United States Patent 12,644,137 (MATERIALS AND METHODS FOR TREATMENT OF HEMOGLOBINOPATHIES) - sequence listing, part 3

SEQ ID NO: 43511 - DNA, 20 bp, Artificial Sequence
  Synthetic oligonucleotide; CAG chr11 5270901 5270920 5270904 -
taaatcccaacttccagttt

SEQ ID NO: 43512 - DNA, 20 bp, Artificial Sequence
  Synthetic oligonucleotide; AAG chr11 5270891 5270910 5270894 -
cttccagtttcagctctacc

SEQ ID NO: 43513 - DNA, 20 bp, Artificial Sequence
  Synthetic oligonucleotide; AAG chr11 5270886 5270905 5270889 -
agtttcagctctaccaagta

SEQ ID NO: 43514 - DNA, 20 bp, Artificial Sequence
  Synthetic oligonucleotide; GAG chr11 5270884 5270903 5270887 -
tttcagctctaccaagtaaa

SEQ ID NO: 43515 - DNA, 20 bp, Artificial Sequence
  Synthetic oligonucleotide; TAG chr11 5270880 5270899 5270883 -
agctctaccaagtaaagagc

SEQ ID NO: 43516 - DNA, 20 bp, Artificial Sequence
  Synthetic oligonucleotide; AAG chr11 5270876 5270895 5270879 -
ctaccaagtaaagagctagc

SEQ ID NO: 43517 - DNA, 20 bp, Artificial Sequence
  Synthetic oligonucleotide; TGG chr11 5270864 5270883 5270867 -
gagctagcaagtcatcaaaa

SEQ ID NO: 43518 - DNA, 20 bp, Artificial Sequence
  Synthetic oligonucleotide; GGG chr11 5270863 5270882 5270866 -
agctagcaagtcatcaaaat

SEQ ID NO: 43519 - DNA, 20 bp, Artificial Sequence
  Synthetic oligonucleotide; GGG chr11 5270862 5270881 5270865 -
gctagcaagtcatcaaaatg

SEQ ID NO: 43520 - DNA, 20 bp, Artificial Sequence
  Synthetic oligonucleotide; CAG chr11 5270854 5270873 5270857 -
gtcatcaaaatggggacata

SEQ ID NO: 43521 - DNA, 20 bp, Artificial Sequence
  Synthetic oligonucleotide; AAG chr11 5270843 5270862 5270846 -
ggggacatacagaaaaaaaa

SEQ ID NO: 43522 - DNA, 20 bp, Artificial Sequence
  Synthetic oligonucleotide; AGG chr11 5270842 5270861 5270845 -
gggacatacagaaaaaaaaa

SEQ ID NO: 43523 - DNA, 20 bp, Artificial Sequence
  Synthetic oligonucleotide; TAG chr11 5270835 5270854 5270838 -
acagaaaaaaaaaaggacac

SEQ ID NO: 43524 - DNA, 20 bp, Artificial Sequence
  Synthetic oligonucleotide; GAG chr11 5270833 5270852 5270836 -
agaaaaaaaaaaggacacta

SEQ ID NO: 43525 - DNA, 20 bp, Artificial Sequence
  Synthetic oligonucleotide; AGG chr11 5270832 5270851 5270835 -
gaaaaaaaaaaggacactag

SEQ ID NO: 43526 - DNA, 20 bp, Artificial Sequence
  Synthetic oligonucleotide; TAG chr11 5270810 5270829 5270813 -
gaataatataccctgactcc

SEQ ID NO: 43527 - DNA, 20 bp, Artificial Sequence
  Synthetic oligonucleotide; TGG chr11 5270759 5270778 5270762 -
ctctgtttgatgacaaattc

SEQ ID NO: 43528 - DNA, 20 bp, Artificial Sequence
  Synthetic oligonucleotide; TAG chr11 5270743 5270762 5270746 -
attctggctttaaataattt

SEQ ID NO: 43529 - DNA, 20 bp, Artificial Sequence
  Synthetic oligonucleotide; AGG chr11 5270742 5270761 5270745 -
ttctggctttaaataatttt

SEQ ID NO: 43530 - DNA, 20 bp, Artificial Sequence
  Synthetic oligonucleotide; TAG chr11 5270735 5270754 5270738 -
tttaaataattttaggattt

SEQ ID NO: 43531 - DNA, 20 bp, Artificial Sequence
  Synthetic oligonucleotide; AGG chr11 5270734 5270753 5270737 -
ttaaataattttaggatttt

SEQ ID NO: 43532 - DNA, 20 bp, Artificial Sequence
  Synthetic oligonucleotide; CAG chr11 5270726 5270745 5270729 -
ttttaggattttaggcttct

SEQ ID NO: 43533 - DNA, 20 bp, Artificial Sequence
  Synthetic oligonucleotide; CAG chr11 5270714 5270733 5270717 -
aggcttctcagctcccttcc

SEQ ID NO: 43534 - DNA, 20 bp, Artificial Sequence
  Synthetic oligonucleotide; GAG chr11 5270710 5270729 5270713 -
ttctcagctcccttcccagt

SEQ ID NO: 43535 - DNA, 20 bp, Artificial Sequence
  Synthetic oligonucleotide; AAG chr11 5270707 5270726 5270710 -
tcagctcccttcccagtgag

SEQ ID NO: 43536 - DNA, 20 bp, Artificial Sequence
  Synthetic oligonucleotide; AAG chr11 5270701 5270720 5270704 -
cccttcccagtgagaagtat

SEQ ID NO: 43537 - DNA, 20 bp, Artificial Sequence
  Synthetic oligonucleotide; CAG chr11 5270698 5270717 5270701 -
ttcccagtgagaagtataag

SEQ ID NO: 43538 - DNA, 20 bp, Artificial Sequence
  Synthetic oligonucleotide; AGG chr11 5270697 5270716 5270700 -
tcccagtgagaagtataagc

SEQ ID NO: 43539 - DNA, 20 bp, Artificial Sequence
  Synthetic oligonucleotide; CAG chr11 5270693 5270712 5270696 -
agtgagaagtataagcagga

SEQ ID NO: 43540 - DNA, 20 bp, Artificial Sequence
  Synthetic oligonucleotide; CAG chr11 5270689 5270708 5270692 -
agaagtataagcaggacaga

SEQ ID NO: 43541 - DNA, 20 bp, Artificial Sequence
  Synthetic oligonucleotide; AGG chr11 5270688 5270707 5270691 -
gaagtataagcaggacagac

SEQ ID NO: 43542 - DNA, 20 bp, Artificial Sequence
  Synthetic oligonucleotide; AAG chr11 5270684 5270703 5270687 -
tataagcaggacagacaggc

SEQ ID NO: 43543 - DNA, 20 bp, Artificial Sequence
  Synthetic oligonucleotide; AAG chr11 5270680 5270699 5270683 -
agcaggacagacaggcaagc

SEQ ID NO: 43544 - DNA, 20 bp, Artificial Sequence
  Synthetic oligonucleotide; AAG chr11 5270677 5270696 5270680 -
aggacagacaggcaagcaag

SEQ ID NO: 43545 - DNA, 20 bp, Artificial Sequence
  Synthetic oligonucleotide; GAG chr11 5270675 5270694 5270678 -
gacagacaggcaagcaagaa

SEQ ID NO: 43546 - DNA, 20 bp, Artificial Sequence
  Synthetic oligonucleotide; GAG chr11 5270673 5270692 5270676 -
cagacaggcaagcaagaaga

SEQ ID NO: 43547 - DNA, 20 bp, Artificial Sequence
  Synthetic oligonucleotide; CAG chr11 5270667 5270686 5270670 -
ggcaagcaagaagagagccc

SEQ ID NO: 43548 - DNA, 20 bp, Artificial Sequence
  Synthetic oligonucleotide; AGG chr11 5270666 5270685 5270669 -
gcaagcaagaagagagcccc

SEQ ID NO: 43549 - DNA, 20 bp, Artificial Sequence
  Synthetic oligonucleotide; AAG chr11 5270652 5270671 5270655 -
agccccaggcaatactcaca

SEQ ID NO: 43550 - DNA, 20 bp, Artificial Sequence
  Synthetic oligonucleotide; TAG chr11 5270649 5270668 5270652 -
cccaggcaatactcacaaag

SEQ ID NO: 43551 - DNA, 20 bp, Artificial Sequence
  Synthetic oligonucleotide; TGG chr11 5270633 5270652 5270636 -
aaagtagccaatgtcccctg

SEQ ID NO: 43552 - DNA, 20 bp, Artificial Sequence
  Synthetic oligonucleotide; TAG chr11 5270627 5270646 5270630 -
gccaatgtcccctgtggtca

SEQ ID NO: 43553 - DNA, 20 bp, Artificial Sequence
  Synthetic oligonucleotide; GAG chr11 5270625 5270644 5270628 -
caatgtcccctgtggtcata

SEQ ID NO: 43554 - DNA, 20 bp, Artificial Sequence
  Synthetic oligonucleotide; AAG chr11 5270615 5270634 5270618 -
tgtggtcatagagaaatgaa

SEQ ID NO: 43555 - DNA, 20 bp, Artificial Sequence
  Synthetic oligonucleotide; GAG chr11 5270613 5270632 5270616 -
tggtcatagagaaatgaaaa

SEQ ID NO: 43556 - DNA, 20 bp, Artificial Sequence
  Synthetic oligonucleotide; GAG chr11 5270611 5270630 5270614 -
gtcatagagaaatgaaaaga

SEQ ID NO: 43557 - DNA, 20 bp, Artificial Sequence
  Synthetic oligonucleotide; GAG chr11 5270609 5270628 5270612 -
catagagaaatgaaaagaga

SEQ ID NO: 43558 - DNA, 20 bp, Artificial Sequence
  Synthetic oligonucleotide; AGG chr11 5270608 5270627 5270611 -
atagagaaatgaaaagagag

SEQ ID NO: 43559 - DNA, 20 bp, Artificial Sequence
  Synthetic oligonucleotide; TGG chr11 5270599 5270618 5270602 -
tgaaaagagagaggattctc

SEQ ID NO: 43560 - DNA, 20 bp, Artificial Sequence
  Synthetic oligonucleotide; AAG chr11 5270596 5270615 5270599 -
aaagagagaggattctctgg

SEQ ID NO: 43561 - DNA, 20 bp, Artificial Sequence
  Synthetic oligonucleotide; TGG chr11 5270590 5270609 5270593 -
agaggattctctggaagcac

SEQ ID NO: 43562 - DNA, 20 bp, Artificial Sequence
  Synthetic oligonucleotide; TAG chr11 5270561 5270580 5270564 -
tcttttctgtctgtcctctc

SEQ ID NO: 43563 - DNA, 20 bp, Artificial Sequence
  Synthetic oligonucleotide; AGG chr11 5270560 5270579 5270563 -
cttttctgtctgtcctctct

SEQ ID NO: 43564 - DNA, 20 bp, Artificial Sequence
  Synthetic oligonucleotide; GGG chr11 5270559 5270578 5270562 -
ttttctgtctgtcctctcta

SEQ ID NO: 43565 - DNA, 20 bp, Artificial Sequence
  Synthetic oligonucleotide; AAG chr11 5270547 5270566 5270550 -
cctctctagggaatcacccc

SEQ ID NO: 43566 - DNA, 20 bp, Artificial Sequence
  Synthetic oligonucleotide; AGG chr11 5270546 5270565 5270549 -
ctctctagggaatcacccca

SEQ ID NO: 43567 - DNA, 20 bp, Artificial Sequence
  Synthetic oligonucleotide; TGG chr11 5270533 5270552 5270536 -
caccccaaggtactgtactt

SEQ ID NO: 43568 - DNA, 20 bp, Artificial Sequence
  Synthetic oligonucleotide; GGG chr11 5270532 5270551 5270535 -
accccaaggtactgtacttt

SEQ ID NO: 43569 - DNA, 20 bp, Artificial Sequence
  Synthetic oligonucleotide; AAG chr11 5270526 5270545 5270529 -
aggtactgtactttgggatt

SEQ ID NO: 43570 - DNA, 20 bp, Artificial Sequence
  Synthetic oligonucleotide; AGG chr11 5270525 5270544 5270528 -
ggtactgtactttgggatta

SEQ ID NO: 43571 - DNA, 20 bp, Artificial Sequence
  Synthetic oligonucleotide; TAG chr11 5270519 5270538 5270522 -
gtactttgggattaaggctt

SEQ ID NO: 43572 - DNA, 20 bp, Artificial Sequence
  Synthetic oligonucleotide; TGG chr11 5270508 5270527 5270511 -
ttaaggctttagtcccactg

SEQ ID NO: 43573 - DNA, 20 bp, Artificial Sequence
  Synthetic oligonucleotide; CAG chr11 5270487 5270506 5270490 -
ggactacttgctattctgtt

SEQ ID NO: 43574 - DNA, 20 bp, Artificial Sequence
  Synthetic oligonucleotide; TAG chr11 5270480 5270499 5270483 -
ttgctattctgttcagtttc

SEQ ID NO: 43575 - DNA, 20 bp, Artificial Sequence
  Synthetic oligonucleotide; AAG chr11 5270477 5270496 5270480 -
ctattctgttcagtttctag

SEQ ID NO: 43576 - DNA, 20 bp, Artificial Sequence
  Synthetic oligonucleotide; AGG chr11 5270476 5270495 5270479 -
tattctgttcagtttctaga

SEQ ID NO: 43577 - DNA, 20 bp, Artificial Sequence
  Synthetic oligonucleotide; CGG chr11 5270464 5270483 5270467 -
tttctagaaggaactatgta

SEQ ID NO: 43578 - DNA, 20 bp, Artificial Sequence
  Synthetic oligonucleotide; TAG chr11 5270449 5270468 5270452 -
atgtacggtttttgtctccc

SEQ ID NO: 43579 - DNA, 20 bp, Artificial Sequence
  Synthetic oligonucleotide; GAG chr11 5270447 5270466 5270450 -
gtacggtttttgtctcccta

SEQ ID NO: 43580 - DNA, 20 bp, Artificial Sequence
  Synthetic oligonucleotide; AAG chr11 5270439 5270458 5270442 -
tttgtctccctagagaaact

SEQ ID NO: 43581 - DNA, 20 bp, Artificial Sequence
  Synthetic oligonucleotide; AGG chr11 5270438 5270457 5270441 -
ttgtctccctagagaaacta

SEQ ID NO: 43582 - DNA, 20 bp, Artificial Sequence
  Synthetic oligonucleotide; CAG chr11 5270433 5270452 5270436 -
tccctagagaaactaaggta

SEQ ID NO: 43583 - DNA, 20 bp, Artificial Sequence
  Synthetic oligonucleotide; AAG chr11 5270430 5270449 5270433 -
ctagagaaactaaggtacag

SEQ ID NO: 43584 - DNA, 20 bp, Artificial Sequence
  Synthetic oligonucleotide; AAG chr11 5270405 5270424 5270408 -
ttgtttacaatgcactcctt

SEQ ID NO: 43585 - DNA, 20 bp, Artificial Sequence
  Synthetic oligonucleotide; GAG chr11 5270403 5270422 5270406 -
gtttacaatgcactccttaa

SEQ ID NO: 43586 - DNA, 20 bp, Artificial Sequence
  Synthetic oligonucleotide; GAG chr11 5270401 5270420 5270404 -
ttacaatgcactccttaaga

SEQ ID NO: 43587 - DNA, 20 bp, Artificial Sequence
  Synthetic oligonucleotide; TAG chr11 5270397 5270416 5270400 -
aatgcactccttaagagagc

SEQ ID NO: 43588 - DNA, 20 bp, Artificial Sequence
  Synthetic oligonucleotide; TGG chr11 5270391 5270410 5270394 -
ctccttaagagagctagaac

SEQ ID NO: 43589 - DNA, 20 bp, Artificial Sequence
  Synthetic oligonucleotide; GGG chr11 5270390 5270409 5270393 -
tccttaagagagctagaact

SEQ ID NO: 43590 - DNA, 20 bp, Artificial Sequence
  Synthetic oligonucleotide; GAG chr11 5270386 5270405 5270389 -
taagagagctagaactgggt

SEQ ID NO: 43591 - DNA, 20 bp, Artificial Sequence
  Synthetic oligonucleotide; CAG chr11 5270371 5270390 5270374 -
tgggtgagattctgttttaa

SEQ ID NO: 43592 - DNA, 20 bp, Artificial Sequence
  Synthetic oligonucleotide; TGG chr11 5270351 5270370 5270354 -
cagctttattttcttttcct

SEQ ID NO: 43593 - DNA, 20 bp, Artificial Sequence
  Synthetic oligonucleotide; AAG chr11 5270320 5270339 5270323 -
ttgtcactgtcaccaccttt

SEQ ID NO: 43594 - DNA, 20 bp, Artificial Sequence
  Synthetic oligonucleotide; AGG chr11 5270319 5270338 5270322 -
tgtcactgtcaccaccttta

SEQ ID NO: 43595 - DNA, 20 bp, Artificial Sequence
  Synthetic oligonucleotide; TGG chr11 5270298 5270317 5270301 -
ggcaaatgttaaatgcgctt

SEQ ID NO: 43596 - DNA, 20 bp, Artificial Sequence
  Synthetic oligonucleotide; GAG chr11 5270273 5270292 5270276 -
gaaactttttttcctatttt

SEQ ID NO: 43597 - DNA, 20 bp, Artificial Sequence
  Synthetic oligonucleotide; GAG chr11 5270254 5270273 5270257 -
tgagatttgctcctttatat

SEQ ID NO: 43598 - DNA, 20 bp, Artificial Sequence
  Synthetic oligonucleotide; AGG chr11 5270253 5270272 5270256 -
gagatttgctcctttatatg

SEQ ID NO: 43599 - DNA, 20 bp, Artificial Sequence
  Synthetic oligonucleotide; TGG chr11 5270244 5270263 5270247 -
tcctttatatgaggctttct

SEQ ID NO: 43600 - DNA, 20 bp, Artificial Sequence
  Synthetic oligonucleotide; AAG chr11 5270239 5270258 5270242 -
tatatgaggctttcttggaa

SEQ ID NO: 43601 - DNA, 20 bp, Artificial Sequence
  Synthetic oligonucleotide; AGG chr11 5270238 5270257 5270241 -
atatgaggctttcttggaaa

SEQ ID NO: 43602 - DNA, 20 bp, Artificial Sequence
  Synthetic oligonucleotide; GAG chr11 5270236 5270255 5270239 -
atgaggctttcttggaaaag

SEQ ID NO: 43603 - DNA, 20 bp, Artificial Sequence
  Synthetic oligonucleotide; TGG chr11 5270231 5270250 5270234 -
gctttcttggaaaaggagaa

SEQ ID NO: 43604 - DNA, 20 bp, Artificial Sequence
  Synthetic oligonucleotide; GGG chr11 5270230 5270249 5270233 -
ctttcttggaaaaggagaat

SEQ ID NO: 43605 - DNA, 20 bp, Artificial Sequence
  Synthetic oligonucleotide; GAG chr11 5270228 5270247 5270231 -
ttcttggaaaaggagaatgg

SEQ ID NO: 43606 - DNA, 20 bp, Artificial Sequence
  Synthetic oligonucleotide; GAG chr11 5270226 5270245 5270229 -
cttggaaaaggagaatggga

SEQ ID NO: 43607 - DNA, 20 bp, Artificial Sequence
  Synthetic oligonucleotide; TGG chr11 5270222 5270241 5270225 -
gaaaaggagaatgggagaga

SEQ ID NO: 43608 - DNA, 20 bp, Artificial Sequence
  Synthetic oligonucleotide; TGG chr11 5270210 5270229 5270213 -
gggagagatggatatcattt

SEQ ID NO: 43609 - DNA, 20 bp, Artificial Sequence
  Synthetic oligonucleotide; AAG chr11 5270207 5270226 5270210 -
agagatggatatcattttgg

SEQ ID NO: 43610 - DNA, 20 bp, Artificial Sequence
  Synthetic oligonucleotide; AAG chr11 5270198 5270217 5270201 -
tatcattttggaagatgatg

SEQ ID NO: 43611 - DNA, 20 bp, Artificial Sequence
  Synthetic oligonucleotide; GAG chr11 5270196 5270215 5270199 -
tcattttggaagatgatgaa

SEQ ID NO: 43612 - DNA, 20 bp, Artificial Sequence
  Synthetic oligonucleotide; AGG chr11 5270195 5270214 5270198 -
cattttggaagatgatgaag

SEQ ID NO: 43613 - DNA, 20 bp, Artificial Sequence
  Synthetic oligonucleotide; GGG chr11 5270194 5270213 5270197 -
attttggaagatgatgaaga

SEQ ID NO: 43614 - DNA, 20 bp, Artificial Sequence
  Synthetic oligonucleotide; AAG chr11 5270186 5270205 5270189 -
agatgatgaagagggtaaaa

SEQ ID NO: 43615 - DNA, 20 bp, Artificial Sequence
  Synthetic oligonucleotide; AGG chr11 5270185 5270204 5270188 -
gatgatgaagagggtaaaaa

SEQ ID NO: 43616 - DNA, 20 bp, Artificial Sequence
  Synthetic oligonucleotide; GGG chr11 5270184 5270203 5270187 -
atgatgaagagggtaaaaaa

SEQ ID NO: 43617 - DNA, 20 bp, Artificial Sequence
  Synthetic oligonucleotide; GGG chr11 5270183 5270202 5270186 -
tgatgaagagggtaaaaaag

SEQ ID NO: 43618 - DNA, 20 bp, Artificial Sequence
  Synthetic oligonucleotide; TGG chr11 5270175 5270194 5270178 -
agggtaaaaaaggggacaaa

SEQ ID NO: 43619 - DNA, 20 bp, Artificial Sequence
  Synthetic oligonucleotide; CAG chr11 5270160 5270179 5270163 -
acaaatggaaatttgtgttg

SEQ ID NO: 43620 - DNA, 20 bp, Artificial Sequence
  Synthetic oligonucleotide; TAG chr11 5270156 5270175 5270159 -
atggaaatttgtgttgcaga

SEQ ID NO: 43621 - DNA, 20 bp, Artificial Sequence
  Synthetic oligonucleotide; GAG chr11 5270151 5270170 5270154 -
aatttgtgttgcagatagat

SEQ ID NO: 43622 - DNA, 20 bp, Artificial Sequence
  Synthetic oligonucleotide; AGG chr11 5270150 5270169 5270153 -
atttgtgttgcagatagatg

SEQ ID NO: 43623 - DNA, 20 bp, Artificial Sequence
  Synthetic oligonucleotide; GAG chr11 5270148 5270167 5270151 -
ttgtgttgcagatagatgag

SEQ ID NO: 43624 - DNA, 20 bp, Artificial Sequence
  Synthetic oligonucleotide; AAG chr11 5270136 5270155 5270139 -
tagatgaggagccaacaaaa

SEQ ID NO: 43625 - DNA, 20 bp, Artificial Sequence
  Synthetic oligonucleotide; GAG chr11 5270134 5270153 5270137 -
gatgaggagccaacaaaaaa

SEQ ID NO: 43626 - DNA, 20 bp, Artificial Sequence
  Synthetic oligonucleotide; CAG chr11 5270128 5270147 5270131 -
gagccaacaaaaaagagcct

SEQ ID NO: 43627 - DNA, 20 bp, Artificial Sequence
  Synthetic oligonucleotide; AGG chr11 5270127 5270146 5270130 -
agccaacaaaaaagagcctc

SEQ ID NO: 43628 - DNA, 20 bp, Artificial Sequence
  Synthetic oligonucleotide; CAG chr11 5270121 5270140 5270124 -
caaaaaagagcctcaggatc

SEQ ID NO: 43629 - DNA, 20 bp, Artificial Sequence
  Synthetic oligonucleotide; TAG chr11 5270100 5270119 5270103 -
agcacacattatcacaaact

SEQ ID NO: 43630 - DNA, 20 bp, Artificial Sequence
  Synthetic oligonucleotide; CGG chr11 5270070 5270089 5270073 -
ccatcactgctgaccctctc

SEQ ID NO: 43631 - DNA, 20 bp, Artificial Sequence
  Synthetic oligonucleotide; GAG chr11 5270051 5270070 5270054 -
ccggacctgactccacccct

SEQ ID NO: 43632 - DNA, 20 bp, Artificial Sequence
  Synthetic oligonucleotide; AGG chr11 5270050 5270069 5270053 -
cggacctgactccacccctg

SEQ ID NO: 43633 - DNA, 20 bp, Artificial Sequence
  Synthetic oligonucleotide; GGG chr11 5270049 5270068 5270052 -
ggacctgactccacccctga

SEQ ID NO: 43634 - DNA, 20 bp, Artificial Sequence
  Synthetic oligonucleotide; CAG chr11 5270043 5270062 5270046 -
gactccacccctgagggaca

SEQ ID NO: 43635 - DNA, 20 bp, Artificial Sequence
  Synthetic oligonucleotide; AGG chr11 5270042 5270061 5270045 -
actccacccctgagggacac

SEQ ID NO: 43636 - DNA, 20 bp, Artificial Sequence
  Synthetic oligonucleotide; CAG chr11 5270038 5270057 5270041 -
cacccctgagggacacaggt

SEQ ID NO: 43637 - DNA, 20 bp, Artificial Sequence
  Synthetic oligonucleotide; AAG chr11 5270017 5270036 5270020 -
agccttgaccaatgactttt

SEQ ID NO: 43638 - DNA, 20 bp, Artificial Sequence
  Synthetic oligonucleotide; TGG chr11 5270009 5270028 5270012 -
ccaatgacttttaagtacca

SEQ ID NO: 43639 - DNA, 20 bp, Artificial Sequence
  Synthetic oligonucleotide; GAG chr11 5270007 5270026 5270010 -
aatgacttttaagtaccatg

SEQ ID NO: 43640 - DNA, 20 bp, Artificial Sequence
  Synthetic oligonucleotide; CAG chr11 5270002 5270021 5270005 -
cttttaagtaccatggagaa

SEQ ID NO: 43641 - DNA, 20 bp, Artificial Sequence
  Synthetic oligonucleotide; AGG chr11 5270001 5270020 5270004 -
ttttaagtaccatggagaac

SEQ ID NO: 43642 - DNA, 20 bp, Artificial Sequence
  Synthetic oligonucleotide; GGG chr11 5270000 5270019 5270003 -
tttaagtaccatggagaaca

SEQ ID NO: 43643 - DNA, 20 bp, Artificial Sequence
  Synthetic oligonucleotide; GGG chr11 5269999 5270018 5270002 -
ttaagtaccatggagaacag

SEQ ID NO: 43644 - DNA, 20 bp, Artificial Sequence
  Synthetic oligonucleotide; GGG chr11 5269998 5270017 5270001 -
taagtaccatggagaacagg

SEQ ID NO: 43645 - DNA, 20 bp, Artificial Sequence
  Synthetic oligonucleotide; CAG chr11 5269994 5270013 5269997 -
taccatggagaacagggggc

SEQ ID NO: 43646 - DNA, 20 bp, Artificial Sequence
  Synthetic oligonucleotide; CGG chr11 5269986 5270005 5269989 -
agaacagggggccagaactt

SEQ ID NO: 43647 - DNA, 20 bp, Artificial Sequence
  Synthetic oligonucleotide; CAG chr11 5269983 5270002 5269986 -
acagggggccagaacttcgg

SEQ ID NO: 43648 - DNA, 20 bp, Artificial Sequence
  Synthetic oligonucleotide; AAG chr11 5269978 5269997 5269981 -
gggccagaacttcggcagta

SEQ ID NO: 43649 - DNA, 20 bp, Artificial Sequence
  Synthetic oligonucleotide; AAG chr11 5269970 5269989 5269973 -
acttcggcagtaaagaataa

SEQ ID NO: 43650 - DNA, 20 bp, Artificial Sequence
  Synthetic oligonucleotide; AGG chr11 5269969 5269988 5269972 -
cttcggcagtaaagaataaa

SEQ ID NO: 43651 - DNA, 20 bp, Artificial Sequence
  Synthetic oligonucleotide; CAG chr11 5269965 5269984 5269968 -
ggcagtaaagaataaaaggc

SEQ ID NO: 43652 - DNA, 20 bp, Artificial Sequence
  Synthetic oligonucleotide; CAG chr11 5269961 5269980 5269964 -
gtaaagaataaaaggccaga

SEQ ID NO: 43653 - DNA, 20 bp, Artificial Sequence
  Synthetic oligonucleotide; GAG chr11 5269959 5269978 5269962 -
aaagaataaaaggccagaca

SEQ ID NO: 43654 - DNA, 20 bp, Artificial Sequence
  Synthetic oligonucleotide; GAG chr11 5269957 5269976 5269960 -
agaataaaaggccagacaga

SEQ ID NO: 43655 - DNA, 20 bp, Artificial Sequence
  Synthetic oligonucleotide; AGG chr11 5269956 5269975 5269959 -
gaataaaaggccagacagag

SEQ ID NO: 43656 - DNA, 20 bp, Artificial Sequence
  Synthetic oligonucleotide; CAG chr11 5269953 5269972 5269956 -
taaaaggccagacagagagg

SEQ ID NO: 43657 - DNA, 20 bp, Artificial Sequence
  Synthetic oligonucleotide; CAG chr11 5269950 5269969 5269953 -
aaggccagacagagaggcag

SEQ ID NO: 43658 - DNA, 20 bp, Artificial Sequence
  Synthetic oligonucleotide; CAG chr11 5269928 5269947 5269931 -
gcacatatctgcttccgaca

SEQ ID NO: 43659 - DNA, 20 bp, Artificial Sequence
  Synthetic oligonucleotide; TAG chr11 5269915 5269934 5269918 -
tccgacacagctgcaatcac

SEQ ID NO: 43660 - DNA, 20 bp, Artificial Sequence
  Synthetic oligonucleotide; AAG chr11 5269911 5269930 5269914 -
acacagctgcaatcactagc

SEQ ID NO: 43661 - DNA, 20 bp, Artificial Sequence
  Synthetic oligonucleotide; CAG chr11 5269904 5269923 5269907 -
tgcaatcactagcaagctct

SEQ ID NO: 43662 - DNA, 20 bp, Artificial Sequence
  Synthetic oligonucleotide; AGG chr11 5269903 5269922 5269906 -
gcaatcactagcaagctctc

SEQ ID NO: 43663 - DNA, 20 bp, Artificial Sequence
  Synthetic oligonucleotide; TGG chr11 5269898 5269917 5269901 -
cactagcaagctctcaggcc

SEQ ID NO: 43664 - DNA, 20 bp, Artificial Sequence
  Synthetic oligonucleotide; TGG chr11 5269890 5269909 5269893 -
agctctcaggcctggcatca

SEQ ID NO: 43665 - DNA, 20 bp, Artificial Sequence
  Synthetic oligonucleotide; GAG chr11 5269873 5269892 5269876 -
tcatggtgcattttactgct

SEQ ID NO: 43666 - DNA, 20 bp, Artificial Sequence
  Synthetic oligonucleotide; AGG chr11 5269872 5269891 5269875 -
catggtgcattttactgctg

SEQ ID NO: 43667 - DNA, 20 bp, Artificial Sequence
  Synthetic oligonucleotide; GAG chr11 5269870 5269889 5269873 -
tggtgcattttactgctgag

SEQ ID NO: 43668 - DNA, 20 bp, Artificial Sequence
  Synthetic oligonucleotide; AAG chr11 5269867 5269886 5269870 -
tgcattttactgctgaggag

SEQ ID NO: 43669 - DNA, 20 bp, Artificial Sequence
  Synthetic oligonucleotide; AGG chr11 5269866 5269885 5269869 -
gcattttactgctgaggaga

SEQ ID NO: 43670 - DNA, 20 bp, Artificial Sequence
  Synthetic oligonucleotide; TAG chr11 5269853 5269872 5269856 -
gaggagaaggctgccgtcac

SEQ ID NO: 43671 - DNA, 20 bp, Artificial Sequence
  Synthetic oligonucleotide; TGG chr11 5269846 5269865 5269849 -
aggctgccgtcactagcctg

SEQ ID NO: 43672 - DNA, 20 bp, Artificial Sequence
  Synthetic oligonucleotide; GAG chr11 5269844 5269863 5269847 -
gctgccgtcactagcctgtg

SEQ ID NO: 43673 - DNA, 20 bp, Artificial Sequence
  Synthetic oligonucleotide; AAG chr11 5269840 5269859 5269843 -
ccgtcactagcctgtggagc

SEQ ID NO: 43674 - DNA, 20 bp, Artificial Sequence
  Synthetic oligonucleotide; TGG chr11 5269830 5269849 5269833 -
cctgtggagcaagatgaatg

SEQ ID NO: 43675 - DNA, 20 bp, Artificial Sequence
  Synthetic oligonucleotide; AAG chr11 5269827 5269846 5269830 -
gtggagcaagatgaatgtgg

SEQ ID NO: 43676 - DNA, 20 bp, Artificial Sequence
  Synthetic oligonucleotide; GAG chr11 5269825 5269844 5269828 -
ggagcaagatgaatgtggaa

SEQ ID NO: 43677 - DNA, 20 bp, Artificial Sequence
  Synthetic oligonucleotide; AGG chr11 5269824 5269843 5269827 -
gagcaagatgaatgtggaag

SEQ ID NO: 43678 - DNA, 20 bp, Artificial Sequence
  Synthetic oligonucleotide; TGG chr11 5269820 5269839 5269823 -
aagatgaatgtggaagaggc

SEQ ID NO: 43679 - DNA, 20 bp, Artificial Sequence
  Synthetic oligonucleotide; GAG chr11 5269818 5269837 5269821 -
gatgaatgtggaagaggctg

SEQ ID NO: 43680 - DNA, 20 bp, Artificial Sequence
  Synthetic oligonucleotide; AGG chr11 5269817 5269836 5269820 -
atgaatgtggaagaggctgg

SEQ ID NO: 43681 - DNA, 20 bp, Artificial Sequence
  Synthetic oligonucleotide; AAG chr11 5269812 5269831 5269815 -
tgtggaagaggctggaggtg

SEQ ID NO: 43682 - DNA, 20 bp, Artificial Sequence
  Synthetic oligonucleotide; TGG chr11 5269806 5269825 5269809 -
agaggctggaggtgaagcct

SEQ ID NO: 43683 - DNA, 20 bp, Artificial Sequence
  Synthetic oligonucleotide; GGG chr11 5269805 5269824 5269808 -
gaggctggaggtgaagcctt

SEQ ID NO: 43684 - DNA, 20 bp, Artificial Sequence
  Synthetic oligonucleotide; CAG chr11 5269802 5269821 5269805 -
gctggaggtgaagccttggg

SEQ ID NO: 43685 - DNA, 20 bp, Artificial Sequence
  Synthetic oligonucleotide; AGG chr11 5269801 5269820 5269804 -
ctggaggtgaagccttgggc

SEQ ID NO: 43686 - DNA, 20 bp, Artificial Sequence
  Synthetic oligonucleotide; AAG chr11 5269797 5269816 5269800 -
aggtgaagccttgggcaggt

SEQ ID NO: 43687 - DNA, 20 bp, Artificial Sequence
  Synthetic oligonucleotide; TGG chr11 5269791 5269810 5269794 -
agccttgggcaggtaagcat

SEQ ID NO: 43688 - DNA, 20 bp, Artificial Sequence
  Synthetic oligonucleotide; TGG chr11 5269777 5269796 5269780 -
aagcattggttctcaatgca

SEQ ID NO: 43689 - DNA, 20 bp, Artificial Sequence
  Synthetic oligonucleotide; GGG chr11 5269776 5269795 5269779 -
agcattggttctcaatgcat

SEQ ID NO: 43690 - DNA, 20 bp, Artificial Sequence
  Synthetic oligonucleotide; AAG chr11 5269769 5269788 5269772 -
gttctcaatgcatgggaatg

SEQ ID NO: 43691 - DNA, 20 bp, Artificial Sequence
  Synthetic oligonucleotide; AGG chr11 5269768 5269787 5269771 -
ttctcaatgcatgggaatga

SEQ ID NO: 43692 - DNA, 20 bp, Artificial Sequence
  Synthetic oligonucleotide; GGG chr11 5269767 5269786 5269770 -
tctcaatgcatgggaatgaa

SEQ ID NO: 43693 - DNA, 20 bp, Artificial Sequence
  Synthetic oligonucleotide; TAG chr11 5269752 5269771 5269755 -
atgaagggtgaatattaccc

SEQ ID NO: 43694 - DNA, 20 bp, Artificial Sequence
  Synthetic oligonucleotide; AAG chr11 5269748 5269767 5269751 -
agggtgaatattaccctagc

SEQ ID NO: 43695 - DNA, 20 bp, Artificial Sequence
  Synthetic oligonucleotide; TGG chr11 5269740 5269759 5269743 -
tattaccctagcaagttgat

SEQ ID NO: 43696 - DNA, 20 bp, Artificial Sequence
  Synthetic oligonucleotide; GGG chr11 5269739 5269758 5269742 -
attaccctagcaagttgatt

SEQ ID NO: 43697 - DNA, 20 bp, Artificial Sequence
  Synthetic oligonucleotide; AAG chr11 5269735 5269754 5269738 -
ccctagcaagttgattggga

SEQ ID NO: 43698 - DNA, 20 bp, Artificial Sequence
  Synthetic oligonucleotide; AAG chr11 5269727 5269746 5269730 -
agttgattgggaaagtcctc

SEQ ID NO: 43699 - DNA, 20 bp, Artificial Sequence
  Synthetic oligonucleotide; TGG chr11 5269693 5269712 5269696 -
ctctaattttgtatctgata

SEQ ID NO: 43700 - DNA, 20 bp, Artificial Sequence
  Synthetic oligonucleotide; TAG chr11 5269680 5269699 5269683 -
tctgatatggtgtcatttca

SEQ ID NO: 43701 - DNA, 20 bp, Artificial Sequence
  Synthetic oligonucleotide; TGG chr11 5269658 5269677 5269661 -
gactcctcgttgtttacccc

SEQ ID NO: 43702 - DNA, 20 bp, Artificial Sequence
  Synthetic oligonucleotide; CAG chr11 5269652 5269671 5269655 -
tcgttgtttacccctggacc

SEQ ID NO: 43703 - DNA, 20 bp, Artificial Sequence
  Synthetic oligonucleotide; GAG chr11 5269650 5269669 5269653 -
gttgtttacccctggaccca

SEQ ID NO: 43704 - DNA, 20 bp, Artificial Sequence
  Synthetic oligonucleotide; CAG chr11 5269638 5269657 5269641 -
tggacccagagattttttga

SEQ ID NO: 43705 - DNA, 20 bp, Artificial Sequence
  Synthetic oligonucleotide; TGG chr11 5269632 5269651 5269635 -
cagagattttttgacagctt

SEQ ID NO: 43706 - DNA, 20 bp, Artificial Sequence
  Synthetic oligonucleotide; TGG chr11 5269603 5269622 5269606 -
gtcgtctccctctgccatcc

SEQ ID NO: 43707 - DNA, 20 bp, Artificial Sequence
  Synthetic oligonucleotide; GGG chr11 5269602 5269621 5269605 -
tcgtctccctctgccatcct

SEQ ID NO: 43708 - DNA, 20 bp, Artificial Sequence
  Synthetic oligonucleotide; AAG chr11 5269592 5269611 5269595 -
ctgccatcctgggcaacccc

SEQ ID NO: 43709 - DNA, 20 bp, Artificial Sequence
  Synthetic oligonucleotide; AGG chr11 5269591 5269610 5269594 -
tgccatcctgggcaacccca

SEQ ID NO: 43710 - DNA, 20 bp, Artificial Sequence
  Synthetic oligonucleotide; AAG chr11 5269586 5269605 5269589 -
tcctgggcaaccccaaggtc

SEQ ID NO: 43711 - DNA, 20 bp, Artificial Sequence
  Synthetic oligonucleotide; AGG chr11 5269585 5269604 5269588 -
cctgggcaaccccaaggtca

SEQ ID NO: 43712 - DNA, 20 bp, Artificial Sequence
  Synthetic oligonucleotide; TGG chr11 5269578 5269597 5269581 -
aaccccaaggtcaaggccca

SEQ ID NO: 43713 - DNA, 20 bp, Artificial Sequence
  Synthetic oligonucleotide; AAG chr11 5269574 5269593 5269577 -
ccaaggtcaaggcccatggc

SEQ ID NO: 43714 - DNA, 20 bp, Artificial Sequence
  Synthetic oligonucleotide; AAG chr11 5269571 5269590 5269574 -
aggtcaaggcccatggcaag

SEQ ID NO: 43715 - DNA, 20 bp, Artificial Sequence
  Synthetic oligonucleotide; AGG chr11 5269570 5269589 5269573 -
ggtcaaggcccatggcaaga

SEQ ID NO: 43716 - DNA, 20 bp, Artificial Sequence
  Synthetic oligonucleotide; TGG chr11 5269554 5269573 5269557 -
aagaaggtgctgacttcctt

SEQ ID NO: 43717 - DNA, 20 bp, Artificial Sequence
  Synthetic oligonucleotide; GAG chr11 5269552 5269571 5269555 -
gaaggtgctgacttcctttg

SEQ ID NO: 43718 - DNA, 20 bp, Artificial Sequence
  Synthetic oligonucleotide; TGG chr11 5269534 5269553 5269537 -
tggagatgctattaaaaaca

SEQ ID NO: 43719 - DNA, 20 bp, Artificial Sequence
  Synthetic oligonucleotide; AAG chr11 5269523 5269542 5269526 -
ttaaaaacatggacaacctc

SEQ ID NO: 43720 - DNA, 20 bp, Artificial Sequence
  Synthetic oligonucleotide; AAG chr11 5269508 5269527 5269511 -
acctcaagcccgcctttgct

SEQ ID NO: 43721 - DNA, 20 bp, Artificial Sequence
  Synthetic oligonucleotide; GAG chr11 5269503 5269522 5269506 -
aagcccgcctttgctaagct

SEQ ID NO: 43722 - DNA, 20 bp, Artificial Sequence
  Synthetic oligonucleotide; GAG chr11 5269499 5269518 5269502 -
ccgcctttgctaagctgagt

SEQ ID NO: 43723 - DNA, 20 bp, Artificial Sequence
  Synthetic oligonucleotide; AAG chr11 5269484 5269503 5269487 -
tgagtgagctgcactgtgac

SEQ ID NO: 43724 - DNA, 20 bp, Artificial Sequence
  Synthetic oligonucleotide; TGG chr11 5269474 5269493 5269477 -
gcactgtgacaagctgcatg

SEQ ID NO: 43725 - DNA, 20 bp, Artificial Sequence
  Synthetic oligonucleotide; GAG chr11 5269466 5269485 5269469 -
acaagctgcatgtggatcct

SEQ ID NO: 43726 - DNA, 20 bp, Artificial Sequence
  Synthetic oligonucleotide; AAG chr11 5269457 5269476 5269460 -
atgtggatcctgagaacttc

SEQ ID NO: 43727 - DNA, 20 bp, Artificial Sequence
  Synthetic oligonucleotide; AGG chr11 5269456 5269475 5269459 -
tgtggatcctgagaacttca

SEQ ID NO: 43728 - DNA, 20 bp, Artificial Sequence
  Synthetic oligonucleotide; GAG chr11 5269452 5269471 5269455 -
gatcctgagaacttcaaggt

SEQ ID NO: 43729 - DNA, 20 bp, Artificial Sequence
  Synthetic oligonucleotide; CAG chr11 5269447 5269466 5269450 -
tgagaacttcaaggtgagtt

SEQ ID NO: 43730 - DNA, 20 bp, Artificial Sequence
  Synthetic oligonucleotide; AGG chr11 5269446 5269465 5269449 -
gagaacttcaaggtgagttc

SEQ ID NO: 43731 - DNA, 20 bp, Artificial Sequence
  Synthetic oligonucleotide; TGG chr11 5269440 5269459 5269443 -
ttcaaggtgagttcaggtgc

SEQ ID NO: 43732 - DNA, 20 bp, Artificial Sequence
  Synthetic oligonucleotide; TGG chr11 5269424 5269443 5269427 -
gtgctggtgatgtgattttt

SEQ ID NO: 43733 - DNA, 20 bp, Artificial Sequence
  Synthetic oligonucleotide; AAG chr11 5269399 5269418 5269402 -
ttatattttgacattaattg

SEQ ID NO: 43734 - DNA, 20 bp, Artificial Sequence
  Synthetic oligonucleotide; TGG chr11 5269383 5269402 5269386 -
attgaagctcataatcttat

SEQ ID NO: 43735 - DNA, 20 bp, Artificial Sequence
  Synthetic oligonucleotide; AAG chr11 5269379 5269398 5269382 -
aagctcataatcttattgga

SEQ ID NO: 43736 - DNA, 20 bp, Artificial Sequence
  Synthetic oligonucleotide; AAG chr11 5269369 5269388 5269372 -
tcttattggaaagaccaaca

SEQ ID NO: 43737 - DNA, 20 bp, Artificial Sequence
  Synthetic oligonucleotide; CAG chr11 5269362 5269381 5269365 -
ggaaagaccaacaaagatct

SEQ ID NO: 43738 - DNA, 20 bp, Artificial Sequence
  Synthetic oligonucleotide; TGG chr11 5269353 5269372 5269356 -
aacaaagatctcagaaatca

SEQ ID NO: 43739 - DNA, 20 bp, Artificial Sequence
  Synthetic oligonucleotide; GGG chr11 5269352 5269371 5269355 -
acaaagatctcagaaatcat

SEQ ID NO: 43740 - DNA, 20 bp, Artificial Sequence
  Synthetic oligonucleotide; GAG chr11 5269347 5269366 5269350 -
gatctcagaaatcatgggtc

SEQ ID NO: 43741 - DNA, 20 bp, Artificial Sequence
  Synthetic oligonucleotide; TAG chr11 5269336 5269355 5269339 -
tcatgggtcgagcttgatgt

SEQ ID NO: 43742 - DNA, 20 bp, Artificial Sequence
  Synthetic oligonucleotide; CAG chr11 5269331 5269350 5269334 -
ggtcgagcttgatgttagaa

SEQ ID NO: 43743 - DNA, 20 bp, Artificial Sequence
  Synthetic oligonucleotide; CAG chr11 5269328 5269347 5269331 -
cgagcttgatgttagaacag

SEQ ID NO: 43744 - DNA, 20 bp, Artificial Sequence
  Synthetic oligonucleotide; TAG chr11 5269320 5269339 5269323 -
atgttagaacagcagacttc

SEQ ID NO: 43745 - DNA, 20 bp, Artificial Sequence
  Synthetic oligonucleotide; GAG chr11 5269316 5269335 5269319 -
tagaacagcagacttctagt

SEQ ID NO: 43746 - DNA, 20 bp, Artificial Sequence
  Synthetic oligonucleotide; CAG chr11 5269291 5269310 5269294 -
taaccaaaacttacatgatt

SEQ ID NO: 43747 - DNA, 20 bp, Artificial Sequence
  Synthetic oligonucleotide; TAG chr11 5269285 5269304 5269288 -
aaacttacatgattcagaac

SEQ ID NO: 43748 - DNA, 20 bp, Artificial Sequence
  Synthetic oligonucleotide; CAG chr11 5269279 5269298 5269282 -
acatgattcagaactagtga

SEQ ID NO: 43749 - DNA, 20 bp, Artificial Sequence
  Synthetic oligonucleotide; AAG chr11 5269274 5269293 5269277 -
attcagaactagtgacagta

SEQ ID NO: 43750 - DNA, 20 bp, Artificial Sequence
  Synthetic oligonucleotide; AGG chr11 5269273 5269292 5269276 -
ttcagaactagtgacagtaa

SEQ ID NO: 43751 - DNA, 20 bp, Artificial Sequence
  Synthetic oligonucleotide; CAG chr11 5269262 5269281 5269265 -
tgacagtaaaggactactaa

SEQ ID NO: 43752 - DNA, 20 bp, Artificial Sequence
  Synthetic oligonucleotide; TGG chr11 5269252 5269271 5269255 -
ggactactaacagcctgaat

SEQ ID NO: 43753 - DNA, 20 bp, Artificial Sequence
  Synthetic oligonucleotide; CAG chr11 5269239 5269258 5269242 -
cctgaattggcttaactttt

SEQ ID NO: 43754 - DNA, 20 bp, Artificial Sequence
  Synthetic oligonucleotide; AGG chr11 5269238 5269257 5269241 -
ctgaattggcttaacttttc

SEQ ID NO: 43755 - DNA, 20 bp, Artificial Sequence
  Synthetic oligonucleotide; CAG chr11 5269226 5269245 5269229 -
aacttttcaggaaatcttgc

SEQ ID NO: 43756 - DNA, 20 bp, Artificial Sequence
  Synthetic oligonucleotide; CAG chr11 5269205 5269224 5269208 -
agaacttgatgtgtttatcc

SEQ ID NO: 43757 - DNA, 20 bp, Artificial Sequence
  Synthetic oligonucleotide; GAG chr11 5269203 5269222 5269206 -
aacttgatgtgtttatccca

SEQ ID NO: 43758 - DNA, 20 bp, Artificial Sequence
  Synthetic oligonucleotide; TAG chr11 5269190 5269209 5269193 -
tatcccagagaattgtatta

SEQ ID NO: 43759 - DNA, 20 bp, Artificial Sequence
  Synthetic oligonucleotide; TAG chr11 5269182 5269201 5269185 -
agaattgtattatagaattg

SEQ ID NO: 43760 - DNA, 20 bp, Artificial Sequence
  Synthetic oligonucleotide; AAG chr11 5269171 5269190 5269174 -
atagaattgtagacttgtga

SEQ ID NO: 43761 - DNA, 20 bp, Artificial Sequence
  Synthetic oligonucleotide; AAG chr11 5269168 5269187 5269171 -
gaattgtagacttgtgaaag

SEQ ID NO: 43762 - DNA, 20 bp, Artificial Sequence
  Synthetic oligonucleotide; TGG chr11 5269156 5269175 5269159 -
tgtgaaagaagaatgaaatt

SEQ ID NO: 43763 - DNA, 20 bp, Artificial Sequence
  Synthetic oligonucleotide; TGG chr11 5269149 5269168 5269152 -
gaagaatgaaatttggcttt

SEQ ID NO: 43764 - DNA, 20 bp, Artificial Sequence
  Synthetic oligonucleotide; TAG chr11 5269146 5269165 5269149 -
gaatgaaatttggcttttgg

SEQ ID NO: 43765 - DNA, 20 bp, Artificial Sequence
  Synthetic oligonucleotide; AAG chr11 5269139 5269158 5269142 -
atttggcttttggtagatga

SEQ ID NO: 43766 - DNA, 20 bp, Artificial Sequence
  Synthetic oligonucleotide; AAG chr11 5269128 5269147 5269131 -
ggtagatgaaagtccatttc

SEQ ID NO: 43767 - DNA, 20 bp, Artificial Sequence
  Synthetic oligonucleotide; AGG chr11 5269127 5269146 5269130 -
gtagatgaaagtccatttca

SEQ ID NO: 43768 - DNA, 20 bp, Artificial Sequence
  Synthetic oligonucleotide; TAG chr11 5269121 5269140 5269124 -
gaaagtccatttcaaggaaa

SEQ ID NO: 43769 - DNA, 20 bp, Artificial Sequence
  Synthetic oligonucleotide; TGG chr11 5269101 5269120 5269104 -
tagaaatgccttattttatg

SEQ ID NO: 43770 - DNA, 20 bp, Artificial Sequence
  Synthetic oligonucleotide; GGG chr11 5269100 5269119 5269103 -
agaaatgccttattttatgt

SEQ ID NO: 43771 - DNA, 20 bp, Artificial Sequence
  Synthetic oligonucleotide; GAG chr11 5269086 5269105 5269089 -
ttatgtgggtcatgataatt

SEQ ID NO: 43772 - DNA, 20 bp, Artificial Sequence
  Synthetic oligonucleotide; AGG chr11 5269085 5269104 5269088 -
tatgtgggtcatgataattg

SEQ ID NO: 43773 - DNA, 20 bp, Artificial Sequence
  Synthetic oligonucleotide; TAG chr11 5269080 5269099 5269083 -
gggtcatgataattgaggtt

SEQ ID NO: 43774 - DNA, 20 bp, Artificial Sequence
  Synthetic oligonucleotide; AAG chr11 5269076 5269095 5269079 -
catgataattgaggtttaga

SEQ ID NO: 43775 - DNA, 20 bp, Artificial Sequence
  Synthetic oligonucleotide; GAG chr11 5269074 5269093 5269077 -
tgataattgaggtttagaaa

SEQ ID NO: 43776 - DNA, 20 bp, Artificial Sequence
  Synthetic oligonucleotide; AAG chr11 5269052 5269071 5269055 -
gatttttgcaaaaaaaataa

SEQ ID NO: 43777 - DNA, 20 bp, Artificial Sequence
  Synthetic oligonucleotide; AAG chr11 5269040 5269059 5269043 -
aaaaataaaagatttgctca

SEQ ID NO: 43778 - DNA, 20 bp, Artificial Sequence
  Synthetic oligonucleotide; AAG chr11 5269031 5269050 5269034 -
agatttgctcaaagaaaaat

SEQ ID NO: 43779 - DNA, 20 bp, Artificial Sequence
  Synthetic oligonucleotide; CAG chr11 5268996 5269015 5268999 -
aaatatgttaaatttcccat

SEQ ID NO: 43780 - DNA, 20 bp, Artificial Sequence
  Synthetic oligonucleotide; AAG chr11 5268983 5269002 5268986 -
ttcccatcagtattgtgacc

SEQ ID NO: 43781 - DNA, 20 bp, Artificial Sequence
  Synthetic oligonucleotide; AAG chr11 5268978 5268997 5268981 -
atcagtattgtgaccaagtg

SEQ ID NO: 43782 - DNA, 20 bp, Artificial Sequence
  Synthetic oligonucleotide; AGG chr11 5268977 5268996 5268980 -
tcagtattgtgaccaagtga

SEQ ID NO: 43783 - DNA, 20 bp, Artificial Sequence
  Synthetic oligonucleotide; TGG chr11 5268957 5268976 5268960 -
aggcttgtttccgaatttgt

SEQ ID NO: 43784 - DNA, 20 bp, Artificial Sequence
  Synthetic oligonucleotide; GGG chr11 5268956 5268975 5268959 -
ggcttgtttccgaatttgtt

SEQ ID NO: 43785 - DNA, 20 bp, Artificial Sequence
  Synthetic oligonucleotide; GGG chr11 5268955 5268974 5268958 -
gcttgtttccgaatttgttg

SEQ ID NO: 43786 - DNA, 20 bp, Artificial Sequence
  Synthetic oligonucleotide; GAG chr11 5268936 5268955 5268939 -
ggggattttaaactcccgct

SEQ ID NO: 43787 - DNA, 20 bp, Artificial Sequence
  Synthetic oligonucleotide; CAG chr11 5268925 5268944 5268928 -
actcccgctgagaactcttg

SEQ ID NO: 43788 - DNA, 20 bp, Artificial Sequence
  Synthetic oligonucleotide; TAG chr11 5268896 5268915 5268899 -
cattctacatttacaaaaat

SEQ ID NO: 43789 - DNA, 20 bp, Artificial Sequence
  Synthetic oligonucleotide; AAG chr11 5268882 5268901 5268885 -
aaaaattagacaattgctta

SEQ ID NO: 43790 - DNA, 20 bp, Artificial Sequence
  Synthetic oligonucleotide; CAG chr11 5268874 5268893 5268877 -
gacaattgcttaaagaaaaa

SEQ ID NO: 43791 - DNA, 20 bp, Artificial Sequence
  Synthetic oligonucleotide; AGG chr11 5268873 5268892 5268876 -
acaattgcttaaagaaaaac

SEQ ID NO: 43792 - DNA, 20 bp, Artificial Sequence
  Synthetic oligonucleotide; GGG chr11 5268872 5268891 5268875 -
caattgcttaaagaaaaaca

SEQ ID NO: 43793 - DNA, 20 bp, Artificial Sequence
  Synthetic oligonucleotide; GAG chr11 5268870 5268889 5268873 -
attgcttaaagaaaaacagg

SEQ ID NO: 43794 - DNA, 20 bp, Artificial Sequence
  Synthetic oligonucleotide; GAG chr11 5268868 5268887 5268871 -
tgcttaaagaaaaacaggga

SEQ ID NO: 43795 - DNA, 20 bp, Artificial Sequence
  Synthetic oligonucleotide; GAG chr11 5268866 5268885 5268869 -
cttaaagaaaaacagggaga

SEQ ID NO: 43796 - DNA, 20 bp, Artificial Sequence
  Synthetic oligonucleotide; AGG chr11 5268865 5268884 5268868 -
ttaaagaaaaacagggagag

SEQ ID NO: 43797 - DNA, 20 bp, Artificial Sequence
  Synthetic oligonucleotide; GGG chr11 5268864 5268883 5268867 -
taaagaaaaacagggagaga

SEQ ID NO: 43798 - DNA, 20 bp, Artificial Sequence
  Synthetic oligonucleotide; TGG chr11 5268848 5268867 5268851 -
gagagggaacccaataatac

SEQ ID NO: 43799 - DNA, 20 bp, Artificial Sequence
  Synthetic oligonucleotide; TGG chr11 5268840 5268859 5268843 -
acccaataatactggtaaaa

SEQ ID NO: 43800 - DNA, 20 bp, Artificial Sequence
  Synthetic oligonucleotide; GGG chr11 5268839 5268858 5268842 -
cccaataatactggtaaaat

SEQ ID NO: 43801 - DNA, 20 bp, Artificial Sequence
  Synthetic oligonucleotide; GGG chr11 5268838 5268857 5268841 -
ccaataatactggtaaaatg

SEQ ID NO: 43802 - DNA, 20 bp, Artificial Sequence
  Synthetic oligonucleotide; AAG chr11 5268835 5268854 5268838 -
ataatactggtaaaatgggg

SEQ ID NO: 43803 - DNA, 20 bp, Artificial Sequence
  Synthetic oligonucleotide; AGG chr11 5268834 5268853 5268837 -
taatactggtaaaatgggga

SEQ ID NO: 43804 - DNA, 20 bp, Artificial Sequence
  Synthetic oligonucleotide; GGG chr11 5268833 5268852 5268836 -
aatactggtaaaatggggaa

SEQ ID NO: 43805 - DNA, 20 bp, Artificial Sequence
  Synthetic oligonucleotide; GGG chr11 5268832 5268851 5268835 -
atactggtaaaatggggaag

SEQ ID NO: 43806 - DNA, 20 bp, Artificial Sequence
  Synthetic oligonucleotide; GGG chr11 5268831 5268850 5268834 -
tactggtaaaatggggaagg

SEQ ID NO: 43807 - DNA, 20 bp, Artificial Sequence
  Synthetic oligonucleotide; GAG chr11 5268827 5268846 5268830 -
ggtaaaatggggaagggggt

SEQ ID NO: 43808 - DNA, 20 bp, Artificial Sequence
  Synthetic oligonucleotide; AGG chr11 5268826 5268845 5268829 -
gtaaaatggggaagggggtg

SEQ ID NO: 43809 - DNA, 20 bp, Artificial Sequence
  Synthetic oligonucleotide; GGG chr11 5268825 5268844 5268828 -
taaaatggggaagggggtga

SEQ ID NO: 43810 - DNA, 20 bp, Artificial Sequence
  Synthetic oligonucleotide; TAG chr11 5268820 5268839 5268823 -
tggggaagggggtgagggtg

SEQ ID NO: 43811 - DNA, 20 bp, Artificial Sequence
  Synthetic oligonucleotide; AGG chr11 5268819 5268838 5268822 -
ggggaagggggtgagggtgt

SEQ ID NO: 43812 - DNA, 20 bp, Artificial Sequence
  Synthetic oligonucleotide; TAG chr11 5268816 5268835 5268819 -
gaagggggtgagggtgtagg

SEQ ID NO: 43813 - DNA, 20 bp, Artificial Sequence
  Synthetic oligonucleotide; AGG chr11 5268815 5268834 5268818 -
aagggggtgagggtgtaggt

SEQ ID NO: 43814 - DNA, 20 bp, Artificial Sequence
  Synthetic oligonucleotide; TAG chr11 5268812 5268831 5268815 -
ggggtgagggtgtaggtagg

SEQ ID NO: 43815 - DNA, 20 bp, Artificial Sequence
  Synthetic oligonucleotide; TAG chr11 5268798 5268817 5268801 -
ggtaggtagaatgttgaatg

SEQ ID NO: 43816 - DNA, 20 bp, Artificial Sequence
  Synthetic oligonucleotide; AGG chr11 5268797 5268816 5268800 -
gtaggtagaatgttgaatgt

SEQ ID NO: 43817 - DNA, 20 bp, Artificial Sequence
  Synthetic oligonucleotide; GGG chr11 5268796 5268815 5268799 -
taggtagaatgttgaatgta

SEQ ID NO: 43818 - DNA, 20 bp, Artificial Sequence
  Synthetic oligonucleotide; TAG chr11 5268789 5268808 5268792 -
aatgttgaatgtagggctca

SEQ ID NO: 43819 - DNA, 20 bp, Artificial Sequence
  Synthetic oligonucleotide; AAG chr11 5268771 5268790 5268774 -
catagaataaaattgaacct

SEQ ID NO: 43820 - DNA, 20 bp, Artificial Sequence
  Synthetic oligonucleotide; TGG chr11 5268753 5268772 5268756 -
ctaagctcatctgaattttt

SEQ ID NO: 43821 - DNA, 20 bp, Artificial Sequence
  Synthetic oligonucleotide; GGG chr11 5268752 5268771 5268755 -
taagctcatctgaatttttt

SEQ ID NO: 43822 - DNA, 20 bp, Artificial Sequence
  Synthetic oligonucleotide; TGG chr11 5268749 5268768 5268752 -
gctcatctgaattttttggg

SEQ ID NO: 43823 - DNA, 20 bp, Artificial Sequence
  Synthetic oligonucleotide; GGG chr11 5268748 5268767 5268751 -
ctcatctgaattttttgggt

SEQ ID NO: 43824 - DNA, 20 bp, Artificial Sequence
  Synthetic oligonucleotide; TGG chr11 5268736 5268755 5268739 -
ttttgggtgggcacaaacct

SEQ ID NO: 43825 - DNA, 20 bp, Artificial Sequence
  Synthetic oligonucleotide; CAG chr11 5268731 5268750 5268734 -
ggtgggcacaaaccttggaa

SEQ ID NO: 43826 - DNA, 20 bp, Artificial Sequence
  Synthetic oligonucleotide; GAG chr11 5268725 5268744 5268728 -
cacaaaccttggaacagttt

SEQ ID NO: 43827 - DNA, 20 bp, Artificial Sequence
  Synthetic oligonucleotide; AGG chr11 5268724 5268743 5268727 -
acaaaccttggaacagtttg

SEQ ID NO: 43828 - DNA, 20 bp, Artificial Sequence
  Synthetic oligonucleotide; CAG chr11 5268720 5268739 5268723 -
accttggaacagtttgaggt

SEQ ID NO: 43829 - DNA, 20 bp, Artificial Sequence
  Synthetic oligonucleotide; AGG chr11 5268719 5268738 5268722 -
ccttggaacagtttgaggtc

SEQ ID NO: 43830 - DNA, 20 bp, Artificial Sequence
  Synthetic oligonucleotide; GGG chr11 5268718 5268737 5268721 -
cttggaacagtttgaggtca

SEQ ID NO: 43831 - DNA, 20 bp, Artificial Sequence
  Synthetic oligonucleotide; TAG chr11 5268710 5268729 5268713 -
agtttgaggtcagggttgtc

SEQ ID NO: 43832 - DNA, 20 bp, Artificial Sequence
  Synthetic oligonucleotide; AGG chr11 5268709 5268728 5268712 -
gtttgaggtcagggttgtct

SEQ ID NO: 43833 - DNA, 20 bp, Artificial Sequence
  Synthetic oligonucleotide; TAG chr11 5268702 5268721 5268705 -
gtcagggttgtctaggaatg

SEQ ID NO: 43834 - DNA, 20 bp, Artificial Sequence
  Synthetic oligonucleotide; AGG chr11 5268701 5268720 5268704 -
tcagggttgtctaggaatgt

SEQ ID NO: 43835 - DNA, 20 bp, Artificial Sequence
  Synthetic oligonucleotide; AAG chr11 5268694 5268713 5268697 -
tgtctaggaatgtaggtata

SEQ ID NO: 43836 - DNA, 20 bp, Artificial Sequence
  Synthetic oligonucleotide; AAG chr11 5268660 5268679 5268663 -
tgtttgtttgttttttcatc

SEQ ID NO: 43837 - DNA, 20 bp, Artificial Sequence
  Synthetic oligonucleotide; CGG chr11 5268650 5268669 5268653 -
ttttttcatcaagttgtttt

SEQ ID NO: 43838 - DNA, 20 bp, Artificial Sequence
  Synthetic oligonucleotide; CAG chr11 5268601 5268620 5268604 -
ttattttgtcttttgcctaa

SEQ ID NO: 43839 - DNA, 20 bp, Artificial Sequence
  Synthetic oligonucleotide; TGG chr11 5268594 5268613 5268597 -
gtcttttgcctaacagctcc

SEQ ID NO: 43840 - DNA, 20 bp, Artificial Sequence
  Synthetic oligonucleotide; GGG chr11 5268593 5268612 5268596 -
tcttttgcctaacagctcct

SEQ ID NO: 43841 - DNA, 20 bp, Artificial Sequence
  Synthetic oligonucleotide; TGG chr11 5268582 5268601 5268585 -
acagctcctgggtaacgtga

SEQ ID NO: 43842 - DNA, 20 bp, Artificial Sequence
  Synthetic oligonucleotide; TGG chr11 5268570 5268589 5268573 -
taacgtgatggtgattattc

SEQ ID NO: 43843 - DNA, 20 bp, Artificial Sequence
  Synthetic oligonucleotide; TGG chr11 5268557 5268576 5268560 -
attattctggctactcactt

SEQ ID NO: 43844 - DNA, 20 bp, Artificial Sequence
  Synthetic oligonucleotide; AAG chr11 5268553 5268572 5268556 -
ttctggctactcactttggc

SEQ ID NO: 43845 - DNA, 20 bp, Artificial Sequence
  Synthetic oligonucleotide; AGG chr11 5268552 5268571 5268555 -
tctggctactcactttggca

SEQ ID NO: 43846 - DNA, 20 bp, Artificial Sequence
  Synthetic oligonucleotide; GAG chr11 5268550 5268569 5268553 -
tggctactcactttggcaag

SEQ ID NO: 43847 - DNA, 20 bp, Artificial Sequence
  Synthetic oligonucleotide; AAG chr11 5268537 5268556 5268540 -
tggcaaggagttcacccctg

SEQ ID NO: 43848 - DNA, 20 bp, Artificial Sequence
  Synthetic oligonucleotide; CAG chr11 5268532 5268551 5268535 -
aggagttcacccctgaagtg

SEQ ID NO: 43849 - DNA, 20 bp, Artificial Sequence
  Synthetic oligonucleotide; AGG chr11 5268531 5268550 5268534 -
ggagttcacccctgaagtgc

SEQ ID NO: 43850 - DNA, 20 bp, Artificial Sequence
  Synthetic oligonucleotide; TGG chr11 5268523 5268542 5268526 -
cccctgaagtgcaggctgcc

SEQ ID NO: 43851 - DNA, 20 bp, Artificial Sequence
  Synthetic oligonucleotide; CAG chr11 5268520 5268539 5268523 -
ctgaagtgcaggctgcctgg

SEQ ID NO: 43852 - DNA, 20 bp, Artificial Sequence
  Synthetic oligonucleotide; AAG chr11 5268517 5268536 5268520 -
aagtgcaggctgcctggcag

SEQ ID NO: 43853 - DNA, 20 bp, Artificial Sequence
  Synthetic oligonucleotide; TGG chr11 5268513 5268532 5268516 -
gcaggctgcctggcagaagc

SEQ ID NO: 43854 - DNA, 20 bp, Artificial Sequence
  Synthetic oligonucleotide; TGG chr11 5268489 5268508 5268492 -
gtctgctgtcgccattgccc

SEQ ID NO: 43855 - DNA, 20 bp, Artificial Sequence
  Synthetic oligonucleotide; AAG chr11 5268481 5268500 5268484 -
tcgccattgccctggcccat

SEQ ID NO: 43856 - DNA, 20 bp, Artificial Sequence
  Synthetic oligonucleotide; GAG chr11 5268471 5268490 5268474 -
cctggcccataagtaccact

SEQ ID NO: 43857 - DNA, 20 bp, Artificial Sequence
  Synthetic oligonucleotide; CAG chr11 5268460 5268479 5268463 -
agtaccactgagttctcttc

SEQ ID NO: 43858 - DNA, 20 bp, Artificial Sequence
  Synthetic oligonucleotide; CAG chr11 5268453 5268472 5268456 -
ctgagttctcttccagtttg

SEQ ID NO: 43859 - DNA, 20 bp, Artificial Sequence
  Synthetic oligonucleotide; AGG chr11 5268452 5268471 5268455 -
tgagttctcttccagtttgc

SEQ ID NO: 43860 - DNA, 20 bp, Artificial Sequence
  Synthetic oligonucleotide; TGG chr11 5268415 5268434 5268418 -
tgacaccctccttctgcaca

SEQ ID NO: 43861 - DNA, 20 bp, Artificial Sequence
  Synthetic oligonucleotide; GGG chr11 5268414 5268433 5268417 -
gacaccctccttctgcacat

SEQ ID NO: 43862 - DNA, 20 bp, Artificial Sequence
  Synthetic oligonucleotide; GGG chr11 5268413 5268432 5268416 -
acaccctccttctgcacatg

SEQ ID NO: 43863 - DNA, 20 bp, Artificial Sequence
  Synthetic oligonucleotide; TGG chr11 5268408 5268427 5268411 -
ctccttctgcacatggggac

SEQ ID NO: 43864 - DNA, 20 bp, Artificial Sequence
  Synthetic oligonucleotide; GGG chr11 5268407 5268426 5268410 -
tccttctgcacatggggact

SEQ ID NO: 43865 - DNA, 20 bp, Artificial Sequence
  Synthetic oligonucleotide; TGG chr11 5268402 5268421 5268405 -
ctgcacatggggactgggct

SEQ ID NO: 43866 - DNA, 20 bp, Artificial Sequence
  Synthetic oligonucleotide; GAG chr11 5268395 5268414 5268398 -
tggggactgggcttggcctt

SEQ ID NO: 43867 - DNA, 20 bp, Artificial Sequence
  Synthetic oligonucleotide; GAG chr11 5268393 5268412 5268396 -
gggactgggcttggccttga

SEQ ID NO: 43868 - DNA, 20 bp, Artificial Sequence
  Synthetic oligonucleotide; AAG chr11 5268389 5268408 5268392 -
ctgggcttggccttgagaga

SEQ ID NO: 43869 - DNA, 20 bp, Artificial Sequence
  Synthetic oligonucleotide; AAG chr11 5268372 5268391 5268375 -
agaaagccttctgtttaata

SEQ ID NO: 43870 - DNA, 20 bp, Artificial Sequence
  Synthetic oligonucleotide; CAG chr11 5268358 5268377 5268361 -
ttaataaagtacattttctt

SEQ ID NO: 43871 - DNA, 20 bp, Artificial Sequence
  Synthetic oligonucleotide; AAG chr11 5268306 5268325 5268309 -
atcttttactcttgtgttaa

SEQ ID NO: 43872 - DNA, 20 bp, Artificial Sequence
  Synthetic oligonucleotide; AGG chr11 5268305 5268324 5268308 -
tcttttactcttgtgttaaa

SEQ ID NO: 43873 - DNA, 20 bp, Artificial Sequence
  Synthetic oligonucleotide; AAG chr11 5268299 5268318 5268302 -
actcttgtgttaaaaggaaa

SEQ ID NO: 43874 - DNA, 20 bp, Artificial Sequence
  Synthetic oligonucleotide; TGG chr11 5268290 5268309 5268293 -
ttaaaaggaaaaagtgttca

SEQ ID NO: 43875 - DNA, 20 bp, Artificial Sequence
  Synthetic oligonucleotide; GGG chr11 5268289 5268308 5268292 -
taaaaggaaaaagtgttcat

SEQ ID NO: 43876 - DNA, 20 bp, Artificial Sequence
  Synthetic oligonucleotide; GAG chr11 5268284 5268303 5268287 -
ggaaaaagtgttcatgggct

SEQ ID NO: 43877 - DNA, 20 bp, Artificial Sequence
  Synthetic oligonucleotide; AGG chr11 5268283 5268302 5268286 -
gaaaaagtgttcatgggctg

SEQ ID NO: 43878 - DNA, 20 bp, Artificial Sequence
  Synthetic oligonucleotide; GGG chr11 5268282 5268301 5268285 -
aaaaagtgttcatgggctga

SEQ ID NO: 43879 - DNA, 20 bp, Artificial Sequence
  Synthetic oligonucleotide; TGG chr11 5268278 5268297 5268281 -
agtgttcatgggctgaggga

SEQ ID NO: 43880 - DNA, 20 bp, Artificial Sequence
  Synthetic oligonucleotide; GAG chr11 5268276 5268295 5268279 -
tgttcatgggctgagggatg

SEQ ID NO: 43881 - DNA, 20 bp, Artificial Sequence
  Synthetic oligonucleotide; GAG chr11 5268274 5268293 5268277 -
ttcatgggctgagggatgga

SEQ ID NO: 43882 - DNA, 20 bp, Artificial Sequence
  Synthetic oligonucleotide; TAG chr11 5268266 5268285 5268269 -
ctgagggatggagagaaaca

SEQ ID NO: 43883 - DNA, 20 bp, Artificial Sequence
  Synthetic oligonucleotide; AGG chr11 5268265 5268284 5268268 -
tgagggatggagagaaacat

SEQ ID NO: 43884 - DNA, 20 bp, Artificial Sequence
  Synthetic oligonucleotide; AAG chr11 5268262 5268281 5268265 -
gggatggagagaaacatagg

SEQ ID NO: 43885 - DNA, 20 bp, Artificial Sequence
  Synthetic oligonucleotide; AAG chr11 5268255 5268274 5268258 -
agagaaacataggaagaacc

SEQ ID NO: 43886 - DNA, 20 bp, Artificial Sequence
  Synthetic oligonucleotide; GAG chr11 5268253 5268272 5268256 -
agaaacataggaagaaccaa

SEQ ID NO: 43887 - DNA, 20 bp, Artificial Sequence
  Synthetic oligonucleotide; AAG chr11 5268243 5268262 5268246 -
gaagaaccaagagcttcctt

SEQ ID NO: 43888 - DNA, 20 bp, Artificial Sequence
  Synthetic oligonucleotide; TGG chr11 5268233 5268252 5268236 -
gagcttccttaagaaatgta

SEQ ID NO: 43889 - DNA, 20 bp, Artificial Sequence
  Synthetic oligonucleotide; GGG chr11 5268232 5268251 5268235 -
agcttccttaagaaatgtat

SEQ ID NO: 43890 - DNA, 20 bp, Artificial Sequence
  Synthetic oligonucleotide; GGG chr11 5268231 5268250 5268234 -
gcttccttaagaaatgtatg

SEQ ID NO: 43891 - DNA, 20 bp, Artificial Sequence
  Synthetic oligonucleotide; GGG chr11 5268230 5268249 5268233 -
cttccttaagaaatgtatgg

SEQ ID NO: 43892 - DNA, 20 bp, Artificial Sequence
  Synthetic oligonucleotide; TGG chr11 5268212 5268231 5268215 -
gggggcttgtaaaattaatg

SEQ ID NO: 43893 - DNA, 20 bp, Artificial Sequence
  Synthetic oligonucleotide; TGG chr11 5268203 5268222 5268206 -
taaaattaatgtggatgtta

SEQ ID NO: 43894 - DNA, 20 bp, Artificial Sequence
  Synthetic oligonucleotide; GGG chr11 5268202 5268221 5268205 -
aaaattaatgtggatgttat

SEQ ID NO: 43895 - DNA, 20 bp, Artificial Sequence
  Synthetic oligonucleotide; GAG chr11 5268200 5268219 5268203 -
aattaatgtggatgttatgg

SEQ ID NO: 43896 - DNA, 20 bp, Artificial Sequence
  Synthetic oligonucleotide; CAG chr11 5268192 5268211 5268195 -
tggatgttatgggagaattc

SEQ ID NO: 43897 - DNA, 20 bp, Artificial Sequence
  Synthetic oligonucleotide; AGG chr11 5268191 5268210 5268194 -
ggatgttatgggagaattcc

SEQ ID NO: 43898 - DNA, 20 bp, Artificial Sequence
  Synthetic oligonucleotide; AAG chr11 5268183 5268202 5268186 -
tgggagaattccaggattcc

SEQ ID NO: 43899 - DNA, 20 bp, Artificial Sequence
  Synthetic oligonucleotide; AGG chr11 5268182 5268201 5268185 -
gggagaattccaggattcca

SEQ ID NO: 43900 - DNA, 20 bp, Artificial Sequence
  Synthetic oligonucleotide; GAG chr11 5268180 5268199 5268183 -
gagaattccaggattccaag

SEQ ID NO: 43901 - DNA, 20 bp, Artificial Sequence
  Synthetic oligonucleotide; AGG chr11 5268179 5268198 5268182 -
agaattccaggattccaagg

SEQ ID NO: 43902 - DNA, 20 bp, Artificial Sequence
  Synthetic oligonucleotide; TGG chr11 5268167 5268186 5268170 -
ttccaaggaggatgatatga

SEQ ID NO: 43903 - DNA, 20 bp, Artificial Sequence
  Synthetic oligonucleotide; GAG chr11 5268165 5268184 5268168 -
ccaaggaggatgatatgatg

SEQ ID NO: 43904 - DNA, 20 bp, Artificial Sequence
  Synthetic oligonucleotide; CGG chr11 5268150 5268169 5268153 -
tgatggagaaaaatctttat

SEQ ID NO: 43905 - DNA, 20 bp, Artificial Sequence
  Synthetic oligonucleotide; GGG chr11 5268149 5268168 5268152 -
gatggagaaaaatctttatc

SEQ ID NO: 43906 - DNA, 20 bp, Artificial Sequence
  Synthetic oligonucleotide; GGG chr11 5268148 5268167 5268151 -
atggagaaaaatctttatcg

SEQ ID NO: 43907 - DNA, 20 bp, Artificial Sequence
  Synthetic oligonucleotide; TGG chr11 5268145 5268164 5268148 -
gagaaaaatctttatcgggg

SEQ ID NO: 43908 - DNA, 20 bp, Artificial Sequence
  Synthetic oligonucleotide; GGG chr11 5268144 5268163 5268147 -
agaaaaatctttatcggggt

SEQ ID NO: 43909 - DNA, 20 bp, Artificial Sequence
  Synthetic oligonucleotide; TGG chr11 5268137 5268156 5268140 -
tctttatcggggtgggaaaa

SEQ ID NO: 43910 - DNA, 20 bp, Artificial Sequence
  Synthetic oligonucleotide; AAG chr11 5268128 5268147 5268131 -
gggtgggaaaatggttaatt

SEQ ID NO: 43911 - DNA, 20 bp, Artificial Sequence
  Synthetic oligonucleotide; TGG chr11 5268125 5268144 5268128 -
tgggaaaatggttaattaag

SEQ ID NO: 43912 - DNA, 20 bp, Artificial Sequence
  Synthetic oligonucleotide; CAG chr11 5268121 5268140 5268124 -
aaaatggttaattaagtgga

SEQ ID NO: 43913 - DNA, 20 bp, Artificial Sequence
  Synthetic oligonucleotide; GAG chr11 5268119 5268138 5268122 -
aatggttaattaagtggaca

SEQ ID NO: 43914 - DNA, 20 bp, Artificial Sequence
  Synthetic oligonucleotide; TAG chr11 5268111 5268130 5268114 -
attaagtggacagagactcc

SEQ ID NO: 43915 - DNA, 20 bp, Artificial Sequence
  Synthetic oligonucleotide; AGG chr11 5268110 5268129 5268113 -
ttaagtggacagagactcct

SEQ ID NO: 43916 - DNA, 20 bp, Artificial Sequence
  Synthetic oligonucleotide; CAG chr11 5268107 5268126 5268110 -
agtggacagagactcctagg

SEQ ID NO: 43917 - DNA, 20 bp, Artificial Sequence
  Synthetic oligonucleotide; CGG chr11 5268092 5268111 5268095 -
ctaggcagtttttactgcac

SEQ ID NO: 43918 - DNA, 20 bp, Artificial Sequence
  Synthetic oligonucleotide; GGG chr11 5268091 5268110 5268094 -
taggcagtttttactgcacc

SEQ ID NO: 43919 - DNA, 20 bp, Artificial Sequence
  Synthetic oligonucleotide; GGG chr11 5268090 5268109 5268093 -
aggcagtttttactgcaccg

SEQ ID NO: 43920 - DNA, 20 bp, Artificial Sequence
  Synthetic oligonucleotide; AAG chr11 5268086 5268105 5268089 -
agtttttactgcaccgggga

SEQ ID NO: 43921 - DNA, 20 bp, Artificial Sequence
  Synthetic oligonucleotide; AAG chr11 5268083 5268102 5268086 -
ttttactgcaccggggaaag

SEQ ID NO: 43922 - DNA, 20 bp, Artificial Sequence
  Synthetic oligonucleotide; AGG chr11 5268082 5268101 5268085 -
tttactgcaccggggaaaga

SEQ ID NO: 43923 - DNA, 20 bp, Artificial Sequence
  Synthetic oligonucleotide; GAG chr11 5268080 5268099 5268083 -
tactgcaccggggaaagaag

SEQ ID NO: 43924 - DNA, 20 bp, Artificial Sequence
  Synthetic oligonucleotide; TAG chr11 5268073 5268092 5268076 -
ccggggaaagaaggagctgt

SEQ ID NO: 43925 - DNA, 20 bp, Artificial Sequence
  Synthetic oligonucleotide; TGG chr11 5268070 5268089 5268073 -
gggaaagaaggagctgttag

SEQ ID NO: 43926 - DNA, 20 bp, Artificial Sequence
  Synthetic oligonucleotide; GAG chr11 5268062 5268081 5268065 -
aggagctgttagtggtacct

SEQ ID NO: 43927 - DNA, 20 bp, Artificial Sequence
  Synthetic oligonucleotide; AAG chr11 5268058 5268077 5268061 -
gctgttagtggtacctgaga

SEQ ID NO: 43928 - DNA, 20 bp, Artificial Sequence
  Synthetic oligonucleotide; CAG chr11 5268055 5268074 5268058 -
gttagtggtacctgagaaag

SEQ ID NO: 43929 - DNA, 20 bp, Artificial Sequence
  Synthetic oligonucleotide; TGG chr11 5268047 5268066 5268050 -
tacctgagaaagcagatttg

SEQ ID NO: 43930 - DNA, 20 bp, Artificial Sequence
  Synthetic oligonucleotide; TAG chr11 5267995 5268014 5267998 -
caaaacaaaacaaaacttca

SEQ ID NO: 43931 - DNA, 20 bp, Artificial Sequence
  Synthetic oligonucleotide; AAG chr11 5267986 5268005 5267989 -
acaaaacttcatagatatcc

SEQ ID NO: 43932 - DNA, 20 bp, Artificial Sequence
  Synthetic oligonucleotide; TAG chr11 5267980 5267999 5267983 -
cttcatagatatccaagata

SEQ ID NO: 43933 - DNA, 20 bp, Artificial Sequence
  Synthetic oligonucleotide; AGG chr11 5267979 5267998 5267982 -
ttcatagatatccaagatat

SEQ ID NO: 43934 - DNA, 20 bp, Artificial Sequence
  Synthetic oligonucleotide; TAG chr11 5267975 5267994 5267978 -
tagatatccaagatataggc

SEQ ID NO: 43935 - DNA, 20 bp, Artificial Sequence
  Synthetic oligonucleotide; AAG chr11 5267937 5267956 5267940 -
ttactcttatttacattttg

SEQ ID NO: 43936 - DNA, 20 bp, Artificial Sequence
  Synthetic oligonucleotide; TAG chr11 5267934 5267953 5267937 -
ctcttatttacattttgaag

SEQ ID NO: 43937 - DNA, 20 bp, Artificial Sequence
  Synthetic oligonucleotide; TAG chr11 5267930 5267949 5267933 -
tatttacattttgaagtagc

SEQ ID NO: 43938 - DNA, 20 bp, Artificial Sequence
  Synthetic oligonucleotide; TGG chr11 5267900 5267919 5267903 -
catgttttatgaaattgatt

SEQ ID NO: 43939 - DNA, 20 bp, Artificial Sequence
  Synthetic oligonucleotide; GAG chr11 5267898 5267917 5267901 -
tgttttatgaaattgatttg

SEQ ID NO: 43940 - DNA, 20 bp, Artificial Sequence
  Synthetic oligonucleotide; AAG chr11 5267893 5267912 5267896 -
tatgaaattgatttggagat

SEQ ID NO: 43941 - DNA, 20 bp, Artificial Sequence
  Synthetic oligonucleotide; GAG chr11 5267888 5267907 5267891 -
aattgatttggagataagat

SEQ ID NO: 43942 - DNA, 20 bp, Artificial Sequence
  Synthetic oligonucleotide; TAG chr11 5267872 5267891 5267875 -
agatgagtgtgtatcaacaa

SEQ ID NO: 43943 - DNA, 20 bp, Artificial Sequence
  Synthetic oligonucleotide; AAG chr11 5267854 5267873 5267857 -
aatagcctgctctttccatg

SEQ ID NO: 43944 - DNA, 20 bp, Artificial Sequence
  Synthetic oligonucleotide; AGG chr11 5267853 5267872 5267856 -
atagcctgctctttccatga

SEQ ID NO: 43945 - DNA, 20 bp, Artificial Sequence
  Synthetic oligonucleotide; TGG chr11 5267836 5267855 5267839 -
tgaaggattccattatttca

SEQ ID NO: 43946 - DNA, 20 bp, Artificial Sequence
  Synthetic oligonucleotide; GGG chr11 5267835 5267854 5267838 -
gaaggattccattatttcat

SEQ ID NO: 43947 - DNA, 20 bp, Artificial Sequence
  Synthetic oligonucleotide; TAG chr11 5267831 5267850 5267834 -
gattccattatttcatgggt

SEQ ID NO: 43948 - DNA, 20 bp, Artificial Sequence
  Synthetic oligonucleotide; AAG chr11 5267825 5267844 5267828 -
attatttcatgggttagctg

SEQ ID NO: 43949 - DNA, 20 bp, Artificial Sequence
  Synthetic oligonucleotide; AAG chr11 5267820 5267839 5267823 -
ttcatgggttagctgaagct

SEQ ID NO: 43950 - DNA, 20 bp, Artificial Sequence
  Synthetic oligonucleotide; TAG chr11 5267786 5267805 5267789 -
cattgtgcattatcttctga

SEQ ID NO: 43951 - DNA, 20 bp, Artificial Sequence
  Synthetic oligonucleotide; AAG chr11 5267762 5267781 5267765 -
atgtaacatgcactaaaata

SEQ ID NO: 43952 - DNA, 20 bp, Artificial Sequence
  Synthetic oligonucleotide; TAG chr11 5267758 5267777 5267761 -
aacatgcactaaaataaagt

SEQ ID NO: 43953 - DNA, 20 bp, Artificial Sequence
  Synthetic oligonucleotide; GAG chr11 5267756 5267775 5267759 -
catgcactaaaataaagtta

SEQ ID NO: 43954 - DNA, 20 bp, Artificial Sequence
  Synthetic oligonucleotide; TAG chr11 5267752 5267771 5267755 -
cactaaaataaagttagagt

SEQ ID NO: 43955 - DNA, 20 bp, Artificial Sequence
  Synthetic oligonucleotide; AGG chr11 5267751 5267770 5267754 -
actaaaataaagttagagtt

SEQ ID NO: 43956 - DNA, 20 bp, Artificial Sequence
  Synthetic oligonucleotide; GAG chr11 5267744 5267763 5267747 -
taaagttagagttaggacct

SEQ ID NO: 43957 - DNA, 20 bp, Artificial Sequence
  Synthetic oligonucleotide; TGG chr11 5267741 5267760 5267744 -
agttagagttaggacctgag

SEQ ID NO: 43958 - DNA, 20 bp, Artificial Sequence
  Synthetic oligonucleotide; GGG chr11 5267740 5267759 5267743 -
gttagagttaggacctgagt

SEQ ID NO: 43959 - DNA, 20 bp, Artificial Sequence
  Synthetic oligonucleotide; AAG chr11 5267736 5267755 5267739 -
gagttaggacctgagtggga

SEQ ID NO: 43960 - DNA, 20 bp, Artificial Sequence
  Synthetic oligonucleotide; TGG chr11 5267729 5267748 5267732 -
gacctgagtgggaaagtttt

SEQ ID NO: 43961 - DNA, 20 bp, Artificial Sequence
  Synthetic oligonucleotide; GAG chr11 5267727 5267746 5267730 -
cctgagtgggaaagtttttg

SEQ ID NO: 43962 - DNA, 20 bp, Artificial Sequence
  Synthetic oligonucleotide; GAG chr11 5267725 5267744 5267728 -
tgagtgggaaagtttttgga

SEQ ID NO: 43963 - DNA, 20 bp, Artificial Sequence
  Synthetic oligonucleotide; AAG chr11 5267715 5267734 5267718 -
agtttttggagagtgtgatg

SEQ ID NO: 43964 - DNA, 20 bp, Artificial Sequence
  Synthetic oligonucleotide; TGG chr11 5267704 5267723 5267707 -
agtgtgatgaagactttccg

SEQ ID NO: 43965 - DNA, 20 bp, Artificial Sequence
  Synthetic oligonucleotide; GGG chr11 5267703 5267722 5267706 -
gtgtgatgaagactttccgt

SEQ ID NO: 43966 - DNA, 20 bp, Artificial Sequence
  Synthetic oligonucleotide; GAG chr11 5267701 5267720 5267704 -
gtgatgaagactttccgtgg

SEQ ID NO: 43967 - DNA, 20 bp, Artificial Sequence
  Synthetic oligonucleotide; TAG chr11 5267697 5267716 5267700 -
tgaagactttccgtgggaga

SEQ ID NO: 43968 - DNA, 20 bp, Artificial Sequence
  Synthetic oligonucleotide; AAG chr11 5267684 5267703 5267687 -
tgggagatagaatactaata

SEQ ID NO: 43969 - DNA, 20 bp, Artificial Sequence
  Synthetic oligonucleotide; AGG chr11 5267683 5267702 5267686 -
gggagatagaatactaataa

SEQ ID NO: 43970 - DNA, 20 bp, Artificial Sequence
  Synthetic oligonucleotide; CAG chr11 5267665 5267684 5267668 -
aaaggcttaaattctaaaac

SEQ ID NO: 43971 - DNA, 20 bp, Artificial Sequence
  Synthetic oligonucleotide; AAG chr11 5267661 5267680 5267664 -
gcttaaattctaaaaccagc

SEQ ID NO: 43972 - DNA, 20 bp, Artificial Sequence
  Synthetic oligonucleotide; TAG chr11 5267657 5267676 5267660 -
aaattctaaaaccagcaagc

SEQ ID NO: 43973 - DNA, 20 bp, Artificial Sequence
  Synthetic oligonucleotide; AGG chr11 5267656 5267675 5267659 -
aattctaaaaccagcaagct

SEQ ID NO: 43974 - DNA, 20 bp, Artificial Sequence
  Synthetic oligonucleotide; GGG chr11 5267655 5267674 5267658 -
attctaaaaccagcaagcta

SEQ ID NO: 43975 - DNA, 20 bp, Artificial Sequence
  Synthetic oligonucleotide; TGG chr11 5267632 5267651 5267635 -
cttcgtgacttgcatgaaac

SEQ ID NO: 43976 - DNA, 20 bp, Artificial Sequence
  Synthetic oligonucleotide; TGG chr11 5267624 5267643 5267627 -
cttgcatgaaactggctctc

SEQ ID NO: 43977 - DNA, 20 bp, Artificial Sequence
  Synthetic oligonucleotide; AAG chr11 5267621 5267640 5267624 -
gcatgaaactggctctctgg

SEQ ID NO: 43978 - DNA, 20 bp, Artificial Sequence
  Synthetic oligonucleotide; TAG chr11 5267618 5267637 5267621 -
tgaaactggctctctggaag

SEQ ID NO: 43979 - DNA, 20 bp, Artificial Sequence
  Synthetic oligonucleotide; AAG chr11 5267615 5267634 5267618 -
aactggctctctggaagtag

SEQ ID NO: 43980 - DNA, 20 bp, Artificial Sequence
  Synthetic oligonucleotide; AGG chr11 5267614 5267633 5267617 -
actggctctctggaagtaga

SEQ ID NO: 43981 - DNA, 20 bp, Artificial Sequence
  Synthetic oligonucleotide; GGG chr11 5267613 5267632 5267616 -
ctggctctctggaagtagaa

SEQ ID NO: 43982 - DNA, 20 bp, Artificial Sequence
  Synthetic oligonucleotide; GAG chr11 5267611 5267630 5267614 -
ggctctctggaagtagaagg

SEQ ID NO: 43983 - DNA, 20 bp, Artificial Sequence
  Synthetic oligonucleotide; GAG chr11 5267609 5267628 5267612 -
ctctctggaagtagaaggga

SEQ ID NO: 43984 - DNA, 20 bp, Artificial Sequence
  Synthetic oligonucleotide; AAG chr11 5267605 5267624 5267608 -
ctggaagtagaagggagagt

SEQ ID NO: 43985 - DNA, 20 bp, Artificial Sequence
  Synthetic oligonucleotide; TAG chr11 5267595 5267614 5267598 -
aagggagagtaagacatacg

SEQ ID NO: 43986 - DNA, 20 bp, Artificial Sequence
  Synthetic oligonucleotide; GAG chr11 5267593 5267612 5267596 -
gggagagtaagacatacgta

SEQ ID NO: 43987 - DNA, 20 bp, Artificial Sequence
  Synthetic oligonucleotide; AGG chr11 5267592 5267611 5267595 -
ggagagtaagacatacgtag

SEQ ID NO: 43988 - DNA, 20 bp, Artificial Sequence
  Synthetic oligonucleotide; TAG chr11 5267587 5267606 5267590 -
gtaagacatacgtagaggac

SEQ ID NO: 43989 - DNA, 20 bp, Artificial Sequence
  Synthetic oligonucleotide; AGG chr11 5267586 5267605 5267589 -
taagacatacgtagaggact

SEQ ID NO: 43990 - DNA, 20 bp, Artificial Sequence
  Synthetic oligonucleotide; AAG chr11 5267582 5267601 5267585 -
acatacgtagaggactagga

SEQ ID NO: 43991 - DNA, 20 bp, Artificial Sequence
  Synthetic oligonucleotide; CAG chr11 5267577 5267596 5267580 -
cgtagaggactaggaaagac

SEQ ID NO: 43992 - DNA, 20 bp, Artificial Sequence
  Synthetic oligonucleotide; TAG chr11 5267573 5267592 5267576 -
gaggactaggaaagaccaga

SEQ ID NO: 43993 - DNA, 20 bp, Artificial Sequence
  Synthetic oligonucleotide; CAG chr11 5267568 5267587 5267571 -
ctaggaaagaccagatagta

SEQ ID NO: 43994 - DNA, 20 bp, Artificial Sequence
  Synthetic oligonucleotide; AGG chr11 5267567 5267586 5267570 -
taggaaagaccagatagtac

SEQ ID NO: 43995 - DNA, 20 bp, Artificial Sequence
  Synthetic oligonucleotide; GGG chr11 5267566 5267585 5267569 -
aggaaagaccagatagtaca

SEQ ID NO: 43996 - DNA, 20 bp, Artificial Sequence
  Synthetic oligonucleotide; TGG chr11 5267561 5267580 5267564 -
agaccagatagtacagggcc

SEQ ID NO: 43997 - DNA, 20 bp, Artificial Sequence
  Synthetic oligonucleotide; AAG chr11 5267546 5267565 5267549 -
gggcctggctacaaaaatac

SEQ ID NO: 43998 - DNA, 20 bp, Artificial Sequence
  Synthetic oligonucleotide; AAG chr11 5267512 5267531 5267515 -
ctattgcaatactaaacgat

SEQ ID NO: 43999 - DNA, 20 bp, Artificial Sequence
  Synthetic oligonucleotide; TAG chr11 5267506 5267525 5267509 -
caatactaaacgataagcat

SEQ ID NO: 44000 - DNA, 20 bp, Artificial Sequence
  Synthetic oligonucleotide; AGG chr11 5267505 5267524 5267508 -
aatactaaacgataagcatt

SEQ ID NO: 44001 - DNA, 20 bp, Artificial Sequence
  Synthetic oligonucleotide; AAG chr11 5267497 5267516 5267500 -
acgataagcattaggatgtt

SEQ ID NO: 44002 - DNA, 20 bp, Artificial Sequence
  Synthetic oligonucleotide; CAG chr11 5267489 5267508 5267492 -
cattaggatgttaagtgact

SEQ ID NO: 44003 - DNA, 20 bp, Artificial Sequence
  Synthetic oligonucleotide; AGG chr11 5267488 5267507 5267491 -
attaggatgttaagtgactc

SEQ ID NO: 44004 - DNA, 20 bp, Artificial Sequence
  Synthetic oligonucleotide; AAG chr11 5267481 5267500 5267484 -
tgttaagtgactcaggaaat

SEQ ID NO: 44005 - DNA, 20 bp, Artificial Sequence
  Synthetic oligonucleotide; TGG chr11 5267474 5267493 5267477 -
tgactcaggaaataagattt

SEQ ID NO: 44006 - DNA, 20 bp, Artificial Sequence
  Synthetic oligonucleotide; GGG chr11 5267473 5267492 5267476 -
gactcaggaaataagatttt

SEQ ID NO: 44007 - DNA, 20 bp, Artificial Sequence
  Synthetic oligonucleotide; AAG chr11 5267467 5267486 5267470 -
ggaaataagattttgggaaa

SEQ ID NO: 44008 - DNA, 20 bp, Artificial Sequence
  Synthetic oligonucleotide; TGG chr11 5267442 5267461 5267445 -
atctgcttatgtgcacaaaa

SEQ ID NO: 44009 - DNA, 20 bp, Artificial Sequence
  Synthetic oligonucleotide; AAG chr11 5267435 5267454 5267438 -
tatgtgcacaaaatggattc

SEQ ID NO: 44010 - DNA, 20 bp, Artificial Sequence
  Synthetic oligonucleotide; CAG chr11 5267428 5267447 5267431 -
acaaaatggattcaagtttg

SEQ ID NO: 44011 - DNA, 20 bp, Artificial Sequence
  Synthetic oligonucleotide; TGG chr11 5267412 5267431 5267415 -
tttgcagataaaataaaata

SEQ ID NO: 44012 - DNA, 20 bp, Artificial Sequence
  Synthetic oligonucleotide; AAG chr11 5267399 5267418 5267402 -
taaaatatggatgatgattc

SEQ ID NO: 44013 - DNA, 20 bp, Artificial Sequence
  Synthetic oligonucleotide; AGG chr11 5267398 5267417 5267401 -
aaaatatggatgatgattca

SEQ ID NO: 44014 - DNA, 20 bp, Artificial Sequence
  Synthetic oligonucleotide; GGG chr11 5267397 5267416 5267400 -
aaatatggatgatgattcaa

SEQ ID NO: 44015 - DNA, 20 bp, Artificial Sequence
  Synthetic oligonucleotide; GGG chr11 5267396 5267415 5267399 -
aatatggatgatgattcaag

SEQ ID NO: 44016 - DNA, 20 bp, Artificial Sequence
  Synthetic oligonucleotide; CAG chr11 5267392 5267411 5267395 -
tggatgatgattcaagggga

SEQ ID NO: 44017 - DNA, 20 bp, Artificial Sequence
  Synthetic oligonucleotide; TGG chr11 5267383 5267402 5267386 -
attcaaggggacagatacaa

SEQ ID NO: 44018 - DNA, 20 bp, Artificial Sequence
  Synthetic oligonucleotide; AAG chr11 5267371 5267390 5267374 -
agatacaatggttcaaaccc

SEQ ID NO: 44019 - DNA, 20 bp, Artificial Sequence
  Synthetic oligonucleotide; GAG chr11 5267369 5267388 5267372 -
atacaatggttcaaacccaa

SEQ ID NO: 44020 - DNA, 20 bp, Artificial Sequence
  Synthetic oligonucleotide; AGG chr11 5267368 5267387 5267371 -
tacaatggttcaaacccaag

SEQ ID NO: 44021 - DNA, 20 bp, Artificial Sequence
  Synthetic oligonucleotide; GAG chr11 5267366 5267385 5267369 -
caatggttcaaacccaagag

SEQ ID NO: 44022 - DNA, 20 bp, Artificial Sequence
  Synthetic oligonucleotide; CAG chr11 5267363 5267382 5267366 -
tggttcaaacccaagaggag

SEQ ID NO: 44023 - DNA, 20 bp, Artificial Sequence
  Synthetic oligonucleotide; GAG chr11 5267359 5267378 5267362 -
tcaaacccaagaggagcagt

SEQ ID NO: 44024 - DNA, 20 bp, Artificial Sequence
  Synthetic oligonucleotide; TGG chr11 5267352 5267371 5267355 -
caagaggagcagtgagtctg

SEQ ID NO: 44025 - DNA, 20 bp, Artificial Sequence
  Synthetic oligonucleotide; AAG chr11 5267343 5267362 5267346 -
cagtgagtctgtggaatttg

SEQ ID NO: 44026 - DNA, 20 bp, Artificial Sequence
  Synthetic oligonucleotide; AGG chr11 5267342 5267361 5267345 -
agtgagtctgtggaatttga

SEQ ID NO: 44027 - DNA, 20 bp, Artificial Sequence
  Synthetic oligonucleotide; TGG chr11 5267338 5267357 5267341 -
agtctgtggaatttgaagga

SEQ ID NO: 44028 - DNA, 20 bp, Artificial Sequence
  Synthetic oligonucleotide; AAG chr11 5267332 5267351 5267335 -
tggaatttgaaggatggaca

SEQ ID NO: 44029 - DNA, 20 bp, Artificial Sequence
  Synthetic oligonucleotide; AGG chr11 5267331 5267350 5267334 -
ggaatttgaaggatggacaa

SEQ ID NO: 44030 - DNA, 20 bp, Artificial Sequence
  Synthetic oligonucleotide; TGG chr11 5267328 5267347 5267331 -
atttgaaggatggacaaagg

SEQ ID NO: 44031 - DNA, 20 bp, Artificial Sequence
  Synthetic oligonucleotide; GGG chr11 5267327 5267346 5267330 -
tttgaaggatggacaaaggt

SEQ ID NO: 44032 - DNA, 20 bp, Artificial Sequence
  Synthetic oligonucleotide; GGG chr11 5267326 5267345 5267329 -
ttgaaggatggacaaaggtg

SEQ ID NO: 44033 - DNA, 20 bp, Artificial Sequence
  Synthetic oligonucleotide; GAG chr11 5267322 5267341 5267325 -
aggatggacaaaggtggggt

SEQ ID NO: 44034 - DNA, 20 bp, Artificial Sequence
  Synthetic oligonucleotide; AAG chr11 5267318 5267337 5267321 -
tggacaaaggtggggtgaga

SEQ ID NO: 44035 - DNA, 20 bp, Artificial Sequence
  Synthetic oligonucleotide; TAG chr11 5267312 5267331 5267315 -
aaggtggggtgagaaagaca

SEQ ID NO: 44036 - DNA, 20 bp, Artificial Sequence
  Synthetic oligonucleotide; TGG chr11 5267295 5267314 5267298 -
acatagtattcgactgactg

SEQ ID NO: 44037 - DNA, 20 bp, Artificial Sequence
  Synthetic oligonucleotide; GGG chr11 5267294 5267313 5267297 -
catagtattcgactgactgt

SEQ ID NO: 44038 - DNA, 20 bp, Artificial Sequence
  Synthetic oligonucleotide; GAG chr11 5267292 5267311 5267295 -
tagtattcgactgactgtgg

SEQ ID NO: 44039 - DNA, 20 bp, Artificial Sequence
  Synthetic oligonucleotide; GAG chr11 5267287 5267306 5267290 -
ttcgactgactgtgggagat

SEQ ID NO: 44040 - DNA, 20 bp, Artificial Sequence
  Synthetic oligonucleotide; AAG chr11 5267284 5267303 5267287 -
gactgactgtgggagatgag

SEQ ID NO: 44041 - DNA, 20 bp, Artificial Sequence
  Synthetic oligonucleotide; AGG chr11 5267283 5267302 5267286 -
actgactgtgggagatgaga

SEQ ID NO: 44042 - DNA, 20 bp, Artificial Sequence
  Synthetic oligonucleotide; AAG chr11 5267280 5267299 5267283 -
gactgtgggagatgagaagg

SEQ ID NO: 44043 - DNA, 20 bp, Artificial Sequence
  Synthetic oligonucleotide; AAG chr11 5267277 5267296 5267280 -
tgtgggagatgagaaggaag

SEQ ID NO: 44044 - DNA, 20 bp, Artificial Sequence
  Synthetic oligonucleotide; AGG chr11 5267276 5267295 5267279 -
gtgggagatgagaaggaaga

SEQ ID NO: 44045 - DNA, 20 bp, Artificial Sequence
  Synthetic oligonucleotide; GAG chr11 5267274 5267293 5267277 -
gggagatgagaaggaagaag

SEQ ID NO: 44046 - DNA, 20 bp, Artificial Sequence
  Synthetic oligonucleotide; AGG chr11 5267273 5267292 5267276 -
ggagatgagaaggaagaagg

SEQ ID NO: 44047 - DNA, 20 bp, Artificial Sequence
  Synthetic oligonucleotide; AAG chr11 5267256 5267275 5267259 -
aggaggtgataaatgactga

SEQ ID NO: 44048 - DNA, 20 bp, Artificial Sequence
  Synthetic oligonucleotide; CAG chr11 5267249 5267268 5267252 -
gataaatgactgaaagctcc

SEQ ID NO: 44049 - DNA, 20 bp, Artificial Sequence
  Synthetic oligonucleotide; TGG chr11 5267244 5267263 5267247 -
atgactgaaagctcccagac

SEQ ID NO: 44050 - DNA, 20 bp, Artificial Sequence
  Synthetic oligonucleotide; AAG chr11 5267239 5267258 5267242 -
tgaaagctcccagactggtg

SEQ ID NO: 44051 - DNA, 20 bp, Artificial Sequence
  Synthetic oligonucleotide; CAG chr11 5267232 5267251 5267235 -
tcccagactggtgaagataa

SEQ ID NO: 44052 - DNA, 20 bp, Artificial Sequence
  Synthetic oligonucleotide; AGG chr11 5267231 5267250 5267234 -
cccagactggtgaagataac

SEQ ID NO: 44053 - DNA, 20 bp, Artificial Sequence
  Synthetic oligonucleotide; GAG chr11 5267229 5267248 5267232 -
cagactggtgaagataacag

SEQ ID NO: 44054 - DNA, 20 bp, Artificial Sequence
  Synthetic oligonucleotide; AGG chr11 5267228 5267247 5267231 -
agactggtgaagataacagg

SEQ ID NO: 44055 - DNA, 20 bp, Artificial Sequence
  Synthetic oligonucleotide; TGG chr11 5267209 5267228 5267212 -
gaggaaaccatgcactgacc

SEQ ID NO: 44056 - DNA, 20 bp, Artificial Sequence
  Synthetic oligonucleotide; AAG chr11 5267191 5267210 5267194 -
cctggtgactctcatgtgtg

SEQ ID NO: 44057 - DNA, 20 bp, Artificial Sequence
  Synthetic oligonucleotide; AGG chr11 5267190 5267209 5267193 -
ctggtgactctcatgtgtga

SEQ ID NO: 44058 - DNA, 20 bp, Artificial Sequence
  Synthetic oligonucleotide; GGG chr11 5267189 5267208 5267192 -
tggtgactctcatgtgtgaa

SEQ ID NO: 44059 - DNA, 20 bp, Artificial Sequence
  Synthetic oligonucleotide; TAG chr11 5267186 5267205 5267189 -
tgactctcatgtgtgaaggg

SEQ ID NO: 44060 - DNA, 20 bp, Artificial Sequence
  Synthetic oligonucleotide; GAG chr11 5267184 5267203 5267187 -
actctcatgtgtgaagggta

SEQ ID NO: 44061 - DNA, 20 bp, Artificial Sequence
  Synthetic oligonucleotide; AGG chr11 5267183 5267202 5267186 -
ctctcatgtgtgaagggtag

SEQ ID NO: 44062 - DNA, 20 bp, Artificial Sequence
  Synthetic oligonucleotide; GGG chr11 5267182 5267201 5267185 -
tctcatgtgtgaagggtaga

SEQ ID NO: 44063 - DNA, 20 bp, Artificial Sequence
  Synthetic oligonucleotide; CAG chr11 5267172 5267191 5267175 -
gaagggtagagggatattaa

SEQ ID NO: 44064 - DNA, 20 bp, Artificial Sequence
  Synthetic oligonucleotide; TAG chr11 5267159 5267178 5267162 -
atattaacagatttactttt

SEQ ID NO: 44065 - DNA, 20 bp, Artificial Sequence
  Synthetic oligonucleotide; AGG chr11 5267158 5267177 5267161 -
tattaacagatttacttttt

SEQ ID NO: 44066 - DNA, 20 bp, Artificial Sequence
  Synthetic oligonucleotide; AAG chr11 5267155 5267174 5267158 -
taacagatttactttttagg

SEQ ID NO: 44067 - DNA, 20 bp, Artificial Sequence
  Synthetic oligonucleotide; TAG chr11 5267149 5267168 5267152 -
atttactttttaggaagtgc

SEQ ID NO: 44068 - DNA, 20 bp, Artificial Sequence
  Synthetic oligonucleotide; TGG chr11 5267144 5267163 5267147 -
ctttttaggaagtgctagat

SEQ ID NO: 44069 - DNA, 20 bp, Artificial Sequence
  Synthetic oligonucleotide; CAG chr11 5267140 5267159 5267143 -
ttaggaagtgctagattggt

SEQ ID NO: 44070 - DNA, 20 bp, Artificial Sequence
  Synthetic oligonucleotide; AGG chr11 5267139 5267158 5267142 -
taggaagtgctagattggtc

SEQ ID NO: 44071 - DNA, 20 bp, Artificial Sequence
  Synthetic oligonucleotide; GGG chr11 5267138 5267157 5267141 -
aggaagtgctagattggtca

SEQ ID NO: 44072 - DNA, 20 bp, Artificial Sequence
  Synthetic oligonucleotide; GAG chr11 5267136 5267155 5267139 -
gaagtgctagattggtcagg

SEQ ID NO: 44073 - DNA, 20 bp, Artificial Sequence
  Synthetic oligonucleotide; CAG chr11 5267123 5267142 5267126 -
ggtcagggagttttgacctt

SEQ ID NO: 44074 - DNA, 20 bp, Artificial Sequence
  Synthetic oligonucleotide; AGG chr11 5267122 5267141 5267125 -
gtcagggagttttgaccttc

SEQ ID NO: 44075 - DNA, 20 bp, Artificial Sequence
  Synthetic oligonucleotide; AAG chr11 5267101 5267120 5267104 -
ggtcttgtgtctttcatatc

SEQ ID NO: 44076 - DNA, 20 bp, Artificial Sequence
  Synthetic oligonucleotide; AGG chr11 5267100 5267119 5267103 -
gtcttgtgtctttcatatca

SEQ ID NO: 44077 - DNA, 20 bp, Artificial Sequence
  Synthetic oligonucleotide; AAG chr11 5267081 5267100 5267084 -
aaggaacctttgcattttcc

SEQ ID NO: 44078 - DNA, 20 bp, Artificial Sequence
  Synthetic oligonucleotide; TAG chr11 5267077 5267096 5267080 -
aacctttgcattttccaagt

SEQ ID NO: 44079 - DNA, 20 bp, Artificial Sequence
  Synthetic oligonucleotide; GAG chr11 5267075 5267094 5267078 -
cctttgcattttccaagtta

SEQ ID NO: 44080 - DNA, 20 bp, Artificial Sequence
  Synthetic oligonucleotide; TGG chr11 5267062 5267081 5267065 -
caagttagagtgccatattt

SEQ ID NO: 44081 - DNA, 20 bp, Artificial Sequence
  Synthetic oligonucleotide; TAG chr11 5267044 5267063 5267047 -
tttggcaaatataactttat

SEQ ID NO: 44082 - DNA, 20 bp, Artificial Sequence
  Synthetic oligonucleotide; TAG chr11 5267033 5267052 5267036 -
taactttattagtaatttta

SEQ ID NO: 44083 - DNA, 20 bp, Artificial Sequence
  Synthetic oligonucleotide; CAG chr11 5267015 5267034 5267018 -
tatagtgctctcacattgat

SEQ ID NO: 44084 - DNA, 20 bp, Artificial Sequence
  Synthetic oligonucleotide; TGG chr11 5266984 5267003 5266987 -
ctgtgaattacttttgaatt

SEQ ID NO: 44085 - DNA, 20 bp, Artificial Sequence
  Synthetic oligonucleotide; CAG chr11 5266970 5266989 5266973 -
tgaatttggctgtatatatc

SEQ ID NO: 44086 - DNA, 20 bp, Artificial Sequence
  Synthetic oligonucleotide; TGG chr11 5266963 5266982 5266966 -
ggctgtatatatccagaata

SEQ ID NO: 44087 - DNA, 20 bp, Artificial Sequence
  Synthetic oligonucleotide; GGG chr11 5266962 5266981 5266965 -
gctgtatatatccagaatat

SEQ ID NO: 44088 - DNA, 20 bp, Artificial Sequence
  Synthetic oligonucleotide; GAG chr11 5266960 5266979 5266963 -
tgtatatatccagaatatgg

SEQ ID NO: 44089 - DNA, 20 bp, Artificial Sequence
  Synthetic oligonucleotide; GAG chr11 5266958 5266977 5266961 -
tatatatccagaatatggga

SEQ ID NO: 44090 - DNA, 20 bp, Artificial Sequence
  Synthetic oligonucleotide; GAG chr11 5266956 5266975 5266959 -
tatatccagaatatgggaga

SEQ ID NO: 44091 - DNA, 20 bp, Artificial Sequence
  Synthetic oligonucleotide; TAG chr11 5266939 5266958 5266942 -
agagagacaaataattattg

SEQ ID NO: 44092 - DNA, 20 bp, Artificial Sequence
  Synthetic oligonucleotide; CAG chr11 5266933 5266952 5266936 -
acaaataattattgtagttg

SEQ ID NO: 44093 - DNA, 20 bp, Artificial Sequence
  Synthetic oligonucleotide; AGG chr11 5266932 5266951 5266935 -
caaataattattgtagttgc

SEQ ID NO: 44094 - DNA, 20 bp, Artificial Sequence
  Synthetic oligonucleotide; TGG chr11 5266916 5266935 5266919 -
ttgcaggctatcaacaatac

SEQ ID NO: 44095 - DNA, 20 bp, Artificial Sequence
  Synthetic oligonucleotide; GAG chr11 5266906 5266925 5266909 -
tcaacaatactggtctctct

SEQ ID NO: 44096 - DNA, 20 bp, Artificial Sequence
  Synthetic oligonucleotide; CAG chr11 5266875 5266894 5266878 -
cctttcaatatgcccataaa

SEQ ID NO: 44097 - DNA, 20 bp, Artificial Sequence
  Synthetic oligonucleotide; GAG chr11 5266873 5266892 5266876 -
tttcaatatgcccataaaca

SEQ ID NO: 44098 - DNA, 20 bp, Artificial Sequence
  Synthetic oligonucleotide; CAG chr11 5266866 5266885 5266869 -
atgcccataaacagagtaaa

SEQ ID NO: 44099 - DNA, 20 bp, Artificial Sequence
  Synthetic oligonucleotide; AGG chr11 5266865 5266884 5266868 -
tgcccataaacagagtaaac

SEQ ID NO: 44100 - DNA, 20 bp, Artificial Sequence
  Synthetic oligonucleotide; GGG chr11 5266864 5266883 5266867 -
gcccataaacagagtaaaca

SEQ ID NO: 44101 - DNA, 20 bp, Artificial Sequence
  Synthetic oligonucleotide; TGG chr11 5266853 5266872 5266856 -
gagtaaacagggattattca

SEQ ID NO: 44102 - DNA, 20 bp, Artificial Sequence
  Synthetic oligonucleotide; TAG chr11 5266833 5266852 5266836 -
tggcactaaatattttcacc

SEQ ID NO: 44103 - DNA, 20 bp, Artificial Sequence
  Synthetic oligonucleotide; CAG chr11 5266829 5266848 5266832 -
actaaatattttcacctagt

SEQ ID NO: 44104 - DNA, 20 bp, Artificial Sequence
  Synthetic oligonucleotide; TGG chr11 5266818 5266837 5266821 -
tcacctagtcagtcaacaaa

SEQ ID NO: 44105 - DNA, 20 bp, Artificial Sequence
  Synthetic oligonucleotide; GGG chr11 5266817 5266836 5266820 -
cacctagtcagtcaacaaat

SEQ ID NO: 44106 - DNA, 20 bp, Artificial Sequence
  Synthetic oligonucleotide; GAG chr11 5266815 5266834 5266818 -
cctagtcagtcaacaaatgg

SEQ ID NO: 44107 - DNA, 20 bp, Artificial Sequence
  Synthetic oligonucleotide; TGG chr11 5266775 5266794 5266778 -
tacatatttttatatattta

SEQ ID NO: 44108 - DNA, 20 bp, Artificial Sequence
  Synthetic oligonucleotide; GGG chr11 5266774 5266793 5266777 -
acatatttttatatatttat

SEQ ID NO: 44109 - DNA, 20 bp, Artificial Sequence
  Synthetic oligonucleotide; GGG chr11 5266773 5266792 5266776 -
catatttttatatatttatg

SEQ ID NO: 44110 - DNA, 20 bp, Artificial Sequence
  Synthetic oligonucleotide; TAG chr11 5266749 5266768 5266752 -
acatgtgatacttacatgcc

SEQ ID NO: 44111 - DNA, 20 bp, Artificial Sequence
  Synthetic oligonucleotide; AAG chr11 5266732 5266751 5266735 -
gcctagaacatgtgatgatt

SEQ ID NO: 44112 - DNA, 20 bp, Artificial Sequence
  Synthetic oligonucleotide; TAG chr11 5266727 5266746 5266730 -
gaacatgtgatgattaagtc

SEQ ID NO: 44113 - DNA, 20 bp, Artificial Sequence
  Synthetic oligonucleotide; TAG chr11 5266719 5266738 5266722 -
gatgattaagtctagatatt

SEQ ID NO: 44114 - DNA, 20 bp, Artificial Sequence
  Synthetic oligonucleotide; AGG chr11 5266718 5266737 5266721 -
atgattaagtctagatattt

SEQ ID NO: 44115 - DNA, 20 bp, Artificial Sequence
  Synthetic oligonucleotide; GAG chr11 5266701 5266720 5266704 -
tttaggatatccattgcttt

SEQ ID NO: 44116 - DNA, 20 bp, Artificial Sequence
  Synthetic oligonucleotide; GAG chr11 5266677 5266696 5266680 -
atttatcatttctatgtatt

SEQ ID NO: 44117 - DNA, 20 bp, Artificial Sequence
  Synthetic oligonucleotide; TAG chr11 5266653 5266672 5266656 -
aaatttcaaatcctcatttc

SEQ ID NO: 44118 - DNA, 20 bp, Artificial Sequence
  Synthetic oligonucleotide; TAG chr11 5266628 5266647 5266631 -
attttgaaatatataataaa

SEQ ID NO: 44119 - DNA, 20 bp, Artificial Sequence
  Synthetic oligonucleotide; TAG chr11 5266615 5266634 5266618 -
taataaatagtaattaacta

SEQ ID NO: 44120 - DNA, 20 bp, Artificial Sequence
  Synthetic oligonucleotide; TGG chr11 5266586 5266605 5266589 -
tactcaaatatcaaacatta

SEQ ID NO: 44121 - DNA, 20 bp, Artificial Sequence
  Synthetic oligonucleotide; CAG chr11 5266502 5266521 5266505 -
atacacactcacactttttc

SEQ ID NO: 44122 - DNA, 20 bp, Artificial Sequence
  Synthetic oligonucleotide; GAG chr11 5266464 5266483 5266467 -
attctactctctaccaccat

SEQ ID NO: 44123 - DNA, 20 bp, Artificial Sequence
  Synthetic oligonucleotide; TAG chr11 5266450 5266469 5266453 -
caccatgagacccacttttt

SEQ ID NO: 44124 - DNA, 20 bp, Artificial Sequence
  Synthetic oligonucleotide; CAG chr11 5266441 5266460 5266444 -
acccacttttttagctccca

SEQ ID NO: 44125 - DNA, 20 bp, Artificial Sequence
  Synthetic oligonucleotide; TGG chr11 5266402 5266421 5266405 -
gatatttgactttctgtatc

SEQ ID NO: 44126 - DNA, 20 bp, Artificial Sequence
  Synthetic oligonucleotide; TGG chr11 5266377 5266396 5266380 -
tattttattatctatctctt

SEQ ID NO: 44127 - DNA, 20 bp, Artificial Sequence
  Synthetic oligonucleotide; AAG chr11 5266368 5266387 5266371 -
atctatctctttggcatacc

SEQ ID NO: 44128 - DNA, 20 bp, Artificial Sequence
  Synthetic oligonucleotide; GAG chr11 5266366 5266385 5266369 -
ctatctctttggcataccaa

SEQ ID NO: 44129 - DNA, 20 bp, Artificial Sequence
  Synthetic oligonucleotide; CAG chr11 5266345 5266364 5266348 -
agtttgtttttgttctgctt

SEQ ID NO: 44130 - DNA, 20 bp, Artificial Sequence
  Synthetic oligonucleotide; AGG chr11 5266344 5266363 5266347 -
gtttgtttttgttctgcttc

SEQ ID NO: 44131 - DNA, 20 bp, Artificial Sequence
  Synthetic oligonucleotide; GGG chr11 5266343 5266362 5266346 -
tttgtttttgttctgcttca

SEQ ID NO: 44132 - DNA, 20 bp, Artificial Sequence
  Synthetic oligonucleotide; TGG chr11 5266317 5266336 5266320 -
tcaattaacataatgacctc

SEQ ID NO: 44133 - DNA, 20 bp, Artificial Sequence
  Synthetic oligonucleotide; AAG chr11 5266289 5266308 5266292 -
tccatgttgctacaaatgac

SEQ ID NO: 44134 - DNA, 20 bp, Artificial Sequence
  Synthetic oligonucleotide; TGG chr11 5266270 5266289 5266273 -
caagatttcattctttttca

SEQ ID NO: 44135 - DNA, 20 bp, Artificial Sequence
  Synthetic oligonucleotide; TAG chr11 5266262 5266281 5266265 -
cattctttttcatggcaaaa

SEQ ID NO: 44136 - DNA, 20 bp, Artificial Sequence
  Synthetic oligonucleotide; TAG chr11 5266217 5266236 5266220 -
ttaatccgttcatctgttga

SEQ ID NO: 44137 - DNA, 20 bp, Artificial Sequence
  Synthetic oligonucleotide; TAG chr11 5266209 5266228 5266212 -
ttcatctgttgatagacact

SEQ ID NO: 44138 - DNA, 20 bp, Artificial Sequence
  Synthetic oligonucleotide; AGG chr11 5266208 5266227 5266211 -
tcatctgttgatagacactt

SEQ ID NO: 44139 - DNA, 20 bp, Artificial Sequence
  Synthetic oligonucleotide; TAG chr11 5266178 5266197 5266181 -
caaaccttaactattgtgaa

SEQ ID NO: 44140 - DNA, 20 bp, Artificial Sequence
  Synthetic oligonucleotide; GAG chr11 5266160 5266179 5266163 -
aatagtgcttcaataaacat

SEQ ID NO: 44141 - DNA, 20 bp, Artificial Sequence
  Synthetic oligonucleotide; TGG chr11 5266143 5266162 5266146 -
catgagtgtaatgtgtccat

SEQ ID NO: 44142 - DNA, 20 bp, Artificial Sequence
  Synthetic oligonucleotide; TGG chr11 5266119 5266138 5266122 -
tatactgatttcctttcttt

SEQ ID NO: 44143 - DNA, 20 bp, Artificial Sequence
  Synthetic oligonucleotide; TAG chr11 5266104 5266123 5266107 -
tcttttggataaataaccac

SEQ ID NO: 44144 - DNA, 20 bp, Artificial Sequence
  Synthetic oligonucleotide; GAG chr11 5266100 5266119 5266103 -
ttggataaataaccactagt

SEQ ID NO: 44145 - DNA, 20 bp, Artificial Sequence
  Synthetic oligonucleotide; TGG chr11 5266092 5266111 5266095 -
ataaccactagtgagattgc

SEQ ID NO: 44146 - DNA, 20 bp, Artificial Sequence
  Synthetic oligonucleotide; TAG chr11 5266080 5266099 5266083 -
gagattgctggattgtatga

SEQ ID NO: 44147 - DNA, 20 bp, Artificial Sequence
  Synthetic oligonucleotide; TAG chr11 5266068 5266087 5266071 -
ttgtatgatagttctgtttt

SEQ ID NO: 44148 - DNA, 20 bp, Artificial Sequence
  Synthetic oligonucleotide; GAG chr11 5266059 5266078 5266062 -
agttctgtttttagtttact

SEQ ID NO: 44149 - DNA, 20 bp, Artificial Sequence
  Synthetic oligonucleotide; TGG chr11 5266032 5266051 5266035 -
cttcatactgttttccataa

SEQ ID NO: 44150 - DNA, 20 bp, Artificial Sequence
  Synthetic oligonucleotide; CAG chr11 5266004 5266023 5266007 -
ctattttacattcccaccaa

SEQ ID NO: 44151 - DNA, 20 bp, Artificial Sequence
  Synthetic oligonucleotide; AAG chr11 5265996 5266015 5265999 -
cattcccaccaacagtgtgt

SEQ ID NO: 44152 - DNA, 20 bp, Artificial Sequence
  Synthetic oligonucleotide; AAG chr11 5265992 5266011 5265995 -
cccaccaacagtgtgtaaga

SEQ ID NO: 44153 - DNA, 20 bp, Artificial Sequence
  Synthetic oligonucleotide; GAG chr11 5265990 5266009 5265993 -
caccaacagtgtgtaagaaa

SEQ ID NO: 44154 - DNA, 20 bp, Artificial Sequence
  Synthetic oligonucleotide; AAG chr11 5265964 5265983 5265967 -
ccttttctccatatcctcac

SEQ ID NO: 44155 - DNA, 20 bp, Artificial Sequence
  Synthetic oligonucleotide; AGG chr11 5265963 5265982 5265966 -
cttttctccatatcctcaca

SEQ ID NO: 44156 - DNA, 20 bp, Artificial Sequence
  Synthetic oligonucleotide; TAG chr11 5265932 5265951 5265935 -
ttttttgtcttttttgttaa

SEQ ID NO: 44157 - DNA, 20 bp, Artificial Sequence
  Synthetic oligonucleotide; TAG chr11 5265919 5265938 5265922 -
ttgttaatagccgttttaac

SEQ ID NO: 44158 - DNA, 20 bp, Artificial Sequence
  Synthetic oligonucleotide; GAG chr11 5265917 5265936 5265920 -
gttaatagccgttttaacta

SEQ ID NO: 44159 - DNA, 20 bp, Artificial Sequence
  Synthetic oligonucleotide; AAG chr11 5265913 5265932 5265916 -
atagccgttttaactagagt

SEQ ID NO: 44160 - DNA, 20 bp, Artificial Sequence
  Synthetic oligonucleotide; TAG chr11 5265910 5265929 5265913 -
gccgttttaactagagtaag

SEQ ID NO: 44161 - DNA, 20 bp, Artificial Sequence
  Synthetic oligonucleotide; TAG chr11 5265896 5265915 5265899 -
agtaagtagatatctcattg

SEQ ID NO: 44162 - DNA, 20 bp, Artificial Sequence
  Synthetic oligonucleotide; TAG chr11 5265868 5265887 5265871 -
atttgcatttccctgatcat

SEQ ID NO: 44163 - DNA, 20 bp, Artificial Sequence
  Synthetic oligonucleotide; GAG chr11 5265858 5265877 5265861 -
ccctgatcattagtgatgtt

SEQ ID NO: 44164 - DNA, 20 bp, Artificial Sequence
  Synthetic oligonucleotide; TGG chr11 5265836 5265855 5265839 -
gaattttttcatatgtttgt

SEQ ID NO: 44165 - DNA, 20 bp, Artificial Sequence
  Synthetic oligonucleotide; GAG chr11 5265813 5265832 5265816 -
tcatttgtatatctttttct

SEQ ID NO: 44166 - DNA, 20 bp, Artificial Sequence
  Synthetic oligonucleotide; TAG chr11 5265791 5265810 5265794 -
gaattgtctgttcatgtcct

SEQ ID NO: 44167 - DNA, 20 bp, Artificial Sequence
  Synthetic oligonucleotide; TGG chr11 5265776 5265795 5265779 -
gtccttagcctactttttat

SEQ ID NO: 44168 - DNA, 20 bp, Artificial Sequence
  Synthetic oligonucleotide; GGG chr11 5265775 5265794 5265778 -
tccttagcctactttttatt

SEQ ID NO: 44169 - DNA, 20 bp, Artificial Sequence
  Synthetic oligonucleotide; TAG chr11 5265732 5265751 5265735 -
taatctatttgtgttcattt

SEQ ID NO: 44170 - DNA, 20 bp, Artificial Sequence
  Synthetic oligonucleotide; GAG chr11 5265730 5265749 5265733 -
atctatttgtgttcatttta

SEQ ID NO: 44171 - DNA, 20 bp, Artificial Sequence
  Synthetic oligonucleotide; TGG chr11 5265725 5265744 5265728 -
tttgtgttcattttagagcc

SEQ ID NO: 44172 - DNA, 20 bp, Artificial Sequence
  Synthetic oligonucleotide; CAG chr11 5265707 5265726 5265710 -
cctggatattattcttttgt

SEQ ID NO: 44173 - DNA, 20 bp, Artificial Sequence
  Synthetic oligonucleotide; TAG chr11 5265699 5265718 5265702 -
ttattcttttgtcagatgta

SEQ ID NO: 44174 - DNA, 20 bp, Artificial Sequence
  Synthetic oligonucleotide; AAG chr11 5265690 5265709 5265693 -
tgtcagatgtatagattgtg

SEQ ID NO: 44175 - DNA, 20 bp, Artificial Sequence
  Synthetic oligonucleotide; TGG chr11 5265671 5265690 5265674 -
gaagattttctcccactctg

SEQ ID NO: 44176 - DNA, 20 bp, Artificial Sequence
  Synthetic oligonucleotide; GGG chr11 5265670 5265689 5265673 -
aagattttctcccactctgt

SEQ ID NO: 44177 - DNA, 20 bp, Artificial Sequence
  Synthetic oligonucleotide; CAG chr11 5265651 5265670 5265654 -
tgggttgtctgtttattctg

SEQ ID NO: 44178 - DNA, 20 bp, Artificial Sequence
  Synthetic oligonucleotide; AAG chr11 5265627 5265646 5265630 -
ctcttccttttgccatgcaa

SEQ ID NO: 44179 - DNA, 20 bp, Artificial Sequence
  Synthetic oligonucleotide; TAG chr11 5265619 5265638 5265622 -
tttgccatgcaaaagctctt

SEQ ID NO: 44180 - DNA, 20 bp, Artificial Sequence
  Synthetic oligonucleotide; TAG chr11 5265609 5265628 5265612 -
aaaagctctttagtttaatt

SEQ ID NO: 44181 - DNA, 20 bp, Artificial Sequence
  Synthetic oligonucleotide; CAG chr11 5265603 5265622 5265606 -
tctttagtttaatttagtcc

SEQ ID NO: 44182 - DNA, 20 bp, Artificial Sequence
  Synthetic oligonucleotide; TGG chr11 5265562 5265581 5265565 -
tgtatttgcatttgtgttct

SEQ ID NO: 44183 - DNA, 20 bp, Artificial Sequence
  Synthetic oligonucleotide; AAG chr11 5265542 5265561 5265545 -
tggtcatgaaatcctttcct

SEQ ID NO: 44184 - DNA, 20 bp, Artificial Sequence
  Synthetic oligonucleotide; TAG chr11 5265531 5265550 5265534 -
tcctttcctaagccaatgtg

SEQ ID NO: 44185 - DNA, 20 bp, Artificial Sequence
  Synthetic oligonucleotide; AAG chr11 5265528 5265547 5265531 -
tttcctaagccaatgtgtag

SEQ ID NO: 44186 - DNA, 20 bp, Artificial Sequence
  Synthetic oligonucleotide; AGG chr11 5265527 5265546 5265530 -
ttcctaagccaatgtgtaga

SEQ ID NO: 44187 - DNA, 20 bp, Artificial Sequence
  Synthetic oligonucleotide; GGG chr11 5265526 5265545 5265529 -
tcctaagccaatgtgtagaa

SEQ ID NO: 44188 - DNA, 20 bp, Artificial Sequence
  Synthetic oligonucleotide; TAG chr11 5265504 5265523 5265507 -
gtttttccgatgttattttc

SEQ ID NO: 44189 - DNA, 20 bp, Artificial Sequence
  Synthetic oligonucleotide; CAG chr11 5265493 5265512 5265496 -
gttattttctagaattgtta

SEQ ID NO: 44190 - DNA, 20 bp, Artificial Sequence
  Synthetic oligonucleotide; CAG chr11 5265487 5265506 5265490 -
ttctagaattgttacagttt

SEQ ID NO: 44191 - DNA, 20 bp, Artificial Sequence
  Synthetic oligonucleotide; AGG chr11 5265486 5265505 5265489 -
tctagaattgttacagtttc

SEQ ID NO: 44192 - DNA, 20 bp, Artificial Sequence
  Synthetic oligonucleotide; GGG chr11 5265485 5265504 5265488 -
ctagaattgttacagtttca

SEQ ID NO: 44193 - DNA, 20 bp, Artificial Sequence
  Synthetic oligonucleotide; TAG chr11 5265480 5265499 5265483 -
attgttacagtttcagggct

SEQ ID NO: 44194 - DNA, 20 bp, Artificial Sequence
  Synthetic oligonucleotide; AAG chr11 5265473 5265492 5265476 -
cagtttcagggcttagattt

SEQ ID NO: 44195 - DNA, 20 bp, Artificial Sequence
  Synthetic oligonucleotide; GAG chr11 5265455 5265474 5265458 -
ttaagtccttgatccatctt

SEQ ID NO: 44196 - DNA, 20 bp, Artificial Sequence
  Synthetic oligonucleotide; AAG chr11 5265439 5265458 5265442 -
tcttgagttgatttttgtat

SEQ ID NO: 44197 - DNA, 20 bp, Artificial Sequence
  Synthetic oligonucleotide; AGG chr11 5265438 5265457 5265441 -
cttgagttgatttttgtata

SEQ ID NO: 44198 - DNA, 20 bp, Artificial Sequence
  Synthetic oligonucleotide; GAG chr11 5265434 5265453 5265437 -
agttgatttttgtataaggt

SEQ ID NO: 44199 - DNA, 20 bp, Artificial Sequence
  Synthetic oligonucleotide; GAG chr11 5265432 5265451 5265435 -
ttgatttttgtataaggtga

SEQ ID NO: 44200 - DNA, 20 bp, Artificial Sequence
  Synthetic oligonucleotide; AAG chr11 5265426 5265445 5265429 -
tttgtataaggtgagagatg

SEQ ID NO: 44201 - DNA, 20 bp, Artificial Sequence
  Synthetic oligonucleotide; CAG chr11 5265420 5265439 5265423 -
taaggtgagagatgaagatc

SEQ ID NO: 44202 - DNA, 20 bp, Artificial Sequence
  Synthetic oligonucleotide; TAG chr11 5265400 5265419 5265403 -
cagtttcattctcctacatg

SEQ ID NO: 44203 - DNA, 20 bp, Artificial Sequence
  Synthetic oligonucleotide; CAG chr11 5265392 5265411 5265395 -
ttctcctacatgtagcttgc

SEQ ID NO: 44204 - DNA, 20 bp, Artificial Sequence
  Synthetic oligonucleotide; TAG chr11 5265366 5265385 5265369 -
tccccgcaccatttgttgaa

SEQ ID NO: 44205 - DNA, 20 bp, Artificial Sequence
  Synthetic oligonucleotide; AGG chr11 5265365 5265384 5265368 -
ccccgcaccatttgttgaat

SEQ ID NO: 44206 - DNA, 20 bp, Artificial Sequence
  Synthetic oligonucleotide; GGG chr11 5265364 5265383 5265367 -
cccgcaccatttgttgaata

SEQ ID NO: 44207 - DNA, 20 bp, Artificial Sequence
  Synthetic oligonucleotide; AAG chr11 5265323 5265342 5265326 -
tgtttttgtttgctttgtca

SEQ ID NO: 44208 - DNA, 20 bp, Artificial Sequence
  Synthetic oligonucleotide; CAG chr11 5265318 5265337 5265321 -
ttgtttgctttgtcaaagat

SEQ ID NO: 44209 - DNA, 20 bp, Artificial Sequence
  Synthetic oligonucleotide; TGG chr11 5265314 5265333 5265317 -
ttgctttgtcaaagatcagt

SEQ ID NO: 44210 - DNA, 20 bp, Artificial Sequence
  Synthetic oligonucleotide; AAG chr11 5265307 5265326 5265310 -
gtcaaagatcagttggatgt

SEQ ID NO: 44211 - DNA, 20 bp, Artificial Sequence
  Synthetic oligonucleotide; GAG chr11 5265299 5265318 5265302 -
tcagttggatgtaagtattt

SEQ ID NO: 44212 - DNA, 20 bp, Artificial Sequence
  Synthetic oligonucleotide; TGG chr11 5265288 5265307 5265291 -
taagtatttgagtttatttc

SEQ ID NO: 44213 - DNA, 20 bp, Artificial Sequence
  Synthetic oligonucleotide; GGG chr11 5265287 5265306 5265290 -
aagtatttgagtttatttct

SEQ ID NO: 44214 - DNA, 20 bp, Artificial Sequence
  Synthetic oligonucleotide; TGG chr11 5265266 5265285 5265269 -
ggttctctattctgttccat

SEQ ID NO: 44215 - DNA, 20 bp, Artificial Sequence
  Synthetic oligonucleotide; CAG chr11 5265242 5265261 5265245 -
cgatgtgcctatttgtacac

SEQ ID NO: 44216 - DNA, 20 bp, Artificial Sequence
  Synthetic oligonucleotide; TGG chr11 5265226 5265245 5265229 -
acaccagcatcatgctgttt

SEQ ID NO: 44217 - DNA, 20 bp, Artificial Sequence
  Synthetic oligonucleotide; TGG chr11 5265217 5265236 5265220 -
tcatgctgttttggtgacta

SEQ ID NO: 44218 - DNA, 20 bp, Artificial Sequence
  Synthetic oligonucleotide; TAG chr11 5265204 5265223 5265207 -
gtgactatggccttattgta

SEQ ID NO: 44219 - DNA, 20 bp, Artificial Sequence
  Synthetic oligonucleotide; GAG chr11 5265193 5265212 5265196 -
cttattgtatagtttgaaat

SEQ ID NO: 44220 - DNA, 20 bp, Artificial Sequence
  Synthetic oligonucleotide; AGG chr11 5265192 5265211 5265195 -
ttattgtatagtttgaaatg

SEQ ID NO: 44221 - DNA, 20 bp, Artificial Sequence
  Synthetic oligonucleotide; CAG chr11 5265175 5265194 5265178 -
atgaggtaatgtaatgcctt

SEQ ID NO: 44222 - DNA, 20 bp, Artificial Sequence
  Synthetic oligonucleotide; TAG chr11 5265157 5265176 5265160 -
ttcagatttgttcttttttt

SEQ ID NO: 44223 - DNA, 20 bp, Artificial Sequence
  Synthetic oligonucleotide; TGG chr11 5265140 5265159 5265143 -
ttttagacttgcttgtttat

SEQ ID NO: 44224 - DNA, 20 bp, Artificial Sequence
  Synthetic oligonucleotide; GGG chr11 5265139 5265158 5265142 -
tttagacttgcttgtttatt

SEQ ID NO: 44225 - DNA, 20 bp, Artificial Sequence
  Synthetic oligonucleotide; TGG chr11 5265128 5265147 5265131 -
ttgtttattgggctcttttt

SEQ ID NO: 44226 - DNA, 20 bp, Artificial Sequence
  Synthetic oligonucleotide; AAG chr11 5265119 5265138 5265122 -
gggctcttttttggttccat

SEQ ID NO: 44227 - DNA, 20 bp, Artificial Sequence
  Synthetic oligonucleotide; TAG chr11 5265111 5265130 5265114 -
ttttggttccataagaattt

SEQ ID NO: 44228 - DNA, 20 bp, Artificial Sequence
  Synthetic oligonucleotide; AGG chr11 5265110 5265129 5265113 -
tttggttccataagaatttt

SEQ ID NO: 44229 - DNA, 20 bp, Artificial Sequence
  Synthetic oligonucleotide; TAG chr11 5265096 5265115 5265099 -
aattttaggattgttttttc

SEQ ID NO: 44230 - DNA, 20 bp, Artificial Sequence
  Synthetic oligonucleotide; AAG chr11 5265086 5265105 5265089 -
ttgttttttctagttctgtg

SEQ ID NO: 44231 - DNA, 20 bp, Artificial Sequence
  Synthetic oligonucleotide; TGG chr11 5265078 5265097 5265081 -
tctagttctgtgaagactaa

SEQ ID NO: 44232 - DNA, 20 bp, Artificial Sequence
  Synthetic oligonucleotide; TGG chr11 5265075 5265094 5265078 -
agttctgtgaagactaatgg

SEQ ID NO: 44233 - DNA, 20 bp, Artificial Sequence
  Synthetic oligonucleotide; TGG chr11 5265064 5265083 5265067 -
gactaatggtggtattttga

SEQ ID NO: 44234 - DNA, 20 bp, Artificial Sequence
  Synthetic oligonucleotide; GGG chr11 5265063 5265082 5265066 -
actaatggtggtattttgat

SEQ ID NO: 44235 - DNA, 20 bp, Artificial Sequence
  Synthetic oligonucleotide; TAG chr11 5265044 5265063 5265047 -
tgggaattgcaatgaatttg

SEQ ID NO: 44236 - DNA, 20 bp, Artificial Sequence
  Synthetic oligonucleotide; AGG chr11 5265043 5265062 5265046 -
gggaattgcaatgaatttgt

SEQ ID NO: 44237 - DNA, 20 bp, Artificial Sequence
  Synthetic oligonucleotide; TGG chr11 5265033 5265052 5265036 -
atgaatttgtaggttgcttc

SEQ ID NO: 44238 - DNA, 20 bp, Artificial Sequence
  Synthetic oligonucleotide; TGG chr11 5265025 5265044 5265028 -
gtaggttgcttctggcatta

SEQ ID NO: 44239 - DNA, 20 bp, Artificial Sequence
  Synthetic oligonucleotide; GAG chr11 5264990 5265009 5264993 -
tattgattctacccatctat

SEQ ID NO: 44240 - DNA, 20 bp, Artificial Sequence
  Synthetic oligonucleotide; TGG chr11 5264985 5265004 5264988 -
attctacccatctatgagaa

SEQ ID NO: 44241 - DNA, 20 bp, Artificial Sequence
  Synthetic oligonucleotide; CAG chr11 5264943 5264962 5264946 -
gtgtcttatatgattacttt

SEQ ID NO: 44242 - DNA, 20 bp, Artificial Sequence
  Synthetic oligonucleotide; TAG chr11 5264930 5264949 5264933 -
ttactttcagccgtgttttg

SEQ ID NO: 44243 - DNA, 20 bp, Artificial Sequence
  Synthetic oligonucleotide; TAG chr11 5264918 5264937 5264921 -
gtgttttgtagttttccttg

SEQ ID NO: 44244 - DNA, 20 bp, Artificial Sequence
  Synthetic oligonucleotide; TGG chr11 5264899 5264918 5264902 -
gtagatgtctttcacctcct

SEQ ID NO: 44245 - DNA, 20 bp, Artificial Sequence
  Synthetic oligonucleotide; TAG chr11 5264895 5264914 5264898 -
atgtctttcacctccttggt

SEQ ID NO: 44246 - DNA, 20 bp, Artificial Sequence
  Synthetic oligonucleotide; AGG chr11 5264894 5264913 5264897 -
tgtctttcacctccttggtt

SEQ ID NO: 44247 - DNA, 20 bp, Artificial Sequence
  Synthetic oligonucleotide; AAG chr11 5264880 5264899 5264883 -
ttggttaggtatatattcct

SEQ ID NO: 44248 - DNA, 20 bp, Artificial Sequence
  Synthetic oligonucleotide; CAG chr11 5264849 5264868 5264852 -
ttgttttgttttgttttttg

SEQ ID NO: 44249 - DNA, 20 bp, Artificial Sequence
  Synthetic oligonucleotide; AAG chr11 5264837 5264856 5264840 -
gttttttgcagctattgtaa

SEQ ID NO: 44250 - DNA, 20 bp, Artificial Sequence
  Synthetic oligonucleotide; AGG chr11 5264836 5264855 5264839 -
ttttttgcagctattgtaaa

SEQ ID NO: 44251 - DNA, 20 bp, Artificial Sequence
  Synthetic oligonucleotide; GGG chr11 5264835 5264854 5264838 -
tttttgcagctattgtaaaa

SEQ ID NO: 44252 - DNA, 20 bp, Artificial Sequence
  Synthetic oligonucleotide; GGG chr11 5264834 5264853 5264837 -
ttttgcagctattgtaaaag

SEQ ID NO: 44253 - DNA, 20 bp, Artificial Sequence
  Synthetic oligonucleotide; GAG chr11 5264829 5264848 5264832 -
cagctattgtaaaaggggtt

SEQ ID NO: 44254 - DNA, 20 bp, Artificial Sequence
  Synthetic oligonucleotide; CAG chr11 5264810 5264829 5264813 -
tgagttcttgattttattct

SEQ ID NO: 44255 - DNA, 20 bp, Artificial Sequence
  Synthetic oligonucleotide; TGG chr11 5264805 5264824 5264808 -
tcttgattttattctcagct

SEQ ID NO: 44256 - DNA, 20 bp, Artificial Sequence
  Synthetic oligonucleotide; TGG chr11 5264795 5264814 5264798 -
attctcagcttggtcattgc

SEQ ID NO: 44257 - DNA, 20 bp, Artificial Sequence
  Synthetic oligonucleotide; AAG chr11 5264787 5264806 5264790 -
cttggtcattgctggtatgt

SEQ ID NO: 44258 - DNA, 20 bp, Artificial Sequence
  Synthetic oligonucleotide; AAG chr11 5264783 5264802 5264786 -
gtcattgctggtatgtaaga

SEQ ID NO: 44259 - DNA, 20 bp, Artificial Sequence
  Synthetic oligonucleotide; TGG chr11 5264772 5264791 5264775 -
tatgtaagaaagcaactcat

SEQ ID NO: 44260 - DNA, 20 bp, Artificial Sequence
  Synthetic oligonucleotide; CAG chr11 5264750 5264769 5264753 -
gtgtacgttaattttgtatc

SEQ ID NO: 44261 - DNA, 20 bp, Artificial Sequence
  Synthetic oligonucleotide; CAG chr11 5264725 5264744 5264728 -
actttgctgaattattttat

SEQ ID NO: 44262 - DNA, 20 bp, Artificial Sequence
  Synthetic oligonucleotide; TAG chr11 5264719 5264738 5264722 -
ctgaattattttatcagttc

SEQ ID NO: 44263 - DNA, 20 bp, Artificial Sequence
  Synthetic oligonucleotide; AGG chr11 5264718 5264737 5264721 -
tgaattattttatcagttct

SEQ ID NO: 44264 - DNA, 20 bp, Artificial Sequence
  Synthetic oligonucleotide; GGG chr11 5264717 5264736 5264720 -
gaattattttatcagttcta

SEQ ID NO: 44265 - DNA, 20 bp, Artificial Sequence
  Synthetic oligonucleotide; GGG chr11 5264716 5264735 5264719 -
aattattttatcagttctag

SEQ ID NO: 44266 - DNA, 20 bp, Artificial Sequence
  Synthetic oligonucleotide; GGG chr11 5264715 5264734 5264718 -
attattttatcagttctagg

SEQ ID NO: 44267 - DNA, 20 bp, Artificial Sequence
  Synthetic oligonucleotide; TGG chr11 5264709 5264728 5264712 -
ttatcagttctagggggttt

SEQ ID NO: 44268 - DNA, 20 bp, Artificial Sequence
  Synthetic oligonucleotide; GAG chr11 5264707 5264726 5264710 -
atcagttctagggggttttg

SEQ ID NO: 44269 - DNA, 20 bp, Artificial Sequence
  Synthetic oligonucleotide; AGG chr11 5264706 5264725 5264709 -
tcagttctagggggttttgg

SEQ ID NO: 44270 - DNA, 20 bp, Artificial Sequence
  Synthetic oligonucleotide; GAG chr11 5264704 5264723 5264707 -
agttctagggggttttggag

SEQ ID NO: 44271 - DNA, 20 bp, Artificial Sequence
  Synthetic oligonucleotide; TAG chr11 5264697 5264716 5264700 -
gggggttttggaggagtctt

SEQ ID NO: 44272 - DNA, 20 bp, Artificial Sequence
  Synthetic oligonucleotide; GAG chr11 5264695 5264714 5264698 -
gggttttggaggagtcttta

SEQ ID NO: 44273 - DNA, 20 bp, Artificial Sequence
  Synthetic oligonucleotide; CAG chr11 5264667 5264686 5264670 -
tacatacacaatcatatcat

SEQ ID NO: 44274 - DNA, 20 bp, Artificial Sequence
  Synthetic oligonucleotide; CAG chr11 5264660 5264679 5264663 -
acaatcatatcatcagcaaa

SEQ ID NO: 44275 - DNA, 20 bp, Artificial Sequence
  Synthetic oligonucleotide; CAG chr11 5264654 5264673 5264657 -
atatcatcagcaaacagtga

SEQ ID NO: 44276 - DNA, 20 bp, Artificial Sequence
  Synthetic oligonucleotide; TGG chr11 5264629 5264648 5264632 -
tgactttctctttaacaatt

SEQ ID NO: 44277 - DNA, 20 bp, Artificial Sequence
  Synthetic oligonucleotide; TAG chr11 5264588 5264607 5264591 -
tcttgtctgattgctcttgc

SEQ ID NO: 44278 - DNA, 20 bp, Artificial Sequence
  Synthetic oligonucleotide; AGG chr11 5264587 5264606 5264590 -
cttgtctgattgctcttgct

SEQ ID NO: 44279 - DNA, 20 bp, Artificial Sequence
  Synthetic oligonucleotide; CAG chr11 5264579 5264598 5264582 -
attgctcttgctaggacttc

SEQ ID NO: 44280 - DNA, 20 bp, Artificial Sequence
  Synthetic oligonucleotide; AAG chr11 5264566 5264585 5264569 -
ggacttccagtaatatgtta

SEQ ID NO: 44281 - DNA, 20 bp, Artificial Sequence
  Synthetic oligonucleotide; GAG chr11 5264564 5264583 5264567 -
acttccagtaatatgttaaa

SEQ ID NO: 44282 - DNA, 20 bp, Artificial Sequence
  Synthetic oligonucleotide; AAG chr11 5264561 5264580 5264564 -
tccagtaatatgttaaagag

SEQ ID NO: 44283 - DNA, 20 bp, Artificial Sequence
  Synthetic oligonucleotide; TGG chr11 5264558 5264577 5264561 -
agtaatatgttaaagagaag

SEQ ID NO: 44284 - DNA, 20 bp, Artificial Sequence
  Synthetic oligonucleotide; GAG chr11 5264554 5264573 5264557 -
atatgttaaagagaagtggt

SEQ ID NO: 44285 - DNA, 20 bp, Artificial Sequence
  Synthetic oligonucleotide; GAG chr11 5264552 5264571 5264555 -
atgttaaagagaagtggtga

SEQ ID NO: 44286 - DNA, 20 bp, Artificial Sequence
  Synthetic oligonucleotide; TGG chr11 5264549 5264568 5264552 -
ttaaagagaagtggtgagag

SEQ ID NO: 44287 - DNA, 20 bp, Artificial Sequence
  Synthetic oligonucleotide; GGG chr11 5264548 5264567 5264551 -
taaagagaagtggtgagagt

SEQ ID NO: 44288 - DNA, 20 bp, Artificial Sequence
  Synthetic oligonucleotide; CAG chr11 5264529 5264548 5264532 -
tgggtatccttgtctcattc

SEQ ID NO: 44289 - DNA, 20 bp, Artificial Sequence
  Synthetic oligonucleotide; CAG chr11 5264522 5264541 5264525 -
ccttgtctcattccagtttt

SEQ ID NO: 44290 - DNA, 20 bp, Artificial Sequence
  Synthetic oligonucleotide; CAG chr11 5264518 5264537 5264521 -
gtctcattccagttttcaga

SEQ ID NO: 44291 - DNA, 20 bp, Artificial Sequence
  Synthetic oligonucleotide; TGG chr11 5264481 5264500 5264484 -
tttcccattcaatataatgt

SEQ ID NO: 44292 - DNA, 20 bp, Artificial Sequence
  Synthetic oligonucleotide; TAG chr11 5264464 5264483 5264467 -
tgttggctgtgtgtttacca

SEQ ID NO: 44293 - DNA, 20 bp, Artificial Sequence
  Synthetic oligonucleotide; TGG chr11 5264460 5264479 5264463 -
ggctgtgtgtttaccatagc

SEQ ID NO: 44294 - DNA, 20 bp, Artificial Sequence
  Synthetic oligonucleotide; GAG chr11 5264444 5264463 5264447 -
tagctggcttttattacatt

SEQ ID NO: 44295 - DNA, 20 bp, Artificial Sequence
  Synthetic oligonucleotide; AGG chr11 5264443 5264462 5264446 -
agctggcttttattacattg

SEQ ID NO: 44296 - DNA, 20 bp, Artificial Sequence
  Synthetic oligonucleotide; GAG chr11 5264414 5264433 5264417 -
ctttgtaaaccgattttgct

SEQ ID NO: 44297 - DNA, 20 bp, Artificial Sequence
  Synthetic oligonucleotide; TAG chr11 5264408 5264427 5264411 -
aaaccgattttgctgagttt

SEQ ID NO: 44298 - DNA, 20 bp, Artificial Sequence
  Synthetic oligonucleotide; AAG chr11 5264400 5264419 5264403 -
tttgctgagttttagtcata

SEQ ID NO: 44299 - DNA, 20 bp, Artificial Sequence
  Synthetic oligonucleotide; CAG chr11 5264375 5264394 5264378 -
atgttgaattttgttgaatg

SEQ ID NO: 44300 - DNA, 20 bp, Artificial Sequence
  Synthetic oligonucleotide; TGG chr11 5264366 5264385 5264369 -
tttgttgaatgcagtttctg

SEQ ID NO: 44301 - DNA, 20 bp, Artificial Sequence
  Synthetic oligonucleotide; GAG chr11 5264358 5264377 5264361 -
atgcagtttctgtggctatt

SEQ ID NO: 44302 - DNA, 20 bp, Artificial Sequence
  Synthetic oligonucleotide; TGG chr11 5264247 5264266 5264250 -
gcatgaaacccacttgatca

SEQ ID NO: 44303 - DNA, 20 bp, Artificial Sequence
  Synthetic oligonucleotide; GGG chr11 5264246 5264265 5264249 -
catgaaacccacttgatcat

SEQ ID NO: 44304 - DNA, 20 bp, Artificial Sequence
  Synthetic oligonucleotide; CGG chr11 5264229 5264248 5264232 -
catgggttttgatatgctgt

SEQ ID NO: 44305 - DNA, 20 bp, Artificial Sequence
  Synthetic oligonucleotide; TAG chr11 5264219 5264238 5264222 -
gatatgctgtcggatgctat

SEQ ID NO: 44306 - DNA, 20 bp, Artificial Sequence
  Synthetic oligonucleotide; TAG chr11 5264215 5264234 5264218 -
tgctgtcggatgctattagc

SEQ ID NO: 44307 - DNA, 20 bp, Artificial Sequence
  Synthetic oligonucleotide; AAG chr11 5264203 5264222 5264206 -
ctattagctagtattttgtc

SEQ ID NO: 44308 - DNA, 20 bp, Artificial Sequence
  Synthetic oligonucleotide; AGG chr11 5264202 5264221 5264205 -
tattagctagtattttgtca

SEQ ID NO: 44309 - DNA, 20 bp, Artificial Sequence
  Synthetic oligonucleotide; TGG chr11 5264195 5264214 5264198 -
tagtattttgtcaaggatgt

SEQ ID NO: 44310 - DNA, 20 bp, Artificial Sequence
  Synthetic oligonucleotide; CAG chr11 5264179 5264198 5264182 -
atgttggcatctatgttcat

SEQ ID NO: 44311 - DNA, 20 bp, Artificial Sequence
  Synthetic oligonucleotide; AGG chr11 5264178 5264197 5264181 -
tgttggcatctatgttcatc

SEQ ID NO: 44312 - DNA, 20 bp, Artificial Sequence
  Synthetic oligonucleotide; GGG chr11 5264177 5264196 5264180 -
gttggcatctatgttcatca

SEQ ID NO: 44313 - DNA, 20 bp, Artificial Sequence
  Synthetic oligonucleotide; TAG chr11 5264163 5264182 5264166 -
tcatcagggatattgatctg

SEQ ID NO: 44314 - DNA, 20 bp, Artificial Sequence
  Synthetic oligonucleotide; TGG chr11 5264147 5264166 5264150 -
tctgtagtgttttttttttt

SEQ ID NO: 44315 - DNA, 20 bp, Artificial Sequence
  Synthetic oligonucleotide; CAG chr11 5264131 5264150 5264134 -
tttttggttatgttctttcc

SEQ ID NO: 44316 - DNA, 20 bp, Artificial Sequence
  Synthetic oligonucleotide; TGG chr11 5264125 5264144 5264128 -
gttatgttctttcccagttt

SEQ ID NO: 44317 - DNA, 20 bp, Artificial Sequence
  Synthetic oligonucleotide; AAG chr11 5264118 5264137 5264121 -
tctttcccagttttggtatt

SEQ ID NO: 44318 - DNA, 20 bp, Artificial Sequence
  Synthetic oligonucleotide; AGG chr11 5264117 5264136 5264120 -
ctttcccagttttggtatta

SEQ ID NO: 44319 - DNA, 20 bp, Artificial Sequence
  Synthetic oligonucleotide; TGG chr11 5264108 5264127 5264111 -
ttttggtattaaggtgatac

SEQ ID NO: 44320 - DNA, 20 bp, Artificial Sequence
  Synthetic oligonucleotide; TAG chr11 5264100 5264119 5264103 -
ttaaggtgatactggcttca

SEQ ID NO: 44321 - DNA, 20 bp, Artificial Sequence
  Synthetic oligonucleotide; TAG chr11 5264090 5264109 5264093 -
actggcttcatagaatgatt

SEQ ID NO: 44322 - DNA, 20 bp, Artificial Sequence
  Synthetic oligonucleotide; AGG chr11 5264089 5264108 5264092 -
ctggcttcatagaatgattt

SEQ ID NO: 44323 - DNA, 20 bp, Artificial Sequence
  Synthetic oligonucleotide; GGG chr11 5264088 5264107 5264091 -
tggcttcatagaatgattta

SEQ ID NO: 44324 - DNA, 20 bp, Artificial Sequence
  Synthetic oligonucleotide; GAG chr11 5264086 5264105 5264089 -
gcttcatagaatgatttagg

SEQ ID NO: 44325 - DNA, 20 bp, Artificial Sequence
  Synthetic oligonucleotide; AGG chr11 5264085 5264104 5264088 -
cttcatagaatgatttaggg

SEQ ID NO: 44326 - DNA, 20 bp, Artificial Sequence
  Synthetic oligonucleotide; TAG chr11 5264061 5264080 5264064 -
ttctctctttctctatcttg

SEQ ID NO: 44327 - DNA, 20 bp, Artificial Sequence
  Synthetic oligonucleotide; TAG chr11 5264047 5264066 5264050 -
atcttgtagaatactgtcaa

SEQ ID NO: 44328 - DNA, 20 bp, Artificial Sequence
  Synthetic oligonucleotide; AGG chr11 5264046 5264065 5264049 -
tcttgtagaatactgtcaat

SEQ ID NO: 44329 - DNA, 20 bp, Artificial Sequence
  Synthetic oligonucleotide; TGG chr11 5264041 5264060 5264044 -
tagaatactgtcaataggat

SEQ ID NO: 44330 - DNA, 20 bp, Artificial Sequence
  Synthetic oligonucleotide; TGG chr11 5264016 5264035 5264019 -
tcaattcttctttgaatgtc

SEQ ID NO: 44331 - DNA, 20 bp, Artificial Sequence
  Synthetic oligonucleotide; TAG chr11 5264013 5264032 5264016 -
attcttctttgaatgtctgg

SEQ ID NO: 44332 - DNA, 20 bp, Artificial Sequence
  Synthetic oligonucleotide; CAG chr11 5264006 5264025 5264009 -
tttgaatgtctggtagaatt

SEQ ID NO: 44333 - DNA, 20 bp, Artificial Sequence
  Synthetic oligonucleotide; TGG chr11 5263990 5264009 5263993 -
aattcagctgtgaatctatc

SEQ ID NO: 44334 - DNA, 20 bp, Artificial Sequence
  Synthetic oligonucleotide; TGG chr11 5263984 5264003 5263987 -
gctgtgaatctatctggtcc

SEQ ID NO: 44335 - DNA, 20 bp, Artificial Sequence
  Synthetic oligonucleotide; TGG chr11 5263968 5263987 5263971 -
gtcctggacttttttgttgt

SEQ ID NO: 44336 - DNA, 20 bp, Artificial Sequence
  Synthetic oligonucleotide; CAG chr11 5263946 5263965 5263949 -
gtaaatttttattatcattt

SEQ ID NO: 44337 - DNA, 20 bp, Artificial Sequence
  Synthetic oligonucleotide; TGG chr11 5263927 5263946 5263930 -
tcagtcttgctgcttattac

SEQ ID NO: 44338 - DNA, 20 bp, Artificial Sequence
  Synthetic oligonucleotide; CAG chr11 5263918 5263937 5263921 -
ctgcttattactggtctgtt

SEQ ID NO: 44339 - DNA, 20 bp, Artificial Sequence
  Synthetic oligonucleotide; AGG chr11 5263917 5263936 5263920 -
tgcttattactggtctgttc

SEQ ID NO: 44340 - DNA, 20 bp, Artificial Sequence
  Synthetic oligonucleotide; GGG chr11 5263916 5263935 5263919 -
gcttattactggtctgttca

SEQ ID NO: 44341 - DNA, 20 bp, Artificial Sequence
  Synthetic oligonucleotide; AAG chr11 5263893 5263912 5263896 -
tatctaattcttcctgactt

SEQ ID NO: 44342 - DNA, 20 bp, Artificial Sequence
  Synthetic oligonucleotide; TAG chr11 5263889 5263908 5263892 -
taattcttcctgacttaagc

SEQ ID NO: 44343 - DNA, 20 bp, Artificial Sequence
  Synthetic oligonucleotide; GAG chr11 5263887 5263906 5263890 -
attcttcctgacttaagcta

SEQ ID NO: 44344 - DNA, 20 bp, Artificial Sequence
  Synthetic oligonucleotide; CAG chr11 5263871 5263890 5263874 -
gctagagccctgtatctttc

SEQ ID NO: 44345 - DNA, 20 bp, Artificial Sequence
  Synthetic oligonucleotide; AGG chr11 5263870 5263889 5263873 -
ctagagccctgtatctttcc

SEQ ID NO: 44346 - DNA, 20 bp, Artificial Sequence
  Synthetic oligonucleotide; TAG chr11 5263850 5263869 5263853 -
aggaattcgaacgtctcctt

SEQ ID NO: 44347 - DNA, 20 bp, Artificial Sequence
  Synthetic oligonucleotide; AGG chr11 5263849 5263868 5263852 -
ggaattcgaacgtctccttt

SEQ ID NO: 44348 - DNA, 20 bp, Artificial Sequence
  Synthetic oligonucleotide; TAG chr11 5263841 5263860 5263844 -
aacgtctcctttaggttttc

SEQ ID NO: 44349 - DNA, 20 bp, Artificial Sequence
  Synthetic oligonucleotide; AAG chr11 5263826 5263845 5263829 -
ttttctagtttatgcatgta

SEQ ID NO: 44350 - DNA, 20 bp, Artificial Sequence
  Synthetic oligonucleotide; AGG chr11 5263825 5263844 5263828 -
tttctagtttatgcatgtaa

SEQ ID NO: 44351 - DNA, 20 bp, Artificial Sequence
  Synthetic oligonucleotide; TAG chr11 5263816 5263835 5263819 -
tatgcatgtaaaggtgttca

SEQ ID NO: 44352 - DNA, 20 bp, Artificial Sequence
  Synthetic oligonucleotide; TAG chr11 5263813 5263832 5263816 -
gcatgtaaaggtgttcatag

SEQ ID NO: 44353 - DNA, 20 bp, Artificial Sequence
  Synthetic oligonucleotide; TGG chr11 5263785 5263804 5263788 -
aataatcttttgtatttctg

SEQ ID NO: 44354 - DNA, 20 bp, Artificial Sequence
  Synthetic oligonucleotide; CAG chr11 5263779 5263798 5263782 -
cttttgtatttctgtggtat

SEQ ID NO: 44355 - DNA, 20 bp, Artificial Sequence
  Synthetic oligonucleotide; TAG chr11 5263773 5263792 5263776 -
tatttctgtggtatcagtaa

SEQ ID NO: 44356 - DNA, 20 bp, Artificial Sequence
  Synthetic oligonucleotide; GAG chr11 5263747 5263766 5263750 -
ctcctgttttgtttctaatt

SEQ ID NO: 44357 - DNA, 20 bp, Artificial Sequence
  Synthetic oligonucleotide; TGG chr11 5263717 5263736 5263720 -
gcacttctctcctcttttct

SEQ ID NO: 44358 - DNA, 20 bp, Artificial Sequence
  Synthetic oligonucleotide; TGG chr11 5263701 5263720 5263704 -
ttcttggttaatcttgctaa

SEQ ID NO: 44359 - DNA, 20 bp, Artificial Sequence
  Synthetic oligonucleotide; CAG chr11 5263693 5263712 5263696 -
taatcttgctaatggtctat

SEQ ID NO: 44360 - DNA, 20 bp, Artificial Sequence
  Synthetic oligonucleotide; AAG chr11 5263673 5263692 5263676 -
cagttttatttatcttttca

SEQ ID NO: 44361 - DNA, 20 bp, Artificial Sequence
  Synthetic oligonucleotide; CAG chr11 5263667 5263686 5263670 -
tatttatcttttcaaagaac

SEQ ID NO: 44362 - DNA, 20 bp, Artificial Sequence
  Synthetic oligonucleotide; TAG chr11 5263650 5263669 5263653 -
aaccagctttttatttcatt

SEQ ID NO: 44363 - DNA, 20 bp, Artificial Sequence
  Synthetic oligonucleotide; CAG chr11 5263631 5263650 5263634 -
ttagcttttgtatttttttg

SEQ ID NO: 44364 - DNA, 20 bp, Artificial Sequence
  Synthetic oligonucleotide; TAG chr11 5263612 5263631 5263615 -
gcagttgttttaatttcatt

SEQ ID NO: 44365 - DNA, 20 bp, Artificial Sequence
  Synthetic oligonucleotide; TAG chr11 5263595 5263614 5263598 -
atttagttctcctcttatct

SEQ ID NO: 44366 - DNA, 20 bp, Artificial Sequence
  Synthetic oligonucleotide; TGG chr11 5263574 5263593 5263577 -
agttattccctttcttttgc

SEQ ID NO: 44367 - DNA, 20 bp, Artificial Sequence
  Synthetic oligonucleotide; GGG chr11 5263573 5263592 5263576 -
gttattccctttcttttgct

SEQ ID NO: 44368 - DNA, 20 bp, Artificial Sequence
  Synthetic oligonucleotide; TGG chr11 5263567 5263586 5263570 -
ccctttcttttgctgggttt

SEQ ID NO: 44369 - DNA, 20 bp, Artificial Sequence
  Synthetic oligonucleotide; TAG chr11 5263543 5263562 5263546 -
tctgtttgtttttgtttctc

SEQ ID NO: 44370 - DNA, 20 bp, Artificial Sequence
  Synthetic oligonucleotide; TGG chr11 5263533 5263552 5263536 -
tttgtttctctagtttcttg

SEQ ID NO: 44371 - DNA, 20 bp, Artificial Sequence
  Synthetic oligonucleotide; CAG chr11 5263499 5263518 5263502 -
attgtctgtctgtcctcttt

SEQ ID NO: 44372 - DNA, 20 bp, Artificial Sequence
  Synthetic oligonucleotide; TAG chr11 5263477 5263496 5263480 -
gactctttgacatcgacatt

SEQ ID NO: 44373 - DNA, 20 bp, Artificial Sequence
  Synthetic oligonucleotide; AGG chr11 5263476 5263495 5263479 -
actctttgacatcgacattt

SEQ ID NO: 44374 - DNA, 20 bp, Artificial Sequence
  Synthetic oligonucleotide; GGG chr11 5263475 5263494 5263478 -
ctctttgacatcgacattta

SEQ ID NO: 44375 - DNA, 20 bp, Artificial Sequence
  Synthetic oligonucleotide; TAG chr11 5263456 5263475 5263459 -
agggctgtgaactttccttt

SEQ ID NO: 44376 - DNA, 20 bp, Artificial Sequence
  Synthetic oligonucleotide; TAG chr11 5263434 5263453 5263437 -
gcaccatctttgctgtatcc

SEQ ID NO: 44377 - DNA, 20 bp, Artificial Sequence
  Synthetic oligonucleotide; GAG chr11 5263432 5263451 5263435 -
accatctttgctgtatccta

SEQ ID NO: 44378 - DNA, 20 bp, Artificial Sequence
  Synthetic oligonucleotide; AGG chr11 5263431 5263450 5263434 -
ccatctttgctgtatcctag

SEQ ID NO: 44379 - DNA, 20 bp, Artificial Sequence
  Synthetic oligonucleotide; TAG chr11 5263422 5263441 5263425 -
ctgtatcctagaggttttga

SEQ ID NO: 44380 - DNA, 20 bp, Artificial Sequence
  Synthetic oligonucleotide; AGG chr11 5263421 5263440 5263424 -
tgtatcctagaggttttgat

SEQ ID NO: 44381 - DNA, 20 bp, Artificial Sequence
  Synthetic oligonucleotide; CGG chr11 5263403 5263422 5263406 -
ataggttgtgtcactattgt

SEQ ID NO: 44382 - DNA, 20 bp, Artificial Sequence
  Synthetic oligonucleotide; CAG chr11 5263399 5263418 5263402 -
gttgtgtcactattgtcggt

SEQ ID NO: 44383 - DNA, 20 bp, Artificial Sequence
  Synthetic oligonucleotide; AAG chr11 5263393 5263412 5263396 -
tcactattgtcggtcagttc

SEQ ID NO: 44384 - DNA, 20 bp, Artificial Sequence
  Synthetic oligonucleotide; AAG chr11 5263364 5263383 5263367 -
tgttgttcttattatacttt

SEQ ID NO: 44385 - DNA, 20 bp, Artificial Sequence
  Synthetic oligonucleotide; TGG chr11 5263358 5263377 5263361 -
tcttattatactttaagttc

SEQ ID NO: 44386 - DNA, 20 bp, Artificial Sequence
  Synthetic oligonucleotide; GGG chr11 5263357 5263376 5263360 -
cttattatactttaagttct

SEQ ID NO: 44387 - DNA, 20 bp, Artificial Sequence
  Synthetic oligonucleotide; CAG chr11 5263345 5263364 5263348 -
taagttctgggatacatgtg

SEQ ID NO: 44388 - DNA, 20 bp, Artificial Sequence
  Synthetic oligonucleotide; CAG chr11 5263336 5263355 5263339 -
ggatacatgtgcagaatgtg

SEQ ID NO: 44389 - DNA, 20 bp, Artificial Sequence
  Synthetic oligonucleotide; AGG chr11 5263335 5263354 5263338 -
gatacatgtgcagaatgtgc

SEQ ID NO: 44390 - DNA, 20 bp, Artificial Sequence
  Synthetic oligonucleotide; TAG chr11 5263323 5263342 5263326 -
gaatgtgcaggtttgttaca

SEQ ID NO: 44391 - DNA, 20 bp, Artificial Sequence
  Synthetic oligonucleotide; AGG chr11 5263322 5263341 5263325 -
aatgtgcaggtttgttacat

SEQ ID NO: 44392 - DNA, 20 bp, Artificial Sequence
  Synthetic oligonucleotide; TAG chr11 5263317 5263336 5263320 -
gcaggtttgttacataggta

SEQ ID NO: 44393 - DNA, 20 bp, Artificial Sequence
  Synthetic oligonucleotide; TGG chr11 5263306 5263325 5263309 -
acataggtatagatgtgcca

SEQ ID NO: 44394 - DNA, 20 bp, Artificial Sequence
  Synthetic oligonucleotide; TGG chr11 5263303 5263322 5263306 -
taggtatagatgtgccatgg

SEQ ID NO: 44395 - DNA, 20 bp, Artificial Sequence
  Synthetic oligonucleotide; TAG chr11 5263269 5263288 5263272 -
catcaacctgtcatctacat

SEQ ID NO: 44396 - DNA, 20 bp, Artificial Sequence
  Synthetic oligonucleotide; AGG chr11 5263268 5263287 5263271 -
atcaacctgtcatctacatt

SEQ ID NO: 44397 - DNA, 20 bp, Artificial Sequence
  Synthetic oligonucleotide; CAG chr11 5263220 5263239 5263223 -
ctaaccccctcaccccccga

SEQ ID NO: 44398 - DNA, 20 bp, Artificial Sequence
  Synthetic oligonucleotide; AGG chr11 5263219 5263238 5263222 -
taaccccctcaccccccgac

SEQ ID NO: 44399 - DNA, 20 bp, Artificial Sequence
  Synthetic oligonucleotide; TGG chr11 5263213 5263232 5263216 -
cctcaccccccgacaggccc

SEQ ID NO: 44400 - DNA, 20 bp, Artificial Sequence
  Synthetic oligonucleotide; GAG chr11 5263154 5263173 5263157 -
attgttcaactcccacttat

SEQ ID NO: 44401 - DNA, 20 bp, Artificial Sequence
  Synthetic oligonucleotide; GAG chr11 5263150 5263169 5263153 -
ttcaactcccacttatgagt

SEQ ID NO: 44402 - DNA, 20 bp, Artificial Sequence
  Synthetic oligonucleotide; TGG chr11 5263141 5263160 5263144 -
cacttatgagtgagaacgtg

SEQ ID NO: 44403 - DNA, 20 bp, Artificial Sequence
  Synthetic oligonucleotide; TGG chr11 5263134 5263153 5263137 -
gagtgagaacgtgtggtgtt

SEQ ID NO: 44404 - DNA, 20 bp, Artificial Sequence
  Synthetic oligonucleotide; TAG chr11 5263114 5263133 5263117 -
tggtttctctgttcctgtgt

SEQ ID NO: 44405 - DNA, 20 bp, Artificial Sequence
  Synthetic oligonucleotide; CAG chr11 5263105 5263124 5263108 -
tgttcctgtgttagtttgct

SEQ ID NO: 44406 - DNA, 20 bp, Artificial Sequence
  Synthetic oligonucleotide; TGG chr11 5263097 5263116 5263100 -
tgttagtttgctcagaatga

SEQ ID NO: 44407 - DNA, 20 bp, Artificial Sequence
  Synthetic oligonucleotide; AAG chr11 5263068 5263087 5263071 -
ccttcatccatgtccctgca

SEQ ID NO: 44408 - DNA, 20 bp, Artificial Sequence
  Synthetic oligonucleotide; TGG chr11 5263045 5263064 5263048 -
acatgaactcatcattttta

SEQ ID NO: 44409 - DNA, 20 bp, Artificial Sequence
  Synthetic oligonucleotide; TAG chr11 5263037 5263056 5263040 -
tcatcatttttatggctgca

SEQ ID NO: 44410 - DNA, 20 bp, Artificial Sequence
  Synthetic oligonucleotide; TGG chr11 5263027 5263046 5263030 -
tatggctgcatagtattcca

SEQ ID NO: 44411 - DNA, 20 bp, Artificial Sequence
  Synthetic oligonucleotide; TGG chr11 5262984 5263003 5262987 -
tttatccattatatcgctga

SEQ ID NO: 44412 - DNA, 20 bp, Artificial Sequence
  Synthetic oligonucleotide; TGG chr11 5262976 5262995 5262979 -
ttatatcgctgatggccatt

SEQ ID NO: 44413 - DNA, 20 bp, Artificial Sequence
  Synthetic oligonucleotide; GGG chr11 5262975 5262994 5262978 -
tatatcgctgatggccattt

SEQ ID NO: 44414 - DNA, 20 bp, Artificial Sequence
  Synthetic oligonucleotide; TGG chr11 5262971 5262990 5262974 -
tcgctgatggccatttgggt

SEQ ID NO: 44415 - DNA, 20 bp, Artificial Sequence
  Synthetic oligonucleotide; AAG chr11 5262964 5262983 5262967 -
tggccatttgggttggttcc

SEQ ID NO: 44416 - DNA, 20 bp, Artificial Sequence
  Synthetic oligonucleotide; TAG chr11 5262945 5262964 5262948 -
caagtctttgctattgtgaa

SEQ ID NO: 44417 - DNA, 20 bp, Artificial Sequence
  Synthetic oligonucleotide; TAG chr11 5262908 5262927 5262911 -
tacgtgtgcacgtgtcttta

SEQ ID NO: 44418 - DNA, 20 bp, Artificial Sequence
  Synthetic oligonucleotide; TAG chr11 5262905 5262924 5262908 -
gtgtgcacgtgtctttatag

SEQ ID NO: 44419 - DNA, 20 bp, Artificial Sequence
  Synthetic oligonucleotide; TGG chr11 5262885 5262904 5262888 -
tagaatgatttctaattctt

SEQ ID NO: 44420 - DNA, 20 bp, Artificial Sequence
  Synthetic oligonucleotide; GGG chr11 5262884 5262903 5262887 -
agaatgatttctaattcttt

SEQ ID NO: 44421 - DNA, 20 bp, Artificial Sequence
  Synthetic oligonucleotide; CAG chr11 5262873 5262892 5262876 -
taattctttgggtatatacc

SEQ ID NO: 44422 - DNA, 20 bp, Artificial Sequence
  Synthetic oligonucleotide; TGG chr11 5262867 5262886 5262870 -
tttgggtatatacccagtaa

SEQ ID NO: 44423 - DNA, 20 bp, Artificial Sequence
  Synthetic oligonucleotide; GGG chr11 5262866 5262885 5262869 -
ttgggtatatacccagtaat

SEQ ID NO: 44424 - DNA, 20 bp, Artificial Sequence
  Synthetic oligonucleotide; TGG chr11 5262858 5262877 5262861 -
atacccagtaatgggattgc

SEQ ID NO: 44425 - DNA, 20 bp, Artificial Sequence
  Synthetic oligonucleotide; GGG chr11 5262857 5262876 5262860 -
tacccagtaatgggattgct

SEQ ID NO: 44426 - DNA, 20 bp, Artificial Sequence
  Synthetic oligonucleotide; CAG chr11 5262849 5262868 5262852 -
aatgggattgctgggtcaaa

SEQ ID NO: 44427 - DNA, 20 bp, Artificial Sequence
  Synthetic oligonucleotide; TGG chr11 5262840 5262859 5262843 -
gctgggtcaaacagtatttc

SEQ ID NO: 44428 - DNA, 20 bp, Artificial Sequence
  Synthetic oligonucleotide; TAG chr11 5262834 5262853 5262837 -
tcaaacagtatttctggttc

SEQ ID NO: 44429 - DNA, 20 bp, Artificial Sequence
  Synthetic oligonucleotide; GAG chr11 5262825 5262844 5262828 -
atttctggttctagatcctt

SEQ ID NO: 44430 - DNA, 20 bp, Artificial Sequence
  Synthetic oligonucleotide; AGG chr11 5262824 5262843 5262827 -
tttctggttctagatccttg

SEQ ID NO: 44431 - DNA, 20 bp, Artificial Sequence
  Synthetic oligonucleotide; TGG chr11 5262798 5262817 5262801 -
cgccacactgtcttccacaa

SEQ ID NO: 44432 - DNA, 20 bp, Artificial Sequence
  Synthetic oligonucleotide; CAG chr11 5262770 5262789 5262773 -
ctaatttacacacccatcaa

SEQ ID NO: 44433 - DNA, 20 bp, Artificial Sequence
  Synthetic oligonucleotide; CAG chr11 5262734 5262753 5262737 -
ctattcttccacatcctctc

SEQ ID NO: 44434 - DNA, 20 bp, Artificial Sequence
  Synthetic oligonucleotide; TGG chr11 5262690 5262709 5262693 -
ttaataattgccattctaac

SEQ ID NO: 44435 - DNA, 20 bp, Artificial Sequence
  Synthetic oligonucleotide; GAG chr11 5262684 5262703 5262687 -
attgccattctaactggcat

SEQ ID NO: 44436 - DNA, 20 bp, Artificial Sequence
  Synthetic oligonucleotide; TGG chr11 5262680 5262699 5262683 -
ccattctaactggcatgaga

SEQ ID NO: 44437 - DNA, 20 bp, Artificial Sequence
  Synthetic oligonucleotide; TGG chr11 5262667 5262686 5262670 -
catgagatggtatctcattg

SEQ ID NO: 44438 - DNA, 20 bp, Artificial Sequence
  Synthetic oligonucleotide; CAG chr11 5262639 5262658 5262642 -
atttgcatttctctaatgac

SEQ ID NO: 44439 - DNA, 20 bp, Artificial Sequence
  Synthetic oligonucleotide; GAG chr11 5262629 5262648 5262632 -
ctctaatgaccagtgatgat

SEQ ID NO: 44440 - DNA, 20 bp, Artificial Sequence
  Synthetic oligonucleotide; TGG chr11 5262607 5262626 5262610 -
gcttcttttcatgtgtttct

SEQ ID NO: 44441 - DNA, 20 bp, Artificial Sequence
  Synthetic oligonucleotide; TAG chr11 5262586 5262605 5262589 -
ggccacataaatgacttctt

SEQ ID NO: 44442 - DNA, 20 bp, Artificial Sequence
  Synthetic oligonucleotide; GAG chr11 5262584 5262603 5262587 -
ccacataaatgacttcttta

SEQ ID NO: 44443 - DNA, 20 bp, Artificial Sequence
  Synthetic oligonucleotide; AAG chr11 5262581 5262600 5262584 -
cataaatgacttctttagag

SEQ ID NO: 44444 - DNA, 20 bp, Artificial Sequence
  Synthetic oligonucleotide; TGG chr11 5262547 5262566 5262550 -
atcctttgtccactttttga

SEQ ID NO: 44445 - DNA, 20 bp, Artificial Sequence
  Synthetic oligonucleotide; GGG chr11 5262546 5262565 5262549 -
tcctttgtccactttttgat

SEQ ID NO: 44446 - DNA, 20 bp, Artificial Sequence
  Synthetic oligonucleotide; GGG chr11 5262545 5262564 5262548 -
cctttgtccactttttgatg

SEQ ID NO: 44447 - DNA, 20 bp, Artificial Sequence
  Synthetic oligonucleotide; TAG chr11 5262538 5262557 5262541 -
ccactttttgatggggtcgt

SEQ ID NO: 44448 - DNA, 20 bp, Artificial Sequence
  Synthetic oligonucleotide; AGG chr11 5262537 5262556 5262540 -
cactttttgatggggtcgtt

SEQ ID NO: 44449 - DNA, 20 bp, Artificial Sequence
  Synthetic oligonucleotide; AAG chr11 5262513 5262532 5262516 -
tttttcttgtaaatttgttg

SEQ ID NO: 44450 - DNA, 20 bp, Artificial Sequence
  Synthetic oligonucleotide; TAG chr11 5262503 5262522 5262506 -
aaatttgttgaagttctttg

SEQ ID NO: 44451 - DNA, 20 bp, Artificial Sequence
  Synthetic oligonucleotide; TGG chr11 5262496 5262515 5262499 -
ttgaagttctttgtagattt

SEQ ID NO: 44452 - DNA, 20 bp, Artificial Sequence
  Synthetic oligonucleotide; TAG chr11 5262489 5262508 5262492 -
tctttgtagattttggatgt

SEQ ID NO: 44453 - DNA, 20 bp, Artificial Sequence
  Synthetic oligonucleotide; CAG chr11 5262478 5262497 5262481 -
tttggatgttagccctttgt

SEQ ID NO: 44454 - DNA, 20 bp, Artificial Sequence
  Synthetic oligonucleotide; TGG chr11 5262474 5262493 5262477 -
gatgttagccctttgtcaga

SEQ ID NO: 44455 - DNA, 20 bp, Artificial Sequence
  Synthetic oligonucleotide; TAG chr11 5262470 5262489 5262473 -
ttagccctttgtcagatgga

SEQ ID NO: 44456 - DNA, 20 bp, Artificial Sequence
  Synthetic oligonucleotide; TAG chr11 5262442 5262461 5262445 -
aaaaattttctcccattctg

SEQ ID NO: 44457 - DNA, 20 bp, Artificial Sequence
  Synthetic oligonucleotide; AGG chr11 5262441 5262460 5262444 -
aaaattttctcccattctgt

SEQ ID NO: 44458 - DNA, 20 bp, Artificial Sequence
  Synthetic oligonucleotide; TAG chr11 5262418 5262437 5262421 -
ttgcctgttcactctgatga

SEQ ID NO: 44459 - DNA, 20 bp, Artificial Sequence
  Synthetic oligonucleotide; CAG chr11 5262403 5262422 5262406 -
gatgatagtcttttgctgtg

SEQ ID NO: 44460 - DNA, 20 bp, Artificial Sequence
  Synthetic oligonucleotide; AAG chr11 5262400 5262419 5262403 -
gatagtcttttgctgtgcag

SEQ ID NO: 44461 - DNA, 20 bp, Artificial Sequence
  Synthetic oligonucleotide; TAG chr11 5262392 5262411 5262395 -
tttgctgtgcagaagctctt

SEQ ID NO: 44462 - DNA, 20 bp, Artificial Sequence
  Synthetic oligonucleotide; TAG chr11 5262383 5262402 5262386 -
cagaagctctttagtttaat

SEQ ID NO: 44463 - DNA, 20 bp, Artificial Sequence
  Synthetic oligonucleotide; TGG chr11 5262363 5262382 5262366 -
tagatcccatatgtcaattt

SEQ ID NO: 44464 - DNA, 20 bp, Artificial Sequence
  Synthetic oligonucleotide; TAG chr11 5262333 5262352 5262336 -
tgtcattgcttttgatgttt

SEQ ID NO: 44465 - DNA, 20 bp, Artificial Sequence
  Synthetic oligonucleotide; TGG chr11 5262298 5262317 5262301 -
gcccatgcctatgtcctgaa

SEQ ID NO: 44466 - DNA, 20 bp, Artificial Sequence
  Synthetic oligonucleotide; TAG chr11 5262288 5262307 5262291 -
atgtcctgaatggtattgcc

SEQ ID NO: 44467 - DNA, 20 bp, Artificial Sequence
  Synthetic oligonucleotide; AGG chr11 5262287 5262306 5262290 -
tgtcctgaatggtattgcct

SEQ ID NO: 44468 - DNA, 20 bp, Artificial Sequence
  Synthetic oligonucleotide; TAG chr11 5262276 5262295 5262279 -
gtattgcctaggttatcttc

SEQ ID NO: 44469 - DNA, 20 bp, Artificial Sequence
  Synthetic oligonucleotide; AGG chr11 5262275 5262294 5262278 -
tattgcctaggttatcttct

SEQ ID NO: 44470 - DNA, 20 bp, Artificial Sequence
  Synthetic oligonucleotide; TGG chr11 5262265 5262284 5262268 -
gttatcttctaggattttta

SEQ ID NO: 44471 - DNA, 20 bp, Artificial Sequence
  Synthetic oligonucleotide; TAG chr11 5262259 5262278 5262262 -
ttctaggatttttatggttt

SEQ ID NO: 44472 - DNA, 20 bp, Artificial Sequence
  Synthetic oligonucleotide; AGG chr11 5262258 5262277 5262261 -
tctaggatttttatggtttt

SEQ ID NO: 44473 - DNA, 20 bp, Artificial Sequence
  Synthetic oligonucleotide; AAG chr11 5262245 5262264 5262248 -
tggttttaggttgcacattt

SEQ ID NO: 44474 - DNA, 20 bp, Artificial Sequence
  Synthetic oligonucleotide; GAG chr11 5262227 5262246 5262230 -
ttaagtctttaatccacctt

SEQ ID NO: 44475 - DNA, 20 bp, Artificial Sequence
  Synthetic oligonucleotide; AAG chr11 5262211 5262230 5262214 -
ccttgagttaatttttgtat

SEQ ID NO: 44476 - DNA, 20 bp, Artificial Sequence
  Synthetic oligonucleotide; AGG chr11 5262210 5262229 5262213 -
cttgagttaatttttgtata

SEQ ID NO: 44477 - DNA, 20 bp, Artificial Sequence
  Synthetic oligonucleotide; AAG chr11 5262204 5262223 5262207 -
ttaatttttgtataaggtgt

SEQ ID NO: 44478 - DNA, 20 bp, Artificial Sequence
  Synthetic oligonucleotide; AGG chr11 5262203 5262222 5262206 -
taatttttgtataaggtgta

SEQ ID NO: 44479 - DNA, 20 bp, Artificial Sequence
  Synthetic oligonucleotide; AAG chr11 5262200 5262219 5262203 -
tttttgtataaggtgtaagg

SEQ ID NO: 44480 - DNA, 20 bp, Artificial Sequence
  Synthetic oligonucleotide; AGG chr11 5262199 5262218 5262202 -
ttttgtataaggtgtaagga

SEQ ID NO: 44481 - DNA, 20 bp, Artificial Sequence
  Synthetic oligonucleotide; GGG chr11 5262198 5262217 5262201 -
tttgtataaggtgtaaggaa

SEQ ID NO: 44482 - DNA, 20 bp, Artificial Sequence
  Synthetic oligonucleotide; GGG chr11 5262197 5262216 5262200 -
ttgtataaggtgtaaggaag

SEQ ID NO: 44483 - DNA, 20 bp, Artificial Sequence
  Synthetic oligonucleotide; CAG chr11 5262192 5262211 5262195 -
taaggtgtaaggaaggggta

SEQ ID NO: 44484 - DNA, 20 bp, Artificial Sequence
  Synthetic oligonucleotide; CAG chr11 5262186 5262205 5262189 -
gtaaggaaggggtacagttt

SEQ ID NO: 44485 - DNA, 20 bp, Artificial Sequence
  Synthetic oligonucleotide; TAG chr11 5262168 5262187 5262171 -
ttcagttttatgcatattgc

SEQ ID NO: 44486 - DNA, 20 bp, Artificial Sequence
  Synthetic oligonucleotide; CAG chr11 5262164 5262183 5262167 -
gttttatgcatattgctagc

SEQ ID NO: 44487 - DNA, 20 bp, Artificial Sequence
  Synthetic oligonucleotide; CAG chr11 5262155 5262174 5262158 -
atattgctagccagtttttc

SEQ ID NO: 44488 - DNA, 20 bp, Artificial Sequence
  Synthetic oligonucleotide; TAG chr11 5262138 5262157 5262141 -
ttccagcaccatttattaaa

SEQ ID NO: 44489 - DNA, 20 bp, Artificial Sequence
  Synthetic oligonucleotide; AGG chr11 5262137 5262156 5262140 -
tccagcaccatttattaaat

SEQ ID NO: 44490 - DNA, 20 bp, Artificial Sequence
  Synthetic oligonucleotide; GGG chr11 5262136 5262155 5262139 -
ccagcaccatttattaaata

SEQ ID NO: 44491 - DNA, 20 bp, Artificial Sequence
  Synthetic oligonucleotide; AAG chr11 5262099 5262118 5262102 -
tgcttttgtgatgtttgtca

SEQ ID NO: 44492 - DNA, 20 bp, Artificial Sequence
  Synthetic oligonucleotide; CAG chr11 5262094 5262113 5262097 -
ttgtgatgtttgtcaaagat

SEQ ID NO: 44493 - DNA, 20 bp, Artificial Sequence
  Synthetic oligonucleotide; TGG chr11 5262090 5262109 5262093 -
gatgtttgtcaaagatcaga

SEQ ID NO: 44494 - DNA, 20 bp, Artificial Sequence
  Synthetic oligonucleotide; TAG chr11 5262084 5262103 5262087 -
tgtcaaagatcagatggtcg

SEQ ID NO: 44495 - DNA, 20 bp, Artificial Sequence
  Synthetic oligonucleotide; TGG chr11 5262076 5262095 5262079 -
atcagatggtcgtagatgtg

SEQ ID NO: 44496 - DNA, 20 bp, Artificial Sequence
  Synthetic oligonucleotide; GAG chr11 5262063 5262082 5262066 -
agatgtgtggcattatttct

SEQ ID NO: 44497 - DNA, 20 bp, Artificial Sequence
  Synthetic oligonucleotide; AGG chr11 5262062 5262081 5262065 -
gatgtgtggcattatttctg

SEQ ID NO: 44498 - DNA, 20 bp, Artificial Sequence
  Synthetic oligonucleotide; TGG chr11 5262042 5262061 5262045 -
aggcttctgttctgttccac

SEQ ID NO: 44499 - DNA, 20 bp, Artificial Sequence
  Synthetic oligonucleotide; TGG chr11 5262024 5262043 5262027 -
actggtctatatatctgttt

SEQ ID NO: 44500 - DNA, 20 bp, Artificial Sequence
  Synthetic oligonucleotide; CAG chr11 5262018 5262037 5262021 -
ctatatatctgttttggtac

SEQ ID NO: 44501 - DNA, 20 bp, Artificial Sequence
  Synthetic oligonucleotide; TAG chr11 5261993 5262012 5261996 -
ccatgctgtttttgttactg

SEQ ID NO: 44502 - DNA, 20 bp, Artificial Sequence
  Synthetic oligonucleotide; TAG chr11 5261985 5262004 5261988 -
tttttgttactgtagccttg

SEQ ID NO: 44503 - DNA, 20 bp, Artificial Sequence
  Synthetic oligonucleotide; TAG chr11 5261980 5261999 5261983 -
gttactgtagccttgtagta

SEQ ID NO: 44504 - DNA, 20 bp, Artificial Sequence
  Synthetic oligonucleotide; AAG chr11 5261973 5261992 5261976 -
tagccttgtagtatagtttg

SEQ ID NO: 44505 - DNA, 20 bp, Artificial Sequence
  Synthetic oligonucleotide; CAG chr11 5261969 5261988 5261972 -
cttgtagtatagtttgaagt

SEQ ID NO: 44506 - DNA, 20 bp, Artificial Sequence
  Synthetic oligonucleotide; AGG chr11 5261968 5261987 5261971 -
ttgtagtatagtttgaagtc

SEQ ID NO: 44507 - DNA, 20 bp, Artificial Sequence
  Synthetic oligonucleotide; TAG chr11 5261965 5261984 5261968 -
tagtatagtttgaagtcagg

SEQ ID NO: 44508 - DNA, 20 bp, Artificial Sequence
  Synthetic oligonucleotide; CAG chr11 5261951 5261970 5261954 -
gtcaggtagcatcatgcctc

SEQ ID NO: 44509 - DNA, 20 bp, Artificial Sequence
  Synthetic oligonucleotide; TAG chr11 5261932 5261951 5261935 -
ccagctttgttctttttgtt

SEQ ID NO: 44510 - DNA, 20 bp, Artificial Sequence
  Synthetic oligonucleotide; AGG chr11 5261931 5261950 5261934 -
cagctttgttctttttgttt

SEQ ID NO: 44511 - DNA, 20 bp, Artificial Sequence
  Synthetic oligonucleotide; TGG chr11 5261921 5261940 5261924 -
ctttttgtttaggattgtct

SEQ ID NO: 44512 - DNA, 20 bp, Artificial Sequence
  Synthetic oligonucleotide; TGG chr11 5261913 5261932 5261916 -
ttaggattgtcttggctata

SEQ ID NO: 44513 - DNA, 20 bp, Artificial Sequence
  Synthetic oligonucleotide; GGG chr11 5261912 5261931 5261915 -
taggattgtcttggctatat

SEQ ID NO: 44514 - DNA, 20 bp, Artificial Sequence
  Synthetic oligonucleotide; AAG chr11 5261882 5261901 5261885 -
ttgattccatatgacattta

SEQ ID NO: 44515 - DNA, 20 bp, Artificial Sequence
  Synthetic oligonucleotide; TAG chr11 5261879 5261898 5261882 -
attccatatgacatttaaag

SEQ ID NO: 44516 - DNA, 20 bp, Artificial Sequence
  Synthetic oligonucleotide; AAG chr11 5261855 5261874 5261858 -
tttttctaattctttgaaaa

SEQ ID NO: 44517 - DNA, 20 bp, Artificial Sequence
  Synthetic oligonucleotide; CAG chr11 5261851 5261870 5261854 -
tctaattctttgaaaaaagt

SEQ ID NO: 44518 - DNA, 20 bp, Artificial Sequence
  Synthetic oligonucleotide; TGG chr11 5261848 5261867 5261851 -
aattctttgaaaaaagtcag

SEQ ID NO: 44519 - DNA, 20 bp, Artificial Sequence
  Synthetic oligonucleotide; TAG chr11 5261845 5261864 5261848 -
tctttgaaaaaagtcagtgg

SEQ ID NO: 44520 - DNA, 20 bp, Artificial Sequence
  Synthetic oligonucleotide; TGG chr11 5261837 5261856 5261840 -
aaaagtcagtggtagcttga

SEQ ID NO: 44521 - DNA, 20 bp, Artificial Sequence
  Synthetic oligonucleotide; GGG chr11 5261836 5261855 5261839 -
aaagtcagtggtagcttgat

SEQ ID NO: 44522 - DNA, 20 bp, Artificial Sequence
  Synthetic oligonucleotide; GGG chr11 5261835 5261854 5261838 -
aagtcagtggtagcttgatg

SEQ ID NO: 44523 - DNA, 20 bp, Artificial Sequence
  Synthetic oligonucleotide; TAG chr11 5261831 5261850 5261834 -
cagtggtagcttgatgggga

SEQ ID NO: 44524 - DNA, 20 bp, Artificial Sequence
  Synthetic oligonucleotide; TGG chr11 5261807 5261826 5261810 -
attgaatctataaattactt

SEQ ID NO: 44525 - DNA, 20 bp, Artificial Sequence
  Synthetic oligonucleotide; GGG chr11 5261806 5261825 5261809 -
ttgaatctataaattacttt

SEQ ID NO: 44526 - DNA, 20 bp, Artificial Sequence
  Synthetic oligonucleotide; CAG chr11 5261803 5261822 5261806 -
aatctataaattactttggg

SEQ ID NO: 44527 - DNA, 20 bp, Artificial Sequence
  Synthetic oligonucleotide; TGG chr11 5261798 5261817 5261801 -
ataaattactttgggcagta

SEQ ID NO: 44528 - DNA, 20 bp, Artificial Sequence
  Synthetic oligonucleotide; AAG chr11 5261787 5261806 5261790 -
tgggcagtatggccatttta

SEQ ID NO: 44529 - DNA, 20 bp, Artificial Sequence
  Synthetic oligonucleotide; GAG chr11 5261763 5261782 5261766 -
tattgattctttctatctat

SEQ ID NO: 44530 - DNA, 20 bp, Artificial Sequence
  Synthetic oligonucleotide; TGG chr11 5261758 5261777 5261761 -
attctttctatctatgagca

SEQ ID NO: 44531 - DNA, 20 bp, Artificial Sequence
  Synthetic oligonucleotide; GAG chr11 5261716 5261735 5261719 -
gtgtcctctcttatttcctt

SEQ ID NO: 44532 - DNA, 20 bp, Artificial Sequence
  Synthetic oligonucleotide; CAG chr11 5261713 5261732 5261716 -
tcctctcttatttccttgag

SEQ ID NO: 44533 - DNA, 20 bp, Artificial Sequence
  Synthetic oligonucleotide; GAG chr11 5261709 5261728 5261712 -
ctcttatttccttgagcagt

SEQ ID NO: 44534 - DNA, 20 bp, Artificial Sequence
  Synthetic oligonucleotide; TGG chr11 5261706 5261725 5261709 -
ttatttccttgagcagtgag

SEQ ID NO: 44535 - DNA, 20 bp, Artificial Sequence
  Synthetic oligonucleotide; TAG chr11 5261699 5261718 5261702 -
cttgagcagtgagtggtttg

SEQ ID NO: 44536 - DNA, 20 bp, Artificial Sequence
  Synthetic oligonucleotide; AAG chr11 5261687 5261706 5261690 -
gtggtttgtagctctccttg

SEQ ID NO: 44537 - DNA, 20 bp, Artificial Sequence
  Synthetic oligonucleotide; GAG chr11 5261685 5261704 5261688 -
ggtttgtagctctccttgaa

SEQ ID NO: 44538 - DNA, 20 bp, Artificial Sequence
  Synthetic oligonucleotide; AGG chr11 5261684 5261703 5261687 -
gtttgtagctctccttgaag

SEQ ID NO: 44539 - DNA, 20 bp, Artificial Sequence
  Synthetic oligonucleotide; TAG chr11 5261667 5261686 5261670 -
aagaggttcttcacatccct

SEQ ID NO: 44540 - DNA, 20 bp, Artificial Sequence
  Synthetic oligonucleotide; AAG chr11 5261664 5261683 5261667 -
aggttcttcacatcccttag

SEQ ID NO: 44541 - DNA, 20 bp, Artificial Sequence
  Synthetic oligonucleotide; TAG chr11 5261652 5261671 5261655 -
tcccttagaagttgtatttc

SEQ ID NO: 44542 - DNA, 20 bp, Artificial Sequence
  Synthetic oligonucleotide; AGG chr11 5261651 5261670 5261654 -
cccttagaagttgtatttct

SEQ ID NO: 44543 - DNA, 20 bp, Artificial Sequence
  Synthetic oligonucleotide; CAG chr11 5261627 5261646 5261630 -
attttattttattctctttg

SEQ ID NO: 44544 - DNA, 20 bp, Artificial Sequence
  Synthetic oligonucleotide; TGG chr11 5261614 5261633 5261617 -
ctctttgcagcaattgtgaa

SEQ ID NO: 44545 - DNA, 20 bp, Artificial Sequence
  Synthetic oligonucleotide; GGG chr11 5261613 5261632 5261616 -
tctttgcagcaattgtgaat

SEQ ID NO: 44546 - DNA, 20 bp, Artificial Sequence
  Synthetic oligonucleotide; GAG chr11 5261611 5261630 5261614 -
tttgcagcaattgtgaatgg

SEQ ID NO: 44547 - DNA, 20 bp, Artificial Sequence
  Synthetic oligonucleotide; TGG chr11 5261595 5261614 5261598 -
atgggagttcacccatgatt

SEQ ID NO: 44548 - DNA, 20 bp, Artificial Sequence
  Synthetic oligonucleotide; TGG chr11 5261573 5261592 5261576 -
gctctctgcttgtctattat

SEQ ID NO: 44549 - DNA, 20 bp, Artificial Sequence
  Synthetic oligonucleotide; TAG chr11 5261566 5261585 5261569 -
gcttgtctattattggtgta

SEQ ID NO: 44550 - DNA, 20 bp, Artificial Sequence
  Synthetic oligonucleotide; AGG chr11 5261565 5261584 5261568 -
cttgtctattattggtgtat

SEQ ID NO: 44551 - DNA, 20 bp, Artificial Sequence
  Synthetic oligonucleotide; GAG chr11 5261526 5261545 5261529 -
gcacactgattttgtatctt

SEQ ID NO: 44552 - DNA, 20 bp, Artificial Sequence
  Synthetic oligonucleotide; AAG chr11 5261514 5261533 5261517 -
tgtatcttgagactttgctg

SEQ ID NO: 44553 - DNA, 20 bp, Artificial Sequence
  Synthetic oligonucleotide; CAG chr11 5261503 5261522 5261506 -
actttgctgaagctgtttat

SEQ ID NO: 44554 - DNA, 20 bp, Artificial Sequence
  Synthetic oligonucleotide; AAG chr11 5261497 5261516 5261500 -
ctgaagctgtttatcagctt

SEQ ID NO: 44555 - DNA, 20 bp, Artificial Sequence
  Synthetic oligonucleotide; TGG chr11 5261490 5261509 5261493 -
tgtttatcagcttaagattt

SEQ ID NO: 44556 - DNA, 20 bp, Artificial Sequence
  Synthetic oligonucleotide; GGG chr11 5261489 5261508 5261492 -
gtttatcagcttaagatttt

SEQ ID NO: 44557 - DNA, 20 bp, Artificial Sequence
  Synthetic oligonucleotide; GAG chr11 5261484 5261503 5261487 -
tcagcttaagattttgggct

SEQ ID NO: 44558 - DNA, 20 bp, Artificial Sequence
  Synthetic oligonucleotide; CAG chr11 5261477 5261496 5261480 -
aagattttgggctgagatga

SEQ ID NO: 44559 - DNA, 20 bp, Artificial Sequence
  Synthetic oligonucleotide; AGG chr11 5261476 5261495 5261479 -
agattttgggctgagatgac

SEQ ID NO: 44560 - DNA, 20 bp, Artificial Sequence
  Synthetic oligonucleotide; GGG chr11 5261475 5261494 5261478 -
gattttgggctgagatgaca

SEQ ID NO: 44561 - DNA, 20 bp, Artificial Sequence
  Synthetic oligonucleotide; CAG chr11 5261440 5261459 5261443 -
acaatcatgtcatctgcaaa

SEQ ID NO: 44562 - DNA, 20 bp, Artificial Sequence
  Synthetic oligonucleotide; GAG chr11 5261438 5261457 5261441 -
aatcatgtcatctgcaaaca

SEQ ID NO: 44563 - DNA, 20 bp, Artificial Sequence
  Synthetic oligonucleotide; TGG chr11 5261372 5261391 5261375 -
tttctcttgcctgattgtcc

SEQ ID NO: 44564 - DNA, 20 bp, Artificial Sequence
  Synthetic oligonucleotide; GAG chr11 5261368 5261387 5261371 -
tcttgcctgattgtcctggc

SEQ ID NO: 44565 - DNA, 20 bp, Artificial Sequence
  Synthetic oligonucleotide; GAG chr11 5261347 5261366 5261350 -
agaacttccaatactatgtt

SEQ ID NO: 44566 - DNA, 20 bp, Artificial Sequence
  Synthetic oligonucleotide; AAG chr11 5261343 5261362 5261346 -
cttccaatactatgttgagt

SEQ ID NO: 44567 - DNA, 20 bp, Artificial Sequence
  Synthetic oligonucleotide; GAG chr11 5261341 5261360 5261344 -
tccaatactatgttgagtaa

SEQ ID NO: 44568 - DNA, 20 bp, Artificial Sequence
  Synthetic oligonucleotide; TGG chr11 5261338 5261357 5261341 -
aatactatgttgagtaagag

SEQ ID NO: 44569 - DNA, 20 bp, Artificial Sequence
  Synthetic oligonucleotide; GAG chr11 5261334 5261353 5261337 -
ctatgttgagtaagagtggc

SEQ ID NO: 44570 - DNA, 20 bp, Artificial Sequence
  Synthetic oligonucleotide; GAG chr11 5261332 5261351 5261335 -
atgttgagtaagagtggcga

SEQ ID NO: 44571 - DNA, 20 bp, Artificial Sequence
  Synthetic oligonucleotide; AGG chr11 5261331 5261350 5261334 -
tgttgagtaagagtggcgag

SEQ ID NO: 44572 - DNA, 20 bp, Artificial Sequence
  Synthetic oligonucleotide; GGG chr11 5261330 5261349 5261333 -
gttgagtaagagtggcgaga

SEQ ID NO: 44573 - DNA, 20 bp, Artificial Sequence
  Synthetic oligonucleotide; CGG chr11 5261311 5261330 5261314 -
agggcatccttgtcttgtgc

SEQ ID NO: 44574 - DNA, 20 bp, Artificial Sequence
  Synthetic oligonucleotide; AAG chr11 5261302 5261321 5261305 -
ttgtcttgtgccggttttca

SEQ ID NO: 44575 - DNA, 20 bp, Artificial Sequence
  Synthetic oligonucleotide; CAG chr11 5261247 5261266 5261250 -
ttgttgacccaatgatcatt

SEQ ID NO: 44576 - DNA, 20 bp, Artificial Sequence
  Synthetic oligonucleotide; AGG chr11 5261246 5261265 5261249 -
tgttgacccaatgatcattc

SEQ ID NO: 44577 - DNA, 20 bp, Artificial Sequence
  Synthetic oligonucleotide; GAG chr11 5261244 5261263 5261247 -
ttgacccaatgatcattcag

SEQ ID NO: 44578 - DNA, 20 bp, Artificial Sequence
  Synthetic oligonucleotide; CAG chr11 5261241 5261260 5261244 -
acccaatgatcattcaggag

SEQ ID NO: 44579 - DNA, 20 bp, Artificial Sequence
  Synthetic oligonucleotide; AGG chr11 5261240 5261259 5261243 -
cccaatgatcattcaggagc

SEQ ID NO: 44580 - DNA, 20 bp, Artificial Sequence
  Synthetic oligonucleotide; TGG chr11 5261213 5261232 5261216 -
ttaatttccctgtatttgca

SEQ ID NO: 44581 - DNA, 20 bp, Artificial Sequence
  Synthetic oligonucleotide; AAG chr11 5261205 5261224 5261208 -
cctgtatttgcatggttttg

SEQ ID NO: 44582 - DNA, 20 bp, Artificial Sequence
  Synthetic oligonucleotide; AGG chr11 5261204 5261223 5261207 -
ctgtatttgcatggttttga

SEQ ID NO: 44583 - DNA, 20 bp, Artificial Sequence
  Synthetic oligonucleotide; TAG chr11 5261192 5261211 5261195 -
ggttttgaaggttccttttg

SEQ ID NO: 44584 - DNA, 20 bp, Artificial Sequence
  Synthetic oligonucleotide; TGG chr11 5261165 5261184 5261168 -
tttccaattttattctactg

SEQ ID NO: 44585 - DNA, 20 bp, Artificial Sequence
  Synthetic oligonucleotide; GAG chr11 5261159 5261178 5261162 -
attttattctactgtggtct

SEQ ID NO: 44586 - DNA, 20 bp, Artificial Sequence
  Synthetic oligonucleotide; GAG chr11 5261157 5261176 5261160 -
tttattctactgtggtctga

SEQ ID NO: 44587 - DNA, 20 bp, Artificial Sequence
  Synthetic oligonucleotide; GAG chr11 5261155 5261174 5261158 -
tattctactgtggtctgaga

SEQ ID NO: 44588 - DNA, 20 bp, Artificial Sequence
  Synthetic oligonucleotide; GAG chr11 5261118 5261137 5261121 -
tcaatttttaaaaatttatt

SEQ ID NO: 44589 - DNA, 20 bp, Artificial Sequence
  Synthetic oligonucleotide; AGG chr11 5261117 5261136 5261120 -
caatttttaaaaatttattg

SEQ ID NO: 44590 - DNA, 20 bp, Artificial Sequence
  Synthetic oligonucleotide; TGG chr11 5261105 5261124 5261108 -
atttattgaggcttgttttg

SEQ ID NO: 44591 - DNA, 20 bp, Artificial Sequence
  Synthetic oligonucleotide; TGG chr11 5261093 5261112 5261096 -
ttgttttgtggcatatcata

SEQ ID NO: 44592 - DNA, 20 bp, Artificial Sequence
  Synthetic oligonucleotide; TGG chr11 5261083 5261102 5261086 -
gcatatcatatggcctatct

SEQ ID NO: 44593 - DNA, 20 bp, Artificial Sequence
  Synthetic oligonucleotide; GAG chr11 5261081 5261100 5261084 -
atatcatatggcctatcttg

SEQ ID NO: 44594 - DNA, 20 bp, Artificial Sequence
  Synthetic oligonucleotide; AAG chr11 5261077 5261096 5261080 -
catatggcctatcttggaga

SEQ ID NO: 44595 - DNA, 20 bp, Artificial Sequence
  Synthetic oligonucleotide; TAG chr11 5261057 5261076 5261060 -
aagttccatgtgctgatgaa

SEQ ID NO: 44596 - DNA, 20 bp, Artificial Sequence
  Synthetic oligonucleotide; CAG chr11 5261041 5261060 5261044 -
tgaatagaatgtgtattctg

SEQ ID NO: 44597 - DNA, 20 bp, Artificial Sequence
  Synthetic oligonucleotide; TGG chr11 5261034 5261053 5261037 -
aatgtgtattctgcagttgt

SEQ ID NO: 44598 - DNA, 20 bp, Artificial Sequence
  Synthetic oligonucleotide; GGG chr11 5261033 5261052 5261036 -
atgtgtattctgcagttgtt

SEQ ID NO: 44599 - DNA, 20 bp, Artificial Sequence
  Synthetic oligonucleotide; TAG chr11 5261030 5261049 5261033 -
tgtattctgcagttgttggg

SEQ ID NO: 44600 - DNA, 20 bp, Artificial Sequence
  Synthetic oligonucleotide; AAG chr11 5261006 5261025 5261009 -
atgtcctgtaaatatctgtt

SEQ ID NO: 44601 - DNA, 20 bp, Artificial Sequence
  Synthetic oligonucleotide; TAG chr11 5260971 5260990 5260974 -
ttaaatccattgtttctttg

SEQ ID NO: 44602 - DNA, 20 bp, Artificial Sequence
  Synthetic oligonucleotide; TAG chr11 5260949 5260968 5260952 -
gactgtcttgatgacctgcc

SEQ ID NO: 44603 - DNA, 20 bp, Artificial Sequence
  Synthetic oligonucleotide; CAG chr11 5260944 5260963 5260947 -
tcttgatgacctgcctagtg

SEQ ID NO: 44604 - DNA, 20 bp, Artificial Sequence
  Synthetic oligonucleotide; CAG chr11 5260940 5260959 5260943 -
gatgacctgcctagtgcagt

SEQ ID NO: 44605 - DNA, 20 bp, Artificial Sequence
  Synthetic oligonucleotide; TGG chr11 5260937 5260956 5260940 -
gacctgcctagtgcagtcag

SEQ ID NO: 44606 - DNA, 20 bp, Artificial Sequence
  Synthetic oligonucleotide; GAG chr11 5260935 5260954 5260938 -
cctgcctagtgcagtcagtg

SEQ ID NO: 44607 - DNA, 20 bp, Artificial Sequence
  Synthetic oligonucleotide; AAG chr11 5260927 5260946 5260930 -
gtgcagtcagtggagtattg

SEQ ID NO: 44608 - DNA, 20 bp, Artificial Sequence
  Synthetic oligonucleotide; TAG chr11 5260898 5260917 5260901 -
actattattatgttgctgtc

SEQ ID NO: 44609 - DNA, 20 bp, Artificial Sequence
  Synthetic oligonucleotide; TAG chr11 5260893 5260912 5260896 -
tattatgttgctgtctagtc

SEQ ID NO: 44610 - DNA, 20 bp, Artificial Sequence
  Synthetic oligonucleotide; TAG chr11 5260890 5260909 5260893 -
tatgttgctgtctagtctag

SEQ ID NO: 44611 - DNA, 20 bp, Artificial Sequence
  Synthetic oligonucleotide; TGG chr11 5260870 5260889 5260873 -
tagtaattgttttataaatt

SEQ ID NO: 44612 - DNA, 20 bp, Artificial Sequence
  Synthetic oligonucleotide; GGG chr11 5260869 5260888 5260872 -
agtaattgttttataaattt

SEQ ID NO: 44613 - DNA, 20 bp, Artificial Sequence
  Synthetic oligonucleotide; CAG chr11 5260861 5260880 5260864 -
ttttataaatttgggatctc

SEQ ID NO: 44614 - DNA, 20 bp, Artificial Sequence
  Synthetic oligonucleotide; TAG chr11 5260855 5260874 5260858 -
aaatttgggatctccagtat

SEQ ID NO: 44615 - DNA, 20 bp, Artificial Sequence
  Synthetic oligonucleotide; AAG chr11 5260839 5260858 5260842 -
gtattagatgcatatatatt

SEQ ID NO: 44616 - DNA, 20 bp, Artificial Sequence
  Synthetic oligonucleotide; TGG chr11 5260817 5260836 5260820 -
gaattgtaatattctcccat

SEQ ID NO: 44617 - DNA, 20 bp, Artificial Sequence
  Synthetic oligonucleotide; AAG chr11 5260812 5260831 5260815 -
gtaatattctcccattggac

SEQ ID NO: 44618 - DNA, 20 bp, Artificial Sequence
  Synthetic oligonucleotide; AGG chr11 5260811 5260830 5260814 -
taatattctcccattggaca

SEQ ID NO: 44619 - DNA, 20 bp, Artificial Sequence
  Synthetic oligonucleotide; GGG chr11 5260810 5260829 5260813 -
aatattctcccattggacaa

SEQ ID NO: 44620 - DNA, 20 bp, Artificial Sequence
  Synthetic oligonucleotide; AAG chr11 5260754 5260773 5260757 -
ttttaactgctgtttcttta

SEQ ID NO: 44621 - DNA, 20 bp, Artificial Sequence
  Synthetic oligonucleotide; AAG chr11 5260734 5260753 5260737 -
aagtttgttttgtctgacat

SEQ ID NO: 44622 - DNA, 20 bp, Artificial Sequence
  Synthetic oligonucleotide; TAG chr11 5260729 5260748 5260732 -
tgttttgtctgacataagaa

SEQ ID NO: 44623 - DNA, 20 bp, Artificial Sequence
  Synthetic oligonucleotide; TGG chr11 5260720 5260739 5260723 -
tgacataagaatagctgctt

SEQ ID NO: 44624 - DNA, 20 bp, Artificial Sequence
  Synthetic oligonucleotide; TGG chr11 5260709 5260728 5260712 -
tagctgctttggctcgcttt

SEQ ID NO: 44625 - DNA, 20 bp, Artificial Sequence
  Synthetic oligonucleotide; TGG chr11 5260694 5260713 5260697 -
gcttttggtgtccatttgtg

SEQ ID NO: 44626 - DNA, 20 bp, Artificial Sequence
  Synthetic oligonucleotide; AAG chr11 5260665 5260684 5260668 -
attttccacccctttacctt

SEQ ID NO: 44627 - DNA, 20 bp, Artificial Sequence
  Synthetic oligonucleotide; GAG chr11 5260655 5260674 5260658 -
cctttaccttaagtttatgt

SEQ ID NO: 44628 - DNA, 20 bp, Artificial Sequence
  Synthetic oligonucleotide; TAG chr11 5260641 5260660 5260644 -
ttatgtgagtccttatgtgt

SEQ ID NO: 44629 - DNA, 20 bp, Artificial Sequence
  Synthetic oligonucleotide; AGG chr11 5260640 5260659 5260643 -
tatgtgagtccttatgtgtt

SEQ ID NO: 44630 - DNA, 20 bp, Artificial Sequence
  Synthetic oligonucleotide; GAG chr11 5260636 5260655 5260639 -
tgagtccttatgtgttaggt

SEQ ID NO: 44631 - DNA, 20 bp, Artificial Sequence
  Synthetic oligonucleotide; AAG chr11 5260626 5260645 5260629 -
tgtgttaggtgagtctcctg

SEQ ID NO: 44632 - DNA, 20 bp, Artificial Sequence
  Synthetic oligonucleotide; AGG chr11 5260625 5260644 5260628 -
gtgttaggtgagtctcctga

SEQ ID NO: 44633 - DNA, 20 bp, Artificial Sequence
  Synthetic oligonucleotide; CGG chr11 5260622 5260641 5260625 -
ttaggtgagtctcctgaagg

SEQ ID NO: 44634 - DNA, 20 bp, Artificial Sequence
  Synthetic oligonucleotide; CAG chr11 5260619 5260638 5260622 -
ggtgagtctcctgaaggcgg

SEQ ID NO: 44635 - DNA, 20 bp, Artificial Sequence
  Synthetic oligonucleotide; TGG chr11 5260611 5260630 5260614 -
tcctgaaggcggcagataac

SEQ ID NO: 44636 - DNA, 20 bp, Artificial Sequence
  Synthetic oligonucleotide; TGG chr11 5260607 5260626 5260610 -
gaaggcggcagataactggt

SEQ ID NO: 44637 - DNA, 20 bp, Artificial Sequence
  Synthetic oligonucleotide; AAG chr11 5260569 5260588 5260572 -
tctgcaattctgtatctttt

SEQ ID NO: 44638 - DNA, 20 bp, Artificial Sequence
  Synthetic oligonucleotide; TGG chr11 5260566 5260585 5260569 -
gcaattctgtatcttttaag

SEQ ID NO: 44639 - DNA, 20 bp, Artificial Sequence
  Synthetic oligonucleotide; GAG chr11 5260564 5260583 5260567 -
aattctgtatcttttaagtg

SEQ ID NO: 44640 - DNA, 20 bp, Artificial Sequence
  Synthetic oligonucleotide; TAG chr11 5260557 5260576 5260560 -
tatcttttaagtggagcatt

SEQ ID NO: 44641 - DNA, 20 bp, Artificial Sequence
  Synthetic oligonucleotide; CAG chr11 5260536 5260555 5260539 -
agtccatttacattcaacat

SEQ ID NO: 44642 - DNA, 20 bp, Artificial Sequence
  Synthetic oligonucleotide; GAG chr11 5260529 5260548 5260532 -
ttacattcaacatcagtatt

SEQ ID NO: 44643 - DNA, 20 bp, Artificial Sequence
  Synthetic oligonucleotide; AGG chr11 5260528 5260547 5260531 -
tacattcaacatcagtattg

SEQ ID NO: 44644 - DNA, 20 bp, Artificial Sequence
  Synthetic oligonucleotide; GAG chr11 5260522 5260541 5260525 -
caacatcagtattgaggtgt

SEQ ID NO: 44645 - DNA, 20 bp, Artificial Sequence
  Synthetic oligonucleotide; AGG chr11 5260521 5260540 5260524 -
aacatcagtattgaggtgtg

SEQ ID NO: 44646 - DNA, 20 bp, Artificial Sequence
  Synthetic oligonucleotide; TGG chr11 5260501 5260520 5260504 -
aggtactattccattcttcg

SEQ ID NO: 44647 - DNA, 20 bp, Artificial Sequence
  Synthetic oligonucleotide; TGG chr11 5260447 5260466 5260450 -
tttttgttgtatatgtccta

SEQ ID NO: 44648 - DNA, 20 bp, Artificial Sequence
  Synthetic oligonucleotide; GGG chr11 5260446 5260465 5260449 -
ttttgttgtatatgtcctat

SEQ ID NO: 44649 - DNA, 20 bp, Artificial Sequence
  Synthetic oligonucleotide; AAG chr11 5260431 5260450 5260434 -
cctatgggatttatgcttta

SEQ ID NO: 44650 - DNA, 20 bp, Artificial Sequence
  Synthetic oligonucleotide; GAG chr11 5260429 5260448 5260432 -
tatgggatttatgctttaaa

SEQ ID NO: 44651 - DNA, 20 bp, Artificial Sequence
  Synthetic oligonucleotide; AGG chr11 5260428 5260447 5260431 -
atgggatttatgctttaaag

SEQ ID NO: 44652 - DNA, 20 bp, Artificial Sequence
  Synthetic oligonucleotide; CAG chr11 5260406 5260425 5260409 -
gttctgttttgatgtgcttc

SEQ ID NO: 44653 - DNA, 20 bp, Artificial Sequence
  Synthetic oligonucleotide; AGG chr11 5260405 5260424 5260408 -
ttctgttttgatgtgcttcc

SEQ ID NO: 44654 - DNA, 20 bp, Artificial Sequence
  Synthetic oligonucleotide; GGG chr11 5260404 5260423 5260407 -
tctgttttgatgtgcttcca

SEQ ID NO: 44655 - DNA, 20 bp, Artificial Sequence
  Synthetic oligonucleotide; AAG chr11 5260393 5260412 5260396 -
gtgcttccagggtttatttc

SEQ ID NO: 44656 - DNA, 20 bp, Artificial Sequence
  Synthetic oligonucleotide; TAG chr11 5260387 5260406 5260390 -
ccagggtttatttcaagatt

SEQ ID NO: 44657 - DNA, 20 bp, Artificial Sequence
  Synthetic oligonucleotide; GAG chr11 5260385 5260404 5260388 -
agggtttatttcaagattta

SEQ ID NO: 44658 - DNA, 20 bp, Artificial Sequence
  Synthetic oligonucleotide; CAG chr11 5260372 5260391 5260375 -
agatttagagctccttttat

SEQ ID NO: 44659 - DNA, 20 bp, Artificial Sequence
  Synthetic oligonucleotide; TAG chr11 5260363 5260382 5260366 -
gctccttttatcagttcttg

SEQ ID NO: 44660 - DNA, 20 bp, Artificial Sequence
  Synthetic oligonucleotide; TGG chr11 5260357 5260376 5260360 -
tttatcagttcttgtagtgt

SEQ ID NO: 44661 - DNA, 20 bp, Artificial Sequence
  Synthetic oligonucleotide; TGG chr11 5260352 5260371 5260355 -
cagttcttgtagtgttggct

SEQ ID NO: 44662 - DNA, 20 bp, Artificial Sequence
  Synthetic oligonucleotide; TAG chr11 5260349 5260368 5260352 -
ttcttgtagtgttggcttgg

SEQ ID NO: 44663 - DNA, 20 bp, Artificial Sequence
  Synthetic oligonucleotide; CAG chr11 5260333 5260352 5260336 -
ttggtagtgccgaattctct

SEQ ID NO: 44664 - DNA, 20 bp, Artificial Sequence
  Synthetic oligonucleotide; AAG chr11 5260287 5260306 5260290 -
gtgtattttcttcatttgtg

SEQ ID NO: 44665 - DNA, 20 bp, Artificial Sequence
  Synthetic oligonucleotide; TAG chr11 5260282 5260301 5260285 -
ttttcttcatttgtgaagct

SEQ ID NO: 44666 - DNA, 20 bp, Artificial Sequence
  Synthetic oligonucleotide; TGG chr11 5260273 5260292 5260276 -
tttgtgaagcttagtttcac

SEQ ID NO: 44667 - DNA, 20 bp, Artificial Sequence
  Synthetic oligonucleotide; TGG chr11 5260258 5260277 5260261 -
ttcactggatataaaattct

SEQ ID NO: 44668 - DNA, 20 bp, Artificial Sequence
  Synthetic oligonucleotide; AAG chr11 5260237 5260256 5260240 -
ggctgataattgttttgttt

SEQ ID NO: 44669 - DNA, 20 bp, Artificial Sequence
  Synthetic oligonucleotide; AAG chr11 5260234 5260253 5260237 -
tgataattgttttgtttaag

SEQ ID NO: 44670 - DNA, 20 bp, Artificial Sequence
  Synthetic oligonucleotide; AGG chr11 5260233 5260252 5260236 -
gataattgttttgtttaaga

SEQ ID NO: 44671 - DNA, 20 bp, Artificial Sequence
  Synthetic oligonucleotide; AAG chr11 5260227 5260246 5260230 -
tgttttgtttaagaaggctg

SEQ ID NO: 44672 - DNA, 20 bp, Artificial Sequence
  Synthetic oligonucleotide; TAG chr11 5260223 5260242 5260226 -
ttgtttaagaaggctgaaga

SEQ ID NO: 44673 - DNA, 20 bp, Artificial Sequence
  Synthetic oligonucleotide; AGG chr11 5260222 5260241 5260225 -
tgtttaagaaggctgaagat

SEQ ID NO: 44674 - DNA, 20 bp, Artificial Sequence
  Synthetic oligonucleotide; GGG chr11 5260221 5260240 5260224 -
gtttaagaaggctgaagata

SEQ ID NO: 44675 - DNA, 20 bp, Artificial Sequence
  Synthetic oligonucleotide; TAG chr11 5260205 5260224 5260208 -
gatagggccatattcacttc

SEQ ID NO: 44676 - DNA, 20 bp, Artificial Sequence
  Synthetic oligonucleotide; CGG chr11 5260196 5260215 5260199 -
atattcacttctagctttta

SEQ ID NO: 44677 - DNA, 20 bp, Artificial Sequence
  Synthetic oligonucleotide; GAG chr11 5260185 5260204 5260188 -
tagcttttacggtttctgct

SEQ ID NO: 44678 - DNA, 20 bp, Artificial Sequence
  Synthetic oligonucleotide; TAG chr11 5260163 5260182 5260166 -
gaaatctgctgttaatctga

SEQ ID NO: 44679 - DNA, 20 bp, Artificial Sequence
  Synthetic oligonucleotide; AGG chr11 5260162 5260181 5260165 -
aaatctgctgttaatctgat

SEQ ID NO: 44680 - DNA, 20 bp, Artificial Sequence
  Synthetic oligonucleotide; TAG chr11 5260149 5260168 5260152 -
atctgataggttttctttca

SEQ ID NO: 44681 - DNA, 20 bp, Artificial Sequence
  Synthetic oligonucleotide; AGG chr11 5260148 5260167 5260151 -
tctgataggttttctttcat

SEQ ID NO: 44682 - DNA, 20 bp, Artificial Sequence
  Synthetic oligonucleotide; TGG chr11 5260140 5260159 5260143 -
gttttctttcataggttacc

SEQ ID NO: 44683 - DNA, 20 bp, Artificial Sequence
  Synthetic oligonucleotide; TAG chr11 5260137 5260156 5260140 -
ttctttcataggttacctgg

SEQ ID NO: 44684 - DNA, 20 bp, Artificial Sequence
  Synthetic oligonucleotide; CAG chr11 5260124 5260143 5260127 -
tacctggtagtttcacctca

SEQ ID NO: 44685 - DNA, 20 bp, Artificial Sequence
  Synthetic oligonucleotide; AAG chr11 5260116 5260135 5260119 -
agtttcacctcacagctctt

SEQ ID NO: 44686 - DNA, 20 bp, Artificial Sequence
  Synthetic oligonucleotide; TAG chr11 5260099 5260118 5260102 -
cttaagattctctttgtctt

SEQ ID NO: 44687 - DNA, 20 bp, Artificial Sequence
  Synthetic oligonucleotide; TGG chr11 5260089 5260108 5260092 -
tctttgtctttagataactt

SEQ ID NO: 44688 - DNA, 20 bp, Artificial Sequence
  Synthetic oligonucleotide; TAG chr11 5260065 5260084 5260068 -
tactctgatgacaatgtacc

SEQ ID NO: 44689 - DNA, 20 bp, Artificial Sequence
  Synthetic oligonucleotide; AGG chr11 5260064 5260083 5260067 -
actctgatgacaatgtacct

SEQ ID NO: 44690 - DNA, 20 bp, Artificial Sequence
  Synthetic oligonucleotide; CAG chr11 5260035 5260054 5260038 -
tatttttgcaatgaatttcc

SEQ ID NO: 44691 - DNA, 20 bp, Artificial Sequence
  Synthetic oligonucleotide; AGG chr11 5260034 5260053 5260037 -
atttttgcaatgaatttccc

SEQ ID NO: 44692 - DNA, 20 bp, Artificial Sequence
  Synthetic oligonucleotide; GAG chr11 5260023 5260042 5260026 -
gaatttcccaggtgtttatt

SEQ ID NO: 44693 - DNA, 20 bp, Artificial Sequence
  Synthetic oligonucleotide; TGG chr11 5260009 5260028 5260012 -
tttattgagcttcttgtatt

SEQ ID NO: 44694 - DNA, 20 bp, Artificial Sequence
  Synthetic oligonucleotide; TAG chr11 5260001 5260020 5260004 -
gcttcttgtatttggatatc

SEQ ID NO: 44695 - DNA, 20 bp, Artificial Sequence
  Synthetic oligonucleotide; AGG chr11 5260000 5260019 5260003 -
cttcttgtatttggatatct

SEQ ID NO: 44696 - DNA, 20 bp, Artificial Sequence
  Synthetic oligonucleotide; TAG chr11 5259993 5260012 5259996 -
tatttggatatctaggtctc

SEQ ID NO: 44697 - DNA, 20 bp, Artificial Sequence
  Synthetic oligonucleotide; AAG chr11 5259989 5260008 5259992 -
tggatatctaggtctctagc

SEQ ID NO: 44698 - DNA, 20 bp, Artificial Sequence
  Synthetic oligonucleotide; AGG chr11 5259988 5260007 5259991 -
ggatatctaggtctctagca

SEQ ID NO: 44699 - DNA, 20 bp, Artificial Sequence
  Synthetic oligonucleotide; TGG chr11 5259985 5260004 5259988 -
tatctaggtctctagcaagg

SEQ ID NO: 44700 - DNA, 20 bp, Artificial Sequence
  Synthetic oligonucleotide; GGG chr11 5259984 5260003 5259987 -
atctaggtctctagcaaggt

SEQ ID NO: 44701 - DNA, 20 bp, Artificial Sequence
  Synthetic oligonucleotide; GGG chr11 5259983 5260002 5259986 -
tctaggtctctagcaaggtg

SEQ ID NO: 44702 - DNA, 20 bp, Artificial Sequence
  Synthetic oligonucleotide; GGG chr11 5259982 5260001 5259985 -
ctaggtctctagcaaggtgg

SEQ ID NO: 44703 - DNA, 20 bp, Artificial Sequence
  Synthetic oligonucleotide; AAG chr11 5259979 5259998 5259982 -
ggtctctagcaaggtggggg

SEQ ID NO: 44704 - DNA, 20 bp, Artificial Sequence
  Synthetic oligonucleotide; TGG chr11 5259957 5259976 5259960 -
gttttccttgattatttccc

SEQ ID NO: 44705 - DNA, 20 bp, Artificial Sequence
  Synthetic oligonucleotide; AAG chr11 5259952 5259971 5259955 -
ccttgattatttccctggat

SEQ ID NO: 44706 - DNA, 20 bp, Artificial Sequence
  Synthetic oligonucleotide; TAG chr11 5259936 5259955 5259939 -
ggataagttttccaaacttt

SEQ ID NO: 44707 - DNA, 20 bp, Artificial Sequence
  Synthetic oligonucleotide; CAG chr11 5259918 5259937 5259921 -
tttagatttctcttctttct

SEQ ID NO: 44708 - DNA, 20 bp, Artificial Sequence
  Synthetic oligonucleotide; AGG chr11 5259917 5259936 5259920 -
ttagatttctcttctttctc

SEQ ID NO: 44709 - DNA, 20 bp, Artificial Sequence
  Synthetic oligonucleotide; TAG chr11 5259899 5259918 5259902 -
tcaggaatgctgattattct

SEQ ID NO: 44710 - DNA, 20 bp, Artificial Sequence
  Synthetic oligonucleotide; AGG chr11 5259898 5259917 5259901 -
caggaatgctgattattctt

SEQ ID NO: 44711 - DNA, 20 bp, Artificial Sequence
  Synthetic oligonucleotide; CAG chr11 5259874 5259893 5259877 -
ttgattgtttaacataatcc

SEQ ID NO: 44712 - DNA, 20 bp, Artificial Sequence
  Synthetic oligonucleotide; TGG chr11 5259865 5259884 5259868 -
taacataatcccagatttct

SEQ ID NO: 44713 - DNA, 20 bp, Artificial Sequence
  Synthetic oligonucleotide; GAG chr11 5259863 5259882 5259866 -
acataatcccagatttcttg

SEQ ID NO: 44714 - DNA, 20 bp, Artificial Sequence
  Synthetic oligonucleotide; AGG chr11 5259862 5259881 5259865 -
cataatcccagatttcttgg

SEQ ID NO: 44715 - DNA, 20 bp, Artificial Sequence
  Synthetic oligonucleotide; TGG chr11 5259819 5259838 5259822 -
tcttttttctttgtctttgt

SEQ ID NO: 44716 - DNA, 20 bp, Artificial Sequence
  Synthetic oligonucleotide; TGG chr11 5259814 5259833 5259817 -
tttctttgtctttgttggat

SEQ ID NO: 44717 - DNA, 20 bp, Artificial Sequence
  Synthetic oligonucleotide; GGG chr11 5259813 5259832 5259816 -
ttctttgtctttgttggatt

SEQ ID NO: 44718 - DNA, 20 bp, Artificial Sequence
  Synthetic oligonucleotide; AAG chr11 5259788 5259807 5259791 -
aattcaaaaactttgtcttc

SEQ ID NO: 44719 - DNA, 20 bp, Artificial Sequence
  Synthetic oligonucleotide; TGG chr11 5259767 5259786 5259770 -
agctctgaatttcttctgct

SEQ ID NO: 44720 - DNA, 20 bp, Artificial Sequence
  Synthetic oligonucleotide; GAG chr11 5259753 5259772 5259756 -
tctgcttggattctattgct

SEQ ID NO: 44721 - DNA, 20 bp, Artificial Sequence
  Synthetic oligonucleotide; TAG chr11 5259744 5259763 5259747 -
attctattgctgagactttc

SEQ ID NO: 44722 - DNA, 20 bp, Artificial Sequence
  Synthetic oligonucleotide; GAG chr11 5259742 5259761 5259745 -
tctattgctgagactttcta

SEQ ID NO: 44723 - DNA, 20 bp, Artificial Sequence
  Synthetic oligonucleotide; AAG chr11 5259723 5259742 5259726 -
agagcattttgcatttctat

SEQ ID NO: 44724 - DNA, 20 bp, Artificial Sequence
  Synthetic oligonucleotide; AAG chr11 5259694 5259713 5259697 -
cattcatccattgtttcctg

SEQ ID NO: 44725 - DNA, 20 bp, Artificial Sequence
  Synthetic oligonucleotide; AAG chr11 5259654 5259673 5259657 -
ttatgctatctctttaactg

SEQ ID NO: 44726 - DNA, 20 bp, Artificial Sequence
  Synthetic oligonucleotide; TGG chr11 5259620 5259639 5259623 -
catttcttgtatcatatttt

SEQ ID NO: 44727 - DNA, 20 bp, Artificial Sequence
  Synthetic oligonucleotide; TGG chr11 5259605 5259624 5259608 -
atttttggtttttttaaaat

SEQ ID NO: 44728 - DNA, 20 bp, Artificial Sequence
  Synthetic oligonucleotide; CGG chr11 5259589 5259608 5259592 -
aaattggacttcaccttcct

SEQ ID NO: 44729 - DNA, 20 bp, Artificial Sequence
  Synthetic oligonucleotide; TAG chr11 5259573 5259592 5259576 -
tcctcggatgcctccttgat

SEQ ID NO: 44730 - DNA, 20 bp, Artificial Sequence
  Synthetic oligonucleotide; CAG chr11 5259541 5259560 5259544 -
tgaccttctgaattattttt

SEQ ID NO: 44731 - DNA, 20 bp, Artificial Sequence
  Synthetic oligonucleotide; AGG chr11 5259540 5259559 5259543 -
gaccttctgaattatttttc

SEQ ID NO: 44732 - DNA, 20 bp, Artificial Sequence
  Synthetic oligonucleotide; CAG chr11 5259532 5259551 5259535 -
gaattatttttcaggtaaat

SEQ ID NO: 44733 - DNA, 20 bp, Artificial Sequence
  Synthetic oligonucleotide; AGG chr11 5259531 5259550 5259534 -
aattatttttcaggtaaatc

SEQ ID NO: 44734 - DNA, 20 bp, Artificial Sequence
  Synthetic oligonucleotide; GGG chr11 5259530 5259549 5259533 -
attatttttcaggtaaatca

SEQ ID NO: 44735 - DNA, 20 bp, Artificial Sequence
  Synthetic oligonucleotide; TGG chr11 5259518 5259537 5259521 -
gtaaatcagggatttcttct

SEQ ID NO: 44736 - DNA, 20 bp, Artificial Sequence
  Synthetic oligonucleotide; TGG chr11 5259513 5259532 5259516 -
tcagggatttcttcttggtt

SEQ ID NO: 44737 - DNA, 20 bp, Artificial Sequence
  Synthetic oligonucleotide; TGG chr11 5259501 5259520 5259504 -
tcttggtttggatgcattgc

SEQ ID NO: 44738 - DNA, 20 bp, Artificial Sequence
  Synthetic oligonucleotide; GAG chr11 5259497 5259516 5259500 -
ggtttggatgcattgctggt

SEQ ID NO: 44739 - DNA, 20 bp, Artificial Sequence
  Synthetic oligonucleotide; TAG chr11 5259493 5259512 5259496 -
tggatgcattgctggtgagc

SEQ ID NO: 44740 - DNA, 20 bp, Artificial Sequence
  Synthetic oligonucleotide; TGG chr11 5259480 5259499 5259483 -
ggtgagctagtatgattttt

SEQ ID NO: 44741 - DNA, 20 bp, Artificial Sequence
  Synthetic oligonucleotide; GGG chr11 5259479 5259498 5259482 -
gtgagctagtatgatttttt

SEQ ID NO: 44742 - DNA, 20 bp, Artificial Sequence
  Synthetic oligonucleotide; GGG chr11 5259478 5259497 5259481 -
tgagctagtatgattttttg

SEQ ID NO: 44743 - DNA, 20 bp, Artificial Sequence
  Synthetic oligonucleotide; GGG chr11 5259477 5259496 5259480 -
gagctagtatgattttttgg

SEQ ID NO: 44744 - DNA, 20 bp, Artificial Sequence
  Synthetic oligonucleotide; GGG chr11 5259476 5259495 5259479 -
agctagtatgattttttggg

SEQ ID NO: 44745 - DNA, 20 bp, Artificial Sequence
  Synthetic oligonucleotide; AAG chr11 5259468 5259487 5259471 -
tgattttttggggggtgtta

SEQ ID NO: 44746 - DNA, 20 bp, Artificial Sequence
  Synthetic oligonucleotide; CAG chr11 5259445 5259464 5259448 -
aaccttgtttttcatattac

SEQ ID NO: 44747 - DNA, 20 bp, Artificial Sequence
  Synthetic oligonucleotide; GAG chr11 5259443 5259462 5259446 -
ccttgtttttcatattacca

SEQ ID NO: 44748 - DNA, 20 bp, Artificial Sequence
  Synthetic oligonucleotide; TAG chr11 5259439 5259458 5259442 -
gtttttcatattaccagagt

SEQ ID NO: 44749 - DNA, 20 bp, Artificial Sequence
  Synthetic oligonucleotide; TGG chr11 5259431 5259450 5259434 -
tattaccagagttagttttc

SEQ ID NO: 44750 - DNA, 20 bp, Artificial Sequence
  Synthetic oligonucleotide; TGG chr11 5259416 5259435 5259419 -
ttttctggttccttctcact

SEQ ID NO: 44751 - DNA, 20 bp, Artificial Sequence
  Synthetic oligonucleotide; GGG chr11 5259415 5259434 5259418 -
tttctggttccttctcactt

SEQ ID NO: 44752 - DNA, 20 bp, Artificial Sequence
  Synthetic oligonucleotide; TAG chr11 5259412 5259431 5259415 -
ctggttccttctcacttggg

SEQ ID NO: 44753 - DNA, 20 bp, Artificial Sequence
  Synthetic oligonucleotide; AGG chr11 5259411 5259430 5259414 -
tggttccttctcacttgggt

SEQ ID NO: 44754 - DNA, 20 bp, Artificial Sequence
  Synthetic oligonucleotide; CAG chr11 5259402 5259421 5259405 -
ctcacttgggtaggctctgt

SEQ ID NO: 44755 - DNA, 20 bp, Artificial Sequence
  Synthetic oligonucleotide; GAG chr11 5259400 5259419 5259403 -
cacttgggtaggctctgtca

SEQ ID NO: 44756 - DNA, 20 bp, Artificial Sequence
  Synthetic oligonucleotide; AGG chr11 5259399 5259418 5259402 -
acttgggtaggctctgtcag

SEQ ID NO: 44757 - DNA, 20 bp, Artificial Sequence
  Synthetic oligonucleotide; GGG chr11 5259398 5259417 5259401 -
cttgggtaggctctgtcaga

SEQ ID NO: 44758 - DNA, 20 bp, Artificial Sequence
  Synthetic oligonucleotide; AAG chr11 5259394 5259413 5259397 -
ggtaggctctgtcagaggga

SEQ ID NO: 44759 - DNA, 20 bp, Artificial Sequence
  Synthetic oligonucleotide; TAG chr11 5259389 5259408 5259392 -
gctctgtcagagggaaagtc

SEQ ID NO: 44760 - DNA, 20 bp, Artificial Sequence
  Synthetic oligonucleotide; AGG chr11 5259388 5259407 5259391 -
ctctgtcagagggaaagtct

SEQ ID NO: 44761 - DNA, 20 bp, Artificial Sequence
  Synthetic oligonucleotide; AAG chr11 5259381 5259400 5259384 -
agagggaaagtctaggcctc

SEQ ID NO: 44762 - DNA, 20 bp, Artificial Sequence
  Synthetic oligonucleotide; AGG chr11 5259380 5259399 5259383 -
gagggaaagtctaggcctca

SEQ ID NO: 44763 - DNA, 20 bp, Artificial Sequence
  Synthetic oligonucleotide; GAG chr11 5259375 5259394 5259378 -
aaagtctaggcctcaaggct

SEQ ID NO: 44764 - DNA, 20 bp, Artificial Sequence
  Synthetic oligonucleotide; GAG chr11 5259359 5259378 5259362 -
ggctgagacttttgtcccat

SEQ ID NO: 44765 - DNA, 20 bp, Artificial Sequence
  Synthetic oligonucleotide; AGG chr11 5259358 5259377 5259361 -
gctgagacttttgtcccatg

SEQ ID NO: 44766 - DNA, 20 bp, Artificial Sequence
  Synthetic oligonucleotide; TAG chr11 5259342 5259361 5259345 -
catgaggtgttcccttgatg

SEQ ID NO: 44767 - DNA, 20 bp, Artificial Sequence
  Synthetic oligonucleotide; CAG chr11 5259337 5259356 5259340 -
ggtgttcccttgatgtagca

SEQ ID NO: 44768 - DNA, 20 bp, Artificial Sequence
  Synthetic oligonucleotide; TAG chr11 5259322 5259341 5259325 -
tagcacagtcccccttttcc

SEQ ID NO: 44769 - DNA, 20 bp, Artificial Sequence
  Synthetic oligonucleotide; AGG chr11 5259321 5259340 5259324 -
agcacagtcccccttttcct

SEQ ID NO: 44770 - DNA, 20 bp, Artificial Sequence
  Synthetic oligonucleotide; TGG chr11 5259316 5259335 5259319 -
agtcccccttttcctaggcg

SEQ ID NO: 44771 - DNA, 20 bp, Artificial Sequence
  Synthetic oligonucleotide; GGG chr11 5259315 5259334 5259318 -
gtcccccttttcctaggcgt

SEQ ID NO: 44772 - DNA, 20 bp, Artificial Sequence
  Synthetic oligonucleotide; GGG chr11 5259314 5259333 5259317 -
tcccccttttcctaggcgtg

SEQ ID NO: 44773 - DNA, 20 bp, Artificial Sequence
  Synthetic oligonucleotide; GAG chr11 5259305 5259324 5259308 -
tcctaggcgtggggcttcct

SEQ ID NO: 44774 - DNA, 20 bp, Artificial Sequence
  Synthetic oligonucleotide; GAG chr11 5259303 5259322 5259306 -
ctaggcgtggggcttcctga

SEQ ID NO: 44775 - DNA, 20 bp, Artificial Sequence
  Synthetic oligonucleotide; TAG chr11 5259292 5259311 5259295 -
gcttcctgagagccgaactg

SEQ ID NO: 44776 - DNA, 20 bp, Artificial Sequence
  Synthetic oligonucleotide; TGG chr11 5259271 5259290 5259274 -
agtgattgttatctctcttc

SEQ ID NO: 44777 - DNA, 20 bp, Artificial Sequence
  Synthetic oligonucleotide; TAG chr11 5259265 5259284 5259268 -
tgttatctctcttctggatc

SEQ ID NO: 44778 - DNA, 20 bp, Artificial Sequence
  Synthetic oligonucleotide; CAG chr11 5259254 5259273 5259257 -
ttctggatctagccacccat

SEQ ID NO: 44779 - DNA, 20 bp, Artificial Sequence
  Synthetic oligonucleotide; AGG chr11 5259253 5259272 5259256 -
tctggatctagccacccatc

SEQ ID NO: 44780 - DNA, 20 bp, Artificial Sequence
  Synthetic oligonucleotide; CAG chr11 5259245 5259264 5259248 -
tagccacccatcaggtctac

SEQ ID NO: 44781 - DNA, 20 bp, Artificial Sequence
  Synthetic oligonucleotide; CAG chr11 5259238 5259257 5259241 -
ccatcaggtctaccagactc

SEQ ID NO: 44782 - DNA, 20 bp, Artificial Sequence
  Synthetic oligonucleotide; AGG chr11 5259237 5259256 5259240 -
catcaggtctaccagactcc

SEQ ID NO: 44783 - DNA, 20 bp, Artificial Sequence
  Synthetic oligonucleotide; TGG chr11 5259233 5259252 5259236 -
aggtctaccagactccaggc

SEQ ID NO: 44784 - DNA, 20 bp, Artificial Sequence
  Synthetic oligonucleotide; TGG chr11 5259227 5259246 5259230 -
accagactccaggctggtac

SEQ ID NO: 44785 - DNA, 20 bp, Artificial Sequence
  Synthetic oligonucleotide; GGG chr11 5259226 5259245 5259229 -
ccagactccaggctggtact

SEQ ID NO: 44786 - DNA, 20 bp, Artificial Sequence
  Synthetic oligonucleotide; GGG chr11 5259225 5259244 5259228 -
cagactccaggctggtactg

SEQ ID NO: 44787 - DNA, 20 bp, Artificial Sequence
  Synthetic oligonucleotide; CAG chr11 5259212 5259231 5259215 -
ggtactggggtttgtctgca

SEQ ID NO: 44788 - DNA, 20 bp, Artificial Sequence
  Synthetic oligonucleotide; GAG chr11 5259210 5259229 5259213 -
tactggggtttgtctgcaca

SEQ ID NO: 44789 - DNA, 20 bp, Artificial Sequence
  Synthetic oligonucleotide; TGG chr11 5259186 5259205 5259189 -
cttgtgacgtgaaccatctg

SEQ ID NO: 44790 - DNA, 20 bp, Artificial Sequence
  Synthetic oligonucleotide; GGG chr11 5259185 5259204 5259188 -
ttgtgacgtgaaccatctgt

SEQ ID NO: 44791 - DNA, 20 bp, Artificial Sequence
  Synthetic oligonucleotide; CAG chr11 5259177 5259196 5259180 -
tgaaccatctgtgggtctct

SEQ ID NO: 44792 - DNA, 20 bp, Artificial Sequence
  Synthetic oligonucleotide; TAG chr11 5259171 5259190 5259174 -
atctgtgggtctctcagcca

SEQ ID NO: 44793 - DNA, 20 bp, Artificial Sequence
  Synthetic oligonucleotide; TGG chr11 5259149 5259168 5259152 -
gatacaaccacctgctccaa

SEQ ID NO: 44794 - DNA, 20 bp, Artificial Sequence
  Synthetic oligonucleotide; GAG chr11 5259147 5259166 5259150 -
tacaaccacctgctccaatg

SEQ ID NO: 44795 - DNA, 20 bp, Artificial Sequence
  Synthetic oligonucleotide; AGG chr11 5259146 5259165 5259149 -
acaaccacctgctccaatgg

SEQ ID NO: 44796 - DNA, 20 bp, Artificial Sequence
  Synthetic oligonucleotide; TGG chr11 5259143 5259162 5259146 -
accacctgctccaatggagg

SEQ ID NO: 44797 - DNA, 20 bp, Artificial Sequence
  Synthetic oligonucleotide; CAG chr11 5259140 5259159 5259143 -
acctgctccaatggaggtgg

SEQ ID NO: 44798 - DNA, 20 bp, Artificial Sequence
  Synthetic oligonucleotide; GAG chr11 5259138 5259157 5259141 -
ctgctccaatggaggtggca

SEQ ID NO: 44799 - DNA, 20 bp, Artificial Sequence
  Synthetic oligonucleotide; AGG chr11 5259137 5259156 5259140 -
tgctccaatggaggtggcag

SEQ ID NO: 44800 - DNA, 20 bp, Artificial Sequence
  Synthetic oligonucleotide; TGG chr11 5259128 5259147 5259131 -
ggaggtggcagaggatgaaa

SEQ ID NO: 44801 - DNA, 20 bp, Artificial Sequence
  Synthetic oligonucleotide; GAG chr11 5259118 5259137 5259121 -
gaggatgaaatggactctgt

SEQ ID NO: 44802 - DNA, 20 bp, Artificial Sequence
  Synthetic oligonucleotide; AGG chr11 5259117 5259136 5259120 -
aggatgaaatggactctgtg

SEQ ID NO: 44803 - DNA, 20 bp, Artificial Sequence
  Synthetic oligonucleotide; GGG chr11 5259116 5259135 5259119 -
ggatgaaatggactctgtga

SEQ ID NO: 44804 - DNA, 20 bp, Artificial Sequence
  Synthetic oligonucleotide; TGG chr11 5259103 5259122 5259106 -
tctgtgagggtccttacttt

SEQ ID NO: 44805 - DNA, 20 bp, Artificial Sequence
  Synthetic oligonucleotide; TGG chr11 5259076 5259095 5259079 -
tcaatgcactatttttgtgc

SEQ ID NO: 44806 - DNA, 20 bp, Artificial Sequence
  Synthetic oligonucleotide; TGG chr11 5259072 5259091 5259075 -
tgcactatttttgtgctggt

SEQ ID NO: 44807 - DNA, 20 bp, Artificial Sequence
  Synthetic oligonucleotide; CAG chr11 5259061 5259080 5259064 -
tgtgctggttggcctcctgc

SEQ ID NO: 44808 - DNA, 20 bp, Artificial Sequence
  Synthetic oligonucleotide; AGG chr11 5259060 5259079 5259063 -
gtgctggttggcctcctgcc

SEQ ID NO: 44809 - DNA, 20 bp, Artificial Sequence
  Synthetic oligonucleotide; GAG chr11 5259058 5259077 5259061 -
gctggttggcctcctgccag

SEQ ID NO: 44810 - DNA, 20 bp, Artificial Sequence
  Synthetic oligonucleotide; AGG chr11 5259057 5259076 5259060 -
ctggttggcctcctgccagg

SEQ ID NO: 44811 - DNA, 20 bp, Artificial Sequence
  Synthetic oligonucleotide; TGG chr11 5259054 5259073 5259057 -
gttggcctcctgccaggagg

SEQ ID NO: 44812 - DNA, 20 bp, Artificial Sequence
  Synthetic oligonucleotide; TAG chr11 5259044 5259063 5259047 -
tgccaggaggtggcactttc

SEQ ID NO: 44813 - DNA, 20 bp, Artificial Sequence
  Synthetic oligonucleotide; AAG chr11 5259040 5259059 5259043 -
aggaggtggcactttctaga

SEQ ID NO: 44814 - DNA, 20 bp, Artificial Sequence
  Synthetic oligonucleotide; CAG chr11 5259034 5259053 5259037 -
tggcactttctagaaagcat

SEQ ID NO: 44815 - DNA, 20 bp, Artificial Sequence
  Synthetic oligonucleotide; CAG chr11 5259031 5259050 5259034 -
cactttctagaaagcatcag

SEQ ID NO: 44816 - DNA, 20 bp, Artificial Sequence
  Synthetic oligonucleotide; GAG chr11 5259029 5259048 5259032 -
ctttctagaaagcatcagca

SEQ ID NO: 44817 - DNA, 20 bp, Artificial Sequence
  Synthetic oligonucleotide; AGG chr11 5259028 5259047 5259031 -
tttctagaaagcatcagcag

SEQ ID NO: 44818 - DNA, 20 bp, Artificial Sequence
  Synthetic oligonucleotide; CAG chr11 5259025 5259044 5259028 -
ctagaaagcatcagcagagg

SEQ ID NO: 44819 - DNA, 20 bp, Artificial Sequence
  Synthetic oligonucleotide; CAG chr11 5259021 5259040 5259024 -
aaagcatcagcagaggcagt

SEQ ID NO: 44820 - DNA, 20 bp, Artificial Sequence
  Synthetic oligonucleotide; AGG chr11 5259020 5259039 5259023 -
aagcatcagcagaggcagtc

SEQ ID NO: 44821 - DNA, 20 bp, Artificial Sequence
  Synthetic oligonucleotide; TGG chr11 5259017 5259036 5259020 -
catcagcagaggcagtcagg

SEQ ID NO: 44822 - DNA, 20 bp, Artificial Sequence
  Synthetic oligonucleotide; TGG chr11 5259014 5259033 5259017 -
cagcagaggcagtcaggtgg

SEQ ID NO: 44823 - DNA, 20 bp, Artificial Sequence
  Synthetic oligonucleotide; TGG chr11 5259011 5259030 5259014 -
cagaggcagtcaggtggtgg

SEQ ID NO: 44824 - DNA, 20 bp, Artificial Sequence
  Synthetic oligonucleotide; TGG chr11 5259007 5259026 5259010 -
ggcagtcaggtggtggtggc

SEQ ID NO: 44825 - DNA, 20 bp, Artificial Sequence
  Synthetic oligonucleotide; GGG chr11 5259006 5259025 5259009 -
gcagtcaggtggtggtggct

SEQ ID NO: 44826 - DNA, 20 bp, Artificial Sequence
  Synthetic oligonucleotide; GGG chr11 5259005 5259024 5259008 -
cagtcaggtggtggtggctg

SEQ ID NO: 44827 - DNA, 20 bp, Artificial Sequence
  Synthetic oligonucleotide; GGG chr11 5259004 5259023 5259007 -
agtcaggtggtggtggctgg

SEQ ID NO: 44828 - DNA, 20 bp, Artificial Sequence
  Synthetic oligonucleotide; GGG chr11 5259003 5259022 5259006 -
gtcaggtggtggtggctggg

SEQ ID NO: 44829 - DNA, 20 bp, Artificial Sequence
  Synthetic oligonucleotide; GGG chr11 5259002 5259021 5259005 -
tcaggtggtggtggctgggg

SEQ ID NO: 44830 - DNA, 20 bp, Artificial Sequence
  Synthetic oligonucleotide; TGG chr11 5258998 5259017 5259001 -
gtggtggtggctgggggggc

SEQ ID NO: 44831 - DNA, 20 bp, Artificial Sequence
  Synthetic oligonucleotide; GGG chr11 5258997 5259016 5259000 -
tggtggtggctgggggggct

SEQ ID NO: 44832 - DNA, 20 bp, Artificial Sequence
  Synthetic oligonucleotide; GGG chr11 5258996 5259015 5258999 -
ggtggtggctgggggggctg

SEQ ID NO: 44833 - DNA, 20 bp, Artificial Sequence
  Synthetic oligonucleotide; TAG chr11 5258988 5259007 5258991 -
ctgggggggctggggcaccc

SEQ ID NO: 44834 - DNA, 20 bp, Artificial Sequence
  Synthetic oligonucleotide; AAG chr11 5258978 5258997 5258981 -
tggggcaccctagaactccc

SEQ ID NO: 44835 - DNA, 20 bp, Artificial Sequence
  Synthetic oligonucleotide; CAG chr11 5258956 5258975 5258959 -
gaatatatgccctttgtctt

SEQ ID NO: 44836 - DNA, 20 bp, Artificial Sequence
  Synthetic oligonucleotide; CAG chr11 5258949 5258968 5258952 -
tgccctttgtcttcagctac

SEQ ID NO: 44837 - DNA, 20 bp, Artificial Sequence
  Synthetic oligonucleotide; AGG chr11 5258948 5258967 5258951 -
gccctttgtcttcagctacc

SEQ ID NO: 44838 - DNA, 20 bp, Artificial Sequence
  Synthetic oligonucleotide; GGG chr11 5258947 5258966 5258950 -
ccctttgtcttcagctacca

SEQ ID NO: 44839 - DNA, 20 bp, Artificial Sequence
  Synthetic oligonucleotide; GAG chr11 5258943 5258962 5258946 -
ttgtcttcagctaccagggt

SEQ ID NO: 44840 - DNA, 20 bp, Artificial Sequence
  Synthetic oligonucleotide; AAG chr11 5258939 5258958 5258942 -
cttcagctaccagggtgagt

SEQ ID NO: 44841 - DNA, 20 bp, Artificial Sequence
  Synthetic oligonucleotide; AGG chr11 5258938 5258957 5258941 -
ttcagctaccagggtgagta

SEQ ID NO: 44842 - DNA, 20 bp, Artificial Sequence
  Synthetic oligonucleotide; AAG chr11 5258935 5258954 5258938 -
agctaccagggtgagtaagg

SEQ ID NO: 44843 - DNA, 20 bp, Artificial Sequence
  Synthetic oligonucleotide; AGG chr11 5258934 5258953 5258937 -
gctaccagggtgagtaagga

SEQ ID NO: 44844 - DNA, 20 bp, Artificial Sequence
  Synthetic oligonucleotide; CAG chr11 5258926 5258945 5258929 -
ggtgagtaaggaaggaccat

SEQ ID NO: 44845 - DNA, 20 bp, Artificial Sequence
  Synthetic oligonucleotide; AGG chr11 5258925 5258944 5258928 -
gtgagtaaggaaggaccatc

SEQ ID NO: 44846 - DNA, 20 bp, Artificial Sequence
  Synthetic oligonucleotide; TGG chr11 5258922 5258941 5258925 -
agtaaggaaggaccatcagg

SEQ ID NO: 44847 - DNA, 20 bp, Artificial Sequence
  Synthetic oligonucleotide; GGG chr11 5258921 5258940 5258924 -
gtaaggaaggaccatcaggt

SEQ ID NO: 44848 - DNA, 20 bp, Artificial Sequence
  Synthetic oligonucleotide; GGG chr11 5258920 5258939 5258923 -
taaggaaggaccatcaggtg

SEQ ID NO: 44849 - DNA, 20 bp, Artificial Sequence
  Synthetic oligonucleotide; GGG chr11 5258919 5258938 5258922 -
aaggaaggaccatcaggtgg

SEQ ID NO: 44850 - DNA, 20 bp, Artificial Sequence
  Synthetic oligonucleotide; CAG chr11 5258916 5258935 5258919 -
gaaggaccatcaggtggggg

SEQ ID NO: 44851 - DNA, 20 bp, Artificial Sequence
  Synthetic oligonucleotide; AGG chr11 5258915 5258934 5258918 -
aaggaccatcaggtgggggc

SEQ ID NO: 44852 - DNA, 20 bp, Artificial Sequence
  Synthetic oligonucleotide; TAG chr11 5258910 5258929 5258913 -
ccatcaggtgggggcaggac

SEQ ID NO: 44853 - DNA, 20 bp, Artificial Sequence
  Synthetic oligonucleotide; GAG chr11 5258899 5258918 5258902 -
gggcaggactagtcgtgtct

SEQ ID NO: 44854 - DNA, 20 bp, Artificial Sequence
  Synthetic oligonucleotide; CAG chr11 5258894 5258913 5258897 -
ggactagtcgtgtctgagct

SEQ ID NO: 44855 - DNA, 20 bp, Artificial Sequence
  Synthetic oligonucleotide; GAG chr11 5258892 5258911 5258895 -
actagtcgtgtctgagctca

SEQ ID NO: 44856 - DNA, 20 bp, Artificial Sequence
  Synthetic oligonucleotide; TGG chr11 5258883 5258902 5258886 -
gtctgagctcagagtctcct

SEQ ID NO: 44857 - DNA, 20 bp, Artificial Sequence
  Synthetic oligonucleotide; GGG chr11 5258882 5258901 5258885 -
tctgagctcagagtctcctt

SEQ ID NO: 44858 - DNA, 20 bp, Artificial Sequence
  Synthetic oligonucleotide; CAG chr11 5258879 5258898 5258882 -
gagctcagagtctccttggg

SEQ ID NO: 44859 - DNA, 20 bp, Artificial Sequence
  Synthetic oligonucleotide; AGG chr11 5258878 5258897 5258881 -
agctcagagtctccttgggc

SEQ ID NO: 44860 - DNA, 20 bp, Artificial Sequence
  Synthetic oligonucleotide; TGG chr11 5258867 5258886 5258870 -
tccttgggcaggtctttctg

SEQ ID NO: 44861 - DNA, 20 bp, Artificial Sequence
  Synthetic oligonucleotide; TGG chr11 5258858 5258877 5258861 -
aggtctttctgtggctactg

SEQ ID NO: 44862 - DNA, 20 bp, Artificial Sequence
  Synthetic oligonucleotide; GGG chr11 5258857 5258876 5258860 -
ggtctttctgtggctactgt

SEQ ID NO: 44863 - DNA, 20 bp, Artificial Sequence
  Synthetic oligonucleotide; GAG chr11 5258855 5258874 5258858 -
tctttctgtggctactgtgg

SEQ ID NO: 44864 - DNA, 20 bp, Artificial Sequence
  Synthetic oligonucleotide; AGG chr11 5258854 5258873 5258857 -
ctttctgtggctactgtggg

SEQ ID NO: 44865 - DNA, 20 bp, Artificial Sequence
  Synthetic oligonucleotide; TGG chr11 5258850 5258869 5258853 -
ctgtggctactgtgggagga

SEQ ID NO: 44866 - DNA, 20 bp, Artificial Sequence
  Synthetic oligonucleotide; GGG chr11 5258849 5258868 5258852 -
tgtggctactgtgggaggat

SEQ ID NO: 44867 - DNA, 20 bp, Artificial Sequence
  Synthetic oligonucleotide; GGG chr11 5258848 5258867 5258851 -
gtggctactgtgggaggatg

SEQ ID NO: 44868 - DNA, 20 bp, Artificial Sequence
  Synthetic oligonucleotide; GGG chr11 5258847 5258866 5258850 -
tggctactgtgggaggatgg

SEQ ID NO: 44869 - DNA, 20 bp, Artificial Sequence
  Synthetic oligonucleotide; TAG chr11 5258842 5258861 5258845 -
actgtgggaggatgggggtg

SEQ ID NO: 44870 - DNA, 20 bp, Artificial Sequence
  Synthetic oligonucleotide; CAG chr11 5258835 5258854 5258838 -
gaggatgggggtgtagtttc

SEQ ID NO: 44871 - DNA, 20 bp, Artificial Sequence
  Synthetic oligonucleotide; AGG chr11 5258834 5258853 5258837 -
aggatgggggtgtagtttcc

SEQ ID NO: 44872 - DNA, 20 bp, Artificial Sequence
  Synthetic oligonucleotide; TGG chr11 5258827 5258846 5258830 -
gggtgtagtttccaggtcaa

SEQ ID NO: 44873 - DNA, 20 bp, Artificial Sequence
  Synthetic oligonucleotide; TAG chr11 5258813 5258832 5258816 -
ggtcaatggatttatgttcc

SEQ ID NO: 44874 - DNA, 20 bp, Artificial Sequence
  Synthetic oligonucleotide; AGG chr11 5258812 5258831 5258815 -
gtcaatggatttatgttcct

SEQ ID NO: 44875 - DNA, 20 bp, Artificial Sequence
  Synthetic oligonucleotide; TGG chr11 5258802 5258821 5258805 -
ttatgttcctaggacaatta

SEQ ID NO: 44876 - DNA, 20 bp, Artificial Sequence
  Synthetic oligonucleotide; CAG chr11 5258780 5258799 5258783 -
gctgcctctgctgtgtcatg

SEQ ID NO: 44877 - DNA, 20 bp, Artificial Sequence
  Synthetic oligonucleotide; AGG chr11 5258779 5258798 5258782 -
ctgcctctgctgtgtcatgc

SEQ ID NO: 44878 - DNA, 20 bp, Artificial Sequence
  Synthetic oligonucleotide; CAG chr11 5258772 5258791 5258775 -
tgctgtgtcatgcaggtcat

SEQ ID NO: 44879 - DNA, 20 bp, Artificial Sequence
  Synthetic oligonucleotide; AGG chr11 5258771 5258790 5258774 -
gctgtgtcatgcaggtcatc

SEQ ID NO: 44880 - DNA, 20 bp, Artificial Sequence
  Synthetic oligonucleotide; AAG chr11 5258767 5258786 5258770 -
tgtcatgcaggtcatcagga

SEQ ID NO: 44881 - DNA, 20 bp, Artificial Sequence
  Synthetic oligonucleotide; TGG chr11 5258764 5258783 5258767 -
catgcaggtcatcaggaaag

SEQ ID NO: 44882 - DNA, 20 bp, Artificial Sequence
  Synthetic oligonucleotide; GGG chr11 5258763 5258782 5258766 -
atgcaggtcatcaggaaagt

SEQ ID NO: 44883 - DNA, 20 bp, Artificial Sequence
  Synthetic oligonucleotide; GGG chr11 5258762 5258781 5258765 -
tgcaggtcatcaggaaagtg

SEQ ID NO: 44884 - DNA, 20 bp, Artificial Sequence
  Synthetic oligonucleotide; GGG chr11 5258761 5258780 5258764 -
gcaggtcatcaggaaagtgg

SEQ ID NO: 44885 - DNA, 20 bp, Artificial Sequence
  Synthetic oligonucleotide; AAG chr11 5258757 5258776 5258760 -
gtcatcaggaaagtggggga

SEQ ID NO: 44886 - DNA, 20 bp, Artificial Sequence
  Synthetic oligonucleotide; AAG chr11 5258753 5258772 5258756 -
tcaggaaagtgggggaaagc

SEQ ID NO: 44887 - DNA, 20 bp, Artificial Sequence
  Synthetic oligonucleotide; CAG chr11 5258750 5258769 5258753 -
ggaaagtgggggaaagcaag

SEQ ID NO: 44888 - DNA, 20 bp, Artificial Sequence
  Synthetic oligonucleotide; CAG chr11 5258733 5258752 5258736 -
aagcagtcacgtgacttgcc

SEQ ID NO: 44889 - DNA, 20 bp, Artificial Sequence
  Synthetic oligonucleotide; AAG chr11 5258714 5258733 5258717 -
ccagctcccatgcaactcaa

SEQ ID NO: 44890 - DNA, 20 bp, Artificial Sequence
  Synthetic oligonucleotide; AGG chr11 5258713 5258732 5258716 -
cagctcccatgcaactcaaa

SEQ ID NO: 44891 - DNA, 20 bp, Artificial Sequence
  Synthetic oligonucleotide; TGG chr11 5258709 5258728 5258712 -
tcccatgcaactcaaaaggt

SEQ ID NO: 44892 - DNA, 20 bp, Artificial Sequence
  Synthetic oligonucleotide; CAG chr11 5258697 5258716 5258700 -
caaaaggttggtctcacttc

SEQ ID NO: 44893 - DNA, 20 bp, Artificial Sequence
  Synthetic oligonucleotide; CAG chr11 5258675 5258694 5258678 -
gcgtgcaccctcccccgcaa

SEQ ID NO: 44894 - DNA, 20 bp, Artificial Sequence
  Synthetic oligonucleotide; CAG chr11 5258653 5258672 5258656 -
gcaccgaatctgtttccatg

SEQ ID NO: 44895 - DNA, 20 bp, Artificial Sequence
  Synthetic oligonucleotide; CAG chr11 5258649 5258668 5258652 -
cgaatctgtttccatgcagt

SEQ ID NO: 44896 - DNA, 20 bp, Artificial Sequence
  Synthetic oligonucleotide; GAG chr11 5258645 5258664 5258648 -
tctgtttccatgcagtcagt

SEQ ID NO: 44897 - DNA, 20 bp, Artificial Sequence
  Synthetic oligonucleotide; AAG chr11 5258641 5258660 5258644 -
tttccatgcagtcagtgagc

SEQ ID NO: 44898 - DNA, 20 bp, Artificial Sequence
  Synthetic oligonucleotide; AGG chr11 5258640 5258659 5258643 -
ttccatgcagtcagtgagca

SEQ ID NO: 44899 - DNA, 20 bp, Artificial Sequence
  Synthetic oligonucleotide; GAG chr11 5258635 5258654 5258638 -
tgcagtcagtgagcaaggct

SEQ ID NO: 44900 - DNA, 20 bp, Artificial Sequence
  Synthetic oligonucleotide; CAG chr11 5258623 5258642 5258626 -
gcaaggctgagaacttgccc

SEQ ID NO: 44901 - DNA, 20 bp, Artificial Sequence
  Synthetic oligonucleotide; AGG chr11 5258622 5258641 5258625 -
caaggctgagaacttgcccc

SEQ ID NO: 44902 - DNA, 20 bp, Artificial Sequence
  Synthetic oligonucleotide; CAG chr11 5258615 5258634 5258618 -
gagaacttgccccaggctac

SEQ ID NO: 44903 - DNA, 20 bp, Artificial Sequence
  Synthetic oligonucleotide; AAG chr11 5258602 5258621 5258605 -
aggctaccagctgcgaaacc

SEQ ID NO: 44904 - DNA, 20 bp, Artificial Sequence
  Synthetic oligonucleotide; TAG chr11 5258599 5258618 5258602 -
ctaccagctgcgaaaccaag

SEQ ID NO: 44905 - DNA, 20 bp, Artificial Sequence
  Synthetic oligonucleotide; AGG chr11 5258598 5258617 5258601 -
taccagctgcgaaaccaagt

SEQ ID NO: 44906 - DNA, 20 bp, Artificial Sequence
  Synthetic oligonucleotide; GGG chr11 5258597 5258616 5258600 -
accagctgcgaaaccaagta

SEQ ID NO: 44907 - DNA, 20 bp, Artificial Sequence
  Synthetic oligonucleotide; CAG chr11 5258577 5258596 5258580 -
gggctgtcctacttccctgc

SEQ ID NO: 44908 - DNA, 20 bp, Artificial Sequence
  Synthetic oligonucleotide; TGG chr11 5258574 5258593 5258577 -
ctgtcctacttccctgccag

SEQ ID NO: 44909 - DNA, 20 bp, Artificial Sequence
  Synthetic oligonucleotide; GAG chr11 5258572 5258591 5258575 -
gtcctacttccctgccagtg

SEQ ID NO: 44910 - DNA, 20 bp, Artificial Sequence
  Synthetic oligonucleotide; CAG chr11 5258525 5258544 5258528 -
ccaccaacccccccactgcc

SEQ ID NO: 44911 - DNA, 20 bp, Artificial Sequence
  Synthetic oligonucleotide; TAG chr11 5258518 5258537 5258521 -
cccccccactgcccagcccc

SEQ ID NO: 44912 - DNA, 20 bp, Artificial Sequence
  Synthetic oligonucleotide; TGG chr11 5258512 5258531 5258515 -
cactgcccagcccctagatc

SEQ ID NO: 44913 - DNA, 20 bp, Artificial Sequence
  Synthetic oligonucleotide; CAG chr11 5258508 5258527 5258511 -
gcccagcccctagatctggc

SEQ ID NO: 44914 - DNA, 20 bp, Artificial Sequence
  Synthetic oligonucleotide; AGG chr11 5258507 5258526 5258510 -
cccagcccctagatctggcc

SEQ ID NO: 44915 - DNA, 20 bp, Artificial Sequence
  Synthetic oligonucleotide; TGG chr11 5258504 5258523 5258507 -
agcccctagatctggccagg

SEQ ID NO: 44916 - DNA, 20 bp, Artificial Sequence
  Synthetic oligonucleotide; GAG chr11 5258502 5258521 5258505 -
cccctagatctggccaggtg

SEQ ID NO: 44917 - DNA, 20 bp, Artificial Sequence
  Synthetic oligonucleotide; CAG chr11 5258473 5258492 5258476 -
tttttcctgtcatcttttcc

SEQ ID NO: 44918 - DNA, 20 bp, Artificial Sequence
  Synthetic oligonucleotide; TGG chr11 5258464 5258483 5258467 -
tcatcttttcccagttcctc

SEQ ID NO: 44919 - DNA, 20 bp, Artificial Sequence
  Synthetic oligonucleotide; CAG chr11 5258461 5258480 5258464 -
tcttttcccagttcctctgg

SEQ ID NO: 44920 - DNA, 20 bp, Artificial Sequence
  Synthetic oligonucleotide; GAG chr11 5258438 5258457 5258441 -
ccctcccaaatgacccctgt

SEQ ID NO: 44921 - DNA, 20 bp, Artificial Sequence
  Synthetic oligonucleotide; AGG chr11 5258437 5258456 5258440 -
cctcccaaatgacccctgtg

SEQ ID NO: 44922 - DNA, 20 bp, Artificial Sequence
  Synthetic oligonucleotide; AAG chr11 5258433 5258452 5258436 -
ccaaatgacccctgtgaggc

SEQ ID NO: 44923 - DNA, 20 bp, Artificial Sequence
  Synthetic oligonucleotide; AGG chr11 5258432 5258451 5258435 -
caaatgacccctgtgaggca

SEQ ID NO: 44924 - DNA, 20 bp, Artificial Sequence
  Synthetic oligonucleotide; CAG chr11 5258429 5258448 5258432 -
atgacccctgtgaggcaagg

SEQ ID NO: 44925 - DNA, 20 bp, Artificial Sequence
  Synthetic oligonucleotide; TGG chr11 5258423 5258442 5258426 -
cctgtgaggcaaggcagaaa

SEQ ID NO: 44926 - DNA, 20 bp, Artificial Sequence
  Synthetic oligonucleotide; TAG chr11 5258415 5258434 5258418 -
gcaaggcagaaatggcttcc

SEQ ID NO: 44927 - DNA, 20 bp, Artificial Sequence
  Synthetic oligonucleotide; AGG chr11 5258414 5258433 5258417 -
caaggcagaaatggcttcct

SEQ ID NO: 44928 - DNA, 20 bp, Artificial Sequence
  Synthetic oligonucleotide; GGG chr11 5258413 5258432 5258416 -
aaggcagaaatggcttccta

SEQ ID NO: 44929 - DNA, 20 bp, Artificial Sequence
  Synthetic oligonucleotide; GGG chr11 5258412 5258431 5258415 -
aggcagaaatggcttcctag

SEQ ID NO: 44930 - DNA, 20 bp, Artificial Sequence
  Synthetic oligonucleotide; CAG chr11 5258406 5258425 5258409 -
aaatggcttcctaggggacc

SEQ ID NO: 44931 - DNA, 20 bp, Artificial Sequence
  Synthetic oligonucleotide; GAG chr11 5258404 5258423 5258407 -
atggcttcctaggggaccca

SEQ ID NO: 44932 - DNA, 20 bp, Artificial Sequence
  Synthetic oligonucleotide; GAG chr11 5258402 5258421 5258405 -
ggcttcctaggggacccaga

SEQ ID NO: 44933 - DNA, 20 bp, Artificial Sequence
  Synthetic oligonucleotide; CAG chr11 5258395 5258414 5258398 -
taggggacccagagagccca

SEQ ID NO: 44934 - DNA, 20 bp, Artificial Sequence
  Synthetic oligonucleotide; AGG chr11 5258394 5258413 5258397 -
aggggacccagagagcccac

SEQ ID NO: 44935 - DNA, 20 bp, Artificial Sequence
  Synthetic oligonucleotide; GGG chr11 5258393 5258412 5258396 -
ggggacccagagagcccaca

SEQ ID NO: 44936 - DNA, 20 bp, Artificial Sequence
  Synthetic oligonucleotide; TGG chr11 5258354 5258373 5258357 -
ctctacccctgtattttgct

SEQ ID NO: 44937 - DNA, 20 bp, Artificial Sequence
  Synthetic oligonucleotide; CAG chr11 5258336 5258355 5258339 -
cttggccctctaaattgact

SEQ ID NO: 44938 - DNA, 20 bp, Artificial Sequence
  Synthetic oligonucleotide; CAG chr11 5258330 5258349 5258333 -
cctctaaattgactcagctc

SEQ ID NO: 44939 - DNA, 20 bp, Artificial Sequence
  Synthetic oligonucleotide; AGG chr11 5258329 5258348 5258332 -
ctctaaattgactcagctcc

SEQ ID NO: 44940 - DNA, 20 bp, Artificial Sequence
  Synthetic oligonucleotide; AAG chr11 5258325 5258344 5258328 -
aaattgactcagctccaggt

SEQ ID NO: 44941 - DNA, 20 bp, Artificial Sequence
  Synthetic oligonucleotide; AGG chr11 5258324 5258343 5258327 -
aattgactcagctccaggta

SEQ ID NO: 44942 - DNA, 20 bp, Artificial Sequence
  Synthetic oligonucleotide; CAG chr11 5258320 5258339 5258323 -
gactcagctccaggtaaggt

SEQ ID NO: 44943 - DNA, 20 bp, Artificial Sequence
  Synthetic oligonucleotide; TGG chr11 5258305 5258324 5258308 -
aaggtcagaatcttctcctg

SEQ ID NO: 44944 - DNA, 20 bp, Artificial Sequence
  Synthetic oligonucleotide; TAG chr11 5258300 5258319 5258303 -
cagaatcttctcctgtggtc

SEQ ID NO: 44945 - DNA, 20 bp, Artificial Sequence
  Synthetic oligonucleotide; CAG chr11 5258292 5258311 5258295 -
tctcctgtggtctagatctt

SEQ ID NO: 44946 - DNA, 20 bp, Artificial Sequence
  Synthetic oligonucleotide; AGG chr11 5258291 5258310 5258294 -
ctcctgtggtctagatcttc

SEQ ID NO: 44947 - DNA, 20 bp, Artificial Sequence
  Synthetic oligonucleotide; CAG chr11 5258283 5258302 5258286 -
gtctagatcttcaggttccc

SEQ ID NO: 44948 - DNA, 20 bp, Artificial Sequence
  Synthetic oligonucleotide; GAG chr11 5258279 5258298 5258282 -
agatcttcaggttccccagt

SEQ ID NO: 44949 - DNA, 20 bp, Artificial Sequence
  Synthetic oligonucleotide; AGG chr11 5258278 5258297 5258281 -
gatcttcaggttccccagtg

SEQ ID NO: 44950 - DNA, 20 bp, Artificial Sequence
  Synthetic oligonucleotide; TGG chr11 5258266 5258285 5258269 -
ccccagtgaggatgtgtgtt

SEQ ID NO: 44951 - DNA, 20 bp, Artificial Sequence
  Synthetic oligonucleotide; GGG chr11 5258265 5258284 5258268 -
cccagtgaggatgtgtgttt

SEQ ID NO: 44952 - DNA, 20 bp, Artificial Sequence
  Synthetic oligonucleotide; GGG chr11 5258264 5258283 5258267 -
ccagtgaggatgtgtgtttg

SEQ ID NO: 44953 - DNA, 20 bp, Artificial Sequence
  Synthetic oligonucleotide; GGG chr11 5258263 5258282 5258266 -
cagtgaggatgtgtgtttgg

SEQ ID NO: 44954 - DNA, 20 bp, Artificial Sequence
  Synthetic oligonucleotide; TAG chr11 5258260 5258279 5258263 -
tgaggatgtgtgtttggggg

SEQ ID NO: 44955 - DNA, 20 bp, Artificial Sequence
  Synthetic oligonucleotide; CGG chr11 5258256 5258275 5258259 -
gatgtgtgtttgggggtaga

SEQ ID NO: 44956 - DNA, 20 bp, Artificial Sequence
  Synthetic oligonucleotide; CAG chr11 5258234 5258253 5258237 -
gtcccccttttccacttcca

SEQ ID NO: 44957 - DNA, 20 bp, Artificial Sequence
  Synthetic oligonucleotide; TGG chr11 5258229 5258248 5258232 -
ccttttccacttccacagtt

SEQ ID NO: 44958 - DNA, 20 bp, Artificial Sequence
  Synthetic oligonucleotide; GGG chr11 5258228 5258247 5258231 -
cttttccacttccacagttt

SEQ ID NO: 44959 - DNA, 20 bp, Artificial Sequence
  Synthetic oligonucleotide; TGG chr11 5258212 5258231 5258215 -
gtttgggcactcacaatatt

SEQ ID NO: 44960 - DNA, 20 bp, Artificial Sequence
  Synthetic oligonucleotide; GGG chr11 5258211 5258230 5258214 -
tttgggcactcacaatattt

SEQ ID NO: 44961 - DNA, 20 bp, Artificial Sequence
  Synthetic oligonucleotide; GGG chr11 5258210 5258229 5258213 -
ttgggcactcacaatatttg

SEQ ID NO: 44962 - DNA, 20 bp, Artificial Sequence
  Synthetic oligonucleotide; CGG chr11 5258200 5258219 5258203 -
acaatatttggggtgtttcc

SEQ ID NO: 44963 - DNA, 20 bp, Artificial Sequence
  Synthetic oligonucleotide; GGG chr11 5258199 5258218 5258202 -
caatatttggggtgtttccc

SEQ ID NO: 44964 - DNA, 20 bp, Artificial Sequence
  Synthetic oligonucleotide; CAG chr11 5258191 5258210 5258194 -
ggggtgtttcccgggtcctg

SEQ ID NO: 44965 - DNA, 20 bp, Artificial Sequence
  Synthetic oligonucleotide; AGG chr11 5258190 5258209 5258193 -
gggtgtttcccgggtcctgc

SEQ ID NO: 44966 - DNA, 20 bp, Artificial Sequence
  Synthetic oligonucleotide; GAG chr11 5258188 5258207 5258191 -
gtgtttcccgggtcctgcag

SEQ ID NO: 44967 - DNA, 20 bp, Artificial Sequence
  Synthetic oligonucleotide; CAG chr11 5258171 5258190 5258174 -
caggagcaatctgcttcttt

SEQ ID NO: 44968 - DNA, 20 bp, Artificial Sequence
  Synthetic oligonucleotide; GAG chr11 5258169 5258188 5258172 -
ggagcaatctgcttctttca

SEQ ID NO: 44969 - DNA, 20 bp, Artificial Sequence
  Synthetic oligonucleotide; AGG chr11 5258168 5258187 5258171 -
gagcaatctgcttctttcag

SEQ ID NO: 44970 - DNA, 20 bp, Artificial Sequence
  Synthetic oligonucleotide; GGG chr11 5258167 5258186 5258170 -
agcaatctgcttctttcaga

SEQ ID NO: 44971 - DNA, 20 bp, Artificial Sequence
  Synthetic oligonucleotide; CAG chr11 5258150 5258169 5258153 -
agagggtgtgtgcgttctct

SEQ ID NO: 44972 - DNA, 20 bp, Artificial Sequence
  Synthetic oligonucleotide; CAG chr11 5258128 5258147 5258131 -
gctttcttgatttatttctg

SEQ ID NO: 44973 - DNA, 20 bp, Artificial Sequence
  Synthetic oligonucleotide; AGG chr11 5258127 5258146 5258130 -
ctttcttgatttatttctgc

SEQ ID NO: 44974 - DNA, 20 bp, Artificial Sequence
  Synthetic oligonucleotide; TGG chr11 5258124 5258143 5258127 -
tcttgatttatttctgcagg

SEQ ID NO: 44975 - DNA, 20 bp, Artificial Sequence
  Synthetic oligonucleotide; TGG chr11 5258100 5258119 5258103 -
tctgcaaaaaaaattcctga

SEQ ID NO: 44976 - DNA, 20 bp, Artificial Sequence
  Synthetic oligonucleotide; GGG chr11 5258099 5258118 5258102 -
ctgcaaaaaaaattcctgat

SEQ ID NO: 44977 - DNA, 20 bp, Artificial Sequence
  Synthetic oligonucleotide; GAG chr11 5258097 5258116 5258100 -
gcaaaaaaaattcctgatgg

SEQ ID NO: 44978 - DNA, 20 bp, Artificial Sequence
  Synthetic oligonucleotide; GAG chr11 5258069 5258088 5258072 -
acatgctgctctgtgcatcc

SEQ ID NO: 44979 - DNA, 20 bp, Artificial Sequence
  Synthetic oligonucleotide; TGG chr11 5258066 5258085 5258069 -
tgctgctctgtgcatccgag

SEQ ID NO: 44980 - DNA, 20 bp, Artificial Sequence
  Synthetic oligonucleotide; GGG chr11 5258065 5258084 5258068 -
gctgctctgtgcatccgagt

SEQ ID NO: 44981 - DNA, 20 bp, Artificial Sequence
  Synthetic oligonucleotide; GAG chr11 5258063 5258082 5258066 -
tgctctgtgcatccgagtgg

SEQ ID NO: 44982 - DNA, 20 bp, Artificial Sequence
  Synthetic oligonucleotide; CGG chr11 5258011 5258030 5258014 -
gccatcaccctctaatttgt

SEQ ID NO: 44983 - DNA, 20 bp, Artificial Sequence
  Synthetic oligonucleotide; AAG chr11 5257929 5257948 5257932 -
ctatactgccctttgatatc

SEQ ID NO: 44984 - DNA, 20 bp, Artificial Sequence
  Synthetic oligonucleotide; AGG chr11 5257928 5257947 5257931 -
tatactgccctttgatatca

SEQ ID NO: 44985 - DNA, 20 bp, Artificial Sequence
  Synthetic oligonucleotide; AAG chr11 5257921 5257940 5257924 -
ccctttgatatcaaggaatc

SEQ ID NO: 44986 - DNA, 20 bp, Artificial Sequence
  Synthetic oligonucleotide; AGG chr11 5257920 5257939 5257923 -
cctttgatatcaaggaatca

SEQ ID NO: 44987 - DNA, 20 bp, Artificial Sequence
  Synthetic oligonucleotide; GAG chr11 5257907 5257926 5257910 -
ggaatcaaggacgtgatgtt

SEQ ID NO: 44988 - DNA, 20 bp, Artificial Sequence
  Synthetic oligonucleotide; AGG chr11 5257906 5257925 5257909 -
gaatcaaggacgtgatgttg

SEQ ID NO: 44989 - DNA, 20 bp, Artificial Sequence
  Synthetic oligonucleotide; GGG chr11 5257905 5257924 5257908 -
aatcaaggacgtgatgttga

SEQ ID NO: 44990 - DNA, 20 bp, Artificial Sequence
  Synthetic oligonucleotide; GGG chr11 5257904 5257923 5257907 -
atcaaggacgtgatgttgag

SEQ ID NO: 44991 - DNA, 20 bp, Artificial Sequence
  Synthetic oligonucleotide; TGG chr11 5257901 5257920 5257904 -
aaggacgtgatgttgagggg

SEQ ID NO: 44992 - DNA, 20 bp, Artificial Sequence
  Synthetic oligonucleotide; GGG chr11 5257900 5257919 5257903 -
aggacgtgatgttgaggggt

SEQ ID NO: 44993 - DNA, 20 bp, Artificial Sequence
  Synthetic oligonucleotide; CAG chr11 5257897 5257916 5257900 -
acgtgatgttgaggggtggg

SEQ ID NO: 44994 - DNA, 20 bp, Artificial Sequence
  Synthetic oligonucleotide; TGG chr11 5257894 5257913 5257897 -
tgatgttgaggggtgggcag

SEQ ID NO: 44995 - DNA, 20 bp, Artificial Sequence
  Synthetic oligonucleotide; TAG chr11 5257874 5257893 5257877 -
tggatacactctttacccct

SEQ ID NO: 44996 - DNA, 20 bp, Artificial Sequence
  Synthetic oligonucleotide; AGG chr11 5257873 5257892 5257876 -
ggatacactctttacccctt

SEQ ID NO: 44997 - DNA, 20 bp, Artificial Sequence
  Synthetic oligonucleotide; GGG chr11 5257872 5257891 5257875 -
gatacactctttacccctta

SEQ ID NO: 44998 - DNA, 20 bp, Artificial Sequence
  Synthetic oligonucleotide; GAG chr11 5257870 5257889 5257873 -
tacactctttaccccttagg

SEQ ID NO: 44999 - DNA, 20 bp, Artificial Sequence
  Synthetic oligonucleotide; TAG chr11 5257860 5257879 5257863 -
accccttagggagctatatc

SEQ ID NO: 45000 - DNA, 20 bp, Artificial Sequence
  Synthetic oligonucleotide; TAG chr11 5257854 5257873 5257857 -
tagggagctatatctagatt

SEQ ID NO: 45001 - DNA, 20 bp, Artificial Sequence
  Synthetic oligonucleotide; AAG chr11 5257838 5257857 5257841 -
gatttagatattgccaattc

SEQ ID NO: 45002 - DNA, 20 bp, Artificial Sequence
  Synthetic oligonucleotide; AAG chr11 5257822 5257841 5257825 -
attcaagataacttaattga

SEQ ID NO: 45003 - DNA, 20 bp, Artificial Sequence
  Synthetic oligonucleotide; AAG chr11 5257774 5257793 5257777 -
cacacacacatctgcatgac

SEQ ID NO: 45004 - DNA, 20 bp, Artificial Sequence
  Synthetic oligonucleotide; TAG chr11 5257763 5257782 5257766 -
ctgcatgacaagatttttaa

SEQ ID NO: 45005 - DNA, 20 bp, Artificial Sequence
  Synthetic oligonucleotide; AAG chr11 5257756 5257775 5257759 -
acaagatttttaatagttga

SEQ ID NO: 45006 - DNA, 20 bp, Artificial Sequence
  Synthetic oligonucleotide; CAG chr11 5257734 5257753 5257737 -
gaataactaataattgtcca

SEQ ID NO: 45007 - DNA, 20 bp, Artificial Sequence
  Synthetic oligonucleotide; AGG chr11 5257733 5257752 5257736 -
aataactaataattgtccac

SEQ ID NO: 45008 - DNA, 20 bp, Artificial Sequence
  Synthetic oligonucleotide; AAG chr11 5257726 5257745 5257729 -
aataattgtccacaggcaat

SEQ ID NO: 45009 - DNA, 20 bp, Artificial Sequence
  Synthetic oligonucleotide; AGG chr11 5257725 5257744 5257728 -
ataattgtccacaggcaata

SEQ ID NO: 45010 - DNA, 20 bp, Artificial Sequence
  Synthetic oligonucleotide; GGG chr11 5257724 5257743 5257727 -
taattgtccacaggcaataa

SEQ ID NO: 45011 - DNA, 20 bp, Artificial Sequence
  Synthetic oligonucleotide; AAG chr11 5257715 5257734 5257718 -
acaggcaataagggcttttt

SEQ ID NO: 45012 - DNA, 20 bp, Artificial Sequence
  Synthetic oligonucleotide; CAG chr11 5257707 5257726 5257710 -
taagggctttttaagcaaaa

SEQ ID NO: 45013 - DNA, 20 bp, Artificial Sequence
  Synthetic oligonucleotide; CAG chr11 5257694 5257713 5257697 -
agcaaaacagttgtgataaa

SEQ ID NO: 45014 - DNA, 20 bp, Artificial Sequence
  Synthetic oligonucleotide; AGG chr11 5257693 5257712 5257696 -
gcaaaacagttgtgataaac

SEQ ID NO: 45015 - DNA, 20 bp, Artificial Sequence
  Synthetic oligonucleotide; TAG chr11 5257683 5257702 5257686 -
tgtgataaacaggtcattct

SEQ ID NO: 45016 - DNA, 20 bp, Artificial Sequence
  Synthetic oligonucleotide; TAG chr11 5257678 5257697 5257681 -
taaacaggtcattcttagaa

SEQ ID NO: 45017 - DNA, 20 bp, Artificial Sequence
  Synthetic oligonucleotide; CAG chr11 5257670 5257689 5257673 -
tcattcttagaatagtaatc

SEQ ID NO: 45018 - DNA, 20 bp, Artificial Sequence
  Synthetic oligonucleotide; TAG chr11 5257663 5257682 5257666 -
tagaatagtaatccagccaa

SEQ ID NO: 45019 - DNA, 20 bp, Artificial Sequence
  Synthetic oligonucleotide; CAG chr11 5257658 5257677 5257661 -
tagtaatccagccaatagta

SEQ ID NO: 45020 - DNA, 20 bp, Artificial Sequence
  Synthetic oligonucleotide; AGG chr11 5257657 5257676 5257660 -
agtaatccagccaatagtac

SEQ ID NO: 45021 - DNA, 20 bp, Artificial Sequence
  Synthetic oligonucleotide; TAG chr11 5257649 5257668 5257652 -
agccaatagtacaggttgct

SEQ ID NO: 45022 - DNA, 20 bp, Artificial Sequence
  Synthetic oligonucleotide; GAG chr11 5257647 5257666 5257650 -
ccaatagtacaggttgctta

SEQ ID NO: 45023 - DNA, 20 bp, Artificial Sequence
  Synthetic oligonucleotide; CAG chr11 5257631 5257650 5257634 -
cttagagattatgtcattac

SEQ ID NO: 45024 - DNA, 20 bp, Artificial Sequence
  Synthetic oligonucleotide; GAG chr11 5257629 5257648 5257632 -
tagagattatgtcattacca

SEQ ID NO: 45025 - DNA, 20 bp, Artificial Sequence
  Synthetic oligonucleotide; TGG chr11 5257612 5257631 5257615 -
ccagagttaaaattctataa

SEQ ID NO: 45026 - DNA, 20 bp, Artificial Sequence
  Synthetic oligonucleotide; GAG chr11 5257590 5257609 5257593 -
gcttctcactccctaccact

SEQ ID NO: 45027 - DNA, 20 bp, Artificial Sequence
  Synthetic oligonucleotide; AGG chr11 5257589 5257608 5257592 -
cttctcactccctaccactg

SEQ ID NO: 45028 - DNA, 20 bp, Artificial Sequence
  Synthetic oligonucleotide; AAG chr11 5257584 5257603 5257587 -
cactccctaccactgaggac

SEQ ID NO: 45029 - DNA, 20 bp, Artificial Sequence
  Synthetic oligonucleotide; TAG chr11 5257571 5257590 5257574 -
tgaggacaagtttatgtcct

SEQ ID NO: 45030 - DNA, 20 bp, Artificial Sequence
  Synthetic oligonucleotide; AGG chr11 5257570 5257589 5257573 -
gaggacaagtttatgtcctt

SEQ ID NO: 45031 - DNA, 20 bp, Artificial Sequence
  Synthetic oligonucleotide; CGG chr11 5257515 5257534 5257518 -
ttctccactttacatatcaa

SEQ ID NO: 45032 - DNA, 20 bp, Artificial Sequence
  Synthetic oligonucleotide; TGG chr11 5257509 5257528 5257512 -
actttacatatcaacggcac

SEQ ID NO: 45033 - DNA, 20 bp, Artificial Sequence
  Synthetic oligonucleotide; TGG chr11 5257489 5257508 5257492 -
tggttctttatctaactctc

SEQ ID NO: 45034 - DNA, 20 bp, Artificial Sequence
  Synthetic oligonucleotide; CAG chr11 5257484 5257503 5257487 -
ctttatctaactctctggca

SEQ ID NO: 45035 - DNA, 20 bp, Artificial Sequence
  Synthetic oligonucleotide; CAG chr11 5257481 5257500 5257484 -
tatctaactctctggcacag

SEQ ID NO: 45036 - DNA, 20 bp, Artificial Sequence
  Synthetic oligonucleotide; AGG chr11 5257480 5257499 5257483 -
atctaactctctggcacagc

SEQ ID NO: 45037 - DNA, 20 bp, Artificial Sequence
  Synthetic oligonucleotide; GAG chr11 5257478 5257497 5257481 -
ctaactctctggcacagcag

SEQ ID NO: 45038 - DNA, 20 bp, Artificial Sequence
  Synthetic oligonucleotide; CAG chr11 5257458 5257477 5257461 -
gagtttgttttcttctgctt

SEQ ID NO: 45039 - DNA, 20 bp, Artificial Sequence
  Synthetic oligonucleotide; GAG chr11 5257456 5257475 5257459 -
gtttgttttcttctgcttca

SEQ ID NO: 45040 - DNA, 20 bp, Artificial Sequence
  Synthetic oligonucleotide; CAG chr11 5257436 5257455 5257439 -
gagctttgaatttactattt

SEQ ID NO: 45041 - DNA, 20 bp, Artificial Sequence
  Synthetic oligonucleotide; TGG chr11 5257418 5257437 5257421 -
ttcagcttctaaactttatt

SEQ ID NO: 45042 - DNA, 20 bp, Artificial Sequence
  Synthetic oligonucleotide; TGG chr11 5257402 5257421 5257405 -
tatttggcaatgccttccca

SEQ ID NO: 45043 - DNA, 20 bp, Artificial Sequence
  Synthetic oligonucleotide; CAG chr11 5257399 5257418 5257402 -
ttggcaatgccttcccatgg

SEQ ID NO: 45044 - DNA, 20 bp, Artificial Sequence
  Synthetic oligonucleotide; TAG chr11 5257343 5257362 5257346 -
tttctccttaatttcattct

SEQ ID NO: 45045 - DNA, 20 bp, Artificial Sequence
  Synthetic oligonucleotide; TAG chr11 5257278 5257297 5257281 -
aattttatgtatgttctacc

SEQ ID NO: 45046 - DNA, 20 bp, Artificial Sequence
  Synthetic oligonucleotide; CAG chr11 5257264 5257283 5257267 -
tctacctagattataatctt

SEQ ID NO: 45047 - DNA, 20 bp, Artificial Sequence
  Synthetic oligonucleotide; GAG chr11 5257262 5257281 5257265 -
tacctagattataatcttca

SEQ ID NO: 45048 - DNA, 20 bp, Artificial Sequence
  Synthetic oligonucleotide; AGG chr11 5257261 5257280 5257264 -
acctagattataatcttcag

SEQ ID NO: 45049 - DNA, 20 bp, Artificial Sequence
  Synthetic oligonucleotide; AAG chr11 5257257 5257276 5257260 -
agattataatcttcagagga

SEQ ID NO: 45050 - DNA, 20 bp, Artificial Sequence
  Synthetic oligonucleotide; CAG chr11 5257191 5257210 5257194 -
aaattatgacatttatttaa

SEQ ID NO: 45051 - DNA, 20 bp, Artificial Sequence
  Synthetic oligonucleotide; TGG chr11 5257158 5257177 5257161 -
aacaaatgtttgaaaataca

SEQ ID NO: 45052 - DNA, 20 bp, Artificial Sequence
  Synthetic oligonucleotide; GGG chr11 5257157 5257176 5257160 -
acaaatgtttgaaaatacat

SEQ ID NO: 45053 - DNA, 20 bp, Artificial Sequence
  Synthetic oligonucleotide; AAG chr11 5257153 5257172 5257156 -
atgtttgaaaatacatggga

SEQ ID NO: 45054 - DNA, 20 bp, Artificial Sequence
  Synthetic oligonucleotide; AAG chr11 5257118 5257137 5257121 -
cacttgaaattgcttgtgta

SEQ ID NO: 45055 - DNA, 20 bp, Artificial Sequence
  Synthetic oligonucleotide; CAG chr11 5257112 5257131 5257115 -
aaattgcttgtgtaaagaaa

SEQ ID NO: 45056 - DNA, 20 bp, Artificial Sequence
  Synthetic oligonucleotide; CAG chr11 5257103 5257122 5257106 -
gtgtaaagaaacagttttat

SEQ ID NO: 45057 - DNA, 20 bp, Artificial Sequence
  Synthetic oligonucleotide; TAG chr11 5257099 5257118 5257102 -
aaagaaacagttttatcagt

SEQ ID NO: 45058 - DNA, 20 bp, Artificial Sequence
  Synthetic oligonucleotide; AGG chr11 5257098 5257117 5257101 -
aagaaacagttttatcagtt

SEQ ID NO: 45059 - DNA, 20 bp, Artificial Sequence
  Synthetic oligonucleotide; CAG chr11 5257082 5257101 5257085 -
agttaggatttaatcaatgt

SEQ ID NO: 45060 - DNA, 20 bp, Artificial Sequence
  Synthetic oligonucleotide; AAG chr11 5257079 5257098 5257082 -
taggatttaatcaatgtcag

SEQ ID NO: 45061 - DNA, 20 bp, Artificial Sequence
  Synthetic oligonucleotide; TAG chr11 5257068 5257087 5257071 -
caatgtcagaagcaatgata

SEQ ID NO: 45062 - DNA, 20 bp, Artificial Sequence
  Synthetic oligonucleotide; AGG chr11 5257067 5257086 5257070 -
aatgtcagaagcaatgatat

SEQ ID NO: 45063 - DNA, 20 bp, Artificial Sequence
  Synthetic oligonucleotide; GAG chr11 5257057 5257076 5257060 -
gcaatgatataggaaaaatc

SEQ ID NO: 45064 - DNA, 20 bp, Artificial Sequence
  Synthetic oligonucleotide; AGG chr11 5257056 5257075 5257059 -
caatgatataggaaaaatcg

SEQ ID NO: 45065 - DNA, 20 bp, Artificial Sequence
  Synthetic oligonucleotide; AAG chr11 5257050 5257069 5257053 -
tataggaaaaatcgaggaat

SEQ ID NO: 45066 - DNA, 20 bp, Artificial Sequence
  Synthetic oligonucleotide; CAG chr11 5257046 5257065 5257049 -
ggaaaaatcgaggaataaga

SEQ ID NO: 45067 - DNA, 20 bp, Artificial Sequence
  Synthetic oligonucleotide; TGG chr11 5257040 5257059 5257043 -
atcgaggaataagacagtta

SEQ ID NO: 45068 - DNA, 20 bp, Artificial Sequence
  Synthetic oligonucleotide; AAG chr11 5257035 5257054 5257038 -
ggaataagacagttatggat

SEQ ID NO: 45069 - DNA, 20 bp, Artificial Sequence
  Synthetic oligonucleotide; AGG chr11 5257034 5257053 5257037 -
gaataagacagttatggata

SEQ ID NO: 45070 - DNA, 20 bp, Artificial Sequence
  Synthetic oligonucleotide; GAG chr11 5257032 5257051 5257035 -
ataagacagttatggataag

SEQ ID NO: 45071 - DNA, 20 bp, Artificial Sequence
  Synthetic oligonucleotide; AAG chr11 5257011 5257030 5257014 -
agaaatcaacaaactcttaa

SEQ ID NO: 45072 - DNA, 20 bp, Artificial Sequence
  Synthetic oligonucleotide; AAG chr11 5256996 5257015 5256999 -
cttaaaagatattgcctcaa

SEQ ID NO: 45073 - DNA, 20 bp, Artificial Sequence
  Synthetic oligonucleotide; AAG chr11 5256990 5257009 5256993 -
agatattgcctcaaaagcat

SEQ ID NO: 45074 - DNA, 20 bp, Artificial Sequence
  Synthetic oligonucleotide; GAG chr11 5256988 5257007 5256991 -
atattgcctcaaaagcataa

SEQ ID NO: 45075 - DNA, 20 bp, Artificial Sequence
  Synthetic oligonucleotide; AGG chr11 5256987 5257006 5256990 -
tattgcctcaaaagcataag

SEQ ID NO: 45076 - DNA, 20 bp, Artificial Sequence
  Synthetic oligonucleotide; AAG chr11 5256980 5256999 5256983 -
tcaaaagcataagaggaaat

SEQ ID NO: 45077 - DNA, 20 bp, Artificial Sequence
  Synthetic oligonucleotide; AGG chr11 5256979 5256998 5256982 -
caaaagcataagaggaaata

SEQ ID NO: 45078 - DNA, 20 bp, Artificial Sequence
  Synthetic oligonucleotide; GGG chr11 5256978 5256997 5256981 -
aaaagcataagaggaaataa

SEQ ID NO: 45079 - DNA, 20 bp, Artificial Sequence
  Synthetic oligonucleotide; TAG chr11 5256960 5256979 5256963 -
aagggtttatacatgacttt

SEQ ID NO: 45080 - DNA, 20 bp, Artificial Sequence
  Synthetic oligonucleotide; TGG chr11 5256947 5256966 5256950 -
tgacttttagaacactgcct

SEQ ID NO: 45081 - DNA, 20 bp, Artificial Sequence
  Synthetic oligonucleotide; TGG chr11 5256940 5256959 5256943 -
tagaacactgccttggtttt

SEQ ID NO: 45082 - DNA, 20 bp, Artificial Sequence
  Synthetic oligonucleotide; TGG chr11 5256932 5256951 5256935 -
tgccttggtttttggataaa

SEQ ID NO: 45083 - DNA, 20 bp, Artificial Sequence
  Synthetic oligonucleotide; GGG chr11 5256931 5256950 5256934 -
gccttggtttttggataaat

SEQ ID NO: 45084 - DNA, 20 bp, Artificial Sequence
  Synthetic oligonucleotide; GGG chr11 5256930 5256949 5256933 -
ccttggtttttggataaatg

SEQ ID NO: 45085 - DNA, 20 bp, Artificial Sequence
  Synthetic oligonucleotide; AAG chr11 5256927 5256946 5256930 -
tggtttttggataaatgggg

SEQ ID NO: 45086 - DNA, 20 bp, Artificial Sequence
  Synthetic oligonucleotide; CAG chr11 5256913 5256932 5256916 -
atggggaagttgtttgaaaa

SEQ ID NO: 45087 - DNA, 20 bp, Artificial Sequence
  Synthetic oligonucleotide; AGG chr11 5256912 5256931 5256915 -
tggggaagttgtttgaaaac

SEQ ID NO: 45088 - DNA, 20 bp, Artificial Sequence
  Synthetic oligonucleotide; GAG chr11 5256910 5256929 5256913 -
gggaagttgtttgaaaacag

SEQ ID NO: 45089 - DNA, 20 bp, Artificial Sequence
  Synthetic oligonucleotide; AGG chr11 5256909 5256928 5256912 -
ggaagttgtttgaaaacagg

SEQ ID NO: 45090 - DNA, 20 bp, Artificial Sequence
  Synthetic oligonucleotide; GGG chr11 5256908 5256927 5256911 -
gaagttgtttgaaaacagga

SEQ ID NO: 45091 - DNA, 20 bp, Artificial Sequence
  Synthetic oligonucleotide; TAG chr11 5256901 5256920 5256904 -
tttgaaaacaggagggatcc

SEQ ID NO: 45092 - DNA, 20 bp, Artificial Sequence
  Synthetic oligonucleotide; TAG chr11 5256890 5256909 5256893 -
gagggatcctagatattcct

SEQ ID NO: 45093 - DNA, 20 bp, Artificial Sequence
  Synthetic oligonucleotide; GAG chr11 5256884 5256903 5256887 -
tcctagatattccttagtct

SEQ ID NO: 45094 - DNA, 20 bp, Artificial Sequence
  Synthetic oligonucleotide; AGG chr11 5256883 5256902 5256886 -
cctagatattccttagtctg

SEQ ID NO: 45095 - DNA, 20 bp, Artificial Sequence
  Synthetic oligonucleotide; GAG chr11 5256881 5256900 5256884 -
tagatattccttagtctgag

SEQ ID NO: 45096 - DNA, 20 bp, Artificial Sequence
  Synthetic oligonucleotide; AGG chr11 5256880 5256899 5256883 -
agatattccttagtctgagg

SEQ ID NO: 45097 - DNA, 20 bp, Artificial Sequence
  Synthetic oligonucleotide; GAG chr11 5256878 5256897 5256881 -
atattccttagtctgaggag

SEQ ID NO: 45098 - DNA, 20 bp, Artificial Sequence
  Synthetic oligonucleotide; AAG chr11 5256870 5256889 5256873 -
tagtctgaggaggagcaatt

SEQ ID NO: 45099 - DNA, 20 bp, Artificial Sequence
  Synthetic oligonucleotide; TAG chr11 5256856 5256875 5256859 -
gcaattaagattcacttgtt

SEQ ID NO: 45100 - DNA, 20 bp, Artificial Sequence
  Synthetic oligonucleotide; GAG chr11 5256854 5256873 5256857 -
aattaagattcacttgttta

SEQ ID NO: 45101 - DNA, 20 bp, Artificial Sequence
  Synthetic oligonucleotide; AGG chr11 5256853 5256872 5256856 -
attaagattcacttgtttag

SEQ ID NO: 45102 - DNA, 20 bp, Artificial Sequence
  Synthetic oligonucleotide; TGG chr11 5256849 5256868 5256852 -
agattcacttgtttagaggc

SEQ ID NO: 45103 - DNA, 20 bp, Artificial Sequence
  Synthetic oligonucleotide; GGG chr11 5256848 5256867 5256851 -
gattcacttgtttagaggct

SEQ ID NO: 45104 - DNA, 20 bp, Artificial Sequence
  Synthetic oligonucleotide; GAG chr11 5256846 5256865 5256849 -
ttcacttgtttagaggctgg

SEQ ID NO: 45105 - DNA, 20 bp, Artificial Sequence
  Synthetic oligonucleotide; TGG chr11 5256843 5256862 5256846 -
acttgtttagaggctgggag

SEQ ID NO: 45106 - DNA, 20 bp, Artificial Sequence
  Synthetic oligonucleotide; TGG chr11 5256840 5256859 5256843 -
tgtttagaggctgggagtgg

SEQ ID NO: 45107 - DNA, 20 bp, Artificial Sequence
  Synthetic oligonucleotide; CAG chr11 5256821 5256840 5256824 -
gtggctcacgcctgtaatcc

SEQ ID NO: 45108 - DNA, 20 bp, Artificial Sequence
  Synthetic oligonucleotide; TGG chr11 5256813 5256832 5256816 -
cgcctgtaatcccagaattt

SEQ ID NO: 45109 - DNA, 20 bp, Artificial Sequence
  Synthetic oligonucleotide; GGG chr11 5256812 5256831 5256815 -
gcctgtaatcccagaatttt

SEQ ID NO: 45110 - DNA, 20 bp, Artificial Sequence
  Synthetic oligonucleotide; GAG chr11 5256810 5256829 5256813 -
ctgtaatcccagaattttgg

SEQ ID NO: 45111 - DNA, 20 bp, Artificial Sequence
  Synthetic oligonucleotide; AGG chr11 5256809 5256828 5256812 -
tgtaatcccagaattttggg

SEQ ID NO: 45112 - DNA, 20 bp, Artificial Sequence
  Synthetic oligonucleotide; AAG chr11 5256804 5256823 5256807 -
tcccagaattttgggaggcc

SEQ ID NO: 45113 - DNA, 20 bp, Artificial Sequence
  Synthetic oligonucleotide; AGG chr11 5256803 5256822 5256806 -
cccagaattttgggaggcca

SEQ ID NO: 45114 - DNA, 20 bp, Artificial Sequence
  Synthetic oligonucleotide; CAG chr11 5256800 5256819 5256803 -
agaattttgggaggccaagg

SEQ ID NO: 45115 - DNA, 20 bp, Artificial Sequence
  Synthetic oligonucleotide; AGG chr11 5256799 5256818 5256802 -
gaattttgggaggccaaggc

SEQ ID NO: 45116 - DNA, 20 bp, Artificial Sequence
  Synthetic oligonucleotide; CAG chr11 5256796 5256815 5256799 -
ttttgggaggccaaggcagg

SEQ ID NO: 45117 - DNA, 20 bp, Artificial Sequence
  Synthetic oligonucleotide; GAG chr11 5256786 5256805 5256789 -
ccaaggcaggcagatcacct

SEQ ID NO: 45118 - DNA, 20 bp, Artificial Sequence
  Synthetic oligonucleotide; AGG chr11 5256785 5256804 5256788 -
caaggcaggcagatcacctg

SEQ ID NO: 45119 - DNA, 20 bp, Artificial Sequence
  Synthetic oligonucleotide; AAG chr11 5256780 5256799 5256783 -
caggcagatcacctgaggtc

SEQ ID NO: 45120 - DNA, 20 bp, Artificial Sequence
  Synthetic oligonucleotide; GAG chr11 5256778 5256797 5256781 -
ggcagatcacctgaggtcaa

SEQ ID NO: 45121 - DNA, 20 bp, Artificial Sequence
  Synthetic oligonucleotide; AAG chr11 5256772 5256791 5256775 -
tcacctgaggtcaagagttc

SEQ ID NO: 45122 - DNA, 20 bp, Artificial Sequence
  Synthetic oligonucleotide; TGG chr11 5256762 5256781 5256765 -
tcaagagttcaagaccaacc

SEQ ID NO: 45123 - DNA, 20 bp, Artificial Sequence
  Synthetic oligonucleotide; TGG chr11 5256753 5256772 5256756 -
caagaccaacctggccaaca

SEQ ID NO: 45124 - DNA, 20 bp, Artificial Sequence
  Synthetic oligonucleotide; TAG chr11 5256719 5256738 5256722 -
ctctacaaaaatacaaaaat

SEQ ID NO: 45125 - DNA, 20 bp, Artificial Sequence
  Synthetic oligonucleotide; CAG chr11 5256715 5256734 5256718 -
acaaaaatacaaaaattaga

SEQ ID NO: 45126 - DNA, 20 bp, Artificial Sequence
  Synthetic oligonucleotide; AGG chr11 5256714 5256733 5256717 -
caaaaatacaaaaattagac

SEQ ID NO: 45127 - DNA, 20 bp, Artificial Sequence
  Synthetic oligonucleotide; TGG chr11 5256706 5256725 5256709 -
caaaaattagacaggcatga

SEQ ID NO: 45128 - DNA, 20 bp, Artificial Sequence
  Synthetic oligonucleotide; AAG chr11 5256702 5256721 5256705 -
aattagacaggcatgatggc

SEQ ID NO: 45129 - DNA, 20 bp, Artificial Sequence
  Synthetic oligonucleotide; CAG chr11 5256687 5256706 5256690 -
atggcaagtgcctgtaatcc

SEQ ID NO: 45130 - DNA, 20 bp, Artificial Sequence
  Synthetic oligonucleotide; TGG chr11 5256679 5256698 5256682 -
tgcctgtaatcccagctact

SEQ ID NO: 45131 - DNA, 20 bp, Artificial Sequence
  Synthetic oligonucleotide; GGG chr11 5256678 5256697 5256681 -
gcctgtaatcccagctactt

SEQ ID NO: 45132 - DNA, 20 bp, Artificial Sequence
  Synthetic oligonucleotide; GAG chr11 5256676 5256695 5256679 -
ctgtaatcccagctacttgg

SEQ ID NO: 45133 - DNA, 20 bp, Artificial Sequence
  Synthetic oligonucleotide; AGG chr11 5256675 5256694 5256678 -
tgtaatcccagctacttggg

SEQ ID NO: 45134 - DNA, 20 bp, Artificial Sequence
  Synthetic oligonucleotide; GAG chr11 5256670 5256689 5256673 -
tcccagctacttgggaggct

SEQ ID NO: 45135 - DNA, 20 bp, Artificial Sequence
  Synthetic oligonucleotide; AGG chr11 5256669 5256688 5256672 -
cccagctacttgggaggctg

SEQ ID NO: 45136 - DNA, 20 bp, Artificial Sequence
  Synthetic oligonucleotide; AAG chr11 5256666 5256685 5256669 -
agctacttgggaggctgagg

SEQ ID NO: 45137 - DNA, 20 bp, Artificial Sequence
  Synthetic oligonucleotide; AGG chr11 5256665 5256684 5256668 -
gctacttgggaggctgagga

SEQ ID NO: 45138 - DNA, 20 bp, Artificial Sequence
  Synthetic oligonucleotide; GAG chr11 5256663 5256682 5256666 -
tacttgggaggctgaggaag

SEQ ID NO: 45139 - DNA, 20 bp, Artificial Sequence
  Synthetic oligonucleotide; TGG chr11 5256647 5256666 5256650 -
gaaggagaattgcttgaacc

SEQ ID NO: 45140 - DNA, 20 bp, Artificial Sequence
  Synthetic oligonucleotide; AAG chr11 5256644 5256663 5256647 -
ggagaattgcttgaacctgg

SEQ ID NO: 45141 - DNA, 20 bp, Artificial Sequence
  Synthetic oligonucleotide; AGG chr11 5256643 5256662 5256646 -
gagaattgcttgaacctgga

SEQ ID NO: 45142 - DNA, 20 bp, Artificial Sequence
  Synthetic oligonucleotide; CAG chr11 5256640 5256659 5256643 -
aattgcttgaacctggaagg

SEQ ID NO: 45143 - DNA, 20 bp, Artificial Sequence
  Synthetic oligonucleotide; AGG chr11 5256639 5256658 5256642 -
attgcttgaacctggaaggc

SEQ ID NO: 45144 - DNA, 20 bp, Artificial Sequence
  Synthetic oligonucleotide; GAG chr11 5256637 5256656 5256640 -
tgcttgaacctggaaggcag

SEQ ID NO: 45145 - DNA, 20 bp, Artificial Sequence
  Synthetic oligonucleotide; CAG chr11 5256631 5256650 5256634 -
aacctggaaggcaggagttg

SEQ ID NO: 45146 - DNA, 20 bp, Artificial Sequence
  Synthetic oligonucleotide; GAG chr11 5256627 5256646 5256630 -
tggaaggcaggagttgcagt

SEQ ID NO: 45147 - DNA, 20 bp, Artificial Sequence
  Synthetic oligonucleotide; GAG chr11 5256622 5256641 5256625 -
ggcaggagttgcagtgagcc

SEQ ID NO: 45148 - DNA, 20 bp, Artificial Sequence
  Synthetic oligonucleotide; CAG chr11 5256602 5256621 5256605 -
gagatcataccactgcactc

SEQ ID NO: 45149 - DNA, 20 bp, Artificial Sequence
  Synthetic oligonucleotide; TGG chr11 5256597 5256616 5256600 -
cataccactgcactccagcc

SEQ ID NO: 45150 - DNA, 20 bp, Artificial Sequence
  Synthetic oligonucleotide; GGG chr11 5256596 5256615 5256599 -
ataccactgcactccagcct

SEQ ID NO: 45151 - DNA, 20 bp, Artificial Sequence
  Synthetic oligonucleotide; CAG chr11 5256590 5256609 5256593 -
ctgcactccagcctgggtga

SEQ ID NO: 45152 - DNA, 20 bp, Artificial Sequence
  Synthetic oligonucleotide; AAG chr11 5256584 5256603 5256587 -
tccagcctgggtgacagaac

SEQ ID NO: 45153 - DNA, 20 bp, Artificial Sequence
  Synthetic oligonucleotide; AAG chr11 5256561 5256580 5256564 -
actctgtctcaaaaaaaaaa

SEQ ID NO: 45154 - DNA, 20 bp, Artificial Sequence
  Synthetic oligonucleotide; GAG chr11 5256559 5256578 5256562 -
tctgtctcaaaaaaaaaaaa

SEQ ID NO: 45155 - DNA, 20 bp, Artificial Sequence
  Synthetic oligonucleotide; GAG chr11 5256557 5256576 5256560 -
tgtctcaaaaaaaaaaaaga

SEQ ID NO: 45156 - DNA, 20 bp, Artificial Sequence
  Synthetic oligonucleotide; AAG chr11 5256548 5256567 5256551 -
aaaaaaaaagagagattcaa

SEQ ID NO: 45157 - DNA, 20 bp, Artificial Sequence
  Synthetic oligonucleotide; TAG chr11 5256534 5256553 5256537 -
attcaaaagattcacttgtt

SEQ ID NO: 45158 - DNA, 20 bp, Artificial Sequence
  Synthetic oligonucleotide; AGG chr11 5256533 5256552 5256536 -
ttcaaaagattcacttgttt

SEQ ID NO: 45159 - DNA, 20 bp, Artificial Sequence
  Synthetic oligonucleotide; TAG chr11 5256527 5256546 5256530 -
agattcacttgtttaggcct

SEQ ID NO: 45160 - DNA, 20 bp, Artificial Sequence
  Synthetic oligonucleotide; CGG chr11 5256524 5256543 5256527 -
ttcacttgtttaggccttag

SEQ ID NO: 45161 - DNA, 20 bp, Artificial Sequence
  Synthetic oligonucleotide; GGG chr11 5256523 5256542 5256526 -
tcacttgtttaggccttagc

SEQ ID NO: 45162 - DNA, 20 bp, Artificial Sequence
  Synthetic oligonucleotide; TAG chr11 5256518 5256537 5256521 -
tgtttaggccttagcgggct

SEQ ID NO: 45163 - DNA, 20 bp, Artificial Sequence
  Synthetic oligonucleotide; CAG chr11 5256511 5256530 5256514 -
gccttagcgggcttagacac

SEQ ID NO: 45164 - DNA, 20 bp, Artificial Sequence
  Synthetic oligonucleotide; AAG chr11 5256491 5256510 5256494 -
cagtctctgacacattctta

SEQ ID NO: 45165 - DNA, 20 bp, Artificial Sequence
  Synthetic oligonucleotide; AGG chr11 5256490 5256509 5256493 -
agtctctgacacattcttaa

SEQ ID NO: 45166 - DNA, 20 bp, Artificial Sequence
  Synthetic oligonucleotide; CAG chr11 5256486 5256505 5256489 -
tctgacacattcttaaaggt

SEQ ID NO: 45167 - DNA, 20 bp, Artificial Sequence
  Synthetic oligonucleotide; AGG chr11 5256485 5256504 5256488 -
ctgacacattcttaaaggtc

SEQ ID NO: 45168 - DNA, 20 bp, Artificial Sequence
  Synthetic oligonucleotide; TGG chr11 5256473 5256492 5256476 -
taaaggtcaggctctacaaa

SEQ ID NO: 45169 - DNA, 20 bp, Artificial Sequence
  Synthetic oligonucleotide; CAG chr11 5256462 5256481 5256465 -
ctctacaaatggaacccaac

SEQ ID NO: 45170 - DNA, 20 bp, Artificial Sequence
  Synthetic oligonucleotide; CAG chr11 5256454 5256473 5256457 -
atggaacccaaccagactct

SEQ ID NO: 45171 - DNA, 20 bp, Artificial Sequence
  Synthetic oligonucleotide; TGG chr11 5256448 5256467 5256451 -
cccaaccagactctcagata

SEQ ID NO: 45172 - DNA, 20 bp, Artificial Sequence
  Synthetic oligonucleotide; AAG chr11 5256442 5256461 5256445 -
cagactctcagatatggcca

SEQ ID NO: 45173 - DNA, 20 bp, Artificial Sequence
  Synthetic oligonucleotide; CAG chr11 5256419 5256438 5256422 -
atctatacacacccatctca

SEQ ID NO: 45174 - DNA, 20 bp, Artificial Sequence
  Synthetic oligonucleotide; AAG chr11 5256403 5256422 5256406 -
ctcacagatcccctatctta

SEQ ID NO: 45175 - DNA, 20 bp, Artificial Sequence
  Synthetic oligonucleotide; GAG chr11 5256401 5256420 5256404 -
cacagatcccctatcttaaa

SEQ ID NO: 45176 - DNA, 20 bp, Artificial Sequence
  Synthetic oligonucleotide; TGG chr11 5256389 5256408 5256392 -
atcttaaagagaccctaatt

SEQ ID NO: 45177 - DNA, 20 bp, Artificial Sequence
  Synthetic oligonucleotide; GGG chr11 5256388 5256407 5256391 -
tcttaaagagaccctaattt

SEQ ID NO: 45178 - DNA, 20 bp, Artificial Sequence
  Synthetic oligonucleotide; CAG chr11 5256378 5256397 5256381 -
accctaatttgggttcacct

SEQ ID NO: 45179 - DNA, 20 bp, Artificial Sequence
  Synthetic oligonucleotide; CAG chr11 5256359 5256378 5256362 -
tcagtctctataatctgtac

SEQ ID NO: 45180 - DNA, 20 bp, Artificial Sequence
  Synthetic oligonucleotide; TAG chr11 5256325 5256344 5256328 -
aaatctttctcacccatcct

SEQ ID NO: 45181 - DNA, 20 bp, Artificial Sequence
  Synthetic oligonucleotide; GAG chr11 5256319 5256338 5256322 -
ttctcacccatccttagatt

SEQ ID NO: 45182 - DNA, 20 bp, Artificial Sequence
  Synthetic oligonucleotide; GAG chr11 5256317 5256336 5256320 -
ctcacccatccttagattga

SEQ ID NO: 45183 - DNA, 20 bp, Artificial Sequence
  Synthetic oligonucleotide; AAG chr11 5256314 5256333 5256317 -
acccatccttagattgagag

SEQ ID NO: 45184 - DNA, 20 bp, Artificial Sequence
  Synthetic oligonucleotide; GAG chr11 5256295 5256314 5256298 -
gaagtcacttattattatgt

SEQ ID NO: 45185 - DNA, 20 bp, Artificial Sequence
  Synthetic oligonucleotide; TGG chr11 5256288 5256307 5256291 -
cttattattatgtgagtaac

SEQ ID NO: 45186 - DNA, 20 bp, Artificial Sequence
  Synthetic oligonucleotide; AAG chr11 5256285 5256304 5256288 -
attattatgtgagtaactgg

SEQ ID NO: 45187 - DNA, 20 bp, Artificial Sequence
  Synthetic oligonucleotide; AAG chr11 5256274 5256293 5256277 -
agtaactggaagatactgat

SEQ ID NO: 45188 - DNA, 20 bp, Artificial Sequence
  Synthetic oligonucleotide; AAG chr11 5256220 5256239 5256223 -
aacttttattttaacttcca

SEQ ID NO: 45189 - DNA, 20 bp, Artificial Sequence
  Synthetic oligonucleotide; AAG chr11 5256214 5256233 5256217 -
tattttaacttccaaagaac

SEQ ID NO: 45190 - DNA, 20 bp, Artificial Sequence
  Synthetic oligonucleotide; CAG chr11 5256200 5256219 5256203 -
aagaacaagtgcaatatgtg

SEQ ID NO: 45191 - DNA, 20 bp, Artificial Sequence
  Synthetic oligonucleotide; CAG chr11 5256187 5256206 5256190 -
atatgtgcagctttgttgcg

SEQ ID NO: 45192 - DNA, 20 bp, Artificial Sequence
  Synthetic oligonucleotide; AGG chr11 5256186 5256205 5256189 -
tatgtgcagctttgttgcgc

SEQ ID NO: 45193 - DNA, 20 bp, Artificial Sequence
  Synthetic oligonucleotide; TGG chr11 5256167 5256186 5256170 -
caggtcaacatgtatctttc

SEQ ID NO: 45194 - DNA, 20 bp, Artificial Sequence
  Synthetic oligonucleotide; TAG chr11 5256159 5256178 5256162 -
catgtatctttctggtcttt

SEQ ID NO: 45195 - DNA, 20 bp, Artificial Sequence
  Synthetic oligonucleotide; GAG chr11 5256142 5256161 5256145 -
ttttagccgcctaacacttt

SEQ ID NO: 45196 - DNA, 20 bp, Artificial Sequence
  Synthetic oligonucleotide; CAG chr11 5256139 5256158 5256142 -
tagccgcctaacactttgag

SEQ ID NO: 45197 - DNA, 20 bp, Artificial Sequence
  Synthetic oligonucleotide; AAG chr11 5256132 5256151 5256135 -
ctaacactttgagcagatat

SEQ ID NO: 45198 - DNA, 20 bp, Artificial Sequence
  Synthetic oligonucleotide; CAG chr11 5256122 5256141 5256125 -
gagcagatataagccttaca

SEQ ID NO: 45199 - DNA, 20 bp, Artificial Sequence
  Synthetic oligonucleotide; AGG chr11 5256121 5256140 5256124 -
agcagatataagccttacac

SEQ ID NO: 45200 - DNA, 20 bp, Artificial Sequence
  Synthetic oligonucleotide; AAG chr11 5256112 5256131 5256115 -
aagccttacacaggattatg

SEQ ID NO: 45201 - DNA, 20 bp, Artificial Sequence
  Synthetic oligonucleotide; AAG chr11 5256104 5256123 5256107 -
cacaggattatgaagtctga

SEQ ID NO: 45202 - DNA, 20 bp, Artificial Sequence
  Synthetic oligonucleotide; AGG chr11 5256103 5256122 5256106 -
acaggattatgaagtctgaa

SEQ ID NO: 45203 - DNA, 20 bp, Artificial Sequence
  Synthetic oligonucleotide; TAG chr11 5256064 5256083 5256067 -
tataattcctatcaacctga

SEQ ID NO: 45204 - DNA, 20 bp, Artificial Sequence
  Synthetic oligonucleotide; AGG chr11 5256063 5256082 5256066 -
ataattcctatcaacctgat

SEQ ID NO: 45205 - DNA, 20 bp, Artificial Sequence
  Synthetic oligonucleotide; TAG chr11 5256059 5256078 5256062 -
ttcctatcaacctgataggt

SEQ ID NO: 45206 - DNA, 20 bp, Artificial Sequence
  Synthetic oligonucleotide; AGG chr11 5256058 5256077 5256061 -
tcctatcaacctgataggtt

SEQ ID NO: 45207 - DNA, 20 bp, Artificial Sequence
  Synthetic oligonucleotide; GGG chr11 5256057 5256076 5256060 -
cctatcaacctgataggtta

SEQ ID NO: 45208 - DNA, 20 bp, Artificial Sequence
  Synthetic oligonucleotide; GGG chr11 5256056 5256075 5256059 -
ctatcaacctgataggttag

SEQ ID NO: 45209 - DNA, 20 bp, Artificial Sequence
  Synthetic oligonucleotide; AAG chr11 5256053 5256072 5256056 -
tcaacctgataggttagggg

SEQ ID NO: 45210 - DNA, 20 bp, Artificial Sequence
  Synthetic oligonucleotide; AGG chr11 5256052 5256071 5256055 -
caacctgataggttagggga

SEQ ID NO: 45211 - DNA, 20 bp, Artificial Sequence
  Synthetic oligonucleotide; TAG chr11 5256049 5256068 5256052 -
cctgataggttaggggaagg

SEQ ID NO: 45212 - DNA, 20 bp, Artificial Sequence
  Synthetic oligonucleotide; GAG chr11 5256047 5256066 5256050 -
tgataggttaggggaaggta

SEQ ID NO: 45213 - DNA, 20 bp, Artificial Sequence
  Synthetic oligonucleotide; AAG chr11 5256032 5256051 5256035 -
aggtagagctctcctccaat

SEQ ID NO: 45214 - DNA, 20 bp, Artificial Sequence
  Synthetic oligonucleotide; CAG chr11 5256028 5256047 5256031 -
agagctctcctccaataagc

SEQ ID NO: 45215 - DNA, 20 bp, Artificial Sequence
  Synthetic oligonucleotide; CAG chr11 5256020 5256039 5256023 -
cctccaataagccagatttc

SEQ ID NO: 45216 - DNA, 20 bp, Artificial Sequence
  Synthetic oligonucleotide; GAG chr11 5256018 5256037 5256021 -
tccaataagccagatttcca

SEQ ID NO: 45217 - DNA, 20 bp, Artificial Sequence
  Synthetic oligonucleotide; AAG chr11 5255994 5256013 5255997 -
ttctgacgtcataatctacc

SEQ ID NO: 45218 - DNA, 20 bp, Artificial Sequence
  Synthetic oligonucleotide; AGG chr11 5255993 5256012 5255996 -
tctgacgtcataatctacca

SEQ ID NO: 45219 - DNA, 20 bp, Artificial Sequence
  Synthetic oligonucleotide; TGG chr11 5255987 5256006 5255990 -
gtcataatctaccaaggtca

SEQ ID NO: 45220 - DNA, 20 bp, Artificial Sequence
  Synthetic oligonucleotide; GAG chr11 5255981 5256000 5255984 -
atctaccaaggtcatggatc

SEQ ID NO: 45221 - DNA, 20 bp, Artificial Sequence
  Synthetic oligonucleotide; CAG chr11 5255976 5255995 5255979 -
ccaaggtcatggatcgagtt

SEQ ID NO: 45222 - DNA, 20 bp, Artificial Sequence
  Synthetic oligonucleotide; GAG chr11 5255974 5255993 5255977 -
aaggtcatggatcgagttca

SEQ ID NO: 45223 - DNA, 20 bp, Artificial Sequence
  Synthetic oligonucleotide; AAG chr11 5255962 5255981 5255965 -
cgagttcagagaaaaaacaa

SEQ ID NO: 45224 - DNA, 20 bp, Artificial Sequence
  Synthetic oligonucleotide; AAG chr11 5255926 5255945 5255929 -
accaaaaaataaaaatccca

SEQ ID NO: 45225 - DNA, 20 bp, Artificial Sequence
  Synthetic oligonucleotide; AAG chr11 5255915 5255934 5255918 -
aaaatcccaaagaaaaaata

SEQ ID NO: 45226 - DNA, 20 bp, Artificial Sequence
  Synthetic oligonucleotide; CAG chr11 5255905 5255924 5255908 -
agaaaaaataaagaaaaaaa

SEQ ID NO: 45227 - DNA, 20 bp, Artificial Sequence
  Synthetic oligonucleotide; AAG chr11 5255880 5255899 5255883 -
tgaatacttcctgccatgtt

SEQ ID NO: 45228 - DNA, 20 bp, Artificial Sequence
  Synthetic oligonucleotide; TGG chr11 5255877 5255896 5255880 -
atacttcctgccatgttaag

SEQ ID NO: 45229 - DNA, 20 bp, Artificial Sequence
  Synthetic oligonucleotide; CAG chr11 5255865 5255884 5255868 -
atgttaagtggccaatatgt

SEQ ID NO: 45230 - DNA, 20 bp, Artificial Sequence
  Synthetic oligonucleotide; CAG chr11 5255859 5255878 5255862 -
agtggccaatatgtcagaaa

SEQ ID NO: 45231 - DNA, 20 bp, Artificial Sequence
  Synthetic oligonucleotide; GAG chr11 5255852 5255871 5255855 -
aatatgtcagaaacagcact

SEQ ID NO: 45232 - DNA, 20 bp, Artificial Sequence
  Synthetic oligonucleotide; CAG chr11 5255846 5255865 5255849 -
tcagaaacagcactgagtta

SEQ ID NO: 45233 - DNA, 20 bp, Artificial Sequence
  Synthetic oligonucleotide; AAG chr11 5255840 5255859 5255843 -
acagcactgagttacagata

SEQ ID NO: 45234 - DNA, 20 bp, Artificial Sequence
  Synthetic oligonucleotide; CAG chr11 5255825 5255844 5255828 -
agataaagatgtctaaacta

SEQ ID NO: 45235 - DNA, 20 bp, Artificial Sequence
  Synthetic oligonucleotide; CAG chr11 5255814 5255833 5255817 -
tctaaactacagtgacatcc

SEQ ID NO: 45236 - DNA, 20 bp, Artificial Sequence
  Synthetic oligonucleotide; CAG chr11 5255805 5255824 5255808 -
cagtgacatcccagctgtca

SEQ ID NO: 45237 - DNA, 20 bp, Artificial Sequence
  Synthetic oligonucleotide; TGG chr11 5255798 5255817 5255801 -
atcccagctgtcacagtgtg

SEQ ID NO: 45238 - DNA, 20 bp, Artificial Sequence
  Synthetic oligonucleotide; TAG chr11 5255790 5255809 5255793 -
tgtcacagtgtgtggactat

SEQ ID NO: 45239 - DNA, 20 bp, Artificial Sequence
  Synthetic oligonucleotide; CAG chr11 5255778 5255797 5255781 -
tggactattagtcaataaaa

SEQ ID NO: 45240 - DNA, 20 bp, Artificial Sequence
  Synthetic oligonucleotide; AAG chr11 5255763 5255782 5255766 -
taaaacagtccctgcctctt

SEQ ID NO: 45241 - DNA, 20 bp, Artificial Sequence
  Synthetic oligonucleotide; GAG chr11 5255761 5255780 5255764 -
aaacagtccctgcctcttaa

SEQ ID NO: 45242 - DNA, 20 bp, Artificial Sequence
  Synthetic oligonucleotide; TAG chr11 5255726 5255745 5255729 -
caaatacatgtcttatgtct

SEQ ID NO: 45243 - DNA, 20 bp, Artificial Sequence
  Synthetic oligonucleotide; AAG chr11 5255720 5255739 5255723 -
catgtcttatgtcttagaat

SEQ ID NO: 45244 - DNA, 20 bp, Artificial Sequence
  Synthetic oligonucleotide; AAG chr11 5255710 5255729 5255713 -
gtcttagaataagattccct

SEQ ID NO: 45245 - DNA, 20 bp, Artificial Sequence
  Synthetic oligonucleotide; AAG chr11 5255707 5255726 5255710 -
ttagaataagattccctaag

SEQ ID NO: 45246 - DNA, 20 bp, Artificial Sequence
  Synthetic oligonucleotide; TAG chr11 5255698 5255717 5255701 -
gattccctaagaagtgaacc

SEQ ID NO: 45247 - DNA, 20 bp, Artificial Sequence
  Synthetic oligonucleotide; AAG chr11 5255686 5255705 5255689 -
agtgaacctagcatttatac

SEQ ID NO: 45248 - DNA, 20 bp, Artificial Sequence
  Synthetic oligonucleotide; TAG chr11 5255665 5255684 5255668 -
agataattaattctaatcca

SEQ ID NO: 45249 - DNA, 20 bp, Artificial Sequence
  Synthetic oligonucleotide; TGG chr11 5255658 5255677 5255661 -
taattctaatccatagtatc

SEQ ID NO: 45250 - DNA, 20 bp, Artificial Sequence
  Synthetic oligonucleotide; AAG chr11 5255653 5255672 5255656 -
ctaatccatagtatctggta

SEQ ID NO: 45251 - DNA, 20 bp, Artificial Sequence
  Synthetic oligonucleotide; GAG chr11 5255651 5255670 5255654 -
aatccatagtatctggtaaa

SEQ ID NO: 45252 - DNA, 20 bp, Artificial Sequence
  Synthetic oligonucleotide; GAG chr11 5255627 5255646 5255630 -
attctaccatcatctttacc

SEQ ID NO: 45253 - DNA, 20 bp, Artificial Sequence
  Synthetic oligonucleotide; TAG chr11 5255622 5255641 5255625 -
accatcatctttaccgagca

SEQ ID NO: 45254 - DNA, 20 bp, Artificial Sequence
  Synthetic oligonucleotide; AAG chr11 5255619 5255638 5255622 -
atcatctttaccgagcatag

SEQ ID NO: 45255 - DNA, 20 bp, Artificial Sequence
  Synthetic oligonucleotide; GAG chr11 5255617 5255636 5255620 -
catctttaccgagcatagaa

SEQ ID NO: 45256 - DNA, 20 bp, Artificial Sequence
  Synthetic oligonucleotide; TGG chr11 5255600 5255619 5255603 -
gaagagctacaccaaaaccc

SEQ ID NO: 45257 - DNA, 20 bp, Artificial Sequence
  Synthetic oligonucleotide; GGG chr11 5255599 5255618 5255602 -
aagagctacaccaaaaccct

SEQ ID NO: 45258 - DNA, 20 bp, Artificial Sequence
  Synthetic oligonucleotide; CAG chr11 5255592 5255611 5255595 -
acaccaaaaccctgggtcat

SEQ ID NO: 45259 - DNA, 20 bp, Artificial Sequence
  Synthetic oligonucleotide; CAG chr11 5255588 5255607 5255591 -
caaaaccctgggtcatcagc

SEQ ID NO: 45260 - DNA, 20 bp, Artificial Sequence
  Synthetic oligonucleotide; CAG chr11 5255571 5255590 5255574 -
agccagcacatacacttatc

SEQ ID NO: 45261 - DNA, 20 bp, Artificial Sequence
  Synthetic oligonucleotide; CGG chr11 5255551 5255570 5255554 -
cagtgataaatacacatcat

SEQ ID NO: 45262 - DNA, 20 bp, Artificial Sequence
  Synthetic oligonucleotide; GGG chr11 5255550 5255569 5255553 -
agtgataaatacacatcatc

SEQ ID NO: 45263 - DNA, 20 bp, Artificial Sequence
  Synthetic oligonucleotide; GAG chr11 5255506 5255525 5255509 -
ataaaaaaaatacttttgct

SEQ ID NO: 45264 - DNA, 20 bp, Artificial Sequence
  Synthetic oligonucleotide; CAG chr11 5255497 5255516 5255500 -
atacttttgctgagatgaaa

SEQ ID NO: 45265 - DNA, 20 bp, Artificial Sequence
  Synthetic oligonucleotide; AGG chr11 5255496 5255515 5255499 -
tacttttgctgagatgaaac

SEQ ID NO: 45266 - DNA, 20 bp, Artificial Sequence
  Synthetic oligonucleotide; TAG chr11 5255477 5255496 5255480 -
caggcgtgatttatttcaaa

SEQ ID NO: 45267 - DNA, 20 bp, Artificial Sequence
  Synthetic oligonucleotide; AGG chr11 5255476 5255495 5255479 -
aggcgtgatttatttcaaat

SEQ ID NO: 45268 - DNA, 20 bp, Artificial Sequence
  Synthetic oligonucleotide; CGG chr11 5255471 5255490 5255474 -
tgatttatttcaaataggta

SEQ ID NO: 45269 - DNA, 20 bp, Artificial Sequence
  Synthetic oligonucleotide; AAG chr11 5255466 5255485 5255469 -
tatttcaaataggtacggat

SEQ ID NO: 45270 - DNA, 20 bp, Artificial Sequence
  Synthetic oligonucleotide; TAG chr11 5255463 5255482 5255466 -
ttcaaataggtacggataag

SEQ ID NO: 45271 - DNA, 20 bp, Artificial Sequence
  Synthetic oligonucleotide; AAG chr11 5255454 5255473 5255457 -
gtacggataagtagatattg

SEQ ID NO: 45272 - DNA, 20 bp, Artificial Sequence
  Synthetic oligonucleotide; AAG chr11 5255450 5255469 5255453 -
ggataagtagatattgaagt

SEQ ID NO: 45273 - DNA, 20 bp, Artificial Sequence
  Synthetic oligonucleotide; AGG chr11 5255449 5255468 5255452 -
gataagtagatattgaagta

SEQ ID NO: 45274 - DNA, 20 bp, Artificial Sequence
  Synthetic oligonucleotide; CAG chr11 5255443 5255462 5255446 -
tagatattgaagtaaggatt

SEQ ID NO: 45275 - DNA, 20 bp, Artificial Sequence
  Synthetic oligonucleotide; TAG chr11 5255385 5255404 5255388 -
gcactgaaactgttgcttta

SEQ ID NO: 45276 - DNA, 20 bp, Artificial Sequence
  Synthetic oligonucleotide; AGG chr11 5255384 5255403 5255387 -
cactgaaactgttgctttat

SEQ ID NO: 45277 - DNA, 20 bp, Artificial Sequence
  Synthetic oligonucleotide; GAG chr11 5255363 5255382 5255366 -
ggatttttcactacactaat

SEQ ID NO: 45278 - DNA, 20 bp, Artificial Sequence
  Synthetic oligonucleotide; AAG chr11 5255355 5255374 5255358 -
cactacactaatgagaactt

SEQ ID NO: 45279 - DNA, 20 bp, Artificial Sequence
  Synthetic oligonucleotide; GAG chr11 5255353 5255372 5255356 -
ctacactaatgagaacttaa

SEQ ID NO: 45280 - DNA, 20 bp, Artificial Sequence
  Synthetic oligonucleotide; TGG chr11 5255346 5255365 5255349 -
aatgagaacttaagagataa

SEQ ID NO: 45281 - DNA, 20 bp, Artificial Sequence
  Synthetic oligonucleotide; CAG chr11 5255333 5255352 5255336 -
gagataatggcctaaaacca

SEQ ID NO: 45282 - DNA, 20 bp, Artificial Sequence
  Synthetic oligonucleotide; GAG chr11 5255331 5255350 5255334 -
gataatggcctaaaaccaca

SEQ ID NO: 45283 - DNA, 20 bp, Artificial Sequence
  Synthetic oligonucleotide; GAG chr11 5255329 5255348 5255332 -
taatggcctaaaaccacaga

SEQ ID NO: 45284 - DNA, 20 bp, Artificial Sequence
  Synthetic oligonucleotide; AAG chr11 5255318 5255337 5255321 -
aaccacagagagtatattca

SEQ ID NO: 45285 - DNA, 20 bp, Artificial Sequence
  Synthetic oligonucleotide; AAG chr11 5255313 5255332 5255316 -
cagagagtatattcaaagat

SEQ ID NO: 45286 - DNA, 20 bp, Artificial Sequence
  Synthetic oligonucleotide; TAG chr11 5255308 5255327 5255311 -
agtatattcaaagataagta

SEQ ID NO: 45287 - DNA, 20 bp, Artificial Sequence
  Synthetic oligonucleotide; TGG chr11 5255294 5255313 5255297 -
taagtatagcacttcttatt

SEQ ID NO: 45288 - DNA, 20 bp, Artificial Sequence
  Synthetic oligonucleotide; GAG chr11 5255272 5255291 5255275 -
gaaaccaatgcttactaaat

SEQ ID NO: 45289 - DNA, 20 bp, Artificial Sequence
  Synthetic oligonucleotide; AAG chr11 5255266 5255285 5255269 -
aatgcttactaaatgagact

SEQ ID NO: 45290 - DNA, 20 bp, Artificial Sequence
  Synthetic oligonucleotide; TGG chr11 5255243 5255262 5255246 -
acgtgtcccatcaaaaatcc

SEQ ID NO: 45291 - DNA, 20 bp, Artificial Sequence
  Synthetic oligonucleotide; TGG chr11 5255194 5255213 5255197 -
tccctgaacttttcaaaaat

SEQ ID NO: 45292 - DNA, 20 bp, Artificial Sequence
  Synthetic oligonucleotide; CAG chr11 5255169 5255188 5255172 -
catgctttaactttaaacta

SEQ ID NO: 45293 - DNA, 20 bp, Artificial Sequence
  Synthetic oligonucleotide; AGG chr11 5255168 5255187 5255171 -
atgctttaactttaaactac

SEQ ID NO: 45294 - DNA, 20 bp, Artificial Sequence
  Synthetic oligonucleotide; TGG chr11 5255159 5255178 5255162 -
ctttaaactacaggcctcac

SEQ ID NO: 45295 - DNA, 20 bp, Artificial Sequence
  Synthetic oligonucleotide; GAG chr11 5255157 5255176 5255160 -
ttaaactacaggcctcactg

SEQ ID NO: 45296 - DNA, 20 bp, Artificial Sequence
  Synthetic oligonucleotide; CAG chr11 5255151 5255170 5255154 -
tacaggcctcactggagcta

SEQ ID NO: 45297 - DNA, 20 bp, Artificial Sequence
  Synthetic oligonucleotide; AAG chr11 5255146 5255165 5255149 -
gcctcactggagctacagac

SEQ ID NO: 45298 - DNA, 20 bp, Artificial Sequence
  Synthetic oligonucleotide; AAG chr11 5255143 5255162 5255146 -
tcactggagctacagacaag

SEQ ID NO: 45299 - DNA, 20 bp, Artificial Sequence
  Synthetic oligonucleotide; AGG chr11 5255142 5255161 5255145 -
cactggagctacagacaaga

SEQ ID NO: 45300 - DNA, 20 bp, Artificial Sequence
  Synthetic oligonucleotide; CGG chr11 5255132 5255151 5255135 -
acagacaagaaggtgaaaaa

SEQ ID NO: 45301 - DNA, 20 bp, Artificial Sequence
  Synthetic oligonucleotide; AAG chr11 5255122 5255141 5255125 -
aggtgaaaaacggctgacaa

SEQ ID NO: 45302 - DNA, 20 bp, Artificial Sequence
  Synthetic oligonucleotide; AAG chr11 5255119 5255138 5255122 -
tgaaaaacggctgacaaaag

SEQ ID NO: 45303 - DNA, 20 bp, Artificial Sequence
  Synthetic oligonucleotide; TGG chr11 5255113 5255132 5255116 -
acggctgacaaaagaagtcc

SEQ ID NO: 45304 - DNA, 20 bp, Artificial Sequence
  Synthetic oligonucleotide; TGG chr11 5255101 5255120 5255104 -
agaagtcctggtatcttcta

SEQ ID NO: 45305 - DNA, 20 bp, Artificial Sequence
  Synthetic oligonucleotide; TGG chr11 5255098 5255117 5255101 -
agtcctggtatcttctatgg

SEQ ID NO: 45306 - DNA, 20 bp, Artificial Sequence
  Synthetic oligonucleotide; GGG chr11 5255097 5255116 5255100 -
gtcctggtatcttctatggt

SEQ ID NO: 45307 - DNA, 20 bp, Artificial Sequence
  Synthetic oligonucleotide; GAG chr11 5255095 5255114 5255098 -
cctggtatcttctatggtgg

SEQ ID NO: 45308 - DNA, 20 bp, Artificial Sequence
  Synthetic oligonucleotide; AAG chr11 5255092 5255111 5255095 -
ggtatcttctatggtgggag

SEQ ID NO: 45309 - DNA, 20 bp, Artificial Sequence
  Synthetic oligonucleotide; TAG chr11 5255084 5255103 5255087 -
ctatggtgggagaagaaaac

SEQ ID NO: 45310 - DNA, 20 bp, Artificial Sequence
  Synthetic oligonucleotide; AAG chr11 5255078 5255097 5255081 -
tgggagaagaaaactagcta

SEQ ID NO: 45311 - DNA, 20 bp, Artificial Sequence
  Synthetic oligonucleotide; AGG chr11 5255077 5255096 5255080 -
gggagaagaaaactagctaa

SEQ ID NO: 45312 - DNA, 20 bp, Artificial Sequence
  Synthetic oligonucleotide; GGG chr11 5255076 5255095 5255079 -
ggagaagaaaactagctaaa

SEQ ID NO: 45313 - DNA, 20 bp, Artificial Sequence
  Synthetic oligonucleotide; AAG chr11 5255073 5255092 5255076 -
gaagaaaactagctaaaggg

SEQ ID NO: 45314 - DNA, 20 bp, Artificial Sequence
  Synthetic oligonucleotide; TAG chr11 5255063 5255082 5255066 -
agctaaagggaagaataaat

SEQ ID NO: 45315 - DNA, 20 bp, Artificial Sequence
  Synthetic oligonucleotide; GAG chr11 5255061 5255080 5255064 -
ctaaagggaagaataaatta

SEQ ID NO: 45316 - DNA, 20 bp, Artificial Sequence
  Synthetic oligonucleotide; TGG chr11 5255052 5255071 5255055 -
agaataaattagagaaaaat

SEQ ID NO: 45317 - DNA, 20 bp, Artificial Sequence
  Synthetic oligonucleotide; CGG chr11 5255038 5255057 5255041 -
aaaaattggaatgactgaat

SEQ ID NO: 45318 - DNA, 20 bp, Artificial Sequence
  Synthetic oligonucleotide; AAG chr11 5255032 5255051 5255035 -
tggaatgactgaatcggaac

SEQ ID NO: 45319 - DNA, 20 bp, Artificial Sequence
  Synthetic oligonucleotide; AGG chr11 5255031 5255050 5255034 -
ggaatgactgaatcggaaca

SEQ ID NO: 45320 - DNA, 20 bp, Artificial Sequence
  Synthetic oligonucleotide; AAG chr11 5255026 5255045 5255029 -
gactgaatcggaacaaggca

SEQ ID NO: 45321 - DNA, 20 bp, Artificial Sequence
  Synthetic oligonucleotide; AGG chr11 5255025 5255044 5255028 -
actgaatcggaacaaggcaa

SEQ ID NO: 45322 - DNA, 20 bp, Artificial Sequence
  Synthetic oligonucleotide; AAG chr11 5255008 5255027 5255011 -
caaaggctataaaaaaaatt

SEQ ID NO: 45323 - DNA, 20 bp, Artificial Sequence
  Synthetic oligonucleotide; CAG chr11 5255005 5255024 5255008 -
aggctataaaaaaaattaag

SEQ ID NO: 45324 - DNA, 20 bp, Artificial Sequence
  Synthetic oligonucleotide; CAG chr11 5255002 5255021 5255005 -
ctataaaaaaaattaagcag

SEQ ID NO: 45325 - DNA, 20 bp, Artificial Sequence
  Synthetic oligonucleotide; TGG chr11 5254991 5255010 5254994 -
attaagcagcagtatcctct

SEQ ID NO: 45326 - DNA, 20 bp, Artificial Sequence
  Synthetic oligonucleotide; GGG chr11 5254990 5255009 5254993 -
ttaagcagcagtatcctctt

SEQ ID NO: 45327 - DNA, 20 bp, Artificial Sequence
  Synthetic oligonucleotide; GGG chr11 5254989 5255008 5254992 -
taagcagcagtatcctcttg

SEQ ID NO: 45328 - DNA, 20 bp, Artificial Sequence
  Synthetic oligonucleotide; GGG chr11 5254988 5255007 5254991 -
aagcagcagtatcctcttgg

SEQ ID NO: 45329 - DNA, 20 bp, Artificial Sequence
  Synthetic oligonucleotide; CGG chr11 5254944 5254963 5254947 -
atgcaaatatctgtctgaaa

SEQ ID NO: 45330 - DNA, 20 bp, Artificial Sequence
  Synthetic oligonucleotide; TGG chr11 5254937 5254956 5254940 -
tatctgtctgaaacggtccc

SEQ ID NO: 45331 - DNA, 20 bp, Artificial Sequence
  Synthetic oligonucleotide; TGG chr11 5254920 5254939 5254923 -
ccctggctaaactccaccca

SEQ ID NO: 45332 - DNA, 20 bp, Artificial Sequence
  Synthetic oligonucleotide; GGG chr11 5254919 5254938 5254922 -
cctggctaaactccacccat

SEQ ID NO: 45333 - DNA, 20 bp, Artificial Sequence
  Synthetic oligonucleotide; TGG chr11 5254915 5254934 5254918 -
gctaaactccacccatgggt

SEQ ID NO: 45334 - DNA, 20 bp, Artificial Sequence
  Synthetic oligonucleotide; CAG chr11 5254911 5254930 5254914 -
aactccacccatgggttggc

SEQ ID NO: 45335 - DNA, 20 bp, Artificial Sequence
  Synthetic oligonucleotide; TAG chr11 5254893 5254912 5254896 -
gccagccttgccttgaccaa

SEQ ID NO: 45336 - DNA, 20 bp, Artificial Sequence
  Synthetic oligonucleotide; AAG chr11 5254883 5254902 5254886 -
ccttgaccaatagccttgac

SEQ ID NO: 45337 - DNA, 20 bp, Artificial Sequence
  Synthetic oligonucleotide; AGG chr11 5254882 5254901 5254885 -
cttgaccaatagccttgaca

SEQ ID NO: 45338 - DNA, 20 bp, Artificial Sequence
  Synthetic oligonucleotide; TAG chr11 5254866 5254885 5254869 -
gacaaggcaaacttgaccaa

SEQ ID NO: 45339 - DNA, 20 bp, Artificial Sequence
  Synthetic oligonucleotide; TAG chr11 5254860 5254879 5254863 -
gcaaacttgaccaatagtct

SEQ ID NO: 45340 - DNA, 20 bp, Artificial Sequence
  Synthetic oligonucleotide; GAG chr11 5254858 5254877 5254861 -
aaacttgaccaatagtctta

SEQ ID NO: 45341 - DNA, 20 bp, Artificial Sequence
  Synthetic oligonucleotide; CAG chr11 5254851 5254870 5254854 -
accaatagtcttagagtatc

SEQ ID NO: 45342 - DNA, 20 bp, Artificial Sequence
  Synthetic oligonucleotide; GAG chr11 5254847 5254866 5254850 -
atagtcttagagtatccagt

SEQ ID NO: 45343 - DNA, 20 bp, Artificial Sequence
  Synthetic oligonucleotide; AGG chr11 5254846 5254865 5254849 -
tagtcttagagtatccagtg

SEQ ID NO: 45344 - DNA, 20 bp, Artificial Sequence
  Synthetic oligonucleotide; CAG chr11 5254842 5254861 5254845 -
cttagagtatccagtgaggc

SEQ ID NO: 45345 - DNA, 20 bp, Artificial Sequence
  Synthetic oligonucleotide; AGG chr11 5254841 5254860 5254844 -
ttagagtatccagtgaggcc

SEQ ID NO: 45346 - DNA, 20 bp, Artificial Sequence
  Synthetic oligonucleotide; GGG chr11 5254840 5254859 5254843 -
tagagtatccagtgaggcca

SEQ ID NO: 45347 - DNA, 20 bp, Artificial Sequence
  Synthetic oligonucleotide; GGG chr11 5254839 5254858 5254842 -
agagtatccagtgaggccag

SEQ ID NO: 45348 - DNA, 20 bp, Artificial Sequence
  Synthetic oligonucleotide; CGG chr11 5254835 5254854 5254838 -
tatccagtgaggccaggggc

SEQ ID NO: 45349 - DNA, 20 bp, Artificial Sequence
  Synthetic oligonucleotide; CGG chr11 5254832 5254851 5254835 -
ccagtgaggccaggggccgg

SEQ ID NO: 45350 - DNA, 20 bp, Artificial Sequence
  Synthetic oligonucleotide; TGG chr11 5254828 5254847 5254831 -
tgaggccaggggccggcggc

SEQ ID NO: 45351 - DNA, 20 bp, Artificial Sequence
  Synthetic oligonucleotide; TAG chr11 5254824 5254843 5254827 -
gccaggggccggcggctggc

SEQ ID NO: 45352 - DNA, 20 bp, Artificial Sequence
  Synthetic oligonucleotide; AGG chr11 5254823 5254842 5254826 -
ccaggggccggcggctggct

SEQ ID NO: 45353 - DNA, 20 bp, Artificial Sequence
  Synthetic oligonucleotide; GGG chr11 5254822 5254841 5254825 -
caggggccggcggctggcta

SEQ ID NO: 45354 - DNA, 20 bp, Artificial Sequence
  Synthetic oligonucleotide; AAG chr11 5254816 5254835 5254819 -
ccggcggctggctagggatg

SEQ ID NO: 45355 - DNA, 20 bp, Artificial Sequence
  Synthetic oligonucleotide; AAG chr11 5254808 5254827 5254811 -
tggctagggatgaagaataa

SEQ ID NO: 45356 - DNA, 20 bp, Artificial Sequence
  Synthetic oligonucleotide; AGG chr11 5254807 5254826 5254810 -
ggctagggatgaagaataaa

SEQ ID NO: 45357 - DNA, 20 bp, Artificial Sequence
  Synthetic oligonucleotide; AAG chr11 5254804 5254823 5254807 -
tagggatgaagaataaaagg

SEQ ID NO: 45358 - DNA, 20 bp, Artificial Sequence
  Synthetic oligonucleotide; CAG chr11 5254794 5254813 5254797 -
gaataaaaggaagcaccctt

SEQ ID NO: 45359 - DNA, 20 bp, Artificial Sequence
  Synthetic oligonucleotide; CAG chr11 5254791 5254810 5254794 -
taaaaggaagcacccttcag

SEQ ID NO: 45360 - DNA, 20 bp, Artificial Sequence
  Synthetic oligonucleotide; TGG chr11 5254771 5254790 5254774 -
cagttccacacactcgcttc

SEQ ID NO: 45361 - DNA, 20 bp, Artificial Sequence
  Synthetic oligonucleotide; GAG chr11 5254761 5254780 5254764 -
cactcgcttctggaacgtct

SEQ ID NO: 45362 - DNA, 20 bp, Artificial Sequence
  Synthetic oligonucleotide; AGG chr11 5254760 5254779 5254763 -
actcgcttctggaacgtctg

SEQ ID NO: 45363 - DNA, 20 bp, Artificial Sequence
  Synthetic oligonucleotide; AAG chr11 5254749 5254768 5254752 -
gaacgtctgaggttatcaat

SEQ ID NO: 45364 - DNA, 20 bp, Artificial Sequence
  Synthetic oligonucleotide; TAG chr11 5254742 5254761 5254745 -
tgaggttatcaataagctcc

SEQ ID NO: 45365 - DNA, 20 bp, Artificial Sequence
  Synthetic oligonucleotide; CAG chr11 5254737 5254756 5254740 -
ttatcaataagctcctagtc

SEQ ID NO: 45366 - DNA, 20 bp, Artificial Sequence
  Synthetic oligonucleotide; TGG chr11 5254728 5254747 5254731 -
agctcctagtccagacgcca

SEQ ID NO: 45367 - DNA, 20 bp, Artificial Sequence
  Synthetic oligonucleotide; GGG chr11 5254727 5254746 5254730 -
gctcctagtccagacgccat

SEQ ID NO: 45368 - DNA, 20 bp, Artificial Sequence
  Synthetic oligonucleotide; CAG chr11 5254716 5254735 5254719 -
agacgccatgggtcatttca

SEQ ID NO: 45369 - DNA, 20 bp, Artificial Sequence
  Synthetic oligonucleotide; GAG chr11 5254714 5254733 5254717 -
acgccatgggtcatttcaca

SEQ ID NO: 45370 - DNA, 20 bp, Artificial Sequence
  Synthetic oligonucleotide; AGG chr11 5254713 5254732 5254716 -
cgccatgggtcatttcacag

SEQ ID NO: 45371 - DNA, 20 bp, Artificial Sequence
  Synthetic oligonucleotide; GAG chr11 5254711 5254730 5254714 -
ccatgggtcatttcacagag

SEQ ID NO: 45372 - DNA, 20 bp, Artificial Sequence
  Synthetic oligonucleotide; AGG chr11 5254710 5254729 5254713 -
catgggtcatttcacagagg

SEQ ID NO: 45373 - DNA, 20 bp, Artificial Sequence
  Synthetic oligonucleotide; AAG chr11 5254705 5254724 5254708 -
gtcatttcacagaggaggac

SEQ ID NO: 45374 - DNA, 20 bp, Artificial Sequence
  Synthetic oligonucleotide; AGG chr11 5254704 5254723 5254707 -
tcatttcacagaggaggaca

SEQ ID NO: 45375 - DNA, 20 bp, Artificial Sequence
  Synthetic oligonucleotide; AAG chr11 5254691 5254710 5254694 -
gaggacaaggctactatcac

SEQ ID NO: 45376 - DNA, 20 bp, Artificial Sequence
  Synthetic oligonucleotide; TGG chr11 5254684 5254703 5254687 -
aggctactatcacaagcctg

SEQ ID NO: 45377 - DNA, 20 bp, Artificial Sequence
  Synthetic oligonucleotide; GGG chr11 5254683 5254702 5254686 -
ggctactatcacaagcctgt

SEQ ID NO: 45378 - DNA, 20 bp, Artificial Sequence
  Synthetic oligonucleotide; GGG chr11 5254682 5254701 5254685 -
gctactatcacaagcctgtg

SEQ ID NO: 45379 - DNA, 20 bp, Artificial Sequence
  Synthetic oligonucleotide; AAG chr11 5254678 5254697 5254681 -
ctatcacaagcctgtggggc

SEQ ID NO: 45380 - DNA, 20 bp, Artificial Sequence
  Synthetic oligonucleotide; AGG chr11 5254677 5254696 5254680 -
tatcacaagcctgtggggca

SEQ ID NO: 45381 - DNA, 20 bp, Artificial Sequence
  Synthetic oligonucleotide; TGG chr11 5254668 5254687 5254671 -
cctgtggggcaaggtgaatg

SEQ ID NO: 45382 - DNA, 20 bp, Artificial Sequence
  Synthetic oligonucleotide; AAG chr11 5254665 5254684 5254668 -
gtggggcaaggtgaatgtgg

SEQ ID NO: 45383 - DNA, 20 bp, Artificial Sequence
  Synthetic oligonucleotide; TGG chr11 5254658 5254677 5254661 -
aaggtgaatgtggaagatgc

SEQ ID NO: 45384 - DNA, 20 bp, Artificial Sequence
  Synthetic oligonucleotide; GAG chr11 5254656 5254675 5254659 -
ggtgaatgtggaagatgctg

SEQ ID NO: 45385 - DNA, 20 bp, Artificial Sequence
  Synthetic oligonucleotide; AGG chr11 5254655 5254674 5254658 -
gtgaatgtggaagatgctgg

SEQ ID NO: 45386 - DNA, 20 bp, Artificial Sequence
  Synthetic oligonucleotide; GAG chr11 5254653 5254672 5254656 -
gaatgtggaagatgctggag

SEQ ID NO: 45387 - DNA, 20 bp, Artificial Sequence
  Synthetic oligonucleotide; TGG chr11 5254644 5254663 5254647 -
agatgctggaggagaaaccc

SEQ ID NO: 45388 - DNA, 20 bp, Artificial Sequence
  Synthetic oligonucleotide; GGG chr11 5254643 5254662 5254646 -
gatgctggaggagaaaccct

SEQ ID NO: 45389 - DNA, 20 bp, Artificial Sequence
  Synthetic oligonucleotide; AAG chr11 5254640 5254659 5254643 -
gctggaggagaaaccctggg

SEQ ID NO: 45390 - DNA, 20 bp, Artificial Sequence
  Synthetic oligonucleotide; AGG chr11 5254639 5254658 5254642 -
ctggaggagaaaccctggga

SEQ ID NO: 45391 - DNA, 20 bp, Artificial Sequence
  Synthetic oligonucleotide; TAG chr11 5254636 5254655 5254639 -
gaggagaaaccctgggaagg

SEQ ID NO: 45392 - DNA, 20 bp, Artificial Sequence
  Synthetic oligonucleotide; AGG chr11 5254635 5254654 5254638 -
aggagaaaccctgggaaggt

SEQ ID NO: 45393 - DNA, 20 bp, Artificial Sequence
  Synthetic oligonucleotide; TGG chr11 5254629 5254648 5254632 -
aaccctgggaaggtaggctc

SEQ ID NO: 45394 - DNA, 20 bp, Artificial Sequence
  Synthetic oligonucleotide; CAG chr11 5254622 5254641 5254625 -
ggaaggtaggctctggtgac

SEQ ID NO: 45395 - DNA, 20 bp, Artificial Sequence
  Synthetic oligonucleotide; AGG chr11 5254621 5254640 5254624 -
gaaggtaggctctggtgacc

SEQ ID NO: 45396 - DNA, 20 bp, Artificial Sequence
  Synthetic oligonucleotide; AAG chr11 5254616 5254635 5254619 -
taggctctggtgaccaggac

SEQ ID NO: 45397 - DNA, 20 bp, Artificial Sequence
  Synthetic oligonucleotide; AGG chr11 5254615 5254634 5254618 -
aggctctggtgaccaggaca

SEQ ID NO: 45398 - DNA, 20 bp, Artificial Sequence
  Synthetic oligonucleotide; GGG chr11 5254614 5254633 5254617 -
ggctctggtgaccaggacaa

SEQ ID NO: 45399 - DNA, 20 bp, Artificial Sequence
  Synthetic oligonucleotide; GAG chr11 5254612 5254631 5254615 -
ctctggtgaccaggacaagg

SEQ ID NO: 45400 - DNA, 20 bp, Artificial Sequence
  Synthetic oligonucleotide; AGG chr11 5254611 5254630 5254614 -
tctggtgaccaggacaaggg

SEQ ID NO: 45401 - DNA, 20 bp, Artificial Sequence
  Synthetic oligonucleotide; GGG chr11 5254610 5254629 5254613 -
ctggtgaccaggacaaggga

SEQ ID NO: 45402 - DNA, 20 bp, Artificial Sequence
  Synthetic oligonucleotide; AAG chr11 5254607 5254626 5254610 -
gtgaccaggacaagggaggg

SEQ ID NO: 45403 - DNA, 20 bp, Artificial Sequence
  Synthetic oligonucleotide; AGG chr11 5254606 5254625 5254609 -
tgaccaggacaagggaggga

SEQ ID NO: 45404 - DNA, 20 bp, Artificial Sequence
  Synthetic oligonucleotide; AAG chr11 5254603 5254622 5254606 -
ccaggacaagggagggaagg

SEQ ID NO: 45405 - DNA, 20 bp, Artificial Sequence
  Synthetic oligonucleotide; AGG chr11 5254602 5254621 5254605 -
caggacaagggagggaagga

SEQ ID NO: 45406 - DNA, 20 bp, Artificial Sequence
  Synthetic oligonucleotide; TGG chr11 5254589 5254608 5254592 -
ggaaggaaggaccctgtgcc

SEQ ID NO: 45407 - DNA, 20 bp, Artificial Sequence
  Synthetic oligonucleotide; AAG chr11 5254583 5254602 5254586 -
aaggaccctgtgcctggcaa

SEQ ID NO: 45408 - DNA, 20 bp, Artificial Sequence
  Synthetic oligonucleotide; CAG chr11 5254578 5254597 5254581 -
ccctgtgcctggcaaaagtc

SEQ ID NO: 45409 - DNA, 20 bp, Artificial Sequence
  Synthetic oligonucleotide; AGG chr11 5254577 5254596 5254580 -
cctgtgcctggcaaaagtcc

SEQ ID NO: 45410 - DNA, 20 bp, Artificial Sequence
  Synthetic oligonucleotide; CAG chr11 5254566 5254585 5254569 -
caaaagtccaggtcgcttct

SEQ ID NO: 45411 - DNA, 20 bp, Artificial Sequence
  Synthetic oligonucleotide; AGG chr11 5254565 5254584 5254568 -
aaaagtccaggtcgcttctc

SEQ ID NO: 45412 - DNA, 20 bp, Artificial Sequence
  Synthetic oligonucleotide; TGG chr11 5254557 5254576 5254560 -
aggtcgcttctcaggatttg

SEQ ID NO: 45413 - DNA, 20 bp, Artificial Sequence
  Synthetic oligonucleotide; CAG chr11 5254518 5254537 5254521 -
aactgttcttgtcaatctca

SEQ ID NO: 45414 - DNA, 20 bp, Artificial Sequence
  Synthetic oligonucleotide; AGG chr11 5254517 5254536 5254520 -
actgttcttgtcaatctcac

SEQ ID NO: 45415 - DNA, 20 bp, Artificial Sequence
  Synthetic oligonucleotide; TGG chr11 5254510 5254529 5254513 -
ttgtcaatctcacaggctcc

SEQ ID NO: 45416 - DNA, 20 bp, Artificial Sequence
  Synthetic oligonucleotide; TGG chr11 5254496 5254515 5254499 -
ggctcctggttgtctaccca

SEQ ID NO: 45417 - DNA, 20 bp, Artificial Sequence
  Synthetic oligonucleotide; CAG chr11 5254490 5254509 5254493 -
tggttgtctacccatggacc

SEQ ID NO: 45418 - DNA, 20 bp, Artificial Sequence
  Synthetic oligonucleotide; GAG chr11 5254488 5254507 5254491 -
gttgtctacccatggaccca

SEQ ID NO: 45419 - DNA, 20 bp, Artificial Sequence
  Synthetic oligonucleotide; AGG chr11 5254487 5254506 5254490 -
ttgtctacccatggacccag

SEQ ID NO: 45420 - DNA, 20 bp, Artificial Sequence
  Synthetic oligonucleotide; CAG chr11 5254476 5254495 5254479 -
tggacccagaggttctttga

SEQ ID NO: 45421 - DNA, 20 bp, Artificial Sequence
  Synthetic oligonucleotide; TGG chr11 5254470 5254489 5254473 -
cagaggttctttgacagctt

SEQ ID NO: 45422 - DNA, 20 bp, Artificial Sequence
  Synthetic oligonucleotide; TGG chr11 5254441 5254460 5254444 -
gtcctctgcctctgccatca

SEQ ID NO: 45423 - DNA, 20 bp, Artificial Sequence
  Synthetic oligonucleotide; GGG chr11 5254440 5254459 5254443 -
tcctctgcctctgccatcat

SEQ ID NO: 45424 - DNA, 20 bp, Artificial Sequence
  Synthetic oligonucleotide; AAG chr11 5254429 5254448 5254432 -
tgccatcatgggcaacccca

SEQ ID NO: 45425 - DNA, 20 bp, Artificial Sequence
  Synthetic oligonucleotide; AAG chr11 5254424 5254443 5254427 -
tcatgggcaaccccaaagtc

SEQ ID NO: 45426 - DNA, 20 bp, Artificial Sequence
  Synthetic oligonucleotide; AGG chr11 5254423 5254442 5254426 -
catgggcaaccccaaagtca

SEQ ID NO: 45427 - DNA, 20 bp, Artificial Sequence
  Synthetic oligonucleotide; TGG chr11 5254416 5254435 5254419 -
aaccccaaagtcaaggcaca

SEQ ID NO: 45428 - DNA, 20 bp, Artificial Sequence
  Synthetic oligonucleotide; AAG chr11 5254412 5254431 5254415 -
ccaaagtcaaggcacatggc

SEQ ID NO: 45429 - DNA, 20 bp, Artificial Sequence
  Synthetic oligonucleotide; AAG chr11 5254409 5254428 5254412 -
aagtcaaggcacatggcaag

SEQ ID NO: 45430 - DNA, 20 bp, Artificial Sequence
  Synthetic oligonucleotide; AGG chr11 5254408 5254427 5254411 -
agtcaaggcacatggcaaga

SEQ ID NO: 45431 - DNA, 20 bp, Artificial Sequence
  Synthetic oligonucleotide; TGG chr11 5254393 5254412 5254396 -
caagaaggtgctgacttcct

SEQ ID NO: 45432 - DNA, 20 bp, Artificial Sequence
  Synthetic oligonucleotide; GGG chr11 5254392 5254411 5254395 -
aagaaggtgctgacttcctt

SEQ ID NO: 45433 - DNA, 20 bp, Artificial Sequence
  Synthetic oligonucleotide; GAG chr11 5254390 5254409 5254393 -
gaaggtgctgacttccttgg

SEQ ID NO: 45434 - DNA, 20 bp, Artificial Sequence
  Synthetic oligonucleotide; AAG chr11 5254379 5254398 5254382 -
cttccttgggagatgccata

SEQ ID NO: 45435 - DNA, 20 bp, Artificial Sequence
  Synthetic oligonucleotide; TGG chr11 5254372 5254391 5254375 -
gggagatgccataaagcacc

SEQ ID NO: 45436 - DNA, 20 bp, Artificial Sequence
  Synthetic oligonucleotide; AAG chr11 5254361 5254380 5254364 -
taaagcacctggatgatctc

SEQ ID NO: 45437 - DNA, 20 bp, Artificial Sequence
  Synthetic oligonucleotide; AGG chr11 5254360 5254379 5254363 -
aaagcacctggatgatctca

SEQ ID NO: 45438 - DNA, 20 bp, Artificial Sequence
  Synthetic oligonucleotide; GGG chr11 5254359 5254378 5254362 -
aagcacctggatgatctcaa

SEQ ID NO: 45439 - DNA, 20 bp, Artificial Sequence
  Synthetic oligonucleotide; CAG chr11 5254346 5254365 5254349 -
atctcaagggcacctttgcc

SEQ ID NO: 45440 - DNA, 20 bp, Artificial Sequence
  Synthetic oligonucleotide; GAG chr11 5254341 5254360 5254344 -
aagggcacctttgcccagct

SEQ ID NO: 45441 - DNA, 20 bp, Artificial Sequence
  Synthetic oligonucleotide; AAG chr11 5254322 5254341 5254325 -
tgagtgaactgcactgtgac

SEQ ID NO: 45442 - DNA, 20 bp, Artificial Sequence
  Synthetic oligonucleotide; TGG chr11 5254312 5254331 5254315 -
gcactgtgacaagctgcatg

SEQ ID NO: 45443 - DNA, 20 bp, Artificial Sequence
  Synthetic oligonucleotide; GAG chr11 5254304 5254323 5254307 -
acaagctgcatgtggatcct

SEQ ID NO: 45444 - DNA, 20 bp, Artificial Sequence
  Synthetic oligonucleotide; AAG chr11 5254295 5254314 5254298 -
atgtggatcctgagaacttc

SEQ ID NO: 45445 - DNA, 20 bp, Artificial Sequence
  Synthetic oligonucleotide; AGG chr11 5254294 5254313 5254297 -
tgtggatcctgagaacttca

SEQ ID NO: 45446 - DNA, 20 bp, Artificial Sequence
  Synthetic oligonucleotide; GAG chr11 5254290 5254309 5254293 -
gatcctgagaacttcaaggt

SEQ ID NO: 45447 - DNA, 20 bp, Artificial Sequence
  Synthetic oligonucleotide; CAG chr11 5254285 5254304 5254288 -
tgagaacttcaaggtgagtc

SEQ ID NO: 45448 - DNA, 20 bp, Artificial Sequence
  Synthetic oligonucleotide; AGG chr11 5254284 5254303 5254287 -
gagaacttcaaggtgagtcc

SEQ ID NO: 45449 - DNA, 20 bp, Artificial Sequence
  Synthetic oligonucleotide; GAG chr11 5254282 5254301 5254285 -
gaacttcaaggtgagtccag

SEQ ID NO: 45450 - DNA, 20 bp, Artificial Sequence
  Synthetic oligonucleotide; CAG chr11 5254273 5254292 5254276 -
ggtgagtccaggagatgttt

SEQ ID NO: 45451 - DNA, 20 bp, Artificial Sequence
  Synthetic oligonucleotide; TAG chr11 5254258 5254277 5254261 -
tgtttcagcactgttgcctt

SEQ ID NO: 45452 - DNA, 20 bp, Artificial Sequence
  Synthetic oligonucleotide; GAG chr11 5254251 5254270 5254254 -
gcactgttgcctttagtctc

SEQ ID NO: 45453 - DNA, 20 bp, Artificial Sequence
  Synthetic oligonucleotide; AGG chr11 5254250 5254269 5254253 -
cactgttgcctttagtctcg

SEQ ID NO: 45454 - DNA, 20 bp, Artificial Sequence
  Synthetic oligonucleotide; TAG chr11 5254242 5254261 5254245 -
cctttagtctcgaggcaact

SEQ ID NO: 45455 - DNA, 20 bp, Artificial Sequence
  Synthetic oligonucleotide; GAG chr11 5254233 5254252 5254236 -
tcgaggcaacttagacaact

SEQ ID NO: 45456 - DNA, 20 bp, Artificial Sequence
  Synthetic oligonucleotide; GAG chr11 5254221 5254240 5254224 -
agacaactgagtattgatct

SEQ ID NO: 45457 - DNA, 20 bp, Artificial Sequence
  Synthetic oligonucleotide; CAG chr11 5254216 5254235 5254219 -
actgagtattgatctgagca

SEQ ID NO: 45458 - DNA, 20 bp, Artificial Sequence
  Synthetic oligonucleotide; CAG chr11 5254213 5254232 5254216 -
gagtattgatctgagcacag

SEQ ID NO: 45459 - DNA, 20 bp, Artificial Sequence
  Synthetic oligonucleotide; AGG chr11 5254212 5254231 5254215 -
agtattgatctgagcacagc

SEQ ID NO: 45460 - DNA, 20 bp, Artificial Sequence
  Synthetic oligonucleotide; GGG chr11 5254211 5254230 5254214 -
gtattgatctgagcacagca

SEQ ID NO: 45461 - DNA, 20 bp, Artificial Sequence
  Synthetic oligonucleotide; GAG chr11 5254205 5254224 5254208 -
atctgagcacagcagggtgt

SEQ ID NO: 45462 - DNA, 20 bp, Artificial Sequence
  Synthetic oligonucleotide; AAG chr11 5254195 5254214 5254198 -
agcagggtgtgagctgtttg

SEQ ID NO: 45463 - DNA, 20 bp, Artificial Sequence
  Synthetic oligonucleotide; TGG chr11 5254188 5254207 5254191 -
tgtgagctgtttgaagatac

SEQ ID NO: 45464 - DNA, 20 bp, Artificial Sequence
  Synthetic oligonucleotide; GGG chr11 5254187 5254206 5254190 -
gtgagctgtttgaagatact

SEQ ID NO: 45465 - DNA, 20 bp, Artificial Sequence
  Synthetic oligonucleotide; GGG chr11 5254186 5254205 5254189 -
tgagctgtttgaagatactg

SEQ ID NO: 45466 - DNA, 20 bp, Artificial Sequence
  Synthetic oligonucleotide; TGG chr11 5254182 5254201 5254185 -
ctgtttgaagatactggggt

SEQ ID NO: 45467 - DNA, 20 bp, Artificial Sequence
  Synthetic oligonucleotide; GGG chr11 5254181 5254200 5254184 -
tgtttgaagatactggggtt

SEQ ID NO: 45468 - DNA, 20 bp, Artificial Sequence
  Synthetic oligonucleotide; GAG chr11 5254179 5254198 5254182 -
tttgaagatactggggttgg

SEQ ID NO: 45469 - DNA, 20 bp, Artificial Sequence
  Synthetic oligonucleotide; AAG chr11 5254174 5254193 5254177 -
agatactggggttgggagtg

SEQ ID NO: 45470 - DNA, 20 bp, Artificial Sequence
  Synthetic oligonucleotide; CAG chr11 5254165 5254184 5254168 -
ggttgggagtgaagaaactg

SEQ ID NO: 45471 - DNA, 20 bp, Artificial Sequence
  Synthetic oligonucleotide; GAG chr11 5254163 5254182 5254166 -
ttgggagtgaagaaactgca

SEQ ID NO: 45472 - DNA, 20 bp, Artificial Sequence
  Synthetic oligonucleotide; AGG chr11 5254162 5254181 5254165 -
tgggagtgaagaaactgcag

SEQ ID NO: 45473 - DNA, 20 bp, Artificial Sequence
  Synthetic oligonucleotide; TGG chr11 5254153 5254172 5254156 -
agaaactgcagaggactaac

SEQ ID NO: 45474 - DNA, 20 bp, Artificial Sequence
  Synthetic oligonucleotide; GGG chr11 5254152 5254171 5254155 -
gaaactgcagaggactaact

SEQ ID NO: 45475 - DNA, 20 bp, Artificial Sequence
  Synthetic oligonucleotide; GAG chr11 5254147 5254166 5254150 -
tgcagaggactaactgggct

SEQ ID NO: 45476 - DNA, 20 bp, Artificial Sequence
  Synthetic oligonucleotide; CAG chr11 5254141 5254160 5254144 -
ggactaactgggctgagacc

SEQ ID NO: 45477 - DNA, 20 bp, Artificial Sequence
  Synthetic oligonucleotide; TGG chr11 5254138 5254157 5254141 -
ctaactgggctgagacccag

SEQ ID NO: 45478 - DNA, 20 bp, Artificial Sequence
  Synthetic oligonucleotide; TAG chr11 5254127 5254146 5254130 -
gagacccagtggcaatgttt

SEQ ID NO: 45479 - DNA, 20 bp, Artificial Sequence
  Synthetic oligonucleotide; AGG chr11 5254126 5254145 5254129 -
agacccagtggcaatgtttt

SEQ ID NO: 45480 - DNA, 20 bp, Artificial Sequence
  Synthetic oligonucleotide; GGG chr11 5254125 5254144 5254128 -
gacccagtggcaatgtttta

SEQ ID NO: 45481 - DNA, 20 bp, Artificial Sequence
  Synthetic oligonucleotide; AAG chr11 5254119 5254138 5254122 -
gtggcaatgttttagggcct

SEQ ID NO: 45482 - DNA, 20 bp, Artificial Sequence
  Synthetic oligonucleotide; AGG chr11 5254118 5254137 5254121 -
tggcaatgttttagggccta

SEQ ID NO: 45483 - DNA, 20 bp, Artificial Sequence
  Synthetic oligonucleotide; GAG chr11 5254116 5254135 5254119 -
gcaatgttttagggcctaag

SEQ ID NO: 45484 - DNA, 20 bp, Artificial Sequence
  Synthetic oligonucleotide; TAG chr11 5254099 5254118 5254102 -
aaggagtgcctctgaaaatc

SEQ ID NO: 45485 - DNA, 20 bp, Artificial Sequence
  Synthetic oligonucleotide; TGG chr11 5254095 5254114 5254098 -
agtgcctctgaaaatctaga

SEQ ID NO: 45486 - DNA, 20 bp, Artificial Sequence
  Synthetic oligonucleotide; GAG chr11 5254078 5254097 5254081 -
agatggacaactttgacttt

SEQ ID NO: 45487 - DNA, 20 bp, Artificial Sequence
  Synthetic oligonucleotide; AAG chr11 5254073 5254092 5254076 -
gacaactttgactttgagaa

SEQ ID NO: 45488 - DNA, 20 bp, Artificial Sequence
  Synthetic oligonucleotide; GAG chr11 5254071 5254090 5254074 -
caactttgactttgagaaaa

SEQ ID NO: 45489 - DNA, 20 bp, Artificial Sequence
  Synthetic oligonucleotide; GAG chr11 5254069 5254088 5254072 -
actttgactttgagaaaaga

SEQ ID NO: 45490 - DNA, 20 bp, Artificial Sequence
  Synthetic oligonucleotide; AGG chr11 5254068 5254087 5254071 -
ctttgactttgagaaaagag

SEQ ID NO: 45491 - DNA, 20 bp, Artificial Sequence
  Synthetic oligonucleotide; TGG chr11 5254065 5254084 5254068 -
tgactttgagaaaagagagg

SEQ ID NO: 45492 - DNA, 20 bp, Artificial Sequence
  Synthetic oligonucleotide; GAG chr11 5254058 5254077 5254061 -
gagaaaagagaggtggaaat

SEQ ID NO: 45493 - DNA, 20 bp, Artificial Sequence
  Synthetic oligonucleotide; AGG chr11 5254057 5254076 5254060 -
agaaaagagaggtggaaatg

SEQ ID NO: 45494 - DNA, 20 bp, Artificial Sequence
  Synthetic oligonucleotide; TAG chr11 5254036 5254055 5254039 -
ggaaaatgacttttctttat

SEQ ID NO: 45495 - DNA, 20 bp, Artificial Sequence
  Synthetic oligonucleotide; CGG chr11 5254029 5254048 5254032 -
gacttttctttattagattt

SEQ ID NO: 45496 - DNA, 20 bp, Artificial Sequence
  Synthetic oligonucleotide; TAG chr11 5254026 5254045 5254029 -
ttttctttattagatttcgg

SEQ ID NO: 45497 - DNA, 20 bp, Artificial Sequence
  Synthetic oligonucleotide; AAG chr11 5254022 5254041 5254025 -
ctttattagatttcggtaga

SEQ ID NO: 45498 - DNA, 20 bp, Artificial Sequence
  Synthetic oligonucleotide; TGG chr11 5253971 5253990 5253974 -
ttcgttttaaaacatctatc

SEQ ID NO: 45499 - DNA, 20 bp, Artificial Sequence
  Synthetic oligonucleotide; GAG chr11 5253969 5253988 5253972 -
cgttttaaaacatctatctg

SEQ ID NO: 45500 - DNA, 20 bp, Artificial Sequence
  Synthetic oligonucleotide; AGG chr11 5253968 5253987 5253971 -
gttttaaaacatctatctgg

SEQ ID NO: 45501 - DNA, 20 bp, Artificial Sequence
  Synthetic oligonucleotide; CAG chr11 5253965 5253984 5253968 -
ttaaaacatctatctggagg

SEQ ID NO: 45502 - DNA, 20 bp, Artificial Sequence
  Synthetic oligonucleotide; AGG chr11 5253964 5253983 5253967 -
taaaacatctatctggaggc

SEQ ID NO: 45503 - DNA, 20 bp, Artificial Sequence
  Synthetic oligonucleotide; AAG chr11 5253959 5253978 5253962 -
catctatctggaggcaggac

SEQ ID NO: 45504 - DNA, 20 bp, Artificial Sequence
  Synthetic oligonucleotide; TGG chr11 5253954 5253973 5253957 -
atctggaggcaggacaagta

SEQ ID NO: 45505 - DNA, 20 bp, Artificial Sequence
  Synthetic oligonucleotide; AAG chr11 5253943 5253962 5253946 -
ggacaagtatggtcattaaa

SEQ ID NO: 45506 - DNA, 20 bp, Artificial Sequence
  Synthetic oligonucleotide; CAG chr11 5253937 5253956 5253940 -
gtatggtcattaaaaagatg

SEQ ID NO: 45507 - DNA, 20 bp, Artificial Sequence
  Synthetic oligonucleotide; AGG chr11 5253936 5253955 5253939 -
tatggtcattaaaaagatgc

SEQ ID NO: 45508 - DNA, 20 bp, Artificial Sequence
  Synthetic oligonucleotide; CAG chr11 5253933 5253952 5253936 -
ggtcattaaaaagatgcagg

SEQ ID NO: 45509 - DNA, 20 bp, Artificial Sequence
  Synthetic oligonucleotide; AAG chr11 5253930 5253949 5253933 -
cattaaaaagatgcaggcag

SEQ ID NO: 45510 - DNA, 20 bp, Artificial Sequence
  Synthetic oligonucleotide; AGG chr11 5253929 5253948 5253932 -
attaaaaagatgcaggcaga

SEQ ID NO: 45511 - DNA, 20 bp, Artificial Sequence
  Synthetic oligonucleotide; TGG chr11 5253919 5253938 5253922 -
tgcaggcagaaggcatatat

SEQ ID NO: 45512 - DNA, 20 bp, Artificial Sequence
  Synthetic oligonucleotide; CAG chr11 5253914 5253933 5253917 -
gcagaaggcatatattggct

SEQ ID NO: 45513 - DNA, 20 bp, Artificial Sequence
  Synthetic oligonucleotide; AAG chr11 5253908 5253927 5253911 -
ggcatatattggctcagtca

SEQ ID NO: 45514 - DNA, 20 bp, Artificial Sequence
  Synthetic oligonucleotide; TGG chr11 5253905 5253924 5253908 -
atatattggctcagtcaaag

SEQ ID NO: 45515 - DNA, 20 bp, Artificial Sequence
  Synthetic oligonucleotide; GGG chr11 5253904 5253923 5253907 -
tatattggctcagtcaaagt

SEQ ID NO: 45516 - DNA, 20 bp, Artificial Sequence
  Synthetic oligonucleotide; GGG chr11 5253903 5253922 5253906 -
atattggctcagtcaaagtg

SEQ ID NO: 45517 - DNA, 20 bp, Artificial Sequence
  Synthetic oligonucleotide; TGG chr11 5253895 5253914 5253898 -
tcagtcaaagtggggaactt

SEQ ID NO: 45518 - DNA, 20 bp, Artificial Sequence
  Synthetic oligonucleotide; TGG chr11 5253892 5253911 5253895 -
gtcaaagtggggaactttgg

SEQ ID NO: 45519 - DNA, 20 bp, Artificial Sequence
  Synthetic oligonucleotide; AAG chr11 5253873 5253892 5253876 -
gtggccaaacatacattgct

SEQ ID NO: 45520 - DNA, 20 bp, Artificial Sequence
  Synthetic oligonucleotide; AGG chr11 5253872 5253891 5253875 -
tggccaaacatacattgcta

SEQ ID NO: 45521 - DNA, 20 bp, Artificial Sequence
  Synthetic oligonucleotide; CAG chr11 5253857 5253876 5253860 -
tgctaaggctattcctatat

SEQ ID NO: 45522 - DNA, 20 bp, Artificial Sequence
  Synthetic oligonucleotide; TGG chr11 5253853 5253872 5253856 -
aaggctattcctatatcagc

SEQ ID NO: 45523 - DNA, 20 bp, Artificial Sequence
  Synthetic oligonucleotide; CAG chr11 5253798 5253817 5253801 -
aaacttatatcctttaattc

SEQ ID NO: 45524 - DNA, 20 bp, Artificial Sequence
  Synthetic oligonucleotide; TGG chr11 5253794 5253813 5253797 -
ttatatcctttaattccaga

SEQ ID NO: 45525 - DNA, 20 bp, Artificial Sequence
  Synthetic oligonucleotide; GGG chr11 5253793 5253812 5253796 -
tatatcctttaattccagat

SEQ ID NO: 45526 - DNA, 20 bp, Artificial Sequence
  Synthetic oligonucleotide; GGG chr11 5253792 5253811 5253795 -
atatcctttaattccagatg

SEQ ID NO: 45527 - DNA, 20 bp, Artificial Sequence
  Synthetic oligonucleotide; GGG chr11 5253791 5253810 5253794 -
tatcctttaattccagatgg

SEQ ID NO: 45528 - DNA, 20 bp, Artificial Sequence
  Synthetic oligonucleotide; AAG chr11 5253786 5253805 5253789 -
tttaattccagatgggggca

SEQ ID NO: 45529 - DNA, 20 bp, Artificial Sequence
  Synthetic oligonucleotide; CAG chr11 5253777 5253796 5253780 -
agatgggggcaaagtatgtc

SEQ ID NO: 45530 - DNA, 20 bp, Artificial Sequence
  Synthetic oligonucleotide; AGG chr11 5253776 5253795 5253779 -
gatgggggcaaagtatgtcc

SEQ ID NO: 45531 - DNA, 20 bp, Artificial Sequence
  Synthetic oligonucleotide; GGG chr11 5253775 5253794 5253778 -
atgggggcaaagtatgtcca

SEQ ID NO: 45532 - DNA, 20 bp, Artificial Sequence
  Synthetic oligonucleotide; GGG chr11 5253774 5253793 5253777 -
tgggggcaaagtatgtccag

SEQ ID NO: 45533 - DNA, 20 bp, Artificial Sequence
  Synthetic oligonucleotide; GAG chr11 5253770 5253789 5253773 -
ggcaaagtatgtccaggggt

SEQ ID NO: 45534 - DNA, 20 bp, Artificial Sequence
  Synthetic oligonucleotide; AGG chr11 5253769 5253788 5253772 -
gcaaagtatgtccaggggtg

SEQ ID NO: 45535 - DNA, 20 bp, Artificial Sequence
  Synthetic oligonucleotide; TGG chr11 5253751 5253770 5253754 -
tgaggaacaattgaaacatt

SEQ ID NO: 45536 - DNA, 20 bp, Artificial Sequence
  Synthetic oligonucleotide; GGG chr11 5253750 5253769 5253753 -
gaggaacaattgaaacattt

SEQ ID NO: 45537 - DNA, 20 bp, Artificial Sequence
  Synthetic oligonucleotide; TGG chr11 5253746 5253765 5253749 -
aacaattgaaacatttgggc

SEQ ID NO: 45538 - DNA, 20 bp, Artificial Sequence
  Synthetic oligonucleotide; GAG chr11 5253744 5253763 5253747 -
caattgaaacatttgggctg

SEQ ID NO: 45539 - DNA, 20 bp, Artificial Sequence
  Synthetic oligonucleotide; TAG chr11 5253741 5253760 5253744 -
ttgaaacatttgggctggag

SEQ ID NO: 45540 - DNA, 20 bp, Artificial Sequence
  Synthetic oligonucleotide; AAG chr11 5253731 5253750 5253734 -
tgggctggagtagattttga

SEQ ID NO: 45541 - DNA, 20 bp, Artificial Sequence
  Synthetic oligonucleotide; CAG chr11 5253727 5253746 5253730 -
ctggagtagattttgaaagt

SEQ ID NO: 45542 - DNA, 20 bp, Artificial Sequence
  Synthetic oligonucleotide; GAG chr11 5253676 5253695 5253679 -
gcgtgtgtttgtgtgtgtgt

SEQ ID NO: 45543 - DNA, 20 bp, Artificial Sequence
  Synthetic oligonucleotide; GAG chr11 5253674 5253693 5253677 -
gtgtgtttgtgtgtgtgtga

SEQ ID NO: 45544 - DNA, 20 bp, Artificial Sequence
  Synthetic oligonucleotide; CAG chr11 5253649 5253668 5253652 -
tgtgtttcttttaacgtttt

SEQ ID NO: 45545 - DNA, 20 bp, Artificial Sequence
  Synthetic oligonucleotide; CAG chr11 5253642 5253661 5253645 -
cttttaacgttttcagccta

SEQ ID NO: 45546 - DNA, 20 bp, Artificial Sequence
  Synthetic oligonucleotide; CAG chr11 5253635 5253654 5253638 -
cgttttcagcctacagcata

SEQ ID NO: 45547 - DNA, 20 bp, Artificial Sequence
  Synthetic oligonucleotide; AGG chr11 5253634 5253653 5253637 -
gttttcagcctacagcatac

SEQ ID NO: 45548 - DNA, 20 bp, Artificial Sequence
  Synthetic oligonucleotide; GGG chr11 5253633 5253652 5253636 -
ttttcagcctacagcataca

SEQ ID NO: 45549 - DNA, 20 bp, Artificial Sequence
  Synthetic oligonucleotide; TGG chr11 5253626 5253645 5253629 -
cctacagcatacagggttca

SEQ ID NO: 45550 - DNA, 20 bp, Artificial Sequence
  Synthetic oligonucleotide; TGG chr11 5253623 5253642 5253626 -
acagcatacagggttcatgg

SEQ ID NO: 45551 - DNA, 20 bp, Artificial Sequence
  Synthetic oligonucleotide; AAG chr11 5253619 5253638 5253622 -
catacagggttcatggtggc

SEQ ID NO: 45552 - DNA, 20 bp, Artificial Sequence
  Synthetic oligonucleotide; AAG chr11 5253616 5253635 5253619 -
acagggttcatggtggcaag

SEQ ID NO: 45553 - DNA, 20 bp, Artificial Sequence
  Synthetic oligonucleotide; AAG chr11 5253608 5253627 5253611 -
catggtggcaagaagataac

SEQ ID NO: 45554 - DNA, 20 bp, Artificial Sequence
  Synthetic oligonucleotide; TGG chr11 5253595 5253614 5253598 -
agataacaagatttaaatta

SEQ ID NO: 45555 - DNA, 20 bp, Artificial Sequence
  Synthetic oligonucleotide; CAG chr11 5253591 5253610 5253594 -
aacaagatttaaattatggc

SEQ ID NO: 45556 - DNA, 20 bp, Artificial Sequence
  Synthetic oligonucleotide; TAG chr11 5253584 5253603 5253587 -
tttaaattatggccagtgac

SEQ ID NO: 45557 - DNA, 20 bp, Artificial Sequence
  Synthetic oligonucleotide; AAG chr11 5253575 5253594 5253578 -
tggccagtgactagtgctgc

SEQ ID NO: 45558 - DNA, 20 bp, Artificial Sequence
  Synthetic oligonucleotide; AAG chr11 5253572 5253591 5253575 -
ccagtgactagtgctgcaag

SEQ ID NO: 45559 - DNA, 20 bp, Artificial Sequence
  Synthetic oligonucleotide; TGG chr11 5253550 5253569 5253553 -
gaacaactacctgcatttaa

SEQ ID NO: 45560 - DNA, 20 bp, Artificial Sequence
  Synthetic oligonucleotide; GGG chr11 5253549 5253568 5253552 -
aacaactacctgcatttaat

SEQ ID NO: 45561 - DNA, 20 bp, Artificial Sequence
  Synthetic oligonucleotide; AAG chr11 5253545 5253564 5253548 -
actacctgcatttaatggga

SEQ ID NO: 45562 - DNA, 20 bp, Artificial Sequence
  Synthetic oligonucleotide; CAG chr11 5253534 5253553 5253537 -
ttaatgggaaagcaaaatct

SEQ ID NO: 45563 - DNA, 20 bp, Artificial Sequence
  Synthetic oligonucleotide; AGG chr11 5253533 5253552 5253536 -
taatgggaaagcaaaatctc

SEQ ID NO: 45564 - DNA, 20 bp, Artificial Sequence
  Synthetic oligonucleotide; GAG chr11 5253526 5253545 5253529 -
aaagcaaaatctcaggcttt

SEQ ID NO: 45565 - DNA, 20 bp, Artificial Sequence
  Synthetic oligonucleotide; AGG chr11 5253525 5253544 5253528 -
aagcaaaatctcaggctttg

SEQ ID NO: 45566 - DNA, 20 bp, Artificial Sequence
  Synthetic oligonucleotide; GGG chr11 5253524 5253543 5253527 -
agcaaaatctcaggctttga

SEQ ID NO: 45567 - DNA, 20 bp, Artificial Sequence
  Synthetic oligonucleotide; AAG chr11 5253521 5253540 5253524 -
aaaatctcaggctttgaggg

SEQ ID NO: 45568 - DNA, 20 bp, Artificial Sequence
  Synthetic oligonucleotide; TAG chr11 5253512 5253531 5253515 -
ggctttgagggaagttaaca

SEQ ID NO: 45569 - DNA, 20 bp, Artificial Sequence
  Synthetic oligonucleotide; AGG chr11 5253511 5253530 5253514 -
gctttgagggaagttaacat

SEQ ID NO: 45570 - DNA, 20 bp, Artificial Sequence
  Synthetic oligonucleotide; TGG chr11 5253500 5253519 5253503 -
agttaacataggcttgattc

SEQ ID NO: 45571 - DNA, 20 bp, Artificial Sequence
  Synthetic oligonucleotide; GGG chr11 5253499 5253518 5253502 -
gttaacataggcttgattct

SEQ ID NO: 45572 - DNA, 20 bp, Artificial Sequence
  Synthetic oligonucleotide; TGG chr11 5253496 5253515 5253499 -
aacataggcttgattctggg

SEQ ID NO: 45573 - DNA, 20 bp, Artificial Sequence
  Synthetic oligonucleotide; AAG chr11 5253493 5253512 5253496 -
ataggcttgattctgggtgg

SEQ ID NO: 45574 - DNA, 20 bp, Artificial Sequence
  Synthetic oligonucleotide; TGG chr11 5253488 5253507 5253491 -
cttgattctgggtggaagct

SEQ ID NO: 45575 - DNA, 20 bp, Artificial Sequence
  Synthetic oligonucleotide; TAG chr11 5253481 5253500 5253484 -
ctgggtggaagcttggtgtg

SEQ ID NO: 45576 - DNA, 20 bp, Artificial Sequence
  Synthetic oligonucleotide; TGG chr11 5253473 5253492 5253476 -
aagcttggtgtgtagttatc

SEQ ID NO: 45577 - DNA, 20 bp, Artificial Sequence
  Synthetic oligonucleotide; GAG chr11 5253471 5253490 5253474 -
gcttggtgtgtagttatctg

SEQ ID NO: 45578 - DNA, 20 bp, Artificial Sequence
  Synthetic oligonucleotide; AGG chr11 5253470 5253489 5253473 -
cttggtgtgtagttatctgg

SEQ ID NO: 45579 - DNA, 20 bp, Artificial Sequence
  Synthetic oligonucleotide; CAG chr11 5253466 5253485 5253469 -
gtgtgtagttatctggaggc

SEQ ID NO: 45580 - DNA, 20 bp, Artificial Sequence
  Synthetic oligonucleotide; AGG chr11 5253465 5253484 5253468 -
tgtgtagttatctggaggcc

SEQ ID NO: 45581 - DNA, 20 bp, Artificial Sequence
  Synthetic oligonucleotide; TGG chr11 5253461 5253480 5253464 -
tagttatctggaggccaggc

SEQ ID NO: 45582 - DNA, 20 bp, Artificial Sequence
  Synthetic oligonucleotide; GAG chr11 5253459 5253478 5253462 -
gttatctggaggccaggctg

SEQ ID NO: 45583 - DNA, 20 bp, Artificial Sequence
  Synthetic oligonucleotide; CAG chr11 5253452 5253471 5253455 -
ggaggccaggctggagctct

SEQ ID NO: 45584 - DNA, 20 bp, Artificial Sequence
  Synthetic oligonucleotide; TGG chr11 5253442 5253461 5253445 -
ctggagctctcagctcacta

SEQ ID NO: 45585 - DNA, 20 bp, Artificial Sequence
  Synthetic oligonucleotide; GGG chr11 5253441 5253460 5253444 -
tggagctctcagctcactat

SEQ ID NO: 45586 - DNA, 20 bp, Artificial Sequence
  Synthetic oligonucleotide; CAG chr11 5253409 5253428 5253412 -
attgtctcctttcatctcaa

SEQ ID NO: 45587 - DNA, 20 bp, Artificial Sequence
  Synthetic oligonucleotide; TGG chr11 5253402 5253421 5253405 -
cctttcatctcaacagctcc

SEQ ID NO: 45588 - DNA, 20 bp, Artificial Sequence
  Synthetic oligonucleotide; GGG chr11 5253401 5253420 5253404 -
ctttcatctcaacagctcct

SEQ ID NO: 45589 - DNA, 20 bp, Artificial Sequence
  Synthetic oligonucleotide; TGG chr11 5253390 5253409 5253393 -
acagctcctgggaaatgtgc

SEQ ID NO: 45590 - DNA, 20 bp, Artificial Sequence
  Synthetic oligonucleotide; TGG chr11 5253378 5253397 5253381 -
aaatgtgctggtgaccgttt

SEQ ID NO: 45591 - DNA, 20 bp, Artificial Sequence
  Synthetic oligonucleotide; CGG chr11 5253365 5253384 5253368 -
accgttttggcaatccattt

SEQ ID NO: 45592 - DNA, 20 bp, Artificial Sequence
  Synthetic oligonucleotide; AAG chr11 5253360 5253379 5253363 -
tttggcaatccatttcggca

SEQ ID NO: 45593 - DNA, 20 bp, Artificial Sequence
  Synthetic oligonucleotide; GAG chr11 5253346 5253365 5253349 -
tcggcaaagaattcacccct

SEQ ID NO: 45594 - DNA, 20 bp, Artificial Sequence
  Synthetic oligonucleotide; AGG chr11 5253345 5253364 5253348 -
cggcaaagaattcacccctg

SEQ ID NO: 45595 - DNA, 20 bp, Artificial Sequence
  Synthetic oligonucleotide; CAG chr11 5253340 5253359 5253343 -
aagaattcacccctgaggtg

SEQ ID NO: 45596 - DNA, 20 bp, Artificial Sequence
  Synthetic oligonucleotide; AGG chr11 5253339 5253358 5253342 -
agaattcacccctgaggtgc

SEQ ID NO: 45597 - DNA, 20 bp, Artificial Sequence
  Synthetic oligonucleotide; TGG chr11 5253331 5253350 5253334 -
cccctgaggtgcaggcttcc

SEQ ID NO: 45598 - DNA, 20 bp, Artificial Sequence
  Synthetic oligonucleotide; CAG chr11 5253328 5253347 5253331 -
ctgaggtgcaggcttcctgg

SEQ ID NO: 45599 - DNA, 20 bp, Artificial Sequence
  Synthetic oligonucleotide; AAG chr11 5253325 5253344 5253328 -
aggtgcaggcttcctggcag

SEQ ID NO: 45600 - DNA, 20 bp, Artificial Sequence
  Synthetic oligonucleotide; TGG chr11 5253321 5253340 5253324 -
gcaggcttcctggcagaaga

SEQ ID NO: 45601 - DNA, 20 bp, Artificial Sequence
  Synthetic oligonucleotide; TGG chr11 5253314 5253333 5253317 -
tcctggcagaagatggtgac

SEQ ID NO: 45602 - DNA, 20 bp, Artificial Sequence
  Synthetic oligonucleotide; GAG chr11 5253312 5253331 5253315 -
ctggcagaagatggtgactg

SEQ ID NO: 45603 - DNA, 20 bp, Artificial Sequence
  Synthetic oligonucleotide; TGG chr11 5253309 5253328 5253312 -
gcagaagatggtgactggag

SEQ ID NO: 45604 - DNA, 20 bp, Artificial Sequence
  Synthetic oligonucleotide; CAG chr11 5253305 5253324 5253308 -
aagatggtgactggagtggc

SEQ ID NO: 45605 - DNA, 20 bp, Artificial Sequence
  Synthetic oligonucleotide; CAG chr11 5253290 5253309 5253293 -
gtggccagtgccctgtcctc

SEQ ID NO: 45606 - DNA, 20 bp, Artificial Sequence
  Synthetic oligonucleotide; GAG chr11 5253279 5253298 5253282 -
cctgtcctccagataccact

SEQ ID NO: 45607 - DNA, 20 bp, Artificial Sequence
  Synthetic oligonucleotide; CAG chr11 5253260 5253279 5253263 -
tgagctcactgcccatgatg

SEQ ID NO: 45608 - DNA, 20 bp, Artificial Sequence
  Synthetic oligonucleotide; GAG chr11 5253258 5253277 5253261 -
agctcactgcccatgatgca

SEQ ID NO: 45609 - DNA, 20 bp, Artificial Sequence
  Synthetic oligonucleotide; AAG chr11 5253250 5253269 5253253 -
gcccatgatgcagagctttc

SEQ ID NO: 45610 - DNA, 20 bp, Artificial Sequence
  Synthetic oligonucleotide; AGG chr11 5253249 5253268 5253252 -
cccatgatgcagagctttca

SEQ ID NO: 45611 - DNA, 20 bp, Artificial Sequence
  Synthetic oligonucleotide; TAG chr11 5253245 5253264 5253248 -
tgatgcagagctttcaagga

SEQ ID NO: 45612 - DNA, 20 bp, Artificial Sequence
  Synthetic oligonucleotide; AGG chr11 5253244 5253263 5253247 -
gatgcagagctttcaaggat

SEQ ID NO: 45613 - DNA, 20 bp, Artificial Sequence
  Synthetic oligonucleotide; AAG chr11 5253230 5253249 5253233 -
aaggataggctttattctgc

SEQ ID NO: 45614 - DNA, 20 bp, Artificial Sequence
  Synthetic oligonucleotide; AAG chr11 5253201 5253220 5253204 -
aataataaatctattctgct

SEQ ID NO: 45615 - DNA, 20 bp, Artificial Sequence
  Synthetic oligonucleotide; GAG chr11 5253199 5253218 5253202 -
taataaatctattctgctaa

SEQ ID NO: 45616 - DNA, 20 bp, Artificial Sequence
  Synthetic oligonucleotide; TGG chr11 5253188 5253207 5253191 -
ttctgctaagagatcacaca

SEQ ID NO: 45617 - DNA, 20 bp, Artificial Sequence
  Synthetic oligonucleotide; CAG chr11 5253178 5253197 5253181 -
agatcacacatggttgtctt

SEQ ID NO: 45618 - DNA, 20 bp, Artificial Sequence
  Synthetic oligonucleotide; GAG chr11 5253147 5253166 5253150 -
ttatgtctttttaaatatat

SEQ ID NO: 45619 - DNA, 20 bp, Artificial Sequence
  Synthetic oligonucleotide; AAG chr11 5253139 5253158 5253142 -
ttttaaatatatgagccaca

SEQ ID NO: 45620 - DNA, 20 bp, Artificial Sequence
  Synthetic oligonucleotide; AGG chr11 5253138 5253157 5253141 -
tttaaatatatgagccacaa

SEQ ID NO: 45621 - DNA, 20 bp, Artificial Sequence
  Synthetic oligonucleotide; GGG chr11 5253137 5253156 5253140 -
ttaaatatatgagccacaaa

SEQ ID NO: 45622 - DNA, 20 bp, Artificial Sequence
  Synthetic oligonucleotide; GAG chr11 5253125 5253144 5253128 -
gccacaaagggttttatgtt

SEQ ID NO: 45623 - DNA, 20 bp, Artificial Sequence
  Synthetic oligonucleotide; AGG chr11 5253124 5253143 5253127 -
ccacaaagggttttatgttg

SEQ ID NO: 45624 - DNA, 20 bp, Artificial Sequence
  Synthetic oligonucleotide; GGG chr11 5253123 5253142 5253126 -
cacaaagggttttatgttga

SEQ ID NO: 45625 - DNA, 20 bp, Artificial Sequence
  Synthetic oligonucleotide; TGG chr11 5253097 5253116 5253100 -
tgtttatgtgtatttataca

SEQ ID NO: 45626 - DNA, 20 bp, Artificial Sequence
  Synthetic oligonucleotide; TAG chr11 5253046 5253065 5253049 -
ccacacttttttgtttacgt

SEQ ID NO: 45627 - DNA, 20 bp, Artificial Sequence
  Synthetic oligonucleotide; TGG chr11 5253040 5253059 5253043 -
ttttttgtttacgttagatg

SEQ ID NO: 45628 - DNA, 20 bp, Artificial Sequence
  Synthetic oligonucleotide; GGG chr11 5253039 5253058 5253042 -
tttttgtttacgttagatgt

SEQ ID NO: 45629 - DNA, 20 bp, Artificial Sequence
  Synthetic oligonucleotide; GAG chr11 5253029 5253048 5253032 -
cgttagatgtgggttttgat

SEQ ID NO: 45630 - DNA, 20 bp, Artificial Sequence
  Synthetic oligonucleotide; AAG chr11 5253019 5253038 5253022 -
gggttttgatgagcaaataa

SEQ ID NO: 45631 - DNA, 20 bp, Artificial Sequence
  Synthetic oligonucleotide; TAG chr11 5253013 5253032 5253016 -
tgatgagcaaataaaagaac

SEQ ID NO: 45632 - DNA, 20 bp, Artificial Sequence
  Synthetic oligonucleotide; AGG chr11 5253012 5253031 5253015 -
gatgagcaaataaaagaact

SEQ ID NO: 45633 - DNA, 20 bp, Artificial Sequence
  Synthetic oligonucleotide; AAG chr11 5253004 5253023 5253007 -
aataaaagaactaggcaata

SEQ ID NO: 45634 - DNA, 20 bp, Artificial Sequence
  Synthetic oligonucleotide; TGG chr11 5252990 5253009 5252993 -
gcaataaagaaacttgtaca

SEQ ID NO: 45635 - DNA, 20 bp, Artificial Sequence
  Synthetic oligonucleotide; GGG chr11 5252989 5253008 5252992 -
caataaagaaacttgtacat

SEQ ID NO: 45636 - DNA, 20 bp, Artificial Sequence
  Synthetic oligonucleotide; GAG chr11 5252987 5253006 5252990 -
ataaagaaacttgtacatgg

SEQ ID NO: 45637 - DNA, 20 bp, Artificial Sequence
  Synthetic oligonucleotide; AAG chr11 5252978 5252997 5252981 -
cttgtacatgggagttctgc

SEQ ID NO: 45638 - DNA, 20 bp, Artificial Sequence
  Synthetic oligonucleotide; TGG chr11 5252975 5252994 5252978 -
gtacatgggagttctgcaag

SEQ ID NO: 45639 - DNA, 20 bp, Artificial Sequence
  Synthetic oligonucleotide; GGG chr11 5252974 5252993 5252977 -
tacatgggagttctgcaagt

SEQ ID NO: 45640 - DNA, 20 bp, Artificial Sequence
  Synthetic oligonucleotide; GAG chr11 5252972 5252991 5252975 -
catgggagttctgcaagtgg

SEQ ID NO: 45641 - DNA, 20 bp, Artificial Sequence
  Synthetic oligonucleotide; AAG chr11 5252966 5252985 5252969 -
agttctgcaagtgggagtaa

SEQ ID NO: 45642 - DNA, 20 bp, Artificial Sequence
  Synthetic oligonucleotide; AGG chr11 5252965 5252984 5252968 -
gttctgcaagtgggagtaaa

SEQ ID NO: 45643 - DNA, 20 bp, Artificial Sequence
  Synthetic oligonucleotide; CAG chr11 5252960 5252979 5252963 -
gcaagtgggagtaaaaggtg

SEQ ID NO: 45644 - DNA, 20 bp, Artificial Sequence
  Synthetic oligonucleotide; AGG chr11 5252959 5252978 5252962 -
caagtgggagtaaaaggtgc

SEQ ID NO: 45645 - DNA, 20 bp, Artificial Sequence
  Synthetic oligonucleotide; GAG chr11 5252957 5252976 5252960 -
agtgggagtaaaaggtgcag

SEQ ID NO: 45646 - DNA, 20 bp, Artificial Sequence
  Synthetic oligonucleotide; TGG chr11 5252949 5252968 5252952 -
taaaaggtgcaggagaaatc

SEQ ID NO: 45647 - DNA, 20 bp, Artificial Sequence
  Synthetic oligonucleotide; TGG chr11 5252945 5252964 5252948 -
aggtgcaggagaaatctggt

SEQ ID NO: 45648 - DNA, 20 bp, Artificial Sequence
  Synthetic oligonucleotide; AAG chr11 5252942 5252961 5252945 -
tgcaggagaaatctggttgg

SEQ ID NO: 45649 - DNA, 20 bp, Artificial Sequence
  Synthetic oligonucleotide; AAG chr11 5252938 5252957 5252941 -
ggagaaatctggttggaaga

SEQ ID NO: 45650 - DNA, 20 bp, Artificial Sequence
  Synthetic oligonucleotide; TAG chr11 5252928 5252947 5252931 -
ggttggaagaaagacctcta

SEQ ID NO: 45651 - DNA, 20 bp, Artificial Sequence
  Synthetic oligonucleotide; AGG chr11 5252927 5252946 5252930 -
gttggaagaaagacctctat

SEQ ID NO: 45652 - DNA, 20 bp, Artificial Sequence
  Synthetic oligonucleotide; CAG chr11 5252923 5252942 5252926 -
gaagaaagacctctatagga

SEQ ID NO: 45653 - DNA, 20 bp, Artificial Sequence
  Synthetic oligonucleotide; AGG chr11 5252922 5252941 5252925 -
aagaaagacctctataggac

SEQ ID NO: 45654 - DNA, 20 bp, Artificial Sequence
  Synthetic oligonucleotide; CAG chr11 5252913 5252932 5252916 -
ctctataggacaggactcct

SEQ ID NO: 45655 - DNA, 20 bp, Artificial Sequence
  Synthetic oligonucleotide; CAG chr11 5252907 5252926 5252910 -
aggacaggactcctcagaaa

SEQ ID NO: 45656 - DNA, 20 bp, Artificial Sequence
  Synthetic oligonucleotide; TGG chr11 5252898 5252917 5252901 -
ctcctcagaaacagatgttt

SEQ ID NO: 45657 - DNA, 20 bp, Artificial Sequence
  Synthetic oligonucleotide; AAG chr11 5252895 5252914 5252898 -
ctcagaaacagatgttttgg

SEQ ID NO: 45658 - DNA, 20 bp, Artificial Sequence
  Synthetic oligonucleotide; GAG chr11 5252893 5252912 5252896 -
cagaaacagatgttttggaa

SEQ ID NO: 45659 - DNA, 20 bp, Artificial Sequence
  Synthetic oligonucleotide; TGG chr11 5252889 5252908 5252892 -
aacagatgttttggaagaga

SEQ ID NO: 45660 - DNA, 20 bp, Artificial Sequence
  Synthetic oligonucleotide; GGG chr11 5252888 5252907 5252891 -
acagatgttttggaagagat

SEQ ID NO: 45661 - DNA, 20 bp, Artificial Sequence
  Synthetic oligonucleotide; GGG chr11 5252887 5252906 5252890 -
cagatgttttggaagagatg

SEQ ID NO: 45662 - DNA, 20 bp, Artificial Sequence
  Synthetic oligonucleotide; AAG chr11 5252883 5252902 5252886 -
tgttttggaagagatgggga

SEQ ID NO: 45663 - DNA, 20 bp, Artificial Sequence
  Synthetic oligonucleotide; AGG chr11 5252882 5252901 5252885 -
gttttggaagagatggggaa

SEQ ID NO: 45664 - DNA, 20 bp, Artificial Sequence
  Synthetic oligonucleotide; CAG chr11 5252877 5252896 5252880 -
ggaagagatggggaaaggtt

SEQ ID NO: 45665 - DNA, 20 bp, Artificial Sequence
  Synthetic oligonucleotide; AAG chr11 5252872 5252891 5252875 -
agatggggaaaggttcagtg

SEQ ID NO: 45666 - DNA, 20 bp, Artificial Sequence
  Synthetic oligonucleotide; AGG chr11 5252871 5252890 5252874 -
gatggggaaaggttcagtga

SEQ ID NO: 45667 - DNA, 20 bp, Artificial Sequence
  Synthetic oligonucleotide; GGG chr11 5252870 5252889 5252873 -
atggggaaaggttcagtgaa

SEQ ID NO: 45668 - DNA, 20 bp, Artificial Sequence
  Synthetic oligonucleotide; GGG chr11 5252869 5252888 5252872 -
tggggaaaggttcagtgaag

SEQ ID NO: 45669 - DNA, 20 bp, Artificial Sequence
  Synthetic oligonucleotide; GGG chr11 5252868 5252887 5252871 -
ggggaaaggttcagtgaagg

SEQ ID NO: 45670 - DNA, 20 bp, Artificial Sequence
  Synthetic oligonucleotide; TGG chr11 5252850 5252869 5252853 -
gggggctgaacccccttccc

SEQ ID NO: 45671 - DNA, 20 bp, Artificial Sequence
  Synthetic oligonucleotide; CAG chr11 5252843 5252862 5252846 -
gaacccccttccctggattg

SEQ ID NO: 45672 - DNA, 20 bp, Artificial Sequence
  Synthetic oligonucleotide; CAG chr11 5252838 5252857 5252841 -
cccttccctggattgcagca

SEQ ID NO: 45673 - DNA, 20 bp, Artificial Sequence
  Synthetic oligonucleotide; CAG chr11 5252835 5252854 5252838 -
ttccctggattgcagcacag

SEQ ID NO: 45674 - DNA, 20 bp, Artificial Sequence
  Synthetic oligonucleotide; GAG chr11 5252831 5252850 5252834 -
ctggattgcagcacagcagc

SEQ ID NO: 45675 - DNA, 20 bp, Artificial Sequence
  Synthetic oligonucleotide; AGG chr11 5252830 5252849 5252833 -
tggattgcagcacagcagcg

SEQ ID NO: 45676 - DNA, 20 bp, Artificial Sequence
  Synthetic oligonucleotide; AAG chr11 5252827 5252846 5252830 -
attgcagcacagcagcgagg

SEQ ID NO: 45677 - DNA, 20 bp, Artificial Sequence
  Synthetic oligonucleotide; AGG chr11 5252826 5252845 5252829 -
ttgcagcacagcagcgagga

SEQ ID NO: 45678 - DNA, 20 bp, Artificial Sequence
  Synthetic oligonucleotide; GGG chr11 5252825 5252844 5252828 -
tgcagcacagcagcgaggaa

SEQ ID NO: 45679 - DNA, 20 bp, Artificial Sequence
  Synthetic oligonucleotide; GGG chr11 5252824 5252843 5252827 -
gcagcacagcagcgaggaag

SEQ ID NO: 45680 - DNA, 20 bp, Artificial Sequence
  Synthetic oligonucleotide; AAG chr11 5252814 5252833 5252817 -
agcgaggaaggggctcaacg

SEQ ID NO: 45681 - DNA, 20 bp, Artificial Sequence
  Synthetic oligonucleotide; AAG chr11 5252808 5252827 5252811 -
gaaggggctcaacgaagaaa

SEQ ID NO: 45682 - DNA, 20 bp, Artificial Sequence
  Synthetic oligonucleotide; AAG chr11 5252799 5252818 5252802 -
caacgaagaaaaagtgttcc

SEQ ID NO: 45683 - DNA, 20 bp, Artificial Sequence
  Synthetic oligonucleotide; TAG chr11 5252793 5252812 5252796 -
agaaaaagtgttccaagctt

SEQ ID NO: 45684 - DNA, 20 bp, Artificial Sequence
  Synthetic oligonucleotide; AGG chr11 5252792 5252811 5252795 -
gaaaaagtgttccaagcttt

SEQ ID NO: 45685 - DNA, 20 bp, Artificial Sequence
  Synthetic oligonucleotide; AAG chr11 5252789 5252808 5252792 -
aaagtgttccaagctttagg

SEQ ID NO: 45686 - DNA, 20 bp, Artificial Sequence
  Synthetic oligonucleotide; AAG chr11 5252784 5252803 5252787 -
gttccaagctttaggaagtc

SEQ ID NO: 45687 - DNA, 20 bp, Artificial Sequence
  Synthetic oligonucleotide; AGG chr11 5252783 5252802 5252786 -
ttccaagctttaggaagtca

SEQ ID NO: 45688 - DNA, 20 bp, Artificial Sequence
  Synthetic oligonucleotide; TAG chr11 5252778 5252797 5252781 -
agctttaggaagtcaaggtt

SEQ ID NO: 45689 - DNA, 20 bp, Artificial Sequence
  Synthetic oligonucleotide; AGG chr11 5252777 5252796 5252780 -
gctttaggaagtcaaggttt

SEQ ID NO: 45690 - DNA, 20 bp, Artificial Sequence
  Synthetic oligonucleotide; CAG chr11 5252774 5252793 5252777 -
ttaggaagtcaaggtttagg

SEQ ID NO: 45691 - DNA, 20 bp, Artificial Sequence
  Synthetic oligonucleotide; AGG chr11 5252773 5252792 5252776 -
taggaagtcaaggtttaggc

SEQ ID NO: 45692 - DNA, 20 bp, Artificial Sequence
  Synthetic oligonucleotide; GGG chr11 5252772 5252791 5252775 -
aggaagtcaaggtttaggca

SEQ ID NO: 45693 - DNA, 20 bp, Artificial Sequence
  Synthetic oligonucleotide; TAG chr11 5252768 5252787 5252771 -
agtcaaggtttaggcaggga

SEQ ID NO: 45694 - DNA, 20 bp, Artificial Sequence
  Synthetic oligonucleotide; TAG chr11 5252751 5252770 5252754 -
ggatagccattctattttat

SEQ ID NO: 45695 - DNA, 20 bp, Artificial Sequence
  Synthetic oligonucleotide; AGG chr11 5252750 5252769 5252753 -
gatagccattctattttatt

SEQ ID NO: 45696 - DNA, 20 bp, Artificial Sequence
  Synthetic oligonucleotide; GGG chr11 5252749 5252768 5252752 -
atagccattctattttatta

SEQ ID NO: 45697 - DNA, 20 bp, Artificial Sequence
  Synthetic oligonucleotide; GGG chr11 5252748 5252767 5252751 -
tagccattctattttattag

SEQ ID NO: 45698 - DNA, 20 bp, Artificial Sequence
  Synthetic oligonucleotide; CGG chr11 5252730 5252749 5252733 -
aggggcaatactatttccaa

SEQ ID NO: 45699 - DNA, 20 bp, Artificial Sequence
  Synthetic oligonucleotide; TGG chr11 5252723 5252742 5252726 -
atactatttccaacggcatc

SEQ ID NO: 45700 - DNA, 20 bp, Artificial Sequence
  Synthetic oligonucleotide; CAG chr11 5252713 5252732 5252716 -
caacggcatctggcttttct

SEQ ID NO: 45701 - DNA, 20 bp, Artificial Sequence
  Synthetic oligonucleotide; GAG chr11 5252703 5252722 5252706 -
tggcttttctcagcccttgt

SEQ ID NO: 45702 - DNA, 20 bp, Artificial Sequence
  Synthetic oligonucleotide; AGG chr11 5252702 5252721 5252705 -
ggcttttctcagcccttgtg

SEQ ID NO: 45703 - DNA, 20 bp, Artificial Sequence
  Synthetic oligonucleotide; CAG chr11 5252694 5252713 5252697 -
tcagcccttgtgaggctcta

SEQ ID NO: 45704 - DNA, 20 bp, Artificial Sequence
  Synthetic oligonucleotide; AGG chr11 5252693 5252712 5252696 -
cagcccttgtgaggctctac

SEQ ID NO: 45705 - DNA, 20 bp, Artificial Sequence
  Synthetic oligonucleotide; GGG chr11 5252692 5252711 5252695 -
agcccttgtgaggctctaca

SEQ ID NO: 45706 - DNA, 20 bp, Artificial Sequence
  Synthetic oligonucleotide; GAG chr11 5252690 5252709 5252693 -
cccttgtgaggctctacagg

SEQ ID NO: 45707 - DNA, 20 bp, Artificial Sequence
  Synthetic oligonucleotide; AGG chr11 5252689 5252708 5252692 -
ccttgtgaggctctacaggg

SEQ ID NO: 45708 - DNA, 20 bp, Artificial Sequence
  Synthetic oligonucleotide; GAG chr11 5252684 5252703 5252687 -
tgaggctctacagggaggtt

SEQ ID NO: 45709 - DNA, 20 bp, Artificial Sequence
  Synthetic oligonucleotide; AGG chr11 5252683 5252702 5252686 -
gaggctctacagggaggttg

SEQ ID NO: 45710 - DNA, 20 bp, Artificial Sequence
  Synthetic oligonucleotide; TAG chr11 5252677 5252696 5252680 -
ctacagggaggttgaggtgt

SEQ ID NO: 45711 - DNA, 20 bp, Artificial Sequence
  Synthetic oligonucleotide; GAG chr11 5252675 5252694 5252678 -
acagggaggttgaggtgtta

SEQ ID NO: 45712 - DNA, 20 bp, Artificial Sequence
  Synthetic oligonucleotide; CAG chr11 5252670 5252689 5252673 -
gaggttgaggtgttagagat

SEQ ID NO: 45713 - DNA, 20 bp, Artificial Sequence
  Synthetic oligonucleotide; GAG chr11 5252668 5252687 5252671 -
ggttgaggtgttagagatca

SEQ ID NO: 45714 - DNA, 20 bp, Artificial Sequence
  Synthetic oligonucleotide; CAG chr11 5252665 5252684 5252668 -
tgaggtgttagagatcagag

SEQ ID NO: 45715 - DNA, 20 bp, Artificial Sequence
  Synthetic oligonucleotide; AGG chr11 5252664 5252683 5252667 -
gaggtgttagagatcagagc

SEQ ID NO: 45716 - DNA, 20 bp, Artificial Sequence
  Synthetic oligonucleotide; CAG chr11 5252658 5252677 5252661 -
ttagagatcagagcaggaaa

SEQ ID NO: 45717 - DNA, 20 bp, Artificial Sequence
  Synthetic oligonucleotide; AGG chr11 5252657 5252676 5252660 -
tagagatcagagcaggaaac

SEQ ID NO: 45718 - DNA, 20 bp, Artificial Sequence
  Synthetic oligonucleotide; CGG chr11 5252642 5252661 5252645 -
gaaacaggtttttctttcca

SEQ ID NO: 45719 - DNA, 20 bp, Artificial Sequence
  Synthetic oligonucleotide; AAG chr11 5252628 5252647 5252631 -
tttccacggtaactacaatg

SEQ ID NO: 45720 - DNA, 20 bp, Artificial Sequence
  Synthetic oligonucleotide; AAG chr11 5252609 5252628 5252612 -
gaagtgatccttactttact

SEQ ID NO: 45721 - DNA, 20 bp, Artificial Sequence
  Synthetic oligonucleotide; AGG chr11 5252608 5252627 5252611 -
aagtgatccttactttacta

SEQ ID NO: 45722 - DNA, 20 bp, Artificial Sequence
  Synthetic oligonucleotide; AAG chr11 5252592 5252611 5252595 -
actaaggaacttttcatttt

SEQ ID NO: 45723 - DNA, 20 bp, Artificial Sequence
  Synthetic oligonucleotide; AAG chr11 5252573 5252592 5252576 -
taagtgttgacgcatgccta

SEQ ID NO: 45724 - DNA, 20 bp, Artificial Sequence
  Synthetic oligonucleotide; GAG chr11 5252571 5252590 5252574 -
agtgttgacgcatgcctaaa

SEQ ID NO: 45725 - DNA, 20 bp, Artificial Sequence
  Synthetic oligonucleotide; AGG chr11 5252570 5252589 5252573 -
gtgttgacgcatgcctaaag

SEQ ID NO: 45726 - DNA, 20 bp, Artificial Sequence
  Synthetic oligonucleotide; AAG chr11 5252546 5252565 5252549 -
gaaattaatcccataccctt

SEQ ID NO: 45727 - DNA, 20 bp, Artificial Sequence
  Synthetic oligonucleotide; CAG chr11 5252539 5252558 5252542 -
atcccatacccttaagtcta

SEQ ID NO: 45728 - DNA, 20 bp, Artificial Sequence
  Synthetic oligonucleotide; TGG chr11 5252534 5252553 5252537 -
atacccttaagtctacagac

SEQ ID NO: 45729 - DNA, 20 bp, Artificial Sequence
  Synthetic oligonucleotide; CAG chr11 5252528 5252547 5252531 -
ttaagtctacagactggtca

SEQ ID NO: 45730 - DNA, 20 bp, Artificial Sequence
  Synthetic oligonucleotide; AAG chr11 5252519 5252538 5252522 -
cagactggtcacagcatttc

SEQ ID NO: 45731 - DNA, 20 bp, Artificial Sequence
  Synthetic oligonucleotide; AGG chr11 5252518 5252537 5252521 -
agactggtcacagcatttca

SEQ ID NO: 45732 - DNA, 20 bp, Artificial Sequence
  Synthetic oligonucleotide; GAG chr11 5252516 5252535 5252519 -
actggtcacagcatttcaag

SEQ ID NO: 45733 - DNA, 20 bp, Artificial Sequence
  Synthetic oligonucleotide; AGG chr11 5252515 5252534 5252518 -
ctggtcacagcatttcaagg

SEQ ID NO: 45734 - DNA, 20 bp, Artificial Sequence
  Synthetic oligonucleotide; GAG chr11 5252513 5252532 5252516 -
ggtcacagcatttcaaggag

SEQ ID NO: 45735 - DNA, 20 bp, Artificial Sequence
  Synthetic oligonucleotide; AAG chr11 5252500 5252519 5252503 -
caaggaggagacctcattgt

SEQ ID NO: 45736 - DNA, 20 bp, Artificial Sequence
  Synthetic oligonucleotide; TAG chr11 5252493 5252512 5252496 -
gagacctcattgtaagcttc

SEQ ID NO: 45737 - DNA, 20 bp, Artificial Sequence
  Synthetic oligonucleotide; AGG chr11 5252492 5252511 5252495 -
agacctcattgtaagcttct

SEQ ID NO: 45738 - DNA, 20 bp, Artificial Sequence
  Synthetic oligonucleotide; GGG chr11 5252491 5252510 5252494 -
gacctcattgtaagcttcta

SEQ ID NO: 45739 - DNA, 20 bp, Artificial Sequence
  Synthetic oligonucleotide; GAG chr11 5252489 5252508 5252492 -
cctcattgtaagcttctagg

SEQ ID NO: 45740 - DNA, 20 bp, Artificial Sequence
  Synthetic oligonucleotide; AGG chr11 5252488 5252507 5252491 -
ctcattgtaagcttctaggg

SEQ ID NO: 45741 - DNA, 20 bp, Artificial Sequence
  Synthetic oligonucleotide; TGG chr11 5252485 5252504 5252488 -
attgtaagcttctagggagg

SEQ ID NO: 45742 - DNA, 20 bp, Artificial Sequence
  Synthetic oligonucleotide; GGG chr11 5252484 5252503 5252487 -
ttgtaagcttctagggaggt

SEQ ID NO: 45743 - DNA, 20 bp, Artificial Sequence
  Synthetic oligonucleotide; GGG chr11 5252483 5252502 5252486 -
tgtaagcttctagggaggtg

SEQ ID NO: 45744 - DNA, 20 bp, Artificial Sequence
  Synthetic oligonucleotide; TAG chr11 5252477 5252496 5252480 -
cttctagggaggtggggact

SEQ ID NO: 45745 - DNA, 20 bp, Artificial Sequence
  Synthetic oligonucleotide; AGG chr11 5252476 5252495 5252479 -
ttctagggaggtggggactt

SEQ ID NO: 45746 - DNA, 20 bp, Artificial Sequence
  Synthetic oligonucleotide; AAG chr11 5252471 5252490 5252474 -
gggaggtggggacttaggtg

SEQ ID NO: 45747 - DNA, 20 bp, Artificial Sequence
  Synthetic oligonucleotide; AGG chr11 5252470 5252489 5252473 -
ggaggtggggacttaggtga

SEQ ID NO: 45748 - DNA, 20 bp, Artificial Sequence
  Synthetic oligonucleotide; GAG chr11 5252463 5252482 5252466 -
gggacttaggtgaaggaaat

SEQ ID NO: 45749 - DNA, 20 bp, Artificial Sequence
  Synthetic oligonucleotide; CAG chr11 5252459 5252478 5252462 -
cttaggtgaaggaaatgagc

SEQ ID NO: 45750 - DNA, 20 bp, Artificial Sequence
  Synthetic oligonucleotide; CAG chr11 5252456 5252475 5252459 -
aggtgaaggaaatgagccag

SEQ ID NO: 45751 - DNA, 20 bp, Artificial Sequence
  Synthetic oligonucleotide; AAG chr11 5252453 5252472 5252456 -
tgaaggaaatgagccagcag

SEQ ID NO: 45752 - DNA, 20 bp, Artificial Sequence
  Synthetic oligonucleotide; AAG chr11 5252445 5252464 5252448 -
atgagccagcagaagctcac

SEQ ID NO: 45753 - DNA, 20 bp, Artificial Sequence
  Synthetic oligonucleotide; CAG chr11 5252441 5252460 5252444 -
gccagcagaagctcacaagt

SEQ ID NO: 45754 - DNA, 20 bp, Artificial Sequence
  Synthetic oligonucleotide; CAG chr11 5252435 5252454 5252438 -
agaagctcacaagtcagcat

SEQ ID NO: 45755 - DNA, 20 bp, Artificial Sequence
  Synthetic oligonucleotide; CAG chr11 5252420 5252439 5252423 -
agcatcagcgtgtcatgtct

SEQ ID NO: 45756 - DNA, 20 bp, Artificial Sequence
  Synthetic oligonucleotide; CAG chr11 5252417 5252436 5252420 -
atcagcgtgtcatgtctcag

SEQ ID NO: 45757 - DNA, 20 bp, Artificial Sequence
  Synthetic oligonucleotide; CAG chr11 5252414 5252433 5252417 -
agcgtgtcatgtctcagcag

SEQ ID NO: 45758 - DNA, 20 bp, Artificial Sequence
  Synthetic oligonucleotide; CAG chr11 5252409 5252428 5252412 -
gtcatgtctcagcagcagaa

SEQ ID NO: 45759 - DNA, 20 bp, Artificial Sequence
  Synthetic oligonucleotide; CGG chr11 5252404 5252423 5252407 -
gtctcagcagcagaacagca

SEQ ID NO: 45760 - DNA, 20 bp, Artificial Sequence
  Synthetic oligonucleotide; CAG chr11 5252400 5252419 5252403 -
cagcagcagaacagcacggt

SEQ ID NO: 45761 - DNA, 20 bp, Artificial Sequence
  Synthetic oligonucleotide; TAG chr11 5252388 5252407 5252391 -
agcacggtcagatgaaaata

SEQ ID NO: 45762 - DNA, 20 bp, Artificial Sequence
  Synthetic oligonucleotide; AAG chr11 5252381 5252400 5252384 -
tcagatgaaaatatagtgtg

SEQ ID NO: 45763 - DNA, 20 bp, Artificial Sequence
  Synthetic oligonucleotide; GAG chr11 5252359 5252378 5252362 -
gaatttgtataacattaatt

SEQ ID NO: 45764 - DNA, 20 bp, Artificial Sequence
  Synthetic oligonucleotide; AAG chr11 5252356 5252375 5252359 -
tttgtataacattaattgag

SEQ ID NO: 45765 - DNA, 20 bp, Artificial Sequence
  Synthetic oligonucleotide; AGG chr11 5252355 5252374 5252358 -
ttgtataacattaattgaga

SEQ ID NO: 45766 - DNA, 20 bp, Artificial Sequence
  Synthetic oligonucleotide; CAG chr11 5252352 5252371 5252355 -
tataacattaattgagaagg

SEQ ID NO: 45767 - DNA, 20 bp, Artificial Sequence
  Synthetic oligonucleotide; TGG chr11 5252343 5252362 5252346 -
aattgagaaggcagattcac

SEQ ID NO: 45768 - DNA, 20 bp, Artificial Sequence
  Synthetic oligonucleotide; GAG chr11 5252341 5252360 5252344 -
ttgagaaggcagattcactg

SEQ ID NO: 45769 - DNA, 20 bp, Artificial Sequence
  Synthetic oligonucleotide; AAG chr11 5252323 5252342 5252326 -
tggagttcttatataattga

SEQ ID NO: 45770 - DNA, 20 bp, Artificial Sequence
  Synthetic oligonucleotide; AAG chr11 5252305 5252324 5252308 -
gaaagttaatgcacgttaat

SEQ ID NO: 45771 - DNA, 20 bp, Artificial Sequence
  Synthetic oligonucleotide; AAG chr11 5252301 5252320 5252304 -
gttaatgcacgttaataagc

SEQ ID NO: 45772 - DNA, 20 bp, Artificial Sequence
  Synthetic oligonucleotide; GAG chr11 5252299 5252318 5252302 -
taatgcacgttaataagcaa

SEQ ID NO: 45773 - DNA, 20 bp, Artificial Sequence
  Synthetic oligonucleotide; TAG chr11 5252294 5252313 5252297 -
cacgttaataagcaagagtt

SEQ ID NO: 45774 - DNA, 20 bp, Artificial Sequence
  Synthetic oligonucleotide; TGG chr11 5252281 5252300 5252284 -
aagagtttagtttaatgtga

SEQ ID NO: 45775 - DNA, 20 bp, Artificial Sequence
  Synthetic oligonucleotide; CAG chr11 5252252 5252271 5252255 -
gaacttaacgcttgtgtctc

SEQ ID NO: 45776 - DNA, 20 bp, Artificial Sequence
  Synthetic oligonucleotide; TGG chr11 5252217 5252236 5252220 -
ctgaatccccaactcccaat

SEQ ID NO: 45777 - DNA, 20 bp, Artificial Sequence
  Synthetic oligonucleotide; TGG chr11 5252205 5252224 5252208 -
ctcccaattggctccatttg

SEQ ID NO: 45778 - DNA, 20 bp, Artificial Sequence
  Synthetic oligonucleotide; GGG chr11 5252204 5252223 5252207 -
tcccaattggctccatttgt

SEQ ID NO: 45779 - DNA, 20 bp, Artificial Sequence
  Synthetic oligonucleotide; GGG chr11 5252203 5252222 5252206 -
cccaattggctccatttgtg

SEQ ID NO: 45780 - DNA, 20 bp, Artificial Sequence
  Synthetic oligonucleotide; GGG chr11 5252202 5252221 5252205 -
ccaattggctccatttgtgg

SEQ ID NO: 45781 - DNA, 20 bp, Artificial Sequence
  Synthetic oligonucleotide; GAG chr11 5252200 5252219 5252203 -
aattggctccatttgtgggg

SEQ ID NO: 45782 - DNA, 20 bp, Artificial Sequence
  Synthetic oligonucleotide; AGG chr11 5252199 5252218 5252202 -
attggctccatttgtggggg

SEQ ID NO: 45783 - DNA, 20 bp, Artificial Sequence
  Synthetic oligonucleotide; TGG chr11 5252193 5252212 5252196 -
tccatttgtgggggaggctt

SEQ ID NO: 45784 - DNA, 20 bp, Artificial Sequence
  Synthetic oligonucleotide; AAG chr11 5252188 5252207 5252191 -
ttgtgggggaggctttggaa

SEQ ID NO: 45785 - DNA, 20 bp, Artificial Sequence
  Synthetic oligonucleotide; CAG chr11 5252181 5252200 5252184 -
ggaggctttggaaaagtaat

SEQ ID NO: 45786 - DNA, 20 bp, Artificial Sequence
  Synthetic oligonucleotide; AGG chr11 5252180 5252199 5252183 -
gaggctttggaaaagtaatc

SEQ ID NO: 45787 - DNA, 20 bp, Artificial Sequence
  Synthetic oligonucleotide; TAG chr11 5252175 5252194 5252178 -
tttggaaaagtaatcaggtt

SEQ ID NO: 45788 - DNA, 20 bp, Artificial Sequence
  Synthetic oligonucleotide; GAG chr11 5252173 5252192 5252176 -
tggaaaagtaatcaggttta

SEQ ID NO: 45789 - DNA, 20 bp, Artificial Sequence
  Synthetic oligonucleotide; AGG chr11 5252172 5252191 5252175 -
ggaaaagtaatcaggtttag

SEQ ID NO: 45790 - DNA, 20 bp, Artificial Sequence
  Synthetic oligonucleotide; GAG chr11 5252170 5252189 5252173 -
aaaagtaatcaggtttagag

SEQ ID NO: 45791 - DNA, 20 bp, Artificial Sequence
  Synthetic oligonucleotide; GAG chr11 5252162 5252181 5252165 -
tcaggtttagaggagctcat

SEQ ID NO: 45792 - DNA, 20 bp, Artificial Sequence
  Synthetic oligonucleotide; GAG chr11 5252160 5252179 5252163 -
aggtttagaggagctcatga

SEQ ID NO: 45793 - DNA, 20 bp, Artificial Sequence
  Synthetic oligonucleotide; CAG chr11 5252157 5252176 5252160 -
tttagaggagctcatgagag

SEQ ID NO: 45794 - DNA, 20 bp, Artificial Sequence
  Synthetic oligonucleotide; TAG chr11 5252144 5252163 5252147 -
atgagagcagatccccatca

SEQ ID NO: 45795 - DNA, 20 bp, Artificial Sequence
  Synthetic oligonucleotide; CAG chr11 5252126 5252145 5252129 -
catagaattattttcctcat

SEQ ID NO: 45796 - DNA, 20 bp, Artificial Sequence
  Synthetic oligonucleotide; AAG chr11 5252123 5252142 5252126 -
agaattattttcctcatcag

SEQ ID NO: 45797 - DNA, 20 bp, Artificial Sequence
  Synthetic oligonucleotide; CAG chr11 5252120 5252139 5252123 -
attattttcctcatcagaag

SEQ ID NO: 45798 - DNA, 20 bp, Artificial Sequence
  Synthetic oligonucleotide; GAG chr11 5252118 5252137 5252121 -
tattttcctcatcagaagca

SEQ ID NO: 45799 - DNA, 20 bp, Artificial Sequence
  Synthetic oligonucleotide; GAG chr11 5252116 5252135 5252119 -
ttttcctcatcagaagcaga

SEQ ID NO: 45800 - DNA, 20 bp, Artificial Sequence
  Synthetic oligonucleotide; TAG chr11 5252111 5252130 5252114 -
ctcatcagaagcagagagat

SEQ ID NO: 45801 - DNA, 20 bp, Artificial Sequence
  Synthetic oligonucleotide; TGG chr11 5252092 5252111 5252095 -
ttagccatttctcttccttc

SEQ ID NO: 45802 - DNA, 20 bp, Artificial Sequence
  Synthetic oligonucleotide; GAG chr11 5252088 5252107 5252091 -
ccatttctcttccttctggt

SEQ ID NO: 45803 - DNA, 20 bp, Artificial Sequence
  Synthetic oligonucleotide; AGG chr11 5252087 5252106 5252090 -
catttctcttccttctggtg

SEQ ID NO: 45804 - DNA, 20 bp, Artificial Sequence
  Synthetic oligonucleotide; CAG chr11 5252081 5252100 5252084 -
tcttccttctggtgaggaca

SEQ ID NO: 45805 - DNA, 20 bp, Artificial Sequence
  Synthetic oligonucleotide; TGG chr11 5252078 5252097 5252081 -
tccttctggtgaggacacag

SEQ ID NO: 45806 - DNA, 20 bp, Artificial Sequence
  Synthetic oligonucleotide; GGG chr11 5252077 5252096 5252080 -
ccttctggtgaggacacagt

SEQ ID NO: 45807 - DNA, 20 bp, Artificial Sequence
  Synthetic oligonucleotide; AAG chr11 5252074 5252093 5252077 -
tctggtgaggacacagtggg

SEQ ID NO: 45808 - DNA, 20 bp, Artificial Sequence
  Synthetic oligonucleotide; CAG chr11 5252070 5252089 5252073 -
gtgaggacacagtgggaagt

SEQ ID NO: 45809 - DNA, 20 bp, Artificial Sequence
  Synthetic oligonucleotide; CAG chr11 5252055 5252074 5252058 -
gaagtcagccacctgcaacc

SEQ ID NO: 45810 - DNA, 20 bp, Artificial Sequence
  Synthetic oligonucleotide; AGG chr11 5252054 5252073 5252057 -
aagtcagccacctgcaaccc

SEQ ID NO: 45811 - DNA, 20 bp, Artificial Sequence
  Synthetic oligonucleotide; AAG chr11 5252051 5252070 5252054 -
tcagccacctgcaacccagg

SEQ ID NO: 45812 - DNA, 20 bp, Artificial Sequence
  Synthetic oligonucleotide; GAG chr11 5252049 5252068 5252052 -
agccacctgcaacccaggaa

SEQ ID NO: 45813 - DNA, 20 bp, Artificial Sequence
  Synthetic oligonucleotide; GAG chr11 5252047 5252066 5252050 -
ccacctgcaacccaggaaga

SEQ ID NO: 45814 - DNA, 20 bp, Artificial Sequence
  Synthetic oligonucleotide; CAG chr11 5252037 5252056 5252040 -
cccaggaagagagccctgac

SEQ ID NO: 45815 - DNA, 20 bp, Artificial Sequence
  Synthetic oligonucleotide; AGG chr11 5252036 5252055 5252039 -
ccaggaagagagccctgacc

SEQ ID NO: 45816 - DNA, 20 bp, Artificial Sequence
  Synthetic oligonucleotide; CAG chr11 5252030 5252049 5252033 -
agagagccctgaccaggaac

SEQ ID NO: 45817 - DNA, 20 bp, Artificial Sequence
  Synthetic oligonucleotide; CAG chr11 5252027 5252046 5252030 -
gagccctgaccaggaaccag

SEQ ID NO: 45818 - DNA, 20 bp, Artificial Sequence
  Synthetic oligonucleotide; AAG chr11 5252022 5252041 5252025 -
ctgaccaggaaccagcagaa

SEQ ID NO: 45819 - DNA, 20 bp, Artificial Sequence
  Synthetic oligonucleotide; GAG chr11 5252018 5252037 5252021 -
ccaggaaccagcagaaaagt

SEQ ID NO: 45820 - DNA, 20 bp, Artificial Sequence
  Synthetic oligonucleotide; AAG chr11 5251998 5252017 5252001 -
gagaaaaaatcctgttgttg

SEQ ID NO: 45821 - DNA, 20 bp, Artificial Sequence
  Synthetic oligonucleotide; CAG chr11 5251990 5252009 5251993 -
atcctgttgttgaagtcacc

SEQ ID NO: 45822 - DNA, 20 bp, Artificial Sequence
  Synthetic oligonucleotide; TAG chr11 5251970 5251989 5251973 -
cagtctatgctattttgtta

SEQ ID NO: 45823 - DNA, 20 bp, Artificial Sequence
  Synthetic oligonucleotide; AAG chr11 5251956 5251975 5251959 -
ttgttatagcaccttgcact

SEQ ID NO: 45824 - DNA, 20 bp, Artificial Sequence
  Synthetic oligonucleotide; AAG chr11 5251952 5251971 5251955 -
tatagcaccttgcactaagt

SEQ ID NO: 45825 - DNA, 20 bp, Artificial Sequence
  Synthetic oligonucleotide; AGG chr11 5251951 5251970 5251954 -
atagcaccttgcactaagta

SEQ ID NO: 45826 - DNA, 20 bp, Artificial Sequence
  Synthetic oligonucleotide; CAG chr11 5251948 5251967 5251951 -
gcaccttgcactaagtaagg

SEQ ID NO: 45827 - DNA, 20 bp, Artificial Sequence
  Synthetic oligonucleotide; AAG chr11 5251942 5251961 5251945 -
tgcactaagtaaggcagatg

SEQ ID NO: 45828 - DNA, 20 bp, Artificial Sequence
  Synthetic oligonucleotide; AAG chr11 5251938 5251957 5251941 -
ctaagtaaggcagatgaaga

SEQ ID NO: 45829 - DNA, 20 bp, Artificial Sequence
  Synthetic oligonucleotide; GAG chr11 5251936 5251955 5251939 -
aagtaaggcagatgaagaaa

SEQ ID NO: 45830 - DNA, 20 bp, Artificial Sequence
  Synthetic oligonucleotide; AAG chr11 5251925 5251944 5251928 -
atgaagaaagagaaaaaaat

SEQ ID NO: 45831 - DNA, 20 bp, Artificial Sequence
  Synthetic oligonucleotide; CGG chr11 5251919 5251938 5251922 -
aaagagaaaaaaataagctt

SEQ ID NO: 45832 - DNA, 20 bp, Artificial Sequence
  Synthetic oligonucleotide; CAG chr11 5251912 5251931 5251915 -
aaaaaataagcttcggtgtt

SEQ ID NO: 45833 - DNA, 20 bp, Artificial Sequence
  Synthetic oligonucleotide; TGG chr11 5251909 5251928 5251912 -
aaataagcttcggtgttcag

SEQ ID NO: 45834 - DNA, 20 bp, Artificial Sequence
  Synthetic oligonucleotide; TAG chr11 5251904 5251923 5251907 -
agcttcggtgttcagtggat

SEQ ID NO: 45835 - DNA, 20 bp, Artificial Sequence
  Synthetic oligonucleotide; CAG chr11 5251886 5251905 5251889 -
attagaaaccatgtttatct

SEQ ID NO: 45836 - DNA, 20 bp, Artificial Sequence
  Synthetic oligonucleotide; AGG chr11 5251885 5251904 5251888 -
ttagaaaccatgtttatctc

SEQ ID NO: 45837 - DNA, 20 bp, Artificial Sequence
  Synthetic oligonucleotide; CAG chr11 5251852 5251871 5251855 -
tccacttgtcctctgtgttt

SEQ ID NO: 45838 - DNA, 20 bp, Artificial Sequence
  Synthetic oligonucleotide; AAG chr11 5251817 5251836 5251820 -
actctactactctcatctgt

SEQ ID NO: 45839 - DNA, 20 bp, Artificial Sequence
  Synthetic oligonucleotide; TAG chr11 5251807 5251826 5251810 -
tctcatctgtaagatgcaaa

SEQ ID NO: 45840 - DNA, 20 bp, Artificial Sequence
  Synthetic oligonucleotide; AAG chr11 5251803 5251822 5251806 -
atctgtaagatgcaaatagt

SEQ ID NO: 45841 - DNA, 20 bp, Artificial Sequence
  Synthetic oligonucleotide; GAG chr11 5251797 5251816 5251800 -
aagatgcaaatagtaagcct

SEQ ID NO: 45842 - DNA, 20 bp, Artificial Sequence
  Synthetic oligonucleotide; TAG chr11 5251750 5251769 5251753 -
attttttcttcaacgtactt

SEQ ID NO: 45843 - DNA, 20 bp, Artificial Sequence
  Synthetic oligonucleotide; AGG chr11 5251749 5251768 5251752 -
ttttttcttcaacgtacttt

SEQ ID NO: 45844 - DNA, 20 bp, Artificial Sequence
  Synthetic oligonucleotide; CAG chr11 5251727 5251746 5251730 -
gcttgtaatgtgtttatata

SEQ ID NO: 45845 - DNA, 20 bp, Artificial Sequence
  Synthetic oligonucleotide; AAG chr11 5251715 5251734 5251718 -
tttatatacagtgaaatgtc

SEQ ID NO: 45846 - DNA, 20 bp, Artificial Sequence
  Synthetic oligonucleotide; CAG chr11 5251676 5251695 5251679 -
ctttctttcttttttttcct

SEQ ID NO: 45847 - DNA, 20 bp, Artificial Sequence
  Synthetic oligonucleotide; CAG chr11 5251670 5251689 5251673 -
ttcttttttttcctcagcct

SEQ ID NO: 45848 - DNA, 20 bp, Artificial Sequence
  Synthetic oligonucleotide; GAG chr11 5251668 5251687 5251671 -
cttttttttcctcagcctca

SEQ ID NO: 45849 - DNA, 20 bp, Artificial Sequence
  Synthetic oligonucleotide; CAG chr11 5251641 5251660 5251644 -
ccacatgcccttcctacttt

SEQ ID NO: 45850 - DNA, 20 bp, Artificial Sequence
  Synthetic oligonucleotide; AGG chr11 5251640 5251659 5251643 -
cacatgcccttcctactttc

SEQ ID NO: 45851 - DNA, 20 bp, Artificial Sequence
  Synthetic oligonucleotide; TGG chr11 5251610 5251629 5251613 -
ttctccaaacgtcttctgcc

SEQ ID NO: 45852 - DNA, 20 bp, Artificial Sequence
  Synthetic oligonucleotide; AAG chr11 5251592 5251611 5251595 -
cctggctccatcaaatcata

SEQ ID NO: 45853 - DNA, 20 bp, Artificial Sequence
  Synthetic oligonucleotide; AGG chr11 5251591 5251610 5251594 -
ctggctccatcaaatcataa

SEQ ID NO: 45854 - DNA, 20 bp, Artificial Sequence
  Synthetic oligonucleotide; TAG chr11 5251518 5251537 5251521 -
ttctttgtcctttttttttt

SEQ ID NO: 45855 - DNA, 20 bp, Artificial Sequence
  Synthetic oligonucleotide; AAG chr11 5251509 5251528 5251512 -
ctttttttttttagtaaaac

SEQ ID NO: 45856 - DNA, 20 bp, Artificial Sequence
  Synthetic oligonucleotide; AAG chr11 5251492 5251511 5251495 -
aacaagtttataaaaaattg

SEQ ID NO: 45857 - DNA, 20 bp, Artificial Sequence
  Synthetic oligonucleotide; AGG chr11 5251491 5251510 5251494 -
acaagtttataaaaaattga

SEQ ID NO: 45858 - DNA, 20 bp, Artificial Sequence
  Synthetic oligonucleotide; TGG chr11 5251478 5251497 5251481 -
aaattgaaggaataaatgaa

SEQ ID NO: 45859 - DNA, 20 bp, Artificial Sequence
  Synthetic oligonucleotide; TAG chr11 5251467 5251486 5251470 -
ataaatgaatggctacttca

SEQ ID NO: 45860 - DNA, 20 bp, Artificial Sequence
  Synthetic oligonucleotide; AGG chr11 5251466 5251485 5251469 -
taaatgaatggctacttcat

SEQ ID NO: 45861 - DNA, 20 bp, Artificial Sequence
  Synthetic oligonucleotide; CAG chr11 5251463 5251482 5251466 -
atgaatggctacttcatagg

SEQ ID NO: 45862 - DNA, 20 bp, Artificial Sequence
  Synthetic oligonucleotide; GAG chr11 5251461 5251480 5251464 -
gaatggctacttcataggca

SEQ ID NO: 45863 - DNA, 20 bp, Artificial Sequence
  Synthetic oligonucleotide; TAG chr11 5251458 5251477 5251461 -
tggctacttcataggcagag

SEQ ID NO: 45864 - DNA, 20 bp, Artificial Sequence
  Synthetic oligonucleotide; AAG chr11 5251451 5251470 5251454 -
ttcataggcagagtagacgc

SEQ ID NO: 45865 - DNA, 20 bp, Artificial Sequence
  Synthetic oligonucleotide; AGG chr11 5251450 5251469 5251453 -
tcataggcagagtagacgca

SEQ ID NO: 45866 - DNA, 20 bp, Artificial Sequence
  Synthetic oligonucleotide; GGG chr11 5251449 5251468 5251452 -
cataggcagagtagacgcaa

SEQ ID NO: 45867 - DNA, 20 bp, Artificial Sequence
  Synthetic oligonucleotide; TGG chr11 5251442 5251461 5251445 -
agagtagacgcaagggctac

SEQ ID NO: 45868 - DNA, 20 bp, Artificial Sequence
  Synthetic oligonucleotide; TAG chr11 5251412 5251431 5251415 -
tttttattgttatttttcaa

SEQ ID NO: 45869 - DNA, 20 bp, Artificial Sequence
  Synthetic oligonucleotide; AAG chr11 5251399 5251418 5251402 -
ttttcaatagtatgctaaac

SEQ ID NO: 45870 - DNA, 20 bp, Artificial Sequence
  Synthetic oligonucleotide; AGG chr11 5251398 5251417 5251401 -
tttcaatagtatgctaaaca

SEQ ID NO: 45871 - DNA, 20 bp, Artificial Sequence
  Synthetic oligonucleotide; GGG chr11 5251397 5251416 5251400 -
ttcaatagtatgctaaacaa

SEQ ID NO: 45872 - DNA, 20 bp, Artificial Sequence
  Synthetic oligonucleotide; GGG chr11 5251396 5251415 5251399 -
tcaatagtatgctaaacaag

SEQ ID NO: 45873 - DNA, 20 bp, Artificial Sequence
  Synthetic oligonucleotide; TAG chr11 5251393 5251412 5251396 -
atagtatgctaaacaagggg

SEQ ID NO: 45874 - DNA, 20 bp, Artificial Sequence
  Synthetic oligonucleotide; TAG chr11 5251369 5251388 5251372 -
ttatttatgctgcccatttt

SEQ ID NO: 45875 - DNA, 20 bp, Artificial Sequence
  Synthetic oligonucleotide; AAG chr11 5251359 5251378 5251362 -
tgcccatttttagaccataa

SEQ ID NO: 45876 - DNA, 20 bp, Artificial Sequence
  Synthetic oligonucleotide; TGG chr11 5251336 5251355 5251339 -
ataacttcctgatgttgcca

SEQ ID NO: 45877 - DNA, 20 bp, Artificial Sequence
  Synthetic oligonucleotide; AAG chr11 5251290 5251309 5251293 -
ttcatttcattttaatttcg

SEQ ID NO: 45878 - DNA, 20 bp, Artificial Sequence
  Synthetic oligonucleotide; AGG chr11 5251289 5251308 5251292 -
tcatttcattttaatttcga

SEQ ID NO: 45879 - DNA, 20 bp, Artificial Sequence
  Synthetic oligonucleotide; CAG chr11 5251278 5251297 5251281 -
taatttcgaaggtacatgtg

SEQ ID NO: 45880 - DNA, 20 bp, Artificial Sequence
  Synthetic oligonucleotide; AGG chr11 5251277 5251296 5251280 -
aatttcgaaggtacatgtgc

SEQ ID NO: 45881 - DNA, 20 bp, Artificial Sequence
  Synthetic oligonucleotide; CAG chr11 5251269 5251288 5251272 -
aggtacatgtgcaggatgtg

SEQ ID NO: 45882 - DNA, 20 bp, Artificial Sequence
  Synthetic oligonucleotide; AGG chr11 5251268 5251287 5251271 -
ggtacatgtgcaggatgtgc

SEQ ID NO: 45883 - DNA, 20 bp, Artificial Sequence
  Synthetic oligonucleotide; TGG chr11 5251256 5251275 5251259 -
ggatgtgcaggcttgttaca

SEQ ID NO: 45884 - DNA, 20 bp, Artificial Sequence
  Synthetic oligonucleotide; GGG chr11 5251255 5251274 5251258 -
gatgtgcaggcttgttacat

SEQ ID NO: 45885 - DNA, 20 bp, Artificial Sequence
  Synthetic oligonucleotide; TGG chr11 5251236 5251255 5251239 -
tgggtaaatgtgtgtctttc

SEQ ID NO: 45886 - DNA, 20 bp, Artificial Sequence
  Synthetic oligonucleotide; TAG chr11 5251228 5251247 5251231 -
tgtgtgtctttctggccttt

SEQ ID NO: 45887 - DNA, 20 bp, Artificial Sequence
  Synthetic oligonucleotide; GAG chr11 5251211 5251230 5251214 -
ttttagccatctgtatcaat

SEQ ID NO: 45888 - DNA, 20 bp, Artificial Sequence
  Synthetic oligonucleotide; CAG chr11 5251208 5251227 5251211 -
tagccatctgtatcaatgag

SEQ ID NO: 45889 - DNA, 20 bp, Artificial Sequence
  Synthetic oligonucleotide; AAG chr11 5251201 5251220 5251204 -
ctgtatcaatgagcagatat

SEQ ID NO: 45890 - DNA, 20 bp, Artificial Sequence
  Synthetic oligonucleotide; CAG chr11 5251191 5251210 5251194 -
gagcagatataagctttaca

SEQ ID NO: 45891 - DNA, 20 bp, Artificial Sequence
  Synthetic oligonucleotide; AGG chr11 5251190 5251209 5251193 -
agcagatataagctttacac

SEQ ID NO: 45892 - DNA, 20 bp, Artificial Sequence
  Synthetic oligonucleotide; AAG chr11 5251181 5251200 5251184 -
aagctttacacaggatcatg

SEQ ID NO: 45893 - DNA, 20 bp, Artificial Sequence
  Synthetic oligonucleotide; AGG chr11 5251180 5251199 5251183 -
agctttacacaggatcatga

SEQ ID NO: 45894 - DNA, 20 bp, Artificial Sequence
  Synthetic oligonucleotide; AAG chr11 5251173 5251192 5251176 -
cacaggatcatgaaggatga

SEQ ID NO: 45895 - DNA, 20 bp, Artificial Sequence
  Synthetic oligonucleotide; TAG chr11 5251133 5251152 5251136 -
aataatttcaatcaacctga

SEQ ID NO: 45896 - DNA, 20 bp, Artificial Sequence
  Synthetic oligonucleotide; TAG chr11 5251128 5251147 5251131 -
tttcaatcaacctgatagct

SEQ ID NO: 45897 - DNA, 20 bp, Artificial Sequence
  Synthetic oligonucleotide; AGG chr11 5251127 5251146 5251130 -
ttcaatcaacctgatagctt

SEQ ID NO: 45898 - DNA, 20 bp, Artificial Sequence
  Synthetic oligonucleotide; GGG chr11 5251126 5251145 5251129 -
tcaatcaacctgatagctta

SEQ ID NO: 45899 - DNA, 20 bp, Artificial Sequence
  Synthetic oligonucleotide; GGG chr11 5251125 5251144 5251128 -
caatcaacctgatagcttag

SEQ ID NO: 45900 - DNA, 20 bp, Artificial Sequence
  Synthetic oligonucleotide; AAG chr11 5251109 5251128 5251112 -
ttaggggataaactaatttg

SEQ ID NO: 45901 - DNA, 20 bp, Artificial Sequence
  Synthetic oligonucleotide; CAG chr11 5251103 5251122 5251106 -
gataaactaatttgaagata

SEQ ID NO: 45902 - DNA, 20 bp, Artificial Sequence
  Synthetic oligonucleotide; AAG chr11 5251088 5251107 5251091 -
agatacagcttgcctccgat

SEQ ID NO: 45903 - DNA, 20 bp, Artificial Sequence
  Synthetic oligonucleotide; CAG chr11 5251084 5251103 5251087 -
acagcttgcctccgataagc

SEQ ID NO: 45904 - DNA, 20 bp, Artificial Sequence
  Synthetic oligonucleotide; CAG chr11 5251076 5251095 5251079 -
cctccgataagccagaattc

SEQ ID NO: 45905 - DNA, 20 bp, Artificial Sequence
  Synthetic oligonucleotide; GAG chr11 5251074 5251093 5251077 -
tccgataagccagaattcca

SEQ ID NO: 45906 - DNA, 20 bp, Artificial Sequence
  Synthetic oligonucleotide; TGG chr11 5251067 5251086 5251070 -
agccagaattccagagcttc

SEQ ID NO: 45907 - DNA, 20 bp, Artificial Sequence
  Synthetic oligonucleotide; TAG chr11 5251054 5251073 5251057 -
gagcttctggcattataatc

SEQ ID NO: 45908 - DNA, 20 bp, Artificial Sequence
  Synthetic oligonucleotide; AAG chr11 5251050 5251069 5251053 -
ttctggcattataatctagc

SEQ ID NO: 45909 - DNA, 20 bp, Artificial Sequence
  Synthetic oligonucleotide; AGG chr11 5251049 5251068 5251052 -
tctggcattataatctagca

SEQ ID NO: 45910 - DNA, 20 bp, Artificial Sequence
  Synthetic oligonucleotide; TAG chr11 5251045 5251064 5251048 -
gcattataatctagcaaggt

SEQ ID NO: 45911 - DNA, 20 bp, Artificial Sequence
  Synthetic oligonucleotide; GAG chr11 5251043 5251062 5251046 -
attataatctagcaaggtta

SEQ ID NO: 45912 - DNA, 20 bp, Artificial Sequence
  Synthetic oligonucleotide; TGG chr11 5251036 5251055 5251039 -
tctagcaaggttagagatca

SEQ ID NO: 45913 - DNA, 20 bp, Artificial Sequence
  Synthetic oligonucleotide; CAG chr11 5251025 5251044 5251028 -
tagagatcatggatcacttt

SEQ ID NO: 45914 - DNA, 20 bp, Artificial Sequence
  Synthetic oligonucleotide; GAG chr11 5251023 5251042 5251026 -
gagatcatggatcactttca

SEQ ID NO: 45915 - DNA, 20 bp, Artificial Sequence
  Synthetic oligonucleotide; AAG chr11 5250997 5251016 5251000 -
aacaaaaacaaactaaccaa

SEQ ID NO: 45916 - DNA, 20 bp, Artificial Sequence
  Synthetic oligonucleotide; CAG chr11 5250989 5251008 5250992 -
caaactaaccaaaagcaaaa

SEQ ID NO: 45917 - DNA, 20 bp, Artificial Sequence
  Synthetic oligonucleotide; TGG chr11 5250948 5250967 5250951 -
aatacttcctaccctgttaa

SEQ ID NO: 45918 - DNA, 20 bp, Artificial Sequence
  Synthetic oligonucleotide; CAG chr11 5250935 5250954 5250938 -
ctgttaatggtccaatatgt

SEQ ID NO: 45919 - DNA, 20 bp, Artificial Sequence
  Synthetic oligonucleotide; CAG chr11 5250929 5250948 5250932 -
atggtccaatatgtcagaaa

SEQ ID NO: 45920 - DNA, 20 bp, Artificial Sequence
  Synthetic oligonucleotide; TAG chr11 5250918 5250937 5250921 -
tgtcagaaacagcactgtgt

SEQ ID NO: 45921 - DNA, 20 bp, Artificial Sequence
  Synthetic oligonucleotide; AAG chr11 5250910 5250929 5250913 -
acagcactgtgttagaaata

SEQ ID NO: 45922 - DNA, 20 bp, Artificial Sequence
  Synthetic oligonucleotide; AAG chr11 5250900 5250919 5250903 -
gttagaaataaagctgtcta

SEQ ID NO: 45923 - DNA, 20 bp, Artificial Sequence
  Synthetic oligonucleotide; GAG chr11 5250884 5250903 5250887 -
tctaaagtacactaatattc

SEQ ID NO: 45924 - DNA, 20 bp, Artificial Sequence
  Synthetic oligonucleotide; TAG chr11 5250875 5250894 5250878 -
cactaatattcgagttataa

SEQ ID NO: 45925 - DNA, 20 bp, Artificial Sequence
  Synthetic oligonucleotide; TGG chr11 5250868 5250887 5250871 -
attcgagttataatagtgtg

SEQ ID NO: 45926 - DNA, 20 bp, Artificial Sequence
  Synthetic oligonucleotide; TAG chr11 5250860 5250879 5250863 -
tataatagtgtgtggactat

SEQ ID NO: 45927 - DNA, 20 bp, Artificial Sequence
  Synthetic oligonucleotide; TAG chr11 5250832 5250851 5250835 -
aaaaacaacccttgcctctt

SEQ ID NO: 45928 - DNA, 20 bp, Artificial Sequence
  Synthetic oligonucleotide; GAG chr11 5250830 5250849 5250833 -
aaacaacccttgcctcttta

SEQ ID NO: 45929 - DNA, 20 bp, Artificial Sequence
  Synthetic oligonucleotide; TAG chr11 5250795 5250814 5250798 -
tacacgcacatcttatgtct

SEQ ID NO: 45930 - DNA, 20 bp, Artificial Sequence
  Synthetic oligonucleotide; GAG chr11 5250793 5250812 5250796 -
cacgcacatcttatgtctta

SEQ ID NO: 45931 - DNA, 20 bp, Artificial Sequence
  Synthetic oligonucleotide; AAG chr11 5250789 5250808 5250792 -
cacatcttatgtcttagagt

SEQ ID NO: 45932 - DNA, 20 bp, Artificial Sequence
  Synthetic oligonucleotide; GAG chr11 5250779 5250798 5250782 -
gtcttagagtaagattccct

SEQ ID NO: 45933 - DNA, 20 bp, Artificial Sequence
  Synthetic oligonucleotide; AAG chr11 5250776 5250795 5250779 -
ttagagtaagattccctgag

SEQ ID NO: 45934 - DNA, 20 bp, Artificial Sequence
  Synthetic oligonucleotide; TAG chr11 5250767 5250786 5250770 -
gattccctgagaagtgaacc

SEQ ID NO: 45935 - DNA, 20 bp, Artificial Sequence
  Synthetic oligonucleotide; AAG chr11 5250755 5250774 5250758 -
agtgaacctagcatttatac

SEQ ID NO: 45936 - DNA, 20 bp, Artificial Sequence
  Synthetic oligonucleotide; CAG chr11 5250734 5250753 5250737 -
agataattaattctaatcca

SEQ ID NO: 45937 - DNA, 20 bp, Artificial Sequence
  Synthetic oligonucleotide; AAG chr11 5250722 5250741 5250725 -
ctaatccacagtacctgcca

SEQ ID NO: 45938 - DNA, 20 bp, Artificial Sequence
  Synthetic oligonucleotide; GAG chr11 5250696 5250715 5250699 -
attctaccatcatctttact

SEQ ID NO: 45939 - DNA, 20 bp, Artificial Sequence
  Synthetic oligonucleotide; TAG chr11 5250691 5250710 5250694 -
accatcatctttactgagca

SEQ ID NO: 45940 - DNA, 20 bp, Artificial Sequence
  Synthetic oligonucleotide; AAG chr11 5250688 5250707 5250691 -
atcatctttactgagcatag

SEQ ID NO: 45941 - DNA, 20 bp, Artificial Sequence
  Synthetic oligonucleotide; GAG chr11 5250686 5250705 5250689 -
catctttactgagcatagaa

SEQ ID NO: 45942 - DNA, 20 bp, Artificial Sequence
  Synthetic oligonucleotide; TGG chr11 5250669 5250688 5250672 -
gaagagctacgccaaaaccc

SEQ ID NO: 45943 - DNA, 20 bp, Artificial Sequence
  Synthetic oligonucleotide; GGG chr11 5250668 5250687 5250671 -
aagagctacgccaaaaccct

SEQ ID NO: 45944 - DNA, 20 bp, Artificial Sequence
  Synthetic oligonucleotide; CAG chr11 5250661 5250680 5250664 -
acgccaaaaccctgggtcat

SEQ ID NO: 45945 - DNA, 20 bp, Artificial Sequence
  Synthetic oligonucleotide; CAG chr11 5250657 5250676 5250660 -
caaaaccctgggtcatcagc

SEQ ID NO: 45946 - DNA, 20 bp, Artificial Sequence
  Synthetic oligonucleotide; CAG chr11 5250640 5250659 5250643 -
agccagcacacacacttatc

SEQ ID NO: 45947 - DNA, 20 bp, Artificial Sequence
  Synthetic oligonucleotide; TGG chr11 5250637 5250656 5250640 -
cagcacacacacttatccag

SEQ ID NO: 45948 - DNA, 20 bp, Artificial Sequence
  Synthetic oligonucleotide; TGG chr11 5250619 5250638 5250622 -
agtggtaaatacacatcatc

SEQ ID NO: 45949 - DNA, 20 bp, Artificial Sequence
  Synthetic oligonucleotide; TGG chr11 5250594 5250613 5250597 -
tatacatacatacctgaata

SEQ ID NO: 45950 - DNA, 20 bp, Artificial Sequence
  Synthetic oligonucleotide; AAG chr11 5250575 5250594 5250578 -
atggaatcaaatatttttct

SEQ ID NO: 45951 - DNA, 20 bp, Artificial Sequence
  Synthetic oligonucleotide; CAG chr11 5250566 5250585 5250569 -
aatatttttctaagatgaaa

SEQ ID NO: 45952 - DNA, 20 bp, Artificial Sequence
  Synthetic oligonucleotide; TAG chr11 5250546 5250565 5250549 -
cagtcatgatttatttcaaa

SEQ ID NO: 45953 - DNA, 20 bp, Artificial Sequence
  Synthetic oligonucleotide; AGG chr11 5250545 5250564 5250548 -
agtcatgatttatttcaaat

SEQ ID NO: 45954 - DNA, 20 bp, Artificial Sequence
  Synthetic oligonucleotide; CGG chr11 5250540 5250559 5250543 -
tgatttatttcaaataggta

SEQ ID NO: 45955 - DNA, 20 bp, Artificial Sequence
  Synthetic oligonucleotide; AAG chr11 5250535 5250554 5250538 -
tatttcaaataggtacggat

SEQ ID NO: 45956 - DNA, 20 bp, Artificial Sequence
  Synthetic oligonucleotide; TAG chr11 5250532 5250551 5250535 -
ttcaaataggtacggataag

SEQ ID NO: 45957 - DNA, 20 bp, Artificial Sequence
  Synthetic oligonucleotide; GAG chr11 5250524 5250543 5250527 -
ggtacggataagtagatatt

SEQ ID NO: 45958 - DNA, 20 bp, Artificial Sequence
  Synthetic oligonucleotide; AGG chr11 5250523 5250542 5250526 -
gtacggataagtagatattg

SEQ ID NO: 45959 - DNA, 20 bp, Artificial Sequence
  Synthetic oligonucleotide; AAG chr11 5250519 5250538 5250522 -
ggataagtagatattgaggt

SEQ ID NO: 45960 - DNA, 20 bp, Artificial Sequence
  Synthetic oligonucleotide; TAG chr11 5250513 5250532 5250516 -
gtagatattgaggtaagcat

SEQ ID NO: 45961 - DNA, 20 bp, Artificial Sequence
  Synthetic oligonucleotide; AGG chr11 5250512 5250531 5250515 -
tagatattgaggtaagcatt

SEQ ID NO: 45962 - DNA, 20 bp, Artificial Sequence
  Synthetic oligonucleotide; TGG chr11 5250467 5250486 5250470 -
ctattactgcgctgaaactg

SEQ ID NO: 45963 - DNA, 20 bp, Artificial Sequence
  Synthetic oligonucleotide; TAG chr11 5250459 5250478 5250462 -
gcgctgaaactgtggcttta

SEQ ID NO: 45964 - DNA, 20 bp, Artificial Sequence
  Synthetic oligonucleotide; GAG chr11 5250434 5250453 5250437 -
attgttttcactgcactatt

SEQ ID NO: 45965 - DNA, 20 bp, Artificial Sequence
  Synthetic oligonucleotide; AAG chr11 5250426 5250445 5250429 -
cactgcactattgagaaatt

SEQ ID NO: 45966 - DNA, 20 bp, Artificial Sequence
  Synthetic oligonucleotide; GAG chr11 5250424 5250443 5250427 -
ctgcactattgagaaattaa

SEQ ID NO: 45967 - DNA, 20 bp, Artificial Sequence
  Synthetic oligonucleotide; TGG chr11 5250417 5250436 5250420 -
attgagaaattaagagataa

SEQ ID NO: 45968 - DNA, 20 bp, Artificial Sequence
  Synthetic oligonucleotide; AAG chr11 5250411 5250430 5250414 -
aaattaagagataatggcaa

SEQ ID NO: 45969 - DNA, 20 bp, Artificial Sequence
  Synthetic oligonucleotide; AAG chr11 5250403 5250422 5250406 -
agataatggcaaaagtcaca

SEQ ID NO: 45970 - DNA, 20 bp, Artificial Sequence
  Synthetic oligonucleotide; GAG chr11 5250401 5250420 5250404 -
ataatggcaaaagtcacaaa

SEQ ID NO: 45971 - DNA, 20 bp, Artificial Sequence
  Synthetic oligonucleotide; AAG chr11 5250388 5250407 5250391 -
tcacaaagagtatattcaaa

SEQ ID NO: 45972 - DNA, 20 bp, Artificial Sequence
  Synthetic oligonucleotide; AAG chr11 5250385 5250404 5250388 -
caaagagtatattcaaaaag

SEQ ID NO: 45973 - DNA, 20 bp, Artificial Sequence
  Synthetic oligonucleotide; TAG chr11 5250380 5250399 5250383 -
agtatattcaaaaagaagta

SEQ ID NO: 45974 - DNA, 20 bp, Artificial Sequence
  Synthetic oligonucleotide; TAG chr11 5250366 5250385 5250369 -
gaagtatagcactttttcct

SEQ ID NO: 45975 - DNA, 20 bp, Artificial Sequence
  Synthetic oligonucleotide; AAG chr11 5250346 5250365 5250349 -
tagaaaccactgctaactga

SEQ ID NO: 45976 - DNA, 20 bp, Artificial Sequence
  Synthetic oligonucleotide; GAG chr11 5250344 5250363 5250347 -
gaaaccactgctaactgaaa

SEQ ID NO: 45977 - DNA, 20 bp, Artificial Sequence
  Synthetic oligonucleotide; AAG chr11 5250338 5250357 5250341 -
actgctaactgaaagagact

SEQ ID NO: 45978 - DNA, 20 bp, Artificial Sequence
  Synthetic oligonucleotide; TGG chr11 5250315 5250334 5250318 -
atttgtcccgtcaaaaatcc

SEQ ID NO: 45979 - DNA, 20 bp, Artificial Sequence
  Synthetic oligonucleotide; TGG chr11 5250266 5250285 5250269 -
tccctgaacttttcaaaaat

SEQ ID NO: 45980 - DNA, 20 bp, Artificial Sequence
  Synthetic oligonucleotide; TAG chr11 5250254 5250273 5250257 -
tcaaaaattggtacatgctt

SEQ ID NO: 45981 - DNA, 20 bp, Artificial Sequence
  Synthetic oligonucleotide; CAG chr11 5250241 5250260 5250244 -
catgctttagctttaaacta

SEQ ID NO: 45982 - DNA, 20 bp, Artificial Sequence
  Synthetic oligonucleotide; AGG chr11 5250240 5250259 5250243 -
atgctttagctttaaactac

SEQ ID NO: 45983 - DNA, 20 bp, Artificial Sequence
  Synthetic oligonucleotide; TGG chr11 5250231 5250250 5250234 -
ctttaaactacaggcctcac

SEQ ID NO: 45984 - DNA, 20 bp, Artificial Sequence
  Synthetic oligonucleotide; GAG chr11 5250229 5250248 5250232 -
ttaaactacaggcctcactg

SEQ ID NO: 45985 - DNA, 20 bp, Artificial Sequence
  Synthetic oligonucleotide; TAG chr11 5250225 5250244 5250228 -
actacaggcctcactggagc

SEQ ID NO: 45986 - DNA, 20 bp, Artificial Sequence
  Synthetic oligonucleotide; GAG chr11 5250223 5250242 5250226 -
tacaggcctcactggagcta

SEQ ID NO: 45987 - DNA, 20 bp, Artificial Sequence
  Synthetic oligonucleotide; AAG chr11 5250218 5250237 5250221 -
gcctcactggagctagagac

SEQ ID NO: 45988 - DNA, 20 bp, Artificial Sequence
  Synthetic oligonucleotide; AAG chr11 5250215 5250234 5250218 -
tcactggagctagagacaag

SEQ ID NO: 45989 - DNA, 20 bp, Artificial Sequence
  Synthetic oligonucleotide; AGG chr11 5250214 5250233 5250217 -
cactggagctagagacaaga

SEQ ID NO: 45990 - DNA, 20 bp, Artificial Sequence
  Synthetic oligonucleotide; CGG chr11 5250204 5250223 5250207 -
agagacaagaaggtaaaaaa

SEQ ID NO: 45991 - DNA, 20 bp, Artificial Sequence
  Synthetic oligonucleotide; AAG chr11 5250194 5250213 5250197 -
aggtaaaaaacggctgacaa

SEQ ID NO: 45992 - DNA, 20 bp, Artificial Sequence
  Synthetic oligonucleotide; AAG chr11 5250191 5250210 5250194 -
taaaaaacggctgacaaaag

SEQ ID NO: 45993 - DNA, 20 bp, Artificial Sequence
  Synthetic oligonucleotide; TGG chr11 5250185 5250204 5250188 -
acggctgacaaaagaagtcc

SEQ ID NO: 45994 - DNA, 20 bp, Artificial Sequence
  Synthetic oligonucleotide; TGG chr11 5250170 5250189 5250173 -
agtcctggtatcctctatga

SEQ ID NO: 45995 - DNA, 20 bp, Artificial Sequence
  Synthetic oligonucleotide; GGG chr11 5250169 5250188 5250172 -
gtcctggtatcctctatgat

SEQ ID NO: 45996 - DNA, 20 bp, Artificial Sequence
  Synthetic oligonucleotide; GAG chr11 5250167 5250186 5250170 -
cctggtatcctctatgatgg

SEQ ID NO: 45997 - DNA, 20 bp, Artificial Sequence
  Synthetic oligonucleotide; AAG chr11 5250164 5250183 5250167 -
ggtatcctctatgatgggag

SEQ ID NO: 45998 - DNA, 20 bp, Artificial Sequence
  Synthetic oligonucleotide; AGG chr11 5250163 5250182 5250166 -
gtatcctctatgatgggaga

SEQ ID NO: 45999 - DNA, 20 bp, Artificial Sequence
  Synthetic oligonucleotide; TAG chr11 5250156 5250175 5250159 -
ctatgatgggagaaggaaac

SEQ ID NO: 46000 - DNA, 20 bp, Artificial Sequence
  Synthetic oligonucleotide; AAG chr11 5250150 5250169 5250153 -
tgggagaaggaaactagcta

SEQ ID NO: 46001 - DNA, 20 bp, Artificial Sequence
  Synthetic oligonucleotide; AGG chr11 5250149 5250168 5250152 -
gggagaaggaaactagctaa

SEQ ID NO: 46002 - DNA, 20 bp, Artificial Sequence
  Synthetic oligonucleotide; GGG chr11 5250148 5250167 5250151 -
ggagaaggaaactagctaaa

SEQ ID NO: 46003 - DNA, 20 bp, Artificial Sequence
  Synthetic oligonucleotide; AAG chr11 5250145 5250164 5250148 -
gaaggaaactagctaaaggg

SEQ ID NO: 46004 - DNA, 20 bp, Artificial Sequence
  Synthetic oligonucleotide; TAG chr11 5250135 5250154 5250138 -
agctaaagggaagaataaat

SEQ ID NO: 46005 - DNA, 20 bp, Artificial Sequence
  Synthetic oligonucleotide; GAG chr11 5250133 5250152 5250136 -
ctaaagggaagaataaatta

SEQ ID NO: 46006 - DNA, 20 bp, Artificial Sequence
  Synthetic oligonucleotide; TGG chr11 5250124 5250143 5250127 -
agaataaattagagaaaaac

SEQ ID NO: 46007 - DNA, 20 bp, Artificial Sequence
  Synthetic oligonucleotide; CGG chr11 5250110 5250129 5250113 -
aaaaactggaatgactgaat

SEQ ID NO: 46008 - DNA, 20 bp, Artificial Sequence
  Synthetic oligonucleotide; AAG chr11 5250104 5250123 5250107 -
tggaatgactgaatcggaac

SEQ ID NO: 46009 - DNA, 20 bp, Artificial Sequence
  Synthetic oligonucleotide; AGG chr11 5250103 5250122 5250106 -
ggaatgactgaatcggaaca

SEQ ID NO: 46010 - DNA, 20 bp, Artificial Sequence
  Synthetic oligonucleotide; AAG chr11 5250098 5250117 5250101 -
gactgaatcggaacaaggca

SEQ ID NO: 46011 - DNA, 20 bp, Artificial Sequence
  Synthetic oligonucleotide; AGG chr11 5250097 5250116 5250100 -
actgaatcggaacaaggcaa

SEQ ID NO: 46012 - DNA, 20 bp, Artificial Sequence
  Synthetic oligonucleotide; TAG chr11 5250081 5250100 5250084 -
gcaaaggctataaaaaaaat

SEQ ID NO: 46013 - DNA, 20 bp, Artificial Sequence
  Synthetic oligonucleotide; CAG chr11 5250078 5250097 5250081 -
aaggctataaaaaaaattag

SEQ ID NO: 46014 - DNA, 20 bp, Artificial Sequence
  Synthetic oligonucleotide; TGG chr11 5250067 5250086 5250070 -
aaaaattagcagtatcctct

SEQ ID NO: 46015 - DNA, 20 bp, Artificial Sequence
  Synthetic oligonucleotide; GGG chr11 5250066 5250085 5250069 -
aaaattagcagtatcctctt

SEQ ID NO: 46016 - DNA, 20 bp, Artificial Sequence
  Synthetic oligonucleotide; GGG chr11 5250065 5250084 5250068 -
aaattagcagtatcctcttg

SEQ ID NO: 46017 - DNA, 20 bp, Artificial Sequence
  Synthetic oligonucleotide; GGG chr11 5250064 5250083 5250067 -
aattagcagtatcctcttgg

SEQ ID NO: 46018 - DNA, 20 bp, Artificial Sequence
  Synthetic oligonucleotide; CGG chr11 5250020 5250039 5250023 -
atgcaaatatctgtctgaaa

SEQ ID NO: 46019 - DNA, 20 bp, Artificial Sequence
  Synthetic oligonucleotide; TGG chr11 5250013 5250032 5250016 -
tatctgtctgaaacggtccc

SEQ ID NO: 46020 - DNA, 20 bp, Artificial Sequence
  Synthetic oligonucleotide; TGG chr11 5249996 5250015 5249999 -
ccctggctaaactccaccca

SEQ ID NO: 46021 - DNA, 20 bp, Artificial Sequence
  Synthetic oligonucleotide; GGG chr11 5249995 5250014 5249998 -
cctggctaaactccacccat

SEQ ID NO: 46022 - DNA, 20 bp, Artificial Sequence
  Synthetic oligonucleotide; TGG chr11 5249991 5250010 5249994 -
gctaaactccacccatgggt

SEQ ID NO: 46023 - DNA, 20 bp, Artificial Sequence
  Synthetic oligonucleotide; CAG chr11 5249987 5250006 5249990 -
aactccacccatgggttggc

SEQ ID NO: 46024 - DNA, 20 bp, Artificial Sequence
  Synthetic oligonucleotide; TAG chr11 5249969 5249988 5249972 -
gccagccttgccttgaccaa

SEQ ID NO: 46025 - DNA, 20 bp, Artificial Sequence
  Synthetic oligonucleotide; AAG chr11 5249959 5249978 5249962 -
ccttgaccaatagccttgac

SEQ ID NO: 46026 - DNA, 20 bp, Artificial Sequence
  Synthetic oligonucleotide; AGG chr11 5249958 5249977 5249961 -
cttgaccaatagccttgaca

SEQ ID NO: 46027 - DNA, 20 bp, Artificial Sequence
  Synthetic oligonucleotide; TAG chr11 5249942 5249961 5249945 -
gacaaggcaaacttgaccaa

SEQ ID NO: 46028 - DNA, 20 bp, Artificial Sequence
  Synthetic oligonucleotide; TAG chr11 5249936 5249955 5249939 -
gcaaacttgaccaatagtct

SEQ ID NO: 46029 - DNA, 20 bp, Artificial Sequence
  Synthetic oligonucleotide; GAG chr11 5249934 5249953 5249937 -
aaacttgaccaatagtctta

SEQ ID NO: 46030 - DNA, 20 bp, Artificial Sequence
  Synthetic oligonucleotide; CAG chr11 5249927 5249946 5249930 -
accaatagtcttagagtatc

SEQ ID NO: 46031 - DNA, 20 bp, Artificial Sequence
  Synthetic oligonucleotide; GAG chr11 5249923 5249942 5249926 -
atagtcttagagtatccagt

SEQ ID NO: 46032 - DNA, 20 bp, Artificial Sequence
  Synthetic oligonucleotide; AGG chr11 5249922 5249941 5249925 -
tagtcttagagtatccagtg

SEQ ID NO: 46033 - DNA, 20 bp, Artificial Sequence
  Synthetic oligonucleotide; CAG chr11 5249918 5249937 5249921 -
cttagagtatccagtgaggc

SEQ ID NO: 46034 - DNA, 20 bp, Artificial Sequence
  Synthetic oligonucleotide; AGG chr11 5249917 5249936 5249920 -
ttagagtatccagtgaggcc

SEQ ID NO: 46035 - DNA, 20 bp, Artificial Sequence
  Synthetic oligonucleotide; GGG chr11 5249916 5249935 5249919 -
tagagtatccagtgaggcca

SEQ ID NO: 46036 - DNA, 20 bp, Artificial Sequence
  Synthetic oligonucleotide; GGG chr11 5249915 5249934 5249918 -
agagtatccagtgaggccag

SEQ ID NO: 46037 - DNA, 20 bp, Artificial Sequence
  Synthetic oligonucleotide; CGG chr11 5249911 5249930 5249914 -
tatccagtgaggccaggggc

SEQ ID NO: 46038 - DNA, 20 bp, Artificial Sequence
  Synthetic oligonucleotide; CGG chr11 5249908 5249927 5249911 -
ccagtgaggccaggggccgg

SEQ ID NO: 46039 - DNA, 20 bp, Artificial Sequence
  Synthetic oligonucleotide; TGG chr11 5249904 5249923 5249907 -
tgaggccaggggccggcggc

SEQ ID NO: 46040 - DNA, 20 bp, Artificial Sequence
  Synthetic oligonucleotide; TAG chr11 5249900 5249919 5249903 -
gccaggggccggcggctggc

SEQ ID NO: 46041 - DNA, 20 bp, Artificial Sequence
  Synthetic oligonucleotide; AGG chr11 5249899 5249918 5249902 -
ccaggggccggcggctggct

SEQ ID NO: 46042 - DNA, 20 bp, Artificial Sequence
  Synthetic oligonucleotide; GGG chr11 5249898 5249917 5249901 -
caggggccggcggctggcta

SEQ ID NO: 46043 - DNA, 20 bp, Artificial Sequence
  Synthetic oligonucleotide; AAG chr11 5249892 5249911 5249895 -
ccggcggctggctagggatg

SEQ ID NO: 46044 - DNA, 20 bp, Artificial Sequence
  Synthetic oligonucleotide; AAG chr11 5249884 5249903 5249887 -
tggctagggatgaagaataa

SEQ ID NO: 46045 - DNA, 20 bp, Artificial Sequence
  Synthetic oligonucleotide; AGG chr11 5249883 5249902 5249886 -
ggctagggatgaagaataaa

SEQ ID NO: 46046 - DNA, 20 bp, Artificial Sequence
  Synthetic oligonucleotide; AAG chr11 5249880 5249899 5249883 -
tagggatgaagaataaaagg

SEQ ID NO: 46047 - DNA, 20 bp, Artificial Sequence
  Synthetic oligonucleotide; CAG chr11 5249870 5249889 5249873 -
gaataaaaggaagcaccctt

SEQ ID NO: 46048 - DNA, 20 bp, Artificial Sequence
  Synthetic oligonucleotide; CAG chr11 5249867 5249886 5249870 -
taaaaggaagcacccttcag

SEQ ID NO: 46049 - DNA, 20 bp, Artificial Sequence
  Synthetic oligonucleotide; TGG chr11 5249847 5249866 5249850 -
cagttccacacactcgcttc

SEQ ID NO: 46050 - DNA, 20 bp, Artificial Sequence
  Synthetic oligonucleotide; GAG chr11 5249837 5249856 5249840 -
cactcgcttctggaacgtct

SEQ ID NO: 46051 - DNA, 20 bp, Artificial Sequence
  Synthetic oligonucleotide; AGG chr11 5249836 5249855 5249839 -
actcgcttctggaacgtctg

SEQ ID NO: 46052 - DNA, 20 bp, Artificial Sequence
  Synthetic oligonucleotide; AAG chr11 5249825 5249844 5249828 -
gaacgtctgaggttatcaat

SEQ ID NO: 46053 - DNA, 20 bp, Artificial Sequence
  Synthetic oligonucleotide; TAG chr11 5249818 5249837 5249821 -
tgaggttatcaataagctcc

SEQ ID NO: 46054 - DNA, 20 bp, Artificial Sequence
  Synthetic oligonucleotide; CAG chr11 5249813 5249832 5249816 -
ttatcaataagctcctagtc

SEQ ID NO: 46055 - DNA, 20 bp, Artificial Sequence
  Synthetic oligonucleotide; TGG chr11 5249804 5249823 5249807 -
agctcctagtccagacgcca

SEQ ID NO: 46056 - DNA, 20 bp, Artificial Sequence
  Synthetic oligonucleotide; GGG chr11 5249803 5249822 5249806 -
gctcctagtccagacgccat

SEQ ID NO: 46057 - DNA, 20 bp, Artificial Sequence
  Synthetic oligonucleotide; CAG chr11 5249792 5249811 5249795 -
agacgccatgggtcatttca

SEQ ID NO: 46058 - DNA, 20 bp, Artificial Sequence
  Synthetic oligonucleotide; GAG chr11 5249790 5249809 5249793 -
acgccatgggtcatttcaca

SEQ ID NO: 46059 - DNA, 20 bp, Artificial Sequence
  Synthetic oligonucleotide; AGG chr11 5249789 5249808 5249792 -
cgccatgggtcatttcacag

SEQ ID NO: 46060 - DNA, 20 bp, Artificial Sequence
  Synthetic oligonucleotide; GAG chr11 5249787 5249806 5249790 -
ccatgggtcatttcacagag

SEQ ID NO: 46061 - DNA, 20 bp, Artificial Sequence
  Synthetic oligonucleotide; AGG chr11 5249786 5249805 5249789 -
catgggtcatttcacagagg

SEQ ID NO: 46062 - DNA, 20 bp, Artificial Sequence
  Synthetic oligonucleotide; AAG chr11 5249781 5249800 5249784 -
gtcatttcacagaggaggac

SEQ ID NO: 46063 - DNA, 20 bp, Artificial Sequence
  Synthetic oligonucleotide; AGG chr11 5249780 5249799 5249783 -
tcatttcacagaggaggaca

SEQ ID NO: 46064 - DNA, 20 bp, Artificial Sequence
  Synthetic oligonucleotide; AAG chr11 5249767 5249786 5249770 -
gaggacaaggctactatcac

SEQ ID NO: 46065 - DNA, 20 bp, Artificial Sequence
  Synthetic oligonucleotide; TGG chr11 5249760 5249779 5249763 -
aggctactatcacaagcctg

SEQ ID NO: 46066 - DNA, 20 bp, Artificial Sequence
  Synthetic oligonucleotide; GGG chr11 5249759 5249778 5249762 -
ggctactatcacaagcctgt

SEQ ID NO: 46067 - DNA, 20 bp, Artificial Sequence
  Synthetic oligonucleotide; GGG chr11 5249758 5249777 5249761 -
gctactatcacaagcctgtg

SEQ ID NO: 46068 - DNA, 20 bp, Artificial Sequence
  Synthetic oligonucleotide; AAG chr11 5249754 5249773 5249757 -
ctatcacaagcctgtggggc

SEQ ID NO: 46069 - DNA, 20 bp, Artificial Sequence
  Synthetic oligonucleotide; AGG chr11 5249753 5249772 5249756 -
tatcacaagcctgtggggca

SEQ ID NO: 46070 - DNA, 20 bp, Artificial Sequence
  Synthetic oligonucleotide; TGG chr11 5249744 5249763 5249747 -
cctgtggggcaaggtgaatg

SEQ ID NO: 46071 - DNA, 20 bp, Artificial Sequence
  Synthetic oligonucleotide; AAG chr11 5249741 5249760 5249744 -
gtggggcaaggtgaatgtgg

SEQ ID NO: 46072 - DNA, 20 bp, Artificial Sequence
  Synthetic oligonucleotide; TGG chr11 5249734 5249753 5249737 -
aaggtgaatgtggaagatgc

SEQ ID NO: 46073 - DNA, 20 bp, Artificial Sequence
  Synthetic oligonucleotide; GAG chr11 5249732 5249751 5249735 -
ggtgaatgtggaagatgctg

SEQ ID NO: 46074 - DNA, 20 bp, Artificial Sequence
  Synthetic oligonucleotide; AGG chr11 5249731 5249750 5249734 -
gtgaatgtggaagatgctgg

SEQ ID NO: 46075 - DNA, 20 bp, Artificial Sequence
  Synthetic oligonucleotide; GAG chr11 5249729 5249748 5249732 -
gaatgtggaagatgctggag

SEQ ID NO: 46076 - DNA, 20 bp, Artificial Sequence
  Synthetic oligonucleotide; TGG chr11 5249720 5249739 5249723 -
agatgctggaggagaaaccc

SEQ ID NO: 46077 - DNA, 20 bp, Artificial Sequence
  Synthetic oligonucleotide; GGG chr11 5249719 5249738 5249722 -
gatgctggaggagaaaccct

SEQ ID NO: 46078 - DNA, 20 bp, Artificial Sequence
  Synthetic oligonucleotide; AAG chr11 5249716 5249735 5249719 -
gctggaggagaaaccctggg

SEQ ID NO: 46079 - DNA, 20 bp, Artificial Sequence
  Synthetic oligonucleotide; AGG chr11 5249715 5249734 5249718 -
ctggaggagaaaccctggga

SEQ ID NO: 46080 - DNA, 20 bp, Artificial Sequence
  Synthetic oligonucleotide; TAG chr11 5249712 5249731 5249715 -
gaggagaaaccctgggaagg

SEQ ID NO: 46081 - DNA, 20 bp, Artificial Sequence
  Synthetic oligonucleotide; AGG chr11 5249711 5249730 5249714 -
aggagaaaccctgggaaggt

SEQ ID NO: 46082 - DNA, 20 bp, Artificial Sequence
  Synthetic oligonucleotide; TGG chr11 5249705 5249724 5249708 -
aaccctgggaaggtaggctc

SEQ ID NO: 46083 - DNA, 20 bp, Artificial Sequence
  Synthetic oligonucleotide; CAG chr11 5249698 5249717 5249701 -
ggaaggtaggctctggtgac

SEQ ID NO: 46084 - DNA, 20 bp, Artificial Sequence
  Synthetic oligonucleotide; AGG chr11 5249697 5249716 5249700 -
gaaggtaggctctggtgacc

SEQ ID NO: 46085 - DNA, 20 bp, Artificial Sequence
  Synthetic oligonucleotide; AAG chr11 5249692 5249711 5249695 -
taggctctggtgaccaggac

SEQ ID NO: 46086 - DNA, 20 bp, Artificial Sequence
  Synthetic oligonucleotide; AGG chr11 5249691 5249710 5249694 -
aggctctggtgaccaggaca

SEQ ID NO: 46087 - DNA, 20 bp, Artificial Sequence
  Synthetic oligonucleotide; GGG chr11 5249690 5249709 5249693 -
ggctctggtgaccaggacaa

SEQ ID NO: 46088 - DNA, 20 bp, Artificial Sequence
  Synthetic oligonucleotide; GAG chr11 5249688 5249707 5249691 -
ctctggtgaccaggacaagg

SEQ ID NO: 46089 - DNA, 20 bp, Artificial Sequence
  Synthetic oligonucleotide; AGG chr11 5249687 5249706 5249690 -
tctggtgaccaggacaaggg

SEQ ID NO: 46090 - DNA, 20 bp, Artificial Sequence
  Synthetic oligonucleotide; GGG chr11 5249686 5249705 5249689 -
ctggtgaccaggacaaggga

SEQ ID NO: 46091 - DNA, 20 bp, Artificial Sequence
  Synthetic oligonucleotide; AAG chr11 5249683 5249702 5249686 -
gtgaccaggacaagggaggg

SEQ ID NO: 46092 - DNA, 20 bp, Artificial Sequence
  Synthetic oligonucleotide; AGG chr11 5249682 5249701 5249685 -
tgaccaggacaagggaggga

SEQ ID NO: 46093 - DNA, 20 bp, Artificial Sequence
  Synthetic oligonucleotide; AAG chr11 5249679 5249698 5249682 -
ccaggacaagggagggaagg

SEQ ID NO: 46094 - DNA, 20 bp, Artificial Sequence
  Synthetic oligonucleotide; AGG chr11 5249678 5249697 5249681 -
caggacaagggagggaagga

SEQ ID NO: 46095 - DNA, 20 bp, Artificial Sequence
  Synthetic oligonucleotide; TGG chr11 5249665 5249684 5249668 -
ggaaggaaggaccctgtgcc

SEQ ID NO: 46096 - DNA, 20 bp, Artificial Sequence
  Synthetic oligonucleotide; AAG chr11 5249659 5249678 5249662 -
aaggaccctgtgcctggcaa

SEQ ID NO: 46097 - DNA, 20 bp, Artificial Sequence
  Synthetic oligonucleotide; CAG chr11 5249654 5249673 5249657 -
ccctgtgcctggcaaaagtc

SEQ ID NO: 46098 - DNA, 20 bp, Artificial Sequence
  Synthetic oligonucleotide; AGG chr11 5249653 5249672 5249656 -
cctgtgcctggcaaaagtcc

SEQ ID NO: 46099 - DNA, 20 bp, Artificial Sequence
  Synthetic oligonucleotide; CAG chr11 5249642 5249661 5249645 -
caaaagtccaggtcgcttct

SEQ ID NO: 46100 - DNA, 20 bp, Artificial Sequence
  Synthetic oligonucleotide; AGG chr11 5249641 5249660 5249644 -
aaaagtccaggtcgcttctc

SEQ ID NO: 46101 - DNA, 20 bp, Artificial Sequence
  Synthetic oligonucleotide; TGG chr11 5249633 5249652 5249636 -
aggtcgcttctcaggatttg

SEQ ID NO: 46102 - DNA, 20 bp, Artificial Sequence
  Synthetic oligonucleotide; CAG chr11 5249594 5249613 5249597 -
aactgttcttgtcaatctca

SEQ ID NO: 46103 - DNA, 20 bp, Artificial Sequence
  Synthetic oligonucleotide; AGG chr11 5249593 5249612 5249596 -
actgttcttgtcaatctcac

SEQ ID NO: 46104 - DNA, 20 bp, Artificial Sequence
  Synthetic oligonucleotide; TGG chr11 5249586 5249605 5249589 -
ttgtcaatctcacaggctcc

SEQ ID NO: 46105 - DNA, 20 bp, Artificial Sequence
  Synthetic oligonucleotide; TGG chr11 5249572 5249591 5249575 -
ggctcctggttgtctaccca

SEQ ID NO: 46106 - DNA, 20 bp, Artificial Sequence
  Synthetic oligonucleotide; CAG chr11 5249566 5249585 5249569 -
tggttgtctacccatggacc

SEQ ID NO: 46107 - DNA, 20 bp, Artificial Sequence
  Synthetic oligonucleotide; GAG chr11 5249564 5249583 5249567 -
gttgtctacccatggaccca

SEQ ID NO: 46108 - DNA, 20 bp, Artificial Sequence
  Synthetic oligonucleotide; AGG chr11 5249563 5249582 5249566 -
ttgtctacccatggacccag

SEQ ID NO: 46109 - DNA, 20 bp, Artificial Sequence
  Synthetic oligonucleotide; CAG chr11 5249552 5249571 5249555 -
tggacccagaggttctttga

SEQ ID NO: 46110 - DNA, 20 bp, Artificial Sequence
  Synthetic oligonucleotide; TGG chr11 5249546 5249565 5249549 -
cagaggttctttgacagctt

SEQ ID NO: 46111 - DNA, 20 bp, Artificial Sequence
  Synthetic oligonucleotide; TGG chr11 5249517 5249536 5249520 -
gtcctctgcctctgccatca

SEQ ID NO: 46112 - DNA, 20 bp, Artificial Sequence
  Synthetic oligonucleotide; GGG chr11 5249516 5249535 5249519 -
tcctctgcctctgccatcat

SEQ ID NO: 46113 - DNA, 20 bp, Artificial Sequence
  Synthetic oligonucleotide; AAG chr11 5249505 5249524 5249508 -
tgccatcatgggcaacccca

SEQ ID NO: 46114 - DNA, 20 bp, Artificial Sequence
  Synthetic oligonucleotide; AAG chr11 5249500 5249519 5249503 -
tcatgggcaaccccaaagtc

SEQ ID NO: 46115 - DNA, 20 bp, Artificial Sequence
  Synthetic oligonucleotide; AGG chr11 5249499 5249518 5249502 -
catgggcaaccccaaagtca

SEQ ID NO: 46116 - DNA, 20 bp, Artificial Sequence
  Synthetic oligonucleotide; TGG chr11 5249492 5249511 5249495 -
aaccccaaagtcaaggcaca

SEQ ID NO: 46117 - DNA, 20 bp, Artificial Sequence
  Synthetic oligonucleotide; AAG chr11 5249488 5249507 5249491 -
ccaaagtcaaggcacatggc

SEQ ID NO: 46118 - DNA, 20 bp, Artificial Sequence
  Synthetic oligonucleotide; AAG chr11 5249485 5249504 5249488 -
aagtcaaggcacatggcaag

SEQ ID NO: 46119 - DNA, 20 bp, Artificial Sequence
  Synthetic oligonucleotide; AGG chr11 5249484 5249503 5249487 -
agtcaaggcacatggcaaga

SEQ ID NO: 46120 - DNA, 20 bp, Artificial Sequence
  Synthetic oligonucleotide; TGG chr11 5249469 5249488 5249472 -
caagaaggtgctgacttcct

SEQ ID NO: 46121 - DNA, 20 bp, Artificial Sequence
  Synthetic oligonucleotide; GGG chr11 5249468 5249487 5249471 -
aagaaggtgctgacttcctt

SEQ ID NO: 46122 - DNA, 20 bp, Artificial Sequence
  Synthetic oligonucleotide; GAG chr11 5249466 5249485 5249469 -
gaaggtgctgacttccttgg

SEQ ID NO: 46123 - DNA, 20 bp, Artificial Sequence
  Synthetic oligonucleotide; AAG chr11 5249455 5249474 5249458 -
cttccttgggagatgccaca

SEQ ID NO: 46124 - DNA, 20 bp, Artificial Sequence
  Synthetic oligonucleotide; TGG chr11 5249448 5249467 5249451 -
gggagatgccacaaagcacc

SEQ ID NO: 46125 - DNA, 20 bp, Artificial Sequence
  Synthetic oligonucleotide; AAG chr11 5249437 5249456 5249440 -
caaagcacctggatgatctc

SEQ ID NO: 46126 - DNA, 20 bp, Artificial Sequence
  Synthetic oligonucleotide; AGG chr11 5249436 5249455 5249439 -
aaagcacctggatgatctca

SEQ ID NO: 46127 - DNA, 20 bp, Artificial Sequence
  Synthetic oligonucleotide; GGG chr11 5249435 5249454 5249438 -
aagcacctggatgatctcaa

SEQ ID NO: 46128 - DNA, 20 bp, Artificial Sequence
  Synthetic oligonucleotide; CAG chr11 5249422 5249441 5249425 -
atctcaagggcacctttgcc

SEQ ID NO: 46129 - DNA, 20 bp, Artificial Sequence
  Synthetic oligonucleotide; GAG chr11 5249417 5249436 5249420 -
aagggcacctttgcccagct

SEQ ID NO: 46130 - DNA, 20 bp, Artificial Sequence
  Synthetic oligonucleotide; AAG chr11 5249398 5249417 5249401 -
tgagtgaactgcactgtgac

SEQ ID NO: 46131 - DNA, 20 bp, Artificial Sequence
  Synthetic oligonucleotide; TGG chr11 5249388 5249407 5249391 -
gcactgtgacaagctgcatg

SEQ ID NO: 46132 - DNA, 20 bp, Artificial Sequence
  Synthetic oligonucleotide; GAG chr11 5249380 5249399 5249383 -
acaagctgcatgtggatcct

SEQ ID NO: 46133 - DNA, 20 bp, Artificial Sequence
  Synthetic oligonucleotide; AAG chr11 5249371 5249390 5249374 -
atgtggatcctgagaacttc

SEQ ID NO: 46134 - DNA, 20 bp, Artificial Sequence
  Synthetic oligonucleotide; AGG chr11 5249370 5249389 5249373 -
tgtggatcctgagaacttca

SEQ ID NO: 46135 - DNA, 20 bp, Artificial Sequence
  Synthetic oligonucleotide; GAG chr11 5249366 5249385 5249369 -
gatcctgagaacttcaaggt

SEQ ID NO: 46136 - DNA, 20 bp, Artificial Sequence
  Synthetic oligonucleotide; CAG chr11 5249361 5249380 5249364 -
tgagaacttcaaggtgagtc

SEQ ID NO: 46137 - DNA, 20 bp, Artificial Sequence
  Synthetic oligonucleotide; AGG chr11 5249360 5249379 5249363 -
gagaacttcaaggtgagtcc

SEQ ID NO: 46138 - DNA, 20 bp, Artificial Sequence
  Synthetic oligonucleotide; GAG chr11 5249358 5249377 5249361 -
gaacttcaaggtgagtccag

SEQ ID NO: 46139 - DNA, 20 bp, Artificial Sequence
  Synthetic oligonucleotide; CAG chr11 5249349 5249368 5249352 -
ggtgagtccaggagatgttt

SEQ ID NO: 46140 - DNA, 20 bp, Artificial Sequence
  Synthetic oligonucleotide; TAG chr11 5249334 5249353 5249337 -
tgtttcagccctgttgcctt

SEQ ID NO: 46141 - DNA, 20 bp, Artificial Sequence
  Synthetic oligonucleotide; GAG chr11 5249327 5249346 5249330 -
gccctgttgcctttagtctc

SEQ ID NO: 46142 - DNA, 20 bp, Artificial Sequence
  Synthetic oligonucleotide; AGG chr11 5249326 5249345 5249329 -
ccctgttgcctttagtctcg

SEQ ID NO: 46143 - DNA, 20 bp, Artificial Sequence
  Synthetic oligonucleotide; TAG chr11 5249318 5249337 5249321 -
cctttagtctcgaggcaact

SEQ ID NO: 46144 - DNA, 20 bp, Artificial Sequence
  Synthetic oligonucleotide; CGG chr11 5249311 5249330 5249314 -
tctcgaggcaacttagacaa

SEQ ID NO: 46145 - DNA, 20 bp, Artificial Sequence
  Synthetic oligonucleotide; GAG chr11 5249309 5249328 5249312 -
tcgaggcaacttagacaacg

SEQ ID NO: 46146 - DNA, 20 bp, Artificial Sequence
  Synthetic oligonucleotide; GAG chr11 5249297 5249316 5249300 -
agacaacggagtattgatct

SEQ ID NO: 46147 - DNA, 20 bp, Artificial Sequence
  Synthetic oligonucleotide; CAG chr11 5249292 5249311 5249295 -
acggagtattgatctgagca

SEQ ID NO: 46148 - DNA, 20 bp, Artificial Sequence
  Synthetic oligonucleotide; CAG chr11 5249289 5249308 5249292 -
gagtattgatctgagcacag

SEQ ID NO: 46149 - DNA, 20 bp, Artificial Sequence
  Synthetic oligonucleotide; AGG chr11 5249288 5249307 5249291 -
agtattgatctgagcacagc

SEQ ID NO: 46150 - DNA, 20 bp, Artificial Sequence
  Synthetic oligonucleotide; GGG chr11 5249287 5249306 5249290 -
gtattgatctgagcacagca

SEQ ID NO: 46151 - DNA, 20 bp, Artificial Sequence
  Synthetic oligonucleotide; GAG chr11 5249281 5249300 5249284 -
atctgagcacagcagggtgt

SEQ ID NO: 46152 - DNA, 20 bp, Artificial Sequence
  Synthetic oligonucleotide; AAG chr11 5249271 5249290 5249274 -
agcagggtgtgagctgtttg

SEQ ID NO: 46153 - DNA, 20 bp, Artificial Sequence
  Synthetic oligonucleotide; TGG chr11 5249264 5249283 5249267 -
tgtgagctgtttgaagatac

SEQ ID NO: 46154 - DNA, 20 bp, Artificial Sequence
  Synthetic oligonucleotide; GGG chr11 5249263 5249282 5249266 -
gtgagctgtttgaagatact

SEQ ID NO: 46155 - DNA, 20 bp, Artificial Sequence
  Synthetic oligonucleotide; GGG chr11 5249262 5249281 5249265 -
tgagctgtttgaagatactg

SEQ ID NO: 46156 - DNA, 20 bp, Artificial Sequence
  Synthetic oligonucleotide; TGG chr11 5249258 5249277 5249261 -
ctgtttgaagatactggggt

SEQ ID NO: 46157 - DNA, 20 bp, Artificial Sequence
  Synthetic oligonucleotide; GGG chr11 5249257 5249276 5249260 -
tgtttgaagatactggggtt

SEQ ID NO: 46158 - DNA, 20 bp, Artificial Sequence
  Synthetic oligonucleotide; GGG chr11 5249256 5249275 5249259 -
gtttgaagatactggggttg

SEQ ID NO: 46159 - DNA, 20 bp, Artificial Sequence
  Synthetic oligonucleotide; GGG chr11 5249255 5249274 5249258 -
tttgaagatactggggttgg

SEQ ID NO: 46160 - DNA, 20 bp, Artificial Sequence
  Synthetic oligonucleotide; AAG chr11 5249250 5249269 5249253 -
agatactggggttgggggtg

SEQ ID NO: 46161 - DNA, 20 bp, Artificial Sequence
  Synthetic oligonucleotide; CAG chr11 5249241 5249260 5249244 -
ggttgggggtgaagaaactg

SEQ ID NO: 46162 - DNA, 20 bp, Artificial Sequence
  Synthetic oligonucleotide; GAG chr11 5249239 5249258 5249242 -
ttgggggtgaagaaactgca

SEQ ID NO: 46163 - DNA, 20 bp, Artificial Sequence
  Synthetic oligonucleotide; AGG chr11 5249238 5249257 5249241 -
tgggggtgaagaaactgcag

SEQ ID NO: 46164 - DNA, 20 bp, Artificial Sequence
  Synthetic oligonucleotide; TGG chr11 5249229 5249248 5249232 -
agaaactgcagaggactaac

SEQ ID NO: 46165 - DNA, 20 bp, Artificial Sequence
  Synthetic oligonucleotide; GGG chr11 5249228 5249247 5249231 -
gaaactgcagaggactaact

SEQ ID NO: 46166 - DNA, 20 bp, Artificial Sequence
  Synthetic oligonucleotide; GAG chr11 5249223 5249242 5249226 -
tgcagaggactaactgggct

SEQ ID NO: 46167 - DNA, 20 bp, Artificial Sequence
  Synthetic oligonucleotide; CAG chr11 5249217 5249236 5249220 -
ggactaactgggctgagacc

SEQ ID NO: 46168 - DNA, 20 bp, Artificial Sequence
  Synthetic oligonucleotide; TGG chr11 5249214 5249233 5249217 -
ctaactgggctgagacccag

SEQ ID NO: 46169 - DNA, 20 bp, Artificial Sequence
  Synthetic oligonucleotide; TAG chr11 5249203 5249222 5249206 -
gagacccagtggtaatgttt

SEQ ID NO: 46170 - DNA, 20 bp, Artificial Sequence
  Synthetic oligonucleotide; AGG chr11 5249202 5249221 5249205 -
agacccagtggtaatgtttt

SEQ ID NO: 46171 - DNA, 20 bp, Artificial Sequence
  Synthetic oligonucleotide; GGG chr11 5249201 5249220 5249204 -
gacccagtggtaatgtttta

SEQ ID NO: 46172 - DNA, 20 bp, Artificial Sequence
  Synthetic oligonucleotide; AAG chr11 5249195 5249214 5249198 -
gtggtaatgttttagggcct

SEQ ID NO: 46173 - DNA, 20 bp, Artificial Sequence
  Synthetic oligonucleotide; AGG chr11 5249194 5249213 5249197 -
tggtaatgttttagggccta

SEQ ID NO: 46174 - DNA, 20 bp, Artificial Sequence
  Synthetic oligonucleotide; GAG chr11 5249192 5249211 5249195 -
gtaatgttttagggcctaag

SEQ ID NO: 46175 - DNA, 20 bp, Artificial Sequence
  Synthetic oligonucleotide; TAG chr11 5249175 5249194 5249178 -
aaggagtgcctctaaaaatc

SEQ ID NO: 46176 - DNA, 20 bp, Artificial Sequence
  Synthetic oligonucleotide; TGG chr11 5249171 5249190 5249174 -
agtgcctctaaaaatctaga

SEQ ID NO: 46177 - DNA, 20 bp, Artificial Sequence
  Synthetic oligonucleotide; GAG chr11 5249154 5249173 5249157 -
agatggacaattttgacttt

SEQ ID NO: 46178 - DNA, 20 bp, Artificial Sequence
  Synthetic oligonucleotide; AAG chr11 5249149 5249168 5249152 -
gacaattttgactttgagaa

SEQ ID NO: 46179 - DNA, 20 bp, Artificial Sequence
  Synthetic oligonucleotide; GAG chr11 5249147 5249166 5249150 -
caattttgactttgagaaaa

SEQ ID NO: 46180 - DNA, 20 bp, Artificial Sequence
  Synthetic oligonucleotide; GAG chr11 5249145 5249164 5249148 -
attttgactttgagaaaaga

SEQ ID NO: 46181 - DNA, 20 bp, Artificial Sequence
  Synthetic oligonucleotide; AGG chr11 5249144 5249163 5249147 -
ttttgactttgagaaaagag

SEQ ID NO: 46182 - DNA, 20 bp, Artificial Sequence
  Synthetic oligonucleotide; TGG chr11 5249141 5249160 5249144 -
tgactttgagaaaagagagg

SEQ ID NO: 46183 - DNA, 20 bp, Artificial Sequence
  Synthetic oligonucleotide; GAG chr11 5249134 5249153 5249137 -
gagaaaagagaggtggaaat

SEQ ID NO: 46184 - DNA, 20 bp, Artificial Sequence
  Synthetic oligonucleotide; AGG chr11 5249133 5249152 5249136 -
agaaaagagaggtggaaatg

SEQ ID NO: 46185 - DNA, 20 bp, Artificial Sequence
  Synthetic oligonucleotide; TAG chr11 5249112 5249131 5249115 -
ggaaaatgacttttctttat

SEQ ID NO: 46186 - DNA, 20 bp, Artificial Sequence
  Synthetic oligonucleotide; CAG chr11 5249105 5249124 5249108 -
gacttttctttattagattc

SEQ ID NO: 46187 - DNA, 20 bp, Artificial Sequence
  Synthetic oligonucleotide; TAG chr11 5249102 5249121 5249105 -
ttttctttattagattccag

SEQ ID NO: 46188 - DNA, 20 bp, Artificial Sequence
  Synthetic oligonucleotide; AAG chr11 5249098 5249117 5249101 -
ctttattagattccagtaga

SEQ ID NO: 46189 - DNA, 20 bp, Artificial Sequence
  Synthetic oligonucleotide; TGG chr11 5249051 5249070 5249054 -
gttgttttaaaacatctatc

SEQ ID NO: 46190 - DNA, 20 bp, Artificial Sequence
  Synthetic oligonucleotide; GAG chr11 5249049 5249068 5249052 -
tgttttaaaacatctatctg

SEQ ID NO: 46191 - DNA, 20 bp, Artificial Sequence
  Synthetic oligonucleotide; AGG chr11 5249048 5249067 5249051 -
gttttaaaacatctatctgg

SEQ ID NO: 46192 - DNA, 20 bp, Artificial Sequence
  Synthetic oligonucleotide; CAG chr11 5249045 5249064 5249048 -
ttaaaacatctatctggagg

SEQ ID NO: 46193 - DNA, 20 bp, Artificial Sequence
  Synthetic oligonucleotide; AGG chr11 5249044 5249063 5249047 -
taaaacatctatctggaggc

SEQ ID NO: 46194 - DNA, 20 bp, Artificial Sequence
  Synthetic oligonucleotide; AAG chr11 5249039 5249058 5249042 -
catctatctggaggcaggac

SEQ ID NO: 46195 - DNA, 20 bp, Artificial Sequence
  Synthetic oligonucleotide; TGG chr11 5249034 5249053 5249037 -
atctggaggcaggacaagta

SEQ ID NO: 46196 - DNA, 20 bp, Artificial Sequence
  Synthetic oligonucleotide; AAG chr11 5249023 5249042 5249026 -
ggacaagtatggtcgttaaa

SEQ ID NO: 46197 - DNA, 20 bp, Artificial Sequence
  Synthetic oligonucleotide; CAG chr11 5249017 5249036 5249020 -
gtatggtcgttaaaaagatg

SEQ ID NO: 46198 - DNA, 20 bp, Artificial Sequence
  Synthetic oligonucleotide; AGG chr11 5249016 5249035 5249019 -
tatggtcgttaaaaagatgc

SEQ ID NO: 46199 - DNA, 20 bp, Artificial Sequence
  Synthetic oligonucleotide; CAG chr11 5249013 5249032 5249016 -
ggtcgttaaaaagatgcagg

SEQ ID NO: 46200 - DNA, 20 bp, Artificial Sequence
  Synthetic oligonucleotide; AAG chr11 5249010 5249029 5249013 -
cgttaaaaagatgcaggcag

SEQ ID NO: 46201 - DNA, 20 bp, Artificial Sequence
  Synthetic oligonucleotide; AGG chr11 5249009 5249028 5249012 -
gttaaaaagatgcaggcaga

SEQ ID NO: 46202 - DNA, 20 bp, Artificial Sequence
  Synthetic oligonucleotide; TGG chr11 5248999 5249018 5249002 -
tgcaggcagaaggcatatat

SEQ ID NO: 46203 - DNA, 20 bp, Artificial Sequence
  Synthetic oligonucleotide; CAG chr11 5248994 5249013 5248997 -
gcagaaggcatatattggct

SEQ ID NO: 46204 - DNA, 20 bp, Artificial Sequence
  Synthetic oligonucleotide; AAG chr11 5248988 5249007 5248991 -
ggcatatattggctcagtca

SEQ ID NO: 46205 - DNA, 20 bp, Artificial Sequence
  Synthetic oligonucleotide; TGG chr11 5248985 5249004 5248988 -
atatattggctcagtcaaag

SEQ ID NO: 46206 - DNA, 20 bp, Artificial Sequence
  Synthetic oligonucleotide; GGG chr11 5248984 5249003 5248987 -
tatattggctcagtcaaagt

SEQ ID NO: 46207 - DNA, 20 bp, Artificial Sequence
  Synthetic oligonucleotide; GGG chr11 5248983 5249002 5248986 -
atattggctcagtcaaagtg

SEQ ID NO: 46208 - DNA, 20 bp, Artificial Sequence
  Synthetic oligonucleotide; TGG chr11 5248975 5248994 5248978 -
tcagtcaaagtggggaactt

SEQ ID NO: 46209 - DNA, 20 bp, Artificial Sequence
  Synthetic oligonucleotide; TGG chr11 5248972 5248991 5248975 -
gtcaaagtggggaactttgg

SEQ ID NO: 46210 - DNA, 20 bp, Artificial Sequence
  Synthetic oligonucleotide; AAG chr11 5248953 5248972 5248956 -
gtggccaaacatacattgct

SEQ ID NO: 46211 - DNA, 20 bp, Artificial Sequence
  Synthetic oligonucleotide; AGG chr11 5248952 5248971 5248955 -
tggccaaacatacattgcta

SEQ ID NO: 46212 - DNA, 20 bp, Artificial Sequence
  Synthetic oligonucleotide; CAG chr11 5248937 5248956 5248940 -
tgctaaggctattcctatat

SEQ ID NO: 46213 - DNA, 20 bp, Artificial Sequence
  Synthetic oligonucleotide; TGG chr11 5248933 5248952 5248936 -
aaggctattcctatatcagc

SEQ ID NO: 46214 - DNA, 20 bp, Artificial Sequence
  Synthetic oligonucleotide; CAG chr11 5248878 5248897 5248881 -
aaacttatatcctttaattc

SEQ ID NO: 46215 - DNA, 20 bp, Artificial Sequence
  Synthetic oligonucleotide; TGG chr11 5248874 5248893 5248877 -
ttatatcctttaattccaga

SEQ ID NO: 46216 - DNA, 20 bp, Artificial Sequence
  Synthetic oligonucleotide; GGG chr11 5248873 5248892 5248876 -
tatatcctttaattccagat

SEQ ID NO: 46217 - DNA, 20 bp, Artificial Sequence
  Synthetic oligonucleotide; GGG chr11 5248872 5248891 5248875 -
atatcctttaattccagatg

SEQ ID NO: 46218 - DNA, 20 bp, Artificial Sequence
  Synthetic oligonucleotide; GGG chr11 5248871 5248890 5248874 -
tatcctttaattccagatgg

SEQ ID NO: 46219 - DNA, 20 bp, Artificial Sequence
  Synthetic oligonucleotide; AAG chr11 5248866 5248885 5248869 -
tttaattccagatgggggca

SEQ ID NO: 46220 - DNA, 20 bp, Artificial Sequence
  Synthetic oligonucleotide; CAG chr11 5248857 5248876 5248860 -
agatgggggcaaagtatgtc

SEQ ID NO: 46221 - DNA, 20 bp, Artificial Sequence
  Synthetic oligonucleotide; AGG chr11 5248856 5248875 5248859 -
gatgggggcaaagtatgtcc

SEQ ID NO: 46222 - DNA, 20 bp, Artificial Sequence
  Synthetic oligonucleotide; GGG chr11 5248855 5248874 5248858 -
atgggggcaaagtatgtcca

SEQ ID NO: 46223 - DNA, 20 bp, Artificial Sequence
  Synthetic oligonucleotide; GGG chr11 5248854 5248873 5248857 -
tgggggcaaagtatgtccag

SEQ ID NO: 46224 - DNA, 20 bp, Artificial Sequence
  Synthetic oligonucleotide; GAG chr11 5248850 5248869 5248853 -
ggcaaagtatgtccaggggt

SEQ ID NO: 46225 - DNA, 20 bp, Artificial Sequence
  Synthetic oligonucleotide; AGG chr11 5248849 5248868 5248852 -
gcaaagtatgtccaggggtg

SEQ ID NO: 46226 - DNA, 20 bp, Artificial Sequence
  Synthetic oligonucleotide; TGG chr11 5248831 5248850 5248834 -
tgaggaacaattgaaacatt

SEQ ID NO: 46227 - DNA, 20 bp, Artificial Sequence
  Synthetic oligonucleotide; GGG chr11 5248830 5248849 5248833 -
gaggaacaattgaaacattt

SEQ ID NO: 46228 - DNA, 20 bp, Artificial Sequence
  Synthetic oligonucleotide; TGG chr11 5248826 5248845 5248829 -
aacaattgaaacatttgggc

SEQ ID NO: 46229 - DNA, 20 bp, Artificial Sequence
  Synthetic oligonucleotide; GAG chr11 5248824 5248843 5248827 -
caattgaaacatttgggctg

SEQ ID NO: 46230 - DNA, 20 bp, Artificial Sequence
  Synthetic oligonucleotide; TAG chr11 5248821 5248840 5248824 -
ttgaaacatttgggctggag

SEQ ID NO: 46231 - DNA, 20 bp, Artificial Sequence
  Synthetic oligonucleotide; AAG chr11 5248811 5248830 5248814 -
tgggctggagtagattttga

SEQ ID NO: 46232 - DNA, 20 bp, Artificial Sequence
  Synthetic oligonucleotide; CAG chr11 5248807 5248826 5248810 -
ctggagtagattttgaaagt

SEQ ID NO: 46233 - DNA, 20 bp, Artificial Sequence
  Synthetic oligonucleotide; CAG chr11 5248756 5248775 5248759 -
gcgcgtgtgtgtgtgtgtgt

SEQ ID NO: 46234 - DNA, 20 bp, Artificial Sequence
  Synthetic oligonucleotide; CAG chr11 5248731 5248750 5248734 -
tgtgtttcttttaacgtctt

SEQ ID NO: 46235 - DNA, 20 bp, Artificial Sequence
  Synthetic oligonucleotide; CAG chr11 5248717 5248736 5248720 -
cgtcttcagcctacaacata

SEQ ID NO: 46236 - DNA, 20 bp, Artificial Sequence
  Synthetic oligonucleotide; AGG chr11 5248716 5248735 5248719 -
gtcttcagcctacaacatac

SEQ ID NO: 46237 - DNA, 20 bp, Artificial Sequence
  Synthetic oligonucleotide; GGG chr11 5248715 5248734 5248718 -
tcttcagcctacaacataca

SEQ ID NO: 46238 - DNA, 20 bp, Artificial Sequence
  Synthetic oligonucleotide; TGG chr11 5248708 5248727 5248711 -
cctacaacatacagggttca

SEQ ID NO: 46239 - DNA, 20 bp, Artificial Sequence
  Synthetic oligonucleotide; TGG chr11 5248705 5248724 5248708 -
acaacatacagggttcatgg

SEQ ID NO: 46240 - DNA, 20 bp, Artificial Sequence
  Synthetic oligonucleotide; AAG chr11 5248701 5248720 5248704 -
catacagggttcatggtggc

SEQ ID NO: 46241 - DNA, 20 bp, Artificial Sequence
  Synthetic oligonucleotide; AAG chr11 5248698 5248717 5248701 -
acagggttcatggtggcaag

SEQ ID NO: 46242 - DNA, 20 bp, Artificial Sequence
  Synthetic oligonucleotide; TAG chr11 5248694 5248713 5248697 -
ggttcatggtggcaagaaga

SEQ ID NO: 46243 - DNA, 20 bp, Artificial Sequence
  Synthetic oligonucleotide; AAG chr11 5248690 5248709 5248693 -
catggtggcaagaagatagc

SEQ ID NO: 46244 - DNA, 20 bp, Artificial Sequence
  Synthetic oligonucleotide; TGG chr11 5248677 5248696 5248680 -
agatagcaagatttaaatta

SEQ ID NO: 46245 - DNA, 20 bp, Artificial Sequence
  Synthetic oligonucleotide; CAG chr11 5248673 5248692 5248676 -
agcaagatttaaattatggc

SEQ ID NO: 46246 - DNA, 20 bp, Artificial Sequence
  Synthetic oligonucleotide; TAG chr11 5248666 5248685 5248669 -
tttaaattatggccagtgac

SEQ ID NO: 46247 - DNA, 20 bp, Artificial Sequence
  Synthetic oligonucleotide; AAG chr11 5248657 5248676 5248660 -
tggccagtgactagtgcttg

SEQ ID NO: 46248 - DNA, 20 bp, Artificial Sequence
  Synthetic oligonucleotide; AGG chr11 5248656 5248675 5248659 -
ggccagtgactagtgcttga

SEQ ID NO: 46249 - DNA, 20 bp, Artificial Sequence
  Synthetic oligonucleotide; GGG chr11 5248655 5248674 5248658 -
gccagtgactagtgcttgaa

SEQ ID NO: 46250 - DNA, 20 bp, Artificial Sequence
  Synthetic oligonucleotide; GGG chr11 5248654 5248673 5248657 -
ccagtgactagtgcttgaag

SEQ ID NO: 46251 - DNA, 20 bp, Artificial Sequence
  Synthetic oligonucleotide; TGG chr11 5248632 5248651 5248635 -
gaacaactacctgcatttaa

SEQ ID NO: 46252 - DNA, 20 bp, Artificial Sequence
  Synthetic oligonucleotide; GGG chr11 5248631 5248650 5248634 -
aacaactacctgcatttaat

SEQ ID NO: 46253 - DNA, 20 bp, Artificial Sequence
  Synthetic oligonucleotide; AAG chr11 5248628 5248647 5248631 -
aactacctgcatttaatggg

SEQ ID NO: 46254 - DNA, 20 bp, Artificial Sequence
  Synthetic oligonucleotide; AGG chr11 5248627 5248646 5248630 -
actacctgcatttaatggga

SEQ ID NO: 46255 - DNA, 20 bp, Artificial Sequence
  Synthetic oligonucleotide; CAG chr11 5248616 5248635 5248619 -
ttaatgggaaggcaaaatct

SEQ ID NO: 46256 - DNA, 20 bp, Artificial Sequence
  Synthetic oligonucleotide; AGG chr11 5248615 5248634 5248618 -
taatgggaaggcaaaatctc

SEQ ID NO: 46257 - DNA, 20 bp, Artificial Sequence
  Synthetic oligonucleotide; GAG chr11 5248608 5248627 5248611 -
aaggcaaaatctcaggcttt

SEQ ID NO: 46258 - DNA, 20 bp, Artificial Sequence
  Synthetic oligonucleotide; AGG chr11 5248607 5248626 5248610 -
aggcaaaatctcaggctttg

SEQ ID NO: 46259 - DNA, 20 bp, Artificial Sequence
  Synthetic oligonucleotide; GGG chr11 5248606 5248625 5248609 -
ggcaaaatctcaggctttga

SEQ ID NO: 46260 - DNA, 20 bp, Artificial Sequence
  Synthetic oligonucleotide; AAG chr11 5248603 5248622 5248606 -
aaaatctcaggctttgaggg

SEQ ID NO: 46261 - DNA, 20 bp, Artificial Sequence
  Synthetic oligonucleotide; TAG chr11 5248594 5248613 5248597 -
ggctttgagggaagttaaca

SEQ ID NO: 46262 - DNA, 20 bp, Artificial Sequence
  Synthetic oligonucleotide; AGG chr11 5248593 5248612 5248596 -
gctttgagggaagttaacat

SEQ ID NO: 46263 - DNA, 20 bp, Artificial Sequence
  Synthetic oligonucleotide; TGG chr11 5248582 5248601 5248585 -
agttaacataggcttgattc

SEQ ID NO: 46264 - DNA, 20 bp, Artificial Sequence
  Synthetic oligonucleotide; GGG chr11 5248581 5248600 5248584 -
gttaacataggcttgattct

SEQ ID NO: 46265 - DNA, 20 bp, Artificial Sequence
  Synthetic oligonucleotide; TGG chr11 5248578 5248597 5248581 -
aacataggcttgattctggg

SEQ ID NO: 46266 - DNA, 20 bp, Artificial Sequence
  Synthetic oligonucleotide; AAG chr11 5248575 5248594 5248578 -
ataggcttgattctgggtgg

SEQ ID NO: 46267 - DNA, 20 bp, Artificial Sequence
  Synthetic oligonucleotide; TGG chr11 5248570 5248589 5248573 -
cttgattctgggtggaagct

SEQ ID NO: 46268 - DNA, 20 bp, Artificial Sequence
  Synthetic oligonucleotide; TAG chr11 5248563 5248582 5248566 -
ctgggtggaagcttggtgtg

SEQ ID NO: 46269 - DNA, 20 bp, Artificial Sequence
  Synthetic oligonucleotide; TGG chr11 5248555 5248574 5248558 -
aagcttggtgtgtagttatc

SEQ ID NO: 46270 - DNA, 20 bp, Artificial Sequence
  Synthetic oligonucleotide; GAG chr11 5248553 5248572 5248556 -
gcttggtgtgtagttatctg

SEQ ID NO: 46271 - DNA, 20 bp, Artificial Sequence
  Synthetic oligonucleotide; AGG chr11 5248552 5248571 5248555 -
cttggtgtgtagttatctgg

SEQ ID NO: 46272 - DNA, 20 bp, Artificial Sequence
  Synthetic oligonucleotide; CAG chr11 5248548 5248567 5248551 -
gtgtgtagttatctggaggc

SEQ ID NO: 46273 - DNA, 20 bp, Artificial Sequence
  Synthetic oligonucleotide; AGG chr11 5248547 5248566 5248550 -
tgtgtagttatctggaggcc

SEQ ID NO: 46274 - DNA, 20 bp, Artificial Sequence
  Synthetic oligonucleotide; TGG chr11 5248543 5248562 5248546 -
tagttatctggaggccaggc

SEQ ID NO: 46275 - DNA, 20 bp, Artificial Sequence
  Synthetic oligonucleotide; GAG chr11 5248541 5248560 5248544 -
gttatctggaggccaggctg

SEQ ID NO: 46276 - DNA, 20 bp, Artificial Sequence
  Synthetic oligonucleotide; CAG chr11 5248534 5248553 5248537 -
ggaggccaggctggagctct

SEQ ID NO: 46277 - DNA, 20 bp, Artificial Sequence
  Synthetic oligonucleotide; TGG chr11 5248524 5248543 5248527 -
ctggagctctcagctcacta

SEQ ID NO: 46278 - DNA, 20 bp, Artificial Sequence
  Synthetic oligonucleotide; GGG chr11 5248523 5248542 5248526 -
tggagctctcagctcactat

SEQ ID NO: 46279 - DNA, 20 bp, Artificial Sequence
  Synthetic oligonucleotide; CAG chr11 5248491 5248510 5248494 -
attgtctcctttcatctcaa

SEQ ID NO: 46280 - DNA, 20 bp, Artificial Sequence
  Synthetic oligonucleotide; TGG chr11 5248484 5248503 5248487 -
cctttcatctcaacagctcc

SEQ ID NO: 46281 - DNA, 20 bp, Artificial Sequence
  Synthetic oligonucleotide; GGG chr11 5248483 5248502 5248486 -
ctttcatctcaacagctcct

SEQ ID NO: 46282 - DNA, 20 bp, Artificial Sequence
  Synthetic oligonucleotide; TGG chr11 5248472 5248491 5248475 -
acagctcctgggaaatgtgc

SEQ ID NO: 46283 - DNA, 20 bp, Artificial Sequence
  Synthetic oligonucleotide; TGG chr11 5248460 5248479 5248463 -
aaatgtgctggtgaccgttt

SEQ ID NO: 46284 - DNA, 20 bp, Artificial Sequence
  Synthetic oligonucleotide; CGG chr11 5248447 5248466 5248450 -
accgttttggcaatccattt

SEQ ID NO: 46285 - DNA, 20 bp, Artificial Sequence
  Synthetic oligonucleotide; AAG chr11 5248442 5248461 5248445 -
tttggcaatccatttcggca

SEQ ID NO: 46286 - DNA, 20 bp, Artificial Sequence
  Synthetic oligonucleotide; GAG chr11 5248428 5248447 5248431 -
tcggcaaagaattcacccct

SEQ ID NO: 46287 - DNA, 20 bp, Artificial Sequence
  Synthetic oligonucleotide; AGG chr11 5248427 5248446 5248430 -
cggcaaagaattcacccctg

SEQ ID NO: 46288 - DNA, 20 bp, Artificial Sequence
  Synthetic oligonucleotide; CAG chr11 5248422 5248441 5248425 -
aagaattcacccctgaggtg

SEQ ID NO: 46289 - DNA, 20 bp, Artificial Sequence
  Synthetic oligonucleotide; AGG chr11 5248421 5248440 5248424 -
agaattcacccctgaggtgc

SEQ ID NO: 46290 - DNA, 20 bp, Artificial Sequence
  Synthetic oligonucleotide; TGG chr11 5248413 5248432 5248416 -
cccctgaggtgcaggcttcc

SEQ ID NO: 46291 - DNA, 20 bp, Artificial Sequence
  Synthetic oligonucleotide; CAG chr11 5248410 5248429 5248413 -
ctgaggtgcaggcttcctgg

SEQ ID NO: 46292 - DNA, 20 bp, Artificial Sequence
  Synthetic oligonucleotide; AAG chr11 5248407 5248426 5248410 -
aggtgcaggcttcctggcag

SEQ ID NO: 46293 - DNA, 20 bp, Artificial Sequence
  Synthetic oligonucleotide; TGG chr11 5248403 5248422 5248406 -
gcaggcttcctggcagaaga

SEQ ID NO: 46294 - DNA, 20 bp, Artificial Sequence
  Synthetic oligonucleotide; CAG chr11 5248394 5248413 5248397 -
ctggcagaagatggtgactg

SEQ ID NO: 46295 - DNA, 20 bp, Artificial Sequence
  Synthetic oligonucleotide; TGG chr11 5248391 5248410 5248394 -
gcagaagatggtgactgcag

SEQ ID NO: 46296 - DNA, 20 bp, Artificial Sequence
  Synthetic oligonucleotide; CAG chr11 5248387 5248406 5248390 -
aagatggtgactgcagtggc

SEQ ID NO: 46297 - DNA, 20 bp, Artificial Sequence
  Synthetic oligonucleotide; CAG chr11 5248372 5248391 5248375 -
gtggccagtgccctgtcctc

SEQ ID NO: 46298 - DNA, 20 bp, Artificial Sequence
  Synthetic oligonucleotide; GAG chr11 5248361 5248380 5248364 -
cctgtcctccagataccact

SEQ ID NO: 46299 - DNA, 20 bp, Artificial Sequence
  Synthetic oligonucleotide; CAG chr11 5248342 5248361 5248345 -
tgagctcactgcccatgatt

SEQ ID NO: 46300 - DNA, 20 bp, Artificial Sequence
  Synthetic oligonucleotide; GAG chr11 5248340 5248359 5248343 -
agctcactgcccatgattca

SEQ ID NO: 46301 - DNA, 20 bp, Artificial Sequence
  Synthetic oligonucleotide; AAG chr11 5248332 5248351 5248335 -
gcccatgattcagagctttc

SEQ ID NO: 46302 - DNA, 20 bp, Artificial Sequence
  Synthetic oligonucleotide; AGG chr11 5248331 5248350 5248334 -
cccatgattcagagctttca

SEQ ID NO: 46303 - DNA, 20 bp, Artificial Sequence
  Synthetic oligonucleotide; TAG chr11 5248327 5248346 5248330 -
tgattcagagctttcaagga

SEQ ID NO: 46304 - DNA, 20 bp, Artificial Sequence
  Synthetic oligonucleotide; AGG chr11 5248326 5248345 5248329 -
gattcagagctttcaaggat

SEQ ID NO: 46305 - DNA, 20 bp, Artificial Sequence
  Synthetic oligonucleotide; AAG chr11 5248312 5248331 5248315 -
aaggataggctttattctgc

SEQ ID NO: 46306 - DNA, 20 bp, Artificial Sequence
  Synthetic oligonucleotide; GAG chr11 5248282 5248301 5248285 -
aataataaatctattctgct

SEQ ID NO: 46307 - DNA, 20 bp, Artificial Sequence
  Synthetic oligonucleotide; GAG chr11 5248280 5248299 5248283 -
taataaatctattctgctga

SEQ ID NO: 46308 - DNA, 20 bp, Artificial Sequence
  Synthetic oligonucleotide; CAG chr11 5248259 5248278 5248262 -
agatcacacatgattttctt

SEQ ID NO: 46309 - DNA, 20 bp, Artificial Sequence
  Synthetic oligonucleotide; GAG chr11 5248227 5248246 5248230 -
ttacatctttttaaatatat

SEQ ID NO: 46310 - DNA, 20 bp, Artificial Sequence
  Synthetic oligonucleotide; AAG chr11 5248219 5248238 5248222 -
ttttaaatatatgagccaca

SEQ ID NO: 46311 - DNA, 20 bp, Artificial Sequence
  Synthetic oligonucleotide; AGG chr11 5248218 5248237 5248221 -
tttaaatatatgagccacaa

SEQ ID NO: 46312 - DNA, 20 bp, Artificial Sequence
  Synthetic oligonucleotide; GGG chr11 5248217 5248236 5248220 -
ttaaatatatgagccacaaa

SEQ ID NO: 46313 - DNA, 20 bp, Artificial Sequence
  Synthetic oligonucleotide; GAG chr11 5248206 5248225 5248209 -
agccacaaagggtttatatt

SEQ ID NO: 46314 - DNA, 20 bp, Artificial Sequence
  Synthetic oligonucleotide; AGG chr11 5248205 5248224 5248208 -
gccacaaagggtttatattg

SEQ ID NO: 46315 - DNA, 20 bp, Artificial Sequence
  Synthetic oligonucleotide; GGG chr11 5248204 5248223 5248207 -
ccacaaagggtttatattga

SEQ ID NO: 46316 - DNA, 20 bp, Artificial Sequence
  Synthetic oligonucleotide; AAG chr11 5248201 5248220 5248204 -
caaagggtttatattgaggg

SEQ ID NO: 46317 - DNA, 20 bp, Artificial Sequence
  Synthetic oligonucleotide; TGG chr11 5248162 5248181 5248165 -
tgcatgcctgtttgtgtttg

SEQ ID NO: 46318 - DNA, 20 bp, Artificial Sequence
  Synthetic oligonucleotide; GAG chr11 5248129 5248148 5248132 -
ctcctcatttatttttatat

SEQ ID NO: 46319 - DNA, 20 bp, Artificial Sequence
  Synthetic oligonucleotide; GAG chr11 5248112 5248131 5248115 -
tatgagatgtgcattttgat

SEQ ID NO: 46320 - DNA, 20 bp, Artificial Sequence
  Synthetic oligonucleotide; AAG chr11 5248102 5248121 5248105 -
gcattttgatgagcaaataa

SEQ ID NO: 46321 - DNA, 20 bp, Artificial Sequence
  Synthetic oligonucleotide; CAG chr11 5248099 5248118 5248102 -
ttttgatgagcaaataaaag

SEQ ID NO: 46322 - DNA, 20 bp, Artificial Sequence
  Synthetic oligonucleotide; AAG chr11 5248094 5248113 5248097 -
atgagcaaataaaagcagta

SEQ ID NO: 46323 - DNA, 20 bp, Artificial Sequence
  Synthetic oligonucleotide; CGG chr11 5248080 5248099 5248083 -
gcagtaaagacacttgtaca

SEQ ID NO: 46324 - DNA, 20 bp, Artificial Sequence
  Synthetic oligonucleotide; GGG chr11 5248079 5248098 5248082 -
cagtaaagacacttgtacac

SEQ ID NO: 46325 - DNA, 20 bp, Artificial Sequence
  Synthetic oligonucleotide; GAG chr11 5248077 5248096 5248080 -
gtaaagacacttgtacacgg

SEQ ID NO: 46326 - DNA, 20 bp, Artificial Sequence
  Synthetic oligonucleotide; AAG chr11 5248068 5248087 5248071 -
cttgtacacgggagttctgc

SEQ ID NO: 46327 - DNA, 20 bp, Artificial Sequence
  Synthetic oligonucleotide; TGG chr11 5248065 5248084 5248068 -
gtacacgggagttctgcaag

SEQ ID NO: 46328 - DNA, 20 bp, Artificial Sequence
  Synthetic oligonucleotide; GGG chr11 5248064 5248083 5248067 -
tacacgggagttctgcaagt

SEQ ID NO: 46329 - DNA, 20 bp, Artificial Sequence
  Synthetic oligonucleotide; GAG chr11 5248062 5248081 5248065 -
cacgggagttctgcaagtgg

SEQ ID NO: 46330 - DNA, 20 bp, Artificial Sequence
  Synthetic oligonucleotide; TGG chr11 5248055 5248074 5248058 -
gttctgcaagtgggagtaaa

SEQ ID NO: 46331 - DNA, 20 bp, Artificial Sequence
  Synthetic oligonucleotide; TAG chr11 5248050 5248069 5248053 -
gcaagtgggagtaaatggtg

SEQ ID NO: 46332 - DNA, 20 bp, Artificial Sequence
  Synthetic oligonucleotide; AGG chr11 5248049 5248068 5248052 -
caagtgggagtaaatggtgt

SEQ ID NO: 46333 - DNA, 20 bp, Artificial Sequence
  Synthetic oligonucleotide; GAG chr11 5248047 5248066 5248050 -
agtgggagtaaatggtgtag

SEQ ID NO: 46334 - DNA, 20 bp, Artificial Sequence
  Synthetic oligonucleotide; CGG chr11 5248039 5248058 5248042 -
taaatggtgtaggagaaatc

SEQ ID NO: 46335 - DNA, 20 bp, Artificial Sequence
  Synthetic oligonucleotide; TGG chr11 5248036 5248055 5248039 -
atggtgtaggagaaatccgg

SEQ ID NO: 46336 - DNA, 20 bp, Artificial Sequence
  Synthetic oligonucleotide; GGG chr11 5248035 5248054 5248038 -
tggtgtaggagaaatccggt

SEQ ID NO: 46337 - DNA, 20 bp, Artificial Sequence
  Synthetic oligonucleotide; AAG chr11 5248032 5248051 5248035 -
tgtaggagaaatccggtggg

SEQ ID NO: 46338 - DNA, 20 bp, Artificial Sequence
  Synthetic oligonucleotide; AAG chr11 5248028 5248047 5248031 -
ggagaaatccggtgggaaga

SEQ ID NO: 46339 - DNA, 20 bp, Artificial Sequence
  Synthetic oligonucleotide; TAG chr11 5248018 5248037 5248021 -
ggtgggaagaaagacctcta

SEQ ID NO: 46340 - DNA, 20 bp, Artificial Sequence
  Synthetic oligonucleotide; AGG chr11 5248017 5248036 5248020 -
gtgggaagaaagacctctat

SEQ ID NO: 46341 - DNA, 20 bp, Artificial Sequence
  Synthetic oligonucleotide; CAG chr11 5248013 5248032 5248016 -
gaagaaagacctctatagga

SEQ ID NO: 46342 - DNA, 20 bp, Artificial Sequence
  Synthetic oligonucleotide; AGG chr11 5248012 5248031 5248015 -
aagaaagacctctataggac

SEQ ID NO: 46343 - DNA, 20 bp, Artificial Sequence
  Synthetic oligonucleotide; CAG chr11 5248003 5248022 5248006 -
ctctataggacaggacttct

SEQ ID NO: 46344 - DNA, 20 bp, Artificial Sequence
  Synthetic oligonucleotide; CAG chr11 5247997 5248016 5248000 -
aggacaggacttctcagaaa

SEQ ID NO: 46345 - DNA, 20 bp, Artificial Sequence
  Synthetic oligonucleotide; TGG chr11 5247988 5248007 5247991 -
cttctcagaaacagatgttt

SEQ ID NO: 46346 - DNA, 20 bp, Artificial Sequence
  Synthetic oligonucleotide; AAG chr11 5247985 5248004 5247988 -
ctcagaaacagatgttttgg

SEQ ID NO: 46347 - DNA, 20 bp, Artificial Sequence
  Synthetic oligonucleotide; GAG chr11 5247983 5248002 5247986 -
cagaaacagatgttttggaa

SEQ ID NO: 46348 - DNA, 20 bp, Artificial Sequence
  Synthetic oligonucleotide; TGG chr11 5247979 5247998 5247982 -
aacagatgttttggaagaga

SEQ ID NO: 46349 - DNA, 20 bp, Artificial Sequence
  Synthetic oligonucleotide; GGG chr11 5247978 5247997 5247981 -
acagatgttttggaagagat

SEQ ID NO: 46350 - DNA, 20 bp, Artificial Sequence
  Synthetic oligonucleotide; AAG chr11 5247973 5247992 5247976 -
tgttttggaagagatgggaa

SEQ ID NO: 46351 - DNA, 20 bp, Artificial Sequence
  Synthetic oligonucleotide; AGG chr11 5247972 5247991 5247975 -
gttttggaagagatgggaaa

SEQ ID NO: 46352 - DNA, 20 bp, Artificial Sequence
  Synthetic oligonucleotide; CAG chr11 5247967 5247986 5247970 -
ggaagagatgggaaaaggtt

SEQ ID NO: 46353 - DNA, 20 bp, Artificial Sequence
  Synthetic oligonucleotide; AAG chr11 5247962 5247981 5247965 -
agatgggaaaaggttcagtg

SEQ ID NO: 46354 - DNA, 20 bp, Artificial Sequence
  Synthetic oligonucleotide; TGG chr11 5247956 5247975 5247959 -
gaaaaggttcagtgaagacc

SEQ ID NO: 46355 - DNA, 20 bp, Artificial Sequence
  Synthetic oligonucleotide; GGG chr11 5247955 5247974 5247958 -
aaaaggttcagtgaagacct

SEQ ID NO: 46356 - DNA, 20 bp, Artificial Sequence
  Synthetic oligonucleotide; GGG chr11 5247954 5247973 5247957 -
aaaggttcagtgaagacctg

SEQ ID NO: 46357 - DNA, 20 bp, Artificial Sequence
  Synthetic oligonucleotide; GGG chr11 5247953 5247972 5247956 -
aaggttcagtgaagacctgg

SEQ ID NO: 46358 - DNA, 20 bp, Artificial Sequence
  Synthetic oligonucleotide; TGG chr11 5247949 5247968 5247952 -
ttcagtgaagacctgggggc

SEQ ID NO: 46359 - DNA, 20 bp, Artificial Sequence
  Synthetic oligonucleotide; CAG chr11 5247938 5247957 5247941 -
cctgggggctggattgattg

SEQ ID NO: 46360 - DNA, 20 bp, Artificial Sequence
  Synthetic oligonucleotide; GAG chr11 5247933 5247952 5247936 -
gggctggattgattgcagct

SEQ ID NO: 46361 - DNA, 20 bp, Artificial Sequence
  Synthetic oligonucleotide; TAG chr11 5247930 5247949 5247933 -
ctggattgattgcagctgag

SEQ ID NO: 46362 - DNA, 20 bp, Artificial Sequence
  Synthetic oligonucleotide; AAG chr11 5247926 5247945 5247929 -
attgattgcagctgagtagc

SEQ ID NO: 46363 - DNA, 20 bp, Artificial Sequence
  Synthetic oligonucleotide; AGG chr11 5247925 5247944 5247928 -
ttgattgcagctgagtagca

SEQ ID NO: 46364 - DNA, 20 bp, Artificial Sequence
  Synthetic oligonucleotide; TGG chr11 5247921 5247940 5247924 -
ttgcagctgagtagcaagga

SEQ ID NO: 46365 - DNA, 20 bp, Artificial Sequence
  Synthetic oligonucleotide; AAG chr11 5247913 5247932 5247916 -
gagtagcaaggatggttctt

SEQ ID NO: 46366 - DNA, 20 bp, Artificial Sequence
  Synthetic oligonucleotide; AGG chr11 5247912 5247931 5247915 -
agtagcaaggatggttctta

SEQ ID NO: 46367 - DNA, 20 bp, Artificial Sequence
  Synthetic oligonucleotide; AAG chr11 5247909 5247928 5247912 -
agcaaggatggttcttaagg

SEQ ID NO: 46368 - DNA, 20 bp, Artificial Sequence
  Synthetic oligonucleotide; AGG chr11 5247908 5247927 5247911 -
gcaaggatggttcttaagga

SEQ ID NO: 46369 - DNA, 20 bp, Artificial Sequence
  Synthetic oligonucleotide; GGG chr11 5247907 5247926 5247910 -
caaggatggttcttaaggaa

SEQ ID NO: 46370 - DNA, 20 bp, Artificial Sequence
  Synthetic oligonucleotide; AAG chr11 5247903 5247922 5247906 -
gatggttcttaaggaaggga

SEQ ID NO: 46371 - DNA, 20 bp, Artificial Sequence
  Synthetic oligonucleotide; AAG chr11 5247894 5247913 5247897 -
taaggaagggaaagtgttcc

SEQ ID NO: 46372 - DNA, 20 bp, Artificial Sequence
  Synthetic oligonucleotide; TAG chr11 5247888 5247907 5247891 -
agggaaagtgttccaagctt

SEQ ID NO: 46373 - DNA, 20 bp, Artificial Sequence
  Synthetic oligonucleotide; AGG chr11 5247887 5247906 5247890 -
gggaaagtgttccaagcttt

SEQ ID NO: 46374 - DNA, 20 bp, Artificial Sequence
  Synthetic oligonucleotide; AAG chr11 5247879 5247898 5247882 -
gttccaagctttaggaattc

SEQ ID NO: 46375 - DNA, 20 bp, Artificial Sequence
  Synthetic oligonucleotide; AGG chr11 5247878 5247897 5247881 -
ttccaagctttaggaattca

SEQ ID NO: 46376 - DNA, 20 bp, Artificial Sequence
  Synthetic oligonucleotide; TAG chr11 5247873 5247892 5247876 -
agctttaggaattcaaggtt

SEQ ID NO: 46377 - DNA, 20 bp, Artificial Sequence
  Synthetic oligonucleotide; CAG chr11 5247869 5247888 5247872 -
ttaggaattcaaggtttagt

SEQ ID NO: 46378 - DNA, 20 bp, Artificial Sequence
  Synthetic oligonucleotide; AGG chr11 5247868 5247887 5247871 -
taggaattcaaggtttagtc

SEQ ID NO: 46379 - DNA, 20 bp, Artificial Sequence
  Synthetic oligonucleotide; TAG chr11 5247863 5247882 5247866 -
attcaaggtttagtcaggtg

SEQ ID NO: 46380 - DNA, 20 bp, Artificial Sequence
  Synthetic oligonucleotide; TAG chr11 5247846 5247865 5247849 -
gtgtagcaattctattttat

SEQ ID NO: 46381 - DNA, 20 bp, Artificial Sequence
  Synthetic oligonucleotide; AGG chr11 5247845 5247864 5247848 -
tgtagcaattctattttatt

SEQ ID NO: 46382 - DNA, 20 bp, Artificial Sequence
  Synthetic oligonucleotide; GAG chr11 5247843 5247862 5247846 -
tagcaattctattttattag

SEQ ID NO: 46383 - DNA, 20 bp, Artificial Sequence
  Synthetic oligonucleotide; AGG chr11 5247842 5247861 5247845 -
agcaattctattttattagg

SEQ ID NO: 46384 - DNA, 20 bp, Artificial Sequence
  Synthetic oligonucleotide; TGG chr11 5247825 5247844 5247828 -
aggaggaatactatttctaa

SEQ ID NO: 46385 - DNA, 20 bp, Artificial Sequence
  Synthetic oligonucleotide; TAG chr11 5247818 5247837 5247821 -
atactatttctaatggcact

SEQ ID NO: 46386 - DNA, 20 bp, Artificial Sequence
  Synthetic oligonucleotide; CAG chr11 5247808 5247827 5247811 -
taatggcacttagcttttca

SEQ ID NO: 46387 - DNA, 20 bp, Artificial Sequence
  Synthetic oligonucleotide; TGG chr11 5247799 5247818 5247802 -
ttagcttttcacagcccttg

SEQ ID NO: 46388 - DNA, 20 bp, Artificial Sequence
  Synthetic oligonucleotide; AAG chr11 5247790 5247809 5247793 -
cacagcccttgtggatgcct

SEQ ID NO: 46389 - DNA, 20 bp, Artificial Sequence
  Synthetic oligonucleotide; AAG chr11 5247786 5247805 5247789 -
gcccttgtggatgcctaaga

SEQ ID NO: 46390 - DNA, 20 bp, Artificial Sequence
  Synthetic oligonucleotide; AAG chr11 5247762 5247781 5247765 -
gaaattaatcccatgccctc

SEQ ID NO: 46391 - DNA, 20 bp, Artificial Sequence
  Synthetic oligonucleotide; CAG chr11 5247755 5247774 5247758 -
atcccatgccctcaagtgtg

SEQ ID NO: 46392 - DNA, 20 bp, Artificial Sequence
  Synthetic oligonucleotide; TGG chr11 5247750 5247769 5247753 -
atgccctcaagtgtgcagat

SEQ ID NO: 46393 - DNA, 20 bp, Artificial Sequence
  Synthetic oligonucleotide; CAG chr11 5247744 5247763 5247747 -
tcaagtgtgcagattggtca

SEQ ID NO: 46394 - DNA, 20 bp, Artificial Sequence
  Synthetic oligonucleotide; AAG chr11 5247735 5247754 5247738 -
cagattggtcacagcatttc

SEQ ID NO: 46395 - DNA, 20 bp, Artificial Sequence
  Synthetic oligonucleotide; AGG chr11 5247734 5247753 5247737 -
agattggtcacagcatttca

SEQ ID NO: 46396 - DNA, 20 bp, Artificial Sequence
  Synthetic oligonucleotide; GGG chr11 5247733 5247752 5247736 -
gattggtcacagcatttcaa

SEQ ID NO: 46397 - DNA, 20 bp, Artificial Sequence
  Synthetic oligonucleotide; GAG chr11 5247731 5247750 5247734 -
ttggtcacagcatttcaagg

SEQ ID NO: 46398 - DNA, 20 bp, Artificial Sequence
  Synthetic oligonucleotide; GAG chr11 5247729 5247748 5247732 -
ggtcacagcatttcaaggga

SEQ ID NO: 46399 - DNA, 20 bp, Artificial Sequence
  Synthetic oligonucleotide; AAG chr11 5247716 5247735 5247719 -
caagggagagacctcattgt

SEQ ID NO: 46400 - DNA, 20 bp, Artificial Sequence
  Synthetic oligonucleotide; TGG chr11 5247709 5247728 5247712 -
gagacctcattgtaagactc

SEQ ID NO: 46401 - DNA, 20 bp, Artificial Sequence
  Synthetic oligonucleotide; GGG chr11 5247708 5247727 5247711 -
agacctcattgtaagactct

SEQ ID NO: 46402 - DNA, 20 bp, Artificial Sequence
  Synthetic oligonucleotide; GGG chr11 5247707 5247726 5247710 -
gacctcattgtaagactctg

SEQ ID NO: 46403 - DNA, 20 bp, Artificial Sequence
  Synthetic oligonucleotide; GGG chr11 5247706 5247725 5247709 -
acctcattgtaagactctgg

SEQ ID NO: 46404 - DNA, 20 bp, Artificial Sequence
  Synthetic oligonucleotide; GAG chr11 5247704 5247723 5247707 -
ctcattgtaagactctgggg

SEQ ID NO: 46405 - DNA, 20 bp, Artificial Sequence
  Synthetic oligonucleotide; AGG chr11 5247703 5247722 5247706 -
tcattgtaagactctggggg

SEQ ID NO: 46406 - DNA, 20 bp, Artificial Sequence
  Synthetic oligonucleotide; TGG chr11 5247700 5247719 5247703 -
ttgtaagactctgggggagg

SEQ ID NO: 46407 - DNA, 20 bp, Artificial Sequence
  Synthetic oligonucleotide; GGG chr11 5247699 5247718 5247702 -
tgtaagactctgggggaggt

SEQ ID NO: 46408 - DNA, 20 bp, Artificial Sequence
  Synthetic oligonucleotide; GGG chr11 5247698 5247717 5247701 -
gtaagactctgggggaggtg

SEQ ID NO: 46409 - DNA, 20 bp, Artificial Sequence
  Synthetic oligonucleotide; TAG chr11 5247692 5247711 5247695 -
ctctgggggaggtggggact

SEQ ID NO: 46410 - DNA, 20 bp, Artificial Sequence
  Synthetic oligonucleotide; AGG chr11 5247691 5247710 5247694 -
tctgggggaggtggggactt

SEQ ID NO: 46411 - DNA, 20 bp, Artificial Sequence
  Synthetic oligonucleotide; AAG chr11 5247685 5247704 5247688 -
ggaggtggggacttaggtgt

SEQ ID NO: 46412 - DNA, 20 bp, Artificial Sequence
  Synthetic oligonucleotide; CAG chr11 5247674 5247693 5247677 -
cttaggtgtaagaaatgaat

SEQ ID NO: 46413 - DNA, 20 bp, Artificial Sequence
  Synthetic oligonucleotide; CAG chr11 5247671 5247690 5247674 -
aggtgtaagaaatgaatcag

SEQ ID NO: 46414 - DNA, 20 bp, Artificial Sequence
  Synthetic oligonucleotide; GAG chr11 5247669 5247688 5247672 -
gtgtaagaaatgaatcagca

SEQ ID NO: 46415 - DNA, 20 bp, Artificial Sequence
  Synthetic oligonucleotide; AGG chr11 5247668 5247687 5247671 -
tgtaagaaatgaatcagcag

SEQ ID NO: 46416 - DNA, 20 bp, Artificial Sequence
  Synthetic oligonucleotide; AAG chr11 5247660 5247679 5247663 -
atgaatcagcagaggctcac

SEQ ID NO: 46417 - DNA, 20 bp, Artificial Sequence
  Synthetic oligonucleotide; CAG chr11 5247656 5247675 5247659 -
atcagcagaggctcacaagt

SEQ ID NO: 46418 - DNA, 20 bp, Artificial Sequence
  Synthetic oligonucleotide; GAG chr11 5247650 5247669 5247653 -
agaggctcacaagtcagcat

SEQ ID NO: 46419 - DNA, 20 bp, Artificial Sequence
  Synthetic oligonucleotide; GAG chr11 5247635 5247654 5247638 -
agcatgagcatgttatgtct

SEQ ID NO: 46420 - DNA, 20 bp, Artificial Sequence
  Synthetic oligonucleotide; CAG chr11 5247629 5247648 5247632 -
agcatgttatgtctgagaaa

SEQ ID NO: 46421 - DNA, 20 bp, Artificial Sequence
  Synthetic oligonucleotide; CAG chr11 5247624 5247643 5247627 -
gttatgtctgagaaacagac

SEQ ID NO: 46422 - DNA, 20 bp, Artificial Sequence
  Synthetic oligonucleotide; GAG chr11 5247615 5247634 5247618 -
gagaaacagaccagcactgt

SEQ ID NO: 46423 - DNA, 20 bp, Artificial Sequence
  Synthetic oligonucleotide; TAG chr11 5247603 5247622 5247606 -
agcactgtgagatcaaaatg

SEQ ID NO: 46424 - DNA, 20 bp, Artificial Sequence
  Synthetic oligonucleotide; TGG chr11 5247600 5247619 5247603 -
actgtgagatcaaaatgtag

SEQ ID NO: 46425 - DNA, 20 bp, Artificial Sequence
  Synthetic oligonucleotide; GGG chr11 5247599 5247618 5247602 -
ctgtgagatcaaaatgtagt

SEQ ID NO: 46426 - DNA, 20 bp, Artificial Sequence
  Synthetic oligonucleotide; AAG chr11 5247596 5247615 5247599 -
tgagatcaaaatgtagtggg

SEQ ID NO: 46427 - DNA, 20 bp, Artificial Sequence
  Synthetic oligonucleotide; TGG chr11 5247575 5247594 5247578 -
agaatttgtacaacattaat

SEQ ID NO: 46428 - DNA, 20 bp, Artificial Sequence
  Synthetic oligonucleotide; AAG chr11 5247572 5247591 5247575 -
atttgtacaacattaattgg

SEQ ID NO: 46429 - DNA, 20 bp, Artificial Sequence
  Synthetic oligonucleotide; AGG chr11 5247571 5247590 5247574 -
tttgtacaacattaattgga

SEQ ID NO: 46430 - DNA, 20 bp, Artificial Sequence
  Synthetic oligonucleotide; TGG chr11 5247559 5247578 5247562 -
taattggaaggcttacttaa

SEQ ID NO: 46431 - DNA, 20 bp, Artificial Sequence
  Synthetic oligonucleotide; TAG chr11 5247546 5247565 5247549 -
tacttaatggaatttttgta

SEQ ID NO: 46432 - DNA, 20 bp, Artificial Sequence
  Synthetic oligonucleotide; TGG chr11 5247542 5247561 5247545 -
taatggaatttttgtatagt

SEQ ID NO: 46433 - DNA, 20 bp, Artificial Sequence
  Synthetic oligonucleotide; TAG chr11 5247535 5247554 5247538 -
atttttgtatagttggatgt

SEQ ID NO: 46434 - DNA, 20 bp, Artificial Sequence
  Synthetic oligonucleotide; AAG chr11 5247521 5247540 5247524 -
ggatgttagtgcatctctat

SEQ ID NO: 46435 - DNA, 20 bp, Artificial Sequence
  Synthetic oligonucleotide; AAG chr11 5247517 5247536 5247520 -
gttagtgcatctctataagt

SEQ ID NO: 46436 - DNA, 20 bp, Artificial Sequence
  Synthetic oligonucleotide; GAG chr11 5247515 5247534 5247518 -
tagtgcatctctataagtaa

SEQ ID NO: 46437 - DNA, 20 bp, Artificial Sequence
  Synthetic oligonucleotide; TGG chr11 5247502 5247521 5247505 -
taagtaagagtttaatatga

SEQ ID NO: 46438 - DNA, 20 bp, Artificial Sequence
  Synthetic oligonucleotide; CGG chr11 5247494 5247513 5247497 -
agtttaatatgatggtgtta

SEQ ID NO: 46439 - DNA, 20 bp, Artificial Sequence
  Synthetic oligonucleotide; TGG chr11 5247426 5247445 5247429 -
ctcccaactgaccttatctg

SEQ ID NO: 46440 - DNA, 20 bp, Artificial Sequence
  Synthetic oligonucleotide; GGG chr11 5247425 5247444 5247428 -
tcccaactgaccttatctgt

SEQ ID NO: 46441 - DNA, 20 bp, Artificial Sequence
  Synthetic oligonucleotide; GGG chr11 5247424 5247443 5247427 -
cccaactgaccttatctgtg

SEQ ID NO: 46442 - DNA, 20 bp, Artificial Sequence
  Synthetic oligonucleotide; GGG chr11 5247423 5247442 5247426 -
ccaactgaccttatctgtgg

SEQ ID NO: 46443 - DNA, 20 bp, Artificial Sequence
  Synthetic oligonucleotide; GAG chr11 5247421 5247440 5247424 -
aactgaccttatctgtgggg

SEQ ID NO: 46444 - DNA, 20 bp, Artificial Sequence
  Synthetic oligonucleotide; AGG chr11 5247420 5247439 5247423 -
actgaccttatctgtggggg

SEQ ID NO: 46445 - DNA, 20 bp, Artificial Sequence
  Synthetic oligonucleotide; AAG chr11 5247409 5247428 5247412 -
ctgtgggggaggcttttgaa

SEQ ID NO: 46446 - DNA, 20 bp, Artificial Sequence
  Synthetic oligonucleotide; TAG chr11 5247402 5247421 5247405 -
ggaggcttttgaaaagtaat

SEQ ID NO: 46447 - DNA, 20 bp, Artificial Sequence
  Synthetic oligonucleotide; AGG chr11 5247401 5247420 5247404 -
gaggcttttgaaaagtaatt

SEQ ID NO: 46448 - DNA, 20 bp, Artificial Sequence
  Synthetic oligonucleotide; TAG chr11 5247396 5247415 5247399 -
ttttgaaaagtaattaggtt

SEQ ID NO: 46449 - DNA, 20 bp, Artificial Sequence
  Synthetic oligonucleotide; GAG chr11 5247391 5247410 5247394 -
aaaagtaattaggtttagat

SEQ ID NO: 46450 - DNA, 20 bp, Artificial Sequence
  Synthetic oligonucleotide; AAG chr11 5247383 5247402 5247386 -
ttaggtttagatgagctcat

SEQ ID NO: 46451 - DNA, 20 bp, Artificial Sequence
  Synthetic oligonucleotide; GAG chr11 5247381 5247400 5247384 -
aggtttagatgagctcataa

SEQ ID NO: 46452 - DNA, 20 bp, Artificial Sequence
  Synthetic oligonucleotide; CAG chr11 5247378 5247397 5247381 -
tttagatgagctcataagag

SEQ ID NO: 46453 - DNA, 20 bp, Artificial Sequence
  Synthetic oligonucleotide; CAG chr11 5247347 5247366 5247350 -
cataaaattattttccttat

SEQ ID NO: 46454 - DNA, 20 bp, Artificial Sequence
  Synthetic oligonucleotide; AAG chr11 5247344 5247363 5247347 -
aaaattattttccttatcag

SEQ ID NO: 46455 - DNA, 20 bp, Artificial Sequence
  Synthetic oligonucleotide; CAG chr11 5247341 5247360 5247344 -
attattttccttatcagaag

SEQ ID NO: 46456 - DNA, 20 bp, Artificial Sequence
  Synthetic oligonucleotide; GAG chr11 5247339 5247358 5247342 -
tattttccttatcagaagca

SEQ ID NO: 46457 - DNA, 20 bp, Artificial Sequence
  Synthetic oligonucleotide; GAG chr11 5247337 5247356 5247340 -
ttttccttatcagaagcaga

SEQ ID NO: 46458 - DNA, 20 bp, Artificial Sequence
  Synthetic oligonucleotide; AAG chr11 5247332 5247351 5247335 -
cttatcagaagcagagagac

SEQ ID NO: 46459 - DNA, 20 bp, Artificial Sequence
  Synthetic oligonucleotide; CGG chr11 5247312 5247331 5247315 -
aagccatttctctttcctcc

SEQ ID NO: 46460 - DNA, 20 bp, Artificial Sequence
  Synthetic oligonucleotide; GAG chr11 5247308 5247327 5247311 -
catttctctttcctcccggt

SEQ ID NO: 46461 - DNA, 20 bp, Artificial Sequence
  Synthetic oligonucleotide; AGG chr11 5247307 5247326 5247310 -
atttctctttcctcccggtg

SEQ ID NO: 46462 - DNA, 20 bp, Artificial Sequence
  Synthetic oligonucleotide; CAG chr11 5247301 5247320 5247304 -
ctttcctcccggtgaggaca

SEQ ID NO: 46463 - DNA, 20 bp, Artificial Sequence
  Synthetic oligonucleotide; GAG chr11 5247297 5247316 5247300 -
cctcccggtgaggacacagt

SEQ ID NO: 46464 - DNA, 20 bp, Artificial Sequence
  Synthetic oligonucleotide; AAG chr11 5247294 5247313 5247297 -
cccggtgaggacacagtgag

SEQ ID NO: 46465 - DNA, 20 bp, Artificial Sequence
  Synthetic oligonucleotide; CAG chr11 5247275 5247294 5247278 -
gaagtccgccatctgcaatc

SEQ ID NO: 46466 - DNA, 20 bp, Artificial Sequence
  Synthetic oligonucleotide; AGG chr11 5247274 5247293 5247277 -
aagtccgccatctgcaatcc

SEQ ID NO: 46467 - DNA, 20 bp, Artificial Sequence
  Synthetic oligonucleotide; AAG chr11 5247271 5247290 5247274 -
tccgccatctgcaatccagg

SEQ ID NO: 46468 - DNA, 20 bp, Artificial Sequence
  Synthetic oligonucleotide; GAG chr11 5247269 5247288 5247272 -
cgccatctgcaatccaggaa

SEQ ID NO: 46469 - DNA, 20 bp, Artificial Sequence
  Synthetic oligonucleotide; GAG chr11 5247254 5247273 5247257 -
aggaagagaaccctgaccac

SEQ ID NO: 46470 - DNA, 20 bp, Artificial Sequence
  Synthetic oligonucleotide; CAG chr11 5247250 5247269 5247253 -
agagaaccctgaccacgagt

SEQ ID NO: 46471 - DNA, 20 bp, Artificial Sequence
  Synthetic oligonucleotide; CAG chr11 5247243 5247262 5247246 -
cctgaccacgagtcagcctt

SEQ ID NO: 46472 - DNA, 20 bp, Artificial Sequence
  Synthetic oligonucleotide; GAG chr11 5247234 5247253 5247237 -
gagtcagccttcagaaatgt

SEQ ID NO: 46473 - DNA, 20 bp, Artificial Sequence
  Synthetic oligonucleotide; AAG chr11 5247214 5247233 5247217 -
gagaaaaaactctgttgttg

SEQ ID NO: 46474 - DNA, 20 bp, Artificial Sequence
  Synthetic oligonucleotide; CAG chr11 5247206 5247225 5247209 -
actctgttgttgaagccacc

SEQ ID NO: 46475 - DNA, 20 bp, Artificial Sequence
  Synthetic oligonucleotide; TAG chr11 5247186 5247205 5247189 -
cagtcttttgtattttgtta

SEQ ID NO: 46476 - DNA, 20 bp, Artificial Sequence
  Synthetic oligonucleotide; GAG chr11 5247172 5247191 5247175 -
ttgttatagcaccttgcact

SEQ ID NO: 46477 - DNA, 20 bp, Artificial Sequence
  Synthetic oligonucleotide; AAG chr11 5247168 5247187 5247171 -
tatagcaccttgcactgagt

SEQ ID NO: 46478 - DNA, 20 bp, Artificial Sequence
  Synthetic oligonucleotide; AGG chr11 5247167 5247186 5247170 -
atagcaccttgcactgagta

SEQ ID NO: 46479 - DNA, 20 bp, Artificial Sequence
  Synthetic oligonucleotide; CAG chr11 5247164 5247183 5247167 -
gcaccttgcactgagtaagg

SEQ ID NO: 46480 - DNA, 20 bp, Artificial Sequence
  Synthetic oligonucleotide; AAG chr11 5247158 5247177 5247161 -
tgcactgagtaaggcagatg

SEQ ID NO: 46481 - DNA, 20 bp, Artificial Sequence
  Synthetic oligonucleotide; AAG chr11 5247155 5247174 5247158 -
actgagtaaggcagatgaag

SEQ ID NO: 46482 - DNA, 20 bp, Artificial Sequence
  Synthetic oligonucleotide; AGG chr11 5247154 5247173 5247157 -
ctgagtaaggcagatgaaga

SEQ ID NO: 46483 - DNA, 20 bp, Artificial Sequence
  Synthetic oligonucleotide; GAG chr11 5247152 5247171 5247155 -
gagtaaggcagatgaagaag

SEQ ID NO: 46484 - DNA, 20 bp, Artificial Sequence
  Synthetic oligonucleotide; AAG chr11 5247141 5247160 5247144 -
atgaagaaggagaaaaaaat

SEQ ID NO: 46485 - DNA, 20 bp, Artificial Sequence
  Synthetic oligonucleotide; TGG chr11 5247136 5247155 5247139 -
gaaggagaaaaaaataagct

SEQ ID NO: 46486 - DNA, 20 bp, Artificial Sequence
  Synthetic oligonucleotide; GGG chr11 5247135 5247154 5247138 -
aaggagaaaaaaataagctt

SEQ ID NO: 46487 - DNA, 20 bp, Artificial Sequence
  Synthetic oligonucleotide; GAG chr11 5247128 5247147 5247131 -
aaaaaataagcttgggtttt

SEQ ID NO: 46488 - DNA, 20 bp, Artificial Sequence
  Synthetic oligonucleotide; TGG chr11 5247125 5247144 5247128 -
aaataagcttgggttttgag

SEQ ID NO: 46489 - DNA, 20 bp, Artificial Sequence
  Synthetic oligonucleotide; CAG chr11 5247118 5247137 5247121 -
cttgggttttgagtggacta

SEQ ID NO: 46490 - DNA, 20 bp, Artificial Sequence
  Synthetic oligonucleotide; CAG chr11 5247102 5247121 5247105 -
actacagaccatgtttatct

SEQ ID NO: 46491 - DNA, 20 bp, Artificial Sequence
  Synthetic oligonucleotide; AGG chr11 5247101 5247120 5247104 -
ctacagaccatgtttatctc

SEQ ID NO: 46492 - DNA, 20 bp, Artificial Sequence
  Synthetic oligonucleotide; AAG chr11 5247092 5247111 5247095 -
atgtttatctcaggtttgca

SEQ ID NO: 46493 - DNA, 20 bp, Artificial Sequence
  Synthetic oligonucleotide; CAG chr11 5247068 5247087 5247071 -
tcccctcgtcccctatgttt

SEQ ID NO: 46494 - DNA, 20 bp, Artificial Sequence
  Synthetic oligonucleotide; AAG chr11 5247033 5247052 5247036 -
actctactactctcatctat

SEQ ID NO: 46495 - DNA, 20 bp, Artificial Sequence
  Synthetic oligonucleotide; AAG chr11 5247019 5247038 5247022 -
atctataagacccaaataat

SEQ ID NO: 46496 - DNA, 20 bp, Artificial Sequence
  Synthetic oligonucleotide; TAG chr11 5246958 5246977 5246961 -
tacttcaacatgctttactc

SEQ ID NO: 46497 - DNA, 20 bp, Artificial Sequence
  Synthetic oligonucleotide; CAG chr11 5246935 5246954 5246938 -
ccttgtaatgtctttacata

SEQ ID NO: 46498 - DNA, 20 bp, Artificial Sequence
  Synthetic oligonucleotide; AAG chr11 5246923 5246942 5246926 -
tttacatacagtgaaatgta

SEQ ID NO: 46499 - DNA, 20 bp, Artificial Sequence
  Synthetic oligonucleotide; CAG chr11 5246883 5246902 5246886 -
ctttctttcttttttctcct

SEQ ID NO: 46500 - DNA, 20 bp, Artificial Sequence
  Synthetic oligonucleotide; CAG chr11 5246877 5246896 5246880 -
ttcttttttctcctcagcct

SEQ ID NO: 46501 - DNA, 20 bp, Artificial Sequence
  Synthetic oligonucleotide; TGG chr11 5246870 5246889 5246873 -
ttctcctcagcctcagaatt

SEQ ID NO: 46502 - DNA, 20 bp, Artificial Sequence
  Synthetic oligonucleotide; CAG chr11 5246848 5246867 5246851 -
gcacatgcccttccttcttt

SEQ ID NO: 46503 - DNA, 20 bp, Artificial Sequence
  Synthetic oligonucleotide; AGG chr11 5246847 5246866 5246850 -
cacatgcccttccttctttc

SEQ ID NO: 46504 - DNA, 20 bp, Artificial Sequence
  Synthetic oligonucleotide; TGG chr11 5246823 5246842 5246826 -
acttctccaacatctctgcc

SEQ ID NO: 46505 - DNA, 20 bp, Artificial Sequence
  Synthetic oligonucleotide; AAG chr11 5246805 5246824 5246808 -
cctggctccatcatatcata

SEQ ID NO: 46506 - DNA, 20 bp, Artificial Sequence
  Synthetic oligonucleotide; AGG chr11 5246804 5246823 5246807 -
ctggctccatcatatcataa

SEQ ID NO: 46507 - DNA, 20 bp, Artificial Sequence
  Synthetic oligonucleotide; CAG chr11 5246787 5246806 5246790 -
taaaggtcccacttcaaatg

SEQ ID NO: 46508 - DNA, 20 bp, Artificial Sequence
  Synthetic oligonucleotide; CAG chr11 5246772 5246791 5246775 -
aaatgcagtcactaccgttt

SEQ ID NO: 46509 - DNA, 20 bp, Artificial Sequence
  Synthetic oligonucleotide; AAG chr11 5246730 5246749 5246733 -
ttttgttttttgtttttttt

SEQ ID NO: 46510 - DNA, 20 bp, Artificial Sequence
  Synthetic oligonucleotide; AAG chr11 5246724 5246743 5246727 -
tttttgttttttttaagtca

SEQ ID NO: 46511 - DNA, 20 bp, Artificial Sequence
  Synthetic oligonucleotide; GAG chr11 5246711 5246730 5246714 -
taagtcaaagcaaatttctt

SEQ ID NO: 46512 - DNA, 20 bp, Artificial Sequence
  Synthetic oligonucleotide; GAG chr11 5246709 5246728 5246712 -
agtcaaagcaaatttcttga

SEQ ID NO: 46513 - DNA, 20 bp, Artificial Sequence
  Synthetic oligonucleotide; GAG chr11 5246707 5246726 5246710 -
tcaaagcaaatttcttgaga

SEQ ID NO: 46514 - DNA, 20 bp, Artificial Sequence
  Synthetic oligonucleotide; AAG chr11 5246702 5246721 5246705 -
gcaaatttcttgagagagta

SEQ ID NO: 46515 - DNA, 20 bp, Artificial Sequence
  Synthetic oligonucleotide; TAG chr11 5246677 5246696 5246680 -
ataaacgaatgactactgca

SEQ ID NO: 46516 - DNA, 20 bp, Artificial Sequence
  Synthetic oligonucleotide; AGG chr11 5246676 5246695 5246679 -
taaacgaatgactactgcat

SEQ ID NO: 46517 - DNA, 20 bp, Artificial Sequence
  Synthetic oligonucleotide; CAG chr11 5246673 5246692 5246676 -
acgaatgactactgcatagg

SEQ ID NO: 46518 - DNA, 20 bp, Artificial Sequence
  Synthetic oligonucleotide; GAG chr11 5246671 5246690 5246674 -
gaatgactactgcataggca

SEQ ID NO: 46519 - DNA, 20 bp, Artificial Sequence
  Synthetic oligonucleotide; CAG chr11 5246668 5246687 5246671 -
tgactactgcataggcagag

SEQ ID NO: 46520 - DNA, 20 bp, Artificial Sequence
  Synthetic oligonucleotide; GAG chr11 5246661 5246680 5246664 -
tgcataggcagagcagcccc

SEQ ID NO: 46521 - DNA, 20 bp, Artificial Sequence
  Synthetic oligonucleotide; AGG chr11 5246660 5246679 5246663 -
gcataggcagagcagccccg

SEQ ID NO: 46522 - DNA, 20 bp, Artificial Sequence
  Synthetic oligonucleotide; GGG chr11 5246659 5246678 5246662 -
cataggcagagcagccccga

SEQ ID NO: 46523 - DNA, 20 bp, Artificial Sequence
  Synthetic oligonucleotide; TGG chr11 5246652 5246671 5246655 -
agagcagccccgagggccgc

SEQ ID NO: 46524 - DNA, 20 bp, Artificial Sequence
  Synthetic oligonucleotide; TGG chr11 5246637 5246656 5246640 -
gccgctggttgttcctttta

SEQ ID NO: 46525 - DNA, 20 bp, Artificial Sequence
  Synthetic oligonucleotide; AAG chr11 5246610 5246629 5246613 -
ttcttgatgatatgttaaac

SEQ ID NO: 46526 - DNA, 20 bp, Artificial Sequence
  Synthetic oligonucleotide; TGG chr11 5246604 5246623 5246607 -
atgatatgttaaacaagttt

SEQ ID NO: 46527 - DNA, 20 bp, Artificial Sequence
  Synthetic oligonucleotide; TAG chr11 5246580 5246599 5246583 -
ttatttatgccttctctttt

SEQ ID NO: 46528 - DNA, 20 bp, Artificial Sequence
  Synthetic oligonucleotide; AGG chr11 5246579 5246598 5246582 -
tatttatgccttctcttttt

SEQ ID NO: 46529 - DNA, 20 bp, Artificial Sequence
  Synthetic oligonucleotide; TAG chr11 5246571 5246590 5246574 -
ccttctctttttaggccata

SEQ ID NO: 46530 - DNA, 20 bp, Artificial Sequence
  Synthetic oligonucleotide; AGG chr11 5246570 5246589 5246573 -
cttctctttttaggccatat

SEQ ID NO: 46531 - DNA, 20 bp, Artificial Sequence
  Synthetic oligonucleotide; GGG chr11 5246569 5246588 5246572 -
ttctctttttaggccatata

SEQ ID NO: 46532 - DNA, 20 bp, Artificial Sequence
  Synthetic oligonucleotide; TGG chr11 5246547 5246566 5246550 -
gtaactttctgacattgcca

SEQ ID NO: 46533 - DNA, 20 bp, Artificial Sequence
  Synthetic oligonucleotide; CAG chr11 5246506 5246525 5246509 -
atttactgttaccttaaatt

SEQ ID NO: 46534 - DNA, 20 bp, Artificial Sequence
  Synthetic oligonucleotide; AGG chr11 5246505 5246524 5246508 -
tttactgttaccttaaattc

SEQ ID NO: 46535 - DNA, 20 bp, Artificial Sequence
  Synthetic oligonucleotide; GGG chr11 5246504 5246523 5246507 -
ttactgttaccttaaattca

SEQ ID NO: 46536 - DNA, 20 bp, Artificial Sequence
  Synthetic oligonucleotide; GGG chr11 5246503 5246522 5246506 -
tactgttaccttaaattcag

SEQ ID NO: 46537 - DNA, 20 bp, Artificial Sequence
  Synthetic oligonucleotide; CAG chr11 5246492 5246511 5246495 -
taaattcaggggtacacgta

SEQ ID NO: 46538 - DNA, 20 bp, Artificial Sequence
  Synthetic oligonucleotide; AGG chr11 5246491 5246510 5246494 -
aaattcaggggtacacgtac

SEQ ID NO: 46539 - DNA, 20 bp, Artificial Sequence
  Synthetic oligonucleotide; CAG chr11 5246483 5246502 5246486 -
gggtacacgtacaggatatg

SEQ ID NO: 46540 - DNA, 20 bp, Artificial Sequence
  Synthetic oligonucleotide; AGG chr11 5246482 5246501 5246485 -
ggtacacgtacaggatatgc

SEQ ID NO: 46541 - DNA, 20 bp, Artificial Sequence
  Synthetic oligonucleotide; TAG chr11 5246470 5246489 5246473 -
ggatatgcaggtttgtttta

SEQ ID NO: 46542 - DNA, 20 bp, Artificial Sequence
  Synthetic oligonucleotide; AGG chr11 5246469 5246488 5246472 -
gatatgcaggtttgttttat

SEQ ID NO: 46543 - DNA, 20 bp, Artificial Sequence
  Synthetic oligonucleotide; AAG chr11 5246463 5246482 5246466 -
caggtttgttttataggtaa

SEQ ID NO: 46544 - DNA, 20 bp, Artificial Sequence
  Synthetic oligonucleotide; TGG chr11 5246453 5246472 5246456 -
ttataggtaaaagtgtgcca

SEQ ID NO: 46545 - DNA, 20 bp, Artificial Sequence
  Synthetic oligonucleotide; TGG chr11 5246444 5246463 5246447 -
aaagtgtgccatggttttaa

SEQ ID NO: 46546 - DNA, 20 bp, Artificial Sequence
  Synthetic oligonucleotide; GGG chr11 5246443 5246462 5246446 -
aagtgtgccatggttttaat

SEQ ID NO: 46547 - DNA, 20 bp, Artificial Sequence
  Synthetic oligonucleotide; AAG chr11 5246424 5246443 5246427 -
tgggttttttttttcttgta

SEQ ID NO: 46548 - DNA, 20 bp, Artificial Sequence
  Synthetic oligonucleotide; AAG chr11 5246415 5246434 5246418 -
tttttcttgtaaagttgttt

SEQ ID NO: 46549 - DNA, 20 bp, Artificial Sequence
  Synthetic oligonucleotide; TGG chr11 5246398 5246417 5246401 -
tttaagtttcttgtttactc

SEQ ID NO: 46550 - DNA, 20 bp, Artificial Sequence
  Synthetic oligonucleotide; TAG chr11 5246391 5246410 5246394 -
ttcttgtttactctggatat

SEQ ID NO: 46551 - DNA, 20 bp, Artificial Sequence
  Synthetic oligonucleotide; AGG chr11 5246390 5246409 5246393 -
tcttgtttactctggatatt

SEQ ID NO: 46552 - DNA, 20 bp, Artificial Sequence
  Synthetic oligonucleotide; CAG chr11 5246380 5246399 5246383 -
tctggatattaggcctttgt

SEQ ID NO: 46553 - DNA, 20 bp, Artificial Sequence
  Synthetic oligonucleotide; AAG chr11 5246377 5246396 5246380 -
ggatattaggcctttgtcag

SEQ ID NO: 46554 - DNA, 20 bp, Artificial Sequence
  Synthetic oligonucleotide; TAG chr11 5246372 5246391 5246375 -
ttaggcctttgtcagaagaa

SEQ ID NO: 46555 - DNA, 20 bp, Artificial Sequence
  Synthetic oligonucleotide; TGG chr11 5246367 5246386 5246370 -
cctttgtcagaagaatagat

SEQ ID NO: 46556 - DNA, 20 bp, Artificial Sequence
  Synthetic oligonucleotide; TAG chr11 5246344 5246363 5246347 -
aaaatctttttcccattctg

SEQ ID NO: 46557 - DNA, 20 bp, Artificial Sequence
  Synthetic oligonucleotide; TGG chr11 5246324 5246343 5246327 -
tagattgtctttcgctctga

SEQ ID NO: 46558 - DNA, 20 bp, Artificial Sequence
  Synthetic oligonucleotide; TAG chr11 5246321 5246340 5246324 -
attgtctttcgctctgatgg

SEQ ID NO: 46559 - DNA, 20 bp, Artificial Sequence
  Synthetic oligonucleotide; GAG chr11 5246307 5246326 5246310 -
tgatggtagtttcttttgct

SEQ ID NO: 46560 - DNA, 20 bp, Artificial Sequence
  Synthetic oligonucleotide; CAG chr11 5246304 5246323 5246307 -
tggtagtttcttttgctgag

SEQ ID NO: 46561 - DNA, 20 bp, Artificial Sequence
  Synthetic oligonucleotide; AGG chr11 5246303 5246322 5246306 -
ggtagtttcttttgctgagc

SEQ ID NO: 46562 - DNA, 20 bp, Artificial Sequence
  Synthetic oligonucleotide; GAG chr11 5246301 5246320 5246304 -
tagtttcttttgctgagcag

SEQ ID NO: 46563 - DNA, 20 bp, Artificial Sequence
  Synthetic oligonucleotide; TAG chr11 5246293 5246312 5246296 -
tttgctgagcaggagctctt

SEQ ID NO: 46564 - DNA, 20 bp, Artificial Sequence
  Synthetic oligonucleotide; TAG chr11 5246284 5246303 5246287 -
caggagctctttagtttaat

SEQ ID NO: 46565 - DNA, 20 bp, Artificial Sequence
  Synthetic oligonucleotide; TGG chr11 5246274 5246293 5246277 -
ttagtttaattagattccat

SEQ ID NO: 46566 - DNA, 20 bp, Artificial Sequence
  Synthetic oligonucleotide; TAG chr11 5246198 5246217 5246201 -
gcccgtgtttatatcatgaa

SEQ ID NO: 46567 - DNA, 20 bp, Artificial Sequence
  Synthetic oligonucleotide; TAG chr11 5246176 5246195 5246179 -
gtattgccttgatttttttc

SEQ ID NO: 46568 - DNA, 20 bp, Artificial Sequence
  Synthetic oligonucleotide; AGG chr11 5246175 5246194 5246178 -
tattgccttgatttttttct

SEQ ID NO: 46569 - DNA, 20 bp, Artificial Sequence
  Synthetic oligonucleotide; TAG chr11 5246165 5246184 5246168 -
atttttttctaggcttttta

SEQ ID NO: 46570 - DNA, 20 bp, Artificial Sequence
  Synthetic oligonucleotide; TGG chr11 5246160 5246179 5246163 -
tttctaggctttttatagtt

SEQ ID NO: 46571 - DNA, 20 bp, Artificial Sequence
  Synthetic oligonucleotide; GGG chr11 5246159 5246178 5246162 -
ttctaggctttttatagttt

SEQ ID NO: 46572 - DNA, 20 bp, Artificial Sequence
  Synthetic oligonucleotide; GGG chr11 5246158 5246177 5246161 -
tctaggctttttatagtttg

SEQ ID NO: 46573 - DNA, 20 bp, Artificial Sequence
  Synthetic oligonucleotide; AAG chr11 5246145 5246164 5246148 -
tagtttggggtttttcattt

SEQ ID NO: 46574 - DNA, 20 bp, Artificial Sequence
  Synthetic oligonucleotide; TGG chr11 5246129 5246148 5246132 -
atttaagtctctaatccatc

SEQ ID NO: 46575 - DNA, 20 bp, Artificial Sequence
  Synthetic oligonucleotide; GAG chr11 5246127 5246146 5246130 -
ttaagtctctaatccatctg

SEQ ID NO: 46576 - DNA, 20 bp, Artificial Sequence
  Synthetic oligonucleotide; TGG chr11 5246117 5246136 5246120 -
aatccatctggagttaattt

SEQ ID NO: 46577 - DNA, 20 bp, Artificial Sequence
  Synthetic oligonucleotide; AAG chr11 5246112 5246131 5246115 -
atctggagttaattttggat

SEQ ID NO: 46578 - DNA, 20 bp, Artificial Sequence
  Synthetic oligonucleotide; AGG chr11 5246111 5246130 5246114 -
tctggagttaattttggata

SEQ ID NO: 46579 - DNA, 20 bp, Artificial Sequence
  Synthetic oligonucleotide; AAG chr11 5246105 5246124 5246108 -
gttaattttggataaggtat

SEQ ID NO: 46580 - DNA, 20 bp, Artificial Sequence
  Synthetic oligonucleotide; AGG chr11 5246104 5246123 5246107 -
ttaattttggataaggtata

SEQ ID NO: 46581 - DNA, 20 bp, Artificial Sequence
  Synthetic oligonucleotide; AAG chr11 5246101 5246120 5246104 -
attttggataaggtataagg

SEQ ID NO: 46582 - DNA, 20 bp, Artificial Sequence
  Synthetic oligonucleotide; AGG chr11 5246100 5246119 5246103 -
ttttggataaggtataagga

SEQ ID NO: 46583 - DNA, 20 bp, Artificial Sequence
  Synthetic oligonucleotide; GAG chr11 5246098 5246117 5246101 -
ttggataaggtataaggaag

SEQ ID NO: 46584 - DNA, 20 bp, Artificial Sequence
  Synthetic oligonucleotide; CAG chr11 5246093 5246112 5246096 -
taaggtataaggaaggagtc

SEQ ID NO: 46585 - DNA, 20 bp, Artificial Sequence
  Synthetic oligonucleotide; CAG chr11 5246080 5246099 5246083 -
aggagtccagtttcattttt

SEQ ID NO: 46586 - DNA, 20 bp, Artificial Sequence
  Synthetic oligonucleotide; TGG chr11 5246073 5246092 5246076 -
cagtttcatttttcagcata

SEQ ID NO: 46587 - DNA, 20 bp, Artificial Sequence
  Synthetic oligonucleotide; TAG chr11 5246069 5246088 5246072 -
ttcatttttcagcatatggc

SEQ ID NO: 46588 - DNA, 20 bp, Artificial Sequence
  Synthetic oligonucleotide; CAG chr11 5246065 5246084 5246068 -
tttttcagcatatggctagc

SEQ ID NO: 46589 - DNA, 20 bp, Artificial Sequence
  Synthetic oligonucleotide; CAG chr11 5246008 5246027 5246011 -
tccccattgcttgcttttgt

SEQ ID NO: 46590 - DNA, 20 bp, Artificial Sequence
  Synthetic oligonucleotide; AGG chr11 5246007 5246026 5246010 -
ccccattgcttgcttttgtc

SEQ ID NO: 46591 - DNA, 20 bp, Artificial Sequence
  Synthetic oligonucleotide; AAG chr11 5245997 5246016 5246000 -
tgcttttgtcaggtttctaa

SEQ ID NO: 46592 - DNA, 20 bp, Artificial Sequence
  Synthetic oligonucleotide; CAG chr11 5245992 5246011 5245995 -
ttgtcaggtttctaaaagac

SEQ ID NO: 46593 - DNA, 20 bp, Artificial Sequence
  Synthetic oligonucleotide; TGG chr11 5245988 5246007 5245991 -
caggtttctaaaagaccaga

SEQ ID NO: 46594 - DNA, 20 bp, Artificial Sequence
  Synthetic oligonucleotide; TAG chr11 5245982 5246001 5245985 -
tctaaaagaccagatggttg

SEQ ID NO: 46595 - DNA, 20 bp, Artificial Sequence
  Synthetic oligonucleotide; AGG chr11 5245981 5246000 5245984 -
ctaaaagaccagatggttgt

SEQ ID NO: 46596 - DNA, 20 bp, Artificial Sequence
  Synthetic oligonucleotide; CAG chr11 5245969 5245988 5245972 -
atggttgtaggtacaatatg

SEQ ID NO: 46597 - DNA, 20 bp, Artificial Sequence
  Synthetic oligonucleotide; AAG chr11 5245959 5245978 5245962 -
gtacaatatgcagtttcttc

SEQ ID NO: 46598 - DNA, 20 bp, Artificial Sequence
  Synthetic oligonucleotide; TAG chr11 5245914 5245933 5245917 -
tcttattaattcatttcttt

SEQ ID NO: 46599 - DNA, 20 bp, Artificial Sequence
  Synthetic oligonucleotide; TGG chr11 5245902 5245921 5245905 -
atttcttttagtatgtatgc

SEQ ID NO: 46600 - DNA, 20 bp, Artificial Sequence
  Synthetic oligonucleotide; TAG chr11 5245883 5245902 5245886 -
ctggtctcctctgctcacta

SEQ ID NO: 46601 - DNA, 20 bp, Artificial Sequence
  Synthetic oligonucleotide; GAG chr11 5245879 5245898 5245882 -
tctcctctgctcactatagt

SEQ ID NO: 46602 - DNA, 20 bp, Artificial Sequence
  Synthetic oligonucleotide; AGG chr11 5245878 5245897 5245881 -
ctcctctgctcactatagtg

SEQ ID NO: 46603 - DNA, 20 bp, Artificial Sequence
  Synthetic oligonucleotide; GGG chr11 5245877 5245896 5245880 -
tcctctgctcactatagtga

SEQ ID NO: 46604 - DNA, 20 bp, Artificial Sequence
  Synthetic oligonucleotide; TAG chr11 5245868 5245887 5245871 -
cactatagtgagggcaccat

SEQ ID NO: 46605 - DNA, 20 bp, Artificial Sequence
  Synthetic oligonucleotide; CAG chr11 5245864 5245883 5245867 -
atagtgagggcaccattagc

SEQ ID NO: 46606 - DNA, 20 bp, Artificial Sequence
  Synthetic oligonucleotide; GAG chr11 5245862 5245881 5245865 -
agtgagggcaccattagcca

SEQ ID NO: 46607 - DNA, 20 bp, Artificial Sequence
  Synthetic oligonucleotide; TAG chr11 5245847 5245866 5245850 -
agccagagaatctgtctgtc

SEQ ID NO: 46608 - DNA, 20 bp, Artificial Sequence
  Synthetic oligonucleotide; AAG chr11 5245837 5245856 5245840 -
tctgtctgtctagttcatgt

SEQ ID NO: 46609 - DNA, 20 bp, Artificial Sequence
  Synthetic oligonucleotide; CAG chr11 5245829 5245848 5245832 -
tctagttcatgtaagattct

SEQ ID NO: 46610 - DNA, 20 bp, Artificial Sequence
  Synthetic oligonucleotide; AAG chr11 5245822 5245841 5245825 -
catgtaagattctcagaatt

SEQ ID NO: 46611 - DNA, 20 bp, Artificial Sequence
  Synthetic oligonucleotide; TGG chr11 5245814 5245833 5245817 -
attctcagaattaagaaaaa

SEQ ID NO: 46612 - DNA, 20 bp, Artificial Sequence
  Synthetic oligonucleotide; TGG chr11 5245810 5245829 5245813 -
tcagaattaagaaaaatgga

SEQ ID NO: 46613 - DNA, 20 bp, Artificial Sequence
  Synthetic oligonucleotide; TGG chr11 5245789 5245808 5245792 -
ggcatatgaatgaaacttca

SEQ ID NO: 46614 - DNA, 20 bp, Artificial Sequence
  Synthetic oligonucleotide; TGG chr11 5245778 5245797 5245781 -
gaaacttcatggatgacata

SEQ ID NO: 46615 - DNA, 20 bp, Artificial Sequence
  Synthetic oligonucleotide; AAG chr11 5245744 5245763 5245747 -
tatttgttgaattaatgcat

SEQ ID NO: 46616 - DNA, 20 bp, Artificial Sequence
  Synthetic oligonucleotide; CAG chr11 5245735 5245754 5245738 -
aattaatgcataagatgcaa

SEQ ID NO: 46617 - DNA, 20 bp, Artificial Sequence
  Synthetic oligonucleotide; GAG chr11 5245733 5245752 5245736 -
ttaatgcataagatgcaaca

SEQ ID NO: 46618 - DNA, 20 bp, Artificial Sequence
  Synthetic oligonucleotide; GAG chr11 5245731 5245750 5245734 -
aatgcataagatgcaacaga

SEQ ID NO: 46619 - DNA, 20 bp, Artificial Sequence
  Synthetic oligonucleotide; AAG chr11 5245728 5245747 5245731 -
gcataagatgcaacagagag

SEQ ID NO: 46620 - DNA, 20 bp, Artificial Sequence
  Synthetic oligonucleotide; TGG chr11 5245704 5245723 5245707 -
tgacaactgcaatgataacc

SEQ ID NO: 46621 - DNA, 20 bp, Artificial Sequence
  Synthetic oligonucleotide; AAG chr11 5245689 5245708 5245692 -
taacctggtattgatgatat

SEQ ID NO: 46622 - DNA, 20 bp, Artificial Sequence
  Synthetic oligonucleotide; GAG chr11 5245687 5245706 5245690 -
acctggtattgatgatataa

SEQ ID NO: 46623 - DNA, 20 bp, Artificial Sequence
  Synthetic oligonucleotide; TAG chr11 5245680 5245699 5245683 -
attgatgatataagagtcta

SEQ ID NO: 46624 - DNA, 20 bp, Artificial Sequence
  Synthetic oligonucleotide; CAG chr11 5245673 5245692 5245676 -
atataagagtctatagatca

SEQ ID NO: 46625 - DNA, 20 bp, Artificial Sequence
  Synthetic oligonucleotide; TAG chr11 5245670 5245689 5245673 -
taagagtctatagatcacag

SEQ ID NO: 46626 - DNA, 20 bp, Artificial Sequence
  Synthetic oligonucleotide; AAG chr11 5245667 5245686 5245670 -
gagtctatagatcacagtag

SEQ ID NO: 46627 - DNA, 20 bp, Artificial Sequence
  Synthetic oligonucleotide; TGG chr11 5245655 5245674 5245658 -
cacagtagaagcaataatca

SEQ ID NO: 46628 - DNA, 20 bp, Artificial Sequence
  Synthetic oligonucleotide; TGG chr11 5245644 5245663 5245647 -
caataatcatggaaaacaat

SEQ ID NO: 46629 - DNA, 20 bp, Artificial Sequence
  Synthetic oligonucleotide; TGG chr11 5245638 5245657 5245641 -
tcatggaaaacaattggaaa

SEQ ID NO: 46630 - DNA, 20 bp, Artificial Sequence
  Synthetic oligonucleotide; GGG chr11 5245637 5245656 5245640 -
catggaaaacaattggaaat

SEQ ID NO: 46631 - DNA, 20 bp, Artificial Sequence
  Synthetic oligonucleotide; GGG chr11 5245636 5245655 5245639 -
atggaaaacaattggaaatg

SEQ ID NO: 46632 - DNA, 20 bp, Artificial Sequence
  Synthetic oligonucleotide; CAG chr11 5245631 5245650 5245634 -
aaacaattggaaatggggaa

SEQ ID NO: 46633 - DNA, 20 bp, Artificial Sequence
  Synthetic oligonucleotide; AAG chr11 5245620 5245639 5245623 -
aatggggaacagccacaaac

SEQ ID NO: 46634 - DNA, 20 bp, Artificial Sequence
  Synthetic oligonucleotide; AAG chr11 5245616 5245635 5245619 -
gggaacagccacaaacaaga

SEQ ID NO: 46635 - DNA, 20 bp, Artificial Sequence
  Synthetic oligonucleotide; CAG chr11 5245601 5245620 5245604 -
caagaaagaatcaatacttc

SEQ ID NO: 46636 - DNA, 20 bp, Artificial Sequence
  Synthetic oligonucleotide; AGG chr11 5245600 5245619 5245603 -
aagaaagaatcaatacttcc

SEQ ID NO: 46637 - DNA, 20 bp, Artificial Sequence
  Synthetic oligonucleotide; AAG chr11 5245596 5245615 5245599 -
aagaatcaatacttccagga

SEQ ID NO: 46638 - DNA, 20 bp, Artificial Sequence
  Synthetic oligonucleotide; CAG chr11 5245587 5245606 5245590 -
tacttccaggaaagtgactg

SEQ ID NO: 46639 - DNA, 20 bp, Artificial Sequence
  Synthetic oligonucleotide; AGG chr11 5245586 5245605 5245589 -
acttccaggaaagtgactgc

SEQ ID NO: 46640 - DNA, 20 bp, Artificial Sequence
  Synthetic oligonucleotide; TGG chr11 5245573 5245592 5245576 -
tgactgcaggtcacttttcc

SEQ ID NO: 46641 - DNA, 20 bp, Artificial Sequence
  Synthetic oligonucleotide; GAG chr11 5245571 5245590 5245574 -
actgcaggtcacttttcctg

SEQ ID NO: 46642 - DNA, 20 bp, Artificial Sequence
  Synthetic oligonucleotide; CGG chr11 5245568 5245587 5245571 -
gcaggtcacttttcctggag

SEQ ID NO: 46643 - DNA, 20 bp, Artificial Sequence
  Synthetic oligonucleotide; GGG chr11 5245567 5245586 5245570 -
caggtcacttttcctggagc

SEQ ID NO: 46644 - DNA, 20 bp, Artificial Sequence
  Synthetic oligonucleotide; GAG chr11 5245563 5245582 5245566 -
tcacttttcctggagcgggt

SEQ ID NO: 46645 - DNA, 20 bp, Artificial Sequence
  Synthetic oligonucleotide; GAG chr11 5245561 5245580 5245564 -
acttttcctggagcgggtga

SEQ ID NO: 46646 - DNA, 20 bp, Artificial Sequence
  Synthetic oligonucleotide; AAG chr11 5245556 5245575 5245559 -
tcctggagcgggtgagagaa

SEQ ID NO: 46647 - DNA, 20 bp, Artificial Sequence
  Synthetic oligonucleotide; TGG chr11 5245553 5245572 5245556 -
tggagcgggtgagagaaaag

SEQ ID NO: 46648 - DNA, 20 bp, Artificial Sequence
  Synthetic oligonucleotide; AAG chr11 5245550 5245569 5245553 -
agcgggtgagagaaaagtgg

SEQ ID NO: 46649 - DNA, 20 bp, Artificial Sequence
  Synthetic oligonucleotide; TAG chr11 5245546 5245565 5245549 -
ggtgagagaaaagtggaagt

SEQ ID NO: 46650 - DNA, 20 bp, Artificial Sequence
  Synthetic oligonucleotide; CAG chr11 5245543 5245562 5245546 -
gagagaaaagtggaagttag

SEQ ID NO: 46651 - DNA, 20 bp, Artificial Sequence
  Synthetic oligonucleotide; TGG chr11 5245525 5245544 5245528 -
agcagtaactgctgaattcc

SEQ ID NO: 46652 - DNA, 20 bp, Artificial Sequence
  Synthetic oligonucleotide; TGG chr11 5245521 5245540 5245524 -
gtaactgctgaattcctggt

SEQ ID NO: 46653 - DNA, 20 bp, Artificial Sequence
  Synthetic oligonucleotide; TGG chr11 5245514 5245533 5245517 -
ctgaattcctggttggctga

SEQ ID NO: 46654 - DNA, 20 bp, Artificial Sequence
  Synthetic oligonucleotide; AAG chr11 5245510 5245529 5245513 -
attcctggttggctgatgga

SEQ ID NO: 46655 - DNA, 20 bp, Artificial Sequence
  Synthetic oligonucleotide; TGG chr11 5245506 5245525 5245509 -
ctggttggctgatggaaaga

SEQ ID NO: 46656 - DNA, 20 bp, Artificial Sequence
  Synthetic oligonucleotide; GGG chr11 5245505 5245524 5245508 -
tggttggctgatggaaagat

SEQ ID NO: 46657 - DNA, 20 bp, Artificial Sequence
  Synthetic oligonucleotide; GGG chr11 5245504 5245523 5245507 -
ggttggctgatggaaagatg

SEQ ID NO: 46658 - DNA, 20 bp, Artificial Sequence
  Synthetic oligonucleotide; CAG chr11 5245501 5245520 5245504 -
tggctgatggaaagatgggg

SEQ ID NO: 46659 - DNA, 20 bp, Artificial Sequence
  Synthetic oligonucleotide; TGG chr11 5245490 5245509 5245493 -
aagatggggcagctgttcac

SEQ ID NO: 46660 - DNA, 20 bp, Artificial Sequence
  Synthetic oligonucleotide; CAG chr11 5245483 5245502 5245486 -
ggcagctgttcactggtacg

SEQ ID NO: 46661 - DNA, 20 bp, Artificial Sequence
  Synthetic oligonucleotide; AGG chr11 5245482 5245501 5245485 -
gcagctgttcactggtacgc

SEQ ID NO: 46662 - DNA, 20 bp, Artificial Sequence
  Synthetic oligonucleotide; GGG chr11 5245481 5245500 5245484 -
cagctgttcactggtacgca

SEQ ID NO: 46663 - DNA, 20 bp, Artificial Sequence
  Synthetic oligonucleotide; TAG chr11 5245475 5245494 5245478 -
ttcactggtacgcagggttt

SEQ ID NO: 46664 - DNA, 20 bp, Artificial Sequence
  Synthetic oligonucleotide; AAG chr11 5245460 5245479 5245463 -
ggttttagatgtatgtacct

SEQ ID NO: 46665 - DNA, 20 bp, Artificial Sequence
  Synthetic oligonucleotide; AGG chr11 5245459 5245478 5245462 -
gttttagatgtatgtaccta

SEQ ID NO: 46666 - DNA, 20 bp, Artificial Sequence
  Synthetic oligonucleotide; GAG chr11 5245452 5245471 5245455 -
atgtatgtacctaaggatat

SEQ ID NO: 46667 - DNA, 20 bp, Artificial Sequence
  Synthetic oligonucleotide; AGG chr11 5245451 5245470 5245454 -
tgtatgtacctaaggatatg

SEQ ID NO: 46668 - DNA, 20 bp, Artificial Sequence
  Synthetic oligonucleotide; TGG chr11 5245446 5245465 5245449 -
gtacctaaggatatgaggta

SEQ ID NO: 46669 - DNA, 20 bp, Artificial Sequence
  Synthetic oligonucleotide; CAG chr11 5245436 5245455 5245439 -
atatgaggtatggcaatgaa

SEQ ID NO: 46670 - DNA, 20 bp, Artificial Sequence
  Synthetic oligonucleotide; TGG chr11 5245424 5245443 5245427 -
gcaatgaacagaaattcttt

SEQ ID NO: 46671 - DNA, 20 bp, Artificial Sequence
  Synthetic oligonucleotide; GGG chr11 5245423 5245442 5245426 -
caatgaacagaaattctttt

SEQ ID NO: 46672 - DNA, 20 bp, Artificial Sequence
  Synthetic oligonucleotide; GAG chr11 5245417 5245436 5245420 -
acagaaattcttttgggaat

SEQ ID NO: 46673 - DNA, 20 bp, Artificial Sequence
  Synthetic oligonucleotide; TAG chr11 5245411 5245430 5245414 -
attcttttgggaatgagttt

SEQ ID NO: 46674 - DNA, 20 bp, Artificial Sequence
  Synthetic oligonucleotide; AGG chr11 5245410 5245429 5245413 -
ttcttttgggaatgagtttt

SEQ ID NO: 46675 - DNA, 20 bp, Artificial Sequence
  Synthetic oligonucleotide; GGG chr11 5245409 5245428 5245412 -
tcttttgggaatgagtttta

SEQ ID NO: 46676 - DNA, 20 bp, Artificial Sequence
  Synthetic oligonucleotide; AAG chr11 5245400 5245419 5245403 -
aatgagttttagggccatta

SEQ ID NO: 46677 - DNA, 20 bp, Artificial Sequence
  Synthetic oligonucleotide; AGG chr11 5245399 5245418 5245402 -
atgagttttagggccattaa

SEQ ID NO: 46678 - DNA, 20 bp, Artificial Sequence
  Synthetic oligonucleotide; AAG chr11 5245386 5245405 5245389 -
ccattaaaggacatgacctg

SEQ ID NO: 46679 - DNA, 20 bp, Artificial Sequence
  Synthetic oligonucleotide; GAG chr11 5245375 5245394 5245378 -
catgacctgaagtttcctct

SEQ ID NO: 46680 - DNA, 20 bp, Artificial Sequence
  Synthetic oligonucleotide; AGG chr11 5245374 5245393 5245377 -
atgacctgaagtttcctctg

SEQ ID NO: 46681 - DNA, 20 bp, Artificial Sequence
  Synthetic oligonucleotide; CAG chr11 5245370 5245389 5245373 -
cctgaagtttcctctgaggc

SEQ ID NO: 46682 - DNA, 20 bp, Artificial Sequence
  Synthetic oligonucleotide; TAG chr11 5245332 5245351 5245335 -
ataaatgtgtttcctgcata

SEQ ID NO: 46683 - DNA, 20 bp, Artificial Sequence
  Synthetic oligonucleotide; AAG chr11 5245326 5245345 5245329 -
gtgtttcctgcatatagtca

SEQ ID NO: 46684 - DNA, 20 bp, Artificial Sequence
  Synthetic oligonucleotide; AAG chr11 5245282 5245301 5245285 -
atcatcgatctctgctctta

SEQ ID NO: 46685 - DNA, 20 bp, Artificial Sequence
  Synthetic oligonucleotide; TGG chr11 5245272 5245291 5245275 -
tctgctcttaaagataatct

SEQ ID NO: 46686 - DNA, 20 bp, Artificial Sequence
  Synthetic oligonucleotide; AAG chr11 5245224 5245243 5245227 -
caaactttccccatgttcct

SEQ ID NO: 46687 - DNA, 20 bp, Artificial Sequence
  Synthetic oligonucleotide; CAG chr11 5245216 5245235 5245219 -
ccccatgttcctaagtaaaa

SEQ ID NO: 46688 - DNA, 20 bp, Artificial Sequence
  Synthetic oligonucleotide; AGG chr11 5245215 5245234 5245218 -
cccatgttcctaagtaaaac

SEQ ID NO: 46689 - DNA, 20 bp, Artificial Sequence
  Synthetic oligonucleotide; AAG chr11 5245191 5245210 5245194 -
aactgcctctcaactatatc

SEQ ID NO: 46690 - DNA, 20 bp, Artificial Sequence
  Synthetic oligonucleotide; TAG chr11 5245188 5245207 5245191 -
tgcctctcaactatatcaag

SEQ ID NO: 46691 - DNA, 20 bp, Artificial Sequence
  Synthetic oligonucleotide; CAG chr11 5245161 5245180 5245164 -
aaatattgtgtctctaatat

SEQ ID NO: 46692 - DNA, 20 bp, Artificial Sequence
  Synthetic oligonucleotide; CAG chr11 5245153 5245172 5245156 -
tgtctctaatatcagaaatt

SEQ ID NO: 46693 - DNA, 20 bp, Artificial Sequence
  Synthetic oligonucleotide; TGG chr11 5245139 5245158 5245142 -
gaaattcagctttaatatat

SEQ ID NO: 46694 - DNA, 20 bp, Artificial Sequence
  Synthetic oligonucleotide; GGG chr11 5245138 5245157 5245141 -
aaattcagctttaatatatt

SEQ ID NO: 46695 - DNA, 20 bp, Artificial Sequence
  Synthetic oligonucleotide; TAG chr11 5245118 5245137 5245121 -
gggtttaactctttgaaatt

SEQ ID NO: 46696 - DNA, 20 bp, Artificial Sequence
  Synthetic oligonucleotide; GAG chr11 5245116 5245135 5245119 -
gtttaactctttgaaattta

SEQ ID NO: 46697 - DNA, 20 bp, Artificial Sequence
  Synthetic oligonucleotide; TGG chr11 5245096 5245115 5245099 -
gagtctccttgaaatacaca

SEQ ID NO: 46698 - DNA, 20 bp, Artificial Sequence
  Synthetic oligonucleotide; GGG chr11 5245095 5245114 5245098 -
agtctccttgaaatacacat

SEQ ID NO: 46699 - DNA, 20 bp, Artificial Sequence
  Synthetic oligonucleotide; GGG chr11 5245094 5245113 5245097 -
gtctccttgaaatacacatg

SEQ ID NO: 46700 - DNA, 20 bp, Artificial Sequence
  Synthetic oligonucleotide; GGG chr11 5245093 5245112 5245096 -
tctccttgaaatacacatgg

SEQ ID NO: 46701 - DNA, 20 bp, Artificial Sequence
  Synthetic oligonucleotide; AAG chr11 5245065 5245084 5245068 -
tcctaaactttatttcttgt

SEQ ID NO: 46702 - DNA, 20 bp, Artificial Sequence
  Synthetic oligonucleotide; AGG chr11 5245064 5245083 5245067 -
cctaaactttatttcttgta

SEQ ID NO: 46703 - DNA, 20 bp, Artificial Sequence
  Synthetic oligonucleotide; CAG chr11 5245053 5245072 5245056 -
tttcttgtaaggatttatct

SEQ ID NO: 46704 - DNA, 20 bp, Artificial Sequence
  Synthetic oligonucleotide; AGG chr11 5245052 5245071 5245055 -
ttcttgtaaggatttatctc

SEQ ID NO: 46705 - DNA, 20 bp, Artificial Sequence
  Synthetic oligonucleotide; GGG chr11 5245051 5245070 5245054 -
tcttgtaaggatttatctca

SEQ ID NO: 46706 - DNA, 20 bp, Artificial Sequence
  Synthetic oligonucleotide; GGG chr11 5245050 5245069 5245053 -
cttgtaaggatttatctcag

SEQ ID NO: 46707 - DNA, 20 bp, Artificial Sequence
  Synthetic oligonucleotide; CAG chr11 5245035 5245054 5245038 -
ctcaggggtaacacacaaac

SEQ ID NO: 46708 - DNA, 20 bp, Artificial Sequence
  Synthetic oligonucleotide; AAG chr11 5245018 5245037 5245021 -
aaccagcatcctgaacctct

SEQ ID NO: 46709 - DNA, 20 bp, Artificial Sequence
  Synthetic oligonucleotide; GAG chr11 5245012 5245031 5245015 -
catcctgaacctctaagtat

SEQ ID NO: 46710 - DNA, 20 bp, Artificial Sequence
  Synthetic oligonucleotide; AGG chr11 5245011 5245030 5245014 -
atcctgaacctctaagtatg

SEQ ID NO: 46711 - DNA, 20 bp, Artificial Sequence
  Synthetic oligonucleotide; CAG chr11 5245007 5245026 5245010 -
tgaacctctaagtatgagga

SEQ ID NO: 46712 - DNA, 20 bp, Artificial Sequence
  Synthetic oligonucleotide; AAG chr11 5245003 5245022 5245006 -
cctctaagtatgaggacagt

SEQ ID NO: 46713 - DNA, 20 bp, Artificial Sequence
  Synthetic oligonucleotide; AAG chr11 5244996 5245015 5244999 -
gtatgaggacagtaagcctt

SEQ ID NO: 46714 - DNA, 20 bp, Artificial Sequence
  Synthetic oligonucleotide; CGG chr11 5244964 5244983 5244967 -
taaactgttcttctctctgc

SEQ ID NO: 46715 - DNA, 20 bp, Artificial Sequence
  Synthetic oligonucleotide; TGG chr11 5244961 5244980 5244964 -
actgttcttctctctgccgg

SEQ ID NO: 46716 - DNA, 20 bp, Artificial Sequence
  Synthetic oligonucleotide; AAG chr11 5244958 5244977 5244961 -
gttcttctctctgccggtgg

SEQ ID NO: 46717 - DNA, 20 bp, Artificial Sequence
  Synthetic oligonucleotide; GAG chr11 5244923 5244942 5244926 -
attcctgaaattgcttgttt

SEQ ID NO: 46718 - DNA, 20 bp, Artificial Sequence
  Synthetic oligonucleotide; GAG chr11 5244914 5244933 5244917 -
attgcttgtttgagacgcat

SEQ ID NO: 46719 - DNA, 20 bp, Artificial Sequence
  Synthetic oligonucleotide; CAG chr11 5244906 5244925 5244909 -
tttgagacgcatgagacgtg

SEQ ID NO: 46720 - DNA, 20 bp, Artificial Sequence
  Synthetic oligonucleotide; GAG chr11 5244898 5244917 5244901 -
gcatgagacgtgcagcacat

SEQ ID NO: 46721 - DNA, 20 bp, Artificial Sequence
  Synthetic oligonucleotide; CAG chr11 5244888 5244907 5244891 -
tgcagcacatgagacacgtg

SEQ ID NO: 46722 - DNA, 20 bp, Artificial Sequence
  Synthetic oligonucleotide; CAG chr11 5244885 5244904 5244888 -
agcacatgagacacgtgcag

SEQ ID NO: 46723 - DNA, 20 bp, Artificial Sequence
  Synthetic oligonucleotide; TGG chr11 5244878 5244897 5244881 -
gagacacgtgcagcagcctg

SEQ ID NO: 46724 - DNA, 20 bp, Artificial Sequence
  Synthetic oligonucleotide; CAG chr11 5244867 5244886 5244870 -
agcagcctgtggaatattgt

SEQ ID NO: 46725 - DNA, 20 bp, Artificial Sequence
  Synthetic oligonucleotide; AAG chr11 5244862 5244881 5244865 -
cctgtggaatattgtcagtg

SEQ ID NO: 46726 - DNA, 20 bp, Artificial Sequence
  Synthetic oligonucleotide; TAG chr11 5244843 5244862 5244846 -
gaagaatgtctttgcctgat

SEQ ID NO: 46727 - DNA, 20 bp, Artificial Sequence
  Synthetic oligonucleotide; AAG chr11 5244835 5244854 5244838 -
tctttgcctgattagatata

SEQ ID NO: 46728 - DNA, 20 bp, Artificial Sequence
  Synthetic oligonucleotide; AAG chr11 5244830 5244849 5244833 -
gcctgattagatataaagac

SEQ ID NO: 46729 - DNA, 20 bp, Artificial Sequence
  Synthetic oligonucleotide; CAG chr11 5244820 5244839 5244823 -
atataaagacaagttaaaca

SEQ ID NO: 46730 - DNA, 20 bp, Artificial Sequence
  Synthetic oligonucleotide; TAG chr11 5244814 5244833 5244817 -
agacaagttaaacacagcat

SEQ ID NO: 46731 - DNA, 20 bp, Artificial Sequence
  Synthetic oligonucleotide; TAG chr11 5244807 5244826 5244810 -
ttaaacacagcattagacta

SEQ ID NO: 46732 - DNA, 20 bp, Artificial Sequence
  Synthetic oligonucleotide; AAG chr11 5244801 5244820 5244804 -
acagcattagactatagatc

SEQ ID NO: 46733 - DNA, 20 bp, Artificial Sequence
  Synthetic oligonucleotide; CAG chr11 5244791 5244810 5244794 -
actatagatcaagcctgtgc

SEQ ID NO: 46734 - DNA, 20 bp, Artificial Sequence
  Synthetic oligonucleotide; CAG chr11 5244769 5244788 5244772 -
gacacaaatgacctaatgcc

SEQ ID NO: 46735 - DNA, 20 bp, Artificial Sequence
  Synthetic oligonucleotide; CGG chr11 5244764 5244783 5244767 -
aaatgacctaatgcccagca

SEQ ID NO: 46736 - DNA, 20 bp, Artificial Sequence
  Synthetic oligonucleotide; GGG chr11 5244763 5244782 5244766 -
aatgacctaatgcccagcac

SEQ ID NO: 46737 - DNA, 20 bp, Artificial Sequence
  Synthetic oligonucleotide; CGG chr11 5244757 5244776 5244760 -
ctaatgcccagcacgggcca

SEQ ID NO: 46738 - DNA, 20 bp, Artificial Sequence
  Synthetic oligonucleotide; CAG chr11 5244731 5244750 5244734 -
ctcctatcctcttgcttgaa

SEQ ID NO: 46739 - DNA, 20 bp, Artificial Sequence
  Synthetic oligonucleotide; GAG chr11 5244729 5244748 5244732 -
cctatcctcttgcttgaaca

SEQ ID NO: 46740 - DNA, 20 bp, Artificial Sequence
  Synthetic oligonucleotide; CAG chr11 5244726 5244745 5244729 -
atcctcttgcttgaacagag

SEQ ID NO: 46741 - DNA, 20 bp, Artificial Sequence
  Synthetic oligonucleotide; TAG chr11 5244701 5244720 5244704 -
cacttctcccccaacactat

SEQ ID NO: 46742 - DNA, 20 bp, Artificial Sequence
  Synthetic oligonucleotide; TGG chr11 5244692 5244711 5244695 -
cccaacactattagatgttc

SEQ ID NO: 46743 - DNA, 20 bp, Artificial Sequence
  Synthetic oligonucleotide; TAG chr11 5244679 5244698 5244682 -
gatgttctggcataattttg

SEQ ID NO: 46744 - DNA, 20 bp, Artificial Sequence
  Synthetic oligonucleotide; TAG chr11 5244671 5244690 5244674 -
ggcataattttgtagatatg

SEQ ID NO: 46745 - DNA, 20 bp, Artificial Sequence
  Synthetic oligonucleotide; AGG chr11 5244670 5244689 5244673 -
gcataattttgtagatatgt

SEQ ID NO: 46746 - DNA, 20 bp, Artificial Sequence
  Synthetic oligonucleotide; TGG chr11 5244659 5244678 5244662 -
tagatatgtaggatttgaca

SEQ ID NO: 46747 - DNA, 20 bp, Artificial Sequence
  Synthetic oligonucleotide; CAG chr11 5244639 5244658 5244642 -
tggactattgttcaatgatt

SEQ ID NO: 46748 - DNA, 20 bp, Artificial Sequence
  Synthetic oligonucleotide; GAG chr11 5244637 5244656 5244640 -
gactattgttcaatgattca

SEQ ID NO: 46749 - DNA, 20 bp, Artificial Sequence
  Synthetic oligonucleotide; AGG chr11 5244636 5244655 5244639 -
actattgttcaatgattcag

SEQ ID NO: 46750 - DNA, 20 bp, Artificial Sequence
  Synthetic oligonucleotide; CAG chr11 5244619 5244638 5244622 -
cagaggaaatctcctttgtt

SEQ ID NO: 46751 - DNA, 20 bp, Artificial Sequence
  Synthetic oligonucleotide; AAG chr11 5244614 5244633 5244617 -
gaaatctcctttgttcagat

SEQ ID NO: 46752 - DNA, 20 bp, Artificial Sequence
  Synthetic oligonucleotide; TGG chr11 5244595 5244614 5244598 -
taagtacactgactactaaa

SEQ ID NO: 46753 - DNA, 20 bp, Artificial Sequence
  Synthetic oligonucleotide; CAG chr11 5244581 5244600 5244584 -
actaaatggattaaaaaaca

SEQ ID NO: 46754 - DNA, 20 bp, Artificial Sequence
  Synthetic oligonucleotide; CAG chr11 5244568 5244587 5244571 -
aaaaacacagtaataaaacc

SEQ ID NO: 46755 - DNA, 20 bp, Artificial Sequence
  Synthetic oligonucleotide; TAG chr11 5244548 5244567 5244551 -
cagttttccccttacttccc

SEQ ID NO: 46756 - DNA, 20 bp, Artificial Sequence
  Synthetic oligonucleotide; AAG chr11 5244520 5244539 5244523 -
ttcttattctgctttcttcc

SEQ ID NO: 46757 - DNA, 20 bp, Artificial Sequence
  Synthetic oligonucleotide; TGG chr11 5244510 5244529 5244513 -
gctttcttccaagttgatgc

SEQ ID NO: 46758 - DNA, 20 bp, Artificial Sequence
  Synthetic oligonucleotide; TAG chr11 5244506 5244525 5244509 -
tcttccaagttgatgctgga

SEQ ID NO: 46759 - DNA, 20 bp, Artificial Sequence
  Synthetic oligonucleotide; GAG chr11 5244504 5244523 5244507 -
ttccaagttgatgctggata

SEQ ID NO: 46760 - DNA, 20 bp, Artificial Sequence
  Synthetic oligonucleotide; AGG chr11 5244503 5244522 5244506 -
tccaagttgatgctggatag

SEQ ID NO: 46761 - DNA, 20 bp, Artificial Sequence
  Synthetic oligonucleotide; AAG chr11 5244481 5244500 5244484 -
gtgtttatttctattctaaa

SEQ ID NO: 46762 - DNA, 20 bp, Artificial Sequence
  Synthetic oligonucleotide; TGG chr11 5244469 5244488 5244472 -
attctaaaaagtgatgaaat

SEQ ID NO: 46763 - DNA, 20 bp, Artificial Sequence
  Synthetic oligonucleotide; CGG chr11 5244465 5244484 5244468 -
taaaaagtgatgaaattggc

SEQ ID NO: 46764 - DNA, 20 bp, Artificial Sequence
  Synthetic oligonucleotide; GGG chr11 5244464 5244483 5244467 -
aaaaagtgatgaaattggcc

SEQ ID NO: 46765 - DNA, 20 bp, Artificial Sequence
  Synthetic oligonucleotide; CGG chr11 5244459 5244478 5244462 -
gtgatgaaattggccgggcg

SEQ ID NO: 46766 - DNA, 20 bp, Artificial Sequence
  Synthetic oligonucleotide; TGG chr11 5244456 5244475 5244459 -
atgaaattggccgggcgcgg

SEQ ID NO: 46767 - DNA, 20 bp, Artificial Sequence
  Synthetic oligonucleotide; CAG chr11 5244437 5244456 5244440 -
gtggctcacacctgtaatcc

SEQ ID NO: 46768 - DNA, 20 bp, Artificial Sequence
  Synthetic oligonucleotide; TGG chr11 5244429 5244448 5244432 -
cacctgtaatcccagcactt

SEQ ID NO: 46769 - DNA, 20 bp, Artificial Sequence
  Synthetic oligonucleotide; GGG chr11 5244428 5244447 5244431 -
acctgtaatcccagcacttt

SEQ ID NO: 46770 - DNA, 20 bp, Artificial Sequence
  Synthetic oligonucleotide; GAG chr11 5244426 5244445 5244429 -
ctgtaatcccagcactttgg

SEQ ID NO: 46771 - DNA, 20 bp, Artificial Sequence
  Synthetic oligonucleotide; AGG chr11 5244425 5244444 5244428 -
tgtaatcccagcactttggg

SEQ ID NO: 46772 - DNA, 20 bp, Artificial Sequence
  Synthetic oligonucleotide; GAG chr11 5244420 5244439 5244423 -
tcccagcactttgggaggct

SEQ ID NO: 46773 - DNA, 20 bp, Artificial Sequence
  Synthetic oligonucleotide; AGG chr11 5244419 5244438 5244422 -
cccagcactttgggaggctg

SEQ ID NO: 46774 - DNA, 20 bp, Artificial Sequence
  Synthetic oligonucleotide; TGG chr11 5244416 5244435 5244419 -
agcactttgggaggctgagg

SEQ ID NO: 46775 - DNA, 20 bp, Artificial Sequence
  Synthetic oligonucleotide; GGG chr11 5244415 5244434 5244418 -
gcactttgggaggctgaggt

SEQ ID NO: 46776 - DNA, 20 bp, Artificial Sequence
  Synthetic oligonucleotide; CGG chr11 5244412 5244431 5244415 -
ctttgggaggctgaggtggg

SEQ ID NO: 46777 - DNA, 20 bp, Artificial Sequence
  Synthetic oligonucleotide; GAG chr11 5244404 5244423 5244407 -
ggctgaggtgggcggatcac

SEQ ID NO: 46778 - DNA, 20 bp, Artificial Sequence
  Synthetic oligonucleotide; AGG chr11 5244403 5244422 5244406 -
gctgaggtgggcggatcacg

SEQ ID NO: 46779 - DNA, 20 bp, Artificial Sequence
  Synthetic oligonucleotide; CAG chr11 5244399 5244418 5244402 -
aggtgggcggatcacgaggt

SEQ ID NO: 46780 - DNA, 20 bp, Artificial Sequence
  Synthetic oligonucleotide; AGG chr11 5244398 5244417 5244401 -
ggtgggcggatcacgaggtc

SEQ ID NO: 46781 - DNA, 20 bp, Artificial Sequence
  Synthetic oligonucleotide; GAG chr11 5244396 5244415 5244399 -
tgggcggatcacgaggtcag

SEQ ID NO: 46782 - DNA, 20 bp, Artificial Sequence
  Synthetic oligonucleotide; AAG chr11 5244390 5244409 5244393 -
gatcacgaggtcaggagatc

SEQ ID NO: 46783 - DNA, 20 bp, Artificial Sequence
  Synthetic oligonucleotide; TGG chr11 5244380 5244399 5244383 -
tcaggagatcaagaccatcc

SEQ ID NO: 46784 - DNA, 20 bp, Artificial Sequence
  Synthetic oligonucleotide; TGG chr11 5244371 5244390 5244374 -
caagaccatcctggctaaca

SEQ ID NO: 46785 - DNA, 20 bp, Artificial Sequence
  Synthetic oligonucleotide; TAG chr11 5244335 5244354 5244338 -
ctactaaaaatacaaaaaat

SEQ ID NO: 46786 - DNA, 20 bp, Artificial Sequence
  Synthetic oligonucleotide; CAG chr11 5244331 5244350 5244334 -
taaaaatacaaaaaattagc

SEQ ID NO: 46787 - DNA, 20 bp, Artificial Sequence
  Synthetic oligonucleotide; GAG chr11 5244329 5244348 5244332 -
aaaatacaaaaaattagcca

SEQ ID NO: 46788 - DNA, 20 bp, Artificial Sequence
  Synthetic oligonucleotide; CAG chr11 5244325 5244344 5244328 -
tacaaaaaattagccagaga

SEQ ID NO: 46789 - DNA, 20 bp, Artificial Sequence
  Synthetic oligonucleotide; TGG chr11 5244322 5244341 5244325 -
aaaaaattagccagagacag

SEQ ID NO: 46790 - DNA, 20 bp, Artificial Sequence
  Synthetic oligonucleotide; CGG chr11 5244319 5244338 5244322 -
aaattagccagagacagtgg

SEQ ID NO: 46791 - DNA, 20 bp, Artificial Sequence
  Synthetic oligonucleotide; GGG chr11 5244318 5244337 5244321 -
aattagccagagacagtggc

SEQ ID NO: 46792 - DNA, 20 bp, Artificial Sequence
  Synthetic oligonucleotide; TAG chr11 5244309 5244328 5244312 -
gagacagtggcgggtgcctg

SEQ ID NO: 46793 - DNA, 20 bp, Artificial Sequence
  Synthetic oligonucleotide; CAG chr11 5244303 5244322 5244306 -
gtggcgggtgcctgtagtcc

SEQ ID NO: 46794 - DNA, 20 bp, Artificial Sequence
  Synthetic oligonucleotide; CGG chr11 5244295 5244314 5244298 -
tgcctgtagtcccagctact

SEQ ID NO: 46795 - DNA, 20 bp, Artificial Sequence
  Synthetic oligonucleotide; GGG chr11 5244294 5244313 5244297 -
gcctgtagtcccagctactc

SEQ ID NO: 46796 - DNA, 20 bp, Artificial Sequence
  Synthetic oligonucleotide; GAG chr11 5244292 5244311 5244295 -
ctgtagtcccagctactcgg

SEQ ID NO: 46797 - DNA, 20 bp, Artificial Sequence
  Synthetic oligonucleotide; AGG chr11 5244291 5244310 5244294 -
tgtagtcccagctactcggg

SEQ ID NO: 46798 - DNA, 20 bp, Artificial Sequence
  Synthetic oligonucleotide; GAG chr11 5244286 5244305 5244289 -
tcccagctactcgggaggct

SEQ ID NO: 46799 - DNA, 20 bp, Artificial Sequence
  Synthetic oligonucleotide; AGG chr11 5244285 5244304 5244288 -
cccagctactcgggaggctg

SEQ ID NO: 46800 - DNA, 20 bp, Artificial Sequence
  Synthetic oligonucleotide; CAG chr11 5244282 5244301 5244285 -
agctactcgggaggctgagg

SEQ ID NO: 46801 - DNA, 20 bp, Artificial Sequence
  Synthetic oligonucleotide; AGG chr11 5244281 5244300 5244284 -
gctactcgggaggctgaggc

SEQ ID NO: 46802 - DNA, 20 bp, Artificial Sequence
  Synthetic oligonucleotide; GAG chr11 5244279 5244298 5244282 -
tactcgggaggctgaggcag

SEQ ID NO: 46803 - DNA, 20 bp, Artificial Sequence
  Synthetic oligonucleotide; TGG chr11 5244274 5244293 5244277 -
gggaggctgaggcaggagaa

SEQ ID NO: 46804 - DNA, 20 bp, Artificial Sequence
  Synthetic oligonucleotide; TGG chr11 5244263 5244282 5244266 -
gcaggagaatggcgtgaacc

SEQ ID NO: 46805 - DNA, 20 bp, Artificial Sequence
  Synthetic oligonucleotide; GGG chr11 5244262 5244281 5244265 -
caggagaatggcgtgaacct

SEQ ID NO: 46806 - DNA, 20 bp, Artificial Sequence
  Synthetic oligonucleotide; GAG chr11 5244260 5244279 5244263 -
ggagaatggcgtgaacctgg

SEQ ID NO: 46807 - DNA, 20 bp, Artificial Sequence
  Synthetic oligonucleotide; AGG chr11 5244259 5244278 5244262 -
gagaatggcgtgaacctggg

SEQ ID NO: 46808 - DNA, 20 bp, Artificial Sequence
  Synthetic oligonucleotide; CAG chr11 5244256 5244275 5244259 -
aatggcgtgaacctgggagg

SEQ ID NO: 46809 - DNA, 20 bp, Artificial Sequence
  Synthetic oligonucleotide; GAG chr11 5244254 5244273 5244257 -
tggcgtgaacctgggaggca

SEQ ID NO: 46810 - DNA, 20 bp, Artificial Sequence
  Synthetic oligonucleotide; CGG chr11 5244247 5244266 5244250 -
aacctgggaggcagagcttg

SEQ ID NO: 46811 - DNA, 20 bp, Artificial Sequence
  Synthetic oligonucleotide; GAG chr11 5244243 5244262 5244246 -
tgggaggcagagcttgcggt

SEQ ID NO: 46812 - DNA, 20 bp, Artificial Sequence
  Synthetic oligonucleotide; CAG chr11 5244240 5244259 5244243 -
gaggcagagcttgcggtgag

SEQ ID NO: 46813 - DNA, 20 bp, Artificial Sequence
  Synthetic oligonucleotide; GAG chr11 5244238 5244257 5244241 -
ggcagagcttgcggtgagca

SEQ ID NO: 46814 - DNA, 20 bp, Artificial Sequence
  Synthetic oligonucleotide; CAG chr11 5244216 5244235 5244219 -
gatcgcgccactgcacactc

SEQ ID NO: 46815 - DNA, 20 bp, Artificial Sequence
  Synthetic oligonucleotide; TGG chr11 5244211 5244230 5244214 -
cgccactgcacactccagcc

SEQ ID NO: 46816 - DNA, 20 bp, Artificial Sequence
  Synthetic oligonucleotide; GGG chr11 5244210 5244229 5244213 -
gccactgcacactccagcct

SEQ ID NO: 46817 - DNA, 20 bp, Artificial Sequence
  Synthetic oligonucleotide; AAG chr11 5244202 5244221 5244205 -
acactccagcctgggtgaca

SEQ ID NO: 46818 - DNA, 20 bp, Artificial Sequence
  Synthetic oligonucleotide; GAG chr11 5244198 5244217 5244201 -
tccagcctgggtgacaaagc

SEQ ID NO: 46819 - DNA, 20 bp, Artificial Sequence
  Synthetic oligonucleotide; AAG chr11 5244167 5244186 5244170 -
tcaaaaaaaaaaaaaaaaaa

SEQ ID NO: 46820 - DNA, 20 bp, Artificial Sequence
  Synthetic oligonucleotide; AAG chr11 5244161 5244180 5244164 -
aaaaaaaaaaaaaaaagaaa

SEQ ID NO: 46821 - DNA, 20 bp, Artificial Sequence
  Synthetic oligonucleotide; AAG chr11 5244157 5244176 5244160 -
aaaaaaaaaaaagaaaaaga

SEQ ID NO: 46822 - DNA, 20 bp, Artificial Sequence
  Synthetic oligonucleotide; AAG chr11 5244153 5244172 5244156 -
aaaaaaaagaaaaagaaaga

SEQ ID NO: 46823 - DNA, 20 bp, Artificial Sequence
  Synthetic oligonucleotide; AAG chr11 5244149 5244168 5244152 -
aaaagaaaaagaaagaaaga

SEQ ID NO: 46824 - DNA, 20 bp, Artificial Sequence
  Synthetic oligonucleotide; TAG chr11 5244114 5244133 5244117 -
atgaaattgtgtattcaatg

SEQ ID NO: 46825 - DNA, 20 bp, Artificial Sequence
  Synthetic oligonucleotide; AAG chr11 5244107 5244126 5244110 -
tgtgtattcaatgtagtctc

SEQ ID NO: 46826 - DNA, 20 bp, Artificial Sequence
  Synthetic oligonucleotide; GAG chr11 5244105 5244124 5244108 -
tgtattcaatgtagtctcaa

SEQ ID NO: 46827 - DNA, 20 bp, Artificial Sequence
  Synthetic oligonucleotide; AAG chr11 5244091 5244110 5244094 -
tctcaagagaattgaaaacc

SEQ ID NO: 46828 - DNA, 20 bp, Artificial Sequence
  Synthetic oligonucleotide; AAG chr11 5244087 5244106 5244090 -
aagagaattgaaaaccaaga

SEQ ID NO: 46829 - DNA, 20 bp, Artificial Sequence
  Synthetic oligonucleotide; AGG chr11 5244086 5244105 5244089 -
agagaattgaaaaccaagaa

SEQ ID NO: 46830 - DNA, 20 bp, Artificial Sequence
  Synthetic oligonucleotide; TGG chr11 5244080 5244099 5244083 -
ttgaaaaccaagaaaggctg

SEQ ID NO: 46831 - DNA, 20 bp, Artificial Sequence
  Synthetic oligonucleotide; AAG chr11 5244064 5244083 5244067 -
gctgtggcttcttccacata

SEQ ID NO: 46832 - DNA, 20 bp, Artificial Sequence
  Synthetic oligonucleotide; TGG chr11 5244059 5244078 5244062 -
ggcttcttccacataaagcc

SEQ ID NO: 46833 - DNA, 20 bp, Artificial Sequence
  Synthetic oligonucleotide; CAG chr11 5244048 5244067 5244051 -
cataaagcctggatgaataa

SEQ ID NO: 46834 - DNA, 20 bp, Artificial Sequence
  Synthetic oligonucleotide; AGG chr11 5244047 5244066 5244050 -
ataaagcctggatgaataac

SEQ ID NO: 46835 - DNA, 20 bp, Artificial Sequence
  Synthetic oligonucleotide; CAG chr11 5244010 5244029 5244013 -
cattgtcacaactcctgatc

SEQ ID NO: 46836 - DNA, 20 bp, Artificial Sequence
  Synthetic oligonucleotide; AGG chr11 5244009 5244028 5244012 -
attgtcacaactcctgatcc

SEQ ID NO: 46837 - DNA, 20 bp, Artificial Sequence
  Synthetic oligonucleotide; TGG chr11 5244000 5244019 5244003 -
actcctgatccaggaattga

SEQ ID NO: 46838 - DNA, 20 bp, Artificial Sequence
  Synthetic oligonucleotide; AAG chr11 5243995 5244014 5243998 -
tgatccaggaattgatggct

SEQ ID NO: 46839 - DNA, 20 bp, Artificial Sequence
  Synthetic oligonucleotide; CAG chr11 5243969 5243988 5243972 -
ttcgtaattcttatcctttt

SEQ ID NO: 46840 - DNA, 20 bp, Artificial Sequence
  Synthetic oligonucleotide; CAG chr11 5243945 5243964 5243948 -
tgtaacttattcctatttgt

SEQ ID NO: 46841 - DNA, 20 bp, Artificial Sequence
  Synthetic oligonucleotide; CAG chr11 5243938 5243957 5243941 -
tattcctatttgtcagcatt

SEQ ID NO: 46842 - DNA, 20 bp, Artificial Sequence
  Synthetic oligonucleotide; AGG chr11 5243937 5243956 5243940 -
attcctatttgtcagcattc

SEQ ID NO: 46843 - DNA, 20 bp, Artificial Sequence
  Synthetic oligonucleotide; TAG chr11 5243930 5243949 5243933 -
tttgtcagcattcaggttat

SEQ ID NO: 46844 - DNA, 20 bp, Artificial Sequence
  Synthetic oligonucleotide; CGG chr11 5243927 5243946 5243930 -
gtcagcattcaggttattag

SEQ ID NO: 46845 - DNA, 20 bp, Artificial Sequence
  Synthetic oligonucleotide; TGG chr11 5243920 5243939 5243923 -
ttcaggttattagcggctgc

SEQ ID NO: 46846 - DNA, 20 bp, Artificial Sequence
  Synthetic oligonucleotide; AAG chr11 5243915 5243934 5243918 -
gttattagcggctgctggcg

SEQ ID NO: 46847 - DNA, 20 bp, Artificial Sequence
  Synthetic oligonucleotide; GAG chr11 5243907 5243926 5243910 -
cggctgctggcgaagtcctt

SEQ ID NO: 46848 - DNA, 20 bp, Artificial Sequence
  Synthetic oligonucleotide; TGG chr11 5243889 5243908 5243892 -
ttgagaaataaactgcacac

SEQ ID NO: 46849 - DNA, 20 bp, Artificial Sequence
  Synthetic oligonucleotide; TGG chr11 5243885 5243904 5243888 -
gaaataaactgcacactgga

SEQ ID NO: 46850 - DNA, 20 bp, Artificial Sequence
  Synthetic oligonucleotide; TGG chr11 5243882 5243901 5243885 -
ataaactgcacactggatgg

SEQ ID NO: 46851 - DNA, 20 bp, Artificial Sequence
  Synthetic oligonucleotide; GGG chr11 5243881 5243900 5243884 -
taaactgcacactggatggt

SEQ ID NO: 46852 - DNA, 20 bp, Artificial Sequence
  Synthetic oligonucleotide; GGG chr11 5243880 5243899 5243883 -
aaactgcacactggatggtg

SEQ ID NO: 46853 - DNA, 20 bp, Artificial Sequence
  Synthetic oligonucleotide; GGG chr11 5243879 5243898 5243882 -
aactgcacactggatggtgg

SEQ ID NO: 46854 - DNA, 20 bp, Artificial Sequence
  Synthetic oligonucleotide; TAG chr11 5243876 5243895 5243879 -
tgcacactggatggtggggg

SEQ ID NO: 46855 - DNA, 20 bp, Artificial Sequence
  Synthetic oligonucleotide; TAG chr11 5243871 5243890 5243874 -
actggatggtgggggtagtg

SEQ ID NO: 46856 - DNA, 20 bp, Artificial Sequence
  Synthetic oligonucleotide; AGG chr11 5243870 5243889 5243873 -
ctggatggtgggggtagtgt

SEQ ID NO: 46857 - DNA, 20 bp, Artificial Sequence
  Synthetic oligonucleotide; TGG chr11 5243863 5243882 5243866 -
gtgggggtagtgtaggaaaa

SEQ ID NO: 46858 - DNA, 20 bp, Artificial Sequence
  Synthetic oligonucleotide; GAG chr11 5243861 5243880 5243864 -
gggggtagtgtaggaaaatg

SEQ ID NO: 46859 - DNA, 20 bp, Artificial Sequence
  Synthetic oligonucleotide; AGG chr11 5243860 5243879 5243863 -
ggggtagtgtaggaaaatgg

SEQ ID NO: 46860 - DNA, 20 bp, Artificial Sequence
  Synthetic oligonucleotide; GGG chr11 5243859 5243878 5243862 -
gggtagtgtaggaaaatgga

SEQ ID NO: 46861 - DNA, 20 bp, Artificial Sequence
  Synthetic oligonucleotide; GGG chr11 5243858 5243877 5243861 -
ggtagtgtaggaaaatggag

SEQ ID NO: 46862 - DNA, 20 bp, Artificial Sequence
  Synthetic oligonucleotide; AAG chr11 5243855 5243874 5243858 -
agtgtaggaaaatggagggg

SEQ ID NO: 46863 - DNA, 20 bp, Artificial Sequence
  Synthetic oligonucleotide; AGG chr11 5243854 5243873 5243857 -
gtgtaggaaaatggagggga

SEQ ID NO: 46864 - DNA, 20 bp, Artificial Sequence
  Synthetic oligonucleotide; AAG chr11 5243851 5243870 5243854 -
taggaaaatggaggggaagg

SEQ ID NO: 46865 - DNA, 20 bp, Artificial Sequence
  Synthetic oligonucleotide; AAG chr11 5243846 5243865 5243849 -
aaatggaggggaaggaagta

SEQ ID NO: 46866 - DNA, 20 bp, Artificial Sequence
  Synthetic oligonucleotide; AAG chr11 5243834 5243853 5243837 -
aggaagtaaagtttcaaatt

SEQ ID NO: 46867 - DNA, 20 bp, Artificial Sequence
  Synthetic oligonucleotide; CAG chr11 5243825 5243844 5243828 -
agtttcaaattaagcctgaa

SEQ ID NO: 46868 - DNA, 20 bp, Artificial Sequence
  Synthetic oligonucleotide; AAG chr11 5243820 5243839 5243823 -
caaattaagcctgaacagca

SEQ ID NO: 46869 - DNA, 20 bp, Artificial Sequence
  Synthetic oligonucleotide; GAG chr11 5243810 5243829 5243813 -
ctgaacagcaaagttcccct

SEQ ID NO: 46870 - DNA, 20 bp, Artificial Sequence
  Synthetic oligonucleotide; AAG chr11 5243807 5243826 5243810 -
aacagcaaagttcccctgag

SEQ ID NO: 46871 - DNA, 20 bp, Artificial Sequence
  Synthetic oligonucleotide; AGG chr11 5243806 5243825 5243809 -
acagcaaagttcccctgaga

SEQ ID NO: 46872 - DNA, 20 bp, Artificial Sequence
  Synthetic oligonucleotide; TGG chr11 5243798 5243817 5243801 -
gttcccctgagaaggccacc

SEQ ID NO: 46873 - DNA, 20 bp, Artificial Sequence
  Synthetic oligonucleotide; CAG chr11 5243788 5243807 5243791 -
gaaggccacctggattctat

SEQ ID NO: 46874 - DNA, 20 bp, Artificial Sequence
  Synthetic oligonucleotide; TGG chr11 5243737 5243756 5243740 -
ccttgcccaaaccccacccc

SEQ ID NO: 46875 - DNA, 20 bp, Artificial Sequence
  Synthetic oligonucleotide; GAG chr11 5243735 5243754 5243738 -
ttgcccaaaccccacccctg

SEQ ID NO: 46876 - DNA, 20 bp, Artificial Sequence
  Synthetic oligonucleotide; TAG chr11 5243711 5243730 5243714 -
cacaacccacccttgaccaa

SEQ ID NO: 46877 - DNA, 20 bp, Artificial Sequence
  Synthetic oligonucleotide; GAG chr11 5243696 5243715 5243699 -
accaatagattcattttact

SEQ ID NO: 46878 - DNA, 20 bp, Artificial Sequence
  Synthetic oligonucleotide; AGG chr11 5243695 5243714 5243698 -
ccaatagattcattttactg

SEQ ID NO: 46879 - DNA, 20 bp, Artificial Sequence
  Synthetic oligonucleotide; GGG chr11 5243694 5243713 5243697 -
caatagattcattttactga

SEQ ID NO: 46880 - DNA, 20 bp, Artificial Sequence
  Synthetic oligonucleotide; GAG chr11 5243692 5243711 5243695 -
atagattcattttactgagg

SEQ ID NO: 46881 - DNA, 20 bp, Artificial Sequence
  Synthetic oligonucleotide; AGG chr11 5243691 5243710 5243694 -
tagattcattttactgaggg

SEQ ID NO: 46882 - DNA, 20 bp, Artificial Sequence
  Synthetic oligonucleotide; AAG chr11 5243686 5243705 5243689 -
tcattttactgagggaggca

SEQ ID NO: 46883 - DNA, 20 bp, Artificial Sequence
  Synthetic oligonucleotide; AGG chr11 5243685 5243704 5243688 -
cattttactgagggaggcaa

SEQ ID NO: 46884 - DNA, 20 bp, Artificial Sequence
  Synthetic oligonucleotide; GGG chr11 5243684 5243703 5243687 -
attttactgagggaggcaaa

SEQ ID NO: 46885 - DNA, 20 bp, Artificial Sequence
  Synthetic oligonucleotide; TGG chr11 5243680 5243699 5243683 -
tactgagggaggcaaagggc

SEQ ID NO: 46886 - DNA, 20 bp, Artificial Sequence
  Synthetic oligonucleotide; TAG chr11 5243673 5243692 5243676 -
ggaggcaaagggctggtcaa

SEQ ID NO: 46887 - DNA, 20 bp, Artificial Sequence
  Synthetic oligonucleotide; TGG chr11 5243659 5243678 5243662 -
ggtcaatagattcatttcac

SEQ ID NO: 46888 - DNA, 20 bp, Artificial Sequence
  Synthetic oligonucleotide; GGG chr11 5243658 5243677 5243661 -
gtcaatagattcatttcact

SEQ ID NO: 46889 - DNA, 20 bp, Artificial Sequence
  Synthetic oligonucleotide; GAG chr11 5243656 5243675 5243659 -
caatagattcatttcactgg

SEQ ID NO: 46890 - DNA, 20 bp, Artificial Sequence
  Synthetic oligonucleotide; GAG chr11 5243654 5243673 5243657 -
atagattcatttcactggga

SEQ ID NO: 46891 - DNA, 20 bp, Artificial Sequence
  Synthetic oligonucleotide; AGG chr11 5243653 5243672 5243656 -
tagattcatttcactgggag

SEQ ID NO: 46892 - DNA, 20 bp, Artificial Sequence
  Synthetic oligonucleotide; AAG chr11 5243648 5243667 5243651 -
tcatttcactgggagaggca

SEQ ID NO: 46893 - DNA, 20 bp, Artificial Sequence
  Synthetic oligonucleotide; AGG chr11 5243647 5243666 5243650 -
catttcactgggagaggcaa

SEQ ID NO: 46894 - DNA, 20 bp, Artificial Sequence
  Synthetic oligonucleotide; GGG chr11 5243646 5243665 5243649 -
atttcactgggagaggcaaa

SEQ ID NO: 46895 - DNA, 20 bp, Artificial Sequence
  Synthetic oligonucleotide; TGG chr11 5243642 5243661 5243645 -
cactgggagaggcaaagggc

SEQ ID NO: 46896 - DNA, 20 bp, Artificial Sequence
  Synthetic oligonucleotide; GGG chr11 5243641 5243660 5243644 -
actgggagaggcaaagggct

SEQ ID NO: 46897 - DNA, 20 bp, Artificial Sequence
  Synthetic oligonucleotide; GGG chr11 5243640 5243659 5243643 -
ctgggagaggcaaagggctg

SEQ ID NO: 46898 - DNA, 20 bp, Artificial Sequence
  Synthetic oligonucleotide; GGG chr11 5243639 5243658 5243642 -
tgggagaggcaaagggctgg

SEQ ID NO: 46899 - DNA, 20 bp, Artificial Sequence
  Synthetic oligonucleotide; CAG chr11 5243635 5243654 5243638 -
agaggcaaagggctgggggc

SEQ ID NO: 46900 - DNA, 20 bp, Artificial Sequence
  Synthetic oligonucleotide; GAG chr11 5243633 5243652 5243636 -
aggcaaagggctgggggcca

SEQ ID NO: 46901 - DNA, 20 bp, Artificial Sequence
  Synthetic oligonucleotide; GAG chr11 5243631 5243650 5243634 -
gcaaagggctgggggccaga

SEQ ID NO: 46902 - DNA, 20 bp, Artificial Sequence
  Synthetic oligonucleotide; AGG chr11 5243630 5243649 5243633 -
caaagggctgggggccagag

SEQ ID NO: 46903 - DNA, 20 bp, Artificial Sequence
  Synthetic oligonucleotide; GAG chr11 5243628 5243647 5243631 -
aagggctgggggccagagag

SEQ ID NO: 46904 - DNA, 20 bp, Artificial Sequence
  Synthetic oligonucleotide; AAG chr11 5243625 5243644 5243628 -
ggctgggggccagagaggag

SEQ ID NO: 46905 - DNA, 20 bp, Artificial Sequence
  Synthetic oligonucleotide; AAG chr11 5243618 5243637 5243621 -
ggccagagaggagaagtaaa

SEQ ID NO: 46906 - DNA, 20 bp, Artificial Sequence
  Synthetic oligonucleotide; AAG chr11 5243606 5243625 5243609 -
gaagtaaaaagccacacatg

SEQ ID NO: 46907 - DNA, 20 bp, Artificial Sequence
  Synthetic oligonucleotide; CAG chr11 5243603 5243622 5243606 -
gtaaaaagccacacatgaag

SEQ ID NO: 46908 - DNA, 20 bp, Artificial Sequence
  Synthetic oligonucleotide; CAG chr11 5243595 5243614 5243598 -
ccacacatgaagcagcaatg

SEQ ID NO: 46909 - DNA, 20 bp, Artificial Sequence
  Synthetic oligonucleotide; AGG chr11 5243594 5243613 5243597 -
cacacatgaagcagcaatgc

SEQ ID NO: 46910 - DNA, 20 bp, Artificial Sequence
  Synthetic oligonucleotide; TGG chr11 5243583 5243602 5243586 -
cagcaatgcaggcatgcttc

SEQ ID NO: 46911 - DNA, 20 bp, Artificial Sequence
  Synthetic oligonucleotide; CAG chr11 5243565 5243584 5243568 -
tctggctcatctgtgatcac

SEQ ID NO: 46912 - DNA, 20 bp, Artificial Sequence
  Synthetic oligonucleotide; AGG chr11 5243564 5243583 5243567 -
ctggctcatctgtgatcacc

SEQ ID NO: 46913 - DNA, 20 bp, Artificial Sequence
  Synthetic oligonucleotide; CAG chr11 5243554 5243573 5243557 -
tgtgatcaccaggaaactcc

SEQ ID NO: 46914 - DNA, 20 bp, Artificial Sequence
  Synthetic oligonucleotide; TAG chr11 5243540 5243559 5243543 -
aactcccagatctgacactg

SEQ ID NO: 46915 - DNA, 20 bp, Artificial Sequence
  Synthetic oligonucleotide; AAG chr11 5243520 5243539 5243523 -
tagtgcatttcactgctgac

SEQ ID NO: 46916 - DNA, 20 bp, Artificial Sequence
  Synthetic oligonucleotide; AAG chr11 5243517 5243536 5243520 -
tgcatttcactgctgacaag

SEQ ID NO: 46917 - DNA, 20 bp, Artificial Sequence
  Synthetic oligonucleotide; AGG chr11 5243516 5243535 5243519 -
gcatttcactgctgacaaga

SEQ ID NO: 46918 - DNA, 20 bp, Artificial Sequence
  Synthetic oligonucleotide; CAG chr11 5243503 5243522 5243506 -
gacaagaaggctgctgccac

SEQ ID NO: 46919 - DNA, 20 bp, Artificial Sequence
  Synthetic oligonucleotide; AAG chr11 5243494 5243513 5243497 -
gctgctgccaccagcctgtg

SEQ ID NO: 46920 - DNA, 20 bp, Artificial Sequence
  Synthetic oligonucleotide; AAG chr11 5243490 5243509 5243493 -
ctgccaccagcctgtgaagc

SEQ ID NO: 46921 - DNA, 20 bp, Artificial Sequence
  Synthetic oligonucleotide; AGG chr11 5243489 5243508 5243492 -
tgccaccagcctgtgaagca

SEQ ID NO: 46922 - DNA, 20 bp, Artificial Sequence
  Synthetic oligonucleotide; AAG chr11 5243484 5243503 5243487 -
ccagcctgtgaagcaaggtt

SEQ ID NO: 46923 - DNA, 20 bp, Artificial Sequence
  Synthetic oligonucleotide; AGG chr11 5243483 5243502 5243486 -
cagcctgtgaagcaaggtta

SEQ ID NO: 46924 - DNA, 20 bp, Artificial Sequence
  Synthetic oligonucleotide; GAG chr11 5243479 5243498 5243482 -
ctgtgaagcaaggttaaggt

SEQ ID NO: 46925 - DNA, 20 bp, Artificial Sequence
  Synthetic oligonucleotide; AAG chr11 5243476 5243495 5243479 -
tgaagcaaggttaaggtgag

SEQ ID NO: 46926 - DNA, 20 bp, Artificial Sequence
  Synthetic oligonucleotide; AGG chr11 5243475 5243494 5243478 -
gaagcaaggttaaggtgaga

SEQ ID NO: 46927 - DNA, 20 bp, Artificial Sequence
  Synthetic oligonucleotide; TGG chr11 5243471 5243490 5243474 -
caaggttaaggtgagaaggc

SEQ ID NO: 46928 - DNA, 20 bp, Artificial Sequence
  Synthetic oligonucleotide; GAG chr11 5243469 5243488 5243472 -
aggttaaggtgagaaggctg

SEQ ID NO: 46929 - DNA, 20 bp, Artificial Sequence
  Synthetic oligonucleotide; AGG chr11 5243468 5243487 5243471 -
ggttaaggtgagaaggctgg

SEQ ID NO: 46930 - DNA, 20 bp, Artificial Sequence
  Synthetic oligonucleotide; GAG chr11 5243464 5243483 5243467 -
aaggtgagaaggctggaggt

SEQ ID NO: 46931 - DNA, 20 bp, Artificial Sequence
  Synthetic oligonucleotide; TGG chr11 5243457 5243476 5243460 -
gaaggctggaggtgagattc

SEQ ID NO: 46932 - DNA, 20 bp, Artificial Sequence
  Synthetic oligonucleotide; GGG chr11 5243456 5243475 5243459 -
aaggctggaggtgagattct

SEQ ID NO: 46933 - DNA, 20 bp, Artificial Sequence
  Synthetic oligonucleotide; CAG chr11 5243453 5243472 5243456 -
gctggaggtgagattctggg

SEQ ID NO: 46934 - DNA, 20 bp, Artificial Sequence
  Synthetic oligonucleotide; AGG chr11 5243452 5243471 5243455 -
ctggaggtgagattctgggc

SEQ ID NO: 46935 - DNA, 20 bp, Artificial Sequence
  Synthetic oligonucleotide; TAG chr11 5243449 5243468 5243452 -
gaggtgagattctgggcagg

SEQ ID NO: 46936 - DNA, 20 bp, Artificial Sequence
  Synthetic oligonucleotide; AGG chr11 5243448 5243467 5243451 -
aggtgagattctgggcaggt

SEQ ID NO: 46937 - DNA, 20 bp, Artificial Sequence
  Synthetic oligonucleotide; TGG chr11 5243442 5243461 5243445 -
gattctgggcaggtaggtac

SEQ ID NO: 46938 - DNA, 20 bp, Artificial Sequence
  Synthetic oligonucleotide; AAG chr11 5243439 5243458 5243442 -
tctgggcaggtaggtactgg

SEQ ID NO: 46939 - DNA, 20 bp, Artificial Sequence
  Synthetic oligonucleotide; CGG chr11 5243435 5243454 5243438 -
ggcaggtaggtactggaagc

SEQ ID NO: 46940 - DNA, 20 bp, Artificial Sequence
  Synthetic oligonucleotide; GGG chr11 5243434 5243453 5243437 -
gcaggtaggtactggaagcc

SEQ ID NO: 46941 - DNA, 20 bp, Artificial Sequence
  Synthetic oligonucleotide; AAG chr11 5243429 5243448 5243432 -
taggtactggaagccgggac

SEQ ID NO: 46942 - DNA, 20 bp, Artificial Sequence
  Synthetic oligonucleotide; AGG chr11 5243428 5243447 5243431 -
aggtactggaagccgggaca

SEQ ID NO: 46943 - DNA, 20 bp, Artificial Sequence
  Synthetic oligonucleotide; CAG chr11 5243423 5243442 5243426 -
ctggaagccgggacaaggtg

SEQ ID NO: 46944 - DNA, 20 bp, Artificial Sequence
  Synthetic oligonucleotide; AAG chr11 5243419 5243438 5243422 -
aagccgggacaaggtgcaga

SEQ ID NO: 46945 - DNA, 20 bp, Artificial Sequence
  Synthetic oligonucleotide; AGG chr11 5243418 5243437 5243421 -
agccgggacaaggtgcagaa

SEQ ID NO: 46946 - DNA, 20 bp, Artificial Sequence
  Synthetic oligonucleotide; CAG chr11 5243415 5243434 5243418 -
cgggacaaggtgcagaaagg

SEQ ID NO: 46947 - DNA, 20 bp, Artificial Sequence
  Synthetic oligonucleotide; AAG chr11 5243411 5243430 5243414 -
acaaggtgcagaaaggcaga

SEQ ID NO: 46948 - DNA, 20 bp, Artificial Sequence
  Synthetic oligonucleotide; AAG chr11 5243399 5243418 5243402 -
aaggcagaaagtgtttctga

SEQ ID NO: 46949 - DNA, 20 bp, Artificial Sequence
  Synthetic oligonucleotide; GAG chr11 5243397 5243416 5243400 -
ggcagaaagtgtttctgaaa

SEQ ID NO: 46950 - DNA, 20 bp, Artificial Sequence
  Synthetic oligonucleotide; AGG chr11 5243396 5243415 5243399 -
gcagaaagtgtttctgaaag

SEQ ID NO: 46951 - DNA, 20 bp, Artificial Sequence
  Synthetic oligonucleotide; GGG chr11 5243395 5243414 5243398 -
cagaaagtgtttctgaaaga

SEQ ID NO: 46952 - DNA, 20 bp, Artificial Sequence
  Synthetic oligonucleotide; TAG chr11 5243390 5243409 5243393 -
agtgtttctgaaagagggat

SEQ ID NO: 46953 - DNA, 20 bp, Artificial Sequence
  Synthetic oligonucleotide; TAG chr11 5243373 5243392 5243376 -
gattagcccgttgtcttaca

SEQ ID NO: 46954 - DNA, 20 bp, Artificial Sequence
  Synthetic oligonucleotide; CAG chr11 5243332 5243351 5243335 -
ctgtgattatgactatccca

SEQ ID NO: 46955 - DNA, 20 bp, Artificial Sequence
  Synthetic oligonucleotide; TGG chr11 5243324 5243343 5243327 -
atgactatcccacagtctcc

SEQ ID NO: 46956 - DNA, 20 bp, Artificial Sequence
  Synthetic oligonucleotide; TGG chr11 5243310 5243329 5243313 -
gtctcctggttgtctaccca

SEQ ID NO: 46957 - DNA, 20 bp, Artificial Sequence
  Synthetic oligonucleotide; TAG chr11 5243304 5243323 5243307 -
tggttgtctacccatggacc

SEQ ID NO: 46958 - DNA, 20 bp, Artificial Sequence
  Synthetic oligonucleotide; GAG chr11 5243302 5243321 5243305 -
gttgtctacccatggaccta

SEQ ID NO: 46959 - DNA, 20 bp, Artificial Sequence
  Synthetic oligonucleotide; AGG chr11 5243301 5243320 5243304 -
ttgtctacccatggacctag

SEQ ID NO: 46960 - DNA, 20 bp, Artificial Sequence
  Synthetic oligonucleotide; AAG chr11 5243290 5243309 5243293 -
tggacctagaggtactttga

SEQ ID NO: 46961 - DNA, 20 bp, Artificial Sequence
  Synthetic oligonucleotide; TGG chr11 5243284 5243303 5243287 -
tagaggtactttgaaagttt

SEQ ID NO: 46962 - DNA, 20 bp, Artificial Sequence
  Synthetic oligonucleotide; TGG chr11 5243276 5243295 5243279 -
ctttgaaagttttggatatc

SEQ ID NO: 46963 - DNA, 20 bp, Artificial Sequence
  Synthetic oligonucleotide; GGG chr11 5243275 5243294 5243278 -
tttgaaagttttggatatct

SEQ ID NO: 46964 - DNA, 20 bp, Artificial Sequence
  Synthetic oligonucleotide; TGG chr11 5243255 5243274 5243258 -
gggctctgactgtgcaataa

SEQ ID NO: 46965 - DNA, 20 bp, Artificial Sequence
  Synthetic oligonucleotide; GGG chr11 5243254 5243273 5243257 -
ggctctgactgtgcaataat

SEQ ID NO: 46966 - DNA, 20 bp, Artificial Sequence
  Synthetic oligonucleotide; AAG chr11 5243243 5243262 5243246 -
tgcaataatgggcaacccca

SEQ ID NO: 46967 - DNA, 20 bp, Artificial Sequence
  Synthetic oligonucleotide; AAG chr11 5243238 5243257 5243241 -
taatgggcaaccccaaagtc

SEQ ID NO: 46968 - DNA, 20 bp, Artificial Sequence
  Synthetic oligonucleotide; AGG chr11 5243237 5243256 5243240 -
aatgggcaaccccaaagtca

SEQ ID NO: 46969 - DNA, 20 bp, Artificial Sequence
  Synthetic oligonucleotide; TGG chr11 5243230 5243249 5243233 -
aaccccaaagtcaaggcaca

SEQ ID NO: 46970 - DNA, 20 bp, Artificial Sequence
  Synthetic oligonucleotide; AAG chr11 5243226 5243245 5243229 -
ccaaagtcaaggcacatggc

SEQ ID NO: 46971 - DNA, 20 bp, Artificial Sequence
  Synthetic oligonucleotide; AAG chr11 5243223 5243242 5243226 -
aagtcaaggcacatggcaag

SEQ ID NO: 46972 - DNA, 20 bp, Artificial Sequence
  Synthetic oligonucleotide; AGG chr11 5243222 5243241 5243225 -
agtcaaggcacatggcaaga

SEQ ID NO: 46973 - DNA, 20 bp, Artificial Sequence
  Synthetic oligonucleotide; CGG chr11 5243206 5243225 5243209 -
aagaaggtgctgatctcctt

SEQ ID NO: 46974 - DNA, 20 bp, Artificial Sequence
  Synthetic oligonucleotide; AAG chr11 5243201 5243220 5243204 -
ggtgctgatctccttcggaa

SEQ ID NO: 46975 - DNA, 20 bp, Artificial Sequence
  Synthetic oligonucleotide; CGG chr11 5243186 5243205 5243189 -
cggaaaagctgttatgctca

SEQ ID NO: 46976 - DNA, 20 bp, Artificial Sequence
  Synthetic oligonucleotide; AAG chr11 5243174 5243193 5243177 -
tatgctcacggatgacctca

SEQ ID NO: 46977 - DNA, 20 bp, Artificial Sequence
  Synthetic oligonucleotide; AGG chr11 5243173 5243192 5243176 -
atgctcacggatgacctcaa

SEQ ID NO: 46978 - DNA, 20 bp, Artificial Sequence
  Synthetic oligonucleotide; GAG chr11 5243155 5243174 5243158 -
aaaggcacctttgctacact

SEQ ID NO: 46979 - DNA, 20 bp, Artificial Sequence
  Synthetic oligonucleotide; AAG chr11 5243136 5243155 5243139 -
tgagtgacctgcactgtaac

SEQ ID NO: 46980 - DNA, 20 bp, Artificial Sequence
  Synthetic oligonucleotide; TGG chr11 5243126 5243145 5243129 -
gcactgtaacaagctgcacg

SEQ ID NO: 46981 - DNA, 20 bp, Artificial Sequence
  Synthetic oligonucleotide; GAG chr11 5243118 5243137 5243121 -
acaagctgcacgtggaccct

SEQ ID NO: 46982 - DNA, 20 bp, Artificial Sequence
  Synthetic oligonucleotide; TGG chr11 5243108 5243127 5243111 -
cgtggaccctgagaacttcc

SEQ ID NO: 46983 - DNA, 20 bp, Artificial Sequence
  Synthetic oligonucleotide; GAG chr11 5243104 5243123 5243107 -
gaccctgagaacttcctggt

SEQ ID NO: 46984 - DNA, 20 bp, Artificial Sequence
  Synthetic oligonucleotide; TAG chr11 5243101 5243120 5243104 -
cctgagaacttcctggtgag

SEQ ID NO: 46985 - DNA, 20 bp, Artificial Sequence
  Synthetic oligonucleotide; AAG chr11 5243097 5243116 5243100 -
agaacttcctggtgagtagt

SEQ ID NO: 46986 - DNA, 20 bp, Artificial Sequence
  Synthetic oligonucleotide; TAG chr11 5243068 5243087 5243071 -
cacgctttcttctttaccct

SEQ ID NO: 46987 - DNA, 20 bp, Artificial Sequence
  Synthetic oligonucleotide; TGG chr11 5243053 5243072 5243056 -
acccttagatatttgcacta

SEQ ID NO: 46988 - DNA, 20 bp, Artificial Sequence
  Synthetic oligonucleotide; GGG chr11 5243052 5243071 5243055 -
cccttagatatttgcactat

SEQ ID NO: 46989 - DNA, 20 bp, Artificial Sequence
  Synthetic oligonucleotide; AAG chr11 5243040 5243059 5243043 -
tgcactatgggtacttttga

SEQ ID NO: 46990 - DNA, 20 bp, Artificial Sequence
  Synthetic oligonucleotide; CAG chr11 5243037 5243056 5243040 -
actatgggtacttttgaaag

SEQ ID NO: 46991 - DNA, 20 bp, Artificial Sequence
  Synthetic oligonucleotide; GAG chr11 5243035 5243054 5243038 -
tatgggtacttttgaaagca

SEQ ID NO: 46992 - DNA, 20 bp, Artificial Sequence
  Synthetic oligonucleotide; AGG chr11 5243034 5243053 5243037 -
atgggtacttttgaaagcag

SEQ ID NO: 46993 - DNA, 20 bp, Artificial Sequence
  Synthetic oligonucleotide; TGG chr11 5243031 5243050 5243034 -
ggtacttttgaaagcagagg

SEQ ID NO: 46994 - DNA, 20 bp, Artificial Sequence
  Synthetic oligonucleotide; GAG chr11 5243012 5243031 5243015 -
gtggctttctcttgtgttat

SEQ ID NO: 46995 - DNA, 20 bp, Artificial Sequence
  Synthetic oligonucleotide; CAG chr11 5243008 5243027 5243011 -
ctttctcttgtgttatgagt

SEQ ID NO: 46996 - DNA, 20 bp, Artificial Sequence
  Synthetic oligonucleotide; TGG chr11 5243002 5243021 5243005 -
cttgtgttatgagtcagcta

SEQ ID NO: 46997 - DNA, 20 bp, Artificial Sequence
  Synthetic oligonucleotide; GGG chr11 5243001 5243020 5243004 -
ttgtgttatgagtcagctat

SEQ ID NO: 46998 - DNA, 20 bp, Artificial Sequence
  Synthetic oligonucleotide; CAG chr11 5242987 5243006 5242990 -
agctatgggatatgatattt

SEQ ID NO: 46999 - DNA, 20 bp, Artificial Sequence
  Synthetic oligonucleotide; CAG chr11 5242984 5243003 5242987 -
tatgggatatgatatttcag

SEQ ID NO: 47000 - DNA, 20 bp, Artificial Sequence
  Synthetic oligonucleotide; TGG chr11 5242981 5243000 5242984 -
gggatatgatatttcagcag

SEQ ID NO: 47001 - DNA, 20 bp, Artificial Sequence
  Synthetic oligonucleotide; GGG chr11 5242980 5242999 5242983 -
ggatatgatatttcagcagt

SEQ ID NO: 47002 - DNA, 20 bp, Artificial Sequence
  Synthetic oligonucleotide; GAG chr11 5242972 5242991 5242975 -
tatttcagcagtgggatttt

SEQ ID NO: 47003 - DNA, 20 bp, Artificial Sequence
  Synthetic oligonucleotide; GAG chr11 5242970 5242989 5242973 -
tttcagcagtgggattttga

SEQ ID NO: 47004 - DNA, 20 bp, Artificial Sequence
  Synthetic oligonucleotide; TGG chr11 5242936 5242955 5242939 -
taaataacataactaaaatt

SEQ ID NO: 47005 - DNA, 20 bp, Artificial Sequence
  Synthetic oligonucleotide; TAG chr11 5242933 5242952 5242936 -
ataacataactaaaatttgg

SEQ ID NO: 47006 - DNA, 20 bp, Artificial Sequence
  Synthetic oligonucleotide; GAG chr11 5242931 5242950 5242934 -
aacataactaaaatttggta

SEQ ID NO: 47007 - DNA, 20 bp, Artificial Sequence
  Synthetic oligonucleotide; AAG chr11 5242927 5242946 5242930 -
taactaaaatttggtagagc

SEQ ID NO: 47008 - DNA, 20 bp, Artificial Sequence
  Synthetic oligonucleotide; AGG chr11 5242926 5242945 5242929 -
aactaaaatttggtagagca

SEQ ID NO: 47009 - DNA, 20 bp, Artificial Sequence
  Synthetic oligonucleotide; TGG chr11 5242912 5242931 5242915 -
agagcaaggactatgaataa

SEQ ID NO: 47010 - DNA, 20 bp, Artificial Sequence
  Synthetic oligonucleotide; AAG chr11 5242909 5242928 5242912 -
gcaaggactatgaataatgg

SEQ ID NO: 47011 - DNA, 20 bp, Artificial Sequence
  Synthetic oligonucleotide; AGG chr11 5242908 5242927 5242911 -
caaggactatgaataatgga

SEQ ID NO: 47012 - DNA, 20 bp, Artificial Sequence
  Synthetic oligonucleotide; TAG chr11 5242890 5242909 5242893 -
gaaggccacttaccatttga

SEQ ID NO: 47013 - DNA, 20 bp, Artificial Sequence
  Synthetic oligonucleotide; TGG chr11 5242858 5242877 5242861 -
acacatcttataaaaaattc

SEQ ID NO: 47014 - DNA, 20 bp, Artificial Sequence
  Synthetic oligonucleotide; GAG chr11 5242842 5242861 5242845 -
attctggccaaaatcaaact

SEQ ID NO: 47015 - DNA, 20 bp, Artificial Sequence
  Synthetic oligonucleotide; TGG chr11 5242833 5242852 5242836 -
aaaatcaaactgagtgtttt

SEQ ID NO: 47016 - DNA, 20 bp, Artificial Sequence
  Synthetic oligonucleotide; GAG chr11 5242828 5242847 5242831 -
caaactgagtgtttttggat

SEQ ID NO: 47017 - DNA, 20 bp, Artificial Sequence
  Synthetic oligonucleotide; AGG chr11 5242827 5242846 5242830 -
aaactgagtgtttttggatg

SEQ ID NO: 47018 - DNA, 20 bp, Artificial Sequence
  Synthetic oligonucleotide; GGG chr11 5242826 5242845 5242829 -
aactgagtgtttttggatga

SEQ ID NO: 47019 - DNA, 20 bp, Artificial Sequence
  Synthetic oligonucleotide; CAG chr11 5242821 5242840 5242824 -
agtgtttttggatgagggaa

SEQ ID NO: 47020 - DNA, 20 bp, Artificial Sequence
  Synthetic oligonucleotide; AAG chr11 5242818 5242837 5242821 -
gtttttggatgagggaacag

SEQ ID NO: 47021 - DNA, 20 bp, Artificial Sequence
  Synthetic oligonucleotide; GAG chr11 5242813 5242832 5242816 -
tggatgagggaacagaagtt

SEQ ID NO: 47022 - DNA, 20 bp, Artificial Sequence
  Synthetic oligonucleotide; TAG chr11 5242809 5242828 5242812 -
tgagggaacagaagttgaga

SEQ ID NO: 47023 - DNA, 20 bp, Artificial Sequence
  Synthetic oligonucleotide; GAG chr11 5242807 5242826 5242810 -
agggaacagaagttgagata

SEQ ID NO: 47024 - DNA, 20 bp, Artificial Sequence
  Synthetic oligonucleotide; TGG chr11 5242786 5242805 5242789 -
agaaaataacatctttcctt

SEQ ID NO: 47025 - DNA, 20 bp, Artificial Sequence
  Synthetic oligonucleotide; CAG chr11 5242782 5242801 5242785 -
aataacatctttcctttggt

SEQ ID NO: 47026 - DNA, 20 bp, Artificial Sequence
  Synthetic oligonucleotide; TAG chr11 5242757 5242776 5242760 -
aaattttctataaaaattaa

SEQ ID NO: 47027 - DNA, 20 bp, Artificial Sequence
  Synthetic oligonucleotide; TAG chr11 5242741 5242760 5242744 -
ttaatagtcacttttctgca

SEQ ID NO: 47028 - DNA, 20 bp, Artificial Sequence
  Synthetic oligonucleotide; TGG chr11 5242735 5242754 5242738 -
gtcacttttctgcatagtcc

SEQ ID NO: 47029 - DNA, 20 bp, Artificial Sequence
  Synthetic oligonucleotide; GAG chr11 5242733 5242752 5242736 -
cacttttctgcatagtcctg

SEQ ID NO: 47030 - DNA, 20 bp, Artificial Sequence
  Synthetic oligonucleotide; AGG chr11 5242732 5242751 5242735 -
acttttctgcatagtcctgg

SEQ ID NO: 47031 - DNA, 20 bp, Artificial Sequence
  Synthetic oligonucleotide; TAG chr11 5242728 5242747 5242731 -
ttctgcatagtcctggaggt

SEQ ID NO: 47032 - DNA, 20 bp, Artificial Sequence
  Synthetic oligonucleotide; AAG chr11 5242722 5242741 5242725 -
atagtcctggaggttagaaa

SEQ ID NO: 47033 - DNA, 20 bp, Artificial Sequence
  Synthetic oligonucleotide; AAG chr11 5242707 5242726 5242710 -
agaaaaagatcaactgaaca

SEQ ID NO: 47034 - DNA, 20 bp, Artificial Sequence
  Synthetic oligonucleotide; TAG chr11 5242704 5242723 5242707 -
aaaagatcaactgaacaaag

SEQ ID NO: 47035 - DNA, 20 bp, Artificial Sequence
  Synthetic oligonucleotide; TGG chr11 5242701 5242720 5242704 -
agatcaactgaacaaagtag

SEQ ID NO: 47036 - DNA, 20 bp, Artificial Sequence
  Synthetic oligonucleotide; GGG chr11 5242700 5242719 5242703 -
gatcaactgaacaaagtagt

SEQ ID NO: 47037 - DNA, 20 bp, Artificial Sequence
  Synthetic oligonucleotide; AAG chr11 5242697 5242716 5242700 -
caactgaacaaagtagtggg

SEQ ID NO: 47038 - DNA, 20 bp, Artificial Sequence
  Synthetic oligonucleotide; AAG chr11 5242686 5242705 5242689 -
agtagtgggaagctgttaaa

SEQ ID NO: 47039 - DNA, 20 bp, Artificial Sequence
  Synthetic oligonucleotide; GAG chr11 5242684 5242703 5242687 -
tagtgggaagctgttaaaaa

SEQ ID NO: 47040 - DNA, 20 bp, Artificial Sequence
  Synthetic oligonucleotide; AGG chr11 5242683 5242702 5242686 -
agtgggaagctgttaaaaag

SEQ ID NO: 47041 - DNA, 20 bp, Artificial Sequence
  Synthetic oligonucleotide; TGG chr11 5242658 5242677 5242661 -
tgtttccctccgaatgatga

SEQ ID NO: 47042 - DNA, 20 bp, Artificial Sequence
  Synthetic oligonucleotide; TGG chr11 5242639 5242658 5242642 -
atggtatacttttgtacgca

SEQ ID NO: 47043 - DNA, 20 bp, Artificial Sequence
  Synthetic oligonucleotide; CAG chr11 5242634 5242653 5242637 -
atacttttgtacgcatggta

SEQ ID NO: 47044 - DNA, 20 bp, Artificial Sequence
  Synthetic oligonucleotide; AGG chr11 5242633 5242652 5242636 -
tacttttgtacgcatggtac

SEQ ID NO: 47045 - DNA, 20 bp, Artificial Sequence
  Synthetic oligonucleotide; GAG chr11 5242618 5242637 5242621 -
ggtacaggattctttgttat

SEQ ID NO: 47046 - DNA, 20 bp, Artificial Sequence
  Synthetic oligonucleotide; TGG chr11 5242611 5242630 5242614 -
gattctttgttatgagtgtt

SEQ ID NO: 47047 - DNA, 20 bp, Artificial Sequence
  Synthetic oligonucleotide; GGG chr11 5242610 5242629 5242613 -
attctttgttatgagtgttt

SEQ ID NO: 47048 - DNA, 20 bp, Artificial Sequence
  Synthetic oligonucleotide; TGG chr11 5242569 5242588 5242572 -
gtatgtatgtatgtgatgac

SEQ ID NO: 47049 - DNA, 20 bp, Artificial Sequence
  Synthetic oligonucleotide; GGG chr11 5242568 5242587 5242571 -
tatgtatgtatgtgatgact

SEQ ID NO: 47050 - DNA, 20 bp, Artificial Sequence
  Synthetic oligonucleotide; GGG chr11 5242567 5242586 5242570 -
atgtatgtatgtgatgactg

SEQ ID NO: 47051 - DNA, 20 bp, Artificial Sequence
  Synthetic oligonucleotide; AAG chr11 5242537 5242556 5242540 -
ctatccattactgttccttg

SEQ ID NO: 47052 - DNA, 20 bp, Artificial Sequence
  Synthetic oligonucleotide; AAG chr11 5242513 5242532 5242516 -
actattatcctactttttaa

SEQ ID NO: 47053 - DNA, 20 bp, Artificial Sequence
  Synthetic oligonucleotide; AGG chr11 5242512 5242531 5242515 -
ctattatcctactttttaaa

SEQ ID NO: 47054 - DNA, 20 bp, Artificial Sequence
  Synthetic oligonucleotide; AAG chr11 5242506 5242525 5242509 -
tcctactttttaaaaggacg

SEQ ID NO: 47055 - DNA, 20 bp, Artificial Sequence
  Synthetic oligonucleotide; TGG chr11 5242469 5242488 5242472 -
atgaaacaatcacaatatgt

SEQ ID NO: 47056 - DNA, 20 bp, Artificial Sequence
  Synthetic oligonucleotide; GGG chr11 5242468 5242487 5242471 -
tgaaacaatcacaatatgtt

SEQ ID NO: 47057 - DNA, 20 bp, Artificial Sequence
  Synthetic oligonucleotide; GGG chr11 5242467 5242486 5242470 -
gaaacaatcacaatatgttg

SEQ ID NO: 47058 - DNA, 20 bp, Artificial Sequence
  Synthetic oligonucleotide; TAG chr11 5242464 5242483 5242467 -
acaatcacaatatgttgggg

SEQ ID NO: 47059 - DNA, 20 bp, Artificial Sequence
  Synthetic oligonucleotide; GAG chr11 5242460 5242479 5242463 -
tcacaatatgttggggtagt

SEQ ID NO: 47060 - DNA, 20 bp, Artificial Sequence
  Synthetic oligonucleotide; TGG chr11 5242456 5242475 5242459 -
aatatgttggggtagtgagt

SEQ ID NO: 47061 - DNA, 20 bp, Artificial Sequence
  Synthetic oligonucleotide; TAG chr11 5242451 5242470 5242454 -
gttggggtagtgagttggca

SEQ ID NO: 47062 - DNA, 20 bp, Artificial Sequence
  Synthetic oligonucleotide; AAG chr11 5242447 5242466 5242450 -
gggtagtgagttggcatagc

SEQ ID NO: 47063 - DNA, 20 bp, Artificial Sequence
  Synthetic oligonucleotide; AAG chr11 5242443 5242462 5242446 -
agtgagttggcatagcaagt

SEQ ID NO: 47064 - DNA, 20 bp, Artificial Sequence
  Synthetic oligonucleotide; GAG chr11 5242441 5242460 5242444 -
tgagttggcatagcaagtaa

SEQ ID NO: 47065 - DNA, 20 bp, Artificial Sequence
  Synthetic oligonucleotide; AAG chr11 5242438 5242457 5242441 -
gttggcatagcaagtaagag

SEQ ID NO: 47066 - DNA, 20 bp, Artificial Sequence
  Synthetic oligonucleotide; AGG chr11 5242437 5242456 5242440 -
ttggcatagcaagtaagaga

SEQ ID NO: 47067 - DNA, 20 bp, Artificial Sequence
  Synthetic oligonucleotide; TAG chr11 5242433 5242452 5242436 -
catagcaagtaagagaagga

SEQ ID NO: 47068 - DNA, 20 bp, Artificial Sequence
  Synthetic oligonucleotide; AGG chr11 5242432 5242451 5242435 -
atagcaagtaagagaaggat

SEQ ID NO: 47069 - DNA, 20 bp, Artificial Sequence
  Synthetic oligonucleotide; TGG chr11 5242423 5242442 5242426 -
aagagaaggataggacacaa

SEQ ID NO: 47070 - DNA, 20 bp, Artificial Sequence
  Synthetic oligonucleotide; GGG chr11 5242422 5242441 5242425 -
agagaaggataggacacaat

SEQ ID NO: 47071 - DNA, 20 bp, Artificial Sequence
  Synthetic oligonucleotide; GAG chr11 5242420 5242439 5242423 -
agaaggataggacacaatgg

SEQ ID NO: 47072 - DNA, 20 bp, Artificial Sequence
  Synthetic oligonucleotide; AGG chr11 5242419 5242438 5242422 -
gaaggataggacacaatggg

SEQ ID NO: 47073 - DNA, 20 bp, Artificial Sequence
  Synthetic oligonucleotide; CAG chr11 5242414 5242433 5242417 -
ataggacacaatgggaggtg

SEQ ID NO: 47074 - DNA, 20 bp, Artificial Sequence
  Synthetic oligonucleotide; AGG chr11 5242413 5242432 5242416 -
taggacacaatgggaggtgc

SEQ ID NO: 47075 - DNA, 20 bp, Artificial Sequence
  Synthetic oligonucleotide; GGG chr11 5242412 5242431 5242415 -
aggacacaatgggaggtgca

SEQ ID NO: 47076 - DNA, 20 bp, Artificial Sequence
  Synthetic oligonucleotide; CAG chr11 5242405 5242424 5242408 -
aatgggaggtgcagggctgc

SEQ ID NO: 47077 - DNA, 20 bp, Artificial Sequence
  Synthetic oligonucleotide; AAG chr11 5242394 5242413 5242397 -
cagggctgccagtcatattg

SEQ ID NO: 47078 - DNA, 20 bp, Artificial Sequence
  Synthetic oligonucleotide; TAG chr11 5242383 5242402 5242386 -
gtcatattgaagctgatatc

SEQ ID NO: 47079 - DNA, 20 bp, Artificial Sequence
  Synthetic oligonucleotide; TGG chr11 5242373 5242392 5242376 -
agctgatatctagcccataa

SEQ ID NO: 47080 - DNA, 20 bp, Artificial Sequence
  Synthetic oligonucleotide; GAG chr11 5242369 5242388 5242372 -
gatatctagcccataatggt

SEQ ID NO: 47081 - DNA, 20 bp, Artificial Sequence
  Synthetic oligonucleotide; GAG chr11 5242367 5242386 5242370 -
tatctagcccataatggtga

SEQ ID NO: 47082 - DNA, 20 bp, Artificial Sequence
  Synthetic oligonucleotide; TGG chr11 5242352 5242371 5242355 -
ggtgagagttgctcaaactc

SEQ ID NO: 47083 - DNA, 20 bp, Artificial Sequence
  Synthetic oligonucleotide; AAG chr11 5242344 5242363 5242347 -
ttgctcaaactctggtgaaa

SEQ ID NO: 47084 - DNA, 20 bp, Artificial Sequence
  Synthetic oligonucleotide; AGG chr11 5242343 5242362 5242346 -
tgctcaaactctggtgaaaa

SEQ ID NO: 47085 - DNA, 20 bp, Artificial Sequence
  Synthetic oligonucleotide; AAG chr11 5242336 5242355 5242339 -
actctggtgaaaaaggatgt

SEQ ID NO: 47086 - DNA, 20 bp, Artificial Sequence
  Synthetic oligonucleotide; AAG chr11 5242314 5242333 5242317 -
gtgttatatctatttactgc

SEQ ID NO: 47087 - DNA, 20 bp, Artificial Sequence
  Synthetic oligonucleotide; CAG chr11 5242309 5242328 5242312 -
atatctatttactgcaagtc

SEQ ID NO: 47088 - DNA, 20 bp, Artificial Sequence
  Synthetic oligonucleotide; GAG chr11 5242303 5242322 5242306 -
atttactgcaagtccagctt

SEQ ID NO: 47089 - DNA, 20 bp, Artificial Sequence
  Synthetic oligonucleotide; AGG chr11 5242302 5242321 5242305 -
tttactgcaagtccagcttg

SEQ ID NO: 47090 - DNA, 20 bp, Artificial Sequence
  Synthetic oligonucleotide; CAG chr11 5242251 5242270 5242254 -
ttttatcttcactccctccc

SEQ ID NO: 47091 - DNA, 20 bp, Artificial Sequence
  Synthetic oligonucleotide; TAG chr11 5242244 5242263 5242247 -
ttcactccctccccagctct

SEQ ID NO: 47092 - DNA, 20 bp, Artificial Sequence
  Synthetic oligonucleotide; AGG chr11 5242243 5242262 5242246 -
tcactccctccccagctctt

SEQ ID NO: 47093 - DNA, 20 bp, Artificial Sequence
  Synthetic oligonucleotide; TGG chr11 5242220 5242239 5242223 -
caacgtgatattgattgttt

SEQ ID NO: 47094 - DNA, 20 bp, Artificial Sequence
  Synthetic oligonucleotide; CAG chr11 5242207 5242226 5242210 -
attgttttggcaacccactt

SEQ ID NO: 47095 - DNA, 20 bp, Artificial Sequence
  Synthetic oligonucleotide; GAG chr11 5242203 5242222 5242206 -
ttttggcaacccacttcagc

SEQ ID NO: 47096 - DNA, 20 bp, Artificial Sequence
  Synthetic oligonucleotide; AGG chr11 5242202 5242221 5242205 -
tttggcaacccacttcagcg

SEQ ID NO: 47097 - DNA, 20 bp, Artificial Sequence
  Synthetic oligonucleotide; CAG chr11 5242188 5242207 5242191 -
tcagcgaggattttacccta

SEQ ID NO: 47098 - DNA, 20 bp, Artificial Sequence
  Synthetic oligonucleotide; CAG chr11 5242182 5242201 5242185 -
aggattttaccctacagata

SEQ ID NO: 47099 - DNA, 20 bp, Artificial Sequence
  Synthetic oligonucleotide; AGG chr11 5242181 5242200 5242184 -
ggattttaccctacagatac

SEQ ID NO: 47100 - DNA, 20 bp, Artificial Sequence
  Synthetic oligonucleotide; TGG chr11 5242173 5242192 5242176 -
ccctacagatacaggcttct

SEQ ID NO: 47101 - DNA, 20 bp, Artificial Sequence
  Synthetic oligonucleotide; CAG chr11 5242170 5242189 5242173 -
tacagatacaggcttcttgg

SEQ ID NO: 47102 - DNA, 20 bp, Artificial Sequence
  Synthetic oligonucleotide; TGG chr11 5242151 5242170 5242154 -
gcagtaactaacaaatgctg

SEQ ID NO: 47103 - DNA, 20 bp, Artificial Sequence
  Synthetic oligonucleotide; TAG chr11 5242139 5242158 5242142 -
aaatgctgtggttaatgctg

SEQ ID NO: 47104 - DNA, 20 bp, Artificial Sequence
  Synthetic oligonucleotide; AAG chr11 5242131 5242150 5242134 -
tggttaatgctgtagcccac

SEQ ID NO: 47105 - DNA, 20 bp, Artificial Sequence
  Synthetic oligonucleotide; GAG chr11 5242122 5242141 5242125 -
ctgtagcccacaagaccact

SEQ ID NO: 47106 - DNA, 20 bp, Artificial Sequence
  Synthetic oligonucleotide; TGG chr11 5242093 5242112 5242096 -
gtccactatgtttgtaccta

SEQ ID NO: 47107 - DNA, 20 bp, Artificial Sequence
  Synthetic oligonucleotide; TAG chr11 5242049 5242068 5242052 -
tcccaaaatctcatctcctt

SEQ ID NO: 47108 - DNA, 20 bp, Artificial Sequence
  Synthetic oligonucleotide; TGG chr11 5242045 5242064 5242048 -
aaaatctcatctcctttaga

SEQ ID NO: 47109 - DNA, 20 bp, Artificial Sequence
  Synthetic oligonucleotide; GGG chr11 5242044 5242063 5242047 -
aaatctcatctcctttagat

SEQ ID NO: 47110 - DNA, 20 bp, Artificial Sequence
  Synthetic oligonucleotide; GGG chr11 5242043 5242062 5242046 -
aatctcatctcctttagatg

SEQ ID NO: 47111 - DNA, 20 bp, Artificial Sequence
  Synthetic oligonucleotide; GGG chr11 5242042 5242061 5242045 -
atctcatctcctttagatgg

SEQ ID NO: 47112 - DNA, 20 bp, Artificial Sequence
  Synthetic oligonucleotide; GAG chr11 5242040 5242059 5242043 -
ctcatctcctttagatgggg

SEQ ID NO: 47113 - DNA, 20 bp, Artificial Sequence
  Synthetic oligonucleotide; AGG chr11 5242039 5242058 5242042 -
tcatctcctttagatggggg

SEQ ID NO: 47114 - DNA, 20 bp, Artificial Sequence
  Synthetic oligonucleotide; TGG chr11 5242035 5242054 5242038 -
ctcctttagatgggggaggt

SEQ ID NO: 47115 - DNA, 20 bp, Artificial Sequence
  Synthetic oligonucleotide; GGG chr11 5242034 5242053 5242037 -
tcctttagatgggggaggtt

SEQ ID NO: 47116 - DNA, 20 bp, Artificial Sequence
  Synthetic oligonucleotide; GGG chr11 5242033 5242052 5242036 -
cctttagatgggggaggttg

SEQ ID NO: 47117 - DNA, 20 bp, Artificial Sequence
  Synthetic oligonucleotide; GAG chr11 5242031 5242050 5242034 -
tttagatgggggaggttggg

SEQ ID NO: 47118 - DNA, 20 bp, Artificial Sequence
  Synthetic oligonucleotide; AAG chr11 5242028 5242047 5242031 -
agatgggggaggttggggag

SEQ ID NO: 47119 - DNA, 20 bp, Artificial Sequence
  Synthetic oligonucleotide; GAG chr11 5242026 5242045 5242029 -
atgggggaggttggggagaa

SEQ ID NO: 47120 - DNA, 20 bp, Artificial Sequence
  Synthetic oligonucleotide; CAG chr11 5242023 5242042 5242026 -
ggggaggttggggagaagag

SEQ ID NO: 47121 - DNA, 20 bp, Artificial Sequence
  Synthetic oligonucleotide; CAG chr11 5242003 5242022 5242006 -
cagtatcctgcctgctgatt

SEQ ID NO: 47122 - DNA, 20 bp, Artificial Sequence
  Synthetic oligonucleotide; TAG chr11 5241983 5242002 5241986 -
cagttcctgcatgataaaaa

SEQ ID NO: 47123 - DNA, 20 bp, Artificial Sequence
  Synthetic oligonucleotide; AAG chr11 5241976 5241995 5241979 -
tgcatgataaaaatagaata

SEQ ID NO: 47124 - DNA, 20 bp, Artificial Sequence
  Synthetic oligonucleotide; AAG chr11 5241960 5241979 5241963 -
aataaagaaatatgctctct

SEQ ID NO: 47125 - DNA, 20 bp, Artificial Sequence
  Synthetic oligonucleotide; CAG chr11 5241912 5241931 5241915 -
ctttatattttaccctgatt

SEQ ID NO: 47126 - DNA, 20 bp, Artificial Sequence
  Synthetic oligonucleotide; AAG chr11 5241905 5241924 5241908 -
ttttaccctgattcagccaa

SEQ ID NO: 47127 - DNA, 20 bp, Artificial Sequence
  Synthetic oligonucleotide; AGG chr11 5241904 5241923 5241907 -
tttaccctgattcagccaaa

SEQ ID NO: 47128 - DNA, 20 bp, Artificial Sequence
  Synthetic oligonucleotide; TGG chr11 5241886 5241905 5241889 -
aaaggacgcactatttctga

SEQ ID NO: 47129 - DNA, 20 bp, Artificial Sequence
  Synthetic oligonucleotide; GAG chr11 5241879 5241898 5241882 -
gcactatttctgatggaaat

SEQ ID NO: 47130 - DNA, 20 bp, Artificial Sequence
  Synthetic oligonucleotide; TGG chr11 5241871 5241890 5241874 -
tctgatggaaatgagaatgt

SEQ ID NO: 47131 - DNA, 20 bp, Artificial Sequence
  Synthetic oligonucleotide; GAG chr11 5241869 5241888 5241872 -
tgatggaaatgagaatgttg

SEQ ID NO: 47132 - DNA, 20 bp, Artificial Sequence
  Synthetic oligonucleotide; TGG chr11 5241864 5241883 5241867 -
gaaatgagaatgttggagaa

SEQ ID NO: 47133 - DNA, 20 bp, Artificial Sequence
  Synthetic oligonucleotide; GGG chr11 5241863 5241882 5241866 -
aaatgagaatgttggagaat

SEQ ID NO: 47134 - DNA, 20 bp, Artificial Sequence
  Synthetic oligonucleotide; GAG chr11 5241861 5241880 5241864 -
atgagaatgttggagaatgg

SEQ ID NO: 47135 - DNA, 20 bp, Artificial Sequence
  Synthetic oligonucleotide; AAG chr11 5241855 5241874 5241858 -
atgttggagaatgggagttt

SEQ ID NO: 47136 - DNA, 20 bp, Artificial Sequence
  Synthetic oligonucleotide; AGG chr11 5241854 5241873 5241857 -
tgttggagaatgggagttta

SEQ ID NO: 47137 - DNA, 20 bp, Artificial Sequence
  Synthetic oligonucleotide; CAG chr11 5241850 5241869 5241853 -
ggagaatgggagtttaagga

SEQ ID NO: 47138 - DNA, 20 bp, Artificial Sequence
  Synthetic oligonucleotide; GAG chr11 5241848 5241867 5241851 -
agaatgggagtttaaggaca

SEQ ID NO: 47139 - DNA, 20 bp, Artificial Sequence
  Synthetic oligonucleotide; AAG chr11 5241845 5241864 5241848 -
atgggagtttaaggacagag

SEQ ID NO: 47140 - DNA, 20 bp, Artificial Sequence
  Synthetic oligonucleotide; AAG chr11 5241822 5241841 5241825 -
atactttcttgcaatcctgc

SEQ ID NO: 47141 - DNA, 20 bp, Artificial Sequence
  Synthetic oligonucleotide; AAG chr11 5241817 5241836 5241820 -
ttcttgcaatcctgcaagaa

SEQ ID NO: 47142 - DNA, 20 bp, Artificial Sequence
  Synthetic oligonucleotide; GAG chr11 5241815 5241834 5241818 -
cttgcaatcctgcaagaaaa

SEQ ID NO: 47143 - DNA, 20 bp, Artificial Sequence
  Synthetic oligonucleotide; GAG chr11 5241813 5241832 5241816 -
tgcaatcctgcaagaaaaga

SEQ ID NO: 47144 - DNA, 20 bp, Artificial Sequence
  Synthetic oligonucleotide; TGG chr11 5241804 5241823 5241807 -
gcaagaaaagagagaactcg

SEQ ID NO: 47145 - DNA, 20 bp, Artificial Sequence
  Synthetic oligonucleotide; GGG chr11 5241803 5241822 5241806 -
caagaaaagagagaactcgt

SEQ ID NO: 47146 - DNA, 20 bp, Artificial Sequence
  Synthetic oligonucleotide; TGG chr11 5241800 5241819 5241803 -
gaaaagagagaactcgtggg

SEQ ID NO: 47147 - DNA, 20 bp, Artificial Sequence
  Synthetic oligonucleotide; TAG chr11 5241794 5241813 5241797 -
agagaactcgtgggtggatt

SEQ ID NO: 47148 - DNA, 20 bp, Artificial Sequence
  Synthetic oligonucleotide; TGG chr11 5241791 5241810 5241794 -
gaactcgtgggtggatttag

SEQ ID NO: 47149 - DNA, 20 bp, Artificial Sequence
  Synthetic oligonucleotide; GGG chr11 5241790 5241809 5241793 -
aactcgtgggtggatttagt

SEQ ID NO: 47150 - DNA, 20 bp, Artificial Sequence
  Synthetic oligonucleotide; GGG chr11 5241789 5241808 5241792 -
actcgtgggtggatttagtg

SEQ ID NO: 47151 - DNA, 20 bp, Artificial Sequence
  Synthetic oligonucleotide; TAG chr11 5241786 5241805 5241789 -
cgtgggtggatttagtgggg

SEQ ID NO: 47152 - DNA, 20 bp, Artificial Sequence
  Synthetic oligonucleotide; TAG chr11 5241776 5241795 5241779 -
tttagtggggtagttactcc

SEQ ID NO: 47153 - DNA, 20 bp, Artificial Sequence
  Synthetic oligonucleotide; AGG chr11 5241775 5241794 5241778 -
ttagtggggtagttactcct

SEQ ID NO: 47154 - DNA, 20 bp, Artificial Sequence
  Synthetic oligonucleotide; AAG chr11 5241772 5241791 5241775 -
gtggggtagttactcctagg

SEQ ID NO: 47155 - DNA, 20 bp, Artificial Sequence
  Synthetic oligonucleotide; AGG chr11 5241771 5241790 5241774 -
tggggtagttactcctagga

SEQ ID NO: 47156 - DNA, 20 bp, Artificial Sequence
  Synthetic oligonucleotide; GGG chr11 5241770 5241789 5241773 -
ggggtagttactcctaggaa

SEQ ID NO: 47157 - DNA, 20 bp, Artificial Sequence
  Synthetic oligonucleotide; GGG chr11 5241769 5241788 5241772 -
gggtagttactcctaggaag

SEQ ID NO: 47158 - DNA, 20 bp, Artificial Sequence
  Synthetic oligonucleotide; TAG chr11 5241756 5241775 5241759 -
taggaaggggaaatcgtctc

SEQ ID NO: 47159 - DNA, 20 bp, Artificial Sequence
  Synthetic oligonucleotide; AAG chr11 5241750 5241769 5241753 -
ggggaaatcgtctctagaat

SEQ ID NO: 47160 - DNA, 20 bp, Artificial Sequence
  Synthetic oligonucleotide; CAG chr11 5241735 5241754 5241738 -
agaataagacaatgttttta

SEQ ID NO: 47161 - DNA, 20 bp, Artificial Sequence
  Synthetic oligonucleotide; AAG chr11 5241731 5241750 5241734 -
taagacaatgtttttacaga

SEQ ID NO: 47162 - DNA, 20 bp, Artificial Sequence
  Synthetic oligonucleotide; AGG chr11 5241730 5241749 5241733 -
aagacaatgtttttacagaa

SEQ ID NO: 47163 - DNA, 20 bp, Artificial Sequence
  Synthetic oligonucleotide; GGG chr11 5241729 5241748 5241732 -
agacaatgtttttacagaaa

SEQ ID NO: 47164 - DNA, 20 bp, Artificial Sequence
  Synthetic oligonucleotide; GAG chr11 5241727 5241746 5241730 -
acaatgtttttacagaaagg

SEQ ID NO: 47165 - DNA, 20 bp, Artificial Sequence
  Synthetic oligonucleotide; AGG chr11 5241726 5241745 5241729 -
caatgtttttacagaaaggg

SEQ ID NO: 47166 - DNA, 20 bp, Artificial Sequence
  Synthetic oligonucleotide; TGG chr11 5241719 5241738 5241722 -
tttacagaaagggaggtcaa

SEQ ID NO: 47167 - DNA, 20 bp, Artificial Sequence
  Synthetic oligonucleotide; GAG chr11 5241717 5241736 5241720 -
tacagaaagggaggtcaatg

SEQ ID NO: 47168 - DNA, 20 bp, Artificial Sequence
  Synthetic oligonucleotide; AGG chr11 5241716 5241735 5241719 -
acagaaagggaggtcaatgg

SEQ ID NO: 47169 - DNA, 20 bp, Artificial Sequence
  Synthetic oligonucleotide; TGG chr11 5241706 5241725 5241709 -
aggtcaatggaggtactctt

SEQ ID NO: 47170 - DNA, 20 bp, Artificial Sequence
  Synthetic oligonucleotide; GAG chr11 5241704 5241723 5241707 -
gtcaatggaggtactctttg

SEQ ID NO: 47171 - DNA, 20 bp, Artificial Sequence
  Synthetic oligonucleotide; AGG chr11 5241703 5241722 5241706 -
tcaatggaggtactctttgg

SEQ ID NO: 47172 - DNA, 20 bp, Artificial Sequence
  Synthetic oligonucleotide; AAG chr11 5241697 5241716 5241700 -
gaggtactctttggaggtgt

SEQ ID NO: 47173 - DNA, 20 bp, Artificial Sequence
  Synthetic oligonucleotide; GAG chr11 5241695 5241714 5241698 -
ggtactctttggaggtgtaa

SEQ ID NO: 47174 - DNA, 20 bp, Artificial Sequence
  Synthetic oligonucleotide; AGG chr11 5241694 5241713 5241697 -
gtactctttggaggtgtaag

SEQ ID NO: 47175 - DNA, 20 bp, Artificial Sequence
  Synthetic oligonucleotide; TGG chr11 5241686 5241705 5241689 -
tggaggtgtaagaggattgt

SEQ ID NO: 47176 - DNA, 20 bp, Artificial Sequence
  Synthetic oligonucleotide; TAG chr11 5241683 5241702 5241686 -
aggtgtaagaggattgttgg

SEQ ID NO: 47177 - DNA, 20 bp, Artificial Sequence
  Synthetic oligonucleotide; TAG chr11 5241676 5241695 5241679 -
agaggattgttggtagtgtg

SEQ ID NO: 47178 - DNA, 20 bp, Artificial Sequence
  Synthetic oligonucleotide; GAG chr11 5241674 5241693 5241677 -
aggattgttggtagtgtgta

SEQ ID NO: 47179 - DNA, 20 bp, Artificial Sequence
  Synthetic oligonucleotide; AGG chr11 5241673 5241692 5241676 -
ggattgttggtagtgtgtag

SEQ ID NO: 47180 - DNA, 20 bp, Artificial Sequence
  Synthetic oligonucleotide; TAG chr11 5241665 5241684 5241668 -
ggtagtgtgtagaggtatgt

SEQ ID NO: 47181 - DNA, 20 bp, Artificial Sequence
  Synthetic oligonucleotide; AGG chr11 5241664 5241683 5241667 -
gtagtgtgtagaggtatgtt

SEQ ID NO: 47182 - DNA, 20 bp, Artificial Sequence
  Synthetic oligonucleotide; TAG chr11 5241653 5241672 5241656 -
aggtatgttaggactcaaat

SEQ ID NO: 47183 - DNA, 20 bp, Artificial Sequence
  Synthetic oligonucleotide; AAG chr11 5241650 5241669 5241653 -
tatgttaggactcaaattag

SEQ ID NO: 47184 - DNA, 20 bp, Artificial Sequence
  Synthetic oligonucleotide; TAG chr11 5241640 5241659 5241643 -
ctcaaattagaagttctgta

SEQ ID NO: 47185 - DNA, 20 bp, Artificial Sequence
  Synthetic oligonucleotide; AGG chr11 5241639 5241658 5241642 -
tcaaattagaagttctgtat

SEQ ID NO: 47186 - DNA, 20 bp, Artificial Sequence
  Synthetic oligonucleotide; CAG chr11 5241617 5241636 5241620 -
gctattatttgtatgaaact

SEQ ID NO: 47187 - DNA, 20 bp, Artificial Sequence
  Synthetic oligonucleotide; AGG chr11 5241616 5241635 5241619 -
ctattatttgtatgaaactc

SEQ ID NO: 47188 - DNA, 20 bp, Artificial Sequence
  Synthetic oligonucleotide; TAG chr11 5241610 5241629 5241613 -
tttgtatgaaactcaggata

SEQ ID NO: 47189 - DNA, 20 bp, Artificial Sequence
  Synthetic oligonucleotide; TGG chr11 5241601 5241620 5241604 -
aactcaggatatagctcatt

SEQ ID NO: 47190 - DNA, 20 bp, Artificial Sequence
  Synthetic oligonucleotide; CAG chr11 5241592 5241611 5241595 -
tatagctcatttggtgactg

SEQ ID NO: 47191 - DNA, 20 bp, Artificial Sequence
  Synthetic oligonucleotide; AAG chr11 5241542 5241561 5241545 -
attttttattatttataatg

SEQ ID NO: 47192 - DNA, 20 bp, Artificial Sequence
  Synthetic oligonucleotide; TGG chr11 5241539 5241558 5241542 -
ttttattatttataatgaag

SEQ ID NO: 47193 - DNA, 20 bp, Artificial Sequence
  Synthetic oligonucleotide; GGG chr11 5241538 5241557 5241541 -
tttattatttataatgaagt

SEQ ID NO: 47194 - DNA, 20 bp, Artificial Sequence
  Synthetic oligonucleotide; GGG chr11 5241537 5241556 5241540 -
ttattatttataatgaagtg

SEQ ID NO: 47195 - DNA, 20 bp, Artificial Sequence
  Synthetic oligonucleotide; TGG chr11 5241533 5241552 5241536 -
tatttataatgaagtgggga

SEQ ID NO: 47196 - DNA, 20 bp, Artificial Sequence
  Synthetic oligonucleotide; GGG chr11 5241532 5241551 5241535 -
atttataatgaagtggggat

SEQ ID NO: 47197 - DNA, 20 bp, Artificial Sequence
  Synthetic oligonucleotide; GGG chr11 5241531 5241550 5241534 -
tttataatgaagtggggatg

SEQ ID NO: 47198 - DNA, 20 bp, Artificial Sequence
  Synthetic oligonucleotide; TAG chr11 5241523 5241542 5241526 -
gaagtggggatggggcttcc

SEQ ID NO: 47199 - DNA, 20 bp, Artificial Sequence
  Synthetic oligonucleotide; GAG chr11 5241521 5241540 5241524 -
agtggggatggggcttccta

SEQ ID NO: 47200 - DNA, 20 bp, Artificial Sequence
  Synthetic oligonucleotide; AAG chr11 5241511 5241530 5241514 -
gggcttcctagagaccaatc

SEQ ID NO: 47201 - DNA, 20 bp, Artificial Sequence
  Synthetic oligonucleotide; AGG chr11 5241510 5241529 5241513 -
ggcttcctagagaccaatca

SEQ ID NO: 47202 - DNA, 20 bp, Artificial Sequence
  Synthetic oligonucleotide; GGG chr11 5241509 5241528 5241512 -
gcttcctagagaccaatcaa

SEQ ID NO: 47203 - DNA, 20 bp, Artificial Sequence
  Synthetic oligonucleotide; TGG chr11 5241474 5241493 5241477 -
ctttctcttaacgtcttcaa

SEQ ID NO: 47204 - DNA, 20 bp, Artificial Sequence
  Synthetic oligonucleotide; TAG chr11 5241465 5241484 5241468 -
aacgtcttcaatggtattaa

SEQ ID NO: 47205 - DNA, 20 bp, Artificial Sequence
  Synthetic oligonucleotide; GAG chr11 5241463 5241482 5241466 -
cgtcttcaatggtattaata

SEQ ID NO: 47206 - DNA, 20 bp, Artificial Sequence
  Synthetic oligonucleotide; AAG chr11 5241450 5241469 5241453 -
attaatagagaattatctct

SEQ ID NO: 47207 - DNA, 20 bp, Artificial Sequence
  Synthetic oligonucleotide; AGG chr11 5241449 5241468 5241452 -
ttaatagagaattatctcta

SEQ ID NO: 47208 - DNA, 20 bp, Artificial Sequence
  Synthetic oligonucleotide; TGG chr11 5241437 5241456 5241440 -
tatctctaaggcatgtgaac

SEQ ID NO: 47209 - DNA, 20 bp, Artificial Sequence
  Synthetic oligonucleotide; TGG chr11 5241428 5241447 5241431 -
ggcatgtgaactggctgtct

SEQ ID NO: 47210 - DNA, 20 bp, Artificial Sequence
  Synthetic oligonucleotide; AAG chr11 5241367 5241386 5241370 -
aacatatttataattccatt

SEQ ID NO: 47211 - DNA, 20 bp, Artificial Sequence
  Synthetic oligonucleotide; TAG chr11 5241352 5241371 5241355 -
ccattaagctgtgcatatga

SEQ ID NO: 47212 - DNA, 20 bp, Artificial Sequence
  Synthetic oligonucleotide; AAG chr11 5241326 5241345 5241329 -
tatcatatgtattttcctta

SEQ ID NO: 47213 - DNA, 20 bp, Artificial Sequence
  Synthetic oligonucleotide; AGG chr11 5241325 5241344 5241328 -
atcatatgtattttccttaa

SEQ ID NO: 47214 - DNA, 20 bp, Artificial Sequence
  Synthetic oligonucleotide; AAG chr11 5241314 5241333 5241317 -
tttccttaaaggatttttgt

SEQ ID NO: 47215 - DNA, 20 bp, Artificial Sequence
  Synthetic oligonucleotide; AAG chr11 5241288 5241307 5241291 -
taattgaattgatacctgta

SEQ ID NO: 47216 - DNA, 20 bp, Artificial Sequence
  Synthetic oligonucleotide; CAG chr11 5241245 5241264 5241248 -
aaataataaatctctttgtt

SEQ ID NO: 47217 - DNA, 20 bp, Artificial Sequence
  Synthetic oligonucleotide; AAG chr11 5241218 5241237 5241221 -
ctgtttctataaatatgtac

SEQ ID NO: 47218 - DNA, 20 bp, Artificial Sequence
  Synthetic oligonucleotide; TAG chr11 5241203 5241222 5241206 -
tgtacaagttttattgtttt

SEQ ID NO: 47219 - DNA, 20 bp, Artificial Sequence
  Synthetic oligonucleotide; TGG chr11 5241200 5241219 5241203 -
acaagttttattgtttttag

SEQ ID NO: 47220 - DNA, 20 bp, Artificial Sequence
  Synthetic oligonucleotide; TAG chr11 5241197 5241216 5241200 -
agttttattgtttttagtgg

SEQ ID NO: 47221 - DNA, 20 bp, Artificial Sequence
  Synthetic oligonucleotide; TAG chr11 5241113 5241132 5241116 -
ttttatgaataaaaaattat

SEQ ID NO: 47222 - DNA, 20 bp, Artificial Sequence
  Synthetic oligonucleotide; GAG chr11 5241074 5241093 5241077 -
ccactgatttttgtttatgt

SEQ ID NO: 47223 - DNA, 20 bp, Artificial Sequence
  Synthetic oligonucleotide; CAG chr11 5241067 5241086 5241070 -
tttttgtttatgtgagcaaa

SEQ ID NO: 47224 - DNA, 20 bp, Artificial Sequence
  Synthetic oligonucleotide; CAG chr11 5241064 5241083 5241067 -
ttgtttatgtgagcaaacag

SEQ ID NO: 47225 - DNA, 20 bp, Artificial Sequence
  Synthetic oligonucleotide; AAG chr11 5241056 5241075 5241059 -
gtgagcaaacagcagattaa

SEQ ID NO: 47226 - DNA, 20 bp, Artificial Sequence
  Synthetic oligonucleotide; AGG chr11 5241055 5241074 5241058 -
tgagcaaacagcagattaaa

SEQ ID NO: 47227 - DNA, 20 bp, Artificial Sequence
  Synthetic oligonucleotide; GAG chr11 5241050 5241069 5241053 -
aaacagcagattaaaaggct

SEQ ID NO: 47228 - DNA, 20 bp, Artificial Sequence
  Synthetic oligonucleotide; TAG chr11 5241044 5241063 5241047 -
cagattaaaaggctgagatt

SEQ ID NO: 47229 - DNA, 20 bp, Artificial Sequence
  Synthetic oligonucleotide; AGG chr11 5241043 5241062 5241046 -
agattaaaaggctgagattt

SEQ ID NO: 47230 - DNA, 20 bp, Artificial Sequence
  Synthetic oligonucleotide; CAG chr11 5241037 5241056 5241040 -
aaaggctgagatttaggaaa

SEQ ID NO: 47231 - DNA, 20 bp, Artificial Sequence
  Synthetic oligonucleotide; AAG chr11 5241028 5241047 5241031 -
gatttaggaaacagcacgtt

SEQ ID NO: 47232 - DNA, 20 bp, Artificial Sequence
  Synthetic oligonucleotide; AAG chr11 5241023 5241042 5241026 -
aggaaacagcacgttaagtc

SEQ ID NO: 47233 - DNA, 20 bp, Artificial Sequence
  Synthetic oligonucleotide; TAG chr11 5241016 5241035 5241019 -
agcacgttaagtcaagttga

SEQ ID NO: 47234 - DNA, 20 bp, Artificial Sequence
  Synthetic oligonucleotide; GAG chr11 5241014 5241033 5241017 -
cacgttaagtcaagttgata

SEQ ID NO: 47235 - DNA, 20 bp, Artificial Sequence
  Synthetic oligonucleotide; AGG chr11 5241013 5241032 5241016 -
acgttaagtcaagttgatag

SEQ ID NO: 47236 - DNA, 20 bp, Artificial Sequence
  Synthetic oligonucleotide; GAG chr11 5241011 5241030 5241014 -
gttaagtcaagttgatagag

SEQ ID NO: 47237 - DNA, 20 bp, Artificial Sequence
  Synthetic oligonucleotide; TGG chr11 5241004 5241023 5241007 -
caagttgatagaggagaata

SEQ ID NO: 47238 - DNA, 20 bp, Artificial Sequence
  Synthetic oligonucleotide; AAG chr11 5240993 5241012 5240996 -
aggagaatatggacatttaa

SEQ ID NO: 47239 - DNA, 20 bp, Artificial Sequence
  Synthetic oligonucleotide; GAG chr11 5240991 5241010 5240994 -
gagaatatggacatttaaaa

SEQ ID NO: 47240 - DNA, 20 bp, Artificial Sequence
  Synthetic oligonucleotide; AGG chr11 5240990 5241009 5240993 -
agaatatggacatttaaaag

SEQ ID NO: 47241 - DNA, 20 bp, Artificial Sequence
  Synthetic oligonucleotide; CAG chr11 5240987 5241006 5240990 -
atatggacatttaaaagagg

SEQ ID NO: 47242 - DNA, 20 bp, Artificial Sequence
  Synthetic oligonucleotide; AGG chr11 5240986 5241005 5240989 -
tatggacatttaaaagaggc

SEQ ID NO: 47243 - DNA, 20 bp, Artificial Sequence
  Synthetic oligonucleotide; TAG chr11 5240971 5240990 5240974 -
gaggcaggatgatataaaat

SEQ ID NO: 47244 - DNA, 20 bp, Artificial Sequence
  Synthetic oligonucleotide; AGG chr11 5240970 5240989 5240973 -
aggcaggatgatataaaatt

SEQ ID NO: 47245 - DNA, 20 bp, Artificial Sequence
  Synthetic oligonucleotide; GGG chr11 5240969 5240988 5240972 -
ggcaggatgatataaaatta

SEQ ID NO: 47246 - DNA, 20 bp, Artificial Sequence
  Synthetic oligonucleotide; TGG chr11 5240962 5240981 5240965 -
tgatataaaattagggaaac

SEQ ID NO: 47247 - DNA, 20 bp, Artificial Sequence
  Synthetic oligonucleotide; CAG chr11 5240956 5240975 5240959 -
aaaattagggaaactggatg

SEQ ID NO: 47248 - DNA, 20 bp, Artificial Sequence
  Synthetic oligonucleotide; GAG chr11 5240954 5240973 5240957 -
aattagggaaactggatgca

SEQ ID NO: 47249 - DNA, 20 bp, Artificial Sequence
  Synthetic oligonucleotide; CAG chr11 5240949 5240968 5240952 -
gggaaactggatgcagagac

SEQ ID NO: 47250 - DNA, 20 bp, Artificial Sequence
  Synthetic oligonucleotide; AAG chr11 5240943 5240962 5240946 -
ctggatgcagagaccagatg

SEQ ID NO: 47251 - DNA, 20 bp, Artificial Sequence
  Synthetic oligonucleotide; AAG chr11 5240939 5240958 5240942 -
atgcagagaccagatgaagt

SEQ ID NO: 47252 - DNA, 20 bp, Artificial Sequence
  Synthetic oligonucleotide; TAG chr11 5240931 5240950 5240934 -
accagatgaagtaagaaaaa

SEQ ID NO: 47253 - DNA, 20 bp, Artificial Sequence
  Synthetic oligonucleotide; GAG chr11 5240918 5240937 5240921 -
agaaaaatagctatcgtttt

SEQ ID NO: 47254 - DNA, 20 bp, Artificial Sequence
  Synthetic oligonucleotide; AAG chr11 5240903 5240922 5240906 -
gttttgagcaaaaatcactg

SEQ ID NO: 47255 - DNA, 20 bp, Artificial Sequence
  Synthetic oligonucleotide; GAG chr11 5240888 5240907 5240891 -
cactgaagtttcttgcatat

SEQ ID NO: 47256 - DNA, 20 bp, Artificial Sequence
  Synthetic oligonucleotide; GAG chr11 5240886 5240905 5240889 -
ctgaagtttcttgcatatga

SEQ ID NO: 47257 - DNA, 20 bp, Artificial Sequence
  Synthetic oligonucleotide; TAG chr11 5240871 5240890 5240874 -
tatgagagtgacataataaa

SEQ ID NO: 47258 - DNA, 20 bp, Artificial Sequence
  Synthetic oligonucleotide; AGG chr11 5240870 5240889 5240873 -
atgagagtgacataataaat

SEQ ID NO: 47259 - DNA, 20 bp, Artificial Sequence
  Synthetic oligonucleotide; GGG chr11 5240869 5240888 5240872 -
tgagagtgacataataaata

SEQ ID NO: 47260 - DNA, 20 bp, Artificial Sequence
  Synthetic oligonucleotide; TAG chr11 5240861 5240880 5240864 -
acataataaatagggaaacg

SEQ ID NO: 47261 - DNA, 20 bp, Artificial Sequence
  Synthetic oligonucleotide; TAG chr11 5240830 5240849 5240833 -
ttcacatgtatatatatata

SEQ ID NO: 47262 - DNA, 20 bp, Artificial Sequence
  Synthetic oligonucleotide; TAG chr11 5240820 5240839 5240823 -
tatatatatatagaactgat

SEQ ID NO: 47263 - DNA, 20 bp, Artificial Sequence
  Synthetic oligonucleotide; AAG chr11 5240814 5240833 5240817 -
tatatagaactgattagaca

SEQ ID NO: 47264 - DNA, 20 bp, Artificial Sequence
  Synthetic oligonucleotide; TGG chr11 5240804 5240823 5240807 -
tgattagacaaagtctaact

SEQ ID NO: 47265 - DNA, 20 bp, Artificial Sequence
  Synthetic oligonucleotide; GGG chr11 5240803 5240822 5240806 -
gattagacaaagtctaactt

SEQ ID NO: 47266 - DNA, 20 bp, Artificial Sequence
  Synthetic oligonucleotide; TAG chr11 5240798 5240817 5240801 -
gacaaagtctaacttgggta

SEQ ID NO: 47267 - DNA, 20 bp, Artificial Sequence
  Synthetic oligonucleotide; CAG chr11 5240794 5240813 5240797 -
aagtctaacttgggtatagt

SEQ ID NO: 47268 - DNA, 20 bp, Artificial Sequence
  Synthetic oligonucleotide; GAG chr11 5240792 5240811 5240795 -
gtctaacttgggtatagtca

SEQ ID NO: 47269 - DNA, 20 bp, Artificial Sequence
  Synthetic oligonucleotide; AGG chr11 5240791 5240810 5240794 -
tctaacttgggtatagtcag

SEQ ID NO: 47270 - DNA, 20 bp, Artificial Sequence
  Synthetic oligonucleotide; GAG chr11 5240789 5240808 5240792 -
taacttgggtatagtcagag

SEQ ID NO: 47271 - DNA, 20 bp, Artificial Sequence
  Synthetic oligonucleotide; GAG chr11 5240769 5240788 5240772 -
gagcttgctgtaattatatt

SEQ ID NO: 47272 - DNA, 20 bp, Artificial Sequence
  Synthetic oligonucleotide; AGG chr11 5240768 5240787 5240771 -
agcttgctgtaattatattg

SEQ ID NO: 47273 - DNA, 20 bp, Artificial Sequence
  Synthetic oligonucleotide; TGG chr11 5240762 5240781 5240765 -
ctgtaattatattgaggtga

SEQ ID NO: 47274 - DNA, 20 bp, Artificial Sequence
  Synthetic oligonucleotide; AAG chr11 5240756 5240775 5240759 -
ttatattgaggtgatggata

SEQ ID NO: 47275 - DNA, 20 bp, Artificial Sequence
  Synthetic oligonucleotide; AAG chr11 5240748 5240767 5240751 -
aggtgatggataaagaactg

SEQ ID NO: 47276 - DNA, 20 bp, Artificial Sequence
  Synthetic oligonucleotide; TGG chr11 5240741 5240760 5240744 -
ggataaagaactgaagttga

SEQ ID NO: 47277 - DNA, 20 bp, Artificial Sequence
  Synthetic oligonucleotide; AAG chr11 5240730 5240749 5240733 -
tgaagttgatggaaacaatg

SEQ ID NO: 47278 - DNA, 20 bp, Artificial Sequence
  Synthetic oligonucleotide; AAG chr11 5240725 5240744 5240728 -
ttgatggaaacaatgaagtt

SEQ ID NO: 47279 - DNA, 20 bp, Artificial Sequence
  Synthetic oligonucleotide; GAG chr11 5240712 5240731 5240715 -
tgaagttaagaaaaaaaatc

SEQ ID NO: 47280 - DNA, 20 bp, Artificial Sequence
  Synthetic oligonucleotide; AAG chr11 5240708 5240727 5240711 -
gttaagaaaaaaaatcgagt

SEQ ID NO: 47281 - DNA, 20 bp, Artificial Sequence
  Synthetic oligonucleotide; GAG chr11 5240706 5240725 5240709 -
taagaaaaaaaatcgagtaa

SEQ ID NO: 47282 - DNA, 20 bp, Artificial Sequence
  Synthetic oligonucleotide; TGG chr11 5240696 5240715 5240699 -
aatcgagtaagagaccattg

SEQ ID NO: 47283 - DNA, 20 bp, Artificial Sequence
  Synthetic oligonucleotide; CAG chr11 5240693 5240712 5240696 -
cgagtaagagaccattgtgg

SEQ ID NO: 47284 - DNA, 20 bp, Artificial Sequence
  Synthetic oligonucleotide; CAG chr11 5240682 5240701 5240685 -
ccattgtggcagtgattgca

SEQ ID NO: 47285 - DNA, 20 bp, Artificial Sequence
  Synthetic oligonucleotide; TGG chr11 5240676 5240695 5240679 -
tggcagtgattgcacagaac

SEQ ID NO: 47286 - DNA, 20 bp, Artificial Sequence
  Synthetic oligonucleotide; CAG chr11 5240659 5240678 5240662 -
aactggaaaacattgtgaaa

SEQ ID NO: 47287 - DNA, 20 bp, Artificial Sequence
  Synthetic oligonucleotide; GAG chr11 5240657 5240676 5240660 -
ctggaaaacattgtgaaaca

SEQ ID NO: 47288 - DNA, 20 bp, Artificial Sequence
  Synthetic oligonucleotide; GAG chr11 5240655 5240674 5240658 -
ggaaaacattgtgaaacaga

SEQ ID NO: 47289 - DNA, 20 bp, Artificial Sequence
  Synthetic oligonucleotide; CAG chr11 5240651 5240670 5240654 -
aacattgtgaaacagagagt

SEQ ID NO: 47290 - DNA, 20 bp, Artificial Sequence
  Synthetic oligonucleotide; GAG chr11 5240649 5240668 5240652 -
cattgtgaaacagagagtca

SEQ ID NO: 47291 - DNA, 20 bp, Artificial Sequence
  Synthetic oligonucleotide; CAG chr11 5240642 5240661 5240645 -
aaacagagagtcagagatga

SEQ ID NO: 47292 - DNA, 20 bp, Artificial Sequence
  Synthetic oligonucleotide; AAG chr11 5240615 5240634 5240618 -
aatccctgtctgtgaatgaa

SEQ ID NO: 47293 - DNA, 20 bp, Artificial Sequence
  Synthetic oligonucleotide; AAG chr11 5240612 5240631 5240615 -
ccctgtctgtgaatgaaaag

SEQ ID NO: 47294 - DNA, 20 bp, Artificial Sequence
  Synthetic oligonucleotide; AGG chr11 5240611 5240630 5240614 -
cctgtctgtgaatgaaaaga

SEQ ID NO: 47295 - DNA, 20 bp, Artificial Sequence
  Synthetic oligonucleotide; CAG chr11 5240597 5240616 5240600 -
aaaagaaggaaatttattga

SEQ ID NO: 47296 - DNA, 20 bp, Artificial Sequence
  Synthetic oligonucleotide; CAG chr11 5240592 5240611 5240595 -
aaggaaatttattgacagaa

SEQ ID NO: 47297 - DNA, 20 bp, Artificial Sequence
  Synthetic oligonucleotide; AAG chr11 5240578 5240597 5240581 -
acagaacagcaaatgcctac

SEQ ID NO: 47298 - DNA, 20 bp, Artificial Sequence
  Synthetic oligonucleotide; TGG chr11 5240566 5240585 5240569 -
atgcctacaagccccctgtt

SEQ ID NO: 47299 - DNA, 20 bp, Artificial Sequence
  Synthetic oligonucleotide; TGG chr11 5240560 5240579 5240563 -
acaagccccctgtttggatc

SEQ ID NO: 47300 - DNA, 20 bp, Artificial Sequence
  Synthetic oligonucleotide; TAG chr11 5240548 5240567 5240551 -
tttggatctggcaatgaacg

SEQ ID NO: 47301 - DNA, 20 bp, Artificial Sequence
  Synthetic oligonucleotide; TGG chr11 5240537 5240556 5240540 -
caatgaacgtagccattctg

SEQ ID NO: 47302 - DNA, 20 bp, Artificial Sequence
  Synthetic oligonucleotide; AAG chr11 5240510 5240529 5240513 -
cacttcaaactcctgtaccc

SEQ ID NO: 47303 - DNA, 20 bp, Artificial Sequence
  Synthetic oligonucleotide; TAG chr11 5240502 5240521 5240505 -
actcctgtacccaagaccct

SEQ ID NO: 47304 - DNA, 20 bp, Artificial Sequence
  Synthetic oligonucleotide; AGG chr11 5240501 5240520 5240504 -
ctcctgtacccaagaccctt

SEQ ID NO: 47305 - DNA, 20 bp, Artificial Sequence
  Synthetic oligonucleotide; AAG chr11 5240498 5240517 5240501 -
ctgtacccaagacccttagg

SEQ ID NO: 47306 - DNA, 20 bp, Artificial Sequence
  Synthetic oligonucleotide; TAG chr11 5240491 5240510 5240494 -
caagacccttaggaagtatg

SEQ ID NO: 47307 - DNA, 20 bp, Artificial Sequence
  Synthetic oligonucleotide; AAG chr11 5240466 5240485 5240469 -
ccctcaaacctaaaacctca

SEQ ID NO: 47308 - DNA, 20 bp, Artificial Sequence
  Synthetic oligonucleotide; AAG chr11 5240462 5240481 5240465 -
caaacctaaaacctcaaaga

SEQ ID NO: 47309 - DNA, 20 bp, Artificial Sequence
  Synthetic oligonucleotide; GAG chr11 5240460 5240479 5240463 -
aacctaaaacctcaaagaaa

SEQ ID NO: 47310 - DNA, 20 bp, Artificial Sequence
  Synthetic oligonucleotide; AGG chr11 5240459 5240478 5240462 -
acctaaaacctcaaagaaag

SEQ ID NO: 47311 - DNA, 20 bp, Artificial Sequence
  Synthetic oligonucleotide; TAG chr11 5240453 5240472 5240456 -
aacctcaaagaaagaggttt

SEQ ID NO: 47312 - DNA, 20 bp, Artificial Sequence
  Synthetic oligonucleotide; AAG chr11 5240450 5240469 5240453 -
ctcaaagaaagaggttttag

SEQ ID NO: 47313 - DNA, 20 bp, Artificial Sequence
  Synthetic oligonucleotide; CAG chr11 5240427 5240446 5240430 -
atataataccctttcttctc

SEQ ID NO: 47314 - DNA, 20 bp, Artificial Sequence
  Synthetic oligonucleotide; AAG chr11 5240396 5240415 5240399 -
atcccaaaacctctttctca

SEQ ID NO: 47315 - DNA, 20 bp, Artificial Sequence
  Synthetic oligonucleotide; AAG chr11 5240369 5240388 5240372 -
tcctctatgtgtccacccca

SEQ ID NO: 47316 - DNA, 20 bp, Artificial Sequence
  Synthetic oligonucleotide; GAG chr11 5240367 5240386 5240370 -
ctctatgtgtccaccccaaa

SEQ ID NO: 47317 - DNA, 20 bp, Artificial Sequence
  Synthetic oligonucleotide; GAG chr11 5240344 5240363 5240347 -
ctcacctcaccatatctctt

SEQ ID NO: 47318 - DNA, 20 bp, Artificial Sequence
  Synthetic oligonucleotide; TGG chr11 5240341 5240360 5240344 -
acctcaccatatctcttgag

SEQ ID NO: 47319 - DNA, 20 bp, Artificial Sequence
  Synthetic oligonucleotide; GGG chr11 5240340 5240359 5240343 -
cctcaccatatctcttgagt

SEQ ID NO: 47320 - DNA, 20 bp, Artificial Sequence
  Synthetic oligonucleotide; GAG chr11 5240338 5240357 5240341 -
tcaccatatctcttgagtgg

SEQ ID NO: 47321 - DNA, 20 bp, Artificial Sequence
  Synthetic oligonucleotide; TAG chr11 5240331 5240350 5240334 -
atctcttgagtgggagcaca

SEQ ID NO: 47322 - DNA, 20 bp, Artificial Sequence
  Synthetic oligonucleotide; TAG chr11 5240327 5240346 5240330 -
cttgagtgggagcacataga

SEQ ID NO: 47323 - DNA, 20 bp, Artificial Sequence
  Synthetic oligonucleotide; AGG chr11 5240326 5240345 5240329 -
ttgagtgggagcacatagat

SEQ ID NO: 47324 - DNA, 20 bp, Artificial Sequence
  Synthetic oligonucleotide; CGG chr11 5240323 5240342 5240326 -
agtgggagcacatagatagg

SEQ ID NO: 47325 - DNA, 20 bp, Artificial Sequence
  Synthetic oligonucleotide; CAG chr11 5240307 5240326 5240310 -
taggcggtgctaccatctaa

SEQ ID NO: 47326 - DNA, 20 bp, Artificial Sequence
  Synthetic oligonucleotide; GAG chr11 5240277 5240296 5240280 -
aattcctttgtcatattttt

SEQ ID NO: 47327 - DNA, 20 bp, Artificial Sequence
  Synthetic oligonucleotide; AAG chr11 5240255 5240274 5240258 -
gtccccactaataacccaca

SEQ ID NO: 47328 - DNA, 20 bp, Artificial Sequence
  Synthetic oligonucleotide; CAG chr11 5240252 5240271 5240255 -
cccactaataacccacaaag

SEQ ID NO: 47329 - DNA, 20 bp, Artificial Sequence
  Synthetic oligonucleotide; CAG chr11 5240240 5240259 5240243 -
ccacaaagcagaataaatac

SEQ ID NO: 47330 - DNA, 20 bp, Artificial Sequence
  Synthetic oligonucleotide; TAG chr11 5240201 5240220 5240204 -
atcactcaactgctgtcttg

SEQ ID NO: 47331 - DNA, 20 bp, Artificial Sequence
  Synthetic oligonucleotide; AAG chr11 5240186 5240205 5240189 -
tcttgtagcatacattaatt

SEQ ID NO: 47332 - DNA, 20 bp, Artificial Sequence
  Synthetic oligonucleotide; AAG chr11 5240083 5240102 5240086 -
gtcactctgtattttaaatg

SEQ ID NO: 47333 - DNA, 20 bp, Artificial Sequence
  Synthetic oligonucleotide; GAG chr11 5240081 5240100 5240084 -
cactctgtattttaaatgaa

SEQ ID NO: 47334 - DNA, 20 bp, Artificial Sequence
  Synthetic oligonucleotide; GAG chr11 5240076 5240095 5240079 -
tgtattttaaatgaagagat

SEQ ID NO: 47335 - DNA, 20 bp, Artificial Sequence
  Synthetic oligonucleotide; AGG chr11 5240075 5240094 5240078 -
gtattttaaatgaagagatg

SEQ ID NO: 47336 - DNA, 20 bp, Artificial Sequence
  Synthetic oligonucleotide; GGG chr11 5240074 5240093 5240077 -
tattttaaatgaagagatga

SEQ ID NO: 47337 - DNA, 20 bp, Artificial Sequence
  Synthetic oligonucleotide; GAG chr11 5240034 5240053 5240037 -
cttattgttcatttctcgat

SEQ ID NO: 47338 - DNA, 20 bp, Artificial Sequence
  Synthetic oligonucleotide; AGG chr11 5240033 5240052 5240036 -
ttattgttcatttctcgatg

SEQ ID NO: 47339 - DNA, 20 bp, Artificial Sequence
  Synthetic oligonucleotide; GAG chr11 5240031 5240050 5240034 -
attgttcatttctcgatgag

SEQ ID NO: 47340 - DNA, 20 bp, Artificial Sequence
  Synthetic oligonucleotide; TAG chr11 5240012 5240031 5240015 -
ggagttttcacattcacctt

SEQ ID NO: 47341 - DNA, 20 bp, Artificial Sequence
  Synthetic oligonucleotide; TGG chr11 5240009 5240028 5240012 -
gttttcacattcacctttag

SEQ ID NO: 47342 - DNA, 20 bp, Artificial Sequence
  Synthetic oligonucleotide; AAG chr11 5239997 5240016 5240000 -
acctttagtggaaaacacat

SEQ ID NO: 47343 - DNA, 20 bp, Artificial Sequence
  Synthetic oligonucleotide; CAG chr11 5239983 5240002 5239986 -
acacataagtacacatctta

SEQ ID NO: 47344 - DNA, 20 bp, Artificial Sequence
  Synthetic oligonucleotide; AGG chr11 5239982 5240001 5239985 -
cacataagtacacatcttac

SEQ ID NO: 47345 - DNA, 20 bp, Artificial Sequence
  Synthetic oligonucleotide; TAG chr11 5239957 5239976 5239960 -
aaatataccaaactgacatg

SEQ ID NO: 47346 - DNA, 20 bp, Artificial Sequence
  Synthetic oligonucleotide; TAG chr11 5239936 5239955 5239939 -
agcatgaatgcttgtgcatg

SEQ ID NO: 47347 - DNA, 20 bp, Artificial Sequence
  Synthetic oligonucleotide; TAG chr11 5239918 5239937 5239921 -
tgtagtcatataaaatcttg

SEQ ID NO: 47348 - DNA, 20 bp, Artificial Sequence
  Synthetic oligonucleotide; CAG chr11 5239886 5239905 5239889 -
cattctctgatatacacata

SEQ ID NO: 47349 - DNA, 20 bp, Artificial Sequence
  Synthetic oligonucleotide; AAG chr11 5239823 5239842 5239826 -
caaacattccatgcacacat

SEQ ID NO: 47350 - DNA, 20 bp, Artificial Sequence
  Synthetic oligonucleotide; CAG chr11 5239806 5239825 5239809 -
cataagaacacacactgtta

SEQ ID NO: 47351 - DNA, 20 bp, Artificial Sequence
  Synthetic oligonucleotide; GAG chr11 5239793 5239812 5239796 -
actgttacagatgcatactt

SEQ ID NO: 47352 - DNA, 20 bp, Artificial Sequence
  Synthetic oligonucleotide; CAG chr11 5239771 5239790 5239774 -
gtgcattgacaaaattaccc

SEQ ID NO: 47353 - DNA, 20 bp, Artificial Sequence
  Synthetic oligonucleotide; TAG chr11 5239762 5239781 5239765 -
caaaattaccccagtcaatc

SEQ ID NO: 47354 - DNA, 20 bp, Artificial Sequence
  Synthetic oligonucleotide; GAG chr11 5239760 5239779 5239763 -
aaattaccccagtcaatcta

SEQ ID NO: 47355 - DNA, 20 bp, Artificial Sequence
  Synthetic oligonucleotide; TGG chr11 5239753 5239772 5239756 -
cccagtcaatctagagaatt

SEQ ID NO: 47356 - DNA, 20 bp, Artificial Sequence
  Synthetic oligonucleotide; TAG chr11 5239730 5239749 5239733 -
atttctgcatttgactctgt

SEQ ID NO: 47357 - DNA, 20 bp, Artificial Sequence
  Synthetic oligonucleotide; TGG chr11 5239702 5239721 5239705 -
tacatgctgttcatttactc

SEQ ID NO: 47358 - DNA, 20 bp, Artificial Sequence
  Synthetic oligonucleotide; GGG chr11 5239701 5239720 5239704 -
acatgctgttcatttactct

SEQ ID NO: 47359 - DNA, 20 bp, Artificial Sequence
  Synthetic oligonucleotide; AAG chr11 5239651 5239670 5239654 -
ctatcttgtactcatacttt

SEQ ID NO: 47360 - DNA, 20 bp, Artificial Sequence
  Synthetic oligonucleotide; AAG chr11 5239623 5239642 5239626 -
acttatatgttatctcaact

SEQ ID NO: 47361 - DNA, 20 bp, Artificial Sequence
  Synthetic oligonucleotide; AAG chr11 5239620 5239639 5239623 -
tatatgttatctcaactaag

SEQ ID NO: 47362 - DNA, 20 bp, Artificial Sequence
  Synthetic oligonucleotide; TGG chr11 5239596 5239615 5239599 -
tatttttttttaattttaac

SEQ ID NO: 47363 - DNA, 20 bp, Artificial Sequence
  Synthetic oligonucleotide; GGG chr11 5239595 5239614 5239598 -
atttttttttaattttaact

SEQ ID NO: 47364 - DNA, 20 bp, Artificial Sequence
  Synthetic oligonucleotide; AAG chr11 5239588 5239607 5239591 -
tttaattttaactgggctta

SEQ ID NO: 47365 - DNA, 20 bp, Artificial Sequence
  Synthetic oligonucleotide; TGG chr11 5239558 5239577 5239561 -
tataaactctgctacaatta

SEQ ID NO: 47366 - DNA, 20 bp, Artificial Sequence
  Synthetic oligonucleotide; GGG chr11 5239557 5239576 5239560 -
ataaactctgctacaattat

SEQ ID NO: 47367 - DNA, 20 bp, Artificial Sequence
  Synthetic oligonucleotide; TAG chr11 5239537 5239556 5239540 -
gggctctttcttataatatt

SEQ ID NO: 47368 - DNA, 20 bp, Artificial Sequence
  Synthetic oligonucleotide; TGG chr11 5239466 5239485 5239469 -
ctaaattttaacctctttta

SEQ ID NO: 47369 - DNA, 20 bp, Artificial Sequence
  Synthetic oligonucleotide; TAG chr11 5239463 5239482 5239466 -
aattttaacctcttttatgg

SEQ ID NO: 47370 - DNA, 20 bp, Artificial Sequence
  Synthetic oligonucleotide; GAG chr11 5239461 5239480 5239464 -
ttttaacctcttttatggta

SEQ ID NO: 47371 - DNA, 20 bp, Artificial Sequence
  Synthetic oligonucleotide; TAG chr11 5239431 5239450 5239434 -
cttgtaaactcttatttccc

SEQ ID NO: 47372 - DNA, 20 bp, Artificial Sequence
  Synthetic oligonucleotide; TGG chr11 5239424 5239443 5239427 -
actcttatttccctagtatt

SEQ ID NO: 47373 - DNA, 20 bp, Artificial Sequence
  Synthetic oligonucleotide; GAG chr11 5239422 5239441 5239425 -
tcttatttccctagtatttg

SEQ ID NO: 47374 - DNA, 20 bp, Artificial Sequence
  Synthetic oligonucleotide; AAG chr11 5239410 5239429 5239413 -
agtatttggagatgaaaaaa

SEQ ID NO: 47375 - DNA, 20 bp, Artificial Sequence
  Synthetic oligonucleotide; TAG chr11 5239390 5239409 5239393 -
aagattaaattatccaaaat

SEQ ID NO: 47376 - DNA, 20 bp, Artificial Sequence
  Synthetic oligonucleotide; GAG chr11 5239367 5239386 5239370 -
atctctcttttctacattat

SEQ ID NO: 47377 - DNA, 20 bp, Artificial Sequence
  Synthetic oligonucleotide; TAG chr11 5239350 5239369 5239353 -
tatgagtattacactatcca

SEQ ID NO: 47378 - DNA, 20 bp, Artificial Sequence
  Synthetic oligonucleotide; GAG chr11 5239348 5239367 5239351 -
tgagtattacactatccata

SEQ ID NO: 47379 - DNA, 20 bp, Artificial Sequence
  Synthetic oligonucleotide; AAG chr11 5239345 5239364 5239348 -
gtattacactatccatagag

SEQ ID NO: 47380 - DNA, 20 bp, Artificial Sequence
  Synthetic oligonucleotide; GAG chr11 5239335 5239354 5239338 -
atccatagagaagtttgttt

SEQ ID NO: 47381 - DNA, 20 bp, Artificial Sequence
  Synthetic oligonucleotide; GAG chr11 5239323 5239342 5239326 -
gtttgtttgagacctaaact

SEQ ID NO: 47382 - DNA, 20 bp, Artificial Sequence
  Synthetic oligonucleotide; AGG chr11 5239322 5239341 5239325 -
tttgtttgagacctaaactg

SEQ ID NO: 47383 - DNA, 20 bp, Artificial Sequence
  Synthetic oligonucleotide; TGG chr11 5239313 5239332 5239316 -
gacctaaactgaggaacctt

SEQ ID NO: 47384 - DNA, 20 bp, Artificial Sequence
  Synthetic oligonucleotide; TAG chr11 5239286 5239305 5239289 -
aaaatgactatgtgatatct

SEQ ID NO: 47385 - DNA, 20 bp, Artificial Sequence
  Synthetic oligonucleotide; TAG chr11 5239277 5239296 5239280 -
atgtgatatcttagtattta

SEQ ID NO: 47386 - DNA, 20 bp, Artificial Sequence
  Synthetic oligonucleotide; AGG chr11 5239276 5239295 5239279 -
tgtgatatcttagtatttat

SEQ ID NO: 47387 - DNA, 20 bp, Artificial Sequence
  Synthetic oligonucleotide; GAG chr11 5239269 5239288 5239272 -
tcttagtatttataggtcat

SEQ ID NO: 47388 - DNA, 20 bp, Artificial Sequence
  Synthetic oligonucleotide; AGG chr11 5239268 5239287 5239271 -
cttagtatttataggtcatg

SEQ ID NO: 47389 - DNA, 20 bp, Artificial Sequence
  Synthetic oligonucleotide; TAG chr11 5239244 5239263 5239247 -
tccttcctctgcctctgcta

SEQ ID NO: 47390 - DNA, 20 bp, Artificial Sequence
  Synthetic oligonucleotide; TAG chr11 5239235 5239254 5239238 -
tgcctctgctatagtttgat

SEQ ID NO: 47391 - DNA, 20 bp, Artificial Sequence
  Synthetic oligonucleotide; AAG chr11 5239227 5239246 5239230 -
ctatagtttgattagtcaac

SEQ ID NO: 47392 - DNA, 20 bp, Artificial Sequence
  Synthetic oligonucleotide; CAG chr11 5239200 5239219 5239203 -
tgtcatgcatttattcacat

SEQ ID NO: 47393 - DNA, 20 bp, Artificial Sequence
  Synthetic oligonucleotide; AAG chr11 5239181 5239200 5239184 -
tcagaatttcatacactaat

SEQ ID NO: 47394 - DNA, 20 bp, Artificial Sequence
  Synthetic oligonucleotide; TAG chr11 5239175 5239194 5239178 -
tttcatacactaataagaca

SEQ ID NO: 47395 - DNA, 20 bp, Artificial Sequence
  Synthetic oligonucleotide; CAG chr11 5239169 5239188 5239172 -
acactaataagacatagtat

SEQ ID NO: 47396 - DNA, 20 bp, Artificial Sequence
  Synthetic oligonucleotide; AAG chr11 5239166 5239185 5239169 -
ctaataagacatagtatcag

SEQ ID NO: 47397 - DNA, 20 bp, Artificial Sequence
  Synthetic oligonucleotide; CAG chr11 5239162 5239181 5239165 -
taagacatagtatcagaagt

SEQ ID NO: 47398 - DNA, 20 bp, Artificial Sequence
  Synthetic oligonucleotide; TAG chr11 5239154 5239173 5239157 -
agtatcagaagtcagtttat

SEQ ID NO: 47399 - DNA, 20 bp, Artificial Sequence
  Synthetic oligonucleotide; CAG chr11 5239145 5239164 5239148 -
agtcagtttattagttatat

SEQ ID NO: 47400 - DNA, 20 bp, Artificial Sequence
  Synthetic oligonucleotide; TAG chr11 5239141 5239160 5239144 -
agtttattagttatatcagt

SEQ ID NO: 47401 - DNA, 20 bp, Artificial Sequence
  Synthetic oligonucleotide; AGG chr11 5239140 5239159 5239143 -
gtttattagttatatcagtt

SEQ ID NO: 47402 - DNA, 20 bp, Artificial Sequence
  Synthetic oligonucleotide; GGG chr11 5239139 5239158 5239142 -
tttattagttatatcagtta

SEQ ID NO: 47403 - DNA, 20 bp, Artificial Sequence
  Synthetic oligonucleotide; AAG chr11 5239130 5239149 5239133 -
tatatcagttagggtccatc

SEQ ID NO: 47404 - DNA, 20 bp, Artificial Sequence
  Synthetic oligonucleotide; AGG chr11 5239129 5239148 5239132 -
atatcagttagggtccatca

SEQ ID NO: 47405 - DNA, 20 bp, Artificial Sequence
  Synthetic oligonucleotide; AAG chr11 5239125 5239144 5239128 -
cagttagggtccatcaagga

SEQ ID NO: 47406 - DNA, 20 bp, Artificial Sequence
  Synthetic oligonucleotide; AGG chr11 5239124 5239143 5239127 -
agttagggtccatcaaggaa

SEQ ID NO: 47407 - DNA, 20 bp, Artificial Sequence
  Synthetic oligonucleotide; CAG chr11 5239109 5239128 5239112 -
aggaaaggacaaaccattat

SEQ ID NO: 47408 - DNA, 20 bp, Artificial Sequence
  Synthetic oligonucleotide; TAG chr11 5239096 5239115 5239099 -
ccattatcagttactcaacc

SEQ ID NO: 47409 - DNA, 20 bp, Artificial Sequence
  Synthetic oligonucleotide; CAG chr11 5239084 5239103 5239087 -
actcaacctagaattaaata

SEQ ID NO: 47410 - DNA, 20 bp, Artificial Sequence
  Synthetic oligonucleotide; TAG chr11 5239074 5239093 5239077 -
gaattaaatacagctcttaa

SEQ ID NO: 47411 - DNA, 20 bp, Artificial Sequence
  Synthetic oligonucleotide; TGG chr11 5239055 5239074 5239058 -
atagttaattatccttgtat

SEQ ID NO: 47412 - DNA, 20 bp, Artificial Sequence
  Synthetic oligonucleotide; AAG chr11 5239052 5239071 5239055 -
gttaattatccttgtattgg

SEQ ID NO: 47413 - DNA, 20 bp, Artificial Sequence
  Synthetic oligonucleotide; GAG chr11 5239050 5239069 5239053 -
taattatccttgtattggaa

SEQ ID NO: 47414 - DNA, 20 bp, Artificial Sequence
  Synthetic oligonucleotide; AAG chr11 5239032 5239051 5239035 -
aagagctaaaatatcaaata

SEQ ID NO: 47415 - DNA, 20 bp, Artificial Sequence
  Synthetic oligonucleotide; AGG chr11 5239031 5239050 5239034 -
agagctaaaatatcaaataa

SEQ ID NO: 47416 - DNA, 20 bp, Artificial Sequence
  Synthetic oligonucleotide; CAG chr11 5239027 5239046 5239030 -
ctaaaatatcaaataaagga

SEQ ID NO: 47417 - DNA, 20 bp, Artificial Sequence
  Synthetic oligonucleotide; CAG chr11 5239022 5239041 5239025 -
atatcaaataaaggacagtg

SEQ ID NO: 47418 - DNA, 20 bp, Artificial Sequence
  Synthetic oligonucleotide; TAG chr11 5239014 5239033 5239017 -
taaaggacagtgcagaaatc

SEQ ID NO: 47419 - DNA, 20 bp, Artificial Sequence
  Synthetic oligonucleotide; TAG chr11 5239007 5239026 5239010 -
cagtgcagaaatctagatgt

SEQ ID NO: 47420 - DNA, 20 bp, Artificial Sequence
  Synthetic oligonucleotide; CAG chr11 5238998 5239017 5239001 -
aatctagatgttagtaacat

SEQ ID NO: 47421 - DNA, 20 bp, Artificial Sequence
  Synthetic oligonucleotide; TAG chr11 5238978 5238997 5238981 -
cagaaaacctcttccgccat

SEQ ID NO: 47422 - DNA, 20 bp, Artificial Sequence
  Synthetic oligonucleotide; AGG chr11 5238977 5238996 5238980 -
agaaaacctcttccgccatt

SEQ ID NO: 47423 - DNA, 20 bp, Artificial Sequence
  Synthetic oligonucleotide; TAG chr11 5238972 5238991 5238975 -
acctcttccgccattaggcc

SEQ ID NO: 47424 - DNA, 20 bp, Artificial Sequence
  Synthetic oligonucleotide; AAG chr11 5238969 5238988 5238972 -
tcttccgccattaggcctag

SEQ ID NO: 47425 - DNA, 20 bp, Artificial Sequence
  Synthetic oligonucleotide; AGG chr11 5238968 5238987 5238971 -
cttccgccattaggcctaga

SEQ ID NO: 47426 - DNA, 20 bp, Artificial Sequence
  Synthetic oligonucleotide; GGG chr11 5238967 5238986 5238970 -
ttccgccattaggcctagaa

SEQ ID NO: 47427 - DNA, 20 bp, Artificial Sequence
  Synthetic oligonucleotide; CAG chr11 5238964 5238983 5238967 -
cgccattaggcctagaaggg

SEQ ID NO: 47428 - DNA, 20 bp, Artificial Sequence
  Synthetic oligonucleotide; AAG chr11 5238961 5238980 5238964 -
cattaggcctagaagggcag

SEQ ID NO: 47429 - DNA, 20 bp, Artificial Sequence
  Synthetic oligonucleotide; AGG chr11 5238960 5238979 5238963 -
attaggcctagaagggcaga

SEQ ID NO: 47430 - DNA, 20 bp, Artificial Sequence
  Synthetic oligonucleotide; GAG chr11 5238958 5238977 5238961 -
taggcctagaagggcagaag

SEQ ID NO: 47431 - DNA, 20 bp, Artificial Sequence
  Synthetic oligonucleotide; CAG chr11 5238939 5238958 5238942 -
ggagaaaatgtttataccac

SEQ ID NO: 47432 - DNA, 20 bp, Artificial Sequence
  Synthetic oligonucleotide; GAG chr11 5238937 5238956 5238940 -
agaaaatgtttataccacca

SEQ ID NO: 47433 - DNA, 20 bp, Artificial Sequence
  Synthetic oligonucleotide; CAG chr11 5238932 5238951 5238935 -
atgtttataccaccagagtc

SEQ ID NO: 47434 - DNA, 20 bp, Artificial Sequence
  Synthetic oligonucleotide; CAG chr11 5238926 5238945 5238929 -
ataccaccagagtccagaac

SEQ ID NO: 47435 - DNA, 20 bp, Artificial Sequence
  Synthetic oligonucleotide; GAG chr11 5238924 5238943 5238927 -
accaccagagtccagaacca

SEQ ID NO: 47436 - DNA, 20 bp, Artificial Sequence
  Synthetic oligonucleotide; CAG chr11 5238913 5238932 5238916 -
ccagaaccagagcccataac

SEQ ID NO: 47437 - DNA, 20 bp, Artificial Sequence
  Synthetic oligonucleotide; GAG chr11 5238911 5238930 5238914 -
agaaccagagcccataacca

SEQ ID NO: 47438 - DNA, 20 bp, Artificial Sequence
  Synthetic oligonucleotide; AGG chr11 5238910 5238929 5238913 -
gaaccagagcccataaccag

SEQ ID NO: 47439 - DNA, 20 bp, Artificial Sequence
  Synthetic oligonucleotide; TGG chr11 5238902 5238921 5238905 -
gcccataaccagaggtccac

SEQ ID NO: 47440 - DNA, 20 bp, Artificial Sequence
  Synthetic oligonucleotide; CAG chr11 5238896 5238915 5238899 -
aaccagaggtccactggatt

SEQ ID NO: 47441 - DNA, 20 bp, Artificial Sequence
  Synthetic oligonucleotide; GAG chr11 5238892 5238911 5238895 -
agaggtccactggattcagt

SEQ ID NO: 47442 - DNA, 20 bp, Artificial Sequence
  Synthetic oligonucleotide; TAG chr11 5238888 5238907 5238891 -
gtccactggattcagtgagc

SEQ ID NO: 47443 - DNA, 20 bp, Artificial Sequence
  Synthetic oligonucleotide; TGG chr11 5238885 5238904 5238888 -
cactggattcagtgagctag

SEQ ID NO: 47444 - DNA, 20 bp, Artificial Sequence
  Synthetic oligonucleotide; GGG chr11 5238884 5238903 5238887 -
actggattcagtgagctagt

SEQ ID NO: 47445 - DNA, 20 bp, Artificial Sequence
  Synthetic oligonucleotide; TGG chr11 5238874 5238893 5238877 -
gtgagctagtgggtgctcct

SEQ ID NO: 47446 - DNA, 20 bp, Artificial Sequence
  Synthetic oligonucleotide; GAG chr11 5238872 5238891 5238875 -
gagctagtgggtgctccttg

SEQ ID NO: 47447 - DNA, 20 bp, Artificial Sequence
  Synthetic oligonucleotide; GAG chr11 5238870 5238889 5238873 -
gctagtgggtgctccttgga

SEQ ID NO: 47448 - DNA, 20 bp, Artificial Sequence
  Synthetic oligonucleotide; GAG chr11 5238868 5238887 5238871 -
tagtgggtgctccttggaga

SEQ ID NO: 47449 - DNA, 20 bp, Artificial Sequence
  Synthetic oligonucleotide; CAG chr11 5238864 5238883 5238867 -
gggtgctccttggagagagc

SEQ ID NO: 47450 - DNA, 20 bp, Artificial Sequence
  Synthetic oligonucleotide; TGG chr11 5238851 5238870 5238854 -
agagagccagaactgtctaa

SEQ ID NO: 47451 - DNA, 20 bp, Artificial Sequence
  Synthetic oligonucleotide; GGG chr11 5238850 5238869 5238853 -
gagagccagaactgtctaat

SEQ ID NO: 47452 - DNA, 20 bp, Artificial Sequence
  Synthetic oligonucleotide; GGG chr11 5238849 5238868 5238852 -
agagccagaactgtctaatg

SEQ ID NO: 47453 - DNA, 20 bp, Artificial Sequence
  Synthetic oligonucleotide; GGG chr11 5238848 5238867 5238851 -
gagccagaactgtctaatgg

SEQ ID NO: 47454 - DNA, 20 bp, Artificial Sequence
  Synthetic oligonucleotide; AAG chr11 5238840 5238859 5238843 -
actgtctaatgggggcatca

SEQ ID NO: 47455 - DNA, 20 bp, Artificial Sequence
  Synthetic oligonucleotide; CAG chr11 5238834 5238853 5238837 -
taatgggggcatcaaagtat

SEQ ID NO: 47456 - DNA, 20 bp, Artificial Sequence
  Synthetic oligonucleotide; AAG chr11 5238813 5238832 5238816 -
agccataaaaaaccataaaa

SEQ ID NO: 47457 - DNA, 20 bp, Artificial Sequence
  Synthetic oligonucleotide; TAG chr11 5238799 5238818 5238802 -
ataaaaaagactgtctgctg

SEQ ID NO: 47458 - DNA, 20 bp, Artificial Sequence
  Synthetic oligonucleotide; AGG chr11 5238798 5238817 5238801 -
taaaaaagactgtctgctgt

SEQ ID NO: 47459 - DNA, 20 bp, Artificial Sequence
  Synthetic oligonucleotide; GAG chr11 5238796 5238815 5238799 -
aaaaagactgtctgctgtag

SEQ ID NO: 47460 - DNA, 20 bp, Artificial Sequence
  Synthetic oligonucleotide; CAG chr11 5238786 5238805 5238789 -
tctgctgtaggagatccgtt

SEQ ID NO: 47461 - DNA, 20 bp, Artificial Sequence
  Synthetic oligonucleotide; GAG chr11 5238784 5238803 5238787 -
tgctgtaggagatccgttca

SEQ ID NO: 47462 - DNA, 20 bp, Artificial Sequence
  Synthetic oligonucleotide; GAG chr11 5238782 5238801 5238785 -
ctgtaggagatccgttcaga

SEQ ID NO: 47463 - DNA, 20 bp, Artificial Sequence
  Synthetic oligonucleotide; GAG chr11 5238780 5238799 5238783 -
gtaggagatccgttcagaga

SEQ ID NO: 47464 - DNA, 20 bp, Artificial Sequence
  Synthetic oligonucleotide; GAG chr11 5238778 5238797 5238781 -
aggagatccgttcagagaga

SEQ ID NO: 47465 - DNA, 20 bp, Artificial Sequence
  Synthetic oligonucleotide; GAG chr11 5238776 5238795 5238779 -
gagatccgttcagagagaga

SEQ ID NO: 47466 - DNA, 20 bp, Artificial Sequence
  Synthetic oligonucleotide; GAG chr11 5238774 5238793 5238777 -
gatccgttcagagagagaga

SEQ ID NO: 47467 - DNA, 20 bp, Artificial Sequence
  Synthetic oligonucleotide; CAG chr11 5238769 5238788 5238772 -
gttcagagagagagagagac

SEQ ID NO: 47468 - DNA, 20 bp, Artificial Sequence
  Synthetic oligonucleotide; CAG chr11 5238741 5238760 5238744 -
atcttgcttatgctttccct

SEQ ID NO: 47469 - DNA, 20 bp, Artificial Sequence
  Synthetic oligonucleotide; CAG chr11 5238737 5238756 5238740 -
tgcttatgctttccctcagc

SEQ ID NO: 47470 - DNA, 20 bp, Artificial Sequence
  Synthetic oligonucleotide; CAG chr11 5238722 5238741 5238725 -
tcagccagtgtttaccattg

SEQ ID NO: 47471 - DNA, 20 bp, Artificial Sequence
  Synthetic oligonucleotide; AAG chr11 5238702 5238721 5238705 -
cagaatgtacatgcgactga

SEQ ID NO: 47472 - DNA, 20 bp, Artificial Sequence
  Synthetic oligonucleotide; AGG chr11 5238701 5238720 5238704 -
agaatgtacatgcgactgaa

SEQ ID NO: 47473 - DNA, 20 bp, Artificial Sequence
  Synthetic oligonucleotide; GGG chr11 5238700 5238719 5238703 -
gaatgtacatgcgactgaaa

SEQ ID NO: 47474 - DNA, 20 bp, Artificial Sequence
  Synthetic oligonucleotide; GAG chr11 5238696 5238715 5238699 -
gtacatgcgactgaaagggt

SEQ ID NO: 47475 - DNA, 20 bp, Artificial Sequence
  Synthetic oligonucleotide; AGG chr11 5238695 5238714 5238698 -
tacatgcgactgaaagggtg

SEQ ID NO: 47476 - DNA, 20 bp, Artificial Sequence
  Synthetic oligonucleotide; TGG chr11 5238687 5238706 5238690 -
actgaaagggtgaggaaacc

SEQ ID NO: 47477 - DNA, 20 bp, Artificial Sequence
  Synthetic oligonucleotide; GGG chr11 5238686 5238705 5238689 -
ctgaaagggtgaggaaacct

SEQ ID NO: 47478 - DNA, 20 bp, Artificial Sequence
  Synthetic oligonucleotide; CAG chr11 5238677 5238696 5238680 -
tgaggaaacctgggaaatgt

SEQ ID NO: 47479 - DNA, 20 bp, Artificial Sequence
  Synthetic oligonucleotide; CAG chr11 5238663 5238682 5238666 -
aaatgtcagttcctcaaata

SEQ ID NO: 47480 - DNA, 20 bp, Artificial Sequence
  Synthetic oligonucleotide; GAG chr11 5238661 5238680 5238664 -
atgtcagttcctcaaataca

SEQ ID NO: 47481 - DNA, 20 bp, Artificial Sequence
  Synthetic oligonucleotide; GAG chr11 5238652 5238671 5238655 -
cctcaaatacagagaacact

SEQ ID NO: 47482 - DNA, 20 bp, Artificial Sequence
  Synthetic oligonucleotide; AGG chr11 5238651 5238670 5238654 -
ctcaaatacagagaacactg

SEQ ID NO: 47483 - DNA, 20 bp, Artificial Sequence
  Synthetic oligonucleotide; GGG chr11 5238650 5238669 5238653 -
tcaaatacagagaacactga

SEQ ID NO: 47484 - DNA, 20 bp, Artificial Sequence
  Synthetic oligonucleotide; AAG chr11 5238647 5238666 5238650 -
aatacagagaacactgaggg

SEQ ID NO: 47485 - DNA, 20 bp, Artificial Sequence
  Synthetic oligonucleotide; AGG chr11 5238646 5238665 5238649 -
atacagagaacactgaggga

SEQ ID NO: 47486 - DNA, 20 bp, Artificial Sequence
  Synthetic oligonucleotide; GAG chr11 5238641 5238660 5238644 -
gagaacactgagggaaggat

SEQ ID NO: 47487 - DNA, 20 bp, Artificial Sequence
  Synthetic oligonucleotide; AAG chr11 5238626 5238645 5238629 -
aggatgagaaataaatgtga

SEQ ID NO: 47488 - DNA, 20 bp, Artificial Sequence
  Synthetic oligonucleotide; CAG chr11 5238623 5238642 5238626 -
atgagaaataaatgtgaaag

SEQ ID NO: 47489 - DNA, 20 bp, Artificial Sequence
  Synthetic oligonucleotide; TGG chr11 5238613 5238632 5238616 -
aatgtgaaagcagacatgaa

SEQ ID NO: 47490 - DNA, 20 bp, Artificial Sequence
  Synthetic oligonucleotide; CAG chr11 5238603 5238622 5238606 -
cagacatgaatggtaattga

SEQ ID NO: 47491 - DNA, 20 bp, Artificial Sequence
  Synthetic oligonucleotide; AAG chr11 5238600 5238619 5238603 -
acatgaatggtaattgacag

SEQ ID NO: 47492 - DNA, 20 bp, Artificial Sequence
  Synthetic oligonucleotide; AGG chr11 5238599 5238618 5238602 -
catgaatggtaattgacaga

SEQ ID NO: 47493 - DNA, 20 bp, Artificial Sequence
  Synthetic oligonucleotide; TAG chr11 5238592 5238611 5238595 -
ggtaattgacagaaggaaac

SEQ ID NO: 47494 - DNA, 20 bp, Artificial Sequence
  Synthetic oligonucleotide; AGG chr11 5238591 5238610 5238594 -
gtaattgacagaaggaaact

SEQ ID NO: 47495 - DNA, 20 bp, Artificial Sequence
  Synthetic oligonucleotide; CAG chr11 5238581 5238600 5238584 -
gaaggaaactaggatgtgtc

SEQ ID NO: 47496 - DNA, 20 bp, Artificial Sequence
  Synthetic oligonucleotide; CAG chr11 5238564 5238583 5238567 -
gtccagtaaatgaataatta

SEQ ID NO: 47497 - DNA, 20 bp, Artificial Sequence
  Synthetic oligonucleotide; CAG chr11 5238557 5238576 5238560 -
aaatgaataattacagtgtg

SEQ ID NO: 47498 - DNA, 20 bp, Artificial Sequence
  Synthetic oligonucleotide; AAG chr11 5238526 5238545 5238529 -
gcaatgattaatgtattgat

SEQ ID NO: 47499 - DNA, 20 bp, Artificial Sequence
  Synthetic oligonucleotide; CAG chr11 5238509 5238528 5238512 -
gataagataatatgaaaaca

SEQ ID NO: 47500 - DNA, 20 bp, Artificial Sequence
  Synthetic oligonucleotide; CAG chr11 5238498 5238517 5238501 -
atgaaaacacagaattcaaa

SEQ ID NO: 47501 - DNA, 20 bp, Artificial Sequence
  Synthetic oligonucleotide; CAG chr11 5238495 5238514 5238498 -
aaaacacagaattcaaacag

SEQ ID NO: 47502 - DNA, 20 bp, Artificial Sequence
  Synthetic oligonucleotide; GAG chr11 5238486 5238505 5238489 -
aattcaaacagcagtgaact

SEQ ID NO: 47503 - DNA, 20 bp, Artificial Sequence
  Synthetic oligonucleotide; TAG chr11 5238481 5238500 5238484 -
aaacagcagtgaactgagat

SEQ ID NO: 47504 - DNA, 20 bp, Artificial Sequence
  Synthetic oligonucleotide; TGG chr11 5238473 5238492 5238476 -
gtgaactgagattagaattg

SEQ ID NO: 47505 - DNA, 20 bp, Artificial Sequence
  Synthetic oligonucleotide; GAG chr11 5238471 5238490 5238474 -
gaactgagattagaattgtg

SEQ ID NO: 47506 - DNA, 20 bp, Artificial Sequence
  Synthetic oligonucleotide; GAG chr11 5238469 5238488 5238472 -
actgagattagaattgtgga

SEQ ID NO: 47507 - DNA, 20 bp, Artificial Sequence
  Synthetic oligonucleotide; TGG chr11 5238463 5238482 5238466 -
attagaattgtggagagcac

SEQ ID NO: 47508 - DNA, 20 bp, Artificial Sequence
  Synthetic oligonucleotide; AAG chr11 5238455 5238474 5238458 -
tgtggagagcactggcattt

SEQ ID NO: 47509 - DNA, 20 bp, Artificial Sequence
  Synthetic oligonucleotide; TAG chr11 5238441 5238460 5238444 -
gcatttaagaatgtcacact

SEQ ID NO: 47510 - DNA, 20 bp, Artificial Sequence
  Synthetic oligonucleotide; TAG chr11 5238428 5238447 5238431 -
tcacacttagaatgtgtctc

SEQ ID NO: 47511 - DNA, 20 bp, Artificial Sequence
  Synthetic oligonucleotide; AGG chr11 5238427 5238446 5238430 -
cacacttagaatgtgtctct

SEQ ID NO: 47512 - DNA, 20 bp, Artificial Sequence
  Synthetic oligonucleotide; TAG chr11 5238372 5238391 5238375 -
attatctgaaaattatgaat

SEQ ID NO: 47513 - DNA, 20 bp, Artificial Sequence
  Synthetic oligonucleotide; AGG chr11 5238371 5238390 5238374 -
ttatctgaaaattatgaatt

SEQ ID NO: 47514 - DNA, 20 bp, Artificial Sequence
  Synthetic oligonucleotide; AAG chr11 5238364 5238383 5238367 -
aaaattatgaattaggtaca

SEQ ID NO: 47515 - DNA, 20 bp, Artificial Sequence
  Synthetic oligonucleotide; CAG chr11 5238342 5238361 5238345 -
gctcaaataatttatttttt

SEQ ID NO: 47516 - DNA, 20 bp, Artificial Sequence
  Synthetic oligonucleotide; AGG chr11 5238341 5238360 5238344 -
ctcaaataatttattttttc

SEQ ID NO: 47517 - DNA, 20 bp, Artificial Sequence
  Synthetic oligonucleotide; TAG chr11 5238337 5238356 5238340 -
aataatttattttttcaggt

SEQ ID NO: 47518 - DNA, 20 bp, Artificial Sequence
  Synthetic oligonucleotide; AAG chr11 5238333 5238352 5238336 -
atttattttttcaggttagc

SEQ ID NO: 47519 - DNA, 20 bp, Artificial Sequence
  Synthetic oligonucleotide; GAG chr11 5238310 5238329 5238313 -
aactttttttttttttttct

SEQ ID NO: 47520 - DNA, 20 bp, Artificial Sequence
  Synthetic oligonucleotide; TAG chr11 5238306 5238325 5238309 -
ttttttttttttttctgaga

SEQ ID NO: 47521 - DNA, 20 bp, Artificial Sequence
  Synthetic oligonucleotide; GAG chr11 5238304 5238323 5238307 -
ttttttttttttctgagata

SEQ ID NO: 47522 - DNA, 20 bp, Artificial Sequence
  Synthetic oligonucleotide; TGG chr11 5238293 5238312 5238296 -
tctgagatagagcattgcta

SEQ ID NO: 47523 - DNA, 20 bp, Artificial Sequence
  Synthetic oligonucleotide; CAG chr11 5238285 5238304 5238288 -
agagcattgctatggttgcc

SEQ ID NO: 47524 - DNA, 20 bp, Artificial Sequence
  Synthetic oligonucleotide; AGG chr11 5238284 5238303 5238287 -
gagcattgctatggttgccc

SEQ ID NO: 47525 - DNA, 20 bp, Artificial Sequence
  Synthetic oligonucleotide; TGG chr11 5238280 5238299 5238283 -
attgctatggttgcccaggc

SEQ ID NO: 47526 - DNA, 20 bp, Artificial Sequence
  Synthetic oligonucleotide; GAG chr11 5238278 5238297 5238281 -
tgctatggttgcccaggctg

SEQ ID NO: 47527 - DNA, 20 bp, Artificial Sequence
  Synthetic oligonucleotide; TGG chr11 5238270 5238289 5238273 -
ttgcccaggctggagtgcaa

SEQ ID NO: 47528 - DNA, 20 bp, Artificial Sequence
  Synthetic oligonucleotide; CAG chr11 5238260 5238279 5238263 -
tggagtgcaatggcatgatc

SEQ ID NO: 47529 - DNA, 20 bp, Artificial Sequence
  Synthetic oligonucleotide; AGG chr11 5238259 5238278 5238262 -
ggagtgcaatggcatgatcc

SEQ ID NO: 47530 - DNA, 20 bp, Artificial Sequence
  Synthetic oligonucleotide; CAG chr11 5238235 5238254 5238238 -
tcactgcaacatctgcctcc

SEQ ID NO: 47531 - DNA, 20 bp, Artificial Sequence
  Synthetic oligonucleotide; AGG chr11 5238234 5238253 5238237 -
cactgcaacatctgcctccc

SEQ ID NO: 47532 - DNA, 20 bp, Artificial Sequence
  Synthetic oligonucleotide; AAG chr11 5238228 5238247 5238231 -
aacatctgcctcccaggttc

SEQ ID NO: 47533 - DNA, 20 bp, Artificial Sequence
  Synthetic oligonucleotide; CAG chr11 5238211 5238230 5238214 -
ttcaagcgattctcctgcct

SEQ ID NO: 47534 - DNA, 20 bp, Artificial Sequence
  Synthetic oligonucleotide; AAG chr11 5238202 5238221 5238205 -
ttctcctgcctcagcctccc

SEQ ID NO: 47535 - DNA, 20 bp, Artificial Sequence
  Synthetic oligonucleotide; TAG chr11 5238199 5238218 5238202 -
tcctgcctcagcctcccaag

SEQ ID NO: 47536 - DNA, 20 bp, Artificial Sequence
  Synthetic oligonucleotide; TGG chr11 5238195 5238214 5238198 -
gcctcagcctcccaagtagc

SEQ ID NO: 47537 - DNA, 20 bp, Artificial Sequence
  Synthetic oligonucleotide; CAG chr11 5238187 5238206 5238190 -
ctcccaagtagctggcacta

SEQ ID NO: 47538 - DNA, 20 bp, Artificial Sequence
  Synthetic oligonucleotide; AGG chr11 5238186 5238205 5238189 -
tcccaagtagctggcactac

SEQ ID NO: 47539 - DNA, 20 bp, Artificial Sequence
  Synthetic oligonucleotide; TGG chr11 5238164 5238183 5238167 -
gcatgtgccaccaccatgcc

SEQ ID NO: 47540 - DNA, 20 bp, Artificial Sequence
  Synthetic oligonucleotide; TAG chr11 5238146 5238165 5238149 -
cctggctaattttctatttt

SEQ ID NO: 47541 - DNA, 20 bp, Artificial Sequence
  Synthetic oligonucleotide; TAG chr11 5238143 5238162 5238146 -
ggctaattttctatttttag

SEQ ID NO: 47542 - DNA, 20 bp, Artificial Sequence
  Synthetic oligonucleotide; TAG chr11 5238139 5238158 5238142 -
aattttctatttttagtaga

SEQ ID NO: 47543 - DNA, 20 bp, Artificial Sequence
  Synthetic oligonucleotide; AGG chr11 5238138 5238157 5238141 -
attttctatttttagtagat

SEQ ID NO: 47544 - DNA, 20 bp, Artificial Sequence
  Synthetic oligonucleotide; GGG chr11 5238137 5238156 5238140 -
ttttctatttttagtagata

SEQ ID NO: 47545 - DNA, 20 bp, Artificial Sequence
  Synthetic oligonucleotide; GGG chr11 5238136 5238155 5238139 -
tttctatttttagtagatag

SEQ ID NO: 47546 - DNA, 20 bp, Artificial Sequence
  Synthetic oligonucleotide; GGG chr11 5238135 5238154 5238138 -
ttctatttttagtagatagg

SEQ ID NO: 47547 - DNA, 20 bp, Artificial Sequence
  Synthetic oligonucleotide; TGG chr11 5238121 5238140 5238124 -
gatagggggtttcaccatgt

SEQ ID NO: 47548 - DNA, 20 bp, Artificial Sequence
  Synthetic oligonucleotide; CAG chr11 5238117 5238136 5238120 -
gggggtttcaccatgttggt

SEQ ID NO: 47549 - DNA, 20 bp, Artificial Sequence
  Synthetic oligonucleotide; AGG chr11 5238116 5238135 5238119 -
ggggtttcaccatgttggtc

SEQ ID NO: 47550 - DNA, 20 bp, Artificial Sequence
  Synthetic oligonucleotide; CAG chr11 5238092 5238111 5238095 -
tgatctcgaactcctaacat

SEQ ID NO: 47551 - DNA, 20 bp, Artificial Sequence
  Synthetic oligonucleotide; AGG chr11 5238091 5238110 5238094 -
gatctcgaactcctaacatc

SEQ ID NO: 47552 - DNA, 20 bp, Artificial Sequence
  Synthetic oligonucleotide; CGG chr11 5238074 5238093 5238077 -
atcaggtgatccaccctcct

SEQ ID NO: 47553 - DNA, 20 bp, Artificial Sequence
  Synthetic oligonucleotide; AAG chr11 5238064 5238083 5238067 -
ccaccctcctcggcctctga

SEQ ID NO: 47554 - DNA, 20 bp, Artificial Sequence
  Synthetic oligonucleotide; TGG chr11 5238058 5238077 5238061 -
tcctcggcctctgaaagtgc

SEQ ID NO: 47555 - DNA, 20 bp, Artificial Sequence
  Synthetic oligonucleotide; GGG chr11 5238057 5238076 5238060 -
cctcggcctctgaaagtgct

SEQ ID NO: 47556 - DNA, 20 bp, Artificial Sequence
  Synthetic oligonucleotide; CAG chr11 5238050 5238069 5238053 -
ctctgaaagtgctgggatca

SEQ ID NO: 47557 - DNA, 20 bp, Artificial Sequence
  Synthetic oligonucleotide; AGG chr11 5238049 5238068 5238052 -
tctgaaagtgctgggatcac

SEQ ID NO: 47558 - DNA, 20 bp, Artificial Sequence
  Synthetic oligonucleotide; GAG chr11 5238043 5238062 5238046 -
agtgctgggatcacaggcgt

SEQ ID NO: 47559 - DNA, 20 bp, Artificial Sequence
  Synthetic oligonucleotide; CAG chr11 5238030 5238049 5238033 -
caggcgtgagccaccacacc

SEQ ID NO: 47560 - DNA, 20 bp, Artificial Sequence
  Synthetic oligonucleotide; AAG chr11 5238025 5238044 5238028 -
gtgagccaccacacccagcc

SEQ ID NO: 47561 - DNA, 20 bp, Artificial Sequence
  Synthetic oligonucleotide; TAG chr11 5238009 5238028 5238012 -
agccaagaatgtgaattttg

SEQ ID NO: 47562 - DNA, 20 bp, Artificial Sequence
  Synthetic oligonucleotide; AAG chr11 5238006 5238025 5238009 -
caagaatgtgaattttgtag

SEQ ID NO: 47563 - DNA, 20 bp, Artificial Sequence
  Synthetic oligonucleotide; AGG chr11 5238005 5238024 5238008 -
aagaatgtgaattttgtaga

SEQ ID NO: 47564 - DNA, 20 bp, Artificial Sequence
  Synthetic oligonucleotide; TAG chr11 5237978 5237997 5237981 -
aacccatatttctctgaccc

SEQ ID NO: 47565 - DNA, 20 bp, Artificial Sequence
  Synthetic oligonucleotide; GAG chr11 5237976 5237995 5237979 -
cccatatttctctgacccta

SEQ ID NO: 47566 - DNA, 20 bp, Artificial Sequence
  Synthetic oligonucleotide; TAG chr11 5237969 5237988 5237972 -
ttctctgaccctagagtcct

SEQ ID NO: 47567 - DNA, 20 bp, Artificial Sequence
  Synthetic oligonucleotide; TGG chr11 5237948 5237967 5237951 -
agtatacctcccataccatg

SEQ ID NO: 47568 - DNA, 20 bp, Artificial Sequence
  Synthetic oligonucleotide; CAG chr11 5237890 5237909 5237893 -
ctaccttttcctttttgttt

SEQ ID NO: 47569 - DNA, 20 bp, Artificial Sequence
  Synthetic oligonucleotide; TAG chr11 5237867 5237886 5237870 -
cttttcactgtgtcaaaatc

SEQ ID NO: 47570 - DNA, 20 bp, Artificial Sequence
  Synthetic oligonucleotide; CAG chr11 5237834 5237853 5237837 -
cctacctgctctgaaaccaa

SEQ ID NO: 47571 - DNA, 20 bp, Artificial Sequence
  Synthetic oligonucleotide; AAG chr11 5237830 5237849 5237833 -
cctgctctgaaaccaacagc

SEQ ID NO: 47572 - DNA, 20 bp, Artificial Sequence
  Synthetic oligonucleotide; TGG chr11 5237804 5237823 5237807 -
acttccattctaacccacat

SEQ ID NO: 47573 - DNA, 20 bp, Artificial Sequence
  Synthetic oligonucleotide; GAG chr11 5237776 5237795 5237779 -
cactaattaaaatcgatact

SEQ ID NO: 47574 - DNA, 20 bp, Artificial Sequence
  Synthetic oligonucleotide; CGG chr11 5237761 5237780 5237764 -
atactgagttctaaaatcat

SEQ ID NO: 47575 - DNA, 20 bp, Artificial Sequence
  Synthetic oligonucleotide; GGG chr11 5237760 5237779 5237763 -
tactgagttctaaaatcatc

SEQ ID NO: 47576 - DNA, 20 bp, Artificial Sequence
  Synthetic oligonucleotide; GGG chr11 5237759 5237778 5237762 -
actgagttctaaaatcatcg

SEQ ID NO: 47577 - DNA, 20 bp, Artificial Sequence
  Synthetic oligonucleotide; TGG chr11 5237752 5237771 5237755 -
tctaaaatcatcggggattt

SEQ ID NO: 47578 - DNA, 20 bp, Artificial Sequence
  Synthetic oligonucleotide; GGG chr11 5237751 5237770 5237754 -
ctaaaatcatcggggatttt

SEQ ID NO: 47579 - DNA, 20 bp, Artificial Sequence
  Synthetic oligonucleotide; GGG chr11 5237750 5237769 5237753 -
taaaatcatcggggattttg

SEQ ID NO: 47580 - DNA, 20 bp, Artificial Sequence
  Synthetic oligonucleotide; GAG chr11 5237722 5237741 5237725 -
gtcttacttcatacttcctt

SEQ ID NO: 47581 - DNA, 20 bp, Artificial Sequence
  Synthetic oligonucleotide; TGG chr11 5237703 5237722 5237706 -
tgagatttcacattaaatgt

SEQ ID NO: 47582 - DNA, 20 bp, Artificial Sequence
  Synthetic oligonucleotide; AAG chr11 5237691 5237710 5237694 -
ttaaatgttggtgttcatta

SEQ ID NO: 47583 - DNA, 20 bp, Artificial Sequence
  Synthetic oligonucleotide; AGG chr11 5237690 5237709 5237693 -
taaatgttggtgttcattaa

SEQ ID NO: 47584 - DNA, 20 bp, Artificial Sequence
  Synthetic oligonucleotide; TGG chr11 5237655 5237674 5237658 -
ctttgtattcatcacactct

SEQ ID NO: 47585 - DNA, 20 bp, Artificial Sequence
  Synthetic oligonucleotide; CAG chr11 5237647 5237666 5237650 -
tcatcacactcttggattca

SEQ ID NO: 47586 - DNA, 20 bp, Artificial Sequence
  Synthetic oligonucleotide; CAG chr11 5237623 5237642 5237626 -
tatatctaaactcttaaata

SEQ ID NO: 47587 - DNA, 20 bp, Artificial Sequence
  Synthetic oligonucleotide; CAG chr11 5237568 5237587 5237571 -
taacctctgacctccaacct

SEQ ID NO: 47588 - DNA, 20 bp, Artificial Sequence
  Synthetic oligonucleotide; TGG chr11 5237537 5237556 5237540 -
ccatatatcaaacaatgtac

SEQ ID NO: 47589 - DNA, 20 bp, Artificial Sequence
  Synthetic oligonucleotide; GGG chr11 5237536 5237555 5237539 -
catatatcaaacaatgtact

SEQ ID NO: 47590 - DNA, 20 bp, Artificial Sequence
  Synthetic oligonucleotide; TAG chr11 5237523 5237542 5237526 -
atgtactgggcttatttata

SEQ ID NO: 47591 - DNA, 20 bp, Artificial Sequence
  Synthetic oligonucleotide; TAG chr11 5237512 5237531 5237515 -
ttatttatatagatgtccta

SEQ ID NO: 47592 - DNA, 20 bp, Artificial Sequence
  Synthetic oligonucleotide; AGG chr11 5237511 5237530 5237514 -
tatttatatagatgtcctat

SEQ ID NO: 47593 - DNA, 20 bp, Artificial Sequence
  Synthetic oligonucleotide; CAG chr11 5237503 5237522 5237506 -
tagatgtcctataggcacct

SEQ ID NO: 47594 - DNA, 20 bp, Artificial Sequence
  Synthetic oligonucleotide; CAG chr11 5237497 5237516 5237500 -
tcctataggcacctcagact

SEQ ID NO: 47595 - DNA, 20 bp, Artificial Sequence
  Synthetic oligonucleotide; TGG chr11 5237492 5237511 5237495 -
taggcacctcagactcagca

SEQ ID NO: 47596 - DNA, 20 bp, Artificial Sequence
  Synthetic oligonucleotide; GGG chr11 5237491 5237510 5237494 -
aggcacctcagactcagcat

SEQ ID NO: 47597 - DNA, 20 bp, Artificial Sequence
  Synthetic oligonucleotide; CAG chr11 5237454 5237473 5237457 -
tactaaaactgtttctcttc

SEQ ID NO: 47598 - DNA, 20 bp, Artificial Sequence
  Synthetic oligonucleotide; TAG chr11 5237439 5237458 5237442 -
tcttccagtgttttccattt

SEQ ID NO: 47599 - DNA, 20 bp, Artificial Sequence
  Synthetic oligonucleotide; TAG chr11 5237432 5237451 5237435 -
gtgttttccattttagtcat

SEQ ID NO: 47600 - DNA, 20 bp, Artificial Sequence
  Synthetic oligonucleotide; TAG chr11 5237428 5237447 5237431 -
tttccattttagtcattaga

SEQ ID NO: 47601 - DNA, 20 bp, Artificial Sequence
  Synthetic oligonucleotide; AAG chr11 5237408 5237427 5237411 -
tagctacttgcccattcacc

SEQ ID NO: 47602 - DNA, 20 bp, Artificial Sequence
  Synthetic oligonucleotide; AGG chr11 5237407 5237426 5237410 -
agctacttgcccattcacca

SEQ ID NO: 47603 - DNA, 20 bp, Artificial Sequence
  Synthetic oligonucleotide; CAG chr11 5237401 5237420 5237404 -
ttgcccattcaccaaggtca

SEQ ID NO: 47604 - DNA, 20 bp, Artificial Sequence
  Synthetic oligonucleotide; CAG chr11 5237369 5237388 5237372 -
atttccctacctctaatcaa

SEQ ID NO: 47605 - DNA, 20 bp, Artificial Sequence
  Synthetic oligonucleotide; CAG chr11 5237315 5237334 5237318 -
taatcaccactcttactgcc

SEQ ID NO: 47606 - DNA, 20 bp, Artificial Sequence
  Synthetic oligonucleotide; CAG chr11 5237311 5237330 5237314 -
caccactcttactgcccagt

SEQ ID NO: 47607 - DNA, 20 bp, Artificial Sequence
  Synthetic oligonucleotide; AGG chr11 5237310 5237329 5237313 -
accactcttactgcccagtc

SEQ ID NO: 47608 - DNA, 20 bp, Artificial Sequence
  Synthetic oligonucleotide; AAG chr11 5237288 5237307 5237291 -
gtcctcattgtttcctgaac

SEQ ID NO: 47609 - DNA, 20 bp, Artificial Sequence
  Synthetic oligonucleotide; GAG chr11 5237286 5237305 5237289 -
cctcattgtttcctgaacaa

SEQ ID NO: 47610 - DNA, 20 bp, Artificial Sequence
  Synthetic oligonucleotide; TAG chr11 5237283 5237302 5237286 -
cattgtttcctgaacaagag

SEQ ID NO: 47611 - DNA, 20 bp, Artificial Sequence
  Synthetic oligonucleotide; TAG chr11 5237261 5237280 5237264 -
gatgctattctttccacttt

SEQ ID NO: 47612 - DNA, 20 bp, Artificial Sequence
  Synthetic oligonucleotide; TGG chr11 5237249 5237268 5237252 -
tccacttttagaccttatcc

SEQ ID NO: 47613 - DNA, 20 bp, Artificial Sequence
  Synthetic oligonucleotide; TGG chr11 5237245 5237264 5237248 -
cttttagaccttatcctggc

SEQ ID NO: 47614 - DNA, 20 bp, Artificial Sequence
  Synthetic oligonucleotide; CGG chr11 5237239 5237258 5237242 -
gaccttatcctggctggatg

SEQ ID NO: 47615 - DNA, 20 bp, Artificial Sequence
  Synthetic oligonucleotide; TGG chr11 5237236 5237255 5237239 -
cttatcctggctggatgcgg

SEQ ID NO: 47616 - DNA, 20 bp, Artificial Sequence
  Synthetic oligonucleotide; CAG chr11 5237231 5237250 5237234 -
cctggctggatgcggtggct

SEQ ID NO: 47617 - DNA, 20 bp, Artificial Sequence
  Synthetic oligonucleotide; AGG chr11 5237230 5237249 5237233 -
ctggctggatgcggtggctc

SEQ ID NO: 47618 - DNA, 20 bp, Artificial Sequence
  Synthetic oligonucleotide; CAG chr11 5237217 5237236 5237220 -
gtggctcaggcttgtaaacc

SEQ ID NO: 47619 - DNA, 20 bp, Artificial Sequence
  Synthetic oligonucleotide; TGG chr11 5237209 5237228 5237212 -
ggcttgtaaacccagcactt

SEQ ID NO: 47620 - DNA, 20 bp, Artificial Sequence
  Synthetic oligonucleotide; GGG chr11 5237208 5237227 5237211 -
gcttgtaaacccagcacttt

SEQ ID NO: 47621 - DNA, 20 bp, Artificial Sequence
  Synthetic oligonucleotide; GAG chr11 5237206 5237225 5237209 -
ttgtaaacccagcactttgg

SEQ ID NO: 47622 - DNA, 20 bp, Artificial Sequence
  Synthetic oligonucleotide; AGG chr11 5237205 5237224 5237208 -
tgtaaacccagcactttggg

SEQ ID NO: 47623 - DNA, 20 bp, Artificial Sequence
  Synthetic oligonucleotide; AAG chr11 5237200 5237219 5237203 -
acccagcactttgggaggcc

SEQ ID NO: 47624 - DNA, 20 bp, Artificial Sequence
  Synthetic oligonucleotide; AGG chr11 5237199 5237218 5237202 -
cccagcactttgggaggcca

SEQ ID NO: 47625 - DNA, 20 bp, Artificial Sequence
  Synthetic oligonucleotide; CAG chr11 5237196 5237215 5237199 -
agcactttgggaggccaagg

SEQ ID NO: 47626 - DNA, 20 bp, Artificial Sequence
  Synthetic oligonucleotide; AGG chr11 5237195 5237214 5237198 -
gcactttgggaggccaaggc

SEQ ID NO: 47627 - DNA, 20 bp, Artificial Sequence
  Synthetic oligonucleotide; CAG chr11 5237192 5237211 5237195 -
ctttgggaggccaaggcagg

SEQ ID NO: 47628 - DNA, 20 bp, Artificial Sequence
  Synthetic oligonucleotide; GAG chr11 5237182 5237201 5237185 -
ccaaggcaggcagatcactt

SEQ ID NO: 47629 - DNA, 20 bp, Artificial Sequence
  Synthetic oligonucleotide; AGG chr11 5237181 5237200 5237184 -
caaggcaggcagatcacttg

SEQ ID NO: 47630 - DNA, 20 bp, Artificial Sequence
  Synthetic oligonucleotide; CAG chr11 5237177 5237196 5237180 -
gcaggcagatcacttgaggt

SEQ ID NO: 47631 - DNA, 20 bp, Artificial Sequence
  Synthetic oligonucleotide; AGG chr11 5237176 5237195 5237179 -
caggcagatcacttgaggtc

SEQ ID NO: 47632 - DNA, 20 bp, Artificial Sequence
  Synthetic oligonucleotide; GAG chr11 5237174 5237193 5237177 -
ggcagatcacttgaggtcag

SEQ ID NO: 47633 - DNA, 20 bp, Artificial Sequence
  Synthetic oligonucleotide; AAG chr11 5237168 5237187 5237171 -
tcacttgaggtcaggagttc

SEQ ID NO: 47634 - DNA, 20 bp, Artificial Sequence
  Synthetic oligonucleotide; CAG chr11 5237163 5237182 5237166 -
tgaggtcaggagttcaagac

SEQ ID NO: 47635 - DNA, 20 bp, Artificial Sequence
  Synthetic oligonucleotide; TGG chr11 5237149 5237168 5237152 -
caagaccagcctgaccaaca

SEQ ID NO: 47636 - DNA, 20 bp, Artificial Sequence
  Synthetic oligonucleotide; CAG chr11 5237115 5237134 5237118 -
ctctactaaaaatacaaaat

SEQ ID NO: 47637 - DNA, 20 bp, Artificial Sequence
  Synthetic oligonucleotide; CGG chr11 5237111 5237130 5237114 -
actaaaaatacaaaatcagc

SEQ ID NO: 47638 - DNA, 20 bp, Artificial Sequence
  Synthetic oligonucleotide; GGG chr11 5237110 5237129 5237113 -
ctaaaaatacaaaatcagcc

SEQ ID NO: 47639 - DNA, 20 bp, Artificial Sequence
  Synthetic oligonucleotide; TGG chr11 5237103 5237122 5237106 -
tacaaaatcagccgggcgtg

SEQ ID NO: 47640 - DNA, 20 bp, Artificial Sequence
  Synthetic oligonucleotide; CAG chr11 5237090 5237109 5237093 -
gggcgtgtggtgcatgcctg

SEQ ID NO: 47641 - DNA, 20 bp, Artificial Sequence
  Synthetic oligonucleotide; CAG chr11 5237084 5237103 5237087 -
gtggtgcatgcctgcagtcc

SEQ ID NO: 47642 - DNA, 20 bp, Artificial Sequence
  Synthetic oligonucleotide; CAG chr11 5237076 5237095 5237079 -
tgcctgcagtcccagctatt

SEQ ID NO: 47643 - DNA, 20 bp, Artificial Sequence
  Synthetic oligonucleotide; AGG chr11 5237075 5237094 5237078 -
gcctgcagtcccagctattc

SEQ ID NO: 47644 - DNA, 20 bp, Artificial Sequence
  Synthetic oligonucleotide; TGG chr11 5237072 5237091 5237075 -
tgcagtcccagctattcagg

SEQ ID NO: 47645 - DNA, 20 bp, Artificial Sequence
  Synthetic oligonucleotide; GAG chr11 5237067 5237086 5237070 -
tcccagctattcaggtggct

SEQ ID NO: 47646 - DNA, 20 bp, Artificial Sequence
  Synthetic oligonucleotide; AGG chr11 5237066 5237085 5237069 -
cccagctattcaggtggctg

SEQ ID NO: 47647 - DNA, 20 bp, Artificial Sequence
  Synthetic oligonucleotide; CAG chr11 5237063 5237082 5237066 -
agctattcaggtggctgagg

SEQ ID NO: 47648 - DNA, 20 bp, Artificial Sequence
  Synthetic oligonucleotide; AGG chr11 5237062 5237081 5237065 -
gctattcaggtggctgaggc

SEQ ID NO: 47649 - DNA, 20 bp, Artificial Sequence
  Synthetic oligonucleotide; GAG chr11 5237060 5237079 5237063 -
tattcaggtggctgaggcag

SEQ ID NO: 47650 - DNA, 20 bp, Artificial Sequence
  Synthetic oligonucleotide; CAG chr11 5237044 5237063 5237047 -
gcaggagaattgcttgaacc

SEQ ID NO: 47651 - DNA, 20 bp, Artificial Sequence
  Synthetic oligonucleotide; AGG chr11 5237043 5237062 5237046 -
caggagaattgcttgaaccc

SEQ ID NO: 47652 - DNA, 20 bp, Artificial Sequence
  Synthetic oligonucleotide; GAG chr11 5237041 5237060 5237044 -
ggagaattgcttgaacccag

SEQ ID NO: 47653 - DNA, 20 bp, Artificial Sequence
  Synthetic oligonucleotide; AGG chr11 5237040 5237059 5237043 -
gagaattgcttgaacccagg

SEQ ID NO: 47654 - DNA, 20 bp, Artificial Sequence
  Synthetic oligonucleotide; CAG chr11 5237037 5237056 5237040 -
aattgcttgaacccaggagg

SEQ ID NO: 47655 - DNA, 20 bp, Artificial Sequence
  Synthetic oligonucleotide; GAG chr11 5237035 5237054 5237038 -
ttgcttgaacccaggaggca

SEQ ID NO: 47656 - DNA, 20 bp, Artificial Sequence
  Synthetic oligonucleotide; AGG chr11 5237034 5237053 5237037 -
tgcttgaacccaggaggcag

SEQ ID NO: 47657 - DNA, 20 bp, Artificial Sequence
  Synthetic oligonucleotide; CGG chr11 5237028 5237047 5237031 -
aacccaggaggcagaggttg

SEQ ID NO: 47658 - DNA, 20 bp, Artificial Sequence
  Synthetic oligonucleotide; GAG chr11 5237024 5237043 5237027 -
caggaggcagaggttgcggt

SEQ ID NO: 47659 - DNA, 20 bp, Artificial Sequence
  Synthetic oligonucleotide; TAG chr11 5237019 5237038 5237022 -
ggcagaggttgcggtgagcc

SEQ ID NO: 47660 - DNA, 20 bp, Artificial Sequence
  Synthetic oligonucleotide; TAG chr11 5236999 5237018 5237002 -
tagattgcaccattgcactc

SEQ ID NO: 47661 - DNA, 20 bp, Artificial Sequence
  Synthetic oligonucleotide; TGG chr11 5236994 5237013 5236997 -
tgcaccattgcactctagct

SEQ ID NO: 47662 - DNA, 20 bp, Artificial Sequence
  Synthetic oligonucleotide; GGG chr11 5236993 5237012 5236996 -
gcaccattgcactctagctt

SEQ ID NO: 47663 - DNA, 20 bp, Artificial Sequence
  Synthetic oligonucleotide; TAG chr11 5236987 5237006 5236990 -
ttgcactctagcttgggcaa

SEQ ID NO: 47664 - DNA, 20 bp, Artificial Sequence
  Synthetic oligonucleotide; AGG chr11 5236986 5237005 5236989 -
tgcactctagcttgggcaat

SEQ ID NO: 47665 - DNA, 20 bp, Artificial Sequence
  Synthetic oligonucleotide; GGG chr11 5236985 5237004 5236988 -
gcactctagcttgggcaata

SEQ ID NO: 47666 - DNA, 20 bp, Artificial Sequence
  Synthetic oligonucleotide; CAG chr11 5236968 5236987 5236971 -
atagggatgaaactccatct

SEQ ID NO: 47667 - DNA, 20 bp, Artificial Sequence
  Synthetic oligonucleotide; AAG chr11 5236965 5236984 5236968 -
gggatgaaactccatctcag

SEQ ID NO: 47668 - DNA, 20 bp, Artificial Sequence
  Synthetic oligonucleotide; GAG chr11 5236963 5236982 5236966 -
gatgaaactccatctcagaa

SEQ ID NO: 47669 - DNA, 20 bp, Artificial Sequence
  Synthetic oligonucleotide; AAG chr11 5236958 5236977 5236961 -
aactccatctcagaagagaa

SEQ ID NO: 47670 - DNA, 20 bp, Artificial Sequence
  Synthetic oligonucleotide; AAG chr11 5236950 5236969 5236953 -
ctcagaagagaaaagaaaaa

SEQ ID NO: 47671 - DNA, 20 bp, Artificial Sequence
  Synthetic oligonucleotide; TAG chr11 5236907 5236926 5236910 -
tcctctcaatgcaatccata

SEQ ID NO: 47672 - DNA, 20 bp, Artificial Sequence
  Synthetic oligonucleotide; CAG chr11 5236890 5236909 5236893 -
atatagaataaacatgtaac

SEQ ID NO: 47673 - DNA, 20 bp, Artificial Sequence
  Synthetic oligonucleotide; CAG chr11 5236863 5236882 5236866 -
cccaatgtgtaaaatcattt

SEQ ID NO: 47674 - DNA, 20 bp, Artificial Sequence
  Synthetic oligonucleotide; AGG chr11 5236862 5236881 5236865 -
ccaatgtgtaaaatcatttc

SEQ ID NO: 47675 - DNA, 20 bp, Artificial Sequence
  Synthetic oligonucleotide; TAG chr11 5236859 5236878 5236862 -
atgtgtaaaatcatttcagg

SEQ ID NO: 47676 - DNA, 20 bp, Artificial Sequence
  Synthetic oligonucleotide; CAG chr11 5236854 5236873 5236857 -
taaaatcatttcaggtagaa

SEQ ID NO: 47677 - DNA, 20 bp, Artificial Sequence
  Synthetic oligonucleotide; AAG chr11 5236846 5236865 5236849 -
tttcaggtagaacagaatta

SEQ ID NO: 47678 - DNA, 20 bp, Artificial Sequence
  Synthetic oligonucleotide; AAG chr11 5236839 5236858 5236842 -
tagaacagaattaaagtgaa

SEQ ID NO: 47679 - DNA, 20 bp, Artificial Sequence
  Synthetic oligonucleotide; AAG chr11 5236834 5236853 5236837 -
cagaattaaagtgaaaagcc

SEQ ID NO: 47680 - DNA, 20 bp, Artificial Sequence
  Synthetic oligonucleotide; TGG chr11 5236827 5236846 5236830 -
aaagtgaaaagccaagtctt

SEQ ID NO: 47681 - DNA, 20 bp, Artificial Sequence
  Synthetic oligonucleotide; CAG chr11 5236818 5236837 5236821 -
agccaagtctttggaattaa

SEQ ID NO: 47682 - DNA, 20 bp, Artificial Sequence
  Synthetic oligonucleotide; AAG chr11 5236812 5236831 5236815 -
gtctttggaattaacagaca

SEQ ID NO: 47683 - DNA, 20 bp, Artificial Sequence
  Synthetic oligonucleotide; CAG chr11 5236800 5236819 5236803 -
aacagacaaagatcaaataa

SEQ ID NO: 47684 - DNA, 20 bp, Artificial Sequence
  Synthetic oligonucleotide; TGG chr11 5236791 5236810 5236794 -
agatcaaataacagtcctca

SEQ ID NO: 47685 - DNA, 20 bp, Artificial Sequence
  Synthetic oligonucleotide; AAG chr11 5236784 5236803 5236787 -
ataacagtcctcatggcctt

SEQ ID NO: 47686 - DNA, 20 bp, Artificial Sequence
  Synthetic oligonucleotide; TAG chr11 5236761 5236780 5236764 -
aatttacctaacattttttt

SEQ ID NO: 47687 - DNA, 20 bp, Artificial Sequence
  Synthetic oligonucleotide; TGG chr11 5236735 5236754 5236738 -
caattttcttatatatgaat

SEQ ID NO: 47688 - DNA, 20 bp, Artificial Sequence
  Synthetic oligonucleotide; AAG chr11 5236701 5236720 5236704 -
ctccctcacaaacacattct

SEQ ID NO: 47689 - DNA, 20 bp, Artificial Sequence
  Synthetic oligonucleotide; AAG chr11 5236693 5236712 5236696 -
caaacacattctaagatttt

SEQ ID NO: 47690 - DNA, 20 bp, Artificial Sequence
  Synthetic oligonucleotide; AGG chr11 5236692 5236711 5236695 -
aaacacattctaagatttta

SEQ ID NO: 47691 - DNA, 20 bp, Artificial Sequence
  Synthetic oligonucleotide; GAG chr11 5236690 5236709 5236693 -
acacattctaagattttaag

SEQ ID NO: 47692 - DNA, 20 bp, Artificial Sequence
  Synthetic oligonucleotide; AAG chr11 5236678 5236697 5236681 -
attttaaggagatattgatg

SEQ ID NO: 47693 - DNA, 20 bp, Artificial Sequence
  Synthetic oligonucleotide; CAG chr11 5236654 5236673 5236657 -
acatcatctgtcatttttaa

SEQ ID NO: 47694 - DNA, 20 bp, Artificial Sequence
  Synthetic oligonucleotide; AGG chr11 5236653 5236672 5236656 -
catcatctgtcatttttaac

SEQ ID NO: 47695 - DNA, 20 bp, Artificial Sequence
  Synthetic oligonucleotide; TAG chr11 5236650 5236669 5236653 -
catctgtcatttttaacagg

SEQ ID NO: 47696 - DNA, 20 bp, Artificial Sequence
  Synthetic oligonucleotide; TGG chr11 5236647 5236666 5236650 -
ctgtcatttttaacaggtag

SEQ ID NO: 47697 - DNA, 20 bp, Artificial Sequence
  Synthetic oligonucleotide; TAG chr11 5236644 5236663 5236647 -
tcatttttaacaggtagtgg

SEQ ID NO: 47698 - DNA, 20 bp, Artificial Sequence
  Synthetic oligonucleotide; CAG chr11 5236632 5236651 5236635 -
ggtagtggtagtgattcaca

SEQ ID NO: 47699 - DNA, 20 bp, Artificial Sequence
  Synthetic oligonucleotide; TGG chr11 5236579 5236598 5236582 -
tccattctgtattcttgacc

SEQ ID NO: 47700 - DNA, 20 bp, Artificial Sequence
  Synthetic oligonucleotide; GAG chr11 5236563 5236582 5236566 -
gacctggttgtattctttct

SEQ ID NO: 47701 - DNA, 20 bp, Artificial Sequence
  Synthetic oligonucleotide; CAG chr11 5236557 5236576 5236560 -
gttgtattctttctgagctc

SEQ ID NO: 47702 - DNA, 20 bp, Artificial Sequence
  Synthetic oligonucleotide; AAG chr11 5236542 5236561 5236545 -
agctccagatccacatatct

SEQ ID NO: 47703 - DNA, 20 bp, Artificial Sequence
  Synthetic oligonucleotide; AAG chr11 5236519 5236538 5236522 -
tacatctttttgcattttac

SEQ ID NO: 47704 - DNA, 20 bp, Artificial Sequence
  Synthetic oligonucleotide; GAG chr11 5236517 5236536 5236520 -
catctttttgcattttacaa

SEQ ID NO: 47705 - DNA, 20 bp, Artificial Sequence
  Synthetic oligonucleotide; AAG chr11 5236493 5236512 5236496 -
gcatacaatacaatgtatcc

SEQ ID NO: 47706 - DNA, 20 bp, Artificial Sequence
  Synthetic oligonucleotide; TGG chr11 5236449 5236468 5236452 -
taccactaaactcacaaatg

SEQ ID NO: 47707 - DNA, 20 bp, Artificial Sequence
  Synthetic oligonucleotide; TGG chr11 5236411 5236430 5236414 -
cacgactgacatcaccgtca

SEQ ID NO: 47708 - DNA, 20 bp, Artificial Sequence
  Synthetic oligonucleotide; AAG chr11 5236405 5236424 5236408 -
tgacatcaccgtcatggtcc

SEQ ID NO: 47709 - DNA, 20 bp, Artificial Sequence
  Synthetic oligonucleotide; TAG chr11 5236394 5236413 5236397 -
tcatggtccaagtctgataa

SEQ ID NO: 47710 - DNA, 20 bp, Artificial Sequence
  Synthetic oligonucleotide; TGG chr11 5236388 5236407 5236391 -
tccaagtctgataatagaaa

SEQ ID NO: 47711 - DNA, 20 bp, Artificial Sequence
  Synthetic oligonucleotide; CAG chr11 5236359 5236378 5236362 -
cactttcttccctactgcaa

SEQ ID NO: 47712 - DNA, 20 bp, Artificial Sequence
  Synthetic oligonucleotide; AAG chr11 5236356 5236375 5236359 -
tttcttccctactgcaacag

SEQ ID NO: 47713 - DNA, 20 bp, Artificial Sequence
  Synthetic oligonucleotide; CAG chr11 5236351 5236370 5236354 -
tccctactgcaacagaagcc

SEQ ID NO: 47714 - DNA, 20 bp, Artificial Sequence
  Synthetic oligonucleotide; AAG chr11 5236302 5236321 5236305 -
ctaaaatacatttcttcact

SEQ ID NO: 47715 - DNA, 20 bp, Artificial Sequence
  Synthetic oligonucleotide; GAG chr11 5236298 5236317 5236301 -
aatacatttcttcactaagt

SEQ ID NO: 47716 - DNA, 20 bp, Artificial Sequence
  Synthetic oligonucleotide; AAG chr11 5236283 5236302 5236286 -
taagtgagaataatctttta

SEQ ID NO: 47717 - DNA, 20 bp, Artificial Sequence
  Synthetic oligonucleotide; TGG chr11 5236228 5236247 5236231 -
aattattcaatatctttcgt

SEQ ID NO: 47718 - DNA, 20 bp, Artificial Sequence
  Synthetic oligonucleotide; CAG chr11 5236221 5236240 5236224 -
caatatctttcgttggcttc

SEQ ID NO: 47719 - DNA, 20 bp, Artificial Sequence
  Synthetic oligonucleotide; AGG chr11 5236220 5236239 5236223 -
aatatctttcgttggcttcc

SEQ ID NO: 47720 - DNA, 20 bp, Artificial Sequence
  Synthetic oligonucleotide; CAG chr11 5236214 5236233 5236217 -
tttcgttggcttccaggtta

SEQ ID NO: 47721 - DNA, 20 bp, Artificial Sequence
  Synthetic oligonucleotide; AAG chr11 5236194 5236213 5236197 -
cagaaaaataacttgtaaca

SEQ ID NO: 47722 - DNA, 20 bp, Artificial Sequence
  Synthetic oligonucleotide; AAG chr11 5236187 5236206 5236190 -
ataacttgtaacaaagttta

SEQ ID NO: 47723 - DNA, 20 bp, Artificial Sequence
  Synthetic oligonucleotide; AGG chr11 5236186 5236205 5236189 -
taacttgtaacaaagtttaa

SEQ ID NO: 47724 - DNA, 20 bp, Artificial Sequence
  Synthetic oligonucleotide; TGG chr11 5236176 5236195 5236179 -
caaagtttaaaggtcattca

SEQ ID NO: 47725 - DNA, 20 bp, Artificial Sequence
  Synthetic oligonucleotide; CAG chr11 5236134 5236153 5236137 -
ataacatttccccttgtgat

SEQ ID NO: 47726 - DNA, 20 bp, Artificial Sequence
  Synthetic oligonucleotide; CAG chr11 5236126 5236145 5236129 -
tccccttgtgatcagaatct

SEQ ID NO: 47727 - DNA, 20 bp, Artificial Sequence
  Synthetic oligonucleotide; AGG chr11 5236125 5236144 5236128 -
ccccttgtgatcagaatctc

SEQ ID NO: 47728 - DNA, 20 bp, Artificial Sequence
  Synthetic oligonucleotide; AAG chr11 5236093 5236112 5236096 -
catctttctatatacaaata

SEQ ID NO: 47729 - DNA, 20 bp, Artificial Sequence
  Synthetic oligonucleotide; TAG chr11 5236085 5236104 5236088 -
tatatacaaataaagtcata

SEQ ID NO: 47730 - DNA, 20 bp, Artificial Sequence
  Synthetic oligonucleotide; TGG chr11 5236068 5236087 5236071 -
atatagtttgaactcacctc

SEQ ID NO: 47731 - DNA, 20 bp, Artificial Sequence
  Synthetic oligonucleotide; AAG chr11 5236014 5236033 5236017 -
catttgtatcgctacgtgtt

SEQ ID NO: 47732 - DNA, 20 bp, Artificial Sequence
  Synthetic oligonucleotide; CAG chr11 5236011 5236030 5236014 -
ttgtatcgctacgtgttaag

SEQ ID NO: 47733 - DNA, 20 bp, Artificial Sequence
  Synthetic oligonucleotide; TAG chr11 5236008 5236027 5236011 -
tatcgctacgtgttaagcag

SEQ ID NO: 47734 - DNA, 20 bp, Artificial Sequence
  Synthetic oligonucleotide; TGG chr11 5235938 5235957 5235941 -
taatttatcaattctactgt

SEQ ID NO: 47735 - DNA, 20 bp, Artificial Sequence
  Synthetic oligonucleotide; AAG chr11 5235934 5235953 5235937 -
ttatcaattctactgttggt

SEQ ID NO: 47736 - DNA, 20 bp, Artificial Sequence
  Synthetic oligonucleotide; AAG chr11 5235926 5235945 5235929 -
tctactgttggtaagcattt

SEQ ID NO: 47737 - DNA, 20 bp, Artificial Sequence
  Synthetic oligonucleotide; TGG chr11 5235923 5235942 5235926 -
actgttggtaagcatttaag

SEQ ID NO: 47738 - DNA, 20 bp, Artificial Sequence
  Synthetic oligonucleotide; CGG chr11 5235916 5235935 5235919 -
gtaagcatttaagtggctac

SEQ ID NO: 47739 - DNA, 20 bp, Artificial Sequence
  Synthetic oligonucleotide; GAG chr11 5235910 5235929 5235913 -
atttaagtggctaccggttt

SEQ ID NO: 47740 - DNA, 20 bp, Artificial Sequence
  Synthetic oligonucleotide; AGG chr11 5235909 5235928 5235912 -
tttaagtggctaccggtttg

SEQ ID NO: 47741 - DNA, 20 bp, Artificial Sequence
  Synthetic oligonucleotide; AAG chr11 5235884 5235903 5235887 -
tttatgattattgctgtcat

SEQ ID NO: 47742 - DNA, 20 bp, Artificial Sequence
  Synthetic oligonucleotide; TGG chr11 5235863 5235882 5235866 -
agcatttctatacatgtctt

SEQ ID NO: 47743 - DNA, 20 bp, Artificial Sequence
  Synthetic oligonucleotide; TAG chr11 5235816 5235835 5235819 -
atatctaaaaatgtaattgc

SEQ ID NO: 47744 - DNA, 20 bp, Artificial Sequence
  Synthetic oligonucleotide; AGG chr11 5235815 5235834 5235818 -
tatctaaaaatgtaattgct

SEQ ID NO: 47745 - DNA, 20 bp, Artificial Sequence
  Synthetic oligonucleotide; TAG chr11 5235809 5235828 5235812 -
aaaatgtaattgctaggtaa

SEQ ID NO: 47746 - DNA, 20 bp, Artificial Sequence
  Synthetic oligonucleotide; AAG chr11 5235799 5235818 5235802 -
tgctaggtaatagacttatc

SEQ ID NO: 47747 - DNA, 20 bp, Artificial Sequence
  Synthetic oligonucleotide; CAG chr11 5235792 5235811 5235795 -
taatagacttatcaagcatc

SEQ ID NO: 47748 - DNA, 20 bp, Artificial Sequence
  Synthetic oligonucleotide; TGG chr11 5235783 5235802 5235786 -
tatcaagcatccagcatttg

SEQ ID NO: 47749 - DNA, 20 bp, Artificial Sequence
  Synthetic oligonucleotide; AAG chr11 5235771 5235790 5235774 -
agcatttgtggatactatta

SEQ ID NO: 47750 - DNA, 20 bp, Artificial Sequence
  Synthetic oligonucleotide; AGG chr11 5235770 5235789 5235773 -
gcatttgtggatactattaa

SEQ ID NO: 47751 - DNA, 20 bp, Artificial Sequence
  Synthetic oligonucleotide; AAG chr11 5235760 5235779 5235763 -
atactattaaaggttttcca

SEQ ID NO: 47752 - DNA, 20 bp, Artificial Sequence
  Synthetic oligonucleotide; AGG chr11 5235759 5235778 5235762 -
tactattaaaggttttccaa

SEQ ID NO: 47753 - DNA, 20 bp, Artificial Sequence
  Synthetic oligonucleotide; GGG chr11 5235758 5235777 5235761 -
actattaaaggttttccaaa

SEQ ID NO: 47754 - DNA, 20 bp, Artificial Sequence
  Synthetic oligonucleotide; GGG chr11 5235757 5235776 5235760 -
ctattaaaggttttccaaag

SEQ ID NO: 47755 - DNA, 20 bp, Artificial Sequence
  Synthetic oligonucleotide; CAG chr11 5235741 5235760 5235744 -
aaaggggttatactattgta

SEQ ID NO: 47756 - DNA, 20 bp, Artificial Sequence
  Synthetic oligonucleotide; CAG chr11 5235729 5235748 5235732 -
ctattgtacagtgtcaccaa

SEQ ID NO: 47757 - DNA, 20 bp, Artificial Sequence
  Synthetic oligonucleotide; GAG chr11 5235727 5235746 5235730 -
attgtacagtgtcaccaaca

SEQ ID NO: 47758 - DNA, 20 bp, Artificial Sequence
  Synthetic oligonucleotide; GAG chr11 5235721 5235740 5235724 -
cagtgtcaccaacagagttt

SEQ ID NO: 47759 - DNA, 20 bp, Artificial Sequence
  Synthetic oligonucleotide; CAG chr11 5235680 5235699 5235683 -
accaccaaaatttgaactgt

SEQ ID NO: 47760 - DNA, 20 bp, Artificial Sequence
  Synthetic oligonucleotide; TGG chr11 5235403 5235422 5235406 -
tttccttcaatccttccttt

SEQ ID NO: 47761 - DNA, 20 bp, Artificial Sequence
  Synthetic oligonucleotide; TGG chr11 5235391 5235410 5235394 -
cttccttttggatatgctca

SEQ ID NO: 47762 - DNA, 20 bp, Artificial Sequence
  Synthetic oligonucleotide; GGG chr11 5235390 5235409 5235393 -
ttccttttggatatgctcat

SEQ ID NO: 47763 - DNA, 20 bp, Artificial Sequence
  Synthetic oligonucleotide; TGG chr11 5235367 5235386 5235370 -
tgtgtatttgtctgccattg

SEQ ID NO: 47764 - DNA, 20 bp, Artificial Sequence
  Synthetic oligonucleotide; CAG chr11 5235351 5235370 5235354 -
attgtggcattatttgaatt

SEQ ID NO: 47765 - DNA, 20 bp, Artificial Sequence
  Synthetic oligonucleotide; AAG chr11 5235346 5235365 5235349 -
ggcattatttgaattcagaa

SEQ ID NO: 47766 - DNA, 20 bp, Artificial Sequence
  Synthetic oligonucleotide; GAG chr11 5235344 5235363 5235347 -
cattatttgaattcagaaaa

SEQ ID NO: 47767 - DNA, 20 bp, Artificial Sequence
  Synthetic oligonucleotide; TGG chr11 5235330 5235349 5235333 -
agaaaagagtgaaaaactac

SEQ ID NO: 47768 - DNA, 20 bp, Artificial Sequence
  Synthetic oligonucleotide; GGG chr11 5235329 5235348 5235332 -
gaaaagagtgaaaaactact

SEQ ID NO: 47769 - DNA, 20 bp, Artificial Sequence
  Synthetic oligonucleotide; TGG chr11 5235315 5235334 5235318 -
actactgggatcttcattcc

SEQ ID NO: 47770 - DNA, 20 bp, Artificial Sequence
  Synthetic oligonucleotide; GGG chr11 5235314 5235333 5235317 -
ctactgggatcttcattcct

SEQ ID NO: 47771 - DNA, 20 bp, Artificial Sequence
  Synthetic oligonucleotide; AAG chr11 5235290 5235309 5235293 -
ctaattccacattttttttt

SEQ ID NO: 47772 - DNA, 20 bp, Artificial Sequence
  Synthetic oligonucleotide; TAG chr11 5235261 5235280 5235264 -
tctgtaaaaatgttctgtac

SEQ ID NO: 47773 - DNA, 20 bp, Artificial Sequence
  Synthetic oligonucleotide; CAG chr11 5235250 5235269 5235253 -
gttctgtactagcatattcc

SEQ ID NO: 47774 - DNA, 20 bp, Artificial Sequence
  Synthetic oligonucleotide; AGG chr11 5235249 5235268 5235252 -
ttctgtactagcatattccc

SEQ ID NO: 47775 - DNA, 20 bp, Artificial Sequence
  Synthetic oligonucleotide; TGG chr11 5235227 5235246 5235230 -
gaacttcgttaaatttaatc

SEQ ID NO: 47776 - DNA, 20 bp, Artificial Sequence
  Synthetic oligonucleotide; TGG chr11 5235217 5235236 5235220 -
aaatttaatctggctgaata

SEQ ID NO: 47777 - DNA, 20 bp, Artificial Sequence
  Synthetic oligonucleotide; TAG chr11 5235183 5235202 5235186 -
ttcactttgcattctttctt

SEQ ID NO: 47778 - DNA, 20 bp, Artificial Sequence
  Synthetic oligonucleotide; CAG chr11 5235091 5235110 5235094 -
aaccttaaaattcatgtttc

SEQ ID NO: 47779 - DNA, 20 bp, Artificial Sequence
  Synthetic oligonucleotide; TGG chr11 5235072 5235091 5235075 -
ccagaacctatttcaataac

SEQ ID NO: 47780 - DNA, 20 bp, Artificial Sequence
  Synthetic oligonucleotide; TGG chr11 5235032 5235051 5235035 -
ttttttaaatattcttttaa

SEQ ID NO: 47781 - DNA, 20 bp, Artificial Sequence
  Synthetic oligonucleotide; TAG chr11 5235003 5235022 5235006 -
atttcaatataataaaaaat

SEQ ID NO: 47782 - DNA, 20 bp, Artificial Sequence
  Synthetic oligonucleotide; GAG chr11 5235001 5235020 5235004 -
ttcaatataataaaaaatta

SEQ ID NO: 47783 - DNA, 20 bp, Artificial Sequence
  Synthetic oligonucleotide; TAG chr11 5234990 5235009 5234993 -
aaaaaattagagttttatta

SEQ ID NO: 47784 - DNA, 20 bp, Artificial Sequence
  Synthetic oligonucleotide; AGG chr11 5234989 5235008 5234992 -
aaaaattagagttttattat

SEQ ID NO: 47785 - DNA, 20 bp, Artificial Sequence
  Synthetic oligonucleotide; AAG chr11 5234986 5235005 5234989 -
aattagagttttattatagg

SEQ ID NO: 47786 - DNA, 20 bp, Artificial Sequence
  Synthetic oligonucleotide; AAG chr11 5234973 5234992 5234976 -
ttataggaagaatttaccaa

SEQ ID NO: 47787 - DNA, 20 bp, Artificial Sequence
  Synthetic oligonucleotide; AAG chr11 5234970 5234989 5234973 -
taggaagaatttaccaaaag

SEQ ID NO: 47788 - DNA, 20 bp, Artificial Sequence
  Synthetic oligonucleotide; AGG chr11 5234969 5234988 5234972 -
aggaagaatttaccaaaaga

SEQ ID NO: 47789 - DNA, 20 bp, Artificial Sequence
  Synthetic oligonucleotide; GAG chr11 5234967 5234986 5234970 -
gaagaatttaccaaaagaag

SEQ ID NO: 47790 - DNA, 20 bp, Artificial Sequence
  Synthetic oligonucleotide; AGG chr11 5234966 5234985 5234969 -
aagaatttaccaaaagaagg

SEQ ID NO: 47791 - DNA, 20 bp, Artificial Sequence
  Synthetic oligonucleotide; AAG chr11 5234963 5234982 5234966 -
aatttaccaaaagaaggagg

SEQ ID NO: 47792 - DNA, 20 bp, Artificial Sequence
  Synthetic oligonucleotide; AAG chr11 5234959 5234978 5234962 -
taccaaaagaaggaggaagc

SEQ ID NO: 47793 - DNA, 20 bp, Artificial Sequence
  Synthetic oligonucleotide; AAG chr11 5234955 5234974 5234958 -
aaaagaaggaggaagcaagc

SEQ ID NO: 47794 - DNA, 20 bp, Artificial Sequence
  Synthetic oligonucleotide; CAG chr11 5234943 5234962 5234946 -
aagcaagcaagtttaaactg

SEQ ID NO: 47795 - DNA, 20 bp, Artificial Sequence
  Synthetic oligonucleotide; TAG chr11 5234937 5234956 5234940 -
gcaagtttaaactgcagcaa

SEQ ID NO: 47796 - DNA, 20 bp, Artificial Sequence
  Synthetic oligonucleotide; TGG chr11 5234903 5234922 5234906 -
ccaacctctcaaaattccct

SEQ ID NO: 47797 - DNA, 20 bp, Artificial Sequence
  Synthetic oligonucleotide; GAG chr11 5234901 5234920 5234904 -
aacctctcaaaattcccttg

SEQ ID NO: 47798 - DNA, 20 bp, Artificial Sequence
  Synthetic oligonucleotide; TAG chr11 5234887 5234906 5234890 -
cccttggagacaaaaatctc

SEQ ID NO: 47799 - DNA, 20 bp, Artificial Sequence
  Synthetic oligonucleotide; GAG chr11 5234885 5234904 5234888 -
cttggagacaaaaatctcta

SEQ ID NO: 47800 - DNA, 20 bp, Artificial Sequence
  Synthetic oligonucleotide; AGG chr11 5234884 5234903 5234887 -
ttggagacaaaaatctctag

SEQ ID NO: 47801 - DNA, 20 bp, Artificial Sequence
  Synthetic oligonucleotide; AAG chr11 5234879 5234898 5234882 -
gacaaaaatctctagaggca

SEQ ID NO: 47802 - DNA, 20 bp, Artificial Sequence
  Synthetic oligonucleotide; AAG chr11 5234876 5234895 5234879 -
aaaaatctctagaggcaaag

SEQ ID NO: 47803 - DNA, 20 bp, Artificial Sequence
  Synthetic oligonucleotide; GAG chr11 5234862 5234881 5234865 -
gcaaagaagaactttatatt

SEQ ID NO: 47804 - DNA, 20 bp, Artificial Sequence
  Synthetic oligonucleotide; TAG chr11 5234835 5234854 5234838 -
cttgttaaaacatctgcttt

SEQ ID NO: 47805 - DNA, 20 bp, Artificial Sequence
  Synthetic oligonucleotide; AAG chr11 5234830 5234849 5234833 -
taaaacatctgcttttagat

SEQ ID NO: 47806 - DNA, 20 bp, Artificial Sequence
  Synthetic oligonucleotide; TAG chr11 5234821 5234840 5234824 -
tgcttttagataagttttct

SEQ ID NO: 47807 - DNA, 20 bp, Artificial Sequence
  Synthetic oligonucleotide; AAG chr11 5234814 5234833 5234817 -
agataagttttcttagtata

SEQ ID NO: 47808 - DNA, 20 bp, Artificial Sequence
  Synthetic oligonucleotide; CAG chr11 5234808 5234827 5234811 -
gttttcttagtataaagtga

SEQ ID NO: 47809 - DNA, 20 bp, Artificial Sequence
  Synthetic oligonucleotide; AAG chr11 5234797 5234816 5234800 -
ataaagtgacagaaacaaat

SEQ ID NO: 47810 - DNA, 20 bp, Artificial Sequence
  Synthetic oligonucleotide; AAG chr11 5234785 5234804 5234788 -
aaacaaataagttaaactct

SEQ ID NO: 47811 - DNA, 20 bp, Artificial Sequence
  Synthetic oligonucleotide; TAG chr11 5234766 5234785 5234769 -
taagatacattccactatat

SEQ ID NO: 47812 - DNA, 20 bp, Artificial Sequence
  Synthetic oligonucleotide; TAG chr11 5234736 5234755 5234739 -
cacttctgcaaaaatgaaac

SEQ ID NO: 47813 - DNA, 20 bp, Artificial Sequence
  Synthetic oligonucleotide; AGG chr11 5234735 5234754 5234738 -
acttctgcaaaaatgaaact

SEQ ID NO: 47814 - DNA, 20 bp, Artificial Sequence
  Synthetic oligonucleotide; GAG chr11 5234733 5234752 5234736 -
ttctgcaaaaatgaaactag

SEQ ID NO: 47815 - DNA, 20 bp, Artificial Sequence
  Synthetic oligonucleotide; AGG chr11 5234732 5234751 5234735 -
tctgcaaaaatgaaactagg

SEQ ID NO: 47816 - DNA, 20 bp, Artificial Sequence
  Synthetic oligonucleotide; TAG chr11 5234722 5234741 5234725 -
tgaaactaggaggatatttt

SEQ ID NO: 47817 - DNA, 20 bp, Artificial Sequence
  Synthetic oligonucleotide; AAG chr11 5234706 5234725 5234709 -
tttttagaaacaactgctga

SEQ ID NO: 47818 - DNA, 20 bp, Artificial Sequence
  Synthetic oligonucleotide; GAG chr11 5234704 5234723 5234707 -
tttagaaacaactgctgaaa

SEQ ID NO: 47819 - DNA, 20 bp, Artificial Sequence
  Synthetic oligonucleotide; CGG chr11 5234698 5234717 5234701 -
aacaactgctgaaagagatg

SEQ ID NO: 47820 - DNA, 20 bp, Artificial Sequence
  Synthetic oligonucleotide; TGG chr11 5234695 5234714 5234698 -
aactgctgaaagagatgcgg

SEQ ID NO: 47821 - DNA, 20 bp, Artificial Sequence
  Synthetic oligonucleotide; GGG chr11 5234694 5234713 5234697 -
actgctgaaagagatgcggt

SEQ ID NO: 47822 - DNA, 20 bp, Artificial Sequence
  Synthetic oligonucleotide; GGG chr11 5234693 5234712 5234696 -
ctgctgaaagagatgcggtg

SEQ ID NO: 47823 - DNA, 20 bp, Artificial Sequence
  Synthetic oligonucleotide; GAG chr11 5234691 5234710 5234694 -
gctgaaagagatgcggtggg

SEQ ID NO: 47824 - DNA, 20 bp, Artificial Sequence
  Synthetic oligonucleotide; TAG chr11 5234683 5234702 5234686 -
agatgcggtggggagatatg

SEQ ID NO: 47825 - DNA, 20 bp, Artificial Sequence
  Synthetic oligonucleotide; GAG chr11 5234681 5234700 5234684 -
atgcggtggggagatatgta

SEQ ID NO: 47826 - DNA, 20 bp, Artificial Sequence
  Synthetic oligonucleotide; AGG chr11 5234680 5234699 5234683 -
tgcggtggggagatatgtag

SEQ ID NO: 47827 - DNA, 20 bp, Artificial Sequence
  Synthetic oligonucleotide; GAG chr11 5234678 5234697 5234681 -
cggtggggagatatgtagag

SEQ ID NO: 47828 - DNA, 20 bp, Artificial Sequence
  Synthetic oligonucleotide; CAG chr11 5234673 5234692 5234676 -
gggagatatgtagaggagaa

SEQ ID NO: 47829 - DNA, 20 bp, Artificial Sequence
  Synthetic oligonucleotide; AGG chr11 5234672 5234691 5234675 -
ggagatatgtagaggagaac

SEQ ID NO: 47830 - DNA, 20 bp, Artificial Sequence
  Synthetic oligonucleotide; GGG chr11 5234671 5234690 5234674 -
gagatatgtagaggagaaca

SEQ ID NO: 47831 - DNA, 20 bp, Artificial Sequence
  Synthetic oligonucleotide; GAG chr11 5234663 5234682 5234666 -
tagaggagaacagggtttct

SEQ ID NO: 47832 - DNA, 20 bp, Artificial Sequence
  Synthetic oligonucleotide; AAG chr11 5234658 5234677 5234661 -
gagaacagggtttctgagtc

SEQ ID NO: 47833 - DNA, 20 bp, Artificial Sequence
  Synthetic oligonucleotide; CAG chr11 5234645 5234664 5234648 -
ctgagtcaagacacacatga

SEQ ID NO: 47834 - DNA, 20 bp, Artificial Sequence
  Synthetic oligonucleotide; CAG chr11 5234640 5234659 5234643 -
tcaagacacacatgacagaa

SEQ ID NO: 47835 - DNA, 20 bp, Artificial Sequence
  Synthetic oligonucleotide; CAG chr11 5234630 5234649 5234633 -
catgacagaacagccaatct

SEQ ID NO: 47836 - DNA, 20 bp, Artificial Sequence
  Synthetic oligonucleotide; AGG chr11 5234629 5234648 5234632 -
atgacagaacagccaatctc

SEQ ID NO: 47837 - DNA, 20 bp, Artificial Sequence
  Synthetic oligonucleotide; GGG chr11 5234628 5234647 5234631 -
tgacagaacagccaatctca

SEQ ID NO: 47838 - DNA, 20 bp, Artificial Sequence
  Synthetic oligonucleotide; AAG chr11 5234624 5234643 5234627 -
agaacagccaatctcagggc

SEQ ID NO: 47839 - DNA, 20 bp, Artificial Sequence
  Synthetic oligonucleotide; AAG chr11 5234619 5234638 5234622 -
agccaatctcagggcaagtt

SEQ ID NO: 47840 - DNA, 20 bp, Artificial Sequence
  Synthetic oligonucleotide; AGG chr11 5234618 5234637 5234621 -
gccaatctcagggcaagtta

SEQ ID NO: 47841 - DNA, 20 bp, Artificial Sequence
  Synthetic oligonucleotide; GGG chr11 5234617 5234636 5234620 -
ccaatctcagggcaagttaa

SEQ ID NO: 47842 - DNA, 20 bp, Artificial Sequence
  Synthetic oligonucleotide; TAG chr11 5234612 5234631 5234615 -
ctcagggcaagttaagggaa

SEQ ID NO: 47843 - DNA, 20 bp, Artificial Sequence
  Synthetic oligonucleotide; TGG chr11 5234609 5234628 5234612 -
agggcaagttaagggaatag

SEQ ID NO: 47844 - DNA, 20 bp, Artificial Sequence
  Synthetic oligonucleotide; AAG chr11 5234602 5234621 5234605 -
gttaagggaatagtggaatg

SEQ ID NO: 47845 - DNA, 20 bp, Artificial Sequence
  Synthetic oligonucleotide; AGG chr11 5234601 5234620 5234604 -
ttaagggaatagtggaatga

SEQ ID NO: 47846 - DNA, 20 bp, Artificial Sequence
  Synthetic oligonucleotide; TGG chr11 5234539 5234558 5234542 -
tcttaaaccaacctgctcac

SEQ ID NO: 47847 - DNA, 20 bp, Artificial Sequence
  Synthetic oligonucleotide; GAG chr11 5234537 5234556 5234540 -
ttaaaccaacctgctcactg

SEQ ID NO: 47848 - DNA, 20 bp, Artificial Sequence
  Synthetic oligonucleotide; CAG chr11 5234534 5234553 5234537 -
aaccaacctgctcactggag

SEQ ID NO: 47849 - DNA, 20 bp, Artificial Sequence
  Synthetic oligonucleotide; AGG chr11 5234533 5234552 5234536 -
accaacctgctcactggagc

SEQ ID NO: 47850 - DNA, 20 bp, Artificial Sequence
  Synthetic oligonucleotide; GGG chr11 5234532 5234551 5234535 -
ccaacctgctcactggagca

SEQ ID NO: 47851 - DNA, 20 bp, Artificial Sequence
  Synthetic oligonucleotide; GAG chr11 5234530 5234549 5234533 -
aacctgctcactggagcagg

SEQ ID NO: 47852 - DNA, 20 bp, Artificial Sequence
  Synthetic oligonucleotide; AGG chr11 5234529 5234548 5234532 -
acctgctcactggagcaggg

SEQ ID NO: 47853 - DNA, 20 bp, Artificial Sequence
  Synthetic oligonucleotide; CAG chr11 5234525 5234544 5234528 -
gctcactggagcagggagga

SEQ ID NO: 47854 - DNA, 20 bp, Artificial Sequence
  Synthetic oligonucleotide; AGG chr11 5234524 5234543 5234527 -
ctcactggagcagggaggac

SEQ ID NO: 47855 - DNA, 20 bp, Artificial Sequence
  Synthetic oligonucleotide; CAG chr11 5234519 5234538 5234522 -
tggagcagggaggacaggac

SEQ ID NO: 47856 - DNA, 20 bp, Artificial Sequence
  Synthetic oligonucleotide; AAG chr11 5234511 5234530 5234514 -
ggaggacaggaccagcataa

SEQ ID NO: 47857 - DNA, 20 bp, Artificial Sequence
  Synthetic oligonucleotide; AGG chr11 5234510 5234529 5234513 -
gaggacaggaccagcataaa

SEQ ID NO: 47858 - DNA, 20 bp, Artificial Sequence
  Synthetic oligonucleotide; CAG chr11 5234507 5234526 5234510 -
gacaggaccagcataaaagg

SEQ ID NO: 47859 - DNA, 20 bp, Artificial Sequence
  Synthetic oligonucleotide; AGG chr11 5234506 5234525 5234509 -
acaggaccagcataaaaggc

SEQ ID NO: 47860 - DNA, 20 bp, Artificial Sequence
  Synthetic oligonucleotide; GGG chr11 5234505 5234524 5234508 -
caggaccagcataaaaggca

SEQ ID NO: 47861 - DNA, 20 bp, Artificial Sequence
  Synthetic oligonucleotide; CAG chr11 5234502 5234521 5234505 -
gaccagcataaaaggcaggg

SEQ ID NO: 47862 - DNA, 20 bp, Artificial Sequence
  Synthetic oligonucleotide; GAG chr11 5234500 5234519 5234503 -
ccagcataaaaggcagggca

SEQ ID NO: 47863 - DNA, 20 bp, Artificial Sequence
  Synthetic oligonucleotide; CAG chr11 5234465 5234484 5234468 -
tacactttcttctgacataa

SEQ ID NO: 47864 - DNA, 20 bp, Artificial Sequence
  Synthetic oligonucleotide; TAG chr11 5234455 5234474 5234458 -
tctgacataacagtgttcac

SEQ ID NO: 47865 - DNA, 20 bp, Artificial Sequence
  Synthetic oligonucleotide; CAG chr11 5234442 5234461 5234445 -
tgttcactagcaacctcaaa

SEQ ID NO: 47866 - DNA, 20 bp, Artificial Sequence
  Synthetic oligonucleotide; TGG chr11 5234433 5234452 5234436 -
gcaacctcaaacagacacca

SEQ ID NO: 47867 - DNA, 20 bp, Artificial Sequence
  Synthetic oligonucleotide; GAG chr11 5234416 5234435 5234419 -
ccatggtgcatctgactcct

SEQ ID NO: 47868 - DNA, 20 bp, Artificial Sequence
  Synthetic oligonucleotide; AGG chr11 5234415 5234434 5234418 -
catggtgcatctgactcctg

SEQ ID NO: 47869 - DNA, 20 bp, Artificial Sequence
  Synthetic oligonucleotide; GAG chr11 5234413 5234432 5234416 -
tggtgcatctgactcctgag

SEQ ID NO: 47870 - DNA, 20 bp, Artificial Sequence
  Synthetic oligonucleotide; AAG chr11 5234410 5234429 5234413 -
tgcatctgactcctgaggag

SEQ ID NO: 47871 - DNA, 20 bp, Artificial Sequence
  Synthetic oligonucleotide; TGG chr11 5234389 5234408 5234392 -
agactgctgtcaatgccctg

SEQ ID NO: 47872 - DNA, 20 bp, Artificial Sequence
  Synthetic oligonucleotide; GGG chr11 5234388 5234407 5234391 -
gactgctgtcaatgccctgt

SEQ ID NO: 47873 - DNA, 20 bp, Artificial Sequence
  Synthetic oligonucleotide; GGG chr11 5234387 5234406 5234390 -
actgctgtcaatgccctgtg

SEQ ID NO: 47874 - DNA, 20 bp, Artificial Sequence
  Synthetic oligonucleotide; AAG chr11 5234382 5234401 5234385 -
tgtcaatgccctgtggggca

SEQ ID NO: 47875 - DNA, 20 bp, Artificial Sequence
  Synthetic oligonucleotide; TGG chr11 5234373 5234392 5234376 -
cctgtggggcaaagtgaacg

SEQ ID NO: 47876 - DNA, 20 bp, Artificial Sequence
  Synthetic oligonucleotide; CAG chr11 5234367 5234386 5234370 -
gggcaaagtgaacgtggatg

SEQ ID NO: 47877 - DNA, 20 bp, Artificial Sequence
  Synthetic oligonucleotide; TGG chr11 5234363 5234382 5234366 -
aaagtgaacgtggatgcagt

SEQ ID NO: 47878 - DNA, 20 bp, Artificial Sequence
  Synthetic oligonucleotide; TGG chr11 5234360 5234379 5234363 -
gtgaacgtggatgcagttgg

SEQ ID NO: 47879 - DNA, 20 bp, Artificial Sequence
  Synthetic oligonucleotide; GAG chr11 5234356 5234375 5234359 -
acgtggatgcagttggtggt

SEQ ID NO: 47880 - DNA, 20 bp, Artificial Sequence
  Synthetic oligonucleotide; AGG chr11 5234355 5234374 5234358 -
cgtggatgcagttggtggtg

SEQ ID NO: 47881 - DNA, 20 bp, Artificial Sequence
  Synthetic oligonucleotide; TGG chr11 5234349 5234368 5234352 -
tgcagttggtggtgaggccc

SEQ ID NO: 47882 - DNA, 20 bp, Artificial Sequence
  Synthetic oligonucleotide; GGG chr11 5234348 5234367 5234351 -
gcagttggtggtgaggccct

SEQ ID NO: 47883 - DNA, 20 bp, Artificial Sequence
  Synthetic oligonucleotide; CAG chr11 5234345 5234364 5234348 -
gttggtggtgaggccctggg

SEQ ID NO: 47884 - DNA, 20 bp, Artificial Sequence
  Synthetic oligonucleotide; AGG chr11 5234344 5234363 5234347 -
ttggtggtgaggccctgggc

SEQ ID NO: 47885 - DNA, 20 bp, Artificial Sequence
  Synthetic oligonucleotide; TGG chr11 5234340 5234359 5234343 -
tggtgaggccctgggcaggt

SEQ ID NO: 47886 - DNA, 20 bp, Artificial Sequence
  Synthetic oligonucleotide; AAG chr11 5234333 5234352 5234336 -
gccctgggcaggttggtatc

SEQ ID NO: 47887 - DNA, 20 bp, Artificial Sequence
  Synthetic oligonucleotide; AGG chr11 5234332 5234351 5234335 -
ccctgggcaggttggtatca

SEQ ID NO: 47888 - DNA, 20 bp, Artificial Sequence
  Synthetic oligonucleotide; AAG chr11 5234325 5234344 5234328 -
caggttggtatcaaggttat

SEQ ID NO: 47889 - DNA, 20 bp, Artificial Sequence
  Synthetic oligonucleotide; GAG chr11 5234323 5234342 5234326 -
ggttggtatcaaggttataa

SEQ ID NO: 47890 - DNA, 20 bp, Artificial Sequence
  Synthetic oligonucleotide; GAG chr11 5234321 5234340 5234324 -
ttggtatcaaggttataaga

SEQ ID NO: 47891 - DNA, 20 bp, Artificial Sequence
  Synthetic oligonucleotide; AGG chr11 5234320 5234339 5234323 -
tggtatcaaggttataagag

SEQ ID NO: 47892 - DNA, 20 bp, Artificial Sequence
  Synthetic oligonucleotide; AAG chr11 5234314 5234333 5234317 -
caaggttataagagaggctc

SEQ ID NO: 47893 - DNA, 20 bp, Artificial Sequence
  Synthetic oligonucleotide; AGG chr11 5234313 5234332 5234316 -
aaggttataagagaggctca

SEQ ID NO: 47894 - DNA, 20 bp, Artificial Sequence
  Synthetic oligonucleotide; GAG chr11 5234311 5234330 5234314 -
ggttataagagaggctcaag

SEQ ID NO: 47895 - DNA, 20 bp, Artificial Sequence
  Synthetic oligonucleotide; AGG chr11 5234310 5234329 5234313 -
gttataagagaggctcaagg

SEQ ID NO: 47896 - DNA, 20 bp, Artificial Sequence
  Synthetic oligonucleotide; TGG chr11 5234303 5234322 5234306 -
gagaggctcaaggaggcaaa

SEQ ID NO: 47897 - DNA, 20 bp, Artificial Sequence
  Synthetic oligonucleotide; TGG chr11 5234296 5234315 5234299 -
tcaaggaggcaaatggaaac

SEQ ID NO: 47898 - DNA, 20 bp, Artificial Sequence
  Synthetic oligonucleotide; GGG chr11 5234295 5234314 5234298 -
caaggaggcaaatggaaact

SEQ ID NO: 47899 - DNA, 20 bp, Artificial Sequence
  Synthetic oligonucleotide; TAG chr11 5234286 5234305 5234289 -
aaatggaaactgggcatgtg

SEQ ID NO: 47900 - DNA, 20 bp, Artificial Sequence
  Synthetic oligonucleotide; CAG chr11 5234282 5234301 5234285 -
ggaaactgggcatgtgtaga

SEQ ID NO: 47901 - DNA, 20 bp, Artificial Sequence
  Synthetic oligonucleotide; GAG chr11 5234280 5234299 5234283 -
aaactgggcatgtgtagaca

SEQ ID NO: 47902 - DNA, 20 bp, Artificial Sequence
  Synthetic oligonucleotide; AAG chr11 5234277 5234296 5234280 -
ctgggcatgtgtagacagag

SEQ ID NO: 47903 - DNA, 20 bp, Artificial Sequence
  Synthetic oligonucleotide; TGG chr11 5234269 5234288 5234272 -
gtgtagacagagaagactct

SEQ ID NO: 47904 - DNA, 20 bp, Artificial Sequence
  Synthetic oligonucleotide; GGG chr11 5234268 5234287 5234271 -
tgtagacagagaagactctt

SEQ ID NO: 47905 - DNA, 20 bp, Artificial Sequence
  Synthetic oligonucleotide; TAG chr11 5234258 5234277 5234261 -
gaagactcttgggtttctga

SEQ ID NO: 47906 - DNA, 20 bp, Artificial Sequence
  Synthetic oligonucleotide; AGG chr11 5234257 5234276 5234260 -
aagactcttgggtttctgat

SEQ ID NO: 47907 - DNA, 20 bp, Artificial Sequence
  Synthetic oligonucleotide; TGG chr11 5234236 5234255 5234239 -
ggcactgactctctgtccct

SEQ ID NO: 47908 - DNA, 20 bp, Artificial Sequence
  Synthetic oligonucleotide; GGG chr11 5234235 5234254 5234238 -
gcactgactctctgtccctt

SEQ ID NO: 47909 - DNA, 20 bp, Artificial Sequence
  Synthetic oligonucleotide; CAG chr11 5234217 5234236 5234220 -
ttgggctgttttcctaccct

SEQ ID NO: 47910 - DNA, 20 bp, Artificial Sequence
  Synthetic oligonucleotide; TGG chr11 5234209 5234228 5234212 -
ttttcctaccctcagattac

SEQ ID NO: 47911 - DNA, 20 bp, Artificial Sequence
  Synthetic oligonucleotide; TGG chr11 5234206 5234225 5234209 -
tcctaccctcagattactgg

SEQ ID NO: 47912 - DNA, 20 bp, Artificial Sequence
  Synthetic oligonucleotide; TGG chr11 5234195 5234214 5234198 -
gattactggtggtctaccct

SEQ ID NO: 47913 - DNA, 20 bp, Artificial Sequence
  Synthetic oligonucleotide; CAG chr11 5234189 5234208 5234192 -
tggtggtctacccttggacc

SEQ ID NO: 47914 - DNA, 20 bp, Artificial Sequence
  Synthetic oligonucleotide; GAG chr11 5234187 5234206 5234190 -
gtggtctacccttggaccca

SEQ ID NO: 47915 - DNA, 20 bp, Artificial Sequence
  Synthetic oligonucleotide; AGG chr11 5234186 5234205 5234189 -
tggtctacccttggacccag

SEQ ID NO: 47916 - DNA, 20 bp, Artificial Sequence
  Synthetic oligonucleotide; GAG chr11 5234177 5234196 5234180 -
cttggacccagaggttcttt

SEQ ID NO: 47917 - DNA, 20 bp, Artificial Sequence
  Synthetic oligonucleotide; TGG chr11 5234169 5234188 5234172 -
cagaggttctttgagtcctt

SEQ ID NO: 47918 - DNA, 20 bp, Artificial Sequence
  Synthetic oligonucleotide; GGG chr11 5234168 5234187 5234171 -
agaggttctttgagtccttt

SEQ ID NO: 47919 - DNA, 20 bp, Artificial Sequence
  Synthetic oligonucleotide; GGG chr11 5234167 5234186 5234170 -
gaggttctttgagtcctttg

SEQ ID NO: 47920 - DNA, 20 bp, Artificial Sequence
  Synthetic oligonucleotide; TGG chr11 5234140 5234159 5234143 -
gtcctctcctgatgctgtta

SEQ ID NO: 47921 - DNA, 20 bp, Artificial Sequence
  Synthetic oligonucleotide; GGG chr11 5234139 5234158 5234142 -
tcctctcctgatgctgttat

SEQ ID NO: 47922 - DNA, 20 bp, Artificial Sequence
  Synthetic oligonucleotide; AAG chr11 5234129 5234148 5234132 -
atgctgttatgggcaaccct

SEQ ID NO: 47923 - DNA, 20 bp, Artificial Sequence
  Synthetic oligonucleotide; AGG chr11 5234128 5234147 5234131 -
tgctgttatgggcaacccta

SEQ ID NO: 47924 - DNA, 20 bp, Artificial Sequence
  Synthetic oligonucleotide; AAG chr11 5234123 5234142 5234126 -
ttatgggcaaccctaaggtg

SEQ ID NO: 47925 - DNA, 20 bp, Artificial Sequence
  Synthetic oligonucleotide; AGG chr11 5234122 5234141 5234125 -
tatgggcaaccctaaggtga

SEQ ID NO: 47926 - DNA, 20 bp, Artificial Sequence
  Synthetic oligonucleotide; TGG chr11 5234115 5234134 5234118 -
aaccctaaggtgaaggctca

SEQ ID NO: 47927 - DNA, 20 bp, Artificial Sequence
  Synthetic oligonucleotide; AAG chr11 5234111 5234130 5234114 -
ctaaggtgaaggctcatggc

SEQ ID NO: 47928 - DNA, 20 bp, Artificial Sequence
  Synthetic oligonucleotide; AAG chr11 5234108 5234127 5234111 -
aggtgaaggctcatggcaag

SEQ ID NO: 47929 - DNA, 20 bp, Artificial Sequence
  Synthetic oligonucleotide; AGG chr11 5234107 5234126 5234110 -
ggtgaaggctcatggcaaga

SEQ ID NO: 47930 - DNA, 20 bp, Artificial Sequence
  Synthetic oligonucleotide; TAG chr11 5234101 5234120 5234104 -
ggctcatggcaagaaggtgc

SEQ ID NO: 47931 - DNA, 20 bp, Artificial Sequence
  Synthetic oligonucleotide; AGG chr11 5234100 5234119 5234103 -
gctcatggcaagaaggtgct

SEQ ID NO: 47932 - DNA, 20 bp, Artificial Sequence
  Synthetic oligonucleotide; TAG chr11 5234091 5234110 5234094 -
aagaaggtgctaggtgcctt

SEQ ID NO: 47933 - DNA, 20 bp, Artificial Sequence
  Synthetic oligonucleotide; TGG chr11 5234085 5234104 5234088 -
gtgctaggtgcctttagtga

SEQ ID NO: 47934 - DNA, 20 bp, Artificial Sequence
  Synthetic oligonucleotide; TGG chr11 5234080 5234099 5234083 -
aggtgcctttagtgatggcc

SEQ ID NO: 47935 - DNA, 20 bp, Artificial Sequence
  Synthetic oligonucleotide; TGG chr11 5234071 5234090 5234074 -
tagtgatggcctggctcacc

SEQ ID NO: 47936 - DNA, 20 bp, Artificial Sequence
  Synthetic oligonucleotide; AAG chr11 5234060 5234079 5234063 -
tggctcacctggacaacctc

SEQ ID NO: 47937 - DNA, 20 bp, Artificial Sequence
  Synthetic oligonucleotide; AGG chr11 5234059 5234078 5234062 -
ggctcacctggacaacctca

SEQ ID NO: 47938 - DNA, 20 bp, Artificial Sequence
  Synthetic oligonucleotide; GGG chr11 5234058 5234077 5234061 -
gctcacctggacaacctcaa

SEQ ID NO: 47939 - DNA, 20 bp, Artificial Sequence
  Synthetic oligonucleotide; CAG chr11 5234045 5234064 5234048 -
acctcaagggcactttttct

SEQ ID NO: 47940 - DNA, 20 bp, Artificial Sequence
  Synthetic oligonucleotide; GAG chr11 5234040 5234059 5234043 -
aagggcactttttctcagct

SEQ ID NO: 47941 - DNA, 20 bp, Artificial Sequence
  Synthetic oligonucleotide; GAG chr11 5234036 5234055 5234039 -
gcactttttctcagctgagt

SEQ ID NO: 47942 - DNA, 20 bp, Artificial Sequence
  Synthetic oligonucleotide; AAG chr11 5234021 5234040 5234024 -
tgagtgagctgcactgtgac

SEQ ID NO: 47943 - DNA, 20 bp, Artificial Sequence
  Synthetic oligonucleotide; TGG chr11 5234011 5234030 5234014 -
gcactgtgacaagctgcacg

SEQ ID NO: 47944 - DNA, 20 bp, Artificial Sequence
  Synthetic oligonucleotide; GAG chr11 5234003 5234022 5234006 -
acaagctgcacgtggatcct

SEQ ID NO: 47945 - DNA, 20 bp, Artificial Sequence
  Synthetic oligonucleotide; CAG chr11 5233995 5234014 5233998 -
cacgtggatcctgagaactt

SEQ ID NO: 47946 - DNA, 20 bp, Artificial Sequence
  Synthetic oligonucleotide; AGG chr11 5233994 5234013 5233997 -
acgtggatcctgagaacttc

SEQ ID NO: 47947 - DNA, 20 bp, Artificial Sequence
  Synthetic oligonucleotide; GGG chr11 5233993 5234012 5233996 -
cgtggatcctgagaacttca

SEQ ID NO: 47948 - DNA, 20 bp, Artificial Sequence
  Synthetic oligonucleotide; GAG chr11 5233989 5234008 5233992 -
gatcctgagaacttcagggt

SEQ ID NO: 47949 - DNA, 20 bp, Artificial Sequence
  Synthetic oligonucleotide; CAG chr11 5233984 5234003 5233987 -
tgagaacttcagggtgagtc

SEQ ID NO: 47950 - DNA, 20 bp, Artificial Sequence
  Synthetic oligonucleotide; AGG chr11 5233983 5234002 5233986 -
gagaacttcagggtgagtcc

SEQ ID NO: 47951 - DNA, 20 bp, Artificial Sequence
  Synthetic oligonucleotide; GAG chr11 5233981 5234000 5233984 -
gaacttcagggtgagtccag

SEQ ID NO: 47952 - DNA, 20 bp, Artificial Sequence
  Synthetic oligonucleotide; TGG chr11 5233938 5233957 5233941 -
tactttctaatcttacattt

SEQ ID NO: 47953 - DNA, 20 bp, Artificial Sequence
  Synthetic oligonucleotide; CAG chr11 5233720 5233739 5233723 -
acaactcaaattatgcatac

SEQ ID NO: 47954 - DNA, 20 bp, Artificial Sequence
  Synthetic oligonucleotide; TAG chr11 5233694 5233713 5233697 -
tcacctgctaattctgcact

SEQ ID NO: 47955 - DNA, 20 bp, Artificial Sequence
  Synthetic oligonucleotide; TGG chr11 5233668 5233687 5233671 -
aatccttttgtctctccaca

SEQ ID NO: 47956 - DNA, 20 bp, Artificial Sequence
  Synthetic oligonucleotide; GGG chr11 5233667 5233686 5233670 -
atccttttgtctctccacat

SEQ ID NO: 47957 - DNA, 20 bp, Artificial Sequence
  Synthetic oligonucleotide; TGG chr11 5233662 5233681 5233665 -
tttgtctctccacatgggta

SEQ ID NO: 47958 - DNA, 20 bp, Artificial Sequence
  Synthetic oligonucleotide; GGG chr11 5233661 5233680 5233664 -
ttgtctctccacatgggtat

SEQ ID NO: 47959 - DNA, 20 bp, Artificial Sequence
  Synthetic oligonucleotide; GAG chr11 5233659 5233678 5233662 -
gtctctccacatgggtatgg

SEQ ID NO: 47960 - DNA, 20 bp, Artificial Sequence
  Synthetic oligonucleotide; GAG chr11 5233657 5233676 5233660 -
ctctccacatgggtatggga

SEQ ID NO: 47961 - DNA, 20 bp, Artificial Sequence
  Synthetic oligonucleotide; AGG chr11 5233656 5233675 5233659 -
tctccacatgggtatgggag

SEQ ID NO: 47962 - DNA, 20 bp, Artificial Sequence
  Synthetic oligonucleotide; AAG chr11 5233643 5233662 5233646 -
atgggagaggctccaactca

SEQ ID NO: 47963 - DNA, 20 bp, Artificial Sequence
  Synthetic oligonucleotide; GAG chr11 5233638 5233657 5233641 -
agaggctccaactcaaagat

SEQ ID NO: 47964 - DNA, 20 bp, Artificial Sequence
  Synthetic oligonucleotide; GAG chr11 5233636 5233655 5233639 -
aggctccaactcaaagatga

SEQ ID NO: 47965 - DNA, 20 bp, Artificial Sequence
  Synthetic oligonucleotide; AGG chr11 5233635 5233654 5233638 -
ggctccaactcaaagatgag

SEQ ID NO: 47966 - DNA, 20 bp, Artificial Sequence
  Synthetic oligonucleotide; TAG chr11 5233630 5233649 5233633 -
caactcaaagatgagaggca

SEQ ID NO: 47967 - DNA, 20 bp, Artificial Sequence
  Synthetic oligonucleotide; TAG chr11 5233617 5233636 5233620 -
agaggcatagaatactgttt

SEQ ID NO: 47968 - DNA, 20 bp, Artificial Sequence
  Synthetic oligonucleotide; GAG chr11 5233615 5233634 5233618 -
aggcatagaatactgtttta

SEQ ID NO: 47969 - DNA, 20 bp, Artificial Sequence
  Synthetic oligonucleotide; AGG chr11 5233614 5233633 5233617 -
ggcatagaatactgttttag

SEQ ID NO: 47970 - DNA, 20 bp, Artificial Sequence
  Synthetic oligonucleotide; AAG chr11 5233592 5233611 5233595 -
gctataaatcattttacaat

SEQ ID NO: 47971 - DNA, 20 bp, Artificial Sequence
  Synthetic oligonucleotide; AGG chr11 5233591 5233610 5233594 -
ctataaatcattttacaata

SEQ ID NO: 47972 - DNA, 20 bp, Artificial Sequence
  Synthetic oligonucleotide; TGG chr11 5233582 5233601 5233585 -
attttacaataaggaataat

SEQ ID NO: 47973 - DNA, 20 bp, Artificial Sequence
  Synthetic oligonucleotide; TAG chr11 5233563 5233582 5233566 -
ttggaattttataaattctg

SEQ ID NO: 47974 - DNA, 20 bp, Artificial Sequence
  Synthetic oligonucleotide; TGG chr11 5233556 5233575 5233559 -
tttataaattctgtagtaaa

SEQ ID NO: 47975 - DNA, 20 bp, Artificial Sequence
  Synthetic oligonucleotide; TGG chr11 5233551 5233570 5233554 -
aaattctgtagtaaatggaa

SEQ ID NO: 47976 - DNA, 20 bp, Artificial Sequence
  Synthetic oligonucleotide; AAG chr11 5233547 5233566 5233550 -
tctgtagtaaatggaatgga

SEQ ID NO: 47977 - DNA, 20 bp, Artificial Sequence
  Synthetic oligonucleotide; AGG chr11 5233546 5233565 5233549 -
ctgtagtaaatggaatggaa

SEQ ID NO: 47978 - DNA, 20 bp, Artificial Sequence
  Synthetic oligonucleotide; AAG chr11 5233542 5233561 5233545 -
agtaaatggaatggaaagga

SEQ ID NO: 47979 - DNA, 20 bp, Artificial Sequence
  Synthetic oligonucleotide; AAG chr11 5233522 5233541 5233525 -
aagtgaatatttgattatga

SEQ ID NO: 47980 - DNA, 20 bp, Artificial Sequence
  Synthetic oligonucleotide; TAG chr11 5233517 5233536 5233520 -
aatatttgattatgaaagac

SEQ ID NO: 47981 - DNA, 20 bp, Artificial Sequence
  Synthetic oligonucleotide; AGG chr11 5233516 5233535 5233519 -
atatttgattatgaaagact

SEQ ID NO: 47982 - DNA, 20 bp, Artificial Sequence
  Synthetic oligonucleotide; CAG chr11 5233513 5233532 5233516 -
tttgattatgaaagactagg

SEQ ID NO: 47983 - DNA, 20 bp, Artificial Sequence
  Synthetic oligonucleotide; TGG chr11 5233504 5233523 5233507 -
gaaagactaggcagttacac

SEQ ID NO: 47984 - DNA, 20 bp, Artificial Sequence
  Synthetic oligonucleotide; GAG chr11 5233502 5233521 5233505 -
aagactaggcagttacactg

SEQ ID NO: 47985 - DNA, 20 bp, Artificial Sequence
  Synthetic oligonucleotide; AGG chr11 5233501 5233520 5233504 -
agactaggcagttacactgg

SEQ ID NO: 47986 - DNA, 20 bp, Artificial Sequence
  Synthetic oligonucleotide; TGG chr11 5233498 5233517 5233501 -
ctaggcagttacactggagg

SEQ ID NO: 47987 - DNA, 20 bp, Artificial Sequence
  Synthetic oligonucleotide; GGG chr11 5233497 5233516 5233500 -
taggcagttacactggaggt

SEQ ID NO: 47988 - DNA, 20 bp, Artificial Sequence
  Synthetic oligonucleotide; GGG chr11 5233496 5233515 5233499 -
aggcagttacactggaggtg

SEQ ID NO: 47989 - DNA, 20 bp, Artificial Sequence
  Synthetic oligonucleotide; CAG chr11 5233493 5233512 5233496 -
cagttacactggaggtgggg

SEQ ID NO: 47990 - DNA, 20 bp, Artificial Sequence
  Synthetic oligonucleotide; AAG chr11 5233490 5233509 5233493 -
ttacactggaggtggggcag

SEQ ID NO: 47991 - DNA, 20 bp, Artificial Sequence
  Synthetic oligonucleotide; TAG chr11 5233480 5233499 5233483 -
ggtggggcagaagtcgttgc

SEQ ID NO: 47992 - DNA, 20 bp, Artificial Sequence
  Synthetic oligonucleotide; AGG chr11 5233479 5233498 5233482 -
gtggggcagaagtcgttgct

SEQ ID NO: 47993 - DNA, 20 bp, Artificial Sequence
  Synthetic oligonucleotide; GAG chr11 5233477 5233496 5233480 -
ggggcagaagtcgttgctag

SEQ ID NO: 47994 - DNA, 20 bp, Artificial Sequence
  Synthetic oligonucleotide; CAG chr11 5233473 5233492 5233476 -
cagaagtcgttgctaggaga

SEQ ID NO: 47995 - DNA, 20 bp, Artificial Sequence
  Synthetic oligonucleotide; TAG chr11 5233420 5233439 5233423 -
tgtatctattaatctgttta

SEQ ID NO: 47996 - DNA, 20 bp, Artificial Sequence
  Synthetic oligonucleotide; TGG chr11 5233370 5233389 5233373 -
atacaaaattaaaactaatt

SEQ ID NO: 47997 - DNA, 20 bp, Artificial Sequence
  Synthetic oligonucleotide; TAG chr11 5233353 5233372 5233356 -
atttggaattaatttgtata

SEQ ID NO: 47998 - DNA, 20 bp, Artificial Sequence
  Synthetic oligonucleotide; CAG chr11 5233343 5233362 5233346 -
aatttgtatatagtattata

SEQ ID NO: 47999 - DNA, 20 bp, Artificial Sequence
  Synthetic oligonucleotide; TAG chr11 5233334 5233353 5233337 -
atagtattatacagcatata

SEQ ID NO: 48000 - DNA, 20 bp, Artificial Sequence
  Synthetic oligonucleotide; TAG chr11 5233315 5233334 5233318 -
atagcatatatgtacatata

SEQ ID NO: 48001 - DNA, 20 bp, Artificial Sequence
  Synthetic oligonucleotide; TAG chr11 5233303 5233322 5233306 -
tacatatatagactacatgc

SEQ ID NO: 48002 - DNA, 20 bp, Artificial Sequence
  Synthetic oligonucleotide; AAG chr11 5233298 5233317 5233301 -
atatagactacatgctagtt

SEQ ID NO: 48003 - DNA, 20 bp, Artificial Sequence
  Synthetic oligonucleotide; TAG chr11 5233291 5233310 5233294 -
ctacatgctagttaagtaca

SEQ ID NO: 48004 - DNA, 20 bp, Artificial Sequence
  Synthetic oligonucleotide; GAG chr11 5233289 5233308 5233292 -
acatgctagttaagtacata

SEQ ID NO: 48005 - DNA, 20 bp, Artificial Sequence
  Synthetic oligonucleotide; AGG chr11 5233288 5233307 5233291 -
catgctagttaagtacatag

SEQ ID NO: 48006 - DNA, 20 bp, Artificial Sequence
  Synthetic oligonucleotide; TAG chr11 5233274 5233293 5233277 -
acatagaggatgtgtgtgta

SEQ ID NO: 48007 - DNA, 20 bp, Artificial Sequence
  Synthetic oligonucleotide; TGG chr11 5233225 5233244 5233228 -
tatgtacttatttatgctga

SEQ ID NO: 48008 - DNA, 20 bp, Artificial Sequence
  Synthetic oligonucleotide; GGG chr11 5233224 5233243 5233227 -
atgtacttatttatgctgat

SEQ ID NO: 48009 - DNA, 20 bp, Artificial Sequence
  Synthetic oligonucleotide; TGG chr11 5233214 5233233 5233217 -
ttatgctgatgggaataacc

SEQ ID NO: 48010 - DNA, 20 bp, Artificial Sequence
  Synthetic oligonucleotide; GGG chr11 5233213 5233232 5233216 -
tatgctgatgggaataacct

SEQ ID NO: 48011 - DNA, 20 bp, Artificial Sequence
  Synthetic oligonucleotide; GGG chr11 5233212 5233231 5233215 -
atgctgatgggaataacctg

SEQ ID NO: 48012 - DNA, 20 bp, Artificial Sequence
  Synthetic oligonucleotide; CAG chr11 5233207 5233226 5233210 -
gatgggaataacctggggat

SEQ ID NO: 48013 - DNA, 20 bp, Artificial Sequence
  Synthetic oligonucleotide; AAG chr11 5233196 5233215 5233199 -
cctggggatcagttttgtct

SEQ ID NO: 48014 - DNA, 20 bp, Artificial Sequence
  Synthetic oligonucleotide; TGG chr11 5233190 5233209 5233193 -
gatcagttttgtctaagatt

SEQ ID NO: 48015 - DNA, 20 bp, Artificial Sequence
  Synthetic oligonucleotide; GGG chr11 5233189 5233208 5233192 -
atcagttttgtctaagattt

SEQ ID NO: 48016 - DNA, 20 bp, Artificial Sequence
  Synthetic oligonucleotide; CAG chr11 5233186 5233205 5233189 -
agttttgtctaagatttggg

SEQ ID NO: 48017 - DNA, 20 bp, Artificial Sequence
  Synthetic oligonucleotide; TGG chr11 5233176 5233195 5233179 -
aagatttgggcagaaaaaaa

SEQ ID NO: 48018 - DNA, 20 bp, Artificial Sequence
  Synthetic oligonucleotide; GGG chr11 5233175 5233194 5233178 -
agatttgggcagaaaaaaat

SEQ ID NO: 48019 - DNA, 20 bp, Artificial Sequence
  Synthetic oligonucleotide; TGG chr11 5233169 5233188 5233172 -
gggcagaaaaaaatgggtgt

SEQ ID NO: 48020 - DNA, 20 bp, Artificial Sequence
  Synthetic oligonucleotide; CAG chr11 5233164 5233183 5233167 -
gaaaaaaatgggtgttggct

SEQ ID NO: 48021 - DNA, 20 bp, Artificial Sequence
  Synthetic oligonucleotide; CAG chr11 5233156 5233175 5233159 -
tgggtgttggctcagtttct

SEQ ID NO: 48022 - DNA, 20 bp, Artificial Sequence
  Synthetic oligonucleotide; AAG chr11 5233153 5233172 5233156 -
gtgttggctcagtttctcag

SEQ ID NO: 48023 - DNA, 20 bp, Artificial Sequence
  Synthetic oligonucleotide; CAG chr11 5233149 5233168 5233152 -
tggctcagtttctcagaagc

SEQ ID NO: 48024 - DNA, 20 bp, Artificial Sequence
  Synthetic oligonucleotide; CAG chr11 5233096 5233115 5233099 -
atctgcctacctcttctccg

SEQ ID NO: 48025 - DNA, 20 bp, Artificial Sequence
  Synthetic oligonucleotide; TGG chr11 5233089 5233108 5233092 -
tacctcttctccgcagctct

SEQ ID NO: 48026 - DNA, 20 bp, Artificial Sequence
  Synthetic oligonucleotide; GGG chr11 5233088 5233107 5233091 -
acctcttctccgcagctctt

SEQ ID NO: 48027 - DNA, 20 bp, Artificial Sequence
  Synthetic oligonucleotide; TGG chr11 5233077 5233096 5233080 -
gcagctcttgggcaatgtgc

SEQ ID NO: 48028 - DNA, 20 bp, Artificial Sequence
  Synthetic oligonucleotide; TGG chr11 5233065 5233084 5233068 -
caatgtgctggtgtgtgtgc

SEQ ID NO: 48029 - DNA, 20 bp, Artificial Sequence
  Synthetic oligonucleotide; TGG chr11 5233052 5233071 5233055 -
tgtgtgctggcccgcaactt

SEQ ID NO: 48030 - DNA, 20 bp, Artificial Sequence
  Synthetic oligonucleotide; AAG chr11 5233048 5233067 5233051 -
tgctggcccgcaactttggc

SEQ ID NO: 48031 - DNA, 20 bp, Artificial Sequence
  Synthetic oligonucleotide; AGG chr11 5233047 5233066 5233050 -
gctggcccgcaactttggca

SEQ ID NO: 48032 - DNA, 20 bp, Artificial Sequence
  Synthetic oligonucleotide; CAG chr11 5233027 5233046 5233030 -
aggaattcaccccacaaatg

SEQ ID NO: 48033 - DNA, 20 bp, Artificial Sequence
  Synthetic oligonucleotide; AGG chr11 5233026 5233045 5233029 -
ggaattcaccccacaaatgc

SEQ ID NO: 48034 - DNA, 20 bp, Artificial Sequence
  Synthetic oligonucleotide; CAG chr11 5233015 5233034 5233018 -
cacaaatgcaggctgcctat

SEQ ID NO: 48035 - DNA, 20 bp, Artificial Sequence
  Synthetic oligonucleotide; AAG chr11 5233012 5233031 5233015 -
aaatgcaggctgcctatcag

SEQ ID NO: 48036 - DNA, 20 bp, Artificial Sequence
  Synthetic oligonucleotide; AGG chr11 5233011 5233030 5233014 -
aatgcaggctgcctatcaga

SEQ ID NO: 48037 - DNA, 20 bp, Artificial Sequence
  Synthetic oligonucleotide; TGG chr11 5233008 5233027 5233011 -
gcaggctgcctatcagaagg

SEQ ID NO: 48038 - DNA, 20 bp, Artificial Sequence
  Synthetic oligonucleotide; TGG chr11 5233005 5233024 5233008 -
ggctgcctatcagaaggtgg

SEQ ID NO: 48039 - DNA, 20 bp, Artificial Sequence
  Synthetic oligonucleotide; TGG chr11 5233001 5233020 5233004 -
gcctatcagaaggtggtggc

SEQ ID NO: 48040 - DNA, 20 bp, Artificial Sequence
  Synthetic oligonucleotide; TGG chr11 5232996 5233015 5232999 -
tcagaaggtggtggctggtg

SEQ ID NO: 48041 - DNA, 20 bp, Artificial Sequence
  Synthetic oligonucleotide; TGG chr11 5232984 5233003 5232987 -
ggctggtgtggctaatgccc

SEQ ID NO: 48042 - DNA, 20 bp, Artificial Sequence
  Synthetic oligonucleotide; AAG chr11 5232976 5232995 5232979 -
tggctaatgccctggctcac

SEQ ID NO: 48043 - DNA, 20 bp, Artificial Sequence
  Synthetic oligonucleotide; GAG chr11 5232966 5232985 5232969 -
cctggctcacaagtaccatt

SEQ ID NO: 48044 - DNA, 20 bp, Artificial Sequence
  Synthetic oligonucleotide; TGG chr11 5232959 5232978 5232962 -
cacaagtaccattgagatcc

SEQ ID NO: 48045 - DNA, 20 bp, Artificial Sequence
  Synthetic oligonucleotide; AAG chr11 5232937 5232956 5232940 -
gactgtttcctgataaccat

SEQ ID NO: 48046 - DNA, 20 bp, Artificial Sequence
  Synthetic oligonucleotide; AAG chr11 5232934 5232953 5232937 -
tgtttcctgataaccataag

SEQ ID NO: 48047 - DNA, 20 bp, Artificial Sequence
  Synthetic oligonucleotide; TAG chr11 5232919 5232938 5232922 -
ataagaagaccctatttccc

SEQ ID NO: 48048 - DNA, 20 bp, Artificial Sequence
  Synthetic oligonucleotide; TGG chr11 5232899 5232918 5232902 -
tagattctattttctgaact

SEQ ID NO: 48049 - DNA, 20 bp, Artificial Sequence
  Synthetic oligonucleotide; GGG chr11 5232898 5232917 5232901 -
agattctattttctgaactt

SEQ ID NO: 48050 - DNA, 20 bp, Artificial Sequence
  Synthetic oligonucleotide; AAG chr11 5232878 5232897 5232881 -
gggaacacaatgcctacttc

SEQ ID NO: 48051 - DNA, 20 bp, Artificial Sequence
  Synthetic oligonucleotide; AGG chr11 5232877 5232896 5232880 -
ggaacacaatgcctacttca

SEQ ID NO: 48052 - DNA, 20 bp, Artificial Sequence
  Synthetic oligonucleotide; GGG chr11 5232876 5232895 5232879 -
gaacacaatgcctacttcaa

SEQ ID NO: 48053 - DNA, 20 bp, Artificial Sequence
  Synthetic oligonucleotide; TGG chr11 5232871 5232890 5232874 -
caatgcctacttcaagggta

SEQ ID NO: 48054 - DNA, 20 bp, Artificial Sequence
  Synthetic oligonucleotide; AAG chr11 5232855 5232874 5232858 -
ggtatggcttctgcctaata

SEQ ID NO: 48055 - DNA, 20 bp, Artificial Sequence
  Synthetic oligonucleotide; CAG chr11 5232846 5232865 5232849 -
tctgcctaataaagaatgtt

SEQ ID NO: 48056 - DNA, 20 bp, Artificial Sequence
  Synthetic oligonucleotide; CAG chr11 5232802 5232821 5232805 -
acttatttcatttttttgtc

SEQ ID NO: 48057 - DNA, 20 bp, Artificial Sequence
  Synthetic oligonucleotide; AGG chr11 5232801 5232820 5232804 -
cttatttcatttttttgtcc

SEQ ID NO: 48058 - DNA, 20 bp, Artificial Sequence
  Synthetic oligonucleotide; AAG chr11 5232793 5232812 5232796 -
atttttttgtccaggtgtgt

SEQ ID NO: 48059 - DNA, 20 bp, Artificial Sequence
  Synthetic oligonucleotide; AAG chr11 5232790 5232809 5232793 -
tttttgtccaggtgtgtaag

SEQ ID NO: 48060 - DNA, 20 bp, Artificial Sequence
  Synthetic oligonucleotide; AGG chr11 5232789 5232808 5232792 -
ttttgtccaggtgtgtaaga

SEQ ID NO: 48061 - DNA, 20 bp, Artificial Sequence
  Synthetic oligonucleotide; GAG chr11 5232781 5232800 5232784 -
aggtgtgtaagaaggttcct

SEQ ID NO: 48062 - DNA, 20 bp, Artificial Sequence
  Synthetic oligonucleotide; AGG chr11 5232780 5232799 5232783 -
ggtgtgtaagaaggttcctg

SEQ ID NO: 48063 - DNA, 20 bp, Artificial Sequence
  Synthetic oligonucleotide; CAG chr11 5232772 5232791 5232775 -
agaaggttcctgaggctcta

SEQ ID NO: 48064 - DNA, 20 bp, Artificial Sequence
  Synthetic oligonucleotide; TAG chr11 5232768 5232787 5232771 -
ggttcctgaggctctacaga

SEQ ID NO: 48065 - DNA, 20 bp, Artificial Sequence
  Synthetic oligonucleotide; AGG chr11 5232767 5232786 5232770 -
gttcctgaggctctacagat

SEQ ID NO: 48066 - DNA, 20 bp, Artificial Sequence
  Synthetic oligonucleotide; GGG chr11 5232766 5232785 5232769 -
ttcctgaggctctacagata

SEQ ID NO: 48067 - DNA, 20 bp, Artificial Sequence
  Synthetic oligonucleotide; GAG chr11 5232764 5232783 5232767 -
cctgaggctctacagatagg

SEQ ID NO: 48068 - DNA, 20 bp, Artificial Sequence
  Synthetic oligonucleotide; AAG chr11 5232744 5232763 5232747 -
gagcacttgtttattttaca

SEQ ID NO: 48069 - DNA, 20 bp, Artificial Sequence
  Synthetic oligonucleotide; GAG chr11 5232742 5232761 5232745 -
gcacttgtttattttacaaa

SEQ ID NO: 48070 - DNA, 20 bp, Artificial Sequence
  Synthetic oligonucleotide; TGG chr11 5232735 5232754 5232738 -
tttattttacaaagagtaca

SEQ ID NO: 48071 - DNA, 20 bp, Artificial Sequence
  Synthetic oligonucleotide; GGG chr11 5232734 5232753 5232737 -
ttattttacaaagagtacat

SEQ ID NO: 48072 - DNA, 20 bp, Artificial Sequence
  Synthetic oligonucleotide; AAG chr11 5232729 5232748 5232732 -
ttacaaagagtacatgggaa

SEQ ID NO: 48073 - DNA, 20 bp, Artificial Sequence
  Synthetic oligonucleotide; GAG chr11 5232727 5232746 5232730 -
acaaagagtacatgggaaaa

SEQ ID NO: 48074 - DNA, 20 bp, Artificial Sequence
  Synthetic oligonucleotide; AAG chr11 5232722 5232741 5232725 -
gagtacatgggaaaagagaa

SEQ ID NO: 48075 - DNA, 20 bp, Artificial Sequence
  Synthetic oligonucleotide; AAG chr11 5232718 5232737 5232721 -
acatgggaaaagagaaaagc

SEQ ID NO: 48076 - DNA, 20 bp, Artificial Sequence
  Synthetic oligonucleotide; AGG chr11 5232717 5232736 5232720 -
catgggaaaagagaaaagca

SEQ ID NO: 48077 - DNA, 20 bp, Artificial Sequence
  Synthetic oligonucleotide; GGG chr11 5232716 5232735 5232719 -
atgggaaaagagaaaagcaa

SEQ ID NO: 48078 - DNA, 20 bp, Artificial Sequence
  Synthetic oligonucleotide; AAG chr11 5232705 5232724 5232708 -
gaaaagcaagggaaccgtac

SEQ ID NO: 48079 - DNA, 20 bp, Artificial Sequence
  Synthetic oligonucleotide; AGG chr11 5232704 5232723 5232707 -
aaaagcaagggaaccgtaca

SEQ ID NO: 48080 - DNA, 20 bp, Artificial Sequence
  Synthetic oligonucleotide; TGG chr11 5232695 5232714 5232698 -
ggaaccgtacaaggcattaa

SEQ ID NO: 48081 - DNA, 20 bp, Artificial Sequence
  Synthetic oligonucleotide; GGG chr11 5232694 5232713 5232697 -
gaaccgtacaaggcattaat

SEQ ID NO: 48082 - DNA, 20 bp, Artificial Sequence
  Synthetic oligonucleotide; AAG chr11 5232674 5232693 5232677 -
gggtgacacttctacctcca

SEQ ID NO: 48083 - DNA, 20 bp, Artificial Sequence
  Synthetic oligonucleotide; GAG chr11 5232672 5232691 5232675 -
gtgacacttctacctccaaa

SEQ ID NO: 48084 - DNA, 20 bp, Artificial Sequence
  Synthetic oligonucleotide; CAG chr11 5232669 5232688 5232672 -
acacttctacctccaaagag

SEQ ID NO: 48085 - DNA, 20 bp, Artificial Sequence
  Synthetic oligonucleotide; AAG chr11 5232658 5232677 5232661 -
tccaaagagcagaaattatc

SEQ ID NO: 48086 - DNA, 20 bp, Artificial Sequence
  Synthetic oligonucleotide; AAG chr11 5232642 5232661 5232645 -
tatcaagaactcttgataca

SEQ ID NO: 48087 - DNA, 20 bp, Artificial Sequence
  Synthetic oligonucleotide; TGG chr11 5232632 5232651 5232635 -
tcttgatacaaagataatac

SEQ ID NO: 48088 - DNA, 20 bp, Artificial Sequence
  Synthetic oligonucleotide; CAG chr11 5232624 5232643 5232627 -
caaagataatactggcactg

SEQ ID NO: 48089 - DNA, 20 bp, Artificial Sequence
  Synthetic oligonucleotide; GAG chr11 5232622 5232641 5232625 -
aagataatactggcactgca

SEQ ID NO: 48090 - DNA, 20 bp, Artificial Sequence
  Synthetic oligonucleotide; AGG chr11 5232621 5232640 5232624 -
agataatactggcactgcag

SEQ ID NO: 48091 - DNA, 20 bp, Artificial Sequence
  Synthetic oligonucleotide; TAG chr11 5232615 5232634 5232618 -
tactggcactgcagaggttc

SEQ ID NO: 48092 - DNA, 20 bp, Artificial Sequence
  Synthetic oligonucleotide; AGG chr11 5232614 5232633 5232617 -
actggcactgcagaggttct

SEQ ID NO: 48093 - DNA, 20 bp, Artificial Sequence
  Synthetic oligonucleotide; GGG chr11 5232613 5232632 5232616 -
ctggcactgcagaggttcta

SEQ ID NO: 48094 - DNA, 20 bp, Artificial Sequence
  Synthetic oligonucleotide; AAG chr11 5232610 5232629 5232613 -
gcactgcagaggttctaggg

SEQ ID NO: 48095 - DNA, 20 bp, Artificial Sequence
  Synthetic oligonucleotide; AAG chr11 5232596 5232615 5232599 -
ctagggaagacctcaaccct

SEQ ID NO: 48096 - DNA, 20 bp, Artificial Sequence
  Synthetic oligonucleotide; TAG chr11 5232590 5232609 5232593 -
aagacctcaaccctaagaca

SEQ ID NO: 48097 - DNA, 20 bp, Artificial Sequence
  Synthetic oligonucleotide; AAG chr11 5232583 5232602 5232586 -
caaccctaagacatagcctc

SEQ ID NO: 48098 - DNA, 20 bp, Artificial Sequence
  Synthetic oligonucleotide; AGG chr11 5232582 5232601 5232585 -
aaccctaagacatagcctca

SEQ ID NO: 48099 - DNA, 20 bp, Artificial Sequence
  Synthetic oligonucleotide; GGG chr11 5232581 5232600 5232584 -
accctaagacatagcctcaa

SEQ ID NO: 48100 - DNA, 20 bp, Artificial Sequence
  Synthetic oligonucleotide; GAG chr11 5232548 5232567 5232551 -
attaaactccaacaattact

SEQ ID NO: 48101 - DNA, 20 bp, Artificial Sequence
  Synthetic oligonucleotide; AAG chr11 5232526 5232545 5232529 -
gaaaataatgtgctcaatta

SEQ ID NO: 48102 - DNA, 20 bp, Artificial Sequence
  Synthetic oligonucleotide; AGG chr11 5232525 5232544 5232528 -
aaaataatgtgctcaattaa

SEQ ID NO: 48103 - DNA, 20 bp, Artificial Sequence
  Synthetic oligonucleotide; AAG chr11 5232508 5232527 5232511 -
taaaggcataatgattactc

SEQ ID NO: 48104 - DNA, 20 bp, Artificial Sequence
  Synthetic oligonucleotide; TAG chr11 5232459 5232478 5232462 -
cttcctttgcctgcacattg

SEQ ID NO: 48105 - DNA, 20 bp, Artificial Sequence
  Synthetic oligonucleotide; AAG chr11 5232435 5232454 5232438 -
ccataatactataccccatc

SEQ ID NO: 48106 - DNA, 20 bp, Artificial Sequence
  Synthetic oligonucleotide; AAG chr11 5232420 5232439 5232423 -
ccatcaagtgttcctgctcc

SEQ ID NO: 48107 - DNA, 20 bp, Artificial Sequence
  Synthetic oligonucleotide; TAG chr11 5232414 5232433 5232417 -
agtgttcctgctccaagaaa

SEQ ID NO: 48108 - DNA, 20 bp, Artificial Sequence
  Synthetic oligonucleotide; CAG chr11 5232391 5232410 5232394 -
cttcctcctcttacttgccc

SEQ ID NO: 48109 - DNA, 20 bp, Artificial Sequence
  Synthetic oligonucleotide; AAG chr11 5232376 5232395 5232379 -
tgccccagaacatctctgta

SEQ ID NO: 48110 - DNA, 20 bp, Artificial Sequence
  Synthetic oligonucleotide; CAG chr11 5232348 5232367 5232351 -
cctcttatcttcccatattt

SEQ ID NO: 48111 - DNA, 20 bp, Artificial Sequence
  Synthetic oligonucleotide; AAG chr11 5232343 5232362 5232346 -
tatcttcccatatttcagtc

SEQ ID NO: 48112 - DNA, 20 bp, Artificial Sequence
  Synthetic oligonucleotide; CAG chr11 5232301 5232320 5232304 -
cttgtgacctctcttgaccc

SEQ ID NO: 48113 - DNA, 20 bp, Artificial Sequence
  Synthetic oligonucleotide; AAG chr11 5232179 5232198 5232182 -
acacacactccgtgctttat

SEQ ID NO: 48114 - DNA, 20 bp, Artificial Sequence
  Synthetic oligonucleotide; TGG chr11 5232116 5232135 5232119 -
cctcatattaaattcatcaa

SEQ ID NO: 48115 - DNA, 20 bp, Artificial Sequence
  Synthetic oligonucleotide; GGG chr11 5232115 5232134 5232118 -
ctcatattaaattcatcaat

SEQ ID NO: 48116 - DNA, 20 bp, Artificial Sequence
  Synthetic oligonucleotide; CAG chr11 5232112 5232131 5232115 -
atattaaattcatcaatggg

SEQ ID NO: 48117 - DNA, 20 bp, Artificial Sequence
  Synthetic oligonucleotide; AAG chr11 5232108 5232127 5232111 -
taaattcatcaatgggcaga

SEQ ID NO: 48118 - DNA, 20 bp, Artificial Sequence
  Synthetic oligonucleotide; AAG chr11 5232092 5232111 5232095 -
cagaaagaaaatatttattc

SEQ ID NO: 48119 - DNA, 20 bp, Artificial Sequence
  Synthetic oligonucleotide; CAG chr11 5232085 5232104 5232088 -
aaaatatttattcaagaaaa

SEQ ID NO: 48120 - DNA, 20 bp, Artificial Sequence
  Synthetic oligonucleotide; GAG chr11 5232065 5232084 5232068 -
cagtgaatgaatgaacgaat

SEQ ID NO: 48121 - DNA, 20 bp, Artificial Sequence
  Synthetic oligonucleotide; GAG chr11 5232057 5232076 5232060 -
gaatgaacgaatgagtaaat

SEQ ID NO: 48122 - DNA, 20 bp, Artificial Sequence
  Synthetic oligonucleotide; AAG chr11 5232048 5232067 5232051 -
aatgagtaaatgagtaaatg

SEQ ID NO: 48123 - DNA, 20 bp, Artificial Sequence
  Synthetic oligonucleotide; AGG chr11 5232047 5232066 5232050 -
atgagtaaatgagtaaatga

SEQ ID NO: 48124 - DNA, 20 bp, Artificial Sequence
  Synthetic oligonucleotide; TAG chr11 5232026 5232045 5232029 -
ggaatgattattccttgctt

SEQ ID NO: 48125 - DNA, 20 bp, Artificial Sequence
  Synthetic oligonucleotide; TGG chr11 5232017 5232036 5232020 -
attccttgctttagaacttc

SEQ ID NO: 48126 - DNA, 20 bp, Artificial Sequence
  Synthetic oligonucleotide; TAG chr11 5232011 5232030 5232014 -
tgctttagaacttctggaat

SEQ ID NO: 48127 - DNA, 20 bp, Artificial Sequence
  Synthetic oligonucleotide; GAG chr11 5232009 5232028 5232012 -
ctttagaacttctggaatta

SEQ ID NO: 48128 - DNA, 20 bp, Artificial Sequence
  Synthetic oligonucleotide; AGG chr11 5232008 5232027 5232011 -
tttagaacttctggaattag

SEQ ID NO: 48129 - DNA, 20 bp, Artificial Sequence
  Synthetic oligonucleotide; CAG chr11 5231982 5232001 5231985 -
atattaataataccatcgca

SEQ ID NO: 48130 - DNA, 20 bp, Artificial Sequence
  Synthetic oligonucleotide; AAG chr11 5231948 5231967 5231951 -
tgttaatgctacaacataca

SEQ ID NO: 48131 - DNA, 20 bp, Artificial Sequence
  Synthetic oligonucleotide; GAG chr11 5231946 5231965 5231949 -
ttaatgctacaacatacaaa

SEQ ID NO: 48132 - DNA, 20 bp, Artificial Sequence
  Synthetic oligonucleotide; AGG chr11 5231945 5231964 5231948 -
taatgctacaacatacaaag

SEQ ID NO: 48133 - DNA, 20 bp, Artificial Sequence
  Synthetic oligonucleotide; AAG chr11 5231942 5231961 5231945 -
tgctacaacatacaaagagg

SEQ ID NO: 48134 - DNA, 20 bp, Artificial Sequence
  Synthetic oligonucleotide; CAG chr11 5231935 5231954 5231938 -
acatacaaagaggaagcatg

SEQ ID NO: 48135 - DNA, 20 bp, Artificial Sequence
  Synthetic oligonucleotide; CAG chr11 5231920 5231939 5231923 -
gcatgcagtaaacaaccgaa

SEQ ID NO: 48136 - DNA, 20 bp, Artificial Sequence
  Synthetic oligonucleotide; TAG chr11 5231899 5231918 5231902 -
agttatttcctttctgatca

SEQ ID NO: 48137 - DNA, 20 bp, Artificial Sequence
  Synthetic oligonucleotide; AGG chr11 5231898 5231917 5231901 -
gttatttcctttctgatcat

SEQ ID NO: 48138 - DNA, 20 bp, Artificial Sequence
  Synthetic oligonucleotide; GAG chr11 5231896 5231915 5231899 -
tatttcctttctgatcatag

SEQ ID NO: 48139 - DNA, 20 bp, Artificial Sequence
  Synthetic oligonucleotide; GAG chr11 5231877 5231896 5231880 -
ggagtaatatttttttcctt

SEQ ID NO: 48140 - DNA, 20 bp, Artificial Sequence
  Synthetic oligonucleotide; TAG chr11 5231860 5231879 5231863 -
cttgagcaccatttttgcca

SEQ ID NO: 48141 - DNA, 20 bp, Artificial Sequence
  Synthetic oligonucleotide; AGG chr11 5231859 5231878 5231862 -
ttgagcaccatttttgccat

SEQ ID NO: 48142 - DNA, 20 bp, Artificial Sequence
  Synthetic oligonucleotide; TAG chr11 5231850 5231869 5231853 -
atttttgccataggtaaaat

SEQ ID NO: 48143 - DNA, 20 bp, Artificial Sequence
  Synthetic oligonucleotide; AAG chr11 5231847 5231866 5231850 -
tttgccataggtaaaattag

SEQ ID NO: 48144 - DNA, 20 bp, Artificial Sequence
  Synthetic oligonucleotide; AGG chr11 5231846 5231865 5231849 -
ttgccataggtaaaattaga

SEQ ID NO: 48145 - DNA, 20 bp, Artificial Sequence
  Synthetic oligonucleotide; TAG chr11 5231838 5231857 5231841 -
ggtaaaattagaaggatttt

SEQ ID NO: 48146 - DNA, 20 bp, Artificial Sequence
  Synthetic oligonucleotide; CAG chr11 5231827 5231846 5231830 -
aaggatttttagaactttct

SEQ ID NO: 48147 - DNA, 20 bp, Artificial Sequence
  Synthetic oligonucleotide; CAG chr11 5231755 5231774 5231758 -
aacttacttgaatacctaaa

SEQ ID NO: 48148 - DNA, 20 bp, Artificial Sequence
  Synthetic oligonucleotide; AAG chr11 5231728 5231747 5231731 -
tgttgtttccttgtgtttga

SEQ ID NO: 48149 - DNA, 20 bp, Artificial Sequence
  Synthetic oligonucleotide; CAG chr11 5231717 5231736 5231720 -
tgtgtttgaaagtgctttca

SEQ ID NO: 48150 - DNA, 20 bp, Artificial Sequence
  Synthetic oligonucleotide; CAG chr11 5231696 5231715 5231699 -
agtaactctgtctgtactgc

SEQ ID NO: 48151 - DNA, 20 bp, Artificial Sequence
  Synthetic oligonucleotide; TAG chr11 5231673 5231692 5231676 -
aatatactgacaatgtgtta

SEQ ID NO: 48152 - DNA, 20 bp, Artificial Sequence
  Synthetic oligonucleotide; TGG chr11 5231637 5231656 5231640 -
tcacaacattttgaattgac

SEQ ID NO: 48153 - DNA, 20 bp, Artificial Sequence
  Synthetic oligonucleotide; CAG chr11 5231634 5231653 5231637 -
caacattttgaattgactgg

SEQ ID NO: 48154 - DNA, 20 bp, Artificial Sequence
  Synthetic oligonucleotide; CAG chr11 5231631 5231650 5231634 -
cattttgaattgactggcag

SEQ ID NO: 48155 - DNA, 20 bp, Artificial Sequence
  Synthetic oligonucleotide; AAG chr11 5231628 5231647 5231631 -
tttgaattgactggcagcag

SEQ ID NO: 48156 - DNA, 20 bp, Artificial Sequence
  Synthetic oligonucleotide; AAG chr11 5231599 5231618 5231602 -
tatatccatgtgttttcctt

SEQ ID NO: 48157 - DNA, 20 bp, Artificial Sequence
  Synthetic oligonucleotide; TAG chr11 5231586 5231605 5231589 -
tttccttaagtcattataca

SEQ ID NO: 48158 - DNA, 20 bp, Artificial Sequence
  Synthetic oligonucleotide; TAG chr11 5231583 5231602 5231586 -
ccttaagtcattatacatag

SEQ ID NO: 48159 - DNA, 20 bp, Artificial Sequence
  Synthetic oligonucleotide; AGG chr11 5231582 5231601 5231585 -
cttaagtcattatacatagt

SEQ ID NO: 48160 - DNA, 20 bp, Artificial Sequence
  Synthetic oligonucleotide; GAG chr11 5231575 5231594 5231578 -
cattatacatagtaggcact

SEQ ID NO: 48161 - DNA, 20 bp, Artificial Sequence
  Synthetic oligonucleotide; AAG chr11 5231554 5231573 5231557 -
agaactctttatatctgaat

SEQ ID NO: 48162 - DNA, 20 bp, Artificial Sequence
  Synthetic oligonucleotide; TAG chr11 5231546 5231565 5231549 -
ttatatctgaataagatatt

SEQ ID NO: 48163 - DNA, 20 bp, Artificial Sequence
  Synthetic oligonucleotide; AGG chr11 5231545 5231564 5231548 -
tatatctgaataagatattt

SEQ ID NO: 48164 - DNA, 20 bp, Artificial Sequence
  Synthetic oligonucleotide; TGG chr11 5231536 5231555 5231539 -
ataagatatttaggaaccac

SEQ ID NO: 48165 - DNA, 20 bp, Artificial Sequence
  Synthetic oligonucleotide; CAG chr11 5231524 5231543 5231527 -
ggaaccactggtttacatat

SEQ ID NO: 48166 - DNA, 20 bp, Artificial Sequence
  Synthetic oligonucleotide; AAG chr11 5231521 5231540 5231524 -
accactggtttacatatcag

SEQ ID NO: 48167 - DNA, 20 bp, Artificial Sequence
  Synthetic oligonucleotide; CAG chr11 5231518 5231537 5231521 -
actggtttacatatcagaag

SEQ ID NO: 48168 - DNA, 20 bp, Artificial Sequence
  Synthetic oligonucleotide; GAG chr11 5231516 5231535 5231519 -
tggtttacatatcagaagca

SEQ ID NO: 48169 - DNA, 20 bp, Artificial Sequence
  Synthetic oligonucleotide; CAG chr11 5231508 5231527 5231511 -
atatcagaagcagagctact

SEQ ID NO: 48170 - DNA, 20 bp, Artificial Sequence
  Synthetic oligonucleotide; AGG chr11 5231507 5231526 5231510 -
tatcagaagcagagctactc

SEQ ID NO: 48171 - DNA, 20 bp, Artificial Sequence
  Synthetic oligonucleotide; GGG chr11 5231506 5231525 5231509 -
atcagaagcagagctactca

SEQ ID NO: 48172 - DNA, 20 bp, Artificial Sequence
  Synthetic oligonucleotide; TGG chr11 5231498 5231517 5231501 -
cagagctactcagggcattt

SEQ ID NO: 48173 - DNA, 20 bp, Artificial Sequence
  Synthetic oligonucleotide; GGG chr11 5231497 5231516 5231500 -
agagctactcagggcatttt

SEQ ID NO: 48174 - DNA, 20 bp, Artificial Sequence
  Synthetic oligonucleotide; GGG chr11 5231496 5231515 5231499 -
gagctactcagggcattttg

SEQ ID NO: 48175 - DNA, 20 bp, Artificial Sequence
  Synthetic oligonucleotide; AAG chr11 5231493 5231512 5231496 -
ctactcagggcattttgggg

SEQ ID NO: 48176 - DNA, 20 bp, Artificial Sequence
  Synthetic oligonucleotide; GAG chr11 5231473 5231492 5231476 -
aagatcactttcacattcct

SEQ ID NO: 48177 - DNA, 20 bp, Artificial Sequence
  Synthetic oligonucleotide; TAG chr11 5231468 5231487 5231471 -
cactttcacattcctgagca

SEQ ID NO: 48178 - DNA, 20 bp, Artificial Sequence
  Synthetic oligonucleotide; AGG chr11 5231467 5231486 5231470 -
actttcacattcctgagcat

SEQ ID NO: 48179 - DNA, 20 bp, Artificial Sequence
  Synthetic oligonucleotide; GGG chr11 5231466 5231485 5231469 -
ctttcacattcctgagcata

SEQ ID NO: 48180 - DNA, 20 bp, Artificial Sequence
  Synthetic oligonucleotide; AAG chr11 5231463 5231482 5231466 -
tcacattcctgagcataggg

SEQ ID NO: 48181 - DNA, 20 bp, Artificial Sequence
  Synthetic oligonucleotide; AAG chr11 5231453 5231472 5231456 -
gagcatagggaagttctcat

SEQ ID NO: 48182 - DNA, 20 bp, Artificial Sequence
  Synthetic oligonucleotide; GAG chr11 5231451 5231470 5231454 -
gcatagggaagttctcataa

SEQ ID NO: 48183 - DNA, 20 bp, Artificial Sequence
  Synthetic oligonucleotide; AAG chr11 5231447 5231466 5231450 -
agggaagttctcataagagt

SEQ ID NO: 48184 - DNA, 20 bp, Artificial Sequence
  Synthetic oligonucleotide; AAG chr11 5231437 5231456 5231440 -
tcataagagtaagatattaa

SEQ ID NO: 48185 - DNA, 20 bp, Artificial Sequence
  Synthetic oligonucleotide; AGG chr11 5231436 5231455 5231439 -
cataagagtaagatattaaa

SEQ ID NO: 48186 - DNA, 20 bp, Artificial Sequence
  Synthetic oligonucleotide; GAG chr11 5231434 5231453 5231437 -
taagagtaagatattaaaag

SEQ ID NO: 48187 - DNA, 20 bp, Artificial Sequence
  Synthetic oligonucleotide; TGG chr11 5231422 5231441 5231425 -
attaaaaggagatacttgtg

SEQ ID NO: 48188 - DNA, 20 bp, Artificial Sequence
  Synthetic oligonucleotide; AAG chr11 5231412 5231431 5231415 -
gatacttgtgtggtattcga

SEQ ID NO: 48189 - DNA, 20 bp, Artificial Sequence
  Synthetic oligonucleotide; CAG chr11 5231408 5231427 5231411 -
cttgtgtggtattcgaaaga

SEQ ID NO: 48190 - DNA, 20 bp, Artificial Sequence
  Synthetic oligonucleotide; AAG chr11 5231404 5231423 5231407 -
tgtggtattcgaaagacagt

SEQ ID NO: 48191 - DNA, 20 bp, Artificial Sequence
  Synthetic oligonucleotide; GAG chr11 5231402 5231421 5231405 -
tggtattcgaaagacagtaa

SEQ ID NO: 48192 - DNA, 20 bp, Artificial Sequence
  Synthetic oligonucleotide; GAG chr11 5231400 5231419 5231403 -
gtattcgaaagacagtaaga

SEQ ID NO: 48193 - DNA, 20 bp, Artificial Sequence
  Synthetic oligonucleotide; TAG chr11 5231393 5231412 5231396 -
aaagacagtaagagagattg

SEQ ID NO: 48194 - DNA, 20 bp, Artificial Sequence
  Synthetic oligonucleotide; TAG chr11 5231375 5231394 5231378 -
tgtagaccttatgatcttga

SEQ ID NO: 48195 - DNA, 20 bp, Artificial Sequence
  Synthetic oligonucleotide; AGG chr11 5231374 5231393 5231377 -
gtagaccttatgatcttgat

SEQ ID NO: 48196 - DNA, 20 bp, Artificial Sequence
  Synthetic oligonucleotide; GGG chr11 5231373 5231392 5231376 -
tagaccttatgatcttgata

SEQ ID NO: 48197 - DNA, 20 bp, Artificial Sequence
  Synthetic oligonucleotide; AAG chr11 5231344 5231363 5231347 -
aactacattcctttctccaa

SEQ ID NO: 48198 - DNA, 20 bp, Artificial Sequence
  Synthetic oligonucleotide; AAG chr11 5231332 5231351 5231335 -
ttctccaaaagtcaaaaaaa

SEQ ID NO: 48199 - DNA, 20 bp, Artificial Sequence
  Synthetic oligonucleotide; GAG chr11 5231330 5231349 5231333 -
ctccaaaagtcaaaaaaaaa

SEQ ID NO: 48200 - DNA, 20 bp, Artificial Sequence
  Synthetic oligonucleotide; TAG chr11 5231321 5231340 5231324 -
tcaaaaaaaaagagcaaata

SEQ ID NO: 48201 - DNA, 20 bp, Artificial Sequence
  Synthetic oligonucleotide; TAG chr11 5231290 5231309 5231293 -
accttctattcctacaccat

SEQ ID NO: 48202 - DNA, 20 bp, Artificial Sequence
  Synthetic oligonucleotide; AAG chr11 5231287 5231306 5231290 -
ttctattcctacaccattag

SEQ ID NO: 48203 - DNA, 20 bp, Artificial Sequence
  Synthetic oligonucleotide; TAG chr11 5231284 5231303 5231287 -
tattcctacaccattagaag

SEQ ID NO: 48204 - DNA, 20 bp, Artificial Sequence
  Synthetic oligonucleotide; CAG chr11 5231280 5231299 5231283 -
cctacaccattagaagtagt

SEQ ID NO: 48205 - DNA, 20 bp, Artificial Sequence
  Synthetic oligonucleotide; GAG chr11 5231276 5231295 5231279 -
caccattagaagtagtcagt

SEQ ID NO: 48206 - DNA, 20 bp, Artificial Sequence
  Synthetic oligonucleotide; TAG chr11 5231271 5231290 5231274 -
ttagaagtagtcagtgagtc

SEQ ID NO: 48207 - DNA, 20 bp, Artificial Sequence
  Synthetic oligonucleotide; AGG chr11 5231270 5231289 5231273 -
tagaagtagtcagtgagtct

SEQ ID NO: 48208 - DNA, 20 bp, Artificial Sequence
  Synthetic oligonucleotide; AAG chr11 5231266 5231285 5231269 -
agtagtcagtgagtctaggc

SEQ ID NO: 48209 - DNA, 20 bp, Artificial Sequence
  Synthetic oligonucleotide; TGG chr11 5231259 5231278 5231262 -
agtgagtctaggcaagatgt

SEQ ID NO: 48210 - DNA, 20 bp, Artificial Sequence
  Synthetic oligonucleotide; CAG chr11 5231238 5231257 5231241 -
ggccctaaaaatccaaatac

SEQ ID NO: 48211 - DNA, 20 bp, Artificial Sequence
  Synthetic oligonucleotide; GAG chr11 5231236 5231255 5231239 -
ccctaaaaatccaaatacca

SEQ ID NO: 48212 - DNA, 20 bp, Artificial Sequence
  Synthetic oligonucleotide; GAG chr11 5231226 5231245 5231229 -
ccaaataccagagaattcat

SEQ ID NO: 48213 - DNA, 20 bp, Artificial Sequence
  Synthetic oligonucleotide; TGG chr11 5231214 5231233 5231217 -
gaattcatgagaacatcacc

SEQ ID NO: 48214 - DNA, 20 bp, Artificial Sequence
  Synthetic oligonucleotide; TGG chr11 5231210 5231229 5231213 -
tcatgagaacatcacctgga

SEQ ID NO: 48215 - DNA, 20 bp, Artificial Sequence
  Synthetic oligonucleotide; GGG chr11 5231209 5231228 5231212 -
catgagaacatcacctggat

SEQ ID NO: 48216 - DNA, 20 bp, Artificial Sequence
  Synthetic oligonucleotide; GAG chr11 5231197 5231216 5231200 -
acctggatgggacatgtgcc

SEQ ID NO: 48217 - DNA, 20 bp, Artificial Sequence
  Synthetic oligonucleotide; TAG chr11 5231174 5231193 5231177 -
cacacacaattactatatgc

SEQ ID NO: 48218 - DNA, 20 bp, Artificial Sequence
  Synthetic oligonucleotide; AGG chr11 5231173 5231192 5231176 -
acacacaattactatatgct

SEQ ID NO: 48219 - DNA, 20 bp, Artificial Sequence
  Synthetic oligonucleotide; AAG chr11 5231151 5231170 5231154 -
gcattgctatcttcatattg

SEQ ID NO: 48220 - DNA, 20 bp, Artificial Sequence
  Synthetic oligonucleotide; GAG chr11 5231146 5231165 5231149 -
gctatcttcatattgaagat

SEQ ID NO: 48221 - DNA, 20 bp, Artificial Sequence
  Synthetic oligonucleotide; AGG chr11 5231145 5231164 5231148 -
ctatcttcatattgaagatg

SEQ ID NO: 48222 - DNA, 20 bp, Artificial Sequence
  Synthetic oligonucleotide; GAG chr11 5231143 5231162 5231146 -
atcttcatattgaagatgag

SEQ ID NO: 48223 - DNA, 20 bp, Artificial Sequence
  Synthetic oligonucleotide; AGG chr11 5231142 5231161 5231145 -
tcttcatattgaagatgagg

SEQ ID NO: 48224 - DNA, 20 bp, Artificial Sequence
  Synthetic oligonucleotide; AAG chr11 5231137 5231156 5231140 -
atattgaagatgaggaggtc

SEQ ID NO: 48225 - DNA, 20 bp, Artificial Sequence
  Synthetic oligonucleotide; GAG chr11 5231135 5231154 5231138 -
attgaagatgaggaggtcaa

SEQ ID NO: 48226 - DNA, 20 bp, Artificial Sequence
  Synthetic oligonucleotide; AAG chr11 5231125 5231144 5231128 -
aggaggtcaagagatgaaaa

SEQ ID NO: 48227 - DNA, 20 bp, Artificial Sequence
  Synthetic oligonucleotide; TGG chr11 5231119 5231138 5231122 -
tcaagagatgaaaaaagact

SEQ ID NO: 48228 - DNA, 20 bp, Artificial Sequence
  Synthetic oligonucleotide; TAG chr11 5231087 5231106 5231090 -
gttatattaaaattatttgt

SEQ ID NO: 48229 - DNA, 20 bp, Artificial Sequence
  Synthetic oligonucleotide; GAG chr11 5231085 5231104 5231088 -
tatattaaaattatttgtta

SEQ ID NO: 48230 - DNA, 20 bp, Artificial Sequence
  Synthetic oligonucleotide; TAG chr11 5231082 5231101 5231085 -
attaaaattatttgttagag

SEQ ID NO: 48231 - DNA, 20 bp, Artificial Sequence
  Synthetic oligonucleotide; GAG chr11 5231080 5231099 5231083 -
taaaattatttgttagagta

SEQ ID NO: 48232 - DNA, 20 bp, Artificial Sequence
  Synthetic oligonucleotide; AAG chr11 5231070 5231089 5231073 -
tgttagagtagagcttttgt

SEQ ID NO: 48233 - DNA, 20 bp, Artificial Sequence
  Synthetic oligonucleotide; GAG chr11 5231068 5231087 5231071 -
ttagagtagagcttttgtaa

SEQ ID NO: 48234 - DNA, 20 bp, Artificial Sequence
  Synthetic oligonucleotide; TAG chr11 5231063 5231082 5231066 -
gtagagcttttgtaagagtc

SEQ ID NO: 48235 - DNA, 20 bp, Artificial Sequence
  Synthetic oligonucleotide; AGG chr11 5231062 5231081 5231065 -
tagagcttttgtaagagtct

SEQ ID NO: 48236 - DNA, 20 bp, Artificial Sequence
  Synthetic oligonucleotide; GAG chr11 5231060 5231079 5231063 -
gagcttttgtaagagtctag

SEQ ID NO: 48237 - DNA, 20 bp, Artificial Sequence
  Synthetic oligonucleotide; TGG chr11 5231055 5231074 5231058 -
tttgtaagagtctaggagtg

SEQ ID NO: 48238 - DNA, 20 bp, Artificial Sequence
  Synthetic oligonucleotide; GGG chr11 5231054 5231073 5231057 -
ttgtaagagtctaggagtgt

SEQ ID NO: 48239 - DNA, 20 bp, Artificial Sequence
  Synthetic oligonucleotide; GAG chr11 5231052 5231071 5231055 -
gtaagagtctaggagtgtgg

SEQ ID NO: 48240 - DNA, 20 bp, Artificial Sequence
  Synthetic oligonucleotide; TGG chr11 5231032 5231051 5231035 -
gagctaaatgatgatacaca

SEQ ID NO: 48241 - DNA, 20 bp, Artificial Sequence
  Synthetic oligonucleotide; TAG chr11 5231019 5231038 5231022 -
atacacatggacacaaaaaa

SEQ ID NO: 48242 - DNA, 20 bp, Artificial Sequence
  Synthetic oligonucleotide; CAG chr11 5231011 5231030 5231014 -
ggacacaaaaaatagatcaa

SEQ ID NO: 48243 - DNA, 20 bp, Artificial Sequence
  Synthetic oligonucleotide; CAG chr11 5231003 5231022 5231006 -
aaaatagatcaacagacacc

SEQ ID NO: 48244 - DNA, 20 bp, Artificial Sequence
  Synthetic oligonucleotide; AGG chr11 5231002 5231021 5231005 -
aaatagatcaacagacaccc

SEQ ID NO: 48245 - DNA, 20 bp, Artificial Sequence
  Synthetic oligonucleotide; GAG chr11 5230992 5231011 5230995 -
acagacacccaggcctactt

SEQ ID NO: 48246 - DNA, 20 bp, Artificial Sequence
  Synthetic oligonucleotide; AGG chr11 5230991 5231010 5230994 -
cagacacccaggcctacttg

SEQ ID NO: 48247 - DNA, 20 bp, Artificial Sequence
  Synthetic oligonucleotide; GGG chr11 5230990 5231009 5230993 -
agacacccaggcctacttga

SEQ ID NO: 48248 - DNA, 20 bp, Artificial Sequence
  Synthetic oligonucleotide; GAG chr11 5230985 5231004 5230988 -
cccaggcctacttgagggtt

SEQ ID NO: 48249 - DNA, 20 bp, Artificial Sequence
  Synthetic oligonucleotide; AGG chr11 5230984 5231003 5230987 -
ccaggcctacttgagggttg

SEQ ID NO: 48250 - DNA, 20 bp, Artificial Sequence
  Synthetic oligonucleotide; GGG chr11 5230983 5231002 5230986 -
caggcctacttgagggttga

SEQ ID NO: 48251 - DNA, 20 bp, Artificial Sequence
  Synthetic oligonucleotide; TGG chr11 5230980 5230999 5230983 -
gcctacttgagggttgaggg

SEQ ID NO: 48252 - DNA, 20 bp, Artificial Sequence
  Synthetic oligonucleotide; GGG chr11 5230979 5230998 5230982 -
cctacttgagggttgagggt

SEQ ID NO: 48253 - DNA, 20 bp, Artificial Sequence
  Synthetic oligonucleotide; AAG chr11 5230976 5230995 5230979 -
acttgagggttgagggtggg

SEQ ID NO: 48254 - DNA, 20 bp, Artificial Sequence
  Synthetic oligonucleotide; GAG chr11 5230974 5230993 5230977 -
ttgagggttgagggtgggaa

SEQ ID NO: 48255 - DNA, 20 bp, Artificial Sequence
  Synthetic oligonucleotide; AGG chr11 5230973 5230992 5230976 -
tgagggttgagggtgggaag

SEQ ID NO: 48256 - DNA, 20 bp, Artificial Sequence
  Synthetic oligonucleotide; GGG chr11 5230972 5230991 5230975 -
gagggttgagggtgggaaga

SEQ ID NO: 48257 - DNA, 20 bp, Artificial Sequence
  Synthetic oligonucleotide; GAG chr11 5230970 5230989 5230973 -
gggttgagggtgggaagagg

SEQ ID NO: 48258 - DNA, 20 bp, Artificial Sequence
  Synthetic oligonucleotide; AAG chr11 5230958 5230977 5230961 -
ggaagagggagacgatgaaa

SEQ ID NO: 48259 - DNA, 20 bp, Artificial Sequence
  Synthetic oligonucleotide; TGG chr11 5230948 5230967 5230951 -
gacgatgaaaaagaacctat

SEQ ID NO: 48260 - DNA, 20 bp, Artificial Sequence
  Synthetic oligonucleotide; GGG chr11 5230947 5230966 5230950 -
acgatgaaaaagaacctatt

SEQ ID NO: 48261 - DNA, 20 bp, Artificial Sequence
  Synthetic oligonucleotide; AAG chr11 5230940 5230959 5230943 -
aaaagaacctattgggtatt

SEQ ID NO: 48262 - DNA, 20 bp, Artificial Sequence
  Synthetic oligonucleotide; GAG chr11 5230928 5230947 5230931 -
tgggtattaagttcatcact

SEQ ID NO: 48263 - DNA, 20 bp, Artificial Sequence
  Synthetic oligonucleotide; AAG chr11 5230904 5230923 5230907 -
gatgaaataatctgtacatc

SEQ ID NO: 48264 - DNA, 20 bp, Artificial Sequence
  Synthetic oligonucleotide; CAG chr11 5230898 5230917 5230901 -
ataatctgtacatcaagacc

SEQ ID NO: 48265 - DNA, 20 bp, Artificial Sequence
  Synthetic oligonucleotide; AAG chr11 5230842 5230861 5230845 -
tacccccaaatttaaaatga

SEQ ID NO: 48266 - DNA, 20 bp, Artificial Sequence
  Synthetic oligonucleotide; AAG chr11 5230831 5230850 5230834 -
ttaaaatgaaagttaaaaca

SEQ ID NO: 48267 - DNA, 20 bp, Artificial Sequence
  Synthetic oligonucleotide; TAG chr11 5230826 5230845 5230829 -
atgaaagttaaaacaaagta

SEQ ID NO: 48268 - DNA, 20 bp, Artificial Sequence
  Synthetic oligonucleotide; AGG chr11 5230825 5230844 5230828 -
tgaaagttaaaacaaagtat

SEQ ID NO: 48269 - DNA, 20 bp, Artificial Sequence
  Synthetic oligonucleotide; TGG chr11 5230820 5230839 5230823 -
gttaaaacaaagtataggaa

SEQ ID NO: 48270 - DNA, 20 bp, Artificial Sequence
  Synthetic oligonucleotide; AAG chr11 5230805 5230824 5230808 -
aggaatggaattaattcctc

SEQ ID NO: 48271 - DNA, 20 bp, Artificial Sequence
  Synthetic oligonucleotide; TGG chr11 5230799 5230818 5230802 -
ggaattaattcctcaagatt

SEQ ID NO: 48272 - DNA, 20 bp, Artificial Sequence
  Synthetic oligonucleotide; TGG chr11 5230768 5230787 5230771 -
ttatttgataatttatcaaa

SEQ ID NO: 48273 - DNA, 20 bp, Artificial Sequence
  Synthetic oligonucleotide; TGG chr11 5230745 5230764 5230748 -
ttgtttttcttttctcacta

SEQ ID NO: 48274 - DNA, 20 bp, Artificial Sequence
  Synthetic oligonucleotide; CAG chr11 5230721 5230740 5230724 -
gttgctttataaactatgtt

SEQ ID NO: 48275 - DNA, 20 bp, Artificial Sequence
  Synthetic oligonucleotide; AAG chr11 5230705 5230724 5230708 -
tgttcagtatgtctgaatga

SEQ ID NO: 48276 - DNA, 20 bp, Artificial Sequence
  Synthetic oligonucleotide; AGG chr11 5230704 5230723 5230707 -
gttcagtatgtctgaatgaa

SEQ ID NO: 48277 - DNA, 20 bp, Artificial Sequence
  Synthetic oligonucleotide; GGG chr11 5230703 5230722 5230706 -
ttcagtatgtctgaatgaaa

SEQ ID NO: 48278 - DNA, 20 bp, Artificial Sequence
  Synthetic oligonucleotide; AAG chr11 5230685 5230704 5230688 -
aagggtgtgtgtgtgtgtga

SEQ ID NO: 48279 - DNA, 20 bp, Artificial Sequence
  Synthetic oligonucleotide; GAG chr11 5230683 5230702 5230686 -
gggtgtgtgtgtgtgtgaaa

SEQ ID NO: 48280 - DNA, 20 bp, Artificial Sequence
  Synthetic oligonucleotide; GAG chr11 5230681 5230700 5230684 -
gtgtgtgtgtgtgtgaaaga

SEQ ID NO: 48281 - DNA, 20 bp, Artificial Sequence
  Synthetic oligonucleotide; AGG chr11 5230680 5230699 5230683 -
tgtgtgtgtgtgtgaaagag

SEQ ID NO: 48282 - DNA, 20 bp, Artificial Sequence
  Synthetic oligonucleotide; GGG chr11 5230679 5230698 5230682 -
gtgtgtgtgtgtgaaagaga

SEQ ID NO: 48283 - DNA, 20 bp, Artificial Sequence
  Synthetic oligonucleotide; GAG chr11 5230677 5230696 5230680 -
gtgtgtgtgtgaaagagagg

SEQ ID NO: 48284 - DNA, 20 bp, Artificial Sequence
  Synthetic oligonucleotide; GAG chr11 5230675 5230694 5230678 -
gtgtgtgtgaaagagaggga

SEQ ID NO: 48285 - DNA, 20 bp, Artificial Sequence
  Synthetic oligonucleotide; GAG chr11 5230673 5230692 5230676 -
gtgtgtgaaagagagggaga

SEQ ID NO: 48286 - DNA, 20 bp, Artificial Sequence
  Synthetic oligonucleotide; AGG chr11 5230672 5230691 5230675 -
tgtgtgaaagagagggagag

SEQ ID NO: 48287 - DNA, 20 bp, Artificial Sequence
  Synthetic oligonucleotide; AAG chr11 5230669 5230688 5230672 -
gtgaaagagagggagagagg

SEQ ID NO: 48288 - DNA, 20 bp, Artificial Sequence
  Synthetic oligonucleotide; AGG chr11 5230668 5230687 5230671 -
tgaaagagagggagagagga

SEQ ID NO: 48289 - DNA, 20 bp, Artificial Sequence
  Synthetic oligonucleotide; GGG chr11 5230667 5230686 5230670 -
gaaagagagggagagaggaa

SEQ ID NO: 48290 - DNA, 20 bp, Artificial Sequence
  Synthetic oligonucleotide; AAG chr11 5230664 5230683 5230667 -
agagagggagagaggaaggg

SEQ ID NO: 48291 - DNA, 20 bp, Artificial Sequence
  Synthetic oligonucleotide; GAG chr11 5230662 5230681 5230665 -
agagggagagaggaagggaa

SEQ ID NO: 48292 - DNA, 20 bp, Artificial Sequence
  Synthetic oligonucleotide; GAG chr11 5230660 5230679 5230663 -
agggagagaggaagggaaga

SEQ ID NO: 48293 - DNA, 20 bp, Artificial Sequence
  Synthetic oligonucleotide; AGG chr11 5230659 5230678 5230662 -
gggagagaggaagggaagag

SEQ ID NO: 48294 - DNA, 20 bp, Artificial Sequence
  Synthetic oligonucleotide; GAG chr11 5230638 5230657 5230641 -
ggacgtaataatgtgaattt

SEQ ID NO: 48295 - DNA, 20 bp, Artificial Sequence
  Synthetic oligonucleotide; CAG chr11 5230601 5230620 5230604 -
tcaataaaataatttaatgt

SEQ ID NO: 48296 - DNA, 20 bp, Artificial Sequence
  Synthetic oligonucleotide; AGG chr11 5230600 5230619 5230603 -
caataaaataatttaatgtc

SEQ ID NO: 48297 - DNA, 20 bp, Artificial Sequence
  Synthetic oligonucleotide; GAG chr11 5230598 5230617 5230601 -
ataaaataatttaatgtcag

SEQ ID NO: 48298 - DNA, 20 bp, Artificial Sequence
  Synthetic oligonucleotide; AAG chr11 5230591 5230610 5230594 -
aatttaatgtcaggagaatt

SEQ ID NO: 48299 - DNA, 20 bp, Artificial Sequence
  Synthetic oligonucleotide; TAG chr11 5230583 5230602 5230586 -
gtcaggagaattaagcctaa

SEQ ID NO: 48300 - DNA, 20 bp, Artificial Sequence
  Synthetic oligonucleotide; GAG chr11 5230558 5230577 5230561 -
tcctaaatcatccatctctt

SEQ ID NO: 48301 - DNA, 20 bp, Artificial Sequence
  Synthetic oligonucleotide; CAG chr11 5230552 5230571 5230555 -
atcatccatctcttgagctt

SEQ ID NO: 48302 - DNA, 20 bp, Artificial Sequence
  Synthetic oligonucleotide; GAG chr11 5230550 5230569 5230553 -
catccatctcttgagcttca

SEQ ID NO: 48303 - DNA, 20 bp, Artificial Sequence
  Synthetic oligonucleotide; CAG chr11 5230547 5230566 5230550 -
ccatctcttgagcttcagag

SEQ ID NO: 48304 - DNA, 20 bp, Artificial Sequence
  Synthetic oligonucleotide; AAG chr11 5230515 5230534 5230518 -
ttaatgcctacatgtttgta

SEQ ID NO: 48305 - DNA, 20 bp, Artificial Sequence
  Synthetic oligonucleotide; AGG chr11 5230514 5230533 5230517 -
taatgcctacatgtttgtaa

SEQ ID NO: 48306 - DNA, 20 bp, Artificial Sequence
  Synthetic oligonucleotide; GGG chr11 5230513 5230532 5230516 -
aatgcctacatgtttgtaaa

SEQ ID NO: 48307 - DNA, 20 bp, Artificial Sequence
  Synthetic oligonucleotide; CAG chr11 5230506 5230525 5230509 -
acatgtttgtaaagggtgtt

SEQ ID NO: 48308 - DNA, 20 bp, Artificial Sequence
  Synthetic oligonucleotide; AAG chr11 5230499 5230518 5230502 -
tgtaaagggtgttcagactg

SEQ ID NO: 48309 - DNA, 20 bp, Artificial Sequence
  Synthetic oligonucleotide; AAG chr11 5230494 5230513 5230497 -
agggtgttcagactgaagcc

SEQ ID NO: 48310 - DNA, 20 bp, Artificial Sequence
  Synthetic oligonucleotide; AAG chr11 5230479 5230498 5230482 -
aagccaagattctacctcta

SEQ ID NO: 48311 - DNA, 20 bp, Artificial Sequence
  Synthetic oligonucleotide; GAG chr11 5230477 5230496 5230480 -
gccaagattctacctctaaa

SEQ ID NO: 48312 - DNA, 20 bp, Artificial Sequence
  Synthetic oligonucleotide; AAG chr11 5230453 5230472 5230456 -
tgcaatctcaaatttatctg

SEQ ID NO: 48313 - DNA, 20 bp, Artificial Sequence
  Synthetic oligonucleotide; TGG chr11 5230418 5230437 5230421 -
ctctccataaattgacacca

SEQ ID NO: 48314 - DNA, 20 bp, Artificial Sequence
  Synthetic oligonucleotide; GAG chr11 5230405 5230424 5230408 -
gacaccatggcccacttaat

SEQ ID NO: 48315 - DNA, 20 bp, Artificial Sequence
  Synthetic oligonucleotide; AGG chr11 5230404 5230423 5230407 -
acaccatggcccacttaatg

SEQ ID NO: 48316 - DNA, 20 bp, Artificial Sequence
  Synthetic oligonucleotide; AAG chr11 5230393 5230412 5230396 -
cacttaatgaggttaaaaaa

SEQ ID NO: 48317 - DNA, 20 bp, Artificial Sequence
  Synthetic oligonucleotide; GAG chr11 5230370 5230389 5230373 -
ctaattctgaatgaaaatct

SEQ ID NO: 48318 - DNA, 20 bp, Artificial Sequence
  Synthetic oligonucleotide; CAG chr11 5230365 5230384 5230368 -
tctgaatgaaaatctgagcc

SEQ ID NO: 48319 - DNA, 20 bp, Artificial Sequence
  Synthetic oligonucleotide; TGG chr11 5230362 5230381 5230365 -
gaatgaaaatctgagcccag

SEQ ID NO: 48320 - DNA, 20 bp, Artificial Sequence
  Synthetic oligonucleotide; GAG chr11 5230360 5230379 5230363 -
atgaaaatctgagcccagtg

SEQ ID NO: 48321 - DNA, 20 bp, Artificial Sequence
  Synthetic oligonucleotide; AGG chr11 5230359 5230378 5230362 -
tgaaaatctgagcccagtgg

SEQ ID NO: 48322 - DNA, 20 bp, Artificial Sequence
  Synthetic oligonucleotide; AAG chr11 5230342 5230361 5230345 -
tggaggaaatattaatgaac

SEQ ID NO: 48323 - DNA, 20 bp, Artificial Sequence
  Synthetic oligonucleotide; AGG chr11 5230341 5230360 5230344 -
ggaggaaatattaatgaaca

SEQ ID NO: 48324 - DNA, 20 bp, Artificial Sequence
  Synthetic oligonucleotide; CAG chr11 5230336 5230355 5230339 -
aaatattaatgaacaaggtg

SEQ ID NO: 48325 - DNA, 20 bp, Artificial Sequence
  Synthetic oligonucleotide; TAG chr11 5230292 5230311 5230295 -
taataattatgcatatactt

SEQ ID NO: 48326 - DNA, 20 bp, Artificial Sequence
  Synthetic oligonucleotide; AAG chr11 5230287 5230306 5230290 -
attatgcatatactttagca

SEQ ID NO: 48327 - DNA, 20 bp, Artificial Sequence
  Synthetic oligonucleotide; TGG chr11 5230256 5230275 5230259 -
atgttgactttattgctttt

SEQ ID NO: 48328 - DNA, 20 bp, Artificial Sequence
  Synthetic oligonucleotide; AAG chr11 5230252 5230271 5230255 -
tgactttattgctttttggt

SEQ ID NO: 48329 - DNA, 20 bp, Artificial Sequence
  Synthetic oligonucleotide; AAG chr11 5230234 5230253 5230237 -
gtaagaaatacaacttttta

SEQ ID NO: 48330 - DNA, 20 bp, Artificial Sequence
  Synthetic oligonucleotide; CGG chr11 5230190 5230209 5230193 -
caaactattttgtgtgtgtg

SEQ ID NO: 48331 - DNA, 20 bp, Artificial Sequence
  Synthetic oligonucleotide; TGG chr11 5230177 5230196 5230180 -
gtgtgtgcggtttgtttcta

SEQ ID NO: 48332 - DNA, 20 bp, Artificial Sequence
  Synthetic oligonucleotide; GGG chr11 5230176 5230195 5230179 -
tgtgtgcggtttgtttctat

SEQ ID NO: 48333 - DNA, 20 bp, Artificial Sequence
  Synthetic oligonucleotide; TGG chr11 5230170 5230189 5230173 -
cggtttgtttctatgggttc

SEQ ID NO: 48334 - DNA, 20 bp, Artificial Sequence
  Synthetic oligonucleotide; TGG chr11 5230161 5230180 5230164 -
tctatgggttctggttttct

SEQ ID NO: 48335 - DNA, 20 bp, Artificial Sequence
  Synthetic oligonucleotide; GAG chr11 5230159 5230178 5230162 -
tatgggttctggttttcttg

SEQ ID NO: 48336 - DNA, 20 bp, Artificial Sequence
  Synthetic oligonucleotide; GAG chr11 5230125 5230144 5230128 -
cattttaattaattaattct

SEQ ID NO: 48337 - DNA, 20 bp, Artificial Sequence
  Synthetic oligonucleotide; GAG chr11 5230123 5230142 5230126 -
ttttaattaattaattctga

SEQ ID NO: 48338 - DNA, 20 bp, Artificial Sequence
  Synthetic oligonucleotide; GAG chr11 5230115 5230134 5230118 -
aattaattctgagagctgct

SEQ ID NO: 48339 - DNA, 20 bp, Artificial Sequence
  Synthetic oligonucleotide; GAG chr11 5230101 5230120 5230104 -
gctgctgagttgtgtttact

SEQ ID NO: 48340 - DNA, 20 bp, Artificial Sequence
  Synthetic oligonucleotide; GAG chr11 5230099 5230118 5230102 -
tgctgagttgtgtttactga

SEQ ID NO: 48341 - DNA, 20 bp, Artificial Sequence
  Synthetic oligonucleotide; GAG chr11 5230083 5230102 5230086 -
ctgagagattgtgtatctgc

SEQ ID NO: 48342 - DNA, 20 bp, Artificial Sequence
  Synthetic oligonucleotide; GAG chr11 5230081 5230100 5230084 -
gagagattgtgtatctgcga

SEQ ID NO: 48343 - DNA, 20 bp, Artificial Sequence
  Synthetic oligonucleotide; AAG chr11 5230078 5230097 5230081 -
agattgtgtatctgcgagag

SEQ ID NO: 48344 - DNA, 20 bp, Artificial Sequence
  Synthetic oligonucleotide; TAG chr11 5230071 5230090 5230074 -
gtatctgcgagagaagtctg

SEQ ID NO: 48345 - DNA, 20 bp, Artificial Sequence
  Synthetic oligonucleotide; AAG chr11 5230067 5230086 5230070 -
ctgcgagagaagtctgtagc

SEQ ID NO: 48346 - DNA, 20 bp, Artificial Sequence
  Synthetic oligonucleotide; TAG chr11 5230064 5230083 5230067 -
cgagagaagtctgtagcaag

SEQ ID NO: 48347 - DNA, 20 bp, Artificial Sequence
  Synthetic oligonucleotide; TAG chr11 5230060 5230079 5230063 -
agaagtctgtagcaagtagc

SEQ ID NO: 48348 - DNA, 20 bp, Artificial Sequence
  Synthetic oligonucleotide; TAG chr11 5230044 5230063 5230047 -
tagctagactgtgcttgacc

SEQ ID NO: 48349 - DNA, 20 bp, Artificial Sequence
  Synthetic oligonucleotide; AGG chr11 5230043 5230062 5230046 -
agctagactgtgcttgacct

SEQ ID NO: 48350 - DNA, 20 bp, Artificial Sequence
  Synthetic oligonucleotide; CAG chr11 5230032 5230051 5230035 -
gcttgacctaggaacatata

SEQ ID NO: 48351 - DNA, 20 bp, Artificial Sequence
  Synthetic oligonucleotide; TAG chr11 5230029 5230048 5230032 -
tgacctaggaacatatacag

SEQ ID NO: 48352 - DNA, 20 bp, Artificial Sequence
  Synthetic oligonucleotide; TGG chr11 5230007 5230026 5230010 -
gattgctaaaatgtctcact

SEQ ID NO: 48353 - DNA, 20 bp, Artificial Sequence
  Synthetic oligonucleotide; GGG chr11 5230006 5230025 5230009 -
attgctaaaatgtctcactt

SEQ ID NO: 48354 - DNA, 20 bp, Artificial Sequence
  Synthetic oligonucleotide; GGG chr11 5230005 5230024 5230008 -
ttgctaaaatgtctcacttg

SEQ ID NO: 48355 - DNA, 20 bp, Artificial Sequence
  Synthetic oligonucleotide; TAG chr11 5229997 5230016 5230000 -
atgtctcacttggggaattt

SEQ ID NO: 48356 - DNA, 20 bp, Artificial Sequence
  Synthetic oligonucleotide; CAG chr11 5229988 5230007 5229991 -
ttggggaattttagactaaa

SEQ ID NO: 48357 - DNA, 20 bp, Artificial Sequence
  Synthetic oligonucleotide; TAG chr11 5229985 5230004 5229988 -
gggaattttagactaaacag

SEQ ID NO: 48358 - DNA, 20 bp, Artificial Sequence
  Synthetic oligonucleotide; GAG chr11 5229983 5230002 5229986 -
gaattttagactaaacagta

SEQ ID NO: 48359 - DNA, 20 bp, Artificial Sequence
  Synthetic oligonucleotide; TAG chr11 5229963 5229982 5229966 -
gagcatgtataaaaatactc

SEQ ID NO: 48360 - DNA, 20 bp, Artificial Sequence
  Synthetic oligonucleotide; AAG chr11 5229958 5229977 5229961 -
tgtataaaaatactctagtc

SEQ ID NO: 48361 - DNA, 20 bp, Artificial Sequence
  Synthetic oligonucleotide; TAG chr11 5229918 5229937 5229921 -
atgataaaaccacactccca

SEQ ID NO: 48362 - DNA, 20 bp, Artificial Sequence
  Synthetic oligonucleotide; GAG chr11 5229913 5229932 5229916 -
aaaaccacactcccatagat

SEQ ID NO: 48363 - DNA, 20 bp, Artificial Sequence
  Synthetic oligonucleotide; TGG chr11 5229896 5229915 5229899 -
gatgagtgtcatgattttca

SEQ ID NO: 48364 - DNA, 20 bp, Artificial Sequence
  Synthetic oligonucleotide; GAG chr11 5229894 5229913 5229897 -
tgagtgtcatgattttcatg

SEQ ID NO: 48365 - DNA, 20 bp, Artificial Sequence
  Synthetic oligonucleotide; AGG chr11 5229893 5229912 5229896 -
gagtgtcatgattttcatgg

SEQ ID NO: 48366 - DNA, 20 bp, Artificial Sequence
  Synthetic oligonucleotide; AAG chr11 5229890 5229909 5229893 -
tgtcatgattttcatggagg

SEQ ID NO: 48367 - DNA, 20 bp, Artificial Sequence
  Synthetic oligonucleotide; AAG chr11 5229871 5229890 5229874 -
gaagttaatattcatcctct

SEQ ID NO: 48368 - DNA, 20 bp, Artificial Sequence
  Synthetic oligonucleotide; CAG chr11 5229862 5229881 5229865 -
attcatcctctaagtatacc

SEQ ID NO: 48369 - DNA, 20 bp, Artificial Sequence
  Synthetic oligonucleotide; TAG chr11 5229857 5229876 5229860 -
tcctctaagtatacccagac

SEQ ID NO: 48370 - DNA, 20 bp, Artificial Sequence
  Synthetic oligonucleotide; AGG chr11 5229856 5229875 5229859 -
cctctaagtatacccagact

SEQ ID NO: 48371 - DNA, 20 bp, Artificial Sequence
  Synthetic oligonucleotide; GGG chr11 5229855 5229874 5229858 -
ctctaagtatacccagacta

SEQ ID NO: 48372 - DNA, 20 bp, Artificial Sequence
  Synthetic oligonucleotide; TAG chr11 5229833 5229852 5229836 -
gccattctgatataaaacat

SEQ ID NO: 48373 - DNA, 20 bp, Artificial Sequence
  Synthetic oligonucleotide; AGG chr11 5229832 5229851 5229835 -
ccattctgatataaaacatt

SEQ ID NO: 48374 - DNA, 20 bp, Artificial Sequence
  Synthetic oligonucleotide; AAG chr11 5229825 5229844 5229828 -
gatataaaacattaggactt

SEQ ID NO: 48375 - DNA, 20 bp, Artificial Sequence
  Synthetic oligonucleotide; AAG chr11 5229821 5229840 5229824 -
taaaacattaggacttaaga

SEQ ID NO: 48376 - DNA, 20 bp, Artificial Sequence
  Synthetic oligonucleotide; TAG chr11 5229813 5229832 5229816 -
taggacttaagaaagattaa

SEQ ID NO: 48377 - DNA, 20 bp, Artificial Sequence
  Synthetic oligonucleotide; TGG chr11 5229808 5229827 5229811 -
cttaagaaagattaatagac

SEQ ID NO: 48378 - DNA, 20 bp, Artificial Sequence
  Synthetic oligonucleotide; GAG chr11 5229806 5229825 5229809 -
taagaaagattaatagactg

SEQ ID NO: 48379 - DNA, 20 bp, Artificial Sequence
  Synthetic oligonucleotide; AAG chr11 5229801 5229820 5229804 -
aagattaatagactggagta

SEQ ID NO: 48380 - DNA, 20 bp, Artificial Sequence
  Synthetic oligonucleotide; AGG chr11 5229800 5229819 5229803 -
agattaatagactggagtaa

SEQ ID NO: 48381 - DNA, 20 bp, Artificial Sequence
  Synthetic oligonucleotide; TGG chr11 5229794 5229813 5229797 -
atagactggagtaaaggaaa

SEQ ID NO: 48382 - DNA, 20 bp, Artificial Sequence
  Synthetic oligonucleotide; GAG chr11 5229762 5229781 5229765 -
tctctcgctgtctctttttt

SEQ ID NO: 48383 - DNA, 20 bp, Artificial Sequence
  Synthetic oligonucleotide; AGG chr11 5229761 5229780 5229764 -
ctctcgctgtctcttttttg

SEQ ID NO: 48384 - DNA, 20 bp, Artificial Sequence
  Synthetic oligonucleotide; TGG chr11 5229718 5229737 5229721 -
gtgtgtgtgtgtgtgtgttg

SEQ ID NO: 48385 - DNA, 20 bp, Artificial Sequence
  Synthetic oligonucleotide; CAG chr11 5229714 5229733 5229717 -
gtgtgtgtgtgtgttgtggt

SEQ ID NO: 48386 - DNA, 20 bp, Artificial Sequence
  Synthetic oligonucleotide; TGG chr11 5229711 5229730 5229714 -
tgtgtgtgtgttgtggtcag

SEQ ID NO: 48387 - DNA, 20 bp, Artificial Sequence
  Synthetic oligonucleotide; GGG chr11 5229710 5229729 5229713 -
gtgtgtgtgttgtggtcagt

SEQ ID NO: 48388 - DNA, 20 bp, Artificial Sequence
  Synthetic oligonucleotide; GGG chr11 5229709 5229728 5229712 -
tgtgtgtgttgtggtcagtg

SEQ ID NO: 48389 - DNA, 20 bp, Artificial Sequence
  Synthetic oligonucleotide; TGG chr11 5229705 5229724 5229708 -
tgtgttgtggtcagtggggc

SEQ ID NO: 48390 - DNA, 20 bp, Artificial Sequence
  Synthetic oligonucleotide; AAG chr11 5229697 5229716 5229700 -
ggtcagtggggctggaataa

SEQ ID NO: 48391 - DNA, 20 bp, Artificial Sequence
  Synthetic oligonucleotide; TAG chr11 5229694 5229713 5229697 -
cagtggggctggaataaaag

SEQ ID NO: 48392 - DNA, 20 bp, Artificial Sequence
  Synthetic oligonucleotide; TAG chr11 5229689 5229708 5229692 -
gggctggaataaaagtagaa

SEQ ID NO: 48393 - DNA, 20 bp, Artificial Sequence
  Synthetic oligonucleotide; TGG chr11 5229672 5229691 5229675 -
gaatagacctgcacctgctg

SEQ ID NO: 48394 - DNA, 20 bp, Artificial Sequence
  Synthetic oligonucleotide; CAG chr11 5229659 5229678 5229662 -
cctgctgtggcatccattca

SEQ ID NO: 48395 - DNA, 20 bp, Artificial Sequence
  Synthetic oligonucleotide; GAG chr11 5229657 5229676 5229660 -
tgctgtggcatccattcaca

SEQ ID NO: 48396 - DNA, 20 bp, Artificial Sequence
  Synthetic oligonucleotide; TAG chr11 5229654 5229673 5229657 -
tgtggcatccattcacagag

SEQ ID NO: 48397 - DNA, 20 bp, Artificial Sequence
  Synthetic oligonucleotide; AAG chr11 5229651 5229670 5229654 -
ggcatccattcacagagtag

SEQ ID NO: 48398 - DNA, 20 bp, Artificial Sequence
  Synthetic oligonucleotide; AAG chr11 5229647 5229666 5229650 -
tccattcacagagtagaagc

SEQ ID NO: 48399 - DNA, 20 bp, Artificial Sequence
  Synthetic oligonucleotide; TAG chr11 5229637 5229656 5229640 -
gagtagaagcaagctcacaa

SEQ ID NO: 48400 - DNA, 20 bp, Artificial Sequence
  Synthetic oligonucleotide; AAG chr11 5229632 5229651 5229635 -
gaagcaagctcacaatagtg

SEQ ID NO: 48401 - DNA, 20 bp, Artificial Sequence
  Synthetic oligonucleotide; CAG chr11 5229625 5229644 5229628 -
gctcacaatagtgaagatgt

SEQ ID NO: 48402 - DNA, 20 bp, Artificial Sequence
  Synthetic oligonucleotide; AAG chr11 5229621 5229640 5229624 -
acaatagtgaagatgtcagt

SEQ ID NO: 48403 - DNA, 20 bp, Artificial Sequence
  Synthetic oligonucleotide; TAG chr11 5229612 5229631 5229615 -
aagatgtcagtaagcttgaa

SEQ ID NO: 48404 - DNA, 20 bp, Artificial Sequence
  Synthetic oligonucleotide; CAG chr11 5229604 5229623 5229607 -
agtaagcttgaatagttttt

SEQ ID NO: 48405 - DNA, 20 bp, Artificial Sequence
  Synthetic oligonucleotide; AGG chr11 5229603 5229622 5229606 -
gtaagcttgaatagtttttc

SEQ ID NO: 48406 - DNA, 20 bp, Artificial Sequence
  Synthetic oligonucleotide; TAG chr11 5229583 5229602 5229586 -
aggaactttgaatgctgatt

SEQ ID NO: 48407 - DNA, 20 bp, Artificial Sequence
  Synthetic oligonucleotide; GAG chr11 5229570 5229589 5229573 -
gctgatttagatttgaaact

SEQ ID NO: 48408 - DNA, 20 bp, Artificial Sequence
  Synthetic oligonucleotide; AGG chr11 5229569 5229588 5229572 -
ctgatttagatttgaaactg

SEQ ID NO: 48409 - DNA, 20 bp, Artificial Sequence
  Synthetic oligonucleotide; TGG chr11 5229513 5229532 5229516 -
cttcttgaaacttatttgcc

SEQ ID NO: 48410 - DNA, 20 bp, Artificial Sequence
  Synthetic oligonucleotide; TGG chr11 5229504 5229523 5229507 -
acttatttgcctggtatgcc

SEQ ID NO: 48411 - DNA, 20 bp, Artificial Sequence
  Synthetic oligonucleotide; GGG chr11 5229503 5229522 5229506 -
cttatttgcctggtatgcct

SEQ ID NO: 48412 - DNA, 20 bp, Artificial Sequence
  Synthetic oligonucleotide; TGG chr11 5229493 5229512 5229496 -
tggtatgcctgggcttttga

SEQ ID NO: 48413 - DNA, 20 bp, Artificial Sequence
  Synthetic oligonucleotide; TAG chr11 5229487 5229506 5229490 -
gcctgggcttttgatggtct

SEQ ID NO: 48414 - DNA, 20 bp, Artificial Sequence
  Synthetic oligonucleotide; TAG chr11 5229482 5229501 5229485 -
ggcttttgatggtcttagta

SEQ ID NO: 48415 - DNA, 20 bp, Artificial Sequence
  Synthetic oligonucleotide; CAG chr11 5229475 5229494 5229478 -
gatggtcttagtatagcttg

SEQ ID NO: 48416 - DNA, 20 bp, Artificial Sequence
  Synthetic oligonucleotide; CAG chr11 5229461 5229480 5229464 -
agcttgcagccttgtccctg

SEQ ID NO: 48417 - DNA, 20 bp, Artificial Sequence
  Synthetic oligonucleotide; AGG chr11 5229460 5229479 5229463 -
gcttgcagccttgtccctgc

SEQ ID NO: 48418 - DNA, 20 bp, Artificial Sequence
  Synthetic oligonucleotide; GGG chr11 5229459 5229478 5229462 -
cttgcagccttgtccctgca

SEQ ID NO: 48419 - DNA, 20 bp, Artificial Sequence
  Synthetic oligonucleotide; TGG chr11 5229451 5229470 5229454 -
cttgtccctgcagggtatta

SEQ ID NO: 48420 - DNA, 20 bp, Artificial Sequence
  Synthetic oligonucleotide; GGG chr11 5229450 5229469 5229453 -
ttgtccctgcagggtattat

SEQ ID NO: 48421 - DNA, 20 bp, Artificial Sequence
  Synthetic oligonucleotide; TAG chr11 5229444 5229463 5229447 -
ctgcagggtattatgggtaa

SEQ ID NO: 48422 - DNA, 20 bp, Artificial Sequence
  Synthetic oligonucleotide; AAG chr11 5229440 5229459 5229443 -
agggtattatgggtaataga

SEQ ID NO: 48423 - DNA, 20 bp, Artificial Sequence
  Synthetic oligonucleotide; AAG chr11 5229435 5229454 5229438 -
attatgggtaatagaaagaa

SEQ ID NO: 48424 - DNA, 20 bp, Artificial Sequence
  Synthetic oligonucleotide; TAG chr11 5229418 5229437 5229421 -
gaaaagtctgcgttacactc

SEQ ID NO: 48425 - DNA, 20 bp, Artificial Sequence
  Synthetic oligonucleotide; AAG chr11 5229408 5229427 5229411 -
cgttacactctagtcacact

SEQ ID NO: 48426 - DNA, 20 bp, Artificial Sequence
  Synthetic oligonucleotide; TGG chr11 5229395 5229414 5229398 -
tcacactaagtaactaccat

SEQ ID NO: 48427 - DNA, 20 bp, Artificial Sequence
  Synthetic oligonucleotide; AAG chr11 5229390 5229409 5229393 -
ctaagtaactaccattggaa

SEQ ID NO: 48428 - DNA, 20 bp, Artificial Sequence
  Synthetic oligonucleotide; AAG chr11 5229373 5229392 5229376 -
gaaaagcaacccctgccttg

SEQ ID NO: 48429 - DNA, 20 bp, Artificial Sequence
  Synthetic oligonucleotide; CAG chr11 5229369 5229388 5229372 -
agcaacccctgccttgaagc

SEQ ID NO: 48430 - DNA, 20 bp, Artificial Sequence
  Synthetic oligonucleotide; AGG chr11 5229368 5229387 5229371 -
gcaacccctgccttgaagcc

SEQ ID NO: 48431 - DNA, 20 bp, Artificial Sequence
  Synthetic oligonucleotide; TGG chr11 5229361 5229380 5229364 -
ctgccttgaagccaggatga

SEQ ID NO: 48432 - DNA, 20 bp, Artificial Sequence
  Synthetic oligonucleotide; CAG chr11 5229352 5229371 5229355 -
agccaggatgatggtatctg

SEQ ID NO: 48433 - DNA, 20 bp, Artificial Sequence
  Synthetic oligonucleotide; CAG chr11 5229349 5229368 5229352 -
caggatgatggtatctgcag

SEQ ID NO: 48434 - DNA, 20 bp, Artificial Sequence
  Synthetic oligonucleotide; AAG chr11 5229336 5229355 5229339 -
tctgcagcagttgccaacac

SEQ ID NO: 48435 - DNA, 20 bp, Artificial Sequence
  Synthetic oligonucleotide; GAG chr11 5229334 5229353 5229337 -
tgcagcagttgccaacacaa

SEQ ID NO: 48436 - DNA, 20 bp, Artificial Sequence
  Synthetic oligonucleotide; AAG chr11 5229331 5229350 5229334 -
agcagttgccaacacaagag

SEQ ID NO: 48437 - DNA, 20 bp, Artificial Sequence
  Synthetic oligonucleotide; AGG chr11 5229330 5229349 5229333 -
gcagttgccaacacaagaga

SEQ ID NO: 48438 - DNA, 20 bp, Artificial Sequence
  Synthetic oligonucleotide; TAG chr11 5229322 5229341 5229325 -
caacacaagagaaggatcca

SEQ ID NO: 48439 - DNA, 20 bp, Artificial Sequence
  Synthetic oligonucleotide; AAG chr11 5229305 5229324 5229308 -
ccatagttcatcatttaaaa

SEQ ID NO: 48440 - DNA, 20 bp, Artificial Sequence
  Synthetic oligonucleotide; TAG chr11 5229293 5229312 5229296 -
atttaaaaaagaaaacaaaa

SEQ ID NO: 48441 - DNA, 20 bp, Artificial Sequence
  Synthetic oligonucleotide; AAG chr11 5229287 5229306 5229290 -
aaaagaaaacaaaatagaaa

SEQ ID NO: 48442 - DNA, 20 bp, Artificial Sequence
  Synthetic oligonucleotide; AGG chr11 5229286 5229305 5229289 -
aaagaaaacaaaatagaaaa

SEQ ID NO: 48443 - DNA, 20 bp, Artificial Sequence
  Synthetic oligonucleotide; GAG chr11 5229271 5229290 5229274 -
gaaaaaggaaaactatttct

SEQ ID NO: 48444 - DNA, 20 bp, Artificial Sequence
  Synthetic oligonucleotide; AAG chr11 5229265 5229284 5229268 -
ggaaaactatttctgagcat

SEQ ID NO: 48445 - DNA, 20 bp, Artificial Sequence
  Synthetic oligonucleotide; AAG chr11 5229262 5229281 5229265 -
aaactatttctgagcataag

SEQ ID NO: 48446 - DNA, 20 bp, Artificial Sequence
  Synthetic oligonucleotide; TAG chr11 5229256 5229275 5229259 -
tttctgagcataagaagttg

SEQ ID NO: 48447 - DNA, 20 bp, Artificial Sequence
  Synthetic oligonucleotide; AGG chr11 5229255 5229274 5229258 -
ttctgagcataagaagttgt

SEQ ID NO: 48448 - DNA, 20 bp, Artificial Sequence
  Synthetic oligonucleotide; GGG chr11 5229254 5229273 5229257 -
tctgagcataagaagttgta

SEQ ID NO: 48449 - DNA, 20 bp, Artificial Sequence
  Synthetic oligonucleotide; AAG chr11 5229250 5229269 5229253 -
agcataagaagttgtagggt

SEQ ID NO: 48450 - DNA, 20 bp, Artificial Sequence
  Synthetic oligonucleotide; AAG chr11 5229242 5229261 5229245 -
aagttgtagggtaagtcttt

SEQ ID NO: 48451 - DNA, 20 bp, Artificial Sequence
  Synthetic oligonucleotide; AAG chr11 5229239 5229258 5229242 -
ttgtagggtaagtctttaag

SEQ ID NO: 48452 - DNA, 20 bp, Artificial Sequence
  Synthetic oligonucleotide; AGG chr11 5229238 5229257 5229241 -
tgtagggtaagtctttaaga

SEQ ID NO: 48453 - DNA, 20 bp, Artificial Sequence
  Synthetic oligonucleotide; CAG chr11 5229218 5229237 5229221 -
aggtgacaatttctgccaat

SEQ ID NO: 48454 - DNA, 20 bp, Artificial Sequence
  Synthetic oligonucleotide; AGG chr11 5229217 5229236 5229220 -
ggtgacaatttctgccaatc

SEQ ID NO: 48455 - DNA, 20 bp, Artificial Sequence
  Synthetic oligonucleotide; AAG chr11 5229208 5229227 5229211 -
ttctgccaatcaggatttca

SEQ ID NO: 48456 - DNA, 20 bp, Artificial Sequence
  Synthetic oligonucleotide; TGG chr11 5229187 5229206 5229190 -
agctcttgctttgacaattt

SEQ ID NO: 48457 - DNA, 20 bp, Artificial Sequence
  Synthetic oligonucleotide; CAG chr11 5229179 5229198 5229182 -
ctttgacaattttggtcttt

SEQ ID NO: 48458 - DNA, 20 bp, Artificial Sequence
  Synthetic oligonucleotide; AAG chr11 5229141 5229160 5229144 -
acctatattataatttcata

SEQ ID NO: 48459 - DNA, 20 bp, Artificial Sequence
  Synthetic oligonucleotide; CAG chr11 5229118 5229137 5229121 -
tctgtgcattttctttgacc

SEQ ID NO: 48460 - DNA, 20 bp, Artificial Sequence
  Synthetic oligonucleotide; AGG chr11 5229117 5229136 5229120 -
ctgtgcattttctttgaccc

SEQ ID NO: 48461 - DNA, 20 bp, Artificial Sequence
  Synthetic oligonucleotide; AAG chr11 5229104 5229123 5229107 -
ttgacccaggatatttgcaa

SEQ ID NO: 48462 - DNA, 20 bp, Artificial Sequence
  Synthetic oligonucleotide; CAG chr11 5229084 5229103 5229087 -
aagacatattcaaacttccg

SEQ ID NO: 48463 - DNA, 20 bp, Artificial Sequence
  Synthetic oligonucleotide; CAG chr11 5229047 5229066 5229050 -
catatacatgcctcttatat

SEQ ID NO: 48464 - DNA, 20 bp, Artificial Sequence
  Synthetic oligonucleotide; AGG chr11 5229046 5229065 5229049 -
atatacatgcctcttatatc

SEQ ID NO: 48465 - DNA, 20 bp, Artificial Sequence
  Synthetic oligonucleotide; GGG chr11 5229045 5229064 5229048 -
tatacatgcctcttatatca

SEQ ID NO: 48466 - DNA, 20 bp, Artificial Sequence
  Synthetic oligonucleotide; CAG chr11 5229034 5229053 5229037 -
cttatatcagggatgtgaaa

SEQ ID NO: 48467 - DNA, 20 bp, Artificial Sequence
  Synthetic oligonucleotide; AGG chr11 5229033 5229052 5229036 -
ttatatcagggatgtgaaac

SEQ ID NO: 48468 - DNA, 20 bp, Artificial Sequence
  Synthetic oligonucleotide; GGG chr11 5229032 5229051 5229035 -
tatatcagggatgtgaaaca

SEQ ID NO: 48469 - DNA, 20 bp, Artificial Sequence
  Synthetic oligonucleotide; CAG chr11 5228993 5229012 5228996 -
aatctaaaacaatgctaatg

SEQ ID NO: 48470 - DNA, 20 bp, Artificial Sequence
  Synthetic oligonucleotide; AGG chr11 5228992 5229011 5228995 -
atctaaaacaatgctaatgc

SEQ ID NO: 48471 - DNA, 20 bp, Artificial Sequence
  Synthetic oligonucleotide; CAG chr11 5228956 5228975 5228959 -
aaataaaatccaaaatctaa

SEQ ID NO: 48472 - DNA, 20 bp, Artificial Sequence
  Synthetic oligonucleotide; AAG chr11 5228951 5228970 5228954 -
aaatccaaaatctaacagcc

SEQ ID NO: 48473 - DNA, 20 bp, Artificial Sequence
  Synthetic oligonucleotide; AAG chr11 5228913 5228932 5228916 -
ttaacatttaaaatatttta

SEQ ID NO: 48474 - DNA, 20 bp, Artificial Sequence
  Synthetic oligonucleotide; CAG chr11 5228899 5228918 5228902 -
attttaaagacgtcttttcc

SEQ ID NO: 48475 - DNA, 20 bp, Artificial Sequence
  Synthetic oligonucleotide; AGG chr11 5228898 5228917 5228901 -
ttttaaagacgtcttttccc

SEQ ID NO: 48476 - DNA, 20 bp, Artificial Sequence
  Synthetic oligonucleotide; CAG chr11 5228872 5228891 5228875 -
caacatgtgaaatcttttct

SEQ ID NO: 48477 - DNA, 20 bp, Artificial Sequence
  Synthetic oligonucleotide; AGG chr11 5228871 5228890 5228874 -
aacatgtgaaatcttttctc

SEQ ID NO: 48478 - DNA, 20 bp, Artificial Sequence
  Synthetic oligonucleotide; GGG chr11 5228870 5228889 5228873 -
acatgtgaaatcttttctca

SEQ ID NO: 48479 - DNA, 20 bp, Artificial Sequence
  Synthetic oligonucleotide; TAG chr11 5228854 5228873 5228857 -
ctcagggatacacgtgtgcc

SEQ ID NO: 48480 - DNA, 20 bp, Artificial Sequence
  Synthetic oligonucleotide; TAG chr11 5228838 5228857 5228841 -
tgcctagatcctcattgctt

SEQ ID NO: 48481 - DNA, 20 bp, Artificial Sequence
  Synthetic oligonucleotide; CAG chr11 5228828 5228847 5228831 -
ctcattgctttagtttttta

SEQ ID NO: 48482 - DNA, 20 bp, Artificial Sequence
  Synthetic oligonucleotide; GAG chr11 5228826 5228845 5228829 -
cattgctttagttttttaca

SEQ ID NO: 48483 - DNA, 20 bp, Artificial Sequence
  Synthetic oligonucleotide; AGG chr11 5228825 5228844 5228828 -
attgctttagttttttacag

SEQ ID NO: 48484 - DNA, 20 bp, Artificial Sequence
  Synthetic oligonucleotide; AAG chr11 5228810 5228829 5228813 -
tacagaggaatgaatataaa

SEQ ID NO: 48485 - DNA, 20 bp, Artificial Sequence
  Synthetic oligonucleotide; TAG chr11 5228765 5228784 5228768 -
cttacctctataatcataca

SEQ ID NO: 48486 - DNA, 20 bp, Artificial Sequence
  Synthetic oligonucleotide; AGG chr11 5228764 5228783 5228767 -
ttacctctataatcatacat

SEQ ID NO: 48487 - DNA, 20 bp, Artificial Sequence
  Synthetic oligonucleotide; TAG chr11 5228746 5228765 5228749 -
ataggcataattttttaacc

SEQ ID NO: 48488 - DNA, 20 bp, Artificial Sequence
  Synthetic oligonucleotide; AGG chr11 5228745 5228764 5228748 -
taggcataattttttaacct

SEQ ID NO: 48489 - DNA, 20 bp, Artificial Sequence
  Synthetic oligonucleotide; CAG chr11 5228739 5228758 5228742 -
taattttttaacctaggctc

SEQ ID NO: 48490 - DNA, 20 bp, Artificial Sequence
  Synthetic oligonucleotide; TAG chr11 5228735 5228754 5228738 -
tttttaacctaggctccaga

SEQ ID NO: 48491 - DNA, 20 bp, Artificial Sequence
  Synthetic oligonucleotide; TAG chr11 5228729 5228748 5228732 -
acctaggctccagatagcca

SEQ ID NO: 48492 - DNA, 20 bp, Artificial Sequence
  Synthetic oligonucleotide; AAG chr11 5228726 5228745 5228729 -
taggctccagatagccatag

SEQ ID NO: 48493 - DNA, 20 bp, Artificial Sequence
  Synthetic oligonucleotide; GAG chr11 5228700 5228719 5228703 -
caaacactttctgcgtgtgt

SEQ ID NO: 48494 - DNA, 20 bp, Artificial Sequence
  Synthetic oligonucleotide; CAG chr11 5228691 5228710 5228694 -
tctgcgtgtgtgagaataat

SEQ ID NO: 48495 - DNA, 20 bp, Artificial Sequence
  Synthetic oligonucleotide; GAG chr11 5228689 5228708 5228692 -
tgcgtgtgtgagaataatca

SEQ ID NO: 48496 - DNA, 20 bp, Artificial Sequence
  Synthetic oligonucleotide; GAG chr11 5228685 5228704 5228688 -
tgtgtgagaataatcagagt

SEQ ID NO: 48497 - DNA, 20 bp, Artificial Sequence
  Synthetic oligonucleotide; AAG chr11 5228672 5228691 5228675 -
tcagagtgagattttttcac

SEQ ID NO: 48498 - DNA, 20 bp, Artificial Sequence
  Synthetic oligonucleotide; GAG chr11 5228661 5228680 5228664 -
ttttttcacaagtacctgat

SEQ ID NO: 48499 - DNA, 20 bp, Artificial Sequence
  Synthetic oligonucleotide; AGG chr11 5228660 5228679 5228663 -
tttttcacaagtacctgatg

SEQ ID NO: 48500 - DNA, 20 bp, Artificial Sequence
  Synthetic oligonucleotide; GGG chr11 5228659 5228678 5228662 -
ttttcacaagtacctgatga

SEQ ID NO: 48501 - DNA, 20 bp, Artificial Sequence
  Synthetic oligonucleotide; GAG chr11 5228654 5228673 5228657 -
acaagtacctgatgagggtt

SEQ ID NO: 48502 - DNA, 20 bp, Artificial Sequence
  Synthetic oligonucleotide; CAG chr11 5228650 5228669 5228653 -
gtacctgatgagggttgaga

SEQ ID NO: 48503 - DNA, 20 bp, Artificial Sequence
  Synthetic oligonucleotide; AGG chr11 5228649 5228668 5228652 -
tacctgatgagggttgagac

SEQ ID NO: 48504 - DNA, 20 bp, Artificial Sequence
  Synthetic oligonucleotide; TAG chr11 5228646 5228665 5228649 -
ctgatgagggttgagacagg

SEQ ID NO: 48505 - DNA, 20 bp, Artificial Sequence
  Synthetic oligonucleotide; AAG chr11 5228640 5228659 5228643 -
agggttgagacaggtagaaa

SEQ ID NO: 48506 - DNA, 20 bp, Artificial Sequence
  Synthetic oligonucleotide; GAG chr11 5228636 5228655 5228639 -
ttgagacaggtagaaaaagt

SEQ ID NO: 48507 - DNA, 20 bp, Artificial Sequence
  Synthetic oligonucleotide; GAG chr11 5228634 5228653 5228637 -
gagacaggtagaaaaagtga

SEQ ID NO: 48508 - DNA, 20 bp, Artificial Sequence
  Synthetic oligonucleotide; TAG chr11 5228618 5228637 5228621 -
gtgagagatctctatttatt

SEQ ID NO: 48509 - DNA, 20 bp, Artificial Sequence
  Synthetic oligonucleotide; TAG chr11 5228609 5228628 5228612 -
ctctatttatttagcaataa

SEQ ID NO: 48510 - DNA, 20 bp, Artificial Sequence
  Synthetic oligonucleotide; GAG chr11 5228607 5228626 5228610 -
ctatttatttagcaataata

SEQ ID NO: 48511 - DNA, 20 bp, Artificial Sequence
  Synthetic oligonucleotide; AAG chr11 5228603 5228622 5228606 -
ttatttagcaataatagaga

SEQ ID NO: 48512 - DNA, 20 bp, Artificial Sequence
  Synthetic oligonucleotide; AAG chr11 5228595 5228614 5228598 -
caataatagagaaagcattt

SEQ ID NO: 48513 - DNA, 20 bp, Artificial Sequence
  Synthetic oligonucleotide; GAG chr11 5228593 5228612 5228596 -
ataatagagaaagcatttaa

SEQ ID NO: 48514 - DNA, 20 bp, Artificial Sequence
  Synthetic oligonucleotide; AAG chr11 5228586 5228605 5228589 -
agaaagcatttaagagaata

SEQ ID NO: 48515 - DNA, 20 bp, Artificial Sequence
  Synthetic oligonucleotide; TGG chr11 5228580 5228599 5228583 -
catttaagagaataaagcaa

SEQ ID NO: 48516 - DNA, 20 bp, Artificial Sequence
  Synthetic oligonucleotide; AAG chr11 5228573 5228592 5228576 -
gagaataaagcaatggaaat

SEQ ID NO: 48517 - DNA, 20 bp, Artificial Sequence
  Synthetic oligonucleotide; TAG chr11 5228544 5228563 5228547 -
gtaaatttccttctgataac

SEQ ID NO: 48518 - DNA, 20 bp, Artificial Sequence
  Synthetic oligonucleotide; TAG chr11 5228538 5228557 5228541 -
ttccttctgataactagaaa

SEQ ID NO: 48519 - DNA, 20 bp, Artificial Sequence
  Synthetic oligonucleotide; GAG chr11 5228536 5228555 5228539 -
ccttctgataactagaaata

SEQ ID NO: 48520 - DNA, 20 bp, Artificial Sequence
  Synthetic oligonucleotide; AGG chr11 5228535 5228554 5228538 -
cttctgataactagaaatag

SEQ ID NO: 48521 - DNA, 20 bp, Artificial Sequence
  Synthetic oligonucleotide; CAG chr11 5228529 5228548 5228532 -
ataactagaaatagaggatc

SEQ ID NO: 48522 - DNA, 20 bp, Artificial Sequence
  Synthetic oligonucleotide; TGG chr11 5228519 5228538 5228522 -
atagaggatccagtttcttt

SEQ ID NO: 48523 - DNA, 20 bp, Artificial Sequence
  Synthetic oligonucleotide; TAG chr11 5228450 5228469 5228453 -
tattttattttgtgtaatcg

SEQ ID NO: 48524 - DNA, 20 bp, Artificial Sequence
  Synthetic oligonucleotide; CAG chr11 5228444 5228463 5228447 -
attttgtgtaatcgtagttt

SEQ ID NO: 48525 - DNA, 20 bp, Artificial Sequence
  Synthetic oligonucleotide; GAG chr11 5228442 5228461 5228445 -
tttgtgtaatcgtagtttca

SEQ ID NO: 48526 - DNA, 20 bp, Artificial Sequence
  Synthetic oligonucleotide; TAG chr11 5228436 5228455 5228439 -
taatcgtagtttcagagtgt

SEQ ID NO: 48527 - DNA, 20 bp, Artificial Sequence
  Synthetic oligonucleotide; GAG chr11 5228434 5228453 5228437 -
atcgtagtttcagagtgtta

SEQ ID NO: 48528 - DNA, 20 bp, Artificial Sequence
  Synthetic oligonucleotide; AAG chr11 5228427 5228446 5228430 -
tttcagagtgttagagctga

SEQ ID NO: 48529 - DNA, 20 bp, Artificial Sequence
  Synthetic oligonucleotide; AGG chr11 5228426 5228445 5228429 -
ttcagagtgttagagctgaa

SEQ ID NO: 48530 - DNA, 20 bp, Artificial Sequence
  Synthetic oligonucleotide; AAG chr11 5228423 5228442 5228426 -
agagtgttagagctgaaagg

SEQ ID NO: 48531 - DNA, 20 bp, Artificial Sequence
  Synthetic oligonucleotide; AAG chr11 5228420 5228439 5228423 -
gtgttagagctgaaaggaag

SEQ ID NO: 48532 - DNA, 20 bp, Artificial Sequence
  Synthetic oligonucleotide; TAG chr11 5228417 5228436 5228420 -
ttagagctgaaaggaagaag

SEQ ID NO: 48533 - DNA, 20 bp, Artificial Sequence
  Synthetic oligonucleotide; AGG chr11 5228416 5228435 5228419 -
tagagctgaaaggaagaagt

SEQ ID NO: 48534 - DNA, 20 bp, Artificial Sequence
  Synthetic oligonucleotide; GAG chr11 5228414 5228433 5228417 -
gagctgaaaggaagaagtag

SEQ ID NO: 48535 - DNA, 20 bp, Artificial Sequence
  Synthetic oligonucleotide; AAG chr11 5228402 5228421 5228405 -
agaagtaggagaaacatgca

SEQ ID NO: 48536 - DNA, 20 bp, Artificial Sequence
  Synthetic oligonucleotide; AAG chr11 5228396 5228415 5228399 -
aggagaaacatgcaaagtaa

SEQ ID NO: 48537 - DNA, 20 bp, Artificial Sequence
  Synthetic oligonucleotide; TGG chr11 5228366 5228385 5228369 -
ctttccttactaaaccgaca

SEQ ID NO: 48538 - DNA, 20 bp, Artificial Sequence
  Synthetic oligonucleotide; GGG chr11 5228365 5228384 5228368 -
tttccttactaaaccgacat

SEQ ID NO: 48539 - DNA, 20 bp, Artificial Sequence
  Synthetic oligonucleotide; CAG chr11 5228358 5228377 5228361 -
actaaaccgacatgggtttc

SEQ ID NO: 48540 - DNA, 20 bp, Artificial Sequence
  Synthetic oligonucleotide; AGG chr11 5228357 5228376 5228360 -
ctaaaccgacatgggtttcc

SEQ ID NO: 48541 - DNA, 20 bp, Artificial Sequence
  Synthetic oligonucleotide; TAG chr11 5228354 5228373 5228357 -
aaccgacatgggtttccagg

SEQ ID NO: 48542 - DNA, 20 bp, Artificial Sequence
  Synthetic oligonucleotide; AGG chr11 5228353 5228372 5228356 -
accgacatgggtttccaggt

SEQ ID NO: 48543 - DNA, 20 bp, Artificial Sequence
  Synthetic oligonucleotide; GGG chr11 5228352 5228371 5228355 -
ccgacatgggtttccaggta

SEQ ID NO: 48544 - DNA, 20 bp, Artificial Sequence
  Synthetic oligonucleotide; GGG chr11 5228351 5228370 5228354 -
cgacatgggtttccaggtag

SEQ ID NO: 48545 - DNA, 20 bp, Artificial Sequence
  Synthetic oligonucleotide; CAG chr11 5228348 5228367 5228351 -
catgggtttccaggtagggg

SEQ ID NO: 48546 - DNA, 20 bp, Artificial Sequence
  Synthetic oligonucleotide; AGG chr11 5228347 5228366 5228350 -
atgggtttccaggtaggggc

SEQ ID NO: 48547 - DNA, 20 bp, Artificial Sequence
  Synthetic oligonucleotide; CAG chr11 5228341 5228360 5228344 -
ttccaggtaggggcaggatt

SEQ ID NO: 48548 - DNA, 20 bp, Artificial Sequence
  Synthetic oligonucleotide; AGG chr11 5228340 5228359 5228343 -
tccaggtaggggcaggattc

SEQ ID NO: 48549 - DNA, 20 bp, Artificial Sequence
  Synthetic oligonucleotide; CAG chr11 5228329 5228348 5228332 -
gcaggattcaggatgactga

SEQ ID NO: 48550 - DNA, 20 bp, Artificial Sequence
  Synthetic oligonucleotide; AGG chr11 5228328 5228347 5228331 -
caggattcaggatgactgac

SEQ ID NO: 48551 - DNA, 20 bp, Artificial Sequence
  Synthetic oligonucleotide; GGG chr11 5228327 5228346 5228330 -
aggattcaggatgactgaca

SEQ ID NO: 48552 - DNA, 20 bp, Artificial Sequence
  Synthetic oligonucleotide; TAG chr11 5228320 5228339 5228323 -
aggatgactgacagggccct

SEQ ID NO: 48553 - DNA, 20 bp, Artificial Sequence
  Synthetic oligonucleotide; AGG chr11 5228319 5228338 5228322 -
ggatgactgacagggccctt

SEQ ID NO: 48554 - DNA, 20 bp, Artificial Sequence
  Synthetic oligonucleotide; GGG chr11 5228318 5228337 5228321 -
gatgactgacagggccctta

SEQ ID NO: 48555 - DNA, 20 bp, Artificial Sequence
  Synthetic oligonucleotide; GAG chr11 5228309 5228328 5228312 -
cagggcccttagggaacact

SEQ ID NO: 48556 - DNA, 20 bp, Artificial Sequence
  Synthetic oligonucleotide; TAG chr11 5228248 5228267 5228251 -
gttttaattacatcttttaa

SEQ ID NO: 48557 - DNA, 20 bp, Artificial Sequence
  Synthetic oligonucleotide; CAG chr11 5228245 5228264 5228248 -
ttaattacatcttttaatag

SEQ ID NO: 48558 - DNA, 20 bp, Artificial Sequence
  Synthetic oligonucleotide; AGG chr11 5228244 5228263 5228247 -
taattacatcttttaatagc

SEQ ID NO: 48559 - DNA, 20 bp, Artificial Sequence
  Synthetic oligonucleotide; AAG chr11 5228241 5228260 5228244 -
ttacatcttttaatagcagg

SEQ ID NO: 48560 - DNA, 20 bp, Artificial Sequence
  Synthetic oligonucleotide; CAG chr11 5228238 5228257 5228241 -
catcttttaatagcaggaag

SEQ ID NO: 48561 - DNA, 20 bp, Artificial Sequence
  Synthetic oligonucleotide; AAG chr11 5228220 5228239 5228223 -
agcagaactctgcacttcaa

SEQ ID NO: 48562 - DNA, 20 bp, Artificial Sequence
  Synthetic oligonucleotide; GAG chr11 5228204 5228223 5228207 -
tcaaaagtttttcctcacct

SEQ ID NO: 48563 - DNA, 20 bp, Artificial Sequence
  Synthetic oligonucleotide; AGG chr11 5228203 5228222 5228206 -
caaaagtttttcctcacctg

SEQ ID NO: 48564 - DNA, 20 bp, Artificial Sequence
  Synthetic oligonucleotide; GAG chr11 5228201 5228220 5228204 -
aaagtttttcctcacctgag

SEQ ID NO: 48565 - DNA, 20 bp, Artificial Sequence
  Synthetic oligonucleotide; TAG chr11 5228192 5228211 5228195 -
cctcacctgaggagttaatt

SEQ ID NO: 48566 - DNA, 20 bp, Artificial Sequence
  Synthetic oligonucleotide; AAG chr11 5228186 5228205 5228189 -
ctgaggagttaatttagtac

SEQ ID NO: 48567 - DNA, 20 bp, Artificial Sequence
  Synthetic oligonucleotide; AGG chr11 5228185 5228204 5228188 -
tgaggagttaatttagtaca

SEQ ID NO: 48568 - DNA, 20 bp, Artificial Sequence
  Synthetic oligonucleotide; GGG chr11 5228184 5228203 5228187 -
gaggagttaatttagtacaa

SEQ ID NO: 48569 - DNA, 20 bp, Artificial Sequence
  Synthetic oligonucleotide; GGG chr11 5228183 5228202 5228186 -
aggagttaatttagtacaag

SEQ ID NO: 48570 - DNA, 20 bp, Artificial Sequence
  Synthetic oligonucleotide; AAG chr11 5228177 5228196 5228180 -
taatttagtacaaggggaaa

SEQ ID NO: 48571 - DNA, 20 bp, Artificial Sequence
  Synthetic oligonucleotide; CAG chr11 5228172 5228191 5228175 -
tagtacaaggggaaaaagta

SEQ ID NO: 48572 - DNA, 20 bp, Artificial Sequence
  Synthetic oligonucleotide; AGG chr11 5228171 5228190 5228174 -
agtacaaggggaaaaagtac

SEQ ID NO: 48573 - DNA, 20 bp, Artificial Sequence
  Synthetic oligonucleotide; GGG chr11 5228170 5228189 5228173 -
gtacaaggggaaaaagtaca

SEQ ID NO: 48574 - DNA, 20 bp, Artificial Sequence
  Synthetic oligonucleotide; GGG chr11 5228169 5228188 5228172 -
tacaaggggaaaaagtacag

SEQ ID NO: 48575 - DNA, 20 bp, Artificial Sequence
  Synthetic oligonucleotide; GGG chr11 5228168 5228187 5228171 -
acaaggggaaaaagtacagg

SEQ ID NO: 48576 - DNA, 20 bp, Artificial Sequence
  Synthetic oligonucleotide; TGG chr11 5228164 5228183 5228167 -
ggggaaaaagtacaggggga

SEQ ID NO: 48577 - DNA, 20 bp, Artificial Sequence
  Synthetic oligonucleotide; GGG chr11 5228163 5228182 5228166 -
gggaaaaagtacagggggat

SEQ ID NO: 48578 - DNA, 20 bp, Artificial Sequence
  Synthetic oligonucleotide; GAG chr11 5228161 5228180 5228164 -
gaaaaagtacagggggatgg

SEQ ID NO: 48579 - DNA, 20 bp, Artificial Sequence
  Synthetic oligonucleotide; AAG chr11 5228157 5228176 5228160 -
aagtacagggggatgggaga

SEQ ID NO: 48580 - DNA, 20 bp, Artificial Sequence
  Synthetic oligonucleotide; AGG chr11 5228156 5228175 5228159 -
agtacagggggatgggagaa

SEQ ID NO: 48581 - DNA, 20 bp, Artificial Sequence
  Synthetic oligonucleotide; TGG chr11 5228144 5228163 5228147 -
tgggagaaaggcgatcacgt

SEQ ID NO: 48582 - DNA, 20 bp, Artificial Sequence
  Synthetic oligonucleotide; GGG chr11 5228143 5228162 5228146 -
gggagaaaggcgatcacgtt

SEQ ID NO: 48583 - DNA, 20 bp, Artificial Sequence
  Synthetic oligonucleotide; AAG chr11 5228140 5228159 5228143 -
agaaaggcgatcacgttggg

SEQ ID NO: 48584 - DNA, 20 bp, Artificial Sequence
  Synthetic oligonucleotide; TAG chr11 5228134 5228153 5228137 -
gcgatcacgttgggaagcta

SEQ ID NO: 48585 - DNA, 20 bp, Artificial Sequence
  Synthetic oligonucleotide; GAG chr11 5228132 5228151 5228135 -
gatcacgttgggaagctata

SEQ ID NO: 48586 - DNA, 20 bp, Artificial Sequence
  Synthetic oligonucleotide; AAG chr11 5228128 5228147 5228131 -
acgttgggaagctatagaga

SEQ ID NO: 48587 - DNA, 20 bp, Artificial Sequence
  Synthetic oligonucleotide; AAG chr11 5228125 5228144 5228128 -
ttgggaagctatagagaaag

SEQ ID NO: 48588 - DNA, 20 bp, Artificial Sequence
  Synthetic oligonucleotide; GAG chr11 5228123 5228142 5228126 -
gggaagctatagagaaagaa

SEQ ID NO: 48589 - DNA, 20 bp, Artificial Sequence
  Synthetic oligonucleotide; TAG chr11 5228113 5228132 5228116 -
agagaaagaagagtaaattt

SEQ ID NO: 48590 - DNA, 20 bp, Artificial Sequence
  Synthetic oligonucleotide; AAG chr11 5228108 5228127 5228111 -
aagaagagtaaattttagta

SEQ ID NO: 48591 - DNA, 20 bp, Artificial Sequence
  Synthetic oligonucleotide; AGG chr11 5228107 5228126 5228110 -
agaagagtaaattttagtaa

SEQ ID NO: 48592 - DNA, 20 bp, Artificial Sequence
  Synthetic oligonucleotide; GAG chr11 5228105 5228124 5228108 -
aagagtaaattttagtaaag

SEQ ID NO: 48593 - DNA, 20 bp, Artificial Sequence
  Synthetic oligonucleotide; AGG chr11 5228104 5228123 5228107 -
agagtaaattttagtaaagg

SEQ ID NO: 48594 - DNA, 20 bp, Artificial Sequence
  Synthetic oligonucleotide; AAG chr11 5228082 5228101 5228085 -
gtttaaacaaacaaaatata

SEQ ID NO: 48595 - DNA, 20 bp, Artificial Sequence
  Synthetic oligonucleotide; GAG chr11 5228080 5228099 5228083 -
ttaaacaaacaaaatataaa

SEQ ID NO: 48596 - DNA, 20 bp, Artificial Sequence
  Synthetic oligonucleotide; TAG chr11 5228074 5228093 5228077 -
aaacaaaatataaagagaaa

SEQ ID NO: 48597 - DNA, 20 bp, Artificial Sequence
  Synthetic oligonucleotide; AGG chr11 5228073 5228092 5228076 -
aacaaaatataaagagaaat

SEQ ID NO: 48598 - DNA, 20 bp, Artificial Sequence
  Synthetic oligonucleotide; AAG chr11 5228060 5228079 5228063 -
gagaaataggaacttgaatc

SEQ ID NO: 48599 - DNA, 20 bp, Artificial Sequence
  Synthetic oligonucleotide; AGG chr11 5228059 5228078 5228062 -
agaaataggaacttgaatca

SEQ ID NO: 48600 - DNA, 20 bp, Artificial Sequence
  Synthetic oligonucleotide; CAG chr11 5228040 5228059 5228043 -
aaggaaatgattttaaaacg

SEQ ID NO: 48601 - DNA, 20 bp, Artificial Sequence
  Synthetic oligonucleotide; TAG chr11 5228031 5228050 5228034 -
attttaaaacgcagtattct

SEQ ID NO: 48602 - DNA, 20 bp, Artificial Sequence
  Synthetic oligonucleotide; TGG chr11 5228028 5228047 5228031 -
ttaaaacgcagtattcttag

SEQ ID NO: 48603 - DNA, 20 bp, Artificial Sequence
  Synthetic oligonucleotide; TAG chr11 5228023 5228042 5228026 -
acgcagtattcttagtggac

SEQ ID NO: 48604 - DNA, 20 bp, Artificial Sequence
  Synthetic oligonucleotide; GAG chr11 5228021 5228040 5228024 -
gcagtattcttagtggacta

SEQ ID NO: 48605 - DNA, 20 bp, Artificial Sequence
  Synthetic oligonucleotide; AGG chr11 5228020 5228039 5228023 -
cagtattcttagtggactag

SEQ ID NO: 48606 - DNA, 20 bp, Artificial Sequence
  Synthetic oligonucleotide; GAG chr11 5228004 5228023 5228007 -
ctagaggaaaaaaataatct

SEQ ID NO: 48607 - DNA, 20 bp, Artificial Sequence
  Synthetic oligonucleotide; AAG chr11 5227999 5228018 5228002 -
ggaaaaaaataatctgagcc

SEQ ID NO: 48608 - DNA, 20 bp, Artificial Sequence
  Synthetic oligonucleotide; TAG chr11 5227996 5228015 5227999 -
aaaaaataatctgagccaag

SEQ ID NO: 48609 - DNA, 20 bp, Artificial Sequence
  Synthetic oligonucleotide; AAG chr11 5227993 5228012 5227996 -
aaataatctgagccaagtag

SEQ ID NO: 48610 - DNA, 20 bp, Artificial Sequence
  Synthetic oligonucleotide; AAG chr11 5227962 5227981 5227965 -
ccctcctacccctactttct

SEQ ID NO: 48611 - DNA, 20 bp, Artificial Sequence
  Synthetic oligonucleotide; CAG chr11 5227956 5227975 5227959 -
tacccctactttctaagtca

SEQ ID NO: 48612 - DNA, 20 bp, Artificial Sequence
  Synthetic oligonucleotide; GAG chr11 5227954 5227973 5227957 -
cccctactttctaagtcaca

SEQ ID NO: 48613 - DNA, 20 bp, Artificial Sequence
  Synthetic oligonucleotide; AGG chr11 5227953 5227972 5227956 -
ccctactttctaagtcacag

SEQ ID NO: 48614 - DNA, 20 bp, Artificial Sequence
  Synthetic oligonucleotide; CAG chr11 5227937 5227956 5227940 -
acagaggctttttgttcccc

SEQ ID NO: 48615 - DNA, 20 bp, Artificial Sequence
  Synthetic oligonucleotide; CAG chr11 5227925 5227944 5227928 -
tgttcccccagacactcttg

SEQ ID NO: 48616 - DNA, 20 bp, Artificial Sequence
  Synthetic oligonucleotide; TAG chr11 5227920 5227939 5227923 -
ccccagacactcttgcagat

SEQ ID NO: 48617 - DNA, 20 bp, Artificial Sequence
  Synthetic oligonucleotide; CAG chr11 5227915 5227934 5227918 -
gacactcttgcagattagtc

SEQ ID NO: 48618 - DNA, 20 bp, Artificial Sequence
  Synthetic oligonucleotide; AGG chr11 5227914 5227933 5227917 -
acactcttgcagattagtcc

SEQ ID NO: 48619 - DNA, 20 bp, Artificial Sequence
  Synthetic oligonucleotide; CAG chr11 5227911 5227930 5227914 -
ctcttgcagattagtccagg

SEQ ID NO: 48620 - DNA, 20 bp, Artificial Sequence
  Synthetic oligonucleotide; CAG chr11 5227905 5227924 5227908 -
cagattagtccaggcagaaa

SEQ ID NO: 48621 - DNA, 20 bp, Artificial Sequence
  Synthetic oligonucleotide; TAG chr11 5227901 5227920 5227904 -
ttagtccaggcagaaacagt

SEQ ID NO: 48622 - DNA, 20 bp, Artificial Sequence
  Synthetic oligonucleotide; CAG chr11 5227891 5227910 5227894 -
cagaaacagttagatgtccc

SEQ ID NO: 48623 - DNA, 20 bp, Artificial Sequence
  Synthetic oligonucleotide; TAG chr11 5227851 5227870 5227854 -
accactgattaccccattga

SEQ ID NO: 48624 - DNA, 20 bp, Artificial Sequence
  Synthetic oligonucleotide; TGG chr11 5227840 5227859 5227843 -
ccccattgatagtcacactt

SEQ ID NO: 48625 - DNA, 20 bp, Artificial Sequence
  Synthetic oligonucleotide; GGG chr11 5227839 5227858 5227842 -
cccattgatagtcacacttt

SEQ ID NO: 48626 - DNA, 20 bp, Artificial Sequence
  Synthetic oligonucleotide; AAG chr11 5227832 5227851 5227835 -
atagtcacactttgggttgt

SEQ ID NO: 48627 - DNA, 20 bp, Artificial Sequence
  Synthetic oligonucleotide; AAG chr11 5227795 5227814 5227798 -
tttgtatttttgactgcatt

SEQ ID NO: 48628 - DNA, 20 bp, Artificial Sequence
  Synthetic oligonucleotide; GAG chr11 5227793 5227812 5227796 -
tgtatttttgactgcattaa

SEQ ID NO: 48629 - DNA, 20 bp, Artificial Sequence
  Synthetic oligonucleotide; AGG chr11 5227792 5227811 5227795 -
gtatttttgactgcattaag

SEQ ID NO: 48630 - DNA, 20 bp, Artificial Sequence
  Synthetic oligonucleotide; TAG chr11 5227785 5227804 5227788 -
tgactgcattaagaggtctc

SEQ ID NO: 48631 - DNA, 20 bp, Artificial Sequence
  Synthetic oligonucleotide; AAG chr11 5227752 5227771 5227755 -
cttgtttcccaaaacctaat

SEQ ID NO: 48632 - DNA, 20 bp, Artificial Sequence
  Synthetic oligonucleotide; CAG chr11 5227738 5227757 5227741 -
cctaataagtaactaatgca

SEQ ID NO: 48633 - DNA, 20 bp, Artificial Sequence
  Synthetic oligonucleotide; GAG chr11 5227736 5227755 5227739 -
taataagtaactaatgcaca

SEQ ID NO: 48634 - DNA, 20 bp, Artificial Sequence
  Synthetic oligonucleotide; TAG chr11 5227706 5227725 5227709 -
atttgtatttattctatttt

SEQ ID NO: 48635 - DNA, 20 bp, Artificial Sequence
  Synthetic oligonucleotide; TAG chr11 5227692 5227711 5227695 -
tatttttagacataatttat

SEQ ID NO: 48636 - DNA, 20 bp, Artificial Sequence
  Synthetic oligonucleotide; GAG chr11 5227682 5227701 5227685 -
cataatttattagcatgcat

SEQ ID NO: 48637 - DNA, 20 bp, Artificial Sequence
  Synthetic oligonucleotide; AAG chr11 5227673 5227692 5227676 -
ttagcatgcatgagcaaatt

SEQ ID NO: 48638 - DNA, 20 bp, Artificial Sequence
  Synthetic oligonucleotide; CAG chr11 5227583 5227602 5227586 -
tatattttttcttttcttac

SEQ ID NO: 48639 - DNA, 20 bp, Artificial Sequence
  Synthetic oligonucleotide; AAG chr11 5227580 5227599 5227583 -
attttttcttttcttaccag

SEQ ID NO: 48640 - DNA, 20 bp, Artificial Sequence
  Synthetic oligonucleotide; AGG chr11 5227579 5227598 5227582 -
ttttttcttttcttaccaga

SEQ ID NO: 48641 - DNA, 20 bp, Artificial Sequence
  Synthetic oligonucleotide; AAG chr11 5227563 5227582 5227566 -
cagaaggttttaatccaaat

SEQ ID NO: 48642 - DNA, 20 bp, Artificial Sequence
  Synthetic oligonucleotide; AGG chr11 5227562 5227581 5227565 -
agaaggttttaatccaaata

SEQ ID NO: 48643 - DNA, 20 bp, Artificial Sequence
  Synthetic oligonucleotide; GAG chr11 5227560 5227579 5227563 -
aaggttttaatccaaataag

SEQ ID NO: 48644 - DNA, 20 bp, Artificial Sequence
  Synthetic oligonucleotide; AAG chr11 5227557 5227576 5227560 -
gttttaatccaaataaggag

SEQ ID NO: 48645 - DNA, 20 bp, Artificial Sequence
  Synthetic oligonucleotide; TAG chr11 5227547 5227566 5227550 -
aaataaggagaagatatgct

SEQ ID NO: 48646 - DNA, 20 bp, Artificial Sequence
  Synthetic oligonucleotide; GAG chr11 5227540 5227559 5227543 -
gagaagatatgcttagaacc

SEQ ID NO: 48647 - DNA, 20 bp, Artificial Sequence
  Synthetic oligonucleotide; AGG chr11 5227539 5227558 5227542 -
agaagatatgcttagaaccg

SEQ ID NO: 48648 - DNA, 20 bp, Artificial Sequence
  Synthetic oligonucleotide; TAG chr11 5227536 5227555 5227539 -
agatatgcttagaaccgagg

SEQ ID NO: 48649 - DNA, 20 bp, Artificial Sequence
  Synthetic oligonucleotide; GAG chr11 5227534 5227553 5227537 -
atatgcttagaaccgaggta

SEQ ID NO: 48650 - DNA, 20 bp, Artificial Sequence
  Synthetic oligonucleotide; AAG chr11 5227510 5227529 5227513 -
tttcatccattctgtcctgt

SEQ ID NO: 48651 - DNA, 20 bp, Artificial Sequence
  Synthetic oligonucleotide; TGG chr11 5227493 5227512 5227496 -
tgtaagtattttgcatattc

SEQ ID NO: 48652 - DNA, 20 bp, Artificial Sequence
  Synthetic oligonucleotide; GAG chr11 5227491 5227510 5227494 -
taagtattttgcatattctg

SEQ ID NO: 48653 - DNA, 20 bp, Artificial Sequence
  Synthetic oligonucleotide; CAG chr11 5227485 5227504 5227488 -
ttttgcatattctggagacg

SEQ ID NO: 48654 - DNA, 20 bp, Artificial Sequence
  Synthetic oligonucleotide; AGG chr11 5227484 5227503 5227487 -
tttgcatattctggagacgc

SEQ ID NO: 48655 - DNA, 20 bp, Artificial Sequence
  Synthetic oligonucleotide; AAG chr11 5227481 5227500 5227484 -
gcatattctggagacgcagg

SEQ ID NO: 48656 - DNA, 20 bp, Artificial Sequence
  Synthetic oligonucleotide; GAG chr11 5227479 5227498 5227482 -
atattctggagacgcaggaa

SEQ ID NO: 48657 - DNA, 20 bp, Artificial Sequence
  Synthetic oligonucleotide; AAG chr11 5227458 5227477 5227461 -
agatccatctacatatccca

SEQ ID NO: 48658 - DNA, 20 bp, Artificial Sequence
  Synthetic oligonucleotide; TGG chr11 5227447 5227466 5227450 -
catatcccaaagctgaatta

SEQ ID NO: 48659 - DNA, 20 bp, Artificial Sequence
  Synthetic oligonucleotide; TAG chr11 5227444 5227463 5227447 -
atcccaaagctgaattatgg

SEQ ID NO: 48660 - DNA, 20 bp, Artificial Sequence
  Synthetic oligonucleotide; TAG chr11 5227423 5227442 5227426 -
agacaaaactcttccacttt

SEQ ID NO: 48661 - DNA, 20 bp, Artificial Sequence
  Synthetic oligonucleotide; AAG chr11 5227395 5227414 5227398 -
caacttcttatttgtgtaat

SEQ ID NO: 48662 - DNA, 20 bp, Artificial Sequence
  Synthetic oligonucleotide; TGG chr11 5227387 5227406 5227390 -
tatttgtgtaataagaaaat

SEQ ID NO: 48663 - DNA, 20 bp, Artificial Sequence
  Synthetic oligonucleotide; GGG chr11 5227386 5227405 5227389 -
atttgtgtaataagaaaatt

SEQ ID NO: 48664 - DNA, 20 bp, Artificial Sequence
  Synthetic oligonucleotide; AAG chr11 5227359 5227378 5227362 -
cgatcttcaatatgcttacc

SEQ ID NO: 48665 - DNA, 20 bp, Artificial Sequence
  Synthetic oligonucleotide; AAG chr11 5227322 5227341 5227325 -
attacgtaaatacacttgca

SEQ ID NO: 48666 - DNA, 20 bp, Artificial Sequence
  Synthetic oligonucleotide; AGG chr11 5227321 5227340 5227324 -
ttacgtaaatacacttgcaa

SEQ ID NO: 48667 - DNA, 20 bp, Artificial Sequence
  Synthetic oligonucleotide; GAG chr11 5227319 5227338 5227322 -
acgtaaatacacttgcaaag

SEQ ID NO: 48668 - DNA, 20 bp, Artificial Sequence
  Synthetic oligonucleotide; AGG chr11 5227318 5227337 5227321 -
cgtaaatacacttgcaaagg

SEQ ID NO: 48669 - DNA, 20 bp, Artificial Sequence
  Synthetic oligonucleotide; TAG chr11 5227308 5227327 5227311 -
cttgcaaaggaggatgtttt

SEQ ID NO: 48670 - DNA, 20 bp, Artificial Sequence
  Synthetic oligonucleotide; TAG chr11 5227305 5227324 5227308 -
gcaaaggaggatgtttttag

SEQ ID NO: 48671 - DNA, 20 bp, Artificial Sequence
  Synthetic oligonucleotide; TGG chr11 5227289 5227308 5227292 -
ttagtagcaatttgtactga

SEQ ID NO: 48672 - DNA, 20 bp, Artificial Sequence
  Synthetic oligonucleotide; TGG chr11 5227284 5227303 5227287 -
agcaatttgtactgatggta

SEQ ID NO: 48673 - DNA, 20 bp, Artificial Sequence
  Synthetic oligonucleotide; GGG chr11 5227283 5227302 5227286 -
gcaatttgtactgatggtat

SEQ ID NO: 48674 - DNA, 20 bp, Artificial Sequence
  Synthetic oligonucleotide; GGG chr11 5227282 5227301 5227285 -
caatttgtactgatggtatg

SEQ ID NO: 48675 - DNA, 20 bp, Artificial Sequence
  Synthetic oligonucleotide; AAG chr11 5227277 5227296 5227280 -
tgtactgatggtatggggcc

SEQ ID NO: 48676 - DNA, 20 bp, Artificial Sequence
  Synthetic oligonucleotide; GAG chr11 5227275 5227294 5227278 -
tactgatggtatggggccaa

SEQ ID NO: 48677 - DNA, 20 bp, Artificial Sequence
  Synthetic oligonucleotide; TAG chr11 5227264 5227283 5227267 -
tggggccaagagatatatct

SEQ ID NO: 48678 - DNA, 20 bp, Artificial Sequence
  Synthetic oligonucleotide; GAG chr11 5227262 5227281 5227265 -
gggccaagagatatatctta

SEQ ID NO: 48679 - DNA, 20 bp, Artificial Sequence
  Synthetic oligonucleotide; AGG chr11 5227261 5227280 5227264 -
ggccaagagatatatcttag

SEQ ID NO: 48680 - DNA, 20 bp, Artificial Sequence
  Synthetic oligonucleotide; GGG chr11 5227260 5227279 5227263 -
gccaagagatatatcttaga

SEQ ID NO: 48681 - DNA, 20 bp, Artificial Sequence
  Synthetic oligonucleotide; GAG chr11 5227258 5227277 5227261 -
caagagatatatcttagagg

SEQ ID NO: 48682 - DNA, 20 bp, Artificial Sequence
  Synthetic oligonucleotide; AGG chr11 5227257 5227276 5227260 -
aagagatatatcttagaggg

SEQ ID NO: 48683 - DNA, 20 bp, Artificial Sequence
  Synthetic oligonucleotide; GGG chr11 5227256 5227275 5227259 -
agagatatatcttagaggga

SEQ ID NO: 48684 - DNA, 20 bp, Artificial Sequence
  Synthetic oligonucleotide; GAG chr11 5227251 5227270 5227254 -
tatatcttagagggagggct

SEQ ID NO: 48685 - DNA, 20 bp, Artificial Sequence
  Synthetic oligonucleotide; AGG chr11 5227250 5227269 5227253 -
atatcttagagggagggctg

SEQ ID NO: 48686 - DNA, 20 bp, Artificial Sequence
  Synthetic oligonucleotide; GGG chr11 5227249 5227268 5227252 -
tatcttagagggagggctga

SEQ ID NO: 48687 - DNA, 20 bp, Artificial Sequence
  Synthetic oligonucleotide; AAG chr11 5227242 5227261 5227245 -
gagggagggctgagggtttg

SEQ ID NO: 48688 - DNA, 20 bp, Artificial Sequence
  Synthetic oligonucleotide; AAG chr11 5227229 5227248 5227232 -
gggtttgaagtccaactcct

SEQ ID NO: 48689 - DNA, 20 bp, Artificial Sequence
  Synthetic oligonucleotide; CAG chr11 5227225 5227244 5227228 -
ttgaagtccaactcctaagc

SEQ ID NO: 48690 - DNA, 20 bp, Artificial Sequence
  Synthetic oligonucleotide; CAG chr11 5227219 5227238 5227222 -
tccaactcctaagccagtgc

SEQ ID NO: 48691 - DNA, 20 bp, Artificial Sequence
  Synthetic oligonucleotide; AAG chr11 5227216 5227235 5227219 -
aactcctaagccagtgccag

SEQ ID NO: 48692 - DNA, 20 bp, Artificial Sequence
  Synthetic oligonucleotide; GAG chr11 5227214 5227233 5227217 -
ctcctaagccagtgccagaa

SEQ ID NO: 48693 - DNA, 20 bp, Artificial Sequence
  Synthetic oligonucleotide; AAG chr11 5227209 5227228 5227212 -
aagccagtgccagaagagcc

SEQ ID NO: 48694 - DNA, 20 bp, Artificial Sequence
  Synthetic oligonucleotide; AGG chr11 5227208 5227227 5227211 -
agccagtgccagaagagcca

SEQ ID NO: 48695 - DNA, 20 bp, Artificial Sequence
  Synthetic oligonucleotide; CAG chr11 5227204 5227223 5227207 -
agtgccagaagagccaagga

SEQ ID NO: 48696 - DNA, 20 bp, Artificial Sequence
  Synthetic oligonucleotide; AGG chr11 5227203 5227222 5227206 -
gtgccagaagagccaaggac

SEQ ID NO: 48697 - DNA, 20 bp, Artificial Sequence
  Synthetic oligonucleotide; CGG chr11 5227198 5227217 5227201 -
agaagagccaaggacaggta

SEQ ID NO: 48698 - DNA, 20 bp, Artificial Sequence
  Synthetic oligonucleotide; TAG chr11 5227184 5227203 5227187 -
caggtacggctgtcatcact

SEQ ID NO: 48699 - DNA, 20 bp, Artificial Sequence
  Synthetic oligonucleotide; TGG chr11 5227170 5227189 5227173 -
atcacttagacctcaccctg

SEQ ID NO: 48700 - DNA, 20 bp, Artificial Sequence
  Synthetic oligonucleotide; GAG chr11 5227168 5227187 5227171 -
cacttagacctcaccctgtg

SEQ ID NO: 48701 - DNA, 20 bp, Artificial Sequence
  Synthetic oligonucleotide; TAG chr11 5227157 5227176 5227160 -
caccctgtggagccacaccc

SEQ ID NO: 48702 - DNA, 20 bp, Artificial Sequence
  Synthetic oligonucleotide; AGG chr11 5227156 5227175 5227159 -
accctgtggagccacaccct

SEQ ID NO: 48703 - DNA, 20 bp, Artificial Sequence
  Synthetic oligonucleotide; GGG chr11 5227155 5227174 5227158 -
ccctgtggagccacacccta

SEQ ID NO: 48704 - DNA, 20 bp, Artificial Sequence
  Synthetic oligonucleotide; TGG chr11 5227151 5227170 5227154 -
gtggagccacaccctagggt

SEQ ID NO: 48705 - DNA, 20 bp, Artificial Sequence
  Synthetic oligonucleotide; CAG chr11 5227136 5227155 5227139 -
agggttggccaatctactcc

SEQ ID NO: 48706 - DNA, 20 bp, Artificial Sequence
  Synthetic oligonucleotide; AGG chr11 5227135 5227154 5227138 -
gggttggccaatctactccc

SEQ ID NO: 48707 - DNA, 20 bp, Artificial Sequence
  Synthetic oligonucleotide; GAG chr11 5227133 5227152 5227136 -
gttggccaatctactcccag

SEQ ID NO: 48708 - DNA, 20 bp, Artificial Sequence
  Synthetic oligonucleotide; CAG chr11 5227130 5227149 5227133 -
ggccaatctactcccaggag

SEQ ID NO: 48709 - DNA, 20 bp, Artificial Sequence
  Synthetic oligonucleotide; AGG chr11 5227129 5227148 5227132 -
gccaatctactcccaggagc

SEQ ID NO: 48710 - DNA, 20 bp, Artificial Sequence
  Synthetic oligonucleotide; GGG chr11 5227128 5227147 5227131 -
ccaatctactcccaggagca

SEQ ID NO: 48711 - DNA, 20 bp, Artificial Sequence
  Synthetic oligonucleotide; GAG chr11 5227126 5227145 5227129 -
aatctactcccaggagcagg

SEQ ID NO: 48712 - DNA, 20 bp, Artificial Sequence
  Synthetic oligonucleotide; AGG chr11 5227125 5227144 5227128 -
atctactcccaggagcaggg

SEQ ID NO: 48713 - DNA, 20 bp, Artificial Sequence
  Synthetic oligonucleotide; GGG chr11 5227124 5227143 5227127 -
tctactcccaggagcaggga

SEQ ID NO: 48714 - DNA, 20 bp, Artificial Sequence
  Synthetic oligonucleotide; CAG chr11 5227121 5227140 5227124 -
actcccaggagcagggaggg

SEQ ID NO: 48715 - DNA, 20 bp, Artificial Sequence
  Synthetic oligonucleotide; AGG chr11 5227120 5227139 5227123 -
ctcccaggagcagggagggc

SEQ ID NO: 48716 - DNA, 20 bp, Artificial Sequence
  Synthetic oligonucleotide; GAG chr11 5227118 5227137 5227121 -
cccaggagcagggagggcag

SEQ ID NO: 48717 - DNA, 20 bp, Artificial Sequence
  Synthetic oligonucleotide; CAG chr11 5227114 5227133 5227117 -
ggagcagggagggcaggagc

SEQ ID NO: 48718 - DNA, 20 bp, Artificial Sequence
  Synthetic oligonucleotide; AGG chr11 5227113 5227132 5227116 -
gagcagggagggcaggagcc

SEQ ID NO: 48719 - DNA, 20 bp, Artificial Sequence
  Synthetic oligonucleotide; GGG chr11 5227112 5227131 5227115 -
agcagggagggcaggagcca

SEQ ID NO: 48720 - DNA, 20 bp, Artificial Sequence
  Synthetic oligonucleotide; TGG chr11 5227108 5227127 5227111 -
gggagggcaggagccagggc

SEQ ID NO: 48721 - DNA, 20 bp, Artificial Sequence
  Synthetic oligonucleotide; GGG chr11 5227107 5227126 5227110 -
ggagggcaggagccagggct

SEQ ID NO: 48722 - DNA, 20 bp, Artificial Sequence
  Synthetic oligonucleotide; AAG chr11 5227099 5227118 5227102 -
ggagccagggctgggcataa

SEQ ID NO: 48723 - DNA, 20 bp, Artificial Sequence
  Synthetic oligonucleotide; CAG chr11 5227095 5227114 5227098 -
ccagggctgggcataaaagt

SEQ ID NO: 48724 - DNA, 20 bp, Artificial Sequence
  Synthetic oligonucleotide; AGG chr11 5227094 5227113 5227097 -
cagggctgggcataaaagtc

SEQ ID NO: 48725 - DNA, 20 bp, Artificial Sequence
  Synthetic oligonucleotide; GGG chr11 5227093 5227112 5227096 -
agggctgggcataaaagtca

SEQ ID NO: 48726 - DNA, 20 bp, Artificial Sequence
  Synthetic oligonucleotide; CAG chr11 5227090 5227109 5227093 -
gctgggcataaaagtcaggg

SEQ ID NO: 48727 - DNA, 20 bp, Artificial Sequence
  Synthetic oligonucleotide; GAG chr11 5227088 5227107 5227091 -
tgggcataaaagtcagggca

SEQ ID NO: 48728 - DNA, 20 bp, Artificial Sequence
  Synthetic oligonucleotide; TAG chr11 5227043 5227062 5227046 -
tctgacacaactgtgttcac

SEQ ID NO: 48729 - DNA, 20 bp, Artificial Sequence
  Synthetic oligonucleotide; CAG chr11 5227030 5227049 5227033 -
tgttcactagcaacctcaaa

SEQ ID NO: 48730 - DNA, 20 bp, Artificial Sequence
  Synthetic oligonucleotide; TGG chr11 5227021 5227040 5227024 -
gcaacctcaaacagacacca

SEQ ID NO: 48731 - DNA, 20 bp, Artificial Sequence
  Synthetic oligonucleotide; GAG chr11 5227004 5227023 5227007 -
ccatggtgcatctgactcct

SEQ ID NO: 48732 - DNA, 20 bp, Artificial Sequence
  Synthetic oligonucleotide; AGG chr11 5227003 5227022 5227006 -
catggtgcatctgactcctg

SEQ ID NO: 48733 - DNA, 20 bp, Artificial Sequence
  Synthetic oligonucleotide; GAG chr11 5227001 5227020 5227004 -
tggtgcatctgactcctgag

SEQ ID NO: 48734 - DNA, 20 bp, Artificial Sequence
  Synthetic oligonucleotide; AAG chr11 5226998 5227017 5227001 -
tgcatctgactcctgaggag

SEQ ID NO: 48735 - DNA, 20 bp, Artificial Sequence
  Synthetic oligonucleotide; TGG chr11 5226977 5226996 5226980 -
agtctgccgttactgccctg

SEQ ID NO: 48736 - DNA, 20 bp, Artificial Sequence
  Synthetic oligonucleotide; GGG chr11 5226976 5226995 5226979 -
gtctgccgttactgccctgt

SEQ ID NO: 48737 - DNA, 20 bp, Artificial Sequence
  Synthetic oligonucleotide; GGG chr11 5226975 5226994 5226978 -
tctgccgttactgccctgtg

SEQ ID NO: 48738 - DNA, 20 bp, Artificial Sequence
  Synthetic oligonucleotide; AAG chr11 5226971 5226990 5226974 -
ccgttactgccctgtggggc

SEQ ID NO: 48739 - DNA, 20 bp, Artificial Sequence
  Synthetic oligonucleotide; AGG chr11 5226970 5226989 5226973 -
cgttactgccctgtggggca

SEQ ID NO: 48740 - DNA, 20 bp, Artificial Sequence
  Synthetic oligonucleotide; TGG chr11 5226961 5226980 5226964 -
cctgtggggcaaggtgaacg

SEQ ID NO: 48741 - DNA, 20 bp, Artificial Sequence
  Synthetic oligonucleotide; AAG chr11 5226955 5226974 5226958 -
gggcaaggtgaacgtggatg

SEQ ID NO: 48742 - DNA, 20 bp, Artificial Sequence
  Synthetic oligonucleotide; TGG chr11 5226951 5226970 5226954 -
aaggtgaacgtggatgaagt

SEQ ID NO: 48743 - DNA, 20 bp, Artificial Sequence
  Synthetic oligonucleotide; TGG chr11 5226948 5226967 5226951 -
gtgaacgtggatgaagttgg

SEQ ID NO: 48744 - DNA, 20 bp, Artificial Sequence
  Synthetic oligonucleotide; GAG chr11 5226944 5226963 5226947 -
acgtggatgaagttggtggt

SEQ ID NO: 48745 - DNA, 20 bp, Artificial Sequence
  Synthetic oligonucleotide; AGG chr11 5226943 5226962 5226946 -
cgtggatgaagttggtggtg

SEQ ID NO: 48746 - DNA, 20 bp, Artificial Sequence
  Synthetic oligonucleotide; TGG chr11 5226937 5226956 5226940 -
tgaagttggtggtgaggccc

SEQ ID NO: 48747 - DNA, 20 bp, Artificial Sequence
  Synthetic oligonucleotide; GGG chr11 5226936 5226955 5226939 -
gaagttggtggtgaggccct

SEQ ID NO: 48748 - DNA, 20 bp, Artificial Sequence
  Synthetic oligonucleotide; CAG chr11 5226933 5226952 5226936 -
gttggtggtgaggccctggg

SEQ ID NO: 48749 - DNA, 20 bp, Artificial Sequence
  Synthetic oligonucleotide; AGG chr11 5226932 5226951 5226935 -
ttggtggtgaggccctgggc

SEQ ID NO: 48750 - DNA, 20 bp, Artificial Sequence
  Synthetic oligonucleotide; TGG chr11 5226928 5226947 5226931 -
tggtgaggccctgggcaggt

SEQ ID NO: 48751 - DNA, 20 bp, Artificial Sequence
  Synthetic oligonucleotide; AAG chr11 5226921 5226940 5226924 -
gccctgggcaggttggtatc

SEQ ID NO: 48752 - DNA, 20 bp, Artificial Sequence
  Synthetic oligonucleotide; AGG chr11 5226920 5226939 5226923 -
ccctgggcaggttggtatca

SEQ ID NO: 48753 - DNA, 20 bp, Artificial Sequence
  Synthetic oligonucleotide; AAG chr11 5226913 5226932 5226916 -
caggttggtatcaaggttac

SEQ ID NO: 48754 - DNA, 20 bp, Artificial Sequence
  Synthetic oligonucleotide; CAG chr11 5226909 5226928 5226912 -
ttggtatcaaggttacaaga

SEQ ID NO: 48755 - DNA, 20 bp, Artificial Sequence
  Synthetic oligonucleotide; AGG chr11 5226908 5226927 5226911 -
tggtatcaaggttacaagac

SEQ ID NO: 48756 - DNA, 20 bp, Artificial Sequence
  Synthetic oligonucleotide; AAG chr11 5226902 5226921 5226905 -
caaggttacaagacaggttt

SEQ ID NO: 48757 - DNA, 20 bp, Artificial Sequence
  Synthetic oligonucleotide; AGG chr11 5226901 5226920 5226904 -
aaggttacaagacaggttta

SEQ ID NO: 48758 - DNA, 20 bp, Artificial Sequence
  Synthetic oligonucleotide; GAG chr11 5226899 5226918 5226902 -
ggttacaagacaggtttaag

SEQ ID NO: 48759 - DNA, 20 bp, Artificial Sequence
  Synthetic oligonucleotide; TAG chr11 5226891 5226910 5226894 -
gacaggtttaaggagaccaa

SEQ ID NO: 48760 - DNA, 20 bp, Artificial Sequence
  Synthetic oligonucleotide; TGG chr11 5226884 5226903 5226887 -
ttaaggagaccaatagaaac

SEQ ID NO: 48761 - DNA, 20 bp, Artificial Sequence
  Synthetic oligonucleotide; GGG chr11 5226883 5226902 5226886 -
taaggagaccaatagaaact

SEQ ID NO: 48762 - DNA, 20 bp, Artificial Sequence
  Synthetic oligonucleotide; TGG chr11 5226876 5226895 5226879 -
accaatagaaactgggcatg

SEQ ID NO: 48763 - DNA, 20 bp, Artificial Sequence
  Synthetic oligonucleotide; GAG chr11 5226874 5226893 5226877 -
caatagaaactgggcatgtg

SEQ ID NO: 48764 - DNA, 20 bp, Artificial Sequence
  Synthetic oligonucleotide; CAG chr11 5226870 5226889 5226873 -
agaaactgggcatgtggaga

SEQ ID NO: 48765 - DNA, 20 bp, Artificial Sequence
  Synthetic oligonucleotide; GAG chr11 5226868 5226887 5226871 -
aaactgggcatgtggagaca

SEQ ID NO: 48766 - DNA, 20 bp, Artificial Sequence
  Synthetic oligonucleotide; AAG chr11 5226865 5226884 5226868 -
ctgggcatgtggagacagag

SEQ ID NO: 48767 - DNA, 20 bp, Artificial Sequence
  Synthetic oligonucleotide; TGG chr11 5226857 5226876 5226860 -
gtggagacagagaagactct

SEQ ID NO: 48768 - DNA, 20 bp, Artificial Sequence
  Synthetic oligonucleotide; GGG chr11 5226856 5226875 5226859 -
tggagacagagaagactctt

SEQ ID NO: 48769 - DNA, 20 bp, Artificial Sequence
  Synthetic oligonucleotide; TAG chr11 5226846 5226865 5226849 -
gaagactcttgggtttctga

SEQ ID NO: 48770 - DNA, 20 bp, Artificial Sequence
  Synthetic oligonucleotide; AGG chr11 5226845 5226864 5226848 -
aagactcttgggtttctgat

SEQ ID NO: 48771 - DNA, 20 bp, Artificial Sequence
  Synthetic oligonucleotide; TGG chr11 5226822 5226841 5226825 -
cactgactctctctgcctat

SEQ ID NO: 48772 - DNA, 20 bp, Artificial Sequence
  Synthetic oligonucleotide; TAG chr11 5226803 5226822 5226806 -
ttggtctattttcccaccct

SEQ ID NO: 48773 - DNA, 20 bp, Artificial Sequence
  Synthetic oligonucleotide; AGG chr11 5226802 5226821 5226805 -
tggtctattttcccaccctt

SEQ ID NO: 48774 - DNA, 20 bp, Artificial Sequence
  Synthetic oligonucleotide; TGG chr11 5226795 5226814 5226798 -
ttttcccacccttaggctgc

SEQ ID NO: 48775 - DNA, 20 bp, Artificial Sequence
  Synthetic oligonucleotide; TGG chr11 5226792 5226811 5226795 -
tcccacccttaggctgctgg

SEQ ID NO: 48776 - DNA, 20 bp, Artificial Sequence
  Synthetic oligonucleotide; TGG chr11 5226781 5226800 5226784 -
ggctgctggtggtctaccct

SEQ ID NO: 48777 - DNA, 20 bp, Artificial Sequence
  Synthetic oligonucleotide; CAG chr11 5226775 5226794 5226778 -
tggtggtctacccttggacc

SEQ ID NO: 48778 - DNA, 20 bp, Artificial Sequence
  Synthetic oligonucleotide; GAG chr11 5226773 5226792 5226776 -
gtggtctacccttggaccca

SEQ ID NO: 48779 - DNA, 20 bp, Artificial Sequence
  Synthetic oligonucleotide; AGG chr11 5226772 5226791 5226775 -
tggtctacccttggacccag

SEQ ID NO: 48780 - DNA, 20 bp, Artificial Sequence
  Synthetic oligonucleotide; GAG chr11 5226763 5226782 5226766 -
cttggacccagaggttcttt

SEQ ID NO: 48781 - DNA, 20 bp, Artificial Sequence
  Synthetic oligonucleotide; TGG chr11 5226755 5226774 5226758 -
cagaggttctttgagtcctt

SEQ ID NO: 48782 - DNA, 20 bp, Artificial Sequence
  Synthetic oligonucleotide; GGG chr11 5226754 5226773 5226757 -
agaggttctttgagtccttt

SEQ ID NO: 48783 - DNA, 20 bp, Artificial Sequence
  Synthetic oligonucleotide; GGG chr11 5226753 5226772 5226756 -
gaggttctttgagtcctttg

SEQ ID NO: 48784 - DNA, 20 bp, Artificial Sequence
  Synthetic oligonucleotide; TGG chr11 5226726 5226745 5226729 -
gtccactcctgatgctgtta

SEQ ID NO: 48785 - DNA, 20 bp, Artificial Sequence
  Synthetic oligonucleotide; GGG chr11 5226725 5226744 5226728 -
tccactcctgatgctgttat

SEQ ID NO: 48786 - DNA, 20 bp, Artificial Sequence
  Synthetic oligonucleotide; AAG chr11 5226715 5226734 5226718 -
atgctgttatgggcaaccct

SEQ ID NO: 48787 - DNA, 20 bp, Artificial Sequence
  Synthetic oligonucleotide; AGG chr11 5226714 5226733 5226717 -
tgctgttatgggcaacccta

SEQ ID NO: 48788 - DNA, 20 bp, Artificial Sequence
  Synthetic oligonucleotide; AAG chr11 5226709 5226728 5226712 -
ttatgggcaaccctaaggtg

SEQ ID NO: 48789 - DNA, 20 bp, Artificial Sequence
  Synthetic oligonucleotide; AGG chr11 5226708 5226727 5226711 -
tatgggcaaccctaaggtga

SEQ ID NO: 48790 - DNA, 20 bp, Artificial Sequence
  Synthetic oligonucleotide; TGG chr11 5226701 5226720 5226704 -
aaccctaaggtgaaggctca

SEQ ID NO: 48791 - DNA, 20 bp, Artificial Sequence
  Synthetic oligonucleotide; AAG chr11 5226697 5226716 5226700 -
ctaaggtgaaggctcatggc

SEQ ID NO: 48792 - DNA, 20 bp, Artificial Sequence
  Synthetic oligonucleotide; AAG chr11 5226693 5226712 5226696 -
ggtgaaggctcatggcaaga

SEQ ID NO: 48793 - DNA, 20 bp, Artificial Sequence
  Synthetic oligonucleotide; CGG chr11 5226686 5226705 5226689 -
gctcatggcaagaaagtgct

SEQ ID NO: 48794 - DNA, 20 bp, Artificial Sequence
  Synthetic oligonucleotide; TAG chr11 5226677 5226696 5226680 -
aagaaagtgctcggtgcctt

SEQ ID NO: 48795 - DNA, 20 bp, Artificial Sequence
  Synthetic oligonucleotide; TGG chr11 5226671 5226690 5226674 -
gtgctcggtgcctttagtga

SEQ ID NO: 48796 - DNA, 20 bp, Artificial Sequence
  Synthetic oligonucleotide; TGG chr11 5226666 5226685 5226669 -
cggtgcctttagtgatggcc

SEQ ID NO: 48797 - DNA, 20 bp, Artificial Sequence
  Synthetic oligonucleotide; TGG chr11 5226657 5226676 5226660 -
tagtgatggcctggctcacc

SEQ ID NO: 48798 - DNA, 20 bp, Artificial Sequence
  Synthetic oligonucleotide; AAG chr11 5226646 5226665 5226649 -
tggctcacctggacaacctc

SEQ ID NO: 48799 - DNA, 20 bp, Artificial Sequence
  Synthetic oligonucleotide; AGG chr11 5226645 5226664 5226648 -
ggctcacctggacaacctca

SEQ ID NO: 48800 - DNA, 20 bp, Artificial Sequence
  Synthetic oligonucleotide; GGG chr11 5226644 5226663 5226647 -
gctcacctggacaacctcaa

SEQ ID NO: 48801 - DNA, 20 bp, Artificial Sequence
  Synthetic oligonucleotide; GAG chr11 5226626 5226645 5226629 -
aagggcacctttgccacact

SEQ ID NO: 48802 - DNA, 20 bp, Artificial Sequence
  Synthetic oligonucleotide; GAG chr11 5226622 5226641 5226625 -
gcacctttgccacactgagt

SEQ ID NO: 48803 - DNA, 20 bp, Artificial Sequence
  Synthetic oligonucleotide; AAG chr11 5226607 5226626 5226610 -
tgagtgagctgcactgtgac

SEQ ID NO: 48804 - DNA, 20 bp, Artificial Sequence
  Synthetic oligonucleotide; TGG chr11 5226597 5226616 5226600 -
gcactgtgacaagctgcacg

SEQ ID NO: 48805 - DNA, 20 bp, Artificial Sequence
  Synthetic oligonucleotide; GAG chr11 5226589 5226608 5226592 -
acaagctgcacgtggatcct

SEQ ID NO: 48806 - DNA, 20 bp, Artificial Sequence
  Synthetic oligonucleotide; CAG chr11 5226581 5226600 5226584 -
cacgtggatcctgagaactt

SEQ ID NO: 48807 - DNA, 20 bp, Artificial Sequence
  Synthetic oligonucleotide; AGG chr11 5226580 5226599 5226583 -
acgtggatcctgagaacttc

SEQ ID NO: 48808 - DNA, 20 bp, Artificial Sequence
  Synthetic oligonucleotide; GGG chr11 5226579 5226598 5226582 -
cgtggatcctgagaacttca

SEQ ID NO: 48809 - DNA, 20 bp, Artificial Sequence
  Synthetic oligonucleotide; GAG chr11 5226575 5226594 5226578 -
gatcctgagaacttcagggt

SEQ ID NO: 48810 - DNA, 20 bp, Artificial Sequence
  Synthetic oligonucleotide; TGG chr11 5226568 5226587 5226571 -
agaacttcagggtgagtcta

SEQ ID NO: 48811 - DNA, 20 bp, Artificial Sequence
  Synthetic oligonucleotide; GGG chr11 5226567 5226586 5226570 -
gaacttcagggtgagtctat

SEQ ID NO: 48812 - DNA, 20 bp, Artificial Sequence
  Synthetic oligonucleotide; TGG chr11 5226532 5226551 5226535 -
ttctttccccttcttttcta

SEQ ID NO: 48813 - DNA, 20 bp, Artificial Sequence
  Synthetic oligonucleotide; AAG chr11 5226527 5226546 5226530 -
tccccttcttttctatggtt

SEQ ID NO: 48814 - DNA, 20 bp, Artificial Sequence
  Synthetic oligonucleotide; TAG chr11 5226515 5226534 5226518 -
ctatggttaagttcatgtca

SEQ ID NO: 48815 - DNA, 20 bp, Artificial Sequence
  Synthetic oligonucleotide; AGG chr11 5226514 5226533 5226517 -
tatggttaagttcatgtcat

SEQ ID NO: 48816 - DNA, 20 bp, Artificial Sequence
  Synthetic oligonucleotide; AAG chr11 5226511 5226530 5226514 -
ggttaagttcatgtcatagg

SEQ ID NO: 48817 - DNA, 20 bp, Artificial Sequence
  Synthetic oligonucleotide; AGG chr11 5226510 5226529 5226513 -
gttaagttcatgtcatagga

SEQ ID NO: 48818 - DNA, 20 bp, Artificial Sequence
  Synthetic oligonucleotide; GGG chr11 5226509 5226528 5226512 -
ttaagttcatgtcataggaa

SEQ ID NO: 48819 - DNA, 20 bp, Artificial Sequence
  Synthetic oligonucleotide; GGG chr11 5226508 5226527 5226511 -
taagttcatgtcataggaag

SEQ ID NO: 48820 - DNA, 20 bp, Artificial Sequence
  Synthetic oligonucleotide; AAG chr11 5226503 5226522 5226506 -
tcatgtcataggaaggggat

SEQ ID NO: 48821 - DNA, 20 bp, Artificial Sequence
  Synthetic oligonucleotide; CAG chr11 5226497 5226516 5226500 -
cataggaaggggataagtaa

SEQ ID NO: 48822 - DNA, 20 bp, Artificial Sequence
  Synthetic oligonucleotide; AGG chr11 5226496 5226515 5226499 -
ataggaaggggataagtaac

SEQ ID NO: 48823 - DNA, 20 bp, Artificial Sequence
  Synthetic oligonucleotide; GGG chr11 5226495 5226514 5226498 -
taggaaggggataagtaaca

SEQ ID NO: 48824 - DNA, 20 bp, Artificial Sequence
  Synthetic oligonucleotide; CAG chr11 5226490 5226509 5226493 -
aggggataagtaacagggta

SEQ ID NO: 48825 - DNA, 20 bp, Artificial Sequence
  Synthetic oligonucleotide; TAG chr11 5226485 5226504 5226488 -
ataagtaacagggtacagtt

SEQ ID NO: 48826 - DNA, 20 bp, Artificial Sequence
  Synthetic oligonucleotide; TGG chr11 5226480 5226499 5226483 -
taacagggtacagtttagaa

SEQ ID NO: 48827 - DNA, 20 bp, Artificial Sequence
  Synthetic oligonucleotide; GGG chr11 5226479 5226498 5226482 -
aacagggtacagtttagaat

SEQ ID NO: 48828 - DNA, 20 bp, Artificial Sequence
  Synthetic oligonucleotide; CAG chr11 5226473 5226492 5226476 -
gtacagtttagaatgggaaa

SEQ ID NO: 48829 - DNA, 20 bp, Artificial Sequence
  Synthetic oligonucleotide; CAG chr11 5226456 5226475 5226459 -
aaacagacgaatgattgcat

SEQ ID NO: 48830 - DNA, 20 bp, Artificial Sequence
  Synthetic oligonucleotide; TGG chr11 5226451 5226470 5226454 -
gacgaatgattgcatcagtg

SEQ ID NO: 48831 - DNA, 20 bp, Artificial Sequence
  Synthetic oligonucleotide; AAG chr11 5226448 5226467 5226451 -
gaatgattgcatcagtgtgg

SEQ ID NO: 48832 - DNA, 20 bp, Artificial Sequence
  Synthetic oligonucleotide; CAG chr11 5226442 5226461 5226445 -
ttgcatcagtgtggaagtct

SEQ ID NO: 48833 - DNA, 20 bp, Artificial Sequence
  Synthetic oligonucleotide; AGG chr11 5226441 5226460 5226444 -
tgcatcagtgtggaagtctc

SEQ ID NO: 48834 - DNA, 20 bp, Artificial Sequence
  Synthetic oligonucleotide; TAG chr11 5226431 5226450 5226434 -
tggaagtctcaggatcgttt

SEQ ID NO: 48835 - DNA, 20 bp, Artificial Sequence
  Synthetic oligonucleotide; AAG chr11 5226311 5226330 5226314 -
cttaacattgtgtataacaa

SEQ ID NO: 48836 - DNA, 20 bp, Artificial Sequence
  Synthetic oligonucleotide; AGG chr11 5226310 5226329 5226313 -
ttaacattgtgtataacaaa

SEQ ID NO: 48837 - DNA, 20 bp, Artificial Sequence
  Synthetic oligonucleotide; GAG chr11 5226297 5226316 5226300 -
taacaaaaggaaatatctct

SEQ ID NO: 48838 - DNA, 20 bp, Artificial Sequence
  Synthetic oligonucleotide; AAG chr11 5226287 5226306 5226290 -
aaatatctctgagatacatt

SEQ ID NO: 48839 - DNA, 20 bp, Artificial Sequence
  Synthetic oligonucleotide; CAG chr11 5226262 5226281 5226265 -
acttaaaaaaaaactttaca

SEQ ID NO: 48840 - DNA, 20 bp, Artificial Sequence
  Synthetic oligonucleotide; TAG chr11 5226253 5226272 5226256 -
aaaactttacacagtctgcc

SEQ ID NO: 48841 - DNA, 20 bp, Artificial Sequence
  Synthetic oligonucleotide; TGG chr11 5226238 5226257 5226241 -
ctgcctagtacattactatt

SEQ ID NO: 48842 - DNA, 20 bp, Artificial Sequence
  Synthetic oligonucleotide; TGG chr11 5226147 5226166 5226150 -
ataatcattatacatattta

SEQ ID NO: 48843 - DNA, 20 bp, Artificial Sequence
  Synthetic oligonucleotide; GGG chr11 5226146 5226165 5226149 -
taatcattatacatatttat

SEQ ID NO: 48844 - DNA, 20 bp, Artificial Sequence
  Synthetic oligonucleotide; AAG chr11 5226140 5226159 5226143 -
ttatacatatttatgggtta

SEQ ID NO: 48845 - DNA, 20 bp, Artificial Sequence
  Synthetic oligonucleotide; CAG chr11 5226100 5226119 5226103 -
tgtacacatattgaccaaat

SEQ ID NO: 48846 - DNA, 20 bp, Artificial Sequence
  Synthetic oligonucleotide; AGG chr11 5226099 5226118 5226102 -
gtacacatattgaccaaatc

SEQ ID NO: 48847 - DNA, 20 bp, Artificial Sequence
  Synthetic oligonucleotide; GGG chr11 5226098 5226117 5226101 -
tacacatattgaccaaatca

SEQ ID NO: 48848 - DNA, 20 bp, Artificial Sequence
  Synthetic oligonucleotide; CAG chr11 5226001 5226020 5226004 -
tttccctaatctctttcttt

SEQ ID NO: 48849 - DNA, 20 bp, Artificial Sequence
  Synthetic oligonucleotide; AGG chr11 5226000 5226019 5226003 -
ttccctaatctctttctttc

SEQ ID NO: 48850 - DNA, 20 bp, Artificial Sequence
  Synthetic oligonucleotide; GGG chr11 5225999 5226018 5226002 -
tccctaatctctttctttca

SEQ ID NO: 48851 - DNA, 20 bp, Artificial Sequence
  Synthetic oligonucleotide; AAG chr11 5225955 5225974 5225958 -
tgcctctttgcaccattcta

SEQ ID NO: 48852 - DNA, 20 bp, Artificial Sequence
  Synthetic oligonucleotide; CAG chr11 5225947 5225966 5225950 -
tgcaccattctaaagaataa

SEQ ID NO: 48853 - DNA, 20 bp, Artificial Sequence
  Synthetic oligonucleotide; TGG chr11 5225934 5225953 5225937 -
agaataacagtgataatttc

SEQ ID NO: 48854 - DNA, 20 bp, Artificial Sequence
  Synthetic oligonucleotide; GGG chr11 5225933 5225952 5225936 -
gaataacagtgataatttct

SEQ ID NO: 48855 - DNA, 20 bp, Artificial Sequence
  Synthetic oligonucleotide; AAG chr11 5225928 5225947 5225931 -
acagtgataatttctgggtt

SEQ ID NO: 48856 - DNA, 20 bp, Artificial Sequence
  Synthetic oligonucleotide; AGG chr11 5225927 5225946 5225930 -
cagtgataatttctgggtta

SEQ ID NO: 48857 - DNA, 20 bp, Artificial Sequence
  Synthetic oligonucleotide; TAG chr11 5225921 5225940 5225924 -
taatttctgggttaaggcaa

SEQ ID NO: 48858 - DNA, 20 bp, Artificial Sequence
  Synthetic oligonucleotide; AAG chr11 5225870 5225889 5225873 -
atataaattgtaactgatgt

SEQ ID NO: 48859 - DNA, 20 bp, Artificial Sequence
  Synthetic oligonucleotide; GAG chr11 5225868 5225887 5225871 -
ataaattgtaactgatgtaa

SEQ ID NO: 48860 - DNA, 20 bp, Artificial Sequence
  Synthetic oligonucleotide; AGG chr11 5225867 5225886 5225870 -
taaattgtaactgatgtaag

SEQ ID NO: 48861 - DNA, 20 bp, Artificial Sequence
  Synthetic oligonucleotide; TAG chr11 5225850 5225869 5225853 -
aagaggtttcatattgctaa

SEQ ID NO: 48862 - DNA, 20 bp, Artificial Sequence
  Synthetic oligonucleotide; CAG chr11 5225847 5225866 5225850 -
aggtttcatattgctaatag

SEQ ID NO: 48863 - DNA, 20 bp, Artificial Sequence
  Synthetic oligonucleotide; CAG chr11 5225836 5225855 5225839 -
tgctaatagcagctacaatc

SEQ ID NO: 48864 - DNA, 20 bp, Artificial Sequence
  Synthetic oligonucleotide; TGG chr11 5225811 5225830 5225814 -
accattctgcttttatttta

SEQ ID NO: 48865 - DNA, 20 bp, Artificial Sequence
  Synthetic oligonucleotide; TGG chr11 5225807 5225826 5225810 -
ttctgcttttattttatggt

SEQ ID NO: 48866 - DNA, 20 bp, Artificial Sequence
  Synthetic oligonucleotide; GGG chr11 5225806 5225825 5225809 -
tctgcttttattttatggtt

SEQ ID NO: 48867 - DNA, 20 bp, Artificial Sequence
  Synthetic oligonucleotide; AAG chr11 5225801 5225820 5225804 -
ttttattttatggttgggat

SEQ ID NO: 48868 - DNA, 20 bp, Artificial Sequence
  Synthetic oligonucleotide; AGG chr11 5225800 5225819 5225803 -
tttattttatggttgggata

SEQ ID NO: 48869 - DNA, 20 bp, Artificial Sequence
  Synthetic oligonucleotide; TGG chr11 5225796 5225815 5225799 -
ttttatggttgggataaggc

SEQ ID NO: 48870 - DNA, 20 bp, Artificial Sequence
  Synthetic oligonucleotide; GAG chr11 5225785 5225804 5225788 -
ggataaggctggattattct

SEQ ID NO: 48871 - DNA, 20 bp, Artificial Sequence
  Synthetic oligonucleotide; AAG chr11 5225779 5225798 5225782 -
ggctggattattctgagtcc

SEQ ID NO: 48872 - DNA, 20 bp, Artificial Sequence
  Synthetic oligonucleotide; TAG chr11 5225775 5225794 5225778 -
ggattattctgagtccaagc

SEQ ID NO: 48873 - DNA, 20 bp, Artificial Sequence
  Synthetic oligonucleotide; AGG chr11 5225774 5225793 5225777 -
gattattctgagtccaagct

SEQ ID NO: 48874 - DNA, 20 bp, Artificial Sequence
  Synthetic oligonucleotide; CAG chr11 5225730 5225749 5225733 -
tacctcttatcttcctccca

SEQ ID NO: 48875 - DNA, 20 bp, Artificial Sequence
  Synthetic oligonucleotide; TGG chr11 5225723 5225742 5225726 -
tatcttcctcccacagctcc

SEQ ID NO: 48876 - DNA, 20 bp, Artificial Sequence
  Synthetic oligonucleotide; GGG chr11 5225722 5225741 5225725 -
atcttcctcccacagctcct

SEQ ID NO: 48877 - DNA, 20 bp, Artificial Sequence
  Synthetic oligonucleotide; TGG chr11 5225711 5225730 5225714 -
acagctcctgggcaacgtgc

SEQ ID NO: 48878 - DNA, 20 bp, Artificial Sequence
  Synthetic oligonucleotide; TGG chr11 5225699 5225718 5225702 -
caacgtgctggtctgtgtgc

SEQ ID NO: 48879 - DNA, 20 bp, Artificial Sequence
  Synthetic oligonucleotide; TGG chr11 5225686 5225705 5225689 -
tgtgtgctggcccatcactt

SEQ ID NO: 48880 - DNA, 20 bp, Artificial Sequence
  Synthetic oligonucleotide; AAG chr11 5225681 5225700 5225684 -
gctggcccatcactttggca

SEQ ID NO: 48881 - DNA, 20 bp, Artificial Sequence
  Synthetic oligonucleotide; CAG chr11 5225666 5225685 5225669 -
tggcaaagaattcaccccac

SEQ ID NO: 48882 - DNA, 20 bp, Artificial Sequence
  Synthetic oligonucleotide; CAG chr11 5225661 5225680 5225664 -
aagaattcaccccaccagtg

SEQ ID NO: 48883 - DNA, 20 bp, Artificial Sequence
  Synthetic oligonucleotide; AGG chr11 5225660 5225679 5225663 -
agaattcaccccaccagtgc

SEQ ID NO: 48884 - DNA, 20 bp, Artificial Sequence
  Synthetic oligonucleotide; CAG chr11 5225649 5225668 5225652 -
caccagtgcaggctgcctat

SEQ ID NO: 48885 - DNA, 20 bp, Artificial Sequence
  Synthetic oligonucleotide; AAG chr11 5225645 5225664 5225648 -
agtgcaggctgcctatcaga

SEQ ID NO: 48886 - DNA, 20 bp, Artificial Sequence
  Synthetic oligonucleotide; TGG chr11 5225642 5225661 5225645 -
gcaggctgcctatcagaaag

SEQ ID NO: 48887 - DNA, 20 bp, Artificial Sequence
  Synthetic oligonucleotide; TGG chr11 5225639 5225658 5225642 -
ggctgcctatcagaaagtgg

SEQ ID NO: 48888 - DNA, 20 bp, Artificial Sequence
  Synthetic oligonucleotide; TGG chr11 5225635 5225654 5225638 -
gcctatcagaaagtggtggc

SEQ ID NO: 48889 - DNA, 20 bp, Artificial Sequence
  Synthetic oligonucleotide; TGG chr11 5225630 5225649 5225633 -
tcagaaagtggtggctggtg

SEQ ID NO: 48890 - DNA, 20 bp, Artificial Sequence
  Synthetic oligonucleotide; TGG chr11 5225618 5225637 5225621 -
ggctggtgtggctaatgccc

SEQ ID NO: 48891 - DNA, 20 bp, Artificial Sequence
  Synthetic oligonucleotide; AAG chr11 5225610 5225629 5225613 -
tggctaatgccctggcccac

SEQ ID NO: 48892 - DNA, 20 bp, Artificial Sequence
  Synthetic oligonucleotide; AAG chr11 5225600 5225619 5225603 -
cctggcccacaagtatcact

SEQ ID NO: 48893 - DNA, 20 bp, Artificial Sequence
  Synthetic oligonucleotide; AAG chr11 5225568 5225587 5225571 -
ttgctgtccaatttctatta

SEQ ID NO: 48894 - DNA, 20 bp, Artificial Sequence
  Synthetic oligonucleotide; AGG chr11 5225567 5225586 5225570 -
tgctgtccaatttctattaa

SEQ ID NO: 48895 - DNA, 20 bp, Artificial Sequence
  Synthetic oligonucleotide; AAG chr11 5225550 5225569 5225553 -
taaaggttcctttgttccct

SEQ ID NO: 48896 - DNA, 20 bp, Artificial Sequence
  Synthetic oligonucleotide; TGG chr11 5225533 5225552 5225536 -
cctaagtccaactactaaac

SEQ ID NO: 48897 - DNA, 20 bp, Artificial Sequence
  Synthetic oligonucleotide; GGG chr11 5225532 5225551 5225535 -
ctaagtccaactactaaact

SEQ ID NO: 48898 - DNA, 20 bp, Artificial Sequence
  Synthetic oligonucleotide; GGG chr11 5225531 5225550 5225534 -
taagtccaactactaaactg

SEQ ID NO: 48899 - DNA, 20 bp, Artificial Sequence
  Synthetic oligonucleotide; GGG chr11 5225530 5225549 5225533 -
aagtccaactactaaactgg

SEQ ID NO: 48900 - DNA, 20 bp, Artificial Sequence
  Synthetic oligonucleotide; AAG chr11 5225519 5225538 5225522 -
ctaaactgggggatattatg

SEQ ID NO: 48901 - DNA, 20 bp, Artificial Sequence
  Synthetic oligonucleotide; AGG chr11 5225518 5225537 5225521 -
taaactgggggatattatga

SEQ ID NO: 48902 - DNA, 20 bp, Artificial Sequence
  Synthetic oligonucleotide; GGG chr11 5225517 5225536 5225520 -
aaactgggggatattatgaa

SEQ ID NO: 48903 - DNA, 20 bp, Artificial Sequence
  Synthetic oligonucleotide; GAG chr11 5225510 5225529 5225513 -
gggatattatgaagggcctt

SEQ ID NO: 48904 - DNA, 20 bp, Artificial Sequence
  Synthetic oligonucleotide; TGG chr11 5225503 5225522 5225506 -
tatgaagggccttgagcatc

SEQ ID NO: 48905 - DNA, 20 bp, Artificial Sequence
  Synthetic oligonucleotide; AAG chr11 5225428 5225447 5225431 -
tttctgaatattttactaaa

SEQ ID NO: 48906 - DNA, 20 bp, Artificial Sequence
  Synthetic oligonucleotide; AGG chr11 5225427 5225446 5225430 -
ttctgaatattttactaaaa

SEQ ID NO: 48907 - DNA, 20 bp, Artificial Sequence
  Synthetic oligonucleotide; GGG chr11 5225426 5225445 5225429 -
tctgaatattttactaaaaa

SEQ ID NO: 48908 - DNA, 20 bp, Artificial Sequence
  Synthetic oligonucleotide; TGG chr11 5225419 5225438 5225422 -
attttactaaaaagggaatg

SEQ ID NO: 48909 - DNA, 20 bp, Artificial Sequence
  Synthetic oligonucleotide; GGG chr11 5225418 5225437 5225421 -
ttttactaaaaagggaatgt

SEQ ID NO: 48910 - DNA, 20 bp, Artificial Sequence
  Synthetic oligonucleotide; GAG chr11 5225416 5225435 5225419 -
ttactaaaaagggaatgtgg

SEQ ID NO: 48911 - DNA, 20 bp, Artificial Sequence
  Synthetic oligonucleotide; AGG chr11 5225415 5225434 5225418 -
tactaaaaagggaatgtggg

SEQ ID NO: 48912 - DNA, 20 bp, Artificial Sequence
  Synthetic oligonucleotide; CAG chr11 5225411 5225430 5225414 -
aaaaagggaatgtgggaggt

SEQ ID NO: 48913 - DNA, 20 bp, Artificial Sequence
  Synthetic oligonucleotide; AAG chr11 5225393 5225412 5225396 -
gtcagtgcatttaaaacata

SEQ ID NO: 48914 - DNA, 20 bp, Artificial Sequence
  Synthetic oligonucleotide; AAG chr11 5225385 5225404 5225388 -
atttaaaacataaagaaatg

SEQ ID NO: 48915 - DNA, 20 bp, Artificial Sequence
  Synthetic oligonucleotide; GAG chr11 5225383 5225402 5225386 -
ttaaaacataaagaaatgaa

SEQ ID NO: 48916 - DNA, 20 bp, Artificial Sequence
  Synthetic oligonucleotide; TAG chr11 5225379 5225398 5225382 -
aacataaagaaatgaagagc

SEQ ID NO: 48917 - DNA, 20 bp, Artificial Sequence
  Synthetic oligonucleotide; TGG chr11 5225367 5225386 5225370 -
tgaagagctagttcaaacct

SEQ ID NO: 48918 - DNA, 20 bp, Artificial Sequence
  Synthetic oligonucleotide; GGG chr11 5225366 5225385 5225369 -
gaagagctagttcaaacctt

SEQ ID NO: 48919 - DNA, 20 bp, Artificial Sequence
  Synthetic oligonucleotide; AAG chr11 5225335 5225354 5225338 -
ctatatcttaaactccatga

SEQ ID NO: 48920 - DNA, 20 bp, Artificial Sequence
  Synthetic oligonucleotide; AAG chr11 5225332 5225351 5225335 -
tatcttaaactccatgaaag

SEQ ID NO: 48921 - DNA, 20 bp, Artificial Sequence
  Synthetic oligonucleotide; AGG chr11 5225331 5225350 5225334 -
atcttaaactccatgaaaga

SEQ ID NO: 48922 - DNA, 20 bp, Artificial Sequence
  Synthetic oligonucleotide; GAG chr11 5225327 5225346 5225330 -
taaactccatgaaagaaggt

SEQ ID NO: 48923 - DNA, 20 bp, Artificial Sequence
  Synthetic oligonucleotide; AGG chr11 5225326 5225345 5225329 -
aaactccatgaaagaaggtg

SEQ ID NO: 48924 - DNA, 20 bp, Artificial Sequence
  Synthetic oligonucleotide; CAG chr11 5225316 5225335 5225319 -
aaagaaggtgaggctgcaaa

SEQ ID NO: 48925 - DNA, 20 bp, Artificial Sequence
  Synthetic oligonucleotide; TGG chr11 5225302 5225321 5225305 -
tgcaaacagctaatgcacat

SEQ ID NO: 48926 - DNA, 20 bp, Artificial Sequence
  Synthetic oligonucleotide; CAG chr11 5225296 5225315 5225299 -
cagctaatgcacattggcaa

SEQ ID NO: 48927 - DNA, 20 bp, Artificial Sequence
  Synthetic oligonucleotide; CAG chr11 5225264 5225283 5225267 -
catatgccttattcatccct

SEQ ID NO: 48928 - DNA, 20 bp, Artificial Sequence
  Synthetic oligonucleotide; AAG chr11 5225259 5225278 5225262 -
gccttattcatccctcagaa

SEQ ID NO: 48929 - DNA, 20 bp, Artificial Sequence
  Synthetic oligonucleotide; AGG chr11 5225258 5225277 5225261 -
ccttattcatccctcagaaa

SEQ ID NO: 48930 - DNA, 20 bp, Artificial Sequence
  Synthetic oligonucleotide; AAG chr11 5225251 5225270 5225254 -
catccctcagaaaaggattc

SEQ ID NO: 48931 - DNA, 20 bp, Artificial Sequence
  Synthetic oligonucleotide; TAG chr11 5225248 5225267 5225251 -
ccctcagaaaaggattcaag

SEQ ID NO: 48932 - DNA, 20 bp, Artificial Sequence
  Synthetic oligonucleotide; GAG chr11 5225246 5225265 5225249 -
ctcagaaaaggattcaagta

SEQ ID NO: 48933 - DNA, 20 bp, Artificial Sequence
  Synthetic oligonucleotide; AGG chr11 5225245 5225264 5225248 -
tcagaaaaggattcaagtag

SEQ ID NO: 48934 - DNA, 20 bp, Artificial Sequence
  Synthetic oligonucleotide; TGG chr11 5225235 5225254 5225238 -
attcaagtagaggcttgatt

SEQ ID NO: 48935 - DNA, 20 bp, Artificial Sequence
  Synthetic oligonucleotide; GAG chr11 5225233 5225252 5225236 -
tcaagtagaggcttgatttg

SEQ ID NO: 48936 - DNA, 20 bp, Artificial Sequence
  Synthetic oligonucleotide; AGG chr11 5225232 5225251 5225235 -
caagtagaggcttgatttgg

SEQ ID NO: 48937 - DNA, 20 bp, Artificial Sequence
  Synthetic oligonucleotide; AAG chr11 5225226 5225245 5225229 -
gaggcttgatttggaggtta

SEQ ID NO: 48938 - DNA, 20 bp, Artificial Sequence
  Synthetic oligonucleotide; TAG chr11 5225188 5225207 5225191 -
ttttacattacttattgttt

SEQ ID NO: 48939 - DNA, 20 bp, Artificial Sequence
  Synthetic oligonucleotide; CAG chr11 5225135 5225154 5225138 -
tttgcttatcctgcatctct

SEQ ID NO: 48940 - DNA, 20 bp, Artificial Sequence
  Synthetic oligonucleotide; CAG chr11 5225119 5225138 5225122 -
ctctcagccttgactccact

SEQ ID NO: 48941 - DNA, 20 bp, Artificial Sequence
  Synthetic oligonucleotide; TAG chr11 5225106 5225125 5225109 -
ctccactcagttctcttgct

SEQ ID NO: 48942 - DNA, 20 bp, Artificial Sequence
  Synthetic oligonucleotide; GAG chr11 5225104 5225123 5225107 -
ccactcagttctcttgctta

SEQ ID NO: 48943 - DNA, 20 bp, Artificial Sequence
  Synthetic oligonucleotide; AAG chr11 5225084 5225103 5225087 -
gagataccacctttcccctg

SEQ ID NO: 48944 - DNA, 20 bp, Artificial Sequence
  Synthetic oligonucleotide; CGG chr11 5225063 5225082 5225066 -
agtgttccttccatgtttta

SEQ ID NO: 48945 - DNA, 20 bp, Artificial Sequence
  Synthetic oligonucleotide; GAG chr11 5225059 5225078 5225062 -
ttccttccatgttttacggc

SEQ ID NO: 48946 - DNA, 20 bp, Artificial Sequence
  Synthetic oligonucleotide; TGG chr11 5225055 5225074 5225058 -
ttccatgttttacggcgaga

SEQ ID NO: 48947 - DNA, 20 bp, Artificial Sequence
  Synthetic oligonucleotide; TGG chr11 5225040 5225059 5225043 -
cgagatggtttctcctcgcc

SEQ ID NO: 48948 - DNA, 20 bp, Artificial Sequence
  Synthetic oligonucleotide; CAG chr11 5225032 5225051 5225035 -
tttctcctcgcctggccact

SEQ ID NO: 48949 - DNA, 20 bp, Artificial Sequence
  Synthetic oligonucleotide; TAG chr11 5225026 5225045 5225029 -
ctcgcctggccactcagcct

SEQ ID NO: 48950 - DNA, 20 bp, Artificial Sequence
  Synthetic oligonucleotide; TAG chr11 5225006 5225025 5225009 -
tagttgtctctgttgtctta

SEQ ID NO: 48951 - DNA, 20 bp, Artificial Sequence
  Synthetic oligonucleotide; GAG chr11 5225004 5225023 5225007 -
gttgtctctgttgtcttata

SEQ ID NO: 48952 - DNA, 20 bp, Artificial Sequence
  Synthetic oligonucleotide; AGG chr11 5225003 5225022 5225006 -
ttgtctctgttgtcttatag

SEQ ID NO: 48953 - DNA, 20 bp, Artificial Sequence
  Synthetic oligonucleotide; AAG chr11 5224992 5225011 5224995 -
gtcttatagaggtctacttg

SEQ ID NO: 48954 - DNA, 20 bp, Artificial Sequence
  Synthetic oligonucleotide; AAG chr11 5224989 5225008 5224992 -
ttatagaggtctacttgaag

SEQ ID NO: 48955 - DNA, 20 bp, Artificial Sequence
  Synthetic oligonucleotide; AGG chr11 5224988 5225007 5224991 -
tatagaggtctacttgaaga

SEQ ID NO: 48956 - DNA, 20 bp, Artificial Sequence
  Synthetic oligonucleotide; CAG chr11 5224980 5224999 5224983 -
tctacttgaagaaggaaaaa

SEQ ID NO: 48957 - DNA, 20 bp, Artificial Sequence
  Synthetic oligonucleotide; AGG chr11 5224979 5224998 5224982 -
ctacttgaagaaggaaaaac

SEQ ID NO: 48958 - DNA, 20 bp, Artificial Sequence
  Synthetic oligonucleotide; GGG chr11 5224978 5224997 5224981 -
tacttgaagaaggaaaaaca

SEQ ID NO: 48959 - DNA, 20 bp, Artificial Sequence
  Synthetic oligonucleotide; GGG chr11 5224977 5224996 5224980 -
acttgaagaaggaaaaacag

SEQ ID NO: 48960 - DNA, 20 bp, Artificial Sequence
  Synthetic oligonucleotide; TGG chr11 5224971 5224990 5224974 -
agaaggaaaaacaggggtca

SEQ ID NO: 48961 - DNA, 20 bp, Artificial Sequence
  Synthetic oligonucleotide; GAG chr11 5224954 5224973 5224957 -
tcatggtttgactgtcctgt

SEQ ID NO: 48962 - DNA, 20 bp, Artificial Sequence
  Synthetic oligonucleotide; CAG chr11 5224925 5224944 5224928 -
ttccctgcctcccccactca

SEQ ID NO: 48963 - DNA, 20 bp, Artificial Sequence
  Synthetic oligonucleotide; CGG chr11 5224917 5224936 5224920 -
ctcccccactcacagtgacc

SEQ ID NO: 48964 - DNA, 20 bp, Artificial Sequence
  Synthetic oligonucleotide; CAG chr11 5224908 5224927 5224911 -
tcacagtgacccggaatctg

SEQ ID NO: 48965 - DNA, 20 bp, Artificial Sequence
  Synthetic oligonucleotide; TAG chr11 5224902 5224921 5224905 -
tgacccggaatctgcagtgc

SEQ ID NO: 48966 - DNA, 20 bp, Artificial Sequence
  Synthetic oligonucleotide; CGG chr11 5224894 5224913 5224897 -
aatctgcagtgctagtctcc

SEQ ID NO: 48967 - DNA, 20 bp, Artificial Sequence
  Synthetic oligonucleotide; CAG chr11 5224875 5224894 5224878 -
ccggaactatcactctttca

SEQ ID NO: 48968 - DNA, 20 bp, Artificial Sequence
  Synthetic oligonucleotide; TGG chr11 5224865 5224884 5224868 -
cactctttcacagtctgctt

SEQ ID NO: 48969 - DNA, 20 bp, Artificial Sequence
  Synthetic oligonucleotide; AAG chr11 5224862 5224881 5224865 -
tctttcacagtctgctttgg

SEQ ID NO: 48970 - DNA, 20 bp, Artificial Sequence
  Synthetic oligonucleotide; AGG chr11 5224861 5224880 5224864 -
ctttcacagtctgctttgga

SEQ ID NO: 48971 - DNA, 20 bp, Artificial Sequence
  Synthetic oligonucleotide; TGG chr11 5224856 5224875 5224859 -
acagtctgctttggaaggac

SEQ ID NO: 48972 - DNA, 20 bp, Artificial Sequence
  Synthetic oligonucleotide; GGG chr11 5224855 5224874 5224858 -
cagtctgctttggaaggact

SEQ ID NO: 48973 - DNA, 20 bp, Artificial Sequence
  Synthetic oligonucleotide; TAG chr11 5224850 5224869 5224853 -
tgctttggaaggactgggct

SEQ ID NO: 48974 - DNA, 20 bp, Artificial Sequence
  Synthetic oligonucleotide; AAG chr11 5224841 5224860 5224844 -
aggactgggcttagtatgaa

SEQ ID NO: 48975 - DNA, 20 bp, Artificial Sequence
  Synthetic oligonucleotide; TAG chr11 5224837 5224856 5224840 -
ctgggcttagtatgaaaagt

SEQ ID NO: 48976 - DNA, 20 bp, Artificial Sequence
  Synthetic oligonucleotide; AGG chr11 5224836 5224855 5224839 -
tgggcttagtatgaaaagtt

SEQ ID NO: 48977 - DNA, 20 bp, Artificial Sequence
  Synthetic oligonucleotide; GAG chr11 5224830 5224849 5224833 -
tagtatgaaaagttaggact

SEQ ID NO: 48978 - DNA, 20 bp, Artificial Sequence
  Synthetic oligonucleotide; AAG chr11 5224827 5224846 5224830 -
tatgaaaagttaggactgag

SEQ ID NO: 48979 - DNA, 20 bp, Artificial Sequence
  Synthetic oligonucleotide; AAG chr11 5224817 5224836 5224820 -
taggactgagaagaatttga

SEQ ID NO: 48980 - DNA, 20 bp, Artificial Sequence
  Synthetic oligonucleotide; AGG chr11 5224816 5224835 5224819 -
aggactgagaagaatttgaa

SEQ ID NO: 48981 - DNA, 20 bp, Artificial Sequence
  Synthetic oligonucleotide; CGG chr11 5224813 5224832 5224816 -
actgagaagaatttgaaagg

SEQ ID NO: 48982 - DNA, 20 bp, Artificial Sequence
  Synthetic oligonucleotide; TAG chr11 5224803 5224822 5224806 -
atttgaaaggcggctttttg

SEQ ID NO: 48983 - DNA, 20 bp, Artificial Sequence
  Synthetic oligonucleotide; TAG chr11 5224767 5224786 5224770 -
actgtcttattaccctgtca

SEQ ID NO: 48984 - DNA, 20 bp, Artificial Sequence
  Synthetic oligonucleotide; AGG chr11 5224766 5224785 5224769 -
ctgtcttattaccctgtcat

SEQ ID NO: 48985 - DNA, 20 bp, Artificial Sequence
  Synthetic oligonucleotide; TGG chr11 5224752 5224771 5224755 -
tgtcataggcccaccccaaa

SEQ ID NO: 48986 - DNA, 20 bp, Artificial Sequence
  Synthetic oligonucleotide; AAG chr11 5224749 5224768 5224752 -
cataggcccaccccaaatgg

SEQ ID NO: 48987 - DNA, 20 bp, Artificial Sequence
  Synthetic oligonucleotide; CAG chr11 5224733 5224752 5224736 -
atggaagtcccattcttcct

SEQ ID NO: 48988 - DNA, 20 bp, Artificial Sequence
  Synthetic oligonucleotide; AGG chr11 5224732 5224751 5224735 -
tggaagtcccattcttcctc

SEQ ID NO: 48989 - DNA, 20 bp, Artificial Sequence
  Synthetic oligonucleotide; AAG chr11 5224723 5224742 5224726 -
cattcttcctcaggatgttt

SEQ ID NO: 48990 - DNA, 20 bp, Artificial Sequence
  Synthetic oligonucleotide; TAG chr11 5224718 5224737 5224721 -
ttcctcaggatgtttaagat

SEQ ID NO: 48991 - DNA, 20 bp, Artificial Sequence
  Synthetic oligonucleotide; CAG chr11 5224711 5224730 5224714 -
ggatgtttaagattagcatt

SEQ ID NO: 48992 - DNA, 20 bp, Artificial Sequence
  Synthetic oligonucleotide; AGG chr11 5224710 5224729 5224713 -
gatgtttaagattagcattc

SEQ ID NO: 48993 - DNA, 20 bp, Artificial Sequence
  Synthetic oligonucleotide; AAG chr11 5224707 5224726 5224710 -
gtttaagattagcattcagg

SEQ ID NO: 48994 - DNA, 20 bp, Artificial Sequence
  Synthetic oligonucleotide; GAG chr11 5224705 5224724 5224708 -
ttaagattagcattcaggaa

SEQ ID NO: 48995 - DNA, 20 bp, Artificial Sequence
  Synthetic oligonucleotide; CAG chr11 5224700 5224719 5224703 -
attagcattcaggaagagat

SEQ ID NO: 48996 - DNA, 20 bp, Artificial Sequence
  Synthetic oligonucleotide; GAG chr11 5224698 5224717 5224701 -
tagcattcaggaagagatca

SEQ ID NO: 48997 - DNA, 20 bp, Artificial Sequence
  Synthetic oligonucleotide; AGG chr11 5224697 5224716 5224700 -
agcattcaggaagagatcag

SEQ ID NO: 48998 - DNA, 20 bp, Artificial Sequence
  Synthetic oligonucleotide; TGG chr11 5224689 5224708 5224692 -
ggaagagatcagaggtctgc

SEQ ID NO: 48999 - DNA, 20 bp, Artificial Sequence
  Synthetic oligonucleotide; TGG chr11 5224666 5224685 5224669 -
ctcccttatcatgtccctta

SEQ ID NO: 49000 - DNA, 20 bp, Artificial Sequence
  Synthetic oligonucleotide; TGG chr11 5224657 5224676 5224660 -
catgtcccttatggtgcttc

SEQ ID NO: 49001 - DNA, 20 bp, Artificial Sequence
  Synthetic oligonucleotide; CAG chr11 5224649 5224668 5224652 -
ttatggtgcttctggctctg

SEQ ID NO: 49002 - DNA, 20 bp, Artificial Sequence
  Synthetic oligonucleotide; TAG chr11 5224642 5224661 5224645 -
gcttctggctctgcagttat

SEQ ID NO: 49003 - DNA, 20 bp, Artificial Sequence
  Synthetic oligonucleotide; TAG chr11 5224637 5224656 5224640 -
tggctctgcagttattagca

SEQ ID NO: 49004 - DNA, 20 bp, Artificial Sequence
  Synthetic oligonucleotide; TAG chr11 5224590 5224609 5224593 -
catttttcttattcaatacc

SEQ ID NO: 49005 - DNA, 20 bp, Artificial Sequence
  Synthetic oligonucleotide; AGG chr11 5224589 5224608 5224592 -
atttttcttattcaatacct

SEQ ID NO: 49006 - DNA, 20 bp, Artificial Sequence
  Synthetic oligonucleotide; TAG chr11 5224586 5224605 5224589 -
tttcttattcaatacctagg

SEQ ID NO: 49007 - DNA, 20 bp, Artificial Sequence
  Synthetic oligonucleotide; AGG chr11 5224585 5224604 5224588 -
ttcttattcaatacctaggt

SEQ ID NO: 49008 - DNA, 20 bp, Artificial Sequence
  Synthetic oligonucleotide; TAG chr11 5224582 5224601 5224585 -
ttattcaatacctaggtagg

SEQ ID NO: 49009 - DNA, 20 bp, Artificial Sequence
  Synthetic oligonucleotide; TAG chr11 5224575 5224594 5224578 -
atacctaggtaggtagatgc

SEQ ID NO: 49010 - DNA, 20 bp, Artificial Sequence
  Synthetic oligonucleotide; TGG chr11 5224568 5224587 5224571 -
ggtaggtagatgctagattc

SEQ ID NO: 49011 - DNA, 20 bp, Artificial Sequence
  Synthetic oligonucleotide; GAG chr11 5224554 5224573 5224557 -
agattctggaaataaaatat

SEQ ID NO: 49012 - DNA, 20 bp, Artificial Sequence
  Synthetic oligonucleotide; AAG chr11 5224547 5224566 5224550 -
ggaaataaaatatgagtctc

SEQ ID NO: 49013 - DNA, 20 bp, Artificial Sequence
  Synthetic oligonucleotide; TGG chr11 5224544 5224563 5224547 -
aataaaatatgagtctcaag

SEQ ID NO: 49014 - DNA, 20 bp, Artificial Sequence
  Synthetic oligonucleotide; CAG chr11 5224525 5224544 5224528 -
gtggtccttgtcctctctcc

SEQ ID NO: 49015 - DNA, 20 bp, Artificial Sequence
  Synthetic oligonucleotide; TAG chr11 5224508 5224527 5224511 -
tcccagtcaaattctgaatc

SEQ ID NO: 49016 - DNA, 20 bp, Artificial Sequence
  Synthetic oligonucleotide; TGG chr11 5224504 5224523 5224507 -
agtcaaattctgaatctagt

SEQ ID NO: 49017 - DNA, 20 bp, Artificial Sequence
  Synthetic oligonucleotide; AAG chr11 5224500 5224519 5224503 -
aaattctgaatctagttggc

SEQ ID NO: 49018 - DNA, 20 bp, Artificial Sequence
  Synthetic oligonucleotide; AAG chr11 5224486 5224505 5224489 -
gttggcaagattctgaaatc

SEQ ID NO: 49019 - DNA, 20 bp, Artificial Sequence
  Synthetic oligonucleotide; AGG chr11 5224485 5224504 5224488 -
ttggcaagattctgaaatca

SEQ ID NO: 49020 - DNA, 20 bp, Artificial Sequence
  Synthetic oligonucleotide; CAG chr11 5224474 5224493 5224477 -
ctgaaatcaaggcatataat

SEQ ID NO: 49021 - DNA, 20 bp, Artificial Sequence
  Synthetic oligonucleotide; AAG chr11 5224467 5224486 5224470 -
caaggcatataatcagtaat

SEQ ID NO: 49022 - DNA, 20 bp, Artificial Sequence
  Synthetic oligonucleotide; TAG chr11 5224458 5224477 5224461 -
taatcagtaataagtgatga

SEQ ID NO: 49023 - DNA, 20 bp, Artificial Sequence
  Synthetic oligonucleotide; AAG chr11 5224455 5224474 5224458 -
tcagtaataagtgatgatag

SEQ ID NO: 49024 - DNA, 20 bp, Artificial Sequence
  Synthetic oligonucleotide; AGG chr11 5224454 5224473 5224457 -
cagtaataagtgatgataga

SEQ ID NO: 49025 - DNA, 20 bp, Artificial Sequence
  Synthetic oligonucleotide; GGG chr11 5224453 5224472 5224456 -
agtaataagtgatgatagaa

SEQ ID NO: 49026 - DNA, 20 bp, Artificial Sequence
  Synthetic oligonucleotide; TAG chr11 5224446 5224465 5224449 -
agtgatgatagaagggtata

SEQ ID NO: 49027 - DNA, 20 bp, Artificial Sequence
  Synthetic oligonucleotide; AAG chr11 5224443 5224462 5224446 -
gatgatagaagggtatatag

SEQ ID NO: 49028 - DNA, 20 bp, Artificial Sequence
  Synthetic oligonucleotide; GAG chr11 5224427 5224446 5224430 -
atagaagaattttattatat

SEQ ID NO: 49029 - DNA, 20 bp, Artificial Sequence
  Synthetic oligonucleotide; GAG chr11 5224425 5224444 5224428 -
agaagaattttattatatga

SEQ ID NO: 49030 - DNA, 20 bp, Artificial Sequence
  Synthetic oligonucleotide; AGG chr11 5224424 5224443 5224427 -
gaagaattttattatatgag

SEQ ID NO: 49031 - DNA, 20 bp, Artificial Sequence
  Synthetic oligonucleotide; GGG chr11 5224423 5224442 5224426 -
aagaattttattatatgaga

SEQ ID NO: 49032 - DNA, 20 bp, Artificial Sequence
  Synthetic oligonucleotide; CAG chr11 5224395 5224414 5224398 -
ccctcaaaatgaaatgaaat

SEQ ID NO: 49033 - DNA, 20 bp, Artificial Sequence
  Synthetic oligonucleotide; TGG chr11 5224355 5224374 5224358 -
taaacaaaaataaatttgaa

SEQ ID NO: 49034 - DNA, 20 bp, Artificial Sequence
  Synthetic oligonucleotide; GGG chr11 5224354 5224373 5224357 -
aaacaaaaataaatttgaat

SEQ ID NO: 49035 - DNA, 20 bp, Artificial Sequence
  Synthetic oligonucleotide; AAG chr11 5224348 5224367 5224351 -
aaataaatttgaatgggtta

SEQ ID NO: 49036 - DNA, 20 bp, Artificial Sequence
  Synthetic oligonucleotide; AAG chr11 5224336 5224355 5224339 -
atgggttaaagaattaaact

SEQ ID NO: 49037 - DNA, 20 bp, Artificial Sequence
  Synthetic oligonucleotide; AAG chr11 5224310 5224329 5224313 -
taaaaccataaaaattttta

SEQ ID NO: 49038 - DNA, 20 bp, Artificial Sequence
  Synthetic oligonucleotide; AAG chr11 5224300 5224319 5224303 -
aaaatttttaaagaaatcaa

SEQ ID NO: 49039 - DNA, 20 bp, Artificial Sequence
  Synthetic oligonucleotide; AAG chr11 5224297 5224316 5224300 -
atttttaaagaaatcaaaag

SEQ ID NO: 49040 - DNA, 20 bp, Artificial Sequence
  Synthetic oligonucleotide; CAG chr11 5224273 5224292 5224276 -
aaattctaatattcacgttg

SEQ ID NO: 49041 - DNA, 20 bp, Artificial Sequence
  Synthetic oligonucleotide; GAG chr11 5224250 5224269 5224253 -
ccgttttttgaatttgatat

SEQ ID NO: 49042 - DNA, 20 bp, Artificial Sequence
  Synthetic oligonucleotide; AAG chr11 5224247 5224266 5224250 -
ttttttgaatttgatatgag

SEQ ID NO: 49043 - DNA, 20 bp, Artificial Sequence
  Synthetic oligonucleotide; AAG chr11 5224242 5224261 5224245 -
tgaatttgatatgagaagca

SEQ ID NO: 49044 - DNA, 20 bp, Artificial Sequence
  Synthetic oligonucleotide; AGG chr11 5224241 5224260 5224244 -
gaatttgatatgagaagcaa

SEQ ID NO: 49045 - DNA, 20 bp, Artificial Sequence
  Synthetic oligonucleotide; AAG chr11 5224232 5224251 5224235 -
atgagaagcaaaggcaacaa

SEQ ID NO: 49046 - DNA, 20 bp, Artificial Sequence
  Synthetic oligonucleotide; AGG chr11 5224231 5224250 5224234 -
tgagaagcaaaggcaacaaa

SEQ ID NO: 49047 - DNA, 20 bp, Artificial Sequence
  Synthetic oligonucleotide; AAG chr11 5224221 5224240 5224224 -
aggcaacaaaaggaaaaata

SEQ ID NO: 49048 - DNA, 20 bp, Artificial Sequence
  Synthetic oligonucleotide; AAG chr11 5224218 5224237 5224221 -
caacaaaaggaaaaataaag

SEQ ID NO: 49049 - DNA, 20 bp, Artificial Sequence
  Synthetic oligonucleotide; GAG chr11 5224214 5224233 5224217 -
aaaaggaaaaataaagaagt

SEQ ID NO: 49050 - DNA, 20 bp, Artificial Sequence
  Synthetic oligonucleotide; AGG chr11 5224213 5224232 5224216 -
aaaggaaaaataaagaagtg

SEQ ID NO: 49051 - DNA, 20 bp, Artificial Sequence
  Synthetic oligonucleotide; AAG chr11 5224158 5224177 5224161 -
acaaaacaatgaacaaatga

SEQ ID NO: 49052 - DNA, 20 bp, Artificial Sequence
  Synthetic oligonucleotide; AGG chr11 5224157 5224176 5224160 -
caaaacaatgaacaaatgaa

SEQ ID NO: 49053 - DNA, 20 bp, Artificial Sequence
  Synthetic oligonucleotide; TGG chr11 5224142 5224161 5224145 -
atgaaaggtgaaccatgaaa

SEQ ID NO: 49054 - DNA, 20 bp, Artificial Sequence
  Synthetic oligonucleotide; TGG chr11 5224106 5224125 5224109 -
caaatatttcttaaatattt

SEQ ID NO: 49055 - DNA, 20 bp, Artificial Sequence
  Synthetic oligonucleotide; AAG chr11 5224085 5224104 5224088 -
ggttaatatccaaaatatat

SEQ ID NO: 49056 - DNA, 20 bp, Artificial Sequence
  Synthetic oligonucleotide; CAG chr11 5224077 5224096 5224080 -
tccaaaatatataagaaaca

SEQ ID NO: 49057 - DNA, 20 bp, Artificial Sequence
  Synthetic oligonucleotide; TAG chr11 5224044 5224063 5224047 -
aacaaacaaaaaattaaaaa

SEQ ID NO: 49058 - DNA, 20 bp, Artificial Sequence
  Synthetic oligonucleotide; AGG chr11 5224043 5224062 5224046 -
acaaacaaaaaattaaaaat

SEQ ID NO: 49059 - DNA, 20 bp, Artificial Sequence
  Synthetic oligonucleotide; AAG chr11 5224023 5224042 5224026 -
aggaaaataaaaaaattaaa

SEQ ID NO: 49060 - DNA, 20 bp, Artificial Sequence
  Synthetic oligonucleotide; AAG chr11 5224020 5224039 5224023 -
aaaataaaaaaattaaaaag

SEQ ID NO: 49061 - DNA, 20 bp, Artificial Sequence
  Synthetic oligonucleotide; TGG chr11 5224001 5224020 5224004 -
gaagaaaatcctgccattta

SEQ ID NO: 49062 - DNA, 20 bp, Artificial Sequence
  Synthetic oligonucleotide; CAG chr11 5223998 5224017 5224001 -
gaaaatcctgccatttatgg

SEQ ID NO: 49063 - DNA, 20 bp, Artificial Sequence
  Synthetic oligonucleotide; TGG chr11 5223983 5224002 5223986 -
tatggcagaattgatgaacc

SEQ ID NO: 49064 - DNA, 20 bp, Artificial Sequence
  Synthetic oligonucleotide; GAG chr11 5223981 5224000 5223984 -
tggcagaattgatgaacctg

SEQ ID NO: 49065 - DNA, 20 bp, Artificial Sequence
  Synthetic oligonucleotide; AGG chr11 5223980 5223999 5223983 -
ggcagaattgatgaacctgg

SEQ ID NO: 49066 - DNA, 20 bp, Artificial Sequence
  Synthetic oligonucleotide; AAG chr11 5223967 5223986 5223970 -
aacctggaggatgtaaaact

SEQ ID NO: 49067 - DNA, 20 bp, Artificial Sequence
  Synthetic oligonucleotide; AAG chr11 5223958 5223977 5223961 -
gatgtaaaactaagaaaaat

SEQ ID NO: 49068 - DNA, 20 bp, Artificial Sequence
  Synthetic oligonucleotide; AAG chr11 5223944 5223963 5223947 -
aaaaataagcctgacacaaa

SEQ ID NO: 49069 - DNA, 20 bp, Artificial Sequence
  Synthetic oligonucleotide; AAG chr11 5223901 5223920 5223904 -
ctcatatgtgaaacataaaa

SEQ ID NO: 49070 - DNA, 20 bp, Artificial Sequence
  Synthetic oligonucleotide; TGG chr11 5223889 5223908 5223892 -
acataaaaaagtcactctca

SEQ ID NO: 49071 - DNA, 20 bp, Artificial Sequence
  Synthetic oligonucleotide; CAG chr11 5223883 5223902 5223886 -
aaaagtcactctcatggaaa

SEQ ID NO: 49072 - DNA, 20 bp, Artificial Sequence
  Synthetic oligonucleotide; CAG chr11 5223879 5223898 5223882 -
gtcactctcatggaaacaga

SEQ ID NO: 49073 - DNA, 20 bp, Artificial Sequence
  Synthetic oligonucleotide; TAG chr11 5223876 5223895 5223879 -
actctcatggaaacagacag

SEQ ID NO: 49074 - DNA, 20 bp, Artificial Sequence
  Synthetic oligonucleotide; GAG chr11 5223874 5223893 5223877 -
tctcatggaaacagacagta

SEQ ID NO: 49075 - DNA, 20 bp, Artificial Sequence
  Synthetic oligonucleotide; AGG chr11 5223873 5223892 5223876 -
ctcatggaaacagacagtag

SEQ ID NO: 49076 - DNA, 20 bp, Artificial Sequence
  Synthetic oligonucleotide; TGG chr11 5223868 5223887 5223871 -
ggaaacagacagtagaggta

SEQ ID NO: 49077 - DNA, 20 bp, Artificial Sequence
  Synthetic oligonucleotide; CAG chr11 5223861 5223880 5223864 -
gacagtagaggtatggtttc

SEQ ID NO: 49078 - DNA, 20 bp, Artificial Sequence
  Synthetic oligonucleotide; AGG chr11 5223860 5223879 5223863 -
acagtagaggtatggtttcc

SEQ ID NO: 49079 - DNA, 20 bp, Artificial Sequence
  Synthetic oligonucleotide; GGG chr11 5223859 5223878 5223862 -
cagtagaggtatggtttcca

SEQ ID NO: 49080 - DNA, 20 bp, Artificial Sequence
  Synthetic oligonucleotide; GGG chr11 5223858 5223877 5223861 -
agtagaggtatggtttccag

SEQ ID NO: 49081 - DNA, 20 bp, Artificial Sequence
  Synthetic oligonucleotide; TGG chr11 5223854 5223873 5223857 -
gaggtatggtttccaggggt

SEQ ID NO: 49082 - DNA, 20 bp, Artificial Sequence
  Synthetic oligonucleotide; GGG chr11 5223853 5223872 5223856 -
aggtatggtttccaggggtt

SEQ ID NO: 49083 - DNA, 20 bp, Artificial Sequence
  Synthetic oligonucleotide; GGG chr11 5223852 5223871 5223855 -
ggtatggtttccaggggttg

SEQ ID NO: 49084 - DNA, 20 bp, Artificial Sequence
  Synthetic oligonucleotide; GGG chr11 5223851 5223870 5223854 -
gtatggtttccaggggttgg

SEQ ID NO: 49085 - DNA, 20 bp, Artificial Sequence
  Synthetic oligonucleotide; TGG chr11 5223848 5223867 5223851 -
tggtttccaggggttggggg

SEQ ID NO: 49086 - DNA, 20 bp, Artificial Sequence
  Synthetic oligonucleotide; GGG chr11 5223847 5223866 5223850 -
ggtttccaggggttgggggt

SEQ ID NO: 49087 - DNA, 20 bp, Artificial Sequence
  Synthetic oligonucleotide; GAG chr11 5223845 5223864 5223848 -
tttccaggggttgggggtgg

SEQ ID NO: 49088 - DNA, 20 bp, Artificial Sequence
  Synthetic oligonucleotide; CAG chr11 5223839 5223858 5223842 -
ggggttgggggtgggagaat

SEQ ID NO: 49089 - DNA, 20 bp, Artificial Sequence
  Synthetic oligonucleotide; AGG chr11 5223838 5223857 5223841 -
gggttgggggtgggagaatc

SEQ ID NO: 49090 - DNA, 20 bp, Artificial Sequence
  Synthetic oligonucleotide; AAG chr11 5223822 5223841 5223825 -
aatcaggaaactattactca

SEQ ID NO: 49091 - DNA, 20 bp, Artificial Sequence
  Synthetic oligonucleotide; AGG chr11 5223821 5223840 5223824 -
atcaggaaactattactcaa

SEQ ID NO: 49092 - DNA, 20 bp, Artificial Sequence
  Synthetic oligonucleotide; GGG chr11 5223820 5223839 5223823 -
tcaggaaactattactcaaa

SEQ ID NO: 49093 - DNA, 20 bp, Artificial Sequence
  Synthetic oligonucleotide; CAG chr11 5223807 5223826 5223810 -
actcaaagggtataaaattt

SEQ ID NO: 49094 - DNA, 20 bp, Artificial Sequence
  Synthetic oligonucleotide; TGG chr11 5223799 5223818 5223802 -
ggtataaaatttcagttatg

SEQ ID NO: 49095 - DNA, 20 bp, Artificial Sequence
  Synthetic oligonucleotide; GGG chr11 5223798 5223817 5223801 -
gtataaaatttcagttatgt

SEQ ID NO: 49096 - DNA, 20 bp, Artificial Sequence
  Synthetic oligonucleotide; TAG chr11 5223783 5223802 5223786 -
tatgtgggatgaataaattc

SEQ ID NO: 49097 - DNA, 20 bp, Artificial Sequence
  Synthetic oligonucleotide; CAG chr11 5223768 5223787 5223771 -
aattctagatatctaatgta

SEQ ID NO: 49098 - DNA, 20 bp, Artificial Sequence
  Synthetic oligonucleotide; TAG chr11 5223754 5223773 5223757 -
aatgtacagcatcgtgactg

SEQ ID NO: 49099 - DNA, 20 bp, Artificial Sequence
  Synthetic oligonucleotide; AAG chr11 5223738 5223757 5223741 -
actgtagttaattgtactgt

SEQ ID NO: 49100 - DNA, 20 bp, Artificial Sequence
  Synthetic oligonucleotide; AAG chr11 5223718 5223737 5223721 -
aagtatatttaaaatttgca

SEQ ID NO: 49101 - DNA, 20 bp, Artificial Sequence
  Synthetic oligonucleotide; GAG chr11 5223716 5223735 5223719 -
gtatatttaaaatttgcaaa

SEQ ID NO: 49102 - DNA, 20 bp, Artificial Sequence
  Synthetic oligonucleotide; GAG chr11 5223714 5223733 5223717 -
atatttaaaatttgcaaaga

SEQ ID NO: 49103 - DNA, 20 bp, Artificial Sequence
  Synthetic oligonucleotide; TAG chr11 5223711 5223730 5223714 -
tttaaaatttgcaaagagag

SEQ ID NO: 49104 - DNA, 20 bp, Artificial Sequence
  Synthetic oligonucleotide; TAG chr11 5223693 5223712 5223696 -
agtagatttttttttttttt

SEQ ID NO: 49105 - DNA, 20 bp, Artificial Sequence
  Synthetic oligonucleotide; TGG chr11 5223689 5223708 5223692 -
gatttttttttttttttaga

SEQ ID NO: 49106 - DNA, 20 bp, Artificial Sequence
  Synthetic oligonucleotide; GAG chr11 5223687 5223706 5223690 -
tttttttttttttttagatg

SEQ ID NO: 49107 - DNA, 20 bp, Artificial Sequence
  Synthetic oligonucleotide; CAG chr11 5223668 5223687 5223671 -
ggagttttgctcttgttgtc

SEQ ID NO: 49108 - DNA, 20 bp, Artificial Sequence
  Synthetic oligonucleotide; AGG chr11 5223667 5223686 5223670 -
gagttttgctcttgttgtcc

SEQ ID NO: 49109 - DNA, 20 bp, Artificial Sequence
  Synthetic oligonucleotide; TGG chr11 5223663 5223682 5223666 -
tttgctcttgttgtccaggc

SEQ ID NO: 49110 - DNA, 20 bp, Artificial Sequence
  Synthetic oligonucleotide; GAG chr11 5223661 5223680 5223664 -
tgctcttgttgtccaggctg

SEQ ID NO: 49111 - DNA, 20 bp, Artificial Sequence
  Synthetic oligonucleotide; TGG chr11 5223653 5223672 5223656 -
ttgtccaggctggagtgcaa

SEQ ID NO: 49112 - DNA, 20 bp, Artificial Sequence
  Synthetic oligonucleotide; AAG chr11 5223649 5223668 5223652 -
ccaggctggagtgcaatggc

SEQ ID NO: 49113 - DNA, 20 bp, Artificial Sequence
  Synthetic oligonucleotide; TGG chr11 5223642 5223661 5223645 -
ggagtgcaatggcaagatct

SEQ ID NO: 49114 - DNA, 20 bp, Artificial Sequence
  Synthetic oligonucleotide; TGG chr11 5223618 5223637 5223621 -
tcactgcaacctccgcctcc

SEQ ID NO: 49115 - DNA, 20 bp, Artificial Sequence
  Synthetic oligonucleotide; GGG chr11 5223617 5223636 5223620 -
cactgcaacctccgcctcct

SEQ ID NO: 49116 - DNA, 20 bp, Artificial Sequence
  Synthetic oligonucleotide; AAG chr11 5223611 5223630 5223614 -
aacctccgcctcctgggttc

SEQ ID NO: 49117 - DNA, 20 bp, Artificial Sequence
  Synthetic oligonucleotide; CAG chr11 5223594 5223613 5223597 -
ttcaagcaaatctcctgcct

SEQ ID NO: 49118 - DNA, 20 bp, Artificial Sequence
  Synthetic oligonucleotide; GAG chr11 5223585 5223604 5223588 -
atctcctgcctcagcctccc

SEQ ID NO: 49119 - DNA, 20 bp, Artificial Sequence
  Synthetic oligonucleotide; TAG chr11 5223582 5223601 5223585 -
tcctgcctcagcctcccgag

SEQ ID NO: 49120 - DNA, 20 bp, Artificial Sequence
  Synthetic oligonucleotide; TGG chr11 5223578 5223597 5223581 -
gcctcagcctcccgagtagc

SEQ ID NO: 49121 - DNA, 20 bp, Artificial Sequence
  Synthetic oligonucleotide; GGG chr11 5223577 5223596 5223580 -
cctcagcctcccgagtagct

SEQ ID NO: 49122 - DNA, 20 bp, Artificial Sequence
  Synthetic oligonucleotide; CAG chr11 5223570 5223589 5223573 -
ctcccgagtagctgggatta

SEQ ID NO: 49123 - DNA, 20 bp, Artificial Sequence
  Synthetic oligonucleotide; AGG chr11 5223569 5223588 5223572 -
tcccgagtagctgggattac

SEQ ID NO: 49124 - DNA, 20 bp, Artificial Sequence
  Synthetic oligonucleotide; CAG chr11 5223550 5223569 5223553 -
caggcatgcgacaccatgcc

SEQ ID NO: 49125 - DNA, 20 bp, Artificial Sequence
  Synthetic oligonucleotide; TAG chr11 5223532 5223551 5223535 -
cccagctaattttgtatttt

SEQ ID NO: 49126 - DNA, 20 bp, Artificial Sequence
  Synthetic oligonucleotide; TAG chr11 5223529 5223548 5223532 -
agctaattttgtatttttag

SEQ ID NO: 49127 - DNA, 20 bp, Artificial Sequence
  Synthetic oligonucleotide; GAG chr11 5223527 5223546 5223530 -
ctaattttgtatttttagta

SEQ ID NO: 49128 - DNA, 20 bp, Artificial Sequence
  Synthetic oligonucleotide; CGG chr11 5223523 5223542 5223526 -
ttttgtatttttagtagaga

SEQ ID NO: 49129 - DNA, 20 bp, Artificial Sequence
  Synthetic oligonucleotide; GGG chr11 5223522 5223541 5223525 -
tttgtatttttagtagagac

SEQ ID NO: 49130 - DNA, 20 bp, Artificial Sequence
  Synthetic oligonucleotide; GGG chr11 5223521 5223540 5223524 -
ttgtatttttagtagagacg

SEQ ID NO: 49131 - DNA, 20 bp, Artificial Sequence
  Synthetic oligonucleotide; TGG chr11 5223507 5223526 5223510 -
gagacggggtttctccatgt

SEQ ID NO: 49132 - DNA, 20 bp, Artificial Sequence
  Synthetic oligonucleotide; CAG chr11 5223503 5223522 5223506 -
cggggtttctccatgttggt

SEQ ID NO: 49133 - DNA, 20 bp, Artificial Sequence
  Synthetic oligonucleotide; AGG chr11 5223502 5223521 5223505 -
ggggtttctccatgttggtc

SEQ ID NO: 49134 - DNA, 20 bp, Artificial Sequence
  Synthetic oligonucleotide; CGG chr11 5223484 5223503 5223487 -
tcaggctgatccgcctgcct

SEQ ID NO: 49135 - DNA, 20 bp, Artificial Sequence
  Synthetic oligonucleotide; AAG chr11 5223474 5223493 5223477 -
ccgcctgcctcggccaccca

SEQ ID NO: 49136 - DNA, 20 bp, Artificial Sequence
  Synthetic oligonucleotide; AGG chr11 5223473 5223492 5223476 -
cgcctgcctcggccacccaa

SEQ ID NO: 49137 - DNA, 20 bp, Artificial Sequence
  Synthetic oligonucleotide; GGG chr11 5223472 5223491 5223475 -
gcctgcctcggccacccaaa

SEQ ID NO: 49138 - DNA, 20 bp, Artificial Sequence
  Synthetic oligonucleotide; TGG chr11 5223468 5223487 5223471 -
gcctcggccacccaaagggc

SEQ ID NO: 49139 - DNA, 20 bp, Artificial Sequence
  Synthetic oligonucleotide; GGG chr11 5223467 5223486 5223470 -
cctcggccacccaaagggct

SEQ ID NO: 49140 - DNA, 20 bp, Artificial Sequence
  Synthetic oligonucleotide; CAG chr11 5223460 5223479 5223463 -
cacccaaagggctgggatta

SEQ ID NO: 49141 - DNA, 20 bp, Artificial Sequence
  Synthetic oligonucleotide; AGG chr11 5223459 5223478 5223462 -
acccaaagggctgggattac

SEQ ID NO: 49142 - DNA, 20 bp, Artificial Sequence
  Synthetic oligonucleotide; GAG chr11 5223453 5223472 5223456 -
agggctgggattacaggcgt

SEQ ID NO: 49143 - DNA, 20 bp, Artificial Sequence
  Synthetic oligonucleotide; CGG chr11 5223446 5223465 5223449 -
ggattacaggcgtgagccac

SEQ ID NO: 49144 - DNA, 20 bp, Artificial Sequence
  Synthetic oligonucleotide; GGG chr11 5223445 5223464 5223448 -
gattacaggcgtgagccacc

SEQ ID NO: 49145 - DNA, 20 bp, Artificial Sequence
  Synthetic oligonucleotide; TGG chr11 5223440 5223459 5223443 -
caggcgtgagccaccgggcc

SEQ ID NO: 49146 - DNA, 20 bp, Artificial Sequence
  Synthetic oligonucleotide; GAG chr11 5223435 5223454 5223438 -
gtgagccaccgggcctggcc

SEQ ID NO: 49147 - DNA, 20 bp, Artificial Sequence
  Synthetic oligonucleotide; GAG chr11 5223433 5223452 5223436 -
gagccaccgggcctggccga

SEQ ID NO: 49148 - DNA, 20 bp, Artificial Sequence
  Synthetic oligonucleotide; TAG chr11 5223430 5223449 5223433 -
ccaccgggcctggccgagag

SEQ ID NO: 49149 - DNA, 20 bp, Artificial Sequence
  Synthetic oligonucleotide; AAG chr11 5223420 5223439 5223423 -
tggccgagagtagatcttaa

SEQ ID NO: 49150 - DNA, 20 bp, Artificial Sequence
  Synthetic oligonucleotide; AAG chr11 5223407 5223426 5223410 -
atcttaaaagcatttaccac

SEQ ID NO: 49151 - DNA, 20 bp, Artificial Sequence
  Synthetic oligonucleotide; AAG chr11 5223401 5223420 5223404 -
aaagcatttaccacaagaaa

SEQ ID NO: 49152 - DNA, 20 bp, Artificial Sequence
  Synthetic oligonucleotide; AGG chr11 5223400 5223419 5223403 -
aagcatttaccacaagaaaa

SEQ ID NO: 49153 - DNA, 20 bp, Artificial Sequence
  Synthetic oligonucleotide; GAG chr11 5223388 5223407 5223391 -
caagaaaaaggtaactatgt

SEQ ID NO: 49154 - DNA, 20 bp, Artificial Sequence
  Synthetic oligonucleotide; TGG chr11 5223381 5223400 5223384 -
aaggtaactatgtgagataa

SEQ ID NO: 49155 - DNA, 20 bp, Artificial Sequence
  Synthetic oligonucleotide; GGG chr11 5223380 5223399 5223383 -
aggtaactatgtgagataat

SEQ ID NO: 49156 - DNA, 20 bp, Artificial Sequence
  Synthetic oligonucleotide; TAG chr11 5223368 5223387 5223371 -
gagataatgggtatgttaat

SEQ ID NO: 49157 - DNA, 20 bp, Artificial Sequence
  Synthetic oligonucleotide; TGG chr11 5223357 5223376 5223360 -
tatgttaattagcttgattg

SEQ ID NO: 49158 - DNA, 20 bp, Artificial Sequence
  Synthetic oligonucleotide; AAG chr11 5223342 5223361 5223345 -
gattgtggtaatcatttcac

SEQ ID NO: 49159 - DNA, 20 bp, Artificial Sequence
  Synthetic oligonucleotide; AGG chr11 5223341 5223360 5223344 -
attgtggtaatcatttcaca

SEQ ID NO: 49160 - DNA, 20 bp, Artificial Sequence
  Synthetic oligonucleotide; AAG chr11 5223265 5223284 5223268 -
ttgtgaatgatacctcaata

SEQ ID NO: 49161 - DNA, 20 bp, Artificial Sequence
  Synthetic oligonucleotide; AAG chr11 5223259 5223278 5223262 -
atgatacctcaataaagttg

SEQ ID NO: 49162 - DNA, 20 bp, Artificial Sequence
  Synthetic oligonucleotide; AAG chr11 5223246 5223265 5223249 -
aaagttgaagaataataaaa

SEQ ID NO: 49163 - DNA, 20 bp, Artificial Sequence
  Synthetic oligonucleotide; TAG chr11 5223241 5223260 5223244 -
tgaagaataataaaaaagaa

SEQ ID NO: 49164 - DNA, 20 bp, Artificial Sequence
  Synthetic oligonucleotide; TAG chr11 5223188 5223207 5223191 -
aaaaaatgcatcttgatgat

SEQ ID NO: 49165 - DNA, 20 bp, Artificial Sequence
  Synthetic oligonucleotide; CAG chr11 5223166 5223185 5223169 -
gaattgcattcttgattttt

SEQ ID NO: 49166 - DNA, 20 bp, Artificial Sequence
  Synthetic oligonucleotide; TAG chr11 5223110 5223129 5223113 -
caaaacaatacaataaattt

SEQ ID NO: 49167 - DNA, 20 bp, Artificial Sequence
  Synthetic oligonucleotide; TAG chr11 5223054 5223073 5223057 -
aattatatatatatatattt

SEQ ID NO: 49168 - DNA, 20 bp, Artificial Sequence
  Synthetic oligonucleotide; TAG chr11 5223041 5223060 5223044 -
tatattttagatattttgta

SEQ ID NO: 49169 - DNA, 20 bp, Artificial Sequence
  Synthetic oligonucleotide; TAG chr11 5223028 5223047 5223031 -
ttttgtatagttttactccc

SEQ ID NO: 49170 - DNA, 20 bp, Artificial Sequence
  Synthetic oligonucleotide; TAG chr11 5223019 5223038 5223022 -
gttttactccctagattttc

SEQ ID NO: 49171 - DNA, 20 bp, Artificial Sequence
  Synthetic oligonucleotide; TAG chr11 5223003 5223022 5223006 -
tttctagtgttattattaaa

SEQ ID NO: 49172 - DNA, 20 bp, Artificial Sequence
  Synthetic oligonucleotide; AAG chr11 5222998 5223017 5223001 -
agtgttattattaaatagtg

SEQ ID NO: 49173 - DNA, 20 bp, Artificial Sequence
  Synthetic oligonucleotide; AAG chr11 5222933 5222952 5222936 -
tcatttctaacattctctct

SEQ ID NO: 49174 - DNA, 20 bp, Artificial Sequence
  Synthetic oligonucleotide; TGG chr11 5222884 5222903 5222887 -
ttaatattatctctttctgc

SEQ ID NO: 49175 - DNA, 20 bp, Artificial Sequence
  Synthetic oligonucleotide; TGG chr11 5222864 5222883 5222867 -
tggaaatacattgttacttt

SEQ ID NO: 49176 - DNA, 20 bp, Artificial Sequence
  Synthetic oligonucleotide; TGG chr11 5222849 5222868 5222852 -
acttttggtttatctaaaaa

SEQ ID NO: 49177 - DNA, 20 bp, Artificial Sequence
  Synthetic oligonucleotide; AAG chr11 5222796 5222815 5222799 -
aattaataccactcatgtgt

SEQ ID NO: 49178 - DNA, 20 bp, Artificial Sequence
  Synthetic oligonucleotide; AAG chr11 5222792 5222811 5222795 -
aataccactcatgtgtaagt

SEQ ID NO: 49179 - DNA, 20 bp, Artificial Sequence
  Synthetic oligonucleotide; TAG chr11 5222788 5222807 5222791 -
ccactcatgtgtaagtaaga

SEQ ID NO: 49180 - DNA, 20 bp, Artificial Sequence
  Synthetic oligonucleotide; TGG chr11 5222785 5222804 5222788 -
ctcatgtgtaagtaagatag

SEQ ID NO: 49181 - DNA, 20 bp, Artificial Sequence
  Synthetic oligonucleotide; TAG chr11 5222776 5222795 5222779 -
aagtaagatagtggaataaa

SEQ ID NO: 49182 - DNA, 20 bp, Artificial Sequence
  Synthetic oligonucleotide; TAG chr11 5222721 5222740 5222724 -
taatgtgatatataaaaata

SEQ ID NO: 49183 - DNA, 20 bp, Artificial Sequence
  Synthetic oligonucleotide; TAG chr11 5222708 5222727 5222711 -
aaaaatatagcttttaaatt

SEQ ID NO: 49184 - DNA, 20 bp, Artificial Sequence
  Synthetic oligonucleotide; TGG chr11 5222703 5222722 5222706 -
tatagcttttaaatttagct

SEQ ID NO: 49185 - DNA, 20 bp, Artificial Sequence
  Synthetic oligonucleotide; CAG chr11 5222686 5222705 5222689 -
gcttggaaataaaaaacaaa

SEQ ID NO: 49186 - DNA, 20 bp, Artificial Sequence
  Synthetic oligonucleotide; AAG chr11 5222658 5222677 5222661 -
gaacaactatactttttgaa

SEQ ID NO: 49187 - DNA, 20 bp, Artificial Sequence
  Synthetic oligonucleotide; GAG chr11 5222656 5222675 5222659 -
acaactatactttttgaaaa

SEQ ID NO: 49188 - DNA, 20 bp, Artificial Sequence
  Synthetic oligonucleotide; AAG chr11 5222651 5222670 5222654 -
tatactttttgaaaagagta

SEQ ID NO: 49189 - DNA, 20 bp, Artificial Sequence
  Synthetic oligonucleotide; TAG chr11 5222608 5222627 5222611 -
accacaatcgattacacaat

SEQ ID NO: 49190 - DNA, 20 bp, Artificial Sequence
  Synthetic oligonucleotide; AGG chr11 5222607 5222626 5222610 -
ccacaatcgattacacaatt

SEQ ID NO: 49191 - DNA, 20 bp, Artificial Sequence
  Synthetic oligonucleotide; AAG chr11 5222600 5222619 5222603 -
cgattacacaattaggtgtg

SEQ ID NO: 49192 - DNA, 20 bp, Artificial Sequence
  Synthetic oligonucleotide; AGG chr11 5222599 5222618 5222602 -
gattacacaattaggtgtga

SEQ ID NO: 49193 - DNA, 20 bp, Artificial Sequence
  Synthetic oligonucleotide; CAG chr11 5222589 5222608 5222592 -
ttaggtgtgaaggtaaaatt

SEQ ID NO: 49194 - DNA, 20 bp, Artificial Sequence
  Synthetic oligonucleotide; TAG chr11 5222574 5222593 5222577 -
aaattcagtcacgaaaaaac

SEQ ID NO: 49195 - DNA, 20 bp, Artificial Sequence
  Synthetic oligonucleotide; TGG chr11 5222561 5222580 5222564 -
aaaaaactagaataaaaata

SEQ ID NO: 49196 - DNA, 20 bp, Artificial Sequence
  Synthetic oligonucleotide; GGG chr11 5222560 5222579 5222563 -
aaaaactagaataaaaatat

SEQ ID NO: 49197 - DNA, 20 bp, Artificial Sequence
  Synthetic oligonucleotide; AAG chr11 5222557 5222576 5222560 -
aactagaataaaaatatggg

SEQ ID NO: 49198 - DNA, 20 bp, Artificial Sequence
  Synthetic oligonucleotide; TAG chr11 5222539 5222558 5222542 -
ggaagacatgtatataatct

SEQ ID NO: 49199 - DNA, 20 bp, Artificial Sequence
  Synthetic oligonucleotide; GAG chr11 5222537 5222556 5222540 -
aagacatgtatataatctta

SEQ ID NO: 49200 - DNA, 20 bp, Artificial Sequence
  Synthetic oligonucleotide; AAG chr11 5222506 5222525 5222509 -
gttatttaattatcaaccca

SEQ ID NO: 49201 - DNA, 20 bp, Artificial Sequence
  Synthetic oligonucleotide; TAG chr11 5222503 5222522 5222506 -
atttaattatcaacccaaag

SEQ ID NO: 49202 - DNA, 20 bp, Artificial Sequence
  Synthetic oligonucleotide; AAG chr11 5222492 5222511 5222495 -
aacccaaagtagaaactatc

SEQ ID NO: 49203 - DNA, 20 bp, Artificial Sequence
  Synthetic oligonucleotide; AGG chr11 5222491 5222510 5222494 -
acccaaagtagaaactatca

SEQ ID NO: 49204 - DNA, 20 bp, Artificial Sequence
  Synthetic oligonucleotide; GGG chr11 5222490 5222509 5222493 -
cccaaagtagaaactatcaa

SEQ ID NO: 49205 - DNA, 20 bp, Artificial Sequence
  Synthetic oligonucleotide; GAG chr11 5222488 5222507 5222491 -
caaagtagaaactatcaagg

SEQ ID NO: 49206 - DNA, 20 bp, Artificial Sequence
  Synthetic oligonucleotide; CAG chr11 5222476 5222495 5222479 -
tatcaagggagaaataaatt

SEQ ID NO: 49207 - DNA, 20 bp, Artificial Sequence
  Synthetic oligonucleotide; AAG chr11 5222463 5222482 5222466 -
ataaattcagtcaacaataa

SEQ ID NO: 49208 - DNA, 20 bp, Artificial Sequence
  Synthetic oligonucleotide; AAG chr11 5222455 5222474 5222458 -
agtcaacaataaaagcattt

SEQ ID NO: 49209 - DNA, 20 bp, Artificial Sequence
  Synthetic oligonucleotide; AAG chr11 5222452 5222471 5222455 -
caacaataaaagcatttaag

SEQ ID NO: 49210 - DNA, 20 bp, Artificial Sequence
  Synthetic oligonucleotide; TAG chr11 5222443 5222462 5222446 -
aagcatttaagaagttattc

SEQ ID NO: 49211 - DNA, 20 bp, Artificial Sequence
  Synthetic oligonucleotide; AGG chr11 5222442 5222461 5222445 -
agcatttaagaagttattct

SEQ ID NO: 49212 - DNA, 20 bp, Artificial Sequence
  Synthetic oligonucleotide; TGG chr11 5222438 5222457 5222441 -
tttaagaagttattctaggc

SEQ ID NO: 49213 - DNA, 20 bp, Artificial Sequence
  Synthetic oligonucleotide; GGG chr11 5222437 5222456 5222440 -
ttaagaagttattctaggct

SEQ ID NO: 49214 - DNA, 20 bp, Artificial Sequence
  Synthetic oligonucleotide; GAG chr11 5222435 5222454 5222438 -
aagaagttattctaggctgg

SEQ ID NO: 49215 - DNA, 20 bp, Artificial Sequence
  Synthetic oligonucleotide; CGG chr11 5222432 5222451 5222435 -
aagttattctaggctgggag

SEQ ID NO: 49216 - DNA, 20 bp, Artificial Sequence
  Synthetic oligonucleotide; TGG chr11 5222429 5222448 5222432 -
ttattctaggctgggagcgg

SEQ ID NO: 49217 - DNA, 20 bp, Artificial Sequence
  Synthetic oligonucleotide; CAG chr11 5222410 5222429 5222413 -
gtggctcacacctgcaattg

SEQ ID NO: 49218 - DNA, 20 bp, Artificial Sequence
  Synthetic oligonucleotide; TGG chr11 5222402 5222421 5222405 -
cacctgcaattgcagcactt

SEQ ID NO: 49219 - DNA, 20 bp, Artificial Sequence
  Synthetic oligonucleotide; GGG chr11 5222401 5222420 5222404 -
acctgcaattgcagcacttt

SEQ ID NO: 49220 - DNA, 20 bp, Artificial Sequence
  Synthetic oligonucleotide; GAG chr11 5222399 5222418 5222402 -
ctgcaattgcagcactttgg

SEQ ID NO: 49221 - DNA, 20 bp, Artificial Sequence
  Synthetic oligonucleotide; AGG chr11 5222398 5222417 5222401 -
tgcaattgcagcactttggg

SEQ ID NO: 49222 - DNA, 20 bp, Artificial Sequence
  Synthetic oligonucleotide; TAG chr11 5222393 5222412 5222396 -
ttgcagcactttgggaggcc

SEQ ID NO: 49223 - DNA, 20 bp, Artificial Sequence
  Synthetic oligonucleotide; CAG chr11 5222389 5222408 5222392 -
agcactttgggaggcctaga

SEQ ID NO: 49224 - DNA, 20 bp, Artificial Sequence
  Synthetic oligonucleotide; AGG chr11 5222388 5222407 5222391 -
gcactttgggaggcctagac

SEQ ID NO: 49225 - DNA, 20 bp, Artificial Sequence
  Synthetic oligonucleotide; CGG chr11 5222385 5222404 5222388 -
ctttgggaggcctagacagg

SEQ ID NO: 49226 - DNA, 20 bp, Artificial Sequence
  Synthetic oligonucleotide; CAG chr11 5222372 5222391 5222375 -
agacaggcggatcacgacgt

SEQ ID NO: 49227 - DNA, 20 bp, Artificial Sequence
  Synthetic oligonucleotide; AGG chr11 5222371 5222390 5222374 -
gacaggcggatcacgacgtc

SEQ ID NO: 49228 - DNA, 20 bp, Artificial Sequence
  Synthetic oligonucleotide; GAG chr11 5222369 5222388 5222372 -
caggcggatcacgacgtcag

SEQ ID NO: 49229 - DNA, 20 bp, Artificial Sequence
  Synthetic oligonucleotide; AAG chr11 5222363 5222382 5222366 -
gatcacgacgtcaggagttc

SEQ ID NO: 49230 - DNA, 20 bp, Artificial Sequence
  Synthetic oligonucleotide; CAG chr11 5222358 5222377 5222361 -
cgacgtcaggagttcaagat

SEQ ID NO: 49231 - DNA, 20 bp, Artificial Sequence
  Synthetic oligonucleotide; TGG chr11 5222353 5222372 5222356 -
tcaggagttcaagatcagcc

SEQ ID NO: 49232 - DNA, 20 bp, Artificial Sequence
  Synthetic oligonucleotide; TAG chr11 5222344 5222363 5222347 -
caagatcagcctggccaaca

SEQ ID NO: 49233 - DNA, 20 bp, Artificial Sequence
  Synthetic oligonucleotide; TAG chr11 5222308 5222327 5222311 -
ctactaaaaatataaaaact

SEQ ID NO: 49234 - DNA, 20 bp, Artificial Sequence
  Synthetic oligonucleotide; TGG chr11 5222303 5222322 5222306 -
aaaaatataaaaacttagcc

SEQ ID NO: 49235 - DNA, 20 bp, Artificial Sequence
  Synthetic oligonucleotide; TGG chr11 5222298 5222317 5222301 -
tataaaaacttagcctggcg

SEQ ID NO: 49236 - DNA, 20 bp, Artificial Sequence
  Synthetic oligonucleotide; TGG chr11 5222295 5222314 5222298 -
aaaaacttagcctggcgtgg

SEQ ID NO: 49237 - DNA, 20 bp, Artificial Sequence
  Synthetic oligonucleotide; CAG chr11 5222292 5222311 5222295 -
aacttagcctggcgtggtgg

SEQ ID NO: 49238 - DNA, 20 bp, Artificial Sequence
  Synthetic oligonucleotide; AGG chr11 5222291 5222310 5222294 -
acttagcctggcgtggtggc

SEQ ID NO: 49239 - DNA, 20 bp, Artificial Sequence
  Synthetic oligonucleotide; CAG chr11 5222276 5222295 5222279 -
gtggcaggcatgtgtaatcc

SEQ ID NO: 49240 - DNA, 20 bp, Artificial Sequence
  Synthetic oligonucleotide; TGG chr11 5222268 5222287 5222271 -
catgtgtaatcccagcaatt

SEQ ID NO: 49241 - DNA, 20 bp, Artificial Sequence
  Synthetic oligonucleotide; GGG chr11 5222267 5222286 5222270 -
atgtgtaatcccagcaattt

SEQ ID NO: 49242 - DNA, 20 bp, Artificial Sequence
  Synthetic oligonucleotide; GAG chr11 5222265 5222284 5222268 -
gtgtaatcccagcaatttgg

SEQ ID NO: 49243 - DNA, 20 bp, Artificial Sequence
  Synthetic oligonucleotide; AGG chr11 5222264 5222283 5222267 -
tgtaatcccagcaatttggg

SEQ ID NO: 49244 - DNA, 20 bp, Artificial Sequence
  Synthetic oligonucleotide; GAG chr11 5222259 5222278 5222262 -
tcccagcaatttgggaggct

SEQ ID NO: 49245 - DNA, 20 bp, Artificial Sequence
  Synthetic oligonucleotide; AGG chr11 5222258 5222277 5222261 -
cccagcaatttgggaggctg

SEQ ID NO: 49246 - DNA, 20 bp, Artificial Sequence
  Synthetic oligonucleotide; CAG chr11 5222255 5222274 5222258 -
agcaatttgggaggctgagg

SEQ ID NO: 49247 - DNA, 20 bp, Artificial Sequence
  Synthetic oligonucleotide; AGG chr11 5222254 5222273 5222257 -
gcaatttgggaggctgaggc

SEQ ID NO: 49248 - DNA, 20 bp, Artificial Sequence
  Synthetic oligonucleotide; GAG chr11 5222252 5222271 5222255 -
aatttgggaggctgaggcag

SEQ ID NO: 49249 - DNA, 20 bp, Artificial Sequence
  Synthetic oligonucleotide; TGG chr11 5222236 5222255 5222239 -
gcaggagaatcgcttgatcc

SEQ ID NO: 49250 - DNA, 20 bp, Artificial Sequence
  Synthetic oligonucleotide; GGG chr11 5222235 5222254 5222238 -
caggagaatcgcttgatcct

SEQ ID NO: 49251 - DNA, 20 bp, Artificial Sequence
  Synthetic oligonucleotide; GAG chr11 5222233 5222252 5222236 -
ggagaatcgcttgatcctgg

SEQ ID NO: 49252 - DNA, 20 bp, Artificial Sequence
  Synthetic oligonucleotide; AGG chr11 5222232 5222251 5222235 -
gagaatcgcttgatcctggg

SEQ ID NO: 49253 - DNA, 20 bp, Artificial Sequence
  Synthetic oligonucleotide; CAG chr11 5222229 5222248 5222232 -
aatcgcttgatcctgggagg

SEQ ID NO: 49254 - DNA, 20 bp, Artificial Sequence
  Synthetic oligonucleotide; GAG chr11 5222227 5222246 5222230 -
tcgcttgatcctgggaggca

SEQ ID NO: 49255 - DNA, 20 bp, Artificial Sequence
  Synthetic oligonucleotide; AGG chr11 5222226 5222245 5222229 -
cgcttgatcctgggaggcag

SEQ ID NO: 49256 - DNA, 20 bp, Artificial Sequence
  Synthetic oligonucleotide; CAG chr11 5222220 5222239 5222223 -
atcctgggaggcagaggttg

SEQ ID NO: 49257 - DNA, 20 bp, Artificial Sequence
  Synthetic oligonucleotide; GAG chr11 5222216 5222235 5222219 -
tgggaggcagaggttgcagt

SEQ ID NO: 49258 - DNA, 20 bp, Artificial Sequence
  Synthetic oligonucleotide; AAG chr11 5222211 5222230 5222214 -
ggcagaggttgcagtgagcc

SEQ ID NO: 49259 - DNA, 20 bp, Artificial Sequence
  Synthetic oligonucleotide; CAG chr11 5222191 5222210 5222194 -
aagattgtgccactgcattc

SEQ ID NO: 49260 - DNA, 20 bp, Artificial Sequence
  Synthetic oligonucleotide; CAG chr11 5222186 5222205 5222189 -
tgtgccactgcattccagcc

SEQ ID NO: 49261 - DNA, 20 bp, Artificial Sequence
  Synthetic oligonucleotide; AGG chr11 5222185 5222204 5222188 -
gtgccactgcattccagccc

SEQ ID NO: 49262 - DNA, 20 bp, Artificial Sequence
  Synthetic oligonucleotide; CAG chr11 5222179 5222198 5222182 -
ctgcattccagcccaggtga

SEQ ID NO: 49263 - DNA, 20 bp, Artificial Sequence
  Synthetic oligonucleotide; GAG chr11 5222173 5222192 5222176 -
tccagcccaggtgacagcat

SEQ ID NO: 49264 - DNA, 20 bp, Artificial Sequence
  Synthetic oligonucleotide; AAG chr11 5222152 5222171 5222155 -
agactccgtcacaaaaaaaa

SEQ ID NO: 49265 - DNA, 20 bp, Artificial Sequence
  Synthetic oligonucleotide; AAG chr11 5222141 5222160 5222144 -
caaaaaaaaaagaaaaaaaa

SEQ ID NO: 49266 - DNA, 20 bp, Artificial Sequence
  Synthetic oligonucleotide; AGG chr11 5222140 5222159 5222143 -
aaaaaaaaaagaaaaaaaaa

SEQ ID NO: 49267 - DNA, 20 bp, Artificial Sequence
  Synthetic oligonucleotide; GGG chr11 5222139 5222158 5222142 -
aaaaaaaaagaaaaaaaaaa

SEQ ID NO: 49268 - DNA, 20 bp, Artificial Sequence
  Synthetic oligonucleotide; GGG chr11 5222138 5222157 5222141 -
aaaaaaaagaaaaaaaaaag

SEQ ID NO: 49269 - DNA, 20 bp, Artificial Sequence
  Synthetic oligonucleotide; GGG chr11 5222137 5222156 5222140 -
aaaaaaagaaaaaaaaaagg

SEQ ID NO: 49270 - DNA, 20 bp, Artificial Sequence
  Synthetic oligonucleotide; GGG chr11 5222136 5222155 5222139 -
aaaaaagaaaaaaaaaaggg

SEQ ID NO: 49271 - DNA, 20 bp, Artificial Sequence
  Synthetic oligonucleotide; GGG chr11 5222135 5222154 5222138 -
aaaaagaaaaaaaaaagggg

SEQ ID NO: 49272 - DNA, 20 bp, Artificial Sequence
  Synthetic oligonucleotide; GGG chr11 5222134 5222153 5222137 -
aaaagaaaaaaaaaaggggg

SEQ ID NO: 49273 - DNA, 20 bp, Artificial Sequence
  Synthetic oligonucleotide; GGG chr11 5222133 5222152 5222136 -
aaagaaaaaaaaaagggggg

SEQ ID NO: 49274 - DNA, 20 bp, Artificial Sequence
  Synthetic oligonucleotide; GGG chr11 5222132 5222151 5222135 -
aagaaaaaaaaaaggggggg

SEQ ID NO: 49275 - DNA, 20 bp, Artificial Sequence
  Synthetic oligonucleotide; GAG chr11 5222130 5222149 5222133 -
gaaaaaaaaaaggggggggg

SEQ ID NO: 49276 - DNA, 20 bp, Artificial Sequence
  Synthetic oligonucleotide; CGG chr11 5222127 5222146 5222130 -
aaaaaaaaggggggggggag

SEQ ID NO: 49277 - DNA, 20 bp, Artificial Sequence
  Synthetic oligonucleotide; TGG chr11 5222124 5222143 5222127 -
aaaaaggggggggggagcgg

SEQ ID NO: 49278 - DNA, 20 bp, Artificial Sequence
  Synthetic oligonucleotide; GAG chr11 5222122 5222141 5222125 -
aaaggggggggggagcggtg

SEQ ID NO: 49279 - DNA, 20 bp, Artificial Sequence
  Synthetic oligonucleotide; AAG chr11 5222117 5222136 5222120 -
ggggggggagcggtggagcc

SEQ ID NO: 49280 - DNA, 20 bp, Artificial Sequence
  Synthetic oligonucleotide; TAG chr11 5222105 5222124 5222108 -
gtggagccaagatgaccgaa

SEQ ID NO: 49281 - DNA, 20 bp, Artificial Sequence
  Synthetic oligonucleotide; AGG chr11 5222104 5222123 5222107 -
tggagccaagatgaccgaat

SEQ ID NO: 49282 - DNA, 20 bp, Artificial Sequence
  Synthetic oligonucleotide; CAG chr11 5222099 5222118 5222102 -
ccaagatgaccgaataggaa

SEQ ID NO: 49283 - DNA, 20 bp, Artificial Sequence
  Synthetic oligonucleotide; CAG chr11 5222093 5222112 5222096 -
tgaccgaataggaacagctc

SEQ ID NO: 49284 - DNA, 20 bp, Artificial Sequence
  Synthetic oligonucleotide; TAG chr11 5222086 5222105 5222089 -
ataggaacagctccagtcta

SEQ ID NO: 49285 - DNA, 20 bp, Artificial Sequence
  Synthetic oligonucleotide; GAG chr11 5222073 5222092 5222076 -
cagtctatagctcccatcgt

SEQ ID NO: 49286 - DNA, 20 bp, Artificial Sequence
  Synthetic oligonucleotide; CAG chr11 5222065 5222084 5222068 -
agctcccatcgtgagtgacg

SEQ ID NO: 49287 - DNA, 20 bp, Artificial Sequence
  Synthetic oligonucleotide; AAG chr11 5222062 5222081 5222065 -
tcccatcgtgagtgacgcag

SEQ ID NO: 49288 - DNA, 20 bp, Artificial Sequence
  Synthetic oligonucleotide; CGG chr11 5222058 5222077 5222061 -
atcgtgagtgacgcagaaga

SEQ ID NO: 49289 - DNA, 20 bp, Artificial Sequence
  Synthetic oligonucleotide; GGG chr11 5222057 5222076 5222060 -
tcgtgagtgacgcagaagac

SEQ ID NO: 49290 - DNA, 20 bp, Artificial Sequence
  Synthetic oligonucleotide; GAG chr11 5222034 5222053 5222037 -
tgatttctgcatttccaact

SEQ ID NO: 49291 - DNA, 20 bp, Artificial Sequence
  Synthetic oligonucleotide; AGG chr11 5222033 5222052 5222036 -
gatttctgcatttccaactg

SEQ ID NO: 49292 - DNA, 20 bp, Artificial Sequence
  Synthetic oligonucleotide; CAG chr11 5222027 5222046 5222030 -
tgcatttccaactgaggtac

SEQ ID NO: 49293 - DNA, 20 bp, Artificial Sequence
  Synthetic oligonucleotide; AGG chr11 5222026 5222045 5222029 -
gcatttccaactgaggtacc

SEQ ID NO: 49294 - DNA, 20 bp, Artificial Sequence
  Synthetic oligonucleotide; CAG chr11 5222014 5222033 5222017 -
gaggtaccaggttcatctca

SEQ ID NO: 49295 - DNA, 20 bp, Artificial Sequence
  Synthetic oligonucleotide; AGG chr11 5222013 5222032 5222016 -
aggtaccaggttcatctcac

SEQ ID NO: 49296 - DNA, 20 bp, Artificial Sequence
  Synthetic oligonucleotide; GGG chr11 5222012 5222031 5222015 -
ggtaccaggttcatctcaca

SEQ ID NO: 49297 - DNA, 20 bp, Artificial Sequence
  Synthetic oligonucleotide; AAG chr11 5222009 5222028 5222012 -
accaggttcatctcacaggg

SEQ ID NO: 49298 - DNA, 20 bp, Artificial Sequence
  Synthetic oligonucleotide; CAG chr11 5222003 5222022 5222006 -
ttcatctcacagggaagtgc

SEQ ID NO: 49299 - DNA, 20 bp, Artificial Sequence
  Synthetic oligonucleotide; AGG chr11 5222002 5222021 5222005 -
tcatctcacagggaagtgcc

SEQ ID NO: 49300 - DNA, 20 bp, Artificial Sequence
  Synthetic oligonucleotide; CAG chr11 5221999 5222018 5222002 -
tctcacagggaagtgccagg

SEQ ID NO: 49301 - DNA, 20 bp, Artificial Sequence
  Synthetic oligonucleotide; TGG chr11 5221996 5222015 5221999 -
cacagggaagtgccaggcag

SEQ ID NO: 49302 - DNA, 20 bp, Artificial Sequence
  Synthetic oligonucleotide; GGG chr11 5221995 5222014 5221998 -
acagggaagtgccaggcagt

SEQ ID NO: 49303 - DNA, 20 bp, Artificial Sequence
  Synthetic oligonucleotide; CAG chr11 5221990 5222009 5221993 -
gaagtgccaggcagtgggtg

SEQ ID NO: 49304 - DNA, 20 bp, Artificial Sequence
  Synthetic oligonucleotide; AGG chr11 5221989 5222008 5221992 -
aagtgccaggcagtgggtgc

SEQ ID NO: 49305 - DNA, 20 bp, Artificial Sequence
  Synthetic oligonucleotide; CAG chr11 5221985 5222004 5221988 -
gccaggcagtgggtgcagga

SEQ ID NO: 49306 - DNA, 20 bp, Artificial Sequence
  Synthetic oligonucleotide; TAG chr11 5221982 5222001 5221985 -
aggcagtgggtgcaggacag

SEQ ID NO: 49307 - DNA, 20 bp, Artificial Sequence
  Synthetic oligonucleotide; AGG chr11 5221981 5222000 5221984 -
ggcagtgggtgcaggacagt

SEQ ID NO: 49308 - DNA, 20 bp, Artificial Sequence
  Synthetic oligonucleotide; CAG chr11 5221976 5221995 5221979 -
tgggtgcaggacagtaggtg

SEQ ID NO: 49309 - DNA, 20 bp, Artificial Sequence
  Synthetic oligonucleotide; GAG chr11 5221961 5221980 5221964 -
aggtgcagtgcactgtgcat

SEQ ID NO: 49310 - DNA, 20 bp, Artificial Sequence
  Synthetic oligonucleotide; AAG chr11 5221955 5221974 5221958 -
agtgcactgtgcatgagcca

SEQ ID NO: 49311 - DNA, 20 bp, Artificial Sequence
  Synthetic oligonucleotide; CAG chr11 5221952 5221971 5221955 -
gcactgtgcatgagccaaag

SEQ ID NO: 49312 - DNA, 20 bp, Artificial Sequence
  Synthetic oligonucleotide; AGG chr11 5221951 5221970 5221954 -
cactgtgcatgagccaaagc

SEQ ID NO: 49313 - DNA, 20 bp, Artificial Sequence
  Synthetic oligonucleotide; GGG chr11 5221950 5221969 5221953 -
actgtgcatgagccaaagca

SEQ ID NO: 49314 - DNA, 20 bp, Artificial Sequence
  Synthetic oligonucleotide; GAG chr11 5221946 5221965 5221949 -
tgcatgagccaaagcagggc

SEQ ID NO: 49315 - DNA, 20 bp, Artificial Sequence
  Synthetic oligonucleotide; AGG chr11 5221945 5221964 5221948 -
gcatgagccaaagcagggcg

SEQ ID NO: 49316 - DNA, 20 bp, Artificial Sequence
  Synthetic oligonucleotide; CGG chr11 5221930 5221949 5221933 -
gggcgaggcatcacctcacc

SEQ ID NO: 49317 - DNA, 20 bp, Artificial Sequence
  Synthetic oligonucleotide; GGG chr11 5221929 5221948 5221932 -
ggcgaggcatcacctcaccc

SEQ ID NO: 49318 - DNA, 20 bp, Artificial Sequence
  Synthetic oligonucleotide; AAG chr11 5221926 5221945 5221929 -
gaggcatcacctcacccggg

SEQ ID NO: 49319 - DNA, 20 bp, Artificial Sequence
  Synthetic oligonucleotide; AAG chr11 5221920 5221939 5221923 -
tcacctcacccgggaagcac

SEQ ID NO: 49320 - DNA, 20 bp, Artificial Sequence
  Synthetic oligonucleotide; AGG chr11 5221919 5221938 5221922 -
cacctcacccgggaagcaca

SEQ ID NO: 49321 - DNA, 20 bp, Artificial Sequence
  Synthetic oligonucleotide; GGG chr11 5221918 5221937 5221921 -
acctcacccgggaagcacaa

SEQ ID NO: 49322 - DNA, 20 bp, Artificial Sequence
  Synthetic oligonucleotide; GGG chr11 5221917 5221936 5221920 -
cctcacccgggaagcacaag

SEQ ID NO: 49323 - DNA, 20 bp, Artificial Sequence
  Synthetic oligonucleotide; CAG chr11 5221913 5221932 5221916 -
acccgggaagcacaaggggt

SEQ ID NO: 49324 - DNA, 20 bp, Artificial Sequence
  Synthetic oligonucleotide; AGG chr11 5221912 5221931 5221915 -
cccgggaagcacaaggggtc

SEQ ID NO: 49325 - DNA, 20 bp, Artificial Sequence
  Synthetic oligonucleotide; GGG chr11 5221911 5221930 5221914 -
ccgggaagcacaaggggtca

SEQ ID NO: 49326 - DNA, 20 bp, Artificial Sequence
  Synthetic oligonucleotide; TAG chr11 5221896 5221915 5221899 -
ggtcagggaattccctttcc

SEQ ID NO: 49327 - DNA, 20 bp, Artificial Sequence
  Synthetic oligonucleotide; AAG chr11 5221890 5221909 5221893 -
ggaattccctttcctagtca

SEQ ID NO: 49328 - DNA, 20 bp, Artificial Sequence
  Synthetic oligonucleotide; AAG chr11 5221885 5221904 5221888 -
tccctttcctagtcaaagaa

SEQ ID NO: 49329 - DNA, 20 bp, Artificial Sequence
  Synthetic oligonucleotide; AGG chr11 5221884 5221903 5221887 -
ccctttcctagtcaaagaaa

SEQ ID NO: 49330 - DNA, 20 bp, Artificial Sequence
  Synthetic oligonucleotide; GGG chr11 5221883 5221902 5221886 -
cctttcctagtcaaagaaaa

SEQ ID NO: 49331 - DNA, 20 bp, Artificial Sequence
  Synthetic oligonucleotide; CAG chr11 5221877 5221896 5221880 -
ctagtcaaagaaaagggtga

SEQ ID NO: 49332 - DNA, 20 bp, Artificial Sequence
  Synthetic oligonucleotide; TGG chr11 5221873 5221892 5221876 -
tcaaagaaaagggtgacaga

SEQ ID NO: 49333 - DNA, 20 bp, Artificial Sequence
  Synthetic oligonucleotide; TGG chr11 5221866 5221885 5221869 -
aaagggtgacagatggcacc

SEQ ID NO: 49334 - DNA, 20 bp, Artificial Sequence
  Synthetic oligonucleotide; CGG chr11 5221858 5221877 5221861 -
acagatggcacctggaaaat

SEQ ID NO: 49335 - DNA, 20 bp, Artificial Sequence
  Synthetic oligonucleotide; GGG chr11 5221857 5221876 5221860 -
cagatggcacctggaaaatc

SEQ ID NO: 49336 - DNA, 20 bp, Artificial Sequence
  Synthetic oligonucleotide; AAG chr11 5221822 5221841 5221825 -
taatactgcgctcttccaac

SEQ ID NO: 49337 - DNA, 20 bp, Artificial Sequence
  Synthetic oligonucleotide; TGG chr11 5221810 5221829 5221813 -
cttccaacaagcttaacaaa

SEQ ID NO: 49338 - DNA, 20 bp, Artificial Sequence
  Synthetic oligonucleotide; CAG chr11 5221802 5221821 5221805 -
aagcttaacaaatggcacac

SEQ ID NO: 49339 - DNA, 20 bp, Artificial Sequence
  Synthetic oligonucleotide; AGG chr11 5221801 5221820 5221804 -
agcttaacaaatggcacacc

SEQ ID NO: 49340 - DNA, 20 bp, Artificial Sequence
  Synthetic oligonucleotide; GAG chr11 5221799 5221818 5221802 -
cttaacaaatggcacaccag

SEQ ID NO: 49341 - DNA, 20 bp, Artificial Sequence
  Synthetic oligonucleotide; TGG chr11 5221781 5221800 5221784 -
aggagattatatcccatgcc

SEQ ID NO: 49342 - DNA, 20 bp, Artificial Sequence
  Synthetic oligonucleotide; CAG chr11 5221776 5221795 5221779 -
attatatcccatgcctggct

SEQ ID NO: 49343 - DNA, 20 bp, Artificial Sequence
  Synthetic oligonucleotide; GAG chr11 5221774 5221793 5221777 -
tatatcccatgcctggctca

SEQ ID NO: 49344 - DNA, 20 bp, Artificial Sequence
  Synthetic oligonucleotide; AGG chr11 5221773 5221792 5221776 -
atatcccatgcctggctcag

SEQ ID NO: 49345 - DNA, 20 bp, Artificial Sequence
  Synthetic oligonucleotide; GGG chr11 5221772 5221791 5221775 -
tatcccatgcctggctcaga

SEQ ID NO: 49346 - DNA, 20 bp, Artificial Sequence
  Synthetic oligonucleotide; TGG chr11 5221758 5221777 5221761 -
ctcagagggtcctacgccca

SEQ ID NO: 49347 - DNA, 20 bp, Artificial Sequence
  Synthetic oligonucleotide; GAG chr11 5221756 5221775 5221759 -
cagagggtcctacgcccatg

SEQ ID NO: 49348 - DNA, 20 bp, Artificial Sequence
  Synthetic oligonucleotide; TAG chr11 5221740 5221759 5221743 -
catggagcctcgctcattgc

SEQ ID NO: 49349 - DNA, 20 bp, Artificial Sequence
  Synthetic oligonucleotide; CAG chr11 5221735 5221754 5221738 -
agcctcgctcattgctagca

SEQ ID NO: 49350 - DNA, 20 bp, Artificial Sequence
  Synthetic oligonucleotide; CAG chr11 5221732 5221751 5221735 -
ctcgctcattgctagcacag

SEQ ID NO: 49351 - DNA, 20 bp, Artificial Sequence
  Synthetic oligonucleotide; GAG chr11 5221726 5221745 5221729 -
cattgctagcacagcagtct

SEQ ID NO: 49352 - DNA, 20 bp, Artificial Sequence
  Synthetic oligonucleotide; AGG chr11 5221725 5221744 5221728 -
attgctagcacagcagtctg

SEQ ID NO: 49353 - DNA, 20 bp, Artificial Sequence
  Synthetic oligonucleotide; AAG chr11 5221713 5221732 5221716 -
gcagtctgaggtcaaactgc

SEQ ID NO: 49354 - DNA, 20 bp, Artificial Sequence
  Synthetic oligonucleotide; AGG chr11 5221712 5221731 5221715 -
cagtctgaggtcaaactgca

SEQ ID NO: 49355 - DNA, 20 bp, Artificial Sequence
  Synthetic oligonucleotide; TGG chr11 5221709 5221728 5221712 -
tctgaggtcaaactgcaagg

SEQ ID NO: 49356 - DNA, 20 bp, Artificial Sequence
  Synthetic oligonucleotide; CAG chr11 5221706 5221725 5221709 -
gaggtcaaactgcaaggtgg

SEQ ID NO: 49357 - DNA, 20 bp, Artificial Sequence
  Synthetic oligonucleotide; GAG chr11 5221702 5221721 5221705 -
tcaaactgcaaggtggcagt

SEQ ID NO: 49358 - DNA, 20 bp, Artificial Sequence
  Synthetic oligonucleotide; AGG chr11 5221701 5221720 5221704 -
caaactgcaaggtggcagtg

SEQ ID NO: 49359 - DNA, 20 bp, Artificial Sequence
  Synthetic oligonucleotide; TGG chr11 5221697 5221716 5221700 -
ctgcaaggtggcagtgaggc

SEQ ID NO: 49360 - DNA, 20 bp, Artificial Sequence
  Synthetic oligonucleotide; GGG chr11 5221696 5221715 5221699 -
tgcaaggtggcagtgaggct

SEQ ID NO: 49361 - DNA, 20 bp, Artificial Sequence
  Synthetic oligonucleotide; GGG chr11 5221695 5221714 5221698 -
gcaaggtggcagtgaggctg

SEQ ID NO: 49362 - DNA, 20 bp, Artificial Sequence
  Synthetic oligonucleotide; GGG chr11 5221694 5221713 5221697 -
caaggtggcagtgaggctgg

SEQ ID NO: 49363 - DNA, 20 bp, Artificial Sequence
  Synthetic oligonucleotide; GAG chr11 5221692 5221711 5221695 -
aggtggcagtgaggctgggg

SEQ ID NO: 49364 - DNA, 20 bp, Artificial Sequence
  Synthetic oligonucleotide; AGG chr11 5221691 5221710 5221694 -
ggtggcagtgaggctggggg

SEQ ID NO: 49365 - DNA, 20 bp, Artificial Sequence
  Synthetic oligonucleotide; GGG chr11 5221690 5221709 5221693 -
gtggcagtgaggctggggga

SEQ ID NO: 49366 - DNA, 20 bp, Artificial Sequence
  Synthetic oligonucleotide; GGG chr11 5221689 5221708 5221692 -
tggcagtgaggctgggggag

SEQ ID NO: 49367 - DNA, 20 bp, Artificial Sequence
  Synthetic oligonucleotide; CAG chr11 5221672 5221691 5221675 -
gaggggtgcccaccattgtc

SEQ ID NO: 49368 - DNA, 20 bp, Artificial Sequence
  Synthetic oligonucleotide; AGG chr11 5221671 5221690 5221674 -
aggggtgcccaccattgtcc

SEQ ID NO: 49369 - DNA, 20 bp, Artificial Sequence
  Synthetic oligonucleotide; GAG chr11 5221665 5221684 5221668 -
gcccaccattgtccaggctt

SEQ ID NO: 49370 - DNA, 20 bp, Artificial Sequence
  Synthetic oligonucleotide; CAG chr11 5221662 5221681 5221665 -
caccattgtccaggcttgag

SEQ ID NO: 49371 - DNA, 20 bp, Artificial Sequence
  Synthetic oligonucleotide; AGG chr11 5221661 5221680 5221664 -
accattgtccaggcttgagc

SEQ ID NO: 49372 - DNA, 20 bp, Artificial Sequence
  Synthetic oligonucleotide; AAG chr11 5221652 5221671 5221655 -
caggcttgagcaggtaaaca

SEQ ID NO: 49373 - DNA, 20 bp, Artificial Sequence
  Synthetic oligonucleotide; TGG chr11 5221644 5221663 5221647 -
agcaggtaaacaaagccgcc

SEQ ID NO: 49374 - DNA, 20 bp, Artificial Sequence
  Synthetic oligonucleotide; AAG chr11 5221641 5221660 5221644 -
aggtaaacaaagccgcctgg

SEQ ID NO: 49375 - DNA, 20 bp, Artificial Sequence
  Synthetic oligonucleotide; TGG chr11 5221631 5221650 5221634 -
agccgcctggaagctcgaac

SEQ ID NO: 49376 - DNA, 20 bp, Artificial Sequence
  Synthetic oligonucleotide; GGG chr11 5221630 5221649 5221633 -
gccgcctggaagctcgaact

SEQ ID NO: 49377 - DNA, 20 bp, Artificial Sequence
  Synthetic oligonucleotide; TGG chr11 5221627 5221646 5221630 -
gcctggaagctcgaactggg

SEQ ID NO: 49378 - DNA, 20 bp, Artificial Sequence
  Synthetic oligonucleotide; GAG chr11 5221625 5221644 5221628 -
ctggaagctcgaactgggtg

SEQ ID NO: 49379 - DNA, 20 bp, Artificial Sequence
  Synthetic oligonucleotide; CAG chr11 5221615 5221634 5221618 -
gaactgggtggagcccacca

SEQ ID NO: 49380 - DNA, 20 bp, Artificial Sequence
  Synthetic oligonucleotide; AAG chr11 5221609 5221628 5221612 -
ggtggagcccaccacagctc

SEQ ID NO: 49381 - DNA, 20 bp, Artificial Sequence
  Synthetic oligonucleotide; AGG chr11 5221608 5221627 5221611 -
gtggagcccaccacagctca

SEQ ID NO: 49382 - DNA, 20 bp, Artificial Sequence
  Synthetic oligonucleotide; GAG chr11 5221606 5221625 5221609 -
ggagcccaccacagctcaag

SEQ ID NO: 49383 - DNA, 20 bp, Artificial Sequence
  Synthetic oligonucleotide; AGG chr11 5221605 5221624 5221608 -
gagcccaccacagctcaagg

SEQ ID NO: 49384 - DNA, 20 bp, Artificial Sequence
  Synthetic oligonucleotide; TAG chr11 5221588 5221607 5221591 -
aggaggcctgcctgcctctg

SEQ ID NO: 49385 - DNA, 20 bp, Artificial Sequence
  Synthetic oligonucleotide; AGG chr11 5221587 5221606 5221590 -
ggaggcctgcctgcctctgt

SEQ ID NO: 49386 - DNA, 20 bp, Artificial Sequence
  Synthetic oligonucleotide; TAG chr11 5221575 5221594 5221578 -
gcctctgtaggctccacctc

SEQ ID NO: 49387 - DNA, 20 bp, Artificial Sequence
  Synthetic oligonucleotide; AGG chr11 5221574 5221593 5221577 -
cctctgtaggctccacctct

SEQ ID NO: 49388 - DNA, 20 bp, Artificial Sequence
  Synthetic oligonucleotide; GGG chr11 5221573 5221592 5221576 -
ctctgtaggctccacctcta

SEQ ID NO: 49389 - DNA, 20 bp, Artificial Sequence
  Synthetic oligonucleotide; GGG chr11 5221572 5221591 5221575 -
tctgtaggctccacctctag

SEQ ID NO: 49390 - DNA, 20 bp, Artificial Sequence
  Synthetic oligonucleotide; CAG chr11 5221569 5221588 5221572 -
gtaggctccacctctagggg

SEQ ID NO: 49391 - DNA, 20 bp, Artificial Sequence
  Synthetic oligonucleotide; AGG chr11 5221568 5221587 5221571 -
taggctccacctctaggggc

SEQ ID NO: 49392 - DNA, 20 bp, Artificial Sequence
  Synthetic oligonucleotide; GGG chr11 5221567 5221586 5221570 -
aggctccacctctaggggca

SEQ ID NO: 49393 - DNA, 20 bp, Artificial Sequence
  Synthetic oligonucleotide; CAG chr11 5221562 5221581 5221565 -
ccacctctaggggcagggca

SEQ ID NO: 49394 - DNA, 20 bp, Artificial Sequence
  Synthetic oligonucleotide; AAG chr11 5221551 5221570 5221554 -
ggcagggcacagacaaacaa

SEQ ID NO: 49395 - DNA, 20 bp, Artificial Sequence
  Synthetic oligonucleotide; AAG chr11 5221543 5221562 5221546 -
acagacaaacaaaagacaac

SEQ ID NO: 49396 - DNA, 20 bp, Artificial Sequence
  Synthetic oligonucleotide; CAG chr11 5221532 5221551 5221535 -
aaagacaacaagaacctctg

SEQ ID NO: 49397 - DNA, 20 bp, Artificial Sequence
  Synthetic oligonucleotide; CAG chr11 5221509 5221528 5221512 -
acttaaatgtccctgtctga

SEQ ID NO: 49398 - DNA, 20 bp, Artificial Sequence
  Synthetic oligonucleotide; AAG chr11 5221501 5221520 5221504 -
gtccctgtctgacagctttg

SEQ ID NO: 49399 - DNA, 20 bp, Artificial Sequence
  Synthetic oligonucleotide; GAG chr11 5221499 5221518 5221502 -
ccctgtctgacagctttgaa

SEQ ID NO: 49400 - DNA, 20 bp, Artificial Sequence
  Synthetic oligonucleotide; GAG chr11 5221497 5221516 5221500 -
ctgtctgacagctttgaaga

SEQ ID NO: 49401 - DNA, 20 bp, Artificial Sequence
  Synthetic oligonucleotide; TAG chr11 5221494 5221513 5221497 -
tctgacagctttgaagagag

SEQ ID NO: 49402 - DNA, 20 bp, Artificial Sequence
  Synthetic oligonucleotide; TGG chr11 5221491 5221510 5221494 -
gacagctttgaagagagtag

SEQ ID NO: 49403 - DNA, 20 bp, Artificial Sequence
  Synthetic oligonucleotide; CAG chr11 5221482 5221501 5221485 -
gaagagagtagtggttctcc

SEQ ID NO: 49404 - DNA, 20 bp, Artificial Sequence
  Synthetic oligonucleotide; TAG chr11 5221475 5221494 5221478 -
gtagtggttctcccagcaca

SEQ ID NO: 49405 - DNA, 20 bp, Artificial Sequence
  Synthetic oligonucleotide; CAG chr11 5221469 5221488 5221472 -
gttctcccagcacatagctt

SEQ ID NO: 49406 - DNA, 20 bp, Artificial Sequence
  Synthetic oligonucleotide; GAG chr11 5221462 5221481 5221465 -
cagcacatagcttcagatct

SEQ ID NO: 49407 - DNA, 20 bp, Artificial Sequence
  Synthetic oligonucleotide; CAG chr11 5221457 5221476 5221460 -
catagcttcagatctgagaa

SEQ ID NO: 49408 - DNA, 20 bp, Artificial Sequence
  Synthetic oligonucleotide; AGG chr11 5221456 5221475 5221459 -
atagcttcagatctgagaac

SEQ ID NO: 49409 - DNA, 20 bp, Artificial Sequence
  Synthetic oligonucleotide; CAG chr11 5221453 5221472 5221456 -
gcttcagatctgagaacagg

SEQ ID NO: 49410 - DNA, 20 bp, Artificial Sequence
  Synthetic oligonucleotide; AAG chr11 5221439 5221458 5221442 -
aacaggcagactgcctcctc

SEQ ID NO: 49411 - DNA, 20 bp, Artificial Sequence
  Synthetic oligonucleotide; TGG chr11 5221436 5221455 5221439 -
aggcagactgcctcctcaag

SEQ ID NO: 49412 - DNA, 20 bp, Artificial Sequence
  Synthetic oligonucleotide; GGG chr11 5221435 5221454 5221438 -
ggcagactgcctcctcaagt

SEQ ID NO: 49413 - DNA, 20 bp, Artificial Sequence
  Synthetic oligonucleotide; GAG chr11 5221420 5221439 5221423 -
caagtgggtccctgaccccc

SEQ ID NO: 49414 - DNA, 20 bp, Artificial Sequence
  Synthetic oligonucleotide; TAG chr11 5221417 5221436 5221420 -
gtgggtccctgacccccgag

SEQ ID NO: 49415 - DNA, 20 bp, Artificial Sequence
  Synthetic oligonucleotide; TGG chr11 5221408 5221427 5221411 -
tgacccccgagtagcctaac

SEQ ID NO: 49416 - DNA, 20 bp, Artificial Sequence
  Synthetic oligonucleotide; GGG chr11 5221407 5221426 5221410 -
gacccccgagtagcctaact

SEQ ID NO: 49417 - DNA, 20 bp, Artificial Sequence
  Synthetic oligonucleotide; GAG chr11 5221405 5221424 5221408 -
cccccgagtagcctaactgg

SEQ ID NO: 49418 - DNA, 20 bp, Artificial Sequence
  Synthetic oligonucleotide; AGG chr11 5221404 5221423 5221407 -
ccccgagtagcctaactggg

SEQ ID NO: 49419 - DNA, 20 bp, Artificial Sequence
  Synthetic oligonucleotide; CAG chr11 5221394 5221413 5221397 -
cctaactgggaggcatcccc

SEQ ID NO: 49420 - DNA, 20 bp, Artificial Sequence
  Synthetic oligonucleotide; TAG chr11 5221391 5221410 5221394 -
aactgggaggcatcccccag

SEQ ID NO: 49421 - DNA, 20 bp, Artificial Sequence
  Synthetic oligonucleotide; AGG chr11 5221390 5221409 5221393 -
actgggaggcatcccccagt

SEQ ID NO: 49422 - DNA, 20 bp, Artificial Sequence
  Synthetic oligonucleotide; GGG chr11 5221389 5221408 5221392 -
ctgggaggcatcccccagta

SEQ ID NO: 49423 - DNA, 20 bp, Artificial Sequence
  Synthetic oligonucleotide; GGG chr11 5221388 5221407 5221391 -
tgggaggcatcccccagtag

SEQ ID NO: 49424 - DNA, 20 bp, Artificial Sequence
  Synthetic oligonucleotide; CAG chr11 5221385 5221404 5221388 -
gaggcatcccccagtagggg

SEQ ID NO: 49425 - DNA, 20 bp, Artificial Sequence
  Synthetic oligonucleotide; TGG chr11 5221368 5221387 5221371 -
gggcagactgacacctcaca

SEQ ID NO: 49426 - DNA, 20 bp, Artificial Sequence
  Synthetic oligonucleotide; TGG chr11 5221364 5221383 5221367 -
agactgacacctcacatggc

SEQ ID NO: 49427 - DNA, 20 bp, Artificial Sequence
  Synthetic oligonucleotide; AAG chr11 5221352 5221371 5221355 -
cacatggctggtactcctct

SEQ ID NO: 49428 - DNA, 20 bp, Artificial Sequence
  Synthetic oligonucleotide; CAG chr11 5221339 5221358 5221342 -
ctcctctaagacaaaacttc

SEQ ID NO: 49429 - DNA, 20 bp, Artificial Sequence
  Synthetic oligonucleotide; GAG chr11 5221337 5221356 5221340 -
cctctaagacaaaacttcca

SEQ ID NO: 49430 - DNA, 20 bp, Artificial Sequence
  Synthetic oligonucleotide; AGG chr11 5221336 5221355 5221339 -
ctctaagacaaaacttccag

SEQ ID NO: 49431 - DNA, 20 bp, Artificial Sequence
  Synthetic oligonucleotide; CAG chr11 5221327 5221346 5221330 -
aaaacttccagaggaatgat

SEQ ID NO: 49432 - DNA, 20 bp, Artificial Sequence
  Synthetic oligonucleotide; AGG chr11 5221326 5221345 5221329 -
aaacttccagaggaatgatc

SEQ ID NO: 49433 - DNA, 20 bp, Artificial Sequence
  Synthetic oligonucleotide; CAG chr11 5221323 5221342 5221326 -
cttccagaggaatgatcagg

SEQ ID NO: 49434 - DNA, 20 bp, Artificial Sequence
  Synthetic oligonucleotide; CAG chr11 5221320 5221339 5221323 -
ccagaggaatgatcaggcag

SEQ ID NO: 49435 - DNA, 20 bp, Artificial Sequence
  Synthetic oligonucleotide; CGG chr11 5221311 5221330 5221314 -
tgatcaggcagcagcatttg

SEQ ID NO: 49436 - DNA, 20 bp, Artificial Sequence
  Synthetic oligonucleotide; CAG chr11 5221286 5221305 5221289 -
caccaatatccactgttctg

SEQ ID NO: 49437 - DNA, 20 bp, Artificial Sequence
  Synthetic oligonucleotide; CAG chr11 5221266 5221285 5221269 -
cagccaccgctgttgatacc

SEQ ID NO: 49438 - DNA, 20 bp, Artificial Sequence
  Synthetic oligonucleotide; AGG chr11 5221265 5221284 5221268 -
agccaccgctgttgataccc

SEQ ID NO: 49439 - DNA, 20 bp, Artificial Sequence
  Synthetic oligonucleotide; CAG chr11 5221258 5221277 5221261 -
gctgttgatacccaggaaaa

SEQ ID NO: 49440 - DNA, 20 bp, Artificial Sequence
  Synthetic oligonucleotide; TGG chr11 5221251 5221270 5221254 -
atacccaggaaaacagcttc

SEQ ID NO: 49441 - DNA, 20 bp, Artificial Sequence
  Synthetic oligonucleotide; GAG chr11 5221249 5221268 5221252 -
acccaggaaaacagcttctg

SEQ ID NO: 49442 - DNA, 20 bp, Artificial Sequence
  Synthetic oligonucleotide; TGG chr11 5221246 5221265 5221249 -
caggaaaacagcttctggag

SEQ ID NO: 49443 - DNA, 20 bp, Artificial Sequence
  Synthetic oligonucleotide; CAG chr11 5221238 5221257 5221241 -
cagcttctggagtggacctc

SEQ ID NO: 49444 - DNA, 20 bp, Artificial Sequence
  Synthetic oligonucleotide; CAG chr11 5221225 5221244 5221228 -
ggacctccagtaaactccaa

SEQ ID NO: 49445 - DNA, 20 bp, Artificial Sequence
  Synthetic oligonucleotide; CAG chr11 5221217 5221236 5221220 -
agtaaactccaacagacctg

SEQ ID NO: 49446 - DNA, 20 bp, Artificial Sequence
  Synthetic oligonucleotide; GAG chr11 5221212 5221231 5221215 -
actccaacagacctgcagct

SEQ ID NO: 49447 - DNA, 20 bp, Artificial Sequence
  Synthetic oligonucleotide; AGG chr11 5221211 5221230 5221214 -
ctccaacagacctgcagctg

SEQ ID NO: 49448 - DNA, 20 bp, Artificial Sequence
  Synthetic oligonucleotide; GGG chr11 5221210 5221229 5221213 -
tccaacagacctgcagctga

SEQ ID NO: 49449 - DNA, 20 bp, Artificial Sequence
  Synthetic oligonucleotide; TAG chr11 5221197 5221216 5221200 -
cagctgagggtcctgactgt

SEQ ID NO: 49450 - DNA, 20 bp, Artificial Sequence
  Synthetic oligonucleotide; AAG chr11 5221194 5221213 5221197 -
ctgagggtcctgactgttag

SEQ ID NO: 49451 - DNA, 20 bp, Artificial Sequence
  Synthetic oligonucleotide; AGG chr11 5221193 5221212 5221196 -
tgagggtcctgactgttaga

SEQ ID NO: 49452 - DNA, 20 bp, Artificial Sequence
  Synthetic oligonucleotide; CAG chr11 5221178 5221197 5221181 -
ttagaaggaaaactaacaaa

SEQ ID NO: 49453 - DNA, 20 bp, Artificial Sequence
  Synthetic oligonucleotide; AAG chr11 5221174 5221193 5221177 -
aaggaaaactaacaaacaga

SEQ ID NO: 49454 - DNA, 20 bp, Artificial Sequence
  Synthetic oligonucleotide; AGG chr11 5221173 5221192 5221176 -
aggaaaactaacaaacagaa

SEQ ID NO: 49455 - DNA, 20 bp, Artificial Sequence
  Synthetic oligonucleotide; AAG chr11 5221130 5221149 5221133 -
tctgtacatcgccatcatca

SEQ ID NO: 49456 - DNA, 20 bp, Artificial Sequence
  Synthetic oligonucleotide; AAG chr11 5221123 5221142 5221126 -
atcgccatcatcaaagacca

SEQ ID NO: 49457 - DNA, 20 bp, Artificial Sequence
  Synthetic oligonucleotide; AGG chr11 5221122 5221141 5221125 -
tcgccatcatcaaagaccaa

SEQ ID NO: 49458 - DNA, 20 bp, Artificial Sequence
  Synthetic oligonucleotide; TAG chr11 5221119 5221138 5221122 -
ccatcatcaaagaccaaagg

SEQ ID NO: 49459 - DNA, 20 bp, Artificial Sequence
  Synthetic oligonucleotide; AAG chr11 5221105 5221124 5221108 -
caaaggtagataaaaccata

SEQ ID NO: 49460 - DNA, 20 bp, Artificial Sequence
  Synthetic oligonucleotide; TGG chr11 5221101 5221120 5221104 -
ggtagataaaaccataaaga

SEQ ID NO: 49461 - DNA, 20 bp, Artificial Sequence
  Synthetic oligonucleotide; GGG chr11 5221100 5221119 5221103 -
gtagataaaaccataaagat

SEQ ID NO: 49462 - DNA, 20 bp, Artificial Sequence
  Synthetic oligonucleotide; GGG chr11 5221099 5221118 5221102 -
tagataaaaccataaagatg

SEQ ID NO: 49463 - DNA, 20 bp, Artificial Sequence
  Synthetic oligonucleotide; AAG chr11 5221093 5221112 5221096 -
aaaccataaagatggggaaa

SEQ ID NO: 49464 - DNA, 20 bp, Artificial Sequence
  Synthetic oligonucleotide; CAG chr11 5221090 5221109 5221093 -
ccataaagatggggaaaaag

SEQ ID NO: 49465 - DNA, 20 bp, Artificial Sequence
  Synthetic oligonucleotide; GAG chr11 5221088 5221107 5221091 -
ataaagatggggaaaaagca

SEQ ID NO: 49466 - DNA, 20 bp, Artificial Sequence
  Synthetic oligonucleotide; CAG chr11 5221085 5221104 5221088 -
aagatggggaaaaagcagag

SEQ ID NO: 49467 - DNA, 20 bp, Artificial Sequence
  Synthetic oligonucleotide; TGG chr11 5221076 5221095 5221079 -
aaaaagcagagcagaaaaac

SEQ ID NO: 49468 - DNA, 20 bp, Artificial Sequence
  Synthetic oligonucleotide; GAG chr11 5221060 5221079 5221063 -
aaactggacactctaaaaat

SEQ ID NO: 49469 - DNA, 20 bp, Artificial Sequence
  Synthetic oligonucleotide; GAG chr11 5221058 5221077 5221061 -
actggacactctaaaaatga

SEQ ID NO: 49470 - DNA, 20 bp, Artificial Sequence
  Synthetic oligonucleotide; AAG chr11 5221039 5221058 5221042 -
agagtgcctctcctcctcca

SEQ ID NO: 49471 - DNA, 20 bp, Artificial Sequence
  Synthetic oligonucleotide; CAG chr11 5221031 5221050 5221034 -
tctcctcctccaaagtaacg

SEQ ID NO: 49472 - DNA, 20 bp, Artificial Sequence
  Synthetic oligonucleotide; CAG chr11 5221020 5221039 5221023 -
aaagtaacgcagctcctcac

SEQ ID NO: 49473 - DNA, 20 bp, Artificial Sequence
  Synthetic oligonucleotide; TGG chr11 5221014 5221033 5221017 -
acgcagctcctcaccagcaa

SEQ ID NO: 49474 - DNA, 20 bp, Artificial Sequence
  Synthetic oligonucleotide; AAG chr11 5221007 5221026 5221010 -
tcctcaccagcaatggaaca

SEQ ID NO: 49475 - DNA, 20 bp, Artificial Sequence
  Synthetic oligonucleotide; TGG chr11 5221003 5221022 5221006 -
caccagcaatggaacaaagc

SEQ ID NO: 49476 - DNA, 20 bp, Artificial Sequence
  Synthetic oligonucleotide; GGG chr11 5221002 5221021 5221005 -
accagcaatggaacaaagct

SEQ ID NO: 49477 - DNA, 20 bp, Artificial Sequence
  Synthetic oligonucleotide; CAG chr11 5220999 5221018 5221002 -
agcaatggaacaaagctggg

SEQ ID NO: 49478 - DNA, 20 bp, Artificial Sequence
  Synthetic oligonucleotide; GAG chr11 5220997 5221016 5221000 -
caatggaacaaagctgggca

SEQ ID NO: 49479 - DNA, 20 bp, Artificial Sequence
  Synthetic oligonucleotide; GAG chr11 5220982 5221001 5220985 -
gggcagagaatgactttgac

SEQ ID NO: 49480 - DNA, 20 bp, Artificial Sequence
  Synthetic oligonucleotide; GAG chr11 5220977 5220996 5220980 -
gagaatgactttgacgagtt

SEQ ID NO: 49481 - DNA, 20 bp, Artificial Sequence
  Synthetic oligonucleotide; GAG chr11 5220975 5220994 5220978 -
gaatgactttgacgagttga

SEQ ID NO: 49482 - DNA, 20 bp, Artificial Sequence
  Synthetic oligonucleotide; GAG chr11 5220973 5220992 5220976 -
atgactttgacgagttgaga

SEQ ID NO: 49483 - DNA, 20 bp, Artificial Sequence
  Synthetic oligonucleotide; AGG chr11 5220972 5220991 5220975 -
tgactttgacgagttgagag

SEQ ID NO: 49484 - DNA, 20 bp, Artificial Sequence
  Synthetic oligonucleotide; AAG chr11 5220969 5220988 5220972 -
ctttgacgagttgagagagg

SEQ ID NO: 49485 - DNA, 20 bp, Artificial Sequence
  Synthetic oligonucleotide; AGG chr11 5220968 5220987 5220971 -
tttgacgagttgagagagga

SEQ ID NO: 49486 - DNA, 20 bp, Artificial Sequence
  Synthetic oligonucleotide; CAG chr11 5220962 5220981 5220965 -
gagttgagagaggaaggctt

SEQ ID NO: 49487 - DNA, 20 bp, Artificial Sequence
  Synthetic oligonucleotide; AAG chr11 5220959 5220978 5220962 -
ttgagagaggaaggcttcag

SEQ ID NO: 49488 - DNA, 20 bp, Artificial Sequence
  Synthetic oligonucleotide; AAG chr11 5220943 5220962 5220946 -
tcagaagatcaaactactcc

SEQ ID NO: 49489 - DNA, 20 bp, Artificial Sequence
  Synthetic oligonucleotide; AAG chr11 5220937 5220956 5220940 -
gatcaaactactccaagcta

SEQ ID NO: 49490 - DNA, 20 bp, Artificial Sequence
  Synthetic oligonucleotide; AGG chr11 5220936 5220955 5220939 -
atcaaactactccaagctaa

SEQ ID NO: 49491 - DNA, 20 bp, Artificial Sequence
  Synthetic oligonucleotide; GAG chr11 5220934 5220953 5220937 -
caaactactccaagctaaag

SEQ ID NO: 49492 - DNA, 20 bp, Artificial Sequence
  Synthetic oligonucleotide; AGG chr11 5220933 5220952 5220936 -
aaactactccaagctaaagg

SEQ ID NO: 49493 - DNA, 20 bp, Artificial Sequence
  Synthetic oligonucleotide; AAG chr11 5220930 5220949 5220933 -
ctactccaagctaaaggagg

SEQ ID NO: 49494 - DNA, 20 bp, Artificial Sequence
  Synthetic oligonucleotide; CGG chr11 5220917 5220936 5220920 -
aaggaggaagttcgaacaaa

SEQ ID NO: 49495 - DNA, 20 bp, Artificial Sequence
  Synthetic oligonucleotide; AAG chr11 5220912 5220931 5220915 -
ggaagttcgaacaaacggca

SEQ ID NO: 49496 - DNA, 20 bp, Artificial Sequence
  Synthetic oligonucleotide; AAG chr11 5220909 5220928 5220912 -
agttcgaacaaacggcaaag

SEQ ID NO: 49497 - DNA, 20 bp, Artificial Sequence
  Synthetic oligonucleotide; TAG chr11 5220885 5220904 5220888 -
aaaaaactttgaaaaaaaat

SEQ ID NO: 49498 - DNA, 20 bp, Artificial Sequence
  Synthetic oligonucleotide; TGG chr11 5220877 5220896 5220880 -
ttgaaaaaaaattagatgaa

SEQ ID NO: 49499 - DNA, 20 bp, Artificial Sequence
  Synthetic oligonucleotide; TAG chr11 5220869 5220888 5220872 -
aaattagatgaatggataac

SEQ ID NO: 49500 - DNA, 20 bp, Artificial Sequence
  Synthetic oligonucleotide; CAG chr11 5220853 5220872 5220856 -
taactagaataaccaatgca

SEQ ID NO: 49501 - DNA, 20 bp, Artificial Sequence
  Synthetic oligonucleotide; AAG chr11 5220850 5220869 5220853 -
ctagaataaccaatgcacag

SEQ ID NO: 49502 - DNA, 20 bp, Artificial Sequence
  Synthetic oligonucleotide; AAG chr11 5220841 5220860 5220844 -
ccaatgcacagaagtcctta

SEQ ID NO: 49503 - DNA, 20 bp, Artificial Sequence
  Synthetic oligonucleotide; AGG chr11 5220840 5220859 5220843 -
caatgcacagaagtccttaa

SEQ ID NO: 49504 - DNA, 20 bp, Artificial Sequence
  Synthetic oligonucleotide; TGG chr11 5220831 5220850 5220834 -
gaagtccttaaaggacctga

SEQ ID NO: 49505 - DNA, 20 bp, Artificial Sequence
  Synthetic oligonucleotide; GAG chr11 5220829 5220848 5220832 -
agtccttaaaggacctgatg

SEQ ID NO: 49506 - DNA, 20 bp, Artificial Sequence
  Synthetic oligonucleotide; AAG chr11 5220817 5220836 5220820 -
acctgatggagctgaaaacc

SEQ ID NO: 49507 - DNA, 20 bp, Artificial Sequence
  Synthetic oligonucleotide; AGG chr11 5220816 5220835 5220819 -
cctgatggagctgaaaacca

SEQ ID NO: 49508 - DNA, 20 bp, Artificial Sequence
  Synthetic oligonucleotide; CAG chr11 5220813 5220832 5220816 -
gatggagctgaaaaccaagg

SEQ ID NO: 49509 - DNA, 20 bp, Artificial Sequence
  Synthetic oligonucleotide; AGG chr11 5220812 5220831 5220815 -
atggagctgaaaaccaaggc

SEQ ID NO: 49510 - DNA, 20 bp, Artificial Sequence
  Synthetic oligonucleotide; GAG chr11 5220810 5220829 5220813 -
ggagctgaaaaccaaggcag

SEQ ID NO: 49511 - DNA, 20 bp, Artificial Sequence
  Synthetic oligonucleotide; AAG chr11 5220788 5220807 5220791 -
gaactacgtgacaaatacac

SEQ ID NO: 49512 - DNA, 20 bp, Artificial Sequence
  Synthetic oligonucleotide; CAG chr11 5220782 5220801 5220785 -
cgtgacaaatacacaagcct

SEQ ID NO: 49513 - DNA, 20 bp, Artificial Sequence
  Synthetic oligonucleotide; GAG chr11 5220771 5220790 5220774 -
cacaagcctcagtaaccgat

SEQ ID NO: 49514 - DNA, 20 bp, Artificial Sequence
  Synthetic oligonucleotide; TGG chr11 5220762 5220781 5220765 -
cagtaaccgatgagatcaac

SEQ ID NO: 49515 - DNA, 20 bp, Artificial Sequence
  Synthetic oligonucleotide; AAG chr11 5220759 5220778 5220762 -
taaccgatgagatcaactgg

SEQ ID NO: 49516 - DNA, 20 bp, Artificial Sequence
  Synthetic oligonucleotide; AAG chr11 5220755 5220774 5220758 -
cgatgagatcaactggaaga

SEQ ID NO: 49517 - DNA, 20 bp, Artificial Sequence
  Synthetic oligonucleotide; AGG chr11 5220754 5220773 5220757 -
gatgagatcaactggaagaa

SEQ ID NO: 49518 - DNA, 20 bp, Artificial Sequence
  Synthetic oligonucleotide; GGG chr11 5220753 5220772 5220756 -
atgagatcaactggaagaaa

SEQ ID NO: 49519 - DNA, 20 bp, Artificial Sequence
  Synthetic oligonucleotide; AAG chr11 5220738 5220757 5220741 -
agaaagggtatcaatgacga

SEQ ID NO: 49520 - DNA, 20 bp, Artificial Sequence
  Synthetic oligonucleotide; AAG chr11 5220718 5220737 5220721 -
aagatgaaatgaatgaaatg

SEQ ID NO: 49521 - DNA, 20 bp, Artificial Sequence
  Synthetic oligonucleotide; AAG chr11 5220711 5220730 5220714 -
aatgaatgaaatgaagcatg

SEQ ID NO: 49522 - DNA, 20 bp, Artificial Sequence
  Synthetic oligonucleotide; GAG chr11 5220709 5220728 5220712 -
tgaatgaaatgaagcatgaa

SEQ ID NO: 49523 - DNA, 20 bp, Artificial Sequence
  Synthetic oligonucleotide; AAG chr11 5220706 5220725 5220709 -
atgaaatgaagcatgaagag

SEQ ID NO: 49524 - DNA, 20 bp, Artificial Sequence
  Synthetic oligonucleotide; TAG chr11 5220701 5220720 5220704 -
atgaagcatgaagagaagtt

SEQ ID NO: 49525 - DNA, 20 bp, Artificial Sequence
  Synthetic oligonucleotide; GAG chr11 5220699 5220718 5220702 -
gaagcatgaagagaagttta

SEQ ID NO: 49526 - DNA, 20 bp, Artificial Sequence
  Synthetic oligonucleotide; AAG chr11 5220692 5220711 5220695 -
gaagagaagtttagagaaaa

SEQ ID NO: 49527 - DNA, 20 bp, Artificial Sequence
  Synthetic oligonucleotide; AAG chr11 5220683 5220702 5220686 -
tttagagaaaaaagaataaa

SEQ ID NO: 49528 - DNA, 20 bp, Artificial Sequence
  Synthetic oligonucleotide; AAG chr11 5220671 5220690 5220674 -
agaataaaaagaaacgaaca

SEQ ID NO: 49529 - DNA, 20 bp, Artificial Sequence
  Synthetic oligonucleotide; AAG chr11 5220663 5220682 5220666 -
aagaaacgaacaaagcctcc

SEQ ID NO: 49530 - DNA, 20 bp, Artificial Sequence
  Synthetic oligonucleotide; TGG chr11 5220655 5220674 5220658 -
aacaaagcctccaagaaata

SEQ ID NO: 49531 - DNA, 20 bp, Artificial Sequence
  Synthetic oligonucleotide; GGG chr11 5220654 5220673 5220657 -
acaaagcctccaagaaatat

SEQ ID NO: 49532 - DNA, 20 bp, Artificial Sequence
  Synthetic oligonucleotide; AAG chr11 5220641 5220660 5220644 -
gaaatatgggactatgtgaa

SEQ ID NO: 49533 - DNA, 20 bp, Artificial Sequence
  Synthetic oligonucleotide; TGG chr11 5220620 5220639 5220623 -
agaccaaatctacatctaat

SEQ ID NO: 49534 - DNA, 20 bp, Artificial Sequence
  Synthetic oligonucleotide; TAG chr11 5220615 5220634 5220618 -
aaatctacatctaattggtg

SEQ ID NO: 49535 - DNA, 20 bp, Artificial Sequence
  Synthetic oligonucleotide; AAG chr11 5220608 5220627 5220611 -
catctaattggtgtagctga

SEQ ID NO: 49536 - DNA, 20 bp, Artificial Sequence
  Synthetic oligonucleotide; TGG chr11 5220602 5220621 5220605 -
attggtgtagctgaaagtga

SEQ ID NO: 49537 - DNA, 20 bp, Artificial Sequence
  Synthetic oligonucleotide; GGG chr11 5220601 5220620 5220604 -
ttggtgtagctgaaagtgat

SEQ ID NO: 49538 - DNA, 20 bp, Artificial Sequence
  Synthetic oligonucleotide; GGG chr11 5220600 5220619 5220603 -
tggtgtagctgaaagtgatg

SEQ ID NO: 49539 - DNA, 20 bp, Artificial Sequence
  Synthetic oligonucleotide; GAG chr11 5220598 5220617 5220601 -
gtgtagctgaaagtgatggg

SEQ ID NO: 49540 - DNA, 20 bp, Artificial Sequence
  Synthetic oligonucleotide; TGG chr11 5220593 5220612 5220596 -
gctgaaagtgatggggagaa

SEQ ID NO: 49541 - DNA, 20 bp, Artificial Sequence
  Synthetic oligonucleotide; AAG chr11 5220586 5220605 5220589 -
gtgatggggagaatggaacc

SEQ ID NO: 49542 - DNA, 20 bp, Artificial Sequence
  Synthetic oligonucleotide; TGG chr11 5220582 5220601 5220585 -
tggggagaatggaaccaagt

SEQ ID NO: 49543 - DNA, 20 bp, Artificial Sequence
  Synthetic oligonucleotide; CAG chr11 5220568 5220587 5220571 -
ccaagttggaaaacactctg

SEQ ID NO: 49544 - DNA, 20 bp, Artificial Sequence
  Synthetic oligonucleotide; AGG chr11 5220567 5220586 5220570 -
caagttggaaaacactctgc

SEQ ID NO: 49545 - DNA, 20 bp, Artificial Sequence
  Synthetic oligonucleotide; CAG chr11 5220556 5220575 5220559 -
acactctgcaggatattatc

SEQ ID NO: 49546 - DNA, 20 bp, Artificial Sequence
  Synthetic oligonucleotide; AGG chr11 5220555 5220574 5220558 -
cactctgcaggatattatcc

SEQ ID NO: 49547 - DNA, 20 bp, Artificial Sequence
  Synthetic oligonucleotide; GAG chr11 5220553 5220572 5220556 -
ctctgcaggatattatccag

SEQ ID NO: 49548 - DNA, 20 bp, Artificial Sequence
  Synthetic oligonucleotide; TAG chr11 5220537 5220556 5220540 -
ccaggagaacttccccaatc

SEQ ID NO: 49549 - DNA, 20 bp, Artificial Sequence
  Synthetic oligonucleotide; AAG chr11 5220533 5220552 5220536 -
gagaacttccccaatctagc

SEQ ID NO: 49550 - DNA, 20 bp, Artificial Sequence
  Synthetic oligonucleotide; AGG chr11 5220532 5220551 5220535 -
agaacttccccaatctagca

SEQ ID NO: 49551 - DNA, 20 bp, Artificial Sequence
  Synthetic oligonucleotide; AAG chr11 5220528 5220547 5220531 -
cttccccaatctagcaaggc

SEQ ID NO: 49552 - DNA, 20 bp, Artificial Sequence
  Synthetic oligonucleotide; CAG chr11 5220511 5220530 5220514 -
ggcaagcccaaattcacatt

SEQ ID NO: 49553 - DNA, 20 bp, Artificial Sequence
  Synthetic oligonucleotide; AGG chr11 5220510 5220529 5220513 -
gcaagcccaaattcacattc

SEQ ID NO: 49554 - DNA, 20 bp, Artificial Sequence
  Synthetic oligonucleotide; CAG chr11 5220502 5220521 5220505 -
aaattcacattcaggaaata

SEQ ID NO: 49555 - DNA, 20 bp, Artificial Sequence
  Synthetic oligonucleotide; GAG chr11 5220500 5220519 5220503 -
attcacattcaggaaataca

SEQ ID NO: 49556 - DNA, 20 bp, Artificial Sequence
  Synthetic oligonucleotide; AAG chr11 5220488 5220507 5220491 -
gaaatacagagaacgccaca

SEQ ID NO: 49557 - DNA, 20 bp, Artificial Sequence
  Synthetic oligonucleotide; TAG chr11 5220478 5220497 5220481 -
gaacgccacaaagatactcc

SEQ ID NO: 49558 - DNA, 20 bp, Artificial Sequence
  Synthetic oligonucleotide; GAG chr11 5220476 5220495 5220479 -
acgccacaaagatactccta

SEQ ID NO: 49559 - DNA, 20 bp, Artificial Sequence
  Synthetic oligonucleotide; AAG chr11 5220471 5220490 5220474 -
acaaagatactcctagagaa

SEQ ID NO: 49560 - DNA, 20 bp, Artificial Sequence
  Synthetic oligonucleotide; AAG chr11 5220461 5220480 5220464 -
tcctagagaaaagcaactcc

SEQ ID NO: 49561 - DNA, 20 bp, Artificial Sequence
  Synthetic oligonucleotide; CAG chr11 5220446 5220465 5220449 -
actccaagacacataactgt

SEQ ID NO: 49562 - DNA, 20 bp, Artificial Sequence
  Synthetic oligonucleotide; AAG chr11 5220435 5220454 5220438 -
cataactgtcagattcacca

SEQ ID NO: 49563 - DNA, 20 bp, Artificial Sequence
  Synthetic oligonucleotide; AAG chr11 5220424 5220443 5220427 -
gattcaccaaagttgaaatg

SEQ ID NO: 49564 - DNA, 20 bp, Artificial Sequence
  Synthetic oligonucleotide; AGG chr11 5220423 5220442 5220426 -
attcaccaaagttgaaatga

SEQ ID NO: 49565 - DNA, 20 bp, Artificial Sequence
  Synthetic oligonucleotide; AAG chr11 5220410 5220429 5220413 -
gaaatgaaggaaaaaatgtt

SEQ ID NO: 49566 - DNA, 20 bp, Artificial Sequence
  Synthetic oligonucleotide; AGG chr11 5220409 5220428 5220412 -
aaatgaaggaaaaaatgtta

SEQ ID NO: 49567 - DNA, 20 bp, Artificial Sequence
  Synthetic oligonucleotide; GGG chr11 5220408 5220427 5220411 -
aatgaaggaaaaaatgttaa

SEQ ID NO: 49568 - DNA, 20 bp, Artificial Sequence
  Synthetic oligonucleotide; CAG chr11 5220405 5220424 5220408 -
gaaggaaaaaatgttaaggg

SEQ ID NO: 49569 - DNA, 20 bp, Artificial Sequence
  Synthetic oligonucleotide; CAG chr11 5220401 5220420 5220404 -
gaaaaaatgttaagggcagc

SEQ ID NO: 49570 - DNA, 20 bp, Artificial Sequence
  Synthetic oligonucleotide; GAG chr11 5220399 5220418 5220402 -
aaaaatgttaagggcagcca

SEQ ID NO: 49571 - DNA, 20 bp, Artificial Sequence
  Synthetic oligonucleotide; GAG chr11 5220397 5220416 5220400 -
aaatgttaagggcagccaga

SEQ ID NO: 49572 - DNA, 20 bp, Artificial Sequence
  Synthetic oligonucleotide; AAG chr11 5220393 5220412 5220396 -
gttaagggcagccagagaga

SEQ ID NO: 49573 - DNA, 20 bp, Artificial Sequence
  Synthetic oligonucleotide; AGG chr11 5220392 5220411 5220395 -
ttaagggcagccagagagaa

SEQ ID NO: 49574 - DNA, 20 bp, Artificial Sequence
  Synthetic oligonucleotide; CGG chr11 5220388 5220407 5220391 -
gggcagccagagagaaaggt

SEQ ID NO: 49575 - DNA, 20 bp, Artificial Sequence
  Synthetic oligonucleotide; GGG chr11 5220387 5220406 5220390 -
ggcagccagagagaaaggtc

SEQ ID NO: 49576 - DNA, 20 bp, Artificial Sequence
  Synthetic oligonucleotide; AAG chr11 5220375 5220394 5220378 -
gaaaggtcgggttacccaca

SEQ ID NO: 49577 - DNA, 20 bp, Artificial Sequence
  Synthetic oligonucleotide; AGG chr11 5220374 5220393 5220377 -
aaaggtcgggttacccacaa

SEQ ID NO: 49578 - DNA, 20 bp, Artificial Sequence
  Synthetic oligonucleotide; GGG chr11 5220373 5220392 5220376 -
aaggtcgggttacccacaaa

SEQ ID NO: 49579 - DNA, 20 bp, Artificial Sequence
  Synthetic oligonucleotide; AAG chr11 5220370 5220389 5220373 -
gtcgggttacccacaaaggg

SEQ ID NO: 49580 - DNA, 20 bp, Artificial Sequence
  Synthetic oligonucleotide; CAG chr11 5220362 5220381 5220365 -
acccacaaagggaagcccat

SEQ ID NO: 49581 - DNA, 20 bp, Artificial Sequence
  Synthetic oligonucleotide; CAG chr11 5220354 5220373 5220357 -
agggaagcccatcagactaa

SEQ ID NO: 49582 - DNA, 20 bp, Artificial Sequence
  Synthetic oligonucleotide; CGG chr11 5220342 5220361 5220345 -
cagactaacagctgatctat

SEQ ID NO: 49583 - DNA, 20 bp, Artificial Sequence
  Synthetic oligonucleotide; CAG chr11 5220339 5220358 5220342 -
actaacagctgatctatcgg

SEQ ID NO: 49584 - DNA, 20 bp, Artificial Sequence
  Synthetic oligonucleotide; AAG chr11 5220327 5220346 5220330 -
tctatcggcagaaactctac

SEQ ID NO: 49585 - DNA, 20 bp, Artificial Sequence
  Synthetic oligonucleotide; CAG chr11 5220323 5220342 5220326 -
tcggcagaaactctacaagc

SEQ ID NO: 49586 - DNA, 20 bp, Artificial Sequence
  Synthetic oligonucleotide; AAG chr11 5220320 5220339 5220323 -
gcagaaactctacaagccag

SEQ ID NO: 49587 - DNA, 20 bp, Artificial Sequence
  Synthetic oligonucleotide; AAG chr11 5220316 5220335 5220319 -
aaactctacaagccagaaga

SEQ ID NO: 49588 - DNA, 20 bp, Artificial Sequence
  Synthetic oligonucleotide; TGG chr11 5220313 5220332 5220316 -
ctctacaagccagaagaaag

SEQ ID NO: 49589 - DNA, 20 bp, Artificial Sequence
  Synthetic oligonucleotide; GGG chr11 5220312 5220331 5220315 -
tctacaagccagaagaaagt

SEQ ID NO: 49590 - DNA, 20 bp, Artificial Sequence
  Synthetic oligonucleotide; GGG chr11 5220311 5220330 5220314 -
ctacaagccagaagaaagtg

SEQ ID NO: 49591 - DNA, 20 bp, Artificial Sequence
  Synthetic oligonucleotide; GGG chr11 5220310 5220329 5220313 -
tacaagccagaagaaagtgg

SEQ ID NO: 49592 - DNA, 20 bp, Artificial Sequence
  Synthetic oligonucleotide; AAG chr11 5220288 5220307 5220291 -
gccaatattcaacattgtta

SEQ ID NO: 49593 - DNA, 20 bp, Artificial Sequence
  Synthetic oligonucleotide; AAG chr11 5220283 5220302 5220286 -
tattcaacattgttaaagaa

SEQ ID NO: 49594 - DNA, 20 bp, Artificial Sequence
  Synthetic oligonucleotide; CAG chr11 5220269 5220288 5220272 -
aaagaaaagaattttcaacc

SEQ ID NO: 49595 - DNA, 20 bp, Artificial Sequence
  Synthetic oligonucleotide; CAG chr11 5220255 5220274 5220258 -
tcaacccagaatttcatatc

SEQ ID NO: 49596 - DNA, 20 bp, Artificial Sequence
  Synthetic oligonucleotide; AAG chr11 5220245 5220264 5220248 -
atttcatatccagccaaact

SEQ ID NO: 49597 - DNA, 20 bp, Artificial Sequence
  Synthetic oligonucleotide; AAG chr11 5220236 5220255 5220239 -
ccagccaaactaagcttcat

SEQ ID NO: 49598 - DNA, 20 bp, Artificial Sequence
  Synthetic oligonucleotide; AAG chr11 5220231 5220250 5220234 -
caaactaagcttcataagtg

SEQ ID NO: 49599 - DNA, 20 bp, Artificial Sequence
  Synthetic oligonucleotide; AGG chr11 5220230 5220249 5220233 -
aaactaagcttcataagtga

SEQ ID NO: 49600 - DNA, 20 bp, Artificial Sequence
  Synthetic oligonucleotide; GAG chr11 5220228 5220247 5220231 -
actaagcttcataagtgaag

SEQ ID NO: 49601 - DNA, 20 bp, Artificial Sequence
  Synthetic oligonucleotide; CAG chr11 5220210 5220229 5220213 -
aggagaaataaaatccttta

SEQ ID NO: 49602 - DNA, 20 bp, Artificial Sequence
  Synthetic oligonucleotide; AAG chr11 5220205 5220224 5220208 -
aaataaaatcctttacagac

SEQ ID NO: 49603 - DNA, 20 bp, Artificial Sequence
  Synthetic oligonucleotide; GAG chr11 5220194 5220213 5220197 -
tttacagacaagcaaatgct

SEQ ID NO: 49604 - DNA, 20 bp, Artificial Sequence
  Synthetic oligonucleotide; GAG chr11 5220192 5220211 5220195 -
tacagacaagcaaatgctga

SEQ ID NO: 49605 - DNA, 20 bp, Artificial Sequence
  Synthetic oligonucleotide; CAG chr11 5220176 5220195 5220179 -
ctgagagattttgtcaccac

SEQ ID NO: 49606 - DNA, 20 bp, Artificial Sequence
  Synthetic oligonucleotide; AGG chr11 5220175 5220194 5220178 -
tgagagattttgtcaccacc

SEQ ID NO: 49607 - DNA, 20 bp, Artificial Sequence
  Synthetic oligonucleotide; AAG chr11 5220162 5220181 5220165 -
caccaccaggcctgccctac

SEQ ID NO: 49608 - DNA, 20 bp, Artificial Sequence
  Synthetic oligonucleotide; GAG chr11 5220160 5220179 5220163 -
ccaccaggcctgccctacaa

SEQ ID NO: 49609 - DNA, 20 bp, Artificial Sequence
  Synthetic oligonucleotide; AAG chr11 5220151 5220170 5220154 -
ctgccctacaagagctcctg

SEQ ID NO: 49610 - DNA, 20 bp, Artificial Sequence
  Synthetic oligonucleotide; AGG chr11 5220150 5220169 5220153 -
tgccctacaagagctcctga

SEQ ID NO: 49611 - DNA, 20 bp, Artificial Sequence
  Synthetic oligonucleotide; AAG chr11 5220147 5220166 5220150 -
cctacaagagctcctgaagg

SEQ ID NO: 49612 - DNA, 20 bp, Artificial Sequence
  Synthetic oligonucleotide; TGG chr11 5220135 5220154 5220138 -
cctgaaggaagcactaaaca

SEQ ID NO: 49613 - DNA, 20 bp, Artificial Sequence
  Synthetic oligonucleotide; AAG chr11 5220131 5220150 5220134 -
aaggaagcactaaacatgga

SEQ ID NO: 49614 - DNA, 20 bp, Artificial Sequence
  Synthetic oligonucleotide; AGG chr11 5220130 5220149 5220133 -
aggaagcactaaacatggaa

SEQ ID NO: 49615 - DNA, 20 bp, Artificial Sequence
  Synthetic oligonucleotide; TAG chr11 5220121 5220140 5220124 -
taaacatggaaaggaacaac

SEQ ID NO: 49616 - DNA, 20 bp, Artificial Sequence
  Synthetic oligonucleotide; CAG chr11 5220115 5220134 5220118 -
tggaaaggaacaactagtat

SEQ ID NO: 49617 - DNA, 20 bp, Artificial Sequence
  Synthetic oligonucleotide; AAG chr11 5220086 5220105 5220089 -
caaaaacatgccaaattgta

SEQ ID NO: 49618 - DNA, 20 bp, Artificial Sequence
  Synthetic oligonucleotide; AAG chr11 5220077 5220096 5220080 -
gccaaattgtaaagaccatc

SEQ ID NO: 49619 - DNA, 20 bp, Artificial Sequence
  Synthetic oligonucleotide; AGG chr11 5220076 5220095 5220079 -
ccaaattgtaaagaccatca

SEQ ID NO: 49620 - DNA, 20 bp, Artificial Sequence
  Synthetic oligonucleotide; TAG chr11 5220072 5220091 5220075 -
attgtaaagaccatcaaggc

SEQ ID NO: 49621 - DNA, 20 bp, Artificial Sequence
  Synthetic oligonucleotide; AGG chr11 5220071 5220090 5220074 -
ttgtaaagaccatcaaggct

SEQ ID NO: 49622 - DNA, 20 bp, Artificial Sequence
  Synthetic oligonucleotide; AAG chr11 5220068 5220087 5220071 -
taaagaccatcaaggctagg

SEQ ID NO: 49623 - DNA, 20 bp, Artificial Sequence
  Synthetic oligonucleotide; GAG chr11 5220052 5220071 5220055 -
taggaagaaactgcatcaac

SEQ ID NO: 49624 - DNA, 20 bp, Artificial Sequence
  Synthetic oligonucleotide; CAG chr11 5220040 5220059 5220043 -
gcatcaacgagcaaaataac

SEQ ID NO: 49625 - DNA, 20 bp, Artificial Sequence
  Synthetic oligonucleotide; CAG chr11 5220022 5220041 5220025 -
accagctaacatcataatga

SEQ ID NO: 49626 - DNA, 20 bp, Artificial Sequence
  Synthetic oligonucleotide; AGG chr11 5220021 5220040 5220024 -
ccagctaacatcataatgac

SEQ ID NO: 49627 - DNA, 20 bp, Artificial Sequence
  Synthetic oligonucleotide; TAG chr11 5219979 5219998 5219982 -
atactcaccttaaatgtaaa

SEQ ID NO: 49628 - DNA, 20 bp, Artificial Sequence
  Synthetic oligonucleotide; AGG chr11 5219978 5219997 5219981 -
tactcaccttaaatgtaaat

SEQ ID NO: 49629 - DNA, 20 bp, Artificial Sequence
  Synthetic oligonucleotide; AAG chr11 5219958 5219977 5219961 -
aggctaaatgctccaattaa

SEQ ID NO: 49630 - DNA, 20 bp, Artificial Sequence
  Synthetic oligonucleotide; CAG chr11 5219952 5219971 5219955 -
aatgctccaattaaaagaca

SEQ ID NO: 49631 - DNA, 20 bp, Artificial Sequence
  Synthetic oligonucleotide; TGG chr11 5219947 5219966 5219950 -
tccaattaaaagacacagac

SEQ ID NO: 49632 - DNA, 20 bp, Artificial Sequence
  Synthetic oligonucleotide; TGG chr11 5219939 5219958 5219942 -
aaagacacagactggcaaat

SEQ ID NO: 49633 - DNA, 20 bp, Artificial Sequence
  Synthetic oligonucleotide; AAG chr11 5219934 5219953 5219937 -
cacagactggcaaattggat

SEQ ID NO: 49634 - DNA, 20 bp, Artificial Sequence
  Synthetic oligonucleotide; AGG chr11 5219933 5219952 5219936 -
acagactggcaaattggata

SEQ ID NO: 49635 - DNA, 20 bp, Artificial Sequence
  Synthetic oligonucleotide; GAG chr11 5219931 5219950 5219934 -
agactggcaaattggataag

SEQ ID NO: 49636 - DNA, 20 bp, Artificial Sequence
  Synthetic oligonucleotide; AAG chr11 5219926 5219945 5219929 -
ggcaaattggataaggagtc

SEQ ID NO: 49637 - DNA, 20 bp, Artificial Sequence
  Synthetic oligonucleotide; CAG chr11 5219903 5219922 5219906 -
acccatctgtgttctgtatt

SEQ ID NO: 49638 - DNA, 20 bp, Artificial Sequence
  Synthetic oligonucleotide; AGG chr11 5219902 5219921 5219905 -
cccatctgtgttctgtattc

SEQ ID NO: 49639 - DNA, 20 bp, Artificial Sequence
  Synthetic oligonucleotide; CAG chr11 5219883 5219902 5219886 -
caggaaacccatctcacgtg

SEQ ID NO: 49640 - DNA, 20 bp, Artificial Sequence
  Synthetic oligonucleotide; GAG chr11 5219881 5219900 5219884 -
ggaaacccatctcacgtgca

SEQ ID NO: 49641 - DNA, 20 bp, Artificial Sequence
  Synthetic oligonucleotide; TAG chr11 5219871 5219890 5219874 -
ctcacgtgcagagacacaca

SEQ ID NO: 49642 - DNA, 20 bp, Artificial Sequence
  Synthetic oligonucleotide; AGG chr11 5219870 5219889 5219873 -
tcacgtgcagagacacacat

SEQ ID NO: 49643 - DNA, 20 bp, Artificial Sequence
  Synthetic oligonucleotide; AAG chr11 5219857 5219876 5219860 -
cacacataggctcgaaataa

SEQ ID NO: 49644 - DNA, 20 bp, Artificial Sequence
  Synthetic oligonucleotide; AGG chr11 5219856 5219875 5219859 -
acacataggctcgaaataaa

SEQ ID NO: 49645 - DNA, 20 bp, Artificial Sequence
  Synthetic oligonucleotide; TGG chr11 5219852 5219871 5219855 -
ataggctcgaaataaaagga

SEQ ID NO: 49646 - DNA, 20 bp, Artificial Sequence
  Synthetic oligonucleotide; GAG chr11 5219850 5219869 5219853 -
aggctcgaaataaaaggatg

SEQ ID NO: 49647 - DNA, 20 bp, Artificial Sequence
  Synthetic oligonucleotide; AGG chr11 5219849 5219868 5219852 -
ggctcgaaataaaaggatgg

SEQ ID NO: 49648 - DNA, 20 bp, Artificial Sequence
  Synthetic oligonucleotide; AAG chr11 5219836 5219855 5219839 -
aggatggaggaatatctacc

SEQ ID NO: 49649 - DNA, 20 bp, Artificial Sequence
  Synthetic oligonucleotide; TGG chr11 5219829 5219848 5219832 -
aggaatatctaccaagcaaa

SEQ ID NO: 49650 - DNA, 20 bp, Artificial Sequence
  Synthetic oligonucleotide; AAG chr11 5219816 5219835 5219819 -
aagcaaatggaaaacaaaaa

SEQ ID NO: 49651 - DNA, 20 bp, Artificial Sequence
  Synthetic oligonucleotide; AGG chr11 5219815 5219834 5219818 -
agcaaatggaaaacaaaaaa

SEQ ID NO: 49652 - DNA, 20 bp, Artificial Sequence
  Synthetic oligonucleotide; CAG chr11 5219812 5219831 5219815 -
aaatggaaaacaaaaaaagg

SEQ ID NO: 49653 - DNA, 20 bp, Artificial Sequence
  Synthetic oligonucleotide; AGG chr11 5219811 5219830 5219814 -
aatggaaaacaaaaaaaggc

SEQ ID NO: 49654 - DNA, 20 bp, Artificial Sequence
  Synthetic oligonucleotide; GGG chr11 5219810 5219829 5219813 -
atggaaaacaaaaaaaggca

SEQ ID NO: 49655 - DNA, 20 bp, Artificial Sequence
  Synthetic oligonucleotide; GGG chr11 5219809 5219828 5219812 -
tggaaaacaaaaaaaggcag

SEQ ID NO: 49656 - DNA, 20 bp, Artificial Sequence
  Synthetic oligonucleotide; TAG chr11 5219797 5219816 5219800 -
aaaggcaggggttgcaatcc

SEQ ID NO: 49657 - DNA, 20 bp, Artificial Sequence
  Synthetic oligonucleotide; CAG chr11 5219782 5219801 5219785 -
aatcctagtctctgataaaa

SEQ ID NO: 49658 - DNA, 20 bp, Artificial Sequence
  Synthetic oligonucleotide; AAG chr11 5219765 5219784 5219768 -
aaacagattttaaaccaaca

SEQ ID NO: 49659 - DNA, 20 bp, Artificial Sequence
  Synthetic oligonucleotide; AAG chr11 5219757 5219776 5219760 -
tttaaaccaacaaagatcaa

SEQ ID NO: 49660 - DNA, 20 bp, Artificial Sequence
  Synthetic oligonucleotide; GAG chr11 5219755 5219774 5219758 -
taaaccaacaaagatcaaaa

SEQ ID NO: 49661 - DNA, 20 bp, Artificial Sequence
  Synthetic oligonucleotide; AAG chr11 5219749 5219768 5219752 -
aacaaagatcaaaagagaca

SEQ ID NO: 49662 - DNA, 20 bp, Artificial Sequence
  Synthetic oligonucleotide; AAG chr11 5219746 5219765 5219749 -
aaagatcaaaagagacaaag

SEQ ID NO: 49663 - DNA, 20 bp, Artificial Sequence
  Synthetic oligonucleotide; AGG chr11 5219745 5219764 5219748 -
aagatcaaaagagacaaaga

SEQ ID NO: 49664 - DNA, 20 bp, Artificial Sequence
  Synthetic oligonucleotide; TGG chr11 5219731 5219750 5219734 -
caaagaaggccattacataa

SEQ ID NO: 49665 - DNA, 20 bp, Artificial Sequence
  Synthetic oligonucleotide; AAG chr11 5219726 5219745 5219729 -
aaggccattacataatggca

SEQ ID NO: 49666 - DNA, 20 bp, Artificial Sequence
  Synthetic oligonucleotide; AGG chr11 5219725 5219744 5219728 -
aggccattacataatggcaa

SEQ ID NO: 49667 - DNA, 20 bp, Artificial Sequence
  Synthetic oligonucleotide; GGG chr11 5219724 5219743 5219727 -
ggccattacataatggcaaa

SEQ ID NO: 49668 - DNA, 20 bp, Artificial Sequence
  Synthetic oligonucleotide; AAG chr11 5219713 5219732 5219716 -
aatggcaaagggatctattc

SEQ ID NO: 49669 - DNA, 20 bp, Artificial Sequence
  Synthetic oligonucleotide; AAG chr11 5219710 5219729 5219713 -
ggcaaagggatctattcaag

SEQ ID NO: 49670 - DNA, 20 bp, Artificial Sequence
  Synthetic oligonucleotide; AAG chr11 5219707 5219726 5219710 -
aaagggatctattcaagaag

SEQ ID NO: 49671 - DNA, 20 bp, Artificial Sequence
  Synthetic oligonucleotide; CAG chr11 5219671 5219690 5219674 -
aaatatatatgcacccaata

SEQ ID NO: 49672 - DNA, 20 bp, Artificial Sequence
  Synthetic oligonucleotide; AGG chr11 5219670 5219689 5219673 -
aatatatatgcacccaatac

SEQ ID NO: 49673 - DNA, 20 bp, Artificial Sequence
  Synthetic oligonucleotide; GAG chr11 5219668 5219687 5219671 -
tatatatgcacccaatacag

SEQ ID NO: 49674 - DNA, 20 bp, Artificial Sequence
  Synthetic oligonucleotide; CAG chr11 5219661 5219680 5219664 -
gcacccaatacaggagcacc

SEQ ID NO: 49675 - DNA, 20 bp, Artificial Sequence
  Synthetic oligonucleotide; AAG chr11 5219647 5219666 5219650 -
agcacccagattcataaaac

SEQ ID NO: 49676 - DNA, 20 bp, Artificial Sequence
  Synthetic oligonucleotide; GAG chr11 5219640 5219659 5219643 -
agattcataaaacaagtcct

SEQ ID NO: 49677 - DNA, 20 bp, Artificial Sequence
  Synthetic oligonucleotide; AAG chr11 5219628 5219647 5219631 -
caagtcctgagtgacctaca

SEQ ID NO: 49678 - DNA, 20 bp, Artificial Sequence
  Synthetic oligonucleotide; GAG chr11 5219626 5219645 5219629 -
agtcctgagtgacctacaaa

SEQ ID NO: 49679 - DNA, 20 bp, Artificial Sequence
  Synthetic oligonucleotide; TAG chr11 5219620 5219639 5219623 -
gagtgacctacaaagagact

SEQ ID NO: 49680 - DNA, 20 bp, Artificial Sequence
  Synthetic oligonucleotide; TGG chr11 5219599 5219618 5219602 -
agatgcccacacaataataa

SEQ ID NO: 49681 - DNA, 20 bp, Artificial Sequence
  Synthetic oligonucleotide; GGG chr11 5219598 5219617 5219601 -
gatgcccacacaataataat

SEQ ID NO: 49682 - DNA, 20 bp, Artificial Sequence
  Synthetic oligonucleotide; GAG chr11 5219596 5219615 5219599 -
tgcccacacaataataatgg

SEQ ID NO: 49683 - DNA, 20 bp, Artificial Sequence
  Synthetic oligonucleotide; TAG chr11 5219569 5219588 5219572 -
taacaccccactgtcaacat

SEQ ID NO: 49684 - DNA, 20 bp, Artificial Sequence
  Synthetic oligonucleotide; CAG chr11 5219565 5219584 5219568 -
accccactgtcaacattaga

SEQ ID NO: 49685 - DNA, 20 bp, Artificial Sequence
  Synthetic oligonucleotide; GAG chr11 5219556 5219575 5219559 -
tcaacattagacagatcaac

SEQ ID NO: 49686 - DNA, 20 bp, Artificial Sequence
  Synthetic oligonucleotide; CAG chr11 5219552 5219571 5219555 -
cattagacagatcaacgaga

SEQ ID NO: 49687 - DNA, 20 bp, Artificial Sequence
  Synthetic oligonucleotide; AAG chr11 5219548 5219567 5219551 -
agacagatcaacgagacaga

SEQ ID NO: 49688 - DNA, 20 bp, Artificial Sequence
  Synthetic oligonucleotide; AAG chr11 5219540 5219559 5219543 -
caacgagacagaaagttaac

SEQ ID NO: 49689 - DNA, 20 bp, Artificial Sequence
  Synthetic oligonucleotide; AGG chr11 5219539 5219558 5219542 -
aacgagacagaaagttaaca

SEQ ID NO: 49690 - DNA, 20 bp, Artificial Sequence
  Synthetic oligonucleotide; CAG chr11 5219531 5219550 5219534 -
agaaagttaacaaggatatc

SEQ ID NO: 49691 - DNA, 20 bp, Artificial Sequence
  Synthetic oligonucleotide; AGG chr11 5219530 5219549 5219533 -
gaaagttaacaaggatatcc

SEQ ID NO: 49692 - DNA, 20 bp, Artificial Sequence
  Synthetic oligonucleotide; TGG chr11 5219524 5219543 5219527 -
taacaaggatatccaggaat

SEQ ID NO: 49693 - DNA, 20 bp, Artificial Sequence
  Synthetic oligonucleotide; CAG chr11 5219518 5219537 5219521 -
ggatatccaggaattggact

SEQ ID NO: 49694 - DNA, 20 bp, Artificial Sequence
  Synthetic oligonucleotide; AAG chr11 5219506 5219525 5219509 -
attggactcagctctgcacc

SEQ ID NO: 49695 - DNA, 20 bp, Artificial Sequence
  Synthetic oligonucleotide; CAG chr11 5219503 5219522 5219506 -
ggactcagctctgcaccaag

SEQ ID NO: 49696 - DNA, 20 bp, Artificial Sequence
  Synthetic oligonucleotide; TAG chr11 5219494 5219513 5219497 -
tctgcaccaagcagacctaa

SEQ ID NO: 49697 - DNA, 20 bp, Artificial Sequence
  Synthetic oligonucleotide; CAG chr11 5219484 5219503 5219487 -
gcagacctaatagacatcta

SEQ ID NO: 49698 - DNA, 20 bp, Artificial Sequence
  Synthetic oligonucleotide; CAG chr11 5219461 5219480 5219464 -
aactctccaccccaaatcaa

SEQ ID NO: 49699 - DNA, 20 bp, Artificial Sequence
  Synthetic oligonucleotide; CAG chr11 5219443 5219462 5219446 -
aacagaatatacattctttt

SEQ ID NO: 49700 - DNA, 20 bp, Artificial Sequence
  Synthetic oligonucleotide; TAG chr11 5219407 5219426 5219410 -
ctattccaaaactgaccaca

SEQ ID NO: 49701 - DNA, 20 bp, Artificial Sequence
  Synthetic oligonucleotide; TGG chr11 5219403 5219422 5219406 -
tccaaaactgaccacatagt

SEQ ID NO: 49702 - DNA, 20 bp, Artificial Sequence
  Synthetic oligonucleotide; AAG chr11 5219400 5219419 5219403 -
aaaactgaccacatagttgg

SEQ ID NO: 49703 - DNA, 20 bp, Artificial Sequence
  Synthetic oligonucleotide; AAG chr11 5219395 5219414 5219398 -
tgaccacatagttggaagta

SEQ ID NO: 49704 - DNA, 20 bp, Artificial Sequence
  Synthetic oligonucleotide; CAG chr11 5219385 5219404 5219388 -
gttggaagtaaagctctcct

SEQ ID NO: 49705 - DNA, 20 bp, Artificial Sequence
  Synthetic oligonucleotide; AAG chr11 5219373 5219392 5219376 -
gctctcctcagcaaatgtaa

SEQ ID NO: 49706 - DNA, 20 bp, Artificial Sequence
  Synthetic oligonucleotide; CAG chr11 5219368 5219387 5219371 -
cctcagcaaatgtaaaagaa

SEQ ID NO: 49707 - DNA, 20 bp, Artificial Sequence
  Synthetic oligonucleotide; CAG chr11 5219344 5219363 5219347 -
aactataacaaactgtctct

SEQ ID NO: 49708 - DNA, 20 bp, Artificial Sequence
  Synthetic oligonucleotide; CAG chr11 5219337 5219356 5219340 -
acaaactgtctctcagacca

SEQ ID NO: 49709 - DNA, 20 bp, Artificial Sequence
  Synthetic oligonucleotide; TAG chr11 5219323 5219342 5219326 -
agaccacagtgcaatcaaac

SEQ ID NO: 49710 - DNA, 20 bp, Artificial Sequence
  Synthetic oligonucleotide; CAG chr11 5219316 5219335 5219319 -
agtgcaatcaaactagaact

SEQ ID NO: 49711 - DNA, 20 bp, Artificial Sequence
  Synthetic oligonucleotide; AGG chr11 5219315 5219334 5219318 -
gtgcaatcaaactagaactc

SEQ ID NO: 49712 - DNA, 20 bp, Artificial Sequence
  Synthetic oligonucleotide; AAG chr11 5219309 5219328 5219312 -
tcaaactagaactcaggatt

SEQ ID NO: 49713 - DNA, 20 bp, Artificial Sequence
  Synthetic oligonucleotide; CAG chr11 5219287 5219306 5219290 -
gaaactcactcaaaaccact

SEQ ID NO: 49714 - DNA, 20 bp, Artificial Sequence
  Synthetic oligonucleotide; TGG chr11 5219279 5219298 5219282 -
ctcaaaaccactcagctaca

SEQ ID NO: 49715 - DNA, 20 bp, Artificial Sequence
  Synthetic oligonucleotide; CAG chr11 5219268 5219287 5219271 -
tcagctacatggaaactgaa

SEQ ID NO: 49716 - DNA, 20 bp, Artificial Sequence
  Synthetic oligonucleotide; TGG chr11 5219246 5219265 5219249 -
gcctgctcctgaatgactac

SEQ ID NO: 49717 - DNA, 20 bp, Artificial Sequence
  Synthetic oligonucleotide; GGG chr11 5219245 5219264 5219248 -
cctgctcctgaatgactact

SEQ ID NO: 49718 - DNA, 20 bp, Artificial Sequence
  Synthetic oligonucleotide; AAG chr11 5219228 5219247 5219231 -
actgggtacataacaaaatg

SEQ ID NO: 49719 - DNA, 20 bp, Artificial Sequence
  Synthetic oligonucleotide; AGG chr11 5219227 5219246 5219230 -
ctgggtacataacaaaatga

SEQ ID NO: 49720 - DNA, 20 bp, Artificial Sequence
  Synthetic oligonucleotide; CAG chr11 5219224 5219243 5219227 -
ggtacataacaaaatgaagg

SEQ ID NO: 49721 - DNA, 20 bp, Artificial Sequence
  Synthetic oligonucleotide; AAG chr11 5219216 5219235 5219219 -
acaaaatgaaggcagaaata

SEQ ID NO: 49722 - DNA, 20 bp, Artificial Sequence
  Synthetic oligonucleotide; GAG chr11 5219195 5219214 5219198 -
agatgttctttgaaaccaac

SEQ ID NO: 49723 - DNA, 20 bp, Artificial Sequence
  Synthetic oligonucleotide; AAG chr11 5219188 5219207 5219191 -
ctttgaaaccaacgagaaca

SEQ ID NO: 49724 - DNA, 20 bp, Artificial Sequence
  Synthetic oligonucleotide; CAG chr11 5219174 5219193 5219177 -
agaacaaagacacaacacac

SEQ ID NO: 49725 - DNA, 20 bp, Artificial Sequence
  Synthetic oligonucleotide; GAG chr11 5219164 5219183 5219167 -
cacaacacaccagaatctct

SEQ ID NO: 49726 - DNA, 20 bp, Artificial Sequence
  Synthetic oligonucleotide; AAG chr11 5219152 5219171 5219155 -
gaatctctgagacacattca

SEQ ID NO: 49727 - DNA, 20 bp, Artificial Sequence
  Synthetic oligonucleotide; CAG chr11 5219149 5219168 5219152 -
tctctgagacacattcaaag

SEQ ID NO: 49728 - DNA, 20 bp, Artificial Sequence
  Synthetic oligonucleotide; TAG chr11 5219142 5219161 5219145 -
gacacattcaaagcagtgtg

SEQ ID NO: 49729 - DNA, 20 bp, Artificial Sequence
  Synthetic oligonucleotide; GAG chr11 5219140 5219159 5219143 -
cacattcaaagcagtgtgta

SEQ ID NO: 49730 - DNA, 20 bp, Artificial Sequence
  Synthetic oligonucleotide; AGG chr11 5219139 5219158 5219142 -
acattcaaagcagtgtgtag

SEQ ID NO: 49731 - DNA, 20 bp, Artificial Sequence
  Synthetic oligonucleotide; GGG chr11 5219138 5219157 5219141 -
cattcaaagcagtgtgtaga

SEQ ID NO: 49732 - DNA, 20 bp, Artificial Sequence
  Synthetic oligonucleotide; TAG chr11 5219128 5219147 5219131 -
agtgtgtagagggaaattta

SEQ ID NO: 49733 - DNA, 20 bp, Artificial Sequence
  Synthetic oligonucleotide; AAG chr11 5219111 5219130 5219114 -
ttatagcactaaatgcccac

SEQ ID NO: 49734 - DNA, 20 bp, Artificial Sequence
  Synthetic oligonucleotide; AGG chr11 5219110 5219129 5219113 -
tatagcactaaatgcccaca

SEQ ID NO: 49735 - DNA, 20 bp, Artificial Sequence
  Synthetic oligonucleotide; GGG chr11 5219109 5219128 5219112 -
atagcactaaatgcccacaa

SEQ ID NO: 49736 - DNA, 20 bp, Artificial Sequence
  Synthetic oligonucleotide; AAG chr11 5219105 5219124 5219108 -
cactaaatgcccacaaggga

SEQ ID NO: 49737 - DNA, 20 bp, Artificial Sequence
  Synthetic oligonucleotide; CAG chr11 5219102 5219121 5219105 -
taaatgcccacaagggaaag

SEQ ID NO: 49738 - DNA, 20 bp, Artificial Sequence
  Synthetic oligonucleotide; AGG chr11 5219101 5219120 5219104 -
aaatgcccacaagggaaagc

SEQ ID NO: 49739 - DNA, 20 bp, Artificial Sequence
  Synthetic oligonucleotide; AAG chr11 5219097 5219116 5219100 -
gcccacaagggaaagcagga

SEQ ID NO: 49740 - DNA, 20 bp, Artificial Sequence
  Synthetic oligonucleotide; TAG chr11 5219057 5219076 5219060 -
taacatcacaattaaaaaac

SEQ ID NO: 49741 - DNA, 20 bp, Artificial Sequence
  Synthetic oligonucleotide; GAG chr11 5219055 5219074 5219058 -
acatcacaattaaaaaacta

SEQ ID NO: 49742 - DNA, 20 bp, Artificial Sequence
  Synthetic oligonucleotide; AAG chr11 5219052 5219071 5219055 -
tcacaattaaaaaactagag

SEQ ID NO: 49743 - DNA, 20 bp, Artificial Sequence
  Synthetic oligonucleotide; CAG chr11 5219049 5219068 5219052 -
caattaaaaaactagagaag

SEQ ID NO: 49744 - DNA, 20 bp, Artificial Sequence
  Synthetic oligonucleotide; AGG chr11 5219048 5219067 5219051 -
aattaaaaaactagagaagc

SEQ ID NO: 49745 - DNA, 20 bp, Artificial Sequence
  Synthetic oligonucleotide; GAG chr11 5219046 5219065 5219049 -
ttaaaaaactagagaagcag

SEQ ID NO: 49746 - DNA, 20 bp, Artificial Sequence
  Synthetic oligonucleotide; AAG chr11 5219030 5219049 5219033 -
gcaggagcaaacacattcaa

SEQ ID NO: 49747 - DNA, 20 bp, Artificial Sequence
  Synthetic oligonucleotide; CAG chr11 5219023 5219042 5219026 -
caaacacattcaaaagctaa

SEQ ID NO: 49748 - DNA, 20 bp, Artificial Sequence
  Synthetic oligonucleotide; AAG chr11 5219020 5219039 5219023 -
acacattcaaaagctaacag

SEQ ID NO: 49749 - DNA, 20 bp, Artificial Sequence
  Synthetic oligonucleotide; AAG chr11 5219015 5219034 5219018 -
ttcaaaagctaacagaagac

SEQ ID NO: 49750 - DNA, 20 bp, Artificial Sequence
  Synthetic oligonucleotide; AAG chr11 5219004 5219023 5219007 -
acagaagacaagaaataact

SEQ ID NO: 49751 - DNA, 20 bp, Artificial Sequence
  Synthetic oligonucleotide; CAG chr11 5218999 5219018 5219002 -
agacaagaaataactaagat

SEQ ID NO: 49752 - DNA, 20 bp, Artificial Sequence
  Synthetic oligonucleotide; GAG chr11 5218997 5219016 5219000 -
acaagaaataactaagatca

SEQ ID NO: 49753 - DNA, 20 bp, Artificial Sequence
  Synthetic oligonucleotide; CAG chr11 5218994 5219013 5218997 -
agaaataactaagatcagag

SEQ ID NO: 49754 - DNA, 20 bp, Artificial Sequence
  Synthetic oligonucleotide; AAG chr11 5218991 5219010 5218994 -
aataactaagatcagagcag

SEQ ID NO: 49755 - DNA, 20 bp, Artificial Sequence
  Synthetic oligonucleotide; AAG chr11 5218986 5219005 5218989 -
ctaagatcagagcagaagtg

SEQ ID NO: 49756 - DNA, 20 bp, Artificial Sequence
  Synthetic oligonucleotide; AGG chr11 5218985 5219004 5218988 -
taagatcagagcagaagtga

SEQ ID NO: 49757 - DNA, 20 bp, Artificial Sequence
  Synthetic oligonucleotide; TAG chr11 5218979 5218998 5218982 -
cagagcagaagtgaaggaca

SEQ ID NO: 49758 - DNA, 20 bp, Artificial Sequence
  Synthetic oligonucleotide; GAG chr11 5218977 5218996 5218980 -
gagcagaagtgaaggacata

SEQ ID NO: 49759 - DNA, 20 bp, Artificial Sequence
  Synthetic oligonucleotide; CAG chr11 5218940 5218959 5218943 -
ttcaaaaaaatcaatgaatc

SEQ ID NO: 49760 - DNA, 20 bp, Artificial Sequence
  Synthetic oligonucleotide; AAG chr11 5218937 5218956 5218940 -
aaaaaaatcaatgaatccag

SEQ ID NO: 49761 - DNA, 20 bp, Artificial Sequence
  Synthetic oligonucleotide; AAG chr11 5218921 5218940 5218924 -
ccagaagctgtttttttgaa

SEQ ID NO: 49762 - DNA, 20 bp, Artificial Sequence
  Synthetic oligonucleotide; TAG chr11 5218904 5218923 5218907 -
gaaaagatcaacaaaattga

SEQ ID NO: 49763 - DNA, 20 bp, Artificial Sequence
  Synthetic oligonucleotide; TAG chr11 5218896 5218915 5218899 -
caacaaaattgatagactgc

SEQ ID NO: 49764 - DNA, 20 bp, Artificial Sequence
  Synthetic oligonucleotide; AAG chr11 5218892 5218911 5218895 -
aaaattgatagactgctagc

SEQ ID NO: 49765 - DNA, 20 bp, Artificial Sequence
  Synthetic oligonucleotide; AAG chr11 5218882 5218901 5218885 -
gactgctagcaagactaata

SEQ ID NO: 49766 - DNA, 20 bp, Artificial Sequence
  Synthetic oligonucleotide; AAG chr11 5218879 5218898 5218882 -
tgctagcaagactaataaag

SEQ ID NO: 49767 - DNA, 20 bp, Artificial Sequence
  Synthetic oligonucleotide; AAG chr11 5218874 5218893 5218877 -
gcaagactaataaagaagaa

SEQ ID NO: 49768 - DNA, 20 bp, Artificial Sequence
  Synthetic oligonucleotide; GAG chr11 5218872 5218891 5218875 -
aagactaataaagaagaaaa

SEQ ID NO: 49769 - DNA, 20 bp, Artificial Sequence
  Synthetic oligonucleotide; GAG chr11 5218870 5218889 5218873 -
gactaataaagaagaaaaga

SEQ ID NO: 49770 - DNA, 20 bp, Artificial Sequence
  Synthetic oligonucleotide; AAG chr11 5218867 5218886 5218870 -
taataaagaagaaaagagag

SEQ ID NO: 49771 - DNA, 20 bp, Artificial Sequence
  Synthetic oligonucleotide; TAG chr11 5218857 5218876 5218860 -
gaaaagagagaagaatcaaa

SEQ ID NO: 49772 - DNA, 20 bp, Artificial Sequence
  Synthetic oligonucleotide; CGG chr11 5218836 5218855 5218839 -
agacgcaataaaaaatgaca

SEQ ID NO: 49773 - DNA, 20 bp, Artificial Sequence
  Synthetic oligonucleotide; GGG chr11 5218835 5218854 5218838 -
gacgcaataaaaaatgacac

SEQ ID NO: 49774 - DNA, 20 bp, Artificial Sequence
  Synthetic oligonucleotide; GGG chr11 5218834 5218853 5218837 -
acgcaataaaaaatgacacg

SEQ ID NO: 49775 - DNA, 20 bp, Artificial Sequence
  Synthetic oligonucleotide; CAG chr11 5218814 5218833 5218817 -
gggtatcaccactgatccca

SEQ ID NO: 49776 - DNA, 20 bp, Artificial Sequence
  Synthetic oligonucleotide; CAG chr11 5218795 5218814 5218798 -
acagaaatacaaactaccgt

SEQ ID NO: 49777 - DNA, 20 bp, Artificial Sequence
  Synthetic oligonucleotide; GAG chr11 5218793 5218812 5218796 -
agaaatacaaactaccgtca

SEQ ID NO: 49778 - DNA, 20 bp, Artificial Sequence
  Synthetic oligonucleotide; TAG chr11 5218760 5218779 5218763 -
acacctctacgcaaataaac

SEQ ID NO: 49779 - DNA, 20 bp, Artificial Sequence
  Synthetic oligonucleotide; TAG chr11 5218751 5218770 5218754 -
cgcaaataaactagaaaatc

SEQ ID NO: 49780 - DNA, 20 bp, Artificial Sequence
  Synthetic oligonucleotide; AAG chr11 5218748 5218767 5218751 -
aaataaactagaaaatctag

SEQ ID NO: 49781 - DNA, 20 bp, Artificial Sequence
  Synthetic oligonucleotide; TGG chr11 5218742 5218761 5218745 -
actagaaaatctagaagaaa

SEQ ID NO: 49782 - DNA, 20 bp, Artificial Sequence
  Synthetic oligonucleotide; AAG chr11 5218711 5218730 5218714 -
ctcgacacatacactctgcc

SEQ ID NO: 49783 - DNA, 20 bp, Artificial Sequence
  Synthetic oligonucleotide; CAG chr11 5218701 5218720 5218704 -
acactctgccaagactaaac

SEQ ID NO: 49784 - DNA, 20 bp, Artificial Sequence
  Synthetic oligonucleotide; AGG chr11 5218700 5218719 5218703 -
cactctgccaagactaaacc

SEQ ID NO: 49785 - DNA, 20 bp, Artificial Sequence
  Synthetic oligonucleotide; AAG chr11 5218697 5218716 5218700 -
tctgccaagactaaaccagg

SEQ ID NO: 49786 - DNA, 20 bp, Artificial Sequence
  Synthetic oligonucleotide; AAG chr11 5218694 5218713 5218697 -
gccaagactaaaccaggaag

SEQ ID NO: 49787 - DNA, 20 bp, Artificial Sequence
  Synthetic oligonucleotide; TAG chr11 5218678 5218697 5218681 -
gaagaagttgtatctctgaa

SEQ ID NO: 49788 - DNA, 20 bp, Artificial Sequence
  Synthetic oligonucleotide; CAG chr11 5218667 5218686 5218670 -
atctctgaatagaccaataa

SEQ ID NO: 49789 - DNA, 20 bp, Artificial Sequence
  Synthetic oligonucleotide; AGG chr11 5218666 5218685 5218669 -
tctctgaatagaccaataac

SEQ ID NO: 49790 - DNA, 20 bp, Artificial Sequence
  Synthetic oligonucleotide; GAG chr11 5218653 5218672 5218656 -
caataacaggctctgaaatt

SEQ ID NO: 49791 - DNA, 20 bp, Artificial Sequence
  Synthetic oligonucleotide; AGG chr11 5218652 5218671 5218655 -
aataacaggctctgaaattg

SEQ ID NO: 49792 - DNA, 20 bp, Artificial Sequence
  Synthetic oligonucleotide; TAG chr11 5218639 5218658 5218642 -
gaaattgaggcaataattaa

SEQ ID NO: 49793 - DNA, 20 bp, Artificial Sequence
  Synthetic oligonucleotide; AAG chr11 5218621 5218640 5218624 -
aatagcttatcaaccaaaaa

SEQ ID NO: 49794 - DNA, 20 bp, Artificial Sequence
  Synthetic oligonucleotide; CGG chr11 5218616 5218635 5218619 -
cttatcaaccaaaaaaagtc

SEQ ID NO: 49795 - DNA, 20 bp, Artificial Sequence
  Synthetic oligonucleotide; GGG chr11 5218615 5218634 5218618 -
ttatcaaccaaaaaaagtcc

SEQ ID NO: 49796 - DNA, 20 bp, Artificial Sequence
  Synthetic oligonucleotide; CAG chr11 5218610 5218629 5218613 -
aaccaaaaaaagtccgggac

SEQ ID NO: 49797 - DNA, 20 bp, Artificial Sequence
  Synthetic oligonucleotide; TAG chr11 5218607 5218626 5218610 -
caaaaaaagtccgggaccag

SEQ ID NO: 49798 - DNA, 20 bp, Artificial Sequence
  Synthetic oligonucleotide; AGG chr11 5218606 5218625 5218609 -
aaaaaaagtccgggaccagt

SEQ ID NO: 49799 - DNA, 20 bp, Artificial Sequence
  Synthetic oligonucleotide; TAG chr11 5218598 5218617 5218601 -
tccgggaccagtaggattca

SEQ ID NO: 49800 - DNA, 20 bp, Artificial Sequence
  Synthetic oligonucleotide; CAG chr11 5218584 5218603 5218587 -
gattcatagccgaattctac

SEQ ID NO: 49801 - DNA, 20 bp, Artificial Sequence
  Synthetic oligonucleotide; GAG chr11 5218582 5218601 5218585 -
ttcatagccgaattctacca

SEQ ID NO: 49802 - DNA, 20 bp, Artificial Sequence
  Synthetic oligonucleotide; AGG chr11 5218581 5218600 5218584 -
tcatagccgaattctaccag

SEQ ID NO: 49803 - DNA, 20 bp, Artificial Sequence
  Synthetic oligonucleotide; AAG chr11 5218575 5218594 5218578 -
ccgaattctaccagaggtac

SEQ ID NO: 49804 - DNA, 20 bp, Artificial Sequence
  Synthetic oligonucleotide; AGG chr11 5218574 5218593 5218577 -
cgaattctaccagaggtaca

SEQ ID NO: 49805 - DNA, 20 bp, Artificial Sequence
  Synthetic oligonucleotide; GAG chr11 5218572 5218591 5218575 -
aattctaccagaggtacaag

SEQ ID NO: 49806 - DNA, 20 bp, Artificial Sequence
  Synthetic oligonucleotide; AGG chr11 5218571 5218590 5218574 -
attctaccagaggtacaagg

SEQ ID NO: 49807 - DNA, 20 bp, Artificial Sequence
  Synthetic oligonucleotide; GAG chr11 5218569 5218588 5218572 -
tctaccagaggtacaaggag

SEQ ID NO: 49808 - DNA, 20 bp, Artificial Sequence
  Synthetic oligonucleotide; TGG chr11 5218565 5218584 5218568 -
ccagaggtacaaggaggagc

SEQ ID NO: 49809 - DNA, 20 bp, Artificial Sequence
  Synthetic oligonucleotide; TAG chr11 5218532 5218551 5218535 -
tctgaaactattccaatcaa

SEQ ID NO: 49810 - DNA, 20 bp, Artificial Sequence
  Synthetic oligonucleotide; AAG chr11 5218526 5218545 5218529 -
actattccaatcaatagaaa

SEQ ID NO: 49811 - DNA, 20 bp, Artificial Sequence
  Synthetic oligonucleotide; GAG chr11 5218524 5218543 5218527 -
tattccaatcaatagaaaaa

SEQ ID NO: 49812 - DNA, 20 bp, Artificial Sequence
  Synthetic oligonucleotide; AGG chr11 5218523 5218542 5218526 -
attccaatcaatagaaaaag

SEQ ID NO: 49813 - DNA, 20 bp, Artificial Sequence
  Synthetic oligonucleotide; GGG chr11 5218522 5218541 5218525 -
ttccaatcaatagaaaaaga

SEQ ID NO: 49814 - DNA, 20 bp, Artificial Sequence
  Synthetic oligonucleotide; GAG chr11 5218497 5218516 5218500 -
tcctccctaactcattttat

SEQ ID NO: 49815 - DNA, 20 bp, Artificial Sequence
  Synthetic oligonucleotide; AGG chr11 5218496 5218515 5218499 -
cctccctaactcattttatg

SEQ ID NO: 49816 - DNA, 20 bp, Artificial Sequence
  Synthetic oligonucleotide; CAG chr11 5218492 5218511 5218495 -
cctaactcattttatgaggc

SEQ ID NO: 49817 - DNA, 20 bp, Artificial Sequence
  Synthetic oligonucleotide; AAG chr11 5218473 5218492 5218476 -
ccagcatcatcctgatacca

SEQ ID NO: 49818 - DNA, 20 bp, Artificial Sequence
  Synthetic oligonucleotide; CAG chr11 5218465 5218484 5218468 -
atcctgataccaaagcctga

SEQ ID NO: 49819 - DNA, 20 bp, Artificial Sequence
  Synthetic oligonucleotide; GAG chr11 5218463 5218482 5218466 -
cctgataccaaagcctgaca

SEQ ID NO: 49820 - DNA, 20 bp, Artificial Sequence
  Synthetic oligonucleotide; AAG chr11 5218448 5218467 5218451 -
tgacagagacacaacaaaaa

SEQ ID NO: 49821 - DNA, 20 bp, Artificial Sequence
  Synthetic oligonucleotide; GAG chr11 5218446 5218465 5218449 -
acagagacacaacaaaaaaa

SEQ ID NO: 49822 - DNA, 20 bp, Artificial Sequence
  Synthetic oligonucleotide; TGG chr11 5218388 5218407 5218391 -
aaaaatcctcaataaaatac

SEQ ID NO: 49823 - DNA, 20 bp, Artificial Sequence
  Synthetic oligonucleotide; AAG chr11 5218365 5218384 5218368 -
caaactgatccaccatgatc

SEQ ID NO: 49824 - DNA, 20 bp, Artificial Sequence
  Synthetic oligonucleotide; TGG chr11 5218362 5218381 5218365 -
actgatccaccatgatcaag

SEQ ID NO: 49825 - DNA, 20 bp, Artificial Sequence
  Synthetic oligonucleotide; GGG chr11 5218361 5218380 5218364 -
ctgatccaccatgatcaagt

SEQ ID NO: 49826 - DNA, 20 bp, Artificial Sequence
  Synthetic oligonucleotide; AAG chr11 5218341 5218360 5218344 -
gggcttcatccctgccatgc

SEQ ID NO: 49827 - DNA, 20 bp, Artificial Sequence
  Synthetic oligonucleotide; AGG chr11 5218340 5218359 5218343 -
ggcttcatccctgccatgca

SEQ ID NO: 49828 - DNA, 20 bp, Artificial Sequence
  Synthetic oligonucleotide; TGG chr11 5218336 5218355 5218339 -
tcatccctgccatgcaaggc

SEQ ID NO: 49829 - DNA, 20 bp, Artificial Sequence
  Synthetic oligonucleotide; CAG chr11 5218303 5218322 5218306 -
gaaaatcaataaacataatc

SEQ ID NO: 49830 - DNA, 20 bp, Artificial Sequence
  Synthetic oligonucleotide; CAG chr11 5218292 5218311 5218295 -
aacataatccagcatataaa

SEQ ID NO: 49831 - DNA, 20 bp, Artificial Sequence
  Synthetic oligonucleotide; AAG chr11 5218284 5218303 5218287 -
ccagcatataaacagaacca

SEQ ID NO: 49832 - DNA, 20 bp, Artificial Sequence
  Synthetic oligonucleotide; TAG chr11 5218257 5218276 5218260 -
aaaccatatgattatctcaa

SEQ ID NO: 49833 - DNA, 20 bp, Artificial Sequence
  Synthetic oligonucleotide; CAG chr11 5218251 5218270 5218254 -
tatgattatctcaatagatg

SEQ ID NO: 49834 - DNA, 20 bp, Artificial Sequence
  Synthetic oligonucleotide; AAG chr11 5218246 5218265 5218249 -
ttatctcaatagatgcagaa

SEQ ID NO: 49835 - DNA, 20 bp, Artificial Sequence
  Synthetic oligonucleotide; AGG chr11 5218245 5218264 5218248 -
tatctcaatagatgcagaaa

SEQ ID NO: 49836 - DNA, 20 bp, Artificial Sequence
  Synthetic oligonucleotide; TAG chr11 5218194 5218213 5218197 -
gctaaaaactctcaataaat

SEQ ID NO: 49837 - DNA, 20 bp, Artificial Sequence
  Synthetic oligonucleotide; AGG chr11 5218193 5218212 5218196 -
ctaaaaactctcaataaatt

SEQ ID NO: 49838 - DNA, 20 bp, Artificial Sequence
  Synthetic oligonucleotide; TGG chr11 5218184 5218203 5218187 -
ctcaataaattaggtattga

SEQ ID NO: 49839 - DNA, 20 bp, Artificial Sequence
  Synthetic oligonucleotide; GGG chr11 5218183 5218202 5218186 -
tcaataaattaggtattgat

SEQ ID NO: 49840 - DNA, 20 bp, Artificial Sequence
  Synthetic oligonucleotide; AAG chr11 5218163 5218182 5218166 -
gggacatatctcaaaataat

SEQ ID NO: 49841 - DNA, 20 bp, Artificial Sequence
  Synthetic oligonucleotide; GAG chr11 5218161 5218180 5218164 -
gacatatctcaaaataataa

SEQ ID NO: 49842 - DNA, 20 bp, Artificial Sequence
  Synthetic oligonucleotide; CAG chr11 5218140 5218159 5218143 -
agctatctatgacaaaccca

SEQ ID NO: 49843 - DNA, 20 bp, Artificial Sequence
  Synthetic oligonucleotide; GAG chr11 5218124 5218143 5218127 -
cccacagccaatatcatact

SEQ ID NO: 49844 - DNA, 20 bp, Artificial Sequence
  Synthetic oligonucleotide; TGG chr11 5218121 5218140 5218124 -
acagccaatatcatactgag

SEQ ID NO: 49845 - DNA, 20 bp, Artificial Sequence
  Synthetic oligonucleotide; TGG chr11 5218110 5218129 5218113 -
catactgagtggacaaaaac

SEQ ID NO: 49846 - DNA, 20 bp, Artificial Sequence
  Synthetic oligonucleotide; AAG chr11 5218107 5218126 5218110 -
actgagtggacaaaaactgg

SEQ ID NO: 49847 - DNA, 20 bp, Artificial Sequence
  Synthetic oligonucleotide; TGG chr11 5218088 5218107 5218091 -
gaagcattccctttgaaaac

SEQ ID NO: 49848 - DNA, 20 bp, Artificial Sequence
  Synthetic oligonucleotide; AAG chr11 5218082 5218101 5218085 -
ttccctttgaaaactggcac

SEQ ID NO: 49849 - DNA, 20 bp, Artificial Sequence
  Synthetic oligonucleotide; AGG chr11 5218081 5218100 5218084 -
tccctttgaaaactggcaca

SEQ ID NO: 49850 - DNA, 20 bp, Artificial Sequence
  Synthetic oligonucleotide; CAG chr11 5218078 5218097 5218081 -
ctttgaaaactggcacaagg

SEQ ID NO: 49851 - DNA, 20 bp, Artificial Sequence
  Synthetic oligonucleotide; AGG chr11 5218077 5218096 5218080 -
tttgaaaactggcacaaggc

SEQ ID NO: 49852 - DNA, 20 bp, Artificial Sequence
  Synthetic oligonucleotide; GGG chr11 5218076 5218095 5218079 -
ttgaaaactggcacaaggca

SEQ ID NO: 49853 - DNA, 20 bp, Artificial Sequence
  Synthetic oligonucleotide; TAG chr11 5218044 5218063 5218047 -
ctcaccactcctattcaaca

SEQ ID NO: 49854 - DNA, 20 bp, Artificial Sequence
  Synthetic oligonucleotide; AAG chr11 5218035 5218054 5218038 -
cctattcaacatagtgttgt

SEQ ID NO: 49855 - DNA, 20 bp, Artificial Sequence
  Synthetic oligonucleotide; TGG chr11 5218029 5218048 5218032 -
caacatagtgttgtaagttc

SEQ ID NO: 49856 - DNA, 20 bp, Artificial Sequence
  Synthetic oligonucleotide; CAG chr11 5218025 5218044 5218028 -
atagtgttgtaagttctggc

SEQ ID NO: 49857 - DNA, 20 bp, Artificial Sequence
  Synthetic oligonucleotide; AGG chr11 5218024 5218043 5218027 -
tagtgttgtaagttctggcc

SEQ ID NO: 49858 - DNA, 20 bp, Artificial Sequence
  Synthetic oligonucleotide; GGG chr11 5218023 5218042 5218026 -
agtgttgtaagttctggcca

SEQ ID NO: 49859 - DNA, 20 bp, Artificial Sequence
  Synthetic oligonucleotide; CAG chr11 5218016 5218035 5218019 -
taagttctggccagggcaat

SEQ ID NO: 49860 - DNA, 20 bp, Artificial Sequence
  Synthetic oligonucleotide; AGG chr11 5218015 5218034 5218018 -
aagttctggccagggcaatc

SEQ ID NO: 49861 - DNA, 20 bp, Artificial Sequence
  Synthetic oligonucleotide; CAG chr11 5218012 5218031 5218015 -
ttctggccagggcaatcagg

SEQ ID NO: 49862 - DNA, 20 bp, Artificial Sequence
  Synthetic oligonucleotide; AGG chr11 5218011 5218030 5218014 -
tctggccagggcaatcaggc

SEQ ID NO: 49863 - DNA, 20 bp, Artificial Sequence
  Synthetic oligonucleotide; GAG chr11 5218009 5218028 5218012 -
tggccagggcaatcaggcag

SEQ ID NO: 49864 - DNA, 20 bp, Artificial Sequence
  Synthetic oligonucleotide; AAG chr11 5218006 5218025 5218009 -
ccagggcaatcaggcaggag

SEQ ID NO: 49865 - DNA, 20 bp, Artificial Sequence
  Synthetic oligonucleotide; AGG chr11 5218005 5218024 5218008 -
cagggcaatcaggcaggaga

SEQ ID NO: 49866 - DNA, 20 bp, Artificial Sequence
  Synthetic oligonucleotide; AAG chr11 5217997 5218016 5218000 -
tcaggcaggagaaggaaata

SEQ ID NO: 49867 - DNA, 20 bp, Artificial Sequence
  Synthetic oligonucleotide; AGG chr11 5217996 5218015 5217999 -
caggcaggagaaggaaataa

SEQ ID NO: 49868 - DNA, 20 bp, Artificial Sequence
  Synthetic oligonucleotide; GGG chr11 5217995 5218014 5217998 -
aggcaggagaaggaaataaa

SEQ ID NO: 49869 - DNA, 20 bp, Artificial Sequence
  Synthetic oligonucleotide; TAG chr11 5217984 5218003 5217987 -
ggaaataaagggcattcaat

SEQ ID NO: 49870 - DNA, 20 bp, Artificial Sequence
  Synthetic oligonucleotide; AGG chr11 5217983 5218002 5217986 -
gaaataaagggcattcaatt

SEQ ID NO: 49871 - DNA, 20 bp, Artificial Sequence
  Synthetic oligonucleotide; AAG chr11 5217978 5217997 5217981 -
aaagggcattcaattaggaa

SEQ ID NO: 49872 - DNA, 20 bp, Artificial Sequence
  Synthetic oligonucleotide; GAG chr11 5217976 5217995 5217979 -
agggcattcaattaggaaaa

SEQ ID NO: 49873 - DNA, 20 bp, Artificial Sequence
  Synthetic oligonucleotide; AGG chr11 5217975 5217994 5217978 -
gggcattcaattaggaaaag

SEQ ID NO: 49874 - DNA, 20 bp, Artificial Sequence
  Synthetic oligonucleotide; AAG chr11 5217972 5217991 5217975 -
cattcaattaggaaaagagg

SEQ ID NO: 49875 - DNA, 20 bp, Artificial Sequence
  Synthetic oligonucleotide; CAG chr11 5217951 5217970 5217954 -
agtgaaattgtccctgtttg

SEQ ID NO: 49876 - DNA, 20 bp, Artificial Sequence
  Synthetic oligonucleotide; TAG chr11 5217930 5217949 5217933 -
agatgacatgattgtatatc

SEQ ID NO: 49877 - DNA, 20 bp, Artificial Sequence
  Synthetic oligonucleotide; CAG chr11 5217912 5217931 5217915 -
tctagaaaaccccattgtct

SEQ ID NO: 49878 - DNA, 20 bp, Artificial Sequence
  Synthetic oligonucleotide; AAG chr11 5217895 5217914 5217898 -
tctcagcccaaaatctcctt

SEQ ID NO: 49879 - DNA, 20 bp, Artificial Sequence
  Synthetic oligonucleotide; AAG chr11 5217887 5217906 5217890 -
caaaatctccttaagctgat

SEQ ID NO: 49880 - DNA, 20 bp, Artificial Sequence
  Synthetic oligonucleotide; CAG chr11 5217878 5217897 5217881 -
cttaagctgataagcaactt

SEQ ID NO: 49881 - DNA, 20 bp, Artificial Sequence
  Synthetic oligonucleotide; AAG chr11 5217873 5217892 5217876 -
gctgataagcaacttcagca

SEQ ID NO: 49882 - DNA, 20 bp, Artificial Sequence
  Synthetic oligonucleotide; CAG chr11 5217867 5217886 5217870 -
aagcaacttcagcaaagtct

SEQ ID NO: 49883 - DNA, 20 bp, Artificial Sequence
  Synthetic oligonucleotide; AGG chr11 5217866 5217885 5217869 -
agcaacttcagcaaagtctc

SEQ ID NO: 49884 - DNA, 20 bp, Artificial Sequence
  Synthetic oligonucleotide; CAG chr11 5217854 5217873 5217857 -
aaagtctcaggatataaaat

SEQ ID NO: 49885 - DNA, 20 bp, Artificial Sequence
  Synthetic oligonucleotide; AAG chr11 5217837 5217856 5217840 -
aatcagtgtgcaaaaatcac

SEQ ID NO: 49886 - DNA, 20 bp, Artificial Sequence
  Synthetic oligonucleotide; CAG chr11 5217815 5217834 5217818 -
gtattcctatgcaccaataa

SEQ ID NO: 49887 - DNA, 20 bp, Artificial Sequence
  Synthetic oligonucleotide; CAG chr11 5217807 5217826 5217810 -
atgcaccaataacagacaaa

SEQ ID NO: 49888 - DNA, 20 bp, Artificial Sequence
  Synthetic oligonucleotide; GAG chr11 5217805 5217824 5217808 -
gcaccaataacagacaaaca

SEQ ID NO: 49889 - DNA, 20 bp, Artificial Sequence
  Synthetic oligonucleotide; GAG chr11 5217803 5217822 5217806 -
accaataacagacaaacaga

SEQ ID NO: 49890 - DNA, 20 bp, Artificial Sequence
  Synthetic oligonucleotide; GAG chr11 5217791 5217810 5217794 -
caaacagagagccaaatcat

SEQ ID NO: 49891 - DNA, 20 bp, Artificial Sequence
  Synthetic oligonucleotide; AAG chr11 5217763 5217782 5217766 -
tcccattcacaattgcttca

SEQ ID NO: 49892 - DNA, 20 bp, Artificial Sequence
  Synthetic oligonucleotide; GAG chr11 5217761 5217780 5217764 -
ccattcacaattgcttcaaa

SEQ ID NO: 49893 - DNA, 20 bp, Artificial Sequence
  Synthetic oligonucleotide; TAG chr11 5217747 5217766 5217750 -
ttcaaagagaataaaatacc

SEQ ID NO: 49894 - DNA, 20 bp, Artificial Sequence
  Synthetic oligonucleotide; AGG chr11 5217746 5217765 5217749 -
tcaaagagaataaaatacct

SEQ ID NO: 49895 - DNA, 20 bp, Artificial Sequence
  Synthetic oligonucleotide; AAG chr11 5217731 5217750 5217734 -
tacctaggaatccaacttac

SEQ ID NO: 49896 - DNA, 20 bp, Artificial Sequence
  Synthetic oligonucleotide; AGG chr11 5217730 5217749 5217733 -
acctaggaatccaacttaca

SEQ ID NO: 49897 - DNA, 20 bp, Artificial Sequence
  Synthetic oligonucleotide; GGG chr11 5217729 5217748 5217732 -
cctaggaatccaacttacaa

SEQ ID NO: 49898 - DNA, 20 bp, Artificial Sequence
  Synthetic oligonucleotide; AAG chr11 5217721 5217740 5217724 -
tccaacttacaagggatgtg

SEQ ID NO: 49899 - DNA, 20 bp, Artificial Sequence
  Synthetic oligonucleotide; AGG chr11 5217720 5217739 5217723 -
ccaacttacaagggatgtga

SEQ ID NO: 49900 - DNA, 20 bp, Artificial Sequence
  Synthetic oligonucleotide; AAG chr11 5217709 5217728 5217712 -
gggatgtgaaggacctcttc

SEQ ID NO: 49901 - DNA, 20 bp, Artificial Sequence
  Synthetic oligonucleotide; AGG chr11 5217708 5217727 5217711 -
ggatgtgaaggacctcttca

SEQ ID NO: 49902 - DNA, 20 bp, Artificial Sequence
  Synthetic oligonucleotide; GAG chr11 5217706 5217725 5217709 -
atgtgaaggacctcttcaag

SEQ ID NO: 49903 - DNA, 20 bp, Artificial Sequence
  Synthetic oligonucleotide; AAG chr11 5217675 5217694 5217678 -
accactgctcaatgaaataa

SEQ ID NO: 49904 - DNA, 20 bp, Artificial Sequence
  Synthetic oligonucleotide; GAG chr11 5217673 5217692 5217676 -
cactgctcaatgaaataaaa

SEQ ID NO: 49905 - DNA, 20 bp, Artificial Sequence
  Synthetic oligonucleotide; AGG chr11 5217672 5217691 5217675 -
actgctcaatgaaataaaag

SEQ ID NO: 49906 - DNA, 20 bp, Artificial Sequence
  Synthetic oligonucleotide; TGG chr11 5217658 5217677 5217661 -
taaaagaggatacaaacaaa

SEQ ID NO: 49907 - DNA, 20 bp, Artificial Sequence
  Synthetic oligonucleotide; AAG chr11 5217655 5217674 5217658 -
aagaggatacaaacaaatgg

SEQ ID NO: 49908 - DNA, 20 bp, Artificial Sequence
  Synthetic oligonucleotide; TGG chr11 5217637 5217656 5217640 -
ggaagaacattccatgctca

SEQ ID NO: 49909 - DNA, 20 bp, Artificial Sequence
  Synthetic oligonucleotide; GGG chr11 5217636 5217655 5217639 -
gaagaacattccatgctcat

SEQ ID NO: 49910 - DNA, 20 bp, Artificial Sequence
  Synthetic oligonucleotide; TAG chr11 5217633 5217652 5217636 -
gaacattccatgctcatggg

SEQ ID NO: 49911 - DNA, 20 bp, Artificial Sequence
  Synthetic oligonucleotide; AGG chr11 5217632 5217651 5217635 -
aacattccatgctcatgggt

SEQ ID NO: 49912 - DNA, 20 bp, Artificial Sequence
  Synthetic oligonucleotide; AAG chr11 5217629 5217648 5217632 -
attccatgctcatgggtagg

SEQ ID NO: 49913 - DNA, 20 bp, Artificial Sequence
  Synthetic oligonucleotide; TGG chr11 5217609 5217628 5217612 -
aagaatcaatatcgtgaaaa

SEQ ID NO: 49914 - DNA, 20 bp, Artificial Sequence
  Synthetic oligonucleotide; AAG chr11 5217595 5217614 5217598 -
tgaaaatggtcatactgccc

SEQ ID NO: 49915 - DNA, 20 bp, Artificial Sequence
  Synthetic oligonucleotide; AGG chr11 5217594 5217613 5217597 -
gaaaatggtcatactgccca

SEQ ID NO: 49916 - DNA, 20 bp, Artificial Sequence
  Synthetic oligonucleotide; TAG chr11 5217584 5217603 5217587 -
atactgcccaaggtaattta

SEQ ID NO: 49917 - DNA, 20 bp, Artificial Sequence
  Synthetic oligonucleotide; AAG chr11 5217562 5217581 5217565 -
gattcaatgccatccccatc

SEQ ID NO: 49918 - DNA, 20 bp, Artificial Sequence
  Synthetic oligonucleotide; CAG chr11 5217540 5217559 5217543 -
gctaccaatgactttcttca

SEQ ID NO: 49919 - DNA, 20 bp, Artificial Sequence
  Synthetic oligonucleotide; TGG chr11 5217534 5217553 5217537 -
aatgactttcttcacagaac

SEQ ID NO: 49920 - DNA, 20 bp, Artificial Sequence
  Synthetic oligonucleotide; AAG chr11 5217517 5217536 5217520 -
aactggaaaaaactacttta

SEQ ID NO: 49921 - DNA, 20 bp, Artificial Sequence
  Synthetic oligonucleotide; TGG chr11 5217508 5217527 5217511 -
aaactactttaaagttcata

SEQ ID NO: 49922 - DNA, 20 bp, Artificial Sequence
  Synthetic oligonucleotide; AAG chr11 5217497 5217516 5217500 -
aagttcatatggaaccaaaa

SEQ ID NO: 49923 - DNA, 20 bp, Artificial Sequence
  Synthetic oligonucleotide; GAG chr11 5217495 5217514 5217498 -
gttcatatggaaccaaaaaa

SEQ ID NO: 49924 - DNA, 20 bp, Artificial Sequence
  Synthetic oligonucleotide; AAG chr11 5217481 5217500 5217484 -
aaaaaagagcccacatcacc

SEQ ID NO: 49925 - DNA, 20 bp, Artificial Sequence
  Synthetic oligonucleotide; AGG chr11 5217480 5217499 5217483 -
aaaaagagcccacatcacca

SEQ ID NO: 49926 - DNA, 20 bp, Artificial Sequence
  Synthetic oligonucleotide; AAG chr11 5217470 5217489 5217473 -
cacatcaccaaggcaatcct

SEQ ID NO: 49927 - DNA, 20 bp, Artificial Sequence
  Synthetic oligonucleotide; AAG chr11 5217463 5217482 5217466 -
ccaaggcaatcctaagccaa

SEQ ID NO: 49928 - DNA, 20 bp, Artificial Sequence
  Synthetic oligonucleotide; AAG chr11 5217456 5217475 5217459 -
aatcctaagccaaaagaaca

SEQ ID NO: 49929 - DNA, 20 bp, Artificial Sequence
  Synthetic oligonucleotide; TGG chr11 5217452 5217471 5217455 -
ctaagccaaaagaacaaagc

SEQ ID NO: 49930 - DNA, 20 bp, Artificial Sequence
  Synthetic oligonucleotide; GAG chr11 5217450 5217469 5217453 -
aagccaaaagaacaaagctg

SEQ ID NO: 49931 - DNA, 20 bp, Artificial Sequence
  Synthetic oligonucleotide; AGG chr11 5217449 5217468 5217452 -
agccaaaagaacaaagctgg

SEQ ID NO: 49932 - DNA, 20 bp, Artificial Sequence
  Synthetic oligonucleotide; CGG chr11 5217408 5217427 5217411 -
caaactatactacaatgcta

SEQ ID NO: 49933 - DNA, 20 bp, Artificial Sequence
  Synthetic oligonucleotide; CAG chr11 5217396 5217415 5217399 -
caatgctacggtaaccaaaa

SEQ ID NO: 49934 - DNA, 20 bp, Artificial Sequence
  Synthetic oligonucleotide; TGG chr11 5217391 5217410 5217394 -
ctacggtaaccaaaacagca

SEQ ID NO: 49935 - DNA, 20 bp, Artificial Sequence
  Synthetic oligonucleotide; TGG chr11 5217385 5217404 5217388 -
taaccaaaacagcatggtac

SEQ ID NO: 49936 - DNA, 20 bp, Artificial Sequence
  Synthetic oligonucleotide; CAG chr11 5217374 5217393 5217377 -
gcatggtactggtaccaaaa

SEQ ID NO: 49937 - DNA, 20 bp, Artificial Sequence
  Synthetic oligonucleotide; GAG chr11 5217372 5217391 5217375 -
atggtactggtaccaaaaca

SEQ ID NO: 49938 - DNA, 20 bp, Artificial Sequence
  Synthetic oligonucleotide; TAG chr11 5217366 5217385 5217369 -
ctggtaccaaaacagagatc

SEQ ID NO: 49939 - DNA, 20 bp, Artificial Sequence
  Synthetic oligonucleotide; TGG chr11 5217358 5217377 5217361 -
aaaacagagatctagaccaa

SEQ ID NO: 49940 - DNA, 20 bp, Artificial Sequence
  Synthetic oligonucleotide; CAG chr11 5217353 5217372 5217356 -
agagatctagaccaatggaa

SEQ ID NO: 49941 - DNA, 20 bp, Artificial Sequence
  Synthetic oligonucleotide; CAG chr11 5217348 5217367 5217351 -
tctagaccaatggaacagaa

SEQ ID NO: 49942 - DNA, 20 bp, Artificial Sequence
  Synthetic oligonucleotide; GAG chr11 5217346 5217365 5217349 -
tagaccaatggaacagaaca

SEQ ID NO: 49943 - DNA, 20 bp, Artificial Sequence
  Synthetic oligonucleotide; CAG chr11 5217339 5217358 5217342 -
atggaacagaacagagccct

SEQ ID NO: 49944 - DNA, 20 bp, Artificial Sequence
  Synthetic oligonucleotide; GAG chr11 5217292 5217311 5217295 -
atctgatctttgacaaacct

SEQ ID NO: 49945 - DNA, 20 bp, Artificial Sequence
  Synthetic oligonucleotide; GAG chr11 5217290 5217309 5217293 -
ctgatctttgacaaacctga

SEQ ID NO: 49946 - DNA, 20 bp, Artificial Sequence
  Synthetic oligonucleotide; AAG chr11 5217283 5217302 5217286 -
ttgacaaacctgagagaaac

SEQ ID NO: 49947 - DNA, 20 bp, Artificial Sequence
  Synthetic oligonucleotide; TGG chr11 5217277 5217296 5217280 -
aacctgagagaaacaagcaa

SEQ ID NO: 49948 - DNA, 20 bp, Artificial Sequence
  Synthetic oligonucleotide; GGG chr11 5217276 5217295 5217279 -
acctgagagaaacaagcaat

SEQ ID NO: 49949 - DNA, 20 bp, Artificial Sequence
  Synthetic oligonucleotide; GGG chr11 5217275 5217294 5217278 -
cctgagagaaacaagcaatg

SEQ ID NO: 49950 - DNA, 20 bp, Artificial Sequence
  Synthetic oligonucleotide; AAG chr11 5217271 5217290 5217274 -
agagaaacaagcaatgggga

SEQ ID NO: 49951 - DNA, 20 bp, Artificial Sequence
  Synthetic oligonucleotide; AGG chr11 5217270 5217289 5217273 -
gagaaacaagcaatggggaa

SEQ ID NO: 49952 - DNA, 20 bp, Artificial Sequence
  Synthetic oligonucleotide; TGG chr11 5217250 5217269 5217253 -
aggattccctatttaataaa

SEQ ID NO: 49953 - DNA, 20 bp, Artificial Sequence
  Synthetic oligonucleotide; TGG chr11 5217244 5217263 5217247 -
ccctatttaataaatggtgc

SEQ ID NO: 49954 - DNA, 20 bp, Artificial Sequence
  Synthetic oligonucleotide; GGG chr11 5217243 5217262 5217246 -
cctatttaataaatggtgct

SEQ ID NO: 49955 - DNA, 20 bp, Artificial Sequence
  Synthetic oligonucleotide; TGG chr11 5217235 5217254 5217238 -
ataaatggtgctgggaaaac

SEQ ID NO: 49956 - DNA, 20 bp, Artificial Sequence
  Synthetic oligonucleotide; TAG chr11 5217231 5217250 5217234 -
atggtgctgggaaaactggc

SEQ ID NO: 49957 - DNA, 20 bp, Artificial Sequence
  Synthetic oligonucleotide; TAG chr11 5217221 5217240 5217224 -
gaaaactggctagccatatg

SEQ ID NO: 49958 - DNA, 20 bp, Artificial Sequence
  Synthetic oligonucleotide; AAG chr11 5217217 5217236 5217220 -
actggctagccatatgtaga

SEQ ID NO: 49959 - DNA, 20 bp, Artificial Sequence
  Synthetic oligonucleotide; TGG chr11 5217207 5217226 5217210 -
catatgtagaaagctgaaac

SEQ ID NO: 49960 - DNA, 20 bp, Artificial Sequence
  Synthetic oligonucleotide; AAG chr11 5217170 5217189 5217173 -
ccttatacaaaaattaattc

SEQ ID NO: 49961 - DNA, 20 bp, Artificial Sequence
  Synthetic oligonucleotide; TGG chr11 5217166 5217185 5217169 -
atacaaaaattaattcaaga

SEQ ID NO: 49962 - DNA, 20 bp, Artificial Sequence
  Synthetic oligonucleotide; AAG chr11 5217159 5217178 5217162 -
aattaattcaagatggatta

SEQ ID NO: 49963 - DNA, 20 bp, Artificial Sequence
  Synthetic oligonucleotide; TAG chr11 5217146 5217165 5217149 -
tggattaaagacttacatgt

SEQ ID NO: 49964 - DNA, 20 bp, Artificial Sequence
  Synthetic oligonucleotide; TAG chr11 5217123 5217142 5217126 -
acctaaaaccataaaaaccc

SEQ ID NO: 49965 - DNA, 20 bp, Artificial Sequence
  Synthetic oligonucleotide; TAG chr11 5217111 5217130 5217114 -
aaaaaccctagaaaaaaacc

SEQ ID NO: 49966 - DNA, 20 bp, Artificial Sequence
  Synthetic oligonucleotide; AGG chr11 5217110 5217129 5217113 -
aaaaccctagaaaaaaacct

SEQ ID NO: 49967 - DNA, 20 bp, Artificial Sequence
  Synthetic oligonucleotide; CAG chr11 5217097 5217116 5217100 -
aaaacctaggcaataccatt

SEQ ID NO: 49968 - DNA, 20 bp, Artificial Sequence
  Synthetic oligonucleotide; AGG chr11 5217096 5217115 5217099 -
aaacctaggcaataccattc

SEQ ID NO: 49969 - DNA, 20 bp, Artificial Sequence
  Synthetic oligonucleotide; TAG chr11 5217090 5217109 5217093 -
aggcaataccattcaggaca

SEQ ID NO: 49970 - DNA, 20 bp, Artificial Sequence
  Synthetic oligonucleotide; AGG chr11 5217089 5217108 5217092 -
ggcaataccattcaggacat

SEQ ID NO: 49971 - DNA, 20 bp, Artificial Sequence
  Synthetic oligonucleotide; TGG chr11 5217084 5217103 5217087 -
taccattcaggacataggca

SEQ ID NO: 49972 - DNA, 20 bp, Artificial Sequence
  Synthetic oligonucleotide; GGG chr11 5217083 5217102 5217086 -
accattcaggacataggcat

SEQ ID NO: 49973 - DNA, 20 bp, Artificial Sequence
  Synthetic oligonucleotide; AAG chr11 5217079 5217098 5217082 -
ttcaggacataggcatgggc

SEQ ID NO: 49974 - DNA, 20 bp, Artificial Sequence
  Synthetic oligonucleotide; AGG chr11 5217078 5217097 5217081 -
tcaggacataggcatgggca

SEQ ID NO: 49975 - DNA, 20 bp, Artificial Sequence
  Synthetic oligonucleotide; AAG chr11 5217054 5217073 5217057 -
cttcatgtctaaaacaccaa

SEQ ID NO: 49976 - DNA, 20 bp, Artificial Sequence
  Synthetic oligonucleotide; TGG chr11 5217048 5217067 5217051 -
gtctaaaacaccaaaagcaa

SEQ ID NO: 49977 - DNA, 20 bp, Artificial Sequence
  Synthetic oligonucleotide; AAG chr11 5217039 5217058 5217042 -
accaaaagcaatggcaacaa

SEQ ID NO: 49978 - DNA, 20 bp, Artificial Sequence
  Synthetic oligonucleotide; TGG chr11 5217030 5217049 5217033 -
aatggcaacaaaagacaaaa

SEQ ID NO: 49979 - DNA, 20 bp, Artificial Sequence
  Synthetic oligonucleotide; CGG chr11 5217022 5217041 5217025 -
caaaagacaaaatggacaaa

SEQ ID NO: 49980 - DNA, 20 bp, Artificial Sequence
  Synthetic oligonucleotide; GGG chr11 5217021 5217040 5217024 -
aaaagacaaaatggacaaac

SEQ ID NO: 49981 - DNA, 20 bp, Artificial Sequence
  Synthetic oligonucleotide; AAG chr11 5217004 5217023 5217007 -
aacgggatctaattaaacta

SEQ ID NO: 49982 - DNA, 20 bp, Artificial Sequence
  Synthetic oligonucleotide; GAG chr11 5217002 5217021 5217005 -
cgggatctaattaaactaaa

SEQ ID NO: 49983 - DNA, 20 bp, Artificial Sequence
  Synthetic oligonucleotide; CAG chr11 5216991 5217010 5216994 -
taaactaaagagcttctgca

SEQ ID NO: 49984 - DNA, 20 bp, Artificial Sequence
  Synthetic oligonucleotide; AAG chr11 5216985 5217004 5216988 -
aaagagcttctgcacagcta

SEQ ID NO: 49985 - DNA, 20 bp, Artificial Sequence
  Synthetic oligonucleotide; CAG chr11 5216972 5216991 5216975 -
acagctaaagaaactaccat

SEQ ID NO: 49986 - DNA, 20 bp, Artificial Sequence
  Synthetic oligonucleotide; GAG chr11 5216970 5216989 5216973 -
agctaaagaaactaccatca

SEQ ID NO: 49987 - DNA, 20 bp, Artificial Sequence
  Synthetic oligonucleotide; CAG chr11 5216963 5216982 5216966 -
gaaactaccatcagagtgaa

SEQ ID NO: 49988 - DNA, 20 bp, Artificial Sequence
  Synthetic oligonucleotide; AGG chr11 5216962 5216981 5216965 -
aaactaccatcagagtgaac

SEQ ID NO: 49989 - DNA, 20 bp, Artificial Sequence
  Synthetic oligonucleotide; TGG chr11 5216947 5216966 5216950 -
tgaacaggcaacctacaaaa

SEQ ID NO: 49990 - DNA, 20 bp, Artificial Sequence
  Synthetic oligonucleotide; GGG chr11 5216946 5216965 5216949 -
gaacaggcaacctacaaaat

SEQ ID NO: 49991 - DNA, 20 bp, Artificial Sequence
  Synthetic oligonucleotide; GAG chr11 5216944 5216963 5216947 -
acaggcaacctacaaaatgg

SEQ ID NO: 49992 - DNA, 20 bp, Artificial Sequence
  Synthetic oligonucleotide; AAG chr11 5216913 5216932 5216916 -
tgcaatctactcatctgaca

SEQ ID NO: 49993 - DNA, 20 bp, Artificial Sequence
  Synthetic oligonucleotide; AGG chr11 5216912 5216931 5216915 -
gcaatctactcatctgacaa

SEQ ID NO: 49994 - DNA, 20 bp, Artificial Sequence
  Synthetic oligonucleotide; GGG chr11 5216911 5216930 5216914 -
caatctactcatctgacaaa

SEQ ID NO: 49995 - DNA, 20 bp, Artificial Sequence
  Synthetic oligonucleotide; CAG chr11 5216900 5216919 5216903 -
tctgacaaagggctaatatc

SEQ ID NO: 49996 - DNA, 20 bp, Artificial Sequence
  Synthetic oligonucleotide; AAG chr11 5216869 5216888 5216872 -
atgaactcaaacaaatttac

SEQ ID NO: 49997 - DNA, 20 bp, Artificial Sequence
  Synthetic oligonucleotide; AAG chr11 5216843 5216862 5216846 -
aaacaaacaaccccatcaaa

SEQ ID NO: 49998 - DNA, 20 bp, Artificial Sequence
  Synthetic oligonucleotide; TGG chr11 5216840 5216859 5216843 -
caaacaaccccatcaaaaag

SEQ ID NO: 49999 - DNA, 20 bp, Artificial Sequence
  Synthetic oligonucleotide; GGG chr11 5216839 5216858 5216842 -
aaacaaccccatcaaaaagt

SEQ ID NO: 50000 - DNA, 20 bp, Artificial Sequence
  Synthetic oligonucleotide; AAG chr11 5216834 5216853 5216837 -
accccatcaaaaagtgggca

SEQ ID NO: 50001 - DNA, 20 bp, Artificial Sequence
  Synthetic oligonucleotide; AGG chr11 5216833 5216852 5216836 -
ccccatcaaaaagtgggcaa

SEQ ID NO: 50002 - DNA, 20 bp, Artificial Sequence
  Synthetic oligonucleotide; CAG chr11 5216823 5216842 5216826 -
aagtgggcaaaggatatgaa

SEQ ID NO: 50003 - DNA, 20 bp, Artificial Sequence
  Synthetic oligonucleotide; AAG chr11 5216809 5216828 5216812 -
tatgaacagacacttcgcaa

SEQ ID NO: 50004 - DNA, 20 bp, Artificial Sequence
  Synthetic oligonucleotide; AAG chr11 5216806 5216825 5216809 -
gaacagacacttcgcaaaag

SEQ ID NO: 50005 - DNA, 20 bp, Artificial Sequence
  Synthetic oligonucleotide; TAG chr11 5216758 5216777 5216761 -
gaaaaaatgctcatcatcac

SEQ ID NO: 50006 - DNA, 20 bp, Artificial Sequence
  Synthetic oligonucleotide; CAG chr11 5216751 5216770 5216754 -
tgctcatcatcactagccat

SEQ ID NO: 50007 - DNA, 20 bp, Artificial Sequence
  Synthetic oligonucleotide; GAG chr11 5216749 5216768 5216752 -
ctcatcatcactagccatca

SEQ ID NO: 50008 - DNA, 20 bp, Artificial Sequence
  Synthetic oligonucleotide; GAG chr11 5216724 5216743 5216727 -
atgcaaatcaaaaccacaat

SEQ ID NO: 50009 - DNA, 20 bp, Artificial Sequence
  Synthetic oligonucleotide; CAG chr11 5216707 5216726 5216710 -
aatgagataccatctcacac

SEQ ID NO: 50010 - DNA, 20 bp, Artificial Sequence
  Synthetic oligonucleotide; TAG chr11 5216703 5216722 5216706 -
agataccatctcacaccagt

SEQ ID NO: 50011 - DNA, 20 bp, Artificial Sequence
  Synthetic oligonucleotide; TGG chr11 5216698 5216717 5216701 -
ccatctcacaccagttagaa

SEQ ID NO: 50012 - DNA, 20 bp, Artificial Sequence
  Synthetic oligonucleotide; AAG chr11 5216684 5216703 5216687 -
ttagaatggcgatcattaaa

SEQ ID NO: 50013 - DNA, 20 bp, Artificial Sequence
  Synthetic oligonucleotide; CAG chr11 5216680 5216699 5216683 -
aatggcgatcattaaaaagt

SEQ ID NO: 50014 - DNA, 20 bp, Artificial Sequence
  Synthetic oligonucleotide; AGG chr11 5216679 5216698 5216682 -
atggcgatcattaaaaagtc

SEQ ID NO: 50015 - DNA, 20 bp, Artificial Sequence
  Synthetic oligonucleotide; CAG chr11 5216670 5216689 5216673 -
attaaaaagtcaggaaacaa

SEQ ID NO: 50016 - DNA, 20 bp, Artificial Sequence
  Synthetic oligonucleotide; AGG chr11 5216669 5216688 5216672 -
ttaaaaagtcaggaaacaac

SEQ ID NO: 50017 - DNA, 20 bp, Artificial Sequence
  Synthetic oligonucleotide; TGG chr11 5216663 5216682 5216666 -
agtcaggaaacaacaggtgc

SEQ ID NO: 50018 - DNA, 20 bp, Artificial Sequence
  Synthetic oligonucleotide; GAG chr11 5216661 5216680 5216664 -
tcaggaaacaacaggtgctg

SEQ ID NO: 50019 - DNA, 20 bp, Artificial Sequence
  Synthetic oligonucleotide; GAG chr11 5216659 5216678 5216662 -
aggaaacaacaggtgctgga

SEQ ID NO: 50020 - DNA, 20 bp, Artificial Sequence
  Synthetic oligonucleotide; AGG chr11 5216658 5216677 5216661 -
ggaaacaacaggtgctggag

SEQ ID NO: 50021 - DNA, 20 bp, Artificial Sequence
  Synthetic oligonucleotide; TGG chr11 5216652 5216671 5216655 -
aacaggtgctggagaggatg

SEQ ID NO: 50022 - DNA, 20 bp, Artificial Sequence
  Synthetic oligonucleotide; GAG chr11 5216650 5216669 5216653 -
caggtgctggagaggatgtg

SEQ ID NO: 50023 - DNA, 20 bp, Artificial Sequence
  Synthetic oligonucleotide; CAG chr11 5216644 5216663 5216647 -
ctggagaggatgtggagaaa

SEQ ID NO: 50024 - DNA, 20 bp, Artificial Sequence
  Synthetic oligonucleotide; AGG chr11 5216643 5216662 5216646 -
tggagaggatgtggagaaac

SEQ ID NO: 50025 - DNA, 20 bp, Artificial Sequence
  Synthetic oligonucleotide; TGG chr11 5216623 5216642 5216626 -
aggaacaacttttacactgt

SEQ ID NO: 50026 - DNA, 20 bp, Artificial Sequence
  Synthetic oligonucleotide; TGG chr11 5216620 5216639 5216623 -
aacaacttttacactgttgg

SEQ ID NO: 50027 - DNA, 20 bp, Artificial Sequence
  Synthetic oligonucleotide; GGG chr11 5216619 5216638 5216622 -
acaacttttacactgttggt

SEQ ID NO: 50028 - DNA, 20 bp, Artificial Sequence
  Synthetic oligonucleotide; TAG chr11 5216607 5216626 5216610 -
ctgttggtgggactgtaaac

SEQ ID NO: 50029 - DNA, 20 bp, Artificial Sequence
  Synthetic oligonucleotide; CGG chr11 5216593 5216612 5216596 -
gtaaactagttcaaccattg

SEQ ID NO: 50030 - DNA, 20 bp, Artificial Sequence
  Synthetic oligonucleotide; AAG chr11 5216590 5216609 5216593 -
aactagttcaaccattgcgg

SEQ ID NO: 50031 - DNA, 20 bp, Artificial Sequence
  Synthetic oligonucleotide; CAG chr11 5216586 5216605 5216589 -
agttcaaccattgcggaagt

SEQ ID NO: 50032 - DNA, 20 bp, Artificial Sequence
  Synthetic oligonucleotide; TGG chr11 5216581 5216600 5216584 -
aaccattgcggaagtcagtg

SEQ ID NO: 50033 - DNA, 20 bp, Artificial Sequence
  Synthetic oligonucleotide; CAG chr11 5216570 5216589 5216573 -
aagtcagtgtggcaattcct

SEQ ID NO: 50034 - DNA, 20 bp, Artificial Sequence
  Synthetic oligonucleotide; AGG chr11 5216569 5216588 5216572 -
agtcagtgtggcaattcctc

SEQ ID NO: 50035 - DNA, 20 bp, Artificial Sequence
  Synthetic oligonucleotide; TAG chr11 5216562 5216581 5216565 -
gtggcaattcctcaggaatc

SEQ ID NO: 50036 - DNA, 20 bp, Artificial Sequence
  Synthetic oligonucleotide; TAG chr11 5216556 5216575 5216559 -
attcctcaggaatctagaac

SEQ ID NO: 50037 - DNA, 20 bp, Artificial Sequence
  Synthetic oligonucleotide; CAG chr11 5216538 5216557 5216541 -
actagaaataccatttgacc

SEQ ID NO: 50038 - DNA, 20 bp, Artificial Sequence
  Synthetic oligonucleotide; TGG chr11 5216523 5216542 5216526 -
tgacccagccatcccattac

SEQ ID NO: 50039 - DNA, 20 bp, Artificial Sequence
  Synthetic oligonucleotide; GGG chr11 5216522 5216541 5216525 -
gacccagccatcccattact

SEQ ID NO: 50040 - DNA, 20 bp, Artificial Sequence
  Synthetic oligonucleotide; AAG chr11 5216509 5216528 5216512 -
cattactgggtacataccca

SEQ ID NO: 50041 - DNA, 20 bp, Artificial Sequence
  Synthetic oligonucleotide; AGG chr11 5216508 5216527 5216511 -
attactgggtacatacccaa

SEQ ID NO: 50042 - DNA, 20 bp, Artificial Sequence
  Synthetic oligonucleotide; AAG chr11 5216484 5216503 5216487 -
ttataaatcatgctgctata

SEQ ID NO: 50043 - DNA, 20 bp, Artificial Sequence
  Synthetic oligonucleotide; CAG chr11 5216457 5216476 5216460 -
atgcacacgtatgtttattg

SEQ ID NO: 50044 - DNA, 20 bp, Artificial Sequence
  Synthetic oligonucleotide; TAG chr11 5216442 5216461 5216445 -
tattgcagcactattcacaa

SEQ ID NO: 50045 - DNA, 20 bp, Artificial Sequence
  Synthetic oligonucleotide; AAG chr11 5216437 5216456 5216440 -
cagcactattcacaatagca

SEQ ID NO: 50046 - DNA, 20 bp, Artificial Sequence
  Synthetic oligonucleotide; TGG chr11 5216431 5216450 5216434 -
tattcacaatagcaaagact

SEQ ID NO: 50047 - DNA, 20 bp, Artificial Sequence
  Synthetic oligonucleotide; TAG chr11 5216403 5216422 5216406 -
acccaaatgtccaacaacga

SEQ ID NO: 50048 - DNA, 20 bp, Artificial Sequence
  Synthetic oligonucleotide; TGG chr11 5216398 5216417 5216401 -
aatgtccaacaacgatagac

SEQ ID NO: 50049 - DNA, 20 bp, Artificial Sequence
  Synthetic oligonucleotide; AAG chr11 5216392 5216411 5216395 -
caacaacgatagactggatt

SEQ ID NO: 50050 - DNA, 20 bp, Artificial Sequence
  Synthetic oligonucleotide; TGG chr11 5216383 5216402 5216386 -
tagactggattaagaaaatg

SEQ ID NO: 50051 - DNA, 20 bp, Artificial Sequence
  Synthetic oligonucleotide; TGG chr11 5216367 5216386 5216370 -
aatgtggcacatatacacca

SEQ ID NO: 50052 - DNA, 20 bp, Artificial Sequence
  Synthetic oligonucleotide; CAG chr11 5216355 5216374 5216358 -
atacaccatggaatactatg

SEQ ID NO: 50053 - DNA, 20 bp, Artificial Sequence
  Synthetic oligonucleotide; GAG chr11 5216338 5216357 5216341 -
atgcagccataaaaaatgat

SEQ ID NO: 50054 - DNA, 20 bp, Artificial Sequence
  Synthetic oligonucleotide; TAG chr11 5216322 5216341 5216325 -
tgatgagttcatgtcctttg

SEQ ID NO: 50055 - DNA, 20 bp, Artificial Sequence
  Synthetic oligonucleotide; AGG chr11 5216321 5216340 5216324 -
gatgagttcatgtcctttgt

SEQ ID NO: 50056 - DNA, 20 bp, Artificial Sequence
  Synthetic oligonucleotide; GGG chr11 5216320 5216339 5216323 -
atgagttcatgtcctttgta

SEQ ID NO: 50057 - DNA, 20 bp, Artificial Sequence
  Synthetic oligonucleotide; TGG chr11 5216314 5216333 5216317 -
tcatgtcctttgtagggaca

SEQ ID NO: 50058 - DNA, 20 bp, Artificial Sequence
  Synthetic oligonucleotide; AAG chr11 5216308 5216327 5216311 -
cctttgtagggacatggatg

SEQ ID NO: 50059 - DNA, 20 bp, Artificial Sequence
  Synthetic oligonucleotide; TGG chr11 5216304 5216323 5216307 -
tgtagggacatggatgaagc

SEQ ID NO: 50060 - DNA, 20 bp, Artificial Sequence
  Synthetic oligonucleotide; CAG chr11 5216288 5216307 5216291 -
aagctggaaactatcattct

SEQ ID NO: 50061 - DNA, 20 bp, Artificial Sequence
  Synthetic oligonucleotide; AAG chr11 5216274 5216293 5216277 -
cattctcagcaaactatcac

SEQ ID NO: 50062 - DNA, 20 bp, Artificial Sequence
  Synthetic oligonucleotide; AGG chr11 5216273 5216292 5216276 -
attctcagcaaactatcaca

SEQ ID NO: 50063 - DNA, 20 bp, Artificial Sequence
  Synthetic oligonucleotide; GAG chr11 5216271 5216290 5216274 -
tctcagcaaactatcacaag

SEQ ID NO: 50064 - DNA, 20 bp, Artificial Sequence
  Synthetic oligonucleotide; TAG chr11 5216238 5216257 5216241 -
acaccgcatgttctcactca

SEQ ID NO: 50065 - DNA, 20 bp, Artificial Sequence
  Synthetic oligonucleotide; AGG chr11 5216237 5216256 5216240 -
caccgcatgttctcactcat

SEQ ID NO: 50066 - DNA, 20 bp, Artificial Sequence
  Synthetic oligonucleotide; TGG chr11 5216234 5216253 5216237 -
cgcatgttctcactcatagg

SEQ ID NO: 50067 - DNA, 20 bp, Artificial Sequence
  Synthetic oligonucleotide; GGG chr11 5216233 5216252 5216236 -
gcatgttctcactcataggt

SEQ ID NO: 50068 - DNA, 20 bp, Artificial Sequence
  Synthetic oligonucleotide; GAG chr11 5216219 5216238 5216222 -
ataggtgggaattgaacaat

SEQ ID NO: 50069 - DNA, 20 bp, Artificial Sequence
  Synthetic oligonucleotide; TGG chr11 5216210 5216229 5216213 -
aattgaacaatgagaacaca

SEQ ID NO: 50070 - DNA, 20 bp, Artificial Sequence
  Synthetic oligonucleotide; AAG chr11 5216200 5216219 5216203 -
tgagaacacatggacacatg

SEQ ID NO: 50071 - DNA, 20 bp, Artificial Sequence
  Synthetic oligonucleotide; GAG chr11 5216198 5216217 5216201 -
agaacacatggacacatgaa

SEQ ID NO: 50072 - DNA, 20 bp, Artificial Sequence
  Synthetic oligonucleotide; AGG chr11 5216197 5216216 5216200 -
gaacacatggacacatgaag

SEQ ID NO: 50073 - DNA, 20 bp, Artificial Sequence
  Synthetic oligonucleotide; TGG chr11 5216182 5216201 5216185 -
tgaagaggaacatcacactc

SEQ ID NO: 50074 - DNA, 20 bp, Artificial Sequence
  Synthetic oligonucleotide; GGG chr11 5216181 5216200 5216184 -
gaagaggaacatcacactct

SEQ ID NO: 50075 - DNA, 20 bp, Artificial Sequence
  Synthetic oligonucleotide; GGG chr11 5216180 5216199 5216183 -
aagaggaacatcacactctg

SEQ ID NO: 50076 - DNA, 20 bp, Artificial Sequence
  Synthetic oligonucleotide; TGG chr11 5216170 5216189 5216173 -
tcacactctggggactgtta

SEQ ID NO: 50077 - DNA, 20 bp, Artificial Sequence
  Synthetic oligonucleotide; GGG chr11 5216169 5216188 5216172 -
cacactctggggactgttat

SEQ ID NO: 50078 - DNA, 20 bp, Artificial Sequence
  Synthetic oligonucleotide; GGG chr11 5216168 5216187 5216171 -
acactctggggactgttatg

SEQ ID NO: 50079 - DNA, 20 bp, Artificial Sequence
  Synthetic oligonucleotide; TGG chr11 5216165 5216184 5216168 -
ctctggggactgttatgggg

SEQ ID NO: 50080 - DNA, 20 bp, Artificial Sequence
  Synthetic oligonucleotide; GGG chr11 5216164 5216183 5216167 -
tctggggactgttatggggt

SEQ ID NO: 50081 - DNA, 20 bp, Artificial Sequence
  Synthetic oligonucleotide; GGG chr11 5216163 5216182 5216166 -
ctggggactgttatggggtg

SEQ ID NO: 50082 - DNA, 20 bp, Artificial Sequence
  Synthetic oligonucleotide; GGG chr11 5216162 5216181 5216165 -
tggggactgttatggggtgg

SEQ ID NO: 50083 - DNA, 20 bp, Artificial Sequence
  Synthetic oligonucleotide; GGG chr11 5216161 5216180 5216164 -
ggggactgttatggggtggg

SEQ ID NO: 50084 - DNA, 20 bp, Artificial Sequence
  Synthetic oligonucleotide; CAG chr11 5216158 5216177 5216161 -
gactgttatggggtgggggg

SEQ ID NO: 50085 - DNA, 20 bp, Artificial Sequence
  Synthetic oligonucleotide; AGG chr11 5216157 5216176 5216160 -
actgttatggggtggggggc

SEQ ID NO: 50086 - DNA, 20 bp, Artificial Sequence
  Synthetic oligonucleotide; GGG chr11 5216156 5216175 5216159 -
ctgttatggggtggggggca

SEQ ID NO: 50087 - DNA, 20 bp, Artificial Sequence
  Synthetic oligonucleotide; GGG chr11 5216155 5216174 5216158 -
tgttatggggtggggggcag

SEQ ID NO: 50088 - DNA, 20 bp, Artificial Sequence
  Synthetic oligonucleotide; CAG chr11 5216152 5216171 5216155 -
tatggggtggggggcagggg

SEQ ID NO: 50089 - DNA, 20 bp, Artificial Sequence
  Synthetic oligonucleotide; AGG chr11 5216151 5216170 5216154 -
atggggtggggggcaggggc

SEQ ID NO: 50090 - DNA, 20 bp, Artificial Sequence
  Synthetic oligonucleotide; GGG chr11 5216150 5216169 5216153 -
tggggtggggggcaggggca

SEQ ID NO: 50091 - DNA, 20 bp, Artificial Sequence
  Synthetic oligonucleotide; TAG chr11 5216146 5216165 5216149 -
gtggggggcaggggcaggga

SEQ ID NO: 50092 - DNA, 20 bp, Artificial Sequence
  Synthetic oligonucleotide; TAG chr11 5216140 5216159 5216143 -
ggcaggggcagggatagcac

SEQ ID NO: 50093 - DNA, 20 bp, Artificial Sequence
  Synthetic oligonucleotide; AGG chr11 5216139 5216158 5216142 -
gcaggggcagggatagcact

SEQ ID NO: 50094 - DNA, 20 bp, Artificial Sequence
  Synthetic oligonucleotide; GAG chr11 5216137 5216156 5216140 -
aggggcagggatagcactag

SEQ ID NO: 50095 - DNA, 20 bp, Artificial Sequence
  Synthetic oligonucleotide; GAG chr11 5216113 5216132 5216116 -
tatacctaatgctaaatgac

SEQ ID NO: 50096 - DNA, 20 bp, Artificial Sequence
  Synthetic oligonucleotide; TGG chr11 5216106 5216125 5216109 -
aatgctaaatgacgagttaa

SEQ ID NO: 50097 - DNA, 20 bp, Artificial Sequence
  Synthetic oligonucleotide; GGG chr11 5216105 5216124 5216108 -
atgctaaatgacgagttaat

SEQ ID NO: 50098 - DNA, 20 bp, Artificial Sequence
  Synthetic oligonucleotide; CAG chr11 5216100 5216119 5216103 -
aaatgacgagttaatgggtg

SEQ ID NO: 50099 - DNA, 20 bp, Artificial Sequence
  Synthetic oligonucleotide; TGG chr11 5216087 5216106 5216090 -
atgggtgcagcacaccaaca

SEQ ID NO: 50100 - DNA, 20 bp, Artificial Sequence
  Synthetic oligonucleotide; AAG chr11 5216028 5216047 5216031 -
cacatgtaccctaaaacttg

SEQ ID NO: 50101 - DNA, 20 bp, Artificial Sequence
  Synthetic oligonucleotide; AAG chr11 5216010 5216029 5216013 -
tgaagtataataataaaaaa

SEQ ID NO: 50102 - DNA, 20 bp, Artificial Sequence
  Synthetic oligonucleotide; TAG chr11 5215976 5215995 5215979 -
aaactgatctcacacatccg

SEQ ID NO: 50103 - DNA, 20 bp, Artificial Sequence
  Synthetic oligonucleotide; GAG chr11 5215974 5215993 5215977 -
actgatctcacacatccgta

SEQ ID NO: 50104 - DNA, 20 bp, Artificial Sequence
  Synthetic oligonucleotide; AAG chr11 5215963 5215982 5215966 -
acatccgtagagccattatc

SEQ ID NO: 50105 - DNA, 20 bp, Artificial Sequence
  Synthetic oligonucleotide; TAG chr11 5215945 5215964 5215948 -
tcaagtctttctctttgaaa

SEQ ID NO: 50106 - DNA, 20 bp, Artificial Sequence
  Synthetic oligonucleotide; CAG chr11 5215941 5215960 5215944 -
gtctttctctttgaaataga

SEQ ID NO: 50107 - DNA, 20 bp, Artificial Sequence
  Synthetic oligonucleotide; TAG chr11 5215933 5215952 5215936 -
ctttgaaatagacagaaatt

SEQ ID NO: 50108 - DNA, 20 bp, Artificial Sequence
  Synthetic oligonucleotide; CAG chr11 5215922 5215941 5215925 -
acagaaatttagtgttttct

SEQ ID NO: 50109 - DNA, 20 bp, Artificial Sequence
  Synthetic oligonucleotide; CAG chr11 5215918 5215937 5215921 -
aaatttagtgttttctcagt

SEQ ID NO: 50110 - DNA, 20 bp, Artificial Sequence
  Synthetic oligonucleotide; TAG chr11 5215899 5215918 5215902 -
tcagttaacattccttcaac

SEQ ID NO: 50111 - DNA, 20 bp, Artificial Sequence
  Synthetic oligonucleotide; TAG chr11 5215894 5215913 5215897 -
taacattccttcaactagat

SEQ ID NO: 50112 - DNA, 20 bp, Artificial Sequence
  Synthetic oligonucleotide; CAG chr11 5215877 5215896 5215880 -
gattagttgtgacaaaattt

SEQ ID NO: 50113 - DNA, 20 bp, Artificial Sequence
  Synthetic oligonucleotide; AGG chr11 5215876 5215895 5215879 -
attagttgtgacaaaatttc

SEQ ID NO: 50114 - DNA, 20 bp, Artificial Sequence
  Synthetic oligonucleotide; CAG chr11 5215854 5215873 5215857 -
gccttgctcaactctaacct

SEQ ID NO: 50115 - DNA, 20 bp, Artificial Sequence
  Synthetic oligonucleotide; GAG chr11 5215834 5215853 5215837 -
cagtctctccatatatttct

SEQ ID NO: 50116 - DNA, 20 bp, Artificial Sequence
  Synthetic oligonucleotide; GAG chr11 5215832 5215851 5215835 -
gtctctccatatatttctga

SEQ ID NO: 50117 - DNA, 20 bp, Artificial Sequence
  Synthetic oligonucleotide; AAG chr11 5215808 5215827 5215811 -
cttccttcttatttgtttat

SEQ ID NO: 50118 - DNA, 20 bp, Artificial Sequence
  Synthetic oligonucleotide; TAG chr11 5215801 5215820 5215804 -
cttatttgtttataagaatt

SEQ ID NO: 50119 - DNA, 20 bp, Artificial Sequence
  Synthetic oligonucleotide; TGG chr11 5215794 5215813 5215797 -
gtttataagaatttagtaaa

SEQ ID NO: 50120 - DNA, 20 bp, Artificial Sequence
  Synthetic oligonucleotide; GAG chr11 5215784 5215803 5215787 -
atttagtaaatggcaatatt

SEQ ID NO: 50121 - DNA, 20 bp, Artificial Sequence
  Synthetic oligonucleotide; AAG chr11 5215781 5215800 5215784 -
tagtaaatggcaatattgag

SEQ ID NO: 50122 - DNA, 20 bp, Artificial Sequence
  Synthetic oligonucleotide; TAG chr11 5215778 5215797 5215781 -
taaatggcaatattgagaag

SEQ ID NO: 50123 - DNA, 20 bp, Artificial Sequence
  Synthetic oligonucleotide; TGG chr11 5215768 5215787 5215771 -
tattgagaagtagaaaattt

SEQ ID NO: 50124 - DNA, 20 bp, Artificial Sequence
  Synthetic oligonucleotide; GAG chr11 5215766 5215785 5215769 -
ttgagaagtagaaaattttg

SEQ ID NO: 50125 - DNA, 20 bp, Artificial Sequence
  Synthetic oligonucleotide; CAG chr11 5215746 5215765 5215749 -
gagacttgtttttcatgaac

SEQ ID NO: 50126 - DNA, 20 bp, Artificial Sequence
  Synthetic oligonucleotide; AAG chr11 5215733 5215752 5215736 -
catgaaccagaacaatctca

SEQ ID NO: 50127 - DNA, 20 bp, Artificial Sequence
  Synthetic oligonucleotide; CAG chr11 5215730 5215749 5215733 -
gaaccagaacaatctcaaag

SEQ ID NO: 50128 - DNA, 20 bp, Artificial Sequence
  Synthetic oligonucleotide; CAG chr11 5215717 5215736 5215720 -
ctcaaagcagcaatactaaa

SEQ ID NO: 50129 - DNA, 20 bp, Artificial Sequence
  Synthetic oligonucleotide; AGG chr11 5215716 5215735 5215719 -
tcaaagcagcaatactaaac

SEQ ID NO: 50130 - DNA, 20 bp, Artificial Sequence
  Synthetic oligonucleotide; GAG chr11 5215714 5215733 5215717 -
aaagcagcaatactaaacag

SEQ ID NO: 50131 - DNA, 20 bp, Artificial Sequence
  Synthetic oligonucleotide; AAG chr11 5215709 5215728 5215712 -
agcaatactaaacaggagcc

SEQ ID NO: 50132 - DNA, 20 bp, Artificial Sequence
  Synthetic oligonucleotide; TAG chr11 5215704 5215723 5215707 -
tactaaacaggagccaagcc

SEQ ID NO: 50133 - DNA, 20 bp, Artificial Sequence
  Synthetic oligonucleotide; AAG chr11 5215697 5215716 5215700 -
caggagccaagcctagaata

SEQ ID NO: 50134 - DNA, 20 bp, Artificial Sequence
  Synthetic oligonucleotide; TGG chr11 5215685 5215704 5215688 -
ctagaataaagttgaatttc

SEQ ID NO: 50135 - DNA, 20 bp, Artificial Sequence
  Synthetic oligonucleotide; AAG chr11 5215675 5215694 5215678 -
gttgaatttctggaatcaac

SEQ ID NO: 50136 - DNA, 20 bp, Artificial Sequence
  Synthetic oligonucleotide; TAG chr11 5215671 5215690 5215674 -
aatttctggaatcaacaagc

SEQ ID NO: 50137 - DNA, 20 bp, Artificial Sequence
  Synthetic oligonucleotide; AGG chr11 5215670 5215689 5215673 -
atttctggaatcaacaagct

SEQ ID NO: 50138 - DNA, 20 bp, Artificial Sequence
  Synthetic oligonucleotide; GGG chr11 5215669 5215688 5215672 -
tttctggaatcaacaagcta

SEQ ID NO: 50139 - DNA, 20 bp, Artificial Sequence
  Synthetic oligonucleotide; GGG chr11 5215668 5215687 5215671 -
ttctggaatcaacaagctag

SEQ ID NO: 50140 - DNA, 20 bp, Artificial Sequence
  Synthetic oligonucleotide; AAG chr11 5215664 5215683 5215667 -
ggaatcaacaagctagggga

SEQ ID NO: 50141 - DNA, 20 bp, Artificial Sequence
  Synthetic oligonucleotide; AAG chr11 5215652 5215671 5215655 -
ctaggggaaagtctcccatt

SEQ ID NO: 50142 - DNA, 20 bp, Artificial Sequence
  Synthetic oligonucleotide; TGG chr11 5215633 5215652 5215636 -
taagtcaaatatttgacaac

SEQ ID NO: 50143 - DNA, 20 bp, Artificial Sequence
  Synthetic oligonucleotide; GGG chr11 5215632 5215651 5215635 -
aagtcaaatatttgacaact

SEQ ID NO: 50144 - DNA, 20 bp, Artificial Sequence
  Synthetic oligonucleotide; GAG chr11 5215630 5215649 5215633 -
gtcaaatatttgacaactgg

SEQ ID NO: 50145 - DNA, 20 bp, Artificial Sequence
  Synthetic oligonucleotide; AGG chr11 5215629 5215648 5215632 -
tcaaatatttgacaactggg

SEQ ID NO: 50146 - DNA, 20 bp, Artificial Sequence
  Synthetic oligonucleotide; AAG chr11 5215624 5215643 5215627 -
tatttgacaactgggaggtc

SEQ ID NO: 50147 - DNA, 20 bp, Artificial Sequence
  Synthetic oligonucleotide; CAG chr11 5215620 5215639 5215623 -
tgacaactgggaggtcaagt

SEQ ID NO: 50148 - DNA, 20 bp, Artificial Sequence
  Synthetic oligonucleotide; GAG chr11 5215618 5215637 5215621 -
acaactgggaggtcaagtca

SEQ ID NO: 50149 - DNA, 20 bp, Artificial Sequence
  Synthetic oligonucleotide; AGG chr11 5215617 5215636 5215620 -
caactgggaggtcaagtcag

SEQ ID NO: 50150 - DNA, 20 bp, Artificial Sequence
  Synthetic oligonucleotide; AAG chr11 5215601 5215620 5215604 -
tcagaggtgaaaaatgatta

SEQ ID NO: 50151 - DNA, 20 bp, Artificial Sequence
  Synthetic oligonucleotide; AAG chr11 5215593 5215612 5215596 -
gaaaaatgattaaagataac

SEQ ID NO: 50152 - DNA, 20 bp, Artificial Sequence
  Synthetic oligonucleotide; GAG chr11 5215591 5215610 5215594 -
aaaatgattaaagataacaa

SEQ ID NO: 50153 - DNA, 20 bp, Artificial Sequence
  Synthetic oligonucleotide; AGG chr11 5215590 5215609 5215593 -
aaatgattaaagataacaag

SEQ ID NO: 50154 - DNA, 20 bp, Artificial Sequence
  Synthetic oligonucleotide; AAG chr11 5215577 5215596 5215580 -
taacaagaggtctgaaaaca

SEQ ID NO: 50155 - DNA, 20 bp, Artificial Sequence
  Synthetic oligonucleotide; AAG chr11 5215557 5215576 5215560 -
aagtgaccaattaaaataaa

SEQ ID NO: 50156 - DNA, 20 bp, Artificial Sequence
  Synthetic oligonucleotide; AAG chr11 5215553 5215572 5215556 -
gaccaattaaaataaaaaga

SEQ ID NO: 50157 - DNA, 20 bp, Artificial Sequence
  Synthetic oligonucleotide; GAG chr11 5215551 5215570 5215554 -
ccaattaaaataaaaagaaa

SEQ ID NO: 50158 - DNA, 20 bp, Artificial Sequence
  Synthetic oligonucleotide; AAG chr11 5215546 5215565 5215549 -
taaaataaaaagaaagagcc

SEQ ID NO: 50159 - DNA, 20 bp, Artificial Sequence
  Synthetic oligonucleotide; TGG chr11 5215542 5215561 5215545 -
ataaaaagaaagagccaagc

SEQ ID NO: 50160 - DNA, 20 bp, Artificial Sequence
  Synthetic oligonucleotide; GGG chr11 5215541 5215560 5215544 -
taaaaagaaagagccaagct

SEQ ID NO: 50161 - DNA, 20 bp, Artificial Sequence
  Synthetic oligonucleotide; CAG chr11 5215536 5215555 5215539 -
agaaagagccaagctgggca

SEQ ID NO: 50162 - DNA, 20 bp, Artificial Sequence
  Synthetic oligonucleotide; TGG chr11 5215533 5215552 5215536 -
aagagccaagctgggcacag

SEQ ID NO: 50163 - DNA, 20 bp, Artificial Sequence
  Synthetic oligonucleotide; TAG chr11 5215520 5215539 5215523 -
ggcacagtggcttgcatctg

SEQ ID NO: 50164 - DNA, 20 bp, Artificial Sequence
  Synthetic oligonucleotide; CAG chr11 5215514 5215533 5215517 -
gtggcttgcatctgtagtcc

SEQ ID NO: 50165 - DNA, 20 bp, Artificial Sequence
  Synthetic oligonucleotide; CAG chr11 5215506 5215525 5215509 -
catctgtagtcccagtaacc

SEQ ID NO: 50166 - DNA, 20 bp, Artificial Sequence
  Synthetic oligonucleotide; AGG chr11 5215505 5215524 5215508 -
atctgtagtcccagtaaccc

SEQ ID NO: 50167 - DNA, 20 bp, Artificial Sequence
  Synthetic oligonucleotide; GAG chr11 5215503 5215522 5215506 -
ctgtagtcccagtaacccag

SEQ ID NO: 50168 - DNA, 20 bp, Artificial Sequence
  Synthetic oligonucleotide; AGG chr11 5215502 5215521 5215505 -
tgtagtcccagtaacccagg

SEQ ID NO: 50169 - DNA, 20 bp, Artificial Sequence
  Synthetic oligonucleotide; AAG chr11 5215496 5215515 5215499 -
cccagtaacccaggaggctg

SEQ ID NO: 50170 - DNA, 20 bp, Artificial Sequence
  Synthetic oligonucleotide; TAG chr11 5215490 5215509 5215493 -
aacccaggaggctgaagtga

SEQ ID NO: 50171 - DNA, 20 bp, Artificial Sequence
  Synthetic oligonucleotide; AGG chr11 5215489 5215508 5215492 -
acccaggaggctgaagtgat

SEQ ID NO: 50172 - DNA, 20 bp, Artificial Sequence
  Synthetic oligonucleotide; GAG chr11 5215479 5215498 5215482 -
ctgaagtgataggatcactt

SEQ ID NO: 50173 - DNA, 20 bp, Artificial Sequence
  Synthetic oligonucleotide; CAG chr11 5215474 5215493 5215477 -
gtgataggatcacttgagcc

SEQ ID NO: 50174 - DNA, 20 bp, Artificial Sequence
  Synthetic oligonucleotide; AGG chr11 5215473 5215492 5215476 -
tgataggatcacttgagccc

SEQ ID NO: 50175 - DNA, 20 bp, Artificial Sequence
  Synthetic oligonucleotide; CAG chr11 5215466 5215485 5215469 -
atcacttgagcccaggattt

SEQ ID NO: 50176 - DNA, 20 bp, Artificial Sequence
  Synthetic oligonucleotide; AGG chr11 5215465 5215484 5215468 -
tcacttgagcccaggatttc

SEQ ID NO: 50177 - DNA, 20 bp, Artificial Sequence
  Synthetic oligonucleotide; GGG chr11 5215464 5215483 5215467 -
cacttgagcccaggatttca

SEQ ID NO: 50178 - DNA, 20 bp, Artificial Sequence
  Synthetic oligonucleotide; CAG chr11 5215458 5215477 5215461 -
agcccaggatttcagggttg

SEQ ID NO: 50179 - DNA, 20 bp, Artificial Sequence
  Synthetic oligonucleotide; GAG chr11 5215454 5215473 5215457 -
caggatttcagggttgcagt

SEQ ID NO: 50180 - DNA, 20 bp, Artificial Sequence
  Synthetic oligonucleotide; TAG chr11 5215429 5215448 5215432 -
ataatgacaccactgctctc

SEQ ID NO: 50181 - DNA, 20 bp, Artificial Sequence
  Synthetic oligonucleotide; TGG chr11 5215423 5215442 5215426 -
acaccactgctctctagcct

SEQ ID NO: 50182 - DNA, 20 bp, Artificial Sequence
  Synthetic oligonucleotide; GAG chr11 5215415 5215434 5215418 -
gctctctagccttggtgact

SEQ ID NO: 50183 - DNA, 20 bp, Artificial Sequence
  Synthetic oligonucleotide; GAG chr11 5215401 5215420 5215404 -
gtgactgagatcctgtctct

SEQ ID NO: 50184 - DNA, 20 bp, Artificial Sequence
  Synthetic oligonucleotide; AGG chr11 5215400 5215419 5215403 -
tgactgagatcctgtctctg

SEQ ID NO: 50185 - DNA, 20 bp, Artificial Sequence
  Synthetic oligonucleotide; AAG chr11 5215383 5215402 5215386 -
ctgaggaaaaacaaacaaac

SEQ ID NO: 50186 - DNA, 20 bp, Artificial Sequence
  Synthetic oligonucleotide; CAG chr11 5215357 5215376 5215360 -
aaaacaaacaaacaaacaca

SEQ ID NO: 50187 - DNA, 20 bp, Artificial Sequence
  Synthetic oligonucleotide; AAG chr11 5215349 5215368 5215352 -
caaacaaacacacagatatt

SEQ ID NO: 50188 - DNA, 20 bp, Artificial Sequence
  Synthetic oligonucleotide; TAG chr11 5215342 5215361 5215345 -
acacacagatattaagaaca

SEQ ID NO: 50189 - DNA, 20 bp, Artificial Sequence
  Synthetic oligonucleotide; AAG chr11 5215339 5215358 5215342 -
cacagatattaagaacatag

SEQ ID NO: 50190 - DNA, 20 bp, Artificial Sequence
  Synthetic oligonucleotide; CGG chr11 5215328 5215347 5215331 -
agaacatagaagttttgtta

SEQ ID NO: 50191 - DNA, 20 bp, Artificial Sequence
  Synthetic oligonucleotide; CAG chr11 5215307 5215326 5215310 -
ggtgatgatattctccaaca

SEQ ID NO: 50192 - DNA, 20 bp, Artificial Sequence
  Synthetic oligonucleotide; AGG chr11 5215306 5215325 5215309 -
gtgatgatattctccaacac

SEQ ID NO: 50193 - DNA, 20 bp, Artificial Sequence
  Synthetic oligonucleotide; CAG chr11 5215290 5215309 5215293 -
acacaggtctgaaccccttg

SEQ ID NO: 50194 - DNA, 20 bp, Artificial Sequence
  Synthetic oligonucleotide; CGG chr11 5215282 5215301 5215285 -
ctgaaccccttgcagtgcct

SEQ ID NO: 50195 - DNA, 20 bp, Artificial Sequence
  Synthetic oligonucleotide; GGG chr11 5215281 5215300 5215284 -
tgaaccccttgcagtgcctc

SEQ ID NO: 50196 - DNA, 20 bp, Artificial Sequence
  Synthetic oligonucleotide; GGG chr11 5215280 5215299 5215283 -
gaaccccttgcagtgcctcg

SEQ ID NO: 50197 - DNA, 20 bp, Artificial Sequence
  Synthetic oligonucleotide; CAG chr11 5215268 5215287 5215271 -
gtgcctcggggctgtttctc

SEQ ID NO: 50198 - DNA, 20 bp, Artificial Sequence
  Synthetic oligonucleotide; TGG chr11 5215265 5215284 5215268 -
cctcggggctgtttctccag

SEQ ID NO: 50199 - DNA, 20 bp, Artificial Sequence
  Synthetic oligonucleotide; TGG chr11 5215257 5215276 5215260 -
ctgtttctccagtggattct

SEQ ID NO: 50200 - DNA, 20 bp, Artificial Sequence
  Synthetic oligonucleotide; GGG chr11 5215256 5215275 5215259 -
tgtttctccagtggattctt

SEQ ID NO: 50201 - DNA, 20 bp, Artificial Sequence
  Synthetic oligonucleotide; AAG chr11 5215226 5215245 5215229 -
catcttctcaactttgtgaa

SEQ ID NO: 50202 - DNA, 20 bp, Artificial Sequence
  Synthetic oligonucleotide; AAG chr11 5215212 5215231 5215215 -
tgtgaaaagatattcatcca

SEQ ID NO: 50203 - DNA, 20 bp, Artificial Sequence
  Synthetic oligonucleotide; AGG chr11 5215211 5215230 5215214 -
gtgaaaagatattcatccaa

SEQ ID NO: 50204 - DNA, 20 bp, Artificial Sequence
  Synthetic oligonucleotide; CAG chr11 5215192 5215211 5215195 -
aaggtctcacctgtcttatt

SEQ ID NO: 50205 - DNA, 20 bp, Artificial Sequence
  Synthetic oligonucleotide; GAG chr11 5215190 5215209 5215193 -
ggtctcacctgtcttattca

SEQ ID NO: 50206 - DNA, 20 bp, Artificial Sequence
  Synthetic oligonucleotide; TGG chr11 5215185 5215204 5215188 -
cacctgtcttattcagagct

SEQ ID NO: 50207 - DNA, 20 bp, Artificial Sequence
  Synthetic oligonucleotide; TGG chr11 5215178 5215197 5215181 -
cttattcagagcttggattt

SEQ ID NO: 50208 - DNA, 20 bp, Artificial Sequence
  Synthetic oligonucleotide; TAG chr11 5215173 5215192 5215176 -
tcagagcttggattttggac

SEQ ID NO: 50209 - DNA, 20 bp, Artificial Sequence
  Synthetic oligonucleotide; TGG chr11 5215156 5215175 5215159 -
gactagctttttctatttct

SEQ ID NO: 50210 - DNA, 20 bp, Artificial Sequence
  Synthetic oligonucleotide; GGG chr11 5215155 5215174 5215158 -
actagctttttctatttctt

SEQ ID NO: 50211 - DNA, 20 bp, Artificial Sequence
  Synthetic oligonucleotide; TAG chr11 5215146 5215165 5215149 -
ttctatttcttgggattctc

SEQ ID NO: 50212 - DNA, 20 bp, Artificial Sequence
  Synthetic oligonucleotide; GAG chr11 5215144 5215163 5215147 -
ctatttcttgggattctcta

SEQ ID NO: 50213 - DNA, 20 bp, Artificial Sequence
  Synthetic oligonucleotide; CAG chr11 5215132 5215151 5215135 -
attctctagagccatatatt

SEQ ID NO: 50214 - DNA, 20 bp, Artificial Sequence
  Synthetic oligonucleotide; CAG chr11 5215121 5215140 5215124 -
ccatatattcagatataaca

SEQ ID NO: 50215 - DNA, 20 bp, Artificial Sequence
  Synthetic oligonucleotide; AAG chr11 5215108 5215127 5215111 -
tataacacagatataaccaa

SEQ ID NO: 50216 - DNA, 20 bp, Artificial Sequence
  Synthetic oligonucleotide; AAG chr11 5215105 5215124 5215108 -
aacacagatataaccaaaag

SEQ ID NO: 50217 - DNA, 20 bp, Artificial Sequence
  Synthetic oligonucleotide; AAG chr11 5215100 5215119 5215103 -
agatataaccaaaagaagca

SEQ ID NO: 50218 - DNA, 20 bp, Artificial Sequence
  Synthetic oligonucleotide; AGG chr11 5215099 5215118 5215102 -
gatataaccaaaagaagcaa

SEQ ID NO: 50219 - DNA, 20 bp, Artificial Sequence
  Synthetic oligonucleotide; GAG chr11 5215097 5215116 5215100 -
tataaccaaaagaagcaaag

SEQ ID NO: 50220 - DNA, 20 bp, Artificial Sequence
  Synthetic oligonucleotide; AGG chr11 5215096 5215115 5215099 -
ataaccaaaagaagcaaagg

SEQ ID NO: 50221 - DNA, 20 bp, Artificial Sequence
  Synthetic oligonucleotide; CAG chr11 5215088 5215107 5215091 -
aagaagcaaaggaggcatca

SEQ ID NO: 50222 - DNA, 20 bp, Artificial Sequence
  Synthetic oligonucleotide; AAG chr11 5215085 5215104 5215088 -
aagcaaaggaggcatcacag

SEQ ID NO: 50223 - DNA, 20 bp, Artificial Sequence
  Synthetic oligonucleotide; AGG chr11 5215084 5215103 5215087 -
agcaaaggaggcatcacaga

SEQ ID NO: 50224 - DNA, 20 bp, Artificial Sequence
  Synthetic oligonucleotide; GGG chr11 5215083 5215102 5215086 -
gcaaaggaggcatcacagaa

SEQ ID NO: 50225 - DNA, 20 bp, Artificial Sequence
  Synthetic oligonucleotide; GGG chr11 5215082 5215101 5215085 -
caaaggaggcatcacagaag

SEQ ID NO: 50226 - DNA, 20 bp, Artificial Sequence
  Synthetic oligonucleotide; TGG chr11 5215069 5215088 5215072 -
acagaaggggctttgtattc

SEQ ID NO: 50227 - DNA, 20 bp, Artificial Sequence
  Synthetic oligonucleotide; GGG chr11 5215068 5215087 5215071 -
cagaaggggctttgtattct

SEQ ID NO: 50228 - DNA, 20 bp, Artificial Sequence
  Synthetic oligonucleotide; GGG chr11 5215067 5215086 5215070 -
agaaggggctttgtattctg

SEQ ID NO: 50229 - DNA, 20 bp, Artificial Sequence
  Synthetic oligonucleotide; GAG chr11 5215065 5215084 5215068 -
aaggggctttgtattctggg

SEQ ID NO: 50230 - DNA, 20 bp, Artificial Sequence
  Synthetic oligonucleotide; AGG chr11 5215064 5215083 5215067 -
aggggctttgtattctgggg

SEQ ID NO: 50231 - DNA, 20 bp, Artificial Sequence
  Synthetic oligonucleotide; GGG chr11 5215063 5215082 5215066 -
ggggctttgtattctgggga

SEQ ID NO: 50232 - DNA, 20 bp, Artificial Sequence
  Synthetic oligonucleotide; GGG chr11 5215062 5215081 5215065 -
gggctttgtattctggggag

SEQ ID NO: 50233 - DNA, 20 bp, Artificial Sequence
  Synthetic oligonucleotide; GGG chr11 5215061 5215080 5215064 -
ggctttgtattctggggagg

SEQ ID NO: 50234 - DNA, 20 bp, Artificial Sequence
  Synthetic oligonucleotide; TAG chr11 5215055 5215074 5215058 -
gtattctggggagggggaca

SEQ ID NO: 50235 - DNA, 20 bp, Artificial Sequence
  Synthetic oligonucleotide; GAG chr11 5215053 5215072 5215056 -
attctggggagggggacata

SEQ ID NO: 50236 - DNA, 20 bp, Artificial Sequence
  Synthetic oligonucleotide; GAG chr11 5215048 5215067 5215051 -
ggggagggggacatagagtt

SEQ ID NO: 50237 - DNA, 20 bp, Artificial Sequence
  Synthetic oligonucleotide; GAG chr11 5215046 5215065 5215049 -
ggagggggacatagagttga

SEQ ID NO: 50238 - DNA, 20 bp, Artificial Sequence
  Synthetic oligonucleotide; CAG chr11 5215038 5215057 5215041 -
acatagagttgagagaaata

SEQ ID NO: 50239 - DNA, 20 bp, Artificial Sequence
  Synthetic oligonucleotide; AGG chr11 5215037 5215056 5215040 -
catagagttgagagaaatac

SEQ ID NO: 50240 - DNA, 20 bp, Artificial Sequence
  Synthetic oligonucleotide; TAG chr11 5215028 5215047 5215031 -
gagagaaatacaggaattta

SEQ ID NO: 50241 - DNA, 20 bp, Artificial Sequence
  Synthetic oligonucleotide; AGG chr11 5215027 5215046 5215030 -
agagaaatacaggaatttat

SEQ ID NO: 50242 - DNA, 20 bp, Artificial Sequence
  Synthetic oligonucleotide; AAG chr11 5215014 5215033 5215017 -
aatttataggactctactca

SEQ ID NO: 50243 - DNA, 20 bp, Artificial Sequence
  Synthetic oligonucleotide; GAG chr11 5215012 5215031 5215015 -
tttataggactctactcaaa

SEQ ID NO: 50244 - DNA, 20 bp, Artificial Sequence
  Synthetic oligonucleotide; AAG chr11 5214999 5215018 5215002 -
actcaaagagccctcaaata

SEQ ID NO: 50245 - DNA, 20 bp, Artificial Sequence
  Synthetic oligonucleotide; CGG chr11 5214994 5215013 5214997 -
aagagccctcaaataaagta

SEQ ID NO: 50246 - DNA, 20 bp, Artificial Sequence
  Synthetic oligonucleotide; TAG chr11 5214990 5215009 5214993 -
gccctcaaataaagtacggc

SEQ ID NO: 50247 - DNA, 20 bp, Artificial Sequence
  Synthetic oligonucleotide; AAG chr11 5214975 5214994 5214978 -
acggctagtcttctttgcct

SEQ ID NO: 50248 - DNA, 20 bp, Artificial Sequence
  Synthetic oligonucleotide; GAG chr11 5214967 5214986 5214970 -
tcttctttgcctaagacaat

SEQ ID NO: 50249 - DNA, 20 bp, Artificial Sequence
  Synthetic oligonucleotide; CAG chr11 5214964 5214983 5214967 -
tctttgcctaagacaatgag

SEQ ID NO: 50250 - DNA, 20 bp, Artificial Sequence
  Synthetic oligonucleotide; CAG chr11 5214959 5214978 5214962 -
gcctaagacaatgagcagtc

SEQ ID NO: 50251 - DNA, 20 bp, Artificial Sequence
  Synthetic oligonucleotide; AGG chr11 5214958 5214977 5214961 -
cctaagacaatgagcagtcc

SEQ ID NO: 50252 - DNA, 20 bp, Artificial Sequence
  Synthetic oligonucleotide; AAG chr11 5214955 5214974 5214958 -
aagacaatgagcagtccagg

SEQ ID NO: 50253 - DNA, 20 bp, Artificial Sequence
  Synthetic oligonucleotide; TAG chr11 5214938 5214957 5214941 -
aggaagttatccatttcttt

SEQ ID NO: 50254 - DNA, 20 bp, Artificial Sequence
  Synthetic oligonucleotide; TAG chr11 5214929 5214948 5214932 -
tccatttcttttagattttc

SEQ ID NO: 50255 - DNA, 20 bp, Artificial Sequence
  Synthetic oligonucleotide; TAG chr11 5214916 5214935 5214919 -
gattttctagtttatgtaca

SEQ ID NO: 50256 - DNA, 20 bp, Artificial Sequence
  Synthetic oligonucleotide; GAG chr11 5214914 5214933 5214917 -
ttttctagtttatgtacata

SEQ ID NO: 50257 - DNA, 20 bp, Artificial Sequence
  Synthetic oligonucleotide; TAG chr11 5214904 5214923 5214907 -
tatgtacatagagatgttca

SEQ ID NO: 50258 - DNA, 20 bp, Artificial Sequence
  Synthetic oligonucleotide; TAG chr11 5214901 5214920 5214904 -
gtacatagagatgttcatag

SEQ ID NO: 50259 - DNA, 20 bp, Artificial Sequence
  Synthetic oligonucleotide; TGG chr11 5214873 5214892 5214876 -
gatgattatttgtatttctg

SEQ ID NO: 50260 - DNA, 20 bp, Artificial Sequence
  Synthetic oligonucleotide; GGG chr11 5214872 5214891 5214875 -
atgattatttgtatttctgt

SEQ ID NO: 50261 - DNA, 20 bp, Artificial Sequence
  Synthetic oligonucleotide; GGG chr11 5214871 5214890 5214874 -
tgattatttgtatttctgtg

SEQ ID NO: 50262 - DNA, 20 bp, Artificial Sequence
  Synthetic oligonucleotide; GAG chr11 5214867 5214886 5214870 -
tatttgtatttctgtggggt

SEQ ID NO: 50263 - DNA, 20 bp, Artificial Sequence
  Synthetic oligonucleotide; TGG chr11 5214826 5214845 5214829 -
catttctaactgtgcttatt

SEQ ID NO: 50264 - DNA, 20 bp, Artificial Sequence
  Synthetic oligonucleotide; TAG chr11 5214800 5214819 5214803 -
ttctctcttgtcttctttat

SEQ ID NO: 50265 - DNA, 20 bp, Artificial Sequence
  Synthetic oligonucleotide; TAG chr11 5214795 5214814 5214798 -
tcttgtcttctttattagtc

SEQ ID NO: 50266 - DNA, 20 bp, Artificial Sequence
  Synthetic oligonucleotide; TAG chr11 5214791 5214810 5214794 -
gtcttctttattagtctagc

SEQ ID NO: 50267 - DNA, 20 bp, Artificial Sequence
  Synthetic oligonucleotide; CAG chr11 5214758 5214777 5214761 -
tattaattttttcacaaaac

SEQ ID NO: 50268 - DNA, 20 bp, Artificial Sequence
  Synthetic oligonucleotide; TGG chr11 5214751 5214770 5214754 -
tttttcacaaaaccagctct

SEQ ID NO: 50269 - DNA, 20 bp, Artificial Sequence
  Synthetic oligonucleotide; TGG chr11 5214730 5214749 5214733 -
ggactcattaatcttttgaa

SEQ ID NO: 50270 - DNA, 20 bp, Artificial Sequence
  Synthetic oligonucleotide; CAG chr11 5214705 5214724 5214708 -
ttttgtgttttaatatcctt

SEQ ID NO: 50271 - DNA, 20 bp, Artificial Sequence
  Synthetic oligonucleotide; TAG chr11 5214701 5214720 5214704 -
gtgttttaatatccttcagt

SEQ ID NO: 50272 - DNA, 20 bp, Artificial Sequence
  Synthetic oligonucleotide; TAG chr11 5214668 5214687 5214671 -
gtttatttcttgtcttctgc

SEQ ID NO: 50273 - DNA, 20 bp, Artificial Sequence
  Synthetic oligonucleotide; TAG chr11 5214662 5214681 5214665 -
ttcttgtcttctgctagatt

SEQ ID NO: 50274 - DNA, 20 bp, Artificial Sequence
  Synthetic oligonucleotide; AGG chr11 5214661 5214680 5214664 -
tcttgtcttctgctagattt

SEQ ID NO: 50275 - DNA, 20 bp, Artificial Sequence
  Synthetic oligonucleotide; GGG chr11 5214660 5214679 5214663 -
cttgtcttctgctagattta

SEQ ID NO: 50276 - DNA, 20 bp, Artificial Sequence
  Synthetic oligonucleotide; TGG chr11 5214656 5214675 5214659 -
tcttctgctagatttagggt

SEQ ID NO: 50277 - DNA, 20 bp, Artificial Sequence
  Synthetic oligonucleotide; TGG chr11 5214645 5214664 5214648 -
atttagggttggtttgctct

SEQ ID NO: 50278 - DNA, 20 bp, Artificial Sequence
  Synthetic oligonucleotide; TGG chr11 5214637 5214656 5214640 -
ttggtttgctcttggttctc

SEQ ID NO: 50279 - DNA, 20 bp, Artificial Sequence
  Synthetic oligonucleotide; TAG chr11 5214628 5214647 5214631 -
tcttggttctctggttcttt

SEQ ID NO: 50280 - DNA, 20 bp, Artificial Sequence
  Synthetic oligonucleotide; TAG chr11 5214616 5214635 5214619 -
ggttcttttagttgtgacat

SEQ ID NO: 50281 - DNA, 20 bp, Artificial Sequence
  Synthetic oligonucleotide; AGG chr11 5214615 5214634 5214618 -
gttcttttagttgtgacatt

SEQ ID NO: 50282 - DNA, 20 bp, Artificial Sequence
  Synthetic oligonucleotide; GAG chr11 5214602 5214621 5214605 -
tgacattaggttgttaattt

SEQ ID NO: 50283 - DNA, 20 bp, Artificial Sequence
  Synthetic oligonucleotide; AGG chr11 5214601 5214620 5214604 -
gacattaggttgttaatttg

SEQ ID NO: 50284 - DNA, 20 bp, Artificial Sequence
  Synthetic oligonucleotide; GGG chr11 5214600 5214619 5214603 -
acattaggttgttaatttga

SEQ ID NO: 50285 - DNA, 20 bp, Artificial Sequence
  Synthetic oligonucleotide; AAG chr11 5214593 5214612 5214596 -
gttgttaatttgagggcttt

SEQ ID NO: 50286 - DNA, 20 bp, Artificial Sequence
  Synthetic oligonucleotide; TGG chr11 5214579 5214598 5214582 -
ggctttaagactttttgatg

SEQ ID NO: 50287 - DNA, 20 bp, Artificial Sequence
  Synthetic oligonucleotide; GGG chr11 5214578 5214597 5214581 -
gctttaagactttttgatgt

SEQ ID NO: 50288 - DNA, 20 bp, Artificial Sequence
  Synthetic oligonucleotide; TAG chr11 5214571 5214590 5214574 -
gactttttgatgtgggcatt

SEQ ID NO: 50289 - DNA, 20 bp, Artificial Sequence
  Synthetic oligonucleotide; AAG chr11 5214540 5214559 5214543 -
tttctctcttaacactgtct

SEQ ID NO: 50290 - DNA, 20 bp, Artificial Sequence
  Synthetic oligonucleotide; CAG chr11 5214529 5214548 5214532 -
acactgtctaagctgtgtcc

SEQ ID NO: 50291 - DNA, 20 bp, Artificial Sequence
  Synthetic oligonucleotide; GAG chr11 5214527 5214546 5214530 -
actgtctaagctgtgtccca

SEQ ID NO: 50292 - DNA, 20 bp, Artificial Sequence
  Synthetic oligonucleotide; CGG chr11 5214520 5214539 5214523 -
aagctgtgtcccagagattc

SEQ ID NO: 50293 - DNA, 20 bp, Artificial Sequence
  Synthetic oligonucleotide; TAG chr11 5214495 5214514 5214498 -
tattgtatctttgttctcat

SEQ ID NO: 50294 - DNA, 20 bp, Artificial Sequence
  Synthetic oligonucleotide; AAG chr11 5214487 5214506 5214490 -
ctttgttctcattagtttca

SEQ ID NO: 50295 - DNA, 20 bp, Artificial Sequence
  Synthetic oligonucleotide; TAG chr11 5214465 5214484 5214468 -
gaactattttatttttgcct

SEQ ID NO: 50296 - DNA, 20 bp, Artificial Sequence
  Synthetic oligonucleotide; CAG chr11 5214436 5214455 5214439 -
ttatttacccaaaattcatt

SEQ ID NO: 50297 - DNA, 20 bp, Artificial Sequence
  Synthetic oligonucleotide; AGG chr11 5214435 5214454 5214438 -
tatttacccaaaattcattc

SEQ ID NO: 50298 - DNA, 20 bp, Artificial Sequence
  Synthetic oligonucleotide; GAG chr11 5214433 5214452 5214436 -
tttacccaaaattcattcag

SEQ ID NO: 50299 - DNA, 20 bp, Artificial Sequence
  Synthetic oligonucleotide; CAG chr11 5214430 5214449 5214433 -
acccaaaattcattcaggag

SEQ ID NO: 50300 - DNA, 20 bp, Artificial Sequence
  Synthetic oligonucleotide; AGG chr11 5214429 5214448 5214432 -
cccaaaattcattcaggagc

SEQ ID NO: 50301 - DNA, 20 bp, Artificial Sequence
  Synthetic oligonucleotide; TAG chr11 5214402 5214421 5214405 -
ttaatttccatgtaattgca

SEQ ID NO: 50302 - DNA, 20 bp, Artificial Sequence
  Synthetic oligonucleotide; CAG chr11 5214395 5214414 5214398 -
ccatgtaattgcatagtttt

SEQ ID NO: 50303 - DNA, 20 bp, Artificial Sequence
  Synthetic oligonucleotide; TAG chr11 5214384 5214403 5214387 -
catagttttcagctattcat

SEQ ID NO: 50304 - DNA, 20 bp, Artificial Sequence
  Synthetic oligonucleotide; TGG chr11 5214355 5214374 5214358 -
aatctatttttattcctctg

SEQ ID NO: 50305 - DNA, 20 bp, Artificial Sequence
  Synthetic oligonucleotide; GAG chr11 5214349 5214368 5214352 -
tttttattcctctgtggtct

SEQ ID NO: 50306 - DNA, 20 bp, Artificial Sequence
  Synthetic oligonucleotide; GAG chr11 5214347 5214366 5214350 -
tttattcctctgtggtctga

SEQ ID NO: 50307 - DNA, 20 bp, Artificial Sequence
  Synthetic oligonucleotide; GAG chr11 5214313 5214332 5214316 -
attttttttttgcatttgct

SEQ ID NO: 50308 - DNA, 20 bp, Artificial Sequence
  Synthetic oligonucleotide; AGG chr11 5214312 5214331 5214315 -
ttttttttttgcatttgctg

SEQ ID NO: 50309 - DNA, 20 bp, Artificial Sequence
  Synthetic oligonucleotide; TAG chr11 5214302 5214321 5214305 -
gcatttgctgaggattgttt

SEQ ID NO: 50310 - DNA, 20 bp, Artificial Sequence
  Synthetic oligonucleotide; AGG chr11 5214301 5214320 5214304 -
catttgctgaggattgtttt

SEQ ID NO: 50311 - DNA, 20 bp, Artificial Sequence
  Synthetic oligonucleotide; AAG chr11 5214291 5214310 5214294 -
ggattgttttaggtcctccc

SEQ ID NO: 50312 - DNA, 20 bp, Artificial Sequence
  Synthetic oligonucleotide; AGG chr11 5214290 5214309 5214293 -
gattgttttaggtcctccca

SEQ ID NO: 50313 - DNA, 20 bp, Artificial Sequence
  Synthetic oligonucleotide; CAG chr11 5214281 5214300 5214284 -
aggtcctcccaaggctgaac

SEQ ID NO: 50314 - DNA, 20 bp, Artificial Sequence
  Synthetic oligonucleotide; AGG chr11 5214280 5214299 5214283 -
ggtcctcccaaggctgaacc

SEQ ID NO: 50315 - DNA, 20 bp, Artificial Sequence
  Synthetic oligonucleotide; AAG chr11 5214277 5214296 5214280 -
cctcccaaggctgaaccagg

SEQ ID NO: 50316 - DNA, 20 bp, Artificial Sequence
  Synthetic oligonucleotide; AAG chr11 5214260 5214279 5214263 -
aggaagaaatcaatttcctg

SEQ ID NO: 50317 - DNA, 20 bp, Artificial Sequence
  Synthetic oligonucleotide; GAG chr11 5214258 5214277 5214261 -
gaagaaatcaatttcctgaa

SEQ ID NO: 50318 - DNA, 20 bp, Artificial Sequence
  Synthetic oligonucleotide; GAG chr11 5214246 5214265 5214249 -
ttcctgaagagatccatgat

SEQ ID NO: 50319 - DNA, 20 bp, Artificial Sequence
  Synthetic oligonucleotide; CAG chr11 5214229 5214248 5214232 -
gatgagctctgaaaatgatt

SEQ ID NO: 50320 - DNA, 20 bp, Artificial Sequence
  Synthetic oligonucleotide; TAG chr11 5214219 5214238 5214222 -
gaaaatgattcagtaataaa

SEQ ID NO: 50321 - DNA, 20 bp, Artificial Sequence
  Synthetic oligonucleotide; AAG chr11 5214201 5214220 5214204 -
aatagcctatcaaacaaaaa

SEQ ID NO: 50322 - DNA, 20 bp, Artificial Sequence
  Synthetic oligonucleotide; TGG chr11 5214195 5214214 5214198 -
ctatcaaacaaaaaaagccc

SEQ ID NO: 50323 - DNA, 20 bp, Artificial Sequence
  Synthetic oligonucleotide; CAG chr11 5214165 5214184 5214168 -
gattcacaaccaaattctat

SEQ ID NO: 50324 - DNA, 20 bp, Artificial Sequence
  Synthetic oligonucleotide; AAG chr11 5214155 5214174 5214158 -
caaattctatcagatgcaca

SEQ ID NO: 50325 - DNA, 20 bp, Artificial Sequence
  Synthetic oligonucleotide; AAG chr11 5214152 5214171 5214155 -
attctatcagatgcacaaag

SEQ ID NO: 50326 - DNA, 20 bp, Artificial Sequence
  Synthetic oligonucleotide; GAG chr11 5214150 5214169 5214153 -
tctatcagatgcacaaagaa

SEQ ID NO: 50327 - DNA, 20 bp, Artificial Sequence
  Synthetic oligonucleotide; TGG chr11 5214146 5214165 5214149 -
tcagatgcacaaagaagagt

SEQ ID NO: 50328 - DNA, 20 bp, Artificial Sequence
  Synthetic oligonucleotide; AAG chr11 5214129 5214148 5214132 -
agttggaaaaattcctactg

SEQ ID NO: 50329 - DNA, 20 bp, Artificial Sequence
  Synthetic oligonucleotide; GAG chr11 5214111 5214130 5214114 -
tgaagctactccaaaaaatt

SEQ ID NO: 50330 - DNA, 20 bp, Artificial Sequence
  Synthetic oligonucleotide; AGG chr11 5214110 5214129 5214113 -
gaagctactccaaaaaattg

SEQ ID NO: 50331 - DNA, 20 bp, Artificial Sequence
  Synthetic oligonucleotide; GGG chr11 5214109 5214128 5214112 -
aagctactccaaaaaattga

SEQ ID NO: 50332 - DNA, 20 bp, Artificial Sequence
  Synthetic oligonucleotide; GGG chr11 5214108 5214127 5214111 -
agctactccaaaaaattgag

SEQ ID NO: 50333 - DNA, 20 bp, Artificial Sequence
  Synthetic oligonucleotide; GGG chr11 5214107 5214126 5214110 -
gctactccaaaaaattgagg

SEQ ID NO: 50334 - DNA, 20 bp, Artificial Sequence
  Synthetic oligonucleotide; GAG chr11 5214105 5214124 5214108 -
tactccaaaaaattgagggg

SEQ ID NO: 50335 - DNA, 20 bp, Artificial Sequence
  Synthetic oligonucleotide; AGG chr11 5214104 5214123 5214107 -
actccaaaaaattgaggggg

SEQ ID NO: 50336 - DNA, 20 bp, Artificial Sequence
  Synthetic oligonucleotide; GGG chr11 5214103 5214122 5214106 -
ctccaaaaaattgaggggga

SEQ ID NO: 50337 - DNA, 20 bp, Artificial Sequence
  Synthetic oligonucleotide; CAG chr11 5214091 5214110 5214094 -
gagggggagggattcaacct

SEQ ID NO: 50338 - DNA, 20 bp, Artificial Sequence
  Synthetic oligonucleotide; GAG chr11 5214078 5214097 5214081 -
tcaacctcagctcattttat

SEQ ID NO: 50339 - DNA, 20 bp, Artificial Sequence
  Synthetic oligonucleotide; AGG chr11 5214077 5214096 5214080 -
caacctcagctcattttatg

SEQ ID NO: 50340 - DNA, 20 bp, Artificial Sequence
  Synthetic oligonucleotide; CAG chr11 5214073 5214092 5214076 -
ctcagctcattttatgaggc

SEQ ID NO: 50341 - DNA, 20 bp, Artificial Sequence
  Synthetic oligonucleotide; TAG chr11 5214046 5214065 5214049 -
atcctgataccaaaacctga

SEQ ID NO: 50342 - DNA, 20 bp, Artificial Sequence
  Synthetic oligonucleotide; AAG chr11 5214026 5214045 5214029 -
tagacacacaacaacaaaaa

SEQ ID NO: 50343 - DNA, 20 bp, Artificial Sequence
  Synthetic oligonucleotide; CAG chr11 5214016 5214035 5214019 -
acaacaaaaaaagaaaactt

SEQ ID NO: 50344 - DNA, 20 bp, Artificial Sequence
  Synthetic oligonucleotide; AGG chr11 5214015 5214034 5214018 -
caacaaaaaaagaaaacttc

SEQ ID NO: 50345 - DNA, 20 bp, Artificial Sequence
  Synthetic oligonucleotide; TAG chr11 5213981 5214000 5213984 -
gaacattgatgcaaaaatac

SEQ ID NO: 50346 - DNA, 20 bp, Artificial Sequence
  Synthetic oligonucleotide; AAG chr11 5213977 5213996 5213980 -
attgatgcaaaaatactagc

SEQ ID NO: 50347 - DNA, 20 bp, Artificial Sequence
  Synthetic oligonucleotide; CAG chr11 5213967 5213986 5213970 -
aaatactagcaagccaaatc

SEQ ID NO: 50348 - DNA, 20 bp, Artificial Sequence
  Synthetic oligonucleotide; AAG chr11 5213952 5213971 5213955 -
aaatccagcaacacatcaca

SEQ ID NO: 50349 - DNA, 20 bp, Artificial Sequence
  Synthetic oligonucleotide; AAG chr11 5213933 5213952 5213936 -
aaagctaatccacctcaatc

SEQ ID NO: 50350 - DNA, 20 bp, Artificial Sequence
  Synthetic oligonucleotide; TAG chr11 5213930 5213949 5213933 -
gctaatccacctcaatcaag

SEQ ID NO: 50351 - DNA, 20 bp, Artificial Sequence
  Synthetic oligonucleotide; AGG chr11 5213929 5213948 5213932 -
ctaatccacctcaatcaagt

SEQ ID NO: 50352 - DNA, 20 bp, Artificial Sequence
  Synthetic oligonucleotide; GAG chr11 5213916 5213935 5213919 -
atcaagtaggctttatccct

SEQ ID NO: 50353 - DNA, 20 bp, Artificial Sequence
  Synthetic oligonucleotide; AAG chr11 5213913 5213932 5213916 -
aagtaggctttatccctgag

SEQ ID NO: 50354 - DNA, 20 bp, Artificial Sequence
  Synthetic oligonucleotide; AAG chr11 5213909 5213928 5213912 -
aggctttatccctgagaagc

SEQ ID NO: 50355 - DNA, 20 bp, Artificial Sequence
  Synthetic oligonucleotide; TGG chr11 5213904 5213923 5213907 -
ttatccctgagaagcaagat

SEQ ID NO: 50356 - DNA, 20 bp, Artificial Sequence
  Synthetic oligonucleotide; CAG chr11 5213899 5213918 5213902 -
cctgagaagcaagattggtt

SEQ ID NO: 50357 - DNA, 20 bp, Artificial Sequence
  Synthetic oligonucleotide; CAG chr11 5213860 5213879 5213863 -
aatgtgattcatcatatata

SEQ ID NO: 50358 - DNA, 20 bp, Artificial Sequence
  Synthetic oligonucleotide; CAG chr11 5213848 5213867 5213851 -
catatatacagcactaaaaa

SEQ ID NO: 50359 - DNA, 20 bp, Artificial Sequence
  Synthetic oligonucleotide; AAG chr11 5213813 5213832 5213816 -
catttcaatatgtgcaaaaa

SEQ ID NO: 50360 - DNA, 20 bp, Artificial Sequence
  Synthetic oligonucleotide; TAG chr11 5213762 5213781 5213765 -
gttaaaacctctcaacaaac

SEQ ID NO: 50361 - DNA, 20 bp, Artificial Sequence
  Synthetic oligonucleotide; AAG chr11 5213753 5213772 5213756 -
tctcaacaaactagctattt

SEQ ID NO: 50362 - DNA, 20 bp, Artificial Sequence
  Synthetic oligonucleotide; AGG chr11 5213752 5213771 5213755 -
ctcaacaaactagctattta

SEQ ID NO: 50363 - DNA, 20 bp, Artificial Sequence
  Synthetic oligonucleotide; GAG chr11 5213729 5213748 5213732 -
acatgacctcaaaataatat

SEQ ID NO: 50364 - DNA, 20 bp, Artificial Sequence
  Synthetic oligonucleotide; CAG chr11 5213708 5213727 5213711 -
agccatctatgacaaaccca

SEQ ID NO: 50365 - DNA, 20 bp, Artificial Sequence
  Synthetic oligonucleotide; CAG chr11 5213694 5213713 5213697 -
aacccacagccaacatcata

SEQ ID NO: 50366 - DNA, 20 bp, Artificial Sequence
  Synthetic oligonucleotide; TGG chr11 5213689 5213708 5213692 -
acagccaacatcatacagaa

SEQ ID NO: 50367 - DNA, 20 bp, Artificial Sequence
  Synthetic oligonucleotide; GGG chr11 5213688 5213707 5213691 -
cagccaacatcatacagaat

SEQ ID NO: 50368 - DNA, 20 bp, Artificial Sequence
  Synthetic oligonucleotide; TGG chr11 5213678 5213697 5213681 -
catacagaatgggcaaaacc

SEQ ID NO: 50369 - DNA, 20 bp, Artificial Sequence
  Synthetic oligonucleotide; AAG chr11 5213675 5213694 5213678 -
acagaatgggcaaaacctgg

SEQ ID NO: 50370 - DNA, 20 bp, Artificial Sequence
  Synthetic oligonucleotide; TGG chr11 5213656 5213675 5213659 -
gaagcattcttcttgaaaac

SEQ ID NO: 50371 - DNA, 20 bp, Artificial Sequence
  Synthetic oligonucleotide; AAG chr11 5213650 5213669 5213653 -
ttcttcttgaaaactggcac

SEQ ID NO: 50372 - DNA, 20 bp, Artificial Sequence
  Synthetic oligonucleotide; AAG chr11 5213645 5213664 5213648 -
cttgaaaactggcacaagac

SEQ ID NO: 50373 - DNA, 20 bp, Artificial Sequence
  Synthetic oligonucleotide; AGG chr11 5213644 5213663 5213647 -
ttgaaaactggcacaagaca

SEQ ID NO: 50374 - DNA, 20 bp, Artificial Sequence
  Synthetic oligonucleotide; CAG chr11 5213617 5213636 5213620 -
cctctctcaccactgctatt

SEQ ID NO: 50375 - DNA, 20 bp, Artificial Sequence
  Synthetic oligonucleotide; TAG chr11 5213612 5213631 5213615 -
ctcaccactgctattcagta

SEQ ID NO: 50376 - DNA, 20 bp, Artificial Sequence
  Synthetic oligonucleotide; TGG chr11 5213606 5213625 5213609 -
actgctattcagtatagtac

SEQ ID NO: 50377 - DNA, 20 bp, Artificial Sequence
  Synthetic oligonucleotide; CAG chr11 5213603 5213622 5213606 -
gctattcagtatagtactgg

SEQ ID NO: 50378 - DNA, 20 bp, Artificial Sequence
  Synthetic oligonucleotide; TGG chr11 5213597 5213616 5213600 -
cagtatagtactggcagtcc

SEQ ID NO: 50379 - DNA, 20 bp, Artificial Sequence
  Synthetic oligonucleotide; CAG chr11 5213593 5213612 5213596 -
atagtactggcagtcctggc

SEQ ID NO: 50380 - DNA, 20 bp, Artificial Sequence
  Synthetic oligonucleotide; GAG chr11 5213591 5213610 5213594 -
agtactggcagtcctggcca

SEQ ID NO: 50381 - DNA, 20 bp, Artificial Sequence
  Synthetic oligonucleotide; CAG chr11 5213584 5213603 5213587 -
gcagtcctggccagagcaat

SEQ ID NO: 50382 - DNA, 20 bp, Artificial Sequence
  Synthetic oligonucleotide; AGG chr11 5213583 5213602 5213586 -
cagtcctggccagagcaatc

SEQ ID NO: 50383 - DNA, 20 bp, Artificial Sequence
  Synthetic oligonucleotide; AAG chr11 5213579 5213598 5213582 -
cctggccagagcaatcaggc

SEQ ID NO: 50384 - DNA, 20 bp, Artificial Sequence
  Synthetic oligonucleotide; GAG chr11 5213577 5213596 5213580 -
tggccagagcaatcaggcaa

SEQ ID NO: 50385 - DNA, 20 bp, Artificial Sequence
  Synthetic oligonucleotide; AAG chr11 5213574 5213593 5213577 -
ccagagcaatcaggcaagag

SEQ ID NO: 50386 - DNA, 20 bp, Artificial Sequence
  Synthetic oligonucleotide; AGG chr11 5213573 5213592 5213576 -
cagagcaatcaggcaagaga

SEQ ID NO: 50387 - DNA, 20 bp, Artificial Sequence
  Synthetic oligonucleotide; GGG chr11 5213572 5213591 5213575 -
agagcaatcaggcaagagaa

SEQ ID NO: 50388 - DNA, 20 bp, Artificial Sequence
  Synthetic oligonucleotide; AAG chr11 5213565 5213584 5213568 -
tcaggcaagagaagggaata

SEQ ID NO: 50389 - DNA, 20 bp, Artificial Sequence
  Synthetic oligonucleotide; AGG chr11 5213564 5213583 5213567 -
caggcaagagaagggaataa

SEQ ID NO: 50390 - DNA, 20 bp, Artificial Sequence
  Synthetic oligonucleotide; GGG chr11 5213563 5213582 5213566 -
aggcaagagaagggaataaa

SEQ ID NO: 50391 - DNA, 20 bp, Artificial Sequence
  Synthetic oligonucleotide; TAG chr11 5213552 5213571 5213555 -
gggaataaagggcatccaaa

SEQ ID NO: 50392 - DNA, 20 bp, Artificial Sequence
  Synthetic oligonucleotide; AGG chr11 5213551 5213570 5213554 -
ggaataaagggcatccaaat

SEQ ID NO: 50393 - DNA, 20 bp, Artificial Sequence
  Synthetic oligonucleotide; AAG chr11 5213548 5213567 5213551 -
ataaagggcatccaaatagg

SEQ ID NO: 50394 - DNA, 20 bp, Artificial Sequence
  Synthetic oligonucleotide; GAG chr11 5213546 5213565 5213549 -
aaagggcatccaaataggaa

SEQ ID NO: 50395 - DNA, 20 bp, Artificial Sequence
  Synthetic oligonucleotide; GAG chr11 5213544 5213563 5213547 -
agggcatccaaataggaaga

SEQ ID NO: 50396 - DNA, 20 bp, Artificial Sequence
  Synthetic oligonucleotide; AAG chr11 5213540 5213559 5213543 -
catccaaataggaagagaga

SEQ ID NO: 50397 - DNA, 20 bp, Artificial Sequence
  Synthetic oligonucleotide; AAG chr11 5213534 5213553 5213537 -
aataggaagagagaaagtca

SEQ ID NO: 50398 - DNA, 20 bp, Artificial Sequence
  Synthetic oligonucleotide; TAG chr11 5213512 5213531 5213515 -
gtatccctgttttctgtatc

SEQ ID NO: 50399 - DNA, 20 bp, Artificial Sequence
  Synthetic oligonucleotide; TAG chr11 5213500 5213519 5213503 -
tctgtatctagaaaacacca

SEQ ID NO: 50400 - DNA, 20 bp, Artificial Sequence
  Synthetic oligonucleotide; AAG chr11 5213495 5213514 5213498 -
atctagaaaacaccatagtc

SEQ ID NO: 50401 - DNA, 20 bp, Artificial Sequence
  Synthetic oligonucleotide; AGG chr11 5213494 5213513 5213497 -
tctagaaaacaccatagtca

SEQ ID NO: 50402 - DNA, 20 bp, Artificial Sequence
  Synthetic oligonucleotide; AAG chr11 5213486 5213505 5213489 -
acaccatagtcaaggcccaa

SEQ ID NO: 50403 - DNA, 20 bp, Artificial Sequence
  Synthetic oligonucleotide; CAG chr11 5213477 5213496 5213480 -
tcaaggcccaaaagctcctt

SEQ ID NO: 50404 - DNA, 20 bp, Artificial Sequence
  Synthetic oligonucleotide; CAG chr11 5213464 5213483 5213467 -
gctccttcagctgataactt

SEQ ID NO: 50405 - DNA, 20 bp, Artificial Sequence
  Synthetic oligonucleotide; AAG chr11 5213459 5213478 5213462 -
ttcagctgataacttcagca

SEQ ID NO: 50406 - DNA, 20 bp, Artificial Sequence
  Synthetic oligonucleotide; CAG chr11 5213453 5213472 5213456 -
tgataacttcagcaaagttt

SEQ ID NO: 50407 - DNA, 20 bp, Artificial Sequence
  Synthetic oligonucleotide; AGG chr11 5213452 5213471 5213455 -
gataacttcagcaaagtttc

SEQ ID NO: 50408 - DNA, 20 bp, Artificial Sequence
  Synthetic oligonucleotide; TAG chr11 5213423 5213442 5213426 -
aatcaatgtacaaaaatcac

SEQ ID NO: 50409 - DNA, 20 bp, Artificial Sequence
  Synthetic oligonucleotide; TAG chr11 5213401 5213420 5213404 -
gcattcccatacatcaacaa

SEQ ID NO: 50410 - DNA, 20 bp, Artificial Sequence
  Synthetic oligonucleotide; AAG chr11 5213396 5213415 5213399 -
cccatacatcaacaatagcc

SEQ ID NO: 50411 - DNA, 20 bp, Artificial Sequence
  Synthetic oligonucleotide; TAG chr11 5213391 5213410 5213394 -
acatcaacaatagccaagcc

SEQ ID NO: 50412 - DNA, 20 bp, Artificial Sequence
  Synthetic oligonucleotide; GAG chr11 5213389 5213408 5213392 -
atcaacaatagccaagccta

SEQ ID NO: 50413 - DNA, 20 bp, Artificial Sequence
  Synthetic oligonucleotide; CAG chr11 5213380 5213399 5213383 -
agccaagcctagagccaaat

SEQ ID NO: 50414 - DNA, 20 bp, Artificial Sequence
  Synthetic oligonucleotide; AGG chr11 5213379 5213398 5213382 -
gccaagcctagagccaaatc

SEQ ID NO: 50415 - DNA, 20 bp, Artificial Sequence
  Synthetic oligonucleotide; AAG chr11 5213376 5213395 5213379 -
aagcctagagccaaatcagg

SEQ ID NO: 50416 - DNA, 20 bp, Artificial Sequence
  Synthetic oligonucleotide; AAG chr11 5213347 5213366 5213350 -
ccatttaccgttgccacaaa

SEQ ID NO: 50417 - DNA, 20 bp, Artificial Sequence
  Synthetic oligonucleotide; AAG chr11 5213332 5213351 5213335 -
acaaaaagaataaaatacct

SEQ ID NO: 50418 - DNA, 20 bp, Artificial Sequence
  Synthetic oligonucleotide; AGG chr11 5213331 5213350 5213334 -
caaaaagaataaaataccta

SEQ ID NO: 50419 - DNA, 20 bp, Artificial Sequence
  Synthetic oligonucleotide; AAG chr11 5213316 5213335 5213319 -
acctaaggatatatctaacc

SEQ ID NO: 50420 - DNA, 20 bp, Artificial Sequence
  Synthetic oligonucleotide; CAG chr11 5213313 5213332 5213316 -
taaggatatatctaaccaag

SEQ ID NO: 50421 - DNA, 20 bp, Artificial Sequence
  Synthetic oligonucleotide; AAG chr11 5213306 5213325 5213309 -
atatctaaccaagcagttga

SEQ ID NO: 50422 - DNA, 20 bp, Artificial Sequence
  Synthetic oligonucleotide; GAG chr11 5213292 5213311 5213295 -
agttgaaagatctctacaat

SEQ ID NO: 50423 - DNA, 20 bp, Artificial Sequence
  Synthetic oligonucleotide; AAG chr11 5213270 5213289 5213273 -
gatttacaaaacactgctca

SEQ ID NO: 50424 - DNA, 20 bp, Artificial Sequence
  Synthetic oligonucleotide; CAG chr11 5213263 5213282 5213266 -
aaaacactgctcaaagaaat

SEQ ID NO: 50425 - DNA, 20 bp, Artificial Sequence
  Synthetic oligonucleotide; GAG chr11 5213261 5213280 5213264 -
aacactgctcaaagaaatca

SEQ ID NO: 50426 - DNA, 20 bp, Artificial Sequence
  Synthetic oligonucleotide; TAG chr11 5213254 5213273 5213257 -
ctcaaagaaatcagagctga

SEQ ID NO: 50427 - DNA, 20 bp, Artificial Sequence
  Synthetic oligonucleotide; TGG chr11 5213244 5213263 5213247 -
tcagagctgatagaaacaaa

SEQ ID NO: 50428 - DNA, 20 bp, Artificial Sequence
  Synthetic oligonucleotide; TGG chr11 5213223 5213242 5213226 -
ggaaaaactttccatgctca

SEQ ID NO: 50429 - DNA, 20 bp, Artificial Sequence
  Synthetic oligonucleotide; AAG chr11 5213215 5213234 5213218 -
tttccatgctcatggataaa

SEQ ID NO: 50430 - DNA, 20 bp, Artificial Sequence
  Synthetic oligonucleotide; TAG chr11 5213182 5213201 5213185 -
gttaaaatgtccatactgcc

SEQ ID NO: 50431 - DNA, 20 bp, Artificial Sequence
  Synthetic oligonucleotide; GAG chr11 5213180 5213199 5213183 -
taaaatgtccatactgccta

SEQ ID NO: 50432 - DNA, 20 bp, Artificial Sequence
  Synthetic oligonucleotide; CAG chr11 5213170 5213189 5213173 -
atactgcctagagcaattta

SEQ ID NO: 50433 - DNA, 20 bp, Artificial Sequence
  Synthetic oligonucleotide; AAG chr11 5213162 5213181 5213165 -
tagagcaatttacagtttca

SEQ ID NO: 50434 - DNA, 20 bp, Artificial Sequence
  Synthetic oligonucleotide; CAG chr11 5213126 5213145 5213129 -
actaccaatgacattcttca

SEQ ID NO: 50435 - DNA, 20 bp, Artificial Sequence
  Synthetic oligonucleotide; TAG chr11 5213120 5213139 5213123 -
aatgacattcttcacagaac

SEQ ID NO: 50436 - DNA, 20 bp, Artificial Sequence
  Synthetic oligonucleotide; AAG chr11 5213103 5213122 5213106 -
aactagaaaaatacacttta

SEQ ID NO: 50437 - DNA, 20 bp, Artificial Sequence
  Synthetic oligonucleotide; TGG chr11 5213094 5213113 5213097 -
aatacactttaaagttcata

SEQ ID NO: 50438 - DNA, 20 bp, Artificial Sequence
  Synthetic oligonucleotide; AAG chr11 5213077 5213096 5213080 -
atatggaacaacaacaaaaa

SEQ ID NO: 50439 - DNA, 20 bp, Artificial Sequence
  Synthetic oligonucleotide; TAG chr11 5213068 5213087 5213071 -
aacaacaaaaaaagtccaaa

SEQ ID NO: 50440 - DNA, 20 bp, Artificial Sequence
  Synthetic oligonucleotide; TAG chr11 5213063 5213082 5213066 -
caaaaaaagtccaaatagcc

SEQ ID NO: 50441 - DNA, 20 bp, Artificial Sequence
  Synthetic oligonucleotide; AGG chr11 5213062 5213081 5213065 -
aaaaaaagtccaaatagcct

SEQ ID NO: 50442 - DNA, 20 bp, Artificial Sequence
  Synthetic oligonucleotide; CAG chr11 5213044 5213063 5213047 -
ctaggaaatcctaatactca

SEQ ID NO: 50443 - DNA, 20 bp, Artificial Sequence
  Synthetic oligonucleotide; AGG chr11 5213043 5213062 5213046 -
taggaaatcctaatactcac

SEQ ID NO: 50444 - DNA, 20 bp, Artificial Sequence
  Synthetic oligonucleotide; TGG chr11 5213040 5213059 5213043 -
gaaatcctaatactcacagg

SEQ ID NO: 50445 - DNA, 20 bp, Artificial Sequence
  Synthetic oligonucleotide; GGG chr11 5213039 5213058 5213042 -
aaatcctaatactcacaggt

SEQ ID NO: 50446 - DNA, 20 bp, Artificial Sequence
  Synthetic oligonucleotide; GAG chr11 5213025 5213044 5213028 -
acaggtgggaattgaaaaat

SEQ ID NO: 50447 - DNA, 20 bp, Artificial Sequence
  Synthetic oligonucleotide; TGG chr11 5213016 5213035 5213019 -
aattgaaaaatgagaacact

SEQ ID NO: 50448 - DNA, 20 bp, Artificial Sequence
  Synthetic oligonucleotide; CAG chr11 5213010 5213029 5213013 -
aaaatgagaacacttggaca

SEQ ID NO: 50449 - DNA, 20 bp, Artificial Sequence
  Synthetic oligonucleotide; AGG chr11 5213009 5213028 5213012 -
aaatgagaacacttggacac

SEQ ID NO: 50450 - DNA, 20 bp, Artificial Sequence
  Synthetic oligonucleotide; GGG chr11 5213008 5213027 5213011 -
aatgagaacacttggacaca

SEQ ID NO: 50451 - DNA, 20 bp, Artificial Sequence
  Synthetic oligonucleotide; TGG chr11 5213005 5213024 5213008 -
gagaacacttggacacaggg

SEQ ID NO: 50452 - DNA, 20 bp, Artificial Sequence
  Synthetic oligonucleotide; GGG chr11 5213004 5213023 5213007 -
agaacacttggacacagggt

SEQ ID NO: 50453 - DNA, 20 bp, Artificial Sequence
  Synthetic oligonucleotide; GGG chr11 5213003 5213022 5213006 -
gaacacttggacacagggtg

SEQ ID NO: 50454 - DNA, 20 bp, Artificial Sequence
  Synthetic oligonucleotide; CGG chr11 5212988 5213007 5212991 -
gggtggggaacatcacacac

SEQ ID NO: 50455 - DNA, 20 bp, Artificial Sequence
  Synthetic oligonucleotide; GGG chr11 5212987 5213006 5212990 -
ggtggggaacatcacacacc

SEQ ID NO: 50456 - DNA, 20 bp, Artificial Sequence
  Synthetic oligonucleotide; GGG chr11 5212986 5213005 5212989 -
gtggggaacatcacacaccg

SEQ ID NO: 50457 - DNA, 20 bp, Artificial Sequence
  Synthetic oligonucleotide; TGG chr11 5212976 5212995 5212979 -
tcacacaccggggcctgtcg

SEQ ID NO: 50458 - DNA, 20 bp, Artificial Sequence
  Synthetic oligonucleotide; GGG chr11 5212975 5212994 5212978 -
cacacaccggggcctgtcgt

SEQ ID NO: 50459 - DNA, 20 bp, Artificial Sequence
  Synthetic oligonucleotide; GGG chr11 5212974 5212993 5212977 -
acacaccggggcctgtcgtg

SEQ ID NO: 50460 - DNA, 20 bp, Artificial Sequence
  Synthetic oligonucleotide; TGG chr11 5212971 5212990 5212974 -
caccggggcctgtcgtgggg

SEQ ID NO: 50461 - DNA, 20 bp, Artificial Sequence
  Synthetic oligonucleotide; TAG chr11 5212968 5212987 5212971 -
cggggcctgtcgtggggtgg

SEQ ID NO: 50462 - DNA, 20 bp, Artificial Sequence
  Synthetic oligonucleotide; AGG chr11 5212967 5212986 5212970 -
ggggcctgtcgtggggtggt

SEQ ID NO: 50463 - DNA, 20 bp, Artificial Sequence
  Synthetic oligonucleotide; GAG chr11 5212965 5212984 5212968 -
ggcctgtcgtggggtggtag

SEQ ID NO: 50464 - DNA, 20 bp, Artificial Sequence
  Synthetic oligonucleotide; GAG chr11 5212963 5212982 5212966 -
cctgtcgtggggtggtagga

SEQ ID NO: 50465 - DNA, 20 bp, Artificial Sequence
  Synthetic oligonucleotide; GAG chr11 5212961 5212980 5212964 -
tgtcgtggggtggtaggaga

SEQ ID NO: 50466 - DNA, 20 bp, Artificial Sequence
  Synthetic oligonucleotide; AGG chr11 5212960 5212979 5212963 -
gtcgtggggtggtaggagag

SEQ ID NO: 50467 - DNA, 20 bp, Artificial Sequence
  Synthetic oligonucleotide; GAG chr11 5212958 5212977 5212961 -
cgtggggtggtaggagagag

SEQ ID NO: 50468 - DNA, 20 bp, Artificial Sequence
  Synthetic oligonucleotide; AGG chr11 5212957 5212976 5212960 -
gtggggtggtaggagagagg

SEQ ID NO: 50469 - DNA, 20 bp, Artificial Sequence
  Synthetic oligonucleotide; GGG chr11 5212956 5212975 5212959 -
tggggtggtaggagagagga

SEQ ID NO: 50470 - DNA, 20 bp, Artificial Sequence
  Synthetic oligonucleotide; TAG chr11 5212946 5212965 5212949 -
ggagagaggagggataacat

SEQ ID NO: 50471 - DNA, 20 bp, Artificial Sequence
  Synthetic oligonucleotide; AGG chr11 5212945 5212964 5212948 -
gagagaggagggataacatt

SEQ ID NO: 50472 - DNA, 20 bp, Artificial Sequence
  Synthetic oligonucleotide; GAG chr11 5212943 5212962 5212946 -
gagaggagggataacattag

SEQ ID NO: 50473 - DNA, 20 bp, Artificial Sequence
  Synthetic oligonucleotide; GAG chr11 5212920 5212939 5212923 -
atatatctaatgtaaatgac

SEQ ID NO: 50474 - DNA, 20 bp, Artificial Sequence
  Synthetic oligonucleotide; CGG chr11 5212913 5212932 5212916 -
taatgtaaatgacgagttaa

SEQ ID NO: 50475 - DNA, 20 bp, Artificial Sequence
  Synthetic oligonucleotide; GGG chr11 5212912 5212931 5212915 -
aatgtaaatgacgagttaac

SEQ ID NO: 50476 - DNA, 20 bp, Artificial Sequence
  Synthetic oligonucleotide; CAG chr11 5212907 5212926 5212910 -
aaatgacgagttaacgggtg

SEQ ID NO: 50477 - DNA, 20 bp, Artificial Sequence
  Synthetic oligonucleotide; TGG chr11 5212894 5212913 5212897 -
acgggtgcagcacaccaata

SEQ ID NO: 50478 - DNA, 20 bp, Artificial Sequence
  Synthetic oligonucleotide; CAG chr11 5212863 5212882 5212866 -
tacatatgtaacaaactgca

SEQ ID NO: 50479 - DNA, 20 bp, Artificial Sequence
  Synthetic oligonucleotide; AGG chr11 5212862 5212881 5212865 -
acatatgtaacaaactgcac

SEQ ID NO: 50480 - DNA, 20 bp, Artificial Sequence
  Synthetic oligonucleotide; TAG chr11 5212854 5212873 5212857 -
aacaaactgcacaggtaccg

SEQ ID NO: 50481 - DNA, 20 bp, Artificial Sequence
  Synthetic oligonucleotide; TAG chr11 5212847 5212866 5212850 -
tgcacaggtaccgtagaact

SEQ ID NO: 50482 - DNA, 20 bp, Artificial Sequence
  Synthetic oligonucleotide; GAG chr11 5212845 5212864 5212848 -
cacaggtaccgtagaactta

SEQ ID NO: 50483 - DNA, 20 bp, Artificial Sequence
  Synthetic oligonucleotide; AAG chr11 5212828 5212847 5212831 -
ttagagtacaaaaaaaaaaa

SEQ ID NO: 50484 - DNA, 20 bp, Artificial Sequence
  Synthetic oligonucleotide; GAG chr11 5212826 5212845 5212829 -
agagtacaaaaaaaaaaaaa

SEQ ID NO: 50485 - DNA, 20 bp, Artificial Sequence
  Synthetic oligonucleotide; AAG chr11 5212820 5212839 5212823 -
caaaaaaaaaaaaagagaaa

SEQ ID NO: 50486 - DNA, 20 bp, Artificial Sequence
  Synthetic oligonucleotide; AAG chr11 5212813 5212832 5212816 -
aaaaaaagagaaaaagaaaa

SEQ ID NO: 50487 - DNA, 20 bp, Artificial Sequence
  Synthetic oligonucleotide; TGG chr11 5212809 5212828 5212812 -
aaagagaaaaagaaaaaagc

SEQ ID NO: 50488 - DNA, 20 bp, Artificial Sequence
  Synthetic oligonucleotide; GAG chr11 5212807 5212826 5212810 -
agagaaaaagaaaaaagctg

SEQ ID NO: 50489 - DNA, 20 bp, Artificial Sequence
  Synthetic oligonucleotide; CAG chr11 5212773 5212792 5212776 -
cctaacttcaaaccatacca

SEQ ID NO: 50490 - DNA, 20 bp, Artificial Sequence
  Synthetic oligonucleotide; AGG chr11 5212772 5212791 5212775 -
ctaacttcaaaccataccac

SEQ ID NO: 50491 - DNA, 20 bp, Artificial Sequence
  Synthetic oligonucleotide; GGG chr11 5212771 5212790 5212774 -
taacttcaaaccataccaca

SEQ ID NO: 50492 - DNA, 20 bp, Artificial Sequence
  Synthetic oligonucleotide; CAG chr11 5212765 5212784 5212768 -
caaaccataccacagggcta

SEQ ID NO: 50493 - DNA, 20 bp, Artificial Sequence
  Synthetic oligonucleotide; CAG chr11 5212753 5212772 5212756 -
cagggctacagtaaccaaaa

SEQ ID NO: 50494 - DNA, 20 bp, Artificial Sequence
  Synthetic oligonucleotide; TGG chr11 5212748 5212767 5212751 -
ctacagtaaccaaaacagtg

SEQ ID NO: 50495 - DNA, 20 bp, Artificial Sequence
  Synthetic oligonucleotide; CAG chr11 5212737 5212756 5212740 -
aaaacagtgtggtactgtta

SEQ ID NO: 50496 - DNA, 20 bp, Artificial Sequence
  Synthetic oligonucleotide; AAG chr11 5212732 5212751 5212735 -
agtgtggtactgttacagaa

SEQ ID NO: 50497 - DNA, 20 bp, Artificial Sequence
  Synthetic oligonucleotide; CAG chr11 5212724 5212743 5212727 -
actgttacagaaaagacaca

SEQ ID NO: 50498 - DNA, 20 bp, Artificial Sequence
  Synthetic oligonucleotide; TGG chr11 5212716 5212735 5212719 -
agaaaagacacacagacaaa

SEQ ID NO: 50499 - DNA, 20 bp, Artificial Sequence
  Synthetic oligonucleotide; CAG chr11 5212711 5212730 5212714 -
agacacacagacaaatggaa

SEQ ID NO: 50500 - DNA, 20 bp, Artificial Sequence
  Synthetic oligonucleotide; TAG chr11 5212706 5212725 5212709 -
cacagacaaatggaacagaa

SEQ ID NO: 50501 - DNA, 20 bp, Artificial Sequence
  Synthetic oligonucleotide; GAG chr11 5212704 5212723 5212707 -
cagacaaatggaacagaata

SEQ ID NO: 50502 - DNA, 20 bp, Artificial Sequence
  Synthetic oligonucleotide; GAG chr11 5212702 5212721 5212705 -
gacaaatggaacagaataga

SEQ ID NO: 50503 - DNA, 20 bp, Artificial Sequence
  Synthetic oligonucleotide; CAG chr11 5212697 5212716 5212700 -
atggaacagaatagagagcc

SEQ ID NO: 50504 - DNA, 20 bp, Artificial Sequence
  Synthetic oligonucleotide; AAG chr11 5212690 5212709 5212693 -
agaatagagagcccagaaat

SEQ ID NO: 50505 - DNA, 20 bp, Artificial Sequence
  Synthetic oligonucleotide; AAG chr11 5212655 5212674 5212658 -
caaccatctgatctttgaca

SEQ ID NO: 50506 - DNA, 20 bp, Artificial Sequence
  Synthetic oligonucleotide; AAG chr11 5212641 5212660 5212644 -
ttgacaaagctgataaaaac

SEQ ID NO: 50507 - DNA, 20 bp, Artificial Sequence
  Synthetic oligonucleotide; GAG chr11 5212634 5212653 5212637 -
agctgataaaaacaagcaat

SEQ ID NO: 50508 - DNA, 20 bp, Artificial Sequence
  Synthetic oligonucleotide; AGG chr11 5212633 5212652 5212636 -
gctgataaaaacaagcaatg

SEQ ID NO: 50509 - DNA, 20 bp, Artificial Sequence
  Synthetic oligonucleotide; AAG chr11 5212628 5212647 5212631 -
taaaaacaagcaatgaggaa

SEQ ID NO: 50510 - DNA, 20 bp, Artificial Sequence
  Synthetic oligonucleotide; AAG chr11 5212611 5212630 5212614 -
gaaaagacaccctattcaac

SEQ ID NO: 50511 - DNA, 20 bp, Artificial Sequence
  Synthetic oligonucleotide; TGG chr11 5212608 5212627 5212611 -
aagacaccctattcaacaag

SEQ ID NO: 50512 - DNA, 20 bp, Artificial Sequence
  Synthetic oligonucleotide; TGG chr11 5212602 5212621 5212605 -
ccctattcaacaagtggtgt

SEQ ID NO: 50513 - DNA, 20 bp, Artificial Sequence
  Synthetic oligonucleotide; GGG chr11 5212601 5212620 5212604 -
cctattcaacaagtggtgtt

SEQ ID NO: 50514 - DNA, 20 bp, Artificial Sequence
  Synthetic oligonucleotide; TAG chr11 5212579 5212598 5212582 -
gataactgactaaccgtatg

SEQ ID NO: 50515 - DNA, 20 bp, Artificial Sequence
  Synthetic oligonucleotide; AAG chr11 5212576 5212595 5212579 -
aactgactaaccgtatgtag

SEQ ID NO: 50516 - DNA, 20 bp, Artificial Sequence
  Synthetic oligonucleotide; CAG chr11 5212565 5212584 5212568 -
cgtatgtagaagattgaaac

SEQ ID NO: 50517 - DNA, 20 bp, Artificial Sequence
  Synthetic oligonucleotide; AAG chr11 5212529 5212548 5212532 -
tcatatacacaaataaactc

SEQ ID NO: 50518 - DNA, 20 bp, Artificial Sequence
  Synthetic oligonucleotide; TGG chr11 5212525 5212544 5212528 -
atacacaaataaactcaaga

SEQ ID NO: 50519 - DNA, 20 bp, Artificial Sequence
  Synthetic oligonucleotide; TAG chr11 5212520 5212539 5212523 -
caaataaactcaagatggat

SEQ ID NO: 50520 - DNA, 20 bp, Artificial Sequence
  Synthetic oligonucleotide; GAG chr11 5212518 5212537 5212521 -
aataaactcaagatggatta

SEQ ID NO: 50521 - DNA, 20 bp, Artificial Sequence
  Synthetic oligonucleotide; AAG chr11 5212479 5212498 5212482 -
caaactataaaaatgcttga

SEQ ID NO: 50522 - DNA, 20 bp, Artificial Sequence
  Synthetic oligonucleotide; TAG chr11 5212471 5212490 5212474 -
aaaaatgcttgaaagcaacc

SEQ ID NO: 50523 - DNA, 20 bp, Artificial Sequence
  Synthetic oligonucleotide; AGG chr11 5212470 5212489 5212473 -
aaaatgcttgaaagcaacct

SEQ ID NO: 50524 - DNA, 20 bp, Artificial Sequence
  Synthetic oligonucleotide; CGG chr11 5212456 5212475 5212459 -
caacctaggcaataccattc

SEQ ID NO: 50525 - DNA, 20 bp, Artificial Sequence
  Synthetic oligonucleotide; AAG chr11 5212449 5212468 5212452 -
ggcaataccattccggacat

SEQ ID NO: 50526 - DNA, 20 bp, Artificial Sequence
  Synthetic oligonucleotide; CAG chr11 5212446 5212465 5212449 -
aataccattccggacataag

SEQ ID NO: 50527 - DNA, 20 bp, Artificial Sequence
  Synthetic oligonucleotide; AGG chr11 5212445 5212464 5212448 -
ataccattccggacataagc

SEQ ID NO: 50528 - DNA, 20 bp, Artificial Sequence
  Synthetic oligonucleotide; GGG chr11 5212444 5212463 5212447 -
taccattccggacataagca

SEQ ID NO: 50529 - DNA, 20 bp, Artificial Sequence
  Synthetic oligonucleotide; GGG chr11 5212443 5212462 5212446 -
accattccggacataagcag

SEQ ID NO: 50530 - DNA, 20 bp, Artificial Sequence
  Synthetic oligonucleotide; AAG chr11 5212438 5212457 5212441 -
tccggacataagcaggggca

SEQ ID NO: 50531 - DNA, 20 bp, Artificial Sequence
  Synthetic oligonucleotide; AAG chr11 5212424 5212443 5212427 -
ggggcaaagatttcatgaca

SEQ ID NO: 50532 - DNA, 20 bp, Artificial Sequence
  Synthetic oligonucleotide; CAG chr11 5212414 5212433 5212417 -
tttcatgacaaagatgccaa

SEQ ID NO: 50533 - DNA, 20 bp, Artificial Sequence
  Synthetic oligonucleotide; CAG chr11 5212405 5212424 5212408 -
aaagatgccaacagtcattg

SEQ ID NO: 50534 - DNA, 20 bp, Artificial Sequence
  Synthetic oligonucleotide; AAG chr11 5212399 5212418 5212402 -
gccaacagtcattgcagcaa

SEQ ID NO: 50535 - DNA, 20 bp, Artificial Sequence
  Synthetic oligonucleotide; TAG chr11 5212382 5212401 5212385 -
caaaagcaaaaattgacaaa

SEQ ID NO: 50536 - DNA, 20 bp, Artificial Sequence
  Synthetic oligonucleotide; AGG chr11 5212381 5212400 5212384 -
aaaagcaaaaattgacaaat

SEQ ID NO: 50537 - DNA, 20 bp, Artificial Sequence
  Synthetic oligonucleotide; AAG chr11 5212364 5212383 5212367 -
aataggatctaattaaaata

SEQ ID NO: 50538 - DNA, 20 bp, Artificial Sequence
  Synthetic oligonucleotide; CAG chr11 5212353 5212372 5212356 -
attaaaataaagtttctgca

SEQ ID NO: 50539 - DNA, 20 bp, Artificial Sequence
  Synthetic oligonucleotide; AAG chr11 5212347 5212366 5212350 -
ataaagtttctgcacagcaa

SEQ ID NO: 50540 - DNA, 20 bp, Artificial Sequence
  Synthetic oligonucleotide; GAG chr11 5212332 5212351 5212335 -
agcaaaagaaactatcaact

SEQ ID NO: 50541 - DNA, 20 bp, Artificial Sequence
  Synthetic oligonucleotide; TAG chr11 5212318 5212337 5212321 -
tcaactgagtaaacaaccta

SEQ ID NO: 50542 - DNA, 20 bp, Artificial Sequence
  Synthetic oligonucleotide; TGG chr11 5212313 5212332 5212316 -
tgagtaaacaacctatagaa

SEQ ID NO: 50543 - DNA, 20 bp, Artificial Sequence
  Synthetic oligonucleotide; GGG chr11 5212312 5212331 5212315 -
gagtaaacaacctatagaat

SEQ ID NO: 50544 - DNA, 20 bp, Artificial Sequence
  Synthetic oligonucleotide; GAG chr11 5212310 5212329 5212313 -
gtaaacaacctatagaatgg

SEQ ID NO: 50545 - DNA, 20 bp, Artificial Sequence
  Synthetic oligonucleotide; AAG chr11 5212279 5212298 5212282 -
tgcaaactatgcatccaaca

SEQ ID NO: 50546 - DNA, 20 bp, Artificial Sequence
  Synthetic oligonucleotide; AGG chr11 5212278 5212297 5212281 -
gcaaactatgcatccaacaa

SEQ ID NO: 50547 - DNA, 20 bp, Artificial Sequence
  Synthetic oligonucleotide; CAG chr11 5212266 5212285 5212269 -
tccaacaaaggcctaatatt

SEQ ID NO: 50548 - DNA, 20 bp, Artificial Sequence
  Synthetic oligonucleotide; AAG chr11 5212256 5212275 5212259 -
gcctaatattcagaatctat

SEQ ID NO: 50549 - DNA, 20 bp, Artificial Sequence
  Synthetic oligonucleotide; AGG chr11 5212255 5212274 5212258 -
cctaatattcagaatctata

SEQ ID NO: 50550 - DNA, 20 bp, Artificial Sequence
  Synthetic oligonucleotide; AAG chr11 5212235 5212254 5212238 -
aggaacttaaatgaatctac

SEQ ID NO: 50551 - DNA, 20 bp, Artificial Sequence
  Synthetic oligonucleotide; TGG chr11 5212206 5212225 5212209 -
acaaacaatgccacaaaaaa

SEQ ID NO: 50552 - DNA, 20 bp, Artificial Sequence
  Synthetic oligonucleotide; GGG chr11 5212205 5212224 5212208 -
caaacaatgccacaaaaaat

SEQ ID NO: 50553 - DNA, 20 bp, Artificial Sequence
  Synthetic oligonucleotide; AAG chr11 5212200 5212219 5212203 -
aatgccacaaaaaatgggta

SEQ ID NO: 50554 - DNA, 20 bp, Artificial Sequence
  Synthetic oligonucleotide; AGG chr11 5212199 5212218 5212202 -
atgccacaaaaaatgggtaa

SEQ ID NO: 50555 - DNA, 20 bp, Artificial Sequence
  Synthetic oligonucleotide; CAG chr11 5212189 5212208 5212192 -
aaatgggtaaaggacatgaa

SEQ ID NO: 50556 - DNA, 20 bp, Artificial Sequence
  Synthetic oligonucleotide; CAG chr11 5212185 5212204 5212188 -
gggtaaaggacatgaacaga

SEQ ID NO: 50557 - DNA, 20 bp, Artificial Sequence
  Synthetic oligonucleotide; AAG chr11 5212175 5212194 5212178 -
catgaacagacagtattcaa

SEQ ID NO: 50558 - DNA, 20 bp, Artificial Sequence
  Synthetic oligonucleotide; AAG chr11 5212172 5212191 5212175 -
gaacagacagtattcaaaag

SEQ ID NO: 50559 - DNA, 20 bp, Artificial Sequence
  Synthetic oligonucleotide; TGG chr11 5212160 5212179 5212163 -
ttcaaaagaagacatacatg

SEQ ID NO: 50560 - DNA, 20 bp, Artificial Sequence
  Synthetic oligonucleotide; AAG chr11 5212152 5212171 5212155 -
aagacatacatgtggccacc

SEQ ID NO: 50561 - DNA, 20 bp, Artificial Sequence
  Synthetic oligonucleotide; AAG chr11 5212139 5212158 5212142 -
ggccaccaagcatatgaaaa

SEQ ID NO: 50562 - DNA, 20 bp, Artificial Sequence
  Synthetic oligonucleotide; CAG chr11 5212134 5212153 5212137 -
ccaagcatatgaaaaaagct

SEQ ID NO: 50563 - DNA, 20 bp, Artificial Sequence
  Synthetic oligonucleotide; TAG chr11 5212118 5212137 5212121 -
agctcagtgtcactgatcat

SEQ ID NO: 50564 - DNA, 20 bp, Artificial Sequence
  Synthetic oligonucleotide; GAG chr11 5212116 5212135 5212119 -
ctcagtgtcactgatcatta

SEQ ID NO: 50565 - DNA, 20 bp, Artificial Sequence
  Synthetic oligonucleotide; GAG chr11 5212091 5212110 5212094 -
atgccaatcaaacccaaaat

SEQ ID NO: 50566 - DNA, 20 bp, Artificial Sequence
  Synthetic oligonucleotide; TAG chr11 5212051 5212070 5212054 -
ttaaaatatctataattaaa

SEQ ID NO: 50567 - DNA, 20 bp, Artificial Sequence
  Synthetic oligonucleotide; CAG chr11 5212037 5212056 5212040 -
attaaatagtcaaaaaataa

SEQ ID NO: 50568 - DNA, 20 bp, Artificial Sequence
  Synthetic oligonucleotide; TGG chr11 5212031 5212050 5212034 -
tagtcaaaaaataacagatg

SEQ ID NO: 50569 - DNA, 20 bp, Artificial Sequence
  Synthetic oligonucleotide; GGG chr11 5212030 5212049 5212033 -
agtcaaaaaataacagatgt

SEQ ID NO: 50570 - DNA, 20 bp, Artificial Sequence
  Synthetic oligonucleotide; AAG chr11 5212026 5212045 5212029 -
aaaaaataacagatgtgggt

SEQ ID NO: 50571 - DNA, 20 bp, Artificial Sequence
  Synthetic oligonucleotide; AGG chr11 5212025 5212044 5212028 -
aaaaataacagatgtgggta

SEQ ID NO: 50572 - DNA, 20 bp, Artificial Sequence
  Synthetic oligonucleotide; TGG chr11 5212019 5212038 5212022 -
aacagatgtgggtaaggttg

SEQ ID NO: 50573 - DNA, 20 bp, Artificial Sequence
  Synthetic oligonucleotide; GAG chr11 5212017 5212036 5212020 -
cagatgtgggtaaggttgtg

SEQ ID NO: 50574 - DNA, 20 bp, Artificial Sequence
  Synthetic oligonucleotide; AAG chr11 5212012 5212031 5212015 -
gtgggtaaggttgtggagaa

SEQ ID NO: 50575 - DNA, 20 bp, Artificial Sequence
  Synthetic oligonucleotide; AGG chr11 5212011 5212030 5212014 -
tgggtaaggttgtggagaaa

SEQ ID NO: 50576 - DNA, 20 bp, Artificial Sequence
  Synthetic oligonucleotide; GGG chr11 5212010 5212029 5212013 -
gggtaaggttgtggagaaaa

SEQ ID NO: 50577 - DNA, 20 bp, Artificial Sequence
  Synthetic oligonucleotide; TGG chr11 5211991 5212010 5211994 -
agggaatgtttatacaccat

SEQ ID NO: 50578 - DNA, 20 bp, Artificial Sequence
  Synthetic oligonucleotide; TGG chr11 5211988 5212007 5211991 -
gaatgtttatacaccattgg

SEQ ID NO: 50579 - DNA, 20 bp, Artificial Sequence
  Synthetic oligonucleotide; TAG chr11 5211975 5211994 5211978 -
ccattggtggcaatataaat

SEQ ID NO: 50580 - DNA, 20 bp, Artificial Sequence
  Synthetic oligonucleotide; TAG chr11 5211961 5211980 5211964 -
ataaattagttcgaccattg

SEQ ID NO: 50581 - DNA, 20 bp, Artificial Sequence
  Synthetic oligonucleotide; CAG chr11 5211957 5211976 5211960 -
attagttcgaccattgtaga

SEQ ID NO: 50582 - DNA, 20 bp, Artificial Sequence
  Synthetic oligonucleotide; CAG chr11 5211954 5211973 5211957 -
agttcgaccattgtagacag

SEQ ID NO: 50583 - DNA, 20 bp, Artificial Sequence
  Synthetic oligonucleotide; TGG chr11 5211949 5211968 5211952 -
gaccattgtagacagcagtg

SEQ ID NO: 50584 - DNA, 20 bp, Artificial Sequence
  Synthetic oligonucleotide; AAG chr11 5211936 5211955 5211939 -
agcagtgtggcaattcccta

SEQ ID NO: 50585 - DNA, 20 bp, Artificial Sequence
  Synthetic oligonucleotide; CAG chr11 5211924 5211943 5211927 -
attccctaaagacctaaaaa

SEQ ID NO: 50586 - DNA, 20 bp, Artificial Sequence
  Synthetic oligonucleotide; GAG chr11 5211890 5211909 5211893 -
aacccaacaatcctattatt

SEQ ID NO: 50587 - DNA, 20 bp, Artificial Sequence
  Synthetic oligonucleotide; AAG chr11 5211877 5211896 5211880 -
tattattgagtatataccta

SEQ ID NO: 50588 - DNA, 20 bp, Artificial Sequence
  Synthetic oligonucleotide; AGG chr11 5211876 5211895 5211879 -
attattgagtatatacctaa

SEQ ID NO: 50589 - DNA, 20 bp, Artificial Sequence
  Synthetic oligonucleotide; AAG chr11 5211852 5211871 5211855 -
aaataaaccattctatcaca

SEQ ID NO: 50590 - DNA, 20 bp, Artificial Sequence
  Synthetic oligonucleotide; CAG chr11 5211825 5211844 5211828 -
atgcacacctgtgtccattg

SEQ ID NO: 50591 - DNA, 20 bp, Artificial Sequence
  Synthetic oligonucleotide; TAG chr11 5211811 5211830 5211814 -
ccattgcagcataatcacaa

SEQ ID NO: 50592 - DNA, 20 bp, Artificial Sequence
  Synthetic oligonucleotide; AAG chr11 5211806 5211825 5211809 -
gcagcataatcacaatagca

SEQ ID NO: 50593 - DNA, 20 bp, Artificial Sequence
  Synthetic oligonucleotide; TAG chr11 5211800 5211819 5211803 -
taatcacaatagcaaagaca

SEQ ID NO: 50594 - DNA, 20 bp, Artificial Sequence
  Synthetic oligonucleotide; AAG chr11 5211787 5211806 5211790 -
aaagacatagaatcaacctg

SEQ ID NO: 50595 - DNA, 20 bp, Artificial Sequence
  Synthetic oligonucleotide; AGG chr11 5211786 5211805 5211789 -
aagacatagaatcaacctga

SEQ ID NO: 50596 - DNA, 20 bp, Artificial Sequence
  Synthetic oligonucleotide; TAG chr11 5211778 5211797 5211781 -
gaatcaacctgaaggcccat

SEQ ID NO: 50597 - DNA, 20 bp, Artificial Sequence
  Synthetic oligonucleotide; TGG chr11 5211775 5211794 5211778 -
tcaacctgaaggcccattag

SEQ ID NO: 50598 - DNA, 20 bp, Artificial Sequence
  Synthetic oligonucleotide; AAG chr11 5211762 5211781 5211765 -
ccattagtggtataccgata

SEQ ID NO: 50599 - DNA, 20 bp, Artificial Sequence
  Synthetic oligonucleotide; TGG chr11 5211740 5211759 5211743 -
gaacatgtacatatacacca

SEQ ID NO: 50600 - DNA, 20 bp, Artificial Sequence
  Synthetic oligonucleotide; TGG chr11 5211728 5211747 5211731 -
atacaccatggaatactatg

SEQ ID NO: 50601 - DNA, 20 bp, Artificial Sequence
  Synthetic oligonucleotide; AAG chr11 5211717 5211736 5211720 -
aatactatgtggccataaaa

SEQ ID NO: 50602 - DNA, 20 bp, Artificial Sequence
  Synthetic oligonucleotide; GAG chr11 5211711 5211730 5211714 -
atgtggccataaaaaagaat

SEQ ID NO: 50603 - DNA, 20 bp, Artificial Sequence
  Synthetic oligonucleotide; CAG chr11 5211695 5211714 5211698 -
gaatgagatcatgtcctttg

SEQ ID NO: 50604 - DNA, 20 bp, Artificial Sequence
  Synthetic oligonucleotide; AGG chr11 5211694 5211713 5211697 -
aatgagatcatgtcctttgc

SEQ ID NO: 50605 - DNA, 20 bp, Artificial Sequence
  Synthetic oligonucleotide; TGG chr11 5211687 5211706 5211690 -
tcatgtcctttgcaggaaca

SEQ ID NO: 50606 - DNA, 20 bp, Artificial Sequence
  Synthetic oligonucleotide; TGG chr11 5211683 5211702 5211686 -
gtcctttgcaggaacatgga

SEQ ID NO: 50607 - DNA, 20 bp, Artificial Sequence
  Synthetic oligonucleotide; GAG chr11 5211681 5211700 5211684 -
cctttgcaggaacatggatg

SEQ ID NO: 50608 - DNA, 20 bp, Artificial Sequence
  Synthetic oligonucleotide; CGG chr11 5211677 5211696 5211680 -
tgcaggaacatggatggagc

SEQ ID NO: 50609 - DNA, 20 bp, Artificial Sequence
  Synthetic oligonucleotide; AAG chr11 5211647 5211666 5211650 -
tatccttaacaaactaatgt

SEQ ID NO: 50610 - DNA, 20 bp, Artificial Sequence
  Synthetic oligonucleotide; CAG chr11 5211642 5211661 5211645 -
ttaacaaactaatgtaagaa

SEQ ID NO: 50611 - DNA, 20 bp, Artificial Sequence
  Synthetic oligonucleotide; AAG chr11 5211610 5211629 5211613 -
tactacatattatcacttac

SEQ ID NO: 50612 - DNA, 20 bp, Artificial Sequence
  Synthetic oligonucleotide; TAG chr11 5211607 5211626 5211610 -
tacatattatcacttacaag

SEQ ID NO: 50613 - DNA, 20 bp, Artificial Sequence
  Synthetic oligonucleotide; AGG chr11 5211606 5211625 5211609 -
acatattatcacttacaagt

SEQ ID NO: 50614 - DNA, 20 bp, Artificial Sequence
  Synthetic oligonucleotide; GAG chr11 5211592 5211611 5211595 -
acaagtaggaactaaatgat

SEQ ID NO: 50615 - DNA, 20 bp, Artificial Sequence
  Synthetic oligonucleotide; CGG chr11 5211572 5211591 5211575 -
gagaaaacatgcacacataa

SEQ ID NO: 50616 - DNA, 20 bp, Artificial Sequence
  Synthetic oligonucleotide; GGG chr11 5211571 5211590 5211574 -
agaaaacatgcacacataac

SEQ ID NO: 50617 - DNA, 20 bp, Artificial Sequence
  Synthetic oligonucleotide; AAG chr11 5211563 5211582 5211566 -
tgcacacataacgggaacaa

SEQ ID NO: 50618 - DNA, 20 bp, Artificial Sequence
  Synthetic oligonucleotide; CAG chr11 5211554 5211573 5211557 -
aacgggaacaaaagacactg

SEQ ID NO: 50619 - DNA, 20 bp, Artificial Sequence
  Synthetic oligonucleotide; GAG chr11 5211544 5211563 5211547 -
aaagacactgcagcctaatt

SEQ ID NO: 50620 - DNA, 20 bp, Artificial Sequence
  Synthetic oligonucleotide; TGG chr11 5211539 5211558 5211542 -
cactgcagcctaattgagtt

SEQ ID NO: 50621 - DNA, 20 bp, Artificial Sequence
  Synthetic oligonucleotide; GAG chr11 5211537 5211556 5211540 -
ctgcagcctaattgagtttg

SEQ ID NO: 50622 - DNA, 20 bp, Artificial Sequence
  Synthetic oligonucleotide; AGG chr11 5211536 5211555 5211539 -
tgcagcctaattgagtttgg

SEQ ID NO: 50623 - DNA, 20 bp, Artificial Sequence
  Synthetic oligonucleotide; GGG chr11 5211535 5211554 5211538 -
gcagcctaattgagtttgga

SEQ ID NO: 50624 - DNA, 20 bp, Artificial Sequence
  Synthetic oligonucleotide; TGG chr11 5211532 5211551 5211535 -
gcctaattgagtttggaggg

SEQ ID NO: 50625 - DNA, 20 bp, Artificial Sequence
  Synthetic oligonucleotide; GGG chr11 5211531 5211550 5211534 -
cctaattgagtttggagggt

SEQ ID NO: 50626 - DNA, 20 bp, Artificial Sequence
  Synthetic oligonucleotide; CGG chr11 5211526 5211545 5211529 -
ttgagtttggagggtgggaa

SEQ ID NO: 50627 - DNA, 20 bp, Artificial Sequence
  Synthetic oligonucleotide; GGG chr11 5211525 5211544 5211528 -
tgagtttggagggtgggaac

SEQ ID NO: 50628 - DNA, 20 bp, Artificial Sequence
  Synthetic oligonucleotide; GGG chr11 5211524 5211543 5211527 -
gagtttggagggtgggaacg

SEQ ID NO: 50629 - DNA, 20 bp, Artificial Sequence
  Synthetic oligonucleotide; GAG chr11 5211522 5211541 5211525 -
gtttggagggtgggaacggg

SEQ ID NO: 50630 - DNA, 20 bp, Artificial Sequence
  Synthetic oligonucleotide; AAG chr11 5211519 5211538 5211522 -
tggagggtgggaacggggag

SEQ ID NO: 50631 - DNA, 20 bp, Artificial Sequence
  Synthetic oligonucleotide; GAG chr11 5211517 5211536 5211520 -
gagggtgggaacggggagaa

SEQ ID NO: 50632 - DNA, 20 bp, Artificial Sequence
  Synthetic oligonucleotide; CAG chr11 5211514 5211533 5211517 -
ggtgggaacggggagaagag

SEQ ID NO: 50633 - DNA, 20 bp, Artificial Sequence
  Synthetic oligonucleotide; AAG chr11 5211508 5211527 5211511 -
aacggggagaagagcagaaa

SEQ ID NO: 50634 - DNA, 20 bp, Artificial Sequence
  Synthetic oligonucleotide; GAG chr11 5211497 5211516 5211500 -
gagcagaaaaagtaactatt

SEQ ID NO: 50635 - DNA, 20 bp, Artificial Sequence
  Synthetic oligonucleotide; TGG chr11 5211491 5211510 5211494 -
aaaaagtaactattgagtac

SEQ ID NO: 50636 - DNA, 20 bp, Artificial Sequence
  Synthetic oligonucleotide; GGG chr11 5211490 5211509 5211493 -
aaaagtaactattgagtact

SEQ ID NO: 50637 - DNA, 20 bp, Artificial Sequence
  Synthetic oligonucleotide; GAG chr11 5211488 5211507 5211491 -
aagtaactattgagtactgg

SEQ ID NO: 50638 - DNA, 20 bp, Artificial Sequence
  Synthetic oligonucleotide; TAG chr11 5211448 5211467 5211451 -
acaaacccatgacatgtgtt

SEQ ID NO: 50639 - DNA, 20 bp, Artificial Sequence
  Synthetic oligonucleotide; GAG chr11 5211426 5211445 5211429 -
gctatgtaacaaaccatcgt

SEQ ID NO: 50640 - DNA, 20 bp, Artificial Sequence
  Synthetic oligonucleotide; TAG chr11 5211419 5211438 5211422 -
aacaaaccatcgtgagtctt

SEQ ID NO: 50641 - DNA, 20 bp, Artificial Sequence
  Synthetic oligonucleotide; CAG chr11 5211416 5211435 5211419 -
aaaccatcgtgagtctttag

SEQ ID NO: 50642 - DNA, 20 bp, Artificial Sequence
  Synthetic oligonucleotide; TAG chr11 5211368 5211387 5211371 -
ttgctcctctttccacctat

SEQ ID NO: 50643 - DNA, 20 bp, Artificial Sequence
  Synthetic oligonucleotide; TAG chr11 5211350 5211369 5211353 -
attagtcacatatcttttta

SEQ ID NO: 50644 - DNA, 20 bp, Artificial Sequence
  Synthetic oligonucleotide; CAG chr11 5211340 5211359 5211343 -
tatctttttatagttataat

SEQ ID NO: 50645 - DNA, 20 bp, Artificial Sequence
  Synthetic oligonucleotide; AAG chr11 5211328 5211347 5211331 -
gttataatcagcttgttttt

SEQ ID NO: 50646 - DNA, 20 bp, Artificial Sequence
  Synthetic oligonucleotide; AAG chr11 5211293 5211312 5211296 -
ttgttttatgcgcattatga

SEQ ID NO: 50647 - DNA, 20 bp, Artificial Sequence
  Synthetic oligonucleotide; AAG chr11 5211243 5211262 5211246 -
gtaatttgattttatgcaac

SEQ ID NO: 50648 - DNA, 20 bp, Artificial Sequence
  Synthetic oligonucleotide; TAG chr11 5211221 5211240 5211224 -
gcatttattgtgttcctata

SEQ ID NO: 50649 - DNA, 20 bp, Artificial Sequence
  Synthetic oligonucleotide; TGG chr11 5211194 5211213 5211197 -
tataaaaactgtatatatgt

SEQ ID NO: 50650 - DNA, 20 bp, Artificial Sequence
  Synthetic oligonucleotide; GAG chr11 5211192 5211211 5211195 -
taaaaactgtatatatgttg

SEQ ID NO: 50651 - DNA, 20 bp, Artificial Sequence
  Synthetic oligonucleotide; AGG chr11 5211191 5211210 5211194 -
aaaaactgtatatatgttgg

SEQ ID NO: 50652 - DNA, 20 bp, Artificial Sequence
  Synthetic oligonucleotide; GAG chr11 5211146 5211165 5211149 -
ttttgccctcaaaataatgt

SEQ ID NO: 50653 - DNA, 20 bp, Artificial Sequence
  Synthetic oligonucleotide; TAG chr11 5211138 5211157 5211141 -
tcaaaataatgtgagcaatt

SEQ ID NO: 50654 - DNA, 20 bp, Artificial Sequence
  Synthetic oligonucleotide; TGG chr11 5211130 5211149 5211133 -
atgtgagcaatttagtccta

SEQ ID NO: 50655 - DNA, 20 bp, Artificial Sequence
  Synthetic oligonucleotide; AAG chr11 5211114 5211133 5211117 -
cctatggctcctatttgtta

SEQ ID NO: 50656 - DNA, 20 bp, Artificial Sequence
  Synthetic oligonucleotide; CAG chr11 5211106 5211125 5211109 -
tcctatttgttaaagacatt

SEQ ID NO: 50657 - DNA, 20 bp, Artificial Sequence
  Synthetic oligonucleotide; TAG chr11 5211065 5211084 5211068 -
attgttaatttctttctttc

SEQ ID NO: 50658 - DNA, 20 bp, Artificial Sequence
  Synthetic oligonucleotide; CAG chr11 5211041 5211060 5211044 -
tctcttttttttttttttga

SEQ ID NO: 50659 - DNA, 20 bp, Artificial Sequence
  Synthetic oligonucleotide; AGG chr11 5211040 5211059 5211043 -
ctcttttttttttttttgac

SEQ ID NO: 50660 - DNA, 20 bp, Artificial Sequence
  Synthetic oligonucleotide; GGG chr11 5211039 5211058 5211042 -
tcttttttttttttttgaca

SEQ ID NO: 50661 - DNA, 20 bp, Artificial Sequence
  Synthetic oligonucleotide; CAG chr11 5211021 5211040 5211024 -
cagggtctcgctgtgttgcc

SEQ ID NO: 50662 - DNA, 20 bp, Artificial Sequence
  Synthetic oligonucleotide; AGG chr11 5211020 5211039 5211023 -
agggtctcgctgtgttgccc

SEQ ID NO: 50663 - DNA, 20 bp, Artificial Sequence
  Synthetic oligonucleotide; TGG chr11 5211016 5211035 5211019 -
tctcgctgtgttgcccaggt

SEQ ID NO: 50664 - DNA, 20 bp, Artificial Sequence
  Synthetic oligonucleotide; GAG chr11 5211014 5211033 5211017 -
tcgctgtgttgcccaggttg

SEQ ID NO: 50665 - DNA, 20 bp, Artificial Sequence
  Synthetic oligonucleotide; CAG chr11 5211009 5211028 5211012 -
gtgttgcccaggttggagtg

SEQ ID NO: 50666 - DNA, 20 bp, Artificial Sequence
  Synthetic oligonucleotide; TGG chr11 5211006 5211025 5211009 -
ttgcccaggttggagtgcag

SEQ ID NO: 50667 - DNA, 20 bp, Artificial Sequence
  Synthetic oligonucleotide; TGG chr11 5210970 5210989 5210973 -
cactgcaatctccccctcct

SEQ ID NO: 50668 - DNA, 20 bp, Artificial Sequence
  Synthetic oligonucleotide; AAG chr11 5210964 5210983 5210967 -
aatctccccctccttggctc

SEQ ID NO: 50669 - DNA, 20 bp, Artificial Sequence
  Synthetic oligonucleotide; CAG chr11 5210947 5210966 5210950 -
ctcaagatatccttccacct

SEQ ID NO: 50670 - DNA, 20 bp, Artificial Sequence
  Synthetic oligonucleotide; AAG chr11 5210938 5210957 5210941 -
tccttccacctcagcctccc

SEQ ID NO: 50671 - DNA, 20 bp, Artificial Sequence
  Synthetic oligonucleotide; TAG chr11 5210935 5210954 5210938 -
ttccacctcagcctcccaag

SEQ ID NO: 50672 - DNA, 20 bp, Artificial Sequence
  Synthetic oligonucleotide; TGG chr11 5210931 5210950 5210934 -
acctcagcctcccaagtagc

SEQ ID NO: 50673 - DNA, 20 bp, Artificial Sequence
  Synthetic oligonucleotide; GGG chr11 5210930 5210949 5210933 -
cctcagcctcccaagtagct

SEQ ID NO: 50674 - DNA, 20 bp, Artificial Sequence
  Synthetic oligonucleotide; CAG chr11 5210923 5210942 5210926 -
ctcccaagtagctgggacta

SEQ ID NO: 50675 - DNA, 20 bp, Artificial Sequence
  Synthetic oligonucleotide; AGG chr11 5210922 5210941 5210925 -
tcccaagtagctgggactac

SEQ ID NO: 50676 - DNA, 20 bp, Artificial Sequence
  Synthetic oligonucleotide; CGG chr11 5210903 5210922 5210906 -
caggcacgtaacaccatatt

SEQ ID NO: 50677 - DNA, 20 bp, Artificial Sequence
  Synthetic oligonucleotide; TAG chr11 5210880 5210899 5210883 -
ctactttttaaaattttttg

SEQ ID NO: 50678 - DNA, 20 bp, Artificial Sequence
  Synthetic oligonucleotide; GAG chr11 5210878 5210897 5210881 -
actttttaaaattttttgta

SEQ ID NO: 50679 - DNA, 20 bp, Artificial Sequence
  Synthetic oligonucleotide; GAG chr11 5210876 5210895 5210879 -
tttttaaaattttttgtaga

SEQ ID NO: 50680 - DNA, 20 bp, Artificial Sequence
  Synthetic oligonucleotide; AGG chr11 5210875 5210894 5210878 -
ttttaaaattttttgtagag

SEQ ID NO: 50681 - DNA, 20 bp, Artificial Sequence
  Synthetic oligonucleotide; GGG chr11 5210874 5210893 5210877 -
tttaaaattttttgtagaga

SEQ ID NO: 50682 - DNA, 20 bp, Artificial Sequence
  Synthetic oligonucleotide; GGG chr11 5210873 5210892 5210876 -
ttaaaattttttgtagagag

SEQ ID NO: 50683 - DNA, 20 bp, Artificial Sequence
  Synthetic oligonucleotide; AAG chr11 5210854 5210873 5210857 -
ggggtttctccatgttgccc

SEQ ID NO: 50684 - DNA, 20 bp, Artificial Sequence
  Synthetic oligonucleotide; TGG chr11 5210850 5210869 5210853 -
tttctccatgttgcccaagc

SEQ ID NO: 50685 - DNA, 20 bp, Artificial Sequence
  Synthetic oligonucleotide; GAG chr11 5210835 5210854 5210838 -
caagctggtctccaactcct

SEQ ID NO: 50686 - DNA, 20 bp, Artificial Sequence
  Synthetic oligonucleotide; CGG chr11 5210814 5210833 5210817 -
agctcaaatcgttctccctc

SEQ ID NO: 50687 - DNA, 20 bp, Artificial Sequence
  Synthetic oligonucleotide; CGG chr11 5210808 5210827 5210811 -
aatcgttctccctccggcct

SEQ ID NO: 50688 - DNA, 20 bp, Artificial Sequence
  Synthetic oligonucleotide; CAG chr11 5210796 5210815 5210799 -
tccggcctcggctgtgatta

SEQ ID NO: 50689 - DNA, 20 bp, Artificial Sequence
  Synthetic oligonucleotide; AGG chr11 5210795 5210814 5210798 -
ccggcctcggctgtgattac

SEQ ID NO: 50690 - DNA, 20 bp, Artificial Sequence
  Synthetic oligonucleotide; GAG chr11 5210789 5210808 5210792 -
tcggctgtgattacaggtgt

SEQ ID NO: 50691 - DNA, 20 bp, Artificial Sequence
  Synthetic oligonucleotide; TGG chr11 5210776 5210795 5210779 -
caggtgtgagccactgtgct

SEQ ID NO: 50692 - DNA, 20 bp, Artificial Sequence
  Synthetic oligonucleotide; CAG chr11 5210771 5210790 5210774 -
gtgagccactgtgcttggcc

SEQ ID NO: 50693 - DNA, 20 bp, Artificial Sequence
  Synthetic oligonucleotide; GAG chr11 5210732 5210751 5210735 -
ctgttattttctaatccttc

SEQ ID NO: 50694 - DNA, 20 bp, Artificial Sequence
  Synthetic oligonucleotide; AGG chr11 5210731 5210750 5210734 -
tgttattttctaatccttcg

SEQ ID NO: 50695 - DNA, 20 bp, Artificial Sequence
  Synthetic oligonucleotide; AAG chr11 5210723 5210742 5210726 -
tctaatccttcgaggaactc

SEQ ID NO: 50696 - DNA, 20 bp, Artificial Sequence
  Synthetic oligonucleotide; AAG chr11 5210697 5210716 5210700 -
tatcttgaaaactaattcaa

SEQ ID NO: 50697 - DNA, 20 bp, Artificial Sequence
  Synthetic oligonucleotide; AGG chr11 5210696 5210715 5210699 -
atcttgaaaactaattcaaa

SEQ ID NO: 50698 - DNA, 20 bp, Artificial Sequence
  Synthetic oligonucleotide; GAG chr11 5210686 5210705 5210689 -
ctaattcaaaaggtactaac

SEQ ID NO: 50699 - DNA, 20 bp, Artificial Sequence
  Synthetic oligonucleotide; TAG chr11 5210681 5210700 5210684 -
tcaaaaggtactaacgagat

SEQ ID NO: 50700 - DNA, 20 bp, Artificial Sequence
  Synthetic oligonucleotide; AGG chr11 5210680 5210699 5210683 -
caaaaggtactaacgagatt

SEQ ID NO: 50701 - DNA, 20 bp, Artificial Sequence
  Synthetic oligonucleotide; AAG chr11 5210677 5210696 5210680 -
aaggtactaacgagattagg

SEQ ID NO: 50702 - DNA, 20 bp, Artificial Sequence
  Synthetic oligonucleotide; GAG chr11 5210668 5210687 5210671 -
acgagattaggaagtgcccc

SEQ ID NO: 50703 - DNA, 20 bp, Artificial Sequence
  Synthetic oligonucleotide; GAG chr11 5210666 5210685 5210669 -
gagattaggaagtgccccga

SEQ ID NO: 50704 - DNA, 20 bp, Artificial Sequence
  Synthetic oligonucleotide; GAG chr11 5210664 5210683 5210667 -
gattaggaagtgccccgaga

SEQ ID NO: 50705 - DNA, 20 bp, Artificial Sequence
  Synthetic oligonucleotide; TAG chr11 5210657 5210676 5210660 -
aagtgccccgagagagtgca

SEQ ID NO: 50706 - DNA, 20 bp, Artificial Sequence
  Synthetic oligonucleotide; GAG chr11 5210655 5210674 5210658 -
gtgccccgagagagtgcata

SEQ ID NO: 50707 - DNA, 20 bp, Artificial Sequence
  Synthetic oligonucleotide; AGG chr11 5210654 5210673 5210657 -
tgccccgagagagtgcatag

SEQ ID NO: 50708 - DNA, 20 bp, Artificial Sequence
  Synthetic oligonucleotide; GAG chr11 5210652 5210671 5210655 -
ccccgagagagtgcatagag

SEQ ID NO: 50709 - DNA, 20 bp, Artificial Sequence
  Synthetic oligonucleotide; GAG chr11 5210650 5210669 5210653 -
ccgagagagtgcatagagga

SEQ ID NO: 50710 - DNA, 20 bp, Artificial Sequence
  Synthetic oligonucleotide; AGG chr11 5210649 5210668 5210652 -
cgagagagtgcatagaggag

SEQ ID NO: 50711 - DNA, 20 bp, Artificial Sequence
  Synthetic oligonucleotide; GGG chr11 5210648 5210667 5210651 -
gagagagtgcatagaggaga

SEQ ID NO: 50712 - DNA, 20 bp, Artificial Sequence
  Synthetic oligonucleotide; TAG chr11 5210645 5210664 5210648 -
agagtgcatagaggagaggg

SEQ ID NO: 50713 - DNA, 20 bp, Artificial Sequence
  Synthetic oligonucleotide; AAG chr11 5210642 5210661 5210645 -
gtgcatagaggagagggtag

SEQ ID NO: 50714 - DNA, 20 bp, Artificial Sequence
  Synthetic oligonucleotide; AAG chr11 5210637 5210656 5210640 -
tagaggagagggtagaagta

SEQ ID NO: 50715 - DNA, 20 bp, Artificial Sequence
  Synthetic oligonucleotide; TGG chr11 5210633 5210652 5210636 -
ggagagggtagaagtaaagc

SEQ ID NO: 50716 - DNA, 20 bp, Artificial Sequence
  Synthetic oligonucleotide; GGG chr11 5210632 5210651 5210635 -
gagagggtagaagtaaagct

SEQ ID NO: 50717 - DNA, 20 bp, Artificial Sequence
  Synthetic oligonucleotide; TAG chr11 5210619 5210638 5210622 -
taaagctgggtttgctttgt

SEQ ID NO: 50718 - DNA, 20 bp, Artificial Sequence
  Synthetic oligonucleotide; AAG chr11 5210614 5210633 5210617 -
ctgggtttgctttgttagtg

SEQ ID NO: 50719 - DNA, 20 bp, Artificial Sequence
  Synthetic oligonucleotide; AGG chr11 5210613 5210632 5210616 -
tgggtttgctttgttagtga

SEQ ID NO: 50720 - DNA, 20 bp, Artificial Sequence
  Synthetic oligonucleotide; CAG chr11 5210598 5210617 5210601 -
agtgaaggaataaaatgcat

SEQ ID NO: 50721 - DNA, 20 bp, Artificial Sequence
  Synthetic oligonucleotide; GAG chr11 5210596 5210615 5210599 -
tgaaggaataaaatgcatca

SEQ ID NO: 50722 - DNA, 20 bp, Artificial Sequence
  Synthetic oligonucleotide; AGG chr11 5210595 5210614 5210598 -
gaaggaataaaatgcatcag

SEQ ID NO: 50723 - DNA, 20 bp, Artificial Sequence
  Synthetic oligonucleotide; GGG chr11 5210594 5210613 5210597 -
aaggaataaaatgcatcaga

SEQ ID NO: 50724 - DNA, 20 bp, Artificial Sequence
  Synthetic oligonucleotide; CAG chr11 5210581 5210600 5210584 -
catcagagggccgaccttct

SEQ ID NO: 50725 - DNA, 20 bp, Artificial Sequence
  Synthetic oligonucleotide; TAG chr11 5210571 5210590 5210574 -
ccgaccttctcagcctctga

SEQ ID NO: 50726 - DNA, 20 bp, Artificial Sequence
  Synthetic oligonucleotide; AGG chr11 5210570 5210589 5210573 -
cgaccttctcagcctctgat

SEQ ID NO: 50727 - DNA, 20 bp, Artificial Sequence
  Synthetic oligonucleotide; GAG chr11 5210563 5210582 5210566 -
ctcagcctctgataggccct

SEQ ID NO: 50728 - DNA, 20 bp, Artificial Sequence
  Synthetic oligonucleotide; TGG chr11 5210559 5210578 5210562 -
gcctctgataggccctgagc

SEQ ID NO: 50729 - DNA, 20 bp, Artificial Sequence
  Synthetic oligonucleotide; GGG chr11 5210558 5210577 5210561 -
cctctgataggccctgagct

SEQ ID NO: 50730 - DNA, 20 bp, Artificial Sequence
  Synthetic oligonucleotide; GAG chr11 5210556 5210575 5210559 -
tctgataggccctgagctgg

SEQ ID NO: 50731 - DNA, 20 bp, Artificial Sequence
  Synthetic oligonucleotide; AAG chr11 5210548 5210567 5210551 -
gccctgagctgggagctgct

SEQ ID NO: 50732 - DNA, 20 bp, Artificial Sequence
  Synthetic oligonucleotide; CAG chr11 5210537 5210556 5210540 -
ggagctgctaagccatcctg

SEQ ID NO: 50733 - DNA, 20 bp, Artificial Sequence
  Synthetic oligonucleotide; GAG chr11 5210535 5210554 5210538 -
agctgctaagccatcctgca

SEQ ID NO: 50734 - DNA, 20 bp, Artificial Sequence
  Synthetic oligonucleotide; AAG chr11 5210531 5210550 5210534 -
gctaagccatcctgcagagc

SEQ ID NO: 50735 - DNA, 20 bp, Artificial Sequence
  Synthetic oligonucleotide; TGG chr11 5210528 5210547 5210531 -
aagccatcctgcagagcaag

SEQ ID NO: 50736 - DNA, 20 bp, Artificial Sequence
  Synthetic oligonucleotide; GGG chr11 5210527 5210546 5210530 -
agccatcctgcagagcaagt

SEQ ID NO: 50737 - DNA, 20 bp, Artificial Sequence
  Synthetic oligonucleotide; GAG chr11 5210525 5210544 5210528 -
ccatcctgcagagcaagtgg

SEQ ID NO: 50738 - DNA, 20 bp, Artificial Sequence
  Synthetic oligonucleotide; CAG chr11 5210519 5210538 5210522 -
tgcagagcaagtgggagaaa

SEQ ID NO: 50739 - DNA, 20 bp, Artificial Sequence
  Synthetic oligonucleotide; GAG chr11 5210517 5210536 5210520 -
cagagcaagtgggagaaaca

SEQ ID NO: 50740 - DNA, 20 bp, Artificial Sequence
  Synthetic oligonucleotide; AGG chr11 5210516 5210535 5210519 -
agagcaagtgggagaaacag

SEQ ID NO: 50741 - DNA, 20 bp, Artificial Sequence
  Synthetic oligonucleotide; GGG chr11 5210515 5210534 5210518 -
gagcaagtgggagaaacaga

SEQ ID NO: 50742 - DNA, 20 bp, Artificial Sequence
  Synthetic oligonucleotide; TAG chr11 5210509 5210528 5210512 -
gtgggagaaacagagggcat

SEQ ID NO: 50743 - DNA, 20 bp, Artificial Sequence
  Synthetic oligonucleotide; AGG chr11 5210508 5210527 5210511 -
tgggagaaacagagggcatt

SEQ ID NO: 50744 - DNA, 20 bp, Artificial Sequence
  Synthetic oligonucleotide; CAG chr11 5210504 5210523 5210507 -
agaaacagagggcattaggt

SEQ ID NO: 50745 - DNA, 20 bp, Artificial Sequence
  Synthetic oligonucleotide; TGG chr11 5210498 5210517 5210501 -
agagggcattaggtcagact

SEQ ID NO: 50746 - DNA, 20 bp, Artificial Sequence
  Synthetic oligonucleotide; CAG chr11 5210495 5210514 5210498 -
gggcattaggtcagacttgg

SEQ ID NO: 50747 - DNA, 20 bp, Artificial Sequence
  Synthetic oligonucleotide; TGG chr11 5210445 5210464 5210448 -
ccccatccacttgctcattc

SEQ ID NO: 50748 - DNA, 20 bp, Artificial Sequence
  Synthetic oligonucleotide; TGG chr11 5210441 5210460 5210444 -
atccacttgctcattctgga

SEQ ID NO: 50749 - DNA, 20 bp, Artificial Sequence
  Synthetic oligonucleotide; CAG chr11 5210438 5210457 5210441 -
cacttgctcattctggatgg

SEQ ID NO: 50750 - DNA, 20 bp, Artificial Sequence
  Synthetic oligonucleotide; AGG chr11 5210437 5210456 5210440 -
acttgctcattctggatggc

SEQ ID NO: 50751 - DNA, 20 bp, Artificial Sequence
  Synthetic oligonucleotide; TAG chr11 5210432 5210451 5210435 -
ctcattctggatggcaggat

SEQ ID NO: 50752 - DNA, 20 bp, Artificial Sequence
  Synthetic oligonucleotide; AGG chr11 5210431 5210450 5210434 -
tcattctggatggcaggatt

SEQ ID NO: 50753 - DNA, 20 bp, Artificial Sequence
  Synthetic oligonucleotide; TAG chr11 5210407 5210426 5210410 -
tttatatttccctaccatat

SEQ ID NO: 50754 - DNA, 20 bp, Artificial Sequence
  Synthetic oligonucleotide; AAG chr11 5210392 5210411 5210395 -
catattagcttgtgcactta

SEQ ID NO: 50755 - DNA, 20 bp, Artificial Sequence
  Synthetic oligonucleotide; AGG chr11 5210391 5210410 5210394 -
atattagcttgtgcacttaa

SEQ ID NO: 50756 - DNA, 20 bp, Artificial Sequence
  Synthetic oligonucleotide; AAG chr11 5210388 5210407 5210391 -
ttagcttgtgcacttaaagg

SEQ ID NO: 50757 - DNA, 20 bp, Artificial Sequence
  Synthetic oligonucleotide; TAG chr11 5210383 5210402 5210386 -
ttgtgcacttaaaggaagtt

SEQ ID NO: 50758 - DNA, 20 bp, Artificial Sequence
  Synthetic oligonucleotide; TAG chr11 5210379 5210398 5210382 -
gcacttaaaggaagtttaga

SEQ ID NO: 50759 - DNA, 20 bp, Artificial Sequence
  Synthetic oligonucleotide; TGG chr11 5210365 5210384 5210368 -
tttagatagccttgactcca

SEQ ID NO: 50760 - DNA, 20 bp, Artificial Sequence
  Synthetic oligonucleotide; GGG chr11 5210364 5210383 5210367 -
ttagatagccttgactccat

SEQ ID NO: 50761 - DNA, 20 bp, Artificial Sequence
  Synthetic oligonucleotide; GGG chr11 5210363 5210382 5210366 -
tagatagccttgactccatg

SEQ ID NO: 50762 - DNA, 20 bp, Artificial Sequence
  Synthetic oligonucleotide; AAG chr11 5210358 5210377 5210361 -
agccttgactccatggggaa

SEQ ID NO: 50763 - DNA, 20 bp, Artificial Sequence
  Synthetic oligonucleotide; AGG chr11 5210357 5210376 5210360 -
gccttgactccatggggaaa

SEQ ID NO: 50764 - DNA, 20 bp, Artificial Sequence
  Synthetic oligonucleotide; AAG chr11 5210351 5210370 5210354 -
actccatggggaaaaggaaa

SEQ ID NO: 50765 - DNA, 20 bp, Artificial Sequence
  Synthetic oligonucleotide; TAG chr11 5210342 5210361 5210345 -
ggaaaaggaaaaagtacatt

SEQ ID NO: 50766 - DNA, 20 bp, Artificial Sequence
  Synthetic oligonucleotide; TGG chr11 5210339 5210358 5210342 -
aaaggaaaaagtacatttag

SEQ ID NO: 50767 - DNA, 20 bp, Artificial Sequence
  Synthetic oligonucleotide; GGG chr11 5210338 5210357 5210341 -
aaggaaaaagtacatttagt

SEQ ID NO: 50768 - DNA, 20 bp, Artificial Sequence
  Synthetic oligonucleotide; GGG chr11 5210337 5210356 5210340 -
aggaaaaagtacatttagtg

SEQ ID NO: 50769 - DNA, 20 bp, Artificial Sequence
  Synthetic oligonucleotide; TGG chr11 5210332 5210351 5210335 -
aaagtacatttagtggggtg

SEQ ID NO: 50770 - DNA, 20 bp, Artificial Sequence
  Synthetic oligonucleotide; GGG chr11 5210331 5210350 5210334 -
aagtacatttagtggggtgt

SEQ ID NO: 50771 - DNA, 20 bp, Artificial Sequence
  Synthetic oligonucleotide; TGG chr11 5210323 5210342 5210326 -
ttagtggggtgtgggactgt

SEQ ID NO: 50772 - DNA, 20 bp, Artificial Sequence
  Synthetic oligonucleotide; TAG chr11 5210315 5210334 5210318 -
gtgtgggactgttggattat

SEQ ID NO: 50773 - DNA, 20 bp, Artificial Sequence
  Synthetic oligonucleotide; CAG chr11 5210285 5210304 5210288 -
gcatttctctcattctgttc

SEQ ID NO: 50774 - DNA, 20 bp, Artificial Sequence
  Synthetic oligonucleotide; GAG chr11 5210280 5210299 5210283 -
tctctcattctgttccagtt

SEQ ID NO: 50775 - DNA, 20 bp, Artificial Sequence
  Synthetic oligonucleotide; AGG chr11 5210279 5210298 5210282 -
ctctcattctgttccagttg

SEQ ID NO: 50776 - DNA, 20 bp, Artificial Sequence
  Synthetic oligonucleotide; CAG chr11 5210275 5210294 5210278 -
cattctgttccagttgaggc

SEQ ID NO: 50777 - DNA, 20 bp, Artificial Sequence
  Synthetic oligonucleotide; TAG chr11 5210260 5210279 5210263 -
gaggccagcttgcttcccac

SEQ ID NO: 50778 - DNA, 20 bp, Artificial Sequence
  Synthetic oligonucleotide; AAG chr11 5210257 5210276 5210260 -
gccagcttgcttcccactag

SEQ ID NO: 50779 - DNA, 20 bp, Artificial Sequence
  Synthetic oligonucleotide; TAG chr11 5210228 5210247 5210231 -
tgttctctttatacaattcc

SEQ ID NO: 50780 - DNA, 20 bp, Artificial Sequence
  Synthetic oligonucleotide; AAG chr11 5210223 5210242 5210226 -
tctttatacaattcctagtc

SEQ ID NO: 50781 - DNA, 20 bp, Artificial Sequence
  Synthetic oligonucleotide; TAG chr11 5210220 5210239 5210223 -
ttatacaattcctagtcaag

SEQ ID NO: 50782 - DNA, 20 bp, Artificial Sequence
  Synthetic oligonucleotide; AGG chr11 5210219 5210238 5210222 -
tatacaattcctagtcaagt

SEQ ID NO: 50783 - DNA, 20 bp, Artificial Sequence
  Synthetic oligonucleotide; GGG chr11 5210218 5210237 5210221 -
atacaattcctagtcaagta

SEQ ID NO: 50784 - DNA, 20 bp, Artificial Sequence
  Synthetic oligonucleotide; GGG chr11 5210217 5210236 5210220 -
tacaattcctagtcaagtag

SEQ ID NO: 50785 - DNA, 20 bp, Artificial Sequence
  Synthetic oligonucleotide; AAG chr11 5210210 5210229 5210213 -
cctagtcaagtaggggcaaa

SEQ ID NO: 50786 - DNA, 20 bp, Artificial Sequence
  Synthetic oligonucleotide; TGG chr11 5210183 5210202 5210186 -
ttcatttattattgtttttc

SEQ ID NO: 50787 - DNA, 20 bp, Artificial Sequence
  Synthetic oligonucleotide; GGG chr11 5210182 5210201 5210185 -
tcatttattattgtttttct

SEQ ID NO: 50788 - DNA, 20 bp, Artificial Sequence
  Synthetic oligonucleotide; TAG chr11 5210176 5210195 5210179 -
attattgtttttctgggatg

SEQ ID NO: 50789 - DNA, 20 bp, Artificial Sequence
  Synthetic oligonucleotide; CAG chr11 5210172 5210191 5210175 -
ttgtttttctgggatgtagc

SEQ ID NO: 50790 - DNA, 20 bp, Artificial Sequence
  Synthetic oligonucleotide; AGG chr11 5210171 5210190 5210174 -
tgtttttctgggatgtagcc

SEQ ID NO: 50791 - DNA, 20 bp, Artificial Sequence
  Synthetic oligonucleotide; GAG chr11 5210169 5210188 5210172 -
tttttctgggatgtagccag

SEQ ID NO: 50792 - DNA, 20 bp, Artificial Sequence
  Synthetic oligonucleotide; TGG chr11 5210152 5210171 5210155 -
caggagcaatttaaacttgc

SEQ ID NO: 50793 - DNA, 20 bp, Artificial Sequence
  Synthetic oligonucleotide; GAG chr11 5210150 5210169 5210153 -
ggagcaatttaaacttgctg

SEQ ID NO: 50794 - DNA, 20 bp, Artificial Sequence
  Synthetic oligonucleotide; GAG chr11 5210125 5210144 5210128 -
caatttcttcaactacaaat

SEQ ID NO: 50795 - DNA, 20 bp, Artificial Sequence
  Synthetic oligonucleotide; CAG chr11 5210111 5210130 5210114 -
acaaatgagaataataataa

SEQ ID NO: 50796 - DNA, 20 bp, Artificial Sequence
  Synthetic oligonucleotide; AGG chr11 5210110 5210129 5210113 -
caaatgagaataataataac

SEQ ID NO: 50797 - DNA, 20 bp, Artificial Sequence
  Synthetic oligonucleotide; CAG chr11 5210084 5210103 5210087 -
acgaactaattgtaataata

SEQ ID NO: 50798 - DNA, 20 bp, Artificial Sequence
  Synthetic oligonucleotide; AAG chr11 5210062 5210081 5210065 -
gaactaaatgtaaatataca

SEQ ID NO: 50799 - DNA, 20 bp, Artificial Sequence
  Synthetic oligonucleotide; AGG chr11 5210061 5210080 5210064 -
aactaaatgtaaatatacaa

SEQ ID NO: 50800 - DNA, 20 bp, Artificial Sequence
  Synthetic oligonucleotide; TGG chr11 5210044 5210063 5210047 -
caaaggataaattcaaaatc

SEQ ID NO: 50801 - DNA, 20 bp, Artificial Sequence
  Synthetic oligonucleotide; GGG chr11 5210043 5210062 5210046 -
aaaggataaattcaaaatct

SEQ ID NO: 50802 - DNA, 20 bp, Artificial Sequence
  Synthetic oligonucleotide; CAG chr11 5210034 5210053 5210037 -
attcaaaatctgggcacatg

SEQ ID NO: 50803 - DNA, 20 bp, Artificial Sequence
  Synthetic oligonucleotide; AGG chr11 5210033 5210052 5210036 -
ttcaaaatctgggcacatgc

SEQ ID NO: 50804 - DNA, 20 bp, Artificial Sequence
  Synthetic oligonucleotide; AAG chr11 5210023 5210042 5210026 -
gggcacatgcaggctgctat

SEQ ID NO: 50805 - DNA, 20 bp, Artificial Sequence
  Synthetic oligonucleotide; GAG chr11 5210021 5210040 5210024 -
gcacatgcaggctgctataa

SEQ ID NO: 50806 - DNA, 20 bp, Artificial Sequence
  Synthetic oligonucleotide; TAG chr11 5210000 5210019 5210003 -
agaaaacatctatgatatta

SEQ ID NO: 50807 - DNA, 20 bp, Artificial Sequence
  Synthetic oligonucleotide; AGG chr11 5209999 5210018 5210002 -
gaaaacatctatgatattat

SEQ ID NO: 50808 - DNA, 20 bp, Artificial Sequence
  Synthetic oligonucleotide; TAG chr11 5209974 5209993 5209977 -
gaccaaatgacattaaatta

SEQ ID NO: 50809 - DNA, 20 bp, Artificial Sequence
  Synthetic oligonucleotide; TGG chr11 5209971 5209990 5209974 -
caaatgacattaaattatag

SEQ ID NO: 50810 - DNA, 20 bp, Artificial Sequence
  Synthetic oligonucleotide; GGG chr11 5209970 5209989 5209973 -
aaatgacattaaattatagt

SEQ ID NO: 50811 - DNA, 20 bp, Artificial Sequence
  Synthetic oligonucleotide; GGG chr11 5209969 5209988 5209972 -
aatgacattaaattatagtg

SEQ ID NO: 50812 - DNA, 20 bp, Artificial Sequence
  Synthetic oligonucleotide; GAG chr11 5209967 5209986 5209970 -
tgacattaaattatagtggg

SEQ ID NO: 50813 - DNA, 20 bp, Artificial Sequence
  Synthetic oligonucleotide; AGG chr11 5209966 5209985 5209969 -
gacattaaattatagtgggg

SEQ ID NO: 50814 - DNA, 20 bp, Artificial Sequence
  Synthetic oligonucleotide; CAG chr11 5209959 5209978 5209962 -
aattatagtggggaggtaaa

SEQ ID NO: 50815 - DNA, 20 bp, Artificial Sequence
  Synthetic oligonucleotide; AGG chr11 5209958 5209977 5209961 -
attatagtggggaggtaaac

SEQ ID NO: 50816 - DNA, 20 bp, Artificial Sequence
  Synthetic oligonucleotide; TGG chr11 5209954 5209973 5209957 -
tagtggggaggtaaacaggt

SEQ ID NO: 50817 - DNA, 20 bp, Artificial Sequence
  Synthetic oligonucleotide; CAG chr11 5209951 5209970 5209954 -
tggggaggtaaacaggttgg

SEQ ID NO: 50818 - DNA, 20 bp, Artificial Sequence
  Synthetic oligonucleotide; AAG chr11 5209939 5209958 5209942 -
caggttggcagtgtatttta

SEQ ID NO: 50819 - DNA, 20 bp, Artificial Sequence
  Synthetic oligonucleotide; TAG chr11 5209911 5209930 5209914 -
catatgcatattttatgacc

SEQ ID NO: 50820 - DNA, 20 bp, Artificial Sequence
  Synthetic oligonucleotide; CAG chr11 5209901 5209920 5209904 -
ttttatgacctagcaattta

SEQ ID NO: 50821 - DNA, 20 bp, Artificial Sequence
  Synthetic oligonucleotide; AAG chr11 5209877 5209896 5209880 -
atatatatacaaaaatatat

SEQ ID NO: 50822 - DNA, 20 bp, Artificial Sequence
  Synthetic oligonucleotide; TAG chr11 5209866 5209885 5209869 -
aaaatatataagaatcttca

SEQ ID NO: 50823 - DNA, 20 bp, Artificial Sequence
  Synthetic oligonucleotide; CAG chr11 5209863 5209882 5209866 -
atatataagaatcttcatag

SEQ ID NO: 50824 - DNA, 20 bp, Artificial Sequence
  Synthetic oligonucleotide; TAG chr11 5209848 5209867 5209851 -
catagcagcaatttatatta

SEQ ID NO: 50825 - DNA, 20 bp, Artificial Sequence
  Synthetic oligonucleotide; AAG chr11 5209841 5209860 5209844 -
gcaatttatattatagccaa

SEQ ID NO: 50826 - DNA, 20 bp, Artificial Sequence
  Synthetic oligonucleotide; TAG chr11 5209837 5209856 5209840 -
tttatattatagccaaaagc

SEQ ID NO: 50827 - DNA, 20 bp, Artificial Sequence
  Synthetic oligonucleotide; AAG chr11 5209834 5209853 5209837 -
atattatagccaaaagctag

SEQ ID NO: 50828 - DNA, 20 bp, Artificial Sequence
  Synthetic oligonucleotide; AGG chr11 5209833 5209852 5209836 -
tattatagccaaaagctaga

SEQ ID NO: 50829 - DNA, 20 bp, Artificial Sequence
  Synthetic oligonucleotide; TGG chr11 5209809 5209828 5209812 -
actcaaatatctatcaactg

SEQ ID NO: 50830 - DNA, 20 bp, Artificial Sequence
  Synthetic oligonucleotide; GAG chr11 5209807 5209826 5209810 -
tcaaatatctatcaactgtg

SEQ ID NO: 50831 - DNA, 20 bp, Artificial Sequence
  Synthetic oligonucleotide; TGG chr11 5209789 5209808 5209792 -
tggagtcaataaatatattg

SEQ ID NO: 50832 - DNA, 20 bp, Artificial Sequence
  Synthetic oligonucleotide; TAG chr11 5209773 5209792 5209776 -
attgtggtatatacataaaa

SEQ ID NO: 50833 - DNA, 20 bp, Artificial Sequence
  Synthetic oligonucleotide; CAG chr11 5209761 5209780 5209764 -
acataaaatagaatgacatt

SEQ ID NO: 50834 - DNA, 20 bp, Artificial Sequence
  Synthetic oligonucleotide; CAG chr11 5209741 5209760 5209744 -
cagaaatgaaaaatcaacta

SEQ ID NO: 50835 - DNA, 20 bp, Artificial Sequence
  Synthetic oligonucleotide; TAG chr11 5209730 5209749 5209733 -
aatcaactacagtcatacac

SEQ ID NO: 50836 - DNA, 20 bp, Artificial Sequence
  Synthetic oligonucleotide; AAG chr11 5209694 5209713 5209697 -
cacaaacataatattgaata

SEQ ID NO: 50837 - DNA, 20 bp, Artificial Sequence
  Synthetic oligonucleotide; CAG chr11 5209690 5209709 5209693 -
aacataatattgaataaagt

SEQ ID NO: 50838 - DNA, 20 bp, Artificial Sequence
  Synthetic oligonucleotide; AAG chr11 5209683 5209702 5209686 -
tattgaataaagtcagacat

SEQ ID NO: 50839 - DNA, 20 bp, Artificial Sequence
  Synthetic oligonucleotide; CAG chr11 5209675 5209694 5209678 -
aaagtcagacataagcaaca

SEQ ID NO: 50840 - DNA, 20 bp, Artificial Sequence
  Synthetic oligonucleotide; AAG chr11 5209642 5209661 5209645 -
tgtatacacacttttaaaaa

SEQ ID NO: 50841 - DNA, 20 bp, Artificial Sequence
  Synthetic oligonucleotide; AGG chr11 5209641 5209660 5209644 -
gtatacacacttttaaaaaa

SEQ ID NO: 50842 - DNA, 20 bp, Artificial Sequence
  Synthetic oligonucleotide; GGG chr11 5209640 5209659 5209643 -
tatacacacttttaaaaaaa

SEQ ID NO: 50843 - DNA, 20 bp, Artificial Sequence
  Synthetic oligonucleotide; GAG chr11 5209633 5209652 5209636 -
acttttaaaaaaagggacat

SEQ ID NO: 50844 - DNA, 20 bp, Artificial Sequence
  Synthetic oligonucleotide; CAG chr11 5209604 5209623 5209607 -
gtgataaaaatgaattatat

SEQ ID NO: 50845 - DNA, 20 bp, Artificial Sequence
  Synthetic oligonucleotide; AGG chr11 5209603 5209622 5209606 -
tgataaaaatgaattatatc

SEQ ID NO: 50846 - DNA, 20 bp, Artificial Sequence
  Synthetic oligonucleotide; TGG chr11 5209586 5209605 5209589 -
atcaggataattattaactt

SEQ ID NO: 50847 - DNA, 20 bp, Artificial Sequence
  Synthetic oligonucleotide; GAG chr11 5209584 5209603 5209587 -
caggataattattaactttg

SEQ ID NO: 50848 - DNA, 20 bp, Artificial Sequence
  Synthetic oligonucleotide; TAG chr11 5209576 5209595 5209579 -
ttattaactttggagacaat

SEQ ID NO: 50849 - DNA, 20 bp, Artificial Sequence
  Synthetic oligonucleotide; TGG chr11 5209573 5209592 5209576 -
ttaactttggagacaattag

SEQ ID NO: 50850 - DNA, 20 bp, Artificial Sequence
  Synthetic oligonucleotide; AAG chr11 5209563 5209582 5209566 -
agacaattagtggaatgata

SEQ ID NO: 50851 - DNA, 20 bp, Artificial Sequence
  Synthetic oligonucleotide; GAG chr11 5209561 5209580 5209564 -
acaattagtggaatgataaa

SEQ ID NO: 50852 - DNA, 20 bp, Artificial Sequence
  Synthetic oligonucleotide; GAG chr11 5209557 5209576 5209560 -
ttagtggaatgataaagagt

SEQ ID NO: 50853 - DNA, 20 bp, Artificial Sequence
  Synthetic oligonucleotide; TAG chr11 5209523 5209542 5209526 -
tctttaatttcctatcttat

SEQ ID NO: 50854 - DNA, 20 bp, Artificial Sequence
  Synthetic oligonucleotide; TGG chr11 5209512 5209531 5209515 -
ctatcttattagttgttaca

SEQ ID NO: 50855 - DNA, 20 bp, Artificial Sequence
  Synthetic oligonucleotide; GGG chr11 5209511 5209530 5209514 -
tatcttattagttgttacat

SEQ ID NO: 50856 - DNA, 20 bp, Artificial Sequence
  Synthetic oligonucleotide; AAG chr11 5209492 5209511 5209495 -
tgggtgtgttcaccttccaa

SEQ ID NO: 50857 - DNA, 20 bp, Artificial Sequence
  Synthetic oligonucleotide; CAG chr11 5209483 5209502 5209486 -
tcaccttccaaaagttaatt

SEQ ID NO: 50858 - DNA, 20 bp, Artificial Sequence
  Synthetic oligonucleotide; TAG chr11 5209409 5209428 5209412 -
attaaaataaaaactaaatt

SEQ ID NO: 50859 - DNA, 20 bp, Artificial Sequence
  Synthetic oligonucleotide; TGG chr11 5209395 5209414 5209398 -
taaatttagaaactaaacaa

SEQ ID NO: 50860 - DNA, 20 bp, Artificial Sequence
  Synthetic oligonucleotide; AAG chr11 5209388 5209407 5209391 -
agaaactaaacaatggaaaa

SEQ ID NO: 50861 - DNA, 20 bp, Artificial Sequence
  Synthetic oligonucleotide; CAG chr11 5209384 5209403 5209387 -
actaaacaatggaaaaaagt

SEQ ID NO: 50862 - DNA, 20 bp, Artificial Sequence
  Synthetic oligonucleotide; AAG chr11 5209363 5209382 5209366 -
agaccatttctttgcatttc

SEQ ID NO: 50863 - DNA, 20 bp, Artificial Sequence
  Synthetic oligonucleotide; AAG chr11 5209360 5209379 5209363 -
ccatttctttgcatttcaag

SEQ ID NO: 50864 - DNA, 20 bp, Artificial Sequence
  Synthetic oligonucleotide; GAG chr11 5209345 5209364 5209348 -
tcaagaagtgcatactaact

SEQ ID NO: 50865 - DNA, 20 bp, Artificial Sequence
  Synthetic oligonucleotide; TGG chr11 5209326 5209345 5209329 -
tgagatattacattcttaaa

SEQ ID NO: 50866 - DNA, 20 bp, Artificial Sequence
  Synthetic oligonucleotide; TAG chr11 5209320 5209339 5209323 -
attacattcttaaatggctt

SEQ ID NO: 50867 - DNA, 20 bp, Artificial Sequence
  Synthetic oligonucleotide; TAG chr11 5209312 5209331 5209315 -
cttaaatggctttagtcaat

SEQ ID NO: 50868 - DNA, 20 bp, Artificial Sequence
  Synthetic oligonucleotide; AGG chr11 5209311 5209330 5209314 -
ttaaatggctttagtcaatt

SEQ ID NO: 50869 - DNA, 20 bp, Artificial Sequence
  Synthetic oligonucleotide; TAG chr11 5209268 5209287 5209271 -
taaacatttgcttctaaatc

SEQ ID NO: 50870 - DNA, 20 bp, Artificial Sequence
  Synthetic oligonucleotide; AGG chr11 5209267 5209286 5209270 -
aaacatttgcttctaaatct

SEQ ID NO: 50871 - DNA, 20 bp, Artificial Sequence
  Synthetic oligonucleotide; TAG chr11 5209264 5209283 5209267 -
catttgcttctaaatctagg

SEQ ID NO: 50872 - DNA, 20 bp, Artificial Sequence
  Synthetic oligonucleotide; AAG chr11 5209244 5209263 5209247 -
tagactgtcttaacttcctg

SEQ ID NO: 50873 - DNA, 20 bp, Artificial Sequence
  Synthetic oligonucleotide; AAG chr11 5209241 5209260 5209244 -
actgtcttaacttcctgaag

SEQ ID NO: 50874 - DNA, 20 bp, Artificial Sequence
  Synthetic oligonucleotide; GAG chr11 5209239 5209258 5209242 -
tgtcttaacttcctgaagaa

SEQ ID NO: 50875 - DNA, 20 bp, Artificial Sequence
  Synthetic oligonucleotide; AGG chr11 5209238 5209257 5209241 -
gtcttaacttcctgaagaag

SEQ ID NO: 50876 - DNA, 20 bp, Artificial Sequence
  Synthetic oligonucleotide; GGG chr11 5209237 5209256 5209240 -
tcttaacttcctgaagaaga

SEQ ID NO: 50877 - DNA, 20 bp, Artificial Sequence
  Synthetic oligonucleotide; AAG chr11 5209234 5209253 5209237 -
taacttcctgaagaagaggg

SEQ ID NO: 50878 - DNA, 20 bp, Artificial Sequence
  Synthetic oligonucleotide; AAG chr11 5209219 5209238 5209222 -
gagggaagaaataatgaaaa

SEQ ID NO: 50879 - DNA, 20 bp, Artificial Sequence
  Synthetic oligonucleotide; AGG chr11 5209218 5209237 5209221 -
agggaagaaataatgaaaaa

SEQ ID NO: 50880 - DNA, 20 bp, Artificial Sequence
  Synthetic oligonucleotide; CAG chr11 5209208 5209227 5209211 -
taatgaaaaaaggaaaataa

SEQ ID NO: 50881 - DNA, 20 bp, Artificial Sequence
  Synthetic oligonucleotide; TAG chr11 5209198 5209217 5209201 -
aggaaaataacagaaatacc

SEQ ID NO: 50882 - DNA, 20 bp, Artificial Sequence
  Synthetic oligonucleotide; GAG chr11 5209196 5209215 5209199 -
gaaaataacagaaataccta

SEQ ID NO: 50883 - DNA, 20 bp, Artificial Sequence
  Synthetic oligonucleotide; AGG chr11 5209195 5209214 5209198 -
aaaataacagaaatacctag

SEQ ID NO: 50884 - DNA, 20 bp, Artificial Sequence
  Synthetic oligonucleotide; GAG chr11 5209193 5209212 5209196 -
aataacagaaatacctagag

SEQ ID NO: 50885 - DNA, 20 bp, Artificial Sequence
  Synthetic oligonucleotide; AGG chr11 5209192 5209211 5209195 -
ataacagaaatacctagagg

SEQ ID NO: 50886 - DNA, 20 bp, Artificial Sequence
  Synthetic oligonucleotide; GGG chr11 5209191 5209210 5209194 -
taacagaaatacctagagga

SEQ ID NO: 50887 - DNA, 20 bp, Artificial Sequence
  Synthetic oligonucleotide; AAG chr11 5209181 5209200 5209184 -
acctagaggagggaaataaa

SEQ ID NO: 50888 - DNA, 20 bp, Artificial Sequence
  Synthetic oligonucleotide; TAG chr11 5209176 5209195 5209179 -
gaggagggaaataaaaagcc

SEQ ID NO: 50889 - DNA, 20 bp, Artificial Sequence
  Synthetic oligonucleotide; AGG chr11 5209175 5209194 5209178 -
aggagggaaataaaaagcct

SEQ ID NO: 50890 - DNA, 20 bp, Artificial Sequence
  Synthetic oligonucleotide; AAG chr11 5209171 5209190 5209174 -
gggaaataaaaagcctagga

SEQ ID NO: 50891 - DNA, 20 bp, Artificial Sequence
  Synthetic oligonucleotide; AAG chr11 5209159 5209178 5209162 -
gcctaggaaagcaacatgaa

SEQ ID NO: 50892 - DNA, 20 bp, Artificial Sequence
  Synthetic oligonucleotide; TGG chr11 5209155 5209174 5209158 -
aggaaagcaacatgaaaaga

SEQ ID NO: 50893 - DNA, 20 bp, Artificial Sequence
  Synthetic oligonucleotide; TGG chr11 5209145 5209164 5209148 -
catgaaaagatggtgctctc

SEQ ID NO: 50894 - DNA, 20 bp, Artificial Sequence
  Synthetic oligonucleotide; GAG chr11 5209125 5209144 5209128 -
tggtacatcctgtgcttcct

SEQ ID NO: 50895 - DNA, 20 bp, Artificial Sequence
  Synthetic oligonucleotide; TGG chr11 5209090 5209109 5209093 -
gtcttttacacacactgtct

SEQ ID NO: 50896 - DNA, 20 bp, Artificial Sequence
  Synthetic oligonucleotide; GGG chr11 5209089 5209108 5209092 -
tcttttacacacactgtctt

SEQ ID NO: 50897 - DNA, 20 bp, Artificial Sequence
  Synthetic oligonucleotide; TGG chr11 5209085 5209104 5209088 -
ttacacacactgtcttggga

SEQ ID NO: 50898 - DNA, 20 bp, Artificial Sequence
  Synthetic oligonucleotide; GGG chr11 5209084 5209103 5209087 -
tacacacactgtcttgggat

SEQ ID NO: 50899 - DNA, 20 bp, Artificial Sequence
  Synthetic oligonucleotide; AAG chr11 5209077 5209096 5209080 -
actgtcttgggatgggcatt

SEQ ID NO: 50900 - DNA, 20 bp, Artificial Sequence
  Synthetic oligonucleotide; AGG chr11 5209076 5209095 5209079 -
ctgtcttgggatgggcatta

SEQ ID NO: 50901 - DNA, 20 bp, Artificial Sequence
  Synthetic oligonucleotide; TAG chr11 5209068 5209087 5209071 -
ggatgggcattaaggtgttg

SEQ ID NO: 50902 - DNA, 20 bp, Artificial Sequence
  Synthetic oligonucleotide; CAG chr11 5209060 5209079 5209063 -
attaaggtgttgtagctact

SEQ ID NO: 50903 - DNA, 20 bp, Artificial Sequence
  Synthetic oligonucleotide; TAG chr11 5209056 5209075 5209059 -
aggtgttgtagctactcagc

SEQ ID NO: 50904 - DNA, 20 bp, Artificial Sequence
  Synthetic oligonucleotide; AAG chr11 5209052 5209071 5209055 -
gttgtagctactcagctagt

SEQ ID NO: 50905 - DNA, 20 bp, Artificial Sequence
  Synthetic oligonucleotide; TAG chr11 5209049 5209068 5209052 -
gtagctactcagctagtaag

SEQ ID NO: 50906 - DNA, 20 bp, Artificial Sequence
  Synthetic oligonucleotide; GAG chr11 5209044 5209063 5209047 -
tactcagctagtaagtagct

SEQ ID NO: 50907 - DNA, 20 bp, Artificial Sequence
  Synthetic oligonucleotide; AAG chr11 5209039 5209058 5209042 -
agctagtaagtagctgagct

SEQ ID NO: 50908 - DNA, 20 bp, Artificial Sequence
  Synthetic oligonucleotide; AAG chr11 5209021 5209040 5209024 -
ctaagattctttcaattcca

SEQ ID NO: 50909 - DNA, 20 bp, Artificial Sequence
  Synthetic oligonucleotide; CAG chr11 5209017 5209036 5209020 -
gattctttcaattccaaagt

SEQ ID NO: 50910 - DNA, 20 bp, Artificial Sequence
  Synthetic oligonucleotide; CAG chr11 5209014 5209033 5209017 -
tctttcaattccaaagtcag

SEQ ID NO: 50911 - DNA, 20 bp, Artificial Sequence
  Synthetic oligonucleotide; TGG chr11 5208998 5209017 5209001 -
tcagcagtgtcttcactaca

SEQ ID NO: 50912 - DNA, 20 bp, Artificial Sequence
  Synthetic oligonucleotide; AAG chr11 5208986 5209005 5208989 -
tcactacatggtactatgtc

SEQ ID NO: 50913 - DNA, 20 bp, Artificial Sequence
  Synthetic oligonucleotide; AAG chr11 5208982 5209001 5208985 -
tacatggtactatgtcaaga

SEQ ID NO: 50914 - DNA, 20 bp, Artificial Sequence
  Synthetic oligonucleotide; GAG chr11 5208980 5208999 5208983 -
catggtactatgtcaagaaa

SEQ ID NO: 50915 - DNA, 20 bp, Artificial Sequence
  Synthetic oligonucleotide; AAG chr11 5208964 5208983 5208967 -
gaaagagaaactccactaaa

SEQ ID NO: 50916 - DNA, 20 bp, Artificial Sequence
  Synthetic oligonucleotide; TAG chr11 5208943 5208962 5208946 -
agaacttcattgctctctgt

SEQ ID NO: 50917 - DNA, 20 bp, Artificial Sequence
  Synthetic oligonucleotide; AGG chr11 5208942 5208961 5208945 -
gaacttcattgctctctgtt

SEQ ID NO: 50918 - DNA, 20 bp, Artificial Sequence
  Synthetic oligonucleotide; GGG chr11 5208941 5208960 5208944 -
aacttcattgctctctgtta

SEQ ID NO: 50919 - DNA, 20 bp, Artificial Sequence
  Synthetic oligonucleotide; TGG chr11 5208924 5208943 5208927 -
ttagggatacattaacattt

SEQ ID NO: 50920 - DNA, 20 bp, Artificial Sequence
  Synthetic oligonucleotide; GGG chr11 5208923 5208942 5208926 -
tagggatacattaacatttt

SEQ ID NO: 50921 - DNA, 20 bp, Artificial Sequence
  Synthetic oligonucleotide; TAG chr11 5208898 5208917 5208901 -
atgaaaaaaaaatgttacaa

SEQ ID NO: 50922 - DNA, 20 bp, Artificial Sequence
  Synthetic oligonucleotide; CAG chr11 5208891 5208910 5208894 -
aaaaatgttacaatagctta

SEQ ID NO: 50923 - DNA, 20 bp, Artificial Sequence
  Synthetic oligonucleotide; AGG chr11 5208890 5208909 5208893 -
aaaatgttacaatagcttac

SEQ ID NO: 50924 - DNA, 20 bp, Artificial Sequence
  Synthetic oligonucleotide; TGG chr11 5208865 5208884 5208868 -
acctccacttatatgaccta

SEQ ID NO: 50925 - DNA, 20 bp, Artificial Sequence
  Synthetic oligonucleotide; CAG chr11 5208850 5208869 5208853 -
acctatggacctcttaaact

SEQ ID NO: 50926 - DNA, 20 bp, Artificial Sequence
  Synthetic oligonucleotide; GAG chr11 5208846 5208865 5208849 -
atggacctcttaaactcagc

SEQ ID NO: 50927 - DNA, 20 bp, Artificial Sequence
  Synthetic oligonucleotide; AAG chr11 5208838 5208857 5208841 -
cttaaactcagcgagttgaa

SEQ ID NO: 50928 - DNA, 20 bp, Artificial Sequence
  Synthetic oligonucleotide; TAG chr11 5208834 5208853 5208837 -
aactcagcgagttgaaaaga

SEQ ID NO: 50929 - DNA, 20 bp, Artificial Sequence
  Synthetic oligonucleotide; CAG chr11 5208810 5208829 5208813 -
aaattatcctccacttcttt

SEQ ID NO: 50930 - DNA, 20 bp, Artificial Sequence
  Synthetic oligonucleotide; TGG chr11 5208778 5208797 5208781 -
atgcttccaaacttgatgaa

SEQ ID NO: 50931 - DNA, 20 bp, Artificial Sequence
  Synthetic oligonucleotide; CAG chr11 5208769 5208788 5208772 -
aacttgatgaatggttcact

SEQ ID NO: 50932 - DNA, 20 bp, Artificial Sequence
  Synthetic oligonucleotide; AAG chr11 5208760 5208779 5208763 -
aatggttcactcagatttcc

SEQ ID NO: 50933 - DNA, 20 bp, Artificial Sequence
  Synthetic oligonucleotide; TAG chr11 5208674 5208693 5208677 -
aataatcaatttctcacaac

SEQ ID NO: 50934 - DNA, 20 bp, Artificial Sequence
  Synthetic oligonucleotide; TAG chr11 5208650 5208669 5208653 -
attattatcataaatactga

SEQ ID NO: 50935 - DNA, 20 bp, Artificial Sequence
  Synthetic oligonucleotide; GAG chr11 5208642 5208661 5208645 -
cataaatactgatagctttt

SEQ ID NO: 50936 - DNA, 20 bp, Artificial Sequence
  Synthetic oligonucleotide; TGG chr11 5208639 5208658 5208642 -
aaatactgatagcttttgag

SEQ ID NO: 50937 - DNA, 20 bp, Artificial Sequence
  Synthetic oligonucleotide; CAG chr11 5208636 5208655 5208639 -
tactgatagcttttgagtgg

SEQ ID NO: 50938 - DNA, 20 bp, Artificial Sequence
  Synthetic oligonucleotide; GAG chr11 5208628 5208647 5208631 -
gcttttgagtggcagataat

SEQ ID NO: 50939 - DNA, 20 bp, Artificial Sequence
  Synthetic oligonucleotide; CAG chr11 5208577 5208596 5208580 -
caatatttttaaaaattgtg

SEQ ID NO: 50940 - DNA, 20 bp, Artificial Sequence
  Synthetic oligonucleotide; AAG chr11 5208572 5208591 5208575 -
tttttaaaaattgtgcagct

SEQ ID NO: 50941 - DNA, 20 bp, Artificial Sequence
  Synthetic oligonucleotide; GAG chr11 5208565 5208584 5208568 -
aaattgtgcagctaagtgtt

SEQ ID NO: 50942 - DNA, 20 bp, Artificial Sequence
  Synthetic oligonucleotide; AAG chr11 5208545 5208564 5208548 -
gagctaaaaattatatacct

SEQ ID NO: 50943 - DNA, 20 bp, Artificial Sequence
  Synthetic oligonucleotide; AAG chr11 5208529 5208548 5208532 -
acctaagaaatgacaaaacc

SEQ ID NO: 50944 - DNA, 20 bp, Artificial Sequence
  Synthetic oligonucleotide; CAG chr11 5208517 5208536 5208520 -
acaaaaccaagatttgaaac

SEQ ID NO: 50945 - DNA, 20 bp, Artificial Sequence
  Synthetic oligonucleotide; CAG chr11 5208503 5208522 5208506 -
tgaaaccagttctcactgac

SEQ ID NO: 50946 - DNA, 20 bp, Artificial Sequence
  Synthetic oligonucleotide; AAG chr11 5208500 5208519 5208503 -
aaccagttctcactgaccag

SEQ ID NO: 50947 - DNA, 20 bp, Artificial Sequence
  Synthetic oligonucleotide; CAG chr11 5208487 5208506 5208490 -
tgaccagaagatcattcttt

SEQ ID NO: 50948 - DNA, 20 bp, Artificial Sequence
  Synthetic oligonucleotide; AAG chr11 5208482 5208501 5208485 -
agaagatcattctttcagct

SEQ ID NO: 50949 - DNA, 20 bp, Artificial Sequence
  Synthetic oligonucleotide; AGG chr11 5208481 5208500 5208484 -
gaagatcattctttcagcta

SEQ ID NO: 50950 - DNA, 20 bp, Artificial Sequence
  Synthetic oligonucleotide; GAG chr11 5208479 5208498 5208482 -
agatcattctttcagctaag

SEQ ID NO: 50951 - DNA, 20 bp, Artificial Sequence
  Synthetic oligonucleotide; TAG chr11 5208456 5208475 5208459 -
ctaattactgcgttccttca

SEQ ID NO: 50952 - DNA, 20 bp, Artificial Sequence
  Synthetic oligonucleotide; CAG chr11 5208437 5208456 5208440 -
atagtttttttttttcctct

SEQ ID NO: 50953 - DNA, 20 bp, Artificial Sequence
  Synthetic oligonucleotide; AGG chr11 5208436 5208455 5208439 -
tagtttttttttttcctctc

SEQ ID NO: 50954 - DNA, 20 bp, Artificial Sequence
  Synthetic oligonucleotide; TGG chr11 5208409 5208428 5208412 -
ccctgaaatatgcattttct

SEQ ID NO: 50955 - DNA, 20 bp, Artificial Sequence
  Synthetic oligonucleotide; CGG chr11 5208348 5208367 5208351 -
gcccttcaataacttctaac

SEQ ID NO: 50956 - DNA, 20 bp, Artificial Sequence
  Synthetic oligonucleotide; TGG chr11 5208316 5208335 5208319 -
cctatttgtgtcttgcaaca

SEQ ID NO: 50957 - DNA, 20 bp, Artificial Sequence
  Synthetic oligonucleotide; GGG chr11 5208315 5208334 5208318 -
ctatttgtgtcttgcaacat

SEQ ID NO: 50958 - DNA, 20 bp, Artificial Sequence
  Synthetic oligonucleotide; TAG chr11 5208308 5208327 5208311 -
tgtcttgcaacatgggataa

SEQ ID NO: 50959 - DNA, 20 bp, Artificial Sequence
  Synthetic oligonucleotide; AGG chr11 5208307 5208326 5208310 -
gtcttgcaacatgggataat

SEQ ID NO: 50960 - DNA, 20 bp, Artificial Sequence
  Synthetic oligonucleotide; TGG chr11 5208301 5208320 5208304 -
caacatgggataataggttc

SEQ ID NO: 50961 - DNA, 20 bp, Artificial Sequence
  Synthetic oligonucleotide; GAG chr11 5208295 5208314 5208298 -
gggataataggttctggcat

SEQ ID NO: 50962 - DNA, 20 bp, Artificial Sequence
  Synthetic oligonucleotide; CAG chr11 5208291 5208310 5208294 -
taataggttctggcatgaga

SEQ ID NO: 50963 - DNA, 20 bp, Artificial Sequence
  Synthetic oligonucleotide; CGG chr11 5208286 5208305 5208289 -
ggttctggcatgagacagcc

SEQ ID NO: 50964 - DNA, 20 bp, Artificial Sequence
  Synthetic oligonucleotide; GGG chr11 5208285 5208304 5208288 -
gttctggcatgagacagccc

SEQ ID NO: 50965 - DNA, 20 bp, Artificial Sequence
  Synthetic oligonucleotide; CAG chr11 5208273 5208292 5208276 -
gacagcccgggctctactct

SEQ ID NO: 50966 - DNA, 20 bp, Artificial Sequence
  Synthetic oligonucleotide; AGG chr11 5208272 5208291 5208275 -
acagcccgggctctactctc

SEQ ID NO: 50967 - DNA, 20 bp, Artificial Sequence
  Synthetic oligonucleotide; AAG chr11 5208264 5208283 5208267 -
ggctctactctcaggtccat

SEQ ID NO: 50968 - DNA, 20 bp, Artificial Sequence
  Synthetic oligonucleotide; TAG chr11 5208257 5208276 5208260 -
ctctcaggtccataagttaa

SEQ ID NO: 50969 - DNA, 20 bp, Artificial Sequence
  Synthetic oligonucleotide; GAG chr11 5208245 5208264 5208248 -
taagttaatagctttgtttt

SEQ ID NO: 50970 - DNA, 20 bp, Artificial Sequence
  Synthetic oligonucleotide; AGG chr11 5208244 5208263 5208247 -
aagttaatagctttgttttg

SEQ ID NO: 50971 - DNA, 20 bp, Artificial Sequence
  Synthetic oligonucleotide; AAG chr11 5208239 5208258 5208242 -
aatagctttgttttgaggat

SEQ ID NO: 50972 - DNA, 20 bp, Artificial Sequence
  Synthetic oligonucleotide; AAG chr11 5208199 5208218 5208202 -
acattcctcaataataaatt

SEQ ID NO: 50973 - DNA, 20 bp, Artificial Sequence
  Synthetic oligonucleotide; GAG chr11 5208197 5208216 5208200 -
attcctcaataataaattaa

SEQ ID NO: 50974 - DNA, 20 bp, Artificial Sequence
  Synthetic oligonucleotide; TGG chr11 5208188 5208207 5208191 -
taataaattaagagctataa

SEQ ID NO: 50975 - DNA, 20 bp, Artificial Sequence
  Synthetic oligonucleotide; TAG chr11 5208163 5208182 5208166 -
tctactttataaatttctta

SEQ ID NO: 50976 - DNA, 20 bp, Artificial Sequence
  Synthetic oligonucleotide; GAG chr11 5208159 5208178 5208162 -
ctttataaatttcttatagt

SEQ ID NO: 50977 - DNA, 20 bp, Artificial Sequence
  Synthetic oligonucleotide; AAG chr11 5208116 5208135 5208119 -
cgaaaaatgacaaaccaaat

SEQ ID NO: 50978 - DNA, 20 bp, Artificial Sequence
  Synthetic oligonucleotide; CAG chr11 5208109 5208128 5208112 -
tgacaaaccaaataagttcc

SEQ ID NO: 50979 - DNA, 20 bp, Artificial Sequence
  Synthetic oligonucleotide; TGG chr11 5208077 5208096 5208080 -
actttttatcatgatgatca

SEQ ID NO: 50980 - DNA, 20 bp, Artificial Sequence
  Synthetic oligonucleotide; TAG chr11 5208029 5208048 5208032 -
ataatttttttcttcaccta

SEQ ID NO: 50981 - DNA, 20 bp, Artificial Sequence
  Synthetic oligonucleotide; CAG chr11 5208023 5208042 5208026 -
tttttcttcacctatagcca

SEQ ID NO: 50982 - DNA, 20 bp, Artificial Sequence
  Synthetic oligonucleotide; CAG chr11 5208019 5208038 5208022 -
tcttcacctatagccacagt

SEQ ID NO: 50983 - DNA, 20 bp, Artificial Sequence
  Synthetic oligonucleotide; AAG chr11 5208009 5208028 5208012 -
tagccacagtcagcttctca

SEQ ID NO: 50984 - DNA, 20 bp, Artificial Sequence
  Synthetic oligonucleotide; TAG chr11 5207970 5207989 5207973 -
ctcacctttttatgatctaa

SEQ ID NO: 50985 - DNA, 20 bp, Artificial Sequence
  Synthetic oligonucleotide; CAG chr11 5207937 5207956 5207940 -
ctccacgctgacgtttacca

SEQ ID NO: 50986 - DNA, 20 bp, Artificial Sequence
  Synthetic oligonucleotide; TGG chr11 5207930 5207949 5207933 -
ctgacgtttaccacagaacc

SEQ ID NO: 50987 - DNA, 20 bp, Artificial Sequence
  Synthetic oligonucleotide; TAG chr11 5207924 5207943 5207927 -
tttaccacagaacctggaca

SEQ ID NO: 50988 - DNA, 20 bp, Artificial Sequence
  Synthetic oligonucleotide; AGG chr11 5207923 5207942 5207926 -
ttaccacagaacctggacat

SEQ ID NO: 50989 - DNA, 20 bp, Artificial Sequence
  Synthetic oligonucleotide; CAG chr11 5207874 5207893 5207877 -
aataaataaaataaataaaa

SEQ ID NO: 50990 - DNA, 20 bp, Artificial Sequence
  Synthetic oligonucleotide; AAG chr11 5207856 5207875 5207859 -
aacagaaaaaaaacgataca

SEQ ID NO: 50991 - DNA, 20 bp, Artificial Sequence
  Synthetic oligonucleotide; AGG chr11 5207855 5207874 5207858 -
acagaaaaaaaacgatacaa

SEQ ID NO: 50992 - DNA, 20 bp, Artificial Sequence
  Synthetic oligonucleotide; GGG chr11 5207854 5207873 5207857 -
cagaaaaaaaacgatacaaa

SEQ ID NO: 50993 - DNA, 20 bp, Artificial Sequence
  Synthetic oligonucleotide; AAG chr11 5207847 5207866 5207850 -
aaaacgatacaaagggtatg

SEQ ID NO: 50994 - DNA, 20 bp, Artificial Sequence
  Synthetic oligonucleotide; AGG chr11 5207846 5207865 5207849 -
aaacgatacaaagggtatga

SEQ ID NO: 50995 - DNA, 20 bp, Artificial Sequence
  Synthetic oligonucleotide; GAG chr11 5207840 5207859 5207843 -
tacaaagggtatgaaggatt

SEQ ID NO: 50996 - DNA, 20 bp, Artificial Sequence
  Synthetic oligonucleotide; CGG chr11 5207819 5207838 5207822 -
agtgaatatgttatatgcta

SEQ ID NO: 50997 - DNA, 20 bp, Artificial Sequence
  Synthetic oligonucleotide; CAG chr11 5207813 5207832 5207816 -
tatgttatatgctacggcac

SEQ ID NO: 50998 - DNA, 20 bp, Artificial Sequence
  Synthetic oligonucleotide; TGG chr11 5207810 5207829 5207813 -
gttatatgctacggcaccag

SEQ ID NO: 50999 - DNA, 20 bp, Artificial Sequence
  Synthetic oligonucleotide; TGG chr11 5207801 5207820 5207804 -
tacggcaccagtggtctttc

SEQ ID NO: 51000 - DNA, 20 bp, Artificial Sequence
  Synthetic oligonucleotide; GGG chr11 5207800 5207819 5207803 -
acggcaccagtggtctttct

SEQ ID NO: 51001 - DNA, 20 bp, Artificial Sequence
  Synthetic oligonucleotide; TAG chr11 5207776 5207795 5207779 -
attgtacacttgccccattc

SEQ ID NO: 51002 - DNA, 20 bp, Artificial Sequence
  Synthetic oligonucleotide; AGG chr11 5207775 5207794 5207778 -
ttgtacacttgccccattct

SEQ ID NO: 51003 - DNA, 20 bp, Artificial Sequence
  Synthetic oligonucleotide; TGG chr11 5207768 5207787 5207771 -
cttgccccattctaggacaa

SEQ ID NO: 51004 - DNA, 20 bp, Artificial Sequence
  Synthetic oligonucleotide; TAG chr11 5207754 5207773 5207757 -
ggacaatggttccttctgat

SEQ ID NO: 51005 - DNA, 20 bp, Artificial Sequence
  Synthetic oligonucleotide; CAG chr11 5207741 5207760 5207744 -
ttctgattagttaccttttc

SEQ ID NO: 51006 - DNA, 20 bp, Artificial Sequence
  Synthetic oligonucleotide; GAG chr11 5207735 5207754 5207738 -
ttagttaccttttccagtct

SEQ ID NO: 51007 - DNA, 20 bp, Artificial Sequence
  Synthetic oligonucleotide; GAG chr11 5207733 5207752 5207736 -
agttaccttttccagtctga

SEQ ID NO: 51008 - DNA, 20 bp, Artificial Sequence
  Synthetic oligonucleotide; TGG chr11 5207723 5207742 5207726 -
tccagtctgagagacatgcc

SEQ ID NO: 51009 - DNA, 20 bp, Artificial Sequence
  Synthetic oligonucleotide; AAG chr11 5207704 5207723 5207707 -
ctggctcacacctgatttgt

SEQ ID NO: 51010 - DNA, 20 bp, Artificial Sequence
  Synthetic oligonucleotide; AGG chr11 5207703 5207722 5207706 -
tggctcacacctgatttgta

SEQ ID NO: 51011 - DNA, 20 bp, Artificial Sequence
  Synthetic oligonucleotide; TGG chr11 5207697 5207716 5207700 -
acacctgatttgtaaggcaa

SEQ ID NO: 51012 - DNA, 20 bp, Artificial Sequence
  Synthetic oligonucleotide; GAG chr11 5207695 5207714 5207698 -
acctgatttgtaaggcaatg

SEQ ID NO: 51013 - DNA, 20 bp, Artificial Sequence
  Synthetic oligonucleotide; TGG chr11 5207691 5207710 5207694 -
gatttgtaaggcaatggaga

SEQ ID NO: 51014 - DNA, 20 bp, Artificial Sequence
  Synthetic oligonucleotide; GAG chr11 5207689 5207708 5207692 -
tttgtaaggcaatggagatg

SEQ ID NO: 51015 - DNA, 20 bp, Artificial Sequence
  Synthetic oligonucleotide; AAG chr11 5207670 5207689 5207673 -
ggagacactcttatatccaa

SEQ ID NO: 51016 - DNA, 20 bp, Artificial Sequence
  Synthetic oligonucleotide; TAG chr11 5207663 5207682 5207666 -
ctcttatatccaaaagtaca

SEQ ID NO: 51017 - DNA, 20 bp, Artificial Sequence
  Synthetic oligonucleotide; CGG chr11 5207657 5207676 5207660 -
tatccaaaagtacatagctc

SEQ ID NO: 51018 - DNA, 20 bp, Artificial Sequence
  Synthetic oligonucleotide; TAG chr11 5207654 5207673 5207657 -
ccaaaagtacatagctccgg

SEQ ID NO: 51019 - DNA, 20 bp, Artificial Sequence
  Synthetic oligonucleotide; TAG chr11 5207649 5207668 5207652 -
agtacatagctccggtagct

SEQ ID NO: 51020 - DNA, 20 bp, Artificial Sequence
  Synthetic oligonucleotide; TAG chr11 5207625 5207644 5207628 -
taataaacctttgtcacctc

SEQ ID NO: 51021 - DNA, 20 bp, Artificial Sequence
  Synthetic oligonucleotide; GAG chr11 5207623 5207642 5207626 -
ataaacctttgtcacctcta

SEQ ID NO: 51022 - DNA, 20 bp, Artificial Sequence
  Synthetic oligonucleotide; CAG chr11 5207605 5207624 5207608 -
tagagaattctaaaaatcca

SEQ ID NO: 51023 - DNA, 20 bp, Artificial Sequence
  Synthetic oligonucleotide; TAG chr11 5207599 5207618 5207602 -
attctaaaaatccacagatt

SEQ ID NO: 51024 - DNA, 20 bp, Artificial Sequence
  Synthetic oligonucleotide; TAG chr11 5207590 5207609 5207593 -
atccacagatttagaaattc

SEQ ID NO: 51025 - DNA, 20 bp, Artificial Sequence
  Synthetic oligonucleotide; AGG chr11 5207589 5207608 5207592 -
tccacagatttagaaattct

SEQ ID NO: 51026 - DNA, 20 bp, Artificial Sequence
  Synthetic oligonucleotide; AAG chr11 5207581 5207600 5207584 -
tttagaaattctaggaatcc

SEQ ID NO: 51027 - DNA, 20 bp, Artificial Sequence
  Synthetic oligonucleotide; TAG chr11 5207566 5207585 5207569 -
aatccaagaaattacaattt

SEQ ID NO: 51028 - DNA, 20 bp, Artificial Sequence
  Synthetic oligonucleotide; CGG chr11 5207523 5207542 5207526 -
ataacaataaccaataaaca

SEQ ID NO: 51029 - DNA, 20 bp, Artificial Sequence
  Synthetic oligonucleotide; AAG chr11 5207499 5207518 5207502 -
cattttatttacataaataa

SEQ ID NO: 51030 - DNA, 20 bp, Artificial Sequence
  Synthetic oligonucleotide; TGG chr11 5207495 5207514 5207498 -
ttatttacataaataaaaga

SEQ ID NO: 51031 - DNA, 20 bp, Artificial Sequence
  Synthetic oligonucleotide; GGG chr11 5207494 5207513 5207497 -
tatttacataaataaaagat

SEQ ID NO: 51032 - DNA, 20 bp, Artificial Sequence
  Synthetic oligonucleotide; TAG chr11 5207469 5207488 5207472 -
tgtcacacaatttaaaaatc

SEQ ID NO: 51033 - DNA, 20 bp, Artificial Sequence
  Synthetic oligonucleotide; AGG chr11 5207468 5207487 5207471 -
gtcacacaatttaaaaatct

SEQ ID NO: 51034 - DNA, 20 bp, Artificial Sequence
  Synthetic oligonucleotide; GGG chr11 5207467 5207486 5207470 -
tcacacaatttaaaaatcta

SEQ ID NO: 51035 - DNA, 20 bp, Artificial Sequence
  Synthetic oligonucleotide; AAG chr11 5207460 5207479 5207463 -
atttaaaaatctagggtcga

SEQ ID NO: 51036 - DNA, 20 bp, Artificial Sequence
  Synthetic oligonucleotide; CAG chr11 5207454 5207473 5207457 -
aaatctagggtcgaaagcca

SEQ ID NO: 51037 - DNA, 20 bp, Artificial Sequence
  Synthetic oligonucleotide; AAG chr11 5207449 5207468 5207452 -
tagggtcgaaagccacagca

SEQ ID NO: 51038 - DNA, 20 bp, Artificial Sequence
  Synthetic oligonucleotide; AGG chr11 5207448 5207467 5207451 -
agggtcgaaagccacagcaa

SEQ ID NO: 51039 - DNA, 20 bp, Artificial Sequence
  Synthetic oligonucleotide; TGG chr11 5207437 5207456 5207440 -
ccacagcaaaggcaacctcc

SEQ ID NO: 51040 - DNA, 20 bp, Artificial Sequence
  Synthetic oligonucleotide; TAG chr11 5207421 5207440 5207424 -
ctcctggcactatatcacaa

SEQ ID NO: 51041 - DNA, 20 bp, Artificial Sequence
  Synthetic oligonucleotide; TAG chr11 5207406 5207425 5207409 -
cacaatagatgacacctgca

SEQ ID NO: 51042 - DNA, 20 bp, Artificial Sequence
  Synthetic oligonucleotide; GAG chr11 5207404 5207423 5207407 -
caatagatgacacctgcata

SEQ ID NO: 51043 - DNA, 20 bp, Artificial Sequence
  Synthetic oligonucleotide; AAG chr11 5207400 5207419 5207403 -
agatgacacctgcatagaga

SEQ ID NO: 51044 - DNA, 20 bp, Artificial Sequence
  Synthetic oligonucleotide; AAG chr11 5207395 5207414 5207398 -
acacctgcatagagaaagca

SEQ ID NO: 51045 - DNA, 20 bp, Artificial Sequence
  Synthetic oligonucleotide; TGG chr11 5207392 5207411 5207395 -
cctgcatagagaaagcaaag

SEQ ID NO: 51046 - DNA, 20 bp, Artificial Sequence
  Synthetic oligonucleotide; TAG chr11 5207383 5207402 5207386 -
agaaagcaaagtggtcatgt

SEQ ID NO: 51047 - DNA, 20 bp, Artificial Sequence
  Synthetic oligonucleotide; TGG chr11 5207354 5207373 5207357 -
attgcctcaaataatccctg

SEQ ID NO: 51048 - DNA, 20 bp, Artificial Sequence
  Synthetic oligonucleotide; GGG chr11 5207353 5207372 5207356 -
ttgcctcaaataatccctgt

SEQ ID NO: 51049 - DNA, 20 bp, Artificial Sequence
  Synthetic oligonucleotide; GGG chr11 5207352 5207371 5207355 -
tgcctcaaataatccctgtg

SEQ ID NO: 51050 - DNA, 20 bp, Artificial Sequence
  Synthetic oligonucleotide; CAG chr11 5207326 5207345 5207329 -
tctactcttttgtattccat

SEQ ID NO: 51051 - DNA, 20 bp, Artificial Sequence
  Synthetic oligonucleotide; CAG chr11 5207314 5207333 5207317 -
tattccatcagcttttttcc

SEQ ID NO: 51052 - DNA, 20 bp, Artificial Sequence
  Synthetic oligonucleotide; TAG chr11 5207298 5207317 5207301 -
ttcccagtaacaacacatcc

SEQ ID NO: 51053 - DNA, 20 bp, Artificial Sequence
  Synthetic oligonucleotide; GAG chr11 5207280 5207299 5207283 -
cctagcaataatatcctgac

SEQ ID NO: 51054 - DNA, 20 bp, Artificial Sequence
  Synthetic oligonucleotide; AAG chr11 5207248 5207267 5207251 -
aaaaaaaaaactcccctcct

SEQ ID NO: 51055 - DNA, 20 bp, Artificial Sequence
  Synthetic oligonucleotide; CAG chr11 5207242 5207261 5207245 -
aaaactcccctcctaagata

SEQ ID NO: 51056 - DNA, 20 bp, Artificial Sequence
  Synthetic oligonucleotide; TGG chr11 5207231 5207250 5207234 -
cctaagatacagtatctttg

SEQ ID NO: 51057 - DNA, 20 bp, Artificial Sequence
  Synthetic oligonucleotide; CAG chr11 5207219 5207238 5207222 -
tatctttgtggttgcatccc

SEQ ID NO: 51058 - DNA, 20 bp, Artificial Sequence
  Synthetic oligonucleotide; TGG chr11 5207204 5207223 5207207 -
atccccagccatccctcatt

SEQ ID NO: 51059 - DNA, 20 bp, Artificial Sequence
  Synthetic oligonucleotide; GAG chr11 5207199 5207218 5207202 -
cagccatccctcatttggtt

SEQ ID NO: 51060 - DNA, 20 bp, Artificial Sequence
  Synthetic oligonucleotide; AGG chr11 5207198 5207217 5207201 -
agccatccctcatttggttg

SEQ ID NO: 51061 - DNA, 20 bp, Artificial Sequence
  Synthetic oligonucleotide; TGG chr11 5207194 5207213 5207197 -
atccctcatttggttgaggt

SEQ ID NO: 51062 - DNA, 20 bp, Artificial Sequence
  Synthetic oligonucleotide; TGG chr11 5207183 5207202 5207186 -
ggttgaggttggaatttcaa

SEQ ID NO: 51063 - DNA, 20 bp, Artificial Sequence
  Synthetic oligonucleotide; GGG chr11 5207182 5207201 5207185 -
gttgaggttggaatttcaat

SEQ ID NO: 51064 - DNA, 20 bp, Artificial Sequence
  Synthetic oligonucleotide; TGG chr11 5207179 5207198 5207182 -
gaggttggaatttcaatggg

SEQ ID NO: 51065 - DNA, 20 bp, Artificial Sequence
  Synthetic oligonucleotide; GGG chr11 5207178 5207197 5207181 -
aggttggaatttcaatgggt

SEQ ID NO: 51066 - DNA, 20 bp, Artificial Sequence
  Synthetic oligonucleotide; TGG chr11 5207147 5207166 5207150 -
ttccctaaacaaacttgcca

SEQ ID NO: 51067 - DNA, 20 bp, Artificial Sequence
  Synthetic oligonucleotide; AAG chr11 5207137 5207156 5207140 -
aaacttgccatggtaaaatc

SEQ ID NO: 51068 - DNA, 20 bp, Artificial Sequence
  Synthetic oligonucleotide; AGG chr11 5207136 5207155 5207139 -
aacttgccatggtaaaatca

SEQ ID NO: 51069 - DNA, 20 bp, Artificial Sequence
  Synthetic oligonucleotide; TAG chr11 5207132 5207151 5207135 -
tgccatggtaaaatcaaggc

SEQ ID NO: 51070 - DNA, 20 bp, Artificial Sequence
  Synthetic oligonucleotide; AAG chr11 5207114 5207133 5207117 -
gctagcattactgttcacac

SEQ ID NO: 51071 - DNA, 20 bp, Artificial Sequence
  Synthetic oligonucleotide; AGG chr11 5207113 5207132 5207116 -
ctagcattactgttcacaca

SEQ ID NO: 51072 - DNA, 20 bp, Artificial Sequence
  Synthetic oligonucleotide; AAG chr11 5207101 5207120 5207104 -
ttcacacaaggcactgtgct

SEQ ID NO: 51073 - DNA, 20 bp, Artificial Sequence
  Synthetic oligonucleotide; TAG chr11 5207085 5207104 5207088 -
tgctaagatccccatcctta

SEQ ID NO: 51074 - DNA, 20 bp, Artificial Sequence
  Synthetic oligonucleotide; TGG chr11 5207079 5207098 5207082 -
gatccccatccttatagcaa

SEQ ID NO: 51075 - DNA, 20 bp, Artificial Sequence
  Synthetic oligonucleotide; GGG chr11 5207078 5207097 5207081 -
atccccatccttatagcaat

SEQ ID NO: 51076 - DNA, 20 bp, Artificial Sequence
  Synthetic oligonucleotide; GAG chr11 5207076 5207095 5207079 -
ccccatccttatagcaatgg

SEQ ID NO: 51077 - DNA, 20 bp, Artificial Sequence
  Synthetic oligonucleotide; AGG chr11 5207075 5207094 5207078 -
cccatccttatagcaatggg

SEQ ID NO: 51078 - DNA, 20 bp, Artificial Sequence
  Synthetic oligonucleotide; GGG chr11 5207074 5207093 5207077 -
ccatccttatagcaatggga

SEQ ID NO: 51079 - DNA, 20 bp, Artificial Sequence
  Synthetic oligonucleotide; TAG chr11 5207067 5207086 5207070 -
tatagcaatgggagggctca

SEQ ID NO: 51080 - DNA, 20 bp, Artificial Sequence
  Synthetic oligonucleotide; AGG chr11 5207066 5207085 5207069 -
atagcaatgggagggctcat

SEQ ID NO: 51081 - DNA, 20 bp, Artificial Sequence
  Synthetic oligonucleotide; AAG chr11 5207062 5207081 5207065 -
caatgggagggctcataggc

SEQ ID NO: 51082 - DNA, 20 bp, Artificial Sequence
  Synthetic oligonucleotide; CAG chr11 5207049 5207068 5207052 -
cataggcaagtcatgtcatg

SEQ ID NO: 51083 - DNA, 20 bp, Artificial Sequence
  Synthetic oligonucleotide; GAG chr11 5207047 5207066 5207050 -
taggcaagtcatgtcatgca

SEQ ID NO: 51084 - DNA, 20 bp, Artificial Sequence
  Synthetic oligonucleotide; AGG chr11 5207046 5207065 5207049 -
aggcaagtcatgtcatgcag

SEQ ID NO: 51085 - DNA, 20 bp, Artificial Sequence
  Synthetic oligonucleotide; TGG chr11 5207018 5207037 5207021 -
tcatcatcccttcttgtctt

SEQ ID NO: 51086 - DNA, 20 bp, Artificial Sequence
  Synthetic oligonucleotide; GGG chr11 5207017 5207036 5207020 -
catcatcccttcttgtcttt

SEQ ID NO: 51087 - DNA, 20 bp, Artificial Sequence
  Synthetic oligonucleotide; GGG chr11 5207016 5207035 5207019 -
atcatcccttcttgtctttg

SEQ ID NO: 51088 - DNA, 20 bp, Artificial Sequence
  Synthetic oligonucleotide; TGG chr11 5207010 5207029 5207013 -
ccttcttgtctttggggact

SEQ ID NO: 51089 - DNA, 20 bp, Artificial Sequence
  Synthetic oligonucleotide; GGG chr11 5207009 5207028 5207012 -
cttcttgtctttggggactt

SEQ ID NO: 51090 - DNA, 20 bp, Artificial Sequence
  Synthetic oligonucleotide; CGG chr11 5207000 5207019 5207003 -
tttggggacttgggtctctc

SEQ ID NO: 51091 - DNA, 20 bp, Artificial Sequence
  Synthetic oligonucleotide; TAG chr11 5206992 5207011 5206995 -
cttgggtctctccggttgta

SEQ ID NO: 51092 - DNA, 20 bp, Artificial Sequence
  Synthetic oligonucleotide; AGG chr11 5206991 5207010 5206994 -
ttgggtctctccggttgtat

SEQ ID NO: 51093 - DNA, 20 bp, Artificial Sequence
  Synthetic oligonucleotide; GAG chr11 5206989 5207008 5206992 -
gggtctctccggttgtatag

SEQ ID NO: 51094 - DNA, 20 bp, Artificial Sequence
  Synthetic oligonucleotide; CAG chr11 5206979 5206998 5206982 -
ggttgtataggagatttcgc

SEQ ID NO: 51095 - DNA, 20 bp, Artificial Sequence
  Synthetic oligonucleotide; AGG chr11 5206978 5206997 5206981 -
gttgtataggagatttcgcc

SEQ ID NO: 51096 - DNA, 20 bp, Artificial Sequence
  Synthetic oligonucleotide; TAG chr11 5206956 5206975 5206959 -
gcatttgaatccttcactgc

SEQ ID NO: 51097 - DNA, 20 bp, Artificial Sequence
  Synthetic oligonucleotide; TGG chr11 5206947 5206966 5206950 -
tccttcactgctagtcatcc

SEQ ID NO: 51098 - DNA, 20 bp, Artificial Sequence
  Synthetic oligonucleotide; TGG chr11 5206938 5206957 5206941 -
gctagtcatcctggactctg

SEQ ID NO: 51099 - DNA, 20 bp, Artificial Sequence
  Synthetic oligonucleotide; GAG chr11 5206907 5206926 5206910 -
atccatctctcctatgttct

SEQ ID NO: 51100 - DNA, 20 bp, Artificial Sequence
  Synthetic oligonucleotide; AGG chr11 5206906 5206925 5206909 -
tccatctctcctatgttctg

SEQ ID NO: 51101 - DNA, 20 bp, Artificial Sequence
  Synthetic oligonucleotide; CAG chr11 5206902 5206921 5206905 -
tctctcctatgttctgaggt

SEQ ID NO: 51102 - DNA, 20 bp, Artificial Sequence
  Synthetic oligonucleotide; CAG chr11 5206881 5206900 5206884 -
agaatgacctctctcttaac

SEQ ID NO: 51103 - DNA, 20 bp, Artificial Sequence
  Synthetic oligonucleotide; TGG chr11 5206873 5206892 5206876 -
ctctctcttaaccagttgtc

SEQ ID NO: 51104 - DNA, 20 bp, Artificial Sequence
  Synthetic oligonucleotide; GGG chr11 5206872 5206891 5206875 -
tctctcttaaccagttgtct

SEQ ID NO: 51105 - DNA, 20 bp, Artificial Sequence
  Synthetic oligonucleotide; CAG chr11 5206867 5206886 5206870 -
cttaaccagttgtctgggcc

SEQ ID NO: 51106 - DNA, 20 bp, Artificial Sequence
  Synthetic oligonucleotide; AGG chr11 5206866 5206885 5206869 -
ttaaccagttgtctgggccc

SEQ ID NO: 51107 - DNA, 20 bp, Artificial Sequence
  Synthetic oligonucleotide; TAG chr11 5206849 5206868 5206852 -
cccaggctccattattgata

SEQ ID NO: 51108 - DNA, 20 bp, Artificial Sequence
  Synthetic oligonucleotide; TGG chr11 5206830 5206849 5206833 -
atagtcatgatctcctctgt

SEQ ID NO: 51109 - DNA, 20 bp, Artificial Sequence
  Synthetic oligonucleotide; GGG chr11 5206829 5206848 5206832 -
tagtcatgatctcctctgtt

SEQ ID NO: 51110 - DNA, 20 bp, Artificial Sequence
  Synthetic oligonucleotide; GGG chr11 5206828 5206847 5206831 -
agtcatgatctcctctgttg

SEQ ID NO: 51111 - DNA, 20 bp, Artificial Sequence
  Synthetic oligonucleotide; AAG chr11 5206822 5206841 5206825 -
gatctcctctgttggggatg

SEQ ID NO: 51112 - DNA, 20 bp, Artificial Sequence
  Synthetic oligonucleotide; TAG chr11 5206819 5206838 5206822 -
ctcctctgttggggatgaag

SEQ ID NO: 51113 - DNA, 20 bp, Artificial Sequence
  Synthetic oligonucleotide; AGG chr11 5206818 5206837 5206821 -
tcctctgttggggatgaagt

SEQ ID NO: 51114 - DNA, 20 bp, Artificial Sequence
  Synthetic oligonucleotide; GAG chr11 5206808 5206827 5206811 -
gggatgaagtaggcaaattt

SEQ ID NO: 51115 - DNA, 20 bp, Artificial Sequence
  Synthetic oligonucleotide; AGG chr11 5206807 5206826 5206810 -
ggatgaagtaggcaaatttg

SEQ ID NO: 51116 - DNA, 20 bp, Artificial Sequence
  Synthetic oligonucleotide; CAG chr11 5206772 5206791 5206775 -
tctcacattcttttcttgaa

SEQ ID NO: 51117 - DNA, 20 bp, Artificial Sequence
  Synthetic oligonucleotide; AAG chr11 5206768 5206787 5206771 -
acattcttttcttgaacaga

SEQ ID NO: 51118 - DNA, 20 bp, Artificial Sequence
  Synthetic oligonucleotide; TAG chr11 5206764 5206783 5206767 -
tcttttcttgaacagaaaga

SEQ ID NO: 51119 - DNA, 20 bp, Artificial Sequence
  Synthetic oligonucleotide; TGG chr11 5206758 5206777 5206761 -
cttgaacagaaagatagaac

SEQ ID NO: 51120 - DNA, 20 bp, Artificial Sequence
  Synthetic oligonucleotide; TAG chr11 5206748 5206767 5206751 -
aagatagaactggaaattaa

SEQ ID NO: 51121 - DNA, 20 bp, Artificial Sequence
  Synthetic oligonucleotide; TAG chr11 5206745 5206764 5206748 -
atagaactggaaattaatag

SEQ ID NO: 51122 - DNA, 20 bp, Artificial Sequence
  Synthetic oligonucleotide; TAG chr11 5206724 5206743 5206727 -
agtatataaattcaaaattt

SEQ ID NO: 51123 - DNA, 20 bp, Artificial Sequence
  Synthetic oligonucleotide; CAG chr11 5206704 5206723 5206707 -
tagctttaataacatttaat

SEQ ID NO: 51124 - DNA, 20 bp, Artificial Sequence
  Synthetic oligonucleotide; TGG chr11 5206688 5206707 5206691 -
taatcagacataaataatta

SEQ ID NO: 51125 - DNA, 20 bp, Artificial Sequence
  Synthetic oligonucleotide; TAG chr11 5206659 5206678 5206662 -
gaatttcaataaataaattt

SEQ ID NO: 51126 - DNA, 20 bp, Artificial Sequence
  Synthetic oligonucleotide; AAG chr11 5206647 5206666 5206650 -
ataaattttagttctaatat

SEQ ID NO: 51127 - DNA, 20 bp, Artificial Sequence
  Synthetic oligonucleotide; AAG chr11 5206614 5206633 5206617 -
taatattcatactttttctg

SEQ ID NO: 51128 - DNA, 20 bp, Artificial Sequence
  Synthetic oligonucleotide; AGG chr11 5206613 5206632 5206616 -
aatattcatactttttctga

SEQ ID NO: 51129 - DNA, 20 bp, Artificial Sequence
  Synthetic oligonucleotide; TGG chr11 5206594 5206613 5206597 -
aaggctttactaatttgata

SEQ ID NO: 51130 - DNA, 20 bp, Artificial Sequence
  Synthetic oligonucleotide; TGG chr11 5206547 5206566 5206550 -
actattcttattccactgtg

SEQ ID NO: 51131 - DNA, 20 bp, Artificial Sequence
  Synthetic oligonucleotide; GAG chr11 5206540 5206559 5206543 -
ttattccactgtgtggtgat

SEQ ID NO: 51132 - DNA, 20 bp, Artificial Sequence
  Synthetic oligonucleotide; AAG chr11 5206536 5206555 5206539 -
tccactgtgtggtgatgaga

SEQ ID NO: 51133 - DNA, 20 bp, Artificial Sequence
  Synthetic oligonucleotide; GAG chr11 5206532 5206551 5206535 -
ctgtgtggtgatgagaaagt

SEQ ID NO: 51134 - DNA, 20 bp, Artificial Sequence
  Synthetic oligonucleotide; GAG chr11 5206530 5206549 5206533 -
gtgtggtgatgagaaagtga

SEQ ID NO: 51135 - DNA, 20 bp, Artificial Sequence
  Synthetic oligonucleotide; TGG chr11 5206521 5206540 5206524 -
tgagaaagtgagagatgttc

SEQ ID NO: 51136 - DNA, 20 bp, Artificial Sequence
  Synthetic oligonucleotide; GAG chr11 5206519 5206538 5206522 -
agaaagtgagagatgttctg

SEQ ID NO: 51137 - DNA, 20 bp, Artificial Sequence
  Synthetic oligonucleotide; TGG chr11 5206515 5206534 5206518 -
agtgagagatgttctggaga

SEQ ID NO: 51138 - DNA, 20 bp, Artificial Sequence
  Synthetic oligonucleotide; TAG chr11 5206506 5206525 5206509 -
tgttctggagatggtgatta

SEQ ID NO: 51139 - DNA, 20 bp, Artificial Sequence
  Synthetic oligonucleotide; TAG chr11 5206502 5206521 5206505 -
ctggagatggtgattataga

SEQ ID NO: 51140 - DNA, 20 bp, Artificial Sequence
  Synthetic oligonucleotide; AAG chr11 5206491 5206510 5206494 -
gattatagatagcttccctg

SEQ ID NO: 51141 - DNA, 20 bp, Artificial Sequence
  Synthetic oligonucleotide; TAG chr11 5206485 5206504 5206488 -
agatagcttccctgaagcca

SEQ ID NO: 51142 - DNA, 20 bp, Artificial Sequence
  Synthetic oligonucleotide; TGG chr11 5206474 5206493 5206477 -
ctgaagccatagtaaccccc

SEQ ID NO: 51143 - DNA, 20 bp, Artificial Sequence
  Synthetic oligonucleotide; GAG chr11 5206472 5206491 5206475 -
gaagccatagtaaccccctg

SEQ ID NO: 51144 - DNA, 20 bp, Artificial Sequence
  Synthetic oligonucleotide; TGG chr11 5206463 5206482 5206466 -
gtaaccccctggagaaaaat

SEQ ID NO: 51145 - DNA, 20 bp, Artificial Sequence
  Synthetic oligonucleotide; TGG chr11 5206457 5206476 5206460 -
ccctggagaaaaattggacc

SEQ ID NO: 51146 - DNA, 20 bp, Artificial Sequence
  Synthetic oligonucleotide; GAG chr11 5206455 5206474 5206458 -
ctggagaaaaattggacctg

SEQ ID NO: 51147 - DNA, 20 bp, Artificial Sequence
  Synthetic oligonucleotide; TAG chr11 5206450 5206469 5206453 -
gaaaaattggacctggagtc

SEQ ID NO: 51148 - DNA, 20 bp, Artificial Sequence
  Synthetic oligonucleotide; CAG chr11 5206447 5206466 5206450 -
aaattggacctggagtctag

SEQ ID NO: 51149 - DNA, 20 bp, Artificial Sequence
  Synthetic oligonucleotide; TAG chr11 5206442 5206461 5206445 -
ggacctggagtctagcagcc

SEQ ID NO: 51150 - DNA, 20 bp, Artificial Sequence
  Synthetic oligonucleotide; AGG chr11 5206441 5206460 5206444 -
gacctggagtctagcagcct

SEQ ID NO: 51151 - DNA, 20 bp, Artificial Sequence
  Synthetic oligonucleotide; TGG chr11 5206436 5206455 5206439 -
ggagtctagcagcctaggta

SEQ ID NO: 51152 - DNA, 20 bp, Artificial Sequence
  Synthetic oligonucleotide; GGG chr11 5206435 5206454 5206438 -
gagtctagcagcctaggtat

SEQ ID NO: 51153 - DNA, 20 bp, Artificial Sequence
  Synthetic oligonucleotide; TAG chr11 5206420 5206439 5206423 -
ggtatgggtactcgatttct

SEQ ID NO: 51154 - DNA, 20 bp, Artificial Sequence
  Synthetic oligonucleotide; AAG chr11 5206416 5206435 5206419 -
tgggtactcgatttcttaga

SEQ ID NO: 51155 - DNA, 20 bp, Artificial Sequence
  Synthetic oligonucleotide; AAG chr11 5206385 5206404 5206388 -
atttcctttatcttaaaaat

SEQ ID NO: 51156 - DNA, 20 bp, Artificial Sequence
  Synthetic oligonucleotide; AGG chr11 5206384 5206403 5206387 -
tttcctttatcttaaaaata

SEQ ID NO: 51157 - DNA, 20 bp, Artificial Sequence
  Synthetic oligonucleotide; GGG chr11 5206383 5206402 5206386 -
ttcctttatcttaaaaataa

SEQ ID NO: 51158 - DNA, 20 bp, Artificial Sequence
  Synthetic oligonucleotide; AAG chr11 5206375 5206394 5206378 -
tcttaaaaataagggtattg

SEQ ID NO: 51159 - DNA, 20 bp, Artificial Sequence
  Synthetic oligonucleotide; TAG chr11 5206372 5206391 5206375 -
taaaaataagggtattgaag

SEQ ID NO: 51160 - DNA, 20 bp, Artificial Sequence
  Synthetic oligonucleotide; TAG chr11 5206364 5206383 5206367 -
agggtattgaagtagaattc

SEQ ID NO: 51161 - DNA, 20 bp, Artificial Sequence
  Synthetic oligonucleotide; CAG chr11 5206355 5206374 5206358 -
aagtagaattctagaatttt

SEQ ID NO: 51162 - DNA, 20 bp, Artificial Sequence
  Synthetic oligonucleotide; GAG chr11 5206353 5206372 5206356 -
gtagaattctagaattttca

SEQ ID NO: 51163 - DNA, 20 bp, Artificial Sequence
  Synthetic oligonucleotide; AGG chr11 5206352 5206371 5206355 -
tagaattctagaattttcag

SEQ ID NO: 51164 - DNA, 20 bp, Artificial Sequence
  Synthetic oligonucleotide; TAG chr11 5206329 5206348 5206332 -
acaacttaaaatatgtgtaa

SEQ ID NO: 51165 - DNA, 20 bp, Artificial Sequence
  Synthetic oligonucleotide; AAG chr11 5206278 5206297 5206281 -
ctgttcattttaatatattt

SEQ ID NO: 51166 - DNA, 20 bp, Artificial Sequence
  Synthetic oligonucleotide; AGG chr11 5206277 5206296 5206280 -
tgttcattttaatatattta

SEQ ID NO: 51167 - DNA, 20 bp, Artificial Sequence
  Synthetic oligonucleotide; AAG chr11 5206260 5206279 5206263 -
ttaaggatgaattttttaaa

SEQ ID NO: 51168 - DNA, 20 bp, Artificial Sequence
  Synthetic oligonucleotide; CGG chr11 5206242 5206261 5206245 -
aaaagttgatttcataaaaa

SEQ ID NO: 51169 - DNA, 20 bp, Artificial Sequence
  Synthetic oligonucleotide; GGG chr11 5206241 5206260 5206244 -
aaagttgatttcataaaaac

SEQ ID NO: 51170 - DNA, 20 bp, Artificial Sequence
  Synthetic oligonucleotide; TAG chr11 5206236 5206255 5206239 -
tgatttcataaaaacgggaa

SEQ ID NO: 51171 - DNA, 20 bp, Artificial Sequence
  Synthetic oligonucleotide; AAG chr11 5206232 5206251 5206235 -
ttcataaaaacgggaataga

SEQ ID NO: 51172 - DNA, 20 bp, Artificial Sequence
  Synthetic oligonucleotide; TGG chr11 5206228 5206247 5206231 -
taaaaacgggaatagaaaga

SEQ ID NO: 51173 - DNA, 20 bp, Artificial Sequence
  Synthetic oligonucleotide; TAG chr11 5206220 5206239 5206223 -
ggaatagaaagatggttcca

SEQ ID NO: 51174 - DNA, 20 bp, Artificial Sequence
  Synthetic oligonucleotide; AGG chr11 5206219 5206238 5206222 -
gaatagaaagatggttccat

SEQ ID NO: 51175 - DNA, 20 bp, Artificial Sequence
  Synthetic oligonucleotide; GAG chr11 5206210 5206229 5206213 -
gatggttccataggctgact

SEQ ID NO: 51176 - DNA, 20 bp, Artificial Sequence
  Synthetic oligonucleotide; GAG chr11 5206208 5206227 5206211 -
tggttccataggctgactga

SEQ ID NO: 51177 - DNA, 20 bp, Artificial Sequence
  Synthetic oligonucleotide; TAG chr11 5206203 5206222 5206206 -
ccataggctgactgagagtg

SEQ ID NO: 51178 - DNA, 20 bp, Artificial Sequence
  Synthetic oligonucleotide; GAG chr11 5206201 5206220 5206204 -
ataggctgactgagagtgta

SEQ ID NO: 51179 - DNA, 20 bp, Artificial Sequence
  Synthetic oligonucleotide; AGG chr11 5206200 5206219 5206203 -
taggctgactgagagtgtag

SEQ ID NO: 51180 - DNA, 20 bp, Artificial Sequence
  Synthetic oligonucleotide; GAG chr11 5206198 5206217 5206201 -
ggctgactgagagtgtagag

SEQ ID NO: 51181 - DNA, 20 bp, Artificial Sequence
  Synthetic oligonucleotide; AGG chr11 5206197 5206216 5206200 -
gctgactgagagtgtagagg

SEQ ID NO: 51182 - DNA, 20 bp, Artificial Sequence
  Synthetic oligonucleotide; GGG chr11 5206196 5206215 5206199 -
ctgactgagagtgtagagga

SEQ ID NO: 51183 - DNA, 20 bp, Artificial Sequence
  Synthetic oligonucleotide; TGG chr11 5206192 5206211 5206195 -
ctgagagtgtagaggaggga

SEQ ID NO: 51184 - DNA, 20 bp, Artificial Sequence
  Synthetic oligonucleotide; GGG chr11 5206191 5206210 5206194 -
tgagagtgtagaggagggat

SEQ ID NO: 51185 - DNA, 20 bp, Artificial Sequence
  Synthetic oligonucleotide; AAG chr11 5206188 5206207 5206191 -
gagtgtagaggagggatggg

SEQ ID NO: 51186 - DNA, 20 bp, Artificial Sequence
  Synthetic oligonucleotide; AGG chr11 5206187 5206206 5206190 -
agtgtagaggagggatggga

SEQ ID NO: 51187 - DNA, 20 bp, Artificial Sequence
  Synthetic oligonucleotide; GGG chr11 5206186 5206205 5206189 -
gtgtagaggagggatgggaa

SEQ ID NO: 51188 - DNA, 20 bp, Artificial Sequence
  Synthetic oligonucleotide; AAG chr11 5206182 5206201 5206185 -
agaggagggatgggaaggga

SEQ ID NO: 51189 - DNA, 20 bp, Artificial Sequence
  Synthetic oligonucleotide; AAG chr11 5206179 5206198 5206182 -
ggagggatgggaagggaaag

SEQ ID NO: 51190 - DNA, 20 bp, Artificial Sequence
  Synthetic oligonucleotide; CAG chr11 5206168 5206187 5206171 -
aagggaaagaagttgatctt

SEQ ID NO: 51191 - DNA, 20 bp, Artificial Sequence
  Synthetic oligonucleotide; TAG chr11 5206164 5206183 5206167 -
gaaagaagttgatcttcagt

SEQ ID NO: 51192 - DNA, 20 bp, Artificial Sequence
  Synthetic oligonucleotide; TAG chr11 5206159 5206178 5206162 -
aagttgatcttcagttagac

SEQ ID NO: 51193 - DNA, 20 bp, Artificial Sequence
  Synthetic oligonucleotide; GAG chr11 5206157 5206176 5206160 -
gttgatcttcagttagacta

SEQ ID NO: 51194 - DNA, 20 bp, Artificial Sequence
  Synthetic oligonucleotide; AGG chr11 5206156 5206175 5206159 -
ttgatcttcagttagactag

SEQ ID NO: 51195 - DNA, 20 bp, Artificial Sequence
  Synthetic oligonucleotide; AAG chr11 5206150 5206169 5206153 -
ttcagttagactagaggaat

SEQ ID NO: 51196 - DNA, 20 bp, Artificial Sequence
  Synthetic oligonucleotide; TAG chr11 5206144 5206163 5206147 -
tagactagaggaataagttt

SEQ ID NO: 51197 - DNA, 20 bp, Artificial Sequence
  Synthetic oligonucleotide; TAG chr11 5206124 5206143 5206127 -
tagtgatctctcacactgca

SEQ ID NO: 51198 - DNA, 20 bp, Artificial Sequence
  Synthetic oligonucleotide; CAG chr11 5206115 5206134 5206118 -
ctcacactgcatagtgaaca

SEQ ID NO: 51199 - DNA, 20 bp, Artificial Sequence
  Synthetic oligonucleotide; AAG chr11 5206042 5206061 5206045 -
ttatgttctcaccacaaaaa

SEQ ID NO: 51200 - DNA, 20 bp, Artificial Sequence
  Synthetic oligonucleotide; TGG chr11 5206038 5206057 5206041 -
gttctcaccacaaaaaaagt

SEQ ID NO: 51201 - DNA, 20 bp, Artificial Sequence
  Synthetic oligonucleotide; AAG chr11 5206035 5206054 5206038 -
ctcaccacaaaaaaagttgg

SEQ ID NO: 51202 - DNA, 20 bp, Artificial Sequence
  Synthetic oligonucleotide; AGG chr11 5206034 5206053 5206037 -
tcaccacaaaaaaagttgga

SEQ ID NO: 51203 - DNA, 20 bp, Artificial Sequence
  Synthetic oligonucleotide; TAG chr11 5206015 5206034 5206018 -
aaggtgattcatatgctaat

SEQ ID NO: 51204 - DNA, 20 bp, Artificial Sequence
  Synthetic oligonucleotide; TAG chr11 5206007 5206026 5206010 -
tcatatgctaattagcttga

SEQ ID NO: 51205 - DNA, 20 bp, Artificial Sequence
  Synthetic oligonucleotide; TAG chr11 5205983 5206002 5205986 -
ctctctctacaatgtatata

SEQ ID NO: 51206 - DNA, 20 bp, Artificial Sequence
  Synthetic oligonucleotide; CAG chr11 5205882 5205901 5205885 -
tatatgcacttattatttgc

SEQ ID NO: 51207 - DNA, 20 bp, Artificial Sequence
  Synthetic oligonucleotide; AGG chr11 5205881 5205900 5205884 -
atatgcacttattatttgcc

SEQ ID NO: 51208 - DNA, 20 bp, Artificial Sequence
  Synthetic oligonucleotide; TGG chr11 5205819 5205838 5205822 -
cctccttttacttttctgct

SEQ ID NO: 51209 - DNA, 20 bp, Artificial Sequence
  Synthetic oligonucleotide; CAG chr11 5205801 5205820 5205804 -
cttggttttcttctttcatt

SEQ ID NO: 51210 - DNA, 20 bp, Artificial Sequence
  Synthetic oligonucleotide; CAG chr11 5205791 5205810 5205794 -
ttctttcattcagtgtttac

SEQ ID NO: 51211 - DNA, 20 bp, Artificial Sequence
  Synthetic oligonucleotide; TAG chr11 5205781 5205800 5205784 -
cagtgtttaccagtttctta

SEQ ID NO: 51212 - DNA, 20 bp, Artificial Sequence
  Synthetic oligonucleotide; AAG chr11 5205765 5205784 5205768 -
cttatagttaattttatttt

SEQ ID NO: 51213 - DNA, 20 bp, Artificial Sequence
  Synthetic oligonucleotide; AAG chr11 5205745 5205764 5205748 -
aagctgtctcacattttctg

SEQ ID NO: 51214 - DNA, 20 bp, Artificial Sequence
  Synthetic oligonucleotide; AAG chr11 5205740 5205759 5205743 -
gtctcacattttctgaagaa

SEQ ID NO: 51215 - DNA, 20 bp, Artificial Sequence
  Synthetic oligonucleotide; AGG chr11 5205739 5205758 5205742 -
tctcacattttctgaagaaa

SEQ ID NO: 51216 - DNA, 20 bp, Artificial Sequence
  Synthetic oligonucleotide; GGG chr11 5205738 5205757 5205741 -
ctcacattttctgaagaaaa

SEQ ID NO: 51217 - DNA, 20 bp, Artificial Sequence
  Synthetic oligonucleotide; AAG chr11 5205726 5205745 5205729 -
gaagaaaagggaacatatta

SEQ ID NO: 51218 - DNA, 20 bp, Artificial Sequence
  Synthetic oligonucleotide; GAG chr11 5205695 5205714 5205698 -
acaaatacactatcttgcat

SEQ ID NO: 51219 - DNA, 20 bp, Artificial Sequence
  Synthetic oligonucleotide; TGG chr11 5205679 5205698 5205682 -
gcatgagatgatttatgtca

SEQ ID NO: 51220 - DNA, 20 bp, Artificial Sequence
  Synthetic oligonucleotide; TGG chr11 5205637 5205656 5205640 -
tcttataaaaacttctcaaa

SEQ ID NO: 51221 - DNA, 20 bp, Artificial Sequence
  Synthetic oligonucleotide; TAG chr11 5205633 5205652 5205636 -
ataaaaacttctcaaatggt

SEQ ID NO: 51222 - DNA, 20 bp, Artificial Sequence
  Synthetic oligonucleotide; TGG chr11 5205629 5205648 5205632 -
aaacttctcaaatggttaga

SEQ ID NO: 51223 - DNA, 20 bp, Artificial Sequence
  Synthetic oligonucleotide; CAG chr11 5205623 5205642 5205626 -
ctcaaatggttagatggcta

SEQ ID NO: 51224 - DNA, 20 bp, Artificial Sequence
  Synthetic oligonucleotide; CAG chr11 5205615 5205634 5205618 -
gttagatggctacagttgaa

SEQ ID NO: 51225 - DNA, 20 bp, Artificial Sequence
  Synthetic oligonucleotide; TGG chr11 5205611 5205630 5205614 -
gatggctacagttgaacaga

SEQ ID NO: 51226 - DNA, 20 bp, Artificial Sequence
  Synthetic oligonucleotide; AAG chr11 5205578 5205597 5205581 -
atattttttataatgcttct

SEQ ID NO: 51227 - DNA, 20 bp, Artificial Sequence
  Synthetic oligonucleotide; AGG chr11 5205577 5205596 5205580 -
tattttttataatgcttcta

SEQ ID NO: 51228 - DNA, 20 bp, Artificial Sequence
  Synthetic oligonucleotide; TGG chr11 5205572 5205591 5205575 -
tttataatgcttctaaggta

SEQ ID NO: 51229 - DNA, 20 bp, Artificial Sequence
  Synthetic oligonucleotide; TAG chr11 5205549 5205568 5205552 -
ctaatttttaaaaaatattt

SEQ ID NO: 51230 - DNA, 20 bp, Artificial Sequence
  Synthetic oligonucleotide; TGG chr11 5205540 5205559 5205543 -
aaaaaatattttagtaatga

SEQ ID NO: 51231 - DNA, 20 bp, Artificial Sequence
  Synthetic oligonucleotide; GGG chr11 5205539 5205558 5205542 -
aaaaatattttagtaatgat

SEQ ID NO: 51232 - DNA, 20 bp, Artificial Sequence
  Synthetic oligonucleotide; TAG chr11 5205525 5205544 5205528 -
aatgatgggaatattattta

SEQ ID NO: 51233 - DNA, 20 bp, Artificial Sequence
  Synthetic oligonucleotide; AAG chr11 5205488 5205507 5205491 -
atataatgaaatatgtaata

SEQ ID NO: 51234 - DNA, 20 bp, Artificial Sequence
  Synthetic oligonucleotide; TAG chr11 5205483 5205502 5205486 -
atgaaatatgtaataaagtc

SEQ ID NO: 51235 - DNA, 20 bp, Artificial Sequence
  Synthetic oligonucleotide; TAG chr11 5205288 5205307 5205291 -
tataatatataataaatata

SEQ ID NO: 51236 - DNA, 20 bp, Artificial Sequence
  Synthetic oligonucleotide; AAG chr11 5205239 5205258 5205242 -
tgtatctatatatgtttata

SEQ ID NO: 51237 - DNA, 20 bp, Artificial Sequence
  Synthetic oligonucleotide; TAG chr11 5205223 5205242 5205226 -
tataaagtcattcctctaat

SEQ ID NO: 51238 - DNA, 20 bp, Artificial Sequence
  Synthetic oligonucleotide; AGG chr11 5205222 5205241 5205225 -
ataaagtcattcctctaatt

SEQ ID NO: 51239 - DNA, 20 bp, Artificial Sequence
  Synthetic oligonucleotide; CAG chr11 5205208 5205227 5205211 -
ctaattaggtcataaccatt

SEQ ID NO: 51240 - DNA, 20 bp, Artificial Sequence
  Synthetic oligonucleotide; AGG chr11 5205207 5205226 5205210 -
taattaggtcataaccattc

SEQ ID NO: 51241 - DNA, 20 bp, Artificial Sequence
  Synthetic oligonucleotide; TGG chr11 5205199 5205218 5205202 -
tcataaccattcaggtaaac

SEQ ID NO: 51242 - DNA, 20 bp, Artificial Sequence
  Synthetic oligonucleotide; AAG chr11 5205190 5205209 5205193 -
ttcaggtaaactggaaattt

SEQ ID NO: 51243 - DNA, 20 bp, Artificial Sequence
  Synthetic oligonucleotide; CAG chr11 5205180 5205199 5205183 -
ctggaaatttaagcctactt

SEQ ID NO: 51244 - DNA, 20 bp, Artificial Sequence
  Synthetic oligonucleotide; AGG chr11 5205179 5205198 5205182 -
tggaaatttaagcctacttc

SEQ ID NO: 51245 - DNA, 20 bp, Artificial Sequence
  Synthetic oligonucleotide; TGG chr11 5205172 5205191 5205175 -
ttaagcctacttcaggtttg

SEQ ID NO: 51246 - DNA, 20 bp, Artificial Sequence
  Synthetic oligonucleotide; TAG chr11 5205165 5205184 5205168 -
tacttcaggtttgtggtaaa

SEQ ID NO: 51247 - DNA, 20 bp, Artificial Sequence
  Synthetic oligonucleotide; TAG chr11 5205149 5205168 5205152 -
taaatagattctctctgaac

SEQ ID NO: 51248 - DNA, 20 bp, Artificial Sequence
  Synthetic oligonucleotide; CAG chr11 5205140 5205159 5205143 -
tctctctgaactagcatatt

SEQ ID NO: 51249 - DNA, 20 bp, Artificial Sequence
  Synthetic oligonucleotide; CAG chr11 5205127 5205146 5205130 -
gcatattcagaatcattaaa

SEQ ID NO: 51250 - DNA, 20 bp, Artificial Sequence
  Synthetic oligonucleotide; CAG chr11 5205123 5205142 5205126 -
attcagaatcattaaacagt

SEQ ID NO: 51251 - DNA, 20 bp, Artificial Sequence
  Synthetic oligonucleotide; TGG chr11 5205115 5205134 5205118 -
tcattaaacagtcagttctt

SEQ ID NO: 51252 - DNA, 20 bp, Artificial Sequence
  Synthetic oligonucleotide; AAG chr11 5205110 5205129 5205113 -
aaacagtcagttctttggac

SEQ ID NO: 51253 - DNA, 20 bp, Artificial Sequence
  Synthetic oligonucleotide; TAG chr11 5205102 5205121 5205105 -
agttctttggacaagtctta

SEQ ID NO: 51254 - DNA, 20 bp, Artificial Sequence
  Synthetic oligonucleotide; CAG chr11 5205083 5205102 5205086 -
atagaatgttcttacctctt

SEQ ID NO: 51255 - DNA, 20 bp, Artificial Sequence
  Synthetic oligonucleotide; AAG chr11 5205073 5205092 5205076 -
cttacctcttcagccatccc

SEQ ID NO: 51256 - DNA, 20 bp, Artificial Sequence
  Synthetic oligonucleotide; GAG chr11 5205064 5205083 5205067 -
tcagccatcccaagactctt

SEQ ID NO: 51257 - DNA, 20 bp, Artificial Sequence
  Synthetic oligonucleotide; AGG chr11 5205063 5205082 5205066 -
cagccatcccaagactcttg

SEQ ID NO: 51258 - DNA, 20 bp, Artificial Sequence
  Synthetic oligonucleotide; GGG chr11 5205062 5205081 5205065 -
agccatcccaagactcttga

SEQ ID NO: 51259 - DNA, 20 bp, Artificial Sequence
  Synthetic oligonucleotide; AAG chr11 5205040 5205059 5205043 -
gcctgacctcgcttacacta

SEQ ID NO: 51260 - DNA, 20 bp, Artificial Sequence
  Synthetic oligonucleotide; CAG chr11 5205037 5205056 5205040 -
tgacctcgcttacactaaag

SEQ ID NO: 51261 - DNA, 20 bp, Artificial Sequence
  Synthetic oligonucleotide; AAG chr11 5205014 5205033 5205017 -
atctgccttatgcatcactg

SEQ ID NO: 51262 - DNA, 20 bp, Artificial Sequence
  Synthetic oligonucleotide; TAG chr11 5205011 5205030 5205014 -
tgccttatgcatcactgaag

SEQ ID NO: 51263 - DNA, 20 bp, Artificial Sequence
  Synthetic oligonucleotide; AGG chr11 5205010 5205029 5205013 -
gccttatgcatcactgaagt

SEQ ID NO: 51264 - DNA, 20 bp, Artificial Sequence
  Synthetic oligonucleotide; GGG chr11 5205009 5205028 5205012 -
ccttatgcatcactgaagta

SEQ ID NO: 51265 - DNA, 20 bp, Artificial Sequence
  Synthetic oligonucleotide; GAG chr11 5205007 5205026 5205010 -
ttatgcatcactgaagtagg

SEQ ID NO: 51266 - DNA, 20 bp, Artificial Sequence
  Synthetic oligonucleotide; AGG chr11 5205006 5205025 5205009 -
tatgcatcactgaagtaggg

SEQ ID NO: 51267 - DNA, 20 bp, Artificial Sequence
  Synthetic oligonucleotide; GGG chr11 5205005 5205024 5205008 -
atgcatcactgaagtaggga

SEQ ID NO: 51268 - DNA, 20 bp, Artificial Sequence
  Synthetic oligonucleotide; AAG chr11 5205002 5205021 5205005 -
catcactgaagtagggaggg

SEQ ID NO: 51269 - DNA, 20 bp, Artificial Sequence
  Synthetic oligonucleotide; AAG chr11 5204998 5205017 5205001 -
actgaagtagggagggaaga

SEQ ID NO: 51270 - DNA, 20 bp, Artificial Sequence
  Synthetic oligonucleotide; TAG chr11 5204972 5204991 5204975 -
gatgaactacttctgacccc

SEQ ID NO: 51271 - DNA, 20 bp, Artificial Sequence
  Synthetic oligonucleotide; TGG chr11 5204969 5204988 5204972 -
gaactacttctgacccctag

SEQ ID NO: 51272 - DNA, 20 bp, Artificial Sequence
  Synthetic oligonucleotide; CAG chr11 5204962 5204981 5204965 -
ttctgacccctagtggtgtc

SEQ ID NO: 51273 - DNA, 20 bp, Artificial Sequence
  Synthetic oligonucleotide; AAG chr11 5204957 5204976 5204960 -
acccctagtggtgtccagaa

SEQ ID NO: 51274 - DNA, 20 bp, Artificial Sequence
  Synthetic oligonucleotide; AAG chr11 5204947 5204966 5204950 -
gtgtccagaaaagaccatta

SEQ ID NO: 51275 - DNA, 20 bp, Artificial Sequence
  Synthetic oligonucleotide; AGG chr11 5204946 5204965 5204949 -
tgtccagaaaagaccattaa

SEQ ID NO: 51276 - DNA, 20 bp, Artificial Sequence
  Synthetic oligonucleotide; AAG chr11 5204932 5204951 5204935 -
cattaaaggaatgaccttta

SEQ ID NO: 51277 - DNA, 20 bp, Artificial Sequence
  Synthetic oligonucleotide; AGG chr11 5204931 5204950 5204934 -
attaaaggaatgacctttaa

SEQ ID NO: 51278 - DNA, 20 bp, Artificial Sequence
  Synthetic oligonucleotide; TGG chr11 5204927 5204946 5204930 -
aaggaatgacctttaaagga

SEQ ID NO: 51279 - DNA, 20 bp, Artificial Sequence
  Synthetic oligonucleotide; AAG chr11 5204906 5204925 5204909 -
ggacatacaattttttgtcc

SEQ ID NO: 51280 - DNA, 20 bp, Artificial Sequence
  Synthetic oligonucleotide; AGG chr11 5204905 5204924 5204908 -
gacatacaattttttgtcca

SEQ ID NO: 51281 - DNA, 20 bp, Artificial Sequence
  Synthetic oligonucleotide; CAG chr11 5204902 5204921 5204905 -
atacaattttttgtccaagg

SEQ ID NO: 51282 - DNA, 20 bp, Artificial Sequence
  Synthetic oligonucleotide; AGG chr11 5204901 5204920 5204904 -
tacaattttttgtccaaggc

SEQ ID NO: 51283 - DNA, 20 bp, Artificial Sequence
  Synthetic oligonucleotide; TGG chr11 5204891 5204910 5204894 -
tgtccaaggcaggacatgtg

SEQ ID NO: 51284 - DNA, 20 bp, Artificial Sequence
  Synthetic oligonucleotide; GGG chr11 5204890 5204909 5204893 -
gtccaaggcaggacatgtgt

SEQ ID NO: 51285 - DNA, 20 bp, Artificial Sequence
  Synthetic oligonucleotide; CAG chr11 5204880 5204899 5204883 -
ggacatgtgtgggtgtcttt

SEQ ID NO: 51286 - DNA, 20 bp, Artificial Sequence
  Synthetic oligonucleotide; AAG chr11 5204865 5204884 5204868 -
tctttcagtaattatgttct

SEQ ID NO: 51287 - DNA, 20 bp, Artificial Sequence
  Synthetic oligonucleotide; CAG chr11 5204860 5204879 5204863 -
cagtaattatgttctaagaa

SEQ ID NO: 51288 - DNA, 20 bp, Artificial Sequence
  Synthetic oligonucleotide; TGG chr11 5204840 5204859 5204843 -
cagcaaaaactccactgcct

SEQ ID NO: 51289 - DNA, 20 bp, Artificial Sequence
  Synthetic oligonucleotide; TAG chr11 5204833 5204852 5204836 -
aactccactgccttggcaaa

SEQ ID NO: 51290 - DNA, 20 bp, Artificial Sequence
  Synthetic oligonucleotide; AGG chr11 5204832 5204851 5204835 -
actccactgccttggcaaat

SEQ ID NO: 51291 - DNA, 20 bp, Artificial Sequence
  Synthetic oligonucleotide; TAG chr11 5204822 5204841 5204825 -
cttggcaaataggaatgttt

SEQ ID NO: 51292 - DNA, 20 bp, Artificial Sequence
  Synthetic oligonucleotide; TAG chr11 5204814 5204833 5204817 -
ataggaatgttttagttcta

SEQ ID NO: 51293 - DNA, 20 bp, Artificial Sequence
  Synthetic oligonucleotide; AAG chr11 5204804 5204823 5204807 -
tttagttctatagaattata

SEQ ID NO: 51294 - DNA, 20 bp, Artificial Sequence
  Synthetic oligonucleotide; AAG chr11 5204801 5204820 5204804 -
agttctatagaattataaag

SEQ ID NO: 51295 - DNA, 20 bp, Artificial Sequence
  Synthetic oligonucleotide; TGG chr11 5204762 5204781 5204765 -
atatactttctctatgtctt

SEQ ID NO: 51296 - DNA, 20 bp, Artificial Sequence
  Synthetic oligonucleotide; TGG chr11 5204747 5204766 5204750 -
gtctttggaacaatgactat

SEQ ID NO: 51297 - DNA, 20 bp, Artificial Sequence
  Synthetic oligonucleotide; AAG chr11 5204728 5204747 5204731 -
ttggtcattaccctatttta

SEQ ID NO: 51298 - DNA, 20 bp, Artificial Sequence
  Synthetic oligonucleotide; AAG chr11 5204724 5204743 5204727 -
tcattaccctattttaaagt

SEQ ID NO: 51299 - DNA, 20 bp, Artificial Sequence
  Synthetic oligonucleotide; AAG chr11 5204720 5204739 5204723 -
taccctattttaaagtaagc

SEQ ID NO: 51300 - DNA, 20 bp, Artificial Sequence
  Synthetic oligonucleotide; CAG chr11 5204709 5204728 5204712 -
aaagtaagcaagtaatcaca

SEQ ID NO: 51301 - DNA, 20 bp, Artificial Sequence
  Synthetic oligonucleotide; AGG chr11 5204708 5204727 5204711 -
aagtaagcaagtaatcacac

SEQ ID NO: 51302 - DNA, 20 bp, Artificial Sequence
  Synthetic oligonucleotide; GGG chr11 5204707 5204726 5204710 -
agtaagcaagtaatcacaca

SEQ ID NO: 51303 - DNA, 20 bp, Artificial Sequence
  Synthetic oligonucleotide; AAG chr11 5204692 5204711 5204695 -
acacagggaattattctgaa

SEQ ID NO: 51304 - DNA, 20 bp, Artificial Sequence
  Synthetic oligonucleotide; CAG chr11 5204688 5204707 5204691 -
agggaattattctgaaaaga

SEQ ID NO: 51305 - DNA, 20 bp, Artificial Sequence
  Synthetic oligonucleotide; AAG chr11 5204669 5204688 5204672 -
acagaaaaaaaaaaaaaacc

SEQ ID NO: 51306 - DNA, 20 bp, Artificial Sequence
  Synthetic oligonucleotide; GAG chr11 5204667 5204686 5204670 -
agaaaaaaaaaaaaaaccaa

SEQ ID NO: 51307 - DNA, 20 bp, Artificial Sequence
  Synthetic oligonucleotide; TAG chr11 5204651 5204670 5204654 -
ccaagagatttctgcatatg

SEQ ID NO: 51308 - DNA, 20 bp, Artificial Sequence
  Synthetic oligonucleotide; AGG chr11 5204650 5204669 5204653 -
caagagatttctgcatatgt

SEQ ID NO: 51309 - DNA, 20 bp, Artificial Sequence
  Synthetic oligonucleotide; CAG chr11 5204646 5204665 5204649 -
agatttctgcatatgtaggt

SEQ ID NO: 51310 - DNA, 20 bp, Artificial Sequence
  Synthetic oligonucleotide; CAG chr11 5204636 5204655 5204639 -
atatgtaggtcagttttaat

SEQ ID NO: 51311 - DNA, 20 bp, Artificial Sequence
  Synthetic oligonucleotide; GAG chr11 5204634 5204653 5204637 -
atgtaggtcagttttaatca

SEQ ID NO: 51312 - DNA, 20 bp, Artificial Sequence
  Synthetic oligonucleotide; AGG chr11 5204633 5204652 5204636 -
tgtaggtcagttttaatcag

SEQ ID NO: 51313 - DNA, 20 bp, Artificial Sequence
  Synthetic oligonucleotide; GGG chr11 5204632 5204651 5204635 -
gtaggtcagttttaatcaga

SEQ ID NO: 51314 - DNA, 20 bp, Artificial Sequence
  Synthetic oligonucleotide; CAG chr11 5204626 5204645 5204629 -
cagttttaatcagagggcat

SEQ ID NO: 51315 - DNA, 20 bp, Artificial Sequence
  Synthetic oligonucleotide; AAG chr11 5204621 5204640 5204624 -
ttaatcagagggcatcagaa

SEQ ID NO: 51316 - DNA, 20 bp, Artificial Sequence
  Synthetic oligonucleotide; AAG chr11 5204610 5204629 5204613 -
gcatcagaaaagactcctga

SEQ ID NO: 51317 - DNA, 20 bp, Artificial Sequence
  Synthetic oligonucleotide; TGG chr11 5204600 5204619 5204603 -
agactcctgaaagaatgacc

SEQ ID NO: 51318 - DNA, 20 bp, Artificial Sequence
  Synthetic oligonucleotide; CAG chr11 5204585 5204604 5204588 -
tgacctggttattataatca

SEQ ID NO: 51319 - DNA, 20 bp, Artificial Sequence
  Synthetic oligonucleotide; AAG chr11 5204571 5204590 5204574 -
taatcacagatttgctttcc

SEQ ID NO: 51320 - DNA, 20 bp, Artificial Sequence
  Synthetic oligonucleotide; CAG chr11 5204559 5204578 5204562 -
tgctttccaagtcaacattc

SEQ ID NO: 51321 - DNA, 20 bp, Artificial Sequence
  Synthetic oligonucleotide; CAG chr11 5204555 5204574 5204558 -
ttccaagtcaacattccaga

SEQ ID NO: 51322 - DNA, 20 bp, Artificial Sequence
  Synthetic oligonucleotide; CAG chr11 5204548 5204567 5204551 -
tcaacattccagacagtgct

SEQ ID NO: 51323 - DNA, 20 bp, Artificial Sequence
  Synthetic oligonucleotide; GAG chr11 5204546 5204565 5204549 -
aacattccagacagtgctca

SEQ ID NO: 51324 - DNA, 20 bp, Artificial Sequence
  Synthetic oligonucleotide; AGG chr11 5204545 5204564 5204548 -
acattccagacagtgctcag

SEQ ID NO: 51325 - DNA, 20 bp, Artificial Sequence
  Synthetic oligonucleotide; GGG chr11 5204544 5204563 5204547 -
cattccagacagtgctcaga

SEQ ID NO: 51326 - DNA, 20 bp, Artificial Sequence
  Synthetic oligonucleotide; GGG chr11 5204543 5204562 5204546 -
attccagacagtgctcagag

SEQ ID NO: 51327 - DNA, 20 bp, Artificial Sequence
  Synthetic oligonucleotide; CAG chr11 5204517 5204536 5204520 -
cgaaaacccttttatttctc

SEQ ID NO: 51328 - DNA, 20 bp, Artificial Sequence
  Synthetic oligonucleotide; TAG chr11 5204472 5204491 5204475 -
cttctctatttattttatta

SEQ ID NO: 51329 - DNA, 20 bp, Artificial Sequence
  Synthetic oligonucleotide; AGG chr11 5204471 5204490 5204474 -
ttctctatttattttattat

SEQ ID NO: 51330 - DNA, 20 bp, Artificial Sequence
  Synthetic oligonucleotide; TGG chr11 5204460 5204479 5204463 -
ttttattataggcattgttc

SEQ ID NO: 51331 - DNA, 20 bp, Artificial Sequence
  Synthetic oligonucleotide; TGG chr11 5204453 5204472 5204456 -
ataggcattgttctggttgc

SEQ ID NO: 51332 - DNA, 20 bp, Artificial Sequence
  Synthetic oligonucleotide; GGG chr11 5204452 5204471 5204455 -
taggcattgttctggttgct

SEQ ID NO: 51333 - DNA, 20 bp, Artificial Sequence
  Synthetic oligonucleotide; CAG chr11 5204445 5204464 5204448 -
tgttctggttgctgggaact

SEQ ID NO: 51334 - DNA, 20 bp, Artificial Sequence
  Synthetic oligonucleotide; GAG chr11 5204439 5204458 5204442 -
ggttgctgggaactcagact

SEQ ID NO: 51335 - DNA, 20 bp, Artificial Sequence
  Synthetic oligonucleotide; CAG chr11 5204418 5204437 5204421 -
agataccatacactgactct

SEQ ID NO: 51336 - DNA, 20 bp, Artificial Sequence
  Synthetic oligonucleotide; TAG chr11 5204414 5204433 5204417 -
accatacactgactctcaga

SEQ ID NO: 51337 - DNA, 20 bp, Artificial Sequence
  Synthetic oligonucleotide; TGG chr11 5204391 5204410 5204394 -
cataacacaacatgatgtct

SEQ ID NO: 51338 - DNA, 20 bp, Artificial Sequence
  Synthetic oligonucleotide; CAG chr11 5204358 5204377 5204361 -
atctttttgttttttaaata

SEQ ID NO: 51339 - DNA, 20 bp, Artificial Sequence
  Synthetic oligonucleotide; AGG chr11 5204357 5204376 5204360 -
tctttttgttttttaaatac

SEQ ID NO: 51340 - DNA, 20 bp, Artificial Sequence
  Synthetic oligonucleotide; TGG chr11 5204354 5204373 5204357 -
ttttgttttttaaatacagg

SEQ ID NO: 51341 - DNA, 20 bp, Artificial Sequence
  Synthetic oligonucleotide; GAG chr11 5204352 5204371 5204355 -
ttgttttttaaatacaggtg

SEQ ID NO: 51342 - DNA, 20 bp, Artificial Sequence
  Synthetic oligonucleotide; TGG chr11 5204345 5204364 5204348 -
ttaaatacaggtggagcatc

SEQ ID NO: 51343 - DNA, 20 bp, Artificial Sequence
  Synthetic oligonucleotide; TGG chr11 5204219 5204238 5204222 -
ctccaacatgtattttgctc

SEQ ID NO: 51344 - DNA, 20 bp, Artificial Sequence
  Synthetic oligonucleotide; AAG chr11 5204207 5204226 5204210 -
ttttgctctggtaatcccaa

SEQ ID NO: 51345 - DNA, 20 bp, Artificial Sequence
  Synthetic oligonucleotide; AGG chr11 5204206 5204225 5204209 -
tttgctctggtaatcccaaa

SEQ ID NO: 51346 - DNA, 20 bp, Artificial Sequence
  Synthetic oligonucleotide; TAG chr11 5204199 5204218 5204202 -
tggtaatcccaaaaggctga

SEQ ID NO: 51347 - DNA, 20 bp, Artificial Sequence
  Synthetic oligonucleotide; TGG chr11 5204190 5204209 5204193 -
caaaaggctgatagtctcta

SEQ ID NO: 51348 - DNA, 20 bp, Artificial Sequence
  Synthetic oligonucleotide; TGG chr11 5204187 5204206 5204190 -
aaggctgatagtctctatgg

SEQ ID NO: 51349 - DNA, 20 bp, Artificial Sequence
  Synthetic oligonucleotide; TGG chr11 5204179 5204198 5204182 -
tagtctctatggtggcaaca

SEQ ID NO: 51350 - DNA, 20 bp, Artificial Sequence
  Synthetic oligonucleotide; TAG chr11 5204158 5204177 5204161 -
ggataatactgttccccatc

SEQ ID NO: 51351 - DNA, 20 bp, Artificial Sequence
  Synthetic oligonucleotide; TGG chr11 5204154 5204173 5204157 -
aatactgttccccatctaga

SEQ ID NO: 51352 - DNA, 20 bp, Artificial Sequence
  Synthetic oligonucleotide; TAG chr11 5204133 5204152 5204136 -
ggtctcatttcttctgtatc

SEQ ID NO: 51353 - DNA, 20 bp, Artificial Sequence
  Synthetic oligonucleotide; AAG chr11 5204126 5204145 5204129 -
tttcttctgtatctagtctg

SEQ ID NO: 51354 - DNA, 20 bp, Artificial Sequence
  Synthetic oligonucleotide; AAG chr11 5204123 5204142 5204126 -
cttctgtatctagtctgaag

SEQ ID NO: 51355 - DNA, 20 bp, Artificial Sequence
  Synthetic oligonucleotide; AAG chr11 5204111 5204130 5204114 -
gtctgaagaagcctgaatga

SEQ ID NO: 51356 - DNA, 20 bp, Artificial Sequence
  Synthetic oligonucleotide; TAG chr11 5204108 5204127 5204111 -
tgaagaagcctgaatgaaag

SEQ ID NO: 51357 - DNA, 20 bp, Artificial Sequence
  Synthetic oligonucleotide; AAG chr11 5204099 5204118 5204102 -
ctgaatgaaagtagattttt

SEQ ID NO: 51358 - DNA, 20 bp, Artificial Sequence
  Synthetic oligonucleotide; TAG chr11 5204091 5204110 5204094 -
aagtagatttttaagctttg

SEQ ID NO: 51359 - DNA, 20 bp, Artificial Sequence
  Synthetic oligonucleotide; TAG chr11 5204087 5204106 5204090 -
agatttttaagctttgtagc

SEQ ID NO: 51360 - DNA, 20 bp, Artificial Sequence
  Synthetic oligonucleotide; AAG chr11 5204080 5204099 5204083 -
taagctttgtagctagtctg

SEQ ID NO: 51361 - DNA, 20 bp, Artificial Sequence
  Synthetic oligonucleotide; TAG chr11 5204071 5204090 5204074 -
tagctagtctgaagcctttg

SEQ ID NO: 51362 - DNA, 20 bp, Artificial Sequence
  Synthetic oligonucleotide; CAG chr11 5204067 5204086 5204070 -
tagtctgaagcctttgtagt

SEQ ID NO: 51363 - DNA, 20 bp, Artificial Sequence
  Synthetic oligonucleotide; AAG chr11 5204060 5204079 5204063 -
aagcctttgtagtcagtctg

SEQ ID NO: 51364 - DNA, 20 bp, Artificial Sequence
  Synthetic oligonucleotide; TAG chr11 5204042 5204061 5204045 -
tgaagaaacctgcatgaaaa

SEQ ID NO: 51365 - DNA, 20 bp, Artificial Sequence
  Synthetic oligonucleotide; TGG chr11 5204024 5204043 5204027 -
aatagattttttttttcctt

SEQ ID NO: 51366 - DNA, 20 bp, Artificial Sequence
  Synthetic oligonucleotide; GGG chr11 5204023 5204042 5204026 -
atagattttttttttccttt

SEQ ID NO: 51367 - DNA, 20 bp, Artificial Sequence
  Synthetic oligonucleotide; CAG chr11 5204019 5204038 5204022 -
attttttttttcctttggga

SEQ ID NO: 51368 - DNA, 20 bp, Artificial Sequence
  Synthetic oligonucleotide; GAG chr11 5204017 5204036 5204020 -
tttttttttcctttgggaca

SEQ ID NO: 51369 - DNA, 20 bp, Artificial Sequence
  Synthetic oligonucleotide; CAG chr11 5203999 5204018 5204002 -
cagagtcttgctctgtcgcc

SEQ ID NO: 51370 - DNA, 20 bp, Artificial Sequence
  Synthetic oligonucleotide; TGG chr11 5203994 5204013 5203997 -
tcttgctctgtcgcccagac

SEQ ID NO: 51371 - DNA, 20 bp, Artificial Sequence
  Synthetic oligonucleotide; GAG chr11 5203992 5204011 5203995 -
ttgctctgtcgcccagactg

SEQ ID NO: 51372 - DNA, 20 bp, Artificial Sequence
  Synthetic oligonucleotide; TGG chr11 5203984 5204003 5203987 -
tcgcccagactggagtgcaa

SEQ ID NO: 51373 - DNA, 20 bp, Artificial Sequence
  Synthetic oligonucleotide; CGG chr11 5203973 5203992 5203976 -
ggagtgcaatggcgcgatct

SEQ ID NO: 51374 - DNA, 20 bp, Artificial Sequence
  Synthetic oligonucleotide; CAG chr11 5203949 5203968 5203952 -
tcactgcaacttccacctcc

SEQ ID NO: 51375 - DNA, 20 bp, Artificial Sequence
  Synthetic oligonucleotide; AGG chr11 5203948 5203967 5203951 -
cactgcaacttccacctccc

SEQ ID NO: 51376 - DNA, 20 bp, Artificial Sequence
  Synthetic oligonucleotide; AAG chr11 5203942 5203961 5203945 -
aacttccacctcccaggatc

SEQ ID NO: 51377 - DNA, 20 bp, Artificial Sequence
  Synthetic oligonucleotide; CAG chr11 5203925 5203944 5203928 -
atcaagcaattctcctgcct

SEQ ID NO: 51378 - DNA, 20 bp, Artificial Sequence
  Synthetic oligonucleotide; AAG chr11 5203916 5203935 5203919 -
ttctcctgcctcagtctccc

SEQ ID NO: 51379 - DNA, 20 bp, Artificial Sequence
  Synthetic oligonucleotide; TGG chr11 5203909 5203928 5203912 -
gcctcagtctcccaagtaac

SEQ ID NO: 51380 - DNA, 20 bp, Artificial Sequence
  Synthetic oligonucleotide; GGG chr11 5203908 5203927 5203911 -
cctcagtctcccaagtaact

SEQ ID NO: 51381 - DNA, 20 bp, Artificial Sequence
  Synthetic oligonucleotide; CAG chr11 5203901 5203920 5203904 -
ctcccaagtaactgggatta

SEQ ID NO: 51382 - DNA, 20 bp, Artificial Sequence
  Synthetic oligonucleotide; AGG chr11 5203900 5203919 5203903 -
tcccaagtaactgggattac

SEQ ID NO: 51383 - DNA, 20 bp, Artificial Sequence
  Synthetic oligonucleotide; GAG chr11 5203898 5203917 5203901 -
ccaagtaactgggattacag

SEQ ID NO: 51384 - DNA, 20 bp, Artificial Sequence
  Synthetic oligonucleotide; CAG chr11 5203881 5203900 5203884 -
caggagcacactgccatgcc

SEQ ID NO: 51385 - DNA, 20 bp, Artificial Sequence
  Synthetic oligonucleotide; TAG chr11 5203860 5203879 5203863 -
agctaattatttttgtgttt

SEQ ID NO: 51386 - DNA, 20 bp, Artificial Sequence
  Synthetic oligonucleotide; TAG chr11 5203857 5203876 5203860 -
taattatttttgtgttttag

SEQ ID NO: 51387 - DNA, 20 bp, Artificial Sequence
  Synthetic oligonucleotide; GAG chr11 5203855 5203874 5203858 -
attatttttgtgttttagta

SEQ ID NO: 51388 - DNA, 20 bp, Artificial Sequence
  Synthetic oligonucleotide; CAG chr11 5203851 5203870 5203854 -
tttttgtgttttagtagaga

SEQ ID NO: 51389 - DNA, 20 bp, Artificial Sequence
  Synthetic oligonucleotide; AGG chr11 5203850 5203869 5203853 -
ttttgtgttttagtagagac

SEQ ID NO: 51390 - DNA, 20 bp, Artificial Sequence
  Synthetic oligonucleotide; GGG chr11 5203849 5203868 5203852 -
tttgtgttttagtagagaca

SEQ ID NO: 51391 - DNA, 20 bp, Artificial Sequence
  Synthetic oligonucleotide; CAG chr11 5203831 5203850 5203834 -
cagggtttcaccattttgcc

SEQ ID NO: 51392 - DNA, 20 bp, Artificial Sequence
  Synthetic oligonucleotide; AGG chr11 5203830 5203849 5203833 -
agggtttcaccattttgccc

SEQ ID NO: 51393 - DNA, 20 bp, Artificial Sequence
  Synthetic oligonucleotide; TGG chr11 5203826 5203845 5203829 -
tttcaccattttgcccaggt

SEQ ID NO: 51394 - DNA, 20 bp, Artificial Sequence
  Synthetic oligonucleotide; GAG chr11 5203811 5203830 5203814 -
caggttggtctccaactcct

SEQ ID NO: 51395 - DNA, 20 bp, Artificial Sequence
  Synthetic oligonucleotide; CAG chr11 5203806 5203825 5203809 -
tggtctccaactcctgagct

SEQ ID NO: 51396 - DNA, 20 bp, Artificial Sequence
  Synthetic oligonucleotide; CGG chr11 5203788 5203807 5203791 -
ctcagccaatccacctgcct

SEQ ID NO: 51397 - DNA, 20 bp, Artificial Sequence
  Synthetic oligonucleotide; AAG chr11 5203778 5203797 5203781 -
ccacctgcctcggcctccca

SEQ ID NO: 51398 - DNA, 20 bp, Artificial Sequence
  Synthetic oligonucleotide; TAG chr11 5203772 5203791 5203775 -
gcctcggcctcccaaagtgc

SEQ ID NO: 51399 - DNA, 20 bp, Artificial Sequence
  Synthetic oligonucleotide; AGG chr11 5203771 5203790 5203774 -
cctcggcctcccaaagtgct

SEQ ID NO: 51400 - DNA, 20 bp, Artificial Sequence
  Synthetic oligonucleotide; CAG chr11 5203764 5203783 5203767 -
ctcccaaagtgctaggatta

SEQ ID NO: 51401 - DNA, 20 bp, Artificial Sequence
  Synthetic oligonucleotide; AGG chr11 5203763 5203782 5203766 -
tcccaaagtgctaggattac

SEQ ID NO: 51402 - DNA, 20 bp, Artificial Sequence
  Synthetic oligonucleotide; GAG chr11 5203757 5203776 5203760 -
agtgctaggattacaggcgt

SEQ ID NO: 51403 - DNA, 20 bp, Artificial Sequence
  Synthetic oligonucleotide; AAG chr11 5203749 5203768 5203752 -
gattacaggcgtgagccacc

SEQ ID NO: 51404 - DNA, 20 bp, Artificial Sequence
  Synthetic oligonucleotide; TGG chr11 5203744 5203763 5203747 -
caggcgtgagccaccaagcc

SEQ ID NO: 51405 - DNA, 20 bp, Artificial Sequence
  Synthetic oligonucleotide; AAG chr11 5203737 5203756 5203740 -
gagccaccaagcctggctga

SEQ ID NO: 51406 - DNA, 20 bp, Artificial Sequence
  Synthetic oligonucleotide; TAG chr11 5203734 5203753 5203737 -
ccaccaagcctggctgaaag

SEQ ID NO: 51407 - DNA, 20 bp, Artificial Sequence
  Synthetic oligonucleotide; CAG chr11 5203705 5203724 5203708 -
ttaacacatacctacattca

SEQ ID NO: 51408 - DNA, 20 bp, Artificial Sequence
  Synthetic oligonucleotide; CAG chr11 5203676 5203695 5203679 -
aaatcttttgtgatcaatcc

SEQ ID NO: 51409 - DNA, 20 bp, Artificial Sequence
  Synthetic oligonucleotide; GAG chr11 5203655 5203674 5203658 -
agatccttgacgatatgtct

SEQ ID NO: 51410 - DNA, 20 bp, Artificial Sequence
  Synthetic oligonucleotide; CAG chr11 5203651 5203670 5203654 -
ccttgacgatatgtctgagt

SEQ ID NO: 51411 - DNA, 20 bp, Artificial Sequence
  Synthetic oligonucleotide; AGG chr11 5203650 5203669 5203653 -
cttgacgatatgtctgagtc

SEQ ID NO: 51412 - DNA, 20 bp, Artificial Sequence
  Synthetic oligonucleotide; TGG chr11 5203646 5203665 5203649 -
acgatatgtctgagtcaggc

SEQ ID NO: 51413 - DNA, 20 bp, Artificial Sequence
  Synthetic oligonucleotide; GAG chr11 5203639 5203658 5203642 -
gtctgagtcaggctggaaat

SEQ ID NO: 51414 - DNA, 20 bp, Artificial Sequence
  Synthetic oligonucleotide; GAG chr11 5203637 5203656 5203640 -
ctgagtcaggctggaaatga

SEQ ID NO: 51415 - DNA, 20 bp, Artificial Sequence
  Synthetic oligonucleotide; TGG chr11 5203618 5203637 5203621 -
agagaaatcatgtttgaaat

SEQ ID NO: 51416 - DNA, 20 bp, Artificial Sequence
  Synthetic oligonucleotide; GAG chr11 5203616 5203635 5203619 -
agaaatcatgtttgaaattg

SEQ ID NO: 51417 - DNA, 20 bp, Artificial Sequence
  Synthetic oligonucleotide; AAG chr11 5203603 5203622 5203606 -
gaaattggagtgttgtattc

SEQ ID NO: 51418 - DNA, 20 bp, Artificial Sequence
  Synthetic oligonucleotide; AGG chr11 5203602 5203621 5203605 -
aaattggagtgttgtattca

SEQ ID NO: 51419 - DNA, 20 bp, Artificial Sequence
  Synthetic oligonucleotide; CAG chr11 5203598 5203617 5203601 -
tggagtgttgtattcaaggt

SEQ ID NO: 51420 - DNA, 20 bp, Artificial Sequence
  Synthetic oligonucleotide; AAG chr11 5203594 5203613 5203597 -
gtgttgtattcaaggtcagc

SEQ ID NO: 51421 - DNA, 20 bp, Artificial Sequence
  Synthetic oligonucleotide; TGG chr11 5203586 5203605 5203589 -
ttcaaggtcagcaagatccc

SEQ ID NO: 51422 - DNA, 20 bp, Artificial Sequence
  Synthetic oligonucleotide; GAG chr11 5203584 5203603 5203587 -
caaggtcagcaagatccctg

SEQ ID NO: 51423 - DNA, 20 bp, Artificial Sequence
  Synthetic oligonucleotide; CAG chr11 5203581 5203600 5203584 -
ggtcagcaagatccctggag

SEQ ID NO: 51424 - DNA, 20 bp, Artificial Sequence
  Synthetic oligonucleotide; TGG chr11 5203552 5203571 5203555 -
ttttataaaccattcaaact

SEQ ID NO: 51425 - DNA, 20 bp, Artificial Sequence
  Synthetic oligonucleotide; TGG chr11 5203533 5203552 5203536 -
ttggtatatgatgactcaat

SEQ ID NO: 51426 - DNA, 20 bp, Artificial Sequence
  Synthetic oligonucleotide; TGG chr11 5203530 5203549 5203533 -
gtatatgatgactcaattgg

SEQ ID NO: 51427 - DNA, 20 bp, Artificial Sequence
  Synthetic oligonucleotide; AAG chr11 5203524 5203543 5203527 -
gatgactcaattggtggcca

SEQ ID NO: 51428 - DNA, 20 bp, Artificial Sequence
  Synthetic oligonucleotide; AGG chr11 5203523 5203542 5203526 -
atgactcaattggtggccaa

SEQ ID NO: 51429 - DNA, 20 bp, Artificial Sequence
  Synthetic oligonucleotide; CAG chr11 5203519 5203538 5203522 -
ctcaattggtggccaaaggt

SEQ ID NO: 51430 - DNA, 20 bp, Artificial Sequence
  Synthetic oligonucleotide; AAG chr11 5203514 5203533 5203517 -
ttggtggccaaaggtcagaa

SEQ ID NO: 51431 - DNA, 20 bp, Artificial Sequence
  Synthetic oligonucleotide; AAG chr11 5203508 5203527 5203511 -
gccaaaggtcagaaaagact

SEQ ID NO: 51432 - DNA, 20 bp, Artificial Sequence
  Synthetic oligonucleotide; CAG chr11 5203499 5203518 5203502 -
cagaaaagactaagtgtaca

SEQ ID NO: 51433 - DNA, 20 bp, Artificial Sequence
  Synthetic oligonucleotide; TAG chr11 5203475 5203494 5203478 -
tgattttacacacactttga

SEQ ID NO: 51434 - DNA, 20 bp, Artificial Sequence
  Synthetic oligonucleotide; AGG chr11 5203474 5203493 5203477 -
gattttacacacactttgat

SEQ ID NO: 51435 - DNA, 20 bp, Artificial Sequence
  Synthetic oligonucleotide; GAG chr11 5203472 5203491 5203475 -
ttttacacacactttgatag

SEQ ID NO: 51436 - DNA, 20 bp, Artificial Sequence
  Synthetic oligonucleotide; TAG chr11 5203430 5203449 5203433 -
tttatatctctgtgattgtc

SEQ ID NO: 51437 - DNA, 20 bp, Artificial Sequence
  Synthetic oligonucleotide; TAG chr11 5203416 5203435 5203419 -
attgtctagctcttatttca

SEQ ID NO: 51438 - DNA, 20 bp, Artificial Sequence
  Synthetic oligonucleotide; AAG chr11 5203388 5203407 5203391 -
ttaattaaaaattatttgat

SEQ ID NO: 51439 - DNA, 20 bp, Artificial Sequence
  Synthetic oligonucleotide; GAG chr11 5203348 5203367 5203351 -
cccttatttttcatattctt

SEQ ID NO: 51440 - DNA, 20 bp, Artificial Sequence
  Synthetic oligonucleotide; CAG chr11 5203338 5203357 5203341 -
tcatattcttgagcaaaaaa

SEQ ID NO: 51441 - DNA, 20 bp, Artificial Sequence
  Synthetic oligonucleotide; TGG chr11 5203332 5203351 5203335 -
tcttgagcaaaaaacagata

SEQ ID NO: 51442 - DNA, 20 bp, Artificial Sequence
  Synthetic oligonucleotide; CAG chr11 5203315 5203334 5203318 -
atatggttcctaatcttcta

SEQ ID NO: 51443 - DNA, 20 bp, Artificial Sequence
  Synthetic oligonucleotide; TGG chr11 5203296 5203315 5203299 -
acagcctctaatgaatctaa

SEQ ID NO: 51444 - DNA, 20 bp, Artificial Sequence
  Synthetic oligonucleotide; CAG chr11 5203288 5203307 5203291 -
taatgaatctaatggaaatt

SEQ ID NO: 51445 - DNA, 20 bp, Artificial Sequence
  Synthetic oligonucleotide; AAG chr11 5203277 5203296 5203280 -
atggaaattcagtgtataat

SEQ ID NO: 51446 - DNA, 20 bp, Artificial Sequence
  Synthetic oligonucleotide; TGG chr11 5203274 5203293 5203277 -
gaaattcagtgtataataag

SEQ ID NO: 51447 - DNA, 20 bp, Artificial Sequence
  Synthetic oligonucleotide; TAG chr11 5203258 5203277 5203261 -
taagtggtataaatataaac

SEQ ID NO: 51448 - DNA, 20 bp, Artificial Sequence
  Synthetic oligonucleotide; GAG chr11 5203244 5203263 5203247 -
ataaactagtatactgtgat

SEQ ID NO: 51449 - DNA, 20 bp, Artificial Sequence
  Synthetic oligonucleotide; GAG chr11 5203242 5203261 5203245 -
aaactagtatactgtgatga

SEQ ID NO: 51450 - DNA, 20 bp, Artificial Sequence
  Synthetic oligonucleotide; AAG chr11 5203238 5203257 5203241 -
tagtatactgtgatgagagt

SEQ ID NO: 51451 - DNA, 20 bp, Artificial Sequence
  Synthetic oligonucleotide; TAG chr11 5203234 5203253 5203237 -
atactgtgatgagagtaagt

SEQ ID NO: 51452 - DNA, 20 bp, Artificial Sequence
  Synthetic oligonucleotide; AAG chr11 5203229 5203248 5203232 -
gtgatgagagtaagttagtt

SEQ ID NO: 51453 - DNA, 20 bp, Artificial Sequence
  Synthetic oligonucleotide; AGG chr11 5203228 5203247 5203231 -
tgatgagagtaagttagtta

SEQ ID NO: 51454 - DNA, 20 bp, Artificial Sequence
  Synthetic oligonucleotide; GGG chr11 5203227 5203246 5203230 -
gatgagagtaagttagttaa

SEQ ID NO: 51455 - DNA, 20 bp, Artificial Sequence
  Synthetic oligonucleotide; GGG chr11 5203226 5203245 5203229 -
atgagagtaagttagttaag

SEQ ID NO: 51456 - DNA, 20 bp, Artificial Sequence
  Synthetic oligonucleotide; GGG chr11 5203225 5203244 5203228 -
tgagagtaagttagttaagg

SEQ ID NO: 51457 - DNA, 20 bp, Artificial Sequence
  Synthetic oligonucleotide; AAG chr11 5203219 5203238 5203222 -
taagttagttaagggggttg

SEQ ID NO: 51458 - DNA, 20 bp, Artificial Sequence
  Synthetic oligonucleotide; GAG chr11 5203212 5203231 5203215 -
gttaagggggttgaagaaat

SEQ ID NO: 51459 - DNA, 20 bp, Artificial Sequence
  Synthetic oligonucleotide; TAG chr11 5203203 5203222 5203206 -
gttgaagaaatgagataatc

SEQ ID NO: 51460 - DNA, 20 bp, Artificial Sequence
  Synthetic oligonucleotide; AGG chr11 5203202 5203221 5203205 -
ttgaagaaatgagataatct

SEQ ID NO: 51461 - DNA, 20 bp, Artificial Sequence
  Synthetic oligonucleotide; TGG chr11 5203199 5203218 5203202 -
aagaaatgagataatctagg

SEQ ID NO: 51462 - DNA, 20 bp, Artificial Sequence
  Synthetic oligonucleotide; GGG chr11 5203198 5203217 5203201 -
agaaatgagataatctaggt

SEQ ID NO: 51463 - DNA, 20 bp, Artificial Sequence
  Synthetic oligonucleotide; GGG chr11 5203197 5203216 5203200 -
gaaatgagataatctaggtg

SEQ ID NO: 51464 - DNA, 20 bp, Artificial Sequence
  Synthetic oligonucleotide; GAG chr11 5203195 5203214 5203198 -
aatgagataatctaggtggg

SEQ ID NO: 51465 - DNA, 20 bp, Artificial Sequence
  Synthetic oligonucleotide; CAG chr11 5203192 5203211 5203195 -
gagataatctaggtggggag

SEQ ID NO: 51466 - DNA, 20 bp, Artificial Sequence
  Synthetic oligonucleotide; TAG chr11 5203186 5203205 5203189 -
atctaggtggggagcagtat

SEQ ID NO: 51467 - DNA, 20 bp, Artificial Sequence
  Synthetic oligonucleotide; GAG chr11 5203171 5203190 5203174 -
agtattagaaaaatccccct

SEQ ID NO: 51468 - DNA, 20 bp, Artificial Sequence
  Synthetic oligonucleotide; AGG chr11 5203170 5203189 5203173 -
gtattagaaaaatccccctg

SEQ ID NO: 51469 - DNA, 20 bp, Artificial Sequence
  Synthetic oligonucleotide; AAG chr11 5203167 5203186 5203170 -
ttagaaaaatccccctgagg

SEQ ID NO: 51470 - DNA, 20 bp, Artificial Sequence
  Synthetic oligonucleotide; AAG chr11 5203147 5203166 5203150 -
aagtaatcattttaactcaa

SEQ ID NO: 51471 - DNA, 20 bp, Artificial Sequence
  Synthetic oligonucleotide; TGG chr11 5203140 5203159 5203143 -
cattttaactcaaaagttaa

SEQ ID NO: 51472 - DNA, 20 bp, Artificial Sequence
  Synthetic oligonucleotide; AAG chr11 5203134 5203153 5203137 -
aactcaaaagttaatggtga

SEQ ID NO: 51473 - DNA, 20 bp, Artificial Sequence
  Synthetic oligonucleotide; AGG chr11 5203133 5203152 5203136 -
actcaaaagttaatggtgaa

SEQ ID NO: 51474 - DNA, 20 bp, Artificial Sequence
  Synthetic oligonucleotide; TGG chr11 5203112 5203131 5203115 -
ggaattgctgtgcaaatact

SEQ ID NO: 51475 - DNA, 20 bp, Artificial Sequence
  Synthetic oligonucleotide; GGG chr11 5203111 5203130 5203114 -
gaattgctgtgcaaatactt

SEQ ID NO: 51476 - DNA, 20 bp, Artificial Sequence
  Synthetic oligonucleotide; GGG chr11 5203110 5203129 5203113 -
aattgctgtgcaaatacttg

SEQ ID NO: 51477 - DNA, 20 bp, Artificial Sequence
  Synthetic oligonucleotide; TAG chr11 5203107 5203126 5203110 -
tgctgtgcaaatacttgggg

SEQ ID NO: 51478 - DNA, 20 bp, Artificial Sequence
  Synthetic oligonucleotide; CGG chr11 5203098 5203117 5203101 -
aatacttggggtagataatt

SEQ ID NO: 51479 - DNA, 20 bp, Artificial Sequence
  Synthetic oligonucleotide; GAG chr11 5203096 5203115 5203099 -
tacttggggtagataattcg

SEQ ID NO: 51480 - DNA, 20 bp, Artificial Sequence
  Synthetic oligonucleotide; CAG chr11 5203091 5203110 5203094 -
ggggtagataattcggagca

SEQ ID NO: 51481 - DNA, 20 bp, Artificial Sequence
  Synthetic oligonucleotide; GAG chr11 5203089 5203108 5203092 -
ggtagataattcggagcaca

SEQ ID NO: 51482 - DNA, 20 bp, Artificial Sequence
  Synthetic oligonucleotide; AAG chr11 5203086 5203105 5203089 -
agataattcggagcacagag

SEQ ID NO: 51483 - DNA, 20 bp, Artificial Sequence
  Synthetic oligonucleotide; TGG chr11 5203079 5203098 5203082 -
tcggagcacagagaagacca

SEQ ID NO: 51484 - DNA, 20 bp, Artificial Sequence
  Synthetic oligonucleotide; GGG chr11 5203078 5203097 5203081 -
cggagcacagagaagaccat

SEQ ID NO: 51485 - DNA, 20 bp, Artificial Sequence
  Synthetic oligonucleotide; AAG chr11 5203073 5203092 5203076 -
cacagagaagaccatgggca

SEQ ID NO: 51486 - DNA, 20 bp, Artificial Sequence
  Synthetic oligonucleotide; GAG chr11 5203065 5203084 5203068 -
agaccatgggcaaagatcct

SEQ ID NO: 51487 - DNA, 20 bp, Artificial Sequence
  Synthetic oligonucleotide; TAG chr11 5203049 5203068 5203052 -
tcctgagacatgcatgtact

SEQ ID NO: 51488 - DNA, 20 bp, Artificial Sequence
  Synthetic oligonucleotide; GAG chr11 5203038 5203057 5203041 -
gcatgtacttagcttgtttt

SEQ ID NO: 51489 - DNA, 20 bp, Artificial Sequence
  Synthetic oligonucleotide; AGG chr11 5203037 5203056 5203040 -
catgtacttagcttgttttg

SEQ ID NO: 51490 - DNA, 20 bp, Artificial Sequence
  Synthetic oligonucleotide; AAG chr11 5203034 5203053 5203037 -
gtacttagcttgttttgagg

SEQ ID NO: 51491 - DNA, 20 bp, Artificial Sequence
  Synthetic oligonucleotide; AAG chr11 5203028 5203047 5203031 -
agcttgttttgaggaagata

SEQ ID NO: 51492 - DNA, 20 bp, Artificial Sequence
  Synthetic oligonucleotide; AAG chr11 5203012 5203031 5203015 -
gataaagatacctaaatatt

SEQ ID NO: 51493 - DNA, 20 bp, Artificial Sequence
  Synthetic oligonucleotide; AGG chr11 5203011 5203030 5203014 -
ataaagatacctaaatatta

SEQ ID NO: 51494 - DNA, 20 bp, Artificial Sequence
  Synthetic oligonucleotide; GAG chr11 5203009 5203028 5203012 -
aaagatacctaaatattaag

SEQ ID NO: 51495 - DNA, 20 bp, Artificial Sequence
  Synthetic oligonucleotide; TAG chr11 5203004 5203023 5203007 -
tacctaaatattaaggagtg

SEQ ID NO: 51496 - DNA, 20 bp, Artificial Sequence
  Synthetic oligonucleotide; AGG chr11 5203003 5203022 5203006 -
acctaaatattaaggagtgt

SEQ ID NO: 51497 - DNA, 20 bp, Artificial Sequence
  Synthetic oligonucleotide; CAG chr11 5203000 5203019 5203003 -
taaatattaaggagtgtagg

SEQ ID NO: 51498 - DNA, 20 bp, Artificial Sequence
  Synthetic oligonucleotide; TAG chr11 5202997 5203016 5203000 -
atattaaggagtgtaggcag

SEQ ID NO: 51499 - DNA, 20 bp, Artificial Sequence
  Synthetic oligonucleotide; TGG chr11 5202994 5203013 5202997 -
ttaaggagtgtaggcagtag

SEQ ID NO: 51500 - DNA, 20 bp, Artificial Sequence
  Synthetic oligonucleotide; AAG chr11 5202987 5203006 5202990 -
gtgtaggcagtagtggtcta

SEQ ID NO: 51501 - DNA, 20 bp, Artificial Sequence
  Synthetic oligonucleotide; TAG chr11 5202978 5202997 5202981 -
gtagtggtctaaagatgtaa

SEQ ID NO: 51502 - DNA, 20 bp, Artificial Sequence
  Synthetic oligonucleotide; AAG chr11 5202975 5202994 5202978 -
gtggtctaaagatgtaatag

SEQ ID NO: 51503 - DNA, 20 bp, Artificial Sequence
  Synthetic oligonucleotide; GAG chr11 5202973 5202992 5202976 -
ggtctaaagatgtaatagaa

SEQ ID NO: 51504 - DNA, 20 bp, Artificial Sequence
  Synthetic oligonucleotide; AGG chr11 5202972 5202991 5202975 -
gtctaaagatgtaatagaag

SEQ ID NO: 51505 - DNA, 20 bp, Artificial Sequence
  Synthetic oligonucleotide; CAG chr11 5202969 5202988 5202972 -
taaagatgtaatagaagagg

SEQ ID NO: 51506 - DNA, 20 bp, Artificial Sequence
  Synthetic oligonucleotide; AGG chr11 5202968 5202987 5202971 -
aaagatgtaatagaagaggc

SEQ ID NO: 51507 - DNA, 20 bp, Artificial Sequence
  Synthetic oligonucleotide; GAG chr11 5202964 5202983 5202967 -
atgtaatagaagaggcaggt

SEQ ID NO: 51508 - DNA, 20 bp, Artificial Sequence
  Synthetic oligonucleotide; AAG chr11 5202950 5202969 5202953 -
gcaggtgagccacgttatac

SEQ ID NO: 51509 - DNA, 20 bp, Artificial Sequence
  Synthetic oligonucleotide; AGG chr11 5202949 5202968 5202952 -
caggtgagccacgttataca

SEQ ID NO: 51510 - DNA, 20 bp, Artificial Sequence
  Synthetic oligonucleotide; AAG chr11 5202930 5202949 5202933 -
aaggctttttgactatgata

SEQ ID NO: 51511 - DNA, 20 bp, Artificial Sequence
  Synthetic oligonucleotide; GAG chr11 5202908 5202927 5202911 -
gaatttgtattttacattac

SEQ ID NO: 51512 - DNA, 20 bp, Artificial Sequence
  Synthetic oligonucleotide; TGG chr11 5202902 5202921 5202905 -
gtattttacattacgagcaa

SEQ ID NO: 51513 - DNA, 20 bp, Artificial Sequence
  Synthetic oligonucleotide; GGG chr11 5202901 5202920 5202904 -
tattttacattacgagcaat

SEQ ID NO: 51514 - DNA, 20 bp, Artificial Sequence
  Synthetic oligonucleotide; AAG chr11 5202897 5202916 5202900 -
ttacattacgagcaatgggt

SEQ ID NO: 51515 - DNA, 20 bp, Artificial Sequence
  Synthetic oligonucleotide; AAG chr11 5202885 5202904 5202888 -
caatgggtaagtgaccatca

SEQ ID NO: 51516 - DNA, 20 bp, Artificial Sequence
  Synthetic oligonucleotide; GAG chr11 5202883 5202902 5202886 -
atgggtaagtgaccatcaaa

SEQ ID NO: 51517 - DNA, 20 bp, Artificial Sequence
  Synthetic oligonucleotide; AAG chr11 5202869 5202888 5202872 -
atcaaagagttttttcaaca

SEQ ID NO: 51518 - DNA, 20 bp, Artificial Sequence
  Synthetic oligonucleotide; AGG chr11 5202868 5202887 5202871 -
tcaaagagttttttcaacaa

SEQ ID NO: 51519 - DNA, 20 bp, Artificial Sequence
  Synthetic oligonucleotide; TAG chr11 5202854 5202873 5202857 -
caacaaaggtttgtgtgatt

SEQ ID NO: 51520 - DNA, 20 bp, Artificial Sequence
  Synthetic oligonucleotide; TAG chr11 5202851 5202870 5202854 -
caaaggtttgtgtgatttag

SEQ ID NO: 51521 - DNA, 20 bp, Artificial Sequence
  Synthetic oligonucleotide; TAG chr11 5202841 5202860 5202844 -
tgtgatttagtagatgtttg

SEQ ID NO: 51522 - DNA, 20 bp, Artificial Sequence
  Synthetic oligonucleotide; AAG chr11 5202836 5202855 5202839 -
tttagtagatgtttgtagaa

SEQ ID NO: 51523 - DNA, 20 bp, Artificial Sequence
  Synthetic oligonucleotide; TGG chr11 5202828 5202847 5202831 -
atgtttgtagaaaagcaatt

SEQ ID NO: 51524 - DNA, 20 bp, Artificial Sequence
  Synthetic oligonucleotide; TGG chr11 5202819 5202838 5202822 -
gaaaagcaatttggtttccc

SEQ ID NO: 51525 - DNA, 20 bp, Artificial Sequence
  Synthetic oligonucleotide; GAG chr11 5202817 5202836 5202820 -
aaagcaatttggtttccctg

SEQ ID NO: 51526 - DNA, 20 bp, Artificial Sequence
  Synthetic oligonucleotide; TAG chr11 5202801 5202820 5202804 -
cctggagataatacattttt

SEQ ID NO: 51527 - DNA, 20 bp, Artificial Sequence
  Synthetic oligonucleotide; GAG chr11 5202799 5202818 5202802 -
tggagataatacatttttta

SEQ ID NO: 51528 - DNA, 20 bp, Artificial Sequence
  Synthetic oligonucleotide; AGG chr11 5202798 5202817 5202801 -
ggagataatacattttttag

SEQ ID NO: 51529 - DNA, 20 bp, Artificial Sequence
  Synthetic oligonucleotide; CAG chr11 5202790 5202809 5202793 -
tacattttttagaggacaaa

SEQ ID NO: 51530 - DNA, 20 bp, Artificial Sequence
  Synthetic oligonucleotide; TAG chr11 5202773 5202792 5202776 -
aaacagataaatcatgatat

SEQ ID NO: 51531 - DNA, 20 bp, Artificial Sequence
  Synthetic oligonucleotide; TAG chr11 5202769 5202788 5202772 -
agataaatcatgatattagc

SEQ ID NO: 51532 - DNA, 20 bp, Artificial Sequence
  Synthetic oligonucleotide; TAG chr11 5202728 5202747 5202731 -
attaatttaataaattatca

SEQ ID NO: 51533 - DNA, 20 bp, Artificial Sequence
  Synthetic oligonucleotide; TAG chr11 5202725 5202744 5202728 -
aatttaataaattatcatag

SEQ ID NO: 51534 - DNA, 20 bp, Artificial Sequence
  Synthetic oligonucleotide; CAG chr11 5202721 5202740 5202724 -
taataaattatcatagtagc

SEQ ID NO: 51535 - DNA, 20 bp, Artificial Sequence
  Synthetic oligonucleotide; AGG chr11 5202720 5202739 5202723 -
aataaattatcatagtagcc

SEQ ID NO: 51536 - DNA, 20 bp, Artificial Sequence
  Synthetic oligonucleotide; GGG chr11 5202719 5202738 5202722 -
ataaattatcatagtagcca

SEQ ID NO: 51537 - DNA, 20 bp, Artificial Sequence
  Synthetic oligonucleotide; AAG chr11 5202696 5202715 5202699 -
aaacaatgatattataaacc

SEQ ID NO: 51538 - DNA, 20 bp, Artificial Sequence
  Synthetic oligonucleotide; CGG chr11 5202692 5202711 5202695 -
aatgatattataaaccaaga

SEQ ID NO: 51539 - DNA, 20 bp, Artificial Sequence
  Synthetic oligonucleotide; GGG chr11 5202691 5202710 5202694 -
atgatattataaaccaagac

SEQ ID NO: 51540 - DNA, 20 bp, Artificial Sequence
  Synthetic oligonucleotide; AAG chr11 5202678 5202697 5202681 -
ccaagacgggcaatgtgtaa

SEQ ID NO: 51541 - DNA, 20 bp, Artificial Sequence
  Synthetic oligonucleotide; TGG chr11 5202675 5202694 5202678 -
agacgggcaatgtgtaaaag

SEQ ID NO: 51542 - DNA, 20 bp, Artificial Sequence
  Synthetic oligonucleotide; GGG chr11 5202674 5202693 5202677 -
gacgggcaatgtgtaaaagt

SEQ ID NO: 51543 - DNA, 20 bp, Artificial Sequence
  Synthetic oligonucleotide; TGG chr11 5202665 5202684 5202668 -
tgtgtaaaagtgggcctatc

SEQ ID NO: 51544 - DNA, 20 bp, Artificial Sequence
  Synthetic oligonucleotide; GGG chr11 5202664 5202683 5202667 -
gtgtaaaagtgggcctatct

SEQ ID NO: 51545 - DNA, 20 bp, Artificial Sequence
  Synthetic oligonucleotide; TGG chr11 5202652 5202671 5202655 -
gcctatctgggatgtgtttc

SEQ ID NO: 51546 - DNA, 20 bp, Artificial Sequence
  Synthetic oligonucleotide; TAG chr11 5202649 5202668 5202652 -
tatctgggatgtgtttctgg

SEQ ID NO: 51547 - DNA, 20 bp, Artificial Sequence
  Synthetic oligonucleotide; TGG chr11 5202643 5202662 5202646 -
ggatgtgtttctggtagaaa

SEQ ID NO: 51548 - DNA, 20 bp, Artificial Sequence
  Synthetic oligonucleotide; TAG chr11 5202640 5202659 5202643 -
tgtgtttctggtagaaatgg

SEQ ID NO: 51549 - DNA, 20 bp, Artificial Sequence
  Synthetic oligonucleotide; AAG chr11 5202627 5202646 5202630 -
gaaatggtagaaattgatga

SEQ ID NO: 51550 - DNA, 20 bp, Artificial Sequence
  Synthetic oligonucleotide; TGG chr11 5202618 5202637 5202621 -
gaaattgatgaaagatttga

SEQ ID NO: 51551 - DNA, 20 bp, Artificial Sequence
  Synthetic oligonucleotide; GAG chr11 5202616 5202635 5202619 -
aattgatgaaagatttgatg

SEQ ID NO: 51552 - DNA, 20 bp, Artificial Sequence
  Synthetic oligonucleotide; GAG chr11 5202614 5202633 5202617 -
ttgatgaaagatttgatgga

SEQ ID NO: 51553 - DNA, 20 bp, Artificial Sequence
  Synthetic oligonucleotide; GAG chr11 5202612 5202631 5202615 -
gatgaaagatttgatggaga

SEQ ID NO: 51554 - DNA, 20 bp, Artificial Sequence
  Synthetic oligonucleotide; AGG chr11 5202611 5202630 5202614 -
atgaaagatttgatggagag

SEQ ID NO: 51555 - DNA, 20 bp, Artificial Sequence
  Synthetic oligonucleotide; AAG chr11 5202607 5202626 5202610 -
aagatttgatggagagagga

SEQ ID NO: 51556 - DNA, 20 bp, Artificial Sequence
  Synthetic oligonucleotide; AGG chr11 5202606 5202625 5202609 -
agatttgatggagagaggaa

SEQ ID NO: 51557 - DNA, 20 bp, Artificial Sequence
  Synthetic oligonucleotide; GGG chr11 5202605 5202624 5202608 -
gatttgatggagagaggaaa

SEQ ID NO: 51558 - DNA, 20 bp, Artificial Sequence
  Synthetic oligonucleotide; AAG chr11 5202602 5202621 5202605 -
ttgatggagagaggaaaggg

SEQ ID NO: 51559 - DNA, 20 bp, Artificial Sequence
  Synthetic oligonucleotide; AGG chr11 5202601 5202620 5202604 -
tgatggagagaggaaaggga

SEQ ID NO: 51560 - DNA, 20 bp, Artificial Sequence
  Synthetic oligonucleotide; AAG chr11 5202597 5202616 5202600 -
ggagagaggaaagggaagga

SEQ ID NO: 51561 - DNA, 20 bp, Artificial Sequence
  Synthetic oligonucleotide; GAG chr11 5202595 5202614 5202598 -
agagaggaaagggaaggaaa

SEQ ID NO: 51562 - DNA, 20 bp, Artificial Sequence
  Synthetic oligonucleotide; GAG chr11 5202593 5202612 5202596 -
agaggaaagggaaggaaaga

SEQ ID NO: 51563 - DNA, 20 bp, Artificial Sequence
  Synthetic oligonucleotide; AAG chr11 5202565 5202584 5202568 -
aaaaattttaaaaatgactc

SEQ ID NO: 51564 - DNA, 20 bp, Artificial Sequence
  Synthetic oligonucleotide; TGG chr11 5202538 5202557 5202541 -
gtcttatgcaattgtgttat

SEQ ID NO: 51565 - DNA, 20 bp, Artificial Sequence
  Synthetic oligonucleotide; TGG chr11 5202535 5202554 5202538 -
ttatgcaattgtgttattgg

SEQ ID NO: 51566 - DNA, 20 bp, Artificial Sequence
  Synthetic oligonucleotide; GAG chr11 5202533 5202552 5202536 -
atgcaattgtgttattggtg

SEQ ID NO: 51567 - DNA, 20 bp, Artificial Sequence
  Synthetic oligonucleotide; TAG chr11 5202516 5202535 5202519 -
gtggagtcactttataatat

SEQ ID NO: 51568 - DNA, 20 bp, Artificial Sequence
  Synthetic oligonucleotide; AGG chr11 5202515 5202534 5202518 -
tggagtcactttataatatt

SEQ ID NO: 51569 - DNA, 20 bp, Artificial Sequence
  Synthetic oligonucleotide; GAG chr11 5202513 5202532 5202516 -
gagtcactttataatattag

SEQ ID NO: 51570 - DNA, 20 bp, Artificial Sequence
  Synthetic oligonucleotide; AAG chr11 5202508 5202527 5202511 -
actttataatattaggagaa

SEQ ID NO: 51571 - DNA, 20 bp, Artificial Sequence
  Synthetic oligonucleotide; AGG chr11 5202507 5202526 5202510 -
ctttataatattaggagaaa

SEQ ID NO: 51572 - DNA, 20 bp, Artificial Sequence
  Synthetic oligonucleotide; GGG chr11 5202506 5202525 5202509 -
tttataatattaggagaaaa

SEQ ID NO: 51573 - DNA, 20 bp, Artificial Sequence
  Synthetic oligonucleotide; CAG chr11 5202502 5202521 5202505 -
taatattaggagaaaaggga

SEQ ID NO: 51574 - DNA, 20 bp, Artificial Sequence
  Synthetic oligonucleotide; TAG chr11 5202495 5202514 5202498 -
aggagaaaagggacagaaaa

SEQ ID NO: 51575 - DNA, 20 bp, Artificial Sequence
  Synthetic oligonucleotide; TGG chr11 5202488 5202507 5202491 -
aagggacagaaaatagattt

SEQ ID NO: 51576 - DNA, 20 bp, Artificial Sequence
  Synthetic oligonucleotide; GGG chr11 5202487 5202506 5202490 -
agggacagaaaatagatttt

SEQ ID NO: 51577 - DNA, 20 bp, Artificial Sequence
  Synthetic oligonucleotide; GGG chr11 5202486 5202505 5202489 -
gggacagaaaatagattttg

SEQ ID NO: 51578 - DNA, 20 bp, Artificial Sequence
  Synthetic oligonucleotide; GGG chr11 5202485 5202504 5202488 -
ggacagaaaatagattttgg

SEQ ID NO: 51579 - DNA, 20 bp, Artificial Sequence
  Synthetic oligonucleotide; GGG chr11 5202484 5202503 5202487 -
gacagaaaatagattttggg

SEQ ID NO: 51580 - DNA, 20 bp, Artificial Sequence
  Synthetic oligonucleotide; AAG chr11 5202475 5202494 5202478 -
tagattttggggggaaaatc

SEQ ID NO: 51581 - DNA, 20 bp, Artificial Sequence
  Synthetic oligonucleotide; TGG chr11 5202464 5202483 5202467 -
gggaaaatcaagtactttat

SEQ ID NO: 51582 - DNA, 20 bp, Artificial Sequence
  Synthetic oligonucleotide; AAG chr11 5202446 5202465 5202449 -
attggcatcattcttatttt

SEQ ID NO: 51583 - DNA, 20 bp, Artificial Sequence
  Synthetic oligonucleotide; CAG chr11 5202433 5202452 5202436 -
ttattttaagattaaacact

SEQ ID NO: 51584 - DNA, 20 bp, Artificial Sequence
  Synthetic oligonucleotide; TAG chr11 5202416 5202435 5202419 -
actcagatgaatatattaaa

SEQ ID NO: 51585 - DNA, 20 bp, Artificial Sequence
  Synthetic oligonucleotide; CAG chr11 5202412 5202431 5202415 -
agatgaatatattaaatagc

SEQ ID NO: 51586 - DNA, 20 bp, Artificial Sequence
  Synthetic oligonucleotide; GAG chr11 5202393 5202412 5202396 -
ccagttgtattcatgaattt

SEQ ID NO: 51587 - DNA, 20 bp, Artificial Sequence
  Synthetic oligonucleotide; CAG chr11 5202386 5202405 5202389 -
tattcatgaatttgagctct

SEQ ID NO: 51588 - DNA, 20 bp, Artificial Sequence
  Synthetic oligonucleotide; AGG chr11 5202385 5202404 5202388 -
attcatgaatttgagctctc

SEQ ID NO: 51589 - DNA, 20 bp, Artificial Sequence
  Synthetic oligonucleotide; GAG chr11 5202383 5202402 5202386 -
tcatgaatttgagctctcag

SEQ ID NO: 51590 - DNA, 20 bp, Artificial Sequence
  Synthetic oligonucleotide; TGG chr11 5202380 5202399 5202383 -
tgaatttgagctctcaggag

SEQ ID NO: 51591 - DNA, 20 bp, Artificial Sequence
  Synthetic oligonucleotide; CAG chr11 5202376 5202395 5202379 -
tttgagctctcaggagtggt

SEQ ID NO: 51592 - DNA, 20 bp, Artificial Sequence
  Synthetic oligonucleotide; AGG chr11 5202375 5202394 5202378 -
ttgagctctcaggagtggtc

SEQ ID NO: 51593 - DNA, 20 bp, Artificial Sequence
  Synthetic oligonucleotide; CAG chr11 5202369 5202388 5202372 -
tctcaggagtggtcaggaat

SEQ ID NO: 51594 - DNA, 20 bp, Artificial Sequence
  Synthetic oligonucleotide; GAG chr11 5202367 5202386 5202370 -
tcaggagtggtcaggaatca

SEQ ID NO: 51595 - DNA, 20 bp, Artificial Sequence
  Synthetic oligonucleotide; AGG chr11 5202366 5202385 5202369 -
caggagtggtcaggaatcag

SEQ ID NO: 51596 - DNA, 20 bp, Artificial Sequence
  Synthetic oligonucleotide; TAG chr11 5202354 5202373 5202357 -
ggaatcagaggtgcaaatgt

SEQ ID NO: 51597 - DNA, 20 bp, Artificial Sequence
  Synthetic oligonucleotide; AAG chr11 5202340 5202359 5202343 -
aaatgttagtttcaaataat

SEQ ID NO: 51598 - DNA, 20 bp, Artificial Sequence
  Synthetic oligonucleotide; AAG chr11 5202334 5202353 5202337 -
tagtttcaaataataagaaa

SEQ ID NO: 51599 - DNA, 20 bp, Artificial Sequence
  Synthetic oligonucleotide; TAG chr11 5202325 5202344 5202328 -
ataataagaaaaagttgaca

SEQ ID NO: 51600 - DNA, 20 bp, Artificial Sequence
  Synthetic oligonucleotide; AAG chr11 5202312 5202331 5202315 -
gttgacatagtctgcacatt

SEQ ID NO: 51601 - DNA, 20 bp, Artificial Sequence
  Synthetic oligonucleotide; AGG chr11 5202311 5202330 5202314 -
ttgacatagtctgcacatta

SEQ ID NO: 51602 - DNA, 20 bp, Artificial Sequence
  Synthetic oligonucleotide; GAG chr11 5202304 5202323 5202307 -
agtctgcacattaaggaact

SEQ ID NO: 51603 - DNA, 20 bp, Artificial Sequence
  Synthetic oligonucleotide; TAG chr11 5202297 5202316 5202300 -
acattaaggaactgagaatt

SEQ ID NO: 51604 - DNA, 20 bp, Artificial Sequence
  Synthetic oligonucleotide; CAG chr11 5202287 5202306 5202290 -
actgagaatttagtttgtaa

SEQ ID NO: 51605 - DNA, 20 bp, Artificial Sequence
  Synthetic oligonucleotide; GAG chr11 5202285 5202304 5202288 -
tgagaatttagtttgtaaca

SEQ ID NO: 51606 - DNA, 20 bp, Artificial Sequence
  Synthetic oligonucleotide; TAG chr11 5202278 5202297 5202281 -
ttagtttgtaacagagatat

SEQ ID NO: 51607 - DNA, 20 bp, Artificial Sequence
  Synthetic oligonucleotide; TAG chr11 5202266 5202285 5202269 -
agagatattagttaaatatt

SEQ ID NO: 51608 - DNA, 20 bp, Artificial Sequence
  Synthetic oligonucleotide; TAG chr11 5202254 5202273 5202257 -
taaatatttagtttaaatat

SEQ ID NO: 51609 - DNA, 20 bp, Artificial Sequence
  Synthetic oligonucleotide; TAG chr11 5202242 5202261 5202245 -
ttaaatattagttaaatatt

SEQ ID NO: 51610 - DNA, 20 bp, Artificial Sequence
  Synthetic oligonucleotide; AAG chr11 5202220 5202239 5202223 -
gctaataaatacaaaattat

SEQ ID NO: 51611 - DNA, 20 bp, Artificial Sequence
  Synthetic oligonucleotide; TAG chr11 5202183 5202202 5202186 -
gaaacatgataccaaaataa

SEQ ID NO: 51612 - DNA, 20 bp, Artificial Sequence
  Synthetic oligonucleotide; TGG chr11 5202175 5202194 5202178 -
ataccaaaataatagatata

SEQ ID NO: 51613 - DNA, 20 bp, Artificial Sequence
  Synthetic oligonucleotide; AAG chr11 5202159 5202178 5202162 -
tatatggataaatttgtctt

SEQ ID NO: 51614 - DNA, 20 bp, Artificial Sequence
  Synthetic oligonucleotide; AAG chr11 5202144 5202163 5202147 -
gtcttaagaaacttcttgaa

SEQ ID NO: 51615 - DNA, 20 bp, Artificial Sequence
  Synthetic oligonucleotide; GAG chr11 5202133 5202152 5202136 -
cttcttgaaaagtgattgtt

SEQ ID NO: 51616 - DNA, 20 bp, Artificial Sequence
  Synthetic oligonucleotide; AAG chr11 5202126 5202145 5202129 -
aaaagtgattgttgagttgc

SEQ ID NO: 51617 - DNA, 20 bp, Artificial Sequence
  Synthetic oligonucleotide; AAG chr11 5202112 5202131 5202115 -
agttgcaagatcgttttaaa

SEQ ID NO: 51618 - DNA, 20 bp, Artificial Sequence
  Synthetic oligonucleotide; AGG chr11 5202111 5202130 5202114 -
gttgcaagatcgttttaaaa

SEQ ID NO: 51619 - DNA, 20 bp, Artificial Sequence
  Synthetic oligonucleotide; GGG chr11 5202110 5202129 5202113 -
ttgcaagatcgttttaaaaa

SEQ ID NO: 51620 - DNA, 20 bp, Artificial Sequence
  Synthetic oligonucleotide; TAG chr11 5202107 5202126 5202110 -
caagatcgttttaaaaaggg

SEQ ID NO: 51621 - DNA, 20 bp, Artificial Sequence
  Synthetic oligonucleotide; AGG chr11 5202106 5202125 5202109 -
aagatcgttttaaaaagggt

SEQ ID NO: 51622 - DNA, 20 bp, Artificial Sequence
  Synthetic oligonucleotide; AAG chr11 5202103 5202122 5202106 -
atcgttttaaaaagggtagg

SEQ ID NO: 51623 - DNA, 20 bp, Artificial Sequence
  Synthetic oligonucleotide; GAG chr11 5202095 5202114 5202098 -
aaaaagggtaggaagaaatt

SEQ ID NO: 51624 - DNA, 20 bp, Artificial Sequence
  Synthetic oligonucleotide; AGG chr11 5202094 5202113 5202097 -
aaaagggtaggaagaaattg

SEQ ID NO: 51625 - DNA, 20 bp, Artificial Sequence
  Synthetic oligonucleotide; AAG chr11 5202089 5202108 5202092 -
ggtaggaagaaattgaggaa

SEQ ID NO: 51626 - DNA, 20 bp, Artificial Sequence
  Synthetic oligonucleotide; TAG chr11 5202073 5202092 5202076 -
ggaaaagatgatgaataatt

SEQ ID NO: 51627 - DNA, 20 bp, Artificial Sequence
  Synthetic oligonucleotide; AGG chr11 5202072 5202091 5202075 -
gaaaagatgatgaataattt

SEQ ID NO: 51628 - DNA, 20 bp, Artificial Sequence
  Synthetic oligonucleotide; CAG chr11 5202069 5202088 5202072 -
aagatgatgaataatttagg

SEQ ID NO: 51629 - DNA, 20 bp, Artificial Sequence
  Synthetic oligonucleotide; TAG chr11 5202065 5202084 5202068 -
tgatgaataatttaggcaga

SEQ ID NO: 51630 - DNA, 20 bp, Artificial Sequence
  Synthetic oligonucleotide; GAG chr11 5202054 5202073 5202057 -
ttaggcagatagaacatttc

SEQ ID NO: 51631 - DNA, 20 bp, Artificial Sequence
  Synthetic oligonucleotide; AAG chr11 5202038 5202057 5202041 -
tttcgagaaaaattttacga

SEQ ID NO: 51632 - DNA, 20 bp, Artificial Sequence
  Synthetic oligonucleotide; AAG chr11 5202035 5202054 5202038 -
cgagaaaaattttacgaaag

SEQ ID NO: 51633 - DNA, 20 bp, Artificial Sequence
  Synthetic oligonucleotide; GAG chr11 5202033 5202052 5202036 -
agaaaaattttacgaaagaa

SEQ ID NO: 51634 - DNA, 20 bp, Artificial Sequence
  Synthetic oligonucleotide; TAG chr11 5202020 5202039 5202023 -
gaaagaagagaaattcgatt

SEQ ID NO: 51635 - DNA, 20 bp, Artificial Sequence
  Synthetic oligonucleotide; GAG chr11 5202018 5202037 5202021 -
aagaagagaaattcgattta

SEQ ID NO: 51636 - DNA, 20 bp, Artificial Sequence
  Synthetic oligonucleotide; AAG chr11 5202009 5202028 5202012 -
aattcgatttagagaaatga

SEQ ID NO: 51637 - DNA, 20 bp, Artificial Sequence
  Synthetic oligonucleotide; AAG chr11 5202006 5202025 5202009 -
tcgatttagagaaatgaaag

SEQ ID NO: 51638 - DNA, 20 bp, Artificial Sequence
  Synthetic oligonucleotide; AAG chr11 5201991 5202010 5201994 -
gaaagaagatacgtattcaa

SEQ ID NO: 51639 - DNA, 20 bp, Artificial Sequence
  Synthetic oligonucleotide; AAG chr11 5201971 5201990 5201974 -
aagactgaaaaatcctctgc

SEQ ID NO: 51640 - DNA, 20 bp, Artificial Sequence
  Synthetic oligonucleotide; AAG chr11 5201963 5201982 5201966 -
aaaatcctctgcaagaaacg

SEQ ID NO: 51641 - DNA, 20 bp, Artificial Sequence
  Synthetic oligonucleotide; AAG chr11 5201953 5201972 5201956 -
gcaagaaacgaagaaacttc

SEQ ID NO: 51642 - DNA, 20 bp, Artificial Sequence
  Synthetic oligonucleotide; TGG chr11 5201943 5201962 5201946 -
aagaaacttcaagcattcta

SEQ ID NO: 51643 - DNA, 20 bp, Artificial Sequence
  Synthetic oligonucleotide; GAG chr11 5201941 5201960 5201944 -
gaaacttcaagcattctatg

SEQ ID NO: 51644 - DNA, 20 bp, Artificial Sequence
  Synthetic oligonucleotide; AAG chr11 5201934 5201953 5201937 -
caagcattctatggagaaaa

SEQ ID NO: 51645 - DNA, 20 bp, Artificial Sequence
  Synthetic oligonucleotide; TAG chr11 5201922 5201941 5201925 -
ggagaaaaaagtattaaaaa

SEQ ID NO: 51646 - DNA, 20 bp, Artificial Sequence
  Synthetic oligonucleotide; GAG chr11 5201918 5201937 5201921 -
aaaaaagtattaaaaatagt

SEQ ID NO: 51647 - DNA, 20 bp, Artificial Sequence
  Synthetic oligonucleotide; AAG chr11 5201913 5201932 5201916 -
agtattaaaaatagtgagct

SEQ ID NO: 51648 - DNA, 20 bp, Artificial Sequence
  Synthetic oligonucleotide; GAG chr11 5201898 5201917 5201901 -
gagctaagttattcaatgct

SEQ ID NO: 51649 - DNA, 20 bp, Artificial Sequence
  Synthetic oligonucleotide; AAG chr11 5201895 5201914 5201898 -
ctaagttattcaatgctgag

SEQ ID NO: 51650 - DNA, 20 bp, Artificial Sequence
  Synthetic oligonucleotide; AGG chr11 5201894 5201913 5201897 -
taagttattcaatgctgaga

SEQ ID NO: 51651 - DNA, 20 bp, Artificial Sequence
  Synthetic oligonucleotide; GAG chr11 5201892 5201911 5201895 -
agttattcaatgctgagaag

SEQ ID NO: 51652 - DNA, 20 bp, Artificial Sequence
  Synthetic oligonucleotide; CAG chr11 5201888 5201907 5201891 -
attcaatgctgagaaggagt

SEQ ID NO: 51653 - DNA, 20 bp, Artificial Sequence
  Synthetic oligonucleotide; AGG chr11 5201887 5201906 5201890 -
ttcaatgctgagaaggagtc

SEQ ID NO: 51654 - DNA, 20 bp, Artificial Sequence
  Synthetic oligonucleotide; GGG chr11 5201886 5201905 5201889 -
tcaatgctgagaaggagtca

SEQ ID NO: 51655 - DNA, 20 bp, Artificial Sequence
  Synthetic oligonucleotide; AAG chr11 5201882 5201901 5201885 -
tgctgagaaggagtcagggc

SEQ ID NO: 51656 - DNA, 20 bp, Artificial Sequence
  Synthetic oligonucleotide; TGG chr11 5201871 5201890 5201874 -
agtcagggcaagaaaaacaa

SEQ ID NO: 51657 - DNA, 20 bp, Artificial Sequence
  Synthetic oligonucleotide; TAG chr11 5201867 5201886 5201870 -
agggcaagaaaaacaatggt

SEQ ID NO: 51658 - DNA, 20 bp, Artificial Sequence
  Synthetic oligonucleotide; TAG chr11 5201859 5201878 5201862 -
aaaaacaatggttagactgc

SEQ ID NO: 51659 - DNA, 20 bp, Artificial Sequence
  Synthetic oligonucleotide; AAG chr11 5201856 5201875 5201859 -
aacaatggttagactgctag

SEQ ID NO: 51660 - DNA, 20 bp, Artificial Sequence
  Synthetic oligonucleotide; CAG chr11 5201849 5201868 5201852 -
gttagactgctagaagacgt

SEQ ID NO: 51661 - DNA, 20 bp, Artificial Sequence
  Synthetic oligonucleotide; TAG chr11 5201844 5201863 5201847 -
actgctagaagacgtcagtg

SEQ ID NO: 51662 - DNA, 20 bp, Artificial Sequence
  Synthetic oligonucleotide; TAG chr11 5201839 5201858 5201842 -
tagaagacgtcagtgtagta

SEQ ID NO: 51663 - DNA, 20 bp, Artificial Sequence
  Synthetic oligonucleotide; GAG chr11 5201837 5201856 5201840 -
gaagacgtcagtgtagtata

SEQ ID NO: 51664 - DNA, 20 bp, Artificial Sequence
  Synthetic oligonucleotide; GAG chr11 5201835 5201854 5201838 -
agacgtcagtgtagtataga

SEQ ID NO: 51665 - DNA, 20 bp, Artificial Sequence
  Synthetic oligonucleotide; GAG chr11 5201826 5201845 5201829 -
tgtagtatagagagtacatt

SEQ ID NO: 51666 - DNA, 20 bp, Artificial Sequence
  Synthetic oligonucleotide; AAG chr11 5201823 5201842 5201826 -
agtatagagagtacattgag

SEQ ID NO: 51667 - DNA, 20 bp, Artificial Sequence
  Synthetic oligonucleotide; AAG chr11 5201819 5201838 5201822 -
tagagagtacattgagaaga

SEQ ID NO: 51668 - DNA, 20 bp, Artificial Sequence
  Synthetic oligonucleotide; TGG chr11 5201812 5201831 5201815 -
tacattgagaagaaagtctg

SEQ ID NO: 51669 - DNA, 20 bp, Artificial Sequence
  Synthetic oligonucleotide; GAG chr11 5201798 5201817 5201801 -
agtctgtggaactgtgttgt

SEQ ID NO: 51670 - DNA, 20 bp, Artificial Sequence
  Synthetic oligonucleotide; AGG chr11 5201797 5201816 5201800 -
gtctgtggaactgtgttgtg

SEQ ID NO: 51671 - DNA, 20 bp, Artificial Sequence
  Synthetic oligonucleotide; AAG chr11 5201789 5201808 5201792 -
aactgtgttgtgaggctaat

SEQ ID NO: 51672 - DNA, 20 bp, Artificial Sequence
  Synthetic oligonucleotide; AAG chr11 5201783 5201802 5201786 -
gttgtgaggctaataagaca

SEQ ID NO: 51673 - DNA, 20 bp, Artificial Sequence
  Synthetic oligonucleotide; AAG chr11 5201775 5201794 5201778 -
gctaataagacaaagctgaa

SEQ ID NO: 51674 - DNA, 20 bp, Artificial Sequence
  Synthetic oligonucleotide; TAG chr11 5201772 5201791 5201775 -
aataagacaaagctgaaaag

SEQ ID NO: 51675 - DNA, 20 bp, Artificial Sequence
  Synthetic oligonucleotide; AGG chr11 5201771 5201790 5201774 -
ataagacaaagctgaaaagt

SEQ ID NO: 51676 - DNA, 20 bp, Artificial Sequence
  Synthetic oligonucleotide; AAG chr11 5201763 5201782 5201766 -
aagctgaaaagtaggacata

SEQ ID NO: 51677 - DNA, 20 bp, Artificial Sequence
  Synthetic oligonucleotide; AGG chr11 5201762 5201781 5201765 -
agctgaaaagtaggacataa

SEQ ID NO: 51678 - DNA, 20 bp, Artificial Sequence
  Synthetic oligonucleotide; GGG chr11 5201761 5201780 5201764 -
gctgaaaagtaggacataaa

SEQ ID NO: 51679 - DNA, 20 bp, Artificial Sequence
  Synthetic oligonucleotide; CAG chr11 5201758 5201777 5201761 -
gaaaagtaggacataaaggg

SEQ ID NO: 51680 - DNA, 20 bp, Artificial Sequence
  Synthetic oligonucleotide; AAG chr11 5201745 5201764 5201748 -
taaagggcagcccaaatctg

SEQ ID NO: 51681 - DNA, 20 bp, Artificial Sequence
  Synthetic oligonucleotide; AAG chr11 5201726 5201745 5201729 -
gaagttactttaacatctcg

SEQ ID NO: 51682 - DNA, 20 bp, Artificial Sequence
  Synthetic oligonucleotide; AAG chr11 5201705 5201724 5201708 -
agttactcaatcaaacatga

SEQ ID NO: 51683 - DNA, 20 bp, Artificial Sequence
  Synthetic oligonucleotide; TGG chr11 5201700 5201719 5201703 -
ctcaatcaaacatgaaagta

SEQ ID NO: 51684 - DNA, 20 bp, Artificial Sequence
  Synthetic oligonucleotide; TAG chr11 5201672 5201691 5201675 -
tgaacatctgtttacattat

SEQ ID NO: 51685 - DNA, 20 bp, Artificial Sequence
  Synthetic oligonucleotide; GAG chr11 5201670 5201689 5201673 -
aacatctgtttacattatta

SEQ ID NO: 51686 - DNA, 20 bp, Artificial Sequence
  Synthetic oligonucleotide; CAG chr11 5201642 5201661 5201645 -
aaaaaacttatgatgattct

SEQ ID NO: 51687 - DNA, 20 bp, Artificial Sequence
  Synthetic oligonucleotide; AGG chr11 5201641 5201660 5201644 -
aaaaacttatgatgattctc

SEQ ID NO: 51688 - DNA, 20 bp, Artificial Sequence
  Synthetic oligonucleotide; TGG chr11 5201636 5201655 5201639 -
cttatgatgattctcaggtc

SEQ ID NO: 51689 - DNA, 20 bp, Artificial Sequence
  Synthetic oligonucleotide; AAG chr11 5201627 5201646 5201630 -
attctcaggtctggaactta

SEQ ID NO: 51690 - DNA, 20 bp, Artificial Sequence
  Synthetic oligonucleotide; CAG chr11 5201624 5201643 5201627 -
ctcaggtctggaacttaaag

SEQ ID NO: 51691 - DNA, 20 bp, Artificial Sequence
  Synthetic oligonucleotide; AGG chr11 5201623 5201642 5201626 -
tcaggtctggaacttaaagc

SEQ ID NO: 51692 - DNA, 20 bp, Artificial Sequence
  Synthetic oligonucleotide; AAG chr11 5201609 5201628 5201612 -
taaagcaggcaaacaatgta

SEQ ID NO: 51693 - DNA, 20 bp, Artificial Sequence
  Synthetic oligonucleotide; AAG chr11 5201606 5201625 5201609 -
agcaggcaaacaatgtaaag

SEQ ID NO: 51694 - DNA, 20 bp, Artificial Sequence
  Synthetic oligonucleotide; AAG chr11 5201603 5201622 5201606 -
aggcaaacaatgtaaagaag

SEQ ID NO: 51695 - DNA, 20 bp, Artificial Sequence
  Synthetic oligonucleotide; GAG chr11 5201580 5201599 5201583 -
ccaattgattctgctaccat

SEQ ID NO: 51696 - DNA, 20 bp, Artificial Sequence
  Synthetic oligonucleotide; AGG chr11 5201579 5201598 5201582 -
caattgattctgctaccatg

SEQ ID NO: 51697 - DNA, 20 bp, Artificial Sequence
  Synthetic oligonucleotide; AAG chr11 5201563 5201582 5201566 -
catgaggcttttgaaattat

SEQ ID NO: 51698 - DNA, 20 bp, Artificial Sequence
  Synthetic oligonucleotide; GAG chr11 5201549 5201568 5201552 -
aattataagcttgcttgttt

SEQ ID NO: 51699 - DNA, 20 bp, Artificial Sequence
  Synthetic oligonucleotide; TGG chr11 5201544 5201563 5201547 -
taagcttgcttgtttgagcc

SEQ ID NO: 51700 - DNA, 20 bp, Artificial Sequence
  Synthetic oligonucleotide; TAG chr11 5201529 5201548 5201532 -
gagcctggctttgtgatctg

SEQ ID NO: 51701 - DNA, 20 bp, Artificial Sequence
  Synthetic oligonucleotide; CAG chr11 5201521 5201540 5201524 -
ctttgtgatctgtagaactg

SEQ ID NO: 51702 - DNA, 20 bp, Artificial Sequence
  Synthetic oligonucleotide; AGG chr11 5201520 5201539 5201523 -
tttgtgatctgtagaactgc

SEQ ID NO: 51703 - DNA, 20 bp, Artificial Sequence
  Synthetic oligonucleotide; AAG chr11 5201513 5201532 5201516 -
tctgtagaactgcaggttct

SEQ ID NO: 51704 - DNA, 20 bp, Artificial Sequence
  Synthetic oligonucleotide; AAG chr11 5201509 5201528 5201512 -
tagaactgcaggttctaaga

SEQ ID NO: 51705 - DNA, 20 bp, Artificial Sequence
  Synthetic oligonucleotide; TGG chr11 5201496 5201515 5201499 -
tctaagaaagaaaacacaat

SEQ ID NO: 51706 - DNA, 20 bp, Artificial Sequence
  Synthetic oligonucleotide; TAG chr11 5201461 5201480 5201464 -
ataaatgtatattgaataaa

SEQ ID NO: 51707 - DNA, 20 bp, Artificial Sequence
  Synthetic oligonucleotide; CAG chr11 5201453 5201472 5201456 -
atattgaataaatagttaat

SEQ ID NO: 51708 - DNA, 20 bp, Artificial Sequence
  Synthetic oligonucleotide; AAG chr11 5201431 5201450 5201434 -
gctcattaactgaataaata

SEQ ID NO: 51709 - DNA, 20 bp, Artificial Sequence
  Synthetic oligonucleotide; AGG chr11 5201430 5201449 5201433 -
ctcattaactgaataaataa

SEQ ID NO: 51710 - DNA, 20 bp, Artificial Sequence
  Synthetic oligonucleotide; TGG chr11 5201425 5201444 5201428 -
taactgaataaataaaggaa

SEQ ID NO: 51711 - DNA, 20 bp, Artificial Sequence
  Synthetic oligonucleotide; GGG chr11 5201424 5201443 5201427 -
aactgaataaataaaggaat

SEQ ID NO: 51712 - DNA, 20 bp, Artificial Sequence
  Synthetic oligonucleotide; AAG chr11 5201421 5201440 5201424 -
tgaataaataaaggaatggg

SEQ ID NO: 51713 - DNA, 20 bp, Artificial Sequence
  Synthetic oligonucleotide; GAG chr11 5201414 5201433 5201417 -
ataaaggaatgggaagcact

SEQ ID NO: 51714 - DNA, 20 bp, Artificial Sequence
  Synthetic oligonucleotide; AAG chr11 5201402 5201421 5201405 -
gaagcactgagctgctatca

SEQ ID NO: 51715 - DNA, 20 bp, Artificial Sequence
  Synthetic oligonucleotide; AGG chr11 5201401 5201420 5201404 -
aagcactgagctgctatcaa

SEQ ID NO: 51716 - DNA, 20 bp, Artificial Sequence
  Synthetic oligonucleotide; CAG chr11 5201396 5201415 5201399 -
ctgagctgctatcaaaggct

SEQ ID NO: 51717 - DNA, 20 bp, Artificial Sequence
  Synthetic oligonucleotide; AAG chr11 5201365 5201384 5201368 -
atctaattctctacatcaca

SEQ ID NO: 51718 - DNA, 20 bp, Artificial Sequence
  Synthetic oligonucleotide; AGG chr11 5201364 5201383 5201367 -
tctaattctctacatcacaa

SEQ ID NO: 51719 - DNA, 20 bp, Artificial Sequence
  Synthetic oligonucleotide; GAG chr11 5201354 5201373 5201357 -
tacatcacaaaggcacaaat

SEQ ID NO: 51720 - DNA, 20 bp, Artificial Sequence
  Synthetic oligonucleotide; AAG chr11 5201340 5201359 5201343 -
acaaatgagttgaacatctc

SEQ ID NO: 51721 - DNA, 20 bp, Artificial Sequence
  Synthetic oligonucleotide; GAG chr11 5201338 5201357 5201341 -
aaatgagttgaacatctcaa

SEQ ID NO: 51722 - DNA, 20 bp, Artificial Sequence
  Synthetic oligonucleotide; AGG chr11 5201337 5201356 5201340 -
aatgagttgaacatctcaag

SEQ ID NO: 51723 - DNA, 20 bp, Artificial Sequence
  Synthetic oligonucleotide; CAG chr11 5201333 5201352 5201336 -
agttgaacatctcaagaggc

SEQ ID NO: 51724 - DNA, 20 bp, Artificial Sequence
  Synthetic oligonucleotide; GAG chr11 5201331 5201350 5201334 -
ttgaacatctcaagaggcca

SEQ ID NO: 51725 - DNA, 20 bp, Artificial Sequence
  Synthetic oligonucleotide; CAG chr11 5201325 5201344 5201328 -
atctcaagaggccagagctc

SEQ ID NO: 51726 - DNA, 20 bp, Artificial Sequence
  Synthetic oligonucleotide; GAG chr11 5201321 5201340 5201324 -
caagaggccagagctccagt

SEQ ID NO: 51727 - DNA, 20 bp, Artificial Sequence
  Synthetic oligonucleotide; AAG chr11 5201305 5201324 5201308 -
cagtgagaaatcatttaccc

SEQ ID NO: 51728 - DNA, 20 bp, Artificial Sequence
  Synthetic oligonucleotide; AGG chr11 5201304 5201323 5201307 -
agtgagaaatcatttaccca

SEQ ID NO: 51729 - DNA, 20 bp, Artificial Sequence
  Synthetic oligonucleotide; AAG chr11 5201263 5201282 5201266 -
ctgtctgcttatcaccaatg

SEQ ID NO: 51730 - DNA, 20 bp, Artificial Sequence
  Synthetic oligonucleotide; AAG chr11 5201257 5201276 5201260 -
gcttatcaccaatgaagaaa

SEQ ID NO: 51731 - DNA, 20 bp, Artificial Sequence
  Synthetic oligonucleotide; TGG chr11 5201247 5201266 5201250 -
aatgaagaaaaagtaattgc

SEQ ID NO: 51732 - DNA, 20 bp, Artificial Sequence
  Synthetic oligonucleotide; TGG chr11 5201234 5201253 5201237 -
taattgctggctacgtcatc

SEQ ID NO: 51733 - DNA, 20 bp, Artificial Sequence
  Synthetic oligonucleotide; GAG chr11 5201232 5201251 5201235 -
attgctggctacgtcatctg

SEQ ID NO: 51734 - DNA, 20 bp, Artificial Sequence
  Synthetic oligonucleotide; AGG chr11 5201231 5201250 5201234 -
ttgctggctacgtcatctgg

SEQ ID NO: 51735 - DNA, 20 bp, Artificial Sequence
  Synthetic oligonucleotide; GGG chr11 5201230 5201249 5201233 -
tgctggctacgtcatctgga

SEQ ID NO: 51736 - DNA, 20 bp, Artificial Sequence
  Synthetic oligonucleotide; GGG chr11 5201229 5201248 5201232 -
gctggctacgtcatctggag

SEQ ID NO: 51737 - DNA, 20 bp, Artificial Sequence
  Synthetic oligonucleotide; GGG chr11 5201228 5201247 5201231 -
ctggctacgtcatctggagg

SEQ ID NO: 51738 - DNA, 20 bp, Artificial Sequence
  Synthetic oligonucleotide; GAG chr11 5201226 5201245 5201229 -
ggctacgtcatctggagggg

SEQ ID NO: 51739 - DNA, 20 bp, Artificial Sequence
  Synthetic oligonucleotide; CAG chr11 5201219 5201238 5201222 -
tcatctggagggggagaaaa

SEQ ID NO: 51740 - DNA, 20 bp, Artificial Sequence
  Synthetic oligonucleotide; AGG chr11 5201218 5201237 5201221 -
catctggagggggagaaaac

SEQ ID NO: 51741 - DNA, 20 bp, Artificial Sequence
  Synthetic oligonucleotide; GAG chr11 5201216 5201235 5201219 -
tctggagggggagaaaacag

SEQ ID NO: 51742 - DNA, 20 bp, Artificial Sequence
  Synthetic oligonucleotide; TAG chr11 5201200 5201219 5201203 -
acaggagtatcttcattaaa

SEQ ID NO: 51743 - DNA, 20 bp, Artificial Sequence
  Synthetic oligonucleotide; TGG chr11 5201193 5201212 5201196 -
tatcttcattaaatagtatt

SEQ ID NO: 51744 - DNA, 20 bp, Artificial Sequence
  Synthetic oligonucleotide; GAG chr11 5201191 5201210 5201194 -
tcttcattaaatagtatttg

SEQ ID NO: 51745 - DNA, 20 bp, Artificial Sequence
  Synthetic oligonucleotide; TGG chr11 5201176 5201195 5201179 -
atttggagaaaaaatatact

SEQ ID NO: 51746 - DNA, 20 bp, Artificial Sequence
  Synthetic oligonucleotide; GAG chr11 5201174 5201193 5201177 -
ttggagaaaaaatatacttg

SEQ ID NO: 51747 - DNA, 20 bp, Artificial Sequence
  Synthetic oligonucleotide; CGG chr11 5201170 5201189 5201173 -
agaaaaaatatacttggaga

SEQ ID NO: 51748 - DNA, 20 bp, Artificial Sequence
  Synthetic oligonucleotide; TGG chr11 5201160 5201179 5201163 -
tacttggagacggcacaaaa

SEQ ID NO: 51749 - DNA, 20 bp, Artificial Sequence
  Synthetic oligonucleotide; CGG chr11 5201150 5201169 5201153 -
cggcacaaaatggaaaatga

SEQ ID NO: 51750 - DNA, 20 bp, Artificial Sequence
  Synthetic oligonucleotide; AAG chr11 5201145 5201164 5201148 -
caaaatggaaaatgacggaa

SEQ ID NO: 51751 - DNA, 20 bp, Artificial Sequence
  Synthetic oligonucleotide; TAG chr11 5201131 5201150 5201134 -
acggaaaagtgactatttaa

SEQ ID NO: 51752 - DNA, 20 bp, Artificial Sequence
  Synthetic oligonucleotide; AAG chr11 5201114 5201133 5201117 -
taatagacttatgatattta

SEQ ID NO: 51753 - DNA, 20 bp, Artificial Sequence
  Synthetic oligonucleotide; AAG chr11 5201107 5201126 5201110 -
cttatgatatttaaagccca

SEQ ID NO: 51754 - DNA, 20 bp, Artificial Sequence
  Synthetic oligonucleotide; TGG chr11 5201074 5201093 5201077 -
acttcgaatgtttaatgaat

SEQ ID NO: 51755 - DNA, 20 bp, Artificial Sequence
  Synthetic oligonucleotide; GAG chr11 5201072 5201091 5201075 -
ttcgaatgtttaatgaattg

SEQ ID NO: 51756 - DNA, 20 bp, Artificial Sequence
  Synthetic oligonucleotide; GAG chr11 5201070 5201089 5201073 -
cgaatgtttaatgaattgga

SEQ ID NO: 51757 - DNA, 20 bp, Artificial Sequence
  Synthetic oligonucleotide; AAG chr11 5201067 5201086 5201070 -
atgtttaatgaattggagag

SEQ ID NO: 51758 - DNA, 20 bp, Artificial Sequence
  Synthetic oligonucleotide; AAG chr11 5201051 5201070 5201054 -
agagaagaaaataatttttc

SEQ ID NO: 51759 - DNA, 20 bp, Artificial Sequence
  Synthetic oligonucleotide; CGG chr11 5201043 5201062 5201046 -
aaataatttttcaagaacct

SEQ ID NO: 51760 - DNA, 20 bp, Artificial Sequence
  Synthetic oligonucleotide; TGG chr11 5201032 5201051 5201035 -
caagaacctcggctctttac

SEQ ID NO: 51761 - DNA, 20 bp, Artificial Sequence
  Synthetic oligonucleotide; TGG chr11 5201006 5201025 5201009 -
aaaatttttaccactatcct

SEQ ID NO: 51762 - DNA, 20 bp, Artificial Sequence
  Synthetic oligonucleotide; GGG chr11 5201005 5201024 5201008 -
aaatttttaccactatcctt

SEQ ID NO: 51763 - DNA, 20 bp, Artificial Sequence
  Synthetic oligonucleotide; AAG chr11 5200993 5201012 5200996 -
ctatccttgggaaaatgtct

SEQ ID NO: 51764 - DNA, 20 bp, Artificial Sequence
  Synthetic oligonucleotide; TAG chr11 5200971 5200990 5200974 -
gcaacgtatttttttaaaac

SEQ ID NO: 51765 - DNA, 20 bp, Artificial Sequence
  Synthetic oligonucleotide; TGG chr11 5200926 5200945 5200929 -
tccttatttgtttttgctta

SEQ ID NO: 51766 - DNA, 20 bp, Artificial Sequence
  Synthetic oligonucleotide; AAG chr11 5200918 5200937 5200921 -
tgtttttgcttatggcttct

SEQ ID NO: 51767 - DNA, 20 bp, Artificial Sequence
  Synthetic oligonucleotide; AGG chr11 5200917 5200936 5200920 -
gtttttgcttatggcttcta

SEQ ID NO: 51768 - DNA, 20 bp, Artificial Sequence
  Synthetic oligonucleotide; CAG chr11 5200901 5200920 5200904 -
tctaaggatatgttcacatc

SEQ ID NO: 51769 - DNA, 20 bp, Artificial Sequence
  Synthetic oligonucleotide; CAG chr11 5200897 5200916 5200900 -
aggatatgttcacatccaga

SEQ ID NO: 51770 - DNA, 20 bp, Artificial Sequence
  Synthetic oligonucleotide; AAG chr11 5200863 5200882 5200866 -
tgacttttaaatgacatcaa

SEQ ID NO: 51771 - DNA, 20 bp, Artificial Sequence
  Synthetic oligonucleotide; AAG chr11 5200860 5200879 5200863 -
cttttaaatgacatcaaaag

SEQ ID NO: 51772 - DNA, 20 bp, Artificial Sequence
  Synthetic oligonucleotide; AAG chr11 5200845 5200864 5200848 -
aaaagaagaccattttctca

SEQ ID NO: 51773 - DNA, 20 bp, Artificial Sequence
  Synthetic oligonucleotide; AGG chr11 5200844 5200863 5200847 -
aaagaagaccattttctcaa

SEQ ID NO: 51774 - DNA, 20 bp, Artificial Sequence
  Synthetic oligonucleotide; TGG chr11 5200838 5200857 5200841 -
gaccattttctcaaaggcaa

SEQ ID NO: 51775 - DNA, 20 bp, Artificial Sequence
  Synthetic oligonucleotide; AAG chr11 5200822 5200841 5200825 -
gcaatggatactatgtctca

SEQ ID NO: 51776 - DNA, 20 bp, Artificial Sequence
  Synthetic oligonucleotide; CAG chr11 5200816 5200835 5200819 -
gatactatgtctcaaagaaa

SEQ ID NO: 51777 - DNA, 20 bp, Artificial Sequence
  Synthetic oligonucleotide; CAG chr11 5200806 5200825 5200809 -
ctcaaagaaacagaatttct

SEQ ID NO: 51778 - DNA, 20 bp, Artificial Sequence
  Synthetic oligonucleotide; AAG chr11 5200792 5200811 5200795 -
atttctcagctgtttttttt

SEQ ID NO: 51779 - DNA, 20 bp, Artificial Sequence
  Synthetic oligonucleotide; CAG chr11 5200788 5200807 5200791 -
ctcagctgttttttttaagt

SEQ ID NO: 51780 - DNA, 20 bp, Artificial Sequence
  Synthetic oligonucleotide; AAG chr11 5200784 5200803 5200787 -
gctgttttttttaagtcagt

SEQ ID NO: 51781 - DNA, 20 bp, Artificial Sequence
  Synthetic oligonucleotide; TAG chr11 5200778 5200797 5200781 -
ttttttaagtcagtaagttt

SEQ ID NO: 51782 - DNA, 20 bp, Artificial Sequence
  Synthetic oligonucleotide; AGG chr11 5200777 5200796 5200780 -
tttttaagtcagtaagtttt

SEQ ID NO: 51783 - DNA, 20 bp, Artificial Sequence
  Synthetic oligonucleotide; GGG chr11 5200776 5200795 5200779 -
ttttaagtcagtaagtttta

SEQ ID NO: 51784 - DNA, 20 bp, Artificial Sequence
  Synthetic oligonucleotide; TAG chr11 5200760 5200779 5200763 -
tttagggtatttcatttact

SEQ ID NO: 51785 - DNA, 20 bp, Artificial Sequence
  Synthetic oligonucleotide; CAG chr11 5200742 5200761 5200745 -
cttagaaatttcattgtatt

SEQ ID NO: 51786 - DNA, 20 bp, Artificial Sequence
  Synthetic oligonucleotide; AGG chr11 5200741 5200760 5200744 -
ttagaaatttcattgtattc

SEQ ID NO: 51787 - DNA, 20 bp, Artificial Sequence
  Synthetic oligonucleotide; CAG chr11 5200693 5200712 5200696 -
aaatactctcacatgtttct

SEQ ID NO: 51788 - DNA, 20 bp, Artificial Sequence
  Synthetic oligonucleotide; CAG chr11 5200687 5200706 5200690 -
tctcacatgtttctcagttc

SEQ ID NO: 51789 - DNA, 20 bp, Artificial Sequence
  Synthetic oligonucleotide; CAG chr11 5200673 5200692 5200676 -
cagttccagaatgattactt

SEQ ID NO: 51790 - DNA, 20 bp, Artificial Sequence
  Synthetic oligonucleotide; AAG chr11 5200669 5200688 5200672 -
tccagaatgattacttcagt

SEQ ID NO: 51791 - DNA, 20 bp, Artificial Sequence
  Synthetic oligonucleotide; TAG chr11 5200663 5200682 5200666 -
atgattacttcagtaagccc

SEQ ID NO: 51792 - DNA, 20 bp, Artificial Sequence
  Synthetic oligonucleotide; CAG chr11 5200657 5200676 5200660 -
acttcagtaagccctagcac

SEQ ID NO: 51793 - DNA, 20 bp, Artificial Sequence
  Synthetic oligonucleotide; TGG chr11 5200630 5200649 5200633 -
aattcttcctttcttctcac

SEQ ID NO: 51794 - DNA, 20 bp, Artificial Sequence
  Synthetic oligonucleotide; TGG chr11 5200621 5200640 5200624 -
tttcttctcactggattttc

SEQ ID NO: 51795 - DNA, 20 bp, Artificial Sequence
  Synthetic oligonucleotide; TGG chr11 5200616 5200635 5200619 -
tctcactggattttctggca

SEQ ID NO: 51796 - DNA, 20 bp, Artificial Sequence
  Synthetic oligonucleotide; GAG chr11 5200614 5200633 5200617 -
tcactggattttctggcatg

SEQ ID NO: 51797 - DNA, 20 bp, Artificial Sequence
  Synthetic oligonucleotide; CAG chr11 5200611 5200630 5200614 -
ctggattttctggcatggag

SEQ ID NO: 51798 - DNA, 20 bp, Artificial Sequence
  Synthetic oligonucleotide; TGG chr11 5200599 5200618 5200602 -
gcatggagcagcaatacccc

SEQ ID NO: 51799 - DNA, 20 bp, Artificial Sequence
  Synthetic oligonucleotide; TGG chr11 5200565 5200584 5200568 -
cttctcctcaatctatgcca

SEQ ID NO: 51800 - DNA, 20 bp, Artificial Sequence
  Synthetic oligonucleotide; TGG chr11 5200556 5200575 5200559 -
aatctatgccatggtgcttt

SEQ ID NO: 51801 - DNA, 20 bp, Artificial Sequence
  Synthetic oligonucleotide; GGG chr11 5200555 5200574 5200558 -
atctatgccatggtgctttt

SEQ ID NO: 51802 - DNA, 20 bp, Artificial Sequence
  Synthetic oligonucleotide; TGG chr11 5200544 5200563 5200547 -
ggtgcttttgggcaattgca

SEQ ID NO: 51803 - DNA, 20 bp, Artificial Sequence
  Synthetic oligonucleotide; TGG chr11 5200527 5200546 5200530 -
gcatggttctccatgtgata

SEQ ID NO: 51804 - DNA, 20 bp, Artificial Sequence
  Synthetic oligonucleotide; GAG chr11 5200521 5200540 5200524 -
ttctccatgtgatatggact

SEQ ID NO: 51805 - DNA, 20 bp, Artificial Sequence
  Synthetic oligonucleotide; AAG chr11 5200516 5200535 5200519 -
catgtgatatggactgagcc

SEQ ID NO: 51806 - DNA, 20 bp, Artificial Sequence
  Synthetic oligonucleotide; CAG chr11 5200506 5200525 5200509 -
ggactgagccaagcctgcac

SEQ ID NO: 51807 - DNA, 20 bp, Artificial Sequence
  Synthetic oligonucleotide; TGG chr11 5200478 5200497 5200481 -
gttttacttcctgtccatgc

SEQ ID NO: 51808 - DNA, 20 bp, Artificial Sequence
  Synthetic oligonucleotide; TGG chr11 5200457 5200476 5200460 -
ggccctcactgacctgtgca

SEQ ID NO: 51809 - DNA, 20 bp, Artificial Sequence
  Synthetic oligonucleotide; GGG chr11 5200456 5200475 5200459 -
gccctcactgacctgtgcat

SEQ ID NO: 51810 - DNA, 20 bp, Artificial Sequence
  Synthetic oligonucleotide; GGG chr11 5200455 5200474 5200458 -
ccctcactgacctgtgcatg

SEQ ID NO: 51811 - DNA, 20 bp, Artificial Sequence
  Synthetic oligonucleotide; CAG chr11 5200436 5200455 5200439 -
ggggctgtccactgtgtaca

SEQ ID NO: 51812 - DNA, 20 bp, Artificial Sequence
  Synthetic oligonucleotide; TGG chr11 5200430 5200449 5200433 -
gtccactgtgtacacagtgc

SEQ ID NO: 51813 - DNA, 20 bp, Artificial Sequence
  Synthetic oligonucleotide; GGG chr11 5200429 5200448 5200432 -
tccactgtgtacacagtgct

SEQ ID NO: 51814 - DNA, 20 bp, Artificial Sequence
  Synthetic oligonucleotide; GGG chr11 5200428 5200447 5200431 -
ccactgtgtacacagtgctg

SEQ ID NO: 51815 - DNA, 20 bp, Artificial Sequence
  Synthetic oligonucleotide; TGG chr11 5200419 5200438 5200422 -
acacagtgctggggatcctg

SEQ ID NO: 51816 - DNA, 20 bp, Artificial Sequence
  Synthetic oligonucleotide; GGG chr11 5200418 5200437 5200421 -
cacagtgctggggatcctgt

SEQ ID NO: 51817 - DNA, 20 bp, Artificial Sequence
  Synthetic oligonucleotide; GGG chr11 5200417 5200436 5200420 -
acagtgctggggatcctgtg

SEQ ID NO: 51818 - DNA, 20 bp, Artificial Sequence
  Synthetic oligonucleotide; GGG chr11 5200416 5200435 5200419 -
cagtgctggggatcctgtgg

SEQ ID NO: 51819 - DNA, 20 bp, Artificial Sequence
  Synthetic oligonucleotide; GAG chr11 5200406 5200425 5200409 -
gatcctgtgggggatcattc

SEQ ID NO: 51820 - DNA, 20 bp, Artificial Sequence
  Synthetic oligonucleotide; GAG chr11 5200404 5200423 5200407 -
tcctgtgggggatcattcga

SEQ ID NO: 51821 - DNA, 20 bp, Artificial Sequence
  Synthetic oligonucleotide; CAG chr11 5200399 5200418 5200402 -
tgggggatcattcgagagat

SEQ ID NO: 51822 - DNA, 20 bp, Artificial Sequence
  Synthetic oligonucleotide; TGG chr11 5200394 5200413 5200397 -
gatcattcgagagatcagct

SEQ ID NO: 51823 - DNA, 20 bp, Artificial Sequence
  Synthetic oligonucleotide; CAG chr11 5200377 5200396 5200380 -
gcttggattcctgcattgcc

SEQ ID NO: 51824 - DNA, 20 bp, Artificial Sequence
  Synthetic oligonucleotide; TGG chr11 5200360 5200379 5200363 -
gcccagtcctatttcatcca

SEQ ID NO: 51825 - DNA, 20 bp, Artificial Sequence
  Synthetic oligonucleotide; TGG chr11 5200346 5200365 5200349 -
catccatggtctgtccttca

SEQ ID NO: 51826 - DNA, 20 bp, Artificial Sequence
  Synthetic oligonucleotide; GAG chr11 5200344 5200363 5200347 -
tccatggtctgtccttcatg

SEQ ID NO: 51827 - DNA, 20 bp, Artificial Sequence
  Synthetic oligonucleotide; TGG chr11 5200322 5200341 5200325 -
gtcctctgtcctcctcacta

SEQ ID NO: 51828 - DNA, 20 bp, Artificial Sequence
  Synthetic oligonucleotide; CGG chr11 5200311 5200330 5200314 -
tcctcactatggcctttgac

SEQ ID NO: 51829 - DNA, 20 bp, Artificial Sequence
  Synthetic oligonucleotide; CAG chr11 5200258 5200277 5200261 -
tcctccatcctgactaattc

SEQ ID NO: 51830 - DNA, 20 bp, Artificial Sequence
  Synthetic oligonucleotide; TGG chr11 5200243 5200262 5200246 -
aattccagaattatcaaaat

SEQ ID NO: 51831 - DNA, 20 bp, Artificial Sequence
  Synthetic oligonucleotide; GGG chr11 5200242 5200261 5200245 -
attccagaattatcaaaatt

SEQ ID NO: 51832 - DNA, 20 bp, Artificial Sequence
  Synthetic oligonucleotide; TAG chr11 5200229 5200248 5200232 -
caaaattgggctcactataa

SEQ ID NO: 51833 - DNA, 20 bp, Artificial Sequence
  Synthetic oligonucleotide; AGG chr11 5200228 5200247 5200231 -
aaaattgggctcactataat

SEQ ID NO: 51834 - DNA, 20 bp, Artificial Sequence
  Synthetic oligonucleotide; TAG chr11 5200225 5200244 5200228 -
attgggctcactataatagg

SEQ ID NO: 51835 - DNA, 20 bp, Artificial Sequence
  Synthetic oligonucleotide; AGG chr11 5200224 5200243 5200227 -
ttgggctcactataataggt

SEQ ID NO: 51836 - DNA, 20 bp, Artificial Sequence
  Synthetic oligonucleotide; GAG chr11 5200222 5200241 5200225 -
gggctcactataataggtag

SEQ ID NO: 51837 - DNA, 20 bp, Artificial Sequence
  Synthetic oligonucleotide; CAG chr11 5200131 5200150 5200134 -
ctcactctttctgcctgcac

SEQ ID NO: 51838 - DNA, 20 bp, Artificial Sequence
  Synthetic oligonucleotide; AGG chr11 5200130 5200149 5200133 -
tcactctttctgcctgcacc

SEQ ID NO: 51839 - DNA, 20 bp, Artificial Sequence
  Synthetic oligonucleotide; TAG chr11 5200115 5200134 5200118 -
gcaccaggatcttctccgct

SEQ ID NO: 51840 - DNA, 20 bp, Artificial Sequence
  Synthetic oligonucleotide; CAG chr11 5200106 5200125 5200109 -
tcttctccgcttagcctgtt

SEQ ID NO: 51841 - DNA, 20 bp, Artificial Sequence
  Synthetic oligonucleotide; TAG chr11 5200090 5200109 5200093 -
tgttcagacatccgattcaa

SEQ ID NO: 51842 - DNA, 20 bp, Artificial Sequence
  Synthetic oligonucleotide; TGG chr11 5200070 5200089 5200073 -
tagttactatgccctgatgc

SEQ ID NO: 51843 - DNA, 20 bp, Artificial Sequence
  Synthetic oligonucleotide; TGG chr11 5200049 5200068 5200052 -
ggttatttgcatactgttgt

SEQ ID NO: 51844 - DNA, 20 bp, Artificial Sequence
  Synthetic oligonucleotide; AAG chr11 5200008 5200027 5200011 -
tctcctacatcctgattctt

SEQ ID NO: 51845 - DNA, 20 bp, Artificial Sequence
  Synthetic oligonucleotide; CAG chr11 5200004 5200023 5200007 -
ctacatcctgattcttaagt

SEQ ID NO: 51846 - DNA, 20 bp, Artificial Sequence
  Synthetic oligonucleotide; TGG chr11 5199998 5200017 5200001 -
cctgattcttaagtcagtcc

SEQ ID NO: 51847 - DNA, 20 bp, Artificial Sequence
  Synthetic oligonucleotide; CAG chr11 5199995 5200014 5199998 -
gattcttaagtcagtcctgg

SEQ ID NO: 51848 - DNA, 20 bp, Artificial Sequence
  Synthetic oligonucleotide; CAG chr11 5199984 5200003 5199987 -
cagtcctggcagttgcctct

SEQ ID NO: 51849 - DNA, 20 bp, Artificial Sequence
  Synthetic oligonucleotide; AGG chr11 5199983 5200002 5199986 -
agtcctggcagttgcctctc

SEQ ID NO: 51850 - DNA, 20 bp, Artificial Sequence
  Synthetic oligonucleotide; AAG chr11 5199980 5199999 5199983 -
cctggcagttgcctctcagg

SEQ ID NO: 51851 - DNA, 20 bp, Artificial Sequence
  Synthetic oligonucleotide; GAG chr11 5199978 5199997 5199981 -
tggcagttgcctctcaggaa

SEQ ID NO: 51852 - DNA, 20 bp, Artificial Sequence
  Synthetic oligonucleotide; GAG chr11 5199976 5199995 5199979 -
gcagttgcctctcaggaaga

SEQ ID NO: 51853 - DNA, 20 bp, Artificial Sequence
  Synthetic oligonucleotide; AGG chr11 5199975 5199994 5199978 -
cagttgcctctcaggaagag

SEQ ID NO: 51854 - DNA, 20 bp, Artificial Sequence
  Synthetic oligonucleotide; CAG chr11 5199960 5199979 5199963 -
aagagaggcataaattattt

SEQ ID NO: 51855 - DNA, 20 bp, Artificial Sequence
  Synthetic oligonucleotide; TAG chr11 5199907 5199926 5199910 -
gtgttctacatccctatcat

SEQ ID NO: 51856 - DNA, 20 bp, Artificial Sequence
  Synthetic oligonucleotide; TGG chr11 5199896 5199915 5199899 -
ccctatcattagcctcacaa

SEQ ID NO: 51857 - DNA, 20 bp, Artificial Sequence
  Synthetic oligonucleotide; TGG chr11 5199883 5199902 5199886 -
ctcacaatggtgcaccgttt

SEQ ID NO: 51858 - DNA, 20 bp, Artificial Sequence
  Synthetic oligonucleotide; AAG chr11 5199879 5199898 5199882 -
caatggtgcaccgttttggc

SEQ ID NO: 51859 - DNA, 20 bp, Artificial Sequence
  Synthetic oligonucleotide; TGG chr11 5199863 5199882 5199866 -
tggcaagcacctttcccccg

SEQ ID NO: 51860 - DNA, 20 bp, Artificial Sequence
  Synthetic oligonucleotide; TGG chr11 5199847 5199866 5199850 -
cccgtggcccacgttctcat

SEQ ID NO: 51861 - DNA, 20 bp, Artificial Sequence
  Synthetic oligonucleotide; CAG chr11 5199799 5199818 5199802 -
ttaatgaatcccatcatcta

SEQ ID NO: 51862 - DNA, 20 bp, Artificial Sequence
  Synthetic oligonucleotide; AAG chr11 5199792 5199811 5199795 -
atcccatcatctacagtgtc

SEQ ID NO: 51863 - DNA, 20 bp, Artificial Sequence
  Synthetic oligonucleotide; CAG chr11 5199783 5199802 5199786 -
tctacagtgtcaagacccaa

SEQ ID NO: 51864 - DNA, 20 bp, Artificial Sequence
  Synthetic oligonucleotide; CAG chr11 5199772 5199791 5199775 -
aagacccaacagattcatac

SEQ ID NO: 51865 - DNA, 20 bp, Artificial Sequence
  Synthetic oligonucleotide; TAG chr11 5199763 5199782 5199766 -
cagattcataccagaatgct

SEQ ID NO: 51866 - DNA, 20 bp, Artificial Sequence
  Synthetic oligonucleotide; AAG chr11 5199745 5199764 5199748 -
cttagactcttttctctgaa

SEQ ID NO: 51867 - DNA, 20 bp, Artificial Sequence
  Synthetic oligonucleotide; GAG chr11 5199737 5199756 5199740 -
cttttctctgaaaagatatt

SEQ ID NO: 51868 - DNA, 20 bp, Artificial Sequence
  Synthetic oligonucleotide; GAG chr11 5199735 5199754 5199738 -
tttctctgaaaagatattga

SEQ ID NO: 51869 - DNA, 20 bp, Artificial Sequence
  Synthetic oligonucleotide; GAG chr11 5199727 5199746 5199730 -
aaaagatattgagagatatt

SEQ ID NO: 51870 - DNA, 20 bp, Artificial Sequence
  Synthetic oligonucleotide; AAG chr11 5199707 5199726 5199710 -
gagatgtattgcctaaaaaa

SEQ ID NO: 51871 - DNA, 20 bp, Artificial Sequence
  Synthetic oligonucleotide; AAG chr11 5199703 5199722 5199706 -
tgtattgcctaaaaaaaaga

SEQ ID NO: 51872 - DNA, 20 bp, Artificial Sequence
  Synthetic oligonucleotide; AAG chr11 5199698 5199717 5199701 -
tgcctaaaaaaaagaaagaa

SEQ ID NO: 51873 - DNA, 20 bp, Artificial Sequence
  Synthetic oligonucleotide; CAG chr11 5199695 5199714 5199698 -
ctaaaaaaaagaaagaaaag

SEQ ID NO: 51874 - DNA, 20 bp, Artificial Sequence
  Synthetic oligonucleotide; CAG chr11 5199672 5199691 5199675 -
caacaataataaacaaaaat

SEQ ID NO: 51875 - DNA, 20 bp, Artificial Sequence
  Synthetic oligonucleotide; AAG chr11 5199659 5199678 5199662 -
caaaaatcagtgccataaaa

SEQ ID NO: 51876 - DNA, 20 bp, Artificial Sequence
  Synthetic oligonucleotide; TAG chr11 5199638 5199657 5199641 -
agaaaaaattattaaaattg

SEQ ID NO: 51877 - DNA, 20 bp, Artificial Sequence
  Synthetic oligonucleotide; GAG chr11 5199626 5199645 5199629 -
taaaattgtagatttactct

SEQ ID NO: 51878 - DNA, 20 bp, Artificial Sequence
  Synthetic oligonucleotide; TAG chr11 5199589 5199608 5199592 -
ccttaaaaaatatttaaata

SEQ ID NO: 51879 - DNA, 20 bp, Artificial Sequence
  Synthetic oligonucleotide; CAG chr11 5199585 5199604 5199588 -
aaaaaatatttaaatatagt

SEQ ID NO: 51880 - DNA, 20 bp, Artificial Sequence
  Synthetic oligonucleotide; GAG chr11 5199583 5199602 5199586 -
aaaatatttaaatatagtca

SEQ ID NO: 51881 - DNA, 20 bp, Artificial Sequence
  Synthetic oligonucleotide; AAG chr11 5199569 5199588 5199572 -
tagtcagagaatcaacaaac

SEQ ID NO: 51882 - DNA, 20 bp, Artificial Sequence
  Synthetic oligonucleotide; CAG chr11 5199555 5199574 5199558 -
acaaacaagttccattgtgt

SEQ ID NO: 51883 - DNA, 20 bp, Artificial Sequence
  Synthetic oligonucleotide; TGG chr11 5199550 5199569 5199553 -
caagttccattgtgtcagcc

SEQ ID NO: 51884 - DNA, 20 bp, Artificial Sequence
  Synthetic oligonucleotide; TAG chr11 5199540 5199559 5199543 -
tgtgtcagcctggacacatg

SEQ ID NO: 51885 - DNA, 20 bp, Artificial Sequence
  Synthetic oligonucleotide; AGG chr11 5199539 5199558 5199542 -
gtgtcagcctggacacatgt

SEQ ID NO: 51886 - DNA, 20 bp, Artificial Sequence
  Synthetic oligonucleotide; CAG chr11 5199527 5199546 5199530 -
acacatgtaggtcactctat

SEQ ID NO: 51887 - DNA, 20 bp, Artificial Sequence
  Synthetic oligonucleotide; AAG chr11 5199511 5199530 5199514 -
ctatcagtctgaccatattt

SEQ ID NO: 51888 - DNA, 20 bp, Artificial Sequence
  Synthetic oligonucleotide; AAG chr11 5199507 5199526 5199510 -
cagtctgaccatatttaaga

SEQ ID NO: 51889 - DNA, 20 bp, Artificial Sequence
  Synthetic oligonucleotide; GAG chr11 5199505 5199524 5199508 -
gtctgaccatatttaagaaa

SEQ ID NO: 51890 - DNA, 20 bp, Artificial Sequence
  Synthetic oligonucleotide; AGG chr11 5199504 5199523 5199507 -
tctgaccatatttaagaaag

SEQ ID NO: 51891 - DNA, 20 bp, Artificial Sequence
  Synthetic oligonucleotide; GAG chr11 5199468 5199487 5199471 -
tttgcctgaaatgtactttt

SEQ ID NO: 51892 - DNA, 20 bp, Artificial Sequence
  Synthetic oligonucleotide; AAG chr11 5199444 5199463 5199447 -
atttcctttgctgtaaaaca

SEQ ID NO: 51893 - DNA, 20 bp, Artificial Sequence
  Synthetic oligonucleotide; TGG chr11 5199440 5199459 5199443 -
cctttgctgtaaaacaaagc

SEQ ID NO: 51894 - DNA, 20 bp, Artificial Sequence
  Synthetic oligonucleotide; TAG chr11 5199427 5199446 5199430 -
acaaagctggattaaaaacc

SEQ ID NO: 51895 - DNA, 20 bp, Artificial Sequence
  Synthetic oligonucleotide; AGG chr11 5199426 5199445 5199429 -
caaagctggattaaaaacct

SEQ ID NO: 51896 - DNA, 20 bp, Artificial Sequence
  Synthetic oligonucleotide; AAG chr11 5199418 5199437 5199421 -
gattaaaaacctaggttttc

SEQ ID NO: 51897 - DNA, 20 bp, Artificial Sequence
  Synthetic oligonucleotide; AAG chr11 5199410 5199429 5199413 -
acctaggttttcaagtttca

SEQ ID NO: 51898 - DNA, 20 bp, Artificial Sequence
  Synthetic oligonucleotide; TAG chr11 5199407 5199426 5199410 -
taggttttcaagtttcaaag

SEQ ID NO: 51899 - DNA, 20 bp, Artificial Sequence
  Synthetic oligonucleotide; AAG chr11 5199396 5199415 5199399 -
gtttcaaagtagaaaacttg

SEQ ID NO: 51900 - DNA, 20 bp, Artificial Sequence
  Synthetic oligonucleotide; GAG chr11 5199378 5199397 5199381 -
tgaagtttctttcattctct

SEQ ID NO: 51901 - DNA, 20 bp, Artificial Sequence
  Synthetic oligonucleotide; AGG chr11 5199377 5199396 5199380 -
gaagtttctttcattctctg

SEQ ID NO: 51902 - DNA, 20 bp, Artificial Sequence
  Synthetic oligonucleotide; TGG chr11 5199352 5199371 5199355 -
tacttaattaaccttcaaaa

SEQ ID NO: 51903 - DNA, 20 bp, Artificial Sequence
  Synthetic oligonucleotide; GAG chr11 5199350 5199369 5199353 -
cttaattaaccttcaaaatg

SEQ ID NO: 51904 - DNA, 20 bp, Artificial Sequence
  Synthetic oligonucleotide; TAG chr11 5199343 5199362 5199346 -
aaccttcaaaatggagacta

SEQ ID NO: 51905 - DNA, 20 bp, Artificial Sequence
  Synthetic oligonucleotide; CAG chr11 5199332 5199351 5199335 -
tggagactatagccaactca

SEQ ID NO: 51906 - DNA, 20 bp, Artificial Sequence
  Synthetic oligonucleotide; AGG chr11 5199331 5199350 5199334 -
ggagactatagccaactcac

SEQ ID NO: 51907 - DNA, 20 bp, Artificial Sequence
  Synthetic oligonucleotide; TGG chr11 5199310 5199329 5199313 -
ggaatgttgtgatatctgta

SEQ ID NO: 51908 - DNA, 20 bp, Artificial Sequence
  Synthetic oligonucleotide; CAG chr11 5199305 5199324 5199308 -
gttgtgatatctgtatggac

SEQ ID NO: 51909 - DNA, 20 bp, Artificial Sequence
  Synthetic oligonucleotide; AAG chr11 5199294 5199313 5199297 -
tgtatggaccagaattgtcc

SEQ ID NO: 51910 - DNA, 20 bp, Artificial Sequence
  Synthetic oligonucleotide; AGG chr11 5199293 5199312 5199296 -
gtatggaccagaattgtcca

SEQ ID NO: 51911 - DNA, 20 bp, Artificial Sequence
  Synthetic oligonucleotide; GGG chr11 5199292 5199311 5199295 -
tatggaccagaattgtccaa

SEQ ID NO: 51912 - DNA, 20 bp, Artificial Sequence
  Synthetic oligonucleotide; TGG chr11 5199273 5199292 5199276 -
agggaacttttctaaactga

SEQ ID NO: 51913 - DNA, 20 bp, Artificial Sequence
  Synthetic oligonucleotide; TGG chr11 5199245 5199264 5199248 -
ttctataaaataccataaaa

SEQ ID NO: 51914 - DNA, 20 bp, Artificial Sequence
  Synthetic oligonucleotide; AAG chr11 5199239 5199258 5199242 -
aaaataccataaaatggcta

SEQ ID NO: 51915 - DNA, 20 bp, Artificial Sequence
  Synthetic oligonucleotide; TGG chr11 5199236 5199255 5199239 -
ataccataaaatggctaaag

SEQ ID NO: 51916 - DNA, 20 bp, Artificial Sequence
  Synthetic oligonucleotide; TGG chr11 5199227 5199246 5199230 -
aatggctaaagtggaatata

SEQ ID NO: 51917 - DNA, 20 bp, Artificial Sequence
  Synthetic oligonucleotide; TGG chr11 5199204 5199223 5199207 -
ctcctgtgcgcttgaaatga

SEQ ID NO: 51918 - DNA, 20 bp, Artificial Sequence
  Synthetic oligonucleotide; TAG chr11 5199201 5199220 5199204 -
ctgtgcgcttgaaatgatgg

SEQ ID NO: 51919 - DNA, 20 bp, Artificial Sequence
  Synthetic oligonucleotide; CAG chr11 5199170 5199189 5199173 -
aacaactgcatttacaattt

SEQ ID NO: 51920 - DNA, 20 bp, Artificial Sequence
  Synthetic oligonucleotide; AAG chr11 5199160 5199179 5199163 -
tttacaatttcagttacttt

SEQ ID NO: 51921 - DNA, 20 bp, Artificial Sequence
  Synthetic oligonucleotide; TGG chr11 5199123 5199142 5199126 -
aatgtttaatgtccttgtat

SEQ ID NO: 51922 - DNA, 20 bp, Artificial Sequence
  Synthetic oligonucleotide; CAG chr11 5199119 5199138 5199122 -
tttaatgtccttgtattgga

SEQ ID NO: 51923 - DNA, 20 bp, Artificial Sequence
  Synthetic oligonucleotide; CAG chr11 5199114 5199133 5199117 -
tgtccttgtattggacagtt

SEQ ID NO: 51924 - DNA, 20 bp, Artificial Sequence
  Synthetic oligonucleotide; CAG chr11 5199109 5199128 5199112 -
ttgtattggacagttcagtt

SEQ ID NO: 51925 - DNA, 20 bp, Artificial Sequence
  Synthetic oligonucleotide; CAG chr11 5199106 5199125 5199109 -
tattggacagttcagttcag

SEQ ID NO: 51926 - DNA, 20 bp, Artificial Sequence
  Synthetic oligonucleotide; TGG chr11 5199094 5199113 5199097 -
cagttcagcagccactatat

SEQ ID NO: 51927 - DNA, 20 bp, Artificial Sequence
  Synthetic oligonucleotide; CAG chr11 5199090 5199109 5199093 -
tcagcagccactatattgga

SEQ ID NO: 51928 - DNA, 20 bp, Artificial Sequence
  Synthetic oligonucleotide; AGG chr11 5199089 5199108 5199092 -
cagcagccactatattggac

SEQ ID NO: 51929 - DNA, 20 bp, Artificial Sequence
  Synthetic oligonucleotide; GGG chr11 5199088 5199107 5199091 -
agcagccactatattggaca

SEQ ID NO: 51930 - DNA, 20 bp, Artificial Sequence
  Synthetic oligonucleotide; AAG chr11 5199085 5199104 5199088 -
agccactatattggacaggg

SEQ ID NO: 51931 - DNA, 20 bp, Artificial Sequence
  Synthetic oligonucleotide; CAG chr11 5199079 5199098 5199082 -
tatattggacagggaagcta

SEQ ID NO: 51932 - DNA, 20 bp, Artificial Sequence
  Synthetic oligonucleotide; AAG chr11 5199070 5199089 5199073 -
cagggaagctacagttcata

SEQ ID NO: 51933 - DNA, 20 bp, Artificial Sequence
  Synthetic oligonucleotide; GAG chr11 5199068 5199087 5199071 -
gggaagctacagttcataaa

SEQ ID NO: 51934 - DNA, 20 bp, Artificial Sequence
  Synthetic oligonucleotide; AGG chr11 5199067 5199086 5199070 -
ggaagctacagttcataaag

SEQ ID NO: 51935 - DNA, 20 bp, Artificial Sequence
  Synthetic oligonucleotide; AAG chr11 5199059 5199078 5199062 -
cagttcataaagaggacaca

SEQ ID NO: 51936 - DNA, 20 bp, Artificial Sequence
  Synthetic oligonucleotide; TGG chr11 5199045 5199064 5199048 -
gacacaaagaaatatgactt

SEQ ID NO: 51937 - DNA, 20 bp, Artificial Sequence
  Synthetic oligonucleotide; TAG chr11 5199013 5199032 5199016 -
ctaccatgtctaatttaaat

SEQ ID NO: 51938 - DNA, 20 bp, Artificial Sequence
  Synthetic oligonucleotide; TAG chr11 5198997 5199016 5199000 -
aaattagaatccttattttt

SEQ ID NO: 51939 - DNA, 20 bp, Artificial Sequence
  Synthetic oligonucleotide; TGG chr11 5198984 5199003 5198987 -
tattttttagattttatatg

SEQ ID NO: 51940 - DNA, 20 bp, Artificial Sequence
  Synthetic oligonucleotide; AAG chr11 5198968 5198987 5198971 -
tatgtggactccactgctac

SEQ ID NO: 51941 - DNA, 20 bp, Artificial Sequence
  Synthetic oligonucleotide; AGG chr11 5198967 5198986 5198970 -
atgtggactccactgctaca

SEQ ID NO: 51942 - DNA, 20 bp, Artificial Sequence
  Synthetic oligonucleotide; TGG chr11 5198963 5198982 5198966 -
ggactccactgctacaaggc

SEQ ID NO: 51943 - DNA, 20 bp, Artificial Sequence
  Synthetic oligonucleotide; AAG chr11 5198960 5198979 5198963 -
ctccactgctacaaggctgg

SEQ ID NO: 51944 - DNA, 20 bp, Artificial Sequence
  Synthetic oligonucleotide; CAG chr11 5198957 5198976 5198960 -
cactgctacaaggctggaag

SEQ ID NO: 51945 - DNA, 20 bp, Artificial Sequence
  Synthetic oligonucleotide; TAG chr11 5198945 5198964 5198948 -
gctggaagcagattttgctc

SEQ ID NO: 51946 - DNA, 20 bp, Artificial Sequence
  Synthetic oligonucleotide; AAG chr11 5198923 5198942 5198926 -
gatcttttgcttttatatct

SEQ ID NO: 51947 - DNA, 20 bp, Artificial Sequence
  Synthetic oligonucleotide; TGG chr11 5198920 5198939 5198923 -
cttttgcttttatatctaag

SEQ ID NO: 51948 - DNA, 20 bp, Artificial Sequence
  Synthetic oligonucleotide; GGG chr11 5198919 5198938 5198922 -
ttttgcttttatatctaagt

SEQ ID NO: 51949 - DNA, 20 bp, Artificial Sequence
  Synthetic oligonucleotide; GGG chr11 5198918 5198937 5198921 -
tttgcttttatatctaagtg

SEQ ID NO: 51950 - DNA, 20 bp, Artificial Sequence
  Synthetic oligonucleotide; GGG chr11 5198917 5198936 5198920 -
ttgcttttatatctaagtgg

SEQ ID NO: 51951 - DNA, 20 bp, Artificial Sequence
  Synthetic oligonucleotide; CAG chr11 5198904 5198923 5198907 -
taagtgggggatcttctgaa

SEQ ID NO: 51952 - DNA, 20 bp, Artificial Sequence
  Synthetic oligonucleotide; GAG chr11 5198899 5198918 5198902 -
gggggatcttctgaacagat

SEQ ID NO: 51953 - DNA, 20 bp, Artificial Sequence
  Synthetic oligonucleotide; GAG chr11 5198873 5198892 5198876 -
gtccgctaccgacttattct

SEQ ID NO: 51954 - DNA, 20 bp, Artificial Sequence
  Synthetic oligonucleotide; AAG chr11 5198865 5198884 5198868 -
ccgacttattctgagtttaa

SEQ ID NO: 51955 - DNA, 20 bp, Artificial Sequence
  Synthetic oligonucleotide; AAG chr11 5198858 5198877 5198861 -
attctgagtttaaaagaaaa

SEQ ID NO: 51956 - DNA, 20 bp, Artificial Sequence
  Synthetic oligonucleotide; AAG chr11 5198851 5198870 5198854 -
gtttaaaagaaaaaagataa

SEQ ID NO: 51957 - DNA, 20 bp, Artificial Sequence
  Synthetic oligonucleotide; AAG chr11 5198842 5198861 5198845 -
aaaaaagataaaagaacata

SEQ ID NO: 51958 - DNA, 20 bp, Artificial Sequence
  Synthetic oligonucleotide; CGG chr11 5198839 5198858 5198842 -
aaagataaaagaacataaag

SEQ ID NO: 51959 - DNA, 20 bp, Artificial Sequence
  Synthetic oligonucleotide; AAG chr11 5198827 5198846 5198830 -
acataaagcggttcttttct

SEQ ID NO: 51960 - DNA, 20 bp, Artificial Sequence
  Synthetic oligonucleotide; AAG chr11 5198823 5198842 5198826 -
aaagcggttcttttctaagt

SEQ ID NO: 51961 - DNA, 20 bp, Artificial Sequence
  Synthetic oligonucleotide; TAG chr11 5198819 5198838 5198822 -
cggttcttttctaagtaagc

SEQ ID NO: 51962 - DNA, 20 bp, Artificial Sequence
  Synthetic oligonucleotide; CAG chr11 5198814 5198833 5198817 -
cttttctaagtaagctagtg

SEQ ID NO: 51963 - DNA, 20 bp, Artificial Sequence
  Synthetic oligonucleotide; AAG chr11 5198804 5198823 5198807 -
taagctagtgcagctttcca

SEQ ID NO: 51964 - DNA, 20 bp, Artificial Sequence
  Synthetic oligonucleotide; AAG chr11 5198801 5198820 5198804 -
gctagtgcagctttccaaag

SEQ ID NO: 51965 - DNA, 20 bp, Artificial Sequence
  Synthetic oligonucleotide; AGG chr11 5198800 5198819 5198803 -
ctagtgcagctttccaaaga

SEQ ID NO: 51966 - DNA, 20 bp, Artificial Sequence
  Synthetic oligonucleotide; AAG chr11 5198796 5198815 5198799 -
tgcagctttccaaagaagga

SEQ ID NO: 51967 - DNA, 20 bp, Artificial Sequence
  Synthetic oligonucleotide; AAG chr11 5198792 5198811 5198795 -
gctttccaaagaaggaaaga

SEQ ID NO: 51968 - DNA, 20 bp, Artificial Sequence
  Synthetic oligonucleotide; AGG chr11 5198791 5198810 5198794 -
ctttccaaagaaggaaagaa

SEQ ID NO: 51969 - DNA, 20 bp, Artificial Sequence
  Synthetic oligonucleotide; AAG chr11 5198788 5198807 5198791 -
tccaaagaaggaaagaaagg

SEQ ID NO: 51970 - DNA, 20 bp, Artificial Sequence
  Synthetic oligonucleotide; AGG chr11 5198787 5198806 5198790 -
ccaaagaaggaaagaaagga

SEQ ID NO: 51971 - DNA, 20 bp, Artificial Sequence
  Synthetic oligonucleotide; CAG chr11 5198780 5198799 5198783 -
aggaaagaaaggaaggaaat

SEQ ID NO: 51972 - DNA, 20 bp, Artificial Sequence
  Synthetic oligonucleotide; AGG chr11 5198779 5198798 5198782 -
ggaaagaaaggaaggaaatc

SEQ ID NO: 51973 - DNA, 20 bp, Artificial Sequence
  Synthetic oligonucleotide; TGG chr11 5198762 5198781 5198765 -
atcaggtacaaaactatgca

SEQ ID NO: 51974 - DNA, 20 bp, Artificial Sequence
  Synthetic oligonucleotide; AAG chr11 5198754 5198773 5198757 -
caaaactatgcatggataac

SEQ ID NO: 51975 - DNA, 20 bp, Artificial Sequence
  Synthetic oligonucleotide; TAG chr11 5198719 5198738 5198722 -
ttaatcttcctatattctat

SEQ ID NO: 51976 - DNA, 20 bp, Artificial Sequence
  Synthetic oligonucleotide; AGG chr11 5198718 5198737 5198721 -
taatcttcctatattctatt

SEQ ID NO: 51977 - DNA, 20 bp, Artificial Sequence
  Synthetic oligonucleotide; AAG chr11 5198710 5198729 5198713 -
ctatattctattaggtatct

SEQ ID NO: 51978 - DNA, 20 bp, Artificial Sequence
  Synthetic oligonucleotide; AAG chr11 5198707 5198726 5198710 -
tattctattaggtatctaag

SEQ ID NO: 51979 - DNA, 20 bp, Artificial Sequence
  Synthetic oligonucleotide; AGG chr11 5198706 5198725 5198709 -
attctattaggtatctaaga

SEQ ID NO: 51980 - DNA, 20 bp, Artificial Sequence
  Synthetic oligonucleotide; AAG chr11 5198702 5198721 5198705 -
tattaggtatctaagaaggt

SEQ ID NO: 51981 - DNA, 20 bp, Artificial Sequence
  Synthetic oligonucleotide; TGG chr11 5198690 5198709 5198693 -
aagaaggtaagtgttaaaat

SEQ ID NO: 51982 - DNA, 20 bp, Artificial Sequence
  Synthetic oligonucleotide; AAG chr11 5198673 5198692 5198676 -
aattggacaaattaatgcat

SEQ ID NO: 51983 - DNA, 20 bp, Artificial Sequence
  Synthetic oligonucleotide; GAG chr11 5198671 5198690 5198674 -
ttggacaaattaatgcataa

SEQ ID NO: 51984 - DNA, 20 bp, Artificial Sequence
  Synthetic oligonucleotide; AAG chr11 5198653 5198672 5198656 -
aagagtcattttacaccaaa

SEQ ID NO: 51985 - DNA, 20 bp, Artificial Sequence
  Synthetic oligonucleotide; TAG chr11 5198630 5198649 5198633 -
caaatatttatttttatttt

SEQ ID NO: 51986 - DNA, 20 bp, Artificial Sequence
  Synthetic oligonucleotide; CAG chr11 5198610 5198629 5198613 -
tagatatcaactaaaacaac

SEQ ID NO: 51987 - DNA, 20 bp, Artificial Sequence
  Synthetic oligonucleotide; TGG chr11 5198567 5198586 5198570 -
gccttcctttcctttcactt

SEQ ID NO: 51988 - DNA, 20 bp, Artificial Sequence
  Synthetic oligonucleotide; TAG chr11 5198548 5198567 5198551 -
ttggacttcattcaataaca

SEQ ID NO: 51989 - DNA, 20 bp, Artificial Sequence
  Synthetic oligonucleotide; CAG chr11 5198524 5198543 5198527 -
ctctgtctacttatttgact

SEQ ID NO: 51990 - DNA, 20 bp, Artificial Sequence
  Synthetic oligonucleotide; GAG chr11 5198522 5198541 5198525 -
ctgtctacttatttgactca

SEQ ID NO: 51991 - DNA, 20 bp, Artificial Sequence
  Synthetic oligonucleotide; AGG chr11 5198521 5198540 5198524 -
tgtctacttatttgactcag

SEQ ID NO: 51992 - DNA, 20 bp, Artificial Sequence
  Synthetic oligonucleotide; GGG chr11 5198520 5198539 5198523 -
gtctacttatttgactcaga

SEQ ID NO: 51993 - DNA, 20 bp, Artificial Sequence
  Synthetic oligonucleotide; CAG chr11 5198506 5198525 5198509 -
ctcagagggaaacaaaaata

SEQ ID NO: 51994 - DNA, 20 bp, Artificial Sequence
  Synthetic oligonucleotide; AGG chr11 5198505 5198524 5198508 -
tcagagggaaacaaaaatac

SEQ ID NO: 51995 - DNA, 20 bp, Artificial Sequence
  Synthetic oligonucleotide; TGG chr11 5198499 5198518 5198502 -
ggaaacaaaaatacaggctt

SEQ ID NO: 51996 - DNA, 20 bp, Artificial Sequence
  Synthetic oligonucleotide; TAG chr11 5198489 5198508 5198492 -
atacaggctttggtttctaa

SEQ ID NO: 51997 - DNA, 20 bp, Artificial Sequence
  Synthetic oligonucleotide; AAG chr11 5198483 5198502 5198486 -
gctttggtttctaatagctt

SEQ ID NO: 51998 - DNA, 20 bp, Artificial Sequence
  Synthetic oligonucleotide; AAG chr11 5198475 5198494 5198478 -
ttctaatagcttaagcctca

SEQ ID NO: 51999 - DNA, 20 bp, Artificial Sequence
  Synthetic oligonucleotide; GAG chr11 5198471 5198490 5198474 -
aatagcttaagcctcaaagt

SEQ ID NO: 52000 - DNA, 20 bp, Artificial Sequence
  Synthetic oligonucleotide; AGG chr11 5198470 5198489 5198473 -
atagcttaagcctcaaagtg

SEQ ID NO: 52001 - DNA, 20 bp, Artificial Sequence
  Synthetic oligonucleotide; TGG chr11 5198457 5198476 5198460 -
caaagtgaggaaattgtttc

SEQ ID NO: 52002 - DNA, 20 bp, Artificial Sequence
  Synthetic oligonucleotide; CAG chr11 5198453 5198472 5198456 -
gtgaggaaattgtttctgga

SEQ ID NO: 52003 - DNA, 20 bp, Artificial Sequence
  Synthetic oligonucleotide; GAG chr11 5198451 5198470 5198454 -
gaggaaattgtttctggaca

SEQ ID NO: 52004 - DNA, 20 bp, Artificial Sequence
  Synthetic oligonucleotide; AAG chr11 5198446 5198465 5198449 -
aattgtttctggacagagta

SEQ ID NO: 52005 - DNA, 20 bp, Artificial Sequence
  Synthetic oligonucleotide; TGG chr11 5198439 5198458 5198442 -
tctggacagagtaaagtatc

SEQ ID NO: 52006 - DNA, 20 bp, Artificial Sequence
  Synthetic oligonucleotide; TAG chr11 5198435 5198454 5198438 -
gacagagtaaagtatctggt

SEQ ID NO: 52007 - DNA, 20 bp, Artificial Sequence
  Synthetic oligonucleotide; AAG chr11 5198431 5198450 5198434 -
gagtaaagtatctggttaga

SEQ ID NO: 52008 - DNA, 20 bp, Artificial Sequence
  Synthetic oligonucleotide; AAG chr11 5198426 5198445 5198429 -
aagtatctggttagaaagat

SEQ ID NO: 52009 - DNA, 20 bp, Artificial Sequence
  Synthetic oligonucleotide; TAG chr11 5198409 5198428 5198412 -
gataagtgtaaaattattcc

SEQ ID NO: 52010 - DNA, 20 bp, Artificial Sequence
  Synthetic oligonucleotide; TAG chr11 5198396 5198415 5198399 -
ttattcctagaacaataaat

SEQ ID NO: 52011 - DNA, 20 bp, Artificial Sequence
  Synthetic oligonucleotide; AGG chr11 5198395 5198414 5198398 -
tattcctagaacaataaatt

SEQ ID NO: 52012 - DNA, 20 bp, Artificial Sequence
  Synthetic oligonucleotide; TGG chr11 5198387 5198406 5198390 -
gaacaataaattaggtcttc

SEQ ID NO: 52013 - DNA, 20 bp, Artificial Sequence
  Synthetic oligonucleotide; GGG chr11 5198386 5198405 5198389 -
aacaataaattaggtcttct

SEQ ID NO: 52014 - DNA, 20 bp, Artificial Sequence
  Synthetic oligonucleotide; CAG chr11 5198380 5198399 5198383 -
aaattaggtcttctgggtta

SEQ ID NO: 52015 - DNA, 20 bp, Artificial Sequence
  Synthetic oligonucleotide; AAG chr11 5198374 5198393 5198377 -
ggtcttctgggttacagtat

SEQ ID NO: 52016 - DNA, 20 bp, Artificial Sequence
  Synthetic oligonucleotide; AGG chr11 5198373 5198392 5198376 -
gtcttctgggttacagtata

SEQ ID NO: 52017 - DNA, 20 bp, Artificial Sequence
  Synthetic oligonucleotide; AAG chr11 5198362 5198381 5198365 -
tacagtataaggttaatttg

SEQ ID NO: 52018 - DNA, 20 bp, Artificial Sequence
  Synthetic oligonucleotide; AGG chr11 5198361 5198380 5198364 -
acagtataaggttaatttga

SEQ ID NO: 52019 - DNA, 20 bp, Artificial Sequence
  Synthetic oligonucleotide; AAG chr11 5198355 5198374 5198358 -
taaggttaatttgaaggata

SEQ ID NO: 52020 - DNA, 20 bp, Artificial Sequence
  Synthetic oligonucleotide; AGG chr11 5198354 5198373 5198357 -
aaggttaatttgaaggataa

SEQ ID NO: 52021 - DNA, 20 bp, Artificial Sequence
  Synthetic oligonucleotide; GAG chr11 5198352 5198371 5198355 -
ggttaatttgaaggataaag

SEQ ID NO: 52022 - DNA, 20 bp, Artificial Sequence
  Synthetic oligonucleotide; AAG chr11 5198332 5198351 5198335 -
gagtgaatttcctgatgtca

SEQ ID NO: 52023 - DNA, 20 bp, Artificial Sequence
  Synthetic oligonucleotide; GAG chr11 5198330 5198349 5198333 -
gtgaatttcctgatgtcaaa

SEQ ID NO: 52024 - DNA, 20 bp, Artificial Sequence
  Synthetic oligonucleotide; AGG chr11 5198329 5198348 5198332 -
tgaatttcctgatgtcaaag

SEQ ID NO: 52025 - DNA, 20 bp, Artificial Sequence
  Synthetic oligonucleotide; TAG chr11 5198323 5198342 5198326 -
tcctgatgtcaaagaggatc

SEQ ID NO: 52026 - DNA, 20 bp, Artificial Sequence
  Synthetic oligonucleotide; TGG chr11 5198311 5198330 5198314 -
agaggatctagtgcatcttc

SEQ ID NO: 52027 - DNA, 20 bp, Artificial Sequence
  Synthetic oligonucleotide; TAG chr11 5198306 5198325 5198309 -
atctagtgcatcttctggta

SEQ ID NO: 52028 - DNA, 20 bp, Artificial Sequence
  Synthetic oligonucleotide; CAG chr11 5198299 5198318 5198302 -
gcatcttctggtatagctat

SEQ ID NO: 52029 - DNA, 20 bp, Artificial Sequence
  Synthetic oligonucleotide; AAG chr11 5198296 5198315 5198299 -
tcttctggtatagctatcag

SEQ ID NO: 52030 - DNA, 20 bp, Artificial Sequence
  Synthetic oligonucleotide; GAG chr11 5198283 5198302 5198286 -
ctatcagaagtgaaaactgt

SEQ ID NO: 52031 - DNA, 20 bp, Artificial Sequence
  Synthetic oligonucleotide; AGG chr11 5198282 5198301 5198285 -
tatcagaagtgaaaactgtg

SEQ ID NO: 52032 - DNA, 20 bp, Artificial Sequence
  Synthetic oligonucleotide; TAG chr11 5198279 5198298 5198282 -
cagaagtgaaaactgtgagg

SEQ ID NO: 52033 - DNA, 20 bp, Artificial Sequence
  Synthetic oligonucleotide; AGG chr11 5198278 5198297 5198281 -
agaagtgaaaactgtgaggt

SEQ ID NO: 52034 - DNA, 20 bp, Artificial Sequence
  Synthetic oligonucleotide; TAG chr11 5198272 5198291 5198275 -
gaaaactgtgaggtaggttc

SEQ ID NO: 52035 - DNA, 20 bp, Artificial Sequence
  Synthetic oligonucleotide; GAG chr11 5198270 5198289 5198273 -
aaactgtgaggtaggttcta

SEQ ID NO: 52036 - DNA, 20 bp, Artificial Sequence
  Synthetic oligonucleotide; AGG chr11 5198269 5198288 5198272 -
aactgtgaggtaggttctag

SEQ ID NO: 52037 - DNA, 20 bp, Artificial Sequence
  Synthetic oligonucleotide; GGG chr11 5198268 5198287 5198271 -
actgtgaggtaggttctaga

SEQ ID NO: 52038 - DNA, 20 bp, Artificial Sequence
  Synthetic oligonucleotide; GGG chr11 5198267 5198286 5198270 -
ctgtgaggtaggttctagag

SEQ ID NO: 52039 - DNA, 20 bp, Artificial Sequence
  Synthetic oligonucleotide; TAG chr11 5198228 5198247 5198231 -
tattttttactatataatca

SEQ ID NO: 52040 - DNA, 20 bp, Artificial Sequence
  Synthetic oligonucleotide; TAG chr11 5198225 5198244 5198228 -
tttttactatataatcatag

SEQ ID NO: 52041 - DNA, 20 bp, Artificial Sequence
  Synthetic oligonucleotide; GAG chr11 5198217 5198236 5198220 -
atataatcatagtagctgcc

SEQ ID NO: 52042 - DNA, 20 bp, Artificial Sequence
  Synthetic oligonucleotide; AGG chr11 5198216 5198235 5198219 -
tataatcatagtagctgccg

SEQ ID NO: 52043 - DNA, 20 bp, Artificial Sequence
  Synthetic oligonucleotide; CGG chr11 5198213 5198232 5198216 -
aatcatagtagctgccgagg

SEQ ID NO: 52044 - DNA, 20 bp, Artificial Sequence
  Synthetic oligonucleotide; GGG chr11 5198212 5198231 5198215 -
atcatagtagctgccgaggc

SEQ ID NO: 52045 - DNA, 20 bp, Artificial Sequence
  Synthetic oligonucleotide; CGG chr11 5198209 5198228 5198212 -
atagtagctgccgaggcggg

SEQ ID NO: 52046 - DNA, 20 bp, Artificial Sequence
  Synthetic oligonucleotide; GAG chr11 5198201 5198220 5198204 -
tgccgaggcgggcggatcat

SEQ ID NO: 52047 - DNA, 20 bp, Artificial Sequence
  Synthetic oligonucleotide; AGG chr11 5198200 5198219 5198203 -
gccgaggcgggcggatcatg

SEQ ID NO: 52048 - DNA, 20 bp, Artificial Sequence
  Synthetic oligonucleotide; CAG chr11 5198196 5198215 5198199 -
aggcgggcggatcatgaggt

SEQ ID NO: 52049 - DNA, 20 bp, Artificial Sequence
  Synthetic oligonucleotide; AGG chr11 5198195 5198214 5198198 -
ggcgggcggatcatgaggtc

SEQ ID NO: 52050 - DNA, 20 bp, Artificial Sequence
  Synthetic oligonucleotide; GAG chr11 5198193 5198212 5198196 -
cgggcggatcatgaggtcag

SEQ ID NO: 52051 - DNA, 20 bp, Artificial Sequence
  Synthetic oligonucleotide; GAG chr11 5198187 5198206 5198190 -
gatcatgaggtcaggagatc

SEQ ID NO: 52052 - DNA, 20 bp, Artificial Sequence
  Synthetic oligonucleotide; TGG chr11 5198177 5198196 5198180 -
tcaggagatcgagaccatcc

SEQ ID NO: 52053 - DNA, 20 bp, Artificial Sequence
  Synthetic oligonucleotide; CAG chr11 5198173 5198192 5198176 -
gagatcgagaccatcctggc

SEQ ID NO: 52054 - DNA, 20 bp, Artificial Sequence
  Synthetic oligonucleotide; TGG chr11 5198167 5198186 5198170 -
gagaccatcctggccagcaa

SEQ ID NO: 52055 - DNA, 20 bp, Artificial Sequence
  Synthetic oligonucleotide; AAG chr11 5198136 5198155 5198139 -
cgtctctactaaaaaaacac

SEQ ID NO: 52056 - DNA, 20 bp, Artificial Sequence
  Synthetic oligonucleotide; AAG chr11 5198132 5198151 5198135 -
tctactaaaaaaacacaaga

SEQ ID NO: 52057 - DNA, 20 bp, Artificial Sequence
  Synthetic oligonucleotide; CAG chr11 5198125 5198144 5198128 -
aaaaaacacaagaaagtatc

SEQ ID NO: 52058 - DNA, 20 bp, Artificial Sequence
  Synthetic oligonucleotide; AGG chr11 5198124 5198143 5198127 -
aaaaacacaagaaagtatcc

SEQ ID NO: 52059 - DNA, 20 bp, Artificial Sequence
  Synthetic oligonucleotide; TGG chr11 5198119 5198138 5198122 -
cacaagaaagtatccaggcg

SEQ ID NO: 52060 - DNA, 20 bp, Artificial Sequence
  Synthetic oligonucleotide; TGG chr11 5198116 5198135 5198119 -
aagaaagtatccaggcgtgg

SEQ ID NO: 52061 - DNA, 20 bp, Artificial Sequence
  Synthetic oligonucleotide; CGG chr11 5198113 5198132 5198116 -
aaagtatccaggcgtggtgg

SEQ ID NO: 52062 - DNA, 20 bp, Artificial Sequence
  Synthetic oligonucleotide; GGG chr11 5198112 5198131 5198115 -
aagtatccaggcgtggtggc

SEQ ID NO: 52063 - DNA, 20 bp, Artificial Sequence
  Synthetic oligonucleotide; TAG chr11 5198103 5198122 5198106 -
ggcgtggtggcgggcacctg

SEQ ID NO: 52064 - DNA, 20 bp, Artificial Sequence
  Synthetic oligonucleotide; CAG chr11 5198097 5198116 5198100 -
gtggcgggcacctgtagtcc

SEQ ID NO: 52065 - DNA, 20 bp, Artificial Sequence
  Synthetic oligonucleotide; AGG chr11 5198096 5198115 5198099 -
tggcgggcacctgtagtccc

SEQ ID NO: 52066 - DNA, 20 bp, Artificial Sequence
  Synthetic oligonucleotide; CGG chr11 5198089 5198108 5198092 -
cacctgtagtcccaggtact

SEQ ID NO: 52067 - DNA, 20 bp, Artificial Sequence
  Synthetic oligonucleotide; GGG chr11 5198088 5198107 5198091 -
acctgtagtcccaggtactc

SEQ ID NO: 52068 - DNA, 20 bp, Artificial Sequence
  Synthetic oligonucleotide; GAG chr11 5198086 5198105 5198089 -
ctgtagtcccaggtactcgg

SEQ ID NO: 52069 - DNA, 20 bp, Artificial Sequence
  Synthetic oligonucleotide; AGG chr11 5198085 5198104 5198088 -
tgtagtcccaggtactcggg

SEQ ID NO: 52070 - DNA, 20 bp, Artificial Sequence
  Synthetic oligonucleotide; GAG chr11 5198080 5198099 5198083 -
tcccaggtactcgggaggct

SEQ ID NO: 52071 - DNA, 20 bp, Artificial Sequence
  Synthetic oligonucleotide; CAG chr11 5198076 5198095 5198079 -
aggtactcgggaggctgaga

SEQ ID NO: 52072 - DNA, 20 bp, Artificial Sequence
  Synthetic oligonucleotide; AGG chr11 5198075 5198094 5198078 -
ggtactcgggaggctgagac

SEQ ID NO: 52073 - DNA, 20 bp, Artificial Sequence
  Synthetic oligonucleotide; GAG chr11 5198073 5198092 5198076 -
tactcgggaggctgagacag

SEQ ID NO: 52074 - DNA, 20 bp, Artificial Sequence
  Synthetic oligonucleotide; TGG chr11 5198068 5198087 5198071 -
gggaggctgagacaggagaa

SEQ ID NO: 52075 - DNA, 20 bp, Artificial Sequence
  Synthetic oligonucleotide; CGG chr11 5198057 5198076 5198060 -
acaggagaatggcgtgaacc

SEQ ID NO: 52076 - DNA, 20 bp, Artificial Sequence
  Synthetic oligonucleotide; GGG chr11 5198056 5198075 5198059 -
caggagaatggcgtgaaccc

SEQ ID NO: 52077 - DNA, 20 bp, Artificial Sequence
  Synthetic oligonucleotide; GAG chr11 5198054 5198073 5198057 -
ggagaatggcgtgaacccgg

SEQ ID NO: 52078 - DNA, 20 bp, Artificial Sequence
  Synthetic oligonucleotide; AGG chr11 5198053 5198072 5198056 -
gagaatggcgtgaacccggg

SEQ ID NO: 52079 - DNA, 20 bp, Artificial Sequence
  Synthetic oligonucleotide; TGG chr11 5198050 5198069 5198053 -
aatggcgtgaacccgggagg

SEQ ID NO: 52080 - DNA, 20 bp, Artificial Sequence
  Synthetic oligonucleotide; GAG chr11 5198048 5198067 5198051 -
tggcgtgaacccgggaggtg

SEQ ID NO: 52081 - DNA, 20 bp, Artificial Sequence
  Synthetic oligonucleotide; CAG chr11 5198041 5198060 5198044 -
aacccgggaggtggagcttg

SEQ ID NO: 52082 - DNA, 20 bp, Artificial Sequence
  Synthetic oligonucleotide; GAG chr11 5198037 5198056 5198040 -
cgggaggtggagcttgcagt

SEQ ID NO: 52083 - DNA, 20 bp, Artificial Sequence
  Synthetic oligonucleotide; GAG chr11 5198032 5198051 5198035 -
ggtggagcttgcagtgagtc

SEQ ID NO: 52084 - DNA, 20 bp, Artificial Sequence
  Synthetic oligonucleotide; CAG chr11 5198012 5198031 5198015 -
gagatcacgccactgcactc

SEQ ID NO: 52085 - DNA, 20 bp, Artificial Sequence
  Synthetic oligonucleotide; TGG chr11 5198007 5198026 5198010 -
cacgccactgcactccagcc

SEQ ID NO: 52086 - DNA, 20 bp, Artificial Sequence
  Synthetic oligonucleotide; GGG chr11 5198006 5198025 5198009 -
acgccactgcactccagcct

SEQ ID NO: 52087 - DNA, 20 bp, Artificial Sequence
  Synthetic oligonucleotide; CAG chr11 5198000 5198019 5198003 -
ctgcactccagcctgggcga

SEQ ID NO: 52088 - DNA, 20 bp, Artificial Sequence
  Synthetic oligonucleotide; GAG chr11 5197998 5198017 5198001 -
gcactccagcctgggcgaca

SEQ ID NO: 52089 - DNA, 20 bp, Artificial Sequence
  Synthetic oligonucleotide; GAG chr11 5197996 5198015 5197999 -
actccagcctgggcgacaga

SEQ ID NO: 52090 - DNA, 20 bp, Artificial Sequence
  Synthetic oligonucleotide; GAG chr11 5197994 5198013 5197997 -
tccagcctgggcgacagaga

SEQ ID NO: 52091 - DNA, 20 bp, Artificial Sequence
  Synthetic oligonucleotide; AAG chr11 5197966 5197985 5197969 -
gtctcaaaaaaaaaaaaaaa

SEQ ID NO: 52092 - DNA, 20 bp, Artificial Sequence
  Synthetic oligonucleotide; GAG chr11 5197964 5197983 5197967 -
ctcaaaaaaaaaaaaaaaaa

SEQ ID NO: 52093 - DNA, 20 bp, Artificial Sequence
  Synthetic oligonucleotide; AAG chr11 5197954 5197973 5197957 -
aaaaaaaaaagagaaaaaaa

SEQ ID NO: 52094 - DNA, 20 bp, Artificial Sequence
  Synthetic oligonucleotide; AAG chr11 5197949 5197968 5197952 -
aaaaagagaaaaaaaaagaa

SEQ ID NO: 52095 - DNA, 20 bp, Artificial Sequence
  Synthetic oligonucleotide; CAG chr11 5197933 5197952 5197936 -
agaaaagttgatatgaatgt

SEQ ID NO: 52096 - DNA, 20 bp, Artificial Sequence
  Synthetic oligonucleotide; AGG chr11 5197932 5197951 5197935 -
gaaaagttgatatgaatgtc

SEQ ID NO: 52097 - DNA, 20 bp, Artificial Sequence
  Synthetic oligonucleotide; TGG chr11 5197929 5197948 5197932 -
aagttgatatgaatgtcagg

SEQ ID NO: 52098 - DNA, 20 bp, Artificial Sequence
  Synthetic oligonucleotide; TAG chr11 5197926 5197945 5197929 -
ttgatatgaatgtcaggtgg

SEQ ID NO: 52099 - DNA, 20 bp, Artificial Sequence
  Synthetic oligonucleotide; CAG chr11 5197915 5197934 5197918 -
gtcaggtggtagtactgctc

SEQ ID NO: 52100 - DNA, 20 bp, Artificial Sequence
  Synthetic oligonucleotide; AGG chr11 5197914 5197933 5197917 -
tcaggtggtagtactgctcc

SEQ ID NO: 52101 - DNA, 20 bp, Artificial Sequence
  Synthetic oligonucleotide; TGG chr11 5197885 5197904 5197888 -
aatgataataaatgtctgca

SEQ ID NO: 52102 - DNA, 20 bp, Artificial Sequence
  Synthetic oligonucleotide; TGG chr11 5197875 5197894 5197878 -
aatgtctgcatggtccctcc

SEQ ID NO: 52103 - DNA, 20 bp, Artificial Sequence
  Synthetic oligonucleotide; TGG chr11 5197867 5197886 5197870 -
catggtccctcctggccgac

SEQ ID NO: 52104 - DNA, 20 bp, Artificial Sequence
  Synthetic oligonucleotide; TGG chr11 5197860 5197879 5197863 -
cctcctggccgactggaatg

SEQ ID NO: 52105 - DNA, 20 bp, Artificial Sequence
  Synthetic oligonucleotide; AAG chr11 5197847 5197866 5197850 -
tggaatgtggccaatctgac

SEQ ID NO: 52106 - DNA, 20 bp, Artificial Sequence
  Synthetic oligonucleotide; CAG chr11 5197832 5197851 5197835 -
ctgacaagattcctatgccc

SEQ ID NO: 52107 - DNA, 20 bp, Artificial Sequence
  Synthetic oligonucleotide; AAG chr11 5197817 5197836 5197820 -
tgccccagttttataatgaa

SEQ ID NO: 52108 - DNA, 20 bp, Artificial Sequence
  Synthetic oligonucleotide; GAG chr11 5197815 5197834 5197818 -
ccccagttttataatgaaaa

SEQ ID NO: 52109 - DNA, 20 bp, Artificial Sequence
  Synthetic oligonucleotide; AAG chr11 5197812 5197831 5197815 -
cagttttataatgaaaagag

SEQ ID NO: 52110 - DNA, 20 bp, Artificial Sequence
  Synthetic oligonucleotide; TAG chr11 5197808 5197827 5197811 -
tttataatgaaaagagaagt

SEQ ID NO: 52111 - DNA, 20 bp, Artificial Sequence
  Synthetic oligonucleotide; TAG chr11 5197793 5197812 5197796 -
gaagttagctgctgaatctg

SEQ ID NO: 52112 - DNA, 20 bp, Artificial Sequence
  Synthetic oligonucleotide; GAG chr11 5197791 5197810 5197794 -
agttagctgctgaatctgta

SEQ ID NO: 52113 - DNA, 20 bp, Artificial Sequence
  Synthetic oligonucleotide; AGG chr11 5197790 5197809 5197793 -
gttagctgctgaatctgtag

SEQ ID NO: 52114 - DNA, 20 bp, Artificial Sequence
  Synthetic oligonucleotide; TAG chr11 5197771 5197790 5197774 -
gaggtcatgtgaatgtctca

SEQ ID NO: 52115 - DNA, 20 bp, Artificial Sequence
  Synthetic oligonucleotide; TGG chr11 5197759 5197778 5197762 -
atgtctcatagatttctcaa

SEQ ID NO: 52116 - DNA, 20 bp, Artificial Sequence
  Synthetic oligonucleotide; AAG chr11 5197753 5197772 5197756 -
catagatttctcaatggcca

SEQ ID NO: 52117 - DNA, 20 bp, Artificial Sequence
  Synthetic oligonucleotide; AAG chr11 5197750 5197769 5197753 -
agatttctcaatggccaaag

SEQ ID NO: 52118 - DNA, 20 bp, Artificial Sequence
  Synthetic oligonucleotide; AAG chr11 5197728 5197747 5197731 -
gcttccttctaatgctttga

SEQ ID NO: 52119 - DNA, 20 bp, Artificial Sequence
  Synthetic oligonucleotide; AAG chr11 5197720 5197739 5197723 -
ctaatgctttgaaagtgaat

SEQ ID NO: 52120 - DNA, 20 bp, Artificial Sequence
  Synthetic oligonucleotide; CGG chr11 5197698 5197717 5197701 -
gcatccaccctcccatacgc

SEQ ID NO: 52121 - DNA, 20 bp, Artificial Sequence
  Synthetic oligonucleotide; GAG chr11 5197696 5197715 5197699 -
atccaccctcccatacgccg

SEQ ID NO: 52122 - DNA, 20 bp, Artificial Sequence
  Synthetic oligonucleotide; GAG chr11 5197694 5197713 5197697 -
ccaccctcccatacgccgga

SEQ ID NO: 52123 - DNA, 20 bp, Artificial Sequence
  Synthetic oligonucleotide; TGG chr11 5197679 5197698 5197682 -
ccggagagctgacacaacac

SEQ ID NO: 52124 - DNA, 20 bp, Artificial Sequence
  Synthetic oligonucleotide; GGG chr11 5197678 5197697 5197681 -
cggagagctgacacaacact

SEQ ID NO: 52125 - DNA, 20 bp, Artificial Sequence
  Synthetic oligonucleotide; GGG chr11 5197677 5197696 5197680 -
ggagagctgacacaacactg

SEQ ID NO: 52126 - DNA, 20 bp, Artificial Sequence
  Synthetic oligonucleotide; AAG chr11 5197674 5197693 5197677 -
gagctgacacaacactgggg

SEQ ID NO: 52127 - DNA, 20 bp, Artificial Sequence
  Synthetic oligonucleotide; CAG chr11 5197671 5197690 5197674 -
ctgacacaacactggggaag

SEQ ID NO: 52128 - DNA, 20 bp, Artificial Sequence
  Synthetic oligonucleotide; GAG chr11 5197669 5197688 5197672 -
gacacaacactggggaagca

SEQ ID NO: 52129 - DNA, 20 bp, Artificial Sequence
  Synthetic oligonucleotide; CAG chr11 5197634 5197653 5197637 -
actgacaatatgttttccac

SEQ ID NO: 52130 - DNA, 20 bp, Artificial Sequence
  Synthetic oligonucleotide; TAG chr11 5197624 5197643 5197627 -
tgttttccaccagccactca

SEQ ID NO: 52131 - DNA, 20 bp, Artificial Sequence
  Synthetic oligonucleotide; AGG chr11 5197623 5197642 5197626 -
gttttccaccagccactcat

SEQ ID NO: 52132 - DNA, 20 bp, Artificial Sequence
  Synthetic oligonucleotide; GGG chr11 5197622 5197641 5197625 -
ttttccaccagccactcata

SEQ ID NO: 52133 - DNA, 20 bp, Artificial Sequence
  Synthetic oligonucleotide; AAG chr11 5197619 5197638 5197622 -
tccaccagccactcataggg

SEQ ID NO: 52134 - DNA, 20 bp, Artificial Sequence
  Synthetic oligonucleotide; CAG chr11 5197613 5197632 5197616 -
agccactcatagggaagcat

SEQ ID NO: 52135 - DNA, 20 bp, Artificial Sequence
  Synthetic oligonucleotide; GAG chr11 5197561 5197580 5197564 -
attacatgtctgacacaact

SEQ ID NO: 52136 - DNA, 20 bp, Artificial Sequence
  Synthetic oligonucleotide; TGG chr11 5197554 5197573 5197557 -
gtctgacacaactgagttgt

SEQ ID NO: 52137 - DNA, 20 bp, Artificial Sequence
  Synthetic oligonucleotide; GAG chr11 5197548 5197567 5197551 -
cacaactgagttgttggttt

SEQ ID NO: 52138 - DNA, 20 bp, Artificial Sequence
  Synthetic oligonucleotide; GAG chr11 5197546 5197565 5197549 -
caactgagttgttggtttga

SEQ ID NO: 52139 - DNA, 20 bp, Artificial Sequence
  Synthetic oligonucleotide; CAG chr11 5197533 5197552 5197536 -
ggtttgagagttatgtttaa

SEQ ID NO: 52140 - DNA, 20 bp, Artificial Sequence
  Synthetic oligonucleotide; AGG chr11 5197532 5197551 5197535 -
gtttgagagttatgtttaac

SEQ ID NO: 52141 - DNA, 20 bp, Artificial Sequence
  Synthetic oligonucleotide; GGG chr11 5197531 5197550 5197534 -
tttgagagttatgtttaaca

SEQ ID NO: 52142 - DNA, 20 bp, Artificial Sequence
  Synthetic oligonucleotide; GAG chr11 5197529 5197548 5197532 -
tgagagttatgtttaacagg

SEQ ID NO: 52143 - DNA, 20 bp, Artificial Sequence
  Synthetic oligonucleotide; GAG chr11 5197527 5197546 5197530 -
agagttatgtttaacaggga

SEQ ID NO: 52144 - DNA, 20 bp, Artificial Sequence
  Synthetic oligonucleotide; TAG chr11 5197524 5197543 5197527 -
gttatgtttaacagggagag

SEQ ID NO: 52145 - DNA, 20 bp, Artificial Sequence
  Synthetic oligonucleotide; AGG chr11 5197523 5197542 5197526 -
ttatgtttaacagggagagt

SEQ ID NO: 52146 - DNA, 20 bp, Artificial Sequence
  Synthetic oligonucleotide; AAG chr11 5197520 5197539 5197523 -
tgtttaacagggagagtagg

SEQ ID NO: 52147 - DNA, 20 bp, Artificial Sequence
  Synthetic oligonucleotide; AGG chr11 5197519 5197538 5197522 -
gtttaacagggagagtagga

SEQ ID NO: 52148 - DNA, 20 bp, Artificial Sequence
  Synthetic oligonucleotide; AAG chr11 5197508 5197527 5197511 -
agagtaggaaggctcatctg

SEQ ID NO: 52149 - DNA, 20 bp, Artificial Sequence
  Synthetic oligonucleotide; GAG chr11 5197493 5197512 5197496 -
atctgaagacttcatactat

SEQ ID NO: 52150 - DNA, 20 bp, Artificial Sequence
  Synthetic oligonucleotide; CAG chr11 5197479 5197498 5197482 -
tactatgagtgtttgtgctt

SEQ ID NO: 52151 - DNA, 20 bp, Artificial Sequence
  Synthetic oligonucleotide; TAG chr11 5197474 5197493 5197477 -
tgagtgtttgtgcttcagat

SEQ ID NO: 52152 - DNA, 20 bp, Artificial Sequence
  Synthetic oligonucleotide; AGG chr11 5197473 5197492 5197476 -
gagtgtttgtgcttcagatt

SEQ ID NO: 52153 - DNA, 20 bp, Artificial Sequence
  Synthetic oligonucleotide; TAG chr11 5197463 5197482 5197466 -
gcttcagattaggcaaccta

SEQ ID NO: 52154 - DNA, 20 bp, Artificial Sequence
  Synthetic oligonucleotide; TAG chr11 5197446 5197465 5197449 -
ctatagaatgtgaaccaaaa

SEQ ID NO: 52155 - DNA, 20 bp, Artificial Sequence
  Synthetic oligonucleotide; TGG chr11 5197433 5197452 5197436 -
accaaaatagtttgaaataa

SEQ ID NO: 52156 - DNA, 20 bp, Artificial Sequence
  Synthetic oligonucleotide; CAG chr11 5197419 5197438 5197422 -
aaataatggccgtgacaaaa

SEQ ID NO: 52157 - DNA, 20 bp, Artificial Sequence
  Synthetic oligonucleotide; AAG chr11 5197400 5197419 5197403 -
acagttaataaaaaatacct

SEQ ID NO: 52158 - DNA, 20 bp, Artificial Sequence
  Synthetic oligonucleotide; GAG chr11 5197398 5197417 5197401 -
agttaataaaaaatacctaa

SEQ ID NO: 52159 - DNA, 20 bp, Artificial Sequence
  Synthetic oligonucleotide; CAG chr11 5197389 5197408 5197392 -
aaaatacctaagagtatcct

SEQ ID NO: 52160 - DNA, 20 bp, Artificial Sequence
  Synthetic oligonucleotide; TAG chr11 5197370 5197389 5197373 -
tcagaaatcattgcttattt

SEQ ID NO: 52161 - DNA, 20 bp, Artificial Sequence
  Synthetic oligonucleotide; GAG chr11 5197368 5197387 5197371 -
agaaatcattgcttatttta

SEQ ID NO: 52162 - DNA, 20 bp, Artificial Sequence
  Synthetic oligonucleotide; AAG chr11 5197342 5197361 5197345 -
tataattgtactatgatgat

SEQ ID NO: 52163 - DNA, 20 bp, Artificial Sequence
  Synthetic oligonucleotide; AAG chr11 5197332 5197351 5197335 -
ctatgatgataagatttatg

SEQ ID NO: 52164 - DNA, 20 bp, Artificial Sequence
  Synthetic oligonucleotide; CAG chr11 5197324 5197343 5197327 -
ataagatttatgaagaactt

SEQ ID NO: 52165 - DNA, 20 bp, Artificial Sequence
  Synthetic oligonucleotide; CAG chr11 5197308 5197327 5197311 -
acttcagaatctttacaatt

SEQ ID NO: 52166 - DNA, 20 bp, Artificial Sequence
  Synthetic oligonucleotide; AAG chr11 5197302 5197321 5197305 -
gaatctttacaattcagcca

SEQ ID NO: 52167 - DNA, 20 bp, Artificial Sequence
  Synthetic oligonucleotide; AGG chr11 5197301 5197320 5197304 -
aatctttacaattcagccaa

SEQ ID NO: 52168 - DNA, 20 bp, Artificial Sequence
  Synthetic oligonucleotide; GGG chr11 5197300 5197319 5197303 -
atctttacaattcagccaaa

SEQ ID NO: 52169 - DNA, 20 bp, Artificial Sequence
  Synthetic oligonucleotide; GAG chr11 5197298 5197317 5197301 -
ctttacaattcagccaaagg

SEQ ID NO: 52170 - DNA, 20 bp, Artificial Sequence
  Synthetic oligonucleotide; AGG chr11 5197297 5197316 5197300 -
tttacaattcagccaaaggg

SEQ ID NO: 52171 - DNA, 20 bp, Artificial Sequence
  Synthetic oligonucleotide; CAG chr11 5197289 5197308 5197292 -
tcagccaaagggaggaaaat

SEQ ID NO: 52172 - DNA, 20 bp, Artificial Sequence
  Synthetic oligonucleotide; AAG chr11 5197270 5197289 5197273 -
tcagtaaaaaaaaaaaaaaa

SEQ ID NO: 52173 - DNA, 20 bp, Artificial Sequence
  Synthetic oligonucleotide; AAG chr11 5197260 5197279 5197263 -
aaaaaaaaaaaagccaatga

SEQ ID NO: 52174 - DNA, 20 bp, Artificial Sequence
  Synthetic oligonucleotide; TGG chr11 5197239 5197258 5197242 -
agtaaactttatatgattac

SEQ ID NO: 52175 - DNA, 20 bp, Artificial Sequence
  Synthetic oligonucleotide; GGG chr11 5197238 5197257 5197241 -
gtaaactttatatgattact

SEQ ID NO: 52176 - DNA, 20 bp, Artificial Sequence
  Synthetic oligonucleotide; CAG chr11 5197228 5197247 5197231 -
tatgattactgggctttata

SEQ ID NO: 52177 - DNA, 20 bp, Artificial Sequence
  Synthetic oligonucleotide; AAG chr11 5197224 5197243 5197227 -
attactgggctttatacaga

SEQ ID NO: 52178 - DNA, 20 bp, Artificial Sequence
  Synthetic oligonucleotide; CAG chr11 5197218 5197237 5197221 -
gggctttatacagaaagaaa

SEQ ID NO: 52179 - DNA, 20 bp, Artificial Sequence
  Synthetic oligonucleotide; AGG chr11 5197217 5197236 5197220 -
ggctttatacagaaagaaac

SEQ ID NO: 52180 - DNA, 20 bp, Artificial Sequence
  Synthetic oligonucleotide; TAG chr11 5197212 5197231 5197215 -
tatacagaaagaaacaggtt

SEQ ID NO: 52181 - DNA, 20 bp, Artificial Sequence
  Synthetic oligonucleotide; TAG chr11 5197204 5197223 5197207 -
aagaaacaggtttagaacat

SEQ ID NO: 52182 - DNA, 20 bp, Artificial Sequence
  Synthetic oligonucleotide; TAG chr11 5197201 5197220 5197204 -
aaacaggtttagaacattag

SEQ ID NO: 52183 - DNA, 20 bp, Artificial Sequence
  Synthetic oligonucleotide; TAG chr11 5197196 5197215 5197199 -
ggtttagaacattagtagtt

SEQ ID NO: 52184 - DNA, 20 bp, Artificial Sequence
  Synthetic oligonucleotide; AAG chr11 5197178 5197197 5197181 -
tttagattgtttgttttgca

SEQ ID NO: 52185 - DNA, 20 bp, Artificial Sequence
  Synthetic oligonucleotide; AGG chr11 5197177 5197196 5197180 -
ttagattgtttgttttgcaa

SEQ ID NO: 52186 - DNA, 20 bp, Artificial Sequence
  Synthetic oligonucleotide; TGG chr11 5197166 5197185 5197169 -
gttttgcaaaggcctctatc

SEQ ID NO: 52187 - DNA, 20 bp, Artificial Sequence
  Synthetic oligonucleotide; AAG chr11 5197163 5197182 5197166 -
ttgcaaaggcctctatctgg

SEQ ID NO: 52188 - DNA, 20 bp, Artificial Sequence
  Synthetic oligonucleotide; GAG chr11 5197128 5197147 5197131 -
aaaataactaaacctctcct

SEQ ID NO: 52189 - DNA, 20 bp, Artificial Sequence
  Synthetic oligonucleotide; AGG chr11 5197127 5197146 5197130 -
aaataactaaacctctcctg

SEQ ID NO: 52190 - DNA, 20 bp, Artificial Sequence
  Synthetic oligonucleotide; AAG chr11 5197124 5197143 5197127 -
taactaaacctctcctgagg

SEQ ID NO: 52191 - DNA, 20 bp, Artificial Sequence
  Synthetic oligonucleotide; AAG chr11 5197119 5197138 5197122 -
aaacctctcctgaggaagaa

SEQ ID NO: 52192 - DNA, 20 bp, Artificial Sequence
  Synthetic oligonucleotide; AGG chr11 5197118 5197137 5197121 -
aacctctcctgaggaagaaa

SEQ ID NO: 52193 - DNA, 20 bp, Artificial Sequence
  Synthetic oligonucleotide; CAG chr11 5197109 5197128 5197112 -
tgaggaagaaaaggcaattt

SEQ ID NO: 52194 - DNA, 20 bp, Artificial Sequence
  Synthetic oligonucleotide; GAG chr11 5197107 5197126 5197110 -
aggaagaaaaggcaatttca

SEQ ID NO: 52195 - DNA, 20 bp, Artificial Sequence
  Synthetic oligonucleotide; CAG chr11 5197100 5197119 5197103 -
aaaggcaatttcagagacat

SEQ ID NO: 52196 - DNA, 20 bp, Artificial Sequence
  Synthetic oligonucleotide; CAG chr11 5197095 5197114 5197098 -
caatttcagagacatcagcc

SEQ ID NO: 52197 - DNA, 20 bp, Artificial Sequence
  Synthetic oligonucleotide; AGG chr11 5197094 5197113 5197097 -
aatttcagagacatcagccc

SEQ ID NO: 52198 - DNA, 20 bp, Artificial Sequence
  Synthetic oligonucleotide; AAG chr11 5197085 5197104 5197088 -
gacatcagcccaggtcctga

SEQ ID NO: 52199 - DNA, 20 bp, Artificial Sequence
  Synthetic oligonucleotide; AGG chr11 5197084 5197103 5197087 -
acatcagcccaggtcctgaa

SEQ ID NO: 52200 - DNA, 20 bp, Artificial Sequence
  Synthetic oligonucleotide; AAG chr11 5197081 5197100 5197084 -
tcagcccaggtcctgaaagg

SEQ ID NO: 52201 - DNA, 20 bp, Artificial Sequence
  Synthetic oligonucleotide; GAG chr11 5197079 5197098 5197082 -
agcccaggtcctgaaaggaa

SEQ ID NO: 52202 - DNA, 20 bp, Artificial Sequence
  Synthetic oligonucleotide; CAG chr11 5197076 5197095 5197079 -
ccaggtcctgaaaggaagag

SEQ ID NO: 52203 - DNA, 20 bp, Artificial Sequence
  Synthetic oligonucleotide; TGG chr11 5197072 5197091 5197075 -
gtcctgaaaggaagagcaga

SEQ ID NO: 52204 - DNA, 20 bp, Artificial Sequence
  Synthetic oligonucleotide; GAG chr11 5197070 5197089 5197073 -
cctgaaaggaagagcagatg

SEQ ID NO: 52205 - DNA, 20 bp, Artificial Sequence
  Synthetic oligonucleotide; CAG chr11 5197061 5197080 5197064 -
aagagcagatggagacatca

SEQ ID NO: 52206 - DNA, 20 bp, Artificial Sequence
  Synthetic oligonucleotide; AGG chr11 5197060 5197079 5197063 -
agagcagatggagacatcac

SEQ ID NO: 52207 - DNA, 20 bp, Artificial Sequence
  Synthetic oligonucleotide; AAG chr11 5197032 5197051 5197035 -
aaaacactgtctgttttgaa

SEQ ID NO: 52208 - DNA, 20 bp, Artificial Sequence
  Synthetic oligonucleotide; TAG chr11 5197024 5197043 5197027 -
gtctgttttgaaaagctaca

SEQ ID NO: 52209 - DNA, 20 bp, Artificial Sequence
  Synthetic oligonucleotide; TAG chr11 5197021 5197040 5197024 -
tgttttgaaaagctacatag

SEQ ID NO: 52210 - DNA, 20 bp, Artificial Sequence
  Synthetic oligonucleotide; CAG chr11 5197017 5197036 5197020 -
ttgaaaagctacatagtagc

SEQ ID NO: 52211 - DNA, 20 bp, Artificial Sequence
  Synthetic oligonucleotide; AGG chr11 5197016 5197035 5197019 -
tgaaaagctacatagtagcc

SEQ ID NO: 52212 - DNA, 20 bp, Artificial Sequence
  Synthetic oligonucleotide; TGG chr11 5197013 5197032 5197016 -
aaagctacatagtagccagg

SEQ ID NO: 52213 - DNA, 20 bp, Artificial Sequence
  Synthetic oligonucleotide; GAG chr11 5197011 5197030 5197014 -
agctacatagtagccaggtg

SEQ ID NO: 52214 - DNA, 20 bp, Artificial Sequence
  Synthetic oligonucleotide; AAG chr11 5196986 5197005 5196989 -
atttttccatatatctcaaa

SEQ ID NO: 52215 - DNA, 20 bp, Artificial Sequence
  Synthetic oligonucleotide; CAG chr11 5196982 5197001 5196985 -
ttccatatatctcaaaaagc

SEQ ID NO: 52216 - DNA, 20 bp, Artificial Sequence
  Synthetic oligonucleotide; AAG chr11 5196974 5196993 5196977 -
atctcaaaaagccagcttct

SEQ ID NO: 52217 - DNA, 20 bp, Artificial Sequence
  Synthetic oligonucleotide; AGG chr11 5196973 5196992 5196976 -
tctcaaaaagccagcttcta

SEQ ID NO: 52218 - DNA, 20 bp, Artificial Sequence
  Synthetic oligonucleotide; TAG chr11 5196951 5196970 5196954 -
gaaacttgttttccatgaat

SEQ ID NO: 52219 - DNA, 20 bp, Artificial Sequence
  Synthetic oligonucleotide; AGG chr11 5196950 5196969 5196953 -
aaacttgttttccatgaatt

SEQ ID NO: 52220 - DNA, 20 bp, Artificial Sequence
  Synthetic oligonucleotide; CAG chr11 5196941 5196960 5196944 -
ttccatgaattaggcaacaa

SEQ ID NO: 52221 - DNA, 20 bp, Artificial Sequence
  Synthetic oligonucleotide; TGG chr11 5196920 5196939 5196923 -
agctgaaactgttgttgatg

SEQ ID NO: 52222 - DNA, 20 bp, Artificial Sequence
  Synthetic oligonucleotide; TAG chr11 5196917 5196936 5196920 -
tgaaactgttgttgatgtgg

SEQ ID NO: 52223 - DNA, 20 bp, Artificial Sequence
  Synthetic oligonucleotide; CAG chr11 5196910 5196929 5196913 -
gttgttgatgtggtagcctg

SEQ ID NO: 52224 - DNA, 20 bp, Artificial Sequence
  Synthetic oligonucleotide; GAG chr11 5196908 5196927 5196911 -
tgttgatgtggtagcctgca

SEQ ID NO: 52225 - DNA, 20 bp, Artificial Sequence
  Synthetic oligonucleotide; CAG chr11 5196904 5196923 5196907 -
gatgtggtagcctgcagagc

SEQ ID NO: 52226 - DNA, 20 bp, Artificial Sequence
  Synthetic oligonucleotide; GAG chr11 5196900 5196919 5196903 -
tggtagcctgcagagccagt

SEQ ID NO: 52227 - DNA, 20 bp, Artificial Sequence
  Synthetic oligonucleotide; AAG chr11 5196897 5196916 5196900 -
tagcctgcagagccagtgag

SEQ ID NO: 52228 - DNA, 20 bp, Artificial Sequence
  Synthetic oligonucleotide; CAG chr11 5196894 5196913 5196897 -
cctgcagagccagtgagaag

SEQ ID NO: 52229 - DNA, 20 bp, Artificial Sequence
  Synthetic oligonucleotide; CAG chr11 5196887 5196906 5196890 -
agccagtgagaagcagttat

SEQ ID NO: 52230 - DNA, 20 bp, Artificial Sequence
  Synthetic oligonucleotide; AAG chr11 5196874 5196893 5196877 -
cagttatcagattcctttgt

SEQ ID NO: 52231 - DNA, 20 bp, Artificial Sequence
  Synthetic oligonucleotide; AGG chr11 5196873 5196892 5196876 -
agttatcagattcctttgta

SEQ ID NO: 52232 - DNA, 20 bp, Artificial Sequence
  Synthetic oligonucleotide; AAG chr11 5196865 5196884 5196868 -
gattcctttgtaaggcctgc

SEQ ID NO: 52233 - DNA, 20 bp, Artificial Sequence
  Synthetic oligonucleotide; AGG chr11 5196864 5196883 5196867 -
attcctttgtaaggcctgca

SEQ ID NO: 52234 - DNA, 20 bp, Artificial Sequence
  Synthetic oligonucleotide; CAG chr11 5196853 5196872 5196856 -
aggcctgcaaggctactatc

SEQ ID NO: 52235 - DNA, 20 bp, Artificial Sequence
  Synthetic oligonucleotide; GAG chr11 5196843 5196862 5196846 -
ggctactatccagcgtcact

SEQ ID NO: 52236 - DNA, 20 bp, Artificial Sequence
  Synthetic oligonucleotide; CAG chr11 5196826 5196845 5196829 -
actgagaaacgttacgaaaa

SEQ ID NO: 52237 - DNA, 20 bp, Artificial Sequence
  Synthetic oligonucleotide; CAG chr11 5196820 5196839 5196823 -
aaacgttacgaaaacagcca

SEQ ID NO: 52238 - DNA, 20 bp, Artificial Sequence
  Synthetic oligonucleotide; TAG chr11 5196811 5196830 5196814 -
gaaaacagccacagtgatgt

SEQ ID NO: 52239 - DNA, 20 bp, Artificial Sequence
  Synthetic oligonucleotide; AGG chr11 5196810 5196829 5196813 -
aaaacagccacagtgatgtt

SEQ ID NO: 52240 - DNA, 20 bp, Artificial Sequence
  Synthetic oligonucleotide; GGG chr11 5196809 5196828 5196812 -
aaacagccacagtgatgtta

SEQ ID NO: 52241 - DNA, 20 bp, Artificial Sequence
  Synthetic oligonucleotide; CAG chr11 5196801 5196820 5196804 -
acagtgatgttagggaaaca

SEQ ID NO: 52242 - DNA, 20 bp, Artificial Sequence
  Synthetic oligonucleotide; TAG chr11 5196773 5196792 5196776 -
ttttgcctttttttttttaa

SEQ ID NO: 52243 - DNA, 20 bp, Artificial Sequence
  Synthetic oligonucleotide; AGG chr11 5196772 5196791 5196775 -
tttgcctttttttttttaat

SEQ ID NO: 52244 - DNA, 20 bp, Artificial Sequence
  Synthetic oligonucleotide; TAG chr11 5196769 5196788 5196772 -
gcctttttttttttaatagg

SEQ ID NO: 52245 - DNA, 20 bp, Artificial Sequence
  Synthetic oligonucleotide; AAG chr11 5196733 5196752 5196736 -
tgtaactgctgccttaaatg

SEQ ID NO: 52246 - DNA, 20 bp, Artificial Sequence
  Synthetic oligonucleotide; CGG chr11 5196727 5196746 5196730 -
tgctgccttaaatgaagtca

SEQ ID NO: 52247 - DNA, 20 bp, Artificial Sequence
  Synthetic oligonucleotide; AAG chr11 5196714 5196733 5196717 -
gaagtcacggttattataat

SEQ ID NO: 52248 - DNA, 20 bp, Artificial Sequence
  Synthetic oligonucleotide; AGG chr11 5196713 5196732 5196716 -
aagtcacggttattataata

SEQ ID NO: 52249 - DNA, 20 bp, Artificial Sequence
  Synthetic oligonucleotide; GAG chr11 5196711 5196730 5196714 -
gtcacggttattataataag

SEQ ID NO: 52250 - DNA, 20 bp, Artificial Sequence
  Synthetic oligonucleotide; GAG chr11 5196691 5196710 5196694 -
gagaaaacaaaaatattgcc

SEQ ID NO: 52251 - DNA, 20 bp, Artificial Sequence
  Synthetic oligonucleotide; AAG chr11 5196685 5196704 5196688 -
acaaaaatattgccgagaac

SEQ ID NO: 52252 - DNA, 20 bp, Artificial Sequence
  Synthetic oligonucleotide; AGG chr11 5196684 5196703 5196687 -
caaaaatattgccgagaaca

SEQ ID NO: 52253 - DNA, 20 bp, Artificial Sequence
  Synthetic oligonucleotide; AAG chr11 5196675 5196694 5196678 -
tgccgagaacaaggtgacaa

SEQ ID NO: 52254 - DNA, 20 bp, Artificial Sequence
  Synthetic oligonucleotide; AAG chr11 5196671 5196690 5196674 -
gagaacaaggtgacaaaagt

SEQ ID NO: 52255 - DNA, 20 bp, Artificial Sequence
  Synthetic oligonucleotide; CAG chr11 5196665 5196684 5196668 -
aaggtgacaaaagtaagatt

SEQ ID NO: 52256 - DNA, 20 bp, Artificial Sequence
  Synthetic oligonucleotide; CAG chr11 5196657 5196676 5196660 -
aaaagtaagattcagaaaat

SEQ ID NO: 52257 - DNA, 20 bp, Artificial Sequence
  Synthetic oligonucleotide; AAG chr11 5196653 5196672 5196656 -
gtaagattcagaaaatcaga

SEQ ID NO: 52258 - DNA, 20 bp, Artificial Sequence
  Synthetic oligonucleotide; TAG chr11 5196648 5196667 5196651 -
attcagaaaatcagaaagtc

SEQ ID NO: 52259 - DNA, 20 bp, Artificial Sequence
  Synthetic oligonucleotide; AAG chr11 5196608 5196627 5196611 -
catttaactcttacaccgaa

SEQ ID NO: 52260 - DNA, 20 bp, Artificial Sequence
  Synthetic oligonucleotide; AAG chr11 5196603 5196622 5196606 -
aactcttacaccgaaaagct

SEQ ID NO: 52261 - DNA, 20 bp, Artificial Sequence
  Synthetic oligonucleotide; AGG chr11 5196602 5196621 5196605 -
actcttacaccgaaaagcta

SEQ ID NO: 52262 - DNA, 20 bp, Artificial Sequence
  Synthetic oligonucleotide; CAG chr11 5196597 5196616 5196600 -
tacaccgaaaagctaaggtc

SEQ ID NO: 52263 - DNA, 20 bp, Artificial Sequence
  Synthetic oligonucleotide; TGG chr11 5196594 5196613 5196597 -
accgaaaagctaaggtccag

SEQ ID NO: 52264 - DNA, 20 bp, Artificial Sequence
  Synthetic oligonucleotide; GGG chr11 5196593 5196612 5196596 -
ccgaaaagctaaggtccagt

SEQ ID NO: 52265 - DNA, 20 bp, Artificial Sequence
  Synthetic oligonucleotide; GAG chr11 5196591 5196610 5196594 -
gaaaagctaaggtccagtgg

SEQ ID NO: 52266 - DNA, 20 bp, Artificial Sequence
  Synthetic oligonucleotide; CAG chr11 5196584 5196603 5196587 -
taaggtccagtgggagaaat

SEQ ID NO: 52267 - DNA, 20 bp, Artificial Sequence
  Synthetic oligonucleotide; TAG chr11 5196574 5196593 5196577 -
tgggagaaatcagtgattct

SEQ ID NO: 52268 - DNA, 20 bp, Artificial Sequence
  Synthetic oligonucleotide; AAG chr11 5196571 5196590 5196574 -
gagaaatcagtgattcttag

SEQ ID NO: 52269 - DNA, 20 bp, Artificial Sequence
  Synthetic oligonucleotide; GAG chr11 5196567 5196586 5196570 -
aatcagtgattcttagaagt

SEQ ID NO: 52270 - DNA, 20 bp, Artificial Sequence
  Synthetic oligonucleotide; GAG chr11 5196565 5196584 5196568 -
tcagtgattcttagaagtga

SEQ ID NO: 52271 - DNA, 20 bp, Artificial Sequence
  Synthetic oligonucleotide; AGG chr11 5196564 5196583 5196567 -
cagtgattcttagaagtgag

SEQ ID NO: 52272 - DNA, 20 bp, Artificial Sequence
  Synthetic oligonucleotide; CAG chr11 5196553 5196572 5196556 -
agaagtgagaggacatgatt

SEQ ID NO: 52273 - DNA, 20 bp, Artificial Sequence
  Synthetic oligonucleotide; AGG chr11 5196552 5196571 5196555 -
gaagtgagaggacatgattc

SEQ ID NO: 52274 - DNA, 20 bp, Artificial Sequence
  Synthetic oligonucleotide; TAG chr11 5196547 5196566 5196550 -
gagaggacatgattcaggat

SEQ ID NO: 52275 - DNA, 20 bp, Artificial Sequence
  Synthetic oligonucleotide; TAG chr11 5196533 5196552 5196536 -
caggattagaaatgtgtttt

SEQ ID NO: 52276 - DNA, 20 bp, Artificial Sequence
  Synthetic oligonucleotide; CAG chr11 5196502 5196521 5196505 -
atctgctaataataaatcca

SEQ ID NO: 52277 - DNA, 20 bp, Artificial Sequence
  Synthetic oligonucleotide; AGG chr11 5196501 5196520 5196504 -
tctgctaataataaatccac

SEQ ID NO: 52278 - DNA, 20 bp, Artificial Sequence
  Synthetic oligonucleotide; CAG chr11 5196498 5196517 5196501 -
gctaataataaatccacagg

SEQ ID NO: 52279 - DNA, 20 bp, Artificial Sequence
  Synthetic oligonucleotide; CAG chr11 5196480 5196499 5196483 -
ggcagatgttcactgtacac

SEQ ID NO: 52280 - DNA, 20 bp, Artificial Sequence
  Synthetic oligonucleotide; CAG chr11 5196477 5196496 5196480 -
agatgttcactgtacaccag

SEQ ID NO: 52281 - DNA, 20 bp, Artificial Sequence
  Synthetic oligonucleotide; TGG chr11 5196461 5196480 5196464 -
ccagcagtcttcaatgtttt

SEQ ID NO: 52282 - DNA, 20 bp, Artificial Sequence
  Synthetic oligonucleotide; CAG chr11 5196455 5196474 5196458 -
gtcttcaatgtttttggtac

SEQ ID NO: 52283 - DNA, 20 bp, Artificial Sequence
  Synthetic oligonucleotide; AGG chr11 5196454 5196473 5196457 -
tcttcaatgtttttggtacc

SEQ ID NO: 52284 - DNA, 20 bp, Artificial Sequence
  Synthetic oligonucleotide; GGG chr11 5196453 5196472 5196456 -
cttcaatgtttttggtacca

SEQ ID NO: 52285 - DNA, 20 bp, Artificial Sequence
  Synthetic oligonucleotide; TGG chr11 5196440 5196459 5196443 -
ggtaccagggactgcttttg

SEQ ID NO: 52286 - DNA, 20 bp, Artificial Sequence
  Synthetic oligonucleotide; AAG chr11 5196437 5196456 5196440 -
accagggactgcttttgtgg

SEQ ID NO: 52287 - DNA, 20 bp, Artificial Sequence
  Synthetic oligonucleotide; AAG chr11 5196432 5196451 5196435 -
ggactgcttttgtggaagac

SEQ ID NO: 52288 - DNA, 20 bp, Artificial Sequence
  Synthetic oligonucleotide; AGG chr11 5196431 5196450 5196434 -
gactgcttttgtggaagaca

SEQ ID NO: 52289 - DNA, 20 bp, Artificial Sequence
  Synthetic oligonucleotide; CAG chr11 5196426 5196445 5196429 -
cttttgtggaagacaaggtg

SEQ ID NO: 52290 - DNA, 20 bp, Artificial Sequence
  Synthetic oligonucleotide; AGG chr11 5196425 5196444 5196428 -
ttttgtggaagacaaggtgc

SEQ ID NO: 52291 - DNA, 20 bp, Artificial Sequence
  Synthetic oligonucleotide; GAG chr11 5196423 5196442 5196426 -
ttgtggaagacaaggtgcag

SEQ ID NO: 52292 - DNA, 20 bp, Artificial Sequence
  Synthetic oligonucleotide; AGG chr11 5196422 5196441 5196425 -
tgtggaagacaaggtgcagg

SEQ ID NO: 52293 - DNA, 20 bp, Artificial Sequence
  Synthetic oligonucleotide; GGG chr11 5196421 5196440 5196424 -
gtggaagacaaggtgcagga

SEQ ID NO: 52294 - DNA, 20 bp, Artificial Sequence
  Synthetic oligonucleotide; TGG chr11 5196416 5196435 5196419 -
agacaaggtgcaggagggca

SEQ ID NO: 52295 - DNA, 20 bp, Artificial Sequence
  Synthetic oligonucleotide; CAG chr11 5196410 5196429 5196413 -
ggtgcaggagggcatggttt

SEQ ID NO: 52296 - DNA, 20 bp, Artificial Sequence
  Synthetic oligonucleotide; AGG chr11 5196409 5196428 5196412 -
gtgcaggagggcatggtttc

SEQ ID NO: 52297 - DNA, 20 bp, Artificial Sequence
  Synthetic oligonucleotide; CAG chr11 5196389 5196408 5196392 -
aggatgaaactgttccacct

SEQ ID NO: 52298 - DNA, 20 bp, Artificial Sequence
  Synthetic oligonucleotide; GAG chr11 5196387 5196406 5196390 -
gatgaaactgttccacctca

SEQ ID NO: 52299 - DNA, 20 bp, Artificial Sequence
  Synthetic oligonucleotide; TAG chr11 5196381 5196400 5196384 -
actgttccacctcagagcat

SEQ ID NO: 52300 - DNA, 20 bp, Artificial Sequence
  Synthetic oligonucleotide; AGG chr11 5196380 5196399 5196383 -
ctgttccacctcagagcatt

SEQ ID NO: 52301 - DNA, 20 bp, Artificial Sequence
  Synthetic oligonucleotide; TAG chr11 5196374 5196393 5196377 -
cacctcagagcattaggcat

SEQ ID NO: 52302 - DNA, 20 bp, Artificial Sequence
  Synthetic oligonucleotide; AAG chr11 5196363 5196382 5196366 -
attaggcattagattctcat

SEQ ID NO: 52303 - DNA, 20 bp, Artificial Sequence
  Synthetic oligonucleotide; AAG chr11 5196360 5196379 5196363 -
aggcattagattctcataag

SEQ ID NO: 52304 - DNA, 20 bp, Artificial Sequence
  Synthetic oligonucleotide; TAG chr11 5196349 5196368 5196352 -
tctcataagaagccgcaacc

SEQ ID NO: 52305 - DNA, 20 bp, Artificial Sequence
  Synthetic oligonucleotide; GAG chr11 5196327 5196346 5196330 -
gatcccttgcatgcctctat

SEQ ID NO: 52306 - DNA, 20 bp, Artificial Sequence
  Synthetic oligonucleotide; CAG chr11 5196297 5196316 5196300 -
tgccgccactgccgatgtga

SEQ ID NO: 52307 - DNA, 20 bp, Artificial Sequence
  Synthetic oligonucleotide; AGG chr11 5196296 5196315 5196299 -
gccgccactgccgatgtgac

SEQ ID NO: 52308 - DNA, 20 bp, Artificial Sequence
  Synthetic oligonucleotide; GAG chr11 5196294 5196313 5196297 -
cgccactgccgatgtgacag

SEQ ID NO: 52309 - DNA, 20 bp, Artificial Sequence
  Synthetic oligonucleotide; AGG chr11 5196293 5196312 5196296 -
gccactgccgatgtgacagg

SEQ ID NO: 52310 - DNA, 20 bp, Artificial Sequence
  Synthetic oligonucleotide; GAG chr11 5196291 5196310 5196294 -
cactgccgatgtgacaggag

SEQ ID NO: 52311 - DNA, 20 bp, Artificial Sequence
  Synthetic oligonucleotide; AGG chr11 5196290 5196309 5196293 -
actgccgatgtgacaggagg

SEQ ID NO: 52312 - DNA, 20 bp, Artificial Sequence
  Synthetic oligonucleotide; GAG chr11 5196288 5196307 5196291 -
tgccgatgtgacaggaggag

SEQ ID NO: 52313 - DNA, 20 bp, Artificial Sequence
  Synthetic oligonucleotide; CAG chr11 5196283 5196302 5196286 -
atgtgacaggaggaggagct

SEQ ID NO: 52314 - DNA, 20 bp, Artificial Sequence
  Synthetic oligonucleotide; AGG chr11 5196282 5196301 5196285 -
tgtgacaggaggaggagctc

SEQ ID NO: 52315 - DNA, 20 bp, Artificial Sequence
  Synthetic oligonucleotide; CAG chr11 5196279 5196298 5196282 -
gacaggaggaggagctcagg

SEQ ID NO: 52316 - DNA, 20 bp, Artificial Sequence
  Synthetic oligonucleotide; GAG chr11 5196251 5196270 5196254 -
cttgctcatccccctgctgt

SEQ ID NO: 52317 - DNA, 20 bp, Artificial Sequence
  Synthetic oligonucleotide; CAG chr11 5196246 5196265 5196249 -
tcatccccctgctgtgagac

SEQ ID NO: 52318 - DNA, 20 bp, Artificial Sequence
  Synthetic oligonucleotide; AGG chr11 5196245 5196264 5196248 -
catccccctgctgtgagacc

SEQ ID NO: 52319 - DNA, 20 bp, Artificial Sequence
  Synthetic oligonucleotide; TAG chr11 5196238 5196257 5196241 -
ctgctgtgagaccaggttcc

SEQ ID NO: 52320 - DNA, 20 bp, Artificial Sequence
  Synthetic oligonucleotide; CAG chr11 5196235 5196254 5196238 -
ctgtgagaccaggttcctag

SEQ ID NO: 52321 - DNA, 20 bp, Artificial Sequence
  Synthetic oligonucleotide; AGG chr11 5196234 5196253 5196237 -
tgtgagaccaggttcctagc

SEQ ID NO: 52322 - DNA, 20 bp, Artificial Sequence
  Synthetic oligonucleotide; CGG chr11 5196228 5196247 5196231 -
accaggttcctagcaggcca

SEQ ID NO: 52323 - DNA, 20 bp, Artificial Sequence
  Synthetic oligonucleotide; CAG chr11 5196223 5196242 5196226 -
gttcctagcaggccacggac

SEQ ID NO: 52324 - DNA, 20 bp, Artificial Sequence
  Synthetic oligonucleotide; TGG chr11 5196217 5196236 5196220 -
agcaggccacggaccagtac

SEQ ID NO: 52325 - DNA, 20 bp, Artificial Sequence
  Synthetic oligonucleotide; AAG chr11 5196213 5196232 5196216 -
ggccacggaccagtactggt

SEQ ID NO: 52326 - DNA, 20 bp, Artificial Sequence
  Synthetic oligonucleotide; TGG chr11 5196210 5196229 5196213 -
cacggaccagtactggtaag

SEQ ID NO: 52327 - DNA, 20 bp, Artificial Sequence
  Synthetic oligonucleotide; CAG chr11 5196206 5196225 5196209 -
gaccagtactggtaagtggc

SEQ ID NO: 52328 - DNA, 20 bp, Artificial Sequence
  Synthetic oligonucleotide; AGG chr11 5196205 5196224 5196208 -
accagtactggtaagtggcc

SEQ ID NO: 52329 - DNA, 20 bp, Artificial Sequence
  Synthetic oligonucleotide; TAG chr11 5196172 5196191 5196175 -
actatacctccctattttcc

SEQ ID NO: 52330 - DNA, 20 bp, Artificial Sequence
  Synthetic oligonucleotide; AGG chr11 5196171 5196190 5196174 -
ctatacctccctattttcct

SEQ ID NO: 52331 - DNA, 20 bp, Artificial Sequence
  Synthetic oligonucleotide; CAG chr11 5196145 5196164 5196148 -
atcaaaatcgtattgttaaa

SEQ ID NO: 52332 - DNA, 20 bp, Artificial Sequence
  Synthetic oligonucleotide; AAG chr11 5196138 5196157 5196141 -
tcgtattgttaaacagactt

SEQ ID NO: 52333 - DNA, 20 bp, Artificial Sequence
  Synthetic oligonucleotide; GAG chr11 5196136 5196155 5196139 -
gtattgttaaacagacttaa

SEQ ID NO: 52334 - DNA, 20 bp, Artificial Sequence
  Synthetic oligonucleotide; GAG chr11 5196122 5196141 5196125 -
acttaagagatgttctactt

SEQ ID NO: 52335 - DNA, 20 bp, Artificial Sequence
  Synthetic oligonucleotide; AGG chr11 5196121 5196140 5196124 -
cttaagagatgttctacttg

SEQ ID NO: 52336 - DNA, 20 bp, Artificial Sequence
  Synthetic oligonucleotide; TAG chr11 5196102 5196121 5196105 -
gaggttgtgtctccattccc

SEQ ID NO: 52337 - DNA, 20 bp, Artificial Sequence
  Synthetic oligonucleotide; AGG chr11 5196101 5196120 5196104 -
aggttgtgtctccattccct

SEQ ID NO: 52338 - DNA, 20 bp, Artificial Sequence
  Synthetic oligonucleotide; CAG chr11 5196078 5196097 5196081 -
atatttgttaccattacttg

SEQ ID NO: 52339 - DNA, 20 bp, Artificial Sequence
  Synthetic oligonucleotide; AAG chr11 5196075 5196094 5196078 -
tttgttaccattacttgcag

SEQ ID NO: 52340 - DNA, 20 bp, Artificial Sequence
  Synthetic oligonucleotide; TAG chr11 5196064 5196083 5196067 -
tacttgcagaagataattgc

SEQ ID NO: 52341 - DNA, 20 bp, Artificial Sequence
  Synthetic oligonucleotide; GAG chr11 5196062 5196081 5196065 -
cttgcagaagataattgcta

SEQ ID NO: 52342 - DNA, 20 bp, Artificial Sequence
  Synthetic oligonucleotide; TAG chr11 5196059 5196078 5196062 -
gcagaagataattgctagag

SEQ ID NO: 52343 - DNA, 20 bp, Artificial Sequence
  Synthetic oligonucleotide; TAG chr11 5196052 5196071 5196055 -
ataattgctagagtagtgaa

SEQ ID NO: 52344 - DNA, 20 bp, Artificial Sequence
  Synthetic oligonucleotide; GAG chr11 5196050 5196069 5196053 -
aattgctagagtagtgaata

SEQ ID NO: 52345 - DNA, 20 bp, Artificial Sequence
  Synthetic oligonucleotide; AGG chr11 5196049 5196068 5196052 -
attgctagagtagtgaatag

SEQ ID NO: 52346 - DNA, 20 bp, Artificial Sequence
  Synthetic oligonucleotide; CAG chr11 5196042 5196061 5196045 -
gagtagtgaatagaggcctc

SEQ ID NO: 52347 - DNA, 20 bp, Artificial Sequence
  Synthetic oligonucleotide; AAG chr11 5196036 5196055 5196039 -
tgaatagaggcctccagatg

SEQ ID NO: 52348 - DNA, 20 bp, Artificial Sequence
  Synthetic oligonucleotide; AGG chr11 5196035 5196054 5196038 -
gaatagaggcctccagatga

SEQ ID NO: 52349 - DNA, 20 bp, Artificial Sequence
  Synthetic oligonucleotide; TAG chr11 5196023 5196042 5196026 -
ccagatgaaggaaataaaaa

SEQ ID NO: 52350 - DNA, 20 bp, Artificial Sequence
  Synthetic oligonucleotide; CAG chr11 5196010 5196029 5196013 -
ataaaaatagtccattttcc

SEQ ID NO: 52351 - DNA, 20 bp, Artificial Sequence
  Synthetic oligonucleotide; AAG chr11 5196007 5196026 5196010 -
aaaatagtccattttcccag

SEQ ID NO: 52352 - DNA, 20 bp, Artificial Sequence
  Synthetic oligonucleotide; CAG chr11 5195997 5196016 5196000 -
attttcccagaagtctcttg

SEQ ID NO: 52353 - DNA, 20 bp, Artificial Sequence
  Synthetic oligonucleotide; TAG chr11 5195971 5195990 5195974 -
cttaaaaattaatgccaacc

SEQ ID NO: 52354 - DNA, 20 bp, Artificial Sequence
  Synthetic oligonucleotide; AAG chr11 5195966 5195985 5195969 -
aaattaatgccaacctagcc

SEQ ID NO: 52355 - DNA, 20 bp, Artificial Sequence
  Synthetic oligonucleotide; CAG chr11 5195953 5195972 5195956 -
cctagccaagaacacccctg

SEQ ID NO: 52356 - DNA, 20 bp, Artificial Sequence
  Synthetic oligonucleotide; TAG chr11 5195950 5195969 5195953 -
agccaagaacacccctgcag

SEQ ID NO: 52357 - DNA, 20 bp, Artificial Sequence
  Synthetic oligonucleotide; AGG chr11 5195949 5195968 5195952 -
gccaagaacacccctgcagt

SEQ ID NO: 52358 - DNA, 20 bp, Artificial Sequence
  Synthetic oligonucleotide; GAG chr11 5195947 5195966 5195950 -
caagaacacccctgcagtag

SEQ ID NO: 52359 - DNA, 20 bp, Artificial Sequence
  Synthetic oligonucleotide; AAG chr11 5195933 5195952 5195936 -
cagtaggagtcgatgtccta

SEQ ID NO: 52360 - DNA, 20 bp, Artificial Sequence
  Synthetic oligonucleotide; CAG chr11 5195924 5195943 5195927 -
tcgatgtcctaaagcttttc

SEQ ID NO: 52361 - DNA, 20 bp, Artificial Sequence
  Synthetic oligonucleotide; AAG chr11 5195918 5195937 5195921 -
tcctaaagcttttccagtaa

SEQ ID NO: 52362 - DNA, 20 bp, Artificial Sequence
  Synthetic oligonucleotide; TGG chr11 5195913 5195932 5195916 -
aagcttttccagtaaaagtg

SEQ ID NO: 52363 - DNA, 20 bp, Artificial Sequence
  Synthetic oligonucleotide; CAG chr11 5195898 5195917 5195901 -
aagtgtggtttctgcccctg

SEQ ID NO: 52364 - DNA, 20 bp, Artificial Sequence
  Synthetic oligonucleotide; TGG chr11 5195892 5195911 5195895 -
ggtttctgcccctgcagtct

SEQ ID NO: 52365 - DNA, 20 bp, Artificial Sequence
  Synthetic oligonucleotide; TGG chr11 5195879 5195898 5195882 -
gcagtcttggcaccatgtaa

SEQ ID NO: 52366 - DNA, 20 bp, Artificial Sequence
  Synthetic oligonucleotide; TAG chr11 5195872 5195891 5195875 -
tggcaccatgtaatggcaca

SEQ ID NO: 52367 - DNA, 20 bp, Artificial Sequence
  Synthetic oligonucleotide; CAG chr11 5195863 5195882 5195866 -
gtaatggcacatagaaaatg

SEQ ID NO: 52368 - DNA, 20 bp, Artificial Sequence
  Synthetic oligonucleotide; AGG chr11 5195862 5195881 5195865 -
taatggcacatagaaaatgc

SEQ ID NO: 52369 - DNA, 20 bp, Artificial Sequence
  Synthetic oligonucleotide; CAG chr11 5195855 5195874 5195858 -
acatagaaaatgcaggcttt

SEQ ID NO: 52370 - DNA, 20 bp, Artificial Sequence
  Synthetic oligonucleotide; AGG chr11 5195854 5195873 5195857 -
catagaaaatgcaggctttc

SEQ ID NO: 52371 - DNA, 20 bp, Artificial Sequence
  Synthetic oligonucleotide; CAG chr11 5195848 5195867 5195851 -
aaatgcaggctttcaggttg

SEQ ID NO: 52372 - DNA, 20 bp, Artificial Sequence
  Synthetic oligonucleotide; CAG chr11 5195844 5195863 5195847 -
gcaggctttcaggttgcagc

SEQ ID NO: 52373 - DNA, 20 bp, Artificial Sequence
  Synthetic oligonucleotide; GAG chr11 5195837 5195856 5195840 -
ttcaggttgcagccagaact

SEQ ID NO: 52374 - DNA, 20 bp, Artificial Sequence
  Synthetic oligonucleotide; AGG chr11 5195836 5195855 5195839 -
tcaggttgcagccagaactg

SEQ ID NO: 52375 - DNA, 20 bp, Artificial Sequence
  Synthetic oligonucleotide; CGG chr11 5195826 5195845 5195829 -
gccagaactgaggaatcaat

SEQ ID NO: 52376 - DNA, 20 bp, Artificial Sequence
  Synthetic oligonucleotide; TAG chr11 5195819 5195838 5195822 -
ctgaggaatcaatcggtgtt

SEQ ID NO: 52377 - DNA, 20 bp, Artificial Sequence
  Synthetic oligonucleotide; GAG chr11 5195811 5195830 5195814 -
tcaatcggtgtttagctttt

SEQ ID NO: 52378 - DNA, 20 bp, Artificial Sequence
  Synthetic oligonucleotide; TGG chr11 5195804 5195823 5195807 -
gtgtttagcttttgagatgc

SEQ ID NO: 52379 - DNA, 20 bp, Artificial Sequence
  Synthetic oligonucleotide; TGG chr11 5195786 5195805 5195789 -
gctggtaatgttctctttct

SEQ ID NO: 52380 - DNA, 20 bp, Artificial Sequence
  Synthetic oligonucleotide; GAG chr11 5195780 5195799 5195783 -
aatgttctctttcttggtct

SEQ ID NO: 52381 - DNA, 20 bp, Artificial Sequence
  Synthetic oligonucleotide; AAG chr11 5195767 5195786 5195770 -
ttggtctgagtgtttgttaa

SEQ ID NO: 52382 - DNA, 20 bp, Artificial Sequence
  Synthetic oligonucleotide; AAG chr11 5195683 5195702 5195686 -
gaataataaaatataaattt

SEQ ID NO: 52383 - DNA, 20 bp, Artificial Sequence
  Synthetic oligonucleotide; GAG chr11 5195674 5195693 5195677 -
aatataaatttaagaaatat

SEQ ID NO: 52384 - DNA, 20 bp, Artificial Sequence
  Synthetic oligonucleotide; AAG chr11 5195668 5195687 5195671 -
aatttaagaaatatgagtga

SEQ ID NO: 52385 - DNA, 20 bp, Artificial Sequence
  Synthetic oligonucleotide; TGG chr11 5195645 5195664 5195648 -
tgtcaatttacatataaacc

SEQ ID NO: 52386 - DNA, 20 bp, Artificial Sequence
  Synthetic oligonucleotide; CAG chr11 5195642 5195661 5195645 -
caatttacatataaacctgg

SEQ ID NO: 52387 - DNA, 20 bp, Artificial Sequence
  Synthetic oligonucleotide; AAG chr11 5195597 5195616 5195600 -
ctactttctctaatccacta

SEQ ID NO: 52388 - DNA, 20 bp, Artificial Sequence
  Synthetic oligonucleotide; TAG chr11 5195591 5195610 5195594 -
tctctaatccactaaagcta

SEQ ID NO: 52389 - DNA, 20 bp, Artificial Sequence
  Synthetic oligonucleotide; CAG chr11 5195581 5195600 5195584 -
actaaagctatagatgtaca

SEQ ID NO: 52390 - DNA, 20 bp, Artificial Sequence
  Synthetic oligonucleotide; GAG chr11 5195579 5195598 5195582 -
taaagctatagatgtacaca

SEQ ID NO: 52391 - DNA, 20 bp, Artificial Sequence
  Synthetic oligonucleotide; AAG chr11 5195568 5195587 5195571 -
atgtacacagagacactgtg

SEQ ID NO: 52392 - DNA, 20 bp, Artificial Sequence
  Synthetic oligonucleotide; TAG chr11 5195561 5195580 5195564 -
cagagacactgtgaagaaaa

SEQ ID NO: 52393 - DNA, 20 bp, Artificial Sequence
  Synthetic oligonucleotide; AAG chr11 5195534 5195553 5195537 -
atatgtatgaacaaattgat

SEQ ID NO: 52394 - DNA, 20 bp, Artificial Sequence
  Synthetic oligonucleotide; CAG chr11 5195500 5195519 5195503 -
aaatatgattttttaaaaaa

SEQ ID NO: 52395 - DNA, 20 bp, Artificial Sequence
  Synthetic oligonucleotide; CAG chr11 5195495 5195514 5195498 -
tgattttttaaaaaacagaa

SEQ ID NO: 52396 - DNA, 20 bp, Artificial Sequence
  Synthetic oligonucleotide; AGG chr11 5195494 5195513 5195497 -
gattttttaaaaaacagaac

SEQ ID NO: 52397 - DNA, 20 bp, Artificial Sequence
  Synthetic oligonucleotide; CAG chr11 5195468 5195487 5195471 -
atctgaaatctatatgtcta

SEQ ID NO: 52398 - DNA, 20 bp, Artificial Sequence
  Synthetic oligonucleotide; AAG chr11 5195463 5195482 5195466 -
aaatctatatgtctacagaa

SEQ ID NO: 52399 - DNA, 20 bp, Artificial Sequence
  Synthetic oligonucleotide; AGG chr11 5195462 5195481 5195465 -
aatctatatgtctacagaaa

SEQ ID NO: 52400 - DNA, 20 bp, Artificial Sequence
  Synthetic oligonucleotide; GAG chr11 5195451 5195470 5195454 -
ctacagaaaaggataccaat

SEQ ID NO: 52401 - DNA, 20 bp, Artificial Sequence
  Synthetic oligonucleotide; AAG chr11 5195431 5195450 5195434 -
gagaaaaaacgttatctgca

SEQ ID NO: 52402 - DNA, 20 bp, Artificial Sequence
  Synthetic oligonucleotide; GAG chr11 5195429 5195448 5195432 -
gaaaaaacgttatctgcaaa

SEQ ID NO: 52403 - DNA, 20 bp, Artificial Sequence
  Synthetic oligonucleotide; TGG chr11 5195419 5195438 5195422 -
tatctgcaaagagcattttc

SEQ ID NO: 52404 - DNA, 20 bp, Artificial Sequence
  Synthetic oligonucleotide; CAG chr11 5195409 5195428 5195412 -
gagcattttctggaaaaaca

SEQ ID NO: 52405 - DNA, 20 bp, Artificial Sequence
  Synthetic oligonucleotide; AAG chr11 5195394 5195413 5195397 -
aaacacagaaattacttata

SEQ ID NO: 52406 - DNA, 20 bp, Artificial Sequence
  Synthetic oligonucleotide; GAG chr11 5195384 5195403 5195387 -
attacttataaagcattcgt

SEQ ID NO: 52407 - DNA, 20 bp, Artificial Sequence
  Synthetic oligonucleotide; AGG chr11 5195383 5195402 5195386 -
ttacttataaagcattcgtg

SEQ ID NO: 52408 - DNA, 20 bp, Artificial Sequence
  Synthetic oligonucleotide; GGG chr11 5195382 5195401 5195385 -
tacttataaagcattcgtga

SEQ ID NO: 52409 - DNA, 20 bp, Artificial Sequence
  Synthetic oligonucleotide; GGG chr11 5195381 5195400 5195384 -
acttataaagcattcgtgag

SEQ ID NO: 52410 - DNA, 20 bp, Artificial Sequence
  Synthetic oligonucleotide; TAG chr11 5195378 5195397 5195381 -
tataaagcattcgtgagggg

SEQ ID NO: 52411 - DNA, 20 bp, Artificial Sequence
  Synthetic oligonucleotide; AGG chr11 5195377 5195396 5195380 -
ataaagcattcgtgaggggt

SEQ ID NO: 52412 - DNA, 20 bp, Artificial Sequence
  Synthetic oligonucleotide; GGG chr11 5195376 5195395 5195379 -
taaagcattcgtgaggggta

SEQ ID NO: 52413 - DNA, 20 bp, Artificial Sequence
  Synthetic oligonucleotide; TGG chr11 5195366 5195385 5195369 -
gtgaggggtagggctaaaaa

SEQ ID NO: 52414 - DNA, 20 bp, Artificial Sequence
  Synthetic oligonucleotide; TAG chr11 5195363 5195382 5195366 -
aggggtagggctaaaaatgg

SEQ ID NO: 52415 - DNA, 20 bp, Artificial Sequence
  Synthetic oligonucleotide; AAG chr11 5195358 5195377 5195361 -
tagggctaaaaatggtagaa

SEQ ID NO: 52416 - DNA, 20 bp, Artificial Sequence
  Synthetic oligonucleotide; AGG chr11 5195357 5195376 5195360 -
agggctaaaaatggtagaaa

SEQ ID NO: 52417 - DNA, 20 bp, Artificial Sequence
  Synthetic oligonucleotide; AAG chr11 5195341 5195360 5195344 -
gaaaaggtgaatacctgttt

SEQ ID NO: 52418 - DNA, 20 bp, Artificial Sequence
  Synthetic oligonucleotide; AGG chr11 5195340 5195359 5195343 -
aaaaggtgaatacctgttta

SEQ ID NO: 52419 - DNA, 20 bp, Artificial Sequence
  Synthetic oligonucleotide; AAG chr11 5195329 5195348 5195332 -
acctgtttaaggttgcctaa

SEQ ID NO: 52420 - DNA, 20 bp, Artificial Sequence
  Synthetic oligonucleotide; TAG chr11 5195325 5195344 5195328 -
gtttaaggttgcctaaaaga

SEQ ID NO: 52421 - DNA, 20 bp, Artificial Sequence
  Synthetic oligonucleotide; CAG chr11 5195321 5195340 5195324 -
aaggttgcctaaaagatagc

SEQ ID NO: 52422 - DNA, 20 bp, Artificial Sequence
  Synthetic oligonucleotide; AGG chr11 5195320 5195339 5195323 -
aggttgcctaaaagatagcc

SEQ ID NO: 52423 - DNA, 20 bp, Artificial Sequence
  Synthetic oligonucleotide; TAG chr11 5195303 5195322 5195306 -
gccaggtactcatttctctt

SEQ ID NO: 52424 - DNA, 20 bp, Artificial Sequence
  Synthetic oligonucleotide; TGG chr11 5195297 5195316 5195300 -
tactcatttctctttagttc

SEQ ID NO: 52425 - DNA, 20 bp, Artificial Sequence
  Synthetic oligonucleotide; TAG chr11 5195285 5195304 5195288 -
tttagttctggcaaaatgat

SEQ ID NO: 52426 - DNA, 20 bp, Artificial Sequence
  Synthetic oligonucleotide; TAG chr11 5195276 5195295 5195279 -
ggcaaaatgattagtgtctg

SEQ ID NO: 52427 - DNA, 20 bp, Artificial Sequence
  Synthetic oligonucleotide; CAG chr11 5195253 5195272 5195256 -
taaccaaatcaatgatgatc

SEQ ID NO: 52428 - DNA, 20 bp, Artificial Sequence
  Synthetic oligonucleotide; TGG chr11 5195246 5195265 5195249 -
atcaatgatgatccagacac

SEQ ID NO: 52429 - DNA, 20 bp, Artificial Sequence
  Synthetic oligonucleotide; GGG chr11 5195245 5195264 5195248 -
tcaatgatgatccagacact

SEQ ID NO: 52430 - DNA, 20 bp, Artificial Sequence
  Synthetic oligonucleotide; CAG chr11 5195237 5195256 5195240 -
gatccagacactgggaaatt

SEQ ID NO: 52431 - DNA, 20 bp, Artificial Sequence
  Synthetic oligonucleotide; AAG chr11 5195230 5195249 5195233 -
acactgggaaattcagtgca

SEQ ID NO: 52432 - DNA, 20 bp, Artificial Sequence
  Synthetic oligonucleotide; AGG chr11 5195229 5195248 5195232 -
cactgggaaattcagtgcaa

SEQ ID NO: 52433 - DNA, 20 bp, Artificial Sequence
  Synthetic oligonucleotide; CAG chr11 5195222 5195241 5195225 -
aaattcagtgcaaaggatgc

SEQ ID NO: 52434 - DNA, 20 bp, Artificial Sequence
  Synthetic oligonucleotide; AGG chr11 5195221 5195240 5195224 -
aattcagtgcaaaggatgcc

SEQ ID NO: 52435 - DNA, 20 bp, Artificial Sequence
  Synthetic oligonucleotide; AAG chr11 5195215 5195234 5195218 -
gtgcaaaggatgccaggact

SEQ ID NO: 52436 - DNA, 20 bp, Artificial Sequence
  Synthetic oligonucleotide; AGG chr11 5195214 5195233 5195217 -
tgcaaaggatgccaggacta

SEQ ID NO: 52437 - DNA, 20 bp, Artificial Sequence
  Synthetic oligonucleotide; CAG chr11 5195197 5195216 5195200 -
ctaaggtgtaatatatgaaa

SEQ ID NO: 52438 - DNA, 20 bp, Artificial Sequence
  Synthetic oligonucleotide; GAG chr11 5195195 5195214 5195198 -
aaggtgtaatatatgaaaca

SEQ ID NO: 52439 - DNA, 20 bp, Artificial Sequence
  Synthetic oligonucleotide; GAG chr11 5195193 5195212 5195196 -
ggtgtaatatatgaaacaga

SEQ ID NO: 52440 - DNA, 20 bp, Artificial Sequence
  Synthetic oligonucleotide; AAG chr11 5195181 5195200 5195184 -
gaaacagagagattatgcaa

SEQ ID NO: 52441 - DNA, 20 bp, Artificial Sequence
  Synthetic oligonucleotide; AAG chr11 5195148 5195167 5195151 -
gaatgatgataaactgtctc

SEQ ID NO: 52442 - DNA, 20 bp, Artificial Sequence
  Synthetic oligonucleotide; GAG chr11 5195146 5195165 5195149 -
atgatgataaactgtctcaa

SEQ ID NO: 52443 - DNA, 20 bp, Artificial Sequence
  Synthetic oligonucleotide; AAG chr11 5195142 5195161 5195145 -
tgataaactgtctcaagaga

SEQ ID NO: 52444 - DNA, 20 bp, Artificial Sequence
  Synthetic oligonucleotide; AGG chr11 5195141 5195160 5195144 -
gataaactgtctcaagagaa

SEQ ID NO: 52445 - DNA, 20 bp, Artificial Sequence
  Synthetic oligonucleotide; TAG chr11 5195133 5195152 5195136 -
gtctcaagagaaaggactaa

SEQ ID NO: 52446 - DNA, 20 bp, Artificial Sequence
  Synthetic oligonucleotide; TGG chr11 5195126 5195145 5195129 -
gagaaaggactaatagatat

SEQ ID NO: 52447 - DNA, 20 bp, Artificial Sequence
  Synthetic oligonucleotide; GAG chr11 5195118 5195137 5195121 -
actaatagatattggcattt

SEQ ID NO: 52448 - DNA, 20 bp, Artificial Sequence
  Synthetic oligonucleotide; TGG chr11 5195104 5195123 5195107 -
gcatttgagtattcgcttac

SEQ ID NO: 52449 - DNA, 20 bp, Artificial Sequence
  Synthetic oligonucleotide; TAG chr11 5195099 5195118 5195102 -
tgagtattcgcttactggat

SEQ ID NO: 52450 - DNA, 20 bp, Artificial Sequence
  Synthetic oligonucleotide; TAG chr11 5195095 5195114 5195098 -
tattcgcttactggattagc

SEQ ID NO: 52451 - DNA, 20 bp, Artificial Sequence
  Synthetic oligonucleotide; AGG chr11 5195094 5195113 5195097 -
attcgcttactggattagct

SEQ ID NO: 52452 - DNA, 20 bp, Artificial Sequence
  Synthetic oligonucleotide; CAG chr11 5195079 5195098 5195082 -
tagctaggcttctttctgat

SEQ ID NO: 52453 - DNA, 20 bp, Artificial Sequence
  Synthetic oligonucleotide; AAG chr11 5195070 5195089 5195073 -
ttctttctgatcagccttca

SEQ ID NO: 52454 - DNA, 20 bp, Artificial Sequence
  Synthetic oligonucleotide; TGG chr11 5195063 5195082 5195066 -
tgatcagccttcaaagtaac

SEQ ID NO: 52455 - DNA, 20 bp, Artificial Sequence
  Synthetic oligonucleotide; CAG chr11 5195059 5195078 5195062 -
cagccttcaaagtaactggc

SEQ ID NO: 52456 - DNA, 20 bp, Artificial Sequence
  Synthetic oligonucleotide; TAG chr11 5195034 5195053 5195037 -
aactaattgtaccgtgttca

SEQ ID NO: 52457 - DNA, 20 bp, Artificial Sequence
  Synthetic oligonucleotide; AAG chr11 5194977 5194996 5194980 -
ttttattattattatacttt

SEQ ID NO: 52458 - DNA, 20 bp, Artificial Sequence
  Synthetic oligonucleotide; TAG chr11 5194971 5194990 5194974 -
tattattatactttaagttt

SEQ ID NO: 52459 - DNA, 20 bp, Artificial Sequence
  Synthetic oligonucleotide; AGG chr11 5194970 5194989 5194973 -
attattatactttaagtttt

SEQ ID NO: 52460 - DNA, 20 bp, Artificial Sequence
  Synthetic oligonucleotide; GGG chr11 5194969 5194988 5194972 -
ttattatactttaagtttta

SEQ ID NO: 52461 - DNA, 20 bp, Artificial Sequence
  Synthetic oligonucleotide; CAG chr11 5194949 5194968 5194952 -
gggtacatgtgcacaatgtg

SEQ ID NO: 52462 - DNA, 20 bp, Artificial Sequence
  Synthetic oligonucleotide; AGG chr11 5194948 5194967 5194951 -
ggtacatgtgcacaatgtgc

SEQ ID NO: 52463 - DNA, 20 bp, Artificial Sequence
  Synthetic oligonucleotide; TAG chr11 5194944 5194963 5194947 -
catgtgcacaatgtgcaggt

SEQ ID NO: 52464 - DNA, 20 bp, Artificial Sequence
  Synthetic oligonucleotide; TGG chr11 5194916 5194935 5194919 -
tatgtatacatgtgccatgc

SEQ ID NO: 52465 - DNA, 20 bp, Artificial Sequence
  Synthetic oligonucleotide; TAG chr11 5194887 5194906 5194890 -
tcacccattaactcatcatt

SEQ ID NO: 52466 - DNA, 20 bp, Artificial Sequence
  Synthetic oligonucleotide; TAG chr11 5194881 5194900 5194884 -
attaactcatcatttagcat

SEQ ID NO: 52467 - DNA, 20 bp, Artificial Sequence
  Synthetic oligonucleotide; AGG chr11 5194880 5194899 5194883 -
ttaactcatcatttagcatt

SEQ ID NO: 52468 - DNA, 20 bp, Artificial Sequence
  Synthetic oligonucleotide; CAG chr11 5194833 5194852 5194836 -
tccctccccccaccccacaa

SEQ ID NO: 52469 - DNA, 20 bp, Artificial Sequence
  Synthetic oligonucleotide; CAG chr11 5194826 5194845 5194829 -
ccccaccccacaacagtccc

SEQ ID NO: 52470 - DNA, 20 bp, Artificial Sequence
  Synthetic oligonucleotide; GAG chr11 5194824 5194843 5194827 -
ccaccccacaacagtcccca

SEQ ID NO: 52471 - DNA, 20 bp, Artificial Sequence
  Synthetic oligonucleotide; GAG chr11 5194767 5194786 5194770 -
attgttcaattcccacctat

SEQ ID NO: 52472 - DNA, 20 bp, Artificial Sequence
  Synthetic oligonucleotide; GAG chr11 5194763 5194782 5194766 -
ttcaattcccacctatgagt

SEQ ID NO: 52473 - DNA, 20 bp, Artificial Sequence
  Synthetic oligonucleotide; CAG chr11 5194754 5194773 5194757 -
cacctatgagtgagaacatg

SEQ ID NO: 52474 - DNA, 20 bp, Artificial Sequence
  Synthetic oligonucleotide; TGG chr11 5194747 5194766 5194750 -
gagtgagaacatgcagtgtt

SEQ ID NO: 52475 - DNA, 20 bp, Artificial Sequence
  Synthetic oligonucleotide; TAG chr11 5194728 5194747 5194731 -
ttggtttttcgtccttgcga

SEQ ID NO: 52476 - DNA, 20 bp, Artificial Sequence
  Synthetic oligonucleotide; GAG chr11 5194719 5194738 5194722 -
cgtccttgcgatagtttact

SEQ ID NO: 52477 - DNA, 20 bp, Artificial Sequence
  Synthetic oligonucleotide; AAG chr11 5194682 5194701 5194685 -
atttcatccatgtccctaca

SEQ ID NO: 52478 - DNA, 20 bp, Artificial Sequence
  Synthetic oligonucleotide; AGG chr11 5194681 5194700 5194684 -
tttcatccatgtccctacaa

SEQ ID NO: 52479 - DNA, 20 bp, Artificial Sequence
  Synthetic oligonucleotide; TGG chr11 5194657 5194676 5194660 -
catgaactcatcctttttta

SEQ ID NO: 52480 - DNA, 20 bp, Artificial Sequence
  Synthetic oligonucleotide; TAG chr11 5194649 5194668 5194652 -
catccttttttatggctgca

SEQ ID NO: 52481 - DNA, 20 bp, Artificial Sequence
  Synthetic oligonucleotide; TGG chr11 5194639 5194658 5194642 -
tatggctgcatagtattcca

SEQ ID NO: 52482 - DNA, 20 bp, Artificial Sequence
  Synthetic oligonucleotide; CAG chr11 5194610 5194629 5194613 -
tgtgccacattttcttaatc

SEQ ID NO: 52483 - DNA, 20 bp, Artificial Sequence
  Synthetic oligonucleotide; TGG chr11 5194596 5194615 5194599 -
ttaatccagtctatcattgt

SEQ ID NO: 52484 - DNA, 20 bp, Artificial Sequence
  Synthetic oligonucleotide; TGG chr11 5194588 5194607 5194591 -
gtctatcattgttggacatt

SEQ ID NO: 52485 - DNA, 20 bp, Artificial Sequence
  Synthetic oligonucleotide; GGG chr11 5194587 5194606 5194590 -
tctatcattgttggacattt

SEQ ID NO: 52486 - DNA, 20 bp, Artificial Sequence
  Synthetic oligonucleotide; TGG chr11 5194583 5194602 5194586 -
tcattgttggacatttgggt

SEQ ID NO: 52487 - DNA, 20 bp, Artificial Sequence
  Synthetic oligonucleotide; AAG chr11 5194576 5194595 5194579 -
tggacatttgggttggttcc

SEQ ID NO: 52488 - DNA, 20 bp, Artificial Sequence
  Synthetic oligonucleotide; TAG chr11 5194557 5194576 5194560 -
caagtctttgctattgtgaa

SEQ ID NO: 52489 - DNA, 20 bp, Artificial Sequence
  Synthetic oligonucleotide; TAG chr11 5194525 5194544 5194528 -
aaattgcatttacaaacctt

SEQ ID NO: 52490 - DNA, 20 bp, Artificial Sequence
  Synthetic oligonucleotide; TAG chr11 5194521 5194540 5194524 -
tgcatttacaaacctttagc

SEQ ID NO: 52491 - DNA, 20 bp, Artificial Sequence
  Synthetic oligonucleotide; AAG chr11 5194512 5194531 5194515 -
aaacctttagctagacatga

SEQ ID NO: 52492 - DNA, 20 bp, Artificial Sequence
  Synthetic oligonucleotide; CAG chr11 5194504 5194523 5194507 -
agctagacatgaaagttctc

SEQ ID NO: 52493 - DNA, 20 bp, Artificial Sequence
  Synthetic oligonucleotide; TGG chr11 5194489 5194508 5194492 -
ttctccagttccatatttca

SEQ ID NO: 52494 - DNA, 20 bp, Artificial Sequence
  Synthetic oligonucleotide; GAG chr11 5194485 5194504 5194488 -
ccagttccatatttcatggt

SEQ ID NO: 52495 - DNA, 20 bp, Artificial Sequence
  Synthetic oligonucleotide; AGG chr11 5194484 5194503 5194487 -
cagttccatatttcatggtg

SEQ ID NO: 52496 - DNA, 20 bp, Artificial Sequence
  Synthetic oligonucleotide; AAG chr11 5194477 5194496 5194480 -
atatttcatggtgaggaaca

SEQ ID NO: 52497 - DNA, 20 bp, Artificial Sequence
  Synthetic oligonucleotide; TGG chr11 5194470 5194489 5194473 -
atggtgaggaacaaagaata

SEQ ID NO: 52498 - DNA, 20 bp, Artificial Sequence
  Synthetic oligonucleotide; TGG chr11 5194467 5194486 5194470 -
gtgaggaacaaagaatatgg

SEQ ID NO: 52499 - DNA, 20 bp, Artificial Sequence
  Synthetic oligonucleotide; GGG chr11 5194466 5194485 5194469 -
tgaggaacaaagaatatggt

SEQ ID NO: 52500 - DNA, 20 bp, Artificial Sequence
  Synthetic oligonucleotide; GGG chr11 5194465 5194484 5194468 -
gaggaacaaagaatatggtg

SEQ ID NO: 52501 - DNA, 20 bp, Artificial Sequence
  Synthetic oligonucleotide; TGG chr11 5194426 5194445 5194429 -
ttgttcctcaccatgaaata

SEQ ID NO: 52502 - DNA, 20 bp, Artificial Sequence
  Synthetic oligonucleotide; TGG chr11 5194420 5194439 5194423 -
ctcaccatgaaatatggaac

SEQ ID NO: 52503 - DNA, 20 bp, Artificial Sequence
  Synthetic oligonucleotide; GAG chr11 5194418 5194437 5194421 -
caccatgaaatatggaactg

SEQ ID NO: 52504 - DNA, 20 bp, Artificial Sequence
  Synthetic oligonucleotide; TAG chr11 5194403 5194422 5194406 -
aactggagaactttcatgtc

SEQ ID NO: 52505 - DNA, 20 bp, Artificial Sequence
  Synthetic oligonucleotide; AAG chr11 5194397 5194416 5194400 -
agaactttcatgtctagcta

SEQ ID NO: 52506 - DNA, 20 bp, Artificial Sequence
  Synthetic oligonucleotide; AGG chr11 5194396 5194415 5194399 -
gaactttcatgtctagctaa

SEQ ID NO: 52507 - DNA, 20 bp, Artificial Sequence
  Synthetic oligonucleotide; CAG chr11 5194376 5194395 5194379 -
aggtttgtaaatgcaccaat

SEQ ID NO: 52508 - DNA, 20 bp, Artificial Sequence
  Synthetic oligonucleotide; AAG chr11 5194356 5194375 5194359 -
cagcaatctgtgtctaactc

SEQ ID NO: 52509 - DNA, 20 bp, Artificial Sequence
  Synthetic oligonucleotide; AGG chr11 5194355 5194374 5194358 -
agcaatctgtgtctaactca

SEQ ID NO: 52510 - DNA, 20 bp, Artificial Sequence
  Synthetic oligonucleotide; CAG chr11 5194335 5194354 5194338 -
aggtttgtaaatgcaccaat

SEQ ID NO: 52511 - DNA, 20 bp, Artificial Sequence
  Synthetic oligonucleotide; TAG chr11 5194321 5194340 5194324 -
accaatcagtgctctgtgtc

SEQ ID NO: 52512 - DNA, 20 bp, Artificial Sequence
  Synthetic oligonucleotide; TAG chr11 5194312 5194331 5194315 -
tgctctgtgtctagctaatc

SEQ ID NO: 52513 - DNA, 20 bp, Artificial Sequence
  Synthetic oligonucleotide; TGG chr11 5194309 5194328 5194312 -
tctgtgtctagctaatctag

SEQ ID NO: 52514 - DNA, 20 bp, Artificial Sequence
  Synthetic oligonucleotide; GGG chr11 5194308 5194327 5194311 -
ctgtgtctagctaatctagt

SEQ ID NO: 52515 - DNA, 20 bp, Artificial Sequence
  Synthetic oligonucleotide; GGG chr11 5194307 5194326 5194310 -
tgtgtctagctaatctagtg

SEQ ID NO: 52516 - DNA, 20 bp, Artificial Sequence
  Synthetic oligonucleotide; TGG chr11 5194301 5194320 5194304 -
tagctaatctagtggggact

SEQ ID NO: 52517 - DNA, 20 bp, Artificial Sequence
  Synthetic oligonucleotide; GAG chr11 5194299 5194318 5194302 -
gctaatctagtggggacttg

SEQ ID NO: 52518 - DNA, 20 bp, Artificial Sequence
  Synthetic oligonucleotide; TAG chr11 5194284 5194303 5194287 -
acttggagaacttttgtgtc

SEQ ID NO: 52519 - DNA, 20 bp, Artificial Sequence
  Synthetic oligonucleotide; AAG chr11 5194278 5194297 5194281 -
agaacttttgtgtctagcta

SEQ ID NO: 52520 - DNA, 20 bp, Artificial Sequence
  Synthetic oligonucleotide; AGG chr11 5194277 5194296 5194280 -
gaacttttgtgtctagctaa

SEQ ID NO: 52521 - DNA, 20 bp, Artificial Sequence
  Synthetic oligonucleotide; CAG chr11 5194257 5194276 5194260 -
aggattgtaaatgcactaat

SEQ ID NO: 52522 - DNA, 20 bp, Artificial Sequence
  Synthetic oligonucleotide; TAG chr11 5194243 5194262 5194246 -
actaatcagcactctgtgtc

SEQ ID NO: 52523 - DNA, 20 bp, Artificial Sequence
  Synthetic oligonucleotide; AAG chr11 5194237 5194256 5194240 -
cagcactctgtgtctagctc

SEQ ID NO: 52524 - DNA, 20 bp, Artificial Sequence
  Synthetic oligonucleotide; AGG chr11 5194236 5194255 5194239 -
agcactctgtgtctagctca

SEQ ID NO: 52525 - DNA, 20 bp, Artificial Sequence
  Synthetic oligonucleotide; CAG chr11 5194216 5194235 5194219 -
aggtttgtaaatgcaccaat

SEQ ID NO: 52526 - DNA, 20 bp, Artificial Sequence
  Synthetic oligonucleotide; CGG chr11 5194200 5194219 5194203 -
caatcagcactctgccaaaa

SEQ ID NO: 52527 - DNA, 20 bp, Artificial Sequence
  Synthetic oligonucleotide; CAG chr11 5194191 5194210 5194194 -
ctctgccaaaacggaccaac

SEQ ID NO: 52528 - DNA, 20 bp, Artificial Sequence
  Synthetic oligonucleotide; TGG chr11 5194176 5194195 5194179 -
ccaaccagctctctgtaaaa

SEQ ID NO: 52529 - DNA, 20 bp, Artificial Sequence
  Synthetic oligonucleotide; GGG chr11 5194175 5194194 5194178 -
caaccagctctctgtaaaat

SEQ ID NO: 52530 - DNA, 20 bp, Artificial Sequence
  Synthetic oligonucleotide; CAG chr11 5194167 5194186 5194170 -
tctctgtaaaatgggccaat

SEQ ID NO: 52531 - DNA, 20 bp, Artificial Sequence
  Synthetic oligonucleotide; TGG chr11 5194152 5194171 5194155 -
ccaatcagctctctgtaaaa

SEQ ID NO: 52532 - DNA, 20 bp, Artificial Sequence
  Synthetic oligonucleotide; CAG chr11 5194143 5194162 5194146 -
tctctgtaaaatggaccaat

SEQ ID NO: 52533 - DNA, 20 bp, Artificial Sequence
  Synthetic oligonucleotide; CAG chr11 5194140 5194159 5194143 -
ctgtaaaatggaccaatcag

SEQ ID NO: 52534 - DNA, 20 bp, Artificial Sequence
  Synthetic oligonucleotide; AGG chr11 5194139 5194158 5194142 -
tgtaaaatggaccaatcagc

SEQ ID NO: 52535 - DNA, 20 bp, Artificial Sequence
  Synthetic oligonucleotide; TGG chr11 5194133 5194152 5194136 -
atggaccaatcagcaggatg

SEQ ID NO: 52536 - DNA, 20 bp, Artificial Sequence
  Synthetic oligonucleotide; GGG chr11 5194132 5194151 5194135 -
tggaccaatcagcaggatgt

SEQ ID NO: 52537 - DNA, 20 bp, Artificial Sequence
  Synthetic oligonucleotide; TGG chr11 5194129 5194148 5194132 -
accaatcagcaggatgtggg

SEQ ID NO: 52538 - DNA, 20 bp, Artificial Sequence
  Synthetic oligonucleotide; GGG chr11 5194128 5194147 5194131 -
ccaatcagcaggatgtgggt

SEQ ID NO: 52539 - DNA, 20 bp, Artificial Sequence
  Synthetic oligonucleotide; GGG chr11 5194127 5194146 5194130 -
caatcagcaggatgtgggtg

SEQ ID NO: 52540 - DNA, 20 bp, Artificial Sequence
  Synthetic oligonucleotide; CAG chr11 5194123 5194142 5194126 -
cagcaggatgtgggtggggt

SEQ ID NO: 52541 - DNA, 20 bp, Artificial Sequence
  Synthetic oligonucleotide; AAG chr11 5194118 5194137 5194121 -
ggatgtgggtggggtcagat

SEQ ID NO: 52542 - DNA, 20 bp, Artificial Sequence
  Synthetic oligonucleotide; AGG chr11 5194117 5194136 5194120 -
gatgtgggtggggtcagata

SEQ ID NO: 52543 - DNA, 20 bp, Artificial Sequence
  Synthetic oligonucleotide; AAG chr11 5194109 5194128 5194112 -
tggggtcagataaggaaata

SEQ ID NO: 52544 - DNA, 20 bp, Artificial Sequence
  Synthetic oligonucleotide; AGG chr11 5194108 5194127 5194111 -
ggggtcagataaggaaataa

SEQ ID NO: 52545 - DNA, 20 bp, Artificial Sequence
  Synthetic oligonucleotide; CAG chr11 5194105 5194124 5194108 -
gtcagataaggaaataaagg

SEQ ID NO: 52546 - DNA, 20 bp, Artificial Sequence
  Synthetic oligonucleotide; AGG chr11 5194104 5194123 5194107 -
tcagataaggaaataaaggc

SEQ ID NO: 52547 - DNA, 20 bp, Artificial Sequence
  Synthetic oligonucleotide; CGG chr11 5194097 5194116 5194100 -
aggaaataaaggcaggctgc

SEQ ID NO: 52548 - DNA, 20 bp, Artificial Sequence
  Synthetic oligonucleotide; GAG chr11 5194095 5194114 5194098 -
gaaataaaggcaggctgccg

SEQ ID NO: 52549 - DNA, 20 bp, Artificial Sequence
  Synthetic oligonucleotide; CAG chr11 5194091 5194110 5194094 -
taaaggcaggctgccggagc

SEQ ID NO: 52550 - DNA, 20 bp, Artificial Sequence
  Synthetic oligonucleotide; TGG chr11 5194073 5194092 5194076 -
gccagctgtgacaactgact

SEQ ID NO: 52551 - DNA, 20 bp, Artificial Sequence
  Synthetic oligonucleotide; GGG chr11 5194072 5194091 5194075 -
ccagctgtgacaactgactt

SEQ ID NO: 52552 - DNA, 20 bp, Artificial Sequence
  Synthetic oligonucleotide; TGG chr11 5194054 5194073 5194057 -
ttgggttccctaccatgctg

SEQ ID NO: 52553 - DNA, 20 bp, Artificial Sequence
  Synthetic oligonucleotide; AAG chr11 5194051 5194070 5194054 -
ggttccctaccatgctgtgg

SEQ ID NO: 52554 - DNA, 20 bp, Artificial Sequence
  Synthetic oligonucleotide; TGG chr11 5194001 5194020 5194004 -
tcttactgctgctcactctt

SEQ ID NO: 52555 - DNA, 20 bp, Artificial Sequence
  Synthetic oligonucleotide; GAG chr11 5193981 5194000 5193984 -
tggatccgcgctgcctttat

SEQ ID NO: 52556 - DNA, 20 bp, Artificial Sequence
  Synthetic oligonucleotide; AAG chr11 5193961 5193980 5193964 -
gagctgtaacactcactgcg

SEQ ID NO: 52557 - DNA, 20 bp, Artificial Sequence
  Synthetic oligonucleotide; AGG chr11 5193960 5193979 5193963 -
agctgtaacactcactgcga

SEQ ID NO: 52558 - DNA, 20 bp, Artificial Sequence
  Synthetic oligonucleotide; CGG chr11 5193953 5193972 5193956 -
acactcactgcgaaggtctg

SEQ ID NO: 52559 - DNA, 20 bp, Artificial Sequence
  Synthetic oligonucleotide; AAG chr11 5193939 5193958 5193942 -
ggtctgcggcttcacttctg

SEQ ID NO: 52560 - DNA, 20 bp, Artificial Sequence
  Synthetic oligonucleotide; CAG chr11 5193935 5193954 5193938 -
tgcggcttcacttctgaagc

SEQ ID NO: 52561 - DNA, 20 bp, Artificial Sequence
  Synthetic oligonucleotide; AAG chr11 5193931 5193950 5193934 -
gcttcacttctgaagccagc

SEQ ID NO: 52562 - DNA, 20 bp, Artificial Sequence
  Synthetic oligonucleotide; CAG chr11 5193918 5193937 5193921 -
agccagcaagaccacgaacc

SEQ ID NO: 52563 - DNA, 20 bp, Artificial Sequence
  Synthetic oligonucleotide; TGG chr11 5193913 5193932 5193916 -
gcaagaccacgaacccagca

SEQ ID NO: 52564 - DNA, 20 bp, Artificial Sequence
  Synthetic oligonucleotide; GGG chr11 5193912 5193931 5193915 -
caagaccacgaacccagcat

SEQ ID NO: 52565 - DNA, 20 bp, Artificial Sequence
  Synthetic oligonucleotide; GGG chr11 5193911 5193930 5193914 -
aagaccacgaacccagcatg

SEQ ID NO: 52566 - DNA, 20 bp, Artificial Sequence
  Synthetic oligonucleotide; GGG chr11 5193910 5193929 5193913 -
agaccacgaacccagcatgg

SEQ ID NO: 52567 - DNA, 20 bp, Artificial Sequence
  Synthetic oligonucleotide; AAG chr11 5193896 5193915 5193899 -
gcatgggggatgaacaaccc

SEQ ID NO: 52568 - DNA, 20 bp, Artificial Sequence
  Synthetic oligonucleotide; CAG chr11 5193892 5193911 5193895 -
gggggatgaacaacccaaga

SEQ ID NO: 52569 - DNA, 20 bp, Artificial Sequence
  Synthetic oligonucleotide; AGG chr11 5193891 5193910 5193894 -
ggggatgaacaacccaagac

SEQ ID NO: 52570 - DNA, 20 bp, Artificial Sequence
  Synthetic oligonucleotide; GAG chr11 5193889 5193908 5193892 -
ggatgaacaacccaagacag

SEQ ID NO: 52571 - DNA, 20 bp, Artificial Sequence
  Synthetic oligonucleotide; AGG chr11 5193888 5193907 5193891 -
gatgaacaacccaagacagg

SEQ ID NO: 52572 - DNA, 20 bp, Artificial Sequence
  Synthetic oligonucleotide; GAG chr11 5193882 5193901 5193885 -
caacccaagacaggaggaat

SEQ ID NO: 52573 - DNA, 20 bp, Artificial Sequence
  Synthetic oligonucleotide; AAG chr11 5193857 5193876 5193860 -
actccatacgctccgccttt

SEQ ID NO: 52574 - DNA, 20 bp, Artificial Sequence
  Synthetic oligonucleotide; GAG chr11 5193855 5193874 5193858 -
tccatacgctccgcctttaa

SEQ ID NO: 52575 - DNA, 20 bp, Artificial Sequence
  Synthetic oligonucleotide; TGG chr11 5193837 5193856 5193840 -
aagagctgtaacactccccg

SEQ ID NO: 52576 - DNA, 20 bp, Artificial Sequence
  Synthetic oligonucleotide; GGG chr11 5193836 5193855 5193839 -
agagctgtaacactccccgt

SEQ ID NO: 52577 - DNA, 20 bp, Artificial Sequence
  Synthetic oligonucleotide; GGG chr11 5193835 5193854 5193838 -
gagctgtaacactccccgtg

SEQ ID NO: 52578 - DNA, 20 bp, Artificial Sequence
  Synthetic oligonucleotide; GGG chr11 5193834 5193853 5193837 -
agctgtaacactccccgtgg

SEQ ID NO: 52579 - DNA, 20 bp, Artificial Sequence
  Synthetic oligonucleotide; CAG chr11 5193827 5193846 5193830 -
acactccccgtgggggtctg

SEQ ID NO: 52580 - DNA, 20 bp, Artificial Sequence
  Synthetic oligonucleotide; TGG chr11 5193815 5193834 5193818 -
ggggtctgcagcttcactcc

SEQ ID NO: 52581 - DNA, 20 bp, Artificial Sequence
  Synthetic oligonucleotide; GAG chr11 5193813 5193832 5193816 -
ggtctgcagcttcactcctg

SEQ ID NO: 52582 - DNA, 20 bp, Artificial Sequence
  Synthetic oligonucleotide; CAG chr11 5193809 5193828 5193812 -
tgcagcttcactcctggagc

SEQ ID NO: 52583 - DNA, 20 bp, Artificial Sequence
  Synthetic oligonucleotide; AAG chr11 5193805 5193824 5193808 -
gcttcactcctggagccagc

SEQ ID NO: 52584 - DNA, 20 bp, Artificial Sequence
  Synthetic oligonucleotide; CAG chr11 5193789 5193808 5193792 -
cagcaagaccgtgaacacac

SEQ ID NO: 52585 - DNA, 20 bp, Artificial Sequence
  Synthetic oligonucleotide; AAG chr11 5193786 5193805 5193789 -
caagaccgtgaacacaccag

SEQ ID NO: 52586 - DNA, 20 bp, Artificial Sequence
  Synthetic oligonucleotide; AGG chr11 5193785 5193804 5193788 -
aagaccgtgaacacaccaga

SEQ ID NO: 52587 - DNA, 20 bp, Artificial Sequence
  Synthetic oligonucleotide; AAG chr11 5193782 5193801 5193785 -
accgtgaacacaccagaagg

SEQ ID NO: 52588 - DNA, 20 bp, Artificial Sequence
  Synthetic oligonucleotide; TGG chr11 5193773 5193792 5193776 -
acaccagaaggaagaaactc

SEQ ID NO: 52589 - DNA, 20 bp, Artificial Sequence
  Synthetic oligonucleotide; AAG chr11 5193761 5193780 5193764 -
agaaactctggacacatctg

SEQ ID NO: 52590 - DNA, 20 bp, Artificial Sequence
  Synthetic oligonucleotide; TGG chr11 5193748 5193767 5193751 -
acatctgaagtaacaaactt

SEQ ID NO: 52591 - DNA, 20 bp, Artificial Sequence
  Synthetic oligonucleotide; AAG chr11 5193716 5193735 5193719 -
cctttgaacacaccatcttt

SEQ ID NO: 52592 - DNA, 20 bp, Artificial Sequence
  Synthetic oligonucleotide; GAG chr11 5193695 5193714 5193698 -
agaattgtaacactcaccac

SEQ ID NO: 52593 - DNA, 20 bp, Artificial Sequence
  Synthetic oligonucleotide; AGG chr11 5193694 5193713 5193697 -
gaattgtaacactcaccacg

SEQ ID NO: 52594 - DNA, 20 bp, Artificial Sequence
  Synthetic oligonucleotide; GGG chr11 5193693 5193712 5193696 -
aattgtaacactcaccacga

SEQ ID NO: 52595 - DNA, 20 bp, Artificial Sequence
  Synthetic oligonucleotide; CGG chr11 5193686 5193705 5193689 -
acactcaccacgagggttcg

SEQ ID NO: 52596 - DNA, 20 bp, Artificial Sequence
  Synthetic oligonucleotide; AAG chr11 5193672 5193691 5193675 -
ggttcgcggcttcattcttt

SEQ ID NO: 52597 - DNA, 20 bp, Artificial Sequence
  Synthetic oligonucleotide; CAG chr11 5193668 5193687 5193671 -
cgcggcttcattctttaagt

SEQ ID NO: 52598 - DNA, 20 bp, Artificial Sequence
  Synthetic oligonucleotide; GAG chr11 5193664 5193683 5193667 -
gcttcattctttaagtcagc

SEQ ID NO: 52599 - DNA, 20 bp, Artificial Sequence
  Synthetic oligonucleotide; AAG chr11 5193658 5193677 5193661 -
ttctttaagtcagcgagacc

SEQ ID NO: 52600 - DNA, 20 bp, Artificial Sequence
  Synthetic oligonucleotide; CGG chr11 5193642 5193661 5193645 -
gaccaagaacccaccaattc

SEQ ID NO: 52601 - DNA, 20 bp, Artificial Sequence
  Synthetic oligonucleotide; CAG chr11 5193636 5193655 5193639 -
gaacccaccaattccggaca

SEQ ID NO: 52602 - DNA, 20 bp, Artificial Sequence
  Synthetic oligonucleotide; AAG chr11 5193633 5193652 5193636 -
cccaccaattccggacacag

SEQ ID NO: 52603 - DNA, 20 bp, Artificial Sequence
  Synthetic oligonucleotide; AGG chr11 5193632 5193651 5193635 -
ccaccaattccggacacaga

SEQ ID NO: 52604 - DNA, 20 bp, Artificial Sequence
  Synthetic oligonucleotide; TGG chr11 5193628 5193647 5193631 -
caattccggacacagaagga

SEQ ID NO: 52605 - DNA, 20 bp, Artificial Sequence
  Synthetic oligonucleotide; AAG chr11 5193622 5193641 5193625 -
cggacacagaaggatggaca

SEQ ID NO: 52606 - DNA, 20 bp, Artificial Sequence
  Synthetic oligonucleotide; CAG chr11 5193614 5193633 5193617 -
gaaggatggacaaagattat

SEQ ID NO: 52607 - DNA, 20 bp, Artificial Sequence
  Synthetic oligonucleotide; AGG chr11 5193613 5193632 5193616 -
aaggatggacaaagattatc

SEQ ID NO: 52608 - DNA, 20 bp, Artificial Sequence
  Synthetic oligonucleotide; AAG chr11 5193601 5193620 5193604 -
agattatcaggaatgcaatt

SEQ ID NO: 52609 - DNA, 20 bp, Artificial Sequence
  Synthetic oligonucleotide; TAG chr11 5193573 5193592 5193576 -
caacacaaaaattacatacc

SEQ ID NO: 52610 - DNA, 20 bp, Artificial Sequence
  Synthetic oligonucleotide; AAG chr11 5193556 5193575 5193559 -
acctagaatcaattttaata

SEQ ID NO: 52611 - DNA, 20 bp, Artificial Sequence
  Synthetic oligonucleotide; TGG chr11 5193543 5193562 5193546 -
tttaataaagaaaacttatt

SEQ ID NO: 52612 - DNA, 20 bp, Artificial Sequence
  Synthetic oligonucleotide; GAG chr11 5193541 5193560 5193544 -
taataaagaaaacttatttg

SEQ ID NO: 52613 - DNA, 20 bp, Artificial Sequence
  Synthetic oligonucleotide; CAG chr11 5193536 5193555 5193539 -
aagaaaacttatttggagca

SEQ ID NO: 52614 - DNA, 20 bp, Artificial Sequence
  Synthetic oligonucleotide; CAG chr11 5193527 5193546 5193530 -
tatttggagcacagcttatt

SEQ ID NO: 52615 - DNA, 20 bp, Artificial Sequence
  Synthetic oligonucleotide; AGG chr11 5193526 5193545 5193529 -
atttggagcacagcttattc

SEQ ID NO: 52616 - DNA, 20 bp, Artificial Sequence
  Synthetic oligonucleotide; GGG chr11 5193525 5193544 5193528 -
tttggagcacagcttattca

SEQ ID NO: 52617 - DNA, 20 bp, Artificial Sequence
  Synthetic oligonucleotide; CAG chr11 5193522 5193541 5193525 -
ggagcacagcttattcaggg

SEQ ID NO: 52618 - DNA, 20 bp, Artificial Sequence
  Synthetic oligonucleotide; AAG chr11 5193512 5193531 5193515 -
ttattcagggcagaaaataa

SEQ ID NO: 52619 - DNA, 20 bp, Artificial Sequence
  Synthetic oligonucleotide; AAG chr11 5193499 5193518 5193502 -
aaaataaaagctaataataa

SEQ ID NO: 52620 - DNA, 20 bp, Artificial Sequence
  Synthetic oligonucleotide; GAG chr11 5193497 5193516 5193500 -
aataaaagctaataataaaa

SEQ ID NO: 52621 - DNA, 20 bp, Artificial Sequence
  Synthetic oligonucleotide; AGG chr11 5193496 5193515 5193499 -
ataaaagctaataataaaag

SEQ ID NO: 52622 - DNA, 20 bp, Artificial Sequence
  Synthetic oligonucleotide; TAG chr11 5193455 5193474 5193458 -
aattaaataaccactcattt

SEQ ID NO: 52623 - DNA, 20 bp, Artificial Sequence
  Synthetic oligonucleotide; CAG chr11 5193436 5193455 5193439 -
ttagatccttgatatttgaa

SEQ ID NO: 52624 - DNA, 20 bp, Artificial Sequence
  Synthetic oligonucleotide; TAG chr11 5193431 5193450 5193434 -
tccttgatatttgaacagaa

SEQ ID NO: 52625 - DNA, 20 bp, Artificial Sequence
  Synthetic oligonucleotide; TAG chr11 5193419 5193438 5193422 -
gaacagaatagtataaaaaa

SEQ ID NO: 52626 - DNA, 20 bp, Artificial Sequence
  Synthetic oligonucleotide; GAG chr11 5193417 5193436 5193420 -
acagaatagtataaaaaata

SEQ ID NO: 52627 - DNA, 20 bp, Artificial Sequence
  Synthetic oligonucleotide; AGG chr11 5193416 5193435 5193419 -
cagaatagtataaaaaatag

SEQ ID NO: 52628 - DNA, 20 bp, Artificial Sequence
  Synthetic oligonucleotide; GGG chr11 5193415 5193434 5193418 -
agaatagtataaaaaataga

SEQ ID NO: 52629 - DNA, 20 bp, Artificial Sequence
  Synthetic oligonucleotide; TAG chr11 5193403 5193422 5193406 -
aaaatagagggcatgataaa

SEQ ID NO: 52630 - DNA, 20 bp, Artificial Sequence
  Synthetic oligonucleotide; AAG chr11 5193394 5193413 5193397 -
ggcatgataaatagtaaata

SEQ ID NO: 52631 - DNA, 20 bp, Artificial Sequence
  Synthetic oligonucleotide; GAG chr11 5193382 5193401 5193385 -
agtaaataaagcaaaaatat

SEQ ID NO: 52632 - DNA, 20 bp, Artificial Sequence
  Synthetic oligonucleotide; GAG chr11 5193380 5193399 5193383 -
taaataaagcaaaaatatga

SEQ ID NO: 52633 - DNA, 20 bp, Artificial Sequence
  Synthetic oligonucleotide; GAG chr11 5193375 5193394 5193378 -
aaagcaaaaatatgagagat

SEQ ID NO: 52634 - DNA, 20 bp, Artificial Sequence
  Synthetic oligonucleotide; AAG chr11 5193369 5193388 5193372 -
aaaatatgagagatgagatg

SEQ ID NO: 52635 - DNA, 20 bp, Artificial Sequence
  Synthetic oligonucleotide; TAG chr11 5193366 5193385 5193369 -
atatgagagatgagatgaag

SEQ ID NO: 52636 - DNA, 20 bp, Artificial Sequence
  Synthetic oligonucleotide; AAG chr11 5193358 5193377 5193361 -
gatgagatgaagtagccaat

SEQ ID NO: 52637 - DNA, 20 bp, Artificial Sequence
  Synthetic oligonucleotide; AGG chr11 5193357 5193376 5193360 -
atgagatgaagtagccaata

SEQ ID NO: 52638 - DNA, 20 bp, Artificial Sequence
  Synthetic oligonucleotide; GGG chr11 5193356 5193375 5193359 -
tgagatgaagtagccaataa

SEQ ID NO: 52639 - DNA, 20 bp, Artificial Sequence
  Synthetic oligonucleotide; GGG chr11 5193355 5193374 5193358 -
gagatgaagtagccaataag

SEQ ID NO: 52640 - DNA, 20 bp, Artificial Sequence
  Synthetic oligonucleotide; GGG chr11 5193354 5193373 5193357 -
agatgaagtagccaataagg

SEQ ID NO: 52641 - DNA, 20 bp, Artificial Sequence
  Synthetic oligonucleotide; CAG chr11 5193350 5193369 5193353 -
gaagtagccaataaggggga

SEQ ID NO: 52642 - DNA, 20 bp, Artificial Sequence
  Synthetic oligonucleotide; AGG chr11 5193349 5193368 5193352 -
aagtagccaataagggggac

SEQ ID NO: 52643 - DNA, 20 bp, Artificial Sequence
  Synthetic oligonucleotide; AAG chr11 5193346 5193365 5193349 -
tagccaataagggggacagg

SEQ ID NO: 52644 - DNA, 20 bp, Artificial Sequence
  Synthetic oligonucleotide; TAG chr11 5193343 5193362 5193346 -
ccaataagggggacaggaag

SEQ ID NO: 52645 - DNA, 20 bp, Artificial Sequence
  Synthetic oligonucleotide; AAG chr11 5193336 5193355 5193339 -
gggggacaggaagtagattt

SEQ ID NO: 52646 - DNA, 20 bp, Artificial Sequence
  Synthetic oligonucleotide; GAG chr11 5193334 5193353 5193337 -
gggacaggaagtagatttaa

SEQ ID NO: 52647 - DNA, 20 bp, Artificial Sequence
  Synthetic oligonucleotide; CAG chr11 5193329 5193348 5193332 -
aggaagtagatttaagagtg

SEQ ID NO: 52648 - DNA, 20 bp, Artificial Sequence
  Synthetic oligonucleotide; AAG chr11 5193321 5193340 5193324 -
gatttaagagtgcagaaaaa

SEQ ID NO: 52649 - DNA, 20 bp, Artificial Sequence
  Synthetic oligonucleotide; AGG chr11 5193320 5193339 5193323 -
atttaagagtgcagaaaaaa

SEQ ID NO: 52650 - DNA, 20 bp, Artificial Sequence
  Synthetic oligonucleotide; AAG chr11 5193314 5193333 5193317 -
gagtgcagaaaaaaaggaca

SEQ ID NO: 52651 - DNA, 20 bp, Artificial Sequence
  Synthetic oligonucleotide; AGG chr11 5193313 5193332 5193316 -
agtgcagaaaaaaaggacaa

SEQ ID NO: 52652 - DNA, 20 bp, Artificial Sequence
  Synthetic oligonucleotide; TGG chr11 5193302 5193321 5193305 -
aaaggacaaaggaataaata

SEQ ID NO: 52653 - DNA, 20 bp, Artificial Sequence
  Synthetic oligonucleotide; GGG chr11 5193301 5193320 5193304 -
aaggacaaaggaataaatat

SEQ ID NO: 52654 - DNA, 20 bp, Artificial Sequence
  Synthetic oligonucleotide; GGG chr11 5193300 5193319 5193303 -
aggacaaaggaataaatatg

SEQ ID NO: 52655 - DNA, 20 bp, Artificial Sequence
  Synthetic oligonucleotide; GGG chr11 5193299 5193318 5193302 -
ggacaaaggaataaatatgg

SEQ ID NO: 52656 - DNA, 20 bp, Artificial Sequence
  Synthetic oligonucleotide; GGG chr11 5193298 5193317 5193301 -
gacaaaggaataaatatggg

SEQ ID NO: 52657 - DNA, 20 bp, Artificial Sequence
  Synthetic oligonucleotide; TGG chr11 5193293 5193312 5193296 -
aggaataaatatggggggca

SEQ ID NO: 52658 - DNA, 20 bp, Artificial Sequence
  Synthetic oligonucleotide; GAG chr11 5193291 5193310 5193294 -
gaataaatatggggggcatg

SEQ ID NO: 52659 - DNA, 20 bp, Artificial Sequence
  Synthetic oligonucleotide; AGG chr11 5193290 5193309 5193293 -
aataaatatggggggcatgg

SEQ ID NO: 52660 - DNA, 20 bp, Artificial Sequence
  Synthetic oligonucleotide; TAG chr11 5193281 5193300 5193284 -
ggggggcatggaggaaaaaa

SEQ ID NO: 52661 - DNA, 20 bp, Artificial Sequence
  Synthetic oligonucleotide; AGG chr11 5193280 5193299 5193283 -
gggggcatggaggaaaaaat

SEQ ID NO: 52662 - DNA, 20 bp, Artificial Sequence
  Synthetic oligonucleotide; GGG chr11 5193279 5193298 5193282 -
ggggcatggaggaaaaaata

SEQ ID NO: 52663 - DNA, 20 bp, Artificial Sequence
  Synthetic oligonucleotide; AAG chr11 5193274 5193293 5193277 -
atggaggaaaaaatagggtg

SEQ ID NO: 52664 - DNA, 20 bp, Artificial Sequence
  Synthetic oligonucleotide; CAG chr11 5193270 5193289 5193273 -
aggaaaaaatagggtgaagt

SEQ ID NO: 52665 - DNA, 20 bp, Artificial Sequence
  Synthetic oligonucleotide; AGG chr11 5193269 5193288 5193272 -
ggaaaaaatagggtgaagtc

SEQ ID NO: 52666 - DNA, 20 bp, Artificial Sequence
  Synthetic oligonucleotide; TGG chr11 5193249 5193268 5193252 -
aggaactccaaaatcttaac

SEQ ID NO: 52667 - DNA, 20 bp, Artificial Sequence
  Synthetic oligonucleotide; GAG chr11 5193247 5193266 5193250 -
gaactccaaaatcttaactg

SEQ ID NO: 52668 - DNA, 20 bp, Artificial Sequence
  Synthetic oligonucleotide; CAG chr11 5193242 5193261 5193245 -
ccaaaatcttaactggagtt

SEQ ID NO: 52669 - DNA, 20 bp, Artificial Sequence
  Synthetic oligonucleotide; AGG chr11 5193241 5193260 5193244 -
caaaatcttaactggagttc

SEQ ID NO: 52670 - DNA, 20 bp, Artificial Sequence
  Synthetic oligonucleotide; GAG chr11 5193239 5193258 5193242 -
aaatcttaactggagttcag

SEQ ID NO: 52671 - DNA, 20 bp, Artificial Sequence
  Synthetic oligonucleotide; GAG chr11 5193237 5193256 5193240 -
atcttaactggagttcagga

SEQ ID NO: 52672 - DNA, 20 bp, Artificial Sequence
  Synthetic oligonucleotide; GAG chr11 5193235 5193254 5193238 -
cttaactggagttcaggaga

SEQ ID NO: 52673 - DNA, 20 bp, Artificial Sequence
  Synthetic oligonucleotide; TAG chr11 5193226 5193245 5193229 -
agttcaggagagagtgaaaa

SEQ ID NO: 52674 - DNA, 20 bp, Artificial Sequence
  Synthetic oligonucleotide; TAG chr11 5193217 5193236 5193220 -
gagagtgaaaatagaacatg

SEQ ID NO: 52675 - DNA, 20 bp, Artificial Sequence
  Synthetic oligonucleotide; AAG chr11 5193214 5193233 5193217 -
agtgaaaatagaacatgtag

SEQ ID NO: 52676 - DNA, 20 bp, Artificial Sequence
  Synthetic oligonucleotide; AGG chr11 5193213 5193232 5193216 -
gtgaaaatagaacatgtaga

SEQ ID NO: 52677 - DNA, 20 bp, Artificial Sequence
  Synthetic oligonucleotide; TAG chr11 5193203 5193222 5193206 -
aacatgtagaaggaacttac

SEQ ID NO: 52678 - DNA, 20 bp, Artificial Sequence
  Synthetic oligonucleotide; GAG chr11 5193201 5193220 5193204 -
catgtagaaggaacttacta

SEQ ID NO: 52679 - DNA, 20 bp, Artificial Sequence
  Synthetic oligonucleotide; AAG chr11 5193190 5193209 5193193 -
aacttactagagatcaatac

SEQ ID NO: 52680 - DNA, 20 bp, Artificial Sequence
  Synthetic oligonucleotide; AAG chr11 5193171 5193190 5193174 -
caagacaattttctgaacaa

SEQ ID NO: 52681 - DNA, 20 bp, Artificial Sequence
  Synthetic oligonucleotide; CAG chr11 5193164 5193183 5193167 -
attttctgaacaaaagaaca

SEQ ID NO: 52682 - DNA, 20 bp, Artificial Sequence
  Synthetic oligonucleotide; CAG chr11 5193161 5193180 5193164 -
ttctgaacaaaagaacacag

SEQ ID NO: 52683 - DNA, 20 bp, Artificial Sequence
  Synthetic oligonucleotide; GAG chr11 5193150 5193169 5193153 -
agaacacagcagttgaaatt

SEQ ID NO: 52684 - DNA, 20 bp, Artificial Sequence
  Synthetic oligonucleotide; GAG chr11 5193148 5193167 5193151 -
aacacagcagttgaaattga

SEQ ID NO: 52685 - DNA, 20 bp, Artificial Sequence
  Synthetic oligonucleotide; CAG chr11 5193130 5193149 5193133 -
gagagtatccacaaaatacc

SEQ ID NO: 52686 - DNA, 20 bp, Artificial Sequence
  Synthetic oligonucleotide; TGG chr11 5193100 5193119 5193103 -
taaaataaaataaaaattca

SEQ ID NO: 52687 - DNA, 20 bp, Artificial Sequence
  Synthetic oligonucleotide; AAG chr11 5193096 5193115 5193099 -
ataaaataaaaattcatggt

SEQ ID NO: 52688 - DNA, 20 bp, Artificial Sequence
  Synthetic oligonucleotide; AAG chr11 5193091 5193110 5193094 -
ataaaaattcatggtaagtt

SEQ ID NO: 52689 - DNA, 20 bp, Artificial Sequence
  Synthetic oligonucleotide; GAG chr11 5193089 5193108 5193092 -
aaaaattcatggtaagttaa

SEQ ID NO: 52690 - DNA, 20 bp, Artificial Sequence
  Synthetic oligonucleotide; AAG chr11 5193074 5193093 5193077 -
gttaagagaatgaaaaaaac

SEQ ID NO: 52691 - DNA, 20 bp, Artificial Sequence
  Synthetic oligonucleotide; CAG chr11 5193068 5193087 5193071 -
agaatgaaaaaaacaagcca

SEQ ID NO: 52692 - DNA, 20 bp, Artificial Sequence
  Synthetic oligonucleotide; GAG chr11 5193066 5193085 5193069 -
aatgaaaaaaacaagccaca

SEQ ID NO: 52693 - DNA, 20 bp, Artificial Sequence
  Synthetic oligonucleotide; AAG chr11 5193034 5193053 5193037 -
gcaaaacatattatctgata

SEQ ID NO: 52694 - DNA, 20 bp, Artificial Sequence
  Synthetic oligonucleotide; AGG chr11 5193033 5193052 5193036 -
caaaacatattatctgataa

SEQ ID NO: 52695 - DNA, 20 bp, Artificial Sequence
  Synthetic oligonucleotide; AAG chr11 5193010 5193029 5193013 -
acttgtatacatattataca

SEQ ID NO: 52696 - DNA, 20 bp, Artificial Sequence
  Synthetic oligonucleotide; AAG chr11 5192964 5192983 5192967 -
aaacaaacaatccaattgca

SEQ ID NO: 52697 - DNA, 20 bp, Artificial Sequence
  Synthetic oligonucleotide; TGG chr11 5192961 5192980 5192964 -
caaacaatccaattgcaaag

SEQ ID NO: 52698 - DNA, 20 bp, Artificial Sequence
  Synthetic oligonucleotide; GGG chr11 5192960 5192979 5192963 -
aaacaatccaattgcaaagt

SEQ ID NO: 52699 - DNA, 20 bp, Artificial Sequence
  Synthetic oligonucleotide; AAG chr11 5192954 5192973 5192957 -
tccaattgcaaagtgggcaa

SEQ ID NO: 52700 - DNA, 20 bp, Artificial Sequence
  Synthetic oligonucleotide; CAG chr11 5192944 5192963 5192947 -
aagtgggcaaaagatctgaa

SEQ ID NO: 52701 - DNA, 20 bp, Artificial Sequence
  Synthetic oligonucleotide; AAG chr11 5192930 5192949 5192933 -
tctgaacagacactttacca

SEQ ID NO: 52702 - DNA, 20 bp, Artificial Sequence
  Synthetic oligonucleotide; AAG chr11 5192927 5192946 5192930 -
gaacagacactttaccaaag

SEQ ID NO: 52703 - DNA, 20 bp, Artificial Sequence
  Synthetic oligonucleotide; TAG chr11 5192919 5192938 5192922 -
actttaccaaagaagatata

SEQ ID NO: 52704 - DNA, 20 bp, Artificial Sequence
  Synthetic oligonucleotide; AAG chr11 5192908 5192927 5192911 -
gaagatatatagattgcaat

SEQ ID NO: 52705 - DNA, 20 bp, Artificial Sequence
  Synthetic oligonucleotide; CAG chr11 5192889 5192908 5192892 -
taagcacatgaaaatatact

SEQ ID NO: 52706 - DNA, 20 bp, Artificial Sequence
  Synthetic oligonucleotide; AAG chr11 5192872 5192891 5192875 -
actcagtaacacatgtcatt

SEQ ID NO: 52707 - DNA, 20 bp, Artificial Sequence
  Synthetic oligonucleotide; AAG chr11 5192852 5192871 5192855 -
aagaaactgcacattaaaac

SEQ ID NO: 52708 - DNA, 20 bp, Artificial Sequence
  Synthetic oligonucleotide; AAG chr11 5192849 5192868 5192852 -
aaactgcacattaaaacaag

SEQ ID NO: 52709 - DNA, 20 bp, Artificial Sequence
  Synthetic oligonucleotide; TAG chr11 5192824 5192843 5192827 -
accaaccactacacacatat

SEQ ID NO: 52710 - DNA, 20 bp, Artificial Sequence
  Synthetic oligonucleotide; AAG chr11 5192821 5192840 5192824 -
aaccactacacacatattag

SEQ ID NO: 52711 - DNA, 20 bp, Artificial Sequence
  Synthetic oligonucleotide; AGG chr11 5192820 5192839 5192823 -
accactacacacatattaga

SEQ ID NO: 52712 - DNA, 20 bp, Artificial Sequence
  Synthetic oligonucleotide; TGG chr11 5192784 5192803 5192787 -
tactgacatccaccaaacac

SEQ ID NO: 52713 - DNA, 20 bp, Artificial Sequence
  Synthetic oligonucleotide; AAG chr11 5192776 5192795 5192779 -
tccaccaaacactggcaacg

SEQ ID NO: 52714 - DNA, 20 bp, Artificial Sequence
  Synthetic oligonucleotide; TGG chr11 5192773 5192792 5192776 -
accaaacactggcaacgaag

SEQ ID NO: 52715 - DNA, 20 bp, Artificial Sequence
  Synthetic oligonucleotide; GAG chr11 5192771 5192790 5192774 -
caaacactggcaacgaagtg

SEQ ID NO: 52716 - DNA, 20 bp, Artificial Sequence
  Synthetic oligonucleotide; CAG chr11 5192765 5192784 5192768 -
ctggcaacgaagtggagcaa

SEQ ID NO: 52717 - DNA, 20 bp, Artificial Sequence
  Synthetic oligonucleotide; TAG chr11 5192742 5192761 5192745 -
taactctcacttattgcttg

SEQ ID NO: 52718 - DNA, 20 bp, Artificial Sequence
  Synthetic oligonucleotide; AGG chr11 5192741 5192760 5192744 -
aactctcacttattgcttgt

SEQ ID NO: 52719 - DNA, 20 bp, Artificial Sequence
  Synthetic oligonucleotide; GGG chr11 5192740 5192759 5192743 -
actctcacttattgcttgta

SEQ ID NO: 52720 - DNA, 20 bp, Artificial Sequence
  Synthetic oligonucleotide; GAG chr11 5192735 5192754 5192738 -
cacttattgcttgtagggat

SEQ ID NO: 52721 - DNA, 20 bp, Artificial Sequence
  Synthetic oligonucleotide; TAG chr11 5192729 5192748 5192732 -
ttgcttgtagggatgagaaa

SEQ ID NO: 52722 - DNA, 20 bp, Artificial Sequence
  Synthetic oligonucleotide; CAG chr11 5192724 5192743 5192727 -
tgtagggatgagaaatagtg

SEQ ID NO: 52723 - DNA, 20 bp, Artificial Sequence
  Synthetic oligonucleotide; TGG chr11 5192715 5192734 5192718 -
gagaaatagtgcagccaaat

SEQ ID NO: 52724 - DNA, 20 bp, Artificial Sequence
  Synthetic oligonucleotide; AAG chr11 5192712 5192731 5192715 -
aaatagtgcagccaaattgg

SEQ ID NO: 52725 - DNA, 20 bp, Artificial Sequence
  Synthetic oligonucleotide; CAG chr11 5192708 5192727 5192711 -
agtgcagccaaattggaaga

SEQ ID NO: 52726 - DNA, 20 bp, Artificial Sequence
  Synthetic oligonucleotide; CAG chr11 5192701 5192720 5192704 -
ccaaattggaagacagttta

SEQ ID NO: 52727 - DNA, 20 bp, Artificial Sequence
  Synthetic oligonucleotide; TAG chr11 5192685 5192704 5192688 -
tttacagtttcttacaaaac

SEQ ID NO: 52728 - DNA, 20 bp, Artificial Sequence
  Synthetic oligonucleotide; GAG chr11 5192635 5192654 5192638 -
tcctatgtatttacccaaat

SEQ ID NO: 52729 - DNA, 20 bp, Artificial Sequence
  Synthetic oligonucleotide; CAG chr11 5192611 5192630 5192614 -
caaaaatttatgtccacaca

SEQ ID NO: 52730 - DNA, 20 bp, Artificial Sequence
  Synthetic oligonucleotide; AAG chr11 5192595 5192614 5192598 -
cacacagacatgaactaacc

SEQ ID NO: 52731 - DNA, 20 bp, Artificial Sequence
  Synthetic oligonucleotide; AGG chr11 5192594 5192613 5192597 -
acacagacatgaactaacca

SEQ ID NO: 52732 - DNA, 20 bp, Artificial Sequence
  Synthetic oligonucleotide; TAG chr11 5192587 5192606 5192590 -
catgaactaaccaaggttta

SEQ ID NO: 52733 - DNA, 20 bp, Artificial Sequence
  Synthetic oligonucleotide; AGG chr11 5192586 5192605 5192589 -
atgaactaaccaaggtttat

SEQ ID NO: 52734 - DNA, 20 bp, Artificial Sequence
  Synthetic oligonucleotide; AAG chr11 5192562 5192581 5192565 -
actttactcataattgccaa

SEQ ID NO: 52735 - DNA, 20 bp, Artificial Sequence
  Synthetic oligonucleotide; AAG chr11 5192555 5192574 5192558 -
tcataattgccaaaagttga

SEQ ID NO: 52736 - DNA, 20 bp, Artificial Sequence
  Synthetic oligonucleotide; AAG chr11 5192547 5192566 5192550 -
gccaaaagttgaaagtaacc

SEQ ID NO: 52737 - DNA, 20 bp, Artificial Sequence
  Synthetic oligonucleotide; TGG chr11 5192539 5192558 5192542 -
ttgaaagtaaccaagatgaa

SEQ ID NO: 52738 - DNA, 20 bp, Artificial Sequence
  Synthetic oligonucleotide; TGG chr11 5192528 5192547 5192531 -
caagatgaatggataaactg

SEQ ID NO: 52739 - DNA, 20 bp, Artificial Sequence
  Synthetic oligonucleotide; TAG chr11 5192517 5192536 5192520 -
gataaactgtggaacatcca

SEQ ID NO: 52740 - DNA, 20 bp, Artificial Sequence
  Synthetic oligonucleotide; AGG chr11 5192516 5192535 5192519 -
ataaactgtggaacatccat

SEQ ID NO: 52741 - DNA, 20 bp, Artificial Sequence
  Synthetic oligonucleotide; TAG chr11 5192512 5192531 5192515 -
actgtggaacatccatagga

SEQ ID NO: 52742 - DNA, 20 bp, Artificial Sequence
  Synthetic oligonucleotide; CAG chr11 5192500 5192519 5192503 -
ccataggatagaatattatt

SEQ ID NO: 52743 - DNA, 20 bp, Artificial Sequence
  Synthetic oligonucleotide; AAG chr11 5192486 5192505 5192489 -
attattcagtgatataaata

SEQ ID NO: 52744 - DNA, 20 bp, Artificial Sequence
  Synthetic oligonucleotide; AGG chr11 5192485 5192504 5192488 -
ttattcagtgatataaataa

SEQ ID NO: 52745 - DNA, 20 bp, Artificial Sequence
  Synthetic oligonucleotide; AAG chr11 5192476 5192495 5192479 -
gatataaataaaggtctatc

SEQ ID NO: 52746 - DNA, 20 bp, Artificial Sequence
  Synthetic oligonucleotide; AAG chr11 5192466 5192485 5192469 -
aaggtctatcaagctgtgaa

SEQ ID NO: 52747 - DNA, 20 bp, Artificial Sequence
  Synthetic oligonucleotide; AAG chr11 5192458 5192477 5192461 -
tcaagctgtgaaaagacata

SEQ ID NO: 52748 - DNA, 20 bp, Artificial Sequence
  Synthetic oligonucleotide; GAG chr11 5192456 5192475 5192459 -
aagctgtgaaaagacataaa

SEQ ID NO: 52749 - DNA, 20 bp, Artificial Sequence
  Synthetic oligonucleotide; TAG chr11 5192415 5192434 5192418 -
taattcattttctttaatta

SEQ ID NO: 52750 - DNA, 20 bp, Artificial Sequence
  Synthetic oligonucleotide; GAG chr11 5192364 5192383 5192367 -
acctattttatcttgctgtt

SEQ ID NO: 52751 - DNA, 20 bp, Artificial Sequence
  Synthetic oligonucleotide; TAG chr11 5192346 5192365 5192349 -
ttgagaaacttccattccta

SEQ ID NO: 52752 - DNA, 20 bp, Artificial Sequence
  Synthetic oligonucleotide; TAG chr11 5192299 5192318 5192302 -
tattattcctcaaacaaata

SEQ ID NO: 52753 - DNA, 20 bp, Artificial Sequence
  Synthetic oligonucleotide; TAG chr11 5192285 5192304 5192288 -
caaatatagatattcaataa

SEQ ID NO: 52754 - DNA, 20 bp, Artificial Sequence
  Synthetic oligonucleotide; TAG chr11 5192277 5192296 5192280 -
gatattcaataatagacaaa

SEQ ID NO: 52755 - DNA, 20 bp, Artificial Sequence
  Synthetic oligonucleotide; AAG chr11 5192268 5192287 5192271 -
taatagacaaatagtgaata

SEQ ID NO: 52756 - DNA, 20 bp, Artificial Sequence
  Synthetic oligonucleotide; TGG chr11 5192263 5192282 5192266 -
gacaaatagtgaataaagta

SEQ ID NO: 52757 - DNA, 20 bp, Artificial Sequence
  Synthetic oligonucleotide; TAG chr11 5192246 5192265 5192249 -
gtatggtacattctttgact

SEQ ID NO: 52758 - DNA, 20 bp, Artificial Sequence
  Synthetic oligonucleotide; CAG chr11 5192240 5192259 5192243 -
tacattctttgacttagttt

SEQ ID NO: 52759 - DNA, 20 bp, Artificial Sequence
  Synthetic oligonucleotide; CAG chr11 5192236 5192255 5192239 -
ttctttgacttagtttcaga

SEQ ID NO: 52760 - DNA, 20 bp, Artificial Sequence
  Synthetic oligonucleotide; TAG chr11 5192225 5192244 5192228 -
agtttcagacagctattgca

SEQ ID NO: 52761 - DNA, 20 bp, Artificial Sequence
  Synthetic oligonucleotide; TAG chr11 5192215 5192234 5192218 -
agctattgcatagaatgaaa

SEQ ID NO: 52762 - DNA, 20 bp, Artificial Sequence
  Synthetic oligonucleotide; CAG chr11 5192197 5192216 5192200 -
aatagattaatatttaataa

SEQ ID NO: 52763 - DNA, 20 bp, Artificial Sequence
  Synthetic oligonucleotide; AGG chr11 5192196 5192215 5192199 -
atagattaatatttaataac

SEQ ID NO: 52764 - DNA, 20 bp, Artificial Sequence
  Synthetic oligonucleotide; AAG chr11 5192170 5192189 5192173 -
tgttatgatttattaaaaat

SEQ ID NO: 52765 - DNA, 20 bp, Artificial Sequence
  Synthetic oligonucleotide; AAG chr11 5192156 5192175 5192159 -
aaaaataagatgataaataa

SEQ ID NO: 52766 - DNA, 20 bp, Artificial Sequence
  Synthetic oligonucleotide; TAG chr11 5192150 5192169 5192153 -
aagatgataaataaaagatt

SEQ ID NO: 52767 - DNA, 20 bp, Artificial Sequence
  Synthetic oligonucleotide; TGG chr11 5192137 5192156 5192140 -
aaagatttagtatcttccca

SEQ ID NO: 52768 - DNA, 20 bp, Artificial Sequence
  Synthetic oligonucleotide; GAG chr11 5192135 5192154 5192138 -
agatttagtatcttcccatg

SEQ ID NO: 52769 - DNA, 20 bp, Artificial Sequence
  Synthetic oligonucleotide; TAG chr11 5192122 5192141 5192125 -
tcccatggagataacacact

SEQ ID NO: 52770 - DNA, 20 bp, Artificial Sequence
  Synthetic oligonucleotide; CAG chr11 5192116 5192135 5192119 -
ggagataacacacttagata

SEQ ID NO: 52771 - DNA, 20 bp, Artificial Sequence
  Synthetic oligonucleotide; AGG chr11 5192115 5192134 5192118 -
gagataacacacttagatac

SEQ ID NO: 52772 - DNA, 20 bp, Artificial Sequence
  Synthetic oligonucleotide; TGG chr11 5192099 5192118 5192102 -
atacaggtttcatgtcactt

SEQ ID NO: 52773 - DNA, 20 bp, Artificial Sequence
  Synthetic oligonucleotide; GAG chr11 5192092 5192111 5192095 -
tttcatgtcactttggacat

SEQ ID NO: 52774 - DNA, 20 bp, Artificial Sequence
  Synthetic oligonucleotide; AAG chr11 5192087 5192106 5192090 -
tgtcactttggacatgagta

SEQ ID NO: 52775 - DNA, 20 bp, Artificial Sequence
  Synthetic oligonucleotide; GAG chr11 5192085 5192104 5192088 -
tcactttggacatgagtaaa

SEQ ID NO: 52776 - DNA, 20 bp, Artificial Sequence
  Synthetic oligonucleotide; AGG chr11 5192084 5192103 5192087 -
cactttggacatgagtaaag

SEQ ID NO: 52777 - DNA, 20 bp, Artificial Sequence
  Synthetic oligonucleotide; GAG chr11 5192082 5192101 5192085 -
ctttggacatgagtaaagag

SEQ ID NO: 52778 - DNA, 20 bp, Artificial Sequence
  Synthetic oligonucleotide; GAG chr11 5192046 5192065 5192049 -
tcccaaatcttgatcacatt

SEQ ID NO: 52779 - DNA, 20 bp, Artificial Sequence
  Synthetic oligonucleotide; AAG chr11 5192038 5192057 5192041 -
cttgatcacattgagtatca

SEQ ID NO: 52780 - DNA, 20 bp, Artificial Sequence
  Synthetic oligonucleotide; AGG chr11 5192037 5192056 5192040 -
ttgatcacattgagtatcaa

SEQ ID NO: 52781 - DNA, 20 bp, Artificial Sequence
  Synthetic oligonucleotide; AAG chr11 5192034 5192053 5192037 -
atcacattgagtatcaaagg

SEQ ID NO: 52782 - DNA, 20 bp, Artificial Sequence
  Synthetic oligonucleotide; AGG chr11 5192033 5192052 5192036 -
tcacattgagtatcaaagga

SEQ ID NO: 52783 - DNA, 20 bp, Artificial Sequence
  Synthetic oligonucleotide; AAG chr11 5192030 5192049 5192033 -
cattgagtatcaaaggaagg

SEQ ID NO: 52784 - DNA, 20 bp, Artificial Sequence
  Synthetic oligonucleotide; AAG chr11 5192027 5192046 5192030 -
tgagtatcaaaggaaggaag

SEQ ID NO: 52785 - DNA, 20 bp, Artificial Sequence
  Synthetic oligonucleotide; TGG chr11 5192011 5192030 5192014 -
gaagaagaaaaaattattaa

SEQ ID NO: 52786 - DNA, 20 bp, Artificial Sequence
  Synthetic oligonucleotide; TGG chr11 5192008 5192027 5192011 -
gaagaaaaaattattaatgg

SEQ ID NO: 52787 - DNA, 20 bp, Artificial Sequence
  Synthetic oligonucleotide; TGG chr11 5191985 5192004 5191988 -
cattaaatatcatttattat

SEQ ID NO: 52788 - DNA, 20 bp, Artificial Sequence
  Synthetic oligonucleotide; TGG chr11 5191973 5191992 5191976 -
tttattattggatgtgttat

SEQ ID NO: 52789 - DNA, 20 bp, Artificial Sequence
  Synthetic oligonucleotide; TGG chr11 5191962 5191981 5191965 -
atgtgttattggcattgtat

SEQ ID NO: 52790 - DNA, 20 bp, Artificial Sequence
  Synthetic oligonucleotide; GAG chr11 5191928 5191947 5191931 -
actgctgtaaaaaaatacct

SEQ ID NO: 52791 - DNA, 20 bp, Artificial Sequence
  Synthetic oligonucleotide; TGG chr11 5191923 5191942 5191926 -
tgtaaaaaaatacctgagac

SEQ ID NO: 52792 - DNA, 20 bp, Artificial Sequence
  Synthetic oligonucleotide; GGG chr11 5191922 5191941 5191925 -
gtaaaaaaatacctgagact

SEQ ID NO: 52793 - DNA, 20 bp, Artificial Sequence
  Synthetic oligonucleotide; AAG chr11 5191910 5191929 5191913 -
ctgagactgggtaatttata

SEQ ID NO: 52794 - DNA, 20 bp, Artificial Sequence
  Synthetic oligonucleotide; CAG chr11 5191905 5191924 5191908 -
actgggtaatttataaagaa

SEQ ID NO: 52795 - DNA, 20 bp, Artificial Sequence
  Synthetic oligonucleotide; GAG chr11 5191903 5191922 5191906 -
tgggtaatttataaagaaca

SEQ ID NO: 52796 - DNA, 20 bp, Artificial Sequence
  Synthetic oligonucleotide; AGG chr11 5191902 5191921 5191905 -
gggtaatttataaagaacag

SEQ ID NO: 52797 - DNA, 20 bp, Artificial Sequence
  Synthetic oligonucleotide; TGG chr11 5191893 5191912 5191896 -
ataaagaacagaggtttaat

SEQ ID NO: 52798 - DNA, 20 bp, Artificial Sequence
  Synthetic oligonucleotide; AAG chr11 5191886 5191905 5191889 -
acagaggtttaattggctca

SEQ ID NO: 52799 - DNA, 20 bp, Artificial Sequence
  Synthetic oligonucleotide; CAG chr11 5191878 5191897 5191881 -
ttaattggctcaaagttctt

SEQ ID NO: 52800 - DNA, 20 bp, Artificial Sequence
  Synthetic oligonucleotide; AGG chr11 5191877 5191896 5191880 -
taattggctcaaagttcttc

SEQ ID NO: 52801 - DNA, 20 bp, Artificial Sequence
  Synthetic oligonucleotide; AAG chr11 5191868 5191887 5191871 -
caaagttcttcaggctgtac

SEQ ID NO: 52802 - DNA, 20 bp, Artificial Sequence
  Synthetic oligonucleotide; AAG chr11 5191865 5191884 5191868 -
agttcttcaggctgtacaag

SEQ ID NO: 52803 - DNA, 20 bp, Artificial Sequence
  Synthetic oligonucleotide; TGG chr11 5191860 5191879 5191863 -
ttcaggctgtacaagaagca

SEQ ID NO: 52804 - DNA, 20 bp, Artificial Sequence
  Synthetic oligonucleotide; CAG chr11 5191857 5191876 5191860 -
aggctgtacaagaagcatgg

SEQ ID NO: 52805 - DNA, 20 bp, Artificial Sequence
  Synthetic oligonucleotide; CAG chr11 5191846 5191865 5191849 -
gaagcatggcagcatctgct

SEQ ID NO: 52806 - DNA, 20 bp, Artificial Sequence
  Synthetic oligonucleotide; TAG chr11 5191839 5191858 5191842 -
ggcagcatctgctcagcttc

SEQ ID NO: 52807 - DNA, 20 bp, Artificial Sequence
  Synthetic oligonucleotide; AGG chr11 5191838 5191857 5191841 -
gcagcatctgctcagcttct

SEQ ID NO: 52808 - DNA, 20 bp, Artificial Sequence
  Synthetic oligonucleotide; GGG chr11 5191837 5191856 5191840 -
cagcatctgctcagcttcta

SEQ ID NO: 52809 - DNA, 20 bp, Artificial Sequence
  Synthetic oligonucleotide; GAG chr11 5191835 5191854 5191838 -
gcatctgctcagcttctagg

SEQ ID NO: 52810 - DNA, 20 bp, Artificial Sequence
  Synthetic oligonucleotide; AAG chr11 5191827 5191846 5191830 -
tcagcttctagggagacctc

SEQ ID NO: 52811 - DNA, 20 bp, Artificial Sequence
  Synthetic oligonucleotide; TGG chr11 5191811 5191830 5191814 -
cctcaagaaacttacaatca

SEQ ID NO: 52812 - DNA, 20 bp, Artificial Sequence
  Synthetic oligonucleotide; CAG chr11 5191808 5191827 5191811 -
caagaaacttacaatcatgg

SEQ ID NO: 52813 - DNA, 20 bp, Artificial Sequence
  Synthetic oligonucleotide; AAG chr11 5191805 5191824 5191808 -
gaaacttacaatcatggcag

SEQ ID NO: 52814 - DNA, 20 bp, Artificial Sequence
  Synthetic oligonucleotide; AAG chr11 5191799 5191818 5191802 -
tacaatcatggcagaagaca

SEQ ID NO: 52815 - DNA, 20 bp, Artificial Sequence
  Synthetic oligonucleotide; CAG chr11 5191796 5191815 5191799 -
aatcatggcagaagacaaag

SEQ ID NO: 52816 - DNA, 20 bp, Artificial Sequence
  Synthetic oligonucleotide; AGG chr11 5191795 5191814 5191798 -
atcatggcagaagacaaagc

SEQ ID NO: 52817 - DNA, 20 bp, Artificial Sequence
  Synthetic oligonucleotide; GAG chr11 5191793 5191812 5191796 -
catggcagaagacaaagcag

SEQ ID NO: 52818 - DNA, 20 bp, Artificial Sequence
  Synthetic oligonucleotide; AAG chr11 5191789 5191808 5191792 -
gcagaagacaaagcaggagc

SEQ ID NO: 52819 - DNA, 20 bp, Artificial Sequence
  Synthetic oligonucleotide; TGG chr11 5191776 5191795 5191779 -
caggagcaagtatcttcaca

SEQ ID NO: 52820 - DNA, 20 bp, Artificial Sequence
  Synthetic oligonucleotide; CAG chr11 5191772 5191791 5191775 -
agcaagtatcttcacatggc

SEQ ID NO: 52821 - DNA, 20 bp, Artificial Sequence
  Synthetic oligonucleotide; AGG chr11 5191771 5191790 5191774 -
gcaagtatcttcacatggcc

SEQ ID NO: 52822 - DNA, 20 bp, Artificial Sequence
  Synthetic oligonucleotide; CAG chr11 5191767 5191786 5191770 -
gtatcttcacatggccagga

SEQ ID NO: 52823 - DNA, 20 bp, Artificial Sequence
  Synthetic oligonucleotide; AGG chr11 5191766 5191785 5191769 -
tatcttcacatggccaggac

SEQ ID NO: 52824 - DNA, 20 bp, Artificial Sequence
  Synthetic oligonucleotide; GGG chr11 5191765 5191784 5191768 -
atcttcacatggccaggaca

SEQ ID NO: 52825 - DNA, 20 bp, Artificial Sequence
  Synthetic oligonucleotide; GAG chr11 5191763 5191782 5191766 -
cttcacatggccaggacagg

SEQ ID NO: 52826 - DNA, 20 bp, Artificial Sequence
  Synthetic oligonucleotide; AAG chr11 5191760 5191779 5191763 -
cacatggccaggacagggag

SEQ ID NO: 52827 - DNA, 20 bp, Artificial Sequence
  Synthetic oligonucleotide; CAG chr11 5191757 5191776 5191760 -
atggccaggacagggagaag

SEQ ID NO: 52828 - DNA, 20 bp, Artificial Sequence
  Synthetic oligonucleotide; AGG chr11 5191756 5191775 5191759 -
tggccaggacagggagaagc

SEQ ID NO: 52829 - DNA, 20 bp, Artificial Sequence
  Synthetic oligonucleotide; GGG chr11 5191755 5191774 5191758 -
ggccaggacagggagaagca

SEQ ID NO: 52830 - DNA, 20 bp, Artificial Sequence
  Synthetic oligonucleotide; TAG chr11 5191752 5191771 5191755 -
caggacagggagaagcaggg

SEQ ID NO: 52831 - DNA, 20 bp, Artificial Sequence
  Synthetic oligonucleotide; AGG chr11 5191751 5191770 5191754 -
aggacagggagaagcagggt

SEQ ID NO: 52832 - DNA, 20 bp, Artificial Sequence
  Synthetic oligonucleotide; GAG chr11 5191749 5191768 5191752 -
gacagggagaagcagggtag

SEQ ID NO: 52833 - DNA, 20 bp, Artificial Sequence
  Synthetic oligonucleotide; AGG chr11 5191748 5191767 5191751 -
acagggagaagcagggtagg

SEQ ID NO: 52834 - DNA, 20 bp, Artificial Sequence
  Synthetic oligonucleotide; CAG chr11 5191724 5191743 5191727 -
gctacacactttcaaacaac

SEQ ID NO: 52835 - DNA, 20 bp, Artificial Sequence
  Synthetic oligonucleotide; GAG chr11 5191715 5191734 5191718 -
tttcaaacaaccagcctctt

SEQ ID NO: 52836 - DNA, 20 bp, Artificial Sequence
  Synthetic oligonucleotide; CAG chr11 5191701 5191720 5191704 -
cctcttgagaactcactata

SEQ ID NO: 52837 - DNA, 20 bp, Artificial Sequence
  Synthetic oligonucleotide; AAG chr11 5191694 5191713 5191697 -
agaactcactatacagtacc

SEQ ID NO: 52838 - DNA, 20 bp, Artificial Sequence
  Synthetic oligonucleotide; AGG chr11 5191693 5191712 5191696 -
gaactcactatacagtacca

SEQ ID NO: 52839 - DNA, 20 bp, Artificial Sequence
  Synthetic oligonucleotide; GGG chr11 5191692 5191711 5191695 -
aactcactatacagtaccaa

SEQ ID NO: 52840 - DNA, 20 bp, Artificial Sequence
  Synthetic oligonucleotide; GGG chr11 5191691 5191710 5191694 -
actcactatacagtaccaag

SEQ ID NO: 52841 - DNA, 20 bp, Artificial Sequence
  Synthetic oligonucleotide; GGG chr11 5191690 5191709 5191693 -
ctcactatacagtaccaagg

SEQ ID NO: 52842 - DNA, 20 bp, Artificial Sequence
  Synthetic oligonucleotide; TGG chr11 5191686 5191705 5191689 -
ctatacagtaccaaggggga

SEQ ID NO: 52843 - DNA, 20 bp, Artificial Sequence
  Synthetic oligonucleotide; GAG chr11 5191668 5191687 5191671 -
gatggtactaaatcgctgat

SEQ ID NO: 52844 - DNA, 20 bp, Artificial Sequence
  Synthetic oligonucleotide; AAG chr11 5191633 5191652 5191636 -
atgattgaattacctcccac

SEQ ID NO: 52845 - DNA, 20 bp, Artificial Sequence
  Synthetic oligonucleotide; AGG chr11 5191632 5191651 5191635 -
tgattgaattacctcccaca

SEQ ID NO: 52846 - DNA, 20 bp, Artificial Sequence
  Synthetic oligonucleotide; TGG chr11 5191614 5191633 5191617 -
caaggccccacctccaacgc

SEQ ID NO: 52847 - DNA, 20 bp, Artificial Sequence
  Synthetic oligonucleotide; TGG chr11 5191588 5191607 5191591 -
ttataatttaacatgatatt

SEQ ID NO: 52848 - DNA, 20 bp, Artificial Sequence
  Synthetic oligonucleotide; GGG chr11 5191587 5191606 5191590 -
tataatttaacatgatattt

SEQ ID NO: 52849 - DNA, 20 bp, Artificial Sequence
  Synthetic oligonucleotide; TGG chr11 5191584 5191603 5191587 -
aatttaacatgatatttggg

SEQ ID NO: 52850 - DNA, 20 bp, Artificial Sequence
  Synthetic oligonucleotide; CAG chr11 5191576 5191595 5191579 -
atgatatttgggtggtgaca

SEQ ID NO: 52851 - DNA, 20 bp, Artificial Sequence
  Synthetic oligonucleotide; TGG chr11 5191549 5191568 5191552 -
aaaccatatccttccacctc

SEQ ID NO: 52852 - DNA, 20 bp, Artificial Sequence
  Synthetic oligonucleotide; CAG chr11 5191490 5191509 5191493 -
atacaatcattacttcccaa

SEQ ID NO: 52853 - DNA, 20 bp, Artificial Sequence
  Synthetic oligonucleotide; AAG chr11 5191480 5191499 5191483 -
tacttcccaacagtcctaca

SEQ ID NO: 52854 - DNA, 20 bp, Artificial Sequence
  Synthetic oligonucleotide; CAG chr11 5191464 5191483 5191467 -
tacaaagtcttaactcattc

SEQ ID NO: 52855 - DNA, 20 bp, Artificial Sequence
  Synthetic oligonucleotide; AAG chr11 5191450 5191469 5191453 -
tcattccagcattaactcaa

SEQ ID NO: 52856 - DNA, 20 bp, Artificial Sequence
  Synthetic oligonucleotide; AAG chr11 5191443 5191462 5191446 -
agcattaactcaaaagtcca

SEQ ID NO: 52857 - DNA, 20 bp, Artificial Sequence
  Synthetic oligonucleotide; AAG chr11 5191436 5191455 5191439 -
actcaaaagtccaaagtcca

SEQ ID NO: 52858 - DNA, 20 bp, Artificial Sequence
  Synthetic oligonucleotide; AAG chr11 5191425 5191444 5191428 -
caaagtccaaagtcttatcc

SEQ ID NO: 52859 - DNA, 20 bp, Artificial Sequence
  Synthetic oligonucleotide; AAG chr11 5191420 5191439 5191423 -
tccaaagtcttatccaagac

SEQ ID NO: 52860 - DNA, 20 bp, Artificial Sequence
  Synthetic oligonucleotide; AGG chr11 5191419 5191438 5191422 -
ccaaagtcttatccaagaca

SEQ ID NO: 52861 - DNA, 20 bp, Artificial Sequence
  Synthetic oligonucleotide; AAG chr11 5191415 5191434 5191418 -
agtcttatccaagacaaggc

SEQ ID NO: 52862 - DNA, 20 bp, Artificial Sequence
  Synthetic oligonucleotide; GAG chr11 5191398 5191417 5191401 -
ggcaagtcccttcaacctat

SEQ ID NO: 52863 - DNA, 20 bp, Artificial Sequence
  Synthetic oligonucleotide; AAG chr11 5191378 5191397 5191381 -
gagcctgtaaaatcaaaaac

SEQ ID NO: 52864 - DNA, 20 bp, Artificial Sequence
  Synthetic oligonucleotide; TAG chr11 5191374 5191393 5191377 -
ctgtaaaatcaaaaacaagt

SEQ ID NO: 52865 - DNA, 20 bp, Artificial Sequence
  Synthetic oligonucleotide; AAG chr11 5191363 5191382 5191366 -
aaaacaagttagttacttcc

SEQ ID NO: 52866 - DNA, 20 bp, Artificial Sequence
  Synthetic oligonucleotide; TGG chr11 5191354 5191373 5191357 -
tagttacttccaagacataa

SEQ ID NO: 52867 - DNA, 20 bp, Artificial Sequence
  Synthetic oligonucleotide; GAG chr11 5191352 5191371 5191355 -
gttacttccaagacataatg

SEQ ID NO: 52868 - DNA, 20 bp, Artificial Sequence
  Synthetic oligonucleotide; AGG chr11 5191351 5191370 5191354 -
ttacttccaagacataatgg

SEQ ID NO: 52869 - DNA, 20 bp, Artificial Sequence
  Synthetic oligonucleotide; TGG chr11 5191345 5191364 5191348 -
ccaagacataatggaggtac

SEQ ID NO: 52870 - DNA, 20 bp, Artificial Sequence
  Synthetic oligonucleotide; TGG chr11 5191339 5191358 5191342 -
cataatggaggtactggcat

SEQ ID NO: 52871 - DNA, 20 bp, Artificial Sequence
  Synthetic oligonucleotide; GGG chr11 5191338 5191357 5191341 -
ataatggaggtactggcatt

SEQ ID NO: 52872 - DNA, 20 bp, Artificial Sequence
  Synthetic oligonucleotide; AAG chr11 5191317 5191336 5191320 -
ggtacaaattcccattccaa

SEQ ID NO: 52873 - DNA, 20 bp, Artificial Sequence
  Synthetic oligonucleotide; GAG chr11 5191315 5191334 5191318 -
tacaaattcccattccaaaa

SEQ ID NO: 52874 - DNA, 20 bp, Artificial Sequence
  Synthetic oligonucleotide; GAG chr11 5191313 5191332 5191316 -
caaattcccattccaaaaga

SEQ ID NO: 52875 - DNA, 20 bp, Artificial Sequence
  Synthetic oligonucleotide; AAG chr11 5191299 5191318 5191302 -
aaaagagagaaatgcaccaa

SEQ ID NO: 52876 - DNA, 20 bp, Artificial Sequence
  Synthetic oligonucleotide; AAG chr11 5191295 5191314 5191298 -
gagagaaatgcaccaaaaga

SEQ ID NO: 52877 - DNA, 20 bp, Artificial Sequence
  Synthetic oligonucleotide; AGG chr11 5191294 5191313 5191297 -
agagaaatgcaccaaaagaa

SEQ ID NO: 52878 - DNA, 20 bp, Artificial Sequence
  Synthetic oligonucleotide; GGG chr11 5191293 5191312 5191296 -
gagaaatgcaccaaaagaaa

SEQ ID NO: 52879 - DNA, 20 bp, Artificial Sequence
  Synthetic oligonucleotide; GGG chr11 5191292 5191311 5191295 -
agaaatgcaccaaaagaaag

SEQ ID NO: 52880 - DNA, 20 bp, Artificial Sequence
  Synthetic oligonucleotide; AAG chr11 5191286 5191305 5191289 -
gcaccaaaagaaaggggcta

SEQ ID NO: 52881 - DNA, 20 bp, Artificial Sequence
  Synthetic oligonucleotide; GAG chr11 5191274 5191293 5191277 -
aggggctaaagatcccacac

SEQ ID NO: 52882 - DNA, 20 bp, Artificial Sequence
  Synthetic oligonucleotide; TAG chr11 5191271 5191290 5191274 -
ggctaaagatcccacacgag

SEQ ID NO: 52883 - DNA, 20 bp, Artificial Sequence
  Synthetic oligonucleotide; CAG chr11 5191262 5191281 5191265 -
tcccacacgagtagaaaacc

SEQ ID NO: 52884 - DNA, 20 bp, Artificial Sequence
  Synthetic oligonucleotide; CAG chr11 5191259 5191278 5191262 -
cacacgagtagaaaacccag

SEQ ID NO: 52885 - DNA, 20 bp, Artificial Sequence
  Synthetic oligonucleotide; AGG chr11 5191258 5191277 5191261 -
acacgagtagaaaacccagc

SEQ ID NO: 52886 - DNA, 20 bp, Artificial Sequence
  Synthetic oligonucleotide; GGG chr11 5191257 5191276 5191260 -
cacgagtagaaaacccagca

SEQ ID NO: 52887 - DNA, 20 bp, Artificial Sequence
  Synthetic oligonucleotide; CAG chr11 5191254 5191273 5191257 -
gagtagaaaacccagcaggg

SEQ ID NO: 52888 - DNA, 20 bp, Artificial Sequence
  Synthetic oligonucleotide; TGG chr11 5191235 5191254 5191238 -
gcagtcattacaccttgata

SEQ ID NO: 52889 - DNA, 20 bp, Artificial Sequence
  Synthetic oligonucleotide; TGG chr11 5191230 5191249 5191233 -
cattacaccttgatatggtt

SEQ ID NO: 52890 - DNA, 20 bp, Artificial Sequence
  Synthetic oligonucleotide; CAG chr11 5191227 5191246 5191230 -
tacaccttgatatggtttgg

SEQ ID NO: 52891 - DNA, 20 bp, Artificial Sequence
  Synthetic oligonucleotide; TAG chr11 5191198 5191217 5191201 -
cacccaaatttcttcttgaa

SEQ ID NO: 52892 - DNA, 20 bp, Artificial Sequence
  Synthetic oligonucleotide; TAG chr11 5191195 5191214 5191198 -
ccaaatttcttcttgaatag

SEQ ID NO: 52893 - DNA, 20 bp, Artificial Sequence
  Synthetic oligonucleotide; AGG chr11 5191194 5191213 5191197 -
caaatttcttcttgaatagt

SEQ ID NO: 52894 - DNA, 20 bp, Artificial Sequence
  Synthetic oligonucleotide; TGG chr11 5191170 5191189 5191173 -
cccataatccctgcctgtca

SEQ ID NO: 52895 - DNA, 20 bp, Artificial Sequence
  Synthetic oligonucleotide; AAG chr11 5191167 5191186 5191170 -
ataatccctgcctgtcatgg

SEQ ID NO: 52896 - DNA, 20 bp, Artificial Sequence
  Synthetic oligonucleotide; AGG chr11 5191166 5191185 5191169 -
taatccctgcctgtcatgga

SEQ ID NO: 52897 - DNA, 20 bp, Artificial Sequence
  Synthetic oligonucleotide; TGG chr11 5191156 5191175 5191159 -
ctgtcatggaaggaacacac

SEQ ID NO: 52898 - DNA, 20 bp, Artificial Sequence
  Synthetic oligonucleotide; GGG chr11 5191155 5191174 5191158 -
tgtcatggaaggaacacact

SEQ ID NO: 52899 - DNA, 20 bp, Artificial Sequence
  Synthetic oligonucleotide; TGG chr11 5191138 5191157 5191141 -
actgggatgtaattgaatca

SEQ ID NO: 52900 - DNA, 20 bp, Artificial Sequence
  Synthetic oligonucleotide; GGG chr11 5191137 5191156 5191140 -
ctgggatgtaattgaatcat

SEQ ID NO: 52901 - DNA, 20 bp, Artificial Sequence
  Synthetic oligonucleotide; GGG chr11 5191136 5191155 5191139 -
tgggatgtaattgaatcatg

SEQ ID NO: 52902 - DNA, 20 bp, Artificial Sequence
  Synthetic oligonucleotide; GGG chr11 5191135 5191154 5191138 -
gggatgtaattgaatcatgg

SEQ ID NO: 52903 - DNA, 20 bp, Artificial Sequence
  Synthetic oligonucleotide; TAG chr11 5191132 5191151 5191135 -
atgtaattgaatcatggggg

SEQ ID NO: 52904 - DNA, 20 bp, Artificial Sequence
  Synthetic oligonucleotide; AGG chr11 5191131 5191150 5191134 -
tgtaattgaatcatgggggt

SEQ ID NO: 52905 - DNA, 20 bp, Artificial Sequence
  Synthetic oligonucleotide; TAG chr11 5191105 5191124 5191108 -
ttcacatgctgttctcatga

SEQ ID NO: 52906 - DNA, 20 bp, Artificial Sequence
  Synthetic oligonucleotide; GAG chr11 5191101 5191120 5191104 -
catgctgttctcatgatagt

SEQ ID NO: 52907 - DNA, 20 bp, Artificial Sequence
  Synthetic oligonucleotide; AAG chr11 5191097 5191116 5191100 -
ctgttctcatgatagtgagt

SEQ ID NO: 52908 - DNA, 20 bp, Artificial Sequence
  Synthetic oligonucleotide; AAG chr11 5191088 5191107 5191091 -
tgatagtgagtaagtctcac

SEQ ID NO: 52909 - DNA, 20 bp, Artificial Sequence
  Synthetic oligonucleotide; TGG chr11 5191079 5191098 5191082 -
gtaagtctcacaagatctga

SEQ ID NO: 52910 - DNA, 20 bp, Artificial Sequence
  Synthetic oligonucleotide; AAG chr11 5191069 5191088 5191072 -
caagatctgatggttttata

SEQ ID NO: 52911 - DNA, 20 bp, Artificial Sequence
  Synthetic oligonucleotide; AGG chr11 5191068 5191087 5191071 -
aagatctgatggttttataa

SEQ ID NO: 52912 - DNA, 20 bp, Artificial Sequence
  Synthetic oligonucleotide; GGG chr11 5191067 5191086 5191070 -
agatctgatggttttataaa

SEQ ID NO: 52913 - DNA, 20 bp, Artificial Sequence
  Synthetic oligonucleotide; CAG chr11 5191026 5191045 5191029 -
tctcttgcctgccaccatgt

SEQ ID NO: 52914 - DNA, 20 bp, Artificial Sequence
  Synthetic oligonucleotide; AAG chr11 5190984 5191003 5190987 -
tcaccttccaccatgattgt

SEQ ID NO: 52915 - DNA, 20 bp, Artificial Sequence
  Synthetic oligonucleotide; AGG chr11 5190983 5191002 5190986 -
caccttccaccatgattgta

SEQ ID NO: 52916 - DNA, 20 bp, Artificial Sequence
  Synthetic oligonucleotide; CAG chr11 5190974 5190993 5190977 -
ccatgattgtaaggcctccc

SEQ ID NO: 52917 - DNA, 20 bp, Artificial Sequence
  Synthetic oligonucleotide; TGG chr11 5190966 5190985 5190969 -
gtaaggcctccccagcaatg

SEQ ID NO: 52918 - DNA, 20 bp, Artificial Sequence
  Synthetic oligonucleotide; GAG chr11 5190957 5190976 5190960 -
ccccagcaatgtggatctat

SEQ ID NO: 52919 - DNA, 20 bp, Artificial Sequence
  Synthetic oligonucleotide; CAG chr11 5190922 5190941 5190925 -
ctttttctttataaattacc

SEQ ID NO: 52920 - DNA, 20 bp, Artificial Sequence
  Synthetic oligonucleotide; CGG chr11 5190916 5190935 5190919 -
ctttataaattacccagtct

SEQ ID NO: 52921 - DNA, 20 bp, Artificial Sequence
  Synthetic oligonucleotide; GGG chr11 5190915 5190934 5190918 -
tttataaattacccagtctc

SEQ ID NO: 52922 - DNA, 20 bp, Artificial Sequence
  Synthetic oligonucleotide; TAG chr11 5190902 5190921 5190905 -
cagtctcgggtatttcttca

SEQ ID NO: 52923 - DNA, 20 bp, Artificial Sequence
  Synthetic oligonucleotide; CAG chr11 5190899 5190918 5190902 -
tctcgggtatttcttcatag

SEQ ID NO: 52924 - DNA, 20 bp, Artificial Sequence
  Synthetic oligonucleotide; CGG chr11 5190889 5190908 5190892 -
ttcttcatagcagtttaaaa

SEQ ID NO: 52925 - DNA, 20 bp, Artificial Sequence
  Synthetic oligonucleotide; CAG chr11 5190831 5190850 5190834 -
tttgaccccatgtctcatat

SEQ ID NO: 52926 - DNA, 20 bp, Artificial Sequence
  Synthetic oligonucleotide; AGG chr11 5190830 5190849 5190833 -
ttgaccccatgtctcatatc

SEQ ID NO: 52927 - DNA, 20 bp, Artificial Sequence
  Synthetic oligonucleotide; GGG chr11 5190829 5190848 5190832 -
tgaccccatgtctcatatca

SEQ ID NO: 52928 - DNA, 20 bp, Artificial Sequence
  Synthetic oligonucleotide; AAG chr11 5190814 5190833 5190817 -
tatcagggacacactgatgc

SEQ ID NO: 52929 - DNA, 20 bp, Artificial Sequence
  Synthetic oligonucleotide; GAG chr11 5190812 5190831 5190815 -
tcagggacacactgatgcaa

SEQ ID NO: 52930 - DNA, 20 bp, Artificial Sequence
  Synthetic oligonucleotide; AGG chr11 5190811 5190830 5190814 -
cagggacacactgatgcaag

SEQ ID NO: 52931 - DNA, 20 bp, Artificial Sequence
  Synthetic oligonucleotide; TGG chr11 5190808 5190827 5190811 -
ggacacactgatgcaagagg

SEQ ID NO: 52932 - DNA, 20 bp, Artificial Sequence
  Synthetic oligonucleotide; GGG chr11 5190807 5190826 5190810 -
gacacactgatgcaagaggt

SEQ ID NO: 52933 - DNA, 20 bp, Artificial Sequence
  Synthetic oligonucleotide; AAG chr11 5190799 5190818 5190802 -
gatgcaagaggtgggctccc

SEQ ID NO: 52934 - DNA, 20 bp, Artificial Sequence
  Synthetic oligonucleotide; AGG chr11 5190798 5190817 5190801 -
atgcaagaggtgggctccca

SEQ ID NO: 52935 - DNA, 20 bp, Artificial Sequence
  Synthetic oligonucleotide; TGG chr11 5190792 5190811 5190795 -
gaggtgggctcccaaggcct

SEQ ID NO: 52936 - DNA, 20 bp, Artificial Sequence
  Synthetic oligonucleotide; GGG chr11 5190791 5190810 5190794 -
aggtgggctcccaaggcctt

SEQ ID NO: 52937 - DNA, 20 bp, Artificial Sequence
  Synthetic oligonucleotide; CAG chr11 5190788 5190807 5190791 -
tgggctcccaaggccttggg

SEQ ID NO: 52938 - DNA, 20 bp, Artificial Sequence
  Synthetic oligonucleotide; CAG chr11 5190764 5190783 5190767 -
tccacccctattgctttgca

SEQ ID NO: 52939 - DNA, 20 bp, Artificial Sequence
  Synthetic oligonucleotide; TAG chr11 5190759 5190778 5190762 -
ccctattgctttgcacagtt

SEQ ID NO: 52940 - DNA, 20 bp, Artificial Sequence
  Synthetic oligonucleotide; AAG chr11 5190739 5190758 5190742 -
tagcccctgctgctgctctt

SEQ ID NO: 52941 - DNA, 20 bp, Artificial Sequence
  Synthetic oligonucleotide; GAG chr11 5190737 5190756 5190740 -
gcccctgctgctgctcttaa

SEQ ID NO: 52942 - DNA, 20 bp, Artificial Sequence
  Synthetic oligonucleotide; GAG chr11 5190726 5190745 5190729 -
tgctcttaagagattgtatt

SEQ ID NO: 52943 - DNA, 20 bp, Artificial Sequence
  Synthetic oligonucleotide; CAG chr11 5190717 5190736 5190720 -
gagattgtattgagtgtttg

SEQ ID NO: 52944 - DNA, 20 bp, Artificial Sequence
  Synthetic oligonucleotide; TAG chr11 5190708 5190727 5190711 -
ttgagtgtttgcagcttttc

SEQ ID NO: 52945 - DNA, 20 bp, Artificial Sequence
  Synthetic oligonucleotide; AGG chr11 5190707 5190726 5190710 -
tgagtgtttgcagcttttct

SEQ ID NO: 52946 - DNA, 20 bp, Artificial Sequence
  Synthetic oligonucleotide; CGG chr11 5190700 5190719 5190703 -
ttgcagcttttctaggtgca

SEQ ID NO: 52947 - DNA, 20 bp, Artificial Sequence
  Synthetic oligonucleotide; CAG chr11 5190687 5190706 5190690 -
aggtgcacggtgcaaactgt

SEQ ID NO: 52948 - DNA, 20 bp, Artificial Sequence
  Synthetic oligonucleotide; TGG chr11 5190684 5190703 5190687 -
tgcacggtgcaaactgtcag

SEQ ID NO: 52949 - DNA, 20 bp, Artificial Sequence
  Synthetic oligonucleotide; TGG chr11 5190670 5190689 5190673 -
tgtcagtggatctaccattc

SEQ ID NO: 52950 - DNA, 20 bp, Artificial Sequence
  Synthetic oligonucleotide; GGG chr11 5190669 5190688 5190672 -
gtcagtggatctaccattct

SEQ ID NO: 52951 - DNA, 20 bp, Artificial Sequence
  Synthetic oligonucleotide; GGG chr11 5190668 5190687 5190671 -
tcagtggatctaccattctg

SEQ ID NO: 52952 - DNA, 20 bp, Artificial Sequence
  Synthetic oligonucleotide; TGG chr11 5190663 5190682 5190666 -
ggatctaccattctggggtc

SEQ ID NO: 52953 - DNA, 20 bp, Artificial Sequence
  Synthetic oligonucleotide; GAG chr11 5190661 5190680 5190664 -
atctaccattctggggtctg

SEQ ID NO: 52954 - DNA, 20 bp, Artificial Sequence
  Synthetic oligonucleotide; AGG chr11 5190660 5190679 5190663 -
tctaccattctggggtctgg

SEQ ID NO: 52955 - DNA, 20 bp, Artificial Sequence
  Synthetic oligonucleotide; CGG chr11 5190656 5190675 5190659 -
ccattctggggtctggagga

SEQ ID NO: 52956 - DNA, 20 bp, Artificial Sequence
  Synthetic oligonucleotide; TGG chr11 5190653 5190672 5190656 -
ttctggggtctggaggacgg

SEQ ID NO: 52957 - DNA, 20 bp, Artificial Sequence
  Synthetic oligonucleotide; TAG chr11 5190639 5190658 5190642 -
ggacggtggcccttttctca

SEQ ID NO: 52958 - DNA, 20 bp, Artificial Sequence
  Synthetic oligonucleotide; TAG chr11 5190630 5190649 5190633 -
cccttttctcatagctctgc

SEQ ID NO: 52959 - DNA, 20 bp, Artificial Sequence
  Synthetic oligonucleotide; AGG chr11 5190629 5190648 5190632 -
ccttttctcatagctctgct

SEQ ID NO: 52960 - DNA, 20 bp, Artificial Sequence
  Synthetic oligonucleotide; CAG chr11 5190626 5190645 5190629 -
tttctcatagctctgctagg

SEQ ID NO: 52961 - DNA, 20 bp, Artificial Sequence
  Synthetic oligonucleotide; CAG chr11 5190618 5190637 5190621 -
agctctgctaggcagtgccc

SEQ ID NO: 52962 - DNA, 20 bp, Artificial Sequence
  Synthetic oligonucleotide; TGG chr11 5190615 5190634 5190618 -
tctgctaggcagtgccccag

SEQ ID NO: 52963 - DNA, 20 bp, Artificial Sequence
  Synthetic oligonucleotide; GAG chr11 5190613 5190632 5190616 -
tgctaggcagtgccccagtg

SEQ ID NO: 52964 - DNA, 20 bp, Artificial Sequence
  Synthetic oligonucleotide; GAG chr11 5190603 5190622 5190606 -
tgccccagtggagactctgt

SEQ ID NO: 52965 - DNA, 20 bp, Artificial Sequence
  Synthetic oligonucleotide; AGG chr11 5190602 5190621 5190605 -
gccccagtggagactctgtg

SEQ ID NO: 52966 - DNA, 20 bp, Artificial Sequence
  Synthetic oligonucleotide; GGG chr11 5190601 5190620 5190604 -
ccccagtggagactctgtga

SEQ ID NO: 52967 - DNA, 20 bp, Artificial Sequence
  Synthetic oligonucleotide; GGG chr11 5190600 5190619 5190603 -
cccagtggagactctgtgag

SEQ ID NO: 52968 - DNA, 20 bp, Artificial Sequence
  Synthetic oligonucleotide; GGG chr11 5190599 5190618 5190602 -
ccagtggagactctgtgagg

SEQ ID NO: 52969 - DNA, 20 bp, Artificial Sequence
  Synthetic oligonucleotide; TAG chr11 5190561 5190580 5190564 -
tttcctccacattgccctat

SEQ ID NO: 52970 - DNA, 20 bp, Artificial Sequence
  Synthetic oligonucleotide; GAG chr11 5190559 5190578 5190562 -
tcctccacattgccctatta

SEQ ID NO: 52971 - DNA, 20 bp, Artificial Sequence
  Synthetic oligonucleotide; AGG chr11 5190558 5190577 5190561 -
cctccacattgccctattag

SEQ ID NO: 52972 - DNA, 20 bp, Artificial Sequence
  Synthetic oligonucleotide; GAG chr11 5190547 5190566 5190550 -
ccctattagaggttcttcat

SEQ ID NO: 52973 - DNA, 20 bp, Artificial Sequence
  Synthetic oligonucleotide; AGG chr11 5190546 5190565 5190549 -
cctattagaggttcttcatg

SEQ ID NO: 52974 - DNA, 20 bp, Artificial Sequence
  Synthetic oligonucleotide; GGG chr11 5190545 5190564 5190548 -
ctattagaggttcttcatga

SEQ ID NO: 52975 - DNA, 20 bp, Artificial Sequence
  Synthetic oligonucleotide; CAG chr11 5190531 5190550 5190534 -
tcatgagggttctgcccctg

SEQ ID NO: 52976 - DNA, 20 bp, Artificial Sequence
  Synthetic oligonucleotide; AGG chr11 5190530 5190549 5190533 -
catgagggttctgcccctgc

SEQ ID NO: 52977 - DNA, 20 bp, Artificial Sequence
  Synthetic oligonucleotide; GAG chr11 5190528 5190547 5190531 -
tgagggttctgcccctgcag

SEQ ID NO: 52978 - DNA, 20 bp, Artificial Sequence
  Synthetic oligonucleotide; AGG chr11 5190527 5190546 5190530 -
gagggttctgcccctgcagg

SEQ ID NO: 52979 - DNA, 20 bp, Artificial Sequence
  Synthetic oligonucleotide; CAG chr11 5190508 5190527 5190511 -
gaggcttctgcctgaacact

SEQ ID NO: 52980 - DNA, 20 bp, Artificial Sequence
  Synthetic oligonucleotide; AGG chr11 5190507 5190526 5190510 -
aggcttctgcctgaacactc

SEQ ID NO: 52981 - DNA, 20 bp, Artificial Sequence
  Synthetic oligonucleotide; TAG chr11 5190480 5190499 5190483 -
tctacacatcctctgaaatc

SEQ ID NO: 52982 - DNA, 20 bp, Artificial Sequence
  Synthetic oligonucleotide; AGG chr11 5190479 5190498 5190482 -
ctacacatcctctgaaatct

SEQ ID NO: 52983 - DNA, 20 bp, Artificial Sequence
  Synthetic oligonucleotide; TGG chr11 5190476 5190495 5190479 -
cacatcctctgaaatctagg

SEQ ID NO: 52984 - DNA, 20 bp, Artificial Sequence
  Synthetic oligonucleotide; GAG chr11 5190474 5190493 5190477 -
catcctctgaaatctaggtg

SEQ ID NO: 52985 - DNA, 20 bp, Artificial Sequence
  Synthetic oligonucleotide; AGG chr11 5190473 5190492 5190476 -
atcctctgaaatctaggtgg

SEQ ID NO: 52986 - DNA, 20 bp, Artificial Sequence
  Synthetic oligonucleotide; AAG chr11 5190465 5190484 5190468 -
aaatctaggtggaggcttac

SEQ ID NO: 52987 - DNA, 20 bp, Artificial Sequence
  Synthetic oligonucleotide; CAG chr11 5190434 5190453 5190437 -
ttttgacctttgcacactcc

SEQ ID NO: 52988 - DNA, 20 bp, Artificial Sequence
  Synthetic oligonucleotide; TGG chr11 5190418 5190437 5190421 -
ctcccagatttatcaccatg

SEQ ID NO: 52989 - DNA, 20 bp, Artificial Sequence
  Synthetic oligonucleotide; AAG chr11 5190415 5190434 5190418 -
ccagatttatcaccatgtgg

SEQ ID NO: 52990 - DNA, 20 bp, Artificial Sequence
  Synthetic oligonucleotide; AAG chr11 5190407 5190426 5190410 -
atcaccatgtggaagcctcc

SEQ ID NO: 52991 - DNA, 20 bp, Artificial Sequence
  Synthetic oligonucleotide; AGG chr11 5190406 5190425 5190409 -
tcaccatgtggaagcctcca

SEQ ID NO: 52992 - DNA, 20 bp, Artificial Sequence
  Synthetic oligonucleotide; AAG chr11 5190383 5190402 5190386 -
cttatgtcttgcaccctctg

SEQ ID NO: 52993 - DNA, 20 bp, Artificial Sequence
  Synthetic oligonucleotide; CAG chr11 5190380 5190399 5190383 -
atgtcttgcaccctctgaag

SEQ ID NO: 52994 - DNA, 20 bp, Artificial Sequence
  Synthetic oligonucleotide; TGG chr11 5190377 5190396 5190380 -
tcttgcaccctctgaagcag

SEQ ID NO: 52995 - DNA, 20 bp, Artificial Sequence
  Synthetic oligonucleotide; TAG chr11 5190371 5190390 5190374 -
accctctgaagcagtggcct

SEQ ID NO: 52996 - DNA, 20 bp, Artificial Sequence
  Synthetic oligonucleotide; TGG chr11 5190361 5190380 5190364 -
gcagtggccttagctgttct

SEQ ID NO: 52997 - DNA, 20 bp, Artificial Sequence
  Synthetic oligonucleotide; GGG chr11 5190360 5190379 5190363 -
cagtggccttagctgttctt

SEQ ID NO: 52998 - DNA, 20 bp, Artificial Sequence
  Synthetic oligonucleotide; GAG chr11 5190350 5190369 5190353 -
agctgttcttgggccccttt

SEQ ID NO: 52999 - DNA, 20 bp, Artificial Sequence
  Synthetic oligonucleotide; CAG chr11 5190344 5190363 5190347 -
tcttgggcccctttgagcca

SEQ ID NO: 53000 - DNA, 20 bp, Artificial Sequence
  Synthetic oligonucleotide; TGG chr11 5190340 5190359 5190343 -
gggcccctttgagccacagc

SEQ ID NO: 53001 - DNA, 20 bp, Artificial Sequence
  Synthetic oligonucleotide; TGG chr11 5190334 5190353 5190337 -
ctttgagccacagctggtgc

SEQ ID NO: 53002 - DNA, 20 bp, Artificial Sequence
  Synthetic oligonucleotide; GAG chr11 5190332 5190351 5190335 -
ttgagccacagctggtgctg

SEQ ID NO: 53003 - DNA, 20 bp, Artificial Sequence
  Synthetic oligonucleotide; CAG chr11 5190329 5190348 5190332 -
agccacagctggtgctggag

SEQ ID NO: 53004 - DNA, 20 bp, Artificial Sequence
  Synthetic oligonucleotide; CAG chr11 5190325 5190344 5190328 -
acagctggtgctggagcagc

SEQ ID NO: 53005 - DNA, 20 bp, Artificial Sequence
  Synthetic oligonucleotide; AGG chr11 5190324 5190343 5190327 -
cagctggtgctggagcagcc

SEQ ID NO: 53006 - DNA, 20 bp, Artificial Sequence
  Synthetic oligonucleotide; AAG chr11 5190317 5190336 5190320 -
tgctggagcagccaggatgc

SEQ ID NO: 53007 - DNA, 20 bp, Artificial Sequence
  Synthetic oligonucleotide; AGG chr11 5190316 5190335 5190319 -
gctggagcagccaggatgca

SEQ ID NO: 53008 - DNA, 20 bp, Artificial Sequence
  Synthetic oligonucleotide; CAG chr11 5190311 5190330 5190314 -
agcagccaggatgcaaggaa

SEQ ID NO: 53009 - DNA, 20 bp, Artificial Sequence
  Synthetic oligonucleotide; AAG chr11 5190301 5190320 5190304 -
atgcaaggaacagtgtcctg

SEQ ID NO: 53010 - DNA, 20 bp, Artificial Sequence
  Synthetic oligonucleotide; AAG chr11 5190292 5190311 5190295 -
acagtgtcctgaagctgctc

SEQ ID NO: 53011 - DNA, 20 bp, Artificial Sequence
  Synthetic oligonucleotide; AGG chr11 5190291 5190310 5190294 -
cagtgtcctgaagctgctca

SEQ ID NO: 53012 - DNA, 20 bp, Artificial Sequence
  Synthetic oligonucleotide; CAG chr11 5190288 5190307 5190291 -
tgtcctgaagctgctcaagg

SEQ ID NO: 53013 - DNA, 20 bp, Artificial Sequence
  Synthetic oligonucleotide; CAG chr11 5190285 5190304 5190288 -
cctgaagctgctcaaggcag

SEQ ID NO: 53014 - DNA, 20 bp, Artificial Sequence
  Synthetic oligonucleotide; AGG chr11 5190284 5190303 5190287 -
ctgaagctgctcaaggcagc

SEQ ID NO: 53015 - DNA, 20 bp, Artificial Sequence
  Synthetic oligonucleotide; GGG chr11 5190283 5190302 5190286 -
tgaagctgctcaaggcagca

SEQ ID NO: 53016 - DNA, 20 bp, Artificial Sequence
  Synthetic oligonucleotide; CAG chr11 5190254 5190273 5190257 -
atctcacccacaaaatcatt

SEQ ID NO: 53017 - DNA, 20 bp, Artificial Sequence
  Synthetic oligonucleotide; TAG chr11 5190245 5190264 5190248 -
acaaaatcattcagtactcc

SEQ ID NO: 53018 - DNA, 20 bp, Artificial Sequence
  Synthetic oligonucleotide; AGG chr11 5190244 5190263 5190247 -
caaaatcattcagtactcct

SEQ ID NO: 53019 - DNA, 20 bp, Artificial Sequence
  Synthetic oligonucleotide; CAG chr11 5190237 5190256 5190240 -
attcagtactcctaggccac

SEQ ID NO: 53020 - DNA, 20 bp, Artificial Sequence
  Synthetic oligonucleotide; AGG chr11 5190236 5190255 5190239 -
ttcagtactcctaggccacc

SEQ ID NO: 53021 - DNA, 20 bp, Artificial Sequence
  Synthetic oligonucleotide; GAG chr11 5190223 5190242 5190226 -
ggccaccaggcctgtgatgt

SEQ ID NO: 53022 - DNA, 20 bp, Artificial Sequence
  Synthetic oligonucleotide; AGG chr11 5190222 5190241 5190225 -
gccaccaggcctgtgatgtg

SEQ ID NO: 53023 - DNA, 20 bp, Artificial Sequence
  Synthetic oligonucleotide; GGG chr11 5190221 5190240 5190224 -
ccaccaggcctgtgatgtga

SEQ ID NO: 53024 - DNA, 20 bp, Artificial Sequence
  Synthetic oligonucleotide; GGG chr11 5190220 5190239 5190223 -
caccaggcctgtgatgtgag

SEQ ID NO: 53025 - DNA, 20 bp, Artificial Sequence
  Synthetic oligonucleotide; AAG chr11 5190210 5190229 5190213 -
gtgatgtgaggggctgctac

SEQ ID NO: 53026 - DNA, 20 bp, Artificial Sequence
  Synthetic oligonucleotide; AGG chr11 5190209 5190228 5190212 -
tgatgtgaggggctgctaca

SEQ ID NO: 53027 - DNA, 20 bp, Artificial Sequence
  Synthetic oligonucleotide; GGG chr11 5190208 5190227 5190211 -
gatgtgaggggctgctacaa

SEQ ID NO: 53028 - DNA, 20 bp, Artificial Sequence
  Synthetic oligonucleotide; GAG chr11 5190189 5190208 5190192 -
agggtctctgaaatgtcttt

SEQ ID NO: 53029 - DNA, 20 bp, Artificial Sequence
  Synthetic oligonucleotide; AGG chr11 5190188 5190207 5190191 -
gggtctctgaaatgtctttg

SEQ ID NO: 53030 - DNA, 20 bp, Artificial Sequence
  Synthetic oligonucleotide; TGG chr11 5190168 5190187 5190171 -
aggcattctcccctttattt

SEQ ID NO: 53031 - DNA, 20 bp, Artificial Sequence
  Synthetic oligonucleotide; TAG chr11 5190161 5190180 5190164 -
ctcccctttattttggctat

SEQ ID NO: 53032 - DNA, 20 bp, Artificial Sequence
  Synthetic oligonucleotide; CGG chr11 5190154 5190173 5190157 -
ttattttggctattagaact

SEQ ID NO: 53033 - DNA, 20 bp, Artificial Sequence
  Synthetic oligonucleotide; CAG chr11 5190125 5190144 5190128 -
ttcatttatgcaaatttcta

SEQ ID NO: 53034 - DNA, 20 bp, Artificial Sequence
  Synthetic oligonucleotide; GAG chr11 5190096 5190115 5190099 -
tgaattgctcctttgaaaat

SEQ ID NO: 53035 - DNA, 20 bp, Artificial Sequence
  Synthetic oligonucleotide; TGG chr11 5190075 5190094 5190078 -
agcttctgttttctaccaca

SEQ ID NO: 53036 - DNA, 20 bp, Artificial Sequence
  Synthetic oligonucleotide; GAG chr11 5190070 5190089 5190073 -
ctgttttctaccacatggcc

SEQ ID NO: 53037 - DNA, 20 bp, Artificial Sequence
  Synthetic oligonucleotide; CAG chr11 5190067 5190086 5190070 -
ttttctaccacatggccgag

SEQ ID NO: 53038 - DNA, 20 bp, Artificial Sequence
  Synthetic oligonucleotide; AAG chr11 5190022 5190041 5190025 -
tctgcttcccttttaaatat

SEQ ID NO: 53039 - DNA, 20 bp, Artificial Sequence
  Synthetic oligonucleotide; GAG chr11 5189984 5190003 5189987 -
atttctttgctcacacatat

SEQ ID NO: 53040 - DNA, 20 bp, Artificial Sequence
  Synthetic oligonucleotide; TAG chr11 5189979 5189998 5189982 -
tttgctcacacatatgagca

SEQ ID NO: 53041 - DNA, 20 bp, Artificial Sequence
  Synthetic oligonucleotide; AGG chr11 5189978 5189997 5189981 -
ttgctcacacatatgagcat

SEQ ID NO: 53042 - DNA, 20 bp, Artificial Sequence
  Synthetic oligonucleotide; TAG chr11 5189971 5189990 5189974 -
cacatatgagcataggttgt

SEQ ID NO: 53043 - DNA, 20 bp, Artificial Sequence
  Synthetic oligonucleotide; AAG chr11 5189968 5189987 5189971 -
atatgagcataggttgttag

SEQ ID NO: 53044 - DNA, 20 bp, Artificial Sequence
  Synthetic oligonucleotide; CAG chr11 5189965 5189984 5189968 -
tgagcataggttgttagaag

SEQ ID NO: 53045 - DNA, 20 bp, Artificial Sequence
  Synthetic oligonucleotide; CAG chr11 5189961 5189980 5189964 -
cataggttgttagaagcagc

SEQ ID NO: 53046 - DNA, 20 bp, Artificial Sequence
  Synthetic oligonucleotide; AGG chr11 5189960 5189979 5189963 -
ataggttgttagaagcagcc

SEQ ID NO: 53047 - DNA, 20 bp, Artificial Sequence
  Synthetic oligonucleotide; TAG chr11 5189933 5189952 5189936 -
atcttgaacaccttgctgct

SEQ ID NO: 53048 - DNA, 20 bp, Artificial Sequence
  Synthetic oligonucleotide; CAG chr11 5189882 5189901 5189885 -
ttatcaacttcgaatttcca

SEQ ID NO: 53049 - DNA, 20 bp, Artificial Sequence
  Synthetic oligonucleotide; AAG chr11 5189872 5189891 5189875 -
cgaatttccacagattctct

SEQ ID NO: 53050 - DNA, 20 bp, Artificial Sequence
  Synthetic oligonucleotide; AGG chr11 5189871 5189890 5189874 -
gaatttccacagattctcta

SEQ ID NO: 53051 - DNA, 20 bp, Artificial Sequence
  Synthetic oligonucleotide; TAG chr11 5189868 5189887 5189871 -
tttccacagattctctaagg

SEQ ID NO: 53052 - DNA, 20 bp, Artificial Sequence
  Synthetic oligonucleotide; GAG chr11 5189866 5189885 5189869 -
tccacagattctctaaggta

SEQ ID NO: 53053 - DNA, 20 bp, Artificial Sequence
  Synthetic oligonucleotide; AGG chr11 5189865 5189884 5189868 -
ccacagattctctaaggtag

SEQ ID NO: 53054 - DNA, 20 bp, Artificial Sequence
  Synthetic oligonucleotide; CAG chr11 5189860 5189879 5189863 -
gattctctaaggtagaggca

SEQ ID NO: 53055 - DNA, 20 bp, Artificial Sequence
  Synthetic oligonucleotide; CAG chr11 5189855 5189874 5189858 -
tctaaggtagaggcacagtg

SEQ ID NO: 53056 - DNA, 20 bp, Artificial Sequence
  Synthetic oligonucleotide; AAG chr11 5189826 5189845 5189829 -
tctttgctaatgtataacaa

SEQ ID NO: 53057 - DNA, 20 bp, Artificial Sequence
  Synthetic oligonucleotide; CAG chr11 5189811 5189830 5189814 -
aacaaaagtgacctttgctc

SEQ ID NO: 53058 - DNA, 20 bp, Artificial Sequence
  Synthetic oligonucleotide; GAG chr11 5189784 5189803 5189787 -
caataaattcatttccatct

SEQ ID NO: 53059 - DNA, 20 bp, Artificial Sequence
  Synthetic oligonucleotide; CAG chr11 5189774 5189793 5189777 -
atttccatctgagaccacct

SEQ ID NO: 53060 - DNA, 20 bp, Artificial Sequence
  Synthetic oligonucleotide; TGG chr11 5189769 5189788 5189772 -
catctgagaccacctcagcc

SEQ ID NO: 53061 - DNA, 20 bp, Artificial Sequence
  Synthetic oligonucleotide; CAG chr11 5189744 5189763 5189747 -
ttcattgtccatatcactat

SEQ ID NO: 53062 - DNA, 20 bp, Artificial Sequence
  Synthetic oligonucleotide; TGG chr11 5189736 5189755 5189739 -
ccatatcactatcagaattt

SEQ ID NO: 53063 - DNA, 20 bp, Artificial Sequence
  Synthetic oligonucleotide; AAG chr11 5189718 5189737 5189721 -
tttggtcacaaccattccac

SEQ ID NO: 53064 - DNA, 20 bp, Artificial Sequence
  Synthetic oligonucleotide; TAG chr11 5189711 5189730 5189714 -
acaaccattccacaagtctc

SEQ ID NO: 53065 - DNA, 20 bp, Artificial Sequence
  Synthetic oligonucleotide; AAG chr11 5189707 5189726 5189710 -
ccattccacaagtctctaga

SEQ ID NO: 53066 - DNA, 20 bp, Artificial Sequence
  Synthetic oligonucleotide; GAG chr11 5189670 5189689 5189673 -
tcatctccctgtcttcttct

SEQ ID NO: 53067 - DNA, 20 bp, Artificial Sequence
  Synthetic oligonucleotide; AAG chr11 5189626 5189645 5189629 -
ctgcctgttatccaatgcca

SEQ ID NO: 53068 - DNA, 20 bp, Artificial Sequence
  Synthetic oligonucleotide; TAG chr11 5189596 5189615 5189599 -
cacattttcatgtatcttta

SEQ ID NO: 53069 - DNA, 20 bp, Artificial Sequence
  Synthetic oligonucleotide; CAG chr11 5189593 5189612 5189596 -
attttcatgtatctttatag

SEQ ID NO: 53070 - DNA, 20 bp, Artificial Sequence
  Synthetic oligonucleotide; TGG chr11 5189579 5189598 5189582 -
ttatagcagtaccccacttt

SEQ ID NO: 53071 - DNA, 20 bp, Artificial Sequence
  Synthetic oligonucleotide; TGG chr11 5189560 5189579 5189563 -
ttggtaccaattttctgtac

SEQ ID NO: 53072 - DNA, 20 bp, Artificial Sequence
  Synthetic oligonucleotide; AAG chr11 5189538 5189557 5189541 -
gtccattctcatcttgctat

SEQ ID NO: 53073 - DNA, 20 bp, Artificial Sequence
  Synthetic oligonucleotide; AGG chr11 5189537 5189556 5189540 -
tccattctcatcttgctata

SEQ ID NO: 53074 - DNA, 20 bp, Artificial Sequence
  Synthetic oligonucleotide; GAG chr11 5189526 5189545 5189529 -
cttgctataaggaaatacct

SEQ ID NO: 53075 - DNA, 20 bp, Artificial Sequence
  Synthetic oligonucleotide; TGG chr11 5189521 5189540 5189524 -
tataaggaaatacctgagac

SEQ ID NO: 53076 - DNA, 20 bp, Artificial Sequence
  Synthetic oligonucleotide; GGG chr11 5189520 5189539 5189523 -
ataaggaaatacctgagact

SEQ ID NO: 53077 - DNA, 20 bp, Artificial Sequence
  Synthetic oligonucleotide; TGG chr11 5189513 5189532 5189516 -
aatacctgagactgggtaaa

SEQ ID NO: 53078 - DNA, 20 bp, Artificial Sequence
  Synthetic oligonucleotide; AAG chr11 5189508 5189527 5189511 -
ctgagactgggtaaatggtg

SEQ ID NO: 53079 - DNA, 20 bp, Artificial Sequence
  Synthetic oligonucleotide; CAG chr11 5189503 5189522 5189506 -
actgggtaaatggtgaagaa

SEQ ID NO: 53080 - DNA, 20 bp, Artificial Sequence
  Synthetic oligonucleotide; GAG chr11 5189501 5189520 5189504 -
tgggtaaatggtgaagaaca

SEQ ID NO: 53081 - DNA, 20 bp, Artificial Sequence
  Synthetic oligonucleotide; TGG chr11 5189491 5189510 5189494 -
gtgaagaacagagatttaat

SEQ ID NO: 53082 - DNA, 20 bp, Artificial Sequence
  Synthetic oligonucleotide; CAG chr11 5189484 5189503 5189487 -
acagagatttaattggctca

SEQ ID NO: 53083 - DNA, 20 bp, Artificial Sequence
  Synthetic oligonucleotide; AAG chr11 5189476 5189495 5189479 -
ttaattggctcacagttcta

SEQ ID NO: 53084 - DNA, 20 bp, Artificial Sequence
  Synthetic oligonucleotide; AGG chr11 5189475 5189494 5189478 -
taattggctcacagttctaa

SEQ ID NO: 53085 - DNA, 20 bp, Artificial Sequence
  Synthetic oligonucleotide; CAG chr11 5189467 5189486 5189470 -
tcacagttctaaaggctgta

SEQ ID NO: 53086 - DNA, 20 bp, Artificial Sequence
  Synthetic oligonucleotide; AGG chr11 5189466 5189485 5189469 -
cacagttctaaaggctgtac

SEQ ID NO: 53087 - DNA, 20 bp, Artificial Sequence
  Synthetic oligonucleotide; AAG chr11 5189463 5189482 5189466 -
agttctaaaggctgtacagg

SEQ ID NO: 53088 - DNA, 20 bp, Artificial Sequence
  Synthetic oligonucleotide; TGG chr11 5189458 5189477 5189461 -
taaaggctgtacaggaagca

SEQ ID NO: 53089 - DNA, 20 bp, Artificial Sequence
  Synthetic oligonucleotide; CAG chr11 5189444 5189463 5189447 -
gaagcatggcaacgtctgct

SEQ ID NO: 53090 - DNA, 20 bp, Artificial Sequence
  Synthetic oligonucleotide; TAG chr11 5189437 5189456 5189440 -
ggcaacgtctgctcagcttc

SEQ ID NO: 53091 - DNA, 20 bp, Artificial Sequence
  Synthetic oligonucleotide; AGG chr11 5189436 5189455 5189439 -
gcaacgtctgctcagcttct

SEQ ID NO: 53092 - DNA, 20 bp, Artificial Sequence
  Synthetic oligonucleotide; GGG chr11 5189435 5189454 5189438 -
caacgtctgctcagcttcta

SEQ ID NO: 53093 - DNA, 20 bp, Artificial Sequence
  Synthetic oligonucleotide; GAG chr11 5189433 5189452 5189436 -
acgtctgctcagcttctagg

SEQ ID NO: 53094 - DNA, 20 bp, Artificial Sequence
  Synthetic oligonucleotide; AGG chr11 5189432 5189451 5189435 -
cgtctgctcagcttctaggg

SEQ ID NO: 53095 - DNA, 20 bp, Artificial Sequence
  Synthetic oligonucleotide; CAG chr11 5189426 5189445 5189429 -
ctcagcttctagggaggttt

SEQ ID NO: 53096 - DNA, 20 bp, Artificial Sequence
  Synthetic oligonucleotide; AGG chr11 5189425 5189444 5189428 -
tcagcttctagggaggtttc

SEQ ID NO: 53097 - DNA, 20 bp, Artificial Sequence
  Synthetic oligonucleotide; TGG chr11 5189409 5189428 5189412 -
tttcaggaaacttataatca

SEQ ID NO: 53098 - DNA, 20 bp, Artificial Sequence
  Synthetic oligonucleotide; CAG chr11 5189406 5189425 5189409 -
caggaaacttataatcatgg

SEQ ID NO: 53099 - DNA, 20 bp, Artificial Sequence
  Synthetic oligonucleotide; GAG chr11 5189404 5189423 5189407 -
ggaaacttataatcatggca

SEQ ID NO: 53100 - DNA, 20 bp, Artificial Sequence
  Synthetic oligonucleotide; GAG chr11 5189402 5189421 5189405 -
aaacttataatcatggcaga

SEQ ID NO: 53101 - DNA, 20 bp, Artificial Sequence
  Synthetic oligonucleotide; CAG chr11 5189394 5189413 5189397 -
aatcatggcagagagaaaaa

SEQ ID NO: 53102 - DNA, 20 bp, Artificial Sequence
  Synthetic oligonucleotide; AGG chr11 5189393 5189412 5189396 -
atcatggcagagagaaaaac

SEQ ID NO: 53103 - DNA, 20 bp, Artificial Sequence
  Synthetic oligonucleotide; GAG chr11 5189391 5189410 5189394 -
catggcagagagaaaaacag

SEQ ID NO: 53104 - DNA, 20 bp, Artificial Sequence
  Synthetic oligonucleotide; TGG chr11 5189374 5189393 5189377 -
caggagcatgtgtcttcaca

SEQ ID NO: 53105 - DNA, 20 bp, Artificial Sequence
  Synthetic oligonucleotide; TGG chr11 5189370 5189389 5189373 -
agcatgtgtcttcacatggc

SEQ ID NO: 53106 - DNA, 20 bp, Artificial Sequence
  Synthetic oligonucleotide; GAG chr11 5189368 5189387 5189371 -
catgtgtcttcacatggctg

SEQ ID NO: 53107 - DNA, 20 bp, Artificial Sequence
  Synthetic oligonucleotide; CAG chr11 5189365 5189384 5189368 -
gtgtcttcacatggctggag

SEQ ID NO: 53108 - DNA, 20 bp, Artificial Sequence
  Synthetic oligonucleotide; AGG chr11 5189364 5189383 5189367 -
tgtcttcacatggctggagc

SEQ ID NO: 53109 - DNA, 20 bp, Artificial Sequence
  Synthetic oligonucleotide; AAG chr11 5189361 5189380 5189364 -
cttcacatggctggagcagg

SEQ ID NO: 53110 - DNA, 20 bp, Artificial Sequence
  Synthetic oligonucleotide; AAG chr11 5189358 5189377 5189361 -
cacatggctggagcaggaag

SEQ ID NO: 53111 - DNA, 20 bp, Artificial Sequence
  Synthetic oligonucleotide; GAG chr11 5189356 5189375 5189359 -
catggctggagcaggaagaa

SEQ ID NO: 53112 - DNA, 20 bp, Artificial Sequence
  Synthetic oligonucleotide; AGG chr11 5189355 5189374 5189358 -
atggctggagcaggaagaag

SEQ ID NO: 53113 - DNA, 20 bp, Artificial Sequence
  Synthetic oligonucleotide; CAG chr11 5189352 5189371 5189355 -
gctggagcaggaagaagagg

SEQ ID NO: 53114 - DNA, 20 bp, Artificial Sequence
  Synthetic oligonucleotide; AGG chr11 5189351 5189370 5189354 -
ctggagcaggaagaagaggc

SEQ ID NO: 53115 - DNA, 20 bp, Artificial Sequence
  Synthetic oligonucleotide; GGG chr11 5189350 5189369 5189353 -
tggagcaggaagaagaggca

SEQ ID NO: 53116 - DNA, 20 bp, Artificial Sequence
  Synthetic oligonucleotide; GAG chr11 5189348 5189367 5189351 -
gagcaggaagaagaggcagg

SEQ ID NO: 53117 - DNA, 20 bp, Artificial Sequence
  Synthetic oligonucleotide; AGG chr11 5189347 5189366 5189350 -
agcaggaagaagaggcaggg

SEQ ID NO: 53118 - DNA, 20 bp, Artificial Sequence
  Synthetic oligonucleotide; TAG chr11 5189344 5189363 5189347 -
aggaagaagaggcagggagg

SEQ ID NO: 53119 - DNA, 20 bp, Artificial Sequence
  Synthetic oligonucleotide; GAG chr11 5189323 5189342 5189326 -
agtaaacaaccatatctcat

SEQ ID NO: 53120 - DNA, 20 bp, Artificial Sequence
  Synthetic oligonucleotide; AAG chr11 5189297 5189316 5189300 -
tcacccactatacgtaccaa

SEQ ID NO: 53121 - DNA, 20 bp, Artificial Sequence
  Synthetic oligonucleotide; AGG chr11 5189296 5189315 5189299 -
cacccactatacgtaccaaa

SEQ ID NO: 53122 - DNA, 20 bp, Artificial Sequence
  Synthetic oligonucleotide; GGG chr11 5189295 5189314 5189298 -
acccactatacgtaccaaaa

SEQ ID NO: 53123 - DNA, 20 bp, Artificial Sequence
  Synthetic oligonucleotide; AAG chr11 5189283 5189302 5189286 -
taccaaaagggactgatatt

SEQ ID NO: 53124 - DNA, 20 bp, Artificial Sequence
  Synthetic oligonucleotide; CAG chr11 5189237 5189256 5189240 -
atgatccaatcacttcccac

SEQ ID NO: 53125 - DNA, 20 bp, Artificial Sequence
  Synthetic oligonucleotide; AGG chr11 5189236 5189255 5189239 -
tgatccaatcacttcccacc

SEQ ID NO: 53126 - DNA, 20 bp, Artificial Sequence
  Synthetic oligonucleotide; TGG chr11 5189218 5189237 5189221 -
ccaggccccatcttcaacac

SEQ ID NO: 53127 - DNA, 20 bp, Artificial Sequence
  Synthetic oligonucleotide; GGG chr11 5189217 5189236 5189220 -
caggccccatcttcaacact

SEQ ID NO: 53128 - DNA, 20 bp, Artificial Sequence
  Synthetic oligonucleotide; GGG chr11 5189216 5189235 5189219 -
aggccccatcttcaacactg

SEQ ID NO: 53129 - DNA, 20 bp, Artificial Sequence
  Synthetic oligonucleotide; CAG chr11 5189209 5189228 5189212 -
atcttcaacactggggatta

SEQ ID NO: 53130 - DNA, 20 bp, Artificial Sequence
  Synthetic oligonucleotide; GAG chr11 5189198 5189217 5189201 -
tggggattacagctgaacat

SEQ ID NO: 53131 - DNA, 20 bp, Artificial Sequence
  Synthetic oligonucleotide; TAG chr11 5189193 5189212 5189196 -
attacagctgaacatgagat

SEQ ID NO: 53132 - DNA, 20 bp, Artificial Sequence
  Synthetic oligonucleotide; AGG chr11 5189192 5189211 5189195 -
ttacagctgaacatgagatt

SEQ ID NO: 53133 - DNA, 20 bp, Artificial Sequence
  Synthetic oligonucleotide; GGG chr11 5189191 5189210 5189194 -
tacagctgaacatgagatta

SEQ ID NO: 53134 - DNA, 20 bp, Artificial Sequence
  Synthetic oligonucleotide; TGG chr11 5189188 5189207 5189191 -
agctgaacatgagattaggg

SEQ ID NO: 53135 - DNA, 20 bp, Artificial Sequence
  Synthetic oligonucleotide; GAG chr11 5189186 5189205 5189189 -
ctgaacatgagattagggtg

SEQ ID NO: 53136 - DNA, 20 bp, Artificial Sequence
  Synthetic oligonucleotide; CAG chr11 5189180 5189199 5189183 -
atgagattagggtggagaca

SEQ ID NO: 53137 - DNA, 20 bp, Artificial Sequence
  Synthetic oligonucleotide; CAG chr11 5189164 5189183 5189167 -
gacacagatccaaaccatat

SEQ ID NO: 53138 - DNA, 20 bp, Artificial Sequence
  Synthetic oligonucleotide; AGG chr11 5189163 5189182 5189166 -
acacagatccaaaccatatc

SEQ ID NO: 53139 - DNA, 20 bp, Artificial Sequence
  Synthetic oligonucleotide; AAG chr11 5189110 5189129 5189113 -
caacaaaatacataaaatgt

SEQ ID NO: 53140 - DNA, 20 bp, Artificial Sequence
  Synthetic oligonucleotide; AAG chr11 5189060 5189079 5189063 -
aaactttgtttctttaatac

SEQ ID NO: 53141 - DNA, 20 bp, Artificial Sequence
  Synthetic oligonucleotide; CAG chr11 5189057 5189076 5189060 -
ctttgtttctttaatacaag

SEQ ID NO: 53142 - DNA, 20 bp, Artificial Sequence
  Synthetic oligonucleotide; TGG chr11 5189048 5189067 5189051 -
tttaatacaagcagtcgtat

SEQ ID NO: 53143 - DNA, 20 bp, Artificial Sequence
  Synthetic oligonucleotide; AAG chr11 5189036 5189055 5189039 -
agtcgtattggcttctatac

SEQ ID NO: 53144 - DNA, 20 bp, Artificial Sequence
  Synthetic oligonucleotide; TAG chr11 5188999 5189018 5189002 -
acacacatattatgatgtat

SEQ ID NO: 53145 - DNA, 20 bp, Artificial Sequence
  Synthetic oligonucleotide; AAG chr11 5188996 5189015 5188999 -
cacatattatgatgtattag

SEQ ID NO: 53146 - DNA, 20 bp, Artificial Sequence
  Synthetic oligonucleotide; AGG chr11 5188995 5189014 5188998 -
acatattatgatgtattaga

SEQ ID NO: 53147 - DNA, 20 bp, Artificial Sequence
  Synthetic oligonucleotide; AAG chr11 5188992 5189011 5188995 -
tattatgatgtattagaagg

SEQ ID NO: 53148 - DNA, 20 bp, Artificial Sequence
  Synthetic oligonucleotide; AAG chr11 5188977 5188996 5188980 -
gaaggaagataaatgtcatc

SEQ ID NO: 53149 - DNA, 20 bp, Artificial Sequence
  Synthetic oligonucleotide; AAG chr11 5188967 5188986 5188970 -
aaatgtcatcaagccttatt

SEQ ID NO: 53150 - DNA, 20 bp, Artificial Sequence
  Synthetic oligonucleotide; AGG chr11 5188966 5188985 5188969 -
aatgtcatcaagccttatta

SEQ ID NO: 53151 - DNA, 20 bp, Artificial Sequence
  Synthetic oligonucleotide; CAG chr11 5188963 5188982 5188966 -
gtcatcaagccttattaagg

SEQ ID NO: 53152 - DNA, 20 bp, Artificial Sequence
  Synthetic oligonucleotide; AGG chr11 5188962 5188981 5188965 -
tcatcaagccttattaaggc

SEQ ID NO: 53153 - DNA, 20 bp, Artificial Sequence
  Synthetic oligonucleotide; TGG chr11 5188956 5188975 5188959 -
agccttattaaggcaggtcc

SEQ ID NO: 53154 - DNA, 20 bp, Artificial Sequence
  Synthetic oligonucleotide; AAG chr11 5188939 5188958 5188942 -
tcctggtgtatccttcctta

SEQ ID NO: 53155 - DNA, 20 bp, Artificial Sequence
  Synthetic oligonucleotide; AAG chr11 5188934 5188953 5188937 -
gtgtatccttccttaaagaa

SEQ ID NO: 53156 - DNA, 20 bp, Artificial Sequence
  Synthetic oligonucleotide; TAG chr11 5188913 5188932 5188916 -
agtatctaataaccttacgt

SEQ ID NO: 53157 - DNA, 20 bp, Artificial Sequence
  Synthetic oligonucleotide; AAG chr11 5188903 5188922 5188906 -
aaccttacgttagctaaacg

SEQ ID NO: 53158 - DNA, 20 bp, Artificial Sequence
  Synthetic oligonucleotide; GAG chr11 5188901 5188920 5188904 -
ccttacgttagctaaacgaa

SEQ ID NO: 53159 - DNA, 20 bp, Artificial Sequence
  Synthetic oligonucleotide; TAG chr11 5188889 5188908 5188892 -
taaacgaagagataatatat

SEQ ID NO: 53160 - DNA, 20 bp, Artificial Sequence
  Synthetic oligonucleotide; CAG chr11 5188876 5188895 5188879 -
aatatattagtaattcttcc

SEQ ID NO: 53161 - DNA, 20 bp, Artificial Sequence
  Synthetic oligonucleotide; AAG chr11 5188870 5188889 5188873 -
ttagtaattcttcccagata

SEQ ID NO: 53162 - DNA, 20 bp, Artificial Sequence
  Synthetic oligonucleotide; AAG chr11 5188857 5188876 5188860 -
ccagataaagatcatctcta

SEQ ID NO: 53163 - DNA, 20 bp, Artificial Sequence
  Synthetic oligonucleotide; TGG chr11 5188836 5188855 5188839 -
agtaattcacaaactccacc

SEQ ID NO: 53164 - DNA, 20 bp, Artificial Sequence
  Synthetic oligonucleotide; AAG chr11 5188832 5188851 5188835 -
attcacaaactccacctgga

SEQ ID NO: 53165 - DNA, 20 bp, Artificial Sequence
  Synthetic oligonucleotide; AAG chr11 5188829 5188848 5188832 -
cacaaactccacctggaaag

SEQ ID NO: 53166 - DNA, 20 bp, Artificial Sequence
  Synthetic oligonucleotide; GAG chr11 5188827 5188846 5188830 -
caaactccacctggaaagaa

SEQ ID NO: 53167 - DNA, 20 bp, Artificial Sequence
  Synthetic oligonucleotide; TGG chr11 5188824 5188843 5188827 -
actccacctggaaagaagag

SEQ ID NO: 53168 - DNA, 20 bp, Artificial Sequence
  Synthetic oligonucleotide; AAG chr11 5188812 5188831 5188815 -
aagaagagtggctattgctc

SEQ ID NO: 53169 - DNA, 20 bp, Artificial Sequence
  Synthetic oligonucleotide; TGG chr11 5188796 5188815 5188799 -
gctcaagctattcttcaatg

SEQ ID NO: 53170 - DNA, 20 bp, Artificial Sequence
  Synthetic oligonucleotide; CAG chr11 5188793 5188812 5188796 -
caagctattcttcaatgtgg

SEQ ID NO: 53171 - DNA, 20 bp, Artificial Sequence
  Synthetic oligonucleotide; AGG chr11 5188792 5188811 5188795 -
aagctattcttcaatgtggc

SEQ ID NO: 53172 - DNA, 20 bp, Artificial Sequence
  Synthetic oligonucleotide; GGG chr11 5188791 5188810 5188794 -
agctattcttcaatgtggca

SEQ ID NO: 53173 - DNA, 20 bp, Artificial Sequence
  Synthetic oligonucleotide; GGG chr11 5188790 5188809 5188793 -
gctattcttcaatgtggcag

SEQ ID NO: 53174 - DNA, 20 bp, Artificial Sequence
  Synthetic oligonucleotide; AAG chr11 5188773 5188792 5188776 -
caggggaaaaatctttgaaa

SEQ ID NO: 53175 - DNA, 20 bp, Artificial Sequence
  Synthetic oligonucleotide; AAG chr11 5188766 5188785 5188769 -
aaaatctttgaaaaagctac

SEQ ID NO: 53176 - DNA, 20 bp, Artificial Sequence
  Synthetic oligonucleotide; GAG chr11 5188736 5188755 5188739 -
aaatattgattccaaccact

SEQ ID NO: 53177 - DNA, 20 bp, Artificial Sequence
  Synthetic oligonucleotide; CAG chr11 5188725 5188744 5188728 -
ccaaccactgagaaactcta

SEQ ID NO: 53178 - DNA, 20 bp, Artificial Sequence
  Synthetic oligonucleotide; CAG chr11 5188722 5188741 5188725 -
accactgagaaactctacag

SEQ ID NO: 53179 - DNA, 20 bp, Artificial Sequence
  Synthetic oligonucleotide; AGG chr11 5188721 5188740 5188724 -
ccactgagaaactctacagc

SEQ ID NO: 53180 - DNA, 20 bp, Artificial Sequence
  Synthetic oligonucleotide; GGG chr11 5188720 5188739 5188723 -
cactgagaaactctacagca

SEQ ID NO: 53181 - DNA, 20 bp, Artificial Sequence
  Synthetic oligonucleotide; TGG chr11 5188704 5188723 5188707 -
agcagggatgtccaatcttt

SEQ ID NO: 53182 - DNA, 20 bp, Artificial Sequence
  Synthetic oligonucleotide; TGG chr11 5188695 5188714 5188698 -
gtccaatcttttggcttccc

SEQ ID NO: 53183 - DNA, 20 bp, Artificial Sequence
  Synthetic oligonucleotide; GGG chr11 5188694 5188713 5188697 -
tccaatcttttggcttccct

SEQ ID NO: 53184 - DNA, 20 bp, Artificial Sequence
  Synthetic oligonucleotide; CAG chr11 5188662 5188681 5188665 -
aaatatactaacactaatga

SEQ ID NO: 53185 - DNA, 20 bp, Artificial Sequence
  Synthetic oligonucleotide; GAG chr11 5188654 5188673 5188657 -
taacactaatgacagctcat

SEQ ID NO: 53186 - DNA, 20 bp, Artificial Sequence
  Synthetic oligonucleotide; AAG chr11 5188600 5188619 5188603 -
ataaaatctcataatgtttt

SEQ ID NO: 53187 - DNA, 20 bp, Artificial Sequence
  Synthetic oligonucleotide; AAG chr11 5188596 5188615 5188599 -
aatctcataatgttttaaga

SEQ ID NO: 53188 - DNA, 20 bp, Artificial Sequence
  Synthetic oligonucleotide; TGG chr11 5188587 5188606 5188590 -
atgttttaagaaagttgtgt

SEQ ID NO: 53189 - DNA, 20 bp, Artificial Sequence
  Synthetic oligonucleotide; TAG chr11 5188583 5188602 5188586 -
tttaagaaagttgtgttgga

SEQ ID NO: 53190 - DNA, 20 bp, Artificial Sequence
  Synthetic oligonucleotide; AAG chr11 5188574 5188593 5188577 -
gttgtgttggatagcattca

SEQ ID NO: 53191 - DNA, 20 bp, Artificial Sequence
  Synthetic oligonucleotide; TGG chr11 5188565 5188584 5188568 -
gatagcattcaaagccatct

SEQ ID NO: 53192 - DNA, 20 bp, Artificial Sequence
  Synthetic oligonucleotide; GGG chr11 5188564 5188583 5188567 -
atagcattcaaagccatctt

SEQ ID NO: 53193 - DNA, 20 bp, Artificial Sequence
  Synthetic oligonucleotide; CAG chr11 5188554 5188573 5188557 -
aagccatcttgggatgcatg

SEQ ID NO: 53194 - DNA, 20 bp, Artificial Sequence
  Synthetic oligonucleotide; CGG chr11 5188547 5188566 5188550 -
cttgggatgcatgcagccca

SEQ ID NO: 53195 - DNA, 20 bp, Artificial Sequence
  Synthetic oligonucleotide; GGG chr11 5188546 5188565 5188549 -
ttgggatgcatgcagcccac

SEQ ID NO: 53196 - DNA, 20 bp, Artificial Sequence
  Synthetic oligonucleotide; CAG chr11 5188540 5188559 5188543 -
tgcatgcagcccacgggcca

SEQ ID NO: 53197 - DNA, 20 bp, Artificial Sequence
  Synthetic oligonucleotide; AGG chr11 5188539 5188558 5188542 -
gcatgcagcccacgggccac

SEQ ID NO: 53198 - DNA, 20 bp, Artificial Sequence
  Synthetic oligonucleotide; TGG chr11 5188535 5188554 5188538 -
gcagcccacgggccacaggt

SEQ ID NO: 53199 - DNA, 20 bp, Artificial Sequence
  Synthetic oligonucleotide; AAG chr11 5188530 5188549 5188533 -
ccacgggccacaggttggac

SEQ ID NO: 53200 - DNA, 20 bp, Artificial Sequence
  Synthetic oligonucleotide; CAG chr11 5188518 5188537 5188521 -
ggttggacaagcttgctcta

SEQ ID NO: 53201 - DNA, 20 bp, Artificial Sequence
  Synthetic oligonucleotide; AAG chr11 5188506 5188525 5188509 -
ttgctctacagcctacaaac

SEQ ID NO: 53202 - DNA, 20 bp, Artificial Sequence
  Synthetic oligonucleotide; AGG chr11 5188505 5188524 5188508 -
tgctctacagcctacaaaca

SEQ ID NO: 53203 - DNA, 20 bp, Artificial Sequence
  Synthetic oligonucleotide; AAG chr11 5188502 5188521 5188505 -
tctacagcctacaaacaagg

SEQ ID NO: 53204 - DNA, 20 bp, Artificial Sequence
  Synthetic oligonucleotide; TGG chr11 5188470 5188489 5188473 -
aatatttctgttctcttttc

SEQ ID NO: 53205 - DNA, 20 bp, Artificial Sequence
  Synthetic oligonucleotide; CAG chr11 5188457 5188476 5188460 -
tcttttctggcaccaactcc

SEQ ID NO: 53206 - DNA, 20 bp, Artificial Sequence
  Synthetic oligonucleotide; TAG chr11 5188448 5188467 5188451 -
gcaccaactcccagctttac

SEQ ID NO: 53207 - DNA, 20 bp, Artificial Sequence
  Synthetic oligonucleotide; CAG chr11 5188435 5188454 5188438 -
gctttactagcaccaactcc

SEQ ID NO: 53208 - DNA, 20 bp, Artificial Sequence
  Synthetic oligonucleotide; GAG chr11 5188414 5188433 5188417 -
agctttactaacttacaaat

SEQ ID NO: 53209 - DNA, 20 bp, Artificial Sequence
  Synthetic oligonucleotide; AAG chr11 5188411 5188430 5188414 -
tttactaacttacaaatgag

SEQ ID NO: 53210 - DNA, 20 bp, Artificial Sequence
  Synthetic oligonucleotide; CAG chr11 5188404 5188423 5188407 -
acttacaaatgagaagaaac

SEQ ID NO: 53211 - DNA, 20 bp, Artificial Sequence
  Synthetic oligonucleotide; AGG chr11 5188403 5188422 5188406 -
cttacaaatgagaagaaacc

SEQ ID NO: 53212 - DNA, 20 bp, Artificial Sequence
  Synthetic oligonucleotide; AAG chr11 5188372 5188391 5188375 -
tatgccaaattacttgttcg

SEQ ID NO: 53213 - DNA, 20 bp, Artificial Sequence
  Synthetic oligonucleotide; AAG chr11 5188368 5188387 5188371 -
ccaaattacttgttcgaaga

SEQ ID NO: 53214 - DNA, 20 bp, Artificial Sequence
  Synthetic oligonucleotide; AGG chr11 5188367 5188386 5188370 -
caaattacttgttcgaagaa

SEQ ID NO: 53215 - DNA, 20 bp, Artificial Sequence
  Synthetic oligonucleotide; TGG chr11 5188358 5188377 5188361 -
tgttcgaagaaaggatcatc

SEQ ID NO: 53216 - DNA, 20 bp, Artificial Sequence
  Synthetic oligonucleotide; TGG chr11 5188344 5188363 5188347 -
atcatctggaattcttttct

SEQ ID NO: 53217 - DNA, 20 bp, Artificial Sequence
  Synthetic oligonucleotide; AAG chr11 5188328 5188347 5188331 -
ttcttggatttcctccactc

SEQ ID NO: 53218 - DNA, 20 bp, Artificial Sequence
  Synthetic oligonucleotide; TAG chr11 5188320 5188339 5188323 -
tttcctccactcaagtccca

SEQ ID NO: 53219 - DNA, 20 bp, Artificial Sequence
  Synthetic oligonucleotide; AAG chr11 5188316 5188335 5188319 -
ctccactcaagtcccatagt

SEQ ID NO: 53220 - DNA, 20 bp, Artificial Sequence
  Synthetic oligonucleotide; AAG chr11 5188310 5188329 5188313 -
tcaagtcccatagtaagata

SEQ ID NO: 53221 - DNA, 20 bp, Artificial Sequence
  Synthetic oligonucleotide; AGG chr11 5188309 5188328 5188312 -
caagtcccatagtaagataa

SEQ ID NO: 53222 - DNA, 20 bp, Artificial Sequence
  Synthetic oligonucleotide; TGG chr11 5188276 5188295 5188279 -
attgtatctttttcattttt

SEQ ID NO: 53223 - DNA, 20 bp, Artificial Sequence
  Synthetic oligonucleotide; AAG chr11 5188270 5188289 5188273 -
tctttttcattttttggctg

SEQ ID NO: 53224 - DNA, 20 bp, Artificial Sequence
  Synthetic oligonucleotide; TAG chr11 5188264 5188283 5188267 -
tcattttttggctgaagcac

SEQ ID NO: 53225 - DNA, 20 bp, Artificial Sequence
  Synthetic oligonucleotide; CAG chr11 5188257 5188276 5188260 -
ttggctgaagcactagcatc

SEQ ID NO: 53226 - DNA, 20 bp, Artificial Sequence
  Synthetic oligonucleotide; AGG chr11 5188256 5188275 5188259 -
tggctgaagcactagcatcc

SEQ ID NO: 53227 - DNA, 20 bp, Artificial Sequence
  Synthetic oligonucleotide; TAG chr11 5188238 5188257 5188241 -
ccaggacactaatttaccta

SEQ ID NO: 53228 - DNA, 20 bp, Artificial Sequence
  Synthetic oligonucleotide; TAG chr11 5188225 5188244 5188228 -
ttacctatagaacaattatc

SEQ ID NO: 53229 - DNA, 20 bp, Artificial Sequence
  Synthetic oligonucleotide; TAG chr11 5188215 5188234 5188218 -
aacaattatctagactcaat

SEQ ID NO: 53230 - DNA, 20 bp, Artificial Sequence
  Synthetic oligonucleotide; AAG chr11 5188212 5188231 5188215 -
aattatctagactcaattag

SEQ ID NO: 53231 - DNA, 20 bp, Artificial Sequence
  Synthetic oligonucleotide; AAG chr11 5188195 5188214 5188198 -
tagaagtatcttacatattg

SEQ ID NO: 53232 - DNA, 20 bp, Artificial Sequence
  Synthetic oligonucleotide; CAG chr11 5188192 5188211 5188195 -
aagtatcttacatattgaag

SEQ ID NO: 53233 - DNA, 20 bp, Artificial Sequence
  Synthetic oligonucleotide; GAG chr11 5188190 5188209 5188193 -
gtatcttacatattgaagca

SEQ ID NO: 53234 - DNA, 20 bp, Artificial Sequence
  Synthetic oligonucleotide; TAG chr11 5188186 5188205 5188189 -
cttacatattgaagcagagt

SEQ ID NO: 53235 - DNA, 20 bp, Artificial Sequence
  Synthetic oligonucleotide; GAG chr11 5188184 5188203 5188187 -
tacatattgaagcagagtta

SEQ ID NO: 53236 - DNA, 20 bp, Artificial Sequence
  Synthetic oligonucleotide; AAG chr11 5188171 5188190 5188174 -
agagttagagctaaaatctc

SEQ ID NO: 53237 - DNA, 20 bp, Artificial Sequence
  Synthetic oligonucleotide; CAG chr11 5188147 5188166 5188150 -
aatccaacatccttaattta

SEQ ID NO: 53238 - DNA, 20 bp, Artificial Sequence
  Synthetic oligonucleotide; CAG chr11 5188135 5188154 5188138 -
ttaatttacagatactaaat

SEQ ID NO: 53239 - DNA, 20 bp, Artificial Sequence
  Synthetic oligonucleotide; TAG chr11 5188132 5188151 5188135 -
atttacagatactaaatcag

SEQ ID NO: 53240 - DNA, 20 bp, Artificial Sequence
  Synthetic oligonucleotide; AAG chr11 5188126 5188145 5188129 -
agatactaaatcagtagcca

SEQ ID NO: 53241 - DNA, 20 bp, Artificial Sequence
  Synthetic oligonucleotide; TGG chr11 5188105 5188124 5188108 -
agccatttttactgctattt

SEQ ID NO: 53242 - DNA, 20 bp, Artificial Sequence
  Synthetic oligonucleotide; CAG chr11 5188098 5188117 5188101 -
tttactgctattttggttaa

SEQ ID NO: 53243 - DNA, 20 bp, Artificial Sequence
  Synthetic oligonucleotide; AGG chr11 5188097 5188116 5188100 -
ttactgctattttggttaac

SEQ ID NO: 53244 - DNA, 20 bp, Artificial Sequence
  Synthetic oligonucleotide; GGG chr11 5188096 5188115 5188099 -
tactgctattttggttaaca

SEQ ID NO: 53245 - DNA, 20 bp, Artificial Sequence
  Synthetic oligonucleotide; TAG chr11 5188061 5188080 5188064 -
atccatttccttgaaatcca

SEQ ID NO: 53246 - DNA, 20 bp, Artificial Sequence
  Synthetic oligonucleotide; GAG chr11 5188045 5188064 5188048 -
tccatagaaatttaaaaact

SEQ ID NO: 53247 - DNA, 20 bp, Artificial Sequence
  Synthetic oligonucleotide; CAG chr11 5188034 5188053 5188037 -
ttaaaaactgagtcttttaa

SEQ ID NO: 53248 - DNA, 20 bp, Artificial Sequence
  Synthetic oligonucleotide; AAG chr11 5188017 5188036 5188020 -
taacagcacaatctgctcta

SEQ ID NO: 53249 - DNA, 20 bp, Artificial Sequence
  Synthetic oligonucleotide; TGG chr11 5188011 5188030 5188014 -
cacaatctgctctaaagtga

SEQ ID NO: 53250 - DNA, 20 bp, Artificial Sequence
  Synthetic oligonucleotide; GAG chr11 5187985 5188004 5187988 -
tttctgacatgaacttatgt

SEQ ID NO: 53251 - DNA, 20 bp, Artificial Sequence
  Synthetic oligonucleotide; TAG chr11 5187924 5187943 5187927 -
atgttccctgcaaaaatatc

SEQ ID NO: 53252 - DNA, 20 bp, Artificial Sequence
  Synthetic oligonucleotide; AGG chr11 5187923 5187942 5187926 -
tgttccctgcaaaaatatct

SEQ ID NO: 53253 - DNA, 20 bp, Artificial Sequence
  Synthetic oligonucleotide; TAG chr11 5187915 5187934 5187918 -
gcaaaaatatctaggtatat

SEQ ID NO: 53254 - DNA, 20 bp, Artificial Sequence
  Synthetic oligonucleotide; TAG chr11 5187903 5187922 5187906 -
aggtatattagataatcata

SEQ ID NO: 53255 - DNA, 20 bp, Artificial Sequence
  Synthetic oligonucleotide; AAG chr11 5187887 5187906 5187890 -
catatagatatatgattatt

SEQ ID NO: 53256 - DNA, 20 bp, Artificial Sequence
  Synthetic oligonucleotide; AGG chr11 5187886 5187905 5187889 -
atatagatatatgattatta

SEQ ID NO: 53257 - DNA, 20 bp, Artificial Sequence
  Synthetic oligonucleotide; GGG chr11 5187885 5187904 5187888 -
tatagatatatgattattaa

SEQ ID NO: 53258 - DNA, 20 bp, Artificial Sequence
  Synthetic oligonucleotide; GAG chr11 5187876 5187895 5187879 -
atgattattaagggcatacc

SEQ ID NO: 53259 - DNA, 20 bp, Artificial Sequence
  Synthetic oligonucleotide; TGG chr11 5187818 5187837 5187821 -
tatataacattcataaaaat

SEQ ID NO: 53260 - DNA, 20 bp, Artificial Sequence
  Synthetic oligonucleotide; AAG chr11 5187800 5187819 5187803 -
attggaaaattatttttcta

SEQ ID NO: 53261 - DNA, 20 bp, Artificial Sequence
  Synthetic oligonucleotide; TGG chr11 5187793 5187812 5187796 -
aattatttttctaaagcatg

SEQ ID NO: 53262 - DNA, 20 bp, Artificial Sequence
  Synthetic oligonucleotide; AAG chr11 5187786 5187805 5187789 -
tttctaaagcatgtggctca

SEQ ID NO: 53263 - DNA, 20 bp, Artificial Sequence
  Synthetic oligonucleotide; TAG chr11 5187779 5187798 5187782 -
agcatgtggctcaaagactg

SEQ ID NO: 53264 - DNA, 20 bp, Artificial Sequence
  Synthetic oligonucleotide; AAG chr11 5187768 5187787 5187771 -
caaagactgtagacttctat

SEQ ID NO: 53265 - DNA, 20 bp, Artificial Sequence
  Synthetic oligonucleotide; TAG chr11 5187714 5187733 5187717 -
taactattatttcatctgca

SEQ ID NO: 53266 - DNA, 20 bp, Artificial Sequence
  Synthetic oligonucleotide; AAG chr11 5187701 5187720 5187704 -
atctgcatagaatattgctg

SEQ ID NO: 53267 - DNA, 20 bp, Artificial Sequence
  Synthetic oligonucleotide; AGG chr11 5187700 5187719 5187703 -
tctgcatagaatattgctga

SEQ ID NO: 53268 - DNA, 20 bp, Artificial Sequence
  Synthetic oligonucleotide; AAG chr11 5187688 5187707 5187691 -
attgctgaaggtgtgtttta

SEQ ID NO: 53269 - DNA, 20 bp, Artificial Sequence
  Synthetic oligonucleotide; TAG chr11 5187685 5187704 5187688 -
gctgaaggtgtgttttaaag

SEQ ID NO: 53270 - DNA, 20 bp, Artificial Sequence
  Synthetic oligonucleotide; TGG chr11 5187677 5187696 5187680 -
tgtgttttaaagtagtaaca

SEQ ID NO: 53271 - DNA, 20 bp, Artificial Sequence
  Synthetic oligonucleotide; CAG chr11 5187663 5187682 5187666 -
gtaacatggtacttgtatca

SEQ ID NO: 53272 - DNA, 20 bp, Artificial Sequence
  Synthetic oligonucleotide; CAG chr11 5187660 5187679 5187663 -
acatggtacttgtatcacag

SEQ ID NO: 53273 - DNA, 20 bp, Artificial Sequence
  Synthetic oligonucleotide; TAG chr11 5187654 5187673 5187657 -
tacttgtatcacagcagccg

SEQ ID NO: 53274 - DNA, 20 bp, Artificial Sequence
  Synthetic oligonucleotide; TGG chr11 5187649 5187668 5187652 -
gtatcacagcagccgtagtt

SEQ ID NO: 53275 - DNA, 20 bp, Artificial Sequence
  Synthetic oligonucleotide; CAG chr11 5187617 5187636 5187620 -
ctcttgcatattatatttat

SEQ ID NO: 53276 - DNA, 20 bp, Artificial Sequence
  Synthetic oligonucleotide; AAG chr11 5187570 5187589 5187573 -
tgctcaaaaaaaaattcttc

SEQ ID NO: 53277 - DNA, 20 bp, Artificial Sequence
  Synthetic oligonucleotide; TAG chr11 5187564 5187583 5187567 -
aaaaaaaattcttcaagttt

SEQ ID NO: 53278 - DNA, 20 bp, Artificial Sequence
  Synthetic oligonucleotide; GAG chr11 5187562 5187581 5187565 -
aaaaaattcttcaagtttta

SEQ ID NO: 53279 - DNA, 20 bp, Artificial Sequence
  Synthetic oligonucleotide; CAG chr11 5187555 5187574 5187558 -
tcttcaagttttagagtccc

SEQ ID NO: 53280 - DNA, 20 bp, Artificial Sequence
  Synthetic oligonucleotide; AAG chr11 5187534 5187553 5187537 -
agatttaaaaacattataat

SEQ ID NO: 53281 - DNA, 20 bp, Artificial Sequence
  Synthetic oligonucleotide; CAG chr11 5187527 5187546 5187530 -
aaaacattataataagttat

SEQ ID NO: 53282 - DNA, 20 bp, Artificial Sequence
  Synthetic oligonucleotide; CAG chr11 5187524 5187543 5187527 -
acattataataagttatcag

SEQ ID NO: 53283 - DNA, 20 bp, Artificial Sequence
  Synthetic oligonucleotide; GAG chr11 5187522 5187541 5187525 -
attataataagttatcagca

SEQ ID NO: 53284 - DNA, 20 bp, Artificial Sequence
  Synthetic oligonucleotide; TGG chr11 5187510 5187529 5187513 -
tatcagcagagtatacctct

SEQ ID NO: 53285 - DNA, 20 bp, Artificial Sequence
  Synthetic oligonucleotide; CAG chr11 5187478 5187497 5187481 -
tttgttcttcctgtcactat

SEQ ID NO: 53286 - DNA, 20 bp, Artificial Sequence
  Synthetic oligonucleotide; AGG chr11 5187477 5187496 5187480 -
ttgttcttcctgtcactatc

SEQ ID NO: 53287 - DNA, 20 bp, Artificial Sequence
  Synthetic oligonucleotide; TAG chr11 5187474 5187493 5187477 -
ttcttcctgtcactatcagg

SEQ ID NO: 53288 - DNA, 20 bp, Artificial Sequence
  Synthetic oligonucleotide; CAG chr11 5187470 5187489 5187473 -
tcctgtcactatcaggtagt

SEQ ID NO: 53289 - DNA, 20 bp, Artificial Sequence
  Synthetic oligonucleotide; CAG chr11 5187464 5187483 5187467 -
cactatcaggtagtcagatg

SEQ ID NO: 53290 - DNA, 20 bp, Artificial Sequence
  Synthetic oligonucleotide; AAG chr11 5187372 5187391 5187375 -
attcctttaatttcttttcc

SEQ ID NO: 53291 - DNA, 20 bp, Artificial Sequence
  Synthetic oligonucleotide; AGG chr11 5187371 5187390 5187374 -
ttcctttaatttcttttcca

SEQ ID NO: 53292 - DNA, 20 bp, Artificial Sequence
  Synthetic oligonucleotide; TAG chr11 5187367 5187386 5187370 -
tttaatttcttttccaagga

SEQ ID NO: 53293 - DNA, 20 bp, Artificial Sequence
  Synthetic oligonucleotide; AGG chr11 5187366 5187385 5187369 -
ttaatttcttttccaaggat

SEQ ID NO: 53294 - DNA, 20 bp, Artificial Sequence
  Synthetic oligonucleotide; TGG chr11 5187363 5187382 5187366 -
atttcttttccaaggatagg

SEQ ID NO: 53295 - DNA, 20 bp, Artificial Sequence
  Synthetic oligonucleotide; GGG chr11 5187362 5187381 5187365 -
tttcttttccaaggataggt

SEQ ID NO: 53296 - DNA, 20 bp, Artificial Sequence
  Synthetic oligonucleotide; AAG chr11 5187359 5187378 5187362 -
cttttccaaggataggtggg

SEQ ID NO: 53297 - DNA, 20 bp, Artificial Sequence
  Synthetic oligonucleotide; AAG chr11 5187354 5187373 5187357 -
ccaaggataggtgggaagat

SEQ ID NO: 53298 - DNA, 20 bp, Artificial Sequence
  Synthetic oligonucleotide; AAG chr11 5187325 5187344 5187328 -
cctttctttaatgtctaaaa

SEQ ID NO: 53299 - DNA, 20 bp, Artificial Sequence
  Synthetic oligonucleotide; AAG chr11 5187321 5187340 5187324 -
tctttaatgtctaaaaaagc

SEQ ID NO: 53300 - DNA, 20 bp, Artificial Sequence
  Synthetic oligonucleotide; AGG chr11 5187320 5187339 5187323 -
ctttaatgtctaaaaaagca

SEQ ID NO: 53301 - DNA, 20 bp, Artificial Sequence
  Synthetic oligonucleotide; AAG chr11 5187315 5187334 5187318 -
atgtctaaaaaagcaaggtg

SEQ ID NO: 53302 - DNA, 20 bp, Artificial Sequence
  Synthetic oligonucleotide; TGG chr11 5187291 5187310 5187294 -
catccaatttaccctcacta

SEQ ID NO: 53303 - DNA, 20 bp, Artificial Sequence
  Synthetic oligonucleotide; AAG chr11 5187284 5187303 5187287 -
tttaccctcactatggtttc

SEQ ID NO: 53304 - DNA, 20 bp, Artificial Sequence
  Synthetic oligonucleotide; TGG chr11 5187272 5187291 5187275 -
atggtttcaagacctttgaa

SEQ ID NO: 53305 - DNA, 20 bp, Artificial Sequence
  Synthetic oligonucleotide; AAG chr11 5187268 5187287 5187271 -
tttcaagacctttgaatgga

SEQ ID NO: 53306 - DNA, 20 bp, Artificial Sequence
  Synthetic oligonucleotide; TAG chr11 5187224 5187243 5187227 -
ttcttatatctcccaccata

SEQ ID NO: 53307 - DNA, 20 bp, Artificial Sequence
  Synthetic oligonucleotide; TAG chr11 5187187 5187206 5187190 -
taataaaatatgacctctct

SEQ ID NO: 53308 - DNA, 20 bp, Artificial Sequence
  Synthetic oligonucleotide; CAG chr11 5187183 5187202 5187186 -
aaaatatgacctctcttagc

SEQ ID NO: 53309 - DNA, 20 bp, Artificial Sequence
  Synthetic oligonucleotide; GAG chr11 5187179 5187198 5187182 -
tatgacctctcttagccagt

SEQ ID NO: 53310 - DNA, 20 bp, Artificial Sequence
  Synthetic oligonucleotide; AAG chr11 5187172 5187191 5187175 -
tctcttagccagtgagaact

SEQ ID NO: 53311 - DNA, 20 bp, Artificial Sequence
  Synthetic oligonucleotide; TAG chr11 5187164 5187183 5187167 -
ccagtgagaactaagatgcc

SEQ ID NO: 53312 - DNA, 20 bp, Artificial Sequence
  Synthetic oligonucleotide; TGG chr11 5187152 5187171 5187155 -
aagatgcctagatgactgat

SEQ ID NO: 53313 - DNA, 20 bp, Artificial Sequence
  Synthetic oligonucleotide; GAG chr11 5187150 5187169 5187153 -
gatgcctagatgactgattg

SEQ ID NO: 53314 - DNA, 20 bp, Artificial Sequence
  Synthetic oligonucleotide; AGG chr11 5187149 5187168 5187152 -
atgcctagatgactgattgg

SEQ ID NO: 53315 - DNA, 20 bp, Artificial Sequence
  Synthetic oligonucleotide; TGG chr11 5187143 5187162 5187146 -
agatgactgattggaggacc

SEQ ID NO: 53316 - DNA, 20 bp, Artificial Sequence
  Synthetic oligonucleotide; GGG chr11 5187142 5187161 5187145 -
gatgactgattggaggacct

SEQ ID NO: 53317 - DNA, 20 bp, Artificial Sequence
  Synthetic oligonucleotide; TAG chr11 5187131 5187150 5187134 -
ggaggacctgggcacttgcc

SEQ ID NO: 53318 - DNA, 20 bp, Artificial Sequence
  Synthetic oligonucleotide; AAG chr11 5187119 5187138 5187122 -
cacttgcctagcatccaatc

SEQ ID NO: 53319 - DNA, 20 bp, Artificial Sequence
  Synthetic oligonucleotide; CAG chr11 5187110 5187129 5187113 -
agcatccaatcaagatcatc

SEQ ID NO: 53320 - DNA, 20 bp, Artificial Sequence
  Synthetic oligonucleotide; CAG chr11 5187106 5187125 5187109 -
tccaatcaagatcatccagt

SEQ ID NO: 53321 - DNA, 20 bp, Artificial Sequence
  Synthetic oligonucleotide; AGG chr11 5187105 5187124 5187108 -
ccaatcaagatcatccagtc

SEQ ID NO: 53322 - DNA, 20 bp, Artificial Sequence
  Synthetic oligonucleotide; GGG chr11 5187104 5187123 5187107 -
caatcaagatcatccagtca

SEQ ID NO: 53323 - DNA, 20 bp, Artificial Sequence
  Synthetic oligonucleotide; CAG chr11 5187100 5187119 5187103 -
caagatcatccagtcagggt

SEQ ID NO: 53324 - DNA, 20 bp, Artificial Sequence
  Synthetic oligonucleotide; TAG chr11 5187075 5187094 5187078 -
gatgtcaaacatcatattta

SEQ ID NO: 53325 - DNA, 20 bp, Artificial Sequence
  Synthetic oligonucleotide; AGG chr11 5187074 5187093 5187077 -
atgtcaaacatcatatttat

SEQ ID NO: 53326 - DNA, 20 bp, Artificial Sequence
  Synthetic oligonucleotide; GGG chr11 5187073 5187092 5187076 -
tgtcaaacatcatatttata

SEQ ID NO: 53327 - DNA, 20 bp, Artificial Sequence
  Synthetic oligonucleotide; AAG chr11 5187070 5187089 5187073 -
caaacatcatatttataggg

SEQ ID NO: 53328 - DNA, 20 bp, Artificial Sequence
  Synthetic oligonucleotide; AAG chr11 5187047 5187066 5187050 -
ttttactatttttttttact

SEQ ID NO: 53329 - DNA, 20 bp, Artificial Sequence
  Synthetic oligonucleotide; TAG chr11 5187033 5187052 5187036 -
tttactaagttttactacta

SEQ ID NO: 53330 - DNA, 20 bp, Artificial Sequence
  Synthetic oligonucleotide; AGG chr11 5187032 5187051 5187035 -
ttactaagttttactactat

SEQ ID NO: 53331 - DNA, 20 bp, Artificial Sequence
  Synthetic oligonucleotide; AAG chr11 5187023 5187042 5187026 -
tttactactataggtgaaaa

SEQ ID NO: 53332 - DNA, 20 bp, Artificial Sequence
  Synthetic oligonucleotide; TAG chr11 5187016 5187035 5187019 -
ctataggtgaaaaaagcttc

SEQ ID NO: 53333 - DNA, 20 bp, Artificial Sequence
  Synthetic oligonucleotide; AGG chr11 5187015 5187034 5187018 -
tataggtgaaaaaagcttct

SEQ ID NO: 53334 - DNA, 20 bp, Artificial Sequence
  Synthetic oligonucleotide; GGG chr11 5187014 5187033 5187017 -
ataggtgaaaaaagcttcta

SEQ ID NO: 53335 - DNA, 20 bp, Artificial Sequence
  Synthetic oligonucleotide; CAG chr11 5186995 5187014 5186998 -
agggattctttgaaaaatat

SEQ ID NO: 53336 - DNA, 20 bp, Artificial Sequence
  Synthetic oligonucleotide; CAG chr11 5186985 5187004 5186988 -
tgaaaaatatcagaaaatca

SEQ ID NO: 53337 - DNA, 20 bp, Artificial Sequence
  Synthetic oligonucleotide; TGG chr11 5186977 5186996 5186980 -
atcagaaaatcacagatata

SEQ ID NO: 53338 - DNA, 20 bp, Artificial Sequence
  Synthetic oligonucleotide; AAG chr11 5186974 5186993 5186977 -
agaaaatcacagatatatgg

SEQ ID NO: 53339 - DNA, 20 bp, Artificial Sequence
  Synthetic oligonucleotide; AGG chr11 5186973 5186992 5186976 -
gaaaatcacagatatatgga

SEQ ID NO: 53340 - DNA, 20 bp, Artificial Sequence
  Synthetic oligonucleotide; GAG chr11 5186962 5186981 5186965 -
atatatggaaggctccactt

SEQ ID NO: 53341 - DNA, 20 bp, Artificial Sequence
  Synthetic oligonucleotide; GAG chr11 5186960 5186979 5186963 -
atatggaaggctccacttga

SEQ ID NO: 53342 - DNA, 20 bp, Artificial Sequence
  Synthetic oligonucleotide; AAG chr11 5186954 5186973 5186957 -
aaggctccacttgagagaat

SEQ ID NO: 53343 - DNA, 20 bp, Artificial Sequence
  Synthetic oligonucleotide; AGG chr11 5186953 5186972 5186956 -
aggctccacttgagagaata

SEQ ID NO: 53344 - DNA, 20 bp, Artificial Sequence
  Synthetic oligonucleotide; TGG chr11 5186929 5186948 5186932 -
aacatctctctccataaatc

SEQ ID NO: 53345 - DNA, 20 bp, Artificial Sequence
  Synthetic oligonucleotide; CAG chr11 5186921 5186940 5186924 -
tctccataaatctggcttat

SEQ ID NO: 53346 - DNA, 20 bp, Artificial Sequence
  Synthetic oligonucleotide; AAG chr11 5186914 5186933 5186917 -
aaatctggcttatcagtgtg

SEQ ID NO: 53347 - DNA, 20 bp, Artificial Sequence
  Synthetic oligonucleotide; CAG chr11 5186910 5186929 5186913 -
ctggcttatcagtgtgaagc

SEQ ID NO: 53348 - DNA, 20 bp, Artificial Sequence
  Synthetic oligonucleotide; TGG chr11 5186886 5186905 5186889 -
ttttaattccatgaatatca

SEQ ID NO: 53349 - DNA, 20 bp, Artificial Sequence
  Synthetic oligonucleotide; AAG chr11 5186841 5186860 5186844 -
ttcatctgtattcctcatta

SEQ ID NO: 53350 - DNA, 20 bp, Artificial Sequence
  Synthetic oligonucleotide; AAG chr11 5186830 5186849 5186833 -
tcctcattaaagtatccttc

SEQ ID NO: 53351 - DNA, 20 bp, Artificial Sequence
  Synthetic oligonucleotide; GAG chr11 5186828 5186847 5186831 -
ctcattaaagtatccttcaa

SEQ ID NO: 53352 - DNA, 20 bp, Artificial Sequence
  Synthetic oligonucleotide; TGG chr11 5186823 5186842 5186826 -
taaagtatccttcaagagaa

SEQ ID NO: 53353 - DNA, 20 bp, Artificial Sequence
  Synthetic oligonucleotide; GGG chr11 5186822 5186841 5186825 -
aaagtatccttcaagagaat

SEQ ID NO: 53354 - DNA, 20 bp, Artificial Sequence
  Synthetic oligonucleotide; CAG chr11 5186812 5186831 5186815 -
tcaagagaatgggatatcta

SEQ ID NO: 53355 - DNA, 20 bp, Artificial Sequence
  Synthetic oligonucleotide; TAG chr11 5186809 5186828 5186812 -
agagaatgggatatctacag

SEQ ID NO: 53356 - DNA, 20 bp, Artificial Sequence
  Synthetic oligonucleotide; TGG chr11 5186792 5186811 5186795 -
cagtagctaatataatttct

SEQ ID NO: 53357 - DNA, 20 bp, Artificial Sequence
  Synthetic oligonucleotide; CAG chr11 5186784 5186803 5186787 -
aatataatttcttggccctt

SEQ ID NO: 53358 - DNA, 20 bp, Artificial Sequence
  Synthetic oligonucleotide; AAG chr11 5186756 5186775 5186759 -
gacccatttaccatgtgacc

SEQ ID NO: 53359 - DNA, 20 bp, Artificial Sequence
  Synthetic oligonucleotide; AAG chr11 5186750 5186769 5186753 -
tttaccatgtgaccaagaaa

SEQ ID NO: 53360 - DNA, 20 bp, Artificial Sequence
  Synthetic oligonucleotide; CAG chr11 5186747 5186766 5186750 -
accatgtgaccaagaaaaag

SEQ ID NO: 53361 - DNA, 20 bp, Artificial Sequence
  Synthetic oligonucleotide; AGG chr11 5186746 5186765 5186749 -
ccatgtgaccaagaaaaagc

SEQ ID NO: 53362 - DNA, 20 bp, Artificial Sequence
  Synthetic oligonucleotide; GGG chr11 5186745 5186764 5186748 -
catgtgaccaagaaaaagca

SEQ ID NO: 53363 - DNA, 20 bp, Artificial Sequence
  Synthetic oligonucleotide; AAG chr11 5186741 5186760 5186744 -
tgaccaagaaaaagcaggga

SEQ ID NO: 53364 - DNA, 20 bp, Artificial Sequence
  Synthetic oligonucleotide; TAG chr11 5186735 5186754 5186738 -
agaaaaagcagggaaagcaa

SEQ ID NO: 53365 - DNA, 20 bp, Artificial Sequence
  Synthetic oligonucleotide; AAG chr11 5186718 5186737 5186721 -
caatagaaccttaaaaatta

SEQ ID NO: 53366 - DNA, 20 bp, Artificial Sequence
  Synthetic oligonucleotide; AGG chr11 5186717 5186736 5186720 -
aatagaaccttaaaaattaa

SEQ ID NO: 53367 - DNA, 20 bp, Artificial Sequence
  Synthetic oligonucleotide; GGG chr11 5186716 5186735 5186719 -
atagaaccttaaaaattaaa

SEQ ID NO: 53368 - DNA, 20 bp, Artificial Sequence
  Synthetic oligonucleotide; GAG chr11 5186704 5186723 5186707 -
aaattaaagggaaataaaat

SEQ ID NO: 53369 - DNA, 20 bp, Artificial Sequence
  Synthetic oligonucleotide; GAG chr11 5186702 5186721 5186705 -
attaaagggaaataaaatga

SEQ ID NO: 53370 - DNA, 20 bp, Artificial Sequence
  Synthetic oligonucleotide; TAG chr11 5186689 5186708 5186692 -
aaaatgagagaattaacttt

SEQ ID NO: 53371 - DNA, 20 bp, Artificial Sequence
  Synthetic oligonucleotide; AGG chr11 5186688 5186707 5186691 -
aaatgagagaattaactttt

SEQ ID NO: 53372 - DNA, 20 bp, Artificial Sequence
  Synthetic oligonucleotide; AAG chr11 5186677 5186696 5186680 -
ttaacttttaggtgccatct

SEQ ID NO: 53373 - DNA, 20 bp, Artificial Sequence
  Synthetic oligonucleotide; AAG chr11 5186667 5186686 5186670 -
ggtgccatctaagatgtgta

SEQ ID NO: 53374 - DNA, 20 bp, Artificial Sequence
  Synthetic oligonucleotide; TGG chr11 5186623 5186642 5186626 -
ttgcaacctatatttgccaa

SEQ ID NO: 53375 - DNA, 20 bp, Artificial Sequence
  Synthetic oligonucleotide; TGG chr11 5186615 5186634 5186618 -
tatatttgccaatggctcat

SEQ ID NO: 53376 - DNA, 20 bp, Artificial Sequence
  Synthetic oligonucleotide; CAG chr11 5186599 5186618 5186602 -
tcattggaaacaatatatga

SEQ ID NO: 53377 - DNA, 20 bp, Artificial Sequence
  Synthetic oligonucleotide; AGG chr11 5186598 5186617 5186601 -
cattggaaacaatatatgac

SEQ ID NO: 53378 - DNA, 20 bp, Artificial Sequence
  Synthetic oligonucleotide; GGG chr11 5186597 5186616 5186600 -
attggaaacaatatatgaca

SEQ ID NO: 53379 - DNA, 20 bp, Artificial Sequence
  Synthetic oligonucleotide; AAG chr11 5186590 5186609 5186593 -
acaatatatgacagggacaa

SEQ ID NO: 53380 - DNA, 20 bp, Artificial Sequence
  Synthetic oligonucleotide; TGG chr11 5186584 5186603 5186587 -
tatgacagggacaaaagacc

SEQ ID NO: 53381 - DNA, 20 bp, Artificial Sequence
  Synthetic oligonucleotide; TAG chr11 5186576 5186595 5186579 -
ggacaaaagacctggacatg

SEQ ID NO: 53382 - DNA, 20 bp, Artificial Sequence
  Synthetic oligonucleotide; TAG chr11 5186558 5186577 5186561 -
tgtagatgtatgtattaact

SEQ ID NO: 53383 - DNA, 20 bp, Artificial Sequence
  Synthetic oligonucleotide; AGG chr11 5186557 5186576 5186560 -
gtagatgtatgtattaactt

SEQ ID NO: 53384 - DNA, 20 bp, Artificial Sequence
  Synthetic oligonucleotide; CAG chr11 5186551 5186570 5186554 -
gtatgtattaacttaggtgt

SEQ ID NO: 53385 - DNA, 20 bp, Artificial Sequence
  Synthetic oligonucleotide; GAG chr11 5186549 5186568 5186552 -
atgtattaacttaggtgtca

SEQ ID NO: 53386 - DNA, 20 bp, Artificial Sequence
  Synthetic oligonucleotide; GAG chr11 5186547 5186566 5186550 -
gtattaacttaggtgtcaga

SEQ ID NO: 53387 - DNA, 20 bp, Artificial Sequence
  Synthetic oligonucleotide; TGG chr11 5186544 5186563 5186547 -
ttaacttaggtgtcagagag

SEQ ID NO: 53388 - DNA, 20 bp, Artificial Sequence
  Synthetic oligonucleotide; TGG chr11 5186541 5186560 5186544 -
acttaggtgtcagagagtgg

SEQ ID NO: 53389 - DNA, 20 bp, Artificial Sequence
  Synthetic oligonucleotide; AAG chr11 5186535 5186554 5186538 -
gtgtcagagagtggtggctg

SEQ ID NO: 53390 - DNA, 20 bp, Artificial Sequence
  Synthetic oligonucleotide; AAG chr11 5186507 5186526 5186510 -
aaatgcacaaattataatga

SEQ ID NO: 53391 - DNA, 20 bp, Artificial Sequence
  Synthetic oligonucleotide; GAG chr11 5186505 5186524 5186508 -
atgcacaaattataatgaaa

SEQ ID NO: 53392 - DNA, 20 bp, Artificial Sequence
  Synthetic oligonucleotide; CAG chr11 5186498 5186517 5186501 -
aattataatgaaagagaatg

SEQ ID NO: 53393 - DNA, 20 bp, Artificial Sequence
  Synthetic oligonucleotide; TGG chr11 5186481 5186500 5186484 -
atgcagtatgtttctccctg

SEQ ID NO: 53394 - DNA, 20 bp, Artificial Sequence
  Synthetic oligonucleotide; CAG chr11 5186469 5186488 5186472 -
tctccctgtggactatgtac

SEQ ID NO: 53395 - DNA, 20 bp, Artificial Sequence
  Synthetic oligonucleotide; AAG chr11 5186466 5186485 5186469 -
ccctgtggactatgtaccag

SEQ ID NO: 53396 - DNA, 20 bp, Artificial Sequence
  Synthetic oligonucleotide; CAG chr11 5186463 5186482 5186466 -
tgtggactatgtaccagaag

SEQ ID NO: 53397 - DNA, 20 bp, Artificial Sequence
  Synthetic oligonucleotide; TGG chr11 5186440 5186459 5186443 -
ctctgtgtcatctccttcca

SEQ ID NO: 53398 - DNA, 20 bp, Artificial Sequence
  Synthetic oligonucleotide; GGG chr11 5186439 5186458 5186442 -
tctgtgtcatctccttccat

SEQ ID NO: 53399 - DNA, 20 bp, Artificial Sequence
  Synthetic oligonucleotide; GAG chr11 5186437 5186456 5186440 -
tgtgtcatctccttccatgg

SEQ ID NO: 53400 - DNA, 20 bp, Artificial Sequence
  Synthetic oligonucleotide; AGG chr11 5186436 5186455 5186439 -
gtgtcatctccttccatggg

SEQ ID NO: 53401 - DNA, 20 bp, Artificial Sequence
  Synthetic oligonucleotide; GAG chr11 5186434 5186453 5186437 -
gtcatctccttccatgggag

SEQ ID NO: 53402 - DNA, 20 bp, Artificial Sequence
  Synthetic oligonucleotide; AAG chr11 5186415 5186434 5186418 -
ggagtaaaattcgtcctctt

SEQ ID NO: 53403 - DNA, 20 bp, Artificial Sequence
  Synthetic oligonucleotide; TGG chr11 5186402 5186421 5186405 -
tcctcttaagctgaaaacct

SEQ ID NO: 53404 - DNA, 20 bp, Artificial Sequence
  Synthetic oligonucleotide; GGG chr11 5186401 5186420 5186404 -
cctcttaagctgaaaacctt

SEQ ID NO: 53405 - DNA, 20 bp, Artificial Sequence
  Synthetic oligonucleotide; AAG chr11 5186395 5186414 5186398 -
aagctgaaaaccttgggccc

SEQ ID NO: 53406 - DNA, 20 bp, Artificial Sequence
  Synthetic oligonucleotide; AAG chr11 5186381 5186400 5186384 -
gggcccaagacatgctttaa

SEQ ID NO: 53407 - DNA, 20 bp, Artificial Sequence
  Synthetic oligonucleotide; AAG chr11 5186378 5186397 5186381 -
cccaagacatgctttaaaag

SEQ ID NO: 53408 - DNA, 20 bp, Artificial Sequence
  Synthetic oligonucleotide; TAG chr11 5186369 5186388 5186372 -
tgctttaaaagaagtataaa

SEQ ID NO: 53409 - DNA, 20 bp, Artificial Sequence
  Synthetic oligonucleotide; CAG chr11 5186363 5186382 5186366 -
aaaagaagtataaatagttc

SEQ ID NO: 53410 - DNA, 20 bp, Artificial Sequence
  Synthetic oligonucleotide; CAG chr11 5186306 5186325 5186309 -
ctcaacctgctaaatatctt

SEQ ID NO: 53411 - DNA, 20 bp, Artificial Sequence
  Synthetic oligonucleotide; AGG chr11 5186305 5186324 5186308 -
tcaacctgctaaatatcttc

SEQ ID NO: 53412 - DNA, 20 bp, Artificial Sequence
  Synthetic oligonucleotide; TAG chr11 5186298 5186317 5186301 -
gctaaatatcttcaggattc

SEQ ID NO: 53413 - DNA, 20 bp, Artificial Sequence
  Synthetic oligonucleotide; AAG chr11 5186288 5186307 5186291 -
ttcaggattctagaaaatgc

SEQ ID NO: 53414 - DNA, 20 bp, Artificial Sequence
  Synthetic oligonucleotide; AAG chr11 5186284 5186303 5186287 -
ggattctagaaaatgcaagt

SEQ ID NO: 53415 - DNA, 20 bp, Artificial Sequence
  Synthetic oligonucleotide; GAG chr11 5186275 5186294 5186278 -
aaaatgcaagtaagtaaact

SEQ ID NO: 53416 - DNA, 20 bp, Artificial Sequence
  Synthetic oligonucleotide; TAG chr11 5186252 5186271 5186255 -
ttatgctcaatgaaaacttg

SEQ ID NO: 53417 - DNA, 20 bp, Artificial Sequence
  Synthetic oligonucleotide; CAG chr11 5186239 5186258 5186242 -
aaacttgtagaaaataacac

SEQ ID NO: 53418 - DNA, 20 bp, Artificial Sequence
  Synthetic oligonucleotide; AAG chr11 5186228 5186247 5186231 -
aaataacaccagaaaaaaaa

SEQ ID NO: 53419 - DNA, 20 bp, Artificial Sequence
  Synthetic oligonucleotide; AGG chr11 5186227 5186246 5186230 -
aataacaccagaaaaaaaaa

SEQ ID NO: 53420 - DNA, 20 bp, Artificial Sequence
  Synthetic oligonucleotide; AAG chr11 5186223 5186242 5186226 -
acaccagaaaaaaaaaaggc

SEQ ID NO: 53421 - DNA, 20 bp, Artificial Sequence
  Synthetic oligonucleotide; CAG chr11 5186214 5186233 5186217 -
aaaaaaaaggcaagaaactg

SEQ ID NO: 53422 - DNA, 20 bp, Artificial Sequence
  Synthetic oligonucleotide; AAG chr11 5186211 5186230 5186214 -
aaaaaggcaagaaactgcag

SEQ ID NO: 53423 - DNA, 20 bp, Artificial Sequence
  Synthetic oligonucleotide; CAG chr11 5186208 5186227 5186211 -
aaggcaagaaactgcagaag

SEQ ID NO: 53424 - DNA, 20 bp, Artificial Sequence
  Synthetic oligonucleotide; TGG chr11 5186153 5186172 5186156 -
tttccttgatttttgaccca

SEQ ID NO: 53425 - DNA, 20 bp, Artificial Sequence
  Synthetic oligonucleotide; TAG chr11 5186145 5186164 5186148 -
atttttgacccatggaatac

SEQ ID NO: 53426 - DNA, 20 bp, Artificial Sequence
  Synthetic oligonucleotide; TGG chr11 5186139 5186158 5186142 -
gacccatggaatactagact

SEQ ID NO: 53427 - DNA, 20 bp, Artificial Sequence
  Synthetic oligonucleotide; TAG chr11 5186133 5186152 5186136 -
tggaatactagacttggctt

SEQ ID NO: 53428 - DNA, 20 bp, Artificial Sequence
  Synthetic oligonucleotide; TGG chr11 5186129 5186148 5186132 -
atactagacttggctttagc

SEQ ID NO: 53429 - DNA, 20 bp, Artificial Sequence
  Synthetic oligonucleotide; GAG chr11 5186127 5186146 5186130 -
actagacttggctttagctg

SEQ ID NO: 53430 - DNA, 20 bp, Artificial Sequence
  Synthetic oligonucleotide; TAG chr11 5186110 5186129 5186113 -
ctggagttgatttgcaattg

SEQ ID NO: 53431 - DNA, 20 bp, Artificial Sequence
  Synthetic oligonucleotide; AAG chr11 5186086 5186105 5186089 -
attttttgtgttcttgtatt

SEQ ID NO: 53432 - DNA, 20 bp, Artificial Sequence
  Synthetic oligonucleotide; AAG chr11 5186082 5186101 5186085 -
tttgtgttcttgtattaagt

SEQ ID NO: 53433 - DNA, 20 bp, Artificial Sequence
  Synthetic oligonucleotide; AAG chr11 5186068 5186087 5186071 -
ttaagtaagtcattttcaaa

SEQ ID NO: 53434 - DNA, 20 bp, Artificial Sequence
  Synthetic oligonucleotide; TAG chr11 5186058 5186077 5186061 -
cattttcaaaaagaatattt

SEQ ID NO: 53435 - DNA, 20 bp, Artificial Sequence
  Synthetic oligonucleotide; TAG chr11 5186047 5186066 5186050 -
agaatattttagttttctct

SEQ ID NO: 53436 - DNA, 20 bp, Artificial Sequence
  Synthetic oligonucleotide; CAG chr11 5186009 5186028 5186012 -
tgctcattttctttgatatg

SEQ ID NO: 53437 - DNA, 20 bp, Artificial Sequence
  Synthetic oligonucleotide; AAG chr11 5185990 5186009 5185993 -
gcagatttgaatgttgtaca

SEQ ID NO: 53438 - DNA, 20 bp, Artificial Sequence
  Synthetic oligonucleotide; TAG chr11 5185968 5185987 5185971 -
gattcaatgaatttatattc

SEQ ID NO: 53439 - DNA, 20 bp, Artificial Sequence
  Synthetic oligonucleotide; TAG chr11 5185965 5185984 5185968 -
tcaatgaatttatattctag

SEQ ID NO: 53440 - DNA, 20 bp, Artificial Sequence
  Synthetic oligonucleotide; AAG chr11 5185955 5185974 5185958 -
tatattctagtagttaaaac

SEQ ID NO: 53441 - DNA, 20 bp, Artificial Sequence
  Synthetic oligonucleotide; AGG chr11 5185954 5185973 5185957 -
atattctagtagttaaaaca

SEQ ID NO: 53442 - DNA, 20 bp, Artificial Sequence
  Synthetic oligonucleotide; CAG chr11 5185949 5185968 5185952 -
ctagtagttaaaacaaggct

SEQ ID NO: 53443 - DNA, 20 bp, Artificial Sequence
  Synthetic oligonucleotide; TAG chr11 5185933 5185952 5185936 -
ggctcagtaataaaaaattt

SEQ ID NO: 53444 - DNA, 20 bp, Artificial Sequence
  Synthetic oligonucleotide; TAG chr11 5185930 5185949 5185933 -
tcagtaataaaaaattttag

SEQ ID NO: 53445 - DNA, 20 bp, Artificial Sequence
  Synthetic oligonucleotide; TAG chr11 5185896 5185915 5185899 -
tgtgtgtgtgcatcgttctg

SEQ ID NO: 53446 - DNA, 20 bp, Artificial Sequence
  Synthetic oligonucleotide; CAG chr11 5185874 5185893 5185877 -
gtttattgactattactcat

SEQ ID NO: 53447 - DNA, 20 bp, Artificial Sequence
  Synthetic oligonucleotide; AGG chr11 5185873 5185892 5185876 -
tttattgactattactcatc

SEQ ID NO: 53448 - DNA, 20 bp, Artificial Sequence
  Synthetic oligonucleotide; TAG chr11 5185867 5185886 5185870 -
gactattactcatcaggtaa

SEQ ID NO: 53449 - DNA, 20 bp, Artificial Sequence
  Synthetic oligonucleotide; TAG chr11 5185862 5185881 5185865 -
ttactcatcaggtaatagtc

SEQ ID NO: 53450 - DNA, 20 bp, Artificial Sequence
  Synthetic oligonucleotide; AGG chr11 5185861 5185880 5185864 -
tactcatcaggtaatagtct

SEQ ID NO: 53451 - DNA, 20 bp, Artificial Sequence
  Synthetic oligonucleotide; CAG chr11 5185856 5185875 5185859 -
atcaggtaatagtctaggca

SEQ ID NO: 53452 - DNA, 20 bp, Artificial Sequence
  Synthetic oligonucleotide; AAG chr11 5185850 5185869 5185853 -
taatagtctaggcacagatt

SEQ ID NO: 53453 - DNA, 20 bp, Artificial Sequence
  Synthetic oligonucleotide; AAG chr11 5185847 5185866 5185850 -
tagtctaggcacagattaag

SEQ ID NO: 53454 - DNA, 20 bp, Artificial Sequence
  Synthetic oligonucleotide; TGG chr11 5185843 5185862 5185846 -
ctaggcacagattaagaagc

SEQ ID NO: 53455 - DNA, 20 bp, Artificial Sequence
  Synthetic oligonucleotide; AAG chr11 5185804 5185823 5185807 -
actctcttccctatgtaaca

SEQ ID NO: 53456 - DNA, 20 bp, Artificial Sequence
  Synthetic oligonucleotide; TGG chr11 5185792 5185811 5185795 -
atgtaacaaagatattatac

SEQ ID NO: 53457 - DNA, 20 bp, Artificial Sequence
  Synthetic oligonucleotide; TGG chr11 5185786 5185805 5185789 -
caaagatattatactggtga

SEQ ID NO: 53458 - DNA, 20 bp, Artificial Sequence
  Synthetic oligonucleotide; GGG chr11 5185785 5185804 5185788 -
aaagatattatactggtgat

SEQ ID NO: 53459 - DNA, 20 bp, Artificial Sequence
  Synthetic oligonucleotide; GGG chr11 5185784 5185803 5185787 -
aagatattatactggtgatg

SEQ ID NO: 53460 - DNA, 20 bp, Artificial Sequence
  Synthetic oligonucleotide; AAG chr11 5185715 5185734 5185718 -
gaactatttgcaccttataa

SEQ ID NO: 53461 - DNA, 20 bp, Artificial Sequence
  Synthetic oligonucleotide; CAG chr11 5185705 5185724 5185708 -
caccttataaaagtaaatga

SEQ ID NO: 53462 - DNA, 20 bp, Artificial Sequence
  Synthetic oligonucleotide; CAG chr11 5185699 5185718 5185702 -
ataaaagtaaatgacagata

SEQ ID NO: 53463 - DNA, 20 bp, Artificial Sequence
  Synthetic oligonucleotide; AGG chr11 5185698 5185717 5185701 -
taaaagtaaatgacagatac

SEQ ID NO: 53464 - DNA, 20 bp, Artificial Sequence
  Synthetic oligonucleotide; GGG chr11 5185697 5185716 5185700 -
aaaagtaaatgacagataca

SEQ ID NO: 53465 - DNA, 20 bp, Artificial Sequence
  Synthetic oligonucleotide; AAG chr11 5185692 5185711 5185695 -
taaatgacagatacagggtg

SEQ ID NO: 53466 - DNA, 20 bp, Artificial Sequence
  Synthetic oligonucleotide; CAG chr11 5185666 5185685 5185669 -
accaattgataccatgtgcc

SEQ ID NO: 53467 - DNA, 20 bp, Artificial Sequence
  Synthetic oligonucleotide; AAG chr11 5185660 5185679 5185663 -
tgataccatgtgcccagtat

SEQ ID NO: 53468 - DNA, 20 bp, Artificial Sequence
  Synthetic oligonucleotide; TAG chr11 5185631 5185650 5185634 -
attaaaaaaaaatttattcc

SEQ ID NO: 53469 - DNA, 20 bp, Artificial Sequence
  Synthetic oligonucleotide; TGG chr11 5185622 5185641 5185625 -
aaatttattcctagtattta

SEQ ID NO: 53470 - DNA, 20 bp, Artificial Sequence
  Synthetic oligonucleotide; CAG chr11 5185597 5185616 5185600 -
actctaaatcaattcaatct

SEQ ID NO: 53471 - DNA, 20 bp, Artificial Sequence
  Synthetic oligonucleotide; TGG chr11 5185589 5185608 5185592 -
tcaattcaatctcagtttga

SEQ ID NO: 53472 - DNA, 20 bp, Artificial Sequence
  Synthetic oligonucleotide; AAG chr11 5185581 5185600 5185584 -
atctcagtttgatggataat

SEQ ID NO: 53473 - DNA, 20 bp, Artificial Sequence
  Synthetic oligonucleotide; AAG chr11 5185574 5185593 5185577 -
tttgatggataataagcctg

SEQ ID NO: 53474 - DNA, 20 bp, Artificial Sequence
  Synthetic oligonucleotide; AAG chr11 5185565 5185584 5185568 -
taataagcctgaagtcctga

SEQ ID NO: 53475 - DNA, 20 bp, Artificial Sequence
  Synthetic oligonucleotide; CAG chr11 5185550 5185569 5185553 -
cctgaaagttaaacttattc

SEQ ID NO: 53476 - DNA, 20 bp, Artificial Sequence
  Synthetic oligonucleotide; TGG chr11 5185534 5185553 5185537 -
attccagttgacaataattt

SEQ ID NO: 53477 - DNA, 20 bp, Artificial Sequence
  Synthetic oligonucleotide; TAG chr11 5185510 5185529 5185513 -
cttaattgctacaattttgt

SEQ ID NO: 53478 - DNA, 20 bp, Artificial Sequence
  Synthetic oligonucleotide; TGG chr11 5185486 5185505 5185489 -
gtcctgatgtcatctattgt

SEQ ID NO: 53479 - DNA, 20 bp, Artificial Sequence
  Synthetic oligonucleotide; GGG chr11 5185485 5185504 5185488 -
tcctgatgtcatctattgtt

SEQ ID NO: 53480 - DNA, 20 bp, Artificial Sequence
  Synthetic oligonucleotide; TAG chr11 5185481 5185500 5185484 -
gatgtcatctattgttggga

SEQ ID NO: 53481 - DNA, 20 bp, Artificial Sequence
  Synthetic oligonucleotide; GAG chr11 5185479 5185498 5185482 -
tgtcatctattgttgggata

SEQ ID NO: 53482 - DNA, 20 bp, Artificial Sequence
  Synthetic oligonucleotide; TAG chr11 5185460 5185479 5185463 -
agagatataaatgacttatg

SEQ ID NO: 53483 - DNA, 20 bp, Artificial Sequence
  Synthetic oligonucleotide; AAG chr11 5185447 5185466 5185450 -
acttatgtagctaccttcct

SEQ ID NO: 53484 - DNA, 20 bp, Artificial Sequence
  Synthetic oligonucleotide; CAG chr11 5185434 5185453 5185437 -
ccttcctaagacactgactt

SEQ ID NO: 53485 - DNA, 20 bp, Artificial Sequence
  Synthetic oligonucleotide; AAG chr11 5185429 5185448 5185432 -
ctaagacactgacttcagaa

SEQ ID NO: 53486 - DNA, 20 bp, Artificial Sequence
  Synthetic oligonucleotide; TAG chr11 5185398 5185417 5185401 -
tttaaatttatgcttattgt

SEQ ID NO: 53487 - DNA, 20 bp, Artificial Sequence
  Synthetic oligonucleotide; AGG chr11 5185397 5185416 5185400 -
ttaaatttatgcttattgtt

SEQ ID NO: 53488 - DNA, 20 bp, Artificial Sequence
  Synthetic oligonucleotide; AAG chr11 5185386 5185405 5185389 -
cttattgttaggtattttac

SEQ ID NO: 53489 - DNA, 20 bp, Artificial Sequence
  Synthetic oligonucleotide; AAG chr11 5185382 5185401 5185385 -
ttgttaggtattttacaagc

SEQ ID NO: 53490 - DNA, 20 bp, Artificial Sequence
  Synthetic oligonucleotide; GAG chr11 5185380 5185399 5185383 -
gttaggtattttacaagcaa

SEQ ID NO: 53491 - DNA, 20 bp, Artificial Sequence
  Synthetic oligonucleotide; AAG chr11 5185372 5185391 5185375 -
ttttacaagcaagagaacta

SEQ ID NO: 53492 - DNA, 20 bp, Artificial Sequence
  Synthetic oligonucleotide; CAG chr11 5185349 5185368 5185352 -
tttaaattaaatgacgtgtc

SEQ ID NO: 53493 - DNA, 20 bp, Artificial Sequence
  Synthetic oligonucleotide; AGG chr11 5185348 5185367 5185351 -
ttaaattaaatgacgtgtcc

SEQ ID NO: 53494 - DNA, 20 bp, Artificial Sequence
  Synthetic oligonucleotide; GGG chr11 5185347 5185366 5185350 -
taaattaaatgacgtgtcca

SEQ ID NO: 53495 - DNA, 20 bp, Artificial Sequence
  Synthetic oligonucleotide; TAG chr11 5185341 5185360 5185344 -
aaatgacgtgtccagggtca

SEQ ID NO: 53496 - DNA, 20 bp, Artificial Sequence
  Synthetic oligonucleotide; GAG chr11 5185339 5185358 5185342 -
atgacgtgtccagggtcata

SEQ ID NO: 53497 - DNA, 20 bp, Artificial Sequence
  Synthetic oligonucleotide; CAG chr11 5185335 5185354 5185338 -
cgtgtccagggtcatagagt

SEQ ID NO: 53498 - DNA, 20 bp, Artificial Sequence
  Synthetic oligonucleotide; AAG chr11 5185329 5185348 5185332 -
cagggtcatagagtcagaat

SEQ ID NO: 53499 - DNA, 20 bp, Artificial Sequence
  Synthetic oligonucleotide; TAG chr11 5185323 5185342 5185326 -
catagagtcagaataagatt

SEQ ID NO: 53500 - DNA, 20 bp, Artificial Sequence
  Synthetic oligonucleotide; CAG chr11 5185319 5185338 5185322 -
gagtcagaataagatttagc

SEQ ID NO: 53501 - DNA, 20 bp, Artificial Sequence
  Synthetic oligonucleotide; TAG chr11 5185290 5185309 5185293 -
aatacaactatatatgtcct

SEQ ID NO: 53502 - DNA, 20 bp, Artificial Sequence
  Synthetic oligonucleotide; GAG chr11 5185288 5185307 5185291 -
tacaactatatatgtcctta

SEQ ID NO: 53503 - DNA, 20 bp, Artificial Sequence
  Synthetic oligonucleotide; TGG chr11 5185247 5185266 5185250 -
accacactatctttgctccg

SEQ ID NO: 53504 - DNA, 20 bp, Artificial Sequence
  Synthetic oligonucleotide; CAG chr11 5185230 5185249 5185233 -
ccgtggatacattcatgatt

SEQ ID NO: 53505 - DNA, 20 bp, Artificial Sequence
  Synthetic oligonucleotide; CAG chr11 5185226 5185245 5185229 -
ggatacattcatgattcagt

SEQ ID NO: 53506 - DNA, 20 bp, Artificial Sequence
  Synthetic oligonucleotide; CAG chr11 5185213 5185232 5185216 -
attcagtcagaatatgctgt

SEQ ID NO: 53507 - DNA, 20 bp, Artificial Sequence
  Synthetic oligonucleotide; TAG chr11 5185202 5185221 5185205 -
atatgctgtcagaaatatcc

SEQ ID NO: 53508 - DNA, 20 bp, Artificial Sequence
  Synthetic oligonucleotide; AAG chr11 5185188 5185207 5185191 -
atatcctagaataatgctac

SEQ ID NO: 53509 - DNA, 20 bp, Artificial Sequence
  Synthetic oligonucleotide; AGG chr11 5185187 5185206 5185190 -
tatcctagaataatgctaca

SEQ ID NO: 53510 - DNA, 20 bp, Artificial Sequence
  Synthetic oligonucleotide; CAG chr11 5185180 5185199 5185183 -
gaataatgctacaaggaacc

SEQ ID NO: 53511 - DNA, 20 bp, Artificial Sequence
  Synthetic oligonucleotide; AGG chr11 5185179 5185198 5185182 -
aataatgctacaaggaaccc

SEQ ID NO: 53512 - DNA, 20 bp, Artificial Sequence
  Synthetic oligonucleotide; TGG chr11 5185167 5185186 5185170 -
aggaacccaggcctataatt

SEQ ID NO: 53513 - DNA, 20 bp, Artificial Sequence
  Synthetic oligonucleotide; GGG chr11 5185166 5185185 5185169 -
ggaacccaggcctataattt

SEQ ID NO: 53514 - DNA, 20 bp, Artificial Sequence
  Synthetic oligonucleotide; TAG chr11 5185142 5185161 5185145 -
catcacatatgacaatgttt

SEQ ID NO: 53515 - DNA, 20 bp, Artificial Sequence
  Synthetic oligonucleotide; AGG chr11 5185141 5185160 5185144 -
atcacatatgacaatgtttt

SEQ ID NO: 53516 - DNA, 20 bp, Artificial Sequence
  Synthetic oligonucleotide; TAG chr11 5185104 5185123 5185107 -
aaacaaatatttaaaaacca

SEQ ID NO: 53517 - DNA, 20 bp, Artificial Sequence
  Synthetic oligonucleotide; AGG chr11 5185103 5185122 5185106 -
aacaaatatttaaaaaccat

SEQ ID NO: 53518 - DNA, 20 bp, Artificial Sequence
  Synthetic oligonucleotide; AAG chr11 5185092 5185111 5185095 -
aaaaaccataggtatcacaa

SEQ ID NO: 53519 - DNA, 20 bp, Artificial Sequence
  Synthetic oligonucleotide; CAG chr11 5185084 5185103 5185087 -
taggtatcacaaaagatcac

SEQ ID NO: 53520 - DNA, 20 bp, Artificial Sequence
  Synthetic oligonucleotide; AAG chr11 5185071 5185090 5185074 -
agatcaccagaaaaaattta

SEQ ID NO: 53521 - DNA, 20 bp, Artificial Sequence
  Synthetic oligonucleotide; AGG chr11 5185070 5185089 5185073 -
gatcaccagaaaaaatttaa

SEQ ID NO: 53522 - DNA, 20 bp, Artificial Sequence
  Synthetic oligonucleotide; CAG chr11 5185066 5185085 5185069 -
accagaaaaaatttaaaggc

SEQ ID NO: 53523 - DNA, 20 bp, Artificial Sequence
  Synthetic oligonucleotide; TAG chr11 5185012 5185031 5185015 -
tcctgtatttttttttcact

SEQ ID NO: 53524 - DNA, 20 bp, Artificial Sequence
  Synthetic oligonucleotide; AAG chr11 5184978 5184997 5184981 -
ccatccctaatgtcctgatg

SEQ ID NO: 53525 - DNA, 20 bp, Artificial Sequence
  Synthetic oligonucleotide; CAG chr11 5184972 5184991 5184975 -
ctaatgtcctgatgaagccc

SEQ ID NO: 53526 - DNA, 20 bp, Artificial Sequence
  Synthetic oligonucleotide; TGG chr11 5184925 5184944 5184928 -
ctacgcttcactcacatgca

SEQ ID NO: 53527 - DNA, 20 bp, Artificial Sequence
  Synthetic oligonucleotide; TGG chr11 5184919 5184938 5184922 -
ttcactcacatgcatggctc

SEQ ID NO: 53528 - DNA, 20 bp, Artificial Sequence
  Synthetic oligonucleotide; TAG chr11 5184914 5184933 5184917 -
tcacatgcatggctctggcc

SEQ ID NO: 53529 - DNA, 20 bp, Artificial Sequence
  Synthetic oligonucleotide; CAG chr11 5184903 5184922 5184906 -
gctctggcctagaactgtgt

SEQ ID NO: 53530 - DNA, 20 bp, Artificial Sequence
  Synthetic oligonucleotide; AGG chr11 5184902 5184921 5184905 -
ctctggcctagaactgtgtc

SEQ ID NO: 53531 - DNA, 20 bp, Artificial Sequence
  Synthetic oligonucleotide; CAG chr11 5184859 5184878 5184862 -
tcctttctctgaaacatcaa

SEQ ID NO: 53532 - DNA, 20 bp, Artificial Sequence
  Synthetic oligonucleotide; GAG chr11 5184831 5184850 5184834 -
ttaaaatattctaacaatgt

SEQ ID NO: 53533 - DNA, 20 bp, Artificial Sequence
  Synthetic oligonucleotide; TAG chr11 5184816 5184835 5184819 -
aatgtgagatatatattaaa

SEQ ID NO: 53534 - DNA, 20 bp, Artificial Sequence
  Synthetic oligonucleotide; TAG chr11 5184804 5184823 5184807 -
atattaaatagtaaaacaat

SEQ ID NO: 53535 - DNA, 20 bp, Artificial Sequence
  Synthetic oligonucleotide; AAG chr11 5184789 5184808 5184792 -
acaattagtttatgtaaata

SEQ ID NO: 53536 - DNA, 20 bp, Artificial Sequence
  Synthetic oligonucleotide; TAG chr11 5184786 5184805 5184789 -
attagtttatgtaaataaag

SEQ ID NO: 53537 - DNA, 20 bp, Artificial Sequence
  Synthetic oligonucleotide; CAG chr11 5184778 5184797 5184781 -
atgtaaataaagtagatcca

SEQ ID NO: 53538 - DNA, 20 bp, Artificial Sequence
  Synthetic oligonucleotide; GAG chr11 5184776 5184795 5184779 -
gtaaataaagtagatccaca

SEQ ID NO: 53539 - DNA, 20 bp, Artificial Sequence
  Synthetic oligonucleotide; AAG chr11 5184739 5184758 5184742 -
attttatcttaatattttta

SEQ ID NO: 53540 - DNA, 20 bp, Artificial Sequence
  Synthetic oligonucleotide; AAG chr11 5184719 5184738 5184722 -
aagaacctcattccaactta

SEQ ID NO: 53541 - DNA, 20 bp, Artificial Sequence
  Synthetic oligonucleotide; AAG chr11 5184715 5184734 5184718 -
acctcattccaacttaaagc

SEQ ID NO: 53542 - DNA, 20 bp, Artificial Sequence
  Synthetic oligonucleotide; AGG chr11 5184714 5184733 5184717 -
cctcattccaacttaaagca

SEQ ID NO: 53543 - DNA, 20 bp, Artificial Sequence
  Synthetic oligonucleotide; GGG chr11 5184713 5184732 5184716 -
ctcattccaacttaaagcaa

SEQ ID NO: 53544 - DNA, 20 bp, Artificial Sequence
  Synthetic oligonucleotide; CAG chr11 5184701 5184720 5184704 -
taaagcaagggtaaattgct

SEQ ID NO: 53545 - DNA, 20 bp, Artificial Sequence
  Synthetic oligonucleotide; TGG chr11 5184693 5184712 5184696 -
gggtaaattgctcagctgtg

SEQ ID NO: 53546 - DNA, 20 bp, Artificial Sequence
  Synthetic oligonucleotide; GGG chr11 5184692 5184711 5184695 -
ggtaaattgctcagctgtgt

SEQ ID NO: 53547 - DNA, 20 bp, Artificial Sequence
  Synthetic oligonucleotide; TGG chr11 5184658 5184677 5184661 -
ctaaactgtaactcaaaaaa

SEQ ID NO: 53548 - DNA, 20 bp, Artificial Sequence
  Synthetic oligonucleotide; GGG chr11 5184657 5184676 5184660 -
taaactgtaactcaaaaaat

SEQ ID NO: 53549 - DNA, 20 bp, Artificial Sequence
  Synthetic oligonucleotide; GAG chr11 5184626 5184645 5184629 -
atttccatcatataaaattt

SEQ ID NO: 53550 - DNA, 20 bp, Artificial Sequence
  Synthetic oligonucleotide; CAG chr11 5184621 5184640 5184624 -
catcatataaaatttgagac

SEQ ID NO: 53551 - DNA, 20 bp, Artificial Sequence
  Synthetic oligonucleotide; TAG chr11 5184612 5184631 5184615 -
aaatttgagaccagaatatt

SEQ ID NO: 53552 - DNA, 20 bp, Artificial Sequence
  Synthetic oligonucleotide; TAG chr11 5184605 5184624 5184608 -
agaccagaatatttagcact

SEQ ID NO: 53553 - DNA, 20 bp, Artificial Sequence
  Synthetic oligonucleotide; AAG chr11 5184593 5184612 5184596 -
ttagcacttagcaaaaacaa

SEQ ID NO: 53554 - DNA, 20 bp, Artificial Sequence
  Synthetic oligonucleotide; AAG chr11 5184588 5184607 5184591 -
acttagcaaaaacaaaagta

SEQ ID NO: 53555 - DNA, 20 bp, Artificial Sequence
  Synthetic oligonucleotide; AGG chr11 5184587 5184606 5184590 -
cttagcaaaaacaaaagtaa

SEQ ID NO: 53556 - DNA, 20 bp, Artificial Sequence
  Synthetic oligonucleotide; TAG chr11 5184584 5184603 5184587 -
agcaaaaacaaaagtaaagg

SEQ ID NO: 53557 - DNA, 20 bp, Artificial Sequence
  Synthetic oligonucleotide; CAG chr11 5184581 5184600 5184584 -
aaaaacaaaagtaaaggtag

SEQ ID NO: 53558 - DNA, 20 bp, Artificial Sequence
  Synthetic oligonucleotide; CAG chr11 5184560 5184579 5184563 -
agactatgctatacaatgat

SEQ ID NO: 53559 - DNA, 20 bp, Artificial Sequence
  Synthetic oligonucleotide; TGG chr11 5184542 5184561 5184545 -
atcagtatattgaactgtaa

SEQ ID NO: 53560 - DNA, 20 bp, Artificial Sequence
  Synthetic oligonucleotide; AAG chr11 5184535 5184554 5184538 -
tattgaactgtaatggaatc

SEQ ID NO: 53561 - DNA, 20 bp, Artificial Sequence
  Synthetic oligonucleotide; GAG chr11 5184533 5184552 5184536 -
ttgaactgtaatggaatcaa

SEQ ID NO: 53562 - DNA, 20 bp, Artificial Sequence
  Synthetic oligonucleotide; TGG chr11 5184529 5184548 5184532 -
actgtaatggaatcaagaga

SEQ ID NO: 53563 - DNA, 20 bp, Artificial Sequence
  Synthetic oligonucleotide; GGG chr11 5184528 5184547 5184531 -
ctgtaatggaatcaagagat

SEQ ID NO: 53564 - DNA, 20 bp, Artificial Sequence
  Synthetic oligonucleotide; GGG chr11 5184527 5184546 5184530 -
tgtaatggaatcaagagatg

SEQ ID NO: 53565 - DNA, 20 bp, Artificial Sequence
  Synthetic oligonucleotide; GGG chr11 5184526 5184545 5184529 -
gtaatggaatcaagagatgg

SEQ ID NO: 53566 - DNA, 20 bp, Artificial Sequence
  Synthetic oligonucleotide; GAG chr11 5184524 5184543 5184527 -
aatggaatcaagagatgggg

SEQ ID NO: 53567 - DNA, 20 bp, Artificial Sequence
  Synthetic oligonucleotide; CAG chr11 5184521 5184540 5184524 -
ggaatcaagagatgggggag

SEQ ID NO: 53568 - DNA, 20 bp, Artificial Sequence
  Synthetic oligonucleotide; AAG chr11 5184509 5184528 5184512 -
tgggggagcagtcatttctt

SEQ ID NO: 53569 - DNA, 20 bp, Artificial Sequence
  Synthetic oligonucleotide; AAG chr11 5184484 5184503 5184487 -
cctgtgccacctcaaaaaac

SEQ ID NO: 53570 - DNA, 20 bp, Artificial Sequence
  Synthetic oligonucleotide; TAG chr11 5184476 5184495 5184479 -
acctcaaaaaacaagaactt

SEQ ID NO: 53571 - DNA, 20 bp, Artificial Sequence
  Synthetic oligonucleotide; CAG chr11 5184472 5184491 5184475 -
caaaaaacaagaactttagc

SEQ ID NO: 53572 - DNA, 20 bp, Artificial Sequence
  Synthetic oligonucleotide; GAG chr11 5184460 5184479 5184463 -
actttagccagcttttactt

SEQ ID NO: 53573 - DNA, 20 bp, Artificial Sequence
  Synthetic oligonucleotide; AAG chr11 5184456 5184475 5184459 -
tagccagcttttacttgaga

SEQ ID NO: 53574 - DNA, 20 bp, Artificial Sequence
  Synthetic oligonucleotide; AGG chr11 5184455 5184474 5184458 -
agccagcttttacttgagaa

SEQ ID NO: 53575 - DNA, 20 bp, Artificial Sequence
  Synthetic oligonucleotide; GGG chr11 5184454 5184473 5184457 -
gccagcttttacttgagaaa

SEQ ID NO: 53576 - DNA, 20 bp, Artificial Sequence
  Synthetic oligonucleotide; TAG chr11 5184447 5184466 5184450 -
tttacttgagaaagggaact

SEQ ID NO: 53577 - DNA, 20 bp, Artificial Sequence
  Synthetic oligonucleotide; GAG chr11 5184445 5184464 5184448 -
tacttgagaaagggaactta

SEQ ID NO: 53578 - DNA, 20 bp, Artificial Sequence
  Synthetic oligonucleotide; GAG chr11 5184443 5184462 5184446 -
cttgagaaagggaacttaga

SEQ ID NO: 53579 - DNA, 20 bp, Artificial Sequence
  Synthetic oligonucleotide; TAG chr11 5184438 5184457 5184441 -
gaaagggaacttagagagta

SEQ ID NO: 53580 - DNA, 20 bp, Artificial Sequence
  Synthetic oligonucleotide; AAG chr11 5184435 5184454 5184438 -
agggaacttagagagtatag

SEQ ID NO: 53581 - DNA, 20 bp, Artificial Sequence
  Synthetic oligonucleotide; TAG chr11 5184334 5184353 5184337 -
tatctatctatctatctttc

SEQ ID NO: 53582 - DNA, 20 bp, Artificial Sequence
  Synthetic oligonucleotide; TAG chr11 5184330 5184349 5184333 -
tatctatctatctttctagc

SEQ ID NO: 53583 - DNA, 20 bp, Artificial Sequence
  Synthetic oligonucleotide; TAG chr11 5184326 5184345 5184329 -
tatctatctttctagctagc

SEQ ID NO: 53584 - DNA, 20 bp, Artificial Sequence
  Synthetic oligonucleotide; TAG chr11 5184322 5184341 5184325 -
tatctttctagctagctagc

SEQ ID NO: 53585 - DNA, 20 bp, Artificial Sequence
  Synthetic oligonucleotide; TAG chr11 5184318 5184337 5184321 -
tttctagctagctagctagc

SEQ ID NO: 53586 - DNA, 20 bp, Artificial Sequence
  Synthetic oligonucleotide; TAG chr11 5184314 5184333 5184317 -
tagctagctagctagctagc

SEQ ID NO: 53587 - DNA, 20 bp, Artificial Sequence
  Synthetic oligonucleotide; TAG chr11 5184310 5184329 5184313 -
tagctagctagctagctagc

SEQ ID NO: 53588 - DNA, 20 bp, Artificial Sequence
  Synthetic oligonucleotide; TGG chr11 5184265 5184284 5184268 -
tctgtatatgtcacctaccc

SEQ ID NO: 53589 - DNA, 20 bp, Artificial Sequence
  Synthetic oligonucleotide; TAG chr11 5184202 5184221 5184205 -
ttgcttctatccacattttt

SEQ ID NO: 53590 - DNA, 20 bp, Artificial Sequence
  Synthetic oligonucleotide; TAG chr11 5184196 5184215 5184199 -
ctatccacattttttagaac

SEQ ID NO: 53591 - DNA, 20 bp, Artificial Sequence
  Synthetic oligonucleotide; TAG chr11 5184189 5184208 5184192 -
cattttttagaactagtaat

SEQ ID NO: 53592 - DNA, 20 bp, Artificial Sequence
  Synthetic oligonucleotide; AAG chr11 5184179 5184198 5184182 -
aactagtaattagtaataac

SEQ ID NO: 53593 - DNA, 20 bp, Artificial Sequence
  Synthetic oligonucleotide; AAG chr11 5184166 5184185 5184169 -
taataacaagtaatatattg

SEQ ID NO: 53594 - DNA, 20 bp, Artificial Sequence
  Synthetic oligonucleotide; TAG chr11 5184158 5184177 5184161 -
agtaatatattgaagtaata

SEQ ID NO: 53595 - DNA, 20 bp, Artificial Sequence
  Synthetic oligonucleotide; TGG chr11 5184112 5184131 5184115 -
cattaaattacttgctgctg

SEQ ID NO: 53596 - DNA, 20 bp, Artificial Sequence
  Synthetic oligonucleotide; TGG chr11 5184109 5184128 5184112 -
taaattacttgctgctgtgg

SEQ ID NO: 53597 - DNA, 20 bp, Artificial Sequence
  Synthetic oligonucleotide; TAG chr11 5184102 5184121 5184105 -
cttgctgctgtggtggtact

SEQ ID NO: 53598 - DNA, 20 bp, Artificial Sequence
  Synthetic oligonucleotide; CAG chr11 5184061 5184080 5184064 -
attaattattgtctcaattt

SEQ ID NO: 53599 - DNA, 20 bp, Artificial Sequence
  Synthetic oligonucleotide; GAG chr11 5184059 5184078 5184062 -
taattattgtctcaatttca

SEQ ID NO: 53600 - DNA, 20 bp, Artificial Sequence
  Synthetic oligonucleotide; AAG chr11 5184039 5184058 5184042 -
gagcctattatttgtctatt

SEQ ID NO: 53601 - DNA, 20 bp, Artificial Sequence
  Synthetic oligonucleotide; GAG chr11 5184037 5184056 5184040 -
gcctattatttgtctattaa

SEQ ID NO: 53602 - DNA, 20 bp, Artificial Sequence
  Synthetic oligonucleotide; TGG chr11 5184020 5184039 5184023 -
taagagattcaatttctccc

SEQ ID NO: 53603 - DNA, 20 bp, Artificial Sequence
  Synthetic oligonucleotide; TAG chr11 5184015 5184034 5184018 -
gattcaatttctccctggtt

SEQ ID NO: 53604 - DNA, 20 bp, Artificial Sequence
  Synthetic oligonucleotide; TGG chr11 5184009 5184028 5184012 -
atttctccctggtttagtct

SEQ ID NO: 53605 - DNA, 20 bp, Artificial Sequence
  Synthetic oligonucleotide; GGG chr11 5184008 5184027 5184011 -
tttctccctggtttagtctt

SEQ ID NO: 53606 - DNA, 20 bp, Artificial Sequence
  Synthetic oligonucleotide; GAG chr11 5184006 5184025 5184009 -
tctccctggtttagtcttgg

SEQ ID NO: 53607 - DNA, 20 bp, Artificial Sequence
  Synthetic oligonucleotide; AGG chr11 5184005 5184024 5184008 -
ctccctggtttagtcttggg

SEQ ID NO: 53608 - DNA, 20 bp, Artificial Sequence
  Synthetic oligonucleotide; GGG chr11 5184004 5184023 5184007 -
tccctggtttagtcttggga

SEQ ID NO: 53609 - DNA, 20 bp, Artificial Sequence
  Synthetic oligonucleotide; GAG chr11 5183991 5184010 5183994 -
cttgggagggtgtatgtgtc

SEQ ID NO: 53610 - DNA, 20 bp, Artificial Sequence
  Synthetic oligonucleotide; AGG chr11 5183990 5184009 5183993 -
ttgggagggtgtatgtgtcg

SEQ ID NO: 53611 - DNA, 20 bp, Artificial Sequence
  Synthetic oligonucleotide; TAG chr11 5183970 5183989 5183973 -
aggaatttatccatttctac

SEQ ID NO: 53612 - DNA, 20 bp, Artificial Sequence
  Synthetic oligonucleotide; TAG chr11 5183961 5183980 5183964 -
tccatttctactagattttc

SEQ ID NO: 53613 - DNA, 20 bp, Artificial Sequence
  Synthetic oligonucleotide; TAG chr11 5183948 5183967 5183951 -
gattttctagtttatttgcg

SEQ ID NO: 53614 - DNA, 20 bp, Artificial Sequence
  Synthetic oligonucleotide; GAG chr11 5183946 5183965 5183949 -
ttttctagtttatttgcgta

SEQ ID NO: 53615 - DNA, 20 bp, Artificial Sequence
  Synthetic oligonucleotide; AGG chr11 5183945 5183964 5183948 -
tttctagtttatttgcgtag

SEQ ID NO: 53616 - DNA, 20 bp, Artificial Sequence
  Synthetic oligonucleotide; TAG chr11 5183936 5183955 5183939 -
tatttgcgtagaggtgttta

SEQ ID NO: 53617 - DNA, 20 bp, Artificial Sequence
  Synthetic oligonucleotide; TGG chr11 5183923 5183942 5183926 -
gtgtttatagtattctctga

SEQ ID NO: 53618 - DNA, 20 bp, Artificial Sequence
  Synthetic oligonucleotide; TAG chr11 5183920 5183939 5183923 -
tttatagtattctctgatgg

SEQ ID NO: 53619 - DNA, 20 bp, Artificial Sequence
  Synthetic oligonucleotide; TGG chr11 5183905 5183924 5183908 -
gatggtagtttgtatgtctg

SEQ ID NO: 53620 - DNA, 20 bp, Artificial Sequence
  Synthetic oligonucleotide; GGG chr11 5183904 5183923 5183907 -
atggtagtttgtatgtctgt

SEQ ID NO: 53621 - DNA, 20 bp, Artificial Sequence
  Synthetic oligonucleotide; TGG chr11 5183899 5183918 5183902 -
agtttgtatgtctgtgggat

SEQ ID NO: 53622 - DNA, 20 bp, Artificial Sequence
  Synthetic oligonucleotide; TGG chr11 5183896 5183915 5183899 -
ttgtatgtctgtgggattgg

SEQ ID NO: 53623 - DNA, 20 bp, Artificial Sequence
  Synthetic oligonucleotide; GAG chr11 5183857 5183876 5183860 -
atttcttattgcatctattt

SEQ ID NO: 53624 - DNA, 20 bp, Artificial Sequence
  Synthetic oligonucleotide; TAG chr11 5183832 5183851 5183835 -
ttctctcttttcttctttat

SEQ ID NO: 53625 - DNA, 20 bp, Artificial Sequence
  Synthetic oligonucleotide; TAG chr11 5183823 5183842 5183826 -
ttcttctttattagtcttgc

SEQ ID NO: 53626 - DNA, 20 bp, Artificial Sequence
  Synthetic oligonucleotide; CAG chr11 5183820 5183839 5183823 -
ttctttattagtcttgctag

SEQ ID NO: 53627 - DNA, 20 bp, Artificial Sequence
  Synthetic oligonucleotide; CAG chr11 5183786 5183805 5183789 -
tgttgatcttttcaaaaaac

SEQ ID NO: 53628 - DNA, 20 bp, Artificial Sequence
  Synthetic oligonucleotide; TGG chr11 5183779 5183798 5183782 -
cttttcaaaaaaccagctcc

SEQ ID NO: 53629 - DNA, 20 bp, Artificial Sequence
  Synthetic oligonucleotide; AAG chr11 5183760 5183779 5183763 -
ctggattcattgattttttt

SEQ ID NO: 53630 - DNA, 20 bp, Artificial Sequence
  Synthetic oligonucleotide; AGG chr11 5183759 5183778 5183762 -
tggattcattgattttttta

SEQ ID NO: 53631 - DNA, 20 bp, Artificial Sequence
  Synthetic oligonucleotide; GGG chr11 5183758 5183777 5183761 -
ggattcattgatttttttaa

SEQ ID NO: 53632 - DNA, 20 bp, Artificial Sequence
  Synthetic oligonucleotide; TAG chr11 5183695 5183714 5183698 -
acttatttcttgccttccgc

SEQ ID NO: 53633 - DNA, 20 bp, Artificial Sequence
  Synthetic oligonucleotide; AAG chr11 5183685 5183704 5183688 -
tgccttccgctagcttttga

SEQ ID NO: 53634 - DNA, 20 bp, Artificial Sequence
  Synthetic oligonucleotide; TAG chr11 5183664 5183683 5183667 -
agtgtttgctcttgcttctc

SEQ ID NO: 53635 - DNA, 20 bp, Artificial Sequence
  Synthetic oligonucleotide; TAG chr11 5183643 5183662 5183646 -
agttcttttaattgtgatgt

SEQ ID NO: 53636 - DNA, 20 bp, Artificial Sequence
  Synthetic oligonucleotide; AGG chr11 5183642 5183661 5183645 -
gttcttttaattgtgatgtt

SEQ ID NO: 53637 - DNA, 20 bp, Artificial Sequence
  Synthetic oligonucleotide; GGG chr11 5183641 5183660 5183644 -
ttcttttaattgtgatgtta

SEQ ID NO: 53638 - DNA, 20 bp, Artificial Sequence
  Synthetic oligonucleotide; TAG chr11 5183629 5183648 5183632 -
tgatgttagggtgtcaattt

SEQ ID NO: 53639 - DNA, 20 bp, Artificial Sequence
  Synthetic oligonucleotide; TGG chr11 5183606 5183625 5183609 -
atctttcctgctttcttttg

SEQ ID NO: 53640 - DNA, 20 bp, Artificial Sequence
  Synthetic oligonucleotide; GGG chr11 5183605 5183624 5183608 -
tctttcctgctttcttttgt

SEQ ID NO: 53641 - DNA, 20 bp, Artificial Sequence
  Synthetic oligonucleotide; TAG chr11 5183598 5183617 5183601 -
tgctttcttttgtgggcatt

SEQ ID NO: 53642 - DNA, 20 bp, Artificial Sequence
  Synthetic oligonucleotide; CAG chr11 5183555 5183574 5183558 -
acactgctttaaatgtgtcc

SEQ ID NO: 53643 - DNA, 20 bp, Artificial Sequence
  Synthetic oligonucleotide; GAG chr11 5183553 5183572 5183556 -
actgctttaaatgtgtccca

SEQ ID NO: 53644 - DNA, 20 bp, Artificial Sequence
  Synthetic oligonucleotide; TGG chr11 5183521 5183540 5183524 -
tgttgtatctttattctcgt

SEQ ID NO: 53645 - DNA, 20 bp, Artificial Sequence
  Synthetic oligonucleotide; AAG chr11 5183513 5183532 5183516 -
ctttattctcgttggtttca

SEQ ID NO: 53646 - DNA, 20 bp, Artificial Sequence
  Synthetic oligonucleotide; CAG chr11 5183474 5183493 5183477 -
ccttcattttgttatgtacc

SEQ ID NO: 53647 - DNA, 20 bp, Artificial Sequence
  Synthetic oligonucleotide; TAG chr11 5183471 5183490 5183474 -
tcattttgttatgtacccag

SEQ ID NO: 53648 - DNA, 20 bp, Artificial Sequence
  Synthetic oligonucleotide; CAG chr11 5183463 5183482 5183466 -
ttatgtacccagtagtcatt

SEQ ID NO: 53649 - DNA, 20 bp, Artificial Sequence
  Synthetic oligonucleotide; AGG chr11 5183462 5183481 5183465 -
tatgtacccagtagtcattc

SEQ ID NO: 53650 - DNA, 20 bp, Artificial Sequence
  Synthetic oligonucleotide; GAG chr11 5183460 5183479 5183463 -
tgtacccagtagtcattcag

SEQ ID NO: 53651 - DNA, 20 bp, Artificial Sequence
  Synthetic oligonucleotide; CAG chr11 5183457 5183476 5183460 -
acccagtagtcattcaggag

SEQ ID NO: 53652 - DNA, 20 bp, Artificial Sequence
  Synthetic oligonucleotide; AGG chr11 5183456 5183475 5183459 -
cccagtagtcattcaggagc

SEQ ID NO: 53653 - DNA, 20 bp, Artificial Sequence
  Synthetic oligonucleotide; CAG chr11 5183448 5183467 5183451 -
tcattcaggagcaggctgtt

SEQ ID NO: 53654 - DNA, 20 bp, Artificial Sequence
  Synthetic oligonucleotide; TAG chr11 5183437 5183456 5183440 -
caggctgttcagtttccatg

SEQ ID NO: 53655 - DNA, 20 bp, Artificial Sequence
  Synthetic oligonucleotide; GAG chr11 5183432 5183451 5183435 -
tgttcagtttccatgtagtt

SEQ ID NO: 53656 - DNA, 20 bp, Artificial Sequence
  Synthetic oligonucleotide; TGG chr11 5183429 5183448 5183432 -
tcagtttccatgtagttgag

SEQ ID NO: 53657 - DNA, 20 bp, Artificial Sequence
  Synthetic oligonucleotide; GAG chr11 5183422 5183441 5183425 -
ccatgtagttgagtggtttt

SEQ ID NO: 53658 - DNA, 20 bp, Artificial Sequence
  Synthetic oligonucleotide; GAG chr11 5183418 5183437 5183421 -
gtagttgagtggttttgagt

SEQ ID NO: 53659 - DNA, 20 bp, Artificial Sequence
  Synthetic oligonucleotide; GAG chr11 5183403 5183422 5183406 -
tgagtgagtttcttaatcct

SEQ ID NO: 53660 - DNA, 20 bp, Artificial Sequence
  Synthetic oligonucleotide; TAG chr11 5183397 5183416 5183400 -
agtttcttaatcctgagttc

SEQ ID NO: 53661 - DNA, 20 bp, Artificial Sequence
  Synthetic oligonucleotide; TGG chr11 5183381 5183400 5183384 -
gttctagtttgattgcactg

SEQ ID NO: 53662 - DNA, 20 bp, Artificial Sequence
  Synthetic oligonucleotide; GAG chr11 5183375 5183394 5183378 -
gtttgattgcactgtggtct

SEQ ID NO: 53663 - DNA, 20 bp, Artificial Sequence
  Synthetic oligonucleotide; GAG chr11 5183373 5183392 5183376 -
ttgattgcactgtggtctga

SEQ ID NO: 53664 - DNA, 20 bp, Artificial Sequence
  Synthetic oligonucleotide; CAG chr11 5183369 5183388 5183372 -
ttgcactgtggtctgagaga

SEQ ID NO: 53665 - DNA, 20 bp, Artificial Sequence
  Synthetic oligonucleotide; GAG chr11 5183334 5183353 5183337 -
tctgttcttttacgtttgct

SEQ ID NO: 53666 - DNA, 20 bp, Artificial Sequence
  Synthetic oligonucleotide; AGG chr11 5183333 5183352 5183336 -
ctgttcttttacgtttgctg

SEQ ID NO: 53667 - DNA, 20 bp, Artificial Sequence
  Synthetic oligonucleotide; GAG chr11 5183331 5183350 5183334 -
gttcttttacgtttgctgag

SEQ ID NO: 53668 - DNA, 20 bp, Artificial Sequence
  Synthetic oligonucleotide; TGG chr11 5183309 5183328 5183312 -
gtgcttcacttccaactatg

SEQ ID NO: 53669 - DNA, 20 bp, Artificial Sequence
  Synthetic oligonucleotide; TGG chr11 5183301 5183320 5183304 -
cttccaactatgtggtcaac

SEQ ID NO: 53670 - DNA, 20 bp, Artificial Sequence
  Synthetic oligonucleotide; TAG chr11 5183296 5183315 5183299 -
aactatgtggtcaactggaa

SEQ ID NO: 53671 - DNA, 20 bp, Artificial Sequence
  Synthetic oligonucleotide; AGG chr11 5183295 5183314 5183298 -
actatgtggtcaactggaat

SEQ ID NO: 53672 - DNA, 20 bp, Artificial Sequence
  Synthetic oligonucleotide; TGG chr11 5183290 5183309 5183293 -
gtggtcaactggaataggtg

SEQ ID NO: 53673 - DNA, 20 bp, Artificial Sequence
  Synthetic oligonucleotide; TGG chr11 5183285 5183304 5183288 -
caactggaataggtgtggtg

SEQ ID NO: 53674 - DNA, 20 bp, Artificial Sequence
  Synthetic oligonucleotide; GAG chr11 5183278 5183297 5183281 -
aataggtgtggtgtggtgct

SEQ ID NO: 53675 - DNA, 20 bp, Artificial Sequence
  Synthetic oligonucleotide; AAG chr11 5183275 5183294 5183278 -
aggtgtggtgtggtgctgag

SEQ ID NO: 53676 - DNA, 20 bp, Artificial Sequence
  Synthetic oligonucleotide; TGG chr11 5183253 5183272 5183256 -
gaatgtatattctattgatt

SEQ ID NO: 53677 - DNA, 20 bp, Artificial Sequence
  Synthetic oligonucleotide; GGG chr11 5183252 5183271 5183255 -
aatgtatattctattgattt

SEQ ID NO: 53678 - DNA, 20 bp, Artificial Sequence
  Synthetic oligonucleotide; TGG chr11 5183248 5183267 5183251 -
tatattctattgatttggga

SEQ ID NO: 53679 - DNA, 20 bp, Artificial Sequence
  Synthetic oligonucleotide; GAG chr11 5183246 5183265 5183249 -
tattctattgatttgggatg

SEQ ID NO: 53680 - DNA, 20 bp, Artificial Sequence
  Synthetic oligonucleotide; GAG chr11 5183244 5183263 5183247 -
ttctattgatttgggatgga

SEQ ID NO: 53681 - DNA, 20 bp, Artificial Sequence
  Synthetic oligonucleotide; TAG chr11 5183236 5183255 5183239 -
atttgggatggagagttctg

SEQ ID NO: 53682 - DNA, 20 bp, Artificial Sequence
  Synthetic oligonucleotide; TAG chr11 5183225 5183244 5183228 -
agagttctgtagatgtctat

SEQ ID NO: 53683 - DNA, 20 bp, Artificial Sequence
  Synthetic oligonucleotide; AGG chr11 5183224 5183243 5183227 -
gagttctgtagatgtctatt

SEQ ID NO: 53684 - DNA, 20 bp, Artificial Sequence
  Synthetic oligonucleotide; TGG chr11 5183215 5183234 5183218 -
agatgtctattaggtctgct

SEQ ID NO: 53685 - DNA, 20 bp, Artificial Sequence
  Synthetic oligonucleotide; CAG chr11 5183210 5183229 5183213 -
tctattaggtctgcttggtg

SEQ ID NO: 53686 - DNA, 20 bp, Artificial Sequence
  Synthetic oligonucleotide; GAG chr11 5183208 5183227 5183211 -
tattaggtctgcttggtgca

SEQ ID NO: 53687 - DNA, 20 bp, Artificial Sequence
  Synthetic oligonucleotide; TGG chr11 5183191 5183210 5183194 -
gcagagctgaattcaattcc

SEQ ID NO: 53688 - DNA, 20 bp, Artificial Sequence
  Synthetic oligonucleotide; CAG chr11 5183144 5183163 5183147 -
gttgatctgtctaatgttga

SEQ ID NO: 53689 - DNA, 20 bp, Artificial Sequence
  Synthetic oligonucleotide; TGG chr11 5183141 5183160 5183144 -
gatctgtctaatgttgacag

SEQ ID NO: 53690 - DNA, 20 bp, Artificial Sequence
  Synthetic oligonucleotide; GGG chr11 5183140 5183159 5183143 -
atctgtctaatgttgacagt

SEQ ID NO: 53691 - DNA, 20 bp, Artificial Sequence
  Synthetic oligonucleotide; GGG chr11 5183139 5183158 5183142 -
tctgtctaatgttgacagtg

SEQ ID NO: 53692 - DNA, 20 bp, Artificial Sequence
  Synthetic oligonucleotide; AAG chr11 5183131 5183150 5183134 -
atgttgacagtggggtgtta

SEQ ID NO: 53693 - DNA, 20 bp, Artificial Sequence
  Synthetic oligonucleotide; TGG chr11 5183110 5183129 5183113 -
agtctcccattattattgtg

SEQ ID NO: 53694 - DNA, 20 bp, Artificial Sequence
  Synthetic oligonucleotide; GGG chr11 5183109 5183128 5183112 -
gtctcccattattattgtgt

SEQ ID NO: 53695 - DNA, 20 bp, Artificial Sequence
  Synthetic oligonucleotide; GAG chr11 5183107 5183126 5183110 -
ctcccattattattgtgtgg

SEQ ID NO: 53696 - DNA, 20 bp, Artificial Sequence
  Synthetic oligonucleotide; AAG chr11 5183101 5183120 5183104 -
ttattattgtgtgggagtct

SEQ ID NO: 53697 - DNA, 20 bp, Artificial Sequence
  Synthetic oligonucleotide; TAG chr11 5183090 5183109 5183093 -
tgggagtctaagtctctttg

SEQ ID NO: 53698 - DNA, 20 bp, Artificial Sequence
  Synthetic oligonucleotide; AGG chr11 5183089 5183108 5183092 -
gggagtctaagtctctttgt

SEQ ID NO: 53699 - DNA, 20 bp, Artificial Sequence
  Synthetic oligonucleotide; AAG chr11 5183081 5183100 5183084 -
aagtctctttgtaggtctct

SEQ ID NO: 53700 - DNA, 20 bp, Artificial Sequence
  Synthetic oligonucleotide; AGG chr11 5183080 5183099 5183083 -
agtctctttgtaggtctcta

SEQ ID NO: 53701 - DNA, 20 bp, Artificial Sequence
  Synthetic oligonucleotide; TGG chr11 5183061 5183080 5183064 -
aaggacttgctttatgaatc

SEQ ID NO: 53702 - DNA, 20 bp, Artificial Sequence
  Synthetic oligonucleotide; GGG chr11 5183060 5183079 5183063 -
aggacttgctttatgaatct

SEQ ID NO: 53703 - DNA, 20 bp, Artificial Sequence
  Synthetic oligonucleotide; TGG chr11 5183046 5183065 5183049 -
gaatctgggtgctgctgtat

SEQ ID NO: 53704 - DNA, 20 bp, Artificial Sequence
  Synthetic oligonucleotide; GGG chr11 5183045 5183064 5183048 -
aatctgggtgctgctgtatt

SEQ ID NO: 53705 - DNA, 20 bp, Artificial Sequence
  Synthetic oligonucleotide; TAG chr11 5183030 5183049 5183033 -
gtattgggtgcatatatatt

SEQ ID NO: 53706 - DNA, 20 bp, Artificial Sequence
  Synthetic oligonucleotide; AGG chr11 5183029 5183048 5183032 -
tattgggtgcatatatattt

SEQ ID NO: 53707 - DNA, 20 bp, Artificial Sequence
  Synthetic oligonucleotide; TAG chr11 5183025 5183044 5183028 -
gggtgcatatatatttagga

SEQ ID NO: 53708 - DNA, 20 bp, Artificial Sequence
  Synthetic oligonucleotide; TAG chr11 5183021 5183040 5183024 -
gcatatatatttaggatagt

SEQ ID NO: 53709 - DNA, 20 bp, Artificial Sequence
  Synthetic oligonucleotide; CAG chr11 5182991 5183010 5182994 -
tgttgaattgatccctttac

SEQ ID NO: 53710 - DNA, 20 bp, Artificial Sequence
  Synthetic oligonucleotide; TGG chr11 5182981 5183000 5182984 -
atccctttaccagtatgtaa

SEQ ID NO: 53711 - DNA, 20 bp, Artificial Sequence
  Synthetic oligonucleotide; TGG chr11 5182952 5182971 5182955 -
ttgtctcttttgatctttgt

SEQ ID NO: 53712 - DNA, 20 bp, Artificial Sequence
  Synthetic oligonucleotide; AAG chr11 5182945 5182964 5182948 -
ttttgatctttgttggttta

SEQ ID NO: 53713 - DNA, 20 bp, Artificial Sequence
  Synthetic oligonucleotide; CAG chr11 5182932 5182951 5182935 -
tggtttaaagtctgttttat

SEQ ID NO: 53714 - DNA, 20 bp, Artificial Sequence
  Synthetic oligonucleotide; GAG chr11 5182930 5182949 5182933 -
gtttaaagtctgttttatca

SEQ ID NO: 53715 - DNA, 20 bp, Artificial Sequence
  Synthetic oligonucleotide; AAG chr11 5182924 5182943 5182927 -
agtctgttttatcagagact

SEQ ID NO: 53716 - DNA, 20 bp, Artificial Sequence
  Synthetic oligonucleotide; TGG chr11 5182884 5182903 5182887 -
ttttttgttttccatttgct

SEQ ID NO: 53717 - DNA, 20 bp, Artificial Sequence
  Synthetic oligonucleotide; TAG chr11 5182881 5182900 5182884 -
tttgttttccatttgcttgg

SEQ ID NO: 53718 - DNA, 20 bp, Artificial Sequence
  Synthetic oligonucleotide; GAG chr11 5182855 5182874 5182858 -
ttcctccatccctttatttt

SEQ ID NO: 53719 - DNA, 20 bp, Artificial Sequence
  Synthetic oligonucleotide; GAG chr11 5182831 5182850 5182834 -
ctatgtgtgtctctccacat

SEQ ID NO: 53720 - DNA, 20 bp, Artificial Sequence
  Synthetic oligonucleotide; TGG chr11 5182826 5182845 5182829 -
tgtgtctctccacatgagat

SEQ ID NO: 53721 - DNA, 20 bp, Artificial Sequence
  Synthetic oligonucleotide; CAG chr11 5182812 5182831 5182815 -
tgagattggtttcctgaata

SEQ ID NO: 53722 - DNA, 20 bp, Artificial Sequence
  Synthetic oligonucleotide; TAG chr11 5182801 5182820 5182804 -
tcctgaatacagcacactga

SEQ ID NO: 53723 - DNA, 20 bp, Artificial Sequence
  Synthetic oligonucleotide; AGG chr11 5182800 5182819 5182803 -
cctgaatacagcacactgat

SEQ ID NO: 53724 - DNA, 20 bp, Artificial Sequence
  Synthetic oligonucleotide; CAG chr11 5182774 5182793 5182777 -
tgactctttatccaatttgc

SEQ ID NO: 53725 - DNA, 20 bp, Artificial Sequence
  Synthetic oligonucleotide; TGG chr11 5182756 5182775 5182759 -
gccagtctgtgtcttttaat

SEQ ID NO: 53726 - DNA, 20 bp, Artificial Sequence
  Synthetic oligonucleotide; GAG chr11 5182754 5182773 5182757 -
cagtctgtgtcttttaattg

SEQ ID NO: 53727 - DNA, 20 bp, Artificial Sequence
  Synthetic oligonucleotide; TAG chr11 5182747 5182766 5182750 -
tgtcttttaattggagcatt

SEQ ID NO: 53728 - DNA, 20 bp, Artificial Sequence
  Synthetic oligonucleotide; AAG chr11 5182731 5182750 5182734 -
catttagctcatttacattt

SEQ ID NO: 53729 - DNA, 20 bp, Artificial Sequence
  Synthetic oligonucleotide; AGG chr11 5182730 5182749 5182733 -
atttagctcatttacattta

SEQ ID NO: 53730 - DNA, 20 bp, Artificial Sequence
  Synthetic oligonucleotide; GAG chr11 5182712 5182731 5182715 -
taaggttaatattgttatgt

SEQ ID NO: 53731 - DNA, 20 bp, Artificial Sequence
  Synthetic oligonucleotide; TAG chr11 5182685 5182704 5182688 -
tgatcctgtcattatgatgt

SEQ ID NO: 53732 - DNA, 20 bp, Artificial Sequence
  Synthetic oligonucleotide; TGG chr11 5182681 5182700 5182684 -
cctgtcattatgatgttagc

SEQ ID NO: 53733 - DNA, 20 bp, Artificial Sequence
  Synthetic oligonucleotide; TAG chr11 5182665 5182684 5182668 -
tagctggttattttgcttgc

SEQ ID NO: 53734 - DNA, 20 bp, Artificial Sequence
  Synthetic oligonucleotide; CAG chr11 5182656 5182675 5182659 -
attttgcttgctagttgatg

SEQ ID NO: 53735 - DNA, 20 bp, Artificial Sequence
  Synthetic oligonucleotide; TAG chr11 5182645 5182664 5182648 -
tagttgatgcagtttctccc

SEQ ID NO: 53736 - DNA, 20 bp, Artificial Sequence
  Synthetic oligonucleotide; TGG chr11 5182636 5182655 5182639 -
cagtttctccctagccttga

SEQ ID NO: 53737 - DNA, 20 bp, Artificial Sequence
  Synthetic oligonucleotide; TGG chr11 5182622 5182641 5182625 -
ccttgatggtctttacaatt

SEQ ID NO: 53738 - DNA, 20 bp, Artificial Sequence
  Synthetic oligonucleotide; CAG chr11 5182609 5182628 5182612 -
tacaatttggcatgtttttg

SEQ ID NO: 53739 - DNA, 20 bp, Artificial Sequence
  Synthetic oligonucleotide; TGG chr11 5182606 5182625 5182609 -
aatttggcatgtttttgcag

SEQ ID NO: 53740 - DNA, 20 bp, Artificial Sequence
  Synthetic oligonucleotide; TGG chr11 5182602 5182621 5182605 -
tggcatgtttttgcagtggc

SEQ ID NO: 53741 - DNA, 20 bp, Artificial Sequence
  Synthetic oligonucleotide; TGG chr11 5182596 5182615 5182599 -
gtttttgcagtggctggtac

SEQ ID NO: 53742 - DNA, 20 bp, Artificial Sequence
  Synthetic oligonucleotide; CAG chr11 5182564 5182583 5182567 -
tccatgtttactgcttcctt

SEQ ID NO: 53743 - DNA, 20 bp, Artificial Sequence
  Synthetic oligonucleotide; AGG chr11 5182563 5182582 5182566 -
ccatgtttactgcttccttc

SEQ ID NO: 53744 - DNA, 20 bp, Artificial Sequence
  Synthetic oligonucleotide; GAG chr11 5182561 5182580 5182564 -
atgtttactgcttccttcag

SEQ ID NO: 53745 - DNA, 20 bp, Artificial Sequence
  Synthetic oligonucleotide; TAG chr11 5182552 5182571 5182555 -
gcttccttcaggagctcttt

SEQ ID NO: 53746 - DNA, 20 bp, Artificial Sequence
  Synthetic oligonucleotide; AGG chr11 5182551 5182570 5182554 -
cttccttcaggagctctttt

SEQ ID NO: 53747 - DNA, 20 bp, Artificial Sequence
  Synthetic oligonucleotide; GGG chr11 5182550 5182569 5182553 -
ttccttcaggagctctttta

SEQ ID NO: 53748 - DNA, 20 bp, Artificial Sequence
  Synthetic oligonucleotide; CAG chr11 5182547 5182566 5182550 -
cttcaggagctcttttaggg

SEQ ID NO: 53749 - DNA, 20 bp, Artificial Sequence
  Synthetic oligonucleotide; AGG chr11 5182546 5182565 5182549 -
ttcaggagctcttttagggc

SEQ ID NO: 53750 - DNA, 20 bp, Artificial Sequence
  Synthetic oligonucleotide; TGG chr11 5182541 5182560 5182544 -
gagctcttttagggcaggcc

SEQ ID NO: 53751 - DNA, 20 bp, Artificial Sequence
  Synthetic oligonucleotide; TGG chr11 5182538 5182557 5182541 -
ctcttttagggcaggcctgg

SEQ ID NO: 53752 - DNA, 20 bp, Artificial Sequence
  Synthetic oligonucleotide; CAG chr11 5182526 5182545 5182529 -
aggcctggtggtgacaaaat

SEQ ID NO: 53753 - DNA, 20 bp, Artificial Sequence
  Synthetic oligonucleotide; AAG chr11 5182507 5182526 5182510 -
tcagcaattgcttgtctgta

SEQ ID NO: 53754 - DNA, 20 bp, Artificial Sequence
  Synthetic oligonucleotide; AAG chr11 5182480 5182499 5182483 -
ttatttctccttcacttatg

SEQ ID NO: 53755 - DNA, 20 bp, Artificial Sequence
  Synthetic oligonucleotide; AAG chr11 5182462 5182481 5182465 -
tgaagcttaccaaccaaaaa

SEQ ID NO: 53756 - DNA, 20 bp, Artificial Sequence
  Synthetic oligonucleotide; CAG chr11 5182457 5182476 5182460 -
cttaccaaccaaaaaaagtc

SEQ ID NO: 53757 - DNA, 20 bp, Artificial Sequence
  Synthetic oligonucleotide; AGG chr11 5182456 5182475 5182459 -
ttaccaaccaaaaaaagtcc

SEQ ID NO: 53758 - DNA, 20 bp, Artificial Sequence
  Synthetic oligonucleotide; CAG chr11 5182451 5182470 5182454 -
aaccaaaaaaagtccaggac

SEQ ID NO: 53759 - DNA, 20 bp, Artificial Sequence
  Synthetic oligonucleotide; TGG chr11 5182447 5182466 5182450 -
aaaaaaagtccaggaccaga

SEQ ID NO: 53760 - DNA, 20 bp, Artificial Sequence
  Synthetic oligonucleotide; CAG chr11 5182439 5182458 5182442 -
tccaggaccagatggattca

SEQ ID NO: 53761 - DNA, 20 bp, Artificial Sequence
  Synthetic oligonucleotide; CAG chr11 5182425 5182444 5182428 -
gattcacagccgaattctac

SEQ ID NO: 53762 - DNA, 20 bp, Artificial Sequence
  Synthetic oligonucleotide; GAG chr11 5182423 5182442 5182426 -
ttcacagccgaattctacca

SEQ ID NO: 53763 - DNA, 20 bp, Artificial Sequence
  Synthetic oligonucleotide; AGG chr11 5182422 5182441 5182425 -
tcacagccgaattctaccag

SEQ ID NO: 53764 - DNA, 20 bp, Artificial Sequence
  Synthetic oligonucleotide; AAG chr11 5182416 5182435 5182419 -
ccgaattctaccagaggtac

SEQ ID NO: 53765 - DNA, 20 bp, Artificial Sequence
  Synthetic oligonucleotide; AGG chr11 5182415 5182434 5182418 -
cgaattctaccagaggtaca

SEQ ID NO: 53766 - DNA, 20 bp, Artificial Sequence
  Synthetic oligonucleotide; GAG chr11 5182413 5182432 5182416 -
aattctaccagaggtacaag

SEQ ID NO: 53767 - DNA, 20 bp, Artificial Sequence
  Synthetic oligonucleotide; AGG chr11 5182412 5182431 5182415 -
attctaccagaggtacaagg

SEQ ID NO: 53768 - DNA, 20 bp, Artificial Sequence
  Synthetic oligonucleotide; GAG chr11 5182410 5182429 5182413 -
tctaccagaggtacaaggag

SEQ ID NO: 53769 - DNA, 20 bp, Artificial Sequence
  Synthetic oligonucleotide; TGG chr11 5182406 5182425 5182409 -
ccagaggtacaaggaggagc

SEQ ID NO: 53770 - DNA, 20 bp, Artificial Sequence
  Synthetic oligonucleotide; TAG chr11 5182373 5182392 5182376 -
tctgaaactattccaatcaa

SEQ ID NO: 53771 - DNA, 20 bp, Artificial Sequence
  Synthetic oligonucleotide; AAG chr11 5182367 5182386 5182370 -
actattccaatcaatagaaa

SEQ ID NO: 53772 - DNA, 20 bp, Artificial Sequence
  Synthetic oligonucleotide; GAG chr11 5182365 5182384 5182368 -
tattccaatcaatagaaaaa

SEQ ID NO: 53773 - DNA, 20 bp, Artificial Sequence
  Synthetic oligonucleotide; AGG chr11 5182364 5182383 5182367 -
attccaatcaatagaaaaag

SEQ ID NO: 53774 - DNA, 20 bp, Artificial Sequence
  Synthetic oligonucleotide; GGG chr11 5182363 5182382 5182366 -
ttccaatcaatagaaaaaga

SEQ ID NO: 53775 - DNA, 20 bp, Artificial Sequence
  Synthetic oligonucleotide; GAG chr11 5182338 5182357 5182341 -
tcctccctaactcattttat

SEQ ID NO: 53776 - DNA, 20 bp, Artificial Sequence
  Synthetic oligonucleotide; AGG chr11 5182337 5182356 5182340 -
cctccctaactcattttatg

SEQ ID NO: 53777 - DNA, 20 bp, Artificial Sequence
  Synthetic oligonucleotide; CAG chr11 5182333 5182352 5182336 -
cctaactcattttatgaggc

SEQ ID NO: 53778 - DNA, 20 bp, Artificial Sequence
  Synthetic oligonucleotide; AAG chr11 5182314 5182333 5182317 -
ccagcatcatcttgatacca

SEQ ID NO: 53779 - DNA, 20 bp, Artificial Sequence
  Synthetic oligonucleotide; TAG chr11 5182309 5182328 5182312 -
atcatcttgataccaaagcc

SEQ ID NO: 53780 - DNA, 20 bp, Artificial Sequence
  Synthetic oligonucleotide; CAG chr11 5182306 5182325 5182309 -
atcttgataccaaagcctag

SEQ ID NO: 53781 - DNA, 20 bp, Artificial Sequence
  Synthetic oligonucleotide; AAG chr11 5182289 5182308 5182292 -
tagcagacacacaacaaaaa

SEQ ID NO: 53782 - DNA, 20 bp, Artificial Sequence
  Synthetic oligonucleotide; GAG chr11 5182287 5182306 5182290 -
gcagacacacaacaaaaaaa

SEQ ID NO: 53783 - DNA, 20 bp, Artificial Sequence
  Synthetic oligonucleotide; CAG chr11 5182240 5182259 5182243 -
aacatcgatgcaaaaatcct

SEQ ID NO: 53784 - DNA, 20 bp, Artificial Sequence
  Synthetic oligonucleotide; TGG chr11 5182229 5182248 5182232 -
aaaaatcctcagtaaaatac

SEQ ID NO: 53785 - DNA, 20 bp, Artificial Sequence
  Synthetic oligonucleotide; CAG chr11 5182215 5182234 5182218 -
aaatactggcaaaccaaatc

SEQ ID NO: 53786 - DNA, 20 bp, Artificial Sequence
  Synthetic oligonucleotide; AGG chr11 5182214 5182233 5182217 -
aatactggcaaaccaaatcc

SEQ ID NO: 53787 - DNA, 20 bp, Artificial Sequence
  Synthetic oligonucleotide; GAG chr11 5182212 5182231 5182215 -
tactggcaaaccaaatccag

SEQ ID NO: 53788 - DNA, 20 bp, Artificial Sequence
  Synthetic oligonucleotide; AAG chr11 5182200 5182219 5182203 -
aaatccaggagcacatcaaa

SEQ ID NO: 53789 - DNA, 20 bp, Artificial Sequence
  Synthetic oligonucleotide; AAG chr11 5182181 5182200 5182184 -
aaagcttatccaccatgatc

SEQ ID NO: 53790 - DNA, 20 bp, Artificial Sequence
  Synthetic oligonucleotide; TGG chr11 5182178 5182197 5182181 -
gcttatccaccatgatcaag

SEQ ID NO: 53791 - DNA, 20 bp, Artificial Sequence
  Synthetic oligonucleotide; GGG chr11 5182177 5182196 5182180 -
cttatccaccatgatcaagt

SEQ ID NO: 53792 - DNA, 20 bp, Artificial Sequence
  Synthetic oligonucleotide; TGG chr11 5182165 5182184 5182168 -
gatcaagtgggcttcatccc

SEQ ID NO: 53793 - DNA, 20 bp, Artificial Sequence
  Synthetic oligonucleotide; GGG chr11 5182164 5182183 5182167 -
atcaagtgggcttcatccct

SEQ ID NO: 53794 - DNA, 20 bp, Artificial Sequence
  Synthetic oligonucleotide; CAG chr11 5182158 5182177 5182161 -
tgggcttcatccctgggatg

SEQ ID NO: 53795 - DNA, 20 bp, Artificial Sequence
  Synthetic oligonucleotide; AGG chr11 5182157 5182176 5182160 -
gggcttcatccctgggatgc

SEQ ID NO: 53796 - DNA, 20 bp, Artificial Sequence
  Synthetic oligonucleotide; GGG chr11 5182156 5182175 5182159 -
ggcttcatccctgggatgca

SEQ ID NO: 53797 - DNA, 20 bp, Artificial Sequence
  Synthetic oligonucleotide; TGG chr11 5182152 5182171 5182155 -
tcatccctgggatgcagggc

SEQ ID NO: 53798 - DNA, 20 bp, Artificial Sequence
  Synthetic oligonucleotide; CAG chr11 5182119 5182138 5182122 -
gcaaatcaataaacataatc

SEQ ID NO: 53799 - DNA, 20 bp, Artificial Sequence
  Synthetic oligonucleotide; CAG chr11 5182108 5182127 5182111 -
aacataatccagcatataaa

SEQ ID NO: 53800 - DNA, 20 bp, Artificial Sequence
  Synthetic oligonucleotide; AAG chr11 5182100 5182119 5182103 -
ccagcatataaacagaacca

SEQ ID NO: 53801 - DNA, 20 bp, Artificial Sequence
  Synthetic oligonucleotide; TAG chr11 5182073 5182092 5182076 -
aaaccacatgattatctcaa

SEQ ID NO: 53802 - DNA, 20 bp, Artificial Sequence
  Synthetic oligonucleotide; CAG chr11 5182067 5182086 5182070 -
catgattatctcaatagatg

SEQ ID NO: 53803 - DNA, 20 bp, Artificial Sequence
  Synthetic oligonucleotide; AAG chr11 5182062 5182081 5182065 -
ttatctcaatagatgcagaa

SEQ ID NO: 53804 - DNA, 20 bp, Artificial Sequence
  Synthetic oligonucleotide; AGG chr11 5182061 5182080 5182064 -
tatctcaatagatgcagaaa

SEQ ID NO: 53805 - DNA, 20 bp, Artificial Sequence
  Synthetic oligonucleotide; TAG chr11 5182010 5182029 5182013 -
actaaaaactctcaataaat

SEQ ID NO: 53806 - DNA, 20 bp, Artificial Sequence
  Synthetic oligonucleotide; AGG chr11 5182009 5182028 5182012 -
ctaaaaactctcaataaatt

SEQ ID NO: 53807 - DNA, 20 bp, Artificial Sequence
  Synthetic oligonucleotide; TGG chr11 5182000 5182019 5182003 -
ctcaataaattaggtatcga

SEQ ID NO: 53808 - DNA, 20 bp, Artificial Sequence
  Synthetic oligonucleotide; GGG chr11 5181999 5182018 5182002 -
tcaataaattaggtatcgat

SEQ ID NO: 53809 - DNA, 20 bp, Artificial Sequence
  Synthetic oligonucleotide; AAG chr11 5181979 5181998 5181982 -
gggacatatctcaaaataat

SEQ ID NO: 53810 - DNA, 20 bp, Artificial Sequence
  Synthetic oligonucleotide; GAG chr11 5181977 5181996 5181980 -
gacatatctcaaaataataa

SEQ ID NO: 53811 - DNA, 20 bp, Artificial Sequence
  Synthetic oligonucleotide; CAG chr11 5181956 5181975 5181959 -
agctatctatgacaaaccca

SEQ ID NO: 53812 - DNA, 20 bp, Artificial Sequence
  Synthetic oligonucleotide; TGG chr11 5181937 5181956 5181940 -
acagccaatatcatactgaa

SEQ ID NO: 53813 - DNA, 20 bp, Artificial Sequence
  Synthetic oligonucleotide; TGG chr11 5181926 5181945 5181929 -
catactgaatggacaaaaac

SEQ ID NO: 53814 - DNA, 20 bp, Artificial Sequence
  Synthetic oligonucleotide; AAG chr11 5181923 5181942 5181926 -
actgaatggacaaaaactgg

SEQ ID NO: 53815 - DNA, 20 bp, Artificial Sequence
  Synthetic oligonucleotide; TGG chr11 5181904 5181923 5181907 -
gaagcattccctttgaaaac

SEQ ID NO: 53816 - DNA, 20 bp, Artificial Sequence
  Synthetic oligonucleotide; AAG chr11 5181898 5181917 5181901 -
ttccctttgaaaactggcac

SEQ ID NO: 53817 - DNA, 20 bp, Artificial Sequence
  Synthetic oligonucleotide; CAG chr11 5181894 5181913 5181897 -
ctttgaaaactggcacaaga

SEQ ID NO: 53818 - DNA, 20 bp, Artificial Sequence
  Synthetic oligonucleotide; AGG chr11 5181893 5181912 5181896 -
tttgaaaactggcacaagac

SEQ ID NO: 53819 - DNA, 20 bp, Artificial Sequence
  Synthetic oligonucleotide; GGG chr11 5181892 5181911 5181895 -
ttgaaaactggcacaagaca

SEQ ID NO: 53820 - DNA, 20 bp, Artificial Sequence
  Synthetic oligonucleotide; TAG chr11 5181860 5181879 5181863 -
ctcaccactcctattcaaca

SEQ ID NO: 53821 - DNA, 20 bp, Artificial Sequence
  Synthetic oligonucleotide; TGG chr11 5181854 5181873 5181857 -
actcctattcaacatagtgt

SEQ ID NO: 53822 - DNA, 20 bp, Artificial Sequence
  Synthetic oligonucleotide; AAG chr11 5181851 5181870 5181854 -
cctattcaacatagtgttgg

SEQ ID NO: 53823 - DNA, 20 bp, Artificial Sequence
  Synthetic oligonucleotide; TGG chr11 5181845 5181864 5181848 -
caacatagtgttggaagttc

SEQ ID NO: 53824 - DNA, 20 bp, Artificial Sequence
  Synthetic oligonucleotide; CAG chr11 5181841 5181860 5181844 -
atagtgttggaagttctggc

SEQ ID NO: 53825 - DNA, 20 bp, Artificial Sequence
  Synthetic oligonucleotide; AGG chr11 5181840 5181859 5181843 -
tagtgttggaagttctggcc

SEQ ID NO: 53826 - DNA, 20 bp, Artificial Sequence
  Synthetic oligonucleotide; GGG chr11 5181839 5181858 5181842 -
agtgttggaagttctggcca

SEQ ID NO: 53827 - DNA, 20 bp, Artificial Sequence
  Synthetic oligonucleotide; CAG chr11 5181832 5181851 5181835 -
gaagttctggccagggcaat

SEQ ID NO: 53828 - DNA, 20 bp, Artificial Sequence
  Synthetic oligonucleotide; AGG chr11 5181831 5181850 5181834 -
aagttctggccagggcaatc

SEQ ID NO: 53829 - DNA, 20 bp, Artificial Sequence
  Synthetic oligonucleotide; AAG chr11 5181827 5181846 5181830 -
tctggccagggcaatcaggc

SEQ ID NO: 53830 - DNA, 20 bp, Artificial Sequence
  Synthetic oligonucleotide; GAG chr11 5181825 5181844 5181828 -
tggccagggcaatcaggcaa

SEQ ID NO: 53831 - DNA, 20 bp, Artificial Sequence
  Synthetic oligonucleotide; AAG chr11 5181821 5181840 5181824 -
cagggcaatcaggcaagaga

SEQ ID NO: 53832 - DNA, 20 bp, Artificial Sequence
  Synthetic oligonucleotide; AAG chr11 5181813 5181832 5181816 -
tcaggcaagagaaagaaata

SEQ ID NO: 53833 - DNA, 20 bp, Artificial Sequence
  Synthetic oligonucleotide; AGG chr11 5181812 5181831 5181815 -
caggcaagagaaagaaataa

SEQ ID NO: 53834 - DNA, 20 bp, Artificial Sequence
  Synthetic oligonucleotide; GGG chr11 5181811 5181830 5181814 -
aggcaagagaaagaaataaa

SEQ ID NO: 53835 - DNA, 20 bp, Artificial Sequence
  Synthetic oligonucleotide; TAG chr11 5181800 5181819 5181803 -
agaaataaagggcattcaat

SEQ ID NO: 53836 - DNA, 20 bp, Artificial Sequence
  Synthetic oligonucleotide; AGG chr11 5181799 5181818 5181802 -
gaaataaagggcattcaatt

SEQ ID NO: 53837 - DNA, 20 bp, Artificial Sequence
  Synthetic oligonucleotide; AAG chr11 5181794 5181813 5181797 -
aaagggcattcaattaggaa

SEQ ID NO: 53838 - DNA, 20 bp, Artificial Sequence
  Synthetic oligonucleotide; GAG chr11 5181792 5181811 5181795 -
agggcattcaattaggaaaa

SEQ ID NO: 53839 - DNA, 20 bp, Artificial Sequence
  Synthetic oligonucleotide; AGG chr11 5181791 5181810 5181794 -
gggcattcaattaggaaaag

SEQ ID NO: 53840 - DNA, 20 bp, Artificial Sequence
  Synthetic oligonucleotide; AAG chr11 5181788 5181807 5181791 -
cattcaattaggaaaagagg

SEQ ID NO: 53841 - DNA, 20 bp, Artificial Sequence
  Synthetic oligonucleotide; CAG chr11 5181767 5181786 5181770 -
agtgaaattgtccctgtttg

SEQ ID NO: 53842 - DNA, 20 bp, Artificial Sequence
  Synthetic oligonucleotide; TAG chr11 5181746 5181765 5181749 -
agatgacgtgattgtatatc

SEQ ID NO: 53843 - DNA, 20 bp, Artificial Sequence
  Synthetic oligonucleotide; CAG chr11 5181728 5181747 5181731 -
tctagaaaaccccatcgtct

SEQ ID NO: 53844 - DNA, 20 bp, Artificial Sequence
  Synthetic oligonucleotide; AAG chr11 5181711 5181730 5181714 -
tctcagcccaaaatctcctt

SEQ ID NO: 53845 - DNA, 20 bp, Artificial Sequence
  Synthetic oligonucleotide; AAG chr11 5181703 5181722 5181706 -
caaaatctccttaagctgat

SEQ ID NO: 53846 - DNA, 20 bp, Artificial Sequence
  Synthetic oligonucleotide; CAG chr11 5181694 5181713 5181697 -
cttaagctgataagcaactt

SEQ ID NO: 53847 - DNA, 20 bp, Artificial Sequence
  Synthetic oligonucleotide; AAG chr11 5181689 5181708 5181692 -
gctgataagcaacttcagaa

SEQ ID NO: 53848 - DNA, 20 bp, Artificial Sequence
  Synthetic oligonucleotide; CAG chr11 5181683 5181702 5181686 -
aagcaacttcagaaaagtct

SEQ ID NO: 53849 - DNA, 20 bp, Artificial Sequence
  Synthetic oligonucleotide; AAG chr11 5181653 5181672 5181656 -
aatcaatgtgcaaaaatcac

SEQ ID NO: 53850 - DNA, 20 bp, Artificial Sequence
  Synthetic oligonucleotide; CAG chr11 5181631 5181650 5181634 -
gcattcctatacaccaataa

SEQ ID NO: 53851 - DNA, 20 bp, Artificial Sequence
  Synthetic oligonucleotide; CAG chr11 5181623 5181642 5181626 -
atacaccaataacagacaaa

SEQ ID NO: 53852 - DNA, 20 bp, Artificial Sequence
  Synthetic oligonucleotide; GAG chr11 5181621 5181640 5181624 -
acaccaataacagacaaaca

SEQ ID NO: 53853 - DNA, 20 bp, Artificial Sequence
  Synthetic oligonucleotide; GAG chr11 5181619 5181638 5181622 -
accaataacagacaaacaga

SEQ ID NO: 53854 - DNA, 20 bp, Artificial Sequence
  Synthetic oligonucleotide; GAG chr11 5181607 5181626 5181610 -
caaacagagagccaaatcat

SEQ ID NO: 53855 - DNA, 20 bp, Artificial Sequence
  Synthetic oligonucleotide; AAG chr11 5181579 5181598 5181582 -
tcccattcacaattgcctca

SEQ ID NO: 53856 - DNA, 20 bp, Artificial Sequence
  Synthetic oligonucleotide; GAG chr11 5181577 5181596 5181580 -
ccattcacaattgcctcaaa

SEQ ID NO: 53857 - DNA, 20 bp, Artificial Sequence
  Synthetic oligonucleotide; TAG chr11 5181563 5181582 5181566 -
ctcaaagagaataaaatacc

SEQ ID NO: 53858 - DNA, 20 bp, Artificial Sequence
  Synthetic oligonucleotide; AGG chr11 5181562 5181581 5181565 -
tcaaagagaataaaatacct

SEQ ID NO: 53859 - DNA, 20 bp, Artificial Sequence
  Synthetic oligonucleotide; AAG chr11 5181547 5181566 5181550 -
tacctaggaatccaacttac

SEQ ID NO: 53860 - DNA, 20 bp, Artificial Sequence
  Synthetic oligonucleotide; AGG chr11 5181546 5181565 5181549 -
acctaggaatccaacttaca

SEQ ID NO: 53861 - DNA, 20 bp, Artificial Sequence
  Synthetic oligonucleotide; GGG chr11 5181545 5181564 5181548 -
cctaggaatccaacttacaa

SEQ ID NO: 53862 - DNA, 20 bp, Artificial Sequence
  Synthetic oligonucleotide; AAG chr11 5181537 5181556 5181540 -
tccaacttacaagggatgtg

SEQ ID NO: 53863 - DNA, 20 bp, Artificial Sequence
  Synthetic oligonucleotide; AGG chr11 5181536 5181555 5181539 -
ccaacttacaagggatgtga

SEQ ID NO: 53864 - DNA, 20 bp, Artificial Sequence
  Synthetic oligonucleotide; AAG chr11 5181525 5181544 5181528 -
gggatgtgaaggacctcttc

SEQ ID NO: 53865 - DNA, 20 bp, Artificial Sequence
  Synthetic oligonucleotide; AGG chr11 5181524 5181543 5181527 -
ggatgtgaaggacctcttca

SEQ ID NO: 53866 - DNA, 20 bp, Artificial Sequence
  Synthetic oligonucleotide; GAG chr11 5181522 5181541 5181525 -
atgtgaaggacctcttcaag

SEQ ID NO: 53867 - DNA, 20 bp, Artificial Sequence
  Synthetic oligonucleotide; AAG chr11 5181491 5181510 5181494 -
aacactgctcaacgaaataa

SEQ ID NO: 53868 - DNA, 20 bp, Artificial Sequence
  Synthetic oligonucleotide; GAG chr11 5181489 5181508 5181492 -
cactgctcaacgaaataaaa

SEQ ID NO: 53869 - DNA, 20 bp, Artificial Sequence
  Synthetic oligonucleotide; AGG chr11 5181488 5181507 5181491 -
actgctcaacgaaataaaag

SEQ ID NO: 53870 - DNA, 20 bp, Artificial Sequence
  Synthetic oligonucleotide; TGG chr11 5181474 5181493 5181477 -
taaaagaggatacaaacaaa

SEQ ID NO: 53871 - DNA, 20 bp, Artificial Sequence
  Synthetic oligonucleotide; AAG chr11 5181471 5181490 5181474 -
aagaggatacaaacaaatgg

SEQ ID NO: 53872 - DNA, 20 bp, Artificial Sequence
  Synthetic oligonucleotide; TGG chr11 5181453 5181472 5181456 -
ggaagaacattccatgctca

SEQ ID NO: 53873 - DNA, 20 bp, Artificial Sequence
  Synthetic oligonucleotide; TAG chr11 5181449 5181468 5181452 -
gaacattccatgctcatgga

SEQ ID NO: 53874 - DNA, 20 bp, Artificial Sequence
  Synthetic oligonucleotide; AGG chr11 5181448 5181467 5181451 -
aacattccatgctcatggat

SEQ ID NO: 53875 - DNA, 20 bp, Artificial Sequence
  Synthetic oligonucleotide; AAG chr11 5181445 5181464 5181448 -
attccatgctcatggatagg

SEQ ID NO: 53876 - DNA, 20 bp, Artificial Sequence
  Synthetic oligonucleotide; TGG chr11 5181425 5181444 5181428 -
aagaatcaatatcgtgaaaa

SEQ ID NO: 53877 - DNA, 20 bp, Artificial Sequence
  Synthetic oligonucleotide; AAG chr11 5181411 5181430 5181414 -
tgaaaatggccttactgccc

SEQ ID NO: 53878 - DNA, 20 bp, Artificial Sequence
  Synthetic oligonucleotide; AGG chr11 5181410 5181429 5181413 -
gaaaatggccttactgccca

SEQ ID NO: 53879 - DNA, 20 bp, Artificial Sequence
  Synthetic oligonucleotide; TAG chr11 5181400 5181419 5181403 -
ttactgcccaaggtaattta

SEQ ID NO: 53880 - DNA, 20 bp, Artificial Sequence
  Synthetic oligonucleotide; AAG chr11 5181378 5181397 5181381 -
gattcaatgccatccccatc

SEQ ID NO: 53881 - DNA, 20 bp, Artificial Sequence
  Synthetic oligonucleotide; CAG chr11 5181356 5181375 5181359 -
gctaccaatgactttcttca

SEQ ID NO: 53882 - DNA, 20 bp, Artificial Sequence
  Synthetic oligonucleotide; TGG chr11 5181350 5181369 5181353 -
aatgactttcttcacagaat

SEQ ID NO: 53883 - DNA, 20 bp, Artificial Sequence
  Synthetic oligonucleotide; AAG chr11 5181333 5181352 5181336 -
aattggaaaaaactacttta

SEQ ID NO: 53884 - DNA, 20 bp, Artificial Sequence
  Synthetic oligonucleotide; TGG chr11 5181324 5181343 5181327 -
aaactactttaaagttcata

SEQ ID NO: 53885 - DNA, 20 bp, Artificial Sequence
  Synthetic oligonucleotide; AAG chr11 5181313 5181332 5181316 -
aagttcatatggaaccaaaa

SEQ ID NO: 53886 - DNA, 20 bp, Artificial Sequence
  Synthetic oligonucleotide; GAG chr11 5181311 5181330 5181314 -
gttcatatggaaccaaaaaa

SEQ ID NO: 53887 - DNA, 20 bp, Artificial Sequence
  Synthetic oligonucleotide; AAG chr11 5181297 5181316 5181300 -
aaaaaagagcccgcattgac

SEQ ID NO: 53888 - DNA, 20 bp, Artificial Sequence
  Synthetic oligonucleotide; AAG chr11 5181286 5181305 5181289 -
cgcattgacaagtcaatcct

SEQ ID NO: 53889 - DNA, 20 bp, Artificial Sequence
  Synthetic oligonucleotide; AAG chr11 5181279 5181298 5181282 -
acaagtcaatcctaagccaa

SEQ ID NO: 53890 - DNA, 20 bp, Artificial Sequence
  Synthetic oligonucleotide; AAG chr11 5181272 5181291 5181275 -
aatcctaagccaaaagaaca

SEQ ID NO: 53891 - DNA, 20 bp, Artificial Sequence
  Synthetic oligonucleotide; TAG chr11 5181268 5181287 5181271 -
ctaagccaaaagaacaaagc

SEQ ID NO: 53892 - DNA, 20 bp, Artificial Sequence
  Synthetic oligonucleotide; GAG chr11 5181266 5181285 5181269 -
aagccaaaagaacaaagcta

SEQ ID NO: 53893 - DNA, 20 bp, Artificial Sequence
  Synthetic oligonucleotide; AGG chr11 5181265 5181284 5181268 -
agccaaaagaacaaagctag

SEQ ID NO: 53894 - DNA, 20 bp, Artificial Sequence
  Synthetic oligonucleotide; AAG chr11 5181231 5181250 5181234 -
ctgacttcaaactatactac

SEQ ID NO: 53895 - DNA, 20 bp, Artificial Sequence
  Synthetic oligonucleotide; AGG chr11 5181230 5181249 5181233 -
tgacttcaaactatactaca

SEQ ID NO: 53896 - DNA, 20 bp, Artificial Sequence
  Synthetic oligonucleotide; CAG chr11 5181225 5181244 5181228 -
tcaaactatactacaaggta

SEQ ID NO: 53897 - DNA, 20 bp, Artificial Sequence
  Synthetic oligonucleotide; TGG chr11 5181208 5181227 5181211 -
gtacagtaaccaaaacaaca

SEQ ID NO: 53898 - DNA, 20 bp, Artificial Sequence
  Synthetic oligonucleotide; TGG chr11 5181202 5181221 5181205 -
taaccaaaacaacatggtac

SEQ ID NO: 53899 - DNA, 20 bp, Artificial Sequence
  Synthetic oligonucleotide; CAG chr11 5181191 5181210 5181194 -
acatggtactggtaccaaaa

SEQ ID NO: 53900 - DNA, 20 bp, Artificial Sequence
  Synthetic oligonucleotide; GAG chr11 5181189 5181208 5181192 -
atggtactggtaccaaaaca

SEQ ID NO: 53901 - DNA, 20 bp, Artificial Sequence
  Synthetic oligonucleotide; TAG chr11 5181183 5181202 5181186 -
ctggtaccaaaacagagatg

SEQ ID NO: 53902 - DNA, 20 bp, Artificial Sequence
  Synthetic oligonucleotide; TGG chr11 5181175 5181194 5181178 -
aaaacagagatgtagaccaa

SEQ ID NO: 53903 - DNA, 20 bp, Artificial Sequence
  Synthetic oligonucleotide; GAG chr11 5181173 5181192 5181176 -
aacagagatgtagaccaatg

SEQ ID NO: 53904 - DNA, 20 bp, Artificial Sequence
  Synthetic oligonucleotide; CAG chr11 5181170 5181189 5181173 -
agagatgtagaccaatggag

SEQ ID NO: 53905 - DNA, 20 bp, Artificial Sequence
  Synthetic oligonucleotide; CAG chr11 5181165 5181184 5181168 -
tgtagaccaatggagcagaa

SEQ ID NO: 53906 - DNA, 20 bp, Artificial Sequence
  Synthetic oligonucleotide; GAG chr11 5181163 5181182 5181166 -
tagaccaatggagcagaaca

SEQ ID NO: 53907 - DNA, 20 bp, Artificial Sequence
  Synthetic oligonucleotide; CAG chr11 5181156 5181175 5181159 -
atggagcagaacagagctct

SEQ ID NO: 53908 - DNA, 20 bp, Artificial Sequence
  Synthetic oligonucleotide; AAG chr11 5181100 5181119 5181103 -
ttgacaaacctgacaaaaac

SEQ ID NO: 53909 - DNA, 20 bp, Artificial Sequence
  Synthetic oligonucleotide; TGG chr11 5181094 5181113 5181097 -
aacctgacaaaaacaagcaa

SEQ ID NO: 53910 - DNA, 20 bp, Artificial Sequence
  Synthetic oligonucleotide; GGG chr11 5181093 5181112 5181096 -
acctgacaaaaacaagcaat

SEQ ID NO: 53911 - DNA, 20 bp, Artificial Sequence
  Synthetic oligonucleotide; GGG chr11 5181092 5181111 5181095 -
cctgacaaaaacaagcaatg

SEQ ID NO: 53912 - DNA, 20 bp, Artificial Sequence
  Synthetic oligonucleotide; AAG chr11 5181088 5181107 5181091 -
acaaaaacaagcaatgggga

SEQ ID NO: 53913 - DNA, 20 bp, Artificial Sequence
  Synthetic oligonucleotide; AGG chr11 5181087 5181106 5181090 -
caaaaacaagcaatggggaa

SEQ ID NO: 53914 - DNA, 20 bp, Artificial Sequence
  Synthetic oligonucleotide; TGG chr11 5181061 5181080 5181064 -
ccctatttaataaatgatgc

SEQ ID NO: 53915 - DNA, 20 bp, Artificial Sequence
  Synthetic oligonucleotide; GGG chr11 5181060 5181079 5181063 -
cctatttaataaatgatgct

SEQ ID NO: 53916 - DNA, 20 bp, Artificial Sequence
  Synthetic oligonucleotide; TGG chr11 5181052 5181071 5181055 -
ataaatgatgctgggaaaac

SEQ ID NO: 53917 - DNA, 20 bp, Artificial Sequence
  Synthetic oligonucleotide; TAG chr11 5181048 5181067 5181051 -
atgatgctgggaaaactggc

SEQ ID NO: 53918 - DNA, 20 bp, Artificial Sequence
  Synthetic oligonucleotide; TAG chr11 5181038 5181057 5181041 -
gaaaactggctagccatatg

SEQ ID NO: 53919 - DNA, 20 bp, Artificial Sequence
  Synthetic oligonucleotide; AAG chr11 5181034 5181053 5181037 -
actggctagccatatgtaga

SEQ ID NO: 53920 - DNA, 20 bp, Artificial Sequence
  Synthetic oligonucleotide; TGG chr11 5181024 5181043 5181027 -
catatgtagaaagctgaaac

SEQ ID NO: 53921 - DNA, 20 bp, Artificial Sequence
  Synthetic oligonucleotide; AAG chr11 5180987 5181006 5180990 -
ccttatacaaaaattatttc

SEQ ID NO: 53922 - DNA, 20 bp, Artificial Sequence
  Synthetic oligonucleotide; TGG chr11 5180983 5181002 5180986 -
atacaaaaattatttcaaga

SEQ ID NO: 53923 - DNA, 20 bp, Artificial Sequence
  Synthetic oligonucleotide; AAG chr11 5180976 5180995 5180979 -
aattatttcaagatggatta

SEQ ID NO: 53924 - DNA, 20 bp, Artificial Sequence
  Synthetic oligonucleotide; TAG chr11 5180963 5180982 5180966 -
tggattaaagacttacatgt

SEQ ID NO: 53925 - DNA, 20 bp, Artificial Sequence
  Synthetic oligonucleotide; TAG chr11 5180940 5180959 5180943 -
acctaaaaccataaaaacct

SEQ ID NO: 53926 - DNA, 20 bp, Artificial Sequence
  Synthetic oligonucleotide; AAG chr11 5180937 5180956 5180940 -
taaaaccataaaaaccttag

SEQ ID NO: 53927 - DNA, 20 bp, Artificial Sequence
  Synthetic oligonucleotide; AAG chr11 5180927 5180946 5180930 -
aaaaccttagaagaaaacct

SEQ ID NO: 53928 - DNA, 20 bp, Artificial Sequence
  Synthetic oligonucleotide; CAG chr11 5180914 5180933 5180917 -
aaaacctaagcaataccatt

SEQ ID NO: 53929 - DNA, 20 bp, Artificial Sequence
  Synthetic oligonucleotide; AGG chr11 5180913 5180932 5180916 -
aaacctaagcaataccattc

SEQ ID NO: 53930 - DNA, 20 bp, Artificial Sequence
  Synthetic oligonucleotide; TAG chr11 5180907 5180926 5180910 -
aagcaataccattcaggaca

SEQ ID NO: 53931 - DNA, 20 bp, Artificial Sequence
  Synthetic oligonucleotide; AGG chr11 5180906 5180925 5180909 -
agcaataccattcaggacat

SEQ ID NO: 53932 - DNA, 20 bp, Artificial Sequence
  Synthetic oligonucleotide; TGG chr11 5180901 5180920 5180904 -
taccattcaggacataggca

SEQ ID NO: 53933 - DNA, 20 bp, Artificial Sequence
  Synthetic oligonucleotide; GGG chr11 5180900 5180919 5180903 -
accattcaggacataggcat

SEQ ID NO: 53934 - DNA, 20 bp, Artificial Sequence
  Synthetic oligonucleotide; AAG chr11 5180896 5180915 5180899 -
ttcaggacataggcatgggc

SEQ ID NO: 53935 - DNA, 20 bp, Artificial Sequence
  Synthetic oligonucleotide; AGG chr11 5180895 5180914 5180898 -
tcaggacataggcatgggca

SEQ ID NO: 53936 - DNA, 20 bp, Artificial Sequence
  Synthetic oligonucleotide; AAG chr11 5180871 5180890 5180874 -
cttcatgtctaaaacaccaa

SEQ ID NO: 53937 - DNA, 20 bp, Artificial Sequence
  Synthetic oligonucleotide; TGG chr11 5180865 5180884 5180868 -
gtctaaaacaccaaaagcaa

SEQ ID NO: 53938 - DNA, 20 bp, Artificial Sequence
  Synthetic oligonucleotide; AAG chr11 5180856 5180875 5180859 -
accaaaagcaatggcaacaa

SEQ ID NO: 53939 - DNA, 20 bp, Artificial Sequence
  Synthetic oligonucleotide; TGG chr11 5180847 5180866 5180850 -
aatggcaacaaaagacaaaa

SEQ ID NO: 53940 - DNA, 20 bp, Artificial Sequence
  Synthetic oligonucleotide; TGG chr11 5180839 5180858 5180842 -
caaaagacaaaatggacaaa

SEQ ID NO: 53941 - DNA, 20 bp, Artificial Sequence
  Synthetic oligonucleotide; GGG chr11 5180838 5180857 5180841 -
aaaagacaaaatggacaaat

SEQ ID NO: 53942 - DNA, 20 bp, Artificial Sequence
  Synthetic oligonucleotide; AAG chr11 5180821 5180840 5180824 -
aatgggatctaattaaacta

SEQ ID NO: 53943 - DNA, 20 bp, Artificial Sequence
  Synthetic oligonucleotide; GAG chr11 5180819 5180838 5180822 -
tgggatctaattaaactaaa

SEQ ID NO: 53944 - DNA, 20 bp, Artificial Sequence
  Synthetic oligonucleotide; CAG chr11 5180808 5180827 5180811 -
taaactaaagagcttctgca

SEQ ID NO: 53945 - DNA, 20 bp, Artificial Sequence
  Synthetic oligonucleotide; AAG chr11 5180802 5180821 5180805 -
aaagagcttctgcacagcaa

SEQ ID NO: 53946 - DNA, 20 bp, Artificial Sequence
  Synthetic oligonucleotide; CAG chr11 5180789 5180808 5180792 -
acagcaaaagaaactaccat

SEQ ID NO: 53947 - DNA, 20 bp, Artificial Sequence
  Synthetic oligonucleotide; GAG chr11 5180787 5180806 5180790 -
agcaaaagaaactaccatca

SEQ ID NO: 53948 - DNA, 20 bp, Artificial Sequence
  Synthetic oligonucleotide; CAG chr11 5180780 5180799 5180783 -
gaaactaccatcagagtgaa

SEQ ID NO: 53949 - DNA, 20 bp, Artificial Sequence
  Synthetic oligonucleotide; AGG chr11 5180779 5180798 5180782 -
aaactaccatcagagtgaac

SEQ ID NO: 53950 - DNA, 20 bp, Artificial Sequence
  Synthetic oligonucleotide; TGG chr11 5180764 5180783 5180767 -
tgaacaggcaacctacacaa

SEQ ID NO: 53951 - DNA, 20 bp, Artificial Sequence
  Synthetic oligonucleotide; GGG chr11 5180763 5180782 5180766 -
gaacaggcaacctacacaat

SEQ ID NO: 53952 - DNA, 20 bp, Artificial Sequence
  Synthetic oligonucleotide; GAG chr11 5180761 5180780 5180764 -
acaggcaacctacacaatgg

SEQ ID NO: 53953 - DNA, 20 bp, Artificial Sequence
  Synthetic oligonucleotide; AAG chr11 5180730 5180749 5180733 -
tgcaatctactcatctgaca

SEQ ID NO: 53954 - DNA, 20 bp, Artificial Sequence
  Synthetic oligonucleotide; AGG chr11 5180729 5180748 5180732 -
gcaatctactcatctgacaa

SEQ ID NO: 53955 - DNA, 20 bp, Artificial Sequence
  Synthetic oligonucleotide; GGG chr11 5180728 5180747 5180731 -
caatctactcatctgacaaa

SEQ ID NO: 53956 - DNA, 20 bp, Artificial Sequence
  Synthetic oligonucleotide; CAG chr11 5180717 5180736 5180720 -
tctgacaaagggctaatatc

SEQ ID NO: 53957 - DNA, 20 bp, Artificial Sequence
  Synthetic oligonucleotide; AAG chr11 5180686 5180705 5180689 -
atgaactcaaacaaatttac

SEQ ID NO: 53958 - DNA, 20 bp, Artificial Sequence
  Synthetic oligonucleotide; AAG chr11 5180659 5180678 5180662 -
aaacaaacaactgcatcaac

SEQ ID NO: 53959 - DNA, 20 bp, Artificial Sequence
  Synthetic oligonucleotide; AGG chr11 5180658 5180677 5180661 -
aacaaacaactgcatcaaca

SEQ ID NO: 53960 - DNA, 20 bp, Artificial Sequence
  Synthetic oligonucleotide; GGG chr11 5180657 5180676 5180660 -
acaaacaactgcatcaacaa

SEQ ID NO: 53961 - DNA, 20 bp, Artificial Sequence
  Synthetic oligonucleotide; GGG chr11 5180656 5180675 5180659 -
caaacaactgcatcaacaag

SEQ ID NO: 53962 - DNA, 20 bp, Artificial Sequence
  Synthetic oligonucleotide; GGG chr11 5180655 5180674 5180658 -
aaacaactgcatcaacaagg

SEQ ID NO: 53963 - DNA, 20 bp, Artificial Sequence
  Synthetic oligonucleotide; AAG chr11 5180650 5180669 5180653 -
actgcatcaacaagggggtg

SEQ ID NO: 53964 - DNA, 20 bp, Artificial Sequence
  Synthetic oligonucleotide; AGG chr11 5180649 5180668 5180652 -
ctgcatcaacaagggggtga

SEQ ID NO: 53965 - DNA, 20 bp, Artificial Sequence
  Synthetic oligonucleotide; CAG chr11 5180639 5180658 5180642 -
aagggggtgaaggatatgaa

SEQ ID NO: 53966 - DNA, 20 bp, Artificial Sequence
  Synthetic oligonucleotide; AAG chr11 5180625 5180644 5180628 -
tatgaacagacacttctcaa

SEQ ID NO: 53967 - DNA, 20 bp, Artificial Sequence
  Synthetic oligonucleotide; AAG chr11 5180622 5180641 5180625 -
gaacagacacttctcaaaag

SEQ ID NO: 53968 - DNA, 20 bp, Artificial Sequence
  Synthetic oligonucleotide; CAG chr11 5180610 5180629 5180613 -
ctcaaaagaagacatttatg

SEQ ID NO: 53969 - DNA, 20 bp, Artificial Sequence
  Synthetic oligonucleotide; TGG chr11 5180574 5180593 5180577 -
gaaaaaatgctcatcatcac

SEQ ID NO: 53970 - DNA, 20 bp, Artificial Sequence
  Synthetic oligonucleotide; CAG chr11 5180567 5180586 5180570 -
tgctcatcatcactggccat

SEQ ID NO: 53971 - DNA, 20 bp, Artificial Sequence
  Synthetic oligonucleotide; GAG chr11 5180565 5180584 5180568 -
ctcatcatcactggccatca

SEQ ID NO: 53972 - DNA, 20 bp, Artificial Sequence
  Synthetic oligonucleotide; GAG chr11 5180540 5180559 5180543 -
atgcaaatcaaaaccacaat

SEQ ID NO: 53973 - DNA, 20 bp, Artificial Sequence
  Synthetic oligonucleotide; CAG chr11 5180523 5180542 5180526 -
aatgagatatcatctcacac

SEQ ID NO: 53974 - DNA, 20 bp, Artificial Sequence
  Synthetic oligonucleotide; TAG chr11 5180519 5180538 5180522 -
agatatcatctcacaccagt

SEQ ID NO: 53975 - DNA, 20 bp, Artificial Sequence
  Synthetic oligonucleotide; TGG chr11 5180514 5180533 5180517 -
tcatctcacaccagttagaa

SEQ ID NO: 53976 - DNA, 20 bp, Artificial Sequence
  Synthetic oligonucleotide; AAG chr11 5180500 5180519 5180503 -
ttagaatggtgatcattaaa

SEQ ID NO: 53977 - DNA, 20 bp, Artificial Sequence
  Synthetic oligonucleotide; CAG chr11 5180496 5180515 5180499 -
aatggtgatcattaaaaagt

SEQ ID NO: 53978 - DNA, 20 bp, Artificial Sequence
  Synthetic oligonucleotide; AGG chr11 5180495 5180514 5180498 -
atggtgatcattaaaaagtc

SEQ ID NO: 53979 - DNA, 20 bp, Artificial Sequence
  Synthetic oligonucleotide; CAG chr11 5180486 5180505 5180489 -
attaaaaagtcaggaaacca

SEQ ID NO: 53980 - DNA, 20 bp, Artificial Sequence
  Synthetic oligonucleotide; AGG chr11 5180485 5180504 5180488 -
ttaaaaagtcaggaaaccac

SEQ ID NO: 53981 - DNA, 20 bp, Artificial Sequence
  Synthetic oligonucleotide; TGG chr11 5180479 5180498 5180482 -
agtcaggaaaccacaggtgc

SEQ ID NO: 53982 - DNA, 20 bp, Artificial Sequence
  Synthetic oligonucleotide; GAG chr11 5180477 5180496 5180480 -
tcaggaaaccacaggtgctg

SEQ ID NO: 53983 - DNA, 20 bp, Artificial Sequence
  Synthetic oligonucleotide; GAG chr11 5180475 5180494 5180478 -
aggaaaccacaggtgctgga

SEQ ID NO: 53984 - DNA, 20 bp, Artificial Sequence
  Synthetic oligonucleotide; AGG chr11 5180474 5180493 5180477 -
ggaaaccacaggtgctggag

SEQ ID NO: 53985 - DNA, 20 bp, Artificial Sequence
  Synthetic oligonucleotide; TGG chr11 5180468 5180487 5180471 -
cacaggtgctggagaggatg

SEQ ID NO: 53986 - DNA, 20 bp, Artificial Sequence
  Synthetic oligonucleotide; GAG chr11 5180466 5180485 5180469 -
caggtgctggagaggatgtg

SEQ ID NO: 53987 - DNA, 20 bp, Artificial Sequence
  Synthetic oligonucleotide; TAG chr11 5180460 5180479 5180463 -
ctggagaggatgtggagaaa

SEQ ID NO: 53988 - DNA, 20 bp, Artificial Sequence
  Synthetic oligonucleotide; AGG chr11 5180459 5180478 5180462 -
tggagaggatgtggagaaat

SEQ ID NO: 53989 - DNA, 20 bp, Artificial Sequence
  Synthetic oligonucleotide; TGG chr11 5180440 5180459 5180443 -
taggaacacttttacactgt

SEQ ID NO: 53990 - DNA, 20 bp, Artificial Sequence
  Synthetic oligonucleotide; TGG chr11 5180437 5180456 5180440 -
gaacacttttacactgttgg

SEQ ID NO: 53991 - DNA, 20 bp, Artificial Sequence
  Synthetic oligonucleotide; GGG chr11 5180436 5180455 5180439 -
aacacttttacactgttggt

SEQ ID NO: 53992 - DNA, 20 bp, Artificial Sequence
  Synthetic oligonucleotide; TAG chr11 5180424 5180443 5180427 -
ctgttggtgggactataaac

SEQ ID NO: 53993 - DNA, 20 bp, Artificial Sequence
  Synthetic oligonucleotide; TGG chr11 5180410 5180429 5180413 -
ataaactagttcaaccattg

SEQ ID NO: 53994 - DNA, 20 bp, Artificial Sequence
  Synthetic oligonucleotide; AAG chr11 5180407 5180426 5180410 -
aactagttcaaccattgtgg

SEQ ID NO: 53995 - DNA, 20 bp, Artificial Sequence
  Synthetic oligonucleotide; CAG chr11 5180403 5180422 5180406 -
agttcaaccattgtggaagt

SEQ ID NO: 53996 - DNA, 20 bp, Artificial Sequence
  Synthetic oligonucleotide; TGG chr11 5180398 5180417 5180401 -
aaccattgtggaagtcagtg

SEQ ID NO: 53997 - DNA, 20 bp, Artificial Sequence
  Synthetic oligonucleotide; CAG chr11 5180387 5180406 5180390 -
aagtcagtgtggcaattcct

SEQ ID NO: 53998 - DNA, 20 bp, Artificial Sequence
  Synthetic oligonucleotide; AGG chr11 5180386 5180405 5180389 -
agtcagtgtggcaattcctc

SEQ ID NO: 53999 - DNA, 20 bp, Artificial Sequence
  Synthetic oligonucleotide; GGG chr11 5180385 5180404 5180388 -
gtcagtgtggcaattcctca

SEQ ID NO: 54000 - DNA, 20 bp, Artificial Sequence
  Synthetic oligonucleotide; TAG chr11 5180379 5180398 5180382 -
gtggcaattcctcagggatc

SEQ ID NO: 54001 - DNA, 20 bp, Artificial Sequence
  Synthetic oligonucleotide; TAG chr11 5180373 5180392 5180376 -
attcctcagggatctagaac

SEQ ID NO: 54002 - DNA, 20 bp, Artificial Sequence
  Synthetic oligonucleotide; CAG chr11 5180355 5180374 5180358 -
actagaaataccatttgacc

SEQ ID NO: 54003 - DNA, 20 bp, Artificial Sequence
  Synthetic oligonucleotide; TGG chr11 5180340 5180359 5180343 -
tgacccagccatcctattac

SEQ ID NO: 54004 - DNA, 20 bp, Artificial Sequence
  Synthetic oligonucleotide; GGG chr11 5180339 5180358 5180342 -
gacccagccatcctattact

SEQ ID NO: 54005 - DNA, 20 bp, Artificial Sequence
  Synthetic oligonucleotide; AAG chr11 5180326 5180345 5180329 -
tattactgggtatataccca

SEQ ID NO: 54006 - DNA, 20 bp, Artificial Sequence
  Synthetic oligonucleotide; AGG chr11 5180325 5180344 5180328 -
attactgggtatatacccaa

SEQ ID NO: 54007 - DNA, 20 bp, Artificial Sequence
  Synthetic oligonucleotide; AAG chr11 5180301 5180320 5180304 -
atgtaaatcatgctgctata

SEQ ID NO: 54008 - DNA, 20 bp, Artificial Sequence
  Synthetic oligonucleotide; TGG chr11 5180274 5180293 5180277 -
atgcacacgtatgtttattg

SEQ ID NO: 54009 - DNA, 20 bp, Artificial Sequence
  Synthetic oligonucleotide; TAG chr11 5180259 5180278 5180262 -
tattgtggcactattcacaa

SEQ ID NO: 54010 - DNA, 20 bp, Artificial Sequence
  Synthetic oligonucleotide; AAG chr11 5180254 5180273 5180257 -
tggcactattcacaatagca

SEQ ID NO: 54011 - DNA, 20 bp, Artificial Sequence
  Synthetic oligonucleotide; TGG chr11 5180248 5180267 5180251 -
tattcacaatagcaaagact

SEQ ID NO: 54012 - DNA, 20 bp, Artificial Sequence
  Synthetic oligonucleotide; TAG chr11 5180220 5180239 5180223 -
acccaaatgtccaacaatga

SEQ ID NO: 54013 - DNA, 20 bp, Artificial Sequence
  Synthetic oligonucleotide; TGG chr11 5180215 5180234 5180218 -
aatgtccaacaatgatagac

SEQ ID NO: 54014 - DNA, 20 bp, Artificial Sequence
  Synthetic oligonucleotide; AAG chr11 5180209 5180228 5180212 -
caacaatgatagactggatt

SEQ ID NO: 54015 - DNA, 20 bp, Artificial Sequence
  Synthetic oligonucleotide; TGG chr11 5180200 5180219 5180203 -
tagactggattaagaaaatg

SEQ ID NO: 54016 - DNA, 20 bp, Artificial Sequence
  Synthetic oligonucleotide; TGG chr11 5180184 5180203 5180187 -
aatgtggcacatatacatca

SEQ ID NO: 54017 - DNA, 20 bp, Artificial Sequence
  Synthetic oligonucleotide; CAG chr11 5180172 5180191 5180175 -
atacatcatggaatactatg

SEQ ID NO: 54018 - DNA, 20 bp, Artificial Sequence
  Synthetic oligonucleotide; GAG chr11 5180155 5180174 5180158 -
atgcagccataaaaaatgat

SEQ ID NO: 54019 - DNA, 20 bp, Artificial Sequence
  Synthetic oligonucleotide; TAG chr11 5180139 5180158 5180142 -
tgatgagttcatgtcctttg

SEQ ID NO: 54020 - DNA, 20 bp, Artificial Sequence
  Synthetic oligonucleotide; AGG chr11 5180138 5180157 5180141 -
gatgagttcatgtcctttgt

SEQ ID NO: 54021 - DNA, 20 bp, Artificial Sequence
  Synthetic oligonucleotide; GGG chr11 5180137 5180156 5180140 -
atgagttcatgtcctttgta

SEQ ID NO: 54022 - DNA, 20 bp, Artificial Sequence
  Synthetic oligonucleotide; TGG chr11 5180131 5180150 5180134 -
tcatgtcctttgtagggaca

SEQ ID NO: 54023 - DNA, 20 bp, Artificial Sequence
  Synthetic oligonucleotide; TGG chr11 5180121 5180140 5180124 -
tgtagggacatggatgaaac

SEQ ID NO: 54024 - DNA, 20 bp, Artificial Sequence
  Synthetic oligonucleotide; GAG chr11 5180105 5180124 5180108 -
aaactggaaaccatcattct

SEQ ID NO: 54025 - DNA, 20 bp, Artificial Sequence
  Synthetic oligonucleotide; AAG chr11 5180100 5180119 5180103 -
ggaaaccatcattctgagca

SEQ ID NO: 54026 - DNA, 20 bp, Artificial Sequence
  Synthetic oligonucleotide; AAG chr11 5180091 5180110 5180094 -
cattctgagcaaagtatcgc

SEQ ID NO: 54027 - DNA, 20 bp, Artificial Sequence
  Synthetic oligonucleotide; AGG chr11 5180090 5180109 5180093 -
attctgagcaaagtatcgca

SEQ ID NO: 54028 - DNA, 20 bp, Artificial Sequence
  Synthetic oligonucleotide; TAG chr11 5180055 5180074 5180058 -
acaccacatattctcactca

SEQ ID NO: 54029 - DNA, 20 bp, Artificial Sequence
  Synthetic oligonucleotide; AGG chr11 5180054 5180073 5180057 -
caccacatattctcactcat

SEQ ID NO: 54030 - DNA, 20 bp, Artificial Sequence
  Synthetic oligonucleotide; TGG chr11 5180051 5180070 5180054 -
cacatattctcactcatagg

SEQ ID NO: 54031 - DNA, 20 bp, Artificial Sequence
  Synthetic oligonucleotide; GGG chr11 5180050 5180069 5180053 -
acatattctcactcataggt

SEQ ID NO: 54032 - DNA, 20 bp, Artificial Sequence
  Synthetic oligonucleotide; GAG chr11 5180048 5180067 5180051 -
atattctcactcataggtgg

SEQ ID NO: 54033 - DNA, 20 bp, Artificial Sequence
  Synthetic oligonucleotide; GAG chr11 5180036 5180055 5180039 -
ataggtgggagttgaacaat

SEQ ID NO: 54034 - DNA, 20 bp, Artificial Sequence
  Synthetic oligonucleotide; TGG chr11 5180027 5180046 5180030 -
agttgaacaatgagaacatt

SEQ ID NO: 54035 - DNA, 20 bp, Artificial Sequence
  Synthetic oligonucleotide; CAG chr11 5180021 5180040 5180024 -
acaatgagaacatttggaca

SEQ ID NO: 54036 - DNA, 20 bp, Artificial Sequence
  Synthetic oligonucleotide; GAG chr11 5180017 5180036 5180020 -
tgagaacatttggacacagt

SEQ ID NO: 54037 - DNA, 20 bp, Artificial Sequence
  Synthetic oligonucleotide; AGG chr11 5180016 5180035 5180019 -
gagaacatttggacacagtg

SEQ ID NO: 54038 - DNA, 20 bp, Artificial Sequence
  Synthetic oligonucleotide; GGG chr11 5180015 5180034 5180018 -
agaacatttggacacagtga

SEQ ID NO: 54039 - DNA, 20 bp, Artificial Sequence
  Synthetic oligonucleotide; GGG chr11 5180014 5180033 5180017 -
gaacatttggacacagtgag

SEQ ID NO: 54040 - DNA, 20 bp, Artificial Sequence
  Synthetic oligonucleotide; CGG chr11 5179999 5180018 5180002 -
gtgaggggaacatcacacac

SEQ ID NO: 54041 - DNA, 20 bp, Artificial Sequence
  Synthetic oligonucleotide; GGG chr11 5179998 5180017 5180001 -
tgaggggaacatcacacacc

SEQ ID NO: 54042 - DNA, 20 bp, Artificial Sequence
  Synthetic oligonucleotide; GGG chr11 5179997 5180016 5180000 -
gaggggaacatcacacaccg

SEQ ID NO: 54043 - DNA, 20 bp, Artificial Sequence
  Synthetic oligonucleotide; TGG chr11 5179987 5180006 5179990 -
tcacacaccggggcctgttg

SEQ ID NO: 54044 - DNA, 20 bp, Artificial Sequence
  Synthetic oligonucleotide; GGG chr11 5179986 5180005 5179989 -
cacacaccggggcctgttgt

SEQ ID NO: 54045 - DNA, 20 bp, Artificial Sequence
  Synthetic oligonucleotide; GGG chr11 5179985 5180004 5179988 -
acacaccggggcctgttgtg

SEQ ID NO: 54046 - DNA, 20 bp, Artificial Sequence
  Synthetic oligonucleotide; TGG chr11 5179982 5180001 5179985 -
caccggggcctgttgtgggg

SEQ ID NO: 54047 - DNA, 20 bp, Artificial Sequence
  Synthetic oligonucleotide; GGG chr11 5179981 5180000 5179984 -
accggggcctgttgtggggt

SEQ ID NO: 54048 - DNA, 20 bp, Artificial Sequence
  Synthetic oligonucleotide; GGG chr11 5179980 5179999 5179983 -
ccggggcctgttgtggggtg

SEQ ID NO: 54049 - DNA, 20 bp, Artificial Sequence
  Synthetic oligonucleotide; GGG chr11 5179979 5179998 5179982 -
cggggcctgttgtggggtgg

SEQ ID NO: 54050 - DNA, 20 bp, Artificial Sequence
  Synthetic oligonucleotide; CGG chr11 5179975 5179994 5179978 -
gcctgttgtggggtgggggc

SEQ ID NO: 54051 - DNA, 20 bp, Artificial Sequence
  Synthetic oligonucleotide; GGG chr11 5179974 5179993 5179977 -
cctgttgtggggtgggggcc

SEQ ID NO: 54052 - DNA, 20 bp, Artificial Sequence
  Synthetic oligonucleotide; GGG chr11 5179973 5179992 5179976 -
ctgttgtggggtgggggccg

SEQ ID NO: 54053 - DNA, 20 bp, Artificial Sequence
  Synthetic oligonucleotide; GGG chr11 5179972 5179991 5179975 -
tgttgtggggtgggggccgg

SEQ ID NO: 54054 - DNA, 20 bp, Artificial Sequence
  Synthetic oligonucleotide; GGG chr11 5179971 5179990 5179974 -
gttgtggggtgggggccggg

SEQ ID NO: 54055 - DNA, 20 bp, Artificial Sequence
  Synthetic oligonucleotide; GAG chr11 5179969 5179988 5179972 -
tgtggggtgggggccggggg

SEQ ID NO: 54056 - DNA, 20 bp, Artificial Sequence
  Synthetic oligonucleotide; AGG chr11 5179968 5179987 5179971 -
gtggggtgggggccgggggg

SEQ ID NO: 54057 - DNA, 20 bp, Artificial Sequence
  Synthetic oligonucleotide; GGG chr11 5179967 5179986 5179970 -
tggggtgggggccgggggga

SEQ ID NO: 54058 - DNA, 20 bp, Artificial Sequence
  Synthetic oligonucleotide; TAG chr11 5179963 5179982 5179966 -
gtgggggccggggggaggga

SEQ ID NO: 54059 - DNA, 20 bp, Artificial Sequence
  Synthetic oligonucleotide; TAG chr11 5179957 5179976 5179960 -
gccggggggagggatagcat

SEQ ID NO: 54060 - DNA, 20 bp, Artificial Sequence
  Synthetic oligonucleotide; AGG chr11 5179956 5179975 5179959 -
ccggggggagggatagcatt

SEQ ID NO: 54061 - DNA, 20 bp, Artificial Sequence
  Synthetic oligonucleotide; GAG chr11 5179954 5179973 5179957 -
ggggggagggatagcattag

SEQ ID NO: 54062 - DNA, 20 bp, Artificial Sequence
  Synthetic oligonucleotide; GAG chr11 5179931 5179950 5179934 -
atatacctaatgtaaatgac

SEQ ID NO: 54063 - DNA, 20 bp, Artificial Sequence
  Synthetic oligonucleotide; TGG chr11 5179924 5179943 5179927 -
taatgtaaatgacgagttaa

SEQ ID NO: 54064 - DNA, 20 bp, Artificial Sequence
  Synthetic oligonucleotide; GGG chr11 5179923 5179942 5179926 -
aatgtaaatgacgagttaat

SEQ ID NO: 54065 - DNA, 20 bp, Artificial Sequence
  Synthetic oligonucleotide; CAG chr11 5179918 5179937 5179921 -
aaatgacgagttaatgggtg

SEQ ID NO: 54066 - DNA, 20 bp, Artificial Sequence
  Synthetic oligonucleotide; TGG chr11 5179905 5179924 5179908 -
atgggtgcagcacaccaaca

SEQ ID NO: 54067 - DNA, 20 bp, Artificial Sequence
  Synthetic oligonucleotide; TAG chr11 5179855 5179874 5179858 -
catgttgtgcacatgtaccc

SEQ ID NO: 54068 - DNA, 20 bp, Artificial Sequence
  Synthetic oligonucleotide; AAG chr11 5179846 5179865 5179849 -
cacatgtaccctagaactta

SEQ ID NO: 54069 - DNA, 20 bp, Artificial Sequence
  Synthetic oligonucleotide; CAG chr11 5179793 5179812 5179796 -
tgtattgtctcattttcaat

SEQ ID NO: 54070 - DNA, 20 bp, Artificial Sequence
  Synthetic oligonucleotide; AAG chr11 5179784 5179803 5179787 -
tcattttcaatcagtgactg

SEQ ID NO: 54071 - DNA, 20 bp, Artificial Sequence
  Synthetic oligonucleotide; TGG chr11 5179781 5179800 5179784 -
ttttcaatcagtgactgaag

SEQ ID NO: 54072 - DNA, 20 bp, Artificial Sequence
  Synthetic oligonucleotide; AAG chr11 5179777 5179796 5179780 -
caatcagtgactgaagtgga

SEQ ID NO: 54073 - DNA, 20 bp, Artificial Sequence
  Synthetic oligonucleotide; GAG chr11 5179744 5179763 5179747 -
ttttattctttaccacctat

SEQ ID NO: 54074 - DNA, 20 bp, Artificial Sequence
  Synthetic oligonucleotide; AGG chr11 5179743 5179762 5179746 -
tttattctttaccacctatg

SEQ ID NO: 54075 - DNA, 20 bp, Artificial Sequence
  Synthetic oligonucleotide; GAG chr11 5179723 5179742 5179726 -
aggcatatactttttttttt

SEQ ID NO: 54076 - DNA, 20 bp, Artificial Sequence
  Synthetic oligonucleotide; GAG chr11 5179721 5179740 5179724 -
gcatatacttttttttttga

SEQ ID NO: 54077 - DNA, 20 bp, Artificial Sequence
  Synthetic oligonucleotide; AGG chr11 5179720 5179739 5179723 -
catatacttttttttttgag

SEQ ID NO: 54078 - DNA, 20 bp, Artificial Sequence
  Synthetic oligonucleotide; GGG chr11 5179719 5179738 5179722 -
atatacttttttttttgaga

SEQ ID NO: 54079 - DNA, 20 bp, Artificial Sequence
  Synthetic oligonucleotide; GAG chr11 5179717 5179736 5179720 -
atacttttttttttgagagg

SEQ ID NO: 54080 - DNA, 20 bp, Artificial Sequence
  Synthetic oligonucleotide; TAG chr11 5179699 5179718 5179702 -
gggagtctcgctctgtcacc

SEQ ID NO: 54081 - DNA, 20 bp, Artificial Sequence
  Synthetic oligonucleotide; AGG chr11 5179698 5179717 5179701 -
ggagtctcgctctgtcacct

SEQ ID NO: 54082 - DNA, 20 bp, Artificial Sequence
  Synthetic oligonucleotide; TGG chr11 5179694 5179713 5179697 -
tctcgctctgtcacctaggc

SEQ ID NO: 54083 - DNA, 20 bp, Artificial Sequence
  Synthetic oligonucleotide; GAG chr11 5179692 5179711 5179695 -
tcgctctgtcacctaggctg

SEQ ID NO: 54084 - DNA, 20 bp, Artificial Sequence
  Synthetic oligonucleotide; CAG chr11 5179687 5179706 5179690 -
ctgtcacctaggctggagtg

SEQ ID NO: 54085 - DNA, 20 bp, Artificial Sequence
  Synthetic oligonucleotide; CAG chr11 5179649 5179668 5179652 -
tcactgaaacttctgcctcc

SEQ ID NO: 54086 - DNA, 20 bp, Artificial Sequence
  Synthetic oligonucleotide; AGG chr11 5179648 5179667 5179651 -
cactgaaacttctgcctccc

SEQ ID NO: 54087 - DNA, 20 bp, Artificial Sequence
  Synthetic oligonucleotide; AAG chr11 5179642 5179661 5179645 -
aacttctgcctcccaggttc

SEQ ID NO: 54088 - DNA, 20 bp, Artificial Sequence
  Synthetic oligonucleotide; CAG chr11 5179625 5179644 5179628 -
ttcaagcgattctcctgcct

SEQ ID NO: 54089 - DNA, 20 bp, Artificial Sequence
  Synthetic oligonucleotide; GAG chr11 5179616 5179635 5179619 -
ttctcctgcctcagcctctt

SEQ ID NO: 54090 - DNA, 20 bp, Artificial Sequence
  Synthetic oligonucleotide; TAG chr11 5179613 5179632 5179616 -
tcctgcctcagcctcttgag

SEQ ID NO: 54091 - DNA, 20 bp, Artificial Sequence
  Synthetic oligonucleotide; TGG chr11 5179609 5179628 5179612 -
gcctcagcctcttgagtagc

SEQ ID NO: 54092 - DNA, 20 bp, Artificial Sequence
  Synthetic oligonucleotide; GGG chr11 5179608 5179627 5179611 -
cctcagcctcttgagtagct

SEQ ID NO: 54093 - DNA, 20 bp, Artificial Sequence
  Synthetic oligonucleotide; AAG chr11 5179601 5179620 5179604 -
ctcttgagtagctgggatta

SEQ ID NO: 54094 - DNA, 20 bp, Artificial Sequence
  Synthetic oligonucleotide; AGG chr11 5179600 5179619 5179603 -
tcttgagtagctgggattaa

SEQ ID NO: 54095 - DNA, 20 bp, Artificial Sequence
  Synthetic oligonucleotide; CAG chr11 5179581 5179600 5179584 -
aaggtgcacaccactatgcc

SEQ ID NO: 54096 - DNA, 20 bp, Artificial Sequence
  Synthetic oligonucleotide; TAG chr11 5179562 5179581 5179565 -
ccagctaatttttgtatttt

SEQ ID NO: 54097 - DNA, 20 bp, Artificial Sequence
  Synthetic oligonucleotide; TAG chr11 5179559 5179578 5179562 -
gctaatttttgtatttttag

SEQ ID NO: 54098 - DNA, 20 bp, Artificial Sequence
  Synthetic oligonucleotide; GAG chr11 5179557 5179576 5179560 -
taatttttgtatttttagta

SEQ ID NO: 54099 - DNA, 20 bp, Artificial Sequence
  Synthetic oligonucleotide; CGG chr11 5179553 5179572 5179556 -
ttttgtatttttagtagaga

SEQ ID NO: 54100 - DNA, 20 bp, Artificial Sequence
  Synthetic oligonucleotide; GGG chr11 5179552 5179571 5179555 -
tttgtatttttagtagagac

SEQ ID NO: 54101 - DNA, 20 bp, Artificial Sequence
  Synthetic oligonucleotide; GGG chr11 5179551 5179570 5179554 -
ttgtatttttagtagagacg

SEQ ID NO: 54102 - DNA, 20 bp, Artificial Sequence
  Synthetic oligonucleotide; TGG chr11 5179537 5179556 5179540 -
gagacggggtttcattgttt

SEQ ID NO: 54103 - DNA, 20 bp, Artificial Sequence
  Synthetic oligonucleotide; AAG chr11 5179532 5179551 5179535 -
ggggtttcattgttttggtc

SEQ ID NO: 54104 - DNA, 20 bp, Artificial Sequence
  Synthetic oligonucleotide; TGG chr11 5179528 5179547 5179531 -
tttcattgttttggtcaagc

SEQ ID NO: 54105 - DNA, 20 bp, Artificial Sequence
  Synthetic oligonucleotide; TGG chr11 5179523 5179542 5179526 -
ttgttttggtcaagctggtc

SEQ ID NO: 54106 - DNA, 20 bp, Artificial Sequence
  Synthetic oligonucleotide; CAG chr11 5179492 5179511 5179495 -
accttgtgatctacccgcct

SEQ ID NO: 54107 - DNA, 20 bp, Artificial Sequence
  Synthetic oligonucleotide; AAG chr11 5179482 5179501 5179485 -
ctacccgcctcagcctctca

SEQ ID NO: 54108 - DNA, 20 bp, Artificial Sequence
  Synthetic oligonucleotide; TGG chr11 5179476 5179495 5179479 -
gcctcagcctctcaaagtgc

SEQ ID NO: 54109 - DNA, 20 bp, Artificial Sequence
  Synthetic oligonucleotide; GGG chr11 5179475 5179494 5179478 -
cctcagcctctcaaagtgct

SEQ ID NO: 54110 - DNA, 20 bp, Artificial Sequence
  Synthetic oligonucleotide; CAG chr11 5179468 5179487 5179471 -
ctctcaaagtgctgggatta

SEQ ID NO: 54111 - DNA, 20 bp, Artificial Sequence
  Synthetic oligonucleotide; AGG chr11 5179467 5179486 5179470 -
tctcaaagtgctgggattac

SEQ ID NO: 54112 - DNA, 20 bp, Artificial Sequence
  Synthetic oligonucleotide; GAG chr11 5179461 5179480 5179464 -
agtgctgggattacaggtgt

SEQ ID NO: 54113 - DNA, 20 bp, Artificial Sequence
  Synthetic oligonucleotide; CAG chr11 5179449 5179468 5179452 -
acaggtgtgagccaccgtgc

SEQ ID NO: 54114 - DNA, 20 bp, Artificial Sequence
  Synthetic oligonucleotide; AGG chr11 5179448 5179467 5179451 -
caggtgtgagccaccgtgcc

SEQ ID NO: 54115 - DNA, 20 bp, Artificial Sequence
  Synthetic oligonucleotide; TGG chr11 5179444 5179463 5179447 -
tgtgagccaccgtgccaggc

SEQ ID NO: 54116 - DNA, 20 bp, Artificial Sequence
  Synthetic oligonucleotide; TAG chr11 5179437 5179456 5179440 -
caccgtgccaggctggcata

SEQ ID NO: 54117 - DNA, 20 bp, Artificial Sequence
  Synthetic oligonucleotide; CAG chr11 5179423 5179442 5179426 -
ggcatatagatttaaaaacc

SEQ ID NO: 54118 - DNA, 20 bp, Artificial Sequence
  Synthetic oligonucleotide; AAG chr11 5179395 5179414 5179398 -
tctgccattgcaaatatcta

SEQ ID NO: 54119 - DNA, 20 bp, Artificial Sequence
  Synthetic oligonucleotide; GAG chr11 5179366 5179385 5179369 -
atgttttatcctatattttt

SEQ ID NO: 54120 - DNA, 20 bp, Artificial Sequence
  Synthetic oligonucleotide; TAG chr11 5179360 5179379 5179363 -
tatcctatatttttgagaaa

SEQ ID NO: 54121 - DNA, 20 bp, Artificial Sequence
  Synthetic oligonucleotide; TGG chr11 5179351 5179370 5179354 -
tttttgagaaatagattaat

SEQ ID NO: 54122 - DNA, 20 bp, Artificial Sequence
  Synthetic oligonucleotide; CAG chr11 5179348 5179367 5179351 -
ttgagaaatagattaattgg

SEQ ID NO: 54123 - DNA, 20 bp, Artificial Sequence
  Synthetic oligonucleotide; TGG chr11 5179317 5179336 5179320 -
aatttgctgtatgtcttcaa

SEQ ID NO: 54124 - DNA, 20 bp, Artificial Sequence
  Synthetic oligonucleotide; TAG chr11 5179313 5179332 5179316 -
tgctgtatgtcttcaatggc

SEQ ID NO: 54125 - DNA, 20 bp, Artificial Sequence
  Synthetic oligonucleotide; TGG chr11 5179306 5179325 5179309 -
tgtcttcaatggctagcata

SEQ ID NO: 54126 - DNA, 20 bp, Artificial Sequence
  Synthetic oligonucleotide; AAG chr11 5179294 5179313 5179297 -
ctagcatatggcttaacaat

SEQ ID NO: 54127 - DNA, 20 bp, Artificial Sequence
  Synthetic oligonucleotide; AAG chr11 5179289 5179308 5179292 -
atatggcttaacaataagtt

SEQ ID NO: 54128 - DNA, 20 bp, Artificial Sequence
  Synthetic oligonucleotide; AGG chr11 5179288 5179307 5179291 -
tatggcttaacaataagtta

SEQ ID NO: 54129 - DNA, 20 bp, Artificial Sequence
  Synthetic oligonucleotide; TGG chr11 5179275 5179294 5179278 -
taagttaaggccaatcaatg

SEQ ID NO: 54130 - DNA, 20 bp, Artificial Sequence
  Synthetic oligonucleotide; AAG chr11 5179272 5179291 5179275 -
gttaaggccaatcaatgtgg

SEQ ID NO: 54131 - DNA, 20 bp, Artificial Sequence
  Synthetic oligonucleotide; AAG chr11 5179269 5179288 5179272 -
aaggccaatcaatgtggaag

SEQ ID NO: 54132 - DNA, 20 bp, Artificial Sequence
  Synthetic oligonucleotide; AGG chr11 5179268 5179287 5179271 -
aggccaatcaatgtggaaga

SEQ ID NO: 54133 - DNA, 20 bp, Artificial Sequence
  Synthetic oligonucleotide; CAG chr11 5179232 5179251 5179235 -
ttgcttgaaatctattttgt

SEQ ID NO: 54134 - DNA, 20 bp, Artificial Sequence
  Synthetic oligonucleotide; AAG chr11 5179206 5179225 5179209 -
taattccctcccatttctgt

SEQ ID NO: 54135 - DNA, 20 bp, Artificial Sequence
  Synthetic oligonucleotide; CAG chr11 5179203 5179222 5179206 -
ttccctcccatttctgtaag

SEQ ID NO: 54136 - DNA, 20 bp, Artificial Sequence
  Synthetic oligonucleotide; TAG chr11 5179168 5179187 5179171 -
tcataactctctattttcct

SEQ ID NO: 54137 - DNA, 20 bp, Artificial Sequence
  Synthetic oligonucleotide; AGG chr11 5179167 5179186 5179170 -
cataactctctattttcctt

SEQ ID NO: 54138 - DNA, 20 bp, Artificial Sequence
  Synthetic oligonucleotide; GGG chr11 5179166 5179185 5179169 -
ataactctctattttcctta

SEQ ID NO: 54139 - DNA, 20 bp, Artificial Sequence
  Synthetic oligonucleotide; CAG chr11 5179156 5179175 5179159 -
attttccttagggatatgat

SEQ ID NO: 54140 - DNA, 20 bp, Artificial Sequence
  Synthetic oligonucleotide; TAG chr11 5179125 5179144 5179128 -
ttgatgctgcgttttatatc

SEQ ID NO: 54141 - DNA, 20 bp, Artificial Sequence
  Synthetic oligonucleotide; TAG chr11 5179111 5179130 5179114 -
tatatctagttttaccttga

SEQ ID NO: 54142 - DNA, 20 bp, Artificial Sequence
  Synthetic oligonucleotide; AGG chr11 5179110 5179129 5179113 -
atatctagttttaccttgat

SEQ ID NO: 54143 - DNA, 20 bp, Artificial Sequence
  Synthetic oligonucleotide; CAG chr11 5179107 5179126 5179110 -
tctagttttaccttgatagg

SEQ ID NO: 54144 - DNA, 20 bp, Artificial Sequence
  Synthetic oligonucleotide; TGG chr11 5179101 5179120 5179104 -
tttaccttgataggcagcat

SEQ ID NO: 54145 - DNA, 20 bp, Artificial Sequence
  Synthetic oligonucleotide; TGG chr11 5179097 5179116 5179100 -
ccttgataggcagcattgga

SEQ ID NO: 54146 - DNA, 20 bp, Artificial Sequence
  Synthetic oligonucleotide; TAG chr11 5179094 5179113 5179097 -
tgataggcagcattggatgg

SEQ ID NO: 54147 - DNA, 20 bp, Artificial Sequence
  Synthetic oligonucleotide; AAG chr11 5179089 5179108 5179092 -
ggcagcattggatggtagta

SEQ ID NO: 54148 - DNA, 20 bp, Artificial Sequence
  Synthetic oligonucleotide; AAG chr11 5179082 5179101 5179085 -
ttggatggtagtaaagatca

SEQ ID NO: 54149 - DNA, 20 bp, Artificial Sequence
  Synthetic oligonucleotide; CAG chr11 5179075 5179094 5179078 -
gtagtaaagatcaaagcttt

SEQ ID NO: 54150 - DNA, 20 bp, Artificial Sequence
  Synthetic oligonucleotide; CAG chr11 5179048 5179067 5179051 -
atcctgccttactttaaatc

SEQ ID NO: 54151 - DNA, 20 bp, Artificial Sequence
  Synthetic oligonucleotide; TAG chr11 5179045 5179064 5179048 -
ctgccttactttaaatccag

SEQ ID NO: 54152 - DNA, 20 bp, Artificial Sequence
  Synthetic oligonucleotide; AGG chr11 5179044 5179063 5179047 -
tgccttactttaaatccagt

SEQ ID NO: 54153 - DNA, 20 bp, Artificial Sequence
  Synthetic oligonucleotide; GGG chr11 5179043 5179062 5179046 -
gccttactttaaatccagta

SEQ ID NO: 54154 - DNA, 20 bp, Artificial Sequence
  Synthetic oligonucleotide; TAG chr11 5179038 5179057 5179041 -
actttaaatccagtagggcc

SEQ ID NO: 54155 - DNA, 20 bp, Artificial Sequence
  Synthetic oligonucleotide; AGG chr11 5179037 5179056 5179040 -
ctttaaatccagtagggcct

SEQ ID NO: 54156 - DNA, 20 bp, Artificial Sequence
  Synthetic oligonucleotide; GGG chr11 5179036 5179055 5179039 -
tttaaatccagtagggccta

SEQ ID NO: 54157 - DNA, 20 bp, Artificial Sequence
  Synthetic oligonucleotide; AAG chr11 5179032 5179051 5179035 -
aatccagtagggcctagggt

SEQ ID NO: 54158 - DNA, 20 bp, Artificial Sequence
  Synthetic oligonucleotide; GAG chr11 5179030 5179049 5179033 -
tccagtagggcctagggtaa

SEQ ID NO: 54159 - DNA, 20 bp, Artificial Sequence
  Synthetic oligonucleotide; AGG chr11 5179029 5179048 5179032 -
ccagtagggcctagggtaag

SEQ ID NO: 54160 - DNA, 20 bp, Artificial Sequence
  Synthetic oligonucleotide; AAG chr11 5179022 5179041 5179025 -
ggcctagggtaagaggctga

SEQ ID NO: 54161 - DNA, 20 bp, Artificial Sequence
  Synthetic oligonucleotide; TGG chr11 5179015 5179034 5179018 -
ggtaagaggctgaaagtctg

SEQ ID NO: 54162 - DNA, 20 bp, Artificial Sequence
  Synthetic oligonucleotide; GGG chr11 5179014 5179033 5179017 -
gtaagaggctgaaagtctgt

SEQ ID NO: 54163 - DNA, 20 bp, Artificial Sequence
  Synthetic oligonucleotide; TAG chr11 5178996 5179015 5178999 -
gtgggttttttttacatctg

SEQ ID NO: 54164 - DNA, 20 bp, Artificial Sequence
  Synthetic oligonucleotide; TAG chr11 5178987 5179006 5178990 -
ttttacatctgtagaaataa

SEQ ID NO: 54165 - DNA, 20 bp, Artificial Sequence
  Synthetic oligonucleotide; TGG chr11 5178973 5178992 5178976 -
aaataatagtatttatataa

SEQ ID NO: 54166 - DNA, 20 bp, Artificial Sequence
  Synthetic oligonucleotide; AAG chr11 5178963 5178982 5178966 -
atttatataatggttattta

SEQ ID NO: 54167 - DNA, 20 bp, Artificial Sequence
  Synthetic oligonucleotide; AGG chr11 5178962 5178981 5178965 -
tttatataatggttatttaa

SEQ ID NO: 54168 - DNA, 20 bp, Artificial Sequence
  Synthetic oligonucleotide; GGG chr11 5178961 5178980 5178964 -
ttatataatggttatttaaa

SEQ ID NO: 54169 - DNA, 20 bp, Artificial Sequence
  Synthetic oligonucleotide; TAG chr11 5178950 5178969 5178953 -
ttatttaaagggcttttcaa

SEQ ID NO: 54170 - DNA, 20 bp, Artificial Sequence
  Synthetic oligonucleotide; AGG chr11 5178949 5178968 5178952 -
tatttaaagggcttttcaat

SEQ ID NO: 54171 - DNA, 20 bp, Artificial Sequence
  Synthetic oligonucleotide; AAG chr11 5178938 5178957 5178941 -
cttttcaataggttattgtg

SEQ ID NO: 54172 - DNA, 20 bp, Artificial Sequence
  Synthetic oligonucleotide; AAG chr11 5178928 5178947 5178931 -
ggttattgtgaagatttaat

SEQ ID NO: 54173 - DNA, 20 bp, Artificial Sequence
  Synthetic oligonucleotide; AAG chr11 5178913 5178932 5178916 -
ttaataagttaatatttgta

SEQ ID NO: 54174 - DNA, 20 bp, Artificial Sequence
  Synthetic oligonucleotide; TAG chr11 5178910 5178929 5178913 -
ataagttaatatttgtaaag

SEQ ID NO: 54175 - DNA, 20 bp, Artificial Sequence
  Synthetic oligonucleotide; AAG chr11 5178894 5178913 5178897 -
aaagtagtatgacacatatt

SEQ ID NO: 54176 - DNA, 20 bp, Artificial Sequence
  Synthetic oligonucleotide; CAG chr11 5178891 5178910 5178894 -
gtagtatgacacatattaag

SEQ ID NO: 54177 - DNA, 20 bp, Artificial Sequence
  Synthetic oligonucleotide; AAG chr11 5178861 5178880 5178864 -
ataatatctactaatttttt

SEQ ID NO: 54178 - DNA, 20 bp, Artificial Sequence
  Synthetic oligonucleotide; AGG chr11 5178860 5178879 5178863 -
taatatctactaatttttta

SEQ ID NO: 54179 - DNA, 20 bp, Artificial Sequence
  Synthetic oligonucleotide; TGG chr11 5178839 5178858 5178842 -
ggtacaaaaaattaattatt

SEQ ID NO: 54180 - DNA, 20 bp, Artificial Sequence
  Synthetic oligonucleotide; TAG chr11 5178836 5178855 5178839 -
acaaaaaattaattatttgg

SEQ ID NO: 54181 - DNA, 20 bp, Artificial Sequence
  Synthetic oligonucleotide; AGG chr11 5178835 5178854 5178838 -
caaaaaattaattatttggt

SEQ ID NO: 54182 - DNA, 20 bp, Artificial Sequence
  Synthetic oligonucleotide; CGG chr11 5178821 5178840 5178824 -
tttggtaggacttatatatt

SEQ ID NO: 54183 - DNA, 20 bp, Artificial Sequence
  Synthetic oligonucleotide; CAG chr11 5178790 5178809 5178793 -
cccattttactctcctttcc

SEQ ID NO: 54184 - DNA, 20 bp, Artificial Sequence
  Synthetic oligonucleotide; GAG chr11 5178788 5178807 5178791 -
cattttactctcctttccca

SEQ ID NO: 54185 - DNA, 20 bp, Artificial Sequence
  Synthetic oligonucleotide; AAG chr11 5178785 5178804 5178788 -
tttactctcctttcccagag

SEQ ID NO: 54186 - DNA, 20 bp, Artificial Sequence
  Synthetic oligonucleotide; TGG chr11 5178775 5178794 5178778 -
tttcccagagaagaaaacat

SEQ ID NO: 54187 - DNA, 20 bp, Artificial Sequence
  Synthetic oligonucleotide; AAG chr11 5178771 5178790 5178774 -
ccagagaagaaaacattgga

SEQ ID NO: 54188 - DNA, 20 bp, Artificial Sequence
  Synthetic oligonucleotide; GAG chr11 5178754 5178773 5178757 -
ggaaagaaaacaaatctgat

SEQ ID NO: 54189 - DNA, 20 bp, Artificial Sequence
  Synthetic oligonucleotide; CAG chr11 5178743 5178762 5178746 -
aaatctgatgagacctcatt

SEQ ID NO: 54190 - DNA, 20 bp, Artificial Sequence
  Synthetic oligonucleotide; AAG chr11 5178737 5178756 5178740 -
gatgagacctcattcagcct

SEQ ID NO: 54191 - DNA, 20 bp, Artificial Sequence
  Synthetic oligonucleotide; AGG chr11 5178736 5178755 5178739 -
atgagacctcattcagccta

SEQ ID NO: 54192 - DNA, 20 bp, Artificial Sequence
  Synthetic oligonucleotide; TAG chr11 5178733 5178752 5178736 -
agacctcattcagcctaagg

SEQ ID NO: 54193 - DNA, 20 bp, Artificial Sequence
  Synthetic oligonucleotide; TAG chr11 5178708 5178727 5178711 -
tttctaaatcctcaactttg

SEQ ID NO: 54194 - DNA, 20 bp, Artificial Sequence
  Synthetic oligonucleotide; TGG chr11 5178694 5178713 5178697 -
actttgtagtctttcactaa

SEQ ID NO: 54195 - DNA, 20 bp, Artificial Sequence
  Synthetic oligonucleotide; TAG chr11 5178688 5178707 5178691 -
tagtctttcactaatggcac

SEQ ID NO: 54196 - DNA, 20 bp, Artificial Sequence
  Synthetic oligonucleotide; AGG chr11 5178687 5178706 5178690 -
agtctttcactaatggcact

SEQ ID NO: 54197 - DNA, 20 bp, Artificial Sequence
  Synthetic oligonucleotide; TGG chr11 5178682 5178701 5178685 -
ttcactaatggcactaggcc

SEQ ID NO: 54198 - DNA, 20 bp, Artificial Sequence
  Synthetic oligonucleotide; CGG chr11 5178664 5178683 5178667 -
cctggaataaactgtacata

SEQ ID NO: 54199 - DNA, 20 bp, Artificial Sequence
  Synthetic oligonucleotide; CAG chr11 5178632 5178651 5178635 -
ttcgcaatcacactaattcc

SEQ ID NO: 54200 - DNA, 20 bp, Artificial Sequence
  Synthetic oligonucleotide; AGG chr11 5178631 5178650 5178634 -
tcgcaatcacactaattccc

SEQ ID NO: 54201 - DNA, 20 bp, Artificial Sequence
  Synthetic oligonucleotide; TGG chr11 5178623 5178642 5178626 -
acactaattcccaggatgtg

SEQ ID NO: 54202 - DNA, 20 bp, Artificial Sequence
  Synthetic oligonucleotide; TGG chr11 5178610 5178629 5178613 -
ggatgtgtggtatgtcctga

SEQ ID NO: 54203 - DNA, 20 bp, Artificial Sequence
  Synthetic oligonucleotide; GGG chr11 5178609 5178628 5178612 -
gatgtgtggtatgtcctgat

SEQ ID NO: 54204 - DNA, 20 bp, Artificial Sequence
  Synthetic oligonucleotide; CAG chr11 5178601 5178620 5178604 -
gtatgtcctgatgggaatcc

SEQ ID NO: 54205 - DNA, 20 bp, Artificial Sequence
  Synthetic oligonucleotide; AGG chr11 5178600 5178619 5178603 -
tatgtcctgatgggaatccc

SEQ ID NO: 54206 - DNA, 20 bp, Artificial Sequence
  Synthetic oligonucleotide; GGG chr11 5178599 5178618 5178602 -
atgtcctgatgggaatccca

SEQ ID NO: 54207 - DNA, 20 bp, Artificial Sequence
  Synthetic oligonucleotide; TGG chr11 5178595 5178614 5178598 -
cctgatgggaatcccagggc

SEQ ID NO: 54208 - DNA, 20 bp, Artificial Sequence
  Synthetic oligonucleotide; AAG chr11 5178592 5178611 5178595 -
gatgggaatcccagggctgg

SEQ ID NO: 54209 - DNA, 20 bp, Artificial Sequence
  Synthetic oligonucleotide; AGG chr11 5178591 5178610 5178594 -
atgggaatcccagggctgga

SEQ ID NO: 54210 - DNA, 20 bp, Artificial Sequence
  Synthetic oligonucleotide; TGG chr11 5178578 5178597 5178581 -
ggctggaaggcttgcatacc

SEQ ID NO: 54211 - DNA, 20 bp, Artificial Sequence
  Synthetic oligonucleotide; TGG chr11 5178544 5178563 5178547 -
tttttcttttatgtacattg

SEQ ID NO: 54212 - DNA, 20 bp, Artificial Sequence
  Synthetic oligonucleotide; CAG chr11 5178535 5178554 5178538 -
tatgtacattgtggctgttg

SEQ ID NO: 54213 - DNA, 20 bp, Artificial Sequence
  Synthetic oligonucleotide; AGG chr11 5178534 5178553 5178537 -
atgtacattgtggctgttgc

SEQ ID NO: 54214 - DNA, 20 bp, Artificial Sequence
  Synthetic oligonucleotide; GAG chr11 5178500 5178519 5178503 -
tgatcttcctgatcatgact

SEQ ID NO: 54215 - DNA, 20 bp, Artificial Sequence
  Synthetic oligonucleotide; CAG chr11 5178495 5178514 5178498 -
ttcctgatcatgactgagcg

SEQ ID NO: 54216 - DNA, 20 bp, Artificial Sequence
  Synthetic oligonucleotide; GAG chr11 5178485 5178504 5178488 -
tgactgagcgcagtctccat

SEQ ID NO: 54217 - DNA, 20 bp, Artificial Sequence
  Synthetic oligonucleotide; TGG chr11 5178457 5178476 5178460 -
gtatctcttcctatccatgc

SEQ ID NO: 54218 - DNA, 20 bp, Artificial Sequence
  Synthetic oligonucleotide; CAG chr11 5178451 5178470 5178454 -
cttcctatccatgctggcct

SEQ ID NO: 54219 - DNA, 20 bp, Artificial Sequence
  Synthetic oligonucleotide; CAG chr11 5178424 5178443 5178427 -
cttcctgctcgccactgctg

SEQ ID NO: 54220 - DNA, 20 bp, Artificial Sequence
  Synthetic oligonucleotide; AAG chr11 5178416 5178435 5178419 -
tcgccactgctgcagcccct

SEQ ID NO: 54221 - DNA, 20 bp, Artificial Sequence
  Synthetic oligonucleotide; AGG chr11 5178415 5178434 5178418 -
cgccactgctgcagccccta

SEQ ID NO: 54222 - DNA, 20 bp, Artificial Sequence
  Synthetic oligonucleotide; TGG chr11 5178409 5178428 5178412 -
tgctgcagcccctaaggtgc

SEQ ID NO: 54223 - DNA, 20 bp, Artificial Sequence
  Synthetic oligonucleotide; TGG chr11 5178398 5178417 5178401 -
ctaaggtgctggctatcctc

SEQ ID NO: 54224 - DNA, 20 bp, Artificial Sequence
  Synthetic oligonucleotide; TGG chr11 5178385 5178404 5178388 -
tatcctctggttccactcca

SEQ ID NO: 54225 - DNA, 20 bp, Artificial Sequence
  Synthetic oligonucleotide; TGG chr11 5178372 5178391 5178375 -
cactccatggacatatcctt

SEQ ID NO: 54226 - DNA, 20 bp, Artificial Sequence
  Synthetic oligonucleotide; TAG chr11 5178369 5178388 5178372 -
tccatggacatatcctttgg

SEQ ID NO: 54227 - DNA, 20 bp, Artificial Sequence
  Synthetic oligonucleotide; CAG chr11 5178356 5178375 5178359 -
cctttggtagttgtgtgtct

SEQ ID NO: 54228 - DNA, 20 bp, Artificial Sequence
  Synthetic oligonucleotide; TGG chr11 5178328 5178347 5178331 -
cttcatacatttcatctttg

SEQ ID NO: 54229 - DNA, 20 bp, Artificial Sequence
  Synthetic oligonucleotide; CAG chr11 5178325 5178344 5178328 -
catacatttcatctttgtgg

SEQ ID NO: 54230 - DNA, 20 bp, Artificial Sequence
  Synthetic oligonucleotide; TGG chr11 5178307 5178326 5178310 -
ggcagaatctgctattctcc

SEQ ID NO: 54231 - DNA, 20 bp, Artificial Sequence
  Synthetic oligonucleotide; TGG chr11 5178301 5178320 5178304 -
atctgctattctcctggcaa

SEQ ID NO: 54232 - DNA, 20 bp, Artificial Sequence
  Synthetic oligonucleotide; TGG chr11 5178283 5178302 5178286 -
aatggcatttgaccgctatg

SEQ ID NO: 54233 - DNA, 20 bp, Artificial Sequence
  Synthetic oligonucleotide; GAG chr11 5178264 5178283 5178267 -
gtggccatctgttacccact

SEQ ID NO: 54234 - DNA, 20 bp, Artificial Sequence
  Synthetic oligonucleotide; CAG chr11 5178241 5178260 5178244 -
atacaccattttaacctcat

SEQ ID NO: 54235 - DNA, 20 bp, Artificial Sequence
  Synthetic oligonucleotide; CAG chr11 5178234 5178253 5178237 -
attttaacctcatcagccgt

SEQ ID NO: 54236 - DNA, 20 bp, Artificial Sequence
  Synthetic oligonucleotide; AGG chr11 5178233 5178252 5178236 -
ttttaacctcatcagccgtc

SEQ ID NO: 54237 - DNA, 20 bp, Artificial Sequence
  Synthetic oligonucleotide; AAG chr11 5178230 5178249 5178233 -
taacctcatcagccgtcagg

SEQ ID NO: 54238 - DNA, 20 bp, Artificial Sequence
  Synthetic oligonucleotide; TGG chr11 5178225 5178244 5178228 -
tcatcagccgtcaggaagat

SEQ ID NO: 54239 - DNA, 20 bp, Artificial Sequence
  Synthetic oligonucleotide; TAG chr11 5178220 5178239 5178223 -
agccgtcaggaagattggca

SEQ ID NO: 54240 - DNA, 20 bp, Artificial Sequence
  Synthetic oligonucleotide; CAG chr11 5178217 5178236 5178220 -
cgtcaggaagattggcatag

SEQ ID NO: 54241 - DNA, 20 bp, Artificial Sequence
  Synthetic oligonucleotide; TGG chr11 5178211 5178230 5178214 -
gaagattggcatagcagctg

SEQ ID NO: 54242 - DNA, 20 bp, Artificial Sequence
  Synthetic oligonucleotide; CAG chr11 5178207 5178226 5178210 -
attggcatagcagctgtggt

SEQ ID NO: 54243 - DNA, 20 bp, Artificial Sequence
  Synthetic oligonucleotide; AGG chr11 5178206 5178225 5178209 -
ttggcatagcagctgtggtc

SEQ ID NO: 54244 - DNA, 20 bp, Artificial Sequence
  Synthetic oligonucleotide; GAG chr11 5178204 5178223 5178207 -
ggcatagcagctgtggtcag

SEQ ID NO: 54245 - DNA, 20 bp, Artificial Sequence
  Synthetic oligonucleotide; TGG chr11 5178172 5178191 5178175 -
ctgctgtccgttcatcttcc

SEQ ID NO: 54246 - DNA, 20 bp, Artificial Sequence
  Synthetic oligonucleotide; TGG chr11 5178150 5178169 5178153 -
gtataccgacttacatattg

SEQ ID NO: 54247 - DNA, 20 bp, Artificial Sequence
  Synthetic oligonucleotide; GGG chr11 5178149 5178168 5178152 -
tataccgacttacatattgt

SEQ ID NO: 54248 - DNA, 20 bp, Artificial Sequence
  Synthetic oligonucleotide; GAG chr11 5178147 5178166 5178150 -
taccgacttacatattgtgg

SEQ ID NO: 54249 - DNA, 20 bp, Artificial Sequence
  Synthetic oligonucleotide; GAG chr11 5178119 5178138 5178122 -
tcattcctcattcctactgt

SEQ ID NO: 54250 - DNA, 20 bp, Artificial Sequence
  Synthetic oligonucleotide; CAG chr11 5178108 5178127 5178111 -
tcctactgtgagcacattgc

SEQ ID NO: 54251 - DNA, 20 bp, Artificial Sequence
  Synthetic oligonucleotide; TGG chr11 5178103 5178122 5178106 -
ctgtgagcacattgccagat

SEQ ID NO: 54252 - DNA, 20 bp, Artificial Sequence
  Synthetic oligonucleotide; TGG chr11 5178096 5178115 5178099 -
cacattgccagattggcttg

SEQ ID NO: 54253 - DNA, 20 bp, Artificial Sequence
  Synthetic oligonucleotide; TGG chr11 5178069 5178088 5178072 -
atcaatgtcaatatcattta

SEQ ID NO: 54254 - DNA, 20 bp, Artificial Sequence
  Synthetic oligonucleotide; TGG chr11 5178058 5178077 5178061 -
tatcatttatggcctcactg

SEQ ID NO: 54255 - DNA, 20 bp, Artificial Sequence
  Synthetic oligonucleotide; CAG chr11 5178043 5178062 5178046 -
cactgtggccctactctcta

SEQ ID NO: 54256 - DNA, 20 bp, Artificial Sequence
  Synthetic oligonucleotide; AGG chr11 5178042 5178061 5178045 -
actgtggccctactctctac

SEQ ID NO: 54257 - DNA, 20 bp, Artificial Sequence
  Synthetic oligonucleotide; TGG chr11 5178037 5178056 5178040 -
ggccctactctctacaggac

SEQ ID NO: 54258 - DNA, 20 bp, Artificial Sequence
  Synthetic oligonucleotide; TAG chr11 5178031 5178050 5178034 -
actctctacaggactggata

SEQ ID NO: 54259 - DNA, 20 bp, Artificial Sequence
  Synthetic oligonucleotide; CAG chr11 5177992 5178011 5177995 -
ctacacaatgatccttcact

SEQ ID NO: 54260 - DNA, 20 bp, Artificial Sequence
  Synthetic oligonucleotide; CAG chr11 5177984 5178003 5177987 -
tgatccttcactcagtgttt

SEQ ID NO: 54261 - DNA, 20 bp, Artificial Sequence
  Synthetic oligonucleotide; TGG chr11 5177972 5177991 5177975 -
cagtgtttcagatatcttcc

SEQ ID NO: 54262 - DNA, 20 bp, Artificial Sequence
  Synthetic oligonucleotide; GGG chr11 5177971 5177990 5177974 -
agtgtttcagatatcttcct

SEQ ID NO: 54263 - DNA, 20 bp, Artificial Sequence
  Synthetic oligonucleotide; CAG chr11 5177964 5177983 5177967 -
cagatatcttcctgggctgc

SEQ ID NO: 54264 - DNA, 20 bp, Artificial Sequence
  Synthetic oligonucleotide; AGG chr11 5177963 5177982 5177966 -
agatatcttcctgggctgcc

SEQ ID NO: 54265 - DNA, 20 bp, Artificial Sequence
  Synthetic oligonucleotide; AAG chr11 5177957 5177976 5177960 -
cttcctgggctgccaggttc

SEQ ID NO: 54266 - DNA, 20 bp, Artificial Sequence
  Synthetic oligonucleotide; AGG chr11 5177956 5177975 5177959 -
ttcctgggctgccaggttca

SEQ ID NO: 54267 - DNA, 20 bp, Artificial Sequence
  Synthetic oligonucleotide; TAG chr11 5177949 5177968 5177952 -
gctgccaggttcaaggccct

SEQ ID NO: 54268 - DNA, 20 bp, Artificial Sequence
  Synthetic oligonucleotide; CGG chr11 5177940 5177959 5177943 -
ttcaaggcccttagtacgtg

SEQ ID NO: 54269 - DNA, 20 bp, Artificial Sequence
  Synthetic oligonucleotide; CAG chr11 5177902 5177921 5177905 -
catatttatgttctataccc

SEQ ID NO: 54270 - DNA, 20 bp, Artificial Sequence
  Synthetic oligonucleotide; TGG chr11 5177871 5177890 5177874 -
tcatttcttgcccatcgctt

SEQ ID NO: 54271 - DNA, 20 bp, Artificial Sequence
  Synthetic oligonucleotide; GAG chr11 5177869 5177888 5177872 -
atttcttgcccatcgctttg

SEQ ID NO: 54272 - DNA, 20 bp, Artificial Sequence
  Synthetic oligonucleotide; AGG chr11 5177868 5177887 5177871 -
tttcttgcccatcgctttgg

SEQ ID NO: 54273 - DNA, 20 bp, Artificial Sequence
  Synthetic oligonucleotide; TAG chr11 5177836 5177855 5177839 -
ccctcaccacattcacatcc

SEQ ID NO: 54274 - DNA, 20 bp, Artificial Sequence
  Synthetic oligonucleotide; TGG chr11 5177833 5177852 5177836 -
tcaccacattcacatcctag

SEQ ID NO: 54275 - DNA, 20 bp, Artificial Sequence
  Synthetic oligonucleotide; GGG chr11 5177832 5177851 5177835 -
caccacattcacatcctagt

SEQ ID NO: 54276 - DNA, 20 bp, Artificial Sequence
  Synthetic oligonucleotide; CAG chr11 5177829 5177848 5177832 -
cacattcacatcctagtggg

SEQ ID NO: 54277 - DNA, 20 bp, Artificial Sequence
  Synthetic oligonucleotide; TAG chr11 5177815 5177834 5177818 -
agtgggcagtctctatgtgt

SEQ ID NO: 54278 - DNA, 20 bp, Artificial Sequence
  Synthetic oligonucleotide; TGG chr11 5177784 5177803 5177787 -
atgctaaaccccatcattta

SEQ ID NO: 54279 - DNA, 20 bp, Artificial Sequence
  Synthetic oligonucleotide; GGG chr11 5177783 5177802 5177786 -
tgctaaaccccatcatttat

SEQ ID NO: 54280 - DNA, 20 bp, Artificial Sequence
  Synthetic oligonucleotide; GGG chr11 5177782 5177801 5177785 -
gctaaaccccatcatttatg

SEQ ID NO: 54281 - DNA, 20 bp, Artificial Sequence
  Synthetic oligonucleotide; AAG chr11 5177777 5177796 5177780 -
accccatcatttatggggtg

SEQ ID NO: 54282 - DNA, 20 bp, Artificial Sequence
  Synthetic oligonucleotide; AAG chr11 5177761 5177780 5177764 -
ggtgaagaccaaacaaatta

SEQ ID NO: 54283 - DNA, 20 bp, Artificial Sequence
  Synthetic oligonucleotide; GAG chr11 5177755 5177774 5177758 -
gaccaaacaaattaaagatc

SEQ ID NO: 54284 - DNA, 20 bp, Artificial Sequence
  Synthetic oligonucleotide; CAG chr11 5177730 5177749 5177733 -
attttgcttttctctcctat

SEQ ID NO: 54285 - DNA, 20 bp, Artificial Sequence
  Synthetic oligonucleotide; AAG chr11 5177716 5177735 5177719 -
tcctatcagtgtatgctgtt

SEQ ID NO: 54286 - DNA, 20 bp, Artificial Sequence
  Synthetic oligonucleotide; AAG chr11 5177707 5177726 5177710 -
tgtatgctgttaagattaaa

SEQ ID NO: 54287 - DNA, 20 bp, Artificial Sequence
  Synthetic oligonucleotide; TAG chr11 5177697 5177716 5177700 -
taagattaaaaagtctgttt

SEQ ID NO: 54288 - DNA, 20 bp, Artificial Sequence
  Synthetic oligonucleotide; AGG chr11 5177696 5177715 5177699 -
aagattaaaaagtctgtttt

SEQ ID NO: 54289 - DNA, 20 bp, Artificial Sequence
  Synthetic oligonucleotide; GGG chr11 5177695 5177714 5177698 -
agattaaaaagtctgtttta

SEQ ID NO: 54290 - DNA, 20 bp, Artificial Sequence
  Synthetic oligonucleotide; TAG chr11 5177690 5177709 5177693 -
aaaaagtctgttttagggaa

SEQ ID NO: 54291 - DNA, 20 bp, Artificial Sequence
  Synthetic oligonucleotide; TAG chr11 5177672 5177691 5177675 -
aatagaataaatacaatcca

SEQ ID NO: 54292 - DNA, 20 bp, Artificial Sequence
  Synthetic oligonucleotide; TGG chr11 5177644 5177663 5177647 -
ctcaaacacacttaaaatga

SEQ ID NO: 54293 - DNA, 20 bp, Artificial Sequence
  Synthetic oligonucleotide; AAG chr11 5177632 5177651 5177635 -
taaaatgatggtgtctatca

SEQ ID NO: 54294 - DNA, 20 bp, Artificial Sequence
  Synthetic oligonucleotide; CGG chr11 5177623 5177642 5177626 -
ggtgtctatcaaagtgtcca

SEQ ID NO: 54295 - DNA, 20 bp, Artificial Sequence
  Synthetic oligonucleotide; AAG chr11 5177611 5177630 5177614 -
agtgtccacggaattttgct

SEQ ID NO: 54296 - DNA, 20 bp, Artificial Sequence
  Synthetic oligonucleotide; AGG chr11 5177610 5177629 5177613 -
gtgtccacggaattttgcta

SEQ ID NO: 54297 - DNA, 20 bp, Artificial Sequence
  Synthetic oligonucleotide; AAG chr11 5177601 5177620 5177604 -
gaattttgctaaggcactca

SEQ ID NO: 54298 - DNA, 20 bp, Artificial Sequence
  Synthetic oligonucleotide; AAG chr11 5177594 5177613 5177597 -
gctaaggcactcaaagatca

SEQ ID NO: 54299 - DNA, 20 bp, Artificial Sequence
  Synthetic oligonucleotide; AGG chr11 5177593 5177612 5177596 -
ctaaggcactcaaagatcaa

SEQ ID NO: 54300 - DNA, 20 bp, Artificial Sequence
  Synthetic oligonucleotide; CAG chr11 5177549 5177568 5177552 -
aatgaaattctccatttttt

SEQ ID NO: 54301 - DNA, 20 bp, Artificial Sequence
  Synthetic oligonucleotide; AAG chr11 5177508 5177527 5177511 -
ttttaacttaaaaatatata

SEQ ID NO: 54302 - DNA, 20 bp, Artificial Sequence
  Synthetic oligonucleotide; GAG chr11 5177499 5177518 5177502 -
aaaaatatataaagataatc

SEQ ID NO: 54303 - DNA, 20 bp, Artificial Sequence
  Synthetic oligonucleotide; AAG chr11 5177494 5177513 5177497 -
tatataaagataatcgagaa

SEQ ID NO: 54304 - DNA, 20 bp, Artificial Sequence
  Synthetic oligonucleotide; GAG chr11 5177492 5177511 5177495 -
tataaagataatcgagaaaa

SEQ ID NO: 54305 - DNA, 20 bp, Artificial Sequence
  Synthetic oligonucleotide; TAG chr11 5177479 5177498 5177482 -
gagaaaagagaaatatattt

SEQ ID NO: 54306 - DNA, 20 bp, Artificial Sequence
  Synthetic oligonucleotide; AGG chr11 5177478 5177497 5177481 -
agaaaagagaaatatatttt

SEQ ID NO: 54307 - DNA, 20 bp, Artificial Sequence
  Synthetic oligonucleotide; GGG chr11 5177477 5177496 5177480 -
gaaaagagaaatatatttta

SEQ ID NO: 54308 - DNA, 20 bp, Artificial Sequence
  Synthetic oligonucleotide; CAG chr11 5177467 5177486 5177470 -
atatattttagggtttaatc

SEQ ID NO: 54309 - DNA, 20 bp, Artificial Sequence
  Synthetic oligonucleotide; TAG chr11 5177448 5177467 5177451 -
ccagattgacttttcctacg

SEQ ID NO: 54310 - DNA, 20 bp, Artificial Sequence
  Synthetic oligonucleotide; GAG chr11 5177446 5177465 5177449 -
agattgacttttcctacgta

SEQ ID NO: 54311 - DNA, 20 bp, Artificial Sequence
  Synthetic oligonucleotide; TAG chr11 5177442 5177461 5177445 -
tgacttttcctacgtagagc

SEQ ID NO: 54312 - DNA, 20 bp, Artificial Sequence
  Synthetic oligonucleotide; AGG chr11 5177441 5177460 5177444 -
gacttttcctacgtagagct

SEQ ID NO: 54313 - DNA, 20 bp, Artificial Sequence
  Synthetic oligonucleotide; AAG chr11 5177438 5177457 5177441 -
ttttcctacgtagagctagg

SEQ ID NO: 54314 - DNA, 20 bp, Artificial Sequence
  Synthetic oligonucleotide; TGG chr11 5177435 5177454 5177438 -
tcctacgtagagctaggaag

SEQ ID NO: 54315 - DNA, 20 bp, Artificial Sequence
  Synthetic oligonucleotide; GGG chr11 5177434 5177453 5177437 -
cctacgtagagctaggaagt

SEQ ID NO: 54316 - DNA, 20 bp, Artificial Sequence
  Synthetic oligonucleotide; GGG chr11 5177433 5177452 5177436 -
ctacgtagagctaggaagtg

SEQ ID NO: 54317 - DNA, 20 bp, Artificial Sequence
  Synthetic oligonucleotide; GAG chr11 5177426 5177445 5177429 -
gagctaggaagtggggtttt

SEQ ID NO: 54318 - DNA, 20 bp, Artificial Sequence
  Synthetic oligonucleotide; CAG chr11 5177422 5177441 5177425 -
taggaagtggggttttgagt

SEQ ID NO: 54319 - DNA, 20 bp, Artificial Sequence
  Synthetic oligonucleotide; TGG chr11 5177415 5177434 5177418 -
tggggttttgagtcagtcac

SEQ ID NO: 54320 - DNA, 20 bp, Artificial Sequence
  Synthetic oligonucleotide; GGG chr11 5177414 5177433 5177417 -
ggggttttgagtcagtcact

SEQ ID NO: 54321 - DNA, 20 bp, Artificial Sequence
  Synthetic oligonucleotide; TAG chr11 5177404 5177423 5177407 -
gtcagtcactgggcttttta

SEQ ID NO: 54322 - DNA, 20 bp, Artificial Sequence
  Synthetic oligonucleotide; CAG chr11 5177400 5177419 5177403 -
gtcactgggctttttatagt

SEQ ID NO: 54323 - DNA, 20 bp, Artificial Sequence
  Synthetic oligonucleotide; CAG chr11 5177354 5177373 5177357 -
aacactcccgctgtactctg

SEQ ID NO: 54324 - DNA, 20 bp, Artificial Sequence
  Synthetic oligonucleotide; GAG chr11 5177352 5177371 5177355 -
cactcccgctgtactctgca

SEQ ID NO: 54325 - DNA, 20 bp, Artificial Sequence
  Synthetic oligonucleotide; AAG chr11 5177331 5177350 5177334 -
agacttgaaccaataacatg

SEQ ID NO: 54326 - DNA, 20 bp, Artificial Sequence
  Synthetic oligonucleotide; AAG chr11 5177295 5177314 5177298 -
tttgtcaacacctgttactt

SEQ ID NO: 54327 - DNA, 20 bp, Artificial Sequence
  Synthetic oligonucleotide; TAG chr11 5177277 5177296 5177280 -
ttaagttaaaatgttatccc

SEQ ID NO: 54328 - DNA, 20 bp, Artificial Sequence
  Synthetic oligonucleotide; AAG chr11 5177245 5177264 5177248 -
taactcactgacatctcaca

SEQ ID NO: 54329 - DNA, 20 bp, Artificial Sequence
  Synthetic oligonucleotide; TGG chr11 5177233 5177252 5177236 -
atctcacaaagtctcttgta

SEQ ID NO: 54330 - DNA, 20 bp, Artificial Sequence
  Synthetic oligonucleotide; TAG chr11 5177228 5177247 5177231 -
acaaagtctcttgtatggaa

SEQ ID NO: 54331 - DNA, 20 bp, Artificial Sequence
  Synthetic oligonucleotide; AAG chr11 5177201 5177220 5177204 -
ataatacatatgtattcaac

SEQ ID NO: 54332 - DNA, 20 bp, Artificial Sequence
  Synthetic oligonucleotide; TAG chr11 5177191 5177210 5177194 -
tgtattcaacaagtgaataa

SEQ ID NO: 54333 - DNA, 20 bp, Artificial Sequence
  Synthetic oligonucleotide; AAG chr11 5177181 5177200 5177184 -
aagtgaataatagtgaatta

SEQ ID NO: 54334 - DNA, 20 bp, Artificial Sequence
  Synthetic oligonucleotide; GAG chr11 5177146 5177165 5177149 -
aatattaaattaacaaatat

SEQ ID NO: 54335 - DNA, 20 bp, Artificial Sequence
  Synthetic oligonucleotide; TGG chr11 5177137 5177156 5177140 -
ttaacaaatatgagattgcc

SEQ ID NO: 54336 - DNA, 20 bp, Artificial Sequence
  Synthetic oligonucleotide; TAG chr11 5177102 5177121 5177105 -
ctgatacacatttcccccta

SEQ ID NO: 54337 - DNA, 20 bp, Artificial Sequence
  Synthetic oligonucleotide; TGG chr11 5177099 5177118 5177102 -
atacacatttccccctatag

SEQ ID NO: 54338 - DNA, 20 bp, Artificial Sequence
  Synthetic oligonucleotide; GAG chr11 5177097 5177116 5177100 -
acacatttccccctatagtg

SEQ ID NO: 54339 - DNA, 20 bp, Artificial Sequence
  Synthetic oligonucleotide; TAG chr11 5177090 5177109 5177093 -
tccccctatagtggagattt

SEQ ID NO: 54340 - DNA, 20 bp, Artificial Sequence
  Synthetic oligonucleotide; AAG chr11 5177083 5177102 5177086 -
atagtggagattttagaccc

SEQ ID NO: 54341 - DNA, 20 bp, Artificial Sequence
  Synthetic oligonucleotide; TGG chr11 5177073 5177092 5177076 -
ttttagacccaagtcatcaa

SEQ ID NO: 54342 - DNA, 20 bp, Artificial Sequence
  Synthetic oligonucleotide; GAG chr11 5177071 5177090 5177074 -
ttagacccaagtcatcaatg

SEQ ID NO: 54343 - DNA, 20 bp, Artificial Sequence
  Synthetic oligonucleotide; TGG chr11 5177063 5177082 5177066 -
aagtcatcaatggagcatca

SEQ ID NO: 54344 - DNA, 20 bp, Artificial Sequence
  Synthetic oligonucleotide; CAG chr11 5177054 5177073 5177057 -
atggagcatcatggcatcaa

SEQ ID NO: 54345 - DNA, 20 bp, Artificial Sequence
  Synthetic oligonucleotide; AAG chr11 5177040 5177059 5177043 -
catcaacagaaacatcactg

SEQ ID NO: 54346 - DNA, 20 bp, Artificial Sequence
  Synthetic oligonucleotide; AAG chr11 5177037 5177056 5177040 -
caacagaaacatcactgaag

SEQ ID NO: 54347 - DNA, 20 bp, Artificial Sequence
  Synthetic oligonucleotide; TGG chr11 5177009 5177028 5177012 -
tgattgaaaatttctatacc

SEQ ID NO: 54348 - DNA, 20 bp, Artificial Sequence
  Synthetic oligonucleotide; GGG chr11 5177008 5177027 5177011 -
gattgaaaatttctatacct

SEQ ID NO: 54349 - DNA, 20 bp, Artificial Sequence
  Synthetic oligonucleotide; AAG chr11 5176970 5176989 5176973 -
taaaataaacattttttaaa

SEQ ID NO: 54350 - DNA, 20 bp, Artificial Sequence
  Synthetic oligonucleotide; TAG chr11 5176966 5176985 5176969 -
ataaacattttttaaaaagc

SEQ ID NO: 54351 - DNA, 20 bp, Artificial Sequence
  Synthetic oligonucleotide; GAG chr11 5176964 5176983 5176967 -
aaacattttttaaaaagcta

SEQ ID NO: 54352 - DNA, 20 bp, Artificial Sequence
  Synthetic oligonucleotide; AAG chr11 5176961 5176980 5176964 -
cattttttaaaaagctagag

SEQ ID NO: 54353 - DNA, 20 bp, Artificial Sequence
  Synthetic oligonucleotide; AAG chr11 5176955 5176974 5176958 -
ttaaaaagctagagaagatt

SEQ ID NO: 54354 - DNA, 20 bp, Artificial Sequence
  Synthetic oligonucleotide; AGG chr11 5176954 5176973 5176957 -
taaaaagctagagaagatta

SEQ ID NO: 54355 - DNA, 20 bp, Artificial Sequence
  Synthetic oligonucleotide; GAG chr11 5176952 5176971 5176955 -
aaaagctagagaagattaag

SEQ ID NO: 54356 - DNA, 20 bp, Artificial Sequence
  Synthetic oligonucleotide; AAG chr11 5176939 5176958 5176942 -
gattaaggagaatattttcc

SEQ ID NO: 54357 - DNA, 20 bp, Artificial Sequence
  Synthetic oligonucleotide; AAG chr11 5176922 5176941 5176925 -
tccaagaaacttaaataaaa

SEQ ID NO: 54358 - DNA, 20 bp, Artificial Sequence
  Synthetic oligonucleotide; CAG chr11 5176909 5176928 5176912 -
aataaaaaagaatgtaatcc

SEQ ID NO: 54359 - DNA, 20 bp, Artificial Sequence
  Synthetic oligonucleotide; AAG chr11 5176903 5176922 5176906 -
aaagaatgtaatcccagcaa

SEQ ID NO: 54360 - DNA, 20 bp, Artificial Sequence
  Synthetic oligonucleotide; CAG chr11 5176878 5176897 5176881 -
attatctatgatattatcta

SEQ ID NO: 54361 - DNA, 20 bp, Artificial Sequence
  Synthetic oligonucleotide; AAG chr11 5176820 5176839 5176823 -
ttacaatctctccttcttaa

SEQ ID NO: 54362 - DNA, 20 bp, Artificial Sequence
  Synthetic oligonucleotide; TAG chr11 5176815 5176834 5176818 -
atctctccttcttaaaagcc

SEQ ID NO: 54363 - DNA, 20 bp, Artificial Sequence
  Synthetic oligonucleotide; GAG chr11 5176801 5176820 5176804 -
aaagcctagaacaatgccat

SEQ ID NO: 54364 - DNA, 20 bp, Artificial Sequence
  Synthetic oligonucleotide; AAG chr11 5176767 5176786 5176770 -
aatgaccttatttacaccta

SEQ ID NO: 54365 - DNA, 20 bp, Artificial Sequence
  Synthetic oligonucleotide; AAG chr11 5176763 5176782 5176766 -
accttatttacacctaaaga

SEQ ID NO: 54366 - DNA, 20 bp, Artificial Sequence
  Synthetic oligonucleotide; GAG chr11 5176744 5176763 5176747 -
aaagacaaaaaaaaaacttt

SEQ ID NO: 54367 - DNA, 20 bp, Artificial Sequence
  Synthetic oligonucleotide; GAG chr11 5176735 5176754 5176738 -
aaaaaaactttgagaaatct

SEQ ID NO: 54368 - DNA, 20 bp, Artificial Sequence
  Synthetic oligonucleotide; AGG chr11 5176734 5176753 5176737 -
aaaaaactttgagaaatctg

SEQ ID NO: 54369 - DNA, 20 bp, Artificial Sequence
  Synthetic oligonucleotide; TGG chr11 5176698 5176717 5176701 -
acttgaaatctactcatgct

SEQ ID NO: 54370 - DNA, 20 bp, Artificial Sequence
  Synthetic oligonucleotide; TAG chr11 5176687 5176706 5176690 -
actcatgcttggcttatgct

SEQ ID NO: 54371 - DNA, 20 bp, Artificial Sequence
  Synthetic oligonucleotide; TAG chr11 5176666 5176685 5176669 -
agctttttctgtgattttta

SEQ ID NO: 54372 - DNA, 20 bp, Artificial Sequence
  Synthetic oligonucleotide; TAG chr11 5176640 5176659 5176643 -
tttatacatgtattaacact

SEQ ID NO: 54373 - DNA, 20 bp, Artificial Sequence
  Synthetic oligonucleotide; TGG chr11 5176597 5176616 5176600 -
aatttatctacatttatatg

SEQ ID NO: 54374 - DNA, 20 bp, Artificial Sequence
  Synthetic oligonucleotide; AAG chr11 5176508 5176527 5176511 -
acacacacgtttgtgcacca

SEQ ID NO: 54375 - DNA, 20 bp, Artificial Sequence
  Synthetic oligonucleotide; AAG chr11 5176502 5176521 5176505 -
acgtttgtgcaccaaagaat

SEQ ID NO: 54376 - DNA, 20 bp, Artificial Sequence
  Synthetic oligonucleotide; AAG chr11 5176498 5176517 5176501 -
ttgtgcaccaaagaataaga

SEQ ID NO: 54377 - DNA, 20 bp, Artificial Sequence
  Synthetic oligonucleotide; TAG chr11 5176494 5176513 5176497 -
gcaccaaagaataagaaagt

SEQ ID NO: 54378 - DNA, 20 bp, Artificial Sequence
  Synthetic oligonucleotide; TAG chr11 5176488 5176507 5176491 -
aagaataagaaagttagaaa

SEQ ID NO: 54379 - DNA, 20 bp, Artificial Sequence
  Synthetic oligonucleotide; CAG chr11 5176477 5176496 5176480 -
agttagaaatagacttccta

SEQ ID NO: 54380 - DNA, 20 bp, Artificial Sequence
  Synthetic oligonucleotide; TGG chr11 5176462 5176481 5176465 -
tcctacagtatttccattat

SEQ ID NO: 54381 - DNA, 20 bp, Artificial Sequence
  Synthetic oligonucleotide; GGG chr11 5176461 5176480 5176464 -
cctacagtatttccattatt

SEQ ID NO: 54382 - DNA, 20 bp, Artificial Sequence
  Synthetic oligonucleotide; AAG chr11 5176458 5176477 5176461 -
acagtatttccattattggg

SEQ ID NO: 54383 - DNA, 20 bp, Artificial Sequence
  Synthetic oligonucleotide; AGG chr11 5176457 5176476 5176460 -
cagtatttccattattggga

SEQ ID NO: 54384 - DNA, 20 bp, Artificial Sequence
  Synthetic oligonucleotide; GGG chr11 5176456 5176475 5176459 -
agtatttccattattgggaa

SEQ ID NO: 54385 - DNA, 20 bp, Artificial Sequence
  Synthetic oligonucleotide; GAG chr11 5176454 5176473 5176457 -
tatttccattattgggaagg

SEQ ID NO: 54386 - DNA, 20 bp, Artificial Sequence
  Synthetic oligonucleotide; TAG chr11 5176408 5176427 5176411 -
tctaattaatttgtttctgc

SEQ ID NO: 54387 - DNA, 20 bp, Artificial Sequence
  Synthetic oligonucleotide; AAG chr11 5176388 5176407 5176391 -
tagtactacactaaatattt

SEQ ID NO: 54388 - DNA, 20 bp, Artificial Sequence
  Synthetic oligonucleotide; CAG chr11 5176348 5176367 5176351 -
ttcaaaatatttgcatttct

SEQ ID NO: 54389 - DNA, 20 bp, Artificial Sequence
  Synthetic oligonucleotide; TAG chr11 5176325 5176344 5176328 -
tacatctgttaaacttcata

SEQ ID NO: 54390 - DNA, 20 bp, Artificial Sequence
  Synthetic oligonucleotide; TGG chr11 5176295 5176314 5176298 -
ttctactctacacaatgttt

SEQ ID NO: 54391 - DNA, 20 bp, Artificial Sequence
  Synthetic oligonucleotide; CAG chr11 5176268 5176287 5176271 -
tctaatgtgaaatttacact

SEQ ID NO: 54392 - DNA, 20 bp, Artificial Sequence
  Synthetic oligonucleotide; AAG chr11 5176247 5176266 5176250 -
agcgttgcatttctccataa

SEQ ID NO: 54393 - DNA, 20 bp, Artificial Sequence
  Synthetic oligonucleotide; TGG chr11 5176233 5176252 5176236 -
ccataaaagtaataatatga

SEQ ID NO: 54394 - DNA, 20 bp, Artificial Sequence
  Synthetic oligonucleotide; GAG chr11 5176225 5176244 5176228 -
gtaataatatgatggaaaat

SEQ ID NO: 54395 - DNA, 20 bp, Artificial Sequence
  Synthetic oligonucleotide; AGG chr11 5176224 5176243 5176227 -
taataatatgatggaaaatg

SEQ ID NO: 54396 - DNA, 20 bp, Artificial Sequence
  Synthetic oligonucleotide; GGG chr11 5176223 5176242 5176226 -
aataatatgatggaaaatga

SEQ ID NO: 54397 - DNA, 20 bp, Artificial Sequence
  Synthetic oligonucleotide; TAG chr11 5176218 5176237 5176221 -
tatgatggaaaatgagggaa

SEQ ID NO: 54398 - DNA, 20 bp, Artificial Sequence
  Synthetic oligonucleotide; TAG chr11 5176214 5176233 5176217 -
atggaaaatgagggaataga

SEQ ID NO: 54399 - DNA, 20 bp, Artificial Sequence
  Synthetic oligonucleotide; CAG chr11 5176207 5176226 5176210 -
atgagggaatagatagattg

SEQ ID NO: 54400 - DNA, 20 bp, Artificial Sequence
  Synthetic oligonucleotide; CAG chr11 5176196 5176215 5176199 -
gatagattgcagtatgatga

SEQ ID NO: 54401 - DNA, 20 bp, Artificial Sequence
  Synthetic oligonucleotide; GAG chr11 5176194 5176213 5176197 -
tagattgcagtatgatgaca

SEQ ID NO: 54402 - DNA, 20 bp, Artificial Sequence
  Synthetic oligonucleotide; AGG chr11 5176193 5176212 5176196 -
agattgcagtatgatgacag

SEQ ID NO: 54403 - DNA, 20 bp, Artificial Sequence
  Synthetic oligonucleotide; AAG chr11 5176180 5176199 5176183 -
atgacagaggatttgactga

SEQ ID NO: 54404 - DNA, 20 bp, Artificial Sequence
  Synthetic oligonucleotide; AGG chr11 5176179 5176198 5176182 -
tgacagaggatttgactgaa

SEQ ID NO: 54405 - DNA, 20 bp, Artificial Sequence
  Synthetic oligonucleotide; TAG chr11 5176176 5176195 5176179 -
cagaggatttgactgaaagg

SEQ ID NO: 54406 - DNA, 20 bp, Artificial Sequence
  Synthetic oligonucleotide; AGG chr11 5176175 5176194 5176178 -
agaggatttgactgaaaggt

SEQ ID NO: 54407 - DNA, 20 bp, Artificial Sequence
  Synthetic oligonucleotide; AAG chr11 5176172 5176191 5176175 -
ggatttgactgaaaggtagg

SEQ ID NO: 54408 - DNA, 20 bp, Artificial Sequence
  Synthetic oligonucleotide; TAG chr11 5176151 5176170 5176154 -
agattttgtatacttgattt

SEQ ID NO: 54409 - DNA, 20 bp, Artificial Sequence
  Synthetic oligonucleotide; CAG chr11 5176148 5176167 5176151 -
ttttgtatacttgattttag

SEQ ID NO: 54410 - DNA, 20 bp, Artificial Sequence
  Synthetic oligonucleotide; TGG chr11 5176145 5176164 5176148 -
tgtatacttgattttagcag

SEQ ID NO: 54411 - DNA, 20 bp, Artificial Sequence
  Synthetic oligonucleotide; GGG chr11 5176144 5176163 5176147 -
gtatacttgattttagcagt

SEQ ID NO: 54412 - DNA, 20 bp, Artificial Sequence
  Synthetic oligonucleotide; GGG chr11 5176143 5176162 5176146 -
tatacttgattttagcagtg

SEQ ID NO: 54413 - DNA, 20 bp, Artificial Sequence
  Synthetic oligonucleotide; GAG chr11 5176141 5176160 5176144 -
tacttgattttagcagtggg

SEQ ID NO: 54414 - DNA, 20 bp, Artificial Sequence
  Synthetic oligonucleotide; AAG chr11 5176136 5176155 5176139 -
gattttagcagtggggagct

SEQ ID NO: 54415 - DNA, 20 bp, Artificial Sequence
  Synthetic oligonucleotide; TAG chr11 5176086 5176105 5176089 -
atgcaacatgatatcttaaa

SEQ ID NO: 54416 - DNA, 20 bp, Artificial Sequence
  Synthetic oligonucleotide; AGG chr11 5176085 5176104 5176088 -
tgcaacatgatatcttaaat

SEQ ID NO: 54417 - DNA, 20 bp, Artificial Sequence
  Synthetic oligonucleotide; TAG chr11 5176050 5176069 5176053 -
tataatcatatatacatata

SEQ ID NO: 54418 - DNA, 20 bp, Artificial Sequence
  Synthetic oligonucleotide; CAG chr11 5176042 5176061 5176045 -
tatatacatatatagctaca

SEQ ID NO: 54419 - DNA, 20 bp, Artificial Sequence
  Synthetic oligonucleotide; CAG chr11 5176017 5176036 5176020 -
acatatacatgtcattttga

SEQ ID NO: 54420 - DNA, 20 bp, Artificial Sequence
  Synthetic oligonucleotide; TGG chr11 5176008 5176027 5176011 -
tgtcattttgacagttaaaa

SEQ ID NO: 54421 - DNA, 20 bp, Artificial Sequence
  Synthetic oligonucleotide; TAG chr11 5176005 5176024 5176008 -
cattttgacagttaaaatgg

SEQ ID NO: 54422 - DNA, 20 bp, Artificial Sequence
  Synthetic oligonucleotide; AAG chr11 5176002 5176021 5176005 -
tttgacagttaaaatggtag

SEQ ID NO: 54423 - DNA, 20 bp, Artificial Sequence
  Synthetic oligonucleotide; CAG chr11 5175962 5175981 5175965 -
acaatctctaaataaacttt

SEQ ID NO: 54424 - DNA, 20 bp, Artificial Sequence
  Synthetic oligonucleotide; GAG chr11 5175957 5175976 5175960 -
ctctaaataaactttcagtt

SEQ ID NO: 54425 - DNA, 20 bp, Artificial Sequence
  Synthetic oligonucleotide; CAG chr11 5175950 5175969 5175953 -
taaactttcagttgagcact

SEQ ID NO: 54426 - DNA, 20 bp, Artificial Sequence
  Synthetic oligonucleotide; AAG chr11 5175940 5175959 5175943 -
gttgagcactcagattctga

SEQ ID NO: 54427 - DNA, 20 bp, Artificial Sequence
  Synthetic oligonucleotide; AGG chr11 5175939 5175958 5175942 -
ttgagcactcagattctgaa

SEQ ID NO: 54428 - DNA, 20 bp, Artificial Sequence
  Synthetic oligonucleotide; TAG chr11 5175933 5175952 5175936 -
actcagattctgaaaggatt

SEQ ID NO: 54429 - DNA, 20 bp, Artificial Sequence
  Synthetic oligonucleotide; AGG chr11 5175932 5175951 5175935 -
ctcagattctgaaaggattt

SEQ ID NO: 54430 - DNA, 20 bp, Artificial Sequence
  Synthetic oligonucleotide; TGG chr11 5175926 5175945 5175929 -
ttctgaaaggatttaggaaa

SEQ ID NO: 54431 - DNA, 20 bp, Artificial Sequence
  Synthetic oligonucleotide; CAG chr11 5175912 5175931 5175915 -
aggaaatggctgttgctatg

SEQ ID NO: 54432 - DNA, 20 bp, Artificial Sequence
  Synthetic oligonucleotide; GAG chr11 5175889 5175908 5175892 -
ctgctgaatttaacattact

SEQ ID NO: 54433 - DNA, 20 bp, Artificial Sequence
  Synthetic oligonucleotide; TGG chr11 5175877 5175896 5175880 -
acattactgagccattgccc

SEQ ID NO: 54434 - DNA, 20 bp, Artificial Sequence
  Synthetic oligonucleotide; GAG chr11 5175870 5175889 5175873 -
tgagccattgccctggacat

SEQ ID NO: 54435 - DNA, 20 bp, Artificial Sequence
  Synthetic oligonucleotide; AAG chr11 5175867 5175886 5175870 -
gccattgccctggacatgag

SEQ ID NO: 54436 - DNA, 20 bp, Artificial Sequence
  Synthetic oligonucleotide; AAG chr11 5175864 5175883 5175867 -
attgccctggacatgagaag

SEQ ID NO: 54437 - DNA, 20 bp, Artificial Sequence
  Synthetic oligonucleotide; CAG chr11 5175835 5175854 5175838 -
tgttctactgtctccttaac

SEQ ID NO: 54438 - DNA, 20 bp, Artificial Sequence
  Synthetic oligonucleotide; CAG chr11 5175824 5175843 5175827 -
ctccttaaccagtaatcctt

SEQ ID NO: 54439 - DNA, 20 bp, Artificial Sequence
  Synthetic oligonucleotide; CAG chr11 5175821 5175840 5175824 -
cttaaccagtaatccttcag

SEQ ID NO: 54440 - DNA, 20 bp, Artificial Sequence
  Synthetic oligonucleotide; AGG chr11 5175820 5175839 5175823 -
ttaaccagtaatccttcagc

SEQ ID NO: 54441 - DNA, 20 bp, Artificial Sequence
  Synthetic oligonucleotide; AAG chr11 5175817 5175836 5175820 -
accagtaatccttcagcagg

SEQ ID NO: 54442 - DNA, 20 bp, Artificial Sequence
  Synthetic oligonucleotide; AGG chr11 5175816 5175835 5175819 -
ccagtaatccttcagcagga

SEQ ID NO: 54443 - DNA, 20 bp, Artificial Sequence
  Synthetic oligonucleotide; GGG chr11 5175815 5175834 5175818 -
cagtaatccttcagcaggaa

SEQ ID NO: 54444 - DNA, 20 bp, Artificial Sequence
  Synthetic oligonucleotide; AAG chr11 5175811 5175830 5175814 -
aatccttcagcaggaaggga

SEQ ID NO: 54445 - DNA, 20 bp, Artificial Sequence
  Synthetic oligonucleotide; AGG chr11 5175810 5175829 5175813 -
atccttcagcaggaagggaa

SEQ ID NO: 54446 - DNA, 20 bp, Artificial Sequence
  Synthetic oligonucleotide; GGG chr11 5175809 5175828 5175812 -
tccttcagcaggaagggaaa

SEQ ID NO: 54447 - DNA, 20 bp, Artificial Sequence
  Synthetic oligonucleotide; AAG chr11 5175805 5175824 5175808 -
tcagcaggaagggaaaggga

SEQ ID NO: 54448 - DNA, 20 bp, Artificial Sequence
  Synthetic oligonucleotide; AGG chr11 5175804 5175823 5175807 -
cagcaggaagggaaagggaa

SEQ ID NO: 54449 - DNA, 20 bp, Artificial Sequence
  Synthetic oligonucleotide; GGG chr11 5175803 5175822 5175806 -
agcaggaagggaaagggaaa

SEQ ID NO: 54450 - DNA, 20 bp, Artificial Sequence
  Synthetic oligonucleotide; AAG chr11 5175799 5175818 5175802 -
ggaagggaaagggaaaggga

SEQ ID NO: 54451 - DNA, 20 bp, Artificial Sequence
  Synthetic oligonucleotide; AGG chr11 5175798 5175817 5175801 -
gaagggaaagggaaagggaa

SEQ ID NO: 54452 - DNA, 20 bp, Artificial Sequence
  Synthetic oligonucleotide; GGG chr11 5175797 5175816 5175800 -
aagggaaagggaaagggaaa

SEQ ID NO: 54453 - DNA, 20 bp, Artificial Sequence
  Synthetic oligonucleotide; AAG chr11 5175793 5175812 5175796 -
gaaagggaaagggaaaggga

SEQ ID NO: 54454 - DNA, 20 bp, Artificial Sequence
  Synthetic oligonucleotide; AGG chr11 5175792 5175811 5175795 -
aaagggaaagggaaagggaa

SEQ ID NO: 54455 - DNA, 20 bp, Artificial Sequence
  Synthetic oligonucleotide; GGG chr11 5175791 5175810 5175794 -
aagggaaagggaaagggaaa

SEQ ID NO: 54456 - DNA, 20 bp, Artificial Sequence
  Synthetic oligonucleotide; AAG chr11 5175787 5175806 5175790 -
gaaagggaaagggaaaggga

SEQ ID NO: 54457 - DNA, 20 bp, Artificial Sequence
  Synthetic oligonucleotide; AGG chr11 5175786 5175805 5175789 -
aaagggaaagggaaagggaa

SEQ ID NO: 54458 - DNA, 20 bp, Artificial Sequence
  Synthetic oligonucleotide; GGG chr11 5175785 5175804 5175788 -
aagggaaagggaaagggaaa

SEQ ID NO: 54459 - DNA, 20 bp, Artificial Sequence
  Synthetic oligonucleotide; AAG chr11 5175781 5175800 5175784 -
gaaagggaaagggaaaggga

SEQ ID NO: 54460 - DNA, 20 bp, Artificial Sequence
  Synthetic oligonucleotide; AGG chr11 5175780 5175799 5175783 -
aaagggaaagggaaagggaa

SEQ ID NO: 54461 - DNA, 20 bp, Artificial Sequence
  Synthetic oligonucleotide; GGG chr11 5175779 5175798 5175782 -
aagggaaagggaaagggaaa

SEQ ID NO: 54462 - DNA, 20 bp, Artificial Sequence
  Synthetic oligonucleotide; GAG chr11 5175777 5175796 5175780 -
gggaaagggaaagggaaagg

SEQ ID NO: 54463 - DNA, 20 bp, Artificial Sequence
  Synthetic oligonucleotide; AGG chr11 5175776 5175795 5175779 -
ggaaagggaaagggaaaggg

SEQ ID NO: 54464 - DNA, 20 bp, Artificial Sequence
  Synthetic oligonucleotide; GGG chr11 5175775 5175794 5175778 -
gaaagggaaagggaaaggga

SEQ ID NO: 54465 - DNA, 20 bp, Artificial Sequence
  Synthetic oligonucleotide; AAG chr11 5175772 5175791 5175775 -
agggaaagggaaagggaggg

SEQ ID NO: 54466 - DNA, 20 bp, Artificial Sequence
  Synthetic oligonucleotide; AGG chr11 5175771 5175790 5175774 -
gggaaagggaaagggaggga

SEQ ID NO: 54467 - DNA, 20 bp, Artificial Sequence
  Synthetic oligonucleotide; GGG chr11 5175770 5175789 5175773 -
ggaaagggaaagggagggaa

SEQ ID NO: 54468 - DNA, 20 bp, Artificial Sequence
  Synthetic oligonucleotide; AAG chr11 5175766 5175785 5175769 -
agggaaagggagggaaggga

SEQ ID NO: 54469 - DNA, 20 bp, Artificial Sequence
  Synthetic oligonucleotide; AGG chr11 5175765 5175784 5175768 -
gggaaagggagggaagggaa

SEQ ID NO: 54470 - DNA, 20 bp, Artificial Sequence
  Synthetic oligonucleotide; AAG chr11 5175761 5175780 5175764 -
aagggagggaagggaaagga

SEQ ID NO: 54471 - DNA, 20 bp, Artificial Sequence
  Synthetic oligonucleotide; AGG chr11 5175760 5175779 5175763 -
agggagggaagggaaaggaa

SEQ ID NO: 54472 - DNA, 20 bp, Artificial Sequence
  Synthetic oligonucleotide; GGG chr11 5175759 5175778 5175762 -
gggagggaagggaaaggaaa

SEQ ID NO: 54473 - DNA, 20 bp, Artificial Sequence
  Synthetic oligonucleotide; AAG chr11 5175756 5175775 5175759 -
agggaagggaaaggaaaggg

SEQ ID NO: 54474 - DNA, 20 bp, Artificial Sequence
  Synthetic oligonucleotide; AGG chr11 5175755 5175774 5175758 -
gggaagggaaaggaaaggga

SEQ ID NO: 54475 - DNA, 20 bp, Artificial Sequence
  Synthetic oligonucleotide; GGG chr11 5175754 5175773 5175757 -
ggaagggaaaggaaagggaa

SEQ ID NO: 54476 - DNA, 20 bp, Artificial Sequence
  Synthetic oligonucleotide; AAG chr11 5175751 5175770 5175754 -
agggaaaggaaagggaaggg

SEQ ID NO: 54477 - DNA, 20 bp, Artificial Sequence
  Synthetic oligonucleotide; AGG chr11 5175750 5175769 5175753 -
gggaaaggaaagggaaggga

SEQ ID NO: 54478 - DNA, 20 bp, Artificial Sequence
  Synthetic oligonucleotide; AAG chr11 5175746 5175765 5175749 -
aaggaaagggaagggaagga

SEQ ID NO: 54479 - DNA, 20 bp, Artificial Sequence
  Synthetic oligonucleotide; AGG chr11 5175745 5175764 5175748 -
aggaaagggaagggaaggaa

SEQ ID NO: 54480 - DNA, 20 bp, Artificial Sequence
  Synthetic oligonucleotide; AAG chr11 5175741 5175760 5175744 -
aagggaagggaaggaaagga

SEQ ID NO: 54481 - DNA, 20 bp, Artificial Sequence
  Synthetic oligonucleotide; AGG chr11 5175740 5175759 5175743 -
agggaagggaaggaaaggaa

SEQ ID NO: 54482 - DNA, 20 bp, Artificial Sequence
  Synthetic oligonucleotide; AAG chr11 5175734 5175753 5175737 -
gggaaggaaaggaaaggaaa

SEQ ID NO: 54483 - DNA, 20 bp, Artificial Sequence
  Synthetic oligonucleotide; AGG chr11 5175733 5175752 5175736 -
ggaaggaaaggaaaggaaaa

SEQ ID NO: 54484 - DNA, 20 bp, Artificial Sequence
  Synthetic oligonucleotide; AAG chr11 5175729 5175748 5175732 -
ggaaaggaaaggaaaaagga

SEQ ID NO: 54485 - DNA, 20 bp, Artificial Sequence
  Synthetic oligonucleotide; AGG chr11 5175728 5175747 5175731 -
gaaaggaaaggaaaaaggaa

SEQ ID NO: 54486 - DNA, 20 bp, Artificial Sequence
  Synthetic oligonucleotide; AAG chr11 5175724 5175743 5175727 -
ggaaaggaaaaaggaaagga

SEQ ID NO: 54487 - DNA, 20 bp, Artificial Sequence
  Synthetic oligonucleotide; AGG chr11 5175723 5175742 5175726 -
gaaaggaaaaaggaaaggaa

SEQ ID NO: 54488 - DNA, 20 bp, Artificial Sequence
  Synthetic oligonucleotide; AAG chr11 5175719 5175738 5175722 -
ggaaaaaggaaaggaaagga

SEQ ID NO: 54489 - DNA, 20 bp, Artificial Sequence
  Synthetic oligonucleotide; AGG chr11 5175718 5175737 5175721 -
gaaaaaggaaaggaaaggaa

SEQ ID NO: 54490 - DNA, 20 bp, Artificial Sequence
  Synthetic oligonucleotide; AAG chr11 5175714 5175733 5175717 -
aaggaaaggaaaggaaagga

SEQ ID NO: 54491 - DNA, 20 bp, Artificial Sequence
  Synthetic oligonucleotide; AGG chr11 5175713 5175732 5175716 -
aggaaaggaaaggaaaggaa

SEQ ID NO: 54492 - DNA, 20 bp, Artificial Sequence
  Synthetic oligonucleotide; AAG chr11 5175709 5175728 5175712 -
aaggaaaggaaaggaaagga

SEQ ID NO: 54493 - DNA, 20 bp, Artificial Sequence
  Synthetic oligonucleotide; AGG chr11 5175708 5175727 5175711 -
aggaaaggaaaggaaaggaa

SEQ ID NO: 54494 - DNA, 20 bp, Artificial Sequence
  Synthetic oligonucleotide; AAG chr11 5175704 5175723 5175707 -
aaggaaaggaaaggaaagga

SEQ ID NO: 54495 - DNA, 20 bp, Artificial Sequence
  Synthetic oligonucleotide; AGG chr11 5175703 5175722 5175706 -
aggaaaggaaaggaaaggaa

SEQ ID NO: 54496 - DNA, 20 bp, Artificial Sequence
  Synthetic oligonucleotide; AAG chr11 5175699 5175718 5175702 -
aaggaaaggaaaggaaagga

SEQ ID NO: 54497 - DNA, 20 bp, Artificial Sequence
  Synthetic oligonucleotide; AGG chr11 5175698 5175717 5175701 -
aggaaaggaaaggaaaggaa

SEQ ID NO: 54498 - DNA, 20 bp, Artificial Sequence
  Synthetic oligonucleotide; AAG chr11 5175694 5175713 5175697 -
aaggaaaggaaaggaaagga

SEQ ID NO: 54499 - DNA, 20 bp, Artificial Sequence
  Synthetic oligonucleotide; AGG chr11 5175693 5175712 5175696 -
aggaaaggaaaggaaaggaa

SEQ ID NO: 54500 - DNA, 20 bp, Artificial Sequence
  Synthetic oligonucleotide; AAG chr11 5175683 5175702 5175686 -
aggaaaggaaaggtccaaaa

SEQ ID NO: 54501 - DNA, 20 bp, Artificial Sequence
  Synthetic oligonucleotide; AGG chr11 5175682 5175701 5175685 -
ggaaaggaaaggtccaaaaa

SEQ ID NO: 54502 - DNA, 20 bp, Artificial Sequence
  Synthetic oligonucleotide; GGG chr11 5175681 5175700 5175684 -
gaaaggaaaggtccaaaaaa

SEQ ID NO: 54503 - DNA, 20 bp, Artificial Sequence
  Synthetic oligonucleotide; CAG chr11 5175678 5175697 5175681 -
aggaaaggtccaaaaaaggg

SEQ ID NO: 54504 - DNA, 20 bp, Artificial Sequence
  Synthetic oligonucleotide; AAG chr11 5175659 5175678 5175662 -
gcagaaaccaaacaatttta

SEQ ID NO: 54505 - DNA, 20 bp, Artificial Sequence
  Synthetic oligonucleotide; CAG chr11 5175656 5175675 5175659 -
gaaaccaaacaattttaaag

SEQ ID NO: 54506 - DNA, 20 bp, Artificial Sequence
  Synthetic oligonucleotide; AGG chr11 5175655 5175674 5175658 -
aaaccaaacaattttaaagc

SEQ ID NO: 54507 - DNA, 20 bp, Artificial Sequence
  Synthetic oligonucleotide; GGG chr11 5175654 5175673 5175657 -
aaccaaacaattttaaagca

SEQ ID NO: 54508 - DNA, 20 bp, Artificial Sequence
  Synthetic oligonucleotide; GAG chr11 5175652 5175671 5175655 -
ccaaacaattttaaagcagg

SEQ ID NO: 54509 - DNA, 20 bp, Artificial Sequence
  Synthetic oligonucleotide; TGG chr11 5175646 5175665 5175649 -
aattttaaagcagggagttt

SEQ ID NO: 54510 - DNA, 20 bp, Artificial Sequence
  Synthetic oligonucleotide; AAG chr11 5175643 5175662 5175646 -
tttaaagcagggagttttgg

SEQ ID NO: 54511 - DNA, 20 bp, Artificial Sequence
  Synthetic oligonucleotide; TAG chr11 5175636 5175655 5175639 -
cagggagttttggaagcact

SEQ ID NO: 54512 - DNA, 20 bp, Artificial Sequence
  Synthetic oligonucleotide; TGG chr11 5175621 5175640 5175624 -
gcacttagctaaaactgata

SEQ ID NO: 54513 - DNA, 20 bp, Artificial Sequence
  Synthetic oligonucleotide; TAG chr11 5175613 5175632 5175616 -
ctaaaactgatatggtgttc

SEQ ID NO: 54514 - DNA, 20 bp, Artificial Sequence
  Synthetic oligonucleotide; CAG chr11 5175609 5175628 5175612 -
aactgatatggtgttctaga

SEQ ID NO: 54515 - DNA, 20 bp, Artificial Sequence
  Synthetic oligonucleotide; TAG chr11 5175603 5175622 5175606 -
tatggtgttctagacagaat

SEQ ID NO: 54516 - DNA, 20 bp, Artificial Sequence
  Synthetic oligonucleotide; AAG chr11 5175584 5175603 5175587 -
ttagcaaaaacaaaaaacaa

SEQ ID NO: 54517 - DNA, 20 bp, Artificial Sequence
  Synthetic oligonucleotide; AGG chr11 5175583 5175602 5175586 -
tagcaaaaacaaaaaacaaa

SEQ ID NO: 54518 - DNA, 20 bp, Artificial Sequence
  Synthetic oligonucleotide; CAG chr11 5175578 5175597 5175581 -
aaaacaaaaaacaaaaggta

SEQ ID NO: 54519 - DNA, 20 bp, Artificial Sequence
  Synthetic oligonucleotide; AGG chr11 5175577 5175596 5175580 -
aaacaaaaaacaaaaggtac

SEQ ID NO: 54520 - DNA, 20 bp, Artificial Sequence
  Synthetic oligonucleotide; GGG chr11 5175576 5175595 5175579 -
aacaaaaaacaaaaggtaca

SEQ ID NO: 54521 - DNA, 20 bp, Artificial Sequence
  Synthetic oligonucleotide; AAG chr11 5175569 5175588 5175572 -
aacaaaaggtacagggtgct

SEQ ID NO: 54522 - DNA, 20 bp, Artificial Sequence
  Synthetic oligonucleotide; AAG chr11 5175558 5175577 5175561 -
cagggtgctaagtgattgat

SEQ ID NO: 54523 - DNA, 20 bp, Artificial Sequence
  Synthetic oligonucleotide; AGG chr11 5175557 5175576 5175560 -
agggtgctaagtgattgata

SEQ ID NO: 54524 - DNA, 20 bp, Artificial Sequence
  Synthetic oligonucleotide; GAG chr11 5175553 5175572 5175556 -
tgctaagtgattgataaggt

SEQ ID NO: 54525 - DNA, 20 bp, Artificial Sequence
  Synthetic oligonucleotide; TAG chr11 5175548 5175567 5175551 -
agtgattgataaggtgagaa

SEQ ID NO: 54526 - DNA, 20 bp, Artificial Sequence
  Synthetic oligonucleotide; GAG chr11 5175535 5175554 5175538 -
gtgagaatagtatttcaaat

SEQ ID NO: 54527 - DNA, 20 bp, Artificial Sequence
  Synthetic oligonucleotide; AAG chr11 5175531 5175550 5175534 -
gaatagtatttcaaatgagc

SEQ ID NO: 54528 - DNA, 20 bp, Artificial Sequence
  Synthetic oligonucleotide; GAG chr11 5175529 5175548 5175532 -
atagtatttcaaatgagcaa

SEQ ID NO: 54529 - DNA, 20 bp, Artificial Sequence
  Synthetic oligonucleotide; AAG chr11 5175522 5175541 5175525 -
ttcaaatgagcaagagatcc

SEQ ID NO: 54530 - DNA, 20 bp, Artificial Sequence
  Synthetic oligonucleotide; CAG chr11 5175517 5175536 5175520 -
atgagcaagagatccaagac

SEQ ID NO: 54531 - DNA, 20 bp, Artificial Sequence
  Synthetic oligonucleotide; CAG chr11 5175506 5175525 5175509 -
atccaagaccagtaccacta

SEQ ID NO: 54532 - DNA, 20 bp, Artificial Sequence
  Synthetic oligonucleotide; GAG chr11 5175486 5175505 5175489 -
cagactattgttttataact

SEQ ID NO: 54533 - DNA, 20 bp, Artificial Sequence
  Synthetic oligonucleotide; AGG chr11 5175485 5175504 5175488 -
agactattgttttataactg

SEQ ID NO: 54534 - DNA, 20 bp, Artificial Sequence
  Synthetic oligonucleotide; TAG chr11 5175479 5175498 5175482 -
ttgttttataactgaggtct

SEQ ID NO: 54535 - DNA, 20 bp, Artificial Sequence
  Synthetic oligonucleotide; AAG chr11 5175464 5175483 5175467 -
ggtcttagttaatatcaatc

SEQ ID NO: 54536 - DNA, 20 bp, Artificial Sequence
  Synthetic oligonucleotide; CGG chr11 5175447 5175466 5175450 -
atcaagcaaaattttgattt

SEQ ID NO: 54537 - DNA, 20 bp, Artificial Sequence
  Synthetic oligonucleotide; GGG chr11 5175446 5175465 5175449 -
tcaagcaaaattttgatttc

SEQ ID NO: 54538 - DNA, 20 bp, Artificial Sequence
  Synthetic oligonucleotide; GGG chr11 5175445 5175464 5175448 -
caagcaaaattttgatttcg

SEQ ID NO: 54539 - DNA, 20 bp, Artificial Sequence
  Synthetic oligonucleotide; GGG chr11 5175444 5175463 5175447 -
aagcaaaattttgatttcgg

SEQ ID NO: 54540 - DNA, 20 bp, Artificial Sequence
  Synthetic oligonucleotide; GGG chr11 5175443 5175462 5175446 -
agcaaaattttgatttcggg

SEQ ID NO: 54541 - DNA, 20 bp, Artificial Sequence
  Synthetic oligonucleotide; GAG chr11 5175441 5175460 5175444 -
caaaattttgatttcggggg

SEQ ID NO: 54542 - DNA, 20 bp, Artificial Sequence
  Synthetic oligonucleotide; AAG chr11 5175434 5175453 5175437 -
ttgatttcggggggagaaaa

SEQ ID NO: 54543 - DNA, 20 bp, Artificial Sequence
  Synthetic oligonucleotide; TGG chr11 5175417 5175436 5175420 -
aaaaagaccaaattgtaatc

SEQ ID NO: 54544 - DNA, 20 bp, Artificial Sequence
  Synthetic oligonucleotide; GGG chr11 5175416 5175435 5175419 -
aaaagaccaaattgtaatct

SEQ ID NO: 54545 - DNA, 20 bp, Artificial Sequence
  Synthetic oligonucleotide; GGG chr11 5175415 5175434 5175418 -
aaagaccaaattgtaatctg

SEQ ID NO: 54546 - DNA, 20 bp, Artificial Sequence
  Synthetic oligonucleotide; AAG chr11 5175346 5175365 5175349 -
tgtatatgatatgatcattt

SEQ ID NO: 54547 - DNA, 20 bp, Artificial Sequence
  Synthetic oligonucleotide; AAG chr11 5175340 5175359 5175343 -
tgatatgatcatttaagtat

SEQ ID NO: 54548 - DNA, 20 bp, Artificial Sequence
  Synthetic oligonucleotide; AAG chr11 5175329 5175348 5175332 -
tttaagtataagtcacctga

SEQ ID NO: 54549 - DNA, 20 bp, Artificial Sequence
  Synthetic oligonucleotide; AAG chr11 5175322 5175341 5175325 -
ataagtcacctgaaagtaaa

SEQ ID NO: 54550 - DNA, 20 bp, Artificial Sequence
  Synthetic oligonucleotide; GAG chr11 5175320 5175339 5175323 -
aagtcacctgaaagtaaaaa

SEQ ID NO: 54551 - DNA, 20 bp, Artificial Sequence
  Synthetic oligonucleotide; AAG chr11 5175311 5175330 5175314 -
gaaagtaaaaagagttatat

SEQ ID NO: 54552 - DNA, 20 bp, Artificial Sequence
  Synthetic oligonucleotide; AGG chr11 5175310 5175329 5175313 -
aaagtaaaaagagttatata

SEQ ID NO: 54553 - DNA, 20 bp, Artificial Sequence
  Synthetic oligonucleotide; AAG chr11 5175272 5175291 5175275 -
ataatgttttatgcaactgc

SEQ ID NO: 54554 - DNA, 20 bp, Artificial Sequence
  Synthetic oligonucleotide; TAG chr11 5175263 5175282 5175266 -
tatgcaactgcaagaaccaa

SEQ ID NO: 54555 - DNA, 20 bp, Artificial Sequence
  Synthetic oligonucleotide; AGG chr11 5175262 5175281 5175265 -
atgcaactgcaagaaccaat

SEQ ID NO: 54556 - DNA, 20 bp, Artificial Sequence
  Synthetic oligonucleotide; TAG chr11 5175255 5175274 5175258 -
tgcaagaaccaataggaaaa

SEQ ID NO: 54557 - DNA, 20 bp, Artificial Sequence
  Synthetic oligonucleotide; TGG chr11 5175250 5175269 5175253 -
gaaccaataggaaaatagaa

SEQ ID NO: 54558 - DNA, 20 bp, Artificial Sequence
  Synthetic oligonucleotide; GGG chr11 5175249 5175268 5175252 -
aaccaataggaaaatagaat

SEQ ID NO: 54559 - DNA, 20 bp, Artificial Sequence
  Synthetic oligonucleotide; TAG chr11 5175221 5175240 5175224 -
tgtcacattcaaaatgatga

SEQ ID NO: 54560 - DNA, 20 bp, Artificial Sequence
  Synthetic oligonucleotide; GAG chr11 5175219 5175238 5175222 -
tcacattcaaaatgatgata

SEQ ID NO: 54561 - DNA, 20 bp, Artificial Sequence
  Synthetic oligonucleotide; AGG chr11 5175218 5175237 5175221 -
cacattcaaaatgatgatag

SEQ ID NO: 54562 - DNA, 20 bp, Artificial Sequence
  Synthetic oligonucleotide; CAG chr11 5175214 5175233 5175217 -
ttcaaaatgatgatagaggc

SEQ ID NO: 54563 - DNA, 20 bp, Artificial Sequence
  Synthetic oligonucleotide; TGG chr11 5175208 5175227 5175211 -
atgatgatagaggccagacg

SEQ ID NO: 54564 - DNA, 20 bp, Artificial Sequence
  Synthetic oligonucleotide; TGG chr11 5175205 5175224 5175208 -
atgatagaggccagacgtgg

SEQ ID NO: 54565 - DNA, 20 bp, Artificial Sequence
  Synthetic oligonucleotide; CAG chr11 5175186 5175205 5175189 -
gtggcgcacacctgtaatcc

SEQ ID NO: 54566 - DNA, 20 bp, Artificial Sequence
  Synthetic oligonucleotide; TGG chr11 5175178 5175197 5175181 -
cacctgtaatcccagctaca

SEQ ID NO: 54567 - DNA, 20 bp, Artificial Sequence
  Synthetic oligonucleotide; GGG chr11 5175177 5175196 5175180 -
acctgtaatcccagctacat

SEQ ID NO: 54568 - DNA, 20 bp, Artificial Sequence
  Synthetic oligonucleotide; GAG chr11 5175175 5175194 5175178 -
ctgtaatcccagctacatgg

SEQ ID NO: 54569 - DNA, 20 bp, Artificial Sequence
  Synthetic oligonucleotide; AGG chr11 5175174 5175193 5175177 -
tgtaatcccagctacatggg

SEQ ID NO: 54570 - DNA, 20 bp, Artificial Sequence
  Synthetic oligonucleotide; GAG chr11 5175169 5175188 5175172 -
tcccagctacatgggaggct

SEQ ID NO: 54571 - DNA, 20 bp, Artificial Sequence
  Synthetic oligonucleotide; AGG chr11 5175168 5175187 5175171 -
cccagctacatgggaggctg

SEQ ID NO: 54572 - DNA, 20 bp, Artificial Sequence
  Synthetic oligonucleotide; CAG chr11 5175165 5175184 5175168 -
agctacatgggaggctgagg

SEQ ID NO: 54573 - DNA, 20 bp, Artificial Sequence
  Synthetic oligonucleotide; AGG chr11 5175164 5175183 5175167 -
gctacatgggaggctgaggc

SEQ ID NO: 54574 - DNA, 20 bp, Artificial Sequence
  Synthetic oligonucleotide; GAG chr11 5175162 5175181 5175165 -
tacatgggaggctgaggcag

SEQ ID NO: 54575 - DNA, 20 bp, Artificial Sequence
  Synthetic oligonucleotide; TGG chr11 5175145 5175164 5175148 -
caggagaatgatttgaattc

SEQ ID NO: 54576 - DNA, 20 bp, Artificial Sequence
  Synthetic oligonucleotide; GAG chr11 5175143 5175162 5175146 -
ggagaatgatttgaattctg

SEQ ID NO: 54577 - DNA, 20 bp, Artificial Sequence
  Synthetic oligonucleotide; AGG chr11 5175142 5175161 5175145 -
gagaatgatttgaattctgg

SEQ ID NO: 54578 - DNA, 20 bp, Artificial Sequence
  Synthetic oligonucleotide; CGG chr11 5175139 5175158 5175142 -
aatgatttgaattctggagg

SEQ ID NO: 54579 - DNA, 20 bp, Artificial Sequence
  Synthetic oligonucleotide; GAG chr11 5175137 5175156 5175140 -
tgatttgaattctggaggcg

SEQ ID NO: 54580 - DNA, 20 bp, Artificial Sequence
  Synthetic oligonucleotide; AGG chr11 5175136 5175155 5175139 -
gatttgaattctggaggcgg

SEQ ID NO: 54581 - DNA, 20 bp, Artificial Sequence
  Synthetic oligonucleotide; CAG chr11 5175130 5175149 5175133 -
aattctggaggcggaggttg

SEQ ID NO: 54582 - DNA, 20 bp, Artificial Sequence
  Synthetic oligonucleotide; GAG chr11 5175126 5175145 5175129 -
ctggaggcggaggttgcagt

SEQ ID NO: 54583 - DNA, 20 bp, Artificial Sequence
  Synthetic oligonucleotide; GAG chr11 5175121 5175140 5175124 -
ggcggaggttgcagtgagcc

SEQ ID NO: 54584 - DNA, 20 bp, Artificial Sequence
  Synthetic oligonucleotide; TAG chr11 5175101 5175120 5175104 -
gagatcgcgtcacctcactc

SEQ ID NO: 54585 - DNA, 20 bp, Artificial Sequence
  Synthetic oligonucleotide; TGG chr11 5175096 5175115 5175099 -
cgcgtcacctcactctagcc

SEQ ID NO: 54586 - DNA, 20 bp, Artificial Sequence
  Synthetic oligonucleotide; CAG chr11 5175089 5175108 5175092 -
cctcactctagcctggacca

SEQ ID NO: 54587 - DNA, 20 bp, Artificial Sequence
  Synthetic oligonucleotide; GAG chr11 5175087 5175106 5175090 -
tcactctagcctggaccaca

SEQ ID NO: 54588 - DNA, 20 bp, Artificial Sequence
  Synthetic oligonucleotide; GAG chr11 5175085 5175104 5175088 -
actctagcctggaccacaga

SEQ ID NO: 54589 - DNA, 20 bp, Artificial Sequence
  Synthetic oligonucleotide; GAG chr11 5175083 5175102 5175086 -
tctagcctggaccacagaga

SEQ ID NO: 54590 - DNA, 20 bp, Artificial Sequence
  Synthetic oligonucleotide; AAG chr11 5175037 5175056 5175040 -
atacgtaaaacaaaaacaaa

SEQ ID NO: 54591 - DNA, 20 bp, Artificial Sequence
  Synthetic oligonucleotide; TAG chr11 5175004 5175023 5175007 -
aataaaacccaaaatgataa

SEQ ID NO: 54592 - DNA, 20 bp, Artificial Sequence
  Synthetic oligonucleotide; CAG chr11 5174933 5174952 5174936 -
gtttattgtaacaattctct

SEQ ID NO: 54593 - DNA, 20 bp, Artificial Sequence
  Synthetic oligonucleotide; AAG chr11 5174845 5174864 5174848 -
tttccatttttattgtgata

SEQ ID NO: 54594 - DNA, 20 bp, Artificial Sequence
  Synthetic oligonucleotide; AAG chr11 5174799 5174818 5174802 -
accgtatatcatatataata

SEQ ID NO: 54595 - DNA, 20 bp, Artificial Sequence
  Synthetic oligonucleotide; AAG chr11 5174775 5174794 5174778 -
tcaccatattaaccattttt

SEQ ID NO: 54596 - DNA, 20 bp, Artificial Sequence
  Synthetic oligonucleotide; TGG chr11 5174762 5174781 5174765 -
catttttaagtataattatg

SEQ ID NO: 54597 - DNA, 20 bp, Artificial Sequence
  Synthetic oligonucleotide; AAG chr11 5174692 5174711 5174695 -
ccaaaactttttcatcatcc

SEQ ID NO: 54598 - DNA, 20 bp, Artificial Sequence
  Synthetic oligonucleotide; CAG chr11 5174689 5174708 5174692 -
aaactttttcatcatccaag

SEQ ID NO: 54599 - DNA, 20 bp, Artificial Sequence
  Synthetic oligonucleotide; TAG chr11 5174671 5174690 5174674 -
agcagaaatgctatacttgt

SEQ ID NO: 54600 - DNA, 20 bp, Artificial Sequence
  Synthetic oligonucleotide; AGG chr11 5174670 5174689 5174673 -
gcagaaatgctatacttgtt

SEQ ID NO: 54601 - DNA, 20 bp, Artificial Sequence
  Synthetic oligonucleotide; CAG chr11 5174667 5174686 5174670 -
gaaatgctatacttgttagg

SEQ ID NO: 54602 - DNA, 20 bp, Artificial Sequence
  Synthetic oligonucleotide; CAG chr11 5174656 5174675 5174659 -
cttgttaggcagtaactccc

SEQ ID NO: 54603 - DNA, 20 bp, Artificial Sequence
  Synthetic oligonucleotide; TAG chr11 5174648 5174667 5174651 -
gcagtaactccccagtccca

SEQ ID NO: 54604 - DNA, 20 bp, Artificial Sequence
  Synthetic oligonucleotide; CAG chr11 5174613 5174632 5174616 -
tactatatgtttctctaaat

SEQ ID NO: 54605 - DNA, 20 bp, Artificial Sequence
  Synthetic oligonucleotide; TAG chr11 5174603 5174622 5174606 -
ttctctaaatcagtctattt

SEQ ID NO: 54606 - DNA, 20 bp, Artificial Sequence
  Synthetic oligonucleotide; TAG chr11 5174586 5174605 5174589 -
ttttagataattcatataaa

SEQ ID NO: 54607 - DNA, 20 bp, Artificial Sequence
  Synthetic oligonucleotide; TGG chr11 5174555 5174574 5174558 -
aatatttgttgttttgtgtc

SEQ ID NO: 54608 - DNA, 20 bp, Artificial Sequence
  Synthetic oligonucleotide; AAG chr11 5174535 5174554 5174538 -
tggcttattttacccaacat

SEQ ID NO: 54609 - DNA, 20 bp, Artificial Sequence
  Synthetic oligonucleotide; AGG chr11 5174534 5174553 5174537 -
ggcttattttacccaacata

SEQ ID NO: 54610 - DNA, 20 bp, Artificial Sequence
  Synthetic oligonucleotide; AAG chr11 5174526 5174545 5174529 -
ttacccaacataaggtttca

SEQ ID NO: 54611 - DNA, 20 bp, Artificial Sequence
  Synthetic oligonucleotide; TAG chr11 5174501 5174520 5174504 -
catccatgccataacatgta

SEQ ID NO: 54612 - DNA, 20 bp, Artificial Sequence
  Synthetic oligonucleotide; TGG chr11 5174498 5174517 5174501 -
ccatgccataacatgtatag

SEQ ID NO: 54613 - DNA, 20 bp, Artificial Sequence
  Synthetic oligonucleotide; AAG chr11 5174494 5174513 5174497 -
gccataacatgtatagtggt

SEQ ID NO: 54614 - DNA, 20 bp, Artificial Sequence
  Synthetic oligonucleotide; TAG chr11 5174467 5174486 5174470 -
tgcttaatgttgtccattca

SEQ ID NO: 54615 - DNA, 20 bp, Artificial Sequence
  Synthetic oligonucleotide; TGG chr11 5174459 5174478 5174462 -
gttgtccattcatagattct

SEQ ID NO: 54616 - DNA, 20 bp, Artificial Sequence
  Synthetic oligonucleotide; AAG chr11 5174443 5174462 5174446 -
ttcttggaaactgaaacttt

SEQ ID NO: 54617 - DNA, 20 bp, Artificial Sequence
  Synthetic oligonucleotide; AAG chr11 5174438 5174457 5174441 -
ggaaactgaaactttaagcc

SEQ ID NO: 54618 - DNA, 20 bp, Artificial Sequence
  Synthetic oligonucleotide; CAG chr11 5174399 5174418 5174402 -
ccattttttttctcatctaa

SEQ ID NO: 54619 - DNA, 20 bp, Artificial Sequence
  Synthetic oligonucleotide; TGG chr11 5174393 5174412 5174396 -
tttttctcatctaacagtgt

SEQ ID NO: 54620 - DNA, 20 bp, Artificial Sequence
  Synthetic oligonucleotide; CAG chr11 5174384 5174403 5174387 -
tctaacagtgttggctaaaa

SEQ ID NO: 54621 - DNA, 20 bp, Artificial Sequence
  Synthetic oligonucleotide; GAG chr11 5174373 5174392 5174376 -
tggctaaaacagtgttattt

SEQ ID NO: 54622 - DNA, 20 bp, Artificial Sequence
  Synthetic oligonucleotide; AGG chr11 5174372 5174391 5174375 -
ggctaaaacagtgttatttg

SEQ ID NO: 54623 - DNA, 20 bp, Artificial Sequence
  Synthetic oligonucleotide; AAG chr11 5174345 5174364 5174348 -
gttttacatcatttcactta

SEQ ID NO: 54624 - DNA, 20 bp, Artificial Sequence
  Synthetic oligonucleotide; AAG chr11 5174307 5174326 5174310 -
acctattcatgacattaaat

SEQ ID NO: 54625 - DNA, 20 bp, Artificial Sequence
  Synthetic oligonucleotide; AGG chr11 5174306 5174325 5174309 -
cctattcatgacattaaata

SEQ ID NO: 54626 - DNA, 20 bp, Artificial Sequence
  Synthetic oligonucleotide; TGG chr11 5174203 5174222 5174206 -
tcatctgtttatgtacattc

SEQ ID NO: 54627 - DNA, 20 bp, Artificial Sequence
  Synthetic oligonucleotide; TGG chr11 5174186 5174205 5174189 -
ttctggttgtttccaccttt

SEQ ID NO: 54628 - DNA, 20 bp, Artificial Sequence
  Synthetic oligonucleotide; CAG chr11 5174153 5174172 5174156 -
taatgctacaatgaacattt

SEQ ID NO: 54629 - DNA, 20 bp, Artificial Sequence
  Synthetic oligonucleotide; AAG chr11 5174147 5174166 5174150 -
tacaatgaacatttcagtac

SEQ ID NO: 54630 - DNA, 20 bp, Artificial Sequence
  Synthetic oligonucleotide; TAG chr11 5174105 5174124 5174108 -
atatatttttaatatatacc

SEQ ID NO: 54631 - DNA, 20 bp, Artificial Sequence
  Synthetic oligonucleotide; AGG chr11 5174104 5174123 5174107 -
tatatttttaatatatacct

SEQ ID NO: 54632 - DNA, 20 bp, Artificial Sequence
  Synthetic oligonucleotide; GAG chr11 5174102 5174121 5174105 -
tatttttaatatatacctag

SEQ ID NO: 54633 - DNA, 20 bp, Artificial Sequence
  Synthetic oligonucleotide; GAG chr11 5174100 5174119 5174103 -
tttttaatatatacctagga

SEQ ID NO: 54634 - DNA, 20 bp, Artificial Sequence
  Synthetic oligonucleotide; AGG chr11 5174099 5174118 5174102 -
ttttaatatatacctaggag

SEQ ID NO: 54635 - DNA, 20 bp, Artificial Sequence
  Synthetic oligonucleotide; TGG chr11 5174091 5174110 5174094 -
tatacctaggagaggaattt

SEQ ID NO: 54636 - DNA, 20 bp, Artificial Sequence
  Synthetic oligonucleotide; GGG chr11 5174090 5174109 5174093 -
atacctaggagaggaatttt

SEQ ID NO: 54637 - DNA, 20 bp, Artificial Sequence
  Synthetic oligonucleotide; GGG chr11 5174089 5174108 5174092 -
tacctaggagaggaattttg

SEQ ID NO: 54638 - DNA, 20 bp, Artificial Sequence
  Synthetic oligonucleotide; CAG chr11 5174074 5174093 5174077 -
ttttggggtcatatgttatt

SEQ ID NO: 54639 - DNA, 20 bp, Artificial Sequence
  Synthetic oligonucleotide; AAG chr11 5174066 5174085 5174069 -
tcatatgttattcagtgcct

SEQ ID NO: 54640 - DNA, 20 bp, Artificial Sequence
  Synthetic oligonucleotide; AAG chr11 5174057 5174076 5174060 -
attcagtgcctaagtttttg

SEQ ID NO: 54641 - DNA, 20 bp, Artificial Sequence
  Synthetic oligonucleotide; CAG chr11 5174034 5174053 5174037 -
aactgtcaaaatattttcta

SEQ ID NO: 54642 - DNA, 20 bp, Artificial Sequence
  Synthetic oligonucleotide; AAG chr11 5174031 5174050 5174034 -
tgtcaaaatattttctacag

SEQ ID NO: 54643 - DNA, 20 bp, Artificial Sequence
  Synthetic oligonucleotide; TAG chr11 5174009 5174028 5174012 -
gttgcaccacttaacatttt

SEQ ID NO: 54644 - DNA, 20 bp, Artificial Sequence
  Synthetic oligonucleotide; CAG chr11 5174006 5174025 5174009 -
gcaccacttaacatttttag

SEQ ID NO: 54645 - DNA, 20 bp, Artificial Sequence
  Synthetic oligonucleotide; GAG chr11 5173995 5174014 5173998 -
catttttagcagcaatatat

SEQ ID NO: 54646 - DNA, 20 bp, Artificial Sequence
  Synthetic oligonucleotide; AGG chr11 5173994 5174013 5173997 -
atttttagcagcaatatatg

SEQ ID NO: 54647 - DNA, 20 bp, Artificial Sequence
  Synthetic oligonucleotide; AAG chr11 5173930 5173949 5173933 -
catttgttttgtttctctta

SEQ ID NO: 54648 - DNA, 20 bp, Artificial Sequence
  Synthetic oligonucleotide; TAG chr11 5173925 5173944 5173928 -
gttttgtttctcttaaagta

SEQ ID NO: 54649 - DNA, 20 bp, Artificial Sequence
  Synthetic oligonucleotide; TAG chr11 5173916 5173935 5173919 -
ctcttaaagtatagacattc

SEQ ID NO: 54650 - DNA, 20 bp, Artificial Sequence
  Synthetic oligonucleotide; AAG chr11 5173912 5173931 5173915 -
taaagtatagacattctagt

SEQ ID NO: 54651 - DNA, 20 bp, Artificial Sequence
  Synthetic oligonucleotide; AAG chr11 5173905 5173924 5173908 -
tagacattctagtaagtttg

SEQ ID NO: 54652 - DNA, 20 bp, Artificial Sequence
  Synthetic oligonucleotide; TAG chr11 5173902 5173921 5173905 -
acattctagtaagtttgaag

SEQ ID NO: 54653 - DNA, 20 bp, Artificial Sequence
  Synthetic oligonucleotide; TGG chr11 5173889 5173908 5173892 -
tttgaagtagtgtcttattg

SEQ ID NO: 54654 - DNA, 20 bp, Artificial Sequence
  Synthetic oligonucleotide; TGG chr11 5173883 5173902 5173886 -
gtagtgtcttattgtggttt

SEQ ID NO: 54655 - DNA, 20 bp, Artificial Sequence
  Synthetic oligonucleotide; TAG chr11 5173838 5173857 5173841 -
tcatttgtatatcttctttc

SEQ ID NO: 54656 - DNA, 20 bp, Artificial Sequence
  Synthetic oligonucleotide; GAG chr11 5173798 5173817 5173801 -
catttgcatatttttaaatt

SEQ ID NO: 54657 - DNA, 20 bp, Artificial Sequence
  Synthetic oligonucleotide; GAG chr11 5173775 5173794 5173778 -
ttgtttgtctttttgttttt

SEQ ID NO: 54658 - DNA, 20 bp, Artificial Sequence
  Synthetic oligonucleotide; TAG chr11 5173769 5173788 5173772 -
gtctttttgtttttgagttg

SEQ ID NO: 54659 - DNA, 20 bp, Artificial Sequence
  Synthetic oligonucleotide; AGG chr11 5173768 5173787 5173771 -
tctttttgtttttgagttgt

SEQ ID NO: 54660 - DNA, 20 bp, Artificial Sequence
  Synthetic oligonucleotide; TGG chr11 5173749 5173768 5173752 -
taggactttttcatacattc

SEQ ID NO: 54661 - DNA, 20 bp, Artificial Sequence
  Synthetic oligonucleotide; AAG chr11 5173716 5173735 5173719 -
tatgaaatacataatttgca

SEQ ID NO: 54662 - DNA, 20 bp, Artificial Sequence
  Synthetic oligonucleotide; TAG chr11 5173697 5173716 5173700 -
aaagatgttctctcatctta

SEQ ID NO: 54663 - DNA, 20 bp, Artificial Sequence
  Synthetic oligonucleotide; AGG chr11 5173696 5173715 5173699 -
aagatgttctctcatcttat

SEQ ID NO: 54664 - DNA, 20 bp, Artificial Sequence
  Synthetic oligonucleotide; AAG chr11 5173674 5173693 5173677 -
gttgtctttttactttctta

SEQ ID NO: 54665 - DNA, 20 bp, Artificial Sequence
  Synthetic oligonucleotide; AAG chr11 5173591 5173610 5173594 -
atactttttgtgtcatatct

SEQ ID NO: 54666 - DNA, 20 bp, Artificial Sequence
  Synthetic oligonucleotide; AAG chr11 5173571 5173590 5173574 -
aagaatctattgtaaaatca

SEQ ID NO: 54667 - DNA, 20 bp, Artificial Sequence
  Synthetic oligonucleotide; AAG chr11 5173562 5173581 5173565 -
ttgtaaaatcaaagttcatg

SEQ ID NO: 54668 - DNA, 20 bp, Artificial Sequence
  Synthetic oligonucleotide; GAG chr11 5173539 5173558 5173542 -
atttacccatgcttccttcc

SEQ ID NO: 54669 - DNA, 20 bp, Artificial Sequence
  Synthetic oligonucleotide; AGG chr11 5173538 5173557 5173541 -
tttacccatgcttccttccg

SEQ ID NO: 54670 - DNA, 20 bp, Artificial Sequence
  Synthetic oligonucleotide; GGG chr11 5173537 5173556 5173540 -
ttacccatgcttccttccga

SEQ ID NO: 54671 - DNA, 20 bp, Artificial Sequence
  Synthetic oligonucleotide; TGG chr11 5173529 5173548 5173532 -
gcttccttccgagggtgtta

SEQ ID NO: 54672 - DNA, 20 bp, Artificial Sequence
  Synthetic oligonucleotide; TAG chr11 5173523 5173542 5173526 -
ttccgagggtgttatggctt

SEQ ID NO: 54673 - DNA, 20 bp, Artificial Sequence
  Synthetic oligonucleotide; TAG chr11 5173513 5173532 5173516 -
gttatggctttagttcaatt

SEQ ID NO: 54674 - DNA, 20 bp, Artificial Sequence
  Synthetic oligonucleotide; AGG chr11 5173512 5173531 5173515 -
ttatggctttagttcaattt

SEQ ID NO: 54675 - DNA, 20 bp, Artificial Sequence
  Synthetic oligonucleotide; TGG chr11 5173485 5173504 5173488 -
tacacaatttttatgcatgc

SEQ ID NO: 54676 - DNA, 20 bp, Artificial Sequence
  Synthetic oligonucleotide; AAG chr11 5173464 5173483 5173467 -
ggcttttaatccttatttga

SEQ ID NO: 54677 - DNA, 20 bp, Artificial Sequence
  Synthetic oligonucleotide; AAG chr11 5173455 5173474 5173458 -
tccttatttgaaagaataca

SEQ ID NO: 54678 - DNA, 20 bp, Artificial Sequence
  Synthetic oligonucleotide; TAG chr11 5173451 5173470 5173454 -
tatttgaaagaatacaaagt

SEQ ID NO: 54679 - DNA, 20 bp, Artificial Sequence
  Synthetic oligonucleotide; TAG chr11 5173432 5173451 5173435 -
ttagcatgacaacaaaaata

SEQ ID NO: 54680 - DNA, 20 bp, Artificial Sequence
  Synthetic oligonucleotide; AAG chr11 5173411 5173430 5173414 -
agcttgaccaattgaatatg

SEQ ID NO: 54681 - DNA, 20 bp, Artificial Sequence
  Synthetic oligonucleotide; CAG chr11 5173395 5173414 5173398 -
tatgaagttgtatataaaaa

SEQ ID NO: 54682 - DNA, 20 bp, Artificial Sequence
  Synthetic oligonucleotide; AAG chr11 5173389 5173408 5173392 -
gttgtatataaaaacagaat

SEQ ID NO: 54683 - DNA, 20 bp, Artificial Sequence
  Synthetic oligonucleotide; CGG chr11 5173384 5173403 5173387 -
atataaaaacagaataagaa

SEQ ID NO: 54684 - DNA, 20 bp, Artificial Sequence
  Synthetic oligonucleotide; CAG chr11 5173381 5173400 5173384 -
taaaaacagaataagaacgg

SEQ ID NO: 54685 - DNA, 20 bp, Artificial Sequence
  Synthetic oligonucleotide; TGG chr11 5173368 5173387 5173371 -
agaacggcagtatgtgcatg

SEQ ID NO: 54686 - DNA, 20 bp, Artificial Sequence
  Synthetic oligonucleotide; AAG chr11 5173361 5173380 5173364 -
cagtatgtgcatgtggcaaa

SEQ ID NO: 54687 - DNA, 20 bp, Artificial Sequence
  Synthetic oligonucleotide; AGG chr11 5173360 5173379 5173363 -
agtatgtgcatgtggcaaaa

SEQ ID NO: 54688 - DNA, 20 bp, Artificial Sequence
  Synthetic oligonucleotide; CAG chr11 5173354 5173373 5173357 -
tgcatgtggcaaaaaggaca

SEQ ID NO: 54689 - DNA, 20 bp, Artificial Sequence
  Synthetic oligonucleotide; CAG chr11 5173342 5173361 5173345 -
aaaggacacagatcaaacaa

SEQ ID NO: 54690 - DNA, 20 bp, Artificial Sequence
  Synthetic oligonucleotide; CAG chr11 5173335 5173354 5173338 -
acagatcaaacaacagaaaa

SEQ ID NO: 54691 - DNA, 20 bp, Artificial Sequence
  Synthetic oligonucleotide; TAG chr11 5173330 5173349 5173333 -
tcaaacaacagaaaacagtc

SEQ ID NO: 54692 - DNA, 20 bp, Artificial Sequence
  Synthetic oligonucleotide; TAG chr11 5173324 5173343 5173327 -
aacagaaaacagtctagaat

SEQ ID NO: 54693 - DNA, 20 bp, Artificial Sequence
  Synthetic oligonucleotide; TGG chr11 5173267 5173286 5173270 -
atgtaatccctcatcatgct

SEQ ID NO: 54694 - DNA, 20 bp, Artificial Sequence
  Synthetic oligonucleotide; GAG chr11 5173265 5173284 5173268 -
gtaatccctcatcatgcttg

SEQ ID NO: 54695 - DNA, 20 bp, Artificial Sequence
  Synthetic oligonucleotide; TGG chr11 5173241 5173260 5173244 -
ccaacccttgatcttatact

SEQ ID NO: 54696 - DNA, 20 bp, Artificial Sequence
  Synthetic oligonucleotide; TAG chr11 5173235 5173254 5173238 -
cttgatcttatacttggtat

SEQ ID NO: 54697 - DNA, 20 bp, Artificial Sequence
  Synthetic oligonucleotide; GAG chr11 5173213 5173232 5173216 -
gaaaaattgtttatatgttt

SEQ ID NO: 54698 - DNA, 20 bp, Artificial Sequence
  Synthetic oligonucleotide; AAG chr11 5173203 5173222 5173206 -
ttatatgtttgagaatactt

SEQ ID NO: 54699 - DNA, 20 bp, Artificial Sequence
  Synthetic oligonucleotide; AAG chr11 5173183 5173202 5173186 -
aagtaaaattctaattaccc

SEQ ID NO: 54700 - DNA, 20 bp, Artificial Sequence
  Synthetic oligonucleotide; CAG chr11 5173164 5173183 5173167 -
caagtcccccaaacaaattt

SEQ ID NO: 54701 - DNA, 20 bp, Artificial Sequence
  Synthetic oligonucleotide; AGG chr11 5173163 5173182 5173166 -
aagtcccccaaacaaatttc

SEQ ID NO: 54702 - DNA, 20 bp, Artificial Sequence
  Synthetic oligonucleotide; TGG chr11 5173160 5173179 5173163 -
tcccccaaacaaatttcagg

SEQ ID NO: 54703 - DNA, 20 bp, Artificial Sequence
  Synthetic oligonucleotide; AAG chr11 5173153 5173172 5173156 -
aacaaatttcaggtggaatc

SEQ ID NO: 54704 - DNA, 20 bp, Artificial Sequence
  Synthetic oligonucleotide; CAG chr11 5173064 5173083 5173067 -
tacaccactatccctatctg

SEQ ID NO: 54705 - DNA, 20 bp, Artificial Sequence
  Synthetic oligonucleotide; TAG chr11 5173052 5173071 5173055 -
cctatctgcagttccgtctc

SEQ ID NO: 54706 - DNA, 20 bp, Artificial Sequence
  Synthetic oligonucleotide; TAG chr11 5173046 5173065 5173049 -
tgcagttccgtctctagctc

SEQ ID NO: 54707 - DNA, 20 bp, Artificial Sequence
  Synthetic oligonucleotide; TGG chr11 5173006 5173025 5173009 -
tccactttttactttgtata

SEQ ID NO: 54708 - DNA, 20 bp, Artificial Sequence
  Synthetic oligonucleotide; TAG chr11 5173001 5173020 5173004 -
tttttactttgtatatggaa

SEQ ID NO: 54709 - DNA, 20 bp, Artificial Sequence
  Synthetic oligonucleotide; AAG chr11 5172992 5173011 5172995 -
tgtatatggaatagcttctt

SEQ ID NO: 54710 - DNA, 20 bp, Artificial Sequence
  Synthetic oligonucleotide; AAG chr11 5172983 5173002 5172986 -
aatagcttcttaagaatgaa

SEQ ID NO: 54711 - DNA, 20 bp, Artificial Sequence
  Synthetic oligonucleotide; AAG chr11 5172939 5172958 5172942 -
atgttaacctgactacataa

SEQ ID NO: 54712 - DNA, 20 bp, Artificial Sequence
  Synthetic oligonucleotide; AAG chr11 5172903 5172922 5172906 -
tgtgtatgaaaaaattaatg

SEQ ID NO: 54713 - DNA, 20 bp, Artificial Sequence
  Synthetic oligonucleotide; AAG chr11 5172898 5172917 5172901 -
atgaaaaaattaatgaagat

SEQ ID NO: 54714 - DNA, 20 bp, Artificial Sequence
  Synthetic oligonucleotide; CGG chr11 5172892 5172911 5172895 -
aaattaatgaagataagatg

SEQ ID NO: 54715 - DNA, 20 bp, Artificial Sequence
  Synthetic oligonucleotide; GGG chr11 5172891 5172910 5172894 -
aattaatgaagataagatgc

SEQ ID NO: 54716 - DNA, 20 bp, Artificial Sequence
  Synthetic oligonucleotide; GGG chr11 5172890 5172909 5172893 -
attaatgaagataagatgcg

SEQ ID NO: 54717 - DNA, 20 bp, Artificial Sequence
  Synthetic oligonucleotide; GGG chr11 5172889 5172908 5172892 -
ttaatgaagataagatgcgg

SEQ ID NO: 54718 - DNA, 20 bp, Artificial Sequence
  Synthetic oligonucleotide; AAG chr11 5172886 5172905 5172889 -
atgaagataagatgcggggg

SEQ ID NO: 54719 - DNA, 20 bp, Artificial Sequence
  Synthetic oligonucleotide; AAG chr11 5172878 5172897 5172881 -
aagatgcgggggaagtatat

SEQ ID NO: 54720 - DNA, 20 bp, Artificial Sequence
  Synthetic oligonucleotide; TGG chr11 5172808 5172827 5172811 -
gtaactattttatgtttatt

SEQ ID NO: 54721 - DNA, 20 bp, Artificial Sequence
  Synthetic oligonucleotide; GGG chr11 5172807 5172826 5172810 -
taactattttatgtttattt

SEQ ID NO: 54722 - DNA, 20 bp, Artificial Sequence
  Synthetic oligonucleotide; TGG chr11 5172790 5172809 5172793 -
tttgggttttgcattgacat

SEQ ID NO: 54723 - DNA, 20 bp, Artificial Sequence
  Synthetic oligonucleotide; CAG chr11 5172764 5172783 5172767 -
gttcttatgtatactctctc

SEQ ID NO: 54724 - DNA, 20 bp, Artificial Sequence
  Synthetic oligonucleotide; CAG chr11 5172752 5172771 5172755 -
actctctccagcatgcttct

SEQ ID NO: 54725 - DNA, 20 bp, Artificial Sequence
  Synthetic oligonucleotide; AGG chr11 5172751 5172770 5172754 -
ctctctccagcatgcttctc

SEQ ID NO: 54726 - DNA, 20 bp, Artificial Sequence
  Synthetic oligonucleotide; AAG chr11 5172716 5172735 5172719 -
ctttctctctaatacacccg

SEQ ID NO: 54727 - DNA, 20 bp, Artificial Sequence
  Synthetic oligonucleotide; TGG chr11 5172709 5172728 5172712 -
tctaatacacccgaagtttc

SEQ ID NO: 54728 - DNA, 20 bp, Artificial Sequence
  Synthetic oligonucleotide; GGG chr11 5172708 5172727 5172711 -
ctaatacacccgaagtttct

SEQ ID NO: 54729 - DNA, 20 bp, Artificial Sequence
  Synthetic oligonucleotide; TGG chr11 5172693 5172712 5172696 -
tttctgggaataattattct

SEQ ID NO: 54730 - DNA, 20 bp, Artificial Sequence
  Synthetic oligonucleotide; GAG chr11 5172677 5172696 5172680 -
ttcttggttaattgcttctt

SEQ ID NO: 54731 - DNA, 20 bp, Artificial Sequence
  Synthetic oligonucleotide; AGG chr11 5172676 5172695 5172679 -
tcttggttaattgcttcttg

SEQ ID NO: 54732 - DNA, 20 bp, Artificial Sequence
  Synthetic oligonucleotide; GGG chr11 5172675 5172694 5172678 -
cttggttaattgcttcttga

SEQ ID NO: 54733 - DNA, 20 bp, Artificial Sequence
  Synthetic oligonucleotide; CAG chr11 5172643 5172662 5172646 -
cattctgtctctatgtcctc

SEQ ID NO: 54734 - DNA, 20 bp, Artificial Sequence
  Synthetic oligonucleotide; AAG chr11 5172634 5172653 5172637 -
tctatgtcctccagtcaact

SEQ ID NO: 54735 - DNA, 20 bp, Artificial Sequence
  Synthetic oligonucleotide; CAG chr11 5172623 5172642 5172626 -
cagtcaactaagcacatata

SEQ ID NO: 54736 - DNA, 20 bp, Artificial Sequence
  Synthetic oligonucleotide; AGG chr11 5172622 5172641 5172625 -
agtcaactaagcacatatac

SEQ ID NO: 54737 - DNA, 20 bp, Artificial Sequence
  Synthetic oligonucleotide; GGG chr11 5172621 5172640 5172624 -
gtcaactaagcacatataca

SEQ ID NO: 54738 - DNA, 20 bp, Artificial Sequence
  Synthetic oligonucleotide; GAG chr11 5172619 5172638 5172622 -
caactaagcacatatacagg

SEQ ID NO: 54739 - DNA, 20 bp, Artificial Sequence
  Synthetic oligonucleotide; AGG chr11 5172618 5172637 5172621 -
aactaagcacatatacaggg

SEQ ID NO: 54740 - DNA, 20 bp, Artificial Sequence
  Synthetic oligonucleotide; TAG chr11 5172615 5172634 5172618 -
taagcacatatacagggagg

SEQ ID NO: 54741 - DNA, 20 bp, Artificial Sequence
  Synthetic oligonucleotide; CAG chr11 5172600 5172619 5172603 -
ggaggtagtaactatgtcca

SEQ ID NO: 54742 - DNA, 20 bp, Artificial Sequence
  Synthetic oligonucleotide; CAG chr11 5172595 5172614 5172598 -
tagtaactatgtccacagcc

SEQ ID NO: 54743 - DNA, 20 bp, Artificial Sequence
  Synthetic oligonucleotide; AAG chr11 5172588 5172607 5172591 -
tatgtccacagcccagttga

SEQ ID NO: 54744 - DNA, 20 bp, Artificial Sequence
  Synthetic oligonucleotide; CAG chr11 5172581 5172600 5172584 -
acagcccagttgaaagtaaa

SEQ ID NO: 54745 - DNA, 20 bp, Artificial Sequence
  Synthetic oligonucleotide; TAG chr11 5172571 5172590 5172574 -
tgaaagtaaacagtaacaaa

SEQ ID NO: 54746 - DNA, 20 bp, Artificial Sequence
  Synthetic oligonucleotide; TGG chr11 5172562 5172581 5172565 -
acagtaacaaatagtatgca

SEQ ID NO: 54747 - DNA, 20 bp, Artificial Sequence
  Synthetic oligonucleotide; TGG chr11 5172552 5172571 5172555 -
atagtatgcatggattgatg

SEQ ID NO: 54748 - DNA, 20 bp, Artificial Sequence
  Synthetic oligonucleotide; TAG chr11 5172549 5172568 5172552 -
gtatgcatggattgatgtgg

SEQ ID NO: 54749 - DNA, 20 bp, Artificial Sequence
  Synthetic oligonucleotide; CAG chr11 5172542 5172561 5172545 -
tggattgatgtggtagctct

SEQ ID NO: 54750 - DNA, 20 bp, Artificial Sequence
  Synthetic oligonucleotide; TAG chr11 5172532 5172551 5172535 -
tggtagctctcagttccacc

SEQ ID NO: 54751 - DNA, 20 bp, Artificial Sequence
  Synthetic oligonucleotide; AGG chr11 5172531 5172550 5172534 -
ggtagctctcagttccacct

SEQ ID NO: 54752 - DNA, 20 bp, Artificial Sequence
  Synthetic oligonucleotide; AAG chr11 5172527 5172546 5172530 -
gctctcagttccacctaggt

SEQ ID NO: 54753 - DNA, 20 bp, Artificial Sequence
  Synthetic oligonucleotide; GAG chr11 5172519 5172538 5172522 -
ttccacctaggtaagtatct

SEQ ID NO: 54754 - DNA, 20 bp, Artificial Sequence
  Synthetic oligonucleotide; AGG chr11 5172518 5172537 5172521 -
tccacctaggtaagtatctg

SEQ ID NO: 54755 - DNA, 20 bp, Artificial Sequence
  Synthetic oligonucleotide; TAG chr11 5172513 5172532 5172516 -
ctaggtaagtatctgaggtc

SEQ ID NO: 54756 - DNA, 20 bp, Artificial Sequence
  Synthetic oligonucleotide; AGG chr11 5172512 5172531 5172515 -
taggtaagtatctgaggtct

SEQ ID NO: 54757 - DNA, 20 bp, Artificial Sequence
  Synthetic oligonucleotide; TAG chr11 5172501 5172520 5172504 -
ctgaggtctaggatcaacta

SEQ ID NO: 54758 - DNA, 20 bp, Artificial Sequence
  Synthetic oligonucleotide; TGG chr11 5172488 5172507 5172491 -
tcaactatagttatgcctaa

SEQ ID NO: 54759 - DNA, 20 bp, Artificial Sequence
  Synthetic oligonucleotide; TGG chr11 5172475 5172494 5172478 -
tgcctaatggtataatgtgc

SEQ ID NO: 54760 - DNA, 20 bp, Artificial Sequence
  Synthetic oligonucleotide; CAG chr11 5172465 5172484 5172468 -
tataatgtgctggcttgcac

SEQ ID NO: 54761 - DNA, 20 bp, Artificial Sequence
  Synthetic oligonucleotide; TAG chr11 5172460 5172479 5172463 -
tgtgctggcttgcaccagct

SEQ ID NO: 54762 - DNA, 20 bp, Artificial Sequence
  Synthetic oligonucleotide; AGG chr11 5172459 5172478 5172462 -
gtgctggcttgcaccagctt

SEQ ID NO: 54763 - DNA, 20 bp, Artificial Sequence
  Synthetic oligonucleotide; AAG chr11 5172455 5172474 5172458 -
tggcttgcaccagcttagga

SEQ ID NO: 54764 - DNA, 20 bp, Artificial Sequence
  Synthetic oligonucleotide; CAG chr11 5172436 5172455 5172439 -
aaagctgattatgctcatct

SEQ ID NO: 54765 - DNA, 20 bp, Artificial Sequence
  Synthetic oligonucleotide; TAG chr11 5172421 5172440 5172424 -
catctcagctctgcatttaa

SEQ ID NO: 54766 - DNA, 20 bp, Artificial Sequence
  Synthetic oligonucleotide; TGG chr11 5172410 5172429 5172413 -
tgcatttaatagcatctctt

SEQ ID NO: 54767 - DNA, 20 bp, Artificial Sequence
  Synthetic oligonucleotide; TAG chr11 5172407 5172426 5172410 -
atttaatagcatctctttgg

SEQ ID NO: 54768 - DNA, 20 bp, Artificial Sequence
  Synthetic oligonucleotide; TGG chr11 5172390 5172409 5172393 -
tggtagtctgaaattgatca

SEQ ID NO: 54769 - DNA, 20 bp, Artificial Sequence
  Synthetic oligonucleotide; TAG chr11 5172387 5172406 5172390 -
tagtctgaaattgatcatgg

SEQ ID NO: 54770 - DNA, 20 bp, Artificial Sequence
  Synthetic oligonucleotide; AGG chr11 5172386 5172405 5172389 -
agtctgaaattgatcatggt

SEQ ID NO: 54771 - DNA, 20 bp, Artificial Sequence
  Synthetic oligonucleotide; GAG chr11 5172384 5172403 5172387 -
tctgaaattgatcatggtag

SEQ ID NO: 54772 - DNA, 20 bp, Artificial Sequence
  Synthetic oligonucleotide; CGG chr11 5172362 5172381 5172365 -
gtcattaaaacacaaaaaat

SEQ ID NO: 54773 - DNA, 20 bp, Artificial Sequence
  Synthetic oligonucleotide; TGG chr11 5172355 5172374 5172358 -
aaacacaaaaaatcggtaac

SEQ ID NO: 54774 - DNA, 20 bp, Artificial Sequence
  Synthetic oligonucleotide; CAG chr11 5172345 5172364 5172348 -
aatcggtaactggtaaaaat

SEQ ID NO: 54775 - DNA, 20 bp, Artificial Sequence
  Synthetic oligonucleotide; AGG chr11 5172344 5172363 5172347 -
atcggtaactggtaaaaatc

SEQ ID NO: 54776 - DNA, 20 bp, Artificial Sequence
  Synthetic oligonucleotide; GGG chr11 5172343 5172362 5172346 -
tcggtaactggtaaaaatca

SEQ ID NO: 54777 - DNA, 20 bp, Artificial Sequence
  Synthetic oligonucleotide; TGG chr11 5172330 5172349 5172333 -
aaaatcagggcatttttatt

SEQ ID NO: 54778 - DNA, 20 bp, Artificial Sequence
  Synthetic oligonucleotide; AAG chr11 5172291 5172310 5172294 -
cccactgattatgcctaacg

SEQ ID NO: 54779 - DNA, 20 bp, Artificial Sequence
  Synthetic oligonucleotide; GAG chr11 5172289 5172308 5172292 -
cactgattatgcctaacgaa

SEQ ID NO: 54780 - DNA, 20 bp, Artificial Sequence
  Synthetic oligonucleotide; TGG chr11 5172283 5172302 5172286 -
ttatgcctaacgaagagccc

SEQ ID NO: 54781 - DNA, 20 bp, Artificial Sequence
  Synthetic oligonucleotide; CGG chr11 5172273 5172292 5172276 -
cgaagagccctggcccaaca

SEQ ID NO: 54782 - DNA, 20 bp, Artificial Sequence
  Synthetic oligonucleotide; GGG chr11 5172272 5172291 5172275 -
gaagagccctggcccaacac

SEQ ID NO: 54783 - DNA, 20 bp, Artificial Sequence
  Synthetic oligonucleotide; AAG chr11 5172269 5172288 5172272 -
gagccctggcccaacacggg

SEQ ID NO: 54784 - DNA, 20 bp, Artificial Sequence
  Synthetic oligonucleotide; AAG chr11 5172266 5172285 5172269 -
ccctggcccaacacgggaag

SEQ ID NO: 54785 - DNA, 20 bp, Artificial Sequence
  Synthetic oligonucleotide; GAG chr11 5172264 5172283 5172267 -
ctggcccaacacgggaagaa

SEQ ID NO: 54786 - DNA, 20 bp, Artificial Sequence
  Synthetic oligonucleotide; CAG chr11 5172259 5172278 5172262 -
ccaacacgggaagaagagtt

SEQ ID NO: 54787 - DNA, 20 bp, Artificial Sequence
  Synthetic oligonucleotide; TGG chr11 5172253 5172272 5172256 -
cgggaagaagagttcagcct

SEQ ID NO: 54788 - DNA, 20 bp, Artificial Sequence
  Synthetic oligonucleotide; GAG chr11 5172234 5172253 5172237 -
ttggtcacattcttatttct

SEQ ID NO: 54789 - DNA, 20 bp, Artificial Sequence
  Synthetic oligonucleotide; TGG chr11 5172210 5172229 5172213 -
cccatcctgaattccatttc

SEQ ID NO: 54790 - DNA, 20 bp, Artificial Sequence
  Synthetic oligonucleotide; AAG chr11 5172189 5172208 5172192 -
ggcctccaacgttaatacct

SEQ ID NO: 54791 - DNA, 20 bp, Artificial Sequence
  Synthetic oligonucleotide; AGG chr11 5172188 5172207 5172191 -
gcctccaacgttaataccta

SEQ ID NO: 54792 - DNA, 20 bp, Artificial Sequence
  Synthetic oligonucleotide; CAG chr11 5172177 5172196 5172180 -
taatacctaaggctctgctg

SEQ ID NO: 54793 - DNA, 20 bp, Artificial Sequence
  Synthetic oligonucleotide; AAG chr11 5172172 5172191 5172175 -
cctaaggctctgctgcagat

SEQ ID NO: 54794 - DNA, 20 bp, Artificial Sequence
  Synthetic oligonucleotide; TGG chr11 5172169 5172188 5172172 -
aaggctctgctgcagataag

SEQ ID NO: 54795 - DNA, 20 bp, Artificial Sequence
  Synthetic oligonucleotide; TAG chr11 5172161 5172180 5172164 -
gctgcagataagtggaactt

SEQ ID NO: 54796 - DNA, 20 bp, Artificial Sequence
  Synthetic oligonucleotide; CAG chr11 5172140 5172159 5172143 -
agtgttaataaacttgttcc

SEQ ID NO: 54797 - DNA, 20 bp, Artificial Sequence
  Synthetic oligonucleotide; AAG chr11 5172125 5172144 5172128 -
gttcccagataaatatctct

SEQ ID NO: 54798 - DNA, 20 bp, Artificial Sequence
  Synthetic oligonucleotide; TAG chr11 5172113 5172132 5172116 -
atatctctaagcctgtaccc

SEQ ID NO: 54799 - DNA, 20 bp, Artificial Sequence
  Synthetic oligonucleotide; GAG chr11 5172087 5172106 5172090 -
caccatcacatgtgacttgt

SEQ ID NO: 54800 - DNA, 20 bp, Artificial Sequence
  Synthetic oligonucleotide; CGG chr11 5172053 5172072 5172056 -
tctgatcttgctccctgacc

SEQ ID NO: 54801 - DNA, 20 bp, Artificial Sequence
  Synthetic oligonucleotide; CAG chr11 5172047 5172066 5172050 -
cttgctccctgacccggttc

SEQ ID NO: 54802 - DNA, 20 bp, Artificial Sequence
  Synthetic oligonucleotide; CAG chr11 5172044 5172063 5172047 -
gctccctgacccggttccag

SEQ ID NO: 54803 - DNA, 20 bp, Artificial Sequence
  Synthetic oligonucleotide; AAG chr11 5172041 5172060 5172044 -
ccctgacccggttccagcag

SEQ ID NO: 54804 - DNA, 20 bp, Artificial Sequence
  Synthetic oligonucleotide; CAG chr11 5172018 5172037 5172021 -
actgacccttctgcaaaata

SEQ ID NO: 54805 - DNA, 20 bp, Artificial Sequence
  Synthetic oligonucleotide; GAG chr11 5172016 5172035 5172019 -
tgacccttctgcaaaataca

SEQ ID NO: 54806 - DNA, 20 bp, Artificial Sequence
  Synthetic oligonucleotide; AGG chr11 5172015 5172034 5172018 -
gacccttctgcaaaatacag

SEQ ID NO: 54807 - DNA, 20 bp, Artificial Sequence
  Synthetic oligonucleotide; GAG chr11 5172013 5172032 5172016 -
cccttctgcaaaatacagag

SEQ ID NO: 54808 - DNA, 20 bp, Artificial Sequence
  Synthetic oligonucleotide; TGG chr11 5171997 5172016 5172000 -
agaggagcttttctaatcta

SEQ ID NO: 54809 - DNA, 20 bp, Artificial Sequence
  Synthetic oligonucleotide; TAG chr11 5171993 5172012 5171996 -
gagcttttctaatctatgga

SEQ ID NO: 54810 - DNA, 20 bp, Artificial Sequence
  Synthetic oligonucleotide; CAG chr11 5171990 5172009 5171993 -
cttttctaatctatggatag

SEQ ID NO: 54811 - DNA, 20 bp, Artificial Sequence
  Synthetic oligonucleotide; AGG chr11 5171989 5172008 5171992 -
ttttctaatctatggatagc

SEQ ID NO: 54812 - DNA, 20 bp, Artificial Sequence
  Synthetic oligonucleotide; TGG chr11 5171986 5172005 5171989 -
tctaatctatggatagcagg

SEQ ID NO: 54813 - DNA, 20 bp, Artificial Sequence
  Synthetic oligonucleotide; GAG chr11 5171984 5172003 5171987 -
taatctatggatagcaggtg

SEQ ID NO: 54814 - DNA, 20 bp, Artificial Sequence
  Synthetic oligonucleotide; AAG chr11 5171980 5171999 5171983 -
ctatggatagcaggtggaga

SEQ ID NO: 54815 - DNA, 20 bp, Artificial Sequence
  Synthetic oligonucleotide; GAG chr11 5171978 5171997 5171981 -
atggatagcaggtggagaaa

SEQ ID NO: 54816 - DNA, 20 bp, Artificial Sequence
  Synthetic oligonucleotide; TGG chr11 5171970 5171989 5171973 -
caggtggagaaagagtgaac

SEQ ID NO: 54817 - DNA, 20 bp, Artificial Sequence
  Synthetic oligonucleotide; AAG chr11 5171966 5171985 5171969 -
tggagaaagagtgaactggt

SEQ ID NO: 54818 - DNA, 20 bp, Artificial Sequence
  Synthetic oligonucleotide; AAG chr11 5171960 5171979 5171963 -
aagagtgaactggtaagtta

SEQ ID NO: 54819 - DNA, 20 bp, Artificial Sequence
  Synthetic oligonucleotide; TGG chr11 5171950 5171969 5171953 -
tggtaagttaaagaaaaaaa

SEQ ID NO: 54820 - DNA, 20 bp, Artificial Sequence
  Synthetic oligonucleotide; TAG chr11 5171933 5171952 5171936 -
aaatggaaaatactttattc

SEQ ID NO: 54821 - DNA, 20 bp, Artificial Sequence
  Synthetic oligonucleotide; AGG chr11 5171932 5171951 5171935 -
aatggaaaatactttattct

SEQ ID NO: 54822 - DNA, 20 bp, Artificial Sequence
  Synthetic oligonucleotide; GAG chr11 5171930 5171949 5171933 -
tggaaaatactttattctag

SEQ ID NO: 54823 - DNA, 20 bp, Artificial Sequence
  Synthetic oligonucleotide; TAG chr11 5171801 5171820 5171804 -
aaatactattattgtcttta

SEQ ID NO: 54824 - DNA, 20 bp, Artificial Sequence
  Synthetic oligonucleotide; TGG chr11 5171790 5171809 5171793 -
ttgtctttatagcaaatatc

SEQ ID NO: 54825 - DNA, 20 bp, Artificial Sequence
  Synthetic oligonucleotide; GGG chr11 5171789 5171808 5171792 -
tgtctttatagcaaatatct

SEQ ID NO: 54826 - DNA, 20 bp, Artificial Sequence
  Synthetic oligonucleotide; CAG chr11 5171783 5171802 5171786 -
tatagcaaatatctgggtct

SEQ ID NO: 54827 - DNA, 20 bp, Artificial Sequence
  Synthetic oligonucleotide; AAG chr11 5171744 5171763 5171747 -
atcaactttaatataatccc

SEQ ID NO: 54828 - DNA, 20 bp, Artificial Sequence
  Synthetic oligonucleotide; TAG chr11 5171721 5171740 5171724 -
attacacgtcaattaaatgt

SEQ ID NO: 54829 - DNA, 20 bp, Artificial Sequence
  Synthetic oligonucleotide; TAG chr11 5171699 5171718 5171702 -
gaaccatcaatactctttat

SEQ ID NO: 54830 - DNA, 20 bp, Artificial Sequence
  Synthetic oligonucleotide; TAG chr11 5171683 5171702 5171686 -
ttattagtgttatattactt

SEQ ID NO: 54831 - DNA, 20 bp, Artificial Sequence
  Synthetic oligonucleotide; AAG chr11 5171650 5171669 5171653 -
actctctttataaacactac

SEQ ID NO: 54832 - DNA, 20 bp, Artificial Sequence
  Synthetic oligonucleotide; TAG chr11 5171646 5171665 5171649 -
tctttataaacactacaagt

SEQ ID NO: 54833 - DNA, 20 bp, Artificial Sequence
  Synthetic oligonucleotide; CAG chr11 5171643 5171662 5171646 -
ttataaacactacaagttag

SEQ ID NO: 54834 - DNA, 20 bp, Artificial Sequence
  Synthetic oligonucleotide; CAG chr11 5171634 5171653 5171637 -
ctacaagttagcagtttctt

SEQ ID NO: 54835 - DNA, 20 bp, Artificial Sequence
  Synthetic oligonucleotide; TAG chr11 5171572 5171591 5171575 -
ttaactgtttttcactgcca

SEQ ID NO: 54836 - DNA, 20 bp, Artificial Sequence
  Synthetic oligonucleotide; GAG chr11 5171557 5171576 5171560 -
tgccatagatgacccaactt

SEQ ID NO: 54837 - DNA, 20 bp, Artificial Sequence
  Synthetic oligonucleotide; TGG chr11 5171534 5171553 5171537 -
atttctattaatgccttatc

SEQ ID NO: 54838 - DNA, 20 bp, Artificial Sequence
  Synthetic oligonucleotide; TAG chr11 5171527 5171546 5171530 -
ttaatgccttatctggcata

SEQ ID NO: 54839 - DNA, 20 bp, Artificial Sequence
  Synthetic oligonucleotide; AGG chr11 5171526 5171545 5171529 -
taatgccttatctggcatat

SEQ ID NO: 54840 - DNA, 20 bp, Artificial Sequence
  Synthetic oligonucleotide; TGG chr11 5171517 5171536 5171520 -
atctggcatataggctatgt

SEQ ID NO: 54841 - DNA, 20 bp, Artificial Sequence
  Synthetic oligonucleotide; TAG chr11 5171492 5171511 5171495 -
tacttttctgcatgacccat

SEQ ID NO: 54842 - DNA, 20 bp, Artificial Sequence
  Synthetic oligonucleotide; AGG chr11 5171491 5171510 5171494 -
acttttctgcatgacccatt

SEQ ID NO: 54843 - DNA, 20 bp, Artificial Sequence
  Synthetic oligonucleotide; TGG chr11 5171470 5171489 5171473 -
ggtttctcttccactcactg

SEQ ID NO: 54844 - DNA, 20 bp, Artificial Sequence
  Synthetic oligonucleotide; CAG chr11 5171448 5171467 5171451 -
gcttacctgtgcccttgttt

SEQ ID NO: 54845 - DNA, 20 bp, Artificial Sequence
  Synthetic oligonucleotide; GAG chr11 5171420 5171439 5171423 -
aattttttatccctttttct

SEQ ID NO: 54846 - DNA, 20 bp, Artificial Sequence
  Synthetic oligonucleotide; AGG chr11 5171419 5171438 5171422 -
attttttatccctttttctg

SEQ ID NO: 54847 - DNA, 20 bp, Artificial Sequence
  Synthetic oligonucleotide; TAG chr11 5171408 5171427 5171411 -
ctttttctgaggaaatgtct

SEQ ID NO: 54848 - DNA, 20 bp, Artificial Sequence
  Synthetic oligonucleotide; TAG chr11 5171395 5171414 5171398 -
aatgtcttagatatgactgt

SEQ ID NO: 54849 - DNA, 20 bp, Artificial Sequence
  Synthetic oligonucleotide; CAG chr11 5171390 5171409 5171393 -
cttagatatgactgttagct

SEQ ID NO: 54850 - DNA, 20 bp, Artificial Sequence
  Synthetic oligonucleotide; GAG chr11 5171368 5171387 5171371 -
gaacttgatgtgcaataact

SEQ ID NO: 54851 - DNA, 20 bp, Artificial Sequence
  Synthetic oligonucleotide; TAG chr11 5171365 5171384 5171368 -
cttgatgtgcaataactgag

SEQ ID NO: 54852 - DNA, 20 bp, Artificial Sequence
  Synthetic oligonucleotide; CAG chr11 5171348 5171367 5171351 -
gagtagaaacttatatattc

SEQ ID NO: 54853 - DNA, 20 bp, Artificial Sequence
  Synthetic oligonucleotide; CAG chr11 5171321 5171340 5171324 -
catgtgcttctcaatatctt

SEQ ID NO: 54854 - DNA, 20 bp, Artificial Sequence
  Synthetic oligonucleotide; GAG chr11 5171319 5171338 5171322 -
tgtgcttctcaatatcttca

SEQ ID NO: 54855 - DNA, 20 bp, Artificial Sequence
  Synthetic oligonucleotide; AGG chr11 5171318 5171337 5171321 -
gtgcttctcaatatcttcag

SEQ ID NO: 54856 - DNA, 20 bp, Artificial Sequence
  Synthetic oligonucleotide; AAG chr11 5171315 5171334 5171318 -
cttctcaatatcttcagagg

SEQ ID NO: 54857 - DNA, 20 bp, Artificial Sequence
  Synthetic oligonucleotide; TGG chr11 5171253 5171272 5171256 -
cctacaacattcactctcgt

SEQ ID NO: 54858 - DNA, 20 bp, Artificial Sequence
  Synthetic oligonucleotide; CGG chr11 5171245 5171264 5171248 -
attcactctcgttggcatcc

SEQ ID NO: 54859 - DNA, 20 bp, Artificial Sequence
  Synthetic oligonucleotide; GGG chr11 5171244 5171263 5171247 -
ttcactctcgttggcatccc

SEQ ID NO: 54860 - DNA, 20 bp, Artificial Sequence
  Synthetic oligonucleotide; TGG chr11 5171239 5171258 5171242 -
tctcgttggcatcccgggac

SEQ ID NO: 54861 - DNA, 20 bp, Artificial Sequence
  Synthetic oligonucleotide; GAG chr11 5171237 5171256 5171240 -
tcgttggcatcccgggactg

SEQ ID NO: 54862 - DNA, 20 bp, Artificial Sequence
  Synthetic oligonucleotide; AGG chr11 5171236 5171255 5171239 -
cgttggcatcccgggactgg

SEQ ID NO: 54863 - DNA, 20 bp, Artificial Sequence
  Synthetic oligonucleotide; CAG chr11 5171233 5171252 5171236 -
tggcatcccgggactggagg

SEQ ID NO: 54864 - DNA, 20 bp, Artificial Sequence
  Synthetic oligonucleotide; TGG chr11 5171221 5171240 5171224 -
actggaggcagaacattatg

SEQ ID NO: 54865 - DNA, 20 bp, Artificial Sequence
  Synthetic oligonucleotide; CGG chr11 5171178 5171197 5171181 -
gatatacaccatcatctttc

SEQ ID NO: 54866 - DNA, 20 bp, Artificial Sequence
  Synthetic oligonucleotide; GGG chr11 5171177 5171196 5171180 -
atatacaccatcatctttcc

SEQ ID NO: 54867 - DNA, 20 bp, Artificial Sequence
  Synthetic oligonucleotide; TGG chr11 5171171 5171190 5171174 -
accatcatctttccgggaaa

SEQ ID NO: 54868 - DNA, 20 bp, Artificial Sequence
  Synthetic oligonucleotide; TGG chr11 5171109 5171128 5171112 -
ccaacccatgtactattttc

SEQ ID NO: 54869 - DNA, 20 bp, Artificial Sequence
  Synthetic oligonucleotide; CGG chr11 5171100 5171119 5171103 -
gtactattttctggccatgc

SEQ ID NO: 54870 - DNA, 20 bp, Artificial Sequence
  Synthetic oligonucleotide; TGG chr11 5171084 5171103 5171087 -
atgccggcctttgttgaact

SEQ ID NO: 54871 - DNA, 20 bp, Artificial Sequence
  Synthetic oligonucleotide; AAG chr11 5171051 5171070 5171054 -
tccaccatgcccactgtgtt

SEQ ID NO: 54872 - DNA, 20 bp, Artificial Sequence
  Synthetic oligonucleotide; TGG chr11 5171036 5171055 5171039 -
gtgttaagcatattcctctt

SEQ ID NO: 54873 - DNA, 20 bp, Artificial Sequence
  Synthetic oligonucleotide; CAG chr11 5171021 5171040 5171024 -
ctctttggcattaacgatgt

SEQ ID NO: 54874 - DNA, 20 bp, Artificial Sequence
  Synthetic oligonucleotide; TGG chr11 5171015 5171034 5171018 -
ggcattaacgatgtcagttt

SEQ ID NO: 54875 - DNA, 20 bp, Artificial Sequence
  Synthetic oligonucleotide; TGG chr11 5171012 5171031 5171015 -
attaacgatgtcagttttgg

SEQ ID NO: 54876 - DNA, 20 bp, Artificial Sequence
  Synthetic oligonucleotide; CAG chr11 5170999 5171018 5171002 -
gttttggtggttgcctgctc

SEQ ID NO: 54877 - DNA, 20 bp, Artificial Sequence
  Synthetic oligonucleotide; TGG chr11 5170968 5170987 5170971 -
tatgcactctttcactctta

SEQ ID NO: 54878 - DNA, 20 bp, Artificial Sequence
  Synthetic oligonucleotide; GAG chr11 5170966 5170985 5170969 -
tgcactctttcactcttatg

SEQ ID NO: 54879 - DNA, 20 bp, Artificial Sequence
  Synthetic oligonucleotide; CAG chr11 5170962 5170981 5170965 -
ctctttcactcttatggagt

SEQ ID NO: 54880 - DNA, 20 bp, Artificial Sequence
  Synthetic oligonucleotide; AGG chr11 5170961 5170980 5170964 -
tctttcactcttatggagtc

SEQ ID NO: 54881 - DNA, 20 bp, Artificial Sequence
  Synthetic oligonucleotide; TGG chr11 5170950 5170969 5170953 -
tatggagtcaggtgtccttc

SEQ ID NO: 54882 - DNA, 20 bp, Artificial Sequence
  Synthetic oligonucleotide; CAG chr11 5170941 5170960 5170944 -
aggtgtccttctggcaatgt

SEQ ID NO: 54883 - DNA, 20 bp, Artificial Sequence
  Synthetic oligonucleotide; TGG chr11 5170938 5170957 5170941 -
tgtccttctggcaatgtcag

SEQ ID NO: 54884 - DNA, 20 bp, Artificial Sequence
  Synthetic oligonucleotide; TGG chr11 5170926 5170945 5170929 -
aatgtcagtggaccgctttg

SEQ ID NO: 54885 - DNA, 20 bp, Artificial Sequence
  Synthetic oligonucleotide; CAG chr11 5170916 5170935 5170919 -
gaccgctttgtggccatcta

SEQ ID NO: 54886 - DNA, 20 bp, Artificial Sequence
  Synthetic oligonucleotide; TGG chr11 5170871 5170890 5170874 -
ctgacaattgcctgcatttc

SEQ ID NO: 54887 - DNA, 20 bp, Artificial Sequence
  Synthetic oligonucleotide; GGG chr11 5170870 5170889 5170873 -
tgacaattgcctgcatttct

SEQ ID NO: 54888 - DNA, 20 bp, Artificial Sequence
  Synthetic oligonucleotide; CGG chr11 5170866 5170885 5170869 -
aattgcctgcatttctggga

SEQ ID NO: 54889 - DNA, 20 bp, Artificial Sequence
  Synthetic oligonucleotide; GGG chr11 5170865 5170884 5170868 -
attgcctgcatttctgggac

SEQ ID NO: 54890 - DNA, 20 bp, Artificial Sequence
  Synthetic oligonucleotide; CAG chr11 5170844 5170863 5170847 -
ggtgccgccattgccttgcg

SEQ ID NO: 54891 - DNA, 20 bp, Artificial Sequence
  Synthetic oligonucleotide; GAG chr11 5170808 5170827 5170811 -
ctcccactgctctttctcct

SEQ ID NO: 54892 - DNA, 20 bp, Artificial Sequence
  Synthetic oligonucleotide; AGG chr11 5170807 5170826 5170810 -
tcccactgctctttctcctg

SEQ ID NO: 54893 - DNA, 20 bp, Artificial Sequence
  Synthetic oligonucleotide; TGG chr11 5170790 5170809 5170793 -
ctgaggcgtctgcctttctg

SEQ ID NO: 54894 - DNA, 20 bp, Artificial Sequence
  Synthetic oligonucleotide; CAG chr11 5170752 5170771 5170755 -
acactcttattgcctccact

SEQ ID NO: 54895 - DNA, 20 bp, Artificial Sequence
  Synthetic oligonucleotide; TGG chr11 5170730 5170749 5170733 -
gatctgatcaaattgccctg

SEQ ID NO: 54896 - DNA, 20 bp, Artificial Sequence
  Synthetic oligonucleotide; GAG chr11 5170728 5170747 5170731 -
tctgatcaaattgccctgtg

SEQ ID NO: 54897 - DNA, 20 bp, Artificial Sequence
  Synthetic oligonucleotide; TAG chr11 5170712 5170731 5170715 -
tgtggagacacacgtcccaa

SEQ ID NO: 54898 - DNA, 20 bp, Artificial Sequence
  Synthetic oligonucleotide; TGG chr11 5170704 5170723 5170707 -
cacacgtcccaatagcatcc

SEQ ID NO: 54899 - DNA, 20 bp, Artificial Sequence
  Synthetic oligonucleotide; TGG chr11 5170676 5170695 5170679 -
tttgtcattaccttcacatt

SEQ ID NO: 54900 - DNA, 20 bp, Artificial Sequence
  Synthetic oligonucleotide; TGG chr11 5170671 5170690 5170674 -
cattaccttcacatttggac

SEQ ID NO: 54901 - DNA, 20 bp, Artificial Sequence
  Synthetic oligonucleotide; TGG chr11 5170653 5170672 5170656 -
actggacttattgttcattg

SEQ ID NO: 54902 - DNA, 20 bp, Artificial Sequence
  Synthetic oligonucleotide; CAG chr11 5170626 5170645 5170629 -
ttatgtgctgattcttcata

SEQ ID NO: 54903 - DNA, 20 bp, Artificial Sequence
  Synthetic oligonucleotide; TGG chr11 5170620 5170639 5170623 -
gctgattcttcatacagtac

SEQ ID NO: 54904 - DNA, 20 bp, Artificial Sequence
  Synthetic oligonucleotide; TAG chr11 5170614 5170633 5170617 -
tcttcatacagtactggaaa

SEQ ID NO: 54905 - DNA, 20 bp, Artificial Sequence
  Synthetic oligonucleotide; TGG chr11 5170607 5170626 5170610 -
acagtactggaaatagcttc

SEQ ID NO: 54906 - DNA, 20 bp, Artificial Sequence
  Synthetic oligonucleotide; GAG chr11 5170605 5170624 5170608 -
agtactggaaatagcttctg

SEQ ID NO: 54907 - DNA, 20 bp, Artificial Sequence
  Synthetic oligonucleotide; CAG chr11 5170602 5170621 5170605 -
actggaaatagcttctggag

SEQ ID NO: 54908 - DNA, 20 bp, Artificial Sequence
  Synthetic oligonucleotide; AGG chr11 5170601 5170620 5170604 -
ctggaaatagcttctggagc

SEQ ID NO: 54909 - DNA, 20 bp, Artificial Sequence
  Synthetic oligonucleotide; GGG chr11 5170600 5170619 5170603 -
tggaaatagcttctggagca

SEQ ID NO: 54910 - DNA, 20 bp, Artificial Sequence
  Synthetic oligonucleotide; CGG chr11 5170597 5170616 5170600 -
aaatagcttctggagcaggg

SEQ ID NO: 54911 - DNA, 20 bp, Artificial Sequence
  Synthetic oligonucleotide; TGG chr11 5170594 5170613 5170597 -
tagcttctggagcagggcgg

SEQ ID NO: 54912 - DNA, 20 bp, Artificial Sequence
  Synthetic oligonucleotide; CAG chr11 5170591 5170610 5170594 -
cttctggagcagggcggtgg

SEQ ID NO: 54913 - DNA, 20 bp, Artificial Sequence
  Synthetic oligonucleotide; AGG chr11 5170590 5170609 5170593 -
ttctggagcagggcggtggc

SEQ ID NO: 54914 - DNA, 20 bp, Artificial Sequence
  Synthetic oligonucleotide; CAG chr11 5170529 5170548 5170532 -
gtgtactatgtgcccatgat

SEQ ID NO: 54915 - DNA, 20 bp, Artificial Sequence
  Synthetic oligonucleotide; TGG chr11 5170505 5170524 5170508 -
ctctccctgatgcaccgctt

SEQ ID NO: 54916 - DNA, 20 bp, Artificial Sequence
  Synthetic oligonucleotide; CGG chr11 5170501 5170520 5170504 -
ccctgatgcaccgctttgga

SEQ ID NO: 54917 - DNA, 20 bp, Artificial Sequence
  Synthetic oligonucleotide; CAG chr11 5170480 5170499 5170483 -
ggcatttacctccacttttc

SEQ ID NO: 54918 - DNA, 20 bp, Artificial Sequence
  Synthetic oligonucleotide; CGG chr11 5170470 5170489 5170473 -
tccacttttccagactgtca

SEQ ID NO: 54919 - DNA, 20 bp, Artificial Sequence
  Synthetic oligonucleotide; TGG chr11 5170440 5170459 5170443 -
ttacctcttttttcctcctg

SEQ ID NO: 54920 - DNA, 20 bp, Artificial Sequence
  Synthetic oligonucleotide; TAG chr11 5170421 5170440 5170424 -
gtggtcaaccccattgtcta

SEQ ID NO: 54921 - DNA, 20 bp, Artificial Sequence
  Synthetic oligonucleotide; AAG chr11 5170407 5170426 5170410 -
tgtctatagtatcaaaatca

SEQ ID NO: 54922 - DNA, 20 bp, Artificial Sequence
  Synthetic oligonucleotide; CAG chr11 5170394 5170413 5170397 -
aaaatcaaagaaattcgcaa

SEQ ID NO: 54923 - DNA, 20 bp, Artificial Sequence
  Synthetic oligonucleotide; CAG chr11 5170373 5170392 5170376 -
agcgttgttcttacactatc

SEQ ID NO: 54924 - DNA, 20 bp, Artificial Sequence
  Synthetic oligonucleotide; AGG chr11 5170372 5170391 5170375 -
gcgttgttcttacactatcc

SEQ ID NO: 54925 - DNA, 20 bp, Artificial Sequence
  Synthetic oligonucleotide; AAG chr11 5170369 5170388 5170372 -
ttgttcttacactatccagg

SEQ ID NO: 54926 - DNA, 20 bp, Artificial Sequence
  Synthetic oligonucleotide; GAG chr11 5170367 5170386 5170370 -
gttcttacactatccaggaa

SEQ ID NO: 54927 - DNA, 20 bp, Artificial Sequence
  Synthetic oligonucleotide; AGG chr11 5170366 5170385 5170369 -
ttcttacactatccaggaag

SEQ ID NO: 54928 - DNA, 20 bp, Artificial Sequence
  Synthetic oligonucleotide; GGG chr11 5170365 5170384 5170368 -
tcttacactatccaggaaga

SEQ ID NO: 54929 - DNA, 20 bp, Artificial Sequence
  Synthetic oligonucleotide; GGG chr11 5170364 5170383 5170367 -
cttacactatccaggaagag

SEQ ID NO: 54930 - DNA, 20 bp, Artificial Sequence
  Synthetic oligonucleotide; GAG chr11 5170360 5170379 5170363 -
cactatccaggaagaggggt

SEQ ID NO: 54931 - DNA, 20 bp, Artificial Sequence
  Synthetic oligonucleotide; TGG chr11 5170351 5170370 5170354 -
ggaagaggggtgagttctaa

SEQ ID NO: 54932 - DNA, 20 bp, Artificial Sequence
  Synthetic oligonucleotide; GAG chr11 5170349 5170368 5170352 -
aagaggggtgagttctaatg

SEQ ID NO: 54933 - DNA, 20 bp, Artificial Sequence
  Synthetic oligonucleotide; AAG chr11 5170342 5170361 5170345 -
gtgagttctaatggagactg

SEQ ID NO: 54934 - DNA, 20 bp, Artificial Sequence
  Synthetic oligonucleotide; CAG chr11 5170330 5170349 5170333 -
ggagactgaagataccctga

SEQ ID NO: 54935 - DNA, 20 bp, Artificial Sequence
  Synthetic oligonucleotide; CAG chr11 5170325 5170344 5170328 -
ctgaagataccctgacagca

SEQ ID NO: 54936 - DNA, 20 bp, Artificial Sequence
  Synthetic oligonucleotide; AGG chr11 5170324 5170343 5170327 -
tgaagataccctgacagcac

SEQ ID NO: 54937 - DNA, 20 bp, Artificial Sequence
  Synthetic oligonucleotide; TAG chr11 5170317 5170336 5170320 -
accctgacagcacaggcact

SEQ ID NO: 54938 - DNA, 20 bp, Artificial Sequence
  Synthetic oligonucleotide; CAG chr11 5170312 5170331 5170315 -
gacagcacaggcacttagat

SEQ ID NO: 54939 - DNA, 20 bp, Artificial Sequence
  Synthetic oligonucleotide; AGG chr11 5170311 5170330 5170314 -
acagcacaggcacttagatc

SEQ ID NO: 54940 - DNA, 20 bp, Artificial Sequence
  Synthetic oligonucleotide; TAG chr11 5170291 5170310 5170294 -
aggctttattacctgaatat

SEQ ID NO: 54941 - DNA, 20 bp, Artificial Sequence
  Synthetic oligonucleotide; TGG chr11 5170265 5170284 5170268 -
tgcaaatatgaaaaattcca

SEQ ID NO: 54942 - DNA, 20 bp, Artificial Sequence
  Synthetic oligonucleotide; GAG chr11 5170243 5170262 5170246 -
gcttattattgcttgttaat

SEQ ID NO: 54943 - DNA, 20 bp, Artificial Sequence
  Synthetic oligonucleotide; TAG chr11 5170227 5170246 5170230 -
taatgagctttaacattttg

SEQ ID NO: 54944 - DNA, 20 bp, Artificial Sequence
  Synthetic oligonucleotide; AAG chr11 5170221 5170240 5170224 -
gctttaacattttgtagatg

SEQ ID NO: 54945 - DNA, 20 bp, Artificial Sequence
  Synthetic oligonucleotide; CAG chr11 5170210 5170229 5170213 -
ttgtagatgaagaaaaaaaa

SEQ ID NO: 54946 - DNA, 20 bp, Artificial Sequence
  Synthetic oligonucleotide; GAG chr11 5170191 5170210 5170194 -
acagttttatatatttccct

SEQ ID NO: 54947 - DNA, 20 bp, Artificial Sequence
  Synthetic oligonucleotide; TAG chr11 5170186 5170205 5170189 -
tttatatatttccctgagaa

SEQ ID NO: 54948 - DNA, 20 bp, Artificial Sequence
  Synthetic oligonucleotide; AGG chr11 5170185 5170204 5170188 -
ttatatatttccctgagaat

SEQ ID NO: 54949 - DNA, 20 bp, Artificial Sequence
  Synthetic oligonucleotide; TGG chr11 5170179 5170198 5170182 -
atttccctgagaataggaaa

SEQ ID NO: 54950 - DNA, 20 bp, Artificial Sequence
  Synthetic oligonucleotide; TGG chr11 5170155 5170174 5170158 -
attactctgaaataaaattg

SEQ ID NO: 54951 - DNA, 20 bp, Artificial Sequence
  Synthetic oligonucleotide; GGG chr11 5170154 5170173 5170157 -
ttactctgaaataaaattgt

SEQ ID NO: 54952 - DNA, 20 bp, Artificial Sequence
  Synthetic oligonucleotide; GAG chr11 5170152 5170171 5170155 -
actctgaaataaaattgtgg

SEQ ID NO: 54953 - DNA, 20 bp, Artificial Sequence
  Synthetic oligonucleotide; AGG chr11 5170151 5170170 5170154 -
ctctgaaataaaattgtggg

SEQ ID NO: 54954 - DNA, 20 bp, Artificial Sequence
  Synthetic oligonucleotide; GAG chr11 5170149 5170168 5170152 -
ctgaaataaaattgtgggag

SEQ ID NO: 54955 - DNA, 20 bp, Artificial Sequence
  Synthetic oligonucleotide; AGG chr11 5170148 5170167 5170151 -
tgaaataaaattgtgggagg

SEQ ID NO: 54956 - DNA, 20 bp, Artificial Sequence
  Synthetic oligonucleotide; TAG chr11 5170143 5170162 5170146 -
taaaattgtgggaggaggca

SEQ ID NO: 54957 - DNA, 20 bp, Artificial Sequence
  Synthetic oligonucleotide; CAG chr11 5170136 5170155 5170139 -
gtgggaggaggcatagaaca

SEQ ID NO: 54958 - DNA, 20 bp, Artificial Sequence
  Synthetic oligonucleotide; AGG chr11 5170135 5170154 5170138 -
tgggaggaggcatagaacac

SEQ ID NO: 54959 - DNA, 20 bp, Artificial Sequence
  Synthetic oligonucleotide; TGG chr11 5170124 5170143 5170127 -
atagaacacaggctttgtcc

SEQ ID NO: 54960 - DNA, 20 bp, Artificial Sequence
  Synthetic oligonucleotide; CAG chr11 5170080 5170099 5170083 -
gaatccttgaatactcaatt

SEQ ID NO: 54961 - DNA, 20 bp, Artificial Sequence
  Synthetic oligonucleotide; TGG chr11 5170070 5170089 5170073 -
atactcaattcagtgacatt

SEQ ID NO: 54962 - DNA, 20 bp, Artificial Sequence
  Synthetic oligonucleotide; TGG chr11 5170064 5170083 5170067 -
aattcagtgacatttggttc

SEQ ID NO: 54963 - DNA, 20 bp, Artificial Sequence
  Synthetic oligonucleotide; GGG chr11 5170063 5170082 5170066 -
attcagtgacatttggttct

SEQ ID NO: 54964 - DNA, 20 bp, Artificial Sequence
  Synthetic oligonucleotide; TAG chr11 5170054 5170073 5170057 -
catttggttctgggaatatg

SEQ ID NO: 54965 - DNA, 20 bp, Artificial Sequence
  Synthetic oligonucleotide; AAG chr11 5170050 5170069 5170053 -
tggttctgggaatatgtaga

SEQ ID NO: 54966 - DNA, 20 bp, Artificial Sequence
  Synthetic oligonucleotide; GAG chr11 5170048 5170067 5170051 -
gttctgggaatatgtagaaa

SEQ ID NO: 54967 - DNA, 20 bp, Artificial Sequence
  Synthetic oligonucleotide; TGG chr11 5170042 5170061 5170045 -
ggaatatgtagaaagagtct

SEQ ID NO: 54968 - DNA, 20 bp, Artificial Sequence
  Synthetic oligonucleotide; GGG chr11 5170041 5170060 5170044 -
gaatatgtagaaagagtctt

SEQ ID NO: 54969 - DNA, 20 bp, Artificial Sequence
  Synthetic oligonucleotide; GGG chr11 5170040 5170059 5170043 -
aatatgtagaaagagtcttg

SEQ ID NO: 54970 - DNA, 20 bp, Artificial Sequence
  Synthetic oligonucleotide; GAG chr11 5170038 5170057 5170041 -
tatgtagaaagagtcttggg

SEQ ID NO: 54971 - DNA, 20 bp, Artificial Sequence
  Synthetic oligonucleotide; AGG chr11 5170037 5170056 5170040 -
atgtagaaagagtcttgggg

SEQ ID NO: 54972 - DNA, 20 bp, Artificial Sequence
  Synthetic oligonucleotide; AAG chr11 5170031 5170050 5170034 -
aaagagtcttggggaggttt

SEQ ID NO: 54973 - DNA, 20 bp, Artificial Sequence
  Synthetic oligonucleotide; TGG chr11 5170024 5170043 5170027 -
cttggggaggtttaagtttc

SEQ ID NO: 54974 - DNA, 20 bp, Artificial Sequence
  Synthetic oligonucleotide; TAG chr11 5170009 5170028 5170012 -
gtttctggttatattaaaat

SEQ ID NO: 54975 - DNA, 20 bp, Artificial Sequence
  Synthetic oligonucleotide; AAG chr11 5169991 5170010 5169994 -
attagtgatacatacttgtg

SEQ ID NO: 54976 - DNA, 20 bp, Artificial Sequence
  Synthetic oligonucleotide; AGG chr11 5169990 5170009 5169993 -
ttagtgatacatacttgtga

SEQ ID NO: 54977 - DNA, 20 bp, Artificial Sequence
  Synthetic oligonucleotide; CAG chr11 5169979 5169998 5169982 -
tacttgtgaaggaaaataat

SEQ ID NO: 54978 - DNA, 20 bp, Artificial Sequence
  Synthetic oligonucleotide; AGG chr11 5169978 5169997 5169981 -
acttgtgaaggaaaataatc

SEQ ID NO: 54979 - DNA, 20 bp, Artificial Sequence
  Synthetic oligonucleotide; AAG chr11 5169969 5169988 5169972 -
ggaaaataatcaggacacaa

SEQ ID NO: 54980 - DNA, 20 bp, Artificial Sequence
  Synthetic oligonucleotide; GAG chr11 5169967 5169986 5169970 -
aaaataatcaggacacaaaa

SEQ ID NO: 54981 - DNA, 20 bp, Artificial Sequence
  Synthetic oligonucleotide; TAG chr11 5169939 5169958 5169942 -
attgtattattttgtttgta

SEQ ID NO: 54982 - DNA, 20 bp, Artificial Sequence
  Synthetic oligonucleotide; CAG chr11 5169933 5169952 5169936 -
ttattttgtttgtatagttt

SEQ ID NO: 54983 - DNA, 20 bp, Artificial Sequence
  Synthetic oligonucleotide; CAG chr11 5169899 5169918 5169902 -
ctaatttaatgtcaaaaaat

SEQ ID NO: 54984 - DNA, 20 bp, Artificial Sequence
  Synthetic oligonucleotide; TGG chr11 5169878 5169897 5169881 -
agaaccctgcttacctctga

SEQ ID NO: 54985 - DNA, 20 bp, Artificial Sequence
  Synthetic oligonucleotide; AAG chr11 5169870 5169889 5169873 -
gcttacctctgatggatata

SEQ ID NO: 54986 - DNA, 20 bp, Artificial Sequence
  Synthetic oligonucleotide; TGG chr11 5169866 5169885 5169869 -
acctctgatggatataaaga

SEQ ID NO: 54987 - DNA, 20 bp, Artificial Sequence
  Synthetic oligonucleotide; AAG chr11 5169863 5169882 5169866 -
tctgatggatataaagatgg

SEQ ID NO: 54988 - DNA, 20 bp, Artificial Sequence
  Synthetic oligonucleotide; TGG chr11 5169858 5169877 5169861 -
tggatataaagatggaagaa

SEQ ID NO: 54989 - DNA, 20 bp, Artificial Sequence
  Synthetic oligonucleotide; GGG chr11 5169857 5169876 5169860 -
ggatataaagatggaagaat

SEQ ID NO: 54990 - DNA, 20 bp, Artificial Sequence
  Synthetic oligonucleotide; GGG chr11 5169856 5169875 5169859 -
gatataaagatggaagaatg

SEQ ID NO: 54991 - DNA, 20 bp, Artificial Sequence
  Synthetic oligonucleotide; GAG chr11 5169854 5169873 5169857 -
tataaagatggaagaatggg

SEQ ID NO: 54992 - DNA, 20 bp, Artificial Sequence
  Synthetic oligonucleotide; GAG chr11 5169852 5169871 5169855 -
taaagatggaagaatgggga

SEQ ID NO: 54993 - DNA, 20 bp, Artificial Sequence
  Synthetic oligonucleotide; GAG chr11 5169845 5169864 5169848 -
ggaagaatggggagagacat

SEQ ID NO: 54994 - DNA, 20 bp, Artificial Sequence
  Synthetic oligonucleotide; AGG chr11 5169844 5169863 5169847 -
gaagaatggggagagacatg

SEQ ID NO: 54995 - DNA, 20 bp, Artificial Sequence
  Synthetic oligonucleotide; TGG chr11 5169834 5169853 5169837 -
gagagacatgaggcaatttc

SEQ ID NO: 54996 - DNA, 20 bp, Artificial Sequence
  Synthetic oligonucleotide; GGG chr11 5169833 5169852 5169836 -
agagacatgaggcaatttct

SEQ ID NO: 54997 - DNA, 20 bp, Artificial Sequence
  Synthetic oligonucleotide; GGG chr11 5169832 5169851 5169835 -
gagacatgaggcaatttctg

SEQ ID NO: 54998 - DNA, 20 bp, Artificial Sequence
  Synthetic oligonucleotide; GAG chr11 5169830 5169849 5169833 -
gacatgaggcaatttctggg

SEQ ID NO: 54999 - DNA, 20 bp, Artificial Sequence
  Synthetic oligonucleotide; TGG chr11 5169826 5169845 5169829 -
tgaggcaatttctggggaga

SEQ ID NO: 55000 - DNA, 20 bp, Artificial Sequence
  Synthetic oligonucleotide; TAG chr11 5169807 5169826 5169810 -
atggaaatattttgttgtgt

SEQ ID NO: 55001 - DNA, 20 bp, Artificial Sequence
  Synthetic oligonucleotide; AGG chr11 5169806 5169825 5169809 -
tggaaatattttgttgtgtt

SEQ ID NO: 55002 - DNA, 20 bp, Artificial Sequence
  Synthetic oligonucleotide; GGG chr11 5169805 5169824 5169808 -
ggaaatattttgttgtgtta

SEQ ID NO: 55003 - DNA, 20 bp, Artificial Sequence
  Synthetic oligonucleotide; TGG chr11 5169799 5169818 5169802 -
attttgttgtgttagggatg

SEQ ID NO: 55004 - DNA, 20 bp, Artificial Sequence
  Synthetic oligonucleotide; CGG chr11 5169769 5169788 5169772 -
gttttgtcaatttgtcaaaa

SEQ ID NO: 55005 - DNA, 20 bp, Artificial Sequence
  Synthetic oligonucleotide; CAG chr11 5169764 5169783 5169767 -
gtcaatttgtcaaaacggta

SEQ ID NO: 55006 - DNA, 20 bp, Artificial Sequence
  Synthetic oligonucleotide; AAG chr11 5169759 5169778 5169762 -
tttgtcaaaacggtacagct

SEQ ID NO: 55007 - DNA, 20 bp, Artificial Sequence
  Synthetic oligonucleotide; TAG chr11 5169743 5169762 5169746 -
agctaagatttgcacatttc

SEQ ID NO: 55008 - DNA, 20 bp, Artificial Sequence
  Synthetic oligonucleotide; AGG chr11 5169742 5169761 5169745 -
gctaagatttgcacatttct

SEQ ID NO: 55009 - DNA, 20 bp, Artificial Sequence
  Synthetic oligonucleotide; AAG chr11 5169694 5169713 5169697 -
tgaatgataataataacaaa

SEQ ID NO: 55010 - DNA, 20 bp, Artificial Sequence
  Synthetic oligonucleotide; AGG chr11 5169693 5169712 5169696 -
gaatgataataataacaaaa

SEQ ID NO: 55011 - DNA, 20 bp, Artificial Sequence
  Synthetic oligonucleotide; TAG chr11 5169686 5169705 5169689 -
aataataacaaaaaggaaaa

SEQ ID NO: 55012 - DNA, 20 bp, Artificial Sequence
  Synthetic oligonucleotide; CAG chr11 5169672 5169691 5169675 -
ggaaaatagtaataataata

SEQ ID NO: 55013 - DNA, 20 bp, Artificial Sequence
  Synthetic oligonucleotide; TAG chr11 5169664 5169683 5169667 -
gtaataataatacagatgat

SEQ ID NO: 55014 - DNA, 20 bp, Artificial Sequence
  Synthetic oligonucleotide; TAG chr11 5169655 5169674 5169658 -
atacagatgattagatttca

SEQ ID NO: 55015 - DNA, 20 bp, Artificial Sequence
  Synthetic oligonucleotide; AAG chr11 5169645 5169664 5169648 -
ttagatttcatagtgaatac

SEQ ID NO: 55016 - DNA, 20 bp, Artificial Sequence
  Synthetic oligonucleotide; TGG chr11 5169640 5169659 5169643 -
tttcatagtgaatacaagtg

SEQ ID NO: 55017 - DNA, 20 bp, Artificial Sequence
  Synthetic oligonucleotide; AAG chr11 5169630 5169649 5169633 -
aatacaagtgtggaaaatac

SEQ ID NO: 55018 - DNA, 20 bp, Artificial Sequence
  Synthetic oligonucleotide; TGG chr11 5169625 5169644 5169628 -
aagtgtggaaaatacaagaa

SEQ ID NO: 55019 - DNA, 20 bp, Artificial Sequence
  Synthetic oligonucleotide; AAG chr11 5169602 5169621 5169605 -
tgtaatgttgataattgttg

SEQ ID NO: 55020 - DNA, 20 bp, Artificial Sequence
  Synthetic oligonucleotide; TGG chr11 5169591 5169610 5169594 -
taattgttgaagttgtgtca

SEQ ID NO: 55021 - DNA, 20 bp, Artificial Sequence
  Synthetic oligonucleotide; GGG chr11 5169590 5169609 5169593 -
aattgttgaagttgtgtcat

SEQ ID NO: 55022 - DNA, 20 bp, Artificial Sequence
  Synthetic oligonucleotide; TGG chr11 5169583 5169602 5169586 -
gaagttgtgtcatgggtgcc

SEQ ID NO: 55023 - DNA, 20 bp, Artificial Sequence
  Synthetic oligonucleotide; TAG chr11 5169549 5169568 5169552 -
aatattctgtttactttgtg

SEQ ID NO: 55024 - DNA, 20 bp, Artificial Sequence
  Synthetic oligonucleotide; AAG chr11 5169526 5169545 5169529 -
tttacaatttctgtaataaa

SEQ ID NO: 55025 - DNA, 20 bp, Artificial Sequence
  Synthetic oligonucleotide; CAG chr11 5169503 5169522 5169506 -
attcttaaaaaaattatact

SEQ ID NO: 55026 - DNA, 20 bp, Artificial Sequence
  Synthetic oligonucleotide; AAG chr11 5169463 5169482 5169466 -
ttaattgaatatgcaccatg

SEQ ID NO: 55027 - DNA, 20 bp, Artificial Sequence
  Synthetic oligonucleotide; CAG chr11 5169460 5169479 5169463 -
attgaatatgcaccatgaag

SEQ ID NO: 55028 - DNA, 20 bp, Artificial Sequence
  Synthetic oligonucleotide; GAG chr11 5169458 5169477 5169461 -
tgaatatgcaccatgaagca

SEQ ID NO: 55029 - DNA, 20 bp, Artificial Sequence
  Synthetic oligonucleotide; TGG chr11 5169443 5169462 5169446 -
aagcagagataacttttaac

SEQ ID NO: 55030 - DNA, 20 bp, Artificial Sequence
  Synthetic oligonucleotide; CAG chr11 5169439 5169458 5169442 -
agagataacttttaactggt

SEQ ID NO: 55031 - DNA, 20 bp, Artificial Sequence
  Synthetic oligonucleotide; AGG chr11 5169438 5169457 5169441 -
gagataacttttaactggtc

SEQ ID NO: 55032 - DNA, 20 bp, Artificial Sequence
  Synthetic oligonucleotide; GAG chr11 5169436 5169455 5169439 -
gataacttttaactggtcag

SEQ ID NO: 55033 - DNA, 20 bp, Artificial Sequence
  Synthetic oligonucleotide; AGG chr11 5169435 5169454 5169438 -
ataacttttaactggtcagg

SEQ ID NO: 55034 - DNA, 20 bp, Artificial Sequence
  Synthetic oligonucleotide; TGG chr11 5169424 5169443 5169427 -
ctggtcaggaggaaactgtt

SEQ ID NO: 55035 - DNA, 20 bp, Artificial Sequence
  Synthetic oligonucleotide; TAG chr11 5169418 5169437 5169421 -
aggaggaaactgtttggctt

SEQ ID NO: 55036 - DNA, 20 bp, Artificial Sequence
  Synthetic oligonucleotide; AAG chr11 5169414 5169433 5169417 -
ggaaactgtttggctttaga

SEQ ID NO: 55037 - DNA, 20 bp, Artificial Sequence
  Synthetic oligonucleotide; GAG chr11 5169395 5169414 5169398 -
aaagctattttatttttaat

SEQ ID NO: 55038 - DNA, 20 bp, Artificial Sequence
  Synthetic oligonucleotide; TAG chr11 5169384 5169403 5169387 -
atttttaatgagttcaatac

SEQ ID NO: 55039 - DNA, 20 bp, Artificial Sequence
  Synthetic oligonucleotide; AAG chr11 5169380 5169399 5169383 -
ttaatgagttcaatactaga

SEQ ID NO: 55040 - DNA, 20 bp, Artificial Sequence
  Synthetic oligonucleotide; TAG chr11 5169344 5169363 5169347 -
actacttgaaaatactgttt

SEQ ID NO: 55041 - DNA, 20 bp, Artificial Sequence
  Synthetic oligonucleotide; AAG chr11 5169341 5169360 5169344 -
acttgaaaatactgttttag

SEQ ID NO: 55042 - DNA, 20 bp, Artificial Sequence
  Synthetic oligonucleotide; CAG chr11 5169323 5169342 5169326 -
agaagaaaataactaaaaaa

SEQ ID NO: 55043 - DNA, 20 bp, Artificial Sequence
  Synthetic oligonucleotide; AAG chr11 5169317 5169336 5169320 -
aaataactaaaaaacagaaa

SEQ ID NO: 55044 - DNA, 20 bp, Artificial Sequence
  Synthetic oligonucleotide; AAG chr11 5169313 5169332 5169316 -
aactaaaaaacagaaaaagc

SEQ ID NO: 55045 - DNA, 20 bp, Artificial Sequence
  Synthetic oligonucleotide; AGG chr11 5169312 5169331 5169315 -
actaaaaaacagaaaaagca

SEQ ID NO: 55046 - DNA, 20 bp, Artificial Sequence
  Synthetic oligonucleotide; TAG chr11 5169296 5169315 5169299 -
agcaaggcctactcctgcaa

SEQ ID NO: 55047 - DNA, 20 bp, Artificial Sequence
  Synthetic oligonucleotide; TGG chr11 5169289 5169308 5169292 -
cctactcctgcaatagtctt

SEQ ID NO: 55048 - DNA, 20 bp, Artificial Sequence
  Synthetic oligonucleotide; CGG chr11 5169272 5169291 5169275 -
ctttggtgacatcaatcact

SEQ ID NO: 55049 - DNA, 20 bp, Artificial Sequence
  Synthetic oligonucleotide; TAG chr11 5169269 5169288 5169272 -
tggtgacatcaatcactcgg

SEQ ID NO: 55050 - DNA, 20 bp, Artificial Sequence
  Synthetic oligonucleotide; TAG chr11 5169266 5169285 5169269 -
tgacatcaatcactcggtag

SEQ ID NO: 55051 - DNA, 20 bp, Artificial Sequence
  Synthetic oligonucleotide; AAG chr11 5169261 5169280 5169264 -
tcaatcactcggtagtagac

SEQ ID NO: 55052 - DNA, 20 bp, Artificial Sequence
  Synthetic oligonucleotide; AAG chr11 5169243 5169262 5169246 -
acaagcttctgacaaacaaa

SEQ ID NO: 55053 - DNA, 20 bp, Artificial Sequence
  Synthetic oligonucleotide; AGG chr11 5169242 5169261 5169245 -
caagcttctgacaaacaaaa

SEQ ID NO: 55054 - DNA, 20 bp, Artificial Sequence
  Synthetic oligonucleotide; TAG chr11 5169239 5169258 5169242 -
gcttctgacaaacaaaaagg

SEQ ID NO: 55055 - DNA, 20 bp, Artificial Sequence
  Synthetic oligonucleotide; AGG chr11 5169238 5169257 5169241 -
cttctgacaaacaaaaaggt

SEQ ID NO: 55056 - DNA, 20 bp, Artificial Sequence
  Synthetic oligonucleotide; GGG chr11 5169237 5169256 5169240 -
ttctgacaaacaaaaaggta

SEQ ID NO: 55057 - DNA, 20 bp, Artificial Sequence
  Synthetic oligonucleotide; GAG chr11 5169235 5169254 5169238 -
ctgacaaacaaaaaggtagg

SEQ ID NO: 55058 - DNA, 20 bp, Artificial Sequence
  Synthetic oligonucleotide; AGG chr11 5169234 5169253 5169237 -
tgacaaacaaaaaggtaggg

SEQ ID NO: 55059 - DNA, 20 bp, Artificial Sequence
  Synthetic oligonucleotide; CAG chr11 5169229 5169248 5169232 -
aacaaaaaggtagggaggac

SEQ ID NO: 55060 - DNA, 20 bp, Artificial Sequence
  Synthetic oligonucleotide; AAG chr11 5169226 5169245 5169229 -
aaaaaggtagggaggaccag

SEQ ID NO: 55061 - DNA, 20 bp, Artificial Sequence
  Synthetic oligonucleotide; TAG chr11 5169218 5169237 5169221 -
agggaggaccagaagaattc

SEQ ID NO: 55062 - DNA, 20 bp, Artificial Sequence
  Synthetic oligonucleotide; CAG chr11 5169206 5169225 5169209 -
aagaattctagaaaatccct

SEQ ID NO: 55063 - DNA, 20 bp, Artificial Sequence
  Synthetic oligonucleotide; CAG chr11 5169202 5169221 5169205 -
attctagaaaatccctcaga

SEQ ID NO: 55064 - DNA, 20 bp, Artificial Sequence
  Synthetic oligonucleotide; AGG chr11 5169201 5169220 5169204 -
ttctagaaaatccctcagac

SEQ ID NO: 55065 - DNA, 20 bp, Artificial Sequence
  Synthetic oligonucleotide; GGG chr11 5169200 5169219 5169203 -
tctagaaaatccctcagaca

SEQ ID NO: 55066 - DNA, 20 bp, Artificial Sequence
  Synthetic oligonucleotide; CAG chr11 5169193 5169212 5169196 -
aatccctcagacagggattg

SEQ ID NO: 55067 - DNA, 20 bp, Artificial Sequence
  Synthetic oligonucleotide; GAG chr11 5169191 5169210 5169194 -
tccctcagacagggattgca

SEQ ID NO: 55068 - DNA, 20 bp, Artificial Sequence
  Synthetic oligonucleotide; CAG chr11 5169169 5169188 5169172 -
gcccaactttttgttttctt

SEQ ID NO: 55069 - DNA, 20 bp, Artificial Sequence
  Synthetic oligonucleotide; CAG chr11 5169142 5169161 5169145 -
ttttgaatttccatgaacca

SEQ ID NO: 55070 - DNA, 20 bp, Artificial Sequence
  Synthetic oligonucleotide; CAG chr11 5169118 5169137 5169121 -
gaatatcctattaaaccaca

SEQ ID NO: 55071 - DNA, 20 bp, Artificial Sequence
  Synthetic oligonucleotide; GAG chr11 5169111 5169130 5169114 -
ctattaaaccacacagtctt

SEQ ID NO: 55072 - DNA, 20 bp, Artificial Sequence
  Synthetic oligonucleotide; CAG chr11 5169101 5169120 5169104 -
acacagtcttgagtgattat

SEQ ID NO: 55073 - DNA, 20 bp, Artificial Sequence
  Synthetic oligonucleotide; AAG chr11 5169092 5169111 5169095 -
tgagtgattatcagccaacc

SEQ ID NO: 55074 - DNA, 20 bp, Artificial Sequence
  Synthetic oligonucleotide; TAG chr11 5169082 5169101 5169085 -
tcagccaaccaagtaactaa

SEQ ID NO: 55075 - DNA, 20 bp, Artificial Sequence
  Synthetic oligonucleotide; AAG chr11 5169079 5169098 5169082 -
gccaaccaagtaactaatag

SEQ ID NO: 55076 - DNA, 20 bp, Artificial Sequence
  Synthetic oligonucleotide; AGG chr11 5169078 5169097 5169081 -
ccaaccaagtaactaataga

SEQ ID NO: 55077 - DNA, 20 bp, Artificial Sequence
  Synthetic oligonucleotide; TGG chr11 5169073 5169092 5169076 -
caagtaactaatagaaggtt

SEQ ID NO: 55078 - DNA, 20 bp, Artificial Sequence
  Synthetic oligonucleotide; AAG chr11 5169051 5169070 5169054 -
gtcaaataaaaatatgtatc

SEQ ID NO: 55079 - DNA, 20 bp, Artificial Sequence
  Synthetic oligonucleotide; GAG chr11 5169044 5169063 5169047 -
aaaaatatgtatcaagtaat

SEQ ID NO: 55080 - DNA, 20 bp, Artificial Sequence
  Synthetic oligonucleotide; TGG chr11 5169041 5169060 5169044 -
aatatgtatcaagtaatgag

SEQ ID NO: 55081 - DNA, 20 bp, Artificial Sequence
  Synthetic oligonucleotide; TGG chr11 5168997 5169016 5169000 -
ttttcctcgaaattaattta

SEQ ID NO: 55082 - DNA, 20 bp, Artificial Sequence
  Synthetic oligonucleotide; AAG chr11 5168959 5168978 5168962 -
aatgtatgaaacacctttga

SEQ ID NO: 55083 - DNA, 20 bp, Artificial Sequence
  Synthetic oligonucleotide; TAG chr11 5168947 5168966 5168950 -
acctttgaaagtgttcaatg

SEQ ID NO: 55084 - DNA, 20 bp, Artificial Sequence
  Synthetic oligonucleotide; AAG chr11 5168942 5168961 5168945 -
tgaaagtgttcaatgtagtg

SEQ ID NO: 55085 - DNA, 20 bp, Artificial Sequence
  Synthetic oligonucleotide; TGG chr11 5168925 5168944 5168928 -
gtgaagtcataaaaacaaca

SEQ ID NO: 55086 - DNA, 20 bp, Artificial Sequence
  Synthetic oligonucleotide; GGG chr11 5168924 5168943 5168927 -
tgaagtcataaaaacaacat

SEQ ID NO: 55087 - DNA, 20 bp, Artificial Sequence
  Synthetic oligonucleotide; CAG chr11 5168896 5168915 5168899 -
aaaaaaaattctcaaaattt

SEQ ID NO: 55088 - DNA, 20 bp, Artificial Sequence
  Synthetic oligonucleotide; GAG chr11 5168894 5168913 5168897 -
aaaaaattctcaaaatttca

SEQ ID NO: 55089 - DNA, 20 bp, Artificial Sequence
  Synthetic oligonucleotide; TAG chr11 5168886 5168905 5168889 -
ctcaaaatttcagagtaatt

SEQ ID NO: 55090 - DNA, 20 bp, Artificial Sequence
  Synthetic oligonucleotide; AAG chr11 5168883 5168902 5168886 -
aaaatttcagagtaatttag

SEQ ID NO: 55091 - DNA, 20 bp, Artificial Sequence
  Synthetic oligonucleotide; TGG chr11 5168859 5168878 5168862 -
ccttccttaacaataattat

SEQ ID NO: 55092 - DNA, 20 bp, Artificial Sequence
  Synthetic oligonucleotide; CAG chr11 5168844 5168863 5168847 -
attattggtaacctccatta

SEQ ID NO: 55093 - DNA, 20 bp, Artificial Sequence
  Synthetic oligonucleotide; TGG chr11 5168822 5168841 5168825 -
gtcctgtattactattctta

SEQ ID NO: 55094 - DNA, 20 bp, Artificial Sequence
  Synthetic oligonucleotide; AAG chr11 5168803 5168822 5168806 -
atggtatacatgaaaaaact

SEQ ID NO: 55095 - DNA, 20 bp, Artificial Sequence
  Synthetic oligonucleotide; GAG chr11 5168801 5168820 5168804 -
ggtatacatgaaaaaactaa

SEQ ID NO: 55096 - DNA, 20 bp, Artificial Sequence
  Synthetic oligonucleotide; AAG chr11 5168778 5168797 5168781 -
ataatttttgtaactttatc

SEQ ID NO: 55097 - DNA, 20 bp, Artificial Sequence
  Synthetic oligonucleotide; TGG chr11 5168766 5168785 5168769 -
actttatcaagttcacacaa

SEQ ID NO: 55098 - DNA, 20 bp, Artificial Sequence
  Synthetic oligonucleotide; AAG chr11 5168748 5168767 5168751 -
aatggaaaacttgtacaccc

SEQ ID NO: 55099 - DNA, 20 bp, Artificial Sequence
  Synthetic oligonucleotide; GAG chr11 5168746 5168765 5168749 -
tggaaaacttgtacacccaa

SEQ ID NO: 55100 - DNA, 20 bp, Artificial Sequence
  Synthetic oligonucleotide; AAG chr11 5168741 5168760 5168744 -
aacttgtacacccaagagcc

SEQ ID NO: 55101 - DNA, 20 bp, Artificial Sequence
  Synthetic oligonucleotide; CAG chr11 5168734 5168753 5168737 -
acacccaagagccaagtcct

SEQ ID NO: 55102 - DNA, 20 bp, Artificial Sequence
  Synthetic oligonucleotide; CAG chr11 5168710 5168729 5168713 -
gtgatgttatacacttgaac

SEQ ID NO: 55103 - DNA, 20 bp, Artificial Sequence
  Synthetic oligonucleotide; TAG chr11 5168700 5168719 5168703 -
acacttgaaccagatgtacc

SEQ ID NO: 55104 - DNA, 20 bp, Artificial Sequence
  Synthetic oligonucleotide; AGG chr11 5168699 5168718 5168702 -
cacttgaaccagatgtacct

SEQ ID NO: 55105 - DNA, 20 bp, Artificial Sequence
  Synthetic oligonucleotide; TAG chr11 5168687 5168706 5168690 -
atgtacctaggttgaaatct

SEQ ID NO: 55106 - DNA, 20 bp, Artificial Sequence
  Synthetic oligonucleotide; TAG chr11 5168672 5168691 5168675 -
aatcttagctatcttgctat

SEQ ID NO: 55107 - DNA, 20 bp, Artificial Sequence
  Synthetic oligonucleotide; TGG chr11 5168663 5168682 5168666 -
tatcttgctattagtaattg

SEQ ID NO: 55108 - DNA, 20 bp, Artificial Sequence
  Synthetic oligonucleotide; GGG chr11 5168662 5168681 5168665 -
atcttgctattagtaattgt

SEQ ID NO: 55109 - DNA, 20 bp, Artificial Sequence
  Synthetic oligonucleotide; TAG chr11 5168652 5168671 5168655 -
tagtaattgtgggatcttgc

SEQ ID NO: 55110 - DNA, 20 bp, Artificial Sequence
  Synthetic oligonucleotide; TAG chr11 5168649 5168668 5168652 -
taattgtgggatcttgctag

SEQ ID NO: 55111 - DNA, 20 bp, Artificial Sequence
  Synthetic oligonucleotide; AAG chr11 5168605 5168624 5168608 -
ttattcatttataaatgaat

SEQ ID NO: 55112 - DNA, 20 bp, Artificial Sequence
  Synthetic oligonucleotide; CAG chr11 5168591 5168610 5168594 -
atgaataagaaaataaaatc

SEQ ID NO: 55113 - DNA, 20 bp, Artificial Sequence
  Synthetic oligonucleotide; AAG chr11 5168574 5168593 5168577 -
atccagcttttatgatcttg

SEQ ID NO: 55114 - DNA, 20 bp, Artificial Sequence
  Synthetic oligonucleotide; TGG chr11 5168560 5168579 5168563 -
atcttgaagattaaatgaaa

SEQ ID NO: 55115 - DNA, 20 bp, Artificial Sequence
  Synthetic oligonucleotide; AAG chr11 5168549 5168568 5168552 -
taaatgaaatggtgcacatt

SEQ ID NO: 55116 - DNA, 20 bp, Artificial Sequence
  Synthetic oligonucleotide; TAG chr11 5168542 5168561 5168545 -
aatggtgcacattaagcaat

SEQ ID NO: 55117 - DNA, 20 bp, Artificial Sequence
  Synthetic oligonucleotide; AAG chr11 5168537 5168556 5168540 -
tgcacattaagcaattagca

SEQ ID NO: 55118 - DNA, 20 bp, Artificial Sequence
  Synthetic oligonucleotide; TAG chr11 5168530 5168549 5168533 -
taagcaattagcaaagttcc

SEQ ID NO: 55119 - DNA, 20 bp, Artificial Sequence
  Synthetic oligonucleotide; AAG chr11 5168512 5168531 5168515 -
cctagtaaaatttgctcaat

SEQ ID NO: 55120 - DNA, 20 bp, Artificial Sequence
  Synthetic oligonucleotide; AAG chr11 5168494 5168513 5168497 -
ataagtaattatattttatt

SEQ ID NO: 55121 - DNA, 20 bp, Artificial Sequence
  Synthetic oligonucleotide; CAG chr11 5168449 5168468 5168452 -
gactacaatacgtgaataca

SEQ ID NO: 55122 - DNA, 20 bp, Artificial Sequence
  Synthetic oligonucleotide; CAG chr11 5168426 5168445 5168429 -
tcaaatttcacaattcctga

SEQ ID NO: 55123 - DNA, 20 bp, Artificial Sequence
  Synthetic oligonucleotide; AAG chr11 5168397 5168416 5168400 -
taaatgctaattttaaactc

SEQ ID NO: 55124 - DNA, 20 bp, Artificial Sequence
  Synthetic oligonucleotide; AAG chr11 5168381 5168400 5168384 -
actcaagtacataaaaatta

SEQ ID NO: 55125 - DNA, 20 bp, Artificial Sequence
  Synthetic oligonucleotide; GAG chr11 5168359 5168378 5168362 -
gtcacaaatttctctgtcac

SEQ ID NO: 55126 - DNA, 20 bp, Artificial Sequence
  Synthetic oligonucleotide; TAG chr11 5168353 5168372 5168356 -
aatttctctgtcacgagcta

SEQ ID NO: 55127 - DNA, 20 bp, Artificial Sequence
  Synthetic oligonucleotide; AAG chr11 5168339 5168358 5168342 -
gagctatagtgtaccatact

SEQ ID NO: 55128 - DNA, 20 bp, Artificial Sequence
  Synthetic oligonucleotide; TAG chr11 5168327 5168346 5168330 -
accatactaagtgatttata

SEQ ID NO: 55129 - DNA, 20 bp, Artificial Sequence
  Synthetic oligonucleotide; TAG chr11 5168322 5168341 5168325 -
actaagtgatttatatagat

SEQ ID NO: 55130 - DNA, 20 bp, Artificial Sequence
  Synthetic oligonucleotide; CGG chr11 5168306 5168325 5168309 -
agattagttcatttaatcca

SEQ ID NO: 55131 - DNA, 20 bp, Artificial Sequence
  Synthetic oligonucleotide; AAG chr11 5168291 5168310 5168294 -
atccacggaacaaatatatg

SEQ ID NO: 55132 - DNA, 20 bp, Artificial Sequence
  Synthetic oligonucleotide; CAG chr11 5168281 5168300 5168284 -
caaatatatgaagaaattat

SEQ ID NO: 55133 - DNA, 20 bp, Artificial Sequence
  Synthetic oligonucleotide; TAG chr11 5168257 5168276 5168260 -
ttgtctacatgttacaaatg

SEQ ID NO: 55134 - DNA, 20 bp, Artificial Sequence
  Synthetic oligonucleotide; CAG chr11 5168251 5168270 5168254 -
acatgttacaaatgtagaaa

SEQ ID NO: 55135 - DNA, 20 bp, Artificial Sequence
  Synthetic oligonucleotide; TAG chr11 5168243 5168262 5168246 -
caaatgtagaaacagaaaca

SEQ ID NO: 55136 - DNA, 20 bp, Artificial Sequence
  Synthetic oligonucleotide; GAG chr11 5168241 5168260 5168244 -
aatgtagaaacagaaacata

SEQ ID NO: 55137 - DNA, 20 bp, Artificial Sequence
  Synthetic oligonucleotide; AAG chr11 5168238 5168257 5168241 -
gtagaaacagaaacatagag

SEQ ID NO: 55138 - DNA, 20 bp, Artificial Sequence
  Synthetic oligonucleotide; AAG chr11 5168233 5168252 5168236 -
aacagaaacatagagaagtc

SEQ ID NO: 55139 - DNA, 20 bp, Artificial Sequence
  Synthetic oligonucleotide; AAG chr11 5168218 5168237 5168221 -
aagtcaagtcatcatgcccc

SEQ ID NO: 55140 - DNA, 20 bp, Artificial Sequence
  Synthetic oligonucleotide; AAG chr11 5168212 5168231 5168215 -
agtcatcatgccccaagtca

SEQ ID NO: 55141 - DNA, 20 bp, Artificial Sequence
  Synthetic oligonucleotide; GAG chr11 5168210 5168229 5168213 -
tcatcatgccccaagtcaaa

SEQ ID NO: 55142 - DNA, 20 bp, Artificial Sequence
  Synthetic oligonucleotide; AAG chr11 5168202 5168221 5168205 -
ccccaagtcaaagagttaat

SEQ ID NO: 55143 - DNA, 20 bp, Artificial Sequence
  Synthetic oligonucleotide; TGG chr11 5168199 5168218 5168202 -
caagtcaaagagttaataag

SEQ ID NO: 55144 - DNA, 20 bp, Artificial Sequence
  Synthetic oligonucleotide; CAG chr11 5168196 5168215 5168199 -
gtcaaagagttaataagtgg

SEQ ID NO: 55145 - DNA, 20 bp, Artificial Sequence
  Synthetic oligonucleotide; CAG chr11 5168177 5168196 5168180 -
gcagaatcacaactcaaaac

SEQ ID NO: 55146 - DNA, 20 bp, Artificial Sequence
  Synthetic oligonucleotide; TAG chr11 5168148 5168167 5168151 -
caactaaaaacctgattctt

SEQ ID NO: 55147 - DNA, 20 bp, Artificial Sequence
  Synthetic oligonucleotide; CAG chr11 5168132 5168151 5168135 -
tctttagcccaccatattat

SEQ ID NO: 55148 - DNA, 20 bp, Artificial Sequence
  Synthetic oligonucleotide; TGG chr11 5168129 5168148 5168132 -
ttagcccaccatattatcag

SEQ ID NO: 55149 - DNA, 20 bp, Artificial Sequence
  Synthetic oligonucleotide; CAG chr11 5168109 5168128 5168112 -
tggtcccataacttaaaatt

SEQ ID NO: 55150 - DNA, 20 bp, Artificial Sequence
  Synthetic oligonucleotide; TGG chr11 5168091 5168110 5168094 -
ttcagatttgactttaaaat

SEQ ID NO: 55151 - DNA, 20 bp, Artificial Sequence
  Synthetic oligonucleotide; AAG chr11 5168082 5168101 5168085 -
gactttaaaattggaatctg

SEQ ID NO: 55152 - DNA, 20 bp, Artificial Sequence
  Synthetic oligonucleotide; AAG chr11 5168073 5168092 5168076 -
attggaatctgaagaacacc

SEQ ID NO: 55153 - DNA, 20 bp, Artificial Sequence
  Synthetic oligonucleotide; GAG chr11 5168044 5168063 5168047 -
tgtaaaccattttctccttt

SEQ ID NO: 55154 - DNA, 20 bp, Artificial Sequence
  Synthetic oligonucleotide; GAG chr11 5168035 5168054 5168038 -
ttttctcctttgagattcat

SEQ ID NO: 55155 - DNA, 20 bp, Artificial Sequence
  Synthetic oligonucleotide; AGG chr11 5168034 5168053 5168037 -
tttctcctttgagattcatg

SEQ ID NO: 55156 - DNA, 20 bp, Artificial Sequence
  Synthetic oligonucleotide; TAG chr11 5167998 5168017 5168001 -
acctctgtttcctctaatta

SEQ ID NO: 55157 - DNA, 20 bp, Artificial Sequence
  Synthetic oligonucleotide; AAG chr11 5167975 5167994 5167978 -
tcatatattaataatgtata

SEQ ID NO: 55158 - DNA, 20 bp, Artificial Sequence
  Synthetic oligonucleotide; AGG chr11 5167974 5167993 5167977 -
catatattaataatgtataa

SEQ ID NO: 55159 - DNA, 20 bp, Artificial Sequence
  Synthetic oligonucleotide; AAG chr11 5167964 5167983 5167967 -
taatgtataaaggttttctc

SEQ ID NO: 55160 - DNA, 20 bp, Artificial Sequence
  Synthetic oligonucleotide; GAG chr11 5167962 5167981 5167965 -
atgtataaaggttttctcaa

SEQ ID NO: 55161 - DNA, 20 bp, Artificial Sequence
  Synthetic oligonucleotide; AGG chr11 5167961 5167980 5167964 -
tgtataaaggttttctcaag

SEQ ID NO: 55162 - DNA, 20 bp, Artificial Sequence
  Synthetic oligonucleotide; AAG chr11 5167948 5167967 5167951 -
tctcaagaggatctttataa

SEQ ID NO: 55163 - DNA, 20 bp, Artificial Sequence
  Synthetic oligonucleotide; AGG chr11 5167947 5167966 5167950 -
ctcaagaggatctttataaa

SEQ ID NO: 55164 - DNA, 20 bp, Artificial Sequence
  Synthetic oligonucleotide; GGG chr11 5167946 5167965 5167949 -
tcaagaggatctttataaaa

SEQ ID NO: 55165 - DNA, 20 bp, Artificial Sequence
  Synthetic oligonucleotide; GGG chr11 5167945 5167964 5167948 -
caagaggatctttataaaag

SEQ ID NO: 55166 - DNA, 20 bp, Artificial Sequence
  Synthetic oligonucleotide; TAG chr11 5167931 5167950 5167934 -
taaaaggggccttcccacat

SEQ ID NO: 55167 - DNA, 20 bp, Artificial Sequence
  Synthetic oligonucleotide; TAG chr11 5167918 5167937 5167921 -
cccacattagtttaactgct

SEQ ID NO: 55168 - DNA, 20 bp, Artificial Sequence
  Synthetic oligonucleotide; AGG chr11 5167917 5167936 5167920 -
ccacattagtttaactgctt

SEQ ID NO: 55169 - DNA, 20 bp, Artificial Sequence
  Synthetic oligonucleotide; TAG chr11 5167879 5167898 5167882 -
acttcctcaaccaacacttt

SEQ ID NO: 55170 - DNA, 20 bp, Artificial Sequence
  Synthetic oligonucleotide; AAG chr11 5167865 5167884 5167868 -
cacttttagaactatcatct

SEQ ID NO: 55171 - DNA, 20 bp, Artificial Sequence
  Synthetic oligonucleotide; CGG chr11 5167855 5167874 5167858 -
actatcatctaagattacat

SEQ ID NO: 55172 - DNA, 20 bp, Artificial Sequence
  Synthetic oligonucleotide; AAG chr11 5167814 5167833 5167817 -
acaataaataaatacttttt

SEQ ID NO: 55173 - DNA, 20 bp, Artificial Sequence
  Synthetic oligonucleotide; CAG chr11 5167810 5167829 5167813 -
taaataaatactttttaagc

SEQ ID NO: 55174 - DNA, 20 bp, Artificial Sequence
  Synthetic oligonucleotide; AAG chr11 5167762 5167781 5167765 -
tattacatattattcattct

SEQ ID NO: 55175 - DNA, 20 bp, Artificial Sequence
  Synthetic oligonucleotide; TAG chr11 5167757 5167776 5167760 -
catattattcattctaagtg

SEQ ID NO: 55176 - DNA, 20 bp, Artificial Sequence
  Synthetic oligonucleotide; TAG chr11 5167751 5167770 5167754 -
attcattctaagtgtagtcc

SEQ ID NO: 55177 - DNA, 20 bp, Artificial Sequence
  Synthetic oligonucleotide; TAG chr11 5167745 5167764 5167748 -
tctaagtgtagtcctagata

SEQ ID NO: 55178 - DNA, 20 bp, Artificial Sequence
  Synthetic oligonucleotide; TAG chr11 5167742 5167761 5167745 -
aagtgtagtcctagatatag

SEQ ID NO: 55179 - DNA, 20 bp, Artificial Sequence
  Synthetic oligonucleotide; GAG chr11 5167740 5167759 5167743 -
gtgtagtcctagatatagta

SEQ ID NO: 55180 - DNA, 20 bp, Artificial Sequence
  Synthetic oligonucleotide; AAG chr11 5167728 5167747 5167731 -
atatagtagagtactacgcc

SEQ ID NO: 55181 - DNA, 20 bp, Artificial Sequence
  Synthetic oligonucleotide; CAG chr11 5167721 5167740 5167724 -
agagtactacgccaagacat

SEQ ID NO: 55182 - DNA, 20 bp, Artificial Sequence
  Synthetic oligonucleotide; AGG chr11 5167720 5167739 5167723 -
gagtactacgccaagacatc

SEQ ID NO: 55183 - DNA, 20 bp, Artificial Sequence
  Synthetic oligonucleotide; AAG chr11 5167715 5167734 5167718 -
ctacgccaagacatcaggtc

SEQ ID NO: 55184 - DNA, 20 bp, Artificial Sequence
  Synthetic oligonucleotide; AGG chr11 5167714 5167733 5167717 -
tacgccaagacatcaggtca

SEQ ID NO: 55185 - DNA, 20 bp, Artificial Sequence
  Synthetic oligonucleotide; AAG chr11 5167706 5167725 5167709 -
gacatcaggtcaaggacaaa

SEQ ID NO: 55186 - DNA, 20 bp, Artificial Sequence
  Synthetic oligonucleotide; AAG chr11 5167693 5167712 5167696 -
ggacaaaaagatgatcctaa

SEQ ID NO: 55187 - DNA, 20 bp, Artificial Sequence
  Synthetic oligonucleotide; CAG chr11 5167690 5167709 5167693 -
caaaaagatgatcctaaaag

SEQ ID NO: 55188 - DNA, 20 bp, Artificial Sequence
  Synthetic oligonucleotide; AAG chr11 5167687 5167706 5167690 -
aaagatgatcctaaaagcag

SEQ ID NO: 55189 - DNA, 20 bp, Artificial Sequence
  Synthetic oligonucleotide; GAG chr11 5167685 5167704 5167688 -
agatgatcctaaaagcagaa

SEQ ID NO: 55190 - DNA, 20 bp, Artificial Sequence
  Synthetic oligonucleotide; GAG chr11 5167680 5167699 5167683 -
atcctaaaagcagaagagat

SEQ ID NO: 55191 - DNA, 20 bp, Artificial Sequence
  Synthetic oligonucleotide; TAG chr11 5167670 5167689 5167673 -
cagaagagatgagaaacaaa

SEQ ID NO: 55192 - DNA, 20 bp, Artificial Sequence
  Synthetic oligonucleotide; AAG chr11 5167661 5167680 5167664 -
tgagaaacaaatagcatata

SEQ ID NO: 55193 - DNA, 20 bp, Artificial Sequence
  Synthetic oligonucleotide; AGG chr11 5167660 5167679 5167663 -
gagaaacaaatagcatataa

SEQ ID NO: 55194 - DNA, 20 bp, Artificial Sequence
  Synthetic oligonucleotide; GAG chr11 5167658 5167677 5167661 -
gaaacaaatagcatataaag

SEQ ID NO: 55195 - DNA, 20 bp, Artificial Sequence
  Synthetic oligonucleotide; TAG chr11 5167625 5167644 5167628 -
tgtgacaacaaacatctcaa

SEQ ID NO: 55196 - DNA, 20 bp, Artificial Sequence
  Synthetic oligonucleotide; CAG chr11 5167614 5167633 5167617 -
acatctcaatagaaatcaca

SEQ ID NO: 55197 - DNA, 20 bp, Artificial Sequence
  Synthetic oligonucleotide; AAG chr11 5167608 5167627 5167611 -
caatagaaatcacacagtcc

SEQ ID NO: 55198 - DNA, 20 bp, Artificial Sequence
  Synthetic oligonucleotide; GAG chr11 5167606 5167625 5167609 -
atagaaatcacacagtccaa

SEQ ID NO: 55199 - DNA, 20 bp, Artificial Sequence
  Synthetic oligonucleotide; GAG chr11 5167604 5167623 5167607 -
agaaatcacacagtccaaga

SEQ ID NO: 55200 - DNA, 20 bp, Artificial Sequence
  Synthetic oligonucleotide; GAG chr11 5167602 5167621 5167605 -
aaatcacacagtccaagaga

SEQ ID NO: 55201 - DNA, 20 bp, Artificial Sequence
  Synthetic oligonucleotide; AAG chr11 5167583 5167602 5167586 -
agagtcgaatgaaattttca

SEQ ID NO: 55202 - DNA, 20 bp, Artificial Sequence
  Synthetic oligonucleotide; CAG chr11 5167576 5167595 5167579 -
aatgaaattttcaaagcgct

SEQ ID NO: 55203 - DNA, 20 bp, Artificial Sequence
  Synthetic oligonucleotide; AGG chr11 5167575 5167594 5167578 -
atgaaattttcaaagcgctc

SEQ ID NO: 55204 - DNA, 20 bp, Artificial Sequence
  Synthetic oligonucleotide; GGG chr11 5167574 5167593 5167577 -
tgaaattttcaaagcgctca

SEQ ID NO: 55205 - DNA, 20 bp, Artificial Sequence
  Synthetic oligonucleotide; AAG chr11 5167567 5167586 5167570 -
ttcaaagcgctcagggataa

SEQ ID NO: 55206 - DNA, 20 bp, Artificial Sequence
  Synthetic oligonucleotide; AAG chr11 5167551 5167570 5167554 -
ataaaagaaaactgatattc

SEQ ID NO: 55207 - DNA, 20 bp, Artificial Sequence
  Synthetic oligonucleotide; TAG chr11 5167539 5167558 5167542 -
tgatattcaagaatatttta

SEQ ID NO: 55208 - DNA, 20 bp, Artificial Sequence
  Synthetic oligonucleotide; AGG chr11 5167538 5167557 5167541 -
gatattcaagaatattttat

SEQ ID NO: 55209 - DNA, 20 bp, Artificial Sequence
  Synthetic oligonucleotide; GGG chr11 5167537 5167556 5167540 -
atattcaagaatattttata

SEQ ID NO: 55210 - DNA, 20 bp, Artificial Sequence
  Synthetic oligonucleotide; AAG chr11 5167514 5167533 5167517 -
taaaactgttattcaaatat

SEQ ID NO: 55211 - DNA, 20 bp, Artificial Sequence
  Synthetic oligonucleotide; AAG chr11 5167502 5167521 5167505 -
tcaaatataagcaatatata

SEQ ID NO: 55212 - DNA, 20 bp, Artificial Sequence
  Synthetic oligonucleotide; CAG chr11 5167492 5167511 5167495 -
gcaatatataaagtctttcc

SEQ ID NO: 55213 - DNA, 20 bp, Artificial Sequence
  Synthetic oligonucleotide; AAG chr11 5167481 5167500 5167484 -
agtctttcccagacaaacaa

SEQ ID NO: 55214 - DNA, 20 bp, Artificial Sequence
  Synthetic oligonucleotide; GAG chr11 5167476 5167495 5167479 -
ttcccagacaaacaaaagtt

SEQ ID NO: 55215 - DNA, 20 bp, Artificial Sequence
  Synthetic oligonucleotide; GAG chr11 5167474 5167493 5167477 -
cccagacaaacaaaagttga

SEQ ID NO: 55216 - DNA, 20 bp, Artificial Sequence
  Synthetic oligonucleotide; CAG chr11 5167458 5167477 5167461 -
ttgagagaattcaccaacac

SEQ ID NO: 55217 - DNA, 20 bp, Artificial Sequence
  Synthetic oligonucleotide; AAG chr11 5167434 5167453 5167437 -
ccatcttgcaaaaaatgcta

SEQ ID NO: 55218 - DNA, 20 bp, Artificial Sequence
  Synthetic oligonucleotide; AGG chr11 5167433 5167452 5167436 -
catcttgcaaaaaatgctaa

SEQ ID NO: 55219 - DNA, 20 bp, Artificial Sequence
  Synthetic oligonucleotide; GGG chr11 5167432 5167451 5167435 -
atcttgcaaaaaatgctaaa

SEQ ID NO: 55220 - DNA, 20 bp, Artificial Sequence
  Synthetic oligonucleotide; GAG chr11 5167430 5167449 5167433 -
cttgcaaaaaatgctaaagg

SEQ ID NO: 55221 - DNA, 20 bp, Artificial Sequence
  Synthetic oligonucleotide; AAG chr11 5167414 5167433 5167417 -
aagggagttatgcaatctga

SEQ ID NO: 55222 - DNA, 20 bp, Artificial Sequence
  Synthetic oligonucleotide; AAG chr11 5167407 5167426 5167410 -
ttatgcaatctgaaagaaaa

SEQ ID NO: 55223 - DNA, 20 bp, Artificial Sequence
  Synthetic oligonucleotide; AAG chr11 5167390 5167409 5167393 -
aaaaagacattaacatgcaa

SEQ ID NO: 55224 - DNA, 20 bp, Artificial Sequence
  Synthetic oligonucleotide; AAG chr11 5167376 5167395 5167379 -
atgcaaaagaaaacttttca

SEQ ID NO: 55225 - DNA, 20 bp, Artificial Sequence
  Synthetic oligonucleotide; TGG chr11 5167361 5167380 5167364 -
tttcaaagtatgaaacccac

SEQ ID NO: 55226 - DNA, 20 bp, Artificial Sequence
  Synthetic oligonucleotide; AAG chr11 5167351 5167370 5167354 -
tgaaacccactggtaaaatt

SEQ ID NO: 55227 - DNA, 20 bp, Artificial Sequence
  Synthetic oligonucleotide; TAG chr11 5167344 5167363 5167347 -
cactggtaaaattaagtaca

SEQ ID NO: 55228 - DNA, 20 bp, Artificial Sequence
  Synthetic oligonucleotide; TAG chr11 5167334 5167353 5167337 -
attaagtacatagacaaacc

SEQ ID NO: 55229 - DNA, 20 bp, Artificial Sequence
  Synthetic oligonucleotide; TGG chr11 5167309 5167328 5167312 -
taccccattactgtattttt

SEQ ID NO: 55230 - DNA, 20 bp, Artificial Sequence
  Synthetic oligonucleotide; CAG chr11 5167293 5167312 5167296 -
tttttggtgtgcaatccaca

SEQ ID NO: 55231 - DNA, 20 bp, Artificial Sequence
  Synthetic oligonucleotide; CAG chr11 5167285 5167304 5167288 -
gtgcaatccacacagaactc

SEQ ID NO: 55232 - DNA, 20 bp, Artificial Sequence
  Synthetic oligonucleotide; CAG chr11 5167251 5167270 5167254 -
aaaaacaaatctttcaaaaa

SEQ ID NO: 55233 - DNA, 20 bp, Artificial Sequence
  Synthetic oligonucleotide; TAG chr11 5167245 5167264 5167248 -
aaatctttcaaaaacagtaa

SEQ ID NO: 55234 - DNA, 20 bp, Artificial Sequence
  Synthetic oligonucleotide; TAG chr11 5167239 5167258 5167242 -
ttcaaaaacagtaatagcta

SEQ ID NO: 55235 - DNA, 20 bp, Artificial Sequence
  Synthetic oligonucleotide; AAG chr11 5167227 5167246 5167230 -
aatagctatagcaacctttt

SEQ ID NO: 55236 - DNA, 20 bp, Artificial Sequence
  Synthetic oligonucleotide; TAG chr11 5167221 5167240 5167224 -
tatagcaaccttttaagatg

SEQ ID NO: 55237 - DNA, 20 bp, Artificial Sequence
  Synthetic oligonucleotide; AGG chr11 5167220 5167239 5167223 -
atagcaaccttttaagatgt

SEQ ID NO: 55238 - DNA, 20 bp, Artificial Sequence
  Synthetic oligonucleotide; GAG chr11 5167197 5167216 5167200 -
taatataaaatatgtaaaat

SEQ ID NO: 55239 - DNA, 20 bp, Artificial Sequence
  Synthetic oligonucleotide; AAG chr11 5167190 5167209 5167193 -
aaatatgtaaaatgagacaa

SEQ ID NO: 55240 - DNA, 20 bp, Artificial Sequence
  Synthetic oligonucleotide; TGG chr11 5167179 5167198 5167182 -
atgagacaaaagtcaaaatg

SEQ ID NO: 55241 - DNA, 20 bp, Artificial Sequence
  Synthetic oligonucleotide; GGG chr11 5167178 5167197 5167181 -
tgagacaaaagtcaaaatgt

SEQ ID NO: 55242 - DNA, 20 bp, Artificial Sequence
  Synthetic oligonucleotide; GGG chr11 5167177 5167196 5167180 -
gagacaaaagtcaaaatgtg

SEQ ID NO: 55243 - DNA, 20 bp, Artificial Sequence
  Synthetic oligonucleotide; GGG chr11 5167176 5167195 5167179 -
agacaaaagtcaaaatgtgg

SEQ ID NO: 55244 - DNA, 20 bp, Artificial Sequence
  Synthetic oligonucleotide; TGG chr11 5167173 5167192 5167176 -
caaaagtcaaaatgtggggg

SEQ ID NO: 55245 - DNA, 20 bp, Artificial Sequence
  Synthetic oligonucleotide; GAG chr11 5167171 5167190 5167174 -
aaagtcaaaatgtgggggtg

SEQ ID NO: 55246 - DNA, 20 bp, Artificial Sequence
  Synthetic oligonucleotide; TGG chr11 5167168 5167187 5167171 -
gtcaaaatgtgggggtggag

SEQ ID NO: 55247 - DNA, 20 bp, Artificial Sequence
  Synthetic oligonucleotide; GAG chr11 5167166 5167185 5167169 -
caaaatgtgggggtggagtg

SEQ ID NO: 55248 - DNA, 20 bp, Artificial Sequence
  Synthetic oligonucleotide; AAG chr11 5167160 5167179 5167163 -
gtgggggtggagtggagtta

SEQ ID NO: 55249 - DNA, 20 bp, Artificial Sequence
  Synthetic oligonucleotide; TAG chr11 5167155 5167174 5167158 -
ggtggagtggagttaaagtg

SEQ ID NO: 55250 - DNA, 20 bp, Artificial Sequence
  Synthetic oligonucleotide; AAG chr11 5167102 5167121 5167105 -
tattcctttatttgcgatct

SEQ ID NO: 55251 - DNA, 20 bp, Artificial Sequence
  Synthetic oligonucleotide; AAG chr11 5167061 5167080 5167064 -
aaataacttgctatatttat

SEQ ID NO: 55252 - DNA, 20 bp, Artificial Sequence
  Synthetic oligonucleotide; AAG chr11 5167047 5167066 5167050 -
atttataagatgtttcttgt

SEQ ID NO: 55253 - DNA, 20 bp, Artificial Sequence
  Synthetic oligonucleotide; TGG chr11 5167039 5167058 5167042 -
gatgtttcttgtaagcccca

SEQ ID NO: 55254 - DNA, 20 bp, Artificial Sequence
  Synthetic oligonucleotide; CAG chr11 5167030 5167049 5167033 -
tgtaagccccatggtaacca

SEQ ID NO: 55255 - DNA, 20 bp, Artificial Sequence
  Synthetic oligonucleotide; TAG chr11 5167012 5167031 5167015 -
cacagcacaaaaatctataa

SEQ ID NO: 55256 - DNA, 20 bp, Artificial Sequence
  Synthetic oligonucleotide; AAG chr11 5166993 5167012 5166996 -
atagatttactaaaaataaa

SEQ ID NO: 55257 - DNA, 20 bp, Artificial Sequence
  Synthetic oligonucleotide; CAG chr11 5166969 5166988 5166972 -
aacaaattaaaatatgctac

SEQ ID NO: 55258 - DNA, 20 bp, Artificial Sequence
  Synthetic oligonucleotide; GAG chr11 5166967 5166986 5166970 -
caaattaaaatatgctacca

SEQ ID NO: 55259 - DNA, 20 bp, Artificial Sequence
  Synthetic oligonucleotide; AAG chr11 5166947 5166966 5166950 -
gagataatcacataaccatg

SEQ ID NO: 55260 - DNA, 20 bp, Artificial Sequence
  Synthetic oligonucleotide; AGG chr11 5166946 5166965 5166949 -
agataatcacataaccatga

SEQ ID NO: 55261 - DNA, 20 bp, Artificial Sequence
  Synthetic oligonucleotide; AAG chr11 5166937 5166956 5166940 -
cataaccatgaaggaaaaaa

SEQ ID NO: 55262 - DNA, 20 bp, Artificial Sequence
  Synthetic oligonucleotide; AGG chr11 5166936 5166955 5166939 -
ataaccatgaaggaaaaaaa

SEQ ID NO: 55263 - DNA, 20 bp, Artificial Sequence
  Synthetic oligonucleotide; AAG chr11 5166933 5166952 5166936 -
accatgaaggaaaaaaaagg

SEQ ID NO: 55264 - DNA, 20 bp, Artificial Sequence
  Synthetic oligonucleotide; GAG chr11 5166931 5166950 5166934 -
catgaaggaaaaaaaaggaa

SEQ ID NO: 55265 - DNA, 20 bp, Artificial Sequence
  Synthetic oligonucleotide; GAG chr11 5166929 5166948 5166932 -
tgaaggaaaaaaaaggaaga

SEQ ID NO: 55266 - DNA, 20 bp, Artificial Sequence
  Synthetic oligonucleotide; AGG chr11 5166928 5166947 5166931 -
gaaggaaaaaaaaggaagag

SEQ ID NO: 55267 - DNA, 20 bp, Artificial Sequence
  Synthetic oligonucleotide; GAG chr11 5166926 5166945 5166929 -
aggaaaaaaaaggaagagag

SEQ ID NO: 55268 - DNA, 20 bp, Artificial Sequence
  Synthetic oligonucleotide; CAG chr11 5166915 5166934 5166918 -
ggaagagaggagtctccata

SEQ ID NO: 55269 - DNA, 20 bp, Artificial Sequence
  Synthetic oligonucleotide; AAG chr11 5166904 5166923 5166907 -
gtctccatacagccaaaaat

SEQ ID NO: 55270 - DNA, 20 bp, Artificial Sequence
  Synthetic oligonucleotide; AAG chr11 5166877 5166896 5166880 -
aaaaaaaaaaaaaaaaaaaa

SEQ ID NO: 55271 - DNA, 20 bp, Artificial Sequence
  Synthetic oligonucleotide; AGG chr11 5166876 5166895 5166879 -
aaaaaaaaaaaaaaaaaaaa

SEQ ID NO: 55272 - DNA, 20 bp, Artificial Sequence
  Synthetic oligonucleotide; TAG chr11 5166862 5166881 5166865 -
aaaaaaaggaaatccttact

SEQ ID NO: 55273 - DNA, 20 bp, Artificial Sequence
  Synthetic oligonucleotide; GAG chr11 5166849 5166868 5166852 -
ccttacttagtaactacact

SEQ ID NO: 55274 - DNA, 20 bp, Artificial Sequence
  Synthetic oligonucleotide; TAG chr11 5166840 5166859 5166843 -
gtaactacactgagtgtaaa

SEQ ID NO: 55275 - DNA, 20 bp, Artificial Sequence
  Synthetic oligonucleotide; CAG chr11 5166834 5166853 5166837 -
acactgagtgtaaatagtct

SEQ ID NO: 55276 - DNA, 20 bp, Artificial Sequence
  Synthetic oligonucleotide; AAG chr11 5166819 5166838 5166822 -
agtctcagttccccaattaa

SEQ ID NO: 55277 - DNA, 20 bp, Artificial Sequence
  Synthetic oligonucleotide; TAG chr11 5166813 5166832 5166816 -
agttccccaattaaaagtaa

SEQ ID NO: 55278 - DNA, 20 bp, Artificial Sequence
  Synthetic oligonucleotide; TGG chr11 5166808 5166827 5166811 -
cccaattaaaagtaatagaa

SEQ ID NO: 55279 - DNA, 20 bp, Artificial Sequence
  Synthetic oligonucleotide; TGG chr11 5166801 5166820 5166804 -
aaaagtaatagaatggtaaa

SEQ ID NO: 55280 - DNA, 20 bp, Artificial Sequence
  Synthetic oligonucleotide; AAG chr11 5166795 5166814 5166798 -
aatagaatggtaaatggata

SEQ ID NO: 55281 - DNA, 20 bp, Artificial Sequence
  Synthetic oligonucleotide; AAG chr11 5166764 5166783 5166767 -
tccaactttatgcgatcttc

SEQ ID NO: 55282 - DNA, 20 bp, Artificial Sequence
  Synthetic oligonucleotide; AAG chr11 5166743 5166762 5166746 -
agaaacccacttcacctata

SEQ ID NO: 55283 - DNA, 20 bp, Artificial Sequence
  Synthetic oligonucleotide; AGG chr11 5166742 5166761 5166745 -
gaaacccacttcacctataa

SEQ ID NO: 55284 - DNA, 20 bp, Artificial Sequence
  Synthetic oligonucleotide; AAG chr11 5166726 5166745 5166729 -
ataaaggcacacataaatga

SEQ ID NO: 55285 - DNA, 20 bp, Artificial Sequence
  Synthetic oligonucleotide; AAG chr11 5166721 5166740 5166724 -
ggcacacataaatgaaagtg

SEQ ID NO: 55286 - DNA, 20 bp, Artificial Sequence
  Synthetic oligonucleotide; AGG chr11 5166720 5166739 5166723 -
gcacacataaatgaaagtga

SEQ ID NO: 55287 - DNA, 20 bp, Artificial Sequence
  Synthetic oligonucleotide; GGG chr11 5166719 5166738 5166722 -
cacacataaatgaaagtgaa

SEQ ID NO: 55288 - DNA, 20 bp, Artificial Sequence
  Synthetic oligonucleotide; TGG chr11 5166715 5166734 5166718 -
cataaatgaaagtgaagggt

SEQ ID NO: 55289 - DNA, 20 bp, Artificial Sequence
  Synthetic oligonucleotide; TGG chr11 5166695 5166714 5166698 -
tggaaaaaaattccatgaac

SEQ ID NO: 55290 - DNA, 20 bp, Artificial Sequence
  Synthetic oligonucleotide; CAG chr11 5166688 5166707 5166691 -
aaattccatgaactggaaac

SEQ ID NO: 55291 - DNA, 20 bp, Artificial Sequence
  Synthetic oligonucleotide; AAG chr11 5166684 5166703 5166687 -
tccatgaactggaaaccaga

SEQ ID NO: 55292 - DNA, 20 bp, Artificial Sequence
  Synthetic oligonucleotide; GAG chr11 5166682 5166701 5166685 -
catgaactggaaaccagaaa

SEQ ID NO: 55293 - DNA, 20 bp, Artificial Sequence
  Synthetic oligonucleotide; CAG chr11 5166679 5166698 5166682 -
gaactggaaaccagaaagag

SEQ ID NO: 55294 - DNA, 20 bp, Artificial Sequence
  Synthetic oligonucleotide; TAG chr11 5166676 5166695 5166679 -
ctggaaaccagaaagagcag

SEQ ID NO: 55295 - DNA, 20 bp, Artificial Sequence
  Synthetic oligonucleotide; CAG chr11 5166658 5166677 5166661 -
agtagtaattgtacttaaat

SEQ ID NO: 55296 - DNA, 20 bp, Artificial Sequence
  Synthetic oligonucleotide; TAG chr11 5166649 5166668 5166652 -
tgtacttaaatcagataaaa

SEQ ID NO: 55297 - DNA, 20 bp, Artificial Sequence
  Synthetic oligonucleotide; AAG chr11 5166626 5166645 5166629 -
actacaaatttaaaaactgt

SEQ ID NO: 55298 - DNA, 20 bp, Artificial Sequence
  Synthetic oligonucleotide; AAG chr11 5166621 5166640 5166624 -
aaatttaaaaactgtaagaa

SEQ ID NO: 55299 - DNA, 20 bp, Artificial Sequence
  Synthetic oligonucleotide; AAG chr11 5166616 5166635 5166619 -
taaaaactgtaagaaaagat

SEQ ID NO: 55300 - DNA, 20 bp, Artificial Sequence
  Synthetic oligonucleotide; AGG chr11 5166615 5166634 5166618 -
aaaaactgtaagaaaagata

SEQ ID NO: 55301 - DNA, 20 bp, Artificial Sequence
  Synthetic oligonucleotide; GAG chr11 5166613 5166632 5166616 -
aaactgtaagaaaagataag

SEQ ID NO: 55302 - DNA, 20 bp, Artificial Sequence
  Synthetic oligonucleotide; AGG chr11 5166612 5166631 5166615 -
aactgtaagaaaagataagg

SEQ ID NO: 55303 - DNA, 20 bp, Artificial Sequence
  Synthetic oligonucleotide; GGG chr11 5166611 5166630 5166614 -
actgtaagaaaagataagga

SEQ ID NO: 55304 - DNA, 20 bp, Artificial Sequence
  Synthetic oligonucleotide; AAG chr11 5166592 5166611 5166595 -
agggtcactgtataataata

SEQ ID NO: 55305 - DNA, 20 bp, Artificial Sequence
  Synthetic oligonucleotide; AGG chr11 5166591 5166610 5166594 -
gggtcactgtataataataa

SEQ ID NO: 55306 - DNA, 20 bp, Artificial Sequence
  Synthetic oligonucleotide; GGG chr11 5166590 5166609 5166593 -
ggtcactgtataataataaa

SEQ ID NO: 55307 - DNA, 20 bp, Artificial Sequence
  Synthetic oligonucleotide; GGG chr11 5166589 5166608 5166592 -
gtcactgtataataataaag

SEQ ID NO: 55308 - DNA, 20 bp, Artificial Sequence
  Synthetic oligonucleotide; CAG chr11 5166580 5166599 5166583 -
taataataaaggggtcaatt

SEQ ID NO: 55309 - DNA, 20 bp, Artificial Sequence
  Synthetic oligonucleotide; AAG chr11 5166576 5166595 5166579 -
aataaaggggtcaattcagc

SEQ ID NO: 55310 - DNA, 20 bp, Artificial Sequence
  Synthetic oligonucleotide; GAG chr11 5166574 5166593 5166577 -
taaaggggtcaattcagcaa

SEQ ID NO: 55311 - DNA, 20 bp, Artificial Sequence
  Synthetic oligonucleotide; AGG chr11 5166573 5166592 5166576 -
aaaggggtcaattcagcaag

SEQ ID NO: 55312 - DNA, 20 bp, Artificial Sequence
  Synthetic oligonucleotide; AAG chr11 5166537 5166556 5166540 -
tattgatgtatccaacatca

SEQ ID NO: 55313 - DNA, 20 bp, Artificial Sequence
  Synthetic oligonucleotide; AAG chr11 5166529 5166548 5166532 -
tatccaacatcaaagttccc

SEQ ID NO: 55314 - DNA, 20 bp, Artificial Sequence
  Synthetic oligonucleotide; AAG chr11 5166521 5166540 5166524 -
atcaaagttcccaagtatat

SEQ ID NO: 55315 - DNA, 20 bp, Artificial Sequence
  Synthetic oligonucleotide; AGG chr11 5166520 5166539 5166523 -
tcaaagttcccaagtatata

SEQ ID NO: 55316 - DNA, 20 bp, Artificial Sequence
  Synthetic oligonucleotide; TAG chr11 5166507 5166526 5166510 -
gtatataaggaaaacattaa

SEQ ID NO: 55317 - DNA, 20 bp, Artificial Sequence
  Synthetic oligonucleotide; AAG chr11 5166499 5166518 5166502 -
ggaaaacattaatagtccta

SEQ ID NO: 55318 - DNA, 20 bp, Artificial Sequence
  Synthetic oligonucleotide; AGG chr11 5166498 5166517 5166501 -
gaaaacattaatagtcctaa

SEQ ID NO: 55319 - DNA, 20 bp, Artificial Sequence
  Synthetic oligonucleotide; GGG chr11 5166497 5166516 5166500 -
aaaacattaatagtcctaaa

SEQ ID NO: 55320 - DNA, 20 bp, Artificial Sequence
  Synthetic oligonucleotide; GAG chr11 5166493 5166512 5166496 -
cattaatagtcctaaagggc

SEQ ID NO: 55321 - DNA, 20 bp, Artificial Sequence
  Synthetic oligonucleotide; CAG chr11 5166489 5166508 5166492 -
aatagtcctaaagggcgaga

SEQ ID NO: 55322 - DNA, 20 bp, Artificial Sequence
  Synthetic oligonucleotide; TAG chr11 5166471 5166490 5166474 -
gacagactgcaatacaataa

SEQ ID NO: 55323 - DNA, 20 bp, Artificial Sequence
  Synthetic oligonucleotide; TAG chr11 5166468 5166487 5166471 -
agactgcaatacaataatag

SEQ ID NO: 55324 - DNA, 20 bp, Artificial Sequence
  Synthetic oligonucleotide; AGG chr11 5166467 5166486 5166470 -
gactgcaatacaataatagt

SEQ ID NO: 55325 - DNA, 20 bp, Artificial Sequence
  Synthetic oligonucleotide; GGG chr11 5166466 5166485 5166469 -
actgcaatacaataatagta

SEQ ID NO: 55326 - DNA, 20 bp, Artificial Sequence
  Synthetic oligonucleotide; CAG chr11 5166449 5166468 5166452 -
gtagggaactttaaacactt

SEQ ID NO: 55327 - DNA, 20 bp, Artificial Sequence
  Synthetic oligonucleotide; CAG chr11 5166443 5166462 5166446 -
aactttaaacacttcagtct

SEQ ID NO: 55328 - DNA, 20 bp, Artificial Sequence
  Synthetic oligonucleotide; CAG chr11 5166433 5166452 5166436 -
acttcagtctcagtaatgaa

SEQ ID NO: 55329 - DNA, 20 bp, Artificial Sequence
  Synthetic oligonucleotide; CGG chr11 5166428 5166447 5166431 -
agtctcagtaatgaacagat

SEQ ID NO: 55330 - DNA, 20 bp, Artificial Sequence
  Synthetic oligonucleotide; CAG chr11 5166424 5166443 5166427 -
tcagtaatgaacagatcggc

SEQ ID NO: 55331 - DNA, 20 bp, Artificial Sequence
  Synthetic oligonucleotide; CAG chr11 5166396 5166415 5166399 -
aaatcaacaaatgaacaaca

SEQ ID NO: 55332 - DNA, 20 bp, Artificial Sequence
  Synthetic oligonucleotide; TAG chr11 5166371 5166390 5166374 -
aatgtacccactatatctaa

SEQ ID NO: 55333 - DNA, 20 bp, Artificial Sequence
  Synthetic oligonucleotide; CAG chr11 5166352 5166371 5166355 -
atagacccaactgacattaa

SEQ ID NO: 55334 - DNA, 20 bp, Artificial Sequence
  Synthetic oligonucleotide; AAG chr11 5166329 5166348 5166332 -
aacttgtcccccaactgctg

SEQ ID NO: 55335 - DNA, 20 bp, Artificial Sequence
  Synthetic oligonucleotide; AAG chr11 5166326 5166345 5166329 -
ttgtcccccaactgctgaag

SEQ ID NO: 55336 - DNA, 20 bp, Artificial Sequence
  Synthetic oligonucleotide; AAG chr11 5166310 5166329 5166313 -
gaagaagatacatttcttta

SEQ ID NO: 55337 - DNA, 20 bp, Artificial Sequence
  Synthetic oligonucleotide; CAG chr11 5166307 5166326 5166310 -
gaagatacatttctttaaag

SEQ ID NO: 55338 - DNA, 20 bp, Artificial Sequence
  Synthetic oligonucleotide; AAG chr11 5166282 5166301 5166285 -
tgtacaacattttcctaaat

SEQ ID NO: 55339 - DNA, 20 bp, Artificial Sequence
  Synthetic oligonucleotide; AGG chr11 5166281 5166300 5166284 -
gtacaacattttcctaaata

SEQ ID NO: 55340 - DNA, 20 bp, Artificial Sequence
  Synthetic oligonucleotide; TAG chr11 5166270 5166289 5166273 -
tcctaaataaggccatatgt

SEQ ID NO: 55341 - DNA, 20 bp, Artificial Sequence
  Synthetic oligonucleotide; AGG chr11 5166269 5166288 5166272 -
cctaaataaggccatatgtt

SEQ ID NO: 55342 - DNA, 20 bp, Artificial Sequence
  Synthetic oligonucleotide; AAG chr11 5166262 5166281 5166265 -
aaggccatatgttaggccac

SEQ ID NO: 55343 - DNA, 20 bp, Artificial Sequence
  Synthetic oligonucleotide; AGG chr11 5166261 5166280 5166264 -
aggccatatgttaggccaca

SEQ ID NO: 55344 - DNA, 20 bp, Artificial Sequence
  Synthetic oligonucleotide; AAG chr11 5166257 5166276 5166260 -
catatgttaggccacaaggt

SEQ ID NO: 55345 - DNA, 20 bp, Artificial Sequence
  Synthetic oligonucleotide; CAG chr11 5166239 5166258 5166242 -
gtaagtttgtacaaattttt

SEQ ID NO: 55346 - DNA, 20 bp, Artificial Sequence
  Synthetic oligonucleotide; AAG chr11 5166236 5166255 5166239 -
agtttgtacaaatttttcag

SEQ ID NO: 55347 - DNA, 20 bp, Artificial Sequence
  Synthetic oligonucleotide; TAG chr11 5166233 5166252 5166236 -
ttgtacaaatttttcagaag

SEQ ID NO: 55348 - DNA, 20 bp, Artificial Sequence
  Synthetic oligonucleotide; AAG chr11 5166220 5166239 5166223 -
tcagaagtagaaattttatc

SEQ ID NO: 55349 - DNA, 20 bp, Artificial Sequence
  Synthetic oligonucleotide; CAG chr11 5166202 5166221 5166205 -
tcaagtatattttctgacca

SEQ ID NO: 55350 - DNA, 20 bp, Artificial Sequence
  Synthetic oligonucleotide; TGG chr11 5166199 5166218 5166202 -
agtatattttctgaccacag

SEQ ID NO: 55351 - DNA, 20 bp, Artificial Sequence
  Synthetic oligonucleotide; TAG chr11 5166188 5166207 5166191 -
tgaccacagtggaataaaac

SEQ ID NO: 55352 - DNA, 20 bp, Artificial Sequence
  Synthetic oligonucleotide; AAG chr11 5166174 5166193 5166177 -
taaaactagaaatgaataac

SEQ ID NO: 55353 - DNA, 20 bp, Artificial Sequence
  Synthetic oligonucleotide; AAG chr11 5166171 5166190 5166174 -
aactagaaatgaataacaag

SEQ ID NO: 55354 - DNA, 20 bp, Artificial Sequence
  Synthetic oligonucleotide; CAG chr11 5166163 5166182 5166166 -
atgaataacaagaagatcat

SEQ ID NO: 55355 - DNA, 20 bp, Artificial Sequence
  Synthetic oligonucleotide; TAG chr11 5166154 5166173 5166157 -
aagaagatcatcagaaaata

SEQ ID NO: 55356 - DNA, 20 bp, Artificial Sequence
  Synthetic oligonucleotide; TGG chr11 5166144 5166163 5166147 -
tcagaaaatatagaaacata

SEQ ID NO: 55357 - DNA, 20 bp, Artificial Sequence
  Synthetic oligonucleotide; CAG chr11 5166133 5166152 5166136 -
agaaacatatggaaatcaaa

SEQ ID NO: 55358 - DNA, 20 bp, Artificial Sequence
  Synthetic oligonucleotide; CAG chr11 5166115 5166134 5166118 -
aacagtatgctcctgaatgt

SEQ ID NO: 55359 - DNA, 20 bp, Artificial Sequence
  Synthetic oligonucleotide; AGG chr11 5166114 5166133 5166117 -
acagtatgctcctgaatgtc

SEQ ID NO: 55360 - DNA, 20 bp, Artificial Sequence
  Synthetic oligonucleotide; GAG chr11 5166106 5166125 5166109 -
ctcctgaatgtcaggcctct

SEQ ID NO: 55361 - DNA, 20 bp, Artificial Sequence
  Synthetic oligonucleotide; AAG chr11 5166100 5166119 5166103 -
aatgtcaggcctctgagccc

SEQ ID NO: 55362 - DNA, 20 bp, Artificial Sequence
  Synthetic oligonucleotide; AAG chr11 5166095 5166114 5166098 -
caggcctctgagcccaagct

SEQ ID NO: 55363 - DNA, 20 bp, Artificial Sequence
  Synthetic oligonucleotide; CAG chr11 5166058 5166077 5166061 -
gtgacctgcatatacacata

SEQ ID NO: 55364 - DNA, 20 bp, Artificial Sequence
  Synthetic oligonucleotide; TGG chr11 5166054 5166073 5166057 -
cctgcatatacacatacaga

SEQ ID NO: 55365 - DNA, 20 bp, Artificial Sequence
  Synthetic oligonucleotide; CAG chr11 5166050 5166069 5166053 -
catatacacatacagatggc

SEQ ID NO: 55366 - DNA, 20 bp, Artificial Sequence
  Synthetic oligonucleotide; AAG chr11 5166015 5166034 5166018 -
ctgatgacattccaccacaa

SEQ ID NO: 55367 - DNA, 20 bp, Artificial Sequence
  Synthetic oligonucleotide; AAG chr11 5166012 5166031 5166015 -
atgacattccaccacaaaag

SEQ ID NO: 55368 - DNA, 20 bp, Artificial Sequence
  Synthetic oligonucleotide; TGG chr11 5166003 5166022 5166006 -
caccacaaaagaagtgaaaa

SEQ ID NO: 55369 - DNA, 20 bp, Artificial Sequence
  Synthetic oligonucleotide; TGG chr11 5165952 5165971 5165955 -
tcttgtgaaattccttctcc

SEQ ID NO: 55370 - DNA, 20 bp, Artificial Sequence
  Synthetic oligonucleotide; TGG chr11 5165942 5165961 5165945 -
ttccttctcctggctcatcc

SEQ ID NO: 55371 - DNA, 20 bp, Artificial Sequence
  Synthetic oligonucleotide; AAG chr11 5165934 5165953 5165937 -
cctggctcatcctggctcaa

SEQ ID NO: 55372 - DNA, 20 bp, Artificial Sequence
  Synthetic oligonucleotide; GAG chr11 5165921 5165940 5165924 -
ggctcaaaagctcccctact

SEQ ID NO: 55373 - DNA, 20 bp, Artificial Sequence
  Synthetic oligonucleotide; CAG chr11 5165891 5165910 5165894 -
tgacccccactcctgcccgc

SEQ ID NO: 55374 - DNA, 20 bp, Artificial Sequence
  Synthetic oligonucleotide; GAG chr11 5165889 5165908 5165892 -
acccccactcctgcccgcca

SEQ ID NO: 55375 - DNA, 20 bp, Artificial Sequence
  Synthetic oligonucleotide; CAG chr11 5165834 5165853 5165837 -
cctacccaaatcttataaaa

SEQ ID NO: 55376 - DNA, 20 bp, Artificial Sequence
  Synthetic oligonucleotide; TGG chr11 5165797 5165816 5165800 -
ccctttgctgactctctttt

SEQ ID NO: 55377 - DNA, 20 bp, Artificial Sequence
  Synthetic oligonucleotide; CAG chr11 5165791 5165810 5165794 -
gctgactctctttttggact

SEQ ID NO: 55378 - DNA, 20 bp, Artificial Sequence
  Synthetic oligonucleotide; CAG chr11 5165776 5165795 5165779 -
ggactcagcctgcctgcacc

SEQ ID NO: 55379 - DNA, 20 bp, Artificial Sequence
  Synthetic oligonucleotide; AGG chr11 5165775 5165794 5165778 -
gactcagcctgcctgcaccc

SEQ ID NO: 55380 - DNA, 20 bp, Artificial Sequence
  Synthetic oligonucleotide; CAG chr11 5165763 5165782 5165766 -
ctgcacccaggtgaaataaa

SEQ ID NO: 55381 - DNA, 20 bp, Artificial Sequence
  Synthetic oligonucleotide; AAG chr11 5165744 5165763 5165747 -
acagccttgttgcttacaca

SEQ ID NO: 55382 - DNA, 20 bp, Artificial Sequence
  Synthetic oligonucleotide; TGG chr11 5165735 5165754 5165738 -
ttgcttacacaaagcctgtt

SEQ ID NO: 55383 - DNA, 20 bp, Artificial Sequence
  Synthetic oligonucleotide; TAG chr11 5165732 5165751 5165735 -
cttacacaaagcctgtttgg

SEQ ID NO: 55384 - DNA, 20 bp, Artificial Sequence
  Synthetic oligonucleotide; TGG chr11 5165719 5165738 5165722 -
tgtttggtagtctcttcata

SEQ ID NO: 55385 - DNA, 20 bp, Artificial Sequence
  Synthetic oligonucleotide; TGG chr11 5165702 5165721 5165705 -
atatggacgcgcatgaaatt

SEQ ID NO: 55386 - DNA, 20 bp, Artificial Sequence
  Synthetic oligonucleotide; CAG chr11 5165689 5165708 5165692 -
tgaaatttggtgccgtgact

SEQ ID NO: 55387 - DNA, 20 bp, Artificial Sequence
  Synthetic oligonucleotide; TGG chr11 5165684 5165703 5165687 -
tttggtgccgtgactcagat

SEQ ID NO: 55388 - DNA, 20 bp, Artificial Sequence
  Synthetic oligonucleotide; GGG chr11 5165683 5165702 5165686 -
ttggtgccgtgactcagatt

SEQ ID NO: 55389 - DNA, 20 bp, Artificial Sequence
  Synthetic oligonucleotide; GGG chr11 5165682 5165701 5165685 -
tggtgccgtgactcagattg

SEQ ID NO: 55390 - DNA, 20 bp, Artificial Sequence
  Synthetic oligonucleotide; GGG chr11 5165681 5165700 5165684 -
ggtgccgtgactcagattgg

SEQ ID NO: 55391 - DNA, 20 bp, Artificial Sequence
  Synthetic oligonucleotide; TGG chr11 5165670 5165689 5165673 -
tcagattgggggacctccct

SEQ ID NO: 55392 - DNA, 20 bp, Artificial Sequence
  Synthetic oligonucleotide; GGG chr11 5165669 5165688 5165672 -
cagattgggggacctccctt

SEQ ID NO: 55393 - DNA, 20 bp, Artificial Sequence
  Synthetic oligonucleotide; GAG chr11 5165667 5165686 5165670 -
gattgggggacctcccttgg

SEQ ID NO: 55394 - DNA, 20 bp, Artificial Sequence
  Synthetic oligonucleotide; GAG chr11 5165631 5165650 5165634 -
cctcctgctctttgctccgt

SEQ ID NO: 55395 - DNA, 20 bp, Artificial Sequence
  Synthetic oligonucleotide; AAG chr11 5165627 5165646 5165630 -
ctgctctttgctccgtgaga

SEQ ID NO: 55396 - DNA, 20 bp, Artificial Sequence
  Synthetic oligonucleotide; CAG chr11 5165609 5165628 5165612 -
gaaagatccacctacgacct

SEQ ID NO: 55397 - DNA, 20 bp, Artificial Sequence
  Synthetic oligonucleotide; AGG chr11 5165608 5165627 5165611 -
aaagatccacctacgacctc

SEQ ID NO: 55398 - DNA, 20 bp, Artificial Sequence
  Synthetic oligonucleotide; CAG chr11 5165592 5165611 5165595 -
cctcaggtcctcaaactgac

SEQ ID NO: 55399 - DNA, 20 bp, Artificial Sequence
  Synthetic oligonucleotide; AAG chr11 5165586 5165605 5165589 -
gtcctcaaactgaccagccc

SEQ ID NO: 55400 - DNA, 20 bp, Artificial Sequence
  Synthetic oligonucleotide; CGG chr11 5165560 5165579 5165563 -
catttcaccaatttcaaatc

SEQ ID NO: 55401 - DNA, 20 bp, Artificial Sequence
  Synthetic oligonucleotide; AAG chr11 5165556 5165575 5165559 -
tcaccaatttcaaatccggt

SEQ ID NO: 55402 - DNA, 20 bp, Artificial Sequence
  Synthetic oligonucleotide; TGG chr11 5165553 5165572 5165556 -
ccaatttcaaatccggtaag

SEQ ID NO: 55403 - DNA, 20 bp, Artificial Sequence
  Synthetic oligonucleotide; TGG chr11 5165487 5165506 5165490 -
cttctttctcctttcaatct

SEQ ID NO: 55404 - DNA, 20 bp, Artificial Sequence
  Synthetic oligonucleotide; CAG chr11 5165434 5165453 5165437 -
tttcaattcctttcattttc

SEQ ID NO: 55405 - DNA, 20 bp, Artificial Sequence
  Synthetic oligonucleotide; TAG chr11 5165431 5165450 5165434 -
caattcctttcattttccag

SEQ ID NO: 55406 - DNA, 20 bp, Artificial Sequence
  Synthetic oligonucleotide; GAG chr11 5165429 5165448 5165432 -
attcctttcattttccagta

SEQ ID NO: 55407 - DNA, 20 bp, Artificial Sequence
  Synthetic oligonucleotide; AAG chr11 5165423 5165442 5165426 -
ttcattttccagtagagaca

SEQ ID NO: 55408 - DNA, 20 bp, Artificial Sequence
  Synthetic oligonucleotide; AGG chr11 5165422 5165441 5165425 -
tcattttccagtagagacaa

SEQ ID NO: 55409 - DNA, 20 bp, Artificial Sequence
  Synthetic oligonucleotide; GAG chr11 5165420 5165439 5165423 -
attttccagtagagacaaag

SEQ ID NO: 55410 - DNA, 20 bp, Artificial Sequence
  Synthetic oligonucleotide; TGG chr11 5165403 5165422 5165406 -
aaggagacatgttttatccg

SEQ ID NO: 55411 - DNA, 20 bp, Artificial Sequence
  Synthetic oligonucleotide; CGG chr11 5165389 5165408 5165392 -
tatccgtggacccaaaactc

SEQ ID NO: 55412 - DNA, 20 bp, Artificial Sequence
  Synthetic oligonucleotide; CAG chr11 5165383 5165402 5165386 -
tggacccaaaactccggtgc

SEQ ID NO: 55413 - DNA, 20 bp, Artificial Sequence
  Synthetic oligonucleotide; CGG chr11 5165377 5165396 5165380 -
caaaactccggtgccagtca

SEQ ID NO: 55414 - DNA, 20 bp, Artificial Sequence
  Synthetic oligonucleotide; TGG chr11 5165372 5165391 5165375 -
ctccggtgccagtcacggac

SEQ ID NO: 55415 - DNA, 20 bp, Artificial Sequence
  Synthetic oligonucleotide; GGG chr11 5165371 5165390 5165374 -
tccggtgccagtcacggact

SEQ ID NO: 55416 - DNA, 20 bp, Artificial Sequence
  Synthetic oligonucleotide; AAG chr11 5165368 5165387 5165371 -
ggtgccagtcacggactggg

SEQ ID NO: 55417 - DNA, 20 bp, Artificial Sequence
  Synthetic oligonucleotide; AGG chr11 5165367 5165386 5165370 -
gtgccagtcacggactggga

SEQ ID NO: 55418 - DNA, 20 bp, Artificial Sequence
  Synthetic oligonucleotide; CAG chr11 5165364 5165383 5165367 -
ccagtcacggactgggaagg

SEQ ID NO: 55419 - DNA, 20 bp, Artificial Sequence
  Synthetic oligonucleotide; TGG chr11 5165353 5165372 5165356 -
ctgggaaggcagccttccct

SEQ ID NO: 55420 - DNA, 20 bp, Artificial Sequence
  Synthetic oligonucleotide; CAG chr11 5165337 5165356 5165340 -
cccttggtgtttaatcattg

SEQ ID NO: 55421 - DNA, 20 bp, Artificial Sequence
  Synthetic oligonucleotide; AGG chr11 5165336 5165355 5165339 -
ccttggtgtttaatcattgc

SEQ ID NO: 55422 - DNA, 20 bp, Artificial Sequence
  Synthetic oligonucleotide; GGG chr11 5165335 5165354 5165338 -
cttggtgtttaatcattgca

SEQ ID NO: 55423 - DNA, 20 bp, Artificial Sequence
  Synthetic oligonucleotide; CAG chr11 5165304 5165323 5165307 -
ctgattattaaaccatgttt

SEQ ID NO: 55424 - DNA, 20 bp, Artificial Sequence
  Synthetic oligonucleotide; GAG chr11 5165302 5165321 5165305 -
gattattaaaccatgtttca

SEQ ID NO: 55425 - DNA, 20 bp, Artificial Sequence
  Synthetic oligonucleotide; AGG chr11 5165301 5165320 5165304 -
attattaaaccatgtttcag

SEQ ID NO: 55426 - DNA, 20 bp, Artificial Sequence
  Synthetic oligonucleotide; CAG chr11 5165295 5165314 5165298 -
aaaccatgtttcagaggtgt

SEQ ID NO: 55427 - DNA, 20 bp, Artificial Sequence
  Synthetic oligonucleotide; CAG chr11 5165286 5165305 5165289 -
ttcagaggtgtcagaccacg

SEQ ID NO: 55428 - DNA, 20 bp, Artificial Sequence
  Synthetic oligonucleotide; AGG chr11 5165285 5165304 5165288 -
tcagaggtgtcagaccacgc

SEQ ID NO: 55429 - DNA, 20 bp, Artificial Sequence
  Synthetic oligonucleotide; GGG chr11 5165284 5165303 5165287 -
cagaggtgtcagaccacgca

SEQ ID NO: 55430 - DNA, 20 bp, Artificial Sequence
  Synthetic oligonucleotide; TGG chr11 5165271 5165290 5165274 -
ccacgcagggatgcctgcct

SEQ ID NO: 55431 - DNA, 20 bp, Artificial Sequence
  Synthetic oligonucleotide; TAG chr11 5165257 5165276 5165260 -
ctgccttggtccttcaccct

SEQ ID NO: 55432 - DNA, 20 bp, Artificial Sequence
  Synthetic oligonucleotide; CGG chr11 5165254 5165273 5165257 -
ccttggtccttcacccttag

SEQ ID NO: 55433 - DNA, 20 bp, Artificial Sequence
  Synthetic oligonucleotide; TGG chr11 5165236 5165255 5165239 -
agcggcaaatcccacttttc

SEQ ID NO: 55434 - DNA, 20 bp, Artificial Sequence
  Synthetic oligonucleotide; GAG chr11 5165234 5165253 5165237 -
cggcaaatcccacttttctg

SEQ ID NO: 55435 - DNA, 20 bp, Artificial Sequence
  Synthetic oligonucleotide; AGG chr11 5165233 5165252 5165236 -
ggcaaatcccacttttctgg

SEQ ID NO: 55436 - DNA, 20 bp, Artificial Sequence
  Synthetic oligonucleotide; GGG chr11 5165232 5165251 5165235 -
gcaaatcccacttttctgga

SEQ ID NO: 55437 - DNA, 20 bp, Artificial Sequence
  Synthetic oligonucleotide; GGG chr11 5165231 5165250 5165234 -
caaatcccacttttctggag

SEQ ID NO: 55438 - DNA, 20 bp, Artificial Sequence
  Synthetic oligonucleotide; GGG chr11 5165230 5165249 5165233 -
aaatcccacttttctggagg

SEQ ID NO: 55439 - DNA, 20 bp, Artificial Sequence
  Synthetic oligonucleotide; GGG chr11 5165229 5165248 5165232 -
aatcccacttttctggaggg

SEQ ID NO: 55440 - DNA, 20 bp, Artificial Sequence
  Synthetic oligonucleotide; AAG chr11 5165225 5165244 5165228 -
ccacttttctggaggggggt

SEQ ID NO: 55441 - DNA, 20 bp, Artificial Sequence
  Synthetic oligonucleotide; TGG chr11 5165176 5165195 5165179 -
ctgccccttcactgcttttc

SEQ ID NO: 55442 - DNA, 20 bp, Artificial Sequence
  Synthetic oligonucleotide; GGG chr11 5165175 5165194 5165178 -
tgccccttcactgcttttct

SEQ ID NO: 55443 - DNA, 20 bp, Artificial Sequence
  Synthetic oligonucleotide; GGG chr11 5165174 5165193 5165177 -
gccccttcactgcttttctg

SEQ ID NO: 55444 - DNA, 20 bp, Artificial Sequence
  Synthetic oligonucleotide; GGG chr11 5165173 5165192 5165176 -
ccccttcactgcttttctgg

SEQ ID NO: 55445 - DNA, 20 bp, Artificial Sequence
  Synthetic oligonucleotide; AAG chr11 5165169 5165188 5165172 -
ttcactgcttttctgggggc

SEQ ID NO: 55446 - DNA, 20 bp, Artificial Sequence
  Synthetic oligonucleotide; CAG chr11 5165127 5165146 5165130 -
tgtgccccaacctcttatct

SEQ ID NO: 55447 - DNA, 20 bp, Artificial Sequence
  Synthetic oligonucleotide; TGG chr11 5164869 5164888 5164872 -
caaccccttgcccatttttc

SEQ ID NO: 55448 - DNA, 20 bp, Artificial Sequence
  Synthetic oligonucleotide; GAG chr11 5164865 5164884 5164868 -
cccttgcccatttttctggt

SEQ ID NO: 55449 - DNA, 20 bp, Artificial Sequence
  Synthetic oligonucleotide; AAG chr11 5164861 5164880 5164864 -
tgcccatttttctggtgagt

SEQ ID NO: 55450 - DNA, 20 bp, Artificial Sequence
  Synthetic oligonucleotide; TGG chr11 5164813 5164832 5164816 -
tctgtactctttcttttctc

SEQ ID NO: 55451 - DNA, 20 bp, Artificial Sequence
  Synthetic oligonucleotide; GGG chr11 5164812 5164831 5164815 -
ctgtactctttcttttctct

SEQ ID NO: 55452 - DNA, 20 bp, Artificial Sequence
  Synthetic oligonucleotide; TAG chr11 5164795 5164814 5164798 -
tctgggcttgcctccttcac

SEQ ID NO: 55453 - DNA, 20 bp, Artificial Sequence
  Synthetic oligonucleotide; AGG chr11 5164794 5164813 5164797 -
ctgggcttgcctccttcact

SEQ ID NO: 55454 - DNA, 20 bp, Artificial Sequence
  Synthetic oligonucleotide; GGG chr11 5164793 5164812 5164796 -
tgggcttgcctccttcacta

SEQ ID NO: 55455 - DNA, 20 bp, Artificial Sequence
  Synthetic oligonucleotide; GGG chr11 5164792 5164811 5164795 -
gggcttgcctccttcactag

SEQ ID NO: 55456 - DNA, 20 bp, Artificial Sequence
  Synthetic oligonucleotide; TAG chr11 5164757 5164776 5164760 -
ctccattcctccctctccct

SEQ ID NO: 55457 - DNA, 20 bp, Artificial Sequence
  Synthetic oligonucleotide; AAG chr11 5164743 5164762 5164746 -
ctcccttagcctgtgctctc

SEQ ID NO: 55458 - DNA, 20 bp, Artificial Sequence
  Synthetic oligonucleotide; AAG chr11 5164680 5164699 5164683 -
aatgccttattttcttctgc

SEQ ID NO: 55459 - DNA, 20 bp, Artificial Sequence
  Synthetic oligonucleotide; AGG chr11 5164679 5164698 5164682 -
atgccttattttcttctgca

SEQ ID NO: 55460 - DNA, 20 bp, Artificial Sequence
  Synthetic oligonucleotide; CAG chr11 5164651 5164670 5164654 -
tgactccaatacaaactcga

SEQ ID NO: 55461 - DNA, 20 bp, Artificial Sequence
  Synthetic oligonucleotide; TGG chr11 5164648 5164667 5164651 -
ctccaatacaaactcgacag

SEQ ID NO: 55462 - DNA, 20 bp, Artificial Sequence
  Synthetic oligonucleotide; TAG chr11 5164638 5164657 5164641 -
aactcgacagtggttccaaa

SEQ ID NO: 55463 - DNA, 20 bp, Artificial Sequence
  Synthetic oligonucleotide; CAG chr11 5164634 5164653 5164637 -
cgacagtggttccaaatagc

SEQ ID NO: 55464 - DNA, 20 bp, Artificial Sequence
  Synthetic oligonucleotide; TGG chr11 5164627 5164646 5164630 -
ggttccaaatagccagaaaa

SEQ ID NO: 55465 - DNA, 20 bp, Artificial Sequence
  Synthetic oligonucleotide; AAG chr11 5164601 5164620 5164604 -
tttcaatttttccattcttc

SEQ ID NO: 55466 - DNA, 20 bp, Artificial Sequence
  Synthetic oligonucleotide; CAG chr11 5164574 5164593 5164577 -
aaataatttttgtcgtaaaa

SEQ ID NO: 55467 - DNA, 20 bp, Artificial Sequence
  Synthetic oligonucleotide; AGG chr11 5164573 5164592 5164576 -
aataatttttgtcgtaaaac

SEQ ID NO: 55468 - DNA, 20 bp, Artificial Sequence
  Synthetic oligonucleotide; CAG chr11 5164566 5164585 5164569 -
tttgtcgtaaaacaggcaaa

SEQ ID NO: 55469 - DNA, 20 bp, Artificial Sequence
  Synthetic oligonucleotide; GAG chr11 5164560 5164579 5164563 -
gtaaaacaggcaaacagtct

SEQ ID NO: 55470 - DNA, 20 bp, Artificial Sequence
  Synthetic oligonucleotide; AGG chr11 5164559 5164578 5164562 -
taaaacaggcaaacagtctg

SEQ ID NO: 55471 - DNA, 20 bp, Artificial Sequence
  Synthetic oligonucleotide; CAG chr11 5164545 5164564 5164548 -
agtctgaggtgcctgacgtc

SEQ ID NO: 55472 - DNA, 20 bp, Artificial Sequence
  Synthetic oligonucleotide; AGG chr11 5164544 5164563 5164547 -
gtctgaggtgcctgacgtcc

SEQ ID NO: 55473 - DNA, 20 bp, Artificial Sequence
  Synthetic oligonucleotide; TGG chr11 5164526 5164545 5164529 -
ccaggcattcttttacacat

SEQ ID NO: 55474 - DNA, 20 bp, Artificial Sequence
  Synthetic oligonucleotide; TAG chr11 5164515 5164534 5164518 -
tttacacattggtccctccc

SEQ ID NO: 55475 - DNA, 20 bp, Artificial Sequence
  Synthetic oligonucleotide; CAG chr11 5164455 5164474 5164458 -
ttccctcccgcctgtcccct

SEQ ID NO: 55476 - DNA, 20 bp, Artificial Sequence
  Synthetic oligonucleotide; AAG chr11 5164442 5164461 5164445 -
gtcccctcagtcccaactcc

SEQ ID NO: 55477 - DNA, 20 bp, Artificial Sequence
  Synthetic oligonucleotide; GAG chr11 5164432 5164451 5164435 -
tcccaactccaagcgtcgct

SEQ ID NO: 55478 - DNA, 20 bp, Artificial Sequence
  Synthetic oligonucleotide; CAG chr11 5164407 5164426 5164410 -
tttctaatcttccttttcta

SEQ ID NO: 55479 - DNA, 20 bp, Artificial Sequence
  Synthetic oligonucleotide; CAG chr11 5164378 5164397 5164381 -
ctgacgtctcccctcctccc

SEQ ID NO: 55480 - DNA, 20 bp, Artificial Sequence
  Synthetic oligonucleotide; AGG chr11 5164377 5164396 5164380 -
tgacgtctcccctcctcccc

SEQ ID NO: 55481 - DNA, 20 bp, Artificial Sequence
  Synthetic oligonucleotide; CAG chr11 5164363 5164382 5164366 -
ctccccaggctgctccttgc

SEQ ID NO: 55482 - DNA, 20 bp, Artificial Sequence
  Synthetic oligonucleotide; AGG chr11 5164362 5164381 5164365 -
tccccaggctgctccttgcc

SEQ ID NO: 55483 - DNA, 20 bp, Artificial Sequence
  Synthetic oligonucleotide; GAG chr11 5164357 5164376 5164360 -
aggctgctccttgccaggcc

SEQ ID NO: 55484 - DNA, 20 bp, Artificial Sequence
  Synthetic oligonucleotide; TAG chr11 5164353 5164372 5164356 -
tgctccttgccaggccgagc

SEQ ID NO: 55485 - DNA, 20 bp, Artificial Sequence
  Synthetic oligonucleotide; AGG chr11 5164352 5164371 5164355 -
gctccttgccaggccgagct

SEQ ID NO: 55486 - DNA, 20 bp, Artificial Sequence
  Synthetic oligonucleotide; CAG chr11 5164335 5164354 5164338 -
gctaggtcccaaatcttcct

SEQ ID NO: 55487 - DNA, 20 bp, Artificial Sequence
  Synthetic oligonucleotide; CAG chr11 5164329 5164348 5164332 -
tcccaaatcttcctcagcct

SEQ ID NO: 55488 - DNA, 20 bp, Artificial Sequence
  Synthetic oligonucleotide; CGG chr11 5164282 5164301 5164285 -
tcacctcccctcctcacacc

SEQ ID NO: 55489 - DNA, 20 bp, Artificial Sequence
  Synthetic oligonucleotide; CGG chr11 5164277 5164296 5164280 -
tcccctcctcacacccggtc

SEQ ID NO: 55490 - DNA, 20 bp, Artificial Sequence
  Synthetic oligonucleotide; CAG chr11 5164270 5164289 5164273 -
ctcacacccggtccggttta

SEQ ID NO: 55491 - DNA, 20 bp, Artificial Sequence
  Synthetic oligonucleotide; TAG chr11 5164253 5164272 5164256 -
ttacagtttcattccgtgac

SEQ ID NO: 55492 - DNA, 20 bp, Artificial Sequence
  Synthetic oligonucleotide; CAG chr11 5164234 5164253 5164237 -
ctagccctccccaacctgcc

SEQ ID NO: 55493 - DNA, 20 bp, Artificial Sequence
  Synthetic oligonucleotide; AAG chr11 5164219 5164238 5164222 -
ctgcccagcaatttcctatt

SEQ ID NO: 55494 - DNA, 20 bp, Artificial Sequence
  Synthetic oligonucleotide; AAG chr11 5164216 5164235 5164219 -
cccagcaatttcctattaag

SEQ ID NO: 55495 - DNA, 20 bp, Artificial Sequence
  Synthetic oligonucleotide; AGG chr11 5164215 5164234 5164218 -
ccagcaatttcctattaaga

SEQ ID NO: 55496 - DNA, 20 bp, Artificial Sequence
  Synthetic oligonucleotide; TGG chr11 5164212 5164231 5164215 -
gcaatttcctattaagaagg

SEQ ID NO: 55497 - DNA, 20 bp, Artificial Sequence
  Synthetic oligonucleotide; AAG chr11 5164206 5164225 5164209 -
tcctattaagaaggtggctg

SEQ ID NO: 55498 - DNA, 20 bp, Artificial Sequence
  Synthetic oligonucleotide; AAG chr11 5164200 5164219 5164203 -
taagaaggtggctgaagcta

SEQ ID NO: 55499 - DNA, 20 bp, Artificial Sequence
  Synthetic oligonucleotide; AGG chr11 5164199 5164218 5164202 -
aagaaggtggctgaagctaa

SEQ ID NO: 55500 - DNA, 20 bp, Artificial Sequence
  Synthetic oligonucleotide; TAG chr11 5164194 5164213 5164197 -
ggtggctgaagctaaaggcg

SEQ ID NO: 55501 - DNA, 20 bp, Artificial Sequence
  Synthetic oligonucleotide; AAG chr11 5164189 5164208 5164192 -
ctgaagctaaaggcgtagtc

SEQ ID NO: 55502 - DNA, 20 bp, Artificial Sequence
  Synthetic oligonucleotide; AGG chr11 5164188 5164207 5164191 -
tgaagctaaaggcgtagtca

SEQ ID NO: 55503 - DNA, 20 bp, Artificial Sequence
  Synthetic oligonucleotide; CAG chr11 5164148 5164167 5164151 -
ttatccgacctctcccgaat

SEQ ID NO: 55504 - DNA, 20 bp, Artificial Sequence
  Synthetic oligonucleotide; GAG chr11 5164146 5164165 5164149 -
atccgacctctcccgaatca

SEQ ID NO: 55505 - DNA, 20 bp, Artificial Sequence
  Synthetic oligonucleotide; TAG chr11 5164139 5164158 5164142 -
ctctcccgaatcagagcgtt

SEQ ID NO: 55506 - DNA, 20 bp, Artificial Sequence
  Synthetic oligonucleotide; AGG chr11 5164138 5164157 5164141 -
tctcccgaatcagagcgttt

SEQ ID NO: 55507 - DNA, 20 bp, Artificial Sequence
  Synthetic oligonucleotide; CAG chr11 5164111 5164130 5164114 -
ttcatcaaatatgaaaaacc

SEQ ID NO: 55508 - DNA, 20 bp, Artificial Sequence
  Synthetic oligonucleotide; CAG chr11 5164106 5164125 5164109 -
caaatatgaaaaacccagcc

SEQ ID NO: 55509 - DNA, 20 bp, Artificial Sequence
  Synthetic oligonucleotide; TGG chr11 5164099 5164118 5164102 -
gaaaaacccagcccagttca

SEQ ID NO: 55510 - DNA, 20 bp, Artificial Sequence
  Synthetic oligonucleotide; CGG chr11 5164090 5164109 5164093 -
agcccagttcatggctcgtt

SEQ ID NO: 55511 - DNA, 20 bp, Artificial Sequence
  Synthetic oligonucleotide; CAG chr11 5164087 5164106 5164090 -
ccagttcatggctcgttcgg

SEQ ID NO: 55512 - DNA, 20 bp, Artificial Sequence
  Synthetic oligonucleotide; GAG chr11 5164077 5164096 5164080 -
gctcgttcggcagcaaccct

SEQ ID NO: 55513 - DNA, 20 bp, Artificial Sequence
  Synthetic oligonucleotide; CAG chr11 5164066 5164085 5164069 -
agcaaccctgagacgcttta

SEQ ID NO: 55514 - DNA, 20 bp, Artificial Sequence
  Synthetic oligonucleotide; TAG chr11 5164060 5164079 5164063 -
cctgagacgctttacagccc

SEQ ID NO: 55515 - DNA, 20 bp, Artificial Sequence
  Synthetic oligonucleotide; AAG chr11 5164050 5164069 5164053 -
tttacagccctagaccctaa

SEQ ID NO: 55516 - DNA, 20 bp, Artificial Sequence
  Synthetic oligonucleotide; AGG chr11 5164049 5164068 5164052 -
ttacagccctagaccctaaa

SEQ ID NO: 55517 - DNA, 20 bp, Artificial Sequence
  Synthetic oligonucleotide; AAG chr11 5164042 5164061 5164045 -
cctagaccctaaaaggacaa

SEQ ID NO: 55518 - DNA, 20 bp, Artificial Sequence
  Synthetic oligonucleotide; AGG chr11 5164041 5164060 5164044 -
ctagaccctaaaaggacaaa

SEQ ID NO: 55519 - DNA, 20 bp, Artificial Sequence
  Synthetic oligonucleotide; TGG chr11 5163964 5163983 5163967 -
aaactccaaaaattaaattc

SEQ ID NO: 55520 - DNA, 20 bp, Artificial Sequence
  Synthetic oligonucleotide; CAG chr11 5163945 5163964 5163948 -
ctggacctcaaaccccacaa

SEQ ID NO: 55521 - DNA, 20 bp, Artificial Sequence
  Synthetic oligonucleotide; AGG chr11 5163944 5163963 5163947 -
tggacctcaaaccccacaac

SEQ ID NO: 55522 - DNA, 20 bp, Artificial Sequence
  Synthetic oligonucleotide; AAG chr11 5163921 5163940 5163924 -
actcaattaacctcaccttc

SEQ ID NO: 55523 - DNA, 20 bp, Artificial Sequence
  Synthetic oligonucleotide; AGG chr11 5163920 5163939 5163923 -
ctcaattaacctcaccttca

SEQ ID NO: 55524 - DNA, 20 bp, Artificial Sequence
  Synthetic oligonucleotide; TAG chr11 5163907 5163926 5163910 -
accttcaaggtgtacaataa

SEQ ID NO: 55525 - DNA, 20 bp, Artificial Sequence
  Synthetic oligonucleotide; GAG chr11 5163905 5163924 5163908 -
cttcaaggtgtacaataata

SEQ ID NO: 55526 - DNA, 20 bp, Artificial Sequence
  Synthetic oligonucleotide; TAG chr11 5163902 5163921 5163905 -
caaggtgtacaataatagag

SEQ ID NO: 55527 - DNA, 20 bp, Artificial Sequence
  Synthetic oligonucleotide; GAG chr11 5163900 5163919 5163903 -
aggtgtacaataatagagta

SEQ ID NO: 55528 - DNA, 20 bp, Artificial Sequence
  Synthetic oligonucleotide; AGG chr11 5163899 5163918 5163902 -
ggtgtacaataatagagtag

SEQ ID NO: 55529 - DNA, 20 bp, Artificial Sequence
  Synthetic oligonucleotide; CAG chr11 5163896 5163915 5163899 -
gtacaataatagagtagagg

SEQ ID NO: 55530 - DNA, 20 bp, Artificial Sequence
  Synthetic oligonucleotide; AAG chr11 5163891 5163910 5163894 -
ataatagagtagaggcagcc

SEQ ID NO: 55531 - DNA, 20 bp, Artificial Sequence
  Synthetic oligonucleotide; TAG chr11 5163888 5163907 5163891 -
atagagtagaggcagccaag

SEQ ID NO: 55532 - DNA, 20 bp, Artificial Sequence
  Synthetic oligonucleotide; GAG chr11 5163873 5163892 5163876 -
ccaagtagcaacatattttt

SEQ ID NO: 55533 - DNA, 20 bp, Artificial Sequence
  Synthetic oligonucleotide; GAG chr11 5163847 5163866 5163850 -
caattccttgcctccactgt

SEQ ID NO: 55534 - DNA, 20 bp, Artificial Sequence
  Synthetic oligonucleotide; CAG chr11 5163836 5163855 5163839 -
ctccactgtgagacaaaccc

SEQ ID NO: 55535 - DNA, 20 bp, Artificial Sequence
  Synthetic oligonucleotide; CAG chr11 5163824 5163843 5163827 -
acaaaccccagccacatctc

SEQ ID NO: 55536 - DNA, 20 bp, Artificial Sequence
  Synthetic oligonucleotide; AAG chr11 5163816 5163835 5163819 -
cagccacatctccagcacac

SEQ ID NO: 55537 - DNA, 20 bp, Artificial Sequence
  Synthetic oligonucleotide; CAG chr11 5163792 5163811 5163795 -
acttccaaatgcctaaaccg

SEQ ID NO: 55538 - DNA, 20 bp, Artificial Sequence
  Synthetic oligonucleotide; TGG chr11 5163789 5163808 5163792 -
tccaaatgcctaaaccgcag

SEQ ID NO: 55539 - DNA, 20 bp, Artificial Sequence
  Synthetic oligonucleotide; CAG chr11 5163785 5163804 5163788 -
aatgcctaaaccgcagtggc

SEQ ID NO: 55540 - DNA, 20 bp, Artificial Sequence
  Synthetic oligonucleotide; AGG chr11 5163784 5163803 5163787 -
atgcctaaaccgcagtggcc

SEQ ID NO: 55541 - DNA, 20 bp, Artificial Sequence
  Synthetic oligonucleotide; CGG chr11 5163773 5163792 5163776 -
gcagtggccaggcgttcctc

SEQ ID NO: 55542 - DNA, 20 bp, Artificial Sequence
  Synthetic oligonucleotide; CAG chr11 5163758 5163777 5163761 -
tcctccggaaccacctcccc

SEQ ID NO: 55543 - DNA, 20 bp, Artificial Sequence
  Synthetic oligonucleotide; AGG chr11 5163757 5163776 5163760 -
cctccggaaccacctccccc

SEQ ID NO: 55544 - DNA, 20 bp, Artificial Sequence
  Synthetic oligonucleotide; GAG chr11 5163755 5163774 5163758 -
tccggaaccacctcccccag

SEQ ID NO: 55545 - DNA, 20 bp, Artificial Sequence
  Synthetic oligonucleotide; AAG chr11 5163744 5163763 5163747 -
ctcccccaggagcttgctac

SEQ ID NO: 55546 - DNA, 20 bp, Artificial Sequence
  Synthetic oligonucleotide; CAG chr11 5163738 5163757 5163741 -
caggagcttgctacaagtgc

SEQ ID NO: 55547 - DNA, 20 bp, Artificial Sequence
  Synthetic oligonucleotide; TGG chr11 5163730 5163749 5163733 -
tgctacaagtgccagaaatc

SEQ ID NO: 55548 - DNA, 20 bp, Artificial Sequence
  Synthetic oligonucleotide; CAG chr11 5163723 5163742 5163726 -
agtgccagaaatctggccac

SEQ ID NO: 55549 - DNA, 20 bp, Artificial Sequence
  Synthetic oligonucleotide; AGG chr11 5163722 5163741 5163725 -
gtgccagaaatctggccacc

SEQ ID NO: 55550 - DNA, 20 bp, Artificial Sequence
  Synthetic oligonucleotide; AAG chr11 5163717 5163736 5163720 -
agaaatctggccaccaggcc

SEQ ID NO: 55551 - DNA, 20 bp, Artificial Sequence
  Synthetic oligonucleotide; AGG chr11 5163716 5163735 5163719 -
gaaatctggccaccaggcca

SEQ ID NO: 55552 - DNA, 20 bp, Artificial Sequence
  Synthetic oligonucleotide; CAG chr11 5163705 5163724 5163708 -
accaggccaaggaatgcccg

SEQ ID NO: 55553 - DNA, 20 bp, Artificial Sequence
  Synthetic oligonucleotide; CAG chr11 5163700 5163719 5163703 -
gccaaggaatgcccgcagcc

SEQ ID NO: 55554 - DNA, 20 bp, Artificial Sequence
  Synthetic oligonucleotide; AGG chr11 5163699 5163718 5163702 -
ccaaggaatgcccgcagccc

SEQ ID NO: 55555 - DNA, 20 bp, Artificial Sequence
  Synthetic oligonucleotide; AAG chr11 5163687 5163706 5163690 -
cgcagcccaggattcctcct

SEQ ID NO: 55556 - DNA, 20 bp, Artificial Sequence
  Synthetic oligonucleotide; CAG chr11 5163668 5163687 5163671 -
taagccgtgtcccatctgtg

SEQ ID NO: 55557 - DNA, 20 bp, Artificial Sequence
  Synthetic oligonucleotide; AGG chr11 5163667 5163686 5163670 -
aagccgtgtcccatctgtgc

SEQ ID NO: 55558 - DNA, 20 bp, Artificial Sequence
  Synthetic oligonucleotide; TAG chr11 5163657 5163676 5163660 -
ccatctgtgcaggaccccac

SEQ ID NO: 55559 - DNA, 20 bp, Artificial Sequence
  Synthetic oligonucleotide; CGG chr11 5163650 5163669 5163653 -
tgcaggaccccactagaaat

SEQ ID NO: 55560 - DNA, 20 bp, Artificial Sequence
  Synthetic oligonucleotide; TGG chr11 5163632 5163651 5163635 -
atcggactgttcaactcacc

SEQ ID NO: 55561 - DNA, 20 bp, Artificial Sequence
  Synthetic oligonucleotide; CAG chr11 5163629 5163648 5163632 -
ggactgttcaactcacctgg

SEQ ID NO: 55562 - DNA, 20 bp, Artificial Sequence
  Synthetic oligonucleotide; TAG chr11 5163619 5163638 5163622 -
actcacctggcagccactcc

SEQ ID NO: 55563 - DNA, 20 bp, Artificial Sequence
  Synthetic oligonucleotide; GAG chr11 5163617 5163636 5163620 -
tcacctggcagccactccta

SEQ ID NO: 55564 - DNA, 20 bp, Artificial Sequence
  Synthetic oligonucleotide; TGG chr11 5163610 5163629 5163613 -
gcagccactcctagagcccc

SEQ ID NO: 55565 - DNA, 20 bp, Artificial Sequence
  Synthetic oligonucleotide; TGG chr11 5163602 5163621 5163605 -
tcctagagcccctggaactc

SEQ ID NO: 55566 - DNA, 20 bp, Artificial Sequence
  Synthetic oligonucleotide; AAG chr11 5163596 5163615 5163599 -
agcccctggaactctggccc

SEQ ID NO: 55567 - DNA, 20 bp, Artificial Sequence
  Synthetic oligonucleotide; AGG chr11 5163595 5163614 5163598 -
gcccctggaactctggccca

SEQ ID NO: 55568 - DNA, 20 bp, Artificial Sequence
  Synthetic oligonucleotide; CAG chr11 5163572 5163591 5163575 -
ctccctgactgactccttcc

SEQ ID NO: 55569 - DNA, 20 bp, Artificial Sequence
  Synthetic oligonucleotide; CGG chr11 5163562 5163581 5163565 -
gactccttcccagatcttct

SEQ ID NO: 55570 - DNA, 20 bp, Artificial Sequence
  Synthetic oligonucleotide; CAG chr11 5163554 5163573 5163557 -
cccagatcttctcggctttg

SEQ ID NO: 55571 - DNA, 20 bp, Artificial Sequence
  Synthetic oligonucleotide; AAG chr11 5163548 5163567 5163551 -
tcttctcggctttgcagctg

SEQ ID NO: 55572 - DNA, 20 bp, Artificial Sequence
  Synthetic oligonucleotide; CGG chr11 5163524 5163543 5163527 -
ctgccactgcctgatcgcct

SEQ ID NO: 55573 - DNA, 20 bp, Artificial Sequence
  Synthetic oligonucleotide; AAG chr11 5163521 5163540 5163524 -
ccactgcctgatcgcctcgg

SEQ ID NO: 55574 - DNA, 20 bp, Artificial Sequence
  Synthetic oligonucleotide; TAG chr11 5163513 5163532 5163516 -
tgatcgcctcggaagccctg

SEQ ID NO: 55575 - DNA, 20 bp, Artificial Sequence
  Synthetic oligonucleotide; CAG chr11 5163503 5163522 5163506 -
ggaagccctgtagaccatca

SEQ ID NO: 55576 - DNA, 20 bp, Artificial Sequence
  Synthetic oligonucleotide; GAG chr11 5163495 5163514 5163498 -
tgtagaccatcacagacacc

SEQ ID NO: 55577 - DNA, 20 bp, Artificial Sequence
  Synthetic oligonucleotide; TAG chr11 5163489 5163508 5163492 -
ccatcacagacaccgagctt

SEQ ID NO: 55578 - DNA, 20 bp, Artificial Sequence
  Synthetic oligonucleotide; AGG chr11 5163488 5163507 5163491 -
catcacagacaccgagcttt

SEQ ID NO: 55579 - DNA, 20 bp, Artificial Sequence
  Synthetic oligonucleotide; CAG chr11 5163476 5163495 5163479 -
cgagctttaggtaattctca

SEQ ID NO: 55580 - DNA, 20 bp, Artificial Sequence
  Synthetic oligonucleotide; TGG chr11 5163473 5163492 5163476 -
gctttaggtaattctcacag

SEQ ID NO: 55581 - DNA, 20 bp, Artificial Sequence
  Synthetic oligonucleotide; GAG chr11 5163471 5163490 5163474 -
tttaggtaattctcacagtg

SEQ ID NO: 55582 - DNA, 20 bp, Artificial Sequence
  Synthetic oligonucleotide; AGG chr11 5163470 5163489 5163473 -
ttaggtaattctcacagtgg

SEQ ID NO: 55583 - DNA, 20 bp, Artificial Sequence
  Synthetic oligonucleotide; GGG chr11 5163469 5163488 5163472 -
taggtaattctcacagtgga

SEQ ID NO: 55584 - DNA, 20 bp, Artificial Sequence
  Synthetic oligonucleotide; AAG chr11 5163465 5163484 5163468 -
taattctcacagtggagggt

SEQ ID NO: 55585 - DNA, 20 bp, Artificial Sequence
  Synthetic oligonucleotide; CAG chr11 5163445 5163464 5163448 -
aagtctgtacccttcttaat

SEQ ID NO: 55586 - DNA, 20 bp, Artificial Sequence
  Synthetic oligonucleotide; TGG chr11 5163440 5163459 5163443 -
tgtacccttcttaatcagta

SEQ ID NO: 55587 - DNA, 20 bp, Artificial Sequence
  Synthetic oligonucleotide; GAG chr11 5163438 5163457 5163441 -
tacccttcttaatcagtatg

SEQ ID NO: 55588 - DNA, 20 bp, Artificial Sequence
  Synthetic oligonucleotide; AGG chr11 5163437 5163456 5163440 -
acccttcttaatcagtatgg

SEQ ID NO: 55589 - DNA, 20 bp, Artificial Sequence
  Synthetic oligonucleotide; AAG chr11 5163406 5163425 5163409 -
tccacattaccttcttttca

SEQ ID NO: 55590 - DNA, 20 bp, Artificial Sequence
  Synthetic oligonucleotide; AGG chr11 5163405 5163424 5163408 -
ccacattaccttcttttcaa

SEQ ID NO: 55591 - DNA, 20 bp, Artificial Sequence
  Synthetic oligonucleotide; TAG chr11 5163374 5163393 5163377 -
ccttgcctccataactgttg

SEQ ID NO: 55592 - DNA, 20 bp, Artificial Sequence
  Synthetic oligonucleotide; AGG chr11 5163373 5163392 5163376 -
cttgcctccataactgttgt

SEQ ID NO: 55593 - DNA, 20 bp, Artificial Sequence
  Synthetic oligonucleotide; TGG chr11 5163364 5163383 5163367 -
ataactgttgtaggtattga

SEQ ID NO: 55594 - DNA, 20 bp, Artificial Sequence
  Synthetic oligonucleotide; CAG chr11 5163360 5163379 5163363 -
ctgttgtaggtattgatggc

SEQ ID NO: 55595 - DNA, 20 bp, Artificial Sequence
  Synthetic oligonucleotide; AGG chr11 5163359 5163378 5163362 -
tgttgtaggtattgatggcc

SEQ ID NO: 55596 - DNA, 20 bp, Artificial Sequence
  Synthetic oligonucleotide; TGG chr11 5163327 5163346 5163330 -
ctcttaaaattccccaactc

SEQ ID NO: 55597 - DNA, 20 bp, Artificial Sequence
  Synthetic oligonucleotide; GAG chr11 5163316 5163335 5163319 -
ccccaactctggtgctaacc

SEQ ID NO: 55598 - DNA, 20 bp, Artificial Sequence
  Synthetic oligonucleotide; AAG chr11 5163300 5163319 5163303 -
aaccgagacgatactctttt

SEQ ID NO: 55599 - DNA, 20 bp, Artificial Sequence
  Synthetic oligonucleotide; CAG chr11 5163270 5163289 5163273 -
ttttcattatccccacctgc

SEQ ID NO: 55600 - DNA, 20 bp, Artificial Sequence
  Synthetic oligonucleotide; TAG chr11 5163258 5163277 5163261 -
ccacctgccagttcccttat

SEQ ID NO: 55601 - DNA, 20 bp, Artificial Sequence
  Synthetic oligonucleotide; AGG chr11 5163257 5163276 5163260 -
cacctgccagttcccttatt

SEQ ID NO: 55602 - DNA, 20 bp, Artificial Sequence
  Synthetic oligonucleotide; GAG chr11 5163252 5163271 5163255 -
gccagttcccttattaggcc

SEQ ID NO: 55603 - DNA, 20 bp, Artificial Sequence
  Synthetic oligonucleotide; TGG chr11 5163212 5163231 5163215 -
tctgcttccctgactattcc

SEQ ID NO: 55604 - DNA, 20 bp, Artificial Sequence
  Synthetic oligonucleotide; GGG chr11 5163211 5163230 5163214 -
ctgcttccctgactattcct

SEQ ID NO: 55605 - DNA, 20 bp, Artificial Sequence
  Synthetic oligonucleotide; CAG chr11 5163205 5163224 5163208 -
ccctgactattcctgggcta

SEQ ID NO: 55606 - DNA, 20 bp, Artificial Sequence
  Synthetic oligonucleotide; CAG chr11 5163176 5163195 5163179 -
ctcattgccatgttttcccc

SEQ ID NO: 55607 - DNA, 20 bp, Artificial Sequence
  Synthetic oligonucleotide; AAG chr11 5163169 5163188 5163172 -
ccatgttttcccccagttca

SEQ ID NO: 55608 - DNA, 20 bp, Artificial Sequence
  Synthetic oligonucleotide; AAG chr11 5163123 5163142 5163126 -
atctccccaccttaatccac

SEQ ID NO: 55609 - DNA, 20 bp, Artificial Sequence
  Synthetic oligonucleotide; AAG chr11 5163117 5163136 5163120 -
ccaccttaatccacaagtat

SEQ ID NO: 55610 - DNA, 20 bp, Artificial Sequence
  Synthetic oligonucleotide; CAG chr11 5163031 5163050 5163034 -
actcttaccccgctcaatgc

SEQ ID NO: 55611 - DNA, 20 bp, Artificial Sequence
  Synthetic oligonucleotide; CAG chr11 5163016 5163035 5163019 -
aatgccagtatcccatccca

SEQ ID NO: 55612 - DNA, 20 bp, Artificial Sequence
  Synthetic oligonucleotide; AAG chr11 5163003 5163022 5163006 -
catcccacagcatgctttga

SEQ ID NO: 55613 - DNA, 20 bp, Artificial Sequence
  Synthetic oligonucleotide; AGG chr11 5163002 5163021 5163005 -
atcccacagcatgctttgaa

SEQ ID NO: 55614 - DNA, 20 bp, Artificial Sequence
  Synthetic oligonucleotide; AAG chr11 5162995 5163014 5162998 -
agcatgctttgaaaggatta

SEQ ID NO: 55615 - DNA, 20 bp, Artificial Sequence
  Synthetic oligonucleotide; CAG chr11 5162971 5162990 5162974 -
ctgttattacttgcctgtta

SEQ ID NO: 55616 - DNA, 20 bp, Artificial Sequence
  Synthetic oligonucleotide; TGG chr11 5162966 5162985 5162969 -
attacttgcctgttacagca

SEQ ID NO: 55617 - DNA, 20 bp, Artificial Sequence
  Synthetic oligonucleotide; AAG chr11 5162956 5162975 5162959 -
tgttacagcatggcctttta

SEQ ID NO: 55618 - DNA, 20 bp, Artificial Sequence
  Synthetic oligonucleotide; CAG chr11 5162907 5162926 5162910 -
cattttacctgtcctaaaac

SEQ ID NO: 55619 - DNA, 20 bp, Artificial Sequence
  Synthetic oligonucleotide; AAG chr11 5162902 5162921 5162905 -
tacctgtcctaaaaccagac

SEQ ID NO: 55620 - DNA, 20 bp, Artificial Sequence
  Synthetic oligonucleotide; CAG chr11 5162894 5162913 5162897 -
ctaaaaccagacaagcctta

SEQ ID NO: 55621 - DNA, 20 bp, Artificial Sequence
  Synthetic oligonucleotide; AGG chr11 5162893 5162912 5162896 -
taaaaccagacaagccttac

SEQ ID NO: 55622 - DNA, 20 bp, Artificial Sequence
  Synthetic oligonucleotide; TAG chr11 5162889 5162908 5162892 -
accagacaagccttacaggt

SEQ ID NO: 55623 - DNA, 20 bp, Artificial Sequence
  Synthetic oligonucleotide; CAG chr11 5162884 5162903 5162887 -
acaagccttacaggttagtt

SEQ ID NO: 55624 - DNA, 20 bp, Artificial Sequence
  Synthetic oligonucleotide; TGG chr11 5162838 5162857 5162841 -
tgttttgcctatccacccca

SEQ ID NO: 55625 - DNA, 20 bp, Artificial Sequence
  Synthetic oligonucleotide; TGG chr11 5162775 5162794 5162778 -
tataacccattattctgttc

SEQ ID NO: 55626 - DNA, 20 bp, Artificial Sequence
  Synthetic oligonucleotide; CAG chr11 5162728 5162747 5162731 -
ttcctttgcacccttcattc

SEQ ID NO: 55627 - DNA, 20 bp, Artificial Sequence
  Synthetic oligonucleotide; TGG chr11 5162707 5162726 5162710 -
agcctctcttcgctttcact

SEQ ID NO: 55628 - DNA, 20 bp, Artificial Sequence
  Synthetic oligonucleotide; TAG chr11 5162686 5162705 5162689 -
ggactgacactgacacccat

SEQ ID NO: 55629 - DNA, 20 bp, Artificial Sequence
  Synthetic oligonucleotide; AGG chr11 5162685 5162704 5162688 -
gactgacactgacacccatt

SEQ ID NO: 55630 - DNA, 20 bp, Artificial Sequence
  Synthetic oligonucleotide; CAG chr11 5162680 5162699 5162683 -
acactgacacccattaggct

SEQ ID NO: 55631 - DNA, 20 bp, Artificial Sequence
  Synthetic oligonucleotide; TGG chr11 5162668 5162687 5162671 -
attaggctcagcaaattacc

SEQ ID NO: 55632 - DNA, 20 bp, Artificial Sequence
  Synthetic oligonucleotide; GGG chr11 5162667 5162686 5162670 -
ttaggctcagcaaattacct

SEQ ID NO: 55633 - DNA, 20 bp, Artificial Sequence
  Synthetic oligonucleotide; AAG chr11 5162652 5162671 5162655 -
tacctgggctgtactgctgc

SEQ ID NO: 55634 - DNA, 20 bp, Artificial Sequence
  Synthetic oligonucleotide; AGG chr11 5162651 5162670 5162654 -
acctgggctgtactgctgca

SEQ ID NO: 55635 - DNA, 20 bp, Artificial Sequence
  Synthetic oligonucleotide; CAG chr11 5162643 5162662 5162646 -
tgtactgctgcaaggcttca

SEQ ID NO: 55636 - DNA, 20 bp, Artificial Sequence
  Synthetic oligonucleotide; CAG chr11 5162639 5162658 5162642 -
ctgctgcaaggcttcacaga

SEQ ID NO: 55637 - DNA, 20 bp, Artificial Sequence
  Synthetic oligonucleotide; CAG chr11 5162624 5162643 5162627 -
acagacagaccccattactt

SEQ ID NO: 55638 - DNA, 20 bp, Artificial Sequence
  Synthetic oligonucleotide; AAG chr11 5162619 5162638 5162622 -
cagaccccattacttcagtc

SEQ ID NO: 55639 - DNA, 20 bp, Artificial Sequence
  Synthetic oligonucleotide; CGG chr11 5162585 5162604 5162588 -
tcctcatgtgttacctatct

SEQ ID NO: 55640 - DNA, 20 bp, Artificial Sequence
  Synthetic oligonucleotide; TAG chr11 5162482 5162501 5162485 -
acaacaactcctttccttcc

SEQ ID NO: 55641 - DNA, 20 bp, Artificial Sequence
  Synthetic oligonucleotide; AGG chr11 5162481 5162500 5162484 -
caacaactcctttccttcct

SEQ ID NO: 55642 - DNA, 20 bp, Artificial Sequence
  Synthetic oligonucleotide; TAG chr11 5162476 5162495 5162479 -
actcctttccttcctaggca

SEQ ID NO: 55643 - DNA, 20 bp, Artificial Sequence
  Synthetic oligonucleotide; TAG chr11 5162472 5162491 5162475 -
ctttccttcctaggcatagt

SEQ ID NO: 55644 - DNA, 20 bp, Artificial Sequence
  Synthetic oligonucleotide; CGG chr11 5162467 5162486 5162470 -
cttcctaggcatagttagtg

SEQ ID NO: 55645 - DNA, 20 bp, Artificial Sequence
  Synthetic oligonucleotide; CAG chr11 5162463 5162482 5162466 -
ctaggcatagttagtgcggt

SEQ ID NO: 55646 - DNA, 20 bp, Artificial Sequence
  Synthetic oligonucleotide; AAG chr11 5162449 5162468 5162452 -
tgcggtcagaattcttacac

SEQ ID NO: 55647 - DNA, 20 bp, Artificial Sequence
  Synthetic oligonucleotide; CAG chr11 5162443 5162462 5162446 -
cagaattcttacacaagatc

SEQ ID NO: 55648 - DNA, 20 bp, Artificial Sequence
  Synthetic oligonucleotide; AGG chr11 5162442 5162461 5162445 -
agaattcttacacaagatcc

SEQ ID NO: 55649 - DNA, 20 bp, Artificial Sequence
  Synthetic oligonucleotide; TAG chr11 5162428 5162447 5162431 -
agatccaggactgcaccctg

SEQ ID NO: 55650 - DNA, 20 bp, Artificial Sequence
  Synthetic oligonucleotide; TAG chr11 5162392 5162411 5162395 -
ataacttgaccttactgttt

SEQ ID NO: 55651 - DNA, 20 bp, Artificial Sequence
  Synthetic oligonucleotide; TAG chr11 5162387 5162406 5162390 -
ttgaccttactgttttagcc

SEQ ID NO: 55652 - DNA, 20 bp, Artificial Sequence
  Synthetic oligonucleotide; CAG chr11 5162380 5162399 5162383 -
tactgttttagcctagccct

SEQ ID NO: 55653 - DNA, 20 bp, Artificial Sequence
  Synthetic oligonucleotide; AGG chr11 5162379 5162398 5162382 -
actgttttagcctagccctc

SEQ ID NO: 55654 - DNA, 20 bp, Artificial Sequence
  Synthetic oligonucleotide; CAG chr11 5162368 5162387 5162371 -
ctagccctcaggtctgcatg

SEQ ID NO: 55655 - DNA, 20 bp, Artificial Sequence
  Synthetic oligonucleotide; TGG chr11 5162365 5162384 5162368 -
gccctcaggtctgcatgcag

SEQ ID NO: 55656 - DNA, 20 bp, Artificial Sequence
  Synthetic oligonucleotide; TAG chr11 5162341 5162360 5162344 -
tgccgctgctttaatacttt

SEQ ID NO: 55657 - DNA, 20 bp, Artificial Sequence
  Synthetic oligonucleotide; GAG chr11 5162339 5162358 5162342 -
ccgctgctttaatactttta

SEQ ID NO: 55658 - DNA, 20 bp, Artificial Sequence
  Synthetic oligonucleotide; AGG chr11 5162338 5162357 5162341 -
cgctgctttaatacttttag

SEQ ID NO: 55659 - DNA, 20 bp, Artificial Sequence
  Synthetic oligonucleotide; TAG chr11 5162312 5162331 5162315 -
taaaaatcacaaactatgct

SEQ ID NO: 55660 - DNA, 20 bp, Artificial Sequence
  Synthetic oligonucleotide; CGG chr11 5162234 5162253 5162237 -
tgcatatactttctgatccc

SEQ ID NO: 55661 - DNA, 20 bp, Artificial Sequence
  Synthetic oligonucleotide; CAG chr11 5162225 5162244 5162228 -
tttctgatccccggctcctt

SEQ ID NO: 55662 - DNA, 20 bp, Artificial Sequence
  Synthetic oligonucleotide; AAG chr11 5162204 5162223 5162207 -
agctgtactcactctttgtt

SEQ ID NO: 55663 - DNA, 20 bp, Artificial Sequence
  Synthetic oligonucleotide; TGG chr11 5162186 5162205 5162189 -
ttaagtcccacaattaccat

SEQ ID NO: 55664 - DNA, 20 bp, Artificial Sequence
  Synthetic oligonucleotide; TGG chr11 5162180 5162199 5162183 -
cccacaattaccattggtcc

SEQ ID NO: 55665 - DNA, 20 bp, Artificial Sequence
  Synthetic oligonucleotide; CGG chr11 5162175 5162194 5162178 -
aattaccattggtcctggcc

SEQ ID NO: 55666 - DNA, 20 bp, Artificial Sequence
  Synthetic oligonucleotide; CGG chr11 5162163 5162182 5162166 -
tcctggcccggacttcaatc

SEQ ID NO: 55667 - DNA, 20 bp, Artificial Sequence
  Synthetic oligonucleotide; TGG chr11 5162022 5162041 5162025 -
gatcacacttgatttattga

SEQ ID NO: 55668 - DNA, 20 bp, Artificial Sequence
  Synthetic oligonucleotide; CAG chr11 5162010 5162029 5162013 -
tttattgatggccgttccac

SEQ ID NO: 55669 - DNA, 20 bp, Artificial Sequence
  Synthetic oligonucleotide; AGG chr11 5162009 5162028 5162012 -
ttattgatggccgttccacc

SEQ ID NO: 55670 - DNA, 20 bp, Artificial Sequence
  Synthetic oligonucleotide; TAG chr11 5162001 5162020 5162004 -
ggccgttccaccaggcctaa

SEQ ID NO: 55671 - DNA, 20 bp, Artificial Sequence
  Synthetic oligonucleotide; CAG chr11 5161990 5162009 5161993 -
caggcctaatagccacacac

SEQ ID NO: 55672 - DNA, 20 bp, Artificial Sequence
  Synthetic oligonucleotide; AAG chr11 5161985 5162004 5161988 -
ctaatagccacacaccagca

SEQ ID NO: 55673 - DNA, 20 bp, Artificial Sequence
  Synthetic oligonucleotide; AGG chr11 5161984 5162003 5161987 -
taatagccacacaccagcaa

SEQ ID NO: 55674 - DNA, 20 bp, Artificial Sequence
  Synthetic oligonucleotide; CAG chr11 5161981 5162000 5161984 -
tagccacacaccagcaaagg

SEQ ID NO: 55675 - DNA, 20 bp, Artificial Sequence
  Synthetic oligonucleotide; AGG chr11 5161980 5161999 5161983 -
agccacacaccagcaaaggc

SEQ ID NO: 55676 - DNA, 20 bp, Artificial Sequence
  Synthetic oligonucleotide; TAG chr11 5161969 5161988 5161972 -
agcaaaggcaggctatgcta

SEQ ID NO: 55677 - DNA, 20 bp, Artificial Sequence
  Synthetic oligonucleotide; TAG chr11 5161956 5161975 5161959 -
tatgctatagtacaaaccac

SEQ ID NO: 55678 - DNA, 20 bp, Artificial Sequence
  Synthetic oligonucleotide; TAG chr11 5161918 5161937 5161921 -
ctctcatttcctttccatcg

SEQ ID NO: 55679 - DNA, 20 bp, Artificial Sequence
  Synthetic oligonucleotide; AAG chr11 5161902 5161921 5161905 -
atcgtagaaatctatcctca

SEQ ID NO: 55680 - DNA, 20 bp, Artificial Sequence
  Synthetic oligonucleotide; CAG chr11 5161888 5161907 5161891 -
tcctcaaagaaataacttct

SEQ ID NO: 55681 - DNA, 20 bp, Artificial Sequence
  Synthetic oligonucleotide; CAG chr11 5161858 5161877 5161861 -
tctgctattctgctactcct

SEQ ID NO: 55682 - DNA, 20 bp, Artificial Sequence
  Synthetic oligonucleotide; AGG chr11 5161857 5161876 5161860 -
ctgctattctgctactcctc

SEQ ID NO: 55683 - DNA, 20 bp, Artificial Sequence
  Synthetic oligonucleotide; GGG chr11 5161856 5161875 5161859 -
tgctattctgctactcctca

SEQ ID NO: 55684 - DNA, 20 bp, Artificial Sequence
  Synthetic oligonucleotide; CAG chr11 5161847 5161866 5161850 -
gctactcctcagggattatt

SEQ ID NO: 55685 - DNA, 20 bp, Artificial Sequence
  Synthetic oligonucleotide; AGG chr11 5161846 5161865 5161849 -
ctactcctcagggattattc

SEQ ID NO: 55686 - DNA, 20 bp, Artificial Sequence
  Synthetic oligonucleotide; AAG chr11 5161821 5161840 5161824 -
ccctcccttccctacacatc

SEQ ID NO: 55687 - DNA, 20 bp, Artificial Sequence
  Synthetic oligonucleotide; GAG chr11 5161815 5161834 5161818 -
cttccctacacatcaagctc

SEQ ID NO: 55688 - DNA, 20 bp, Artificial Sequence
  Synthetic oligonucleotide; AGG chr11 5161814 5161833 5161817 -
ttccctacacatcaagctcg

SEQ ID NO: 55689 - DNA, 20 bp, Artificial Sequence
  Synthetic oligonucleotide; CAG chr11 5161798 5161817 5161801 -
ctcgaggatttgcccccacc

SEQ ID NO: 55690 - DNA, 20 bp, Artificial Sequence
  Synthetic oligonucleotide; AGG chr11 5161797 5161816 5161800 -
tcgaggatttgcccccaccc

SEQ ID NO: 55691 - DNA, 20 bp, Artificial Sequence
  Synthetic oligonucleotide; TGG chr11 5161792 5161811 5161795 -
gatttgcccccacccaggac

SEQ ID NO: 55692 - DNA, 20 bp, Artificial Sequence
  Synthetic oligonucleotide; TAG chr11 5161784 5161803 5161787 -
cccacccaggactggcaaat

SEQ ID NO: 55693 - DNA, 20 bp, Artificial Sequence
  Synthetic oligonucleotide; GAG chr11 5161763 5161782 5161766 -
agatttactcaacatgccct

SEQ ID NO: 55694 - DNA, 20 bp, Artificial Sequence
  Synthetic oligonucleotide; CAG chr11 5161759 5161778 5161762 -
ttactcaacatgccctgagt

SEQ ID NO: 55695 - DNA, 20 bp, Artificial Sequence
  Synthetic oligonucleotide; TAG chr11 5161739 5161758 5161742 -
cagataactaaaatacctct

SEQ ID NO: 55696 - DNA, 20 bp, Artificial Sequence
  Synthetic oligonucleotide; TAG chr11 5161734 5161753 5161737 -
aactaaaatacctcttagtc

SEQ ID NO: 55697 - DNA, 20 bp, Artificial Sequence
  Synthetic oligonucleotide; AGG chr11 5161733 5161752 5161736 -
actaaaatacctcttagtct

SEQ ID NO: 55698 - DNA, 20 bp, Artificial Sequence
  Synthetic oligonucleotide; TAG chr11 5161730 5161749 5161733 -
aaaatacctcttagtctagg

SEQ ID NO: 55699 - DNA, 20 bp, Artificial Sequence
  Synthetic oligonucleotide; TGG chr11 5161717 5161736 5161720 -
gtctaggtagacactttcac

SEQ ID NO: 55700 - DNA, 20 bp, Artificial Sequence
  Synthetic oligonucleotide; AAG chr11 5161712 5161731 5161715 -
ggtagacactttcactggat

SEQ ID NO: 55701 - DNA, 20 bp, Artificial Sequence
  Synthetic oligonucleotide; TAG chr11 5161709 5161728 5161712 -
agacactttcactggataag

SEQ ID NO: 55702 - DNA, 20 bp, Artificial Sequence
  Synthetic oligonucleotide; GAG chr11 5161707 5161726 5161710 -
acactttcactggataagta

SEQ ID NO: 55703 - DNA, 20 bp, Artificial Sequence
  Synthetic oligonucleotide; AGG chr11 5161706 5161725 5161709 -
cactttcactggataagtag

SEQ ID NO: 55704 - DNA, 20 bp, Artificial Sequence
  Synthetic oligonucleotide; CAG chr11 5161694 5161713 5161697 -
ataagtagaggtctttccta

SEQ ID NO: 55705 - DNA, 20 bp, Artificial Sequence
  Synthetic oligonucleotide; AGG chr11 5161693 5161712 5161696 -
taagtagaggtctttcctac

SEQ ID NO: 55706 - DNA, 20 bp, Artificial Sequence
  Synthetic oligonucleotide; GGG chr11 5161692 5161711 5161695 -
aagtagaggtctttcctaca

SEQ ID NO: 55707 - DNA, 20 bp, Artificial Sequence
  Synthetic oligonucleotide; GAG chr11 5161686 5161705 5161689 -
aggtctttcctacagggtct

SEQ ID NO: 55708 - DNA, 20 bp, Artificial Sequence
  Synthetic oligonucleotide; AAG chr11 5161683 5161702 5161686 -
tctttcctacagggtctgag

SEQ ID NO: 55709 - DNA, 20 bp, Artificial Sequence
  Synthetic oligonucleotide; AGG chr11 5161682 5161701 5161685 -
ctttcctacagggtctgaga

SEQ ID NO: 55710 - DNA, 20 bp, Artificial Sequence
  Synthetic oligonucleotide; CAG chr11 5161673 5161692 5161676 -
agggtctgagaaggccaccg

SEQ ID NO: 55711 - DNA, 20 bp, Artificial Sequence
  Synthetic oligonucleotide; CAG chr11 5161652 5161671 5161655 -
agtcatttcttcccttctgt

SEQ ID NO: 55712 - DNA, 20 bp, Artificial Sequence
  Synthetic oligonucleotide; CAG chr11 5161638 5161657 5161641 -
ttctgtcagacataattcct

SEQ ID NO: 55713 - DNA, 20 bp, Artificial Sequence
  Synthetic oligonucleotide; TAG chr11 5161633 5161652 5161636 -
tcagacataattcctcagtt

SEQ ID NO: 55714 - DNA, 20 bp, Artificial Sequence
  Synthetic oligonucleotide; CAG chr11 5161614 5161633 5161617 -
ttagccttcctacctctata

SEQ ID NO: 55715 - DNA, 20 bp, Artificial Sequence
  Synthetic oligonucleotide; CAG chr11 5161603 5161622 5161606 -
acctctatacagtctgataa

SEQ ID NO: 55716 - DNA, 20 bp, Artificial Sequence
  Synthetic oligonucleotide; CAG chr11 5161598 5161617 5161601 -
tatacagtctgataacagac

SEQ ID NO: 55717 - DNA, 20 bp, Artificial Sequence
  Synthetic oligonucleotide; TAG chr11 5161588 5161607 5161591 -
gataacagaccagcctttat

SEQ ID NO: 55718 - DNA, 20 bp, Artificial Sequence
  Synthetic oligonucleotide; CAG chr11 5161579 5161598 5161582 -
ccagcctttattagtcaaat

SEQ ID NO: 55719 - DNA, 20 bp, Artificial Sequence
  Synthetic oligonucleotide; AAG chr11 5161574 5161593 5161577 -
ctttattagtcaaatcagcc

SEQ ID NO: 55720 - DNA, 20 bp, Artificial Sequence
  Synthetic oligonucleotide; CAG chr11 5161571 5161590 5161574 -
tattagtcaaatcagccaag

SEQ ID NO: 55721 - DNA, 20 bp, Artificial Sequence
  Synthetic oligonucleotide; CAG chr11 5161563 5161582 5161566 -
aaatcagccaagcagttttt

SEQ ID NO: 55722 - DNA, 20 bp, Artificial Sequence
  Synthetic oligonucleotide; AGG chr11 5161562 5161581 5161565 -
aatcagccaagcagtttttc

SEQ ID NO: 55723 - DNA, 20 bp, Artificial Sequence
  Synthetic oligonucleotide; TAG chr11 5161555 5161574 5161558 -
caagcagtttttcaggctct

SEQ ID NO: 55724 - DNA, 20 bp, Artificial Sequence
  Synthetic oligonucleotide; CAG chr11 5161548 5161567 5161551 -
tttttcaggctcttagtatt

SEQ ID NO: 55725 - DNA, 20 bp, Artificial Sequence
  Synthetic oligonucleotide; CGG chr11 5161525 5161544 5161528 -
taaaacctttatatccctta

SEQ ID NO: 55726 - DNA, 20 bp, Artificial Sequence
  Synthetic oligonucleotide; CAG chr11 5161511 5161530 5161514 -
cccttacggtcctccgtctt

SEQ ID NO: 55727 - DNA, 20 bp, Artificial Sequence
  Synthetic oligonucleotide; AGG chr11 5161510 5161529 5161513 -
ccttacggtcctccgtcttc

SEQ ID NO: 55728 - DNA, 20 bp, Artificial Sequence
  Synthetic oligonucleotide; AAG chr11 5161505 5161524 5161508 -
cggtcctccgtcttcaggaa

SEQ ID NO: 55729 - DNA, 20 bp, Artificial Sequence
  Synthetic oligonucleotide; TAG chr11 5161502 5161521 5161505 -
tcctccgtcttcaggaaaag

SEQ ID NO: 55730 - DNA, 20 bp, Artificial Sequence
  Synthetic oligonucleotide; CGG chr11 5161497 5161516 5161500 -
cgtcttcaggaaaagtagaa

SEQ ID NO: 55731 - DNA, 20 bp, Artificial Sequence
  Synthetic oligonucleotide; AAG chr11 5161464 5161483 5161467 -
ttttaaaaacacacctcacc

SEQ ID NO: 55732 - DNA, 20 bp, Artificial Sequence
  Synthetic oligonucleotide; CAG chr11 5161459 5161478 5161462 -
aaaacacacctcaccaagct

SEQ ID NO: 55733 - DNA, 20 bp, Artificial Sequence
  Synthetic oligonucleotide; AAG chr11 5161443 5161462 5161446 -
agctcagccaccaacttaaa

SEQ ID NO: 55734 - DNA, 20 bp, Artificial Sequence
  Synthetic oligonucleotide; AGG chr11 5161442 5161461 5161445 -
gctcagccaccaacttaaaa

SEQ ID NO: 55735 - DNA, 20 bp, Artificial Sequence
  Synthetic oligonucleotide; TGG chr11 5161437 5161456 5161440 -
gccaccaacttaaaaaggac

SEQ ID NO: 55736 - DNA, 20 bp, Artificial Sequence
  Synthetic oligonucleotide; CAG chr11 5161408 5161427 5161411 -
cttttaccacttttctttct

SEQ ID NO: 55737 - DNA, 20 bp, Artificial Sequence
  Synthetic oligonucleotide; AAG chr11 5161405 5161424 5161408 -
ttaccacttttctttctcag

SEQ ID NO: 55738 - DNA, 20 bp, Artificial Sequence
  Synthetic oligonucleotide; CAG chr11 5161401 5161420 5161404 -
cacttttctttctcagaagt

SEQ ID NO: 55739 - DNA, 20 bp, Artificial Sequence
  Synthetic oligonucleotide; CAG chr11 5161389 5161408 5161392 -
tcagaagtcagacctgtcct

SEQ ID NO: 55740 - DNA, 20 bp, Artificial Sequence
  Synthetic oligonucleotide; CAG chr11 5161379 5161398 5161382 -
gacctgtcctcagaatgcta

SEQ ID NO: 55741 - DNA, 20 bp, Artificial Sequence
  Synthetic oligonucleotide; AGG chr11 5161378 5161397 5161381 -
acctgtcctcagaatgctac

SEQ ID NO: 55742 - DNA, 20 bp, Artificial Sequence
  Synthetic oligonucleotide; GGG chr11 5161377 5161396 5161380 -
cctgtcctcagaatgctaca

SEQ ID NO: 55743 - DNA, 20 bp, Artificial Sequence
  Synthetic oligonucleotide; CAG chr11 5161372 5161391 5161375 -
cctcagaatgctacagggta

SEQ ID NO: 55744 - DNA, 20 bp, Artificial Sequence
  Synthetic oligonucleotide; GAG chr11 5161362 5161381 5161365 -
ctacagggtacagcccattt

SEQ ID NO: 55745 - DNA, 20 bp, Artificial Sequence
  Synthetic oligonucleotide; TAG chr11 5161351 5161370 5161354 -
agcccatttgagctcctgta

SEQ ID NO: 55746 - DNA, 20 bp, Artificial Sequence
  Synthetic oligonucleotide; TAG chr11 5161334 5161353 5161337 -
gtatagatttgcctttttat

SEQ ID NO: 55747 - DNA, 20 bp, Artificial Sequence
  Synthetic oligonucleotide; AGG chr11 5161333 5161352 5161336 -
tatagatttgcctttttatt

SEQ ID NO: 55748 - DNA, 20 bp, Artificial Sequence
  Synthetic oligonucleotide; CAG chr11 5161327 5161346 5161330 -
tttgcctttttattaggccc

SEQ ID NO: 55749 - DNA, 20 bp, Artificial Sequence
  Synthetic oligonucleotide; CAG chr11 5161316 5161335 5161319 -
attaggccccagtctaattc

SEQ ID NO: 55750 - DNA, 20 bp, Artificial Sequence
  Synthetic oligonucleotide; CAG chr11 5161309 5161328 5161312 -
cccagtctaattccagacac

SEQ ID NO: 55751 - DNA, 20 bp, Artificial Sequence
  Synthetic oligonucleotide; TAG chr11 5161299 5161318 5161302 -
ttccagacaccagaccaact

SEQ ID NO: 55752 - DNA, 20 bp, Artificial Sequence
  Synthetic oligonucleotide; TAG chr11 5161254 5161273 5161257 -
catccctgctatcttctgtc

SEQ ID NO: 55753 - DNA, 20 bp, Artificial Sequence
  Synthetic oligonucleotide; CGG chr11 5161192 5161211 5161195 -
cctgctcttgtttacactgc

SEQ ID NO: 55754 - DNA, 20 bp, Artificial Sequence
  Synthetic oligonucleotide; AAG chr11 5161173 5161192 5161176 -
ccggtttacactgtttttcc

SEQ ID NO: 55755 - DNA, 20 bp, Artificial Sequence
  Synthetic oligonucleotide; CAG chr11 5161164 5161183 5161167 -
actgtttttccaagccatca

SEQ ID NO: 55756 - DNA, 20 bp, Artificial Sequence
  Synthetic oligonucleotide; TGG chr11 5161150 5161169 5161153 -
ccatcacagctgatatctcc

SEQ ID NO: 55757 - DNA, 20 bp, Artificial Sequence
  Synthetic oligonucleotide; AAG chr11 5161115 5161134 5161118 -
actgccactcttaactcttg

SEQ ID NO: 55758 - DNA, 20 bp, Artificial Sequence
  Synthetic oligonucleotide; TGG chr11 5161094 5161113 5161097 -
agtaaataaataatctttgc

SEQ ID NO: 55759 - DNA, 20 bp, Artificial Sequence
  Synthetic oligonucleotide; CAG chr11 5161091 5161110 5161094 -
aaataaataatctttgctgg

SEQ ID NO: 55760 - DNA, 20 bp, Artificial Sequence
  Synthetic oligonucleotide; AGG chr11 5161090 5161109 5161093 -
aataaataatctttgctggc

SEQ ID NO: 55761 - DNA, 20 bp, Artificial Sequence
  Synthetic oligonucleotide; TAG chr11 5161070 5161089 5161073 -
aggactatgttgaatctcct

SEQ ID NO: 55762 - DNA, 20 bp, Artificial Sequence
  Synthetic oligonucleotide; AGG chr11 5161069 5161088 5161072 -
ggactatgttgaatctcctt

SEQ ID NO: 55763 - DNA, 20 bp, Artificial Sequence
  Synthetic oligonucleotide; CAG chr11 5161055 5161074 5161058 -
ctccttaggcactctttaat

SEQ ID NO: 55764 - DNA, 20 bp, Artificial Sequence
  Synthetic oligonucleotide; TAG chr11 5161046 5161065 5161049 -
cactctttaatcagatgtcc

SEQ ID NO: 55765 - DNA, 20 bp, Artificial Sequence
  Synthetic oligonucleotide; AGG chr11 5161045 5161064 5161048 -
actctttaatcagatgtcct

SEQ ID NO: 55766 - DNA, 20 bp, Artificial Sequence
  Synthetic oligonucleotide; TAG chr11 5161029 5161048 5161032 -
tcctaggtcctcccacttct

SEQ ID NO: 55767 - DNA, 20 bp, Artificial Sequence
  Synthetic oligonucleotide; TGG chr11 5160988 5161007 5160991 -
tctccttctcttattccatt

SEQ ID NO: 55768 - DNA, 20 bp, Artificial Sequence
  Synthetic oligonucleotide; CAG chr11 5160959 5160978 5160962 -
aatccatacaaaaccgtatc

SEQ ID NO: 55769 - DNA, 20 bp, Artificial Sequence
  Synthetic oligonucleotide; AGG chr11 5160958 5160977 5160961 -
atccatacaaaaccgtatcc

SEQ ID NO: 55770 - DNA, 20 bp, Artificial Sequence
  Synthetic oligonucleotide; CAG chr11 5160877 5160896 5160880 -
cttaccacaaaatcttcctt

SEQ ID NO: 55771 - DNA, 20 bp, Artificial Sequence
  Synthetic oligonucleotide; TAG chr11 5160857 5160876 5160860 -
cagcttaatctctcccactc

SEQ ID NO: 55772 - DNA, 20 bp, Artificial Sequence
  Synthetic oligonucleotide; AGG chr11 5160856 5160875 5160859 -
agcttaatctctcccactct

SEQ ID NO: 55773 - DNA, 20 bp, Artificial Sequence
  Synthetic oligonucleotide; AAG chr11 5160826 5160845 5160829 -
gccgcccctaatcccgctcg

SEQ ID NO: 55774 - DNA, 20 bp, Artificial Sequence
  Synthetic oligonucleotide; CAG chr11 5160823 5160842 5160826 -
gcccctaatcccgctcgaag

SEQ ID NO: 55775 - DNA, 20 bp, Artificial Sequence
  Synthetic oligonucleotide; GAG chr11 5160816 5160835 5160819 -
atcccgctcgaagcagccct

SEQ ID NO: 55776 - DNA, 20 bp, Artificial Sequence
  Synthetic oligonucleotide; AAG chr11 5160721 5160740 5160724 -
tttatttttcttattaatat

SEQ ID NO: 55777 - DNA, 20 bp, Artificial Sequence
  Synthetic oligonucleotide; AAG chr11 5160718 5160737 5160721 -
atttttcttattaatataag

SEQ ID NO: 55778 - DNA, 20 bp, Artificial Sequence
  Synthetic oligonucleotide; CAG chr11 5160714 5160733 5160717 -
ttcttattaatataagaaga

SEQ ID NO: 55779 - DNA, 20 bp, Artificial Sequence
  Synthetic oligonucleotide; AGG chr11 5160713 5160732 5160716 -
tcttattaatataagaagac

SEQ ID NO: 55780 - DNA, 20 bp, Artificial Sequence
  Synthetic oligonucleotide; CAG chr11 5160705 5160724 5160708 -
atataagaagacaggaatgt

SEQ ID NO: 55781 - DNA, 20 bp, Artificial Sequence
  Synthetic oligonucleotide; AGG chr11 5160704 5160723 5160707 -
tataagaagacaggaatgtc

SEQ ID NO: 55782 - DNA, 20 bp, Artificial Sequence
  Synthetic oligonucleotide; GAG chr11 5160696 5160715 5160699 -
gacaggaatgtcaggcctct

SEQ ID NO: 55783 - DNA, 20 bp, Artificial Sequence
  Synthetic oligonucleotide; AAG chr11 5160690 5160709 5160693 -
aatgtcaggcctctgagccc

SEQ ID NO: 55784 - DNA, 20 bp, Artificial Sequence
  Synthetic oligonucleotide; AAG chr11 5160685 5160704 5160688 -
caggcctctgagcccaagct

SEQ ID NO: 55785 - DNA, 20 bp, Artificial Sequence
  Synthetic oligonucleotide; CAG chr11 5160660 5160679 5160663 -
atcatgtcccctgtgacctg

SEQ ID NO: 55786 - DNA, 20 bp, Artificial Sequence
  Synthetic oligonucleotide; AGG chr11 5160659 5160678 5160662 -
tcatgtcccctgtgacctgc

SEQ ID NO: 55787 - DNA, 20 bp, Artificial Sequence
  Synthetic oligonucleotide; CAG chr11 5160648 5160667 5160651 -
gtgacctgcaggtacacata

SEQ ID NO: 55788 - DNA, 20 bp, Artificial Sequence
  Synthetic oligonucleotide; TGG chr11 5160644 5160663 5160647 -
cctgcaggtacacatacaga

SEQ ID NO: 55789 - DNA, 20 bp, Artificial Sequence
  Synthetic oligonucleotide; CAG chr11 5160640 5160659 5160643 -
caggtacacatacagatggc

SEQ ID NO: 55790 - DNA, 20 bp, Artificial Sequence
  Synthetic oligonucleotide; AAG chr11 5160605 5160624 5160608 -
ctgatgacattccaccacaa

SEQ ID NO: 55791 - DNA, 20 bp, Artificial Sequence
  Synthetic oligonucleotide; AAG chr11 5160602 5160621 5160605 -
atgacattccaccacaaaag

SEQ ID NO: 55792 - DNA, 20 bp, Artificial Sequence
  Synthetic oligonucleotide; TGG chr11 5160593 5160612 5160596 -
caccacaaaagaagtgaaaa

SEQ ID NO: 55793 - DNA, 20 bp, Artificial Sequence
  Synthetic oligonucleotide; AAG chr11 5160554 5160573 5160557 -
ctgatgacattgtcttgtga

SEQ ID NO: 55794 - DNA, 20 bp, Artificial Sequence
  Synthetic oligonucleotide; TGG chr11 5160542 5160561 5160545 -
tcttgtgaaagtccttctcc

SEQ ID NO: 55795 - DNA, 20 bp, Artificial Sequence
  Synthetic oligonucleotide; TGG chr11 5160532 5160551 5160535 -
gtccttctcctggctcatcc

SEQ ID NO: 55796 - DNA, 20 bp, Artificial Sequence
  Synthetic oligonucleotide; AAG chr11 5160524 5160543 5160527 -
cctggctcatcctggctcaa

SEQ ID NO: 55797 - DNA, 20 bp, Artificial Sequence
  Synthetic oligonucleotide; GAG chr11 5160511 5160530 5160514 -
ggctcaaaagctcccctact

SEQ ID NO: 55798 - DNA, 20 bp, Artificial Sequence
  Synthetic oligonucleotide; CAG chr11 5160480 5160499 5160483 -
gaccccccactcctgcccgc

SEQ ID NO: 55799 - DNA, 20 bp, Artificial Sequence
  Synthetic oligonucleotide; GAG chr11 5160478 5160497 5160481 -
ccccccactcctgcccgcca

SEQ ID NO: 55800 - DNA, 20 bp, Artificial Sequence
  Synthetic oligonucleotide; CAG chr11 5160423 5160442 5160426 -
cctacccaaatcttataaaa

SEQ ID NO: 55801 - DNA, 20 bp, Artificial Sequence
  Synthetic oligonucleotide; CGG chr11 5160386 5160405 5160389 -
ccctttgctgactctctttt

SEQ ID NO: 55802 - DNA, 20 bp, Artificial Sequence
  Synthetic oligonucleotide; CAG chr11 5160380 5160399 5160383 -
gctgactctcttttcggact

SEQ ID NO: 55803 - DNA, 20 bp, Artificial Sequence
  Synthetic oligonucleotide; CAG chr11 5160365 5160384 5160368 -
ggactcagcccgcctgcacc

SEQ ID NO: 55804 - DNA, 20 bp, Artificial Sequence
  Synthetic oligonucleotide; AGG chr11 5160364 5160383 5160367 -
gactcagcccgcctgcaccc

SEQ ID NO: 55805 - DNA, 20 bp, Artificial Sequence
  Synthetic oligonucleotide; AAG chr11 5160354 5160373 5160357 -
gcctgcacccaggtgataaa

SEQ ID NO: 55806 - DNA, 20 bp, Artificial Sequence
  Synthetic oligonucleotide; AAG chr11 5160335 5160354 5160338 -
aaagctttattgctcacaca

SEQ ID NO: 55807 - DNA, 20 bp, Artificial Sequence
  Synthetic oligonucleotide; TGG chr11 5160326 5160345 5160329 -
ttgctcacacaaagcctgtt

SEQ ID NO: 55808 - DNA, 20 bp, Artificial Sequence
  Synthetic oligonucleotide; TAG chr11 5160323 5160342 5160326 -
ctcacacaaagcctgtttgg

SEQ ID NO: 55809 - DNA, 20 bp, Artificial Sequence
  Synthetic oligonucleotide; CAG chr11 5160312 5160331 5160315 -
cctgtttggtagtctcctca

SEQ ID NO: 55810 - DNA, 20 bp, Artificial Sequence
  Synthetic oligonucleotide; AGG chr11 5160311 5160330 5160314 -
ctgtttggtagtctcctcac

SEQ ID NO: 55811 - DNA, 20 bp, Artificial Sequence
  Synthetic oligonucleotide; GGG chr11 5160310 5160329 5160313 -
tgtttggtagtctcctcaca

SEQ ID NO: 55812 - DNA, 20 bp, Artificial Sequence
  Synthetic oligonucleotide; GAG chr11 5160282 5160301 5160285 -
catgaaactgaataaccaat

SEQ ID NO: 55813 - DNA, 20 bp, Artificial Sequence
  Synthetic oligonucleotide; AAG chr11 5160273 5160292 5160276 -
gaataaccaatgagtcacta

SEQ ID NO: 55814 - DNA, 20 bp, Artificial Sequence
  Synthetic oligonucleotide; AAG chr11 5160265 5160284 5160268 -
aatgagtcactaaagaaatt

SEQ ID NO: 55815 - DNA, 20 bp, Artificial Sequence
  Synthetic oligonucleotide; AAG chr11 5160262 5160281 5160265 -
gagtcactaaagaaattaag

SEQ ID NO: 55816 - DNA, 20 bp, Artificial Sequence
  Synthetic oligonucleotide; AGG chr11 5160261 5160280 5160264 -
agtcactaaagaaattaaga

SEQ ID NO: 55817 - DNA, 20 bp, Artificial Sequence
  Synthetic oligonucleotide; AAG chr11 5160236 5160255 5160239 -
attttaaaacttcttgaaac

SEQ ID NO: 55818 - DNA, 20 bp, Artificial Sequence
  Synthetic oligonucleotide; TGG chr11 5160227 5160246 5160230 -
cttcttgaaacaagtgaaaa

SEQ ID NO: 55819 - DNA, 20 bp, Artificial Sequence
  Synthetic oligonucleotide; CAG chr11 5160202 5160221 5160205 -
atacaacataccaaaaccta

SEQ ID NO: 55820 - DNA, 20 bp, Artificial Sequence
  Synthetic oligonucleotide; AGG chr11 5160201 5160220 5160204 -
tacaacataccaaaacctac

SEQ ID NO: 55821 - DNA, 20 bp, Artificial Sequence
  Synthetic oligonucleotide; TGG chr11 5160195 5160214 5160198 -
ataccaaaacctacaggata

SEQ ID NO: 55822 - DNA, 20 bp, Artificial Sequence
  Synthetic oligonucleotide; AAG chr11 5160189 5160208 5160192 -
aaacctacaggatatggcaa

SEQ ID NO: 55823 - DNA, 20 bp, Artificial Sequence
  Synthetic oligonucleotide; CAG chr11 5160186 5160205 5160189 -
cctacaggatatggcaaaag

SEQ ID NO: 55824 - DNA, 20 bp, Artificial Sequence
  Synthetic oligonucleotide; TAG chr11 5160179 5160198 5160182 -
gatatggcaaaagcagtact

SEQ ID NO: 55825 - DNA, 20 bp, Artificial Sequence
  Synthetic oligonucleotide; GAG chr11 5160177 5160196 5160180 -
tatggcaaaagcagtactta

SEQ ID NO: 55826 - DNA, 20 bp, Artificial Sequence
  Synthetic oligonucleotide; AGG chr11 5160176 5160195 5160179 -
atggcaaaagcagtacttag

SEQ ID NO: 55827 - DNA, 20 bp, Artificial Sequence
  Synthetic oligonucleotide; GGG chr11 5160175 5160194 5160178 -
tggcaaaagcagtacttaga

SEQ ID NO: 55828 - DNA, 20 bp, Artificial Sequence
  Synthetic oligonucleotide; AAG chr11 5160172 5160191 5160175 -
caaaagcagtacttagaggg

SEQ ID NO: 55829 - DNA, 20 bp, Artificial Sequence
  Synthetic oligonucleotide; TAG chr11 5160165 5160184 5160168 -
agtacttagagggaagttca

SEQ ID NO: 55830 - DNA, 20 bp, Artificial Sequence
  Synthetic oligonucleotide; AAG chr11 5160140 5160159 5160143 -
ataaacacctatatccaaaa

SEQ ID NO: 55831 - DNA, 20 bp, Artificial Sequence
  Synthetic oligonucleotide; TAG chr11 5160137 5160156 5160140 -
aacacctatatccaaaaaag

SEQ ID NO: 55832 - DNA, 20 bp, Artificial Sequence
  Synthetic oligonucleotide; AAG chr11 5160133 5160152 5160136 -
cctatatccaaaaaagtaga

SEQ ID NO: 55833 - DNA, 20 bp, Artificial Sequence
  Synthetic oligonucleotide; AGG chr11 5160132 5160151 5160135 -
ctatatccaaaaaagtagaa

SEQ ID NO: 55834 - DNA, 20 bp, Artificial Sequence
  Synthetic oligonucleotide; AAG chr11 5160121 5160140 5160124 -
aaagtagaaaggcttcaact

SEQ ID NO: 55835 - DNA, 20 bp, Artificial Sequence
  Synthetic oligonucleotide; AAG chr11 5160099 5160118 5160102 -
gcaaccaaacaatgtacctc

SEQ ID NO: 55836 - DNA, 20 bp, Artificial Sequence
  Synthetic oligonucleotide; AGG chr11 5160098 5160117 5160101 -
caaccaaacaatgtacctca

SEQ ID NO: 55837 - DNA, 20 bp, Artificial Sequence
  Synthetic oligonucleotide; TAG chr11 5160092 5160111 5160095 -
aacaatgtacctcaaggaaa

SEQ ID NO: 55838 - DNA, 20 bp, Artificial Sequence
  Synthetic oligonucleotide; AGG chr11 5160091 5160110 5160094 -
acaatgtacctcaaggaaat

SEQ ID NO: 55839 - DNA, 20 bp, Artificial Sequence
  Synthetic oligonucleotide; AAG chr11 5160087 5160106 5160090 -
tgtacctcaaggaaatagga

SEQ ID NO: 55840 - DNA, 20 bp, Artificial Sequence
  Synthetic oligonucleotide; AAG chr11 5160083 5160102 5160086 -
cctcaaggaaataggaaagc

SEQ ID NO: 55841 - DNA, 20 bp, Artificial Sequence
  Synthetic oligonucleotide; TAG chr11 5160058 5160077 5160061 -
caaaccaaatgcaaaattaa

SEQ ID NO: 55842 - DNA, 20 bp, Artificial Sequence
  Synthetic oligonucleotide; AAG chr11 5160055 5160074 5160058 -
accaaatgcaaaattaatag

SEQ ID NO: 55843 - DNA, 20 bp, Artificial Sequence
  Synthetic oligonucleotide; AGG chr11 5160054 5160073 5160057 -
ccaaatgcaaaattaataga

SEQ ID NO: 55844 - DNA, 20 bp, Artificial Sequence
  Synthetic oligonucleotide; GGG chr11 5160053 5160072 5160056 -
caaatgcaaaattaatagaa

SEQ ID NO: 55845 - DNA, 20 bp, Artificial Sequence
  Synthetic oligonucleotide; GGG chr11 5160052 5160071 5160055 -
aaatgcaaaattaatagaag

SEQ ID NO: 55846 - DNA, 20 bp, Artificial Sequence
  Synthetic oligonucleotide; GAG chr11 5160050 5160069 5160053 -
atgcaaaattaatagaaggg

SEQ ID NO: 55847 - DNA, 20 bp, Artificial Sequence
  Synthetic oligonucleotide; AAG chr11 5160043 5160062 5160046 -
attaatagaaggggagaaat

SEQ ID NO: 55848 - DNA, 20 bp, Artificial Sequence
  Synthetic oligonucleotide; AAG chr11 5160039 5160058 5160042 -
atagaaggggagaaataaga

SEQ ID NO: 55849 - DNA, 20 bp, Artificial Sequence
  Synthetic oligonucleotide; CAG chr11 5160034 5160053 5160037 -
aggggagaaataagaaagat

SEQ ID NO: 55850 - DNA, 20 bp, Artificial Sequence
  Synthetic oligonucleotide; GAG chr11 5160032 5160051 5160035 -
gggagaaataagaaagatca

SEQ ID NO: 55851 - DNA, 20 bp, Artificial Sequence
  Synthetic oligonucleotide; AAG chr11 5160029 5160048 5160032 -
agaaataagaaagatcagag

SEQ ID NO: 55852 - DNA, 20 bp, Artificial Sequence
  Synthetic oligonucleotide; GAG chr11 5160012 5160031 5160015 -
gagaagaaacaaatgaaatt

SEQ ID NO: 55853 - DNA, 20 bp, Artificial Sequence
  Synthetic oligonucleotide; CAG chr11 5159998 5160017 5160001 -
gaaattgagaccaaaaaata

SEQ ID NO: 55854 - DNA, 20 bp, Artificial Sequence
  Synthetic oligonucleotide; CAG chr11 5159977 5159996 5159980 -
agaaaatcattaaaaacaaa

SEQ ID NO: 55855 - DNA, 20 bp, Artificial Sequence
  Synthetic oligonucleotide; TGG chr11 5159965 5159984 5159968 -
aaaacaaacagttgctttct

SEQ ID NO: 55856 - DNA, 20 bp, Artificial Sequence
  Synthetic oligonucleotide; AAG chr11 5159961 5159980 5159964 -
caaacagttgctttcttgga

SEQ ID NO: 55857 - DNA, 20 bp, Artificial Sequence
  Synthetic oligonucleotide; AGG chr11 5159960 5159979 5159963 -
aaacagttgctttcttggaa

SEQ ID NO: 55858 - DNA, 20 bp, Artificial Sequence
  Synthetic oligonucleotide; AAG chr11 5159935 5159954 5159938 -
aacaaaatcaacaaaacttt

SEQ ID NO: 55859 - DNA, 20 bp, Artificial Sequence
  Synthetic oligonucleotide; AAG chr11 5159928 5159947 5159931 -
tcaacaaaactttaagaaaa

SEQ ID NO: 55860 - DNA, 20 bp, Artificial Sequence
  Synthetic oligonucleotide; GAG chr11 5159926 5159945 5159929 -
aacaaaactttaagaaaaaa

SEQ ID NO: 55861 - DNA, 20 bp, Artificial Sequence
  Synthetic oligonucleotide; TAG chr11 5159912 5159931 5159915 -
aaaaaagagtcaaataaaat

SEQ ID NO: 55862 - DNA, 20 bp, Artificial Sequence
  Synthetic oligonucleotide; AAG chr11 5159900 5159919 5159903 -
aataaaattagaaaatgaaa

SEQ ID NO: 55863 - DNA, 20 bp, Artificial Sequence
  Synthetic oligonucleotide; GAG chr11 5159898 5159917 5159901 -
taaaattagaaaatgaaaaa

SEQ ID NO: 55864 - DNA, 20 bp, Artificial Sequence
  Synthetic oligonucleotide; AGG chr11 5159897 5159916 5159900 -
aaaattagaaaatgaaaaag

SEQ ID NO: 55865 - DNA, 20 bp, Artificial Sequence
  Synthetic oligonucleotide; GAG chr11 5159883 5159902 5159886 -
aaaaagaggatataacaatt

SEQ ID NO: 55866 - DNA, 20 bp, Artificial Sequence
  Synthetic oligonucleotide; CAG chr11 5159876 5159895 5159879 -
ggatataacaattgagacct

SEQ ID NO: 55867 - DNA, 20 bp, Artificial Sequence
  Synthetic oligonucleotide; AAG chr11 5159866 5159885 5159869 -
attgagacctcagcaacaca

SEQ ID NO: 55868 - DNA, 20 bp, Artificial Sequence
  Synthetic oligonucleotide; TAG chr11 5159857 5159876 5159860 -
tcagcaacacaaagactcat

SEQ ID NO: 55869 - DNA, 20 bp, Artificial Sequence
  Synthetic oligonucleotide; TGG chr11 5159822 5159841 5159825 -
acaactgtattccaacaaat

SEQ ID NO: 55870 - DNA, 20 bp, Artificial Sequence
  Synthetic oligonucleotide; TAG chr11 5159813 5159832 5159816 -
ttccaacaaattggaaaatc

SEQ ID NO: 55871 - DNA, 20 bp, Artificial Sequence
  Synthetic oligonucleotide; TGG chr11 5159804 5159823 5159807 -
attggaaaatctagaataaa

SEQ ID NO: 55872 - DNA, 20 bp, Artificial Sequence
  Synthetic oligonucleotide; TGG chr11 5159792 5159811 5159795 -
agaataaatggataaattcc

SEQ ID NO: 55873 - DNA, 20 bp, Artificial Sequence
  Synthetic oligonucleotide; CAG chr11 5159782 5159801 5159785 -
gataaattcctggacacata

SEQ ID NO: 55874 - DNA, 20 bp, Artificial Sequence
  Synthetic oligonucleotide; TAG chr11 5159777 5159796 5159780 -
attcctggacacatacagcc

SEQ ID NO: 55875 - DNA, 20 bp, Artificial Sequence
  Synthetic oligonucleotide; AAG chr11 5159773 5159792 5159776 -
ctggacacatacagcctagc

SEQ ID NO: 55876 - DNA, 20 bp, Artificial Sequence
  Synthetic oligonucleotide; AAG chr11 5159766 5159785 5159769 -
catacagcctagcaagactg

SEQ ID NO: 55877 - DNA, 20 bp, Artificial Sequence
  Synthetic oligonucleotide; TAG chr11 5159759 5159778 5159762 -
cctagcaagactgaagcatg

SEQ ID NO: 55878 - DNA, 20 bp, Artificial Sequence
  Synthetic oligonucleotide; CAG chr11 5159753 5159772 5159756 -
aagactgaagcatgtagaaa

SEQ ID NO: 55879 - DNA, 20 bp, Artificial Sequence
  Synthetic oligonucleotide; TAG chr11 5159740 5159759 5159743 -
gtagaaacagaaaacctcaa

SEQ ID NO: 55880 - DNA, 20 bp, Artificial Sequence
  Synthetic oligonucleotide; AAG chr11 5159721 5159740 5159724 -
atagaacaataatgaataac

SEQ ID NO: 55881 - DNA, 20 bp, Artificial Sequence
  Synthetic oligonucleotide; AAG chr11 5159714 5159733 5159717 -
aataatgaataacaagatta

SEQ ID NO: 55882 - DNA, 20 bp, Artificial Sequence
  Synthetic oligonucleotide; AAG chr11 5159701 5159720 5159704 -
aagattaaagttgtaatata

SEQ ID NO: 55883 - DNA, 20 bp, Artificial Sequence
  Synthetic oligonucleotide; AAG chr11 5159688 5159707 5159691 -
taatataaagtttcctatta

SEQ ID NO: 55884 - DNA, 20 bp, Artificial Sequence
  Synthetic oligonucleotide; AAG chr11 5159683 5159702 5159686 -
taaagtttcctattaaagaa

SEQ ID NO: 55885 - DNA, 20 bp, Artificial Sequence
  Synthetic oligonucleotide; CAG chr11 5159678 5159697 5159681 -
tttcctattaaagaaaagcc

SEQ ID NO: 55886 - DNA, 20 bp, Artificial Sequence
  Synthetic oligonucleotide; AGG chr11 5159677 5159696 5159680 -
ttcctattaaagaaaagccc

SEQ ID NO: 55887 - DNA, 20 bp, Artificial Sequence
  Synthetic oligonucleotide; TGG chr11 5159668 5159687 5159671 -
aagaaaagcccaggactcga

SEQ ID NO: 55888 - DNA, 20 bp, Artificial Sequence
  Synthetic oligonucleotide; GGG chr11 5159667 5159686 5159670 -
agaaaagcccaggactcgat

SEQ ID NO: 55889 - DNA, 20 bp, Artificial Sequence
  Synthetic oligonucleotide; AAG chr11 5159650 5159669 5159653 -
gatgggctaccaaacatttc

SEQ ID NO: 55890 - DNA, 20 bp, Artificial Sequence
  Synthetic oligonucleotide; TAG chr11 5159647 5159666 5159650 -
gggctaccaaacatttcaag

SEQ ID NO: 55891 - DNA, 20 bp, Artificial Sequence
  Synthetic oligonucleotide; AAG chr11 5159589 5159608 5159592 -
acaaacaaataaaaactgaa

SEQ ID NO: 55892 - DNA, 20 bp, Artificial Sequence
  Synthetic oligonucleotide; AAG chr11 5159586 5159605 5159589 -
aacaaataaaaactgaaaag

SEQ ID NO: 55893 - DNA, 20 bp, Artificial Sequence
  Synthetic oligonucleotide; AGG chr11 5159585 5159604 5159588 -
acaaataaaaactgaaaaga

SEQ ID NO: 55894 - DNA, 20 bp, Artificial Sequence
  Synthetic oligonucleotide; GGG chr11 5159584 5159603 5159587 -
caaataaaaactgaaaagaa

SEQ ID NO: 55895 - DNA, 20 bp, Artificial Sequence
  Synthetic oligonucleotide; GAG chr11 5159559 5159578 5159562 -
tacttctaaacttattctat

SEQ ID NO: 55896 - DNA, 20 bp, Artificial Sequence
  Synthetic oligonucleotide; AGG chr11 5159558 5159577 5159561 -
acttctaaacttattctatg

SEQ ID NO: 55897 - DNA, 20 bp, Artificial Sequence
  Synthetic oligonucleotide; AAG chr11 5159554 5159573 5159557 -
ctaaacttattctatgaggc

SEQ ID NO: 55898 - DNA, 20 bp, Artificial Sequence
  Synthetic oligonucleotide; CAG chr11 5159529 5159548 5159532 -
ttactctaatatacccaaac

SEQ ID NO: 55899 - DNA, 20 bp, Artificial Sequence
  Synthetic oligonucleotide; CAG chr11 5159524 5159543 5159527 -
ctaatatacccaaaccagac

SEQ ID NO: 55900 - DNA, 20 bp, Artificial Sequence
  Synthetic oligonucleotide; AGG chr11 5159523 5159542 5159526 -
taatatacccaaaccagacc

SEQ ID NO: 55901 - DNA, 20 bp, Artificial Sequence
  Synthetic oligonucleotide; AAG chr11 5159498 5159517 5159501 -
acaacaacaaatgcacctca

SEQ ID NO: 55902 - DNA, 20 bp, Artificial Sequence
  Synthetic oligonucleotide; AGG chr11 5159497 5159516 5159500 -
caacaacaaatgcacctcaa

SEQ ID NO: 55903 - DNA, 20 bp, Artificial Sequence
  Synthetic oligonucleotide; GAG chr11 5159495 5159514 5159498 -
acaacaaatgcacctcaaag

SEQ ID NO: 55904 - DNA, 20 bp, Artificial Sequence
  Synthetic oligonucleotide; AGG chr11 5159494 5159513 5159497 -
caacaaatgcacctcaaagg

SEQ ID NO: 55905 - DNA, 20 bp, Artificial Sequence
  Synthetic oligonucleotide; CAG chr11 5159489 5159508 5159492 -
aatgcacctcaaaggaggta

SEQ ID NO: 55906 - DNA, 20 bp, Artificial Sequence
  Synthetic oligonucleotide; TAG chr11 5159486 5159505 5159489 -
gcacctcaaaggaggtacag

SEQ ID NO: 55907 - DNA, 20 bp, Artificial Sequence
  Synthetic oligonucleotide; AGG chr11 5159485 5159504 5159488 -
cacctcaaaggaggtacagt

SEQ ID NO: 55908 - DNA, 20 bp, Artificial Sequence
  Synthetic oligonucleotide; TAG chr11 5159454 5159473 5159457 -
tcaaaataataaaaaccata

SEQ ID NO: 55909 - DNA, 20 bp, Artificial Sequence
  Synthetic oligonucleotide; AGG chr11 5159453 5159472 5159456 -
caaaataataaaaaccatat

SEQ ID NO: 55910 - DNA, 20 bp, Artificial Sequence
  Synthetic oligonucleotide; AAG chr11 5159443 5159462 5159446 -
aaaaccatataggacaaacc

SEQ ID NO: 55911 - DNA, 20 bp, Artificial Sequence
  Synthetic oligonucleotide; CAG chr11 5159422 5159441 5159425 -
agtgctaacattatgctgaa

SEQ ID NO: 55912 - DNA, 20 bp, Artificial Sequence
  Synthetic oligonucleotide; GAG chr11 5159420 5159439 5159423 -
tgctaacattatgctgaaca

SEQ ID NO: 55913 - DNA, 20 bp, Artificial Sequence
  Synthetic oligonucleotide; AAG chr11 5159409 5159428 5159412 -
tgctgaacagagaaacattg

SEQ ID NO: 55914 - DNA, 20 bp, Artificial Sequence
  Synthetic oligonucleotide; AGG chr11 5159408 5159427 5159411 -
gctgaacagagaaacattga

SEQ ID NO: 55915 - DNA, 20 bp, Artificial Sequence
  Synthetic oligonucleotide; AAG chr11 5159395 5159414 5159398 -
acattgaaggcctttcctct

SEQ ID NO: 55916 - DNA, 20 bp, Artificial Sequence
  Synthetic oligonucleotide; AGG chr11 5159394 5159413 5159397 -
cattgaaggcctttcctcta

SEQ ID NO: 55917 - DNA, 20 bp, Artificial Sequence
  Synthetic oligonucleotide; AAG chr11 5159383 5159402 5159386 -
tttcctctaaggactgaaat

SEQ ID NO: 55918 - DNA, 20 bp, Artificial Sequence
  Synthetic oligonucleotide; AGG chr11 5159382 5159401 5159385 -
ttcctctaaggactgaaata

SEQ ID NO: 55919 - DNA, 20 bp, Artificial Sequence
  Synthetic oligonucleotide; AAG chr11 5159378 5159397 5159381 -
tctaaggactgaaataaggc

SEQ ID NO: 55920 - DNA, 20 bp, Artificial Sequence
  Synthetic oligonucleotide; TGG chr11 5159339 5159358 5159342 -
gccattatttaacataatat

SEQ ID NO: 55921 - DNA, 20 bp, Artificial Sequence
  Synthetic oligonucleotide; AAG chr11 5159336 5159355 5159339 -
attatttaacataatattgg

SEQ ID NO: 55922 - DNA, 20 bp, Artificial Sequence
  Synthetic oligonucleotide; TGG chr11 5159330 5159349 5159333 -
taacataatattggaagtct

SEQ ID NO: 55923 - DNA, 20 bp, Artificial Sequence
  Synthetic oligonucleotide; AAG chr11 5159326 5159345 5159329 -
ataatattggaagtcttgga

SEQ ID NO: 55924 - DNA, 20 bp, Artificial Sequence
  Synthetic oligonucleotide; GAG chr11 5159324 5159343 5159327 -
aatattggaagtcttggaaa

SEQ ID NO: 55925 - DNA, 20 bp, Artificial Sequence
  Synthetic oligonucleotide; CAG chr11 5159316 5159335 5159319 -
aagtcttggaaagagaaatt

SEQ ID NO: 55926 - DNA, 20 bp, Artificial Sequence
  Synthetic oligonucleotide; AGG chr11 5159315 5159334 5159318 -
agtcttggaaagagaaattc

SEQ ID NO: 55927 - DNA, 20 bp, Artificial Sequence
  Synthetic oligonucleotide; AAG chr11 5159312 5159331 5159315 -
cttggaaagagaaattcagg

SEQ ID NO: 55928 - DNA, 20 bp, Artificial Sequence
  Synthetic oligonucleotide; GAG chr11 5159310 5159329 5159313 -
tggaaagagaaattcaggaa

SEQ ID NO: 55929 - DNA, 20 bp, Artificial Sequence
  Synthetic oligonucleotide; AAG chr11 5159306 5159325 5159309 -
aagagaaattcaggaagaga

SEQ ID NO: 55930 - DNA, 20 bp, Artificial Sequence
  Synthetic oligonucleotide; AAG chr11 5159302 5159321 5159305 -
gaaattcaggaagagaaaga

SEQ ID NO: 55931 - DNA, 20 bp, Artificial Sequence
  Synthetic oligonucleotide; TGG chr11 5159288 5159307 5159291 -
gaaagaaagtgcatccaaat

SEQ ID NO: 55932 - DNA, 20 bp, Artificial Sequence
  Synthetic oligonucleotide; AAG chr11 5159284 5159303 5159287 -
gaaagtgcatccaaattgga

SEQ ID NO: 55933 - DNA, 20 bp, Artificial Sequence
  Synthetic oligonucleotide; AGG chr11 5159283 5159302 5159286 -
aaagtgcatccaaattggaa

SEQ ID NO: 55934 - DNA, 20 bp, Artificial Sequence
  Synthetic oligonucleotide; AAG chr11 5159280 5159299 5159283 -
gtgcatccaaattggaaagg

SEQ ID NO: 55935 - DNA, 20 bp, Artificial Sequence
  Synthetic oligonucleotide; AAG chr11 5159277 5159296 5159280 -
catccaaattggaaaggaag

SEQ ID NO: 55936 - DNA, 20 bp, Artificial Sequence
  Synthetic oligonucleotide; TAG chr11 5159268 5159287 5159271 -
tggaaaggaagaagttaaat

SEQ ID NO: 55937 - DNA, 20 bp, Artificial Sequence
  Synthetic oligonucleotide; TAG chr11 5159263 5159282 5159266 -
aggaagaagttaaattagcc

SEQ ID NO: 55938 - DNA, 20 bp, Artificial Sequence
  Synthetic oligonucleotide; TAG chr11 5159256 5159275 5159259 -
agttaaattagcctagtttg

SEQ ID NO: 55939 - DNA, 20 bp, Artificial Sequence
  Synthetic oligonucleotide; TAG chr11 5159235 5159254 5159238 -
agatgacatgatcttatact

SEQ ID NO: 55940 - DNA, 20 bp, Artificial Sequence
  Synthetic oligonucleotide; AAG chr11 5159178 5159197 5159181 -
acgatttaaaaaaatcaata

SEQ ID NO: 55941 - DNA, 20 bp, Artificial Sequence
  Synthetic oligonucleotide; CAG chr11 5159172 5159191 5159175 -
taaaaaaatcaataaagtta

SEQ ID NO: 55942 - DNA, 20 bp, Artificial Sequence
  Synthetic oligonucleotide; AGG chr11 5159171 5159190 5159174 -
aaaaaaatcaataaagttac

SEQ ID NO: 55943 - DNA, 20 bp, Artificial Sequence
  Synthetic oligonucleotide; CAG chr11 5159146 5159165 5159149 -
atgaaataaaaatacaaaat

SEQ ID NO: 55944 - DNA, 20 bp, Artificial Sequence
  Synthetic oligonucleotide; TAG chr11 5159143 5159162 5159146 -
aaataaaaatacaaaatcag

SEQ ID NO: 55945 - DNA, 20 bp, Artificial Sequence
  Synthetic oligonucleotide; AAG chr11 5159125 5159144 5159128 -
agtagcatttcatatataaa

SEQ ID NO: 55946 - DNA, 20 bp, Artificial Sequence
  Synthetic oligonucleotide; TAG chr11 5159078 5159097 5159081 -
taaaacaatcttatttacaa

SEQ ID NO: 55947 - DNA, 20 bp, Artificial Sequence
  Synthetic oligonucleotide; CAG chr11 5159055 5159074 5159058 -
caataaaaatataaaatacc

SEQ ID NO: 55948 - DNA, 20 bp, Artificial Sequence
  Synthetic oligonucleotide; AGG chr11 5159054 5159073 5159057 -
aataaaaatataaaataccc

SEQ ID NO: 55949 - DNA, 20 bp, Artificial Sequence
  Synthetic oligonucleotide; GAG chr11 5159052 5159071 5159055 -
taaaaatataaaatacccag

SEQ ID NO: 55950 - DNA, 20 bp, Artificial Sequence
  Synthetic oligonucleotide; AAG chr11 5159037 5159056 5159040 -
cccaggagtcaatctaaccc

SEQ ID NO: 55951 - DNA, 20 bp, Artificial Sequence
  Synthetic oligonucleotide; AAG chr11 5159034 5159053 5159037 -
aggagtcaatctaacccaag

SEQ ID NO: 55952 - DNA, 20 bp, Artificial Sequence
  Synthetic oligonucleotide; AAG chr11 5159028 5159047 5159031 -
caatctaacccaagaagtaa

SEQ ID NO: 55953 - DNA, 20 bp, Artificial Sequence
  Synthetic oligonucleotide; AAG chr11 5159017 5159036 5159020 -
aagaagtaaaagatctctat

SEQ ID NO: 55954 - DNA, 20 bp, Artificial Sequence
  Synthetic oligonucleotide; TGG chr11 5158998 5159017 5159001 -
taagaaaaattataaaactc

SEQ ID NO: 55955 - DNA, 20 bp, Artificial Sequence
  Synthetic oligonucleotide; AAG chr11 5158992 5159011 5158995 -
aaattataaaactctggtga

SEQ ID NO: 55956 - DNA, 20 bp, Artificial Sequence
  Synthetic oligonucleotide; TAG chr11 5158986 5159005 5158989 -
taaaactctggtgaaagaaa

SEQ ID NO: 55957 - DNA, 20 bp, Artificial Sequence
  Synthetic oligonucleotide; AAG chr11 5158983 5159002 5158986 -
aactctggtgaaagaaatag

SEQ ID NO: 55958 - DNA, 20 bp, Artificial Sequence
  Synthetic oligonucleotide; GAG chr11 5158981 5159000 5158984 -
ctctggtgaaagaaatagaa

SEQ ID NO: 55959 - DNA, 20 bp, Artificial Sequence
  Synthetic oligonucleotide; AGG chr11 5158980 5158999 5158983 -
tctggtgaaagaaatagaag

SEQ ID NO: 55960 - DNA, 20 bp, Artificial Sequence
  Synthetic oligonucleotide; GGG chr11 5158979 5158998 5158982 -
ctggtgaaagaaatagaaga

SEQ ID NO: 55961 - DNA, 20 bp, Artificial Sequence
  Synthetic oligonucleotide; TGG chr11 5158963 5158982 5158966 -
aagagggcacacaaataaaa

SEQ ID NO: 55962 - DNA, 20 bp, Artificial Sequence
  Synthetic oligonucleotide; TAG chr11 5158937 5158956 5158940 -
gatattccatgctcatgaac

SEQ ID NO: 55963 - DNA, 20 bp, Artificial Sequence
  Synthetic oligonucleotide; AAG chr11 5158934 5158953 5158937 -
attccatgctcatgaactag

SEQ ID NO: 55964 - DNA, 20 bp, Artificial Sequence
  Synthetic oligonucleotide; AAG chr11 5158902 5158921 5158905 -
taaaatgacaatactaccca

SEQ ID NO: 55965 - DNA, 20 bp, Artificial Sequence
  Synthetic oligonucleotide; CAG chr11 5158892 5158911 5158895 -
atactacccaaagcaatgta

SEQ ID NO: 55966 - DNA, 20 bp, Artificial Sequence
  Synthetic oligonucleotide; CAG chr11 5158886 5158905 5158889 -
cccaaagcaatgtacagatt

SEQ ID NO: 55967 - DNA, 20 bp, Artificial Sequence
  Synthetic oligonucleotide; TGG chr11 5158860 5158879 5158863 -
aatttctgtcaaaataccaa

SEQ ID NO: 55968 - DNA, 20 bp, Artificial Sequence
  Synthetic oligonucleotide; CAG chr11 5158851 5158870 5158854 -
caaaataccaatggcattca

SEQ ID NO: 55969 - DNA, 20 bp, Artificial Sequence
  Synthetic oligonucleotide; TAG chr11 5158845 5158864 5158848 -
accaatggcattcacagaaa

SEQ ID NO: 55970 - DNA, 20 bp, Artificial Sequence
  Synthetic oligonucleotide; TGG chr11 5158820 5158839 5158823 -
aaacaatcctaatatttata

SEQ ID NO: 55971 - DNA, 20 bp, Artificial Sequence
  Synthetic oligonucleotide; AAG chr11 5158809 5158828 5158812 -
atatttatatggaaccacaa

SEQ ID NO: 55972 - DNA, 20 bp, Artificial Sequence
  Synthetic oligonucleotide; TAG chr11 5158798 5158817 5158801 -
gaaccacaaaagatccccaa

SEQ ID NO: 55973 - DNA, 20 bp, Artificial Sequence
  Synthetic oligonucleotide; AAG chr11 5158792 5158811 5158795 -
caaaagatccccaatagcta

SEQ ID NO: 55974 - DNA, 20 bp, Artificial Sequence
  Synthetic oligonucleotide; GAG chr11 5158782 5158801 5158785 -
ccaatagctaaagcaatcct

SEQ ID NO: 55975 - DNA, 20 bp, Artificial Sequence
  Synthetic oligonucleotide; AAG chr11 5158775 5158794 5158778 -
ctaaagcaatcctgagcaaa

SEQ ID NO: 55976 - DNA, 20 bp, Artificial Sequence
  Synthetic oligonucleotide; AAG chr11 5158762 5158781 5158765 -
gagcaaaaagaacaaaacca

SEQ ID NO: 55977 - DNA, 20 bp, Artificial Sequence
  Synthetic oligonucleotide; AAG chr11 5158726 5158745 5158729 -
tgacttcaaaatctactaca

SEQ ID NO: 55978 - DNA, 20 bp, Artificial Sequence
  Synthetic oligonucleotide; CAG chr11 5158720 5158739 5158723 -
caaaatctactacaaagcta

SEQ ID NO: 55979 - DNA, 20 bp, Artificial Sequence
  Synthetic oligonucleotide; TAG chr11 5158717 5158736 5158720 -
aatctactacaaagctacag

SEQ ID NO: 55980 - DNA, 20 bp, Artificial Sequence
  Synthetic oligonucleotide; CAG chr11 5158709 5158728 5158712 -
acaaagctacagtagccaaa

SEQ ID NO: 55981 - DNA, 20 bp, Artificial Sequence
  Synthetic oligonucleotide; CAG chr11 5158704 5158723 5158707 -
gctacagtagccaaacagca

SEQ ID NO: 55982 - DNA, 20 bp, Artificial Sequence
  Synthetic oligonucleotide; AAG chr11 5158692 5158711 5158695 -
aaacagcacagtactgcata

SEQ ID NO: 55983 - DNA, 20 bp, Artificial Sequence
  Synthetic oligonucleotide; CAG chr11 5158688 5158707 5158691 -
agcacagtactgcataaaga

SEQ ID NO: 55984 - DNA, 20 bp, Artificial Sequence
  Synthetic oligonucleotide; CAG chr11 5158680 5158699 5158683 -
actgcataaagacagacata

SEQ ID NO: 55985 - DNA, 20 bp, Artificial Sequence
  Synthetic oligonucleotide; TGG chr11 5158672 5158691 5158675 -
aagacagacatacagcccaa

SEQ ID NO: 55986 - DNA, 20 bp, Artificial Sequence
  Synthetic oligonucleotide; CAG chr11 5158667 5158686 5158670 -
agacatacagcccaatggaa

SEQ ID NO: 55987 - DNA, 20 bp, Artificial Sequence
  Synthetic oligonucleotide; TAG chr11 5158662 5158681 5158665 -
tacagcccaatggaacagca

SEQ ID NO: 55988 - DNA, 20 bp, Artificial Sequence
  Synthetic oligonucleotide; GAG chr11 5158660 5158679 5158663 -
cagcccaatggaacagcata

SEQ ID NO: 55989 - DNA, 20 bp, Artificial Sequence
  Synthetic oligonucleotide; CAG chr11 5158653 5158672 5158656 -
atggaacagcatagagaacc

SEQ ID NO: 55990 - DNA, 20 bp, Artificial Sequence
  Synthetic oligonucleotide; CAG chr11 5158641 5158660 5158644 -
agagaacccagatgcaaatc

SEQ ID NO: 55991 - DNA, 20 bp, Artificial Sequence
  Synthetic oligonucleotide; AGG chr11 5158640 5158659 5158643 -
gagaacccagatgcaaatcc

SEQ ID NO: 55992 - DNA, 20 bp, Artificial Sequence
  Synthetic oligonucleotide; AAG chr11 5158625 5158644 5158628 -
aatccaggcacttaacaacc

SEQ ID NO: 55993 - DNA, 20 bp, Artificial Sequence
  Synthetic oligonucleotide; AAG chr11 5158610 5158629 5158613 -
caaccaagtcatctttaaca

SEQ ID NO: 55994 - DNA, 20 bp, Artificial Sequence
  Synthetic oligonucleotide; AGG chr11 5158609 5158628 5158612 -
aaccaagtcatctttaacaa

SEQ ID NO: 55995 - DNA, 20 bp, Artificial Sequence
  Synthetic oligonucleotide; AAG chr11 5158602 5158621 5158605 -
tcatctttaacaaaggcatc

SEQ ID NO: 55996 - DNA, 20 bp, Artificial Sequence
  Synthetic oligonucleotide; TAG chr11 5158589 5158608 5158592 -
aggcatcaagaacataaaaa

SEQ ID NO: 55997 - DNA, 20 bp, Artificial Sequence
  Synthetic oligonucleotide; AGG chr11 5158588 5158607 5158591 -
ggcatcaagaacataaaaat

SEQ ID NO: 55998 - DNA, 20 bp, Artificial Sequence
  Synthetic oligonucleotide; TGG chr11 5158579 5158598 5158582 -
aacataaaaataggaacaaa

SEQ ID NO: 55999 - DNA, 20 bp, Artificial Sequence
  Synthetic oligonucleotide; GGG chr11 5158578 5158597 5158581 -
acataaaaataggaacaaat

SEQ ID NO: 56000 - DNA, 20 bp, Artificial Sequence
  Synthetic oligonucleotide; CAG chr11 5158574 5158593 5158577 -
aaaaataggaacaaatgggc

SEQ ID NO: 56001 - DNA, 20 bp, Artificial Sequence
  Synthetic oligonucleotide; AGG chr11 5158573 5158592 5158576 -
aaaataggaacaaatgggcc

SEQ ID NO: 56002 - DNA, 20 bp, Artificial Sequence
  Synthetic oligonucleotide; CAG chr11 5158568 5158587 5158571 -
aggaacaaatgggccaggtg

SEQ ID NO: 56003 - DNA, 20 bp, Artificial Sequence
  Synthetic oligonucleotide; TGG chr11 5158565 5158584 5158568 -
aacaaatgggccaggtgcag

SEQ ID NO: 56004 - DNA, 20 bp, Artificial Sequence
  Synthetic oligonucleotide; CAG chr11 5158546 5158565 5158549 -
gtggctcacacctgtaatcc

SEQ ID NO: 56005 - DNA, 20 bp, Artificial Sequence
  Synthetic oligonucleotide; GAG chr11 5158535 5158554 5158538 -
ctgtaatcccagcactttgt

SEQ ID NO: 56006 - DNA, 20 bp, Artificial Sequence
  Synthetic oligonucleotide; AGG chr11 5158534 5158553 5158537 -
tgtaatcccagcactttgtg

SEQ ID NO: 56007 - DNA, 20 bp, Artificial Sequence
  Synthetic oligonucleotide; GAG chr11 5158529 5158548 5158532 -
tcccagcactttgtgaggct

SEQ ID NO: 56008 - DNA, 20 bp, Artificial Sequence
  Synthetic oligonucleotide; AGG chr11 5158528 5158547 5158531 -
cccagcactttgtgaggctg

SEQ ID NO: 56009 - DNA, 20 bp, Artificial Sequence
  Synthetic oligonucleotide; TGG chr11 5158525 5158544 5158528 -
agcactttgtgaggctgagg

SEQ ID NO: 56010 - DNA, 20 bp, Artificial Sequence
  Synthetic oligonucleotide; GGG chr11 5158524 5158543 5158527 -
gcactttgtgaggctgaggt

SEQ ID NO: 56011 - DNA, 20 bp, Artificial Sequence
  Synthetic oligonucleotide; GGG chr11 5158523 5158542 5158526 -
cactttgtgaggctgaggtg

SEQ ID NO: 56012 - DNA, 20 bp, Artificial Sequence
  Synthetic oligonucleotide; GGG chr11 5158522 5158541 5158525 -
actttgtgaggctgaggtgg

SEQ ID NO: 56013 - DNA, 20 bp, Artificial Sequence
  Synthetic oligonucleotide; GGG chr11 5158521 5158540 5158524 -
ctttgtgaggctgaggtggg

SEQ ID NO: 56014 - DNA, 20 bp, Artificial Sequence
  Synthetic oligonucleotide; GAG chr11 5158513 5158532 5158516 -
ggctgaggtggggggatcac

SEQ ID NO: 56015 - DNA, 20 bp, Artificial Sequence
  Synthetic oligonucleotide; AGG chr11 5158512 5158531 5158515 -
gctgaggtggggggatcacg

SEQ ID NO: 56016 - DNA, 20 bp, Artificial Sequence
  Synthetic oligonucleotide; CAG chr11 5158508 5158527 5158511 -
aggtggggggatcacgaggt

SEQ ID NO: 56017 - DNA, 20 bp, Artificial Sequence
  Synthetic oligonucleotide; AGG chr11 5158507 5158526 5158510 -
ggtggggggatcacgaggtc

SEQ ID NO: 56018 - DNA, 20 bp, Artificial Sequence
  Synthetic oligonucleotide; GAG chr11 5158505 5158524 5158508 -
tggggggatcacgaggtcag

SEQ ID NO: 56019 - DNA, 20 bp, Artificial Sequence
  Synthetic oligonucleotide; AAG chr11 5158499 5158518 5158502 -
gatcacgaggtcaggagttc

SEQ ID NO: 56020 - DNA, 20 bp, Artificial Sequence
  Synthetic oligonucleotide; CAG chr11 5158494 5158513 5158497 -
cgaggtcaggagttcaagac

SEQ ID NO: 56021 - DNA, 20 bp, Artificial Sequence
  Synthetic oligonucleotide; TGG chr11 5158480 5158499 5158483 -
caagaccagcctgaccaacg

SEQ ID NO: 56022 - DNA, 20 bp, Artificial Sequence
  Synthetic oligonucleotide; TAG chr11 5158445 5158464 5158448 -
tctactaaaaatacaaaaat

SEQ ID NO: 56023 - DNA, 20 bp, Artificial Sequence
  Synthetic oligonucleotide; CAG chr11 5158441 5158460 5158444 -
ctaaaaatacaaaaattagc

SEQ ID NO: 56024 - DNA, 20 bp, Artificial Sequence
  Synthetic oligonucleotide; AGG chr11 5158440 5158459 5158443 -
taaaaatacaaaaattagcc

SEQ ID NO: 56025 - DNA, 20 bp, Artificial Sequence
  Synthetic oligonucleotide; TGG chr11 5158435 5158454 5158438 -
atacaaaaattagccaggca

SEQ ID NO: 56026 - DNA, 20 bp, Artificial Sequence
  Synthetic oligonucleotide; TGG chr11 5158432 5158451 5158435 -
caaaaattagccaggcatgg

SEQ ID NO: 56027 - DNA, 20 bp, Artificial Sequence
  Synthetic oligonucleotide; GGG chr11 5158431 5158450 5158434 -
aaaaattagccaggcatggt

SEQ ID NO: 56028 - DNA, 20 bp, Artificial Sequence
  Synthetic oligonucleotide; GGG chr11 5158430 5158449 5158433 -
aaaattagccaggcatggtg

SEQ ID NO: 56029 - DNA, 20 bp, Artificial Sequence
  Synthetic oligonucleotide; CAG chr11 5158413 5158432 5158416 -
gtggggcgctcctgtaatcc

SEQ ID NO: 56030 - DNA, 20 bp, Artificial Sequence
  Synthetic oligonucleotide; CAG chr11 5158405 5158424 5158408 -
ctcctgtaatcccagatact

SEQ ID NO: 56031 - DNA, 20 bp, Artificial Sequence
  Synthetic oligonucleotide; AGG chr11 5158404 5158423 5158407 -
tcctgtaatcccagatactc

SEQ ID NO: 56032 - DNA, 20 bp, Artificial Sequence
  Synthetic oligonucleotide; GAG chr11 5158402 5158421 5158405 -
ctgtaatcccagatactcag

SEQ ID NO: 56033 - DNA, 20 bp, Artificial Sequence
  Synthetic oligonucleotide; AGG chr11 5158401 5158420 5158404 -
tgtaatcccagatactcagg

SEQ ID NO: 56034 - DNA, 20 bp, Artificial Sequence
  Synthetic oligonucleotide; GAG chr11 5158396 5158415 5158399 -
tcccagatactcaggaggct

SEQ ID NO: 56035 - DNA, 20 bp, Artificial Sequence
  Synthetic oligonucleotide; AGG chr11 5158395 5158414 5158398 -
cccagatactcaggaggctg

SEQ ID NO: 56036 - DNA, 20 bp, Artificial Sequence
  Synthetic oligonucleotide; CAG chr11 5158392 5158411 5158395 -
agatactcaggaggctgagg

SEQ ID NO: 56037 - DNA, 20 bp, Artificial Sequence
  Synthetic oligonucleotide; AGG chr11 5158391 5158410 5158394 -
gatactcaggaggctgaggc

SEQ ID NO: 56038 - DNA, 20 bp, Artificial Sequence
  Synthetic oligonucleotide; GAG chr11 5158389 5158408 5158392 -
tactcaggaggctgaggcag

SEQ ID NO: 56039 - DNA, 20 bp, Artificial Sequence
  Synthetic oligonucleotide; TGG chr11 5158373 5158392 5158376 -
gcaggagaatcgcttgaacc

SEQ ID NO: 56040 - DNA, 20 bp, Artificial Sequence
  Synthetic oligonucleotide; GGG chr11 5158372 5158391 5158375 -
caggagaatcgcttgaacct

SEQ ID NO: 56041 - DNA, 20 bp, Artificial Sequence
  Synthetic oligonucleotide; GAG chr11 5158370 5158389 5158373 -
ggagaatcgcttgaacctgg

SEQ ID NO: 56042 - DNA, 20 bp, Artificial Sequence
  Synthetic oligonucleotide; AGG chr11 5158369 5158388 5158372 -
gagaatcgcttgaacctggg

SEQ ID NO: 56043 - DNA, 20 bp, Artificial Sequence
  Synthetic oligonucleotide; CAG chr11 5158366 5158385 5158369 -
aatcgcttgaacctgggagg

SEQ ID NO: 56044 - DNA, 20 bp, Artificial Sequence
  Synthetic oligonucleotide; AAG chr11 5158363 5158382 5158366 -
cgcttgaacctgggaggcag

SEQ ID NO: 56045 - DNA, 20 bp, Artificial Sequence
  Synthetic oligonucleotide; CAG chr11 5158357 5158376 5158360 -
aacctgggaggcagaagttg

SEQ ID NO: 56046 - DNA, 20 bp, Artificial Sequence
  Synthetic oligonucleotide; AAG chr11 5158348 5158367 5158351 -
ggcagaagttgcagtgatcc

SEQ ID NO: 56047 - DNA, 20 bp, Artificial Sequence
  Synthetic oligonucleotide; CAG chr11 5158325 5158344 5158328 -
attgtgctgccactgcactc

SEQ ID NO: 56048 - DNA, 20 bp, Artificial Sequence
  Synthetic oligonucleotide; TGG chr11 5158320 5158339 5158323 -
gctgccactgcactccagcc

SEQ ID NO: 56049 - DNA, 20 bp, Artificial Sequence
  Synthetic oligonucleotide; GGG chr11 5158319 5158338 5158322 -
ctgccactgcactccagcct

SEQ ID NO: 56050 - DNA, 20 bp, Artificial Sequence
  Synthetic oligonucleotide; CAG chr11 5158313 5158332 5158316 -
ctgcactccagcctgggcaa

SEQ ID NO: 56051 - DNA, 20 bp, Artificial Sequence
  Synthetic oligonucleotide; GAG chr11 5158309 5158328 5158312 -
actccagcctgggcaacagt

SEQ ID NO: 56052 - DNA, 20 bp, Artificial Sequence
  Synthetic oligonucleotide; AAG chr11 5158280 5158299 5158283 -
tctcaaaaaaaaaaaaaaaa

SEQ ID NO: 56053 - DNA, 20 bp, Artificial Sequence
  Synthetic oligonucleotide; AGG chr11 5158279 5158298 5158282 -
ctcaaaaaaaaaaaaaaaaa

SEQ ID NO: 56054 - DNA, 20 bp, Artificial Sequence
  Synthetic oligonucleotide; CAG chr11 5158270 5158289 5158273 -
aaaaaaaaaaaaggtacaaa

SEQ ID NO: 56055 - DNA, 20 bp, Artificial Sequence
  Synthetic oligonucleotide; AAG chr11 5158260 5158279 5158263 -
aaggtacaaacagtcttttc

SEQ ID NO: 56056 - DNA, 20 bp, Artificial Sequence
  Synthetic oligonucleotide; CAG chr11 5158254 5158273 5158257 -
caaacagtcttttcaagaaa

SEQ ID NO: 56057 - DNA, 20 bp, Artificial Sequence
  Synthetic oligonucleotide; TAG chr11 5158248 5158267 5158251 -
gtcttttcaagaaacagtgc

SEQ ID NO: 56058 - DNA, 20 bp, Artificial Sequence
  Synthetic oligonucleotide; AGG chr11 5158247 5158266 5158250 -
tcttttcaagaaacagtgct

SEQ ID NO: 56059 - DNA, 20 bp, Artificial Sequence
  Synthetic oligonucleotide; TGG chr11 5158239 5158258 5158242 -
agaaacagtgctaggaaaac

SEQ ID NO: 56060 - DNA, 20 bp, Artificial Sequence
  Synthetic oligonucleotide; AAG chr11 5158222 5158241 5158225 -
aactggatatccatttgcaa

SEQ ID NO: 56061 - DNA, 20 bp, Artificial Sequence
  Synthetic oligonucleotide; GAG chr11 5158220 5158239 5158223 -
ctggatatccatttgcaaaa

SEQ ID NO: 56062 - DNA, 20 bp, Artificial Sequence
  Synthetic oligonucleotide; CGG chr11 5158211 5158230 5158214 -
catttgcaaaagagtaaaat

SEQ ID NO: 56063 - DNA, 20 bp, Artificial Sequence
  Synthetic oligonucleotide; AAG chr11 5158174 5158193 5158177 -
ctatatacaaaaatcaaatc

SEQ ID NO: 56064 - DNA, 20 bp, Artificial Sequence
  Synthetic oligonucleotide; TGG chr11 5158170 5158189 5158173 -
atacaaaaatcaaatcaaga

SEQ ID NO: 56065 - DNA, 20 bp, Artificial Sequence
  Synthetic oligonucleotide; AAG chr11 5158163 5158182 5158166 -
aatcaaatcaagatggatta

SEQ ID NO: 56066 - DNA, 20 bp, Artificial Sequence
  Synthetic oligonucleotide; TGG chr11 5158127 5158146 5158130 -
acctgaaattatgaaactac

SEQ ID NO: 56067 - DNA, 20 bp, Artificial Sequence
  Synthetic oligonucleotide; AAG chr11 5158124 5158143 5158127 -
tgaaattatgaaactactgg

SEQ ID NO: 56068 - DNA, 20 bp, Artificial Sequence
  Synthetic oligonucleotide; CAG chr11 5158117 5158136 5158120 -
atgaaactactggaagaaaa

SEQ ID NO: 56069 - DNA, 20 bp, Artificial Sequence
  Synthetic oligonucleotide; TGG chr11 5158114 5158133 5158117 -
aaactactggaagaaaacag

SEQ ID NO: 56070 - DNA, 20 bp, Artificial Sequence
  Synthetic oligonucleotide; GGG chr11 5158113 5158132 5158116 -
aactactggaagaaaacagt

SEQ ID NO: 56071 - DNA, 20 bp, Artificial Sequence
  Synthetic oligonucleotide; GGG chr11 5158112 5158131 5158115 -
actactggaagaaaacagtg

SEQ ID NO: 56072 - DNA, 20 bp, Artificial Sequence
  Synthetic oligonucleotide; CAG chr11 5158101 5158120 5158104 -
aaaacagtggggaaaccctc

SEQ ID NO: 56073 - DNA, 20 bp, Artificial Sequence
  Synthetic oligonucleotide; AGG chr11 5158100 5158119 5158103 -
aaacagtggggaaaccctcc

SEQ ID NO: 56074 - DNA, 20 bp, Artificial Sequence
  Synthetic oligonucleotide; GGG chr11 5158099 5158118 5158102 -
aacagtggggaaaccctcca

SEQ ID NO: 56075 - DNA, 20 bp, Artificial Sequence
  Synthetic oligonucleotide; TGG chr11 5158084 5158103 5158087 -
ctccagggcattcattgatt

SEQ ID NO: 56076 - DNA, 20 bp, Artificial Sequence
  Synthetic oligonucleotide; GGG chr11 5158083 5158102 5158086 -
tccagggcattcattgattt

SEQ ID NO: 56077 - DNA, 20 bp, Artificial Sequence
  Synthetic oligonucleotide; GAG chr11 5158066 5158085 5158069 -
tttgggcaaatactgtctat

SEQ ID NO: 56078 - DNA, 20 bp, Artificial Sequence
  Synthetic oligonucleotide; AAG chr11 5158056 5158075 5158059 -
tactgtctatgagacttcaa

SEQ ID NO: 56079 - DNA, 20 bp, Artificial Sequence
  Synthetic oligonucleotide; TAG chr11 5158032 5158051 5158035 -
acaaataaccaaaacaaaaa

SEQ ID NO: 56080 - DNA, 20 bp, Artificial Sequence
  Synthetic oligonucleotide; TGG chr11 5158024 5158043 5158027 -
ccaaaacaaaaatagacaat

SEQ ID NO: 56081 - DNA, 20 bp, Artificial Sequence
  Synthetic oligonucleotide; GGG chr11 5158023 5158042 5158026 -
caaaacaaaaatagacaatt

SEQ ID NO: 56082 - DNA, 20 bp, Artificial Sequence
  Synthetic oligonucleotide; AAG chr11 5158012 5158031 5158015 -
tagacaattgggattgtttg

SEQ ID NO: 56083 - DNA, 20 bp, Artificial Sequence
  Synthetic oligonucleotide; CAG chr11 5158002 5158021 5158005 -
ggattgtttgaagctctgca

SEQ ID NO: 56084 - DNA, 20 bp, Artificial Sequence
  Synthetic oligonucleotide; AAG chr11 5157997 5158016 5158000 -
gtttgaagctctgcacagca

SEQ ID NO: 56085 - DNA, 20 bp, Artificial Sequence
  Synthetic oligonucleotide; AAG chr11 5157985 5158004 5157988 -
gcacagcaaagaaaataata

SEQ ID NO: 56086 - DNA, 20 bp, Artificial Sequence
  Synthetic oligonucleotide; AAG chr11 5157980 5157999 5157983 -
gcaaagaaaataataaagtg

SEQ ID NO: 56087 - DNA, 20 bp, Artificial Sequence
  Synthetic oligonucleotide; GAG chr11 5157978 5157997 5157981 -
aaagaaaataataaagtgaa

SEQ ID NO: 56088 - DNA, 20 bp, Artificial Sequence
  Synthetic oligonucleotide; AAG chr11 5157967 5157986 5157970 -
taaagtgaagagacaaccca

SEQ ID NO: 56089 - DNA, 20 bp, Artificial Sequence
  Synthetic oligonucleotide; TGG chr11 5157962 5157981 5157965 -
tgaagagacaacccaaagaa

SEQ ID NO: 56090 - DNA, 20 bp, Artificial Sequence
  Synthetic oligonucleotide; GGG chr11 5157961 5157980 5157964 -
gaagagacaacccaaagaat

SEQ ID NO: 56091 - DNA, 20 bp, Artificial Sequence
  Synthetic oligonucleotide; GAG chr11 5157959 5157978 5157962 -
agagacaacccaaagaatgg

SEQ ID NO: 56092 - DNA, 20 bp, Artificial Sequence
  Synthetic oligonucleotide; AAG chr11 5157929 5157948 5157932 -
ttgcaaactatatattttac

SEQ ID NO: 56093 - DNA, 20 bp, Artificial Sequence
  Synthetic oligonucleotide; AGG chr11 5157928 5157947 5157931 -
tgcaaactatatattttaca

SEQ ID NO: 56094 - DNA, 20 bp, Artificial Sequence
  Synthetic oligonucleotide; CAG chr11 5157915 5157934 5157918 -
ttttacaaggaattgataac

SEQ ID NO: 56095 - DNA, 20 bp, Artificial Sequence
  Synthetic oligonucleotide; AAG chr11 5157905 5157924 5157908 -
aattgataaccagaatatgc

SEQ ID NO: 56096 - DNA, 20 bp, Artificial Sequence
  Synthetic oligonucleotide; AAG chr11 5157896 5157915 5157899 -
ccagaatatgcaagaaactc

SEQ ID NO: 56097 - DNA, 20 bp, Artificial Sequence
  Synthetic oligonucleotide; CAG chr11 5157885 5157904 5157888 -
aagaaactcaagcaactcaa

SEQ ID NO: 56098 - DNA, 20 bp, Artificial Sequence
  Synthetic oligonucleotide; TGG chr11 5157859 5157878 5157862 -
ataaataaataaataaataa

SEQ ID NO: 56099 - DNA, 20 bp, Artificial Sequence
  Synthetic oligonucleotide; AAG chr11 5157852 5157871 5157855 -
aataaataaataatggccaa

SEQ ID NO: 56100 - DNA, 20 bp, Artificial Sequence
  Synthetic oligonucleotide; TAG chr11 5157842 5157861 5157845 -
taatggccaaaagacctgaa

SEQ ID NO: 56101 - DNA, 20 bp, Artificial Sequence
  Synthetic oligonucleotide; AAG chr11 5157828 5157847 5157831 -
cctgaatagatatttctcaa

SEQ ID NO: 56102 - DNA, 20 bp, Artificial Sequence
  Synthetic oligonucleotide; AAG chr11 5157825 5157844 5157828 -
gaatagatatttctcaaaag

SEQ ID NO: 56103 - DNA, 20 bp, Artificial Sequence
  Synthetic oligonucleotide; TGG chr11 5157813 5157832 5157816 -
ctcaaaagaagccatacaaa

SEQ ID NO: 56104 - DNA, 20 bp, Artificial Sequence
  Synthetic oligonucleotide; CAG chr11 5157808 5157827 5157811 -
aagaagccatacaaatggcc

SEQ ID NO: 56105 - DNA, 20 bp, Artificial Sequence
  Synthetic oligonucleotide; GAG chr11 5157806 5157825 5157809 -
gaagccatacaaatggccca

SEQ ID NO: 56106 - DNA, 20 bp, Artificial Sequence
  Synthetic oligonucleotide; AGG chr11 5157805 5157824 5157808 -
aagccatacaaatggcccag

SEQ ID NO: 56107 - DNA, 20 bp, Artificial Sequence
  Synthetic oligonucleotide; CAG chr11 5157770 5157789 5157773 -
tgttcaatatcactaatcac

SEQ ID NO: 56108 - DNA, 20 bp, Artificial Sequence
  Synthetic oligonucleotide; TAG chr11 5157732 5157751 5157735 -
aatgtgatatcatctcacct

SEQ ID NO: 56109 - DNA, 20 bp, Artificial Sequence
  Synthetic oligonucleotide; TAG chr11 5157723 5157742 5157726 -
tcatctcaccttagttaaaa

SEQ ID NO: 56110 - DNA, 20 bp, Artificial Sequence
  Synthetic oligonucleotide; AAG chr11 5157705 5157724 5157708 -
aatagcttataacaaaacaa

SEQ ID NO: 56111 - DNA, 20 bp, Artificial Sequence
  Synthetic oligonucleotide; AGG chr11 5157704 5157723 5157707 -
atagcttataacaaaacaaa

SEQ ID NO: 56112 - DNA, 20 bp, Artificial Sequence
  Synthetic oligonucleotide; CAG chr11 5157695 5157714 5157698 -
aacaaaacaaaaggaaataa

SEQ ID NO: 56113 - DNA, 20 bp, Artificial Sequence
  Synthetic oligonucleotide; TGG chr11 5157683 5157702 5157686 -
ggaaataacagatgcttgtg

SEQ ID NO: 56114 - DNA, 20 bp, Artificial Sequence
  Synthetic oligonucleotide; TGG chr11 5157677 5157696 5157680 -
aacagatgcttgtgtggatg

SEQ ID NO: 56115 - DNA, 20 bp, Artificial Sequence
  Synthetic oligonucleotide; AAG chr11 5157671 5157690 5157674 -
tgcttgtgtggatgtggaca

SEQ ID NO: 56116 - DNA, 20 bp, Artificial Sequence
  Synthetic oligonucleotide; AGG chr11 5157670 5157689 5157673 -
gcttgtgtggatgtggacaa

SEQ ID NO: 56117 - DNA, 20 bp, Artificial Sequence
  Synthetic oligonucleotide; GGG chr11 5157669 5157688 5157672 -
cttgtgtggatgtggacaaa

SEQ ID NO: 56118 - DNA, 20 bp, Artificial Sequence
  Synthetic oligonucleotide; TGG chr11 5157649 5157668 5157652 -
gggaaaccctcttacactgt

SEQ ID NO: 56119 - DNA, 20 bp, Artificial Sequence
  Synthetic oligonucleotide; TGG chr11 5157646 5157665 5157649 -
aaaccctcttacactgttgg

SEQ ID NO: 56120 - DNA, 20 bp, Artificial Sequence
  Synthetic oligonucleotide; GGG chr11 5157645 5157664 5157648 -
aaccctcttacactgttggt

SEQ ID NO: 56121 - DNA, 20 bp, Artificial Sequence
  Synthetic oligonucleotide; GAG chr11 5157643 5157662 5157646 -
ccctcttacactgttggtgg

SEQ ID NO: 56122 - DNA, 20 bp, Artificial Sequence
  Synthetic oligonucleotide; TGG chr11 5157633 5157652 5157636 -
ctgttggtgggagtacaaat

SEQ ID NO: 56123 - DNA, 20 bp, Artificial Sequence
  Synthetic oligonucleotide; CAG chr11 5157628 5157647 5157631 -
ggtgggagtacaaattggta

SEQ ID NO: 56124 - DNA, 20 bp, Artificial Sequence
  Synthetic oligonucleotide; AAG chr11 5157617 5157636 5157620 -
aaattggtacagcaattatg

SEQ ID NO: 56125 - DNA, 20 bp, Artificial Sequence
  Synthetic oligonucleotide; AGG chr11 5157616 5157635 5157619 -
aattggtacagcaattatga

SEQ ID NO: 56126 - DNA, 20 bp, Artificial Sequence
  Synthetic oligonucleotide; CAG chr11 5157612 5157631 5157615 -
ggtacagcaattatgaagga

SEQ ID NO: 56127 - DNA, 20 bp, Artificial Sequence
  Synthetic oligonucleotide; TGG chr11 5157607 5157626 5157610 -
agcaattatgaaggacagta

SEQ ID NO: 56128 - DNA, 20 bp, Artificial Sequence
  Synthetic oligonucleotide; GAG chr11 5157605 5157624 5157608 -
caattatgaaggacagtatg

SEQ ID NO: 56129 - DNA, 20 bp, Artificial Sequence
  Synthetic oligonucleotide; AAG chr11 5157586 5157605 5157589 -
ggagatttgtcaaaaatgta

SEQ ID NO: 56130 - DNA, 20 bp, Artificial Sequence
  Synthetic oligonucleotide; TAG chr11 5157583 5157602 5157586 -
gatttgtcaaaaatgtaaag

SEQ ID NO: 56131 - DNA, 20 bp, Artificial Sequence
  Synthetic oligonucleotide; CAG chr11 5157565 5157584 5157568 -
agtagaactaccatatgatc

SEQ ID NO: 56132 - DNA, 20 bp, Artificial Sequence
  Synthetic oligonucleotide; TAG chr11 5157550 5157569 5157553 -
tgatccagcaatatcactcc

SEQ ID NO: 56133 - DNA, 20 bp, Artificial Sequence
  Synthetic oligonucleotide; AGG chr11 5157549 5157568 5157552 -
gatccagcaatatcactcct

SEQ ID NO: 56134 - DNA, 20 bp, Artificial Sequence
  Synthetic oligonucleotide; AAG chr11 5157533 5157552 5157536 -
tcctaggtatatacccttaa

SEQ ID NO: 56135 - DNA, 20 bp, Artificial Sequence
  Synthetic oligonucleotide; TAG chr11 5157523 5157542 5157526 -
atacccttaaaagaataaat

SEQ ID NO: 56136 - DNA, 20 bp, Artificial Sequence
  Synthetic oligonucleotide; AAG chr11 5157513 5157532 5157516 -
aagaataaattagtatgtcg

SEQ ID NO: 56137 - DNA, 20 bp, Artificial Sequence
  Synthetic oligonucleotide; CAG chr11 5157504 5157523 5157507 -
ttagtatgtcgaagatatat

SEQ ID NO: 56138 - DNA, 20 bp, Artificial Sequence
  Synthetic oligonucleotide; TAG chr11 5157484 5157503 5157487 -
cagtactcccatctttatta

SEQ ID NO: 56139 - DNA, 20 bp, Artificial Sequence
  Synthetic oligonucleotide; AAG chr11 5157464 5157483 5157467 -
tagcactattcacaaacgcc

SEQ ID NO: 56140 - DNA, 20 bp, Artificial Sequence
  Synthetic oligonucleotide; CAG chr11 5157433 5157452 5157436 -
tcaactgatgtattcgtcaa

SEQ ID NO: 56141 - DNA, 20 bp, Artificial Sequence
  Synthetic oligonucleotide; TGG chr11 5157425 5157444 5157428 -
tgtattcgtcaacagataaa

SEQ ID NO: 56142 - DNA, 20 bp, Artificial Sequence
  Synthetic oligonucleotide; AAG chr11 5157419 5157438 5157422 -
cgtcaacagataaatggata

SEQ ID NO: 56143 - DNA, 20 bp, Artificial Sequence
  Synthetic oligonucleotide; TGG chr11 5157378 5157397 5157381 -
acacacacacacacacacaa

SEQ ID NO: 56144 - DNA, 20 bp, Artificial Sequence
  Synthetic oligonucleotide; AAG chr11 5157355 5157374 5157358 -
aatattattcaaccataaaa

SEQ ID NO: 56145 - DNA, 20 bp, Artificial Sequence
  Synthetic oligonucleotide; CAG chr11 5157333 5157352 5157336 -
gaatgaaatattatcaatta

SEQ ID NO: 56146 - DNA, 20 bp, Artificial Sequence
  Synthetic oligonucleotide; TGG chr11 5157321 5157340 5157324 -
atcaattacagtaacataaa

SEQ ID NO: 56147 - DNA, 20 bp, Artificial Sequence
  Synthetic oligonucleotide; AAG chr11 5157312 5157331 5157315 -
agtaacataaatggtactga

SEQ ID NO: 56148 - DNA, 20 bp, Artificial Sequence
  Synthetic oligonucleotide; AAG chr11 5157299 5157318 5157302 -
gtactgaaagcaattacgtt

SEQ ID NO: 56149 - DNA, 20 bp, Artificial Sequence
  Synthetic oligonucleotide; AAG chr11 5157290 5157309 5157293 -
gcaattacgttaagtgaaat

SEQ ID NO: 56150 - DNA, 20 bp, Artificial Sequence
  Synthetic oligonucleotide; AAG chr11 5157285 5157304 5157288 -
tacgttaagtgaaataagcc

SEQ ID NO: 56151 - DNA, 20 bp, Artificial Sequence
  Synthetic oligonucleotide; CAG chr11 5157280 5157299 5157283 -
taagtgaaataagccaagca

SEQ ID NO: 56152 - DNA, 20 bp, Artificial Sequence
  Synthetic oligonucleotide; AAG chr11 5157276 5157295 5157279 -
tgaaataagccaagcacaga

SEQ ID NO: 56153 - DNA, 20 bp, Artificial Sequence
  Synthetic oligonucleotide; TGG chr11 5157247 5157266 5157250 -
atcacatgttctaactcgtg

SEQ ID NO: 56154 - DNA, 20 bp, Artificial Sequence
  Synthetic oligonucleotide; AAG chr11 5157244 5157263 5157247 -
acatgttctaactcgtgtgg

SEQ ID NO: 56155 - DNA, 20 bp, Artificial Sequence
  Synthetic oligonucleotide; TGG chr11 5157232 5157251 5157235 -
tcgtgtggaagttaaaaacg

SEQ ID NO: 56156 - DNA, 20 bp, Artificial Sequence
  Synthetic oligonucleotide; AAG chr11 5157221 5157240 5157224 -
ttaaaaacgtggatcttatg

SEQ ID NO: 56157 - DNA, 20 bp, Artificial Sequence
  Synthetic oligonucleotide; CAG chr11 5157217 5157236 5157220 -
aaacgtggatcttatgaaga

SEQ ID NO: 56158 - DNA, 20 bp, Artificial Sequence
  Synthetic oligonucleotide; GAG chr11 5157215 5157234 5157218 -
acgtggatcttatgaagaca

SEQ ID NO: 56159 - DNA, 20 bp, Artificial Sequence
  Synthetic oligonucleotide; GAG chr11 5157213 5157232 5157216 -
gtggatcttatgaagacaga

SEQ ID NO: 56160 - DNA, 20 bp, Artificial Sequence
  Synthetic oligonucleotide; TAG chr11 5157210 5157229 5157213 -
gatcttatgaagacagagag

SEQ ID NO: 56161 - DNA, 20 bp, Artificial Sequence
  Synthetic oligonucleotide; TGG chr11 5157205 5157224 5157208 -
tatgaagacagagagtagat

SEQ ID NO: 56162 - DNA, 20 bp, Artificial Sequence
  Synthetic oligonucleotide; TAG chr11 5157202 5157221 5157205 -
gaagacagagagtagattgg

SEQ ID NO: 56163 - DNA, 20 bp, Artificial Sequence
  Synthetic oligonucleotide; CGG chr11 5157195 5157214 5157198 -
gagagtagattggtagttac

SEQ ID NO: 56164 - DNA, 20 bp, Artificial Sequence
  Synthetic oligonucleotide; CGG chr11 5157192 5157211 5157195 -
agtagattggtagttaccgg

SEQ ID NO: 56165 - DNA, 20 bp, Artificial Sequence
  Synthetic oligonucleotide; CGG chr11 5157189 5157208 5157192 -
agattggtagttaccggcgg

SEQ ID NO: 56166 - DNA, 20 bp, Artificial Sequence
  Synthetic oligonucleotide; GGG chr11 5157188 5157207 5157191 -
gattggtagttaccggcggc

SEQ ID NO: 56167 - DNA, 20 bp, Artificial Sequence
  Synthetic oligonucleotide; GAG chr11 5157186 5157205 5157189 -
ttggtagttaccggcggcgg

SEQ ID NO: 56168 - DNA, 20 bp, Artificial Sequence
  Synthetic oligonucleotide; AGG chr11 5157185 5157204 5157188 -
tggtagttaccggcggcggg

SEQ ID NO: 56169 - DNA, 20 bp, Artificial Sequence
  Synthetic oligonucleotide; GGG chr11 5157184 5157203 5157187 -
ggtagttaccggcggcggga

SEQ ID NO: 56170 - DNA, 20 bp, Artificial Sequence
  Synthetic oligonucleotide; AAG chr11 5157181 5157200 5157184 -
agttaccggcggcgggaggg

SEQ ID NO: 56171 - DNA, 20 bp, Artificial Sequence
  Synthetic oligonucleotide; AAG chr11 5157177 5157196 5157180 -
accggcggcgggagggaaga

SEQ ID NO: 56172 - DNA, 20 bp, Artificial Sequence
  Synthetic oligonucleotide; AGG chr11 5157176 5157195 5157179 -
ccggcggcgggagggaagaa

SEQ ID NO: 56173 - DNA, 20 bp, Artificial Sequence
  Synthetic oligonucleotide; GAG chr11 5157170 5157189 5157173 -
gcgggagggaagaaaggaat

SEQ ID NO: 56174 - DNA, 20 bp, Artificial Sequence
  Synthetic oligonucleotide; AAG chr11 5157162 5157181 5157165 -
gaagaaaggaatgagaaatc

SEQ ID NO: 56175 - DNA, 20 bp, Artificial Sequence
  Synthetic oligonucleotide; TGG chr11 5157004 5157023 5157007 -
ctgaaccgtacactcaaaaa

SEQ ID NO: 56176 - DNA, 20 bp, Artificial Sequence
  Synthetic oligonucleotide; AAG chr11 5156999 5157018 5157002 -
ccgtacactcaaaaatggta

SEQ ID NO: 56177 - DNA, 20 bp, Artificial Sequence
  Synthetic oligonucleotide; TGG chr11 5156995 5157014 5156998 -
acactcaaaaatggtaaaga

SEQ ID NO: 56178 - DNA, 20 bp, Artificial Sequence
  Synthetic oligonucleotide; GGG chr11 5156994 5157013 5156997 -
cactcaaaaatggtaaagat

SEQ ID NO: 56179 - DNA, 20 bp, Artificial Sequence
  Synthetic oligonucleotide; TGG chr11 5156990 5157009 5156993 -
caaaaatggtaaagatgggc

SEQ ID NO: 56180 - DNA, 20 bp, Artificial Sequence
  Synthetic oligonucleotide; GGG chr11 5156989 5157008 5156992 -
aaaaatggtaaagatgggct

SEQ ID NO: 56181 - DNA, 20 bp, Artificial Sequence
  Synthetic oligonucleotide; CGG chr11 5156984 5157003 5156987 -
tggtaaagatgggctgggtg

SEQ ID NO: 56182 - DNA, 20 bp, Artificial Sequence
  Synthetic oligonucleotide; TGG chr11 5156981 5157000 5156984 -
taaagatgggctgggtgcgg

SEQ ID NO: 56183 - DNA, 20 bp, Artificial Sequence
  Synthetic oligonucleotide; CAG chr11 5156962 5156981 5156965 -
gtggccaatgcctgtaatct

SEQ ID NO: 56184 - DNA, 20 bp, Artificial Sequence
  Synthetic oligonucleotide; TGG chr11 5156954 5156973 5156957 -
tgcctgtaatctcagcactt

SEQ ID NO: 56185 - DNA, 20 bp, Artificial Sequence
  Synthetic oligonucleotide; GGG chr11 5156953 5156972 5156956 -
gcctgtaatctcagcacttt

SEQ ID NO: 56186 - DNA, 20 bp, Artificial Sequence
  Synthetic oligonucleotide; GAG chr11 5156951 5156970 5156954 -
ctgtaatctcagcactttgg

SEQ ID NO: 56187 - DNA, 20 bp, Artificial Sequence
  Synthetic oligonucleotide; AGG chr11 5156950 5156969 5156953 -
tgtaatctcagcactttggg

SEQ ID NO: 56188 - DNA, 20 bp, Artificial Sequence
  Synthetic oligonucleotide; AAG chr11 5156945 5156964 5156948 -
tctcagcactttgggaggcc

SEQ ID NO: 56189 - DNA, 20 bp, Artificial Sequence
  Synthetic oligonucleotide; AGG chr11 5156944 5156963 5156947 -
ctcagcactttgggaggcca

SEQ ID NO: 56190 - DNA, 20 bp, Artificial Sequence
  Synthetic oligonucleotide; CAG chr11 5156941 5156960 5156944 -
agcactttgggaggccaagg

SEQ ID NO: 56191 - DNA, 20 bp, Artificial Sequence
  Synthetic oligonucleotide; AGG chr11 5156940 5156959 5156943 -
gcactttgggaggccaaggc

SEQ ID NO: 56192 - DNA, 20 bp, Artificial Sequence
  Synthetic oligonucleotide; TGG chr11 5156937 5156956 5156940 -
ctttgggaggccaaggcagg

SEQ ID NO: 56193 - DNA, 20 bp, Artificial Sequence
  Synthetic oligonucleotide; GAG chr11 5156929 5156948 5156932 -
ggccaaggcaggtggatcat

SEQ ID NO: 56194 - DNA, 20 bp, Artificial Sequence
  Synthetic oligonucleotide; AGG chr11 5156928 5156947 5156931 -
gccaaggcaggtggatcatg

SEQ ID NO: 56195 - DNA, 20 bp, Artificial Sequence
  Synthetic oligonucleotide; CAG chr11 5156924 5156943 5156927 -
aggcaggtggatcatgaggt

SEQ ID NO: 56196 - DNA, 20 bp, Artificial Sequence
  Synthetic oligonucleotide; AGG chr11 5156923 5156942 5156926 -
ggcaggtggatcatgaggtc

SEQ ID NO: 56197 - DNA, 20 bp, Artificial Sequence
  Synthetic oligonucleotide; GAG chr11 5156921 5156940 5156924 -
caggtggatcatgaggtcag

SEQ ID NO: 56198 - DNA, 20 bp, Artificial Sequence
  Synthetic oligonucleotide; AAG chr11 5156915 5156934 5156918 -
gatcatgaggtcaggagtcc

SEQ ID NO: 56199 - DNA, 20 bp, Artificial Sequence
  Synthetic oligonucleotide; CAG chr11 5156910 5156929 5156913 -
tgaggtcaggagtccaagac

SEQ ID NO: 56200 - DNA, 20 bp, Artificial Sequence
  Synthetic oligonucleotide; TGG chr11 5156896 5156915 5156899 -
caagaccagcctgaccaaca

SEQ ID NO: 56201 - DNA, 20 bp, Artificial Sequence
  Synthetic oligonucleotide; TAG chr11 5156860 5156879 5156863 -
ctactaaaaatacaaaaaat

SEQ ID NO: 56202 - DNA, 20 bp, Artificial Sequence
  Synthetic oligonucleotide; CAG chr11 5156856 5156875 5156859 -
taaaaatacaaaaaattagc

SEQ ID NO: 56203 - DNA, 20 bp, Artificial Sequence
  Synthetic oligonucleotide; AGG chr11 5156855 5156874 5156858 -
aaaaatacaaaaaattagcc

SEQ ID NO: 56204 - DNA, 20 bp, Artificial Sequence
  Synthetic oligonucleotide; TGG chr11 5156850 5156869 5156853 -
tacaaaaaattagccaggcg

SEQ ID NO: 56205 - DNA, 20 bp, Artificial Sequence
  Synthetic oligonucleotide; TGG chr11 5156847 5156866 5156850 -
aaaaaattagccaggcgtgg

SEQ ID NO: 56206 - DNA, 20 bp, Artificial Sequence
  Synthetic oligonucleotide; CAG chr11 5156844 5156863 5156847 -
aaattagccaggcgtggtgg

SEQ ID NO: 56207 - DNA, 20 bp, Artificial Sequence
  Synthetic oligonucleotide; AGG chr11 5156843 5156862 5156846 -
aattagccaggcgtggtggc

SEQ ID NO: 56208 - DNA, 20 bp, Artificial Sequence
  Synthetic oligonucleotide; TGG chr11 5156820 5156839 5156823 -
cgcctgtaatcccacctact

SEQ ID NO: 56209 - DNA, 20 bp, Artificial Sequence
  Synthetic oligonucleotide; GGG chr11 5156819 5156838 5156822 -
gcctgtaatcccacctactt

SEQ ID NO: 56210 - DNA, 20 bp, Artificial Sequence
  Synthetic oligonucleotide; GAG chr11 5156817 5156836 5156820 -
ctgtaatcccacctacttgg

SEQ ID NO: 56211 - DNA, 20 bp, Artificial Sequence
  Synthetic oligonucleotide; AGG chr11 5156816 5156835 5156819 -
tgtaatcccacctacttggg

SEQ ID NO: 56212 - DNA, 20 bp, Artificial Sequence
  Synthetic oligonucleotide; TGG chr11 5156811 5156830 5156814 -
tcccacctacttgggaggct

SEQ ID NO: 56213 - DNA, 20 bp, Artificial Sequence
  Synthetic oligonucleotide; GGG chr11 5156810 5156829 5156813 -
cccacctacttgggaggctt

SEQ ID NO: 56214 - DNA, 20 bp, Artificial Sequence
  Synthetic oligonucleotide; CAG chr11 5156807 5156826 5156810 -
acctacttgggaggcttggg

SEQ ID NO: 56215 - DNA, 20 bp, Artificial Sequence
  Synthetic oligonucleotide; AGG chr11 5156806 5156825 5156809 -
cctacttgggaggcttgggc

SEQ ID NO: 56216 - DNA, 20 bp, Artificial Sequence
  Synthetic oligonucleotide; GAG chr11 5156804 5156823 5156807 -
tacttgggaggcttgggcag

SEQ ID NO: 56217 - DNA, 20 bp, Artificial Sequence
  Synthetic oligonucleotide; TGG chr11 5156788 5156807 5156791 -
gcaggagaatcgcttgaacc

SEQ ID NO: 56218 - DNA, 20 bp, Artificial Sequence
  Synthetic oligonucleotide; TGG chr11 5156785 5156804 5156788 -
ggagaatcgcttgaacctgg

SEQ ID NO: 56219 - DNA, 20 bp, Artificial Sequence
  Synthetic oligonucleotide; GGG chr11 5156784 5156803 5156787 -
gagaatcgcttgaacctggt

SEQ ID NO: 56220 - DNA, 20 bp, Artificial Sequence
  Synthetic oligonucleotide; GGG chr11 5156783 5156802 5156786 -
agaatcgcttgaacctggtg

SEQ ID NO: 56221 - DNA, 20 bp, Artificial Sequence
  Synthetic oligonucleotide; GGG chr11 5156782 5156801 5156785 -
gaatcgcttgaacctggtgg

SEQ ID NO: 56222 - DNA, 20 bp, Artificial Sequence
  Synthetic oligonucleotide; CGG chr11 5156779 5156798 5156782 -
tcgcttgaacctggtggggg

SEQ ID NO: 56223 - DNA, 20 bp, Artificial Sequence
  Synthetic oligonucleotide; GAG chr11 5156777 5156796 5156780 -
gcttgaacctggtgggggcg

SEQ ID NO: 56224 - DNA, 20 bp, Artificial Sequence
  Synthetic oligonucleotide; AGG chr11 5156776 5156795 5156779 -
cttgaacctggtgggggcgg

SEQ ID NO: 56225 - DNA, 20 bp, Artificial Sequence
  Synthetic oligonucleotide; CAG chr11 5156770 5156789 5156773 -
cctggtgggggcggaggttg

SEQ ID NO: 56226 - DNA, 20 bp, Artificial Sequence
  Synthetic oligonucleotide; GAG chr11 5156766 5156785 5156769 -
gtgggggcggaggttgcagt

SEQ ID NO: 56227 - DNA, 20 bp, Artificial Sequence
  Synthetic oligonucleotide; AAG chr11 5156761 5156780 5156764 -
ggcggaggttgcagtgagcc

SEQ ID NO: 56228 - DNA, 20 bp, Artificial Sequence
  Synthetic oligonucleotide; CAG chr11 5156741 5156760 5156744 -
aagatcctaccactgcactc

SEQ ID NO: 56229 - DNA, 20 bp, Artificial Sequence
  Synthetic oligonucleotide; TGG chr11 5156736 5156755 5156739 -
cctaccactgcactccagcc

SEQ ID NO: 56230 - DNA, 20 bp, Artificial Sequence
  Synthetic oligonucleotide; CGG chr11 5156729 5156748 5156732 -
ctgcactccagcctggatga

SEQ ID NO: 56231 - DNA, 20 bp, Artificial Sequence
  Synthetic oligonucleotide; GAG chr11 5156727 5156746 5156730 -
gcactccagcctggatgacg

SEQ ID NO: 56232 - DNA, 20 bp, Artificial Sequence
  Synthetic oligonucleotide; GAG chr11 5156723 5156742 5156726 -
tccagcctggatgacggagc

SEQ ID NO: 56233 - DNA, 20 bp, Artificial Sequence
  Synthetic oligonucleotide; AAG chr11 5156710 5156729 5156713 -
acggagcgagactccgtctc

SEQ ID NO: 56234 - DNA, 20 bp, Artificial Sequence
  Synthetic oligonucleotide; AGG chr11 5156709 5156728 5156712 -
cggagcgagactccgtctca

SEQ ID NO: 56235 - DNA, 20 bp, Artificial Sequence
  Synthetic oligonucleotide; AAG chr11 5156697 5156716 5156700 -
ccgtctcaaggaaaaaaaaa

SEQ ID NO: 56236 - DNA, 20 bp, Artificial Sequence
  Synthetic oligonucleotide; AAG chr11 5156692 5156711 5156695 -
tcaaggaaaaaaaaaaagta

SEQ ID NO: 56237 - DNA, 20 bp, Artificial Sequence
  Synthetic oligonucleotide; CGG chr11 5156688 5156707 5156691 -
ggaaaaaaaaaaagtaaaga

SEQ ID NO: 56238 - DNA, 20 bp, Artificial Sequence
  Synthetic oligonucleotide; CAG chr11 5156634 5156653 5156637 -
aaataaatttaaaaaatatt

SEQ ID NO: 56239 - DNA, 20 bp, Artificial Sequence
  Synthetic oligonucleotide; TAG chr11 5156631 5156650 5156634 -
taaatttaaaaaatattcag

SEQ ID NO: 56240 - DNA, 20 bp, Artificial Sequence
  Synthetic oligonucleotide; AGG chr11 5156630 5156649 5156633 -
aaatttaaaaaatattcagt

SEQ ID NO: 56241 - DNA, 20 bp, Artificial Sequence
  Synthetic oligonucleotide; CGG chr11 5156626 5156645 5156629 -
ttaaaaaatattcagtaggc

SEQ ID NO: 56242 - DNA, 20 bp, Artificial Sequence
  Synthetic oligonucleotide; GGG chr11 5156625 5156644 5156628 -
taaaaaatattcagtaggcc

SEQ ID NO: 56243 - DNA, 20 bp, Artificial Sequence
  Synthetic oligonucleotide; CAG chr11 5156620 5156639 5156623 -
aatattcagtaggccgggtg

SEQ ID NO: 56244 - DNA, 20 bp, Artificial Sequence
  Synthetic oligonucleotide; TGG chr11 5156617 5156636 5156620 -
attcagtaggccgggtgcag

SEQ ID NO: 56245 - DNA, 20 bp, Artificial Sequence
  Synthetic oligonucleotide; CAG chr11 5156598 5156617 5156601 -
gtggctcacgcctgtgatcc

SEQ ID NO: 56246 - DNA, 20 bp, Artificial Sequence
  Synthetic oligonucleotide; TGG chr11 5156590 5156609 5156593 -
cgcctgtgatcccagcactt

SEQ ID NO: 56247 - DNA, 20 bp, Artificial Sequence
  Synthetic oligonucleotide; GGG chr11 5156589 5156608 5156592 -
gcctgtgatcccagcacttt

SEQ ID NO: 56248 - DNA, 20 bp, Artificial Sequence
  Synthetic oligonucleotide; GAG chr11 5156587 5156606 5156590 -
ctgtgatcccagcactttgg

SEQ ID NO: 56249 - DNA, 20 bp, Artificial Sequence
  Synthetic oligonucleotide; AGG chr11 5156586 5156605 5156589 -
tgtgatcccagcactttggg

SEQ ID NO: 56250 - DNA, 20 bp, Artificial Sequence
  Synthetic oligonucleotide; CGG chr11 5156583 5156602 5156586 -
gatcccagcactttgggagg

SEQ ID NO: 56251 - DNA, 20 bp, Artificial Sequence
  Synthetic oligonucleotide; GAG chr11 5156581 5156600 5156584 -
tcccagcactttgggaggcg

SEQ ID NO: 56252 - DNA, 20 bp, Artificial Sequence
  Synthetic oligonucleotide; AGG chr11 5156580 5156599 5156583 -
cccagcactttgggaggcgg

SEQ ID NO: 56253 - DNA, 20 bp, Artificial Sequence
  Synthetic oligonucleotide; CGG chr11 5156577 5156596 5156580 -
agcactttgggaggcggagg

SEQ ID NO: 56254 - DNA, 20 bp, Artificial Sequence
  Synthetic oligonucleotide; GGG chr11 5156576 5156595 5156579 -
gcactttgggaggcggaggc

SEQ ID NO: 56255 - DNA, 20 bp, Artificial Sequence
  Synthetic oligonucleotide; TGG chr11 5156573 5156592 5156576 -
ctttgggaggcggaggcggg

SEQ ID NO: 56256 - DNA, 20 bp, Artificial Sequence
  Synthetic oligonucleotide; GAG chr11 5156565 5156584 5156568 -
ggcggaggcgggtggatcac

SEQ ID NO: 56257 - DNA, 20 bp, Artificial Sequence
  Synthetic oligonucleotide; AGG chr11 5156564 5156583 5156567 -
gcggaggcgggtggatcacg

SEQ ID NO: 56258 - DNA, 20 bp, Artificial Sequence
  Synthetic oligonucleotide; GAG chr11 5156557 5156576 5156560 -
cgggtggatcacgaggtcgc

SEQ ID NO: 56259 - DNA, 20 bp, Artificial Sequence
  Synthetic oligonucleotide; GAG chr11 5156551 5156570 5156554 -
gatcacgaggtcgcgagatc

SEQ ID NO: 56260 - DNA, 20 bp, Artificial Sequence
  Synthetic oligonucleotide; TGG chr11 5156541 5156560 5156544 -
tcgcgagatcgagaccatcc

SEQ ID NO: 56261 - DNA, 20 bp, Artificial Sequence
  Synthetic oligonucleotide; CAG chr11 5156532 5156551 5156535 -
cgagaccatcctggctaaca

SEQ ID NO: 56262 - DNA, 20 bp, Artificial Sequence
  Synthetic oligonucleotide; TAG chr11 5156494 5156513 5156497 -
actaaaaaaatacaaaaaat

SEQ ID NO: 56263 - DNA, 20 bp, Artificial Sequence
  Synthetic oligonucleotide; CGG chr11 5156490 5156509 5156493 -
aaaaaatacaaaaaattagc

SEQ ID NO: 56264 - DNA, 20 bp, Artificial Sequence
  Synthetic oligonucleotide; GGG chr11 5156489 5156508 5156492 -
aaaaatacaaaaaattagcc

SEQ ID NO: 56265 - DNA, 20 bp, Artificial Sequence
  Synthetic oligonucleotide; TGG chr11 5156484 5156503 5156487 -
tacaaaaaattagccgggct

SEQ ID NO: 56266 - DNA, 20 bp, Artificial Sequence
  Synthetic oligonucleotide; TGG chr11 5156481 5156500 5156484 -
aaaaaattagccgggcttgg

SEQ ID NO: 56267 - DNA, 20 bp, Artificial Sequence
  Synthetic oligonucleotide; CGG chr11 5156478 5156497 5156481 -
aaattagccgggcttggtgg

SEQ ID NO: 56268 - DNA, 20 bp, Artificial Sequence
  Synthetic oligonucleotide; GGG chr11 5156477 5156496 5156480 -
aattagccgggcttggtggc

SEQ ID NO: 56269 - DNA, 20 bp, Artificial Sequence
  Synthetic oligonucleotide; TAG chr11 5156468 5156487 5156471 -
ggcttggtggcgggtgcctg

SEQ ID NO: 56270 - DNA, 20 bp, Artificial Sequence
  Synthetic oligonucleotide; CAG chr11 5156462 5156481 5156465 -
gtggcgggtgcctgtagtcc

SEQ ID NO: 56271 - DNA, 20 bp, Artificial Sequence
  Synthetic oligonucleotide; TGG chr11 5156453 5156472 5156456 -
gcctgtagtcccagctacta

SEQ ID NO: 56272 - DNA, 20 bp, Artificial Sequence
  Synthetic oligonucleotide; GAG chr11 5156451 5156470 5156454 -
ctgtagtcccagctactatg

SEQ ID NO: 56273 - DNA, 20 bp, Artificial Sequence
  Synthetic oligonucleotide; AGG chr11 5156450 5156469 5156453 -
tgtagtcccagctactatgg

SEQ ID NO: 56274 - DNA, 20 bp, Artificial Sequence
  Synthetic oligonucleotide; GAG chr11 5156445 5156464 5156448 -
tcccagctactatggaggct

SEQ ID NO: 56275 - DNA, 20 bp, Artificial Sequence
  Synthetic oligonucleotide; AGG chr11 5156444 5156463 5156447 -
cccagctactatggaggctg

SEQ ID NO: 56276 - DNA, 20 bp, Artificial Sequence
  Synthetic oligonucleotide; CGG chr11 5156441 5156460 5156444 -
agctactatggaggctgagg

SEQ ID NO: 56277 - DNA, 20 bp, Artificial Sequence
  Synthetic oligonucleotide; GGG chr11 5156440 5156459 5156443 -
gctactatggaggctgaggc

SEQ ID NO: 56278 - DNA, 20 bp, Artificial Sequence
  Synthetic oligonucleotide; GAG chr11 5156438 5156457 5156441 -
tactatggaggctgaggcgg

SEQ ID NO: 56279 - DNA, 20 bp, Artificial Sequence
  Synthetic oligonucleotide; TGG chr11 5156433 5156452 5156436 -
tggaggctgaggcgggagaa

SEQ ID NO: 56280 - DNA, 20 bp, Artificial Sequence
  Synthetic oligonucleotide; CGG chr11 5156422 5156441 5156425 -
gcgggagaatggcgtgaacg

SEQ ID NO: 56281 - DNA, 20 bp, Artificial Sequence
  Synthetic oligonucleotide; GGG chr11 5156421 5156440 5156424 -
cgggagaatggcgtgaacgc

SEQ ID NO: 56282 - DNA, 20 bp, Artificial Sequence
  Synthetic oligonucleotide; GGG chr11 5156420 5156439 5156423 -
gggagaatggcgtgaacgcg

SEQ ID NO: 56283 - DNA, 20 bp, Artificial Sequence
  Synthetic oligonucleotide; GGG chr11 5156419 5156438 5156422 -
ggagaatggcgtgaacgcgg

SEQ ID NO: 56284 - DNA, 20 bp, Artificial Sequence
  Synthetic oligonucleotide; GGG chr11 5156418 5156437 5156421 -
gagaatggcgtgaacgcggg

SEQ ID NO: 56285 - DNA, 20 bp, Artificial Sequence
  Synthetic oligonucleotide; CGG chr11 5156415 5156434 5156418 -
aatggcgtgaacgcgggggg

SEQ ID NO: 56286 - DNA, 20 bp, Artificial Sequence
  Synthetic oligonucleotide; GAG chr11 5156413 5156432 5156416 -
tggcgtgaacgcggggggcg

SEQ ID NO: 56287 - DNA, 20 bp, Artificial Sequence
  Synthetic oligonucleotide; CAG chr11 5156406 5156425 5156409 -
aacgcggggggcggagcttg

SEQ ID NO: 56288 - DNA, 20 bp, Artificial Sequence
  Synthetic oligonucleotide; GAG chr11 5156402 5156421 5156405 -
cggggggcggagcttgcagt

SEQ ID NO: 56289 - DNA, 20 bp, Artificial Sequence
  Synthetic oligonucleotide; CAG chr11 5156399 5156418 5156402 -
ggggcggagcttgcagtgag

SEQ ID NO: 56290 - DNA, 20 bp, Artificial Sequence
  Synthetic oligonucleotide; GAG chr11 5156397 5156416 5156400 -
ggcggagcttgcagtgagca

SEQ ID NO: 56291 - DNA, 20 bp, Artificial Sequence
  Synthetic oligonucleotide; CAG chr11 5156392 5156411 5156395 -
agcttgcagtgagcagagat

SEQ ID NO: 56292 - DNA, 20 bp, Artificial Sequence
  Synthetic oligonucleotide; AGG chr11 5156391 5156410 5156394 -
gcttgcagtgagcagagatc

SEQ ID NO: 56293 - DNA, 20 bp, Artificial Sequence
  Synthetic oligonucleotide; GGG chr11 5156390 5156409 5156393 -
cttgcagtgagcagagatca

SEQ ID NO: 56294 - DNA, 20 bp, Artificial Sequence
  Synthetic oligonucleotide; GGG chr11 5156389 5156408 5156392 -
ttgcagtgagcagagatcag

SEQ ID NO: 56295 - DNA, 20 bp, Artificial Sequence
  Synthetic oligonucleotide; CAG chr11 5156375 5156394 5156378 -
gatcaggggccactgcactc

SEQ ID NO: 56296 - DNA, 20 bp, Artificial Sequence
  Synthetic oligonucleotide; TGG chr11 5156370 5156389 5156373 -
ggggccactgcactccagcc

SEQ ID NO: 56297 - DNA, 20 bp, Artificial Sequence
  Synthetic oligonucleotide; GGG chr11 5156369 5156388 5156372 -
gggccactgcactccagcct

SEQ ID NO: 56298 - DNA, 20 bp, Artificial Sequence
  Synthetic oligonucleotide; CAG chr11 5156363 5156382 5156366 -
ctgcactccagcctgggcga

SEQ ID NO: 56299 - DNA, 20 bp, Artificial Sequence
  Synthetic oligonucleotide; GAG chr11 5156361 5156380 5156364 -
gcactccagcctgggcgaca

SEQ ID NO: 56300 - DNA, 20 bp, Artificial Sequence
  Synthetic oligonucleotide; GAG chr11 5156359 5156378 5156362 -
actccagcctgggcgacaga

SEQ ID NO: 56301 - DNA, 20 bp, Artificial Sequence
  Synthetic oligonucleotide; GAG chr11 5156357 5156376 5156360 -
tccagcctgggcgacagaga

SEQ ID NO: 56302 - DNA, 20 bp, Artificial Sequence
  Synthetic oligonucleotide; AAG chr11 5156338 5156357 5156341 -
agagactctgtctcaaaaaa

SEQ ID NO: 56303 - DNA, 20 bp, Artificial Sequence
  Synthetic oligonucleotide; TAG chr11 5156323 5156342 5156326 -
aaaaaaagaaaaaaaaaatt

SEQ ID NO: 56304 - DNA, 20 bp, Artificial Sequence
  Synthetic oligonucleotide; TAG chr11 5156320 5156339 5156323 -
aaaagaaaaaaaaaatttag

SEQ ID NO: 56305 - DNA, 20 bp, Artificial Sequence
  Synthetic oligonucleotide; TAG chr11 5156315 5156334 5156318 -
aaaaaaaaaatttagtagac

SEQ ID NO: 56306 - DNA, 20 bp, Artificial Sequence
  Synthetic oligonucleotide; CAG chr11 5156301 5156320 5156304 -
gtagactagctaaaaaaatc

SEQ ID NO: 56307 - DNA, 20 bp, Artificial Sequence
  Synthetic oligonucleotide; GAG chr11 5156299 5156318 5156302 -
agactagctaaaaaaatcca

SEQ ID NO: 56308 - DNA, 20 bp, Artificial Sequence
  Synthetic oligonucleotide; TAG chr11 5156295 5156314 5156298 -
tagctaaaaaaatccagaga

SEQ ID NO: 56309 - DNA, 20 bp, Artificial Sequence
  Synthetic oligonucleotide; AAG chr11 5156274 5156293 5156277 -
agttattgatgcatatgtaa

SEQ ID NO: 56310 - DNA, 20 bp, Artificial Sequence
  Synthetic oligonucleotide; AAG chr11 5156256 5156275 5156259 -
aaaagtcttccaatatttac

SEQ ID NO: 56311 - DNA, 20 bp, Artificial Sequence
  Synthetic oligonucleotide; AAG chr11 5156225 5156244 5156228 -
aaaaaaaataaccttgaatt

SEQ ID NO: 56312 - DNA, 20 bp, Artificial Sequence
  Synthetic oligonucleotide; TAG chr11 5156220 5156239 5156223 -
aaataaccttgaattaagtg

SEQ ID NO: 56313 - DNA, 20 bp, Artificial Sequence
  Synthetic oligonucleotide; AAG chr11 5156197 5156216 5156200 -
aactcattgacaatgtttca

SEQ ID NO: 56314 - DNA, 20 bp, Artificial Sequence
  Synthetic oligonucleotide; AGG chr11 5156196 5156215 5156199 -
actcattgacaatgtttcaa

SEQ ID NO: 56315 - DNA, 20 bp, Artificial Sequence
  Synthetic oligonucleotide; GAG chr11 5156189 5156208 5156192 -
gacaatgtttcaaaggatgt

SEQ ID NO: 56316 - DNA, 20 bp, Artificial Sequence
  Synthetic oligonucleotide; AGG chr11 5156188 5156207 5156191 -
acaatgtttcaaaggatgtg

SEQ ID NO: 56317 - DNA, 20 bp, Artificial Sequence
  Synthetic oligonucleotide; GGG chr11 5156187 5156206 5156190 -
caatgtttcaaaggatgtga

SEQ ID NO: 56318 - DNA, 20 bp, Artificial Sequence
  Synthetic oligonucleotide; TGG chr11 5156171 5156190 5156174 -
gtgagggataaactaaaatt

SEQ ID NO: 56319 - DNA, 20 bp, Artificial Sequence
  Synthetic oligonucleotide; GGG chr11 5156170 5156189 5156173 -
tgagggataaactaaaattt

SEQ ID NO: 56320 - DNA, 20 bp, Artificial Sequence
  Synthetic oligonucleotide; CAG chr11 5156167 5156186 5156170 -
gggataaactaaaatttggg

SEQ ID NO: 56321 - DNA, 20 bp, Artificial Sequence
  Synthetic oligonucleotide; TGG chr11 5156143 5156162 5156146 -
acatgctgttcctgtgtact

SEQ ID NO: 56322 - DNA, 20 bp, Artificial Sequence
  Synthetic oligonucleotide; CAG chr11 5156138 5156157 5156141 -
ctgttcctgtgtacttggaa

SEQ ID NO: 56323 - DNA, 20 bp, Artificial Sequence
  Synthetic oligonucleotide; GAG chr11 5156136 5156155 5156139 -
gttcctgtgtacttggaaca

SEQ ID NO: 56324 - DNA, 20 bp, Artificial Sequence
  Synthetic oligonucleotide; AGG chr11 5156135 5156154 5156138 -
ttcctgtgtacttggaacag

SEQ ID NO: 56325 - DNA, 20 bp, Artificial Sequence
  Synthetic oligonucleotide; GGG chr11 5156134 5156153 5156137 -
tcctgtgtacttggaacaga

SEQ ID NO: 56326 - DNA, 20 bp, Artificial Sequence
  Synthetic oligonucleotide; GAG chr11 5156132 5156151 5156135 -
ctgtgtacttggaacagagg

SEQ ID NO: 56327 - DNA, 20 bp, Artificial Sequence
  Synthetic oligonucleotide; TGG chr11 5156123 5156142 5156126 -
tggaacagagggagaaaatc

SEQ ID NO: 56328 - DNA, 20 bp, Artificial Sequence
  Synthetic oligonucleotide; GGG chr11 5156122 5156141 5156125 -
ggaacagagggagaaaatct

SEQ ID NO: 56329 - DNA, 20 bp, Artificial Sequence
  Synthetic oligonucleotide; TGG chr11 5156118 5156137 5156121 -
cagagggagaaaatctgggc

SEQ ID NO: 56330 - DNA, 20 bp, Artificial Sequence
  Synthetic oligonucleotide; TAG chr11 5156104 5156123 5156107 -
ctgggctggaaatattgtta

SEQ ID NO: 56331 - DNA, 20 bp, Artificial Sequence
  Synthetic oligonucleotide; AGG chr11 5156103 5156122 5156106 -
tgggctggaaatattgttat

SEQ ID NO: 56332 - DNA, 20 bp, Artificial Sequence
  Synthetic oligonucleotide; GAG chr11 5156101 5156120 5156104 -
ggctggaaatattgttatag

SEQ ID NO: 56333 - DNA, 20 bp, Artificial Sequence
  Synthetic oligonucleotide; TAG chr11 5156097 5156116 5156100 -
ggaaatattgttataggagt

SEQ ID NO: 56334 - DNA, 20 bp, Artificial Sequence
  Synthetic oligonucleotide; AAG chr11 5156088 5156107 5156091 -
gttataggagttagcacatg

SEQ ID NO: 56335 - DNA, 20 bp, Artificial Sequence
  Synthetic oligonucleotide; AGG chr11 5156087 5156106 5156090 -
ttataggagttagcacatga

SEQ ID NO: 56336 - DNA, 20 bp, Artificial Sequence
  Synthetic oligonucleotide; TGG chr11 5156068 5156087 5156071 -
aaggtgacaactaaattatt

SEQ ID NO: 56337 - DNA, 20 bp, Artificial Sequence
  Synthetic oligonucleotide; GAG chr11 5156066 5156085 5156069 -
ggtgacaactaaattatttg

SEQ ID NO: 56338 - DNA, 20 bp, Artificial Sequence
  Synthetic oligonucleotide; TAG chr11 5156063 5156082 5156066 -
gacaactaaattatttggag

SEQ ID NO: 56339 - DNA, 20 bp, Artificial Sequence
  Synthetic oligonucleotide; TGG chr11 5156059 5156078 5156062 -
actaaattatttggagtaga

SEQ ID NO: 56340 - DNA, 20 bp, Artificial Sequence
  Synthetic oligonucleotide; GAG chr11 5156057 5156076 5156060 -
taaattatttggagtagatg

SEQ ID NO: 56341 - DNA, 20 bp, Artificial Sequence
  Synthetic oligonucleotide; CAG chr11 5156050 5156069 5156053 -
tttggagtagatggagtcac

SEQ ID NO: 56342 - DNA, 20 bp, Artificial Sequence
  Synthetic oligonucleotide; TAG chr11 5156037 5156056 5156040 -
gagtcaccagcacatgtgaa

SEQ ID NO: 56343 - DNA, 20 bp, Artificial Sequence
  Synthetic oligonucleotide; TAG chr11 5156031 5156050 5156034 -
ccagcacatgtgaatagttt

SEQ ID NO: 56344 - DNA, 20 bp, Artificial Sequence
  Synthetic oligonucleotide; AAG chr11 5156015 5156034 5156018 -
gttttagaatgaaatgaccc

SEQ ID NO: 56345 - DNA, 20 bp, Artificial Sequence
  Synthetic oligonucleotide; TAG chr11 5156011 5156030 5156014 -
tagaatgaaatgacccaaga

SEQ ID NO: 56346 - DNA, 20 bp, Artificial Sequence
  Synthetic oligonucleotide; TGG chr11 5156003 5156022 5156006 -
aatgacccaagatagaactt

SEQ ID NO: 56347 - DNA, 20 bp, Artificial Sequence
  Synthetic oligonucleotide; GAG chr11 5156001 5156020 5156004 -
tgacccaagatagaactttg

SEQ ID NO: 56348 - DNA, 20 bp, Artificial Sequence
  Synthetic oligonucleotide; GAG chr11 5155999 5156018 5156002 -
acccaagatagaactttgga

SEQ ID NO: 56349 - DNA, 20 bp, Artificial Sequence
  Synthetic oligonucleotide; CAG chr11 5155976 5155995 5155979 -
cccccaaatttaaataaaat

SEQ ID NO: 56350 - DNA, 20 bp, Artificial Sequence
  Synthetic oligonucleotide; AAG chr11 5155970 5155989 5155973 -
aatttaaataaaatcagtat

SEQ ID NO: 56351 - DNA, 20 bp, Artificial Sequence
  Synthetic oligonucleotide; GAG chr11 5155968 5155987 5155971 -
tttaaataaaatcagtataa

SEQ ID NO: 56352 - DNA, 20 bp, Artificial Sequence
  Synthetic oligonucleotide; AAG chr11 5155965 5155984 5155968 -
aaataaaatcagtataagag

SEQ ID NO: 56353 - DNA, 20 bp, Artificial Sequence
  Synthetic oligonucleotide; GAG chr11 5155963 5155982 5155966 -
ataaaatcagtataagagaa

SEQ ID NO: 56354 - DNA, 20 bp, Artificial Sequence
  Synthetic oligonucleotide; AGG chr11 5155962 5155981 5155965 -
taaaatcagtataagagaag

SEQ ID NO: 56355 - DNA, 20 bp, Artificial Sequence
  Synthetic oligonucleotide; AAG chr11 5155959 5155978 5155962 -
aatcagtataagagaagagg

SEQ ID NO: 56356 - DNA, 20 bp, Artificial Sequence
  Synthetic oligonucleotide; TGG chr11 5155948 5155967 5155951 -
gagaagaggaagaaaccaaa

SEQ ID NO: 56357 - DNA, 20 bp, Artificial Sequence
  Synthetic oligonucleotide; TAG chr11 5155940 5155959 5155943 -
gaagaaaccaaatggtatac

SEQ ID NO: 56358 - DNA, 20 bp, Artificial Sequence
  Synthetic oligonucleotide; TAG chr11 5155923 5155942 5155926 -
tactagtctaaattgtttct

SEQ ID NO: 56359 - DNA, 20 bp, Artificial Sequence
  Synthetic oligonucleotide; AAG chr11 5155914 5155933 5155917 -
aaattgtttcttagtgacaa

SEQ ID NO: 56360 - DNA, 20 bp, Artificial Sequence
  Synthetic oligonucleotide; TAG chr11 5155897 5155916 5155900 -
caaaagaataacctgaatat

SEQ ID NO: 56361 - DNA, 20 bp, Artificial Sequence
  Synthetic oligonucleotide; TAG chr11 5155892 5155911 5155895 -
gaataacctgaatattagat

SEQ ID NO: 56362 - DNA, 20 bp, Artificial Sequence
  Synthetic oligonucleotide; CAG chr11 5155848 5155867 5155851 -
caatttcattcaacatgcaa

SEQ ID NO: 56363 - DNA, 20 bp, Artificial Sequence
  Synthetic oligonucleotide; CAG chr11 5155822 5155841 5155825 -
tattgttttatgctccttca

SEQ ID NO: 56364 - DNA, 20 bp, Artificial Sequence
  Synthetic oligonucleotide; GAG chr11 5155820 5155839 5155823 -
ttgttttatgctccttcaca

SEQ ID NO: 56365 - DNA, 20 bp, Artificial Sequence
  Synthetic oligonucleotide; AGG chr11 5155819 5155838 5155822 -
tgttttatgctccttcacag

SEQ ID NO: 56366 - DNA, 20 bp, Artificial Sequence
  Synthetic oligonucleotide; TGG chr11 5155810 5155829 5155813 -
ctccttcacagaggaaattc

SEQ ID NO: 56367 - DNA, 20 bp, Artificial Sequence
  Synthetic oligonucleotide; AAG chr11 5155806 5155825 5155809 -
ttcacagaggaaattctgga

SEQ ID NO: 56368 - DNA, 20 bp, Artificial Sequence
  Synthetic oligonucleotide; GAG chr11 5155804 5155823 5155807 -
cacagaggaaattctggaaa

SEQ ID NO: 56369 - DNA, 20 bp, Artificial Sequence
  Synthetic oligonucleotide; TGG chr11 5155797 5155816 5155800 -
gaaattctggaaagagcaca

SEQ ID NO: 56370 - DNA, 20 bp, Artificial Sequence
  Synthetic oligonucleotide; GGG chr11 5155796 5155815 5155799 -
aaattctggaaagagcacat

SEQ ID NO: 56371 - DNA, 20 bp, Artificial Sequence
  Synthetic oligonucleotide; GGG chr11 5155795 5155814 5155798 -
aattctggaaagagcacatg

SEQ ID NO: 56372 - DNA, 20 bp, Artificial Sequence
  Synthetic oligonucleotide; TGG chr11 5155758 5155777 5155761 -
atctgtattccttgttctcc

SEQ ID NO: 56373 - DNA, 20 bp, Artificial Sequence
  Synthetic oligonucleotide; TAG chr11 5155728 5155747 5155731 -
ttataaatattctccaccat

SEQ ID NO: 56374 - DNA, 20 bp, Artificial Sequence
  Synthetic oligonucleotide; AAG chr11 5155687 5155706 5155690 -
caatgtctaaacattatatc

SEQ ID NO: 56375 - DNA, 20 bp, Artificial Sequence
  Synthetic oligonucleotide; TAG chr11 5155677 5155696 5155680 -
acattatatcaagtgtctct

SEQ ID NO: 56376 - DNA, 20 bp, Artificial Sequence
  Synthetic oligonucleotide; AAG chr11 5155666 5155685 5155669 -
agtgtctcttagctacattc

SEQ ID NO: 56377 - DNA, 20 bp, Artificial Sequence
  Synthetic oligonucleotide; AAG chr11 5155662 5155681 5155665 -
tctcttagctacattcaaga

SEQ ID NO: 56378 - DNA, 20 bp, Artificial Sequence
  Synthetic oligonucleotide; TAG chr11 5155657 5155676 5155660 -
tagctacattcaagaaagcc

SEQ ID NO: 56379 - DNA, 20 bp, Artificial Sequence
  Synthetic oligonucleotide; CAG chr11 5155650 5155669 5155653 -
attcaagaaagcctagaaac

SEQ ID NO: 56380 - DNA, 20 bp, Artificial Sequence
  Synthetic oligonucleotide; AAG chr11 5155635 5155654 5155638 -
gaaaccagctgtaaaatgtc

SEQ ID NO: 56381 - DNA, 20 bp, Artificial Sequence
  Synthetic oligonucleotide; AGG chr11 5155634 5155653 5155637 -
aaaccagctgtaaaatgtca

SEQ ID NO: 56382 - DNA, 20 bp, Artificial Sequence
  Synthetic oligonucleotide; GAG chr11 5155632 5155651 5155635 -
accagctgtaaaatgtcaag

SEQ ID NO: 56383 - DNA, 20 bp, Artificial Sequence
  Synthetic oligonucleotide; TAG chr11 5155627 5155646 5155630 -
ctgtaaaatgtcaaggagaa

SEQ ID NO: 56384 - DNA, 20 bp, Artificial Sequence
  Synthetic oligonucleotide; AAG chr11 5155612 5155631 5155615 -
gagaatagtgtcatatgcat

SEQ ID NO: 56385 - DNA, 20 bp, Artificial Sequence
  Synthetic oligonucleotide; TAG chr11 5155602 5155621 5155605 -
tcatatgcataagtcttgct

SEQ ID NO: 56386 - DNA, 20 bp, Artificial Sequence
  Synthetic oligonucleotide; CAG chr11 5155592 5155611 5155595 -
aagtcttgcttagaatttat

SEQ ID NO: 56387 - DNA, 20 bp, Artificial Sequence
  Synthetic oligonucleotide; AAG chr11 5155534 5155553 5155537 -
cccattttactaataattta

SEQ ID NO: 56388 - DNA, 20 bp, Artificial Sequence
  Synthetic oligonucleotide; AGG chr11 5155533 5155552 5155536 -
ccattttactaataatttaa

SEQ ID NO: 56389 - DNA, 20 bp, Artificial Sequence
  Synthetic oligonucleotide; AAG chr11 5155529 5155548 5155532 -
tttactaataatttaaaggt

SEQ ID NO: 56390 - DNA, 20 bp, Artificial Sequence
  Synthetic oligonucleotide; TAG chr11 5155503 5155522 5155506 -
ataatttttttcatttcatt

SEQ ID NO: 56391 - DNA, 20 bp, Artificial Sequence
  Synthetic oligonucleotide; TAG chr11 5155476 5155495 5155479 -
tataacatctcactcataaa

SEQ ID NO: 56392 - DNA, 20 bp, Artificial Sequence
  Synthetic oligonucleotide; TAG chr11 5155473 5155492 5155476 -
aacatctcactcataaatag

SEQ ID NO: 56393 - DNA, 20 bp, Artificial Sequence
  Synthetic oligonucleotide; AGG chr11 5155472 5155491 5155475 -
acatctcactcataaatagt

SEQ ID NO: 56394 - DNA, 20 bp, Artificial Sequence
  Synthetic oligonucleotide; AAG chr11 5155448 5155467 5155451 -
atataatgactgttttttga

SEQ ID NO: 56395 - DNA, 20 bp, Artificial Sequence
  Synthetic oligonucleotide; AAG chr11 5155442 5155461 5155445 -
tgactgttttttgaaagaaa

SEQ ID NO: 56396 - DNA, 20 bp, Artificial Sequence
  Synthetic oligonucleotide; AAG chr11 5155439 5155458 5155442 -
ctgttttttgaaagaaaaag

SEQ ID NO: 56397 - DNA, 20 bp, Artificial Sequence
  Synthetic oligonucleotide; AGG chr11 5155438 5155457 5155441 -
tgttttttgaaagaaaaaga

SEQ ID NO: 56398 - DNA, 20 bp, Artificial Sequence
  Synthetic oligonucleotide; AAG chr11 5155435 5155454 5155438 -
tttttgaaagaaaaagaagg

SEQ ID NO: 56399 - DNA, 20 bp, Artificial Sequence
  Synthetic oligonucleotide; AGG chr11 5155434 5155453 5155437 -
ttttgaaagaaaaagaagga

SEQ ID NO: 56400 - DNA, 20 bp, Artificial Sequence
  Synthetic oligonucleotide; AAG chr11 5155430 5155449 5155433 -
gaaagaaaaagaaggaagga

SEQ ID NO: 56401 - DNA, 20 bp, Artificial Sequence
  Synthetic oligonucleotide; AAG chr11 5155423 5155442 5155426 -
aaagaaggaaggaaagtaac

SEQ ID NO: 56402 - DNA, 20 bp, Artificial Sequence
  Synthetic oligonucleotide; AGG chr11 5155422 5155441 5155425 -
aagaaggaaggaaagtaaca

SEQ ID NO: 56403 - DNA, 20 bp, Artificial Sequence
  Synthetic oligonucleotide; AAG chr11 5155419 5155438 5155422 -
aaggaaggaaagtaacaagg

SEQ ID NO: 56404 - DNA, 20 bp, Artificial Sequence
  Synthetic oligonucleotide; AAG chr11 5155415 5155434 5155418 -
aaggaaagtaacaaggaaga

SEQ ID NO: 56405 - DNA, 20 bp, Artificial Sequence
  Synthetic oligonucleotide; GAG chr11 5155413 5155432 5155416 -
ggaaagtaacaaggaagaaa

SEQ ID NO: 56406 - DNA, 20 bp, Artificial Sequence
  Synthetic oligonucleotide; GAG chr11 5155411 5155430 5155414 -
aaagtaacaaggaagaaaga

SEQ ID NO: 56407 - DNA, 20 bp, Artificial Sequence
  Synthetic oligonucleotide; AAG chr11 5155406 5155425 5155409 -
aacaaggaagaaagagagaa

SEQ ID NO: 56408 - DNA, 20 bp, Artificial Sequence
  Synthetic oligonucleotide; GAG chr11 5155404 5155423 5155407 -
caaggaagaaagagagaaaa

SEQ ID NO: 56409 - DNA, 20 bp, Artificial Sequence
  Synthetic oligonucleotide; AGG chr11 5155403 5155422 5155406 -
aaggaagaaagagagaaaag

SEQ ID NO: 56410 - DNA, 20 bp, Artificial Sequence
  Synthetic oligonucleotide; TGG chr11 5155397 5155416 5155400 -
gaaagagagaaaagaggaaa

SEQ ID NO: 56411 - DNA, 20 bp, Artificial Sequence
  Synthetic oligonucleotide; CAG chr11 5155390 5155409 5155393 -
agaaaagaggaaatggatac

SEQ ID NO: 56412 - DNA, 20 bp, Artificial Sequence
  Synthetic oligonucleotide; CAG chr11 5155359 5155378 5155362 -
aatgttcaacaacttgcttc

SEQ ID NO: 56413 - DNA, 20 bp, Artificial Sequence
  Synthetic oligonucleotide; TAG chr11 5155345 5155364 5155348 -
tgcttccagctttacatttg

SEQ ID NO: 56414 - DNA, 20 bp, Artificial Sequence
  Synthetic oligonucleotide; AGG chr11 5155344 5155363 5155347 -
gcttccagctttacatttgt

SEQ ID NO: 56415 - DNA, 20 bp, Artificial Sequence
  Synthetic oligonucleotide; TAG chr11 5155338 5155357 5155341 -
agctttacatttgtaggact

SEQ ID NO: 56416 - DNA, 20 bp, Artificial Sequence
  Synthetic oligonucleotide; AAG chr11 5155309 5155328 5155312 -
ccattataatttgtcactat

SEQ ID NO: 56417 - DNA, 20 bp, Artificial Sequence
  Synthetic oligonucleotide; AAG chr11 5155286 5155305 5155289 -
aatgttacttaatttactaa

SEQ ID NO: 56418 - DNA, 20 bp, Artificial Sequence
  Synthetic oligonucleotide; TGG chr11 5155257 5155276 5155260 -
aaaacttcaataaaataaaa

SEQ ID NO: 56419 - DNA, 20 bp, Artificial Sequence
  Synthetic oligonucleotide; GGG chr11 5155256 5155275 5155259 -
aaacttcaataaaataaaat

SEQ ID NO: 56420 - DNA, 20 bp, Artificial Sequence
  Synthetic oligonucleotide; AAG chr11 5155253 5155272 5155256 -
cttcaataaaataaaatggg

SEQ ID NO: 56421 - DNA, 20 bp, Artificial Sequence
  Synthetic oligonucleotide; GAG chr11 5155247 5155266 5155250 -
taaaataaaatgggaagaat

SEQ ID NO: 56422 - DNA, 20 bp, Artificial Sequence
  Synthetic oligonucleotide; AAG chr11 5155240 5155259 5155243 -
aaatgggaagaatgagactg

SEQ ID NO: 56423 - DNA, 20 bp, Artificial Sequence
  Synthetic oligonucleotide; AAG chr11 5155237 5155256 5155240 -
tgggaagaatgagactgaag

SEQ ID NO: 56424 - DNA, 20 bp, Artificial Sequence
  Synthetic oligonucleotide; GAG chr11 5155231 5155250 5155234 -
gaatgagactgaagaagact

SEQ ID NO: 56425 - DNA, 20 bp, Artificial Sequence
  Synthetic oligonucleotide; AGG chr11 5155230 5155249 5155233 -
aatgagactgaagaagactg

SEQ ID NO: 56426 - DNA, 20 bp, Artificial Sequence
  Synthetic oligonucleotide; AAG chr11 5155227 5155246 5155230 -
gagactgaagaagactgagg

SEQ ID NO: 56427 - DNA, 20 bp, Artificial Sequence
  Synthetic oligonucleotide; TGG chr11 5155216 5155235 5155219 -
agactgaggaagtaattgtg

SEQ ID NO: 56428 - DNA, 20 bp, Artificial Sequence
  Synthetic oligonucleotide; AAG chr11 5155209 5155228 5155212 -
ggaagtaattgtgtggtaaa

SEQ ID NO: 56429 - DNA, 20 bp, Artificial Sequence
  Synthetic oligonucleotide; TAG chr11 5155206 5155225 5155209 -
agtaattgtgtggtaaaaag

SEQ ID NO: 56430 - DNA, 20 bp, Artificial Sequence
  Synthetic oligonucleotide; CAG chr11 5155194 5155213 5155197 -
gtaaaaagtagttatgaata

SEQ ID NO: 56431 - DNA, 20 bp, Artificial Sequence
  Synthetic oligonucleotide; AAG chr11 5155171 5155190 5155174 -
atttttcttttctgaataaa

SEQ ID NO: 56432 - DNA, 20 bp, Artificial Sequence
  Synthetic oligonucleotide; GAG chr11 5155169 5155188 5155172 -
ttttcttttctgaataaaaa

SEQ ID NO: 56433 - DNA, 20 bp, Artificial Sequence
  Synthetic oligonucleotide; CAG chr11 5155153 5155172 5155156 -
aaaagagaaaaaccttgcct

SEQ ID NO: 56434 - DNA, 20 bp, Artificial Sequence
  Synthetic oligonucleotide; AAG chr11 5155137 5155156 5155140 -
gcctcagtgaaaatgtcacc

SEQ ID NO: 56435 - DNA, 20 bp, Artificial Sequence
  Synthetic oligonucleotide; TAG chr11 5155121 5155140 5155124 -
caccaagatatttatttaaa

SEQ ID NO: 56436 - DNA, 20 bp, Artificial Sequence
  Synthetic oligonucleotide; AGG chr11 5155120 5155139 5155123 -
accaagatatttatttaaat

SEQ ID NO: 56437 - DNA, 20 bp, Artificial Sequence
  Synthetic oligonucleotide; TGG chr11 5155114 5155133 5155117 -
atatttatttaaataggaat

SEQ ID NO: 56438 - DNA, 20 bp, Artificial Sequence
  Synthetic oligonucleotide; TAG chr11 5155109 5155128 5155112 -
tatttaaataggaattggca

SEQ ID NO: 56439 - DNA, 20 bp, Artificial Sequence
  Synthetic oligonucleotide; TGG chr11 5155088 5155107 5155091 -
agaaacatgtttgcattaaa

SEQ ID NO: 56440 - DNA, 20 bp, Artificial Sequence
  Synthetic oligonucleotide; GGG chr11 5155087 5155106 5155090 -
gaaacatgtttgcattaaat

SEQ ID NO: 56441 - DNA, 20 bp, Artificial Sequence
  Synthetic oligonucleotide; TAG chr11 5155081 5155100 5155084 -
tgtttgcattaaatgggctt

SEQ ID NO: 56442 - DNA, 20 bp, Artificial Sequence
  Synthetic oligonucleotide; TAG chr11 5155067 5155086 5155070 -
gggctttagaattttgcaaa

SEQ ID NO: 56443 - DNA, 20 bp, Artificial Sequence
  Synthetic oligonucleotide; TGG chr11 5155061 5155080 5155064 -
tagaattttgcaaatagaaa

SEQ ID NO: 56444 - DNA, 20 bp, Artificial Sequence
  Synthetic oligonucleotide; CAG chr11 5155058 5155077 5155061 -
aattttgcaaatagaaatgg

SEQ ID NO: 56445 - DNA, 20 bp, Artificial Sequence
  Synthetic oligonucleotide; AAG chr11 5155053 5155072 5155056 -
tgcaaatagaaatggcagaa

SEQ ID NO: 56446 - DNA, 20 bp, Artificial Sequence
  Synthetic oligonucleotide; AGG chr11 5155052 5155071 5155055 -
gcaaatagaaatggcagaaa

SEQ ID NO: 56447 - DNA, 20 bp, Artificial Sequence
  Synthetic oligonucleotide; TAG chr11 5155045 5155064 5155048 -
gaaatggcagaaaaggaaca

SEQ ID NO: 56448 - DNA, 20 bp, Artificial Sequence
  Synthetic oligonucleotide; TAG chr11 5155003 5155022 5155006 -
catatgaattattctgcatt

SEQ ID NO: 56449 - DNA, 20 bp, Artificial Sequence
  Synthetic oligonucleotide; TGG chr11 5154996 5155015 5154999 -
attattctgcatttagcctg

SEQ ID NO: 56450 - DNA, 20 bp, Artificial Sequence
  Synthetic oligonucleotide; GGG chr11 5154995 5155014 5154998 -
ttattctgcatttagcctgt

SEQ ID NO: 56451 - DNA, 20 bp, Artificial Sequence
  Synthetic oligonucleotide; AAG chr11 5154990 5155009 5154993 -
ctgcatttagcctgtgggaa

SEQ ID NO: 56452 - DNA, 20 bp, Artificial Sequence
  Synthetic oligonucleotide; GAG chr11 5154988 5155007 5154991 -
gcatttagcctgtgggaaaa

SEQ ID NO: 56453 - DNA, 20 bp, Artificial Sequence
  Synthetic oligonucleotide; AAG chr11 5154982 5155001 5154985 -
agcctgtgggaaaagagaaa

SEQ ID NO: 56454 - DNA, 20 bp, Artificial Sequence
  Synthetic oligonucleotide; GAG chr11 5154980 5154999 5154983 -
cctgtgggaaaagagaaaaa

SEQ ID NO: 56455 - DNA, 20 bp, Artificial Sequence
  Synthetic oligonucleotide; GAG chr11 5154978 5154997 5154981 -
tgtgggaaaagagaaaaaga

SEQ ID NO: 56456 - DNA, 20 bp, Artificial Sequence
  Synthetic oligonucleotide; AAG chr11 5154974 5154993 5154977 -
ggaaaagagaaaaagagaga

SEQ ID NO: 56457 - DNA, 20 bp, Artificial Sequence
  Synthetic oligonucleotide; AGG chr11 5154973 5154992 5154976 -
gaaaagagaaaaagagagaa

SEQ ID NO: 56458 - DNA, 20 bp, Artificial Sequence
  Synthetic oligonucleotide; GAG chr11 5154971 5154990 5154974 -
aaagagaaaaagagagaaag

SEQ ID NO: 56459 - DNA, 20 bp, Artificial Sequence
  Synthetic oligonucleotide; AAG chr11 5154960 5154979 5154963 -
gagagaaaggagatttctgc

SEQ ID NO: 56460 - DNA, 20 bp, Artificial Sequence
  Synthetic oligonucleotide; TAG chr11 5154955 5154974 5154958 -
aaaggagatttctgcaagtg

SEQ ID NO: 56461 - DNA, 20 bp, Artificial Sequence
  Synthetic oligonucleotide; CGG chr11 5154943 5154962 5154946 -
tgcaagtgtagaaataatta

SEQ ID NO: 56462 - DNA, 20 bp, Artificial Sequence
  Synthetic oligonucleotide; GGG chr11 5154942 5154961 5154945 -
gcaagtgtagaaataattac

SEQ ID NO: 56463 - DNA, 20 bp, Artificial Sequence
  Synthetic oligonucleotide; GGG chr11 5154941 5154960 5154944 -
caagtgtagaaataattacg

SEQ ID NO: 56464 - DNA, 20 bp, Artificial Sequence
  Synthetic oligonucleotide; TAG chr11 5154934 5154953 5154937 -
agaaataattacggggatat

SEQ ID NO: 56465 - DNA, 20 bp, Artificial Sequence
  Synthetic oligonucleotide; AGG chr11 5154933 5154952 5154936 -
gaaataattacggggatatt

SEQ ID NO: 56466 - DNA, 20 bp, Artificial Sequence
  Synthetic oligonucleotide; CAG chr11 5154927 5154946 5154930 -
attacggggatattaggtgc

SEQ ID NO: 56467 - DNA, 20 bp, Artificial Sequence
  Synthetic oligonucleotide; AAG chr11 5154917 5154936 5154920 -
tattaggtgccagtgaaccc

SEQ ID NO: 56468 - DNA, 20 bp, Artificial Sequence
  Synthetic oligonucleotide; GAG chr11 5154915 5154934 5154918 -
ttaggtgccagtgaacccaa

SEQ ID NO: 56469 - DNA, 20 bp, Artificial Sequence
  Synthetic oligonucleotide; AGG chr11 5154914 5154933 5154917 -
taggtgccagtgaacccaag

SEQ ID NO: 56470 - DNA, 20 bp, Artificial Sequence
  Synthetic oligonucleotide; GGG chr11 5154913 5154932 5154916 -
aggtgccagtgaacccaaga

SEQ ID NO: 56471 - DNA, 20 bp, Artificial Sequence
  Synthetic oligonucleotide; TGG chr11 5154894 5154913 5154897 -
agggctgacttaaaatttgc

SEQ ID NO: 56472 - DNA, 20 bp, Artificial Sequence
  Synthetic oligonucleotide; GGG chr11 5154893 5154912 5154896 -
gggctgacttaaaatttgct

SEQ ID NO: 56473 - DNA, 20 bp, Artificial Sequence
  Synthetic oligonucleotide; TGG chr11 5154883 5154902 5154886 -
aaaatttgctgggtccctcg

SEQ ID NO: 56474 - DNA, 20 bp, Artificial Sequence
  Synthetic oligonucleotide; TGG chr11 5154877 5154896 5154880 -
tgctgggtccctcgtggttt

SEQ ID NO: 56475 - DNA, 20 bp, Artificial Sequence
  Synthetic oligonucleotide; TAG chr11 5154866 5154885 5154869 -
tcgtggttttggctatcaac

SEQ ID NO: 56476 - DNA, 20 bp, Artificial Sequence
  Synthetic oligonucleotide; AGG chr11 5154865 5154884 5154868 -
cgtggttttggctatcaact

SEQ ID NO: 56477 - DNA, 20 bp, Artificial Sequence
  Synthetic oligonucleotide; AAG chr11 5154811 5154830 5154814 -
tacttctccacacattcata

SEQ ID NO: 56478 - DNA, 20 bp, Artificial Sequence
  Synthetic oligonucleotide; AGG chr11 5154810 5154829 5154813 -
acttctccacacattcataa

SEQ ID NO: 56479 - DNA, 20 bp, Artificial Sequence
  Synthetic oligonucleotide; TGG chr11 5154797 5154816 5154800 -
ttcataaaggaatattaaat

SEQ ID NO: 56480 - DNA, 20 bp, Artificial Sequence
  Synthetic oligonucleotide; TGG chr11 5154794 5154813 5154797 -
ataaaggaatattaaattgg

SEQ ID NO: 56481 - DNA, 20 bp, Artificial Sequence
  Synthetic oligonucleotide; TAG chr11 5154790 5154809 5154793 -
aggaatattaaattggtgga

SEQ ID NO: 56482 - DNA, 20 bp, Artificial Sequence
  Synthetic oligonucleotide; GAG chr11 5154768 5154787 5154771 -
gccacttttttctccaattt

SEQ ID NO: 56483 - DNA, 20 bp, Artificial Sequence
  Synthetic oligonucleotide; CAG chr11 5154742 5154761 5154745 -
aataaattcatcccgtgttt

SEQ ID NO: 56484 - DNA, 20 bp, Artificial Sequence
  Synthetic oligonucleotide; CAG chr11 5154732 5154751 5154735 -
tcccgtgtttcagaatgcta

SEQ ID NO: 56485 - DNA, 20 bp, Artificial Sequence
  Synthetic oligonucleotide; GAG chr11 5154719 5154738 5154722 -
aatgctacagacctcactat

SEQ ID NO: 56486 - DNA, 20 bp, Artificial Sequence
  Synthetic oligonucleotide; TGG chr11 5154710 5154729 5154713 -
gacctcactatgagttttac

SEQ ID NO: 56487 - DNA, 20 bp, Artificial Sequence
  Synthetic oligonucleotide; GGG chr11 5154709 5154728 5154712 -
acctcactatgagttttact

SEQ ID NO: 56488 - DNA, 20 bp, Artificial Sequence
  Synthetic oligonucleotide; GGG chr11 5154708 5154727 5154711 -
cctcactatgagttttactg

SEQ ID NO: 56489 - DNA, 20 bp, Artificial Sequence
  Synthetic oligonucleotide; GGG chr11 5154707 5154726 5154710 -
ctcactatgagttttactgg

SEQ ID NO: 56490 - DNA, 20 bp, Artificial Sequence
  Synthetic oligonucleotide; GAG chr11 5154702 5154721 5154705 -
tatgagttttactgggggat

SEQ ID NO: 56491 - DNA, 20 bp, Artificial Sequence
  Synthetic oligonucleotide; AAG chr11 5154693 5154712 5154696 -
tactgggggatgagcacaca

SEQ ID NO: 56492 - DNA, 20 bp, Artificial Sequence
  Synthetic oligonucleotide; TGG chr11 5154689 5154708 5154692 -
gggggatgagcacacaaaga

SEQ ID NO: 56493 - DNA, 20 bp, Artificial Sequence
  Synthetic oligonucleotide; GAG chr11 5154683 5154702 5154686 -
tgagcacacaaagatggtct

SEQ ID NO: 56494 - DNA, 20 bp, Artificial Sequence
  Synthetic oligonucleotide; CAG chr11 5154679 5154698 5154682 -
cacacaaagatggtctgaga

SEQ ID NO: 56495 - DNA, 20 bp, Artificial Sequence
  Synthetic oligonucleotide; CAG chr11 5154671 5154690 5154674 -
gatggtctgagacagacttc

SEQ ID NO: 56496 - DNA, 20 bp, Artificial Sequence
  Synthetic oligonucleotide; AAG chr11 5154668 5154687 5154671 -
ggtctgagacagacttccag

SEQ ID NO: 56497 - DNA, 20 bp, Artificial Sequence
  Synthetic oligonucleotide; AAG chr11 5154665 5154684 5154668 -
ctgagacagacttccagaag

SEQ ID NO: 56498 - DNA, 20 bp, Artificial Sequence
  Synthetic oligonucleotide; AAG chr11 5154662 5154681 5154665 -
agacagacttccagaagaag

SEQ ID NO: 56499 - DNA, 20 bp, Artificial Sequence
  Synthetic oligonucleotide; AAG chr11 5154659 5154678 5154662 -
cagacttccagaagaagaag

SEQ ID NO: 56500 - DNA, 20 bp, Artificial Sequence
  Synthetic oligonucleotide; TAG chr11 5154646 5154665 5154649 -
gaagaagaagatgtccgtgt

SEQ ID NO: 56501 - DNA, 20 bp, Artificial Sequence
  Synthetic oligonucleotide; GAG chr11 5154644 5154663 5154647 -
agaagaagatgtccgtgtta

SEQ ID NO: 56502 - DNA, 20 bp, Artificial Sequence
  Synthetic oligonucleotide; AAG chr11 5154632 5154651 5154635 -
ccgtgttagagataaatgaa

SEQ ID NO: 56503 - DNA, 20 bp, Artificial Sequence
  Synthetic oligonucleotide; AAG chr11 5154623 5154642 5154626 -
agataaatgaaaagtgtaaa

SEQ ID NO: 56504 - DNA, 20 bp, Artificial Sequence
  Synthetic oligonucleotide; CAG chr11 5154602 5154621 5154605 -
agtcatctgcaaaatgtcca

SEQ ID NO: 56505 - DNA, 20 bp, Artificial Sequence
  Synthetic oligonucleotide; TGG chr11 5154589 5154608 5154592 -
atgtccacagtatattatat

SEQ ID NO: 56506 - DNA, 20 bp, Artificial Sequence
  Synthetic oligonucleotide; TGG chr11 5154577 5154596 5154580 -
tattatattggcacatatcc

SEQ ID NO: 56507 - DNA, 20 bp, Artificial Sequence
  Synthetic oligonucleotide; CAG chr11 5154567 5154586 5154570 -
gcacatatcctggcaccaaa

SEQ ID NO: 56508 - DNA, 20 bp, Artificial Sequence
  Synthetic oligonucleotide; GAG chr11 5154565 5154584 5154568 -
acatatcctggcaccaaaca

SEQ ID NO: 56509 - DNA, 20 bp, Artificial Sequence
  Synthetic oligonucleotide; TAG chr11 5154547 5154566 5154550 -
cagagtaaaatttatgacat

SEQ ID NO: 56510 - DNA, 20 bp, Artificial Sequence
  Synthetic oligonucleotide; TGG chr11 5154543 5154562 5154546 -
gtaaaatttatgacattagc

SEQ ID NO: 56511 - DNA, 20 bp, Artificial Sequence
  Synthetic oligonucleotide; CAG chr11 5154529 5154548 5154532 -
attagctggatgctgttaca

SEQ ID NO: 56512 - DNA, 20 bp, Artificial Sequence
  Synthetic oligonucleotide; GAG chr11 5154527 5154546 5154530 -
tagctggatgctgttacaca

SEQ ID NO: 56513 - DNA, 20 bp, Artificial Sequence
  Synthetic oligonucleotide; CAG chr11 5154522 5154541 5154525 -
ggatgctgttacacagagtg

SEQ ID NO: 56514 - DNA, 20 bp, Artificial Sequence
  Synthetic oligonucleotide; CAG chr11 5154518 5154537 5154521 -
gctgttacacagagtgcaga

SEQ ID NO: 56515 - DNA, 20 bp, Artificial Sequence
  Synthetic oligonucleotide; AAG chr11 5154514 5154533 5154517 -
ttacacagagtgcagacaga

SEQ ID NO: 56516 - DNA, 20 bp, Artificial Sequence
  Synthetic oligonucleotide; TAG chr11 5154511 5154530 5154514 -
cacagagtgcagacagaaag

SEQ ID NO: 56517 - DNA, 20 bp, Artificial Sequence
  Synthetic oligonucleotide; GAG chr11 5154509 5154528 5154512 -
cagagtgcagacagaaagta

SEQ ID NO: 56518 - DNA, 20 bp, Artificial Sequence
  Synthetic oligonucleotide; CAG chr11 5154500 5154519 5154503 -
gacagaaagtagagccatca

SEQ ID NO: 56519 - DNA, 20 bp, Artificial Sequence
  Synthetic oligonucleotide; AAG chr11 5154485 5154504 5154488 -
catcacagaacccacaactt

SEQ ID NO: 56520 - DNA, 20 bp, Artificial Sequence
  Synthetic oligonucleotide; AGG chr11 5154484 5154503 5154487 -
atcacagaacccacaactta

SEQ ID NO: 56521 - DNA, 20 bp, Artificial Sequence
  Synthetic oligonucleotide; GGG chr11 5154483 5154502 5154486 -
tcacagaacccacaacttaa

SEQ ID NO: 56522 - DNA, 20 bp, Artificial Sequence
  Synthetic oligonucleotide; AAG chr11 5154476 5154495 5154479 -
acccacaacttaagggaatg

SEQ ID NO: 56523 - DNA, 20 bp, Artificial Sequence
  Synthetic oligonucleotide; TGG chr11 5154472 5154491 5154475 -
acaacttaagggaatgaagc

SEQ ID NO: 56524 - DNA, 20 bp, Artificial Sequence
  Synthetic oligonucleotide; TGG chr11 5154463 5154482 5154466 -
gggaatgaagctggaatcct

SEQ ID NO: 56525 - DNA, 20 bp, Artificial Sequence
  Synthetic oligonucleotide; GAG chr11 5154461 5154480 5154464 -
gaatgaagctggaatccttg

SEQ ID NO: 56526 - DNA, 20 bp, Artificial Sequence
  Synthetic oligonucleotide; AAG chr11 5154458 5154477 5154461 -
tgaagctggaatccttggag

SEQ ID NO: 56527 - DNA, 20 bp, Artificial Sequence
  Synthetic oligonucleotide; TGG chr11 5154449 5154468 5154452 -
aatccttggagaagaaaaat

SEQ ID NO: 56528 - DNA, 20 bp, Artificial Sequence
  Synthetic oligonucleotide; GAG chr11 5154445 5154464 5154448 -
cttggagaagaaaaattggt

SEQ ID NO: 56529 - DNA, 20 bp, Artificial Sequence
  Synthetic oligonucleotide; AAG chr11 5154432 5154451 5154435 -
aattggtgagtgatgaatga

SEQ ID NO: 56530 - DNA, 20 bp, Artificial Sequence
  Synthetic oligonucleotide; TGG chr11 5154417 5154436 5154420 -
aatgaaagtgttatgaaaaa

SEQ ID NO: 56531 - DNA, 20 bp, Artificial Sequence
  Synthetic oligonucleotide; CAG chr11 5154403 5154422 5154406 -
gaaaaatggacaatattctt

SEQ ID NO: 56532 - DNA, 20 bp, Artificial Sequence
  Synthetic oligonucleotide; AGG chr11 5154402 5154421 5154405 -
aaaaatggacaatattcttc

SEQ ID NO: 56533 - DNA, 20 bp, Artificial Sequence
  Synthetic oligonucleotide; TGG chr11 5154395 5154414 5154398 -
gacaatattcttcaggtatc

SEQ ID NO: 56534 - DNA, 20 bp, Artificial Sequence
  Synthetic oligonucleotide; AAG chr11 5154391 5154410 5154394 -
atattcttcaggtatctggt

SEQ ID NO: 56535 - DNA, 20 bp, Artificial Sequence
  Synthetic oligonucleotide; GAG chr11 5154389 5154408 5154392 -
attcttcaggtatctggtaa

SEQ ID NO: 56536 - DNA, 20 bp, Artificial Sequence
  Synthetic oligonucleotide; CAG chr11 5154380 5154399 5154383 -
gtatctggtaagagcaaaac

SEQ ID NO: 56537 - DNA, 20 bp, Artificial Sequence
  Synthetic oligonucleotide; GAG chr11 5154362 5154381 5154365 -
accagctctcaataataatt

SEQ ID NO: 56538 - DNA, 20 bp, Artificial Sequence
  Synthetic oligonucleotide; AGG chr11 5154361 5154380 5154364 -
ccagctctcaataataattg

SEQ ID NO: 56539 - DNA, 20 bp, Artificial Sequence
  Synthetic oligonucleotide; GAG chr11 5154359 5154378 5154362 -
agctctcaataataattgag

SEQ ID NO: 56540 - DNA, 20 bp, Artificial Sequence
  Synthetic oligonucleotide; AAG chr11 5154355 5154374 5154358 -
ctcaataataattgaggagt

SEQ ID NO: 56541 - DNA, 20 bp, Artificial Sequence
  Synthetic oligonucleotide; AAG chr11 5154340 5154359 5154343 -
ggagtaagtctcacgattcc

SEQ ID NO: 56542 - DNA, 20 bp, Artificial Sequence
  Synthetic oligonucleotide; CAG chr11 5154314 5154333 5154317 -
cctctccataatttaattac

SEQ ID NO: 56543 - DNA, 20 bp, Artificial Sequence
  Synthetic oligonucleotide; CAG chr11 5154278 5154297 5154281 -
aatcactctatccaactaac

SEQ ID NO: 56544 - DNA, 20 bp, Artificial Sequence
  Synthetic oligonucleotide; AGG chr11 5154277 5154296 5154280 -
atcactctatccaactaacc

SEQ ID NO: 56545 - DNA, 20 bp, Artificial Sequence
  Synthetic oligonucleotide; CAG chr11 5154230 5154249 5154233 -
accctgctatctgtgcctgt

SEQ ID NO: 56546 - DNA, 20 bp, Artificial Sequence
  Synthetic oligonucleotide; AGG chr11 5154229 5154248 5154232 -
ccctgctatctgtgcctgtc

SEQ ID NO: 56547 - DNA, 20 bp, Artificial Sequence
  Synthetic oligonucleotide; TAG chr11 5154226 5154245 5154229 -
tgctatctgtgcctgtcagg

SEQ ID NO: 56548 - DNA, 20 bp, Artificial Sequence
  Synthetic oligonucleotide; CAG chr11 5154212 5154231 5154215 -
gtcaggtagtactcacatgt

SEQ ID NO: 56549 - DNA, 20 bp, Artificial Sequence
  Synthetic oligonucleotide; TGG chr11 5154204 5154223 5154207 -
gtactcacatgtcagctctt

SEQ ID NO: 56550 - DNA, 20 bp, Artificial Sequence
  Synthetic oligonucleotide; AAG chr11 5154193 5154212 5154196 -
tcagctctttggtcttgaat

SEQ ID NO: 56551 - DNA, 20 bp, Artificial Sequence
  Synthetic oligonucleotide; CAG chr11 5154189 5154208 5154192 -
ctctttggtcttgaataagt

SEQ ID NO: 56552 - DNA, 20 bp, Artificial Sequence
  Synthetic oligonucleotide; AAG chr11 5154168 5154187 5154171 -
agacattgtgattgccatta

SEQ ID NO: 56553 - DNA, 20 bp, Artificial Sequence
  Synthetic oligonucleotide; AGG chr11 5154167 5154186 5154170 -
gacattgtgattgccattaa

SEQ ID NO: 56554 - DNA, 20 bp, Artificial Sequence
  Synthetic oligonucleotide; TGG chr11 5154138 5154157 5154141 -
attctaattgtgattatctt

SEQ ID NO: 56555 - DNA, 20 bp, Artificial Sequence
  Synthetic oligonucleotide; GAG chr11 5154136 5154155 5154139 -
tctaattgtgattatctttg

SEQ ID NO: 56556 - DNA, 20 bp, Artificial Sequence
  Synthetic oligonucleotide; AAG chr11 5154133 5154152 5154136 -
aattgtgattatctttggag

SEQ ID NO: 56557 - DNA, 20 bp, Artificial Sequence
  Synthetic oligonucleotide; TAG chr11 5154113 5154132 5154116 -
aagaaaaaatttgcccctat

SEQ ID NO: 56558 - DNA, 20 bp, Artificial Sequence
  Synthetic oligonucleotide; AAG chr11 5154107 5154126 5154110 -
aaatttgcccctattagaaa

SEQ ID NO: 56559 - DNA, 20 bp, Artificial Sequence
  Synthetic oligonucleotide; CAG chr11 5154103 5154122 5154106 -
ttgcccctattagaaaaagc

SEQ ID NO: 56560 - DNA, 20 bp, Artificial Sequence
  Synthetic oligonucleotide; TGG chr11 5154093 5154112 5154096 -
tagaaaaagccagtgactta

SEQ ID NO: 56561 - DNA, 20 bp, Artificial Sequence
  Synthetic oligonucleotide; TGG chr11 5154089 5154108 5154092 -
aaaagccagtgacttatgga

SEQ ID NO: 56562 - DNA, 20 bp, Artificial Sequence
  Synthetic oligonucleotide; GGG chr11 5154088 5154107 5154091 -
aaagccagtgacttatggat

SEQ ID NO: 56563 - DNA, 20 bp, Artificial Sequence
  Synthetic oligonucleotide; GAG chr11 5154086 5154105 5154089 -
agccagtgacttatggatgg

SEQ ID NO: 56564 - DNA, 20 bp, Artificial Sequence
  Synthetic oligonucleotide; AAG chr11 5154071 5154090 5154074 -
gatgggagtgtcataaaact

SEQ ID NO: 56565 - DNA, 20 bp, Artificial Sequence
  Synthetic oligonucleotide; TGG chr11 5154065 5154084 5154068 -
agtgtcataaaactaagcat

SEQ ID NO: 56566 - DNA, 20 bp, Artificial Sequence
  Synthetic oligonucleotide; GGG chr11 5154064 5154083 5154067 -
gtgtcataaaactaagcatt

SEQ ID NO: 56567 - DNA, 20 bp, Artificial Sequence
  Synthetic oligonucleotide; GGG chr11 5154063 5154082 5154066 -
tgtcataaaactaagcattg

SEQ ID NO: 56568 - DNA, 20 bp, Artificial Sequence
  Synthetic oligonucleotide; TGG chr11 5154050 5154069 5154053 -
agcattggggatcaaatctg

SEQ ID NO: 56569 - DNA, 20 bp, Artificial Sequence
  Synthetic oligonucleotide; AAG chr11 5154041 5154060 5154044 -
gatcaaatctgtggaaatca

SEQ ID NO: 56570 - DNA, 20 bp, Artificial Sequence
  Synthetic oligonucleotide; TAG chr11 5154022 5154041 5154025 -
aaagtatttaattgacctac

SEQ ID NO: 56571 - DNA, 20 bp, Artificial Sequence
  Synthetic oligonucleotide; CGG chr11 5154015 5154034 5154018 -
ttaattgacctactagttta

SEQ ID NO: 56572 - DNA, 20 bp, Artificial Sequence
  Synthetic oligonucleotide; TAG chr11 5154001 5154020 5154004 -
agtttacggtaaatgtatgt

SEQ ID NO: 56573 - DNA, 20 bp, Artificial Sequence
  Synthetic oligonucleotide; CAG chr11 5153992 5154011 5153995 -
taaatgtatgttagctgata

SEQ ID NO: 56574 - DNA, 20 bp, Artificial Sequence
  Synthetic oligonucleotide; TGG chr11 5153958 5153977 5153961 -
tgaaatgtcctctgctgatt

SEQ ID NO: 56575 - DNA, 20 bp, Artificial Sequence
  Synthetic oligonucleotide; AAG chr11 5153943 5153962 5153946 -
tgatttggttctttcatttg

SEQ ID NO: 56576 - DNA, 20 bp, Artificial Sequence
  Synthetic oligonucleotide; TAG chr11 5153938 5153957 5153941 -
tggttctttcatttgaagtt

SEQ ID NO: 56577 - DNA, 20 bp, Artificial Sequence
  Synthetic oligonucleotide; CAG chr11 5153935 5153954 5153938 -
ttctttcatttgaagtttag

SEQ ID NO: 56578 - DNA, 20 bp, Artificial Sequence
  Synthetic oligonucleotide; CAG chr11 5153932 5153951 5153935 -
tttcatttgaagtttagcag

SEQ ID NO: 56579 - DNA, 20 bp, Artificial Sequence
  Synthetic oligonucleotide; GAG chr11 5153905 5153924 5153908 -
acatttgttgttgaatattt

SEQ ID NO: 56580 - DNA, 20 bp, Artificial Sequence
  Synthetic oligonucleotide; AAG chr11 5153822 5153841 5153825 -
caaaaaaaaaaaaaaaaaaa

SEQ ID NO: 56581 - DNA, 20 bp, Artificial Sequence
  Synthetic oligonucleotide; AAG chr11 5153804 5153823 5153807 -
aaaagctgctttttctttca

SEQ ID NO: 56582 - DNA, 20 bp, Artificial Sequence
  Synthetic oligonucleotide; CAG chr11 5153799 5153818 5153802 -
ctgctttttctttcaaagaa

SEQ ID NO: 56583 - DNA, 20 bp, Artificial Sequence
  Synthetic oligonucleotide; CAG chr11 5153780 5153799 5153783 -
acagctacttcctgaatttc

SEQ ID NO: 56584 - DNA, 20 bp, Artificial Sequence
  Synthetic oligonucleotide; TGG chr11 5153772 5153791 5153775 -
ttcctgaatttccagcatat

SEQ ID NO: 56585 - DNA, 20 bp, Artificial Sequence
  Synthetic oligonucleotide; AAG chr11 5153762 5153781 5153765 -
tccagcatattggtgacatg

SEQ ID NO: 56586 - DNA, 20 bp, Artificial Sequence
  Synthetic oligonucleotide; CGG chr11 5153755 5153774 5153758 -
tattggtgacatgaagcata

SEQ ID NO: 56587 - DNA, 20 bp, Artificial Sequence
  Synthetic oligonucleotide; TAG chr11 5153751 5153770 5153754 -
ggtgacatgaagcatacggt

SEQ ID NO: 56588 - DNA, 20 bp, Artificial Sequence
  Synthetic oligonucleotide; GAG chr11 5153739 5153758 5153742 -
catacggttagctgattcat

SEQ ID NO: 56589 - DNA, 20 bp, Artificial Sequence
  Synthetic oligonucleotide; GAG chr11 5153730 5153749 5153733 -
agctgattcatgagcttact

SEQ ID NO: 56590 - DNA, 20 bp, Artificial Sequence
  Synthetic oligonucleotide; AAG chr11 5153710 5153729 5153713 -
gagataaaacaactttattg

SEQ ID NO: 56591 - DNA, 20 bp, Artificial Sequence
  Synthetic oligonucleotide; TAG chr11 5153703 5153722 5153706 -
aacaactttattgaagtgtc

SEQ ID NO: 56592 - DNA, 20 bp, Artificial Sequence
  Synthetic oligonucleotide; AGG chr11 5153702 5153721 5153705 -
acaactttattgaagtgtct

SEQ ID NO: 56593 - DNA, 20 bp, Artificial Sequence
  Synthetic oligonucleotide; AAG chr11 5153698 5153717 5153701 -
ctttattgaagtgtctagga

SEQ ID NO: 56594 - DNA, 20 bp, Artificial Sequence
  Synthetic oligonucleotide; AAG chr11 5153691 5153710 5153694 -
gaagtgtctaggaaagaatg

SEQ ID NO: 56595 - DNA, 20 bp, Artificial Sequence
  Synthetic oligonucleotide; TAG chr11 5153646 5153665 5153649 -
acaaacatttctctaatgta

SEQ ID NO: 56596 - DNA, 20 bp, Artificial Sequence
  Synthetic oligonucleotide; TAG chr11 5153610 5153629 5153613 -
gattcaaaatatgtaatttt

SEQ ID NO: 56597 - DNA, 20 bp, Artificial Sequence
  Synthetic oligonucleotide; CAG chr11 5153590 5153609 5153593 -
tagaaaataactattttgat

SEQ ID NO: 56598 - DNA, 20 bp, Artificial Sequence
  Synthetic oligonucleotide; GAG chr11 5153588 5153607 5153591 -
gaaaataactattttgatca

SEQ ID NO: 56599 - DNA, 20 bp, Artificial Sequence
  Synthetic oligonucleotide; AAG chr11 5153573 5153592 5153576 -
gatcagagaacttttatata

SEQ ID NO: 56600 - DNA, 20 bp, Artificial Sequence
  Synthetic oligonucleotide; AAG chr11 5153567 5153586 5153570 -
agaacttttatataaagcat

SEQ ID NO: 56601 - DNA, 20 bp, Artificial Sequence
  Synthetic oligonucleotide; GAG chr11 5153565 5153584 5153568 -
aacttttatataaagcataa

SEQ ID NO: 56602 - DNA, 20 bp, Artificial Sequence
  Synthetic oligonucleotide; CAG chr11 5153560 5153579 5153563 -
ttatataaagcataagagcc

SEQ ID NO: 56603 - DNA, 20 bp, Artificial Sequence
  Synthetic oligonucleotide; AGG chr11 5153559 5153578 5153562 -
tatataaagcataagagccc

SEQ ID NO: 56604 - DNA, 20 bp, Artificial Sequence
  Synthetic oligonucleotide; CAG chr11 5153551 5153570 5153554 -
gcataagagcccaggttttt

SEQ ID NO: 56605 - DNA, 20 bp, Artificial Sequence
  Synthetic oligonucleotide; CAG chr11 5153535 5153554 5153538 -
ttttcagaaaattcaatcat

SEQ ID NO: 56606 - DNA, 20 bp, Artificial Sequence
  Synthetic oligonucleotide; AAG chr11 5153522 5153541 5153525 -
caatcatcagtgaaattgaa

SEQ ID NO: 56607 - DNA, 20 bp, Artificial Sequence
  Synthetic oligonucleotide; TGG chr11 5153504 5153523 5153507 -
aaaagtgactaaattttctt

SEQ ID NO: 56608 - DNA, 20 bp, Artificial Sequence
  Synthetic oligonucleotide; TAG chr11 5153494 5153513 5153497 -
aaattttctttggttattca

SEQ ID NO: 56609 - DNA, 20 bp, Artificial Sequence
  Synthetic oligonucleotide; TAG chr11 5153476 5153495 5153479 -
catagtgctttcctcaattt

SEQ ID NO: 56610 - DNA, 20 bp, Artificial Sequence
  Synthetic oligonucleotide; AAG chr11 5153466 5153485 5153469 -
tcctcaattttagtctcccc

SEQ ID NO: 56611 - DNA, 20 bp, Artificial Sequence
  Synthetic oligonucleotide; TAG chr11 5153443 5153462 5153446 -
tttgtcctgtcttccctgtc

SEQ ID NO: 56612 - DNA, 20 bp, Artificial Sequence
  Synthetic oligonucleotide; AAG chr11 5153420 5153439 5153423 -
ttctacatttgacttcttct

SEQ ID NO: 56613 - DNA, 20 bp, Artificial Sequence
  Synthetic oligonucleotide; TAG chr11 5153405 5153424 5153408 -
cttctaagaaatctgtcctt

SEQ ID NO: 56614 - DNA, 20 bp, Artificial Sequence
  Synthetic oligonucleotide; CAG chr11 5153374 5153393 5153377 -
tttttactaatttcttatgt

SEQ ID NO: 56615 - DNA, 20 bp, Artificial Sequence
  Synthetic oligonucleotide; GAG chr11 5153372 5153391 5153375 -
tttactaatttcttatgtca

SEQ ID NO: 56616 - DNA, 20 bp, Artificial Sequence
  Synthetic oligonucleotide; AAG chr11 5153354 5153373 5153357 -
cagagctcacaaaattatat

SEQ ID NO: 56617 - DNA, 20 bp, Artificial Sequence
  Synthetic oligonucleotide; AAG chr11 5153331 5153350 5153334 -
catctcacctatatttcatt

SEQ ID NO: 56618 - DNA, 20 bp, Artificial Sequence
  Synthetic oligonucleotide; GAG chr11 5153321 5153340 5153324 -
atatttcattaagaactaat

SEQ ID NO: 56619 - DNA, 20 bp, Artificial Sequence
  Synthetic oligonucleotide; TGG chr11 5153311 5153330 5153314 -
aagaactaatgagcctttat

SEQ ID NO: 56620 - DNA, 20 bp, Artificial Sequence
  Synthetic oligonucleotide; GGG chr11 5153310 5153329 5153313 -
agaactaatgagcctttatt

SEQ ID NO: 56621 - DNA, 20 bp, Artificial Sequence
  Synthetic oligonucleotide; CAG chr11 5153269 5153288 5153272 -
aactctgaacattttaaaac

SEQ ID NO: 56622 - DNA, 20 bp, Artificial Sequence
  Synthetic oligonucleotide; AGG chr11 5153268 5153287 5153271 -
actctgaacattttaaaacc

SEQ ID NO: 56623 - DNA, 20 bp, Artificial Sequence
  Synthetic oligonucleotide; TGG chr11 5153261 5153280 5153264 -
acattttaaaaccaggaaac

SEQ ID NO: 56624 - DNA, 20 bp, Artificial Sequence
  Synthetic oligonucleotide; TGG chr11 5153249 5153268 5153252 -
caggaaactggactctattc

SEQ ID NO: 56625 - DNA, 20 bp, Artificial Sequence
  Synthetic oligonucleotide; CAG chr11 5153221 5153240 5153224 -
tgattcatttgcccattatt

SEQ ID NO: 56626 - DNA, 20 bp, Artificial Sequence
  Synthetic oligonucleotide; TGG chr11 5153212 5153231 5153215 -
tgcccattattcagtatctg

SEQ ID NO: 56627 - DNA, 20 bp, Artificial Sequence
  Synthetic oligonucleotide; CAG chr11 5153204 5153223 5153207 -
attcagtatctgtggtttat

SEQ ID NO: 56628 - DNA, 20 bp, Artificial Sequence
  Synthetic oligonucleotide; AGG chr11 5153203 5153222 5153206 -
ttcagtatctgtggtttatc

SEQ ID NO: 56629 - DNA, 20 bp, Artificial Sequence
  Synthetic oligonucleotide; GAG chr11 5153201 5153220 5153204 -
cagtatctgtggtttatcag

SEQ ID NO: 56630 - DNA, 20 bp, Artificial Sequence
  Synthetic oligonucleotide; AAG chr11 5153197 5153216 5153200 -
atctgtggtttatcaggagc

SEQ ID NO: 56631 - DNA, 20 bp, Artificial Sequence
  Synthetic oligonucleotide; TAG chr11 5153183 5153202 5153186 -
aggagcaagttctcttgccg

SEQ ID NO: 56632 - DNA, 20 bp, Artificial Sequence
  Synthetic oligonucleotide; AGG chr11 5153182 5153201 5153185 -
ggagcaagttctcttgccgt

SEQ ID NO: 56633 - DNA, 20 bp, Artificial Sequence
  Synthetic oligonucleotide; TAG chr11 5153154 5153173 5153157 -
ctgctgctcatcttgtccct

SEQ ID NO: 56634 - DNA, 20 bp, Artificial Sequence
  Synthetic oligonucleotide; CAG chr11 5153151 5153170 5153154 -
ctgctcatcttgtcccttag

SEQ ID NO: 56635 - DNA, 20 bp, Artificial Sequence
  Synthetic oligonucleotide; TAG chr11 5153137 5153156 5153140 -
ccttagcagttccttctctc

SEQ ID NO: 56636 - DNA, 20 bp, Artificial Sequence
  Synthetic oligonucleotide; AAG chr11 5153124 5153143 5153127 -
ttctctctagatattccata

SEQ ID NO: 56637 - DNA, 20 bp, Artificial Sequence
  Synthetic oligonucleotide; AAG chr11 5153091 5153110 5153094 -
ttttaaactcacaacatttc

SEQ ID NO: 56638 - DNA, 20 bp, Artificial Sequence
  Synthetic oligonucleotide; GAG chr11 5153089 5153108 5153092 -
ttaaactcacaacatttcaa

SEQ ID NO: 56639 - DNA, 20 bp, Artificial Sequence
  Synthetic oligonucleotide; CAG chr11 5153083 5153102 5153086 -
tcacaacatttcaagagttt

SEQ ID NO: 56640 - DNA, 20 bp, Artificial Sequence
  Synthetic oligonucleotide; TAG chr11 5153066 5153085 5153069 -
tttcagctgtttaaaatata

SEQ ID NO: 56641 - DNA, 20 bp, Artificial Sequence
  Synthetic oligonucleotide; AGG chr11 5153065 5153084 5153068 -
ttcagctgtttaaaatatat

SEQ ID NO: 56642 - DNA, 20 bp, Artificial Sequence
  Synthetic oligonucleotide; AAG chr11 5153036 5153055 5153039 -
tataattccctttaacttta

SEQ ID NO: 56643 - DNA, 20 bp, Artificial Sequence
  Synthetic oligonucleotide; AAG chr11 5153024 5153043 5153027 -
taactttaaagaaatataaa

SEQ ID NO: 56644 - DNA, 20 bp, Artificial Sequence
  Synthetic oligonucleotide; CAG chr11 5153017 5153036 5153020 -
aaagaaatataaaaagcaac

SEQ ID NO: 56645 - DNA, 20 bp, Artificial Sequence
  Synthetic oligonucleotide; AGG chr11 5153016 5153035 5153019 -
aagaaatataaaaagcaacc

SEQ ID NO: 56646 - DNA, 20 bp, Artificial Sequence
  Synthetic oligonucleotide; GAG chr11 5153014 5153033 5153017 -
gaaatataaaaagcaaccag

SEQ ID NO: 56647 - DNA, 20 bp, Artificial Sequence
  Synthetic oligonucleotide; TGG chr11 5153008 5153027 5153011 -
taaaaagcaaccaggagctt

SEQ ID NO: 56648 - DNA, 20 bp, Artificial Sequence
  Synthetic oligonucleotide; CAG chr11 5153003 5153022 5153006 -
agcaaccaggagctttggct

SEQ ID NO: 56649 - DNA, 20 bp, Artificial Sequence
  Synthetic oligonucleotide; AAG chr11 5152991 5153010 5152994 -
ctttggctcagatttgtcaa

SEQ ID NO: 56650 - DNA, 20 bp, Artificial Sequence
  Synthetic oligonucleotide; AAG chr11 5152984 5153003 5152987 -
tcagatttgtcaaaagtata

SEQ ID NO: 56651 - DNA, 20 bp, Artificial Sequence
  Synthetic oligonucleotide; AAG chr11 5152965 5152984 5152968 -
aaagatttcaattatttcta

SEQ ID NO: 56652 - DNA, 20 bp, Artificial Sequence
  Synthetic oligonucleotide; AAG chr11 5152933 5152952 5152936 -
tacattattctgaatataaa

SEQ ID NO: 56653 - DNA, 20 bp, Artificial Sequence
  Synthetic oligonucleotide; TGG chr11 5152914 5152933 5152917 -
aaagaaatatattatgttct

SEQ ID NO: 56654 - DNA, 20 bp, Artificial Sequence
  Synthetic oligonucleotide; GGG chr11 5152913 5152932 5152916 -
aagaaatatattatgttctt

SEQ ID NO: 56655 - DNA, 20 bp, Artificial Sequence
  Synthetic oligonucleotide; TGG chr11 5152878 5152897 5152881 -
ctacctctattctctttcat

SEQ ID NO: 56656 - DNA, 20 bp, Artificial Sequence
  Synthetic oligonucleotide; GGG chr11 5152877 5152896 5152880 -
tacctctattctctttcatt

SEQ ID NO: 56657 - DNA, 20 bp, Artificial Sequence
  Synthetic oligonucleotide; TGG chr11 5152854 5152873 5152857 -
aatcttttacaccaatgtac

SEQ ID NO: 56658 - DNA, 20 bp, Artificial Sequence
  Synthetic oligonucleotide; CAG chr11 5152850 5152869 5152853 -
ttttacaccaatgtactggt

SEQ ID NO: 56659 - DNA, 20 bp, Artificial Sequence
  Synthetic oligonucleotide; GAG chr11 5152848 5152867 5152851 -
ttacaccaatgtactggtca

SEQ ID NO: 56660 - DNA, 20 bp, Artificial Sequence
  Synthetic oligonucleotide; AAG chr11 5152814 5152833 5152817 -
gcttgtctaaaatgttctta

SEQ ID NO: 56661 - DNA, 20 bp, Artificial Sequence
  Synthetic oligonucleotide; TGG chr11 5152806 5152825 5152809 -
aaaatgttcttaaagaaaat

SEQ ID NO: 56662 - DNA, 20 bp, Artificial Sequence
  Synthetic oligonucleotide; TAG chr11 5152800 5152819 5152803 -
ttcttaaagaaaattggaaa

SEQ ID NO: 56663 - DNA, 20 bp, Artificial Sequence
  Synthetic oligonucleotide; TAG chr11 5152789 5152808 5152792 -
aattggaaatagttaaatac

SEQ ID NO: 56664 - DNA, 20 bp, Artificial Sequence
  Synthetic oligonucleotide; GAG chr11 5152787 5152806 5152790 -
ttggaaatagttaaatacta

SEQ ID NO: 56665 - DNA, 20 bp, Artificial Sequence
  Synthetic oligonucleotide; AGG chr11 5152786 5152805 5152789 -
tggaaatagttaaatactag

SEQ ID NO: 56666 - DNA, 20 bp, Artificial Sequence
  Synthetic oligonucleotide; TAG chr11 5152781 5152800 5152784 -
atagttaaatactagaggaa

SEQ ID NO: 56667 - DNA, 20 bp, Artificial Sequence
  Synthetic oligonucleotide; TGG chr11 5152763 5152782 5152766 -
aatagctgaaatgtgaaata

SEQ ID NO: 56668 - DNA, 20 bp, Artificial Sequence
  Synthetic oligonucleotide; GAG chr11 5152761 5152780 5152764 -
tagctgaaatgtgaaatatg

SEQ ID NO: 56669 - DNA, 20 bp, Artificial Sequence
  Synthetic oligonucleotide; GAG chr11 5152759 5152778 5152762 -
gctgaaatgtgaaatatgga

SEQ ID NO: 56670 - DNA, 20 bp, Artificial Sequence
  Synthetic oligonucleotide; AGG chr11 5152758 5152777 5152761 -
ctgaaatgtgaaatatggag

SEQ ID NO: 56671 - DNA, 20 bp, Artificial Sequence
  Synthetic oligonucleotide; CAG chr11 5152694 5152713 5152697 -
cttctttttttttttgtcca

SEQ ID NO: 56672 - DNA, 20 bp, Artificial Sequence
  Synthetic oligonucleotide; AGG chr11 5152693 5152712 5152696 -
ttctttttttttttgtccac

SEQ ID NO: 56673 - DNA, 20 bp, Artificial Sequence
  Synthetic oligonucleotide; TGG chr11 5152688 5152707 5152691 -
tttttttttgtccacaggtc

SEQ ID NO: 56674 - DNA, 20 bp, Artificial Sequence
  Synthetic oligonucleotide; AAG chr11 5152684 5152703 5152687 -
tttttgtccacaggtctgga

SEQ ID NO: 56675 - DNA, 20 bp, Artificial Sequence
  Synthetic oligonucleotide; CAG chr11 5152675 5152694 5152678 -
acaggtctggaaagaaataa

SEQ ID NO: 56676 - DNA, 20 bp, Artificial Sequence
  Synthetic oligonucleotide; TGG chr11 5152670 5152689 5152673 -
tctggaaagaaataacagac

SEQ ID NO: 56677 - DNA, 20 bp, Artificial Sequence
  Synthetic oligonucleotide; CAG chr11 5152666 5152685 5152669 -
gaaagaaataacagactggc

SEQ ID NO: 56678 - DNA, 20 bp, Artificial Sequence
  Synthetic oligonucleotide; TAG chr11 5152663 5152682 5152666 -
agaaataacagactggccag

SEQ ID NO: 56679 - DNA, 20 bp, Artificial Sequence
  Synthetic oligonucleotide; CAG chr11 5152646 5152665 5152649 -
cagtagtccaatcccctgtc

SEQ ID NO: 56680 - DNA, 20 bp, Artificial Sequence
  Synthetic oligonucleotide; AGG chr11 5152645 5152664 5152648 -
agtagtccaatcccctgtcc

SEQ ID NO: 56681 - DNA, 20 bp, Artificial Sequence
  Synthetic oligonucleotide; TGG chr11 5152633 5152652 5152636 -
ccctgtccaggtgattttgc

SEQ ID NO: 56682 - DNA, 20 bp, Artificial Sequence
  Synthetic oligonucleotide; TGG chr11 5152618 5152637 5152621 -
tttgctggttctaatgtatt

SEQ ID NO: 56683 - DNA, 20 bp, Artificial Sequence
  Synthetic oligonucleotide; TGG chr11 5152589 5152608 5152592 -
atgcacataacatcctatta

SEQ ID NO: 56684 - DNA, 20 bp, Artificial Sequence
  Synthetic oligonucleotide; CAG chr11 5152584 5152603 5152587 -
cataacatcctattatggca

SEQ ID NO: 56685 - DNA, 20 bp, Artificial Sequence
  Synthetic oligonucleotide; CAG chr11 5152556 5152575 5152559 -
gtgaatgccccacctgaaaa

SEQ ID NO: 56686 - DNA, 20 bp, Artificial Sequence
  Synthetic oligonucleotide; AAG chr11 5152508 5152527 5152511 -
ttcctttcaaaactgtgaat

SEQ ID NO: 56687 - DNA, 20 bp, Artificial Sequence
  Synthetic oligonucleotide; TGG chr11 5152504 5152523 5152507 -
tttcaaaactgtgaataaga

SEQ ID NO: 56688 - DNA, 20 bp, Artificial Sequence
  Synthetic oligonucleotide; TAG chr11 5152494 5152513 5152497 -
gtgaataagatggatgattt

SEQ ID NO: 56689 - DNA, 20 bp, Artificial Sequence
  Synthetic oligonucleotide; GAG chr11 5152492 5152511 5152495 -
gaataagatggatgatttta

SEQ ID NO: 56690 - DNA, 20 bp, Artificial Sequence
  Synthetic oligonucleotide; CAG chr11 5152477 5152496 5152480 -
ttttagagttatacccaaat

SEQ ID NO: 56691 - DNA, 20 bp, Artificial Sequence
  Synthetic oligonucleotide; CAG chr11 5152473 5152492 5152476 -
agagttatacccaaatcaga

SEQ ID NO: 56692 - DNA, 20 bp, Artificial Sequence
  Synthetic oligonucleotide; GAG chr11 5152458 5152477 5152461 -
tcagacagactcaatataat

SEQ ID NO: 56693 - DNA, 20 bp, Artificial Sequence
  Synthetic oligonucleotide; TGG chr11 5152453 5152472 5152456 -
cagactcaatataatgagtt

SEQ ID NO: 56694 - DNA, 20 bp, Artificial Sequence
  Synthetic oligonucleotide; GAG chr11 5152451 5152470 5152454 -
gactcaatataatgagtttg

SEQ ID NO: 56695 - DNA, 20 bp, Artificial Sequence
  Synthetic oligonucleotide; CAG chr11 5152443 5152462 5152446 -
ataatgagtttggagaaaat

SEQ ID NO: 56696 - DNA, 20 bp, Artificial Sequence
  Synthetic oligonucleotide; AAG chr11 5152439 5152458 5152442 -
tgagtttggagaaaatcaga

SEQ ID NO: 56697 - DNA, 20 bp, Artificial Sequence
  Synthetic oligonucleotide; CAG chr11 5152436 5152455 5152439 -
gtttggagaaaatcagaaag

SEQ ID NO: 56698 - DNA, 20 bp, Artificial Sequence
  Synthetic oligonucleotide; AAG chr11 5152433 5152452 5152436 -
tggagaaaatcagaaagcag

SEQ ID NO: 56699 - DNA, 20 bp, Artificial Sequence
  Synthetic oligonucleotide; GAG chr11 5152431 5152450 5152434 -
gagaaaatcagaaagcagaa

SEQ ID NO: 56700 - DNA, 20 bp, Artificial Sequence
  Synthetic oligonucleotide; AGG chr11 5152430 5152449 5152433 -
agaaaatcagaaagcagaag

SEQ ID NO: 56701 - DNA, 20 bp, Artificial Sequence
  Synthetic oligonucleotide; CAG chr11 5152425 5152444 5152428 -
atcagaaagcagaagaggaa

SEQ ID NO: 56702 - DNA, 20 bp, Artificial Sequence
  Synthetic oligonucleotide; GAG chr11 5152411 5152430 5152414 -
gaggaacagtaacactgact

SEQ ID NO: 56703 - DNA, 20 bp, Artificial Sequence
  Synthetic oligonucleotide; CAG chr11 5152389 5152408 5152392 -
gaaacttcttttgtttgcat

SEQ ID NO: 56704 - DNA, 20 bp, Artificial Sequence
  Synthetic oligonucleotide; AGG chr11 5152388 5152407 5152391 -
aaacttcttttgtttgcatc

SEQ ID NO: 56705 - DNA, 20 bp, Artificial Sequence
  Synthetic oligonucleotide; GAG chr11 5152386 5152405 5152389 -
acttcttttgtttgcatcag

SEQ ID NO: 56706 - DNA, 20 bp, Artificial Sequence
  Synthetic oligonucleotide; CAG chr11 5152351 5152370 5152354 -
tatgtccatttccaacatca

SEQ ID NO: 56707 - DNA, 20 bp, Artificial Sequence
  Synthetic oligonucleotide; TAG chr11 5152324 5152343 5152327 -
catgccctctgtgttgacac

SEQ ID NO: 56708 - DNA, 20 bp, Artificial Sequence
  Synthetic oligonucleotide; TAG chr11 5152321 5152340 5152324 -
gccctctgtgttgacactag

SEQ ID NO: 56709 - DNA, 20 bp, Artificial Sequence
  Synthetic oligonucleotide; AGG chr11 5152320 5152339 5152323 -
ccctctgtgttgacactagt

SEQ ID NO: 56710 - DNA, 20 bp, Artificial Sequence
  Synthetic oligonucleotide; GGG chr11 5152319 5152338 5152322 -
cctctgtgttgacactagta

SEQ ID NO: 56711 - DNA, 20 bp, Artificial Sequence
  Synthetic oligonucleotide; CAG chr11 5152312 5152331 5152315 -
gttgacactagtagggatcc

SEQ ID NO: 56712 - DNA, 20 bp, Artificial Sequence
  Synthetic oligonucleotide; AGG chr11 5152311 5152330 5152314 -
ttgacactagtagggatccc

SEQ ID NO: 56713 - DNA, 20 bp, Artificial Sequence
  Synthetic oligonucleotide; TAG chr11 5152306 5152325 5152309 -
actagtagggatcccaggcc

SEQ ID NO: 56714 - DNA, 20 bp, Artificial Sequence
  Synthetic oligonucleotide; CAG chr11 5152295 5152314 5152298 -
tcccaggcctagaatctgtg

SEQ ID NO: 56715 - DNA, 20 bp, Artificial Sequence
  Synthetic oligonucleotide; TGG chr11 5152289 5152308 5152292 -
gcctagaatctgtgcagtgc

SEQ ID NO: 56716 - DNA, 20 bp, Artificial Sequence
  Synthetic oligonucleotide; TGG chr11 5152284 5152303 5152287 -
gaatctgtgcagtgctggat

SEQ ID NO: 56717 - DNA, 20 bp, Artificial Sequence
  Synthetic oligonucleotide; GGG chr11 5152283 5152302 5152286 -
aatctgtgcagtgctggatt

SEQ ID NO: 56718 - DNA, 20 bp, Artificial Sequence
  Synthetic oligonucleotide; TGG chr11 5152245 5152264 5152248 -
atttatctcattgctatgat

SEQ ID NO: 56719 - DNA, 20 bp, Artificial Sequence
  Synthetic oligonucleotide; GAG chr11 5152227 5152246 5152230 -
attggaaattccttgcttct

SEQ ID NO: 56720 - DNA, 20 bp, Artificial Sequence
  Synthetic oligonucleotide; GAG chr11 5152211 5152230 5152214 -
ttctgagcatcatcaaatct

SEQ ID NO: 56721 - DNA, 20 bp, Artificial Sequence
  Synthetic oligonucleotide; CAG chr11 5152206 5152225 5152209 -
agcatcatcaaatctgagcg

SEQ ID NO: 56722 - DNA, 20 bp, Artificial Sequence
  Synthetic oligonucleotide; GAG chr11 5152196 5152215 5152199 -
aatctgagcgcagtctccat

SEQ ID NO: 56723 - DNA, 20 bp, Artificial Sequence
  Synthetic oligonucleotide; TAG chr11 5152177 5152196 5152180 -
tgagcccttgtacattttct

SEQ ID NO: 56724 - DNA, 20 bp, Artificial Sequence
  Synthetic oligonucleotide; AGG chr11 5152176 5152195 5152179 -
gagcccttgtacattttctt

SEQ ID NO: 56725 - DNA, 20 bp, Artificial Sequence
  Synthetic oligonucleotide; TAG chr11 5152168 5152187 5152171 -
gtacattttcttaggcatgc

SEQ ID NO: 56726 - DNA, 20 bp, Artificial Sequence
  Synthetic oligonucleotide; AGG chr11 5152167 5152186 5152170 -
tacattttcttaggcatgct

SEQ ID NO: 56727 - DNA, 20 bp, Artificial Sequence
  Synthetic oligonucleotide; GAG chr11 5152165 5152184 5152168 -
cattttcttaggcatgctag

SEQ ID NO: 56728 - DNA, 20 bp, Artificial Sequence
  Synthetic oligonucleotide; CAG chr11 5152159 5152178 5152162 -
cttaggcatgctaggagcca

SEQ ID NO: 56729 - DNA, 20 bp, Artificial Sequence
  Synthetic oligonucleotide; TAG chr11 5152143 5152162 5152146 -
gccacagacattgcacttgc

SEQ ID NO: 56730 - DNA, 20 bp, Artificial Sequence
  Synthetic oligonucleotide; CAG chr11 5152140 5152159 5152143 -
acagacattgcacttgctag

SEQ ID NO: 56731 - DNA, 20 bp, Artificial Sequence
  Synthetic oligonucleotide; AAG chr11 5152127 5152146 5152130 -
ttgctagcagcattatgcca

SEQ ID NO: 56732 - DNA, 20 bp, Artificial Sequence
  Synthetic oligonucleotide; TGG chr11 5152119 5152138 5152122 -
agcattatgccaaagatgct

SEQ ID NO: 56733 - DNA, 20 bp, Artificial Sequence
  Synthetic oligonucleotide; TGG chr11 5152109 5152128 5152112 -
caaagatgcttggaatattc

SEQ ID NO: 56734 - DNA, 20 bp, Artificial Sequence
  Synthetic oligonucleotide; TGG chr11 5152061 5152080 5152064 -
attcctgcttgcttcaaatg

SEQ ID NO: 56735 - DNA, 20 bp, Artificial Sequence
  Synthetic oligonucleotide; CAG chr11 5152043 5152062 5152046 -
tgtggttcatccacacattg

SEQ ID NO: 56736 - DNA, 20 bp, Artificial Sequence
  Synthetic oligonucleotide; AGG chr11 5152042 5152061 5152045 -
gtggttcatccacacattgc

SEQ ID NO: 56737 - DNA, 20 bp, Artificial Sequence
  Synthetic oligonucleotide; GGG chr11 5152041 5152060 5152044 -
tggttcatccacacattgca

SEQ ID NO: 56738 - DNA, 20 bp, Artificial Sequence
  Synthetic oligonucleotide; TAG chr11 5152036 5152055 5152039 -
catccacacattgcagggta

SEQ ID NO: 56739 - DNA, 20 bp, Artificial Sequence
  Synthetic oligonucleotide; GAG chr11 5152034 5152053 5152037 -
tccacacattgcagggtata

SEQ ID NO: 56740 - DNA, 20 bp, Artificial Sequence
  Synthetic oligonucleotide; CAG chr11 5152030 5152049 5152033 -
cacattgcagggtatagagt

SEQ ID NO: 56741 - DNA, 20 bp, Artificial Sequence
  Synthetic oligonucleotide; AGG chr11 5152029 5152048 5152032 -
acattgcagggtatagagtc

SEQ ID NO: 56742 - DNA, 20 bp, Artificial Sequence
  Synthetic oligonucleotide; TGG chr11 5152018 5152037 5152021 -
tatagagtcaggcatccttg

SEQ ID NO: 56743 - DNA, 20 bp, Artificial Sequence
  Synthetic oligonucleotide; TGG chr11 5152012 5152031 5152015 -
gtcaggcatccttgtggcca

SEQ ID NO: 56744 - DNA, 20 bp, Artificial Sequence
  Synthetic oligonucleotide; TGG chr11 5152006 5152025 5152009 -
catccttgtggccatggccc

SEQ ID NO: 56745 - DNA, 20 bp, Artificial Sequence
  Synthetic oligonucleotide; TGG chr11 5151994 5152013 5151997 -
catggccctggaccgttatg

SEQ ID NO: 56746 - DNA, 20 bp, Artificial Sequence
  Synthetic oligonucleotide; AAG chr11 5151975 5151994 5151978 -
gtggccatctgttatccact

SEQ ID NO: 56747 - DNA, 20 bp, Artificial Sequence
  Synthetic oligonucleotide; CAG chr11 5151950 5151969 5151953 -
atgccaacatcttcacccac

SEQ ID NO: 56748 - DNA, 20 bp, Artificial Sequence
  Synthetic oligonucleotide; CAG chr11 5151938 5151957 5151941 -
tcacccaccagcttgtcatt

SEQ ID NO: 56749 - DNA, 20 bp, Artificial Sequence
  Synthetic oligonucleotide; TAG chr11 5151934 5151953 5151937 -
ccaccagcttgtcattcaga

SEQ ID NO: 56750 - DNA, 20 bp, Artificial Sequence
  Synthetic oligonucleotide; AGG chr11 5151933 5151952 5151936 -
caccagcttgtcattcagat

SEQ ID NO: 56751 - DNA, 20 bp, Artificial Sequence
  Synthetic oligonucleotide; TGG chr11 5151925 5151944 5151928 -
tgtcattcagataggaacta

SEQ ID NO: 56752 - DNA, 20 bp, Artificial Sequence
  Synthetic oligonucleotide; CAG chr11 5151915 5151934 5151918 -
ataggaactatggtcgtact

SEQ ID NO: 56753 - DNA, 20 bp, Artificial Sequence
  Synthetic oligonucleotide; AGG chr11 5151914 5151933 5151917 -
taggaactatggtcgtactc

SEQ ID NO: 56754 - DNA, 20 bp, Artificial Sequence
  Synthetic oligonucleotide; GGG chr11 5151913 5151932 5151916 -
aggaactatggtcgtactca

SEQ ID NO: 56755 - DNA, 20 bp, Artificial Sequence
  Synthetic oligonucleotide; TAG chr11 5151898 5151917 5151901 -
actcagggctgctattcttg

SEQ ID NO: 56756 - DNA, 20 bp, Artificial Sequence
  Synthetic oligonucleotide; TAG chr11 5151886 5151905 5151889 -
tattcttgtagccccatgcc

SEQ ID NO: 56757 - DNA, 20 bp, Artificial Sequence
  Synthetic oligonucleotide; AAG chr11 5151875 5151894 5151878 -
ccccatgcctagtactgata

SEQ ID NO: 56758 - DNA, 20 bp, Artificial Sequence
  Synthetic oligonucleotide; CGG chr11 5151869 5151888 5151872 -
gcctagtactgataaagtgc

SEQ ID NO: 56759 - DNA, 20 bp, Artificial Sequence
  Synthetic oligonucleotide; CAG chr11 5151847 5151866 5151850 -
gtttcaattttatcacacaa

SEQ ID NO: 56760 - DNA, 20 bp, Artificial Sequence
  Synthetic oligonucleotide; GAG chr11 5151824 5151843 5151827 -
tcatctcccactcctactgt

SEQ ID NO: 56761 - DNA, 20 bp, Artificial Sequence
  Synthetic oligonucleotide; TGG chr11 5151817 5151836 5151820 -
ccactcctactgtgagcata

SEQ ID NO: 56762 - DNA, 20 bp, Artificial Sequence
  Synthetic oligonucleotide; TAG chr11 5151802 5151821 5151805 -
gcatatggccattgtgaaac

SEQ ID NO: 56763 - DNA, 20 bp, Artificial Sequence
  Synthetic oligonucleotide; CAG chr11 5151799 5151818 5151802 -
tatggccattgtgaaactag

SEQ ID NO: 56764 - DNA, 20 bp, Artificial Sequence
  Synthetic oligonucleotide; CAG chr11 5151796 5151815 5151799 -
ggccattgtgaaactagcag

SEQ ID NO: 56765 - DNA, 20 bp, Artificial Sequence
  Synthetic oligonucleotide; AAG chr11 5151784 5151803 5151787 -
actagcagcagcaaatgttc

SEQ ID NO: 56766 - DNA, 20 bp, Artificial Sequence
  Synthetic oligonucleotide; TGG chr11 5151768 5151787 5151771 -
gttcaagtcaacaaaatcta

SEQ ID NO: 56767 - DNA, 20 bp, Artificial Sequence
  Synthetic oligonucleotide; TGG chr11 5151757 5151776 5151760 -
caaaatctatggtttgtttg

SEQ ID NO: 56768 - DNA, 20 bp, Artificial Sequence
  Synthetic oligonucleotide; TAG chr11 5151745 5151764 5151748 -
tttgtttgtggccttcactg

SEQ ID NO: 56769 - DNA, 20 bp, Artificial Sequence
  Synthetic oligonucleotide; CAG chr11 5151742 5151761 5151745 -
gtttgtggccttcactgtag

SEQ ID NO: 56770 - DNA, 20 bp, Artificial Sequence
  Synthetic oligonucleotide; AGG chr11 5151741 5151760 5151744 -
tttgtggccttcactgtagc

SEQ ID NO: 56771 - DNA, 20 bp, Artificial Sequence
  Synthetic oligonucleotide; CAG chr11 5151704 5151723 5151707 -
tcatcacattgtcctacatc

SEQ ID NO: 56772 - DNA, 20 bp, Artificial Sequence
  Synthetic oligonucleotide; CAG chr11 5151691 5151710 5151694 -
ctacatccagatatttatca

SEQ ID NO: 56773 - DNA, 20 bp, Artificial Sequence
  Synthetic oligonucleotide; CAG chr11 5151674 5151693 5151677 -
tcacagtttttcgtttgccc

SEQ ID NO: 56774 - DNA, 20 bp, Artificial Sequence
  Synthetic oligonucleotide; AAG chr11 5151671 5151690 5151674 -
cagtttttcgtttgccccag

SEQ ID NO: 56775 - DNA, 20 bp, Artificial Sequence
  Synthetic oligonucleotide; AGG chr11 5151670 5151689 5151673 -
agtttttcgtttgccccaga

SEQ ID NO: 56776 - DNA, 20 bp, Artificial Sequence
  Synthetic oligonucleotide; GAG chr11 5151668 5151687 5151671 -
tttttcgtttgccccagaag

SEQ ID NO: 56777 - DNA, 20 bp, Artificial Sequence
  Synthetic oligonucleotide; AGG chr11 5151667 5151686 5151670 -
ttttcgtttgccccagaagg

SEQ ID NO: 56778 - DNA, 20 bp, Artificial Sequence
  Synthetic oligonucleotide; TAG chr11 5151663 5151682 5151666 -
cgtttgccccagaaggaggc

SEQ ID NO: 56779 - DNA, 20 bp, Artificial Sequence
  Synthetic oligonucleotide; AGG chr11 5151662 5151681 5151665 -
gtttgccccagaaggaggct

SEQ ID NO: 56780 - DNA, 20 bp, Artificial Sequence
  Synthetic oligonucleotide; AAG chr11 5151655 5151674 5151658 -
ccagaaggaggctaggttta

SEQ ID NO: 56781 - DNA, 20 bp, Artificial Sequence
  Synthetic oligonucleotide; CAG chr11 5151614 5151633 5151617 -
ctcacatctgtgtcttcctc

SEQ ID NO: 56782 - DNA, 20 bp, Artificial Sequence
  Synthetic oligonucleotide; TAG chr11 5151576 5151595 5151579 -
ttcttctccttcttcacaca

SEQ ID NO: 56783 - DNA, 20 bp, Artificial Sequence
  Synthetic oligonucleotide; AGG chr11 5151575 5151594 5151578 -
tcttctccttcttcacacat

SEQ ID NO: 56784 - DNA, 20 bp, Artificial Sequence
  Synthetic oligonucleotide; TGG chr11 5151570 5151589 5151573 -
tccttcttcacacataggtt

SEQ ID NO: 56785 - DNA, 20 bp, Artificial Sequence
  Synthetic oligonucleotide; GGG chr11 5151569 5151588 5151572 -
ccttcttcacacataggttt

SEQ ID NO: 56786 - DNA, 20 bp, Artificial Sequence
  Synthetic oligonucleotide; TAG chr11 5151531 5151550 5151534 -
tatatccatattctcttttc

SEQ ID NO: 56787 - DNA, 20 bp, Artificial Sequence
  Synthetic oligonucleotide; TGG chr11 5151517 5151536 5151520 -
cttttctagcatttacttgc

SEQ ID NO: 56788 - DNA, 20 bp, Artificial Sequence
  Synthetic oligonucleotide; TGG chr11 5151486 5151505 5151489 -
tttctcaatccacttgtcta

SEQ ID NO: 56789 - DNA, 20 bp, Artificial Sequence
  Synthetic oligonucleotide; AAG chr11 5151479 5151498 5151482 -
atccacttgtctatggtgca

SEQ ID NO: 56790 - DNA, 20 bp, Artificial Sequence
  Synthetic oligonucleotide; CAG chr11 5151470 5151489 5151473 -
tctatggtgcaaagaccaca

SEQ ID NO: 56791 - DNA, 20 bp, Artificial Sequence
  Synthetic oligonucleotide; TGG chr11 5151454 5151473 5151457 -
cacacagattcgcattcatg

SEQ ID NO: 56792 - DNA, 20 bp, Artificial Sequence
  Synthetic oligonucleotide; CAG chr11 5151392 5151411 5151395 -
ctacatgcttttttcttttg

SEQ ID NO: 56793 - DNA, 20 bp, Artificial Sequence
  Synthetic oligonucleotide; TAG chr11 5151389 5151408 5151392 -
catgcttttttcttttgcag

SEQ ID NO: 56794 - DNA, 20 bp, Artificial Sequence
  Synthetic oligonucleotide; GAG chr11 5151350 5151369 5151353 -
aaacaaaaaacatattattt

SEQ ID NO: 56795 - DNA, 20 bp, Artificial Sequence
  Synthetic oligonucleotide; TGG chr11 5151343 5151362 5151346 -
aaacatattatttgagatgc

SEQ ID NO: 56796 - DNA, 20 bp, Artificial Sequence
  Synthetic oligonucleotide; GGG chr11 5151342 5151361 5151345 -
aacatattatttgagatgct

SEQ ID NO: 56797 - DNA, 20 bp, Artificial Sequence
  Synthetic oligonucleotide; CAG chr11 5151325 5151344 5151328 -
gctgggtttgtgaaatctgc

SEQ ID NO: 56798 - DNA, 20 bp, Artificial Sequence
  Synthetic oligonucleotide; TAG chr11 5151317 5151336 5151320 -
tgtgaaatctgccagcacaa

SEQ ID NO: 56799 - DNA, 20 bp, Artificial Sequence
  Synthetic oligonucleotide; TGG chr11 5151313 5151332 5151316 -
aaatctgccagcacaatagc

SEQ ID NO: 56800 - DNA, 20 bp, Artificial Sequence
  Synthetic oligonucleotide; TAG chr11 5151307 5151326 5151310 -
gccagcacaatagctggttt

SEQ ID NO: 56801 - DNA, 20 bp, Artificial Sequence
  Synthetic oligonucleotide; TGG chr11 5151297 5151316 5151300 -
tagctggttttagatcatca

SEQ ID NO: 56802 - DNA, 20 bp, Artificial Sequence
  Synthetic oligonucleotide; CAG chr11 5151283 5151302 5151286 -
tcatcatggctcatatcaat

SEQ ID NO: 56803 - DNA, 20 bp, Artificial Sequence
  Synthetic oligonucleotide; TGG chr11 5151280 5151299 5151283 -
tcatggctcatatcaatcag

SEQ ID NO: 56804 - DNA, 20 bp, Artificial Sequence
  Synthetic oligonucleotide; GGG chr11 5151279 5151298 5151282 -
catggctcatatcaatcagt

SEQ ID NO: 56805 - DNA, 20 bp, Artificial Sequence
  Synthetic oligonucleotide; AAG chr11 5151251 5151270 5151254 -
gaattctacgtgactaatga

SEQ ID NO: 56806 - DNA, 20 bp, Artificial Sequence
  Synthetic oligonucleotide; GAG chr11 5151247 5151266 5151250 -
tctacgtgactaatgaaagt

SEQ ID NO: 56807 - DNA, 20 bp, Artificial Sequence
  Synthetic oligonucleotide; AAG chr11 5151244 5151263 5151247 -
acgtgactaatgaaagtgag

SEQ ID NO: 56808 - DNA, 20 bp, Artificial Sequence
  Synthetic oligonucleotide; GAG chr11 5151233 5151252 5151236 -
gaaagtgagaagtgtgaaat

SEQ ID NO: 56809 - DNA, 20 bp, Artificial Sequence
  Synthetic oligonucleotide; AAG chr11 5151228 5151247 5151231 -
tgagaagtgtgaaatgagtg

SEQ ID NO: 56810 - DNA, 20 bp, Artificial Sequence
  Synthetic oligonucleotide; TAG chr11 5151225 5151244 5151228 -
gaagtgtgaaatgagtgaag

SEQ ID NO: 56811 - DNA, 20 bp, Artificial Sequence
  Synthetic oligonucleotide; TAG chr11 5151190 5151209 5151193 -
attttttctcttttattctt

SEQ ID NO: 56812 - DNA, 20 bp, Artificial Sequence
  Synthetic oligonucleotide; TGG chr11 5151183 5151202 5151186 -
ctcttttattctttagcccc

SEQ ID NO: 56813 - DNA, 20 bp, Artificial Sequence
  Synthetic oligonucleotide; GAG chr11 5151178 5151197 5151181 -
ttattctttagcccctggtt

SEQ ID NO: 56814 - DNA, 20 bp, Artificial Sequence
  Synthetic oligonucleotide; AAG chr11 5151165 5151184 5151168 -
cctggttgagttattcttct

SEQ ID NO: 56815 - DNA, 20 bp, Artificial Sequence
  Synthetic oligonucleotide; CAG chr11 5151152 5151171 5151155 -
ttcttctaagaatatttctc

SEQ ID NO: 56816 - DNA, 20 bp, Artificial Sequence
  Synthetic oligonucleotide; AGG chr11 5151151 5151170 5151154 -
tcttctaagaatatttctcc

SEQ ID NO: 56817 - DNA, 20 bp, Artificial Sequence
  Synthetic oligonucleotide; GAG chr11 5151149 5151168 5151152 -
ttctaagaatatttctccag

SEQ ID NO: 56818 - DNA, 20 bp, Artificial Sequence
  Synthetic oligonucleotide; AGG chr11 5151148 5151167 5151151 -
tctaagaatatttctccagg

SEQ ID NO: 56819 - DNA, 20 bp, Artificial Sequence
  Synthetic oligonucleotide; AAG chr11 5151104 5151123 5151107 -
cactgaatttaaatgcacct

SEQ ID NO: 56820 - DNA, 20 bp, Artificial Sequence
  Synthetic oligonucleotide; AGG chr11 5151103 5151122 5151106 -
actgaatttaaatgcaccta

SEQ ID NO: 56821 - DNA, 20 bp, Artificial Sequence
  Synthetic oligonucleotide; CAG chr11 5151081 5151100 5151084 -
gctcgttgttctgaaacatc

SEQ ID NO: 56822 - DNA, 20 bp, Artificial Sequence
  Synthetic oligonucleotide; AGG chr11 5151080 5151099 5151083 -
ctcgttgttctgaaacatcc

SEQ ID NO: 56823 - DNA, 20 bp, Artificial Sequence
  Synthetic oligonucleotide; GGG chr11 5151079 5151098 5151082 -
tcgttgttctgaaacatcca

SEQ ID NO: 56824 - DNA, 20 bp, Artificial Sequence
  Synthetic oligonucleotide; AAG chr11 5151063 5151082 5151066 -
tccagggactcaatgaaaac

SEQ ID NO: 56825 - DNA, 20 bp, Artificial Sequence
  Synthetic oligonucleotide; AAG chr11 5151011 5151030 5151014 -
tgccttaaaaaaaaaaatca

SEQ ID NO: 56826 - DNA, 20 bp, Artificial Sequence
  Synthetic oligonucleotide; AGG chr11 5151010 5151029 5151013 -
gccttaaaaaaaaaaatcaa

SEQ ID NO: 56827 - DNA, 20 bp, Artificial Sequence
  Synthetic oligonucleotide; AAG chr11 5151007 5151026 5151010 -
ttaaaaaaaaaaatcaaagg

SEQ ID NO: 56828 - DNA, 20 bp, Artificial Sequence
  Synthetic oligonucleotide; AAG chr11 5150980 5150999 5150983 -
tgttaactgtgttcttgtca

SEQ ID NO: 56829 - DNA, 20 bp, Artificial Sequence
  Synthetic oligonucleotide; AAG chr11 5150960 5150979 5150963 -
aagaaaatcttatgaatatc

SEQ ID NO: 56830 - DNA, 20 bp, Artificial Sequence
  Synthetic oligonucleotide; GAG chr11 5150958 5150977 5150961 -
gaaaatcttatgaatatcaa

SEQ ID NO: 56831 - DNA, 20 bp, Artificial Sequence
  Synthetic oligonucleotide; AAG chr11 5150949 5150968 5150952 -
atgaatatcaagagacaata

SEQ ID NO: 56832 - DNA, 20 bp, Artificial Sequence
  Synthetic oligonucleotide; CAG chr11 5150924 5150943 5150927 -
taaaaatttaaatacatttt

SEQ ID NO: 56833 - DNA, 20 bp, Artificial Sequence
  Synthetic oligonucleotide; GAG chr11 5150922 5150941 5150925 -
aaaatttaaatacattttca

SEQ ID NO: 56834 - DNA, 20 bp, Artificial Sequence
  Synthetic oligonucleotide; AAG chr11 5150913 5150932 5150916 -
atacattttcagagtcatac

SEQ ID NO: 56835 - DNA, 20 bp, Artificial Sequence
  Synthetic oligonucleotide; AGG chr11 5150912 5150931 5150915 -
tacattttcagagtcataca

SEQ ID NO: 56836 - DNA, 20 bp, Artificial Sequence
  Synthetic oligonucleotide; CAG chr11 5150904 5150923 5150907 -
cagagtcatacaaggaatta

SEQ ID NO: 56837 - DNA, 20 bp, Artificial Sequence
  Synthetic oligonucleotide; AGG chr11 5150903 5150922 5150906 -
agagtcatacaaggaattac

SEQ ID NO: 56838 - DNA, 20 bp, Artificial Sequence
  Synthetic oligonucleotide; TAG chr11 5150891 5150910 5150894 -
ggaattacaggcacaaaaat

SEQ ID NO: 56839 - DNA, 20 bp, Artificial Sequence
  Synthetic oligonucleotide; CAG chr11 5150885 5150904 5150888 -
acaggcacaaaaattagaac

SEQ ID NO: 56840 - DNA, 20 bp, Artificial Sequence
  Synthetic oligonucleotide; AGG chr11 5150884 5150903 5150887 -
caggcacaaaaattagaacc

SEQ ID NO: 56841 - DNA, 20 bp, Artificial Sequence
  Synthetic oligonucleotide; CAG chr11 5150768 5150787 5150771 -
atattaaaaatactatacta

SEQ ID NO: 56842 - DNA, 20 bp, Artificial Sequence
  Synthetic oligonucleotide; TAG chr11 5150752 5150771 5150755 -
actacagaatcgtgacataa

SEQ ID NO: 56843 - DNA, 20 bp, Artificial Sequence
  Synthetic oligonucleotide; TGG chr11 5150743 5150762 5150746 -
tcgtgacataatagtaaatc

SEQ ID NO: 56844 - DNA, 20 bp, Artificial Sequence
  Synthetic oligonucleotide; CAG chr11 5150738 5150757 5150741 -
acataatagtaaatctggca

SEQ ID NO: 56845 - DNA, 20 bp, Artificial Sequence
  Synthetic oligonucleotide; GAG chr11 5150721 5150740 5150724 -
gcacagtgaataattctcat

SEQ ID NO: 56846 - DNA, 20 bp, Artificial Sequence
  Synthetic oligonucleotide; TGG chr11 5150700 5150719 5150703 -
agtttgtacctatgtaattc

SEQ ID NO: 56847 - DNA, 20 bp, Artificial Sequence
  Synthetic oligonucleotide; AAG chr11 5150695 5150714 5150698 -
gtacctatgtaattctggaa

SEQ ID NO: 56848 - DNA, 20 bp, Artificial Sequence
  Synthetic oligonucleotide; GAG chr11 5150693 5150712 5150696 -
acctatgtaattctggaaaa

SEQ ID NO: 56849 - DNA, 20 bp, Artificial Sequence
  Synthetic oligonucleotide; GAG chr11 5150691 5150710 5150694 -
ctatgtaattctggaaaaga

SEQ ID NO: 56850 - DNA, 20 bp, Artificial Sequence
  Synthetic oligonucleotide; AAG chr11 5150683 5150702 5150686 -
ttctggaaaagagagactga

SEQ ID NO: 56851 - DNA, 20 bp, Artificial Sequence
  Synthetic oligonucleotide; AGG chr11 5150682 5150701 5150685 -
tctggaaaagagagactgaa

SEQ ID NO: 56852 - DNA, 20 bp, Artificial Sequence
  Synthetic oligonucleotide; AAG chr11 5150679 5150698 5150682 -
ggaaaagagagactgaaagg

SEQ ID NO: 56853 - DNA, 20 bp, Artificial Sequence
  Synthetic oligonucleotide; GAG chr11 5150677 5150696 5150680 -
aaaagagagactgaaaggaa

SEQ ID NO: 56854 - DNA, 20 bp, Artificial Sequence
  Synthetic oligonucleotide; GAG chr11 5150675 5150694 5150678 -
aagagagactgaaaggaaga

SEQ ID NO: 56855 - DNA, 20 bp, Artificial Sequence
  Synthetic oligonucleotide; AGG chr11 5150674 5150693 5150677 -
agagagactgaaaggaagag

SEQ ID NO: 56856 - DNA, 20 bp, Artificial Sequence
  Synthetic oligonucleotide; TGG chr11 5150671 5150690 5150674 -
gagactgaaaggaagagagg

SEQ ID NO: 56857 - DNA, 20 bp, Artificial Sequence
  Synthetic oligonucleotide; GGG chr11 5150670 5150689 5150673 -
agactgaaaggaagagaggt

SEQ ID NO: 56858 - DNA, 20 bp, Artificial Sequence
  Synthetic oligonucleotide; GGG chr11 5150669 5150688 5150672 -
gactgaaaggaagagaggtg

SEQ ID NO: 56859 - DNA, 20 bp, Artificial Sequence
  Synthetic oligonucleotide; TGG chr11 5150664 5150683 5150667 -
aaaggaagagaggtggggaa

SEQ ID NO: 56860 - DNA, 20 bp, Artificial Sequence
  Synthetic oligonucleotide; GGG chr11 5150663 5150682 5150666 -
aaggaagagaggtggggaat

SEQ ID NO: 56861 - DNA, 20 bp, Artificial Sequence
  Synthetic oligonucleotide; CAG chr11 5150660 5150679 5150663 -
gaagagaggtggggaatggg

SEQ ID NO: 56862 - DNA, 20 bp, Artificial Sequence
  Synthetic oligonucleotide; AGG chr11 5150659 5150678 5150662 -
aagagaggtggggaatgggc

SEQ ID NO: 56863 - DNA, 20 bp, Artificial Sequence
  Synthetic oligonucleotide; AAG chr11 5150655 5150674 5150658 -
gaggtggggaatgggcaggc

SEQ ID NO: 56864 - DNA, 20 bp, Artificial Sequence
  Synthetic oligonucleotide; AGG chr11 5150654 5150673 5150657 -
aggtggggaatgggcaggca

SEQ ID NO: 56865 - DNA, 20 bp, Artificial Sequence
  Synthetic oligonucleotide; GGG chr11 5150653 5150672 5150656 -
ggtggggaatgggcaggcaa

SEQ ID NO: 56866 - DNA, 20 bp, Artificial Sequence
  Synthetic oligonucleotide; AAG chr11 5150649 5150668 5150652 -
gggaatgggcaggcaaggga

SEQ ID NO: 56867 - DNA, 20 bp, Artificial Sequence
  Synthetic oligonucleotide; AAG chr11 5150646 5150665 5150649 -
aatgggcaggcaagggaaag

SEQ ID NO: 56868 - DNA, 20 bp, Artificial Sequence
  Synthetic oligonucleotide; GAG chr11 5150644 5150663 5150647 -
tgggcaggcaagggaaagaa

SEQ ID NO: 56869 - DNA, 20 bp, Artificial Sequence
  Synthetic oligonucleotide; GAG chr11 5150642 5150661 5150645 -
ggcaggcaagggaaagaaga

SEQ ID NO: 56870 - DNA, 20 bp, Artificial Sequence
  Synthetic oligonucleotide; AAG chr11 5150632 5150651 5150635 -
ggaaagaagagagaaataac

SEQ ID NO: 56871 - DNA, 20 bp, Artificial Sequence
  Synthetic oligonucleotide; TAG chr11 5150621 5150640 5150624 -
agaaataacaagtgtacaca

SEQ ID NO: 56872 - DNA, 20 bp, Artificial Sequence
  Synthetic oligonucleotide; AGG chr11 5150620 5150639 5150623 -
gaaataacaagtgtacacat

SEQ ID NO: 56873 - DNA, 20 bp, Artificial Sequence
  Synthetic oligonucleotide; TGG chr11 5150614 5150633 5150617 -
acaagtgtacacataggatg

SEQ ID NO: 56874 - DNA, 20 bp, Artificial Sequence
  Synthetic oligonucleotide; GAG chr11 5150612 5150631 5150615 -
aagtgtacacataggatgtg

SEQ ID NO: 56875 - DNA, 20 bp, Artificial Sequence
  Synthetic oligonucleotide; CAG chr11 5150607 5150626 5150610 -
tacacataggatgtggagtt

SEQ ID NO: 56876 - DNA, 20 bp, Artificial Sequence
  Synthetic oligonucleotide; GAG chr11 5150605 5150624 5150608 -
cacataggatgtggagttca

SEQ ID NO: 56877 - DNA, 20 bp, Artificial Sequence
  Synthetic oligonucleotide; GAG chr11 5150603 5150622 5150606 -
cataggatgtggagttcaga

SEQ ID NO: 56878 - DNA, 20 bp, Artificial Sequence
  Synthetic oligonucleotide; AAG chr11 5150596 5150615 5150599 -
tgtggagttcagagagaatg

SEQ ID NO: 56879 - DNA, 20 bp, Artificial Sequence
  Synthetic oligonucleotide; AAG chr11 5150577 5150596 5150580 -
gaagcattgaaatctaacca

SEQ ID NO: 56880 - DNA, 20 bp, Artificial Sequence
  Synthetic oligonucleotide; CAG chr11 5150574 5150593 5150577 -
gcattgaaatctaaccaaag

SEQ ID NO: 56881 - DNA, 20 bp, Artificial Sequence
  Synthetic oligonucleotide; AGG chr11 5150573 5150592 5150576 -
cattgaaatctaaccaaagc

SEQ ID NO: 56882 - DNA, 20 bp, Artificial Sequence
  Synthetic oligonucleotide; GGG chr11 5150572 5150591 5150575 -
attgaaatctaaccaaagca

SEQ ID NO: 56883 - DNA, 20 bp, Artificial Sequence
  Synthetic oligonucleotide; GGG chr11 5150571 5150590 5150574 -
ttgaaatctaaccaaagcag

SEQ ID NO: 56884 - DNA, 20 bp, Artificial Sequence
  Synthetic oligonucleotide; GAG chr11 5150569 5150588 5150572 -
gaaatctaaccaaagcaggg

SEQ ID NO: 56885 - DNA, 20 bp, Artificial Sequence
  Synthetic oligonucleotide; TGG chr11 5150542 5150561 5150545 -
atttattgtattttgttttt

SEQ ID NO: 56886 - DNA, 20 bp, Artificial Sequence
  Synthetic oligonucleotide; TAG chr11 5150538 5150557 5150541 -
attgtattttgttttttggt

SEQ ID NO: 56887 - DNA, 20 bp, Artificial Sequence
  Synthetic oligonucleotide; AGG chr11 5150537 5150556 5150540 -
ttgtattttgttttttggtt

SEQ ID NO: 56888 - DNA, 20 bp, Artificial Sequence
  Synthetic oligonucleotide; TAG chr11 5150534 5150553 5150537 -
tattttgttttttggttagg

SEQ ID NO: 56889 - DNA, 20 bp, Artificial Sequence
  Synthetic oligonucleotide; GAG chr11 5150516 5150535 5150519 -
ggtagttacctctgattctt

SEQ ID NO: 56890 - DNA, 20 bp, Artificial Sequence
  Synthetic oligonucleotide; AGG chr11 5150515 5150534 5150518 -
gtagttacctctgattcttg

SEQ ID NO: 56891 - DNA, 20 bp, Artificial Sequence
  Synthetic oligonucleotide; TGG chr11 5150507 5150526 5150510 -
ctctgattcttgaggaatga

SEQ ID NO: 56892 - DNA, 20 bp, Artificial Sequence
  Synthetic oligonucleotide; GAG chr11 5150502 5150521 5150505 -
attcttgaggaatgatggat

SEQ ID NO: 56893 - DNA, 20 bp, Artificial Sequence
  Synthetic oligonucleotide; TAG chr11 5150499 5150518 5150502 -
cttgaggaatgatggatgag

SEQ ID NO: 56894 - DNA, 20 bp, Artificial Sequence
  Synthetic oligonucleotide; AAG chr11 5150494 5150513 5150497 -
ggaatgatggatgagtagcc

SEQ ID NO: 56895 - DNA, 20 bp, Artificial Sequence
  Synthetic oligonucleotide; AGG chr11 5150493 5150512 5150496 -
gaatgatggatgagtagcca

SEQ ID NO: 56896 - DNA, 20 bp, Artificial Sequence
  Synthetic oligonucleotide; AAG chr11 5150490 5150509 5150493 -
tgatggatgagtagccaagg

SEQ ID NO: 56897 - DNA, 20 bp, Artificial Sequence
  Synthetic oligonucleotide; AAG chr11 5150486 5150505 5150489 -
ggatgagtagccaaggaagt

SEQ ID NO: 56898 - DNA, 20 bp, Artificial Sequence
  Synthetic oligonucleotide; CAG chr11 5150471 5150490 5150474 -
gaagtaagaacacatcatgc

SEQ ID NO: 56899 - DNA, 20 bp, Artificial Sequence
  Synthetic oligonucleotide; AGG chr11 5150470 5150489 5150473 -
aagtaagaacacatcatgcc

SEQ ID NO: 56900 - DNA, 20 bp, Artificial Sequence
  Synthetic oligonucleotide; TAG chr11 5150467 5150486 5150470 -
taagaacacatcatgccagg

SEQ ID NO: 56901 - DNA, 20 bp, Artificial Sequence
  Synthetic oligonucleotide; TAG chr11 5150463 5150482 5150466 -
aacacatcatgccaggtaga

SEQ ID NO: 56902 - DNA, 20 bp, Artificial Sequence
  Synthetic oligonucleotide; TAG chr11 5150460 5150479 5150463 -
acatcatgccaggtagatag

SEQ ID NO: 56903 - DNA, 20 bp, Artificial Sequence
  Synthetic oligonucleotide; GAG chr11 5150458 5150477 5150461 -
atcatgccaggtagatagta

SEQ ID NO: 56904 - DNA, 20 bp, Artificial Sequence
  Synthetic oligonucleotide; AGG chr11 5150457 5150476 5150460 -
tcatgccaggtagatagtag

SEQ ID NO: 56905 - DNA, 20 bp, Artificial Sequence
  Synthetic oligonucleotide; GAG chr11 5150455 5150474 5150458 -
atgccaggtagatagtagag

SEQ ID NO: 56906 - DNA, 20 bp, Artificial Sequence
  Synthetic oligonucleotide; TAG chr11 5150444 5150463 5150447 -
atagtagaggagatttaaac

SEQ ID NO: 56907 - DNA, 20 bp, Artificial Sequence
  Synthetic oligonucleotide; TAG chr11 5150435 5150454 5150438 -
gagatttaaactagataatg

SEQ ID NO: 56908 - DNA, 20 bp, Artificial Sequence
  Synthetic oligonucleotide; AAG chr11 5150429 5150448 5150432 -
taaactagataatgtagttt

SEQ ID NO: 56909 - DNA, 20 bp, Artificial Sequence
  Synthetic oligonucleotide; AGG chr11 5150428 5150447 5150431 -
aaactagataatgtagttta

SEQ ID NO: 56910 - DNA, 20 bp, Artificial Sequence
  Synthetic oligonucleotide; TAG chr11 5150419 5150438 5150422 -
aatgtagtttaaggtaactc

SEQ ID NO: 56911 - DNA, 20 bp, Artificial Sequence
  Synthetic oligonucleotide; TGG chr11 5150405 5150424 5150408 -
taactctagttttttcaata

SEQ ID NO: 56912 - DNA, 20 bp, Artificial Sequence
  Synthetic oligonucleotide; GAG chr11 5150399 5150418 5150402 -
tagttttttcaatatggtat

SEQ ID NO: 56913 - DNA, 20 bp, Artificial Sequence
  Synthetic oligonucleotide; AAG chr11 5150393 5150412 5150396 -
tttcaatatggtatgagtgc

SEQ ID NO: 56914 - DNA, 20 bp, Artificial Sequence
  Synthetic oligonucleotide; AGG chr11 5150392 5150411 5150395 -
ttcaatatggtatgagtgca

SEQ ID NO: 56915 - DNA, 20 bp, Artificial Sequence
  Synthetic oligonucleotide; TAG chr11 5150389 5150408 5150392 -
aatatggtatgagtgcaagg

SEQ ID NO: 56916 - DNA, 20 bp, Artificial Sequence
  Synthetic oligonucleotide; TGG chr11 5150382 5150401 5150385 -
tatgagtgcaaggtagaact

SEQ ID NO: 56917 - DNA, 20 bp, Artificial Sequence
  Synthetic oligonucleotide; GGG chr11 5150381 5150400 5150384 -
atgagtgcaaggtagaactt

SEQ ID NO: 56918 - DNA, 20 bp, Artificial Sequence
  Synthetic oligonucleotide; GGG chr11 5150380 5150399 5150383 -
tgagtgcaaggtagaacttg

SEQ ID NO: 56919 - DNA, 20 bp, Artificial Sequence
  Synthetic oligonucleotide; GAG chr11 5150378 5150397 5150381 -
agtgcaaggtagaacttggg

SEQ ID NO: 56920 - DNA, 20 bp, Artificial Sequence
  Synthetic oligonucleotide; AAG chr11 5150373 5150392 5150376 -
aaggtagaacttggggagac

SEQ ID NO: 56921 - DNA, 20 bp, Artificial Sequence
  Synthetic oligonucleotide; AGG chr11 5150372 5150391 5150375 -
aggtagaacttggggagaca

SEQ ID NO: 56922 - DNA, 20 bp, Artificial Sequence
  Synthetic oligonucleotide; TGG chr11 5150350 5150369 5150353 -
gaaaatatgaatatcaaaaa

SEQ ID NO: 56923 - DNA, 20 bp, Artificial Sequence
  Synthetic oligonucleotide; CAG chr11 5150333 5150352 5150336 -
aaatggctattaatgttgtg

SEQ ID NO: 56924 - DNA, 20 bp, Artificial Sequence
  Synthetic oligonucleotide; GAG chr11 5150331 5150350 5150334 -
atggctattaatgttgtgca

SEQ ID NO: 56925 - DNA, 20 bp, Artificial Sequence
  Synthetic oligonucleotide; TGG chr11 5150324 5150343 5150327 -
ttaatgttgtgcagagttgc

SEQ ID NO: 56926 - DNA, 20 bp, Artificial Sequence
  Synthetic oligonucleotide; AAG chr11 5150309 5150328 5150312 -
gttgctggactttattccaa

SEQ ID NO: 56927 - DNA, 20 bp, Artificial Sequence
  Synthetic oligonucleotide; TGG chr11 5150292 5150311 5150295 -
caaaagctataatgtgccat

SEQ ID NO: 56928 - DNA, 20 bp, Artificial Sequence
  Synthetic oligonucleotide; GAG chr11 5150290 5150309 5150293 -
aaagctataatgtgccattg

SEQ ID NO: 56929 - DNA, 20 bp, Artificial Sequence
  Synthetic oligonucleotide; GAG chr11 5150288 5150307 5150291 -
agctataatgtgccattgga

SEQ ID NO: 56930 - DNA, 20 bp, Artificial Sequence
  Synthetic oligonucleotide; AAG chr11 5150259 5150278 5150262 -
tttgtttgcttgtgttctac

SEQ ID NO: 56931 - DNA, 20 bp, Artificial Sequence
  Synthetic oligonucleotide; AAG chr11 5150255 5150274 5150258 -
tttgcttgtgttctacaagt

SEQ ID NO: 56932 - DNA, 20 bp, Artificial Sequence
  Synthetic oligonucleotide; TGG chr11 5150209 5150228 5150212 -
tgtgtgtgtgtgtgtctgct

SEQ ID NO: 56933 - DNA, 20 bp, Artificial Sequence
  Synthetic oligonucleotide; GGG chr11 5150208 5150227 5150211 -
gtgtgtgtgtgtgtctgctt

SEQ ID NO: 56934 - DNA, 20 bp, Artificial Sequence
  Synthetic oligonucleotide; TGG chr11 5150201 5150220 5150204 -
tgtgtgtctgcttgggcatg

SEQ ID NO: 56935 - DNA, 20 bp, Artificial Sequence
  Synthetic oligonucleotide; CAG chr11 5150198 5150217 5150201 -
gtgtctgcttgggcatgtgg

SEQ ID NO: 56936 - DNA, 20 bp, Artificial Sequence
  Synthetic oligonucleotide; CAG chr11 5150186 5150205 5150189 -
gcatgtggcagcataccaca

SEQ ID NO: 56937 - DNA, 20 bp, Artificial Sequence
  Synthetic oligonucleotide; AAG chr11 5150172 5150191 5150175 -
accacacagcaaatataaat

SEQ ID NO: 56938 - DNA, 20 bp, Artificial Sequence
  Synthetic oligonucleotide; TAG chr11 5150167 5150186 5150170 -
acagcaaatataaataagtc

SEQ ID NO: 56939 - DNA, 20 bp, Artificial Sequence
  Synthetic oligonucleotide; AGG chr11 5150166 5150185 5150169 -
cagcaaatataaataagtct

SEQ ID NO: 56940 - DNA, 20 bp, Artificial Sequence
  Synthetic oligonucleotide; GGG chr11 5150165 5150184 5150168 -
agcaaatataaataagtcta

SEQ ID NO: 56941 - DNA, 20 bp, Artificial Sequence
  Synthetic oligonucleotide; TAG chr11 5150153 5150172 5150156 -
taagtctagggctattgtgt

SEQ ID NO: 56942 - DNA, 20 bp, Artificial Sequence
  Synthetic oligonucleotide; AAG chr11 5150148 5150167 5150151 -
ctagggctattgtgttagtg

SEQ ID NO: 56943 - DNA, 20 bp, Artificial Sequence
  Synthetic oligonucleotide; GAG chr11 5150146 5150165 5150149 -
agggctattgtgttagtgaa

SEQ ID NO: 56944 - DNA, 20 bp, Artificial Sequence
  Synthetic oligonucleotide; AGG chr11 5150145 5150164 5150148 -
gggctattgtgttagtgaag

SEQ ID NO: 56945 - DNA, 20 bp, Artificial Sequence
  Synthetic oligonucleotide; GAG chr11 5150143 5150162 5150146 -
gctattgtgttagtgaagag

SEQ ID NO: 56946 - DNA, 20 bp, Artificial Sequence
  Synthetic oligonucleotide; AGG chr11 5150142 5150161 5150145 -
ctattgtgttagtgaagagg

SEQ ID NO: 56947 - DNA, 20 bp, Artificial Sequence
  Synthetic oligonucleotide; TAG chr11 5150122 5150141 5150125 -
aggactatattgtctaaaat

SEQ ID NO: 56948 - DNA, 20 bp, Artificial Sequence
  Synthetic oligonucleotide; TGG chr11 5150119 5150138 5150122 -
actatattgtctaaaattag

SEQ ID NO: 56949 - DNA, 20 bp, Artificial Sequence
  Synthetic oligonucleotide; AAG chr11 5150113 5150132 5150116 -
ttgtctaaaattagtggcat

SEQ ID NO: 56950 - DNA, 20 bp, Artificial Sequence
  Synthetic oligonucleotide; CGG chr11 5150104 5150123 5150107 -
attagtggcataagaattta

SEQ ID NO: 56951 - DNA, 20 bp, Artificial Sequence
  Synthetic oligonucleotide; TAG chr11 5150100 5150119 5150103 -
gtggcataagaatttacggc

SEQ ID NO: 56952 - DNA, 20 bp, Artificial Sequence
  Synthetic oligonucleotide; CAG chr11 5150076 5150095 5150079 -
caattgttcttgaaaaacct

SEQ ID NO: 56953 - DNA, 20 bp, Artificial Sequence
  Synthetic oligonucleotide; AGG chr11 5150075 5150094 5150078 -
aattgttcttgaaaaacctc

SEQ ID NO: 56954 - DNA, 20 bp, Artificial Sequence
  Synthetic oligonucleotide; TAG chr11 5150069 5150088 5150072 -
tcttgaaaaacctcaggtca

SEQ ID NO: 56955 - DNA, 20 bp, Artificial Sequence
  Synthetic oligonucleotide; AAG chr11 5150054 5150073 5150057 -
ggtcatagatcatttttttc

SEQ ID NO: 56956 - DNA, 20 bp, Artificial Sequence
  Synthetic oligonucleotide; AGG chr11 5150053 5150072 5150056 -
gtcatagatcatttttttca

SEQ ID NO: 56957 - DNA, 20 bp, Artificial Sequence
  Synthetic oligonucleotide; TGG chr11 5150047 5150066 5150050 -
gatcatttttttcaaggtta

SEQ ID NO: 56958 - DNA, 20 bp, Artificial Sequence
  Synthetic oligonucleotide; TGG chr11 5150030 5150049 5150033 -
ttatggaaaatattcacata

SEQ ID NO: 56959 - DNA, 20 bp, Artificial Sequence
  Synthetic oligonucleotide; GGG chr11 5150029 5150048 5150032 -
tatggaaaatattcacatat

SEQ ID NO: 56960 - DNA, 20 bp, Artificial Sequence
  Synthetic oligonucleotide; CAG chr11 5150026 5150045 5150029 -
ggaaaatattcacatatggg

SEQ ID NO: 56961 - DNA, 20 bp, Artificial Sequence
  Synthetic oligonucleotide; CAG chr11 5150003 5150022 5150006 -
atgtccatactttgatttac

SEQ ID NO: 56962 - DNA, 20 bp, Artificial Sequence
  Synthetic oligonucleotide; GTGAAT chr11 5150013 5150032 5150029 +
gtatggacatctgcccatat

SEQ ID NO: 56963 - DNA, 20 bp, Artificial Sequence
  Synthetic oligonucleotide; ATGAAT chr11 5150258 5150277 5150274 +
tgtagaacacaagcaaacaa

SEQ ID NO: 56964 - DNA, 20 bp, Artificial Sequence
  Synthetic oligonucleotide; TGGAAT chr11 5150290 5150309 5150306 +
caatggcacattatagcttt

SEQ ID NO: 56965 - DNA, 20 bp, Artificial Sequence
  Synthetic oligonucleotide; TAGAGT chr11 5150397 5150416 5150413 +
tcataccatattgaaaaaac

SEQ ID NO: 56966 - DNA, 20 bp, Artificial Sequence
  Synthetic oligonucleotide; AAGAAT chr11 5150496 5150515 5150512 +
ctactcatccatcattcctc

SEQ ID NO: 56967 - DNA, 20 bp, Artificial Sequence
  Synthetic oligonucleotide; CAGAAT chr11 5150678 5150697 5150694 +
tcctttcagtctctcttttc

SEQ ID NO: 56968 - DNA, 20 bp, Artificial Sequence
  Synthetic oligonucleotide; GAGAAT chr11 5150703 5150722 5150719 +
ttacataggtacaaactcat

SEQ ID NO: 56969 - DNA, 20 bp, Artificial Sequence
  Synthetic oligonucleotide; ATGAAT chr11 5150788 5150807 5150804 +
tgcaggtttttgataaaatg

SEQ ID NO: 56970 - DNA, 20 bp, Artificial Sequence
  Synthetic oligonucleotide; AGGGAT chr11 5151010 5151029 5151026 +
ttgatttttttttttaaggc

SEQ ID NO: 56971 - DNA, 20 bp, Artificial Sequence
  Synthetic oligonucleotide; GAGAGT chr11 5151028 5151047 5151044 +
gcagggatgatcaagaaaat

SEQ ID NO: 56972 - DNA, 20 bp, Artificial Sequence
  Synthetic oligonucleotide; TTGAGT chr11 5151050 5151069 5151066 +
gagtcaacaacttgttttca

SEQ ID NO: 56973 - DNA, 20 bp, Artificial Sequence
  Synthetic oligonucleotide; CTGGAT chr11 5151058 5151077 5151074 +
aacttgttttcattgagtcc

SEQ ID NO: 56974 - DNA, 20 bp, Artificial Sequence
  Synthetic oligonucleotide; AAGAAT chr11 5151147 5151166 5151163 +
tcctggagaaatattcttag

SEQ ID NO: 56975 - DNA, 20 bp, Artificial Sequence
  Synthetic oligonucleotide; AAGAAT chr11 5151170 5151189 5151186 +
aataactcaaccaggggcta

SEQ ID NO: 56976 - DNA, 20 bp, Artificial Sequence
  Synthetic oligonucleotide; TAGAAT chr11 5151243 5151262 5151259 +
tctcactttcattagtcacg

SEQ ID NO: 56977 - DNA, 20 bp, Artificial Sequence
  Synthetic oligonucleotide; GTGGAT chr11 5151404 5151423 5151420 +
gcatgtaggcattaattaag

SEQ ID NO: 56978 - DNA, 20 bp, Artificial Sequence
  Synthetic oligonucleotide; ATGAAT chr11 5151435 5151454 5151451 +
gaacagaacatttttaccac

SEQ ID NO: 56979 - DNA, 20 bp, Artificial Sequence
  Synthetic oligonucleotide; GCGAAT chr11 5151441 5151460 5151457 +
aacatttttaccacatgaat

SEQ ID NO: 56980 - DNA, 20 bp, Artificial Sequence
  Synthetic oligonucleotide; GTGGAT chr11 5151473 5151492 5151489 +
ggtctttgcaccatagacaa

SEQ ID NO: 56981 - DNA, 20 bp, Artificial Sequence
  Synthetic oligonucleotide; GAGAAT chr11 5151516 5151535 5151532 +
agcaagtaaatgctagaaaa

SEQ ID NO: 56982 - DNA, 20 bp, Artificial Sequence
  Synthetic oligonucleotide; ATGGAT chr11 5151522 5151541 5151538 +
taaatgctagaaaagagaat

SEQ ID NO: 56983 - DNA, 20 bp, Artificial Sequence
  Synthetic oligonucleotide; TTGAAT chr11 5151625 5151644 5151641 +
agatgtgagcaatgcaggta

SEQ ID NO: 56984 - DNA, 20 bp, Artificial Sequence
  Synthetic oligonucleotide; CTGGAT chr11 5151681 5151700 5151697 +
cgaaaaactgtgataaatat

SEQ ID NO: 56985 - DNA, 20 bp, Artificial Sequence
  Synthetic oligonucleotide; ATGAAT chr11 5151700 5151719 5151716 +
tctggatgtaggacaatgtg

SEQ ID NO: 56986 - DNA, 20 bp, Artificial Sequence
  Synthetic oligonucleotide; AGGAGT chr11 5151809 5151828 5151825 +
aatggccatatgctcacagt

SEQ ID NO: 56987 - DNA, 20 bp, Artificial Sequence
  Synthetic oligonucleotide; AAGAAT chr11 5151879 5151898 5151895 +
agtactaggcatggggctac

SEQ ID NO: 56988 - DNA, 20 bp, Artificial Sequence
  Synthetic oligonucleotide; CTGAGT chr11 5151892 5151911 5151908 +
gggctacaagaatagcagcc

SEQ ID NO: 56989 - DNA, 20 bp, Artificial Sequence
  Synthetic oligonucleotide; CTGAAT chr11 5151915 5151934 5151931 +
agtacgaccatagttcctat

SEQ ID NO: 56990 - DNA, 20 bp, Artificial Sequence
  Synthetic oligonucleotide; GTGGGT chr11 5151930 5151949 5151946 +
cctatctgaatgacaagctg

SEQ ID NO: 56991 - DNA, 20 bp, Artificial Sequence
  Synthetic oligonucleotide; GTGGAT chr11 5151956 5151975 5151972 +
gaagatgttggcatgtctta

SEQ ID NO: 56992 - DNA, 20 bp, Artificial Sequence
  Synthetic oligonucleotide; AAGGAT chr11 5151999 5152018 5152015 +
cggtccagggccatggccac

SEQ ID NO: 56993 - DNA, 20 bp, Artificial Sequence
  Synthetic oligonucleotide; GTGGAT chr11 5152029 5152048 5152045 +
gactctataccctgcaatgt

SEQ ID NO: 56994 - DNA, 20 bp, Artificial Sequence
  Synthetic oligonucleotide; AGGAAT chr11 5152055 5152074 5152071 +
gaaccacatttgaagcaagc

SEQ ID NO: 56995 - DNA, 20 bp, Artificial Sequence
  Synthetic oligonucleotide; CAGAAT chr11 5152087 5152106 5152103 +
agatttcaggcacattaaac

SEQ ID NO: 56996 - DNA, 20 bp, Artificial Sequence
  Synthetic oligonucleotide; AGGAAT chr11 5152214 5152233 5152230 +
tttgatgatgctcagaagca

SEQ ID NO: 56997 - DNA, 20 bp, Artificial Sequence
  Synthetic oligonucleotide; CAGAAT chr11 5152249 5152268 5152265 +
tagcaatgagataaatggca

SEQ ID NO: 56998 - DNA, 20 bp, Artificial Sequence
  Synthetic oligonucleotide; TGGAAT chr11 5152254 5152273 5152270 +
atgagataaatggcacagaa

SEQ ID NO: 56999 - DNA, 20 bp, Artificial Sequence
  Synthetic oligonucleotide; TGGGAT chr11 5152290 5152309 5152306 +
cactgcacagattctaggcc

SEQ ID NO: 57000 - DNA, 20 bp, Artificial Sequence
  Synthetic oligonucleotide; TTGGGT chr11 5152357 5152376 5152373 +
tggaaatggacatagtgtcg

SEQ ID NO: 57001 - DNA, 20 bp, Artificial Sequence
  Synthetic oligonucleotide; TTGAGT chr11 5152444 5152463 5152460 +
ttttctccaaactcattata

SEQ ID NO: 57002 - DNA, 20 bp, Artificial Sequence
  Synthetic oligonucleotide; TTGGGT chr11 5152459 5152478 5152475 +
ttatattgagtctgtctgat

SEQ ID NO: 57003 - DNA, 20 bp, Artificial Sequence
  Synthetic oligonucleotide; ATGGAT chr11 5152511 5152530 5152527 +
cacagttttgaaaggaaaag

SEQ ID NO: 57004 - DNA, 20 bp, Artificial Sequence
  Synthetic oligonucleotide; TAGGAT chr11 5152572 5152591 5152588 +
tcacaggcactgtgccataa

SEQ ID NO: 57005 - DNA, 20 bp, Artificial Sequence
  Synthetic oligonucleotide; GGGGAT chr11 5152630 5152649 5152646 +
ccagcaaaatcacctggaca

SEQ ID NO: 57006 - DNA, 20 bp, Artificial Sequence
  Synthetic oligonucleotide; GAGAAT chr11 5152864 5152883 5152880 +
gtaaaagattcccaatgaaa

SEQ ID NO: 57007 - DNA, 20 bp, Artificial Sequence
  Synthetic oligonucleotide; CAGAAT chr11 5152921 5152940 5152937 +
aatatatttctttttatatt

SEQ ID NO: 57008 - DNA, 20 bp, Artificial Sequence
  Synthetic oligonucleotide; GAGAAT chr11 5152935 5152954 5152951 +
tatattcagaataatgtaaa

SEQ ID NO: 57009 - DNA, 20 bp, Artificial Sequence
  Synthetic oligonucleotide; GGGAAT chr11 5153026 5153045 5153042 +
tatatttctttaaagttaaa

SEQ ID NO: 57010 - DNA, 20 bp, Artificial Sequence
  Synthetic oligonucleotide; GTGAGT chr11 5153079 5153098 5153095 +
gctgaaactcttgaaatgtt

SEQ ID NO: 57011 - DNA, 20 bp, Artificial Sequence
  Synthetic oligonucleotide; TGGAAT chr11 5153106 5153125 5153122 +
taaaattttaatacacttta

SEQ ID NO: 57012 - DNA, 20 bp, Artificial Sequence
  Synthetic oligonucleotide; CTGAAT chr11 5153198 5153217 5153214 +
ctcctgataaaccacagata

SEQ ID NO: 57013 - DNA, 20 bp, Artificial Sequence
  Synthetic oligonucleotide; ATGAAT chr11 5153213 5153232 5153229 +
agatactgaataatgggcaa

SEQ ID NO: 57014 - DNA, 20 bp, Artificial Sequence
  Synthetic oligonucleotide; CAGAAT chr11 5153227 5153246 5153243 +
gggcaaatgaatcatttagc

SEQ ID NO: 57015 - DNA, 20 bp, Artificial Sequence
  Synthetic oligonucleotide; TAGAGT chr11 5153232 5153251 5153248 +
aatgaatcatttagccagaa

SEQ ID NO: 57016 - DNA, 20 bp, Artificial Sequence
  Synthetic oligonucleotide; CAGAGT chr11 5153262 5153281 5153278 +
tttcctggttttaaaatgtt

SEQ ID NO: 57017 - DNA, 20 bp, Artificial Sequence
  Synthetic oligonucleotide; ATGAAT chr11 5153473 5153492 5153489 +
ctaaaattgaggaaagcact

SEQ ID NO: 57018 - DNA, 20 bp, Artificial Sequence
  Synthetic oligonucleotide; TTGAAT chr11 5153519 5153538 5153535 +
cttttcaatttcactgatga

SEQ ID NO: 57019 - DNA, 20 bp, Artificial Sequence
  Synthetic oligonucleotide; TTGAAT chr11 5153603 5153622 5153619 +
ttttctaaaaattacatatt

SEQ ID NO: 57020 - DNA, 20 bp, Artificial Sequence
  Synthetic oligonucleotide; ATGAAT chr11 5153719 5153738 5153735 +
tgttttatctcagtaagctc

SEQ ID NO: 57021 - DNA, 20 bp, Artificial Sequence
  Synthetic oligonucleotide; ATGGAT chr11 5153867 5153886 5153883 +
gaagaaagagaaaagaggaa

SEQ ID NO: 57022 - DNA, 20 bp, Artificial Sequence
  Synthetic oligonucleotide; TAGAAT chr11 5154132 5154151 5154148 +
tctccaaagataatcacaat

SEQ ID NO: 57023 - DNA, 20 bp, Artificial Sequence
  Synthetic oligonucleotide; AAGAAT chr11 5154138 5154157 5154154 +
aagataatcacaattagaat

SEQ ID NO: 57024 - DNA, 20 bp, Artificial Sequence
  Synthetic oligonucleotide; GTGAGT chr11 5154196 5154215 5154212 +
caagaccaaagagctgacat

SEQ ID NO: 57025 - DNA, 20 bp, Artificial Sequence
  Synthetic oligonucleotide; CAGGGT chr11 5154224 5154243 5154240 +
tacctgacaggcacagatag

SEQ ID NO: 57026 - DNA, 20 bp, Artificial Sequence
  Synthetic oligonucleotide; TTGGAT chr11 5154263 5154282 5154279 +
gtatgtaagttcctggttag

SEQ ID NO: 57027 - DNA, 20 bp, Artificial Sequence
  Synthetic oligonucleotide; TAGAGT chr11 5154268 5154287 5154284 +
taagttcctggttagttgga

SEQ ID NO: 57028 - DNA, 20 bp, Artificial Sequence
  Synthetic oligonucleotide; TGGAAT chr11 5154319 5154338 5154335 +
taaattatggagaggaaact

SEQ ID NO: 57029 - DNA, 20 bp, Artificial Sequence
  Synthetic oligonucleotide; AAGAAT chr11 5154383 5154402 5154399 +
ttgctcttaccagatacctg

SEQ ID NO: 57030 - DNA, 20 bp, Artificial Sequence
  Synthetic oligonucleotide; AAGGAT chr11 5154442 5154461 5154458 +
ctcaccaatttttcttctcc

SEQ ID NO: 57031 - DNA, 20 bp, Artificial Sequence
  Synthetic oligonucleotide; GTGGGT chr11 5154470 5154489 5154486 +
cagcttcattcccttaagtt

SEQ ID NO: 57032 - DNA, 20 bp, Artificial Sequence
  Synthetic oligonucleotide; CAGGAT chr11 5154555 5154574 5154571 +
aattttactctgtttggtgc

SEQ ID NO: 57033 - DNA, 20 bp, Artificial Sequence
  Synthetic oligonucleotide; CGGGAT chr11 5154727 5154746 5154743 +
gtctgtagcattctgaaaca

SEQ ID NO: 57034 - DNA, 20 bp, Artificial Sequence
  Synthetic oligonucleotide; ATGAAT chr11 5154731 5154750 5154747 +
gtagcattctgaaacacggg

SEQ ID NO: 57035 - DNA, 20 bp, Artificial Sequence
  Synthetic oligonucleotide; ATGAAT chr11 5154792 5154811 5154808 +
caccaatttaatattccttt

SEQ ID NO: 57036 - DNA, 20 bp, Artificial Sequence
  Synthetic oligonucleotide; AGGAGT chr11 5154813 5154832 5154829 +
tgaatgtgtggagaagtagg

SEQ ID NO: 57037 - DNA, 20 bp, Artificial Sequence
  Synthetic oligonucleotide; AGGGAT chr11 5154834 5154853 5154850 +
ggagttatgagcatgaaatg

SEQ ID NO: 57038 - DNA, 20 bp, Artificial Sequence
  Synthetic oligonucleotide; TTGGGT chr11 5154895 5154914 5154911 +
caaattttaagtcagccctc

SEQ ID NO: 57039 - DNA, 20 bp, Artificial Sequence
  Synthetic oligonucleotide; CAGAAT chr11 5154987 5155006 5155003 +
cttttcccacaggctaaatg

SEQ ID NO: 57040 - DNA, 20 bp, Artificial Sequence
  Synthetic oligonucleotide; TTGAGT chr11 5155358 5155377 5155374 +
ggaagcaagttgttgaacat

SEQ ID NO: 57041 - DNA, 20 bp, Artificial Sequence
  Synthetic oligonucleotide; ATGAGT chr11 5155459 5155478 5155475 +
tcattatattcctactattt

SEQ ID NO: 57042 - DNA, 20 bp, Artificial Sequence
  Synthetic oligonucleotide; TGGGAT chr11 5155530 5155549 5155546 +
cctttaaattattagtaaaa

SEQ ID NO: 57043 - DNA, 20 bp, Artificial Sequence
  Synthetic oligonucleotide; TTGAAT chr11 5155644 5155663 5155660 +
cagctggtttctaggctttc

SEQ ID NO: 57044 - DNA, 20 bp, Artificial Sequence
  Synthetic oligonucleotide; GAGAAT chr11 5155714 5155733 5155730 +
taggaagcatactaatggtg

SEQ ID NO: 57045 - DNA, 20 bp, Artificial Sequence
  Synthetic oligonucleotide; ATGGAT chr11 5155727 5155746 5155743 +
aatggtggagaatatttata

SEQ ID NO: 57046 - DNA, 20 bp, Artificial Sequence
  Synthetic oligonucleotide; AGGAAT chr11 5155746 5155765 5155762 +
aatggatttccaggagaaca

SEQ ID NO: 57047 - DNA, 20 bp, Artificial Sequence
  Synthetic oligonucleotide; CAGAAT chr11 5155788 5155807 5155804 +
ggaaccccatgtgctctttc

SEQ ID NO: 57048 - DNA, 20 bp, Artificial Sequence
  Synthetic oligonucleotide; TTGAAT chr11 5155835 5155854 5155851 +
aacaatagtactgttgcatg

SEQ ID NO: 57049 - DNA, 20 bp, Artificial Sequence
  Synthetic oligonucleotide; TTGGGT chr11 5155993 5156012 5156009 +
gggctctccaaagttctatc

SEQ ID NO: 57050 - DNA, 20 bp, Artificial Sequence
  Synthetic oligonucleotide; ATGAGT chr11 5156190 5156209 5156206 +
catcctttgaaacattgtca

SEQ ID NO: 57051 - DNA, 20 bp, Artificial Sequence
  Synthetic oligonucleotide; CTGGAT chr11 5156278 5156297 5156294 +
atatgcatcaataactatct

SEQ ID NO: 57052 - DNA, 20 bp, Artificial Sequence
  Synthetic oligonucleotide; CAGAGT chr11 5156328 5156347 5156344 +
tttttttcttttttttgaga

SEQ ID NO: 57053 - DNA, 20 bp, Artificial Sequence
  Synthetic oligonucleotide; TGGAGT chr11 5156353 5156372 5156369 +
tctctctctgtcgcccaggc

SEQ ID NO: 57054 - DNA, 20 bp, Artificial Sequence
  Synthetic oligonucleotide; CGGGGT chr11 5156499 5156518 5156515 +
ttgtatttttttagtagaga

SEQ ID NO: 57055 - DNA, 20 bp, Artificial Sequence
  Synthetic oligonucleotide; CAGGAT chr11 5156519 5156538 5156535 +
cggggtttcactgtgttagc

SEQ ID NO: 57056 - DNA, 20 bp, Artificial Sequence
  Synthetic oligonucleotide; TGGGAT chr11 5156576 5156595 5156592 +
gcctccgcctcccaaagtgc

SEQ ID NO: 57057 - DNA, 20 bp, Artificial Sequence
  Synthetic oligonucleotide; CTGAAT chr11 5156611 5156630 5156627 +
gagccactgcacccggccta

SEQ ID NO: 57058 - DNA, 20 bp, Artificial Sequence
  Synthetic oligonucleotide; CGGAGT chr11 5156694 5156713 5156710 +
ctttttttttttccttgaga

SEQ ID NO: 57059 - DNA, 20 bp, Artificial Sequence
  Synthetic oligonucleotide; TGGAGT chr11 5156719 5156738 5156735 +
tctcgctccgtcatccaggc

SEQ ID NO: 57060 - DNA, 20 bp, Artificial Sequence
  Synthetic oligonucleotide; TAGGAT chr11 5156732 5156751 5156748 +
tccaggctggagtgcagtgg

SEQ ID NO: 57061 - DNA, 20 bp, Artificial Sequence
  Synthetic oligonucleotide; TGGGAT chr11 5156806 5156825 5156822 +
gcccaagcctcccaagtagg

SEQ ID NO: 57062 - DNA, 20 bp, Artificial Sequence
  Synthetic oligonucleotide; CAGGGT chr11 5156863 5156882 5156879 +
ttttgtatttttagtagaga

SEQ ID NO: 57063 - DNA, 20 bp, Artificial Sequence
  Synthetic oligonucleotide; TTGAGT chr11 5156987 5157006 5157003 +
ccagcccatctttaccattt

SEQ ID NO: 57064 - DNA, 20 bp, Artificial Sequence
  Synthetic oligonucleotide; GAGAGT chr11 5157118 5157137 5157134 +
tacacacagagggagagaga

SEQ ID NO: 57065 - DNA, 20 bp, Artificial Sequence
  Synthetic oligonucleotide; GAGGGT chr11 5157126 5157145 5157142 +
gagggagagagagagagtgg

SEQ ID NO: 57066 - DNA, 20 bp, Artificial Sequence
  Synthetic oligonucleotide; ACGAGT chr11 5157228 5157247 5157244 +
tccacgtttttaacttccac

SEQ ID NO: 57067 - DNA, 20 bp, Artificial Sequence
  Synthetic oligonucleotide; TTGAAT chr11 5157343 5157362 5157359 +
tatttcattcttttttatgg

SEQ ID NO: 57068 - DNA, 20 bp, Artificial Sequence
  Synthetic oligonucleotide; ACGAAT chr11 5157416 5157435 5157432 +
ctttatccatttatctgttg

SEQ ID NO: 57069 - DNA, 20 bp, Artificial Sequence
  Synthetic oligonucleotide; GTGAAT chr11 5157451 5157470 5157467 +
gatttcaaatcttggcgttt

SEQ ID NO: 57070 - DNA, 20 bp, Artificial Sequence
  Synthetic oligonucleotide; GGGAGT chr11 5157474 5157493 5157490 +
aatagtgctataataaagat

SEQ ID NO: 57071 - DNA, 20 bp, Artificial Sequence
  Synthetic oligonucleotide; AAGGGT chr11 5157515 5157534 5157531 +
acatactaatttattctttt

SEQ ID NO: 57072 - DNA, 20 bp, Artificial Sequence
  Synthetic oligonucleotide; AGGAGT chr11 5157529 5157548 5157545 +
tcttttaagggtatatacct

SEQ ID NO: 57073 - DNA, 20 bp, Artificial Sequence
  Synthetic oligonucleotide; CTGGAT chr11 5157542 5157561 5157558 +
tatacctaggagtgatattg

SEQ ID NO: 57074 - DNA, 20 bp, Artificial Sequence
  Synthetic oligonucleotide; GAGGGT chr11 5157638 5157657 5157654 +
tactcccaccaacagtgtaa

SEQ ID NO: 57075 - DNA, 20 bp, Artificial Sequence
  Synthetic oligonucleotide; TTGAGT chr11 5157865 5157884 5157881 +
atttatttatttattttctg

SEQ ID NO: 57076 - DNA, 20 bp, Artificial Sequence
  Synthetic oligonucleotide; TTGAGT chr11 5157874 5157893 5157890 +
tttattttctgttgagttgc

SEQ ID NO: 57077 - DNA, 20 bp, Artificial Sequence
  Synthetic oligonucleotide; TTGGGT chr11 5157946 5157965 5157962 +
caaatattttctcccattct

SEQ ID NO: 57078 - DNA, 20 bp, Artificial Sequence
  Synthetic oligonucleotide; ATGAAT chr11 5158069 5158088 5158085 +
gacagtatttgcccaaatca

SEQ ID NO: 57079 - DNA, 20 bp, Artificial Sequence
  Synthetic oligonucleotide; GAGGGT chr11 5158081 5158100 5158097 +
ccaaatcaatgaatgccctg

SEQ ID NO: 57080 - DNA, 20 bp, Artificial Sequence
  Synthetic oligonucleotide; TTGGAT chr11 5158128 5158147 5158144 +
tagtttcataatttcaggta

SEQ ID NO: 57081 - DNA, 20 bp, Artificial Sequence
  Synthetic oligonucleotide; AGGGGT chr11 5158182 5158201 5158198 +
ttttgtatatagtgagagat

SEQ ID NO: 57082 - DNA, 20 bp, Artificial Sequence
  Synthetic oligonucleotide; ATGGAT chr11 5158208 5158227 5158224 +
ccgattttactcttttgcaa

SEQ ID NO: 57083 - DNA, 20 bp, Artificial Sequence
  Synthetic oligonucleotide; TGGAGT chr11 5158280 5158299 5158296 +
ttttttttttttttttgaga

SEQ ID NO: 57084 - DNA, 20 bp, Artificial Sequence
  Synthetic oligonucleotide; TGGAGT chr11 5158303 5158322 5158319 +
agtctcactgttgcccaggc

SEQ ID NO: 57085 - DNA, 20 bp, Artificial Sequence
  Synthetic oligonucleotide; TTGGAT chr11 5158326 5158345 5158342 +
agtgcagtggcagcacaatc

SEQ ID NO: 57086 - DNA, 20 bp, Artificial Sequence
  Synthetic oligonucleotide; CTGAGT chr11 5158382 5158401 5158398 +
gattctcctgcctcagcctc

SEQ ID NO: 57087 - DNA, 20 bp, Artificial Sequence
  Synthetic oligonucleotide; TGGGAT chr11 5158391 5158410 5158407 +
gcctcagcctcctgagtatc

SEQ ID NO: 57088 - DNA, 20 bp, Artificial Sequence
  Synthetic oligonucleotide; CGGAGT chr11 5158447 5158466 5158463 +
ttttgtatttttagtagaga

SEQ ID NO: 57089 - DNA, 20 bp, Artificial Sequence
  Synthetic oligonucleotide; TGGGAT chr11 5158524 5158543 5158540 +
acctcagcctcacaaagtgc

SEQ ID NO: 57090 - DNA, 20 bp, Artificial Sequence
  Synthetic oligonucleotide; CTGGAT chr11 5158618 5158637 5158634 +
atgacttggttgttaagtgc

SEQ ID NO: 57091 - DNA, 20 bp, Artificial Sequence
  Synthetic oligonucleotide; CTGGGT chr11 5158630 5158649 5158646 +
ttaagtgcctggatttgcat

SEQ ID NO: 57092 - DNA, 20 bp, Artificial Sequence
  Synthetic oligonucleotide; CAGGAT chr11 5158761 5158780 5158777 +
ttggttttgttctttttgct

SEQ ID NO: 57093 - DNA, 20 bp, Artificial Sequence
  Synthetic oligonucleotide; GGGGAT chr11 5158780 5158799 5158796 +
tcaggattgctttagctatt

SEQ ID NO: 57094 - DNA, 20 bp, Artificial Sequence
  Synthetic oligonucleotide; TAGGAT chr11 5158809 5158828 5158825 +
ttgtggttccatataaatat

SEQ ID NO: 57095 - DNA, 20 bp, Artificial Sequence
  Synthetic oligonucleotide; GTGAAT chr11 5158830 5158849 5158846 +
aggattgtttttctatttct

SEQ ID NO: 57096 - DNA, 20 bp, Artificial Sequence
  Synthetic oligonucleotide; CTGAAT chr11 5158863 5158882 5158879 +
gtattttgacagaaattgca

SEQ ID NO: 57097 - DNA, 20 bp, Artificial Sequence
  Synthetic oligonucleotide; TTGGGT chr11 5158881 5158900 5158897 +
cactgaatctgtacattgct

SEQ ID NO: 57098 - DNA, 20 bp, Artificial Sequence
  Synthetic oligonucleotide; TGGAAT chr11 5158928 5158947 5158944 +
attcttctagttcatgagca

SEQ ID NO: 57099 - DNA, 20 bp, Artificial Sequence
  Synthetic oligonucleotide; CAGAGT chr11 5158976 5158995 5158992 +
ccctcttctatttctttcac

SEQ ID NO: 57100 - DNA, 20 bp, Artificial Sequence
  Synthetic oligonucleotide; TTGGGT chr11 5159015 5159034 5159031 +
ttatagagatcttttacttc

SEQ ID NO: 57101 - DNA, 20 bp, Artificial Sequence
  Synthetic oligonucleotide; CTGGGT chr11 5159032 5159051 5159048 +
ttcttgggttagattgactc

SEQ ID NO: 57102 - DNA, 20 bp, Artificial Sequence
  Synthetic oligonucleotide; TTGGAT chr11 5159270 5159289 5159286 +
ttaacttcttcctttccaat

SEQ ID NO: 57103 - DNA, 20 bp, Artificial Sequence
  Synthetic oligonucleotide; CTGAAT chr11 5159293 5159312 5159309 +
gatgcactttctttctcttc

SEQ ID NO: 57104 - DNA, 20 bp, Artificial Sequence
  Synthetic oligonucleotide; TTGGGT chr11 5159511 5159530 5159527 +
ttgttgtgtcctggtctggt

SEQ ID NO: 57105 - DNA, 20 bp, Artificial Sequence
  Synthetic oligonucleotide; TAGAGT chr11 5159521 5159540 5159537 +
ctggtctggtttgggtatat

SEQ ID NO: 57106 - DNA, 20 bp, Artificial Sequence
  Synthetic oligonucleotide; TAGAAT chr11 5159540 5159559 5159556 +
ttagagtaatgcttgcctca

SEQ ID NO: 57107 - DNA, 20 bp, Artificial Sequence
  Synthetic oligonucleotide; AGGAAT chr11 5159596 5159615 5159612 +
tttatttgtttgtttgtttg

SEQ ID NO: 57108 - DNA, 20 bp, Artificial Sequence
  Synthetic oligonucleotide; TTGAGT chr11 5159602 5159621 5159618 +
tgtttgtttgtttgaggaat

SEQ ID NO: 57109 - DNA, 20 bp, Artificial Sequence
  Synthetic oligonucleotide; TCGAGT chr11 5159648 5159667 5159664 +
ttgaaatgtttggtagccca

SEQ ID NO: 57110 - DNA, 20 bp, Artificial Sequence
  Synthetic oligonucleotide; AGGAAT chr11 5159771 5159790 5159787 +
ttgctaggctgtatgtgtcc

SEQ ID NO: 57111 - DNA, 20 bp, Artificial Sequence
  Synthetic oligonucleotide; TGGAAT chr11 5159808 5159827 5159824 +
ttctagattttccaatttgt

SEQ ID NO: 57112 - DNA, 20 bp, Artificial Sequence
  Synthetic oligonucleotide; ATGAGT chr11 5159837 5159856 5159853 +
gttgttcataatagtatcta

SEQ ID NO: 57113 - DNA, 20 bp, Artificial Sequence
  Synthetic oligonucleotide; TTGGAT chr11 5160122 5160141 5160138 +
gttgaagcctttctactttt

SEQ ID NO: 57114 - DNA, 20 bp, Artificial Sequence
  Synthetic oligonucleotide; CTGGGT chr11 5160342 5160361 5160358 +
gcaataaagctttttatcac

SEQ ID NO: 57115 - DNA, 20 bp, Artificial Sequence
  Synthetic oligonucleotide; CTGAGT chr11 5160357 5160376 5160373 +
atcacctgggtgcaggcggg

SEQ ID NO: 57116 - DNA, 20 bp, Artificial Sequence
  Synthetic oligonucleotide; GAGAGT chr11 5160370 5160389 5160386 +
aggcgggctgagtccgaaaa

SEQ ID NO: 57117 - DNA, 20 bp, Artificial Sequence
  Synthetic oligonucleotide; AGGAGT chr11 5160390 5160409 5160406 +
gagagtcagcaaagggagat

SEQ ID NO: 57118 - DNA, 20 bp, Artificial Sequence
  Synthetic oligonucleotide; TTGGGT chr11 5160414 5160433 5160430 +
gtggggctgttttataagat

SEQ ID NO: 57119 - DNA, 20 bp, Artificial Sequence
  Synthetic oligonucleotide; GGGGGT chr11 5160445 5160464 5160461 +
aaggaaaattacagtcaaag

SEQ ID NO: 57120 - DNA, 20 bp, Artificial Sequence
  Synthetic oligonucleotide; AGGAGT chr11 5160466 5160485 5160482 +
ggggttgttctctggcgggc

SEQ ID NO: 57121 - DNA, 20 bp, Artificial Sequence
  Synthetic oligonucleotide; GGGGGT chr11 5160473 5160492 5160489 +
ttctctggcgggcaggagtg

SEQ ID NO: 57122 - DNA, 20 bp, Artificial Sequence
  Synthetic oligonucleotide; CAGGAT chr11 5160510 5160529 5160526 +
cagtaggggagcttttgagc

SEQ ID NO: 57123 - DNA, 20 bp, Artificial Sequence
  Synthetic oligonucleotide; TGGAAT chr11 5160591 5160610 5160607 +
cattttcacttcttttgtgg

SEQ ID NO: 57124 - DNA, 20 bp, Artificial Sequence
  Synthetic oligonucleotide; GGGGAT chr11 5160760 5160779 5160776 +
ttggggcagcgaaaattttg

SEQ ID NO: 57125 - DNA, 20 bp, Artificial Sequence
  Synthetic oligonucleotide; CGGGAT chr11 5160810 5160829 5160826 +
tttctcagggctgcttcgag

SEQ ID NO: 57126 - DNA, 20 bp, Artificial Sequence
  Synthetic oligonucleotide; TAGAGT chr11 5160835 5160854 5160851 +
ttaggggcggcgtgggaacc

SEQ ID NO: 57127 - DNA, 20 bp, Artificial Sequence
  Synthetic oligonucleotide; AGGGGT chr11 5160875 5160894 5160891 +
tgaaggaagattttgtggta

SEQ ID NO: 57128 - DNA, 20 bp, Artificial Sequence
  Synthetic oligonucleotide; TGGGGT chr11 5160888 5160907 5160904 +
tgtggtaaggggtgatattg

SEQ ID NO: 57129 - DNA, 20 bp, Artificial Sequence
  Synthetic oligonucleotide; TAGAAT chr11 5160917 5160936 5160933 +
tagaagaaacatttgtcatg

SEQ ID NO: 57130 - DNA, 20 bp, Artificial Sequence
  Synthetic oligonucleotide; CTGGAT chr11 5160936 5160955 5160952 +
gtagaattattggtgatggc

SEQ ID NO: 57131 - DNA, 20 bp, Artificial Sequence
  Synthetic oligonucleotide; ATGGAT chr11 5160952 5160971 5160968 +
tggcctggatacggttttgt

SEQ ID NO: 57132 - DNA, 20 bp, Artificial Sequence
  Synthetic oligonucleotide; TGGAAT chr11 5160970 5160989 5160986 +
gtatggattgaaaaaccaaa

SEQ ID NO: 57133 - DNA, 20 bp, Artificial Sequence
  Synthetic oligonucleotide; AAGAGT chr11 5161039 5161058 5161055 +
ggacctaggacatctgatta

SEQ ID NO: 57134 - DNA, 20 bp, Artificial Sequence
  Synthetic oligonucleotide; AAGAGT chr11 5161096 5161115 5161112 +
aaagattatttatttacttc

SEQ ID NO: 57135 - DNA, 20 bp, Artificial Sequence
  Synthetic oligonucleotide; AAGAGT chr11 5161103 5161122 5161119 +
atttatttacttcaagagtt

SEQ ID NO: 57136 - DNA, 20 bp, Artificial Sequence
  Synthetic oligonucleotide; GGGGAT chr11 5161117 5161136 5161133 +
agagttaagagtggcagttt

SEQ ID NO: 57137 - DNA, 20 bp, Artificial Sequence
  Synthetic oligonucleotide; ATGAGT chr11 5161198 5161217 5161214 +
taaacaagagcagggcatgt

SEQ ID NO: 57138 - DNA, 20 bp, Artificial Sequence
  Synthetic oligonucleotide; GAGAAT chr11 5161208 5161227 5161224 +
cagggcatgtatgagtagtt

SEQ ID NO: 57139 - DNA, 20 bp, Artificial Sequence
  Synthetic oligonucleotide; GTGAAT chr11 5161215 5161234 5161231 +
tgtatgagtagttgagaatg

SEQ ID NO: 57140 - DNA, 20 bp, Artificial Sequence
  Synthetic oligonucleotide; AGGAGT chr11 5161221 5161240 5161237 +
agtagttgagaatggtgaat

SEQ ID NO: 57141 - DNA, 20 bp, Artificial Sequence
  Synthetic oligonucleotide; AGGGAT chr11 5161247 5161266 5161263 +
atgactagacagaagatagc

SEQ ID NO: 57142 - DNA, 20 bp, Artificial Sequence
  Synthetic oligonucleotide; TGGAAT chr11 5161294 5161313 5161310 +
ttctaagttggtctggtgtc

SEQ ID NO: 57143 - DNA, 20 bp, Artificial Sequence
  Synthetic oligonucleotide; AGGGAT chr11 5161507 5161526 5161523 +
cctgaagacggaggaccgta

SEQ ID NO: 57144 - DNA, 20 bp, Artificial Sequence
  Synthetic oligonucleotide; CTGAAT chr11 5161525 5161544 5161541 +
taagggatataaaggtttta

SEQ ID NO: 57145 - DNA, 20 bp, Artificial Sequence
  Synthetic oligonucleotide; AGGAAT chr11 5161618 5161637 5161634 +
gaggtaggaaggctaaactg

SEQ ID NO: 57146 - DNA, 20 bp, Artificial Sequence
  Synthetic oligonucleotide; TTGAGT chr11 5161751 5161770 5161767 +
gttatctgactcagggcatg

SEQ ID NO: 57147 - DNA, 20 bp, Artificial Sequence
  Synthetic oligonucleotide; CTGGGT chr11 5161775 5161794 5161791 +
gtaaatctaatttgccagtc

SEQ ID NO: 57148 - DNA, 20 bp, Artificial Sequence
  Synthetic oligonucleotide; CTGAAT chr11 5161824 5161843 5161840 +
gtgtagggaagggagggggc

SEQ ID NO: 57149 - DNA, 20 bp, Artificial Sequence
  Synthetic oligonucleotide; AGGAGT chr11 5161838 5161857 5161854 +
gggggcctgaataatccctg

SEQ ID NO: 57150 - DNA, 20 bp, Artificial Sequence
  Synthetic oligonucleotide; CAGAAT chr11 5161846 5161865 5161862 +
gaataatccctgaggagtag

SEQ ID NO: 57151 - DNA, 20 bp, Artificial Sequence
  Synthetic oligonucleotide; GAGGAT chr11 5161883 5161902 5161899 +
cactgagaagttatttcttt

SEQ ID NO: 57152 - DNA, 20 bp, Artificial Sequence
  Synthetic oligonucleotide; CAGGGT chr11 5162021 5162040 5162037 +
atcaataaatcaagtgtgat

SEQ ID NO: 57153 - DNA, 20 bp, Artificial Sequence
  Synthetic oligonucleotide; TGGGGT chr11 5162066 5162085 5162082 +
aagaaggaaatatggggaaa

SEQ ID NO: 57154 - DNA, 20 bp, Artificial Sequence
  Synthetic oligonucleotide; GTGAAT chr11 5162070 5162089 5162086 +
aggaaatatggggaaatggg

SEQ ID NO: 57155 - DNA, 20 bp, Artificial Sequence
  Synthetic oligonucleotide; GTGGAT chr11 5162081 5162100 5162097 +
ggaaatggggtgaatgtcag

SEQ ID NO: 57156 - DNA, 20 bp, Artificial Sequence
  Synthetic oligonucleotide; GGGGGT chr11 5162104 5162123 5162120 +
gatcagagagatacaatcat

SEQ ID NO: 57157 - DNA, 20 bp, Artificial Sequence
  Synthetic oligonucleotide; AGGAAT chr11 5162123 5162142 5162139 +
tgggggtcaggtgtggtatc

SEQ ID NO: 57158 - DNA, 20 bp, Artificial Sequence
  Synthetic oligonucleotide; CCGGAT chr11 5162140 5162159 5162156 +
atcaggaataatgtgggagg

SEQ ID NO: 57159 - DNA, 20 bp, Artificial Sequence
  Synthetic oligonucleotide; AAGAGT chr11 5162188 5162207 5162204 +
ggtaattgtgggacttaaca

SEQ ID NO: 57160 - DNA, 20 bp, Artificial Sequence
  Synthetic oligonucleotide; GTGAGT chr11 5162192 5162211 5162208 +
attgtgggacttaacaaaga

SEQ ID NO: 57161 - DNA, 20 bp, Artificial Sequence
  Synthetic oligonucleotide; GGGGAT chr11 5162213 5162232 5162229 +
tgagtacagctgaaggagcc

SEQ ID NO: 57162 - DNA, 20 bp, Artificial Sequence
  Synthetic oligonucleotide; AAGAGT chr11 5162280 5162299 5162296 +
tagaagttatgagaaatgtg

SEQ ID NO: 57163 - DNA, 20 bp, Artificial Sequence
  Synthetic oligonucleotide; CAGGGT chr11 5162408 5162427 5162424 +
ttatttggacagaaaggcta

SEQ ID NO: 57164 - DNA, 20 bp, Artificial Sequence
  Synthetic oligonucleotide; CTGGAT chr11 5162420 5162439 5162436 +
aaaggctacagggtgcagtc

SEQ ID NO: 57165 - DNA, 20 bp, Artificial Sequence
  Synthetic oligonucleotide; AAGAAT chr11 5162433 5162452 5162449 +
tgcagtcctggatcttgtgt

SEQ ID NO: 57166 - DNA, 20 bp, Artificial Sequence
  Synthetic oligonucleotide; AGGAGT chr11 5162470 5162489 5162486 +
taactatgcctaggaaggaa

SEQ ID NO: 57167 - DNA, 20 bp, Artificial Sequence
  Synthetic oligonucleotide; AGGGAT chr11 5162490 5162509 5162506 +
aggagttgttgttttgtaga

SEQ ID NO: 57168 - DNA, 20 bp, Artificial Sequence
  Synthetic oligonucleotide; GAGAAT chr11 5162552 5162571 5162568 +
gagagcacgtgtgtttttat

SEQ ID NO: 57169 - DNA, 20 bp, Artificial Sequence
  Synthetic oligonucleotide; GAGGAT chr11 5162580 5162599 5162596 +
tgccgagataggtaacacat

SEQ ID NO: 57170 - DNA, 20 bp, Artificial Sequence
  Synthetic oligonucleotide; TGGGGT chr11 5162610 5162629 5162626 +
tttgggcttgactgaagtaa

SEQ ID NO: 57171 - DNA, 20 bp, Artificial Sequence
  Synthetic oligonucleotide; ATGGGT chr11 5162666 5162685 5162682 +
caggtaatttgctgagccta

SEQ ID NO: 57172 - DNA, 20 bp, Artificial Sequence
  Synthetic oligonucleotide; TGGAAT chr11 5162706 5162725 5162722 +
aagtgaaagcgaagagaggc

SEQ ID NO: 57173 - DNA, 20 bp, Artificial Sequence
  Synthetic oligonucleotide; AAGGGT chr11 5162713 5162732 5162729 +
agcgaagagaggctggaatg

SEQ ID NO: 57174 - DNA, 20 bp, Artificial Sequence
  Synthetic oligonucleotide; AGGAAT chr11 5162723 5162742 5162739 +
ggctggaatgaagggtgcaa

SEQ ID NO: 57175 - DNA, 20 bp, Artificial Sequence
  Synthetic oligonucleotide; CAGAAT chr11 5162758 5162777 5162774 +
agcatgtttgagatccagaa

SEQ ID NO: 57176 - DNA, 20 bp, Artificial Sequence
  Synthetic oligonucleotide; ATGGGT chr11 5162765 5162784 5162781 +
ttgagatccagaacagaata

SEQ ID NO: 57177 - DNA, 20 bp, Artificial Sequence
  Synthetic oligonucleotide; GAGGAT chr11 5162787 5162806 5162803 +
gggttatagatggaggtatt

SEQ ID NO: 57178 - DNA, 20 bp, Artificial Sequence
  Synthetic oligonucleotide; GAGAGT chr11 5162795 5162814 5162811 +
gatggaggtattgaggatag

SEQ ID NO: 57179 - DNA, 20 bp, Artificial Sequence
  Synthetic oligonucleotide; ATGGGT chr11 5162803 5162822 5162819 +
tattgaggataggagagtat

SEQ ID NO: 57180 - DNA, 20 bp, Artificial Sequence
  Synthetic oligonucleotide; TGGGGT chr11 5162818 5162837 5162834 +
agtatatgggtttggcacca

SEQ ID NO: 57181 - DNA, 20 bp, Artificial Sequence
  Synthetic oligonucleotide; GTGGAT chr11 5162822 5162841 5162838 +
tatgggtttggcaccatggg

SEQ ID NO: 57182 - DNA, 20 bp, Artificial Sequence
  Synthetic oligonucleotide; GGGAAT chr11 5162908 5162927 5162924 +
ttttaggacaggtaaaatgg

SEQ ID NO: 57183 - DNA, 20 bp, Artificial Sequence
  Synthetic oligonucleotide; GAGAGT chr11 5162920 5162939 5162936 +
taaaatgggggaatggtaag

SEQ ID NO: 57184 - DNA, 20 bp, Artificial Sequence
  Synthetic oligonucleotide; TGGGAT chr11 5162996 5163015 5163012 +
aatcctttcaaagcatgctg

SEQ ID NO: 57185 - DNA, 20 bp, Artificial Sequence
  Synthetic oligonucleotide; TGGGAT chr11 5163001 5163020 5163017 +
tttcaaagcatgctgtggga

SEQ ID NO: 57186 - DNA, 20 bp, Artificial Sequence
  Synthetic oligonucleotide; CGGGGT chr11 5163019 5163038 5163035 +
gatgggatactggcattgag

SEQ ID NO: 57187 - DNA, 20 bp, Artificial Sequence
  Synthetic oligonucleotide; AAGAGT chr11 5163025 5163044 5163041 +
atactggcattgagcggggt

SEQ ID NO: 57188 - DNA, 20 bp, Artificial Sequence
  Synthetic oligonucleotide; TGGGAT chr11 5163044 5163063 5163060 +
taagagtgattaggttttaa

SEQ ID NO: 57189 - DNA, 20 bp, Artificial Sequence
  Synthetic oligonucleotide; GTGGAT chr11 5163103 5163122 5163119 +
agtagaggtgtcttatactt

SEQ ID NO: 57190 - DNA, 20 bp, Artificial Sequence
  Synthetic oligonucleotide; GAGGAT chr11 5163130 5163149 5163146 +
aaggtggggagatacaaggg

SEQ ID NO: 57191 - DNA, 20 bp, Artificial Sequence
  Synthetic oligonucleotide; AGGAAT chr11 5163191 5163210 5163207 +
atgaggtatggctgtagccc

SEQ ID NO: 57192 - DNA, 20 bp, Artificial Sequence
  Synthetic oligonucleotide; GGGGAT chr11 5163256 5163275 5163272 +
taataagggaactggcaggt

SEQ ID NO: 57193 - DNA, 20 bp, Artificial Sequence
  Synthetic oligonucleotide; AGGAGT chr11 5163270 5163289 5163286 +
gcaggtggggataatgaaaa

SEQ ID NO: 57194 - DNA, 20 bp, Artificial Sequence
  Synthetic oligonucleotide; AAGAGT chr11 5163282 5163301 5163298 +
aatgaaaaaggagtgcttaa

SEQ ID NO: 57195 - DNA, 20 bp, Artificial Sequence
  Synthetic oligonucleotide; CAGAGT chr11 5163305 5163324 5163321 +
agtatcgtctcggttagcac

SEQ ID NO: 57196 - DNA, 20 bp, Artificial Sequence
  Synthetic oligonucleotide; GGGAAT chr11 5163313 5163332 5163329 +
ctcggttagcaccagagttg

SEQ ID NO: 57197 - DNA, 20 bp, Artificial Sequence
  Synthetic oligonucleotide; TGGAGT chr11 5163402 5163421 5163418 +
cctttgaaaagaaggtaatg

SEQ ID NO: 57198 - DNA, 20 bp, Artificial Sequence
  Synthetic oligonucleotide; GTGGGT chr11 5163406 5163425 5163422 +
tgaaaagaaggtaatgtgga

SEQ ID NO: 57199 - DNA, 20 bp, Artificial Sequence
  Synthetic oligonucleotide; AAGGGT chr11 5163431 5163450 5163447 +
tagcctccatactgattaag

SEQ ID NO: 57200 - DNA, 20 bp, Artificial Sequence
  Synthetic oligonucleotide; GAGAAT chr11 5163457 5163476 5163473 +
acagacttaccctccactgt

SEQ ID NO: 57201 - DNA, 20 bp, Artificial Sequence
  Synthetic oligonucleotide; AGGAGT chr11 5163555 5163574 5163571 +
aaagccgagaagatctggga

SEQ ID NO: 57202 - DNA, 20 bp, Artificial Sequence
  Synthetic oligonucleotide; CAGAGT chr11 5163580 5163599 5163596 +
tcagtcagggagccttgggc

SEQ ID NO: 57203 - DNA, 20 bp, Artificial Sequence
  Synthetic oligonucleotide; AGGAGT chr11 5163598 5163617 5163614 +
gccagagttccaggggctct

SEQ ID NO: 57204 - DNA, 20 bp, Artificial Sequence
  Synthetic oligonucleotide; GTGAGT chr11 5163613 5163632 5163629 +
gctctaggagtggctgccag

SEQ ID NO: 57205 - DNA, 20 bp, Artificial Sequence
  Synthetic oligonucleotide; TGGGGT chr11 5163638 5163657 5163654 +
ttgaacagtccgatttctag

SEQ ID NO: 57206 - DNA, 20 bp, Artificial Sequence
  Synthetic oligonucleotide; AGGAAT chr11 5163670 5163689 5163686 +
cagatgggacacggcttagg

SEQ ID NO: 57207 - DNA, 20 bp, Artificial Sequence
  Synthetic oligonucleotide; TGGGGT chr11 5163814 5163833 5163830 +
ttgtgtgctggagatgtggc

SEQ ID NO: 57208 - DNA, 20 bp, Artificial Sequence
  Synthetic oligonucleotide; AGGAAT chr11 5163839 5163858 5163855 +
tttgtctcacagtggaggca

SEQ ID NO: 57209 - DNA, 20 bp, Artificial Sequence
  Synthetic oligonucleotide; TTGAGT chr11 5163915 5163934 5163931 +
caccttgaaggtgaggttaa

SEQ ID NO: 57210 - DNA, 20 bp, Artificial Sequence
  Synthetic oligonucleotide; TGGGGT chr11 5163928 5163947 5163944 +
aggttaattgagtcctgttg

SEQ ID NO: 57211 - DNA, 20 bp, Artificial Sequence
  Synthetic oligonucleotide; CAGAAT chr11 5163942 5163961 5163958 +
ctgttgtggggtttgaggtc

SEQ ID NO: 57212 - DNA, 20 bp, Artificial Sequence
  Synthetic oligonucleotide; TGGAGT chr11 5163956 5163975 5163972 +
gaggtccagaatttaatttt

SEQ ID NO: 57213 - DNA, 20 bp, Artificial Sequence
  Synthetic oligonucleotide; TTGGGT chr11 5163984 5164003 5164000 +
tatttaatgtcaggagcaga

SEQ ID NO: 57214 - DNA, 20 bp, Artificial Sequence
  Synthetic oligonucleotide; GAGAAT chr11 5164005 5164024 5164021 +
tgggtaataaaatgtatatt

SEQ ID NO: 57215 - DNA, 20 bp, Artificial Sequence
  Synthetic oligonucleotide; TAGGGT chr11 5164031 5164050 5164047 +
aaagtggccttttgtccttt

SEQ ID NO: 57216 - DNA, 20 bp, Artificial Sequence
  Synthetic oligonucleotide; CAGGGT chr11 5164056 5164075 5164072 +
tctagggctgtaaagcgtct

SEQ ID NO: 57217 - DNA, 20 bp, Artificial Sequence
  Synthetic oligonucleotide; CTGGGT chr11 5164088 5164107 5164104 +
cgaacgagccatgaactggg

SEQ ID NO: 57218 - DNA, 20 bp, Artificial Sequence
  Synthetic oligonucleotide; TCGGAT chr11 5164140 5164159 5164156 +
acgctctgattcgggagagg

SEQ ID NO: 57219 - DNA, 20 bp, Artificial Sequence
  Synthetic oligonucleotide; CGGAAT chr11 5164237 5164256 5164253 +
aggttggggagggctagtca

SEQ ID NO: 57220 - DNA, 20 bp, Artificial Sequence
  Synthetic oligonucleotide; CCGGGT chr11 5164259 5164278 5164275 +
gaatgaaactgtaaaccgga

SEQ ID NO: 57221 - DNA, 20 bp, Artificial Sequence
  Synthetic oligonucleotide; CAGGGT chr11 5164293 5164312 5164309 +
gggaggtgataaaaagatta

SEQ ID NO: 57222 - DNA, 20 bp, Artificial Sequence
  Synthetic oligonucleotide; ATGGGT chr11 5164378 5164397 5164394 +
gggaggaggggagacgtcag

SEQ ID NO: 57223 - DNA, 20 bp, Artificial Sequence
  Synthetic oligonucleotide; TGGAGT chr11 5164421 5164440 5164437 +
tagaaagactcagcgacgct

SEQ ID NO: 57224 - DNA, 20 bp, Artificial Sequence
  Synthetic oligonucleotide; AAGAAT chr11 5164514 5164533 5164530 +
agggagggaccaatgtgtaa

SEQ ID NO: 57225 - DNA, 20 bp, Artificial Sequence
  Synthetic oligonucleotide; AAGAAT chr11 5164582 5164601 5164598 +
caaaaattatttagatcttg

SEQ ID NO: 57226 - DNA, 20 bp, Artificial Sequence
  Synthetic oligonucleotide; TCGAGT chr11 5164631 5164650 5164647 +
ctggctatttggaaccactg

SEQ ID NO: 57227 - DNA, 20 bp, Artificial Sequence
  Synthetic oligonucleotide; TGGAGT chr11 5164643 5164662 5164659 +
aaccactgtcgagtttgtat

SEQ ID NO: 57228 - DNA, 20 bp, Artificial Sequence
  Synthetic oligonucleotide; GTGAGT chr11 5164697 5164716 5164713 +
atttaggttttaggtcaggt

SEQ ID NO: 57229 - DNA, 20 bp, Artificial Sequence
  Synthetic oligonucleotide; AGGAAT chr11 5164747 5164766 5164763 +
gcacaggctaagggagaggg

SEQ ID NO: 57230 - DNA, 20 bp, Artificial Sequence
  Synthetic oligonucleotide; GAGGGT chr11 5164754 5164773 5164770 +
ctaagggagagggaggaatg

SEQ ID NO: 57231 - DNA, 20 bp, Artificial Sequence
  Synthetic oligonucleotide; AAGAGT chr11 5164802 5164821 5164818 +
aggcaagcccagagaaaaga

SEQ ID NO: 57232 - DNA, 20 bp, Artificial Sequence
  Synthetic oligonucleotide; AGGGGT chr11 5164823 5164842 5164839 +
agagtacagacacggaggga

SEQ ID NO: 57233 - DNA, 20 bp, Artificial Sequence
  Synthetic oligonucleotide; GGGGGT chr11 5164831 5164850 5164847 +
gacacggagggaaggggttc

SEQ ID NO: 57234 - DNA, 20 bp, Artificial Sequence
  Synthetic oligonucleotide; AGGGGT chr11 5164861 5164880 5164877 +
actcaccagaaaaatgggca

SEQ ID NO: 57235 - DNA, 20 bp, Artificial Sequence
  Synthetic oligonucleotide; AGGGGT chr11 5164882 5164901 5164898 +
ggggttggggcacggaaata

SEQ ID NO: 57236 - DNA, 20 bp, Artificial Sequence
  Synthetic oligonucleotide; TGGGGT chr11 5164888 5164907 5164904 +
ggggcacggaaataaggggt

SEQ ID NO: 57237 - DNA, 20 bp, Artificial Sequence
  Synthetic oligonucleotide; AGGGGT chr11 5164924 5164943 5164940 +
gaggtcagggcacagaaata

SEQ ID NO: 57238 - DNA, 20 bp, Artificial Sequence
  Synthetic oligonucleotide; TGGGGT chr11 5164930 5164949 5164946 +
agggcacagaaataaggggt

SEQ ID NO: 57239 - DNA, 20 bp, Artificial Sequence
  Synthetic oligonucleotide; AGGGAT chr11 5164966 5164985 5164982 +
gaggttggggcacagaaata

SEQ ID NO: 57240 - DNA, 20 bp, Artificial Sequence
  Synthetic oligonucleotide; CGGGGT chr11 5164972 5164991 5164988 +
ggggcacagaaataagggat

SEQ ID NO: 57241 - DNA, 20 bp, Artificial Sequence
  Synthetic oligonucleotide; TGGGGT chr11 5164993 5165012 5165009 +
ggggtgcagagataagaggt

SEQ ID NO: 57242 - DNA, 20 bp, Artificial Sequence
  Synthetic oligonucleotide; AGGGAT chr11 5165008 5165027 5165024 +
gaggttggggtgcagaaata

SEQ ID NO: 57243 - DNA, 20 bp, Artificial Sequence
  Synthetic oligonucleotide; CAGGGT chr11 5165014 5165033 5165030 +
ggggtgcagaaataagggat

SEQ ID NO: 57244 - DNA, 20 bp, Artificial Sequence
  Synthetic oligonucleotide; CGGGGT chr11 5165035 5165054 5165051 +
agggtgcagagataagaggt

SEQ ID NO: 57245 - DNA, 20 bp, Artificial Sequence
  Synthetic oligonucleotide; AGGGAT chr11 5165050 5165069 5165066 +
gaggtcggggtgcagaaata

SEQ ID NO: 57246 - DNA, 20 bp, Artificial Sequence
  Synthetic oligonucleotide; TGGGGT chr11 5165056 5165075 5165072 +
ggggtgcagaaataagggat

SEQ ID NO: 57247 - DNA, 20 bp, Artificial Sequence
  Synthetic oligonucleotide; GAGGAT chr11 5165072 5165091 5165088 +
ggattggggtgcagagataa

SEQ ID NO: 57248 - DNA, 20 bp, Artificial Sequence
  Synthetic oligonucleotide; AGGGAT chr11 5165092 5165111 5165108 +
gaggatggggcgtggaaata

SEQ ID NO: 57249 - DNA, 20 bp, Artificial Sequence
  Synthetic oligonucleotide; TGGGGT chr11 5165097 5165116 5165113 +
tggggcgtggaaataaggga

SEQ ID NO: 57250 - DNA, 20 bp, Artificial Sequence
  Synthetic oligonucleotide; AGGGAT chr11 5165133 5165152 5165149 +
gaggttggggcacagaaata

SEQ ID NO: 57251 - DNA, 20 bp, Artificial Sequence
  Synthetic oligonucleotide; TGGGGT chr11 5165139 5165158 5165155 +
ggggcacagaaataagggat

SEQ ID NO: 57252 - DNA, 20 bp, Artificial Sequence
  Synthetic oligonucleotide; AGGGGT chr11 5165189 5165208 5165205 +
ggggcagagacatggagaga

SEQ ID NO: 57253 - DNA, 20 bp, Artificial Sequence
  Synthetic oligonucleotide; TGGGGT chr11 5165195 5165214 5165211 +
gagacatggagagaaggggt

SEQ ID NO: 57254 - DNA, 20 bp, Artificial Sequence
  Synthetic oligonucleotide; TGGGAT chr11 5165222 5165241 5165238 +
cttacccccctccagaaaag

SEQ ID NO: 57255 - DNA, 20 bp, Artificial Sequence
  Synthetic oligonucleotide; AAGGGT chr11 5165236 5165255 5165252 +
gaaaagtgggatttgccgct

SEQ ID NO: 57256 - DNA, 20 bp, Artificial Sequence
  Synthetic oligonucleotide; CGGAGT chr11 5165367 5165386 5165383 +
tcccagtccgtgactggcac

SEQ ID NO: 57257 - DNA, 20 bp, Artificial Sequence
  Synthetic oligonucleotide; TTGGGT chr11 5165374 5165393 5165390 +
ccgtgactggcaccggagtt

SEQ ID NO: 57258 - DNA, 20 bp, Artificial Sequence
  Synthetic oligonucleotide; ACGGAT chr11 5165382 5165401 5165398 +
ggcaccggagttttgggtcc

SEQ ID NO: 57259 - DNA, 20 bp, Artificial Sequence
  Synthetic oligonucleotide; AGGAAT chr11 5165423 5165442 5165439 +
tgtctctactggaaaatgaa

SEQ ID NO: 57260 - DNA, 20 bp, Artificial Sequence
  Synthetic oligonucleotide; AGGGAT chr11 5165490 5165509 5165506 +
ttgaaaggagaaagaagttg

SEQ ID NO: 57261 - DNA, 20 bp, Artificial Sequence
  Synthetic oligonucleotide; CCGGAT chr11 5165537 5165556 5165553 +
cagtaaaaagaggccactta

SEQ ID NO: 57262 - DNA, 20 bp, Artificial Sequence
  Synthetic oligonucleotide; GTGGAT chr11 5165598 5165617 5165614 +
ttgaggacctgaggtcgtag

SEQ ID NO: 57263 - DNA, 20 bp, Artificial Sequence
  Synthetic oligonucleotide; GGGGAT chr11 5165634 5165653 5165650 +
gagcaaagagcaggaggaca

SEQ ID NO: 57264 - DNA, 20 bp, Artificial Sequence
  Synthetic oligonucleotide; CTGAGT chr11 5165666 5165685 5165682 +
cccaagggaggtcccccaat

SEQ ID NO: 57265 - DNA, 20 bp, Artificial Sequence
  Synthetic oligonucleotide; CTGGGT chr11 5165753 5165772 5165769 +
aacaaggctgtttatttcac

SEQ ID NO: 57266 - DNA, 20 bp, Artificial Sequence
  Synthetic oligonucleotide; CTGAGT chr11 5165768 5165787 5165784 +
ttcacctgggtgcaggcagg

SEQ ID NO: 57267 - DNA, 20 bp, Artificial Sequence
  Synthetic oligonucleotide; GAGAGT chr11 5165781 5165800 5165797 +
aggcaggctgagtccaaaaa

SEQ ID NO: 57268 - DNA, 20 bp, Artificial Sequence
  Synthetic oligonucleotide; AGGAGT chr11 5165801 5165820 5165817 +
gagagtcagcaaagggagat

SEQ ID NO: 57269 - DNA, 20 bp, Artificial Sequence
  Synthetic oligonucleotide; TTGGGT chr11 5165825 5165844 5165841 +
gtggggctgttttataagat

SEQ ID NO: 57270 - DNA, 20 bp, Artificial Sequence
  Synthetic oligonucleotide; GGGGGT chr11 5165856 5165875 5165872 +
aaggaaaattacagtcaaag

SEQ ID NO: 57271 - DNA, 20 bp, Artificial Sequence
  Synthetic oligonucleotide; AGGAGT chr11 5165877 5165896 5165893 +
ggggttgttctctggcgggc

SEQ ID NO: 57272 - DNA, 20 bp, Artificial Sequence
  Synthetic oligonucleotide; GGGGGT chr11 5165883 5165902 5165899 +
gttctctggcgggcaggagt

SEQ ID NO: 57273 - DNA, 20 bp, Artificial Sequence
  Synthetic oligonucleotide; CAGGAT chr11 5165920 5165939 5165936 +
cagtaggggagcttttgagc

SEQ ID NO: 57274 - DNA, 20 bp, Artificial Sequence
  Synthetic oligonucleotide; AGGAAT chr11 5165937 5165956 5165953 +
agccaggatgagccaggaga

SEQ ID NO: 57275 - DNA, 20 bp, Artificial Sequence
  Synthetic oligonucleotide; TGGAAT chr11 5166001 5166020 5166017 +
cattttcacttcttttgtgg

SEQ ID NO: 57276 - DNA, 20 bp, Artificial Sequence
  Synthetic oligonucleotide; TTGGGT chr11 5166342 5166361 5166358 +
acaagttctgttaatgtcag

SEQ ID NO: 57277 - DNA, 20 bp, Artificial Sequence
  Synthetic oligonucleotide; GTGGGT chr11 5166360 5166379 5166376 +
agttgggtctattagatata

SEQ ID NO: 57278 - DNA, 20 bp, Artificial Sequence
  Synthetic oligonucleotide; TTGGAT chr11 5166522 5166541 5166538 +
tatacttgggaactttgatg

SEQ ID NO: 57279 - DNA, 20 bp, Artificial Sequence
  Synthetic oligonucleotide; CTGAAT chr11 5166557 5166576 5166573 +
tttataattgtatcctcttg

SEQ ID NO: 57280 - DNA, 20 bp, Artificial Sequence
  Synthetic oligonucleotide; TGGAAT chr11 5166680 5166699 5166696 +
tctttctggtttccagttca

SEQ ID NO: 57281 - DNA, 20 bp, Artificial Sequence
  Synthetic oligonucleotide; GTGGGT chr11 5166733 5166752 5166749 +
tgtgtgcctttataggtgaa

SEQ ID NO: 57282 - DNA, 20 bp, Artificial Sequence
  Synthetic oligonucleotide; TTGGAT chr11 5166759 5166778 5166775 +
ttcttgaagatcgcataaag

SEQ ID NO: 57283 - DNA, 20 bp, Artificial Sequence
  Synthetic oligonucleotide; AAGGAT chr11 5166845 5166864 5166861 +
actcagtgtagttactaagt

SEQ ID NO: 57284 - DNA, 20 bp, Artificial Sequence
  Synthetic oligonucleotide; AAGGAT chr11 5167063 5167082 5167079 +
aaatatagcaagttatttta

SEQ ID NO: 57285 - DNA, 20 bp, Artificial Sequence
  Synthetic oligonucleotide; ACGAAT chr11 5167070 5167089 5167086 +
gcaagttattttaaaggatg

SEQ ID NO: 57286 - DNA, 20 bp, Artificial Sequence
  Synthetic oligonucleotide; AGGAAT chr11 5167095 5167114 5167111 +
ttatcttagatcgcaaataa

SEQ ID NO: 57287 - DNA, 20 bp, Artificial Sequence
  Synthetic oligonucleotide; TTGGGT chr11 5167250 5167269 5167266 +
gtttttgaaagatttgtttt

SEQ ID NO: 57288 - DNA, 20 bp, Artificial Sequence
  Synthetic oligonucleotide; TGGAGT chr11 5167263 5167282 5167279 +
ttgttttttgggtttcatac

SEQ ID NO: 57289 - DNA, 20 bp, Artificial Sequence
  Synthetic oligonucleotide; GTGGAT chr11 5167274 5167293 5167290 +
gtttcatactggagttctgt

SEQ ID NO: 57290 - DNA, 20 bp, Artificial Sequence
  Synthetic oligonucleotide; TGGGGT chr11 5167302 5167321 5167318 +
cacaccaaaaaatacagtaa

SEQ ID NO: 57291 - DNA, 20 bp, Artificial Sequence
  Synthetic oligonucleotide; GTGGGT chr11 5167341 5167360 5167357 +
ctatgtacttaattttacca

SEQ ID NO: 57292 - DNA, 20 bp, Artificial Sequence
  Synthetic oligonucleotide; GTGAAT chr11 5167444 5167463 5167460 +
tgcaagatggtctggtgttg

SEQ ID NO: 57293 - DNA, 20 bp, Artificial Sequence
  Synthetic oligonucleotide; TTGAAT chr11 5167498 5167517 5167514 +
actttatatattgcttatat

SEQ ID NO: 57294 - DNA, 20 bp, Artificial Sequence
  Synthetic oligonucleotide; TTGAAT chr11 5167529 5167548 5167545 +
ttttaccctataaaatattc

SEQ ID NO: 57295 - DNA, 20 bp, Artificial Sequence
  Synthetic oligonucleotide; CAGGAT chr11 5167623 5167642 5167639 +
tattgagatgtttgttgtca

SEQ ID NO: 57296 - DNA, 20 bp, Artificial Sequence
  Synthetic oligonucleotide; TAGGAT chr11 5167674 5167693 5167690 +
tttctcatctcttctgcttt

SEQ ID NO: 57297 - DNA, 20 bp, Artificial Sequence
  Synthetic oligonucleotide; TAGAAT chr11 5167741 5167760 5167757 +
actatatctaggactacact

SEQ ID NO: 57298 - DNA, 20 bp, Artificial Sequence
  Synthetic oligonucleotide; ATGAAT chr11 5167745 5167764 5167761 +
tatctaggactacacttaga

SEQ ID NO: 57299 - DNA, 20 bp, Artificial Sequence
  Synthetic oligonucleotide; GAGAAT chr11 5167883 5167902 5167899 +
tgttggttgaggaagtagaa

SEQ ID NO: 57300 - DNA, 20 bp, Artificial Sequence
  Synthetic oligonucleotide; GTGAGT chr11 5167996 5168015 5168012 +
tataattagaggaaacagag

SEQ ID NO: 57301 - DNA, 20 bp, Artificial Sequence
  Synthetic oligonucleotide; GTGAAT chr11 5168000 5168019 5168016 +
attagaggaaacagaggtga

SEQ ID NO: 57302 - DNA, 20 bp, Artificial Sequence
  Synthetic oligonucleotide; ATGAAT chr11 5168015 5168034 5168031 +
ggtgagtgaattttgtcctc

SEQ ID NO: 57303 - DNA, 20 bp, Artificial Sequence
  Synthetic oligonucleotide; CAGAAT chr11 5168042 5168061 5168058 +
tcaaaggagaaaatggttta

SEQ ID NO: 57304 - DNA, 20 bp, Artificial Sequence
  Synthetic oligonucleotide; CTGAAT chr11 5168086 5168105 5168102 +
ttccaattttaaagtcaaat

SEQ ID NO: 57305 - DNA, 20 bp, Artificial Sequence
  Synthetic oligonucleotide; AAGAAT chr11 5168128 5168147 5168144 +
actgataatatggtgggcta

SEQ ID NO: 57306 - DNA, 20 bp, Artificial Sequence
  Synthetic oligonucleotide; TTGGAT chr11 5168145 5168164 5168161 +
ctaaagaatcaggtttttag

SEQ ID NO: 57307 - DNA, 20 bp, Artificial Sequence
  Synthetic oligonucleotide; TTGAGT chr11 5168160 5168179 5168176 +
tttagttggattgtctggtt

SEQ ID NO: 57308 - DNA, 20 bp, Artificial Sequence
  Synthetic oligonucleotide; GTGGAT chr11 5168285 5168304 5168301 +
tttcttcatatatttgttcc

SEQ ID NO: 57309 - DNA, 20 bp, Artificial Sequence
  Synthetic oligonucleotide; TTGAGT chr11 5168375 5168394 5168391 +
tgactttaatttttatgtac

SEQ ID NO: 57310 - DNA, 20 bp, Artificial Sequence
  Synthetic oligonucleotide; AGGAAT chr11 5168408 5168427 5168424 +
tagcatttagagagactgtc

SEQ ID NO: 57311 - DNA, 20 bp, Artificial Sequence
  Synthetic oligonucleotide; CTGGAT chr11 5168568 5168587 5168584 +
aatcttcaagatcataaaag

SEQ ID NO: 57312 - DNA, 20 bp, Artificial Sequence
  Synthetic oligonucleotide; ATGAAT chr11 5168597 5168616 5168613 +
attttcttattcatttataa

SEQ ID NO: 57313 - DNA, 20 bp, Artificial Sequence
  Synthetic oligonucleotide; TTGGGT chr11 5168726 5168745 5168742 +
tcacactgaggacttggctc

SEQ ID NO: 57314 - DNA, 20 bp, Artificial Sequence
  Synthetic oligonucleotide; AAGAAT chr11 5168803 5168822 5168819 +
agttttttcatgtataccat

SEQ ID NO: 57315 - DNA, 20 bp, Artificial Sequence
  Synthetic oligonucleotide; GAGAAT chr11 5168883 5168902 5168899 +
ctaaattactctgaaatttt

SEQ ID NO: 57316 - DNA, 20 bp, Artificial Sequence
  Synthetic oligonucleotide; TAGGAT chr11 5169108 5169127 5169124 +
ctcaagactgtgtggtttaa

SEQ ID NO: 57317 - DNA, 20 bp, Artificial Sequence
  Synthetic oligonucleotide; AGGGAT chr11 5169186 5169205 5169202 +
ggctctgcaatccctgtctg

SEQ ID NO: 57318 - DNA, 20 bp, Artificial Sequence
  Synthetic oligonucleotide; TAGAAT chr11 5169196 5169215 5169212 +
tccctgtctgagggattttc

SEQ ID NO: 57319 - DNA, 20 bp, Artificial Sequence
  Synthetic oligonucleotide; CCGAGT chr11 5169249 5169268 5169265 +
tgtcagaagcttgtctacta

SEQ ID NO: 57320 - DNA, 20 bp, Artificial Sequence
  Synthetic oligonucleotide; AGGAGT chr11 5169280 5169299 5169296 +
atgtcaccaaagactattgc

SEQ ID NO: 57321 - DNA, 20 bp, Artificial Sequence
  Synthetic oligonucleotide; CTGAGT chr11 5169480 5169499 5169496 +
taagatttaacattagcaca

SEQ ID NO: 57322 - DNA, 20 bp, Artificial Sequence
  Synthetic oligonucleotide; AAGAAT chr11 5169497 5169516 5169513 +
acactgagtataattttttt

SEQ ID NO: 57323 - DNA, 20 bp, Artificial Sequence
  Synthetic oligonucleotide; CAGAAT chr11 5169540 5169559 5169556 +
tgtaaactacacaaagtaaa

SEQ ID NO: 57324 - DNA, 20 bp, Artificial Sequence
  Synthetic oligonucleotide; CAGGGT chr11 5169869 5169888 5169885 +
ttatatccatcagaggtaag

SEQ ID NO: 57325 - DNA, 20 bp, Artificial Sequence
  Synthetic oligonucleotide; CTGAAT chr11 5170057 5170076 5170073 +
attcccagaaccaaatgtca

SEQ ID NO: 57326 - DNA, 20 bp, Artificial Sequence
  Synthetic oligonucleotide; TTGAGT chr11 5170062 5170081 5170078 +
cagaaccaaatgtcactgaa

SEQ ID NO: 57327 - DNA, 20 bp, Artificial Sequence
  Synthetic oligonucleotide; AAGGAT chr11 5170072 5170091 5170088 +
tgtcactgaattgagtattc

SEQ ID NO: 57328 - DNA, 20 bp, Artificial Sequence
  Synthetic oligonucleotide; CAGAGT chr11 5170146 5170165 5170162 +
ctcctcccacaattttattt

SEQ ID NO: 57329 - DNA, 20 bp, Artificial Sequence
  Synthetic oligonucleotide; TGGAAT chr11 5170245 5170264 5170261 +
taacaagcaataataagcca

SEQ ID NO: 57330 - DNA, 20 bp, Artificial Sequence
  Synthetic oligonucleotide; CAGGGT chr11 5170311 5170330 5170327 +
gatctaagtgcctgtgctgt

SEQ ID NO: 57331 - DNA, 20 bp, Artificial Sequence
  Synthetic oligonucleotide; CTGGAT chr11 5170350 5170369 5170366 +
attagaactcacccctcttc

SEQ ID NO: 57332 - DNA, 20 bp, Artificial Sequence
  Synthetic oligonucleotide; GCGAAT chr11 5170376 5170395 5170392 +
agtgtaagaacaacgctgtt

SEQ ID NO: 57333 - DNA, 20 bp, Artificial Sequence
  Synthetic oligonucleotide; TGGGGT chr11 5170408 5170427 5170424 +
gattttgatactatagacaa

SEQ ID NO: 57334 - DNA, 20 bp, Artificial Sequence
  Synthetic oligonucleotide; TTGAGT chr11 5170560 5170579 5170576 +
atatgtgcgacacacatgtg

SEQ ID NO: 57335 - DNA, 20 bp, Artificial Sequence
  Synthetic oligonucleotide; AAGAAT chr11 5170610 5170629 5170626 +
gctatttccagtactgtatg

SEQ ID NO: 57336 - DNA, 20 bp, Artificial Sequence
  Synthetic oligonucleotide; CAGGAT chr11 5170682 5170701 5170698 +
aaggtaatgacaaatagagc

SEQ ID NO: 57337 - DNA, 20 bp, Artificial Sequence
  Synthetic oligonucleotide; CTGAGT chr11 5170729 5170748 5170745 +
acagggcaatttgatcagat

SEQ ID NO: 57338 - DNA, 20 bp, Artificial Sequence
  Synthetic oligonucleotide; AAGAGT chr11 5170744 5170763 5170760 +
cagatctgagtggaggcaat

SEQ ID NO: 57339 - DNA, 20 bp, Artificial Sequence
  Synthetic oligonucleotide; GAGGGT chr11 5170754 5170773 5170770 +
tggaggcaataagagtgtgt

SEQ ID NO: 57340 - DNA, 20 bp, Artificial Sequence
  Synthetic oligonucleotide; CAGAAT chr11 5170868 5170887 5170884 +
ccagaaatgcaggcaattgt

SEQ ID NO: 57341 - DNA, 20 bp, Artificial Sequence
  Synthetic oligonucleotide; AAGAGT chr11 5170949 5170968 5170965 +
agaaggacacctgactccat

SEQ ID NO: 57342 - DNA, 20 bp, Artificial Sequence
  Synthetic oligonucleotide; AAGAGT chr11 5170957 5170976 5170973 +
acctgactccataagagtga

SEQ ID NO: 57343 - DNA, 20 bp, Artificial Sequence
  Synthetic oligonucleotide; AGGAAT chr11 5171019 5171038 5171035 +
tgacatcgttaatgccaaag

SEQ ID NO: 57344 - DNA, 20 bp, Artificial Sequence
  Synthetic oligonucleotide; ATGGGT chr11 5171100 5171119 5171116 +
gcatggccagaaaatagtac

SEQ ID NO: 57345 - DNA, 20 bp, Artificial Sequence
  Synthetic oligonucleotide; AAGAGT chr11 5171116 5171135 5171132 +
gtacatgggttggtgcaagg

SEQ ID NO: 57346 - DNA, 20 bp, Artificial Sequence
  Synthetic oligonucleotide; TCGGAT chr11 5171126 5171145 5171142 +
tggtgcaaggaagagtcaat

SEQ ID NO: 57347 - DNA, 20 bp, Artificial Sequence
  Synthetic oligonucleotide; AAGAAT chr11 5171138 5171157 5171154 +
gagtcaattcggatgatgtg

SEQ ID NO: 57348 - DNA, 20 bp, Artificial Sequence
  Synthetic oligonucleotide; GGGGAT chr11 5171186 5171205 5171202 +
atggtgtatatcaggcagaa

SEQ ID NO: 57349 - DNA, 20 bp, Artificial Sequence
  Synthetic oligonucleotide; ATGGAT chr11 5171190 5171209 5171206 +
tgtatatcaggcagaagggg

SEQ ID NO: 57350 - DNA, 20 bp, Artificial Sequence
  Synthetic oligonucleotide; CGGGAT chr11 5171223 5171242 5171239 +
taatgttctgcctccagtcc

SEQ ID NO: 57351 - DNA, 20 bp, Artificial Sequence
  Synthetic oligonucleotide; GAGAGT chr11 5171235 5171254 5171251 +
tccagtcccgggatgccaac

SEQ ID NO: 57352 - DNA, 20 bp, Artificial Sequence
  Synthetic oligonucleotide; GTGAAT chr11 5171239 5171258 5171255 +
gtcccgggatgccaacgaga

SEQ ID NO: 57353 - DNA, 20 bp, Artificial Sequence
  Synthetic oligonucleotide; GTGAAT chr11 5171254 5171273 5171270 +
cgagagtgaatgttgtaggt

SEQ ID NO: 57354 - DNA, 20 bp, Artificial Sequence
  Synthetic oligonucleotide; TGGAAT chr11 5171326 5171345 5171342 +
attgagaagcacatggagac

SEQ ID NO: 57355 - DNA, 20 bp, Artificial Sequence
  Synthetic oligonucleotide; AGGGAT chr11 5171406 5171425 5171422 +
taagacatttcctcagaaaa

SEQ ID NO: 57356 - DNA, 20 bp, Artificial Sequence
  Synthetic oligonucleotide; GTGAGT chr11 5171452 5171471 5171468 +
aagggcacaggtaagccaca

SEQ ID NO: 57357 - DNA, 20 bp, Artificial Sequence
  Synthetic oligonucleotide; ATGGGT chr11 5171472 5171491 5171488 +
gtgagtggaagagaaaccta

SEQ ID NO: 57358 - DNA, 20 bp, Artificial Sequence
  Synthetic oligonucleotide; TTGGGT chr11 5171540 5171559 5171556 +
gcattaatagaaatctcaag

SEQ ID NO: 57359 - DNA, 20 bp, Artificial Sequence
  Synthetic oligonucleotide; GAGAGT chr11 5171644 5171663 5171660 +
taacttgtagtgtttataaa

SEQ ID NO: 57360 - DNA, 20 bp, Artificial Sequence
  Synthetic oligonucleotide; ATGAAT chr11 5171652 5171671 5171668 +
agtgtttataaagagagtag

SEQ ID NO: 57361 - DNA, 20 bp, Artificial Sequence
  Synthetic oligonucleotide; AAGAGT chr11 5171682 5171701 5171698 +
aaagtaatataacactaata

SEQ ID NO: 57362 - DNA, 20 bp, Artificial Sequence
  Synthetic oligonucleotide; TGGGAT chr11 5171723 5171742 5171739 +
atttaattgacgtgtaatct

SEQ ID NO: 57363 - DNA, 20 bp, Artificial Sequence
  Synthetic oligonucleotide; TGGAAT chr11 5171836 5171855 5171852 +
atattgtttatcattatatg

SEQ ID NO: 57364 - DNA, 20 bp, Artificial Sequence
  Synthetic oligonucleotide; TAGAAT chr11 5171861 5171880 5171877 +
tatagtaaatattaaatgta

SEQ ID NO: 57365 - DNA, 20 bp, Artificial Sequence
  Synthetic oligonucleotide; AAGGAT chr11 5171896 5171915 5171912 +
aatttaatatattagaacac

SEQ ID NO: 57366 - DNA, 20 bp, Artificial Sequence
  Synthetic oligonucleotide; TAGAAT chr11 5171911 5171930 5171927 +
aacacaaggatagtttctcc

SEQ ID NO: 57367 - DNA, 20 bp, Artificial Sequence
  Synthetic oligonucleotide; AAGGGT chr11 5172008 5172027 5172024 +
agctcctctgtattttgcag

SEQ ID NO: 57368 - DNA, 20 bp, Artificial Sequence
  Synthetic oligonucleotide; CCGGGT chr11 5172030 5172049 5172046 +
gggtcagtcttctgctggaa

SEQ ID NO: 57369 - DNA, 20 bp, Artificial Sequence
  Synthetic oligonucleotide; TAGGGT chr11 5172091 5172110 5172107 +
gtcacatgtgatggtggggc

SEQ ID NO: 57370 - DNA, 20 bp, Artificial Sequence
  Synthetic oligonucleotide; TGGAAT chr11 5172194 5172213 5172210 +
ttaacgttggaggccagaaa

SEQ ID NO: 57371 - DNA, 20 bp, Artificial Sequence
  Synthetic oligonucleotide; CAGGAT chr11 5172201 5172220 5172217 +
tggaggccagaaatggaatt

SEQ ID NO: 57372 - DNA, 20 bp, Artificial Sequence
  Synthetic oligonucleotide; AAGAAT chr11 5172220 5172239 5172236 +
tcaggatggggctcagaaat

SEQ ID NO: 57373 - DNA, 20 bp, Artificial Sequence
  Synthetic oligonucleotide; TGGGAT chr11 5172287 5172306 5172303 +
tcttcgttaggcataatcag

SEQ ID NO: 57374 - DNA, 20 bp, Artificial Sequence
  Synthetic oligonucleotide; CAGAAT chr11 5172636 5172655 5172652 +
ttgactggaggacatagaga

SEQ ID NO: 57375 - DNA, 20 bp, Artificial Sequence
  Synthetic oligonucleotide; AAGAAT chr11 5172672 5172691 5172688 +
ccctcaagaagcaattaacc

SEQ ID NO: 57376 - DNA, 20 bp, Artificial Sequence
  Synthetic oligonucleotide; TCGGGT chr11 5172695 5172714 5172711 +
aataattattcccagaaact

SEQ ID NO: 57377 - DNA, 20 bp, Artificial Sequence
  Synthetic oligonucleotide; GGGAAT chr11 5172718 5172737 5172734 +
ggtgtattagagagaaaggg

SEQ ID NO: 57378 - DNA, 20 bp, Artificial Sequence
  Synthetic oligonucleotide; GAGAGT chr11 5172746 5172765 5172762 +
ttcctgagaagcatgctgga

SEQ ID NO: 57379 - DNA, 20 bp, Artificial Sequence
  Synthetic oligonucleotide; CAGAGT chr11 5173012 5173031 5173028 +
aagtaaaaagtggagagatg

SEQ ID NO: 57380 - DNA, 20 bp, Artificial Sequence
  Synthetic oligonucleotide; TTGGAT chr11 5173017 5173036 5173033 +
aaaagtggagagatgcagag

SEQ ID NO: 57381 - DNA, 20 bp, Artificial Sequence
  Synthetic oligonucleotide; AGGGAT chr11 5173049 5173068 5173065 +
ctagagacggaactgcagat

SEQ ID NO: 57382 - DNA, 20 bp, Artificial Sequence
  Synthetic oligonucleotide; GGGGAT chr11 5173077 5173096 5173093 +
tggtgtagatagtaataaag

SEQ ID NO: 57383 - DNA, 20 bp, Artificial Sequence
  Synthetic oligonucleotide; TTGGGT chr11 5173161 5173180 5173177 +
ctgaaatttgtttgggggac

SEQ ID NO: 57384 - DNA, 20 bp, Artificial Sequence
  Synthetic oligonucleotide; TAGAAT chr11 5173170 5173189 5173186 +
gtttgggggacttgggtaat

SEQ ID NO: 57385 - DNA, 20 bp, Artificial Sequence
  Synthetic oligonucleotide; AAGGGT chr11 5173232 5173251 5173248 +
ctaataccaagtataagatc

SEQ ID NO: 57386 - DNA, 20 bp, Artificial Sequence
  Synthetic oligonucleotide; AGGGAT chr11 5173256 5173275 5173272 +
gttggtctccaagcatgatg

SEQ ID NO: 57387 - DNA, 20 bp, Artificial Sequence
  Synthetic oligonucleotide; ATGGAT chr11 5173295 5173314 5173311 +
ttttatatttttatataaat

SEQ ID NO: 57388 - DNA, 20 bp, Artificial Sequence
  Synthetic oligonucleotide; AAGGAT chr11 5173450 5173469 5173466 +
aactttgtattctttcaaat

SEQ ID NO: 57389 - DNA, 20 bp, Artificial Sequence
  Synthetic oligonucleotide; ATGGGT chr11 5173529 5173548 5173545 +
taacaccctcggaaggaagc

SEQ ID NO: 57390 - DNA, 20 bp, Artificial Sequence
  Synthetic oligonucleotide; ATGAGT chr11 5173589 5173608 5173605 +
ttagatatgacacaaaaagt

SEQ ID NO: 57391 - DNA, 20 bp, Artificial Sequence
  Synthetic oligonucleotide; TTGGAT chr11 5173616 5173635 5173632 +
acaaaaaataaatacataaa

SEQ ID NO: 57392 - DNA, 20 bp, Artificial Sequence
  Synthetic oligonucleotide; CAGAAT chr11 5173727 5173746 5173743 +
tatttcataagtttaatatc

SEQ ID NO: 57393 - DNA, 20 bp, Artificial Sequence
  Synthetic oligonucleotide; GGGAAT chr11 5173800 5173819 5173816 +
tttaaaaatatgcaaatgat

SEQ ID NO: 57394 - DNA, 20 bp, Artificial Sequence
  Synthetic oligonucleotide; ATGAGT chr11 5173804 5173823 5173820 +
aaaatatgcaaatgatggga

SEQ ID NO: 57395 - DNA, 20 bp, Artificial Sequence
  Synthetic oligonucleotide; TAGAAT chr11 5173894 5173913 5173910 +
agacactacttcaaacttac

SEQ ID NO: 57396 - DNA, 20 bp, Artificial Sequence
  Synthetic oligonucleotide; TGGAAT chr11 5173965 5173984 5173981 +
tgacaaagatataagaaaat

SEQ ID NO: 57397 - DNA, 20 bp, Artificial Sequence
  Synthetic oligonucleotide; CTGAAT chr11 5174051 5174070 5174067 +
gttcttcaaaaacttaggca

SEQ ID NO: 57398 - DNA, 20 bp, Artificial Sequence
  Synthetic oligonucleotide; CAGAAT chr11 5174181 5174200 5174197 +
agccaaaaggtggaaacaac

SEQ ID NO: 57399 - DNA, 20 bp, Artificial Sequence
  Synthetic oligonucleotide; ATGAAT chr11 5174199 5174218 5174215 +
accagaatgtacataaacag

SEQ ID NO: 57400 - DNA, 20 bp, Artificial Sequence
  Synthetic oligonucleotide; ATGAAT chr11 5174203 5174222 5174219 +
gaatgtacataaacagatga

SEQ ID NO: 57401 - DNA, 20 bp, Artificial Sequence
  Synthetic oligonucleotide; TGGAAT chr11 5174234 5174253 5174250 +
aatgtgatatatacacacaa

SEQ ID NO: 57402 - DNA, 20 bp, Artificial Sequence
  Synthetic oligonucleotide; AAGAAT chr11 5174257 5174276 5174273 +
aatattatgtagcaataaaa

SEQ ID NO: 57403 - DNA, 20 bp, Artificial Sequence
  Synthetic oligonucleotide; ATGAAT chr11 5174297 5174316 5174313 +
gtaagtccttatttaatgtc

SEQ ID NO: 57404 - DNA, 20 bp, Artificial Sequence
  Synthetic oligonucleotide; ATGGAT chr11 5174395 5174414 5174411 +
actgttagatgagaaaaaaa

SEQ ID NO: 57405 - DNA, 20 bp, Artificial Sequence
  Synthetic oligonucleotide; AAGAAT chr11 5174438 5174457 5174454 +
ggcttaaagtttcagtttcc

SEQ ID NO: 57406 - DNA, 20 bp, Artificial Sequence
  Synthetic oligonucleotide; ATGAAT chr11 5174446 5174465 5174462 +
gtttcagtttccaagaatct

SEQ ID NO: 57407 - DNA, 20 bp, Artificial Sequence
  Synthetic oligonucleotide; ATGGAT chr11 5174494 5174513 5174510 +
accactatacatgttatggc

SEQ ID NO: 57408 - DNA, 20 bp, Artificial Sequence
  Synthetic oligonucleotide; TTGGGT chr11 5174518 5174537 5174534 +
atggactttgaaaccttatg

SEQ ID NO: 57409 - DNA, 20 bp, Artificial Sequence
  Synthetic oligonucleotide; ATGAAT chr11 5174557 5174576 5174573 +
cacaaaacaacaaatattgt

SEQ ID NO: 57410 - DNA, 20 bp, Artificial Sequence
  Synthetic oligonucleotide; ATGAAT chr11 5174571 5174590 5174587 +
tattgtatgaatctatttat

SEQ ID NO: 57411 - DNA, 20 bp, Artificial Sequence
  Synthetic oligonucleotide; GGGAGT chr11 5174636 5174655 5174652 +
tagaggttactatgggactg

SEQ ID NO: 57412 - DNA, 20 bp, Artificial Sequence
  Synthetic oligonucleotide; TTGGAT chr11 5174670 5174689 5174686 +
aacaagtatagcatttctgc

SEQ ID NO: 57413 - DNA, 20 bp, Artificial Sequence
  Synthetic oligonucleotide; TAGGGT chr11 5174878 5174897 5174894 +
agacaaatttttattttgat

SEQ ID NO: 57414 - DNA, 20 bp, Artificial Sequence
  Synthetic oligonucleotide; TTGAAT chr11 5174883 5174902 5174899 +
aatttttattttgattaggg

SEQ ID NO: 57415 - DNA, 20 bp, Artificial Sequence
  Synthetic oligonucleotide; TTGAAT chr11 5174888 5174907 5174904 +
ttattttgattagggttgaa

SEQ ID NO: 57416 - DNA, 20 bp, Artificial Sequence
  Synthetic oligonucleotide; ATGAGT chr11 5174899 5174918 5174915 +
agggttgaattgaatttatt

SEQ ID NO: 57417 - DNA, 20 bp, Artificial Sequence
  Synthetic oligonucleotide; GAGAAT chr11 5174914 5174933 5174930 +
ttattatgagttgtttctga

SEQ ID NO: 57418 - DNA, 20 bp, Artificial Sequence
  Synthetic oligonucleotide; TTGGGT chr11 5174992 5175011 5175008 +
tatacagttctattatcatt

SEQ ID NO: 57419 - DNA, 20 bp, Artificial Sequence
  Synthetic oligonucleotide; TGGAGT chr11 5175054 5175073 5175070 +
tatttttggtttttttgaga

SEQ ID NO: 57420 - DNA, 20 bp, Artificial Sequence
  Synthetic oligonucleotide; TAGAGT chr11 5175079 5175098 5175095 +
tctctctctgtggtccaggc

SEQ ID NO: 57421 - DNA, 20 bp, Artificial Sequence
  Synthetic oligonucleotide; CAGAAT chr11 5175123 5175142 5175139 +
ctcactgcaacctccgcctc

SEQ ID NO: 57422 - DNA, 20 bp, Artificial Sequence
  Synthetic oligonucleotide; TGGGAT chr11 5175164 5175183 5175180 +
gcctcagcctcccatgtagc

SEQ ID NO: 57423 - DNA, 20 bp, Artificial Sequence
  Synthetic oligonucleotide; TTGAAT chr11 5175209 5175228 5175225 +
gtctggcctctatcatcatt

SEQ ID NO: 57424 - DNA, 20 bp, Artificial Sequence
  Synthetic oligonucleotide; TTGGAT chr11 5175500 5175519 5175516 +
agtctgtagtggtactggtc

SEQ ID NO: 57425 - DNA, 20 bp, Artificial Sequence
  Synthetic oligonucleotide; AAGGAT chr11 5175804 5175823 5175820 +
ttccctttcccttcctgctg

SEQ ID NO: 57426 - DNA, 20 bp, Artificial Sequence
  Synthetic oligonucleotide; CAGAAT chr11 5175921 5175940 5175937 +
agccatttcctaaatccttt

SEQ ID NO: 57427 - DNA, 20 bp, Artificial Sequence
  Synthetic oligonucleotide; CTGAGT chr11 5175927 5175946 5175943 +
ttcctaaatcctttcagaat

SEQ ID NO: 57428 - DNA, 20 bp, Artificial Sequence
  Synthetic oligonucleotide; TTGGAT chr11 5176091 5176110 5176107 +
gatatcatgttgcatgcatt

SEQ ID NO: 57429 - DNA, 20 bp, Artificial Sequence
  Synthetic oligonucleotide; CTGAGT chr11 5176245 5176264 5176261 +
ttttatggagaaatgcaacg

SEQ ID NO: 57430 - DNA, 20 bp, Artificial Sequence
  Synthetic oligonucleotide; TAGAAT chr11 5176264 5176283 5176280 +
gctgagtgtaaatttcacat

SEQ ID NO: 57431 - DNA, 20 bp, Artificial Sequence
  Synthetic oligonucleotide; TAGAGT chr11 5176285 5176304 5176301 +
agaatgtccaaaacattgtg

SEQ ID NO: 57432 - DNA, 20 bp, Artificial Sequence
  Synthetic oligonucleotide; TAGAAT chr11 5176413 5176432 5176429 +
aacaaattaattagattttt

SEQ ID NO: 57433 - DNA, 20 bp, Artificial Sequence
  Synthetic oligonucleotide; ATGAGT chr11 5176681 5176700 5176697 +
aagctaagcataagccaagc

SEQ ID NO: 57434 - DNA, 20 bp, Artificial Sequence
  Synthetic oligonucleotide; AGGGAT chr11 5176838 5176857 5176854 +
aaaaatttgtattgatgtga

SEQ ID NO: 57435 - DNA, 20 bp, Artificial Sequence
  Synthetic oligonucleotide; TGGGAT chr11 5176887 5176906 5176903 +
tcatagataattacttttgc

SEQ ID NO: 57436 - DNA, 20 bp, Artificial Sequence
  Synthetic oligonucleotide; TTGGGT chr11 5177061 5177080 5177077 +
catgatgctccattgatgac

SEQ ID NO: 57437 - DNA, 20 bp, Artificial Sequence
  Synthetic oligonucleotide; TTGAAT chr11 5177182 5177201 5177198 +
aattcactattattcacttg

SEQ ID NO: 57438 - DNA, 20 bp, Artificial Sequence
  Synthetic oligonucleotide; GTGAGT chr11 5177237 5177256 5177253 +
agagactttgtgagatgtca

SEQ ID NO: 57439 - DNA, 20 bp, Artificial Sequence
  Synthetic oligonucleotide; AGGGAT chr11 5177256 5177275 5177272 +
agtgagttagaaaatattct

SEQ ID NO: 57440 - DNA, 20 bp, Artificial Sequence
  Synthetic oligonucleotide; CAGAGT chr11 5177334 5177353 5177350 +
gttattggttcaagtctctg

SEQ ID NO: 57441 - DNA, 20 bp, Artificial Sequence
  Synthetic oligonucleotide; GGGAGT chr11 5177345 5177364 5177361 +
aagtctctgcagagtacagc

SEQ ID NO: 57442 - DNA, 20 bp, Artificial Sequence
  Synthetic oligonucleotide; CAGAAT chr11 5177365 5177384 5177381 +
gggagtgttgtacatttcag

SEQ ID NO: 57443 - DNA, 20 bp, Artificial Sequence
  Synthetic oligonucleotide; CTGGAT chr11 5177444 5177463 5177460 +
tctacgtaggaaaagtcaat

SEQ ID NO: 57444 - DNA, 20 bp, Artificial Sequence
  Synthetic oligonucleotide; GAGAAT chr11 5177537 5177556 5177553 +
atagtatttctgaaaaaatg

SEQ ID NO: 57445 - DNA, 20 bp, Artificial Sequence
  Synthetic oligonucleotide; TTGAGT chr11 5177580 5177599 5177596 +
tttttcaaaacctttgatct

SEQ ID NO: 57446 - DNA, 20 bp, Artificial Sequence
  Synthetic oligonucleotide; GAGGAT chr11 5177641 5177660 5177657 +
ccatcattttaagtgtgttt

SEQ ID NO: 57447 - DNA, 20 bp, Artificial Sequence
  Synthetic oligonucleotide; ATGGAT chr11 5177651 5177670 5177667 +
aagtgtgtttgaggatttct

SEQ ID NO: 57448 - DNA, 20 bp, Artificial Sequence
  Synthetic oligonucleotide; TGGGGT chr11 5177771 5177790 5177787 +
ggtcttcaccccataaatga

SEQ ID NO: 57449 - DNA, 20 bp, Artificial Sequence
  Synthetic oligonucleotide; TAGGAT chr11 5177814 5177833 5177830 +
aacacatagagactgcccac

SEQ ID NO: 57450 - DNA, 20 bp, Artificial Sequence
  Synthetic oligonucleotide; GTGAAT chr11 5177820 5177839 5177836 +
tagagactgcccactaggat

SEQ ID NO: 57451 - DNA, 20 bp, Artificial Sequence
  Synthetic oligonucleotide; AGGGAT chr11 5177832 5177851 5177848 +
actaggatgtgaatgtggtg

SEQ ID NO: 57452 - DNA, 20 bp, Artificial Sequence
  Synthetic oligonucleotide; AAGAAT chr11 5177872 5177891 5177888 +
agcgatgggcaagaaatgaa

SEQ ID NO: 57453 - DNA, 20 bp, Artificial Sequence
  Synthetic oligonucleotide; TGGGGT chr11 5177880 5177899 5177896 +
gcaagaaatgaaaagaatgc

SEQ ID NO: 57454 - DNA, 20 bp, Artificial Sequence
  Synthetic oligonucleotide; CTGAGT chr11 5177969 5177988 5177985 +
ccaggaagatatctgaaaca

SEQ ID NO: 57455 - DNA, 20 bp, Artificial Sequence
  Synthetic oligonucleotide; AAGGAT chr11 5177976 5177995 5177992 +
gatatctgaaacactgagtg

SEQ ID NO: 57456 - DNA, 20 bp, Artificial Sequence
  Synthetic oligonucleotide; TAGGAT chr11 5177989 5178008 5178005 +
ctgagtgaaggatcattgtg

SEQ ID NO: 57457 - DNA, 20 bp, Artificial Sequence
  Synthetic oligonucleotide; GAGAGT chr11 5178025 5178044 5178041 +
gcactatatccagtcctgta

SEQ ID NO: 57458 - DNA, 20 bp, Artificial Sequence
  Synthetic oligonucleotide; AGGAAT chr11 5178104 5178123 5178120 +
tctggcaatgtgctcacagt

SEQ ID NO: 57459 - DNA, 20 bp, Artificial Sequence
  Synthetic oligonucleotide; AGGAAT chr11 5178111 5178130 5178127 +
atgtgctcacagtaggaatg

SEQ ID NO: 57460 - DNA, 20 bp, Artificial Sequence
  Synthetic oligonucleotide; GTGGGT chr11 5178245 5178264 5178261 +
ggttaaaatggtgtatctca

SEQ ID NO: 57461 - DNA, 20 bp, Artificial Sequence
  Synthetic oligonucleotide; GAGAAT chr11 5178288 5178307 5178304 +
cggtcaaatgccattgccag

SEQ ID NO: 57462 - DNA, 20 bp, Artificial Sequence
  Synthetic oligonucleotide; AAGGAT chr11 5178352 5178371 5178368 +
tctgagacacacaactacca

SEQ ID NO: 57463 - DNA, 20 bp, Artificial Sequence
  Synthetic oligonucleotide; TGGAGT chr11 5178365 5178384 5178381 +
actaccaaaggatatgtcca

SEQ ID NO: 57464 - DNA, 20 bp, Artificial Sequence
  Synthetic oligonucleotide; GAGGAT chr11 5178378 5178397 5178394 +
atgtccatggagtggaacca

SEQ ID NO: 57465 - DNA, 20 bp, Artificial Sequence
  Synthetic oligonucleotide; ATGGAT chr11 5178439 5178458 5178455 +
ggaagtcggctgaggccagc

SEQ ID NO: 57466 - DNA, 20 bp, Artificial Sequence
  Synthetic oligonucleotide; AGGGAT chr11 5178543 5178562 5178559 +
acaatgtacataaaagaaaa

SEQ ID NO: 57467 - DNA, 20 bp, Artificial Sequence
  Synthetic oligonucleotide; TGGGAT chr11 5178579 5178598 5178595 +
gtatgcaagccttccagccc

SEQ ID NO: 57468 - DNA, 20 bp, Artificial Sequence
  Synthetic oligonucleotide; GGGAAT chr11 5178611 5178630 5178627 +
caggacataccacacatcct

SEQ ID NO: 57469 - DNA, 20 bp, Artificial Sequence
  Synthetic oligonucleotide; GAGGAT chr11 5178695 5178714 5178711 +
tagtgaaagactacaaagtt

SEQ ID NO: 57470 - DNA, 20 bp, Artificial Sequence
  Synthetic oligonucleotide; CTGAAT chr11 5178720 5178739 5178736 +
tttagaaacactaccttagg

SEQ ID NO: 57471 - DNA, 20 bp, Artificial Sequence
  Synthetic oligonucleotide; GAGAGT chr11 5178776 5178795 5178792 +
tgttttcttctctgggaaag

SEQ ID NO: 57472 - DNA, 20 bp, Artificial Sequence
  Synthetic oligonucleotide; ATGGGT chr11 5178785 5178804 5178801 +
ctctgggaaaggagagtaaa

SEQ ID NO: 57473 - DNA, 20 bp, Artificial Sequence
  Synthetic oligonucleotide; CCGAAT chr11 5178798 5178817 5178814 +
gagtaaaatgggttaataga

SEQ ID NO: 57474 - DNA, 20 bp, Artificial Sequence
  Synthetic oligonucleotide; CTGGAT chr11 5179025 5179044 5179041 +
gcctcttaccctaggcccta

SEQ ID NO: 57475 - DNA, 20 bp, Artificial Sequence
  Synthetic oligonucleotide; CAGGAT chr11 5179042 5179061 5179058 +
ctactggatttaaagtaagg

SEQ ID NO: 57476 - DNA, 20 bp, Artificial Sequence
  Synthetic oligonucleotide; GAGAGT chr11 5179157 5179176 5179173 +
tcatatccctaaggaaaata

SEQ ID NO: 57477 - DNA, 20 bp, Artificial Sequence
  Synthetic oligonucleotide; GGGAAT chr11 5179198 5179217 5179214 +
tgctgcttacagaaatggga

SEQ ID NO: 57478 - DNA, 20 bp, Artificial Sequence
  Synthetic oligonucleotide; TAGGAT chr11 5179353 5179372 5179369 +
taatctatttctcaaaaata

SEQ ID NO: 57479 - DNA, 20 bp, Artificial Sequence
  Synthetic oligonucleotide; CTGGGT chr11 5179400 5179419 5179416 +
atttgcaatggcagacggag

SEQ ID NO: 57480 - DNA, 20 bp, Artificial Sequence
  Synthetic oligonucleotide; GCGGGT chr11 5179474 5179493 5179490 +
cagcactttgagaggctgag

SEQ ID NO: 57481 - DNA, 20 bp, Artificial Sequence
  Synthetic oligonucleotide; AGGAGT chr11 5179493 5179512 5179509 +
ggcgggtagatcacaaggtc

SEQ ID NO: 57482 - DNA, 20 bp, Artificial Sequence
  Synthetic oligonucleotide; GAGAAT chr11 5179611 5179630 5179627 +
tactcaagaggctgaggcag

SEQ ID NO: 57483 - DNA, 20 bp, Artificial Sequence
  Synthetic oligonucleotide; AAGAAT chr11 5179734 5179753 5179750 +
tatatgcctcataggtggta

SEQ ID NO: 57484 - DNA, 20 bp, Artificial Sequence
  Synthetic oligonucleotide; TAGGGT chr11 5179833 5179852 5179849 +
gtttattatactttaagttc

SEQ ID NO: 57485 - DNA, 20 bp, Artificial Sequence
  Synthetic oligonucleotide; ATGAGT chr11 5180034 5180053 5180050 +
tcattgttcaactcccacct

SEQ ID NO: 57486 - DNA, 20 bp, Artificial Sequence
  Synthetic oligonucleotide; GAGAAT chr11 5180040 5180059 5180056 +
ttcaactcccacctatgagt

SEQ ID NO: 57487 - DNA, 20 bp, Artificial Sequence
  Synthetic oligonucleotide; CAGAAT chr11 5180084 5180103 5180100 +
cgtccttgcgatactttgct

SEQ ID NO: 57488 - DNA, 20 bp, Artificial Sequence
  Synthetic oligonucleotide; TTGGGT chr11 5180214 5180233 5180230 +
agtctatcattgttggacat

SEQ ID NO: 57489 - DNA, 20 bp, Artificial Sequence
  Synthetic oligonucleotide; GTGAAT chr11 5180241 5180260 5180257 +
ggttccaagtctttgctatt

SEQ ID NO: 57490 - DNA, 20 bp, Artificial Sequence
  Synthetic oligonucleotide; TTGGGT chr11 5180305 5180324 5180321 +
gcagcatgatttacattcct

SEQ ID NO: 57491 - DNA, 20 bp, Artificial Sequence
  Synthetic oligonucleotide; TAGGAT chr11 5180324 5180343 5180340 +
tttgggtatatacccagtaa

SEQ ID NO: 57492 - DNA, 20 bp, Artificial Sequence
  Synthetic oligonucleotide; CTGGGT chr11 5180332 5180351 5180348 +
tatacccagtaataggatgg

SEQ ID NO: 57493 - DNA, 20 bp, Artificial Sequence
  Synthetic oligonucleotide; AGGAAT chr11 5180367 5180386 5180383 +
tttctagttctagatccctg

SEQ ID NO: 57494 - DNA, 20 bp, Artificial Sequence
  Synthetic oligonucleotide; TTGAGT chr11 5180676 5180695 5180692 +
tttttttcttgtaaatttgt

SEQ ID NO: 57495 - DNA, 20 bp, Artificial Sequence
  Synthetic oligonucleotide; CTGGAT chr11 5180694 5180713 5180710 +
gtttgagttcattgtagatt

SEQ ID NO: 57496 - DNA, 20 bp, Artificial Sequence
  Synthetic oligonucleotide; ATGAGT chr11 5180716 5180735 5180732 +
ggatattagccctttgtcag

SEQ ID NO: 57497 - DNA, 20 bp, Artificial Sequence
  Synthetic oligonucleotide; CTGAAT chr11 5180891 5180910 5180907 +
tccttgcccatgcctatgtc

SEQ ID NO: 57498 - DNA, 20 bp, Artificial Sequence
  Synthetic oligonucleotide; AGGGAT chr11 5180995 5181014 5181011 +
ttttgtataaggtgtaagga

SEQ ID NO: 57499 - DNA, 20 bp, Artificial Sequence
  Synthetic oligonucleotide; GGGAAT chr11 5181058 5181077 5181074 +
ccagcatcatttattaaata

SEQ ID NO: 57500 - DNA, 20 bp, Artificial Sequence
  Synthetic oligonucleotide; GTGGAT chr11 5181113 5181132 5181129 +
ttgtcaaagatcagatagtt

SEQ ID NO: 57501 - DNA, 20 bp, Artificial Sequence
  Synthetic oligonucleotide; TAGGAT chr11 5181265 5181284 5181281 +
ctagctttgttcttttggct

SEQ ID NO: 57502 - DNA, 20 bp, Artificial Sequence
  Synthetic oligonucleotide; GGGGAT chr11 5181361 5181380 5181377 +
aaagtcattggtagcttgat

SEQ ID NO: 57503 - DNA, 20 bp, Artificial Sequence
  Synthetic oligonucleotide; TTGAAT chr11 5181371 5181390 5181387 +
gtagcttgatggggatggca

SEQ ID NO: 57504 - DNA, 20 bp, Artificial Sequence
  Synthetic oligonucleotide; TGGAAT chr11 5181439 5181458 5181455 +
attcttcctatccatgagca

SEQ ID NO: 57505 - DNA, 20 bp, Artificial Sequence
  Synthetic oligonucleotide; TTGGAT chr11 5181532 5181551 5181548 +
tccttcacatcccttgtaag

SEQ ID NO: 57506 - DNA, 20 bp, Artificial Sequence
  Synthetic oligonucleotide; GTGAAT chr11 5181569 5181588 5181585 +
ttattctctttgaggcaatt

SEQ ID NO: 57507 - DNA, 20 bp, Artificial Sequence
  Synthetic oligonucleotide; GGGAGT chr11 5181575 5181594 5181591 +
tctttgaggcaattgtgaat

SEQ ID NO: 57508 - DNA, 20 bp, Artificial Sequence
  Synthetic oligonucleotide; AGGAAT chr11 5181623 5181642 5181639 +
tttgtctgttattggtgtat

SEQ ID NO: 57509 - DNA, 20 bp, Artificial Sequence
  Synthetic oligonucleotide; TGGGGT chr11 5181714 5181733 5181730 +
gagattttgggctgagacga

SEQ ID NO: 57510 - DNA, 20 bp, Artificial Sequence
  Synthetic oligonucleotide; TTGAAT chr11 5181781 5181800 5181797 +
ttcacttcctcttttcctaa

SEQ ID NO: 57511 - DNA, 20 bp, Artificial Sequence
  Synthetic oligonucleotide; TTGAAT chr11 5181842 5181861 5181858 +
ccagaacttccaacactatg

SEQ ID NO: 57512 - DNA, 20 bp, Artificial Sequence
  Synthetic oligonucleotide; AGGAGT chr11 5181848 5181867 5181864 +
cttccaacactatgttgaat

SEQ ID NO: 57513 - DNA, 20 bp, Artificial Sequence
  Synthetic oligonucleotide; GGGAAT chr11 5181893 5181912 5181909 +
gtcttgtgccagttttcaaa

SEQ ID NO: 57514 - DNA, 20 bp, Artificial Sequence
  Synthetic oligonucleotide; GTGGGT chr11 5181935 5181954 5181951 +
cattcagtatgatattggct

SEQ ID NO: 57515 - DNA, 20 bp, Artificial Sequence
  Synthetic oligonucleotide; GAGAGT chr11 5181997 5182016 5182013 +
ccatcgatacctaatttatt

SEQ ID NO: 57516 - DNA, 20 bp, Artificial Sequence
  Synthetic oligonucleotide; TTGAAT chr11 5182021 5182040 5182037 +
gtttttagtatgaagcattg

SEQ ID NO: 57517 - DNA, 20 bp, Artificial Sequence
  Synthetic oligonucleotide; CTGGAT chr11 5182096 5182115 5182112 +
tctttggttctgtttatatg

SEQ ID NO: 57518 - DNA, 20 bp, Artificial Sequence
  Synthetic oligonucleotide; AGGGAT chr11 5182144 5182163 5182160 +
ttgaaccagccctgcatccc

SEQ ID NO: 57519 - DNA, 20 bp, Artificial Sequence
  Synthetic oligonucleotide; GTGGAT chr11 5182168 5182187 5182184 +
atgaagcccacttgatcatg

SEQ ID NO: 57520 - DNA, 20 bp, Artificial Sequence
  Synthetic oligonucleotide; CTGGAT chr11 5182192 5182211 5182208 +
ataagctttttgatgtgctc

SEQ ID NO: 57521 - DNA, 20 bp, Artificial Sequence
  Synthetic oligonucleotide; GAGGAT chr11 5182219 5182238 5182235 +
tggtttgccagtattttact

SEQ ID NO: 57522 - DNA, 20 bp, Artificial Sequence
  Synthetic oligonucleotide; AGGGAT chr11 5182244 5182263 5182260 +
tttttgcatcgatgttcatc

SEQ ID NO: 57523 - DNA, 20 bp, Artificial Sequence
  Synthetic oligonucleotide; ATGAGT chr11 5182323 5182342 5182339 +
gatgatgctggcctcataaa

SEQ ID NO: 57524 - DNA, 20 bp, Artificial Sequence
  Synthetic oligonucleotide; GAGGAT chr11 5182333 5182352 5182349 +
gcctcataaaatgagttagg

SEQ ID NO: 57525 - DNA, 20 bp, Artificial Sequence
  Synthetic oligonucleotide; TGGAAT chr11 5182358 5182377 5182374 +
ttccctctttttctattgat

SEQ ID NO: 57526 - DNA, 20 bp, Artificial Sequence
  Synthetic oligonucleotide; AGGAAT chr11 5182373 5182392 5182389 +
ttgattggaatagtttcaga

SEQ ID NO: 57527 - DNA, 20 bp, Artificial Sequence
  Synthetic oligonucleotide; TAGAAT chr11 5182406 5182425 5182422 +
gctcctccttgtacctctgg

SEQ ID NO: 57528 - DNA, 20 bp, Artificial Sequence
  Synthetic oligonucleotide; GTGAAT chr11 5182418 5182437 5182434 +
acctctggtagaattcggct

SEQ ID NO: 57529 - DNA, 20 bp, Artificial Sequence
  Synthetic oligonucleotide; CAGGAT chr11 5182677 5182696 5182693 +
accagctaacatcataatga

SEQ ID NO: 57530 - DNA, 20 bp, Artificial Sequence
  Synthetic oligonucleotide; TTGGAT chr11 5182759 5182778 5182775 +
aaaagacacagactggcaaa

SEQ ID NO: 57531 - DNA, 20 bp, Artificial Sequence
  Synthetic oligonucleotide; AAGAGT chr11 5182766 5182785 5182782 +
acagactggcaaattggata

SEQ ID NO: 57532 - DNA, 20 bp, Artificial Sequence
  Synthetic oligonucleotide; AGGGAT chr11 5182842 5182861 5182858 +
cacacataggctcaaaataa

SEQ ID NO: 57533 - DNA, 20 bp, Artificial Sequence
  Synthetic oligonucleotide; CAGGGT chr11 5182888 5182907 5182904 +
aatggaaaacaaaaaaaagg

SEQ ID NO: 57534 - DNA, 20 bp, Artificial Sequence
  Synthetic oligonucleotide; AGGGAT chr11 5182975 5182994 5182991 +
aggccattacatactggtaa

SEQ ID NO: 57535 - DNA, 20 bp, Artificial Sequence
  Synthetic oligonucleotide; AAGGAT chr11 5183160 5183179 5183176 +
caacgagacagaaagttaac

SEQ ID NO: 57536 - DNA, 20 bp, Artificial Sequence
  Synthetic oligonucleotide; AGGAAT chr11 5183170 5183189 5183186 +
gaaagttaacaaggatatcc

SEQ ID NO: 57537 - DNA, 20 bp, Artificial Sequence
  Synthetic oligonucleotide; TTGAAT chr11 5183175 5183194 5183191 +
ttaacaaggatatccaggaa

SEQ ID NO: 57538 - DNA, 20 bp, Artificial Sequence
  Synthetic oligonucleotide; TAGAAT chr11 5183239 5183258 5183255 +
aactctccatcccaaatcaa

SEQ ID NO: 57539 - DNA, 20 bp, Artificial Sequence
  Synthetic oligonucleotide; CAGGAT chr11 5183382 5183401 5183398 +
agtgcaatcaaactagaact

SEQ ID NO: 57540 - DNA, 20 bp, Artificial Sequence
  Synthetic oligonucleotide; CTGAAT chr11 5183440 5183459 5183456 +
ggaaactgaacagcctgctc

SEQ ID NO: 57541 - DNA, 20 bp, Artificial Sequence
  Synthetic oligonucleotide; CTGGGT chr11 5183451 5183470 5183467 +
agcctgctcctgaatgacta

SEQ ID NO: 57542 - DNA, 20 bp, Artificial Sequence
  Synthetic oligonucleotide; GAGAAT chr11 5183503 5183522 5183519 +
agatgttctttgaaaccaac

SEQ ID NO: 57543 - DNA, 20 bp, Artificial Sequence
  Synthetic oligonucleotide; CAGAAT chr11 5183524 5183543 5183540 +
agaataaagatacaacaaaa

SEQ ID NO: 57544 - DNA, 20 bp, Artificial Sequence
  Synthetic oligonucleotide; ATGAAT chr11 5183750 5183769 5183766 +
aaaaacccttaaaaaaatca

SEQ ID NO: 57545 - DNA, 20 bp, Artificial Sequence
  Synthetic oligonucleotide; GGGGAT chr11 5183863 5183882 5183879 +
atgcaataagaaatgataaa

SEQ ID NO: 57546 - DNA, 20 bp, Artificial Sequence
  Synthetic oligonucleotide; GAGAAT chr11 5183906 5183925 5183922 +
agacatacaaactaccatca

SEQ ID NO: 57547 - DNA, 20 bp, Artificial Sequence
  Synthetic oligonucleotide; ATGGAT chr11 5183956 5183975 5183972 +
aactagaaaatctagtagaa

SEQ ID NO: 57548 - DNA, 20 bp, Artificial Sequence
  Synthetic oligonucleotide; TTGAAT chr11 5184008 5184027 5184024 +
aagactaaaccagggagaaa

SEQ ID NO: 57549 - DNA, 20 bp, Artificial Sequence
  Synthetic oligonucleotide; AGGAGT chr11 5184129 5184148 5184145 +
atgttttcacattataaaac

SEQ ID NO: 57550 - DNA, 20 bp, Artificial Sequence
  Synthetic oligonucleotide; GTGGAT chr11 5184188 5184207 5184204 +
aattactagttctaaaaaat

SEQ ID NO: 57551 - DNA, 20 bp, Artificial Sequence
  Synthetic oligonucleotide; TTGAGT chr11 5184210 5184229 5184226 +
ggatagaagcaagtttaata

SEQ ID NO: 57552 - DNA, 20 bp, Artificial Sequence
  Synthetic oligonucleotide; CAGGGT chr11 5184243 5184262 5184259 +
aagattaggagatgcaacac

SEQ ID NO: 57553 - DNA, 20 bp, Artificial Sequence
  Synthetic oligonucleotide; ATGGGT chr11 5184371 5184390 5184387 +
atagatagatagatagatgc

SEQ ID NO: 57554 - DNA, 20 bp, Artificial Sequence
  Synthetic oligonucleotide; GTGAAT chr11 5184397 5184416 5184413 +
ataaacatagataataatat

SEQ ID NO: 57555 - DNA, 20 bp, Artificial Sequence
  Synthetic oligonucleotide; TTGGGT chr11 5184628 5184647 5184644 +
attttatatgatggaaatgt

SEQ ID NO: 57556 - DNA, 20 bp, Artificial Sequence
  Synthetic oligonucleotide; TTGAGT chr11 5184642 5184661 5184658 +
aaatgtttgggtcccatttt

SEQ ID NO: 57557 - DNA, 20 bp, Artificial Sequence
  Synthetic oligonucleotide; TAGAAT chr11 5184655 5184674 5184671 +
ccattttttgagttacagtt

SEQ ID NO: 57558 - DNA, 20 bp, Artificial Sequence
  Synthetic oligonucleotide; TGGAAT chr11 5184704 5184723 5184720 +
aatttacccttgctttaagt

SEQ ID NO: 57559 - DNA, 20 bp, Artificial Sequence
  Synthetic oligonucleotide; GTGGAT chr11 5184757 5184776 5184773 +
atttgaagttatttaactct

SEQ ID NO: 57560 - DNA, 20 bp, Artificial Sequence
  Synthetic oligonucleotide; TAGAAT chr11 5184818 5184837 5184834 +
taatatatatctcacattgt

SEQ ID NO: 57561 - DNA, 20 bp, Artificial Sequence
  Synthetic oligonucleotide; AAGAAT chr11 5184859 5184878 5184875 +
ttgatgtttcagagaaagga

SEQ ID NO: 57562 - DNA, 20 bp, Artificial Sequence
  Synthetic oligonucleotide; GTGAGT chr11 5184910 5184929 5184926 +
tctaggccagagccatgcat

SEQ ID NO: 57563 - DNA, 20 bp, Artificial Sequence
  Synthetic oligonucleotide; GAGGGT chr11 5184935 5184954 5184951 +
tgaagcgtagttatagaagt

SEQ ID NO: 57564 - DNA, 20 bp, Artificial Sequence
  Synthetic oligonucleotide; AGGGAT chr11 5184970 5184989 5184986 +
tggggcttcatcaggacatt

SEQ ID NO: 57565 - DNA, 20 bp, Artificial Sequence
  Synthetic oligonucleotide; AAGAAT chr11 5184983 5185002 5184999 +
ggacattagggatgggagag

SEQ ID NO: 57566 - DNA, 20 bp, Artificial Sequence
  Synthetic oligonucleotide; AGGAAT chr11 5185008 5185027 5185024 +
tctaagtgaaaaaaaaatac

SEQ ID NO: 57567 - DNA, 20 bp, Artificial Sequence
  Synthetic oligonucleotide; CTGGGT chr11 5185157 5185176 5185173 +
tgatgacccaaattataggc

SEQ ID NO: 57568 - DNA, 20 bp, Artificial Sequence
  Synthetic oligonucleotide; TAGGAT chr11 5185180 5185199 5185196 +
ggttccttgtagcattattc

SEQ ID NO: 57569 - DNA, 20 bp, Artificial Sequence
  Synthetic oligonucleotide; CTGAAT chr11 5185207 5185226 5185223 +
tttctgacagcatattctga

SEQ ID NO: 57570 - DNA, 20 bp, Artificial Sequence
  Synthetic oligonucleotide; ATGAAT chr11 5185214 5185233 5185230 +
cagcatattctgactgaatc

SEQ ID NO: 57571 - DNA, 20 bp, Artificial Sequence
  Synthetic oligonucleotide; GTGAGT chr11 5185400 5185419 5185416 +
aataagcataaatttaaaat

SEQ ID NO: 57572 - DNA, 20 bp, Artificial Sequence
  Synthetic oligonucleotide; TGGAAT chr11 5185528 5185547 5185544 +
agaccaaaattattgtcaac

SEQ ID NO: 57573 - DNA, 20 bp, Artificial Sequence
  Synthetic oligonucleotide; TTGAAT chr11 5185580 5185599 5185596 +
tattatccatcaaactgaga

SEQ ID NO: 57574 - DNA, 20 bp, Artificial Sequence
  Synthetic oligonucleotide; TAGAGT chr11 5185591 5185610 5185607 +
aaactgagattgaattgatt

SEQ ID NO: 57575 - DNA, 20 bp, Artificial Sequence
  Synthetic oligonucleotide; AGGAAT chr11 5185610 5185629 5185626 +
ttagagtatccataaatact

SEQ ID NO: 57576 - DNA, 20 bp, Artificial Sequence
  Synthetic oligonucleotide; ATGAAT chr11 5185732 5185751 5185748 +
ttcagcatggtgacagacac

SEQ ID NO: 57577 - DNA, 20 bp, Artificial Sequence
  Synthetic oligonucleotide; TGGAGT chr11 5185745 5185764 5185761 +
cagacacatgaattttgaaa

SEQ ID NO: 57578 - DNA, 20 bp, Artificial Sequence
  Synthetic oligonucleotide; GAGAGT chr11 5185798 5185817 5185814 +
tatctttgttacatagggaa

SEQ ID NO: 57579 - DNA, 20 bp, Artificial Sequence
  Synthetic oligonucleotide; TGGAGT chr11 5185813 5185832 5185829 +
gggaagagagttaaaaattt

SEQ ID NO: 57580 - DNA, 20 bp, Artificial Sequence
  Synthetic oligonucleotide; ATGAGT chr11 5185854 5185873 5185870 +
tgtgcctagactattacctg

SEQ ID NO: 57581 - DNA, 20 bp, Artificial Sequence
  Synthetic oligonucleotide; TAGAAT chr11 5185946 5185965 5185962 +
ctgagccttgttttaactac

SEQ ID NO: 57582 - DNA, 20 bp, Artificial Sequence
  Synthetic oligonucleotide; TTGAAT chr11 5185961 5185980 5185977 +
actactagaatataaattca

SEQ ID NO: 57583 - DNA, 20 bp, Artificial Sequence
  Synthetic oligonucleotide; ATGGGT chr11 5186132 5186151 5186148 +
aaagccaagtctagtattcc

SEQ ID NO: 57584 - DNA, 20 bp, Artificial Sequence
  Synthetic oligonucleotide; AAGAAT chr11 5186176 5186195 5186192 +
ttagatgattaagttatcgg

SEQ ID NO: 57585 - DNA, 20 bp, Artificial Sequence
  Synthetic oligonucleotide; TAGAAT chr11 5186276 5186295 5186292 +
gtttacttacttgcattttc

SEQ ID NO: 57586 - DNA, 20 bp, Artificial Sequence
  Synthetic oligonucleotide; ACGAAT chr11 5186401 5186420 5186417 +
aaggttttcagcttaagagg

SEQ ID NO: 57587 - DNA, 20 bp, Artificial Sequence
  Synthetic oligonucleotide; ATGGGT chr11 5186749 5186768 5186765 +
ttttcttggtcacatggtaa

SEQ ID NO: 57588 - DNA, 20 bp, Artificial Sequence
  Synthetic oligonucleotide; CAGAAT chr11 5186755 5186774 5186771 +
tggtcacatggtaaatgggt

SEQ ID NO: 57589 - DNA, 20 bp, Artificial Sequence
  Synthetic oligonucleotide; AAGGAT chr11 5186811 5186830 5186827 +
gtagatatcccattctcttg

SEQ ID NO: 57590 - DNA, 20 bp, Artificial Sequence
  Synthetic oligonucleotide; AGGAAT chr11 5186826 5186845 5186842 +
tcttgaaggatactttaatg

SEQ ID NO: 57591 - DNA, 20 bp, Artificial Sequence
  Synthetic oligonucleotide; TGGAAT chr11 5186875 5186894 5186891 +
aacaaataccatgatattca

SEQ ID NO: 57592 - DNA, 20 bp, Artificial Sequence
  Synthetic oligonucleotide; AAGAAT chr11 5186985 5187004 5187001 +
tgattttctgatatttttca

SEQ ID NO: 57593 - DNA, 20 bp, Artificial Sequence
  Synthetic oligonucleotide; CTGGAT chr11 5187087 5187106 5187103 +
ttgacatcagctgaccctga

SEQ ID NO: 57594 - DNA, 20 bp, Artificial Sequence
  Synthetic oligonucleotide; TTGGAT chr11 5187101 5187120 5187117 +
ccctgactggatgatcttga

SEQ ID NO: 57595 - DNA, 20 bp, Artificial Sequence
  Synthetic oligonucleotide; GTGAGT chr11 5187194 5187213 5187210 +
tcatattttattacgtaagt

SEQ ID NO: 57596 - DNA, 20 bp, Artificial Sequence
  Synthetic oligonucleotide; AAGAAT chr11 5187219 5187238 5187235 +
tgctatatggtgggagatat

SEQ ID NO: 57597 - DNA, 20 bp, Artificial Sequence
  Synthetic oligonucleotide; GAGGGT chr11 5187275 5187294 5187291 +
aaaggtcttgaaaccatagt

SEQ ID NO: 57598 - DNA, 20 bp, Artificial Sequence
  Synthetic oligonucleotide; TTGGAT chr11 5187284 5187303 5187300 +
gaaaccatagtgagggtaaa

SEQ ID NO: 57599 - DNA, 20 bp, Artificial Sequence
  Synthetic oligonucleotide; AGGAAT chr11 5187366 5187385 5187382 +
atccttggaaaagaaattaa

SEQ ID NO: 57600 - DNA, 20 bp, Artificial Sequence
  Synthetic oligonucleotide; AAGGAT chr11 5187374 5187393 5187390 +
aaaagaaattaaaggaatca

SEQ ID NO: 57601 - DNA, 20 bp, Artificial Sequence
  Synthetic oligonucleotide; GAGAAT chr11 5187411 5187430 5187427 +
agagatggagaaaggacaag

SEQ ID NO: 57602 - DNA, 20 bp, Artificial Sequence
  Synthetic oligonucleotide; AAGAAT chr11 5187476 5187495 5187492 +
tgatagtgacaggaagaaca

SEQ ID NO: 57603 - DNA, 20 bp, Artificial Sequence
  Synthetic oligonucleotide; TAGAAT chr11 5187481 5187500 5187497 +
gtgacaggaagaacaaagaa

SEQ ID NO: 57604 - DNA, 20 bp, Artificial Sequence
  Synthetic oligonucleotide; AAGAAT chr11 5187551 5187570 5187567 +
tctggggactctaaaacttg

SEQ ID NO: 57605 - DNA, 20 bp, Artificial Sequence
  Synthetic oligonucleotide; ATGAAT chr11 5187804 5187823 5187820 +
aaaataattttccaattttt

SEQ ID NO: 57606 - DNA, 20 bp, Artificial Sequence
  Synthetic oligonucleotide; TGGAAT chr11 5187847 5187866 5187863 +
acatcaagtaacaatatcat

SEQ ID NO: 57607 - DNA, 20 bp, Artificial Sequence
  Synthetic oligonucleotide; TAGAAT chr11 5187936 5187955 5187952 +
gggaacatgtaagtattatg

SEQ ID NO: 57608 - DNA, 20 bp, Artificial Sequence
  Synthetic oligonucleotide; ATGGAT chr11 5188040 5188059 5188056 +
gactcagtttttaaatttct

SEQ ID NO: 57609 - DNA, 20 bp, Artificial Sequence
  Synthetic oligonucleotide; ATGGAT chr11 5188055 5188074 5188071 +
tttctatggatttcaaggaa

SEQ ID NO: 57610 - DNA, 20 bp, Artificial Sequence
  Synthetic oligonucleotide; AAGGAT chr11 5188133 5188152 5188149 +
tgatttagtatctgtaaatt

SEQ ID NO: 57611 - DNA, 20 bp, Artificial Sequence
  Synthetic oligonucleotide; TTGGAT chr11 5188140 5188159 5188156 +
gtatctgtaaattaaggatg

SEQ ID NO: 57612 - DNA, 20 bp, Artificial Sequence
  Synthetic oligonucleotide; TTGAGT chr11 5188196 5188215 5188212 +
aatatgtaagatacttctaa

SEQ ID NO: 57613 - DNA, 20 bp, Artificial Sequence
  Synthetic oligonucleotide; CTGGAT chr11 5188234 5188253 5188250 +
tctataggtaaattagtgtc

SEQ ID NO: 57614 - DNA, 20 bp, Artificial Sequence
  Synthetic oligonucleotide; TTGAGT chr11 5188306 5188325 5188322 +
cctttatcttactatgggac

SEQ ID NO: 57615 - DNA, 20 bp, Artificial Sequence
  Synthetic oligonucleotide; AAGAAT chr11 5188328 5188347 5188344 +
gagtggaggaaatccaagaa

SEQ ID NO: 57616 - DNA, 20 bp, Artificial Sequence
  Synthetic oligonucleotide; GGGAGT chr11 5188414 5188433 5188430 +
atttgtaagttagtaaagct

SEQ ID NO: 57617 - DNA, 20 bp, Artificial Sequence
  Synthetic oligonucleotide; GGGAGT chr11 5188436 5188455 5188452 +
gagttggtgctagtaaagct

SEQ ID NO: 57618 - DNA, 20 bp, Artificial Sequence
  Synthetic oligonucleotide; TTGAAT chr11 5188553 5188572 5188569 +
gcatgcatcccaagatggct

SEQ ID NO: 57619 - DNA, 20 bp, Artificial Sequence
  Synthetic oligonucleotide; TAGAGT chr11 5188705 5188724 5188721 +
aagattggacatccctgctg

SEQ ID NO: 57620 - DNA, 20 bp, Artificial Sequence
  Synthetic oligonucleotide; TGGAAT chr11 5188722 5188741 5188738 +
ctgtagagtttctcagtggt

SEQ ID NO: 57621 - DNA, 20 bp, Artificial Sequence
  Synthetic oligonucleotide; CAGAGT chr11 5188737 5188756 5188753 +
gtggttggaatcaatatttg

SEQ ID NO: 57622 - DNA, 20 bp, Artificial Sequence
  Synthetic oligonucleotide; AAGAAT chr11 5188781 5188800 5188797 +
atttttcccctgccacattg

SEQ ID NO: 57623 - DNA, 20 bp, Artificial Sequence
  Synthetic oligonucleotide; TGGAGT chr11 5188818 5188837 5188834 +
tagccactcttctttccagg

SEQ ID NO: 57624 - DNA, 20 bp, Artificial Sequence
  Synthetic oligonucleotide; GTGAAT chr11 5188826 5188845 5188842 +
cttctttccaggtggagttt

SEQ ID NO: 57625 - DNA, 20 bp, Artificial Sequence
  Synthetic oligonucleotide; AAGAAT chr11 5188858 5188877 5188874 +
agagatgatctttatctggg

SEQ ID NO: 57626 - DNA, 20 bp, Artificial Sequence
  Synthetic oligonucleotide; AAGGAT chr11 5188924 5188943 5188940 +
ttagatacttttctttaagg

SEQ ID NO: 57627 - DNA, 20 bp, Artificial Sequence
  Synthetic oligonucleotide; TTGAAT chr11 5189107 5189126 5189123 +
cttacattttatgtattttg

SEQ ID NO: 57628 - DNA, 20 bp, Artificial Sequence
  Synthetic oligonucleotide; AAGAGT chr11 5189126 5189145 5189142 +
gttgaattgtgtttaatcac

SEQ ID NO: 57629 - DNA, 20 bp, Artificial Sequence
  Synthetic oligonucleotide; TTGGAT chr11 5189151 5189170 5189167 +
taatgcatgcctgatatggt

SEQ ID NO: 57630 - DNA, 20 bp, Artificial Sequence
  Synthetic oligonucleotide; TTGGAT chr11 5189228 5189247 5189244 +
tggggcctggtgggaagtga

SEQ ID NO: 57631 - DNA, 20 bp, Artificial Sequence
  Synthetic oligonucleotide; CAGAGT chr11 5189242 5189261 5189258 +
aagtgattggatcataggag

SEQ ID NO: 57632 - DNA, 20 bp, Artificial Sequence
  Synthetic oligonucleotide; GTGGGT chr11 5189289 5189308 5189305 +
agtcccttttggtacgtata

SEQ ID NO: 57633 - DNA, 20 bp, Artificial Sequence
  Synthetic oligonucleotide; GTGAGT chr11 5189293 5189312 5189309 +
ccttttggtacgtatagtgg

SEQ ID NO: 57634 - DNA, 20 bp, Artificial Sequence
  Synthetic oligonucleotide; GAGAAT chr11 5189528 5189547 5189544 +
gtatttccttatagcaagat

SEQ ID NO: 57635 - DNA, 20 bp, Artificial Sequence
  Synthetic oligonucleotide; TGGGGT chr11 5189563 5189582 5189579 +
cagaaaattggtaccaaaag

SEQ ID NO: 57636 - DNA, 20 bp, Artificial Sequence
  Synthetic oligonucleotide; TTGGAT chr11 5189611 5189630 5189627 +
atgtggaagcaactttggca

SEQ ID NO: 57637 - DNA, 20 bp, Artificial Sequence
  Synthetic oligonucleotide; AAGAGT chr11 5189633 5189652 5189649 +
ggataacaggcagaagttgg

SEQ ID NO: 57638 - DNA, 20 bp, Artificial Sequence
  Synthetic oligonucleotide; GAGAAT chr11 5189672 5189691 5189688 +
aagaagacagggagatgagg

SEQ ID NO: 57639 - DNA, 20 bp, Artificial Sequence
  Synthetic oligonucleotide; TGGAAT chr11 5189699 5189718 5189715 +
tggaactttctagagacttg

SEQ ID NO: 57640 - DNA, 20 bp, Artificial Sequence
  Synthetic oligonucleotide; ATGAAT chr11 5189772 5189791 5189788 +
tgaggtggtctcagatggaa

SEQ ID NO: 57641 - DNA, 20 bp, Artificial Sequence
  Synthetic oligonucleotide; GAGAAT chr11 5189853 5189872 5189869 +
tgcactgtgcctctacctta

SEQ ID NO: 57642 - DNA, 20 bp, Artificial Sequence
  Synthetic oligonucleotide; CCGAGT chr11 5190131 5190150 5190147 +
tttgcataaatgaagaggag

SEQ ID NO: 57643 - DNA, 20 bp, Artificial Sequence
  Synthetic oligonucleotide; GAGAAT chr11 5190158 5190177 5190174 +
ctaatagccaaaataaaggg

SEQ ID NO: 57644 - DNA, 20 bp, Artificial Sequence
  Synthetic oligonucleotide; AGGAGT chr11 5190224 5190243 5190240 +
catcacaggcctggtggcct

SEQ ID NO: 57645 - DNA, 20 bp, Artificial Sequence
  Synthetic oligonucleotide; CTGAAT chr11 5190231 5190250 5190247 +
ggcctggtggcctaggagta

SEQ ID NO: 57646 - DNA, 20 bp, Artificial Sequence
  Synthetic oligonucleotide; GTGGGT chr11 5190243 5190262 5190259 +
taggagtactgaatgatttt

SEQ ID NO: 57647 - DNA, 20 bp, Artificial Sequence
  Synthetic oligonucleotide; GAGGGT chr11 5190365 5190384 5190381 +
cagctaaggccactgcttca

SEQ ID NO: 57648 - DNA, 20 bp, Artificial Sequence
  Synthetic oligonucleotide; GGGAGT chr11 5190413 5190432 5190429 +
ttccacatggtgataaatct

SEQ ID NO: 57649 - DNA, 20 bp, Artificial Sequence
  Synthetic oligonucleotide; GAGGAT chr11 5190467 5190486 5190483 +
aagcctccacctagatttca

SEQ ID NO: 57650 - DNA, 20 bp, Artificial Sequence
  Synthetic oligonucleotide; CTGAGT chr11 5190485 5190504 5190501 +
cagaggatgtgtagaaaagc

SEQ ID NO: 57651 - DNA, 20 bp, Artificial Sequence
  Synthetic oligonucleotide; CAGAGT chr11 5190584 5190603 5190600 +
atgaggttggaaccccctca

SEQ ID NO: 57652 - DNA, 20 bp, Artificial Sequence
  Synthetic oligonucleotide; CAGAAT chr11 5190648 5190667 5190664 +
ggccaccgtcctccagaccc

SEQ ID NO: 57653 - DNA, 20 bp, Artificial Sequence
  Synthetic oligonucleotide; AGGGGT chr11 5190755 5190774 5190771 +
gctaaactgtgcaaagcaat

SEQ ID NO: 57654 - DNA, 20 bp, Artificial Sequence
  Synthetic oligonucleotide; TGGGGT chr11 5190821 5190840 5190837 +
tgtgtccctgatatgagaca

SEQ ID NO: 57655 - DNA, 20 bp, Artificial Sequence
  Synthetic oligonucleotide; TGGAGT chr11 5190842 5190861 5190858 +
ggggtcaaaggagattattt

SEQ ID NO: 57656 - DNA, 20 bp, Artificial Sequence
  Synthetic oligonucleotide; CTGGGT chr11 5190899 5190918 5190915 +
ctatgaagaaatacccgaga

SEQ ID NO: 57657 - DNA, 20 bp, Artificial Sequence
  Synthetic oligonucleotide; AGGGAT chr11 5191158 5191177 5191174 +
gtgttccttccatgacaggc

SEQ ID NO: 57658 - DNA, 20 bp, Artificial Sequence
  Synthetic oligonucleotide; TTGGGT chr11 5191191 5191210 5191207 +
cctactattcaagaagaaat

SEQ ID NO: 57659 - DNA, 20 bp, Artificial Sequence
  Synthetic oligonucleotide; CTGGGT chr11 5191239 5191258 5191255 +
aaggtgtaatgactgccctg

SEQ ID NO: 57660 - DNA, 20 bp, Artificial Sequence
  Synthetic oligonucleotide; TGGGAT chr11 5191257 5191276 5191273 +
tgctgggttttctactcgtg

SEQ ID NO: 57661 - DNA, 20 bp, Artificial Sequence
  Synthetic oligonucleotide; TGGAAT chr11 5191298 5191317 5191314 +
tttggtgcatttctctcttt

SEQ ID NO: 57662 - DNA, 20 bp, Artificial Sequence
  Synthetic oligonucleotide; GGGAAT chr11 5191304 5191323 5191320 +
gcatttctctcttttggaat

SEQ ID NO: 57663 - DNA, 20 bp, Artificial Sequence
  Synthetic oligonucleotide; TTGGAT chr11 5191403 5191422 5191419 +
ttgaagggacttgccttgtc

SEQ ID NO: 57664 - DNA, 20 bp, Artificial Sequence
  Synthetic oligonucleotide; TTGAGT chr11 5191430 5191449 5191446 +
agactttggactttggactt

SEQ ID NO: 57665 - DNA, 20 bp, Artificial Sequence
  Synthetic oligonucleotide; TGGAAT chr11 5191442 5191461 5191458 +
ttggacttttgagttaatgc

SEQ ID NO: 57666 - DNA, 20 bp, Artificial Sequence
  Synthetic oligonucleotide; ATGAGT chr11 5191446 5191465 5191462 +
acttttgagttaatgctgga

SEQ ID NO: 57667 - DNA, 20 bp, Artificial Sequence
  Synthetic oligonucleotide; AAGGAT chr11 5191536 5191555 5191552 +
ttggaaggggccagaggtgg

SEQ ID NO: 57668 - DNA, 20 bp, Artificial Sequence
  Synthetic oligonucleotide; TTGGAT chr11 5191547 5191566 5191563 +
cagaggtggaaggatatggt

SEQ ID NO: 57669 - DNA, 20 bp, Artificial Sequence
  Synthetic oligonucleotide; CAGAGT chr11 5191638 5191657 5191654 +
aggtaattcaatcatggtgg

SEQ ID NO: 57670 - DNA, 20 bp, Artificial Sequence
  Synthetic oligonucleotide; GTGAGT chr11 5191685 5191704 5191701 +
atcccccttggtactgtata

SEQ ID NO: 57671 - DNA, 20 bp, Artificial Sequence
  Synthetic oligonucleotide; GGGAGT chr11 5192042 5192061 5192058 +
actcaatgtgatcaagattt

SEQ ID NO: 57672 - DNA, 20 bp, Artificial Sequence
  Synthetic oligonucleotide; AAGAAT chr11 5192231 5192250 5192247 +
agctgtctgaaactaagtca

SEQ ID NO: 57673 - DNA, 20 bp, Artificial Sequence
  Synthetic oligonucleotide; TTGAAT chr11 5192268 5192287 5192284 +
tattcactatttgtctatta

SEQ ID NO: 57674 - DNA, 20 bp, Artificial Sequence
  Synthetic oligonucleotide; AGGAAT chr11 5192289 5192308 5192305 +
tgaatatctatatttgtttg

SEQ ID NO: 57675 - DNA, 20 bp, Artificial Sequence
  Synthetic oligonucleotide; AAGGAT chr11 5192309 5192328 5192325 +
aggaataataatcagaacag

SEQ ID NO: 57676 - DNA, 20 bp, Artificial Sequence
  Synthetic oligonucleotide; AGGAAT chr11 5192327 5192346 5192343 +
agaaggatatgaaagactat

SEQ ID NO: 57677 - DNA, 20 bp, Artificial Sequence
  Synthetic oligonucleotide; TGGAGT chr11 5192367 5192386 5192383 +
agcaagataaaataggttaa

SEQ ID NO: 57678 - DNA, 20 bp, Artificial Sequence
  Synthetic oligonucleotide; GAGAAT chr11 5192381 5192400 5192397 +
ggttaatggagtaatatgta

SEQ ID NO: 57679 - DNA, 20 bp, Artificial Sequence
  Synthetic oligonucleotide; ATGAAT chr11 5192407 5192426 5192423 +
gatgactataattaaagaaa

SEQ ID NO: 57680 - DNA, 20 bp, Artificial Sequence
  Synthetic oligonucleotide; CTGAAT chr11 5192477 5192496 5192493 +
atagacctttatttatatca

SEQ ID NO: 57681 - DNA, 20 bp, Artificial Sequence
  Synthetic oligonucleotide; ATGGAT chr11 5192496 5192515 5192512 +
actgaataatattctatcct

SEQ ID NO: 57682 - DNA, 20 bp, Artificial Sequence
  Synthetic oligonucleotide; ATGAGT chr11 5192551 5192570 5192567 +
actttcaacttttggcaatt

SEQ ID NO: 57683 - DNA, 20 bp, Artificial Sequence
  Synthetic oligonucleotide; TTGGGT chr11 5192617 5192636 5192633 +
gacataaatttttgactcat

SEQ ID NO: 57684 - DNA, 20 bp, Artificial Sequence
  Synthetic oligonucleotide; AGGAGT chr11 5192631 5192650 5192647 +
actcatttgggtaaatacat

SEQ ID NO: 57685 - DNA, 20 bp, Artificial Sequence
  Synthetic oligonucleotide; TTGGGT chr11 5192644 5192663 5192660 +
aatacataggagtgtgattg

SEQ ID NO: 57686 - DNA, 20 bp, Artificial Sequence
  Synthetic oligonucleotide; GAGAGT chr11 5192734 5192753 5192750 +
catccctacaagcaataagt

SEQ ID NO: 57687 - DNA, 20 bp, Artificial Sequence
  Synthetic oligonucleotide; GTGGAT chr11 5192771 5192790 5192787 +
cacttcgttgccagtgtttg

SEQ ID NO: 57688 - DNA, 20 bp, Artificial Sequence
  Synthetic oligonucleotide; TGGAAT chr11 5192787 5192806 5192803 +
tttggtggatgtcagtattt

SEQ ID NO: 57689 - DNA, 20 bp, Artificial Sequence
  Synthetic oligonucleotide; CTGAGT chr11 5192866 5192885 5192882 +
tttcttaatgacatgtgtta

SEQ ID NO: 57690 - DNA, 20 bp, Artificial Sequence
  Synthetic oligonucleotide; TTGGAT chr11 5192949 5192968 5192965 +
atcttttgcccactttgcaa

SEQ ID NO: 57691 - DNA, 20 bp, Artificial Sequence
  Synthetic oligonucleotide; TAGAAT chr11 5192971 5192990 5192987 +
ggattgtttgttttttattg

SEQ ID NO: 57692 - DNA, 20 bp, Artificial Sequence
  Synthetic oligonucleotide; ATGAAT chr11 5193079 5193098 5193095 +
tttcattctcttaacttacc

SEQ ID NO: 57693 - DNA, 20 bp, Artificial Sequence
  Synthetic oligonucleotide; CTGGGT chr11 5193107 5193126 5193123 +
ttattttattttattttgtt

SEQ ID NO: 57694 - DNA, 20 bp, Artificial Sequence
  Synthetic oligonucleotide; GTGGAT chr11 5193118 5193137 5193134 +
tattttgttctgggtatttt

SEQ ID NO: 57695 - DNA, 20 bp, Artificial Sequence
  Synthetic oligonucleotide; TGGAGT chr11 5193239 5193258 5193255 +
ctgaactccagttaagattt

SEQ ID NO: 57696 - DNA, 20 bp, Artificial Sequence
  Synthetic oligonucleotide; AAGGAT chr11 5193426 5193445 5193442 +
tactattctgttcaaatatc

SEQ ID NO: 57697 - DNA, 20 bp, Artificial Sequence
  Synthetic oligonucleotide; ATGAGT chr11 5193437 5193456 5193453 +
tcaaatatcaaggatctaaa

SEQ ID NO: 57698 - DNA, 20 bp, Artificial Sequence
  Synthetic oligonucleotide; AAGAAT chr11 5193455 5193474 5193471 +
aaatgagtggttatttaatt

SEQ ID NO: 57699 - DNA, 20 bp, Artificial Sequence
  Synthetic oligonucleotide; CTGAAT chr11 5193504 5193523 5193520 +
attagcttttattttctgcc

SEQ ID NO: 57700 - DNA, 20 bp, Artificial Sequence
  Synthetic oligonucleotide; CGGAAT chr11 5193620 5193639 5193636 +
tttgtccatccttctgtgtc

SEQ ID NO: 57701 - DNA, 20 bp, Artificial Sequence
  Synthetic oligonucleotide; GTGGGT chr11 5193628 5193647 5193644 +
tccttctgtgtccggaattg

SEQ ID NO: 57702 - DNA, 20 bp, Artificial Sequence
  Synthetic oligonucleotide; AAGAAT chr11 5193653 5193672 5193669 +
ttcttggtctcgctgactta

SEQ ID NO: 57703 - DNA, 20 bp, Artificial Sequence
  Synthetic oligonucleotide; GTGAGT chr11 5193678 5193697 5193694 +
tgaagccgcgaaccctcgtg

SEQ ID NO: 57704 - DNA, 20 bp, Artificial Sequence
  Synthetic oligonucleotide; AAGGAT chr11 5193712 5193731 5193728 +
tcttaaagatggtgtgttca

SEQ ID NO: 57705 - DNA, 20 bp, Artificial Sequence
  Synthetic oligonucleotide; CAGAGT chr11 5193751 5193770 5193767 +
tttgttacttcagatgtgtc

SEQ ID NO: 57706 - DNA, 20 bp, Artificial Sequence
  Synthetic oligonucleotide; AGGAGT chr11 5193794 5193813 5193810 +
ttcacggtcttgctggctcc

SEQ ID NO: 57707 - DNA, 20 bp, Artificial Sequence
  Synthetic oligonucleotide; GGGAGT chr11 5193819 5193838 5193835 +
tgaagctgcagacccccacg

SEQ ID NO: 57708 - DNA, 20 bp, Artificial Sequence
  Synthetic oligonucleotide; TGGAGT chr11 5193851 5193870 5193867 +
gctcttaaaggcggagcgta

SEQ ID NO: 57709 - DNA, 20 bp, Artificial Sequence
  Synthetic oligonucleotide; TTGGGT chr11 5193874 5193893 5193890 +
agttgctcattcctcctgtc

SEQ ID NO: 57710 - DNA, 20 bp, Artificial Sequence
  Synthetic oligonucleotide; CTGGGT chr11 5193895 5193914 5193911 +
tgggttgttcatcccccatg

SEQ ID NO: 57711 - DNA, 20 bp, Artificial Sequence
  Synthetic oligonucleotide; GTGAGT chr11 5193945 5193964 5193961 +
tgaagccgcagaccttcgca

SEQ ID NO: 57712 - DNA, 20 bp, Artificial Sequence
  Synthetic oligonucleotide; GCGGAT chr11 5193972 5193991 5193988 +
ttacagctcataaaggcagc

SEQ ID NO: 57713 - DNA, 20 bp, Artificial Sequence
  Synthetic oligonucleotide; AAGAGT chr11 5193981 5194000 5193997 +
ataaaggcagcgcggatcca

SEQ ID NO: 57714 - DNA, 20 bp, Artificial Sequence
  Synthetic oligonucleotide; AAGAAT chr11 5194010 5194029 5194026 +
cagcagtaagatttattgtg

SEQ ID NO: 57715 - DNA, 20 bp, Artificial Sequence
  Synthetic oligonucleotide; CAGAGT chr11 5194186 5194205 5194202 +
agctggttggtccgttttgg

SEQ ID NO: 57716 - DNA, 20 bp, Artificial Sequence
  Synthetic oligonucleotide; CAGAGT chr11 5194227 5194246 5194243 +
tacaaaccttgagctagaca

SEQ ID NO: 57717 - DNA, 20 bp, Artificial Sequence
  Synthetic oligonucleotide; TTGAGT chr11 5194334 5194353 5194350 +
gattggtgcatttacaaacc

SEQ ID NO: 57718 - DNA, 20 bp, Artificial Sequence
  Synthetic oligonucleotide; AAGAAT chr11 5194425 5194444 5194441 +
atatttcatggtgaggaaca

SEQ ID NO: 57719 - DNA, 20 bp, Artificial Sequence
  Synthetic oligonucleotide; GGGGAT chr11 5194436 5194455 5194452 +
tgaggaacaaagaatatagt

SEQ ID NO: 57720 - DNA, 20 bp, Artificial Sequence
  Synthetic oligonucleotide; CTGGAT chr11 5194587 5194606 5194603 +
aaatgtccaacaatgataga

SEQ ID NO: 57721 - DNA, 20 bp, Artificial Sequence
  Synthetic oligonucleotide; TGGAAT chr11 5194619 5194638 5194635 +
aatgtggcacatacacacca

SEQ ID NO: 57722 - DNA, 20 bp, Artificial Sequence
  Synthetic oligonucleotide; AAGGAT chr11 5194642 5194661 5194658 +
aatactatgcagccataaaa

SEQ ID NO: 57723 - DNA, 20 bp, Artificial Sequence
  Synthetic oligonucleotide; ATGAGT chr11 5194646 5194665 5194662 +
ctatgcagccataaaaaagg

SEQ ID NO: 57724 - DNA, 20 bp, Artificial Sequence
  Synthetic oligonucleotide; ATGGAT chr11 5194671 5194690 5194687 +
ttcatgtcctttgtagggac

SEQ ID NO: 57725 - DNA, 20 bp, Artificial Sequence
  Synthetic oligonucleotide; GGGAAT chr11 5194753 5194772 5194769 +
gcatgttctcactcataggt

SEQ ID NO: 57726 - DNA, 20 bp, Artificial Sequence
  Synthetic oligonucleotide; TGGGGT chr11 5194816 5194835 5194832 +
tcacactctggggactgttg

SEQ ID NO: 57727 - DNA, 20 bp, Artificial Sequence
  Synthetic oligonucleotide; AGGGAT chr11 5194835 5194854 5194851 +
gtggggtggggggagggagg

SEQ ID NO: 57728 - DNA, 20 bp, Artificial Sequence
  Synthetic oligonucleotide; ATGAGT chr11 5194871 5194890 5194887 +
gatatacctaatgctaaatg

SEQ ID NO: 57729 - DNA, 20 bp, Artificial Sequence
  Synthetic oligonucleotide; ATGGGT chr11 5194879 5194898 5194895 +
taatgctaaatgatgagtta

SEQ ID NO: 57730 - DNA, 20 bp, Artificial Sequence
  Synthetic oligonucleotide; AAGAGT chr11 5194992 5195011 5195008 +
taaaataaaataattttaaa

SEQ ID NO: 57731 - DNA, 20 bp, Artificial Sequence
  Synthetic oligonucleotide; GGGGAT chr11 5195003 5195022 5195019 +
aattttaaaaagagtatagt

SEQ ID NO: 57732 - DNA, 20 bp, Artificial Sequence
  Synthetic oligonucleotide; GCGAAT chr11 5195088 5195107 5195104 +
aagcctagctaatccagtaa

SEQ ID NO: 57733 - DNA, 20 bp, Artificial Sequence
  Synthetic oligonucleotide; CTGAAT chr11 5195214 5195233 5195230 +
tagtcctggcatcctttgca

SEQ ID NO: 57734 - DNA, 20 bp, Artificial Sequence
  Synthetic oligonucleotide; CTGGAT chr11 5195230 5195249 5195246 +
tgcactgaatttcccagtgt

SEQ ID NO: 57735 - DNA, 20 bp, Artificial Sequence
  Synthetic oligonucleotide; ATGAGT chr11 5195290 5195309 5195306 +
tttgccagaactaaagagaa

SEQ ID NO: 57736 - DNA, 20 bp, Artificial Sequence
  Synthetic oligonucleotide; ACGAAT chr11 5195364 5195383 5195380 +
catttttagccctacccctc

SEQ ID NO: 57737 - DNA, 20 bp, Artificial Sequence
  Synthetic oligonucleotide; GTGGAT chr11 5195579 5195598 5195595 +
tgtgtacatctatagcttta

SEQ ID NO: 57738 - DNA, 20 bp, Artificial Sequence
  Synthetic oligonucleotide; AGGGGT chr11 5195934 5195953 5195950 +
aggacatcgactcctactgc

SEQ ID NO: 57739 - DNA, 20 bp, Artificial Sequence
  Synthetic oligonucleotide; GGGAAT chr11 5196082 5196101 5196098 +
taatggtaacaaatatccta

SEQ ID NO: 57740 - DNA, 20 bp, Artificial Sequence
  Synthetic oligonucleotide; GGGGAT chr11 5196238 5196257 5196254 +
ggaacctggtctcacagcag

SEQ ID NO: 57741 - DNA, 20 bp, Artificial Sequence
  Synthetic oligonucleotide; AGGGAT chr11 5196320 5196339 5196336 +
gattctcatagaggcatgca

SEQ ID NO: 57742 - DNA, 20 bp, Artificial Sequence
  Synthetic oligonucleotide; GAGAAT chr11 5196345 5196364 5196361 +
tctaggttgcggcttcttat

SEQ ID NO: 57743 - DNA, 20 bp, Artificial Sequence
  Synthetic oligonucleotide; GTGGAT chr11 5196481 5196500 5196497 +
tgtacagtgaacatctgcct

SEQ ID NO: 57744 - DNA, 20 bp, Artificial Sequence
  Synthetic oligonucleotide; CTGAAT chr11 5196530 5196549 5196546 +
ctaaaaacacatttctaatc

SEQ ID NO: 57745 - DNA, 20 bp, Artificial Sequence
  Synthetic oligonucleotide; AAGAAT chr11 5196553 5196572 5196569 +
aatcatgtcctctcacttct

SEQ ID NO: 57746 - DNA, 20 bp, Artificial Sequence
  Synthetic oligonucleotide; AAGAGT chr11 5196596 5196615 5196612 +
ggaccttagcttttcggtgt

SEQ ID NO: 57747 - DNA, 20 bp, Artificial Sequence
  Synthetic oligonucleotide; ATGAAT chr11 5196605 5196624 5196621 +
cttttcggtgtaagagttaa

SEQ ID NO: 57748 - DNA, 20 bp, Artificial Sequence
  Synthetic oligonucleotide; TTGAAT chr11 5196616 5196635 5196632 +
aagagttaaatgaatagcaa

SEQ ID NO: 57749 - DNA, 20 bp, Artificial Sequence
  Synthetic oligonucleotide; CTGAAT chr11 5196642 5196661 5196658 +
ggactagactttctgatttt

SEQ ID NO: 57750 - DNA, 20 bp, Artificial Sequence
  Synthetic oligonucleotide; CTGGAT chr11 5196830 5196849 5196846 +
cgtaacgtttctcagtgacg

SEQ ID NO: 57751 - DNA, 20 bp, Artificial Sequence
  Synthetic oligonucleotide; AGGAAT chr11 5196858 5196877 5196874 +
tagccttgcaggccttacaa

SEQ ID NO: 57752 - DNA, 20 bp, Artificial Sequence
  Synthetic oligonucleotide; CTGAAT chr11 5197285 5197304 5197301 +
actgattttcctccctttgg

SEQ ID NO: 57753 - DNA, 20 bp, Artificial Sequence
  Synthetic oligonucleotide; GAGGAT chr11 5197368 5197387 5197384 +
taaaataagcaatgatttct

SEQ ID NO: 57754 - DNA, 20 bp, Artificial Sequence
  Synthetic oligonucleotide; ATGAGT chr11 5197603 5197622 5197619 +
attcattctgatgcttccct

SEQ ID NO: 57755 - DNA, 20 bp, Artificial Sequence
  Synthetic oligonucleotide; AAGAAT chr11 5197639 5197658 5197655 +
aaacatattgtcagttgttg

SEQ ID NO: 57756 - DNA, 20 bp, Artificial Sequence
  Synthetic oligonucleotide; GAGGGT chr11 5197686 5197705 5197702 +
gtcagctctccggcgtatgg

SEQ ID NO: 57757 - DNA, 20 bp, Artificial Sequence
  Synthetic oligonucleotide; GTGGAT chr11 5197690 5197709 5197706 +
gctctccggcgtatgggagg

SEQ ID NO: 57758 - DNA, 20 bp, Artificial Sequence
  Synthetic oligonucleotide; AGGAAT chr11 5197818 5197837 5197834 +
tcattataaaactggggcat

SEQ ID NO: 57759 - DNA, 20 bp, Artificial Sequence
  Synthetic oligonucleotide; CAGAGT chr11 5197965 5197984 5197981 +
ttttttttttttttttgaga

SEQ ID NO: 57760 - DNA, 20 bp, Artificial Sequence
  Synthetic oligonucleotide; TGGAGT chr11 5197990 5198009 5198006 +
tctctctctgtcgcccaggc

SEQ ID NO: 57761 - DNA, 20 bp, Artificial Sequence
  Synthetic oligonucleotide; CCGGGT chr11 5198034 5198053 5198050 +
ctcactgcaagctccacctc

SEQ ID NO: 57762 - DNA, 20 bp, Artificial Sequence
  Synthetic oligonucleotide; CCGAGT chr11 5198066 5198085 5198082 +
cattctcctgtctcagcctc

SEQ ID NO: 57763 - DNA, 20 bp, Artificial Sequence
  Synthetic oligonucleotide; CTGGAT chr11 5198102 5198121 5198118 +
acaggtgcccgccaccacgc

SEQ ID NO: 57764 - DNA, 20 bp, Artificial Sequence
  Synthetic oligonucleotide; CGGGGT chr11 5198134 5198153 5198150 +
ttgtgtttttttagtagaga

SEQ ID NO: 57765 - DNA, 20 bp, Artificial Sequence
  Synthetic oligonucleotide; CAGGAT chr11 5198155 5198174 5198171 +
ggggtttcaccattgctggc

SEQ ID NO: 57766 - DNA, 20 bp, Artificial Sequence
  Synthetic oligonucleotide; AGGAAT chr11 5198388 5198407 5198404 +
aagacctaatttattgttct

SEQ ID NO: 57767 - DNA, 20 bp, Artificial Sequence
  Synthetic oligonucleotide; CTGAGT chr11 5198501 5198520 5198517 +
gcctgtatttttgtttccct

SEQ ID NO: 57768 - DNA, 20 bp, Artificial Sequence
  Synthetic oligonucleotide; TTGAAT chr11 5198533 5198552 5198549 +
agtagacagaggctatgtta

SEQ ID NO: 57769 - DNA, 20 bp, Artificial Sequence
  Synthetic oligonucleotide; TAGAAT chr11 5198700 5198719 5198716 +
ttaccttcttagatacctaa

SEQ ID NO: 57770 - DNA, 20 bp, Artificial Sequence
  Synthetic oligonucleotide; CAGAAT chr11 5198852 5198871 5198868 +
tatcttttttcttttaaact

SEQ ID NO: 57771 - DNA, 20 bp, Artificial Sequence
  Synthetic oligonucleotide; TGGAGT chr11 5198955 5198974 5198971 +
tgcttccagccttgtagcag

SEQ ID NO: 57772 - DNA, 20 bp, Artificial Sequence
  Synthetic oligonucleotide; AAGGAT chr11 5198983 5199002 5198999 +
acatataaaatctaaaaaat

SEQ ID NO: 57773 - DNA, 20 bp, Artificial Sequence
  Synthetic oligonucleotide; TTGAAT chr11 5199016 5199035 5199032 +
taaattagacatggtagaag

SEQ ID NO: 57774 - DNA, 20 bp, Artificial Sequence
  Synthetic oligonucleotide; GTGAGT chr11 5199311 5199330 5199327 +
acagatatcacaacattcct

SEQ ID NO: 57775 - DNA, 20 bp, Artificial Sequence
  Synthetic oligonucleotide; GAGAAT chr11 5199359 5199378 5199375 +
ggttaattaagtaaacctca

SEQ ID NO: 57776 - DNA, 20 bp, Artificial Sequence
  Synthetic oligonucleotide; TAGAGT chr11 5199508 5199527 5199524 +
cttaaatatggtcagactga

SEQ ID NO: 57777 - DNA, 20 bp, Artificial Sequence
  Synthetic oligonucleotide; CAGAGT chr11 5199605 5199624 5199621 +
aaggtcatttgtcatggact

SEQ ID NO: 57778 - DNA, 20 bp, Artificial Sequence
  Synthetic oligonucleotide; AAGAGT chr11 5199734 5199753 5199750 +
ctcaatatcttttcagagaa

SEQ ID NO: 57779 - DNA, 20 bp, Artificial Sequence
  Synthetic oligonucleotide; ATGAAT chr11 5199754 5199773 5199770 +
aagagtctaagcattctggt

SEQ ID NO: 57780 - DNA, 20 bp, Artificial Sequence
  Synthetic oligonucleotide; TTGGGT chr11 5199763 5199782 5199779 +
agcattctggtatgaatctg

SEQ ID NO: 57781 - DNA, 20 bp, Artificial Sequence
  Synthetic oligonucleotide; TGGGAT chr11 5199786 5199805 5199802 +
ggtcttgacactgtagatga

SEQ ID NO: 57782 - DNA, 20 bp, Artificial Sequence
  Synthetic oligonucleotide; AAGGAT chr11 5199808 5199827 5199824 +
ggattcattaaaggtgggaa

SEQ ID NO: 57783 - DNA, 20 bp, Artificial Sequence
  Synthetic oligonucleotide; AGGGAT chr11 5199892 5199911 5199908 +
accattgtgaggctaatgat

SEQ ID NO: 57784 - DNA, 20 bp, Artificial Sequence
  Synthetic oligonucleotide; AAGAAT chr11 5199988 5200007 5200004 +
gcaactgccaggactgactt

SEQ ID NO: 57785 - DNA, 20 bp, Artificial Sequence
  Synthetic oligonucleotide; CAGGAT chr11 5199994 5200013 5200010 +
gccaggactgacttaagaat

SEQ ID NO: 57786 - DNA, 20 bp, Artificial Sequence
  Synthetic oligonucleotide; AAGGAT chr11 5200009 5200028 5200025 +
agaatcaggatgtaggagaa

SEQ ID NO: 57787 - DNA, 20 bp, Artificial Sequence
  Synthetic oligonucleotide; ATGAGT chr11 5200013 5200032 5200029 +
tcaggatgtaggagaaaagg

SEQ ID NO: 57788 - DNA, 20 bp, Artificial Sequence
  Synthetic oligonucleotide; TTGAAT chr11 5200070 5200089 5200086 +
gcatcagggcatagtaacta

SEQ ID NO: 57789 - DNA, 20 bp, Artificial Sequence
  Synthetic oligonucleotide; TCGGAT chr11 5200075 5200094 5200091 +
agggcatagtaactattgaa

SEQ ID NO: 57790 - DNA, 20 bp, Artificial Sequence
  Synthetic oligonucleotide; AAGAGT chr11 5200122 5200141 5200138 +
aagatcctggtgcaggcaga

SEQ ID NO: 57791 - DNA, 20 bp, Artificial Sequence
  Synthetic oligonucleotide; AAGGAT chr11 5200132 5200151 5200148 +
tgcaggcagaaagagtgaga

SEQ ID NO: 57792 - DNA, 20 bp, Artificial Sequence
  Synthetic oligonucleotide; GGGGGT chr11 5200178 5200197 5200194 +
aaaatttcagacagatgatg

SEQ ID NO: 57793 - DNA, 20 bp, Artificial Sequence
  Synthetic oligonucleotide; TGGAAT chr11 5200236 5200255 5200252 +
gagcccaattttgataattc

SEQ ID NO: 57794 - DNA, 20 bp, Artificial Sequence
  Synthetic oligonucleotide; CAGGAT chr11 5200246 5200265 5200262 +
ttgataattctggaattagt

SEQ ID NO: 57795 - DNA, 20 bp, Artificial Sequence
  Synthetic oligonucleotide; AGGAAT chr11 5200254 5200273 5200270 +
tctggaattagtcaggatgg

SEQ ID NO: 57796 - DNA, 20 bp, Artificial Sequence
  Synthetic oligonucleotide; GTGGAT chr11 5200266 5200285 5200282 +
caggatggaggaataacgta

SEQ ID NO: 57797 - DNA, 20 bp, Artificial Sequence
  Synthetic oligonucleotide; ATGGAT chr11 5200339 5200358 5200355 +
gactccatgaaggacagacc

SEQ ID NO: 57798 - DNA, 20 bp, Artificial Sequence
  Synthetic oligonucleotide; AGGAAT chr11 5200365 5200384 5200381 +
gaaataggactgggcaatgc

SEQ ID NO: 57799 - DNA, 20 bp, Artificial Sequence
  Synthetic oligonucleotide; TCGAAT chr11 5200384 5200403 5200400 +
caggaatccaagctgatctc

SEQ ID NO: 57800 - DNA, 20 bp, Artificial Sequence
  Synthetic oligonucleotide; CAGGAT chr11 5200399 5200418 5200415 +
atctctcgaatgatccccca

SEQ ID NO: 57801 - DNA, 20 bp, Artificial Sequence
  Synthetic oligonucleotide; GGGGAT chr11 5200564 5200583 5200580 +
atggcatagattgaggagaa

SEQ ID NO: 57802 - DNA, 20 bp, Artificial Sequence
  Synthetic oligonucleotide; AGGGGT chr11 5200578 5200597 5200594 +
ggagaaggggatggaaagcc

SEQ ID NO: 57803 - DNA, 20 bp, Artificial Sequence
  Synthetic oligonucleotide; AAGAAT chr11 5200623 5200642 5200639 +
aaatccagtgagaagaaagg

SEQ ID NO: 57804 - DNA, 20 bp, Artificial Sequence
  Synthetic oligonucleotide; GAGAGT chr11 5200683 5200702 5200699 +
tctggaactgagaaacatgt

SEQ ID NO: 57805 - DNA, 20 bp, Artificial Sequence
  Synthetic oligonucleotide; CTGAAT chr11 5200719 5200738 5200735 +
aggaaatgtttcaatttcac

SEQ ID NO: 57806 - DNA, 20 bp, Artificial Sequence
  Synthetic oligonucleotide; CTGGAT chr11 5200878 5200897 5200894 +
agtcattattttttcactgt

SEQ ID NO: 57807 - DNA, 20 bp, Artificial Sequence
  Synthetic oligonucleotide; AAGGAT chr11 5200985 5201004 5201001 +
cgttgcttagacattttccc

SEQ ID NO: 57808 - DNA, 20 bp, Artificial Sequence
  Synthetic oligonucleotide; AAGAGT chr11 5201075 5201094 5201091 +
ttcattaaacattcgaagtg

SEQ ID NO: 57809 - DNA, 20 bp, Artificial Sequence
  Synthetic oligonucleotide; AGGAAT chr11 5201261 5201280 5201277 +
ttcattggtgataagcagac

SEQ ID NO: 57810 - DNA, 20 bp, Artificial Sequence
  Synthetic oligonucleotide; TTGGGT chr11 5201283 5201302 5201299 +
gaatatttatgcatgagacc

SEQ ID NO: 57811 - DNA, 20 bp, Artificial Sequence
  Synthetic oligonucleotide; GAGAAT chr11 5201354 5201373 5201370 +
atttgtgcctttgtgatgta

SEQ ID NO: 57812 - DNA, 20 bp, Artificial Sequence
  Synthetic oligonucleotide; CAGAAT chr11 5201567 5201586 5201583 +
tttcaaaagcctcatggtag

SEQ ID NO: 57813 - DNA, 20 bp, Artificial Sequence
  Synthetic oligonucleotide; GAGAAT chr11 5201621 5201640 5201637 +
ctgctttaagttccagacct

SEQ ID NO: 57814 - DNA, 20 bp, Artificial Sequence
  Synthetic oligonucleotide; TTGAGT chr11 5201695 5201714 5201711 +
gtccatactttcatgtttga

SEQ ID NO: 57815 - DNA, 20 bp, Artificial Sequence
  Synthetic oligonucleotide; TTGAAT chr11 5201882 5201901 5201898 +
gccctgactccttctcagca

SEQ ID NO: 57816 - DNA, 20 bp, Artificial Sequence
  Synthetic oligonucleotide; TAGAAT chr11 5201923 5201942 5201939 +
ttttaatacttttttctcca

SEQ ID NO: 57817 - DNA, 20 bp, Artificial Sequence
  Synthetic oligonucleotide; GAGGAT chr11 5201954 5201973 5201970 +
aagtttcttcgtttcttgca

SEQ ID NO: 57818 - DNA, 20 bp, Artificial Sequence
  Synthetic oligonucleotide; TTGAAT chr11 5201971 5201990 5201987 +
gcagaggatttttcagtctt

SEQ ID NO: 57819 - DNA, 20 bp, Artificial Sequence
  Synthetic oligonucleotide; TCGAAT chr11 5202002 5202021 5202018 +
tcttctttcatttctctaaa

SEQ ID NO: 57820 - DNA, 20 bp, Artificial Sequence
  Synthetic oligonucleotide; ATGAAT chr11 5202379 5202398 5202395 +
actcctgagagctcaaattc

SEQ ID NO: 57821 - DNA, 20 bp, Artificial Sequence
  Synthetic oligonucleotide; CTGAGT chr11 5202410 5202429 5202426 +
tggctatttaatatattcat

SEQ ID NO: 57822 - DNA, 20 bp, Artificial Sequence
  Synthetic oligonucleotide; AAGAAT chr11 5202431 5202450 5202447 +
tgagtgtttaatcttaaaat

SEQ ID NO: 57823 - DNA, 20 bp, Artificial Sequence
  Synthetic oligonucleotide; TTGAGT chr11 5202543 5202562 5202559 +
acaattgcataagacaagtc

SEQ ID NO: 57824 - DNA, 20 bp, Artificial Sequence
  Synthetic oligonucleotide; CAGGAT chr11 5203044 5203063 5203060 +
agctaagtacatgcatgtct

SEQ ID NO: 57825 - DNA, 20 bp, Artificial Sequence
  Synthetic oligonucleotide; CCGAAT chr11 5203075 5203094 5203091 +
cccatggtcttctctgtgct

SEQ ID NO: 57826 - DNA, 20 bp, Artificial Sequence
  Synthetic oligonucleotide; TTGAGT chr11 5203127 5203146 5203143 +
attcctttcaccattaactt

SEQ ID NO: 57827 - DNA, 20 bp, Artificial Sequence
  Synthetic oligonucleotide; GGGGAT chr11 5203153 5203172 5203169 +
taaaatgattacttcctcag

SEQ ID NO: 57828 - DNA, 20 bp, Artificial Sequence
  Synthetic oligonucleotide; CTGAAT chr11 5203265 5203284 5203281 +
tttataccacttattataca

SEQ ID NO: 57829 - DNA, 20 bp, Artificial Sequence
  Synthetic oligonucleotide; AAGAAT chr11 5203328 5203347 5203344 +
accatatctgttttttgctc

SEQ ID NO: 57830 - DNA, 20 bp, Artificial Sequence
  Synthetic oligonucleotide; AAGGGT chr11 5203343 5203362 5203359 +
tgctcaagaatatgaaaaat

SEQ ID NO: 57831 - DNA, 20 bp, Artificial Sequence
  Synthetic oligonucleotide; TAGAAT chr11 5203354 5203373 5203370 +
atgaaaaataagggttagca

SEQ ID NO: 57832 - DNA, 20 bp, Artificial Sequence
  Synthetic oligonucleotide; ATGAAT chr11 5203436 5203455 5203452 +
cacagagatataaagataat

SEQ ID NO: 57833 - DNA, 20 bp, Artificial Sequence
  Synthetic oligonucleotide; TTGAGT chr11 5203514 5203533 5203530 +
ttctgacctttggccaccaa

SEQ ID NO: 57834 - DNA, 20 bp, Artificial Sequence
  Synthetic oligonucleotide; TTGAAT chr11 5203535 5203554 5203551 +
tgagtcatcatataccaagt

SEQ ID NO: 57835 - DNA, 20 bp, Artificial Sequence
  Synthetic oligonucleotide; AGGGAT chr11 5203565 5203584 5203581 +
tataaaacagatgctgctcc

SEQ ID NO: 57836 - DNA, 20 bp, Artificial Sequence
  Synthetic oligonucleotide; TTGAAT chr11 5203581 5203600 5203597 +
ctccagggatcttgctgacc

SEQ ID NO: 57837 - DNA, 20 bp, Artificial Sequence
  Synthetic oligonucleotide; AAGGAT chr11 5203647 5203666 5203663 +
cctgactcagacatatcgtc

SEQ ID NO: 57838 - DNA, 20 bp, Artificial Sequence
  Synthetic oligonucleotide; TGGGAT chr11 5203654 5203673 5203670 +
cagacatatcgtcaaggatc

SEQ ID NO: 57839 - DNA, 20 bp, Artificial Sequence
  Synthetic oligonucleotide; GTGAAT chr11 5203684 5203703 5203700 +
cacaaaagatttaatattct

SEQ ID NO: 57840 - DNA, 20 bp, Artificial Sequence
  Synthetic oligonucleotide; GTGGAT chr11 5203774 5203793 5203790 +
actttgggaggccgaggcag

SEQ ID NO: 57841 - DNA, 20 bp, Artificial Sequence
  Synthetic oligonucleotide; AGGAGT chr11 5203791 5203810 5203807 +
caggtggattggctgagctc

SEQ ID NO: 57842 - DNA, 20 bp, Artificial Sequence
  Synthetic oligonucleotide; GAGAAT chr11 5203911 5203930 5203927 +
tacttgggagactgaggcag

SEQ ID NO: 57843 - DNA, 20 bp, Artificial Sequence
  Synthetic oligonucleotide; TGGGAT chr11 5204188 5204207 5204204 +
catagagactatcagccttt

SEQ ID NO: 57844 - DNA, 20 bp, Artificial Sequence
  Synthetic oligonucleotide; GAGGAT chr11 5204216 5204235 5204232 +
ccagagcaaaatacatgttg

SEQ ID NO: 57845 - DNA, 20 bp, Artificial Sequence
  Synthetic oligonucleotide; TAGGAT chr11 5204245 5204264 5204261 +
ttaaaatatgttttgaaagg

SEQ ID NO: 57846 - DNA, 20 bp, Artificial Sequence
  Synthetic oligonucleotide; GAGAGT chr11 5204397 5204416 5204413 +
catgttgtgttatgctatct

SEQ ID NO: 57847 - DNA, 20 bp, Artificial Sequence
  Synthetic oligonucleotide; CTGAGT chr11 5204422 5204441 5204438 +
tcagtgtatggtatctcagt

SEQ ID NO: 57848 - DNA, 20 bp, Artificial Sequence
  Synthetic oligonucleotide; GTGAAT chr11 5204482 5204501 5204498 +
aatagagaagacaaatagca

SEQ ID NO: 57849 - DNA, 20 bp, Artificial Sequence
  Synthetic oligonucleotide; TTGAGT chr11 5204488 5204507 5204504 +
gaagacaaatagcagtgaat

SEQ ID NO: 57850 - DNA, 20 bp, Artificial Sequence
  Synthetic oligonucleotide; AAGGGT chr11 5204506 5204525 5204522 +
atttgagtctggagaaataa

SEQ ID NO: 57851 - DNA, 20 bp, Artificial Sequence
  Synthetic oligonucleotide; TGGAAT chr11 5204537 5204556 5204553 +
tatcccctctgagcactgtc

SEQ ID NO: 57852 - DNA, 20 bp, Artificial Sequence
  Synthetic oligonucleotide; AGGAGT chr11 5204592 5204611 5204608 +
aataaccaggtcattctttc

SEQ ID NO: 57853 - DNA, 20 bp, Artificial Sequence
  Synthetic oligonucleotide; CAGAAT chr11 5204674 5204693 5204690 +
tttttttttttctgtctttt

SEQ ID NO: 57854 - DNA, 20 bp, Artificial Sequence
  Synthetic oligonucleotide; TAGGGT chr11 5204713 5204732 5204729 +
attacttgcttactttaaaa

SEQ ID NO: 57855 - DNA, 20 bp, Artificial Sequence
  Synthetic oligonucleotide; TGGAGT chr11 5204826 5204845 5204842 +
attcctatttgccaaggcag

SEQ ID NO: 57856 - DNA, 20 bp, Artificial Sequence
  Synthetic oligonucleotide; AGGGGT chr11 5204951 5204970 5204967 +
ggtcttttctggacaccact

SEQ ID NO: 57857 - DNA, 20 bp, Artificial Sequence
  Synthetic oligonucleotide; AAGAGT chr11 5205044 5205063 5205060 +
gtaagcgaggtcaggccctc

SEQ ID NO: 57858 - DNA, 20 bp, Artificial Sequence
  Synthetic oligonucleotide; TGGGAT chr11 5205052 5205071 5205068 +
ggtcaggccctcaagagtct

SEQ ID NO: 57859 - DNA, 20 bp, Artificial Sequence
  Synthetic oligonucleotide; CTGAAT chr11 5205117 5205136 5205133 +
gaactgactgtttaatgatt

SEQ ID NO: 57860 - DNA, 20 bp, Artificial Sequence
  Synthetic oligonucleotide; GAGAAT chr11 5205136 5205155 5205152 +
tctgaatatgctagttcaga

SEQ ID NO: 57861 - DNA, 20 bp, Artificial Sequence
  Synthetic oligonucleotide; CTGAAT chr11 5205185 5205204 5205201 +
ggcttaaatttccagtttac

SEQ ID NO: 57862 - DNA, 20 bp, Artificial Sequence
  Synthetic oligonucleotide; AGGAAT chr11 5205208 5205227 5205224 +
aatggttatgacctaattag

SEQ ID NO: 57863 - DNA, 20 bp, Artificial Sequence
  Synthetic oligonucleotide; CTGAAT chr11 5205778 5205797 5205794 +
ctataagaaactggtaaaca

SEQ ID NO: 57864 - DNA, 20 bp, Artificial Sequence
  Synthetic oligonucleotide; ATGGAT chr11 5205885 5205904 5205901 +
aataataagtgcatatatta

SEQ ID NO: 57865 - DNA, 20 bp, Artificial Sequence
  Synthetic oligonucleotide; TGGGAT chr11 5205937 5205956 5205953 +
ataatatatataatatgtta

SEQ ID NO: 57866 - DNA, 20 bp, Artificial Sequence
  Synthetic oligonucleotide; GAGAGT chr11 5205978 5205997 5205994 +
atctatatatacattgtaga

SEQ ID NO: 57867 - DNA, 20 bp, Artificial Sequence
  Synthetic oligonucleotide; ATGAAT chr11 5206003 5206022 5206019 +
tctatcaagctaattagcat

SEQ ID NO: 57868 - DNA, 20 bp, Artificial Sequence
  Synthetic oligonucleotide; GAGGAT chr11 5206288 5206307 5206304 +
aaatgaacagttaaatttat

SEQ ID NO: 57869 - DNA, 20 bp, Artificial Sequence
  Synthetic oligonucleotide; TAGAAT chr11 5206342 5206361 5206358 +
aagttgtcctctgaaaattc

SEQ ID NO: 57870 - DNA, 20 bp, Artificial Sequence
  Synthetic oligonucleotide; TCGAGT chr11 5206405 5206424 5206421 +
tgtaaaggctttctaagaaa

SEQ ID NO: 57871 - DNA, 20 bp, Artificial Sequence
  Synthetic oligonucleotide; GGGGGT chr11 5206454 5206473 5206470 +
ccaggtccaatttttctcca

SEQ ID NO: 57872 - DNA, 20 bp, Artificial Sequence
  Synthetic oligonucleotide; TGGAAT chr11 5206532 5206551 5206548 +
actttctcatcaccacacag

SEQ ID NO: 57873 - DNA, 20 bp, Artificial Sequence
  Synthetic oligonucleotide; AAGAAT chr11 5206538 5206557 5206554 +
tcatcaccacacagtggaat

SEQ ID NO: 57874 - DNA, 20 bp, Artificial Sequence
  Synthetic oligonucleotide; ATGAAT chr11 5206604 5206623 5206620 +
gtaaagccttcagaaaaagt

SEQ ID NO: 57875 - DNA, 20 bp, Artificial Sequence
  Synthetic oligonucleotide; TTGAAT chr11 5206709 5206728 5206725 +
atgttattaaagctaaaatt

SEQ ID NO: 57876 - DNA, 20 bp, Artificial Sequence
  Synthetic oligonucleotide; AAGAAT chr11 5206760 5206779 5206776 +
tctatctttctgttcaagaa

SEQ ID NO: 57877 - DNA, 20 bp, Artificial Sequence
  Synthetic oligonucleotide; ATGGAT chr11 5206901 5206920 5206917 +
gacctcagaacataggagag

SEQ ID NO: 57878 - DNA, 20 bp, Artificial Sequence
  Synthetic oligonucleotide; CAGAGT chr11 5206918 5206937 5206934 +
gagatggatattgtacacca

SEQ ID NO: 57879 - DNA, 20 bp, Artificial Sequence
  Synthetic oligonucleotide; CAGGAT chr11 5206925 5206944 5206941 +
atattgtacaccacagagtc

SEQ ID NO: 57880 - DNA, 20 bp, Artificial Sequence
  Synthetic oligonucleotide; AAGGAT chr11 5206942 5206961 5206958 +
gtccaggatgactagcagtg

SEQ ID NO: 57881 - DNA, 20 bp, Artificial Sequence
  Synthetic oligonucleotide; AGGGAT chr11 5207007 5207026 5207023 +
ccaagtccccaaagacaaga

SEQ ID NO: 57882 - DNA, 20 bp, Artificial Sequence
  Synthetic oligonucleotide; AAGGAT chr11 5207066 5207085 5207082 +
atgagccctcccattgctat

SEQ ID NO: 57883 - DNA, 20 bp, Artificial Sequence
  Synthetic oligonucleotide; GGGGAT chr11 5207072 5207091 5207088 +
cctcccattgctataaggat

SEQ ID NO: 57884 - DNA, 20 bp, Artificial Sequence
  Synthetic oligonucleotide; AGGGAT chr11 5207188 5207207 5207204 +
attccaacctcaaccaaatg

SEQ ID NO: 57885 - DNA, 20 bp, Artificial Sequence
  Synthetic oligonucleotide; GGGGAT chr11 5207198 5207217 5207214 +
caaccaaatgagggatggct

SEQ ID NO: 57886 - DNA, 20 bp, Artificial Sequence
  Synthetic oligonucleotide; GGGAGT chr11 5207233 5207252 5207249 +
aagatactgtatcttaggag

SEQ ID NO: 57887 - DNA, 20 bp, Artificial Sequence
  Synthetic oligonucleotide; CAGGAT chr11 5207262 5207281 5207278 +
ttttttttatagaaactcgt

SEQ ID NO: 57888 - DNA, 20 bp, Artificial Sequence
  Synthetic oligonucleotide; TAGGAT chr11 5207276 5207295 5207292 +
actcgtcaggatattattgc

SEQ ID NO: 57889 - DNA, 20 bp, Artificial Sequence
  Synthetic oligonucleotide; TGGAAT chr11 5207307 5207326 5207323 +
gttactgggaaaaaagctga

SEQ ID NO: 57890 - DNA, 20 bp, Artificial Sequence
  Synthetic oligonucleotide; AAGAGT chr11 5207317 5207336 5207333 +
aaaaagctgatggaatacaa

SEQ ID NO: 57891 - DNA, 20 bp, Artificial Sequence
  Synthetic oligonucleotide; AGGGAT chr11 5207335 5207354 5207351 +
aaaagagtagacatccccac

SEQ ID NO: 57892 - DNA, 20 bp, Artificial Sequence
  Synthetic oligonucleotide; TTGGAT chr11 5207559 5207578 5207575 +
agatctaaaattgtaatttc

SEQ ID NO: 57893 - DNA, 20 bp, Artificial Sequence
  Synthetic oligonucleotide; TAGAAT chr11 5207568 5207587 5207584 +
attgtaatttcttggattcc

SEQ ID NO: 57894 - DNA, 20 bp, Artificial Sequence
  Synthetic oligonucleotide; GTGGAT chr11 5207584 5207603 5207600 +
ttcctagaatttctaaatct

SEQ ID NO: 57895 - DNA, 20 bp, Artificial Sequence
  Synthetic oligonucleotide; TAGAAT chr11 5207593 5207612 5207609 +
tttctaaatctgtggatttt

SEQ ID NO: 57896 - DNA, 20 bp, Artificial Sequence
  Synthetic oligonucleotide; TTGGAT chr11 5207650 5207669 5207666 +
gctaccggagctatgtactt

SEQ ID NO: 57897 - DNA, 20 bp, Artificial Sequence
  Synthetic oligonucleotide; AAGAGT chr11 5207658 5207677 5207674 +
agctatgtacttttggatat

SEQ ID NO: 57898 - DNA, 20 bp, Artificial Sequence
  Synthetic oligonucleotide; TAGAAT chr11 5207754 5207773 5207770 +
atcagaaggaaccattgtcc

SEQ ID NO: 57899 - DNA, 20 bp, Artificial Sequence
  Synthetic oligonucleotide; AGGAAT chr11 5208117 5208136 5208133 +
tttggtttgtcatttttcga

SEQ ID NO: 57900 - DNA, 20 bp, Artificial Sequence
  Synthetic oligonucleotide; AGGAAT chr11 5208191 5208210 5208207 +
tagctcttaatttattattg

SEQ ID NO: 57901 - DNA, 20 bp, Artificial Sequence
  Synthetic oligonucleotide; GAGAGT chr11 5208252 5208271 5208268 +
agctattaacttatggacct

SEQ ID NO: 57902 - DNA, 20 bp, Artificial Sequence
  Synthetic oligonucleotide; TTGAGT chr11 5208371 5208390 5208387 +
aaataatagtggtttgaaat

SEQ ID NO: 57903 - DNA, 20 bp, Artificial Sequence
  Synthetic oligonucleotide; TAGAGT chr11 5208376 5208395 5208392 +
atagtggtttgaaatttgag

SEQ ID NO: 57904 - DNA, 20 bp, Artificial Sequence
  Synthetic oligonucleotide; GGGAAT chr11 5208406 5208425 5208422 +
ccaagaaaatgcatatttca

SEQ ID NO: 57905 - DNA, 20 bp, Artificial Sequence
  Synthetic oligonucleotide; AAGAAT chr11 5208468 5208487 5208484 +
gtaattagctccttagctga

SEQ ID NO: 57906 - DNA, 20 bp, Artificial Sequence
  Synthetic oligonucleotide; AGGGAT chr11 5208685 5208704 5208701 +
ttgattattaaatatatata

SEQ ID NO: 57907 - DNA, 20 bp, Artificial Sequence
  Synthetic oligonucleotide; GAGAGT chr11 5208695 5208714 5208711 +
aatatatataagggatagaa

SEQ ID NO: 57908 - DNA, 20 bp, Artificial Sequence
  Synthetic oligonucleotide; GAGAGT chr11 5208702 5208721 5208718 +
ataagggatagaagagagtg

SEQ ID NO: 57909 - DNA, 20 bp, Artificial Sequence
  Synthetic oligonucleotide; CTGAGT chr11 5208746 5208765 5208762 +
caaaattttgtcttggaaat

SEQ ID NO: 57910 - DNA, 20 bp, Artificial Sequence
  Synthetic oligonucleotide; GAGGAT chr11 5208799 5208818 5208815 +
agaggaaactgaaagaagtg

SEQ ID NO: 57911 - DNA, 20 bp, Artificial Sequence
  Synthetic oligonucleotide; CTGAGT chr11 5208827 5208846 5208843 +
tttactatcttttcaactcg

SEQ ID NO: 57912 - DNA, 20 bp, Artificial Sequence
  Synthetic oligonucleotide; TGGAGT chr11 5208949 5208968 5208965 +
agcaatgaagttctttttag

SEQ ID NO: 57913 - DNA, 20 bp, Artificial Sequence
  Synthetic oligonucleotide; TGGAAT chr11 5209001 5209020 5209017 +
agtgaagacactgctgactt

SEQ ID NO: 57914 - DNA, 20 bp, Artificial Sequence
  Synthetic oligonucleotide; AAGAAT chr11 5209010 5209029 5209026 +
actgctgactttggaattga

SEQ ID NO: 57915 - DNA, 20 bp, Artificial Sequence
  Synthetic oligonucleotide; CTGAGT chr11 5209037 5209056 5209053 +
ttagctcagctacttactag

SEQ ID NO: 57916 - DNA, 20 bp, Artificial Sequence
  Synthetic oligonucleotide; ACGAAT chr11 5209088 5209107 5209104 +
caagacagtgtgtgtaaaag

SEQ ID NO: 57917 - DNA, 20 bp, Artificial Sequence
  Synthetic oligonucleotide; CAGGAT chr11 5209113 5209132 5209129 +
taacaacatctcaggaagca

SEQ ID NO: 57918 - DNA, 20 bp, Artificial Sequence
  Synthetic oligonucleotide; AAGAAT chr11 5209309 5209328 5209325 +
ctaattgactaaagccattt

SEQ ID NO: 57919 - DNA, 20 bp, Artificial Sequence
  Synthetic oligonucleotide; CTGAAT chr11 5209460 5209479 5209476 +
cacaaattatacatgcacag

SEQ ID NO: 57920 - DNA, 20 bp, Artificial Sequence
  Synthetic oligonucleotide; AAGAGT chr11 5209519 5209538 5209535 +
actaataagataggaaatta

SEQ ID NO: 57921 - DNA, 20 bp, Artificial Sequence
  Synthetic oligonucleotide; TTGAAT chr11 5209642 5209661 5209658 +
tttttaaaagtgtgtataca

SEQ ID NO: 57922 - DNA, 20 bp, Artificial Sequence
  Synthetic oligonucleotide; GTGAAT chr11 5209691 5209710 5209707 +
ctttattcaatattatgttt

SEQ ID NO: 57923 - DNA, 20 bp, Artificial Sequence
  Synthetic oligonucleotide; CTGAAT chr11 5209738 5209757 5209754 +
ctgtagttgatttttcattt

SEQ ID NO: 57924 - DNA, 20 bp, Artificial Sequence
  Synthetic oligonucleotide; TTGAGT chr11 5209803 5209822 5209819 +
actccacagttgatagatat

SEQ ID NO: 57925 - DNA, 20 bp, Artificial Sequence
  Synthetic oligonucleotide; TTGAAT chr11 5210028 5210047 5210044 +
agcctgcatgtgcccagatt

SEQ ID NO: 57926 - DNA, 20 bp, Artificial Sequence
  Synthetic oligonucleotide; AGGAAT chr11 5210207 5210226 5210223 +
ctttttgcccctacttgact

SEQ ID NO: 57927 - DNA, 20 bp, Artificial Sequence
  Synthetic oligonucleotide; CAGAAT chr11 5210268 5210287 5210284 +
caagctggcctcaactggaa

SEQ ID NO: 57928 - DNA, 20 bp, Artificial Sequence
  Synthetic oligonucleotide; TGGAGT chr11 5210345 5210364 5210361 +
gtactttttccttttcccca

SEQ ID NO: 57929 - DNA, 20 bp, Artificial Sequence
  Synthetic oligonucleotide; CAGAAT chr11 5210423 5210442 5210439 +
taaagcctaatcctgccatc

SEQ ID NO: 57930 - DNA, 20 bp, Artificial Sequence
  Synthetic oligonucleotide; GTGGAT chr11 5210435 5210454 5210451 +
ctgccatccagaatgagcaa

SEQ ID NO: 57931 - DNA, 20 bp, Artificial Sequence
  Synthetic oligonucleotide; CAGAAT chr11 5210466 5210485 5210482 +
aaagggaagggaaaaaggag

SEQ ID NO: 57932 - DNA, 20 bp, Artificial Sequence
  Synthetic oligonucleotide; CAGGAT chr11 5210517 5210536 5210533 +
tgtttctcccacttgctctg

SEQ ID NO: 57933 - DNA, 20 bp, Artificial Sequence
  Synthetic oligonucleotide; TTGAAT chr11 5210677 5210696 5210693 +
cctaatctcgttagtacctt

SEQ ID NO: 57934 - DNA, 20 bp, Artificial Sequence
  Synthetic oligonucleotide; TTGAGT chr11 5210701 5210720 5210717 +
attagttttcaagataggac

SEQ ID NO: 57935 - DNA, 20 bp, Artificial Sequence
  Synthetic oligonucleotide; AAGGAT chr11 5210713 5210732 5210729 +
gataggacttgagttcctcg

SEQ ID NO: 57936 - DNA, 20 bp, Artificial Sequence
  Synthetic oligonucleotide; AGGAGT chr11 5210815 5210834 5210831 +
agggagaacgatttgagctc

SEQ ID NO: 57937 - DNA, 20 bp, Artificial Sequence
  Synthetic oligonucleotide; CCGAAT chr11 5210880 5210899 5210896 +
caaaaaattttaaaaagtag

SEQ ID NO: 57938 - DNA, 20 bp, Artificial Sequence
  Synthetic oligonucleotide; AAGGAT chr11 5210933 5210952 5210949 +
tacttgggaggctgaggtgg

SEQ ID NO: 57939 - DNA, 20 bp, Artificial Sequence
  Synthetic oligonucleotide; CTGAAT chr11 5211083 5211102 5211099 +
attcaggttgtcagaagtaa

SEQ ID NO: 57940 - DNA, 20 bp, Artificial Sequence
  Synthetic oligonucleotide; GAGAAT chr11 5211254 5211273 5211270 +
tcaaattacaaagaaggaca

SEQ ID NO: 57941 - DNA, 20 bp, Artificial Sequence
  Synthetic oligonucleotide; AAGAAT chr11 5211370 5211389 5211386 +
aggtggaaagaggagcaagg

SEQ ID NO: 57942 - DNA, 20 bp, Artificial Sequence
  Synthetic oligonucleotide; ATGGGT chr11 5211438 5211457 5211454 +
tacatagctaaacacatgtc

SEQ ID NO: 57943 - DNA, 20 bp, Artificial Sequence
  Synthetic oligonucleotide; AAGGAT chr11 5211640 5211659 5211656 +
tgttcttacattagtttgtt

SEQ ID NO: 57944 - DNA, 20 bp, Artificial Sequence
  Synthetic oligonucleotide; TAGAAT chr11 5211837 5211856 5211853 +
gtgtgcatgtgtctttgtga

SEQ ID NO: 57945 - DNA, 20 bp, Artificial Sequence
  Synthetic oligonucleotide; TAGGAT chr11 5211875 5211894 5211891 +
tttaggtatatactcaataa

SEQ ID NO: 57946 - DNA, 20 bp, Artificial Sequence
  Synthetic oligonucleotide; TTGGGT chr11 5211883 5211902 5211899 +
tatactcaataataggattg

SEQ ID NO: 57947 - DNA, 20 bp, Artificial Sequence
  Synthetic oligonucleotide; GGGAAT chr11 5211918 5211937 5211934 +
tttctgtttttaggtcttta

SEQ ID NO: 57948 - DNA, 20 bp, Artificial Sequence
  Synthetic oligonucleotide; TTGGGT chr11 5212074 5212093 5212090 +
atgtgagatagtatctcatt

SEQ ID NO: 57949 - DNA, 20 bp, Artificial Sequence
  Synthetic oligonucleotide; TTGAAT chr11 5212155 5212174 5212171 +
ggccacatgtatgtcttctt

SEQ ID NO: 57950 - DNA, 20 bp, Artificial Sequence
  Synthetic oligonucleotide; CTGAAT chr11 5212243 5212262 5212259 +
atttaagttccttatagatt

SEQ ID NO: 57951 - DNA, 20 bp, Artificial Sequence
  Synthetic oligonucleotide; TTGGAT chr11 5212261 5212280 5212277 +
ttctgaatattaggcctttg

SEQ ID NO: 57952 - DNA, 20 bp, Artificial Sequence
  Synthetic oligonucleotide; CGGAAT chr11 5212434 5212453 5212450 +
tctttgcccctgcttatgtc

SEQ ID NO: 57953 - DNA, 20 bp, Artificial Sequence
  Synthetic oligonucleotide; TTGGGT chr11 5212476 5212495 5212492 +
ctttcaagcatttttatagt

SEQ ID NO: 57954 - DNA, 20 bp, Artificial Sequence
  Synthetic oligonucleotide; TTGAGT chr11 5212507 5212526 5212523 +
atttaagtctctaatccatc

SEQ ID NO: 57955 - DNA, 20 bp, Artificial Sequence
  Synthetic oligonucleotide; CGGGGT chr11 5212536 5212555 5212552 +
tttgtgtatatgatatagaa

SEQ ID NO: 57956 - DNA, 20 bp, Artificial Sequence
  Synthetic oligonucleotide; TTGAAT chr11 5212592 5212611 5212608 +
agttatcccaacaccacttg

SEQ ID NO: 57957 - DNA, 20 bp, Artificial Sequence
  Synthetic oligonucleotide; TAGGGT chr11 5212597 5212616 5212613 +
tcccaacaccacttgttgaa

SEQ ID NO: 57958 - DNA, 20 bp, Artificial Sequence
  Synthetic oligonucleotide; GTGAGT chr11 5213023 5213042 5213039 +
tcatttttcaattcccacct

SEQ ID NO: 57959 - DNA, 20 bp, Artificial Sequence
  Synthetic oligonucleotide; TAGGAT chr11 5213031 5213050 5213047 +
caattcccacctgtgagtat

SEQ ID NO: 57960 - DNA, 20 bp, Artificial Sequence
  Synthetic oligonucleotide; AAGAAT chr11 5213108 5213127 5213124 +
tgtatttttctagttctgtg

SEQ ID NO: 57961 - DNA, 20 bp, Artificial Sequence
  Synthetic oligonucleotide; AGGAAT chr11 5213131 5213150 5213147 +
aatgtcattggtagtttgat

SEQ ID NO: 57962 - DNA, 20 bp, Artificial Sequence
  Synthetic oligonucleotide; TGGGAT chr11 5213344 5213363 5213360 +
ctttttgtggcaacggtaaa

SEQ ID NO: 57963 - DNA, 20 bp, Artificial Sequence
  Synthetic oligonucleotide; GGGAAT chr11 5213393 5213412 5213409 +
cttggctattgttgatgtat

SEQ ID NO: 57964 - DNA, 20 bp, Artificial Sequence
  Synthetic oligonucleotide; AGGGAT chr11 5213504 5213523 5213520 +
gttttctagatacagaaaac

SEQ ID NO: 57965 - DNA, 20 bp, Artificial Sequence
  Synthetic oligonucleotide; TTGGAT chr11 5213533 5213552 5213549 +
ttgactttctctcttcctat

SEQ ID NO: 57966 - DNA, 20 bp, Artificial Sequence
  Synthetic oligonucleotide; CTGAAT chr11 5213594 5213613 5213610 +
ccaggactgccagtactata

SEQ ID NO: 57967 - DNA, 20 bp, Artificial Sequence
  Synthetic oligonucleotide; AAGAAT chr11 5213645 5213664 5213661 +
gtcttgtgccagttttcaag

SEQ ID NO: 57968 - DNA, 20 bp, Artificial Sequence
  Synthetic oligonucleotide; GTGGGT chr11 5213687 5213706 5213703 +
cattctgtatgatgttggct

SEQ ID NO: 57969 - DNA, 20 bp, Artificial Sequence
  Synthetic oligonucleotide; TTGAAT chr11 5213773 5213792 5213789 +
ggttttaacatgaagtgaag

SEQ ID NO: 57970 - DNA, 20 bp, Artificial Sequence
  Synthetic oligonucleotide; ATGAAT chr11 5213848 5213867 5213864 +
tttttagtgctgtatatatg

SEQ ID NO: 57971 - DNA, 20 bp, Artificial Sequence
  Synthetic oligonucleotide; AGGGAT chr11 5213896 5213915 5213912 +
ctgaaccaatcttgcttctc

SEQ ID NO: 57972 - DNA, 20 bp, Artificial Sequence
  Synthetic oligonucleotide; GTGGAT chr11 5213920 5213939 5213936 +
ataaagcctacttgattgag

SEQ ID NO: 57973 - DNA, 20 bp, Artificial Sequence
  Synthetic oligonucleotide; CTGGAT chr11 5213944 5213963 5213960 +
attagctttgtgatgtgttg

SEQ ID NO: 57974 - DNA, 20 bp, Artificial Sequence
  Synthetic oligonucleotide; AAGGAT chr11 5213981 5214000 5213997 +
gtatttttgcatcaatgttc

SEQ ID NO: 57975 - DNA, 20 bp, Artificial Sequence
  Synthetic oligonucleotide; CAGGAT chr11 5214040 5214059 5214056 +
tgtctatcaggttttggtat

SEQ ID NO: 57976 - DNA, 20 bp, Artificial Sequence
  Synthetic oligonucleotide; TTGAAT chr11 5214074 5214093 5214090 +
cctcataaaatgagctgagg

SEQ ID NO: 57977 - DNA, 20 bp, Artificial Sequence
  Synthetic oligonucleotide; TGGAGT chr11 5214098 5214117 5214114 +
atccctccccctcaattttt

SEQ ID NO: 57978 - DNA, 20 bp, Artificial Sequence
  Synthetic oligonucleotide; AGGAAT chr11 5214113 5214132 5214129 +
ttttttggagtagcttcagt

SEQ ID NO: 57979 - DNA, 20 bp, Artificial Sequence
  Synthetic oligonucleotide; TAGAAT chr11 5214146 5214165 5214162 +
actcttctttgtgcatctga

SEQ ID NO: 57980 - DNA, 20 bp, Artificial Sequence
  Synthetic oligonucleotide; GTGAAT chr11 5214158 5214177 5214174 +
gcatctgatagaatttggtt

SEQ ID NO: 57981 - DNA, 20 bp, Artificial Sequence
  Synthetic oligonucleotide; CTGAAT chr11 5214206 5214225 5214222 +
gtttgataggctatttatta

SEQ ID NO: 57982 - DNA, 20 bp, Artificial Sequence
  Synthetic oligonucleotide; ATGGAT chr11 5214229 5214248 5214245 +
aatcattttcagagctcatc

SEQ ID NO: 57983 - DNA, 20 bp, Artificial Sequence
  Synthetic oligonucleotide; AGGAAT chr11 5214338 5214357 5214354 +
caatcactctcagaccacag

SEQ ID NO: 57984 - DNA, 20 bp, Artificial Sequence
  Synthetic oligonucleotide; ATGAAT chr11 5214364 5214383 5214380 +
aaaaatagatttcaagacta

SEQ ID NO: 57985 - DNA, 20 bp, Artificial Sequence
  Synthetic oligonucleotide; CTGAAT chr11 5214413 5214432 5214429 +
ggaaattaaacaacctgctc

SEQ ID NO: 57986 - DNA, 20 bp, Artificial Sequence
  Synthetic oligonucleotide; ATGAAT chr11 5214417 5214436 5214433 +
attaaacaacctgctcctga

SEQ ID NO: 57987 - DNA, 20 bp, Artificial Sequence
  Synthetic oligonucleotide; TTGGGT chr11 5214424 5214443 5214440 +
aacctgctcctgaatgaatt

SEQ ID NO: 57988 - DNA, 20 bp, Artificial Sequence
  Synthetic oligonucleotide; CGGAAT chr11 5214498 5214517 5214514 +
agaacaaagatacaatatac

SEQ ID NO: 57989 - DNA, 20 bp, Artificial Sequence
  Synthetic oligonucleotide; AAGGAT chr11 5214685 5214704 5214701 +
aacaagatcaaagctaactg

SEQ ID NO: 57990 - DNA, 20 bp, Artificial Sequence
  Synthetic oligonucleotide; ATGAGT chr11 5214722 5214741 5214738 +
aaataccattcaaaagatta

SEQ ID NO: 57991 - DNA, 20 bp, Artificial Sequence
  Synthetic oligonucleotide; GGGAAT chr11 5214831 5214850 5214847 +
gcacagttagaaatgaaaaa

SEQ ID NO: 57992 - DNA, 20 bp, Artificial Sequence
  Synthetic oligonucleotide; ATGGAT chr11 5214924 5214943 5214940 +
aactagaaaatctaaaagaa

SEQ ID NO: 57993 - DNA, 20 bp, Artificial Sequence
  Synthetic oligonucleotide; TTGAGT chr11 5214993 5215012 5215009 +
gtactttatttgagggctct

SEQ ID NO: 57994 - DNA, 20 bp, Artificial Sequence
  Synthetic oligonucleotide; TAGAGT chr11 5214998 5215017 5215014 +
ttatttgagggctctttgag

SEQ ID NO: 57995 - DNA, 20 bp, Artificial Sequence
  Synthetic oligonucleotide; CAGAAT chr11 5215047 5215066 5215063 +
caactctatgtccccctccc

SEQ ID NO: 57996 - DNA, 20 bp, Artificial Sequence
  Synthetic oligonucleotide; CTGAAT chr11 5215109 5215128 5215125 +
tggttatatctgtgttatat

SEQ ID NO: 57997 - DNA, 20 bp, Artificial Sequence
  Synthetic oligonucleotide; GAGAAT chr11 5215126 5215145 5215142 +
tatctgaatatatggctcta

SEQ ID NO: 57998 - DNA, 20 bp, Artificial Sequence
  Synthetic oligonucleotide; CTGAAT chr11 5215169 5215188 5215185 +
gctagtccaaaatccaagct

SEQ ID NO: 57999 - DNA, 20 bp, Artificial Sequence
  Synthetic oligonucleotide; TTGGAT chr11 5215191 5215210 5215207 +
gaataagacaggtgagacct

SEQ ID NO: 58000 - DNA, 20 bp, Artificial Sequence
  Synthetic oligonucleotide; ATGAAT chr11 5215195 5215214 5215211 +
aagacaggtgagacctttgg

SEQ ID NO: 58001 - DNA, 20 bp, Artificial Sequence
  Synthetic oligonucleotide; AAGAAT chr11 5215236 5215255 5215252 +
tgagaagatgtgaagaaccc

SEQ ID NO: 58002 - DNA, 20 bp, Artificial Sequence
  Synthetic oligonucleotide; AGGGGT chr11 5215272 5215291 5215288 +
aacagccccgaggcactgca

SEQ ID NO: 58003 - DNA, 20 bp, Artificial Sequence
  Synthetic oligonucleotide; GAGAAT chr11 5215292 5215311 5215308 +
aggggttcagacctgtgttg

SEQ ID NO: 58004 - DNA, 20 bp, Artificial Sequence
  Synthetic oligonucleotide; CAGGAT chr11 5215386 5215405 5215402 +
tgtttgtttttcctcagaga

SEQ ID NO: 58005 - DNA, 20 bp, Artificial Sequence
  Synthetic oligonucleotide; CTGGGT chr11 5215483 5215502 5215499 +
gatcctatcacttcagcctc

SEQ ID NO: 58006 - DNA, 20 bp, Artificial Sequence
  Synthetic oligonucleotide; TAGAGT chr11 5215838 5215857 5215854 +
atatatggagagactgaggt

SEQ ID NO: 58007 - DNA, 20 bp, Artificial Sequence
  Synthetic oligonucleotide; AGGAAT chr11 5215884 5215903 5215900 +
gtcacaactaatctagttga

SEQ ID NO: 58008 - DNA, 20 bp, Artificial Sequence
  Synthetic oligonucleotide; ACGGAT chr11 5215955 5215974 5215971 +
aaagacttgataatggctct

SEQ ID NO: 58009 - DNA, 20 bp, Artificial Sequence
  Synthetic oligonucleotide; TAGGAT chr11 5215979 5215998 5215995 +
atgtgtgagatcagttttaa

SEQ ID NO: 58010 - DNA, 20 bp, Artificial Sequence
  Synthetic oligonucleotide; TAGGGT chr11 5216015 5216034 5216031 +
tattattatacttcaagttt

SEQ ID NO: 58011 - DNA, 20 bp, Artificial Sequence
  Synthetic oligonucleotide; CAGAGT chr11 5216160 5216179 5216176 +
ccccaccccataacagtccc

SEQ ID NO: 58012 - DNA, 20 bp, Artificial Sequence
  Synthetic oligonucleotide; ATGAGT chr11 5216217 5216236 5216233 +
tcattgttcaattcccacct

SEQ ID NO: 58013 - DNA, 20 bp, Artificial Sequence
  Synthetic oligonucleotide; GAGAAT chr11 5216267 5216286 5216283 +
tctccttgtgatagtttgct

SEQ ID NO: 58014 - DNA, 20 bp, Artificial Sequence
  Synthetic oligonucleotide; TTGGGT chr11 5216397 5216416 5216413 +
agtctatcgttgttggacat

SEQ ID NO: 58015 - DNA, 20 bp, Artificial Sequence
  Synthetic oligonucleotide; GTGAAT chr11 5216424 5216443 5216440 +
ggttccaagtctttgctatt

SEQ ID NO: 58016 - DNA, 20 bp, Artificial Sequence
  Synthetic oligonucleotide; TTGGGT chr11 5216488 5216507 5216504 +
gcagcatgatttataatcct

SEQ ID NO: 58017 - DNA, 20 bp, Artificial Sequence
  Synthetic oligonucleotide; TGGGAT chr11 5216507 5216526 5216523 +
tttgggtatgtacccagtaa

SEQ ID NO: 58018 - DNA, 20 bp, Artificial Sequence
  Synthetic oligonucleotide; CTGGGT chr11 5216515 5216534 5216531 +
tgtacccagtaatgggatgg

SEQ ID NO: 58019 - DNA, 20 bp, Artificial Sequence
  Synthetic oligonucleotide; AGGAAT chr11 5216550 5216569 5216566 +
tttctagttctagattcctg

SEQ ID NO: 58020 - DNA, 20 bp, Artificial Sequence
  Synthetic oligonucleotide; TGGGGT chr11 5216828 5216847 5216844 +
atcctttgcccactttttga

SEQ ID NO: 58021 - DNA, 20 bp, Artificial Sequence
  Synthetic oligonucleotide; TTGAGT chr11 5216859 5216878 5216875 +
gttttttcttgtaaatttgt

SEQ ID NO: 58022 - DNA, 20 bp, Artificial Sequence
  Synthetic oligonucleotide; CTGGAT chr11 5216877 5216896 5216893 +
gtttgagttcattgtagatt

SEQ ID NO: 58023 - DNA, 20 bp, Artificial Sequence
  Synthetic oligonucleotide; ATGAGT chr11 5216899 5216918 5216915 +
ggatattagccctttgtcag

SEQ ID NO: 58024 - DNA, 20 bp, Artificial Sequence
  Synthetic oligonucleotide; CTGAAT chr11 5217074 5217093 5217090 +
tccttgcccatgcctatgtc

SEQ ID NO: 58025 - DNA, 20 bp, Artificial Sequence
  Synthetic oligonucleotide; TAGGGT chr11 5217101 5217120 5217117 +
gtattgcctaggtttttttc

SEQ ID NO: 58026 - DNA, 20 bp, Artificial Sequence
  Synthetic oligonucleotide; TTGAAT chr11 5217148 5217167 5217164 +
atgtaagtctttaatccatc

SEQ ID NO: 58027 - DNA, 20 bp, Artificial Sequence
  Synthetic oligonucleotide; AGGGAT chr11 5217178 5217197 5217194 +
ttttgtataaggtgtaagga

SEQ ID NO: 58028 - DNA, 20 bp, Artificial Sequence
  Synthetic oligonucleotide; GGGAAT chr11 5217241 5217260 5217257 +
ccagcaccatttattaaata

SEQ ID NO: 58029 - DNA, 20 bp, Artificial Sequence
  Synthetic oligonucleotide; TAGGAT chr11 5217449 5217468 5217465 +
ccagctttgttcttttggct

SEQ ID NO: 58030 - DNA, 20 bp, Artificial Sequence
  Synthetic oligonucleotide; GGGGAT chr11 5217545 5217564 5217561 +
aaagtcattggtagcttgat

SEQ ID NO: 58031 - DNA, 20 bp, Artificial Sequence
  Synthetic oligonucleotide; TTGAAT chr11 5217555 5217574 5217571 +
gtagcttgatggggatggca

SEQ ID NO: 58032 - DNA, 20 bp, Artificial Sequence
  Synthetic oligonucleotide; TGGAAT chr11 5217623 5217642 5217639 +
attcttcctacccatgagca

SEQ ID NO: 58033 - DNA, 20 bp, Artificial Sequence
  Synthetic oligonucleotide; TTGGAT chr11 5217716 5217735 5217732 +
tccttcacatcccttgtaag

SEQ ID NO: 58034 - DNA, 20 bp, Artificial Sequence
  Synthetic oligonucleotide; GTGAAT chr11 5217753 5217772 5217769 +
ttattctctttgaagcaatt

SEQ ID NO: 58035 - DNA, 20 bp, Artificial Sequence
  Synthetic oligonucleotide; GGGAGT chr11 5217759 5217778 5217775 +
tctttgaagcaattgtgaat

SEQ ID NO: 58036 - DNA, 20 bp, Artificial Sequence
  Synthetic oligonucleotide; AGGAAT chr11 5217807 5217826 5217823 +
tttgtctgttattggtgcat

SEQ ID NO: 58037 - DNA, 20 bp, Artificial Sequence
  Synthetic oligonucleotide; TGGGGT chr11 5217898 5217917 5217914 +
gagattttgggctgagacaa

SEQ ID NO: 58038 - DNA, 20 bp, Artificial Sequence
  Synthetic oligonucleotide; TTGAAT chr11 5217965 5217984 5217981 +
ttcacttcctcttttcctaa

SEQ ID NO: 58039 - DNA, 20 bp, Artificial Sequence
  Synthetic oligonucleotide; TTGAAT chr11 5218026 5218045 5218042 +
ccagaacttacaacactatg

SEQ ID NO: 58040 - DNA, 20 bp, Artificial Sequence
  Synthetic oligonucleotide; AGGAGT chr11 5218032 5218051 5218048 +
cttacaacactatgttgaat

SEQ ID NO: 58041 - DNA, 20 bp, Artificial Sequence
  Synthetic oligonucleotide; GGGAAT chr11 5218077 5218096 5218093 +
gccttgtgccagttttcaaa

SEQ ID NO: 58042 - DNA, 20 bp, Artificial Sequence
  Synthetic oligonucleotide; GTGGGT chr11 5218119 5218138 5218135 +
cactcagtatgatattggct

SEQ ID NO: 58043 - DNA, 20 bp, Artificial Sequence
  Synthetic oligonucleotide; GAGAGT chr11 5218181 5218200 5218197 +
ccatcaatacctaatttatt

SEQ ID NO: 58044 - DNA, 20 bp, Artificial Sequence
  Synthetic oligonucleotide; TTGAAT chr11 5218205 5218224 5218221 +
gtttttagcatgaagcgttg

SEQ ID NO: 58045 - DNA, 20 bp, Artificial Sequence
  Synthetic oligonucleotide; CTGGAT chr11 5218280 5218299 5218296 +
tctttggttctgtttatatg

SEQ ID NO: 58046 - DNA, 20 bp, Artificial Sequence
  Synthetic oligonucleotide; AGGGAT chr11 5218328 5218347 5218344 +
ttgaaccagccttgcatggc

SEQ ID NO: 58047 - DNA, 20 bp, Artificial Sequence
  Synthetic oligonucleotide; GTGGAT chr11 5218352 5218371 5218368 +
atgaagcccacttgatcatg

SEQ ID NO: 58048 - DNA, 20 bp, Artificial Sequence
  Synthetic oligonucleotide; GAGGAT chr11 5218378 5218397 5218394 +
cagtttgccagtattttatt

SEQ ID NO: 58049 - DNA, 20 bp, Artificial Sequence
  Synthetic oligonucleotide; AAGGAT chr11 5218403 5218422 5218419 +
tttttgcatcaatgttcatc

SEQ ID NO: 58050 - DNA, 20 bp, Artificial Sequence
  Synthetic oligonucleotide; CAGGAT chr11 5218459 5218478 5218475 +
tctctgtcaggctttggtat

SEQ ID NO: 58051 - DNA, 20 bp, Artificial Sequence
  Synthetic oligonucleotide; ATGAGT chr11 5218482 5218501 5218498 +
gatgatgctggcctcataaa

SEQ ID NO: 58052 - DNA, 20 bp, Artificial Sequence
  Synthetic oligonucleotide; GAGGAT chr11 5218492 5218511 5218508 +
gcctcataaaatgagttagg

SEQ ID NO: 58053 - DNA, 20 bp, Artificial Sequence
  Synthetic oligonucleotide; TGGAAT chr11 5218517 5218536 5218533 +
ttccctctttttctattgat

SEQ ID NO: 58054 - DNA, 20 bp, Artificial Sequence
  Synthetic oligonucleotide; AGGAAT chr11 5218532 5218551 5218548 +
ttgattggaatagtttcaga

SEQ ID NO: 58055 - DNA, 20 bp, Artificial Sequence
  Synthetic oligonucleotide; TAGAAT chr11 5218565 5218584 5218581 +
gctcctccttgtacctctgg

SEQ ID NO: 58056 - DNA, 20 bp, Artificial Sequence
  Synthetic oligonucleotide; ATGAAT chr11 5218577 5218596 5218593 +
acctctggtagaattcggct

SEQ ID NO: 58057 - DNA, 20 bp, Artificial Sequence
  Synthetic oligonucleotide; CAGAGT chr11 5218693 5218712 5218709 +
tcttcctggtttagtcttgg

SEQ ID NO: 58058 - DNA, 20 bp, Artificial Sequence
  Synthetic oligonucleotide; AGGAAT chr11 5218709 5218728 5218725 +
ttggcagagtgtatgtgtcg

SEQ ID NO: 58059 - DNA, 20 bp, Artificial Sequence
  Synthetic oligonucleotide; TGGGAT chr11 5218794 5218813 5218810 +
gacggtagtttgtatttctg

SEQ ID NO: 58060 - DNA, 20 bp, Artificial Sequence
  Synthetic oligonucleotide; CTGGAT chr11 5218917 5218936 5218933 +
tcttttcaaaaaaacagctt

SEQ ID NO: 58061 - DNA, 20 bp, Artificial Sequence
  Synthetic oligonucleotide; AAGGGT chr11 5218938 5218957 5218954 +
tggattcattgatttttttg

SEQ ID NO: 58062 - DNA, 20 bp, Artificial Sequence
  Synthetic oligonucleotide; TTGAAT chr11 5219010 5219029 5219026 +
ttcttgtcttctgttagctt

SEQ ID NO: 58063 - DNA, 20 bp, Artificial Sequence
  Synthetic oligonucleotide; TAGGGT chr11 5219055 5219074 5219071 +
tagttttttaattgtgatgt

SEQ ID NO: 58064 - DNA, 20 bp, Artificial Sequence
  Synthetic oligonucleotide; TTGAAT chr11 5219131 5219150 5219147 +
atttccctctacacactgct

SEQ ID NO: 58065 - DNA, 20 bp, Artificial Sequence
  Synthetic oligonucleotide; CTGAGT chr11 5219264 5219283 5219280 +
gctgttcagtttccatgtag

SEQ ID NO: 58066 - DNA, 20 bp, Artificial Sequence
  Synthetic oligonucleotide; TTGAGT chr11 5219274 5219293 5219290 +
ttccatgtagctgagtggtt

SEQ ID NO: 58067 - DNA, 20 bp, Artificial Sequence
  Synthetic oligonucleotide; GTGAGT chr11 5219278 5219297 5219294 +
atgtagctgagtggttttga

SEQ ID NO: 58068 - DNA, 20 bp, Artificial Sequence
  Synthetic oligonucleotide; CTGAGT chr11 5219293 5219312 5219309 +
tttgagtgagtttcttaatc

SEQ ID NO: 58069 - DNA, 20 bp, Artificial Sequence
  Synthetic oligonucleotide; TGGAAT chr11 5219399 5219418 5219415 +
tccaactatgtggtcagttt

SEQ ID NO: 58070 - DNA, 20 bp, Artificial Sequence
  Synthetic oligonucleotide; AAGAAT chr11 5219425 5219444 5219441 +
aggtgtggtgtggtgctgaa

SEQ ID NO: 58071 - DNA, 20 bp, Artificial Sequence
  Synthetic oligonucleotide; TGGGGT chr11 5219447 5219466 5219463 +
gaatgtatattctgttgatt

SEQ ID NO: 58072 - DNA, 20 bp, Artificial Sequence
  Synthetic oligonucleotide; GAGAGT chr11 5219454 5219473 5219470 +
tattctgttgatttggggtg

SEQ ID NO: 58073 - DNA, 20 bp, Artificial Sequence
  Synthetic oligonucleotide; CTGAGT chr11 5219495 5219514 5219511 +
taggtctgcttggtgcagag

SEQ ID NO: 58074 - DNA, 20 bp, Artificial Sequence
  Synthetic oligonucleotide; CTGGAT chr11 5219508 5219527 5219524 +
tgcagagctgagtccaattc

SEQ ID NO: 58075 - DNA, 20 bp, Artificial Sequence
  Synthetic oligonucleotide; TGGGGT chr11 5219559 5219578 5219575 +
gatctgtctaatgttgacag

SEQ ID NO: 58076 - DNA, 20 bp, Artificial Sequence
  Synthetic oligonucleotide; ATGAAT chr11 5219632 5219651 5219648 +
ggtcactcaggacttgtttt

SEQ ID NO: 58077 - DNA, 20 bp, Artificial Sequence
  Synthetic oligonucleotide; CTGGGT chr11 5219638 5219657 5219654 +
tcaggacttgttttatgaat

SEQ ID NO: 58078 - DNA, 20 bp, Artificial Sequence
  Synthetic oligonucleotide; TTGGGT chr11 5219653 5219672 5219669 +
tgaatctgggtgctcctgta

SEQ ID NO: 58079 - DNA, 20 bp, Artificial Sequence
  Synthetic oligonucleotide; TTGAAT chr11 5219691 5219710 5219707 +
agtatagttagttcttcttc

SEQ ID NO: 58080 - DNA, 20 bp, Artificial Sequence
  Synthetic oligonucleotide; TAGGAT chr11 5219775 5219794 5219791 +
aaatctgttttatcagagac

SEQ ID NO: 58081 - DNA, 20 bp, Artificial Sequence
  Synthetic oligonucleotide; ATGGGT chr11 5219871 5219890 5219887 +
tgtgtgtctctgcacgtgag

SEQ ID NO: 58082 - DNA, 20 bp, Artificial Sequence
  Synthetic oligonucleotide; CTGAAT chr11 5219880 5219899 5219896 +
ctgcacgtgagatgggtttc

SEQ ID NO: 58083 - DNA, 20 bp, Artificial Sequence
  Synthetic oligonucleotide; ATGGGT chr11 5219897 5219916 5219913 +
ttcctgaatacagaacacag

SEQ ID NO: 58084 - DNA, 20 bp, Artificial Sequence
  Synthetic oligonucleotide; GTGAGT chr11 5219971 5219990 5219987 +
ttagcctatttacatttaag

SEQ ID NO: 58085 - DNA, 20 bp, Artificial Sequence
  Synthetic oligonucleotide; ATGAAT chr11 5219987 5220006 5220003 +
taaggtgagtattgttatgt

SEQ ID NO: 58086 - DNA, 20 bp, Artificial Sequence
  Synthetic oligonucleotide; AAGGAT chr11 5220192 5220211 5220208 +
tcagcatttgcttgtctgta

SEQ ID NO: 58087 - DNA, 20 bp, Artificial Sequence
  Synthetic oligonucleotide; CTGGAT chr11 5220232 5220251 5220248 +
acttatgaagcttagtttgg

SEQ ID NO: 58088 - DNA, 20 bp, Artificial Sequence
  Synthetic oligonucleotide; CTGGGT chr11 5220246 5220265 5220262 +
gtttggctggatatgaaatt

SEQ ID NO: 58089 - DNA, 20 bp, Artificial Sequence
  Synthetic oligonucleotide; TTGAAT chr11 5220276 5220295 5220292 +
aattcttttctttaacaatg

SEQ ID NO: 58090 - DNA, 20 bp, Artificial Sequence
  Synthetic oligonucleotide; TAGAGT chr11 5220308 5220327 5220324 +
ccccactttcttctggcttg

SEQ ID NO: 58091 - DNA, 20 bp, Artificial Sequence
  Synthetic oligonucleotide; GTGGGT chr11 5220356 5220375 5220372 +
agtctgatgggcttcccttt

SEQ ID NO: 58092 - DNA, 20 bp, Artificial Sequence
  Synthetic oligonucleotide; GTGAAT chr11 5220417 5220436 5220433 +
tttccttcatttcaactttg

SEQ ID NO: 58093 - DNA, 20 bp, Artificial Sequence
  Synthetic oligonucleotide; TGGAGT chr11 5220440 5220459 5220456 +
aatctgacagttatgtgtct

SEQ ID NO: 58094 - DNA, 20 bp, Artificial Sequence
  Synthetic oligonucleotide; AGGAGT chr11 5220457 5220476 5220473 +
tcttggagttgcttttctct

SEQ ID NO: 58095 - DNA, 20 bp, Artificial Sequence
  Synthetic oligonucleotide; CTGAAT chr11 5220488 5220507 5220504 +
tgtggcgttctctgtatttc

SEQ ID NO: 58096 - DNA, 20 bp, Artificial Sequence
  Synthetic oligonucleotide; GTGAAT chr11 5220494 5220513 5220510 +
gttctctgtatttcctgaat

SEQ ID NO: 58097 - DNA, 20 bp, Artificial Sequence
  Synthetic oligonucleotide; CTGGAT chr11 5220533 5220552 5220549 +
gctagattggggaagttctc

SEQ ID NO: 58098 - DNA, 20 bp, Artificial Sequence
  Synthetic oligonucleotide; CAGAGT chr11 5220548 5220567 5220564 +
ttctcctggataatatcctg

SEQ ID NO: 58099 - DNA, 20 bp, Artificial Sequence
  Synthetic oligonucleotide; TGGAGT chr11 5220922 5220941 5220938 +
tcgaacttcctcctttagct

SEQ ID NO: 58100 - DNA, 20 bp, Artificial Sequence
  Synthetic oligonucleotide; TAGAGT chr11 5221045 5221064 5221061 +
aggagaggcactctcatttt

SEQ ID NO: 58101 - DNA, 20 bp, Artificial Sequence
  Synthetic oligonucleotide; ATGGGT chr11 5221129 5221148 5221145 +
ttgatgatggcgatgtacag

SEQ ID NO: 58102 - DNA, 20 bp, Artificial Sequence
  Synthetic oligonucleotide; GTGGAT chr11 5221142 5221161 5221158 +
tgtacagatgggtttttggt

SEQ ID NO: 58103 - DNA, 20 bp, Artificial Sequence
  Synthetic oligonucleotide; TGGAGT chr11 5221206 5221225 5221222 +
accctcagctgcaggtctgt

SEQ ID NO: 58104 - DNA, 20 bp, Artificial Sequence
  Synthetic oligonucleotide; CTGGGT chr11 5221243 5221262 5221259 +
ccactccagaagctgttttc

SEQ ID NO: 58105 - DNA, 20 bp, Artificial Sequence
  Synthetic oligonucleotide; GTGGAT chr11 5221273 5221292 5221289 +
acagcggtggctgcagaaca

SEQ ID NO: 58106 - DNA, 20 bp, Artificial Sequence
  Synthetic oligonucleotide; AGGAGT chr11 5221334 5221353 5221350 +
ctctggaagttttgtcttag

SEQ ID NO: 58107 - DNA, 20 bp, Artificial Sequence
  Synthetic oligonucleotide; GGGGAT chr11 5221374 5221393 5221390 +
gtgtcagtctgcccctactg

SEQ ID NO: 58108 - DNA, 20 bp, Artificial Sequence
  Synthetic oligonucleotide; GGGGGT chr11 5221400 5221419 5221416 +
gcctcccagttaggctactc

SEQ ID NO: 58109 - DNA, 20 bp, Artificial Sequence
  Synthetic oligonucleotide; TGGGAT chr11 5221765 5221784 5221781 +
aggaccctctgagccaggca

SEQ ID NO: 58110 - DNA, 20 bp, Artificial Sequence
  Synthetic oligonucleotide; GGGAGT chr11 5221826 5221845 5221842 +
gaagagcgcagtattagggc

SEQ ID NO: 58111 - DNA, 20 bp, Artificial Sequence
  Synthetic oligonucleotide; GGGAAT chr11 5221881 5221900 5221897 +
ccttttctttgactaggaaa

SEQ ID NO: 58112 - DNA, 20 bp, Artificial Sequence
  Synthetic oligonucleotide; CCGGGT chr11 5221907 5221926 5221923 +
tccctgaccccttgtgcttc

SEQ ID NO: 58113 - DNA, 20 bp, Artificial Sequence
  Synthetic oligonucleotide; CGGAGT chr11 5222144 5222163 5222160 +
tttttcttttttttttgtga

SEQ ID NO: 58114 - DNA, 20 bp, Artificial Sequence
  Synthetic oligonucleotide; TGGAAT chr11 5222169 5222188 5222185 +
tctcatgctgtcacctgggc

SEQ ID NO: 58115 - DNA, 20 bp, Artificial Sequence
  Synthetic oligonucleotide; CAGGAT chr11 5222214 5222233 5222230 +
tcactgcaacctctgcctcc

SEQ ID NO: 58116 - DNA, 20 bp, Artificial Sequence
  Synthetic oligonucleotide; TGGGAT chr11 5222254 5222273 5222270 +
gcctcagcctcccaaattgc

SEQ ID NO: 58117 - DNA, 20 bp, Artificial Sequence
  Synthetic oligonucleotide; TAGAAT chr11 5222421 5222440 5222437 +
gtgagccaccgctcccagcc

SEQ ID NO: 58118 - DNA, 20 bp, Artificial Sequence
  Synthetic oligonucleotide; CTGAAT chr11 5222453 5222472 5222469 +
ttaaatgcttttattgttga

SEQ ID NO: 58119 - DNA, 20 bp, Artificial Sequence
  Synthetic oligonucleotide; TTGGGT chr11 5222485 5222504 5222501 +
ctcccttgatagtttctact

SEQ ID NO: 58120 - DNA, 20 bp, Artificial Sequence
  Synthetic oligonucleotide; CTGAAT chr11 5222566 5222585 5222582 +
ttattctagttttttcgtga

SEQ ID NO: 58121 - DNA, 20 bp, Artificial Sequence
  Synthetic oligonucleotide; TTGGAT chr11 5222745 5222764 5222761 +
attttagtgagatttagttt

SEQ ID NO: 58122 - DNA, 20 bp, Artificial Sequence
  Synthetic oligonucleotide; ATGAGT chr11 5222780 5222799 5222796 +
ttccactatcttacttacac

SEQ ID NO: 58123 - DNA, 20 bp, Artificial Sequence
  Synthetic oligonucleotide; TAGAAT chr11 5222807 5222826 5222823 +
gtattaatttaacatgattt

SEQ ID NO: 58124 - DNA, 20 bp, Artificial Sequence
  Synthetic oligonucleotide; AAGGAT chr11 5222882 5222901 5222898 +
cagcagaaagagataatatt

SEQ ID NO: 58125 - DNA, 20 bp, Artificial Sequence
  Synthetic oligonucleotide; TAGAAT chr11 5222901 5222920 5222917 +
taaggataatcagaaaaaaa

SEQ ID NO: 58126 - DNA, 20 bp, Artificial Sequence
  Synthetic oligonucleotide; GAGAAT chr11 5222916 5222935 5222932 +
aaaaatagaataaacttaga

SEQ ID NO: 58127 - DNA, 20 bp, Artificial Sequence
  Synthetic oligonucleotide; GGGAGT chr11 5223008 5223027 5223024 +
taataacactagaaaatcta

SEQ ID NO: 58128 - DNA, 20 bp, Artificial Sequence
  Synthetic oligonucleotide; AAGAGT chr11 5223113 5223132 5223129 +
tttattgtattgttttggaa

SEQ ID NO: 58129 - DNA, 20 bp, Artificial Sequence
  Synthetic oligonucleotide; ATGGAT chr11 5223129 5223148 5223145 +
ggaaaagagtaaacagtcaa

SEQ ID NO: 58130 - DNA, 20 bp, Artificial Sequence
  Synthetic oligonucleotide; AAGAAT chr11 5223153 5223172 5223169 +
atatttgtatctgaaaaatc

SEQ ID NO: 58131 - DNA, 20 bp, Artificial Sequence
  Synthetic oligonucleotide; TTGGGT chr11 5223453 5223472 5223469 +
acgcctgtaatcccagccct

SEQ ID NO: 58132 - DNA, 20 bp, Artificial Sequence
  Synthetic oligonucleotide; GCGGAT chr11 5223470 5223489 5223486 +
cctttgggtggccgaggcag

SEQ ID NO: 58133 - DNA, 20 bp, Artificial Sequence
  Synthetic oligonucleotide; TAGAAT chr11 5223761 5223780 5223777 +
gatgctgtacattagatatc

SEQ ID NO: 58134 - DNA, 20 bp, Artificial Sequence
  Synthetic oligonucleotide; TTGAGT chr11 5223801 5223820 5223817 +
taactgaaattttataccct

SEQ ID NO: 58135 - DNA, 20 bp, Artificial Sequence
  Synthetic oligonucleotide; GAGAGT chr11 5223870 5223889 5223886 +
cctctactgtctgtttccat

SEQ ID NO: 58136 - DNA, 20 bp, Artificial Sequence
  Synthetic oligonucleotide; CAGGAT chr11 5223988 5224007 5224004 +
atcaattctgccataaatgg

SEQ ID NO: 58137 - DNA, 20 bp, Artificial Sequence
  Synthetic oligonucleotide; TTGAAT chr11 5224045 5224064 5224061 +
ttttaattttttgtttgtta

SEQ ID NO: 58138 - DNA, 20 bp, Artificial Sequence
  Synthetic oligonucleotide; TTGGAT chr11 5224072 5224091 5224088 +
atctgtgtttcttatatatt

SEQ ID NO: 58139 - DNA, 20 bp, Artificial Sequence
  Synthetic oligonucleotide; GTGAAT chr11 5224257 5224276 5224273 +
attcaaaaaacggctgcaac

SEQ ID NO: 58140 - DNA, 20 bp, Artificial Sequence
  Synthetic oligonucleotide; TAGAAT chr11 5224265 5224284 5224281 +
aacggctgcaacgtgaatat

SEQ ID NO: 58141 - DNA, 20 bp, Artificial Sequence
  Synthetic oligonucleotide; AAGGGT chr11 5224366 5224385 5224382 +
ttttgtttatggtgtaagac

SEQ ID NO: 58142 - DNA, 20 bp, Artificial Sequence
  Synthetic oligonucleotide; GAGGGT chr11 5224390 5224409 5224406 +
gtctgatttcatttcatttt

SEQ ID NO: 58143 - DNA, 20 bp, Artificial Sequence
  Synthetic oligonucleotide; CAGAAT chr11 5224471 5224490 5224487 +
ctgattatatgccttgattt

SEQ ID NO: 58144 - DNA, 20 bp, Artificial Sequence
  Synthetic oligonucleotide; CAGAAT chr11 5224492 5224511 5224508 +
agaatcttgccaactagatt

SEQ ID NO: 58145 - DNA, 20 bp, Artificial Sequence
  Synthetic oligonucleotide; CAGAAT chr11 5224546 5224565 5224562 +
tgagactcatattttatttc

SEQ ID NO: 58146 - DNA, 20 bp, Artificial Sequence
  Synthetic oligonucleotide; TTGAAT chr11 5224574 5224593 5224590 +
agcatctacctacctaggta

SEQ ID NO: 58147 - DNA, 20 bp, Artificial Sequence
  Synthetic oligonucleotide; CTGAAT chr11 5224688 5224707 5224704 +
agcagacctctgatctcttc

SEQ ID NO: 58148 - DNA, 20 bp, Artificial Sequence
  Synthetic oligonucleotide; AAGAAT chr11 5224716 5224735 5224732 +
taatcttaaacatcctgagg

SEQ ID NO: 58149 - DNA, 20 bp, Artificial Sequence
  Synthetic oligonucleotide; TGGGGT chr11 5224734 5224753 5224750 +
ggaagaatgggacttccatt

SEQ ID NO: 58150 - DNA, 20 bp, Artificial Sequence
  Synthetic oligonucleotide; CAGGGT chr11 5224750 5224769 5224766 +
catttggggtgggcctatga

SEQ ID NO: 58151 - DNA, 20 bp, Artificial Sequence
  Synthetic oligonucleotide; GTGAAT chr11 5224768 5224787 5224784 +
gacagggtaataagacagta

SEQ ID NO: 58152 - DNA, 20 bp, Artificial Sequence
  Synthetic oligonucleotide; AAGAGT chr11 5224858 5224877 5224874 +
ccttccaaagcagactgtga

SEQ ID NO: 58153 - DNA, 20 bp, Artificial Sequence
  Synthetic oligonucleotide; CCGGGT chr11 5224894 5224913 5224910 +
ggagactagcactgcagatt

SEQ ID NO: 58154 - DNA, 20 bp, Artificial Sequence
  Synthetic oligonucleotide; GTGAGT chr11 5224904 5224923 5224920 +
actgcagattccgggtcact

SEQ ID NO: 58155 - DNA, 20 bp, Artificial Sequence
  Synthetic oligonucleotide; CTGAGT chr11 5225009 5225028 5225025 +
gacaacagagacaactaagg

SEQ ID NO: 58156 - DNA, 20 bp, Artificial Sequence
  Synthetic oligonucleotide; CTGAGT chr11 5225096 5225115 5225112 +
ggtatctctaagcaagagaa

SEQ ID NO: 58157 - DNA, 20 bp, Artificial Sequence
  Synthetic oligonucleotide; TGGAGT chr11 5225101 5225120 5225117 +
ctctaagcaagagaactgag

SEQ ID NO: 58158 - DNA, 20 bp, Artificial Sequence
  Synthetic oligonucleotide; CAGGAT chr11 5225122 5225141 5225138 +
ggagtcaaggctgagagatg

SEQ ID NO: 58159 - DNA, 20 bp, Artificial Sequence
  Synthetic oligonucleotide; ATGGGT chr11 5225134 5225153 5225150 +
gagagatgcaggataagcaa

SEQ ID NO: 58160 - DNA, 20 bp, Artificial Sequence
  Synthetic oligonucleotide; TTGAAT chr11 5225229 5225248 5225245 +
cctccaaatcaagcctctac

SEQ ID NO: 58161 - DNA, 20 bp, Artificial Sequence
  Synthetic oligonucleotide; AGGGAT chr11 5225244 5225263 5225260 +
tctacttgaatccttttctg

SEQ ID NO: 58162 - DNA, 20 bp, Artificial Sequence
  Synthetic oligonucleotide; ATGAAT chr11 5225248 5225267 5225264 +
cttgaatccttttctgaggg

SEQ ID NO: 58163 - DNA, 20 bp, Artificial Sequence
  Synthetic oligonucleotide; TGGAGT chr11 5225318 5225337 5225334 +
tgcagcctcaccttctttca

SEQ ID NO: 58164 - DNA, 20 bp, Artificial Sequence
  Synthetic oligonucleotide; CAGAAT chr11 5225474 5225493 5225490 +
aataaatgttttttattagg

SEQ ID NO: 58165 - DNA, 20 bp, Artificial Sequence
  Synthetic oligonucleotide; TGGGGT chr11 5225647 5225666 5225663 +
tgataggcagcctgcactgg

SEQ ID NO: 58166 - DNA, 20 bp, Artificial Sequence
  Synthetic oligonucleotide; GTGAAT chr11 5225651 5225670 5225667 +
aggcagcctgcactggtggg

SEQ ID NO: 58167 - DNA, 20 bp, Artificial Sequence
  Synthetic oligonucleotide; CAGAAT chr11 5225764 5225783 5225780 +
aaaagggcctagcttggact

SEQ ID NO: 58168 - DNA, 20 bp, Artificial Sequence
  Synthetic oligonucleotide; CAGAAT chr11 5225802 5225821 5225818 +
tcccaaccataaaataaaag

SEQ ID NO: 58169 - DNA, 20 bp, Artificial Sequence
  Synthetic oligonucleotide; CTGGAT chr11 5225813 5225832 5225829 +
aaataaaagcagaatggtag

SEQ ID NO: 58170 - DNA, 20 bp, Artificial Sequence
  Synthetic oligonucleotide; TAGAAT chr11 5225935 5225954 5225951 +
aaattatcactgttattctt

SEQ ID NO: 58171 - DNA, 20 bp, Artificial Sequence
  Synthetic oligonucleotide; ATGAAT chr11 5226186 5226205 5226202 +
gaaaataaagtagggagatt

SEQ ID NO: 58172 - DNA, 20 bp, Artificial Sequence
  Synthetic oligonucleotide; AAGAAT chr11 5226359 5226378 5226375 +
agaagaaaaaaaaagaaagc

SEQ ID NO: 58173 - DNA, 20 bp, Artificial Sequence
  Synthetic oligonucleotide; CAGGAT chr11 5226568 5226587 5226584 +
tagactcaccctgaagttct

SEQ ID NO: 58174 - DNA, 20 bp, Artificial Sequence
  Synthetic oligonucleotide; TAGGGT chr11 5226694 5226713 5226710 +
cttgccatgagccttcacct

SEQ ID NO: 58175 - DNA, 20 bp, Artificial Sequence
  Synthetic oligonucleotide; AGGAGT chr11 5226716 5226735 5226732 +
gggttgcccataacagcatc

SEQ ID NO: 58176 - DNA, 20 bp, Artificial Sequence
  Synthetic oligonucleotide; CTGGGT chr11 5226752 5226771 5226768 +
ccaaaggactcaaagaacct

SEQ ID NO: 58177 - DNA, 20 bp, Artificial Sequence
  Synthetic oligonucleotide; AAGGGT chr11 5226760 5226779 5226776 +
ctcaaagaacctctgggtcc

SEQ ID NO: 58178 - DNA, 20 bp, Artificial Sequence
  Synthetic oligonucleotide; AAGGGT chr11 5226782 5226801 5226798 +
gggtagaccaccagcagcct

SEQ ID NO: 58179 - DNA, 20 bp, Artificial Sequence
  Synthetic oligonucleotide; GAGAGT chr11 5226811 5226830 5226827 +
aaaatagaccaataggcaga

SEQ ID NO: 58180 - DNA, 20 bp, Artificial Sequence
  Synthetic oligonucleotide; AAGAGT chr11 5226836 5226855 5226852 +
tcagtgcctatcagaaaccc

SEQ ID NO: 58181 - DNA, 20 bp, Artificial Sequence
  Synthetic oligonucleotide; AGGAGT chr11 5226984 5227003 5227000 +
gtaacggcagacttctcctc

SEQ ID NO: 58182 - DNA, 20 bp, Artificial Sequence
  Synthetic oligonucleotide; GGGAGT chr11 5227115 5227134 5227131 +
ctcctgccctccctgctcct

SEQ ID NO: 58183 - DNA, 20 bp, Artificial Sequence
  Synthetic oligonucleotide; TAGGGT chr11 5227135 5227154 5227151 +
gggagtagattggccaaccc

SEQ ID NO: 58184 - DNA, 20 bp, Artificial Sequence
  Synthetic oligonucleotide; CAGGGT chr11 5227150 5227169 5227166 +
aaccctagggtgtggctcca

SEQ ID NO: 58185 - DNA, 20 bp, Artificial Sequence
  Synthetic oligonucleotide; AGGAGT chr11 5227209 5227228 5227225 +
ggctcttctggcactggctt

SEQ ID NO: 58186 - DNA, 20 bp, Artificial Sequence
  Synthetic oligonucleotide; TGGAAT chr11 5227325 5227344 5227341 +
aagtgtatttacgtaatatt

SEQ ID NO: 58187 - DNA, 20 bp, Artificial Sequence
  Synthetic oligonucleotide; AAGAGT chr11 5227410 5227429 5227426 +
agttgatgcactaaaagtgg

SEQ ID NO: 58188 - DNA, 20 bp, Artificial Sequence
  Synthetic oligonucleotide; TGGGAT chr11 5227438 5227457 5227454 +
tgtctaccataattcagctt

SEQ ID NO: 58189 - DNA, 20 bp, Artificial Sequence
  Synthetic oligonucleotide; ATGGAT chr11 5227450 5227469 5227466 +
ttcagctttgggatatgtag

SEQ ID NO: 58190 - DNA, 20 bp, Artificial Sequence
  Synthetic oligonucleotide; CAGAAT chr11 5227471 5227490 5227487 +
tggatctcttcctgcgtctc

SEQ ID NO: 58191 - DNA, 20 bp, Artificial Sequence
  Synthetic oligonucleotide; CAGAAT chr11 5227496 5227515 5227512 +
tatgcaaaatacttacagga

SEQ ID NO: 58192 - DNA, 20 bp, Artificial Sequence
  Synthetic oligonucleotide; ATGGAT chr11 5227500 5227519 5227516 +
caaaatacttacaggacaga

SEQ ID NO: 58193 - DNA, 20 bp, Artificial Sequence
  Synthetic oligonucleotide; TTGGAT chr11 5227545 5227564 5227561 +
taagcatatcttctccttat

SEQ ID NO: 58194 - DNA, 20 bp, Artificial Sequence
  Synthetic oligonucleotide; TAGAAT chr11 5227690 5227709 5227706 +
taataaattatgtctaaaaa

SEQ ID NO: 58195 - DNA, 20 bp, Artificial Sequence
  Synthetic oligonucleotide; TGGGGT chr11 5227835 5227854 5227851 +
acccaaagtgtgactatcaa

SEQ ID NO: 58196 - DNA, 20 bp, Artificial Sequence
  Synthetic oligonucleotide; AAGAGT chr11 5227906 5227925 5227922 +
ttctgcctggactaatctgc

SEQ ID NO: 58197 - DNA, 20 bp, Artificial Sequence
  Synthetic oligonucleotide; AGGGGT chr11 5227949 5227968 5227965 +
gcctctgtgacttagaaagt

SEQ ID NO: 58198 - DNA, 20 bp, Artificial Sequence
  Synthetic oligonucleotide; AAGAAT chr11 5228010 5228029 5228026 +
tttttttcctctagtccact

SEQ ID NO: 58199 - DNA, 20 bp, Artificial Sequence
  Synthetic oligonucleotide; CAGAGT chr11 5228208 5228227 5228224 +
gaggaaaaacttttgaagtg

SEQ ID NO: 58200 - DNA, 20 bp, Artificial Sequence
  Synthetic oligonucleotide; TAGGGT chr11 5228280 5228299 5228296 +
aagcatttatgaggtcagcg

SEQ ID NO: 58201 - DNA, 20 bp, Artificial Sequence
  Synthetic oligonucleotide; CTGAAT chr11 5228318 5228337 5228334 +
taagggccctgtcagtcatc

SEQ ID NO: 58202 - DNA, 20 bp, Artificial Sequence
  Synthetic oligonucleotide; CTGGAT chr11 5228506 5228525 5228522 +
tttaggttaaccaaaagaaa

SEQ ID NO: 58203 - DNA, 20 bp, Artificial Sequence
  Synthetic oligonucleotide; AGGGAT chr11 5228765 5228784 5228781 +
tgtatgattatagaggtaag

SEQ ID NO: 58204 - DNA, 20 bp, Artificial Sequence
  Synthetic oligonucleotide; GAGGAT chr11 5228825 5228844 5228841 +
ctgtaaaaaactaaagcaat

SEQ ID NO: 58205 - DNA, 20 bp, Artificial Sequence
  Synthetic oligonucleotide; TTGAAT chr11 5228869 5228888 5228885 +
ctgagaaaagatttcacatg

SEQ ID NO: 58206 - DNA, 20 bp, Artificial Sequence
  Synthetic oligonucleotide; TTGGAT chr11 5228943 5228962 5228959 +
tttgacttggctgttagatt

SEQ ID NO: 58207 - DNA, 20 bp, Artificial Sequence
  Synthetic oligonucleotide; TTGAAT chr11 5229071 5229090 5229087 +
ataaagtgttctgcggaagt

SEQ ID NO: 58208 - DNA, 20 bp, Artificial Sequence
  Synthetic oligonucleotide; CTGGGT chr11 5229095 5229114 5229111 +
atatgtcttttgcaaatatc

SEQ ID NO: 58209 - DNA, 20 bp, Artificial Sequence
  Synthetic oligonucleotide; ATGGAT chr11 5229301 5229320 5229317 +
tcttttttaaatgatgaact

SEQ ID NO: 58210 - DNA, 20 bp, Artificial Sequence
  Synthetic oligonucleotide; AGGGGT chr11 5229359 5229378 5229375 +
catcatcctggcttcaaggc

SEQ ID NO: 58211 - DNA, 20 bp, Artificial Sequence
  Synthetic oligonucleotide; TAGAGT chr11 5229396 5229415 5229412 +
tggtagttacttagtgtgac

SEQ ID NO: 58212 - DNA, 20 bp, Artificial Sequence
  Synthetic oligonucleotide; GTGAAT chr11 5229638 5229657 5229654 +
tgtgagcttgcttctactct

SEQ ID NO: 58213 - DNA, 20 bp, Artificial Sequence
  Synthetic oligonucleotide; ATGGAT chr11 5229642 5229661 5229658 +
agcttgcttctactctgtga

SEQ ID NO: 58214 - DNA, 20 bp, Artificial Sequence
  Synthetic oligonucleotide; CAGAAT chr11 5229824 5229843 5229840 +
taagtcctaatgttttatat

SEQ ID NO: 58215 - DNA, 20 bp, Artificial Sequence
  Synthetic oligonucleotide; CTGGGT chr11 5229839 5229858 5229855 +
tatatcagaatggccctagt

SEQ ID NO: 58216 - DNA, 20 bp, Artificial Sequence
  Synthetic oligonucleotide; GAGGAT chr11 5229852 5229871 5229868 +
ccctagtctgggtatactta

SEQ ID NO: 58217 - DNA, 20 bp, Artificial Sequence
  Synthetic oligonucleotide; ATGAAT chr11 5229856 5229875 5229872 +
agtctgggtatacttagagg

SEQ ID NO: 58218 - DNA, 20 bp, Artificial Sequence
  Synthetic oligonucleotide; GGGAGT chr11 5229899 5229918 5229915 +
aaatcatgacactcatctat

SEQ ID NO: 58219 - DNA, 20 bp, Artificial Sequence
  Synthetic oligonucleotide; TAGAGT chr11 5229941 5229960 5229957 +
tttcaaaagcagcacttgac

SEQ ID NO: 58220 - DNA, 20 bp, Artificial Sequence
  Synthetic oligonucleotide; CAGAAT chr11 5230104 5230123 5230120 +
aaacacaactcagcagctct

SEQ ID NO: 58221 - DNA, 20 bp, Artificial Sequence
  Synthetic oligonucleotide; TAGGAT chr11 5230194 5230213 5230210 +
cacacaaaatagtttggaaa

SEQ ID NO: 58222 - DNA, 20 bp, Artificial Sequence
  Synthetic oligonucleotide; CAGAAT chr11 5230361 5230380 5230377 +
actgggctcagattttcatt

SEQ ID NO: 58223 - DNA, 20 bp, Artificial Sequence
  Synthetic oligonucleotide; TAGAAT chr11 5230465 5230484 5230481 +
agattgcatctctttagagg

SEQ ID NO: 58224 - DNA, 20 bp, Artificial Sequence
  Synthetic oligonucleotide; ATGGAT chr11 5230543 5230562 5230559 +
actgctctgaagctcaagag

SEQ ID NO: 58225 - DNA, 20 bp, Artificial Sequence
  Synthetic oligonucleotide; AGGAAT chr11 5230786 5230805 5230802 +
aaaattaaagccaaatcttg

SEQ ID NO: 58226 - DNA, 20 bp, Artificial Sequence
  Synthetic oligonucleotide; GGGGGT chr11 5230835 5230854 5230851 +
ttaactttcattttaaattt

SEQ ID NO: 58227 - DNA, 20 bp, Artificial Sequence
  Synthetic oligonucleotide; CTGGGT chr11 5230875 5230894 5230891 +
tataggtaaattgcatatca

SEQ ID NO: 58228 - DNA, 20 bp, Artificial Sequence
  Synthetic oligonucleotide; CTGGGT chr11 5230980 5230999 5230996 +
ccctcaaccctcaagtaggc

SEQ ID NO: 58229 - DNA, 20 bp, Artificial Sequence
  Synthetic oligonucleotide; ATGAAT chr11 5231206 5231225 5231222 +
cccatccaggtgatgttctc

SEQ ID NO: 58230 - DNA, 20 bp, Artificial Sequence
  Synthetic oligonucleotide; TTGGAT chr11 5231222 5231241 5231238 +
tctcatgaattctctggtat

SEQ ID NO: 58231 - DNA, 20 bp, Artificial Sequence
  Synthetic oligonucleotide; AGGAAT chr11 5231277 5231296 5231293 +
ctgactacttctaatggtgt

SEQ ID NO: 58232 - DNA, 20 bp, Artificial Sequence
  Synthetic oligonucleotide; AGGAAT chr11 5231332 5231351 5231348 +
tttttttgacttttggagaa

SEQ ID NO: 58233 - DNA, 20 bp, Artificial Sequence
  Synthetic oligonucleotide; TCGAAT chr11 5231392 5231411 5231408 +
acaatctctcttactgtctt

SEQ ID NO: 58234 - DNA, 20 bp, Artificial Sequence
  Synthetic oligonucleotide; AGGAAT chr11 5231453 5231472 5231469 +
atgagaacttccctatgctc

SEQ ID NO: 58235 - DNA, 20 bp, Artificial Sequence
  Synthetic oligonucleotide; CTGAGT chr11 5231485 5231504 5231501 +
gtgatcttccccaaaatgcc

SEQ ID NO: 58236 - DNA, 20 bp, Artificial Sequence
  Synthetic oligonucleotide; AAGAGT chr11 5231545 5231564 5231561 +
aaatatcttattcagatata

SEQ ID NO: 58237 - DNA, 20 bp, Artificial Sequence
  Synthetic oligonucleotide; ATGGAT chr11 5231590 5231609 5231606 +
taatgacttaaggaaaacac

SEQ ID NO: 58238 - DNA, 20 bp, Artificial Sequence
  Synthetic oligonucleotide; CAGAGT chr11 5231686 5231705 5231702 +
gtatattctggcagtacaga

SEQ ID NO: 58239 - DNA, 20 bp, Artificial Sequence
  Synthetic oligonucleotide; AGGAAT chr11 5232011 5232030 5232027 +
attccagaagttctaaagca

SEQ ID NO: 58240 - DNA, 20 bp, Artificial Sequence
  Synthetic oligonucleotide; TTGAAT chr11 5232070 5232089 5232086 +
ttcattcattcactgttttc

SEQ ID NO: 58241 - DNA, 20 bp, Artificial Sequence
  Synthetic oligonucleotide; ATGAAT chr11 5232099 5232118 5232115 +
tattttctttctgcccattg

SEQ ID NO: 58242 - DNA, 20 bp, Artificial Sequence
  Synthetic oligonucleotide; GAGAAT chr11 5232139 5232158 5232155 +
agtaggcatgtaagaaggta

SEQ ID NO: 58243 - DNA, 20 bp, Artificial Sequence
  Synthetic oligonucleotide; CAGAAT chr11 5232148 5232167 5232164 +
gtaagaaggtagagaatagg

SEQ ID NO: 58244 - DNA, 20 bp, Artificial Sequence
  Synthetic oligonucleotide; CGGAGT chr11 5232167 5232186 5232183 +
gcagaattgcttataaagca

SEQ ID NO: 58245 - DNA, 20 bp, Artificial Sequence
  Synthetic oligonucleotide; GAGGGT chr11 5232231 5232250 5232247 +
atataaaaaatggtgtgggg

SEQ ID NO: 58246 - DNA, 20 bp, Artificial Sequence
  Synthetic oligonucleotide; TTGGGT chr11 5232250 5232269 5232266 +
ggagggtttggaaagatttt

SEQ ID NO: 58247 - DNA, 20 bp, Artificial Sequence
  Synthetic oligonucleotide; TGGGGT chr11 5232279 5232298 5232295 +
atagagaagtttattgtggc

SEQ ID NO: 58248 - DNA, 20 bp, Artificial Sequence
  Synthetic oligonucleotide; ATGAAT chr11 5232314 5232333 5232330 +
tcacaagtaatacgtgagca

SEQ ID NO: 58249 - DNA, 20 bp, Artificial Sequence
  Synthetic oligonucleotide; TGGGGT chr11 5232417 5232436 5232433 +
cttggagcaggaacacttga

SEQ ID NO: 58250 - DNA, 20 bp, Artificial Sequence
  Synthetic oligonucleotide; TTGAGT chr11 5232486 5232505 5232502 +
aaagacaacataacattgtc

SEQ ID NO: 58251 - DNA, 20 bp, Artificial Sequence
  Synthetic oligonucleotide; TGGAGT chr11 5232537 5232556 5232553 +
attattttctcagtaattgt

SEQ ID NO: 58252 - DNA, 20 bp, Artificial Sequence
  Synthetic oligonucleotide; TAGGGT chr11 5232575 5232594 5232591 +
ttacccttgaggctatgtct

SEQ ID NO: 58253 - DNA, 20 bp, Artificial Sequence
  Synthetic oligonucleotide; AAGAGT chr11 5232628 5232647 5232644 +
gccagtattatctttgtatc

SEQ ID NO: 58254 - DNA, 20 bp, Artificial Sequence
  Synthetic oligonucleotide; TAGAAT chr11 5232890 5232909 5232906 +
gtgttcccaagttcagaaaa

SEQ ID NO: 58255 - DNA, 20 bp, Artificial Sequence
  Synthetic oligonucleotide; TAGGGT chr11 5232905 5232924 5232921 +
gaaaatagaatctagggaaa

SEQ ID NO: 58256 - DNA, 20 bp, Artificial Sequence
  Synthetic oligonucleotide; CAGGAT chr11 5232937 5232956 5232953 +
atggttatcaggaaacagtc

SEQ ID NO: 58257 - DNA, 20 bp, Artificial Sequence
  Synthetic oligonucleotide; TGGGGT chr11 5233013 5233032 5233029 +
tgataggcagcctgcatttg

SEQ ID NO: 58258 - DNA, 20 bp, Artificial Sequence
  Synthetic oligonucleotide; GTGAAT chr11 5233017 5233036 5233033 +
aggcagcctgcatttgtggg

SEQ ID NO: 58259 - DNA, 20 bp, Artificial Sequence
  Synthetic oligonucleotide; ATGAAT chr11 5233226 5233245 5233242 +
cagcataaataagtacatat

SEQ ID NO: 58260 - DNA, 20 bp, Artificial Sequence
  Synthetic oligonucleotide; CAGAAT chr11 5233543 5233562 5233559 +
cctttccattccatttacta

SEQ ID NO: 58261 - DNA, 20 bp, Artificial Sequence
  Synthetic oligonucleotide; TTGAGT chr11 5233622 5233641 5233638 +
gtattctatgcctctcatct

SEQ ID NO: 58262 - DNA, 20 bp, Artificial Sequence
  Synthetic oligonucleotide; AAGGAT chr11 5233661 5233680 5233677 +
atacccatgtggagagacaa

SEQ ID NO: 58263 - DNA, 20 bp, Artificial Sequence
  Synthetic oligonucleotide; CAGAAT chr11 5233678 5233697 5233694 +
caaaaggattattctaagtg

SEQ ID NO: 58264 - DNA, 20 bp, Artificial Sequence
  Synthetic oligonucleotide; TTGAGT chr11 5233711 5233730 5233727 +
tgagagctggtatgcataat

SEQ ID NO: 58265 - DNA, 20 bp, Artificial Sequence
  Synthetic oligonucleotide; GGGGGT chr11 5233745 5233764 5233761 +
gagaaggaaaaatgaaggga

SEQ ID NO: 58266 - DNA, 20 bp, Artificial Sequence
  Synthetic oligonucleotide; CAGGAT chr11 5233764 5233783 5233780 +
agggggttgggagagaaaga

SEQ ID NO: 58267 - DNA, 20 bp, Artificial Sequence
  Synthetic oligonucleotide; CAGAAT chr11 5233814 5233833 5233830 +
ttgtgaggaaggaaaaaatg

SEQ ID NO: 58268 - DNA, 20 bp, Artificial Sequence
  Synthetic oligonucleotide; CAGGAT chr11 5233982 5234001 5233998 +
tggactcaccctgaagttct

SEQ ID NO: 58269 - DNA, 20 bp, Artificial Sequence
  Synthetic oligonucleotide; TAGGGT chr11 5234108 5234127 5234124 +
cttgccatgagccttcacct

SEQ ID NO: 58270 - DNA, 20 bp, Artificial Sequence
  Synthetic oligonucleotide; CTGGGT chr11 5234166 5234185 5234182 +
ccaaaggactcaaagaacct

SEQ ID NO: 58271 - DNA, 20 bp, Artificial Sequence
  Synthetic oligonucleotide; AAGGGT chr11 5234174 5234193 5234190 +
ctcaaagaacctctgggtcc

SEQ ID NO: 58272 - DNA, 20 bp, Artificial Sequence
  Synthetic oligonucleotide; GAGGGT chr11 5234196 5234215 5234212 +
gggtagaccaccagtaatct

SEQ ID NO: 58273 - DNA, 20 bp, Artificial Sequence
  Synthetic oligonucleotide; GAGAGT chr11 5234223 5234242 5234239 +
ggaaaacagcccaagggaca

SEQ ID NO: 58274 - DNA, 20 bp, Artificial Sequence
  Synthetic oligonucleotide; AAGAGT chr11 5234248 5234267 5234264 +
tcagtgcctatcagaaaccc

SEQ ID NO: 58275 - DNA, 20 bp, Artificial Sequence
  Synthetic oligonucleotide; AGGAGT chr11 5234396 5234415 5234412 +
ttgacagcagtcttctcctc

SEQ ID NO: 58276 - DNA, 20 bp, Artificial Sequence
  Synthetic oligonucleotide; CAGGGT chr11 5234543 5234562 5234559 +
gcaggttggtttaagataag

SEQ ID NO: 58277 - DNA, 20 bp, Artificial Sequence
  Synthetic oligonucleotide; GAGAAT chr11 5234562 5234581 5234578 +
gcagggtttcattagtttgt

SEQ ID NO: 58278 - DNA, 20 bp, Artificial Sequence
  Synthetic oligonucleotide; TGGAAT chr11 5234752 5234771 5234768 +
agtgttttaggctaatatag

SEQ ID NO: 58279 - DNA, 20 bp, Artificial Sequence
  Synthetic oligonucleotide; TAGAGT chr11 5234764 5234783 5234780 +
taatatagtggaatgtatct

SEQ ID NO: 58280 - DNA, 20 bp, Artificial Sequence
  Synthetic oligonucleotide; GGGAAT chr11 5234884 5234903 5234900 +
ctagagatttttgtctccaa

SEQ ID NO: 58281 - DNA, 20 bp, Artificial Sequence
  Synthetic oligonucleotide; TGGAAT chr11 5234900 5234919 5234916 +
ccaagggaattttgagaggt

SEQ ID NO: 58282 - DNA, 20 bp, Artificial Sequence
  Synthetic oligonucleotide; AAGAAT chr11 5235016 5235035 5235032 +
ttgaaataaatatccattaa

SEQ ID NO: 58283 - DNA, 20 bp, Artificial Sequence
  Synthetic oligonucleotide; ATGAAT chr11 5235031 5235050 5235047 +
attaaaagaatatttaaaaa

SEQ ID NO: 58284 - DNA, 20 bp, Artificial Sequence
  Synthetic oligonucleotide; ATGAAT chr11 5235076 5235095 5235092 +
ttgaaataggttctggaaac

SEQ ID NO: 58285 - DNA, 20 bp, Artificial Sequence
  Synthetic oligonucleotide; TTGAAT chr11 5235135 5235154 5235151 +
aaatattatatacaaatatt

SEQ ID NO: 58286 - DNA, 20 bp, Artificial Sequence
  Synthetic oligonucleotide; AAGAAT chr11 5235167 5235186 5235183 +
aattatggtatgactaaaga

SEQ ID NO: 58287 - DNA, 20 bp, Artificial Sequence
  Synthetic oligonucleotide; GGGAAT chr11 5235229 5235248 5235245 +
ttaaatttaacgaagttcct

SEQ ID NO: 58288 - DNA, 20 bp, Artificial Sequence
  Synthetic oligonucleotide; TGGAAT chr11 5235281 5235300 5235297 +
tgtgttcttaaaaaaaaatg

SEQ ID NO: 58289 - DNA, 20 bp, Artificial Sequence
  Synthetic oligonucleotide; AGGAAT chr11 5235294 5235313 5235310 +
aaaaatgtggaattagaccc

SEQ ID NO: 58290 - DNA, 20 bp, Artificial Sequence
  Synthetic oligonucleotide; CTGAAT chr11 5235328 5235347 5235344 +
cagtagtttttcactctttt

SEQ ID NO: 58291 - DNA, 20 bp, Artificial Sequence
  Synthetic oligonucleotide; AAGGAT chr11 5235388 5235407 5235404 +
ccatgagcatatccaaaagg

SEQ ID NO: 58292 - DNA, 20 bp, Artificial Sequence
  Synthetic oligonucleotide; GAGGAT chr11 5235448 5235467 5235464 +
ggaaggaagaggggaagaga

SEQ ID NO: 58293 - DNA, 20 bp, Artificial Sequence
  Synthetic oligonucleotide; AGGGAT chr11 5235457 5235476 5235473 +
aggggaagagagaggatgga

SEQ ID NO: 58294 - DNA, 20 bp, Artificial Sequence
  Synthetic oligonucleotide; AGGGAT chr11 5235530 5235549 5235546 +
ggaggggagaggagaggaga

SEQ ID NO: 58295 - DNA, 20 bp, Artificial Sequence
  Synthetic oligonucleotide; ATGGAT chr11 5235683 5235702 5235699 +
gttcaaattttggtggtgat

SEQ ID NO: 58296 - DNA, 20 bp, Artificial Sequence
  Synthetic oligonucleotide; CTGGAT chr11 5235769 5235788 5235785 +
tttaatagtatccacaaatg

SEQ ID NO: 58297 - DNA, 20 bp, Artificial Sequence
  Synthetic oligonucleotide; TAGAAT chr11 5235922 5235941 5235938 +
acttaaatgcttaccaacag

SEQ ID NO: 58298 - DNA, 20 bp, Artificial Sequence
  Synthetic oligonucleotide; AAGAAT chr11 5235949 5235968 5235965 +
gataaattacggtatagtca

SEQ ID NO: 58299 - DNA, 20 bp, Artificial Sequence
  Synthetic oligonucleotide; TAGAAT chr11 5235954 5235973 5235970 +
attacggtatagtcaaagaa

SEQ ID NO: 58300 - DNA, 20 bp, Artificial Sequence
  Synthetic oligonucleotide; AAGAAT chr11 5235976 5235995 5235992 +
gaatattacacagaaatgaa

SEQ ID NO: 58301 - DNA, 20 bp, Artificial Sequence
  Synthetic oligonucleotide; GTGAGT chr11 5236051 5236070 5236067 +
ttgattaaaagtaaccagag

SEQ ID NO: 58302 - DNA, 20 bp, Artificial Sequence
  Synthetic oligonucleotide; ATGGAT chr11 5236090 5236109 5236106 +
ctttatttgtatatagaaag

SEQ ID NO: 58303 - DNA, 20 bp, Artificial Sequence
  Synthetic oligonucleotide; TAGGGT chr11 5236138 5236157 5236154 +
caaggggaaatgttataaaa

SEQ ID NO: 58304 - DNA, 20 bp, Artificial Sequence
  Synthetic oligonucleotide; ATGAAT chr11 5236155 5236174 5236171 +
aaatagggtagagaggagcc

SEQ ID NO: 58305 - DNA, 20 bp, Artificial Sequence
  Synthetic oligonucleotide; TTGAAT chr11 5236218 5236237 5236234 +
ctggaagccaacgaaagata

SEQ ID NO: 58306 - DNA, 20 bp, Artificial Sequence
  Synthetic oligonucleotide; AAGAAT chr11 5236416 5236435 5236432 +
gtgatgtcagtcgtgaacac

SEQ ID NO: 58307 - DNA, 20 bp, Artificial Sequence
  Synthetic oligonucleotide; GTGAGT chr11 5236434 5236453 5236450 +
acaagaatagggccacattt

SEQ ID NO: 58308 - DNA, 20 bp, Artificial Sequence
  Synthetic oligonucleotide; TTGGAT chr11 5236471 5236490 5236487 +
ataaaatcagaaatacagtc

SEQ ID NO: 58309 - DNA, 20 bp, Artificial Sequence
  Synthetic oligonucleotide; GTGGAT chr11 5236528 5236547 5236544 +
aaaaagatgtacttagatat

SEQ ID NO: 58310 - DNA, 20 bp, Artificial Sequence
  Synthetic oligonucleotide; AAGAAT chr11 5236546 5236565 5236562 +
atgtggatctggagctcaga

SEQ ID NO: 58311 - DNA, 20 bp, Artificial Sequence
  Synthetic oligonucleotide; AAGAAT chr11 5236563 5236582 5236579 +
agaaagaatacaaccaggtc

SEQ ID NO: 58312 - DNA, 20 bp, Artificial Sequence
  Synthetic oligonucleotide; CAGAAT chr11 5236570 5236589 5236586 +
atacaaccaggtcaagaata

SEQ ID NO: 58313 - DNA, 20 bp, Artificial Sequence
  Synthetic oligonucleotide; GTGAAT chr11 5236613 5236632 5236629 +
aacagatcataatgtgctgt

SEQ ID NO: 58314 - DNA, 20 bp, Artificial Sequence
  Synthetic oligonucleotide; TAGAAT chr11 5236680 5236699 5236696 +
tcaatatctccttaaaatct

SEQ ID NO: 58315 - DNA, 20 bp, Artificial Sequence
  Synthetic oligonucleotide; AGGAAT chr11 5236699 5236718 5236715 +
ttagaatgtgtttgtgaggg

SEQ ID NO: 58316 - DNA, 20 bp, Artificial Sequence
  Synthetic oligonucleotide; ATGGAT chr11 5236888 5236907 5236904 +
tggttacatgtttattctat

SEQ ID NO: 58317 - DNA, 20 bp, Artificial Sequence
  Synthetic oligonucleotide; GAGGAT chr11 5236902 5236921 5236918 +
ttctatatggattgcattga

SEQ ID NO: 58318 - DNA, 20 bp, Artificial Sequence
  Synthetic oligonucleotide; CAGAAT chr11 5236916 5236935 5236932 +
cattgagaggatttgtataa

SEQ ID NO: 58319 - DNA, 20 bp, Artificial Sequence
  Synthetic oligonucleotide; TGGAGT chr11 5236951 5236970 5236967 +
ttttcttttctcttctgaga

SEQ ID NO: 58320 - DNA, 20 bp, Artificial Sequence
  Synthetic oligonucleotide; TAGAGT chr11 5236977 5236996 5236993 +
ttcatccctattgcccaagc

SEQ ID NO: 58321 - DNA, 20 bp, Artificial Sequence
  Synthetic oligonucleotide; CTGGGT chr11 5237021 5237040 5237037 +
ctcaccgcaacctctgcctc

SEQ ID NO: 58322 - DNA, 20 bp, Artificial Sequence
  Synthetic oligonucleotide; CTGAAT chr11 5237053 5237072 5237069 +
aattctcctgcctcagccac

SEQ ID NO: 58323 - DNA, 20 bp, Artificial Sequence
  Synthetic oligonucleotide; TGGGGT chr11 5237116 5237135 5237132 +
ttttgtatttttagtagaga

SEQ ID NO: 58324 - DNA, 20 bp, Artificial Sequence
  Synthetic oligonucleotide; CTGGGT chr11 5237194 5237213 5237210 +
tgccttggcctcccaaagtg

SEQ ID NO: 58325 - DNA, 20 bp, Artificial Sequence
  Synthetic oligonucleotide; CAGGAT chr11 5237227 5237246 5237243 +
cctgagccaccgcatccagc

SEQ ID NO: 58326 - DNA, 20 bp, Artificial Sequence
  Synthetic oligonucleotide; AAGAAT chr11 5237249 5237268 5237265 +
ggataaggtctaaaagtgga

SEQ ID NO: 58327 - DNA, 20 bp, Artificial Sequence
  Synthetic oligonucleotide; AAGAGT chr11 5237301 5237320 5237317 +
tgaggacctgactgggcagt

SEQ ID NO: 58328 - DNA, 20 bp, Artificial Sequence
  Synthetic oligonucleotide; CAGAAT chr11 5237336 5237355 5237352 +
tagatagggacaaattgaag

SEQ ID NO: 58329 - DNA, 20 bp, Artificial Sequence
  Synthetic oligonucleotide; GTGAAT chr11 5237389 5237408 5237405 +
gattttaatctgtgaccttg

SEQ ID NO: 58330 - DNA, 20 bp, Artificial Sequence
  Synthetic oligonucleotide; CTGAGT chr11 5237474 5237493 5237490 +
taacaagtgaaatacccatg

SEQ ID NO: 58331 - DNA, 20 bp, Artificial Sequence
  Synthetic oligonucleotide; ATGGGT chr11 5237533 5237552 5237549 +
cccagtacattgtttgatat

SEQ ID NO: 58332 - DNA, 20 bp, Artificial Sequence
  Synthetic oligonucleotide; CAGAGT chr11 5237573 5237592 5237589 +
ggaggtcagaggttagaaat

SEQ ID NO: 58333 - DNA, 20 bp, Artificial Sequence
  Synthetic oligonucleotide; GGGAAT chr11 5237580 5237599 5237596 +
agaggttagaaatcagagtt

SEQ ID NO: 58334 - DNA, 20 bp, Artificial Sequence
  Synthetic oligonucleotide; TGGGAT chr11 5237586 5237605 5237602 +
tagaaatcagagttgggaat

SEQ ID NO: 58335 - DNA, 20 bp, Artificial Sequence
  Synthetic oligonucleotide; AAGAGT chr11 5237608 5237627 5237624 +
ggattatacaggctgtattt

SEQ ID NO: 58336 - DNA, 20 bp, Artificial Sequence
  Synthetic oligonucleotide; GTGAAT chr11 5237626 5237645 5237642 +
ttaagagtttagatataact

SEQ ID NO: 58337 - DNA, 20 bp, Artificial Sequence
  Synthetic oligonucleotide; AAGAGT chr11 5237634 5237653 5237650 +
ttagatataactgtgaatcc

SEQ ID NO: 58338 - DNA, 20 bp, Artificial Sequence
  Synthetic oligonucleotide; ATGAAT chr11 5237643 5237662 5237659 +
actgtgaatccaagagtgtg

SEQ ID NO: 58339 - DNA, 20 bp, Artificial Sequence
  Synthetic oligonucleotide; GTGGGT chr11 5237786 5237805 5237802 +
ttaattagtgtaatgccaat

SEQ ID NO: 58340 - DNA, 20 bp, Artificial Sequence
  Synthetic oligonucleotide; TAGAAT chr11 5237792 5237811 5237808 +
agtgtaatgccaatgtgggt

SEQ ID NO: 58341 - DNA, 20 bp, Artificial Sequence
  Synthetic oligonucleotide; TAGGGT chr11 5237887 5237906 5237903 +
ctgaaacaaaaaggaaaagg

SEQ ID NO: 58342 - DNA, 20 bp, Artificial Sequence
  Synthetic oligonucleotide; GAGGAT chr11 5237916 5237935 5237932 +
agatgggaaatgtatgtaag

SEQ ID NO: 58343 - DNA, 20 bp, Artificial Sequence
  Synthetic oligonucleotide; TAGGGT chr11 5237956 5237975 5237972 +
gggaggtatactaaggactc

SEQ ID NO: 58344 - DNA, 20 bp, Artificial Sequence
  Synthetic oligonucleotide; ATGGGT chr11 5237971 5237990 5237987 +
gactctagggtcagagaaat

SEQ ID NO: 58345 - DNA, 20 bp, Artificial Sequence
  Synthetic oligonucleotide; CTGGGT chr11 5238007 5238026 5238023 +
tacaaaattcacattcttgg

SEQ ID NO: 58346 - DNA, 20 bp, Artificial Sequence
  Synthetic oligonucleotide; GAGGGT chr11 5238056 5238075 5238072 +
cagcactttcagaggccgag

SEQ ID NO: 58347 - DNA, 20 bp, Artificial Sequence
  Synthetic oligonucleotide; GTGGAT chr11 5238060 5238079 5238076 +
actttcagaggccgaggagg

SEQ ID NO: 58348 - DNA, 20 bp, Artificial Sequence
  Synthetic oligonucleotide; AGGAGT chr11 5238077 5238096 5238093 +
agggtggatcacctgatgtt

SEQ ID NO: 58349 - DNA, 20 bp, Artificial Sequence
  Synthetic oligonucleotide; GAGAAT chr11 5238197 5238216 5238213 +
tacttgggaggctgaggcag

SEQ ID NO: 58350 - DNA, 20 bp, Artificial Sequence
  Synthetic oligonucleotide; CTGGAT chr11 5238237 5238256 5238253 +
aggcagatgttgcagtgagc

SEQ ID NO: 58351 - DNA, 20 bp, Artificial Sequence
  Synthetic oligonucleotide; ATGAAT chr11 5238370 5238389 5238386 +
taattcataattttcagata

SEQ ID NO: 58352 - DNA, 20 bp, Artificial Sequence
  Synthetic oligonucleotide; TTGAAT chr11 5238479 5238498 5238495 +
taatctcagttcactgctgt

SEQ ID NO: 58353 - DNA, 20 bp, Artificial Sequence
  Synthetic oligonucleotide; ACGGAT chr11 5238767 5238786 5238783 +
tggtctctctctctctctga

SEQ ID NO: 58354 - DNA, 20 bp, Artificial Sequence
  Synthetic oligonucleotide; CTGAAT chr11 5238873 5238892 5238889 +
aaggagcacccactagctca

SEQ ID NO: 58355 - DNA, 20 bp, Artificial Sequence
  Synthetic oligonucleotide; AAGGAT chr11 5239039 5239058 5239055 +
tattttagctcttccaatac

SEQ ID NO: 58356 - DNA, 20 bp, Artificial Sequence
  Synthetic oligonucleotide; TTGAGT chr11 5239078 5239097 5239094 +
gagctgtatttaattctagg

SEQ ID NO: 58357 - DNA, 20 bp, Artificial Sequence
  Synthetic oligonucleotide; GTGAAT chr11 5239182 5239201 5239198 +
ttagtgtatgaaattctgat

SEQ ID NO: 58358 - DNA, 20 bp, Artificial Sequence
  Synthetic oligonucleotide; ATGGAT chr11 5239329 5239348 5239345 +
ggtctcaaacaaacttctct

SEQ ID NO: 58359 - DNA, 20 bp, Artificial Sequence
  Synthetic oligonucleotide; TTGGAT chr11 5239373 5239392 5239389 +
tagaaaagagagatctaatt

SEQ ID NO: 58360 - DNA, 20 bp, Artificial Sequence
  Synthetic oligonucleotide; AAGAGT chr11 5239418 5239437 5239434 +
tctccaaatactagggaaat

SEQ ID NO: 58361 - DNA, 20 bp, Artificial Sequence
  Synthetic oligonucleotide; AGGAAT chr11 5239470 5239489 5239486 +
agaggttaaaatttagtggt

SEQ ID NO: 58362 - DNA, 20 bp, Artificial Sequence
  Synthetic oligonucleotide; CAGAGT chr11 5239547 5239566 5239563 +
gaaagagcccataattgtag

SEQ ID NO: 58363 - DNA, 20 bp, Artificial Sequence
  Synthetic oligonucleotide; ATGAGT chr11 5239636 5239655 5239652 +
tataagttaggacttaaagt

SEQ ID NO: 58364 - DNA, 20 bp, Artificial Sequence
  Synthetic oligonucleotide; CAGAGT chr11 5239680 5239699 5239696 +
aatgagggaaagacatcacc

SEQ ID NO: 58365 - DNA, 20 bp, Artificial Sequence
  Synthetic oligonucleotide; CAGAGT chr11 5239711 5239730 5239727 +
aacagcatgtacaaagctaa

SEQ ID NO: 58366 - DNA, 20 bp, Artificial Sequence
  Synthetic oligonucleotide; TGGGGT chr11 5239749 5239768 5239765 +
tccaaattctctagattgac

SEQ ID NO: 58367 - DNA, 20 bp, Artificial Sequence
  Synthetic oligonucleotide; TGGAAT chr11 5239812 5239831 5239828 +
tgtgtgttcttatgtgtgca

SEQ ID NO: 58368 - DNA, 20 bp, Artificial Sequence
  Synthetic oligonucleotide; GAGAAT chr11 5239879 5239898 5239895 +
acatctgtatgtgtatatca

SEQ ID NO: 58369 - DNA, 20 bp, Artificial Sequence
  Synthetic oligonucleotide; GTGAAT chr11 5239995 5240014 5240011 +
ttatgtgttttccactaaag

SEQ ID NO: 58370 - DNA, 20 bp, Artificial Sequence
  Synthetic oligonucleotide; CAGAGT chr11 5240074 5240093 5240090 +
tcatctcttcatttaaaata

SEQ ID NO: 58371 - DNA, 20 bp, Artificial Sequence
  Synthetic oligonucleotide; AGGGAT chr11 5240096 5240115 5240112 +
gagtgacattcagaagggca

SEQ ID NO: 58372 - DNA, 20 bp, Artificial Sequence
  Synthetic oligonucleotide; AAGAAT chr11 5240154 5240173 5240170 +
ttggacacagtaattattca

SEQ ID NO: 58373 - DNA, 20 bp, Artificial Sequence
  Synthetic oligonucleotide; TTGAGT chr11 5240192 5240211 5240208 +
tgtatgctacaagacagcag

SEQ ID NO: 58374 - DNA, 20 bp, Artificial Sequence
  Synthetic oligonucleotide; GTGGGT chr11 5240236 5240255 5240252 +
actggtatttattctgcttt

SEQ ID NO: 58375 - DNA, 20 bp, Artificial Sequence
  Synthetic oligonucleotide; AGGAAT chr11 5240270 5240289 5240286 +
gggactcaaaaatatgacaa

SEQ ID NO: 58376 - DNA, 20 bp, Artificial Sequence
  Synthetic oligonucleotide; TGGGGT chr11 5240349 5240368 5240365 +
atatggtgaggtgagctctt

SEQ ID NO: 58377 - DNA, 20 bp, Artificial Sequence
  Synthetic oligonucleotide; TGGGAT chr11 5240390 5240409 5240406 +
atactttgagaaagaggttt

SEQ ID NO: 58378 - DNA, 20 bp, Artificial Sequence
  Synthetic oligonucleotide; AAGGGT chr11 5240414 5240433 5240430 +
attaatgaaactggagaaga

SEQ ID NO: 58379 - DNA, 20 bp, Artificial Sequence
  Synthetic oligonucleotide; GAGGGT chr11 5240461 5240480 5240477 +
ttctttgaggttttaggttt

SEQ ID NO: 58380 - DNA, 20 bp, Artificial Sequence
  Synthetic oligonucleotide; AAGGGT chr11 5240481 5240500 5240497 +
gagggtgctacatacttcct

SEQ ID NO: 58381 - DNA, 20 bp, Artificial Sequence
  Synthetic oligonucleotide; TTGGGT chr11 5240488 5240507 5240504 +
ctacatacttcctaagggtc

SEQ ID NO: 58382 - DNA, 20 bp, Artificial Sequence
  Synthetic oligonucleotide; AGGAGT chr11 5240496 5240515 5240512 +
ttcctaagggtcttgggtac

SEQ ID NO: 58383 - DNA, 20 bp, Artificial Sequence
  Synthetic oligonucleotide; CAGAAT chr11 5240517 5240536 5240533 +
ggagtttgaagtgattgcca

SEQ ID NO: 58384 - DNA, 20 bp, Artificial Sequence
  Synthetic oligonucleotide; AGGGAT chr11 5240608 5240627 5240624 +
ccttcttttcattcacagac

SEQ ID NO: 58385 - DNA, 20 bp, Artificial Sequence
  Synthetic oligonucleotide; GTGAAT chr11 5240825 5240844 5240841 +
ttctatatatatatatacat

SEQ ID NO: 58386 - DNA, 20 bp, Artificial Sequence
  Synthetic oligonucleotide; ATGAAT chr11 5241126 5241145 5241142 +
cataaaaattgtatatattt

SEQ ID NO: 58387 - DNA, 20 bp, Artificial Sequence
  Synthetic oligonucleotide; GAGAAT chr11 5241161 5241180 5241177 +
tgtgtgtatatatatagaaa

SEQ ID NO: 58388 - DNA, 20 bp, Artificial Sequence
  Synthetic oligonucleotide; TTGGGT chr11 5241246 5241265 5241262 +
acaaagagatttattattta

SEQ ID NO: 58389 - DNA, 20 bp, Artificial Sequence
  Synthetic oligonucleotide; TGGAAT chr11 5241349 5241368 5241365 +
ctatcatatgcacagcttaa

SEQ ID NO: 58390 - DNA, 20 bp, Artificial Sequence
  Synthetic oligonucleotide; CTGAGT chr11 5241594 5241613 5241610 +
gtcaccaaatgagctatatc

SEQ ID NO: 58391 - DNA, 20 bp, Artificial Sequence
  Synthetic oligonucleotide; TTGAGT chr11 5241635 5241654 5241651 +
gcctatacagaacttctaat

SEQ ID NO: 58392 - DNA, 20 bp, Artificial Sequence
  Synthetic oligonucleotide; AAGAGT chr11 5241686 5241705 5241702 +
acaatcctcttacacctcca

SEQ ID NO: 58393 - DNA, 20 bp, Artificial Sequence
  Synthetic oligonucleotide; AGGAGT chr11 5241755 5241774 5241771 +
agagacgatttccccttcct

SEQ ID NO: 58394 - DNA, 20 bp, Artificial Sequence
  Synthetic oligonucleotide; ACGAGT chr11 5241783 5241802 5241799 +
ctaccccactaaatccaccc

SEQ ID NO: 58395 - DNA, 20 bp, Artificial Sequence
  Synthetic oligonucleotide; CAGGAT chr11 5241803 5241822 5241819 +
acgagttctctcttttcttg

SEQ ID NO: 58396 - DNA, 20 bp, Artificial Sequence
  Synthetic oligonucleotide; CTGAAT chr11 5241889 5241908 5241905 +
gaaatagtgcgtccttttgg

SEQ ID NO: 58397 - DNA, 20 bp, Artificial Sequence
  Synthetic oligonucleotide; CAGGGT chr11 5241895 5241914 5241911 +
gtgcgtccttttggctgaat

SEQ ID NO: 58398 - DNA, 20 bp, Artificial Sequence
  Synthetic oligonucleotide; AAGAGT chr11 5241919 5241938 5241935 +
gtaaaatataaagacagaaa

SEQ ID NO: 58399 - DNA, 20 bp, Artificial Sequence
  Synthetic oligonucleotide; CTGAAT chr11 5241980 5241999 5241996 +
ctatttttatcatgcaggaa

SEQ ID NO: 58400 - DNA, 20 bp, Artificial Sequence
  Synthetic oligonucleotide; CAGGAT chr11 5241993 5242012 5242009 +
gcaggaactgaatcagcagg

SEQ ID NO: 58401 - DNA, 20 bp, Artificial Sequence
  Synthetic oligonucleotide; TAGGGT chr11 5242168 5242187 5242184 +
tgccaagaagcctgtatctg

SEQ ID NO: 58402 - DNA, 20 bp, Artificial Sequence
  Synthetic oligonucleotide; GTGGGT chr11 5242189 5242208 5242205 +
agggtaaaatcctcgctgaa

SEQ ID NO: 58403 - DNA, 20 bp, Artificial Sequence
  Synthetic oligonucleotide; GGGAGT chr11 5242235 5242254 5242251 +
cgttgcctaagagctgggga

SEQ ID NO: 58404 - DNA, 20 bp, Artificial Sequence
  Synthetic oligonucleotide; GTGAAT chr11 5242267 5242286 5242283 +
aaaaaagaaaatggtacata

SEQ ID NO: 58405 - DNA, 20 bp, Artificial Sequence
  Synthetic oligonucleotide; CAGAGT chr11 5242330 5242349 5242346 +
acacttacatcctttttcac

SEQ ID NO: 58406 - DNA, 20 bp, Artificial Sequence
  Synthetic oligonucleotide; TAGGAT chr11 5242501 5242520 5242517 +
gacttcgtccttttaaaaag

SEQ ID NO: 58407 - DNA, 20 bp, Artificial Sequence
  Synthetic oligonucleotide; ATGGAT chr11 5242529 5242548 5242545 +
tagtacttcaaggaacagta

SEQ ID NO: 58408 - DNA, 20 bp, Artificial Sequence
  Synthetic oligonucleotide; TAGGAT chr11 5242534 5242553 5242550 +
cttcaaggaacagtaatgga

SEQ ID NO: 58409 - DNA, 20 bp, Artificial Sequence
  Synthetic oligonucleotide; AAGAAT chr11 5242604 5242623 5242620 +
tttcccaaacactcataaca

SEQ ID NO: 58410 - DNA, 20 bp, Artificial Sequence
  Synthetic oligonucleotide; CAGAAT chr11 5242836 5242855 5242852 +
acactcagtttgattttggc

SEQ ID NO: 58411 - DNA, 20 bp, Artificial Sequence
  Synthetic oligonucleotide; AAGGGT chr11 5243047 5243066 5243063 +
tacccatagtgcaaatatct

SEQ ID NO: 58412 - DNA, 20 bp, Artificial Sequence
  Synthetic oligonucleotide; GTGAGT chr11 5243065 5243084 5243081 +
ctaagggtaaagaagaaagc

SEQ ID NO: 58413 - DNA, 20 bp, Artificial Sequence
  Synthetic oligonucleotide; CAGGGT chr11 5243097 5243116 5243113 +
actactcaccaggaagttct

SEQ ID NO: 58414 - DNA, 20 bp, Artificial Sequence
  Synthetic oligonucleotide; TGGGGT chr11 5243223 5243242 5243239 +
cttgccatgtgccttgactt

SEQ ID NO: 58415 - DNA, 20 bp, Artificial Sequence
  Synthetic oligonucleotide; ATGGGT chr11 5243289 5243308 5243305 +
ttcaaagtacctctaggtcc

SEQ ID NO: 58416 - DNA, 20 bp, Artificial Sequence
  Synthetic oligonucleotide; TGGGAT chr11 5243312 5243331 5243328 +
ggtagacaaccaggagactg

SEQ ID NO: 58417 - DNA, 20 bp, Artificial Sequence
  Synthetic oligonucleotide; CAGAAT chr11 5243435 5243454 5243451 +
gcttccagtacctacctgcc

SEQ ID NO: 58418 - DNA, 20 bp, Artificial Sequence
  Synthetic oligonucleotide; GGGAGT chr11 5243533 5243552 5243549 +
tgcactacagtgtcagatct

SEQ ID NO: 58419 - DNA, 20 bp, Artificial Sequence
  Synthetic oligonucleotide; ATGAAT chr11 5243644 5243663 5243660 +
cctttgcctctcccagtgaa

SEQ ID NO: 58420 - DNA, 20 bp, Artificial Sequence
  Synthetic oligonucleotide; ATGAAT chr11 5243682 5243701 5243698 +
cctttgcctccctcagtaaa

SEQ ID NO: 58421 - DNA, 20 bp, Artificial Sequence
  Synthetic oligonucleotide; AAGGGT chr11 5243697 5243716 5243713 +
gtaaaatgaatctattggtc

SEQ ID NO: 58422 - DNA, 20 bp, Artificial Sequence
  Synthetic oligonucleotide; GTGGGT chr11 5243701 5243720 5243717 +
aatgaatctattggtcaagg

SEQ ID NO: 58423 - DNA, 20 bp, Artificial Sequence
  Synthetic oligonucleotide; AGGGGT chr11 5243716 5243735 5243732 +
caagggtgggttgtgactcc

SEQ ID NO: 58424 - DNA, 20 bp, Artificial Sequence
  Synthetic oligonucleotide; TGGGGT chr11 5243721 5243740 5243737 +
gtgggttgtgactccagggg

SEQ ID NO: 58425 - DNA, 20 bp, Artificial Sequence
  Synthetic oligonucleotide; TCGAGT chr11 5243757 5243776 5243773 +
aagttttgcaagatggacat

SEQ ID NO: 58426 - DNA, 20 bp, Artificial Sequence
  Synthetic oligonucleotide; TAGAAT chr11 5243769 5243788 5243785 +
atggacattcgagtttctga

SEQ ID NO: 58427 - DNA, 20 bp, Artificial Sequence
  Synthetic oligonucleotide; CTGAAT chr11 5243915 5243934 5243931 +
cgccagcagccgctaataac

SEQ ID NO: 58428 - DNA, 20 bp, Artificial Sequence
  Synthetic oligonucleotide; AGGAAT chr11 5243931 5243950 5243947 +
taacctgaatgctgacaaat

SEQ ID NO: 58429 - DNA, 20 bp, Artificial Sequence
  Synthetic oligonucleotide; AAGGAT chr11 5243951 5243970 5243967 +
aggaataagttacaactgaa

SEQ ID NO: 58430 - DNA, 20 bp, Artificial Sequence
  Synthetic oligonucleotide; AAGAAT chr11 5243957 5243976 5243973 +
aagttacaactgaaaaggat

SEQ ID NO: 58431 - DNA, 20 bp, Artificial Sequence
  Synthetic oligonucleotide; ACGAAT chr11 5243964 5243983 5243980 +
aactgaaaaggataagaatt

SEQ ID NO: 58432 - DNA, 20 bp, Artificial Sequence
  Synthetic oligonucleotide; CTGGAT chr11 5243987 5244006 5244003 +
aatatcttagccatcaattc

SEQ ID NO: 58433 - DNA, 20 bp, Artificial Sequence
  Synthetic oligonucleotide; AGGAGT chr11 5243994 5244013 5244010 +
tagccatcaattcctggatc

SEQ ID NO: 58434 - DNA, 20 bp, Artificial Sequence
  Synthetic oligonucleotide; TTGAAT chr11 5244096 5244115 5244112 +
tcaattctcttgagactaca

SEQ ID NO: 58435 - DNA, 20 bp, Artificial Sequence
  Synthetic oligonucleotide; TGGAGT chr11 5244169 5244188 5244185 +
ttttttttttttttttgaga

SEQ ID NO: 58436 - DNA, 20 bp, Artificial Sequence
  Synthetic oligonucleotide; TGGAGT chr11 5244194 5244213 5244210 +
tctcgctttgtcacccaggc

SEQ ID NO: 58437 - DNA, 20 bp, Artificial Sequence
  Synthetic oligonucleotide; CCGAGT chr11 5244272 5244291 5244288 +
cattctcctgcctcagcctc

SEQ ID NO: 58438 - DNA, 20 bp, Artificial Sequence
  Synthetic oligonucleotide; TGGGGT chr11 5244338 5244357 5244354 +
ttttgtatttttagtagaga

SEQ ID NO: 58439 - DNA, 20 bp, Artificial Sequence
  Synthetic oligonucleotide; CAGGAT chr11 5244358 5244377 5244374 +
tggggtttcaccatgttagc

SEQ ID NO: 58440 - DNA, 20 bp, Artificial Sequence
  Synthetic oligonucleotide; TGGGAT chr11 5244415 5244434 5244431 +
acctcagcctcccaaagtgc

SEQ ID NO: 58441 - DNA, 20 bp, Artificial Sequence
  Synthetic oligonucleotide; TAGAAT chr11 5244463 5244482 5244479 +
cggccaatttcatcactttt

SEQ ID NO: 58442 - DNA, 20 bp, Artificial Sequence
  Synthetic oligonucleotide; CAGAAT chr11 5244509 5244528 5244525 +
agcatcaacttggaagaaag

SEQ ID NO: 58443 - DNA, 20 bp, Artificial Sequence
  Synthetic oligonucleotide; CTGGGT chr11 5244545 5244564 5244561 +
ctagggaagtaaggggaaaa

SEQ ID NO: 58444 - DNA, 20 bp, Artificial Sequence
  Synthetic oligonucleotide; CTGAAT chr11 5244616 5244635 5244632 +
ctgaacaaaggagatttcct

SEQ ID NO: 58445 - DNA, 20 bp, Artificial Sequence
  Synthetic oligonucleotide; GAGGAT chr11 5244720 5244739 5244736 +
gtgctgctctgttcaagcaa

SEQ ID NO: 58446 - DNA, 20 bp, Artificial Sequence
  Synthetic oligonucleotide; AGGAAT chr11 5244917 5244936 5244933 +
cgtctcaaacaagcaatttc

SEQ ID NO: 58447 - DNA, 20 bp, Artificial Sequence
  Synthetic oligonucleotide; CAGGAT chr11 5245005 5245024 5245021 +
tgtcctcatacttagaggtt

SEQ ID NO: 58448 - DNA, 20 bp, Artificial Sequence
  Synthetic oligonucleotide; AAGAGT chr11 5245105 5245124 5245121 +
caaggagactctaaatttca

SEQ ID NO: 58449 - DNA, 20 bp, Artificial Sequence
  Synthetic oligonucleotide; CTGAAT chr11 5245130 5245149 5245146 +
ttaaacccaatatattaaag

SEQ ID NO: 58450 - DNA, 20 bp, Artificial Sequence
  Synthetic oligonucleotide; TTGAGT chr11 5245333 5245352 5245349 +
atgcaggaaacacatttata

SEQ ID NO: 58451 - DNA, 20 bp, Artificial Sequence
  Synthetic oligonucleotide; AAGAAT chr11 5245405 5245424 5245421 +
gccctaaaactcattcccaa

SEQ ID NO: 58452 - DNA, 20 bp, Artificial Sequence
  Synthetic oligonucleotide; AGGAAT chr11 5245504 5245523 5245520 +
catctttccatcagccaacc

SEQ ID NO: 58453 - DNA, 20 bp, Artificial Sequence
  Synthetic oligonucleotide; GAGAAT chr11 5245808 5245827 5245824 +
catccatttttcttaattct

SEQ ID NO: 58454 - DNA, 20 bp, Artificial Sequence
  Synthetic oligonucleotide; ATGAAT chr11 5245900 5245919 5245916 +
cagcatacatactaaaagaa

SEQ ID NO: 58455 - DNA, 20 bp, Artificial Sequence
  Synthetic oligonucleotide; AAGGAT chr11 5246008 5246027 5246024 +
acaaaagcaagcaatgggga

SEQ ID NO: 58456 - DNA, 20 bp, Artificial Sequence
  Synthetic oligonucleotide; ATGGAT chr11 5246110 5246129 5246126 +
ttatccaaaattaactccag

SEQ ID NO: 58457 - DNA, 20 bp, Artificial Sequence
  Synthetic oligonucleotide; TGGAAT chr11 5246255 5246274 5246271 +
caaaagcaaaaattgaccaa

SEQ ID NO: 58458 - DNA, 20 bp, Artificial Sequence
  Synthetic oligonucleotide; CAGAAT chr11 5246324 5246343 5246340 +
tcagagcgaaagacaatcta

SEQ ID NO: 58459 - DNA, 20 bp, Artificial Sequence
  Synthetic oligonucleotide; CAGAGT chr11 5246376 5246395 5246392 +
tctgacaaaggcctaatatc

SEQ ID NO: 58460 - DNA, 20 bp, Artificial Sequence
  Synthetic oligonucleotide; CTGAAT chr11 5246483 5246502 5246499 +
catatcctgtacgtgtaccc

SEQ ID NO: 58461 - DNA, 20 bp, Artificial Sequence
  Synthetic oligonucleotide; AAGAAT chr11 5246888 5246907 5246904 +
aaaaaagaaagaaagaaaaa

SEQ ID NO: 58462 - DNA, 20 bp, Artificial Sequence
  Synthetic oligonucleotide; TAGAGT chr11 5246936 5246955 5246952 +
atgtaaagacattacaaggc

SEQ ID NO: 58463 - DNA, 20 bp, Artificial Sequence
  Synthetic oligonucleotide; TTGGGT chr11 5247004 5247023 5247020 +
gaagggcgcaggcttattat

SEQ ID NO: 58464 - DNA, 20 bp, Artificial Sequence
  Synthetic oligonucleotide; GAGAGT chr11 5247019 5247038 5247035 +
attatttgggtcttatagat

SEQ ID NO: 58465 - DNA, 20 bp, Artificial Sequence
  Synthetic oligonucleotide; TAGAGT chr11 5247027 5247046 5247043 +
ggtcttatagatgagagtag

SEQ ID NO: 58466 - DNA, 20 bp, Artificial Sequence
  Synthetic oligonucleotide; CTGGGT chr11 5247183 5247202 5247199 +
ctataacaaaatacaaaaga

SEQ ID NO: 58467 - DNA, 20 bp, Artificial Sequence
  Synthetic oligonucleotide; CAGAGT chr11 5247200 5247219 5247216 +
agactgggtggcttcaacaa

SEQ ID NO: 58468 - DNA, 20 bp, Artificial Sequence
  Synthetic oligonucleotide; CAGGGT chr11 5247239 5247258 5247255 +
tctgaaggctgactcgtggt

SEQ ID NO: 58469 - DNA, 20 bp, Artificial Sequence
  Synthetic oligonucleotide; CTGGAT chr11 5247252 5247271 5247268 +
tcgtggtcagggttctcttc

SEQ ID NO: 58470 - DNA, 20 bp, Artificial Sequence
  Synthetic oligonucleotide; GGGGAT chr11 5247349 5247368 5247365 +
aaggaaaataattttatgat

SEQ ID NO: 58471 - DNA, 20 bp, Artificial Sequence
  Synthetic oligonucleotide; GGGAGT chr11 5247421 5247440 5247437 +
ccccacagataaggtcagtt

SEQ ID NO: 58472 - DNA, 20 bp, Artificial Sequence
  Synthetic oligonucleotide; GGGGAT chr11 5247428 5247447 5247444 +
gataaggtcagttgggagtt

SEQ ID NO: 58473 - DNA, 20 bp, Artificial Sequence
  Synthetic oligonucleotide; GTGAAT chr11 5247441 5247460 5247457 +
gggagttggggattcagcat

SEQ ID NO: 58474 - DNA, 20 bp, Artificial Sequence
  Synthetic oligonucleotide; CAGAGT chr11 5247687 5247706 5247703 +
acctaagtccccacctcccc

SEQ ID NO: 58475 - DNA, 20 bp, Artificial Sequence
  Synthetic oligonucleotide; TGGGAT chr11 5247749 5247768 5247765 +
aatctgcacacttgagggca

SEQ ID NO: 58476 - DNA, 20 bp, Artificial Sequence
  Synthetic oligonucleotide; TAGAAT chr11 5247832 5247851 5247848 +
tagtattcctcctaataaaa

SEQ ID NO: 58477 - DNA, 20 bp, Artificial Sequence
  Synthetic oligonucleotide; TTGAAT chr11 5247857 5247876 5247873 +
ttgctacacctgactaaacc

SEQ ID NO: 58478 - DNA, 20 bp, Artificial Sequence
  Synthetic oligonucleotide; CCGGAT chr11 5248016 5248035 5248032 +
tatagaggtctttcttccca

SEQ ID NO: 58479 - DNA, 20 bp, Artificial Sequence
  Synthetic oligonucleotide; CAGAAT chr11 5248264 5248283 5248280 +
aatcatgtgtgatctctcag

SEQ ID NO: 58480 - DNA, 20 bp, Artificial Sequence
  Synthetic oligonucleotide; CAGAAT chr11 5248293 5248312 5248309 +
tttattatttgtattgcttg

SEQ ID NO: 58481 - DNA, 20 bp, Artificial Sequence
  Synthetic oligonucleotide; CTGAAT chr11 5248319 5248338 5248335 +
aaagcctatccttgaaagct

SEQ ID NO: 58482 - DNA, 20 bp, Artificial Sequence
  Synthetic oligonucleotide; AGGGGT chr11 5248408 5248427 5248424 +
tgccaggaagcctgcacctc

SEQ ID NO: 58483 - DNA, 20 bp, Artificial Sequence
  Synthetic oligonucleotide; GTGAAT chr11 5248412 5248431 5248428 +
aggaagcctgcacctcaggg

SEQ ID NO: 58484 - DNA, 20 bp, Artificial Sequence
  Synthetic oligonucleotide; ATGGAT chr11 5248429 5248448 5248445 +
ggggtgaattctttgccgaa

SEQ ID NO: 58485 - DNA, 20 bp, Artificial Sequence
  Synthetic oligonucleotide; CAGAAT chr11 5248560 5248579 5248576 +
ctacacaccaagcttccacc

SEQ ID NO: 58486 - DNA, 20 bp, Artificial Sequence
  Synthetic oligonucleotide; TGGAAT chr11 5248856 5248875 5248872 +
ggacatactttgcccccatc

SEQ ID NO: 58487 - DNA, 20 bp, Artificial Sequence
  Synthetic oligonucleotide; AAGGAT chr11 5248864 5248883 5248880 +
tttgcccccatctggaatta

SEQ ID NO: 58488 - DNA, 20 bp, Artificial Sequence
  Synthetic oligonucleotide; AGGAAT chr11 5248921 5248940 5248937 +
tatatgtgtccagctgatat

SEQ ID NO: 58489 - DNA, 20 bp, Artificial Sequence
  Synthetic oligonucleotide; TGGAAT chr11 5249083 5249102 5249099 +
aagatgaaagttctttctac

SEQ ID NO: 58490 - DNA, 20 bp, Artificial Sequence
  Synthetic oligonucleotide; CTGGGT chr11 5249194 5249213 5249210 +
taggccctaaaacattacca

SEQ ID NO: 58491 - DNA, 20 bp, Artificial Sequence
  Synthetic oligonucleotide; CAGGAT chr11 5249359 5249378 5249375 +
tggactcaccttgaagttct

SEQ ID NO: 58492 - DNA, 20 bp, Artificial Sequence
  Synthetic oligonucleotide; TGGGGT chr11 5249485 5249504 5249501 +
cttgccatgtgccttgactt

SEQ ID NO: 58493 - DNA, 20 bp, Artificial Sequence
  Synthetic oligonucleotide; CTGGGT chr11 5249543 5249562 5249559 +
ccaaagctgtcaaagaacct

SEQ ID NO: 58494 - DNA, 20 bp, Artificial Sequence
  Synthetic oligonucleotide; ATGGGT chr11 5249551 5249570 5249567 +
gtcaaagaacctctgggtcc

SEQ ID NO: 58495 - DNA, 20 bp, Artificial Sequence
  Synthetic oligonucleotide; CAGGGT chr11 5249649 5249668 5249665 +
acctggacttttgccaggca

SEQ ID NO: 58496 - DNA, 20 bp, Artificial Sequence
  Synthetic oligonucleotide; CAGGGT chr11 5249698 5249717 5249714 +
gtcaccagagcctaccttcc

SEQ ID NO: 58497 - DNA, 20 bp, Artificial Sequence
  Synthetic oligonucleotide; GCGAGT chr11 5249830 5249849 5249846 +
taacctcagacgttccagaa

SEQ ID NO: 58498 - DNA, 20 bp, Artificial Sequence
  Synthetic oligonucleotide; AAGGGT chr11 5249850 5249869 5249866 +
gcgagtgtgtggaactgctg

SEQ ID NO: 58499 - DNA, 20 bp, Artificial Sequence
  Synthetic oligonucleotide; CTGGAT chr11 5249904 5249923 5249920 +
gccgccggcccctggcctca

SEQ ID NO: 58500 - DNA, 20 bp, Artificial Sequence
  Synthetic oligonucleotide; ATGGGT chr11 5249975 5249994 5249991 +
aaggcaaggctggccaaccc

SEQ ID NO: 58501 - DNA, 20 bp, Artificial Sequence
  Synthetic oligonucleotide; TGGAGT chr11 5249980 5249999 5249996 +
aaggctggccaacccatggg

SEQ ID NO: 58502 - DNA, 20 bp, Artificial Sequence
  Synthetic oligonucleotide; GAGGAT chr11 5250048 5250067 5250064 +
tgtggggaaggggcccccaa

SEQ ID NO: 58503 - DNA, 20 bp, Artificial Sequence
  Synthetic oligonucleotide; GAGGAT chr11 5250155 5250174 5250171 +
agtttccttctcccatcata

SEQ ID NO: 58504 - DNA, 20 bp, Artificial Sequence
  Synthetic oligonucleotide; AGGGAT chr11 5250261 5250280 5250277 +
taccaatttttgaaaagttc

SEQ ID NO: 58505 - DNA, 20 bp, Artificial Sequence
  Synthetic oligonucleotide; CAGGAT chr11 5250293 5250312 5250309 +
atgtgttttaggcataggtc

SEQ ID NO: 58506 - DNA, 20 bp, Artificial Sequence
  Synthetic oligonucleotide; TTGAAT chr11 5250369 5250388 5250385 +
aaaaagtgctatacttcttt

SEQ ID NO: 58507 - DNA, 20 bp, Artificial Sequence
  Synthetic oligonucleotide; CTGGAT chr11 5250617 5250636 5250633 +
cagatgatgtgtatttacca

SEQ ID NO: 58508 - DNA, 20 bp, Artificial Sequence
  Synthetic oligonucleotide; CAGGGT chr11 5250647 5250666 5250663 +
gtgtgtgctggctgatgacc

SEQ ID NO: 58509 - DNA, 20 bp, Artificial Sequence
  Synthetic oligonucleotide; TAGAAT chr11 5250690 5250709 5250706 +
atgctcagtaaagatgatgg

SEQ ID NO: 58510 - DNA, 20 bp, Artificial Sequence
  Synthetic oligonucleotide; GTGGAT chr11 5250713 5250732 5250729 +
aatgttctttggcaggtact

SEQ ID NO: 58511 - DNA, 20 bp, Artificial Sequence
  Synthetic oligonucleotide; TAGAAT chr11 5250719 5250738 5250735 +
ctttggcaggtactgtggat

SEQ ID NO: 58512 - DNA, 20 bp, Artificial Sequence
  Synthetic oligonucleotide; GGGAAT chr11 5250760 5250779 5250776 +
aatgctaggttcacttctca

SEQ ID NO: 58513 - DNA, 20 bp, Artificial Sequence
  Synthetic oligonucleotide; AAGGGT chr11 5250819 5250838 5250835 +
gaaaacaactctaaagaggc

SEQ ID NO: 58514 - DNA, 20 bp, Artificial Sequence
  Synthetic oligonucleotide; TCGAAT chr11 5250862 5250881 5250878 +
agtccacacactattataac

SEQ ID NO: 58515 - DNA, 20 bp, Artificial Sequence
  Synthetic oligonucleotide; CAGGGT chr11 5250932 5250951 5250948 +
ctgacatattggaccattaa

SEQ ID NO: 58516 - DNA, 20 bp, Artificial Sequence
  Synthetic oligonucleotide; TGGAAT chr11 5251054 5251073 5251070 +
gattataatgccagaagctc

SEQ ID NO: 58517 - DNA, 20 bp, Artificial Sequence
  Synthetic oligonucleotide; GCGAAT chr11 5251525 5251544 5251541 +
aaaggacaaagaaagaaagt

SEQ ID NO: 58518 - DNA, 20 bp, Artificial Sequence
  Synthetic oligonucleotide; GTGAGT chr11 5251543 5251562 5251559 +
gtgcgaattgtgaaatggta

SEQ ID NO: 58519 - DNA, 20 bp, Artificial Sequence
  Synthetic oligonucleotide; GTGGGT chr11 5251562 5251581 5251578 +
agtgagtgatggcatttgaa

SEQ ID NO: 58520 - DNA, 20 bp, Artificial Sequence
  Synthetic oligonucleotide; TAGAAT chr11 5251749 5251768 5251765 +
aaagtacgttgaagaaaaaa

SEQ ID NO: 58521 - DNA, 20 bp, Artificial Sequence
  Synthetic oligonucleotide; GAGAGT chr11 5251803 5251822 5251819 +
actatttgcatcttacagat

SEQ ID NO: 58522 - DNA, 20 bp, Artificial Sequence
  Synthetic oligonucleotide; TAGAGT chr11 5251811 5251830 5251827 +
catcttacagatgagagtag

SEQ ID NO: 58523 - DNA, 20 bp, Artificial Sequence
  Synthetic oligonucleotide; CTGGGT chr11 5251967 5251986 5251983 +
ctataacaaaatagcataga

SEQ ID NO: 58524 - DNA, 20 bp, Artificial Sequence
  Synthetic oligonucleotide; CAGGAT chr11 5251984 5252003 5252000 +
agactgggtgacttcaacaa

SEQ ID NO: 58525 - DNA, 20 bp, Artificial Sequence
  Synthetic oligonucleotide; CTGGGT chr11 5252032 5252051 5252048 +
tcctggtcagggctctcttc

SEQ ID NO: 58526 - DNA, 20 bp, Artificial Sequence
  Synthetic oligonucleotide; GGGGAT chr11 5252128 5252147 5252144 +
gaggaaaataattctatgat

SEQ ID NO: 58527 - DNA, 20 bp, Artificial Sequence
  Synthetic oligonucleotide; GGGAGT chr11 5252200 5252219 5252216 +
ccccacaaatggagccaatt

SEQ ID NO: 58528 - DNA, 20 bp, Artificial Sequence
  Synthetic oligonucleotide; GGGGAT chr11 5252207 5252226 5252223 +
aatggagccaattgggagtt

SEQ ID NO: 58529 - DNA, 20 bp, Artificial Sequence
  Synthetic oligonucleotide; GTGAAT chr11 5252220 5252239 5252236 +
gggagttggggattcagcat

SEQ ID NO: 58530 - DNA, 20 bp, Artificial Sequence
  Synthetic oligonucleotide; GTGAAT chr11 5252323 5252342 5252339 +
tcaattatataagaactcca

SEQ ID NO: 58531 - DNA, 20 bp, Artificial Sequence
  Synthetic oligonucleotide; AAGGGT chr11 5252526 5252545 5252542 +
tgtgaccagtctgtagactt

SEQ ID NO: 58532 - DNA, 20 bp, Artificial Sequence
  Synthetic oligonucleotide; TGGGAT chr11 5252533 5252552 5252549 +
agtctgtagacttaagggta

SEQ ID NO: 58533 - DNA, 20 bp, Artificial Sequence
  Synthetic oligonucleotide; AAGGAT chr11 5252597 5252616 5252613 +
gaaaagttccttagtaaagt

SEQ ID NO: 58534 - DNA, 20 bp, Artificial Sequence
  Synthetic oligonucleotide; TAGAAT chr11 5252737 5252756 5252753 +
tagtattgcccctaataaaa

SEQ ID NO: 58535 - DNA, 20 bp, Artificial Sequence
  Synthetic oligonucleotide; GGGGGT chr11 5252835 5252854 5252851 +
ctgtgctgcaatccagggaa

SEQ ID NO: 58536 - DNA, 20 bp, Artificial Sequence
  Synthetic oligonucleotide; AGGAGT chr11 5252893 5252912 5252909 +
ttccaaaacatctgtttctg

SEQ ID NO: 58537 - DNA, 20 bp, Artificial Sequence
  Synthetic oligonucleotide; TGGAGT chr11 5253043 5253062 5253059 +
ctaacgtaaacaaaaaagtg

SEQ ID NO: 58538 - DNA, 20 bp, Artificial Sequence
  Synthetic oligonucleotide; CAGAAT chr11 5253183 5253202 5253199 +
aaccatgtgtgatctcttag

SEQ ID NO: 58539 - DNA, 20 bp, Artificial Sequence
  Synthetic oligonucleotide; CAGAAT chr11 5253211 5253230 5253227 +
atttattatttgattgcttg

SEQ ID NO: 58540 - DNA, 20 bp, Artificial Sequence
  Synthetic oligonucleotide; AGGGGT chr11 5253326 5253345 5253342 +
tgccaggaagcctgcacctc

SEQ ID NO: 58541 - DNA, 20 bp, Artificial Sequence
  Synthetic oligonucleotide; GTGAAT chr11 5253330 5253349 5253346 +
aggaagcctgcacctcaggg

SEQ ID NO: 58542 - DNA, 20 bp, Artificial Sequence
  Synthetic oligonucleotide; ATGGAT chr11 5253347 5253366 5253363 +
ggggtgaattctttgccgaa

SEQ ID NO: 58543 - DNA, 20 bp, Artificial Sequence
  Synthetic oligonucleotide; CAGAAT chr11 5253478 5253497 5253494 +
ctacacaccaagcttccacc

SEQ ID NO: 58544 - DNA, 20 bp, Artificial Sequence
  Synthetic oligonucleotide; TGGAAT chr11 5253776 5253795 5253792 +
ggacatactttgcccccatc

SEQ ID NO: 58545 - DNA, 20 bp, Artificial Sequence
  Synthetic oligonucleotide; AAGGAT chr11 5253784 5253803 5253800 +
tttgcccccatctggaatta

SEQ ID NO: 58546 - DNA, 20 bp, Artificial Sequence
  Synthetic oligonucleotide; AGGAAT chr11 5253841 5253860 5253857 +
tatatgtgtccagctgatat

SEQ ID NO: 58547 - DNA, 20 bp, Artificial Sequence
  Synthetic oligonucleotide; ACGAAT chr11 5253966 5253985 5253982 +
ctccagatagatgttttaaa

SEQ ID NO: 58548 - DNA, 20 bp, Artificial Sequence
  Synthetic oligonucleotide; CTGGGT chr11 5254118 5254137 5254134 +
taggccctaaaacattgcca

SEQ ID NO: 58549 - DNA, 20 bp, Artificial Sequence
  Synthetic oligonucleotide; CAGGAT chr11 5254283 5254302 5254299 +
tggactcaccttgaagttct

SEQ ID NO: 58550 - DNA, 20 bp, Artificial Sequence
  Synthetic oligonucleotide; TGGGGT chr11 5254409 5254428 5254425 +
cttgccatgtgccttgactt

SEQ ID NO: 58551 - DNA, 20 bp, Artificial Sequence
  Synthetic oligonucleotide; CTGGGT chr11 5254467 5254486 5254483 +
ccaaagctgtcaaagaacct

SEQ ID NO: 58552 - DNA, 20 bp, Artificial Sequence
  Synthetic oligonucleotide; ATGGGT chr11 5254475 5254494 5254491 +
gtcaaagaacctctgggtcc

SEQ ID NO: 58553 - DNA, 20 bp, Artificial Sequence
  Synthetic oligonucleotide; CAGGGT chr11 5254573 5254592 5254589 +
acctggacttttgccaggca

SEQ ID NO: 58554 - DNA, 20 bp, Artificial Sequence
  Synthetic oligonucleotide; CAGGGT chr11 5254622 5254641 5254638 +
gtcaccagagcctaccttcc

SEQ ID NO: 58555 - DNA, 20 bp, Artificial Sequence
  Synthetic oligonucleotide; GCGAGT chr11 5254754 5254773 5254770 +
taacctcagacgttccagaa

SEQ ID NO: 58556 - DNA, 20 bp, Artificial Sequence
  Synthetic oligonucleotide; AAGGGT chr11 5254774 5254793 5254790 +
gcgagtgtgtggaactgctg

SEQ ID NO: 58557 - DNA, 20 bp, Artificial Sequence
  Synthetic oligonucleotide; CTGGAT chr11 5254828 5254847 5254844 +
gccgccggcccctggcctca

SEQ ID NO: 58558 - DNA, 20 bp, Artificial Sequence
  Synthetic oligonucleotide; ATGGGT chr11 5254899 5254918 5254915 +
aaggcaaggctggccaaccc

SEQ ID NO: 58559 - DNA, 20 bp, Artificial Sequence
  Synthetic oligonucleotide; TGGAGT chr11 5254904 5254923 5254920 +
aaggctggccaacccatggg

SEQ ID NO: 58560 - DNA, 20 bp, Artificial Sequence
  Synthetic oligonucleotide; GAGGAT chr11 5254972 5254991 5254988 +
tgtggggaaggggcccccaa

SEQ ID NO: 58561 - DNA, 20 bp, Artificial Sequence
  Synthetic oligonucleotide; AGGGAT chr11 5255189 5255208 5255205 +
taccaatttttgaaaagttc

SEQ ID NO: 58562 - DNA, 20 bp, Artificial Sequence
  Synthetic oligonucleotide; CAGGAT chr11 5255221 5255240 5255237 +
atgtgttttaggcataggtc

SEQ ID NO: 58563 - DNA, 20 bp, Artificial Sequence
  Synthetic oligonucleotide; TTGAAT chr11 5255297 5255316 5255313 +
aagaagtgctatacttatct

SEQ ID NO: 58564 - DNA, 20 bp, Artificial Sequence
  Synthetic oligonucleotide; AGGAAT chr11 5255385 5255404 5255401 +
taaagcaacagtttcagtgc

SEQ ID NO: 58565 - DNA, 20 bp, Artificial Sequence
  Synthetic oligonucleotide; CTGAAT chr11 5255420 5255439 5255436 +
ttatgtaatataatataaga

SEQ ID NO: 58566 - DNA, 20 bp, Artificial Sequence
  Synthetic oligonucleotide; CTGGAT chr11 5255548 5255567 5255564 +
ccgatgatgtgtatttatca

SEQ ID NO: 58567 - DNA, 20 bp, Artificial Sequence
  Synthetic oligonucleotide; CAGGGT chr11 5255578 5255597 5255594 +
gtatgtgctggctgatgacc

SEQ ID NO: 58568 - DNA, 20 bp, Artificial Sequence
  Synthetic oligonucleotide; TAGAAT chr11 5255621 5255640 5255637 +
atgctcggtaaagatgatgg

SEQ ID NO: 58569 - DNA, 20 bp, Artificial Sequence
  Synthetic oligonucleotide; ATGGAT chr11 5255644 5255663 5255660 +
aatgctctttaccagatact

SEQ ID NO: 58570 - DNA, 20 bp, Artificial Sequence
  Synthetic oligonucleotide; TAGAAT chr11 5255650 5255669 5255666 +
ctttaccagatactatggat

SEQ ID NO: 58571 - DNA, 20 bp, Artificial Sequence
  Synthetic oligonucleotide; GGGAAT chr11 5255691 5255710 5255707 +
aatgctaggttcacttctta

SEQ ID NO: 58572 - DNA, 20 bp, Artificial Sequence
  Synthetic oligonucleotide; TGGGAT chr11 5255792 5255811 5255808 +
agtccacacactgtgacagc

SEQ ID NO: 58573 - DNA, 20 bp, Artificial Sequence
  Synthetic oligonucleotide; TGGGAT chr11 5255906 5255925 5255922 +
ttttttctttattttttctt

SEQ ID NO: 58574 - DNA, 20 bp, Artificial Sequence
  Synthetic oligonucleotide; AGGAAT chr11 5256054 5256073 5256070 +
ccctaacctatcaggttgat

SEQ ID NO: 58575 - DNA, 20 bp, Artificial Sequence
  Synthetic oligonucleotide; TGGAAT chr11 5256074 5256093 5256090 +
aggaattataataatattgg

SEQ ID NO: 58576 - DNA, 20 bp, Artificial Sequence
  Synthetic oligonucleotide; TTGAAT chr11 5256218 5256237 5256234 +
tttggaagttaaaataaaag

SEQ ID NO: 58577 - DNA, 20 bp, Artificial Sequence
  Synthetic oligonucleotide; AAGGAT chr11 5256304 5256323 5256320 +
taagtgacttctctcaatct

SEQ ID NO: 58578 - DNA, 20 bp, Artificial Sequence
  Synthetic oligonucleotide; ATGGGT chr11 5256308 5256327 5256324 +
tgacttctctcaatctaagg

SEQ ID NO: 58579 - DNA, 20 bp, Artificial Sequence
  Synthetic oligonucleotide; TAGGGT chr11 5256372 5256391 5256388 +
agactgaggtgaacccaaat

SEQ ID NO: 58580 - DNA, 20 bp, Artificial Sequence
  Synthetic oligonucleotide; GGGGAT chr11 5256390 5256409 5256406 +
attagggtctctttaagata

SEQ ID NO: 58581 - DNA, 20 bp, Artificial Sequence
  Synthetic oligonucleotide; ATGGGT chr11 5256403 5256422 5256419 +
taagataggggatctgtgag

SEQ ID NO: 58582 - DNA, 20 bp, Artificial Sequence
  Synthetic oligonucleotide; GAGAGT chr11 5256433 5256452 5256449 +
atagatctttggccatatct

SEQ ID NO: 58583 - DNA, 20 bp, Artificial Sequence
  Synthetic oligonucleotide; TTGGGT chr11 5256443 5256462 5256459 +
ggccatatctgagagtctgg

SEQ ID NO: 58584 - DNA, 20 bp, Artificial Sequence
  Synthetic oligonucleotide; AAGAAT chr11 5256472 5256491 5256488 +
atttgtagagcctgaccttt

SEQ ID NO: 58585 - DNA, 20 bp, Artificial Sequence
  Synthetic oligonucleotide; GTGAAT chr11 5256519 5256538 5256535 +
gcccgctaaggcctaaacaa

SEQ ID NO: 58586 - DNA, 20 bp, Artificial Sequence
  Synthetic oligonucleotide; TTGAAT chr11 5256528 5256547 5256544 +
ggcctaaacaagtgaatctt

SEQ ID NO: 58587 - DNA, 20 bp, Artificial Sequence
  Synthetic oligonucleotide; CAGAGT chr11 5256555 5256574 5256571 +
tctcttttttttttttgaga

SEQ ID NO: 58588 - DNA, 20 bp, Artificial Sequence
  Synthetic oligonucleotide; TGGAGT chr11 5256580 5256599 5256596 +
tcttgttctgtcacccaggc

SEQ ID NO: 58589 - DNA, 20 bp, Artificial Sequence
  Synthetic oligonucleotide; TGGGAT chr11 5256665 5256684 5256681 +
tcctcagcctcccaagtagc

SEQ ID NO: 58590 - DNA, 20 bp, Artificial Sequence
  Synthetic oligonucleotide; TGGGAT chr11 5256720 5256739 5256736 +
tttttgtatttttgtagaga

SEQ ID NO: 58591 - DNA, 20 bp, Artificial Sequence
  Synthetic oligonucleotide; TGGGAT chr11 5256799 5256818 5256815 +
gccttggcctcccaaaattc

SEQ ID NO: 58592 - DNA, 20 bp, Artificial Sequence
  Synthetic oligonucleotide; GTGAAT chr11 5256841 5256860 5256857 +
cactcccagcctctaaacaa

SEQ ID NO: 58593 - DNA, 20 bp, Artificial Sequence
  Synthetic oligonucleotide; AGGAAT chr11 5256870 5256889 5256886 +
aattgctcctcctcagacta

SEQ ID NO: 58594 - DNA, 20 bp, Artificial Sequence
  Synthetic oligonucleotide; TAGGAT chr11 5256879 5256898 5256895 +
tcctcagactaaggaatatc

SEQ ID NO: 58595 - DNA, 20 bp, Artificial Sequence
  Synthetic oligonucleotide; AAGAGT chr11 5256993 5257012 5257009 +
cttttgaggcaatatctttt

SEQ ID NO: 58596 - DNA, 20 bp, Artificial Sequence
  Synthetic oligonucleotide; GAGAAT chr11 5257224 5257243 5257240 +
catttaagttaaataagtca

SEQ ID NO: 58597 - DNA, 20 bp, Artificial Sequence
  Synthetic oligonucleotide; AAGAAT chr11 5257322 5257341 5257338 +
aatttcagatattattaact

SEQ ID NO: 58598 - DNA, 20 bp, Artificial Sequence
  Synthetic oligonucleotide; AGGAAT chr11 5257370 5257389 5257386 +
aacagaggcaaaatgacaga

SEQ ID NO: 58599 - DNA, 20 bp, Artificial Sequence
  Synthetic oligonucleotide; GAGAGT chr11 5257469 5257488 5257485 +
aacaaactcctgctgtgcca

SEQ ID NO: 58600 - DNA, 20 bp, Artificial Sequence
  Synthetic oligonucleotide; GAGAAT chr11 5257510 5257529 5257526 +
tgccgttgatatgtaaagtg

SEQ ID NO: 58601 - DNA, 20 bp, Artificial Sequence
  Synthetic oligonucleotide; GGGAGT chr11 5257577 5257596 5257593 +
taaacttgtcctcagtggta

SEQ ID NO: 58602 - DNA, 20 bp, Artificial Sequence
  Synthetic oligonucleotide; TAGAAT chr11 5257595 5257614 5257611 +
tagggagtgagaagccatta

SEQ ID NO: 58603 - DNA, 20 bp, Artificial Sequence
  Synthetic oligonucleotide; CTGGAT chr11 5257647 5257666 5257663 +
taagcaacctgtactattgg

SEQ ID NO: 58604 - DNA, 20 bp, Artificial Sequence
  Synthetic oligonucleotide; AAGAAT chr11 5257662 5257681 5257678 +
attggctggattactattct

SEQ ID NO: 58605 - DNA, 20 bp, Artificial Sequence
  Synthetic oligonucleotide; ATGAAT chr11 5257790 5257809 5257806 +
tgtgtgtgtgtgtattcatt

SEQ ID NO: 58606 - DNA, 20 bp, Artificial Sequence
  Synthetic oligonucleotide; TTGAAT chr11 5257816 5257835 5257832 +
ttgctttcaattaagttatc

SEQ ID NO: 58607 - DNA, 20 bp, Artificial Sequence
  Synthetic oligonucleotide; AGGGGT chr11 5257854 5257873 5257870 +
aatctagatatagctcccta

SEQ ID NO: 58608 - DNA, 20 bp, Artificial Sequence
  Synthetic oligonucleotide; AAGAGT chr11 5257861 5257880 5257877 +
atatagctccctaaggggta

SEQ ID NO: 58609 - DNA, 20 bp, Artificial Sequence
  Synthetic oligonucleotide; GAGGGT chr11 5257999 5258018 5258015 +
tgcatattaccgacaaatta

SEQ ID NO: 58610 - DNA, 20 bp, Artificial Sequence
  Synthetic oligonucleotide; TCGGAT chr11 5258047 5258066 5258063 +
aagtacattgcagctcccac

SEQ ID NO: 58611 - DNA, 20 bp, Artificial Sequence
  Synthetic oligonucleotide; AGGAAT chr11 5258082 5258101 5258098 +
agcatgtgaagtctcccatc

SEQ ID NO: 58612 - DNA, 20 bp, Artificial Sequence
  Synthetic oligonucleotide; GTGAGT chr11 5258198 5258217 5258214 +
cgggaaacaccccaaatatt

SEQ ID NO: 58613 - DNA, 20 bp, Artificial Sequence
  Synthetic oligonucleotide; CTGAGT chr11 5258313 5258332 5258329 +
gattctgaccttacctggag

SEQ ID NO: 58614 - DNA, 20 bp, Artificial Sequence
  Synthetic oligonucleotide; AGGGGT chr11 5258344 5258363 5258360 +
tagagggccaagcaaaatac

SEQ ID NO: 58615 - DNA, 20 bp, Artificial Sequence
  Synthetic oligonucleotide; CTGGGT chr11 5258383 5258402 5258399 +
ggaaaagccctgtgggctct

SEQ ID NO: 58616 - DNA, 20 bp, Artificial Sequence
  Synthetic oligonucleotide; AGGGGT chr11 5258420 5258439 5258436 +
ccatttctgccttgcctcac

SEQ ID NO: 58617 - DNA, 20 bp, Artificial Sequence
  Synthetic oligonucleotide; GGGGGT chr11 5258513 5258532 5258529 +
atctaggggctgggcagtgg

SEQ ID NO: 58618 - DNA, 20 bp, Artificial Sequence
  Synthetic oligonucleotide; ATGAAT chr11 5258531 5258550 5258547 +
gggggggttggtggggggac

SEQ ID NO: 58619 - DNA, 20 bp, Artificial Sequence
  Synthetic oligonucleotide; GAGGGT chr11 5258663 5258682 5258679 +
gattcggtgctgttgcgggg

SEQ ID NO: 58620 - DNA, 20 bp, Artificial Sequence
  Synthetic oligonucleotide; TTGAGT chr11 5258694 5258713 5258710 +
ctggaagtgagaccaacctt

SEQ ID NO: 58621 - DNA, 20 bp, Artificial Sequence
  Synthetic oligonucleotide; GGGAGT chr11 5258958 5258977 5258974 +
gacaaagggcatatattctt

SEQ ID NO: 58622 - DNA, 20 bp, Artificial Sequence
  Synthetic oligonucleotide; TAGGGT chr11 5258966 5258985 5258982 +
gcatatattcttgggagttc

SEQ ID NO: 58623 - DNA, 20 bp, Artificial Sequence
  Synthetic oligonucleotide; CAGAGT chr11 5259099 5259118 5259115 +
accaaaagtaaggaccctca

SEQ ID NO: 58624 - DNA, 20 bp, Artificial Sequence
  Synthetic oligonucleotide; TGGAGT chr11 5259216 5259235 5259232 +
gacaaaccccagtaccagcc

SEQ ID NO: 58625 - DNA, 20 bp, Artificial Sequence
  Synthetic oligonucleotide; ATGGGT chr11 5259234 5259253 5259250 +
cctggagtctggtagacctg

SEQ ID NO: 58626 - DNA, 20 bp, Artificial Sequence
  Synthetic oligonucleotide; ATGGAT chr11 5259683 5259702 5259699 +
attcaaaacttcaggaaaca

SEQ ID NO: 58627 - DNA, 20 bp, Artificial Sequence
  Synthetic oligonucleotide; ATGAAT chr11 5259687 5259706 5259703 +
aaaacttcaggaaacaatgg

SEQ ID NO: 58628 - DNA, 20 bp, Artificial Sequence
  Synthetic oligonucleotide; ATGGAT chr11 5259691 5259710 5259707 +
cttcaggaaacaatggatga

SEQ ID NO: 58629 - DNA, 20 bp, Artificial Sequence
  Synthetic oligonucleotide; TAGAAT chr11 5259738 5259757 5259754 +
gctctagaaagtctcagcaa

SEQ ID NO: 58630 - DNA, 20 bp, Artificial Sequence
  Synthetic oligonucleotide; TTGAAT chr11 5259781 5259800 5259797 +
agagcttgaagacaaagttt

SEQ ID NO: 58631 - DNA, 20 bp, Artificial Sequence
  Synthetic oligonucleotide; AAGAAT chr11 5259815 5259834 5259831 +
tccaacaaagacaaagaaaa

SEQ ID NO: 58632 - DNA, 20 bp, Artificial Sequence
  Synthetic oligonucleotide; TGGGAT chr11 5259852 5259871 5259868 +
aacaaagcctccaagaaatc

SEQ ID NO: 58633 - DNA, 20 bp, Artificial Sequence
  Synthetic oligonucleotide; AAGAAT chr11 5259878 5259897 5259894 +
tatgttaaacaatcaaacct

SEQ ID NO: 58634 - DNA, 20 bp, Artificial Sequence
  Synthetic oligonucleotide; CAGAGT chr11 5260058 5260077 5260074 +
ttgcctaggtacattgtcat

SEQ ID NO: 58635 - DNA, 20 bp, Artificial Sequence
  Synthetic oligonucleotide; GAGAAT chr11 5260087 5260106 5260103 +
caaagttatctaaagacaaa

SEQ ID NO: 58636 - DNA, 20 bp, Artificial Sequence
  Synthetic oligonucleotide; GTGAAT chr11 5260188 5260207 5260204 +
agaaaccgtaaaagctagaa

SEQ ID NO: 58637 - DNA, 20 bp, Artificial Sequence
  Synthetic oligonucleotide; AAGAAT chr11 5260237 5260256 5260253 +
aaacaaaacaattatcagcc

SEQ ID NO: 58638 - DNA, 20 bp, Artificial Sequence
  Synthetic oligonucleotide; GAGAAT chr11 5260314 5260333 5260330 +
ttcagaaaaacaaatgctga

SEQ ID NO: 58639 - DNA, 20 bp, Artificial Sequence
  Synthetic oligonucleotide; AAGAAT chr11 5260483 5260502 5260499 +
cacaggcaacaaataccacg

SEQ ID NO: 58640 - DNA, 20 bp, Artificial Sequence
  Synthetic oligonucleotide; TGGAAT chr11 5260488 5260507 5260504 +
gcaacaaataccacgaagaa

SEQ ID NO: 58641 - DNA, 20 bp, Artificial Sequence
  Synthetic oligonucleotide; TTGAAT chr11 5260519 5260538 5260535 +
ctcacacctcaatactgatg

SEQ ID NO: 58642 - DNA, 20 bp, Artificial Sequence
  Synthetic oligonucleotide; CAGAAT chr11 5260557 5260576 5260573 +
aatgctccacttaaaagata

SEQ ID NO: 58643 - DNA, 20 bp, Artificial Sequence
  Synthetic oligonucleotide; CAGAAT chr11 5260565 5260584 5260581 +
acttaaaagatacagaattg

SEQ ID NO: 58644 - DNA, 20 bp, Artificial Sequence
  Synthetic oligonucleotide; ATGAAT chr11 5260569 5260588 5260585 +
aaaagatacagaattgcaga

SEQ ID NO: 58645 - DNA, 20 bp, Artificial Sequence
  Synthetic oligonucleotide; AAGAAT chr11 5260575 5260594 5260591 +
tacagaattgcagaatgaat

SEQ ID NO: 58646 - DNA, 20 bp, Artificial Sequence
  Synthetic oligonucleotide; AGGGGT chr11 5260652 5260671 5260668 +
ctcacataaacttaaggtaa

SEQ ID NO: 58647 - DNA, 20 bp, Artificial Sequence
  Synthetic oligonucleotide; GAGAAT chr11 5260801 5260820 5260817 +
taaaagcccttgtccaatgg

SEQ ID NO: 58648 - DNA, 20 bp, Artificial Sequence
  Synthetic oligonucleotide; ATGGAT chr11 5260961 5260980 5260977 +
agacagtctacaaagaaaca

SEQ ID NO: 58649 - DNA, 20 bp, Artificial Sequence
  Synthetic oligonucleotide; CAGAAT chr11 5261021 5261040 5261037 +
gacattctacccaacaactg

SEQ ID NO: 58650 - DNA, 20 bp, Artificial Sequence
  Synthetic oligonucleotide; TAGAAT chr11 5261148 5261167 5261164 +
agcactctctcagaccacag

SEQ ID NO: 58651 - DNA, 20 bp, Artificial Sequence
  Synthetic oligonucleotide; CTGAAT chr11 5261224 5261243 5261240 +
ggaaattaaataacctgctc

SEQ ID NO: 58652 - DNA, 20 bp, Artificial Sequence
  Synthetic oligonucleotide; TTGGGT chr11 5261235 5261254 5261251 +
aacctgctcctgaatgatca

SEQ ID NO: 58653 - DNA, 20 bp, Artificial Sequence
  Synthetic oligonucleotide; AAGGAT chr11 5261300 5261319 5261316 +
tttgaaaaccggcacaagac

SEQ ID NO: 58654 - DNA, 20 bp, Artificial Sequence
  Synthetic oligonucleotide; ATGGGT chr11 5261579 5261598 5261595 +
gacaagcagagagccaaatc

SEQ ID NO: 58655 - DNA, 20 bp, Artificial Sequence
  Synthetic oligonucleotide; GAGAAT chr11 5261611 5261630 5261627 +
ccattcacaattgctgcaaa

SEQ ID NO: 58656 - DNA, 20 bp, Artificial Sequence
  Synthetic oligonucleotide; AGGGAT chr11 5261647 5261666 5261663 +
acctagaaatacaacttcta

SEQ ID NO: 58657 - DNA, 20 bp, Artificial Sequence
  Synthetic oligonucleotide; AAGAAT chr11 5261752 5261771 5261768 +
attccatgctcatagataga

SEQ ID NO: 58658 - DNA, 20 bp, Artificial Sequence
  Synthetic oligonucleotide; AAGAAT chr11 5261841 5261860 5261857 +
gctaccactgacttttttca

SEQ ID NO: 58659 - DNA, 20 bp, Artificial Sequence
  Synthetic oligonucleotide; TGGAAT chr11 5261873 5261892 5261889 +
aaactactttaaatgtcata

SEQ ID NO: 58660 - DNA, 20 bp, Artificial Sequence
  Synthetic oligonucleotide; AAGAAT chr11 5262106 5262125 5262122 +
catcacaaaagcaatggaga

SEQ ID NO: 58661 - DNA, 20 bp, Artificial Sequence
  Synthetic oligonucleotide; GTGGAT chr11 5262210 5262229 5262226 +
tatacaaaaattaactcaag

SEQ ID NO: 58662 - DNA, 20 bp, Artificial Sequence
  Synthetic oligonucleotide; TGGGAT chr11 5262354 5262373 5262370 +
caaaggccaaaattgacata

SEQ ID NO: 58663 - DNA, 20 bp, Artificial Sequence
  Synthetic oligonucleotide; CAGAGT chr11 5262402 5262421 5262418 +
gcacagcaaaagactatcat

SEQ ID NO: 58664 - DNA, 20 bp, Artificial Sequence
  Synthetic oligonucleotide; CAGAAT chr11 5262422 5262441 5262438 +
cagagtgaacaggcaaccta

SEQ ID NO: 58665 - DNA, 20 bp, Artificial Sequence
  Synthetic oligonucleotide; AAGGAT chr11 5262541 5262560 5262557 +
accccatcaaaaagtggaca

SEQ ID NO: 58666 - DNA, 20 bp, Artificial Sequence
  Synthetic oligonucleotide; TAGAAT chr11 5262672 5262691 5262688 +
agataccatctcatgccagt

SEQ ID NO: 58667 - DNA, 20 bp, Artificial Sequence
  Synthetic oligonucleotide; GAGGAT chr11 5262716 5262735 5262732 +
aggaaacaaaaggtgctgga

SEQ ID NO: 58668 - DNA, 20 bp, Artificial Sequence
  Synthetic oligonucleotide; AAGAAT chr11 5262726 5262745 5262742 +
aggtgctggagaggatgtgg

SEQ ID NO: 58669 - DNA, 20 bp, Artificial Sequence
  Synthetic oligonucleotide; ATGGGT chr11 5262753 5262772 5262769 +
ggaaaaattttacactgttg

SEQ ID NO: 58670 - DNA, 20 bp, Artificial Sequence
  Synthetic oligonucleotide; AAGGAT chr11 5262805 5262824 5262821 +
agacagtgtggcgattcctc

SEQ ID NO: 58671 - DNA, 20 bp, Artificial Sequence
  Synthetic oligonucleotide; CTGGGT chr11 5262850 5262869 5262866 +
ttgacccagcaatcccatta

SEQ ID NO: 58672 - DNA, 20 bp, Artificial Sequence
  Synthetic oligonucleotide; AAGAAT chr11 5262865 5262884 5262881 +
cattactgggtatataccca

SEQ ID NO: 58673 - DNA, 20 bp, Artificial Sequence
  Synthetic oligonucleotide; ATGGAT chr11 5262975 5262994 5262991 +
aaatggccatcagcgatata

SEQ ID NO: 58674 - DNA, 20 bp, Artificial Sequence
  Synthetic oligonucleotide; TGGAAT chr11 5263007 5263026 5263023 +
aatgtggcacatatacacca

SEQ ID NO: 58675 - DNA, 20 bp, Artificial Sequence
  Synthetic oligonucleotide; ATGAGT chr11 5263033 5263052 5263049 +
actatgcagccataaaaatg

SEQ ID NO: 58676 - DNA, 20 bp, Artificial Sequence
  Synthetic oligonucleotide; ATGGAT chr11 5263057 5263076 5263073 +
gttcatgtctttgcagggac

SEQ ID NO: 58677 - DNA, 20 bp, Artificial Sequence
  Synthetic oligonucleotide; GGGAGT chr11 5263140 5263159 5263156 +
acacgttctcactcataagt

SEQ ID NO: 58678 - DNA, 20 bp, Artificial Sequence
  Synthetic oligonucleotide; GGGGGT chr11 5263203 5263222 5263219 +
tcacacaccagggcctgtcg

SEQ ID NO: 58679 - DNA, 20 bp, Artificial Sequence
  Synthetic oligonucleotide; GGGGGT chr11 5263211 5263230 5263227 +
cagggcctgtcggggggtga

SEQ ID NO: 58680 - DNA, 20 bp, Artificial Sequence
  Synthetic oligonucleotide; AGGGAT chr11 5263223 5263242 5263239 +
gggggtgagggggttaggag

SEQ ID NO: 58681 - DNA, 20 bp, Artificial Sequence
  Synthetic oligonucleotide; ATGGGT chr11 5263266 5263285 5263282 +
ctaatgtagatgacaggttg

SEQ ID NO: 58682 - DNA, 20 bp, Artificial Sequence
  Synthetic oligonucleotide; TAGGAT chr11 5263412 5263431 5263428 +
acacaacctatcaaaacctc

SEQ ID NO: 58683 - DNA, 20 bp, Artificial Sequence
  Synthetic oligonucleotide; AAGAGT chr11 5263470 5263489 5263486 +
agccctaaatgtcgatgtca

SEQ ID NO: 58684 - DNA, 20 bp, Artificial Sequence
  Synthetic oligonucleotide; GGGAAT chr11 5263564 5263583 5263580 +
ccaaaacccagcaaaagaaa

SEQ ID NO: 58685 - DNA, 20 bp, Artificial Sequence
  Synthetic oligonucleotide; TCGAAT chr11 5263840 5263859 5263856 +
agaaaacctaaaggagacgt

SEQ ID NO: 58686 - DNA, 20 bp, Artificial Sequence
  Synthetic oligonucleotide; AAGAAT chr11 5263881 5263900 5263897 +
gggctctagcttaagtcagg

SEQ ID NO: 58687 - DNA, 20 bp, Artificial Sequence
  Synthetic oligonucleotide; CTGAAT chr11 5263983 5264002 5263999 +
aggaccagatagattcacag

SEQ ID NO: 58688 - DNA, 20 bp, Artificial Sequence
  Synthetic oligonucleotide; AAGAAT chr11 5264007 5264026 5264023 +
attctaccagacattcaaag

SEQ ID NO: 58689 - DNA, 20 bp, Artificial Sequence
  Synthetic oligonucleotide; GAGAAT chr11 5264056 5264075 5264072 +
ttctacaagatagagaaaga

SEQ ID NO: 58690 - DNA, 20 bp, Artificial Sequence
  Synthetic oligonucleotide; GTGGGT chr11 5264234 5264253 5264250 +
atatcaaaacccatgatcaa

SEQ ID NO: 58691 - DNA, 20 bp, Artificial Sequence
  Synthetic oligonucleotide; AGGGAT chr11 5264248 5264267 5264264 +
gatcaagtgggtttcatgcg

SEQ ID NO: 58692 - DNA, 20 bp, Artificial Sequence
  Synthetic oligonucleotide; ACGGAT chr11 5264256 5264275 5264272 +
gggtttcatgcgagggatgc

SEQ ID NO: 58693 - DNA, 20 bp, Artificial Sequence
  Synthetic oligonucleotide; GAGAAT chr11 5264305 5264324 5264321 +
agtgtgatacacaacataaa

SEQ ID NO: 58694 - DNA, 20 bp, Artificial Sequence
  Synthetic oligonucleotide; TTGAAT chr11 5264469 5264488 5264485 +
aacacacagccaacattata

SEQ ID NO: 58695 - DNA, 20 bp, Artificial Sequence
  Synthetic oligonucleotide; TGGAAT chr11 5264507 5264526 5264523 +
aaagcattctgtctgaaaac

SEQ ID NO: 58696 - DNA, 20 bp, Artificial Sequence
  Synthetic oligonucleotide; AAGGAT chr11 5264518 5264537 5264534 +
tctgaaaactggaatgagac

SEQ ID NO: 58697 - DNA, 20 bp, Artificial Sequence
  Synthetic oligonucleotide; CTGGAT chr11 5264727 5264746 5264743 +
aaaataattcagcaaagttt

SEQ ID NO: 58698 - DNA, 20 bp, Artificial Sequence
  Synthetic oligonucleotide; ATGAGT chr11 5264752 5264771 5264768 +
tacaaaattaacgtacacca

SEQ ID NO: 58699 - DNA, 20 bp, Artificial Sequence
  Synthetic oligonucleotide; GAGAAT chr11 5264789 5264808 5264805 +
ataccagcaatgaccaagct

SEQ ID NO: 58700 - DNA, 20 bp, Artificial Sequence
  Synthetic oligonucleotide; AGGAAT chr11 5264860 5264879 5264876 +
acaaaacaaaacaaaaactt

SEQ ID NO: 58701 - DNA, 20 bp, Artificial Sequence
  Synthetic oligonucleotide; ATGGGT chr11 5264974 5264993 5264990 +
aacacatgccattctcatag

SEQ ID NO: 58702 - DNA, 20 bp, Artificial Sequence
  Synthetic oligonucleotide; TAGAAT chr11 5264979 5264998 5264995 +
atgccattctcatagatggg

SEQ ID NO: 58703 - DNA, 20 bp, Artificial Sequence
  Synthetic oligonucleotide; CAGAAT chr11 5265252 5265271 5265268 +
aggcacatcgaccaatggaa

SEQ ID NO: 58704 - DNA, 20 bp, Artificial Sequence
  Synthetic oligonucleotide; GGGGAT chr11 5265361 5265380 5265377 +
ccctattcaacaaatggtgc

SEQ ID NO: 58705 - DNA, 20 bp, Artificial Sequence
  Synthetic oligonucleotide; GAGAAT chr11 5265387 5265406 5265403 +
agctggcaagctacatgtag

SEQ ID NO: 58706 - DNA, 20 bp, Artificial Sequence
  Synthetic oligonucleotide; CTGGAT chr11 5265397 5265416 5265413 +
ctacatgtaggagaatgaaa

SEQ ID NO: 58707 - DNA, 20 bp, Artificial Sequence
  Synthetic oligonucleotide; ATGGAT chr11 5265438 5265457 5265454 +
tatacaaaaatcaactcaag

SEQ ID NO: 58708 - DNA, 20 bp, Artificial Sequence
  Synthetic oligonucleotide; AAGGAT chr11 5265526 5265545 5265542 +
ttctacacattggcttagga

SEQ ID NO: 58709 - DNA, 20 bp, Artificial Sequence
  Synthetic oligonucleotide; AAGAGT chr11 5265622 5265641 5265638 +
agcttttgcatggcaaaagg

SEQ ID NO: 58710 - DNA, 20 bp, Artificial Sequence
  Synthetic oligonucleotide; CAGAAT chr11 5265631 5265650 5265647 +
atggcaaaaggaagagtctg

SEQ ID NO: 58711 - DNA, 20 bp, Artificial Sequence
  Synthetic oligonucleotide; CAGAGT chr11 5265651 5265670 5265667 +
cagaataaacagacaaccca

SEQ ID NO: 58712 - DNA, 20 bp, Artificial Sequence
  Synthetic oligonucleotide; AAGAAT chr11 5265691 5265710 5265707 +
acaatctatacatctgacaa

SEQ ID NO: 58713 - DNA, 20 bp, Artificial Sequence
  Synthetic oligonucleotide; GAGGAT chr11 5265946 5265965 5265962 +
aaaaaataacagatccttgt

SEQ ID NO: 58714 - DNA, 20 bp, Artificial Sequence
  Synthetic oligonucleotide; GGGAAT chr11 5265989 5266008 5266005 +
ctttcttacacactgttggt

SEQ ID NO: 58715 - DNA, 20 bp, Artificial Sequence
  Synthetic oligonucleotide; TGGGAT chr11 5266176 5266195 5266192 +
tattcacaatagttaaggtt

SEQ ID NO: 58716 - DNA, 20 bp, Artificial Sequence
  Synthetic oligonucleotide; ACGGAT chr11 5266208 5266227 5266224 +
aagtgtctatcaacagatga

SEQ ID NO: 58717 - DNA, 20 bp, Artificial Sequence
  Synthetic oligonucleotide; AAGAAT chr11 5266255 5266274 5266271 +
agtactattttgccatgaaa

SEQ ID NO: 58718 - DNA, 20 bp, Artificial Sequence
  Synthetic oligonucleotide; ATGGAT chr11 5266284 5266303 5266300 +
atcttgtcatttgtagcaac

SEQ ID NO: 58719 - DNA, 20 bp, Artificial Sequence
  Synthetic oligonucleotide; GTGGGT chr11 5266435 5266454 5266451 +
catctgtgggagctaaaaaa

SEQ ID NO: 58720 - DNA, 20 bp, Artificial Sequence
  Synthetic oligonucleotide; GAGAGT chr11 5266453 5266472 5266469 +
aagtgggtctcatggtggta

SEQ ID NO: 58721 - DNA, 20 bp, Artificial Sequence
  Synthetic oligonucleotide; TAGAAT chr11 5266458 5266477 5266474 +
ggtctcatggtggtagagag

SEQ ID NO: 58722 - DNA, 20 bp, Artificial Sequence
  Synthetic oligonucleotide; GTGAGT chr11 5266490 5266509 5266506 +
tatcagaggctggaaaaagt

SEQ ID NO: 58723 - DNA, 20 bp, Artificial Sequence
  Synthetic oligonucleotide; GGGGAT chr11 5266506 5266525 5266522 +
aagtgtgagtgtgtatggga

SEQ ID NO: 58724 - DNA, 20 bp, Artificial Sequence
  Synthetic oligonucleotide; TTGGAT chr11 5266545 5266564 5266561 +
gttaataggtacaaacacag

SEQ ID NO: 58725 - DNA, 20 bp, Artificial Sequence
  Synthetic oligonucleotide; AAGGAT chr11 5266553 5266572 5266569 +
gtacaaacacagttggatag

SEQ ID NO: 58726 - DNA, 20 bp, Artificial Sequence
  Synthetic oligonucleotide; TTGAGT chr11 5266579 5266598 5266595 +
taagccataatgtttgatat

SEQ ID NO: 58727 - DNA, 20 bp, Artificial Sequence
  Synthetic oligonucleotide; TAGGGT chr11 5266584 5266603 5266600 +
cataatgtttgatatttgag

SEQ ID NO: 58728 - DNA, 20 bp, Artificial Sequence
  Synthetic oligonucleotide; GAGGAT chr11 5266638 5266657 5266654 +
atttcaaaatggctagaaat

SEQ ID NO: 58729 - DNA, 20 bp, Artificial Sequence
  Synthetic oligonucleotide; ATGGAT chr11 5266687 5266706 5266703 +
aatgataaatgctcaaagca

SEQ ID NO: 58730 - DNA, 20 bp, Artificial Sequence
  Synthetic oligonucleotide; ATGAAT chr11 5266832 5266851 5266848 +
aggtgaaaatatttagtgcc

SEQ ID NO: 58731 - DNA, 20 bp, Artificial Sequence
  Synthetic oligonucleotide; CTGGAT chr11 5266947 5266966 5266963 +
atttgtctctctcccatatt

SEQ ID NO: 58732 - DNA, 20 bp, Artificial Sequence
  Synthetic oligonucleotide; GAGAGT chr11 5267178 5267197 5267194 +
tccctctacccttcacacat

SEQ ID NO: 58733 - DNA, 20 bp, Artificial Sequence
  Synthetic oligonucleotide; TCGAAT chr11 5267282 5267301 5267298 +
ttctcatctcccacagtcag

SEQ ID NO: 58734 - DNA, 20 bp, Artificial Sequence
  Synthetic oligonucleotide; TTGGGT chr11 5267349 5267368 5267365 +
ccacagactcactgctcctc

SEQ ID NO: 58735 - DNA, 20 bp, Artificial Sequence
  Synthetic oligonucleotide; TTGAAT chr11 5267377 5267396 5267393 +
gaaccattgtatctgtcccc

SEQ ID NO: 58736 - DNA, 20 bp, Artificial Sequence
  Synthetic oligonucleotide; TTGAAT chr11 5267413 5267432 5267429 +
attttattttatctgcaaac

SEQ ID NO: 58737 - DNA, 20 bp, Artificial Sequence
  Synthetic oligonucleotide; CTGAGT chr11 5267466 5267485 5267482 +
ttttcccaaaatcttatttc

SEQ ID NO: 58738 - DNA, 20 bp, Artificial Sequence
  Synthetic oligonucleotide; TAGAAT chr11 5267649 5267668 5267665 +
aagccctagcttgctggttt

SEQ ID NO: 58739 - DNA, 20 bp, Artificial Sequence
  Synthetic oligonucleotide; TGGAAT chr11 5267824 5267843 5267840 +
tcagctaacccatgaaataa

SEQ ID NO: 58740 - DNA, 20 bp, Artificial Sequence
  Synthetic oligonucleotide; AAGAGT chr11 5267929 5267948 5267945 +
agctacttcaaaatgtaaat

SEQ ID NO: 58741 - DNA, 20 bp, Artificial Sequence
  Synthetic oligonucleotide; TTGGAT chr11 5267964 5267983 5267980 +
tagtaattctagcctatatc

SEQ ID NO: 58742 - DNA, 20 bp, Artificial Sequence
  Synthetic oligonucleotide; AGGAGT chr11 5268090 5268109 5268106 +
cggtgcagtaaaaactgcct

SEQ ID NO: 58743 - DNA, 20 bp, Artificial Sequence
  Synthetic oligonucleotide; TGGAAT chr11 5268162 5268181 5268178 +
ctccatcatatcatcctcct

SEQ ID NO: 58744 - DNA, 20 bp, Artificial Sequence
  Synthetic oligonucleotide; TGGAAT chr11 5268170 5268189 5268186 +
tatcatcctccttggaatcc

SEQ ID NO: 58745 - DNA, 20 bp, Artificial Sequence
  Synthetic oligonucleotide; AAGAGT chr11 5268293 5268312 5268309 +
acactttttccttttaacac

SEQ ID NO: 58746 - DNA, 20 bp, Artificial Sequence
  Synthetic oligonucleotide; GAGGGT chr11 5268405 5268424 5268421 +
ccagtccccatgtgcagaag

SEQ ID NO: 58747 - DNA, 20 bp, Artificial Sequence
  Synthetic oligonucleotide; CAGGGT chr11 5268413 5268432 5268429 +
catgtgcagaaggagggtgt

SEQ ID NO: 58748 - DNA, 20 bp, Artificial Sequence
  Synthetic oligonucleotide; AGGGGT chr11 5268518 5268537 5268534 +
tgccaggcagcctgcacttc

SEQ ID NO: 58749 - DNA, 20 bp, Artificial Sequence
  Synthetic oligonucleotide; GTGAGT chr11 5268539 5268558 5268555 +
ggggtgaactccttgccaaa

SEQ ID NO: 58750 - DNA, 20 bp, Artificial Sequence
  Synthetic oligonucleotide; CAGAAT chr11 5268548 5268567 5268564 +
tccttgccaaagtgagtagc

SEQ ID NO: 58751 - DNA, 20 bp, Artificial Sequence
  Synthetic oligonucleotide; TTGAGT chr11 5268613 5268632 5268629 +
caaaataacacacaggcatg

SEQ ID NO: 58752 - DNA, 20 bp, Artificial Sequence
  Synthetic oligonucleotide; TTGGGT chr11 5268834 5268853 5268850 +
tccccattttaccagtatta

SEQ ID NO: 58753 - DNA, 20 bp, Artificial Sequence
  Synthetic oligonucleotide; TAGAAT chr11 5268889 5268908 5268905 +
ttgtctaatttttgtaaatg

SEQ ID NO: 58754 - DNA, 20 bp, Artificial Sequence
  Synthetic oligonucleotide; GTGAGT chr11 5268895 5268914 5268911 +
aatttttgtaaatgtagaat

SEQ ID NO: 58755 - DNA, 20 bp, Artificial Sequence
  Synthetic oligonucleotide; AAGAGT chr11 5268906 5268925 5268922 +
atgtagaatgtgagtgctgc

SEQ ID NO: 58756 - DNA, 20 bp, Artificial Sequence
  Synthetic oligonucleotide; GGGAGT chr11 5268919 5268938 5268935 +
gtgctgcaagagttctcagc

SEQ ID NO: 58757 - DNA, 20 bp, Artificial Sequence
  Synthetic oligonucleotide; TGGGAT chr11 5269183 5269202 5269199 +
aattctataatacaattctc

SEQ ID NO: 58758 - DNA, 20 bp, Artificial Sequence
  Synthetic oligonucleotide; CTGAAT chr11 5269268 5269287 5269284 +
gtcctttactgtcactagtt

SEQ ID NO: 58759 - DNA, 20 bp, Artificial Sequence
  Synthetic oligonucleotide; CAGGAT chr11 5269445 5269464 5269461 +
tgaactcaccttgaagttct

SEQ ID NO: 58760 - DNA, 20 bp, Artificial Sequence
  Synthetic oligonucleotide; TGGGGT chr11 5269571 5269590 5269587 +
cttgccatgggccttgacct

SEQ ID NO: 58761 - DNA, 20 bp, Artificial Sequence
  Synthetic oligonucleotide; CAGGAT chr11 5269581 5269600 5269597 +
gccttgaccttggggttgcc

SEQ ID NO: 58762 - DNA, 20 bp, Artificial Sequence
  Synthetic oligonucleotide; CTGGGT chr11 5269629 5269648 5269645 +
ccaaagctgtcaaaaaatct

SEQ ID NO: 58763 - DNA, 20 bp, Artificial Sequence
  Synthetic oligonucleotide; AGGGGT chr11 5269637 5269656 5269653 +
gtcaaaaaatctctgggtcc

SEQ ID NO: 58764 - DNA, 20 bp, Artificial Sequence
  Synthetic oligonucleotide; AGGAGT chr11 5269651 5269670 5269667 +
gggtccaggggtaaacaacg

SEQ ID NO: 58765 - DNA, 20 bp, Artificial Sequence
  Synthetic oligonucleotide; TAGGGT chr11 5269730 5269749 5269746 +
gactttcccaatcaacttgc

SEQ ID NO: 58766 - DNA, 20 bp, Artificial Sequence
  Synthetic oligonucleotide; AGGGGT chr11 5270031 5270050 5270047 +
aaggctgacctgtgtccctc

SEQ ID NO: 58767 - DNA, 20 bp, Artificial Sequence
  Synthetic oligonucleotide; TGGAGT chr11 5270036 5270055 5270052 +
tgacctgtgtccctcagggg

SEQ ID NO: 58768 - DNA, 20 bp, Artificial Sequence
  Synthetic oligonucleotide; GAGGGT chr11 5270052 5270071 5270068 +
ggggtggagtcaggtccgga

SEQ ID NO: 58769 - DNA, 20 bp, Artificial Sequence
  Synthetic oligonucleotide; ATGGAT chr11 5270066 5270085 5270082 +
tccggagagggtcagcagtg

SEQ ID NO: 58770 - DNA, 20 bp, Artificial Sequence
  Synthetic oligonucleotide; CTGGAT chr11 5270098 5270117 5270114 +
taagtttgtgataatgtgtg

SEQ ID NO: 58771 - DNA, 20 bp, Artificial Sequence
  Synthetic oligonucleotide; CAGAAT chr11 5270357 5270376 5270373 +
agaaaataaagctgttaaaa

SEQ ID NO: 58772 - DNA, 20 bp, Artificial Sequence
  Synthetic oligonucleotide; AGGAGT chr11 5270386 5270405 5270402 +
acccagttctagctctctta

SEQ ID NO: 58773 - DNA, 20 bp, Artificial Sequence
  Synthetic oligonucleotide; CAGAAT chr11 5270469 5270488 5270485 +
agttccttctagaaactgaa

SEQ ID NO: 58774 - DNA, 20 bp, Artificial Sequence
  Synthetic oligonucleotide; TGGGGT chr11 5270526 5270545 5270542 +
aatcccaaagtacagtacct

SEQ ID NO: 58775 - DNA, 20 bp, Artificial Sequence
  Synthetic oligonucleotide; GAGAAT chr11 5270579 5270598 5270595 +
gattacatccagtgcttcca

SEQ ID NO: 58776 - DNA, 20 bp, Artificial Sequence
  Synthetic oligonucleotide; GTGAGT chr11 5270633 5270652 5270649 +
caggggacattggctacttt

SEQ ID NO: 58777 - DNA, 20 bp, Artificial Sequence
  Synthetic oligonucleotide; CAGAAT chr11 5270737 5270756 5270753 +
atcctaaaattatttaaagc

SEQ ID NO: 58778 - DNA, 20 bp, Artificial Sequence
  Synthetic oligonucleotide; GTGAAT chr11 5270765 5270784 5270781 +
gtcatcaaacagagaaaaaa

SEQ ID NO: 58779 - DNA, 20 bp, Artificial Sequence
  Synthetic oligonucleotide; AGGAGT chr11 5270789 5270808 5270805 +
atcgatatattaatcaggct

SEQ ID NO: 58780 - DNA, 20 bp, Artificial Sequence
  Synthetic oligonucleotide; CAGGGT chr11 5270795 5270814 5270811 +
atattaatcaggctaggagt

SEQ ID NO: 58781 - DNA, 20 bp, Artificial Sequence
  Synthetic oligonucleotide; TGGGAT chr11 5270892 5270911 5270908 +
gtagagctgaaactggaagt

SEQ ID NO: 58782 - DNA, 20 bp, Artificial Sequence
  Synthetic oligonucleotide; AAGAAT chr11 5270930 5270949 5270946 +
caattcgatccatgtgcctg

SEQ ID NO: 58783 - DNA, 20 bp, Artificial Sequence
  Synthetic oligonucleotide; TAGAAT chr11 5270997 5271016 5271013 +
ttgtcattatcctcatattt

SEQ ID NO: 58784 - DNA, 20 bp, Artificial Sequence
  Synthetic oligonucleotide; AGGAAT chr11 5271005 5271024 5271021 +
atcctcatattttagaatca

SEQ ID NO: 58785 - DNA, 20 bp, Artificial Sequence
  Synthetic oligonucleotide; GGGAAT chr11 5271060 5271079 5271076 +
gtgacagaagtaatgattgg

SEQ ID NO: 58786 - DNA, 20 bp, Artificial Sequence
  Synthetic oligonucleotide; CAGAGT chr11 5271074 5271093 5271090 +
gattgggggaataatagaag

SEQ ID NO: 58787 - DNA, 20 bp, Artificial Sequence
  Synthetic oligonucleotide; CGGAGT chr11 5271236 5271255 5271252 +
ttttttttttttttttgaga

SEQ ID NO: 58788 - DNA, 20 bp, Artificial Sequence
  Synthetic oligonucleotide; TGGAGT chr11 5271260 5271279 5271276 +
gtctcactctgttgccagac

SEQ ID NO: 58789 - DNA, 20 bp, Artificial Sequence
  Synthetic oligonucleotide; CTGGGT chr11 5271304 5271323 5271320 +
ctcactgcaaccttcgcctc

SEQ ID NO: 58790 - DNA, 20 bp, Artificial Sequence
  Synthetic oligonucleotide; CGGGAT chr11 5271401 5271420 5271417 +
ttttttatttttagtagaga

SEQ ID NO: 58791 - DNA, 20 bp, Artificial Sequence
  Synthetic oligonucleotide; CAGGAT chr11 5271421 5271440 5271437 +
cgggatttcaccatgtttgc

SEQ ID NO: 58792 - DNA, 20 bp, Artificial Sequence
  Synthetic oligonucleotide; AGGAAT chr11 5271528 5271547 5271544 +
ccccttgccccaccagatct

SEQ ID NO: 58793 - DNA, 20 bp, Artificial Sequence
  Synthetic oligonucleotide; GGGGAT chr11 5271630 5271649 5271646 +
ctcccaagtcaagtgccttt

SEQ ID NO: 58794 - DNA, 20 bp, Artificial Sequence
  Synthetic oligonucleotide; AAGAAT chr11 5271753 5271772 5271769 +
aaaaaacacttgtggcaagt

SEQ ID NO: 58795 - DNA, 20 bp, Artificial Sequence
  Synthetic oligonucleotide; CTGAAT chr11 5271839 5271858 5271855 +
attgttattattccaggcca

SEQ ID NO: 58796 - DNA, 20 bp, Artificial Sequence
  Synthetic oligonucleotide; AGGAAT chr11 5271928 5271947 5271944 +
tggctaacacagacaaaacc

SEQ ID NO: 58797 - DNA, 20 bp, Artificial Sequence
  Synthetic oligonucleotide; AGGAGT chr11 5272020 5272039 5272036 +
ttgcatcaaataatatacat

SEQ ID NO: 58798 - DNA, 20 bp, Artificial Sequence
  Synthetic oligonucleotide; TAGGAT chr11 5272125 5272144 5272141 +
ctttatgaaagcattagatc

SEQ ID NO: 58799 - DNA, 20 bp, Artificial Sequence
  Synthetic oligonucleotide; TTGGGT chr11 5272130 5272149 5272146 +
tgaaagcattagatctagga

SEQ ID NO: 58800 - DNA, 20 bp, Artificial Sequence
  Synthetic oligonucleotide; GTGAAT chr11 5272176 5272195 5272192 +
aagtagtgatgcagataaat

SEQ ID NO: 58801 - DNA, 20 bp, Artificial Sequence
  Synthetic oligonucleotide; AGGAGT chr11 5272271 5272290 5272287 +
cgggcagatcatctgaggtc

SEQ ID NO: 58802 - DNA, 20 bp, Artificial Sequence
  Synthetic oligonucleotide; GAGAAT chr11 5272390 5272409 5272406 +
tactcaggaggccaaggcag

SEQ ID NO: 58803 - DNA, 20 bp, Artificial Sequence
  Synthetic oligonucleotide; TTGAAT chr11 5272399 5272418 5272415 +
ggccaaggcaggagaattgc

SEQ ID NO: 58804 - DNA, 20 bp, Artificial Sequence
  Synthetic oligonucleotide; CTGGGT chr11 5272912 5272931 5272928 +
taaccaattaagatacagct

SEQ ID NO: 58805 - DNA, 20 bp, Artificial Sequence
  Synthetic oligonucleotide; GGGAAT chr11 5272925 5272944 5272941 +
tacagctctgggttttcagg

SEQ ID NO: 58806 - DNA, 20 bp, Artificial Sequence
  Synthetic oligonucleotide; TTGAAT chr11 5272976 5272995 5272992 +
cagtggcccttcctcagaac

SEQ ID NO: 58807 - DNA, 20 bp, Artificial Sequence
  Synthetic oligonucleotide; GAGGGT chr11 5272984 5273003 5273000 +
cttcctcagaacttgaatgt

SEQ ID NO: 58808 - DNA, 20 bp, Artificial Sequence
  Synthetic oligonucleotide; AGGAAT chr11 5273009 5273028 5273025 +
tcagacattgccaaagtcca

SEQ ID NO: 58809 - DNA, 20 bp, Artificial Sequence
  Synthetic oligonucleotide; AAGAGT chr11 5273037 5273056 5273053 +
ggaccaggtatctcaaggcc

SEQ ID NO: 58810 - DNA, 20 bp, Artificial Sequence
  Synthetic oligonucleotide; ATGGGT chr11 5273076 5273095 5273092 +
ttctccctaaaacaagccct

SEQ ID NO: 58811 - DNA, 20 bp, Artificial Sequence
  Synthetic oligonucleotide; CAGAGT chr11 5273103 5273122 5273119 +
atcccatcattcttcccatt

SEQ ID NO: 58812 - DNA, 20 bp, Artificial Sequence
  Synthetic oligonucleotide; CAGAGT chr11 5273134 5273153 5273150 +
caccagtcttctcttagatt

SEQ ID NO: 58813 - DNA, 20 bp, Artificial Sequence
  Synthetic oligonucleotide; TGGGGT chr11 5273141 5273160 5273157 +
cttctcttagattcagagta

SEQ ID NO: 58814 - DNA, 20 bp, Artificial Sequence
  Synthetic oligonucleotide; AGGGAT chr11 5273236 5273255 5273252 +
tccagacctggcttgcatcc

SEQ ID NO: 58815 - DNA, 20 bp, Artificial Sequence
  Synthetic oligonucleotide; ATGGAT chr11 5273481 5273500 5273497 +
catatgagataccatgaaaa

SEQ ID NO: 58816 - DNA, 20 bp, Artificial Sequence
  Synthetic oligonucleotide; CAGGAT chr11 5273548 5273567 5273564 +
agataagtgttatggccatc

SEQ ID NO: 58817 - DNA, 20 bp, Artificial Sequence
  Synthetic oligonucleotide; AAGAAT chr11 5273592 5273611 5273608 +
agtcagaaaaagtaatcagt

SEQ ID NO: 58818 - DNA, 20 bp, Artificial Sequence
  Synthetic oligonucleotide; TTGGGT chr11 5273722 5273741 5273738 +
gaagattaattcctgcctgt

SEQ ID NO: 58819 - DNA, 20 bp, Artificial Sequence
  Synthetic oligonucleotide; CAGGAT chr11 5273762 5273781 5273778 +
gtaatttcttaagttctatg

SEQ ID NO: 58820 - DNA, 20 bp, Artificial Sequence
  Synthetic oligonucleotide; AAGAGT chr11 5273859 5273878 5273875 +
tatgacatatgtttaacctg

SEQ ID NO: 58821 - DNA, 20 bp, Artificial Sequence
  Synthetic oligonucleotide; CTGAAT chr11 5273951 5273970 5273967 +
aaagtaggcccttcacttca

SEQ ID NO: 58822 - DNA, 20 bp, Artificial Sequence
  Synthetic oligonucleotide; ATGAAT chr11 5273993 5274012 5274009 +
tctaagaaataaatacttta

SEQ ID NO: 58823 - DNA, 20 bp, Artificial Sequence
  Synthetic oligonucleotide; TAGGAT chr11 5274092 5274111 5274108 +
ctgataggaaaagagctgct

SEQ ID NO: 58824 - DNA, 20 bp, Artificial Sequence
  Synthetic oligonucleotide; AGGAAT chr11 5274220 5274239 5274236 +
tgttagattttgcattatcc

SEQ ID NO: 58825 - DNA, 20 bp, Artificial Sequence
  Synthetic oligonucleotide; TTGGAT chr11 5274229 5274248 5274245 +
ttgcattatccaggaatgac

SEQ ID NO: 58826 - DNA, 20 bp, Artificial Sequence
  Synthetic oligonucleotide; AAGAAT chr11 5274301 5274320 5274317 +
tattttctagtgtaattgta

SEQ ID NO: 58827 - DNA, 20 bp, Artificial Sequence
  Synthetic oligonucleotide; GAGAAT chr11 5274309 5274328 5274325 +
agtgtaattgtaaagaatga

SEQ ID NO: 58828 - DNA, 20 bp, Artificial Sequence
  Synthetic oligonucleotide; AGGGGT chr11 5274373 5274392 5274389 +
tcaacttttattttaagttc

SEQ ID NO: 58829 - DNA, 20 bp, Artificial Sequence
  Synthetic oligonucleotide; CAGGAT chr11 5274386 5274405 5274402 +
taagttcaggggtacatgta

SEQ ID NO: 58830 - DNA, 20 bp, Artificial Sequence
  Synthetic oligonucleotide; ATGAAT chr11 5274415 5274434 5274431 +
caggtttgttacatagataa

SEQ ID NO: 58831 - DNA, 20 bp, Artificial Sequence
  Synthetic oligonucleotide; GGGGGT chr11 5274426 5274445 5274442 +
catagataaatgaatgtcaa

SEQ ID NO: 58832 - DNA, 20 bp, Artificial Sequence
  Synthetic oligonucleotide; ATGAGT chr11 5274555 5274574 5274571 +
agtatgcgttgtttccctct

SEQ ID NO: 58833 - DNA, 20 bp, Artificial Sequence
  Synthetic oligonucleotide; GTGAGT chr11 5274638 5274657 5274654 +
atctctcacgaagtttgcag

SEQ ID NO: 58834 - DNA, 20 bp, Artificial Sequence
  Synthetic oligonucleotide; AAGAGT chr11 5274670 5274689 5274686 +
cagggctgaggctcattctc

SEQ ID NO: 58835 - DNA, 20 bp, Artificial Sequence
  Synthetic oligonucleotide; CAGAGT chr11 5274756 5274775 5274772 +
cactgtgcctaaagtacaac

SEQ ID NO: 58836 - DNA, 20 bp, Artificial Sequence
  Synthetic oligonucleotide; GTGAAT chr11 5274767 5274786 5274783 +
aagtacaaccagagttactt

SEQ ID NO: 58837 - DNA, 20 bp, Artificial Sequence
  Synthetic oligonucleotide; AGGGAT chr11 5274787 5274806 5274803 +
gtgaatgttaattaagcagg

SEQ ID NO: 58838 - DNA, 20 bp, Artificial Sequence
  Synthetic oligonucleotide; AGGAGT chr11 5274807 5274826 5274823 +
agggatctttaatgggaaaa

SEQ ID NO: 58839 - DNA, 20 bp, Artificial Sequence
  Synthetic oligonucleotide; CAGAAT chr11 5274820 5274839 5274836 +
gggaaaaaggagtagaaagc

SEQ ID NO: 58840 - DNA, 20 bp, Artificial Sequence
  Synthetic oligonucleotide; TTGAGT chr11 5274876 5274895 5274892 +
tgggcactgaaggttaaaac

SEQ ID NO: 58841 - DNA, 20 bp, Artificial Sequence
  Synthetic oligonucleotide; TTGAGT chr11 5274966 5274985 5274982 +
ttctttgaccttttgggacc

SEQ ID NO: 58842 - DNA, 20 bp, Artificial Sequence
  Synthetic oligonucleotide; TTGGGT chr11 5275021 5275040 5275037 +
attaaaattctaagaaattc

SEQ ID NO: 58843 - DNA, 20 bp, Artificial Sequence
  Synthetic oligonucleotide; CAGAAT chr11 5275103 5275122 5275119 +
aacaatactctgaagtagtt

SEQ ID NO: 58844 - DNA, 20 bp, Artificial Sequence
  Synthetic oligonucleotide; AAGAGT chr11 5275127 5275146 5275143 +
atgtgctttcaatttatata

SEQ ID NO: 58845 - DNA, 20 bp, Artificial Sequence
  Synthetic oligonucleotide; TTGAAT chr11 5275166 5275185 5275182 +
actattttaagtgcagggct

SEQ ID NO: 58846 - DNA, 20 bp, Artificial Sequence
  Synthetic oligonucleotide; CTGAAT chr11 5275374 5275393 5275390 +
actataacatagtatgtttc

SEQ ID NO: 58847 - DNA, 20 bp, Artificial Sequence
  Synthetic oligonucleotide; GAGGAT chr11 5275415 5275434 5275431 +
ctctggagaaggttaaaact

SEQ ID NO: 58848 - DNA, 20 bp, Artificial Sequence
  Synthetic oligonucleotide; AAGGGT chr11 5275539 5275558 5275555 +
cccctctgttttgtgtcact

SEQ ID NO: 58849 - DNA, 20 bp, Artificial Sequence
  Synthetic oligonucleotide; GAGGAT chr11 5275545 5275564 5275561 +
tgttttgtgtcactaagggt

SEQ ID NO: 58850 - DNA, 20 bp, Artificial Sequence
  Synthetic oligonucleotide; CTGAAT chr11 5275552 5275571 5275568 +
tgtcactaagggtgaggatg

SEQ ID NO: 58851 - DNA, 20 bp, Artificial Sequence
  Synthetic oligonucleotide; AGGAGT chr11 5275609 5275628 5275625 +
atcaataattctagccccac

SEQ ID NO: 58852 - DNA, 20 bp, Artificial Sequence
  Synthetic oligonucleotide; TGGGAT chr11 5275893 5275912 5275909 +
attatttttttctttagact

SEQ ID NO: 58853 - DNA, 20 bp, Artificial Sequence
  Synthetic oligonucleotide; GTGGAT chr11 5275930 5275949 5275946 +
ggcagcgtcagaaactgtgt

SEQ ID NO: 58854 - DNA, 20 bp, Artificial Sequence
  Synthetic oligonucleotide; GAGAGT chr11 5275997 5276016 5276013 +
ggggcctagctaaaggcagt

SEQ ID NO: 58855 - DNA, 20 bp, Artificial Sequence
  Synthetic oligonucleotide; CAGAAT chr11 5276003 5276022 5276019 +
tagctaaaggcagtgagagt

SEQ ID NO: 58856 - DNA, 20 bp, Artificial Sequence
  Synthetic oligonucleotide; GAGAGT chr11 5276089 5276108 5276105 +
aaggctataggttagtgttt

SEQ ID NO: 58857 - DNA, 20 bp, Artificial Sequence
  Synthetic oligonucleotide; TAGGAT chr11 5276268 5276287 5276284 +
accagataacttgcaagtcc

SEQ ID NO: 58858 - DNA, 20 bp, Artificial Sequence
  Synthetic oligonucleotide; GGGGGT chr11 5276393 5276412 5276409 +
atcacacactggggcctgtt

SEQ ID NO: 58859 - DNA, 20 bp, Artificial Sequence
  Synthetic oligonucleotide; AAGGAT chr11 5276412 5276431 5276428 +
tgggggtggggggctagggg

SEQ ID NO: 58860 - DNA, 20 bp, Artificial Sequence
  Synthetic oligonucleotide; ACGGGT chr11 5276447 5276466 5276463 +
agaaatacctaatgtagatg

SEQ ID NO: 58861 - DNA, 20 bp, Artificial Sequence
  Synthetic oligonucleotide; ATGGGT chr11 5276455 5276474 5276471 +
ctaatgtagatgacgggttg

SEQ ID NO: 58862 - DNA, 20 bp, Artificial Sequence
  Synthetic oligonucleotide; CGGAAT chr11 5276553 5276572 5276569 +
tcaaatttaactataagaga

SEQ ID NO: 58863 - DNA, 20 bp, Artificial Sequence
  Synthetic oligonucleotide; CAGAAT chr11 5276588 5276607 5276604 +
aattcttaactataatctta

SEQ ID NO: 58864 - DNA, 20 bp, Artificial Sequence
  Synthetic oligonucleotide; TTGAAT chr11 5276601 5276620 5276617 +
aatcttacagaatattctca

SEQ ID NO: 58865 - DNA, 20 bp, Artificial Sequence
  Synthetic oligonucleotide; ATGGAT chr11 5276749 5276768 5276765 +
aggccatccttcccatgaag

SEQ ID NO: 58866 - DNA, 20 bp, Artificial Sequence
  Synthetic oligonucleotide; ATGAAT chr11 5276753 5276772 5276769 +
catccttcccatgaagatgg

SEQ ID NO: 58867 - DNA, 20 bp, Artificial Sequence
  Synthetic oligonucleotide; ATGAGT chr11 5276884 5276903 5276900 +
aattaattgcttacataaac

SEQ ID NO: 58868 - DNA, 20 bp, Artificial Sequence
  Synthetic oligonucleotide; ATGAGT chr11 5277003 5277022 5277019 +
aatctcagcctacaaaacaa

SEQ ID NO: 58869 - DNA, 20 bp, Artificial Sequence
  Synthetic oligonucleotide; GTGGAT chr11 5277124 5277143 5277140 +
ttctttgtgtgtgcatagca

SEQ ID NO: 58870 - DNA, 20 bp, Artificial Sequence
  Synthetic oligonucleotide; AAGAAT chr11 5277209 5277228 5277225 +
ttcaaaattgtaaaattgct

SEQ ID NO: 58871 - DNA, 20 bp, Artificial Sequence
  Synthetic oligonucleotide; CAGAAT chr11 5277227 5277246 5277243 +
ctaagaatacagcacaaaaa

SEQ ID NO: 58872 - DNA, 20 bp, Artificial Sequence
  Synthetic oligonucleotide; AGGAAT chr11 5277235 5277254 5277251 +
acagcacaaaaacagaatag

SEQ ID NO: 58873 - DNA, 20 bp, Artificial Sequence
  Synthetic oligonucleotide; CAGAGT chr11 5277363 5277382 5277379 +
aaaaaaactgaaatgaaggc

SEQ ID NO: 58874 - DNA, 20 bp, Artificial Sequence
  Synthetic oligonucleotide; CAGGGT chr11 5277379 5277398 5277395 +
aggccagagtgtgattagga

SEQ ID NO: 58875 - DNA, 20 bp, Artificial Sequence
  Synthetic oligonucleotide; AAGGGT chr11 5277387 5277406 5277403 +
gtgtgattaggacagggtga

SEQ ID NO: 58876 - DNA, 20 bp, Artificial Sequence
  Synthetic oligonucleotide; GAGAGT chr11 5277448 5277467 5277464 +
actataaagttaacacctga

SEQ ID NO: 58877 - DNA, 20 bp, Artificial Sequence
  Synthetic oligonucleotide; GGGAAT chr11 5277512 5277531 5277528 +
gattaaatatttagggcata

SEQ ID NO: 58878 - DNA, 20 bp, Artificial Sequence
  Synthetic oligonucleotide; TAGAAT chr11 5277552 5277571 5277568 +
ccctaaagatgtaagatgct

SEQ ID NO: 58879 - DNA, 20 bp, Artificial Sequence
  Synthetic oligonucleotide; AGGAAT chr11 5277563 5277582 5277579 +
taagatgcttagaattttca

SEQ ID NO: 58880 - DNA, 20 bp, Artificial Sequence
  Synthetic oligonucleotide; TAGGAT chr11 5277585 5277604 5277601 +
gaatatcaataaggccaatg

SEQ ID NO: 58881 - DNA, 20 bp, Artificial Sequence
  Synthetic oligonucleotide; GAGAAT chr11 5277607 5277626 5277623 +
ggatgagattcggtgaaggg

SEQ ID NO: 58882 - DNA, 20 bp, Artificial Sequence
  Synthetic oligonucleotide; TAGAGT chr11 5277675 5277694 5277691 +
cactaataatacctacatca

SEQ ID NO: 58883 - DNA, 20 bp, Artificial Sequence
  Synthetic oligonucleotide; GAGAAT chr11 5277792 5277811 5277808 +
atgcatgaacaactattgta

SEQ ID NO: 58884 - DNA, 20 bp, Artificial Sequence
  Synthetic oligonucleotide; AAGGAT chr11 5277801 5277820 5277817 +
caactattgtagagaattgt

SEQ ID NO: 58885 - DNA, 20 bp, Artificial Sequence
  Synthetic oligonucleotide; TTGGAT chr11 5277896 5277915 5277912 +
tacattttgaaaagactaat

SEQ ID NO: 58886 - DNA, 20 bp, Artificial Sequence
  Synthetic oligonucleotide; ATGAGT chr11 5277955 5277974 5277971 +
gtagaagcaggaagattgtt

SEQ ID NO: 58887 - DNA, 20 bp, Artificial Sequence
  Synthetic oligonucleotide; CAGAGT chr11 5278001 5278020 5278017 +
gtggtgacagtgacttagac

SEQ ID NO: 58888 - DNA, 20 bp, Artificial Sequence
  Synthetic oligonucleotide; AGGGGT chr11 5278029 5278048 5278045 +
tagcattggaggtgaaggca

SEQ ID NO: 58889 - DNA, 20 bp, Artificial Sequence
  Synthetic oligonucleotide; CAGGAT chr11 5278069 5278088 5278085 +
atcctttcacgaaaaaccaa

SEQ ID NO: 58890 - DNA, 20 bp, Artificial Sequence
  Synthetic oligonucleotide; GAGAAT chr11 5278084 5278103 5278100 +
accaacaggattttctgaca

SEQ ID NO: 58891 - DNA, 20 bp, Artificial Sequence
  Synthetic oligonucleotide; TGGAAT chr11 5278091 5278110 5278107 +
ggattttctgacagagaata

SEQ ID NO: 58892 - DNA, 20 bp, Artificial Sequence
  Synthetic oligonucleotide; GTGAGT chr11 5278152 5278171 5278168 +
gtgcatgctaatttctggct

SEQ ID NO: 58893 - DNA, 20 bp, Artificial Sequence
  Synthetic oligonucleotide; CAGAGT chr11 5278164 5278183 5278180 +
ttctggctgtgagtatatgt

SEQ ID NO: 58894 - DNA, 20 bp, Artificial Sequence
  Synthetic oligonucleotide; AAGGAT chr11 5278170 5278189 5278186 +
ctgtgagtatatgtcagagt

SEQ ID NO: 58895 - DNA, 20 bp, Artificial Sequence
  Synthetic oligonucleotide; GTGAGT chr11 5278192 5278211 5278208 +
ggattttgaagctaggcaaa

SEQ ID NO: 58896 - DNA, 20 bp, Artificial Sequence
  Synthetic oligonucleotide; TTGGGT chr11 5278200 5278219 5278216 +
aagctaggcaaagtgagtct

SEQ ID NO: 58897 - DNA, 20 bp, Artificial Sequence
  Synthetic oligonucleotide; TTGAAT chr11 5278205 5278224 5278221 +
aggcaaagtgagtctttggg

SEQ ID NO: 58898 - DNA, 20 bp, Artificial Sequence
  Synthetic oligonucleotide; CAGAAT chr11 5278246 5278265 5278262 +
gttcatcacagtctctacct

SEQ ID NO: 58899 - DNA, 20 bp, Artificial Sequence
  Synthetic oligonucleotide; CTGGGT chr11 5278271 5278290 5278287 +
ttggctttaaaattggaaag

SEQ ID NO: 58900 - DNA, 20 bp, Artificial Sequence
  Synthetic oligonucleotide; GTGGGT chr11 5278275 5278294 5278291 +
ctttaaaattggaaagctgg

SEQ ID NO: 58901 - DNA, 20 bp, Artificial Sequence
  Synthetic oligonucleotide; GTGGAT chr11 5278279 5278298 5278295 +
aaaattggaaagctgggtgg

SEQ ID NO: 58902 - DNA, 20 bp, Artificial Sequence
  Synthetic oligonucleotide; TTGGAT chr11 5278357 5278376 5278373 +
aaagtgacatcaagtatttc

SEQ ID NO: 58903 - DNA, 20 bp, Artificial Sequence
  Synthetic oligonucleotide; CAGAAT chr11 5278460 5278479 5278476 +
taagtcagagaacaatcaga

SEQ ID NO: 58904 - DNA, 20 bp, Artificial Sequence
  Synthetic oligonucleotide; GGGAAT chr11 5278478 5278497 5278494 +
gacagaattctgttcggtca

SEQ ID NO: 58905 - DNA, 20 bp, Artificial Sequence
  Synthetic oligonucleotide; ATGGGT chr11 5278487 5278506 5278503 +
ctgttcggtcagggaatttg

SEQ ID NO: 58906 - DNA, 20 bp, Artificial Sequence
  Synthetic oligonucleotide; CAGAGT chr11 5278535 5278554 5278551 +
tgttttcgtttttctttaga

SEQ ID NO: 58907 - DNA, 20 bp, Artificial Sequence
  Synthetic oligonucleotide; TGGAGT chr11 5278555 5278574 5278571 +
cagagtctcgctctggaggc

SEQ ID NO: 58908 - DNA, 20 bp, Artificial Sequence
  Synthetic oligonucleotide; TTGGAT chr11 5278639 5278658 5278655 +
tgcctcagcctcccaagtag

SEQ ID NO: 58909 - DNA, 20 bp, Artificial Sequence
  Synthetic oligonucleotide; AGGAGT chr11 5278784 5278803 5278800 +
tcccaaactgctgtgattac

SEQ ID NO: 58910 - DNA, 20 bp, Artificial Sequence
  Synthetic oligonucleotide; AGGAAT chr11 5278806 5278825 5278822 +
gagtgagccaccgcacctca

SEQ ID NO: 58911 - DNA, 20 bp, Artificial Sequence
  Synthetic oligonucleotide; AGGAAT chr11 5278840 5278859 5278856 +
taggctgtgacctctgcact

SEQ ID NO: 58912 - DNA, 20 bp, Artificial Sequence
  Synthetic oligonucleotide; ATGAGT chr11 5278944 5278963 5278960 +
gaggcgtgcctccatccctg

SEQ ID NO: 58913 - DNA, 20 bp, Artificial Sequence
  Synthetic oligonucleotide; TAGAAT chr11 5278964 5278983 5278980 +
atgagtttttcctccatgtg

SEQ ID NO: 58914 - DNA, 20 bp, Artificial Sequence
  Synthetic oligonucleotide; TTGAAT chr11 5278969 5278988 5278985 +
tttttcctccatgtgtagaa

SEQ ID NO: 58915 - DNA, 20 bp, Artificial Sequence
  Synthetic oligonucleotide; AAGGAT chr11 5278978 5278997 5278994 +
catgtgtagaattgaataag

SEQ ID NO: 58916 - DNA, 20 bp, Artificial Sequence
  Synthetic oligonucleotide; TAGAAT chr11 5278983 5279002 5278999 +
gtagaattgaataagaagga

SEQ ID NO: 58917 - DNA, 20 bp, Artificial Sequence
  Synthetic oligonucleotide; TTGAGT chr11 5279004 5279023 5279020 +
agaattcaatttaacaagct

SEQ ID NO: 58918 - DNA, 20 bp, Artificial Sequence
  Synthetic oligonucleotide; ATGAAT chr11 5279124 5279143 5279140 +
aggcccaatataaaatgaaa

SEQ ID NO: 58919 - DNA, 20 bp, Artificial Sequence
  Synthetic oligonucleotide; AAGGAT chr11 5279149 5279168 5279165 +
tagcccctttgtcaaaaatt

SEQ ID NO: 58920 - DNA, 20 bp, Artificial Sequence
  Synthetic oligonucleotide; AAGGAT chr11 5279172 5279191 5279188 +
gatttcatgtcaggaacagc

SEQ ID NO: 58921 - DNA, 20 bp, Artificial Sequence
  Synthetic oligonucleotide; AAGAGT chr11 5279235 5279254 5279251 +
attcatgatacgaaaaaata

SEQ ID NO: 58922 - DNA, 20 bp, Artificial Sequence
  Synthetic oligonucleotide; TGGAAT chr11 5279341 5279360 5279357 +
agtctttctagacccatcca

SEQ ID NO: 58923 - DNA, 20 bp, Artificial Sequence
  Synthetic oligonucleotide; CCGAGT chr11 5279655 5279674 5279671 +
atcattcattcacagcgaaa

SEQ ID NO: 58924 - DNA, 20 bp, Artificial Sequence
  Synthetic oligonucleotide; ATGAAT chr11 5279689 5279708 5279705 +
aagaggtcattcattcacaa

SEQ ID NO: 58925 - DNA, 20 bp, Artificial Sequence
  Synthetic oligonucleotide; ATGGGT chr11 5279731 5279750 5279747 +
agtatacgtgaggtcctgta

SEQ ID NO: 58926 - DNA, 20 bp, Artificial Sequence
  Synthetic oligonucleotide; AGGAAT chr11 5280081 5280100 5280097 +
aacccttttagctctcctgg

SEQ ID NO: 58927 - DNA, 20 bp, Artificial Sequence
  Synthetic oligonucleotide; CAGGAT chr11 5280100 5280119 5280116 +
gaggaatgtttctttcctct

SEQ ID NO: 58928 - DNA, 20 bp, Artificial Sequence
  Synthetic oligonucleotide; CAGAGT chr11 5280106 5280125 5280122 +
tgtttctttcctctcaggat

SEQ ID NO: 58929 - DNA, 20 bp, Artificial Sequence
  Synthetic oligonucleotide; AGGGGT chr11 5280256 5280275 5280272 +
cttttgccacctagctgtcc

SEQ ID NO: 58930 - DNA, 20 bp, Artificial Sequence
  Synthetic oligonucleotide; TAGAAT chr11 5280547 5280566 5280563 +
attcaggaaataatatattc

SEQ ID NO: 58931 - DNA, 20 bp, Artificial Sequence
  Synthetic oligonucleotide; TGGAGT chr11 5280603 5280622 5280619 +
ctttatgatgccgtttgagg

SEQ ID NO: 58932 - DNA, 20 bp, Artificial Sequence
  Synthetic oligonucleotide; AGGAGT chr11 5280679 5280698 5280695 +
atcctgctggggacccagat

SEQ ID NO: 58933 - DNA, 20 bp, Artificial Sequence
  Synthetic oligonucleotide; GGGGGT chr11 5280807 5280826 5280823 +
gttacacagaaccagaaggc

SEQ ID NO: 58934 - DNA, 20 bp, Artificial Sequence
  Synthetic oligonucleotide; GAGGAT chr11 5280939 5280958 5280955 +
aagcttatttaatcagagat

SEQ ID NO: 58935 - DNA, 20 bp, Artificial Sequence
  Synthetic oligonucleotide; AGGGAT chr11 5280951 5280970 5280967 +
tcagagatgaggatgctgga

SEQ ID NO: 58936 - DNA, 20 bp, Artificial Sequence
  Synthetic oligonucleotide; CTGGAT chr11 5281018 5281037 5281034 +
aaatggttttgaagcacctg

SEQ ID NO: 58937 - DNA, 20 bp, Artificial Sequence
  Synthetic oligonucleotide; TTGAAT chr11 5281045 5281064 5281061 +
ctaaacactattttcagtgc

SEQ ID NO: 58938 - DNA, 20 bp, Artificial Sequence
  Synthetic oligonucleotide; AAGAAT chr11 5281058 5281077 5281074 +
tcagtgcttgaatcataaat

SEQ ID NO: 58939 - DNA, 20 bp, Artificial Sequence
  Synthetic oligonucleotide; AAGAGT chr11 5281087 5281106 5281103 +
acatgtatcttattccccac

SEQ ID NO: 58940 - DNA, 20 bp, Artificial Sequence
  Synthetic oligonucleotide; TGGAGT chr11 5281140 5281159 5281156 +
atgtgctctgtcccccaggc

SEQ ID NO: 58941 - DNA, 20 bp, Artificial Sequence
  Synthetic oligonucleotide; CCGGGT chr11 5281184 5281203 5281200 +
ctcactgcaacctccgcctc

SEQ ID NO: 58942 - DNA, 20 bp, Artificial Sequence
  Synthetic oligonucleotide; TGGGAT chr11 5281225 5281244 5281241 +
gcctcagccaccctaatagc

SEQ ID NO: 58943 - DNA, 20 bp, Artificial Sequence
  Synthetic oligonucleotide; CAGGGT chr11 5281281 5281300 5281297 +
ttttgtactttttgtagagg

SEQ ID NO: 58944 - DNA, 20 bp, Artificial Sequence
  Synthetic oligonucleotide; TGGGAT chr11 5281361 5281380 5281377 +
acctcagcctcccaaagtgc

SEQ ID NO: 58945 - DNA, 20 bp, Artificial Sequence
  Synthetic oligonucleotide; TGGGAT chr11 5281419 5281438 5281435 +
atatttaatagaggtattta

SEQ ID NO: 58946 - DNA, 20 bp, Artificial Sequence
  Synthetic oligonucleotide; AAGAAT chr11 5281432 5281451 5281448 +
gtatttatgggatgggggaa

SEQ ID NO: 58947 - DNA, 20 bp, Artificial Sequence
  Synthetic oligonucleotide; GTGGAT chr11 5281450 5281469 5281466 +
aaaagaatgtttctctcact

SEQ ID NO: 58948 - DNA, 20 bp, Artificial Sequence
  Synthetic oligonucleotide; GAGAGT chr11 5281463 5281482 5281479 +
tctcactgtggattatttta

SEQ ID NO: 58949 - DNA, 20 bp, Artificial Sequence
  Synthetic oligonucleotide; GAGAAT chr11 5281470 5281489 5281486 +
gtggattattttagagagtg

SEQ ID NO: 58950 - DNA, 20 bp, Artificial Sequence
  Synthetic oligonucleotide; GAGGAT chr11 5281547 5281566 5281563 +
gaaaatttatttttttgttg

SEQ ID NO: 58951 - DNA, 20 bp, Artificial Sequence
  Synthetic oligonucleotide; CAGAGT chr11 5281612 5281631 5281628 +
ctggctaagacacagtgaga

SEQ ID NO: 58952 - DNA, 20 bp, Artificial Sequence
  Synthetic oligonucleotide; TAGGGT chr11 5281733 5281752 5281749 +
cagaaatttcataagtctac

SEQ ID NO: 58953 - DNA, 20 bp, Artificial Sequence
  Synthetic oligonucleotide; GAGGAT chr11 5281760 5281779 5281776 +
aggcagatcacataagaaaa

SEQ ID NO: 58954 - DNA, 20 bp, Artificial Sequence
  Synthetic oligonucleotide; GTGAGT chr11 5281783 5281802 5281799 +
gatgccagttaaggtctgca

SEQ ID NO: 58955 - DNA, 20 bp, Artificial Sequence
  Synthetic oligonucleotide; ATGAAT chr11 5281804 5281823 5281820 +
tgagtatgagcccatccctg

SEQ ID NO: 58956 - DNA, 20 bp, Artificial Sequence
  Synthetic oligonucleotide; TAGGAT chr11 5281940 5281959 5281956 +
ttcttgaagtctctgaaata

SEQ ID NO: 58957 - DNA, 20 bp, Artificial Sequence
  Synthetic oligonucleotide; TAGAAT chr11 5281965 5281984 5281981 +
tgataatatgtattagctaa

SEQ ID NO: 58958 - DNA, 20 bp, Artificial Sequence
  Synthetic oligonucleotide; GAGGAT chr11 5281974 5281993 5281990 +
gtattagctaatagaattat

SEQ ID NO: 58959 - DNA, 20 bp, Artificial Sequence
  Synthetic oligonucleotide; AAGAAT chr11 5282095 5282114 5282111 +
tacagttgcatgctacctta

SEQ ID NO: 58960 - DNA, 20 bp, Artificial Sequence
  Synthetic oligonucleotide; GGGAGT chr11 5282445 5282464 5282461 +
agcccatcagggaagacata

SEQ ID NO: 58961 - DNA, 20 bp, Artificial Sequence
  Synthetic oligonucleotide; AGGAAT chr11 5282456 5282475 5282472 +
gaagacatagggagttctgt

SEQ ID NO: 58962 - DNA, 20 bp, Artificial Sequence
  Synthetic oligonucleotide; ATGAGT chr11 5282460 5282479 5282476 +
acatagggagttctgtagga

SEQ ID NO: 58963 - DNA, 20 bp, Artificial Sequence
  Synthetic oligonucleotide; GAGAAT chr11 5282602 5282621 5282618 +
acccggcaaagggagatgca

SEQ ID NO: 58964 - DNA, 20 bp, Artificial Sequence
  Synthetic oligonucleotide; TAGAAT chr11 5282698 5282717 5282714 +
cctcagttcttgacgctagt

SEQ ID NO: 58965 - DNA, 20 bp, Artificial Sequence
  Synthetic oligonucleotide; CAGGAT chr11 5282762 5282781 5282778 +
ctgaggcactgaggtcactg

SEQ ID NO: 58966 - DNA, 20 bp, Artificial Sequence
  Synthetic oligonucleotide; ATGGGT chr11 5282781 5282800 5282797 +
gcaggatgaagacggagcca

SEQ ID NO: 58967 - DNA, 20 bp, Artificial Sequence
  Synthetic oligonucleotide; AAGAGT chr11 5282795 5282814 5282811 +
gagccaatgggttagaccag

SEQ ID NO: 58968 - DNA, 20 bp, Artificial Sequence
  Synthetic oligonucleotide; AGGGGT chr11 5282856 5282875 5282872 +
ccaaagttgcagcttgacca

SEQ ID NO: 58969 - DNA, 20 bp, Artificial Sequence
  Synthetic oligonucleotide; AAGGGT chr11 5282864 5282883 5282880 +
gcagcttgaccaaggggtca

SEQ ID NO: 58970 - DNA, 20 bp, Artificial Sequence
  Synthetic oligonucleotide; AGGAAT chr11 5283118 5283137 5283134 +
agaagcaagggccacagggc

SEQ ID NO: 58971 - DNA, 20 bp, Artificial Sequence
  Synthetic oligonucleotide; CTGAGT chr11 5283155 5283174 5283171 +
atttctcgcatccacaatat

SEQ ID NO: 58972 - DNA, 20 bp, Artificial Sequence
  Synthetic oligonucleotide; CTGGGT chr11 5283206 5283225 5283222 +
tgtcttcagaggtagcagaa

SEQ ID NO: 58973 - DNA, 20 bp, Artificial Sequence
  Synthetic oligonucleotide; TCGAGT chr11 5283278 5283297 5283294 +
ttatttcatgtctttgattt

SEQ ID NO: 58974 - DNA, 20 bp, Artificial Sequence
  Synthetic oligonucleotide; CTGAGT chr11 5283445 5283464 5283461 +
aatgaggtaataatctactt

SEQ ID NO: 58975 - DNA, 20 bp, Artificial Sequence
  Synthetic oligonucleotide; GTGAGT chr11 5283457 5283476 5283473 +
atctacttctgagtattggt

SEQ ID NO: 58976 - DNA, 20 bp, Artificial Sequence
  Synthetic oligonucleotide; TGGAGT chr11 5283510 5283529 5283526 +
ttctttttttttttttgaga

SEQ ID NO: 58977 - DNA, 20 bp, Artificial Sequence
  Synthetic oligonucleotide; TGGAGT chr11 5283535 5283554 5283551 +
tctcactctgtcgcctaggc

SEQ ID NO: 58978 - DNA, 20 bp, Artificial Sequence
  Synthetic oligonucleotide; CTGGGT chr11 5283579 5283598 5283595 +
ctcactgcaacctccacctc

SEQ ID NO: 58979 - DNA, 20 bp, Artificial Sequence
  Synthetic oligonucleotide; CTGAGT chr11 5283611 5283630 5283627 +
gattctcctgcctcagcctc

SEQ ID NO: 58980 - DNA, 20 bp, Artificial Sequence
  Synthetic oligonucleotide; TGGGAT chr11 5283620 5283639 5283636 +
gcctcagcctcctgagtagc

SEQ ID NO: 58981 - DNA, 20 bp, Artificial Sequence
  Synthetic oligonucleotide; AGGGGT chr11 5283678 5283697 5283694 +
tttgtattttttagtagaga

SEQ ID NO: 58982 - DNA, 20 bp, Artificial Sequence
  Synthetic oligonucleotide; TGGGAT chr11 5283757 5283776 5283773 +
gccttggcctcccaaagtgc

SEQ ID NO: 58983 - DNA, 20 bp, Artificial Sequence
  Synthetic oligonucleotide; CAGAAT chr11 5283906 5283925 5283922 +
gttcaataatacatatctca

SEQ ID NO: 58984 - DNA, 20 bp, Artificial Sequence
  Synthetic oligonucleotide; GAGGGT chr11 5284307 5284326 5284323 +
gttagaaggttctactggag

SEQ ID NO: 58985 - DNA, 20 bp, Artificial Sequence
  Synthetic oligonucleotide; GAGAGT chr11 5284471 5284490 5284487 +
actgttaggccactggtcca

SEQ ID NO: 58986 - DNA, 20 bp, Artificial Sequence
  Synthetic oligonucleotide; AGGAGT chr11 5284562 5284581 5284578 +
gatgatgatcctgaaaacat

SEQ ID NO: 58987 - DNA, 20 bp, Artificial Sequence
  Synthetic oligonucleotide; GGGGGT chr11 5284588 5284607 5284604 +
caaggcacttgcccctagct

SEQ ID NO: 58988 - DNA, 20 bp, Artificial Sequence
  Synthetic oligonucleotide; TAGAAT chr11 5284619 5284638 5284635 +
ggagcagtcccatgtagtag

SEQ ID NO: 58989 - DNA, 20 bp, Artificial Sequence
  Synthetic oligonucleotide; GGGAGT chr11 5284703 5284722 5284719 +
gtctatctctcctggctcct

SEQ ID NO: 58990 - DNA, 20 bp, Artificial Sequence
  Synthetic oligonucleotide; GAGGGT chr11 5284874 5284893 5284890 +
ccagctcgcaaagtcaccgt

SEQ ID NO: 58991 - DNA, 20 bp, Artificial Sequence
  Synthetic oligonucleotide; CTGAGT chr11 5284890 5284909 5284906 +
ccgtgagggtcttgtgtttg

SEQ ID NO: 58992 - DNA, 20 bp, Artificial Sequence
  Synthetic oligonucleotide; CAGAAT chr11 5284982 5285001 5284998 +
atggctgtctcctttatcca

SEQ ID NO: 58993 - DNA, 20 bp, Artificial Sequence
  Synthetic oligonucleotide; CAGAGT chr11 5285062 5285081 5285078 +
gggcccatgagcagtagctg

SEQ ID NO: 58994 - DNA, 20 bp, Artificial Sequence
  Synthetic oligonucleotide; TGGAGT chr11 5285178 5285197 5285194 +
ataataatagtgttttttta

SEQ ID NO: 58995 - DNA, 20 bp, Artificial Sequence
  Synthetic oligonucleotide; GAGGAT chr11 5285190 5285209 5285206 +
tttttttatggagttagcgt

SEQ ID NO: 58996 - DNA, 20 bp, Artificial Sequence
  Synthetic oligonucleotide; AAGAGT chr11 5285332 5285351 5285348 +
aattttcccttacctataat

SEQ ID NO: 58997 - DNA, 20 bp, Artificial Sequence
  Synthetic oligonucleotide; CTGGAT chr11 5285371 5285390 5285387 +
atattcttcttatagtgatt

SEQ ID NO: 58998 - DNA, 20 bp, Artificial Sequence
  Synthetic oligonucleotide; GGGAAT chr11 5285385 5285404 5285401 +
gtgattctggatattaaagt

SEQ ID NO: 58999 - DNA, 20 bp, Artificial Sequence
  Synthetic oligonucleotide; CAGGGT chr11 5285459 5285478 5285475 +
ccccacatagatcatctcag

SEQ ID NO: 59000 - DNA, 20 bp, Artificial Sequence
  Synthetic oligonucleotide; GAGGAT chr11 5285479 5285498 5285495 +
cagggttcaggaagataaag

SEQ ID NO: 59001 - DNA, 20 bp, Artificial Sequence
  Synthetic oligonucleotide; GTGGAT chr11 5285524 5285543 5285540 +
taaggaagaacactgggcaa

SEQ ID NO: 59002 - DNA, 20 bp, Artificial Sequence
  Synthetic oligonucleotide; AGGAAT chr11 5285553 5285572 5285569 +
ggttgtccaacgctgaaagt

SEQ ID NO: 59003 - DNA, 20 bp, Artificial Sequence
  Synthetic oligonucleotide; CTGGAT chr11 5285573 5285592 5285589 +
aggaatctaagcactagtct

SEQ ID NO: 59004 - DNA, 20 bp, Artificial Sequence
  Synthetic oligonucleotide; ATGGGT chr11 5285596 5285615 5285612 +
gatgctaggagggcctctgc

SEQ ID NO: 59005 - DNA, 20 bp, Artificial Sequence
  Synthetic oligonucleotide; GAGGAT chr11 5285687 5285706 5285703 +
ccagcaggaaacacttaaga

SEQ ID NO: 59006 - DNA, 20 bp, Artificial Sequence
  Synthetic oligonucleotide; CTGAAT chr11 5285839 5285858 5285855 +
gatttctacatgctggagcc

SEQ ID NO: 59007 - DNA, 20 bp, Artificial Sequence
  Synthetic oligonucleotide; AAGAAT chr11 5285948 5285967 5285964 +
ataatctgattcatgcaacc

SEQ ID NO: 59008 - DNA, 20 bp, Artificial Sequence
  Synthetic oligonucleotide; TGGGGT chr11 5286007 5286026 5286023 +
atttattgttgtgcatatga

SEQ ID NO: 59009 - DNA, 20 bp, Artificial Sequence
  Synthetic oligonucleotide; ATGAGT chr11 5286057 5286076 5286073 +
atagactttctcagagctat

SEQ ID NO: 59010 - DNA, 20 bp, Artificial Sequence
  Synthetic oligonucleotide; GGGAAT chr11 5286065 5286084 5286081 +
tctcagagctatatgagttt

SEQ ID NO: 59011 - DNA, 20 bp, Artificial Sequence
  Synthetic oligonucleotide; CAGGGT chr11 5286093 5286112 5286109 +
atcaagaccagccttttgct

SEQ ID NO: 59012 - DNA, 20 bp, Artificial Sequence
  Synthetic oligonucleotide; AGGGAT chr11 5286112 5286131 5286128 +
tcagggtagaaatcccctat

SEQ ID NO: 59013 - DNA, 20 bp, Artificial Sequence
  Synthetic oligonucleotide; ATGGGT chr11 5286128 5286147 5286144 +
ctatagggatttattcaatg

SEQ ID NO: 59014 - DNA, 20 bp, Artificial Sequence
  Synthetic oligonucleotide; AAGAAT chr11 5286225 5286244 5286241 +
tatgaaattcttacacacag

SEQ ID NO: 59015 - DNA, 20 bp, Artificial Sequence
  Synthetic oligonucleotide; CTGGGT chr11 5286240 5286259 5286256 +
cacagaagaatcttctaatc

SEQ ID NO: 59016 - DNA, 20 bp, Artificial Sequence
  Synthetic oligonucleotide; AGGGAT chr11 5286466 5286485 5286482 +
gtgtagtctttcctgatgtc

SEQ ID NO: 59017 - DNA, 20 bp, Artificial Sequence
  Synthetic oligonucleotide; ACGAAT chr11 5286522 5286541 5286538 +
catcccagagcaggacacag

SEQ ID NO: 59018 - DNA, 20 bp, Artificial Sequence
  Synthetic oligonucleotide; TGGAAT chr11 5286562 5286581 5286578 +
tagtcacttaggaaaaacag

SEQ ID NO: 59019 - DNA, 20 bp, Artificial Sequence
  Synthetic oligonucleotide; AAGAGT chr11 5286571 5286590 5286587 +
aggaaaaacagtggaatgca

SEQ ID NO: 59020 - DNA, 20 bp, Artificial Sequence
  Synthetic oligonucleotide; CTGAAT chr11 5286589 5286608 5286605 +
caaagagtaaaaaatgcttt

SEQ ID NO: 59021 - DNA, 20 bp, Artificial Sequence
  Synthetic oligonucleotide; ATGGAT chr11 5286593 5286612 5286609 +
gagtaaaaaatgctttctga

SEQ ID NO: 59022 - DNA, 20 bp, Artificial Sequence
  Synthetic oligonucleotide; TTGGAT chr11 5286712 5286731 5286728 +
tacatgtcaataaatattta

SEQ ID NO: 59023 - DNA, 20 bp, Artificial Sequence
  Synthetic oligonucleotide; GAGAGT chr11 5286788 5286807 5286804 +
tagtttatgtttgtgtgtgt

SEQ ID NO: 59024 - DNA, 20 bp, Artificial Sequence
  Synthetic oligonucleotide; GGGGAT chr11 5286841 5286860 5286857 +
ttttttaactgtagtaaaat

SEQ ID NO: 59025 - DNA, 20 bp, Artificial Sequence
  Synthetic oligonucleotide; AAGAAT chr11 5286866 5286885 5286882 +
taataatagtatctacctga

SEQ ID NO: 59026 - DNA, 20 bp, Artificial Sequence
  Synthetic oligonucleotide; AAGAGT chr11 5286874 5286893 5286890 +
gtatctacctgaaagaatcc

SEQ ID NO: 59027 - DNA, 20 bp, Artificial Sequence
  Synthetic oligonucleotide; ATGAAT chr11 5286968 5286987 5286984 +
ttttattattacagttaaag

SEQ ID NO: 59028 - DNA, 20 bp, Artificial Sequence
  Synthetic oligonucleotide; AAGAAT chr11 5287011 5287030 5287027 +
cactagttttcacctgcagc

SEQ ID NO: 59029 - DNA, 20 bp, Artificial Sequence
  Synthetic oligonucleotide; TAGAGT chr11 5287053 5287072 5287069 +
aaaatactagcaaacatttc

SEQ ID NO: 59030 - DNA, 20 bp, Artificial Sequence
  Synthetic oligonucleotide; CGGAGT chr11 5287210 5287229 5287226 +
tgggcagattgcttgagctc

SEQ ID NO: 59031 - DNA, 20 bp, Artificial Sequence
  Synthetic oligonucleotide; CAGGAT chr11 5287312 5287331 5287328 +
tacctgtggttccagctact

SEQ ID NO: 59032 - DNA, 20 bp, Artificial Sequence
  Synthetic oligonucleotide; TTGGGT chr11 5287393 5287412 5287409 +
ttttgccactacactcccat

SEQ ID NO: 59033 - DNA, 20 bp, Artificial Sequence
  Synthetic oligonucleotide; CAGAGT chr11 5287401 5287420 5287417 +
ctacactcccatttgggtga

SEQ ID NO: 59034 - DNA, 20 bp, Artificial Sequence
  Synthetic oligonucleotide; CTGAGT chr11 5287465 5287484 5287481 +
ccattttacagatgaagaaa

SEQ ID NO: 59035 - DNA, 20 bp, Artificial Sequence
  Synthetic oligonucleotide; CTGAGT chr11 5287491 5287510 5287507 +
catacaactactaagagaaa

SEQ ID NO: 59036 - DNA, 20 bp, Artificial Sequence
  Synthetic oligonucleotide; AAGGGT chr11 5287577 5287596 5287593 +
cccaagacttttataaagtc

SEQ ID NO: 59037 - DNA, 20 bp, Artificial Sequence
  Synthetic oligonucleotide; TTGAGT chr11 5287582 5287601 5287598 +
gacttttataaagtcaaggg

SEQ ID NO: 59038 - DNA, 20 bp, Artificial Sequence
  Synthetic oligonucleotide; ATGAGT chr11 5287595 5287614 5287611 +
tcaagggttgagtcactgaa

SEQ ID NO: 59039 - DNA, 20 bp, Artificial Sequence
  Synthetic oligonucleotide; TGGGAT chr11 5287604 5287623 5287620 +
gagtcactgaaatgagttat

SEQ ID NO: 59040 - DNA, 20 bp, Artificial Sequence
  Synthetic oligonucleotide; AAGGGT chr11 5287621 5287640 5287637 +
tattgggatggctgtgtggg

SEQ ID NO: 59041 - DNA, 20 bp, Artificial Sequence
  Synthetic oligonucleotide; GAGAAT chr11 5287652 5287671 5287668 +
gttctttcctaaaggtatgt

SEQ ID NO: 59042 - DNA, 20 bp, Artificial Sequence
  Synthetic oligonucleotide; CTGGGT chr11 5287727 5287746 5287743 +
aaatctgacactcagtgggc

SEQ ID NO: 59043 - DNA, 20 bp, Artificial Sequence
  Synthetic oligonucleotide; GAGAAT chr11 5287739 5287758 5287755 +
cagtgggcctgggtgaaggt

SEQ ID NO: 59044 - DNA, 20 bp, Artificial Sequence
  Synthetic oligonucleotide; CTGAAT chr11 5287752 5287771 5287768 +
tgaaggtgagaattttattg

SEQ ID NO: 59045 - DNA, 20 bp, Artificial Sequence
  Synthetic oligonucleotide; ATGAGT chr11 5287787 5287806 5287803 +
tggggacatcttgccagtca

SEQ ID NO: 59046 - DNA, 20 bp, Artificial Sequence
  Synthetic oligonucleotide; TGGAGT chr11 5287819 5287838 5287835 +
ttcaatttccttctcagtct

SEQ ID NO: 59047 - DNA, 20 bp, Artificial Sequence
  Synthetic oligonucleotide; AAGGGT chr11 5287934 5287953 5287950 +
agagaaactgaggctcagag

SEQ ID NO: 59048 - DNA, 20 bp, Artificial Sequence
  Synthetic oligonucleotide; TTGGAT chr11 5287976 5287995 5287992 +
tgacatggaaatgatcaggc

SEQ ID NO: 59049 - DNA, 20 bp, Artificial Sequence
  Synthetic oligonucleotide; GGGAAT chr11 5288172 5288191 5288188 +
taaataagcaaaccctgctc

SEQ ID NO: 59050 - DNA, 20 bp, Artificial Sequence
  Synthetic oligonucleotide; GAGAGT chr11 5288184 5288203 5288200 +
ccctgctcgggaatgggagg

SEQ ID NO: 59051 - DNA, 20 bp, Artificial Sequence
  Synthetic oligonucleotide; TGGAGT chr11 5288193 5288212 5288209 +
ggaatgggagggagagtctc

SEQ ID NO: 59052 - DNA, 20 bp, Artificial Sequence
  Synthetic oligonucleotide; TGGAGT chr11 5288273 5288292 5288289 +
ccctgcccattgctgggcct

SEQ ID NO: 59053 - DNA, 20 bp, Artificial Sequence
  Synthetic oligonucleotide; GTGAGT chr11 5288277 5288296 5288293 +
gcccattgctgggccttgga

SEQ ID NO: 59054 - DNA, 20 bp, Artificial Sequence
  Synthetic oligonucleotide; CTGAGT chr11 5288322 5288341 5288338 +
ggcaagccatctcatagctg

SEQ ID NO: 59055 - DNA, 20 bp, Artificial Sequence
  Synthetic oligonucleotide; AAGAAT chr11 5288396 5288415 5288412 +
cttattctcacactaagaaa

SEQ ID NO: 59056 - DNA, 20 bp, Artificial Sequence
  Synthetic oligonucleotide; TGGGGT chr11 5288440 5288459 5288456 +
ctgcgtcccctcttgtgtac

SEQ ID NO: 59057 - DNA, 20 bp, Artificial Sequence
  Synthetic oligonucleotide; ATGGGT chr11 5288714 5288733 5288730 +
aatttcacatcaatgtctat

SEQ ID NO: 59058 - DNA, 20 bp, Artificial Sequence
  Synthetic oligonucleotide; GTGAAT chr11 5288793 5288812 5288809 +
tctaagaaagttacaacatg

SEQ ID NO: 59059 - DNA, 20 bp, Artificial Sequence
  Synthetic oligonucleotide; AGGAAT chr11 5288861 5288880 5288877 +
tcttgaggcctcagctttct

SEQ ID NO: 59060 - DNA, 20 bp, Artificial Sequence
  Synthetic oligonucleotide; TGGAGT chr11 5289040 5289059 5289056 +
tttcactctgctgtccaggc

SEQ ID NO: 59061 - DNA, 20 bp, Artificial Sequence
  Synthetic oligonucleotide; AGGGAT chr11 5289093 5289112 5289109 +
gccttgacctcctgagctca

SEQ ID NO: 59062 - DNA, 20 bp, Artificial Sequence
  Synthetic oligonucleotide; CTGAGT chr11 5289116 5289135 5289132 +
gatcctcccatttcggcctc

SEQ ID NO: 59063 - DNA, 20 bp, Artificial Sequence
  Synthetic oligonucleotide; CAGGAT chr11 5289204 5289223 5289220 +
cgaggtcttgctatgttgtc

SEQ ID NO: 59064 - DNA, 20 bp, Artificial Sequence
  Synthetic oligonucleotide; TGGAAT chr11 5289262 5289281 5289278 +
cacttctacctctcaagtgc

SEQ ID NO: 59065 - DNA, 20 bp, Artificial Sequence
  Synthetic oligonucleotide; AGGGAT chr11 5289333 5289352 5289349 +
ctaattcctgacactacttg

SEQ ID NO: 59066 - DNA, 20 bp, Artificial Sequence
  Synthetic oligonucleotide; ATGGGT chr11 5289374 5289393 5289390 +
acacatctttaatataccaa

SEQ ID NO: 59067 - DNA, 20 bp, Artificial Sequence
  Synthetic oligonucleotide; TAGGGT chr11 5289385 5289404 5289401 +
atataccaaatgggtgactg

SEQ ID NO: 59068 - DNA, 20 bp, Artificial Sequence
  Synthetic oligonucleotide; TAGAAT chr11 5289403 5289422 5289419 +
tgtagggttgagagggagat

SEQ ID NO: 59069 - DNA, 20 bp, Artificial Sequence
  Synthetic oligonucleotide; GGGGAT chr11 5289574 5289593 5289590 +
gtgcaaaaagggaactacct

SEQ ID NO: 59070 - DNA, 20 bp, Artificial Sequence
  Synthetic oligonucleotide; AAGAGT chr11 5289804 5289823 5289820 +
cttccaaggtctgttgcatc

SEQ ID NO: 59071 - DNA, 20 bp, Artificial Sequence
  Synthetic oligonucleotide; GAGAAT chr11 5289810 5289829 5289826 +
aggtctgttgcatcaagagt

SEQ ID NO: 59072 - DNA, 20 bp, Artificial Sequence
  Synthetic oligonucleotide; TGGGAT chr11 5289832 5289851 5289848 +
gaattgaaggtcttagaagc

SEQ ID NO: 59073 - DNA, 20 bp, Artificial Sequence
  Synthetic oligonucleotide; ATGAGT chr11 5289923 5289942 5289939 +
gatctagtcatctacaaagc

SEQ ID NO: 59074 - DNA, 20 bp, Artificial Sequence
  Synthetic oligonucleotide; GTGGGT chr11 5289930 5289949 5289946 +
tcatctacaaagcatgagtt

SEQ ID NO: 59075 - DNA, 20 bp, Artificial Sequence
  Synthetic oligonucleotide; CAGAAT chr11 5289975 5289994 5289991 +
cttttgacttcctttgacat

SEQ ID NO: 59076 - DNA, 20 bp, Artificial Sequence
  Synthetic oligonucleotide; AGGAAT chr11 5289988 5290007 5290004 +
ttgacatcagaatataacct

SEQ ID NO: 59077 - DNA, 20 bp, Artificial Sequence
  Synthetic oligonucleotide; ATGGAT chr11 5290198 5290217 5290214 +
gtgctcagggctgtgtgtgt

SEQ ID NO: 59078 - DNA, 20 bp, Artificial Sequence
  Synthetic oligonucleotide; GGGAGT chr11 5290225 5290244 5290241 +
gtttgaaatgaaactaaagt

SEQ ID NO: 59079 - DNA, 20 bp, Artificial Sequence
  Synthetic oligonucleotide; GAGAAT chr11 5290366 5290385 5290382 +
caacatcctcataataactt

SEQ ID NO: 59080 - DNA, 20 bp, Artificial Sequence
  Synthetic oligonucleotide; TAGGGT chr11 5290392 5290411 5290408 +
aattttataaaatatcacaa

SEQ ID NO: 59081 - DNA, 20 bp, Artificial Sequence
  Synthetic oligonucleotide; TAGGGT chr11 5290407 5290426 5290423 +
cacaatagggtcatgttcag

SEQ ID NO: 59082 - DNA, 20 bp, Artificial Sequence
  Synthetic oligonucleotide; TTGAGT chr11 5290440 5290459 5290456 +
aaaattagacaagccatagt

SEQ ID NO: 59083 - DNA, 20 bp, Artificial Sequence
  Synthetic oligonucleotide; TTGAAT chr11 5290454 5290473 5290470 +
catagtttgagtttaccctt

SEQ ID NO: 59084 - DNA, 20 bp, Artificial Sequence
  Synthetic oligonucleotide; ATGAGT chr11 5290493 5290512 5290509 +
aaggcaatttaattatcttt

SEQ ID NO: 59085 - DNA, 20 bp, Artificial Sequence
  Synthetic oligonucleotide; AAGAAT chr11 5290607 5290626 5290623 +
tatagttcctagcacaaagt

SEQ ID NO: 59086 - DNA, 20 bp, Artificial Sequence
  Synthetic oligonucleotide; AGGAAT chr11 5290657 5290676 5290673 +
tgtatttatctgttattaat

SEQ ID NO: 59087 - DNA, 20 bp, Artificial Sequence
  Synthetic oligonucleotide; TTGAGT chr11 5290718 5290737 5290734 +
actatgaagcaggtatttat

SEQ ID NO: 59088 - DNA, 20 bp, Artificial Sequence
  Synthetic oligonucleotide; GTGAGT chr11 5290731 5290750 5290747 +
tatttatttgagttttccaa

SEQ ID NO: 59089 - DNA, 20 bp, Artificial Sequence
  Synthetic oligonucleotide; ATGAAT chr11 5290934 5290953 5290950 +
accagccttagctgtctgct

SEQ ID NO: 59090 - DNA, 20 bp, Artificial Sequence
  Synthetic oligonucleotide; GAGGGT chr11 5290982 5291001 5290998 +
aaatgagagagagaaatggg

SEQ ID NO: 59091 - DNA, 20 bp, Artificial Sequence
  Synthetic oligonucleotide; TAGGGT chr11 5291002 5291021 5291018 +
gagggtagaaggaaggaaga

SEQ ID NO: 59092 - DNA, 20 bp, Artificial Sequence
  Synthetic oligonucleotide; TTGAAT chr11 5291087 5291106 5291103 +
aaagagctctttccattaca

SEQ ID NO: 59093 - DNA, 20 bp, Artificial Sequence
  Synthetic oligonucleotide; GTGAGT chr11 5291233 5291252 5291249 +
ttattattagaaatggggaa

SEQ ID NO: 59094 - DNA, 20 bp, Artificial Sequence
  Synthetic oligonucleotide; AGGAGT chr11 5291293 5291312 5291309 +
gggaaactggagaaactggg

SEQ ID NO: 59095 - DNA, 20 bp, Artificial Sequence
  Synthetic oligonucleotide; AAGAGT chr11 5291458 5291477 5291474 +
cagcttcagctacctctcta

SEQ ID NO: 59096 - DNA, 20 bp, Artificial Sequence
  Synthetic oligonucleotide; CAGAGT chr11 5291674 5291693 5291690 +
ctaaactgaaattgctatag

SEQ ID NO: 59097 - DNA, 20 bp, Artificial Sequence
  Synthetic oligonucleotide; AAGAGT chr11 5291710 5291729 5291726 +
gtttacagatattttccaca

SEQ ID NO: 59098 - DNA, 20 bp, Artificial Sequence
  Synthetic oligonucleotide; AAGGAT chr11 5291718 5291737 5291734 +
atattttccacaaagagtaa

SEQ ID NO: 59099 - DNA, 20 bp, Artificial Sequence
  Synthetic oligonucleotide; TAGGAT chr11 5291795 5291814 5291811 +
catattatgacgaacaacat

SEQ ID NO: 59100 - DNA, 20 bp, Artificial Sequence
  Synthetic oligonucleotide; AAGAAT chr11 5291906 5291925 5291922 +
gaaagaggagccatttgatc

SEQ ID NO: 59101 - DNA, 20 bp, Artificial Sequence
  Synthetic oligonucleotide; AAGAAT chr11 5292083 5292102 5292099 +
taaaggagaacctaaagagg

SEQ ID NO: 59102 - DNA, 20 bp, Artificial Sequence
  Synthetic oligonucleotide; AAGGGT chr11 5292154 5292173 5292170 +
aatatccttttgactgtgga

SEQ ID NO: 59103 - DNA, 20 bp, Artificial Sequence
  Synthetic oligonucleotide; AGGGAT chr11 5292218 5292237 5292234 +
agaggaacattggcttggtg

SEQ ID NO: 59104 - DNA, 20 bp, Artificial Sequence
  Synthetic oligonucleotide; CAGGAT chr11 5292242 5292261 5292258 +
atatctgtcctgatgttgtc

SEQ ID NO: 59105 - DNA, 20 bp, Artificial Sequence
  Synthetic oligonucleotide; GGGGAT chr11 5292287 5292306 5292303 +
ataacgtagagaaaacagga

SEQ ID NO: 59106 - DNA, 20 bp, Artificial Sequence
  Synthetic oligonucleotide; AGGGAT chr11 5292322 5292341 5292338 +
gacaaagaggcatcaaagat

SEQ ID NO: 59107 - DNA, 20 bp, Artificial Sequence
  Synthetic oligonucleotide; AAGGAT chr11 5292334 5292353 5292350 +
tcaaagatagggatgtttgt

SEQ ID NO: 59108 - DNA, 20 bp, Artificial Sequence
  Synthetic oligonucleotide; GAGGAT chr11 5292371 5292390 5292387 +
ttttttgcgttagtcaccgt

SEQ ID NO: 59109 - DNA, 20 bp, Artificial Sequence
  Synthetic oligonucleotide; TGGGGT chr11 5292464 5292483 5292480 +
ataataattgtgtgtattca

SEQ ID NO: 59110 - DNA, 20 bp, Artificial Sequence
  Synthetic oligonucleotide; CAGGAT chr11 5292628 5292647 5292644 +
agttaaaatgtcatatgtgt

SEQ ID NO: 59111 - DNA, 20 bp, Artificial Sequence
  Synthetic oligonucleotide; TTGAAT chr11 5292656 5292675 5292672 +
agtaatagatttagaaaaca

SEQ ID NO: 59112 - DNA, 20 bp, Artificial Sequence
  Synthetic oligonucleotide; ATGAAT chr11 5292677 5292696 5292693 +
tgaatgattccttgcaaatc

SEQ ID NO: 59113 - DNA, 20 bp, Artificial Sequence
  Synthetic oligonucleotide; AGGAAT chr11 5292764 5292783 5292780 +
cttgatcacttttggaggtc

SEQ ID NO: 59114 - DNA, 20 bp, Artificial Sequence
  Synthetic oligonucleotide; CAGAAT chr11 5292818 5292837 5292834 +
aacttgaaattgcattatag

SEQ ID NO: 59115 - DNA, 20 bp, Artificial Sequence
  Synthetic oligonucleotide; TTGAGT chr11 5292831 5292850 5292847 +
attatagcagaatgtaggcc

SEQ ID NO: 59116 - DNA, 20 bp, Artificial Sequence
  Synthetic oligonucleotide; GTGGAT chr11 5292835 5292854 5292851 +
tagcagaatgtaggccttga

SEQ ID NO: 59117 - DNA, 20 bp, Artificial Sequence
  Synthetic oligonucleotide; GTGGGT chr11 5292935 5292954 5292951 +
taagcagtttcatatgaaac

SEQ ID NO: 59118 - DNA, 20 bp, Artificial Sequence
  Synthetic oligonucleotide; CTGAGT chr11 5292978 5292997 5292994 +
acagtcagatgttcatggtc

SEQ ID NO: 59119 - DNA, 20 bp, Artificial Sequence
  Synthetic oligonucleotide; AGGAGT chr11 5293006 5293025 5293022 +
tctcctccaagcagtgggcc

SEQ ID NO: 59120 - DNA, 20 bp, Artificial Sequence
  Synthetic oligonucleotide; CAGAAT chr11 5293045 5293064 5293061 +
tgtgattgactttatcattt

SEQ ID NO: 59121 - DNA, 20 bp, Artificial Sequence
  Synthetic oligonucleotide; GAGAAT chr11 5293083 5293102 5293099 +
gccacatagaggaagggaaa

SEQ ID NO: 59122 - DNA, 20 bp, Artificial Sequence
  Synthetic oligonucleotide; GGGAGT chr11 5293111 5293130 5293127 +
tagaagggcactctgcctta

SEQ ID NO: 59123 - DNA, 20 bp, Artificial Sequence
  Synthetic oligonucleotide; CGGAAT chr11 5293246 5293265 5293262 +
tgtttctgacatactgtgtc

SEQ ID NO: 59124 - DNA, 20 bp, Artificial Sequence
  Synthetic oligonucleotide; GTGGGT chr11 5293254 5293273 5293270 +
acatactgtgtccggaattg

SEQ ID NO: 59125 - DNA, 20 bp, Artificial Sequence
  Synthetic oligonucleotide; AAGAAT chr11 5293279 5293298 5293295 +
ttcttggtttcactgacttc

SEQ ID NO: 59126 - DNA, 20 bp, Artificial Sequence
  Synthetic oligonucleotide; GTGAGT chr11 5293304 5293323 5293320 +
tgaagccggggaccctcgtg

SEQ ID NO: 59127 - DNA, 20 bp, Artificial Sequence
  Synthetic oligonucleotide; TGGAGT chr11 5293336 5293355 5293352 +
gttcttaaaggctgcgtgtg

SEQ ID NO: 59128 - DNA, 20 bp, Artificial Sequence
  Synthetic oligonucleotide; TTGGAT chr11 5293358 5293377 5293374 +
gagtttgttcgttctgatgt

SEQ ID NO: 59129 - DNA, 20 bp, Artificial Sequence
  Synthetic oligonucleotide; CGGAGT chr11 5293369 5293388 5293385 +
ttctgatgtttggatgtgtt

SEQ ID NO: 59130 - DNA, 20 bp, Artificial Sequence
  Synthetic oligonucleotide; ATGGGT chr11 5293387 5293406 5293403 +
ttcggagtttcttccttctg

SEQ ID NO: 59131 - DNA, 20 bp, Artificial Sequence
  Synthetic oligonucleotide; AGGAGT chr11 5293411 5293430 5293427 +
gttcgtggtctcgctggctc

SEQ ID NO: 59132 - DNA, 20 bp, Artificial Sequence
  Synthetic oligonucleotide; TGGAGT chr11 5293467 5293486 5293483 +
agctcttaaggcggcgcctc

SEQ ID NO: 59133 - DNA, 20 bp, Artificial Sequence
  Synthetic oligonucleotide; GTGGGT chr11 5293488 5293507 5293504 +
ggagttgttcgttcctcccg

SEQ ID NO: 59134 - DNA, 20 bp, Artificial Sequence
  Synthetic oligonucleotide; AAGAGT chr11 5293513 5293532 5293529 +
ttcgtggtctcgctggcttc

SEQ ID NO: 59135 - DNA, 20 bp, Artificial Sequence
  Synthetic oligonucleotide; GCGGGT chr11 5293647 5293666 5293663 +
cagtgtggaaggggacccga

SEQ ID NO: 59136 - DNA, 20 bp, Artificial Sequence
  Synthetic oligonucleotide; CAGAGT chr11 5293822 5293841 5293838 +
cccaccagattagctagata

SEQ ID NO: 59137 - DNA, 20 bp, Artificial Sequence
  Synthetic oligonucleotide; CAGAGT chr11 5293857 5293876 5293873 +
aaggttctccaagtccccac

SEQ ID NO: 59138 - DNA, 20 bp, Artificial Sequence
  Synthetic oligonucleotide; CAGAGT chr11 5293872 5293891 5293888 +
cccaccagagtagctagata

SEQ ID NO: 59139 - DNA, 20 bp, Artificial Sequence
  Synthetic oligonucleotide; CAGGGT chr11 5293913 5293932 5293929 +
cacaaaccctgagctagaca

SEQ ID NO: 59140 - DNA, 20 bp, Artificial Sequence
  Synthetic oligonucleotide; CCGAGT chr11 5293961 5293980 5293977 +
cttgagctagatacagactg

SEQ ID NO: 59141 - DNA, 20 bp, Artificial Sequence
  Synthetic oligonucleotide; CAGAGT chr11 5294017 5294036 5294033 +
aaggttctccacgtccccac

SEQ ID NO: 59142 - DNA, 20 bp, Artificial Sequence
  Synthetic oligonucleotide; CAGAGT chr11 5294032 5294051 5294048 +
cccaccagagtagctagata

SEQ ID NO: 59143 - DNA, 20 bp, Artificial Sequence
  Synthetic oligonucleotide; CAGGGT chr11 5294073 5294092 5294089 +
cacaaaccctgagctagaca

SEQ ID NO: 59144 - DNA, 20 bp, Artificial Sequence
  Synthetic oligonucleotide; CAGAGT chr11 5294177 5294196 5294193 +
aaggttctccaaggccccac

SEQ ID NO: 59145 - DNA, 20 bp, Artificial Sequence
  Synthetic oligonucleotide; TAGAGT chr11 5294190 5294209 5294206 +
gccccaccagagtagctaga

SEQ ID NO: 59146 - DNA, 20 bp, Artificial Sequence
  Synthetic oligonucleotide; CAGGGT chr11 5294231 5294250 5294247 +
cacaaaccctgagctagaca

SEQ ID NO: 59147 - DNA, 20 bp, Artificial Sequence
  Synthetic oligonucleotide; CAGAGT chr11 5294272 5294291 5294288 +
tacaaaccttgagctagata

SEQ ID NO: 59148 - DNA, 20 bp, Artificial Sequence
  Synthetic oligonucleotide; AAGGGT chr11 5294314 5294333 5294330 +
acaatcccttatctagacat

SEQ ID NO: 59149 - DNA, 20 bp, Artificial Sequence
  Synthetic oligonucleotide; GTGGAT chr11 5294365 5294384 5294381 +
agcctagccggcttcaccca

SEQ ID NO: 59150 - DNA, 20 bp, Artificial Sequence
  Synthetic oligonucleotide; TTGGGT chr11 5294437 5294456 5294453 +
gcgcccgcactcttcagccc

SEQ ID NO: 59151 - DNA, 20 bp, Artificial Sequence
  Synthetic oligonucleotide; CTGGGT chr11 5294454 5294473 5294470 +
cccttgggtggtcgatggga

SEQ ID NO: 59152 - DNA, 20 bp, Artificial Sequence
  Synthetic oligonucleotide; AGGAAT chr11 5294592 5294611 5294608 +
aaggcagctaaggcccggcg

SEQ ID NO: 59153 - DNA, 20 bp, Artificial Sequence
  Synthetic oligonucleotide; CCGAGT chr11 5294669 5294688 5294685 +
ggtggggccggctggcggct

SEQ ID NO: 59154 - DNA, 20 bp, Artificial Sequence
  Synthetic oligonucleotide; CGGGGT chr11 5294676 5294695 5294692 +
ccggctggcggctccgagtg

SEQ ID NO: 59155 - DNA, 20 bp, Artificial Sequence
  Synthetic oligonucleotide; AGGAAT chr11 5294989 5295008 5295005 +
cctgtgcttccaaaaataac

SEQ ID NO: 59156 - DNA, 20 bp, Artificial Sequence
  Synthetic oligonucleotide; TGGAGT chr11 5295062 5295081 5295078 +
taagcagtaaaaataagacc

SEQ ID NO: 59157 - DNA, 20 bp, Artificial Sequence
  Synthetic oligonucleotide; TGGAAT chr11 5295100 5295119 5295116 +
ccaaatgctgtaatacttca

SEQ ID NO: 59158 - DNA, 20 bp, Artificial Sequence
  Synthetic oligonucleotide; ATGAAT chr11 5295176 5295195 5295192 +
gctttaaaaaatgtttcctc

SEQ ID NO: 59159 - DNA, 20 bp, Artificial Sequence
  Synthetic oligonucleotide; ATGAGT chr11 5295228 5295247 5295244 +
gtattctagagccaaatatc

SEQ ID NO: 59160 - DNA, 20 bp, Artificial Sequence
  Synthetic oligonucleotide; TTGAAT chr11 5295233 5295252 5295249 +
ctagagccaaatatcatgag

SEQ ID NO: 59161 - DNA, 20 bp, Artificial Sequence
  Synthetic oligonucleotide; TGGAAT chr11 5295272 5295291 5295288 +
agttagtagccacttcatct

SEQ ID NO: 59162 - DNA, 20 bp, Artificial Sequence
  Synthetic oligonucleotide; AAGGGT chr11 5295316 5295335 5295332 +
gcctcagtttcctcctctta

SEQ ID NO: 59163 - DNA, 20 bp, Artificial Sequence
  Synthetic oligonucleotide; CAGAGT chr11 5295343 5295362 5295359 +
ttacaatagtacttgaggca

SEQ ID NO: 59164 - DNA, 20 bp, Artificial Sequence
  Synthetic oligonucleotide; GTGAAT chr11 5295353 5295372 5295369 +
acttgaggcacagagttact

SEQ ID NO: 59165 - DNA, 20 bp, Artificial Sequence
  Synthetic oligonucleotide; GAGGAT chr11 5295478 5295497 5295494 +
actatcctagtgtgtagatt

SEQ ID NO: 59166 - DNA, 20 bp, Artificial Sequence
  Synthetic oligonucleotide; ATGGGT chr11 5295518 5295537 5295534 +
caaagacatgaaggtcacat

SEQ ID NO: 59167 - DNA, 20 bp, Artificial Sequence
  Synthetic oligonucleotide; GGGAAT chr11 5295530 5295549 5295546 +
ggtcacatatgggtagacat

SEQ ID NO: 59168 - DNA, 20 bp, Artificial Sequence
  Synthetic oligonucleotide; AAGGAT chr11 5295558 5295577 5295574 +
atagatgagatgacattgtc

SEQ ID NO: 59169 - DNA, 20 bp, Artificial Sequence
  Synthetic oligonucleotide; ACGAGT chr11 5295567 5295586 5295583 +
atgacattgtcaaggattac

SEQ ID NO: 59170 - DNA, 20 bp, Artificial Sequence
  Synthetic oligonucleotide; GAGAAT chr11 5295640 5295659 5295656 +
tggcagaaacattttttcaa

SEQ ID NO: 59171 - DNA, 20 bp, Artificial Sequence
  Synthetic oligonucleotide; GTGGAT chr11 5295764 5295783 5295780 +
tgctgctttttgactcagag

SEQ ID NO: 59172 - DNA, 20 bp, Artificial Sequence
  Synthetic oligonucleotide; AGGAAT chr11 5295843 5295862 5295859 +
gtatttagaaggctttggag

SEQ ID NO: 59173 - DNA, 20 bp, Artificial Sequence
  Synthetic oligonucleotide; TAGAGT chr11 5295951 5295970 5295967 +
aatgtacatatatttttgac

SEQ ID NO: 59174 - DNA, 20 bp, Artificial Sequence
  Synthetic oligonucleotide; GAGAAT chr11 5296129 5296148 5296145 +
agatgtttatagtgataagt

SEQ ID NO: 59175 - DNA, 20 bp, Artificial Sequence
  Synthetic oligonucleotide; CAGAAT chr11 5296257 5296276 5296273 +
ttattttatgtgaagaaact

SEQ ID NO: 59176 - DNA, 20 bp, Artificial Sequence
  Synthetic oligonucleotide; TGGAGT chr11 5296264 5296283 5296280 +
atgtgaagaaactcagaata

SEQ ID NO: 59177 - DNA, 20 bp, Artificial Sequence
  Synthetic oligonucleotide; AAGGAT chr11 5296298 5296317 5296314 +
tctcaaattatcacttttat

SEQ ID NO: 59178 - DNA, 20 bp, Artificial Sequence
  Synthetic oligonucleotide; AAGGAT chr11 5296368 5296387 5296384 +
atctcttctcattttctatc

SEQ ID NO: 59179 - DNA, 20 bp, Artificial Sequence
  Synthetic oligonucleotide; CAGGAT chr11 5296513 5296532 5296529 +
tttagattaaaacatctaac

SEQ ID NO: 59180 - DNA, 20 bp, Artificial Sequence
  Synthetic oligonucleotide; ATGAGT chr11 5296648 5296667 5296664 +
acattagttatctcttacat

SEQ ID NO: 59181 - DNA, 20 bp, Artificial Sequence
  Synthetic oligonucleotide; ATGGGT chr11 5296751 5296770 5296767 +
catttcaacctacacaaatt

SEQ ID NO: 59182 - DNA, 20 bp, Artificial Sequence
  Synthetic oligonucleotide; AGGAAT chr11 5296801 5296820 5296817 +
gctacacagctgtttaaatt

SEQ ID NO: 59183 - DNA, 20 bp, Artificial Sequence
  Synthetic oligonucleotide; GTGAAT chr11 5296865 5296884 5296881 +
taggcatttaataaattttg

SEQ ID NO: 59184 - DNA, 20 bp, Artificial Sequence
  Synthetic oligonucleotide; GAGAAT chr11 5296932 5296951 5296948 +
cactatgatacctacttatt

SEQ ID NO: 59185 - DNA, 20 bp, Artificial Sequence
  Synthetic oligonucleotide; TTGAAT chr11 5297027 5297046 5297043 +
cctaggcacatgaaacactt

SEQ ID NO: 59186 - DNA, 20 bp, Artificial Sequence
  Synthetic oligonucleotide; GTGGAT chr11 5297099 5297118 5297115 +
catgcagaaagaagcttaat

SEQ ID NO: 59187 - DNA, 20 bp, Artificial Sequence
  Synthetic oligonucleotide; TAGAGT chr11 5297157 5297176 5297173 +
aacatcctttccctttctgt

SEQ ID NO: 59188 - DNA, 20 bp, Artificial Sequence
  Synthetic oligonucleotide; TTGGAT chr11 5297183 5297202 5297199 +
cacctgccttcatccatccc

SEQ ID NO: 59189 - DNA, 20 bp, Artificial Sequence
  Synthetic oligonucleotide; TTGAGT chr11 5297197 5297216 5297213 +
catcccttggatatgatacc

SEQ ID NO: 59190 - DNA, 20 bp, Artificial Sequence
  Synthetic oligonucleotide; CCGAAT chr11 5297357 5297376 5297373 +
cacatattgtgtttctatgg

SEQ ID NO: 59191 - DNA, 20 bp, Artificial Sequence
  Synthetic oligonucleotide; TTGGAT chr11 5297389 5297408 5297405 +
aggttctacattgtgtggtt

SEQ ID NO: 59192 - DNA, 20 bp, Artificial Sequence
  Synthetic oligonucleotide; AGGAAT chr11 5297452 5297471 5297468 +
cagtctcttcatgtgtagtc

SEQ ID NO: 59193 - DNA, 20 bp, Artificial Sequence
  Synthetic oligonucleotide; TTGAAT chr11 5297535 5297554 5297551 +
cctcttaagacactagcaac

SEQ ID NO: 59194 - DNA, 20 bp, Artificial Sequence
  Synthetic oligonucleotide; GAGGAT chr11 5297588 5297607 5297604 +
attatatactgaactcatgt

SEQ ID NO: 59195 - DNA, 20 bp, Artificial Sequence
  Synthetic oligonucleotide; TAGAGT chr11 5297660 5297679 5297676 +
gtatatcttccttgtaggta

SEQ ID NO: 59196 - DNA, 20 bp, Artificial Sequence
  Synthetic oligonucleotide; TTGGAT chr11 5297757 5297776 5297773 +
ttccttattggtcaatactt

SEQ ID NO: 59197 - DNA, 20 bp, Artificial Sequence
  Synthetic oligonucleotide; TGGGGT chr11 5297808 5297827 5297824 +
tgataataatgccaagaggc

SEQ ID NO: 59198 - DNA, 20 bp, Artificial Sequence
  Synthetic oligonucleotide; AGGAGT chr11 5297824 5297843 5297840 +
aggctggggtgagctataag

SEQ ID NO: 59199 - DNA, 20 bp, Artificial Sequence
  Synthetic oligonucleotide; AGGAAT chr11 5297852 5297871 5297868 +
aggctaatcagtacagcaag

SEQ ID NO: 59200 - DNA, 20 bp, Artificial Sequence
  Synthetic oligonucleotide; ATGAAT chr11 5297856 5297875 5297872 +
taatcagtacagcaagagga

SEQ ID NO: 59201 - DNA, 20 bp, Artificial Sequence
  Synthetic oligonucleotide; GAGGGT chr11 5297890 5297909 5297906 +
agataaagggaacggcgtgg

SEQ ID NO: 59202 - DNA, 20 bp, Artificial Sequence
  Synthetic oligonucleotide; GGGAAT chr11 5297905 5297924 5297921 +
cgtgggagggtgtttcctga

SEQ ID NO: 59203 - DNA, 20 bp, Artificial Sequence
  Synthetic oligonucleotide; GAGAAT chr11 5297927 5297946 5297943 +
gaatattcatgagacaaaca

SEQ ID NO: 59204 - DNA, 20 bp, Artificial Sequence
  Synthetic oligonucleotide; GGGAAT chr11 5297944 5297963 5297960 +
acagagaataaagaaatgaa

SEQ ID NO: 59205 - DNA, 20 bp, Artificial Sequence
  Synthetic oligonucleotide; ATGAAT chr11 5297999 5298018 5298015 +
aagtgatttctagaaagtgc

SEQ ID NO: 59206 - DNA, 20 bp, Artificial Sequence
  Synthetic oligonucleotide; GTGAAT chr11 5298044 5298063 5298060 +
aaagacctggcacttaaaat

SEQ ID NO: 59207 - DNA, 20 bp, Artificial Sequence
  Synthetic oligonucleotide; AGGAAT chr11 5298081 5298100 5298097 +
ctggctgagagaaatatctc

SEQ ID NO: 59208 - DNA, 20 bp, Artificial Sequence
  Synthetic oligonucleotide; CAGGGT chr11 5298104 5298123 5298120 +
aatggccatgttccaggctt

SEQ ID NO: 59209 - DNA, 20 bp, Artificial Sequence
  Synthetic oligonucleotide; CAGGGT chr11 5298182 5298201 5298198 +
tgtccctatcattaggaggc

SEQ ID NO: 59210 - DNA, 20 bp, Artificial Sequence
  Synthetic oligonucleotide; GAGGAT chr11 5298190 5298209 5298206 +
tcattaggaggccagggtgg

SEQ ID NO: 59211 - DNA, 20 bp, Artificial Sequence
  Synthetic oligonucleotide; AGGAAT chr11 5298207 5298226 5298223 +
tgggaggattgcttgaggtt

SEQ ID NO: 59212 - DNA, 20 bp, Artificial Sequence
  Synthetic oligonucleotide; AAGGAT chr11 5298325 5298344 5298341 +
tactcaaaaagctgaggaag

SEQ ID NO: 59213 - DNA, 20 bp, Artificial Sequence
  Synthetic oligonucleotide; CAGGAT chr11 5298341 5298360 5298357 +
gaagaaggattgcttgagcc

SEQ ID NO: 59214 - DNA, 20 bp, Artificial Sequence
  Synthetic oligonucleotide; GGGGGT chr11 5298506 5298525 5298522 +
aggactgcattaataaattt

SEQ ID NO: 59215 - DNA, 20 bp, Artificial Sequence
  Synthetic oligonucleotide; CAGAAT chr11 5298515 5298534 5298531 +
ttaataaatttgggggttta

SEQ ID NO: 59216 - DNA, 20 bp, Artificial Sequence
  Synthetic oligonucleotide; GAGAAT chr11 5298600 5298619 5298616 +
actaaactcacagtatgaca

SEQ ID NO: 59217 - DNA, 20 bp, Artificial Sequence
  Synthetic oligonucleotide; CAGGGT chr11 5298707 5298726 5298723 +
agtatggcaaacttgtcagt

SEQ ID NO: 59218 - DNA, 20 bp, Artificial Sequence
  Synthetic oligonucleotide; GAGGAT chr11 5298719 5298738 5298735 +
ttgtcagtcagggtgagact

SEQ ID NO: 59219 - DNA, 20 bp, Artificial Sequence
  Synthetic oligonucleotide; CTGGAT chr11 5298813 5298832 5298829 +
ataaatgtccttatatatca

SEQ ID NO: 59220 - DNA, 20 bp, Artificial Sequence
  Synthetic oligonucleotide; GTGGAT chr11 5298825 5298844 5298841 +
atatatcactggatcagcag

SEQ ID NO: 59221 - DNA, 20 bp, Artificial Sequence
  Synthetic oligonucleotide; AAGGAT chr11 5298848 5298867 5298864 +
gatgctgacttaataattga

SEQ ID NO: 59222 - DNA, 20 bp, Artificial Sequence
  Synthetic oligonucleotide; ATGAAT chr11 5298892 5298911 5298908 +
taaaatataatatataggtt

SEQ ID NO: 59223 - DNA, 20 bp, Artificial Sequence
  Synthetic oligonucleotide; ATGAGT chr11 5298941 5298960 5298957 +
atatacatttacttaagaaa

SEQ ID NO: 59224 - DNA, 20 bp, Artificial Sequence
  Synthetic oligonucleotide; ATGAGT chr11 5299050 5299069 5299066 +
atgtcatcccttgctaacat

SEQ ID NO: 59225 - DNA, 20 bp, Artificial Sequence
  Synthetic oligonucleotide; TAGAAT chr11 5299434 5299453 5299450 +
cagaaaacgacgtttctaaa

SEQ ID NO: 59226 - DNA, 20 bp, Artificial Sequence
  Synthetic oligonucleotide; GAGAAT chr11 5299488 5299507 5299504 +
aaataaataaattttacaca

SEQ ID NO: 59227 - DNA, 20 bp, Artificial Sequence
  Synthetic oligonucleotide; ATGAAT chr11 5299510 5299529 5299526 +
gaataacaactaaaatgaca

SEQ ID NO: 59228 - DNA, 20 bp, Artificial Sequence
  Synthetic oligonucleotide; CTGAAT chr11 5299569 5299588 5299585 +
acaaacaattcgcacaataa

SEQ ID NO: 59229 - DNA, 20 bp, Artificial Sequence
  Synthetic oligonucleotide; AGGAGT chr11 5299580 5299599 5299596 +
gcacaataactgaatccttc

SEQ ID NO: 59230 - DNA, 20 bp, Artificial Sequence
  Synthetic oligonucleotide; TGGAAT chr11 5299695 5299714 5299711 +
gtattttcttatcaaatctc

SEQ ID NO: 59231 - DNA, 20 bp, Artificial Sequence
  Synthetic oligonucleotide; CAGAGT chr11 5299706 5299725 5299722 +
tcaaatctctggaatatttt

SEQ ID NO: 59232 - DNA, 20 bp, Artificial Sequence
  Synthetic oligonucleotide; GAGAAT chr11 5299764 5299783 5299780 +
gatttcttaagtgaagcaga

SEQ ID NO: 59233 - DNA, 20 bp, Artificial Sequence
  Synthetic oligonucleotide; TAGAAT chr11 5299771 5299790 5299787 +
taagtgaagcagagagaatt

SEQ ID NO: 59234 - DNA, 20 bp, Artificial Sequence
  Synthetic oligonucleotide; TGGAAT chr11 5299776 5299795 5299792 +
gaagcagagagaatttagaa

SEQ ID NO: 59235 - DNA, 20 bp, Artificial Sequence
  Synthetic oligonucleotide; CTGGGT chr11 5299791 5299810 5299807 +
tagaatggaataattatata

SEQ ID NO: 59236 - DNA, 20 bp, Artificial Sequence
  Synthetic oligonucleotide; AGGAAT chr11 5299886 5299905 5299902 +
agaaacagcagtcttcagag

SEQ ID NO: 59237 - DNA, 20 bp, Artificial Sequence
  Synthetic oligonucleotide; ATGAAT chr11 5299890 5299909 5299906 +
acagcagtcttcagagagga

SEQ ID NO: 59238 - DNA, 20 bp, Artificial Sequence
  Synthetic oligonucleotide; ATGGGT chr11 5300206 5300225 5300222 +
aagcaagaggggaaatagaa

SEQ ID NO: 59239 - DNA, 20 bp, Artificial Sequence
  Synthetic oligonucleotide; TGGGAT chr11 5300341 5300360 5300357 +
gggaagaaggaaaacggggc

SEQ ID NO: 59240 - DNA, 20 bp, Artificial Sequence
  Synthetic oligonucleotide; ATGAGT chr11 5300460 5300479 5300476 +
actaagggaaattacatttc

SEQ ID NO: 59241 - DNA, 20 bp, Artificial Sequence
  Synthetic oligonucleotide; CAGAGT chr11 5300540 5300559 5300556 +
taatcaagcaagatcctttt

SEQ ID NO: 59242 - DNA, 20 bp, Artificial Sequence
  Synthetic oligonucleotide; TTGGAT chr11 5300721 5300740 5300737 +
aaatcatagttactcttctt

SEQ ID NO: 59243 - DNA, 20 bp, Artificial Sequence
  Synthetic oligonucleotide; TTGAAT chr11 5300885 5300904 5300901 +
ttttcatgtgataattaaaa

SEQ ID NO: 59244 - DNA, 20 bp, Artificial Sequence
  Synthetic oligonucleotide; GTGGAT chr11 5300913 5300932 5300929 +
aactctgaggaaaaaaaagt

SEQ ID NO: 59245 - DNA, 20 bp, Artificial Sequence
  Synthetic oligonucleotide; CAGGGT chr11 5300926 5300945 5300942 +
aaaaagtgtggatataaaac

SEQ ID NO: 59246 - DNA, 20 bp, Artificial Sequence
  Synthetic oligonucleotide; GCGAAT chr11 5301021 5301040 5301037 +
ctactctgcccagaaaatag

SEQ ID NO: 59247 - DNA, 20 bp, Artificial Sequence
  Synthetic oligonucleotide; TTGAAT chr11 5301036 5301055 5301052 +
aataggcgaataatgcttct

SEQ ID NO: 59248 - DNA, 20 bp, Artificial Sequence
  Synthetic oligonucleotide; TAGGAT chr11 5301068 5301087 5301084 +
ggtcttgatgctataaatga

SEQ ID NO: 59249 - DNA, 20 bp, Artificial Sequence
  Synthetic oligonucleotide; ACGAAT chr11 5301076 5301095 5301092 +
tgctataaatgataggattc

SEQ ID NO: 59250 - DNA, 20 bp, Artificial Sequence
  Synthetic oligonucleotide; GTGAAT chr11 5301150 5301169 5301166 +
ggtgcatgtttcccaaacct

SEQ ID NO: 59251 - DNA, 20 bp, Artificial Sequence
  Synthetic oligonucleotide; ATGAAT chr11 5301154 5301173 5301170 +
catgtttcccaaacctgtga

SEQ ID NO: 59252 - DNA, 20 bp, Artificial Sequence
  Synthetic oligonucleotide; GAGGAT chr11 5301270 5301289 5301286 +
gcaatgcccatcactgtctt

SEQ ID NO: 59253 - DNA, 20 bp, Artificial Sequence
  Synthetic oligonucleotide; CTGAAT chr11 5301330 5301349 5301346 +
aaaaagacagtcaaagaagt

SEQ ID NO: 59254 - DNA, 20 bp, Artificial Sequence
  Synthetic oligonucleotide; TTGGAT chr11 5301338 5301357 5301354 +
agtcaaagaagtctgaataa

SEQ ID NO: 59255 - DNA, 20 bp, Artificial Sequence
  Synthetic oligonucleotide; GCGAGT chr11 5301373 5301392 5301389 +
taaacgtgatatcagcacag

SEQ ID NO: 59256 - DNA, 20 bp, Artificial Sequence
  Synthetic oligonucleotide; ATGGGT chr11 5301434 5301453 5301450 +
gagggcacgggaaccacaat

SEQ ID NO: 59257 - DNA, 20 bp, Artificial Sequence
  Synthetic oligonucleotide; TAGAGT chr11 5301445 5301464 5301461 +
aaccacaatatgggtagcag

SEQ ID NO: 59258 - DNA, 20 bp, Artificial Sequence
  Synthetic oligonucleotide; AAGAAT chr11 5301453 5301472 5301469 +
tatgggtagcagtagagtga

SEQ ID NO: 59259 - DNA, 20 bp, Artificial Sequence
  Synthetic oligonucleotide; GGGAAT chr11 5301518 5301537 5301534 +
cagtcctatgttcatcactc

SEQ ID NO: 59260 - DNA, 20 bp, Artificial Sequence
  Synthetic oligonucleotide; AAGAAT chr11 5301528 5301547 5301544 +
ttcatcactcgggaattggt

SEQ ID NO: 59261 - DNA, 20 bp, Artificial Sequence
  Synthetic oligonucleotide; GCGGAT chr11 5301555 5301574 5301571 +
cagttgtacctcagtggtgt

SEQ ID NO: 59262 - DNA, 20 bp, Artificial Sequence
  Synthetic oligonucleotide; GTGAAT chr11 5301617 5301636 5301633 +
acctgattctacaatggcca

SEQ ID NO: 59263 - DNA, 20 bp, Artificial Sequence
  Synthetic oligonucleotide; ATGAAT chr11 5301621 5301640 5301637 +
gattctacaatggccagtga

SEQ ID NO: 59264 - DNA, 20 bp, Artificial Sequence
  Synthetic oligonucleotide; AAGGAT chr11 5301628 5301647 5301644 +
caatggccagtgaatgaatg

SEQ ID NO: 59265 - DNA, 20 bp, Artificial Sequence
  Synthetic oligonucleotide; TTGGGT chr11 5301633 5301652 5301649 +
gccagtgaatgaatgaagga

SEQ ID NO: 59266 - DNA, 20 bp, Artificial Sequence
  Synthetic oligonucleotide; GTGAAT chr11 5301706 5301725 5301722 +
ccaggactgtgggcattgta

SEQ ID NO: 59267 - DNA, 20 bp, Artificial Sequence
  Synthetic oligonucleotide; AAGAGT chr11 5301798 5301817 5301814 +
tcattccaaatgaggacaag

SEQ ID NO: 59268 - DNA, 20 bp, Artificial Sequence
  Synthetic oligonucleotide; AGGGGT chr11 5301959 5301978 5301975 +
aggtggagaagatatttttt

SEQ ID NO: 59269 - DNA, 20 bp, Artificial Sequence
  Synthetic oligonucleotide; CTGGAT chr11 5302059 5302078 5302075 +
ctcaaaacttaaatattttt

SEQ ID NO: 59270 - DNA, 20 bp, Artificial Sequence
  Synthetic oligonucleotide; TAGAAT chr11 5302113 5302132 5302129 +
gtactcacaaggcctttccc

SEQ ID NO: 59271 - DNA, 20 bp, Artificial Sequence
  Synthetic oligonucleotide; CAGAAT chr11 5302141 5302160 5302157 +
caaataacaaaaatcatggt

SEQ ID NO: 59272 - DNA, 20 bp, Artificial Sequence
  Synthetic oligonucleotide; TTGAGT chr11 5302329 5302348 5302345 +
ttactgtgttactatccaag

SEQ ID NO: 59273 - DNA, 20 bp, Artificial Sequence
  Synthetic oligonucleotide; TAGGAT chr11 5302378 5302397 5302394 +
actaatgggacagctgtatt

SEQ ID NO: 59274 - DNA, 20 bp, Artificial Sequence
  Synthetic oligonucleotide; GTGAAT chr11 5302461 5302480 5302477 +
gttgctatctcaagtggact

SEQ ID NO: 59275 - DNA, 20 bp, Artificial Sequence
  Synthetic oligonucleotide; CGGAGT chr11 5302628 5302647 5302644 +
ctgctctccagcctgggcaa

SEQ ID NO: 59276 - DNA, 20 bp, Artificial Sequence
  Synthetic oligonucleotide; GTGAGT chr11 5302694 5302713 5302710 +
aagaaaataactcatctatt

SEQ ID NO: 59277 - DNA, 20 bp, Artificial Sequence
  Synthetic oligonucleotide; GTGGGT chr11 5302728 5302747 5302744 +
aaatctgaacacctgaacaa

SEQ ID NO: 59278 - DNA, 20 bp, Artificial Sequence
  Synthetic oligonucleotide; CTGAGT chr11 5302814 5302833 5302830 +
ttccctatgctgcaaaaagt

SEQ ID NO: 59279 - DNA, 20 bp, Artificial Sequence
  Synthetic oligonucleotide; TAGAGT chr11 5302935 5302954 5302951 +
cacaaaagcctaatacttgt

SEQ ID NO: 59280 - DNA, 20 bp, Artificial Sequence
  Synthetic oligonucleotide; TTGAGT chr11 5302997 5303016 5303013 +
gtaatatcggaagttggtaa

SEQ ID NO: 59281 - DNA, 20 bp, Artificial Sequence
  Synthetic oligonucleotide; ATGAAT chr11 5303110 5303129 5303126 +
ttacagaccctctaatcatt

SEQ ID NO: 59282 - DNA, 20 bp, Artificial Sequence
  Synthetic oligonucleotide; AAGGAT chr11 5303145 5303164 5303161 +
tcgtattgagaaaaattcac

SEQ ID NO: 59283 - DNA, 20 bp, Artificial Sequence
  Synthetic oligonucleotide; CAGAGT chr11 5303336 5303355 5303352 +
caattgattctgtatgtgtc

SEQ ID NO: 59284 - DNA, 20 bp, Artificial Sequence
  Synthetic oligonucleotide; CAGAAT chr11 5303480 5303499 5303496 +
acaataataattatatgttt

SEQ ID NO: 59285 - DNA, 20 bp, Artificial Sequence
  Synthetic oligonucleotide; ATGGAT chr11 5303644 5303663 5303660 +
gtagcagagactatgttcat

SEQ ID NO: 59286 - DNA, 20 bp, Artificial Sequence
  Synthetic oligonucleotide; CTGAAT chr11 5303680 5303699 5303696 +
ctgctaactaacttgatcca

SEQ ID NO: 59287 - DNA, 20 bp, Artificial Sequence
  Synthetic oligonucleotide; AGGAGT chr11 5303732 5303751 5303748 +
cagaacttatctaccgccac

SEQ ID NO: 59288 - DNA, 20 bp, Artificial Sequence
  Synthetic oligonucleotide; GAGAAT chr11 5303788 5303807 5303804 +
cttccaatgttgccttataa

SEQ ID NO: 59289 - DNA, 20 bp, Artificial Sequence
  Synthetic oligonucleotide; ATGGAT chr11 5303792 5303811 5303808 +
caatgttgccttataagaga

SEQ ID NO: 59290 - DNA, 20 bp, Artificial Sequence
  Synthetic oligonucleotide; CAGGAT chr11 5303818 5303837 5303834 +
taatgccaaaatttgttgta

SEQ ID NO: 59291 - DNA, 20 bp, Artificial Sequence
  Synthetic oligonucleotide; TTGGAT chr11 5303841 5303860 5303857 +
gataagagctaaccacttat

SEQ ID NO: 59292 - DNA, 20 bp, Artificial Sequence
  Synthetic oligonucleotide; GCGGAT chr11 5303950 5303969 5303966 +
ctgagctgcgtttgggacat

SEQ ID NO: 59293 - DNA, 20 bp, Artificial Sequence
  Synthetic oligonucleotide; CAGGGT chr11 5303959 5303978 5303975 +
gtttgggacatgcggatgca

SEQ ID NO: 59294 - DNA, 20 bp, Artificial Sequence
  Synthetic oligonucleotide; GAGAAT chr11 5304147 5304166 5304163 +
acatacccaaatattccagg

SEQ ID NO: 59295 - DNA, 20 bp, Artificial Sequence
  Synthetic oligonucleotide; GGGAGT chr11 5304171 5304190 5304187 +
atagttgccctaatagttta

SEQ ID NO: 59296 - DNA, 20 bp, Artificial Sequence
  Synthetic oligonucleotide; TAGAAT chr11 5304181 5304200 5304197 +
taatagtttagggagtctcc

SEQ ID NO: 59297 - DNA, 20 bp, Artificial Sequence
  Synthetic oligonucleotide; GAGAGT chr11 5304205 5304224 5304221 +
atgtgatacatgacaaaagt

SEQ ID NO: 59298 - DNA, 20 bp, Artificial Sequence
  Synthetic oligonucleotide; TGGAAT chr11 5304222 5304241 5304238 +
agtgagagtcataactttag

SEQ ID NO: 59299 - DNA, 20 bp, Artificial Sequence
  Synthetic oligonucleotide; AGGGAT chr11 5304261 5304280 5304277 +
gcaagcatagaggccccctg

SEQ ID NO: 59300 - DNA, 20 bp, Artificial Sequence
  Synthetic oligonucleotide; CTGAGT chr11 5304303 5304322 5304319 +
cactgttctcttgccccttt

SEQ ID NO: 59301 - DNA, 20 bp, Artificial Sequence
  Synthetic oligonucleotide; CAGAGT chr11 5304342 5304361 5304358 +
ttctttgacagcaactatcc

SEQ ID NO: 59302 - DNA, 20 bp, Artificial Sequence
  Synthetic oligonucleotide; AAGAGT chr11 5304352 5304371 5304368 +
gcaactatcccagagtcctc

SEQ ID NO: 59303 - DNA, 20 bp, Artificial Sequence
  Synthetic oligonucleotide; GAGAAT chr11 5304478 5304497 5304494 +
ctaaaatgagaagacaaaaa

SEQ ID NO: 59304 - DNA, 20 bp, Artificial Sequence
  Synthetic oligonucleotide; CTGAAT chr11 5304562 5304581 5304578 +
ccctgtacaatcagtgtccc

SEQ ID NO: 59305 - DNA, 20 bp, Artificial Sequence
  Synthetic oligonucleotide; GTGGAT chr11 5304811 5304830 5304827 +
tagcactttggaaggctgag

SEQ ID NO: 59306 - DNA, 20 bp, Artificial Sequence
  Synthetic oligonucleotide; CTGGGT chr11 5304891 5304910 5304907 +
actaaaaatacaaaaattag

SEQ ID NO: 59307 - DNA, 20 bp, Artificial Sequence
  Synthetic oligonucleotide; GAGAAT chr11 5304944 5304963 5304960 +
tactcgggaggctgaggcag

SEQ ID NO: 59308 - DNA, 20 bp, Artificial Sequence
  Synthetic oligonucleotide; GAGGAT chr11 5305158 5305177 5305174 +
agaagcaggcacagatgtaa

SEQ ID NO: 59309 - DNA, 20 bp, Artificial Sequence
  Synthetic oligonucleotide; AGGAGT chr11 5305213 5305232 5305229 +
caatgaaaagggaagtttat

SEQ ID NO: 59310 - DNA, 20 bp, Artificial Sequence
  Synthetic oligonucleotide; GTGGAT chr11 5305217 5305236 5305233 +
gaaaagggaagtttatagga

SEQ ID NO: 59311 - DNA, 20 bp, Artificial Sequence
  Synthetic oligonucleotide; TAGAAT chr11 5305250 5305269 5305266 +
taggttaatagtgaaaaata

SEQ ID NO: 59312 - DNA, 20 bp, Artificial Sequence
  Synthetic oligonucleotide; ATGAAT chr11 5305342 5305361 5305358 +
atttcaacataatggcagaa

SEQ ID NO: 59313 - DNA, 20 bp, Artificial Sequence
  Synthetic oligonucleotide; GTGAGT chr11 5305371 5305390 5305387 +
taatgactgtgagacaaaaa

SEQ ID NO: 59314 - DNA, 20 bp, Artificial Sequence
  Synthetic oligonucleotide; GAGGGT chr11 5305435 5305454 5305451 +
cagcactttgggaggccgag

SEQ ID NO: 59315 - DNA, 20 bp, Artificial Sequence
  Synthetic oligonucleotide; GTGGAT chr11 5305439 5305458 5305455 +
actttgggaggccgaggagg

SEQ ID NO: 59316 - DNA, 20 bp, Artificial Sequence
  Synthetic oligonucleotide; TTGAGT chr11 5305448 5305467 5305464 +
ggccgaggagggtggatcac

SEQ ID NO: 59317 - DNA, 20 bp, Artificial Sequence
  Synthetic oligonucleotide; AGGAGT chr11 5305456 5305475 5305472 +
agggtggatcacttgagttc

SEQ ID NO: 59318 - DNA, 20 bp, Artificial Sequence
  Synthetic oligonucleotide; GAGAAT chr11 5305574 5305593 5305590 +
tactctggaggctgaggcat

SEQ ID NO: 59319 - DNA, 20 bp, Artificial Sequence
  Synthetic oligonucleotide; GTGAGT chr11 5305686 5305705 5305702 +
gagagagagagaaaagaaaa

SEQ ID NO: 59320 - DNA, 20 bp, Artificial Sequence
  Synthetic oligonucleotide; AGGAAT chr11 5305809 5305828 5305825 +
gcaactaatatgtgtcataa

SEQ ID NO: 59321 - DNA, 20 bp, Artificial Sequence
  Synthetic oligonucleotide; TTGAAT chr11 5305904 5305923 5305920 +
gttaaacttgcttcccgtat

SEQ ID NO: 59322 - DNA, 20 bp, Artificial Sequence
  Synthetic oligonucleotide; CTGAAT chr11 5305965 5305984 5305981 +
ttgcggtttctgagcatgac

SEQ ID NO: 59323 - DNA, 20 bp, Artificial Sequence
  Synthetic oligonucleotide; AGGGGT chr11 5306047 5306066 5306063 +
tgttacacaaacaactctca

SEQ ID NO: 59324 - DNA, 20 bp, Artificial Sequence
  Synthetic oligonucleotide; TAGGAT chr11 5306073 5306092 5306089 +
tattctagctcatttccaca

SEQ ID NO: 59325 - DNA, 20 bp, Artificial Sequence
  Synthetic oligonucleotide; GGGAAT chr11 5306083 5306102 5306099 +
catttccacataggatattt

SEQ ID NO: 59326 - DNA, 20 bp, Artificial Sequence
  Synthetic oligonucleotide; GAGAGT chr11 5306181 5306200 5306197 +
ctttattttttctttggaag

SEQ ID NO: 59327 - DNA, 20 bp, Artificial Sequence
  Synthetic oligonucleotide; ATGAGT chr11 5306233 5306252 5306249 +
tcagatgaggcatgaccgaa

SEQ ID NO: 59328 - DNA, 20 bp, Artificial Sequence
  Synthetic oligonucleotide; TAGAGT chr11 5306263 5306282 5306279 +
ctcaagtgttccattggtct

SEQ ID NO: 59329 - DNA, 20 bp, Artificial Sequence
  Synthetic oligonucleotide; GTGGGT chr11 5306483 5306502 5306499 +
gctatctcattcatatatat

SEQ ID NO: 59330 - DNA, 20 bp, Artificial Sequence
  Synthetic oligonucleotide; CAGAAT chr11 5306664 5306683 5306680 +
ttatatttaggtctgatctc

SEQ ID NO: 59331 - DNA, 20 bp, Artificial Sequence
  Synthetic oligonucleotide; ATGGGT chr11 5306763 5306782 5306779 +
accctaagacttctttcctg

SEQ ID NO: 59332 - DNA, 20 bp, Artificial Sequence
  Synthetic oligonucleotide; TTGGAT chr11 5306908 5306927 5306924 +
ttctgaaatctcttttttca

SEQ ID NO: 59333 - DNA, 20 bp, Artificial Sequence
  Synthetic oligonucleotide; CTGAGT chr11 5306920 5306939 5306936 +
ttttttcattggattatgtg

SEQ ID NO: 59334 - DNA, 20 bp, Artificial Sequence
  Synthetic oligonucleotide; CAGAAT chr11 5307187 5307206 5307203 +
atacagcaataaatgcattc

SEQ ID NO: 59335 - DNA, 20 bp, Artificial Sequence
  Synthetic oligonucleotide; GTGAGT chr11 5307316 5307335 5307332 +
aaacttctgaaagattttaa

SEQ ID NO: 59336 - DNA, 20 bp, Artificial Sequence
  Synthetic oligonucleotide; GTGGGT chr11 5307358 5307377 5307374 +
aaaatggagcttaacatata

SEQ ID NO: 59337 - DNA, 20 bp, Artificial Sequence
  Synthetic oligonucleotide; ATGAAT chr11 5307388 5307407 5307404 +
agtaagtactagttaagcaa

SEQ ID NO: 59338 - DNA, 20 bp, Artificial Sequence
  Synthetic oligonucleotide; GGGAGT chr11 5307825 5307844 5307841 +
tcttgctctgtcacccagga

SEQ ID NO: 59339 - DNA, 20 bp, Artificial Sequence
  Synthetic oligonucleotide; GTGAGT chr11 5307970 5307989 5307986 +
tcttagtactttggctgcaa

SEQ ID NO: 59340 - DNA, 20 bp, Artificial Sequence
  Synthetic oligonucleotide; AGGAGT chr11 5308493 5308512 5308509 +
aagtgtctaaatatgtatag

SEQ ID NO: 59341 - DNA, 20 bp, Artificial Sequence
  Synthetic oligonucleotide; CTGAGT chr11 5308533 5308552 5308549 +
aattgcactttgggcccctg

SEQ ID NO: 59342 - DNA, 20 bp, Artificial Sequence
  Synthetic oligonucleotide; GTGAGT chr11 5308733 5308752 5308749 +
acagccctgcatattcaaaa

SEQ ID NO: 59343 - DNA, 20 bp, Artificial Sequence
  Synthetic oligonucleotide; TTGAAT chr11 5308844 5308863 5308860 +
tggtcatcactgaagataga

SEQ ID NO: 59344 - DNA, 20 bp, Artificial Sequence
  Synthetic oligonucleotide; CAGAGT chr11 5308955 5308974 5308971 +
ctaagcatgagaaaaactaa

SEQ ID NO: 59345 - DNA, 20 bp, Artificial Sequence
  Synthetic oligonucleotide; CGGGGT chr11 5309202 5309221 5309218 +
caaatcaagatggaaatgat

SEQ ID NO: 59346 - DNA, 20 bp, Artificial Sequence
  Synthetic oligonucleotide; AGGAGT chr11 5309271 5309290 5309287 +
gggcacattatgagaaacag

SEQ ID NO: 59347 - DNA, 20 bp, Artificial Sequence
  Synthetic oligonucleotide; GGGGAT chr11 5309282 5309301 5309298 +
gagaaacagaggagtctttg

SEQ ID NO: 59348 - DNA, 20 bp, Artificial Sequence
  Synthetic oligonucleotide; TTGGGT chr11 5309375 5309394 5309391 +
aattttgcttacagcatgca

SEQ ID NO: 59349 - DNA, 20 bp, Artificial Sequence
  Synthetic oligonucleotide; TTGGAT chr11 5309480 5309499 5309496 +
ttttttaagcattccataga

SEQ ID NO: 59350 - DNA, 20 bp, Artificial Sequence
  Synthetic oligonucleotide; GCGGGT chr11 5309586 5309605 5309602 +
cagcactttgggaggccgag

SEQ ID NO: 59351 - DNA, 20 bp, Artificial Sequence
  Synthetic oligonucleotide; GTGGAT chr11 5309590 5309609 5309606 +
actttgggaggccgaggcgg

SEQ ID NO: 59352 - DNA, 20 bp, Artificial Sequence
  Synthetic oligonucleotide; GAGAAT chr11 5309725 5309744 5309741 +
tactcgggaggctgaggcag

SEQ ID NO: 59353 - DNA, 20 bp, Artificial Sequence
  Synthetic oligonucleotide; GTGGAT chr11 5309932 5309951 5309948 +
tgaaaatgtacctgtaaaat

SEQ ID NO: 59354 - DNA, 20 bp, Artificial Sequence
  Synthetic oligonucleotide; AAGGAT chr11 5309959 5309978 5309975 +
ccacatatttttaggtctgg

SEQ ID NO: 59355 - DNA, 20 bp, Artificial Sequence
  Synthetic oligonucleotide; TTGAGT chr11 5310008 5310027 5310024 +
cattatcataaaatctctag

SEQ ID NO: 59356 - DNA, 20 bp, Artificial Sequence
  Synthetic oligonucleotide; TGGAAT chr11 5310140 5310159 5310156 +
tgtctcattttcttcttcca

SEQ ID NO: 59357 - DNA, 20 bp, Artificial Sequence
  Synthetic oligonucleotide; AGGAAT chr11 5310152 5310171 5310168 +
ttcttccatggaatattcca

SEQ ID NO: 59358 - DNA, 20 bp, Artificial Sequence
  Synthetic oligonucleotide; CAGAAT chr11 5310171 5310190 5310187 +
aaggaatattctttgaaaag

SEQ ID NO: 59359 - DNA, 20 bp, Artificial Sequence
  Synthetic oligonucleotide; CAGAGT chr11 5310180 5310199 5310196 +
tctttgaaaagcagaatatt

SEQ ID NO: 59360 - DNA, 20 bp, Artificial Sequence
  Synthetic oligonucleotide; TAGAAT chr11 5310213 5310232 5310229 +
agtagagagatatatttagg

SEQ ID NO: 59361 - DNA, 20 bp, Artificial Sequence
  Synthetic oligonucleotide; AGGAAT chr11 5310262 5310281 5310278 +
tcaataattcacagtagcca

SEQ ID NO: 59362 - DNA, 20 bp, Artificial Sequence
  Synthetic oligonucleotide; TAGAAT chr11 5310329 5310348 5310345 +
aaaatgtcttatatatgtga

SEQ ID NO: 59363 - DNA, 20 bp, Artificial Sequence
  Synthetic oligonucleotide; ATGAAT chr11 5310376 5310395 5310392 +
ggtctgacacatgctacaac

SEQ ID NO: 59364 - DNA, 20 bp, Artificial Sequence
  Synthetic oligonucleotide; TAGAAT chr11 5310459 5310478 5310475 +
tttcacttacatgagctatc

SEQ ID NO: 59365 - DNA, 20 bp, Artificial Sequence
  Synthetic oligonucleotide; CAGAGT chr11 5310504 5310523 5310520 +
aaaagtagattagaagttac

SEQ ID NO: 59366 - DNA, 20 bp, Artificial Sequence
  Synthetic oligonucleotide; ATGGAT chr11 5310521 5310540 5310537 +
taccagagtgtaggaagaac

SEQ ID NO: 59367 - DNA, 20 bp, Artificial Sequence
  Synthetic oligonucleotide; GGGAGT chr11 5310529 5310548 5310545 +
tgtaggaagaacatggattg

SEQ ID NO: 59368 - DNA, 20 bp, Artificial Sequence
  Synthetic oligonucleotide; TAGAGT chr11 5310551 5310570 5310567 +
gagtaactgattaatcaata

SEQ ID NO: 59369 - DNA, 20 bp, Artificial Sequence
  Synthetic oligonucleotide; AAGAGT chr11 5310745 5310764 5310761 +
attgtgaaaggtttaaaaac

SEQ ID NO: 59370 - DNA, 20 bp, Artificial Sequence
  Synthetic oligonucleotide; TAGGAT chr11 5310851 5310870 5310867 +
acaactatatatatacatac

SEQ ID NO: 59371 - DNA, 20 bp, Artificial Sequence
  Synthetic oligonucleotide; TAGAAT chr11 5310901 5310920 5310917 +
atttatttgattttaataaa

SEQ ID NO: 59372 - DNA, 20 bp, Artificial Sequence
  Synthetic oligonucleotide; TAGGAT chr11 5310906 5310925 5310922 +
tttgattttaataaatagaa

SEQ ID NO: 59373 - DNA, 20 bp, Artificial Sequence
  Synthetic oligonucleotide; AAGAAT chr11 5310940 5310959 5310956 +
caacaatttcacttgagaga

SEQ ID NO: 59374 - DNA, 20 bp, Artificial Sequence
  Synthetic oligonucleotide; TAGGGT chr11 5311026 5311045 5311042 +
gtgaaggcatgccgcaaatc

SEQ ID NO: 59375 - DNA, 20 bp, Artificial Sequence
  Synthetic oligonucleotide; CAGAAT chr11 5311102 5311121 5311118 +
tatttactcatctggtaatt

SEQ ID NO: 59376 - DNA, 20 bp, Artificial Sequence
  Synthetic oligonucleotide; CTGGGT chr11 5311227 5311246 5311243 +
tttggactgctattttaaaa

SEQ ID NO: 59377 - DNA, 20 bp, Artificial Sequence
  Synthetic oligonucleotide; GTGAAT chr11 5311241 5311260 5311257 +
ttaaaactgggtctacttca

SEQ ID NO: 59378 - DNA, 20 bp, Artificial Sequence
  Synthetic oligonucleotide; CCGGAT chr11 5311263 5311282 5311279 +
gaatgacacccaagaaaaac

SEQ ID NO: 59379 - DNA, 20 bp, Artificial Sequence
  Synthetic oligonucleotide; TAGGAT chr11 5311285 5311304 5311301 +
ggatctatcctgctttctcc

SEQ ID NO: 59380 - DNA, 20 bp, Artificial Sequence
  Synthetic oligonucleotide; TTGGGT chr11 5311326 5311345 5311342 +
cacttattctctgaccttct

SEQ ID NO: 59381 - DNA, 20 bp, Artificial Sequence
  Synthetic oligonucleotide; TTGAAT chr11 5311455 5311474 5311471 +
gaaatacatactgaaatgat

SEQ ID NO: 59382 - DNA, 20 bp, Artificial Sequence
  Synthetic oligonucleotide; ATGAAT chr11 5311459 5311478 5311475 +
tacatactgaaatgatttga

SEQ ID NO: 59383 - DNA, 20 bp, Artificial Sequence
  Synthetic oligonucleotide; TTGAGT chr11 5311817 5311836 5311833 +
accatttccactttcctaaa

SEQ ID NO: 59384 - DNA, 20 bp, Artificial Sequence
  Synthetic oligonucleotide; ATGAAT chr11 5311921 5311940 5311937 +
gaagtaattttaaaacatca

SEQ ID NO: 59385 - DNA, 20 bp, Artificial Sequence
  Synthetic oligonucleotide; CCGAGT chr11 5311959 5311978 5311975 +
ttcagtagctttccatgact

SEQ ID NO: 59386 - DNA, 20 bp, Artificial Sequence
  Synthetic oligonucleotide; TAGAAT chr11 5312107 5312126 5312123 +
cacacacactccttcagtct

SEQ ID NO: 59387 - DNA, 20 bp, Artificial Sequence
  Synthetic oligonucleotide; GGGAAT chr11 5312184 5312203 5312200 +
gctgaagggacactttctca

SEQ ID NO: 59388 - DNA, 20 bp, Artificial Sequence
  Synthetic oligonucleotide; TTGGAT chr11 5312295 5312314 5312311 +
tcacagcacttgttttaaat

SEQ ID NO: 59389 - DNA, 20 bp, Artificial Sequence
  Synthetic oligonucleotide; TTGAGT chr11 5312313 5312332 5312329 +
atttggatttcttttattct

SEQ ID NO: 59390 - DNA, 20 bp, Artificial Sequence
  Synthetic oligonucleotide; AGGAAT chr11 5312426 5312445 5312442 +
gcccttaaaaaattaaccaa

SEQ ID NO: 59391 - DNA, 20 bp, Artificial Sequence
  Synthetic oligonucleotide; AGGAAT chr11 5312472 5312491 5312488 +
tccacgaaaataggcacatg

SEQ ID NO: 59392 - DNA, 20 bp, Artificial Sequence
  Synthetic oligonucleotide; TAGGAT chr11 5312522 5312541 5312538 +
aacacaaacccttttaaaca

SEQ ID NO: 59393 - DNA, 20 bp, Artificial Sequence
  Synthetic oligonucleotide; AAGGAT chr11 5312764 5312783 5312780 +
cttcttaaaatcaattataa

SEQ ID NO: 59394 - DNA, 20 bp, Artificial Sequence
  Synthetic oligonucleotide; TAGAAT chr11 5312853 5312872 5312869 +
tgagatcacttgtgatttat

SEQ ID NO: 59395 - DNA, 20 bp, Artificial Sequence
  Synthetic oligonucleotide; TTGAAT chr11 5312869 5312888 5312885 +
ttattagaataaaaaataaa

SEQ ID NO: 59396 - DNA, 20 bp, Artificial Sequence
  Synthetic oligonucleotide; ATGAAT chr11 5313005 5313024 5313021 +
aatgagcaactaggaaattt

SEQ ID NO: 59397 - DNA, 20 bp, Artificial Sequence
  Synthetic oligonucleotide; GAGAGT chr11 5313014 5313033 5313030 +
ctaggaaatttatgaattta

SEQ ID NO: 59398 - DNA, 20 bp, Artificial Sequence
  Synthetic oligonucleotide; TGGGAT chr11 5313108 5313127 5313124 +
tgcaaaaaaaaattgacaaa

SEQ ID NO: 59399 - DNA, 20 bp, Artificial Sequence
  Synthetic oligonucleotide; CAGAAT chr11 5313178 5313197 5313194 +
cagagataacagacaaccta

SEQ ID NO: 59400 - DNA, 20 bp, Artificial Sequence
  Synthetic oligonucleotide; TGGAGT chr11 5313230 5313249 5313246 +
tctgacaaaagtctaatatc

SEQ ID NO: 59401 - DNA, 20 bp, Artificial Sequence
  Synthetic oligonucleotide; GGGAAT chr11 5313289 5313308 5313305 +
aacaaccccattaaaaagtg

SEQ ID NO: 59402 - DNA, 20 bp, Artificial Sequence
  Synthetic oligonucleotide; ATGAAT chr11 5313298 5313317 5313314 +
attaaaaagtggggaatgac

SEQ ID NO: 59403 - DNA, 20 bp, Artificial Sequence
  Synthetic oligonucleotide; TGGGAT chr11 5313405 5313424 5313421 +
aatgcaaatcaaaaccacaa

SEQ ID NO: 59404 - DNA, 20 bp, Artificial Sequence
  Synthetic oligonucleotide; CAGAAT chr11 5313427 5313446 5313443 +
ggataccatctcacaccagt

SEQ ID NO: 59405 - DNA, 20 bp, Artificial Sequence
  Synthetic oligonucleotide; AGGAAT chr11 5313487 5313506 5313503 +
tggcaaggttgcagagagaa

SEQ ID NO: 59406 - DNA, 20 bp, Artificial Sequence
  Synthetic oligonucleotide; TGGAAT chr11 5313492 5313511 5313508 +
aggttgcagagagaaaggaa

SEQ ID NO: 59407 - DNA, 20 bp, Artificial Sequence
  Synthetic oligonucleotide; GAGAGT chr11 5313517 5313536 5313533 +
tgcttttacactgttaacgg

SEQ ID NO: 59408 - DNA, 20 bp, Artificial Sequence
  Synthetic oligonucleotide; GAGAGT chr11 5313546 5313565 5313562 +
ttagttcaaacattgtggaa

SEQ ID NO: 59409 - DNA, 20 bp, Artificial Sequence
  Synthetic oligonucleotide; CTGGGT chr11 5313610 5313629 5313626 +
ttgactcagcaatctcatta

SEQ ID NO: 59410 - DNA, 20 bp, Artificial Sequence
  Synthetic oligonucleotide; AGGAAT chr11 5313626 5313645 5313642 +
attactgggtatatacccaa

SEQ ID NO: 59411 - DNA, 20 bp, Artificial Sequence
  Synthetic oligonucleotide; TGGAAT chr11 5313703 5313722 5313719 +
tattcataatagccaagatg

SEQ ID NO: 59412 - DNA, 20 bp, Artificial Sequence
  Synthetic oligonucleotide; TAGAGT chr11 5313731 5313750 5313747 +
acccaaatgtccatcaatga

SEQ ID NO: 59413 - DNA, 20 bp, Artificial Sequence
  Synthetic oligonucleotide; GTGGAT chr11 5313735 5313754 5313751 +
aaatgtccatcaatgataga

SEQ ID NO: 59414 - DNA, 20 bp, Artificial Sequence
  Synthetic oligonucleotide; TGGAAT chr11 5313767 5313786 5313783 +
aacgtggtacatatatacca

SEQ ID NO: 59415 - DNA, 20 bp, Artificial Sequence
  Synthetic oligonucleotide; AAGGAT chr11 5313795 5313814 5313811 +
tatacagccataaaaaggaa

SEQ ID NO: 59416 - DNA, 20 bp, Artificial Sequence
  Synthetic oligonucleotide; ATGAAT chr11 5313819 5313838 5313835 +
attgtgttccttgcagggac

SEQ ID NO: 59417 - DNA, 20 bp, Artificial Sequence
  Synthetic oligonucleotide; GTGGGT chr11 5313966 5313985 5313982 +
acacaggggcctgtccggta

SEQ ID NO: 59418 - DNA, 20 bp, Artificial Sequence
  Synthetic oligonucleotide; AAGAAT chr11 5313996 5314015 5314012 +
aggagagggagagcaccagg

SEQ ID NO: 59419 - DNA, 20 bp, Artificial Sequence
  Synthetic oligonucleotide; ACGAAT chr11 5314007 5314026 5314023 +
agcaccaggaagaatagcta

SEQ ID NO: 59420 - DNA, 20 bp, Artificial Sequence
  Synthetic oligonucleotide; TAGAGT chr11 5314213 5314232 5314229 +
aaggaaaatctaccctgaaa

SEQ ID NO: 59421 - DNA, 20 bp, Artificial Sequence
  Synthetic oligonucleotide; TAGAGT chr11 5314235 5314254 5314251 +
gagtagttttgagattatag

SEQ ID NO: 59422 - DNA, 20 bp, Artificial Sequence
  Synthetic oligonucleotide; ATGAAT chr11 5314381 5314400 5314397 +
aaatggtactttcagttctt

SEQ ID NO: 59423 - DNA, 20 bp, Artificial Sequence
  Synthetic oligonucleotide; ATGAAT chr11 5314394 5314413 5314410 +
agttcttatgaatacaggtt

SEQ ID NO: 59424 - DNA, 20 bp, Artificial Sequence
  Synthetic oligonucleotide; TAGGGT chr11 5314421 5314440 5314437 +
accatattttccctgattat

SEQ ID NO: 59425 - DNA, 20 bp, Artificial Sequence
  Synthetic oligonucleotide; ATGAAT chr11 5314539 5314558 5314555 +
ataaagctttacatctacat

SEQ ID NO: 59426 - DNA, 20 bp, Artificial Sequence
  Synthetic oligonucleotide; ATGGAT chr11 5314587 5314606 5314603 +
atttatcaattgatcaattg

SEQ ID NO: 59427 - DNA, 20 bp, Artificial Sequence
  Synthetic oligonucleotide; TTGGGT chr11 5314673 5314692 5314689 +
taacactgatacaagagata

SEQ ID NO: 59428 - DNA, 20 bp, Artificial Sequence
  Synthetic oligonucleotide; TTGGAT chr11 5314794 5314813 5314810 +
aataggcgaacaatgcttct

SEQ ID NO: 59429 - DNA, 20 bp, Artificial Sequence
  Synthetic oligonucleotide; TAGGGT chr11 5314825 5314844 5314841 +
tggtttgatgctgtatataa

SEQ ID NO: 59430 - DNA, 20 bp, Artificial Sequence
  Synthetic oligonucleotide; ATGAAT chr11 5314833 5314852 5314849 +
tgctgtatataatagggttc

SEQ ID NO: 59431 - DNA, 20 bp, Artificial Sequence
  Synthetic oligonucleotide; ATGAGT chr11 5314852 5314871 5314868 +
catgaatggaggaaaaagaa

SEQ ID NO: 59432 - DNA, 20 bp, Artificial Sequence
  Synthetic oligonucleotide; GTGAAT chr11 5314908 5314927 5314924 +
ggtgcatgtttcccaaacct

SEQ ID NO: 59433 - DNA, 20 bp, Artificial Sequence
  Synthetic oligonucleotide; AAGGAT chr11 5315028 5315047 5315044 +
gcaatacctttaactgtttt

SEQ ID NO: 59434 - DNA, 20 bp, Artificial Sequence
  Synthetic oligonucleotide; CAGGAT chr11 5315034 5315053 5315050 +
cctttaactgttttaaggat

SEQ ID NO: 59435 - DNA, 20 bp, Artificial Sequence
  Synthetic oligonucleotide; CAGAAT chr11 5315088 5315107 5315104 +
aggaagaaaatcaaagcaac

SEQ ID NO: 59436 - DNA, 20 bp, Artificial Sequence
  Synthetic oligonucleotide; CTGGGT chr11 5315096 5315115 5315112 +
aatcaaagcaaccagaatag

SEQ ID NO: 59437 - DNA, 20 bp, Artificial Sequence
  Synthetic oligonucleotide; TTGAAT chr11 5315110 5315129 5315126 +
gaatagctgggtataagtga

SEQ ID NO: 59438 - DNA, 20 bp, Artificial Sequence
  Synthetic oligonucleotide; GGGAAT chr11 5315180 5315199 5315196 +
aaaggtgtggaagagaacat

SEQ ID NO: 59439 - DNA, 20 bp, Artificial Sequence
  Synthetic oligonucleotide; TGGAGT chr11 5315203 5315222 5315219 +
aatgacaatatgggaagcaa

SEQ ID NO: 59440 - DNA, 20 bp, Artificial Sequence
  Synthetic oligonucleotide; CAGAAT chr11 5315211 5315230 5315227 +
tatgggaagcaatggagtgg

SEQ ID NO: 59441 - DNA, 20 bp, Artificial Sequence
  Synthetic oligonucleotide; AGGGAT chr11 5315227 5315246 5315243 +
gtggcagaattggaggcacg

SEQ ID NO: 59442 - DNA, 20 bp, Artificial Sequence
  Synthetic oligonucleotide; GTGGAT chr11 5315308 5315327 5315324 +
tagttatacctgagaagcat

SEQ ID NO: 59443 - DNA, 20 bp, Artificial Sequence
  Synthetic oligonucleotide; GAGAAT chr11 5315344 5315363 5315360 +
cggtcataggccattgacag

SEQ ID NO: 59444 - DNA, 20 bp, Artificial Sequence
  Synthetic oligonucleotide; GTGGAT chr11 5315364 5315383 5315380 +
gagaatacctgattctgcaa

SEQ ID NO: 59445 - DNA, 20 bp, Artificial Sequence
  Synthetic oligonucleotide; GGGAGT chr11 5315373 5315392 5315389 +
tgattctgcaagtggataat

SEQ ID NO: 59446 - DNA, 20 bp, Artificial Sequence
  Synthetic oligonucleotide; GTGGAT chr11 5315377 5315396 5315393 +
tctgcaagtggataatggga

SEQ ID NO: 59447 - DNA, 20 bp, Artificial Sequence
  Synthetic oligonucleotide; ATGGAT chr11 5315410 5315429 5315426 +
acctgcaagaagcaggcccc

SEQ ID NO: 59448 - DNA, 20 bp, Artificial Sequence
  Synthetic oligonucleotide; ATGGGT chr11 5315513 5315532 5315529 +
gtgtggcaaggaaacagtac

SEQ ID NO: 59449 - DNA, 20 bp, Artificial Sequence
  Synthetic oligonucleotide; GGGGAT chr11 5315599 5315618 5315615 +
cacacataaacagcaaagaa

SEQ ID NO: 59450 - DNA, 20 bp, Artificial Sequence
  Synthetic oligonucleotide; TCGAGT chr11 5315610 5315629 5315626 +
agcaaagaaggggatggaga

SEQ ID NO: 59451 - DNA, 20 bp, Artificial Sequence
  Synthetic oligonucleotide; ATGAAT chr11 5315813 5315832 5315829 +
aataatttattggtatatgc

SEQ ID NO: 59452 - DNA, 20 bp, Artificial Sequence
  Synthetic oligonucleotide; AGGAAT chr11 5315873 5315892 5315889 +
tatagactgtgctagagata

SEQ ID NO: 59453 - DNA, 20 bp, Artificial Sequence
  Synthetic oligonucleotide; ATGAAT chr11 5315898 5315917 5315914 +
tgatgatcatttcttcagtt

SEQ ID NO: 59454 - DNA, 20 bp, Artificial Sequence
  Synthetic oligonucleotide; TTGGAT chr11 5316080 5316099 5316096 +
tgcttagcttaattgcatat

SEQ ID NO: 59455 - DNA, 20 bp, Artificial Sequence
  Synthetic oligonucleotide; TAGAAT chr11 5316176 5316195 5316192 +
ttctttgtttagttttgaaa

SEQ ID NO: 59456 - DNA, 20 bp, Artificial Sequence
  Synthetic oligonucleotide; TGGAAT chr11 5316194 5316213 5316210 +
aatagaatgttaatgtttta

SEQ ID NO: 59457 - DNA, 20 bp, Artificial Sequence
  Synthetic oligonucleotide; TGGAGT chr11 5316387 5316406 5316403 +
taggtgttggtcatcccaga

SEQ ID NO: 59458 - DNA, 20 bp, Artificial Sequence
  Synthetic oligonucleotide; AGGAAT chr11 5316462 5316481 5316478 +
catctaacataagaaggaag

SEQ ID NO: 59459 - DNA, 20 bp, Artificial Sequence
  Synthetic oligonucleotide; TGGAAT chr11 5316517 5316536 5316533 +
ctatgctgtcattttcttgc

SEQ ID NO: 59460 - DNA, 20 bp, Artificial Sequence
  Synthetic oligonucleotide; GAGAGT chr11 5316599 5316618 5316615 +
ctattcaagaggccaaatta

SEQ ID NO: 59461 - DNA, 20 bp, Artificial Sequence
  Synthetic oligonucleotide; CAGAGT chr11 5316629 5316648 5316645 +
gtatgtggaaatcacttccc

SEQ ID NO: 59462 - DNA, 20 bp, Artificial Sequence
  Synthetic oligonucleotide; AAGGAT chr11 5316742 5316761 5316758 +
gaactttcaggtatttctcc

SEQ ID NO: 59463 - DNA, 20 bp, Artificial Sequence
  Synthetic oligonucleotide; ATGGAT chr11 5316746 5316765 5316762 +
tttcaggtatttctccaagg

SEQ ID NO: 59464 - DNA, 20 bp, Artificial Sequence
  Synthetic oligonucleotide; TGGGAT chr11 5316787 5316806 5316803 +
ctccaatgccacctctacat

SEQ ID NO: 59465 - DNA, 20 bp, Artificial Sequence
  Synthetic oligonucleotide; TTGAAT chr11 5316907 5316926 5316923 +
aaagtattgagagatactag

SEQ ID NO: 59466 - DNA, 20 bp, Artificial Sequence
  Synthetic oligonucleotide; CAGGGT chr11 5316914 5316933 5316930 +
tgagagatactagttgaatg

SEQ ID NO: 59467 - DNA, 20 bp, Artificial Sequence
  Synthetic oligonucleotide; TGGAGT chr11 5316937 5316956 5316953 +
ggtcacatgtgtctttgtcc

SEQ ID NO: 59468 - DNA, 20 bp, Artificial Sequence
  Synthetic oligonucleotide; ATGGAT chr11 5317015 5317034 5317031 +
tctgatccacaggaacctca

SEQ ID NO: 59469 - DNA, 20 bp, Artificial Sequence
  Synthetic oligonucleotide; CAGGAT chr11 5317113 5317132 5317129 +
tgcccatttcataccaggtt

SEQ ID NO: 59470 - DNA, 20 bp, Artificial Sequence
  Synthetic oligonucleotide; GTGGGT chr11 5317178 5317197 5317194 +
caacatttactttagataca

SEQ ID NO: 59471 - DNA, 20 bp, Artificial Sequence
  Synthetic oligonucleotide; ATGGAT chr11 5317203 5317222 5317219 +
tacttgtgcaggttttttac

SEQ ID NO: 59472 - DNA, 20 bp, Artificial Sequence
  Synthetic oligonucleotide; GAGAAT chr11 5317355 5317374 5317371 +
tttagcttccacttataaat

SEQ ID NO: 59473 - DNA, 20 bp, Artificial Sequence
  Synthetic oligonucleotide; TAGGAT chr11 5317399 5317418 5317415 +
tgttcttgcgttaatttgct

SEQ ID NO: 59474 - DNA, 20 bp, Artificial Sequence
  Synthetic oligonucleotide; ATGGAT chr11 5317616 5317635 5317632 +
gtctaatgctctgttttcct

SEQ ID NO: 59475 - DNA, 20 bp, Artificial Sequence
  Synthetic oligonucleotide; CGGGAT chr11 5317635 5317654 5317651 +
tatggatatatacccagtag

SEQ ID NO: 59476 - DNA, 20 bp, Artificial Sequence
  Synthetic oligonucleotide; GAGAAT chr11 5317768 5317787 5317784 +
ccttttctccatagcctcat

SEQ ID NO: 59477 - DNA, 20 bp, Artificial Sequence
  Synthetic oligonucleotide; AAGAGT chr11 5317914 5317933 5317930 +
cctgtatgtcttctcttgag

SEQ ID NO: 59478 - DNA, 20 bp, Artificial Sequence
  Synthetic oligonucleotide; GTGGAT chr11 5317926 5317945 5317942 +
ctcttgagaagagtctgttc

SEQ ID NO: 59479 - DNA, 20 bp, Artificial Sequence
  Synthetic oligonucleotide; TGGAAT chr11 5317948 5317967 5317964 +
ggattttgcccatttttaaa

SEQ ID NO: 59480 - DNA, 20 bp, Artificial Sequence
  Synthetic oligonucleotide; TCGAAT chr11 5317980 5317999 5317996 +
ctttttgcttgctgatatgt

SEQ ID NO: 59481 - DNA, 20 bp, Artificial Sequence
  Synthetic oligonucleotide; CTGAAT chr11 5317998 5318017 5318014 +
gttcgaattccttatagatt

SEQ ID NO: 59482 - DNA, 20 bp, Artificial Sequence
  Synthetic oligonucleotide; GTGAAT chr11 5318031 5318050 5318047 +
cttttccagatgcacagttt

SEQ ID NO: 59483 - DNA, 20 bp, Artificial Sequence
  Synthetic oligonucleotide; TAGGGT chr11 5318133 5318152 5318149 +
tattattatactttaagttc

SEQ ID NO: 59484 - DNA, 20 bp, Artificial Sequence
  Synthetic oligonucleotide; GAGAAT chr11 5318388 5318407 5318404 +
tgtccttgtgatagtttgct

SEQ ID NO: 59485 - DNA, 20 bp, Artificial Sequence
  Synthetic oligonucleotide; TTGGGT chr11 5318518 5318537 5318534 +
attctatcattgttggacat

SEQ ID NO: 59486 - DNA, 20 bp, Artificial Sequence
  Synthetic oligonucleotide; GTGAAT chr11 5318545 5318564 5318561 +
ggttccaagtctttgttatt

SEQ ID NO: 59487 - DNA, 20 bp, Artificial Sequence
  Synthetic oligonucleotide; GTGAAT chr11 5318584 5318603 5318600 +
agtttaattaggttccactt

SEQ ID NO: 59488 - DNA, 20 bp, Artificial Sequence
  Synthetic oligonucleotide; TTGAAT chr11 5318676 5318695 5318692 +
tgagatcttacatttaagtt

SEQ ID NO: 59489 - DNA, 20 bp, Artificial Sequence
  Synthetic oligonucleotide; AAGGGT chr11 5318717 5318736 5318733 +
ttctctaaatggtgtaaggt

SEQ ID NO: 59490 - DNA, 20 bp, Artificial Sequence
  Synthetic oligonucleotide; TTGGAT chr11 5318773 5318792 5318789 +
acgtattccagcacagttta

SEQ ID NO: 59491 - DNA, 20 bp, Artificial Sequence
  Synthetic oligonucleotide; TTGAGT chr11 5318855 5318874 5318871 +
gtaactatgtagctttattt

SEQ ID NO: 59492 - DNA, 20 bp, Artificial Sequence
  Synthetic oligonucleotide; TGGGGT chr11 5318917 5318936 5318933 +
tgtaacaatatcatgctgtt

SEQ ID NO: 59493 - DNA, 20 bp, Artificial Sequence
  Synthetic oligonucleotide; CAGAGT chr11 5318996 5319015 5319012 +
tctttctttttttatttttt

SEQ ID NO: 59494 - DNA, 20 bp, Artificial Sequence
  Synthetic oligonucleotide; TGGAGT chr11 5319021 5319040 5319037 +
tttcactctgtcacccaggc

SEQ ID NO: 59495 - DNA, 20 bp, Artificial Sequence
  Synthetic oligonucleotide; CAGAGT chr11 5319065 5319084 5319081 +
ctcactgcaccgtctgcctc

SEQ ID NO: 59496 - DNA, 20 bp, Artificial Sequence
  Synthetic oligonucleotide; CCGAGT chr11 5319097 5319116 5319113 +
aattctcctgcctcagcctt

SEQ ID NO: 59497 - DNA, 20 bp, Artificial Sequence
  Synthetic oligonucleotide; TGGGAT chr11 5319106 5319125 5319122 +
gcctcagccttccgagtagc

SEQ ID NO: 59498 - DNA, 20 bp, Artificial Sequence
  Synthetic oligonucleotide; TAGAGT chr11 5319239 5319258 5319255 +
acctcagccccctaaagtgc

SEQ ID NO: 59499 - DNA, 20 bp, Artificial Sequence
  Synthetic oligonucleotide; ATGAAT chr11 5319361 5319380 5319377 +
caggctctttttggttccat

SEQ ID NO: 59500 - DNA, 20 bp, Artificial Sequence
  Synthetic oligonucleotide; AAGAAT chr11 5319393 5319412 5319409 +
ctagtttttctaatactgtg

SEQ ID NO: 59501 - DNA, 20 bp, Artificial Sequence
  Synthetic oligonucleotide; TTGGAT chr11 5319410 5319429 5319426 +
gtgaagaatgacattggtaa

SEQ ID NO: 59502 - DNA, 20 bp, Artificial Sequence
  Synthetic oligonucleotide; ATGAAT chr11 5319426 5319445 5319442 +
gtaattggatagaaattgca

SEQ ID NO: 59503 - DNA, 20 bp, Artificial Sequence
  Synthetic oligonucleotide; AAGAAT chr11 5319693 5319712 5319709 +
atcaaaggaacatacctcaa

SEQ ID NO: 59504 - DNA, 20 bp, Artificial Sequence
  Synthetic oligonucleotide; CTGAAT chr11 5319736 5319755 5319752 +
aacccataaccaaaaccata

SEQ ID NO: 59505 - DNA, 20 bp, Artificial Sequence
  Synthetic oligonucleotide; AAGGAT chr11 5319785 5319804 5319801 +
ctcgaaaactgcaacaagac

SEQ ID NO: 59506 - DNA, 20 bp, Artificial Sequence
  Synthetic oligonucleotide; CAGGAT chr11 5319992 5320011 5320008 +
aaacaattttagcaaggttt

SEQ ID NO: 59507 - DNA, 20 bp, Artificial Sequence
  Synthetic oligonucleotide; GAGAGT chr11 5320053 5320072 5320069 +
acaccaataaggcccaggct

SEQ ID NO: 59508 - DNA, 20 bp, Artificial Sequence
  Synthetic oligonucleotide; ATGAAT chr11 5320174 5320193 5320190 +
ctagaaagaaaatatttacc

SEQ ID NO: 59509 - DNA, 20 bp, Artificial Sequence
  Synthetic oligonucleotide; GTGAAT chr11 5320203 5320222 5320219 +
tacaacactatcattactac

SEQ ID NO: 59510 - DNA, 20 bp, Artificial Sequence
  Synthetic oligonucleotide; TGGGAT chr11 5320245 5320264 5320261 +
agacacatcaaataaatttc

SEQ ID NO: 59511 - DNA, 20 bp, Artificial Sequence
  Synthetic oligonucleotide; GAGAAT chr11 5320287 5320306 5320303 +
gaagaaatgctacttaagct

SEQ ID NO: 59512 - DNA, 20 bp, Artificial Sequence
  Synthetic oligonucleotide; TGGGGT chr11 5320329 5320348 5320345 +
agtagtgtagtagtatttgg

SEQ ID NO: 59513 - DNA, 20 bp, Artificial Sequence
  Synthetic oligonucleotide; ATGAAT chr11 5320534 5320553 5320550 +
gaaaaaaagcttgagagaaa

SEQ ID NO: 59514 - DNA, 20 bp, Artificial Sequence
  Synthetic oligonucleotide; GGGAAT chr11 5320610 5320629 5320626 +
acattttgacattaccataa

SEQ ID NO: 59515 - DNA, 20 bp, Artificial Sequence
  Synthetic oligonucleotide; ATGAAT chr11 5320614 5320633 5320630 +
tttgacattaccataaggga

SEQ ID NO: 59516 - DNA, 20 bp, Artificial Sequence
  Synthetic oligonucleotide; ATGAGT chr11 5320637 5320656 5320653 +
aatataaaacaagaggtatg

SEQ ID NO: 59517 - DNA, 20 bp, Artificial Sequence
  Synthetic oligonucleotide; CAGGAT chr11 5320733 5320752 5320749 +
agaacaggtaaaagaagtat

SEQ ID NO: 59518 - DNA, 20 bp, Artificial Sequence
  Synthetic oligonucleotide; TTGAAT chr11 5320808 5320827 5320824 +
atcagtagcattagaaaggc

SEQ ID NO: 59519 - DNA, 20 bp, Artificial Sequence
  Synthetic oligonucleotide; TAGAAT chr11 5320834 5320853 5320850 +
agaagagagattctatgact

SEQ ID NO: 59520 - DNA, 20 bp, Artificial Sequence
  Synthetic oligonucleotide; CTGAGT chr11 5320844 5320863 5320860 +
ttctatgacttagaatagaa

SEQ ID NO: 59521 - DNA, 20 bp, Artificial Sequence
  Synthetic oligonucleotide; CTGAAT chr11 5320896 5320915 5320912 +
agaagcgtaagtaatgccac

SEQ ID NO: 59522 - DNA, 20 bp, Artificial Sequence
  Synthetic oligonucleotide; CTGAGT chr11 5320904 5320923 5320920 +
aagtaatgccacctgaattt

SEQ ID NO: 59523 - DNA, 20 bp, Artificial Sequence
  Synthetic oligonucleotide; CTGAAT chr11 5320914 5320933 5320930 +
acctgaatttctgagttttg

SEQ ID NO: 59524 - DNA, 20 bp, Artificial Sequence
  Synthetic oligonucleotide; GAGAGT chr11 5320921 5320940 5320937 +
tttctgagttttgctgaatg

SEQ ID NO: 59525 - DNA, 20 bp, Artificial Sequence
  Synthetic oligonucleotide; ATGAGT chr11 5321015 5321034 5321031 +
tgattggtcattgtacatta

SEQ ID NO: 59526 - DNA, 20 bp, Artificial Sequence
  Synthetic oligonucleotide; GAGAAT chr11 5321053 5321072 5321069 +
gactttgtagaaaagatgaa

SEQ ID NO: 59527 - DNA, 20 bp, Artificial Sequence
  Synthetic oligonucleotide; AAGGAT chr11 5321084 5321103 5321100 +
tcaatgaagtgctttgcaca

SEQ ID NO: 59528 - DNA, 20 bp, Artificial Sequence
  Synthetic oligonucleotide; CAGGAT chr11 5321154 5321173 5321170 +
cattaacatataggtaaaga

SEQ ID NO: 59529 - DNA, 20 bp, Artificial Sequence
  Synthetic oligonucleotide; CTGAAT chr11 5321224 5321243 5321240 +
catgtggtaaagtgggaagg

SEQ ID NO: 59530 - DNA, 20 bp, Artificial Sequence
  Synthetic oligonucleotide; AAGGAT chr11 5321230 5321249 5321246 +
gtaaagtgggaaggctgaat

SEQ ID NO: 59531 - DNA, 20 bp, Artificial Sequence
  Synthetic oligonucleotide; GAGAAT chr11 5321251 5321270 5321267 +
aggatattattttgttttta

SEQ ID NO: 59532 - DNA, 20 bp, Artificial Sequence
  Synthetic oligonucleotide; AAGAGT chr11 5321294 5321313 5321310 +
ccttattaaaaatatgacag

SEQ ID NO: 59533 - DNA, 20 bp, Artificial Sequence
  Synthetic oligonucleotide; GTGGAT chr11 5321447 5321466 5321463 +
ctcaatgaaataaaatgcta

SEQ ID NO: 59534 - DNA, 20 bp, Artificial Sequence
  Synthetic oligonucleotide; TAGAAT chr11 5321467 5321486 5321483 +
gtggattcagatcaccctct

SEQ ID NO: 59535 - DNA, 20 bp, Artificial Sequence
  Synthetic oligonucleotide; GAGAAT chr11 5321521 5321540 5321537 +
ccatgaaggcaccaagaaca

SEQ ID NO: 59536 - DNA, 20 bp, Artificial Sequence
  Synthetic oligonucleotide; AAGAGT chr11 5321807 5321826 5321823 +
tggccttggccagttaaact

SEQ ID NO: 59537 - DNA, 20 bp, Artificial Sequence
  Synthetic oligonucleotide; GGGGAT chr11 5321874 5321893 5321890 +
tcaaaatttagatatcagat

SEQ ID NO: 59538 - DNA, 20 bp, Artificial Sequence
  Synthetic oligonucleotide; GGGAAT chr11 5322012 5322031 5322028 +
tcaagatagcaaatcaagat

SEQ ID NO: 59539 - DNA, 20 bp, Artificial Sequence
  Synthetic oligonucleotide; TAGGAT chr11 5322118 5322137 5322134 +
tttggtagataactgacttt

SEQ ID NO: 59540 - DNA, 20 bp, Artificial Sequence
  Synthetic oligonucleotide; TTGAGT chr11 5322124 5322143 5322140 +
agataactgacttttaggat

SEQ ID NO: 59541 - DNA, 20 bp, Artificial Sequence
  Synthetic oligonucleotide; GTGGAT chr11 5322193 5322212 5322209 +
gttttccccttttgaaattt

SEQ ID NO: 59542 - DNA, 20 bp, Artificial Sequence
  Synthetic oligonucleotide; TTGGAT chr11 5322288 5322307 5322304 +
ccaccacaattttttagtca

SEQ ID NO: 59543 - DNA, 20 bp, Artificial Sequence
  Synthetic oligonucleotide; ATGAAT chr11 5322292 5322311 5322308 +
cacaattttttagtcattgg

SEQ ID NO: 59544 - DNA, 20 bp, Artificial Sequence
  Synthetic oligonucleotide; GAGAGT chr11 5322339 5322358 5322355 +
ttgttggtcttcctaatata

SEQ ID NO: 59545 - DNA, 20 bp, Artificial Sequence
  Synthetic oligonucleotide; AAGAAT chr11 5322379 5322398 5322395 +
agagaaagtatttatggcaa

SEQ ID NO: 59546 - DNA, 20 bp, Artificial Sequence
  Synthetic oligonucleotide; TAGAAT chr11 5322465 5322484 5322481 +
atgtctcatatttttcattc

SEQ ID NO: 59547 - DNA, 20 bp, Artificial Sequence
  Synthetic oligonucleotide; TTGAAT chr11 5322488 5322507 5322504 +
aatggctatattttctattt

SEQ ID NO: 59548 - DNA, 20 bp, Artificial Sequence
  Synthetic oligonucleotide; AAGAAT chr11 5322645 5322664 5322661 +
tctaagatttttttgggcaa

SEQ ID NO: 59549 - DNA, 20 bp, Artificial Sequence
  Synthetic oligonucleotide; AAGAAT chr11 5322659 5322678 5322675 +
gggcaaaagaatatttatag

SEQ ID NO: 59550 - DNA, 20 bp, Artificial Sequence
  Synthetic oligonucleotide; AGGAAT chr11 5322707 5322726 5322723 +
taaaatccagacatcctgca

SEQ ID NO: 59551 - DNA, 20 bp, Artificial Sequence
  Synthetic oligonucleotide; GAGAGT chr11 5322802 5322821 5322818 +
aaatgcaaatcatggcccta

SEQ ID NO: 59552 - DNA, 20 bp, Artificial Sequence
  Synthetic oligonucleotide; CAGGGT chr11 5322817 5322836 5322833 +
ccctagagagtaccctaact

SEQ ID NO: 59553 - DNA, 20 bp, Artificial Sequence
  Synthetic oligonucleotide; GAGAAT chr11 5322905 5322924 5322921 +
cttatcactatatttgccat

SEQ ID NO: 59554 - DNA, 20 bp, Artificial Sequence
  Synthetic oligonucleotide; AAGAAT chr11 5322927 5322946 5322943 +
gaataatgaaaattttaaat

SEQ ID NO: 59555 - DNA, 20 bp, Artificial Sequence
  Synthetic oligonucleotide; GAGAAT chr11 5322942 5322961 5322958 +
taaataagaatttatttcta

SEQ ID NO: 59556 - DNA, 20 bp, Artificial Sequence
  Synthetic oligonucleotide; AAGAAT chr11 5323112 5323131 5323128 +
atttcaggtgcatttgaaag

SEQ ID NO: 59557 - DNA, 20 bp, Artificial Sequence
  Synthetic oligonucleotide; GTGAGT chr11 5323221 5323240 5323237 +
ggtaaagtacttaagtcctt

SEQ ID NO: 59558 - DNA, 20 bp, Artificial Sequence
  Synthetic oligonucleotide; CCGAGT chr11 5323333 5323352 5323349 +
ctgtgtctgattctccagat

SEQ ID NO: 59559 - DNA, 20 bp, Artificial Sequence
  Synthetic oligonucleotide; GCGGAT chr11 5323369 5323388 5323385 +
aacctatgtttagataaaag

SEQ ID NO: 59560 - DNA, 20 bp, Artificial Sequence
  Synthetic oligonucleotide; CAGGGT chr11 5323416 5323435 5323432 +
ggttttgatgctgtagatga

SEQ ID NO: 59561 - DNA, 20 bp, Artificial Sequence
  Synthetic oligonucleotide; ATGAAT chr11 5323502 5323521 5323518 +
cattcttcccaaatctgtaa

SEQ ID NO: 59562 - DNA, 20 bp, Artificial Sequence
  Synthetic oligonucleotide; AAGAAT chr11 5323618 5323637 5323634 +
gcaatgcctatgacagtatt

SEQ ID NO: 59563 - DNA, 20 bp, Artificial Sequence
  Synthetic oligonucleotide; TAGAAT chr11 5323624 5323643 5323640 +
cctatgacagtattaagaat

SEQ ID NO: 59564 - DNA, 20 bp, Artificial Sequence
  Synthetic oligonucleotide; GAGGAT chr11 5323639 5323658 5323655 +
agaattagaatataggagaa

SEQ ID NO: 59565 - DNA, 20 bp, Artificial Sequence
  Synthetic oligonucleotide; CAGGGT chr11 5323686 5323705 5323702 +
tgttaaagagatcaaaatta

SEQ ID NO: 59566 - DNA, 20 bp, Artificial Sequence
  Synthetic oligonucleotide; CAGGAT chr11 5323813 5323832 5323829 +
aaaagacgcaaaattacagg

SEQ ID NO: 59567 - DNA, 20 bp, Artificial Sequence
  Synthetic oligonucleotide; ATGGAT chr11 5323817 5323836 5323833 +
gacgcaaaattacaggcagg

SEQ ID NO: 59568 - DNA, 20 bp, Artificial Sequence
  Synthetic oligonucleotide; GAGAAT chr11 5323876 5323895 5323892 +
gctatgactctagtattggt

SEQ ID NO: 59569 - DNA, 20 bp, Artificial Sequence
  Synthetic oligonucleotide; AAGGAT chr11 5323896 5323915 5323912 +
gagaatggaagcatatctca

SEQ ID NO: 59570 - DNA, 20 bp, Artificial Sequence
  Synthetic oligonucleotide; GCGGAT chr11 5323903 5323922 5323919 +
gaagcatatctcaaaggatt

SEQ ID NO: 59571 - DNA, 20 bp, Artificial Sequence
  Synthetic oligonucleotide; GGGAGT chr11 5323965 5323984 5323981 +
acctgattccacaacagaaa

SEQ ID NO: 59572 - DNA, 20 bp, Artificial Sequence
  Synthetic oligonucleotide; GTGAAT chr11 5323969 5323988 5323985 +
gattccacaacagaaaggga

SEQ ID NO: 59573 - DNA, 20 bp, Artificial Sequence
  Synthetic oligonucleotide; TAGGAT chr11 5324029 5324048 5324045 +
atctccctgtgattcaccca

SEQ ID NO: 59574 - DNA, 20 bp, Artificial Sequence
  Synthetic oligonucleotide; AAGGAT chr11 5324167 5324186 5324183 +
aggagcatgccattgcccag

SEQ ID NO: 59575 - DNA, 20 bp, Artificial Sequence
  Synthetic oligonucleotide; GGGGAT chr11 5324194 5324213 5324210 +
cacacataaacagcaaagaa

SEQ ID NO: 59576 - DNA, 20 bp, Artificial Sequence
  Synthetic oligonucleotide; AAGAAT chr11 5324398 5324417 5324414 +
ctgcaactattttcctgaag

SEQ ID NO: 59577 - DNA, 20 bp, Artificial Sequence
  Synthetic oligonucleotide; CTGAGT chr11 5324446 5324465 5324462 +
ttccctaattagaaaaaata

SEQ ID NO: 59578 - DNA, 20 bp, Artificial Sequence
  Synthetic oligonucleotide; GAGGGT chr11 5324521 5324540 5324537 +
atattatccgcaactatttt

SEQ ID NO: 59579 - DNA, 20 bp, Artificial Sequence
  Synthetic oligonucleotide; ATGGAT chr11 5324585 5324604 5324601 +
cataacataaatatacataa

SEQ ID NO: 59580 - DNA, 20 bp, Artificial Sequence
  Synthetic oligonucleotide; TTGAAT chr11 5324723 5324742 5324739 +
tttctcattttttttggaaa

SEQ ID NO: 59581 - DNA, 20 bp, Artificial Sequence
  Synthetic oligonucleotide; CAGAGT chr11 5324815 5324834 5324831 +
agttacttgagcttggccac

SEQ ID NO: 59582 - DNA, 20 bp, Artificial Sequence
  Synthetic oligonucleotide; GTGGAT chr11 5324822 5324841 5324838 +
tgagcttggccaccagagtt

SEQ ID NO: 59583 - DNA, 20 bp, Artificial Sequence
  Synthetic oligonucleotide; CTGAAT chr11 5324901 5324920 5324917 +
attctgccccttccaacatt

SEQ ID NO: 59584 - DNA, 20 bp, Artificial Sequence
  Synthetic oligonucleotide; AAGGAT chr11 5325262 5325281 5325278 +
ttataatgtttccacagcct

SEQ ID NO: 59585 - DNA, 20 bp, Artificial Sequence
  Synthetic oligonucleotide; AGGGGT chr11 5325315 5325334 5325331 +
cttggttgccacgatccaag

SEQ ID NO: 59586 - DNA, 20 bp, Artificial Sequence
  Synthetic oligonucleotide; CAGAAT chr11 5325379 5325398 5325395 +
gtcttatttaacgagaaatt

SEQ ID NO: 59587 - DNA, 20 bp, Artificial Sequence
  Synthetic oligonucleotide; CAGAAT chr11 5325451 5325470 5325467 +
cctcagtatcaaaaataaat

SEQ ID NO: 59588 - DNA, 20 bp, Artificial Sequence
  Synthetic oligonucleotide; GTGAGT chr11 5325526 5325545 5325542 +
ctacctctgtatcagctcct

SEQ ID NO: 59589 - DNA, 20 bp, Artificial Sequence
  Synthetic oligonucleotide; CAGGAT chr11 5325532 5325551 5325548 +
ctgtatcagctcctgtgagt

SEQ ID NO: 59590 - DNA, 20 bp, Artificial Sequence
  Synthetic oligonucleotide; GGGAAT chr11 5325572 5325591 5325588 +
gattgaaatcaccaacacta

SEQ ID NO: 59591 - DNA, 20 bp, Artificial Sequence
  Synthetic oligonucleotide; TTGAAT chr11 5325596 5325615 5325612 +
atccctaaaattaaatcaca

SEQ ID NO: 59592 - DNA, 20 bp, Artificial Sequence
  Synthetic oligonucleotide; CTGAAT chr11 5325614 5325633 5325630 +
cattgaattcatatagaaga

SEQ ID NO: 59593 - DNA, 20 bp, Artificial Sequence
  Synthetic oligonucleotide; AGGAAT chr11 5325684 5325703 5325700 +
atgcttaaaaacacagattg

SEQ ID NO: 59594 - DNA, 20 bp, Artificial Sequence
  Synthetic oligonucleotide; GAGGAT chr11 5325692 5325711 5325708 +
aaacacagattgaggaataa

SEQ ID NO: 59595 - DNA, 20 bp, Artificial Sequence
  Synthetic oligonucleotide; CGGAAT chr11 5325701 5325720 5325717 +
ttgaggaataagaggatgta

SEQ ID NO: 59596 - DNA, 20 bp, Artificial Sequence
  Synthetic oligonucleotide; GAGAAT chr11 5325722 5325741 5325738 +
ggaatgaggtataggaggaa

SEQ ID NO: 59597 - DNA, 20 bp, Artificial Sequence
  Synthetic oligonucleotide; AAGGGT chr11 5325768 5325787 5325784 +
aattggtgacacatattctg

SEQ ID NO: 59598 - DNA, 20 bp, Artificial Sequence
  Synthetic oligonucleotide; TGGGAT chr11 5325867 5325886 5325883 +
aaaaagaaagccataaaatc

SEQ ID NO: 59599 - DNA, 20 bp, Artificial Sequence
  Synthetic oligonucleotide; AAGGAT chr11 5325893 5325912 5325909 +
tcctttaaaaaaaattgtgt

SEQ ID NO: 59600 - DNA, 20 bp, Artificial Sequence
  Synthetic oligonucleotide; TTGGGT chr11 5326077 5326096 5326093 +
atctccctccatctctaagc

SEQ ID NO: 59601 - DNA, 20 bp, Artificial Sequence
  Synthetic oligonucleotide; GGGAAT chr11 5326153 5326172 5326169 +
taaatcatgtctgagatttt

SEQ ID NO: 59602 - DNA, 20 bp, Artificial Sequence
  Synthetic oligonucleotide; GGGGAT chr11 5326228 5326247 5326244 +
ttacccagaggcaggcgtgt

SEQ ID NO: 59603 - DNA, 20 bp, Artificial Sequence
  Synthetic oligonucleotide; CTGGAT chr11 5326412 5326431 5326428 +
aagcacaagaactagttttt

SEQ ID NO: 59604 - DNA, 20 bp, Artificial Sequence
  Synthetic oligonucleotide; AAGGAT chr11 5326492 5326511 5326508 +
taaatgtttagtgatttcct

SEQ ID NO: 59605 - DNA, 20 bp, Artificial Sequence
  Synthetic oligonucleotide; TGGGGT chr11 5326499 5326518 5326515 +
ttagtgatttcctaaggatc

SEQ ID NO: 59606 - DNA, 20 bp, Artificial Sequence
  Synthetic oligonucleotide; TTGAGT chr11 5326622 5326641 5326638 +
caagttggaaaatgactatt

SEQ ID NO: 59607 - DNA, 20 bp, Artificial Sequence
  Synthetic oligonucleotide; CAGAAT chr11 5326633 5326652 5326649 +
atgactattttgagtcagca

SEQ ID NO: 59608 - DNA, 20 bp, Artificial Sequence
  Synthetic oligonucleotide; ATGAGT chr11 5326732 5326751 5326748 +
agaagctctcaatatggcct

SEQ ID NO: 59609 - DNA, 20 bp, Artificial Sequence
  Synthetic oligonucleotide; CAGAAT chr11 5326775 5326794 5326791 +
attctcccttcaattttatg

SEQ ID NO: 59610 - DNA, 20 bp, Artificial Sequence
  Synthetic oligonucleotide; TTGAAT chr11 5326788 5326807 5326804 +
ttttatgcagaatattgccc

SEQ ID NO: 59611 - DNA, 20 bp, Artificial Sequence
  Synthetic oligonucleotide; CAGGAT chr11 5326801 5326820 5326817 +
attgcccttgaatgtctcaa

SEQ ID NO: 59612 - DNA, 20 bp, Artificial Sequence
  Synthetic oligonucleotide; CTGAAT chr11 5326886 5326905 5326902 +
attctagatgttctattgac

SEQ ID NO: 59613 - DNA, 20 bp, Artificial Sequence
  Synthetic oligonucleotide; ATGAAT chr11 5326915 5326934 5326931 +
acatgatgatatatttctag

SEQ ID NO: 59614 - DNA, 20 bp, Artificial Sequence
  Synthetic oligonucleotide; TTGAAT chr11 5327016 5327035 5327032 +
gctcactttgagaacataat

SEQ ID NO: 59615 - DNA, 20 bp, Artificial Sequence
  Synthetic oligonucleotide; GGGAGT chr11 5327036 5327055 5327052 +
ttgaatgttaccagatacaa

SEQ ID NO: 59616 - DNA, 20 bp, Artificial Sequence
  Synthetic oligonucleotide; GTGAAT chr11 5327123 5327142 5327139 +
tcaagaaaatgtagtaaata

SEQ ID NO: 59617 - DNA, 20 bp, Artificial Sequence
  Synthetic oligonucleotide; CTGAGT chr11 5327218 5327237 5327234 +
tttcctactctgccctcctt

SEQ ID NO: 59618 - DNA, 20 bp, Artificial Sequence
  Synthetic oligonucleotide; TTGGAT chr11 5327223 5327242 5327239 +
tactctgccctccttctgag

SEQ ID NO: 59619 - DNA, 20 bp, Artificial Sequence
  Synthetic oligonucleotide; TAGAAT chr11 5327274 5327293 5327290 +
aaggagatgggccctgtctc

SEQ ID NO: 59620 - DNA, 20 bp, Artificial Sequence
  Synthetic oligonucleotide; GTGAGT chr11 5327287 5327306 5327303 +
ctgtctctagaatttttcta

SEQ ID NO: 59621 - DNA, 20 bp, Artificial Sequence
  Synthetic oligonucleotide; AGGGGT chr11 5327370 5327389 5327386 +
acatgcatgtgtgtgtttca

SEQ ID NO: 59622 - DNA, 20 bp, Artificial Sequence
  Synthetic oligonucleotide; TTGGAT chr11 5327381 5327400 5327397 +
tgtgtttcaaggggtgttgt

SEQ ID NO: 59623 - DNA, 20 bp, Artificial Sequence
  Synthetic oligonucleotide; CAGGAT chr11 5327441 5327460 5327457 +
acttttctttctataaattt

SEQ ID NO: 59624 - DNA, 20 bp, Artificial Sequence
  Synthetic oligonucleotide; CAGAGT chr11 5327452 5327471 5327468 +
tataaatttcaggatcttag

SEQ ID NO: 59625 - DNA, 20 bp, Artificial Sequence
  Synthetic oligonucleotide; GTGAGT chr11 5327525 5327544 5327541 +
tgtctttaatcttcaaaaaa

SEQ ID NO: 59626 - DNA, 20 bp, Artificial Sequence
  Synthetic oligonucleotide; CAGAAT chr11 5327736 5327755 5327752 +
ctaagcctttcaactcgatt

SEQ ID NO: 59627 - DNA, 20 bp, Artificial Sequence
  Synthetic oligonucleotide; CTGGAT chr11 5327833 5327852 5327849 +
aaacgtaaaataagcccttt

SEQ ID NO: 59628 - DNA, 20 bp, Artificial Sequence
  Synthetic oligonucleotide; CTGAGT chr11 5327848 5327867 5327864 +
cctttctggataaacaaaaa

SEQ ID NO: 59629 - DNA, 20 bp, Artificial Sequence
  Synthetic oligonucleotide; TTGAAT chr11 5327896 5327915 5327912 +
aaatgaccaaagatgatcat

SEQ ID NO: 59630 - DNA, 20 bp, Artificial Sequence
  Synthetic oligonucleotide; ATGAAT chr11 5327995 5328014 5328011 +
tctgcttcttattttcaaaa

SEQ ID NO: 59631 - DNA, 20 bp, Artificial Sequence
  Synthetic oligonucleotide; TAGAAT chr11 5328017 5328036 5328033 +
gaatgtattacaataaaaaa

SEQ ID NO: 59632 - DNA, 20 bp, Artificial Sequence
  Synthetic oligonucleotide; GTGAGT chr11 5328085 5328104 5328101 +
ccaataactgaacaaaggag

SEQ ID NO: 59633 - DNA, 20 bp, Artificial Sequence
  Synthetic oligonucleotide; TGGAAT chr11 5328107 5328126 5328123 +
gagtgataacaaagctgttt

SEQ ID NO: 59634 - DNA, 20 bp, Artificial Sequence
  Synthetic oligonucleotide; ATGAGT chr11 5328160 5328179 5328176 +
ataaacatctacatagaaaa

SEQ ID NO: 59635 - DNA, 20 bp, Artificial Sequence
  Synthetic oligonucleotide; AAGAAT chr11 5328166 5328185 5328182 +
atctacatagaaaaatgagt

SEQ ID NO: 59636 - DNA, 20 bp, Artificial Sequence
  Synthetic oligonucleotide; AAGGGT chr11 5328224 5328243 5328240 +
aattatacttatgccaatcc

SEQ ID NO: 59637 - DNA, 20 bp, Artificial Sequence
  Synthetic oligonucleotide; TAGGAT chr11 5328305 5328324 5328321 +
aaaaaaaaaaatctgtgctg

SEQ ID NO: 59638 - DNA, 20 bp, Artificial Sequence
  Synthetic oligonucleotide; TTGAGT chr11 5328376 5328395 5328392 +
aaccttcttatatgctttcc

SEQ ID NO: 59639 - DNA, 20 bp, Artificial Sequence
  Synthetic oligonucleotide; AGGAAT chr11 5328403 5328422 5328419 +
catctcacatcagaagagag

SEQ ID NO: 59640 - DNA, 20 bp, Artificial Sequence
  Synthetic oligonucleotide; CTGAGT chr11 5328567 5328586 5328583 +
gcatgtggaaatcacctccc

SEQ ID NO: 59641 - DNA, 20 bp, Artificial Sequence
  Synthetic oligonucleotide; CGGGAT chr11 5328662 5328681 5328678 +
ggccccacaactgatgtcct

SEQ ID NO: 59642 - DNA, 20 bp, Artificial Sequence
  Synthetic oligonucleotide; AAGAAT chr11 5328684 5328703 5328700 +
ggattttcaggtgtttcctg

SEQ ID NO: 59643 - DNA, 20 bp, Artificial Sequence
  Synthetic oligonucleotide; TGGGGT chr11 5328689 5328708 5328705 +
ttcaggtgtttcctgaagaa

SEQ ID NO: 59644 - DNA, 20 bp, Artificial Sequence
  Synthetic oligonucleotide; AGGGAT chr11 5328734 5328753 5328750 +
aaaaccagctgatgtaagat

SEQ ID NO: 59645 - DNA, 20 bp, Artificial Sequence
  Synthetic oligonucleotide; AAGGGT chr11 5328797 5328816 5328813 +
tcataacttagtttatttga

SEQ ID NO: 59646 - DNA, 20 bp, Artificial Sequence
  Synthetic oligonucleotide; GGGGAT chr11 5328805 5328824 5328821 +
tagtttatttgaaagggtta

SEQ ID NO: 59647 - DNA, 20 bp, Artificial Sequence
  Synthetic oligonucleotide; AGGGAT chr11 5328824 5328843 5328840 +
aggggatatcggttgtcttc

SEQ ID NO: 59648 - DNA, 20 bp, Artificial Sequence
  Synthetic oligonucleotide; ACGGGT chr11 5328843 5328862 5328859 +
cagggatcatatgtacctct

SEQ ID NO: 59649 - DNA, 20 bp, Artificial Sequence
  Synthetic oligonucleotide; ATGAAT chr11 5328859 5328878 5328875 +
ctctacgggtcctagagctt

SEQ ID NO: 59650 - DNA, 20 bp, Artificial Sequence
  Synthetic oligonucleotide; ATGGAT chr11 5328929 5328948 5328945 +
tcttatctactggaacttca

SEQ ID NO: 59651 - DNA, 20 bp, Artificial Sequence
  Synthetic oligonucleotide; TAGAGT chr11 5329000 5329019 5329016 +
tttttttttttttttttaga

SEQ ID NO: 59652 - DNA, 20 bp, Artificial Sequence
  Synthetic oligonucleotide; TGGAGT chr11 5329024 5329043 5329040 +
gtctcactctgtcgccaggc

SEQ ID NO: 59653 - DNA, 20 bp, Artificial Sequence
  Synthetic oligonucleotide; CGGGGT chr11 5329165 5329184 5329181 +
ttttgtatttttagtagaca

SEQ ID NO: 59654 - DNA, 20 bp, Artificial Sequence
  Synthetic oligonucleotide; CAGGAT chr11 5329185 5329204 5329201 +
cggggtttcaccatattggc

SEQ ID NO: 59655 - DNA, 20 bp, Artificial Sequence
  Synthetic oligonucleotide; TGGGAT chr11 5329242 5329261 5329258 +
tccttggcctcccaaagtgc

SEQ ID NO: 59656 - DNA, 20 bp, Artificial Sequence
  Synthetic oligonucleotide; GTGAGT chr11 5329255 5329274 5329271 +
aaagtgctgggattgcaggt

SEQ ID NO: 59657 - DNA, 20 bp, Artificial Sequence
  Synthetic oligonucleotide; CAGAAT chr11 5329374 5329393 5329390 +
aggagcatagtctttattca

SEQ ID NO: 59658 - DNA, 20 bp, Artificial Sequence
  Synthetic oligonucleotide; TGGGGT chr11 5329573 5329592 5329589 +
aaatatagtgtttgtataag

SEQ ID NO: 59659 - DNA, 20 bp, Artificial Sequence
  Synthetic oligonucleotide; GAGAAT chr11 5329647 5329666 5329663 +
atatgacaaactcaaatcaa

SEQ ID NO: 59660 - DNA, 20 bp, Artificial Sequence
  Synthetic oligonucleotide; CAGAAT chr11 5329664 5329683 5329680 +
caagagaattctagcagagc

SEQ ID NO: 59661 - DNA, 20 bp, Artificial Sequence
  Synthetic oligonucleotide; GAGAAT chr11 5329700 5329719 5329716 +
gtgagaaaattgaacacaaa

SEQ ID NO: 59662 - DNA, 20 bp, Artificial Sequence
  Synthetic oligonucleotide; TAGGGT chr11 5329780 5329799 5329796 +
tattattatactttaagttt

SEQ ID NO: 59663 - DNA, 20 bp, Artificial Sequence
  Synthetic oligonucleotide; CGGAGT chr11 5329925 5329944 5329941 +
ccccacctcacaacagtccc

SEQ ID NO: 59664 - DNA, 20 bp, Artificial Sequence
  Synthetic oligonucleotide; ATGAGT chr11 5329982 5330001 5329998 +
tcattgttcaattcccacct

SEQ ID NO: 59665 - DNA, 20 bp, Artificial Sequence
  Synthetic oligonucleotide; GAGAAT chr11 5330032 5330051 5330048 +
tgtccttgcgatagtttgct

SEQ ID NO: 59666 - DNA, 20 bp, Artificial Sequence
  Synthetic oligonucleotide; TTGGGT chr11 5330162 5330181 5330178 +
agtctatcattgttggacat

SEQ ID NO: 59667 - DNA, 20 bp, Artificial Sequence
  Synthetic oligonucleotide; GTGAAT chr11 5330189 5330208 5330205 +
ggttccaagtctttgctatt

SEQ ID NO: 59668 - DNA, 20 bp, Artificial Sequence
  Synthetic oligonucleotide; TTGGGT chr11 5330253 5330272 5330269 +
gcagcatgatttataatccg

SEQ ID NO: 59669 - DNA, 20 bp, Artificial Sequence
  Synthetic oligonucleotide; TGGGAT chr11 5330272 5330291 5330288 +
gttgggtatatacccagtaa

SEQ ID NO: 59670 - DNA, 20 bp, Artificial Sequence
  Synthetic oligonucleotide; CTGGGT chr11 5330280 5330299 5330296 +
tatacccagtaatgggatgg

SEQ ID NO: 59671 - DNA, 20 bp, Artificial Sequence
  Synthetic oligonucleotide; AGGAAT chr11 5330315 5330334 5330331 +
tttctagttctagatccctg

SEQ ID NO: 59672 - DNA, 20 bp, Artificial Sequence
  Synthetic oligonucleotide; AAGAGT chr11 5330367 5330386 5330383 +
aactagtttacagtcccacc

SEQ ID NO: 59673 - DNA, 20 bp, Artificial Sequence
  Synthetic oligonucleotide; AAGGGT chr11 5330564 5330583 5330580 +
tgatgaagcacagtgtctga

SEQ ID NO: 59674 - DNA, 20 bp, Artificial Sequence
  Synthetic oligonucleotide; AAGGAT chr11 5330679 5330698 5330695 +
gcaattcccatgaccttctt

SEQ ID NO: 59675 - DNA, 20 bp, Artificial Sequence
  Synthetic oligonucleotide; CAGAAT chr11 5330685 5330704 5330701 +
cccatgaccttcttaaggat

SEQ ID NO: 59676 - DNA, 20 bp, Artificial Sequence
  Synthetic oligonucleotide; AAGGAT chr11 5330700 5330719 5330716 +
aggatcagaatgtaagagat

SEQ ID NO: 59677 - DNA, 20 bp, Artificial Sequence
  Synthetic oligonucleotide; TAGGAT chr11 5330747 5330766 5330763 +
agttgatgagaccaggacta

SEQ ID NO: 59678 - DNA, 20 bp, Artificial Sequence
  Synthetic oligonucleotide; TGGGAT chr11 5330829 5330848 5330845 +
agaaagcatgggagaggaca

SEQ ID NO: 59679 - DNA, 20 bp, Artificial Sequence
  Synthetic oligonucleotide; GGGAAT chr11 5330844 5330863 5330860 +
ggacatgggattgacagtag

SEQ ID NO: 59680 - DNA, 20 bp, Artificial Sequence
  Synthetic oligonucleotide; GAGGGT chr11 5330855 5330874 5330871 +
tgacagtaggggaatccaga

SEQ ID NO: 59681 - DNA, 20 bp, Artificial Sequence
  Synthetic oligonucleotide; GAGAAT chr11 5330939 5330958 5330955 +
ttcaccaccttagcattggt

SEQ ID NO: 59682 - DNA, 20 bp, Artificial Sequence
  Synthetic oligonucleotide; GGGGAT chr11 5330959 5330978 5330975 +
gagaatggaggtgtatctca

SEQ ID NO: 59683 - DNA, 20 bp, Artificial Sequence
  Synthetic oligonucleotide; ATGGAT chr11 5330966 5330985 5330982 +
gaggtgtatctcaggggatt

SEQ ID NO: 59684 - DNA, 20 bp, Artificial Sequence
  Synthetic oligonucleotide; GGGAGT chr11 5331028 5331047 5331044 +
tctggactccacgatagaga

SEQ ID NO: 59685 - DNA, 20 bp, Artificial Sequence
  Synthetic oligonucleotide; GTGGAT chr11 5331032 5331051 5331048 +
gactccacgatagagaggga

SEQ ID NO: 59686 - DNA, 20 bp, Artificial Sequence
  Synthetic oligonucleotide; GAGAGT chr11 5331160 5331179 5331176 +
tatggctgccagtatagtca

SEQ ID NO: 59687 - DNA, 20 bp, Artificial Sequence
  Synthetic oligonucleotide; AAGAGT chr11 5331182 5331201 5331198 +
gagtagtacacgggctcatg

SEQ ID NO: 59688 - DNA, 20 bp, Artificial Sequence
  Synthetic oligonucleotide; AAGGAT chr11 5331271 5331290 5331287 +
aaagaaggagatagaactcc

SEQ ID NO: 59689 - DNA, 20 bp, Artificial Sequence
  Synthetic oligonucleotide; GTGGGT chr11 5331330 5331349 5331346 +
gaaaaggggcagcagtaatg

SEQ ID NO: 59690 - DNA, 20 bp, Artificial Sequence
  Synthetic oligonucleotide; GTGGAT chr11 5331342 5331361 5331358 +
cagtaatggtgggtgacatg

SEQ ID NO: 59691 - DNA, 20 bp, Artificial Sequence
  Synthetic oligonucleotide; AGGAGT chr11 5331457 5331476 5331473 +
gttctggtagtcacattaaa

SEQ ID NO: 59692 - DNA, 20 bp, Artificial Sequence
  Synthetic oligonucleotide; TCGAGT chr11 5331606 5331625 5331622 +
ttggtacaaattcttcaaaa

SEQ ID NO: 59693 - DNA, 20 bp, Artificial Sequence
  Synthetic oligonucleotide; AAGAAT chr11 5331761 5331780 5331777 +
tgcttcatcaaaaaaatgtt

SEQ ID NO: 59694 - DNA, 20 bp, Artificial Sequence
  Synthetic oligonucleotide; GTGAAT chr11 5331913 5331932 5331929 +
ctatcctaatttctaggact

SEQ ID NO: 59695 - DNA, 20 bp, Artificial Sequence
  Synthetic oligonucleotide; TGGGGT chr11 5331937 5331956 5331953 +
atatgatacaatatcatgct

SEQ ID NO: 59696 - DNA, 20 bp, Artificial Sequence
  Synthetic oligonucleotide; TTGAGT chr11 5331979 5331998 5331995 +
aagttgctgatctattgact

SEQ ID NO: 59697 - DNA, 20 bp, Artificial Sequence
  Synthetic oligonucleotide; CAGAGT chr11 5332042 5332061 5332058 +
attccatgagcccctaaaag

SEQ ID NO: 59698 - DNA, 20 bp, Artificial Sequence
  Synthetic oligonucleotide; GAGAAT chr11 5332064 5332083 5332080 +
gagttttcaccaagtagtag

SEQ ID NO: 59699 - DNA, 20 bp, Artificial Sequence
  Synthetic oligonucleotide; ATGGGT chr11 5332106 5332125 5332122 +
tcaaaatttgagaaaggttc

SEQ ID NO: 59700 - DNA, 20 bp, Artificial Sequence
  Synthetic oligonucleotide; AGGAAT chr11 5332149 5332168 5332165 +
tataaggaggtcacaaaaga

SEQ ID NO: 59701 - DNA, 20 bp, Artificial Sequence
  Synthetic oligonucleotide; CAGAGT chr11 5332245 5332264 5332261 +
acaaaaacaaacagggactt

SEQ ID NO: 59702 - DNA, 20 bp, Artificial Sequence
  Synthetic oligonucleotide; CCGGGT chr11 5332279 5332298 5332295 +
aggaaactgaactctgacag

SEQ ID NO: 59703 - DNA, 20 bp, Artificial Sequence
  Synthetic oligonucleotide; GCGGAT chr11 5332336 5332355 5332352 +
actttgggaggccaaggcgg

SEQ ID NO: 59704 - DNA, 20 bp, Artificial Sequence
  Synthetic oligonucleotide; AGGAGT chr11 5332353 5332372 5332369 +
cgggcggatcacctgaggtc

SEQ ID NO: 59705 - DNA, 20 bp, Artificial Sequence
  Synthetic oligonucleotide; GAGAAT chr11 5332472 5332491 5332488 +
tacttgggaaactgaggcag

SEQ ID NO: 59706 - DNA, 20 bp, Artificial Sequence
  Synthetic oligonucleotide; CTGGGT chr11 5332538 5332557 5332554 +
ttgtgccactgcactccagg

SEQ ID NO: 59707 - DNA, 20 bp, Artificial Sequence
  Synthetic oligonucleotide; CTGAAT chr11 5332617 5332636 5332633 +
aactgagctctgactacaat

SEQ ID NO: 59708 - DNA, 20 bp, Artificial Sequence
  Synthetic oligonucleotide; GCGAAT chr11 5332633 5332652 5332649 +
caatctgaatgaacgtggaa

SEQ ID NO: 59709 - DNA, 20 bp, Artificial Sequence
  Synthetic oligonucleotide; TTGGAT chr11 5332654 5332673 5332670 +
cgaattcttccccagagcct

SEQ ID NO: 59710 - DNA, 20 bp, Artificial Sequence
  Synthetic oligonucleotide; TTGAAT chr11 5332683 5332702 5332699 +
agcccagccctcccgatatt

SEQ ID NO: 59711 - DNA, 20 bp, Artificial Sequence
  Synthetic oligonucleotide; GAGAGT chr11 5332732 5332751 5332748 +
gagaactcagttaagcctat

SEQ ID NO: 59712 - DNA, 20 bp, Artificial Sequence
  Synthetic oligonucleotide; AAGAGT chr11 5332857 5332876 5332873 +
actattatccatattttatt

SEQ ID NO: 59713 - DNA, 20 bp, Artificial Sequence
  Synthetic oligonucleotide; TAGAGT chr11 5332866 5332885 5332882 +
catattttattaagagttta

SEQ ID NO: 59714 - DNA, 20 bp, Artificial Sequence
  Synthetic oligonucleotide; CAGGGT chr11 5332893 5332912 5332909 +
ctataataaactaatattta

SEQ ID NO: 59715 - DNA, 20 bp, Artificial Sequence
  Synthetic oligonucleotide; CAGAAT chr11 5332933 5332952 5332949 +
gtatcatttatctattatca

SEQ ID NO: 59716 - DNA, 20 bp, Artificial Sequence
  Synthetic oligonucleotide; TAGGGT chr11 5333080 5333099 5333096 +
gcaccatctgctcaggtaca

SEQ ID NO: 59717 - DNA, 20 bp, Artificial Sequence
  Synthetic oligonucleotide; CAGAGT chr11 5333405 5333424 5333421 +
aatggccctggaagcaatga

SEQ ID NO: 59718 - DNA, 20 bp, Artificial Sequence
  Synthetic oligonucleotide; GTGGAT chr11 5333621 5333640 5333637 +
aaggcagaaagggaacatag

SEQ ID NO: 59719 - DNA, 20 bp, Artificial Sequence
  Synthetic oligonucleotide; CAGAGT chr11 5333732 5333751 5333748 +
ccaccctgcacattcactcc

SEQ ID NO: 59720 - DNA, 20 bp, Artificial Sequence
  Synthetic oligonucleotide; CAGAGT chr11 5333892 5333911 5333908 +
taaaactactgtttttattt

SEQ ID NO: 59721 - DNA, 20 bp, Artificial Sequence
  Synthetic oligonucleotide; CAGAAT chr11 5333948 5333967 5333964 +
ttggaggttgatacacccgg

SEQ ID NO: 59722 - DNA, 20 bp, Artificial Sequence
  Synthetic oligonucleotide; GAGAAT chr11 5334018 5334037 5334034 +
gcaacaactatgtggtggaa

SEQ ID NO: 59723 - DNA, 20 bp, Artificial Sequence
  Synthetic oligonucleotide; TGGGGT chr11 5334096 5334115 5334112 +
atagtcactagagcctgacc

SEQ ID NO: 59724 - DNA, 20 bp, Artificial Sequence
  Synthetic oligonucleotide; CTGAGT chr11 5334129 5334148 5334145 +
attaaggggagaggtaattg

SEQ ID NO: 59725 - DNA, 20 bp, Artificial Sequence
  Synthetic oligonucleotide; CAGGGT chr11 5334180 5334199 5334196 +
gtatctctgaagactgctaa

SEQ ID NO: 59726 - DNA, 20 bp, Artificial Sequence
  Synthetic oligonucleotide; CTGGAT chr11 5334239 5334258 5334255 +
ccccagtatctgtcttgatg

SEQ ID NO: 59727 - DNA, 20 bp, Artificial Sequence
  Synthetic oligonucleotide; TGGGAT chr11 5334256 5334275 5334272 +
atgctggataattaggctac

SEQ ID NO: 59728 - DNA, 20 bp, Artificial Sequence
  Synthetic oligonucleotide; CAGAAT chr11 5334347 5334366 5334363 +
ttttctttgcaaaaagaaaa

SEQ ID NO: 59729 - DNA, 20 bp, Artificial Sequence
  Synthetic oligonucleotide; ATGAGT chr11 5334566 5334585 5334582 +
tttgttatatatactcacaa

SEQ ID NO: 59730 - DNA, 20 bp, Artificial Sequence
  Synthetic oligonucleotide; AAGAAT chr11 5334632 5334651 5334648 +
tctcttggtaagtcttgccc

SEQ ID NO: 59731 - DNA, 20 bp, Artificial Sequence
  Synthetic oligonucleotide; CAGAGT chr11 5334638 5334657 5334654 +
ggtaagtcttgcccaagaat

SEQ ID NO: 59732 - DNA, 20 bp, Artificial Sequence
  Synthetic oligonucleotide; TTGAAT chr11 5334767 5334786 5334783 +
ctttgtctgacaatttgtac

SEQ ID NO: 59733 - DNA, 20 bp, Artificial Sequence
  Synthetic oligonucleotide; AAGGAT chr11 5334802 5334821 5334818 +
tcatagtctgtcagagaaat

SEQ ID NO: 59734 - DNA, 20 bp, Artificial Sequence
  Synthetic oligonucleotide; GAGAAT chr11 5334810 5334829 5334826 +
tgtcagagaaataaggatct

SEQ ID NO: 59735 - DNA, 20 bp, Artificial Sequence
  Synthetic oligonucleotide; ATGAGT chr11 5334884 5334903 5334900 +
cccaactatgagattttaaa

SEQ ID NO: 59736 - DNA, 20 bp, Artificial Sequence
  Synthetic oligonucleotide; ATGGGT chr11 5334890 5334909 5334906 +
tatgagattttaaaatgagt

SEQ ID NO: 59737 - DNA, 20 bp, Artificial Sequence
  Synthetic oligonucleotide; GAGGGT chr11 5334913 5334932 5334929 +
ggtgcaatgtggtgaaccat

SEQ ID NO: 59738 - DNA, 20 bp, Artificial Sequence
  Synthetic oligonucleotide; CAGAAT chr11 5334999 5335018 5335015 +
taggtcttcctaaatgtaag

SEQ ID NO: 59739 - DNA, 20 bp, Artificial Sequence
  Synthetic oligonucleotide; CTGGAT chr11 5335098 5335117 5335114 +
tactaagttaaaatttaggt

SEQ ID NO: 59740 - DNA, 20 bp, Artificial Sequence
  Synthetic oligonucleotide; ACGAAT chr11 5335231 5335250 5335247 +
gaccctctcactggcagtac

SEQ ID NO: 59741 - DNA, 20 bp, Artificial Sequence
  Synthetic oligonucleotide; CAGAGT chr11 5335320 5335339 5335336 +
taatttcctgcagactgccc

SEQ ID NO: 59742 - DNA, 20 bp, Artificial Sequence
  Synthetic oligonucleotide; TGGGAT chr11 5335326 5335345 5335342 +
cctgcagactgccccagagt

SEQ ID NO: 59743 - DNA, 20 bp, Artificial Sequence
  Synthetic oligonucleotide; GAGGAT chr11 5335362 5335381 5335378 +
gtgaagtgacactgttggtg

SEQ ID NO: 59744 - DNA, 20 bp, Artificial Sequence
  Synthetic oligonucleotide; GAGAAT chr11 5335377 5335396 5335393 +
tggtggaggataagcctcca

SEQ ID NO: 59745 - DNA, 20 bp, Artificial Sequence
  Synthetic oligonucleotide; AAGGGT chr11 5335654 5335673 5335670 +
ttgatgcagtgtttcctgac

SEQ ID NO: 59746 - DNA, 20 bp, Artificial Sequence
  Synthetic oligonucleotide; CTGAGT chr11 5335666 5335685 5335682 +
ttcctgacaagggtcatccg

SEQ ID NO: 59747 - DNA, 20 bp, Artificial Sequence
  Synthetic oligonucleotide; TAGAAT chr11 5335709 5335728 5335725 +
tcacataacacaatatttat

SEQ ID NO: 59748 - DNA, 20 bp, Artificial Sequence
  Synthetic oligonucleotide; TAGGAT chr11 5335934 5335953 5335950 +
attcaggaaggtctctatcc

SEQ ID NO: 59749 - DNA, 20 bp, Artificial Sequence
  Synthetic oligonucleotide; TTGAGT chr11 5335952 5335971 5335968 +
cctaggatttttgctgtttg

SEQ ID NO: 59750 - DNA, 20 bp, Artificial Sequence
  Synthetic oligonucleotide; CTGGAT chr11 5336031 5336050 5336047 +
ttctattatctgtcagcctt

SEQ ID NO: 59751 - DNA, 20 bp, Artificial Sequence
  Synthetic oligonucleotide; TGGGGT chr11 5336124 5336143 5336140 +
atgccaatttgactgggcca

SEQ ID NO: 59752 - DNA, 20 bp, Artificial Sequence
  Synthetic oligonucleotide; GAGGGT chr11 5336169 5336188 5336185 +
attattctagatgtttttgt

SEQ ID NO: 59753 - DNA, 20 bp, Artificial Sequence
  Synthetic oligonucleotide; CTGAAT chr11 5336267 5336286 5336283 +
tcctccaatcagttgaaaac

SEQ ID NO: 59754 - DNA, 20 bp, Artificial Sequence
  Synthetic oligonucleotide; GAGAAT chr11 5336306 5336325 5336322 +
tgacccttccccaaatcaga

SEQ ID NO: 59755 - DNA, 20 bp, Artificial Sequence
  Synthetic oligonucleotide; TGGAAT chr11 5336337 5336356 5336353 +
cttattgatggccttcaaac

SEQ ID NO: 59756 - DNA, 20 bp, Artificial Sequence
  Synthetic oligonucleotide; CTGGGT chr11 5336391 5336410 5336407 +
aactgaaacatcaaaacttc

SEQ ID NO: 59757 - DNA, 20 bp, Artificial Sequence
  Synthetic oligonucleotide; TTGGGT chr11 5336414 5336433 5336430 +
ggtctgaagcctgatggctt

SEQ ID NO: 59758 - DNA, 20 bp, Artificial Sequence
  Synthetic oligonucleotide; TTGAGT chr11 5336492 5336511 5336508 +
gactaaactaccaggctctc

SEQ ID NO: 59759 - DNA, 20 bp, Artificial Sequence
  Synthetic oligonucleotide; GTGAAT chr11 5336625 5336644 5336641 +
cattatttttttttaatgca

SEQ ID NO: 59760 - DNA, 20 bp, Artificial Sequence
  Synthetic oligonucleotide; CAGGAT chr11 5336701 5336720 5336717 +
taagttctgaggtacatgtg

SEQ ID NO: 59761 - DNA, 20 bp, Artificial Sequence
  Synthetic oligonucleotide; TTGGGT chr11 5337089 5337108 5337105 +
tgtctatcattgatggccat

SEQ ID NO: 59762 - DNA, 20 bp, Artificial Sequence
  Synthetic oligonucleotide; GTGAAT chr11 5337116 5337135 5337132 +
gattctatgtctttgctatt

SEQ ID NO: 59763 - DNA, 20 bp, Artificial Sequence
  Synthetic oligonucleotide; TAGAAT chr11 5337161 5337180 5337177 +
atgtgcatgtatcttagtaa

SEQ ID NO: 59764 - DNA, 20 bp, Artificial Sequence
  Synthetic oligonucleotide; TGGGAT chr11 5337199 5337218 5337215 +
tttaggtatatacccagtaa

SEQ ID NO: 59765 - DNA, 20 bp, Artificial Sequence
  Synthetic oligonucleotide; AGGAAT chr11 5337242 5337261 5337258 +
tttctggttctaaatctttg

SEQ ID NO: 59766 - DNA, 20 bp, Artificial Sequence
  Synthetic oligonucleotide; TTGAAT chr11 5337271 5337290 5337287 +
cacactgtcttccacaatgg

SEQ ID NO: 59767 - DNA, 20 bp, Artificial Sequence
  Synthetic oligonucleotide; TGGGGT chr11 5337517 5337536 5337533 +
gtcctttgcccactttttaa

SEQ ID NO: 59768 - DNA, 20 bp, Artificial Sequence
  Synthetic oligonucleotide; CTGGAT chr11 5337569 5337588 5337585 +
gtctaagttcctcatagatt

SEQ ID NO: 59769 - DNA, 20 bp, Artificial Sequence
  Synthetic oligonucleotide; ATGGGT chr11 5337591 5337610 5337607 +
ggatattagacctttgtcag

SEQ ID NO: 59770 - DNA, 20 bp, Artificial Sequence
  Synthetic oligonucleotide; TAGAGT chr11 5337731 5337750 5337747 +
tctcactctttcacccatgc

SEQ ID NO: 59771 - DNA, 20 bp, Artificial Sequence
  Synthetic oligonucleotide; CTGGGT chr11 5337775 5337794 5337791 +
ctcactgcaacctctgcctc

SEQ ID NO: 59772 - DNA, 20 bp, Artificial Sequence
  Synthetic oligonucleotide; CTGAGT chr11 5337807 5337826 5337823 +
aattctcctgcctcagcctc

SEQ ID NO: 59773 - DNA, 20 bp, Artificial Sequence
  Synthetic oligonucleotide; TGGAGT chr11 5337873 5337892 5337889 +
ttttgtatttttagtagaga

SEQ ID NO: 59774 - DNA, 20 bp, Artificial Sequence
  Synthetic oligonucleotide; TGGGAT chr11 5337952 5337971 5337968 +
accttggcctcccaaagtgc

SEQ ID NO: 59775 - DNA, 20 bp, Artificial Sequence
  Synthetic oligonucleotide; CGGAAT chr11 5338079 5338098 5338095 +
tctttgcctgtgtctatgtc

SEQ ID NO: 59776 - DNA, 20 bp, Artificial Sequence
  Synthetic oligonucleotide; TTGGGT chr11 5338122 5338141 5338138 +
cttctaaagtttttatagtt

SEQ ID NO: 59777 - DNA, 20 bp, Artificial Sequence
  Synthetic oligonucleotide; TTGAGT chr11 5338153 5338172 5338169 +
acttaagtctttaatgcatc

SEQ ID NO: 59778 - DNA, 20 bp, Artificial Sequence
  Synthetic oligonucleotide; AGGGGT chr11 5338183 5338202 5338199 +
ttatgtataagatgtaagga

SEQ ID NO: 59779 - DNA, 20 bp, Artificial Sequence
  Synthetic oligonucleotide; GGGAAT chr11 5338246 5338265 5338262 +
ccagcacaatttataaaata

SEQ ID NO: 59780 - DNA, 20 bp, Artificial Sequence
  Synthetic oligonucleotide; CTGAGT chr11 5338321 5338340 5338337 +
tcagatgcgcggtcttactt

SEQ ID NO: 59781 - DNA, 20 bp, Artificial Sequence
  Synthetic oligonucleotide; TTGGGT chr11 5338419 5338438 5338435 +
ccttgtagtataatttgaag

SEQ ID NO: 59782 - DNA, 20 bp, Artificial Sequence
  Synthetic oligonucleotide; ATGAGT chr11 5338586 5338605 5338602 +
ccataaaataaattttgtct

SEQ ID NO: 59783 - DNA, 20 bp, Artificial Sequence
  Synthetic oligonucleotide; AAGGAT chr11 5338616 5338635 5338632 +
taataacaatgactgtgtct

SEQ ID NO: 59784 - DNA, 20 bp, Artificial Sequence
  Synthetic oligonucleotide; CTGGGT chr11 5338676 5338695 5338692 +
ttaattggacatggagacct

SEQ ID NO: 59785 - DNA, 20 bp, Artificial Sequence
  Synthetic oligonucleotide; AGGAAT chr11 5338823 5338842 5338839 +
agcaattatttgttaatgag

SEQ ID NO: 59786 - DNA, 20 bp, Artificial Sequence
  Synthetic oligonucleotide; AAGGAT chr11 5339084 5339103 5339100 +
atattattatttgaaaaaga

SEQ ID NO: 59787 - DNA, 20 bp, Artificial Sequence
  Synthetic oligonucleotide; TTGAAT chr11 5339237 5339256 5339253 +
gttatattcttctttcagtc

SEQ ID NO: 59788 - DNA, 20 bp, Artificial Sequence
  Synthetic oligonucleotide; CTGAAT chr11 5339252 5339271 5339268 +
cagtcttgaatgatgaaaag

SEQ ID NO: 59789 - DNA, 20 bp, Artificial Sequence
  Synthetic oligonucleotide; CTGAAT chr11 5339317 5339336 5339333 +
tgttagtccactggaccact

SEQ ID NO: 59790 - DNA, 20 bp, Artificial Sequence
  Synthetic oligonucleotide; ATGAAT chr11 5339335 5339354 5339351 +
ctctgaattctactcttctt

SEQ ID NO: 59791 - DNA, 20 bp, Artificial Sequence
  Synthetic oligonucleotide; AGGAGT chr11 5339420 5339439 5339436 +
ctaacttttattttaggttc

SEQ ID NO: 59792 - DNA, 20 bp, Artificial Sequence
  Synthetic oligonucleotide; GAGGGT chr11 5339464 5339483 5339480 +
catatttaaacttgtgtcac

SEQ ID NO: 59793 - DNA, 20 bp, Artificial Sequence
  Synthetic oligonucleotide; ATGGGT chr11 5339795 5339814 5339811 +
tgtttatgttgattgttaca

SEQ ID NO: 59794 - DNA, 20 bp, Artificial Sequence
  Synthetic oligonucleotide; TTGAAT chr11 5339802 5339821 5339818 +
gttgattgttacaatgggtt

SEQ ID NO: 59795 - DNA, 20 bp, Artificial Sequence
  Synthetic oligonucleotide; CTGAGT chr11 5339820 5339839 5339836 +
ttttgaatagaaaaacatgt

SEQ ID NO: 59796 - DNA, 20 bp, Artificial Sequence
  Synthetic oligonucleotide; GTGGAT chr11 5339824 5339843 5339840 +
gaatagaaaaacatgtctga

SEQ ID NO: 59797 - DNA, 20 bp, Artificial Sequence
  Synthetic oligonucleotide; GTGAAT chr11 5339933 5339952 5339949 +
catcctacagcatcttctca

SEQ ID NO: 59798 - DNA, 20 bp, Artificial Sequence
  Synthetic oligonucleotide; AGGAGT chr11 5340220 5340239 5340236 +
acaaaacaaattacaagaag

SEQ ID NO: 59799 - DNA, 20 bp, Artificial Sequence
  Synthetic oligonucleotide; TGGAAT chr11 5340237 5340256 5340253 +
aagaggagtttattaggctg

SEQ ID NO: 59800 - DNA, 20 bp, Artificial Sequence
  Synthetic oligonucleotide; CTGAGT chr11 5340275 5340294 5340291 +
tcaaactgtcctccttgtca

SEQ ID NO: 59801 - DNA, 20 bp, Artificial Sequence
  Synthetic oligonucleotide; TGGAAT chr11 5340293 5340312 5340309 +
cactgagtctcaggaaaaca

SEQ ID NO: 59802 - DNA, 20 bp, Artificial Sequence
  Synthetic oligonucleotide; AGGAGT chr11 5340517 5340536 5340533 +
aaagttcttctactgcggtt

SEQ ID NO: 59803 - DNA, 20 bp, Artificial Sequence
  Synthetic oligonucleotide; TGGAGT chr11 5340570 5340589 5340586 +
ttcatagggaacaatatttt

SEQ ID NO: 59804 - DNA, 20 bp, Artificial Sequence
  Synthetic oligonucleotide; CGGAAT chr11 5340625 5340644 5340641 +
agtaggtactacaagcatga

SEQ ID NO: 59805 - DNA, 20 bp, Artificial Sequence
  Synthetic oligonucleotide; AAGGAT chr11 5340655 5340674 5340671 +
ggcaaaaagtagaagccact

SEQ ID NO: 59806 - DNA, 20 bp, Artificial Sequence
  Synthetic oligonucleotide; TGGAGT chr11 5340673 5340692 5340689 +
ctaaggatagtctactgtag

SEQ ID NO: 59807 - DNA, 20 bp, Artificial Sequence
  Synthetic oligonucleotide; TTGAAT chr11 5340716 5340735 5340732 +
tatagttagaagatataaat

SEQ ID NO: 59808 - DNA, 20 bp, Artificial Sequence
  Synthetic oligonucleotide; GGGAAT chr11 5340758 5340777 5340774 +
aaaaatgttatgcccttgga

SEQ ID NO: 59809 - DNA, 20 bp, Artificial Sequence
  Synthetic oligonucleotide; ATGAAT chr11 5340832 5340851 5340848 +
atctaccccacaatattttt

SEQ ID NO: 59810 - DNA, 20 bp, Artificial Sequence
  Synthetic oligonucleotide; GTGGAT chr11 5340848 5340867 5340864 +
ttttatgaataaaataagtt

SEQ ID NO: 59811 - DNA, 20 bp, Artificial Sequence
  Synthetic oligonucleotide; ATGAAT chr11 5340891 5340910 5340907 +
agggacacatgtttggtttt

SEQ ID NO: 59812 - DNA, 20 bp, Artificial Sequence
  Synthetic oligonucleotide; AAGGAT chr11 5340991 5341010 5341007 +
ctcaggtgacatggcgtgac

SEQ ID NO: 59813 - DNA, 20 bp, Artificial Sequence
  Synthetic oligonucleotide; CAGAAT chr11 5341063 5341082 5341079 +
aattacatctcttaatgaaa

SEQ ID NO: 59814 - DNA, 20 bp, Artificial Sequence
  Synthetic oligonucleotide; AAGGAT chr11 5341075 5341094 5341091 +
taatgaaacagaatataaat

SEQ ID NO: 59815 - DNA, 20 bp, Artificial Sequence
  Synthetic oligonucleotide; AGGGAT chr11 5341126 5341145 5341142 +
ctatgagcaatacctgagat

SEQ ID NO: 59816 - DNA, 20 bp, Artificial Sequence
  Synthetic oligonucleotide; ATGAAT chr11 5341153 5341172 5341169 +
caaatgtgtgcaatttatta

SEQ ID NO: 59817 - DNA, 20 bp, Artificial Sequence
  Synthetic oligonucleotide; GAGGGT chr11 5341254 5341273 5341270 +
agcttagcttcagaaggcaa

SEQ ID NO: 59818 - DNA, 20 bp, Artificial Sequence
  Synthetic oligonucleotide; CTGAGT chr11 5341324 5341343 5341340 +
tcttcataagacatttcctg

SEQ ID NO: 59819 - DNA, 20 bp, Artificial Sequence
  Synthetic oligonucleotide; CGGGGT chr11 5341410 5341429 5341426 +
gcacaattctgtaaaatgat

SEQ ID NO: 59820 - DNA, 20 bp, Artificial Sequence
  Synthetic oligonucleotide; TAGGAT chr11 5341526 5341545 5341542 +
agacataacctccctctttt

SEQ ID NO: 59821 - DNA, 20 bp, Artificial Sequence
  Synthetic oligonucleotide; TTGAGT chr11 5341540 5341559 5341556 +
tctttttaggatattttaaa

SEQ ID NO: 59822 - DNA, 20 bp, Artificial Sequence
  Synthetic oligonucleotide; ATGGGT chr11 5341547 5341566 5341563 +
aggatattttaaattgagtt

SEQ ID NO: 59823 - DNA, 20 bp, Artificial Sequence
  Synthetic oligonucleotide; GAGAAT chr11 5341587 5341606 5341603 +
tcagacaattttaatcaaat

SEQ ID NO: 59824 - DNA, 20 bp, Artificial Sequence
  Synthetic oligonucleotide; TGGAAT chr11 5341632 5341651 5341648 +
ggaaatttacacttattaca

SEQ ID NO: 59825 - DNA, 20 bp, Artificial Sequence
  Synthetic oligonucleotide; CAGAAT chr11 5341638 5341657 5341654 +
ttacacttattacatggaat

SEQ ID NO: 59826 - DNA, 20 bp, Artificial Sequence
  Synthetic oligonucleotide; GAGGGT chr11 5341727 5341746 5341743 +
gacctttttcatagcaaaag

SEQ ID NO: 59827 - DNA, 20 bp, Artificial Sequence
  Synthetic oligonucleotide; GAGGAT chr11 5341785 5341804 5341801 +
gtcagccagcgtagatatct

SEQ ID NO: 59828 - DNA, 20 bp, Artificial Sequence
  Synthetic oligonucleotide; TAGGGT chr11 5341815 5341834 5341831 +
tcaacattggagctagcaac

SEQ ID NO: 59829 - DNA, 20 bp, Artificial Sequence
  Synthetic oligonucleotide; TAGAAT chr11 5341823 5341842 5341839 +
ggagctagcaactagggtag

SEQ ID NO: 59830 - DNA, 20 bp, Artificial Sequence
  Synthetic oligonucleotide; AAGAAT chr11 5341829 5341848 5341845 +
agcaactagggtagtagaat

SEQ ID NO: 59831 - DNA, 20 bp, Artificial Sequence
  Synthetic oligonucleotide; GGGAAT chr11 5341942 5341961 5341958 +
tgtcagaaggtactgccttg

SEQ ID NO: 59832 - DNA, 20 bp, Artificial Sequence
  Synthetic oligonucleotide; ATGAGT chr11 5341952 5341971 5341968 +
tactgccttggggaataaat

SEQ ID NO: 59833 - DNA, 20 bp, Artificial Sequence
  Synthetic oligonucleotide; AAGAGT chr11 5342148 5342167 5342164 +
acacctgcagagaaattcat

SEQ ID NO: 59834 - DNA, 20 bp, Artificial Sequence
  Synthetic oligonucleotide; AGGAAT chr11 5342364 5342383 5342380 +
tagagaaatattccgtttac

SEQ ID NO: 59835 - DNA, 20 bp, Artificial Sequence
  Synthetic oligonucleotide; AAGAGT chr11 5342403 5342422 5342419 +
gtacaaactacatttagcta

SEQ ID NO: 59836 - DNA, 20 bp, Artificial Sequence
  Synthetic oligonucleotide; TAGAGT chr11 5342523 5342542 5342539 +
tttgctctcctgctaaatat

SEQ ID NO: 59837 - DNA, 20 bp, Artificial Sequence
  Synthetic oligonucleotide; GAGAGT chr11 5342542 5342561 5342558 +
ttagagtttttacattctgt

SEQ ID NO: 59838 - DNA, 20 bp, Artificial Sequence
  Synthetic oligonucleotide; ATGGGT chr11 5342581 5342600 5342597 +
ggagatcaggttccaattct

SEQ ID NO: 59839 - DNA, 20 bp, Artificial Sequence
  Synthetic oligonucleotide; AAGAAT chr11 5342599 5342618 5342615 +
ctatgggtagtaaaaaggtg

SEQ ID NO: 59840 - DNA, 20 bp, Artificial Sequence
  Synthetic oligonucleotide; CTGAAT chr11 5342611 5342630 5342627 +
aaaaggtgaagaatggcatt

SEQ ID NO: 59841 - DNA, 20 bp, Artificial Sequence
  Synthetic oligonucleotide; TAGGAT chr11 5342643 5342662 5342659 +
ggtcttgacactatatgtta

SEQ ID NO: 59842 - DNA, 20 bp, Artificial Sequence
  Synthetic oligonucleotide; ATGAAT chr11 5342725 5342744 5342741 +
ggaacctgctttccaaaacg

SEQ ID NO: 59843 - DNA, 20 bp, Artificial Sequence
  Synthetic oligonucleotide; TTGAGT chr11 5342843 5342862 5342859 +
aggcaatgctcaggacagtc

SEQ ID NO: 59844 - DNA, 20 bp, Artificial Sequence
  Synthetic oligonucleotide; CTGGGT chr11 5342913 5342932 5342929 +
tataaagactacaagcacag

SEQ ID NO: 59845 - DNA, 20 bp, Artificial Sequence
  Synthetic oligonucleotide; GCGAGT chr11 5342948 5342967 5342964 +
tgaaggtggtatcagcacag

SEQ ID NO: 59846 - DNA, 20 bp, Artificial Sequence
  Synthetic oligonucleotide; CAGAAT chr11 5342975 5342994 5342991 +
taatgacatcctggtgaagg

SEQ ID NO: 59847 - DNA, 20 bp, Artificial Sequence
  Synthetic oligonucleotide; GGGAGT chr11 5342997 5343016 5343013 +
gaatgcatgtgaaagaacat

SEQ ID NO: 59848 - DNA, 20 bp, Artificial Sequence
  Synthetic oligonucleotide; ACGGAT chr11 5343044 5343063 5343060 +
ggggcctgattgggggaaca

SEQ ID NO: 59849 - DNA, 20 bp, Artificial Sequence
  Synthetic oligonucleotide; TCGAGT chr11 5343091 5343110 5343107 +
cccagcccaatcttcactac

SEQ ID NO: 59850 - DNA, 20 bp, Artificial Sequence
  Synthetic oligonucleotide; GAGGGT chr11 5343123 5343142 5343139 +
aagtacagaggtatatctaa

SEQ ID NO: 59851 - DNA, 20 bp, Artificial Sequence
  Synthetic oligonucleotide; CAGAAT chr11 5343166 5343185 5343182 +
cggtcataggccatggcaag

SEQ ID NO: 59852 - DNA, 20 bp, Artificial Sequence
  Synthetic oligonucleotide; GTGAGT chr11 5343192 5343211 5343208 +
gccagactcgagaaaggaaa

SEQ ID NO: 59853 - DNA, 20 bp, Artificial Sequence
  Synthetic oligonucleotide; GAGGGT chr11 5343376 5343395 5343392 +
tcttccttaatgagaagaag

SEQ ID NO: 59854 - DNA, 20 bp, Artificial Sequence
  Synthetic oligonucleotide; AAGGAT chr11 5343394 5343413 5343410 +
aggagggtgccattgccaaa

SEQ ID NO: 59855 - DNA, 20 bp, Artificial Sequence
  Synthetic oligonucleotide; ATGGAT chr11 5343398 5343417 5343414 +
gggtgccattgccaaaaagg

SEQ ID NO: 59856 - DNA, 20 bp, Artificial Sequence
  Synthetic oligonucleotide; AGGGAT chr11 5343477 5343496 5343493 +
tggaaaaccagtcaatagga

SEQ ID NO: 59857 - DNA, 20 bp, Artificial Sequence
  Synthetic oligonucleotide; CTGGGT chr11 5343506 5343525 5343522 +
agctgccgctggacgacatc

SEQ ID NO: 59858 - DNA, 20 bp, Artificial Sequence
  Synthetic oligonucleotide; CAGAAT chr11 5343598 5343617 5343614 +
cacttcgactatatcattct

SEQ ID NO: 59859 - DNA, 20 bp, Artificial Sequence
  Synthetic oligonucleotide; CAGGGT chr11 5343662 5343681 5343678 +
tgtttctcaaaatacattct

SEQ ID NO: 59860 - DNA, 20 bp, Artificial Sequence
  Synthetic oligonucleotide; CAGGAT chr11 5343702 5343721 5343718 +
gtattcttaactgcacattc

SEQ ID NO: 59861 - DNA, 20 bp, Artificial Sequence
  Synthetic oligonucleotide; TGGAGT chr11 5343736 5343755 5343752 +
tacctacgtaatcaaattct

SEQ ID NO: 59862 - DNA, 20 bp, Artificial Sequence
  Synthetic oligonucleotide; AAGAAT chr11 5343836 5343855 5343852 +
ccttaactatgcagatttta

SEQ ID NO: 59863 - DNA, 20 bp, Artificial Sequence
  Synthetic oligonucleotide; GGGGAT chr11 5343864 5343883 5343880 +
gtattctatggggcattcaa

SEQ ID NO: 59864 - DNA, 20 bp, Artificial Sequence
  Synthetic oligonucleotide; CTGAAT chr11 5343975 5343994 5343991 +
tcctgcatgtaaagacttac

SEQ ID NO: 59865 - DNA, 20 bp, Artificial Sequence
  Synthetic oligonucleotide; GTGAAT chr11 5344135 5344154 5344151 +
aacagacattcacgattagt

SEQ ID NO: 59866 - DNA, 20 bp, Artificial Sequence
  Synthetic oligonucleotide; TAGAAT chr11 5344151 5344170 5344167 +
tagtgtgaattaccctcttg

SEQ ID NO: 59867 - DNA, 20 bp, Artificial Sequence
  Synthetic oligonucleotide; TGGAAT chr11 5344220 5344239 5344236 +
tataagttagactttggggc

SEQ ID NO: 59868 - DNA, 20 bp, Artificial Sequence
  Synthetic oligonucleotide; TAGAAT chr11 5344362 5344381 5344378 +
ggcctactgaagtaattccc

SEQ ID NO: 59869 - DNA, 20 bp, Artificial Sequence
  Synthetic oligonucleotide; CTGAAT chr11 5344453 5344472 5344469 +
ttatccccagccataggctt

SEQ ID NO: 59870 - DNA, 20 bp, Artificial Sequence
  Synthetic oligonucleotide; CTGAGT chr11 5344474 5344493 5344490 +
tgaatctgttctccccaata

SEQ ID NO: 59871 - DNA, 20 bp, Artificial Sequence
  Synthetic oligonucleotide; TGGAAT chr11 5344722 5344741 5344738 +
ccatgatatttaaagctctc

SEQ ID NO: 59872 - DNA, 20 bp, Artificial Sequence
  Synthetic oligonucleotide; TTGGAT chr11 5344854 5344873 5344870 +
tactacttgatgtagattaa

SEQ ID NO: 59873 - DNA, 20 bp, Artificial Sequence
  Synthetic oligonucleotide; CGGAAT chr11 5345100 5345119 5345116 +
tagggccttacagaccacca

SEQ ID NO: 59874 - DNA, 20 bp, Artificial Sequence
  Synthetic oligonucleotide; ATGAGT chr11 5345270 5345289 5345286 +
agcaagagacaagaaaagag

SEQ ID NO: 59875 - DNA, 20 bp, Artificial Sequence
  Synthetic oligonucleotide; AAGAGT chr11 5345303 5345322 5345319 +
ctattttaaaaatccatatg

SEQ ID NO: 59876 - DNA, 20 bp, Artificial Sequence
  Synthetic oligonucleotide; GGGAGT chr11 5345429 5345448 5345445 +
tttgctgatatattaaaaat

SEQ ID NO: 59877 - DNA, 20 bp, Artificial Sequence
  Synthetic oligonucleotide; AAGAAT chr11 5345485 5345504 5345501 +
atttctgtttgaacaaatga

SEQ ID NO: 59878 - DNA, 20 bp, Artificial Sequence
  Synthetic oligonucleotide; GGGGAT chr11 5345524 5345543 5345540 +
actcaaaatggaagtctgag

SEQ ID NO: 59879 - DNA, 20 bp, Artificial Sequence
  Synthetic oligonucleotide; AAGAGT chr11 5345553 5345572 5345569 +
tattcacttgtgaggaaatc

SEQ ID NO: 59880 - DNA, 20 bp, Artificial Sequence
  Synthetic oligonucleotide; CTGAAT chr11 5345574 5345593 5345590 +
agagtcattagtaaatatag

SEQ ID NO: 59881 - DNA, 20 bp, Artificial Sequence
  Synthetic oligonucleotide; CAGAGT chr11 5345688 5345707 5345704 +
cgtatccaaatatacccctt

SEQ ID NO: 59882 - DNA, 20 bp, Artificial Sequence
  Synthetic oligonucleotide; AAGAAT chr11 5345843 5345862 5345859 +
gcaacaactcagcactttga

SEQ ID NO: 59883 - DNA, 20 bp, Artificial Sequence
  Synthetic oligonucleotide; CAGAAT chr11 5345895 5345914 5345911 +
taggactgagagacataaac

SEQ ID NO: 59884 - DNA, 20 bp, Artificial Sequence
  Synthetic oligonucleotide; ATGAGT chr11 5345922 5345941 5345938 +
cagtgcctactgaacataca

SEQ ID NO: 59885 - DNA, 20 bp, Artificial Sequence
  Synthetic oligonucleotide; GAGAAT chr11 5346104 5346123 5346120 +
tgaaaaattccttcttatca

SEQ ID NO: 59886 - DNA, 20 bp, Artificial Sequence
  Synthetic oligonucleotide; ATGAAT chr11 5346124 5346143 5346140 +
gagaatatgcagcacaagtg

SEQ ID NO: 59887 - DNA, 20 bp, Artificial Sequence
  Synthetic oligonucleotide; AAGAAT chr11 5346221 5346240 5346237 +
tttcctccttctccattccc

SEQ ID NO: 59888 - DNA, 20 bp, Artificial Sequence
  Synthetic oligonucleotide; TGGAAT chr11 5346270 5346289 5346286 +
gcagctataatagtgatcta

SEQ ID NO: 59889 - DNA, 20 bp, Artificial Sequence
  Synthetic oligonucleotide; GAGGAT chr11 5346411 5346430 5346427 +
ggaaagagatcataaagact

SEQ ID NO: 59890 - DNA, 20 bp, Artificial Sequence
  Synthetic oligonucleotide; TAGAAT chr11 5346519 5346538 5346535 +
gtttaaaaagtaaaatgtag

SEQ ID NO: 59891 - DNA, 20 bp, Artificial Sequence
  Synthetic oligonucleotide; GAGGGT chr11 5346573 5346592 5346589 +
aaaggaaagaagacatatga

SEQ ID NO: 59892 - DNA, 20 bp, Artificial Sequence
  Synthetic oligonucleotide; CTGAGT chr11 5346596 5346615 5346612 +
ggtcaatcatattcacatca

SEQ ID NO: 59893 - DNA, 20 bp, Artificial Sequence
  Synthetic oligonucleotide; TGGAAT chr11 5346635 5346654 5346651 +
ggtagttggttggtagcact

SEQ ID NO: 59894 - DNA, 20 bp, Artificial Sequence
  Synthetic oligonucleotide; AGGAGT chr11 5346751 5346770 5346767 +
tttctctggagagcttatag

SEQ ID NO: 59895 - DNA, 20 bp, Artificial Sequence
  Synthetic oligonucleotide; AGGAGT chr11 5346782 5346801 5346798 +
agtacactctttatatatct

SEQ ID NO: 59896 - DNA, 20 bp, Artificial Sequence
  Synthetic oligonucleotide; CAGGGT chr11 5346837 5346856 5346853 +
tgtttgatggtgaggaagag

SEQ ID NO: 59897 - DNA, 20 bp, Artificial Sequence
  Synthetic oligonucleotide; TTGGAT chr11 5346965 5346984 5346981 +
gtctcccttttatagccaac

SEQ ID NO: 59898 - DNA, 20 bp, Artificial Sequence
  Synthetic oligonucleotide; CTGAAT chr11 5347079 5347098 5347095 +
tttttcaaataagttactgg

SEQ ID NO: 59899 - DNA, 20 bp, Artificial Sequence
  Synthetic oligonucleotide; GGGAAT chr11 5347113 5347132 5347129 +
tggtaggacctttatgtgtg

SEQ ID NO: 59900 - DNA, 20 bp, Artificial Sequence
  Synthetic oligonucleotide; CTGAAT chr11 5347259 5347278 5347275 +
atcttcttggcctatgtaac

SEQ ID NO: 59901 - DNA, 20 bp, Artificial Sequence
  Synthetic oligonucleotide; TAGAGT chr11 5347328 5347347 5347344 +
aagcagagagctagatagac

SEQ ID NO: 59902 - DNA, 20 bp, Artificial Sequence
  Synthetic oligonucleotide; TTGAGT chr11 5347414 5347433 5347430 +
tatcactaactattcccttc

SEQ ID NO: 59903 - DNA, 20 bp, Artificial Sequence
  Synthetic oligonucleotide; GGGGAT chr11 5347449 5347468 5347465 +
cagaagttttctcttttcca

SEQ ID NO: 59904 - DNA, 20 bp, Artificial Sequence
  Synthetic oligonucleotide; TTGAGT chr11 5347672 5347691 5347688 +
ccaggacagagacagagatc

SEQ ID NO: 59905 - DNA, 20 bp, Artificial Sequence
  Synthetic oligonucleotide; AGGAAT chr11 5347817 5347836 5347833 +
gaacaataattatctaaatc

SEQ ID NO: 59906 - DNA, 20 bp, Artificial Sequence
  Synthetic oligonucleotide; AAGAAT chr11 5347947 5347966 5347963 +
gatacatgactatggaactg

SEQ ID NO: 59907 - DNA, 20 bp, Artificial Sequence
  Synthetic oligonucleotide; GAGGGT chr11 5347979 5347998 5347995 +
gaacaaagtttcaggtcagt

SEQ ID NO: 59908 - DNA, 20 bp, Artificial Sequence
  Synthetic oligonucleotide; ATGAAT chr11 5347990 5348009 5348006 +
caggtcagtgagggtattta

SEQ ID NO: 59909 - DNA, 20 bp, Artificial Sequence
  Synthetic oligonucleotide; AAGAGT chr11 5348094 5348113 5348110 +
aagtaatagtgttgtctgct

SEQ ID NO: 59910 - DNA, 20 bp, Artificial Sequence
  Synthetic oligonucleotide; ATGGGT chr11 5348117 5348136 5348133 +
agtagatatatgtagtaggc

SEQ ID NO: 59911 - DNA, 20 bp, Artificial Sequence
  Synthetic oligonucleotide; GAGAGT chr11 5348162 5348181 5348178 +
ctctaaaacttggtttcttt

SEQ ID NO: 59912 - DNA, 20 bp, Artificial Sequence
  Synthetic oligonucleotide; AAGGAT chr11 5348192 5348211 5348208 +
tcttcaaatataaaaaagtg

SEQ ID NO: 59913 - DNA, 20 bp, Artificial Sequence
  Synthetic oligonucleotide; ATGGGT chr11 5348245 5348264 5348261 +
ttctacgaacaaaccagagc

SEQ ID NO: 59914 - DNA, 20 bp, Artificial Sequence
  Synthetic oligonucleotide; ATGAAT chr11 5348263 5348282 5348279 +
gcatgggtgttgactcaggc

SEQ ID NO: 59915 - DNA, 20 bp, Artificial Sequence
  Synthetic oligonucleotide; TGGGGT chr11 5348271 5348290 5348287 +
gttgactcaggcatgaatta

SEQ ID NO: 59916 - DNA, 20 bp, Artificial Sequence
  Synthetic oligonucleotide; GAGAGT chr11 5348337 5348356 5348353 +
ctggcttccattctaaccct

SEQ ID NO: 59917 - DNA, 20 bp, Artificial Sequence
  Synthetic oligonucleotide; TAGAAT chr11 5348399 5348418 5348415 +
gtccagataagtgccaaata

SEQ ID NO: 59918 - DNA, 20 bp, Artificial Sequence
  Synthetic oligonucleotide; TTGGGT chr11 5348532 5348551 5348548 +
aaattaagcttggacggagc

SEQ ID NO: 59919 - DNA, 20 bp, Artificial Sequence
  Synthetic oligonucleotide; CTGGAT chr11 5348549 5348568 5348565 +
agcttgggttatgtgtgcct

SEQ ID NO: 59920 - DNA, 20 bp, Artificial Sequence
  Synthetic oligonucleotide; AGGGGT chr11 5348556 5348575 5348572 +
gttatgtgtgcctctggatc

SEQ ID NO: 59921 - DNA, 20 bp, Artificial Sequence
  Synthetic oligonucleotide; GAGGGT chr11 5348701 5348720 5348717 +
agatagtacccacccagacg

SEQ ID NO: 59922 - DNA, 20 bp, Artificial Sequence
  Synthetic oligonucleotide; GTGGGT chr11 5348705 5348724 5348721 +
agtacccacccagacggagg

SEQ ID NO: 59923 - DNA, 20 bp, Artificial Sequence
  Synthetic oligonucleotide; GTGGGT chr11 5348709 5348728 5348725 +
cccacccagacggagggtgg

SEQ ID NO: 59924 - DNA, 20 bp, Artificial Sequence
  Synthetic oligonucleotide; AAGGAT chr11 5348841 5348860 5348857 +
tcaatattaaccatcacaga

SEQ ID NO: 59925 - DNA, 20 bp, Artificial Sequence
  Synthetic oligonucleotide; GGGGGT chr11 5348862 5348881 5348878 +
aggataatagccaaaggtaa

SEQ ID NO: 59926 - DNA, 20 bp, Artificial Sequence
  Synthetic oligonucleotide; AAGGAT chr11 5348873 5348892 5348889 +
caaaggtaagggggtaaaaa

SEQ ID NO: 59927 - DNA, 20 bp, Artificial Sequence
  Synthetic oligonucleotide; AAGAGT chr11 5348905 5348924 5348921 +
actaagtgcttgagacagaa

SEQ ID NO: 59928 - DNA, 20 bp, Artificial Sequence
  Synthetic oligonucleotide; GAGAAT chr11 5348950 5348969 5348966 +
aaaagccaaagggaaggtga

SEQ ID NO: 59929 - DNA, 20 bp, Artificial Sequence
  Synthetic oligonucleotide; CTGAAT chr11 5348972 5348991 5348988 +
gaatatatgaaagttaacat

SEQ ID NO: 59930 - DNA, 20 bp, Artificial Sequence
  Synthetic oligonucleotide; CAGAGT chr11 5349022 5349041 5349038 +
agagccatcagtttatgcgg

SEQ ID NO: 59931 - DNA, 20 bp, Artificial Sequence
  Synthetic oligonucleotide; GAGAAT chr11 5349038 5349057 5349054 +
gcggcagagtttgagacttt

SEQ ID NO: 59932 - DNA, 20 bp, Artificial Sequence
  Synthetic oligonucleotide; GAGGGT chr11 5349096 5349115 5349112 +
ctatgacagagaccctggaa

SEQ ID NO: 59933 - DNA, 20 bp, Artificial Sequence
  Synthetic oligonucleotide; GTGAAT chr11 5349100 5349119 5349116 +
gacagagaccctggaagagg

SEQ ID NO: 59934 - DNA, 20 bp, Artificial Sequence
  Synthetic oligonucleotide; AGGGAT chr11 5349112 5349131 5349128 +
ggaagagggtgaatggctgc

SEQ ID NO: 59935 - DNA, 20 bp, Artificial Sequence
  Synthetic oligonucleotide; CTGAGT chr11 5349185 5349204 5349201 +
ctcatataccacaaaagcaa

SEQ ID NO: 59936 - DNA, 20 bp, Artificial Sequence
  Synthetic oligonucleotide; GTGAAT chr11 5349189 5349208 5349205 +
tataccacaaaagcaactga

SEQ ID NO: 59937 - DNA, 20 bp, Artificial Sequence
  Synthetic oligonucleotide; AAGGAT chr11 5349250 5349269 5349266 +
acaagacaaacagctatttt

SEQ ID NO: 59938 - DNA, 20 bp, Artificial Sequence
  Synthetic oligonucleotide; ATGAAT chr11 5349604 5349623 5349620 +
attatggtaatcatttaaca

SEQ ID NO: 59939 - DNA, 20 bp, Artificial Sequence
  Synthetic oligonucleotide; CTGAGT chr11 5349686 5349705 5349702 +
cttctttaatcctgcataag

SEQ ID NO: 59940 - DNA, 20 bp, Artificial Sequence
  Synthetic oligonucleotide; CAGAGT chr11 5349758 5349777 5349774 +
cttttctcactttttgagga

SEQ ID NO: 59941 - DNA, 20 bp, Artificial Sequence
  Synthetic oligonucleotide; CTGGGT chr11 5350026 5350045 5350042 +
ggaaatcatttgacacacct

SEQ ID NO: 59942 - DNA, 20 bp, Artificial Sequence
  Synthetic oligonucleotide; GTGAAT chr11 5350030 5350049 5350046 +
atcatttgacacacctctgg

SEQ ID NO: 59943 - DNA, 20 bp, Artificial Sequence
  Synthetic oligonucleotide; GAGAAT chr11 5350157 5350176 5350173 +
ttccccttactttgtgtcaa

SEQ ID NO: 59944 - DNA, 20 bp, Artificial Sequence
  Synthetic oligonucleotide; TTGGAT chr11 5350308 5350327 5350324 +
aaaatgaaagtccagtaatc

SEQ ID NO: 59945 - DNA, 20 bp, Artificial Sequence
  Synthetic oligonucleotide; TAGAAT chr11 5350507 5350526 5350523 +
gcctgcaccagctgaaatct

SEQ ID NO: 59946 - DNA, 20 bp, Artificial Sequence
  Synthetic oligonucleotide; ATGAGT chr11 5350517 5350536 5350533 +
gctgaaatcttagaattcta

SEQ ID NO: 59947 - DNA, 20 bp, Artificial Sequence
  Synthetic oligonucleotide; TTGAAT chr11 5350738 5350757 5350754 +
tcaatttatattatgaaaat

SEQ ID NO: 59948 - DNA, 20 bp, Artificial Sequence
  Synthetic oligonucleotide; TAGGGT chr11 5350768 5350787 5350784 +
tgaagcagtgtatcaataac

SEQ ID NO: 59949 - DNA, 20 bp, Artificial Sequence
  Synthetic oligonucleotide; TAGAGT chr11 5350791 5350810 5350807 +
ggttataaagctgggcaact

SEQ ID NO: 59950 - DNA, 20 bp, Artificial Sequence
  Synthetic oligonucleotide; TTGAAT chr11 5350879 5350898 5350895 +
agtctctggagcttcatcaa

SEQ ID NO: 59951 - DNA, 20 bp, Artificial Sequence
  Synthetic oligonucleotide; AGGAAT chr11 5350894 5350913 5350910 +
atcaattgaattttccctcc

SEQ ID NO: 59952 - DNA, 20 bp, Artificial Sequence
  Synthetic oligonucleotide; CAGGAT chr11 5351092 5351111 5351108 +
caccctataataccaccagt

SEQ ID NO: 59953 - DNA, 20 bp, Artificial Sequence
  Synthetic oligonucleotide; CTGGGT chr11 5351189 5351208 5351205 +
tttcattttgtttttatttt

SEQ ID NO: 59954 - DNA, 20 bp, Artificial Sequence
  Synthetic oligonucleotide; ATGAAT chr11 5351208 5351227 5351224 +
tctgggttatatgatttaca

SEQ ID NO: 59955 - DNA, 20 bp, Artificial Sequence
  Synthetic oligonucleotide; ATGAAT chr11 5351233 5351252 5351249 +
ttcaacaatgtttattctgc

SEQ ID NO: 59956 - DNA, 20 bp, Artificial Sequence
  Synthetic oligonucleotide; TAGAGT chr11 5351275 5351294 5351291 +
tagtatccaataatcttaca

SEQ ID NO: 59957 - DNA, 20 bp, Artificial Sequence
  Synthetic oligonucleotide; TAGGAT chr11 5351326 5351345 5351342 +
acattctattttcccatacc

SEQ ID NO: 59958 - DNA, 20 bp, Artificial Sequence
  Synthetic oligonucleotide; AGGAAT chr11 5351337 5351356 5351353 +
tcccatacctaggatctccc

SEQ ID NO: 59959 - DNA, 20 bp, Artificial Sequence
  Synthetic oligonucleotide; TAGAAT chr11 5351404 5351423 5351420 +
gtgaacatcttatgaacagg

SEQ ID NO: 59960 - DNA, 20 bp, Artificial Sequence
  Synthetic oligonucleotide; TGGAGT chr11 5351454 5351473 5351470 +
ctgattactattgctttacc

SEQ ID NO: 59961 - DNA, 20 bp, Artificial Sequence
  Synthetic oligonucleotide; CTGGAT chr11 5351556 5351575 5351572 +
ggcatggagaaggcacatca

SEQ ID NO: 59962 - DNA, 20 bp, Artificial Sequence
  Synthetic oligonucleotide; AGGAAT chr11 5351629 5351648 5351645 +
gcactcttctctttctcatc

SEQ ID NO: 59963 - DNA, 20 bp, Artificial Sequence
  Synthetic oligonucleotide; CGGAGT chr11 5351694 5351713 5351710 +
atgttggcagctacagacct

SEQ ID NO: 59964 - DNA, 20 bp, Artificial Sequence
  Synthetic oligonucleotide; TGGAGT chr11 5351810 5351829 5351826 +
tatccatactctttctgtca

SEQ ID NO: 59965 - DNA, 20 bp, Artificial Sequence
  Synthetic oligonucleotide; GCGGGT chr11 5351919 5351938 5351935 +
caggtaatgaagattggtgt

SEQ ID NO: 59966 - DNA, 20 bp, Artificial Sequence
  Synthetic oligonucleotide; CAGAGT chr11 5352379 5352398 5352395 +
gcattaaaactaagcagatt

SEQ ID NO: 59967 - DNA, 20 bp, Artificial Sequence
  Synthetic oligonucleotide; AGGAAT chr11 5352447 5352466 5352463 +
cattgtttcactggtctctg

SEQ ID NO: 59968 - DNA, 20 bp, Artificial Sequence
  Synthetic oligonucleotide; CAGGAT chr11 5352470 5352489 5352486 +
aataattcaggggacctgga

SEQ ID NO: 59969 - DNA, 20 bp, Artificial Sequence
  Synthetic oligonucleotide; TTGGGT chr11 5352913 5352932 5352929 +
accaattatatatataattc

SEQ ID NO: 59970 - DNA, 20 bp, Artificial Sequence
  Synthetic oligonucleotide; TTGGGT chr11 5352926 5352945 5352942 +
ataattcttgggtctatgat

SEQ ID NO: 59971 - DNA, 20 bp, Artificial Sequence
  Synthetic oligonucleotide; AGGAAT chr11 5352998 5353017 5353014 +
atattagtcctgttatacat

SEQ ID NO: 59972 - DNA, 20 bp, Artificial Sequence
  Synthetic oligonucleotide; GAGAGT chr11 5353106 5353125 5353122 +
gaaatgagactttcttcaat

SEQ ID NO: 59973 - DNA, 20 bp, Artificial Sequence
  Synthetic oligonucleotide; GAGGGT chr11 5353142 5353161 5353158 +
cctcaattactttcttcaat

SEQ ID NO: 59974 - DNA, 20 bp, Artificial Sequence
  Synthetic oligonucleotide; ATGAGT chr11 5353173 5353192 5353189 +
atttccctcaattcaaaatg

SEQ ID NO: 59975 - DNA, 20 bp, Artificial Sequence
  Synthetic oligonucleotide; AGGGGT chr11 5353396 5353415 5353412 +
catcagagataagactagat

SEQ ID NO: 59976 - DNA, 20 bp, Artificial Sequence
  Synthetic oligonucleotide; CAGAGT chr11 5353422 5353441 5353438 +
gtctggcatgtgcaaaatag

SEQ ID NO: 59977 - DNA, 20 bp, Artificial Sequence
  Synthetic oligonucleotide; GAGAGT chr11 5353455 5353474 5353471 +
caaacagttggtcatatgtg

SEQ ID NO: 59978 - DNA, 20 bp, Artificial Sequence
  Synthetic oligonucleotide; GAGGAT chr11 5353474 5353493 5353490 +
ggagagtggggaggaaggga

SEQ ID NO: 59979 - DNA, 20 bp, Artificial Sequence
  Synthetic oligonucleotide; CAGAGT chr11 5353546 5353565 5353562 +
caaatacttttgattctttt

SEQ ID NO: 59980 - DNA, 20 bp, Artificial Sequence
  Synthetic oligonucleotide; GGGGGT chr11 5353567 5353586 5353583 +
agagtctaggcatgagaaga

SEQ ID NO: 59981 - DNA, 20 bp, Artificial Sequence
  Synthetic oligonucleotide; CAGGGT chr11 5353669 5353688 5353685 +
atattcttttgaccaaaata

SEQ ID NO: 59982 - DNA, 20 bp, Artificial Sequence
  Synthetic oligonucleotide; CTGGAT chr11 5353720 5353739 5353736 +
gccacccagtgaccagtcag

SEQ ID NO: 59983 - DNA, 20 bp, Artificial Sequence
  Synthetic oligonucleotide; GGGGAT chr11 5353803 5353822 5353819 +
actcttcatcacagaaaggt

SEQ ID NO: 59984 - DNA, 20 bp, Artificial Sequence
  Synthetic oligonucleotide; TAGGAT chr11 5353813 5353832 5353829 +
acagaaaggtggggattttt

SEQ ID NO: 59985 - DNA, 20 bp, Artificial Sequence
  Synthetic oligonucleotide; TGGGAT chr11 5353822 5353841 5353838 +
tggggattttttaggattct

SEQ ID NO: 59986 - DNA, 20 bp, Artificial Sequence
  Synthetic oligonucleotide; GAGGAT chr11 5353994 5354013 5354010 +
agcttcttgactgtgtgctc

SEQ ID NO: 59987 - DNA, 20 bp, Artificial Sequence
  Synthetic oligonucleotide; ATGAAT chr11 5354087 5354106 5354103 +
aaatataatttttcattaaa

SEQ ID NO: 59988 - DNA, 20 bp, Artificial Sequence
  Synthetic oligonucleotide; GGGAAT chr11 5354224 5354243 5354240 +
ctttcttcccttgggctttt

SEQ ID NO: 59989 - DNA, 20 bp, Artificial Sequence
  Synthetic oligonucleotide; ATGAAT chr11 5354228 5354247 5354244 +
cttcccttgggcttttggga

SEQ ID NO: 59990 - DNA, 20 bp, Artificial Sequence
  Synthetic oligonucleotide; GGGGAT chr11 5354238 5354257 5354254 +
gcttttgggaatgaattcag

SEQ ID NO: 59991 - DNA, 20 bp, Artificial Sequence
  Synthetic oligonucleotide; TAGGAT chr11 5354333 5354352 5354349 +
caggctagtataaagataac

SEQ ID NO: 59992 - DNA, 20 bp, Artificial Sequence
  Synthetic oligonucleotide; CTGAGT chr11 5354388 5354407 5354404 +
gacacatttgactgacaacc

SEQ ID NO: 59993 - DNA, 20 bp, Artificial Sequence
  Synthetic oligonucleotide; TGGAGT chr11 5354498 5354517 5354514 +
gggacttgcagttctctttg

SEQ ID NO: 59994 - DNA, 20 bp, Artificial Sequence
  Synthetic oligonucleotide; TAGGGT chr11 5354562 5354581 5354578 +
cctgaacaacatatcaacag

SEQ ID NO: 59995 - DNA, 20 bp, Artificial Sequence
  Synthetic oligonucleotide; AAGAAT chr11 5354701 5354720 5354717 +
atcaagagggcatctttgcc

SEQ ID NO: 59996 - DNA, 20 bp, Artificial Sequence
  Synthetic oligonucleotide; AAGAAT chr11 5354789 5354808 5354805 +
gacaaaagacaaacagtttg

SEQ ID NO: 59997 - DNA, 20 bp, Artificial Sequence
  Synthetic oligonucleotide; GAGGGT chr11 5354824 5354843 5354840 +
acttcaagccacaagaagca

SEQ ID NO: 59998 - DNA, 20 bp, Artificial Sequence
  Synthetic oligonucleotide; GAGGAT chr11 5354850 5354869 5354866 +
accagacctgagagaactct

SEQ ID NO: 59999 - DNA, 20 bp, Artificial Sequence
  Synthetic oligonucleotide; CTGAGT chr11 5354897 5354916 5354913 +
ttcaagagaccttgacgaag

SEQ ID NO: 60000 - DNA, 20 bp, Artificial Sequence
  Synthetic oligonucleotide; CTGGAT chr11 5354923 5354942 5354939 +
cactgtgtgaagtctgtgcg

SEQ ID NO: 60001 - DNA, 20 bp, Artificial Sequence
  Synthetic oligonucleotide; GAGGAT chr11 5354983 5355002 5354999 +
agaaaggtgatgtgctctgg

SEQ ID NO: 60002 - DNA, 20 bp, Artificial Sequence
  Synthetic oligonucleotide; ATGGAT chr11 5355004 5355023 5355020 +
aggatatccacaaaaaactc

SEQ ID NO: 60003 - DNA, 20 bp, Artificial Sequence
  Synthetic oligonucleotide; AAGAAT chr11 5355058 5355077 5355074 +
tggaccaatttcctgacttg

SEQ ID NO: 60004 - DNA, 20 bp, Artificial Sequence
  Synthetic oligonucleotide; AAGGAT chr11 5355146 5355165 5355162 +
ctcaacagagcttcaggagg

SEQ ID NO: 60005 - DNA, 20 bp, Artificial Sequence
  Synthetic oligonucleotide; TAGAAT chr11 5355176 5355195 5355192 +
gcctctgtctaaggcagaag

SEQ ID NO: 60006 - DNA, 20 bp, Artificial Sequence
  Synthetic oligonucleotide; AAGAGT chr11 5355206 5355225 5355222 +
gaaagcatagagaaagtttg

SEQ ID NO: 60007 - DNA, 20 bp, Artificial Sequence
  Synthetic oligonucleotide; ACGAAT chr11 5355255 5355274 5355271 +
ttaccattattatagtcaag

SEQ ID NO: 60008 - DNA, 20 bp, Artificial Sequence
  Synthetic oligonucleotide; TTGGAT chr11 5355260 5355279 5355276 +
attattatagtcaagacgaa

SEQ ID NO: 60009 - DNA, 20 bp, Artificial Sequence
  Synthetic oligonucleotide; CTGGGT chr11 5355364 5355383 5355380 +
agtatgaagtgatgatgaaa

SEQ ID NO: 60010 - DNA, 20 bp, Artificial Sequence
  Synthetic oligonucleotide; TTGGGT chr11 5355421 5355440 5355437 +
aaagagcaacacccactgat

SEQ ID NO: 60011 - DNA, 20 bp, Artificial Sequence
  Synthetic oligonucleotide; CTGAGT chr11 5355539 5355558 5355555 +
ttctcctatgccagcatgac

SEQ ID NO: 60012 - DNA, 20 bp, Artificial Sequence
  Synthetic oligonucleotide; AAGAGT chr11 5355755 5355774 5355771 +
taaaaattaaaaaaaaaaaa

SEQ ID NO: 60013 - DNA, 20 bp, Artificial Sequence
  Synthetic oligonucleotide; TAGGGT chr11 5355760 5355779 5355776 +
attaaaaaaaaaaaaaagag

SEQ ID NO: 60014 - DNA, 20 bp, Artificial Sequence
  Synthetic oligonucleotide; AGGGGT chr11 5355768 5355787 5355784 +
aaaaaaaaagagtagggtca

SEQ ID NO: 60015 - DNA, 20 bp, Artificial Sequence
  Synthetic oligonucleotide; TAGGGT chr11 5355775 5355794 5355791 +
aagagtagggtcaaggggta

SEQ ID NO: 60016 - DNA, 20 bp, Artificial Sequence
  Synthetic oligonucleotide; AAGGAT chr11 5355796 5355815 5355812 +
agggtagcaaaattttctta

SEQ ID NO: 60017 - DNA, 20 bp, Artificial Sequence
  Synthetic oligonucleotide; GAGGGT chr11 5355894 5355913 5355910 +
ttaaaaatctgctgcaagct

SEQ ID NO: 60018 - DNA, 20 bp, Artificial Sequence
  Synthetic oligonucleotide; CAGAGT chr11 5356041 5356060 5356057 +
aaactggaaactctaaaaat

SEQ ID NO: 60019 - DNA, 20 bp, Artificial Sequence
  Synthetic oligonucleotide; AGGAAT chr11 5356063 5356082 5356079 +
gagtgcctctcctcctccaa

SEQ ID NO: 60020 - DNA, 20 bp, Artificial Sequence
  Synthetic oligonucleotide; GAGAAT chr11 5356104 5356123 5356120 +
caacggtacaaagctggaca

SEQ ID NO: 60021 - DNA, 20 bp, Artificial Sequence
  Synthetic oligonucleotide; TAGAAT chr11 5356232 5356251 5356248 +
aaattagactaatggctaac

SEQ ID NO: 60022 - DNA, 20 bp, Artificial Sequence
  Synthetic oligonucleotide; ATGAAT chr11 5356303 5356322 5356319 +
caaggcatgagaactacatg

SEQ ID NO: 60023 - DNA, 20 bp, Artificial Sequence
  Synthetic oligonucleotide; AAGGGT chr11 5356346 5356365 5356362 +
tgattcgatcaactggaaga

SEQ ID NO: 60024 - DNA, 20 bp, Artificial Sequence
  Synthetic oligonucleotide; ATGAAT chr11 5356371 5356390 5356387 +
tatcagtgatggaagatcaa

SEQ ID NO: 60025 - DNA, 20 bp, Artificial Sequence
  Synthetic oligonucleotide; AAGAAT chr11 5356409 5356428 5356425 +
gaagagaagtttagagaaaa

SEQ ID NO: 60026 - DNA, 20 bp, Artificial Sequence
  Synthetic oligonucleotide; CAGAAT chr11 5356503 5356522 5356519 +
gtgtacctgaaagtgacggg

SEQ ID NO: 60027 - DNA, 20 bp, Artificial Sequence
  Synthetic oligonucleotide; CAGGAT chr11 5356533 5356552 5356549 +
ccaagttggaaaacactctg

SEQ ID NO: 60028 - DNA, 20 bp, Artificial Sequence
  Synthetic oligonucleotide; AAGGGT chr11 5356691 5356710 5356707 +
gaaatgaagggaaaaatgtt

SEQ ID NO: 60029 - DNA, 20 bp, Artificial Sequence
  Synthetic oligonucleotide; TCGGGT chr11 5356712 5356731 5356728 +
agggtagccagagagaaagg

SEQ ID NO: 60030 - DNA, 20 bp, Artificial Sequence
  Synthetic oligonucleotide; CAGAAT chr11 5356739 5356758 5356755 +
acccacaaagggaagcccat

SEQ ID NO: 60031 - DNA, 20 bp, Artificial Sequence
  Synthetic oligonucleotide; GAGAGT chr11 5356783 5356802 5356799 +
agaaactctacaagccagaa

SEQ ID NO: 60032 - DNA, 20 bp, Artificial Sequence
  Synthetic oligonucleotide; AAGAAT chr11 5356818 5356837 5356834 +
tattcaacatccttaaagga

SEQ ID NO: 60033 - DNA, 20 bp, Artificial Sequence
  Synthetic oligonucleotide; CAGAAT chr11 5356832 5356851 5356848 +
aaaggaaagaattttcaaca

SEQ ID NO: 60034 - DNA, 20 bp, Artificial Sequence
  Synthetic oligonucleotide; CAGGAT chr11 5357083 5357102 5357099 +
accagctaacatcataatga

SEQ ID NO: 60035 - DNA, 20 bp, Artificial Sequence
  Synthetic oligonucleotide; AAGAGT chr11 5357171 5357190 5357187 +
acagacgggcaaattagata

SEQ ID NO: 60036 - DNA, 20 bp, Artificial Sequence
  Synthetic oligonucleotide; AGGGAT chr11 5357247 5357266 5357263 +
cacacataggctcaaaataa

SEQ ID NO: 60037 - DNA, 20 bp, Artificial Sequence
  Synthetic oligonucleotide; AGGGGT chr11 5357293 5357312 5357309 +
aatggaaaacaaaaaaaggc

SEQ ID NO: 60038 - DNA, 20 bp, Artificial Sequence
  Synthetic oligonucleotide; AGGGAT chr11 5357379 5357398 5357395 +
aggccattacataatggtaa

SEQ ID NO: 60039 - DNA, 20 bp, Artificial Sequence
  Synthetic oligonucleotide; AAGGAT chr11 5357579 5357598 5357595 +
caacgagacagaaagttaac

SEQ ID NO: 60040 - DNA, 20 bp, Artificial Sequence
  Synthetic oligonucleotide; AGGAAT chr11 5357589 5357608 5357605 +
gaaagttaacaaggatatcc

SEQ ID NO: 60041 - DNA, 20 bp, Artificial Sequence
  Synthetic oligonucleotide; CAGAAT chr11 5357658 5357677 5357674 +
aactctccaccccaaatcaa

SEQ ID NO: 60042 - DNA, 20 bp, Artificial Sequence
  Synthetic oligonucleotide; CAGGAT chr11 5357803 5357822 5357819 +
agtgcaatcaaactagaact

SEQ ID NO: 60043 - DNA, 20 bp, Artificial Sequence
  Synthetic oligonucleotide; CTGAAT chr11 5357861 5357880 5357877 +
ggaaaccgaacaaattgctc

SEQ ID NO: 60044 - DNA, 20 bp, Artificial Sequence
  Synthetic oligonucleotide; CTGGGT chr11 5357872 5357891 5357888 +
aaattgctcctgaatgacta

SEQ ID NO: 60045 - DNA, 20 bp, Artificial Sequence
  Synthetic oligonucleotide; CAGAAT chr11 5357945 5357964 5357961 +
agaacaaagacacaacatac

SEQ ID NO: 60046 - DNA, 20 bp, Artificial Sequence
  Synthetic oligonucleotide; ATGAAT chr11 5358172 5358191 5358188 +
aaaaacccttcaaaaaatca

SEQ ID NO: 60047 - DNA, 20 bp, Artificial Sequence
  Synthetic oligonucleotide; AAGAAT chr11 5358252 5358271 5358268 +
taataaagaagaaaagagag

SEQ ID NO: 60048 - DNA, 20 bp, Artificial Sequence
  Synthetic oligonucleotide; AAGGGT chr11 5358283 5358302 5358299 +
agatgcaataaaaaatgata

SEQ ID NO: 60049 - DNA, 20 bp, Artificial Sequence
  Synthetic oligonucleotide; GAGAAT chr11 5358328 5358347 5358344 +
agaaatacaaaccaccatca

SEQ ID NO: 60050 - DNA, 20 bp, Artificial Sequence
  Synthetic oligonucleotide; ATGGAT chr11 5358378 5358397 5358394 +
aactagaaaatctagaagaa

SEQ ID NO: 60051 - DNA, 20 bp, Artificial Sequence
  Synthetic oligonucleotide; TTGAAT chr11 5358430 5358449 5358446 +
aagactaaaccaggaagaag

SEQ ID NO: 60052 - DNA, 20 bp, Artificial Sequence
  Synthetic oligonucleotide; CTGAAT chr11 5358438 5358457 5358454 +
accaggaagaagttgaatct

SEQ ID NO: 60053 - DNA, 20 bp, Artificial Sequence
  Synthetic oligonucleotide; CAGGAT chr11 5358454 5358473 5358470 +
atctctgaatagaccaataa

SEQ ID NO: 60054 - DNA, 20 bp, Artificial Sequence
  Synthetic oligonucleotide; TGGAGT chr11 5358515 5358534 5358531 +
aaaaacagtccaggaccaga

SEQ ID NO: 60055 - DNA, 20 bp, Artificial Sequence
  Synthetic oligonucleotide; TCGAAT chr11 5358580 5358599 5358596 +
accattccctctgaaactat

SEQ ID NO: 60056 - DNA, 20 bp, Artificial Sequence
  Synthetic oligonucleotide; GGGAAT chr11 5358599 5358618 5358615 +
ttcgaatcaatagtaaaaga

SEQ ID NO: 60057 - DNA, 20 bp, Artificial Sequence
  Synthetic oligonucleotide; GAGAAT chr11 5358675 5358694 5358691 +
gcagagacacaacaaaaaaa

SEQ ID NO: 60058 - DNA, 20 bp, Artificial Sequence
  Synthetic oligonucleotide; TGGGAT chr11 5358797 5358816 5358813 +
gatcaagtgggcttcatccc

SEQ ID NO: 60059 - DNA, 20 bp, Artificial Sequence
  Synthetic oligonucleotide; CTGAAT chr11 5359020 5359039 5359036 +
aacccacagccaatatcata

SEQ ID NO: 60060 - DNA, 20 bp, Artificial Sequence
  Synthetic oligonucleotide; AGGGAT chr11 5359069 5359088 5359085 +
tttgaaaactggcacaagac

SEQ ID NO: 60061 - DNA, 20 bp, Artificial Sequence
  Synthetic oligonucleotide; TGGAAT chr11 5359108 5359127 5359124 +
actcctattcaacatagtgt

SEQ ID NO: 60062 - DNA, 20 bp, Artificial Sequence
  Synthetic oligonucleotide; CAGGAT chr11 5359278 5359297 5359294 +
aggcaacttcagcaaagtct

SEQ ID NO: 60063 - DNA, 20 bp, Artificial Sequence
  Synthetic oligonucleotide; GAGAAT chr11 5359384 5359403 5359400 +
ccattcacaattgcttcaaa

SEQ ID NO: 60064 - DNA, 20 bp, Artificial Sequence
  Synthetic oligonucleotide; AGGAAT chr11 5359399 5359418 5359415 +
tcaaagagaataaaatacct

SEQ ID NO: 60065 - DNA, 20 bp, Artificial Sequence
  Synthetic oligonucleotide; CTGAAT chr11 5359457 5359476 5359473 +
aggagaactacaaaccactg

SEQ ID NO: 60066 - DNA, 20 bp, Artificial Sequence
  Synthetic oligonucleotide; ATGGGT chr11 5359507 5359526 5359523 +
tggaagaacattccatgctc

SEQ ID NO: 60067 - DNA, 20 bp, Artificial Sequence
  Synthetic oligonucleotide; AAGAAT chr11 5359516 5359535 5359532 +
attccatgctcatgggtagg

SEQ ID NO: 60068 - DNA, 20 bp, Artificial Sequence
  Synthetic oligonucleotide; CAGAAT chr11 5359605 5359624 5359621 +
gctaccaatgactttcttca

SEQ ID NO: 60069 - DNA, 20 bp, Artificial Sequence
  Synthetic oligonucleotide; AAGGAT chr11 5359874 5359893 5359890 +
acaaaaaaaacaaatgggga

SEQ ID NO: 60070 - DNA, 20 bp, Artificial Sequence
  Synthetic oligonucleotide; CTGGAT chr11 5359937 5359956 5359953 +
ccatacgcagaaagctgaaa

SEQ ID NO: 60071 - DNA, 20 bp, Artificial Sequence
  Synthetic oligonucleotide; ATGGAT chr11 5359978 5359997 5359994 +
tatacaaaaattaattcaag

SEQ ID NO: 60072 - DNA, 20 bp, Artificial Sequence
  Synthetic oligonucleotide; TGGGAT chr11 5360123 5360142 5360139 +
caaaagccaaaatggacaaa

SEQ ID NO: 60073 - DNA, 20 bp, Artificial Sequence
  Synthetic oligonucleotide; CAGAGT chr11 5360173 5360192 5360189 +
acagcaaaagaaactaccat

SEQ ID NO: 60074 - DNA, 20 bp, Artificial Sequence
  Synthetic oligonucleotide; CAGAAT chr11 5360193 5360212 5360209 +
cagagtgaacaggcaacata

SEQ ID NO: 60075 - DNA, 20 bp, Artificial Sequence
  Synthetic oligonucleotide; CAGAAT chr11 5360245 5360264 5360261 +
tccgacaaagggctaatatc

SEQ ID NO: 60076 - DNA, 20 bp, Artificial Sequence
  Synthetic oligonucleotide; AAGGAT chr11 5360308 5360327 5360324 +
accccatcaaaaagtgggca

SEQ ID NO: 60077 - DNA, 20 bp, Artificial Sequence
  Synthetic oligonucleotide; TAGAAT chr11 5360439 5360458 5360455 +
agataccatctcacaccagt

SEQ ID NO: 60078 - DNA, 20 bp, Artificial Sequence
  Synthetic oligonucleotide; GAGGAT chr11 5360483 5360502 5360499 +
aggaaacaacaggtgctgga

SEQ ID NO: 60079 - DNA, 20 bp, Artificial Sequence
  Synthetic oligonucleotide; AGGGAT chr11 5360572 5360591 5360588 +
agtcagtgtggcgattcctc

SEQ ID NO: 60080 - DNA, 20 bp, Artificial Sequence
  Synthetic oligonucleotide; CTGGGT chr11 5360617 5360636 5360633 +
ttgacccagccatcccatta

SEQ ID NO: 60081 - DNA, 20 bp, Artificial Sequence
  Synthetic oligonucleotide; AAGGAT chr11 5360632 5360651 5360648 +
cattactgggtacatactca

SEQ ID NO: 60082 - DNA, 20 bp, Artificial Sequence
  Synthetic oligonucleotide; CTGGAT chr11 5360742 5360761 5360758 +
aaatgtccaacaatgataga

SEQ ID NO: 60083 - DNA, 20 bp, Artificial Sequence
  Synthetic oligonucleotide; TGGAAT chr11 5360774 5360793 5360790 +
aacgtggcacatatacacca

SEQ ID NO: 60084 - DNA, 20 bp, Artificial Sequence
  Synthetic oligonucleotide; AAGAGT chr11 5360801 5360820 5360817 +
ctatgcagccataaaaaatg

SEQ ID NO: 60085 - DNA, 20 bp, Artificial Sequence
  Synthetic oligonucleotide; ATGGAT chr11 5360826 5360845 5360842 +
ttcatgtcctttgtagggac

SEQ ID NO: 60086 - DNA, 20 bp, Artificial Sequence
  Synthetic oligonucleotide; GGGAAT chr11 5360907 5360926 5360923 +
gcatgttctcactcataggt

SEQ ID NO: 60087 - DNA, 20 bp, Artificial Sequence
  Synthetic oligonucleotide; TGGGGT chr11 5360970 5360989 5360986 +
tcacacaccagggcctgcag

SEQ ID NO: 60088 - DNA, 20 bp, Artificial Sequence
  Synthetic oligonucleotide; GGGGGT chr11 5360976 5360995 5360992 +
accagggcctgcagtggggt

SEQ ID NO: 60089 - DNA, 20 bp, Artificial Sequence
  Synthetic oligonucleotide; AGGGAT chr11 5360989 5361008 5361005 +
gtggggtgggggtcgggggg

SEQ ID NO: 60090 - DNA, 20 bp, Artificial Sequence
  Synthetic oligonucleotide; ACGAGT chr11 5361025 5361044 5361041 +
gatatacctaatgctaagtg

SEQ ID NO: 60091 - DNA, 20 bp, Artificial Sequence
  Synthetic oligonucleotide; ATGGGT chr11 5361033 5361052 5361049 +
taatgctaagtgacgagtta

SEQ ID NO: 60092 - DNA, 20 bp, Artificial Sequence
  Synthetic oligonucleotide; GAGAAT chr11 5361302 5361321 5361318 +
ttctaaatccctcaggctgg

SEQ ID NO: 60093 - DNA, 20 bp, Artificial Sequence
  Synthetic oligonucleotide; AGGAGT chr11 5361327 5361346 5361343 +
taaagaaggagggaggagag

SEQ ID NO: 60094 - DNA, 20 bp, Artificial Sequence
  Synthetic oligonucleotide; AGGAGT chr11 5361344 5361363 5361360 +
gagaggagtgggccgtaggg

SEQ ID NO: 60095 - DNA, 20 bp, Artificial Sequence
  Synthetic oligonucleotide; CTGAGT chr11 5361382 5361401 5361398 +
ttttctttgcagcttggctt

SEQ ID NO: 60096 - DNA, 20 bp, Artificial Sequence
  Synthetic oligonucleotide; TTGGAT chr11 5361407 5361426 5361423 +
tatagtctaaaaagttggtg

SEQ ID NO: 60097 - DNA, 20 bp, Artificial Sequence
  Synthetic oligonucleotide; AGGGGT chr11 5361433 5361452 5361449 +
ccaatatcttgaccaggctt

SEQ ID NO: 60098 - DNA, 20 bp, Artificial Sequence
  Synthetic oligonucleotide; AGGAAT chr11 5361526 5361545 5361542 +
ttggcctagaggctccgcat

SEQ ID NO: 60099 - DNA, 20 bp, Artificial Sequence
  Synthetic oligonucleotide; TGGGGT chr11 5361602 5361621 5361618 +
atgtatcagtcaagatgtga

SEQ ID NO: 60100 - DNA, 20 bp, Artificial Sequence
  Synthetic oligonucleotide; AAGAAT chr11 5361610 5361629 5361626 +
gtcaagatgtgatggggtat

SEQ ID NO: 60101 - DNA, 20 bp, Artificial Sequence
  Synthetic oligonucleotide; CTGAAT chr11 5361658 5361677 5361674 +
aaatctttagaacttggctt

SEQ ID NO: 60102 - DNA, 20 bp, Artificial Sequence
  Synthetic oligonucleotide; CAGAGT chr11 5361724 5361743 5361740 +
tctcctttttcattccctag

SEQ ID NO: 60103 - DNA, 20 bp, Artificial Sequence
  Synthetic oligonucleotide; GGGAAT chr11 5361765 5361784 5361781 +
aaatcaagttgaaaatccac

SEQ ID NO: 60104 - DNA, 20 bp, Artificial Sequence
  Synthetic oligonucleotide; CAGAAT chr11 5361772 5361791 5361788 +
gttgaaaatccacgggaata

SEQ ID NO: 60105 - DNA, 20 bp, Artificial Sequence
  Synthetic oligonucleotide; TTGGAT chr11 5361808 5361827 5361824 +
gtgtagttccagactctggt

SEQ ID NO: 60106 - DNA, 20 bp, Artificial Sequence
  Synthetic oligonucleotide; TAGAGT chr11 5361912 5361931 5361928 +
actcccaaaaaagatgaagt

SEQ ID NO: 60107 - DNA, 20 bp, Artificial Sequence
  Synthetic oligonucleotide; GAGGAT chr11 5361918 5361937 5361934 +
aaaaaagatgaagttagagt

SEQ ID NO: 60108 - DNA, 20 bp, Artificial Sequence
  Synthetic oligonucleotide; AAGGGT chr11 5361942 5361961 5361958 +
ataggggacactgtaatgac

SEQ ID NO: 60109 - DNA, 20 bp, Artificial Sequence
  Synthetic oligonucleotide; TTGAGT chr11 5361993 5362012 5362009 +
ccaaatagattagtgtcaga

SEQ ID NO: 60110 - DNA, 20 bp, Artificial Sequence
  Synthetic oligonucleotide; GAGAGT chr11 5362186 5362205 5362202 +
atctcaaccacacccagata

SEQ ID NO: 60111 - DNA, 20 bp, Artificial Sequence
  Synthetic oligonucleotide; GTGGAT chr11 5362196 5362215 5362212 +
cacccagatagagagtgata

SEQ ID NO: 60112 - DNA, 20 bp, Artificial Sequence
  Synthetic oligonucleotide; GGGGAT chr11 5362217 5362236 5362233 +
tggatcccgtgtttctgtcg

SEQ ID NO: 60113 - DNA, 20 bp, Artificial Sequence
  Synthetic oligonucleotide; GGGAGT chr11 5362223 5362242 5362239 +
ccgtgtttctgtcgggggat

SEQ ID NO: 60114 - DNA, 20 bp, Artificial Sequence
  Synthetic oligonucleotide; CTGGAT chr11 5362290 5362309 5362306 +
ctacccagatgaaaatggtg

SEQ ID NO: 60115 - DNA, 20 bp, Artificial Sequence
  Synthetic oligonucleotide; AGGAAT chr11 5362345 5362364 5362361 +
aatcaactacgaagatggtc

SEQ ID NO: 60116 - DNA, 20 bp, Artificial Sequence
  Synthetic oligonucleotide; GAGAAT chr11 5362426 5362445 5362442 +
tagttgttgagccttataat

SEQ ID NO: 60117 - DNA, 20 bp, Artificial Sequence
  Synthetic oligonucleotide; CTGGAT chr11 5362453 5362472 5362469 +
tgatgattaaatcaggtcta

SEQ ID NO: 60118 - DNA, 20 bp, Artificial Sequence
  Synthetic oligonucleotide; ATGAAT chr11 5362462 5362481 5362478 +
aatcaggtctactggatact

SEQ ID NO: 60119 - DNA, 20 bp, Artificial Sequence
  Synthetic oligonucleotide; CAGAAT chr11 5362468 5362487 5362484 +
gtctactggatactatgaat

SEQ ID NO: 60120 - DNA, 20 bp, Artificial Sequence
  Synthetic oligonucleotide; CAGAGT chr11 5362565 5362584 5362581 +
taacagaagtcttctggtgg

SEQ ID NO: 60121 - DNA, 20 bp, Artificial Sequence
  Synthetic oligonucleotide; AAGAGT chr11 5362749 5362768 5362765 +
gtacacttgtgatatctata

SEQ ID NO: 60122 - DNA, 20 bp, Artificial Sequence
  Synthetic oligonucleotide; CTGGGT chr11 5362808 5362827 5362824 +
gaagtcctcttcctgatgct

SEQ ID NO: 60123 - DNA, 20 bp, Artificial Sequence
  Synthetic oligonucleotide; GTGAGT chr11 5362826 5362845 5362842 +
ctctgggttggcatctacat

SEQ ID NO: 60124 - DNA, 20 bp, Artificial Sequence
  Synthetic oligonucleotide; AAGAGT chr11 5362836 5362855 5362852 +
gcatctacatgtgagtgccc

SEQ ID NO: 60125 - DNA, 20 bp, Artificial Sequence
  Synthetic oligonucleotide; CTGAAT chr11 5362860 5362879 5362876 +
gtaacaaccaggtggcttca

SEQ ID NO: 60126 - DNA, 20 bp, Artificial Sequence
  Synthetic oligonucleotide; AGGGAT chr11 5362980 5362999 5362996 +
agaaataatagaagttaggc

SEQ ID NO: 60127 - DNA, 20 bp, Artificial Sequence
  Synthetic oligonucleotide; CTGAGT chr11 5363061 5363080 5363077 +
aaaatgtgctaagtagatgt

SEQ ID NO: 60128 - DNA, 20 bp, Artificial Sequence
  Synthetic oligonucleotide; CTGAGT chr11 5363109 5363128 5363125 +
cttaagggaagaaagagacc

SEQ ID NO: 60129 - DNA, 20 bp, Artificial Sequence
  Synthetic oligonucleotide; CAGAAT chr11 5363141 5363160 5363157 +
aaaactcaaagttttacgaa

SEQ ID NO: 60130 - DNA, 20 bp, Artificial Sequence
  Synthetic oligonucleotide; CAGGAT chr11 5363179 5363198 5363195 +
gaaatcatttttcatcaata

SEQ ID NO: 60131 - DNA, 20 bp, Artificial Sequence
  Synthetic oligonucleotide; GTGAGT chr11 5363269 5363288 5363285 +
acacacacacacacacaccg

SEQ ID NO: 60132 - DNA, 20 bp, Artificial Sequence
  Synthetic oligonucleotide; TGGAAT chr11 5363313 5363332 5363329 +
aagtcatgatgcagcagtat

SEQ ID NO: 60133 - DNA, 20 bp, Artificial Sequence
  Synthetic oligonucleotide; TTGAGT chr11 5363365 5363384 5363381 +
ttttacttcaagctatggtg

SEQ ID NO: 60134 - DNA, 20 bp, Artificial Sequence
  Synthetic oligonucleotide; TTGAGT chr11 5363552 5363571 5363568 +
caagcacagataccaagttt

SEQ ID NO: 60135 - DNA, 20 bp, Artificial Sequence
  Synthetic oligonucleotide; GTGAAT chr11 5363558 5363577 5363574 +
cagataccaagtttttgagt

SEQ ID NO: 60136 - DNA, 20 bp, Artificial Sequence
  Synthetic oligonucleotide; TGGAAT chr11 5363624 5363643 5363640 +
actactaagattatattgtc

SEQ ID NO: 60137 - DNA, 20 bp, Artificial Sequence
  Synthetic oligonucleotide; GAGGAT chr11 5363744 5363763 5363760 +
cgggaaagtagcattttcat

SEQ ID NO: 60138 - DNA, 20 bp, Artificial Sequence
  Synthetic oligonucleotide; AGGAAT chr11 5363944 5363963 5363960 +
aaggaggagaagcttgtgtt

SEQ ID NO: 60139 - DNA, 20 bp, Artificial Sequence
  Synthetic oligonucleotide; AAGAAT chr11 5363952 5363971 5363968 +
gaagcttgtgttaggaatgg

SEQ ID NO: 60140 - DNA, 20 bp, Artificial Sequence
  Synthetic oligonucleotide; AAGAGT chr11 5364116 5364135 5364132 +
aggtatctcaacactaaaga

SEQ ID NO: 60141 - DNA, 20 bp, Artificial Sequence
  Synthetic oligonucleotide; CAGGGT chr11 5364130 5364149 5364146 +
taaagaaagagtaaaatttt

SEQ ID NO: 60142 - DNA, 20 bp, Artificial Sequence
  Synthetic oligonucleotide; TGGAAT chr11 5364299 5364318 5364315 +
tcttgacttcacaaaaccat

SEQ ID NO: 60143 - DNA, 20 bp, Artificial Sequence
  Synthetic oligonucleotide; TGGGGT chr11 5364306 5364325 5364322 +
ttcacaaaaccattggaatt

SEQ ID NO: 60144 - DNA, 20 bp, Artificial Sequence
  Synthetic oligonucleotide; CAGGAT chr11 5364400 5364419 5364416 +
gtgatgtgtcatttctgtga

SEQ ID NO: 60145 - DNA, 20 bp, Artificial Sequence
  Synthetic oligonucleotide; GAGAGT chr11 5364525 5364544 5364541 +
tttaagcacagtgctttgaa

SEQ ID NO: 60146 - DNA, 20 bp, Artificial Sequence
  Synthetic oligonucleotide; CTGAAT chr11 5364635 5364654 5364651 +
ctccatcctcatgtgcatct

SEQ ID NO: 60147 - DNA, 20 bp, Artificial Sequence
  Synthetic oligonucleotide; GTGAAT chr11 5364717 5364736 5364733 +
atgacagaagactcttcaaa

SEQ ID NO: 60148 - DNA, 20 bp, Artificial Sequence
  Synthetic oligonucleotide; CAGGGT chr11 5364742 5364761 5364758 +
tgatcaaagtcccttgttta

SEQ ID NO: 60149 - DNA, 20 bp, Artificial Sequence
  Synthetic oligonucleotide; CTGGAT chr11 5364780 5364799 5364796 +
ttccttcctgagcatgtgtt

SEQ ID NO: 60150 - DNA, 20 bp, Artificial Sequence
  Synthetic oligonucleotide; GTGAAT chr11 5364837 5364856 5364853 +
cctttcctaagtttctattg

SEQ ID NO: 60151 - DNA, 20 bp, Artificial Sequence
  Synthetic oligonucleotide; GTGGAT chr11 5364908 5364927 5364924 +
taatcattgtagcttctatg

SEQ ID NO: 60152 - DNA, 20 bp, Artificial Sequence
  Synthetic oligonucleotide; GGGGAT chr11 5364968 5364987 5364984 +
gaagtaacagaaggctacaa

SEQ ID NO: 60153 - DNA, 20 bp, Artificial Sequence
  Synthetic oligonucleotide; ATGAAT chr11 5365015 5365034 5365031 +
ttgtcattcttgtcacagca

SEQ ID NO: 60154 - DNA, 20 bp, Artificial Sequence
  Synthetic oligonucleotide; TTGAAT chr11 5365083 5365102 5365099 +
taatcatgcttgtaataacc

SEQ ID NO: 60155 - DNA, 20 bp, Artificial Sequence
  Synthetic oligonucleotide; GTGAGT chr11 5365138 5365157 5365154 +
taacttttcttctttgtctg

SEQ ID NO: 60156 - DNA, 20 bp, Artificial Sequence
  Synthetic oligonucleotide; TAGAGT chr11 5365156 5365175 5365172 +
tggtgagttctgtagacatt

SEQ ID NO: 60157 - DNA, 20 bp, Artificial Sequence
  Synthetic oligonucleotide; TAGAAT chr11 5365262 5365281 5365278 +
ggtggtgagaacagtgttat

SEQ ID NO: 60158 - DNA, 20 bp, Artificial Sequence
  Synthetic oligonucleotide; ATGGGT chr11 5365297 5365316 5365313 +
gtttgccagctgtggaaaac

SEQ ID NO: 60159 - DNA, 20 bp, Artificial Sequence
  Synthetic oligonucleotide; TGGGAT chr11 5365375 5365394 5365391 +
tggcaacaagtaaccaaata

SEQ ID NO: 60160 - DNA, 20 bp, Artificial Sequence
  Synthetic oligonucleotide; CAGGAT chr11 5365490 5365509 5365506 +
accattttcctgtctatgca

SEQ ID NO: 60161 - DNA, 20 bp, Artificial Sequence
  Synthetic oligonucleotide; TAGGAT chr11 5365495 5365514 5365511 +
tttcctgtctatgcacagga

SEQ ID NO: 60162 - DNA, 20 bp, Artificial Sequence
  Synthetic oligonucleotide; GTGAAT chr11 5365601 5365620 5365617 +
gccatgacagggctcttggt

SEQ ID NO: 60163 - DNA, 20 bp, Artificial Sequence
  Synthetic oligonucleotide; CAGGAT chr11 5365822 5365841 5365838 +
agtatgtgctggcttgatga

SEQ ID NO: 60164 - DNA, 20 bp, Artificial Sequence
  Synthetic oligonucleotide; TTGGGT chr11 5365873 5365892 5365889 +
agaggaactctgcttacctc

SEQ ID NO: 60165 - DNA, 20 bp, Artificial Sequence
  Synthetic oligonucleotide; AAGGGT chr11 5365883 5365902 5365899 +
tgcttacctcttgggttctg

SEQ ID NO: 60166 - DNA, 20 bp, Artificial Sequence
  Synthetic oligonucleotide; AAGAGT chr11 5366054 5366073 5366070 +
tgtttgggggctgttaatgg

SEQ ID NO: 60167 - DNA, 20 bp, Artificial Sequence
  Synthetic oligonucleotide; AGGGGT chr11 5366065 5366084 5366081 +
tgttaatggaagagttgctg

SEQ ID NO: 60168 - DNA, 20 bp, Artificial Sequence
  Synthetic oligonucleotide; GAGGAT chr11 5366141 5366160 5366157 +
aataagaaacagtatgtgaa

SEQ ID NO: 60169 - DNA, 20 bp, Artificial Sequence
  Synthetic oligonucleotide; AAGGAT chr11 5366171 5366190 5366187 +
caagccttaagtaggaagtt

SEQ ID NO: 60170 - DNA, 20 bp, Artificial Sequence
  Synthetic oligonucleotide; AAGAAT chr11 5366248 5366267 5366264 +
agggccagagaaacagaagg

SEQ ID NO: 60171 - DNA, 20 bp, Artificial Sequence
  Synthetic oligonucleotide; GTGGGT chr11 5366284 5366303 5366300 +
gctcaagggaaggttcctct

SEQ ID NO: 60172 - DNA, 20 bp, Artificial Sequence
  Synthetic oligonucleotide; TTGGGT chr11 5366343 5366362 5366359 +
atgcctgtaatcccagcact

SEQ ID NO: 60173 - DNA, 20 bp, Artificial Sequence
  Synthetic oligonucleotide; GAGGAT chr11 5366360 5366379 5366376 +
actttgggtggctgaggcag

SEQ ID NO: 60174 - DNA, 20 bp, Artificial Sequence
  Synthetic oligonucleotide; AAGAGT chr11 5366377 5366396 5366393 +
caggaggatcacctgagggc

SEQ ID NO: 60175 - DNA, 20 bp, Artificial Sequence
  Synthetic oligonucleotide; GAGAAT chr11 5366497 5366516 5366513 +
tacacaggaggctgaggtag

SEQ ID NO: 60176 - DNA, 20 bp, Artificial Sequence
  Synthetic oligonucleotide; CAGGGT chr11 5366727 5366746 5366743 +
aaagaaggaaggaaggaaat

SEQ ID NO: 60177 - DNA, 20 bp, Artificial Sequence
  Synthetic oligonucleotide; TAGAAT chr11 5366756 5366775 5366772 +
cacttgagattcaaagtctt

SEQ ID NO: 60178 - DNA, 20 bp, Artificial Sequence
  Synthetic oligonucleotide; ACGGGT chr11 5366818 5366837 5366834 +
gactaattccaatcccaagc

SEQ ID NO: 60179 - DNA, 20 bp, Artificial Sequence
  Synthetic oligonucleotide; AGGGGT chr11 5366857 5366876 5366873 +
aggactgggaaggtttaggc

SEQ ID NO: 60180 - DNA, 20 bp, Artificial Sequence
  Synthetic oligonucleotide; CAGGAT chr11 5367008 5367027 5367024 +
tcccgctgcagtccatgaac

SEQ ID NO: 60181 - DNA, 20 bp, Artificial Sequence
  Synthetic oligonucleotide; AGGAAT chr11 5367058 5367077 5367074 +
aagacattctctcaagtctc

SEQ ID NO: 60182 - DNA, 20 bp, Artificial Sequence
  Synthetic oligonucleotide; CAGAGT chr11 5367131 5367150 5367147 +
tgcaaagccacttagtgaca

SEQ ID NO: 60183 - DNA, 20 bp, Artificial Sequence
  Synthetic oligonucleotide; TGGAAT chr11 5367158 5367177 5367174 +
ttagttatttcattgtgaac

SEQ ID NO: 60184 - DNA, 20 bp, Artificial Sequence
  Synthetic oligonucleotide; AGGAGT chr11 5367211 5367230 5367227 +
agttaaaagcattgccagaa

SEQ ID NO: 60185 - DNA, 20 bp, Artificial Sequence
  Synthetic oligonucleotide; GAGGGT chr11 5367236 5367255 5367252 +
tcacaatccagaccctaaga

SEQ ID NO: 60186 - DNA, 20 bp, Artificial Sequence
  Synthetic oligonucleotide; TTGGAT chr11 5367244 5367263 5367260 +
cagaccctaagagagggttc

SEQ ID NO: 60187 - DNA, 20 bp, Artificial Sequence
  Synthetic oligonucleotide; AAGAAT chr11 5367263 5367282 5367279 +
cttggatttcgtgcccaaga

SEQ ID NO: 60188 - DNA, 20 bp, Artificial Sequence
  Synthetic oligonucleotide; AGGAGT chr11 5367319 5367338 5367335 +
caagttaattaagaaagtaa

SEQ ID NO: 60189 - DNA, 20 bp, Artificial Sequence
  Synthetic oligonucleotide; AGGGGT chr11 5367412 5367431 5367428 +
tattgatgatatgctaaaca

SEQ ID NO: 60190 - DNA, 20 bp, Artificial Sequence
  Synthetic oligonucleotide; GTGGAT chr11 5367416 5367435 5367432 +
gatgatatgctaaacaaggg

SEQ ID NO: 60191 - DNA, 20 bp, Artificial Sequence
  Synthetic oligonucleotide; GAGAGT chr11 5367505 5367524 5367521 +
aacagtcatagtgctggtgg

SEQ ID NO: 60192 - DNA, 20 bp, Artificial Sequence
  Synthetic oligonucleotide; GTGGGT chr11 5367557 5367576 5367573 +
ctcatcacaatcttggtttg

SEQ ID NO: 60193 - DNA, 20 bp, Artificial Sequence
  Synthetic oligonucleotide; GAGAAT chr11 5367652 5367671 5367668 +
tcttatctcatcctgtgact

SEQ ID NO: 60194 - DNA, 20 bp, Artificial Sequence
  Synthetic oligonucleotide; GGGAAT chr11 5367670 5367689 5367686 +
ctgagaatgcctaactttct

SEQ ID NO: 60195 - DNA, 20 bp, Artificial Sequence
  Synthetic oligonucleotide; TGGAGT chr11 5367723 5367742 5367739 +
tacccagctcctatttaaga

SEQ ID NO: 60196 - DNA, 20 bp, Artificial Sequence
  Synthetic oligonucleotide; CAGAAT chr11 5367791 5367810 5367807 +
gtttctggtatgctagcacc

SEQ ID NO: 60197 - DNA, 20 bp, Artificial Sequence
  Synthetic oligonucleotide; AGGAAT chr11 5367935 5367954 5367951 +
tccttactcagcagtttgtg

SEQ ID NO: 60198 - DNA, 20 bp, Artificial Sequence
  Synthetic oligonucleotide; CAGAGT chr11 5367969 5367988 5367985 +
cttcaaagtttcacttctac

SEQ ID NO: 60199 - DNA, 20 bp, Artificial Sequence
  Synthetic oligonucleotide; GGGAAT chr11 5368227 5368246 5368243 +
cagtcttatgcagtagtttt

SEQ ID NO: 60200 - DNA, 20 bp, Artificial Sequence
  Synthetic oligonucleotide; GGGGAT chr11 5368332 5368351 5368348 +
tggtccactcatctttaagt

SEQ ID NO: 60201 - DNA, 20 bp, Artificial Sequence
  Synthetic oligonucleotide; TTGAAT chr11 5368357 5368376 5368373 +
taccaatagtacccacatgg

SEQ ID NO: 60202 - DNA, 20 bp, Artificial Sequence
  Synthetic oligonucleotide; TTGAGT chr11 5368705 5368724 5368721 +
aaatttgaggtttctaaaca

SEQ ID NO: 60203 - DNA, 20 bp, Artificial Sequence
  Synthetic oligonucleotide; TGGAAT chr11 5368830 5368849 5368846 +
tgttcttaggagcaagatgt

SEQ ID NO: 60204 - DNA, 20 bp, Artificial Sequence
  Synthetic oligonucleotide; GTGGAT chr11 5368851 5368870 5368867 +
ggaatttacaccattcttat

SEQ ID NO: 60205 - DNA, 20 bp, Artificial Sequence
  Synthetic oligonucleotide; GAGGAT chr11 5368875 5368894 5368891 +
attaagagaggtttccttct

SEQ ID NO: 60206 - DNA, 20 bp, Artificial Sequence
  Synthetic oligonucleotide; CCGGAT chr11 5368913 5368932 5368929 +
tgttcaggaactttttcttt

SEQ ID NO: 60207 - DNA, 20 bp, Artificial Sequence
  Synthetic oligonucleotide; ATGAGT chr11 5369030 5369049 5369046 +
ctagatattcattcaccaag

SEQ ID NO: 60208 - DNA, 20 bp, Artificial Sequence
  Synthetic oligonucleotide; CAGAAT chr11 5369046 5369065 5369062 +
caagatgagtgcctttgaag

SEQ ID NO: 60209 - DNA, 20 bp, Artificial Sequence
  Synthetic oligonucleotide; TAGGGT chr11 5369058 5369077 5369074 +
ctttgaagcagaatctgtga

SEQ ID NO: 60210 - DNA, 20 bp, Artificial Sequence
  Synthetic oligonucleotide; TAGAAT chr11 5369096 5369115 5369112 +
tagagacatatggccatgac

SEQ ID NO: 60211 - DNA, 20 bp, Artificial Sequence
  Synthetic oligonucleotide; AAGGAT chr11 5369121 5369140 5369137 +
tctaaggttagacatacaga

SEQ ID NO: 60212 - DNA, 20 bp, Artificial Sequence
  Synthetic oligonucleotide; CTGAGT chr11 5369181 5369200 5369197 +
catccattcacacatataac

SEQ ID NO: 60213 - DNA, 20 bp, Artificial Sequence
  Synthetic oligonucleotide; CTGAAT chr11 5369211 5369230 5369227 +
actgattttctagtactgta

SEQ ID NO: 60214 - DNA, 20 bp, Artificial Sequence
  Synthetic oligonucleotide; TGGGGT chr11 5369258 5369277 5369274 +
gatatgtatgcccatgtgtg

SEQ ID NO: 60215 - DNA, 20 bp, Artificial Sequence
  Synthetic oligonucleotide; TGGAAT chr11 5369321 5369340 5369337 +
aagttattattactagttag

SEQ ID NO: 60216 - DNA, 20 bp, Artificial Sequence
  Synthetic oligonucleotide; GAGAAT chr11 5369381 5369400 5369397 +
gcaaaatataacacttttag

SEQ ID NO: 60217 - DNA, 20 bp, Artificial Sequence
  Synthetic oligonucleotide; CTGGAT chr11 5369442 5369461 5369458 +
agactttttatatatttttt

SEQ ID NO: 60218 - DNA, 20 bp, Artificial Sequence
  Synthetic oligonucleotide; GTGAAT chr11 5369817 5369836 5369833 +
gtctgcatttttgtgttaca

SEQ ID NO: 60219 - DNA, 20 bp, Artificial Sequence
  Synthetic oligonucleotide; CAGGAT chr11 5369916 5369935 5369932 +
agaaagggaagacattttct

SEQ ID NO: 60220 - DNA, 20 bp, Artificial Sequence
  Synthetic oligonucleotide; GAGAGT chr11 5370017 5370036 5370033 +
ctccctctgcatggccccag

SEQ ID NO: 60221 - DNA, 20 bp, Artificial Sequence
  Synthetic oligonucleotide; TTGAAT chr11 5370228 5370247 5370244 +
taaatcctaaagttgaaggt

SEQ ID NO: 60222 - DNA, 20 bp, Artificial Sequence
  Synthetic oligonucleotide; CAGGAT chr11 5370290 5370309 5370306 +
tatcttttatgctgactgtc

SEQ ID NO: 60223 - DNA, 20 bp, Artificial Sequence
  Synthetic oligonucleotide; CTGGGT chr11 5370364 5370383 5370380 +
caaagactaaactaaaatag

SEQ ID NO: 60224 - DNA, 20 bp, Artificial Sequence
  Synthetic oligonucleotide; GAGGAT chr11 5370416 5370435 5370432 +
aaattaaattcaaatcttca

SEQ ID NO: 60225 - DNA, 20 bp, Artificial Sequence
  Synthetic oligonucleotide; ATGAAT chr11 5370556 5370575 5370572 +
cactctttctgtgtttagaa

SEQ ID NO: 60226 - DNA, 20 bp, Artificial Sequence
  Synthetic oligonucleotide; TAGAAT chr11 5370564 5370583 5370580 +
ctgtgtttagaaatgaataa

SEQ ID NO: 60227 - DNA, 20 bp, Artificial Sequence
  Synthetic oligonucleotide; CTGGGT chr11 5370651 5370670 5370667 +
cttctctattttagcaacta

SEQ ID NO: 60228 - DNA, 20 bp, Artificial Sequence
  Synthetic oligonucleotide; GAGAAT chr11 5370794 5370813 5370810 +
agaaaaaatttgatgcaata

SEQ ID NO: 60229 - DNA, 20 bp, Artificial Sequence
  Synthetic oligonucleotide; GCGGGT chr11 5370831 5370850 5370847 +
tgtaagctagtgtgacaaat

SEQ ID NO: 60230 - DNA, 20 bp, Artificial Sequence
  Synthetic oligonucleotide; GAGAGT chr11 5370869 5370888 5370885 +
taatatttcagctgtgacct

SEQ ID NO: 60231 - DNA, 20 bp, Artificial Sequence
  Synthetic oligonucleotide; TTGAGT chr11 5371034 5371053 5371050 +
tttttccaagagcagataat

SEQ ID NO: 60232 - DNA, 20 bp, Artificial Sequence
  Synthetic oligonucleotide; ATGGAT chr11 5371095 5371114 5371111 +
agccctagctatggaccacc

SEQ ID NO: 60233 - DNA, 20 bp, Artificial Sequence
  Synthetic oligonucleotide; TGGAAT chr11 5371122 5371141 5371138 +
ttgaagtaagggctttgttt

SEQ ID NO: 60234 - DNA, 20 bp, Artificial Sequence
  Synthetic oligonucleotide; GAGGAT chr11 5371145 5371164 5371161 +
aattactctccacacattct

SEQ ID NO: 60235 - DNA, 20 bp, Artificial Sequence
  Synthetic oligonucleotide; CCGGAT chr11 5371229 5371248 5371245 +
aagccacacagcacctttcc

SEQ ID NO: 60236 - DNA, 20 bp, Artificial Sequence
  Synthetic oligonucleotide; TAGGGT chr11 5371236 5371255 5371252 +
acagcacctttccccggatc

SEQ ID NO: 60237 - DNA, 20 bp, Artificial Sequence
  Synthetic oligonucleotide; CTGAGT chr11 5371364 5371383 5371380 +
attgatgaaactgtaaaacc

SEQ ID NO: 60238 - DNA, 20 bp, Artificial Sequence
  Synthetic oligonucleotide; AAGAAT chr11 5371400 5371419 5371416 +
agatataaaatttcaacata

SEQ ID NO: 60239 - DNA, 20 bp, Artificial Sequence
  Synthetic oligonucleotide; AAGAGT chr11 5371460 5371479 5371476 +
gacagtgatagctgtatcta

SEQ ID NO: 60240 - DNA, 20 bp, Artificial Sequence
  Synthetic oligonucleotide; AAGGGT chr11 5371510 5371529 5371526 +
catatatctcattatatcca

SEQ ID NO: 60241 - DNA, 20 bp, Artificial Sequence
  Synthetic oligonucleotide; AAGAGT chr11 5371528 5371547 5371544 +
caaagggttacataagtttt

SEQ ID NO: 60242 - DNA, 20 bp, Artificial Sequence
  Synthetic oligonucleotide; TAGGAT chr11 5371643 5371662 5371659 +
gtaagcttgttcaaaaaata

SEQ ID NO: 60243 - DNA, 20 bp, Artificial Sequence
  Synthetic oligonucleotide; CTGAAT chr11 5372058 5372077 5372074 +
ccccatctccttttttaagg

SEQ ID NO: 60244 - DNA, 20 bp, Artificial Sequence
  Synthetic oligonucleotide; GTGAAT chr11 5372188 5372207 5372204 +
gtttccatgtcttggctatt

SEQ ID NO: 60245 - DNA, 20 bp, Artificial Sequence
  Synthetic oligonucleotide; GAGAGT chr11 5372211 5372230 5372227 +
aataatgctgcaattaacat

SEQ ID NO: 60246 - DNA, 20 bp, Artificial Sequence
  Synthetic oligonucleotide; GCGGAT chr11 5372236 5372255 5372252 +
tgcagatagctctagaaaat

SEQ ID NO: 60247 - DNA, 20 bp, Artificial Sequence
  Synthetic oligonucleotide; TTGGAT chr11 5372252 5372271 5372268 +
aaatgcggattttatttatt

SEQ ID NO: 60248 - DNA, 20 bp, Artificial Sequence
  Synthetic oligonucleotide; AAGAGT chr11 5372375 5372394 5372391 +
cattcccaccagctatgcac

SEQ ID NO: 60249 - DNA, 20 bp, Artificial Sequence
  Synthetic oligonucleotide; GTGAGT chr11 5372449 5372468 5372465 +
taatagccatctcaacaggt

SEQ ID NO: 60250 - DNA, 20 bp, Artificial Sequence
  Synthetic oligonucleotide; TTGAGT chr11 5372614 5372633 5372630 +
attttttcatatttagttga

SEQ ID NO: 60251 - DNA, 20 bp, Artificial Sequence
  Synthetic oligonucleotide; TTGGGT chr11 5372632 5372651 5372648 +
gattgagttccttatatatt

SEQ ID NO: 60252 - DNA, 20 bp, Artificial Sequence
  Synthetic oligonucleotide; CAGAAT chr11 5372971 5372990 5372987 +
gacacatagaccaaattgaa

SEQ ID NO: 60253 - DNA, 20 bp, Artificial Sequence
  Synthetic oligonucleotide; AAGGAT chr11 5373048 5373067 5373064 +
ggccaccaacacaatagggg

SEQ ID NO: 60254 - DNA, 20 bp, Artificial Sequence
  Synthetic oligonucleotide; CTGGAT chr11 5373083 5373102 5373099 +
aacaaatagtgttgggaaaa

SEQ ID NO: 60255 - DNA, 20 bp, Artificial Sequence
  Synthetic oligonucleotide; AAGAAT chr11 5373101 5373120 5373117 +
aactggatatccaaatgcaa

SEQ ID NO: 60256 - DNA, 20 bp, Artificial Sequence
  Synthetic oligonucleotide; ACGGGT chr11 5373389 5373408 5373405 +
cagcgtgaacaacacagaag

SEQ ID NO: 60257 - DNA, 20 bp, Artificial Sequence
  Synthetic oligonucleotide; TGGGGT chr11 5373420 5373439 5373436 +
ctgcatttccatctgaggta

SEQ ID NO: 60258 - DNA, 20 bp, Artificial Sequence
  Synthetic oligonucleotide; GGGAGT chr11 5373437 5373456 5373453 +
gtatggggttcatctcgcta

SEQ ID NO: 60259 - DNA, 20 bp, Artificial Sequence
  Synthetic oligonucleotide; GTGGGT chr11 5373465 5373484 5373481 +
cagacagtgggcacaggtca

SEQ ID NO: 60260 - DNA, 20 bp, Artificial Sequence
  Synthetic oligonucleotide; CAGGGT chr11 5373496 5373515 5373512 +
acaccatgcaccagccgaag

SEQ ID NO: 60261 - DNA, 20 bp, Artificial Sequence
  Synthetic oligonucleotide; AGGGGT chr11 5373529 5373548 5373545 +
tgcctcacttgggaagcaca

SEQ ID NO: 60262 - DNA, 20 bp, Artificial Sequence
  Synthetic oligonucleotide; TGGAGT chr11 5373537 5373556 5373553 +
ttgggaagcacaaggggtca

SEQ ID NO: 60263 - DNA, 20 bp, Artificial Sequence
  Synthetic oligonucleotide; AGGGGT chr11 5373563 5373582 5373579 +
tccctttcctggtcaaggaa

SEQ ID NO: 60264 - DNA, 20 bp, Artificial Sequence
  Synthetic oligonucleotide; CCGAAT chr11 5373604 5373623 5373620 +
gaaaattgggccactcccac

SEQ ID NO: 60265 - DNA, 20 bp, Artificial Sequence
  Synthetic oligonucleotide; GAGGGT chr11 5373674 5373693 5373690 +
tatatcctgcacatggctcc

SEQ ID NO: 60266 - DNA, 20 bp, Artificial Sequence
  Synthetic oligonucleotide; CGGAGT chr11 5373690 5373709 5373706 +
ctccgagggtcctacgccca

SEQ ID NO: 60267 - DNA, 20 bp, Artificial Sequence
  Synthetic oligonucleotide; CTGGGT chr11 5373816 5373835 5373832 +
aagcagccaggaagctcaaa

SEQ ID NO: 60268 - DNA, 20 bp, Artificial Sequence
  Synthetic oligonucleotide; GTGGGT chr11 5374012 5374031 5374028 +
cgggcagactgcctcctcaa

SEQ ID NO: 60269 - DNA, 20 bp, Artificial Sequence
  Synthetic oligonucleotide; GCGGAT chr11 5374145 5374164 5374161 +
acgatcagacagcagcattc

SEQ ID NO: 60270 - DNA, 20 bp, Artificial Sequence
  Synthetic oligonucleotide; CAGGGT chr11 5374199 5374218 5374215 +
gctgctgatacccaggcaaa

SEQ ID NO: 60271 - DNA, 20 bp, Artificial Sequence
  Synthetic oligonucleotide; TGGAGT chr11 5374206 5374225 5374222 +
atacccaggcaaacagggtc

SEQ ID NO: 60272 - DNA, 20 bp, Artificial Sequence
  Synthetic oligonucleotide; GAGGGT chr11 5374245 5374264 5374261 +
actccaacagacctgcagct

SEQ ID NO: 60273 - DNA, 20 bp, Artificial Sequence
  Synthetic oligonucleotide; CTGGAT chr11 5374453 5374472 5374469 +
tcaccagcaacggaacaaag

SEQ ID NO: 60274 - DNA, 20 bp, Artificial Sequence
  Synthetic oligonucleotide; GAGAAT chr11 5374460 5374479 5374476 +
caacggaacaaagctggatg

SEQ ID NO: 60275 - DNA, 20 bp, Artificial Sequence
  Synthetic oligonucleotide; ATGAAT chr11 5374576 5374595 5374592 +
aactttgaaaaaaaatttag

SEQ ID NO: 60276 - DNA, 20 bp, Artificial Sequence
  Synthetic oligonucleotide; TAGAAT chr11 5374589 5374608 5374605 +
aatttagatgaatgtataac

SEQ ID NO: 60277 - DNA, 20 bp, Artificial Sequence
  Synthetic oligonucleotide; GAGAAT chr11 5374648 5374667 5374664 +
ggagctgaaagccaaggctc

SEQ ID NO: 60278 - DNA, 20 bp, Artificial Sequence
  Synthetic oligonucleotide; AAGAAT chr11 5374660 5374679 5374676 +
caaggctcgagaatgacgtg

SEQ ID NO: 60279 - DNA, 20 bp, Artificial Sequence
  Synthetic oligonucleotide; AAGGGT chr11 5374703 5374722 5374719 +
tgatgcgatcaactggaaga

SEQ ID NO: 60280 - DNA, 20 bp, Artificial Sequence
  Synthetic oligonucleotide; AAGAAT chr11 5374766 5374785 5374782 +
gaagggaagtttagagaaaa

SEQ ID NO: 60281 - DNA, 20 bp, Artificial Sequence
  Synthetic oligonucleotide; GAGAAT chr11 5374860 5374879 5374876 +
gtgtacctgaaagtgacggg

SEQ ID NO: 60282 - DNA, 20 bp, Artificial Sequence
  Synthetic oligonucleotide; CAGGAT chr11 5374890 5374909 5374906 +
ccaagttggaaaacactctg

SEQ ID NO: 60283 - DNA, 20 bp, Artificial Sequence
  Synthetic oligonucleotide; TCGGGT chr11 5375069 5375088 5375085 +
agggcagccagagagaaagg

SEQ ID NO: 60284 - DNA, 20 bp, Artificial Sequence
  Synthetic oligonucleotide; GAGAGT chr11 5375140 5375159 5375156 +
agaaactctacaagccagaa

SEQ ID NO: 60285 - DNA, 20 bp, Artificial Sequence
  Synthetic oligonucleotide; AAGAAT chr11 5375175 5375194 5375191 +
tattcaacatccttaaagga

SEQ ID NO: 60286 - DNA, 20 bp, Artificial Sequence
  Synthetic oligonucleotide; CAGAAT chr11 5375189 5375208 5375205 +
aaaggaaagaattttcaaca

SEQ ID NO: 60287 - DNA, 20 bp, Artificial Sequence
  Synthetic oligonucleotide; CAGGAT chr11 5375437 5375456 5375453 +
ataaccagctatcataatga

SEQ ID NO: 60288 - DNA, 20 bp, Artificial Sequence
  Synthetic oligonucleotide; TTGGAT chr11 5375518 5375537 5375534 +
gaaagacacagactggcaaa

SEQ ID NO: 60289 - DNA, 20 bp, Artificial Sequence
  Synthetic oligonucleotide; AAGAGT chr11 5375525 5375544 5375541 +
acagactggcaaattggata

SEQ ID NO: 60290 - DNA, 20 bp, Artificial Sequence
  Synthetic oligonucleotide; AAGGAT chr11 5375582 5375601 5375598 +
cacacataggctcaaaataa

SEQ ID NO: 60291 - DNA, 20 bp, Artificial Sequence
  Synthetic oligonucleotide; AGGGGT chr11 5375628 5375647 5375644 +
aatggaaaacaaaaaaaggc

SEQ ID NO: 60292 - DNA, 20 bp, Artificial Sequence
  Synthetic oligonucleotide; AGGGAT chr11 5375714 5375733 5375730 +
aggccattacataatggtaa

SEQ ID NO: 60293 - DNA, 20 bp, Artificial Sequence
  Synthetic oligonucleotide; AAGGAT chr11 5375899 5375918 5375915 +
caacgagacagaaagttaac

SEQ ID NO: 60294 - DNA, 20 bp, Artificial Sequence
  Synthetic oligonucleotide; AGGAAT chr11 5375909 5375928 5375925 +
gaaagttaacaaggatatcc

SEQ ID NO: 60295 - DNA, 20 bp, Artificial Sequence
  Synthetic oligonucleotide; CAGAAT chr11 5375978 5375997 5375994 +
aactctccaccccaaatcaa

SEQ ID NO: 60296 - DNA, 20 bp, Artificial Sequence
  Synthetic oligonucleotide; CAGGAT chr11 5376124 5376143 5376140 +
agtgcaatcaaactagaact

SEQ ID NO: 60297 - DNA, 20 bp, Artificial Sequence
  Synthetic oligonucleotide; CTGAAT chr11 5376182 5376201 5376198 +
ggaaactgaacaacctgctc

SEQ ID NO: 60298 - DNA, 20 bp, Artificial Sequence
  Synthetic oligonucleotide; CTGGGT chr11 5376193 5376212 5376209 +
aacctgctcctgaatgacta

SEQ ID NO: 60299 - DNA, 20 bp, Artificial Sequence
  Synthetic oligonucleotide; CAGAAT chr11 5376266 5376285 5376282 +
agaacaaagacacaacatac

SEQ ID NO: 60300 - DNA, 20 bp, Artificial Sequence
  Synthetic oligonucleotide; TCGAAT chr11 5376285 5376304 5376301 +
ccagaatctctgggacacat

SEQ ID NO: 60301 - DNA, 20 bp, Artificial Sequence
  Synthetic oligonucleotide; ATGAAT chr11 5376492 5376511 5376508 +
aaaaacccttcaaaaaatta

SEQ ID NO: 60302 - DNA, 20 bp, Artificial Sequence
  Synthetic oligonucleotide; AAGGAT chr11 5376517 5376536 5376533 +
tctgggagctggttttttga

SEQ ID NO: 60303 - DNA, 20 bp, Artificial Sequence
  Synthetic oligonucleotide; AAGAAT chr11 5376568 5376587 5376584 +
agactaataagaaaagagag

SEQ ID NO: 60304 - DNA, 20 bp, Artificial Sequence
  Synthetic oligonucleotide; GGGGAT chr11 5376602 5376621 5376618 +
cacaataaaaaaatgataaa

SEQ ID NO: 60305 - DNA, 20 bp, Artificial Sequence
  Synthetic oligonucleotide; GAGAAT chr11 5376645 5376664 5376661 +
agaaatacaaactgccatca

SEQ ID NO: 60306 - DNA, 20 bp, Artificial Sequence
  Synthetic oligonucleotide; ATGGAT chr11 5376695 5376714 5376711 +
aactagaaaatctagaagaa

SEQ ID NO: 60307 - DNA, 20 bp, Artificial Sequence
  Synthetic oligonucleotide; TTGAAT chr11 5376747 5376766 5376763 +
aagactaaaccaggaagaag

SEQ ID NO: 60308 - DNA, 20 bp, Artificial Sequence
  Synthetic oligonucleotide; CTGAAT chr11 5376755 5376774 5376771 +
accaggaagaagttgaatct

SEQ ID NO: 60309 - DNA, 20 bp, Artificial Sequence
  Synthetic oligonucleotide; CAGGAT chr11 5376771 5376790 5376787 +
atctctgaatagaccaataa

SEQ ID NO: 60310 - DNA, 20 bp, Artificial Sequence
  Synthetic oligonucleotide; AAGAGT chr11 5376815 5376834 5376831 +
tcaatagcttaccaaccaaa

SEQ ID NO: 60311 - DNA, 20 bp, Artificial Sequence
  Synthetic oligonucleotide; ATGGAT chr11 5376831 5376850 5376847 +
caaaaagagtccaggaccag

SEQ ID NO: 60312 - DNA, 20 bp, Artificial Sequence
  Synthetic oligonucleotide; AGGAAT chr11 5376867 5376886 5376883 +
attctaacagaggtacaagg

SEQ ID NO: 60313 - DNA, 20 bp, Artificial Sequence
  Synthetic oligonucleotide; AGGAAT chr11 5376916 5376935 5376932 +
ttccaatcaacagaaaaaga

SEQ ID NO: 60314 - DNA, 20 bp, Artificial Sequence
  Synthetic oligonucleotide; GAGAAT chr11 5376992 5377011 5377008 +
aaagagacacaaccaaaaaa

SEQ ID NO: 60315 - DNA, 20 bp, Artificial Sequence
  Synthetic oligonucleotide; ATGAAT chr11 5377003 5377022 5377019 +
accaaaaaagagaattttag

SEQ ID NO: 60316 - DNA, 20 bp, Artificial Sequence
  Synthetic oligonucleotide; CCGAAT chr11 5377057 5377076 5377073 +
ctcaataaaatactggcaaa

SEQ ID NO: 60317 - DNA, 20 bp, Artificial Sequence
  Synthetic oligonucleotide; TGGGAT chr11 5377114 5377133 5377130 +
gatcaagtggacttcatccc

SEQ ID NO: 60318 - DNA, 20 bp, Artificial Sequence
  Synthetic oligonucleotide; CTGAAT chr11 5377337 5377356 5377353 +
aacccacagccaatatcata

SEQ ID NO: 60319 - DNA, 20 bp, Artificial Sequence
  Synthetic oligonucleotide; AGGGAT chr11 5377386 5377405 5377402 +
tttgtaaactggcacaagac

SEQ ID NO: 60320 - DNA, 20 bp, Artificial Sequence
  Synthetic oligonucleotide; AAGGGT chr11 5377466 5377485 5377482 +
ttaggcagaagacaggaaaa

SEQ ID NO: 60321 - DNA, 20 bp, Artificial Sequence
  Synthetic oligonucleotide; CAGGAT chr11 5377596 5377615 5377612 +
aagcaacttcagcaaagcct

SEQ ID NO: 60322 - DNA, 20 bp, Artificial Sequence
  Synthetic oligonucleotide; GAGAAT chr11 5377702 5377721 5377718 +
ccattcacaattgcttcaaa

SEQ ID NO: 60323 - DNA, 20 bp, Artificial Sequence
  Synthetic oligonucleotide; AGGAAT chr11 5377717 5377736 5377733 +
tcaaagagaataaaatacct

SEQ ID NO: 60324 - DNA, 20 bp, Artificial Sequence
  Synthetic oligonucleotide; AGGGAT chr11 5377733 5377752 5377749 +
acctaggaatccaacttaca

SEQ ID NO: 60325 - DNA, 20 bp, Artificial Sequence
  Synthetic oligonucleotide; ATGGGT chr11 5377825 5377844 5377841 +
tggaagaacattccatgctt

SEQ ID NO: 60326 - DNA, 20 bp, Artificial Sequence
  Synthetic oligonucleotide; AAGAAT chr11 5377834 5377853 5377850 +
attccatgcttatgggtagg

SEQ ID NO: 60327 - DNA, 20 bp, Artificial Sequence
  Synthetic oligonucleotide; CAGAAT chr11 5377923 5377942 5377939 +
gctaccaatgattttcttca

SEQ ID NO: 60328 - DNA, 20 bp, Artificial Sequence
  Synthetic oligonucleotide; AAGGAT chr11 5378191 5378210 5378207 +
agaaaaacaagaaatgggga

SEQ ID NO: 60329 - DNA, 20 bp, Artificial Sequence
  Synthetic oligonucleotide; TAGAAT chr11 5378241 5378260 5378257 +
gagaactggctagccatatg

SEQ ID NO: 60330 - DNA, 20 bp, Artificial Sequence
  Synthetic oligonucleotide; CTGGAT chr11 5378254 5378273 5378270 +
ccatatgtagaatgctgaaa

SEQ ID NO: 60331 - DNA, 20 bp, Artificial Sequence
  Synthetic oligonucleotide; ATGGAT chr11 5378295 5378314 5378311 +
tatacaaaaattaattcaag

SEQ ID NO: 60332 - DNA, 20 bp, Artificial Sequence
  Synthetic oligonucleotide; TGGGAT chr11 5378440 5378459 5378456 +
caaaagccaaaattcactaa

SEQ ID NO: 60333 - DNA, 20 bp, Artificial Sequence
  Synthetic oligonucleotide; CAGAGT chr11 5378490 5378509 5378506 +
acagctaaagaaactaccat

SEQ ID NO: 60334 - DNA, 20 bp, Artificial Sequence
  Synthetic oligonucleotide; CAGAAT chr11 5378562 5378581 5378578 +
tctgacaaagggctaatatc

SEQ ID NO: 60335 - DNA, 20 bp, Artificial Sequence
  Synthetic oligonucleotide; AAGGAT chr11 5378629 5378648 5378645 +
gccccatcaacaagtgggca

SEQ ID NO: 60336 - DNA, 20 bp, Artificial Sequence
  Synthetic oligonucleotide; TAGAAT chr11 5378760 5378779 5378776 +
agataccatctcataccagt

SEQ ID NO: 60337 - DNA, 20 bp, Artificial Sequence
  Synthetic oligonucleotide; GAGGAT chr11 5378804 5378823 5378820 +
aggaaacaacaggtgctgga

SEQ ID NO: 60338 - DNA, 20 bp, Artificial Sequence
  Synthetic oligonucleotide; AGGGAT chr11 5378893 5378912 5378909 +
agtcagtgtggcgattcctc

SEQ ID NO: 60339 - DNA, 20 bp, Artificial Sequence
  Synthetic oligonucleotide; CTGGGT chr11 5378938 5378957 5378954 +
ttgacccagccatcccatta

SEQ ID NO: 60340 - DNA, 20 bp, Artificial Sequence
  Synthetic oligonucleotide; AGGAAT chr11 5378954 5378973 5378970 +
attactgggtatatacccaa

SEQ ID NO: 60341 - DNA, 20 bp, Artificial Sequence
  Synthetic oligonucleotide; CTGGAT chr11 5379063 5379082 5379079 +
aaatgtccaacaatgataga

SEQ ID NO: 60342 - DNA, 20 bp, Artificial Sequence
  Synthetic oligonucleotide; TGGAAT chr11 5379095 5379114 5379111 +
aatgtggcacatatacacca

SEQ ID NO: 60343 - DNA, 20 bp, Artificial Sequence
  Synthetic oligonucleotide; ATGAGT chr11 5379121 5379140 5379137 +
actatgcagccataaaaatg

SEQ ID NO: 60344 - DNA, 20 bp, Artificial Sequence
  Synthetic oligonucleotide; ATGGAT chr11 5379146 5379165 5379162 +
ttcatgtcctttgtagggac

SEQ ID NO: 60345 - DNA, 20 bp, Artificial Sequence
  Synthetic oligonucleotide; TGGGGT chr11 5379291 5379310 5379307 +
tcacactctggggactgttg

SEQ ID NO: 60346 - DNA, 20 bp, Artificial Sequence
  Synthetic oligonucleotide; GGGGGT chr11 5379297 5379316 5379313 +
tctggggactgttgtggggt

SEQ ID NO: 60347 - DNA, 20 bp, Artificial Sequence
  Synthetic oligonucleotide; AGGGAT chr11 5379309 5379328 5379325 +
tgtggggtgggggtgcaggg

SEQ ID NO: 60348 - DNA, 20 bp, Artificial Sequence
  Synthetic oligonucleotide; ACGAGT chr11 5379345 5379364 5379361 +
gatatacctaatgctaaatt

SEQ ID NO: 60349 - DNA, 20 bp, Artificial Sequence
  Synthetic oligonucleotide; ATGGGT chr11 5379353 5379372 5379369 +
taatgctaaattacgagtta

SEQ ID NO: 60350 - DNA, 20 bp, Artificial Sequence
  Synthetic oligonucleotide; ATGAAT chr11 5379660 5379679 5379676 +
gctcaaggttagctaaagat

SEQ ID NO: 60351 - DNA, 20 bp, Artificial Sequence
  Synthetic oligonucleotide; TAGAAT chr11 5379746 5379765 5379762 +
atccattttttgtttccttt

SEQ ID NO: 60352 - DNA, 20 bp, Artificial Sequence
  Synthetic oligonucleotide; ATGAGT chr11 5379790 5379809 5379806 +
ggacagcttgatactttccc

SEQ ID NO: 60353 - DNA, 20 bp, Artificial Sequence
  Synthetic oligonucleotide; CTGGGT chr11 5379804 5379823 5379820 +
tttcccatgagtctggcttt

SEQ ID NO: 60354 - DNA, 20 bp, Artificial Sequence
  Synthetic oligonucleotide; CAGAAT chr11 5379944 5379963 5379960 +
atcttggacttttaagtcac

SEQ ID NO: 60355 - DNA, 20 bp, Artificial Sequence
  Synthetic oligonucleotide; TGGAGT chr11 5380056 5380075 5380072 +
actaaaactttagcccaact

SEQ ID NO: 60356 - DNA, 20 bp, Artificial Sequence
  Synthetic oligonucleotide; AGGGGT chr11 5380086 5380105 5380102 +
agaagagatggtttcccaaa

SEQ ID NO: 60357 - DNA, 20 bp, Artificial Sequence
  Synthetic oligonucleotide; TAGGAT chr11 5380156 5380175 5380172 +
tcataatgactgaagagagg

SEQ ID NO: 60358 - DNA, 20 bp, Artificial Sequence
  Synthetic oligonucleotide; AAGAGT chr11 5380185 5380204 5380201 +
acgaaagaaggcgtttctga

SEQ ID NO: 60359 - DNA, 20 bp, Artificial Sequence
  Synthetic oligonucleotide; GGGGAT chr11 5380273 5380292 5380289 +
gcaggtgtccagggaggcag

SEQ ID NO: 60360 - DNA, 20 bp, Artificial Sequence
  Synthetic oligonucleotide; ATGAAT chr11 5380286 5380305 5380302 +
gaggcagggggatggacaaa

SEQ ID NO: 60361 - DNA, 20 bp, Artificial Sequence
  Synthetic oligonucleotide; GTGGGT chr11 5380359 5380378 5380375 +
ttttggcaatcctaacttct

SEQ ID NO: 60362 - DNA, 20 bp, Artificial Sequence
  Synthetic oligonucleotide; TGGAGT chr11 5380407 5380426 5380423 +
atcgatctcacaccacaaaa

SEQ ID NO: 60363 - DNA, 20 bp, Artificial Sequence
  Synthetic oligonucleotide; GAGAGT chr11 5380444 5380463 5380460 +
ggacttgttctaacaggcct

SEQ ID NO: 60364 - DNA, 20 bp, Artificial Sequence
  Synthetic oligonucleotide; AAGAGT chr11 5380492 5380511 5380508 +
ctgtgacagagacacctaaa

SEQ ID NO: 60365 - DNA, 20 bp, Artificial Sequence
  Synthetic oligonucleotide; GTGAGT chr11 5380503 5380522 5380519 +
acacctaaaaagagtctgtt

SEQ ID NO: 60366 - DNA, 20 bp, Artificial Sequence
  Synthetic oligonucleotide; GTGAGT chr11 5380529 5380548 5380545 +
ctggagacattgagaaccct

SEQ ID NO: 60367 - DNA, 20 bp, Artificial Sequence
  Synthetic oligonucleotide; AAGGAT chr11 5380535 5380554 5380551 +
acattgagaaccctgtgagt

SEQ ID NO: 60368 - DNA, 20 bp, Artificial Sequence
  Synthetic oligonucleotide; CAGAGT chr11 5380563 5380582 5380579 +
tatttaggtctgtttctggt

SEQ ID NO: 60369 - DNA, 20 bp, Artificial Sequence
  Synthetic oligonucleotide; GGGGAT chr11 5380569 5380588 5380585 +
ggtctgtttctggtcagagt

SEQ ID NO: 60370 - DNA, 20 bp, Artificial Sequence
  Synthetic oligonucleotide; AAGAAT chr11 5380761 5380780 5380777 +
aggaagatcatcctcaaagg

SEQ ID NO: 60371 - DNA, 20 bp, Artificial Sequence
  Synthetic oligonucleotide; GTGGGT chr11 5380795 5380814 5380811 +
tggcagctttcagctgtgta

SEQ ID NO: 60372 - DNA, 20 bp, Artificial Sequence
  Synthetic oligonucleotide; GGGGAT chr11 5380855 5380874 5380871 +
gccacattttcttgtgccct

SEQ ID NO: 60373 - DNA, 20 bp, Artificial Sequence
  Synthetic oligonucleotide; CAGAAT chr11 5380881 5380900 5380897 +
agtagggccttggtgctggt

SEQ ID NO: 60374 - DNA, 20 bp, Artificial Sequence
  Synthetic oligonucleotide; CTGAAT chr11 5380904 5380923 5380920 +
aatttaagcctatccttggg

SEQ ID NO: 60375 - DNA, 20 bp, Artificial Sequence
  Synthetic oligonucleotide; GGGGAT chr11 5380959 5380978 5380975 +
acagcatgtgtacagacctt

SEQ ID NO: 60376 - DNA, 20 bp, Artificial Sequence
  Synthetic oligonucleotide; AGGAAT chr11 5380978 5380997 5380994 +
tggggattcagttctcctga

SEQ ID NO: 60377 - DNA, 20 bp, Artificial Sequence
  Synthetic oligonucleotide; CTGGAT chr11 5381031 5381050 5381047 +
gggctggctaggtatcaatt

SEQ ID NO: 60378 - DNA, 20 bp, Artificial Sequence
  Synthetic oligonucleotide; ATGGAT chr11 5381247 5381266 5381263 +
gacacttttcacttttagta

SEQ ID NO: 60379 - DNA, 20 bp, Artificial Sequence
  Synthetic oligonucleotide; ATGAAT chr11 5381268 5381287 5381284 +
tggatttagattctttaata

SEQ ID NO: 60380 - DNA, 20 bp, Artificial Sequence
  Synthetic oligonucleotide; CTGAAT chr11 5381297 5381316 5381313 +
aataccttaaaggttaaggc

SEQ ID NO: 60381 - DNA, 20 bp, Artificial Sequence
  Synthetic oligonucleotide; CAGAGT chr11 5381601 5381620 5381617 +
tctatcttcaagttcttgat

SEQ ID NO: 60382 - DNA, 20 bp, Artificial Sequence
  Synthetic oligonucleotide; GAGAAT chr11 5381648 5381667 5381664 +
gcacgtcaatgaaaattgat

SEQ ID NO: 60383 - DNA, 20 bp, Artificial Sequence
  Synthetic oligonucleotide; AAGAAT chr11 5381736 5381755 5381752 +
aaaggtcatttagagcaata

SEQ ID NO: 60384 - DNA, 20 bp, Artificial Sequence
  Synthetic oligonucleotide; CTGAGT chr11 5381750 5381769 5381766 +
gcaataaagaatcaaaaatg

SEQ ID NO: 60385 - DNA, 20 bp, Artificial Sequence
  Synthetic oligonucleotide; TAGAAT chr11 5381825 5381844 5381841 +
aattatataattcagagaaa

SEQ ID NO: 60386 - DNA, 20 bp, Artificial Sequence
  Synthetic oligonucleotide; CAGGGT chr11 5382117 5382136 5382133 +
acatgtcatataaactcatt

SEQ ID NO: 60387 - DNA, 20 bp, Artificial Sequence
  Synthetic oligonucleotide; CTGAAT chr11 5382459 5382478 5382475 +
cttatgtgtgatagatgccc

SEQ ID NO: 60388 - DNA, 20 bp, Artificial Sequence
  Synthetic oligonucleotide; TAGGAT chr11 5382528 5382547 5382544 +
gctgttatactgtccttggc

SEQ ID NO: 60389 - DNA, 20 bp, Artificial Sequence
  Synthetic oligonucleotide; CAGGAT chr11 5382572 5382591 5382588 +
aatcatgttcttaataaatg

SEQ ID NO: 60390 - DNA, 20 bp, Artificial Sequence
  Synthetic oligonucleotide; CTGGGT chr11 5382790 5382809 5382806 +
taaggtggtgccacttctgt

SEQ ID NO: 60391 - DNA, 20 bp, Artificial Sequence
  Synthetic oligonucleotide; ATGGGT chr11 5382829 5382848 5382845 +
aatggcatgtcataaacttc

SEQ ID NO: 60392 - DNA, 20 bp, Artificial Sequence
  Synthetic oligonucleotide; AAGGAT chr11 5382913 5382932 5382929 +
aatcaaccatgccctattta

SEQ ID NO: 60393 - DNA, 20 bp, Artificial Sequence
  Synthetic oligonucleotide; AAGAGT chr11 5382946 5382965 5382962 +
cttgcttcatgccagtctcc

SEQ ID NO: 60394 - DNA, 20 bp, Artificial Sequence
  Synthetic oligonucleotide; GTGAGT chr11 5382982 5383001 5382998 +
ttgtggtggagaggttgtgt

SEQ ID NO: 60395 - DNA, 20 bp, Artificial Sequence
  Synthetic oligonucleotide; TGGGGT chr11 5383235 5383254 5383251 +
cactgacctggacatttgtt

SEQ ID NO: 60396 - DNA, 20 bp, Artificial Sequence
  Synthetic oligonucleotide; TAGGAT chr11 5383240 5383259 5383256 +
acctggacatttgtttgggg

SEQ ID NO: 60397 - DNA, 20 bp, Artificial Sequence
  Synthetic oligonucleotide; TTGAAT chr11 5383245 5383264 5383261 +
gacatttgtttggggtagga

SEQ ID NO: 60398 - DNA, 20 bp, Artificial Sequence
  Synthetic oligonucleotide; ATGAGT chr11 5383351 5383370 5383367 +
atataaaaatagacaggaaa

SEQ ID NO: 60399 - DNA, 20 bp, Artificial Sequence
  Synthetic oligonucleotide; AGGAGT chr11 5383359 5383378 5383375 +
atagacaggaaaatgagtgc

SEQ ID NO: 60400 - DNA, 20 bp, Artificial Sequence
  Synthetic oligonucleotide; GAGAAT chr11 5383367 5383386 5383383 +
gaaaatgagtgcaggagtga

SEQ ID NO: 60401 - DNA, 20 bp, Artificial Sequence
  Synthetic oligonucleotide; ATGGAT chr11 5383440 5383459 5383456 +
aaagccactgtgaacatcac

SEQ ID NO: 60402 - DNA, 20 bp, Artificial Sequence
  Synthetic oligonucleotide; ACGGGT chr11 5383486 5383505 5383502 +
tccgacctctctggaaaacg

SEQ ID NO: 60403 - DNA, 20 bp, Artificial Sequence
  Synthetic oligonucleotide; GTGGAT chr11 5383501 5383520 5383517 +
aaacgacgggtccattacta

SEQ ID NO: 60404 - DNA, 20 bp, Artificial Sequence
  Synthetic oligonucleotide; ATGAAT chr11 5383539 5383558 5383555 +
taaataaaatgataagtgat

SEQ ID NO: 60405 - DNA, 20 bp, Artificial Sequence
  Synthetic oligonucleotide; CTGAAT chr11 5383630 5383649 5383646 +
gtgtagccaaaacctgggga

SEQ ID NO: 60406 - DNA, 20 bp, Artificial Sequence
  Synthetic oligonucleotide; AGGGGT chr11 5383670 5383689 5383686 +
gctcttcagcttcaggagac

SEQ ID NO: 60407 - DNA, 20 bp, Artificial Sequence
  Synthetic oligonucleotide; TAGGAT chr11 5383701 5383720 5383717 +
taaagaaagtttcctgccca

SEQ ID NO: 60408 - DNA, 20 bp, Artificial Sequence
  Synthetic oligonucleotide; GAGGAT chr11 5383769 5383788 5383785 +
gctggagccatggtctttag

SEQ ID NO: 60409 - DNA, 20 bp, Artificial Sequence
  Synthetic oligonucleotide; GTGAGT chr11 5383898 5383917 5383914 +
atttttgttattacctgctg

SEQ ID NO: 60410 - DNA, 20 bp, Artificial Sequence
  Synthetic oligonucleotide; CGGGGT chr11 5383922 5383941 5383938 +
gtctcactactgtcttgtgc

SEQ ID NO: 60411 - DNA, 20 bp, Artificial Sequence
  Synthetic oligonucleotide; AGGAGT chr11 5383931 5383950 5383947 +
ctgtcttgtgccggggtttc

SEQ ID NO: 60412 - DNA, 20 bp, Artificial Sequence
  Synthetic oligonucleotide; GTGGGT chr11 5383935 5383954 5383951 +
cttgtgccggggtttcagga

SEQ ID NO: 60413 - DNA, 20 bp, Artificial Sequence
  Synthetic oligonucleotide; GGGAAT chr11 5383986 5384005 5384002 +
gggagaaaatgagggaaaat

SEQ ID NO: 60414 - DNA, 20 bp, Artificial Sequence
  Synthetic oligonucleotide; TTGAAT chr11 5384066 5384085 5384082 +
aaggcttttcccccaaatgt

SEQ ID NO: 60415 - DNA, 20 bp, Artificial Sequence
  Synthetic oligonucleotide; ATGGAT chr11 5384084 5384103 5384100 +
gtttgaatgtccttagccaa

SEQ ID NO: 60416 - DNA, 20 bp, Artificial Sequence
  Synthetic oligonucleotide; TGGGAT chr11 5384117 5384136 5384133 +
attccctgcactaagcctaa

SEQ ID NO: 60417 - DNA, 20 bp, Artificial Sequence
  Synthetic oligonucleotide; CCGGAT chr11 5384243 5384262 5384259 +
tagctcactgtaaactcaaa

SEQ ID NO: 60418 - DNA, 20 bp, Artificial Sequence
  Synthetic oligonucleotide; CAGGAT chr11 5384284 5384303 5384300 +
accttattcttccaagttgc

SEQ ID NO: 60419 - DNA, 20 bp, Artificial Sequence
  Synthetic oligonucleotide; CAGGGT chr11 5384362 5384381 5384378 +
gaaaatgaagtcttagaaac

SEQ ID NO: 60420 - DNA, 20 bp, Artificial Sequence
  Synthetic oligonucleotide; CAGAAT chr11 5384373 5384392 5384389 +
cttagaaaccagggttctca

SEQ ID NO: 60421 - DNA, 20 bp, Artificial Sequence
  Synthetic oligonucleotide; CAGAGT chr11 5384394 5384413 5384410 +
agaatctcttctgatattct

SEQ ID NO: 60422 - DNA, 20 bp, Artificial Sequence
  Synthetic oligonucleotide; ATGAGT chr11 5384524 5384543 5384540 +
agggctgcctcactcccctg

SEQ ID NO: 60423 - DNA, 20 bp, Artificial Sequence
  Synthetic oligonucleotide; CTGGAT chr11 5384556 5384575 5384572 +
atggccaggccagcccctcc

SEQ ID NO: 60424 - DNA, 20 bp, Artificial Sequence
  Synthetic oligonucleotide; CAGGAT chr11 5384575 5384594 5384591 +
cctggatcatgtctagaagt

SEQ ID NO: 60425 - DNA, 20 bp, Artificial Sequence
  Synthetic oligonucleotide; CAGGAT chr11 5384788 5384807 5384804 +
cttgtaacttccccagtatc

SEQ ID NO: 60426 - DNA, 20 bp, Artificial Sequence
  Synthetic oligonucleotide; ATGAGT chr11 5384851 5384870 5384867 +
aaaaacaggcatgtttacag

SEQ ID NO: 60427 - DNA, 20 bp, Artificial Sequence
  Synthetic oligonucleotide; AGGGGT chr11 5384881 5384900 5384897 +
ccactgtggaaatgttctct

SEQ ID NO: 60428 - DNA, 20 bp, Artificial Sequence
  Synthetic oligonucleotide; ATGAAT chr11 5384893 5384912 5384909 +
tgttctctaggggttcaaaa

SEQ ID NO: 60429 - DNA, 20 bp, Artificial Sequence
  Synthetic oligonucleotide; AAGAAT chr11 5385019 5385038 5385035 +
ctaatattaaattcaaacaa

SEQ ID NO: 60430 - DNA, 20 bp, Artificial Sequence
  Synthetic oligonucleotide; AGGAAT chr11 5385084 5385103 5385100 +
tatactgaaaatctcttttc

SEQ ID NO: 60431 - DNA, 20 bp, Artificial Sequence
  Synthetic oligonucleotide; ATGAAT chr11 5385108 5385127 5385124 +
attttctcctgtgatctaag

SEQ ID NO: 60432 - DNA, 20 bp, Artificial Sequence
  Synthetic oligonucleotide; TTGAAT chr11 5385124 5385143 5385140 +
taagatgaatctactctgcc

SEQ ID NO: 60433 - DNA, 20 bp, Artificial Sequence
  Synthetic oligonucleotide; CTGAGT chr11 5385167 5385186 5385183 +
attagatgtaactgactgct

SEQ ID NO: 60434 - DNA, 20 bp, Artificial Sequence
  Synthetic oligonucleotide; ATGGAT chr11 5385225 5385244 5385241 +
atgactgttgctctcctatc

SEQ ID NO: 60435 - DNA, 20 bp, Artificial Sequence
  Synthetic oligonucleotide; AAGAAT chr11 5385422 5385441 5385438 +
acaacagaaccccaggcaca

SEQ ID NO: 60436 - DNA, 20 bp, Artificial Sequence
  Synthetic oligonucleotide; CAGGAT chr11 5385428 5385447 5385444 +
gaaccccaggcacaaagaat

SEQ ID NO: 60437 - DNA, 20 bp, Artificial Sequence
  Synthetic oligonucleotide; GTGAGT chr11 5385439 5385458 5385455 +
acaaagaatcaggataagag

SEQ ID NO: 60438 - DNA, 20 bp, Artificial Sequence
  Synthetic oligonucleotide; GAGAAT chr11 5385542 5385561 5385558 +
tcaggctccaggggccttta

SEQ ID NO: 60439 - DNA, 20 bp, Artificial Sequence
  Synthetic oligonucleotide; ATGAAT chr11 5385570 5385589 5385586 +
cagtctaatcaacttaaaaa

SEQ ID NO: 60440 - DNA, 20 bp, Artificial Sequence
  Synthetic oligonucleotide; AAGAAT chr11 5385644 5385663 5385660 +
tgttctaaacatgtataata

SEQ ID NO: 60441 - DNA, 20 bp, Artificial Sequence
  Synthetic oligonucleotide; AAGAAT chr11 5385803 5385822 5385819 +
aaaaatctataaagtatata

SEQ ID NO: 60442 - DNA, 20 bp, Artificial Sequence
  Synthetic oligonucleotide; ATGAGT chr11 5385850 5385869 5385866 +
gtatattctataaagtattt

SEQ ID NO: 60443 - DNA, 20 bp, Artificial Sequence
  Synthetic oligonucleotide; ATGGAT chr11 5385905 5385924 5385921 +
ttatacatatgtgtacttat

SEQ ID NO: 60444 - DNA, 20 bp, Artificial Sequence
  Synthetic oligonucleotide; AAGAAT chr11 5385965 5385984 5385981 +
tatataaatataaaaatata

SEQ ID NO: 60445 - DNA, 20 bp, Artificial Sequence
  Synthetic oligonucleotide; AAGGAT chr11 5386100 5386119 5386116 +
gatatttgtactaagtctta

SEQ ID NO: 60446 - DNA, 20 bp, Artificial Sequence
  Synthetic oligonucleotide; AGGGGT chr11 5386133 5386152 5386149 +
tgtttactggttggaaaaac

SEQ ID NO: 60447 - DNA, 20 bp, Artificial Sequence
  Synthetic oligonucleotide; AAGAAT chr11 5386168 5386187 5386184 +
caagaaagcaataaatatag

SEQ ID NO: 60448 - DNA, 20 bp, Artificial Sequence
  Synthetic oligonucleotide; GGGAAT chr11 5386196 5386215 5386212 +
aaacaagaaaagtatgtgta

SEQ ID NO: 60449 - DNA, 20 bp, Artificial Sequence
  Synthetic oligonucleotide; ATGGGT chr11 5386218 5386237 5386234 +
gaattgaagaaaaaaatgat

SEQ ID NO: 60450 - DNA, 20 bp, Artificial Sequence
  Synthetic oligonucleotide; ATGGGT chr11 5386241 5386260 5386257 +
ggtgtgttgactgggaaaag

SEQ ID NO: 60451 - DNA, 20 bp, Artificial Sequence
  Synthetic oligonucleotide; CAGGGT chr11 5386293 5386312 5386309 +
ccgggctaaagatggtgtta

SEQ ID NO: 60452 - DNA, 20 bp, Artificial Sequence
  Synthetic oligonucleotide; TGGGAT chr11 5386375 5386394 5386391 +
tttcgctcactaccaggcct

SEQ ID NO: 60453 - DNA, 20 bp, Artificial Sequence
  Synthetic oligonucleotide; TAGAGT chr11 5386593 5386612 5386609 +
gaaaacagtgcagtgattca

SEQ ID NO: 60454 - DNA, 20 bp, Artificial Sequence
  Synthetic oligonucleotide; GAGGAT chr11 5386633 5386652 5386649 +
taatctcggtggctgcagta

SEQ ID NO: 60455 - DNA, 20 bp, Artificial Sequence
  Synthetic oligonucleotide; TTGAAT chr11 5386672 5386691 5386688 +
gaggagcctggctttgcatg

SEQ ID NO: 60456 - DNA, 20 bp, Artificial Sequence
  Synthetic oligonucleotide; ATGAAT chr11 5386740 5386759 5386756 +
cattggctacagagatgaag

SEQ ID NO: 60457 - DNA, 20 bp, Artificial Sequence
  Synthetic oligonucleotide; AGGGAT chr11 5386753 5386772 5386769 +
gatgaagatgaatagattac

SEQ ID NO: 60458 - DNA, 20 bp, Artificial Sequence
  Synthetic oligonucleotide; GAGGGT chr11 5386802 5386821 5386818 +
attagatacagaaagaggga

SEQ ID NO: 60459 - DNA, 20 bp, Artificial Sequence
  Synthetic oligonucleotide; TTGAGT chr11 5386807 5386826 5386823 +
atacagaaagagggagaggg

SEQ ID NO: 60460 - DNA, 20 bp, Artificial Sequence
  Synthetic oligonucleotide; TTGAAT chr11 5386838 5386857 5386854 +
atcagctcaaaaatgttgtc

SEQ ID NO: 60461 - DNA, 20 bp, Artificial Sequence
  Synthetic oligonucleotide; GTGAAT chr11 5386855 5386874 5386871 +
gtcttgaatggcaggaaatg

SEQ ID NO: 60462 - DNA, 20 bp, Artificial Sequence
  Synthetic oligonucleotide; AAGAAT chr11 5386889 5386908 5386905 +
aaaaaatgcataaatatgag

SEQ ID NO: 60463 - DNA, 20 bp, Artificial Sequence
  Synthetic oligonucleotide; ATGGAT chr11 5386908 5386927 5386924 +
gaagaatcaggtgtgaaaag

SEQ ID NO: 60464 - DNA, 20 bp, Artificial Sequence
  Synthetic oligonucleotide; TTGAGT chr11 5386936 5386955 5386952 +
tgggctcaatattagacgtg

SEQ ID NO: 60465 - DNA, 20 bp, Artificial Sequence
  Synthetic oligonucleotide; CGGAGT chr11 5387003 5387022 5387019 +
aactcaggcctgatatgtaa

SEQ ID NO: 60466 - DNA, 20 bp, Artificial Sequence
  Synthetic oligonucleotide; ATGAAT chr11 5387076 5387095 5387092 +
taataataatagataatata

SEQ ID NO: 60467 - DNA, 20 bp, Artificial Sequence
  Synthetic oligonucleotide; CTGAAT chr11 5387111 5387130 5387127 +
aggtgttcaaggacagtaaa

SEQ ID NO: 60468 - DNA, 20 bp, Artificial Sequence
  Synthetic oligonucleotide; GAGAGT chr11 5387145 5387164 5387161 +
tatttgagcaatggaaataa

SEQ ID NO: 60469 - DNA, 20 bp, Artificial Sequence
  Synthetic oligonucleotide; AAGAAT chr11 5387201 5387220 5387217 +
aaccagcagatcttggcatt

SEQ ID NO: 60470 - DNA, 20 bp, Artificial Sequence
  Synthetic oligonucleotide; GTGAAT chr11 5387326 5387345 5387342 +
ttggcccctagaagtcactg

SEQ ID NO: 60471 - DNA, 20 bp, Artificial Sequence
  Synthetic oligonucleotide; GTGGGT chr11 5387355 5387374 5387371 +
aggagcattgctttagctaa

SEQ ID NO: 60472 - DNA, 20 bp, Artificial Sequence
  Synthetic oligonucleotide; TAGGGT chr11 5387377 5387396 5387393 +
gggttttaaaaaaaacatta

SEQ ID NO: 60473 - DNA, 20 bp, Artificial Sequence
  Synthetic oligonucleotide; TTGAGT chr11 5387389 5387408 5387405 +
aaacattatagggtggttgg

SEQ ID NO: 60474 - DNA, 20 bp, Artificial Sequence
  Synthetic oligonucleotide; GTGGAT chr11 5387586 5387605 5387602 +
gcatttagctgctacttcaa

SEQ ID NO: 60475 - DNA, 20 bp, Artificial Sequence
  Synthetic oligonucleotide; TTGAAT chr11 5387622 5387641 5387638 +
tccccaccttgcttcctcca

SEQ ID NO: 60476 - DNA, 20 bp, Artificial Sequence
  Synthetic oligonucleotide; TTGAAT chr11 5387708 5387727 5387724 +
cacttgttcttcctccttcc

SEQ ID NO: 60477 - DNA, 20 bp, Artificial Sequence
  Synthetic oligonucleotide; TAGAAT chr11 5388015 5388034 5388031 +
ttacttttgcaccaacctaa

SEQ ID NO: 60478 - DNA, 20 bp, Artificial Sequence
  Synthetic oligonucleotide; TTGAAT chr11 5388058 5388077 5388074 +
acaatttcaatatgtattta

SEQ ID NO: 60479 - DNA, 20 bp, Artificial Sequence
  Synthetic oligonucleotide; ATGAAT chr11 5388070 5388089 5388086 +
tgtatttattgaatcaatta

SEQ ID NO: 60480 - DNA, 20 bp, Artificial Sequence
  Synthetic oligonucleotide; TTGAAT chr11 5388090 5388109 5388106 +
atgaataattattgaaataa

SEQ ID NO: 60481 - DNA, 20 bp, Artificial Sequence
  Synthetic oligonucleotide; AAGGAT chr11 5388166 5388185 5388182 +
atttattcaaataatattta

SEQ ID NO: 60482 - DNA, 20 bp, Artificial Sequence
  Synthetic oligonucleotide; AGGAAT chr11 5388255 5388274 5388271 +
agtcatggtttatgtccaca

SEQ ID NO: 60483 - DNA, 20 bp, Artificial Sequence
  Synthetic oligonucleotide; GAGGGT chr11 5388351 5388370 5388367 +
aactacaggaacacatagga

SEQ ID NO: 60484 - DNA, 20 bp, Artificial Sequence
  Synthetic oligonucleotide; GGGAAT chr11 5388373 5388392 5388389 +
gggtattcaaactaaacttg

SEQ ID NO: 60485 - DNA, 20 bp, Artificial Sequence
  Synthetic oligonucleotide; GTGGGT chr11 5388418 5388437 5388434 +
gacatcatatctaagctaag

SEQ ID NO: 60486 - DNA, 20 bp, Artificial Sequence
  Synthetic oligonucleotide; AAGAAT chr11 5388495 5388514 5388511 +
aaaaatgtttttattccagg

SEQ ID NO: 60487 - DNA, 20 bp, Artificial Sequence
  Synthetic oligonucleotide; AAGAAT chr11 5388547 5388566 5388563 +
aagcatactagataaactgg

SEQ ID NO: 60488 - DNA, 20 bp, Artificial Sequence
  Synthetic oligonucleotide; GTGAAT chr11 5388573 5388592 5388589 +
tgtttagtgtcattaacacc

SEQ ID NO: 60489 - DNA, 20 bp, Artificial Sequence
  Synthetic oligonucleotide; TAGGAT chr11 5388592 5388611 5388608 +
cgtgaatatacagaggaaat

SEQ ID NO: 60490 - DNA, 20 bp, Artificial Sequence
  Synthetic oligonucleotide; TAGGAT chr11 5388609 5388628 5388625 +
aattaggatagataagaaaa

SEQ ID NO: 60491 - DNA, 20 bp, Artificial Sequence
  Synthetic oligonucleotide; TAGGGT chr11 5388636 5388655 5388652 +
tacacggagagaaaataagg

SEQ ID NO: 60492 - DNA, 20 bp, Artificial Sequence
  Synthetic oligonucleotide; TTGAAT chr11 5388643 5388662 5388659 +
agagaaaataaggtagggtc

SEQ ID NO: 60493 - DNA, 20 bp, Artificial Sequence
  Synthetic oligonucleotide; CTGAAT chr11 5388721 5388740 5388737 +
tcttgctatatagtagtcaa

SEQ ID NO: 60494 - DNA, 20 bp, Artificial Sequence
  Synthetic oligonucleotide; ATGAGT chr11 5388742 5388761 5388758 +
tgaatacagtagtacaaaag

SEQ ID NO: 60495 - DNA, 20 bp, Artificial Sequence
  Synthetic oligonucleotide; TGGAAT chr11 5388751 5388770 5388767 +
tagtacaaaagatgagtcac

SEQ ID NO: 60496 - DNA, 20 bp, Artificial Sequence
  Synthetic oligonucleotide; AAGAGT chr11 5388765 5388784 5388781 +
agtcactggaatagtcctga

SEQ ID NO: 60497 - DNA, 20 bp, Artificial Sequence
  Synthetic oligonucleotide; CTGAAT chr11 5388774 5388793 5388790 +
aatagtcctgaaagagtgat

SEQ ID NO: 60498 - DNA, 20 bp, Artificial Sequence
  Synthetic oligonucleotide; TAGAAT chr11 5388780 5388799 5388796 +
cctgaaagagtgatctgaat

SEQ ID NO: 60499 - DNA, 20 bp, Artificial Sequence
  Synthetic oligonucleotide; GTGAGT chr11 5388805 5388824 5388821 +
tagcatcaatgaaggtgacg

SEQ ID NO: 60500 - DNA, 20 bp, Artificial Sequence
  Synthetic oligonucleotide; TAGAGT chr11 5388960 5388979 5388976 +
atgaaaagtacagatgttgc

SEQ ID NO: 60501 - DNA, 20 bp, Artificial Sequence
  Synthetic oligonucleotide; TGGAAT chr11 5388996 5389015 5389012 +
aaagagagaaagacaagttc

SEQ ID NO: 60502 - DNA, 20 bp, Artificial Sequence
  Synthetic oligonucleotide; ATGGAT chr11 5389026 5389045 5389042 +
tatttgttatttatcaatat

SEQ ID NO: 60503 - DNA, 20 bp, Artificial Sequence
  Synthetic oligonucleotide; GTGGAT chr11 5389051 5389070 5389067 +
tggtaaatgaaatcatggta

SEQ ID NO: 60504 - DNA, 20 bp, Artificial Sequence
  Synthetic oligonucleotide; TAGAAT chr11 5389075 5389094 5389091 +
atgacattaagaagaaataa

SEQ ID NO: 60505 - DNA, 20 bp, Artificial Sequence
  Synthetic oligonucleotide; AAGGAT chr11 5389098 5389117 5389114 +
aatatggccaggaaattgcc

SEQ ID NO: 60506 - DNA, 20 bp, Artificial Sequence
  Synthetic oligonucleotide; AAGGGT chr11 5389120 5389139 5389136 +
ggatgggaagaactatactt

SEQ ID NO: 60507 - DNA, 20 bp, Artificial Sequence
  Synthetic oligonucleotide; CAGAAT chr11 5389242 5389261 5389258 +
caataaagtagtgagattgg

SEQ ID NO: 60508 - DNA, 20 bp, Artificial Sequence
  Synthetic oligonucleotide; AAGGGT chr11 5389252 5389271 5389268 +
gtgagattggcagaattcat

SEQ ID NO: 60509 - DNA, 20 bp, Artificial Sequence
  Synthetic oligonucleotide; TGGAGT chr11 5389257 5389276 5389273 +
attggcagaattcataaggg

SEQ ID NO: 60510 - DNA, 20 bp, Artificial Sequence
  Synthetic oligonucleotide; GTGAAT chr11 5389309 5389328 5389325 +
atggtactgcttgtgatgtt

SEQ ID NO: 60511 - DNA, 20 bp, Artificial Sequence
  Synthetic oligonucleotide; AAGAAT chr11 5389328 5389347 5389344 +
tgtgaatgttagtgaagctg

SEQ ID NO: 60512 - DNA, 20 bp, Artificial Sequence
  Synthetic oligonucleotide; AGGAAT chr11 5389375 5389394 5389391 +
tattttcagctcaatccccg

SEQ ID NO: 60513 - DNA, 20 bp, Artificial Sequence
  Synthetic oligonucleotide; CTGGAT chr11 5389467 5389486 5389483 +
attctatctcaccagctttc

SEQ ID NO: 60514 - DNA, 20 bp, Artificial Sequence
  Synthetic oligonucleotide; CTGGAT chr11 5389489 5389508 5389505 +
ggattggaaggcatcaaaca

SEQ ID NO: 60515 - DNA, 20 bp, Artificial Sequence
  Synthetic oligonucleotide; GGGGAT chr11 5389660 5389679 5389676 +
tccacgttgcccaccactat

SEQ ID NO: 60516 - DNA, 20 bp, Artificial Sequence
  Synthetic oligonucleotide; TGGAGT chr11 5389743 5389762 5389759 +
catccactctttttccttca

SEQ ID NO: 60517 - DNA, 20 bp, Artificial Sequence
  Synthetic oligonucleotide; GTGGAT chr11 5389920 5389939 5389936 +
cctgaaggcttttccctact

SEQ ID NO: 60518 - DNA, 20 bp, Artificial Sequence
  Synthetic oligonucleotide; ATGAGT chr11 5390356 5390375 5390372 +
ggtcttaaaaaggccagtaa

SEQ ID NO: 60519 - DNA, 20 bp, Artificial Sequence
  Synthetic oligonucleotide; TGGAGT chr11 5390421 5390440 5390437 +
cccaaattggactgaaaatt

SEQ ID NO: 60520 - DNA, 20 bp, Artificial Sequence
  Synthetic oligonucleotide; TTGAGT chr11 5390428 5390447 5390444 +
tggactgaaaatttggagta

SEQ ID NO: 60521 - DNA, 20 bp, Artificial Sequence
  Synthetic oligonucleotide; TGGAGT chr11 5390497 5390516 5390513 +
aatatgggcaaatttatgtc

SEQ ID NO: 60522 - DNA, 20 bp, Artificial Sequence
  Synthetic oligonucleotide; ACGAGT chr11 5391199 5391218 5391215 +
tggctgatcagcctgtccct

SEQ ID NO: 60523 - DNA, 20 bp, Artificial Sequence
  Synthetic oligonucleotide; AGGGGT chr11 5391224 5391243 5391240 +
tgactaaatgcaatccttgc

SEQ ID NO: 60524 - DNA, 20 bp, Artificial Sequence
  Synthetic oligonucleotide; TAGAAT chr11 5391400 5391419 5391416 +
aggtgtgtgcatgtgtccat

SEQ ID NO: 60525 - DNA, 20 bp, Artificial Sequence
  Synthetic oligonucleotide; AGGAAT chr11 5391426 5391445 5391442 +
gactaaatcaagatccctgg

SEQ ID NO: 60526 - DNA, 20 bp, Artificial Sequence
  Synthetic oligonucleotide; AGGGAT chr11 5391537 5391556 5391553 +
ggacatatagatacataaag

SEQ ID NO: 60527 - DNA, 20 bp, Artificial Sequence
  Synthetic oligonucleotide; CTGGAT chr11 5391681 5391700 5391697 +
ttctactttactcaggccct

SEQ ID NO: 60528 - DNA, 20 bp, Artificial Sequence
  Synthetic oligonucleotide; GAGGAT chr11 5391779 5391798 5391795 +
actttgggagaccaaggtgg

SEQ ID NO: 60529 - DNA, 20 bp, Artificial Sequence
  Synthetic oligonucleotide; AGGAGT chr11 5391796 5391815 5391812 +
tgggaggattgctgaaggcc

SEQ ID NO: 60530 - DNA, 20 bp, Artificial Sequence
  Synthetic oligonucleotide; TTGAGT chr11 5391831 5391850 5391847 +
acttcaggcaagaagattac

SEQ ID NO: 60531 - DNA, 20 bp, Artificial Sequence
  Synthetic oligonucleotide; AGGAGT chr11 5391839 5391858 5391855 +
caagaagattacttgagtcc

SEQ ID NO: 60532 - DNA, 20 bp, Artificial Sequence
  Synthetic oligonucleotide; AAGAAT chr11 5391958 5391977 5391974 +
acctgggaggctgaggtggg

SEQ ID NO: 60533 - DNA, 20 bp, Artificial Sequence
  Synthetic oligonucleotide; CTGGGT chr11 5392014 5392033 5392030 +
agccataatcacactactgc

SEQ ID NO: 60534 - DNA, 20 bp, Artificial Sequence
  Synthetic oligonucleotide; GTGGGT chr11 5392167 5392186 5392183 +
ggtatctcatgtttgtatgt

SEQ ID NO: 60535 - DNA, 20 bp, Artificial Sequence
  Synthetic oligonucleotide; TAGAAT chr11 5392322 5392341 5392338 +
tcaatagcagttccgagact

SEQ ID NO: 60536 - DNA, 20 bp, Artificial Sequence
  Synthetic oligonucleotide; TAGAAT chr11 5392377 5392396 5392393 +
attctatagatctcatttgg

SEQ ID NO: 60537 - DNA, 20 bp, Artificial Sequence
  Synthetic oligonucleotide; TGGGGT chr11 5392382 5392401 5392398 +
atagatctcatttggtagaa

SEQ ID NO: 60538 - DNA, 20 bp, Artificial Sequence
  Synthetic oligonucleotide; TAGGAT chr11 5392398 5392417 5392414 +
agaatggggtacaaaaaatt

SEQ ID NO: 60539 - DNA, 20 bp, Artificial Sequence
  Synthetic oligonucleotide; TTGGAT chr11 5392404 5392423 5392420 +
gggtacaaaaaatttaggat

SEQ ID NO: 60540 - DNA, 20 bp, Artificial Sequence
  Synthetic oligonucleotide; ACGAAT chr11 5392575 5392594 5392591 +
atatcttaatttgttactaa

SEQ ID NO: 60541 - DNA, 20 bp, Artificial Sequence
  Synthetic oligonucleotide; AAGAAT chr11 5392585 5392604 5392601 +
ttgttactaaacgaatattg

SEQ ID NO: 60542 - DNA, 20 bp, Artificial Sequence
  Synthetic oligonucleotide; TAGAGT chr11 5392590 5392609 5392606 +
actaaacgaatattgaagaa

SEQ ID NO: 60543 - DNA, 20 bp, Artificial Sequence
  Synthetic oligonucleotide; GCGGGT chr11 5392662 5392681 5392678 +
cagcactctgggaggccgag

SEQ ID NO: 60544 - DNA, 20 bp, Artificial Sequence
  Synthetic oligonucleotide; GTGGAT chr11 5392666 5392685 5392682 +
actctgggaggccgaggcgg

SEQ ID NO: 60545 - DNA, 20 bp, Artificial Sequence
  Synthetic oligonucleotide; CAGAAT chr11 5392800 5392819 5392816 +
tactcaggaggctggggcag

SEQ ID NO: 60546 - DNA, 20 bp, Artificial Sequence
  Synthetic oligonucleotide; CAGAAT chr11 5392966 5392985 5392982 +
aaagaggtattttcacatac

SEQ ID NO: 60547 - DNA, 20 bp, Artificial Sequence
  Synthetic oligonucleotide; TAGGAT chr11 5393100 5393119 5393116 +
taaatgataaattaaaaatt

SEQ ID NO: 60548 - DNA, 20 bp, Artificial Sequence
  Synthetic oligonucleotide; GTGAAT chr11 5393205 5393224 5393221 +
tgtgttgaactatttaataa

SEQ ID NO: 60549 - DNA, 20 bp, Artificial Sequence
  Synthetic oligonucleotide; AAGAAT chr11 5393241 5393260 5393257 +
gtgttattgttcataatttt

SEQ ID NO: 60550 - DNA, 20 bp, Artificial Sequence
  Synthetic oligonucleotide; TAGAAT chr11 5393265 5393284 5393281 +
atgtaagcatacaaaatgtc

SEQ ID NO: 60551 - DNA, 20 bp, Artificial Sequence
  Synthetic oligonucleotide; CTGAGT chr11 5393654 5393673 5393670 +
ttaactcacggtagagaggg

SEQ ID NO: 60552 - DNA, 20 bp, Artificial Sequence
  Synthetic oligonucleotide; TAGAAT chr11 5393968 5393987 5393984 +
taactttttgttccctttcc

SEQ ID NO: 60553 - DNA, 20 bp, Artificial Sequence
  Synthetic oligonucleotide; AAGAGT chr11 5394072 5394091 5394088 +
tttttaatagacttgatttt

SEQ ID NO: 60554 - DNA, 20 bp, Artificial Sequence
  Synthetic oligonucleotide; CTGAGT chr11 5394110 5394129 5394126 +
gaaaaactcagtagaaggta

SEQ ID NO: 60555 - DNA, 20 bp, Artificial Sequence
  Synthetic oligonucleotide; ATGGAT chr11 5394225 5394244 5394241 +
cttgacaataaccttatgag

SEQ ID NO: 60556 - DNA, 20 bp, Artificial Sequence
  Synthetic oligonucleotide; CAGAAT chr11 5394589 5394608 5394605 +
gctcatgtaattgaagttca

SEQ ID NO: 60557 - DNA, 20 bp, Artificial Sequence
  Synthetic oligonucleotide; TTGAAT chr11 5394666 5394685 5394682 +
tatctaaaatgttacctatt

SEQ ID NO: 60558 - DNA, 20 bp, Artificial Sequence
  Synthetic oligonucleotide; CAGAGT chr11 5394802 5394821 5394818 +
agacaatgctttctgaaaga

SEQ ID NO: 60559 - DNA, 20 bp, Artificial Sequence
  Synthetic oligonucleotide; GTGAAT chr11 5394875 5394894 5394891 +
gatctttacatacttgctca

SEQ ID NO: 60560 - DNA, 20 bp, Artificial Sequence
  Synthetic oligonucleotide; GTGAAT chr11 5394885 5394904 5394901 +
tacttgctcagtgaatgaca

SEQ ID NO: 60561 - DNA, 20 bp, Artificial Sequence
  Synthetic oligonucleotide; GAGGAT chr11 5394958 5394977 5394974 +
aagaaaagaaagacaaaaaa

SEQ ID NO: 60562 - DNA, 20 bp, Artificial Sequence
  Synthetic oligonucleotide; AAGGAT chr11 5395021 5395040 5395037 +
gctggggagagaagacagtc

SEQ ID NO: 60563 - DNA, 20 bp, Artificial Sequence
  Synthetic oligonucleotide; GAGGAT chr11 5395118 5395137 5395134 +
tctcaaatgctttggtctag

SEQ ID NO: 60564 - DNA, 20 bp, Artificial Sequence
  Synthetic oligonucleotide; CTGAGT chr11 5395246 5395265 5395262 +
agcccacgtagaacagcatc

SEQ ID NO: 60565 - DNA, 20 bp, Artificial Sequence
  Synthetic oligonucleotide; TGGAGT chr11 5395271 5395290 5395287 +
tcaaatggaagatgctggca

SEQ ID NO: 60566 - DNA, 20 bp, Artificial Sequence
  Synthetic oligonucleotide; GTGGAT chr11 5395346 5395365 5395362 +
tgctgaaggtcctttgtttt

SEQ ID NO: 60567 - DNA, 20 bp, Artificial Sequence
  Synthetic oligonucleotide; TGGAGT chr11 5395364 5395383 5395380 +
ttgtggataaaggaagtcat

SEQ ID NO: 60568 - DNA, 20 bp, Artificial Sequence
  Synthetic oligonucleotide; CAGGGT chr11 5395407 5395426 5395423 +
ttatctagcatgactatatg

SEQ ID NO: 60569 - DNA, 20 bp, Artificial Sequence
  Synthetic oligonucleotide; TGGAAT chr11 5395415 5395434 5395431 +
catgactatatgcagggtta

SEQ ID NO: 60570 - DNA, 20 bp, Artificial Sequence
  Synthetic oligonucleotide; GAGAAT chr11 5395538 5395557 5395554 +
ttactgggctatgccttgta

SEQ ID NO: 60571 - DNA, 20 bp, Artificial Sequence
  Synthetic oligonucleotide; CAGGGT chr11 5395548 5395567 5395564 +
atgccttgtagagaatgata

SEQ ID NO: 60572 - DNA, 20 bp, Artificial Sequence
  Synthetic oligonucleotide; CAGAGT chr11 5395615 5395634 5395631 +
tgatgaagcttctaacattt

SEQ ID NO: 60573 - DNA, 20 bp, Artificial Sequence
  Synthetic oligonucleotide; AAGGAT chr11 5395751 5395770 5395767 +
actttgccaaagccatatgg

SEQ ID NO: 60574 - DNA, 20 bp, Artificial Sequence
  Synthetic oligonucleotide; TGGAAT chr11 5395869 5395888 5395885 +
ctcactgcaacattgctcac

SEQ ID NO: 60575 - DNA, 20 bp, Artificial Sequence
  Synthetic oligonucleotide; TTGAGT chr11 5395906 5395925 5395922 +
caactaataaaatgtgtcta

SEQ ID NO: 60576 - DNA, 20 bp, Artificial Sequence
  Synthetic oligonucleotide; ATGAAT chr11 5395947 5395966 5395963 +
tactccatttaaaattgcat

SEQ ID NO: 60577 - DNA, 20 bp, Artificial Sequence
  Synthetic oligonucleotide; TGGAGT chr11 5395967 5395986 5395983 +
atgaatggctctctaatcta

SEQ ID NO: 60578 - DNA, 20 bp, Artificial Sequence
  Synthetic oligonucleotide; TAGAAT chr11 5395976 5395995 5395992 +
tctctaatctatggagtagg

SEQ ID NO: 60579 - DNA, 20 bp, Artificial Sequence
  Synthetic oligonucleotide; TAGAGT chr11 5396037 5396056 5396053 +
tcagatactttgcacaatca

SEQ ID NO: 60580 - DNA, 20 bp, Artificial Sequence
  Synthetic oligonucleotide; AGGGAT chr11 5396145 5396164 5396161 +
atgtgcctaggctgcaagac

SEQ ID NO: 60581 - DNA, 20 bp, Artificial Sequence
  Synthetic oligonucleotide; CAGGAT chr11 5396355 5396374 5396371 +
aagcaacttcagcaaagtct

SEQ ID NO: 60582 - DNA, 20 bp, Artificial Sequence
  Synthetic oligonucleotide; GTGAGT chr11 5396417 5396436 5396433 +
acaccaataacagacaaaca

SEQ ID NO: 60583 - DNA, 20 bp, Artificial Sequence
  Synthetic oligonucleotide; GAGAAT chr11 5396449 5396468 5396465 +
ccattcacaattgcttcaga

SEQ ID NO: 60584 - DNA, 20 bp, Artificial Sequence
  Synthetic oligonucleotide; AGGAAT chr11 5396464 5396483 5396480 +
tcagagagaatataatacct

SEQ ID NO: 60585 - DNA, 20 bp, Artificial Sequence
  Synthetic oligonucleotide; AGGGAT chr11 5396480 5396499 5396496 +
acctaggaatccaacttaca

SEQ ID NO: 60586 - DNA, 20 bp, Artificial Sequence
  Synthetic oligonucleotide; ATGGAT chr11 5396567 5396586 5396583 +
tggaagaacattccatgctc

SEQ ID NO: 60587 - DNA, 20 bp, Artificial Sequence
  Synthetic oligonucleotide; CAGAAT chr11 5396665 5396684 5396681 +
gctaccaatgactttcttca

SEQ ID NO: 60588 - DNA, 20 bp, Artificial Sequence
  Synthetic oligonucleotide; AAGGAT chr11 5396934 5396953 5396950 +
agaaaaacaagaaatgggga

SEQ ID NO: 60589 - DNA, 20 bp, Artificial Sequence
  Synthetic oligonucleotide; CTGGAT chr11 5396997 5397016 5397013 +
ccaaatgtaggaagctgaaa

SEQ ID NO: 60590 - DNA, 20 bp, Artificial Sequence
  Synthetic oligonucleotide; ATGGAT chr11 5397038 5397057 5397054 +
tatacaaaaattaactcaag

SEQ ID NO: 60591 - DNA, 20 bp, Artificial Sequence
  Synthetic oligonucleotide; TGGGAT chr11 5397183 5397202 5397199 +
caaaagccaaaattcactaa

SEQ ID NO: 60592 - DNA, 20 bp, Artificial Sequence
  Synthetic oligonucleotide; CAGAGT chr11 5397233 5397252 5397249 +
acagcaaaagaaactaccat

SEQ ID NO: 60593 - DNA, 20 bp, Artificial Sequence
  Synthetic oligonucleotide; CAGAAT chr11 5397305 5397324 5397321 +
tctgacaaagggctaatatc

SEQ ID NO: 60594 - DNA, 20 bp, Artificial Sequence
  Synthetic oligonucleotide; AAGGAT chr11 5397368 5397387 5397384 +
accccatcaaaaagtgggca

SEQ ID NO: 60595 - DNA, 20 bp, Artificial Sequence
  Synthetic oligonucleotide; TAGAAT chr11 5397499 5397518 5397515 +
agataccatctcacaccagt

SEQ ID NO: 60596 - DNA, 20 bp, Artificial Sequence
  Synthetic oligonucleotide; GAGGAT chr11 5397543 5397562 5397559 +
aggaaacaacaggtgctgga

SEQ ID NO: 60597 - DNA, 20 bp, Artificial Sequence
  Synthetic oligonucleotide; AGGGAT chr11 5397632 5397651 5397648 +
agtcagtgtggtgattcctc

SEQ ID NO: 60598 - DNA, 20 bp, Artificial Sequence
  Synthetic oligonucleotide; CTGGGT chr11 5397677 5397696 5397693 +
ttgacccagccatcccatta

SEQ ID NO: 60599 - DNA, 20 bp, Artificial Sequence
  Synthetic oligonucleotide; AAGGAT chr11 5397692 5397711 5397708 +
cattactgggtatacaccca

SEQ ID NO: 60600 - DNA, 20 bp, Artificial Sequence
  Synthetic oligonucleotide; CTGGAT chr11 5397802 5397821 5397818 +
aaatgtccaacaatgataga

SEQ ID NO: 60601 - DNA, 20 bp, Artificial Sequence
  Synthetic oligonucleotide; TGGAAT chr11 5397834 5397853 5397850 +
aatgtggcacatatacacca

SEQ ID NO: 60602 - DNA, 20 bp, Artificial Sequence
  Synthetic oligonucleotide; ATGAGT chr11 5397861 5397880 5397877 +
ctatgcagccataaaaaatg

SEQ ID NO: 60603 - DNA, 20 bp, Artificial Sequence
  Synthetic oligonucleotide; ATGGAT chr11 5397886 5397905 5397902 +
ttcatgtcctttgtagggac

SEQ ID NO: 60604 - DNA, 20 bp, Artificial Sequence
  Synthetic oligonucleotide; TGGGGT chr11 5398031 5398050 5398047 +
tcacacaccggggcctgttg

SEQ ID NO: 60605 - DNA, 20 bp, Artificial Sequence
  Synthetic oligonucleotide; AGGGAT chr11 5398050 5398069 5398066 +
gtggggtgggaggagggggc

SEQ ID NO: 60606 - DNA, 20 bp, Artificial Sequence
  Synthetic oligonucleotide; GTGAGT chr11 5398086 5398105 5398102 +
gatatacctaatgttaaatg

SEQ ID NO: 60607 - DNA, 20 bp, Artificial Sequence
  Synthetic oligonucleotide; ATGGGT chr11 5398094 5398113 5398110 +
taatgttaaatggtgagtta

SEQ ID NO: 60608 - DNA, 20 bp, Artificial Sequence
  Synthetic oligonucleotide; CTGGAT chr11 5398234 5398253 5398250 +
atattagttatttaaatatg

SEQ ID NO: 60609 - DNA, 20 bp, Artificial Sequence
  Synthetic oligonucleotide; CTGGAT chr11 5398306 5398325 5398322 +
gcttgtttcccttaggttct

SEQ ID NO: 60610 - DNA, 20 bp, Artificial Sequence
  Synthetic oligonucleotide; CTGGGT chr11 5398336 5398355 5398352 +
agagaggctaatgtaattac

SEQ ID NO: 60611 - DNA, 20 bp, Artificial Sequence
  Synthetic oligonucleotide; ATGAAT chr11 5398449 5398468 5398465 +
agccccaggactaagaagat

SEQ ID NO: 60612 - DNA, 20 bp, Artificial Sequence
  Synthetic oligonucleotide; GTGAGT chr11 5398528 5398547 5398544 +
agaggccagtttcacttgtg

SEQ ID NO: 60613 - DNA, 20 bp, Artificial Sequence
  Synthetic oligonucleotide; TTGAAT chr11 5398591 5398610 5398607 +
gtctccacccaaatttcata

SEQ ID NO: 60614 - DNA, 20 bp, Artificial Sequence
  Synthetic oligonucleotide; TTGGAT chr11 5398648 5398667 5398664 +
agggaccaggtgggagatta

SEQ ID NO: 60615 - DNA, 20 bp, Artificial Sequence
  Synthetic oligonucleotide; CTGAGT chr11 5398690 5398709 5398706 +
cccatgcagttctcgtgata

SEQ ID NO: 60616 - DNA, 20 bp, Artificial Sequence
  Synthetic oligonucleotide; GTGAGT chr11 5398694 5398713 5398710 +
tgcagttctcgtgatactga

SEQ ID NO: 60617 - DNA, 20 bp, Artificial Sequence
  Synthetic oligonucleotide; GTGAGT chr11 5398841 5398860 5398857 +
ctccccagctatgtggaaat

SEQ ID NO: 60618 - DNA, 20 bp, Artificial Sequence
  Synthetic oligonucleotide; GAGAAT chr11 5398907 5398926 5398923 +
tagtatctttagagcagtgt

SEQ ID NO: 60619 - DNA, 20 bp, Artificial Sequence
  Synthetic oligonucleotide; AGGAAT chr11 5399053 5399072 5399069 +
aacctgtctggcagaaggag

SEQ ID NO: 60620 - DNA, 20 bp, Artificial Sequence
  Synthetic oligonucleotide; ATGAAT chr11 5399113 5399132 5399129 +
caaaaacaccagagcacatc

SEQ ID NO: 60621 - DNA, 20 bp, Artificial Sequence
  Synthetic oligonucleotide; TTGGGT chr11 5399148 5399167 5399164 +
agttttgccatcatattatc

SEQ ID NO: 60622 - DNA, 20 bp, Artificial Sequence
  Synthetic oligonucleotide; CTGAGT chr11 5399239 5399258 5399255 +
gtttacctcacagatgtggt

SEQ ID NO: 60623 - DNA, 20 bp, Artificial Sequence
  Synthetic oligonucleotide; GAGAAT chr11 5399318 5399337 5399334 +
gctgactgtgattgactcct

SEQ ID NO: 60624 - DNA, 20 bp, Artificial Sequence
  Synthetic oligonucleotide; TAGAGT chr11 5399338 5399357 5399354 +
gagaattcctgaaagagata

SEQ ID NO: 60625 - DNA, 20 bp, Artificial Sequence
  Synthetic oligonucleotide; GAGAAT chr11 5399347 5399366 5399363 +
tgaaagagatatagagtgga

SEQ ID NO: 60626 - DNA, 20 bp, Artificial Sequence
  Synthetic oligonucleotide; AGGGGT chr11 5399519 5399538 5399535 +
ctccaattctgtccagctcc

SEQ ID NO: 60627 - DNA, 20 bp, Artificial Sequence
  Synthetic oligonucleotide; GAGAAT chr11 5399657 5399676 5399673 +
caaacaaatcctaaactcag

SEQ ID NO: 60628 - DNA, 20 bp, Artificial Sequence
  Synthetic oligonucleotide; AAGGAT chr11 5399738 5399757 5399754 +
ctctggagatggaaactgag

SEQ ID NO: 60629 - DNA, 20 bp, Artificial Sequence
  Synthetic oligonucleotide; CAGGGT chr11 5399902 5399921 5399918 +
gaggtgtggcaggcaagata

SEQ ID NO: 60630 - DNA, 20 bp, Artificial Sequence
  Synthetic oligonucleotide; TGGGAT chr11 5399912 5399931 5399928 +
aggcaagatacagggtgcag

SEQ ID NO: 60631 - DNA, 20 bp, Artificial Sequence
  Synthetic oligonucleotide; AAGGAT chr11 5399919 5399938 5399935 +
atacagggtgcagtgggatc

SEQ ID NO: 60632 - DNA, 20 bp, Artificial Sequence
  Synthetic oligonucleotide; CTGAAT chr11 5399949 5399968 5399952 -
tcttcccgtgtgctgcctta

SEQ ID NO: 60633 - DNA, 20 bp, Artificial Sequence
  Synthetic oligonucleotide; CCGGAT chr11 5399896 5399915 5399899 -
gcctgccacacctcaaataa

SEQ ID NO: 60634 - DNA, 20 bp, Artificial Sequence
  Synthetic oligonucleotide; TAGAGT chr11 5399855 5399874 5399858 -
tcttgactgatacttgaaac

SEQ ID NO: 60635 - DNA, 20 bp, Artificial Sequence
  Synthetic oligonucleotide; CAGAGT chr11 5399743 5399762 5399746 -
tccttctcagtttccatctc

SEQ ID NO: 60636 - DNA, 20 bp, Artificial Sequence
  Synthetic oligonucleotide; AAGGGT chr11 5399723 5399742 5399726 -
cagagtctctaccgccagat

SEQ ID NO: 60637 - DNA, 20 bp, Artificial Sequence
  Synthetic oligonucleotide; CTGAGT chr11 5399677 5399696 5399680 -
cttaaaacacaatcattctc

SEQ ID NO: 60638 - DNA, 20 bp, Artificial Sequence
  Synthetic oligonucleotide; TAGGAT chr11 5399670 5399689 5399673 -
cacaatcattctcctgagtt

SEQ ID NO: 60639 - DNA, 20 bp, Artificial Sequence
  Synthetic oligonucleotide; AGGGAT chr11 5399626 5399645 5399629 -
ttagcttgaaaggttacaaa

SEQ ID NO: 60640 - DNA, 20 bp, Artificial Sequence
  Synthetic oligonucleotide; TAGAAT chr11 5399570 5399589 5399573 -
acaacaaatcagaaaaaaag

SEQ ID NO: 60641 - DNA, 20 bp, Artificial Sequence
  Synthetic oligonucleotide; CAGAAT chr11 5399530 5399549 5399533 -
actgtacccctggagctgga

SEQ ID NO: 60642 - DNA, 20 bp, Artificial Sequence
  Synthetic oligonucleotide; GTGAAT chr11 5399519 5399538 5399522 -
ggagctggacagaattggag

SEQ ID NO: 60643 - DNA, 20 bp, Artificial Sequence
  Synthetic oligonucleotide; GTGAAT chr11 5399385 5399404 5399388 -
atgtgagcctttagcaacca

SEQ ID NO: 60644 - DNA, 20 bp, Artificial Sequence
  Synthetic oligonucleotide; AGGAAT chr11 5399348 5399367 5399351 -
ctccactctatatctctttc

SEQ ID NO: 60645 - DNA, 20 bp, Artificial Sequence
  Synthetic oligonucleotide; AGGAGT chr11 5399338 5399357 5399341 -
tatctctttcaggaattctc

SEQ ID NO: 60646 - DNA, 20 bp, Artificial Sequence
  Synthetic oligonucleotide; AAGAAT chr11 5399231 5399250 5399234 -
tgtgaggtaaacaaggagac

SEQ ID NO: 60647 - DNA, 20 bp, Artificial Sequence
  Synthetic oligonucleotide; GTGAGT chr11 5399181 5399200 5399184 -
aaaccagacataagcatttt

SEQ ID NO: 60648 - DNA, 20 bp, Artificial Sequence
  Synthetic oligonucleotide; AAGAAT chr11 5399143 5399162 5399146 -
tatgatggcaaaactatttc

SEQ ID NO: 60649 - DNA, 20 bp, Artificial Sequence
  Synthetic oligonucleotide; TAGGAT chr11 5399088 5399107 5399091 -
ttttccatctgccaccaatt

SEQ ID NO: 60650 - DNA, 20 bp, Artificial Sequence
  Synthetic oligonucleotide; TGGGGT chr11 5398992 5399011 5398995 -
aagggcttcacactgtgaca

SEQ ID NO: 60651 - DNA, 20 bp, Artificial Sequence
  Synthetic oligonucleotide; GGGAGT chr11 5398985 5399004 5398988 -
tcacactgtgacatggggtt

SEQ ID NO: 60652 - DNA, 20 bp, Artificial Sequence
  Synthetic oligonucleotide; CTGAAT chr11 5398978 5398997 5398981 -
gtgacatggggttgggagtc

SEQ ID NO: 60653 - DNA, 20 bp, Artificial Sequence
  Synthetic oligonucleotide; GGGGAT chr11 5398950 5398969 5398953 -
tgcttcagaaggcagggctt

SEQ ID NO: 60654 - DNA, 20 bp, Artificial Sequence
  Synthetic oligonucleotide; CTGGGT chr11 5398900 5398919 5398903 -
tctaaagatactacctgaga

SEQ ID NO: 60655 - DNA, 20 bp, Artificial Sequence
  Synthetic oligonucleotide; GAGAGT chr11 5398775 5398794 5398778 -
ttacttggtggcaggcaaga

SEQ ID NO: 60656 - DNA, 20 bp, Artificial Sequence
  Synthetic oligonucleotide; AGGGAT chr11 5398636 5398655 5398639 -
tggtccctcccccgacatat

SEQ ID NO: 60657 - DNA, 20 bp, Artificial Sequence
  Synthetic oligonucleotide; GGGGAT chr11 5398627 5398646 5398630 -
ccccgacatatagggattat

SEQ ID NO: 60658 - DNA, 20 bp, Artificial Sequence
  Synthetic oligonucleotide; TTGGGT chr11 5398603 5398622 5398606 -
attacaattcaatatgaaat

SEQ ID NO: 60659 - DNA, 20 bp, Artificial Sequence
  Synthetic oligonucleotide; AGGGAT chr11 5398573 5398592 5398576 -
acacagagccaagccatatc

SEQ ID NO: 60660 - DNA, 20 bp, Artificial Sequence
  Synthetic oligonucleotide; TGGGAT chr11 5398518 5398537 5398521 -
actggcctctgagcctcagg

SEQ ID NO: 60661 - DNA, 20 bp, Artificial Sequence
  Synthetic oligonucleotide; TGGAAT chr11 5398450 5398469 5398453 -
tatcttcttagtcctggggc

SEQ ID NO: 60662 - DNA, 20 bp, Artificial Sequence
  Synthetic oligonucleotide; CAGAGT chr11 5398418 5398437 5398421 -
cattttttgaaaaagctgat

SEQ ID NO: 60663 - DNA, 20 bp, Artificial Sequence
  Synthetic oligonucleotide; AGGAGT chr11 5398408 5398427 5398411 -
aaaagctgatcagagtctct

SEQ ID NO: 60664 - DNA, 20 bp, Artificial Sequence
  Synthetic oligonucleotide; TAGAGT chr11 5398403 5398422 5398406 -
ctgatcagagtctctaggag

SEQ ID NO: 60665 - DNA, 20 bp, Artificial Sequence
  Synthetic oligonucleotide; TAGAGT chr11 5398299 5398318 5398302 -
aagggaaacaagcaaagata

SEQ ID NO: 60666 - DNA, 20 bp, Artificial Sequence
  Synthetic oligonucleotide; ATGAGT chr11 5398278 5398297 5398281 -
agagtcagtatctttgtgaa

SEQ ID NO: 60667 - DNA, 20 bp, Artificial Sequence
  Synthetic oligonucleotide; TAGGGT chr11 5398186 5398205 5398189 -
tttgttatacttttaagttt

SEQ ID NO: 60668 - DNA, 20 bp, Artificial Sequence
  Synthetic oligonucleotide; ATGAGT chr11 5397984 5398003 5397987 -
tcattgttcagttcccacct

SEQ ID NO: 60669 - DNA, 20 bp, Artificial Sequence
  Synthetic oligonucleotide; GAGAAT chr11 5397934 5397953 5397937 -
tgtccttgtgatagtttgct

SEQ ID NO: 60670 - DNA, 20 bp, Artificial Sequence
  Synthetic oligonucleotide; TTGGGT chr11 5397804 5397823 5397807 -
agtctatcattgttggacat

SEQ ID NO: 60671 - DNA, 20 bp, Artificial Sequence
  Synthetic oligonucleotide; GTGAAT chr11 5397777 5397796 5397780 -
ggttccaagtctttgctatt

SEQ ID NO: 60672 - DNA, 20 bp, Artificial Sequence
  Synthetic oligonucleotide; TTGGGT chr11 5397713 5397732 5397716 -
gcagcatgatttataatcct

SEQ ID NO: 60673 - DNA, 20 bp, Artificial Sequence
  Synthetic oligonucleotide; TGGGAT chr11 5397694 5397713 5397697 -
tttgggtgtatacccagtaa

SEQ ID NO: 60674 - DNA, 20 bp, Artificial Sequence
  Synthetic oligonucleotide; CTGGGT chr11 5397686 5397705 5397689 -
tatacccagtaatgggatgg

SEQ ID NO: 60675 - DNA, 20 bp, Artificial Sequence
  Synthetic oligonucleotide; AGGAAT chr11 5397651 5397670 5397654 -
tttctagttctagatccctg

SEQ ID NO: 60676 - DNA, 20 bp, Artificial Sequence
  Synthetic oligonucleotide; TGGGGT chr11 5397374 5397393 5397377 -
atcctttgcccactttttga

SEQ ID NO: 60677 - DNA, 20 bp, Artificial Sequence
  Synthetic oligonucleotide; TTGAGT chr11 5397346 5397365 5397349 -
tttttctcttgtaaatttgt

SEQ ID NO: 60678 - DNA, 20 bp, Artificial Sequence
  Synthetic oligonucleotide; CTGGAT chr11 5397328 5397347 5397331 -
gtttgagttcattgtagatt

SEQ ID NO: 60679 - DNA, 20 bp, Artificial Sequence
  Synthetic oligonucleotide; ATGAGT chr11 5397306 5397325 5397309 -
ggatattagccctttgtcag

SEQ ID NO: 60680 - DNA, 20 bp, Artificial Sequence
  Synthetic oligonucleotide; GTGAAT chr11 5397200 5397219 5397203 -
agtttaattagatcccatta

SEQ ID NO: 60681 - DNA, 20 bp, Artificial Sequence
  Synthetic oligonucleotide; CTGAAT chr11 5397131 5397150 5397134 -
tccatgcccatgcctatgtc

SEQ ID NO: 60682 - DNA, 20 bp, Artificial Sequence
  Synthetic oligonucleotide; TAGAGT chr11 5397104 5397123 5397107 -
gtattgcttaggttttcttc

SEQ ID NO: 60683 - DNA, 20 bp, Artificial Sequence
  Synthetic oligonucleotide; TTGAGT chr11 5397057 5397076 5397060 -
atttaagtctttaatccatc

SEQ ID NO: 60684 - DNA, 20 bp, Artificial Sequence
  Synthetic oligonucleotide; AGGGAT chr11 5397027 5397046 5397030 -
ttttgtataaggtgtaagga

SEQ ID NO: 60685 - DNA, 20 bp, Artificial Sequence
  Synthetic oligonucleotide; GGGAAT chr11 5396964 5396983 5396967 -
ccagcaccatttattaaaca

SEQ ID NO: 60686 - DNA, 20 bp, Artificial Sequence
  Synthetic oligonucleotide; TAGGAT chr11 5396756 5396775 5396759 -
ccagctttgttcttttggct

SEQ ID NO: 60687 - DNA, 20 bp, Artificial Sequence
  Synthetic oligonucleotide; GGGGAT chr11 5396660 5396679 5396663 -
aaagtcattggtagcttgat

SEQ ID NO: 60688 - DNA, 20 bp, Artificial Sequence
  Synthetic oligonucleotide; TTGAAT chr11 5396650 5396669 5396653 -
gtagcttgatggggatggca

SEQ ID NO: 60689 - DNA, 20 bp, Artificial Sequence
  Synthetic oligonucleotide; TGGAAT chr11 5396582 5396601 5396585 -
tttcttcctatccatgagca

SEQ ID NO: 60690 - DNA, 20 bp, Artificial Sequence
  Synthetic oligonucleotide; TTGGAT chr11 5396494 5396513 5396497 -
tccttcacatcccttgtaag

SEQ ID NO: 60691 - DNA, 20 bp, Artificial Sequence
  Synthetic oligonucleotide; GTGAAT chr11 5396457 5396476 5396460 -
atattctctctgaagcaatt

SEQ ID NO: 60692 - DNA, 20 bp, Artificial Sequence
  Synthetic oligonucleotide; GGGAGT chr11 5396451 5396470 5396454 -
tctctgaagcaattgtgaat

SEQ ID NO: 60693 - DNA, 20 bp, Artificial Sequence
  Synthetic oligonucleotide; AAGAAT chr11 5396415 5396434 5396418 -
tttgtctgttattggtgtat

SEQ ID NO: 60694 - DNA, 20 bp, Artificial Sequence
  Synthetic oligonucleotide; GGGGAT chr11 5396345 5396364 5396348 -
gaagttgcttatcagcttaa

SEQ ID NO: 60695 - DNA, 20 bp, Artificial Sequence
  Synthetic oligonucleotide; TGGGGT chr11 5396324 5396343 5396327 -
gggattttgggctgagacaa

SEQ ID NO: 60696 - DNA, 20 bp, Artificial Sequence
  Synthetic oligonucleotide; TTGAAT chr11 5396257 5396276 5396260 -
ttgactttctctttacataa

SEQ ID NO: 60697 - DNA, 20 bp, Artificial Sequence
  Synthetic oligonucleotide; TTGAAT chr11 5396196 5396215 5396199 -
ccagaacttccaacactatg

SEQ ID NO: 60698 - DNA, 20 bp, Artificial Sequence
  Synthetic oligonucleotide; AGGAGT chr11 5396190 5396209 5396193 -
cttccaacactatgttgaat

SEQ ID NO: 60699 - DNA, 20 bp, Artificial Sequence
  Synthetic oligonucleotide; TGGAGT chr11 5395954 5395973 5395957 -
cattcatatgcaattttaaa

SEQ ID NO: 60700 - DNA, 20 bp, Artificial Sequence
  Synthetic oligonucleotide; TGGAGT chr11 5395818 5395837 5395821 -
acaatgaagcgtaaggtatt

SEQ ID NO: 60701 - DNA, 20 bp, Artificial Sequence
  Synthetic oligonucleotide; CTGAAT chr11 5395749 5395768 5395752 -
atatggctttggcaaagtta

SEQ ID NO: 60702 - DNA, 20 bp, Artificial Sequence
  Synthetic oligonucleotide; AGGGAT chr11 5395408 5395427 5395411 -
gcatatagtcatgctagata

SEQ ID NO: 60703 - DNA, 20 bp, Artificial Sequence
  Synthetic oligonucleotide; CAGGAT chr11 5395269 5395288 5395272 -
ccagcatcttccatttgact

SEQ ID NO: 60704 - DNA, 20 bp, Artificial Sequence
  Synthetic oligonucleotide; TTGGGT chr11 5395215 5395234 5395218 -
tataaagctgtctctcttcc

SEQ ID NO: 60705 - DNA, 20 bp, Artificial Sequence
  Synthetic oligonucleotide; AGGAAT chr11 5395196 5395215 5395199 -
cttgggtctttggccctcaa

SEQ ID NO: 60706 - DNA, 20 bp, Artificial Sequence
  Synthetic oligonucleotide; ATGAAT chr11 5395167 5395186 5395170 -
cctagatggacgcagacttg

SEQ ID NO: 60707 - DNA, 20 bp, Artificial Sequence
  Synthetic oligonucleotide; AGGGAT chr11 5395154 5395173 5395157 -
agacttgatgaatgtcaaag

SEQ ID NO: 60708 - DNA, 20 bp, Artificial Sequence
  Synthetic oligonucleotide; ATGAGT chr11 5395084 5395103 5395087 -
aaatggaaatttagtgaacc

SEQ ID NO: 60709 - DNA, 20 bp, Artificial Sequence
  Synthetic oligonucleotide; GAGGAT chr11 5395051 5395070 5395054 -
ggaggtatttcagtgagcca

SEQ ID NO: 60710 - DNA, 20 bp, Artificial Sequence
  Synthetic oligonucleotide; TTGGGT chr11 5394998 5395017 5395001 -
caacttcataagaaaattta

SEQ ID NO: 60711 - DNA, 20 bp, Artificial Sequence
  Synthetic oligonucleotide; TTGGGT chr11 5394868 5394887 5394871 -
gtatgtaaagatcacaagct

SEQ ID NO: 60712 - DNA, 20 bp, Artificial Sequence
  Synthetic oligonucleotide; TTGAAT chr11 5394855 5394874 5394858 -
acaagctttgggtcagatat

SEQ ID NO: 60713 - DNA, 20 bp, Artificial Sequence
  Synthetic oligonucleotide; CAGAGT chr11 5394642 5394661 5394645 -
ggaaaacatgtacaaaggct

SEQ ID NO: 60714 - DNA, 20 bp, Artificial Sequence
  Synthetic oligonucleotide; GTGGAT chr11 5394539 5394558 5394542 -
tcaaaggcttagagaggctt

SEQ ID NO: 60715 - DNA, 20 bp, Artificial Sequence
  Synthetic oligonucleotide; CGGGAT chr11 5394524 5394543 5394527 -
ggcttgtggatattaaataa

SEQ ID NO: 60716 - DNA, 20 bp, Artificial Sequence
  Synthetic oligonucleotide; AGGAAT chr11 5394496 5394515 5394499 -
ttgtaaagatttttgcctgc

SEQ ID NO: 60717 - DNA, 20 bp, Artificial Sequence
  Synthetic oligonucleotide; AGGAAT chr11 5394476 5394495 5394479 -
aggaatataggcttgtgctg

SEQ ID NO: 60718 - DNA, 20 bp, Artificial Sequence
  Synthetic oligonucleotide; AGGAAT chr11 5394435 5394454 5394438 -
aagcagatactgtcattagc

SEQ ID NO: 60719 - DNA, 20 bp, Artificial Sequence
  Synthetic oligonucleotide; TTGAAT chr11 5394381 5394400 5394384 -
tttttggtttgttgttgttg

SEQ ID NO: 60720 - DNA, 20 bp, Artificial Sequence
  Synthetic oligonucleotide; ATGGGT chr11 5394268 5394287 5394271 -
tcagtgtacttatctgtaaa

SEQ ID NO: 60721 - DNA, 20 bp, Artificial Sequence
  Synthetic oligonucleotide; TAGAAT chr11 5394196 5394215 5394199 -
cttatagtgtattatgccct

SEQ ID NO: 60722 - DNA, 20 bp, Artificial Sequence
  Synthetic oligonucleotide; CTGAGT chr11 5394121 5394140 5394124 -
aaggtactcagtaccttcta

SEQ ID NO: 60723 - DNA, 20 bp, Artificial Sequence
  Synthetic oligonucleotide; GTGAAT chr11 5394109 5394128 5394112 -
accttctactgagtttttct

SEQ ID NO: 60724 - DNA, 20 bp, Artificial Sequence
  Synthetic oligonucleotide; ACGAGT chr11 5393912 5393931 5393915 -
atggaaaacatggccctgaa

SEQ ID NO: 60725 - DNA, 20 bp, Artificial Sequence
  Synthetic oligonucleotide; AGGAGT chr11 5393892 5393911 5393895 -
acgagtggtcctgtttggag

SEQ ID NO: 60726 - DNA, 20 bp, Artificial Sequence
  Synthetic oligonucleotide; TTGAAT chr11 5393848 5393867 5393851 -
aaaatcagatgcgcttgata

SEQ ID NO: 60727 - DNA, 20 bp, Artificial Sequence
  Synthetic oligonucleotide; GTGAGT chr11 5393663 5393682 5393666 -
agtactcagccctctctacc

SEQ ID NO: 60728 - DNA, 20 bp, Artificial Sequence
  Synthetic oligonucleotide; ATGAAT chr11 5393322 5393341 5393325 -
ttttaataatagtgtatcaa

SEQ ID NO: 60729 - DNA, 20 bp, Artificial Sequence
  Synthetic oligonucleotide; ATGGAT chr11 5393180 5393199 5393183 -
attgatcactgacctaggag

SEQ ID NO: 60730 - DNA, 20 bp, Artificial Sequence
  Synthetic oligonucleotide; ATGAAT chr11 5393057 5393076 5393060 -
gcatttctgagacacagagc

SEQ ID NO: 60731 - DNA, 20 bp, Artificial Sequence
  Synthetic oligonucleotide; AGGAGT chr11 5392908 5392927 5392911 -
ctttttttttgtttttgaga

SEQ ID NO: 60732 - DNA, 20 bp, Artificial Sequence
  Synthetic oligonucleotide; TGGAGT chr11 5392883 5392902 5392886 -
tcttgctctgttgcccaggc

SEQ ID NO: 60733 - DNA, 20 bp, Artificial Sequence
  Synthetic oligonucleotide; CTGGGT chr11 5392839 5392858 5392842 -
ctcactgcaagctccacctc

SEQ ID NO: 60734 - DNA, 20 bp, Artificial Sequence
  Synthetic oligonucleotide; CTGAGT chr11 5392807 5392826 5392810 -
cattctgctgccccagcctc

SEQ ID NO: 60735 - DNA, 20 bp, Artificial Sequence
  Synthetic oligonucleotide; CTGGGT chr11 5392741 5392760 5392744 -
ttttgtatttttagtagaga

SEQ ID NO: 60736 - DNA, 20 bp, Artificial Sequence
  Synthetic oligonucleotide; CAGGAT chr11 5392721 5392740 5392724 -
ctgggttccaccgtgttagc

SEQ ID NO: 60737 - DNA, 20 bp, Artificial Sequence
  Synthetic oligonucleotide; CAGAGT chr11 5392672 5392691 5392675 -
atccacccgcctcggcctcc

SEQ ID NO: 60738 - DNA, 20 bp, Artificial Sequence
  Synthetic oligonucleotide; TGGGAT chr11 5392664 5392683 5392667 -
gcctcggcctcccagagtgc

SEQ ID NO: 60739 - DNA, 20 bp, Artificial Sequence
  Synthetic oligonucleotide; TTGAGT chr11 5392556 5392575 5392559 -
tgttaatttgcattttaaat

SEQ ID NO: 60740 - DNA, 20 bp, Artificial Sequence
  Synthetic oligonucleotide; TAGAAT chr11 5392383 5392402 5392386 -
attctaccaaatgagatcta

SEQ ID NO: 60741 - DNA, 20 bp, Artificial Sequence
  Synthetic oligonucleotide; AGGAAT chr11 5392377 5392396 5392380 -
ccaaatgagatctatagaat

SEQ ID NO: 60742 - DNA, 20 bp, Artificial Sequence
  Synthetic oligonucleotide; AAGAAT chr11 5392354 5392373 5392357 -
aatttcctctcaacatggag

SEQ ID NO: 60743 - DNA, 20 bp, Artificial Sequence
  Synthetic oligonucleotide; TTGAGT chr11 5392326 5392345 5392329 -
tctaagtctcggaactgcta

SEQ ID NO: 60744 - DNA, 20 bp, Artificial Sequence
  Synthetic oligonucleotide; GTGGAT chr11 5392305 5392324 5392308 -
tgagtaatgtggcctactat

SEQ ID NO: 60745 - DNA, 20 bp, Artificial Sequence
  Synthetic oligonucleotide; TAGAAT chr11 5392286 5392305 5392289 -
tgtggatgtaaattaaagtt

SEQ ID NO: 60746 - DNA, 20 bp, Artificial Sequence
  Synthetic oligonucleotide; AGGAGT chr11 5392266 5392285 5392269 -
tagaatggaacctatgttta

SEQ ID NO: 60747 - DNA, 20 bp, Artificial Sequence
  Synthetic oligonucleotide; CTGGGT chr11 5392234 5392253 5392237 -
ctgtaaggctgcagaaactg

SEQ ID NO: 60748 - DNA, 20 bp, Artificial Sequence
  Synthetic oligonucleotide; GAGAGT chr11 5392207 5392226 5392210 -
ccagaggggctcccaagcct

SEQ ID NO: 60749 - DNA, 20 bp, Artificial Sequence
  Synthetic oligonucleotide; TAGAGT chr11 5392122 5392141 5392125 -
caaacatacatacatatttt

SEQ ID NO: 60750 - DNA, 20 bp, Artificial Sequence
  Synthetic oligonucleotide; TTGAAT chr11 5392063 5392082 5392066 -
gtttgttttcctttttattt

SEQ ID NO: 60751 - DNA, 20 bp, Artificial Sequence
  Synthetic oligonucleotide; CGGGGT chr11 5392057 5392076 5392060 -
tttcctttttatttttgaat

SEQ ID NO: 60752 - DNA, 20 bp, Artificial Sequence
  Synthetic oligonucleotide; TAGGGT chr11 5391899 5391918 5391902 -
tttaattttttttgtagaga

SEQ ID NO: 60753 - DNA, 20 bp, Artificial Sequence
  Synthetic oligonucleotide; TGGGAT chr11 5391777 5391796 5391780 -
accttggtctcccaaagtgc

SEQ ID NO: 60754 - DNA, 20 bp, Artificial Sequence
  Synthetic oligonucleotide; GAGAAT chr11 5391723 5391742 5391726 -
atggtaattttaacctgtag

SEQ ID NO: 60755 - DNA, 20 bp, Artificial Sequence
  Synthetic oligonucleotide; ATGGGT chr11 5391719 5391738 5391722 -
taattttaacctgtaggaga

SEQ ID NO: 60756 - DNA, 20 bp, Artificial Sequence
  Synthetic oligonucleotide; GAGGAT chr11 5391711 5391730 5391714 -
acctgtaggagaatgggtgg

SEQ ID NO: 60757 - DNA, 20 bp, Artificial Sequence
  Synthetic oligonucleotide; CTGAGT chr11 5391696 5391715 5391699 -
ggtgggaggatccagagggc

SEQ ID NO: 60758 - DNA, 20 bp, Artificial Sequence
  Synthetic oligonucleotide; ATGGAT chr11 5391654 5391673 5391657 -
aatgaagatataccaccttg

SEQ ID NO: 60759 - DNA, 20 bp, Artificial Sequence
  Synthetic oligonucleotide; CTGAAT chr11 5391620 5391639 5391623 -
aaaggtgtcttcttgggctt

SEQ ID NO: 60760 - DNA, 20 bp, Artificial Sequence
  Synthetic oligonucleotide; AGGAGT chr11 5391605 5391624 5391608 -
ggcttctgaatgtgaagagg

SEQ ID NO: 60761 - DNA, 20 bp, Artificial Sequence
  Synthetic oligonucleotide; CTGGAT chr11 5391567 5391586 5391570 -
gaagagaacttctgttagct

SEQ ID NO: 60762 - DNA, 20 bp, Artificial Sequence
  Synthetic oligonucleotide; TTGAGT chr11 5391517 5391536 5391520 -
acgcatacatttaatattta

SEQ ID NO: 60763 - DNA, 20 bp, Artificial Sequence
  Synthetic oligonucleotide; AGGGAT chr11 5391444 5391463 5391447 -
aagacatgcctaattcctcc

SEQ ID NO: 60764 - DNA, 20 bp, Artificial Sequence
  Synthetic oligonucleotide; AAGGAT chr11 5391242 5391261 5391245 -
ttcaaagctgagacccctgc

SEQ ID NO: 60765 - DNA, 20 bp, Artificial Sequence
  Synthetic oligonucleotide; TGGGAT chr11 5391172 5391191 5391175 -
gtttatttcctcctgagcaa

SEQ ID NO: 60766 - DNA, 20 bp, Artificial Sequence
  Synthetic oligonucleotide; GTGAGT chr11 5391146 5391165 5391149 -
tgtgacttcaatatgtttgt

SEQ ID NO: 60767 - DNA, 20 bp, Artificial Sequence
  Synthetic oligonucleotide; AGGAGT chr11 5391013 5391032 5391016 -
aaggtaaaatcagagatgag

SEQ ID NO: 60768 - DNA, 20 bp, Artificial Sequence
  Synthetic oligonucleotide; AAGGAT chr11 5391006 5391025 5391009 -
aatcagagatgagaggagtc

SEQ ID NO: 60769 - DNA, 20 bp, Artificial Sequence
  Synthetic oligonucleotide; TAGGAT chr11 5391001 5391020 5391004 -
gagatgagaggagtcaagga

SEQ ID NO: 60770 - DNA, 20 bp, Artificial Sequence
  Synthetic oligonucleotide; AGGAAT chr11 5390977 5390996 5390980 -
atcaaagtctcttcttctag

SEQ ID NO: 60771 - DNA, 20 bp, Artificial Sequence
  Synthetic oligonucleotide; GGGGGT chr11 5390937 5390956 5390940 -
gcacaaccttagaaatttgg

SEQ ID NO: 60772 - DNA, 20 bp, Artificial Sequence
  Synthetic oligonucleotide; AAGAAT chr11 5390908 5390927 5390911 -
gcttgaaacaggtgttgagg

SEQ ID NO: 60773 - DNA, 20 bp, Artificial Sequence
  Synthetic oligonucleotide; AGGAGT chr11 5390900 5390919 5390903 -
caggtgttgaggaagaatgc

SEQ ID NO: 60774 - DNA, 20 bp, Artificial Sequence
  Synthetic oligonucleotide; GGGGGT chr11 5390872 5390891 5390875 -
tgaggtttctgatgtgactt

SEQ ID NO: 60775 - DNA, 20 bp, Artificial Sequence
  Synthetic oligonucleotide; CAGGAT chr11 5390848 5390867 5390851 -
gtctgaaagttactgctgac

SEQ ID NO: 60776 - DNA, 20 bp, Artificial Sequence
  Synthetic oligonucleotide; GTGAGT chr11 5390759 5390778 5390762 -
aaggaggtgtatttccggag

SEQ ID NO: 60777 - DNA, 20 bp, Artificial Sequence
  Synthetic oligonucleotide; CTGGGT chr11 5390712 5390731 5390715 -
ggtctctgccaggctctcct

SEQ ID NO: 60778 - DNA, 20 bp, Artificial Sequence
  Synthetic oligonucleotide; CTGGAT chr11 5390618 5390637 5390621 -
accttcaataaagttgcctt

SEQ ID NO: 60779 - DNA, 20 bp, Artificial Sequence
  Synthetic oligonucleotide; GGGAGT chr11 5390400 5390419 5390403 -
ccttcttataggcctctagg

SEQ ID NO: 60780 - DNA, 20 bp, Artificial Sequence
  Synthetic oligonucleotide; GTGGAT chr11 5390335 5390354 5390338 -
aggaacttgataatggcacg

SEQ ID NO: 60781 - DNA, 20 bp, Artificial Sequence
  Synthetic oligonucleotide; TTGGGT chr11 5390303 5390322 5390306 -
ggtcttaatgctgtatatga

SEQ ID NO: 60782 - DNA, 20 bp, Artificial Sequence
  Synthetic oligonucleotide; ATGAAT chr11 5390254 5390273 5390257 -
tagacattggccataagaag

SEQ ID NO: 60783 - DNA, 20 bp, Artificial Sequence
  Synthetic oligonucleotide; AAGAAT chr11 5390190 5390209 5390193 -
acagccccatcatgggcaca

SEQ ID NO: 60784 - DNA, 20 bp, Artificial Sequence
  Synthetic oligonucleotide; CAGGAT chr11 5390101 5390120 5390104 -
gccaggcctgctactgtgtg

SEQ ID NO: 60785 - DNA, 20 bp, Artificial Sequence
  Synthetic oligonucleotide; ATGAGT chr11 5390097 5390116 5390100 -
ggcctgctactgtgtgcagg

SEQ ID NO: 60786 - DNA, 20 bp, Artificial Sequence
  Synthetic oligonucleotide; ATGAGT chr11 5389967 5389986 5389970 -
cacttcctggtgcaggcaaa

SEQ ID NO: 60787 - DNA, 20 bp, Artificial Sequence
  Synthetic oligonucleotide; AGGGAT chr11 5389909 5389928 5389912 -
gccttcaggaggaggacaat

SEQ ID NO: 60788 - DNA, 20 bp, Artificial Sequence
  Synthetic oligonucleotide; CCGAAT chr11 5389835 5389854 5389838 -
ttgctggccagtgataatga

SEQ ID NO: 60789 - DNA, 20 bp, Artificial Sequence
  Synthetic oligonucleotide; GAGGGT chr11 5389823 5389842 5389826 -
gataatgaccgaatacctca

SEQ ID NO: 60790 - DNA, 20 bp, Artificial Sequence
  Synthetic oligonucleotide; AAGAGT chr11 5389754 5389773 5389757 -
tgaggactccatgaaggaaa

SEQ ID NO: 60791 - DNA, 20 bp, Artificial Sequence
  Synthetic oligonucleotide; GTGGAT chr11 5389750 5389769 5389753 -
gactccatgaaggaaaaaga

SEQ ID NO: 60792 - DNA, 20 bp, Artificial Sequence
  Synthetic oligonucleotide; CTGGAT chr11 5389735 5389754 5389738 -
aaagagtggatgcagaacat

SEQ ID NO: 60793 - DNA, 20 bp, Artificial Sequence
  Synthetic oligonucleotide; GGGAGT chr11 5389703 5389722 5389706 -
cgctccaaagtagatactat

SEQ ID NO: 60794 - DNA, 20 bp, Artificial Sequence
  Synthetic oligonucleotide; AAGGAT chr11 5389629 5389648 5389632 -
ccaggtcagtgagggccagc

SEQ ID NO: 60795 - DNA, 20 bp, Artificial Sequence
  Synthetic oligonucleotide; ATGGGT chr11 5389611 5389630 5389614 -
gcaaggatagtagatagtac

SEQ ID NO: 60796 - DNA, 20 bp, Artificial Sequence
  Synthetic oligonucleotide; GAGGGT chr11 5389595 5389614 5389598 -
gtacatgggtgtgtgcagac

SEQ ID NO: 60797 - DNA, 20 bp, Artificial Sequence
  Synthetic oligonucleotide; CAGAAT chr11 5389573 5389592 5389576 -
gggttggtcttaataatgat

SEQ ID NO: 60798 - DNA, 20 bp, Artificial Sequence
  Synthetic oligonucleotide; GGGGAT chr11 5389525 5389544 5389528 -
accatgtacataaagaaaaa

SEQ ID NO: 60799 - DNA, 20 bp, Artificial Sequence
  Synthetic oligonucleotide; TAGAAT chr11 5389473 5389492 5389476 -
atccaggaaagctggtgaga

SEQ ID NO: 60800 - DNA, 20 bp, Artificial Sequence
  Synthetic oligonucleotide; CTGAGT chr11 5389456 5389475 5389459 -
agatagaatatggggctaaa

SEQ ID NO: 60801 - DNA, 20 bp, Artificial Sequence
  Synthetic oligonucleotide; TTGGAT chr11 5389446 5389465 5389449 -
tggggctaaactgagtaatg

SEQ ID NO: 60802 - DNA, 20 bp, Artificial Sequence
  Synthetic oligonucleotide; ATGAAT chr11 5389434 5389453 5389437 -
gagtaatgttggatagcagc

SEQ ID NO: 60803 - DNA, 20 bp, Artificial Sequence
  Synthetic oligonucleotide; GCGAAT chr11 5389418 5389437 5389421 -
cagcatgaattgaggactga

SEQ ID NO: 60804 - DNA, 20 bp, Artificial Sequence
  Synthetic oligonucleotide; GGGGAT chr11 5389394 5389413 5389397 -
atattggactgacattcctc

SEQ ID NO: 60805 - DNA, 20 bp, Artificial Sequence
  Synthetic oligonucleotide; ATGGAT chr11 5389374 5389393 5389377 -
ggggattgagctgaaaataa

SEQ ID NO: 60806 - DNA, 20 bp, Artificial Sequence
  Synthetic oligonucleotide; ATGAAT chr11 5389272 5389291 5389275 -
gtattatctactccaccctt

SEQ ID NO: 60807 - DNA, 20 bp, Artificial Sequence
  Synthetic oligonucleotide; TAGGGT chr11 5388867 5388886 5388870 -
atcaaccaatcaccaagtcc

SEQ ID NO: 60808 - DNA, 20 bp, Artificial Sequence
  Synthetic oligonucleotide; CTGAAT chr11 5388852 5388871 5388855 -
agtcctagggtttctgttta

SEQ ID NO: 60809 - DNA, 20 bp, Artificial Sequence
  Synthetic oligonucleotide; TGGAAT chr11 5388513 5388532 5388516 -
atttgtattttcattcttcc

SEQ ID NO: 60810 - DNA, 20 bp, Artificial Sequence
  Synthetic oligonucleotide; TTGAAT chr11 5388383 5388402 5388386 -
ttaaattccccaagtttagt

SEQ ID NO: 60811 - DNA, 20 bp, Artificial Sequence
  Synthetic oligonucleotide; GTGAAT chr11 5388285 5388304 5388288 -
ttctgtattgcttctataat

SEQ ID NO: 60812 - DNA, 20 bp, Artificial Sequence
  Synthetic oligonucleotide; AGGGAT chr11 5388226 5388245 5388229 -
ttaattttaatattagctct

SEQ ID NO: 60813 - DNA, 20 bp, Artificial Sequence
  Synthetic oligonucleotide; TGGAAT chr11 5388196 5388215 5388199 -
ttttttagccaccatatcat

SEQ ID NO: 60814 - DNA, 20 bp, Artificial Sequence
  Synthetic oligonucleotide; TTGAAT chr11 5388176 5388195 5388179 -
tggaatcctttaaatattat

SEQ ID NO: 60815 - DNA, 20 bp, Artificial Sequence
  Synthetic oligonucleotide; AAGAGT chr11 5387844 5387863 5387847 -
agggagcaaaggaggaaggt

SEQ ID NO: 60816 - DNA, 20 bp, Artificial Sequence
  Synthetic oligonucleotide; TAGGGT chr11 5387825 5387844 5387828 -
taagagtgatgcattttata

SEQ ID NO: 60817 - DNA, 20 bp, Artificial Sequence
  Synthetic oligonucleotide; CTGAGT chr11 5387802 5387821 5387805 -
ggtagtcagagaagacctct

SEQ ID NO: 60818 - DNA, 20 bp, Artificial Sequence
  Synthetic oligonucleotide; GGGAAT chr11 5387626 5387645 5387629 -
tcaatggaggaagcaaggtg

SEQ ID NO: 60819 - DNA, 20 bp, Artificial Sequence
  Synthetic oligonucleotide; TTGAAT chr11 5387549 5387568 5387552 -
tgcaggtcacgcaagctact

SEQ ID NO: 60820 - DNA, 20 bp, Artificial Sequence
  Synthetic oligonucleotide; TCGAGT chr11 5387524 5387543 5387527 -
ttttattatacttgtgagct

SEQ ID NO: 60821 - DNA, 20 bp, Artificial Sequence
  Synthetic oligonucleotide; ATGGAT chr11 5387500 5387519 5387503 -
gttgagagcagaggtgctgc

SEQ ID NO: 60822 - DNA, 20 bp, Artificial Sequence
  Synthetic oligonucleotide; AGGGGT chr11 5387471 5387490 5387474 -
aggcttacatcactttggca

SEQ ID NO: 60823 - DNA, 20 bp, Artificial Sequence
  Synthetic oligonucleotide; GAGAGT chr11 5387318 5387337 5387321 -
tctaggggccaaatgcaatg

SEQ ID NO: 60824 - DNA, 20 bp, Artificial Sequence
  Synthetic oligonucleotide; CTGAGT chr11 5387010 5387029 5387013 -
aactccgttacatatcaggc

SEQ ID NO: 60825 - DNA, 20 bp, Artificial Sequence
  Synthetic oligonucleotide; AAGGAT chr11 5386977 5386996 5386980 -
ttctcactaggtgtttccaa

SEQ ID NO: 60826 - DNA, 20 bp, Artificial Sequence
  Synthetic oligonucleotide; ATGAAT chr11 5386614 5386633 5386617 -
atgcagaaagtactaactct

SEQ ID NO: 60827 - DNA, 20 bp, Artificial Sequence
  Synthetic oligonucleotide; TAGAAT chr11 5386570 5386589 5386573 -
acttcagtagctcctatcat

SEQ ID NO: 60828 - DNA, 20 bp, Artificial Sequence
  Synthetic oligonucleotide; ATGAAT chr11 5386475 5386494 5386478 -
gtgaaaagcttgacataatc

SEQ ID NO: 60829 - DNA, 20 bp, Artificial Sequence
  Synthetic oligonucleotide; CAGGAT chr11 5386373 5386392 5386376 -
gcctggtagtgagcgaaaat

SEQ ID NO: 60830 - DNA, 20 bp, Artificial Sequence
  Synthetic oligonucleotide; GCGGAT chr11 5386130 5386149 5386133 -
tttccaaccagtaaacactt

SEQ ID NO: 60831 - DNA, 20 bp, Artificial Sequence
  Synthetic oligonucleotide; TAGAAT chr11 5385860 5385879 5385863 -
atttactcataaatacttta

SEQ ID NO: 60832 - DNA, 20 bp, Artificial Sequence
  Synthetic oligonucleotide; TAGGGT chr11 5385791 5385810 5385794 -
agattttttatatataagta

SEQ ID NO: 60833 - DNA, 20 bp, Artificial Sequence
  Synthetic oligonucleotide; TGGAAT chr11 5385572 5385591 5385575 -
attttttaagttgattagac

SEQ ID NO: 60834 - DNA, 20 bp, Artificial Sequence
  Synthetic oligonucleotide; ATGGGT chr11 5385484 5385503 5385487 -
ttttttgcatgaaaaactaa

SEQ ID NO: 60835 - DNA, 20 bp, Artificial Sequence
  Synthetic oligonucleotide; GTGAAT chr11 5385480 5385499 5385483 -
ttgcatgaaaaactaaatgg

SEQ ID NO: 60836 - DNA, 20 bp, Artificial Sequence
  Synthetic oligonucleotide; TGGGGT chr11 5385436 5385455 5385439 -
ttatcctgattctttgtgcc

SEQ ID NO: 60837 - DNA, 20 bp, Artificial Sequence
  Synthetic oligonucleotide; CAGAGT chr11 5385401 5385420 5385404 -
agctctgtgttcaccaactt

SEQ ID NO: 60838 - DNA, 20 bp, Artificial Sequence
  Synthetic oligonucleotide; AAGGAT chr11 5385377 5385396 5385380 -
gtgatgagatggacagggag

SEQ ID NO: 60839 - DNA, 20 bp, Artificial Sequence
  Synthetic oligonucleotide; TGGGAT chr11 5385330 5385349 5385333 -
tacagagacaatgacagggc

SEQ ID NO: 60840 - DNA, 20 bp, Artificial Sequence
  Synthetic oligonucleotide; GGGGAT chr11 5385280 5385299 5385283 -
ctcttgggaagaaagcttta

SEQ ID NO: 60841 - DNA, 20 bp, Artificial Sequence
  Synthetic oligonucleotide; AGGAGT chr11 5385201 5385220 5385204 -
tcatgtctactaagcaatgg

SEQ ID NO: 60842 - DNA, 20 bp, Artificial Sequence
  Synthetic oligonucleotide; CAGAGT chr11 5385142 5385161 5385145 -
cataattaaaatattcaagg

SEQ ID NO: 60843 - DNA, 20 bp, Artificial Sequence
  Synthetic oligonucleotide; ATGAGT chr11 5385082 5385101 5385085 -
aaagagattttcagtataca

SEQ ID NO: 60844 - DNA, 20 bp, Artificial Sequence
  Synthetic oligonucleotide; TTGAAT chr11 5385035 5385054 5385038 -
gtgtctaaatattcttttgt

SEQ ID NO: 60845 - DNA, 20 bp, Artificial Sequence
  Synthetic oligonucleotide; GAGGAT chr11 5384993 5385012 5384996 -
tttaatgaactacattggtg

SEQ ID NO: 60846 - DNA, 20 bp, Artificial Sequence
  Synthetic oligonucleotide; GAGAAT chr11 5384969 5384988 5384972 -
atactgtttcttgtaaatag

SEQ ID NO: 60847 - DNA, 20 bp, Artificial Sequence
  Synthetic oligonucleotide; TAGGAT chr11 5384849 5384868 5384852 -
gtaaacatgcctgtttttag

SEQ ID NO: 60848 - DNA, 20 bp, Artificial Sequence
  Synthetic oligonucleotide; GAGGAT chr11 5384839 5384858 5384842 -
ctgtttttagtaggatagag

SEQ ID NO: 60849 - DNA, 20 bp, Artificial Sequence
  Synthetic oligonucleotide; CTGGAT chr11 5384811 5384830 5384814 -
tggaaggcgaaggccatatc

SEQ ID NO: 60850 - DNA, 20 bp, Artificial Sequence
  Synthetic oligonucleotide; TTGGAT chr11 5384781 5384800 5384784 -
gggaagttacaaggtgttgt

SEQ ID NO: 60851 - DNA, 20 bp, Artificial Sequence
  Synthetic oligonucleotide; GAGGAT chr11 5384760 5384779 5384763 -
tggattaaaataagcagatt

SEQ ID NO: 60852 - DNA, 20 bp, Artificial Sequence
  Synthetic oligonucleotide; TGGGGT chr11 5384755 5384774 5384758 -
taaaataagcagattgagga

SEQ ID NO: 60853 - DNA, 20 bp, Artificial Sequence
  Synthetic oligonucleotide; TTGAAT chr11 5384701 5384720 5384704 -
aaaatgcatttaataatttg

SEQ ID NO: 60854 - DNA, 20 bp, Artificial Sequence
  Synthetic oligonucleotide; GTGAAT chr11 5384693 5384712 5384696 -
tttaataatttgttgaataa

SEQ ID NO: 60855 - DNA, 20 bp, Artificial Sequence
  Synthetic oligonucleotide; GAGAGT chr11 5384672 5384691 5384675 -
tgaatgactgtttttctgat

SEQ ID NO: 60856 - DNA, 20 bp, Artificial Sequence
  Synthetic oligonucleotide; GAGGGT chr11 5384661 5384680 5384664 -
ttttctgatgagagtaagga

SEQ ID NO: 60857 - DNA, 20 bp, Artificial Sequence
  Synthetic oligonucleotide; AAGAGT chr11 5384630 5384649 5384633 -
taccagatggctcggcagga

SEQ ID NO: 60858 - DNA, 20 bp, Artificial Sequence
  Synthetic oligonucleotide; GGGAGT chr11 5384541 5384560 5384544 -
gccatgcaggcactcatcag

SEQ ID NO: 60859 - DNA, 20 bp, Artificial Sequence
  Synthetic oligonucleotide; CAGAAT chr11 5384506 5384525 5384509 -
ctgcctcctggccttcctaa

SEQ ID NO: 60860 - DNA, 20 bp, Artificial Sequence
  Synthetic oligonucleotide; GAGAAT chr11 5384415 5384434 5384418 -
tggttctgtgcatagactct

SEQ ID NO: 60861 - DNA, 20 bp, Artificial Sequence
  Synthetic oligonucleotide; AAGAAT chr11 5384295 5384314 5384298 -
ttataatcctggcaacttgg

SEQ ID NO: 60862 - DNA, 20 bp, Artificial Sequence
  Synthetic oligonucleotide; GAGGAT chr11 5384282 5384301 5384285 -
aacttggaagaataaggtgg

SEQ ID NO: 60863 - DNA, 20 bp, Artificial Sequence
  Synthetic oligonucleotide; TTGAAT chr11 5384273 5384292 5384276 -
gaataaggtgggaggattgc

SEQ ID NO: 60864 - DNA, 20 bp, Artificial Sequence
  Synthetic oligonucleotide; TTGAGT chr11 5384262 5384281 5384265 -
gaggattgcttgaatccggt

SEQ ID NO: 60865 - DNA, 20 bp, Artificial Sequence
  Synthetic oligonucleotide; CTGGGT chr11 5384220 5384239 5384223 -
ttacaccactgcactgtagc

SEQ ID NO: 60866 - DNA, 20 bp, Artificial Sequence
  Synthetic oligonucleotide; GGGAAT chr11 5384123 5384142 5384126 -
atcccattaggcttagtgca

SEQ ID NO: 60867 - DNA, 20 bp, Artificial Sequence
  Synthetic oligonucleotide; GGGAAT chr11 5384114 5384133 5384117 -
ggcttagtgcagggaatgtg

SEQ ID NO: 60868 - DNA, 20 bp, Artificial Sequence
  Synthetic oligonucleotide; ATGAGT chr11 5383889 5383908 5383892 -
ataacaaaaatgtgaagcca

SEQ ID NO: 60869 - DNA, 20 bp, Artificial Sequence
  Synthetic oligonucleotide; AAGAGT chr11 5383864 5383883 5383867 -
taggttccaaaggaagaaag

SEQ ID NO: 60870 - DNA, 20 bp, Artificial Sequence
  Synthetic oligonucleotide; AAGGAT chr11 5383852 5383871 5383855 -
gaagaaagaagagtatagat

SEQ ID NO: 60871 - DNA, 20 bp, Artificial Sequence
  Synthetic oligonucleotide; AAGGGT chr11 5383841 5383860 5383844 -
agtatagataaggatgacac

SEQ ID NO: 60872 - DNA, 20 bp, Artificial Sequence
  Synthetic oligonucleotide; AAGGAT chr11 5383803 5383822 5383806 -
caaggctgtggctgtcacag

SEQ ID NO: 60873 - DNA, 20 bp, Artificial Sequence
  Synthetic oligonucleotide; AAGGGT chr11 5383747 5383766 5383750 -
ggagaacttaatggtaaaca

SEQ ID NO: 60874 - DNA, 20 bp, Artificial Sequence
  Synthetic oligonucleotide; GGGAAT chr11 5383731 5383750 5383734 -
aacaaagggtccccagggct

SEQ ID NO: 60875 - DNA, 20 bp, Artificial Sequence
  Synthetic oligonucleotide; TCGGAT chr11 5383491 5383510 5383494 -
cccgtcgttttccagagagg

SEQ ID NO: 60876 - DNA, 20 bp, Artificial Sequence
  Synthetic oligonucleotide; GAGGAT chr11 5383473 5383492 5383476 -
ggtcggatgtagtatatgaa

SEQ ID NO: 60877 - DNA, 20 bp, Artificial Sequence
  Synthetic oligonucleotide; TTGAAT chr11 5383202 5383221 5383205 -
caaagctctctacttcatct

SEQ ID NO: 60878 - DNA, 20 bp, Artificial Sequence
  Synthetic oligonucleotide; CTGAGT chr11 5383056 5383075 5383059 -
cccagactatgctacagaac

SEQ ID NO: 60879 - DNA, 20 bp, Artificial Sequence
  Synthetic oligonucleotide; TAGAGT chr11 5382914 5382933 5382917 -
ttaaatagggcatggttgat

SEQ ID NO: 60880 - DNA, 20 bp, Artificial Sequence
  Synthetic oligonucleotide; GGGGAT chr11 5382903 5382922 5382906 -
atggttgattagagttgtgt

SEQ ID NO: 60881 - DNA, 20 bp, Artificial Sequence
  Synthetic oligonucleotide; CCGGGT chr11 5382788 5382807 5382791 -
agaagtggcaccaccttaca

SEQ ID NO: 60882 - DNA, 20 bp, Artificial Sequence
  Synthetic oligonucleotide; CAGAGT chr11 5382762 5382781 5382765 -
aagtaactggttgttagggc

SEQ ID NO: 60883 - DNA, 20 bp, Artificial Sequence
  Synthetic oligonucleotide; GAGAGT chr11 5382752 5382771 5382755 -
ttgttagggccagagtgtag

SEQ ID NO: 60884 - DNA, 20 bp, Artificial Sequence
  Synthetic oligonucleotide; CAGGGT chr11 5382746 5382765 5382749 -
gggccagagtgtaggagagt

SEQ ID NO: 60885 - DNA, 20 bp, Artificial Sequence
  Synthetic oligonucleotide; CAGGAT chr11 5382719 5382738 5382722 -
ataggacaagatgcagagag

SEQ ID NO: 60886 - DNA, 20 bp, Artificial Sequence
  Synthetic oligonucleotide; TGGGAT chr11 5382558 5382577 5382561 -
atgattttagcctatttcac

SEQ ID NO: 60887 - DNA, 20 bp, Artificial Sequence
  Synthetic oligonucleotide; GTGGGT chr11 5382398 5382417 5382401 -
tggcaattatattaatattt

SEQ ID NO: 60888 - DNA, 20 bp, Artificial Sequence
  Synthetic oligonucleotide; AAGAAT chr11 5382332 5382351 5382335 -
ctgagctatgaagactaatt

SEQ ID NO: 60889 - DNA, 20 bp, Artificial Sequence
  Synthetic oligonucleotide; AGGGGT chr11 5382284 5382303 5382287 -
gaaaggtatttccaaaaagg

SEQ ID NO: 60890 - DNA, 20 bp, Artificial Sequence
  Synthetic oligonucleotide; GAGAGT chr11 5382190 5382209 5382193 -
tgatcaaatataacatttaa

SEQ ID NO: 60891 - DNA, 20 bp, Artificial Sequence
  Synthetic oligonucleotide; TGGAAT chr11 5382176 5382195 5382179 -
atttaagagagttaatacct

SEQ ID NO: 60892 - DNA, 20 bp, Artificial Sequence
  Synthetic oligonucleotide; CTGAAT chr11 5382140 5382159 5382143 -
aggtaggcaggggcaagacc

SEQ ID NO: 60893 - DNA, 20 bp, Artificial Sequence
  Synthetic oligonucleotide; ATGAGT chr11 5382136 5382155 5382139 -
aggcaggggcaagaccctga

SEQ ID NO: 60894 - DNA, 20 bp, Artificial Sequence
  Synthetic oligonucleotide; TTGGGT chr11 5382093 5382112 5382096 -
catggtacacattttgatgg

SEQ ID NO: 60895 - DNA, 20 bp, Artificial Sequence
  Synthetic oligonucleotide; CAGAGT chr11 5382055 5382074 5382058 -
gagataacaatcatattttc

SEQ ID NO: 60896 - DNA, 20 bp, Artificial Sequence
  Synthetic oligonucleotide; AAGGAT chr11 5382028 5382047 5382031 -
cattgttaacaatatgcagg

SEQ ID NO: 60897 - DNA, 20 bp, Artificial Sequence
  Synthetic oligonucleotide; CTGGAT chr11 5381979 5381998 5381982 -
tgttattttggtgtatggag

SEQ ID NO: 60898 - DNA, 20 bp, Artificial Sequence
  Synthetic oligonucleotide; GTGGAT chr11 5381925 5381944 5381928 -
tagataaacaatactgttta

SEQ ID NO: 60899 - DNA, 20 bp, Artificial Sequence
  Synthetic oligonucleotide; CTGAAT chr11 5381840 5381859 5381843 -
tagctttatattctatttct

SEQ ID NO: 60900 - DNA, 20 bp, Artificial Sequence
  Synthetic oligonucleotide; TTGAGT chr11 5381561 5381580 5381564 -
ttgcctttatgaagctcaca

SEQ ID NO: 60901 - DNA, 20 bp, Artificial Sequence
  Synthetic oligonucleotide; TAGGGT chr11 5381521 5381540 5381524 -
gttcaacgaagtttccaaaa

SEQ ID NO: 60902 - DNA, 20 bp, Artificial Sequence
  Synthetic oligonucleotide; GAGGAT chr11 5381461 5381480 5381464 -
tgaagcctggaggccaagag

SEQ ID NO: 60903 - DNA, 20 bp, Artificial Sequence
  Synthetic oligonucleotide; GTGGGT chr11 5381409 5381428 5381412 -
tcggacctatctctatcact

SEQ ID NO: 60904 - DNA, 20 bp, Artificial Sequence
  Synthetic oligonucleotide; GCGAAT chr11 5381397 5381416 5381400 -
ctatcactgtgggtaatcat

SEQ ID NO: 60905 - DNA, 20 bp, Artificial Sequence
  Synthetic oligonucleotide; GTGAAT chr11 5381381 5381400 5381384 -
tcatgcgaatattaggtgaa

SEQ ID NO: 60906 - DNA, 20 bp, Artificial Sequence
  Synthetic oligonucleotide; GTGGGT chr11 5381375 5381394 5381378 -
gaatattaggtgaagtgaat

SEQ ID NO: 60907 - DNA, 20 bp, Artificial Sequence
  Synthetic oligonucleotide; TAGAAT chr11 5381298 5381317 5381301 -
ggccttaacctttaaggtat

SEQ ID NO: 60908 - DNA, 20 bp, Artificial Sequence
  Synthetic oligonucleotide; AAGAAT chr11 5381283 5381302 5381286 -
ggtattagaattcattatta

SEQ ID NO: 60909 - DNA, 20 bp, Artificial Sequence
  Synthetic oligonucleotide; TGGGGT chr11 5381130 5381149 5381133 -
gagcgacagagagagagagg

SEQ ID NO: 60910 - DNA, 20 bp, Artificial Sequence
  Synthetic oligonucleotide; GGGGGT chr11 5381124 5381143 5381127 -
cagagagagagaggtggggt

SEQ ID NO: 60911 - DNA, 20 bp, Artificial Sequence
  Synthetic oligonucleotide; TGGGGT chr11 5381114 5381133 5381117 -
gaggtggggtgggggtatgg

SEQ ID NO: 60912 - DNA, 20 bp, Artificial Sequence
  Synthetic oligonucleotide; CAGAAT chr11 5381054 5381073 5381057 -
ttatttaaggaacctctatc

SEQ ID NO: 60913 - DNA, 20 bp, Artificial Sequence
  Synthetic oligonucleotide; CTGAAT chr11 5380989 5381008 5380992 -
aggagattccttcaggagaa

SEQ ID NO: 60914 - DNA, 20 bp, Artificial Sequence
  Synthetic oligonucleotide; AAGGAT chr11 5380921 5380940 5380924 -
ccagggggagcattcagccc

SEQ ID NO: 60915 - DNA, 20 bp, Artificial Sequence
  Synthetic oligonucleotide; GAGGAT chr11 5380776 5380795 5380779 -
aaccagttcattcttccttt

SEQ ID NO: 60916 - DNA, 20 bp, Artificial Sequence
  Synthetic oligonucleotide; CAGGGT chr11 5380550 5380569 5380553 -
ctaaataaaatccttactca

SEQ ID NO: 60917 - DNA, 20 bp, Artificial Sequence
  Synthetic oligonucleotide; GCGGGT chr11 5380407 5380426 5380410 -
ttttgtggtgtgagatcgat

SEQ ID NO: 60918 - DNA, 20 bp, Artificial Sequence
  Synthetic oligonucleotide; TAGGAT chr11 5380373 5380392 5380376 -
ctggagagacccacagaagt

SEQ ID NO: 60919 - DNA, 20 bp, Artificial Sequence
  Synthetic oligonucleotide; AAGGGT chr11 5380361 5380380 5380364 -
acagaagttaggattgccaa

SEQ ID NO: 60920 - DNA, 20 bp, Artificial Sequence
  Synthetic oligonucleotide; GAGAGT chr11 5380258 5380277 5380261 -
cctgcatctgtgtgtgcaca

SEQ ID NO: 60921 - DNA, 20 bp, Artificial Sequence
  Synthetic oligonucleotide; CAGAGT chr11 5380028 5380047 5380031 -
catattttgatttgctataa

SEQ ID NO: 60922 - DNA, 20 bp, Artificial Sequence
  Synthetic oligonucleotide; CTGAGT chr11 5380020 5380039 5380023 -
gatttgctataacagagtac

SEQ ID NO: 60923 - DNA, 20 bp, Artificial Sequence
  Synthetic oligonucleotide; CTGGGT chr11 5380014 5380033 5380017 -
ctataacagagtacctgagt

SEQ ID NO: 60924 - DNA, 20 bp, Artificial Sequence
  Synthetic oligonucleotide; TAGAAT chr11 5379776 5379795 5379779 -
ctgtccaccatatgtgaaat

SEQ ID NO: 60925 - DNA, 20 bp, Artificial Sequence
  Synthetic oligonucleotide; ATGGAT chr11 5379752 5379771 5379755 -
attctaaaaggaaacaaaaa

SEQ ID NO: 60926 - DNA, 20 bp, Artificial Sequence
  Synthetic oligonucleotide; AGGAAT chr11 5379733 5379752 5379736 -
aatggattaaacgttttttg

SEQ ID NO: 60927 - DNA, 20 bp, Artificial Sequence
  Synthetic oligonucleotide; CTGAAT chr11 5379721 5379740 5379724 -
gttttttgaggaattattga

SEQ ID NO: 60928 - DNA, 20 bp, Artificial Sequence
  Synthetic oligonucleotide; TAGGGT chr11 5379445 5379464 5379448 -
tattattatactttaagatt

SEQ ID NO: 60929 - DNA, 20 bp, Artificial Sequence
  Synthetic oligonucleotide; CAGAGT chr11 5379301 5379320 5379304 -
ccccaccccacaacagtccc

SEQ ID NO: 60930 - DNA, 20 bp, Artificial Sequence
  Synthetic oligonucleotide; ATGAGT chr11 5379244 5379263 5379247 -
tcattgttcagttcccatct

SEQ ID NO: 60931 - DNA, 20 bp, Artificial Sequence
  Synthetic oligonucleotide; GAGAAT chr11 5379238 5379257 5379241 -
ttcagttcccatctatgagt

SEQ ID NO: 60932 - DNA, 20 bp, Artificial Sequence
  Synthetic oligonucleotide; GAGAAT chr11 5379194 5379213 5379197 -
tgtccttgcgatagtttact

SEQ ID NO: 60933 - DNA, 20 bp, Artificial Sequence
  Synthetic oligonucleotide; TTGGGT chr11 5379065 5379084 5379068 -
agtctatcattgttggacat

SEQ ID NO: 60934 - DNA, 20 bp, Artificial Sequence
  Synthetic oligonucleotide; GTGAAT chr11 5379038 5379057 5379041 -
ggttccaagtctttgctatt

SEQ ID NO: 60935 - DNA, 20 bp, Artificial Sequence
  Synthetic oligonucleotide; TTGGGT chr11 5378974 5378993 5378977 -
gcagcatgatttatattcct

SEQ ID NO: 60936 - DNA, 20 bp, Artificial Sequence
  Synthetic oligonucleotide; TGGGAT chr11 5378955 5378974 5378958 -
tttgggtatatacccagtaa

SEQ ID NO: 60937 - DNA, 20 bp, Artificial Sequence
  Synthetic oligonucleotide; CTGGGT chr11 5378947 5378966 5378950 -
tatacccagtaatgggatgg

SEQ ID NO: 60938 - DNA, 20 bp, Artificial Sequence
  Synthetic oligonucleotide; AGGAAT chr11 5378912 5378931 5378915 -
tttctagttctagatccctg

SEQ ID NO: 60939 - DNA, 20 bp, Artificial Sequence
  Synthetic oligonucleotide; AAGAGT chr11 5378860 5378879 5378863 -
aactagtttacagtcccacc

SEQ ID NO: 60940 - DNA, 20 bp, Artificial Sequence
  Synthetic oligonucleotide; TTGAGT chr11 5378603 5378622 5378606 -
tttttttcttgtaaatttgt

SEQ ID NO: 60941 - DNA, 20 bp, Artificial Sequence
  Synthetic oligonucleotide; CTGGAT chr11 5378585 5378604 5378588 -
gtttgagttcattatagatt

SEQ ID NO: 60942 - DNA, 20 bp, Artificial Sequence
  Synthetic oligonucleotide; ATGAGT chr11 5378563 5378582 5378566 -
ggatattagccctttgtcag

SEQ ID NO: 60943 - DNA, 20 bp, Artificial Sequence
  Synthetic oligonucleotide; GTGAAT chr11 5378457 5378476 5378460 -
agtttcattagatcccatta

SEQ ID NO: 60944 - DNA, 20 bp, Artificial Sequence
  Synthetic oligonucleotide; CTGAAT chr11 5378388 5378407 5378391 -
tccttgcccatgcctatgtc

SEQ ID NO: 60945 - DNA, 20 bp, Artificial Sequence
  Synthetic oligonucleotide; TAGGGT chr11 5378361 5378380 5378364 -
gtaatgcctgcgttttcttc

SEQ ID NO: 60946 - DNA, 20 bp, Artificial Sequence
  Synthetic oligonucleotide; TTGAAT chr11 5378314 5378333 5378317 -
gtttaagtctttaatccatc

SEQ ID NO: 60947 - DNA, 20 bp, Artificial Sequence
  Synthetic oligonucleotide; AGGGAT chr11 5378284 5378303 5378287 -
ttttgtataaggtgtaagga

SEQ ID NO: 60948 - DNA, 20 bp, Artificial Sequence
  Synthetic oligonucleotide; GGGAAT chr11 5378221 5378240 5378224 -
ccagcaccatttattaaata

SEQ ID NO: 60949 - DNA, 20 bp, Artificial Sequence
  Synthetic oligonucleotide; TAGGAT chr11 5378013 5378032 5378016 -
ccagctttgttcttttggct

SEQ ID NO: 60950 - DNA, 20 bp, Artificial Sequence
  Synthetic oligonucleotide; GGGGAT chr11 5377918 5377937 5377921 -
aaaatcattggtagcttgat

SEQ ID NO: 60951 - DNA, 20 bp, Artificial Sequence
  Synthetic oligonucleotide; TTGAAT chr11 5377908 5377927 5377911 -
gtagcttgatggggatggca

SEQ ID NO: 60952 - DNA, 20 bp, Artificial Sequence
  Synthetic oligonucleotide; TGGAAT chr11 5377840 5377859 5377843 -
attcttcctacccataagca

SEQ ID NO: 60953 - DNA, 20 bp, Artificial Sequence
  Synthetic oligonucleotide; TTGGAT chr11 5377747 5377766 5377750 -
tccttcacatcccttgtaag

SEQ ID NO: 60954 - DNA, 20 bp, Artificial Sequence
  Synthetic oligonucleotide; GTGAAT chr11 5377710 5377729 5377713 -
ttattctctttgaagcaatt

SEQ ID NO: 60955 - DNA, 20 bp, Artificial Sequence
  Synthetic oligonucleotide; GGGAGT chr11 5377704 5377723 5377707 -
tctttgaagcaattgtgaat

SEQ ID NO: 60956 - DNA, 20 bp, Artificial Sequence
  Synthetic oligonucleotide; AAGAAT chr11 5377656 5377675 5377659 -
tttgtctgttattggtgtat

SEQ ID NO: 60957 - DNA, 20 bp, Artificial Sequence
  Synthetic oligonucleotide; GGGGGT chr11 5377565 5377584 5377568 -
gagattttgggctgagacaa

SEQ ID NO: 60958 - DNA, 20 bp, Artificial Sequence
  Synthetic oligonucleotide; TTGAAT chr11 5377498 5377517 5377501 -
ttgacttcctcttttcttaa

SEQ ID NO: 60959 - DNA, 20 bp, Artificial Sequence
  Synthetic oligonucleotide; TTGAAT chr11 5377437 5377456 5377440 -
ccagaacttccaacactatg

SEQ ID NO: 60960 - DNA, 20 bp, Artificial Sequence
  Synthetic oligonucleotide; AGGAGT chr11 5377431 5377450 5377434 -
cttccaacactatgttgaat

SEQ ID NO: 60961 - DNA, 20 bp, Artificial Sequence
  Synthetic oligonucleotide; GGGAAT chr11 5377386 5377405 5377389 -
gtcttgtgccagtttacaaa

SEQ ID NO: 60962 - DNA, 20 bp, Artificial Sequence
  Synthetic oligonucleotide; GTGGGT chr11 5377344 5377363 5377347 -
cattcagtatgatattggct

SEQ ID NO: 60963 - DNA, 20 bp, Artificial Sequence
  Synthetic oligonucleotide; AAGGGT chr11 5377266 5377285 5377269 -
tattgaaagtttttagcatg

SEQ ID NO: 60964 - DNA, 20 bp, Artificial Sequence
  Synthetic oligonucleotide; TTGAAT chr11 5377258 5377277 5377261 -
gtttttagcatgaagggttg

SEQ ID NO: 60965 - DNA, 20 bp, Artificial Sequence
  Synthetic oligonucleotide; CTGGAT chr11 5377183 5377202 5377186 -
tctttggttctgtttatatg

SEQ ID NO: 60966 - DNA, 20 bp, Artificial Sequence
  Synthetic oligonucleotide; AGGGAT chr11 5377135 5377154 5377138 -
ttgaaccagccttgcatccc

SEQ ID NO: 60967 - DNA, 20 bp, Artificial Sequence
  Synthetic oligonucleotide; GTGGAT chr11 5377111 5377130 5377114 -
atgaagtccacttgatcatc

SEQ ID NO: 60968 - DNA, 20 bp, Artificial Sequence
  Synthetic oligonucleotide; CTGGAT chr11 5377087 5377106 5377090 -
ataagctttttgatgtgctg

SEQ ID NO: 60969 - DNA, 20 bp, Artificial Sequence
  Synthetic oligonucleotide; GAGGAT chr11 5377060 5377079 5377063 -
cggtttgccagtattttatt

SEQ ID NO: 60970 - DNA, 20 bp, Artificial Sequence
  Synthetic oligonucleotide; AGGGAT chr11 5377035 5377054 5377038 -
tttttgcatcgatgttcatc

SEQ ID NO: 60971 - DNA, 20 bp, Artificial Sequence
  Synthetic oligonucleotide; TAGGAT chr11 5376979 5376998 5376982 -
tctctttctggctttggtat

SEQ ID NO: 60972 - DNA, 20 bp, Artificial Sequence
  Synthetic oligonucleotide; ATGAGT chr11 5376956 5376975 5376959 -
gatgatgctggcctcataaa

SEQ ID NO: 60973 - DNA, 20 bp, Artificial Sequence
  Synthetic oligonucleotide; GAGGAT chr11 5376946 5376965 5376949 -
gcctcataaaatgagttagg

SEQ ID NO: 60974 - DNA, 20 bp, Artificial Sequence
  Synthetic oligonucleotide; TGGAAT chr11 5376921 5376940 5376924 -
ttccttctttttctgttgat

SEQ ID NO: 60975 - DNA, 20 bp, Artificial Sequence
  Synthetic oligonucleotide; AGGAAT chr11 5376906 5376925 5376909 -
ttgattggaatagtttcaga

SEQ ID NO: 60976 - DNA, 20 bp, Artificial Sequence
  Synthetic oligonucleotide; TAGAAT chr11 5376873 5376892 5376876 -
attcctccttgtacctctgt

SEQ ID NO: 60977 - DNA, 20 bp, Artificial Sequence
  Synthetic oligonucleotide; GTGAAT chr11 5376861 5376880 5376864 -
acctctgttagaatttggct

SEQ ID NO: 60978 - DNA, 20 bp, Artificial Sequence
  Synthetic oligonucleotide; TGGGAT chr11 5376748 5376767 5376751 -
acttcttcctggtttagtct

SEQ ID NO: 60979 - DNA, 20 bp, Artificial Sequence
  Synthetic oligonucleotide; AGGAAT chr11 5376729 5376748 5376732 -
ttgggatagtgtatgtgtcc

SEQ ID NO: 60980 - DNA, 20 bp, Artificial Sequence
  Synthetic oligonucleotide; TGGGAT chr11 5376644 5376663 5376647 -
gatggcagtttgtatttctg

SEQ ID NO: 60981 - DNA, 20 bp, Artificial Sequence
  Synthetic oligonucleotide; AAGGGT chr11 5376502 5376521 5376505 -
ccagattcattaattttttg

SEQ ID NO: 60982 - DNA, 20 bp, Artificial Sequence
  Synthetic oligonucleotide; TTGAAT chr11 5376431 5376450 5376434 -
ttcttgacttctgctagctt

SEQ ID NO: 60983 - DNA, 20 bp, Artificial Sequence
  Synthetic oligonucleotide; TAGGGT chr11 5376385 5376404 5376388 -
agttcttttaattgtgatgt

SEQ ID NO: 60984 - DNA, 20 bp, Artificial Sequence
  Synthetic oligonucleotide; TTGGAT chr11 5376372 5376391 5376375 -
gtgatgttagggtgtcaatt

SEQ ID NO: 60985 - DNA, 20 bp, Artificial Sequence
  Synthetic oligonucleotide; TCGAAT chr11 5376309 5376328 5376312 -
atttccccctacacactgat

SEQ ID NO: 60986 - DNA, 20 bp, Artificial Sequence
  Synthetic oligonucleotide; TTGAGT chr11 5376176 5376195 5376179 -
gttgttcagtttccatgtag

SEQ ID NO: 60987 - DNA, 20 bp, Artificial Sequence
  Synthetic oligonucleotide; TTGAGT chr11 5376166 5376185 5376169 -
ttccatgtagttgagtggtt

SEQ ID NO: 60988 - DNA, 20 bp, Artificial Sequence
  Synthetic oligonucleotide; GTGAGT chr11 5376162 5376181 5376165 -
atgtagttgagtggttttga

SEQ ID NO: 60989 - DNA, 20 bp, Artificial Sequence
  Synthetic oligonucleotide; CTGAGT chr11 5376147 5376166 5376150 -
tttgagtgagtttcttaatc

SEQ ID NO: 60990 - DNA, 20 bp, Artificial Sequence
  Synthetic oligonucleotide; TGGAAT chr11 5376041 5376060 5376044 -
tccaagtatgtggtcaattt

SEQ ID NO: 60991 - DNA, 20 bp, Artificial Sequence
  Synthetic oligonucleotide; TGGGGT chr11 5375992 5376011 5375995 -
aaatgtatattctgttgatt

SEQ ID NO: 60992 - DNA, 20 bp, Artificial Sequence
  Synthetic oligonucleotide; GAGAGT chr11 5375985 5376004 5375988 -
tattctgttgatttggggtg

SEQ ID NO: 60993 - DNA, 20 bp, Artificial Sequence
  Synthetic oligonucleotide; CTGGAT chr11 5375931 5375950 5375934 -
tgcagagctgtgttcaattc

SEQ ID NO: 60994 - DNA, 20 bp, Artificial Sequence
  Synthetic oligonucleotide; TGGGGT chr11 5375880 5375899 5375883 -
gatctgtctaatgttgacag

SEQ ID NO: 60995 - DNA, 20 bp, Artificial Sequence
  Synthetic oligonucleotide; GGGAGT chr11 5375848 5375867 5375851 -
gtctcccattattaaagtgt

SEQ ID NO: 60996 - DNA, 20 bp, Artificial Sequence
  Synthetic oligonucleotide; ATGAAT chr11 5375807 5375826 5375810 -
ggtctctaaggacttgcttt

SEQ ID NO: 60997 - DNA, 20 bp, Artificial Sequence
  Synthetic oligonucleotide; CTGGGT chr11 5375801 5375820 5375804 -
taaggacttgctttatgaat

SEQ ID NO: 60998 - DNA, 20 bp, Artificial Sequence
  Synthetic oligonucleotide; TTGGGT chr11 5375786 5375805 5375789 -
tgaatctgggtgctcctgta

SEQ ID NO: 60999 - DNA, 20 bp, Artificial Sequence
  Synthetic oligonucleotide; TAGGAT chr11 5375769 5375788 5375772 -
gtattgggtgcatatatatt

SEQ ID NO: 61000 - DNA, 20 bp, Artificial Sequence
  Synthetic oligonucleotide; TTGAAT chr11 5375748 5375767 5375751 -
aggatagttagctcttcttg

SEQ ID NO: 61001 - DNA, 20 bp, Artificial Sequence
  Synthetic oligonucleotide; TAGGAT chr11 5375664 5375683 5375667 -
aagcctgttttatcagagac

SEQ ID NO: 61002 - DNA, 20 bp, Artificial Sequence
  Synthetic oligonucleotide; ATGGGT chr11 5375568 5375587 5375571 -
tgtgtgtgtgtgcacatgag

SEQ ID NO: 61003 - DNA, 20 bp, Artificial Sequence
  Synthetic oligonucleotide; CTGAAT chr11 5375559 5375578 5375562 -
gtgcacatgagatgggtttc

SEQ ID NO: 61004 - DNA, 20 bp, Artificial Sequence
  Synthetic oligonucleotide; GTGAAT chr11 5375472 5375491 5375475 -
ttaaagttaatattgtatgt

SEQ ID NO: 61005 - DNA, 20 bp, Artificial Sequence
  Synthetic oligonucleotide; CTGGAT chr11 5375226 5375245 5375229 -
acttatgaagcttagtttgg

SEQ ID NO: 61006 - DNA, 20 bp, Artificial Sequence
  Synthetic oligonucleotide; AAGGAT chr11 5375189 5375208 5375192 -
tgttgaaaattctttccttt

SEQ ID NO: 61007 - DNA, 20 bp, Artificial Sequence
  Synthetic oligonucleotide; TTGAAT chr11 5375182 5375201 5375185 -
aattctttcctttaaggatg

SEQ ID NO: 61008 - DNA, 20 bp, Artificial Sequence
  Synthetic oligonucleotide; TAGAGT chr11 5375150 5375169 5375153 -
ccccactctcttctggcttg

SEQ ID NO: 61009 - DNA, 20 bp, Artificial Sequence
  Synthetic oligonucleotide; GTGGGT chr11 5375102 5375121 5375105 -
agtctgatgggcttcccttt

SEQ ID NO: 61010 - DNA, 20 bp, Artificial Sequence
  Synthetic oligonucleotide; GTGAAT chr11 5375041 5375060 5375044 -
tttccttcatttcaactttg

SEQ ID NO: 61011 - DNA, 20 bp, Artificial Sequence
  Synthetic oligonucleotide; TGGAGT chr11 5375018 5375037 5375021 -
aatctgacaattatgtgtct

SEQ ID NO: 61012 - DNA, 20 bp, Artificial Sequence
  Synthetic oligonucleotide; AGGAGT chr11 5375001 5375020 5375004 -
tcttggagttgctcttctcg

SEQ ID NO: 61013 - DNA, 20 bp, Artificial Sequence
  Synthetic oligonucleotide; CTGAAT chr11 5374970 5374989 5374973 -
tgtggcgttctctgtatttc

SEQ ID NO: 61014 - DNA, 20 bp, Artificial Sequence
  Synthetic oligonucleotide; CTGAAT chr11 5374964 5374983 5374967 -
gttctctgtatttcctgaat

SEQ ID NO: 61015 - DNA, 20 bp, Artificial Sequence
  Synthetic oligonucleotide; CTGGAT chr11 5374925 5374944 5374928 -
gctagattggggaagttctc

SEQ ID NO: 61016 - DNA, 20 bp, Artificial Sequence
  Synthetic oligonucleotide; CAGAGT chr11 5374910 5374929 5374913 -
ttctcctggataatatcctg

SEQ ID NO: 61017 - DNA, 20 bp, Artificial Sequence
  Synthetic oligonucleotide; TTGAAT chr11 5374555 5374574 5374558 -
ttatcttctttgcctttggt

SEQ ID NO: 61018 - DNA, 20 bp, Artificial Sequence
  Synthetic oligonucleotide; CGGAGT chr11 5374535 5374554 5374538 -
ttgaatttcctcctgtagct

SEQ ID NO: 61019 - DNA, 20 bp, Artificial Sequence
  Synthetic oligonucleotide; TAGAGT chr11 5374412 5374431 5374415 -
aggaaaggtgctctgctttt

SEQ ID NO: 61020 - DNA, 20 bp, Artificial Sequence
  Synthetic oligonucleotide; ATGGGT chr11 5374328 5374347 5374331 -
ttgatgatagtgatgtaccg

SEQ ID NO: 61021 - DNA, 20 bp, Artificial Sequence
  Synthetic oligonucleotide; GTGGAT chr11 5374315 5374334 5374318 -
tgtaccgatgggtttttggt

SEQ ID NO: 61022 - DNA, 20 bp, Artificial Sequence
  Synthetic oligonucleotide; TGGAGT chr11 5374251 5374270 5374254 -
accctcagctgcaggtctgt

SEQ ID NO: 61023 - DNA, 20 bp, Artificial Sequence
  Synthetic oligonucleotide; CTGGGT chr11 5374214 5374233 5374217 -
ccactccagaccctgtttgc

SEQ ID NO: 61024 - DNA, 20 bp, Artificial Sequence
  Synthetic oligonucleotide; GCGAAT chr11 5374167 5374186 5374170 -
accgcagattttcgtgatcc

SEQ ID NO: 61025 - DNA, 20 bp, Artificial Sequence
  Synthetic oligonucleotide; AGGAGT chr11 5374123 5374142 5374126 -
ctctggaagttttgtctcag

SEQ ID NO: 61026 - DNA, 20 bp, Artificial Sequence
  Synthetic oligonucleotide; GGGGGT chr11 5374082 5374101 5374085 -
gtgtcagtctgcccttactt

SEQ ID NO: 61027 - DNA, 20 bp, Artificial Sequence
  Synthetic oligonucleotide; GGGGGT chr11 5374056 5374075 5374059 -
gcctcccagttaggctgctc

SEQ ID NO: 61028 - DNA, 20 bp, Artificial Sequence
  Synthetic oligonucleotide; AGGGGT chr11 5374049 5374068 5374052 -
agttaggctgctcgggggtc

SEQ ID NO: 61029 - DNA, 20 bp, Artificial Sequence
  Synthetic oligonucleotide; TGGGGT chr11 5373850 5373869 5373853 -
caggcctccttgagctgtgg

SEQ ID NO: 61030 - DNA, 20 bp, Artificial Sequence
  Synthetic oligonucleotide; CAGGAT chr11 5373683 5373702 5373686 -
aggaccctcggagccatgtg

SEQ ID NO: 61031 - DNA, 20 bp, Artificial Sequence
  Synthetic oligonucleotide; TCGGGT chr11 5373628 5373647 5373631 -
ctgtcagaaaagcacagtat

SEQ ID NO: 61032 - DNA, 20 bp, Artificial Sequence
  Synthetic oligonucleotide; GGGAGT chr11 5373622 5373641 5373625 -
gaaaagcacagtattcgggt

SEQ ID NO: 61033 - DNA, 20 bp, Artificial Sequence
  Synthetic oligonucleotide; AGGAGT chr11 5373211 5373230 5373214 -
atctctatacatgttcttcc

SEQ ID NO: 61034 - DNA, 20 bp, Artificial Sequence
  Synthetic oligonucleotide; TTGAGT chr11 5373165 5373184 5373168 -
atttatgtctttaatctatt

SEQ ID NO: 61035 - DNA, 20 bp, Artificial Sequence
  Synthetic oligonucleotide; TTGGAT chr11 5373115 5373134 5373118 -
ccaattttattcttttgcat

SEQ ID NO: 61036 - DNA, 20 bp, Artificial Sequence
  Synthetic oligonucleotide; GAGAAT chr11 5373043 5373062 5373046 -
attgtgttggtggccttgtt

SEQ ID NO: 61037 - DNA, 20 bp, Artificial Sequence
  Synthetic oligonucleotide; GGGGGT chr11 5372854 5372873 5372857 -
caagattgttttggccattt

SEQ ID NO: 61038 - DNA, 20 bp, Artificial Sequence
  Synthetic oligonucleotide; AAGGAT chr11 5372586 5372605 5372589 -
aacctaagtaaaaatgggca

SEQ ID NO: 61039 - DNA, 20 bp, Artificial Sequence
  Synthetic oligonucleotide; CTGAAT chr11 5372580 5372599 5372583 -
agtaaaaatgggcaaaggat

SEQ ID NO: 61040 - DNA, 20 bp, Artificial Sequence
  Synthetic oligonucleotide; AGGGGT chr11 5372431 5372450 5372434 -
tatcaaaaaagacaagagat

SEQ ID NO: 61041 - DNA, 20 bp, Artificial Sequence
  Synthetic oligonucleotide; GGGAAT chr11 5372382 5372401 5372385 -
aactcttgtgcatagctggt

SEQ ID NO: 61042 - DNA, 20 bp, Artificial Sequence
  Synthetic oligonucleotide; TAGAGT chr11 5372320 5372339 5372323 -
gtttctcaaacaactaaaaa

SEQ ID NO: 61043 - DNA, 20 bp, Artificial Sequence
  Synthetic oligonucleotide; GGGAAT chr11 5372059 5372078 5372062 -
gccttaaaaaaggagatggg

SEQ ID NO: 61044 - DNA, 20 bp, Artificial Sequence
  Synthetic oligonucleotide; TAGAGT chr11 5372044 5372063 5372047 -
atggggggaatgtataaacc

SEQ ID NO: 61045 - DNA, 20 bp, Artificial Sequence
  Synthetic oligonucleotide; TGGAAT chr11 5371975 5371994 5371978 -
ggcatgatattacttatatg

SEQ ID NO: 61046 - DNA, 20 bp, Artificial Sequence
  Synthetic oligonucleotide; TAGGAT chr11 5371864 5371883 5371867 -
gttataaacttgcagctgta

SEQ ID NO: 61047 - DNA, 20 bp, Artificial Sequence
  Synthetic oligonucleotide; ATGGAT chr11 5371722 5371741 5371725 -
ctatggaaggtgttgtattg

SEQ ID NO: 61048 - DNA, 20 bp, Artificial Sequence
  Synthetic oligonucleotide; TAGGGT chr11 5371576 5371595 5371579 -
atttctgtttcctaattgtt

SEQ ID NO: 61049 - DNA, 20 bp, Artificial Sequence
  Synthetic oligonucleotide; TTGGAT chr11 5371531 5371550 5371534 -
cttaaaacttatgtaaccct

SEQ ID NO: 61050 - DNA, 20 bp, Artificial Sequence
  Synthetic oligonucleotide; CAGGGT chr11 5371457 5371476 5371460 -
atacagctatcactgtctct

SEQ ID NO: 61051 - DNA, 20 bp, Artificial Sequence
  Synthetic oligonucleotide; CAGGGT chr11 5371387 5371406 5371390 -
tatatctccggcctacaact

SEQ ID NO: 61052 - DNA, 20 bp, Artificial Sequence
  Synthetic oligonucleotide; GAGAAT chr11 5371337 5371356 5371340 -
ttaaatgtttatgagccaca

SEQ ID NO: 61053 - DNA, 20 bp, Artificial Sequence
  Synthetic oligonucleotide; GAGAAT chr11 5371331 5371350 5371334 -
gtttatgagccacagagaat

SEQ ID NO: 61054 - DNA, 20 bp, Artificial Sequence
  Synthetic oligonucleotide; TTGAGT chr11 5371295 5371314 5371298 -
atttttttgaacttctgtgt

SEQ ID NO: 61055 - DNA, 20 bp, Artificial Sequence
  Synthetic oligonucleotide; TAGAGT chr11 5371230 5371249 5371233 -
gggaaaggtgctgtgtggct

SEQ ID NO: 61056 - DNA, 20 bp, Artificial Sequence
  Synthetic oligonucleotide; CAGAAT chr11 5371216 5371235 5371219 -
gtggcttagagtataaacat

SEQ ID NO: 61057 - DNA, 20 bp, Artificial Sequence
  Synthetic oligonucleotide; TAGAAT chr11 5371195 5371214 5371198 -
agaatgtgctatggactttc

SEQ ID NO: 61058 - DNA, 20 bp, Artificial Sequence
  Synthetic oligonucleotide; CAGAAT chr11 5371166 5371185 5371169 -
tcagtgcccttgtatatcct

SEQ ID NO: 61059 - DNA, 20 bp, Artificial Sequence
  Synthetic oligonucleotide; GAGAGT chr11 5371155 5371174 5371158 -
gtatatcctcagaatgtgtg

SEQ ID NO: 61060 - DNA, 20 bp, Artificial Sequence
  Synthetic oligonucleotide; AAGGGT chr11 5371086 5371105 5371089 -
tagctagggctagcagaagg

SEQ ID NO: 61061 - DNA, 20 bp, Artificial Sequence
  Synthetic oligonucleotide; TTGGGT chr11 5371025 5371044 5371028 -
tcttggaaaaaccagtccct

SEQ ID NO: 61062 - DNA, 20 bp, Artificial Sequence
  Synthetic oligonucleotide; GAGAAT chr11 5370705 5370724 5370708 -
atacaagcttcataggaaca

SEQ ID NO: 61063 - DNA, 20 bp, Artificial Sequence
  Synthetic oligonucleotide; AAGAGT chr11 5370563 5370582 5370566 -
tattcatttctaaacacaga

SEQ ID NO: 61064 - DNA, 20 bp, Artificial Sequence
  Synthetic oligonucleotide; AAGAAT chr11 5370533 5370552 5370536 -
aagggagaaagacagaaagt

SEQ ID NO: 61065 - DNA, 20 bp, Artificial Sequence
  Synthetic oligonucleotide; GAGAGT chr11 5370519 5370538 5370522 -
gaaagtaagaatgaaagaaa

SEQ ID NO: 61066 - DNA, 20 bp, Artificial Sequence
  Synthetic oligonucleotide; AAGAAT chr11 5370507 5370526 5370510 -
gaaagaaagagagtgagata

SEQ ID NO: 61067 - DNA, 20 bp, Artificial Sequence
  Synthetic oligonucleotide; TTGAAT chr11 5370429 5370448 5370432 -
acaaatgatcctctgaagat

SEQ ID NO: 61068 - DNA, 20 bp, Artificial Sequence
  Synthetic oligonucleotide; TAGGAT chr11 5370237 5370256 5370240 -
aacattcaaaccttcaactt

SEQ ID NO: 61069 - DNA, 20 bp, Artificial Sequence
  Synthetic oligonucleotide; CAGAAT chr11 5369987 5370006 5369990 -
cttgttgatacagattgaca

SEQ ID NO: 61070 - DNA, 20 bp, Artificial Sequence
  Synthetic oligonucleotide; TTGAGT chr11 5369952 5369971 5369955 -
tctttccccactgcctttcc

SEQ ID NO: 61071 - DNA, 20 bp, Artificial Sequence
  Synthetic oligonucleotide; TTGGAT chr11 5369859 5369878 5369862 -
ttaacaactgttgacttatt

SEQ ID NO: 61072 - DNA, 20 bp, Artificial Sequence
  Synthetic oligonucleotide; TTGAGT chr11 5369735 5369754 5369738 -
cagccaataggactatttat

SEQ ID NO: 61073 - DNA, 20 bp, Artificial Sequence
  Synthetic oligonucleotide; GAGGAT chr11 5369648 5369667 5369651 -
aaagggaaattatctccagg

SEQ ID NO: 61074 - DNA, 20 bp, Artificial Sequence
  Synthetic oligonucleotide; AAGGAT chr11 5369634 5369653 5369637 -
tccagggaggatagaaaggt

SEQ ID NO: 61075 - DNA, 20 bp, Artificial Sequence
  Synthetic oligonucleotide; TGGAGT chr11 5369598 5369617 5369601 -
tactttatatttaatataca

SEQ ID NO: 61076 - DNA, 20 bp, Artificial Sequence
  Synthetic oligonucleotide; TAGGAT chr11 5369557 5369576 5369560 -
aattatatcatagacatatt

SEQ ID NO: 61077 - DNA, 20 bp, Artificial Sequence
  Synthetic oligonucleotide; GTGAAT chr11 5369550 5369569 5369553 -
tcatagacatatttaggata

SEQ ID NO: 61078 - DNA, 20 bp, Artificial Sequence
  Synthetic oligonucleotide; TAGAGT chr11 5369436 5369455 5369439 -
tatataaaaagtctgtttca

SEQ ID NO: 61079 - DNA, 20 bp, Artificial Sequence
  Synthetic oligonucleotide; GTGAAT chr11 5369192 5369211 5369195 -
tagggactcaggttatatgt

SEQ ID NO: 61080 - DNA, 20 bp, Artificial Sequence
  Synthetic oligonucleotide; ATGGAT chr11 5369188 5369207 5369191 -
gactcaggttatatgtgtga

SEQ ID NO: 61081 - DNA, 20 bp, Artificial Sequence
  Synthetic oligonucleotide; ATGAAT chr11 5369184 5369203 5369187 -
caggttatatgtgtgaatgg

SEQ ID NO: 61082 - DNA, 20 bp, Artificial Sequence
  Synthetic oligonucleotide; ATGAAT chr11 5369176 5369195 5369179 -
atgtgtgaatggatgaataa

SEQ ID NO: 61083 - DNA, 20 bp, Artificial Sequence
  Synthetic oligonucleotide; ATGAAT chr11 5369172 5369191 5369175 -
gtgaatggatgaataaatga

SEQ ID NO: 61084 - DNA, 20 bp, Artificial Sequence
  Synthetic oligonucleotide; GTGAAT chr11 5369046 5369065 5369049 -
cttcaaaggcactcatcttg

SEQ ID NO: 61085 - DNA, 20 bp, Artificial Sequence
  Synthetic oligonucleotide; ATGAAT chr11 5369042 5369061 5369045 -
aaaggcactcatcttggtga

SEQ ID NO: 61086 - DNA, 20 bp, Artificial Sequence
  Synthetic oligonucleotide; TTGGGT chr11 5368966 5368985 5368969 -
tgacacacaatttaggcttc

SEQ ID NO: 61087 - DNA, 20 bp, Artificial Sequence
  Synthetic oligonucleotide; AAGAAT chr11 5368869 5368888 5368872 -
aaacctctcttaatccacat

SEQ ID NO: 61088 - DNA, 20 bp, Artificial Sequence
  Synthetic oligonucleotide; TTGAGT chr11 5368738 5368757 5368741 -
cagttttaaagcataatatt

SEQ ID NO: 61089 - DNA, 20 bp, Artificial Sequence
  Synthetic oligonucleotide; CAGGAT chr11 5368657 5368676 5368660 -
tactatgctctgctttctca

SEQ ID NO: 61090 - DNA, 20 bp, Artificial Sequence
  Synthetic oligonucleotide; GAGAAT chr11 5368645 5368664 5368648 -
ctttctcacaggatgcatgt

SEQ ID NO: 61091 - DNA, 20 bp, Artificial Sequence
  Synthetic oligonucleotide; TAGAAT chr11 5368619 5368638 5368622 -
aaaacacaaagtctttatgt

SEQ ID NO: 61092 - DNA, 20 bp, Artificial Sequence
  Synthetic oligonucleotide; CAGAGT chr11 5368539 5368558 5368542 -
ttttctttgtcagagctaga

SEQ ID NO: 61093 - DNA, 20 bp, Artificial Sequence
  Synthetic oligonucleotide; GTGGGT chr11 5368373 5368392 5368376 -
cattaaaataattcaaccat

SEQ ID NO: 61094 - DNA, 20 bp, Artificial Sequence
  Synthetic oligonucleotide; ATGAGT chr11 5368344 5368363 5368347 -
attggtatccccacttaaag

SEQ ID NO: 61095 - DNA, 20 bp, Artificial Sequence
  Synthetic oligonucleotide; TAGGGT chr11 5368304 5368323 5368307 -
aaagataaattgctttgcta

SEQ ID NO: 61096 - DNA, 20 bp, Artificial Sequence
  Synthetic oligonucleotide; TGGGAT chr11 5368277 5368296 5368280 -
cgcagccaataagtggaagg

SEQ ID NO: 61097 - DNA, 20 bp, Artificial Sequence
  Synthetic oligonucleotide; CAGGAT chr11 5368177 5368196 5368180 -
gaagcctacagaacacttaa

SEQ ID NO: 61098 - DNA, 20 bp, Artificial Sequence
  Synthetic oligonucleotide; CTGAAT chr11 5368123 5368142 5368126 -
tggttgaagatgcaacaaat

SEQ ID NO: 61099 - DNA, 20 bp, Artificial Sequence
  Synthetic oligonucleotide; GAGAGT chr11 5368095 5368114 5368098 -
cagaggaaaaaacaaagaaa

SEQ ID NO: 61100 - DNA, 20 bp, Artificial Sequence
  Synthetic oligonucleotide; CTGAGT chr11 5368088 5368107 5368091 -
aaaaacaaagaaagagagtt

SEQ ID NO: 61101 - DNA, 20 bp, Artificial Sequence
  Synthetic oligonucleotide; CTGGGT chr11 5368078 5368097 5368081 -
aaagagagttctgagtgagc

SEQ ID NO: 61102 - DNA, 20 bp, Artificial Sequence
  Synthetic oligonucleotide; TTGGGT chr11 5368043 5368062 5368046 -
agcaaagaaccaagtgaagc

SEQ ID NO: 61103 - DNA, 20 bp, Artificial Sequence
  Synthetic oligonucleotide; TGGGGT chr11 5368031 5368050 5368034 -
agtgaagcttgggttagttg

SEQ ID NO: 61104 - DNA, 20 bp, Artificial Sequence
  Synthetic oligonucleotide; AAGAAT chr11 5367972 5367991 5367975 -
ctggtagaagtgaaactttg

SEQ ID NO: 61105 - DNA, 20 bp, Artificial Sequence
  Synthetic oligonucleotide; CTGAGT chr11 5367946 5367965 5367949 -
gtctgattcctcacaaactg

SEQ ID NO: 61106 - DNA, 20 bp, Artificial Sequence
  Synthetic oligonucleotide; AAGGAT chr11 5367940 5367959 5367943 -
ttcctcacaaactgctgagt

SEQ ID NO: 61107 - DNA, 20 bp, Artificial Sequence
  Synthetic oligonucleotide; TTGAAT chr11 5367846 5367865 5367849 -
aagtgaaaaaaaatacattt

SEQ ID NO: 61108 - DNA, 20 bp, Artificial Sequence
  Synthetic oligonucleotide; CTGGGT chr11 5367814 5367833 5367817 -
attgtgcaagtgcctctatt

SEQ ID NO: 61109 - DNA, 20 bp, Artificial Sequence
  Synthetic oligonucleotide; CTGGGT chr11 5367730 5367749 5367733 -
aactccatcttaaataggag

SEQ ID NO: 61110 - DNA, 20 bp, Artificial Sequence
  Synthetic oligonucleotide; CAGGAT chr11 5367667 5367686 5367670 -
aagttaggcattctcagtca

SEQ ID NO: 61111 - DNA, 20 bp, Artificial Sequence
  Synthetic oligonucleotide; GAGAGT chr11 5367560 5367579 5367563 -
caccaaaccaagattgtgat

SEQ ID NO: 61112 - DNA, 20 bp, Artificial Sequence
  Synthetic oligonucleotide; ATGAAT chr11 5367449 5367468 5367452 -
gcggtctgaaaaggggaggc

SEQ ID NO: 61113 - DNA, 20 bp, Artificial Sequence
  Synthetic oligonucleotide; TAGGGT chr11 5367363 5367382 5367366 -
cctcaggactgttctgccta

SEQ ID NO: 61114 - DNA, 20 bp, Artificial Sequence
  Synthetic oligonucleotide; ATGGAT chr11 5367304 5367323 5367307 -
acttgctttcacttttctgt

SEQ ID NO: 61115 - DNA, 20 bp, Artificial Sequence
  Synthetic oligonucleotide; TAGGGT chr11 5367253 5367272 5367256 -
gaaatccaagaaccctctct

SEQ ID NO: 61116 - DNA, 20 bp, Artificial Sequence
  Synthetic oligonucleotide; CTGGAT chr11 5367247 5367266 5367250 -
caagaaccctctcttagggt

SEQ ID NO: 61117 - DNA, 20 bp, Artificial Sequence
  Synthetic oligonucleotide; GAGAAT chr11 5367069 5367088 5367072 -
accacattcctgagacttga

SEQ ID NO: 61118 - DNA, 20 bp, Artificial Sequence
  Synthetic oligonucleotide; GAGAAT chr11 5367043 5367062 5367046 -
gtctttggtctctgctgcta

SEQ ID NO: 61119 - DNA, 20 bp, Artificial Sequence
  Synthetic oligonucleotide; GGGAAT chr11 5366981 5367000 5366984 -
gcattttcaaactttgggag

SEQ ID NO: 61120 - DNA, 20 bp, Artificial Sequence
  Synthetic oligonucleotide; ATGAAT chr11 5366897 5366916 5366900 -
aactttgtgcctgttgtctc

SEQ ID NO: 61121 - DNA, 20 bp, Artificial Sequence
  Synthetic oligonucleotide; TGGGAT chr11 5366835 5366854 5366838 -
attgcacagagacccgtgct

SEQ ID NO: 61122 - DNA, 20 bp, Artificial Sequence
  Synthetic oligonucleotide; TGGAAT chr11 5366829 5366848 5366832 -
cagagacccgtgcttgggat

SEQ ID NO: 61123 - DNA, 20 bp, Artificial Sequence
  Synthetic oligonucleotide; TTGAAT chr11 5366770 5366789 5366773 -
taatttttattctaaagact

SEQ ID NO: 61124 - DNA, 20 bp, Artificial Sequence
  Synthetic oligonucleotide; GTGAAT chr11 5366759 5366778 5366762 -
ctaaagactttgaatctcaa

SEQ ID NO: 61125 - DNA, 20 bp, Artificial Sequence
  Synthetic oligonucleotide; TGGAGT chr11 5366580 5366599 5366583 -
gcttttgccttccaggctgc

SEQ ID NO: 61126 - DNA, 20 bp, Artificial Sequence
  Synthetic oligonucleotide; CAGGGT chr11 5366437 5366456 5366440 -
ttttgtatttttattagaga

SEQ ID NO: 61127 - DNA, 20 bp, Artificial Sequence
  Synthetic oligonucleotide; TGGGAT chr11 5366358 5366377 5366361 -
gcctcagccacccaaagtgc

SEQ ID NO: 61128 - DNA, 20 bp, Artificial Sequence
  Synthetic oligonucleotide; ATGAGT chr11 5366345 5366364 5366348 -
aaagtgctgggattacaggc

SEQ ID NO: 61129 - DNA, 20 bp, Artificial Sequence
  Synthetic oligonucleotide; CTGGGT chr11 5366134 5366153 5366137 -
actgtttcttattttgccca

SEQ ID NO: 61130 - DNA, 20 bp, Artificial Sequence
  Synthetic oligonucleotide; TAGGGT chr11 5366032 5366051 5366035 -
ctgattacctggctgctcca

SEQ ID NO: 61131 - DNA, 20 bp, Artificial Sequence
  Synthetic oligonucleotide; CAGAGT chr11 5365885 5365904 5365888 -
ttcagaacccaagaggtaag

SEQ ID NO: 61132 - DNA, 20 bp, Artificial Sequence
  Synthetic oligonucleotide; AAGAAT chr11 5365873 5365892 5365876 -
gaggtaagcagagttcctct

SEQ ID NO: 61133 - DNA, 20 bp, Artificial Sequence
  Synthetic oligonucleotide; GTGGGT chr11 5365797 5365816 5365800 -
tctataatgtgctagacaat

SEQ ID NO: 61134 - DNA, 20 bp, Artificial Sequence
  Synthetic oligonucleotide; CTGGAT chr11 5365777 5365796 5365780 -
gtgggtaatggaggtgatgc

SEQ ID NO: 61135 - DNA, 20 bp, Artificial Sequence
  Synthetic oligonucleotide; TTGGGT chr11 5365702 5365721 5365705 -
gacaatttaaatgtatcagt

SEQ ID NO: 61136 - DNA, 20 bp, Artificial Sequence
  Synthetic oligonucleotide; TTGAAT chr11 5365697 5365716 5365700 -
tttaaatgtatcagtttggg

SEQ ID NO: 61137 - DNA, 20 bp, Artificial Sequence
  Synthetic oligonucleotide; AGGGAT chr11 5365685 5365704 5365688 -
agtttgggttgaataaaatc

SEQ ID NO: 61138 - DNA, 20 bp, Artificial Sequence
  Synthetic oligonucleotide; CAGAAT chr11 5365475 5365494 5365478 -
atggttgctgactggcagac

SEQ ID NO: 61139 - DNA, 20 bp, Artificial Sequence
  Synthetic oligonucleotide; TTGGGT chr11 5365470 5365489 5365473 -
tgctgactggcagaccagaa

SEQ ID NO: 61140 - DNA, 20 bp, Artificial Sequence
  Synthetic oligonucleotide; TGGAGT chr11 5365234 5365253 5365237 -
tggttcactagatgtttcca

SEQ ID NO: 61141 - DNA, 20 bp, Artificial Sequence
  Synthetic oligonucleotide; TTGAAT chr11 5365113 5365132 5365116 -
cagttgtgataagctaccac

SEQ ID NO: 61142 - DNA, 20 bp, Artificial Sequence
  Synthetic oligonucleotide; TTGAGT chr11 5365065 5365084 5365068 -
tattgacacatttggtttta

SEQ ID NO: 61143 - DNA, 20 bp, Artificial Sequence
  Synthetic oligonucleotide; AAGAAT chr11 5365026 5365045 5365029 -
ccaagattcattgctgtgac

SEQ ID NO: 61144 - DNA, 20 bp, Artificial Sequence
  Synthetic oligonucleotide; GAGGGT chr11 5364780 5364799 5364783 -
aacacatgctcaggaaggaa

SEQ ID NO: 61145 - DNA, 20 bp, Artificial Sequence
  Synthetic oligonucleotide; AAGAGT chr11 5364733 5364752 5364736 -
gactttgatcattcactttg

SEQ ID NO: 61146 - DNA, 20 bp, Artificial Sequence
  Synthetic oligonucleotide; CTGGAT chr11 5364714 5364733 5364717 -
gaagagtcttctgtcatatg

SEQ ID NO: 61147 - DNA, 20 bp, Artificial Sequence
  Synthetic oligonucleotide; TAGAGT chr11 5364683 5364702 5364686 -
aacagcttagagggctgcct

SEQ ID NO: 61148 - DNA, 20 bp, Artificial Sequence
  Synthetic oligonucleotide; GAGGAT chr11 5364645 5364664 5364648 -
agatattcagagatgcacat

SEQ ID NO: 61149 - DNA, 20 bp, Artificial Sequence
  Synthetic oligonucleotide; TGGAGT chr11 5364640 5364659 5364643 -
ttcagagatgcacatgagga

SEQ ID NO: 61150 - DNA, 20 bp, Artificial Sequence
  Synthetic oligonucleotide; CAGAAT chr11 5364572 5364591 5364575 -
gtttattttttcatttaata

SEQ ID NO: 61151 - DNA, 20 bp, Artificial Sequence
  Synthetic oligonucleotide; TTGAAT chr11 5364513 5364532 5364516 -
tgcttaaagctggcatgtag

SEQ ID NO: 61152 - DNA, 20 bp, Artificial Sequence
  Synthetic oligonucleotide; GAGAAT chr11 5364479 5364498 5364482 -
cagcaaggagactgaccatt

SEQ ID NO: 61153 - DNA, 20 bp, Artificial Sequence
  Synthetic oligonucleotide; AGGAAT chr11 5364461 5364480 5364464 -
ttgagaattacaaatatggc

SEQ ID NO: 61154 - DNA, 20 bp, Artificial Sequence
  Synthetic oligonucleotide; TTGAAT chr11 5364107 5364126 5364110 -
ttgagatacctcttccttta

SEQ ID NO: 61155 - DNA, 20 bp, Artificial Sequence
  Synthetic oligonucleotide; GAGAAT chr11 5364075 5364094 5364078 -
tcgaccttattgcaaccatg

SEQ ID NO: 61156 - DNA, 20 bp, Artificial Sequence
  Synthetic oligonucleotide; GTGGGT chr11 5364030 5364049 5364033 -
aggtccacatcacataatat

SEQ ID NO: 61157 - DNA, 20 bp, Artificial Sequence
  Synthetic oligonucleotide; GTGAAT chr11 5364026 5364045 5364029 -
ccacatcacataatatgtgg

SEQ ID NO: 61158 - DNA, 20 bp, Artificial Sequence
  Synthetic oligonucleotide; ATGGGT chr11 5363937 5363956 5363940 -
gcttctcctcctttacagaa

SEQ ID NO: 61159 - DNA, 20 bp, Artificial Sequence
  Synthetic oligonucleotide; CTGAGT chr11 5363931 5363950 5363934 -
cctcctttacagaaatgggt

SEQ ID NO: 61160 - DNA, 20 bp, Artificial Sequence
  Synthetic oligonucleotide; CTGAGT chr11 5363897 5363916 5363900 -
tttatacctgccatgtcatg

SEQ ID NO: 61161 - DNA, 20 bp, Artificial Sequence
  Synthetic oligonucleotide; TGGGGT chr11 5363885 5363904 5363888 -
atgtcatgctgagtgggggc

SEQ ID NO: 61162 - DNA, 20 bp, Artificial Sequence
  Synthetic oligonucleotide; CTGGAT chr11 5363807 5363826 5363810 -
tattgtacactaaatatagt

SEQ ID NO: 61163 - DNA, 20 bp, Artificial Sequence
  Synthetic oligonucleotide; TAGAAT chr11 5363774 5363793 5363777 -
atatggtccctagtttttaa

SEQ ID NO: 61164 - DNA, 20 bp, Artificial Sequence
  Synthetic oligonucleotide; CAGAAT chr11 5363733 5363752 5363736 -
actttcccgctttccaataa

SEQ ID NO: 61165 - DNA, 20 bp, Artificial Sequence
  Synthetic oligonucleotide; CAGAGT chr11 5363680 5363699 5363683 -
acaagcaaatggccaaatgg

SEQ ID NO: 61166 - DNA, 20 bp, Artificial Sequence
  Synthetic oligonucleotide; GTGAGT chr11 5363538 5363557 5363541 -
tgcttggtttaataaaagta

SEQ ID NO: 61167 - DNA, 20 bp, Artificial Sequence
  Synthetic oligonucleotide; CTGAGT chr11 5363519 5363538 5363522 -
agtgagtgtacctcatggag

SEQ ID NO: 61168 - DNA, 20 bp, Artificial Sequence
  Synthetic oligonucleotide; GAGAGT chr11 5363463 5363482 5363466 -
tggcgcttttgtgtgagaga

SEQ ID NO: 61169 - DNA, 20 bp, Artificial Sequence
  Synthetic oligonucleotide; TAGGAT chr11 5363402 5363421 5363405 -
aggaacaattaattggtgat

SEQ ID NO: 61170 - DNA, 20 bp, Artificial Sequence
  Synthetic oligonucleotide; AGGGGT chr11 5363238 5363257 5363241 -
tgtgtgtgtgtgtgtgtgtg

SEQ ID NO: 61171 - DNA, 20 bp, Artificial Sequence
  Synthetic oligonucleotide; TTGGGT chr11 5363233 5363252 5363236 -
gtgtgtgtgtgtgtgagggg

SEQ ID NO: 61172 - DNA, 20 bp, Artificial Sequence
  Synthetic oligonucleotide; TTGAGT chr11 5363150 5363169 5363153 -
atcattctgttcgtaaaact

SEQ ID NO: 61173 - DNA, 20 bp, Artificial Sequence
  Synthetic oligonucleotide; CAGGGT chr11 5363132 5363151 5363135 -
ctttgagttttgaagacact

SEQ ID NO: 61174 - DNA, 20 bp, Artificial Sequence
  Synthetic oligonucleotide; AGGAAT chr11 5363096 5363115 5363099 -
ccttaagctttctctcatgg

SEQ ID NO: 61175 - DNA, 20 bp, Artificial Sequence
  Synthetic oligonucleotide; AGGGAT chr11 5362890 5362909 5362893 -
aaaacttaatttacaaaagc

SEQ ID NO: 61176 - DNA, 20 bp, Artificial Sequence
  Synthetic oligonucleotide; AAGAGT chr11 5362798 5362817 5362801 -
agaggacttcaaagcccatg

SEQ ID NO: 61177 - DNA, 20 bp, Artificial Sequence
  Synthetic oligonucleotide; CTGGGT chr11 5362661 5362680 5362664 -
aatcagatgggggaagacag

SEQ ID NO: 61178 - DNA, 20 bp, Artificial Sequence
  Synthetic oligonucleotide; CTGAAT chr11 5362339 5362358 5362342 -
cttcgtagttgattatggct

SEQ ID NO: 61179 - DNA, 20 bp, Artificial Sequence
  Synthetic oligonucleotide; CTGGGT chr11 5362298 5362317 5362301 -
gcatccagcaccattttcat

SEQ ID NO: 61180 - DNA, 20 bp, Artificial Sequence
  Synthetic oligonucleotide; CGGGAT chr11 5362226 5362245 5362229 -
cccatcccccgacagaaaca

SEQ ID NO: 61181 - DNA, 20 bp, Artificial Sequence
  Synthetic oligonucleotide; CTGGGT chr11 5362203 5362222 5362206 -
gatccactatcactctctat

SEQ ID NO: 61182 - DNA, 20 bp, Artificial Sequence
  Synthetic oligonucleotide; TGGAAT chr11 5362155 5362174 5362158 -
gcagtgctgatagctcagca

SEQ ID NO: 61183 - DNA, 20 bp, Artificial Sequence
  Synthetic oligonucleotide; AAGGAT chr11 5362112 5362131 5362115 -
tctctctgactttggtttat

SEQ ID NO: 61184 - DNA, 20 bp, Artificial Sequence
  Synthetic oligonucleotide; ATGGAT chr11 5362090 5362109 5362093 -
ggatttgcatacattttctg

SEQ ID NO: 61185 - DNA, 20 bp, Artificial Sequence
  Synthetic oligonucleotide; GGGAAT chr11 5362069 5362088 5362072 -
tggatactaggctcatttct

SEQ ID NO: 61186 - DNA, 20 bp, Artificial Sequence
  Synthetic oligonucleotide; GGGAGT chr11 5361918 5361937 5361921 -
actctaacttcatctttttt

SEQ ID NO: 61187 - DNA, 20 bp, Artificial Sequence
  Synthetic oligonucleotide; CAGAGT chr11 5361826 5361845 5361829 -
aggaaatagataatccaaac

SEQ ID NO: 61188 - DNA, 20 bp, Artificial Sequence
  Synthetic oligonucleotide; GTGGAT chr11 5361785 5361804 5361788 -
agatatcattctgtattccc

SEQ ID NO: 61189 - DNA, 20 bp, Artificial Sequence
  Synthetic oligonucleotide; GGGAAT chr11 5361741 5361760 5361744 -
ctaactagatcactctgcta

SEQ ID NO: 61190 - DNA, 20 bp, Artificial Sequence
  Synthetic oligonucleotide; TAGGAT chr11 5361722 5361741 5361725 -
agggaatgaaaaaggagatc

SEQ ID NO: 61191 - DNA, 20 bp, Artificial Sequence
  Synthetic oligonucleotide; AGGAAT chr11 5361704 5361723 5361707 -
tctaggattttccctcttct

SEQ ID NO: 61192 - DNA, 20 bp, Artificial Sequence
  Synthetic oligonucleotide; GGGAGT chr11 5361656 5361675 5361659 -
gccaagttctaaagatttta

SEQ ID NO: 61193 - DNA, 20 bp, Artificial Sequence
  Synthetic oligonucleotide; TGGGAT chr11 5361647 5361666 5361650 -
taaagattttagggagtctt

SEQ ID NO: 61194 - DNA, 20 bp, Artificial Sequence
  Synthetic oligonucleotide; TGGAGT chr11 5361519 5361538 5361522 -
gcctctaggccaagacacac

SEQ ID NO: 61195 - DNA, 20 bp, Artificial Sequence
  Synthetic oligonucleotide; TTGGAT chr11 5361437 5361456 5361440 -
ccctaagcctggtcaagata

SEQ ID NO: 61196 - DNA, 20 bp, Artificial Sequence
  Synthetic oligonucleotide; AGGGAT chr11 5361314 5361333 5361317 -
ttctttattctcccagcctg

SEQ ID NO: 61197 - DNA, 20 bp, Artificial Sequence
  Synthetic oligonucleotide; AGGAGT chr11 5361293 5361312 5361296 -
gggatttagaactttggaac

SEQ ID NO: 61198 - DNA, 20 bp, Artificial Sequence
  Synthetic oligonucleotide; GGGAAT chr11 5361258 5361277 5361261 -
ttcttcctgcatctaggtta

SEQ ID NO: 61199 - DNA, 20 bp, Artificial Sequence
  Synthetic oligonucleotide; AGGGGT chr11 5361210 5361229 5361213 -
atttattttaagcatcacat

SEQ ID NO: 61200 - DNA, 20 bp, Artificial Sequence
  Synthetic oligonucleotide; GAGGAT chr11 5361187 5361206 5361190 -
ggtagaaaagaaaatgtagg

SEQ ID NO: 61201 - DNA, 20 bp, Artificial Sequence
  Synthetic oligonucleotide; TAGGGT chr11 5361125 5361144 5361128 -
tattattatactttaagttt

SEQ ID NO: 61202 - DNA, 20 bp, Artificial Sequence
  Synthetic oligonucleotide; ATGAGT chr11 5360923 5360942 5360926 -
tcattgttcaattcccacct

SEQ ID NO: 61203 - DNA, 20 bp, Artificial Sequence
  Synthetic oligonucleotide; GAGAAT chr11 5360874 5360893 5360877 -
tgtccttgcgatagtttgct

SEQ ID NO: 61204 - DNA, 20 bp, Artificial Sequence
  Synthetic oligonucleotide; TTGGGT chr11 5360744 5360763 5360747 -
agtctatcattgttggacat

SEQ ID NO: 61205 - DNA, 20 bp, Artificial Sequence
  Synthetic oligonucleotide; GTGAAT chr11 5360717 5360736 5360720 -
ggttccaagtctttgctatt

SEQ ID NO: 61206 - DNA, 20 bp, Artificial Sequence
  Synthetic oligonucleotide; TTGAGT chr11 5360653 5360672 5360656 -
gcagcatgatttataatcct

SEQ ID NO: 61207 - DNA, 20 bp, Artificial Sequence
  Synthetic oligonucleotide; TGGGAT chr11 5360634 5360653 5360637 -
tttgagtatgtacccagtaa

SEQ ID NO: 61208 - DNA, 20 bp, Artificial Sequence
  Synthetic oligonucleotide; CTGGGT chr11 5360626 5360645 5360629 -
tgtacccagtaatgggatgg

SEQ ID NO: 61209 - DNA, 20 bp, Artificial Sequence
  Synthetic oligonucleotide; AGGAAT chr11 5360591 5360610 5360594 -
tttctagttctagatccctg

SEQ ID NO: 61210 - DNA, 20 bp, Artificial Sequence
  Synthetic oligonucleotide; TGGGGT chr11 5360314 5360333 5360317 -
atcctttgcccactttttga

SEQ ID NO: 61211 - DNA, 20 bp, Artificial Sequence
  Synthetic oligonucleotide; TTGAGT chr11 5360286 5360305 5360289 -
tttttttcttgtaaatttgt

SEQ ID NO: 61212 - DNA, 20 bp, Artificial Sequence
  Synthetic oligonucleotide; CTGGAT chr11 5360268 5360287 5360271 -
gtttgagttcatcatagatt

SEQ ID NO: 61213 - DNA, 20 bp, Artificial Sequence
  Synthetic oligonucleotide; TCGGAT chr11 5360250 5360269 5360253 -
ttctggatattagccctttg

SEQ ID NO: 61214 - DNA, 20 bp, Artificial Sequence
  Synthetic oligonucleotide; ATGAGT chr11 5360246 5360265 5360249 -
ggatattagccctttgtcgg

SEQ ID NO: 61215 - DNA, 20 bp, Artificial Sequence
  Synthetic oligonucleotide; CTGAAT chr11 5360071 5360090 5360074 -
tccttgcccatgcctatgtc

SEQ ID NO: 61216 - DNA, 20 bp, Artificial Sequence
  Synthetic oligonucleotide; CAGAGT chr11 5360044 5360063 5360047 -
gtattgcctaggttttcttc

SEQ ID NO: 61217 - DNA, 20 bp, Artificial Sequence
  Synthetic oligonucleotide; TTGAAT chr11 5359997 5360016 5360000 -
atttaagtctgtaatccatc

SEQ ID NO: 61218 - DNA, 20 bp, Artificial Sequence
  Synthetic oligonucleotide; AGGGAT chr11 5359967 5359986 5359970 -
ttttgtataaggtgtaagaa

SEQ ID NO: 61219 - DNA, 20 bp, Artificial Sequence
  Synthetic oligonucleotide; GGGAAT chr11 5359904 5359923 5359907 -
ccagcaccatttattaaata

SEQ ID NO: 61220 - DNA, 20 bp, Artificial Sequence
  Synthetic oligonucleotide; TAGGAT chr11 5359696 5359715 5359699 -
ccagctttgttcttttggct

SEQ ID NO: 61221 - DNA, 20 bp, Artificial Sequence
  Synthetic oligonucleotide; GGGGAT chr11 5359600 5359619 5359603 -
aaagtcattggtagcttgat

SEQ ID NO: 61222 - DNA, 20 bp, Artificial Sequence
  Synthetic oligonucleotide; TTGAAT chr11 5359590 5359609 5359593 -
gtagcttgatggggatggca

SEQ ID NO: 61223 - DNA, 20 bp, Artificial Sequence
  Synthetic oligonucleotide; TGGAAT chr11 5359522 5359541 5359525 -
attcttcctacccatgagca

SEQ ID NO: 61224 - DNA, 20 bp, Artificial Sequence
  Synthetic oligonucleotide; TTGGAT chr11 5359429 5359448 5359432 -
tccttcacctctcttgtaag

SEQ ID NO: 61225 - DNA, 20 bp, Artificial Sequence
  Synthetic oligonucleotide; GTGAAT chr11 5359392 5359411 5359395 -
ttattctctttgaagcaatt

SEQ ID NO: 61226 - DNA, 20 bp, Artificial Sequence
  Synthetic oligonucleotide; GGGAGT chr11 5359386 5359405 5359389 -
tctttgaagcaattgtgaat

SEQ ID NO: 61227 - DNA, 20 bp, Artificial Sequence
  Synthetic oligonucleotide; AAGAAT chr11 5359338 5359357 5359341 -
tttgtctgttattggtgtat

SEQ ID NO: 61228 - DNA, 20 bp, Artificial Sequence
  Synthetic oligonucleotide; TGGGGT chr11 5359247 5359266 5359250 -
gacattttgggctgagacag

SEQ ID NO: 61229 - DNA, 20 bp, Artificial Sequence
  Synthetic oligonucleotide; TTGAAT chr11 5359180 5359199 5359183 -
ttgacttcctcttttcctaa

SEQ ID NO: 61230 - DNA, 20 bp, Artificial Sequence
  Synthetic oligonucleotide; TTGAAT chr11 5359120 5359139 5359123 -
ccagaaattccaacactatg

SEQ ID NO: 61231 - DNA, 20 bp, Artificial Sequence
  Synthetic oligonucleotide; AGGAGT chr11 5359114 5359133 5359117 -
attccaacactatgttgaat

SEQ ID NO: 61232 - DNA, 20 bp, Artificial Sequence
  Synthetic oligonucleotide; GGGAAT chr11 5359069 5359088 5359072 -
gtcttgtgccagttttcaaa

SEQ ID NO: 61233 - DNA, 20 bp, Artificial Sequence
  Synthetic oligonucleotide; GTGGGT chr11 5359027 5359046 5359030 -
cattcagtatgatattggct

SEQ ID NO: 61234 - DNA, 20 bp, Artificial Sequence
  Synthetic oligonucleotide; GAGAGT chr11 5358965 5358984 5358968 -
ccatcaatacctaatttatt

SEQ ID NO: 61235 - DNA, 20 bp, Artificial Sequence
  Synthetic oligonucleotide; AAGGGT chr11 5358949 5358968 5358952 -
tattgagagtttttagcatg

SEQ ID NO: 61236 - DNA, 20 bp, Artificial Sequence
  Synthetic oligonucleotide; TTGAAT chr11 5358941 5358960 5358944 -
gtttttagcatgaagggttg

SEQ ID NO: 61237 - DNA, 20 bp, Artificial Sequence
  Synthetic oligonucleotide; CTGGAT chr11 5358866 5358885 5358869 -
tctttggttctgtttatatg

SEQ ID NO: 61238 - DNA, 20 bp, Artificial Sequence
  Synthetic oligonucleotide; AGGGAT chr11 5358818 5358837 5358821 -
ttgaaccagccttgcatccc

SEQ ID NO: 61239 - DNA, 20 bp, Artificial Sequence
  Synthetic oligonucleotide; GTGGAT chr11 5358794 5358813 5358797 -
atgaagcccacttgatcatg

SEQ ID NO: 61240 - DNA, 20 bp, Artificial Sequence
  Synthetic oligonucleotide; TTGGAT chr11 5358782 5358801 5358785 -
tgatcatggtggataagctt

SEQ ID NO: 61241 - DNA, 20 bp, Artificial Sequence
  Synthetic oligonucleotide; CTGGAT chr11 5358770 5358789 5358773 -
ataagcttttggatgtgctg

SEQ ID NO: 61242 - DNA, 20 bp, Artificial Sequence
  Synthetic oligonucleotide; AGGGAT chr11 5358718 5358737 5358721 -
tttttgcatcgatgtccatc

SEQ ID NO: 61243 - DNA, 20 bp, Artificial Sequence
  Synthetic oligonucleotide; CAGGAT chr11 5358662 5358681 5358665 -
tctctgcccggctttggtat

SEQ ID NO: 61244 - DNA, 20 bp, Artificial Sequence
  Synthetic oligonucleotide; ATGAGT chr11 5358639 5358658 5358642 -
gatgatgctggcctcataaa

SEQ ID NO: 61245 - DNA, 20 bp, Artificial Sequence
  Synthetic oligonucleotide; GAGGAT chr11 5358629 5358648 5358632 -
gcctcataaaatgagttagg

SEQ ID NO: 61246 - DNA, 20 bp, Artificial Sequence
  Synthetic oligonucleotide; TCGAAT chr11 5358604 5358623 5358607 -
ttccctcttttactattgat

SEQ ID NO: 61247 - DNA, 20 bp, Artificial Sequence
  Synthetic oligonucleotide; GGGAAT chr11 5358589 5358608 5358592 -
ttgattcgaatagtttcaga

SEQ ID NO: 61248 - DNA, 20 bp, Artificial Sequence
  Synthetic oligonucleotide; TAGAAT chr11 5358556 5358575 5358559 -
gctcctccttgtacctctgg

SEQ ID NO: 61249 - DNA, 20 bp, Artificial Sequence
  Synthetic oligonucleotide; GAGGGT chr11 5358428 5358447 5358431 -
tcttcctggtttagtcttgg

SEQ ID NO: 61250 - DNA, 20 bp, Artificial Sequence
  Synthetic oligonucleotide; AGGAAT chr11 5358412 5358431 5358415 -
ttgggagggtgtatgtgtca

SEQ ID NO: 61251 - DNA, 20 bp, Artificial Sequence
  Synthetic oligonucleotide; TGGGAT chr11 5358327 5358346 5358330 -
gatggtggtttgtatttctg

SEQ ID NO: 61252 - DNA, 20 bp, Artificial Sequence
  Synthetic oligonucleotide; CTGGAT chr11 5358202 5358221 5358205 -
tctttttgaaaaaccagctt

SEQ ID NO: 61253 - DNA, 20 bp, Artificial Sequence
  Synthetic oligonucleotide; AAGGGT chr11 5358182 5358201 5358185 -
ctggattcattgattttttg

SEQ ID NO: 61254 - DNA, 20 bp, Artificial Sequence
  Synthetic oligonucleotide; TTGAAT chr11 5358110 5358129 5358113 -
ttcttgccttctgctagcat

SEQ ID NO: 61255 - DNA, 20 bp, Artificial Sequence
  Synthetic oligonucleotide; TAGGGT chr11 5358064 5358083 5358067 -
agttcttttaattgtgatgt

SEQ ID NO: 61256 - DNA, 20 bp, Artificial Sequence
  Synthetic oligonucleotide; TTGAAT chr11 5357988 5358007 5357991 -
atttccctctacacactgct

SEQ ID NO: 61257 - DNA, 20 bp, Artificial Sequence
  Synthetic oligonucleotide; TTGAGT chr11 5357845 5357864 5357848 -
ttccatgtagttgagcggtt

SEQ ID NO: 61258 - DNA, 20 bp, Artificial Sequence
  Synthetic oligonucleotide; GTGAGT chr11 5357841 5357860 5357844 -
atgtagttgagcggttttga

SEQ ID NO: 61259 - DNA, 20 bp, Artificial Sequence
  Synthetic oligonucleotide; CTGAGT chr11 5357826 5357845 5357829 -
tttgagtgagtttcttaatc

SEQ ID NO: 61260 - DNA, 20 bp, Artificial Sequence
  Synthetic oligonucleotide; AGGAGT chr11 5357754 5357773 5357757 -
ctgttcttttacatttgctg

SEQ ID NO: 61261 - DNA, 20 bp, Artificial Sequence
  Synthetic oligonucleotide; TGGAAT chr11 5357720 5357739 5357723 -
tccaactatgtggtcaattt

SEQ ID NO: 61262 - DNA, 20 bp, Artificial Sequence
  Synthetic oligonucleotide; AAGAAT chr11 5357694 5357713 5357697 -
aggtgtggtgtggtgctgaa

SEQ ID NO: 61263 - DNA, 20 bp, Artificial Sequence
  Synthetic oligonucleotide; TGGGGT chr11 5357672 5357691 5357675 -
gaatgtatattctgttgatt

SEQ ID NO: 61264 - DNA, 20 bp, Artificial Sequence
  Synthetic oligonucleotide; GAGAGT chr11 5357665 5357684 5357668 -
tattctgttgatttggggtg

SEQ ID NO: 61265 - DNA, 20 bp, Artificial Sequence
  Synthetic oligonucleotide; CTGAGT chr11 5357624 5357643 5357627 -
taggtccgcttggtgcagag

SEQ ID NO: 61266 - DNA, 20 bp, Artificial Sequence
  Synthetic oligonucleotide; CTGGAT chr11 5357611 5357630 5357614 -
tgcagagctgagttcaattc

SEQ ID NO: 61267 - DNA, 20 bp, Artificial Sequence
  Synthetic oligonucleotide; TGGGGT chr11 5357545 5357564 5357548 -
gatctgtctaatgttgacag

SEQ ID NO: 61268 - DNA, 20 bp, Artificial Sequence
  Synthetic oligonucleotide; GAGAGT chr11 5357513 5357532 5357516 -
gtctcccattgttattgtgt

SEQ ID NO: 61269 - DNA, 20 bp, Artificial Sequence
  Synthetic oligonucleotide; CTGGGT chr11 5357466 5357485 5357469 -
taaggacttgctttatgaac

SEQ ID NO: 61270 - DNA, 20 bp, Artificial Sequence
  Synthetic oligonucleotide; TTGGGT chr11 5357451 5357470 5357454 -
tgaacctgggtgttcctgta

SEQ ID NO: 61271 - DNA, 20 bp, Artificial Sequence
  Synthetic oligonucleotide; TAGGAT chr11 5357434 5357453 5357437 -
gtattgggtgcatatatgtt

SEQ ID NO: 61272 - DNA, 20 bp, Artificial Sequence
  Synthetic oligonucleotide; TTGAAT chr11 5357413 5357432 5357416 -
aggatagttagctcttcttg

SEQ ID NO: 61273 - DNA, 20 bp, Artificial Sequence
  Synthetic oligonucleotide; GAGGAT chr11 5357329 5357348 5357332 -
aagcctgttttatcagagat

SEQ ID NO: 61274 - DNA, 20 bp, Artificial Sequence
  Synthetic oligonucleotide; ATGGGT chr11 5357233 5357252 5357236 -
tgtgtgtgtgtgcacatgag

SEQ ID NO: 61275 - DNA, 20 bp, Artificial Sequence
  Synthetic oligonucleotide; CTGAAT chr11 5357224 5357243 5357227 -
gtgcacatgagatgggtttc

SEQ ID NO: 61276 - DNA, 20 bp, Artificial Sequence
  Synthetic oligonucleotide; ATGGGT chr11 5357207 5357226 5357210 -
ttcctgaatacagcacactg

SEQ ID NO: 61277 - DNA, 20 bp, Artificial Sequence
  Synthetic oligonucleotide; GTGAAT chr11 5357118 5357137 5357121 -
taaggttaatattgttatgt

SEQ ID NO: 61278 - DNA, 20 bp, Artificial Sequence
  Synthetic oligonucleotide; CTGGAT chr11 5356869 5356888 5356872 -
acttatgaagcttagtttgg

SEQ ID NO: 61279 - DNA, 20 bp, Artificial Sequence
  Synthetic oligonucleotide; AAGGAT chr11 5356832 5356851 5356835 -
tgttgaaaattctttccttt

SEQ ID NO: 61280 - DNA, 20 bp, Artificial Sequence
  Synthetic oligonucleotide; TTGAAT chr11 5356825 5356844 5356828 -
aattctttcctttaaggatg

SEQ ID NO: 61281 - DNA, 20 bp, Artificial Sequence
  Synthetic oligonucleotide; TAGAGT chr11 5356793 5356812 5356796 -
ccccactctcttctggcttg

SEQ ID NO: 61282 - DNA, 20 bp, Artificial Sequence
  Synthetic oligonucleotide; GTGGGT chr11 5356745 5356764 5356748 -
attctgatgggcttcccttt

SEQ ID NO: 61283 - DNA, 20 bp, Artificial Sequence
  Synthetic oligonucleotide; GTGAAT chr11 5356684 5356703 5356687 -
ttcccttcatttcaactttg

SEQ ID NO: 61284 - DNA, 20 bp, Artificial Sequence
  Synthetic oligonucleotide; AGGAGT chr11 5356644 5356663 5356647 -
ccttgtagttgctcttctca

SEQ ID NO: 61285 - DNA, 20 bp, Artificial Sequence
  Synthetic oligonucleotide; CTGAAT chr11 5356613 5356632 5356616 -
tgtggcgttctctgtatttc

SEQ ID NO: 61286 - DNA, 20 bp, Artificial Sequence
  Synthetic oligonucleotide; TTGAAT chr11 5356607 5356626 5356610 -
gttctctgtatttcctgaat

SEQ ID NO: 61287 - DNA, 20 bp, Artificial Sequence
  Synthetic oligonucleotide; CTGGAT chr11 5356568 5356587 5356571 -
gctagattggggaagttctc

SEQ ID NO: 61288 - DNA, 20 bp, Artificial Sequence
  Synthetic oligonucleotide; CAGAGT chr11 5356553 5356572 5356556 -
ttctcctggataatatcctg

SEQ ID NO: 61289 - DNA, 20 bp, Artificial Sequence
  Synthetic oligonucleotide; TCGAAT chr11 5356354 5356373 5356357 -
ataccctttcttccagttga

SEQ ID NO: 61290 - DNA, 20 bp, Artificial Sequence
  Synthetic oligonucleotide; CTGAGT chr11 5356342 5356361 5356345 -
ccagttgatcgaatcagcta

SEQ ID NO: 61291 - DNA, 20 bp, Artificial Sequence
  Synthetic oligonucleotide; ATGGGT chr11 5356205 5356224 5356208 -
aggtttttaacttttttgcc

SEQ ID NO: 61292 - DNA, 20 bp, Artificial Sequence
  Synthetic oligonucleotide; CGGAGT chr11 5356179 5356198 5356182 -
tcgagcttcctcctttagct

SEQ ID NO: 61293 - DNA, 20 bp, Artificial Sequence
  Synthetic oligonucleotide; TAGAGT chr11 5356056 5356075 5356059 -
aggagaggcactctgatttt

SEQ ID NO: 61294 - DNA, 20 bp, Artificial Sequence
  Synthetic oligonucleotide; ATGGGT chr11 5355973 5355992 5355976 -
ttgatgatggtgacgtacag

SEQ ID NO: 61295 - DNA, 20 bp, Artificial Sequence
  Synthetic oligonucleotide; GTGGAT chr11 5355960 5355979 5355963 -
cgtacagatgggtttttggt

SEQ ID NO: 61296 - DNA, 20 bp, Artificial Sequence
  Synthetic oligonucleotide; AGGAAT chr11 5355848 5355867 5355851 -
attgacgcctatgtcactac

SEQ ID NO: 61297 - DNA, 20 bp, Artificial Sequence
  Synthetic oligonucleotide; GTGGAT chr11 5355679 5355698 5355682 -
ataacttttacagatgattt

SEQ ID NO: 61298 - DNA, 20 bp, Artificial Sequence
  Synthetic oligonucleotide; AAGAGT chr11 5355572 5355591 5355575 -
ttagacagatacaggactgc

SEQ ID NO: 61299 - DNA, 20 bp, Artificial Sequence
  Synthetic oligonucleotide; TGGGGT chr11 5355502 5355521 5355505 -
acttgaactagttgttgggc

SEQ ID NO: 61300 - DNA, 20 bp, Artificial Sequence
  Synthetic oligonucleotide; TGGAAT chr11 5355497 5355516 5355500 -
aactagttgttgggctgggg

SEQ ID NO: 61301 - DNA, 20 bp, Artificial Sequence
  Synthetic oligonucleotide; GTGGGT chr11 5355437 5355456 5355440 -
tgtggagaggacccaaatca

SEQ ID NO: 61302 - DNA, 20 bp, Artificial Sequence
  Synthetic oligonucleotide; TTGAAT chr11 5355423 5355442 5355426 -
aaatcagtgggtgttgctct

SEQ ID NO: 61303 - DNA, 20 bp, Artificial Sequence
  Synthetic oligonucleotide; AAGGAT chr11 5355038 5355057 5355041 -
ggtagttttccagtgttagc

SEQ ID NO: 61304 - DNA, 20 bp, Artificial Sequence
  Synthetic oligonucleotide; ATGAGT chr11 5355026 5355045 5355029 -
gtgttagcaaggatgcatcc

SEQ ID NO: 61305 - DNA, 20 bp, Artificial Sequence
  Synthetic oligonucleotide; GTGGAT chr11 5355015 5355034 5355018 -
gatgcatccatgagtttttt

SEQ ID NO: 61306 - DNA, 20 bp, Artificial Sequence
  Synthetic oligonucleotide; TTGAAT chr11 5354902 5354921 5354905 -
ctcagcttcgtcaaggtctc

SEQ ID NO: 61307 - DNA, 20 bp, Artificial Sequence
  Synthetic oligonucleotide; CAGAGT chr11 5354871 5354890 5354874 -
tgattgcttctaaacatcct

SEQ ID NO: 61308 - DNA, 20 bp, Artificial Sequence
  Synthetic oligonucleotide; GTGAGT chr11 5354752 5354771 5354755 -
cttctggaggacgttttcct

SEQ ID NO: 61309 - DNA, 20 bp, Artificial Sequence
  Synthetic oligonucleotide; CTGAGT chr11 5354744 5354763 5354747 -
ggacgttttcctgtgagtgg

SEQ ID NO: 61310 - DNA, 20 bp, Artificial Sequence
  Synthetic oligonucleotide; GAGGAT chr11 5354617 5354636 5354620 -
gaggggcgggaggaagtggg

SEQ ID NO: 61311 - DNA, 20 bp, Artificial Sequence
  Synthetic oligonucleotide; AGGGGT chr11 5354604 5354623 5354607 -
aagtggggaggatcatgagg

SEQ ID NO: 61312 - DNA, 20 bp, Artificial Sequence
  Synthetic oligonucleotide; CAGGGT chr11 5354411 5354430 5354414 -
agaaagggaggagagaaact

SEQ ID NO: 61313 - DNA, 20 bp, Artificial Sequence
  Synthetic oligonucleotide; CAGAAT chr11 5354382 5354401 5354385 -
cagtcaaatgtgtccattta

SEQ ID NO: 61314 - DNA, 20 bp, Artificial Sequence
  Synthetic oligonucleotide; CAGGAT chr11 5354320 5354339 5354323 -
tagcctgctatggcaggttt

SEQ ID NO: 61315 - DNA, 20 bp, Artificial Sequence
  Synthetic oligonucleotide; GAGGGT chr11 5354303 5354322 5354306 -
tttcaggatcactggaccta

SEQ ID NO: 61316 - DNA, 20 bp, Artificial Sequence
  Synthetic oligonucleotide; GTGAGT chr11 5354299 5354318 5354302 -
aggatcactggacctagagg

SEQ ID NO: 61317 - DNA, 20 bp, Artificial Sequence
  Synthetic oligonucleotide; CTGAAT chr11 5354258 5354277 5354261 -
ttgatgtggcttagatcccc

SEQ ID NO: 61318 - DNA, 20 bp, Artificial Sequence
  Synthetic oligonucleotide; CAGGAT chr11 5354222 5354241 5354225 -
aagcccaagggaagaaagaa

SEQ ID NO: 61319 - DNA, 20 bp, Artificial Sequence
  Synthetic oligonucleotide; ATGGGT chr11 5354136 5354155 5354139 -
tagcagacacacagaaagac

SEQ ID NO: 61320 - DNA, 20 bp, Artificial Sequence
  Synthetic oligonucleotide; GGGAAT chr11 5354047 5354066 5354050 -
agaagttctgtaatacagta

SEQ ID NO: 61321 - DNA, 20 bp, Artificial Sequence
  Synthetic oligonucleotide; TTGAGT chr11 5353959 5353978 5353962 -
aaatttcacacacagccaag

SEQ ID NO: 61322 - DNA, 20 bp, Artificial Sequence
  Synthetic oligonucleotide; AAGAAT chr11 5353843 5353862 5353846 -
ctgtgttatttatacatccc

SEQ ID NO: 61323 - DNA, 20 bp, Artificial Sequence
  Synthetic oligonucleotide; AAGAGT chr11 5353809 5353828 5353812 -
atccccacctttctgtgatg

SEQ ID NO: 61324 - DNA, 20 bp, Artificial Sequence
  Synthetic oligonucleotide; CTGAGT chr11 5353783 5353802 5353786 -
aggtgggcagccatagatca

SEQ ID NO: 61325 - DNA, 20 bp, Artificial Sequence
  Synthetic oligonucleotide; CTGGGT chr11 5353729 5353748 5353732 -
ggcatccagctgactggtca

SEQ ID NO: 61326 - DNA, 20 bp, Artificial Sequence
  Synthetic oligonucleotide; AAGAAT chr11 5353677 5353696 5353680 -
ataccctgtattttggtcaa

SEQ ID NO: 61327 - DNA, 20 bp, Artificial Sequence
  Synthetic oligonucleotide; TTGAGT chr11 5353637 5353656 5353640 -
attaatttaaaacttatcat

SEQ ID NO: 61328 - DNA, 20 bp, Artificial Sequence
  Synthetic oligonucleotide; ATGGAT chr11 5353630 5353649 5353633 -
taaaacttatcatttgagtc

SEQ ID NO: 61329 - DNA, 20 bp, Artificial Sequence
  Synthetic oligonucleotide; AAGAAT chr11 5353564 5353583 5353567 -
tctcatgcctagactctgaa

SEQ ID NO: 61330 - DNA, 20 bp, Artificial Sequence
  Synthetic oligonucleotide; TGGAAT chr11 5353334 5353353 5353337 -
tctctctgttcagtagtaac

SEQ ID NO: 61331 - DNA, 20 bp, Artificial Sequence
  Synthetic oligonucleotide; CTGAAT chr11 5353306 5353325 5353309 -
actatcaagacaatggtcat

SEQ ID NO: 61332 - DNA, 20 bp, Artificial Sequence
  Synthetic oligonucleotide; TTGAAT chr11 5353189 5353208 5353192 -
ctttccctagactcatcatt

SEQ ID NO: 61333 - DNA, 20 bp, Artificial Sequence
  Synthetic oligonucleotide; CTGGAT chr11 5353055 5353074 5353058 -
gctccatatatgcaagagaa

SEQ ID NO: 61334 - DNA, 20 bp, Artificial Sequence
  Synthetic oligonucleotide; AAGAAT chr11 5352935 5352954 5352938 -
gtgacccaaatcatagaccc

SEQ ID NO: 61335 - DNA, 20 bp, Artificial Sequence
  Synthetic oligonucleotide; ATGGGT chr11 5352794 5352813 5352797 -
ttaaatatatataatagtgt

SEQ ID NO: 61336 - DNA, 20 bp, Artificial Sequence
  Synthetic oligonucleotide; GTGAGT chr11 5352710 5352729 5352713 -
ccataagctaatcaaacaat

SEQ ID NO: 61337 - DNA, 20 bp, Artificial Sequence
  Synthetic oligonucleotide; CAGGGT chr11 5352615 5352634 5352618 -
acaaatcagcaatagacagg

SEQ ID NO: 61338 - DNA, 20 bp, Artificial Sequence
  Synthetic oligonucleotide; AGGGAT chr11 5352587 5352606 5352590 -
aataatgttctaagtagcag

SEQ ID NO: 61339 - DNA, 20 bp, Artificial Sequence
  Synthetic oligonucleotide; AGGGAT chr11 5352557 5352576 5352560 -
tgatttccactgaaatgctc

SEQ ID NO: 61340 - DNA, 20 bp, Artificial Sequence
  Synthetic oligonucleotide; CTGAAT chr11 5352480 5352499 5352483 -
tgtcatcctgtccaggtccc

SEQ ID NO: 61341 - DNA, 20 bp, Artificial Sequence
  Synthetic oligonucleotide; TAGAGT chr11 5352439 5352458 5352442 -
agtgaaacaatgtcatgctc

SEQ ID NO: 61342 - DNA, 20 bp, Artificial Sequence
  Synthetic oligonucleotide; GAGAAT chr11 5352425 5352444 5352428 -
atgctctagagtgaggcaga

SEQ ID NO: 61343 - DNA, 20 bp, Artificial Sequence
  Synthetic oligonucleotide; CTGAAT chr11 5352402 5352421 5352405 -
aataaacgaagtatgccact

SEQ ID NO: 61344 - DNA, 20 bp, Artificial Sequence
  Synthetic oligonucleotide; ATGGGT chr11 5352370 5352389 5352373 -
agttttaatgctatagataa

SEQ ID NO: 61345 - DNA, 20 bp, Artificial Sequence
  Synthetic oligonucleotide; GTGGAT chr11 5352342 5352361 5352345 -
ataaaaggtgggaaaaggaa

SEQ ID NO: 61346 - DNA, 20 bp, Artificial Sequence
  Synthetic oligonucleotide; ATGAAT chr11 5352288 5352307 5352291 -
ggaacatgctttccaaacct

SEQ ID NO: 61347 - DNA, 20 bp, Artificial Sequence
  Synthetic oligonucleotide; CAGGAT chr11 5352249 5352268 5352252 -
actacagtgacatagaagac

SEQ ID NO: 61348 - DNA, 20 bp, Artificial Sequence
  Synthetic oligonucleotide; GAGAAT chr11 5352168 5352187 5352171 -
ccaatgcccatgacagtctt

SEQ ID NO: 61349 - DNA, 20 bp, Artificial Sequence
  Synthetic oligonucleotide; CTGGAT chr11 5352100 5352119 5352103 -
cattgcaaataaaactacaa

SEQ ID NO: 61350 - DNA, 20 bp, Artificial Sequence
  Synthetic oligonucleotide; GAGAGT chr11 5352026 5352045 5352029 -
ggtgtagacagaaagcatgg

SEQ ID NO: 61351 - DNA, 20 bp, Artificial Sequence
  Synthetic oligonucleotide; TGGGAT chr11 5352017 5352036 5352020 -
agaaagcatgggagagtaca

SEQ ID NO: 61352 - DNA, 20 bp, Artificial Sequence
  Synthetic oligonucleotide; CTGGGT chr11 5351922 5351941 5351925 -
cgcacaccaatcttcattac

SEQ ID NO: 61353 - DNA, 20 bp, Artificial Sequence
  Synthetic oligonucleotide; CAGGAT chr11 5351910 5351929 5351913 -
ttcattacctgggtgttggt

SEQ ID NO: 61354 - DNA, 20 bp, Artificial Sequence
  Synthetic oligonucleotide; GCGGAT chr11 5351883 5351902 5351886 -
gaggtatatcttaaggggct

SEQ ID NO: 61355 - DNA, 20 bp, Artificial Sequence
  Synthetic oligonucleotide; AAGAGT chr11 5351823 5351842 5351826 -
acacctgactccatgacaga

SEQ ID NO: 61356 - DNA, 20 bp, Artificial Sequence
  Synthetic oligonucleotide; ATGGAT chr11 5351817 5351836 5351820 -
gactccatgacagaaagagt

SEQ ID NO: 61357 - DNA, 20 bp, Artificial Sequence
  Synthetic oligonucleotide; AAGAGT chr11 5351637 5351656 5351640 -
tcattcctgatgagaaagag

SEQ ID NO: 61358 - DNA, 20 bp, Artificial Sequence
  Synthetic oligonucleotide; TGGGAT chr11 5351592 5351611 5351595 -
gagatgtaggctgccaataa

SEQ ID NO: 61359 - DNA, 20 bp, Artificial Sequence
  Synthetic oligonucleotide; ATGAAT chr11 5351588 5351607 5351591 -
tgtaggctgccaataatggg

SEQ ID NO: 61360 - DNA, 20 bp, Artificial Sequence
  Synthetic oligonucleotide; GAGAAT chr11 5351434 5351453 5351437 -
ttgtataaaagttgctcctt

SEQ ID NO: 61361 - DNA, 20 bp, Artificial Sequence
  Synthetic oligonucleotide; AAGGAT chr11 5351381 5351400 5351384 -
tcctgactttcagtgacagc

SEQ ID NO: 61362 - DNA, 20 bp, Artificial Sequence
  Synthetic oligonucleotide; TAGAAT chr11 5351334 5351353 5351337 -
agatcctaggtatgggaaaa

SEQ ID NO: 61363 - DNA, 20 bp, Artificial Sequence
  Synthetic oligonucleotide; TAGGGT chr11 5351309 5351328 5351312 -
tgtataaagaagatattatt

SEQ ID NO: 61364 - DNA, 20 bp, Artificial Sequence
  Synthetic oligonucleotide; TTGGAT chr11 5351285 5351304 5351288 -
gtttactctatgtaagatta

SEQ ID NO: 61365 - DNA, 20 bp, Artificial Sequence
  Synthetic oligonucleotide; GGGGAT chr11 5351271 5351290 5351274 -
agattattggatactacgtt

SEQ ID NO: 61366 - DNA, 20 bp, Artificial Sequence
  Synthetic oligonucleotide; CAGAAT chr11 5351252 5351271 5351255 -
tggggatacagctattcatg

SEQ ID NO: 61367 - DNA, 20 bp, Artificial Sequence
  Synthetic oligonucleotide; TTGAAT chr11 5351238 5351257 5351241 -
ttcatgcagaataaacattg

SEQ ID NO: 61368 - DNA, 20 bp, Artificial Sequence
  Synthetic oligonucleotide; TTGAAT chr11 5351173 5351192 5351176 -
gaaagaagaaatcactatat

SEQ ID NO: 61369 - DNA, 20 bp, Artificial Sequence
  Synthetic oligonucleotide; TAGGGT chr11 5351099 5351118 5351102 -
catcctgactggtggtatta

SEQ ID NO: 61370 - DNA, 20 bp, Artificial Sequence
  Synthetic oligonucleotide; GTGGAT chr11 5351095 5351114 5351098 -
ctgactggtggtattatagg

SEQ ID NO: 61371 - DNA, 20 bp, Artificial Sequence
  Synthetic oligonucleotide; TTGGGT chr11 5350878 5350897 5350881 -
tgatgaagctccagagactt

SEQ ID NO: 61372 - DNA, 20 bp, Artificial Sequence
  Synthetic oligonucleotide; AAGAGT chr11 5350856 5350875 5350859 -
gggtagttagaaaatgacgt

SEQ ID NO: 61373 - DNA, 20 bp, Artificial Sequence
  Synthetic oligonucleotide; AAGAAT chr11 5350768 5350787 5350771 -
gttattgatacactgcttca

SEQ ID NO: 61374 - DNA, 20 bp, Artificial Sequence
  Synthetic oligonucleotide; AAGAAT chr11 5350739 5350758 5350742 -
aattttcataatataaattg

SEQ ID NO: 61375 - DNA, 20 bp, Artificial Sequence
  Synthetic oligonucleotide; GTGGAT chr11 5350721 5350740 5350724 -
tgaagaataaacagtaaaat

SEQ ID NO: 61376 - DNA, 20 bp, Artificial Sequence
  Synthetic oligonucleotide; GAGAAT chr11 5350606 5350625 5350609 -
gtaatttaggcaagatcaag

SEQ ID NO: 61377 - DNA, 20 bp, Artificial Sequence
  Synthetic oligonucleotide; TGGAAT chr11 5350584 5350603 5350587 -
gaattttttttttaaaacta

SEQ ID NO: 61378 - DNA, 20 bp, Artificial Sequence
  Synthetic oligonucleotide; TGGGAT chr11 5350574 5350593 5350577 -
tttaaaactatggaatctga

SEQ ID NO: 61379 - DNA, 20 bp, Artificial Sequence
  Synthetic oligonucleotide; TAGAAT chr11 5350537 5350556 5350540 -
gagaaggctctgtgactcat

SEQ ID NO: 61380 - DNA, 20 bp, Artificial Sequence
  Synthetic oligonucleotide; GAGAAT chr11 5350496 5350515 5350499 -
ggtgcaggcagccaacctct

SEQ ID NO: 61381 - DNA, 20 bp, Artificial Sequence
  Synthetic oligonucleotide; AAGAAT chr11 5350342 5350361 5350345 -
gacctctttctgtccatgaa

SEQ ID NO: 61382 - DNA, 20 bp, Artificial Sequence
  Synthetic oligonucleotide; AAGAAT chr11 5350305 5350324 5350308 -
tactggactttcattttcag

SEQ ID NO: 61383 - DNA, 20 bp, Artificial Sequence
  Synthetic oligonucleotide; AAGAGT chr11 5350147 5350166 5350150 -
gtaaggggaaatgttttgta

SEQ ID NO: 61384 - DNA, 20 bp, Artificial Sequence
  Synthetic oligonucleotide; GTGGAT chr11 5350143 5350162 5350146 -
ggggaaatgttttgtaaaga

SEQ ID NO: 61385 - DNA, 20 bp, Artificial Sequence
  Synthetic oligonucleotide; GTGAGT chr11 5350075 5350094 5350078 -
acctcctttctctttctcta

SEQ ID NO: 61386 - DNA, 20 bp, Artificial Sequence
  Synthetic oligonucleotide; CAGGAT chr11 5350063 5350082 5350066 -
tttctctagtgagtacatgt

SEQ ID NO: 61387 - DNA, 20 bp, Artificial Sequence
  Synthetic oligonucleotide; TGGGGT chr11 5349984 5350003 5349987 -
gaacagatataagatgatga

SEQ ID NO: 61388 - DNA, 20 bp, Artificial Sequence
  Synthetic oligonucleotide; CTGGGT chr11 5349900 5349919 5349903 -
gcagataaaatgtgatatgt

SEQ ID NO: 61389 - DNA, 20 bp, Artificial Sequence
  Synthetic oligonucleotide; CAGGAT chr11 5349700 5349719 5349703 -
cagacaatactcagcttatg

SEQ ID NO: 61390 - DNA, 20 bp, Artificial Sequence
  Synthetic oligonucleotide; AGGAGT chr11 5349404 5349423 5349407 -
ttgataaattaaaaaaaaac

SEQ ID NO: 61391 - DNA, 20 bp, Artificial Sequence
  Synthetic oligonucleotide; AGGAAT chr11 5349398 5349417 5349401 -
aattaaaaaaaaacaggagt

SEQ ID NO: 61392 - DNA, 20 bp, Artificial Sequence
  Synthetic oligonucleotide; TTGAAT chr11 5349341 5349360 5349344 -
atgtatggaacaaataattg

SEQ ID NO: 61393 - DNA, 20 bp, Artificial Sequence
  Synthetic oligonucleotide; AAGAAT chr11 5349280 5349299 5349283 -
tatacacctcattttttggg

SEQ ID NO: 61394 - DNA, 20 bp, Artificial Sequence
  Synthetic oligonucleotide; CTGAGT chr11 5349232 5349251 5349235 -
gtctgttttcatattgaaaa

SEQ ID NO: 61395 - DNA, 20 bp, Artificial Sequence
  Synthetic oligonucleotide; GTGAGT chr11 5349178 5349197 5349181 -
tgtggtatatgagatgatct

SEQ ID NO: 61396 - DNA, 20 bp, Artificial Sequence
  Synthetic oligonucleotide; GGGGAT chr11 5349166 5349185 5349169 -
gatgatctgtgagtttcaga

SEQ ID NO: 61397 - DNA, 20 bp, Artificial Sequence
  Synthetic oligonucleotide; CAGGGT chr11 5349113 5349132 5349116 -
tgcagccattcaccctcttc

SEQ ID NO: 61398 - DNA, 20 bp, Artificial Sequence
  Synthetic oligonucleotide; TAGAAT chr11 5349099 5349118 5349102 -
ctcttccagggtctctgtca

SEQ ID NO: 61399 - DNA, 20 bp, Artificial Sequence
  Synthetic oligonucleotide; TTGAGT chr11 5349089 5349108 5349092 -
gtctctgtcatagaatagac

SEQ ID NO: 61400 - DNA, 20 bp, Artificial Sequence
  Synthetic oligonucleotide; TTGAGT chr11 5348845 5348864 5348848 -
cctttctgtgatggttaata

SEQ ID NO: 61401 - DNA, 20 bp, Artificial Sequence
  Synthetic oligonucleotide; TTGGAT chr11 5348829 5348848 5348832 -
aatattgagtgcaaacttga

SEQ ID NO: 61402 - DNA, 20 bp, Artificial Sequence
  Synthetic oligonucleotide; AAGGAT chr11 5348821 5348840 5348824 -
gtgcaaacttgattggattg

SEQ ID NO: 61403 - DNA, 20 bp, Artificial Sequence
  Synthetic oligonucleotide; CTGGGT chr11 5348801 5348820 5348804 -
aaggatgcaaagtattgttc

SEQ ID NO: 61404 - DNA, 20 bp, Artificial Sequence
  Synthetic oligonucleotide; AAGGGT chr11 5348788 5348807 5348791 -
attgttcctgggtgtgctgt

SEQ ID NO: 61405 - DNA, 20 bp, Artificial Sequence
  Synthetic oligonucleotide; TTGAGT chr11 5348761 5348780 5348764 -
ttgccaaaggagattaacat

SEQ ID NO: 61406 - DNA, 20 bp, Artificial Sequence
  Synthetic oligonucleotide; CTGGGT chr11 5348718 5348737 5348721 -
cagacccacccaccctccgt

SEQ ID NO: 61407 - DNA, 20 bp, Artificial Sequence
  Synthetic oligonucleotide; GTGGGT chr11 5348714 5348733 5348717 -
cccacccaccctccgtctgg

SEQ ID NO: 61408 - DNA, 20 bp, Artificial Sequence
  Synthetic oligonucleotide; AAGAGT chr11 5348655 5348674 5348658 -
aagcaggcaaaagaagatgg

SEQ ID NO: 61409 - DNA, 20 bp, Artificial Sequence
  Synthetic oligonucleotide; GTGGAT chr11 5348648 5348667 5348651 -
caaaagaagatggaagagta

SEQ ID NO: 61410 - DNA, 20 bp, Artificial Sequence
  Synthetic oligonucleotide; GTGAAT chr11 5348592 5348611 5348595 -
gctaaagtcacacaggctat

SEQ ID NO: 61411 - DNA, 20 bp, Artificial Sequence
  Synthetic oligonucleotide; TTGAAT chr11 5348533 5348552 5348536 -
agctccgtccaagcttaatt

SEQ ID NO: 61412 - DNA, 20 bp, Artificial Sequence
  Synthetic oligonucleotide; AAGAAT chr11 5348443 5348462 5348446 -
ttacagaggtatacctcctc

SEQ ID NO: 61413 - DNA, 20 bp, Artificial Sequence
  Synthetic oligonucleotide; AAGAGT chr11 5348433 5348452 5348436 -
atacctcctcaagaatttgg

SEQ ID NO: 61414 - DNA, 20 bp, Artificial Sequence
  Synthetic oligonucleotide; TGGGGT chr11 5348382 5348401 5348385 -
gacttctaaggtaaaagaca

SEQ ID NO: 61415 - DNA, 20 bp, Artificial Sequence
  Synthetic oligonucleotide; CAGGGT chr11 5348358 5348377 5348361 -
gttgggggcagggggactct

SEQ ID NO: 61416 - DNA, 20 bp, Artificial Sequence
  Synthetic oligonucleotide; TAGAAT chr11 5348352 5348371 5348355 -
ggcagggggactctcagggt

SEQ ID NO: 61417 - DNA, 20 bp, Artificial Sequence
  Synthetic oligonucleotide; AAGAAT chr11 5348329 5348348 5348332 -
aatggaagccagagagatta

SEQ ID NO: 61418 - DNA, 20 bp, Artificial Sequence
  Synthetic oligonucleotide; CTGAGT chr11 5348281 5348300 5348284 -
tacaaccccataattcatgc

SEQ ID NO: 61419 - DNA, 20 bp, Artificial Sequence
  Synthetic oligonucleotide; TAGAAT chr11 5348250 5348269 5348253 -
cccatgctctggtttgttcg

SEQ ID NO: 61420 - DNA, 20 bp, Artificial Sequence
  Synthetic oligonucleotide; CAGAAT chr11 5348226 5348245 5348229 -
attgtttgccttatgtgttc

SEQ ID NO: 61421 - DNA, 20 bp, Artificial Sequence
  Synthetic oligonucleotide; GGGAGT chr11 5348156 5348175 5348159 -
accaagttttagagatgtca

SEQ ID NO: 61422 - DNA, 20 bp, Artificial Sequence
  Synthetic oligonucleotide; CAGAAT chr11 5347906 5347925 5347909 -
agatttgggcatcatctttt

SEQ ID NO: 61423 - DNA, 20 bp, Artificial Sequence
  Synthetic oligonucleotide; GTGGGT chr11 5347724 5347743 5347727 -
ttatttgtgccctcagcctt

SEQ ID NO: 61424 - DNA, 20 bp, Artificial Sequence
  Synthetic oligonucleotide; TTGAAT chr11 5347642 5347661 5347645 -
aggttttcctctgttggagg

SEQ ID NO: 61425 - DNA, 20 bp, Artificial Sequence
  Synthetic oligonucleotide; TGGAAT chr11 5347595 5347614 5347598 -
tggctcttgctgtgctactt

SEQ ID NO: 61426 - DNA, 20 bp, Artificial Sequence
  Synthetic oligonucleotide; ATGAGT chr11 5347492 5347511 5347495 -
cttggctgaagcaccatgtg

SEQ ID NO: 61427 - DNA, 20 bp, Artificial Sequence
  Synthetic oligonucleotide; GGGAAT chr11 5347431 5347450 5347434 -
tggtaggctaaactcaagaa

SEQ ID NO: 61428 - DNA, 20 bp, Artificial Sequence
  Synthetic oligonucleotide; CAGAAT chr11 5347410 5347429 5347413 -
ggaatagttagtgataactg

SEQ ID NO: 61429 - DNA, 20 bp, Artificial Sequence
  Synthetic oligonucleotide; TTGGGT chr11 5347393 5347412 5347396 -
ctgcagaatgtgcgttcacg

SEQ ID NO: 61430 - DNA, 20 bp, Artificial Sequence
  Synthetic oligonucleotide; CTGAAT chr11 5347372 5347391 5347375 -
tgggtactagagaaggctgc

SEQ ID NO: 61431 - DNA, 20 bp, Artificial Sequence
  Synthetic oligonucleotide; GGGAAT chr11 5347203 5347222 5347206 -
tgactgttgaagtaaatgta

SEQ ID NO: 61432 - DNA, 20 bp, Artificial Sequence
  Synthetic oligonucleotide; CAGAGT chr11 5347174 5347193 5347177 -
ttacctcccagaggtgatac

SEQ ID NO: 61433 - DNA, 20 bp, Artificial Sequence
  Synthetic oligonucleotide; AGGAGT chr11 5347022 5347041 5347025 -
tgttccagctccctctaagg

SEQ ID NO: 61434 - DNA, 20 bp, Artificial Sequence
  Synthetic oligonucleotide; CAGAGT chr11 5347011 5347030 5347014 -
cctctaaggaggagttaata

SEQ ID NO: 61435 - DNA, 20 bp, Artificial Sequence
  Synthetic oligonucleotide; GGGAGT chr11 5346824 5346843 5346827 -
tcaaacaagttatggtacct

SEQ ID NO: 61436 - DNA, 20 bp, Artificial Sequence
  Synthetic oligonucleotide; AAGAGT chr11 5346793 5346812 5346796 -
gaaatactcctagatatata

SEQ ID NO: 61437 - DNA, 20 bp, Artificial Sequence
  Synthetic oligonucleotide; AAGGAT chr11 5346734 5346753 5346737 -
aaagatacggagaagaagtg

SEQ ID NO: 61438 - DNA, 20 bp, Artificial Sequence
  Synthetic oligonucleotide; TTGGAT chr11 5346711 5346730 5346714 -
gatctcaatagtccacagct

SEQ ID NO: 61439 - DNA, 20 bp, Artificial Sequence
  Synthetic oligonucleotide; GTGAAT chr11 5346612 5346631 5346615 -
gaccttctgtactcagtgat

SEQ ID NO: 61440 - DNA, 20 bp, Artificial Sequence
  Synthetic oligonucleotide; TAGAAT chr11 5346455 5346474 5346458 -
attttctaggtgttccatta

SEQ ID NO: 61441 - DNA, 20 bp, Artificial Sequence
  Synthetic oligonucleotide; AAGAAT chr11 5346324 5346343 5346327 -
ccacgactagctgaggacac

SEQ ID NO: 61442 - DNA, 20 bp, Artificial Sequence
  Synthetic oligonucleotide; TAGAGT chr11 5346303 5346322 5346306 -
agaattttcacaaaacaaag

SEQ ID NO: 61443 - DNA, 20 bp, Artificial Sequence
  Synthetic oligonucleotide; TGGAAT chr11 5346251 5346270 5346254 -
cattaccaggtatgtctgca

SEQ ID NO: 61444 - DNA, 20 bp, Artificial Sequence
  Synthetic oligonucleotide; GGGAAT chr11 5346241 5346260 5346244 -
tatgtctgcatggaattctt

SEQ ID NO: 61445 - DNA, 20 bp, Artificial Sequence
  Synthetic oligonucleotide; AGGAAT chr11 5346116 5346135 5346119 -
ctgcatattctctgataaga

SEQ ID NO: 61446 - DNA, 20 bp, Artificial Sequence
  Synthetic oligonucleotide; AAGAGT chr11 5346042 5346061 5346045 -
tgctgaaacgtcagagaagt

SEQ ID NO: 61447 - DNA, 20 bp, Artificial Sequence
  Synthetic oligonucleotide; CTGGAT chr11 5345988 5346007 5345991 -
acagaaggggaggagctaag

SEQ ID NO: 61448 - DNA, 20 bp, Artificial Sequence
  Synthetic oligonucleotide; AAGAAT chr11 5345961 5345980 5345964 -
atctttgcgtctagtaactg

SEQ ID NO: 61449 - DNA, 20 bp, Artificial Sequence
  Synthetic oligonucleotide; CTGAAT chr11 5345925 5345944 5345928 -
cattgtatgttcagtaggca

SEQ ID NO: 61450 - DNA, 20 bp, Artificial Sequence
  Synthetic oligonucleotide; CAGAAT chr11 5345892 5345911 5345895 -
tatgtctctcagtcctagga

SEQ ID NO: 61451 - DNA, 20 bp, Artificial Sequence
  Synthetic oligonucleotide; ATGGAT chr11 5345886 5345905 5345889 -
tctcagtcctaggacagaat

SEQ ID NO: 61452 - DNA, 20 bp, Artificial Sequence
  Synthetic oligonucleotide; CTGAGT chr11 5345855 5345874 5345858 -
aaaatgattctttcaaagtg

SEQ ID NO: 61453 - DNA, 20 bp, Artificial Sequence
  Synthetic oligonucleotide; ATGGGT chr11 5345784 5345803 5345787 -
tacagttagatctcatctct

SEQ ID NO: 61454 - DNA, 20 bp, Artificial Sequence
  Synthetic oligonucleotide; GAGGAT chr11 5345769 5345788 5345772 -
tctctatgggtggaaggtaa

SEQ ID NO: 61455 - DNA, 20 bp, Artificial Sequence
  Synthetic oligonucleotide; TAGGGT chr11 5345742 5345761 5345745 -
gtttcctttggtggcatctt

SEQ ID NO: 61456 - DNA, 20 bp, Artificial Sequence
  Synthetic oligonucleotide; AGGGGT chr11 5345707 5345726 5345710 -
cactgacaaagtaactctga

SEQ ID NO: 61457 - DNA, 20 bp, Artificial Sequence
  Synthetic oligonucleotide; TTGGAT chr11 5345697 5345716 5345700 -
gtaactctgaaggggtatat

SEQ ID NO: 61458 - DNA, 20 bp, Artificial Sequence
  Synthetic oligonucleotide; TAGGAT chr11 5345673 5345692 5345676 -
atacgaccatctttttaact

SEQ ID NO: 61459 - DNA, 20 bp, Artificial Sequence
  Synthetic oligonucleotide; AGGGAT chr11 5345618 5345637 5345621 -
tgtgacaagaaaaaaaagca

SEQ ID NO: 61460 - DNA, 20 bp, Artificial Sequence
  Synthetic oligonucleotide; GTGAAT chr11 5345560 5345579 5345563 -
gactcttgatttcctcacaa

SEQ ID NO: 61461 - DNA, 20 bp, Artificial Sequence
  Synthetic oligonucleotide; TTGAGT chr11 5345530 5345549 5345533 -
atccccctcagacttccatt

SEQ ID NO: 61462 - DNA, 20 bp, Artificial Sequence
  Synthetic oligonucleotide; ATGGAT chr11 5345320 5345339 5345323 -
aggtcaccatgactcttcat

SEQ ID NO: 61463 - DNA, 20 bp, Artificial Sequence
  Synthetic oligonucleotide; GTGAGT chr11 5345245 5345264 5345248 -
ttcttcacatagcagtctaa

SEQ ID NO: 61464 - DNA, 20 bp, Artificial Sequence
  Synthetic oligonucleotide; CAGAAT chr11 5345222 5345241 5345225 -
agtaatttaaaaatacaaat

SEQ ID NO: 61465 - DNA, 20 bp, Artificial Sequence
  Synthetic oligonucleotide; AGGAAT chr11 5344583 5344602 5344586 -
gcccctagtctagtggcaga

SEQ ID NO: 61466 - DNA, 20 bp, Artificial Sequence
  Synthetic oligonucleotide; GGGGAT chr11 5344461 5344480 5344464 -
agattcagaagcctatggct

SEQ ID NO: 61467 - DNA, 20 bp, Artificial Sequence
  Synthetic oligonucleotide; ATGGAT chr11 5344434 5344453 5344437 -
aagggaaggaaaccaggaag

SEQ ID NO: 61468 - DNA, 20 bp, Artificial Sequence
  Synthetic oligonucleotide; GGGAAT chr11 5344382 5344401 5344385 -
atgagagaggtcagattcta

SEQ ID NO: 61469 - DNA, 20 bp, Artificial Sequence
  Synthetic oligonucleotide; GTGAGT chr11 5344194 5344213 5344197 -
ctgagctattgtcacaagta

SEQ ID NO: 61470 - DNA, 20 bp, Artificial Sequence
  Synthetic oligonucleotide; AAGGAT chr11 5344181 5344200 5344184 -
acaagtagtgagtagtactg

SEQ ID NO: 61471 - DNA, 20 bp, Artificial Sequence
  Synthetic oligonucleotide; GAGGGT chr11 5344168 5344187 5344171 -
agtactgaaggattctacaa

SEQ ID NO: 61472 - DNA, 20 bp, Artificial Sequence
  Synthetic oligonucleotide; GTGAAT chr11 5344148 5344167 5344151 -
gagggtaattcacactaatc

SEQ ID NO: 61473 - DNA, 20 bp, Artificial Sequence
  Synthetic oligonucleotide; CAGAGT chr11 5344056 5344075 5344059 -
cttagctacagtggtagtgg

SEQ ID NO: 61474 - DNA, 20 bp, Artificial Sequence
  Synthetic oligonucleotide; GTGGAT chr11 5343971 5343990 5343974 -
gtctttacatgcaggaaaat

SEQ ID NO: 61475 - DNA, 20 bp, Artificial Sequence
  Synthetic oligonucleotide; AGGGAT chr11 5343964 5343983 5343967 -
catgcaggaaaatgtggatt

SEQ ID NO: 61476 - DNA, 20 bp, Artificial Sequence
  Synthetic oligonucleotide; TTGAAT chr11 5343884 5343903 5343887 -
ttagctttctggaaatcccc

SEQ ID NO: 61477 - DNA, 20 bp, Artificial Sequence
  Synthetic oligonucleotide; TAGAAT chr11 5343872 5343891 5343875 -
aaatccccttgaatgcccca

SEQ ID NO: 61478 - DNA, 20 bp, Artificial Sequence
  Synthetic oligonucleotide; ACGAAT chr11 5343866 5343885 5343869 -
ccttgaatgccccatagaat

SEQ ID NO: 61479 - DNA, 20 bp, Artificial Sequence
  Synthetic oligonucleotide; AAGGGT chr11 5343840 5343859 5343843 -
tctttaaaatctgcatagtt

SEQ ID NO: 61480 - DNA, 20 bp, Artificial Sequence
  Synthetic oligonucleotide; GAGAAT chr11 5343793 5343812 5343796 -
tacataattttttttctgaa

SEQ ID NO: 61481 - DNA, 20 bp, Artificial Sequence
  Synthetic oligonucleotide; AAGAAT chr11 5343757 5343776 5343760 -
atataaacagttgaaactcc

SEQ ID NO: 61482 - DNA, 20 bp, Artificial Sequence
  Synthetic oligonucleotide; TGGAAT chr11 5343724 5343743 5343727 -
cgtaggtaggagatagatcc

SEQ ID NO: 61483 - DNA, 20 bp, Artificial Sequence
  Synthetic oligonucleotide; AAGAAT chr11 5343710 5343729 5343713 -
agatcctggaatgtgcagtt

SEQ ID NO: 61484 - DNA, 20 bp, Artificial Sequence
  Synthetic oligonucleotide; ATGAGT chr11 5343695 5343714 5343698 -
cagttaagaatacaaatagt

SEQ ID NO: 61485 - DNA, 20 bp, Artificial Sequence
  Synthetic oligonucleotide; GAGAAT chr11 5343683 5343702 5343686 -
caaatagtatgagtaaccct

SEQ ID NO: 61486 - DNA, 20 bp, Artificial Sequence
  Synthetic oligonucleotide; GAGAAT chr11 5343619 5343638 5343622 -
tatctttaggaaaaaattct

SEQ ID NO: 61487 - DNA, 20 bp, Artificial Sequence
  Synthetic oligonucleotide; CAGGAT chr11 5343529 5343548 5343532 -
acatttcttctatataaacc

SEQ ID NO: 61488 - DNA, 20 bp, Artificial Sequence
  Synthetic oligonucleotide; CTGGAT chr11 5343457 5343476 5343460 -
ggcttggaggaagctcatca

SEQ ID NO: 61489 - DNA, 20 bp, Artificial Sequence
  Synthetic oligonucleotide; GGGAGT chr11 5343286 5343305 5343289 -
accacaatgcccacggtgct

SEQ ID NO: 61490 - DNA, 20 bp, Artificial Sequence
  Synthetic oligonucleotide; CTGGAT chr11 5343273 5343292 5343276 -
cggtgctgggagtcctctgg

SEQ ID NO: 61491 - DNA, 20 bp, Artificial Sequence
  Synthetic oligonucleotide; TCGAGT chr11 5343203 5343222 5343206 -
tatacactcactttcctttc

SEQ ID NO: 61492 - DNA, 20 bp, Artificial Sequence
  Synthetic oligonucleotide; TCGAGT chr11 5343115 5343134 5343118 -
acctctgtacttactaatac

SEQ ID NO: 61493 - DNA, 20 bp, Artificial Sequence
  Synthetic oligonucleotide; GGGAGT chr11 5343094 5343113 5343097 -
cgagtagtgaagattgggct

SEQ ID NO: 61494 - DNA, 20 bp, Artificial Sequence
  Synthetic oligonucleotide; GGGGAT chr11 5343080 5343099 5343083 -
tgggctgggagttctgatga

SEQ ID NO: 61495 - DNA, 20 bp, Artificial Sequence
  Synthetic oligonucleotide; CAGGAT chr11 5342988 5343007 5342991 -
cacatgcattctgccttcac

SEQ ID NO: 61496 - DNA, 20 bp, Artificial Sequence
  Synthetic oligonucleotide; CTGGAT chr11 5342907 5342926 5342910 -
ttgtagtctttatatttgtg

SEQ ID NO: 61497 - DNA, 20 bp, Artificial Sequence
  Synthetic oligonucleotide; TTGGAT chr11 5342765 5342784 5342768 -
ggttttttatgtcacagtga

SEQ ID NO: 61498 - DNA, 20 bp, Artificial Sequence
  Synthetic oligonucleotide; ATGAAT chr11 5342673 5342692 5342676 -
attttctgttccctccacta

SEQ ID NO: 61499 - DNA, 20 bp, Artificial Sequence
  Synthetic oligonucleotide; CAGAAT chr11 5342634 5342653 5342637 -
gtgtcaagaccaagcagatt

SEQ ID NO: 61500 - DNA, 20 bp, Artificial Sequence
  Synthetic oligonucleotide; TAGAAT chr11 5342602 5342621 5342605 -
cttcacctttttactaccca

SEQ ID NO: 61501 - DNA, 20 bp, Artificial Sequence
  Synthetic oligonucleotide; CAGAAT chr11 5342561 5342580 5342564 -
aatcatcacagtcactctca

SEQ ID NO: 61502 - DNA, 20 bp, Artificial Sequence
  Synthetic oligonucleotide; CGGAAT chr11 5342379 5342398 5342382 -
ttttgttgcattcctgtaaa

SEQ ID NO: 61503 - DNA, 20 bp, Artificial Sequence
  Synthetic oligonucleotide; CAGAAT chr11 5342257 5342276 5342260 -
ataaagttagcagataggaa

SEQ ID NO: 61504 - DNA, 20 bp, Artificial Sequence
  Synthetic oligonucleotide; TCGAGT chr11 5342224 5342243 5342227 -
atataaaattattagttggt

SEQ ID NO: 61505 - DNA, 20 bp, Artificial Sequence
  Synthetic oligonucleotide; TGGAAT chr11 5342214 5342233 5342217 -
attagttggttcgagtgaaa

SEQ ID NO: 61506 - DNA, 20 bp, Artificial Sequence
  Synthetic oligonucleotide; TAGAGT chr11 5342209 5342228 5342212 -
ttggttcgagtgaaatggaa

SEQ ID NO: 61507 - DNA, 20 bp, Artificial Sequence
  Synthetic oligonucleotide; ATGAAT chr11 5342168 5342187 5342171 -
aaatctaatttccaactctt

SEQ ID NO: 61508 - DNA, 20 bp, Artificial Sequence
  Synthetic oligonucleotide; AGGAAT chr11 5342105 5342124 5342108 -
aaatttggtcactgaagtcc

SEQ ID NO: 61509 - DNA, 20 bp, Artificial Sequence
  Synthetic oligonucleotide; AAGAAT chr11 5342087 5342106 5342090 -
ccaggaattttcctgcaaaa

SEQ ID NO: 61510 - DNA, 20 bp, Artificial Sequence
  Synthetic oligonucleotide; ATGAAT chr11 5342002 5342021 5342005 -
cctccctccatcaaattata

SEQ ID NO: 61511 - DNA, 20 bp, Artificial Sequence
  Synthetic oligonucleotide; AGGAAT chr11 5341916 5341935 5341919 -
taacaaaaaaatgtgagaag

SEQ ID NO: 61512 - DNA, 20 bp, Artificial Sequence
  Synthetic oligonucleotide; ACGGAT chr11 5341909 5341928 5341912 -
aaaatgtgagaagaggaatc

SEQ ID NO: 61513 - DNA, 20 bp, Artificial Sequence
  Synthetic oligonucleotide; AAGAAT chr11 5341689 5341708 5341692 -
taggtttctgcatttttttg

SEQ ID NO: 61514 - DNA, 20 bp, Artificial Sequence
  Synthetic oligonucleotide; AAGAAT chr11 5341630 5341649 5341633 -
taataagtgtaaatttccca

SEQ ID NO: 61515 - DNA, 20 bp, Artificial Sequence
  Synthetic oligonucleotide; ATGAGT chr11 5341588 5341607 5341591 -
catttgattaaaattgtctg

SEQ ID NO: 61516 - DNA, 20 bp, Artificial Sequence
  Synthetic oligonucleotide; CAGAAT chr11 5341421 5341440 5341424 -
gttttaccccgatcatttta

SEQ ID NO: 61517 - DNA, 20 bp, Artificial Sequence
  Synthetic oligonucleotide; GTGAAT chr11 5341406 5341425 5341409 -
ttttacagaattgtgcacct

SEQ ID NO: 61518 - DNA, 20 bp, Artificial Sequence
  Synthetic oligonucleotide; TTGAAT chr11 5341156 5341175 5341159 -
cattaataaattgcacacat

SEQ ID NO: 61519 - DNA, 20 bp, Artificial Sequence
  Synthetic oligonucleotide; GAGAGT chr11 5341127 5341146 5341130 -
tatctcaggtattgctcata

SEQ ID NO: 61520 - DNA, 20 bp, Artificial Sequence
  Synthetic oligonucleotide; CTGAAT chr11 5340982 5341001 5340985 -
tgtcacctgagcaacacagt

SEQ ID NO: 61521 - DNA, 20 bp, Artificial Sequence
  Synthetic oligonucleotide; GTGAGT chr11 5340968 5340987 5340971 -
cacagtctgaatactaaatt

SEQ ID NO: 61522 - DNA, 20 bp, Artificial Sequence
  Synthetic oligonucleotide; GTGAGT chr11 5340962 5340981 5340965 -
ctgaatactaaattgtgagt

SEQ ID NO: 61523 - DNA, 20 bp, Artificial Sequence
  Synthetic oligonucleotide; TGGGGT chr11 5340842 5340861 5340845 -
ttttattcataaaaatattg

SEQ ID NO: 61524 - DNA, 20 bp, Artificial Sequence
  Synthetic oligonucleotide; GTGAAT chr11 5340708 5340727 5340711 -
cttctaactataaggccagt

SEQ ID NO: 61525 - DNA, 20 bp, Artificial Sequence
  Synthetic oligonucleotide; AAGAAT chr11 5340511 5340530 5340514 -
agtagaagaacttttttaaa

SEQ ID NO: 61526 - DNA, 20 bp, Artificial Sequence
  Synthetic oligonucleotide; AAGAGT chr11 5340478 5340497 5340481 -
tatgacattgcaaaaaaaaa

SEQ ID NO: 61527 - DNA, 20 bp, Artificial Sequence
  Synthetic oligonucleotide; TAGAAT chr11 5340459 5340478 5340462 -
aaagagtaatgcttttgttg

SEQ ID NO: 61528 - DNA, 20 bp, Artificial Sequence
  Synthetic oligonucleotide; TAGAAT chr11 5340436 5340455 5340439 -
aattactaaaatgcaatgct

SEQ ID NO: 61529 - DNA, 20 bp, Artificial Sequence
  Synthetic oligonucleotide; TAGAGT chr11 5340376 5340395 5340379 -
ttcaaactataataaatatt

SEQ ID NO: 61530 - DNA, 20 bp, Artificial Sequence
  Synthetic oligonucleotide; AAGAAT chr11 5340338 5340357 5340341 -
aagaaatgataataaataaa

SEQ ID NO: 61531 - DNA, 20 bp, Artificial Sequence
  Synthetic oligonucleotide; TTGAAT chr11 5340279 5340298 5340282 -
tcagtgacaaggaggacagt

SEQ ID NO: 61532 - DNA, 20 bp, Artificial Sequence
  Synthetic oligonucleotide; TTGAGT chr11 5340205 5340224 5340208 -
tttgttcagcctagtttcag

SEQ ID NO: 61533 - DNA, 20 bp, Artificial Sequence
  Synthetic oligonucleotide; GTGAAT chr11 5340147 5340166 5340150 -
atcatctcagttatagatat

SEQ ID NO: 61534 - DNA, 20 bp, Artificial Sequence
  Synthetic oligonucleotide; GTGAAT chr11 5340031 5340050 5340034 -
gcaggaaagttgaccatttg

SEQ ID NO: 61535 - DNA, 20 bp, Artificial Sequence
  Synthetic oligonucleotide; TAGGAT chr11 5339940 5339959 5339943 -
aattcactgagaagatgctg

SEQ ID NO: 61536 - DNA, 20 bp, Artificial Sequence
  Synthetic oligonucleotide; ATGAAT chr11 5339936 5339955 5339939 -
cactgagaagatgctgtagg

SEQ ID NO: 61537 - DNA, 20 bp, Artificial Sequence
  Synthetic oligonucleotide; ATGAGT chr11 5339656 5339675 5339659 -
aataccacgtgttctcactt

SEQ ID NO: 61538 - DNA, 20 bp, Artificial Sequence
  Synthetic oligonucleotide; GAGGAT chr11 5339587 5339606 5339590 -
tcacacactggggcctattg

SEQ ID NO: 61539 - DNA, 20 bp, Artificial Sequence
  Synthetic oligonucleotide; GAGGGT chr11 5339580 5339599 5339583 -
ctggggcctattggaggatg

SEQ ID NO: 61540 - DNA, 20 bp, Artificial Sequence
  Synthetic oligonucleotide; GAGGAT chr11 5339563 5339582 5339566 -
atggagggtgaaaggaggga

SEQ ID NO: 61541 - DNA, 20 bp, Artificial Sequence
  Synthetic oligonucleotide; AAGGGT chr11 5339542 5339561 5339545 -
aggatcaggaaaagtaacaa

SEQ ID NO: 61542 - DNA, 20 bp, Artificial Sequence
  Synthetic oligonucleotide; CTGAGT chr11 5339522 5339541 5339525 -
aagggtactaggcttaatac

SEQ ID NO: 61543 - DNA, 20 bp, Artificial Sequence
  Synthetic oligonucleotide; GTGAGT chr11 5339518 5339537 5339521 -
gtactaggcttaatacctga

SEQ ID NO: 61544 - DNA, 20 bp, Artificial Sequence
  Synthetic oligonucleotide; ATGAAT chr11 5339371 5339390 5339374 -
tctcctaggaaacactgcac

SEQ ID NO: 61545 - DNA, 20 bp, Artificial Sequence
  Synthetic oligonucleotide; AAGAGT chr11 5339352 5339371 5339355 -
catgaatttgtattcataag

SEQ ID NO: 61546 - DNA, 20 bp, Artificial Sequence
  Synthetic oligonucleotide; TAGAAT chr11 5339347 5339366 5339350 -
atttgtattcataagaagag

SEQ ID NO: 61547 - DNA, 20 bp, Artificial Sequence
  Synthetic oligonucleotide; CAGAGT chr11 5339340 5339359 5339343 -
ttcataagaagagtagaatt

SEQ ID NO: 61548 - DNA, 20 bp, Artificial Sequence
  Synthetic oligonucleotide; AAGAAT chr11 5339248 5339267 5339251 -
tcatcattcaagactgaaag

SEQ ID NO: 61549 - DNA, 20 bp, Artificial Sequence
  Synthetic oligonucleotide; AGGAAT chr11 5339215 5339234 5339218 -
atatagagaaggacctcatg

SEQ ID NO: 61550 - DNA, 20 bp, Artificial Sequence
  Synthetic oligonucleotide; AAGAAT chr11 5339146 5339165 5339149 -
atgggaaatctaaggtgtaa

SEQ ID NO: 61551 - DNA, 20 bp, Artificial Sequence
  Synthetic oligonucleotide; AGGGAT chr11 5339063 5339082 5339066 -
cttgtgtagtatgggcttga

SEQ ID NO: 61552 - DNA, 20 bp, Artificial Sequence
  Synthetic oligonucleotide; AAGAAT chr11 5339047 5339066 5339050 -
ttgaagggataacataccat

SEQ ID NO: 61553 - DNA, 20 bp, Artificial Sequence
  Synthetic oligonucleotide; TTGAGT chr11 5339034 5339053 5339037 -
ataccataagaatatttaat

SEQ ID NO: 61554 - DNA, 20 bp, Artificial Sequence
  Synthetic oligonucleotide; AAGAAT chr11 5338958 5338977 5338961 -
aaatgattaagaagacgtgg

SEQ ID NO: 61555 - DNA, 20 bp, Artificial Sequence
  Synthetic oligonucleotide; ATGAGT chr11 5338918 5338937 5338921 -
gaaaaaatatgtatggtcta

SEQ ID NO: 61556 - DNA, 20 bp, Artificial Sequence
  Synthetic oligonucleotide; ATGAAT chr11 5338884 5338903 5338887 -
cacttttcctcccatataaa

SEQ ID NO: 61557 - DNA, 20 bp, Artificial Sequence
  Synthetic oligonucleotide; CTGGGT chr11 5338825 5338844 5338828 -
ctctcattaacaaataattg

SEQ ID NO: 61558 - DNA, 20 bp, Artificial Sequence
  Synthetic oligonucleotide; TAGGGT chr11 5338793 5338812 5338796 -
accagagatgcagattttta

SEQ ID NO: 61559 - DNA, 20 bp, Artificial Sequence
  Synthetic oligonucleotide; ATGAGT chr11 5338747 5338766 5338750 -
aaagatacttactagattat

SEQ ID NO: 61560 - DNA, 20 bp, Artificial Sequence
  Synthetic oligonucleotide; AAGGAT chr11 5338726 5338745 5338729 -
tgagtattaaattgggcagc

SEQ ID NO: 61561 - DNA, 20 bp, Artificial Sequence
  Synthetic oligonucleotide; AAGAAT chr11 5338677 5338696 5338680 -
gaggtctccatgtccaatta

SEQ ID NO: 61562 - DNA, 20 bp, Artificial Sequence
  Synthetic oligonucleotide; AGGAGT chr11 5338579 5338598 5338582 -
atttattttatgggaaattt

SEQ ID NO: 61563 - DNA, 20 bp, Artificial Sequence
  Synthetic oligonucleotide; TAGAAT chr11 5338462 5338481 5338465 -
gtcatggttctccagaaaaa

SEQ ID NO: 61564 - DNA, 20 bp, Artificial Sequence
  Synthetic oligonucleotide; CAGGAT chr11 5338453 5338472 5338456 -
ctccagaaaaatagaatcaa

SEQ ID NO: 61565 - DNA, 20 bp, Artificial Sequence
  Synthetic oligonucleotide; CAGAAT chr11 5338358 5338377 5338361 -
agacacactgactaatggaa

SEQ ID NO: 61566 - DNA, 20 bp, Artificial Sequence
  Synthetic oligonucleotide; AGGGAT chr11 5338276 5338295 5338279 -
gtaaaaacaagtaatgggga

SEQ ID NO: 61567 - DNA, 20 bp, Artificial Sequence
  Synthetic oligonucleotide; GTGGGT chr11 5337954 5337973 5337957 -
cagcactttgggaggccaag

SEQ ID NO: 61568 - DNA, 20 bp, Artificial Sequence
  Synthetic oligonucleotide; GTGGAT chr11 5337950 5337969 5337953 -
actttgggaggccaaggtgg

SEQ ID NO: 61569 - DNA, 20 bp, Artificial Sequence
  Synthetic oligonucleotide; GGGAGT chr11 5337933 5337952 5337936 -
tgggtggatcacttgaggtg

SEQ ID NO: 61570 - DNA, 20 bp, Artificial Sequence
  Synthetic oligonucleotide; CTGGGT chr11 5337867 5337886 5337870 -
ctaaaaatacaaaaaatgtg

SEQ ID NO: 61571 - DNA, 20 bp, Artificial Sequence
  Synthetic oligonucleotide; GAGAAT chr11 5337814 5337833 5337817 -
tactcaggaggctgaggcag

SEQ ID NO: 61572 - DNA, 20 bp, Artificial Sequence
  Synthetic oligonucleotide; ATGGGT chr11 5337749 5337768 5337752 -
tcgcaccactgcactctagc

SEQ ID NO: 61573 - DNA, 20 bp, Artificial Sequence
  Synthetic oligonucleotide; AAGAGT chr11 5337741 5337760 5337744 -
ctgcactctagcatgggtga

SEQ ID NO: 61574 - DNA, 20 bp, Artificial Sequence
  Synthetic oligonucleotide; CAGAAT chr11 5337644 5337663 5337647 -
cagagcgaacaggcaaccta

SEQ ID NO: 61575 - DNA, 20 bp, Artificial Sequence
  Synthetic oligonucleotide; CAGAAT chr11 5337592 5337611 5337595 -
tctgacaaaggtctaatatc

SEQ ID NO: 61576 - DNA, 20 bp, Artificial Sequence
  Synthetic oligonucleotide; CAGAAT chr11 5337392 5337411 5337395 -
aaataccatctgacaccagt

SEQ ID NO: 61577 - DNA, 20 bp, Artificial Sequence
  Synthetic oligonucleotide; CTGGGT chr11 5337216 5337235 5337219 -
ttgacctcacaatcccatta

SEQ ID NO: 61578 - DNA, 20 bp, Artificial Sequence
  Synthetic oligonucleotide; AGGAGT chr11 5337200 5337219 5337203 -
attactgggtatatacctaa

SEQ ID NO: 61579 - DNA, 20 bp, Artificial Sequence
  Synthetic oligonucleotide; TAGAAT chr11 5337123 5337142 5337126 -
tattcacaatagcaaagaca

SEQ ID NO: 61580 - DNA, 20 bp, Artificial Sequence
  Synthetic oligonucleotide; AGGGAT chr11 5337038 5337057 5337041 -
aatactatctaaccataaaa

SEQ ID NO: 61581 - DNA, 20 bp, Artificial Sequence
  Synthetic oligonucleotide; ATGGAT chr11 5337009 5337028 5337012 -
atcatgccctttgctgggac

SEQ ID NO: 61582 - DNA, 20 bp, Artificial Sequence
  Synthetic oligonucleotide; GAGAAT chr11 5336913 5336932 5336916 -
agaagtgggagctgaacaat

SEQ ID NO: 61583 - DNA, 20 bp, Artificial Sequence
  Synthetic oligonucleotide; TGGGGT chr11 5336853 5336872 5336856 -
cactggagcctgtcagggca

SEQ ID NO: 61584 - DNA, 20 bp, Artificial Sequence
  Synthetic oligonucleotide; ATGGGT chr11 5336788 5336807 5336791 -
ctgggcttaacacctaggtg

SEQ ID NO: 61585 - DNA, 20 bp, Artificial Sequence
  Synthetic oligonucleotide; TTGAAT chr11 5336688 5336707 5336691 -
gaacttaaaaattaaaaaaa

SEQ ID NO: 61586 - DNA, 20 bp, Artificial Sequence
  Synthetic oligonucleotide; CAGAGT chr11 5336541 5336560 5336544 -
aaggcaagtcccaagatatg

SEQ ID NO: 61587 - DNA, 20 bp, Artificial Sequence
  Synthetic oligonucleotide; GTGAGT chr11 5336537 5336556 5336540 -
caagtcccaagatatgcaga

SEQ ID NO: 61588 - DNA, 20 bp, Artificial Sequence
  Synthetic oligonucleotide; GAGGAT chr11 5336462 5336481 5336465 -
tctgaaggcctgggaaacag

SEQ ID NO: 61589 - DNA, 20 bp, Artificial Sequence
  Synthetic oligonucleotide; AGGAAT chr11 5336339 5336358 5336342 -
cagtttgaaggccatcaata

SEQ ID NO: 61590 - DNA, 20 bp, Artificial Sequence
  Synthetic oligonucleotide; AAGGGT chr11 5336314 5336333 5336317 -
taattctctctgatttgggg

SEQ ID NO: 61591 - DNA, 20 bp, Artificial Sequence
  Synthetic oligonucleotide; TAGAAT chr11 5336178 5336197 5336181 -
aacaccctcacaaaaacatc

SEQ ID NO: 61592 - DNA, 20 bp, Artificial Sequence
  Synthetic oligonucleotide; GAGGAT chr11 5336099 5336118 5336102 -
attaaccatcagagcctgta

SEQ ID NO: 61593 - DNA, 20 bp, Artificial Sequence
  Synthetic oligonucleotide; ATGAGT chr11 5336095 5336114 5336098 -
accatcagagcctgtagagg

SEQ ID NO: 61594 - DNA, 20 bp, Artificial Sequence
  Synthetic oligonucleotide; AAGGAT chr11 5336087 5336106 5336090 -
agcctgtagaggatgagtta

SEQ ID NO: 61595 - DNA, 20 bp, Artificial Sequence
  Synthetic oligonucleotide; TGGAAT chr11 5336082 5336101 5336085 -
gtagaggatgagttaaagga

SEQ ID NO: 61596 - DNA, 20 bp, Artificial Sequence
  Synthetic oligonucleotide; TGGAAT chr11 5336061 5336080 5336064 -
ggaatcttcggagataattg

SEQ ID NO: 61597 - DNA, 20 bp, Artificial Sequence
  Synthetic oligonucleotide; TAGAAT chr11 5336036 5336055 5336039 -
tccagaaggctgacagataa

SEQ ID NO: 61598 - DNA, 20 bp, Artificial Sequence
  Synthetic oligonucleotide; TAGGAT chr11 5335956 5335975 5335959 -
tcaacaaacagcaaaaatcc

SEQ ID NO: 61599 - DNA, 20 bp, Artificial Sequence
  Synthetic oligonucleotide; CTGAAT chr11 5335940 5335959 5335943 -
atcctaggatagagaccttc

SEQ ID NO: 61600 - DNA, 20 bp, Artificial Sequence
  Synthetic oligonucleotide; TTGAAT chr11 5335909 5335928 5335912 -
gcgatataagcttattatac

SEQ ID NO: 61601 - DNA, 20 bp, Artificial Sequence
  Synthetic oligonucleotide; AGGAAT chr11 5335823 5335842 5335826 -
agagctcagaccaagagcca

SEQ ID NO: 61602 - DNA, 20 bp, Artificial Sequence
  Synthetic oligonucleotide; CTGAGT chr11 5335756 5335775 5335759 -
atttctaataatgtggctgc

SEQ ID NO: 61603 - DNA, 20 bp, Artificial Sequence
  Synthetic oligonucleotide; GCGGAT chr11 5335687 5335706 5335690 -
tagaaagagacaggcactca

SEQ ID NO: 61604 - DNA, 20 bp, Artificial Sequence
  Synthetic oligonucleotide; AAGAAT chr11 5335553 5335572 5335556 -
aatacagcaggaaatatgaa

SEQ ID NO: 61605 - DNA, 20 bp, Artificial Sequence
  Synthetic oligonucleotide; ATGAAT chr11 5335526 5335545 5335529 -
aacaaggtcttagaaaatac

SEQ ID NO: 61606 - DNA, 20 bp, Artificial Sequence
  Synthetic oligonucleotide; TTGGGT chr11 5335479 5335498 5335482 -
ttaaggaaatagaagatatt

SEQ ID NO: 61607 - DNA, 20 bp, Artificial Sequence
  Synthetic oligonucleotide; TTGAGT chr11 5335432 5335451 5335435 -
tgcccctaagcttggtgact

SEQ ID NO: 61608 - DNA, 20 bp, Artificial Sequence
  Synthetic oligonucleotide; AGGAAT chr11 5335287 5335306 5335290 -
ctaagataagtgatgtttcc

SEQ ID NO: 61609 - DNA, 20 bp, Artificial Sequence
  Synthetic oligonucleotide; TAGAGT chr11 5335282 5335301 5335285 -
ataagtgatgtttccaggaa

SEQ ID NO: 61610 - DNA, 20 bp, Artificial Sequence
  Synthetic oligonucleotide; GAGGGT chr11 5335238 5335257 5335241 -
gattcgtgtactgccagtga

SEQ ID NO: 61611 - DNA, 20 bp, Artificial Sequence
  Synthetic oligonucleotide; CAGGGT chr11 5335179 5335198 5335182 -
tgaaattaaatcagttatct

SEQ ID NO: 61612 - DNA, 20 bp, Artificial Sequence
  Synthetic oligonucleotide; CAGAAT chr11 5334995 5335014 5334998 -
catttaggaagacctatgag

SEQ ID NO: 61613 - DNA, 20 bp, Artificial Sequence
  Synthetic oligonucleotide; CAGGAT chr11 5334876 5334895 5334879 -
ctcatagttgggctaagttc

SEQ ID NO: 61614 - DNA, 20 bp, Artificial Sequence
  Synthetic oligonucleotide; TAGGAT chr11 5334865 5334884 5334868 -
gctaagttccaggataaatt

SEQ ID NO: 61615 - DNA, 20 bp, Artificial Sequence
  Synthetic oligonucleotide; AGGGAT chr11 5334765 5334784 5334768 -
acaaattgtcagacaaagcc

SEQ ID NO: 61616 - DNA, 20 bp, Artificial Sequence
  Synthetic oligonucleotide; AAGAAT chr11 5334757 5334776 5334760 -
tcagacaaagccagggatta

SEQ ID NO: 61617 - DNA, 20 bp, Artificial Sequence
  Synthetic oligonucleotide; GTGAGT chr11 5334584 5334603 5334587 -
cttatcagcagcactcattt

SEQ ID NO: 61618 - DNA, 20 bp, Artificial Sequence
  Synthetic oligonucleotide; AGGGAT chr11 5334531 5334550 5334534 -
ccaagaaaagattaagtgtg

SEQ ID NO: 61619 - DNA, 20 bp, Artificial Sequence
  Synthetic oligonucleotide; TTGAGT chr11 5334507 5334526 5334510 -
attattaagctttgtctaag

SEQ ID NO: 61620 - DNA, 20 bp, Artificial Sequence
  Synthetic oligonucleotide; CAGGGT chr11 5334487 5334506 5334490 -
ttgagtgagcttattggcta

SEQ ID NO: 61621 - DNA, 20 bp, Artificial Sequence
  Synthetic oligonucleotide; AGGAAT chr11 5334479 5334498 5334482 -
gcttattggctacagggtta

SEQ ID NO: 61622 - DNA, 20 bp, Artificial Sequence
  Synthetic oligonucleotide; GGGAAT chr11 5334435 5334454 5334438 -
ggtatcttctttttgaggtg

SEQ ID NO: 61623 - DNA, 20 bp, Artificial Sequence
  Synthetic oligonucleotide; CTGGAT chr11 5334388 5334407 5334391 -
gatagcatgacttccatgtg

SEQ ID NO: 61624 - DNA, 20 bp, Artificial Sequence
  Synthetic oligonucleotide; TTGAAT chr11 5334232 5334251 5334235 -
acagatactggggaacaatt

SEQ ID NO: 61625 - DNA, 20 bp, Artificial Sequence
  Synthetic oligonucleotide; GAGAAT chr11 5334094 5334113 5334097 -
tcaggctctagtgactatgg

SEQ ID NO: 61626 - DNA, 20 bp, Artificial Sequence
  Synthetic oligonucleotide; TGGAAT chr11 5334089 5334108 5334092 -
ctctagtgactatgggagaa

SEQ ID NO: 61627 - DNA, 20 bp, Artificial Sequence
  Synthetic oligonucleotide; TTGGAT chr11 5334048 5334067 5334051 -
gaaaataaagactaatcttc

SEQ ID NO: 61628 - DNA, 20 bp, Artificial Sequence
  Synthetic oligonucleotide; GAGGGT chr11 5334016 5334035 5334019 -
ccaccacatagttgttgcaa

SEQ ID NO: 61629 - DNA, 20 bp, Artificial Sequence
  Synthetic oligonucleotide; CCGGGT chr11 5333968 5333987 5333971 -
atctgtatctacagattctg

SEQ ID NO: 61630 - DNA, 20 bp, Artificial Sequence
  Synthetic oligonucleotide; ATGGGT chr11 5333888 5333907 5333891 -
aaaaacagtagttttatgtg

SEQ ID NO: 61631 - DNA, 20 bp, Artificial Sequence
  Synthetic oligonucleotide; ATGAAT chr11 5333876 5333895 5333879 -
tttatgtgatgggtgcttac

SEQ ID NO: 61632 - DNA, 20 bp, Artificial Sequence
  Synthetic oligonucleotide; AAGAGT chr11 5333866 5333885 5333869 -
gggtgcttacatgaataatt

SEQ ID NO: 61633 - DNA, 20 bp, Artificial Sequence
  Synthetic oligonucleotide; CTGAGT chr11 5333859 5333878 5333862 -
tacatgaataattaagagtt

SEQ ID NO: 61634 - DNA, 20 bp, Artificial Sequence
  Synthetic oligonucleotide; GGGAGT chr11 5333753 5333772 5333756 -
agaggaaagagactgactct

SEQ ID NO: 61635 - DNA, 20 bp, Artificial Sequence
  Synthetic oligonucleotide; GTGAAT chr11 5333749 5333768 5333752 -
gaaagagactgactctggga

SEQ ID NO: 61636 - DNA, 20 bp, Artificial Sequence
  Synthetic oligonucleotide; CAGGGT chr11 5333740 5333759 5333743 -
tgactctgggagtgaatgtg

SEQ ID NO: 61637 - DNA, 20 bp, Artificial Sequence
  Synthetic oligonucleotide; TGGGGT chr11 5333735 5333754 5333738 -
ctgggagtgaatgtgcaggg

SEQ ID NO: 61638 - DNA, 20 bp, Artificial Sequence
  Synthetic oligonucleotide; TGGAGT chr11 5333362 5333381 5333365 -
aaagtaagcaatgttagtgt

SEQ ID NO: 61639 - DNA, 20 bp, Artificial Sequence
  Synthetic oligonucleotide; GGGAGT chr11 5333356 5333375 5333359 -
agcaatgttagtgttggagt

SEQ ID NO: 61640 - DNA, 20 bp, Artificial Sequence
  Synthetic oligonucleotide; ATGAGT chr11 5333329 5333348 5333332 -
gaaccgtgttttttactaca

SEQ ID NO: 61641 - DNA, 20 bp, Artificial Sequence
  Synthetic oligonucleotide; AAGAAT chr11 5333294 5333313 5333297 -
taggtctgagagactagtaa

SEQ ID NO: 61642 - DNA, 20 bp, Artificial Sequence
  Synthetic oligonucleotide; CTGGGT chr11 5333248 5333267 5333251 -
gctaagttttatgctaaagt

SEQ ID NO: 61643 - DNA, 20 bp, Artificial Sequence
  Synthetic oligonucleotide; TGGGGT chr11 5333225 5333244 5333228 -
ggtgatgcaaaagagacatc

SEQ ID NO: 61644 - DNA, 20 bp, Artificial Sequence
  Synthetic oligonucleotide; AAGGGT chr11 5333170 5333189 5333173 -
tatagaaatagatacaacaa

SEQ ID NO: 61645 - DNA, 20 bp, Artificial Sequence
  Synthetic oligonucleotide; ATGGAT chr11 5333163 5333182 5333166 -
atagatacaacaaaagggtg

SEQ ID NO: 61646 - DNA, 20 bp, Artificial Sequence
  Synthetic oligonucleotide; TAGGAT chr11 5333131 5333150 5333134 -
agaacgacacaggaaaacaa

SEQ ID NO: 61647 - DNA, 20 bp, Artificial Sequence
  Synthetic oligonucleotide; AGGGAT chr11 5333125 5333144 5333128 -
acacaggaaaacaataggat

SEQ ID NO: 61648 - DNA, 20 bp, Artificial Sequence
  Synthetic oligonucleotide; TAGAGT chr11 5333025 5333044 5333028 -
aaataagttgaaccatgcat

SEQ ID NO: 61649 - DNA, 20 bp, Artificial Sequence
  Synthetic oligonucleotide; ATGGAT chr11 5332869 5332888 5332872 -
ctataaactcttaataaaat

SEQ ID NO: 61650 - DNA, 20 bp, Artificial Sequence
  Synthetic oligonucleotide; CTGAGT chr11 5332742 5332761 5332745 -
ctgcactctcataggcttaa

SEQ ID NO: 61651 - DNA, 20 bp, Artificial Sequence
  Synthetic oligonucleotide; TAGGGT chr11 5332728 5332747 5332731 -
gcttaactgagttctctgct

SEQ ID NO: 61652 - DNA, 20 bp, Artificial Sequence
  Synthetic oligonucleotide; AAGAAT chr11 5332663 5332682 5332666 -
cttatccaaaggctctgggg

SEQ ID NO: 61653 - DNA, 20 bp, Artificial Sequence
  Synthetic oligonucleotide; TGGAGT chr11 5332581 5332600 5332584 -
ttttttttttttttttgaga

SEQ ID NO: 61654 - DNA, 20 bp, Artificial Sequence
  Synthetic oligonucleotide; TGGAGT chr11 5332556 5332575 5332559 -
tctcgctctgtcacccagcc

SEQ ID NO: 61655 - DNA, 20 bp, Artificial Sequence
  Synthetic oligonucleotide; CCGGGT chr11 5332511 5332530 5332514 -
ctccctgcaacctgtgcctc

SEQ ID NO: 61656 - DNA, 20 bp, Artificial Sequence
  Synthetic oligonucleotide; AGGGAT chr11 5332418 5332437 5332421 -
taatttttatattttttggt

SEQ ID NO: 61657 - DNA, 20 bp, Artificial Sequence
  Synthetic oligonucleotide; TGGAAT chr11 5332413 5332432 5332416 -
tttatattttttggtaggga

SEQ ID NO: 61658 - DNA, 20 bp, Artificial Sequence
  Synthetic oligonucleotide; TGGGAT chr11 5332334 5332353 5332337 -
gccttggcctcccaaagtgc

SEQ ID NO: 61659 - DNA, 20 bp, Artificial Sequence
  Synthetic oligonucleotide; TTGAAT chr11 5332321 5332340 5332324 -
aaagtgctgggattacaggc

SEQ ID NO: 61660 - DNA, 20 bp, Artificial Sequence
  Synthetic oligonucleotide; CAGAGT chr11 5332295 5332314 5332298 -
gagccattgcacccggctgt

SEQ ID NO: 61661 - DNA, 20 bp, Artificial Sequence
  Synthetic oligonucleotide; TAGGAT chr11 5332209 5332228 5332212 -
tttgtttgcaggctgttagc

SEQ ID NO: 61662 - DNA, 20 bp, Artificial Sequence
  Synthetic oligonucleotide; TTGAAT chr11 5332110 5332129 5332113 -
ccatgaacctttctcaaatt

SEQ ID NO: 61663 - DNA, 20 bp, Artificial Sequence
  Synthetic oligonucleotide; TGGAAT chr11 5332048 5332067 5332051 -
actctgcttttaggggctca

SEQ ID NO: 61664 - DNA, 20 bp, Artificial Sequence
  Synthetic oligonucleotide; CTGAGT chr11 5332028 5332047 5332031 -
tggaattagactaggttccc

SEQ ID NO: 61665 - DNA, 20 bp, Artificial Sequence
  Synthetic oligonucleotide; TAGGAT chr11 5331921 5331940 5331924 -
atattcacagtcctagaaat

SEQ ID NO: 61666 - DNA, 20 bp, Artificial Sequence
  Synthetic oligonucleotide; AAGGGT chr11 5331751 5331770 5331754 -
tgatgaagcacaatgtctga

SEQ ID NO: 61667 - DNA, 20 bp, Artificial Sequence
  Synthetic oligonucleotide; TGGAGT chr11 5331732 5331751 5331735 -
aaagggtggtagaaagcagc

SEQ ID NO: 61668 - DNA, 20 bp, Artificial Sequence
  Synthetic oligonucleotide; GAGGAT chr11 5331719 5331738 5331722 -
aagcagctggagtcgaaact

SEQ ID NO: 61669 - DNA, 20 bp, Artificial Sequence
  Synthetic oligonucleotide; TTGAGT chr11 5331661 5331680 5331664 -
aacagtagcatctggttagc

SEQ ID NO: 61670 - DNA, 20 bp, Artificial Sequence
  Synthetic oligonucleotide; CAGAAT chr11 5331655 5331674 5331658 -
agcatctggttagcttgagt

SEQ ID NO: 61671 - DNA, 20 bp, Artificial Sequence
  Synthetic oligonucleotide; AAGAAT chr11 5331621 5331640 5331624 -
agtgtaaacactcgattttg

SEQ ID NO: 61672 - DNA, 20 bp, Artificial Sequence
  Synthetic oligonucleotide; TGGAGT chr11 5331292 5331311 5331295 -
gtctggagagatttcatcct

SEQ ID NO: 61673 - DNA, 20 bp, Artificial Sequence
  Synthetic oligonucleotide; TGGAGT chr11 5331039 5331058 5331042 -
aatccactccctctctatcg

SEQ ID NO: 61674 - DNA, 20 bp, Artificial Sequence
  Synthetic oligonucleotide; CAGAGT chr11 5331032 5331051 5331035 -
tccctctctatcgtggagtc

SEQ ID NO: 61675 - DNA, 20 bp, Artificial Sequence
  Synthetic oligonucleotide; GGGGGT chr11 5330930 5330949 5330933 -
aaggtggtgaagatagatct

SEQ ID NO: 61676 - DNA, 20 bp, Artificial Sequence
  Synthetic oligonucleotide; GGGGAT chr11 5330916 5330935 5330919 -
agatctgggggttcaaatga

SEQ ID NO: 61677 - DNA, 20 bp, Artificial Sequence
  Synthetic oligonucleotide; CTGGAT chr11 5330874 5330893 5330877 -
gcccataatcatcaccctct

SEQ ID NO: 61678 - DNA, 20 bp, Artificial Sequence
  Synthetic oligonucleotide; GGGAAT chr11 5330688 5330707 5330691 -
ctgatccttaagaaggtcat

SEQ ID NO: 61679 - DNA, 20 bp, Artificial Sequence
  Synthetic oligonucleotide; AAGAAT chr11 5330554 5330573 5330557 -
tgcttcatcaaaaaaatgtt

SEQ ID NO: 61680 - DNA, 20 bp, Artificial Sequence
  Synthetic oligonucleotide; TAGAAT chr11 5330467 5330486 5330470 -
agataccatctcacaccagt

SEQ ID NO: 61681 - DNA, 20 bp, Artificial Sequence
  Synthetic oligonucleotide; GAGGAT chr11 5330423 5330442 5330426 -
agggaacaacaggtgctgga

SEQ ID NO: 61682 - DNA, 20 bp, Artificial Sequence
  Synthetic oligonucleotide; AGGGAT chr11 5330334 5330353 5330337 -
agtcagtgtggcgattcctc

SEQ ID NO: 61683 - DNA, 20 bp, Artificial Sequence
  Synthetic oligonucleotide; CTGGGT chr11 5330289 5330308 5330292 -
ttgacccagccatcccatta

SEQ ID NO: 61684 - DNA, 20 bp, Artificial Sequence
  Synthetic oligonucleotide; ACGGAT chr11 5330274 5330293 5330277 -
cattactgggtatataccca

SEQ ID NO: 61685 - DNA, 20 bp, Artificial Sequence
  Synthetic oligonucleotide; CTGAAT chr11 5330164 5330183 5330167 -
aaatgtccaacaatgataga

SEQ ID NO: 61686 - DNA, 20 bp, Artificial Sequence
  Synthetic oligonucleotide; TGGAAT chr11 5330132 5330151 5330135 -
aatgtggcacatatacacca

SEQ ID NO: 61687 - DNA, 20 bp, Artificial Sequence
  Synthetic oligonucleotide; AAGAGT chr11 5330105 5330124 5330108 -
ctatgcagccataaaaaatg

SEQ ID NO: 61688 - DNA, 20 bp, Artificial Sequence
  Synthetic oligonucleotide; ATGGAT chr11 5330080 5330099 5330083 -
ttcatgtcatttgtagggac

SEQ ID NO: 61689 - DNA, 20 bp, Artificial Sequence
  Synthetic oligonucleotide; GGGAAT chr11 5329998 5330017 5330001 -
gcatgttctcactcataggt

SEQ ID NO: 61690 - DNA, 20 bp, Artificial Sequence
  Synthetic oligonucleotide; ATGGGT chr11 5329872 5329891 5329875 -
taatgctaagtgacaagtta

SEQ ID NO: 61691 - DNA, 20 bp, Artificial Sequence
  Synthetic oligonucleotide; TTGGAT chr11 5329758 5329777 5329761 -
aataataaaaatacattatt

SEQ ID NO: 61692 - DNA, 20 bp, Artificial Sequence
  Synthetic oligonucleotide; TAGAAT chr11 5329677 5329696 5329680 -
ttttgttattctggctctgc

SEQ ID NO: 61693 - DNA, 20 bp, Artificial Sequence
  Synthetic oligonucleotide; TTGAGT chr11 5329662 5329681 5329665 -
tctgctagaattctcttgat

SEQ ID NO: 61694 - DNA, 20 bp, Artificial Sequence
  Synthetic oligonucleotide; GTGAAT chr11 5329395 5329414 5329398 -
ttacacactatttacattct

SEQ ID NO: 61695 - DNA, 20 bp, Artificial Sequence
  Synthetic oligonucleotide; CTGAAT chr11 5329304 5329323 5329307 -
tataattttaagataaaaag

SEQ ID NO: 61696 - DNA, 20 bp, Artificial Sequence
  Synthetic oligonucleotide; GAGGGT chr11 5329244 5329263 5329247 -
cagcactttgggaggccaag

SEQ ID NO: 61697 - DNA, 20 bp, Artificial Sequence
  Synthetic oligonucleotide; GTGGAT chr11 5329240 5329259 5329243 -
actttgggaggccaaggagg

SEQ ID NO: 61698 - DNA, 20 bp, Artificial Sequence
  Synthetic oligonucleotide; CTGGGT chr11 5329160 5329179 5329163 -
actaaaaatacaaaaattag

SEQ ID NO: 61699 - DNA, 20 bp, Artificial Sequence
  Synthetic oligonucleotide; GAGAAT chr11 5329107 5329126 5329110 -
ttctcaggaggctgtggcag

SEQ ID NO: 61700 - DNA, 20 bp, Artificial Sequence
  Synthetic oligonucleotide; TGGAGT chr11 5329084 5329103 5329087 -
aatcacttgaacctgggagg

SEQ ID NO: 61701 - DNA, 20 bp, Artificial Sequence
  Synthetic oligonucleotide; CAGAGT chr11 5329035 5329054 5329038 -
actgcactccagcctggcga

SEQ ID NO: 61702 - DNA, 20 bp, Artificial Sequence
  Synthetic oligonucleotide; CTGAAT chr11 5328988 5329007 5328991 -
aaaaaaaaaaaaaaaaaaag

SEQ ID NO: 61703 - DNA, 20 bp, Artificial Sequence
  Synthetic oligonucleotide; ATGAAT chr11 5328979 5328998 5328982 -
aaaaaaaaaagctgaatgtc

SEQ ID NO: 61704 - DNA, 20 bp, Artificial Sequence
  Synthetic oligonucleotide; TGGAAT chr11 5328889 5328908 5328892 -
aggaaagacaaaaacgcaat

SEQ ID NO: 61705 - DNA, 20 bp, Artificial Sequence
  Synthetic oligonucleotide; TTGGGT chr11 5328785 5328804 5328788 -
agttatgatgctgagcctcc

SEQ ID NO: 61706 - DNA, 20 bp, Artificial Sequence
  Synthetic oligonucleotide; TTGAAT chr11 5328735 5328754 5328738 -
tatcttacatcagctggttt

SEQ ID NO: 61707 - DNA, 20 bp, Artificial Sequence
  Synthetic oligonucleotide; AGGGGT chr11 5328623 5328642 5328626 -
aagagagggaagggagatca

SEQ ID NO: 61708 - DNA, 20 bp, Artificial Sequence
  Synthetic oligonucleotide; GTGAGT chr11 5328534 5328553 5328537 -
tgaggcctcatgagaggtct

SEQ ID NO: 61709 - DNA, 20 bp, Artificial Sequence
  Synthetic oligonucleotide; GTGAAT chr11 5328530 5328549 5328533 -
gcctcatgagaggtctgtga

SEQ ID NO: 61710 - DNA, 20 bp, Artificial Sequence
  Synthetic oligonucleotide; CTGAGT chr11 5328516 5328535 5328519 -
ctgtgagtgaatgatctgaa

SEQ ID NO: 61711 - DNA, 20 bp, Artificial Sequence
  Synthetic oligonucleotide; AGGAAT chr11 5328497 5328516 5328500 -
actgagtcctcaaagaggac

SEQ ID NO: 61712 - DNA, 20 bp, Artificial Sequence
  Synthetic oligonucleotide; GTGAGT chr11 5328466 5328485 5328469 -
cctattttagccacaatact

SEQ ID NO: 61713 - DNA, 20 bp, Artificial Sequence
  Synthetic oligonucleotide; GTGGGT chr11 5328462 5328481 5328465 -
ttttagccacaatactgtga

SEQ ID NO: 61714 - DNA, 20 bp, Artificial Sequence
  Synthetic oligonucleotide; GTGAGT chr11 5328458 5328477 5328461 -
agccacaatactgtgagtgg

SEQ ID NO: 61715 - DNA, 20 bp, Artificial Sequence
  Synthetic oligonucleotide; TTGAAT chr11 5328443 5328462 5328446 -
agtgggtgagtgccaggaac

SEQ ID NO: 61716 - DNA, 20 bp, Artificial Sequence
  Synthetic oligonucleotide; TGGAAT chr11 5328436 5328455 5328439 -
gagtgccaggaacttgaata

SEQ ID NO: 61717 - DNA, 20 bp, Artificial Sequence
  Synthetic oligonucleotide; TGGGAT chr11 5328337 5328356 5328340 -
ggtaaagatcacagctgagg

SEQ ID NO: 61718 - DNA, 20 bp, Artificial Sequence
  Synthetic oligonucleotide; AAGAGT chr11 5328296 5328315 5328299 -
tttttttttttcttttttga

SEQ ID NO: 61719 - DNA, 20 bp, Artificial Sequence
  Synthetic oligonucleotide; TTGGAT chr11 5328246 5328265 5328249 -
ggttttctaatctgggaccc

SEQ ID NO: 61720 - DNA, 20 bp, Artificial Sequence
  Synthetic oligonucleotide; GAGAAT chr11 5328147 5328166 5328150 -
tgtttatagcttttttttca

SEQ ID NO: 61721 - DNA, 20 bp, Artificial Sequence
  Synthetic oligonucleotide; AGGAAT chr11 5327994 5328013 5327997 -
tttgaaaataagaagcagaa

SEQ ID NO: 61722 - DNA, 20 bp, Artificial Sequence
  Synthetic oligonucleotide; GAGGAT chr11 5327806 5327825 5327809 -
attgataactttcctgttca

SEQ ID NO: 61723 - DNA, 20 bp, Artificial Sequence
  Synthetic oligonucleotide; AAGAGT chr11 5327777 5327796 5327780 -
ttgttgatagtttttctctg

SEQ ID NO: 61724 - DNA, 20 bp, Artificial Sequence
  Synthetic oligonucleotide; CTGAAT chr11 5327759 5327778 5327762 -
tgaagagtagacaaaaaatt

SEQ ID NO: 61725 - DNA, 20 bp, Artificial Sequence
  Synthetic oligonucleotide; TCGAGT chr11 5327754 5327773 5327757 -
agtagacaaaaaattctgaa

SEQ ID NO: 61726 - DNA, 20 bp, Artificial Sequence
  Synthetic oligonucleotide; TTGGAT chr11 5327701 5327720 5327704 -
ttaagatctaagaaagcaaa

SEQ ID NO: 61727 - DNA, 20 bp, Artificial Sequence
  Synthetic oligonucleotide; CTGGGT chr11 5327653 5327672 5327656 -
gcagatgataatatattgga

SEQ ID NO: 61728 - DNA, 20 bp, Artificial Sequence
  Synthetic oligonucleotide; AGGAAT chr11 5327634 5327653 5327637 -
actgggttggagaaggcagg

SEQ ID NO: 61729 - DNA, 20 bp, Artificial Sequence
  Synthetic oligonucleotide; GAGAGT chr11 5327604 5327623 5327607 -
cttgtggacaatagaaatct

SEQ ID NO: 61730 - DNA, 20 bp, Artificial Sequence
  Synthetic oligonucleotide; TTGGGT chr11 5327599 5327618 5327602 -
ggacaatagaaatctgagag

SEQ ID NO: 61731 - DNA, 20 bp, Artificial Sequence
  Synthetic oligonucleotide; CGGAGT chr11 5327512 5327531 5327515 -
aaagacaatgcgtgagagca

SEQ ID NO: 61732 - DNA, 20 bp, Artificial Sequence
  Synthetic oligonucleotide; ATGAGT chr11 5327329 5327348 5327332 -
gaactgctctaagagatggc

SEQ ID NO: 61733 - DNA, 20 bp, Artificial Sequence
  Synthetic oligonucleotide; CAGAGT chr11 5327230 5327249 5327233 -
catccaactcagaaggaggg

SEQ ID NO: 61734 - DNA, 20 bp, Artificial Sequence
  Synthetic oligonucleotide; AGGAAT chr11 5327199 5327218 5327202 -
atgagaagatgagggaaagg

SEQ ID NO: 61735 - DNA, 20 bp, Artificial Sequence
  Synthetic oligonucleotide; GAGAGT chr11 5326970 5326989 5326973 -
atgtatttatgcatcttggt

SEQ ID NO: 61736 - DNA, 20 bp, Artificial Sequence
  Synthetic oligonucleotide; AGGAAT chr11 5326950 5326969 5326953 -
gagagtgttgctacaagtat

SEQ ID NO: 61737 - DNA, 20 bp, Artificial Sequence
  Synthetic oligonucleotide; TAGAAT chr11 5326892 5326911 5326895 -
attcaggtcaatagaacatc

SEQ ID NO: 61738 - DNA, 20 bp, Artificial Sequence
  Synthetic oligonucleotide; TAGAAT chr11 5326881 5326900 5326884 -
tagaacatctagaatgaagc

SEQ ID NO: 61739 - DNA, 20 bp, Artificial Sequence
  Synthetic oligonucleotide; ATGGAT chr11 5326831 5326850 5326834 -
tttctcaagttttcagcatt

SEQ ID NO: 61740 - DNA, 20 bp, Artificial Sequence
  Synthetic oligonucleotide; GAGAAT chr11 5326781 5326800 5326784 -
attctgcataaaattgaagg

SEQ ID NO: 61741 - DNA, 20 bp, Artificial Sequence
  Synthetic oligonucleotide; GTGAAT chr11 5326607 5326626 5326610 -
acttgtcccagatggtattg

SEQ ID NO: 61742 - DNA, 20 bp, Artificial Sequence
  Synthetic oligonucleotide; CTGAGT chr11 5326488 5326507 5326491 -
aatcactaaacatttatgtt

SEQ ID NO: 61743 - DNA, 20 bp, Artificial Sequence
  Synthetic oligonucleotide; CTGAAT chr11 5326372 5326391 5326375 -
cttgttaatagctaagccat

SEQ ID NO: 61744 - DNA, 20 bp, Artificial Sequence
  Synthetic oligonucleotide; TGGAAT chr11 5326367 5326386 5326370 -
taatagctaagccatctgaa

SEQ ID NO: 61745 - DNA, 20 bp, Artificial Sequence
  Synthetic oligonucleotide; TAGAAT chr11 5326258 5326277 5326261 -
atgacagtatctagctctcc

SEQ ID NO: 61746 - DNA, 20 bp, Artificial Sequence
  Synthetic oligonucleotide; CTGGGT chr11 5326236 5326255 5326239 -
gaatccccacacgcctgcct

SEQ ID NO: 61747 - DNA, 20 bp, Artificial Sequence
  Synthetic oligonucleotide; AGGAAT chr11 5325897 5325916 5325900 -
ccttacacaattttttttaa

SEQ ID NO: 61748 - DNA, 20 bp, Artificial Sequence
  Synthetic oligonucleotide; CAGAAT chr11 5325788 5325807 5325791 -
tttcttctatgtttaccctt

SEQ ID NO: 61749 - DNA, 20 bp, Artificial Sequence
  Synthetic oligonucleotide; AAGGAT chr11 5325683 5325702 5325686 -
aatctgtgtttttaagcatg

SEQ ID NO: 61750 - DNA, 20 bp, Artificial Sequence
  Synthetic oligonucleotide; ATGAAT chr11 5325626 5325645 5325629 -
attataattcagtcttctat

SEQ ID NO: 61751 - DNA, 20 bp, Artificial Sequence
  Synthetic oligonucleotide; AGGGAT chr11 5325602 5325621 5325605 -
attcaatgtgatttaatttt

SEQ ID NO: 61752 - DNA, 20 bp, Artificial Sequence
  Synthetic oligonucleotide; CAGGAT chr11 5325409 5325428 5325412 -
aggtgctaaagacttgcctc

SEQ ID NO: 61753 - DNA, 20 bp, Artificial Sequence
  Synthetic oligonucleotide; CTGAAT chr11 5325402 5325421 5325405 -
aaagacttgcctccaggatt

SEQ ID NO: 61754 - DNA, 20 bp, Artificial Sequence
  Synthetic oligonucleotide; TTGGAT chr11 5325334 5325353 5325337 -
ttctttctcccatacccctc

SEQ ID NO: 61755 - DNA, 20 bp, Artificial Sequence
  Synthetic oligonucleotide; AGGAGT chr11 5325230 5325249 5325233 -
cagaactgcaacagttcctc

SEQ ID NO: 61756 - DNA, 20 bp, Artificial Sequence
  Synthetic oligonucleotide; TGGAGT chr11 5325223 5325242 5325226 -
gcaacagttcctcaggagtt

SEQ ID NO: 61757 - DNA, 20 bp, Artificial Sequence
  Synthetic oligonucleotide; CTGGAT chr11 5325051 5325070 5325054 -
ggagaaaatgagaaaatcaa

SEQ ID NO: 61758 - DNA, 20 bp, Artificial Sequence
  Synthetic oligonucleotide; ATGGAT chr11 5325015 5325034 5325018 -
aaaggtttctatctcgaaag

SEQ ID NO: 61759 - DNA, 20 bp, Artificial Sequence
  Synthetic oligonucleotide; TGGAAT chr11 5324962 5324981 5324965 -
gcccagacattgttttgcac

SEQ ID NO: 61760 - DNA, 20 bp, Artificial Sequence
  Synthetic oligonucleotide; GCGAAT chr11 5324936 5324955 5324939 -
cacctgaggacctgaaaaaa

SEQ ID NO: 61761 - DNA, 20 bp, Artificial Sequence
  Synthetic oligonucleotide; CAGAAT chr11 5324924 5324943 5324927 -
tgaaaaaagcgaatttgatt

SEQ ID NO: 61762 - DNA, 20 bp, Artificial Sequence
  Synthetic oligonucleotide; CAGAAT chr11 5324907 5324926 5324910 -
attcagaatgttggaagggg

SEQ ID NO: 61763 - DNA, 20 bp, Artificial Sequence
  Synthetic oligonucleotide; TAGAGT chr11 5324813 5324832 5324816 -
ggccaagctcaagtaactgt

SEQ ID NO: 61764 - DNA, 20 bp, Artificial Sequence
  Synthetic oligonucleotide; GCGGAT chr11 5324532 5324551 5324535 -
taagtaccctcaaaatagtt

SEQ ID NO: 61765 - DNA, 20 bp, Artificial Sequence
  Synthetic oligonucleotide; TTGAAT chr11 5324499 5324518 5324502 -
ttaaaattaatgaaaaattt

SEQ ID NO: 61766 - DNA, 20 bp, Artificial Sequence
  Synthetic oligonucleotide; CAGAGT chr11 5324401 5324420 5324404 -
cttcttcaggaaaatagttg

SEQ ID NO: 61767 - DNA, 20 bp, Artificial Sequence
  Synthetic oligonucleotide; GTGGAT chr11 5324309 5324328 5324312 -
aagaaatctgatctttaccg

SEQ ID NO: 61768 - DNA, 20 bp, Artificial Sequence
  Synthetic oligonucleotide; CTGGAT chr11 5324230 5324249 5324233 -
gggctggaggcagctcatca

SEQ ID NO: 61769 - DNA, 20 bp, Artificial Sequence
  Synthetic oligonucleotide; ATGGGT chr11 5324050 5324069 5324053 -
cctactgtaatgggcatcct

SEQ ID NO: 61770 - DNA, 20 bp, Artificial Sequence
  Synthetic oligonucleotide; GTGAAT chr11 5324046 5324065 5324049 -
ctgtaatgggcatcctatgg

SEQ ID NO: 61771 - DNA, 20 bp, Artificial Sequence
  Synthetic oligonucleotide; TGGAAT chr11 5323976 5323995 5323979 -
tattcactccctttctgttg

SEQ ID NO: 61772 - DNA, 20 bp, Artificial Sequence
  Synthetic oligonucleotide; TAGAGT chr11 5323888 5323907 5323891 -
gcttccattctcaccaatac

SEQ ID NO: 61773 - DNA, 20 bp, Artificial Sequence
  Synthetic oligonucleotide; AGGAGT chr11 5323873 5323892 5323876 -
aatactagagtcatagcgtt

SEQ ID NO: 61774 - DNA, 20 bp, Artificial Sequence
  Synthetic oligonucleotide; GGGAGT chr11 5323867 5323886 5323870 -
agagtcatagcgttaggagt

SEQ ID NO: 61775 - DNA, 20 bp, Artificial Sequence
  Synthetic oligonucleotide; AGGGGT chr11 5323854 5323873 5323857 -
taggagtgggagtgtttcta

SEQ ID NO: 61776 - DNA, 20 bp, Artificial Sequence
  Synthetic oligonucleotide; ATGGGT chr11 5323539 5323558 5323542 -
ttatcttctatgttacagtg

SEQ ID NO: 61777 - DNA, 20 bp, Artificial Sequence
  Synthetic oligonucleotide; AAGAAT chr11 5323509 5323528 5323512 -
cattcatttacagatttggg

SEQ ID NO: 61778 - DNA, 20 bp, Artificial Sequence
  Synthetic oligonucleotide; ATGAGT chr11 5323479 5323498 5323482 -
cagaggttgtccacattatc

SEQ ID NO: 61779 - DNA, 20 bp, Artificial Sequence
  Synthetic oligonucleotide; TCGGAT chr11 5323357 5323376 5323360 -
cataggtttagtagttaaac

SEQ ID NO: 61780 - DNA, 20 bp, Artificial Sequence
  Synthetic oligonucleotide; GAGAAT chr11 5323348 5323367 5323351 -
agtagttaaactcggatctg

SEQ ID NO: 61781 - DNA, 20 bp, Artificial Sequence
  Synthetic oligonucleotide; CAGAAT chr11 5323318 5323337 5323321 -
cacagacataaaaatgaagc

SEQ ID NO: 61782 - DNA, 20 bp, Artificial Sequence
  Synthetic oligonucleotide; TGGAGT chr11 5323298 5323317 5323301 -
cagaatgaaaaatgaaagcc

SEQ ID NO: 61783 - DNA, 20 bp, Artificial Sequence
  Synthetic oligonucleotide; AAGGGT chr11 5323274 5323293 5323277 -
gttctttcttagcaaagagc

SEQ ID NO: 61784 - DNA, 20 bp, Artificial Sequence
  Synthetic oligonucleotide; TAGGGT chr11 5323220 5323239 5323223 -
aggacttaagtactttacca

SEQ ID NO: 61785 - DNA, 20 bp, Artificial Sequence
  Synthetic oligonucleotide; CTGAAT chr11 5323177 5323196 5323180 -
agaagtctggtgacagaaca

SEQ ID NO: 61786 - DNA, 20 bp, Artificial Sequence
  Synthetic oligonucleotide; CTGAGT chr11 5322840 5322859 5322843 -
tcttttaactgtcctctacc

SEQ ID NO: 61787 - DNA, 20 bp, Artificial Sequence
  Synthetic oligonucleotide; TAGGGT chr11 5322834 5322853 5322837 -
aactgtcctctaccctgagt

SEQ ID NO: 61788 - DNA, 20 bp, Artificial Sequence
  Synthetic oligonucleotide; CAGAGT chr11 5322770 5322789 5322773 -
atacagtcgtaagtcactta

SEQ ID NO: 61789 - DNA, 20 bp, Artificial Sequence
  Synthetic oligonucleotide; CAGGAT chr11 5322725 5322744 5322728 -
aattttcaatacattccttg

SEQ ID NO: 61790 - DNA, 20 bp, Artificial Sequence
  Synthetic oligonucleotide; CTGGAT chr11 5322717 5322736 5322720 -
atacattccttgcaggatgt

SEQ ID NO: 61791 - DNA, 20 bp, Artificial Sequence
  Synthetic oligonucleotide; GTGAGT chr11 5322598 5322617 5322601 -
agctcgtaaaaaagtaaaaa

SEQ ID NO: 61792 - DNA, 20 bp, Artificial Sequence
  Synthetic oligonucleotide; AAGAGT chr11 5322588 5322607 5322591 -
aaagtaaaaagtgagttttt

SEQ ID NO: 61793 - DNA, 20 bp, Artificial Sequence
  Synthetic oligonucleotide; AAGGGT chr11 5322529 5322548 5322532 -
tcccttggcctaataatagg

SEQ ID NO: 61794 - DNA, 20 bp, Artificial Sequence
  Synthetic oligonucleotide; TAGAAT chr11 5322487 5322506 5322490 -
aatagaaaatatagccattc

SEQ ID NO: 61795 - DNA, 20 bp, Artificial Sequence
  Synthetic oligonucleotide; ATGGAT chr11 5322328 5322347 5322331 -
gaccaacaatgttgagagaa

SEQ ID NO: 61796 - DNA, 20 bp, Artificial Sequence
  Synthetic oligonucleotide; AGGAGT chr11 5322287 5322306 5322290 -
gactaaaaaattgtggtggg

SEQ ID NO: 61797 - DNA, 20 bp, Artificial Sequence
  Synthetic oligonucleotide; CAGGAT chr11 5322229 5322248 5322232 -
agactgatttaattgtgaaa

SEQ ID NO: 61798 - DNA, 20 bp, Artificial Sequence
  Synthetic oligonucleotide; CAGAGT chr11 5322187 5322206 5322190 -
caaaaggggaaaacctatct

SEQ ID NO: 61799 - DNA, 20 bp, Artificial Sequence
  Synthetic oligonucleotide; CTGAAT chr11 5322160 5322179 5322163 -
taatgttcaagttattgatg

SEQ ID NO: 61800 - DNA, 20 bp, Artificial Sequence
  Synthetic oligonucleotide; TCGGAT chr11 5322045 5322064 5322048 -
cttaatggaaaaatctcatt

SEQ ID NO: 61801 - DNA, 20 bp, Artificial Sequence
  Synthetic oligonucleotide; GAGGAT chr11 5321876 5321895 5321879 -
ccatctgatatctaaatttt

SEQ ID NO: 61802 - DNA, 20 bp, Artificial Sequence
  Synthetic oligonucleotide; GTGGGT chr11 5321706 5321725 5321709 -
gcatgccttttgtgtatatg

SEQ ID NO: 61803 - DNA, 20 bp, Artificial Sequence
  Synthetic oligonucleotide; GAGGAT chr11 5321699 5321718 5321702 -
ttttgtgtatatggtgggtt

SEQ ID NO: 61804 - DNA, 20 bp, Artificial Sequence
  Synthetic oligonucleotide; CTGAAT chr11 5321673 5321692 5321676 -
atggcaatattgcagcctca

SEQ ID NO: 61805 - DNA, 20 bp, Artificial Sequence
  Synthetic oligonucleotide; TTGGAT chr11 5321646 5321665 5321649 -
ggtataaggaggtgcttact

SEQ ID NO: 61806 - DNA, 20 bp, Artificial Sequence
  Synthetic oligonucleotide; TTGAAT chr11 5321551 5321570 5321554 -
tccttaaactggtttagacg

SEQ ID NO: 61807 - DNA, 20 bp, Artificial Sequence
  Synthetic oligonucleotide; GAGGGT chr11 5321486 5321505 5321489 -
atttttcaaattgattctaa

SEQ ID NO: 61808 - DNA, 20 bp, Artificial Sequence
  Synthetic oligonucleotide; CTGAAT chr11 5321477 5321496 5321480 -
attgattctaagagggtgat

SEQ ID NO: 61809 - DNA, 20 bp, Artificial Sequence
  Synthetic oligonucleotide; ATGAGT chr11 5321131 5321150 5321134 -
ctgttagaaaagaaaatgat

SEQ ID NO: 61810 - DNA, 20 bp, Artificial Sequence
  Synthetic oligonucleotide; CAGGGT chr11 5321116 5321135 5321119 -
atgatatgagtaattttctc

SEQ ID NO: 61811 - DNA, 20 bp, Artificial Sequence
  Synthetic oligonucleotide; GTGAAT chr11 5320997 5321016 5321000 -
caataaataactgttgatta

SEQ ID NO: 61812 - DNA, 20 bp, Artificial Sequence
  Synthetic oligonucleotide; TAGAAT chr11 5320849 5320868 5320852 -
ctcagttctattctaagtca

SEQ ID NO: 61813 - DNA, 20 bp, Artificial Sequence
  Synthetic oligonucleotide; TTGAAT chr11 5320490 5320509 5320493 -
atacttccttaatgtatatt

SEQ ID NO: 61814 - DNA, 20 bp, Artificial Sequence
  Synthetic oligonucleotide; TTGAAT chr11 5320470 5320489 5320473 -
ttgaataaaattatttttat

SEQ ID NO: 61815 - DNA, 20 bp, Artificial Sequence
  Synthetic oligonucleotide; ATGAAT chr11 5320204 5320223 5320207 -
cgtagtaatgatagtgttgt

SEQ ID NO: 61816 - DNA, 20 bp, Artificial Sequence
  Synthetic oligonucleotide; TTGGGT chr11 5320167 5320186 5320170 -
attttctttctagtgcctgc

SEQ ID NO: 61817 - DNA, 20 bp, Artificial Sequence
  Synthetic oligonucleotide; TGGGAT chr11 5320100 5320119 5320103 -
ttctttgtggctgttcttaa

SEQ ID NO: 61818 - DNA, 20 bp, Artificial Sequence
  Synthetic oligonucleotide; AAGAAT chr11 5319970 5319989 5319973 -
cagttctagcagccttttgg

SEQ ID NO: 61819 - DNA, 20 bp, Artificial Sequence
  Synthetic oligonucleotide; TAGGAT chr11 5319961 5319980 5319964 -
cagccttttggaagaatctg

SEQ ID NO: 61820 - DNA, 20 bp, Artificial Sequence
  Synthetic oligonucleotide; TAGAGT chr11 5319945 5319964 5319948 -
tctgtaggattttctaagta

SEQ ID NO: 61821 - DNA, 20 bp, Artificial Sequence
  Synthetic oligonucleotide; AGGAGT chr11 5319830 5319849 5319833 -
cttccaattttatgttcact

SEQ ID NO: 61822 - DNA, 20 bp, Artificial Sequence
  Synthetic oligonucleotide; GAGAAT chr11 5319821 5319840 5319824 -
ttatgttcactaggagtggt

SEQ ID NO: 61823 - DNA, 20 bp, Artificial Sequence
  Synthetic oligonucleotide; GGGAAT chr11 5319815 5319834 5319818 -
tcactaggagtggtgagaat

SEQ ID NO: 61824 - DNA, 20 bp, Artificial Sequence
  Synthetic oligonucleotide; GAGAAT chr11 5319785 5319804 5319788 -
gtcttgttgcagttttcgag

SEQ ID NO: 61825 - DNA, 20 bp, Artificial Sequence
  Synthetic oligonucleotide; ATGGGT chr11 5319743 5319762 5319746 -
cattcagtatggttttggtt

SEQ ID NO: 61826 - DNA, 20 bp, Artificial Sequence
  Synthetic oligonucleotide; AGGGAT chr11 5319664 5319683 5319667 -
gttggaggtttttatcatga

SEQ ID NO: 61827 - DNA, 20 bp, Artificial Sequence
  Synthetic oligonucleotide; TTGAAT chr11 5319657 5319676 5319660 -
gtttttatcatgaagggatg

SEQ ID NO: 61828 - DNA, 20 bp, Artificial Sequence
  Synthetic oligonucleotide; ATGGAT chr11 5319510 5319529 5319513 -
aataaaagctttccaggctc

SEQ ID NO: 61829 - DNA, 20 bp, Artificial Sequence
  Synthetic oligonucleotide; AAGAAT chr11 5319501 5319520 5319504 -
tttccaggctcatggattgg

SEQ ID NO: 61830 - DNA, 20 bp, Artificial Sequence
  Synthetic oligonucleotide; ATGAAT chr11 5319491 5319510 5319494 -
catggattggaagaatcaat

SEQ ID NO: 61831 - DNA, 20 bp, Artificial Sequence
  Synthetic oligonucleotide; GTGGGT chr11 5319241 5319260 5319244 -
tagcactttagggggctgag

SEQ ID NO: 61832 - DNA, 20 bp, Artificial Sequence
  Synthetic oligonucleotide; AGGAGT chr11 5319220 5319239 5319223 -
tgggtgtatcacctgaggtc

SEQ ID NO: 61833 - DNA, 20 bp, Artificial Sequence
  Synthetic oligonucleotide; GAGAAT chr11 5319104 5319123 5319107 -
tactcggaaggctgaggcag

SEQ ID NO: 61834 - DNA, 20 bp, Artificial Sequence
  Synthetic oligonucleotide; CTGGGT chr11 5319039 5319058 5319042 -
tcgcaccactgcactccagc

SEQ ID NO: 61835 - DNA, 20 bp, Artificial Sequence
  Synthetic oligonucleotide; CAGAGT chr11 5319031 5319050 5319034 -
ctgcactccagcctgggtga

SEQ ID NO: 61836 - DNA, 20 bp, Artificial Sequence
  Synthetic oligonucleotide; TGGAAT chr11 5318783 5318802 5318786 -
acctatccaataaactgtgc

SEQ ID NO: 61837 - DNA, 20 bp, Artificial Sequence
  Synthetic oligonucleotide; AAGAAT chr11 5318757 5318776 5318760 -
acgtggctagccatatgcag

SEQ ID NO: 61838 - DNA, 20 bp, Artificial Sequence
  Synthetic oligonucleotide; ATGAAT chr11 5318706 5318725 5318709 -
tttagagaaatcaactgaaa

SEQ ID NO: 61839 - DNA, 20 bp, Artificial Sequence
  Synthetic oligonucleotide; TAGAAT chr11 5318524 5318543 5318527 -
acccaaatgtccaacaatga

SEQ ID NO: 61840 - DNA, 20 bp, Artificial Sequence
  Synthetic oligonucleotide; ATGGAT chr11 5318520 5318539 5318523 -
aaatgtccaacaatgataga

SEQ ID NO: 61841 - DNA, 20 bp, Artificial Sequence
  Synthetic oligonucleotide; TGGAAT chr11 5318488 5318507 5318491 -
aatgtggcacatatacacca

SEQ ID NO: 61842 - DNA, 20 bp, Artificial Sequence
  Synthetic oligonucleotide; ATGAGT chr11 5318461 5318480 5318464 -
ctatgcagccataaaaaatg

SEQ ID NO: 61843 - DNA, 20 bp, Artificial Sequence
  Synthetic oligonucleotide; ATGGAT chr11 5318436 5318455 5318439 -
ttcatgtcctttgtagggac

SEQ ID NO: 61844 - DNA, 20 bp, Artificial Sequence
  Synthetic oligonucleotide; GGGAAT chr11 5318354 5318373 5318357 -
acatgttctcacttataggt

SEQ ID NO: 61845 - DNA, 20 bp, Artificial Sequence
  Synthetic oligonucleotide; TGGGGT chr11 5318291 5318310 5318294 -
tcacacaccagggcctgttg

SEQ ID NO: 61846 - DNA, 20 bp, Artificial Sequence
  Synthetic oligonucleotide; GGGGGT chr11 5318285 5318304 5318288 -
accagggcctgttgtggggt

SEQ ID NO: 61847 - DNA, 20 bp, Artificial Sequence
  Synthetic oligonucleotide; GGGGGT chr11 5318278 5318297 5318281 -
cctgttgtggggtgggggtg

SEQ ID NO: 61848 - DNA, 20 bp, Artificial Sequence
  Synthetic oligonucleotide; AGGGAT chr11 5318268 5318287 5318271 -
ggtgggggtggggggtggag

SEQ ID NO: 61849 - DNA, 20 bp, Artificial Sequence
  Synthetic oligonucleotide; ATGAGT chr11 5318233 5318252 5318236 -
agatatacctaatgtaaatg

SEQ ID NO: 61850 - DNA, 20 bp, Artificial Sequence
  Synthetic oligonucleotide; ATGGGT chr11 5318225 5318244 5318228 -
ctaatgtaaatgatgagtta

SEQ ID NO: 61851 - DNA, 20 bp, Artificial Sequence
  Synthetic oligonucleotide; CAGAGT chr11 5318093 5318112 5318096 -
gcagcagaagaaactatcaa

SEQ ID NO: 61852 - DNA, 20 bp, Artificial Sequence
  Synthetic oligonucleotide; CAGGAT chr11 5318073 5318092 5318076 -
cagagtaaactgacaatcta

SEQ ID NO: 61853 - DNA, 20 bp, Artificial Sequence
  Synthetic oligonucleotide; CAGAAT chr11 5318021 5318040 5318024 -
tctggaaaaggtctaatatt

SEQ ID NO: 61854 - DNA, 20 bp, Artificial Sequence
  Synthetic oligonucleotide; AGGAAT chr11 5318010 5318029 5318013 -
tctaatattcagaatctata

SEQ ID NO: 61855 - DNA, 20 bp, Artificial Sequence
  Synthetic oligonucleotide; CAGAAT chr11 5317827 5317846 5317830 -
agatactatctcataccagt

SEQ ID NO: 61856 - DNA, 20 bp, Artificial Sequence
  Synthetic oligonucleotide; GGGGAT chr11 5317747 5317766 5317750 -
aacacttatacaatgatgat

SEQ ID NO: 61857 - DNA, 20 bp, Artificial Sequence
  Synthetic oligonucleotide; GAGAGT chr11 5317707 5317726 5317710 -
ccactgcagaaaacagtttg

SEQ ID NO: 61858 - DNA, 20 bp, Artificial Sequence
  Synthetic oligonucleotide; CTGGGT chr11 5317652 5317671 5317655 -
ttgacacagcaatcccgcta

SEQ ID NO: 61859 - DNA, 20 bp, Artificial Sequence
  Synthetic oligonucleotide; TAGAAT chr11 5317575 5317594 5317578 -
atgttcactgtaatgctgtt

SEQ ID NO: 61860 - DNA, 20 bp, Artificial Sequence
  Synthetic oligonucleotide; CGGGAT chr11 5317527 5317546 5317530 -
aggtgtctatcaaaggcgga

SEQ ID NO: 61861 - DNA, 20 bp, Artificial Sequence
  Synthetic oligonucleotide; ATGGGT chr11 5317447 5317466 5317450 -
atcatgtccttttcagcaac

SEQ ID NO: 61862 - DNA, 20 bp, Artificial Sequence
  Synthetic oligonucleotide; TTGAGT chr11 5317353 5317372 5317356 -
ttataagtggaagctaaaca

SEQ ID NO: 61863 - DNA, 20 bp, Artificial Sequence
  Synthetic oligonucleotide; GTGGAT chr11 5317343 5317362 5317346 -
aagctaaacattgagtacac

SEQ ID NO: 61864 - DNA, 20 bp, Artificial Sequence
  Synthetic oligonucleotide; GAGGGT chr11 5317278 5317297 5317281 -
gggcagggagagatgcggga

SEQ ID NO: 61865 - DNA, 20 bp, Artificial Sequence
  Synthetic oligonucleotide; TTGGAT chr11 5317261 5317280 5317264 -
ggagagggttaaaaaatcta

SEQ ID NO: 61866 - DNA, 20 bp, Artificial Sequence
  Synthetic oligonucleotide; GTGGAT chr11 5317025 5317044 5317028 -
atagatccattgaggttcct

SEQ ID NO: 61867 - DNA, 20 bp, Artificial Sequence
  Synthetic oligonucleotide; ATGGAT chr11 5316872 5316891 5316875 -
agacaatgcaaagtacacac

SEQ ID NO: 61868 - DNA, 20 bp, Artificial Sequence
  Synthetic oligonucleotide; TAGGGT chr11 5316848 5316867 5316851 -
atatactgtgtactgatgct

SEQ ID NO: 61869 - DNA, 20 bp, Artificial Sequence
  Synthetic oligonucleotide; AAGGGT chr11 5316838 5316857 5316841 -
tactgatgcttagggtcctg

SEQ ID NO: 61870 - DNA, 20 bp, Artificial Sequence
  Synthetic oligonucleotide; TGGAGT chr11 5316792 5316811 5316795 -
tcccaatgtagaggtggcat

SEQ ID NO: 61871 - DNA, 20 bp, Artificial Sequence
  Synthetic oligonucleotide; AAGGGT chr11 5316686 5316705 5316689 -
cagaggagggaggggagatc

SEQ ID NO: 61872 - DNA, 20 bp, Artificial Sequence
  Synthetic oligonucleotide; CTGAGT chr11 5316676 5316695 5316679 -
aggggagatcaagggttctt

SEQ ID NO: 61873 - DNA, 20 bp, Artificial Sequence
  Synthetic oligonucleotide; TTGAAT chr11 5316607 5316626 5316610 -
aaactctctaatttggcctc

SEQ ID NO: 61874 - DNA, 20 bp, Artificial Sequence
  Synthetic oligonucleotide; GTGAGT chr11 5316589 5316608 5316592 -
tcttgaatagtctttgagaa

SEQ ID NO: 61875 - DNA, 20 bp, Artificial Sequence
  Synthetic oligonucleotide; CTGAGT chr11 5316576 5316595 5316579 -
ttgagaagtgagtgtctgaa

SEQ ID NO: 61876 - DNA, 20 bp, Artificial Sequence
  Synthetic oligonucleotide; AGGAAT chr11 5316557 5316576 5316560 -
actgagtcttcaaatagagc

SEQ ID NO: 61877 - DNA, 20 bp, Artificial Sequence
  Synthetic oligonucleotide; ATGGGT chr11 5316553 5316572 5316556 -
agtcttcaaatagagcagga

SEQ ID NO: 61878 - DNA, 20 bp, Artificial Sequence
  Synthetic oligonucleotide; GTGAGT chr11 5316517 5316536 5316520 -
gcaagaaaatgacagcatag

SEQ ID NO: 61879 - DNA, 20 bp, Artificial Sequence
  Synthetic oligonucleotide; AGGAAT chr11 5316502 5316521 5316505 -
cataggtgagtgccaggaac

SEQ ID NO: 61880 - DNA, 20 bp, Artificial Sequence
  Synthetic oligonucleotide; AGGAAT chr11 5316495 5316514 5316498 -
gagtgccaggaacaggaata

SEQ ID NO: 61881 - DNA, 20 bp, Artificial Sequence
  Synthetic oligonucleotide; TGGGAT chr11 5316405 5316424 5316408 -
ataggagaacatactccatc

SEQ ID NO: 61882 - DNA, 20 bp, Artificial Sequence
  Synthetic oligonucleotide; ATGGAT chr11 5316322 5316341 5316325 -
aagtttcaaatgtggtgctc

SEQ ID NO: 61883 - DNA, 20 bp, Artificial Sequence
  Synthetic oligonucleotide; GTGAAT chr11 5316299 5316318 5316302 -
gattagcttcaggaaaacgt

SEQ ID NO: 61884 - DNA, 20 bp, Artificial Sequence
  Synthetic oligonucleotide; TAGAAT chr11 5316224 5316243 5316227 -
agagggctcatggcttttgt

SEQ ID NO: 61885 - DNA, 20 bp, Artificial Sequence
  Synthetic oligonucleotide; AAGAAT chr11 5315946 5315965 5315949 -
taaaatgtgttttttagatt

SEQ ID NO: 61886 - DNA, 20 bp, Artificial Sequence
  Synthetic oligonucleotide; ATGAAT chr11 5315806 5315825 5315809 -
ccaataaattattgctaaat

SEQ ID NO: 61887 - DNA, 20 bp, Artificial Sequence
  Synthetic oligonucleotide; TAGGAT chr11 5315798 5315817 5315801 -
ttattgctaaatatgaatat

SEQ ID NO: 61888 - DNA, 20 bp, Artificial Sequence
  Synthetic oligonucleotide; AGGGAT chr11 5315741 5315760 5315744 -
gtagtaaaaactgataaggc

SEQ ID NO: 61889 - DNA, 20 bp, Artificial Sequence
  Synthetic oligonucleotide; GTGGAT chr11 5315458 5315477 5315461 -
cccactgtaatgggcgtctt

SEQ ID NO: 61890 - DNA, 20 bp, Artificial Sequence
  Synthetic oligonucleotide; ATGAAT chr11 5315454 5315473 5315457 -
ctgtaatgggcgtcttgtgg

SEQ ID NO: 61891 - DNA, 20 bp, Artificial Sequence
  Synthetic oligonucleotide; CAGAAT chr11 5315381 5315400 5315384 -
ccactcccattatccacttg

SEQ ID NO: 61892 - DNA, 20 bp, Artificial Sequence
  Synthetic oligonucleotide; TTGGGT chr11 5315295 5315314 5315298 -
ataactatttctactaaatc

SEQ ID NO: 61893 - DNA, 20 bp, Artificial Sequence
  Synthetic oligonucleotide; CAGAAT chr11 5314785 5314804 5314788 -
gttcgcctattttctgggca

SEQ ID NO: 61894 - DNA, 20 bp, Artificial Sequence
  Synthetic oligonucleotide; CAGAAT chr11 5314762 5314781 5314765 -
aatggcttgagccctttttt

SEQ ID NO: 61895 - DNA, 20 bp, Artificial Sequence
  Synthetic oligonucleotide; TTGAGT chr11 5314728 5314747 5314731 -
cttcatgatttctgggcctt

SEQ ID NO: 61896 - DNA, 20 bp, Artificial Sequence
  Synthetic oligonucleotide; ATGAAT chr11 5314621 5314640 5314624 -
ctacatggaacaataataca

SEQ ID NO: 61897 - DNA, 20 bp, Artificial Sequence
  Synthetic oligonucleotide; TGGAAT chr11 5314488 5314507 5314491 -
attgagagatactaggaaag

SEQ ID NO: 61898 - DNA, 20 bp, Artificial Sequence
  Synthetic oligonucleotide; TTGAAT chr11 5314478 5314497 5314481 -
actaggaaagtggaatacta

SEQ ID NO: 61899 - DNA, 20 bp, Artificial Sequence
  Synthetic oligonucleotide; AAGAGT chr11 5314377 5314396 5314380 -
actgaaagtaccattttagg

SEQ ID NO: 61900 - DNA, 20 bp, Artificial Sequence
  Synthetic oligonucleotide; ATGAAT chr11 5314293 5314312 5314296 -
ctagttttggccatataaag

SEQ ID NO: 61901 - DNA, 20 bp, Artificial Sequence
  Synthetic oligonucleotide; GTGAAT chr11 5314279 5314298 5314282 -
ataaagatgaattatagcat

SEQ ID NO: 61902 - DNA, 20 bp, Artificial Sequence
  Synthetic oligonucleotide; CAGGGT chr11 5314230 5314249 5314233 -
atctcaaaactactctattt

SEQ ID NO: 61903 - DNA, 20 bp, Artificial Sequence
  Synthetic oligonucleotide; CAGGAT chr11 5314086 5314105 5314089 -
taagttccagggcacatgtg

SEQ ID NO: 61904 - DNA, 20 bp, Artificial Sequence
  Synthetic oligonucleotide; GAGGAT chr11 5313867 5313886 5313870 -
tgttcctgtgttagtttgat

SEQ ID NO: 61905 - DNA, 20 bp, Artificial Sequence
  Synthetic oligonucleotide; TTGGGT chr11 5313737 5313756 5313740 -
actctatcattgatggacat

SEQ ID NO: 61906 - DNA, 20 bp, Artificial Sequence
  Synthetic oligonucleotide; ATGAAT chr11 5313710 5313729 5313713 -
gattccacatcttggctatt

SEQ ID NO: 61907 - DNA, 20 bp, Artificial Sequence
  Synthetic oligonucleotide; TTGGGT chr11 5313646 5313665 5313649 -
atagattgatttatattcct

SEQ ID NO: 61908 - DNA, 20 bp, Artificial Sequence
  Synthetic oligonucleotide; CTGAGT chr11 5313619 5313638 5313622 -
tatacccagtaatgagattg

SEQ ID NO: 61909 - DNA, 20 bp, Artificial Sequence
  Synthetic oligonucleotide; ATGAAT chr11 5313351 5313370 5313354 -
ttcatatgtttattagaagc

SEQ ID NO: 61910 - DNA, 20 bp, Artificial Sequence
  Synthetic oligonucleotide; TGGGGT chr11 5313299 5313318 5313302 -
tgtcattccccactttttaa

SEQ ID NO: 61911 - DNA, 20 bp, Artificial Sequence
  Synthetic oligonucleotide; TTGAGT chr11 5313093 5313112 5313096 -
ttgcagttgcttttggtgtc

SEQ ID NO: 61912 - DNA, 20 bp, Artificial Sequence
  Synthetic oligonucleotide; ATGAGT chr11 5313003 5313022 5313006 -
atttcctagttgctcatttc

SEQ ID NO: 61913 - DNA, 20 bp, Artificial Sequence
  Synthetic oligonucleotide; CTGGAT chr11 5312960 5312979 5312963 -
tcttgtgttctctctaaatg

SEQ ID NO: 61914 - DNA, 20 bp, Artificial Sequence
  Synthetic oligonucleotide; TAGGAT chr11 5312825 5312844 5312828 -
cagcaacttggaaatctcac

SEQ ID NO: 61915 - DNA, 20 bp, Artificial Sequence
  Synthetic oligonucleotide; AAGGGT chr11 5312535 5312554 5312538 -
tgtacatatcctatgtttaa

SEQ ID NO: 61916 - DNA, 20 bp, Artificial Sequence
  Synthetic oligonucleotide; GAGAGT chr11 5312517 5312536 5312520 -
aaaagggtttgtgtttggag

SEQ ID NO: 61917 - DNA, 20 bp, Artificial Sequence
  Synthetic oligonucleotide; ATGGGT chr11 5312420 5312439 5312423 -
aattttttaagggcactatt

SEQ ID NO: 61918 - DNA, 20 bp, Artificial Sequence
  Synthetic oligonucleotide; AAGAAT chr11 5312334 5312353 5312337 -
ttcaaataagtggggactca

SEQ ID NO: 61919 - DNA, 20 bp, Artificial Sequence
  Synthetic oligonucleotide; CTGAAT chr11 5312270 5312289 5312273 -
cataaagcagaaagaagaca

SEQ ID NO: 61920 - DNA, 20 bp, Artificial Sequence
  Synthetic oligonucleotide; GAGAGT chr11 5312263 5312282 5312266 -
cagaaagaagacactgaatg

SEQ ID NO: 61921 - DNA, 20 bp, Artificial Sequence
  Synthetic oligonucleotide; GTGGGT chr11 5312257 5312276 5312260 -
gaagacactgaatggagagt

SEQ ID NO: 61922 - DNA, 20 bp, Artificial Sequence
  Synthetic oligonucleotide; AAGGGT chr11 5312219 5312238 5312222 -
ttgaggttatggcttgaaat

SEQ ID NO: 61923 - DNA, 20 bp, Artificial Sequence
  Synthetic oligonucleotide; ATGGAT chr11 5312172 5312191 5312175 -
ccttcagctgagacctgaaa

SEQ ID NO: 61924 - DNA, 20 bp, Artificial Sequence
  Synthetic oligonucleotide; AAGAAT chr11 5312139 5312158 5312142 -
taactggtgaaaatacagac

SEQ ID NO: 61925 - DNA, 20 bp, Artificial Sequence
  Synthetic oligonucleotide; AGGAGT chr11 5312120 5312139 5312123 -
caagaatattctaagactga

SEQ ID NO: 61926 - DNA, 20 bp, Artificial Sequence
  Synthetic oligonucleotide; GAGGGT chr11 5312060 5312079 5312063 -
agggaaggtggctactggaa

SEQ ID NO: 61927 - DNA, 20 bp, Artificial Sequence
  Synthetic oligonucleotide; AGGAAT chr11 5312025 5312044 5312028 -
gagaagaggctgaagaggga

SEQ ID NO: 61928 - DNA, 20 bp, Artificial Sequence
  Synthetic oligonucleotide; AAGAGT chr11 5312001 5312020 5312004 -
atggccttattggtcatcat

SEQ ID NO: 61929 - DNA, 20 bp, Artificial Sequence
  Synthetic oligonucleotide; TTGAGT chr11 5311995 5312014 5311998 -
ttattggtcatcataagagt

SEQ ID NO: 61930 - DNA, 20 bp, Artificial Sequence
  Synthetic oligonucleotide; CGGAGT chr11 5311982 5312001 5311985 -
taagagtttgagtctctact

SEQ ID NO: 61931 - DNA, 20 bp, Artificial Sequence
  Synthetic oligonucleotide; TGGAAT chr11 5311905 5311924 5311908 -
cttcaatattatttataaaa

SEQ ID NO: 61932 - DNA, 20 bp, Artificial Sequence
  Synthetic oligonucleotide; CAGAAT chr11 5311879 5311898 5311882 -
tgagggaggcagggaaaggg

SEQ ID NO: 61933 - DNA, 20 bp, Artificial Sequence
  Synthetic oligonucleotide; TAGAGT chr11 5311871 5311890 5311874 -
gcagggaaagggcagaatat

SEQ ID NO: 61934 - DNA, 20 bp, Artificial Sequence
  Synthetic oligonucleotide; AAGAGT chr11 5311741 5311760 5311744 -
ttagaaaagcagaggaaaga

SEQ ID NO: 61935 - DNA, 20 bp, Artificial Sequence
  Synthetic oligonucleotide; AAGAAT chr11 5311634 5311653 5311637 -
atgtattgtctataaataag

SEQ ID NO: 61936 - DNA, 20 bp, Artificial Sequence
  Synthetic oligonucleotide; GAGAAT chr11 5311599 5311618 5311602 -
ttttaaagttgtgggacact

SEQ ID NO: 61937 - DNA, 20 bp, Artificial Sequence
  Synthetic oligonucleotide; ATGAGT chr11 5311595 5311614 5311598 -
aaagttgtgggacactgaga

SEQ ID NO: 61938 - DNA, 20 bp, Artificial Sequence
  Synthetic oligonucleotide; AAGAGT chr11 5311439 5311458 5311442 -
tttctttttgcctgatcatg

SEQ ID NO: 61939 - DNA, 20 bp, Artificial Sequence
  Synthetic oligonucleotide; GAGAAT chr11 5311399 5311418 5311402 -
gacatatgtcagaaaatgat

SEQ ID NO: 61940 - DNA, 20 bp, Artificial Sequence
  Synthetic oligonucleotide; GAGAAT chr11 5311337 5311356 5311340 -
atgacacccaaagaaggtca

SEQ ID NO: 61941 - DNA, 20 bp, Artificial Sequence
  Synthetic oligonucleotide; CAGGAT chr11 5311297 5311316 5311300 -
ctcactatcctaggagaaag

SEQ ID NO: 61942 - DNA, 20 bp, Artificial Sequence
  Synthetic oligonucleotide; CCGGGT chr11 5311287 5311306 5311290 -
taggagaaagcaggatagat

SEQ ID NO: 61943 - DNA, 20 bp, Artificial Sequence
  Synthetic oligonucleotide; TTGGGT chr11 5311276 5311295 5311279 -
aggatagatccgggtttttc

SEQ ID NO: 61944 - DNA, 20 bp, Artificial Sequence
  Synthetic oligonucleotide; ATGGAT chr11 5311141 5311160 5311144 -
atacaaacataaataggaag

SEQ ID NO: 61945 - DNA, 20 bp, Artificial Sequence
  Synthetic oligonucleotide; CTGAAT chr11 5311125 5311144 5311128 -
gaagatggattaactaaatt

SEQ ID NO: 61946 - DNA, 20 bp, Artificial Sequence
  Synthetic oligonucleotide; ATGAGT chr11 5311113 5311132 5311116 -
actaaattctgaattaccag

SEQ ID NO: 61947 - DNA, 20 bp, Artificial Sequence
  Synthetic oligonucleotide; AAGAAT chr11 5311100 5311119 5311103 -
ttaccagatgagtaaataac

SEQ ID NO: 61948 - DNA, 20 bp, Artificial Sequence
  Synthetic oligonucleotide; ATGAGT chr11 5311071 5311090 5311074 -
ttgaaaaatgaagttttttc

SEQ ID NO: 61949 - DNA, 20 bp, Artificial Sequence
  Synthetic oligonucleotide; TTGAGT chr11 5310943 5310962 5310946 -
ctttctctcaagtgaaattg

SEQ ID NO: 61950 - DNA, 20 bp, Artificial Sequence
  Synthetic oligonucleotide; TGGAAT chr11 5310820 5310839 5310823 -
tgtgtggacacctgcacatg

SEQ ID NO: 61951 - DNA, 20 bp, Artificial Sequence
  Synthetic oligonucleotide; ATGAAT chr11 5310738 5310757 5310741 -
aacctttcacaataaattta

SEQ ID NO: 61952 - DNA, 20 bp, Artificial Sequence
  Synthetic oligonucleotide; ATGAAT chr11 5310497 5310516 5310500 -
ctaatctactttttgtctct

SEQ ID NO: 61953 - DNA, 20 bp, Artificial Sequence
  Synthetic oligonucleotide; TAGGAT chr11 5310423 5310442 5310426 -
tgcgtatgacttattgcact

SEQ ID NO: 61954 - DNA, 20 bp, Artificial Sequence
  Synthetic oligonucleotide; GTGAAT chr11 5310274 5310293 5310277 -
gtttctattccttggctact

SEQ ID NO: 61955 - DNA, 20 bp, Artificial Sequence
  Synthetic oligonucleotide; CTGAAT chr11 5310203 5310222 5310206 -
tctctctacttcctctcact

SEQ ID NO: 61956 - DNA, 20 bp, Artificial Sequence
  Synthetic oligonucleotide; AAGAAT chr11 5310184 5310203 5310187 -
tctgaatattctgcttttca

SEQ ID NO: 61957 - DNA, 20 bp, Artificial Sequence
  Synthetic oligonucleotide; TGGAAT chr11 5310172 5310191 5310175 -
gcttttcaaagaatattcct

SEQ ID NO: 61958 - DNA, 20 bp, Artificial Sequence
  Synthetic oligonucleotide; CTGGGT chr11 5310079 5310098 5310082 -
ctgactgcaacctctgcctc

SEQ ID NO: 61959 - DNA, 20 bp, Artificial Sequence
  Synthetic oligonucleotide; CTGAGT chr11 5309876 5309895 5309879 -
aatctttgctctggacttca

SEQ ID NO: 61960 - DNA, 20 bp, Artificial Sequence
  Synthetic oligonucleotide; TGGAGT chr11 5309833 5309852 5309836 -
gttttgttttgtttttgaga

SEQ ID NO: 61961 - DNA, 20 bp, Artificial Sequence
  Synthetic oligonucleotide; TGGAGT chr11 5309808 5309827 5309811 -
tctcgctctgtcgcccaggc

SEQ ID NO: 61962 - DNA, 20 bp, Artificial Sequence
  Synthetic oligonucleotide; CCGGGT chr11 5309764 5309783 5309767 -
ctcactgcaagctctgcctc

SEQ ID NO: 61963 - DNA, 20 bp, Artificial Sequence
  Synthetic oligonucleotide; CCGAGT chr11 5309732 5309751 5309735 -
cattctcctgcctcagcctc

SEQ ID NO: 61964 - DNA, 20 bp, Artificial Sequence
  Synthetic oligonucleotide; CGGGGT chr11 5309665 5309684 5309668 -
ttttgtctttttagtagaga

SEQ ID NO: 61965 - DNA, 20 bp, Artificial Sequence
  Synthetic oligonucleotide; CAGGAT chr11 5309645 5309664 5309648 -
cggggtttcactgtgttagc

SEQ ID NO: 61966 - DNA, 20 bp, Artificial Sequence
  Synthetic oligonucleotide; TGGGAT chr11 5309588 5309607 5309591 -
gcctcggcctcccaaagtgc

SEQ ID NO: 61967 - DNA, 20 bp, Artificial Sequence
  Synthetic oligonucleotide; CTGAGT chr11 5309556 5309575 5309559 -
cgtgagccaccgcgcccggc

SEQ ID NO: 61968 - DNA, 20 bp, Artificial Sequence
  Synthetic oligonucleotide; TGGAAT chr11 5309496 5309515 5309499 -
gagaaatgagatccaatcta

SEQ ID NO: 61969 - DNA, 20 bp, Artificial Sequence
  Synthetic oligonucleotide; CTGAAT chr11 5309428 5309447 5309431 -
tgtattaaaactttttcata

SEQ ID NO: 61970 - DNA, 20 bp, Artificial Sequence
  Synthetic oligonucleotide; TTGAGT chr11 5309367 5309386 5309370 -
gtaagcaaaattatatgcta

SEQ ID NO: 61971 - DNA, 20 bp, Artificial Sequence
  Synthetic oligonucleotide; CTGAGT chr11 5309340 5309359 5309343 -
caatgtttaagctattgata

SEQ ID NO: 61972 - DNA, 20 bp, Artificial Sequence
  Synthetic oligonucleotide; CTGGGT chr11 5309197 5309216 5309200 -
ttccatcttgatttgctgac

SEQ ID NO: 61973 - DNA, 20 bp, Artificial Sequence
  Synthetic oligonucleotide; AAGAAT chr11 5309144 5309163 5309147 -
gtctttgtaagttattttgg

SEQ ID NO: 61974 - DNA, 20 bp, Artificial Sequence
  Synthetic oligonucleotide; GTGGAT chr11 5308815 5308834 5308818 -
aacggttatctgggcctgtt

SEQ ID NO: 61975 - DNA, 20 bp, Artificial Sequence
  Synthetic oligonucleotide; GTGAAT chr11 5308808 5308827 5308811 -
atctgggcctgttgtggatt

SEQ ID NO: 61976 - DNA, 20 bp, Artificial Sequence
  Synthetic oligonucleotide; TTGAAT chr11 5308792 5308811 5308795 -
gattgtgaatatgacaatat

SEQ ID NO: 61977 - DNA, 20 bp, Artificial Sequence
  Synthetic oligonucleotide; TTGAAT chr11 5308751 5308770 5308754 -
taagagagggacactcactt

SEQ ID NO: 61978 - DNA, 20 bp, Artificial Sequence
  Synthetic oligonucleotide; AGGAAT chr11 5308708 5308727 5308711 -
tgatggaggaaagagattgg

SEQ ID NO: 61979 - DNA, 20 bp, Artificial Sequence
  Synthetic oligonucleotide; ATGGGT chr11 5308694 5308713 5308697 -
gattggaggaatgtagattt

SEQ ID NO: 61980 - DNA, 20 bp, Artificial Sequence
  Synthetic oligonucleotide; TTGGAT chr11 5308668 5308687 5308671 -
gaagttgtttggcttggaag

SEQ ID NO: 61981 - DNA, 20 bp, Artificial Sequence
  Synthetic oligonucleotide; TGGGGT chr11 5308188 5308207 5308191 -
aatgtctgatatattattgt

SEQ ID NO: 61982 - DNA, 20 bp, Artificial Sequence
  Synthetic oligonucleotide; GAGAAT chr11 5308169 5308188 5308172 -
ttggggtacagttctttatt

SEQ ID NO: 61983 - DNA, 20 bp, Artificial Sequence
  Synthetic oligonucleotide; AAGAGT chr11 5308163 5308182 5308166 -
tacagttctttattgagaat

SEQ ID NO: 61984 - DNA, 20 bp, Artificial Sequence
  Synthetic oligonucleotide; TGGAAT chr11 5308047 5308066 5308050 -
tttcaaagtagtcttttcat

SEQ ID NO: 61985 - DNA, 20 bp, Artificial Sequence
  Synthetic oligonucleotide; GAGAAT chr11 5308039 5308058 5308042 -
tagtcttttcattggaatgg

SEQ ID NO: 61986 - DNA, 20 bp, Artificial Sequence
  Synthetic oligonucleotide; CTGGGT chr11 5307843 5307862 5307846 -
tctcaccactgcactccctc

SEQ ID NO: 61987 - DNA, 20 bp, Artificial Sequence
  Synthetic oligonucleotide; GAGAAT chr11 5307793 5307812 5307796 -
agagaggaaagaaaagaaaa

SEQ ID NO: 61988 - DNA, 20 bp, Artificial Sequence
  Synthetic oligonucleotide; AGGAAT chr11 5307700 5307719 5307703 -
aagaaagaaaaaagaaagga

SEQ ID NO: 61989 - DNA, 20 bp, Artificial Sequence
  Synthetic oligonucleotide; ATGGAT chr11 5307596 5307615 5307599 -
tctttcttcttgatgttgtt

SEQ ID NO: 61990 - DNA, 20 bp, Artificial Sequence
  Synthetic oligonucleotide; AAGAAT chr11 5307423 5307442 5307426 -
aaaaccaatggcttgatcac

SEQ ID NO: 61991 - DNA, 20 bp, Artificial Sequence
  Synthetic oligonucleotide; GTGAGT chr11 5307307 5307326 5307310 -
ttcagaagttttgttttact

SEQ ID NO: 61992 - DNA, 20 bp, Artificial Sequence
  Synthetic oligonucleotide; TAGAAT chr11 5307239 5307258 5307242 -
tcacttcttagctacaagtc

SEQ ID NO: 61993 - DNA, 20 bp, Artificial Sequence
  Synthetic oligonucleotide; ATGAAT chr11 5307217 5307236 5307220 -
gaatcaacaggttctgcaaa

SEQ ID NO: 61994 - DNA, 20 bp, Artificial Sequence
  Synthetic oligonucleotide; TGGAAT chr11 5307209 5307228 5307212 -
aggttctgcaaaatgaattc

SEQ ID NO: 61995 - DNA, 20 bp, Artificial Sequence
  Synthetic oligonucleotide; CTGAAT chr11 5307156 5307175 5307159 -
acgttttggcaaaatcttac

SEQ ID NO: 61996 - DNA, 20 bp, Artificial Sequence
  Synthetic oligonucleotide; GAGGAT chr11 5307144 5307163 5307147 -
aatcttacctgaatatatga

SEQ ID NO: 61997 - DNA, 20 bp, Artificial Sequence
  Synthetic oligonucleotide; TAGAGT chr11 5307096 5307115 5307099 -
tataaacaggtgatagtaaa

SEQ ID NO: 61998 - DNA, 20 bp, Artificial Sequence
  Synthetic oligonucleotide; GCGAGT chr11 5307082 5307101 5307085 -
agtaaatagagtaacttgct

SEQ ID NO: 61999 - DNA, 20 bp, Artificial Sequence
  Synthetic oligonucleotide; TAGAAT chr11 5307061 5307080 5307064 -
cgagtgtcacatatattatg

SEQ ID NO: 62000 - DNA, 20 bp, Artificial Sequence
  Synthetic oligonucleotide; CTGAAT chr11 5307023 5307042 5307026 -
actattttaaatctgaaaga

SEQ ID NO: 62001 - DNA, 20 bp, Artificial Sequence
  Synthetic oligonucleotide; AAGAGT chr11 5307000 5307019 5307003 -
aatttgacatgttttgagat

SEQ ID NO: 62002 - DNA, 20 bp, Artificial Sequence
  Synthetic oligonucleotide; TAGGGT chr11 5306993 5307012 5306996 -
catgttttgagataagagtt

SEQ ID NO: 62003 - DNA, 20 bp, Artificial Sequence
  Synthetic oligonucleotide; TAGAGT chr11 5306988 5307007 5306991 -
tttgagataagagtttaggg

SEQ ID NO: 62004 - DNA, 20 bp, Artificial Sequence
  Synthetic oligonucleotide; CAGAAT chr11 5306913 5306932 5306916 -
tccaatgaaaaaagagattt

SEQ ID NO: 62005 - DNA, 20 bp, Artificial Sequence
  Synthetic oligonucleotide; CTGGAT chr11 5306888 5306907 5306891 -
tgggactaatatgacaacat

SEQ ID NO: 62006 - DNA, 20 bp, Artificial Sequence
  Synthetic oligonucleotide; CAGGAT chr11 5306843 5306862 5306846 -
gagcatcataggaaataaat

SEQ ID NO: 62007 - DNA, 20 bp, Artificial Sequence
  Synthetic oligonucleotide; AGGAAT chr11 5306836 5306855 5306839 -
ataggaaataaatcaggatt

SEQ ID NO: 62008 - DNA, 20 bp, Artificial Sequence
  Synthetic oligonucleotide; TAGGGT chr11 5306769 5306788 5306772 -
acccatcaggaaagaagtct

SEQ ID NO: 62009 - DNA, 20 bp, Artificial Sequence
  Synthetic oligonucleotide; ATGAAT chr11 5306721 5306740 5306724 -
catctagaaaaaaattatgt

SEQ ID NO: 62010 - DNA, 20 bp, Artificial Sequence
  Synthetic oligonucleotide; AGGAGT chr11 5306665 5306684 5306668 -
ggagatcagacctaaatata

SEQ ID NO: 62011 - DNA, 20 bp, Artificial Sequence
  Synthetic oligonucleotide; GTGAAT chr11 5306601 5306620 5306604 -
ctctctcactgtctctgtct

SEQ ID NO: 62012 - DNA, 20 bp, Artificial Sequence
  Synthetic oligonucleotide; ATGAAT chr11 5306497 5306516 5306500 -
taaatgaaacccacatatat

SEQ ID NO: 62013 - DNA, 20 bp, Artificial Sequence
  Synthetic oligonucleotide; CAGGGT chr11 5306482 5306501 5306485 -
tatatatgaatgagatagct

SEQ ID NO: 62014 - DNA, 20 bp, Artificial Sequence
  Synthetic oligonucleotide; TAGGGT chr11 5306477 5306496 5306480 -
atgaatgagatagctcaggg

SEQ ID NO: 62015 - DNA, 20 bp, Artificial Sequence
  Synthetic oligonucleotide; GTGAGT chr11 5306470 5306489 5306473 -
agatagctcagggtagggta

SEQ ID NO: 62016 - DNA, 20 bp, Artificial Sequence
  Synthetic oligonucleotide; TTGAAT chr11 5306463 5306482 5306466 -
tcagggtagggtagtgagtt

SEQ ID NO: 62017 - DNA, 20 bp, Artificial Sequence
  Synthetic oligonucleotide; AAGAAT chr11 5306450 5306469 5306453 -
gtgagttttgaatcaataga

SEQ ID NO: 62018 - DNA, 20 bp, Artificial Sequence
  Synthetic oligonucleotide; ATGAAT chr11 5306431 5306450 5306434 -
aaagaataaataaatgtctg

SEQ ID NO: 62019 - DNA, 20 bp, Artificial Sequence
  Synthetic oligonucleotide; AAGGAT chr11 5306392 5306411 5306395 -
aaaaggtttggtggtggctc

SEQ ID NO: 62020 - DNA, 20 bp, Artificial Sequence
  Synthetic oligonucleotide; AAGGGT chr11 5306380 5306399 5306383 -
ggtggctcaaggattttgta

SEQ ID NO: 62021 - DNA, 20 bp, Artificial Sequence
  Synthetic oligonucleotide; TTGAAT chr11 5306375 5306394 5306378 -
ctcaaggattttgtaaaggg

SEQ ID NO: 62022 - DNA, 20 bp, Artificial Sequence
  Synthetic oligonucleotide; GAGAAT chr11 5306367 5306386 5306370 -
ttttgtaaagggttgaatta

SEQ ID NO: 62023 - DNA, 20 bp, Artificial Sequence
  Synthetic oligonucleotide; GAGAGT chr11 5306266 5306285 5306269 -
ctaagaccaatggaacactt

SEQ ID NO: 62024 - DNA, 20 bp, Artificial Sequence
  Synthetic oligonucleotide; GAGAAT chr11 5306128 5306147 5306131 -
tcccaggttggggaggaaaa

SEQ ID NO: 62025 - DNA, 20 bp, Artificial Sequence
  Synthetic oligonucleotide; TAGAAT chr11 5306080 5306099 5306083 -
tatcctatgtggaaatgagc

SEQ ID NO: 62026 - DNA, 20 bp, Artificial Sequence
  Synthetic oligonucleotide; GAGAGT chr11 5306066 5306085 5306069 -
atgagctagaataacccctt

SEQ ID NO: 62027 - DNA, 20 bp, Artificial Sequence
  Synthetic oligonucleotide; CAGAAT chr11 5306033 5306052 5306036 -
gtaacaaatatatctctcat

SEQ ID NO: 62028 - DNA, 20 bp, Artificial Sequence
  Synthetic oligonucleotide; AAGAGT chr11 5306026 5306045 5306029 -
atatatctctcatcagaatt

SEQ ID NO: 62029 - DNA, 20 bp, Artificial Sequence
  Synthetic oligonucleotide; GAGGAT chr11 5306013 5306032 5306016 -
cagaattaagagtaaatact

SEQ ID NO: 62030 - DNA, 20 bp, Artificial Sequence
  Synthetic oligonucleotide; AAGGAT chr11 5305934 5305953 5305937 -
tggctcaggtaagaaaagcc

SEQ ID NO: 62031 - DNA, 20 bp, Artificial Sequence
  Synthetic oligonucleotide; GAGAAT chr11 5305879 5305898 5305882 -
ccatttgatggacattggtt

SEQ ID NO: 62032 - DNA, 20 bp, Artificial Sequence
  Synthetic oligonucleotide; TTGGGT chr11 5305867 5305886 5305870 -
cattggttgagaatatgagc

SEQ ID NO: 62033 - DNA, 20 bp, Artificial Sequence
  Synthetic oligonucleotide; TTGGGT chr11 5305860 5305879 5305863 -
tgagaatatgagcttgggtt

SEQ ID NO: 62034 - DNA, 20 bp, Artificial Sequence
  Synthetic oligonucleotide; TTGAAT chr11 5305839 5305858 5305842 -
tgggttagataaacctgtgt

SEQ ID NO: 62035 - DNA, 20 bp, Artificial Sequence
  Synthetic oligonucleotide; TAGAGT chr11 5305657 5305676 5305660 -
tttttctctgttgcccaggc

SEQ ID NO: 62036 - DNA, 20 bp, Artificial Sequence
  Synthetic oligonucleotide; CAGGGT chr11 5305613 5305632 5305616 -
ctcactgcgacctcctccac

SEQ ID NO: 62037 - DNA, 20 bp, Artificial Sequence
  Synthetic oligonucleotide; GGGGAT chr11 5305604 5305623 5305607 -
acctcctccaccagggttca

SEQ ID NO: 62038 - DNA, 20 bp, Artificial Sequence
  Synthetic oligonucleotide; CAGAGT chr11 5305581 5305600 5305584 -
gattctcatgcctcagcctc

SEQ ID NO: 62039 - DNA, 20 bp, Artificial Sequence
  Synthetic oligonucleotide; TGGGAT chr11 5305572 5305591 5305575 -
gcctcagcctccagagtagc

SEQ ID NO: 62040 - DNA, 20 bp, Artificial Sequence
  Synthetic oligonucleotide; TGGGAT chr11 5305437 5305456 5305440 -
tcctcggcctcccaaagtgc

SEQ ID NO: 62041 - DNA, 20 bp, Artificial Sequence
  Synthetic oligonucleotide; CCGAGT chr11 5304951 5304970 5304954 -
aattctcctgcctcagcctc

SEQ ID NO: 62042 - DNA, 20 bp, Artificial Sequence
  Synthetic oligonucleotide; TGGGAT chr11 5304942 5304961 5304945 -
gcctcagcctcccgagtagc

SEQ ID NO: 62043 - DNA, 20 bp, Artificial Sequence
  Synthetic oligonucleotide; CAGGGT chr11 5304886 5304905 5304889 -
ttttgtatttttagtagaga

SEQ ID NO: 62044 - DNA, 20 bp, Artificial Sequence
  Synthetic oligonucleotide; TAGGAT chr11 5304813 5304832 5304816 -
acctcagccttccaaagtgc

SEQ ID NO: 62045 - DNA, 20 bp, Artificial Sequence
  Synthetic oligonucleotide; GTGGAT chr11 5304592 5304611 5304595 -
caatatgtggagatgaaaaa

SEQ ID NO: 62046 - DNA, 20 bp, Artificial Sequence
  Synthetic oligonucleotide; CTGGAT chr11 5304408 5304427 5304411 -
catggcaagttgaagaagct

SEQ ID NO: 62047 - DNA, 20 bp, Artificial Sequence
  Synthetic oligonucleotide; ATGGAT chr11 5304401 5304420 5304404 -
agttgaagaagctctggatg

SEQ ID NO: 62048 - DNA, 20 bp, Artificial Sequence
  Synthetic oligonucleotide; TGGGAT chr11 5304364 5304383 5304367 -
tcagaaactcttgaggactc

SEQ ID NO: 62049 - DNA, 20 bp, Artificial Sequence
  Synthetic oligonucleotide; AAGAAT chr11 5304347 5304366 5304350 -
ctctgggatagttgctgtca

SEQ ID NO: 62050 - DNA, 20 bp, Artificial Sequence
  Synthetic oligonucleotide; GAGAGT chr11 5304259 5304278 5304262 -
gggggcctctatgcttgcct

SEQ ID NO: 62051 - DNA, 20 bp, Artificial Sequence
  Synthetic oligonucleotide; TGGAAT chr11 5304165 5304184 5304168 -
attagggcaactattctccc

SEQ ID NO: 62052 - DNA, 20 bp, Artificial Sequence
  Synthetic oligonucleotide; TTGGGT chr11 5304157 5304176 5304160 -
aactattctccctggaatat

SEQ ID NO: 62053 - DNA, 20 bp, Artificial Sequence
  Synthetic oligonucleotide; AAGAAT chr11 5303926 5303945 5303929 -
tgaaaacacgactatagttt

SEQ ID NO: 62054 - DNA, 20 bp, Artificial Sequence
  Synthetic oligonucleotide; CTGGGT chr11 5303881 5303900 5303884 -
tcctccatctggtccattat

SEQ ID NO: 62055 - DNA, 20 bp, Artificial Sequence
  Synthetic oligonucleotide; GTGGAT chr11 5303701 5303720 5303704 -
actatgcaggtcataattca

SEQ ID NO: 62056 - DNA, 20 bp, Artificial Sequence
  Synthetic oligonucleotide; CTGAAT chr11 5303423 5303442 5303426 -
ttgttatcacttcattttta

SEQ ID NO: 62057 - DNA, 20 bp, Artificial Sequence
  Synthetic oligonucleotide; TTGAAT chr11 5303381 5303400 5303384 -
cggtagtaatatttataata

SEQ ID NO: 62058 - DNA, 20 bp, Artificial Sequence
  Synthetic oligonucleotide; CAGAAT chr11 5303348 5303367 5303351 -
taaaagactctggacacata

SEQ ID NO: 62059 - DNA, 20 bp, Artificial Sequence
  Synthetic oligonucleotide; TTGAAT chr11 5303339 5303358 5303342 -
ctggacacatacagaatcaa

SEQ ID NO: 62060 - DNA, 20 bp, Artificial Sequence
  Synthetic oligonucleotide; CTGAGT chr11 5303323 5303342 5303326 -
tcaattgaatttgggagaaa

SEQ ID NO: 62061 - DNA, 20 bp, Artificial Sequence
  Synthetic oligonucleotide; GAGGAT chr11 5303175 5303194 5303178 -
tagacttcatagttccctat

SEQ ID NO: 62062 - DNA, 20 bp, Artificial Sequence
  Synthetic oligonucleotide; GTGAAT chr11 5303165 5303184 5303168 -
agttccctatgaggatcctt

SEQ ID NO: 62063 - DNA, 20 bp, Artificial Sequence
  Synthetic oligonucleotide; ACGAGT chr11 5303149 5303168 5303152 -
ccttgtgaatttttctcaat

SEQ ID NO: 62064 - DNA, 20 bp, Artificial Sequence
  Synthetic oligonucleotide; GAGGGT chr11 5303122 5303141 5303125 -
ttacagattcataatgatta

SEQ ID NO: 62065 - DNA, 20 bp, Artificial Sequence
  Synthetic oligonucleotide; GGGAGT chr11 5303069 5303088 5303072 -
agttgccgtattttctctct

SEQ ID NO: 62066 - DNA, 20 bp, Artificial Sequence
  Synthetic oligonucleotide; ACGAAT chr11 5302972 5302991 5302975 -
cccttcagatcaacatactt

SEQ ID NO: 62067 - DNA, 20 bp, Artificial Sequence
  Synthetic oligonucleotide; ATGAGT chr11 5302880 5302899 5302883 -
ttccgttatgagcttccaac

SEQ ID NO: 62068 - DNA, 20 bp, Artificial Sequence
  Synthetic oligonucleotide; CTGAGT chr11 5302810 5302829 5302813 -
tttgcagcatagggaacttg

SEQ ID NO: 62069 - DNA, 20 bp, Artificial Sequence
  Synthetic oligonucleotide; CTGAGT chr11 5302794 5302813 5302797 -
cttgctgagtcccaagtcca

SEQ ID NO: 62070 - DNA, 20 bp, Artificial Sequence
  Synthetic oligonucleotide; ATGAGT chr11 5302771 5302790 5302774 -
agtaattacacctttctaaa

SEQ ID NO: 62071 - DNA, 20 bp, Artificial Sequence
  Synthetic oligonucleotide; ATGAGT chr11 5302709 5302728 5302712 -
tctgtggaaactcacaatag

SEQ ID NO: 62072 - DNA, 20 bp, Artificial Sequence
  Synthetic oligonucleotide; CAGAGT chr11 5302663 5302682 5302666 -
tattttattttttatagaga

SEQ ID NO: 62073 - DNA, 20 bp, Artificial Sequence
  Synthetic oligonucleotide; CAGGGT chr11 5302526 5302545 5302529 -
tcttttttttttggtggagg

SEQ ID NO: 62074 - DNA, 20 bp, Artificial Sequence
  Synthetic oligonucleotide; CTGGGT chr11 5302502 5302521 5302505 -
gtctagctatgttgcccagg

SEQ ID NO: 62075 - DNA, 20 bp, Artificial Sequence
  Synthetic oligonucleotide; TTGAAT chr11 5302431 5302450 5302434 -
atatttctcagtcatttcta

SEQ ID NO: 62076 - DNA, 20 bp, Artificial Sequence
  Synthetic oligonucleotide; TTGGAT chr11 5302348 5302367 5302351 -
aaaatttgaactgactcaac

SEQ ID NO: 62077 - DNA, 20 bp, Artificial Sequence
  Synthetic oligonucleotide; AGGAAT chr11 5302303 5302322 5302306 -
atatgataaataataggagg

SEQ ID NO: 62078 - DNA, 20 bp, Artificial Sequence
  Synthetic oligonucleotide; AAGAGT chr11 5302295 5302314 5302298 -
aataataggaggaggaataa

SEQ ID NO: 62079 - DNA, 20 bp, Artificial Sequence
  Synthetic oligonucleotide; GAGAAT chr11 5302286 5302305 5302289 -
aggaggaataaaagagtaaa

SEQ ID NO: 62080 - DNA, 20 bp, Artificial Sequence
  Synthetic oligonucleotide; AGGAGT chr11 5302268 5302287 5302271 -
aagagaataaaagggaacaa

SEQ ID NO: 62081 - DNA, 20 bp, Artificial Sequence
  Synthetic oligonucleotide; AAGAGT chr11 5302249 5302268 5302252 -
aaggagtcctatttgggacc

SEQ ID NO: 62082 - DNA, 20 bp, Artificial Sequence
  Synthetic oligonucleotide; ATGAGT chr11 5302219 5302238 5302222 -
gctatgagcacagacgtaag

SEQ ID NO: 62083 - DNA, 20 bp, Artificial Sequence
  Synthetic oligonucleotide; GTGAAT chr11 5302183 5302202 5302186 -
taaaggttgtatgcttcata

SEQ ID NO: 62084 - DNA, 20 bp, Artificial Sequence
  Synthetic oligonucleotide; TGGAAT chr11 5302177 5302196 5302180 -
ttgtatgcttcatagtgaat

SEQ ID NO: 62085 - DNA, 20 bp, Artificial Sequence
  Synthetic oligonucleotide; GTGAGT chr11 5302121 5302140 5302124 -
ttattctagggaaaggcctt

SEQ ID NO: 62086 - DNA, 20 bp, Artificial Sequence
  Synthetic oligonucleotide; CCGGAT chr11 5301879 5301898 5301882 -
ggctcagaggcagttcacta

SEQ ID NO: 62087 - DNA, 20 bp, Artificial Sequence
  Synthetic oligonucleotide; TGGAAT chr11 5301806 5301825 5301809 -
gcactcttcttgtcctcatt

SEQ ID NO: 62088 - DNA, 20 bp, Artificial Sequence
  Synthetic oligonucleotide; TGGGAT chr11 5301741 5301760 5301744 -
atgctggcagacacggacct

SEQ ID NO: 62089 - DNA, 20 bp, Artificial Sequence
  Synthetic oligonucleotide; CTGGGT chr11 5301710 5301729 5301713 -
tcactacaatgcccacagtc

SEQ ID NO: 62090 - DNA, 20 bp, Artificial Sequence
  Synthetic oligonucleotide; TAGAAT chr11 5301628 5301647 5301631 -
cattcattcactggccattg

SEQ ID NO: 62091 - DNA, 20 bp, Artificial Sequence
  Synthetic oligonucleotide; CCGAGT chr11 5301540 5301559 5301543 -
aactgcattcttaccaattc

SEQ ID NO: 62092 - DNA, 20 bp, Artificial Sequence
  Synthetic oligonucleotide; GGGGGT chr11 5301519 5301538 5301522 -
cgagtgatgaacataggact

SEQ ID NO: 62093 - DNA, 20 bp, Artificial Sequence
  Synthetic oligonucleotide; GTGAAT chr11 5301098 5301117 5301101 -
attttctctttcctccattc

SEQ ID NO: 62094 - DNA, 20 bp, Artificial Sequence
  Synthetic oligonucleotide; CAGAGT chr11 5301029 5301048 5301032 -
ttattcgcctattttctggg

SEQ ID NO: 62095 - DNA, 20 bp, Artificial Sequence
  Synthetic oligonucleotide; CAGAAT chr11 5301004 5301023 5301007 -
tagggcttgagcccttattt

SEQ ID NO: 62096 - DNA, 20 bp, Artificial Sequence
  Synthetic oligonucleotide; TAGGAT chr11 5300987 5301006 5300990 -
tttcagaatctcaagatctc

SEQ ID NO: 62097 - DNA, 20 bp, Artificial Sequence
  Synthetic oligonucleotide; CAGAGT chr11 5300920 5300939 5300923 -
tatccacacttttttttcct

SEQ ID NO: 62098 - DNA, 20 bp, Artificial Sequence
  Synthetic oligonucleotide; GGGAAT chr11 5300802 5300821 5300805 -
tatatatcacctaataaaga

SEQ ID NO: 62099 - DNA, 20 bp, Artificial Sequence
  Synthetic oligonucleotide; AAGAAT chr11 5300777 5300796 5300780 -
tgccagtgatgctgaagaaa

SEQ ID NO: 62100 - DNA, 20 bp, Artificial Sequence
  Synthetic oligonucleotide; AAGAGT chr11 5300738 5300757 5300741 -
gagatataacaatccaaaag

SEQ ID NO: 62101 - DNA, 20 bp, Artificial Sequence
  Synthetic oligonucleotide; TTGGGT chr11 5300688 5300707 5300691 -
gataagtggactaaagcagc

SEQ ID NO: 62102 - DNA, 20 bp, Artificial Sequence
  Synthetic oligonucleotide; GTGAAT chr11 5300620 5300639 5300623 -
attttatgtgtcttataaag

SEQ ID NO: 62103 - DNA, 20 bp, Artificial Sequence
  Synthetic oligonucleotide; TTGAAT chr11 5300614 5300633 5300617 -
tgtgtcttataaaggtgaat

SEQ ID NO: 62104 - DNA, 20 bp, Artificial Sequence
  Synthetic oligonucleotide; AAGGAT chr11 5300558 5300577 5300561 -
ttgaaactagttactctgaa

SEQ ID NO: 62105 - DNA, 20 bp, Artificial Sequence
  Synthetic oligonucleotide; TGGAAT chr11 5300102 5300121 5300105 -
ttttagaaatttttcactga

SEQ ID NO: 62106 - DNA, 20 bp, Artificial Sequence
  Synthetic oligonucleotide; TTGGGT chr11 5300044 5300063 5300047 -
gtaagtctttatgctgttca

SEQ ID NO: 62107 - DNA, 20 bp, Artificial Sequence
  Synthetic oligonucleotide; GGGGAT chr11 5300002 5300021 5300005 -
cacttgctattagtgtaaca

SEQ ID NO: 62108 - DNA, 20 bp, Artificial Sequence
  Synthetic oligonucleotide; TTGGAT chr11 5299641 5299660 5299644 -
ctccaaattagaaggcccat

SEQ ID NO: 62109 - DNA, 20 bp, Artificial Sequence
  Synthetic oligonucleotide; AAGGAT chr11 5299599 5299618 5299602 -
ctaataaatgactactcctg

SEQ ID NO: 62110 - DNA, 20 bp, Artificial Sequence
  Synthetic oligonucleotide; GCGAAT chr11 5299582 5299601 5299585 -
ctgaaggattcagttattgt

SEQ ID NO: 62111 - DNA, 20 bp, Artificial Sequence
  Synthetic oligonucleotide; GAGAGT chr11 5299569 5299588 5299572 -
ttattgtgcgaattgtttgt

SEQ ID NO: 62112 - DNA, 20 bp, Artificial Sequence
  Synthetic oligonucleotide; GGGGGT chr11 5299544 5299563 5299547 -
ttctttgaaagtaggacgtg

SEQ ID NO: 62113 - DNA, 20 bp, Artificial Sequence
  Synthetic oligonucleotide; CAGAGT chr11 5299468 5299487 5299471 -
gtttttccaaagttggcata

SEQ ID NO: 62114 - DNA, 20 bp, Artificial Sequence
  Synthetic oligonucleotide; AAGGAT chr11 5299349 5299368 5299352 -
gcatctctattgaccactga

SEQ ID NO: 62115 - DNA, 20 bp, Artificial Sequence
  Synthetic oligonucleotide; AAGAGT chr11 5299337 5299356 5299340 -
accactgaaaggatgtctgt

SEQ ID NO: 62116 - DNA, 20 bp, Artificial Sequence
  Synthetic oligonucleotide; GCGAAT chr11 5299302 5299321 5299305 -
agcggtattaaaattttcag

SEQ ID NO: 62117 - DNA, 20 bp, Artificial Sequence
  Synthetic oligonucleotide; AAGGGT chr11 5299296 5299315 5299299 -
attaaaattttcaggcgaat

SEQ ID NO: 62118 - DNA, 20 bp, Artificial Sequence
  Synthetic oligonucleotide; GGGGAT chr11 5299257 5299276 5299260 -
ggcaaatgtatttgtcagta

SEQ ID NO: 62119 - DNA, 20 bp, Artificial Sequence
  Synthetic oligonucleotide; AGGGAT chr11 5299061 5299080 5299064 -
agtttactcatatgttagca

SEQ ID NO: 62120 - DNA, 20 bp, Artificial Sequence
  Synthetic oligonucleotide; AAGGAT chr11 5298987 5299006 5298990 -
atagtcaaaaatcaattaaa

SEQ ID NO: 62121 - DNA, 20 bp, Artificial Sequence
  Synthetic oligonucleotide; AGGAAT chr11 5298651 5298670 5298654 -
tctcttagagatctgctctg

SEQ ID NO: 62122 - DNA, 20 bp, Artificial Sequence
  Synthetic oligonucleotide; GTGAGT chr11 5298611 5298630 5298614 -
agttaattctctgtcatact

SEQ ID NO: 62123 - DNA, 20 bp, Artificial Sequence
  Synthetic oligonucleotide; AAGGAT chr11 5298558 5298577 5298561 -
catcagcatattgtcttccc

SEQ ID NO: 62124 - DNA, 20 bp, Artificial Sequence
  Synthetic oligonucleotide; TGGAGT chr11 5298408 5298427 5298411 -
tcttgctctgttgcccaggc

SEQ ID NO: 62125 - DNA, 20 bp, Artificial Sequence
  Synthetic oligonucleotide; TTGAGT chr11 5298332 5298351 5298335 -
aatccttcttcctcagcttt

SEQ ID NO: 62126 - DNA, 20 bp, Artificial Sequence
  Synthetic oligonucleotide; TGGGAT chr11 5298267 5298286 5298270 -
gtttttattttttgtaaata

SEQ ID NO: 62127 - DNA, 20 bp, Artificial Sequence
  Synthetic oligonucleotide; CGGGGT chr11 5298152 5298171 5298155 -
aaattttaggcagaaaaggg

SEQ ID NO: 62128 - DNA, 20 bp, Artificial Sequence
  Synthetic oligonucleotide; ATGGGT chr11 5298139 5298158 5298142 -
aaaagggcggggtccctggc

SEQ ID NO: 62129 - DNA, 20 bp, Artificial Sequence
  Synthetic oligonucleotide; ATGAAT chr11 5297937 5297956 5297940 -
ctttattctctgtttgtctc

SEQ ID NO: 62130 - DNA, 20 bp, Artificial Sequence
  Synthetic oligonucleotide; CTGGAT chr11 5297787 5297806 5297790 -
gtgttaccacagttgaacag

SEQ ID NO: 62131 - DNA, 20 bp, Artificial Sequence
  Synthetic oligonucleotide; ATGGAT chr11 5297725 5297744 5297728 -
cttgcaatgtaaattataat

SEQ ID NO: 62132 - DNA, 20 bp, Artificial Sequence
  Synthetic oligonucleotide; CTGGAT chr11 5297618 5297637 5297621 -
gaaaagcctagatatagaaa

SEQ ID NO: 62133 - DNA, 20 bp, Artificial Sequence
  Synthetic oligonucleotide; ATGAGT chr11 5297606 5297625 5297609 -
tatagaaactggatcctcac

SEQ ID NO: 62134 - DNA, 20 bp, Artificial Sequence
  Synthetic oligonucleotide; CAGAAT chr11 5297583 5297602 5297586 -
agttcagtatataattgtaa

SEQ ID NO: 62135 - DNA, 20 bp, Artificial Sequence
  Synthetic oligonucleotide; TCGAGT chr11 5297498 5297517 5297501 -
ctgattatcacaaaaatact

SEQ ID NO: 62136 - DNA, 20 bp, Artificial Sequence
  Synthetic oligonucleotide; AGGGAT chr11 5297342 5297361 5297345 -
atgtggtataaatgagacag

SEQ ID NO: 62137 - DNA, 20 bp, Artificial Sequence
  Synthetic oligonucleotide; ATGAAT chr11 5297313 5297332 5297316 -
tctccttcctatgctgtcag

SEQ ID NO: 62138 - DNA, 20 bp, Artificial Sequence
  Synthetic oligonucleotide; TAGAAT chr11 5297300 5297319 5297303 -
ctgtcagatgaatactgaga

SEQ ID NO: 62139 - DNA, 20 bp, Artificial Sequence
  Synthetic oligonucleotide; TTGGGT chr11 5297238 5297257 5297241 -
catttctgtctgttgaagat

SEQ ID NO: 62140 - DNA, 20 bp, Artificial Sequence
  Synthetic oligonucleotide; GGGGAT chr11 5297230 5297249 5297233 -
tctgttgaagatttgggtgt

SEQ ID NO: 62141 - DNA, 20 bp, Artificial Sequence
  Synthetic oligonucleotide; AGGGAT chr11 5297204 5297223 5297207 -
aactcaaggtatcatatcca

SEQ ID NO: 62142 - DNA, 20 bp, Artificial Sequence
  Synthetic oligonucleotide; ATGGAT chr11 5297200 5297219 5297203 -
caaggtatcatatccaaggg

SEQ ID NO: 62143 - DNA, 20 bp, Artificial Sequence
  Synthetic oligonucleotide; AAGGAT chr11 5297166 5297185 5297169 -
gtgactctaacagaaaggga

SEQ ID NO: 62144 - DNA, 20 bp, Artificial Sequence
  Synthetic oligonucleotide; ATGAAT chr11 5297085 5297104 5297088 -
tgcatgcattggcaatgttt

SEQ ID NO: 62145 - DNA, 20 bp, Artificial Sequence
  Synthetic oligonucleotide; AGGGGT chr11 5297030 5297049 5297033 -
caaaagtgtttcatgtgcct

SEQ ID NO: 62146 - DNA, 20 bp, Artificial Sequence
  Synthetic oligonucleotide; TTGAGT chr11 5297014 5297033 5297017 -
gcctaggggtgtcaaatact

SEQ ID NO: 62147 - DNA, 20 bp, Artificial Sequence
  Synthetic oligonucleotide; CTGAAT chr11 5296979 5296998 5296982 -
tatacttctctgtaatgtgt

SEQ ID NO: 62148 - DNA, 20 bp, Artificial Sequence
  Synthetic oligonucleotide; AGGGAT chr11 5296795 5296814 5296798 -
aacagctgtgtagcctaatt

SEQ ID NO: 62149 - DNA, 20 bp, Artificial Sequence
  Synthetic oligonucleotide; TAGGGT chr11 5296714 5296733 5296717 -
gtatatttatcagaagtctt

SEQ ID NO: 62150 - DNA, 20 bp, Artificial Sequence
  Synthetic oligonucleotide; AGGAAT chr11 5296701 5296720 5296704 -
aagtctttagggtcatgaaa

SEQ ID NO: 62151 - DNA, 20 bp, Artificial Sequence
  Synthetic oligonucleotide; TGGAGT chr11 5296506 5296525 5296509 -
gttttaatctaaatctatct

SEQ ID NO: 62152 - DNA, 20 bp, Artificial Sequence
  Synthetic oligonucleotide; ATGGAT chr11 5296339 5296358 5296342 -
gtttacataaagaaaataag

SEQ ID NO: 62153 - DNA, 20 bp, Artificial Sequence
  Synthetic oligonucleotide; CTGAGT chr11 5296280 5296299 5296283 -
gaaaaaaaatactccatatt

SEQ ID NO: 62154 - DNA, 20 bp, Artificial Sequence
  Synthetic oligonucleotide; CAGAGT chr11 5296191 5296210 5296194 -
tatataaaagatattttaaa

SEQ ID NO: 62155 - DNA, 20 bp, Artificial Sequence
  Synthetic oligonucleotide; AGGAAT chr11 5296087 5296106 5296090 -
tcatagcattttaaatagtt

SEQ ID NO: 62156 - DNA, 20 bp, Artificial Sequence
  Synthetic oligonucleotide; TAGAGT chr11 5296041 5296060 5296044 -
ttctaagtttcccacaaact

SEQ ID NO: 62157 - DNA, 20 bp, Artificial Sequence
  Synthetic oligonucleotide; ATGGGT chr11 5295951 5295970 5295954 -
gtcaaaaatatatgtacatt

SEQ ID NO: 62158 - DNA, 20 bp, Artificial Sequence
  Synthetic oligonucleotide; AAGAGT chr11 5295806 5295825 5295809 -
tttagtacatctaagaagaa

SEQ ID NO: 62159 - DNA, 20 bp, Artificial Sequence
  Synthetic oligonucleotide; CTGAGT chr11 5295782 5295801 5295785 -
gttttgtctcttatccacct

SEQ ID NO: 62160 - DNA, 20 bp, Artificial Sequence
  Synthetic oligonucleotide; CTGGAT chr11 5295722 5295741 5295725 -
tcccacagccccacttagct

SEQ ID NO: 62161 - DNA, 20 bp, Artificial Sequence
  Synthetic oligonucleotide; TGGAGT chr11 5295716 5295735 5295719 -
agccccacttagctctggat

SEQ ID NO: 62162 - DNA, 20 bp, Artificial Sequence
  Synthetic oligonucleotide; ATGGAT chr11 5295670 5295689 5295673 -
actacatggacgtaaaatgc

SEQ ID NO: 62163 - DNA, 20 bp, Artificial Sequence
  Synthetic oligonucleotide; TAGGAT chr11 5295487 5295506 5295490 -
tacatcctcaatctacacac

SEQ ID NO: 62164 - DNA, 20 bp, Artificial Sequence
  Synthetic oligonucleotide; TAGAAT chr11 5295236 5295255 5295239 -
caactcatgatatttggctc

SEQ ID NO: 62165 - DNA, 20 bp, Artificial Sequence
  Synthetic oligonucleotide; CTGAAT chr11 5295223 5295242 5295226 -
ttggctctagaatacatgct

SEQ ID NO: 62166 - DNA, 20 bp, Artificial Sequence
  Synthetic oligonucleotide; TGGGGT chr11 5295144 5295163 5295147 -
ctctgaaataagacataatt

SEQ ID NO: 62167 - DNA, 20 bp, Artificial Sequence
  Synthetic oligonucleotide; CAGGGT chr11 5294993 5295012 5294996 -
tcctgttatttttggaagca

SEQ ID NO: 62168 - DNA, 20 bp, Artificial Sequence
  Synthetic oligonucleotide; TGGGAT chr11 5294986 5295005 5294989 -
atttttggaagcacagggtg

SEQ ID NO: 62169 - DNA, 20 bp, Artificial Sequence
  Synthetic oligonucleotide; GGGAGT chr11 5294732 5294751 5294735 -
gggctgtgcgccgtgcttga

SEQ ID NO: 62170 - DNA, 20 bp, Artificial Sequence
  Synthetic oligonucleotide; CCGGGT chr11 5294725 5294744 5294728 -
gcgccgtgcttgagggagtt

SEQ ID NO: 62171 - DNA, 20 bp, Artificial Sequence
  Synthetic oligonucleotide; AAGAGT chr11 5294451 5294470 5294454 -
catcgaccacccaagggctg

SEQ ID NO: 62172 - DNA, 20 bp, Artificial Sequence
  Synthetic oligonucleotide; CGGGAT chr11 5294395 5294414 5294398 -
ctccccctgcagcccaggtg

SEQ ID NO: 62173 - DNA, 20 bp, Artificial Sequence
  Synthetic oligonucleotide; CTGGGT chr11 5294386 5294405 5294389 -
cagcccaggtgcgggatcca

SEQ ID NO: 62174 - DNA, 20 bp, Artificial Sequence
  Synthetic oligonucleotide; CTGAGT chr11 5294364 5294383 5294367 -
gggtgaagccggctaggctc

SEQ ID NO: 62175 - DNA, 20 bp, Artificial Sequence
  Synthetic oligonucleotide; GGGGAT chr11 5294353 5294372 5294356 -
gctaggctcctgagtttgct

SEQ ID NO: 62176 - DNA, 20 bp, Artificial Sequence
  Synthetic oligonucleotide; AGGGAT chr11 5294323 5294342 5294326 -
agaacccttatgtctagata

SEQ ID NO: 62177 - DNA, 20 bp, Artificial Sequence
  Synthetic oligonucleotide; CAGGGT chr11 5294242 5294261 5294245 -
tcagcaccctgtgtctagct

SEQ ID NO: 62178 - DNA, 20 bp, Artificial Sequence
  Synthetic oligonucleotide; GTGAAT chr11 5294234 5294253 5294237 -
ctgtgtctagctcagggttt

SEQ ID NO: 62179 - DNA, 20 bp, Artificial Sequence
  Synthetic oligonucleotide; AGGGAT chr11 5294165 5294184 5294168 -
agaacctttatgtctagctc

SEQ ID NO: 62180 - DNA, 20 bp, Artificial Sequence
  Synthetic oligonucleotide; CAGGGT chr11 5294084 5294103 5294087 -
tcagcaccctgtgtctagct

SEQ ID NO: 62181 - DNA, 20 bp, Artificial Sequence
  Synthetic oligonucleotide; GTGAAT chr11 5294076 5294095 5294079 -
ctgtgtctagctcagggttt

SEQ ID NO: 62182 - DNA, 20 bp, Artificial Sequence
  Synthetic oligonucleotide; AGGGAT chr11 5294005 5294024 5294008 -
agaacctttatgtctagctc

SEQ ID NO: 62183 - DNA, 20 bp, Artificial Sequence
  Synthetic oligonucleotide; CAGGGT chr11 5293924 5293943 5293927 -
tcagcaccctgtgtctagct

SEQ ID NO: 62184 - DNA, 20 bp, Artificial Sequence
  Synthetic oligonucleotide; GTGAAT chr11 5293916 5293935 5293919 -
ctgtgtctagctcagggttt

SEQ ID NO: 62185 - DNA, 20 bp, Artificial Sequence
  Synthetic oligonucleotide; ATGGAT chr11 5293795 5293814 5293798 -
agaacctttgtgtctagctc

SEQ ID NO: 62186 - DNA, 20 bp, Artificial Sequence
  Synthetic oligonucleotide; CAGGAT chr11 5293733 5293752 5293736 -
cactgggctctaccaatcag

SEQ ID NO: 62187 - DNA, 20 bp, Artificial Sequence
  Synthetic oligonucleotide; GTGGGT chr11 5293727 5293746 5293730 -
gctctaccaatcagcaggat

SEQ ID NO: 62188 - DNA, 20 bp, Artificial Sequence
  Synthetic oligonucleotide; GAGAAT chr11 5293709 5293728 5293712 -
atgtgggtggggccagataa

SEQ ID NO: 62189 - DNA, 20 bp, Artificial Sequence
  Synthetic oligonucleotide; TCGGGT chr11 5293667 5293686 5293670 -
agccagcagtggcaacccgc

SEQ ID NO: 62190 - DNA, 20 bp, Artificial Sequence
  Synthetic oligonucleotide; TTGGGT chr11 5293595 5293614 5293598 -
atcttgctgctgctcactgt

SEQ ID NO: 62191 - DNA, 20 bp, Artificial Sequence
  Synthetic oligonucleotide; GAGGGT chr11 5293321 5293340 5293324 -
agaactgtaacactcaccac

SEQ ID NO: 62192 - DNA, 20 bp, Artificial Sequence
  Synthetic oligonucleotide; ATGAGT chr11 5293244 5293263 5293247 -
cacagtatgtcagaaacaat

SEQ ID NO: 62193 - DNA, 20 bp, Artificial Sequence
  Synthetic oligonucleotide; CAGAGT chr11 5293126 5293145 5293129 -
taatgtgttactccctaagg

SEQ ID NO: 62194 - DNA, 20 bp, Artificial Sequence
  Synthetic oligonucleotide; ATGAAT chr11 5292800 5292819 5292803 -
ttctttacaggccgagaaaa

SEQ ID NO: 62195 - DNA, 20 bp, Artificial Sequence
  Synthetic oligonucleotide; CTGAAT chr11 5292794 5292813 5292797 -
acaggccgagaaaaatgaat

SEQ ID NO: 62196 - DNA, 20 bp, Artificial Sequence
  Synthetic oligonucleotide; AGGAAT chr11 5292689 5292708 5292692 -
atcattattcatgatttgca

SEQ ID NO: 62197 - DNA, 20 bp, Artificial Sequence
  Synthetic oligonucleotide; TTGAAT chr11 5292615 5292634 5292618 -
tttaactatgttccagattt

SEQ ID NO: 62198 - DNA, 20 bp, Artificial Sequence
  Synthetic oligonucleotide; AAGAGT chr11 5292608 5292627 5292611 -
atgttccagatttttgaatg

SEQ ID NO: 62199 - DNA, 20 bp, Artificial Sequence
  Synthetic oligonucleotide; GTGGAT chr11 5292557 5292576 5292560 -
aaaaataagtatgtgaagtg

SEQ ID NO: 62200 - DNA, 20 bp, Artificial Sequence
  Synthetic oligonucleotide; ATGAAT chr11 5292485 5292504 5292488 -
aaagcatcatgttgtacccc

SEQ ID NO: 62201 - DNA, 20 bp, Artificial Sequence
  Synthetic oligonucleotide; ATGGGT chr11 5292283 5292302 5292286 -
gttttctctacgttatttat

SEQ ID NO: 62202 - DNA, 20 bp, Artificial Sequence
  Synthetic oligonucleotide; AAGGAT chr11 5292163 5292182 5292166 -
accaccctttccacagtcaa

SEQ ID NO: 62203 - DNA, 20 bp, Artificial Sequence
  Synthetic oligonucleotide; CAGAGT chr11 5292140 5292159 5292143 -
gatattgtagtttaatgcct

SEQ ID NO: 62204 - DNA, 20 bp, Artificial Sequence
  Synthetic oligonucleotide; TGGAAT chr11 5292083 5292102 5292086 -
cctctttaggttctccttta

SEQ ID NO: 62205 - DNA, 20 bp, Artificial Sequence
  Synthetic oligonucleotide; CAGAGT chr11 5291998 5292017 5292001 -
tatgcctctacctttattag

SEQ ID NO: 62206 - DNA, 20 bp, Artificial Sequence
  Synthetic oligonucleotide; CTGGAT chr11 5291846 5291865 5291849 -
cacgtagtctgtgcttatga

SEQ ID NO: 62207 - DNA, 20 bp, Artificial Sequence
  Synthetic oligonucleotide; ATGGGT chr11 5291798 5291817 5291801 -
ctaatgttgttcgtcataat

SEQ ID NO: 62208 - DNA, 20 bp, Artificial Sequence
  Synthetic oligonucleotide; GAGGAT chr11 5291662 5291681 5291665 -
cagtttaggctagtaagcat

SEQ ID NO: 62209 - DNA, 20 bp, Artificial Sequence
  Synthetic oligonucleotide; CAGAAT chr11 5291619 5291638 5291622 -
ttcccacagtctgttggtca

SEQ ID NO: 62210 - DNA, 20 bp, Artificial Sequence
  Synthetic oligonucleotide; CTGAGT chr11 5291610 5291629 5291613 -
tctgttggtcacagaataac

SEQ ID NO: 62211 - DNA, 20 bp, Artificial Sequence
  Synthetic oligonucleotide; AAGAGT chr11 5291592 5291611 5291595 -
acctgagtgattactgatga

SEQ ID NO: 62212 - DNA, 20 bp, Artificial Sequence
  Synthetic oligonucleotide; GAGAAT chr11 5291586 5291605 5291589 -
gtgattactgatgaaagagt

SEQ ID NO: 62213 - DNA, 20 bp, Artificial Sequence
  Synthetic oligonucleotide; GTGGAT chr11 5291517 5291536 5291520 -
aaatgtttctctttttatta

SEQ ID NO: 62214 - DNA, 20 bp, Artificial Sequence
  Synthetic oligonucleotide; GTGGGT chr11 5291357 5291376 5291360 -
aggagcccttttgattgaag

SEQ ID NO: 62215 - DNA, 20 bp, Artificial Sequence
  Synthetic oligonucleotide; CTGGAT chr11 5291325 5291344 5291328 -
accttacagggacaggacat

SEQ ID NO: 62216 - DNA, 20 bp, Artificial Sequence
  Synthetic oligonucleotide; AAGAGT chr11 5291143 5291162 5291146 -
catcggtctttctttatttc

SEQ ID NO: 62217 - DNA, 20 bp, Artificial Sequence
  Synthetic oligonucleotide; AAGAAT chr11 5291073 5291092 5291076 -
ctctttcaagagacagagaa

SEQ ID NO: 62218 - DNA, 20 bp, Artificial Sequence
  Synthetic oligonucleotide; AAGGAT chr11 5290964 5290983 5290967 -
ttctcagaagtatattttga

SEQ ID NO: 62219 - DNA, 20 bp, Artificial Sequence
  Synthetic oligonucleotide; TAGGGT chr11 5290902 5290921 5290905 -
aagaagtgatattgagaagg

SEQ ID NO: 62220 - DNA, 20 bp, Artificial Sequence
  Synthetic oligonucleotide; TAGAAT chr11 5290851 5290870 5290854 -
tttatatacatctgtattgt

SEQ ID NO: 62221 - DNA, 20 bp, Artificial Sequence
  Synthetic oligonucleotide; GTGGAT chr11 5290792 5290811 5290795 -
atatactagctatgtaacct

SEQ ID NO: 62222 - DNA, 20 bp, Artificial Sequence
  Synthetic oligonucleotide; AAGGAT chr11 5290711 5290730 5290714 -
cctgcttcatagttattaat

SEQ ID NO: 62223 - DNA, 20 bp, Artificial Sequence
  Synthetic oligonucleotide; AAGGAT chr11 5290637 5290656 5290640 -
tacacacacacacacattga

SEQ ID NO: 62224 - DNA, 20 bp, Artificial Sequence
  Synthetic oligonucleotide; CTGGAT chr11 5290533 5290552 5290536 -
ggtattatctaaatttcata

SEQ ID NO: 62225 - DNA, 20 bp, Artificial Sequence
  Synthetic oligonucleotide; AAGGGT chr11 5290474 5290493 5290477 -
tttgtcatatatttattcaa

SEQ ID NO: 62226 - DNA, 20 bp, Artificial Sequence
  Synthetic oligonucleotide; GAGGAT chr11 5290376 5290395 5290379 -
aattattctcaagttattat

SEQ ID NO: 62227 - DNA, 20 bp, Artificial Sequence
  Synthetic oligonucleotide; GAGGAT chr11 5290357 5290376 5290360 -
tgaggatgttgaaagacaga

SEQ ID NO: 62228 - DNA, 20 bp, Artificial Sequence
  Synthetic oligonucleotide; TGGGGT chr11 5290352 5290371 5290355 -
atgttgaaagacagagagga

SEQ ID NO: 62229 - DNA, 20 bp, Artificial Sequence
  Synthetic oligonucleotide; AAGAGT chr11 5290306 5290325 5290309 -
cacaattaagctaagcagct

SEQ ID NO: 62230 - DNA, 20 bp, Artificial Sequence
  Synthetic oligonucleotide; CAGGGT chr11 5290296 5290315 5290299 -
ctaagcagctaagagtcttg

SEQ ID NO: 62231 - DNA, 20 bp, Artificial Sequence
  Synthetic oligonucleotide; CAGGGT chr11 5290277 5290296 5290280 -
gcagggtagtgtagggacca

SEQ ID NO: 62232 - DNA, 20 bp, Artificial Sequence
  Synthetic oligonucleotide; TAGAAT chr11 5290260 5290279 5290263 -
ccacagggttaagggggcag

SEQ ID NO: 62233 - DNA, 20 bp, Artificial Sequence
  Synthetic oligonucleotide; GTGGAT chr11 5290150 5290169 5290153 -
ttgtttaaatgtataaataa

SEQ ID NO: 62234 - DNA, 20 bp, Artificial Sequence
  Synthetic oligonucleotide; AAGAAT chr11 5290142 5290161 5290145 -
atgtataaataagtggatga

SEQ ID NO: 62235 - DNA, 20 bp, Artificial Sequence
  Synthetic oligonucleotide; TAGAAT chr11 5290106 5290125 5290109 -
atagacagatagatgataga

SEQ ID NO: 62236 - DNA, 20 bp, Artificial Sequence
  Synthetic oligonucleotide; GTGAGT chr11 5289898 5289917 5289901 -
atttcagccatatcttaaca

SEQ ID NO: 62237 - DNA, 20 bp, Artificial Sequence
  Synthetic oligonucleotide; AAGGGT chr11 5289703 5289722 5289706 -
ctctaatcttaaaggtaaac

SEQ ID NO: 62238 - DNA, 20 bp, Artificial Sequence
  Synthetic oligonucleotide; TTGAAT chr11 5289433 5289452 5289436 -
gcctttttggtcataaaaca

SEQ ID NO: 62239 - DNA, 20 bp, Artificial Sequence
  Synthetic oligonucleotide; AGGAAT chr11 5289342 5289361 5289345 -
agtatccctcaagtagtgtc

SEQ ID NO: 62240 - DNA, 20 bp, Artificial Sequence
  Synthetic oligonucleotide; AGGAGT chr11 5289311 5289330 5289314 -
atttaaatagtctgcaagcc

SEQ ID NO: 62241 - DNA, 20 bp, Artificial Sequence
  Synthetic oligonucleotide; AAGAGT chr11 5289244 5289263 5289247 -
tgggaggactgcttgagctc

SEQ ID NO: 62242 - DNA, 20 bp, Artificial Sequence
  Synthetic oligonucleotide; GAGGAT chr11 5289123 5289142 5289126 -
tactcaggaggccgaaatgg

SEQ ID NO: 62243 - DNA, 20 bp, Artificial Sequence
  Synthetic oligonucleotide; CAGAGT chr11 5289050 5289069 5289053 -
ctgcactccagcctggacag

SEQ ID NO: 62244 - DNA, 20 bp, Artificial Sequence
  Synthetic oligonucleotide; CAGAAT chr11 5289025 5289044 5289028 -
tgaaaccttgcctcacgaaa

SEQ ID NO: 62245 - DNA, 20 bp, Artificial Sequence
  Synthetic oligonucleotide; CTGGGT chr11 5288956 5288975 5288959 -
tgatgctctaccacataggt

SEQ ID NO: 62246 - DNA, 20 bp, Artificial Sequence
  Synthetic oligonucleotide; TAGAGT chr11 5288797 5288816 5288800 -
tcaccatgttgtaactttct

SEQ ID NO: 62247 - DNA, 20 bp, Artificial Sequence
  Synthetic oligonucleotide; GTGAGT chr11 5288771 5288790 5288774 -
agtaacaatataaagttatt

SEQ ID NO: 62248 - DNA, 20 bp, Artificial Sequence
  Synthetic oligonucleotide; AGGAAT chr11 5288656 5288675 5288659 -
ttctactaagccattgaaac

SEQ ID NO: 62249 - DNA, 20 bp, Artificial Sequence
  Synthetic oligonucleotide; AAGAAT chr11 5288634 5288653 5288637 -
gaataacagaacaagattga

SEQ ID NO: 62250 - DNA, 20 bp, Artificial Sequence
  Synthetic oligonucleotide; TTGAGT chr11 5288611 5288630 5288614 -
aatacattttccgaaattac

SEQ ID NO: 62251 - DNA, 20 bp, Artificial Sequence
  Synthetic oligonucleotide; GAGGGT chr11 5288573 5288592 5288576 -
caagcacgtggacctgggag

SEQ ID NO: 62252 - DNA, 20 bp, Artificial Sequence
  Synthetic oligonucleotide; TGGGAT chr11 5288520 5288539 5288523 -
aaatgcaggtttataataga

SEQ ID NO: 62253 - DNA, 20 bp, Artificial Sequence
  Synthetic oligonucleotide; CAGGGT chr11 5288443 5288462 5288446 -
ccagtacacaagaggggacg

SEQ ID NO: 62254 - DNA, 20 bp, Artificial Sequence
  Synthetic oligonucleotide; GAGAAT chr11 5288405 5288424 5288408 -
ctcattctttttcttagtgt

SEQ ID NO: 62255 - DNA, 20 bp, Artificial Sequence
  Synthetic oligonucleotide; AAGAAT chr11 5288399 5288418 5288402 -
ctttttcttagtgtgagaat

SEQ ID NO: 62256 - DNA, 20 bp, Artificial Sequence
  Synthetic oligonucleotide; CTGAGT chr11 5288384 5288403 5288387 -
agaataagaatagccatgac

SEQ ID NO: 62257 - DNA, 20 bp, Artificial Sequence
  Synthetic oligonucleotide; AGGGGT chr11 5288227 5288246 5288230 -
ctgcagagccagggccgaga

SEQ ID NO: 62258 - DNA, 20 bp, Artificial Sequence
  Synthetic oligonucleotide; CAGGGT chr11 5288189 5288208 5288192 -
ctctccctcccattcccgag

SEQ ID NO: 62259 - DNA, 20 bp, Artificial Sequence
  Synthetic oligonucleotide; TAGAAT chr11 5288096 5288115 5288099 -
gctgtgacatggaaactatg

SEQ ID NO: 62260 - DNA, 20 bp, Artificial Sequence
  Synthetic oligonucleotide; TTGGGT chr11 5288087 5288106 5288090 -
tggaaactatgtagaatatt

SEQ ID NO: 62261 - DNA, 20 bp, Artificial Sequence
  Synthetic oligonucleotide; TTGAAT chr11 5288006 5288025 5288009 -
tagacagaaagtcaggagct

SEQ ID NO: 62262 - DNA, 20 bp, Artificial Sequence
  Synthetic oligonucleotide; AGGAGT chr11 5287924 5287943 5287927 -
cagtttctctttttataagt

SEQ ID NO: 62263 - DNA, 20 bp, Artificial Sequence
  Synthetic oligonucleotide; TGGAGT chr11 5287917 5287936 5287920 -
tctttttataagtaggagtc

SEQ ID NO: 62264 - DNA, 20 bp, Artificial Sequence
  Synthetic oligonucleotide; CTGAGT chr11 5287742 5287761 5287745 -
ctcaccttcacccaggccca

SEQ ID NO: 62265 - DNA, 20 bp, Artificial Sequence
  Synthetic oligonucleotide; GAGGAT chr11 5287699 5287718 5287702 -
tagttcacgtgtgtaaaaag

SEQ ID NO: 62266 - DNA, 20 bp, Artificial Sequence
  Synthetic oligonucleotide; AAGAGT chr11 5287559 5287578 5287562 -
ggcagtatagagcagagatt

SEQ ID NO: 62267 - DNA, 20 bp, Artificial Sequence
  Synthetic oligonucleotide; CTGAGT chr11 5287531 5287550 5287534 -
agatgctggagccagaccac

SEQ ID NO: 62268 - DNA, 20 bp, Artificial Sequence
  Synthetic oligonucleotide; GAGGGT chr11 5287466 5287485 5287469 -
gtttcttcatctgtaaaatg

SEQ ID NO: 62269 - DNA, 20 bp, Artificial Sequence
  Synthetic oligonucleotide; AAGGGT chr11 5287436 5287455 5287439 -
taattagtttgtttttgaga

SEQ ID NO: 62270 - DNA, 20 bp, Artificial Sequence
  Synthetic oligonucleotide; GGGAGT chr11 5287411 5287430 5287414 -
tctcactctgtcacccaaat

SEQ ID NO: 62271 - DNA, 20 bp, Artificial Sequence
  Synthetic oligonucleotide; CTGAGT chr11 5287335 5287354 5287338 -
ggtcctcccacctcaacatc

SEQ ID NO: 62272 - DNA, 20 bp, Artificial Sequence
  Synthetic oligonucleotide; TGGGGT chr11 5287269 5287288 5287272 -
ttttgtatttttggtagaga

SEQ ID NO: 62273 - DNA, 20 bp, Artificial Sequence
  Synthetic oligonucleotide; CAGGAT chr11 5287250 5287269 5287253 -
atggggtttcacatgttaca

SEQ ID NO: 62274 - DNA, 20 bp, Artificial Sequence
  Synthetic oligonucleotide; TGGGAT chr11 5287191 5287210 5287194 -
acctcagccttccaaagtgc

SEQ ID NO: 62275 - DNA, 20 bp, Artificial Sequence
  Synthetic oligonucleotide; AGGAGT chr11 5287170 5287189 5287173 -
gggattataagcatgattac

SEQ ID NO: 62276 - DNA, 20 bp, Artificial Sequence
  Synthetic oligonucleotide; CCGAGT chr11 5287134 5287153 5287137 -
tcataagattgttctgcagc

SEQ ID NO: 62277 - DNA, 20 bp, Artificial Sequence
  Synthetic oligonucleotide; GTGAGT chr11 5287130 5287149 5287133 -
aagattgttctgcagcccga

SEQ ID NO: 62278 - DNA, 20 bp, Artificial Sequence
  Synthetic oligonucleotide; AAGAGT chr11 5287113 5287132 5287116 -
cgagtgagttaatacatgca

SEQ ID NO: 62279 - DNA, 20 bp, Artificial Sequence
  Synthetic oligonucleotide; TTGGAT chr11 5286896 5286915 5286899 -
attaatcatatttaatactc

SEQ ID NO: 62280 - DNA, 20 bp, Artificial Sequence
  Synthetic oligonucleotide; TAGAAT chr11 5286777 5286796 5286780 -
cataaactactagcaaatag

SEQ ID NO: 62281 - DNA, 20 bp, Artificial Sequence
  Synthetic oligonucleotide; CTGGAT chr11 5286693 5286712 5286696 -
acttcttggcagtctgtatg

SEQ ID NO: 62282 - DNA, 20 bp, Artificial Sequence
  Synthetic oligonucleotide; GGGGAT chr11 5286684 5286703 5286687 -
cagtctgtatgctggatgct

SEQ ID NO: 62283 - DNA, 20 bp, Artificial Sequence
  Synthetic oligonucleotide; TGGGAT chr11 5286529 5286548 5286532 -
tattcgtctgtgtcctgctc

SEQ ID NO: 62284 - DNA, 20 bp, Artificial Sequence
  Synthetic oligonucleotide; AGGGGT chr11 5286456 5286475 5286459 -
aagactacaccatgtggaga

SEQ ID NO: 62285 - DNA, 20 bp, Artificial Sequence
  Synthetic oligonucleotide; TAGAGT chr11 5286372 5286391 5286375 -
gtggctctctggttgactgt

SEQ ID NO: 62286 - DNA, 20 bp, Artificial Sequence
  Synthetic oligonucleotide; ATGAAT chr11 5286328 5286347 5286331 -
gcctattatttaacaaatgc

SEQ ID NO: 62287 - DNA, 20 bp, Artificial Sequence
  Synthetic oligonucleotide; CAGAAT chr11 5286318 5286337 5286321 -
taacaaatgcatgaatgctt

SEQ ID NO: 62288 - DNA, 20 bp, Artificial Sequence
  Synthetic oligonucleotide; GGGAAT chr11 5286310 5286329 5286313 -
gcatgaatgcttcagaatat

SEQ ID NO: 62289 - DNA, 20 bp, Artificial Sequence
  Synthetic oligonucleotide; TGGAAT chr11 5286295 5286314 5286298 -
aatatgggaatattatcttc

SEQ ID NO: 62290 - DNA, 20 bp, Artificial Sequence
  Synthetic oligonucleotide; GGGAAT chr11 5286288 5286307 5286291 -
gaatattatcttctggaata

SEQ ID NO: 62291 - DNA, 20 bp, Artificial Sequence
  Synthetic oligonucleotide; CAGGAT chr11 5286263 5286282 5286266 -
tcaagttatattatgtaacc

SEQ ID NO: 62292 - DNA, 20 bp, Artificial Sequence
  Synthetic oligonucleotide; AAGAAT chr11 5286237 5286256 5286240 -
tagaagattcttctgtgtgt

SEQ ID NO: 62293 - DNA, 20 bp, Artificial Sequence
  Synthetic oligonucleotide; TTGAAT chr11 5286146 5286165 5286149 -
agaaagcttttaacccatca

SEQ ID NO: 62294 - DNA, 20 bp, Artificial Sequence
  Synthetic oligonucleotide; GGGGAT chr11 5286129 5286148 5286132 -
tcattgaataaatccctata

SEQ ID NO: 62295 - DNA, 20 bp, Artificial Sequence
  Synthetic oligonucleotide; ATGAAT chr11 5285962 5285981 5285965 -
ctctcataattcttggttgc

SEQ ID NO: 62296 - DNA, 20 bp, Artificial Sequence
  Synthetic oligonucleotide; CAGGGT chr11 5285916 5285935 5285919 -
tgagacaaactatggggaag

SEQ ID NO: 62297 - DNA, 20 bp, Artificial Sequence
  Synthetic oligonucleotide; CTGAAT chr11 5285899 5285918 5285902 -
aagcagggtatgaaagagct

SEQ ID NO: 62298 - DNA, 20 bp, Artificial Sequence
  Synthetic oligonucleotide; TTGGAT chr11 5285800 5285819 5285803 -
gcttaaaatcagaagcccca

SEQ ID NO: 62299 - DNA, 20 bp, Artificial Sequence
  Synthetic oligonucleotide; AAGAGT chr11 5285794 5285813 5285797 -
aatcagaagccccattggat

SEQ ID NO: 62300 - DNA, 20 bp, Artificial Sequence
  Synthetic oligonucleotide; AGGGAT chr11 5285717 5285736 5285720 -
gcctcctgccccgaacttcc

SEQ ID NO: 62301 - DNA, 20 bp, Artificial Sequence
  Synthetic oligonucleotide; TGGAAT chr11 5285690 5285709 5285693 -
ctctcttaagtgtttcctgc

SEQ ID NO: 62302 - DNA, 20 bp, Artificial Sequence
  Synthetic oligonucleotide; AAGAGT chr11 5285629 5285648 5285632 -
tccagcccctggctagttga

SEQ ID NO: 62303 - DNA, 20 bp, Artificial Sequence
  Synthetic oligonucleotide; CTGGAT chr11 5285554 5285573 5285557 -
tactttcagcgttggacaac

SEQ ID NO: 62304 - DNA, 20 bp, Artificial Sequence
  Synthetic oligonucleotide; GAGAAT chr11 5285460 5285479 5285463 -
gctgagatgatctatgtggg

SEQ ID NO: 62305 - DNA, 20 bp, Artificial Sequence
  Synthetic oligonucleotide; CAGAAT chr11 5285394 5285413 5285397 -
ctcattcccactttaatatc

SEQ ID NO: 62306 - DNA, 20 bp, Artificial Sequence
  Synthetic oligonucleotide; AAGAAT chr11 5285379 5285398 5285382 -
atatccagaatcactataag

SEQ ID NO: 62307 - DNA, 20 bp, Artificial Sequence
  Synthetic oligonucleotide; AGGAAT chr11 5285365 5285384 5285368 -
tataagaagaatataataag

SEQ ID NO: 62308 - DNA, 20 bp, Artificial Sequence
  Synthetic oligonucleotide; TGGGAT chr11 5285317 5285336 5285320 -
aaattaagaggcatacgtga

SEQ ID NO: 62309 - DNA, 20 bp, Artificial Sequence
  Synthetic oligonucleotide; ATGAGT chr11 5285313 5285332 5285316 -
taagaggcatacgtgatggg

SEQ ID NO: 62310 - DNA, 20 bp, Artificial Sequence
  Synthetic oligonucleotide; AAGGAT chr11 5285293 5285312 5285296 -
atgagtaagagaggagaggg

SEQ ID NO: 62311 - DNA, 20 bp, Artificial Sequence
  Synthetic oligonucleotide; AAGAGT chr11 5285147 5285166 5285150 -
catgacaagactgagctcag

SEQ ID NO: 62312 - DNA, 20 bp, Artificial Sequence
  Synthetic oligonucleotide; GAGGAT chr11 5285045 5285064 5285048 -
ccctgtgctgcactgatgag

SEQ ID NO: 62313 - DNA, 20 bp, Artificial Sequence
  Synthetic oligonucleotide; ATGGAT chr11 5285036 5285055 5285039 -
gcactgatgaggaggatcag

SEQ ID NO: 62314 - DNA, 20 bp, Artificial Sequence
  Synthetic oligonucleotide; AGGAAT chr11 5285015 5285034 5285018 -
tggatggggcaatgaagcaa

SEQ ID NO: 62315 - DNA, 20 bp, Artificial Sequence
  Synthetic oligonucleotide; GTGGAT chr11 5285003 5285022 5285006 -
tgaagcaaaggaatcattct

SEQ ID NO: 62316 - DNA, 20 bp, Artificial Sequence
  Synthetic oligonucleotide; AGGAGT chr11 5284952 5284971 5284955 -
atgactgtaaatttgggagc

SEQ ID NO: 62317 - DNA, 20 bp, Artificial Sequence
  Synthetic oligonucleotide; TTGGAT chr11 5284936 5284955 5284939 -
gagcaggagtctctaaggac

SEQ ID NO: 62318 - DNA, 20 bp, Artificial Sequence
  Synthetic oligonucleotide; AGGAAT chr11 5284926 5284945 5284929 -
ctctaaggacttggatttca

SEQ ID NO: 62319 - DNA, 20 bp, Artificial Sequence
  Synthetic oligonucleotide; GAGGGT chr11 5284843 5284862 5284846 -
tgtctatcagaggttccagg

SEQ ID NO: 62320 - DNA, 20 bp, Artificial Sequence
  Synthetic oligonucleotide; TGGGGT chr11 5284838 5284857 5284841 -
atcagaggttccagggaggg

SEQ ID NO: 62321 - DNA, 20 bp, Artificial Sequence
  Synthetic oligonucleotide; TGGGGT chr11 5284833 5284852 5284836 -
aggttccagggagggtgggg

SEQ ID NO: 62322 - DNA, 20 bp, Artificial Sequence
  Synthetic oligonucleotide; ATGGGT chr11 5284797 5284816 5284800 -
caccagctatcagggcccag

SEQ ID NO: 62323 - DNA, 20 bp, Artificial Sequence
  Synthetic oligonucleotide; CTGGGT chr11 5284745 5284764 5284748 -
gttaggtcaggttggtggtg

SEQ ID NO: 62324 - DNA, 20 bp, Artificial Sequence
  Synthetic oligonucleotide; TGGAGT chr11 5284740 5284759 5284743 -
gtcaggttggtggtgctggg

SEQ ID NO: 62325 - DNA, 20 bp, Artificial Sequence
  Synthetic oligonucleotide; ATGAGT chr11 5284702 5284721 5284705 -
ggagccaggagagatagacc

SEQ ID NO: 62326 - DNA, 20 bp, Artificial Sequence
  Synthetic oligonucleotide; CAGGAT chr11 5284575 5284594 5284578 -
tgccttgactcctatgtttt

SEQ ID NO: 62327 - DNA, 20 bp, Artificial Sequence
  Synthetic oligonucleotide; AAGAGT chr11 5284554 5284573 5284557 -
aggatcatcatctataaagt

SEQ ID NO: 62328 - DNA, 20 bp, Artificial Sequence
  Synthetic oligonucleotide; TAGGGT chr11 5284529 5284548 5284532 -
taataattgtgtctatctca

SEQ ID NO: 62329 - DNA, 20 bp, Artificial Sequence
  Synthetic oligonucleotide; GAGGAT chr11 5284517 5284536 5284520 -
ctatctcatagggttattat

SEQ ID NO: 62330 - DNA, 20 bp, Artificial Sequence
  Synthetic oligonucleotide; ATGGGT chr11 5284443 5284462 5284446 -
gagctatgggcttcctatgt

SEQ ID NO: 62331 - DNA, 20 bp, Artificial Sequence
  Synthetic oligonucleotide; TCGAAT chr11 5284289 5284308 5284292 -
accagctgctgcagtcaaag

SEQ ID NO: 62332 - DNA, 20 bp, Artificial Sequence
  Synthetic oligonucleotide; AGGAAT chr11 5284122 5284141 5284125 -
tctgaacatgagaaattttt

SEQ ID NO: 62333 - DNA, 20 bp, Artificial Sequence
  Synthetic oligonucleotide; AGGAGT chr11 5284110 5284129 5284113 -
aaatttttaggaatctgcac

SEQ ID NO: 62334 - DNA, 20 bp, Artificial Sequence
  Synthetic oligonucleotide; GGGAAT chr11 5284010 5284029 5284013 -
gaggtaaatgaaagagaagt

SEQ ID NO: 62335 - DNA, 20 bp, Artificial Sequence
  Synthetic oligonucleotide; TTGAGT chr11 5283871 5283890 5283874 -
ctaatgataagtaacacctc

SEQ ID NO: 62336 - DNA, 20 bp, Artificial Sequence
  Synthetic oligonucleotide; TAGAAT chr11 5283852 5283871 5283855 -
cttgagtacttagtatatgc

SEQ ID NO: 62337 - DNA, 20 bp, Artificial Sequence
  Synthetic oligonucleotide; TGGGAT chr11 5283801 5283820 5283804 -
cgggcacggtggctcatata

SEQ ID NO: 62338 - DNA, 20 bp, Artificial Sequence
  Synthetic oligonucleotide; TTGGAT chr11 5283755 5283774 5283758 -
actttgggaggccaaggcaa

SEQ ID NO: 62339 - DNA, 20 bp, Artificial Sequence
  Synthetic oligonucleotide; AGGAGT chr11 5283738 5283757 5283741 -
caattggatcacctgaggtc

SEQ ID NO: 62340 - DNA, 20 bp, Artificial Sequence
  Synthetic oligonucleotide; GAGAAT chr11 5283618 5283637 5283621 -
tactcaggaggctgaggcag

SEQ ID NO: 62341 - DNA, 20 bp, Artificial Sequence
  Synthetic oligonucleotide; CAGAGT chr11 5283545 5283564 5283548 -
ctgcactccagcctaggcga

SEQ ID NO: 62342 - DNA, 20 bp, Artificial Sequence
  Synthetic oligonucleotide; ATGAAT chr11 5283501 5283520 5283504 -
aaaaaaaagaagtttattat

SEQ ID NO: 62343 - DNA, 20 bp, Artificial Sequence
  Synthetic oligonucleotide; TAGGAT chr11 5283242 5283261 5283245 -
gaaccaccaagtagtaaggc

SEQ ID NO: 62344 - DNA, 20 bp, Artificial Sequence
  Synthetic oligonucleotide; GTGGAT chr11 5283170 5283189 5283173 -
aaaacacaaactcagatatt

SEQ ID NO: 62345 - DNA, 20 bp, Artificial Sequence
  Synthetic oligonucleotide; CAGAAT chr11 5282987 5283006 5282990 -
gaaaaatttagaaacaactt

SEQ ID NO: 62346 - DNA, 20 bp, Artificial Sequence
  Synthetic oligonucleotide; TTGGGT chr11 5282967 5282986 5282970 -
cagaataaagagattttctc

SEQ ID NO: 62347 - DNA, 20 bp, Artificial Sequence
  Synthetic oligonucleotide; GGGAGT chr11 5282851 5282870 5282854 -
aagctgcaactttggttaaa

SEQ ID NO: 62348 - DNA, 20 bp, Artificial Sequence
  Synthetic oligonucleotide; AGGAAT chr11 5282683 5282702 5282686 -
tgagggccctaaactatgct

SEQ ID NO: 62349 - DNA, 20 bp, Artificial Sequence
  Synthetic oligonucleotide; CCGGGT chr11 5282608 5282627 5282611 -
attctctgcatctccctttg

SEQ ID NO: 62350 - DNA, 20 bp, Artificial Sequence
  Synthetic oligonucleotide; AAGAAT chr11 5282498 5282517 5282501 -
ttgtctttctcatctgtaaa

SEQ ID NO: 62351 - DNA, 20 bp, Artificial Sequence
  Synthetic oligonucleotide; TAGAGT chr11 5282446 5282465 5282449 -
ctatgtcttccctgatgggc

SEQ ID NO: 62352 - DNA, 20 bp, Artificial Sequence
  Synthetic oligonucleotide; AAGGGT chr11 5282334 5282353 5282337 -
gtcaaaagtaggctaagtag

SEQ ID NO: 62353 - DNA, 20 bp, Artificial Sequence
  Synthetic oligonucleotide; GTGGGT chr11 5282300 5282319 5282303 -
aggaacagagagcaaaagag

SEQ ID NO: 62354 - DNA, 20 bp, Artificial Sequence
  Synthetic oligonucleotide; GTGAAT chr11 5282296 5282315 5282299 -
acagagagcaaaagaggtgg

SEQ ID NO: 62355 - DNA, 20 bp, Artificial Sequence
  Synthetic oligonucleotide; GAGGGT chr11 5282288 5282307 5282291 -
caaaagaggtgggtgaatga

SEQ ID NO: 62356 - DNA, 20 bp, Artificial Sequence
  Synthetic oligonucleotide; GGGAAT chr11 5282222 5282241 5282225 -
tgttgtctaaatatctccta

SEQ ID NO: 62357 - DNA, 20 bp, Artificial Sequence
  Synthetic oligonucleotide; CTGAAT chr11 5282203 5282222 5282206 -
agggaattattgtgagaggt

SEQ ID NO: 62358 - DNA, 20 bp, Artificial Sequence
  Synthetic oligonucleotide; CTGAAT chr11 5282181 5282200 5282184 -
gaatagtgttgtaaaataag

SEQ ID NO: 62359 - DNA, 20 bp, Artificial Sequence
  Synthetic oligonucleotide; CCGAAT chr11 5282143 5282162 5282146 -
ttaacagtcaagaaatacct

SEQ ID NO: 62360 - DNA, 20 bp, Artificial Sequence
  Synthetic oligonucleotide; CTGAAT chr11 5282047 5282066 5282050 -
actgtaacagaaaacactta

SEQ ID NO: 62361 - DNA, 20 bp, Artificial Sequence
  Synthetic oligonucleotide; AGGGAT chr11 5281823 5281842 5281826 -
gttgattgccttaattcatc

SEQ ID NO: 62362 - DNA, 20 bp, Artificial Sequence
  Synthetic oligonucleotide; ATGAGT chr11 5281695 5281714 5281698 -
gaaaggcagagctgactgtg

SEQ ID NO: 62363 - DNA, 20 bp, Artificial Sequence
  Synthetic oligonucleotide; CTGGGT chr11 5281670 5281689 5281673 -
tgatgaaggtgccttctcat

SEQ ID NO: 62364 - DNA, 20 bp, Artificial Sequence
  Synthetic oligonucleotide; GAGAAT chr11 5281583 5281602 5281586 -
gcttgccctgatgggagata

SEQ ID NO: 62365 - DNA, 20 bp, Artificial Sequence
  Synthetic oligonucleotide; ATGGGT chr11 5281579 5281598 5281582 -
gccctgatgggagatagaga

SEQ ID NO: 62366 - DNA, 20 bp, Artificial Sequence
  Synthetic oligonucleotide; GTGGGT chr11 5281363 5281382 5281366 -
cagcactttgggaggctgag

SEQ ID NO: 62367 - DNA, 20 bp, Artificial Sequence
  Synthetic oligonucleotide; AGGAGT chr11 5281341 5281360 5281344 -
gggtggactgcttggagctc

SEQ ID NO: 62368 - DNA, 20 bp, Artificial Sequence
  Synthetic oligonucleotide; TAGGGT chr11 5281240 5281259 5281243 -
gcacctgtaatcccagctat

SEQ ID NO: 62369 - DNA, 20 bp, Artificial Sequence
  Synthetic oligonucleotide; GAGAAT chr11 5281223 5281242 5281226 -
tattagggtggctgaggcag

SEQ ID NO: 62370 - DNA, 20 bp, Artificial Sequence
  Synthetic oligonucleotide; GGGAAT chr11 5281104 5281123 5281107 -
tttttacttggactcttgtg

SEQ ID NO: 62371 - DNA, 20 bp, Artificial Sequence
  Synthetic oligonucleotide; CTGAAT chr11 5281017 5281036 5281020 -
aggtgcttcaaaaccatttg

SEQ ID NO: 62372 - DNA, 20 bp, Artificial Sequence
  Synthetic oligonucleotide; CGGGGT chr11 5280848 5280867 5280851 -
agttctggccaggcccctgt

SEQ ID NO: 62373 - DNA, 20 bp, Artificial Sequence
  Synthetic oligonucleotide; CTGAGT chr11 5280771 5280790 5280774 -
ctggctcaagcacagcaatg

SEQ ID NO: 62374 - DNA, 20 bp, Artificial Sequence
  Synthetic oligonucleotide; ATGAGT chr11 5280761 5280780 5280764 -
cacagcaatgctgagtcatg

SEQ ID NO: 62375 - DNA, 20 bp, Artificial Sequence
  Synthetic oligonucleotide; TAGGGT chr11 5280743 5280762 5280746 -
tgatgagtcatgctgaggct

SEQ ID NO: 62376 - DNA, 20 bp, Artificial Sequence
  Synthetic oligonucleotide; TAGAGT chr11 5280715 5280734 5280718 -
gtgcccagatgttctcagcc

SEQ ID NO: 62377 - DNA, 20 bp, Artificial Sequence
  Synthetic oligonucleotide; CTGGGT chr11 5280697 5280716 5280700 -
cctagagtgatgactcctat

SEQ ID NO: 62378 - DNA, 20 bp, Artificial Sequence
  Synthetic oligonucleotide; CAGGAT chr11 5280685 5280704 5280688 -
actcctatctgggtccccag

SEQ ID NO: 62379 - DNA, 20 bp, Artificial Sequence
  Synthetic oligonucleotide; ATGGAT chr11 5280600 5280619 5280603 -
caaacggcatcataaagaaa

SEQ ID NO: 62380 - DNA, 20 bp, Artificial Sequence
  Synthetic oligonucleotide; CAGAAT chr11 5280586 5280605 5280589 -
aagaaaatggatgcctgaga

SEQ ID NO: 62381 - DNA, 20 bp, Artificial Sequence
  Synthetic oligonucleotide; TAGAAT chr11 5280569 5280588 5280572 -
agacagaatgtgacatattc

SEQ ID NO: 62382 - DNA, 20 bp, Artificial Sequence
  Synthetic oligonucleotide; CTGAAT chr11 5280553 5280572 5280556 -
attctagaatatattatttc

SEQ ID NO: 62383 - DNA, 20 bp, Artificial Sequence
  Synthetic oligonucleotide; TAGAAT chr11 5280480 5280499 5280483 -
tttgttgttatcaattgcca

SEQ ID NO: 62384 - DNA, 20 bp, Artificial Sequence
  Synthetic oligonucleotide; GTGAAT chr11 5280463 5280482 5280466 -
ccatagaatgattagttatt

SEQ ID NO: 62385 - DNA, 20 bp, Artificial Sequence
  Synthetic oligonucleotide; CAGAAT chr11 5280416 5280435 5280419 -
gcctctatacctagaagcgg

SEQ ID NO: 62386 - DNA, 20 bp, Artificial Sequence
  Synthetic oligonucleotide; TAGGAT chr11 5280379 5280398 5280382 -
aatacatgtgtatagatttt

SEQ ID NO: 62387 - DNA, 20 bp, Artificial Sequence
  Synthetic oligonucleotide; AAGGAT chr11 5280348 5280367 5280351 -
cacatgtattaatatgaaac

SEQ ID NO: 62388 - DNA, 20 bp, Artificial Sequence
  Synthetic oligonucleotide; CGGGGT chr11 5280224 5280243 5280227 -
agaggacacatgctcacata

SEQ ID NO: 62389 - DNA, 20 bp, Artificial Sequence
  Synthetic oligonucleotide; TGGGGT chr11 5280207 5280226 5280210 -
atacggggtcagatctgact

SEQ ID NO: 62390 - DNA, 20 bp, Artificial Sequence
  Synthetic oligonucleotide; AAGGAT chr11 5280179 5280198 5280182 -
tactgggaagctctcatctt

SEQ ID NO: 62391 - DNA, 20 bp, Artificial Sequence
  Synthetic oligonucleotide; AAGGGT chr11 5280088 5280107 5280091 -
cattcctccaggagagctaa

SEQ ID NO: 62392 - DNA, 20 bp, Artificial Sequence
  Synthetic oligonucleotide; GTGGGT chr11 5280074 5280093 5280077 -
agctaaaagggttcacctgt

SEQ ID NO: 62393 - DNA, 20 bp, Artificial Sequence
  Synthetic oligonucleotide; GAGGAT chr11 5280050 5280069 5280053 -
gtaactgtgaaggactacaa

SEQ ID NO: 62394 - DNA, 20 bp, Artificial Sequence
  Synthetic oligonucleotide; GGGGAT chr11 5279990 5280009 5279993 -
gagaaaaaacaggaggtcaa

SEQ ID NO: 62395 - DNA, 20 bp, Artificial Sequence
  Synthetic oligonucleotide; AAGAAT chr11 5279969 5279988 5279972 -
gggatagagaaggcttccag

SEQ ID NO: 62396 - DNA, 20 bp, Artificial Sequence
  Synthetic oligonucleotide; AGGAGT chr11 5279942 5279961 5279945 -
gctttgaagctggcttctgt

SEQ ID NO: 62397 - DNA, 20 bp, Artificial Sequence
  Synthetic oligonucleotide; AGGAAT chr11 5279833 5279852 5279836 -
attagttcaacagacatgca

SEQ ID NO: 62398 - DNA, 20 bp, Artificial Sequence
  Synthetic oligonucleotide; ATGAAT chr11 5279821 5279840 5279824 -
gacatgcaaggaattttcag

SEQ ID NO: 62399 - DNA, 20 bp, Artificial Sequence
  Synthetic oligonucleotide; GAGGGT chr11 5279777 5279796 5279780 -
ttcttgaggttagcagctgt

SEQ ID NO: 62400 - DNA, 20 bp, Artificial Sequence
  Synthetic oligonucleotide; GTGAAT chr11 5279707 5279726 5279710 -
actgttttttgtattcattt

SEQ ID NO: 62401 - DNA, 20 bp, Artificial Sequence
  Synthetic oligonucleotide; ATGAAT chr11 5279703 5279722 5279706 -
ttttttgtattcatttgtga

SEQ ID NO: 62402 - DNA, 20 bp, Artificial Sequence
  Synthetic oligonucleotide; GTGAAT chr11 5279668 5279687 5279671 -
tcagtctactcggtttcgct

SEQ ID NO: 62403 - DNA, 20 bp, Artificial Sequence
  Synthetic oligonucleotide; ATGAAT chr11 5279664 5279683 5279667 -
tctactcggtttcgctgtga

SEQ ID NO: 62404 - DNA, 20 bp, Artificial Sequence
  Synthetic oligonucleotide; AAGAGT chr11 5279489 5279508 5279492 -
taagaaaggaaatcaacctg

SEQ ID NO: 62405 - DNA, 20 bp, Artificial Sequence
  Synthetic oligonucleotide; GAGAGT chr11 5279460 5279479 5279463 -
tatacagataacaaaataca

SEQ ID NO: 62406 - DNA, 20 bp, Artificial Sequence
  Synthetic oligonucleotide; GTGAGT chr11 5279456 5279475 5279459 -
cagataacaaaatacagaga

SEQ ID NO: 62407 - DNA, 20 bp, Artificial Sequence
  Synthetic oligonucleotide; TGGAAT chr11 5279423 5279442 5279426 -
gtaataactgtggcacaggc

SEQ ID NO: 62408 - DNA, 20 bp, Artificial Sequence
  Synthetic oligonucleotide; ATGGAT chr11 5279362 5279381 5279365 -
aacagtggggaaaaaattcc

SEQ ID NO: 62409 - DNA, 20 bp, Artificial Sequence
  Synthetic oligonucleotide; ATGGGT chr11 5279358 5279377 5279361 -
gtggggaaaaaattccatgg

SEQ ID NO: 62410 - DNA, 20 bp, Artificial Sequence
  Synthetic oligonucleotide; TTGAGT chr11 5279327 5279346 5279330 -
aagactagcattgttttagg

SEQ ID NO: 62411 - DNA, 20 bp, Artificial Sequence
  Synthetic oligonucleotide; AAGGGT chr11 5279310 5279329 5279313 -
aggttgagtggcagtgttta

SEQ ID NO: 62412 - DNA, 20 bp, Artificial Sequence
  Synthetic oligonucleotide; TAGAAT chr11 5279267 5279286 5279270 -
gaaatatgtggctaaataac

SEQ ID NO: 62413 - DNA, 20 bp, Artificial Sequence
  Synthetic oligonucleotide; ATGAAT chr11 5279241 5279260 5279244 -
actctttattttttcgtatc

SEQ ID NO: 62414 - DNA, 20 bp, Artificial Sequence
  Synthetic oligonucleotide; TTGAAT chr11 5279013 5279032 5279016 -
agtactcaaagcttgttaaa

SEQ ID NO: 62415 - DNA, 20 bp, Artificial Sequence
  Synthetic oligonucleotide; AGGGAT chr11 5278963 5278982 5278966 -
acatggaggaaaaactcatc

SEQ ID NO: 62416 - DNA, 20 bp, Artificial Sequence
  Synthetic oligonucleotide; TTGGGT chr11 5278913 5278932 5278916 -
ggtgtggctctgcagtgtga

SEQ ID NO: 62417 - DNA, 20 bp, Artificial Sequence
  Synthetic oligonucleotide; AAGGGT chr11 5278895 5278914 5278898 -
gattgggtacttgcaggacg

SEQ ID NO: 62418 - DNA, 20 bp, Artificial Sequence
  Synthetic oligonucleotide; TGGGGT chr11 5278890 5278909 5278893 -
ggtacttgcaggacgaaggg

SEQ ID NO: 62419 - DNA, 20 bp, Artificial Sequence
  Synthetic oligonucleotide; GGGAGT chr11 5278884 5278903 5278887 -
tgcaggacgaagggtggggt

SEQ ID NO: 62420 - DNA, 20 bp, Artificial Sequence
  Synthetic oligonucleotide; AGGAGT chr11 5278756 5278775 5278759 -
tgggcagatcacttgaggtc

SEQ ID NO: 62421 - DNA, 20 bp, Artificial Sequence
  Synthetic oligonucleotide; GAGAAT chr11 5278638 5278657 5278641 -
tacttgggaggctgaggcag

SEQ ID NO: 62422 - DNA, 20 bp, Artificial Sequence
  Synthetic oligonucleotide; TGGAGT chr11 5278615 5278634 5278618 -
aatcgcttgaaccggggagg

SEQ ID NO: 62423 - DNA, 20 bp, Artificial Sequence
  Synthetic oligonucleotide; CAGAAT chr11 5278490 5278509 5278493 -
catcaaattccctgaccgaa

SEQ ID NO: 62424 - DNA, 20 bp, Artificial Sequence
  Synthetic oligonucleotide; TAGAGT chr11 5278152 5278171 5278155 -
agccagaaattagcatgcac

SEQ ID NO: 62425 - DNA, 20 bp, Artificial Sequence
  Synthetic oligonucleotide; ATGAGT chr11 5278142 5278161 5278145 -
tagcatgcactagagtgtgc

SEQ ID NO: 62426 - DNA, 20 bp, Artificial Sequence
  Synthetic oligonucleotide; AAGGAT chr11 5278075 5278094 5278078 -
atcctgttggtttttcgtga

SEQ ID NO: 62427 - DNA, 20 bp, Artificial Sequence
  Synthetic oligonucleotide; TAGAGT chr11 5277720 5277739 5277723 -
tatatttatgtgtatgtgtg

SEQ ID NO: 62428 - DNA, 20 bp, Artificial Sequence
  Synthetic oligonucleotide; CCGAAT chr11 5277620 5277639 5277623 -
atcttttattctccccttca

SEQ ID NO: 62429 - DNA, 20 bp, Artificial Sequence
  Synthetic oligonucleotide; TAGGGT chr11 5277557 5277576 5277560 -
ttctaagcatcttacatctt

SEQ ID NO: 62430 - DNA, 20 bp, Artificial Sequence
  Synthetic oligonucleotide; ATGGGT chr11 5277498 5277517 5277501 -
ttaatcatagtttcatataa

SEQ ID NO: 62431 - DNA, 20 bp, Artificial Sequence
  Synthetic oligonucleotide; ATGGGT chr11 5277480 5277499 5277483 -
aaatgggttcctcatcatct

SEQ ID NO: 62432 - DNA, 20 bp, Artificial Sequence
  Synthetic oligonucleotide; TTGAAT chr11 5277214 5277233 5277217 -
ttcttagcaattttacaatt

SEQ ID NO: 62433 - DNA, 20 bp, Artificial Sequence
  Synthetic oligonucleotide; ATGAAT chr11 5277210 5277229 5277213 -
tagcaattttacaattttga

SEQ ID NO: 62434 - DNA, 20 bp, Artificial Sequence
  Synthetic oligonucleotide; ATGAAT chr11 5277206 5277225 5277209 -
aattttacaattttgaatga

SEQ ID NO: 62435 - DNA, 20 bp, Artificial Sequence
  Synthetic oligonucleotide; AAGGAT chr11 5277168 5277187 5277171 -
acatatacaactataattaa

SEQ ID NO: 62436 - DNA, 20 bp, Artificial Sequence
  Synthetic oligonucleotide; TGGAGT chr11 5277119 5277138 5277122 -
tgcacacacaaagaaatcag

SEQ ID NO: 62437 - DNA, 20 bp, Artificial Sequence
  Synthetic oligonucleotide; TGGGAT chr11 5277054 5277073 5277057 -
ctccgcaggcagagccttga

SEQ ID NO: 62438 - DNA, 20 bp, Artificial Sequence
  Synthetic oligonucleotide; CTGAGT chr11 5277046 5277065 5277049 -
gcagagccttgatgggatta

SEQ ID NO: 62439 - DNA, 20 bp, Artificial Sequence
  Synthetic oligonucleotide; TAGAAT chr11 5277038 5277057 5277041 -
ttgatgggattactgagttc

SEQ ID NO: 62440 - DNA, 20 bp, Artificial Sequence
  Synthetic oligonucleotide; ATGAAT chr11 5276960 5276979 5276963 -
caaaataaaaggctcaaaag

SEQ ID NO: 62441 - DNA, 20 bp, Artificial Sequence
  Synthetic oligonucleotide; CAGGGT chr11 5276946 5276965 5276949 -
caaaagatgaatatcgaaac

SEQ ID NO: 62442 - DNA, 20 bp, Artificial Sequence
  Synthetic oligonucleotide; TGGAAT chr11 5276929 5276948 5276932 -
aaccagggtgttttttacac

SEQ ID NO: 62443 - DNA, 20 bp, Artificial Sequence
  Synthetic oligonucleotide; AAGGAT chr11 5276760 5276779 5276763 -
tattcatccatcttcatggg

SEQ ID NO: 62444 - DNA, 20 bp, Artificial Sequence
  Synthetic oligonucleotide; GAGAAT chr11 5276620 5276639 5276623 -
taagcatacttctattcaat

SEQ ID NO: 62445 - DNA, 20 bp, Artificial Sequence
  Synthetic oligonucleotide; AAGAAT chr11 5276595 5276614 5276598 -
tattctgtaagattatagtt

SEQ ID NO: 62446 - DNA, 20 bp, Artificial Sequence
  Synthetic oligonucleotide; TGGGGT chr11 5276511 5276530 5276514 -
ttttaatatgctttaagttc

SEQ ID NO: 62447 - DNA, 20 bp, Artificial Sequence
  Synthetic oligonucleotide; ATGGAT chr11 5276375 5276394 5276378 -
atgttcccctccctgtgtcc

SEQ ID NO: 62448 - DNA, 20 bp, Artificial Sequence
  Synthetic oligonucleotide; TGGAAT chr11 5276318 5276337 5276321 -
taaagtctcagttaaatttt

SEQ ID NO: 62449 - DNA, 20 bp, Artificial Sequence
  Synthetic oligonucleotide; ATGGGT chr11 5275895 5275914 5275898 -
caagtctaaagaaaaaaata

SEQ ID NO: 62450 - DNA, 20 bp, Artificial Sequence
  Synthetic oligonucleotide; CTGAAT chr11 5275761 5275780 5275764 -
gagactggtgacactagtgt

SEQ ID NO: 62451 - DNA, 20 bp, Artificial Sequence
  Synthetic oligonucleotide; TTGAGT chr11 5275750 5275769 5275753 -
cactagtgtctgaatgaggc

SEQ ID NO: 62452 - DNA, 20 bp, Artificial Sequence
  Synthetic oligonucleotide; TAGAAT chr11 5275622 5275641 5275625 -
agaacaaactcctgtggggc

SEQ ID NO: 62453 - DNA, 20 bp, Artificial Sequence
  Synthetic oligonucleotide; ATGGAT chr11 5275514 5275533 5275517 -
gttttccatatttcctcatg

SEQ ID NO: 62454 - DNA, 20 bp, Artificial Sequence
  Synthetic oligonucleotide; CAGAAT chr11 5275295 5275314 5275298 -
gctttatgttgctgttgttt

SEQ ID NO: 62455 - DNA, 20 bp, Artificial Sequence
  Synthetic oligonucleotide; TGGAAT chr11 5275241 5275260 5275244 -
ctcagttctagcactagagg

SEQ ID NO: 62456 - DNA, 20 bp, Artificial Sequence
  Synthetic oligonucleotide; TTGAAT chr11 5275161 5275180 5275164 -
tgcacttaaaatagtctcat

SEQ ID NO: 62457 - DNA, 20 bp, Artificial Sequence
  Synthetic oligonucleotide; CAGAGT chr11 5275115 5275134 5275118 -
aagcacattctgaactactt

SEQ ID NO: 62458 - DNA, 20 bp, Artificial Sequence
  Synthetic oligonucleotide; AAGAAT chr11 5275043 5275062 5275046 -
caatttaattaaaaaaaccc

SEQ ID NO: 62459 - DNA, 20 bp, Artificial Sequence
  Synthetic oligonucleotide; TAGAAT chr11 5275033 5275052 5275036 -
aaaaaaacccaagaatttct

SEQ ID NO: 62460 - DNA, 20 bp, Artificial Sequence
  Synthetic oligonucleotide; TGGGAT chr11 5274933 5274952 5274936 -
agctatatttcagcggaaaa

SEQ ID NO: 62461 - DNA, 20 bp, Artificial Sequence
  Synthetic oligonucleotide; ATGAGT chr11 5274923 5274942 5274926 -
cagcggaaaatgggatattt

SEQ ID NO: 62462 - DNA, 20 bp, Artificial Sequence
  Synthetic oligonucleotide; TAGGAT chr11 5274734 5274753 5274737 -
tcccgaggtcagtcacacaa

SEQ ID NO: 62463 - DNA, 20 bp, Artificial Sequence
  Synthetic oligonucleotide; GAGAAT chr11 5274690 5274709 5274693 -
cagagagagagattactctt

SEQ ID NO: 62464 - DNA, 20 bp, Artificial Sequence
  Synthetic oligonucleotide; GAGGGT chr11 5274544 5274563 5274547 -
acgcatactggggcctatca

SEQ ID NO: 62465 - DNA, 20 bp, Artificial Sequence
  Synthetic oligonucleotide; GAGGGT chr11 5274537 5274556 5274540 -
ctggggcctatcagagggtg

SEQ ID NO: 62466 - DNA, 20 bp, Artificial Sequence
  Synthetic oligonucleotide; GAGGAT chr11 5274521 5274540 5274524 -
ggtggagggtgagagaagga

SEQ ID NO: 62467 - DNA, 20 bp, Artificial Sequence
  Synthetic oligonucleotide; ATGGAT chr11 5274500 5274519 5274503 -
aggatcaggaaaaatcacta

SEQ ID NO: 62468 - DNA, 20 bp, Artificial Sequence
  Synthetic oligonucleotide; CTGAGT chr11 5274480 5274499 5274483 -
atggatgctaagcgtaatac

SEQ ID NO: 62469 - DNA, 20 bp, Artificial Sequence
  Synthetic oligonucleotide; CAGAAT chr11 5274275 5274294 5274278 -
ggcttcctgcaaggcagcca

SEQ ID NO: 62470 - DNA, 20 bp, Artificial Sequence
  Synthetic oligonucleotide; CTGGAT chr11 5274242 5274261 5274245 -
ttgtgatatccaagtcattc

SEQ ID NO: 62471 - DNA, 20 bp, Artificial Sequence
  Synthetic oligonucleotide; TAGAAT chr11 5274210 5274229 5274213 -
aaatctaacacaaaatctag

SEQ ID NO: 62472 - DNA, 20 bp, Artificial Sequence
  Synthetic oligonucleotide; GAGAAT chr11 5274178 5274197 5274181 -
cttacatctatttttgttct

SEQ ID NO: 62473 - DNA, 20 bp, Artificial Sequence
  Synthetic oligonucleotide; CAGAAT chr11 5274148 5274167 5274151 -
atttagatacataatggaag

SEQ ID NO: 62474 - DNA, 20 bp, Artificial Sequence
  Synthetic oligonucleotide; TAGAAT chr11 5274122 5274141 5274125 -
aatttaaaatctggctaatt

SEQ ID NO: 62475 - DNA, 20 bp, Artificial Sequence
  Synthetic oligonucleotide; AAGAAT chr11 5274025 5274044 5274028 -
aaagtaagttatttgtggta

SEQ ID NO: 62476 - DNA, 20 bp, Artificial Sequence
  Synthetic oligonucleotide; AAGAAT chr11 5273944 5273963 5273947 -
aagggcctactttacttaac

SEQ ID NO: 62477 - DNA, 20 bp, Artificial Sequence
  Synthetic oligonucleotide; TTGGAT chr11 5273832 5273851 5273835 -
cagaaagatttaagaaaata

SEQ ID NO: 62478 - DNA, 20 bp, Artificial Sequence
  Synthetic oligonucleotide; TAGAAT chr11 5273792 5273811 5273795 -
attaggcatcttacagtttt

SEQ ID NO: 62479 - DNA, 20 bp, Artificial Sequence
  Synthetic oligonucleotide; AGGAAT chr11 5273736 5273755 5273739 -
taaagcaaacccaaacaggc

SEQ ID NO: 62480 - DNA, 20 bp, Artificial Sequence
  Synthetic oligonucleotide; TCGAAT chr11 5273721 5273740 5273724 -
caggcaggaattaatcttca

SEQ ID NO: 62481 - DNA, 20 bp, Artificial Sequence
  Synthetic oligonucleotide; TTGGGT chr11 5273715 5273734 5273718 -
ggaattaatcttcatcgaat

SEQ ID NO: 62482 - DNA, 20 bp, Artificial Sequence
  Synthetic oligonucleotide; ATGAAT chr11 5273624 5273643 5273627 -
tttaattatatagacaataa

SEQ ID NO: 62483 - DNA, 20 bp, Artificial Sequence
  Synthetic oligonucleotide; CTGGAT chr11 5273571 5273590 5273574 -
tctaatctttctgatctatc

SEQ ID NO: 62484 - DNA, 20 bp, Artificial Sequence
  Synthetic oligonucleotide; CTGAGT chr11 5273381 5273400 5273384 -
gcccgcagcctacctgactt

SEQ ID NO: 62485 - DNA, 20 bp, Artificial Sequence
  Synthetic oligonucleotide; CAGGAT chr11 5273375 5273394 5273378 -
agcctacctgacttctgagt

SEQ ID NO: 62486 - DNA, 20 bp, Artificial Sequence
  Synthetic oligonucleotide; TGGAAT chr11 5273275 5273294 5273278 -
cctttagccataaggaaaca

SEQ ID NO: 62487 - DNA, 20 bp, Artificial Sequence
  Synthetic oligonucleotide; ATGGGT chr11 5273271 5273290 5273274 -
tagccataaggaaacatgga

SEQ ID NO: 62488 - DNA, 20 bp, Artificial Sequence
  Synthetic oligonucleotide; CTGGAT chr11 5273258 5273277 5273261 -
acatggaatgggtcagatcc

SEQ ID NO: 62489 - DNA, 20 bp, Artificial Sequence
  Synthetic oligonucleotide; GAGGAT chr11 5273175 5273194 5273178 -
ctggctccgagggagcagga

SEQ ID NO: 62490 - DNA, 20 bp, Artificial Sequence
  Synthetic oligonucleotide; CTGAAT chr11 5273157 5273176 5273160 -
gagaggatcaaccccatact

SEQ ID NO: 62491 - DNA, 20 bp, Artificial Sequence
  Synthetic oligonucleotide; CTGAAT chr11 5273126 5273145 5273129 -
agaagactggtgtccatact

SEQ ID NO: 62492 - DNA, 20 bp, Artificial Sequence
  Synthetic oligonucleotide; AAGAAT chr11 5273117 5273136 5273120 -
gtgtccatactctgaatggg

SEQ ID NO: 62493 - DNA, 20 bp, Artificial Sequence
  Synthetic oligonucleotide; TGGGAT chr11 5273109 5273128 5273112 -
actctgaatgggaagaatga

SEQ ID NO: 62494 - DNA, 20 bp, Artificial Sequence
  Synthetic oligonucleotide; GTGGAT chr11 5272966 5272985 5272969 -
agggccactgccttcatact

SEQ ID NO: 62495 - DNA, 20 bp, Artificial Sequence
  Synthetic oligonucleotide; CTGAGT chr11 5272878 5272897 5272881 -
atctcaacgactgttcttct

SEQ ID NO: 62496 - DNA, 20 bp, Artificial Sequence
  Synthetic oligonucleotide; GTGGAT chr11 5272800 5272819 5272803 -
gtcattgttcttttatttca

SEQ ID NO: 62497 - DNA, 20 bp, Artificial Sequence
  Synthetic oligonucleotide; TAGGAT chr11 5272773 5272792 5272776 -
aaatacgttctttccaaacc

SEQ ID NO: 62498 - DNA, 20 bp, Artificial Sequence
  Synthetic oligonucleotide; TGGGGT chr11 5272723 5272742 5272726 -
tgtcccaggaagtcttaatc

SEQ ID NO: 62499 - DNA, 20 bp, Artificial Sequence
  Synthetic oligonucleotide; TTGAAT chr11 5272627 5272646 5272630 -
atttagcattttcttctact

SEQ ID NO: 62500 - DNA, 20 bp, Artificial Sequence
  Synthetic oligonucleotide; TAGAAT chr11 5272608 5272627 5272611 -
tttgaatgcaaaggacaaac

SEQ ID NO: 62501 - DNA, 20 bp, Artificial Sequence
  Synthetic oligonucleotide; TGGAGT chr11 5272499 5272518 5272502 -
gtttttgtttttgtttgaga

SEQ ID NO: 62502 - DNA, 20 bp, Artificial Sequence
  Synthetic oligonucleotide; TGGAGT chr11 5272473 5272492 5272476 -
ttcgctcttattgcccaggc

SEQ ID NO: 62503 - DNA, 20 bp, Artificial Sequence
  Synthetic oligonucleotide; CTGAGT chr11 5272397 5272416 5272400 -
aattctcctgccttggcctc

SEQ ID NO: 62504 - DNA, 20 bp, Artificial Sequence
  Synthetic oligonucleotide; GGGGAT chr11 5272387 5272406 5272390 -
ccttggcctcctgagtagct

SEQ ID NO: 62505 - DNA, 20 bp, Artificial Sequence
  Synthetic oligonucleotide; TGGGGT chr11 5272331 5272350 5272334 -
ttttgtatttttagtagaga

SEQ ID NO: 62506 - DNA, 20 bp, Artificial Sequence
  Synthetic oligonucleotide; TGGGAT chr11 5272252 5272271 5272255 -
gccttggcctcctgaagtgc

SEQ ID NO: 62507 - DNA, 20 bp, Artificial Sequence
  Synthetic oligonucleotide; TTGGAT chr11 5272178 5272197 5272181 -
acatttatctgcatcactac

SEQ ID NO: 62508 - DNA, 20 bp, Artificial Sequence
  Synthetic oligonucleotide; AGGAAT chr11 5271958 5271977 5271961 -
ctgtgacacaaaaaaagttt

SEQ ID NO: 62509 - DNA, 20 bp, Artificial Sequence
  Synthetic oligonucleotide; TAGAAT chr11 5271923 5271942 5271926 -
tgtctgtgttagccaatggt

SEQ ID NO: 62510 - DNA, 20 bp, Artificial Sequence
  Synthetic oligonucleotide; TGGAGT chr11 5271875 5271894 5271878 -
ggttaatagctaaaagaaaa

SEQ ID NO: 62511 - DNA, 20 bp, Artificial Sequence
  Synthetic oligonucleotide; TGGAAT chr11 5271854 5271873 5271857 -
ggagtagaaattcagtggcc

SEQ ID NO: 62512 - DNA, 20 bp, Artificial Sequence
  Synthetic oligonucleotide; TGGAAT chr11 5271808 5271827 5271811 -
ttaagtcaggtgaagacttc

SEQ ID NO: 62513 - DNA, 20 bp, Artificial Sequence
  Synthetic oligonucleotide; TGGAAT chr11 5271667 5271686 5271670 -
agaaacgctcttagtaaact

SEQ ID NO: 62514 - DNA, 20 bp, Artificial Sequence
  Synthetic oligonucleotide; TGGAAT chr11 5271660 5271679 5271663 -
ctcttagtaaacttggaata

SEQ ID NO: 62515 - DNA, 20 bp, Artificial Sequence
  Synthetic oligonucleotide; ATGGAT chr11 5271502 5271521 5271505 -
aggagaaagaaatggtagaa

SEQ ID NO: 62516 - DNA, 20 bp, Artificial Sequence
  Synthetic oligonucleotide; GAGAAT chr11 5271343 5271362 5271346 -
tgctcgggaggctgaggcag

SEQ ID NO: 62517 - DNA, 20 bp, Artificial Sequence
  Synthetic oligonucleotide; CAGAGT chr11 5271271 5271290 5271274 -
attgcactccagtctggcaa

SEQ ID NO: 62518 - DNA, 20 bp, Artificial Sequence
  Synthetic oligonucleotide; ATGGAT chr11 5271200 5271219 5271203 -
aaagaaaaaagaaaaaataa

SEQ ID NO: 62519 - DNA, 20 bp, Artificial Sequence
  Synthetic oligonucleotide; TAGAAT chr11 5271128 5271147 5271131 -
ggtgatgtaagggactttta

SEQ ID NO: 62520 - DNA, 20 bp, Artificial Sequence
  Synthetic oligonucleotide; TGGAAT chr11 5271113 5271132 5271116 -
ttttatagaattaacaatgc

SEQ ID NO: 62521 - DNA, 20 bp, Artificial Sequence
  Synthetic oligonucleotide; GTGAAT chr11 5271039 5271058 5271042 -
ttgatagttaaataatttct

SEQ ID NO: 62522 - DNA, 20 bp, Artificial Sequence
  Synthetic oligonucleotide; GAGGAT chr11 5271011 5271030 5271014 -
attccttgattctaaaatat

SEQ ID NO: 62523 - DNA, 20 bp, Artificial Sequence
  Synthetic oligonucleotide; ATGGAT chr11 5270943 5270962 5270946 -
gagcaatattcttcaggcac

SEQ ID NO: 62524 - DNA, 20 bp, Artificial Sequence
  Synthetic oligonucleotide; TCGAAT chr11 5270938 5270957 5270941 -
atattcttcaggcacatgga

SEQ ID NO: 62525 - DNA, 20 bp, Artificial Sequence
  Synthetic oligonucleotide; TTGAAT chr11 5270933 5270952 5270936 -
cttcaggcacatggatcgaa

SEQ ID NO: 62526 - DNA, 20 bp, Artificial Sequence
  Synthetic oligonucleotide; AGGAAT chr11 5270832 5270851 5270835 -
gaaaaaaaaaaggacactag

SEQ ID NO: 62527 - DNA, 20 bp, Artificial Sequence
  Synthetic oligonucleotide; TAGGAT chr11 5270743 5270762 5270746 -
attctggctttaaataattt

SEQ ID NO: 62528 - DNA, 20 bp, Artificial Sequence
  Synthetic oligonucleotide; GAGGAT chr11 5270609 5270628 5270612 -
catagagaaatgaaaagaga

SEQ ID NO: 62529 - DNA, 20 bp, Artificial Sequence
  Synthetic oligonucleotide; CTGGAT chr11 5270591 5270610 5270594 -
gagaggattctctggaagca

SEQ ID NO: 62530 - DNA, 20 bp, Artificial Sequence
  Synthetic oligonucleotide; GGGAAT chr11 5270559 5270578 5270562 -
ttttctgtctgtcctctcta

SEQ ID NO: 62531 - DNA, 20 bp, Artificial Sequence
  Synthetic oligonucleotide; TGGGAT chr11 5270533 5270552 5270536 -
caccccaaggtactgtactt

SEQ ID NO: 62532 - DNA, 20 bp, Artificial Sequence
  Synthetic oligonucleotide; CTGGGT chr11 5270392 5270411 5270395 -
actccttaagagagctagaa

SEQ ID NO: 62533 - DNA, 20 bp, Artificial Sequence
  Synthetic oligonucleotide; GAGAAT chr11 5270236 5270255 5270239 -
atgaggctttcttggaaaag

SEQ ID NO: 62534 - DNA, 20 bp, Artificial Sequence
  Synthetic oligonucleotide; ATGGAT chr11 5270223 5270242 5270226 -
ggaaaaggagaatgggagag

SEQ ID NO: 62535 - DNA, 20 bp, Artificial Sequence
  Synthetic oligonucleotide; GAGGGT chr11 5270196 5270215 5270199 -
tcattttggaagatgatgaa

SEQ ID NO: 62536 - DNA, 20 bp, Artificial Sequence
  Synthetic oligonucleotide; CAGGAT chr11 5270128 5270147 5270131 -
gagccaacaaaaaagagcct

SEQ ID NO: 62537 - DNA, 20 bp, Artificial Sequence
  Synthetic oligonucleotide; AAGAAT chr11 5269978 5269997 5269981 -
gggccagaacttcggcagta

SEQ ID NO: 62538 - DNA, 20 bp, Artificial Sequence
  Synthetic oligonucleotide; ATGAAT chr11 5269837 5269856 5269840 -
tcactagcctgtggagcaag

SEQ ID NO: 62539 - DNA, 20 bp, Artificial Sequence
  Synthetic oligonucleotide; GGGAAT chr11 5269776 5269795 5269779 -
agcattggttctcaatgcat

SEQ ID NO: 62540 - DNA, 20 bp, Artificial Sequence
  Synthetic oligonucleotide; AAGGGT chr11 5269769 5269788 5269772 -
gttctcaatgcatgggaatg

SEQ ID NO: 62541 - DNA, 20 bp, Artificial Sequence
  Synthetic oligonucleotide; GTGAAT chr11 5269765 5269784 5269768 -
tcaatgcatgggaatgaagg

SEQ ID NO: 62542 - DNA, 20 bp, Artificial Sequence
  Synthetic oligonucleotide; CTGAGT chr11 5269505 5269524 5269508 -
tcaagcccgcctttgctaag

SEQ ID NO: 62543 - DNA, 20 bp, Artificial Sequence
  Synthetic oligonucleotide; GTGGAT chr11 5269475 5269494 5269478 -
tgcactgtgacaagctgcat

SEQ ID NO: 62544 - DNA, 20 bp, Artificial Sequence
  Synthetic oligonucleotide; GTGAGT chr11 5269454 5269473 5269457 -
tggatcctgagaacttcaag

SEQ ID NO: 62545 - DNA, 20 bp, Artificial Sequence
  Synthetic oligonucleotide; ATGGGT chr11 5269354 5269373 5269357 -
caacaaagatctcagaaatc

SEQ ID NO: 62546 - DNA, 20 bp, Artificial Sequence
  Synthetic oligonucleotide; CTGAAT chr11 5269258 5269277 5269261 -
agtaaaggactactaacagc

SEQ ID NO: 62547 - DNA, 20 bp, Artificial Sequence
  Synthetic oligonucleotide; GAGAAT chr11 5269203 5269222 5269206 -
aacttgatgtgtttatccca

SEQ ID NO: 62548 - DNA, 20 bp, Artificial Sequence
  Synthetic oligonucleotide; TAGAAT chr11 5269190 5269209 5269193 -
tatcccagagaattgtatta

SEQ ID NO: 62549 - DNA, 20 bp, Artificial Sequence
  Synthetic oligonucleotide; AAGAAT chr11 5269168 5269187 5269171 -
gaattgtagacttgtgaaag

SEQ ID NO: 62550 - DNA, 20 bp, Artificial Sequence
  Synthetic oligonucleotide; GTGGGT chr11 5269102 5269121 5269105 -
atagaaatgccttattttat

SEQ ID NO: 62551 - DNA, 20 bp, Artificial Sequence
  Synthetic oligonucleotide; CCGAAT chr11 5268967 5268986 5268970 -
gaccaagtgaaggcttgttt

SEQ ID NO: 62552 - DNA, 20 bp, Artificial Sequence
  Synthetic oligonucleotide; GGGGAT chr11 5268956 5268975 5268959 -
ggcttgtttccgaatttgtt

SEQ ID NO: 62553 - DNA, 20 bp, Artificial Sequence
  Synthetic oligonucleotide; GGGGGT chr11 5268833 5268852 5268836 -
aatactggtaaaatggggaa

SEQ ID NO: 62554 - DNA, 20 bp, Artificial Sequence
  Synthetic oligonucleotide; GAGGGT chr11 5268827 5268846 5268830 -
ggtaaaatggggaagggggt

SEQ ID NO: 62555 - DNA, 20 bp, Artificial Sequence
  Synthetic oligonucleotide; TAGAAT chr11 5268812 5268831 5268815 -
ggggtgagggtgtaggtagg

SEQ ID NO: 62556 - DNA, 20 bp, Artificial Sequence
  Synthetic oligonucleotide; TTGAAT chr11 5268805 5268824 5268808 -
gggtgtaggtaggtagaatg

SEQ ID NO: 62557 - DNA, 20 bp, Artificial Sequence
  Synthetic oligonucleotide; TAGAAT chr11 5268789 5268808 5268792 -
aatgttgaatgtagggctca

SEQ ID NO: 62558 - DNA, 20 bp, Artificial Sequence
  Synthetic oligonucleotide; CTGAAT chr11 5268763 5268782 5268766 -
aaaattgaacctaagctcat

SEQ ID NO: 62559 - DNA, 20 bp, Artificial Sequence
  Synthetic oligonucleotide; TTGGGT chr11 5268754 5268773 5268757 -
cctaagctcatctgaatttt

SEQ ID NO: 62560 - DNA, 20 bp, Artificial Sequence
  Synthetic oligonucleotide; CAGGGT chr11 5268720 5268739 5268723 -
accttggaacagtttgaggt

SEQ ID NO: 62561 - DNA, 20 bp, Artificial Sequence
  Synthetic oligonucleotide; AGGAAT chr11 5268709 5268728 5268712 -
gtttgaggtcagggttgtct

SEQ ID NO: 62562 - DNA, 20 bp, Artificial Sequence
  Synthetic oligonucleotide; CTGGGT chr11 5268595 5268614 5268598 -
tgtcttttgcctaacagctc

SEQ ID NO: 62563 - DNA, 20 bp, Artificial Sequence
  Synthetic oligonucleotide; AGGAGT chr11 5268552 5268571 5268555 -
tctggctactcactttggca

SEQ ID NO: 62564 - DNA, 20 bp, Artificial Sequence
  Synthetic oligonucleotide; CTGAGT chr11 5268473 5268492 5268476 -
gccctggcccataagtacca

SEQ ID NO: 62565 - DNA, 20 bp, Artificial Sequence
  Synthetic oligonucleotide; AGGGAT chr11 5268283 5268302 5268286 -
gaaaaagtgttcatgggctg

SEQ ID NO: 62566 - DNA, 20 bp, Artificial Sequence
  Synthetic oligonucleotide; GTGGAT chr11 5268213 5268232 5268216 -
tgggggcttgtaaaattaat

SEQ ID NO: 62567 - DNA, 20 bp, Artificial Sequence
  Synthetic oligonucleotide; GAGAAT chr11 5268200 5268219 5268203 -
aattaatgtggatgttatgg

SEQ ID NO: 62568 - DNA, 20 bp, Artificial Sequence
  Synthetic oligonucleotide; CAGGAT chr11 5268192 5268211 5268195 -
tggatgttatgggagaattc

SEQ ID NO: 62569 - DNA, 20 bp, Artificial Sequence
  Synthetic oligonucleotide; GAGGAT chr11 5268180 5268199 5268183 -
gagaattccaggattccaag

SEQ ID NO: 62570 - DNA, 20 bp, Artificial Sequence
  Synthetic oligonucleotide; CGGGGT chr11 5268150 5268169 5268153 -
tgatggagaaaaatctttat

SEQ ID NO: 62571 - DNA, 20 bp, Artificial Sequence
  Synthetic oligonucleotide; TAGAAT chr11 5267975 5267994 5267978 -
tagatatccaagatataggc

SEQ ID NO: 62572 - DNA, 20 bp, Artificial Sequence
  Synthetic oligonucleotide; ATGAGT chr11 5267890 5267909 5267893 -
gaaattgatttggagataag

SEQ ID NO: 62573 - DNA, 20 bp, Artificial Sequence
  Synthetic oligonucleotide; AAGGAT chr11 5267854 5267873 5267857 -
aatagcctgctctttccatg

SEQ ID NO: 62574 - DNA, 20 bp, Artificial Sequence
  Synthetic oligonucleotide; ATGGGT chr11 5267837 5267856 5267840 -
atgaaggattccattatttc

SEQ ID NO: 62575 - DNA, 20 bp, Artificial Sequence
  Synthetic oligonucleotide; TAGAAT chr11 5267786 5267805 5267789 -
cattgtgcattatcttctga

SEQ ID NO: 62576 - DNA, 20 bp, Artificial Sequence
  Synthetic oligonucleotide; TAGAGT chr11 5267758 5267777 5267761 -
aacatgcactaaaataaagt

SEQ ID NO: 62577 - DNA, 20 bp, Artificial Sequence
  Synthetic oligonucleotide; CTGAGT chr11 5267746 5267765 5267749 -
aataaagttagagttaggac

SEQ ID NO: 62578 - DNA, 20 bp, Artificial Sequence
  Synthetic oligonucleotide; GAGAGT chr11 5267727 5267746 5267730 -
cctgagtgggaaagtttttg

SEQ ID NO: 62579 - DNA, 20 bp, Artificial Sequence
  Synthetic oligonucleotide; TAGAAT chr11 5267697 5267716 5267700 -
tgaagactttccgtgggaga

SEQ ID NO: 62580 - DNA, 20 bp, Artificial Sequence
  Synthetic oligonucleotide; GAGAGT chr11 5267611 5267630 5267614 -
ggctctctggaagtagaagg

SEQ ID NO: 62581 - DNA, 20 bp, Artificial Sequence
  Synthetic oligonucleotide; TAGGAT chr11 5267506 5267525 5267509 -
caatactaaacgataagcat

SEQ ID NO: 62582 - DNA, 20 bp, Artificial Sequence
  Synthetic oligonucleotide; ATGGAT chr11 5267443 5267462 5267446 -
aatctgcttatgtgcacaaa

SEQ ID NO: 62583 - DNA, 20 bp, Artificial Sequence
  Synthetic oligonucleotide; ATGGAT chr11 5267413 5267432 5267416 -
gtttgcagataaaataaaat

SEQ ID NO: 62584 - DNA, 20 bp, Artificial Sequence
  Synthetic oligonucleotide; GTGAGT chr11 5267361 5267380 5267364 -
gttcaaacccaagaggagca

SEQ ID NO: 62585 - DNA, 20 bp, Artificial Sequence
  Synthetic oligonucleotide; TGGAAT chr11 5267352 5267371 5267355 -
caagaggagcagtgagtctg

SEQ ID NO: 62586 - DNA, 20 bp, Artificial Sequence
  Synthetic oligonucleotide; AAGGAT chr11 5267343 5267362 5267346 -
cagtgagtctgtggaatttg

SEQ ID NO: 62587 - DNA, 20 bp, Artificial Sequence
  Synthetic oligonucleotide; TGGGGT chr11 5267328 5267347 5267331 -
atttgaaggatggacaaagg

SEQ ID NO: 62588 - DNA, 20 bp, Artificial Sequence
  Synthetic oligonucleotide; AAGGGT chr11 5267191 5267210 5267194 -
cctggtgactctcatgtgtg

SEQ ID NO: 62589 - DNA, 20 bp, Artificial Sequence
  Synthetic oligonucleotide; AGGGAT chr11 5267183 5267202 5267186 -
ctctcatgtgtgaagggtag

SEQ ID NO: 62590 - DNA, 20 bp, Artificial Sequence
  Synthetic oligonucleotide; GGGAGT chr11 5267138 5267157 5267141 -
aggaagtgctagattggtca

SEQ ID NO: 62591 - DNA, 20 bp, Artificial Sequence
  Synthetic oligonucleotide; TAGAGT chr11 5267077 5267096 5267080 -
aacctttgcattttccaagt

SEQ ID NO: 62592 - DNA, 20 bp, Artificial Sequence
  Synthetic oligonucleotide; GTGAAT chr11 5267002 5267021 5267005 -
cattgatcagactttttcct

SEQ ID NO: 62593 - DNA, 20 bp, Artificial Sequence
  Synthetic oligonucleotide; TTGAAT chr11 5266991 5267010 5266994 -
ctttttcctgtgaattactt

SEQ ID NO: 62594 - DNA, 20 bp, Artificial Sequence
  Synthetic oligonucleotide; CAGAAT chr11 5266970 5266989 5266973 -
tgaatttggctgtatatatc

SEQ ID NO: 62595 - DNA, 20 bp, Artificial Sequence
  Synthetic oligonucleotide; CAGAGT chr11 5266875 5266894 5266878 -
cctttcaatatgcccataaa

SEQ ID NO: 62596 - DNA, 20 bp, Artificial Sequence
  Synthetic oligonucleotide; AGGGAT chr11 5266865 5266884 5266868 -
tgcccataaacagagtaaac

SEQ ID NO: 62597 - DNA, 20 bp, Artificial Sequence
  Synthetic oligonucleotide; TGGGGT chr11 5266775 5266794 5266778 -
tacatatttttatatattta

SEQ ID NO: 62598 - DNA, 20 bp, Artificial Sequence
  Synthetic oligonucleotide; TAGGAT chr11 5266719 5266738 5266722 -
gatgattaagtctagatatt

SEQ ID NO: 62599 - DNA, 20 bp, Artificial Sequence
  Synthetic oligonucleotide; ATGAAT chr11 5266438 5266457 5266441 -
cacttttttagctcccacag

SEQ ID NO: 62600 - DNA, 20 bp, Artificial Sequence
  Synthetic oligonucleotide; AAGAGT chr11 5266368 5266387 5266371 -
atctatctctttggcatacc

SEQ ID NO: 62601 - DNA, 20 bp, Artificial Sequence
  Synthetic oligonucleotide; GTGAAT chr11 5266183 5266202 5266186 -
gatcccaaaccttaactatt

SEQ ID NO: 62602 - DNA, 20 bp, Artificial Sequence
  Synthetic oligonucleotide; ATGAGT chr11 5266162 5266181 5266165 -
tgaatagtgcttcaataaac

SEQ ID NO: 62603 - DNA, 20 bp, Artificial Sequence
  Synthetic oligonucleotide; TTGGAT chr11 5266144 5266163 5266147 -
acatgagtgtaatgtgtcca

SEQ ID NO: 62604 - DNA, 20 bp, Artificial Sequence
  Synthetic oligonucleotide; TTGGAT chr11 5266120 5266139 5266123 -
atatactgatttcctttctt

SEQ ID NO: 62605 - DNA, 20 bp, Artificial Sequence
  Synthetic oligonucleotide; CTGGAT chr11 5266093 5266112 5266096 -
aataaccactagtgagattg

SEQ ID NO: 62606 - DNA, 20 bp, Artificial Sequence
  Synthetic oligonucleotide; AAGAGT chr11 5265992 5266011 5265995 -
cccaccaacagtgtgtaaga

SEQ ID NO: 62607 - DNA, 20 bp, Artificial Sequence
  Synthetic oligonucleotide; AAGGAT chr11 5265964 5265983 5265967 -
ccttttctccatatcctcac

SEQ ID NO: 62608 - DNA, 20 bp, Artificial Sequence
  Synthetic oligonucleotide; TAGAGT chr11 5265919 5265938 5265922 -
ttgttaatagccgttttaac

SEQ ID NO: 62609 - DNA, 20 bp, Artificial Sequence
  Synthetic oligonucleotide; GAGAAT chr11 5265858 5265877 5265861 -
ccctgatcattagtgatgtt

SEQ ID NO: 62610 - DNA, 20 bp, Artificial Sequence
  Synthetic oligonucleotide; GAGAAT chr11 5265813 5265832 5265816 -
tcatttgtatatctttttct

SEQ ID NO: 62611 - DNA, 20 bp, Artificial Sequence
  Synthetic oligonucleotide; TGGGAT chr11 5265776 5265795 5265779 -
gtccttagcctactttttat

SEQ ID NO: 62612 - DNA, 20 bp, Artificial Sequence
  Synthetic oligonucleotide; CTGGAT chr11 5265726 5265745 5265729 -
atttgtgttcattttagagc

SEQ ID NO: 62613 - DNA, 20 bp, Artificial Sequence
  Synthetic oligonucleotide; GTGGGT chr11 5265672 5265691 5265675 -
tgaagattttctcccactct

SEQ ID NO: 62614 - DNA, 20 bp, Artificial Sequence
  Synthetic oligonucleotide; AAGGGT chr11 5265528 5265547 5265531 -
tttcctaagccaatgtgtag

SEQ ID NO: 62615 - DNA, 20 bp, Artificial Sequence
  Synthetic oligonucleotide; TAGAAT chr11 5265504 5265523 5265507 -
gtttttccgatgttattttc

SEQ ID NO: 62616 - DNA, 20 bp, Artificial Sequence
  Synthetic oligonucleotide; TTGAGT chr11 5265457 5265476 5265460 -
atttaagtccttgatccatc

SEQ ID NO: 62617 - DNA, 20 bp, Artificial Sequence
  Synthetic oligonucleotide; TTGAAT chr11 5265371 5265390 5265374 -
agctatccccgcaccatttg

SEQ ID NO: 62618 - DNA, 20 bp, Artificial Sequence
  Synthetic oligonucleotide; TAGGGT chr11 5265366 5265385 5265369 -
tccccgcaccatttgttgaa

SEQ ID NO: 62619 - DNA, 20 bp, Artificial Sequence
  Synthetic oligonucleotide; TTGGAT chr11 5265315 5265334 5265318 -
tttgctttgtcaaagatcag

SEQ ID NO: 62620 - DNA, 20 bp, Artificial Sequence
  Synthetic oligonucleotide; TTGAGT chr11 5265301 5265320 5265304 -
gatcagttggatgtaagtat

SEQ ID NO: 62621 - DNA, 20 bp, Artificial Sequence
  Synthetic oligonucleotide; CTGGGT chr11 5265289 5265308 5265292 -
gtaagtatttgagtttattt

SEQ ID NO: 62622 - DNA, 20 bp, Artificial Sequence
  Synthetic oligonucleotide; AAGAAT chr11 5265119 5265138 5265122 -
gggctcttttttggttccat

SEQ ID NO: 62623 - DNA, 20 bp, Artificial Sequence
  Synthetic oligonucleotide; TAGGAT chr11 5265111 5265130 5265114 -
ttttggttccataagaattt

SEQ ID NO: 62624 - DNA, 20 bp, Artificial Sequence
  Synthetic oligonucleotide; GGGAAT chr11 5265063 5265082 5265066 -
actaatggtggtattttgat

SEQ ID NO: 62625 - DNA, 20 bp, Artificial Sequence
  Synthetic oligonucleotide; ATGAAT chr11 5265053 5265072 5265056 -
gtattttgatgggaattgca

SEQ ID NO: 62626 - DNA, 20 bp, Artificial Sequence
  Synthetic oligonucleotide; GAGAAT chr11 5264990 5265009 5264993 -
tattgattctacccatctat

SEQ ID NO: 62627 - DNA, 20 bp, Artificial Sequence
  Synthetic oligonucleotide; AGGGGT chr11 5264836 5264855 5264839 -
ttttttgcagctattgtaaa

SEQ ID NO: 62628 - DNA, 20 bp, Artificial Sequence
  Synthetic oligonucleotide; TTGAGT chr11 5264831 5264850 5264834 -
tgcagctattgtaaaagggg

SEQ ID NO: 62629 - DNA, 20 bp, Artificial Sequence
  Synthetic oligonucleotide; CTGAAT chr11 5264739 5264758 5264742 -
ttttgtatccagaaactttg

SEQ ID NO: 62630 - DNA, 20 bp, Artificial Sequence
  Synthetic oligonucleotide; GGGGGT chr11 5264717 5264736 5264720 -
gaattattttatcagttcta

SEQ ID NO: 62631 - DNA, 20 bp, Artificial Sequence
  Synthetic oligonucleotide; AGGAGT chr11 5264706 5264725 5264709 -
tcagttctagggggttttgg

SEQ ID NO: 62632 - DNA, 20 bp, Artificial Sequence
  Synthetic oligonucleotide; TAGAGT chr11 5264697 5264716 5264700 -
gggggttttggaggagtctt

SEQ ID NO: 62633 - DNA, 20 bp, Artificial Sequence
  Synthetic oligonucleotide; TTGGAT chr11 5264630 5264649 5264633 -
ttgactttctctttaacaat

SEQ ID NO: 62634 - DNA, 20 bp, Artificial Sequence
  Synthetic oligonucleotide; GAGAGT chr11 5264554 5264573 5264557 -
atatgttaaagagaagtggt

SEQ ID NO: 62635 - DNA, 20 bp, Artificial Sequence
  Synthetic oligonucleotide; GTGGGT chr11 5264550 5264569 5264553 -
gttaaagagaagtggtgaga

SEQ ID NO: 62636 - DNA, 20 bp, Artificial Sequence
  Synthetic oligonucleotide; CAGAAT chr11 5264518 5264537 5264521 -
gtctcattccagttttcaga

SEQ ID NO: 62637 - DNA, 20 bp, Artificial Sequence
  Synthetic oligonucleotide; CTGAGT chr11 5264416 5264435 5264419 -
tcctttgtaaaccgattttg

SEQ ID NO: 62638 - DNA, 20 bp, Artificial Sequence
  Synthetic oligonucleotide; TTGAAT chr11 5264392 5264411 5264395 -
gttttagtcataaagtgatg

SEQ ID NO: 62639 - DNA, 20 bp, Artificial Sequence
  Synthetic oligonucleotide; TTGAAT chr11 5264382 5264401 5264385 -
taaagtgatgttgaattttg

SEQ ID NO: 62640 - DNA, 20 bp, Artificial Sequence
  Synthetic oligonucleotide; ATGGGT chr11 5264248 5264267 5264251 -
cgcatgaaacccacttgatc

SEQ ID NO: 62641 - DNA, 20 bp, Artificial Sequence
  Synthetic oligonucleotide; TCGGAT chr11 5264230 5264249 5264233 -
tcatgggttttgatatgctg

SEQ ID NO: 62642 - DNA, 20 bp, Artificial Sequence
  Synthetic oligonucleotide; AAGGAT chr11 5264203 5264222 5264206 -
ctattagctagtattttgtc

SEQ ID NO: 62643 - DNA, 20 bp, Artificial Sequence
  Synthetic oligonucleotide; AGGGAT chr11 5264178 5264197 5264181 -
tgttggcatctatgttcatc

SEQ ID NO: 62644 - DNA, 20 bp, Artificial Sequence
  Synthetic oligonucleotide; TAGAAT chr11 5264100 5264119 5264103 -
ttaaggtgatactggcttca

SEQ ID NO: 62645 - DNA, 20 bp, Artificial Sequence
  Synthetic oligonucleotide; GAGGAT chr11 5264086 5264105 5264089 -
gcttcatagaatgatttagg

SEQ ID NO: 62646 - DNA, 20 bp, Artificial Sequence
  Synthetic oligonucleotide; TAGAAT chr11 5264061 5264080 5264064 -
ttctctctttctctatcttg

SEQ ID NO: 62647 - DNA, 20 bp, Artificial Sequence
  Synthetic oligonucleotide; TAGGAT chr11 5264047 5264066 5264050 -
atcttgtagaatactgtcaa

SEQ ID NO: 62648 - DNA, 20 bp, Artificial Sequence
  Synthetic oligonucleotide; TTGAAT chr11 5264025 5264044 5264028 -
ggattggtatcaattcttct

SEQ ID NO: 62649 - DNA, 20 bp, Artificial Sequence
  Synthetic oligonucleotide; TAGAAT chr11 5264013 5264032 5264016 -
attcttctttgaatgtctgg

SEQ ID NO: 62650 - DNA, 20 bp, Artificial Sequence
  Synthetic oligonucleotide; GTGAAT chr11 5264001 5264020 5264004 -
atgtctggtagaattcagct

SEQ ID NO: 62651 - DNA, 20 bp, Artificial Sequence
  Synthetic oligonucleotide; CAGGGT chr11 5263918 5263937 5263921 -
ctgcttattactggtctgtt

SEQ ID NO: 62652 - DNA, 20 bp, Artificial Sequence
  Synthetic oligonucleotide; AGGAAT chr11 5263870 5263889 5263873 -
ctagagccctgtatctttcc

SEQ ID NO: 62653 - DNA, 20 bp, Artificial Sequence
  Synthetic oligonucleotide; TTGAAT chr11 5263808 5263827 5263811 -
taaaggtgttcatagtagcc

SEQ ID NO: 62654 - DNA, 20 bp, Artificial Sequence
  Synthetic oligonucleotide; TTGAGT chr11 5263749 5263768 5263752 -
atctcctgttttgtttctaa

SEQ ID NO: 62655 - DNA, 20 bp, Artificial Sequence
  Synthetic oligonucleotide; CTGGGT chr11 5263575 5263594 5263578 -
tagttattccctttcttttg

SEQ ID NO: 62656 - DNA, 20 bp, Artificial Sequence
  Synthetic oligonucleotide; TGGGAT chr11 5263358 5263377 5263361 -
tcttattatactttaagttc

SEQ ID NO: 62657 - DNA, 20 bp, Artificial Sequence
  Synthetic oligonucleotide; CAGAAT chr11 5263345 5263364 5263348 -
taagttctgggatacatgtg

SEQ ID NO: 62658 - DNA, 20 bp, Artificial Sequence
  Synthetic oligonucleotide; ATGAGT chr11 5263156 5263175 5263159 -
tcattgttcaactcccactt

SEQ ID NO: 62659 - DNA, 20 bp, Artificial Sequence
  Synthetic oligonucleotide; CAGAAT chr11 5263105 5263124 5263108 -
tgttcctgtgttagtttgct

SEQ ID NO: 62660 - DNA, 20 bp, Artificial Sequence
  Synthetic oligonucleotide; TTGGGT chr11 5262977 5262996 5262980 -
attatatcgctgatggccat

SEQ ID NO: 62661 - DNA, 20 bp, Artificial Sequence
  Synthetic oligonucleotide; GTGAAT chr11 5262950 5262969 5262953 -
ggttccaagtctttgctatt

SEQ ID NO: 62662 - DNA, 20 bp, Artificial Sequence
  Synthetic oligonucleotide; TAGAAT chr11 5262905 5262924 5262908 -
gtgtgcacgtgtctttatag

SEQ ID NO: 62663 - DNA, 20 bp, Artificial Sequence
  Synthetic oligonucleotide; TTGGGT chr11 5262886 5262905 5262889 -
gtagaatgatttctaattct

SEQ ID NO: 62664 - DNA, 20 bp, Artificial Sequence
  Synthetic oligonucleotide; TGGGAT chr11 5262867 5262886 5262870 -
tttgggtatatacccagtaa

SEQ ID NO: 62665 - DNA, 20 bp, Artificial Sequence
  Synthetic oligonucleotide; CTGGGT chr11 5262859 5262878 5262862 -
tatacccagtaatgggattg

SEQ ID NO: 62666 - DNA, 20 bp, Artificial Sequence
  Synthetic oligonucleotide; AGGAAT chr11 5262824 5262843 5262827 -
tttctggttctagatccttg

SEQ ID NO: 62667 - DNA, 20 bp, Artificial Sequence
  Synthetic oligonucleotide; TGGGGT chr11 5262547 5262566 5262550 -
atcctttgtccactttttga

SEQ ID NO: 62668 - DNA, 20 bp, Artificial Sequence
  Synthetic oligonucleotide; TTGGAT chr11 5262497 5262516 5262500 -
gttgaagttctttgtagatt

SEQ ID NO: 62669 - DNA, 20 bp, Artificial Sequence
  Synthetic oligonucleotide; ATGGAT chr11 5262475 5262494 5262478 -
ggatgttagccctttgtcag

SEQ ID NO: 62670 - DNA, 20 bp, Artificial Sequence
  Synthetic oligonucleotide; GTGAAT chr11 5262328 5262347 5262331 -
ttgcttttgatgttttagtc

SEQ ID NO: 62671 - DNA, 20 bp, Artificial Sequence
  Synthetic oligonucleotide; CTGAAT chr11 5262303 5262322 5262306 -
tttttgcccatgcctatgtc

SEQ ID NO: 62672 - DNA, 20 bp, Artificial Sequence
  Synthetic oligonucleotide; TAGGAT chr11 5262276 5262295 5262279 -
gtattgcctaggttatcttc

SEQ ID NO: 62673 - DNA, 20 bp, Artificial Sequence
  Synthetic oligonucleotide; TTGAGT chr11 5262229 5262248 5262232 -
atttaagtctttaatccacc

SEQ ID NO: 62674 - DNA, 20 bp, Artificial Sequence
  Synthetic oligonucleotide; AGGGGT chr11 5262199 5262218 5262202 -
ttttgtataaggtgtaagga

SEQ ID NO: 62675 - DNA, 20 bp, Artificial Sequence
  Synthetic oligonucleotide; GGGAAT chr11 5262136 5262155 5262139 -
ccagcaccatttattaaata

SEQ ID NO: 62676 - DNA, 20 bp, Artificial Sequence
  Synthetic oligonucleotide; TAGGAT chr11 5261932 5261951 5261935 -
ccagctttgttctttttgtt

SEQ ID NO: 62677 - DNA, 20 bp, Artificial Sequence
  Synthetic oligonucleotide; GGGGAT chr11 5261836 5261855 5261839 -
aaagtcagtggtagcttgat

SEQ ID NO: 62678 - DNA, 20 bp, Artificial Sequence
  Synthetic oligonucleotide; TTGAAT chr11 5261826 5261845 5261829 -
gtagcttgatggggatagca

SEQ ID NO: 62679 - DNA, 20 bp, Artificial Sequence
  Synthetic oligonucleotide; TGGAAT chr11 5261758 5261777 5261761 -
attctttctatctatgagca

SEQ ID NO: 62680 - DNA, 20 bp, Artificial Sequence
  Synthetic oligonucleotide; GTGAGT chr11 5261711 5261730 5261714 -
ctctcttatttccttgagca

SEQ ID NO: 62681 - DNA, 20 bp, Artificial Sequence
  Synthetic oligonucleotide; GTGAAT chr11 5261619 5261638 5261622 -
ttattctctttgcagcaatt

SEQ ID NO: 62682 - DNA, 20 bp, Artificial Sequence
  Synthetic oligonucleotide; GGGAGT chr11 5261613 5261632 5261616 -
tctttgcagcaattgtgaat

SEQ ID NO: 62683 - DNA, 20 bp, Artificial Sequence
  Synthetic oligonucleotide; CAGGGT chr11 5261477 5261496 5261480 -
aagattttgggctgagatga

SEQ ID NO: 62684 - DNA, 20 bp, Artificial Sequence
  Synthetic oligonucleotide; TTGAAT chr11 5261410 5261429 5261413 -
ttgacttcctctcttcctat

SEQ ID NO: 62685 - DNA, 20 bp, Artificial Sequence
  Synthetic oligonucleotide; TTGAGT chr11 5261349 5261368 5261352 -
cgagaacttccaatactatg

SEQ ID NO: 62686 - DNA, 20 bp, Artificial Sequence
  Synthetic oligonucleotide; AAGAGT chr11 5261343 5261362 5261346 -
cttccaatactatgttgagt

SEQ ID NO: 62687 - DNA, 20 bp, Artificial Sequence
  Synthetic oligonucleotide; GAGAGT chr11 5261157 5261176 5261160 -
tttattctactgtggtctga

SEQ ID NO: 62688 - DNA, 20 bp, Artificial Sequence
  Synthetic oligonucleotide; ATGAAT chr11 5261062 5261081 5261065 -
ggagaaagttccatgtgctg

SEQ ID NO: 62689 - DNA, 20 bp, Artificial Sequence
  Synthetic oligonucleotide; TAGAAT chr11 5261057 5261076 5261060 -
aagttccatgtgctgatgaa

SEQ ID NO: 62690 - DNA, 20 bp, Artificial Sequence
  Synthetic oligonucleotide; TTGGGT chr11 5261035 5261054 5261038 -
gaatgtgtattctgcagttg

SEQ ID NO: 62691 - DNA, 20 bp, Artificial Sequence
  Synthetic oligonucleotide; TAGAAT chr11 5261030 5261049 5261033 -
tgtattctgcagttgttggg

SEQ ID NO: 62692 - DNA, 20 bp, Artificial Sequence
  Synthetic oligonucleotide; TGGAGT chr11 5260937 5260956 5260940 -
gacctgcctagtgcagtcag

SEQ ID NO: 62693 - DNA, 20 bp, Artificial Sequence
  Synthetic oligonucleotide; TGGGAT chr11 5260870 5260889 5260873 -
tagtaattgttttataaatt

SEQ ID NO: 62694 - DNA, 20 bp, Artificial Sequence
  Synthetic oligonucleotide; AAGAAT chr11 5260839 5260858 5260842 -
gtattagatgcatatatatt

SEQ ID NO: 62695 - DNA, 20 bp, Artificial Sequence
  Synthetic oligonucleotide; AAGAAT chr11 5260734 5260753 5260737 -
aagtttgttttgtctgacat

SEQ ID NO: 62696 - DNA, 20 bp, Artificial Sequence
  Synthetic oligonucleotide; TGGAAT chr11 5260694 5260713 5260697 -
gcttttggtgtccatttgtg

SEQ ID NO: 62697 - DNA, 20 bp, Artificial Sequence
  Synthetic oligonucleotide; GTGAGT chr11 5260657 5260676 5260660 -
cccctttaccttaagtttat

SEQ ID NO: 62698 - DNA, 20 bp, Artificial Sequence
  Synthetic oligonucleotide; GTGAGT chr11 5260638 5260657 5260641 -
tgtgagtccttatgtgttag

SEQ ID NO: 62699 - DNA, 20 bp, Artificial Sequence
  Synthetic oligonucleotide; GTGAAT chr11 5260605 5260624 5260608 -
aggcggcagataactggttg

SEQ ID NO: 62700 - DNA, 20 bp, Artificial Sequence
  Synthetic oligonucleotide; TGGGAT chr11 5260447 5260466 5260450 -
tttttgttgtatatgtccta

SEQ ID NO: 62701 - DNA, 20 bp, Artificial Sequence
  Synthetic oligonucleotide; CAGGGT chr11 5260406 5260425 5260409 -
gttctgttttgatgtgcttc

SEQ ID NO: 62702 - DNA, 20 bp, Artificial Sequence
  Synthetic oligonucleotide; CCGAAT chr11 5260344 5260363 5260347 -
gtagtgttggcttggtagtg

SEQ ID NO: 62703 - DNA, 20 bp, Artificial Sequence
  Synthetic oligonucleotide; CTGGAT chr11 5260274 5260293 5260277 -
atttgtgaagcttagtttca

SEQ ID NO: 62704 - DNA, 20 bp, Artificial Sequence
  Synthetic oligonucleotide; TTGGAT chr11 5260090 5260109 5260093 -
ctctttgtctttagataact

SEQ ID NO: 62705 - DNA, 20 bp, Artificial Sequence
  Synthetic oligonucleotide; ATGAAT chr11 5260045 5260064 5260048 -
taggcaatgatatttttgca

SEQ ID NO: 62706 - DNA, 20 bp, Artificial Sequence
  Synthetic oligonucleotide; TTGGAT chr11 5260010 5260029 5260013 -
gtttattgagcttcttgtat

SEQ ID NO: 62707 - DNA, 20 bp, Artificial Sequence
  Synthetic oligonucleotide; CTGGAT chr11 5259958 5259977 5259961 -
agttttccttgattatttcc

SEQ ID NO: 62708 - DNA, 20 bp, Artificial Sequence
  Synthetic oligonucleotide; AGGAAT chr11 5259917 5259936 5259920 -
ttagatttctcttctttctc

SEQ ID NO: 62709 - DNA, 20 bp, Artificial Sequence
  Synthetic oligonucleotide; TTGGAT chr11 5259820 5259839 5259823 -
ttcttttttctttgtctttg

SEQ ID NO: 62710 - DNA, 20 bp, Artificial Sequence
  Synthetic oligonucleotide; TTGGGT chr11 5259815 5259834 5259818 -
ttttctttgtctttgttgga

SEQ ID NO: 62711 - DNA, 20 bp, Artificial Sequence
  Synthetic oligonucleotide; CTGAAT chr11 5259783 5259802 5259786 -
aaaaactttgtcttcaagct

SEQ ID NO: 62712 - DNA, 20 bp, Artificial Sequence
  Synthetic oligonucleotide; TTGGAT chr11 5259768 5259787 5259771 -
aagctctgaatttcttctgc

SEQ ID NO: 62713 - DNA, 20 bp, Artificial Sequence
  Synthetic oligonucleotide; TTGAAT chr11 5259689 5259708 5259692 -
atccattgtttcctgaagtt

SEQ ID NO: 62714 - DNA, 20 bp, Artificial Sequence
  Synthetic oligonucleotide; TCGGAT chr11 5259590 5259609 5259593 -
aaaattggacttcaccttcc

SEQ ID NO: 62715 - DNA, 20 bp, Artificial Sequence
  Synthetic oligonucleotide; CTGAAT chr11 5259554 5259573 5259557 -
ttagcttaataactgacctt

SEQ ID NO: 62716 - DNA, 20 bp, Artificial Sequence
  Synthetic oligonucleotide; AGGGAT chr11 5259531 5259550 5259534 -
aattatttttcaggtaaatc

SEQ ID NO: 62717 - DNA, 20 bp, Artificial Sequence
  Synthetic oligonucleotide; TTGGAT chr11 5259514 5259533 5259517 -
atcagggatttcttcttggt

SEQ ID NO: 62718 - DNA, 20 bp, Artificial Sequence
  Synthetic oligonucleotide; GGGGGT chr11 5259478 5259497 5259481 -
tgagctagtatgattttttg

SEQ ID NO: 62719 - DNA, 20 bp, Artificial Sequence
  Synthetic oligonucleotide; CAGAGT chr11 5259445 5259464 5259448 -
aaccttgtttttcatattac

SEQ ID NO: 62720 - DNA, 20 bp, Artificial Sequence
  Synthetic oligonucleotide; TTGGGT chr11 5259417 5259436 5259420 -
gttttctggttccttctcac

SEQ ID NO: 62721 - DNA, 20 bp, Artificial Sequence
  Synthetic oligonucleotide; CTGGAT chr11 5259272 5259291 5259275 -
tagtgattgttatctctctt

SEQ ID NO: 62722 - DNA, 20 bp, Artificial Sequence
  Synthetic oligonucleotide; TGGGGT chr11 5259227 5259246 5259230 -
accagactccaggctggtac

SEQ ID NO: 62723 - DNA, 20 bp, Artificial Sequence
  Synthetic oligonucleotide; CAGAGT chr11 5259212 5259231 5259215 -
ggtactggggtttgtctgca

SEQ ID NO: 62724 - DNA, 20 bp, Artificial Sequence
  Synthetic oligonucleotide; GTGGGT chr11 5259187 5259206 5259190 -
tcttgtgacgtgaaccatct

SEQ ID NO: 62725 - DNA, 20 bp, Artificial Sequence
  Synthetic oligonucleotide; GAGGAT chr11 5259138 5259157 5259141 -
ctgctccaatggaggtggca

SEQ ID NO: 62726 - DNA, 20 bp, Artificial Sequence
  Synthetic oligonucleotide; GAGGGT chr11 5259118 5259137 5259121 -
gaggatgaaatggactctgt

SEQ ID NO: 62727 - DNA, 20 bp, Artificial Sequence
  Synthetic oligonucleotide; AAGAAT chr11 5258978 5258997 5258981 -
tggggcaccctagaactccc

SEQ ID NO: 62728 - DNA, 20 bp, Artificial Sequence
  Synthetic oligonucleotide; CAGGGT chr11 5258949 5258968 5258952 -
tgccctttgtcttcagctac

SEQ ID NO: 62729 - DNA, 20 bp, Artificial Sequence
  Synthetic oligonucleotide; GTGAGT chr11 5258945 5258964 5258948 -
ctttgtcttcagctaccagg

SEQ ID NO: 62730 - DNA, 20 bp, Artificial Sequence
  Synthetic oligonucleotide; CAGAGT chr11 5258894 5258913 5258897 -
ggactagtcgtgtctgagct

SEQ ID NO: 62731 - DNA, 20 bp, Artificial Sequence
  Synthetic oligonucleotide; GAGGAT chr11 5258855 5258874 5258858 -
tctttctgtggctactgtgg

SEQ ID NO: 62732 - DNA, 20 bp, Artificial Sequence
  Synthetic oligonucleotide; GGGGGT chr11 5258849 5258868 5258852 -
tgtggctactgtgggaggat

SEQ ID NO: 62733 - DNA, 20 bp, Artificial Sequence
  Synthetic oligonucleotide; ATGGAT chr11 5258828 5258847 5258831 -
ggggtgtagtttccaggtca

SEQ ID NO: 62734 - DNA, 20 bp, Artificial Sequence
  Synthetic oligonucleotide; CCGAAT chr11 5258670 5258689 5258673 -
caccctcccccgcaacagca

SEQ ID NO: 62735 - DNA, 20 bp, Artificial Sequence
  Synthetic oligonucleotide; TGGAGT chr11 5258574 5258593 5258577 -
ctgtcctacttccctgccag

SEQ ID NO: 62736 - DNA, 20 bp, Artificial Sequence
  Synthetic oligonucleotide; CAGAAT chr11 5258320 5258339 5258323 -
gactcagctccaggtaaggt

SEQ ID NO: 62737 - DNA, 20 bp, Artificial Sequence
  Synthetic oligonucleotide; GAGGAT chr11 5258279 5258298 5258282 -
agatcttcaggttccccagt

SEQ ID NO: 62738 - DNA, 20 bp, Artificial Sequence
  Synthetic oligonucleotide; GGGGGT chr11 5258265 5258284 5258268 -
cccagtgaggatgtgtgttt

SEQ ID NO: 62739 - DNA, 20 bp, Artificial Sequence
  Synthetic oligonucleotide; TGGGGT chr11 5258212 5258231 5258215 -
gtttgggcactcacaatatt

SEQ ID NO: 62740 - DNA, 20 bp, Artificial Sequence
  Synthetic oligonucleotide; CCGGGT chr11 5258201 5258220 5258204 -
cacaatatttggggtgtttc

SEQ ID NO: 62741 - DNA, 20 bp, Artificial Sequence
  Synthetic oligonucleotide; GAGGGT chr11 5258169 5258188 5258172 -
ggagcaatctgcttctttca

SEQ ID NO: 62742 - DNA, 20 bp, Artificial Sequence
  Synthetic oligonucleotide; CCGAGT chr11 5258071 5258090 5258074 -
tcacatgctgctctgtgcat

SEQ ID NO: 62743 - DNA, 20 bp, Artificial Sequence
  Synthetic oligonucleotide; AGGAAT chr11 5257928 5257947 5257931 -
tatactgccctttgatatca

SEQ ID NO: 62744 - DNA, 20 bp, Artificial Sequence
  Synthetic oligonucleotide; AGGGGT chr11 5257906 5257925 5257909 -
gaatcaaggacgtgatgttg

SEQ ID NO: 62745 - DNA, 20 bp, Artificial Sequence
  Synthetic oligonucleotide; GTGGAT chr11 5257895 5257914 5257898 -
gtgatgttgaggggtgggca

SEQ ID NO: 62746 - DNA, 20 bp, Artificial Sequence
  Synthetic oligonucleotide; ATGAAT chr11 5257809 5257828 5257812 -
taattgaaagcaaattcata

SEQ ID NO: 62747 - DNA, 20 bp, Artificial Sequence
  Synthetic oligonucleotide; AAGAAT chr11 5257756 5257775 5257759 -
acaagatttttaatagttga

SEQ ID NO: 62748 - DNA, 20 bp, Artificial Sequence
  Synthetic oligonucleotide; TAGAAT chr11 5257683 5257702 5257686 -
tgtgataaacaggtcattct

SEQ ID NO: 62749 - DNA, 20 bp, Artificial Sequence
  Synthetic oligonucleotide; CAGAGT chr11 5257631 5257650 5257634 -
cttagagattatgtcattac

SEQ ID NO: 62750 - DNA, 20 bp, Artificial Sequence
  Synthetic oligonucleotide; AGGAGT chr11 5257480 5257499 5257483 -
atctaactctctggcacagc

SEQ ID NO: 62751 - DNA, 20 bp, Artificial Sequence
  Synthetic oligonucleotide; TTGAAT chr11 5257451 5257470 5257454 -
ttttcttctgcttcagagct

SEQ ID NO: 62752 - DNA, 20 bp, Artificial Sequence
  Synthetic oligonucleotide; TCGAAT chr11 5257371 5257390 5257374 -
ttctgtcattttgcctctgt

SEQ ID NO: 62753 - DNA, 20 bp, Artificial Sequence
  Synthetic oligonucleotide; AAGAAT chr11 5257153 5257172 5257156 -
atgtttgaaaatacatggga

SEQ ID NO: 62754 - DNA, 20 bp, Artificial Sequence
  Synthetic oligonucleotide; TAGGAT chr11 5257099 5257118 5257102 -
aaagaaacagttttatcagt

SEQ ID NO: 62755 - DNA, 20 bp, Artificial Sequence
  Synthetic oligonucleotide; AGGAAT chr11 5257056 5257075 5257059 -
caatgatataggaaaaatcg

SEQ ID NO: 62756 - DNA, 20 bp, Artificial Sequence
  Synthetic oligonucleotide; ATGGAT chr11 5257041 5257060 5257044 -
aatcgaggaataagacagtt

SEQ ID NO: 62757 - DNA, 20 bp, Artificial Sequence
  Synthetic oligonucleotide; AAGGGT chr11 5256980 5256999 5256983 -
tcaaaagcataagaggaaat

SEQ ID NO: 62758 - DNA, 20 bp, Artificial Sequence
  Synthetic oligonucleotide; TTGGAT chr11 5256941 5256960 5256944 -
ttagaacactgccttggttt

SEQ ID NO: 62759 - DNA, 20 bp, Artificial Sequence
  Synthetic oligonucleotide; AGGGAT chr11 5256909 5256928 5256912 -
ggaagttgtttgaaaacagg

SEQ ID NO: 62760 - DNA, 20 bp, Artificial Sequence
  Synthetic oligonucleotide; GGGAGT chr11 5256848 5256867 5256851 -
gattcacttgtttagaggct

SEQ ID NO: 62761 - DNA, 20 bp, Artificial Sequence
  Synthetic oligonucleotide; CAGAAT chr11 5256821 5256840 5256824 -
gtggctcacgcctgtaatcc

SEQ ID NO: 62762 - DNA, 20 bp, Artificial Sequence
  Synthetic oligonucleotide; AAGAGT chr11 5256780 5256799 5256783 -
caggcagatcacctgaggtc

SEQ ID NO: 62763 - DNA, 20 bp, Artificial Sequence
  Synthetic oligonucleotide; GAGAAT chr11 5256663 5256682 5256666 -
tacttgggaggctgaggaag

SEQ ID NO: 62764 - DNA, 20 bp, Artificial Sequence
  Synthetic oligonucleotide; AGGAGT chr11 5256639 5256658 5256642 -
attgcttgaacctggaaggc

SEQ ID NO: 62765 - DNA, 20 bp, Artificial Sequence
  Synthetic oligonucleotide; CTGGGT chr11 5256598 5256617 5256601 -
tcataccactgcactccagc

SEQ ID NO: 62766 - DNA, 20 bp, Artificial Sequence
  Synthetic oligonucleotide; TTGGGT chr11 5256390 5256409 5256393 -
tatcttaaagagaccctaat

SEQ ID NO: 62767 - DNA, 20 bp, Artificial Sequence
  Synthetic oligonucleotide; GTGAGT chr11 5256297 5256316 5256300 -
gagaagtcacttattattat

SEQ ID NO: 62768 - DNA, 20 bp, Artificial Sequence
  Synthetic oligonucleotide; CAGGAT chr11 5256122 5256141 5256125 -
gagcagatataagccttaca

SEQ ID NO: 62769 - DNA, 20 bp, Artificial Sequence
  Synthetic oligonucleotide; AAGGAT chr11 5256104 5256123 5256107 -
cacaggattatgaagtctga

SEQ ID NO: 62770 - DNA, 20 bp, Artificial Sequence
  Synthetic oligonucleotide; CAGAGT chr11 5256020 5256039 5256023 -
cctccaataagccagatttc

SEQ ID NO: 62771 - DNA, 20 bp, Artificial Sequence
  Synthetic oligonucleotide; ATGGAT chr11 5255988 5256007 5255991 -
cgtcataatctaccaaggtc

SEQ ID NO: 62772 - DNA, 20 bp, Artificial Sequence
  Synthetic oligonucleotide; TCGAGT chr11 5255983 5256002 5255986 -
taatctaccaaggtcatgga

SEQ ID NO: 62773 - DNA, 20 bp, Artificial Sequence
  Synthetic oligonucleotide; ATGAAT chr11 5255901 5255920 5255904 -
aaaataaagaaaaaaacagc

SEQ ID NO: 62774 - DNA, 20 bp, Artificial Sequence
  Synthetic oligonucleotide; CTGAGT chr11 5255854 5255873 5255857 -
ccaatatgtcagaaacagca

SEQ ID NO: 62775 - DNA, 20 bp, Artificial Sequence
  Synthetic oligonucleotide; AAGAGT chr11 5255763 5255782 5255766 -
taaaacagtccctgcctctt

SEQ ID NO: 62776 - DNA, 20 bp, Artificial Sequence
  Synthetic oligonucleotide; TAGAAT chr11 5255726 5255745 5255729 -
caaatacatgtcttatgtct

SEQ ID NO: 62777 - DNA, 20 bp, Artificial Sequence
  Synthetic oligonucleotide; CTGGGT chr11 5255601 5255620 5255604 -
agaagagctacaccaaaacc

SEQ ID NO: 62778 - DNA, 20 bp, Artificial Sequence
  Synthetic oligonucleotide; TCGGGT chr11 5255552 5255571 5255555 -
ccagtgataaatacacatca

SEQ ID NO: 62779 - DNA, 20 bp, Artificial Sequence
  Synthetic oligonucleotide; CTGAAT chr11 5255532 5255551 5255535 -
tcgggtgcctacatacatac

SEQ ID NO: 62780 - DNA, 20 bp, Artificial Sequence
  Synthetic oligonucleotide; ACGGAT chr11 5255472 5255491 5255475 -
gtgatttatttcaaataggt

SEQ ID NO: 62781 - DNA, 20 bp, Artificial Sequence
  Synthetic oligonucleotide; AAGGAT chr11 5255450 5255469 5255453 -
ggataagtagatattgaagt

SEQ ID NO: 62782 - DNA, 20 bp, Artificial Sequence
  Synthetic oligonucleotide; TAGGAT chr11 5255385 5255404 5255388 -
gcactgaaactgttgcttta

SEQ ID NO: 62783 - DNA, 20 bp, Artificial Sequence
  Synthetic oligonucleotide; GAGAGT chr11 5255331 5255350 5255334 -
gataatggcctaaaaccaca

SEQ ID NO: 62784 - DNA, 20 bp, Artificial Sequence
  Synthetic oligonucleotide; AAGAAT chr11 5255073 5255092 5255076 -
gaagaaaactagctaaaggg

SEQ ID NO: 62785 - DNA, 20 bp, Artificial Sequence
  Synthetic oligonucleotide; TGGAAT chr11 5255052 5255071 5255055 -
agaataaattagagaaaaat

SEQ ID NO: 62786 - DNA, 20 bp, Artificial Sequence
  Synthetic oligonucleotide; CTGAAT chr11 5255044 5255063 5255047 -
ttagagaaaaattggaatga

SEQ ID NO: 62787 - DNA, 20 bp, Artificial Sequence
  Synthetic oligonucleotide; ATGGGT chr11 5254921 5254940 5254924 -
tccctggctaaactccaccc

SEQ ID NO: 62788 - DNA, 20 bp, Artificial Sequence
  Synthetic oligonucleotide; TAGAGT chr11 5254860 5254879 5254863 -
gcaaacttgaccaatagtct

SEQ ID NO: 62789 - DNA, 20 bp, Artificial Sequence
  Synthetic oligonucleotide; AGGGAT chr11 5254823 5254842 5254826 -
ccaggggccggcggctggct

SEQ ID NO: 62790 - DNA, 20 bp, Artificial Sequence
  Synthetic oligonucleotide; AAGAAT chr11 5254816 5254835 5254819 -
ccggcggctggctagggatg

SEQ ID NO: 62791 - DNA, 20 bp, Artificial Sequence
  Synthetic oligonucleotide; ATGGGT chr11 5254729 5254748 5254732 -
aagctcctagtccagacgcc

SEQ ID NO: 62792 - DNA, 20 bp, Artificial Sequence
  Synthetic oligonucleotide; GTGAAT chr11 5254675 5254694 5254678 -
tcacaagcctgtggggcaag

SEQ ID NO: 62793 - DNA, 20 bp, Artificial Sequence
  Synthetic oligonucleotide; CAGGAT chr11 5254566 5254585 5254569 -
caaaagtccaggtcgcttct

SEQ ID NO: 62794 - DNA, 20 bp, Artificial Sequence
  Synthetic oligonucleotide; CTGGAT chr11 5254373 5254392 5254376 -
tgggagatgccataaagcac

SEQ ID NO: 62795 - DNA, 20 bp, Artificial Sequence
  Synthetic oligonucleotide; CTGAGT chr11 5254343 5254362 5254346 -
tcaagggcacctttgcccag

SEQ ID NO: 62796 - DNA, 20 bp, Artificial Sequence
  Synthetic oligonucleotide; GTGGAT chr11 5254313 5254332 5254316 -
tgcactgtgacaagctgcat

SEQ ID NO: 62797 - DNA, 20 bp, Artificial Sequence
  Synthetic oligonucleotide; GTGAGT chr11 5254292 5254311 5254295 -
tggatcctgagaacttcaag

SEQ ID NO: 62798 - DNA, 20 bp, Artificial Sequence
  Synthetic oligonucleotide; CTGAGT chr11 5254235 5254254 5254238 -
tctcgaggcaacttagacaa

SEQ ID NO: 62799 - DNA, 20 bp, Artificial Sequence
  Synthetic oligonucleotide; CAGGGT chr11 5254213 5254232 5254216 -
gagtattgatctgagcacag

SEQ ID NO: 62800 - DNA, 20 bp, Artificial Sequence
  Synthetic oligonucleotide; TGGGGT chr11 5254188 5254207 5254191 -
tgtgagctgtttgaagatac

SEQ ID NO: 62801 - DNA, 20 bp, Artificial Sequence
  Synthetic oligonucleotide; GGGAGT chr11 5254181 5254200 5254184 -
tgtttgaagatactggggtt

SEQ ID NO: 62802 - DNA, 20 bp, Artificial Sequence
  Synthetic oligonucleotide; AGGAGT chr11 5254118 5254137 5254121 -
tggcaatgttttagggccta

SEQ ID NO: 62803 - DNA, 20 bp, Artificial Sequence
  Synthetic oligonucleotide; AGGGGT chr11 5253776 5253795 5253779 -
gatgggggcaaagtatgtcc

SEQ ID NO: 62804 - DNA, 20 bp, Artificial Sequence
  Synthetic oligonucleotide; TGGAGT chr11 5253746 5253765 5253749 -
aacaattgaaacatttgggc

SEQ ID NO: 62805 - DNA, 20 bp, Artificial Sequence
  Synthetic oligonucleotide; CAGGGT chr11 5253635 5253654 5253638 -
cgttttcagcctacagcata

SEQ ID NO: 62806 - DNA, 20 bp, Artificial Sequence
  Synthetic oligonucleotide; CTGGGT chr11 5253501 5253520 5253504 -
aagttaacataggcttgatt

SEQ ID NO: 62807 - DNA, 20 bp, Artificial Sequence
  Synthetic oligonucleotide; ATGGGT chr11 5253443 5253462 5253446 -
gctggagctctcagctcact

SEQ ID NO: 62808 - DNA, 20 bp, Artificial Sequence
  Synthetic oligonucleotide; AAGAAT chr11 5253360 5253379 5253363 -
tttggcaatccatttcggca

SEQ ID NO: 62809 - DNA, 20 bp, Artificial Sequence
  Synthetic oligonucleotide; TGGAGT chr11 5253314 5253333 5253317 -
tcctggcagaagatggtgac

SEQ ID NO: 62810 - DNA, 20 bp, Artificial Sequence
  Synthetic oligonucleotide; AAGGAT chr11 5253250 5253269 5253253 -
gcccatgatgcagagctttc

SEQ ID NO: 62811 - DNA, 20 bp, Artificial Sequence
  Synthetic oligonucleotide; AAGGGT chr11 5253139 5253158 5253142 -
ttttaaatatatgagccaca

SEQ ID NO: 62812 - DNA, 20 bp, Artificial Sequence
  Synthetic oligonucleotide; AGGGAT chr11 5253124 5253143 5253127 -
ccacaaagggttttatgttg

SEQ ID NO: 62813 - DNA, 20 bp, Artificial Sequence
  Synthetic oligonucleotide; GTGGGT chr11 5253041 5253060 5253044 -
cttttttgtttacgttagat

SEQ ID NO: 62814 - DNA, 20 bp, Artificial Sequence
  Synthetic oligonucleotide; GGGAGT chr11 5252989 5253008 5252992 -
caataaagaaacttgtacat

SEQ ID NO: 62815 - DNA, 20 bp, Artificial Sequence
  Synthetic oligonucleotide; GGGAGT chr11 5252974 5252993 5252977 -
tacatgggagttctgcaagt

SEQ ID NO: 62816 - DNA, 20 bp, Artificial Sequence
  Synthetic oligonucleotide; CTGGAT chr11 5252851 5252870 5252854 -
agggggctgaacccccttcc

SEQ ID NO: 62817 - DNA, 20 bp, Artificial Sequence
  Synthetic oligonucleotide; AGGGAT chr11 5252773 5252792 5252776 -
taggaagtcaaggtttaggc

SEQ ID NO: 62818 - DNA, 20 bp, Artificial Sequence
  Synthetic oligonucleotide; AAGAAT chr11 5252381 5252400 5252384 -
tcagatgaaaatatagtgtg

SEQ ID NO: 62819 - DNA, 20 bp, Artificial Sequence
  Synthetic oligonucleotide; TGGAGT chr11 5252343 5252362 5252346 -
aattgagaaggcagattcac

SEQ ID NO: 62820 - DNA, 20 bp, Artificial Sequence
  Synthetic oligonucleotide; AAGAGT chr11 5252301 5252320 5252304 -
gttaatgcacgttaataagc

SEQ ID NO: 62821 - DNA, 20 bp, Artificial Sequence
  Synthetic oligonucleotide; CTGAAT chr11 5252237 5252256 5252240 -
gtctccagaaaattcacatg

SEQ ID NO: 62822 - DNA, 20 bp, Artificial Sequence
  Synthetic oligonucleotide; TAGAAT chr11 5252144 5252163 5252147 -
atgagagcagatccccatca

SEQ ID NO: 62823 - DNA, 20 bp, Artificial Sequence
  Synthetic oligonucleotide; GTGGAT chr11 5251910 5251929 5251913 -
aaaataagcttcggtgttca

SEQ ID NO: 62824 - DNA, 20 bp, Artificial Sequence
  Synthetic oligonucleotide; CAGAAT chr11 5251852 5251871 5251855 -
tccacttgtcctctgtgttt

SEQ ID NO: 62825 - DNA, 20 bp, Artificial Sequence
  Synthetic oligonucleotide; TTGAAT chr11 5251779 5251798 5251782 -
ctgagcccttctgtctaact

SEQ ID NO: 62826 - DNA, 20 bp, Artificial Sequence
  Synthetic oligonucleotide; CAGAGT chr11 5251670 5251689 5251673 -
ttcttttttttcctcagcct

SEQ ID NO: 62827 - DNA, 20 bp, Artificial Sequence
  Synthetic oligonucleotide; AGGAAT chr11 5251491 5251510 5251494 -
acaagtttataaaaaattga

SEQ ID NO: 62828 - DNA, 20 bp, Artificial Sequence
  Synthetic oligonucleotide; ATGAAT chr11 5251483 5251502 5251486 -
ataaaaaattgaaggaataa

SEQ ID NO: 62829 - DNA, 20 bp, Artificial Sequence
  Synthetic oligonucleotide; CAGAGT chr11 5251463 5251482 5251466 -
atgaatggctacttcatagg

SEQ ID NO: 62830 - DNA, 20 bp, Artificial Sequence
  Synthetic oligonucleotide; AGGGGT chr11 5251398 5251417 5251401 -
tttcaatagtatgctaaaca

SEQ ID NO: 62831 - DNA, 20 bp, Artificial Sequence
  Synthetic oligonucleotide; CAGGAT chr11 5251278 5251297 5251281 -
taatttcgaaggtacatgtg

SEQ ID NO: 62832 - DNA, 20 bp, Artificial Sequence
  Synthetic oligonucleotide; ATGGGT chr11 5251257 5251276 5251260 -
aggatgtgcaggcttgttac

SEQ ID NO: 62833 - DNA, 20 bp, Artificial Sequence
  Synthetic oligonucleotide; CAGGAT chr11 5251191 5251210 5251194 -
gagcagatataagctttaca

SEQ ID NO: 62834 - DNA, 20 bp, Artificial Sequence
  Synthetic oligonucleotide; AAGGAT chr11 5251181 5251200 5251184 -
aagctttacacaggatcatg

SEQ ID NO: 62835 - DNA, 20 bp, Artificial Sequence
  Synthetic oligonucleotide; AAGAAT chr11 5251173 5251192 5251176 -
cacaggatcatgaaggatga

SEQ ID NO: 62836 - DNA, 20 bp, Artificial Sequence
  Synthetic oligonucleotide; GGGGAT chr11 5251126 5251145 5251129 -
tcaatcaacctgatagctta

SEQ ID NO: 62837 - DNA, 20 bp, Artificial Sequence
  Synthetic oligonucleotide; CAGAAT chr11 5251084 5251103 5251087 -
acagcttgcctccgataagc

SEQ ID NO: 62838 - DNA, 20 bp, Artificial Sequence
  Synthetic oligonucleotide; ATGGAT chr11 5251037 5251056 5251040 -
atctagcaaggttagagatc

SEQ ID NO: 62839 - DNA, 20 bp, Artificial Sequence
  Synthetic oligonucleotide; TCGAGT chr11 5250886 5250905 5250889 -
tgtctaaagtacactaatat

SEQ ID NO: 62840 - DNA, 20 bp, Artificial Sequence
  Synthetic oligonucleotide; TAGAGT chr11 5250832 5250851 5250835 -
aaaaacaacccttgcctctt

SEQ ID NO: 62841 - DNA, 20 bp, Artificial Sequence
  Synthetic oligonucleotide; TAGAGT chr11 5250795 5250814 5250798 -
tacacgcacatcttatgtct

SEQ ID NO: 62842 - DNA, 20 bp, Artificial Sequence
  Synthetic oligonucleotide; CTGGGT chr11 5250670 5250689 5250673 -
agaagagctacgccaaaacc

SEQ ID NO: 62843 - DNA, 20 bp, Artificial Sequence
  Synthetic oligonucleotide; CTGAAT chr11 5250601 5250620 5250604 -
tctggtgtatacatacatac

SEQ ID NO: 62844 - DNA, 20 bp, Artificial Sequence
  Synthetic oligonucleotide; TGGAAT chr11 5250594 5250613 5250597 -
tatacatacatacctgaata

SEQ ID NO: 62845 - DNA, 20 bp, Artificial Sequence
  Synthetic oligonucleotide; ACGGAT chr11 5250541 5250560 5250544 -
atgatttatttcaaataggt

SEQ ID NO: 62846 - DNA, 20 bp, Artificial Sequence
  Synthetic oligonucleotide; AAGAGT chr11 5250403 5250422 5250406 -
agataatggcaaaagtcaca

SEQ ID NO: 62847 - DNA, 20 bp, Artificial Sequence
  Synthetic oligonucleotide; AAGAAT chr11 5250145 5250164 5250148 -
gaaggaaactagctaaaggg

SEQ ID NO: 62848 - DNA, 20 bp, Artificial Sequence
  Synthetic oligonucleotide; TGGAAT chr11 5250124 5250143 5250127 -
agaataaattagagaaaaac

SEQ ID NO: 62849 - DNA, 20 bp, Artificial Sequence
  Synthetic oligonucleotide; CTGAAT chr11 5250116 5250135 5250119 -
ttagagaaaaactggaatga

SEQ ID NO: 62850 - DNA, 20 bp, Artificial Sequence
  Synthetic oligonucleotide; ATGGGT chr11 5249997 5250016 5250000 -
tccctggctaaactccaccc

SEQ ID NO: 62851 - DNA, 20 bp, Artificial Sequence
  Synthetic oligonucleotide; TAGAGT chr11 5249936 5249955 5249939 -
gcaaacttgaccaatagtct

SEQ ID NO: 62852 - DNA, 20 bp, Artificial Sequence
  Synthetic oligonucleotide; AGGGAT chr11 5249899 5249918 5249902 -
ccaggggccggcggctggct

SEQ ID NO: 62853 - DNA, 20 bp, Artificial Sequence
  Synthetic oligonucleotide; AAGAAT chr11 5249892 5249911 5249895 -
ccggcggctggctagggatg

SEQ ID NO: 62854 - DNA, 20 bp, Artificial Sequence
  Synthetic oligonucleotide; ATGGGT chr11 5249805 5249824 5249808 -
aagctcctagtccagacgcc

SEQ ID NO: 62855 - DNA, 20 bp, Artificial Sequence
  Synthetic oligonucleotide; GTGAAT chr11 5249751 5249770 5249754 -
tcacaagcctgtggggcaag

SEQ ID NO: 62856 - DNA, 20 bp, Artificial Sequence
  Synthetic oligonucleotide; CAGGAT chr11 5249642 5249661 5249645 -
caaaagtccaggtcgcttct

SEQ ID NO: 62857 - DNA, 20 bp, Artificial Sequence
  Synthetic oligonucleotide; CTGGAT chr11 5249449 5249468 5249452 -
tgggagatgccacaaagcac

SEQ ID NO: 62858 - DNA, 20 bp, Artificial Sequence
  Synthetic oligonucleotide; CTGAGT chr11 5249419 5249438 5249422 -
tcaagggcacctttgcccag

SEQ ID NO: 62859 - DNA, 20 bp, Artificial Sequence
  Synthetic oligonucleotide; GTGGAT chr11 5249389 5249408 5249392 -
tgcactgtgacaagctgcat

SEQ ID NO: 62860 - DNA, 20 bp, Artificial Sequence
  Synthetic oligonucleotide; GTGAGT chr11 5249368 5249387 5249371 -
tggatcctgagaacttcaag

SEQ ID NO: 62861 - DNA, 20 bp, Artificial Sequence
  Synthetic oligonucleotide; CGGAGT chr11 5249311 5249330 5249314 -
tctcgaggcaacttagacaa

SEQ ID NO: 62862 - DNA, 20 bp, Artificial Sequence
  Synthetic oligonucleotide; CAGGGT chr11 5249289 5249308 5249292 -
gagtattgatctgagcacag

SEQ ID NO: 62863 - DNA, 20 bp, Artificial Sequence
  Synthetic oligonucleotide; TGGGGT chr11 5249264 5249283 5249267 -
tgtgagctgtttgaagatac

SEQ ID NO: 62864 - DNA, 20 bp, Artificial Sequence
  Synthetic oligonucleotide; GGGGGT chr11 5249257 5249276 5249260 -
tgtttgaagatactggggtt

SEQ ID NO: 62865 - DNA, 20 bp, Artificial Sequence
  Synthetic oligonucleotide; AGGAGT chr11 5249194 5249213 5249197 -
tggtaatgttttagggccta

SEQ ID NO: 62866 - DNA, 20 bp, Artificial Sequence
  Synthetic oligonucleotide; AGGGGT chr11 5248856 5248875 5248859 -
gatgggggcaaagtatgtcc

SEQ ID NO: 62867 - DNA, 20 bp, Artificial Sequence
  Synthetic oligonucleotide; TGGAGT chr11 5248826 5248845 5248829 -
aacaattgaaacatttgggc

SEQ ID NO: 62868 - DNA, 20 bp, Artificial Sequence
  Synthetic oligonucleotide; CAGGGT chr11 5248717 5248736 5248720 -
cgtcttcagcctacaacata

SEQ ID NO: 62869 - DNA, 20 bp, Artificial Sequence
  Synthetic oligonucleotide; CTGGGT chr11 5248583 5248602 5248586 -
aagttaacataggcttgatt

SEQ ID NO: 62870 - DNA, 20 bp, Artificial Sequence
  Synthetic oligonucleotide; ATGGGT chr11 5248525 5248544 5248528 -
gctggagctctcagctcact

SEQ ID NO: 62871 - DNA, 20 bp, Artificial Sequence
  Synthetic oligonucleotide; AAGAAT chr11 5248442 5248461 5248445 -
tttggcaatccatttcggca

SEQ ID NO: 62872 - DNA, 20 bp, Artificial Sequence
  Synthetic oligonucleotide; AAGGAT chr11 5248332 5248351 5248335 -
gcccatgattcagagctttc

SEQ ID NO: 62873 - DNA, 20 bp, Artificial Sequence
  Synthetic oligonucleotide; AAGGGT chr11 5248219 5248238 5248222 -
ttttaaatatatgagccaca

SEQ ID NO: 62874 - DNA, 20 bp, Artificial Sequence
  Synthetic oligonucleotide; GGGAGT chr11 5248079 5248098 5248082 -
cagtaaagacacttgtacac

SEQ ID NO: 62875 - DNA, 20 bp, Artificial Sequence
  Synthetic oligonucleotide; GGGAGT chr11 5248064 5248083 5248067 -
tacacgggagttctgcaagt

SEQ ID NO: 62876 - DNA, 20 bp, Artificial Sequence
  Synthetic oligonucleotide; CTGGAT chr11 5247950 5247969 5247953 -
gttcagtgaagacctggggg

SEQ ID NO: 62877 - DNA, 20 bp, Artificial Sequence
  Synthetic oligonucleotide; CTGAGT chr11 5247935 5247954 5247938 -
gggggctggattgattgcag

SEQ ID NO: 62878 - DNA, 20 bp, Artificial Sequence
  Synthetic oligonucleotide; AAGGAT chr11 5247926 5247945 5247929 -
attgattgcagctgagtagc

SEQ ID NO: 62879 - DNA, 20 bp, Artificial Sequence
  Synthetic oligonucleotide; AGGAAT chr11 5247887 5247906 5247890 -
gggaaagtgttccaagcttt

SEQ ID NO: 62880 - DNA, 20 bp, Artificial Sequence
  Synthetic oligonucleotide; AGGAAT chr11 5247842 5247861 5247845 -
agcaattctattttattagg

SEQ ID NO: 62881 - DNA, 20 bp, Artificial Sequence
  Synthetic oligonucleotide; GTGGAT chr11 5247800 5247819 5247803 -
cttagcttttcacagccctt

SEQ ID NO: 62882 - DNA, 20 bp, Artificial Sequence
  Synthetic oligonucleotide; ATGAAT chr11 5247680 5247699 5247683 -
tggggacttaggtgtaagaa

SEQ ID NO: 62883 - DNA, 20 bp, Artificial Sequence
  Synthetic oligonucleotide; AAGAAT chr11 5247596 5247615 5247599 -
tgagatcaaaatgtagtggg

SEQ ID NO: 62884 - DNA, 20 bp, Artificial Sequence
  Synthetic oligonucleotide; TGGAAT chr11 5247559 5247578 5247562 -
taattggaaggcttacttaa

SEQ ID NO: 62885 - DNA, 20 bp, Artificial Sequence
  Synthetic oligonucleotide; TTGGAT chr11 5247543 5247562 5247546 -
ttaatggaatttttgtatag

SEQ ID NO: 62886 - DNA, 20 bp, Artificial Sequence
  Synthetic oligonucleotide; AAGAGT chr11 5247517 5247536 5247520 -
gttagtgcatctctataagt

SEQ ID NO: 62887 - DNA, 20 bp, Artificial Sequence
  Synthetic oligonucleotide; CTGAAT chr11 5247458 5247477 5247461 -
gtctcctcaaaattcacatg

SEQ ID NO: 62888 - DNA, 20 bp, Artificial Sequence
  Synthetic oligonucleotide; ACGAGT chr11 5247256 5247275 5247259 -
ccaggaagagaaccctgacc

SEQ ID NO: 62889 - DNA, 20 bp, Artificial Sequence
  Synthetic oligonucleotide; CTGAGT chr11 5247174 5247193 5247177 -
ttttgttatagcaccttgca

SEQ ID NO: 62890 - DNA, 20 bp, Artificial Sequence
  Synthetic oligonucleotide; TTGGGT chr11 5247137 5247156 5247140 -
agaaggagaaaaaaataagc

SEQ ID NO: 62891 - DNA, 20 bp, Artificial Sequence
  Synthetic oligonucleotide; TTGAGT chr11 5247130 5247149 5247133 -
gaaaaaaataagcttgggtt

SEQ ID NO: 62892 - DNA, 20 bp, Artificial Sequence
  Synthetic oligonucleotide; CAGAAT chr11 5246877 5246896 5246880 -
ttcttttttctcctcagcct

SEQ ID NO: 62893 - DNA, 20 bp, Artificial Sequence
  Synthetic oligonucleotide; CAGAAT chr11 5246772 5246791 5246775 -
aaatgcagtcactaccgttt

SEQ ID NO: 62894 - DNA, 20 bp, Artificial Sequence
  Synthetic oligonucleotide; GAGAGT chr11 5246709 5246728 5246712 -
agtcaaagcaaatttcttga

SEQ ID NO: 62895 - DNA, 20 bp, Artificial Sequence
  Synthetic oligonucleotide; ACGAAT chr11 5246693 5246712 5246696 -
ttgagagagtaaagaaataa

SEQ ID NO: 62896 - DNA, 20 bp, Artificial Sequence
  Synthetic oligonucleotide; TTGGAT chr11 5246605 5246624 5246608 -
gatgatatgttaaacaagtt

SEQ ID NO: 62897 - DNA, 20 bp, Artificial Sequence
  Synthetic oligonucleotide; TAGGGT chr11 5246571 5246590 5246574 -
ccttctctttttaggccata

SEQ ID NO: 62898 - DNA, 20 bp, Artificial Sequence
  Synthetic oligonucleotide; AGGGGT chr11 5246505 5246524 5246508 -
tttactgttaccttaaattc

SEQ ID NO: 62899 - DNA, 20 bp, Artificial Sequence
  Synthetic oligonucleotide; CAGGAT chr11 5246492 5246511 5246495 -
taaattcaggggtacacgta

SEQ ID NO: 62900 - DNA, 20 bp, Artificial Sequence
  Synthetic oligonucleotide; ATGGGT chr11 5246445 5246464 5246448 -
aaaagtgtgccatggtttta

SEQ ID NO: 62901 - DNA, 20 bp, Artificial Sequence
  Synthetic oligonucleotide; CTGGAT chr11 5246399 5246418 5246402 -
gtttaagtttcttgtttact

SEQ ID NO: 62902 - DNA, 20 bp, Artificial Sequence
  Synthetic oligonucleotide; AAGAAT chr11 5246377 5246396 5246380 -
ggatattaggcctttgtcag

SEQ ID NO: 62903 - DNA, 20 bp, Artificial Sequence
  Synthetic oligonucleotide; ATGAAT chr11 5246203 5246222 5246206 -
tctgtgcccgtgtttatatc

SEQ ID NO: 62904 - DNA, 20 bp, Artificial Sequence
  Synthetic oligonucleotide; TGGGGT chr11 5246160 5246179 5246163 -
tttctaggctttttatagtt

SEQ ID NO: 62905 - DNA, 20 bp, Artificial Sequence
  Synthetic oligonucleotide; TGGAGT chr11 5246129 5246148 5246132 -
atttaagtctctaatccatc

SEQ ID NO: 62906 - DNA, 20 bp, Artificial Sequence
  Synthetic oligonucleotide; TTGGAT chr11 5246118 5246137 5246121 -
taatccatctggagttaatt

SEQ ID NO: 62907 - DNA, 20 bp, Artificial Sequence
  Synthetic oligonucleotide; AGGAGT chr11 5246100 5246119 5246103 -
ttttggataaggtataagga

SEQ ID NO: 62908 - DNA, 20 bp, Artificial Sequence
  Synthetic oligonucleotide; GAGAAT chr11 5245862 5245881 5245865 -
agtgagggcaccattagcca

SEQ ID NO: 62909 - DNA, 20 bp, Artificial Sequence
  Synthetic oligonucleotide; CAGAAT chr11 5245829 5245848 5245832 -
tctagttcatgtaagattct

SEQ ID NO: 62910 - DNA, 20 bp, Artificial Sequence
  Synthetic oligonucleotide; ATGGAT chr11 5245815 5245834 5245818 -
gattctcagaattaagaaaa

SEQ ID NO: 62911 - DNA, 20 bp, Artificial Sequence
  Synthetic oligonucleotide; ATGAAT chr11 5245804 5245823 5245807 -
ttaagaaaaatggatggcat

SEQ ID NO: 62912 - DNA, 20 bp, Artificial Sequence
  Synthetic oligonucleotide; ATGGAT chr11 5245790 5245809 5245793 -
tggcatatgaatgaaacttc

SEQ ID NO: 62913 - DNA, 20 bp, Artificial Sequence
  Synthetic oligonucleotide; TGGAAT chr11 5245778 5245797 5245781 -
gaaacttcatggatgacata

SEQ ID NO: 62914 - DNA, 20 bp, Artificial Sequence
  Synthetic oligonucleotide; TTGAAT chr11 5245758 5245777 5245761 -
tggaatctaatatgtatttg

SEQ ID NO: 62915 - DNA, 20 bp, Artificial Sequence
  Synthetic oligonucleotide; AAGAGT chr11 5245689 5245708 5245692 -
taacctggtattgatgatat

SEQ ID NO: 62916 - DNA, 20 bp, Artificial Sequence
  Synthetic oligonucleotide; AAGAAT chr11 5245616 5245635 5245619 -
gggaacagccacaaacaaga

SEQ ID NO: 62917 - DNA, 20 bp, Artificial Sequence
  Synthetic oligonucleotide; GCGGGT chr11 5245569 5245588 5245572 -
tgcaggtcacttttcctgga

SEQ ID NO: 62918 - DNA, 20 bp, Artificial Sequence
  Synthetic oligonucleotide; CTGAAT chr11 5245534 5245553 5245537 -
gtggaagttagcagtaactg

SEQ ID NO: 62919 - DNA, 20 bp, Artificial Sequence
  Synthetic oligonucleotide; CAGGGT chr11 5245483 5245502 5245486 -
ggcagctgttcactggtacg

SEQ ID NO: 62920 - DNA, 20 bp, Artificial Sequence
  Synthetic oligonucleotide; AAGGAT chr11 5245460 5245479 5245463 -
ggttttagatgtatgtacct

SEQ ID NO: 62921 - DNA, 20 bp, Artificial Sequence
  Synthetic oligonucleotide; GGGAAT chr11 5245423 5245442 5245426 -
caatgaacagaaattctttt

SEQ ID NO: 62922 - DNA, 20 bp, Artificial Sequence
  Synthetic oligonucleotide; ATGAGT chr11 5245419 5245438 5245422 -
gaacagaaattcttttggga

SEQ ID NO: 62923 - DNA, 20 bp, Artificial Sequence
  Synthetic oligonucleotide; TTGGGT chr11 5245140 5245159 5245143 -
agaaattcagctttaatata

SEQ ID NO: 62924 - DNA, 20 bp, Artificial Sequence
  Synthetic oligonucleotide; TAGAGT chr11 5245118 5245137 5245121 -
gggtttaactctttgaaatt

SEQ ID NO: 62925 - DNA, 20 bp, Artificial Sequence
  Synthetic oligonucleotide; GGGGGT chr11 5245095 5245114 5245098 -
agtctccttgaaatacacat

SEQ ID NO: 62926 - DNA, 20 bp, Artificial Sequence
  Synthetic oligonucleotide; AAGGAT chr11 5245065 5245084 5245068 -
tcctaaactttatttcttgt

SEQ ID NO: 62927 - DNA, 20 bp, Artificial Sequence
  Synthetic oligonucleotide; AGGGGT chr11 5245052 5245071 5245055 -
ttcttgtaaggatttatctc

SEQ ID NO: 62928 - DNA, 20 bp, Artificial Sequence
  Synthetic oligonucleotide; AAGAAT chr11 5244996 5245015 5244999 -
gtatgaggacagtaagcctt

SEQ ID NO: 62929 - DNA, 20 bp, Artificial Sequence
  Synthetic oligonucleotide; TGGAAT chr11 5244878 5244897 5244881 -
gagacacgtgcagcagcctg

SEQ ID NO: 62930 - DNA, 20 bp, Artificial Sequence
  Synthetic oligonucleotide; AAGAAT chr11 5244862 5244881 5244865 -
cctgtggaatattgtcagtg

SEQ ID NO: 62931 - DNA, 20 bp, Artificial Sequence
  Synthetic oligonucleotide; CGGAAT chr11 5244757 5244776 5244760 -
ctaatgcccagcacgggcca

SEQ ID NO: 62932 - DNA, 20 bp, Artificial Sequence
  Synthetic oligonucleotide; TAGGAT chr11 5244671 5244690 5244674 -
ggcataattttgtagatatg

SEQ ID NO: 62933 - DNA, 20 bp, Artificial Sequence
  Synthetic oligonucleotide; ATGGAT chr11 5244596 5244615 5244599 -
ataagtacactgactactaa

SEQ ID NO: 62934 - DNA, 20 bp, Artificial Sequence
  Synthetic oligonucleotide; CTGGAT chr11 5244511 5244530 5244514 -
tgctttcttccaagttgatg

SEQ ID NO: 62935 - DNA, 20 bp, Artificial Sequence
  Synthetic oligonucleotide; GCGGAT chr11 5244413 5244432 5244416 -
actttgggaggctgaggtgg

SEQ ID NO: 62936 - DNA, 20 bp, Artificial Sequence
  Synthetic oligonucleotide; GCGGGT chr11 5244320 5244339 5244323 -
aaaattagccagagacagtg

SEQ ID NO: 62937 - DNA, 20 bp, Artificial Sequence
  Synthetic oligonucleotide; GAGAAT chr11 5244279 5244298 5244282 -
tactcgggaggctgaggcag

SEQ ID NO: 62938 - DNA, 20 bp, Artificial Sequence
  Synthetic oligonucleotide; CTGGGT chr11 5244212 5244231 5244215 -
gcgccactgcacactccagc

SEQ ID NO: 62939 - DNA, 20 bp, Artificial Sequence
  Synthetic oligonucleotide; GAGAAT chr11 5244105 5244124 5244108 -
tgtattcaatgtagtctcaa

SEQ ID NO: 62940 - DNA, 20 bp, Artificial Sequence
  Synthetic oligonucleotide; CTGGAT chr11 5244060 5244079 5244063 -
tggcttcttccacataaagc

SEQ ID NO: 62941 - DNA, 20 bp, Artificial Sequence
  Synthetic oligonucleotide; ATGAAT chr11 5244056 5244075 5244059 -
ttcttccacataaagcctgg

SEQ ID NO: 62942 - DNA, 20 bp, Artificial Sequence
  Synthetic oligonucleotide; CAGGAT chr11 5244048 5244067 5244051 -
cataaagcctggatgaataa

SEQ ID NO: 62943 - DNA, 20 bp, Artificial Sequence
  Synthetic oligonucleotide; AGGAAT chr11 5244009 5244028 5244012 -
attgtcacaactcctgatcc

SEQ ID NO: 62944 - DNA, 20 bp, Artificial Sequence
  Synthetic oligonucleotide; CTGGAT chr11 5243890 5243909 5243893 -
cttgagaaataaactgcaca

SEQ ID NO: 62945 - DNA, 20 bp, Artificial Sequence
  Synthetic oligonucleotide; GGGGGT chr11 5243881 5243900 5243884 -
taaactgcacactggatggt

SEQ ID NO: 62946 - DNA, 20 bp, Artificial Sequence
  Synthetic oligonucleotide; CTGGAT chr11 5243799 5243818 5243802 -
agttcccctgagaaggccac

SEQ ID NO: 62947 - DNA, 20 bp, Artificial Sequence
  Synthetic oligonucleotide; TCGAAT chr11 5243781 5243800 5243784 -
acctggattctatcagaaac

SEQ ID NO: 62948 - DNA, 20 bp, Artificial Sequence
  Synthetic oligonucleotide; TGGAGT chr11 5243737 5243756 5243740 -
ccttgcccaaaccccacccc

SEQ ID NO: 62949 - DNA, 20 bp, Artificial Sequence
  Synthetic oligonucleotide; AGGGAT chr11 5243396 5243415 5243399 -
gcagaaagtgtttctgaaag

SEQ ID NO: 62950 - DNA, 20 bp, Artificial Sequence
  Synthetic oligonucleotide; TTGGAT chr11 5243285 5243304 5243288 -
ctagaggtactttgaaagtt

SEQ ID NO: 62951 - DNA, 20 bp, Artificial Sequence
  Synthetic oligonucleotide; ACGGAT chr11 5243187 5243206 5243190 -
tcggaaaagctgttatgctc

SEQ ID NO: 62952 - DNA, 20 bp, Artificial Sequence
  Synthetic oligonucleotide; CTGAGT chr11 5243157 5243176 5243160 -
tcaaaggcacctttgctaca

SEQ ID NO: 62953 - DNA, 20 bp, Artificial Sequence
  Synthetic oligonucleotide; GTGAGT chr11 5243106 5243125 5243109 -
tggaccctgagaacttcctg

SEQ ID NO: 62954 - DNA, 20 bp, Artificial Sequence
  Synthetic oligonucleotide; ATGGGT chr11 5243054 5243073 5243057 -
tacccttagatatttgcact

SEQ ID NO: 62955 - DNA, 20 bp, Artificial Sequence
  Synthetic oligonucleotide; ATGAGT chr11 5243014 5243033 5243017 -
aggtggctttctcttgtgtt

SEQ ID NO: 62956 - DNA, 20 bp, Artificial Sequence
  Synthetic oligonucleotide; TGGGAT chr11 5243002 5243021 5243005 -
cttgtgttatgagtcagcta

SEQ ID NO: 62957 - DNA, 20 bp, Artificial Sequence
  Synthetic oligonucleotide; TGGGAT chr11 5242981 5243000 5242984 -
gggatatgatatttcagcag

SEQ ID NO: 62958 - DNA, 20 bp, Artificial Sequence
  Synthetic oligonucleotide; GAGAGT chr11 5242972 5242991 5242975 -
tatttcagcagtgggatttt

SEQ ID NO: 62959 - DNA, 20 bp, Artificial Sequence
  Synthetic oligonucleotide; ATGAAT chr11 5242920 5242939 5242923 -
aatttggtagagcaaggact

SEQ ID NO: 62960 - DNA, 20 bp, Artificial Sequence
  Synthetic oligonucleotide; CTGAGT chr11 5242844 5242863 5242847 -
aaattctggccaaaatcaaa

SEQ ID NO: 62961 - DNA, 20 bp, Artificial Sequence
  Synthetic oligonucleotide; TTGGAT chr11 5242834 5242853 5242837 -
caaaatcaaactgagtgttt

SEQ ID NO: 62962 - DNA, 20 bp, Artificial Sequence
  Synthetic oligonucleotide; GAGGAT chr11 5242684 5242703 5242687 -
tagtgggaagctgttaaaaa

SEQ ID NO: 62963 - DNA, 20 bp, Artificial Sequence
  Synthetic oligonucleotide; CCGAAT chr11 5242669 5242688 5242672 -
aaaaagaggattgtttccct

SEQ ID NO: 62964 - DNA, 20 bp, Artificial Sequence
  Synthetic oligonucleotide; CAGGAT chr11 5242634 5242653 5242637 -
atacttttgtacgcatggta

SEQ ID NO: 62965 - DNA, 20 bp, Artificial Sequence
  Synthetic oligonucleotide; ATGAGT chr11 5242620 5242639 5242623 -
atggtacaggattctttgtt

SEQ ID NO: 62966 - DNA, 20 bp, Artificial Sequence
  Synthetic oligonucleotide; TGGGGT chr11 5242469 5242488 5242472 -
atgaaacaatcacaatatgt

SEQ ID NO: 62967 - DNA, 20 bp, Artificial Sequence
  Synthetic oligonucleotide; GTGAGT chr11 5242462 5242481 5242465 -
aatcacaatatgttggggta

SEQ ID NO: 62968 - DNA, 20 bp, Artificial Sequence
  Synthetic oligonucleotide; AAGGAT chr11 5242438 5242457 5242441 -
gttggcatagcaagtaagag

SEQ ID NO: 62969 - DNA, 20 bp, Artificial Sequence
  Synthetic oligonucleotide; GAGAGT chr11 5242369 5242388 5242372 -
gatatctagcccataatggt

SEQ ID NO: 62970 - DNA, 20 bp, Artificial Sequence
  Synthetic oligonucleotide; AAGGAT chr11 5242344 5242363 5242347 -
ttgctcaaactctggtgaaa

SEQ ID NO: 62971 - DNA, 20 bp, Artificial Sequence
  Synthetic oligonucleotide; GAGGAT chr11 5242203 5242222 5242206 -
ttttggcaacccacttcagc

SEQ ID NO: 62972 - DNA, 20 bp, Artificial Sequence
  Synthetic oligonucleotide; CTGAGT chr11 5242124 5242143 5242127 -
tgctgtagcccacaagacca

SEQ ID NO: 62973 - DNA, 20 bp, Artificial Sequence
  Synthetic oligonucleotide; TAGAAT chr11 5241983 5242002 5241986 -
cagttcctgcatgataaaaa

SEQ ID NO: 62974 - DNA, 20 bp, Artificial Sequence
  Synthetic oligonucleotide; GAGAAT chr11 5241879 5241898 5241882 -
gcactatttctgatggaaat

SEQ ID NO: 62975 - DNA, 20 bp, Artificial Sequence
  Synthetic oligonucleotide; GAGAAT chr11 5241869 5241888 5241872 -
tgatggaaatgagaatgttg

SEQ ID NO: 62976 - DNA, 20 bp, Artificial Sequence
  Synthetic oligonucleotide; GGGAGT chr11 5241863 5241882 5241866 -
aaatgagaatgttggagaat

SEQ ID NO: 62977 - DNA, 20 bp, Artificial Sequence
  Synthetic oligonucleotide; GTGGGT chr11 5241805 5241824 5241808 -
tgcaagaaaagagagaactc

SEQ ID NO: 62978 - DNA, 20 bp, Artificial Sequence
  Synthetic oligonucleotide; GTGGAT chr11 5241801 5241820 5241804 -
agaaaagagagaactcgtgg

SEQ ID NO: 62979 - DNA, 20 bp, Artificial Sequence
  Synthetic oligonucleotide; TGGGGT chr11 5241791 5241810 5241794 -
gaactcgtgggtggatttag

SEQ ID NO: 62980 - DNA, 20 bp, Artificial Sequence
  Synthetic oligonucleotide; TAGAAT chr11 5241756 5241775 5241759 -
taggaaggggaaatcgtctc

SEQ ID NO: 62981 - DNA, 20 bp, Artificial Sequence
  Synthetic oligonucleotide; GAGGAT chr11 5241695 5241714 5241698 -
ggtactctttggaggtgtaa

SEQ ID NO: 62982 - DNA, 20 bp, Artificial Sequence
  Synthetic oligonucleotide; CAGGAT chr11 5241617 5241636 5241620 -
gctattatttgtatgaaact

SEQ ID NO: 62983 - DNA, 20 bp, Artificial Sequence
  Synthetic oligonucleotide; GGGGAT chr11 5241538 5241557 5241541 -
tttattatttataatgaagt

SEQ ID NO: 62984 - DNA, 20 bp, Artificial Sequence
  Synthetic oligonucleotide; GAGAAT chr11 5241463 5241482 5241466 -
cgtcttcaatggtattaata

SEQ ID NO: 62985 - DNA, 20 bp, Artificial Sequence
  Synthetic oligonucleotide; AAGGAT chr11 5241326 5241345 5241329 -
tatcatatgtattttcctta

SEQ ID NO: 62986 - DNA, 20 bp, Artificial Sequence
  Synthetic oligonucleotide; TTGAAT chr11 5241305 5241324 5241308 -
aggatttttgtaagaactaa

SEQ ID NO: 62987 - DNA, 20 bp, Artificial Sequence
  Synthetic oligonucleotide; ATGAAT chr11 5241129 5241148 5241132 -
cataaatatatacaattttt

SEQ ID NO: 62988 - DNA, 20 bp, Artificial Sequence
  Synthetic oligonucleotide; GAGAAT chr11 5241011 5241030 5241014 -
gttaagtcaagttgatagag

SEQ ID NO: 62989 - DNA, 20 bp, Artificial Sequence
  Synthetic oligonucleotide; CAGGAT chr11 5240987 5241006 5240990 -
atatggacatttaaaagagg

SEQ ID NO: 62990 - DNA, 20 bp, Artificial Sequence
  Synthetic oligonucleotide; CTGGAT chr11 5240963 5240982 5240966 -
atgatataaaattagggaaa

SEQ ID NO: 62991 - DNA, 20 bp, Artificial Sequence
  Synthetic oligonucleotide; GAGAGT chr11 5240888 5240907 5240891 -
cactgaagtttcttgcatat

SEQ ID NO: 62992 - DNA, 20 bp, Artificial Sequence
  Synthetic oligonucleotide; TTGGGT chr11 5240805 5240824 5240808 -
ctgattagacaaagtctaac

SEQ ID NO: 62993 - DNA, 20 bp, Artificial Sequence
  Synthetic oligonucleotide; ATGGAT chr11 5240763 5240782 5240766 -
gctgtaattatattgaggtg

SEQ ID NO: 62994 - DNA, 20 bp, Artificial Sequence
  Synthetic oligonucleotide; TCGAGT chr11 5240714 5240733 5240717 -
aatgaagttaagaaaaaaaa

SEQ ID NO: 62995 - DNA, 20 bp, Artificial Sequence
  Synthetic oligonucleotide; GAGAGT chr11 5240657 5240676 5240660 -
ctggaaaacattgtgaaaca

SEQ ID NO: 62996 - DNA, 20 bp, Artificial Sequence
  Synthetic oligonucleotide; GTGAAT chr11 5240624 5240643 5240627 -
gacagctaaaatccctgtct

SEQ ID NO: 62997 - DNA, 20 bp, Artificial Sequence
  Synthetic oligonucleotide; TTGGAT chr11 5240567 5240586 5240570 -
aatgcctacaagccccctgt

SEQ ID NO: 62998 - DNA, 20 bp, Artificial Sequence
  Synthetic oligonucleotide; TTGAGT chr11 5240346 5240365 5240349 -
agctcacctcaccatatctc

SEQ ID NO: 62999 - DNA, 20 bp, Artificial Sequence
  Synthetic oligonucleotide; TTGAGT chr11 5240279 5240298 5240282 -
gaaattcctttgtcatattt

SEQ ID NO: 63000 - DNA, 20 bp, Artificial Sequence
  Synthetic oligonucleotide; CAGAAT chr11 5240252 5240271 5240255 -
cccactaataacccacaaag

SEQ ID NO: 63001 - DNA, 20 bp, Artificial Sequence
  Synthetic oligonucleotide; TTGAAT chr11 5240175 5240194 5240178 -
acattaattaagcacattct

SEQ ID NO: 63002 - DNA, 20 bp, Artificial Sequence
  Synthetic oligonucleotide; CTGAAT chr11 5240109 5240128 5240112 -
ttgtgctatcccttgccctt

SEQ ID NO: 63003 - DNA, 20 bp, Artificial Sequence
  Synthetic oligonucleotide; GAGGGT chr11 5240076 5240095 5240079 -
tgtattttaaatgaagagat

SEQ ID NO: 63004 - DNA, 20 bp, Artificial Sequence
  Synthetic oligonucleotide; TTGAAT chr11 5240071 5240090 5240074 -
tttaaatgaagagatgaggg

SEQ ID NO: 63005 - DNA, 20 bp, Artificial Sequence
  Synthetic oligonucleotide; AGGAGT chr11 5240033 5240052 5240036 -
ttattgttcatttctcgatg

SEQ ID NO: 63006 - DNA, 20 bp, Artificial Sequence
  Synthetic oligonucleotide; ATGAAT chr11 5239953 5239972 5239956 -
ataccaaactgacatgtagc

SEQ ID NO: 63007 - DNA, 20 bp, Artificial Sequence
  Synthetic oligonucleotide; TTGAGT chr11 5239795 5239814 5239798 -
acactgttacagatgcatac

SEQ ID NO: 63008 - DNA, 20 bp, Artificial Sequence
  Synthetic oligonucleotide; GAGAAT chr11 5239760 5239779 5239763 -
aaattaccccagtcaatcta

SEQ ID NO: 63009 - DNA, 20 bp, Artificial Sequence
  Synthetic oligonucleotide; TTGGAT chr11 5239754 5239773 5239757 -
ccccagtcaatctagagaat

SEQ ID NO: 63010 - DNA, 20 bp, Artificial Sequence
  Synthetic oligonucleotide; CTGGGT chr11 5239703 5239722 5239706 -
gtacatgctgttcatttact

SEQ ID NO: 63011 - DNA, 20 bp, Artificial Sequence
  Synthetic oligonucleotide; ATGAGT chr11 5239369 5239388 5239372 -
agatctctcttttctacatt

SEQ ID NO: 63012 - DNA, 20 bp, Artificial Sequence
  Synthetic oligonucleotide; CAGAAT chr11 5239200 5239219 5239203 -
tgtcatgcatttattcacat

SEQ ID NO: 63013 - DNA, 20 bp, Artificial Sequence
  Synthetic oligonucleotide; TAGGGT chr11 5239141 5239160 5239144 -
agtttattagttatatcagt

SEQ ID NO: 63014 - DNA, 20 bp, Artificial Sequence
  Synthetic oligonucleotide; TAGAAT chr11 5239096 5239115 5239099 -
ccattatcagttactcaacc

SEQ ID NO: 63015 - DNA, 20 bp, Artificial Sequence
  Synthetic oligonucleotide; CAGAGT chr11 5238939 5238958 5238942 -
ggagaaaatgtttataccac

SEQ ID NO: 63016 - DNA, 20 bp, Artificial Sequence
  Synthetic oligonucleotide; CTGGAT chr11 5238903 5238922 5238906 -
agcccataaccagaggtcca

SEQ ID NO: 63017 - DNA, 20 bp, Artificial Sequence
  Synthetic oligonucleotide; GTGGGT chr11 5238886 5238905 5238889 -
ccactggattcagtgagcta

SEQ ID NO: 63018 - DNA, 20 bp, Artificial Sequence
  Synthetic oligonucleotide; CAGAAT chr11 5238722 5238741 5238725 -
tcagccagtgtttaccattg

SEQ ID NO: 63019 - DNA, 20 bp, Artificial Sequence
  Synthetic oligonucleotide; AAGGGT chr11 5238702 5238721 5238705 -
cagaatgtacatgcgactga

SEQ ID NO: 63020 - DNA, 20 bp, Artificial Sequence
  Synthetic oligonucleotide; AAGGAT chr11 5238647 5238666 5238650 -
aatacagagaacactgaggg

SEQ ID NO: 63021 - DNA, 20 bp, Artificial Sequence
  Synthetic oligonucleotide; ATGAAT chr11 5238618 5238637 5238621 -
aaataaatgtgaaagcagac

SEQ ID NO: 63022 - DNA, 20 bp, Artificial Sequence
  Synthetic oligonucleotide; TAGGAT chr11 5238592 5238611 5238595 -
ggtaattgacagaaggaaac

SEQ ID NO: 63023 - DNA, 20 bp, Artificial Sequence
  Synthetic oligonucleotide; ATGAAT chr11 5238575 5238594 5238578 -
aactaggatgtgtccagtaa

SEQ ID NO: 63024 - DNA, 20 bp, Artificial Sequence
  Synthetic oligonucleotide; CAGAAT chr11 5238509 5238528 5238512 -
gataagataatatgaaaaca

SEQ ID NO: 63025 - DNA, 20 bp, Artificial Sequence
  Synthetic oligonucleotide; TAGAAT chr11 5238481 5238500 5238484 -
aaacagcagtgaactgagat

SEQ ID NO: 63026 - DNA, 20 bp, Artificial Sequence
  Synthetic oligonucleotide; AAGAAT chr11 5238455 5238474 5238458 -
tgtggagagcactggcattt

SEQ ID NO: 63027 - DNA, 20 bp, Artificial Sequence
  Synthetic oligonucleotide; TAGAAT chr11 5238441 5238460 5238444 -
gcatttaagaatgtcacact

SEQ ID NO: 63028 - DNA, 20 bp, Artificial Sequence
  Synthetic oligonucleotide; ATGAAT chr11 5238378 5238397 5238381 -
atattcattatctgaaaatt

SEQ ID NO: 63029 - DNA, 20 bp, Artificial Sequence
  Synthetic oligonucleotide; TGGAGT chr11 5238280 5238299 5238283 -
attgctatggttgcccaggc

SEQ ID NO: 63030 - DNA, 20 bp, Artificial Sequence
  Synthetic oligonucleotide; GGGGGT chr11 5238137 5238156 5238140 -
ttttctatttttagtagata

SEQ ID NO: 63031 - DNA, 20 bp, Artificial Sequence
  Synthetic oligonucleotide; TGGGAT chr11 5238058 5238077 5238061 -
tcctcggcctctgaaagtgc

SEQ ID NO: 63032 - DNA, 20 bp, Artificial Sequence
  Synthetic oligonucleotide; AAGAAT chr11 5238025 5238044 5238028 -
gtgagccaccacacccagcc

SEQ ID NO: 63033 - DNA, 20 bp, Artificial Sequence
  Synthetic oligonucleotide; GTGAAT chr11 5238019 5238038 5238022 -
caccacacccagccaagaat

SEQ ID NO: 63034 - DNA, 20 bp, Artificial Sequence
  Synthetic oligonucleotide; AAGGAT chr11 5238006 5238025 5238009 -
caagaatgtgaattttgtag

SEQ ID NO: 63035 - DNA, 20 bp, Artificial Sequence
  Synthetic oligonucleotide; TAGAGT chr11 5237978 5237997 5237981 -
aacccatatttctctgaccc

SEQ ID NO: 63036 - DNA, 20 bp, Artificial Sequence
  Synthetic oligonucleotide; CTGAGT chr11 5237778 5237797 5237781 -
tacactaattaaaatcgata

SEQ ID NO: 63037 - DNA, 20 bp, Artificial Sequence
  Synthetic oligonucleotide; GGGGAT chr11 5237760 5237779 5237763 -
tactgagttctaaaatcatc

SEQ ID NO: 63038 - DNA, 20 bp, Artificial Sequence
  Synthetic oligonucleotide; TTGGAT chr11 5237656 5237675 5237659 -
actttgtattcatcacactc

SEQ ID NO: 63039 - DNA, 20 bp, Artificial Sequence
  Synthetic oligonucleotide; ATGGGT chr11 5237493 5237512 5237496 -
ataggcacctcagactcagc

SEQ ID NO: 63040 - DNA, 20 bp, Artificial Sequence
  Synthetic oligonucleotide; AAGAGT chr11 5237288 5237307 5237291 -
gtcctcattgtttcctgaac

SEQ ID NO: 63041 - DNA, 20 bp, Artificial Sequence
  Synthetic oligonucleotide; CTGGAT chr11 5237246 5237265 5237249 -
acttttagaccttatcctgg

SEQ ID NO: 63042 - DNA, 20 bp, Artificial Sequence
  Synthetic oligonucleotide; AGGAGT chr11 5237176 5237195 5237179 -
caggcagatcacttgaggtc

SEQ ID NO: 63043 - DNA, 20 bp, Artificial Sequence
  Synthetic oligonucleotide; GAGAAT chr11 5237060 5237079 5237063 -
tattcaggtggctgaggcag

SEQ ID NO: 63044 - DNA, 20 bp, Artificial Sequence
  Synthetic oligonucleotide; AGGGAT chr11 5236986 5237005 5236989 -
tgcactctagcttgggcaat

SEQ ID NO: 63045 - DNA, 20 bp, Artificial Sequence
  Synthetic oligonucleotide; TAGAAT chr11 5236907 5236926 5236910 -
tcctctcaatgcaatccata

SEQ ID NO: 63046 - DNA, 20 bp, Artificial Sequence
  Synthetic oligonucleotide; CAGAAT chr11 5236854 5236873 5236857 -
taaaatcatttcaggtagaa

SEQ ID NO: 63047 - DNA, 20 bp, Artificial Sequence
  Synthetic oligonucleotide; TGGAAT chr11 5236827 5236846 5236830 -
aaagtgaaaagccaagtctt

SEQ ID NO: 63048 - DNA, 20 bp, Artificial Sequence
  Synthetic oligonucleotide; AAGAAT chr11 5236784 5236803 5236787 -
ataacagtcctcatggcctt

SEQ ID NO: 63049 - DNA, 20 bp, Artificial Sequence
  Synthetic oligonucleotide; TAGAAT chr11 5236761 5236780 5236764 -
aatttacctaacattttttt

SEQ ID NO: 63050 - DNA, 20 bp, Artificial Sequence
  Synthetic oligonucleotide; ATGAAT chr11 5236741 5236760 5236744 -
tagaatcaattttcttatat

SEQ ID NO: 63051 - DNA, 20 bp, Artificial Sequence
  Synthetic oligonucleotide; AAGAGT chr11 5236519 5236538 5236522 -
tacatctttttgcattttac

SEQ ID NO: 63052 - DNA, 20 bp, Artificial Sequence
  Synthetic oligonucleotide; GAGAAT chr11 5236298 5236317 5236301 -
aatacatttcttcactaagt

SEQ ID NO: 63053 - DNA, 20 bp, Artificial Sequence
  Synthetic oligonucleotide; TTGAAT chr11 5236251 5236270 5236254 -
aaaccatgccaccacctttc

SEQ ID NO: 63054 - DNA, 20 bp, Artificial Sequence
  Synthetic oligonucleotide; CAGAAT chr11 5236134 5236153 5236137 -
ataacatttccccttgtgat

SEQ ID NO: 63055 - DNA, 20 bp, Artificial Sequence
  Synthetic oligonucleotide; TTGGAT chr11 5235864 5235883 5235867 -
aagcatttctatacatgtct

SEQ ID NO: 63056 - DNA, 20 bp, Artificial Sequence
  Synthetic oligonucleotide; CTGAAT chr11 5235840 5235859 5235843 -
atacacacatgcatgtgttt

SEQ ID NO: 63057 - DNA, 20 bp, Artificial Sequence
  Synthetic oligonucleotide; GTGGAT chr11 5235784 5235803 5235787 -
ttatcaagcatccagcattt

SEQ ID NO: 63058 - DNA, 20 bp, Artificial Sequence
  Synthetic oligonucleotide; AGGGGT chr11 5235759 5235778 5235762 -
tactattaaaggttttccaa

SEQ ID NO: 63059 - DNA, 20 bp, Artificial Sequence
  Synthetic oligonucleotide; CAGAGT chr11 5235729 5235748 5235732 -
ctattgtacagtgtcaccaa

SEQ ID NO: 63060 - DNA, 20 bp, Artificial Sequence
  Synthetic oligonucleotide; TTGAGT chr11 5235723 5235742 5235726 -
tacagtgtcaccaacagagt

SEQ ID NO: 63061 - DNA, 20 bp, Artificial Sequence
  Synthetic oligonucleotide; TTGGAT chr11 5235404 5235423 5235407 -
ctttccttcaatccttcctt

SEQ ID NO: 63062 - DNA, 20 bp, Artificial Sequence
  Synthetic oligonucleotide; ATGGGT chr11 5235392 5235411 5235395 -
ccttccttttggatatgctc

SEQ ID NO: 63063 - DNA, 20 bp, Artificial Sequence
  Synthetic oligonucleotide; TTGAAT chr11 5235358 5235377 5235361 -
gtctgccattgtggcattat

SEQ ID NO: 63064 - DNA, 20 bp, Artificial Sequence
  Synthetic oligonucleotide; AAGAGT chr11 5235346 5235365 5235349 -
ggcattatttgaattcagaa

SEQ ID NO: 63065 - DNA, 20 bp, Artificial Sequence
  Synthetic oligonucleotide; TGGGAT chr11 5235330 5235349 5235333 -
agaaaagagtgaaaaactac

SEQ ID NO: 63066 - DNA, 20 bp, Artificial Sequence
  Synthetic oligonucleotide; CTGGGT chr11 5235316 5235335 5235319 -
aactactgggatcttcattc

SEQ ID NO: 63067 - DNA, 20 bp, Artificial Sequence
  Synthetic oligonucleotide; CTGAAT chr11 5235224 5235243 5235227 -
cttcgttaaatttaatctgg

SEQ ID NO: 63068 - DNA, 20 bp, Artificial Sequence
  Synthetic oligonucleotide; ATGGAT chr11 5235033 5235052 5235036 -
attttttaaatattctttta

SEQ ID NO: 63069 - DNA, 20 bp, Artificial Sequence
  Synthetic oligonucleotide; TAGAGT chr11 5235003 5235022 5235006 -
atttcaatataataaaaaat

SEQ ID NO: 63070 - DNA, 20 bp, Artificial Sequence
  Synthetic oligonucleotide; AAGAAT chr11 5234986 5235005 5234989 -
aattagagttttattatagg

SEQ ID NO: 63071 - DNA, 20 bp, Artificial Sequence
  Synthetic oligonucleotide; TTGAGT chr11 5234864 5234883 5234867 -
aggcaaagaagaactttata

SEQ ID NO: 63072 - DNA, 20 bp, Artificial Sequence
  Synthetic oligonucleotide; GAGGAT chr11 5234733 5234752 5234736 -
ttctgcaaaaatgaaactag

SEQ ID NO: 63073 - DNA, 20 bp, Artificial Sequence
  Synthetic oligonucleotide; CAGGGT chr11 5234673 5234692 5234676 -
gggagatatgtagaggagaa

SEQ ID NO: 63074 - DNA, 20 bp, Artificial Sequence
  Synthetic oligonucleotide; CTGAGT chr11 5234665 5234684 5234668 -
tgtagaggagaacagggttt

SEQ ID NO: 63075 - DNA, 20 bp, Artificial Sequence
  Synthetic oligonucleotide; GGGAAT chr11 5234617 5234636 5234620 -
ccaatctcagggcaagttaa

SEQ ID NO: 63076 - DNA, 20 bp, Artificial Sequence
  Synthetic oligonucleotide; TGGAAT chr11 5234609 5234628 5234612 -
agggcaagttaagggaatag

SEQ ID NO: 63077 - DNA, 20 bp, Artificial Sequence
  Synthetic oligonucleotide; CAGAGT chr11 5234502 5234521 5234505 -
gaccagcataaaaggcaggg

SEQ ID NO: 63078 - DNA, 20 bp, Artificial Sequence
  Synthetic oligonucleotide; GTGGAT chr11 5234374 5234393 5234377 -
ccctgtggggcaaagtgaac

SEQ ID NO: 63079 - DNA, 20 bp, Artificial Sequence
  Synthetic oligonucleotide; TTGGGT chr11 5234270 5234289 5234273 -
tgtgtagacagagaagactc

SEQ ID NO: 63080 - DNA, 20 bp, Artificial Sequence
  Synthetic oligonucleotide; TTGAGT chr11 5234179 5234198 5234182 -
cccttggacccagaggttct

SEQ ID NO: 63081 - DNA, 20 bp, Artificial Sequence
  Synthetic oligonucleotide; GGGGAT chr11 5234168 5234187 5234171 -
agaggttctttgagtccttt

SEQ ID NO: 63082 - DNA, 20 bp, Artificial Sequence
  Synthetic oligonucleotide; CTGAGT chr11 5234042 5234061 5234045 -
tcaagggcactttttctcag

SEQ ID NO: 63083 - DNA, 20 bp, Artificial Sequence
  Synthetic oligonucleotide; GTGGAT chr11 5234012 5234031 5234015 -
tgcactgtgacaagctgcac

SEQ ID NO: 63084 - DNA, 20 bp, Artificial Sequence
  Synthetic oligonucleotide; CAGGGT chr11 5233995 5234014 5233998 -
cacgtggatcctgagaactt

SEQ ID NO: 63085 - DNA, 20 bp, Artificial Sequence
  Synthetic oligonucleotide; GTGAGT chr11 5233991 5234010 5233994 -
tggatcctgagaacttcagg

SEQ ID NO: 63086 - DNA, 20 bp, Artificial Sequence
  Synthetic oligonucleotide; TAGAAT chr11 5233694 5233713 5233697 -
tcacctgctaattctgcact

SEQ ID NO: 63087 - DNA, 20 bp, Artificial Sequence
  Synthetic oligonucleotide; ATGGGT chr11 5233669 5233688 5233672 -
taatccttttgtctctccac

SEQ ID NO: 63088 - DNA, 20 bp, Artificial Sequence
  Synthetic oligonucleotide; TAGAAT chr11 5233630 5233649 5233633 -
caactcaaagatgagaggca

SEQ ID NO: 63089 - DNA, 20 bp, Artificial Sequence
  Synthetic oligonucleotide; AGGAAT chr11 5233591 5233610 5233594 -
ctataaatcattttacaata

SEQ ID NO: 63090 - DNA, 20 bp, Artificial Sequence
  Synthetic oligonucleotide; TGGAAT chr11 5233582 5233601 5233585 -
attttacaataaggaataat

SEQ ID NO: 63091 - DNA, 20 bp, Artificial Sequence
  Synthetic oligonucleotide; TGGAAT chr11 5233556 5233575 5233559 -
tttataaattctgtagtaaa

SEQ ID NO: 63092 - DNA, 20 bp, Artificial Sequence
  Synthetic oligonucleotide; GTGAAT chr11 5233540 5233559 5233543 -
taaatggaatggaaaggaaa

SEQ ID NO: 63093 - DNA, 20 bp, Artificial Sequence
  Synthetic oligonucleotide; TGGAAT chr11 5233370 5233389 5233373 -
atacaaaattaaaactaatt

SEQ ID NO: 63094 - DNA, 20 bp, Artificial Sequence
  Synthetic oligonucleotide; GAGGAT chr11 5233289 5233308 5233292 -
acatgctagttaagtacata

SEQ ID NO: 63095 - DNA, 20 bp, Artificial Sequence
  Synthetic oligonucleotide; GGGAAT chr11 5233224 5233243 5233227 -
atgtacttatttatgctgat

SEQ ID NO: 63096 - DNA, 20 bp, Artificial Sequence
  Synthetic oligonucleotide; GGGGAT chr11 5233213 5233232 5233216 -
tatgctgatgggaataacct

SEQ ID NO: 63097 - DNA, 20 bp, Artificial Sequence
  Synthetic oligonucleotide; ATGGGT chr11 5233177 5233196 5233180 -
taagatttgggcagaaaaaa

SEQ ID NO: 63098 - DNA, 20 bp, Artificial Sequence
  Synthetic oligonucleotide; AGGAAT chr11 5233047 5233066 5233050 -
gctggcccgcaactttggca

SEQ ID NO: 63099 - DNA, 20 bp, Artificial Sequence
  Synthetic oligonucleotide; AAGGGT chr11 5232878 5232897 5232881 -
gggaacacaatgcctacttc

SEQ ID NO: 63100 - DNA, 20 bp, Artificial Sequence
  Synthetic oligonucleotide; AAGAAT chr11 5232855 5232874 5232858 -
ggtatggcttctgcctaata

SEQ ID NO: 63101 - DNA, 20 bp, Artificial Sequence
  Synthetic oligonucleotide; AAGAGT chr11 5232744 5232763 5232747 -
gagcacttgtttattttaca

SEQ ID NO: 63102 - DNA, 20 bp, Artificial Sequence
  Synthetic oligonucleotide; ATGGGT chr11 5232696 5232715 5232699 -
gggaaccgtacaaggcatta

SEQ ID NO: 63103 - DNA, 20 bp, Artificial Sequence
  Synthetic oligonucleotide; AAGGGT chr11 5232583 5232602 5232586 -
caaccctaagacatagcctc

SEQ ID NO: 63104 - DNA, 20 bp, Artificial Sequence
  Synthetic oligonucleotide; AAGAAT chr11 5232376 5232395 5232379 -
tgccccagaacatctctgta

SEQ ID NO: 63105 - DNA, 20 bp, Artificial Sequence
  Synthetic oligonucleotide; GTGAAT chr11 5232083 5232102 5232086 -
aatatttattcaagaaaaca

SEQ ID NO: 63106 - DNA, 20 bp, Artificial Sequence
  Synthetic oligonucleotide; ATGAAT chr11 5232079 5232098 5232082 -
tttattcaagaaaacagtga

SEQ ID NO: 63107 - DNA, 20 bp, Artificial Sequence
  Synthetic oligonucleotide; ACGAAT chr11 5232071 5232090 5232074 -
agaaaacagtgaatgaatga

SEQ ID NO: 63108 - DNA, 20 bp, Artificial Sequence
  Synthetic oligonucleotide; ATGAGT chr11 5232067 5232086 5232070 -
aacagtgaatgaatgaacga

SEQ ID NO: 63109 - DNA, 20 bp, Artificial Sequence
  Synthetic oligonucleotide; ATGAGT chr11 5232059 5232078 5232062 -
atgaatgaacgaatgagtaa

SEQ ID NO: 63110 - DNA, 20 bp, Artificial Sequence
  Synthetic oligonucleotide; AGGAAT chr11 5232047 5232066 5232050 -
atgagtaaatgagtaaatga

SEQ ID NO: 63111 - DNA, 20 bp, Artificial Sequence
  Synthetic oligonucleotide; TGGAAT chr11 5232017 5232036 5232020 -
attccttgctttagaacttc

SEQ ID NO: 63112 - DNA, 20 bp, Artificial Sequence
  Synthetic oligonucleotide; AGGAGT chr11 5231898 5231917 5231901 -
gttatttcctttctgatcat

SEQ ID NO: 63113 - DNA, 20 bp, Artificial Sequence
  Synthetic oligonucleotide; AAGGAT chr11 5231847 5231866 5231850 -
tttgccataggtaaaattag

SEQ ID NO: 63114 - DNA, 20 bp, Artificial Sequence
  Synthetic oligonucleotide; TTGAAT chr11 5231768 5231787 5231771 -
ttgattaattttaaacttac

SEQ ID NO: 63115 - DNA, 20 bp, Artificial Sequence
  Synthetic oligonucleotide; CAGAAT chr11 5231755 5231774 5231758 -
aacttacttgaatacctaaa

SEQ ID NO: 63116 - DNA, 20 bp, Artificial Sequence
  Synthetic oligonucleotide; CAGAAT chr11 5231696 5231715 5231699 -
agtaactctgtctgtactgc

SEQ ID NO: 63117 - DNA, 20 bp, Artificial Sequence
  Synthetic oligonucleotide; TTGAAT chr11 5231647 5231666 5231650 -
actgttttgatcacaacatt

SEQ ID NO: 63118 - DNA, 20 bp, Artificial Sequence
  Synthetic oligonucleotide; CTGAAT chr11 5231560 5231579 5231563 -
gcactgagaactctttatat

SEQ ID NO: 63119 - DNA, 20 bp, Artificial Sequence
  Synthetic oligonucleotide; AAGAGT chr11 5231453 5231472 5231456 -
gagcatagggaagttctcat

SEQ ID NO: 63120 - DNA, 20 bp, Artificial Sequence
  Synthetic oligonucleotide; GTGAGT chr11 5231278 5231297 5231281 -
tacaccattagaagtagtca

SEQ ID NO: 63121 - DNA, 20 bp, Artificial Sequence
  Synthetic oligonucleotide; GAGAAT chr11 5231236 5231255 5231239 -
ccctaaaaatccaaatacca

SEQ ID NO: 63122 - DNA, 20 bp, Artificial Sequence
  Synthetic oligonucleotide; CTGGAT chr11 5231215 5231234 5231218 -
agaattcatgagaacatcac

SEQ ID NO: 63123 - DNA, 20 bp, Artificial Sequence
  Synthetic oligonucleotide; TAGAGT chr11 5231087 5231106 5231090 -
gttatattaaaattatttgt

SEQ ID NO: 63124 - DNA, 20 bp, Artificial Sequence
  Synthetic oligonucleotide; AAGAGT chr11 5231070 5231089 5231073 -
tgttagagtagagcttttgt

SEQ ID NO: 63125 - DNA, 20 bp, Artificial Sequence
  Synthetic oligonucleotide; AGGAGT chr11 5231062 5231081 5231065 -
tagagcttttgtaagagtct

SEQ ID NO: 63126 - DNA, 20 bp, Artificial Sequence
  Synthetic oligonucleotide; GAGGGT chr11 5230992 5231011 5230995 -
acagacacccaggcctactt

SEQ ID NO: 63127 - DNA, 20 bp, Artificial Sequence
  Synthetic oligonucleotide; GAGGGT chr11 5230985 5231004 5230988 -
cccaggcctacttgagggtt

SEQ ID NO: 63128 - DNA, 20 bp, Artificial Sequence
  Synthetic oligonucleotide; TTGGGT chr11 5230949 5230968 5230952 -
agacgatgaaaaagaaccta

SEQ ID NO: 63129 - DNA, 20 bp, Artificial Sequence
  Synthetic oligonucleotide; CTGAGT chr11 5230930 5230949 5230933 -
attgggtattaagttcatca

SEQ ID NO: 63130 - DNA, 20 bp, Artificial Sequence
  Synthetic oligonucleotide; AGGAAT chr11 5230825 5230844 5230828 -
tgaaagttaaaacaaagtat

SEQ ID NO: 63131 - DNA, 20 bp, Artificial Sequence
  Synthetic oligonucleotide; TGGAAT chr11 5230820 5230839 5230823 -
gttaaaacaaagtataggaa

SEQ ID NO: 63132 - DNA, 20 bp, Artificial Sequence
  Synthetic oligonucleotide; CTGAAT chr11 5230713 5230732 5230716 -
ataaactatgttcagtatgt

SEQ ID NO: 63133 - DNA, 20 bp, Artificial Sequence
  Synthetic oligonucleotide; AAGGGT chr11 5230705 5230724 5230708 -
tgttcagtatgtctgaatga

SEQ ID NO: 63134 - DNA, 20 bp, Artificial Sequence
  Synthetic oligonucleotide; GTGAAT chr11 5230646 5230665 5230649 -
ggaagagaggacgtaataat

SEQ ID NO: 63135 - DNA, 20 bp, Artificial Sequence
  Synthetic oligonucleotide; TTGAGT chr11 5230640 5230659 5230643 -
gaggacgtaataatgtgaat

SEQ ID NO: 63136 - DNA, 20 bp, Artificial Sequence
  Synthetic oligonucleotide; GAGAAT chr11 5230598 5230617 5230601 -
ataaaataatttaatgtcag

SEQ ID NO: 63137 - DNA, 20 bp, Artificial Sequence
  Synthetic oligonucleotide; CTGAAT chr11 5230540 5230559 5230543 -
ttgagcttcagagcagtcct

SEQ ID NO: 63138 - DNA, 20 bp, Artificial Sequence
  Synthetic oligonucleotide; AAGGGT chr11 5230515 5230534 5230518 -
ttaatgcctacatgtttgta

SEQ ID NO: 63139 - DNA, 20 bp, Artificial Sequence
  Synthetic oligonucleotide; CTGAAT chr11 5230384 5230403 5230387 -
aggttaaaaaaaagctaatt

SEQ ID NO: 63140 - DNA, 20 bp, Artificial Sequence
  Synthetic oligonucleotide; ATGGGT chr11 5230178 5230197 5230181 -
tgtgtgtgcggtttgtttct

SEQ ID NO: 63141 - DNA, 20 bp, Artificial Sequence
  Synthetic oligonucleotide; CTGAGT chr11 5230117 5230136 5230120 -
ttaattaattctgagagctg

SEQ ID NO: 63142 - DNA, 20 bp, Artificial Sequence
  Synthetic oligonucleotide; GGGAAT chr11 5230005 5230024 5230008 -
ttgctaaaatgtctcacttg

SEQ ID NO: 63143 - DNA, 20 bp, Artificial Sequence
  Synthetic oligonucleotide; ATGAGT chr11 5229915 5229934 5229918 -
ataaaaccacactcccatag

SEQ ID NO: 63144 - DNA, 20 bp, Artificial Sequence
  Synthetic oligonucleotide; TGGAGT chr11 5229808 5229827 5229811 -
cttaagaaagattaatagac

SEQ ID NO: 63145 - DNA, 20 bp, Artificial Sequence
  Synthetic oligonucleotide; TGGAAT chr11 5229705 5229724 5229708 -
tgtgttgtggtcagtggggc

SEQ ID NO: 63146 - DNA, 20 bp, Artificial Sequence
  Synthetic oligonucleotide; TAGAAT chr11 5229694 5229713 5229697 -
cagtggggctggaataaaag

SEQ ID NO: 63147 - DNA, 20 bp, Artificial Sequence
  Synthetic oligonucleotide; CAGAGT chr11 5229659 5229678 5229662 -
cctgctgtggcatccattca

SEQ ID NO: 63148 - DNA, 20 bp, Artificial Sequence
  Synthetic oligonucleotide; TTGAAT chr11 5229617 5229636 5229620 -
tagtgaagatgtcagtaagc

SEQ ID NO: 63149 - DNA, 20 bp, Artificial Sequence
  Synthetic oligonucleotide; TTGAAT chr11 5229596 5229615 5229599 -
tgaatagtttttcaggaact

SEQ ID NO: 63150 - DNA, 20 bp, Artificial Sequence
  Synthetic oligonucleotide; CAGGGT chr11 5229461 5229480 5229464 -
agcttgcagccttgtccctg

SEQ ID NO: 63151 - DNA, 20 bp, Artificial Sequence
  Synthetic oligonucleotide; ATGGGT chr11 5229452 5229471 5229455 -
ccttgtccctgcagggtatt

SEQ ID NO: 63152 - DNA, 20 bp, Artificial Sequence
  Synthetic oligonucleotide; CAGGAT chr11 5229369 5229388 5229372 -
agcaacccctgccttgaagc

SEQ ID NO: 63153 - DNA, 20 bp, Artificial Sequence
  Synthetic oligonucleotide; AAGGAT chr11 5229331 5229350 5229334 -
agcagttgccaacacaagag

SEQ ID NO: 63154 - DNA, 20 bp, Artificial Sequence
  Synthetic oligonucleotide; TAGGGT chr11 5229256 5229275 5229259 -
tttctgagcataagaagttg

SEQ ID NO: 63155 - DNA, 20 bp, Artificial Sequence
  Synthetic oligonucleotide; CAGGAT chr11 5229218 5229237 5229221 -
aggtgacaatttctgccaat

SEQ ID NO: 63156 - DNA, 20 bp, Artificial Sequence
  Synthetic oligonucleotide; CAGAAT chr11 5229179 5229198 5229182 -
ctttgacaattttggtcttt

SEQ ID NO: 63157 - DNA, 20 bp, Artificial Sequence
  Synthetic oligonucleotide; CAGGAT chr11 5229118 5229137 5229121 -
tctgtgcattttctttgacc

SEQ ID NO: 63158 - DNA, 20 bp, Artificial Sequence
  Synthetic oligonucleotide; AGGGAT chr11 5229046 5229065 5229049 -
atatacatgcctcttatatc

SEQ ID NO: 63159 - DNA, 20 bp, Artificial Sequence
  Synthetic oligonucleotide; CAGGGT chr11 5229034 5229053 5229037 -
cttatatcagggatgtgaaa

SEQ ID NO: 63160 - DNA, 20 bp, Artificial Sequence
  Synthetic oligonucleotide; CAGGAT chr11 5228899 5228918 5228902 -
attttaaagacgtcttttcc

SEQ ID NO: 63161 - DNA, 20 bp, Artificial Sequence
  Synthetic oligonucleotide; AGGGAT chr11 5228871 5228890 5228874 -
aacatgtgaaatcttttctc

SEQ ID NO: 63162 - DNA, 20 bp, Artificial Sequence
  Synthetic oligonucleotide; AGGAAT chr11 5228825 5228844 5228828 -
attgctttagttttttacag

SEQ ID NO: 63163 - DNA, 20 bp, Artificial Sequence
  Synthetic oligonucleotide; ATGAAT chr11 5228821 5228840 5228824 -
ctttagttttttacagagga

SEQ ID NO: 63164 - DNA, 20 bp, Artificial Sequence
  Synthetic oligonucleotide; GAGAAT chr11 5228700 5228719 5228703 -
caaacactttctgcgtgtgt

SEQ ID NO: 63165 - DNA, 20 bp, Artificial Sequence
  Synthetic oligonucleotide; CAGAGT chr11 5228691 5228710 5228694 -
tctgcgtgtgtgagaataat

SEQ ID NO: 63166 - DNA, 20 bp, Artificial Sequence
  Synthetic oligonucleotide; GAGGGT chr11 5228661 5228680 5228664 -
ttttttcacaagtacctgat

SEQ ID NO: 63167 - DNA, 20 bp, Artificial Sequence
  Synthetic oligonucleotide; GAGAAT chr11 5228593 5228612 5228596 -
ataatagagaaagcatttaa

SEQ ID NO: 63168 - DNA, 20 bp, Artificial Sequence
  Synthetic oligonucleotide; GAGGAT chr11 5228536 5228555 5228539 -
ccttctgataactagaaata

SEQ ID NO: 63169 - DNA, 20 bp, Artificial Sequence
  Synthetic oligonucleotide; CAGAGT chr11 5228444 5228463 5228447 -
attttgtgtaatcgtagttt

SEQ ID NO: 63170 - DNA, 20 bp, Artificial Sequence
  Synthetic oligonucleotide; ATGGGT chr11 5228367 5228386 5228370 -
actttccttactaaaccgac

SEQ ID NO: 63171 - DNA, 20 bp, Artificial Sequence
  Synthetic oligonucleotide; CAGGAT chr11 5228348 5228367 5228351 -
catgggtttccaggtagggg

SEQ ID NO: 63172 - DNA, 20 bp, Artificial Sequence
  Synthetic oligonucleotide; CAGGAT chr11 5228341 5228360 5228344 -
ttccaggtaggggcaggatt

SEQ ID NO: 63173 - DNA, 20 bp, Artificial Sequence
  Synthetic oligonucleotide; AGGAGT chr11 5228203 5228222 5228206 -
caaaagtttttcctcacctg

SEQ ID NO: 63174 - DNA, 20 bp, Artificial Sequence
  Synthetic oligonucleotide; GGGGAT chr11 5228169 5228188 5228172 -
tacaaggggaaaaagtacag

SEQ ID NO: 63175 - DNA, 20 bp, Artificial Sequence
  Synthetic oligonucleotide; AAGAGT chr11 5228125 5228144 5228128 -
ttgggaagctatagagaaag

SEQ ID NO: 63176 - DNA, 20 bp, Artificial Sequence
  Synthetic oligonucleotide; TTGAAT chr11 5228067 5228086 5228070 -
atataaagagaaataggaac

SEQ ID NO: 63177 - DNA, 20 bp, Artificial Sequence
  Synthetic oligonucleotide; TTGGGT chr11 5227841 5227860 5227844 -
accccattgatagtcacact

SEQ ID NO: 63178 - DNA, 20 bp, Artificial Sequence
  Synthetic oligonucleotide; ATGAAT chr11 5227656 5227675 5227659 -
attaagaaaaacaacaacaa

SEQ ID NO: 63179 - DNA, 20 bp, Artificial Sequence
  Synthetic oligonucleotide; TAGAGT chr11 5227536 5227555 5227539 -
agatatgcttagaaccgagg

SEQ ID NO: 63180 - DNA, 20 bp, Artificial Sequence
  Synthetic oligonucleotide; CTGAAT chr11 5227455 5227474 5227458 -
tccatctacatatcccaaag

SEQ ID NO: 63181 - DNA, 20 bp, Artificial Sequence
  Synthetic oligonucleotide; GAGGAT chr11 5227319 5227338 5227322 -
acgtaaatacacttgcaaag

SEQ ID NO: 63182 - DNA, 20 bp, Artificial Sequence
  Synthetic oligonucleotide; GAGGGT chr11 5227251 5227270 5227254 -
tatatcttagagggagggct

SEQ ID NO: 63183 - DNA, 20 bp, Artificial Sequence
  Synthetic oligonucleotide; TAGGGT chr11 5227157 5227176 5227160 -
caccctgtggagccacaccc

SEQ ID NO: 63184 - DNA, 20 bp, Artificial Sequence
  Synthetic oligonucleotide; GTGGAT chr11 5226962 5226981 5226965 -
ccctgtggggcaaggtgaac

SEQ ID NO: 63185 - DNA, 20 bp, Artificial Sequence
  Synthetic oligonucleotide; TTGGGT chr11 5226858 5226877 5226861 -
tgtggagacagagaagactc

SEQ ID NO: 63186 - DNA, 20 bp, Artificial Sequence
  Synthetic oligonucleotide; TTGAGT chr11 5226765 5226784 5226768 -
cccttggacccagaggttct

SEQ ID NO: 63187 - DNA, 20 bp, Artificial Sequence
  Synthetic oligonucleotide; GGGGAT chr11 5226754 5226773 5226757 -
agaggttctttgagtccttt

SEQ ID NO: 63188 - DNA, 20 bp, Artificial Sequence
  Synthetic oligonucleotide; CTGAGT chr11 5226628 5226647 5226631 -
tcaagggcacctttgccaca

SEQ ID NO: 63189 - DNA, 20 bp, Artificial Sequence
  Synthetic oligonucleotide; GTGGAT chr11 5226598 5226617 5226601 -
tgcactgtgacaagctgcac

SEQ ID NO: 63190 - DNA, 20 bp, Artificial Sequence
  Synthetic oligonucleotide; CAGGGT chr11 5226581 5226600 5226584 -
cacgtggatcctgagaactt

SEQ ID NO: 63191 - DNA, 20 bp, Artificial Sequence
  Synthetic oligonucleotide; GTGAGT chr11 5226577 5226596 5226580 -
tggatcctgagaacttcagg

SEQ ID NO: 63192 - DNA, 20 bp, Artificial Sequence
  Synthetic oligonucleotide; GGGGAT chr11 5226509 5226528 5226512 -
ttaagttcatgtcataggaa

SEQ ID NO: 63193 - DNA, 20 bp, Artificial Sequence
  Synthetic oligonucleotide; CAGGGT chr11 5226497 5226516 5226500 -
cataggaaggggataagtaa

SEQ ID NO: 63194 - DNA, 20 bp, Artificial Sequence
  Synthetic oligonucleotide; TAGAAT chr11 5226485 5226504 5226488 -
ataagtaacagggtacagtt

SEQ ID NO: 63195 - DNA, 20 bp, Artificial Sequence
  Synthetic oligonucleotide; ACGAAT chr11 5226470 5226489 5226473 -
cagtttagaatgggaaacag

SEQ ID NO: 63196 - DNA, 20 bp, Artificial Sequence
  Synthetic oligonucleotide; CAGGAT chr11 5226442 5226461 5226445 -
ttgcatcagtgtggaagtct

SEQ ID NO: 63197 - DNA, 20 bp, Artificial Sequence
  Synthetic oligonucleotide; TGGAAT chr11 5226238 5226257 5226241 -
ctgcctagtacattactatt

SEQ ID NO: 63198 - DNA, 20 bp, Artificial Sequence
  Synthetic oligonucleotide; ATGGGT chr11 5226148 5226167 5226151 -
cataatcattatacatattt

SEQ ID NO: 63199 - DNA, 20 bp, Artificial Sequence
  Synthetic oligonucleotide; CAGGGT chr11 5226100 5226119 5226103 -
tgtacacatattgaccaaat

SEQ ID NO: 63200 - DNA, 20 bp, Artificial Sequence
  Synthetic oligonucleotide; AAGAAT chr11 5225955 5225974 5225958 -
tgcctctttgcaccattcta

SEQ ID NO: 63201 - DNA, 20 bp, Artificial Sequence
  Synthetic oligonucleotide; CTGGGT chr11 5225935 5225954 5225938 -
aagaataacagtgataattt

SEQ ID NO: 63202 - DNA, 20 bp, Artificial Sequence
  Synthetic oligonucleotide; TGGGAT chr11 5225807 5225826 5225810 -
ttctgcttttattttatggt

SEQ ID NO: 63203 - DNA, 20 bp, Artificial Sequence
  Synthetic oligonucleotide; CTGGAT chr11 5225797 5225816 5225800 -
attttatggttgggataagg

SEQ ID NO: 63204 - DNA, 20 bp, Artificial Sequence
  Synthetic oligonucleotide; CTGAGT chr11 5225787 5225806 5225790 -
tgggataaggctggattatt

SEQ ID NO: 63205 - DNA, 20 bp, Artificial Sequence
  Synthetic oligonucleotide; AAGAAT chr11 5225681 5225700 5225684 -
gctggcccatcactttggca

SEQ ID NO: 63206 - DNA, 20 bp, Artificial Sequence
  Synthetic oligonucleotide; GGGGAT chr11 5225531 5225550 5225534 -
taagtccaactactaaactg

SEQ ID NO: 63207 - DNA, 20 bp, Artificial Sequence
  Synthetic oligonucleotide; CTGGAT chr11 5225504 5225523 5225507 -
ttatgaagggccttgagcat

SEQ ID NO: 63208 - DNA, 20 bp, Artificial Sequence
  Synthetic oligonucleotide; CTGAAT chr11 5225445 5225464 5225448 -
atgatgtatttaaattattt

SEQ ID NO: 63209 - DNA, 20 bp, Artificial Sequence
  Synthetic oligonucleotide; GGGAAT chr11 5225426 5225445 5225429 -
tctgaatattttactaaaaa

SEQ ID NO: 63210 - DNA, 20 bp, Artificial Sequence
  Synthetic oligonucleotide; AAGGAT chr11 5225259 5225278 5225262 -
gccttattcatccctcagaa

SEQ ID NO: 63211 - DNA, 20 bp, Artificial Sequence
  Synthetic oligonucleotide; ATGAAT chr11 5225177 5225196 5225180 -
ttattgttttagctgtcctc

SEQ ID NO: 63212 - DNA, 20 bp, Artificial Sequence
  Synthetic oligonucleotide; AGGGGT chr11 5224979 5224998 5224982 -
ctacttgaagaaggaaaaac

SEQ ID NO: 63213 - DNA, 20 bp, Artificial Sequence
  Synthetic oligonucleotide; CGGAAT chr11 5224917 5224936 5224920 -
ctcccccactcacagtgacc

SEQ ID NO: 63214 - DNA, 20 bp, Artificial Sequence
  Synthetic oligonucleotide; AAGAAT chr11 5224827 5224846 5224830 -
tatgaaaagttaggactgag

SEQ ID NO: 63215 - DNA, 20 bp, Artificial Sequence
  Synthetic oligonucleotide; CAGGAT chr11 5224733 5224752 5224736 -
atggaagtcccattcttcct

SEQ ID NO: 63216 - DNA, 20 bp, Artificial Sequence
  Synthetic oligonucleotide; ATGAGT chr11 5224556 5224575 5224559 -
ctagattctggaaataaaat

SEQ ID NO: 63217 - DNA, 20 bp, Artificial Sequence
  Synthetic oligonucleotide; CTGAAT chr11 5224515 5224534 5224518 -
tcctctctcccagtcaaatt

SEQ ID NO: 63218 - DNA, 20 bp, Artificial Sequence
  Synthetic oligonucleotide; AAGGGT chr11 5224455 5224474 5224458 -
tcagtaataagtgatgatag

SEQ ID NO: 63219 - DNA, 20 bp, Artificial Sequence
  Synthetic oligonucleotide; AAGAAT chr11 5224443 5224462 5224446 -
gatgatagaagggtatatag

SEQ ID NO: 63220 - DNA, 20 bp, Artificial Sequence
  Synthetic oligonucleotide; GAGGGT chr11 5224425 5224444 5224428 -
agaagaattttattatatga

SEQ ID NO: 63221 - DNA, 20 bp, Artificial Sequence
  Synthetic oligonucleotide; TTGAAT chr11 5224360 5224379 5224363 -
caccataaacaaaaataaat

SEQ ID NO: 63222 - DNA, 20 bp, Artificial Sequence
  Synthetic oligonucleotide; ATGGGT chr11 5224356 5224375 5224359 -
ataaacaaaaataaatttga

SEQ ID NO: 63223 - DNA, 20 bp, Artificial Sequence
  Synthetic oligonucleotide; AAGAAT chr11 5224348 5224367 5224351 -
aaataaatttgaatgggtta

SEQ ID NO: 63224 - DNA, 20 bp, Artificial Sequence
  Synthetic oligonucleotide; TTGAAT chr11 5224263 5224282 5224266 -
attcacgttgcagccgtttt

SEQ ID NO: 63225 - DNA, 20 bp, Artificial Sequence
  Synthetic oligonucleotide; CAGAAT chr11 5223998 5224017 5224001 -
gaaaatcctgccatttatgg

SEQ ID NO: 63226 - DNA, 20 bp, Artificial Sequence
  Synthetic oligonucleotide; GAGGAT chr11 5223981 5224000 5223984 -
tggcagaattgatgaacctg

SEQ ID NO: 63227 - DNA, 20 bp, Artificial Sequence
  Synthetic oligonucleotide; AGGGGT chr11 5223860 5223879 5223863 -
acagtagaggtatggtttcc

SEQ ID NO: 63228 - DNA, 20 bp, Artificial Sequence
  Synthetic oligonucleotide; GGGGGT chr11 5223853 5223872 5223856 -
aggtatggtttccaggggtt

SEQ ID NO: 63229 - DNA, 20 bp, Artificial Sequence
  Synthetic oligonucleotide; GAGAAT chr11 5223845 5223864 5223848 -
tttccaggggttgggggtgg

SEQ ID NO: 63230 - DNA, 20 bp, Artificial Sequence
  Synthetic oligonucleotide; AAGGGT chr11 5223822 5223841 5223825 -
aatcaggaaactattactca

SEQ ID NO: 63231 - DNA, 20 bp, Artificial Sequence
  Synthetic oligonucleotide; TGGGAT chr11 5223799 5223818 5223802 -
ggtataaaatttcagttatg

SEQ ID NO: 63232 - DNA, 20 bp, Artificial Sequence
  Synthetic oligonucleotide; ATGAAT chr11 5223795 5223814 5223798 -
taaaatttcagttatgtggg

SEQ ID NO: 63233 - DNA, 20 bp, Artificial Sequence
  Synthetic oligonucleotide; GAGAGT chr11 5223716 5223735 5223719 -
gtatatttaaaatttgcaaa

SEQ ID NO: 63234 - DNA, 20 bp, Artificial Sequence
  Synthetic oligonucleotide; TGGAGT chr11 5223689 5223708 5223692 -
gatttttttttttttttaga

SEQ ID NO: 63235 - DNA, 20 bp, Artificial Sequence
  Synthetic oligonucleotide; TGGAGT chr11 5223663 5223682 5223666 -
tttgctcttgttgtccaggc

SEQ ID NO: 63236 - DNA, 20 bp, Artificial Sequence
  Synthetic oligonucleotide; CTGGGT chr11 5223619 5223638 5223622 -
ctcactgcaacctccgcctc

SEQ ID NO: 63237 - DNA, 20 bp, Artificial Sequence
  Synthetic oligonucleotide; CCGAGT chr11 5223587 5223606 5223590 -
aaatctcctgcctcagcctc

SEQ ID NO: 63238 - DNA, 20 bp, Artificial Sequence
  Synthetic oligonucleotide; TGGGAT chr11 5223578 5223597 5223581 -
gcctcagcctcccgagtagc

SEQ ID NO: 63239 - DNA, 20 bp, Artificial Sequence
  Synthetic oligonucleotide; CGGGGT chr11 5223523 5223542 5223526 -
ttttgtatttttagtagaga

SEQ ID NO: 63240 - DNA, 20 bp, Artificial Sequence
  Synthetic oligonucleotide; TGGGAT chr11 5223468 5223487 5223471 -
gcctcggccacccaaagggc

SEQ ID NO: 63241 - DNA, 20 bp, Artificial Sequence
  Synthetic oligonucleotide; GAGAGT chr11 5223435 5223454 5223438 -
gtgagccaccgggcctggcc

SEQ ID NO: 63242 - DNA, 20 bp, Artificial Sequence
  Synthetic oligonucleotide; ATGGGT chr11 5223382 5223401 5223385 -
aaaggtaactatgtgagata

SEQ ID NO: 63243 - DNA, 20 bp, Artificial Sequence
  Synthetic oligonucleotide; GTGAAT chr11 5223283 5223302 5223286 -
aatatatacaatttttattt

SEQ ID NO: 63244 - DNA, 20 bp, Artificial Sequence
  Synthetic oligonucleotide; AAGAAT chr11 5223259 5223278 5223262 -
atgatacctcaataaagttg

SEQ ID NO: 63245 - DNA, 20 bp, Artificial Sequence
  Synthetic oligonucleotide; AAGAAT chr11 5223246 5223265 5223249 -
aaagttgaagaataataaaa

SEQ ID NO: 63246 - DNA, 20 bp, Artificial Sequence
  Synthetic oligonucleotide; ATGAAT chr11 5223231 5223250 5223234 -
taaaaaagaatagacatcac

SEQ ID NO: 63247 - DNA, 20 bp, Artificial Sequence
  Synthetic oligonucleotide; TAGAAT chr11 5223188 5223207 5223191 -
aaaaaatgcatcttgatgat

SEQ ID NO: 63248 - DNA, 20 bp, Artificial Sequence
  Synthetic oligonucleotide; TGGAAT chr11 5222785 5222804 5222788 -
ctcatgtgtaagtaagatag

SEQ ID NO: 63249 - DNA, 20 bp, Artificial Sequence
  Synthetic oligonucleotide; AAGAGT chr11 5222658 5222677 5222661 -
gaacaactatactttttgaa

SEQ ID NO: 63250 - DNA, 20 bp, Artificial Sequence
  Synthetic oligonucleotide; TAGAAT chr11 5222574 5222593 5222577 -
aaattcagtcacgaaaaaac

SEQ ID NO: 63251 - DNA, 20 bp, Artificial Sequence
  Synthetic oligonucleotide; GCGGAT chr11 5222386 5222405 5222389 -
actttgggaggcctagacag

SEQ ID NO: 63252 - DNA, 20 bp, Artificial Sequence
  Synthetic oligonucleotide; AGGAGT chr11 5222371 5222390 5222374 -
gacaggcggatcacgacgtc

SEQ ID NO: 63253 - DNA, 20 bp, Artificial Sequence
  Synthetic oligonucleotide; GAGAAT chr11 5222252 5222271 5222255 -
aatttgggaggctgaggcag

SEQ ID NO: 63254 - DNA, 20 bp, Artificial Sequence
  Synthetic oligonucleotide; CCGAAT chr11 5222110 5222129 5222113 -
gagcggtggagccaagatga

SEQ ID NO: 63255 - DNA, 20 bp, Artificial Sequence
  Synthetic oligonucleotide; GTGAGT chr11 5222075 5222094 5222078 -
tccagtctatagctcccatc

SEQ ID NO: 63256 - DNA, 20 bp, Artificial Sequence
  Synthetic oligonucleotide; ACGGGT chr11 5222059 5222078 5222062 -
catcgtgagtgacgcagaag

SEQ ID NO: 63257 - DNA, 20 bp, Artificial Sequence
  Synthetic oligonucleotide; GTGGGT chr11 5221997 5222016 5222000 -
tcacagggaagtgccaggca

SEQ ID NO: 63258 - DNA, 20 bp, Artificial Sequence
  Synthetic oligonucleotide; AGGGGT chr11 5221919 5221938 5221922 -
cacctcacccgggaagcaca

SEQ ID NO: 63259 - DNA, 20 bp, Artificial Sequence
  Synthetic oligonucleotide; GGGAAT chr11 5221911 5221930 5221914 -
ccgggaagcacaaggggtca

SEQ ID NO: 63260 - DNA, 20 bp, Artificial Sequence
  Synthetic oligonucleotide; AAGGGT chr11 5221885 5221904 5221888 -
tccctttcctagtcaaagaa

SEQ ID NO: 63261 - DNA, 20 bp, Artificial Sequence
  Synthetic oligonucleotide; TCGGGT chr11 5221859 5221878 5221862 -
gacagatggcacctggaaaa

SEQ ID NO: 63262 - DNA, 20 bp, Artificial Sequence
  Synthetic oligonucleotide; GAGGGT chr11 5221774 5221793 5221777 -
tatatcccatgcctggctca

SEQ ID NO: 63263 - DNA, 20 bp, Artificial Sequence
  Synthetic oligonucleotide; AGGGGT chr11 5221691 5221710 5221694 -
ggtggcagtgaggctggggg

SEQ ID NO: 63264 - DNA, 20 bp, Artificial Sequence
  Synthetic oligonucleotide; CTGGGT chr11 5221632 5221651 5221635 -
aagccgcctggaagctcgaa

SEQ ID NO: 63265 - DNA, 20 bp, Artificial Sequence
  Synthetic oligonucleotide; GAGAGT chr11 5221499 5221518 5221502 -
ccctgtctgacagctttgaa

SEQ ID NO: 63266 - DNA, 20 bp, Artificial Sequence
  Synthetic oligonucleotide; GTGGGT chr11 5221437 5221456 5221440 -
caggcagactgcctcctcaa

SEQ ID NO: 63267 - DNA, 20 bp, Artificial Sequence
  Synthetic oligonucleotide; CCGAGT chr11 5221422 5221441 5221425 -
ctcaagtgggtccctgaccc

SEQ ID NO: 63268 - DNA, 20 bp, Artificial Sequence
  Synthetic oligonucleotide; AGGAAT chr11 5221336 5221355 5221339 -
ctctaagacaaaacttccag

SEQ ID NO: 63269 - DNA, 20 bp, Artificial Sequence
  Synthetic oligonucleotide; TGGAGT chr11 5221251 5221270 5221254 -
atacccaggaaaacagcttc

SEQ ID NO: 63270 - DNA, 20 bp, Artificial Sequence
  Synthetic oligonucleotide; GAGGGT chr11 5221212 5221231 5221215 -
actccaacagacctgcagct

SEQ ID NO: 63271 - DNA, 20 bp, Artificial Sequence
  Synthetic oligonucleotide; GAGAGT chr11 5221060 5221079 5221063 -
aaactggacactctaaaaat

SEQ ID NO: 63272 - DNA, 20 bp, Artificial Sequence
  Synthetic oligonucleotide; GAGAAT chr11 5220997 5221016 5221000 -
caatggaacaaagctgggca

SEQ ID NO: 63273 - DNA, 20 bp, Artificial Sequence
  Synthetic oligonucleotide; ACGAGT chr11 5220984 5221003 5220987 -
ctgggcagagaatgactttg

SEQ ID NO: 63274 - DNA, 20 bp, Artificial Sequence
  Synthetic oligonucleotide; ATGAAT chr11 5220882 5220901 5220885 -
aaactttgaaaaaaaattag

SEQ ID NO: 63275 - DNA, 20 bp, Artificial Sequence
  Synthetic oligonucleotide; ATGGAT chr11 5220878 5220897 5220881 -
tttgaaaaaaaattagatga

SEQ ID NO: 63276 - DNA, 20 bp, Artificial Sequence
  Synthetic oligonucleotide; TAGAAT chr11 5220869 5220888 5220872 -
aaattagatgaatggataac

SEQ ID NO: 63277 - DNA, 20 bp, Artificial Sequence
  Synthetic oligonucleotide; AAGGGT chr11 5220755 5220774 5220758 -
cgatgagatcaactggaaga

SEQ ID NO: 63278 - DNA, 20 bp, Artificial Sequence
  Synthetic oligonucleotide; ATGAAT chr11 5220730 5220749 5220733 -
tatcaatgacgaaagatgaa

SEQ ID NO: 63279 - DNA, 20 bp, Artificial Sequence
  Synthetic oligonucleotide; AAGAAT chr11 5220692 5220711 5220695 -
gaagagaagtttagagaaaa

SEQ ID NO: 63280 - DNA, 20 bp, Artificial Sequence
  Synthetic oligonucleotide; GAGAAT chr11 5220598 5220617 5220601 -
gtgtagctgaaagtgatggg

SEQ ID NO: 63281 - DNA, 20 bp, Artificial Sequence
  Synthetic oligonucleotide; CAGGAT chr11 5220568 5220587 5220571 -
ccaagttggaaaacactctg

SEQ ID NO: 63282 - DNA, 20 bp, Artificial Sequence
  Synthetic oligonucleotide; TCGGGT chr11 5220389 5220408 5220392 -
agggcagccagagagaaagg

SEQ ID NO: 63283 - DNA, 20 bp, Artificial Sequence
  Synthetic oligonucleotide; AAGAAT chr11 5220283 5220302 5220286 -
tattcaacattgttaaagaa

SEQ ID NO: 63284 - DNA, 20 bp, Artificial Sequence
  Synthetic oligonucleotide; CAGAAT chr11 5220269 5220288 5220272 -
aaagaaaagaattttcaacc

SEQ ID NO: 63285 - DNA, 20 bp, Artificial Sequence
  Synthetic oligonucleotide; CAGGAT chr11 5220022 5220041 5220025 -
accagctaacatcataatga

SEQ ID NO: 63286 - DNA, 20 bp, Artificial Sequence
  Synthetic oligonucleotide; TTGGAT chr11 5219940 5219959 5219943 -
aaaagacacagactggcaaa

SEQ ID NO: 63287 - DNA, 20 bp, Artificial Sequence
  Synthetic oligonucleotide; AGGAGT chr11 5219933 5219952 5219936 -
acagactggcaaattggata

SEQ ID NO: 63288 - DNA, 20 bp, Artificial Sequence
  Synthetic oligonucleotide; AAGGAT chr11 5219857 5219876 5219860 -
cacacataggctcgaaataa

SEQ ID NO: 63289 - DNA, 20 bp, Artificial Sequence
  Synthetic oligonucleotide; AGGAAT chr11 5219849 5219868 5219852 -
ggctcgaaataaaaggatgg

SEQ ID NO: 63290 - DNA, 20 bp, Artificial Sequence
  Synthetic oligonucleotide; AGGGGT chr11 5219811 5219830 5219814 -
aatggaaaacaaaaaaaggc

SEQ ID NO: 63291 - DNA, 20 bp, Artificial Sequence
  Synthetic oligonucleotide; AGGGAT chr11 5219725 5219744 5219728 -
aggccattacataatggcaa

SEQ ID NO: 63292 - DNA, 20 bp, Artificial Sequence
  Synthetic oligonucleotide; CTGAGT chr11 5219642 5219661 5219645 -
ccagattcataaaacaagtc

SEQ ID NO: 63293 - DNA, 20 bp, Artificial Sequence
  Synthetic oligonucleotide; AAGGAT chr11 5219540 5219559 5219543 -
caacgagacagaaagttaac

SEQ ID NO: 63294 - DNA, 20 bp, Artificial Sequence
  Synthetic oligonucleotide; AGGAAT chr11 5219530 5219549 5219533 -
gaaagttaacaaggatatcc

SEQ ID NO: 63295 - DNA, 20 bp, Artificial Sequence
  Synthetic oligonucleotide; CAGAAT chr11 5219461 5219480 5219464 -
aactctccaccccaaatcaa

SEQ ID NO: 63296 - DNA, 20 bp, Artificial Sequence
  Synthetic oligonucleotide; CAGGAT chr11 5219316 5219335 5219319 -
agtgcaatcaaactagaact

SEQ ID NO: 63297 - DNA, 20 bp, Artificial Sequence
  Synthetic oligonucleotide; CTGAAT chr11 5219258 5219277 5219261 -
ggaaactgaacagcctgctc

SEQ ID NO: 63298 - DNA, 20 bp, Artificial Sequence
  Synthetic oligonucleotide; CTGGGT chr11 5219247 5219266 5219250 -
agcctgctcctgaatgacta

SEQ ID NO: 63299 - DNA, 20 bp, Artificial Sequence
  Synthetic oligonucleotide; CAGAAT chr11 5219174 5219193 5219177 -
agaacaaagacacaacacac

SEQ ID NO: 63300 - DNA, 20 bp, Artificial Sequence
  Synthetic oligonucleotide; ATGAAT chr11 5218947 5218966 5218950 -
aaaacccttcaaaaaaatca

SEQ ID NO: 63301 - DNA, 20 bp, Artificial Sequence
  Synthetic oligonucleotide; AAGAAT chr11 5218867 5218886 5218870 -
taataaagaagaaaagagag

SEQ ID NO: 63302 - DNA, 20 bp, Artificial Sequence
  Synthetic oligonucleotide; CGGGGT chr11 5218836 5218855 5218839 -
agacgcaataaaaaatgaca

SEQ ID NO: 63303 - DNA, 20 bp, Artificial Sequence
  Synthetic oligonucleotide; GAGAAT chr11 5218793 5218812 5218796 -
agaaatacaaactaccgtca

SEQ ID NO: 63304 - DNA, 20 bp, Artificial Sequence
  Synthetic oligonucleotide; ATGGAT chr11 5218743 5218762 5218746 -
aactagaaaatctagaagaa

SEQ ID NO: 63305 - DNA, 20 bp, Artificial Sequence
  Synthetic oligonucleotide; CTGAAT chr11 5218683 5218702 5218686 -
accaggaagaagttgtatct

SEQ ID NO: 63306 - DNA, 20 bp, Artificial Sequence
  Synthetic oligonucleotide; TAGGAT chr11 5218607 5218626 5218610 -
caaaaaaagtccgggaccag

SEQ ID NO: 63307 - DNA, 20 bp, Artificial Sequence
  Synthetic oligonucleotide; CCGAAT chr11 5218595 5218614 5218598 -
gggaccagtaggattcatag

SEQ ID NO: 63308 - DNA, 20 bp, Artificial Sequence
  Synthetic oligonucleotide; GGGAAT chr11 5218522 5218541 5218525 -
ttccaatcaatagaaaaaga

SEQ ID NO: 63309 - DNA, 20 bp, Artificial Sequence
  Synthetic oligonucleotide; GAGAAT chr11 5218446 5218465 5218449 -
acagagacacaacaaaaaaa

SEQ ID NO: 63310 - DNA, 20 bp, Artificial Sequence
  Synthetic oligonucleotide; CTGAGT chr11 5218126 5218145 5218129 -
aacccacagccaatatcata

SEQ ID NO: 63311 - DNA, 20 bp, Artificial Sequence
  Synthetic oligonucleotide; AGGGAT chr11 5218077 5218096 5218080 -
tttgaaaactggcacaaggc

SEQ ID NO: 63312 - DNA, 20 bp, Artificial Sequence
  Synthetic oligonucleotide; CAGGAT chr11 5217867 5217886 5217870 -
aagcaacttcagcaaagtct

SEQ ID NO: 63313 - DNA, 20 bp, Artificial Sequence
  Synthetic oligonucleotide; ATGAGT chr11 5217793 5217812 5217796 -
gacaaacagagagccaaatc

SEQ ID NO: 63314 - DNA, 20 bp, Artificial Sequence
  Synthetic oligonucleotide; GAGAAT chr11 5217761 5217780 5217764 -
ccattcacaattgcttcaaa

SEQ ID NO: 63315 - DNA, 20 bp, Artificial Sequence
  Synthetic oligonucleotide; AGGAAT chr11 5217746 5217765 5217749 -
tcaaagagaataaaatacct

SEQ ID NO: 63316 - DNA, 20 bp, Artificial Sequence
  Synthetic oligonucleotide; AGGGAT chr11 5217730 5217749 5217733 -
acctaggaatccaacttaca

SEQ ID NO: 63317 - DNA, 20 bp, Artificial Sequence
  Synthetic oligonucleotide; GAGGAT chr11 5217673 5217692 5217676 -
cactgctcaatgaaataaaa

SEQ ID NO: 63318 - DNA, 20 bp, Artificial Sequence
  Synthetic oligonucleotide; ATGGGT chr11 5217638 5217657 5217641 -
tggaagaacattccatgctc

SEQ ID NO: 63319 - DNA, 20 bp, Artificial Sequence
  Synthetic oligonucleotide; AAGAAT chr11 5217629 5217648 5217632 -
attccatgctcatgggtagg

SEQ ID NO: 63320 - DNA, 20 bp, Artificial Sequence
  Synthetic oligonucleotide; AAGGAT chr11 5217271 5217290 5217274 -
agagaaacaagcaatgggga

SEQ ID NO: 63321 - DNA, 20 bp, Artificial Sequence
  Synthetic oligonucleotide; CTGGAT chr11 5217208 5217227 5217211 -
ccatatgtagaaagctgaaa

SEQ ID NO: 63322 - DNA, 20 bp, Artificial Sequence
  Synthetic oligonucleotide; ATGGAT chr11 5217167 5217186 5217170 -
tatacaaaaattaattcaag

SEQ ID NO: 63323 - DNA, 20 bp, Artificial Sequence
  Synthetic oligonucleotide; CGGGAT chr11 5217022 5217041 5217025 -
caaaagacaaaatggacaaa

SEQ ID NO: 63324 - DNA, 20 bp, Artificial Sequence
  Synthetic oligonucleotide; CAGAGT chr11 5216972 5216991 5216975 -
acagctaaagaaactaccat

SEQ ID NO: 63325 - DNA, 20 bp, Artificial Sequence
  Synthetic oligonucleotide; CAGAAT chr11 5216900 5216919 5216903 -
tctgacaaagggctaatatc

SEQ ID NO: 63326 - DNA, 20 bp, Artificial Sequence
  Synthetic oligonucleotide; AAGGAT chr11 5216834 5216853 5216837 -
accccatcaaaaagtgggca

SEQ ID NO: 63327 - DNA, 20 bp, Artificial Sequence
  Synthetic oligonucleotide; TAGAAT chr11 5216703 5216722 5216706 -
agataccatctcacaccagt

SEQ ID NO: 63328 - DNA, 20 bp, Artificial Sequence
  Synthetic oligonucleotide; GAGGAT chr11 5216659 5216678 5216662 -
aggaaacaacaggtgctgga

SEQ ID NO: 63329 - DNA, 20 bp, Artificial Sequence
  Synthetic oligonucleotide; AGGAAT chr11 5216569 5216588 5216572 -
agtcagtgtggcaattcctc

SEQ ID NO: 63330 - DNA, 20 bp, Artificial Sequence
  Synthetic oligonucleotide; CTGGGT chr11 5216524 5216543 5216527 -
ttgacccagccatcccatta

SEQ ID NO: 63331 - DNA, 20 bp, Artificial Sequence
  Synthetic oligonucleotide; AAGGAT chr11 5216509 5216528 5216512 -
cattactgggtacataccca

SEQ ID NO: 63332 - DNA, 20 bp, Artificial Sequence
  Synthetic oligonucleotide; CTGGAT chr11 5216399 5216418 5216402 -
aaatgtccaacaacgataga

SEQ ID NO: 63333 - DNA, 20 bp, Artificial Sequence
  Synthetic oligonucleotide; TGGAAT chr11 5216367 5216386 5216370 -
aatgtggcacatatacacca

SEQ ID NO: 63334 - DNA, 20 bp, Artificial Sequence
  Synthetic oligonucleotide; ATGAGT chr11 5216340 5216359 5216343 -
ctatgcagccataaaaaatg

SEQ ID NO: 63335 - DNA, 20 bp, Artificial Sequence
  Synthetic oligonucleotide; ATGGAT chr11 5216315 5216334 5216318 -
ttcatgtcctttgtagggac

SEQ ID NO: 63336 - DNA, 20 bp, Artificial Sequence
  Synthetic oligonucleotide; GAGAAT chr11 5216271 5216290 5216274 -
tctcagcaaactatcacaag

SEQ ID NO: 63337 - DNA, 20 bp, Artificial Sequence
  Synthetic oligonucleotide; GGGAAT chr11 5216233 5216252 5216236 -
gcatgttctcactcataggt

SEQ ID NO: 63338 - DNA, 20 bp, Artificial Sequence
  Synthetic oligonucleotide; TGGGGT chr11 5216170 5216189 5216173 -
tcacactctggggactgtta

SEQ ID NO: 63339 - DNA, 20 bp, Artificial Sequence
  Synthetic oligonucleotide; AGGGAT chr11 5216151 5216170 5216154 -
atggggtggggggcaggggc

SEQ ID NO: 63340 - DNA, 20 bp, Artificial Sequence
  Synthetic oligonucleotide; ACGAGT chr11 5216115 5216134 5216118 -
gatatacctaatgctaaatg

SEQ ID NO: 63341 - DNA, 20 bp, Artificial Sequence
  Synthetic oligonucleotide; ATGGGT chr11 5216107 5216126 5216110 -
taatgctaaatgacgagtta

SEQ ID NO: 63342 - DNA, 20 bp, Artificial Sequence
  Synthetic oligonucleotide; GAGAGT chr11 5215834 5215853 5215837 -
cagtctctccatatatttct

SEQ ID NO: 63343 - DNA, 20 bp, Artificial Sequence
  Synthetic oligonucleotide; AAGAAT chr11 5215808 5215827 5215811 -
cttccttcttatttgtttat

SEQ ID NO: 63344 - DNA, 20 bp, Artificial Sequence
  Synthetic oligonucleotide; TAGAAT chr11 5215704 5215723 5215707 -
tactaaacaggagccaagcc

SEQ ID NO: 63345 - DNA, 20 bp, Artificial Sequence
  Synthetic oligonucleotide; TTGAAT chr11 5215694 5215713 5215697 -
gagccaagcctagaataaag

SEQ ID NO: 63346 - DNA, 20 bp, Artificial Sequence
  Synthetic oligonucleotide; TGGAAT chr11 5215685 5215704 5215688 -
ctagaataaagttgaatttc

SEQ ID NO: 63347 - DNA, 20 bp, Artificial Sequence
  Synthetic oligonucleotide; TAGGAT chr11 5215490 5215509 5215493 -
aacccaggaggctgaagtga

SEQ ID NO: 63348 - DNA, 20 bp, Artificial Sequence
  Synthetic oligonucleotide; CAGGAT chr11 5215474 5215493 5215477 -
gtgataggatcacttgagcc

SEQ ID NO: 63349 - DNA, 20 bp, Artificial Sequence
  Synthetic oligonucleotide; CAGGGT chr11 5215466 5215485 5215469 -
atcacttgagcccaggattt

SEQ ID NO: 63350 - DNA, 20 bp, Artificial Sequence
  Synthetic oligonucleotide; GTGGAT chr11 5215266 5215285 5215269 -
gcctcggggctgtttctcca

SEQ ID NO: 63351 - DNA, 20 bp, Artificial Sequence
  Synthetic oligonucleotide; TTGGGT chr11 5215258 5215277 5215261 -
gctgtttctccagtggattc

SEQ ID NO: 63352 - DNA, 20 bp, Artificial Sequence
  Synthetic oligonucleotide; TTGGAT chr11 5215186 5215205 5215189 -
tcacctgtcttattcagagc

SEQ ID NO: 63353 - DNA, 20 bp, Artificial Sequence
  Synthetic oligonucleotide; TGGGAT chr11 5215156 5215175 5215159 -
gactagctttttctatttct

SEQ ID NO: 63354 - DNA, 20 bp, Artificial Sequence
  Synthetic oligonucleotide; TAGAGT chr11 5215055 5215074 5215058 -
gtattctggggagggggaca

SEQ ID NO: 63355 - DNA, 20 bp, Artificial Sequence
  Synthetic oligonucleotide; AGGAAT chr11 5215037 5215056 5215040 -
catagagttgagagaaatac

SEQ ID NO: 63356 - DNA, 20 bp, Artificial Sequence
  Synthetic oligonucleotide; TGGGGT chr11 5214873 5214892 5214876 -
gatgattatttgtatttctg

SEQ ID NO: 63357 - DNA, 20 bp, Artificial Sequence
  Synthetic oligonucleotide; GTGAGT chr11 5214869 5214888 5214872 -
attatttgtatttctgtggg

SEQ ID NO: 63358 - DNA, 20 bp, Artificial Sequence
  Synthetic oligonucleotide; TTGGAT chr11 5214827 5214846 5214830 -
tcatttctaactgtgcttat

SEQ ID NO: 63359 - DNA, 20 bp, Artificial Sequence
  Synthetic oligonucleotide; TTGAAT chr11 5214735 5214754 5214738 -
ctcttggactcattaatctt

SEQ ID NO: 63360 - DNA, 20 bp, Artificial Sequence
  Synthetic oligonucleotide; TAGGGT chr11 5214662 5214681 5214665 -
ttcttgtcttctgctagatt

SEQ ID NO: 63361 - DNA, 20 bp, Artificial Sequence
  Synthetic oligonucleotide; GAGAGT chr11 5214349 5214368 5214352 -
tttttattcctctgtggtct

SEQ ID NO: 63362 - DNA, 20 bp, Artificial Sequence
  Synthetic oligonucleotide; GAGGAT chr11 5214313 5214332 5214316 -
attttttttttgcatttgct

SEQ ID NO: 63363 - DNA, 20 bp, Artificial Sequence
  Synthetic oligonucleotide; AAGAGT chr11 5214152 5214171 5214155 -
attctatcagatgcacaaag

SEQ ID NO: 63364 - DNA, 20 bp, Artificial Sequence
  Synthetic oligonucleotide; AGGGAT chr11 5214104 5214123 5214107 -
actccaaaaaattgaggggg

SEQ ID NO: 63365 - DNA, 20 bp, Artificial Sequence
  Synthetic oligonucleotide; CAGAAT chr11 5213694 5213713 5213697 -
aacccacagccaacatcata

SEQ ID NO: 63366 - DNA, 20 bp, Artificial Sequence
  Synthetic oligonucleotide; AAGGAT chr11 5213645 5213664 5213648 -
cttgaaaactggcacaagac

SEQ ID NO: 63367 - DNA, 20 bp, Artificial Sequence
  Synthetic oligonucleotide; GGGAAT chr11 5213572 5213591 5213575 -
agagcaatcaggcaagagaa

SEQ ID NO: 63368 - DNA, 20 bp, Artificial Sequence
  Synthetic oligonucleotide; CAGGAT chr11 5213453 5213472 5213456 -
tgataacttcagcaaagttt

SEQ ID NO: 63369 - DNA, 20 bp, Artificial Sequence
  Synthetic oligonucleotide; AAGAAT chr11 5213347 5213366 5213350 -
ccatttaccgttgccacaaa

SEQ ID NO: 63370 - DNA, 20 bp, Artificial Sequence
  Synthetic oligonucleotide; AAGGAT chr11 5213332 5213351 5213335 -
acaaaaagaataaaatacct

SEQ ID NO: 63371 - DNA, 20 bp, Artificial Sequence
  Synthetic oligonucleotide; ATGGAT chr11 5213224 5213243 5213227 -
tggaaaaactttccatgctc

SEQ ID NO: 63372 - DNA, 20 bp, Artificial Sequence
  Synthetic oligonucleotide; AAGAAT chr11 5213215 5213234 5213218 -
tttccatgctcatggataaa

SEQ ID NO: 63373 - DNA, 20 bp, Artificial Sequence
  Synthetic oligonucleotide; GGGAAT chr11 5213039 5213058 5213042 -
aaatcctaatactcacaggt

SEQ ID NO: 63374 - DNA, 20 bp, Artificial Sequence
  Synthetic oligonucleotide; CAGGGT chr11 5213010 5213029 5213013 -
aaaatgagaacacttggaca

SEQ ID NO: 63375 - DNA, 20 bp, Artificial Sequence
  Synthetic oligonucleotide; TGGGGT chr11 5212976 5212995 5212979 -
tcacacaccggggcctgtcg

SEQ ID NO: 63376 - DNA, 20 bp, Artificial Sequence
  Synthetic oligonucleotide; AGGGAT chr11 5212957 5212976 5212960 -
gtggggtggtaggagagagg

SEQ ID NO: 63377 - DNA, 20 bp, Artificial Sequence
  Synthetic oligonucleotide; ACGAGT chr11 5212922 5212941 5212925 -
agatatatctaatgtaaatg

SEQ ID NO: 63378 - DNA, 20 bp, Artificial Sequence
  Synthetic oligonucleotide; ACGGGT chr11 5212914 5212933 5212917 -
ctaatgtaaatgacgagtta

SEQ ID NO: 63379 - DNA, 20 bp, Artificial Sequence
  Synthetic oligonucleotide; TAGAGT chr11 5212847 5212866 5212850 -
tgcacaggtaccgtagaact

SEQ ID NO: 63380 - DNA, 20 bp, Artificial Sequence
  Synthetic oligonucleotide; CAGAAT chr11 5212711 5212730 5212714 -
agacacacagacaaatggaa

SEQ ID NO: 63381 - DNA, 20 bp, Artificial Sequence
  Synthetic oligonucleotide; TGGGAT chr11 5212602 5212621 5212605 -
ccctattcaacaagtggtgt

SEQ ID NO: 63382 - DNA, 20 bp, Artificial Sequence
  Synthetic oligonucleotide; ATGGAT chr11 5212526 5212545 5212529 -
tatacacaaataaactcaag

SEQ ID NO: 63383 - DNA, 20 bp, Artificial Sequence
  Synthetic oligonucleotide; TAGGAT chr11 5212382 5212401 5212385 -
caaaagcaaaaattgacaaa

SEQ ID NO: 63384 - DNA, 20 bp, Artificial Sequence
  Synthetic oligonucleotide; CTGAGT chr11 5212334 5212353 5212337 -
acagcaaaagaaactatcaa

SEQ ID NO: 63385 - DNA, 20 bp, Artificial Sequence
  Synthetic oligonucleotide; TAGAAT chr11 5212318 5212337 5212321 -
tcaactgagtaaacaaccta

SEQ ID NO: 63386 - DNA, 20 bp, Artificial Sequence
  Synthetic oligonucleotide; CAGAAT chr11 5212266 5212285 5212269 -
tccaacaaaggcctaatatt

SEQ ID NO: 63387 - DNA, 20 bp, Artificial Sequence
  Synthetic oligonucleotide; ATGAAT chr11 5212245 5212264 5212248 -
agaatctataaggaacttaa

SEQ ID NO: 63388 - DNA, 20 bp, Artificial Sequence
  Synthetic oligonucleotide; ATGGGT chr11 5212207 5212226 5212210 -
aacaaacaatgccacaaaaa

SEQ ID NO: 63389 - DNA, 20 bp, Artificial Sequence
  Synthetic oligonucleotide; GTGGGT chr11 5212032 5212051 5212035 -
atagtcaaaaaataacagat

SEQ ID NO: 63390 - DNA, 20 bp, Artificial Sequence
  Synthetic oligonucleotide; GGGAAT chr11 5212010 5212029 5212013 -
gggtaaggttgtggagaaaa

SEQ ID NO: 63391 - DNA, 20 bp, Artificial Sequence
  Synthetic oligonucleotide; TTGAGT chr11 5211892 5211911 5211895 -
ttaacccaacaatcctatta

SEQ ID NO: 63392 - DNA, 20 bp, Artificial Sequence
  Synthetic oligonucleotide; TAGAAT chr11 5211800 5211819 5211803 -
taatcacaatagcaaagaca

SEQ ID NO: 63393 - DNA, 20 bp, Artificial Sequence
  Synthetic oligonucleotide; TGGAAT chr11 5211740 5211759 5211743 -
gaacatgtacatatacacca

SEQ ID NO: 63394 - DNA, 20 bp, Artificial Sequence
  Synthetic oligonucleotide; AAGAAT chr11 5211717 5211736 5211720 -
aatactatgtggccataaaa

SEQ ID NO: 63395 - DNA, 20 bp, Artificial Sequence
  Synthetic oligonucleotide; ATGGAT chr11 5211688 5211707 5211691 -
atcatgtcctttgcaggaac

SEQ ID NO: 63396 - DNA, 20 bp, Artificial Sequence
  Synthetic oligonucleotide; TTGAGT chr11 5211546 5211565 5211549 -
caaaagacactgcagcctaa

SEQ ID NO: 63397 - DNA, 20 bp, Artificial Sequence
  Synthetic oligonucleotide; GAGGGT chr11 5211537 5211556 5211540 -
ctgcagcctaattgagtttg

SEQ ID NO: 63398 - DNA, 20 bp, Artificial Sequence
  Synthetic oligonucleotide; TTGAGT chr11 5211499 5211518 5211502 -
aagagcagaaaaagtaacta

SEQ ID NO: 63399 - DNA, 20 bp, Artificial Sequence
  Synthetic oligonucleotide; GTGAGT chr11 5211428 5211447 5211431 -
tagctatgtaacaaaccatc

SEQ ID NO: 63400 - DNA, 20 bp, Artificial Sequence
  Synthetic oligonucleotide; CTGAAT chr11 5211089 5211108 5211092 -
attcagttacttctgacaac

SEQ ID NO: 63401 - DNA, 20 bp, Artificial Sequence
  Synthetic oligonucleotide; CAGGGT chr11 5211041 5211060 5211044 -
tctcttttttttttttttga

SEQ ID NO: 63402 - DNA, 20 bp, Artificial Sequence
  Synthetic oligonucleotide; TGGAGT chr11 5211016 5211035 5211019 -
tctcgctgtgttgcccaggt

SEQ ID NO: 63403 - DNA, 20 bp, Artificial Sequence
  Synthetic oligonucleotide; AGGGGT chr11 5210875 5210894 5210878 -
ttttaaaattttttgtagag

SEQ ID NO: 63404 - DNA, 20 bp, Artificial Sequence
  Synthetic oligonucleotide; GAGAGT chr11 5210666 5210685 5210669 -
gagattaggaagtgccccga

SEQ ID NO: 63405 - DNA, 20 bp, Artificial Sequence
  Synthetic oligonucleotide; GAGGGT chr11 5210650 5210669 5210653 -
ccgagagagtgcatagagga

SEQ ID NO: 63406 - DNA, 20 bp, Artificial Sequence
  Synthetic oligonucleotide; CTGGGT chr11 5210634 5210653 5210637 -
aggagagggtagaagtaaag

SEQ ID NO: 63407 - DNA, 20 bp, Artificial Sequence
  Synthetic oligonucleotide; AGGAAT chr11 5210613 5210632 5210616 -
tgggtttgctttgttagtga

SEQ ID NO: 63408 - DNA, 20 bp, Artificial Sequence
  Synthetic oligonucleotide; CTGGAT chr11 5210446 5210465 5210449 -
tccccatccacttgctcatt

SEQ ID NO: 63409 - DNA, 20 bp, Artificial Sequence
  Synthetic oligonucleotide; CAGGAT chr11 5210438 5210457 5210441 -
cacttgctcattctggatgg

SEQ ID NO: 63410 - DNA, 20 bp, Artificial Sequence
  Synthetic oligonucleotide; TGGGGT chr11 5210339 5210358 5210342 -
aaaggaaaaagtacatttag

SEQ ID NO: 63411 - DNA, 20 bp, Artificial Sequence
  Synthetic oligonucleotide; TTGGAT chr11 5210324 5210343 5210327 -
tttagtggggtgtgggactg

SEQ ID NO: 63412 - DNA, 20 bp, Artificial Sequence
  Synthetic oligonucleotide; AAGAAT chr11 5210257 5210276 5210260 -
gccagcttgcttcccactag

SEQ ID NO: 63413 - DNA, 20 bp, Artificial Sequence
  Synthetic oligonucleotide; TGGGAT chr11 5210183 5210202 5210186 -
ttcatttattattgtttttc

SEQ ID NO: 63414 - DNA, 20 bp, Artificial Sequence
  Synthetic oligonucleotide; TGGAGT chr11 5210152 5210171 5210155 -
caggagcaatttaaacttgc

SEQ ID NO: 63415 - DNA, 20 bp, Artificial Sequence
  Synthetic oligonucleotide; GAGAAT chr11 5210125 5210144 5210128 -
caatttcttcaactacaaat

SEQ ID NO: 63416 - DNA, 20 bp, Artificial Sequence
  Synthetic oligonucleotide; AAGGAT chr11 5210062 5210081 5210065 -
gaactaaatgtaaatataca

SEQ ID NO: 63417 - DNA, 20 bp, Artificial Sequence
  Synthetic oligonucleotide; CAGAAT chr11 5209901 5209920 5209904 -
ttttatgacctagcaattta

SEQ ID NO: 63418 - DNA, 20 bp, Artificial Sequence
  Synthetic oligonucleotide; AAGAAT chr11 5209877 5209896 5209880 -
atatatatacaaaaatatat

SEQ ID NO: 63419 - DNA, 20 bp, Artificial Sequence
  Synthetic oligonucleotide; TGGAGT chr11 5209809 5209828 5209812 -
actcaaatatctatcaactg

SEQ ID NO: 63420 - DNA, 20 bp, Artificial Sequence
  Synthetic oligonucleotide; TAGAAT chr11 5209773 5209792 5209776 -
attgtggtatatacataaaa

SEQ ID NO: 63421 - DNA, 20 bp, Artificial Sequence
  Synthetic oligonucleotide; ATGAAT chr11 5209726 5209745 5209729 -
aactacagtcatacactagt

SEQ ID NO: 63422 - DNA, 20 bp, Artificial Sequence
  Synthetic oligonucleotide; TTGAAT chr11 5209701 5209720 5209704 -
tgcaattcacaaacataata

SEQ ID NO: 63423 - DNA, 20 bp, Artificial Sequence
  Synthetic oligonucleotide; ATGAGT chr11 5209635 5209654 5209638 -
acacttttaaaaaaagggac

SEQ ID NO: 63424 - DNA, 20 bp, Artificial Sequence
  Synthetic oligonucleotide; ATGAAT chr11 5209615 5209634 5209618 -
atgagtcaatcgtgataaaa

SEQ ID NO: 63425 - DNA, 20 bp, Artificial Sequence
  Synthetic oligonucleotide; CAGGAT chr11 5209604 5209623 5209607 -
gtgataaaaatgaattatat

SEQ ID NO: 63426 - DNA, 20 bp, Artificial Sequence
  Synthetic oligonucleotide; TGGAAT chr11 5209573 5209592 5209576 -
ttaactttggagacaattag

SEQ ID NO: 63427 - DNA, 20 bp, Artificial Sequence
  Synthetic oligonucleotide; AAGAGT chr11 5209563 5209582 5209566 -
agacaattagtggaatgata

SEQ ID NO: 63428 - DNA, 20 bp, Artificial Sequence
  Synthetic oligonucleotide; ATGGGT chr11 5209513 5209532 5209516 -
cctatcttattagttgttac

SEQ ID NO: 63429 - DNA, 20 bp, Artificial Sequence
  Synthetic oligonucleotide; TGGGAT chr11 5209090 5209109 5209093 -
gtcttttacacacactgtct

SEQ ID NO: 63430 - DNA, 20 bp, Artificial Sequence
  Synthetic oligonucleotide; AGGGAT chr11 5208942 5208961 5208945 -
gaacttcattgctctctgtt

SEQ ID NO: 63431 - DNA, 20 bp, Artificial Sequence
  Synthetic oligonucleotide; GCGAGT chr11 5208848 5208867 5208851 -
ctatggacctcttaaactca

SEQ ID NO: 63432 - DNA, 20 bp, Artificial Sequence
  Synthetic oligonucleotide; ATGAAT chr11 5208783 5208802 5208786 -
ctctaatgcttccaaacttg

SEQ ID NO: 63433 - DNA, 20 bp, Artificial Sequence
  Synthetic oligonucleotide; TAGAAT chr11 5208674 5208693 5208677 -
aataatcaatttctcacaac

SEQ ID NO: 63434 - DNA, 20 bp, Artificial Sequence
  Synthetic oligonucleotide; TTGAGT chr11 5208644 5208663 5208647 -
atcataaatactgatagctt

SEQ ID NO: 63435 - DNA, 20 bp, Artificial Sequence
  Synthetic oligonucleotide; TGGGAT chr11 5208316 5208335 5208319 -
cctatttgtgtcttgcaaca

SEQ ID NO: 63436 - DNA, 20 bp, Artificial Sequence
  Synthetic oligonucleotide; GAGGAT chr11 5208245 5208264 5208248 -
taagttaatagctttgtttt

SEQ ID NO: 63437 - DNA, 20 bp, Artificial Sequence
  Synthetic oligonucleotide; TGGAAT chr11 5208188 5208207 5208191 -
taataaattaagagctataa

SEQ ID NO: 63438 - DNA, 20 bp, Artificial Sequence
  Synthetic oligonucleotide; GTGAGT chr11 5208161 5208180 5208164 -
tactttataaatttcttata

SEQ ID NO: 63439 - DNA, 20 bp, Artificial Sequence
  Synthetic oligonucleotide; AAGGGT chr11 5207856 5207875 5207859 -
aacagaaaaaaaacgataca

SEQ ID NO: 63440 - DNA, 20 bp, Artificial Sequence
  Synthetic oligonucleotide; AAGGAT chr11 5207847 5207866 5207850 -
aaaacgatacaaagggtatg

SEQ ID NO: 63441 - DNA, 20 bp, Artificial Sequence
  Synthetic oligonucleotide; TTGAGT chr11 5207842 5207861 5207845 -
gatacaaagggtatgaagga

SEQ ID NO: 63442 - DNA, 20 bp, Artificial Sequence
  Synthetic oligonucleotide; GTGAAT chr11 5207838 5207857 5207841 -
caaagggtatgaaggattga

SEQ ID NO: 63443 - DNA, 20 bp, Artificial Sequence
  Synthetic oligonucleotide; CTGGGT chr11 5207802 5207821 5207805 -
ctacggcaccagtggtcttt

SEQ ID NO: 63444 - DNA, 20 bp, Artificial Sequence
  Synthetic oligonucleotide; GAGAAT chr11 5207623 5207642 5207626 -
ataaacctttgtcacctcta

SEQ ID NO: 63445 - DNA, 20 bp, Artificial Sequence
  Synthetic oligonucleotide; AGGAAT chr11 5207589 5207608 5207592 -
tccacagatttagaaattct

SEQ ID NO: 63446 - DNA, 20 bp, Artificial Sequence
  Synthetic oligonucleotide; ATGGGT chr11 5207496 5207515 5207499 -
tttatttacataaataaaag

SEQ ID NO: 63447 - DNA, 20 bp, Artificial Sequence
  Synthetic oligonucleotide; TAGGGT chr11 5207469 5207488 5207472 -
tgtcacacaatttaaaaatc

SEQ ID NO: 63448 - DNA, 20 bp, Artificial Sequence
  Synthetic oligonucleotide; GGGGAT chr11 5207353 5207372 5207356 -
ttgcctcaaataatccctgt

SEQ ID NO: 63449 - DNA, 20 bp, Artificial Sequence
  Synthetic oligonucleotide; ACGAGT chr11 5207282 5207301 5207285 -
atcctagcaataatatcctg

SEQ ID NO: 63450 - DNA, 20 bp, Artificial Sequence
  Synthetic oligonucleotide; TGGAAT chr11 5207194 5207213 5207197 -
atccctcatttggttgaggt

SEQ ID NO: 63451 - DNA, 20 bp, Artificial Sequence
  Synthetic oligonucleotide; ATGGGT chr11 5207184 5207203 5207187 -
tggttgaggttggaatttca

SEQ ID NO: 63452 - DNA, 20 bp, Artificial Sequence
  Synthetic oligonucleotide; GTGGGT chr11 5207180 5207199 5207183 -
tgaggttggaatttcaatgg

SEQ ID NO: 63453 - DNA, 20 bp, Artificial Sequence
  Synthetic oligonucleotide; TTGAAT chr11 5207175 5207194 5207178 -
ttggaatttcaatgggtggg

SEQ ID NO: 63454 - DNA, 20 bp, Artificial Sequence
  Synthetic oligonucleotide; TTGGGT chr11 5207011 5207030 5207014 -
cccttcttgtctttggggac

SEQ ID NO: 63455 - DNA, 20 bp, Artificial Sequence
  Synthetic oligonucleotide; TTGAAT chr11 5206972 5206991 5206975 -
taggagatttcgccaggcat

SEQ ID NO: 63456 - DNA, 20 bp, Artificial Sequence
  Synthetic oligonucleotide; CAGAAT chr11 5206902 5206921 5206905 -
tctctcctatgttctgaggt

SEQ ID NO: 63457 - DNA, 20 bp, Artificial Sequence
  Synthetic oligonucleotide; GGGGAT chr11 5206829 5206848 5206832 -
tagtcatgatctcctctgtt

SEQ ID NO: 63458 - DNA, 20 bp, Artificial Sequence
  Synthetic oligonucleotide; GTGAAT chr11 5206681 5206700 5206684 -
acataaataattatggtaat

SEQ ID NO: 63459 - DNA, 20 bp, Artificial Sequence
  Synthetic oligonucleotide; TGGAGT chr11 5206457 5206476 5206460 -
ccctggagaaaaattggacc

SEQ ID NO: 63460 - DNA, 20 bp, Artificial Sequence
  Synthetic oligonucleotide; ATGGGT chr11 5206437 5206456 5206440 -
tggagtctagcagcctaggt

SEQ ID NO: 63461 - DNA, 20 bp, Artificial Sequence
  Synthetic oligonucleotide; AAGGGT chr11 5206385 5206404 5206388 -
atttcctttatcttaaaaat

SEQ ID NO: 63462 - DNA, 20 bp, Artificial Sequence
  Synthetic oligonucleotide; TAGAAT chr11 5206372 5206391 5206375 -
taaaaataagggtattgaag

SEQ ID NO: 63463 - DNA, 20 bp, Artificial Sequence
  Synthetic oligonucleotide; TAGAAT chr11 5206364 5206383 5206367 -
agggtattgaagtagaattc

SEQ ID NO: 63464 - DNA, 20 bp, Artificial Sequence
  Synthetic oligonucleotide; AAGGAT chr11 5206278 5206297 5206281 -
ctgttcattttaatatattt

SEQ ID NO: 63465 - DNA, 20 bp, Artificial Sequence
  Synthetic oligonucleotide; ATGAAT chr11 5206274 5206293 5206277 -
tcattttaatatatttaagg

SEQ ID NO: 63466 - DNA, 20 bp, Artificial Sequence
  Synthetic oligonucleotide; GGGAAT chr11 5206241 5206260 5206244 -
aaagttgatttcataaaaac

SEQ ID NO: 63467 - DNA, 20 bp, Artificial Sequence
  Synthetic oligonucleotide; GAGAGT chr11 5206210 5206229 5206213 -
gatggttccataggctgact

SEQ ID NO: 63468 - DNA, 20 bp, Artificial Sequence
  Synthetic oligonucleotide; AGGGAT chr11 5206197 5206216 5206200 -
gctgactgagagtgtagagg

SEQ ID NO: 63469 - DNA, 20 bp, Artificial Sequence
  Synthetic oligonucleotide; AGGAAT chr11 5206156 5206175 5206159 -
ttgatcttcagttagactag

SEQ ID NO: 63470 - DNA, 20 bp, Artificial Sequence
  Synthetic oligonucleotide; GGGAAT chr11 5205539 5205558 5205542 -
aaaaatattttagtaatgat

SEQ ID NO: 63471 - DNA, 20 bp, Artificial Sequence
  Synthetic oligonucleotide; CAGAAT chr11 5205140 5205159 5205143 -
tctctctgaactagcatatt

SEQ ID NO: 63472 - DNA, 20 bp, Artificial Sequence
  Synthetic oligonucleotide; TAGAAT chr11 5205102 5205121 5205105 -
agttctttggacaagtctta

SEQ ID NO: 63473 - DNA, 20 bp, Artificial Sequence
  Synthetic oligonucleotide; AGGAAT chr11 5204946 5204965 5204949 -
tgtccagaaaagaccattaa

SEQ ID NO: 63474 - DNA, 20 bp, Artificial Sequence
  Synthetic oligonucleotide; AAGGAT chr11 5204932 5204951 5204935 -
cattaaaggaatgaccttta

SEQ ID NO: 63475 - DNA, 20 bp, Artificial Sequence
  Synthetic oligonucleotide; GTGGGT chr11 5204892 5204911 5204895 -
ttgtccaaggcaggacatgt

SEQ ID NO: 63476 - DNA, 20 bp, Artificial Sequence
  Synthetic oligonucleotide; AGGAAT chr11 5204832 5204851 5204835 -
actccactgccttggcaaat

SEQ ID NO: 63477 - DNA, 20 bp, Artificial Sequence
  Synthetic oligonucleotide; TAGAAT chr11 5204814 5204833 5204817 -
ataggaatgttttagttcta

SEQ ID NO: 63478 - DNA, 20 bp, Artificial Sequence
  Synthetic oligonucleotide; GGGAAT chr11 5204707 5204726 5204710 -
agtaagcaagtaatcacaca

SEQ ID NO: 63479 - DNA, 20 bp, Artificial Sequence
  Synthetic oligonucleotide; AAGAAT chr11 5204610 5204629 5204613 -
gcatcagaaaagactcctga

SEQ ID NO: 63480 - DNA, 20 bp, Artificial Sequence
  Synthetic oligonucleotide; GGGGAT chr11 5204544 5204563 5204547 -
cattccagacagtgctcaga

SEQ ID NO: 63481 - DNA, 20 bp, Artificial Sequence
  Synthetic oligonucleotide; ATGGAT chr11 5204180 5204199 5204183 -
atagtctctatggtggcaac

SEQ ID NO: 63482 - DNA, 20 bp, Artificial Sequence
  Synthetic oligonucleotide; CTGAAT chr11 5204119 5204138 5204122 -
tgtatctagtctgaagaagc

SEQ ID NO: 63483 - DNA, 20 bp, Artificial Sequence
  Synthetic oligonucleotide; CAGAGT chr11 5204019 5204038 5204022 -
attttttttttcctttggga

SEQ ID NO: 63484 - DNA, 20 bp, Artificial Sequence
  Synthetic oligonucleotide; TGGAGT chr11 5203994 5204013 5203997 -
tcttgctctgtcgcccagac

SEQ ID NO: 63485 - DNA, 20 bp, Artificial Sequence
  Synthetic oligonucleotide; CAGGAT chr11 5203949 5203968 5203952 -
tcactgcaacttccacctcc

SEQ ID NO: 63486 - DNA, 20 bp, Artificial Sequence
  Synthetic oligonucleotide; TGGGAT chr11 5203909 5203928 5203912 -
gcctcagtctcccaagtaac

SEQ ID NO: 63487 - DNA, 20 bp, Artificial Sequence
  Synthetic oligonucleotide; CAGGGT chr11 5203851 5203870 5203854 -
tttttgtgttttagtagaga

SEQ ID NO: 63488 - DNA, 20 bp, Artificial Sequence
  Synthetic oligonucleotide; TAGGAT chr11 5203772 5203791 5203775 -
gcctcggcctcccaaagtgc

SEQ ID NO: 63489 - DNA, 20 bp, Artificial Sequence
  Synthetic oligonucleotide; CAGAAT chr11 5203705 5203724 5203708 -
ttaacacatacctacattca

SEQ ID NO: 63490 - DNA, 20 bp, Artificial Sequence
  Synthetic oligonucleotide; CTGAGT chr11 5203657 5203676 5203660 -
ccagatccttgacgatatgt

SEQ ID NO: 63491 - DNA, 20 bp, Artificial Sequence
  Synthetic oligonucleotide; TGGAGT chr11 5203618 5203637 5203621 -
agagaaatcatgtttgaaat

SEQ ID NO: 63492 - DNA, 20 bp, Artificial Sequence
  Synthetic oligonucleotide; AGGAGT chr11 5203474 5203493 5203477 -
gattttacacacactttgat

SEQ ID NO: 63493 - DNA, 20 bp, Artificial Sequence
  Synthetic oligonucleotide; TAGAAT chr11 5203416 5203435 5203419 -
attgtctagctcttatttca

SEQ ID NO: 63494 - DNA, 20 bp, Artificial Sequence
  Synthetic oligonucleotide; ATGAAT chr11 5203306 5203325 5203309 -
ctaatcttctacagcctcta

SEQ ID NO: 63495 - DNA, 20 bp, Artificial Sequence
  Synthetic oligonucleotide; GAGAGT chr11 5203244 5203263 5203247 -
ataaactagtatactgtgat

SEQ ID NO: 63496 - DNA, 20 bp, Artificial Sequence
  Synthetic oligonucleotide; GGGGGT chr11 5203227 5203246 5203230 -
gatgagagtaagttagttaa

SEQ ID NO: 63497 - DNA, 20 bp, Artificial Sequence
  Synthetic oligonucleotide; AGGAAT chr11 5203133 5203152 5203136 -
actcaaaagttaatggtgaa

SEQ ID NO: 63498 - DNA, 20 bp, Artificial Sequence
  Synthetic oligonucleotide; TGGGGT chr11 5203112 5203131 5203115 -
ggaattgctgtgcaaatact

SEQ ID NO: 63499 - DNA, 20 bp, Artificial Sequence
  Synthetic oligonucleotide; AGGAGT chr11 5203011 5203030 5203014 -
ataaagatacctaaatatta

SEQ ID NO: 63500 - DNA, 20 bp, Artificial Sequence
  Synthetic oligonucleotide; AAGAAT chr11 5202930 5202949 5202933 -
aaggctttttgactatgata

SEQ ID NO: 63501 - DNA, 20 bp, Artificial Sequence
  Synthetic oligonucleotide; ATGGGT chr11 5202903 5202922 5202906 -
tgtattttacattacgagca

SEQ ID NO: 63502 - DNA, 20 bp, Artificial Sequence
  Synthetic oligonucleotide; AAGAGT chr11 5202885 5202904 5202888 -
caatgggtaagtgaccatca

SEQ ID NO: 63503 - DNA, 20 bp, Artificial Sequence
  Synthetic oligonucleotide; TGGGAT chr11 5202665 5202684 5202668 -
tgtgtaaaagtgggcctatc

SEQ ID NO: 63504 - DNA, 20 bp, Artificial Sequence
  Synthetic oligonucleotide; TGGAGT chr11 5202535 5202554 5202538 -
ttatgcaattgtgttattgg

SEQ ID NO: 63505 - DNA, 20 bp, Artificial Sequence
  Synthetic oligonucleotide; ATGAAT chr11 5202430 5202449 5202433 -
ttttaagattaaacactcag

SEQ ID NO: 63506 - DNA, 20 bp, Artificial Sequence
  Synthetic oligonucleotide; ATGAAT chr11 5202401 5202420 5202404 -
ttaaatagccagttgtattc

SEQ ID NO: 63507 - DNA, 20 bp, Artificial Sequence
  Synthetic oligonucleotide; AGGAGT chr11 5202385 5202404 5202388 -
attcatgaatttgagctctc

SEQ ID NO: 63508 - DNA, 20 bp, Artificial Sequence
  Synthetic oligonucleotide; AGGAAT chr11 5202375 5202394 5202378 -
ttgagctctcaggagtggtc

SEQ ID NO: 63509 - DNA, 20 bp, Artificial Sequence
  Synthetic oligonucleotide; GAGAAT chr11 5202304 5202323 5202307 -
agtctgcacattaaggaact

SEQ ID NO: 63510 - DNA, 20 bp, Artificial Sequence
  Synthetic oligonucleotide; ATGGAT chr11 5202176 5202195 5202179 -
gataccaaaataatagatat

SEQ ID NO: 63511 - DNA, 20 bp, Artificial Sequence
  Synthetic oligonucleotide; TTGAGT chr11 5202135 5202154 5202138 -
aacttcttgaaaagtgattg

SEQ ID NO: 63512 - DNA, 20 bp, Artificial Sequence
  Synthetic oligonucleotide; AAGGGT chr11 5202112 5202131 5202115 -
agttgcaagatcgttttaaa

SEQ ID NO: 63513 - DNA, 20 bp, Artificial Sequence
  Synthetic oligonucleotide; ATGAAT chr11 5202083 5202102 5202086 -
aagaaattgaggaaaagatg

SEQ ID NO: 63514 - DNA, 20 bp, Artificial Sequence
  Synthetic oligonucleotide; AGGAGT chr11 5201894 5201913 5201897 -
taagttattcaatgctgaga

SEQ ID NO: 63515 - DNA, 20 bp, Artificial Sequence
  Synthetic oligonucleotide; GAGAGT chr11 5201837 5201856 5201840 -
gaagacgtcagtgtagtata

SEQ ID NO: 63516 - DNA, 20 bp, Artificial Sequence
  Synthetic oligonucleotide; TTGAAT chr11 5201485 5201504 5201488 -
aaacacaattggccaataca

SEQ ID NO: 63517 - DNA, 20 bp, Artificial Sequence
  Synthetic oligonucleotide; TTGAAT chr11 5201470 5201489 5201473 -
atacattgaataaatgtata

SEQ ID NO: 63518 - DNA, 20 bp, Artificial Sequence
  Synthetic oligonucleotide; CTGAAT chr11 5201442 5201461 5201445 -
atagttaatcagctcattaa

SEQ ID NO: 63519 - DNA, 20 bp, Artificial Sequence
  Synthetic oligonucleotide; AGGAAT chr11 5201430 5201449 5201433 -
ctcattaactgaataaataa

SEQ ID NO: 63520 - DNA, 20 bp, Artificial Sequence
  Synthetic oligonucleotide; ATGAGT chr11 5201356 5201375 5201359 -
tctacatcacaaaggcacaa

SEQ ID NO: 63521 - DNA, 20 bp, Artificial Sequence
  Synthetic oligonucleotide; AGGAGT chr11 5201218 5201237 5201221 -
catctggagggggagaaaac

SEQ ID NO: 63522 - DNA, 20 bp, Artificial Sequence
  Synthetic oligonucleotide; TCGAAT chr11 5201091 5201110 5201094 -
cccaaagattactcttcact

SEQ ID NO: 63523 - DNA, 20 bp, Artificial Sequence
  Synthetic oligonucleotide; ATGAAT chr11 5201080 5201099 5201083 -
ctcttcacttcgaatgttta

SEQ ID NO: 63524 - DNA, 20 bp, Artificial Sequence
  Synthetic oligonucleotide; AAGGAT chr11 5200918 5200937 5200921 -
tgtttttgcttatggcttct

SEQ ID NO: 63525 - DNA, 20 bp, Artificial Sequence
  Synthetic oligonucleotide; ATGGAT chr11 5200839 5200858 5200842 -
agaccattttctcaaaggca

SEQ ID NO: 63526 - DNA, 20 bp, Artificial Sequence
  Synthetic oligonucleotide; CAGAAT chr11 5200816 5200835 5200819 -
gatactatgtctcaaagaaa

SEQ ID NO: 63527 - DNA, 20 bp, Artificial Sequence
  Synthetic oligonucleotide; TAGGGT chr11 5200778 5200797 5200781 -
ttttttaagtcagtaagttt

SEQ ID NO: 63528 - DNA, 20 bp, Artificial Sequence
  Synthetic oligonucleotide; CAGAAT chr11 5200687 5200706 5200690 -
tctcacatgtttctcagttc

SEQ ID NO: 63529 - DNA, 20 bp, Artificial Sequence
  Synthetic oligonucleotide; ACGAAT chr11 5200653 5200672 5200656 -
cagtaagccctagcaccagc

SEQ ID NO: 63530 - DNA, 20 bp, Artificial Sequence
  Synthetic oligonucleotide; CTGGAT chr11 5200631 5200650 5200634 -
gaattcttcctttcttctca

SEQ ID NO: 63531 - DNA, 20 bp, Artificial Sequence
  Synthetic oligonucleotide; GGGGAT chr11 5200429 5200448 5200432 -
tccactgtgtacacagtgct

SEQ ID NO: 63532 - DNA, 20 bp, Artificial Sequence
  Synthetic oligonucleotide; GGGGAT chr11 5200417 5200436 5200420 -
acagtgctggggatcctgtg

SEQ ID NO: 63533 - DNA, 20 bp, Artificial Sequence
  Synthetic oligonucleotide; TTGGAT chr11 5200395 5200414 5200398 -
ggatcattcgagagatcagc

SEQ ID NO: 63534 - DNA, 20 bp, Artificial Sequence
  Synthetic oligonucleotide; TGGAGT chr11 5200346 5200365 5200349 -
catccatggtctgtccttca

SEQ ID NO: 63535 - DNA, 20 bp, Artificial Sequence
  Synthetic oligonucleotide; CAGAAT chr11 5200258 5200277 5200261 -
tcctccatcctgactaattc

SEQ ID NO: 63536 - DNA, 20 bp, Artificial Sequence
  Synthetic oligonucleotide; AGGAGT chr11 5200224 5200243 5200227 -
ttgggctcactataataggt

SEQ ID NO: 63537 - DNA, 20 bp, Artificial Sequence
  Synthetic oligonucleotide; CAGGAT chr11 5200131 5200150 5200134 -
ctcactctttctgcctgcac

SEQ ID NO: 63538 - DNA, 20 bp, Artificial Sequence
  Synthetic oligonucleotide; TTGGAT chr11 5200050 5200069 5200053 -
tggttatttgcatactgttg

SEQ ID NO: 63539 - DNA, 20 bp, Artificial Sequence
  Synthetic oligonucleotide; ATGAAT chr11 5199816 5199835 5199819 -
acatccttttcccaccttta

SEQ ID NO: 63540 - DNA, 20 bp, Artificial Sequence
  Synthetic oligonucleotide; CAGAAT chr11 5199772 5199791 5199775 -
aagacccaacagattcatac

SEQ ID NO: 63541 - DNA, 20 bp, Artificial Sequence
  Synthetic oligonucleotide; CTGAGT chr11 5199628 5199647 5199631 -
attaaaattgtagatttact

SEQ ID NO: 63542 - DNA, 20 bp, Artificial Sequence
  Synthetic oligonucleotide; GAGAAT chr11 5199583 5199602 5199586 -
aaaatatttaaatatagtca

SEQ ID NO: 63543 - DNA, 20 bp, Artificial Sequence
  Synthetic oligonucleotide; CTGGAT chr11 5199441 5199460 5199444 -
tcctttgctgtaaaacaaag

SEQ ID NO: 63544 - DNA, 20 bp, Artificial Sequence
  Synthetic oligonucleotide; AGGAAT chr11 5199331 5199350 5199334 -
ggagactatagccaactcac

SEQ ID NO: 63545 - DNA, 20 bp, Artificial Sequence
  Synthetic oligonucleotide; CAGAAT chr11 5199305 5199324 5199308 -
gttgtgatatctgtatggac

SEQ ID NO: 63546 - DNA, 20 bp, Artificial Sequence
  Synthetic oligonucleotide; TGGAAT chr11 5199236 5199255 5199239 -
ataccataaaatggctaaag

SEQ ID NO: 63547 - DNA, 20 bp, Artificial Sequence
  Synthetic oligonucleotide; TTGGAT chr11 5199046 5199065 5199049 -
ggacacaaagaaatatgact

SEQ ID NO: 63548 - DNA, 20 bp, Artificial Sequence
  Synthetic oligonucleotide; TAGAAT chr11 5199013 5199032 5199016 -
ctaccatgtctaatttaaat

SEQ ID NO: 63549 - DNA, 20 bp, Artificial Sequence
  Synthetic oligonucleotide; GGGGAT chr11 5198918 5198937 5198921 -
tttgcttttatatctaagtg

SEQ ID NO: 63550 - DNA, 20 bp, Artificial Sequence
  Synthetic oligonucleotide; CTGAGT chr11 5198875 5198894 5198878 -
ctgtccgctaccgacttatt

SEQ ID NO: 63551 - DNA, 20 bp, Artificial Sequence
  Synthetic oligonucleotide; ATGGAT chr11 5198763 5198782 5198766 -
aatcaggtacaaaactatgc

SEQ ID NO: 63552 - DNA, 20 bp, Artificial Sequence
  Synthetic oligonucleotide; AAGAGT chr11 5198673 5198692 5198676 -
aattggacaaattaatgcat

SEQ ID NO: 63553 - DNA, 20 bp, Artificial Sequence
  Synthetic oligonucleotide; CAGAGT chr11 5198453 5198472 5198456 -
gtgaggaaattgtttctgga

SEQ ID NO: 63554 - DNA, 20 bp, Artificial Sequence
  Synthetic oligonucleotide; CTGGGT chr11 5198388 5198407 5198391 -
agaacaataaattaggtctt

SEQ ID NO: 63555 - DNA, 20 bp, Artificial Sequence
  Synthetic oligonucleotide; AAGGAT chr11 5198362 5198381 5198365 -
tacagtataaggttaatttg

SEQ ID NO: 63556 - DNA, 20 bp, Artificial Sequence
  Synthetic oligonucleotide; AGGAGT chr11 5198354 5198373 5198357 -
aaggttaatttgaaggataa

SEQ ID NO: 63557 - DNA, 20 bp, Artificial Sequence
  Synthetic oligonucleotide; GTGAAT chr11 5198350 5198369 5198353 -
ttaatttgaaggataaagga

SEQ ID NO: 63558 - DNA, 20 bp, Artificial Sequence
  Synthetic oligonucleotide; GAGGAT chr11 5198330 5198349 5198333 -
gtgaatttcctgatgtcaaa

SEQ ID NO: 63559 - DNA, 20 bp, Artificial Sequence
  Synthetic oligonucleotide; GCGGAT chr11 5198210 5198229 5198213 -
catagtagctgccgaggcgg

SEQ ID NO: 63560 - DNA, 20 bp, Artificial Sequence
  Synthetic oligonucleotide; GAGAAT chr11 5198073 5198092 5198076 -
tactcgggaggctgagacag

SEQ ID NO: 63561 - DNA, 20 bp, Artificial Sequence
  Synthetic oligonucleotide; GTGAGT chr11 5198039 5198058 5198042 -
cccgggaggtggagcttgca

SEQ ID NO: 63562 - DNA, 20 bp, Artificial Sequence
  Synthetic oligonucleotide; ATGAAT chr11 5197941 5197960 5197944 -
aaaaaaaaagaaaagttgat

SEQ ID NO: 63563 - DNA, 20 bp, Artificial Sequence
  Synthetic oligonucleotide; TGGAAT chr11 5197867 5197886 5197870 -
catggtccctcctggccgac

SEQ ID NO: 63564 - DNA, 20 bp, Artificial Sequence
  Synthetic oligonucleotide; CTGAAT chr11 5197802 5197821 5197805 -
atgaaaagagaagttagctg

SEQ ID NO: 63565 - DNA, 20 bp, Artificial Sequence
  Synthetic oligonucleotide; GTGAAT chr11 5197783 5197802 5197786 -
gctgaatctgtagaggtcat

SEQ ID NO: 63566 - DNA, 20 bp, Artificial Sequence
  Synthetic oligonucleotide; GTGAAT chr11 5197726 5197745 5197729 -
ttccttctaatgctttgaaa

SEQ ID NO: 63567 - DNA, 20 bp, Artificial Sequence
  Synthetic oligonucleotide; GAGAAT chr11 5197669 5197688 5197672 -
gacacaacactggggaagca

SEQ ID NO: 63568 - DNA, 20 bp, Artificial Sequence
  Synthetic oligonucleotide; CAGAAT chr11 5197613 5197632 5197616 -
agccactcatagggaagcat

SEQ ID NO: 63569 - DNA, 20 bp, Artificial Sequence
  Synthetic oligonucleotide; ATGAAT chr11 5197609 5197628 5197612 -
actcatagggaagcatcaga

SEQ ID NO: 63570 - DNA, 20 bp, Artificial Sequence
  Synthetic oligonucleotide; CTGAGT chr11 5197563 5197582 5197566 -
atattacatgtctgacacaa

SEQ ID NO: 63571 - DNA, 20 bp, Artificial Sequence
  Synthetic oligonucleotide; GAGAGT chr11 5197548 5197567 5197551 -
cacaactgagttgttggttt

SEQ ID NO: 63572 - DNA, 20 bp, Artificial Sequence
  Synthetic oligonucleotide; GAGAGT chr11 5197529 5197548 5197532 -
tgagagttatgtttaacagg

SEQ ID NO: 63573 - DNA, 20 bp, Artificial Sequence
  Synthetic oligonucleotide; ATGAGT chr11 5197495 5197514 5197498 -
tcatctgaagacttcatact

SEQ ID NO: 63574 - DNA, 20 bp, Artificial Sequence
  Synthetic oligonucleotide; TAGAAT chr11 5197463 5197482 5197466 -
gcttcagattaggcaaccta

SEQ ID NO: 63575 - DNA, 20 bp, Artificial Sequence
  Synthetic oligonucleotide; AAGAGT chr11 5197400 5197419 5197403 -
acagttaataaaaaatacct

SEQ ID NO: 63576 - DNA, 20 bp, Artificial Sequence
  Synthetic oligonucleotide; CAGAAT chr11 5197324 5197343 5197327 -
ataagatttatgaagaactt

SEQ ID NO: 63577 - DNA, 20 bp, Artificial Sequence
  Synthetic oligonucleotide; ATGAAT chr11 5196957 5196976 5196960 -
tctaaggaaacttgttttcc

SEQ ID NO: 63578 - DNA, 20 bp, Artificial Sequence
  Synthetic oligonucleotide; CAGGAT chr11 5196553 5196572 5196556 -
agaagtgagaggacatgatt

SEQ ID NO: 63579 - DNA, 20 bp, Artificial Sequence
  Synthetic oligonucleotide; CAGGAT chr11 5196410 5196429 5196413 -
ggtgcaggagggcatggttt

SEQ ID NO: 63580 - DNA, 20 bp, Artificial Sequence
  Synthetic oligonucleotide; GAGAAT chr11 5196327 5196346 5196330 -
gatcccttgcatgcctctat

SEQ ID NO: 63581 - DNA, 20 bp, Artificial Sequence
  Synthetic oligonucleotide; TAGGAT chr11 5196102 5196121 5196105 -
gaggttgtgtctccattccc

SEQ ID NO: 63582 - DNA, 20 bp, Artificial Sequence
  Synthetic oligonucleotide; TAGAGT chr11 5196064 5196083 5196067 -
tacttgcagaagataattgc

SEQ ID NO: 63583 - DNA, 20 bp, Artificial Sequence
  Synthetic oligonucleotide; GTGAAT chr11 5196057 5196076 5196060 -
agaagataattgctagagta

SEQ ID NO: 63584 - DNA, 20 bp, Artificial Sequence
  Synthetic oligonucleotide; AGGAGT chr11 5195949 5195968 5195952 -
gccaagaacacccctgcagt

SEQ ID NO: 63585 - DNA, 20 bp, Artificial Sequence
  Synthetic oligonucleotide; AGGAAT chr11 5195836 5195855 5195839 -
tcaggttgcagccagaactg

SEQ ID NO: 63586 - DNA, 20 bp, Artificial Sequence
  Synthetic oligonucleotide; CTGAGT chr11 5195782 5195801 5195785 -
gtaatgttctctttcttggt

SEQ ID NO: 63587 - DNA, 20 bp, Artificial Sequence
  Synthetic oligonucleotide; CTGAAT chr11 5195705 5195724 5195708 -
tatttatgtatttttctgta

SEQ ID NO: 63588 - DNA, 20 bp, Artificial Sequence
  Synthetic oligonucleotide; ATGAGT chr11 5195676 5195695 5195679 -
aaaatataaatttaagaaat

SEQ ID NO: 63589 - DNA, 20 bp, Artificial Sequence
  Synthetic oligonucleotide; CTGAAT chr11 5195638 5195657 5195641 -
ttacatataaacctggcaga

SEQ ID NO: 63590 - DNA, 20 bp, Artificial Sequence
  Synthetic oligonucleotide; CAGGAT chr11 5195495 5195514 5195498 -
tgattttttaaaaaacagaa

SEQ ID NO: 63591 - DNA, 20 bp, Artificial Sequence
  Synthetic oligonucleotide; AAGGAT chr11 5195463 5195482 5195466 -
aaatctatatgtctacagaa

SEQ ID NO: 63592 - DNA, 20 bp, Artificial Sequence
  Synthetic oligonucleotide; AGGGGT chr11 5195383 5195402 5195386 -
ttacttataaagcattcgtg

SEQ ID NO: 63593 - DNA, 20 bp, Artificial Sequence
  Synthetic oligonucleotide; GTGAAT chr11 5195355 5195374 5195358 -
ggctaaaaatggtagaaaag

SEQ ID NO: 63594 - DNA, 20 bp, Artificial Sequence
  Synthetic oligonucleotide; AAGGAT chr11 5195230 5195249 5195233 -
acactgggaaattcagtgca

SEQ ID NO: 63595 - DNA, 20 bp, Artificial Sequence
  Synthetic oligonucleotide; AAGAAT chr11 5195181 5195200 5195184 -
gaaacagagagattatgcaa

SEQ ID NO: 63596 - DNA, 20 bp, Artificial Sequence
  Synthetic oligonucleotide; TTGAAT chr11 5195170 5195189 5195173 -
attatgcaaaagaatacata

SEQ ID NO: 63597 - DNA, 20 bp, Artificial Sequence
  Synthetic oligonucleotide; TTGAGT chr11 5195120 5195139 5195123 -
ggactaatagatattggcat

SEQ ID NO: 63598 - DNA, 20 bp, Artificial Sequence
  Synthetic oligonucleotide; CTGGAT chr11 5195105 5195124 5195108 -
ggcatttgagtattcgctta

SEQ ID NO: 63599 - DNA, 20 bp, Artificial Sequence
  Synthetic oligonucleotide; TAGGGT chr11 5194971 5194990 5194974 -
tattattatactttaagttt

SEQ ID NO: 63600 - DNA, 20 bp, Artificial Sequence
  Synthetic oligonucleotide; CAGAGT chr11 5194826 5194845 5194829 -
ccccaccccacaacagtccc

SEQ ID NO: 63601 - DNA, 20 bp, Artificial Sequence
  Synthetic oligonucleotide; ATGAGT chr11 5194769 5194788 5194772 -
tcattgttcaattcccacct

SEQ ID NO: 63602 - DNA, 20 bp, Artificial Sequence
  Synthetic oligonucleotide; GAGAAT chr11 5194719 5194738 5194722 -
cgtccttgcgatagtttact

SEQ ID NO: 63603 - DNA, 20 bp, Artificial Sequence
  Synthetic oligonucleotide; TTGGGT chr11 5194589 5194608 5194592 -
agtctatcattgttggacat

SEQ ID NO: 63604 - DNA, 20 bp, Artificial Sequence
  Synthetic oligonucleotide; GTGAAT chr11 5194562 5194581 5194565 -
ggttccaagtctttgctatt

SEQ ID NO: 63605 - DNA, 20 bp, Artificial Sequence
  Synthetic oligonucleotide; AAGAAT chr11 5194477 5194496 5194480 -
atatttcatggtgaggaaca

SEQ ID NO: 63606 - DNA, 20 bp, Artificial Sequence
  Synthetic oligonucleotide; GGGGAT chr11 5194466 5194485 5194469 -
tgaggaacaaagaatatggt

SEQ ID NO: 63607 - DNA, 20 bp, Artificial Sequence
  Synthetic oligonucleotide; AAGGAT chr11 5194278 5194297 5194281 -
agaacttttgtgtctagcta

SEQ ID NO: 63608 - DNA, 20 bp, Artificial Sequence
  Synthetic oligonucleotide; CAGGAT chr11 5194140 5194159 5194143 -
ctgtaaaatggaccaatcag

SEQ ID NO: 63609 - DNA, 20 bp, Artificial Sequence
  Synthetic oligonucleotide; GTGGGT chr11 5194134 5194153 5194137 -
aatggaccaatcagcaggat

SEQ ID NO: 63610 - DNA, 20 bp, Artificial Sequence
  Synthetic oligonucleotide; TGGGGT chr11 5194129 5194148 5194132 -
accaatcagcaggatgtggg

SEQ ID NO: 63611 - DNA, 20 bp, Artificial Sequence
  Synthetic oligonucleotide; TTGGGT chr11 5194074 5194093 5194077 -
agccagctgtgacaactgac

SEQ ID NO: 63612 - DNA, 20 bp, Artificial Sequence
  Synthetic oligonucleotide; TTGGAT chr11 5194002 5194021 5194005 -
atcttactgctgctcactct

SEQ ID NO: 63613 - DNA, 20 bp, Artificial Sequence
  Synthetic oligonucleotide; GGGGAT chr11 5193911 5193930 5193914 -
aagaccacgaacccagcatg

SEQ ID NO: 63614 - DNA, 20 bp, Artificial Sequence
  Synthetic oligonucleotide; AGGAAT chr11 5193888 5193907 5193891 -
gatgaacaacccaagacagg

SEQ ID NO: 63615 - DNA, 20 bp, Artificial Sequence
  Synthetic oligonucleotide; GGGGGT chr11 5193836 5193855 5193839 -
agagctgtaacactccccgt

SEQ ID NO: 63616 - DNA, 20 bp, Artificial Sequence
  Synthetic oligonucleotide; AAGAAT chr11 5193716 5193735 5193719 -
cctttgaacacaccatcttt

SEQ ID NO: 63617 - DNA, 20 bp, Artificial Sequence
  Synthetic oligonucleotide; GAGGGT chr11 5193695 5193714 5193698 -
agaattgtaacactcaccac

SEQ ID NO: 63618 - DNA, 20 bp, Artificial Sequence
  Synthetic oligonucleotide; AAGGAT chr11 5193633 5193652 5193636 -
cccaccaattccggacacag

SEQ ID NO: 63619 - DNA, 20 bp, Artificial Sequence
  Synthetic oligonucleotide; AGGAAT chr11 5193613 5193632 5193616 -
aaggatggacaaagattatc

SEQ ID NO: 63620 - DNA, 20 bp, Artificial Sequence
  Synthetic oligonucleotide; TAGAAT chr11 5193573 5193592 5193576 -
caacacaaaaattacatacc

SEQ ID NO: 63621 - DNA, 20 bp, Artificial Sequence
  Synthetic oligonucleotide; CAGAAT chr11 5193436 5193455 5193439 -
ttagatccttgatatttgaa

SEQ ID NO: 63622 - DNA, 20 bp, Artificial Sequence
  Synthetic oligonucleotide; AAGAGT chr11 5193336 5193355 5193339 -
gggggacaggaagtagattt

SEQ ID NO: 63623 - DNA, 20 bp, Artificial Sequence
  Synthetic oligonucleotide; AGGAAT chr11 5193313 5193332 5193316 -
agtgcagaaaaaaaggacaa

SEQ ID NO: 63624 - DNA, 20 bp, Artificial Sequence
  Synthetic oligonucleotide; TAGGGT chr11 5193281 5193300 5193284 -
ggggggcatggaggaaaaaa

SEQ ID NO: 63625 - DNA, 20 bp, Artificial Sequence
  Synthetic oligonucleotide; TGGAGT chr11 5193249 5193268 5193252 -
aggaactccaaaatcttaac

SEQ ID NO: 63626 - DNA, 20 bp, Artificial Sequence
  Synthetic oligonucleotide; GAGAGT chr11 5193237 5193256 5193240 -
atcttaactggagttcagga

SEQ ID NO: 63627 - DNA, 20 bp, Artificial Sequence
  Synthetic oligonucleotide; GAGAGT chr11 5193150 5193169 5193153 -
agaacacagcagttgaaatt

SEQ ID NO: 63628 - DNA, 20 bp, Artificial Sequence
  Synthetic oligonucleotide; GAGAAT chr11 5193089 5193108 5193092 -
aaaaattcatggtaagttaa

SEQ ID NO: 63629 - DNA, 20 bp, Artificial Sequence
  Synthetic oligonucleotide; AGGGAT chr11 5192741 5192760 5192744 -
aactctcacttattgcttgt

SEQ ID NO: 63630 - DNA, 20 bp, Artificial Sequence
  Synthetic oligonucleotide; ATGAGT chr11 5192637 5192656 5192640 -
actcctatgtatttacccaa

SEQ ID NO: 63631 - DNA, 20 bp, Artificial Sequence
  Synthetic oligonucleotide; ATGAAT chr11 5192544 5192563 5192547 -
aaaagttgaaagtaaccaag

SEQ ID NO: 63632 - DNA, 20 bp, Artificial Sequence
  Synthetic oligonucleotide; ATGGAT chr11 5192540 5192559 5192543 -
gttgaaagtaaccaagatga

SEQ ID NO: 63633 - DNA, 20 bp, Artificial Sequence
  Synthetic oligonucleotide; TAGGAT chr11 5192517 5192536 5192520 -
gataaactgtggaacatcca

SEQ ID NO: 63634 - DNA, 20 bp, Artificial Sequence
  Synthetic oligonucleotide; TAGAAT chr11 5192512 5192531 5192515 -
actgtggaacatccatagga

SEQ ID NO: 63635 - DNA, 20 bp, Artificial Sequence
  Synthetic oligonucleotide; GTGAAT chr11 5192275 5192294 5192278 -
tattcaataatagacaaata

SEQ ID NO: 63636 - DNA, 20 bp, Artificial Sequence
  Synthetic oligonucleotide; TAGAAT chr11 5192225 5192244 5192228 -
agtttcagacagctattgca

SEQ ID NO: 63637 - DNA, 20 bp, Artificial Sequence
  Synthetic oligonucleotide; ATGAGT chr11 5192094 5192113 5192097 -
ggtttcatgtcactttggac

SEQ ID NO: 63638 - DNA, 20 bp, Artificial Sequence
  Synthetic oligonucleotide; AGGAGT chr11 5192084 5192103 5192087 -
cactttggacatgagtaaag

SEQ ID NO: 63639 - DNA, 20 bp, Artificial Sequence
  Synthetic oligonucleotide; TTGAGT chr11 5192048 5192067 5192051 -
actcccaaatcttgatcaca

SEQ ID NO: 63640 - DNA, 20 bp, Artificial Sequence
  Synthetic oligonucleotide; TTGGAT chr11 5191986 5192005 5191989 -
gcattaaatatcatttatta

SEQ ID NO: 63641 - DNA, 20 bp, Artificial Sequence
  Synthetic oligonucleotide; CTGGGT chr11 5191924 5191943 5191927 -
ctgtaaaaaaatacctgaga

SEQ ID NO: 63642 - DNA, 20 bp, Artificial Sequence
  Synthetic oligonucleotide; CAGGGT chr11 5191757 5191776 5191760 -
atggccaggacagggagaag

SEQ ID NO: 63643 - DNA, 20 bp, Artificial Sequence
  Synthetic oligonucleotide; GGGGAT chr11 5191691 5191710 5191694 -
actcactatacagtaccaag

SEQ ID NO: 63644 - DNA, 20 bp, Artificial Sequence
  Synthetic oligonucleotide; TTGAAT chr11 5191649 5191668 5191652 -
tgagaactctgccaccatga

SEQ ID NO: 63645 - DNA, 20 bp, Artificial Sequence
  Synthetic oligonucleotide; TTGGGT chr11 5191589 5191608 5191592 -
attataatttaacatgatat

SEQ ID NO: 63646 - DNA, 20 bp, Artificial Sequence
  Synthetic oligonucleotide; TTGGGT chr11 5191340 5191359 5191343 -
acataatggaggtactggca

SEQ ID NO: 63647 - DNA, 20 bp, Artificial Sequence
  Synthetic oligonucleotide; ACGAGT chr11 5191276 5191295 5191279 -
aaaggggctaaagatcccac

SEQ ID NO: 63648 - DNA, 20 bp, Artificial Sequence
  Synthetic oligonucleotide; TTGAAT chr11 5191203 5191222 5191206 -
tttcccacccaaatttcttc

SEQ ID NO: 63649 - DNA, 20 bp, Artificial Sequence
  Synthetic oligonucleotide; TGGGAT chr11 5191156 5191175 5191159 -
ctgtcatggaaggaacacac

SEQ ID NO: 63650 - DNA, 20 bp, Artificial Sequence
  Synthetic oligonucleotide; TTGAAT chr11 5191146 5191165 5191149 -
aggaacacactgggatgtaa

SEQ ID NO: 63651 - DNA, 20 bp, Artificial Sequence
  Synthetic oligonucleotide; GGGGGT chr11 5191137 5191156 5191140 -
ctgggatgtaattgaatcat

SEQ ID NO: 63652 - DNA, 20 bp, Artificial Sequence
  Synthetic oligonucleotide; GTGAGT chr11 5191103 5191122 5191106 -
cacatgctgttctcatgata

SEQ ID NO: 63653 - DNA, 20 bp, Artificial Sequence
  Synthetic oligonucleotide; GTGGAT chr11 5190967 5190986 5190970 -
tgtaaggcctccccagcaat

SEQ ID NO: 63654 - DNA, 20 bp, Artificial Sequence
  Synthetic oligonucleotide; ATGAGT chr11 5190959 5190978 5190962 -
ctccccagcaatgtggatct

SEQ ID NO: 63655 - DNA, 20 bp, Artificial Sequence
  Synthetic oligonucleotide; TCGGGT chr11 5190917 5190936 5190920 -
tctttataaattacccagtc

SEQ ID NO: 63656 - DNA, 20 bp, Artificial Sequence
  Synthetic oligonucleotide; TTGAGT chr11 5190728 5190747 5190731 -
gctgctcttaagagattgta

SEQ ID NO: 63657 - DNA, 20 bp, Artificial Sequence
  Synthetic oligonucleotide; GTGGAT chr11 5190685 5190704 5190688 -
gtgcacggtgcaaactgtca

SEQ ID NO: 63658 - DNA, 20 bp, Artificial Sequence
  Synthetic oligonucleotide; TGGGGT chr11 5190670 5190689 5190673 -
tgtcagtggatctaccattc

SEQ ID NO: 63659 - DNA, 20 bp, Artificial Sequence
  Synthetic oligonucleotide; GGGGGT chr11 5190601 5190620 5190604 -
ccccagtggagactctgtga

SEQ ID NO: 63660 - DNA, 20 bp, Artificial Sequence
  Synthetic oligonucleotide; GAGGGT chr11 5190547 5190566 5190550 -
ccctattagaggttcttcat

SEQ ID NO: 63661 - DNA, 20 bp, Artificial Sequence
  Synthetic oligonucleotide; CAGGAT chr11 5190325 5190344 5190328 -
acagctggtgctggagcagc

SEQ ID NO: 63662 - DNA, 20 bp, Artificial Sequence
  Synthetic oligonucleotide; CAGGGT chr11 5190285 5190304 5190288 -
cctgaagctgctcaaggcag

SEQ ID NO: 63663 - DNA, 20 bp, Artificial Sequence
  Synthetic oligonucleotide; CTGAAT chr11 5190278 5190297 5190281 -
ctgctcaaggcagcagggtc

SEQ ID NO: 63664 - DNA, 20 bp, Artificial Sequence
  Synthetic oligonucleotide; AAGGGT chr11 5190210 5190229 5190213 -
gtgatgtgaggggctgctac

SEQ ID NO: 63665 - DNA, 20 bp, Artificial Sequence
  Synthetic oligonucleotide; TTGAAT chr11 5190117 5190136 5190120 -
tgcaaatttctacagcctgc

SEQ ID NO: 63666 - DNA, 20 bp, Artificial Sequence
  Synthetic oligonucleotide; TCGAAT chr11 5189893 5189912 5189896 -
cttaaataatattatcaact

SEQ ID NO: 63667 - DNA, 20 bp, Artificial Sequence
  Synthetic oligonucleotide; CAGAAT chr11 5189744 5189763 5189747 -
ttcattgtccatatcactat

SEQ ID NO: 63668 - DNA, 20 bp, Artificial Sequence
  Synthetic oligonucleotide; CTGGGT chr11 5189522 5189541 5189525 -
ctataaggaaatacctgaga

SEQ ID NO: 63669 - DNA, 20 bp, Artificial Sequence
  Synthetic oligonucleotide; GGGGAT chr11 5189217 5189236 5189220 -
caggccccatcttcaacact

SEQ ID NO: 63670 - DNA, 20 bp, Artificial Sequence
  Synthetic oligonucleotide; TAGGGT chr11 5189193 5189212 5189196 -
attacagctgaacatgagat

SEQ ID NO: 63671 - DNA, 20 bp, Artificial Sequence
  Synthetic oligonucleotide; ATGAAT chr11 5189087 5189106 5189090 -
caaaacacaacaacaaaacg

SEQ ID NO: 63672 - DNA, 20 bp, Artificial Sequence
  Synthetic oligonucleotide; AAGAGT chr11 5188829 5188848 5188832 -
cacaaactccacctggaaag

SEQ ID NO: 63673 - DNA, 20 bp, Artificial Sequence
  Synthetic oligonucleotide; AGGGAT chr11 5188721 5188740 5188724 -
ccactgagaaactctacagc

SEQ ID NO: 63674 - DNA, 20 bp, Artificial Sequence
  Synthetic oligonucleotide; TTGGAT chr11 5188588 5188607 5188591 -
aatgttttaagaaagttgtg

SEQ ID NO: 63675 - DNA, 20 bp, Artificial Sequence
  Synthetic oligonucleotide; TGGGAT chr11 5188565 5188584 5188568 -
gatagcattcaaagccatct

SEQ ID NO: 63676 - DNA, 20 bp, Artificial Sequence
  Synthetic oligonucleotide; AAGGAT chr11 5188368 5188387 5188371 -
ccaaattacttgttcgaaga

SEQ ID NO: 63677 - DNA, 20 bp, Artificial Sequence
  Synthetic oligonucleotide; TGGAAT chr11 5188358 5188377 5188361 -
tgttcgaagaaaggatcatc

SEQ ID NO: 63678 - DNA, 20 bp, Artificial Sequence
  Synthetic oligonucleotide; TTGGAT chr11 5188345 5188364 5188348 -
gatcatctggaattcttttc

SEQ ID NO: 63679 - DNA, 20 bp, Artificial Sequence
  Synthetic oligonucleotide; CAGAGT chr11 5188192 5188211 5188195 -
aagtatcttacatattgaag

SEQ ID NO: 63680 - DNA, 20 bp, Artificial Sequence
  Synthetic oligonucleotide; CTGAGT chr11 5188047 5188066 5188050 -
aatccatagaaatttaaaaa

SEQ ID NO: 63681 - DNA, 20 bp, Artificial Sequence
  Synthetic oligonucleotide; GAGAAT chr11 5187985 5188004 5187988 -
tttctgacatgaacttatgt

SEQ ID NO: 63682 - DNA, 20 bp, Artificial Sequence
  Synthetic oligonucleotide; TAGAAT chr11 5187714 5187733 5187717 -
taactattatttcatctgca

SEQ ID NO: 63683 - DNA, 20 bp, Artificial Sequence
  Synthetic oligonucleotide; TTGGAT chr11 5187650 5187669 5187653 -
tgtatcacagcagccgtagt

SEQ ID NO: 63684 - DNA, 20 bp, Artificial Sequence
  Synthetic oligonucleotide; TAGAGT chr11 5187564 5187583 5187567 -
aaaaaaaattcttcaagttt

SEQ ID NO: 63685 - DNA, 20 bp, Artificial Sequence
  Synthetic oligonucleotide; CAGAGT chr11 5187524 5187543 5187527 -
acattataataagttatcag

SEQ ID NO: 63686 - DNA, 20 bp, Artificial Sequence
  Synthetic oligonucleotide; TTGGAT chr11 5187511 5187530 5187514 -
ttatcagcagagtatacctc

SEQ ID NO: 63687 - DNA, 20 bp, Artificial Sequence
  Synthetic oligonucleotide; AAGGAT chr11 5187372 5187391 5187375 -
attcctttaatttcttttcc

SEQ ID NO: 63688 - DNA, 20 bp, Artificial Sequence
  Synthetic oligonucleotide; TTGAAT chr11 5187277 5187296 5187280 -
tcactatggtttcaagacct

SEQ ID NO: 63689 - DNA, 20 bp, Artificial Sequence
  Synthetic oligonucleotide; CAGGGT chr11 5187106 5187125 5187109 -
tccaatcaagatcatccagt

SEQ ID NO: 63690 - DNA, 20 bp, Artificial Sequence
  Synthetic oligonucleotide; AGGGAT chr11 5187015 5187034 5187018 -
tataggtgaaaaaagcttct

SEQ ID NO: 63691 - DNA, 20 bp, Artificial Sequence
  Synthetic oligonucleotide; GAGAAT chr11 5186960 5186979 5186963 -
atatggaaggctccacttga

SEQ ID NO: 63692 - DNA, 20 bp, Artificial Sequence
  Synthetic oligonucleotide; ATGAAT chr11 5186896 5186915 5186899 -
tgaagccagtttttaattcc

SEQ ID NO: 63693 - DNA, 20 bp, Artificial Sequence
  Synthetic oligonucleotide; GAGAAT chr11 5186828 5186847 5186831 -
ctcattaaagtatccttcaa

SEQ ID NO: 63694 - DNA, 20 bp, Artificial Sequence
  Synthetic oligonucleotide; TGGGAT chr11 5186823 5186842 5186826 -
taaagtatccttcaagagaa

SEQ ID NO: 63695 - DNA, 20 bp, Artificial Sequence
  Synthetic oligonucleotide; GAGAAT chr11 5186702 5186721 5186705 -
attaaagggaaataaaatga

SEQ ID NO: 63696 - DNA, 20 bp, Artificial Sequence
  Synthetic oligonucleotide; GAGAGT chr11 5186549 5186568 5186552 -
atgtattaacttaggtgtca

SEQ ID NO: 63697 - DNA, 20 bp, Artificial Sequence
  Synthetic oligonucleotide; GAGAAT chr11 5186505 5186524 5186508 -
atgcacaaattataatgaaa

SEQ ID NO: 63698 - DNA, 20 bp, Artificial Sequence
  Synthetic oligonucleotide; AGGAGT chr11 5186436 5186455 5186439 -
gtgtcatctccttccatggg

SEQ ID NO: 63699 - DNA, 20 bp, Artificial Sequence
  Synthetic oligonucleotide; CAGGAT chr11 5186306 5186325 5186309 -
ctcaacctgctaaatatctt

SEQ ID NO: 63700 - DNA, 20 bp, Artificial Sequence
  Synthetic oligonucleotide; CTGAGT chr11 5186277 5186296 5186280 -
agaaaatgcaagtaagtaaa

SEQ ID NO: 63701 - DNA, 20 bp, Artificial Sequence
  Synthetic oligonucleotide; TGGAAT chr11 5186153 5186172 5186156 -
tttccttgatttttgaccca

SEQ ID NO: 63702 - DNA, 20 bp, Artificial Sequence
  Synthetic oligonucleotide; TGGAGT chr11 5186129 5186148 5186132 -
atactagacttggctttagc

SEQ ID NO: 63703 - DNA, 20 bp, Artificial Sequence
  Synthetic oligonucleotide; AAGAAT chr11 5186068 5186087 5186071 -
ttaagtaagtcattttcaaa

SEQ ID NO: 63704 - DNA, 20 bp, Artificial Sequence
  Synthetic oligonucleotide; TAGAAT chr11 5186047 5186066 5186050 -
agaatattttagttttctct

SEQ ID NO: 63705 - DNA, 20 bp, Artificial Sequence
  Synthetic oligonucleotide; TTGAAT chr11 5186004 5186023 5186007 -
attttctttgatatgcagat

SEQ ID NO: 63706 - DNA, 20 bp, Artificial Sequence
  Synthetic oligonucleotide; ATGAAT chr11 5185982 5186001 5185985 -
gaatgttgtacaaagattca

SEQ ID NO: 63707 - DNA, 20 bp, Artificial Sequence
  Synthetic oligonucleotide; CAGGGT chr11 5185699 5185718 5185702 -
ataaaagtaaatgacagata

SEQ ID NO: 63708 - DNA, 20 bp, Artificial Sequence
  Synthetic oligonucleotide; ATGGAT chr11 5185623 5185642 5185626 -
aaaatttattcctagtattt

SEQ ID NO: 63709 - DNA, 20 bp, Artificial Sequence
  Synthetic oligonucleotide; ATGGAT chr11 5185590 5185609 5185593 -
atcaattcaatctcagtttg

SEQ ID NO: 63710 - DNA, 20 bp, Artificial Sequence
  Synthetic oligonucleotide; TGGGAT chr11 5185486 5185505 5185489 -
gtcctgatgtcatctattgt

SEQ ID NO: 63711 - DNA, 20 bp, Artificial Sequence
  Synthetic oligonucleotide; CAGGGT chr11 5185349 5185368 5185352 -
tttaaattaaatgacgtgtc

SEQ ID NO: 63712 - DNA, 20 bp, Artificial Sequence
  Synthetic oligonucleotide; TAGAGT chr11 5185341 5185360 5185344 -
aaatgacgtgtccagggtca

SEQ ID NO: 63713 - DNA, 20 bp, Artificial Sequence
  Synthetic oligonucleotide; CAGAAT chr11 5185335 5185354 5185338 -
cgtgtccagggtcatagagt

SEQ ID NO: 63714 - DNA, 20 bp, Artificial Sequence
  Synthetic oligonucleotide; GTGGAT chr11 5185248 5185267 5185251 -
caccacactatctttgctcc

SEQ ID NO: 63715 - DNA, 20 bp, Artificial Sequence
  Synthetic oligonucleotide; CAGAAT chr11 5185226 5185245 5185229 -
ggatacattcatgattcagt

SEQ ID NO: 63716 - DNA, 20 bp, Artificial Sequence
  Synthetic oligonucleotide; TAGAAT chr11 5185202 5185221 5185205 -
atatgctgtcagaaatatcc

SEQ ID NO: 63717 - DNA, 20 bp, Artificial Sequence
  Synthetic oligonucleotide; TTGGGT chr11 5185168 5185187 5185171 -
aaggaacccaggcctataat

SEQ ID NO: 63718 - DNA, 20 bp, Artificial Sequence
  Synthetic oligonucleotide; AGGAAT chr11 5184902 5184921 5184905 -
ctctggcctagaactgtgtc

SEQ ID NO: 63719 - DNA, 20 bp, Artificial Sequence
  Synthetic oligonucleotide; CAGAGT chr11 5184778 5184797 5184781 -
atgtaaataaagtagatcca

SEQ ID NO: 63720 - DNA, 20 bp, Artificial Sequence
  Synthetic oligonucleotide; AAGGGT chr11 5184715 5184734 5184718 -
acctcattccaacttaaagc

SEQ ID NO: 63721 - DNA, 20 bp, Artificial Sequence
  Synthetic oligonucleotide; GTGGGT chr11 5184694 5184713 5184697 -
agggtaaattgctcagctgt

SEQ ID NO: 63722 - DNA, 20 bp, Artificial Sequence
  Synthetic oligonucleotide; CAGAAT chr11 5184621 5184640 5184624 -
catcatataaaatttgagac

SEQ ID NO: 63723 - DNA, 20 bp, Artificial Sequence
  Synthetic oligonucleotide; TGGAAT chr11 5184542 5184561 5184545 -
atcagtatattgaactgtaa

SEQ ID NO: 63724 - DNA, 20 bp, Artificial Sequence
  Synthetic oligonucleotide; GAGAGT chr11 5184445 5184464 5184448 -
tacttgagaaagggaactta

SEQ ID NO: 63725 - DNA, 20 bp, Artificial Sequence
  Synthetic oligonucleotide; GAGGGT chr11 5184006 5184025 5184009 -
tctccctggtttagtcttgg

SEQ ID NO: 63726 - DNA, 20 bp, Artificial Sequence
  Synthetic oligonucleotide; AGGAAT chr11 5183990 5184009 5183993 -
ttgggagggtgtatgtgtcg

SEQ ID NO: 63727 - DNA, 20 bp, Artificial Sequence
  Synthetic oligonucleotide; TGGGAT chr11 5183905 5183924 5183908 -
gatggtagtttgtatgtctg

SEQ ID NO: 63728 - DNA, 20 bp, Artificial Sequence
  Synthetic oligonucleotide; TTGAGT chr11 5183859 5183878 5183862 -
tcatttcttattgcatctat

SEQ ID NO: 63729 - DNA, 20 bp, Artificial Sequence
  Synthetic oligonucleotide; CTGGAT chr11 5183780 5183799 5183783 -
tcttttcaaaaaaccagctc

SEQ ID NO: 63730 - DNA, 20 bp, Artificial Sequence
  Synthetic oligonucleotide; AAGGGT chr11 5183760 5183779 5183763 -
ctggattcattgattttttt

SEQ ID NO: 63731 - DNA, 20 bp, Artificial Sequence
  Synthetic oligonucleotide; TAGGGT chr11 5183643 5183662 5183646 -
agttcttttaattgtgatgt

SEQ ID NO: 63732 - DNA, 20 bp, Artificial Sequence
  Synthetic oligonucleotide; TTGAGT chr11 5183434 5183453 5183437 -
gctgttcagtttccatgtag

SEQ ID NO: 63733 - DNA, 20 bp, Artificial Sequence
  Synthetic oligonucleotide; TTGAGT chr11 5183424 5183443 5183427 -
ttccatgtagttgagtggtt

SEQ ID NO: 63734 - DNA, 20 bp, Artificial Sequence
  Synthetic oligonucleotide; GTGAGT chr11 5183420 5183439 5183423 -
atgtagttgagtggttttga

SEQ ID NO: 63735 - DNA, 20 bp, Artificial Sequence
  Synthetic oligonucleotide; CTGAGT chr11 5183405 5183424 5183408 -
tttgagtgagtttcttaatc

SEQ ID NO: 63736 - DNA, 20 bp, Artificial Sequence
  Synthetic oligonucleotide; AGGAGT chr11 5183333 5183352 5183336 -
ctgttcttttacgtttgctg

SEQ ID NO: 63737 - DNA, 20 bp, Artificial Sequence
  Synthetic oligonucleotide; TGGAAT chr11 5183301 5183320 5183304 -
cttccaactatgtggtcaac

SEQ ID NO: 63738 - DNA, 20 bp, Artificial Sequence
  Synthetic oligonucleotide; AAGAAT chr11 5183275 5183294 5183278 -
aggtgtggtgtggtgctgag

SEQ ID NO: 63739 - DNA, 20 bp, Artificial Sequence
  Synthetic oligonucleotide; TGGGAT chr11 5183253 5183272 5183256 -
gaatgtatattctattgatt

SEQ ID NO: 63740 - DNA, 20 bp, Artificial Sequence
  Synthetic oligonucleotide; GAGAGT chr11 5183246 5183265 5183249 -
tattctattgatttgggatg

SEQ ID NO: 63741 - DNA, 20 bp, Artificial Sequence
  Synthetic oligonucleotide; CTGAAT chr11 5183205 5183224 5183208 -
taggtctgcttggtgcagag

SEQ ID NO: 63742 - DNA, 20 bp, Artificial Sequence
  Synthetic oligonucleotide; CTGGAT chr11 5183192 5183211 5183195 -
tgcagagctgaattcaattc

SEQ ID NO: 63743 - DNA, 20 bp, Artificial Sequence
  Synthetic oligonucleotide; TGGGGT chr11 5183141 5183160 5183144 -
gatctgtctaatgttgacag

SEQ ID NO: 63744 - DNA, 20 bp, Artificial Sequence
  Synthetic oligonucleotide; GGGAGT chr11 5183109 5183128 5183112 -
gtctcccattattattgtgt

SEQ ID NO: 63745 - DNA, 20 bp, Artificial Sequence
  Synthetic oligonucleotide; ATGAAT chr11 5183068 5183087 5183071 -
ggtctctaaggacttgcttt

SEQ ID NO: 63746 - DNA, 20 bp, Artificial Sequence
  Synthetic oligonucleotide; CTGGGT chr11 5183062 5183081 5183065 -
taaggacttgctttatgaat

SEQ ID NO: 63747 - DNA, 20 bp, Artificial Sequence
  Synthetic oligonucleotide; TTGGGT chr11 5183047 5183066 5183050 -
tgaatctgggtgctgctgta

SEQ ID NO: 63748 - DNA, 20 bp, Artificial Sequence
  Synthetic oligonucleotide; TAGGAT chr11 5183030 5183049 5183033 -
gtattgggtgcatatatatt

SEQ ID NO: 63749 - DNA, 20 bp, Artificial Sequence
  Synthetic oligonucleotide; TTGAAT chr11 5183009 5183028 5183012 -
aggatagttagctcttcttg

SEQ ID NO: 63750 - DNA, 20 bp, Artificial Sequence
  Synthetic oligonucleotide; CTGAAT chr11 5182819 5182838 5182822 -
ctccacatgagattggtttc

SEQ ID NO: 63751 - DNA, 20 bp, Artificial Sequence
  Synthetic oligonucleotide; GAGAAT chr11 5182712 5182731 5182715 -
taaggttaatattgttatgt

SEQ ID NO: 63752 - DNA, 20 bp, Artificial Sequence
  Synthetic oligonucleotide; ATGGAT chr11 5182448 5182467 5182451 -
caaaaaaagtccaggaccag

SEQ ID NO: 63753 - DNA, 20 bp, Artificial Sequence
  Synthetic oligonucleotide; CCGAAT chr11 5182436 5182455 5182439 -
aggaccagatggattcacag

SEQ ID NO: 63754 - DNA, 20 bp, Artificial Sequence
  Synthetic oligonucleotide; GGGAAT chr11 5182363 5182382 5182366 -
ttccaatcaatagaaaaaga

SEQ ID NO: 63755 - DNA, 20 bp, Artificial Sequence
  Synthetic oligonucleotide; GAGAAT chr11 5182287 5182306 5182290 -
gcagacacacaacaaaaaaa

SEQ ID NO: 63756 - DNA, 20 bp, Artificial Sequence
  Synthetic oligonucleotide; TGGGAT chr11 5182165 5182184 5182168 -
gatcaagtgggcttcatccc

SEQ ID NO: 63757 - DNA, 20 bp, Artificial Sequence
  Synthetic oligonucleotide; CTGAAT chr11 5181942 5181961 5181945 -
aacccacagccaatatcata

SEQ ID NO: 63758 - DNA, 20 bp, Artificial Sequence
  Synthetic oligonucleotide; AGGGAT chr11 5181893 5181912 5181896 -
tttgaaaactggcacaagac

SEQ ID NO: 63759 - DNA, 20 bp, Artificial Sequence
  Synthetic oligonucleotide; ATGAGT chr11 5181609 5181628 5181612 -
gacaaacagagagccaaatc

SEQ ID NO: 63760 - DNA, 20 bp, Artificial Sequence
  Synthetic oligonucleotide; GAGAAT chr11 5181577 5181596 5181580 -
ccattcacaattgcctcaaa

SEQ ID NO: 63761 - DNA, 20 bp, Artificial Sequence
  Synthetic oligonucleotide; AGGAAT chr11 5181562 5181581 5181565 -
tcaaagagaataaaatacct

SEQ ID NO: 63762 - DNA, 20 bp, Artificial Sequence
  Synthetic oligonucleotide; AGGGAT chr11 5181546 5181565 5181549 -
acctaggaatccaacttaca

SEQ ID NO: 63763 - DNA, 20 bp, Artificial Sequence
  Synthetic oligonucleotide; GAGGAT chr11 5181489 5181508 5181492 -
cactgctcaacgaaataaaa

SEQ ID NO: 63764 - DNA, 20 bp, Artificial Sequence
  Synthetic oligonucleotide; ATGGAT chr11 5181454 5181473 5181457 -
tggaagaacattccatgctc

SEQ ID NO: 63765 - DNA, 20 bp, Artificial Sequence
  Synthetic oligonucleotide; AAGAAT chr11 5181445 5181464 5181448 -
attccatgctcatggatagg

SEQ ID NO: 63766 - DNA, 20 bp, Artificial Sequence
  Synthetic oligonucleotide; CAGAAT chr11 5181356 5181375 5181359 -
gctaccaatgactttcttca

SEQ ID NO: 63767 - DNA, 20 bp, Artificial Sequence
  Synthetic oligonucleotide; AAGGAT chr11 5181088 5181107 5181091 -
acaaaaacaagcaatgggga

SEQ ID NO: 63768 - DNA, 20 bp, Artificial Sequence
  Synthetic oligonucleotide; CTGGAT chr11 5181025 5181044 5181028 -
ccatatgtagaaagctgaaa

SEQ ID NO: 63769 - DNA, 20 bp, Artificial Sequence
  Synthetic oligonucleotide; ATGGAT chr11 5180984 5181003 5180987 -
tatacaaaaattatttcaag

SEQ ID NO: 63770 - DNA, 20 bp, Artificial Sequence
  Synthetic oligonucleotide; TGGGAT chr11 5180839 5180858 5180842 -
caaaagacaaaatggacaaa

SEQ ID NO: 63771 - DNA, 20 bp, Artificial Sequence
  Synthetic oligonucleotide; CAGAGT chr11 5180789 5180808 5180792 -
acagcaaaagaaactaccat

SEQ ID NO: 63772 - DNA, 20 bp, Artificial Sequence
  Synthetic oligonucleotide; CAGAAT chr11 5180717 5180736 5180720 -
tctgacaaagggctaatatc

SEQ ID NO: 63773 - DNA, 20 bp, Artificial Sequence
  Synthetic oligonucleotide; GGGGGT chr11 5180657 5180676 5180660 -
acaaacaactgcatcaacaa

SEQ ID NO: 63774 - DNA, 20 bp, Artificial Sequence
  Synthetic oligonucleotide; AAGGAT chr11 5180650 5180669 5180653 -
actgcatcaacaagggggtg

SEQ ID NO: 63775 - DNA, 20 bp, Artificial Sequence
  Synthetic oligonucleotide; TAGAAT chr11 5180519 5180538 5180522 -
agatatcatctcacaccagt

SEQ ID NO: 63776 - DNA, 20 bp, Artificial Sequence
  Synthetic oligonucleotide; GAGGAT chr11 5180475 5180494 5180478 -
aggaaaccacaggtgctgga

SEQ ID NO: 63777 - DNA, 20 bp, Artificial Sequence
  Synthetic oligonucleotide; AGGGAT chr11 5180386 5180405 5180389 -
agtcagtgtggcaattcctc

SEQ ID NO: 63778 - DNA, 20 bp, Artificial Sequence
  Synthetic oligonucleotide; CTGGGT chr11 5180341 5180360 5180344 -
ttgacccagccatcctatta

SEQ ID NO: 63779 - DNA, 20 bp, Artificial Sequence
  Synthetic oligonucleotide; AGGAAT chr11 5180325 5180344 5180328 -
attactgggtatatacccaa

SEQ ID NO: 63780 - DNA, 20 bp, Artificial Sequence
  Synthetic oligonucleotide; CTGGAT chr11 5180216 5180235 5180219 -
aaatgtccaacaatgataga

SEQ ID NO: 63781 - DNA, 20 bp, Artificial Sequence
  Synthetic oligonucleotide; TGGAAT chr11 5180184 5180203 5180187 -
aatgtggcacatatacatca

SEQ ID NO: 63782 - DNA, 20 bp, Artificial Sequence
  Synthetic oligonucleotide; ATGAGT chr11 5180157 5180176 5180160 -
ctatgcagccataaaaaatg

SEQ ID NO: 63783 - DNA, 20 bp, Artificial Sequence
  Synthetic oligonucleotide; ATGGAT chr11 5180132 5180151 5180135 -
ttcatgtcctttgtagggac

SEQ ID NO: 63784 - DNA, 20 bp, Artificial Sequence
  Synthetic oligonucleotide; GGGAGT chr11 5180050 5180069 5180053 -
acatattctcactcataggt

SEQ ID NO: 63785 - DNA, 20 bp, Artificial Sequence
  Synthetic oligonucleotide; TGGGGT chr11 5179987 5180006 5179990 -
tcacacaccggggcctgttg

SEQ ID NO: 63786 - DNA, 20 bp, Artificial Sequence
  Synthetic oligonucleotide; AGGGAT chr11 5179968 5179987 5179971 -
gtggggtgggggccgggggg

SEQ ID NO: 63787 - DNA, 20 bp, Artificial Sequence
  Synthetic oligonucleotide; ACGAGT chr11 5179933 5179952 5179936 -
agatatacctaatgtaaatg

SEQ ID NO: 63788 - DNA, 20 bp, Artificial Sequence
  Synthetic oligonucleotide; ATGGGT chr11 5179925 5179944 5179928 -
ctaatgtaaatgacgagtta

SEQ ID NO: 63789 - DNA, 20 bp, Artificial Sequence
  Synthetic oligonucleotide; GGGAGT chr11 5179719 5179738 5179722 -
atatacttttttttttgaga

SEQ ID NO: 63790 - DNA, 20 bp, Artificial Sequence
  Synthetic oligonucleotide; TGGAGT chr11 5179694 5179713 5179697 -
tctcgctctgtcacctaggc

SEQ ID NO: 63791 - DNA, 20 bp, Artificial Sequence
  Synthetic oligonucleotide; TTGAGT chr11 5179618 5179637 5179621 -
gattctcctgcctcagcctc

SEQ ID NO: 63792 - DNA, 20 bp, Artificial Sequence
  Synthetic oligonucleotide; TGGGAT chr11 5179609 5179628 5179612 -
gcctcagcctcttgagtagc

SEQ ID NO: 63793 - DNA, 20 bp, Artificial Sequence
  Synthetic oligonucleotide; CGGGGT chr11 5179553 5179572 5179556 -
ttttgtatttttagtagaga

SEQ ID NO: 63794 - DNA, 20 bp, Artificial Sequence
  Synthetic oligonucleotide; TGGGAT chr11 5179476 5179495 5179479 -
gcctcagcctctcaaagtgc

SEQ ID NO: 63795 - DNA, 20 bp, Artificial Sequence
  Synthetic oligonucleotide; AGGGAT chr11 5179167 5179186 5179170 -
cataactctctattttcctt

SEQ ID NO: 63796 - DNA, 20 bp, Artificial Sequence
  Synthetic oligonucleotide; TTGGAT chr11 5179102 5179121 5179105 -
ttttaccttgataggcagca

SEQ ID NO: 63797 - DNA, 20 bp, Artificial Sequence
  Synthetic oligonucleotide; TAGGGT chr11 5179038 5179057 5179041 -
actttaaatccagtagggcc

SEQ ID NO: 63798 - DNA, 20 bp, Artificial Sequence
  Synthetic oligonucleotide; GTGGGT chr11 5179016 5179035 5179019 -
gggtaagaggctgaaagtct

SEQ ID NO: 63799 - DNA, 20 bp, Artificial Sequence
  Synthetic oligonucleotide; TGGAAT chr11 5178682 5178701 5178685 -
ttcactaatggcactaggcc

SEQ ID NO: 63800 - DNA, 20 bp, Artificial Sequence
  Synthetic oligonucleotide; CAGGAT chr11 5178632 5178651 5178635 -
ttcgcaatcacactaattcc

SEQ ID NO: 63801 - DNA, 20 bp, Artificial Sequence
  Synthetic oligonucleotide; GGGAAT chr11 5178609 5178628 5178612 -
gatgtgtggtatgtcctgat

SEQ ID NO: 63802 - DNA, 20 bp, Artificial Sequence
  Synthetic oligonucleotide; CTGGAT chr11 5178579 5178598 5178582 -
gggctggaaggcttgcatac

SEQ ID NO: 63803 - DNA, 20 bp, Artificial Sequence
  Synthetic oligonucleotide; CAGAAT chr11 5178325 5178344 5178328 -
catacatttcatctttgtgg

SEQ ID NO: 63804 - DNA, 20 bp, Artificial Sequence
  Synthetic oligonucleotide; CTGGAT chr11 5178038 5178057 5178041 -
tggccctactctctacagga

SEQ ID NO: 63805 - DNA, 20 bp, Artificial Sequence
  Synthetic oligonucleotide; TGGGGT chr11 5177784 5177803 5177787 -
atgctaaaccccatcattta

SEQ ID NO: 63806 - DNA, 20 bp, Artificial Sequence
  Synthetic oligonucleotide; TCGAGT chr11 5177757 5177776 5177760 -
aagaccaaacaaattaaaga

SEQ ID NO: 63807 - DNA, 20 bp, Artificial Sequence
  Synthetic oligonucleotide; GGGAAT chr11 5177695 5177714 5177698 -
agattaaaaagtctgtttta

SEQ ID NO: 63808 - DNA, 20 bp, Artificial Sequence
  Synthetic oligonucleotide; TAGAAT chr11 5177690 5177709 5177693 -
aaaaagtctgttttagggaa

SEQ ID NO: 63809 - DNA, 20 bp, Artificial Sequence
  Synthetic oligonucleotide; CGGAAT chr11 5177623 5177642 5177626 -
ggtgtctatcaaagtgtcca

SEQ ID NO: 63810 - DNA, 20 bp, Artificial Sequence
  Synthetic oligonucleotide; ATGAAT chr11 5177533 5177552 5177536 -
ttttcagaaatactattttc

SEQ ID NO: 63811 - DNA, 20 bp, Artificial Sequence
  Synthetic oligonucleotide; TAGGGT chr11 5177479 5177498 5177482 -
gagaaaagagaaatatattt

SEQ ID NO: 63812 - DNA, 20 bp, Artificial Sequence
  Synthetic oligonucleotide; TGGGGT chr11 5177435 5177454 5177438 -
tcctacgtagagctaggaag

SEQ ID NO: 63813 - DNA, 20 bp, Artificial Sequence
  Synthetic oligonucleotide; TTGAGT chr11 5177428 5177447 5177431 -
tagagctaggaagtggggtt

SEQ ID NO: 63814 - DNA, 20 bp, Artificial Sequence
  Synthetic oligonucleotide; TAGAAT chr11 5177277 5177296 5177280 -
ttaagttaaaatgttatccc

SEQ ID NO: 63815 - DNA, 20 bp, Artificial Sequence
  Synthetic oligonucleotide; TGGAAT chr11 5177233 5177252 5177236 -
atctcacaaagtctcttgta

SEQ ID NO: 63816 - DNA, 20 bp, Artificial Sequence
  Synthetic oligonucleotide; GTGAAT chr11 5177199 5177218 5177202 -
aatacatatgtattcaacaa

SEQ ID NO: 63817 - DNA, 20 bp, Artificial Sequence
  Synthetic oligonucleotide; GTGAAT chr11 5177189 5177208 5177192 -
tattcaacaagtgaataata

SEQ ID NO: 63818 - DNA, 20 bp, Artificial Sequence
  Synthetic oligonucleotide; CTGGAT chr11 5177138 5177157 5177141 -
attaacaaatatgagattgc

SEQ ID NO: 63819 - DNA, 20 bp, Artificial Sequence
  Synthetic oligonucleotide; CTGGGT chr11 5177010 5177029 5177013 -
atgattgaaaatttctatac

SEQ ID NO: 63820 - DNA, 20 bp, Artificial Sequence
  Synthetic oligonucleotide; GAGAAT chr11 5176952 5176971 5176955 -
aaaagctagagaagattaag

SEQ ID NO: 63821 - DNA, 20 bp, Artificial Sequence
  Synthetic oligonucleotide; AAGAAT chr11 5176922 5176941 5176925 -
tccaagaaacttaaataaaa

SEQ ID NO: 63822 - DNA, 20 bp, Artificial Sequence
  Synthetic oligonucleotide; GAGAAT chr11 5176801 5176820 5176804 -
aaagcctagaacaatgccat

SEQ ID NO: 63823 - DNA, 20 bp, Artificial Sequence
  Synthetic oligonucleotide; GTGGAT chr11 5176598 5176617 5176601 -
taatttatctacatttatat

SEQ ID NO: 63824 - DNA, 20 bp, Artificial Sequence
  Synthetic oligonucleotide; AAGAAT chr11 5176508 5176527 5176511 -
acacacacgtttgtgcacca

SEQ ID NO: 63825 - DNA, 20 bp, Artificial Sequence
  Synthetic oligonucleotide; GAGAAT chr11 5176454 5176473 5176457 -
tatttccattattgggaagg

SEQ ID NO: 63826 - DNA, 20 bp, Artificial Sequence
  Synthetic oligonucleotide; TTGAAT chr11 5176378 5176397 5176381 -
ctaaatatttaagtgctatt

SEQ ID NO: 63827 - DNA, 20 bp, Artificial Sequence
  Synthetic oligonucleotide; GGGAAT chr11 5176223 5176242 5176226 -
aataatatgatggaaaatga

SEQ ID NO: 63828 - DNA, 20 bp, Artificial Sequence
  Synthetic oligonucleotide; GAGGAT chr11 5176194 5176213 5176197 -
tagattgcagtatgatgaca

SEQ ID NO: 63829 - DNA, 20 bp, Artificial Sequence
  Synthetic oligonucleotide; ATGAAT chr11 5176079 5176098 5176082 -
atgatatcttaaataggtat

SEQ ID NO: 63830 - DNA, 20 bp, Artificial Sequence
  Synthetic oligonucleotide; TTGAAT chr11 5175990 5176009 5175993 -
aatggtagaagtaaaaatga

SEQ ID NO: 63831 - DNA, 20 bp, Artificial Sequence
  Synthetic oligonucleotide; AAGGAT chr11 5175940 5175959 5175943 -
gttgagcactcagattctga

SEQ ID NO: 63832 - DNA, 20 bp, Artificial Sequence
  Synthetic oligonucleotide; CTGAAT chr11 5175906 5175925 5175909 -
tggctgttgctatgcagctg

SEQ ID NO: 63833 - DNA, 20 bp, Artificial Sequence
  Synthetic oligonucleotide; GGGAGT chr11 5175654 5175673 5175657 -
aaccaaacaattttaaagca

SEQ ID NO: 63834 - DNA, 20 bp, Artificial Sequence
  Synthetic oligonucleotide; CAGAAT chr11 5175609 5175628 5175612 -
aactgatatggtgttctaga

SEQ ID NO: 63835 - DNA, 20 bp, Artificial Sequence
  Synthetic oligonucleotide; CAGGGT chr11 5175578 5175597 5175581 -
aaaacaaaaaacaaaaggta

SEQ ID NO: 63836 - DNA, 20 bp, Artificial Sequence
  Synthetic oligonucleotide; GAGAAT chr11 5175553 5175572 5175556 -
tgctaagtgattgataaggt

SEQ ID NO: 63837 - DNA, 20 bp, Artificial Sequence
  Synthetic oligonucleotide; TGGGGT chr11 5175417 5175436 5175420 -
aaaaagaccaaattgtaatc

SEQ ID NO: 63838 - DNA, 20 bp, Artificial Sequence
  Synthetic oligonucleotide; AAGAGT chr11 5175322 5175341 5175325 -
ataagtcacctgaaagtaaa

SEQ ID NO: 63839 - DNA, 20 bp, Artificial Sequence
  Synthetic oligonucleotide; TAGAAT chr11 5175255 5175274 5175258 -
tgcaagaaccaataggaaaa

SEQ ID NO: 63840 - DNA, 20 bp, Artificial Sequence
  Synthetic oligonucleotide; GAGAAT chr11 5175162 5175181 5175165 -
tacatgggaggctgaggcag

SEQ ID NO: 63841 - DNA, 20 bp, Artificial Sequence
  Synthetic oligonucleotide; TTGAAT chr11 5175153 5175172 5175156 -
ggctgaggcaggagaatgat

SEQ ID NO: 63842 - DNA, 20 bp, Artificial Sequence
  Synthetic oligonucleotide; GAGGAT chr11 5174373 5174392 5174376 -
tggctaaaacagtgttattt

SEQ ID NO: 63843 - DNA, 20 bp, Artificial Sequence
  Synthetic oligonucleotide; GTGAAT chr11 5174178 5174197 5174181 -
gtttccaccttttggctatt

SEQ ID NO: 63844 - DNA, 20 bp, Artificial Sequence
  Synthetic oligonucleotide; AGGAAT chr11 5174099 5174118 5174102 -
ttttaatatatacctaggag

SEQ ID NO: 63845 - DNA, 20 bp, Artificial Sequence
  Synthetic oligonucleotide; TGGGGT chr11 5174091 5174110 5174094 -
tatacctaggagaggaattt

SEQ ID NO: 63846 - DNA, 20 bp, Artificial Sequence
  Synthetic oligonucleotide; GAGGAT chr11 5173995 5174014 5173998 -
catttttagcagcaatatat

SEQ ID NO: 63847 - DNA, 20 bp, Artificial Sequence
  Synthetic oligonucleotide; TTGAGT chr11 5173800 5173819 5173803 -
atcatttgcatatttttaaa

SEQ ID NO: 63848 - DNA, 20 bp, Artificial Sequence
  Synthetic oligonucleotide; TTGAGT chr11 5173777 5173796 5173780 -
agttgtttgtctttttgttt

SEQ ID NO: 63849 - DNA, 20 bp, Artificial Sequence
  Synthetic oligonucleotide; CTGGAT chr11 5173750 5173769 5173753 -
gtaggactttttcatacatt

SEQ ID NO: 63850 - DNA, 20 bp, Artificial Sequence
  Synthetic oligonucleotide; AAGAAT chr11 5173591 5173610 5173594 -
atactttttgtgtcatatct

SEQ ID NO: 63851 - DNA, 20 bp, Artificial Sequence
  Synthetic oligonucleotide; GAGGGT chr11 5173539 5173558 5173542 -
atttacccatgcttccttcc

SEQ ID NO: 63852 - DNA, 20 bp, Artificial Sequence
  Synthetic oligonucleotide; AAGAAT chr11 5173464 5173483 5173467 -
ggcttttaatccttatttga

SEQ ID NO: 63853 - DNA, 20 bp, Artificial Sequence
  Synthetic oligonucleotide; TTGAAT chr11 5173420 5173439 5173423 -
caaaaatatagcttgaccaa

SEQ ID NO: 63854 - DNA, 20 bp, Artificial Sequence
  Synthetic oligonucleotide; CAGAAT chr11 5173395 5173414 5173398 -
tatgaagttgtatataaaaa

SEQ ID NO: 63855 - DNA, 20 bp, Artificial Sequence
  Synthetic oligonucleotide; TAGAAT chr11 5173330 5173349 5173333 -
tcaaacaacagaaaacagtc

SEQ ID NO: 63856 - DNA, 20 bp, Artificial Sequence
  Synthetic oligonucleotide; GAGAAT chr11 5173213 5173232 5173216 -
gaaaaattgtttatatgttt

SEQ ID NO: 63857 - DNA, 20 bp, Artificial Sequence
  Synthetic oligonucleotide; TGGAAT chr11 5173160 5173179 5173163 -
tcccccaaacaaatttcagg

SEQ ID NO: 63858 - DNA, 20 bp, Artificial Sequence
  Synthetic oligonucleotide; AAGAAT chr11 5173153 5173172 5173156 -
aacaaatttcaggtggaatc

SEQ ID NO: 63859 - DNA, 20 bp, Artificial Sequence
  Synthetic oligonucleotide; TGGAAT chr11 5173006 5173025 5173009 -
tccactttttactttgtata

SEQ ID NO: 63860 - DNA, 20 bp, Artificial Sequence
  Synthetic oligonucleotide; AAGAAT chr11 5172992 5173011 5172995 -
tgtatatggaatagcttctt

SEQ ID NO: 63861 - DNA, 20 bp, Artificial Sequence
  Synthetic oligonucleotide; TTGGGT chr11 5172809 5172828 5172812 -
tgtaactattttatgtttat

SEQ ID NO: 63862 - DNA, 20 bp, Artificial Sequence
  Synthetic oligonucleotide; GGGAAT chr11 5172708 5172727 5172711 -
ctaatacacccgaagtttct

SEQ ID NO: 63863 - DNA, 20 bp, Artificial Sequence
  Synthetic oligonucleotide; AGGGAT chr11 5172676 5172695 5172679 -
tcttggttaattgcttcttg

SEQ ID NO: 63864 - DNA, 20 bp, Artificial Sequence
  Synthetic oligonucleotide; CTGAAT chr11 5172669 5172688 5172672 -
taattgcttcttgagggata

SEQ ID NO: 63865 - DNA, 20 bp, Artificial Sequence
  Synthetic oligonucleotide; ATGGAT chr11 5172563 5172582 5172566 -
aacagtaacaaatagtatgc

SEQ ID NO: 63866 - DNA, 20 bp, Artificial Sequence
  Synthetic oligonucleotide; TAGGAT chr11 5172513 5172532 5172516 -
ctaggtaagtatctgaggtc

SEQ ID NO: 63867 - DNA, 20 bp, Artificial Sequence
  Synthetic oligonucleotide; AGGAGT chr11 5172386 5172405 5172389 -
agtctgaaattgatcatggt

SEQ ID NO: 63868 - DNA, 20 bp, Artificial Sequence
  Synthetic oligonucleotide; AAGAGT chr11 5172266 5172285 5172269 -
ccctggcccaacacgggaag

SEQ ID NO: 63869 - DNA, 20 bp, Artificial Sequence
  Synthetic oligonucleotide; CTGAAT chr11 5172224 5172243 5172227 -
tcttatttctgagccccatc

SEQ ID NO: 63870 - DNA, 20 bp, Artificial Sequence
  Synthetic oligonucleotide; ATGGAT chr11 5171998 5172017 5172001 -
cagaggagcttttctaatct

SEQ ID NO: 63871 - DNA, 20 bp, Artificial Sequence
  Synthetic oligonucleotide; AAGAGT chr11 5171980 5171999 5171983 -
ctatggatagcaggtggaga

SEQ ID NO: 63872 - DNA, 20 bp, Artificial Sequence
  Synthetic oligonucleotide; CTGGGT chr11 5171791 5171810 5171794 -
attgtctttatagcaaatat

SEQ ID NO: 63873 - DNA, 20 bp, Artificial Sequence
  Synthetic oligonucleotide; GTGAAT chr11 5171618 5171637 5171621 -
tcttcagtcataatttccat

SEQ ID NO: 63874 - DNA, 20 bp, Artificial Sequence
  Synthetic oligonucleotide; TGGAAT chr11 5171517 5171536 5171520 -
atctggcatataggctatgt

SEQ ID NO: 63875 - DNA, 20 bp, Artificial Sequence
  Synthetic oligonucleotide; CTGAGT chr11 5171370 5171389 5171373 -
cagaacttgatgtgcaataa

SEQ ID NO: 63876 - DNA, 20 bp, Artificial Sequence
  Synthetic oligonucleotide; GTGGAT chr11 5171222 5171241 5171225 -
gactggaggcagaacattat

SEQ ID NO: 63877 - DNA, 20 bp, Artificial Sequence
  Synthetic oligonucleotide; CCGAAT chr11 5171150 5171169 5171153 -
ggcatcattcttcacatcat

SEQ ID NO: 63878 - DNA, 20 bp, Artificial Sequence
  Synthetic oligonucleotide; TGGAGT chr11 5170968 5170987 5170971 -
tatgcactctttcactctta

SEQ ID NO: 63879 - DNA, 20 bp, Artificial Sequence
  Synthetic oligonucleotide; ACGGGT chr11 5170867 5170886 5170870 -
caattgcctgcatttctggg

SEQ ID NO: 63880 - DNA, 20 bp, Artificial Sequence
  Synthetic oligonucleotide; AGGGGT chr11 5170366 5170385 5170369 -
ttcttacactatccaggaag

SEQ ID NO: 63881 - DNA, 20 bp, Artificial Sequence
  Synthetic oligonucleotide; GTGAGT chr11 5170362 5170381 5170365 -
tacactatccaggaagaggg

SEQ ID NO: 63882 - DNA, 20 bp, Artificial Sequence
  Synthetic oligonucleotide; CTGAAT chr11 5170299 5170318 5170302 -
cttagatcaggctttattac

SEQ ID NO: 63883 - DNA, 20 bp, Artificial Sequence
  Synthetic oligonucleotide; GAGAAT chr11 5170191 5170210 5170194 -
acagttttatatatttccct

SEQ ID NO: 63884 - DNA, 20 bp, Artificial Sequence
  Synthetic oligonucleotide; CTGAAT chr11 5170102 5170121 5170105 -
gtgatgacacactttgtgtg

SEQ ID NO: 63885 - DNA, 20 bp, Artificial Sequence
  Synthetic oligonucleotide; TTGAAT chr11 5170094 5170113 5170097 -
acactttgtgtgctgaatcc

SEQ ID NO: 63886 - DNA, 20 bp, Artificial Sequence
  Synthetic oligonucleotide; GGGAAT chr11 5170063 5170082 5170066 -
attcagtgacatttggttct

SEQ ID NO: 63887 - DNA, 20 bp, Artificial Sequence
  Synthetic oligonucleotide; AAGAGT chr11 5170050 5170069 5170053 -
tggttctgggaatatgtaga

SEQ ID NO: 63888 - DNA, 20 bp, Artificial Sequence
  Synthetic oligonucleotide; AAGAGT chr11 5169969 5169988 5169972 -
ggaaaataatcaggacacaa

SEQ ID NO: 63889 - DNA, 20 bp, Artificial Sequence
  Synthetic oligonucleotide; ATGGAT chr11 5169879 5169898 5169882 -
cagaaccctgcttacctctg

SEQ ID NO: 63890 - DNA, 20 bp, Artificial Sequence
  Synthetic oligonucleotide; AAGAAT chr11 5169863 5169882 5169866 -
tctgatggatataaagatgg

SEQ ID NO: 63891 - DNA, 20 bp, Artificial Sequence
  Synthetic oligonucleotide; AGGGAT chr11 5169806 5169825 5169809 -
tggaaatattttgttgtgtt

SEQ ID NO: 63892 - DNA, 20 bp, Artificial Sequence
  Synthetic oligonucleotide; CTGAAT chr11 5169715 5169734 5169718 -
tcaattttacatcaaaactt

SEQ ID NO: 63893 - DNA, 20 bp, Artificial Sequence
  Synthetic oligonucleotide; GTGAAT chr11 5169653 5169672 5169656 -
acagatgattagatttcata

SEQ ID NO: 63894 - DNA, 20 bp, Artificial Sequence
  Synthetic oligonucleotide; AAGAAT chr11 5169630 5169649 5169633 -
aatacaagtgtggaaaatac

SEQ ID NO: 63895 - DNA, 20 bp, Artificial Sequence
  Synthetic oligonucleotide; ATGGGT chr11 5169592 5169611 5169595 -
ataattgttgaagttgtgtc

SEQ ID NO: 63896 - DNA, 20 bp, Artificial Sequence
  Synthetic oligonucleotide; TTGAAT chr11 5169479 5169498 5169482 -
gtgctaatgttaaatcttaa

SEQ ID NO: 63897 - DNA, 20 bp, Artificial Sequence
  Synthetic oligonucleotide; ATGAGT chr11 5169397 5169416 5169400 -
agaaagctattttattttta

SEQ ID NO: 63898 - DNA, 20 bp, Artificial Sequence
  Synthetic oligonucleotide; AAGAAT chr11 5169226 5169245 5169229 -
aaaaaggtagggaggaccag

SEQ ID NO: 63899 - DNA, 20 bp, Artificial Sequence
  Synthetic oligonucleotide; AGGGAT chr11 5169201 5169220 5169204 -
ttctagaaaatccctcagac

SEQ ID NO: 63900 - DNA, 20 bp, Artificial Sequence
  Synthetic oligonucleotide; TTGAAT chr11 5169160 5169179 5169163 -
tttgttttcttcagataatt

SEQ ID NO: 63901 - DNA, 20 bp, Artificial Sequence
  Synthetic oligonucleotide; GTGAAT chr11 5169140 5169159 5169143 -
ttgaatttccatgaaccaca

SEQ ID NO: 63902 - DNA, 20 bp, Artificial Sequence
  Synthetic oligonucleotide; TTGAGT chr11 5169113 5169132 5169116 -
tcctattaaaccacacagtc

SEQ ID NO: 63903 - DNA, 20 bp, Artificial Sequence
  Synthetic oligonucleotide; ATGAGT chr11 5169046 5169065 5169049 -
ataaaaatatgtatcaagta

SEQ ID NO: 63904 - DNA, 20 bp, Artificial Sequence
  Synthetic oligonucleotide; TGGGAT chr11 5168925 5168944 5168928 -
gtgaagtcataaaaacaaca

SEQ ID NO: 63905 - DNA, 20 bp, Artificial Sequence
  Synthetic oligonucleotide; CAGAGT chr11 5168896 5168915 5168899 -
aaaaaaaattctcaaaattt

SEQ ID NO: 63906 - DNA, 20 bp, Artificial Sequence
  Synthetic oligonucleotide; TGGGAT chr11 5168663 5168682 5168666 -
tatcttgctattagtaattg

SEQ ID NO: 63907 - DNA, 20 bp, Artificial Sequence
  Synthetic oligonucleotide; TTGAAT chr11 5168636 5168655 5168639 -
ttgctagtagtatgacctgt

SEQ ID NO: 63908 - DNA, 20 bp, Artificial Sequence
  Synthetic oligonucleotide; ATGAAT chr11 5168611 5168630 5168614 -
tataatttattcatttataa

SEQ ID NO: 63909 - DNA, 20 bp, Artificial Sequence
  Synthetic oligonucleotide; GTGAAT chr11 5168458 5168477 5168461 -
accaaatctgactacaatac

SEQ ID NO: 63910 - DNA, 20 bp, Artificial Sequence
  Synthetic oligonucleotide; AAGAGT chr11 5168212 5168231 5168215 -
agtcatcatgccccaagtca

SEQ ID NO: 63911 - DNA, 20 bp, Artificial Sequence
  Synthetic oligonucleotide; CAGAAT chr11 5168196 5168215 5168199 -
gtcaaagagttaataagtgg

SEQ ID NO: 63912 - DNA, 20 bp, Artificial Sequence
  Synthetic oligonucleotide; TGGAAT chr11 5168091 5168110 5168094 -
ttcagatttgactttaaaat

SEQ ID NO: 63913 - DNA, 20 bp, Artificial Sequence
  Synthetic oligonucleotide; GAGGAT chr11 5167962 5167981 5167965 -
atgtataaaggttttctcaa

SEQ ID NO: 63914 - DNA, 20 bp, Artificial Sequence
  Synthetic oligonucleotide; TAGAGT chr11 5167742 5167761 5167745 -
aagtgtagtcctagatatag

SEQ ID NO: 63915 - DNA, 20 bp, Artificial Sequence
  Synthetic oligonucleotide; GAGAGT chr11 5167604 5167623 5167607 -
agaaatcacacagtccaaga

SEQ ID NO: 63916 - DNA, 20 bp, Artificial Sequence
  Synthetic oligonucleotide; TCGAAT chr11 5167599 5167618 5167602 -
tcacacagtccaagagagag

SEQ ID NO: 63917 - DNA, 20 bp, Artificial Sequence
  Synthetic oligonucleotide; AGGGAT chr11 5167575 5167594 5167578 -
atgaaattttcaaagcgctc

SEQ ID NO: 63918 - DNA, 20 bp, Artificial Sequence
  Synthetic oligonucleotide; AAGAAT chr11 5167551 5167570 5167554 -
ataaaagaaaactgatattc

SEQ ID NO: 63919 - DNA, 20 bp, Artificial Sequence
  Synthetic oligonucleotide; TAGGGT chr11 5167539 5167558 5167542 -
tgatattcaagaatatttta

SEQ ID NO: 63920 - DNA, 20 bp, Artificial Sequence
  Synthetic oligonucleotide; GAGAAT chr11 5167474 5167493 5167477 -
cccagacaaacaaaagttga

SEQ ID NO: 63921 - DNA, 20 bp, Artificial Sequence
  Synthetic oligonucleotide; GGGAGT chr11 5167432 5167451 5167435 -
atcttgcaaaaaatgctaaa

SEQ ID NO: 63922 - DNA, 20 bp, Artificial Sequence
  Synthetic oligonucleotide; TAGAAT chr11 5167334 5167353 5167337 -
attaagtacatagacaaacc

SEQ ID NO: 63923 - DNA, 20 bp, Artificial Sequence
  Synthetic oligonucleotide; GGGGGT chr11 5167178 5167197 5167181 -
tgagacaaaagtcaaaatgt

SEQ ID NO: 63924 - DNA, 20 bp, Artificial Sequence
  Synthetic oligonucleotide; TGGAGT chr11 5167173 5167192 5167176 -
caaaagtcaaaatgtggggg

SEQ ID NO: 63925 - DNA, 20 bp, Artificial Sequence
  Synthetic oligonucleotide; TGGAGT chr11 5167168 5167187 5167171 -
gtcaaaatgtgggggtggag

SEQ ID NO: 63926 - DNA, 20 bp, Artificial Sequence
  Synthetic oligonucleotide; TAGAAT chr11 5167155 5167174 5167158 -
ggtggagtggagttaaagtg

SEQ ID NO: 63927 - DNA, 20 bp, Artificial Sequence
  Synthetic oligonucleotide; AGGAGT chr11 5166928 5166947 5166931 -
gaaggaaaaaaaaggaagag

SEQ ID NO: 63928 - DNA, 20 bp, Artificial Sequence
  Synthetic oligonucleotide; CTGAGT chr11 5166851 5166870 5166854 -
atccttacttagtaactaca

SEQ ID NO: 63929 - DNA, 20 bp, Artificial Sequence
  Synthetic oligonucleotide; TAGAAT chr11 5166813 5166832 5166816 -
agttccccaattaaaagtaa

SEQ ID NO: 63930 - DNA, 20 bp, Artificial Sequence
  Synthetic oligonucleotide; ATGGAT chr11 5166802 5166821 5166805 -
taaaagtaatagaatggtaa

SEQ ID NO: 63931 - DNA, 20 bp, Artificial Sequence
  Synthetic oligonucleotide; AAGGGT chr11 5166721 5166740 5166724 -
ggcacacataaatgaaagtg

SEQ ID NO: 63932 - DNA, 20 bp, Artificial Sequence
  Synthetic oligonucleotide; GAGGGT chr11 5166613 5166632 5166616 -
aaactgtaagaaaagataag

SEQ ID NO: 63933 - DNA, 20 bp, Artificial Sequence
  Synthetic oligonucleotide; AGGGGT chr11 5166591 5166610 5166594 -
gggtcactgtataataataa

SEQ ID NO: 63934 - DNA, 20 bp, Artificial Sequence
  Synthetic oligonucleotide; GAGGAT chr11 5166574 5166593 5166577 -
taaaggggtcaattcagcaa

SEQ ID NO: 63935 - DNA, 20 bp, Artificial Sequence
  Synthetic oligonucleotide; TGGAAT chr11 5166199 5166218 5166202 -
agtatattttctgaccacag

SEQ ID NO: 63936 - DNA, 20 bp, Artificial Sequence
  Synthetic oligonucleotide; ATGAAT chr11 5166183 5166202 5166186 -
acagtggaataaaactagaa

SEQ ID NO: 63937 - DNA, 20 bp, Artificial Sequence
  Synthetic oligonucleotide; CTGAAT chr11 5166123 5166142 5166126 -
ggaaatcaaacagtatgctc

SEQ ID NO: 63938 - DNA, 20 bp, Artificial Sequence
  Synthetic oligonucleotide; AGGGAT chr11 5165285 5165304 5165288 -
tcagaggtgtcagaccacgc

SEQ ID NO: 63939 - DNA, 20 bp, Artificial Sequence
  Synthetic oligonucleotide; GGGGGT chr11 5165231 5165250 5165234 -
caaatcccacttttctggag

SEQ ID NO: 63940 - DNA, 20 bp, Artificial Sequence
  Synthetic oligonucleotide; GTGAGT chr11 5164867 5164886 5164870 -
accccttgcccatttttctg

SEQ ID NO: 63941 - DNA, 20 bp, Artificial Sequence
  Synthetic oligonucleotide; CTGAGT chr11 5164434 5164453 5164437 -
agtcccaactccaagcgtcg

SEQ ID NO: 63942 - DNA, 20 bp, Artificial Sequence
  Synthetic oligonucleotide; CCGAAT chr11 5164154 5164173 5164157 -
ttttctttatccgacctctc

SEQ ID NO: 63943 - DNA, 20 bp, Artificial Sequence
  Synthetic oligonucleotide; TAGAGT chr11 5163907 5163926 5163910 -
accttcaaggtgtacaataa

SEQ ID NO: 63944 - DNA, 20 bp, Artificial Sequence
  Synthetic oligonucleotide; TTGAGT chr11 5163875 5163894 5163878 -
agccaagtagcaacatattt

SEQ ID NO: 63945 - DNA, 20 bp, Artificial Sequence
  Synthetic oligonucleotide; AGGAAT chr11 5163716 5163735 5163719 -
gaaatctggccaccaggcca

SEQ ID NO: 63946 - DNA, 20 bp, Artificial Sequence
  Synthetic oligonucleotide; CAGGAT chr11 5163700 5163719 5163703 -
gccaaggaatgcccgcagcc

SEQ ID NO: 63947 - DNA, 20 bp, Artificial Sequence
  Synthetic oligonucleotide; GAGGGT chr11 5163471 5163490 5163474 -
tttaggtaattctcacagtg

SEQ ID NO: 63948 - DNA, 20 bp, Artificial Sequence
  Synthetic oligonucleotide; AAGGAT chr11 5163003 5163022 5163006 -
catcccacagcatgctttga

SEQ ID NO: 63949 - DNA, 20 bp, Artificial Sequence
  Synthetic oligonucleotide; CAGAAT chr11 5162884 5162903 5162887 -
acaagccttacaggttagtt

SEQ ID NO: 63950 - DNA, 20 bp, Artificial Sequence
  Synthetic oligonucleotide; CTGGAT chr11 5162776 5162795 5162779 -
ctataacccattattctgtt

SEQ ID NO: 63951 - DNA, 20 bp, Artificial Sequence
  Synthetic oligonucleotide; CAGAAT chr11 5162463 5162482 5162466 -
ctaggcatagttagtgcggt

SEQ ID NO: 63952 - DNA, 20 bp, Artificial Sequence
  Synthetic oligonucleotide; AGGGAT chr11 5161857 5161876 5161860 -
ctgctattctgctactcctc

SEQ ID NO: 63953 - DNA, 20 bp, Artificial Sequence
  Synthetic oligonucleotide; GAGGAT chr11 5161815 5161834 5161818 -
cttccctacacatcaagctc

SEQ ID NO: 63954 - DNA, 20 bp, Artificial Sequence
  Synthetic oligonucleotide; CTGAGT chr11 5161765 5161784 5161768 -
ttagatttactcaacatgcc

SEQ ID NO: 63955 - DNA, 20 bp, Artificial Sequence
  Synthetic oligonucleotide; CTGGAT chr11 5161718 5161737 5161721 -
agtctaggtagacactttca

SEQ ID NO: 63956 - DNA, 20 bp, Artificial Sequence
  Synthetic oligonucleotide; CAGGGT chr11 5161694 5161713 5161697 -
ataagtagaggtctttccta

SEQ ID NO: 63957 - DNA, 20 bp, Artificial Sequence
  Synthetic oligonucleotide; CAGAAT chr11 5161389 5161408 5161392 -
tcagaagtcagacctgtcct

SEQ ID NO: 63958 - DNA, 20 bp, Artificial Sequence
  Synthetic oligonucleotide; CAGGGT chr11 5161379 5161398 5161382 -
gacctgtcctcagaatgcta

SEQ ID NO: 63959 - DNA, 20 bp, Artificial Sequence
  Synthetic oligonucleotide; TAGAAT chr11 5161299 5161318 5161302 -
ttccagacaccagaccaact

SEQ ID NO: 63960 - DNA, 20 bp, Artificial Sequence
  Synthetic oligonucleotide; TTGAAT chr11 5161081 5161100 5161084 -
tctttgctggcaggactatg

SEQ ID NO: 63961 - DNA, 20 bp, Artificial Sequence
  Synthetic oligonucleotide; AGGAAT chr11 5160713 5160732 5160716 -
tcttattaatataagaagac

SEQ ID NO: 63962 - DNA, 20 bp, Artificial Sequence
  Synthetic oligonucleotide; AGGGAT chr11 5160311 5160330 5160314 -
ctgtttggtagtctcctcac

SEQ ID NO: 63963 - DNA, 20 bp, Artificial Sequence
  Synthetic oligonucleotide; CTGAAT chr11 5160295 5160314 5160298 -
tcacagggatgcgcatgaaa

SEQ ID NO: 63964 - DNA, 20 bp, Artificial Sequence
  Synthetic oligonucleotide; ATGAGT chr11 5160284 5160303 5160287 -
cgcatgaaactgaataacca

SEQ ID NO: 63965 - DNA, 20 bp, Artificial Sequence
  Synthetic oligonucleotide; CAGGAT chr11 5160202 5160221 5160205 -
atacaacataccaaaaccta

SEQ ID NO: 63966 - DNA, 20 bp, Artificial Sequence
  Synthetic oligonucleotide; AAGAGT chr11 5159928 5159947 5159931 -
tcaacaaaactttaagaaaa

SEQ ID NO: 63967 - DNA, 20 bp, Artificial Sequence
  Synthetic oligonucleotide; GAGGAT chr11 5159898 5159917 5159901 -
taaaattagaaaatgaaaaa

SEQ ID NO: 63968 - DNA, 20 bp, Artificial Sequence
  Synthetic oligonucleotide; TAGAAT chr11 5159813 5159832 5159816 -
ttccaacaaattggaaaatc

SEQ ID NO: 63969 - DNA, 20 bp, Artificial Sequence
  Synthetic oligonucleotide; ATGGAT chr11 5159805 5159824 5159808 -
aattggaaaatctagaataa

SEQ ID NO: 63970 - DNA, 20 bp, Artificial Sequence
  Synthetic oligonucleotide; ATGAAT chr11 5159730 5159749 5159733 -
aaaacctcaatagaacaata

SEQ ID NO: 63971 - DNA, 20 bp, Artificial Sequence
  Synthetic oligonucleotide; AAGAAT chr11 5159378 5159397 5159381 -
tctaaggactgaaataaggc

SEQ ID NO: 63972 - DNA, 20 bp, Artificial Sequence
  Synthetic oligonucleotide; CAGGAT chr11 5159172 5159191 5159175 -
taaaaaaatcaataaagtta

SEQ ID NO: 63973 - DNA, 20 bp, Artificial Sequence
  Synthetic oligonucleotide; AGGAGT chr11 5159054 5159073 5159057 -
aataaaaatataaaataccc

SEQ ID NO: 63974 - DNA, 20 bp, Artificial Sequence
  Synthetic oligonucleotide; AAGAAT chr11 5158934 5158953 5158937 -
attccatgctcatgaactag

SEQ ID NO: 63975 - DNA, 20 bp, Artificial Sequence
  Synthetic oligonucleotide; GGGGAT chr11 5158522 5158541 5158525 -
actttgtgaggctgaggtgg

SEQ ID NO: 63976 - DNA, 20 bp, Artificial Sequence
  Synthetic oligonucleotide; AGGAGT chr11 5158507 5158526 5158510 -
ggtggggggatcacgaggtc

SEQ ID NO: 63977 - DNA, 20 bp, Artificial Sequence
  Synthetic oligonucleotide; GAGAAT chr11 5158389 5158408 5158392 -
tactcaggaggctgaggcag

SEQ ID NO: 63978 - DNA, 20 bp, Artificial Sequence
  Synthetic oligonucleotide; CTGGAT chr11 5158240 5158259 5158243 -
aagaaacagtgctaggaaaa

SEQ ID NO: 63979 - DNA, 20 bp, Artificial Sequence
  Synthetic oligonucleotide; AAGAGT chr11 5158222 5158241 5158225 -
aactggatatccatttgcaa

SEQ ID NO: 63980 - DNA, 20 bp, Artificial Sequence
  Synthetic oligonucleotide; ATGGAT chr11 5158171 5158190 5158174 -
tatacaaaaatcaaatcaag

SEQ ID NO: 63981 - DNA, 20 bp, Artificial Sequence
  Synthetic oligonucleotide; TTGAAT chr11 5158158 5158177 5158161 -
aatcaagatggattaaagac

SEQ ID NO: 63982 - DNA, 20 bp, Artificial Sequence
  Synthetic oligonucleotide; TGGGAT chr11 5158024 5158043 5158027 -
ccaaaacaaaaatagacaat

SEQ ID NO: 63983 - DNA, 20 bp, Artificial Sequence
  Synthetic oligonucleotide; AAGAAT chr11 5157967 5157986 5157970 -
taaagtgaagagacaaccca

SEQ ID NO: 63984 - DNA, 20 bp, Artificial Sequence
  Synthetic oligonucleotide; AGGAAT chr11 5157928 5157947 5157931 -
tgcaaactatatattttaca

SEQ ID NO: 63985 - DNA, 20 bp, Artificial Sequence
  Synthetic oligonucleotide; CAGAAT chr11 5157915 5157934 5157918 -
ttttacaaggaattgataac

SEQ ID NO: 63986 - DNA, 20 bp, Artificial Sequence
  Synthetic oligonucleotide; CTGAAT chr11 5157847 5157866 5157850 -
ataaataatggccaaaagac

SEQ ID NO: 63987 - DNA, 20 bp, Artificial Sequence
  Synthetic oligonucleotide; GTGGAT chr11 5157684 5157703 5157687 -
aggaaataacagatgcttgt

SEQ ID NO: 63988 - DNA, 20 bp, Artificial Sequence
  Synthetic oligonucleotide; GGGAGT chr11 5157645 5157664 5157648 -
aaccctcttacactgttggt

SEQ ID NO: 63989 - DNA, 20 bp, Artificial Sequence
  Synthetic oligonucleotide; AAGAAT chr11 5157533 5157552 5157536 -
tcctaggtatatacccttaa

SEQ ID NO: 63990 - DNA, 20 bp, Artificial Sequence
  Synthetic oligonucleotide; ATGGAT chr11 5157426 5157445 5157429 -
atgtattcgtcaacagataa

SEQ ID NO: 63991 - DNA, 20 bp, Artificial Sequence
  Synthetic oligonucleotide; TGGAAT chr11 5157378 5157397 5157381 -
acacacacacacacacacaa

SEQ ID NO: 63992 - DNA, 20 bp, Artificial Sequence
  Synthetic oligonucleotide; AAGAAT chr11 5157355 5157374 5157358 -
aatattattcaaccataaaa

SEQ ID NO: 63993 - DNA, 20 bp, Artificial Sequence
  Synthetic oligonucleotide; GTGGAT chr11 5157233 5157252 5157236 -
ctcgtgtggaagttaaaaac

SEQ ID NO: 63994 - DNA, 20 bp, Artificial Sequence
  Synthetic oligonucleotide; GAGAGT chr11 5157215 5157234 5157218 -
acgtggatcttatgaagaca

SEQ ID NO: 63995 - DNA, 20 bp, Artificial Sequence
  Synthetic oligonucleotide; AGGAAT chr11 5157176 5157195 5157179 -
ccggcggcgggagggaagaa

SEQ ID NO: 63996 - DNA, 20 bp, Artificial Sequence
  Synthetic oligonucleotide; GTGAAT chr11 5157079 5157098 5157082 -
gtgtatatatatataaaaat

SEQ ID NO: 63997 - DNA, 20 bp, Artificial Sequence
  Synthetic oligonucleotide; CTGGGT chr11 5156991 5157010 5156994 -
tcaaaaatggtaaagatggg

SEQ ID NO: 63998 - DNA, 20 bp, Artificial Sequence
  Synthetic oligonucleotide; GTGGAT chr11 5156938 5156957 5156941 -
actttgggaggccaaggcag

SEQ ID NO: 63999 - DNA, 20 bp, Artificial Sequence
  Synthetic oligonucleotide; AGGAGT chr11 5156923 5156942 5156926 -
ggcaggtggatcatgaggtc

SEQ ID NO: 64000 - DNA, 20 bp, Artificial Sequence
  Synthetic oligonucleotide; GAGAAT chr11 5156804 5156823 5156807 -
tacttgggaggcttgggcag

SEQ ID NO: 64001 - DNA, 20 bp, Artificial Sequence
  Synthetic oligonucleotide; CTGGAT chr11 5156737 5156756 5156740 -
tcctaccactgcactccagc

SEQ ID NO: 64002 - DNA, 20 bp, Artificial Sequence
  Synthetic oligonucleotide; CCGGGT chr11 5156627 5156646 5156630 -
tttaaaaaatattcagtagg

SEQ ID NO: 64003 - DNA, 20 bp, Artificial Sequence
  Synthetic oligonucleotide; GCGGGT chr11 5156578 5156597 5156581 -
cagcactttgggaggcggag

SEQ ID NO: 64004 - DNA, 20 bp, Artificial Sequence
  Synthetic oligonucleotide; GTGGAT chr11 5156574 5156593 5156577 -
actttgggaggcggaggcgg

SEQ ID NO: 64005 - DNA, 20 bp, Artificial Sequence
  Synthetic oligonucleotide; GCGGGT chr11 5156479 5156498 5156482 -
aaaattagccgggcttggtg

SEQ ID NO: 64006 - DNA, 20 bp, Artificial Sequence
  Synthetic oligonucleotide; GAGAAT chr11 5156438 5156457 5156441 -
tactatggaggctgaggcgg

SEQ ID NO: 64007 - DNA, 20 bp, Artificial Sequence
  Synthetic oligonucleotide; TTGAAT chr11 5156232 5156251 5156235 -
acaatgaaaaaaaaataacc

SEQ ID NO: 64008 - DNA, 20 bp, Artificial Sequence
  Synthetic oligonucleotide; AAGGAT chr11 5156197 5156216 5156200 -
aactcattgacaatgtttca

SEQ ID NO: 64009 - DNA, 20 bp, Artificial Sequence
  Synthetic oligonucleotide; AGGGAT chr11 5156188 5156207 5156191 -
acaatgtttcaaaggatgtg

SEQ ID NO: 64010 - DNA, 20 bp, Artificial Sequence
  Synthetic oligonucleotide; AGGAGT chr11 5156103 5156122 5156106 -
tgggctggaaatattgttat

SEQ ID NO: 64011 - DNA, 20 bp, Artificial Sequence
  Synthetic oligonucleotide; TGGAGT chr11 5156068 5156087 5156071 -
aaggtgacaactaaattatt

SEQ ID NO: 64012 - DNA, 20 bp, Artificial Sequence
  Synthetic oligonucleotide; TGGAGT chr11 5156059 5156078 5156062 -
actaaattatttggagtaga

SEQ ID NO: 64013 - DNA, 20 bp, Artificial Sequence
  Synthetic oligonucleotide; GTGAAT chr11 5156042 5156061 5156045 -
agatggagtcaccagcacat

SEQ ID NO: 64014 - DNA, 20 bp, Artificial Sequence
  Synthetic oligonucleotide; TAGAAT chr11 5156031 5156050 5156034 -
ccagcacatgtgaatagttt

SEQ ID NO: 64015 - DNA, 20 bp, Artificial Sequence
  Synthetic oligonucleotide; AAGAAT chr11 5155914 5155933 5155917 -
aaattgtttcttagtgacaa

SEQ ID NO: 64016 - DNA, 20 bp, Artificial Sequence
  Synthetic oligonucleotide; CTGAAT chr11 5155905 5155924 5155908 -
cttagtgacaaaagaataac

SEQ ID NO: 64017 - DNA, 20 bp, Artificial Sequence
  Synthetic oligonucleotide; CTGAAT chr11 5155874 5155893 5155877 -
attagctgcctatatgctct

SEQ ID NO: 64018 - DNA, 20 bp, Artificial Sequence
  Synthetic oligonucleotide; TGGGGT chr11 5155797 5155816 5155800 -
gaaattctggaaagagcaca

SEQ ID NO: 64019 - DNA, 20 bp, Artificial Sequence
  Synthetic oligonucleotide; GAGAAT chr11 5155632 5155651 5155635 -
accagctgtaaaatgtcaag

SEQ ID NO: 64020 - DNA, 20 bp, Artificial Sequence
  Synthetic oligonucleotide; TAGAAT chr11 5155602 5155621 5155605 -
tcatatgcataagtcttgct

SEQ ID NO: 64021 - DNA, 20 bp, Artificial Sequence
  Synthetic oligonucleotide; TAGAAT chr11 5155503 5155522 5155506 -
ataatttttttcatttcatt

SEQ ID NO: 64022 - DNA, 20 bp, Artificial Sequence
  Synthetic oligonucleotide; AGGAAT chr11 5155472 5155491 5155475 -
acatctcactcataaatagt

SEQ ID NO: 64023 - DNA, 20 bp, Artificial Sequence
  Synthetic oligonucleotide; ATGGAT chr11 5155398 5155417 5155401 -
agaaagagagaaaagaggaa

SEQ ID NO: 64024 - DNA, 20 bp, Artificial Sequence
  Synthetic oligonucleotide; AAGAAT chr11 5155309 5155328 5155312 -
ccattataatttgtcactat

SEQ ID NO: 64025 - DNA, 20 bp, Artificial Sequence
  Synthetic oligonucleotide; AAGAAT chr11 5155253 5155272 5155256 -
cttcaataaaataaaatggg

SEQ ID NO: 64026 - DNA, 20 bp, Artificial Sequence
  Synthetic oligonucleotide; ATGAAT chr11 5155201 5155220 5155204 -
ttgtgtggtaaaaagtagtt

SEQ ID NO: 64027 - DNA, 20 bp, Artificial Sequence
  Synthetic oligonucleotide; CTGAAT chr11 5155180 5155199 5155183 -
tgaatacagatttttctttt

SEQ ID NO: 64028 - DNA, 20 bp, Artificial Sequence
  Synthetic oligonucleotide; AGGAAT chr11 5155120 5155139 5155123 -
accaagatatttatttaaat

SEQ ID NO: 64029 - DNA, 20 bp, Artificial Sequence
  Synthetic oligonucleotide; TAGAAT chr11 5155081 5155100 5155084 -
tgtttgcattaaatgggctt

SEQ ID NO: 64030 - DNA, 20 bp, Artificial Sequence
  Synthetic oligonucleotide; ATGAAT chr11 5155020 5155039 5155023 -
tgtaaaaaaattttttgcat

SEQ ID NO: 64031 - DNA, 20 bp, Artificial Sequence
  Synthetic oligonucleotide; GGGGAT chr11 5154942 5154961 5154945 -
gcaagtgtagaaataattac

SEQ ID NO: 64032 - DNA, 20 bp, Artificial Sequence
  Synthetic oligonucleotide; CTGGGT chr11 5154895 5154914 5154898 -
gagggctgacttaaaatttg

SEQ ID NO: 64033 - DNA, 20 bp, Artificial Sequence
  Synthetic oligonucleotide; AGGAAT chr11 5154810 5154829 5154813 -
acttctccacacattcataa

SEQ ID NO: 64034 - DNA, 20 bp, Artificial Sequence
  Synthetic oligonucleotide; GTGGAT chr11 5154795 5154814 5154798 -
cataaaggaatattaaattg

SEQ ID NO: 64035 - DNA, 20 bp, Artificial Sequence
  Synthetic oligonucleotide; CAGAAT chr11 5154742 5154761 5154745 -
aataaattcatcccgtgttt

SEQ ID NO: 64036 - DNA, 20 bp, Artificial Sequence
  Synthetic oligonucleotide; ATGAGT chr11 5154721 5154740 5154724 -
agaatgctacagacctcact

SEQ ID NO: 64037 - DNA, 20 bp, Artificial Sequence
  Synthetic oligonucleotide; GGGGAT chr11 5154708 5154727 5154711 -
cctcactatgagttttactg

SEQ ID NO: 64038 - DNA, 20 bp, Artificial Sequence
  Synthetic oligonucleotide; CAGAGT chr11 5154567 5154586 5154570 -
gcacatatcctggcaccaaa

SEQ ID NO: 64039 - DNA, 20 bp, Artificial Sequence
  Synthetic oligonucleotide; CTGGAT chr11 5154544 5154563 5154547 -
agtaaaatttatgacattag

SEQ ID NO: 64040 - DNA, 20 bp, Artificial Sequence
  Synthetic oligonucleotide; CAGAGT chr11 5154529 5154548 5154532 -
attagctggatgctgttaca

SEQ ID NO: 64041 - DNA, 20 bp, Artificial Sequence
  Synthetic oligonucleotide; GGGAAT chr11 5154483 5154502 5154486 -
tcacagaacccacaacttaa

SEQ ID NO: 64042 - DNA, 20 bp, Artificial Sequence
  Synthetic oligonucleotide; TGGAAT chr11 5154472 5154491 5154475 -
acaacttaagggaatgaagc

SEQ ID NO: 64043 - DNA, 20 bp, Artificial Sequence
  Synthetic oligonucleotide; GTGAGT chr11 5154447 5154466 5154450 -
tccttggagaagaaaaattg

SEQ ID NO: 64044 - DNA, 20 bp, Artificial Sequence
  Synthetic oligonucleotide; ATGAAT chr11 5154440 5154459 5154443 -
agaagaaaaattggtgagtg

SEQ ID NO: 64045 - DNA, 20 bp, Artificial Sequence
  Synthetic oligonucleotide; AGGAGT chr11 5154361 5154380 5154364 -
ccagctctcaataataattg

SEQ ID NO: 64046 - DNA, 20 bp, Artificial Sequence
  Synthetic oligonucleotide; TTGAAT chr11 5154199 5154218 5154202 -
cacatgtcagctctttggtc

SEQ ID NO: 64047 - DNA, 20 bp, Artificial Sequence
  Synthetic oligonucleotide; AAGGAT chr11 5154168 5154187 5154171 -
agacattgtgattgccatta

SEQ ID NO: 64048 - DNA, 20 bp, Artificial Sequence
  Synthetic oligonucleotide; ATGGAT chr11 5154094 5154113 5154097 -
ttagaaaaagccagtgactt

SEQ ID NO: 64049 - DNA, 20 bp, Artificial Sequence
  Synthetic oligonucleotide; GGGAGT chr11 5154088 5154107 5154091 -
aaagccagtgacttatggat

SEQ ID NO: 64050 - DNA, 20 bp, Artificial Sequence
  Synthetic oligonucleotide; GGGGAT chr11 5154064 5154083 5154067 -
gtgtcataaaactaagcatt

SEQ ID NO: 64051 - DNA, 20 bp, Artificial Sequence
  Synthetic oligonucleotide; TTGAAT chr11 5153915 5153934 5153918 -
cagcagttgaacatttgttg

SEQ ID NO: 64052 - DNA, 20 bp, Artificial Sequence
  Synthetic oligonucleotide; TTGAGT chr11 5153907 5153926 5153910 -
gaacatttgttgttgaatat

SEQ ID NO: 64053 - DNA, 20 bp, Artificial Sequence
  Synthetic oligonucleotide; CTGAAT chr11 5153789 5153808 5153792 -
tttcaaagaacagctacttc

SEQ ID NO: 64054 - DNA, 20 bp, Artificial Sequence
  Synthetic oligonucleotide; AAGAAT chr11 5153698 5153717 5153701 -
ctttattgaagtgtctagga

SEQ ID NO: 64055 - DNA, 20 bp, Artificial Sequence
  Synthetic oligonucleotide; AAGAGT chr11 5153091 5153110 5153094 -
ttttaaactcacaacatttc

SEQ ID NO: 64056 - DNA, 20 bp, Artificial Sequence
  Synthetic oligonucleotide; CTGAAT chr11 5152944 5152963 5152947 -
agcattctctttacattatt

SEQ ID NO: 64057 - DNA, 20 bp, Artificial Sequence
  Synthetic oligonucleotide; TTGGGT chr11 5152915 5152934 5152918 -
aaaagaaatatattatgttc

SEQ ID NO: 64058 - DNA, 20 bp, Artificial Sequence
  Synthetic oligonucleotide; GGGAAT chr11 5152877 5152896 5152880 -
tacctctattctctttcatt

SEQ ID NO: 64059 - DNA, 20 bp, Artificial Sequence
  Synthetic oligonucleotide; CAGAGT chr11 5152850 5152869 5152853 -
ttttacaccaatgtactggt

SEQ ID NO: 64060 - DNA, 20 bp, Artificial Sequence
  Synthetic oligonucleotide; AGGAAT chr11 5152786 5152805 5152789 -
tggaaatagttaaatactag

SEQ ID NO: 64061 - DNA, 20 bp, Artificial Sequence
  Synthetic oligonucleotide; TTGGAT chr11 5152619 5152638 5152622 -
ttttgctggttctaatgtat

SEQ ID NO: 64062 - DNA, 20 bp, Artificial Sequence
  Synthetic oligonucleotide; GTGAAT chr11 5152576 5152595 5152579 -
cctattatggcacagtgcct

SEQ ID NO: 64063 - DNA, 20 bp, Artificial Sequence
  Synthetic oligonucleotide; ATGAAT chr11 5152541 5152560 5152544 -
gaaaacagtgatgtatctcc

SEQ ID NO: 64064 - DNA, 20 bp, Artificial Sequence
  Synthetic oligonucleotide; GTGAAT chr11 5152514 5152533 5152517 -
catcttttcctttcaaaact

SEQ ID NO: 64065 - DNA, 20 bp, Artificial Sequence
  Synthetic oligonucleotide; ATGGAT chr11 5152505 5152524 5152508 -
ctttcaaaactgtgaataag

SEQ ID NO: 64066 - DNA, 20 bp, Artificial Sequence
  Synthetic oligonucleotide; TAGAGT chr11 5152494 5152513 5152497 -
gtgaataagatggatgattt

SEQ ID NO: 64067 - DNA, 20 bp, Artificial Sequence
  Synthetic oligonucleotide; ATGAGT chr11 5152460 5152479 5152463 -
aatcagacagactcaatata

SEQ ID NO: 64068 - DNA, 20 bp, Artificial Sequence
  Synthetic oligonucleotide; AGGGAT chr11 5152320 5152339 5152323 -
ccctctgtgttgacactagt

SEQ ID NO: 64069 - DNA, 20 bp, Artificial Sequence
  Synthetic oligonucleotide; TAGAAT chr11 5152306 5152325 5152309 -
actagtagggatcccaggcc

SEQ ID NO: 64070 - DNA, 20 bp, Artificial Sequence
  Synthetic oligonucleotide; CTGGAT chr11 5152290 5152309 5152293 -
ggcctagaatctgtgcagtg

SEQ ID NO: 64071 - DNA, 20 bp, Artificial Sequence
  Synthetic oligonucleotide; TGGGAT chr11 5152284 5152303 5152287 -
gaatctgtgcagtgctggat

SEQ ID NO: 64072 - DNA, 20 bp, Artificial Sequence
  Synthetic oligonucleotide; TGGAAT chr11 5152119 5152138 5152122 -
agcattatgccaaagatgct

SEQ ID NO: 64073 - DNA, 20 bp, Artificial Sequence
  Synthetic oligonucleotide; CAGGGT chr11 5152043 5152062 5152046 -
tgtggttcatccacacattg

SEQ ID NO: 64074 - DNA, 20 bp, Artificial Sequence
  Synthetic oligonucleotide; TAGAGT chr11 5152036 5152055 5152039 -
catccacacattgcagggta

SEQ ID NO: 64075 - DNA, 20 bp, Artificial Sequence
  Synthetic oligonucleotide; CAGGAT chr11 5151742 5151761 5151745 -
gtttgtggccttcactgtag

SEQ ID NO: 64076 - DNA, 20 bp, Artificial Sequence
  Synthetic oligonucleotide; TTGGGT chr11 5151571 5151590 5151574 -
ctccttcttcacacataggt

SEQ ID NO: 64077 - DNA, 20 bp, Artificial Sequence
  Synthetic oligonucleotide; CTGGGT chr11 5151344 5151363 5151347 -
aaaacatattatttgagatg

SEQ ID NO: 64078 - DNA, 20 bp, Artificial Sequence
  Synthetic oligonucleotide; TGGGAT chr11 5151280 5151299 5151283 -
tcatggctcatatcaatcag

SEQ ID NO: 64079 - DNA, 20 bp, Artificial Sequence
  Synthetic oligonucleotide; GTGAAT chr11 5151273 5151292 5151276 -
tcatatcaatcagtgggatt

SEQ ID NO: 64080 - DNA, 20 bp, Artificial Sequence
  Synthetic oligonucleotide; ATGAGT chr11 5151235 5151254 5151238 -
atgaaagtgagaagtgtgaa

SEQ ID NO: 64081 - DNA, 20 bp, Artificial Sequence
  Synthetic oligonucleotide; GTGAAT chr11 5151223 5151242 5151226 -
agtgtgaaatgagtgaagta

SEQ ID NO: 64082 - DNA, 20 bp, Artificial Sequence
  Synthetic oligonucleotide; TTGAGT chr11 5151180 5151199 5151183 -
ttttattctttagcccctgg

SEQ ID NO: 64083 - DNA, 20 bp, Artificial Sequence
  Synthetic oligonucleotide; AAGAAT chr11 5151165 5151184 5151168 -
cctggttgagttattcttct

SEQ ID NO: 64084 - DNA, 20 bp, Artificial Sequence
  Synthetic oligonucleotide; GAGGAT chr11 5151149 5151168 5151152 -
ttctaagaatatttctccag

SEQ ID NO: 64085 - DNA, 20 bp, Artificial Sequence
  Synthetic oligonucleotide; CTGAAT chr11 5151122 5151141 5151125 -
tataaattatgcctttgtca

SEQ ID NO: 64086 - DNA, 20 bp, Artificial Sequence
  Synthetic oligonucleotide; ATGAAT chr11 5150969 5150988 5150972 -
ttcttgtcaaagaaaatctt

SEQ ID NO: 64087 - DNA, 20 bp, Artificial Sequence
  Synthetic oligonucleotide; CAGAGT chr11 5150924 5150943 5150927 -
taaaaatttaaatacatttt

SEQ ID NO: 64088 - DNA, 20 bp, Artificial Sequence
  Synthetic oligonucleotide; AGGAAT chr11 5150912 5150931 5150915 -
tacattttcagagtcataca

SEQ ID NO: 64089 - DNA, 20 bp, Artificial Sequence
  Synthetic oligonucleotide; CAGAAT chr11 5150768 5150787 5150771 -
atattaaaaatactatacta

SEQ ID NO: 64090 - DNA, 20 bp, Artificial Sequence
  Synthetic oligonucleotide; GTGAAT chr11 5150736 5150755 5150739 -
ataatagtaaatctggcaca

SEQ ID NO: 64091 - DNA, 20 bp, Artificial Sequence
  Synthetic oligonucleotide; ATGAGT chr11 5150723 5150742 5150726 -
tggcacagtgaataattctc

SEQ ID NO: 64092 - DNA, 20 bp, Artificial Sequence
  Synthetic oligonucleotide; GGGAAT chr11 5150669 5150688 5150672 -
gactgaaaggaagagaggtg

SEQ ID NO: 64093 - DNA, 20 bp, Artificial Sequence
  Synthetic oligonucleotide; TAGGAT chr11 5150621 5150640 5150624 -
agaaataacaagtgtacaca

SEQ ID NO: 64094 - DNA, 20 bp, Artificial Sequence
  Synthetic oligonucleotide; TGGAGT chr11 5150614 5150633 5150617 -
acaagtgtacacataggatg

SEQ ID NO: 64095 - DNA, 20 bp, Artificial Sequence
  Synthetic oligonucleotide; GAGAAT chr11 5150603 5150622 5150606 -
cataggatgtggagttcaga

SEQ ID NO: 64096 - DNA, 20 bp, Artificial Sequence
  Synthetic oligonucleotide; GGGAGT chr11 5150571 5150590 5150574 -
ttgaaatctaaccaaagcag

SEQ ID NO: 64097 - DNA, 20 bp, Artificial Sequence
  Synthetic oligonucleotide; AGGAAT chr11 5150515 5150534 5150518 -
gtagttacctctgattcttg

SEQ ID NO: 64098 - DNA, 20 bp, Artificial Sequence
  Synthetic oligonucleotide; ATGGAT chr11 5150508 5150527 5150511 -
cctctgattcttgaggaatg

SEQ ID NO: 64099 - DNA, 20 bp, Artificial Sequence
  Synthetic oligonucleotide; ATGAGT chr11 5150504 5150523 5150507 -
tgattcttgaggaatgatgg

SEQ ID NO: 64100 - DNA, 20 bp, Artificial Sequence
  Synthetic oligonucleotide; ATGAGT chr11 5150401 5150420 5150404 -
tctagttttttcaatatggt

SEQ ID NO: 64101 - DNA, 20 bp, Artificial Sequence
  Synthetic oligonucleotide; ATGAAT chr11 5150364 5150383 5150367 -
cttggggagacaaggaaaat

SEQ ID NO: 64102 - DNA, 20 bp, Artificial Sequence
  Synthetic oligonucleotide; CAGAGT chr11 5150333 5150352 5150336 -
aaatggctattaatgttgtg

SEQ ID NO: 64103 - DNA, 20 bp, Artificial Sequence
  Synthetic oligonucleotide; GAGAGT chr11 5150290 5150309 5150293 -
aaagctataatgtgccattg

SEQ ID NO: 64104 - DNA, 20 bp, Artificial Sequence
  Synthetic oligonucleotide; AAGAAT chr11 5150113 5150132 5150116 -
ttgtctaaaattagtggcat

SEQ ID NO: 64105 - DNA, 24 bp, Artificial Sequence
  Synthetic oligonucleotide; GTTAGATT chr11 5150555 5150578 5150575 +
aataaatgcaactcccctgctttg

SEQ ID NO: 64106 - DNA, 24 bp, Artificial Sequence
  Synthetic oligonucleotide; GCCAGATT chr11 5150715 5150738 5150735 +
aaactcatgagaattattcactgt

SEQ ID NO: 64107 - DNA, 24 bp, Artificial Sequence
  Synthetic oligonucleotide; TCACGATT chr11 5150733 5150756 5150753 +
cactgtgccagatttactattatg

SEQ ID NO: 64108 - DNA, 24 bp, Artificial Sequence
  Synthetic oligonucleotide; ATAAGATT chr11 5150943 5150966 5150963 +
aggctttattgtctcttgatattc

SEQ ID NO: 64109 - DNA, 24 bp, Artificial Sequence
  Synthetic oligonucleotide; CTTTGATT chr11 5150984 5151007 5151004 +
aagaacacagttaacatgtacttc

SEQ ID NO: 64110 - DNA, 24 bp, Artificial Sequence
  Synthetic oligonucleotide; CACTGATT chr11 5151254 5151277 5151274 +
ttagtcacgtagaattcacaatcc

SEQ ID NO: 64111 - DNA, 24 bp, Artificial Sequence
  Synthetic oligonucleotide; GGCAGATT chr11 5151300 5151323 5151320 +
tgatctaaaaccagctattgtgct

SEQ ID NO: 64112 - DNA, 24 bp, Artificial Sequence
  Synthetic oligonucleotide; GGTGGATT chr11 5151399 5151422 5151419 +
aaaaagcatgtaggcattaattaa

SEQ ID NO: 64113 - DNA, 24 bp, Artificial Sequence
  Synthetic oligonucleotide; AGTGGATT chr11 5151468 5151491 5151488 +
tgtgtggtctttgcaccatagaca

SEQ ID NO: 64114 - DNA, 24 bp, Artificial Sequence
  Synthetic oligonucleotide; CATAGATT chr11 5151742 5151765 5151762 +
ctacagtgaaggccacaaacaaac

SEQ ID NO: 64115 - DNA, 24 bp, Artificial Sequence
  Synthetic oligonucleotide; AATAGATT chr11 5152060 5152083 5152080 +
acatttgaagcaagcaggaatcaa

SEQ ID NO: 64116 - DNA, 24 bp, Artificial Sequence
  Synthetic oligonucleotide; CTCAGATT chr11 5152184 5152207 5152204 +
gtacaagggctcatggagactgcg

SEQ ID NO: 64117 - DNA, 24 bp, Artificial Sequence
  Synthetic oligonucleotide; CACAGATT chr11 5152271 5152294 5152291 +
gaatggaatcccaatccagcactg

SEQ ID NO: 64118 - DNA, 24 bp, Artificial Sequence
  Synthetic oligonucleotide; TTCTGATT chr11 5152414 5152437 5152434 +
cagtgttactgttcctcttctgct

SEQ ID NO: 64119 - DNA, 24 bp, Artificial Sequence
  Synthetic oligonucleotide; GTCTGATT chr11 5152448 5152471 5152468 +
ctccaaactcattatattgagtct

SEQ ID NO: 64120 - DNA, 24 bp, Artificial Sequence
  Synthetic oligonucleotide; GATGGATT chr11 5152506 5152529 5152526 +
ttattcacagttttgaaaggaaaa

SEQ ID NO: 64121 - DNA, 24 bp, Artificial Sequence
  Synthetic oligonucleotide; AGGGGATT chr11 5152625 5152648 5152645 +
tagaaccagcaaaatcacctggac

SEQ ID NO: 64122 - DNA, 24 bp, Artificial Sequence
  Synthetic oligonucleotide; AAAAGATT chr11 5152842 5152865 5152862 +
agactctgaccagtacattggtgt

SEQ ID NO: 64123 - DNA, 24 bp, Artificial Sequence
  Synthetic oligonucleotide; GACAGATT chr11 5153384 5153407 5153404 +
ttagtaaaaataaaaaagctaaag

SEQ ID NO: 64124 - DNA, 24 bp, Artificial Sequence
  Synthetic oligonucleotide; TGATGATT chr11 5153509 5153532 5153529 +
aatttagtcacttttcaatttcac

SEQ ID NO: 64125 - DNA, 24 bp, Artificial Sequence
  Synthetic oligonucleotide; CTTTGATT chr11 5154014 5154037 5154034 +
gtaaactagtaggtcaattaaata

SEQ ID NO: 64126 - DNA, 24 bp, Artificial Sequence
  Synthetic oligonucleotide; CACAGATT chr11 5154024 5154047 5154044 +
aggtcaattaaatactttgatttc

SEQ ID NO: 64127 - DNA, 24 bp, Artificial Sequence
  Synthetic oligonucleotide; GAGTGATT chr11 5154266 5154289 5154286 +
tgtaagttcctggttagttggata

SEQ ID NO: 64128 - DNA, 24 bp, Artificial Sequence
  Synthetic oligonucleotide; CAAGGATT chr11 5154437 5154460 5154457 +
catcactcaccaatttttcttctc

SEQ ID NO: 64129 - DNA, 24 bp, Artificial Sequence
  Synthetic oligonucleotide; GAGGGATT chr11 5154829 5154852 5154849 +
taggaggagttatgagcatgaaat

SEQ ID NO: 64130 - DNA, 24 bp, Artificial Sequence
  Synthetic oligonucleotide; ATGGGATT chr11 5155525 5155548 5155545 +
tcttacctttaaattattagtaaa

SEQ ID NO: 64131 - DNA, 24 bp, Artificial Sequence
  Synthetic oligonucleotide; AATGGATT chr11 5155722 5155745 5155742 +
atactaatggtggagaatatttat

SEQ ID NO: 64132 - DNA, 24 bp, Artificial Sequence
  Synthetic oligonucleotide; AATTGATT chr11 5155839 5155862 5155859 +
atagtactgttgcatgttgaatga

SEQ ID NO: 64133 - DNA, 24 bp, Artificial Sequence
  Synthetic oligonucleotide; TACTGATT chr11 5155947 5155970 5155967 +
atttggtttcttcctcttctctta

SEQ ID NO: 64134 - DNA, 24 bp, Artificial Sequence
  Synthetic oligonucleotide; CCCAGATT chr11 5156095 5156118 5156115 +
taactcctataacaatatttccag

SEQ ID NO: 64135 - DNA, 24 bp, Artificial Sequence
  Synthetic oligonucleotide; TCTGGATT chr11 5156273 5156296 5156293 +
tttacatatgcatcaataactatc

SEQ ID NO: 64136 - DNA, 24 bp, Artificial Sequence
  Synthetic oligonucleotide; AAGCGATT chr11 5156769 5156792 5156789 +
gcaacctccgcccccaccaggttc

SEQ ID NO: 64137 - DNA, 24 bp, Artificial Sequence
  Synthetic oligonucleotide; GTGGGATT chr11 5156801 5156824 5156821 +
ctcctgcccaagcctcccaagtag

SEQ ID NO: 64138 - DNA, 24 bp, Artificial Sequence
  Synthetic oligonucleotide; CTGAGATT chr11 5156935 5156958 5156955 +
cacctgccttggcctcccaaagtg

SEQ ID NO: 64139 - DNA, 24 bp, Artificial Sequence
  Synthetic oligonucleotide; GCTTGATT chr11 5157134 5157157 5157154 +
gagagagagtgggagggttttttt

SEQ ID NO: 64140 - DNA, 24 bp, Artificial Sequence
  Synthetic oligonucleotide; AGTTGATT chr11 5157423 5157446 5157443 +
catttatctgttgacgaatacatc

SEQ ID NO: 64141 - DNA, 24 bp, Artificial Sequence
  Synthetic oligonucleotide; TTTTGATT chr11 5157732 5157755 5157752 +
aggtgagatgatatcacattgtgg

SEQ ID NO: 64142 - DNA, 24 bp, Artificial Sequence
  Synthetic oligonucleotide; TGGTGATT chr11 5157744 5157767 5157764 +
atcacattgtggttttgatttatc

SEQ ID NO: 64143 - DNA, 24 bp, Artificial Sequence
  Synthetic oligonucleotide; ATTGGATT chr11 5158123 5158146 5158143 +
tccagtagtttcataatttcaggt

SEQ ID NO: 64144 - DNA, 24 bp, Artificial Sequence
  Synthetic oligonucleotide; TCTTGATT chr11 5158146 5158169 5158166 +
tattggattcaagtctttaatcca

SEQ ID NO: 64145 - DNA, 24 bp, Artificial Sequence
  Synthetic oligonucleotide; ATTTGATT chr11 5158151 5158174 5158171 +
gattcaagtctttaatccatcttg

SEQ ID NO: 64146 - DNA, 24 bp, Artificial Sequence
  Synthetic oligonucleotide; GTCCGATT chr11 5158182 5158205 5158202 +
ttttgtatatagtgagagataggg

SEQ ID NO: 64147 - DNA, 24 bp, Artificial Sequence
  Synthetic oligonucleotide; AAGCGATT chr11 5158354 5158377 5158374 +
ctgcaacttctgcctcccaggttc

SEQ ID NO: 64148 - DNA, 24 bp, Artificial Sequence
  Synthetic oligonucleotide; CTGGGATT chr11 5158386 5158409 5158406 +
ctcctgcctcagcctcctgagtat

SEQ ID NO: 64149 - DNA, 24 bp, Artificial Sequence
  Synthetic oligonucleotide; CTGGGATT chr11 5158519 5158542 5158539 +
cccccacctcagcctcacaaagtg

SEQ ID NO: 64150 - DNA, 24 bp, Artificial Sequence
  Synthetic oligonucleotide; CCTGGATT chr11 5158613 5158636 5158633 +
taaagatgacttggttgttaagtg

SEQ ID NO: 64151 - DNA, 24 bp, Artificial Sequence
  Synthetic oligonucleotide; AGTAGATT chr11 5158705 5158728 5158725 +
gctgtttggctactgtagctttgt

SEQ ID NO: 64152 - DNA, 24 bp, Artificial Sequence
  Synthetic oligonucleotide; TCAGGATT chr11 5158756 5158779 5158776 +
tagctttggttttgttctttttgc

SEQ ID NO: 64153 - DNA, 24 bp, Artificial Sequence
  Synthetic oligonucleotide; TTAGGATT chr11 5158804 5158827 5158824 +
atcttttgtggttccatataaata

SEQ ID NO: 64154 - DNA, 24 bp, Artificial Sequence
  Synthetic oligonucleotide; GTTAGATT chr11 5159015 5159038 5159035 +
ttatagagatcttttacttcttgg

SEQ ID NO: 64155 - DNA, 24 bp, Artificial Sequence
  Synthetic oligonucleotide; ATAAGATT chr11 5159060 5159083 5159080 +
tttatatttttattgctattgtaa

SEQ ID NO: 64156 - DNA, 24 bp, Artificial Sequence
  Synthetic oligonucleotide; TATTGATT chr11 5159072 5159095 5159092 +
ttgctattgtaaataagattgttt

SEQ ID NO: 64157 - DNA, 24 bp, Artificial Sequence
  Synthetic oligonucleotide; TGCAGATT chr11 5159085 5159108 5159105 +
taagattgttttattgattttttt

SEQ ID NO: 64158 - DNA, 24 bp, Artificial Sequence
  Synthetic oligonucleotide; TACTGATT chr11 5159117 5159140 5159137 +
gataactttttatatatgaaatgc

SEQ ID NO: 64159 - DNA, 24 bp, Artificial Sequence
  Synthetic oligonucleotide; TATTGATT chr11 5159154 5159177 5159174 +
tttttatttcatatcctgtaactt

SEQ ID NO: 64160 - DNA, 24 bp, Artificial Sequence
  Synthetic oligonucleotide; GTACGATT chr11 5159602 5159625 5159622 +
tgtttgtttgtttgaggaatttga

SEQ ID NO: 64161 - DNA, 24 bp, Artificial Sequence
  Synthetic oligonucleotide; TCTAGATT chr11 5159785 5159808 5159805 +
gtgtccaggaatttatccatttat

SEQ ID NO: 64162 - DNA, 24 bp, Artificial Sequence
  Synthetic oligonucleotide; TGTTGATT chr11 5159918 5159941 5159938 +
tttgactcttttttcttaaagttt

SEQ ID NO: 64163 - DNA, 24 bp, Artificial Sequence
  Synthetic oligonucleotide; TAATGATT chr11 5159961 5159984 5159981 +
tccaagaaagcaactgtttgtttt

SEQ ID NO: 64164 - DNA, 24 bp, Artificial Sequence
  Synthetic oligonucleotide; ATAAGATT chr11 5160403 5160426 5160423 +
gggagataggagtggggctgtttt

SEQ ID NO: 64165 - DNA, 24 bp, Artificial Sequence
  Synthetic oligonucleotide; GCGGGATT chr11 5160805 5160828 5160825 +
cgatatttctcagggctgcttcga

SEQ ID NO: 64166 - DNA, 24 bp, Artificial Sequence
  Synthetic oligonucleotide; GAGAGATT chr11 5160839 5160862 5160859 +
gggcggcgtgggaacctagagtgg

SEQ ID NO: 64167 - DNA, 24 bp, Artificial Sequence
  Synthetic oligonucleotide; GGAAGATT chr11 5160855 5160878 5160875 +
tagagtgggagagattaagctgaa

SEQ ID NO: 64168 - DNA, 24 bp, Artificial Sequence
  Synthetic oligonucleotide; TATGGATT chr11 5160947 5160970 5160967 +
ggtgatggcctggatacggttttg

SEQ ID NO: 64169 - DNA, 24 bp, Artificial Sequence
  Synthetic oligonucleotide; ATCTGATT chr11 5161026 5161049 5161046 +
ctaagaagtgggaggacctaggac

SEQ ID NO: 64170 - DNA, 24 bp, Artificial Sequence
  Synthetic oligonucleotide; AGGAGATT chr11 5161046 5161069 5161066 +
ggacatctgattaaagagtgccta

SEQ ID NO: 64171 - DNA, 24 bp, Artificial Sequence
  Synthetic oligonucleotide; CAAAGATT chr11 5161071 5161094 5161091 +
ggagattcaacatagtcctgccag

SEQ ID NO: 64172 - DNA, 24 bp, Artificial Sequence
  Synthetic oligonucleotide; GGCTGATT chr11 5161550 5161573 5161570 +
tactaagagcctgaaaaactgctt

SEQ ID NO: 64173 - DNA, 24 bp, Artificial Sequence
  Synthetic oligonucleotide; GATAGATT chr11 5161882 5161905 5161902 +
acactgagaagttatttctttgag

SEQ ID NO: 64174 - DNA, 24 bp, Artificial Sequence
  Synthetic oligonucleotide; GCCGGATT chr11 5162135 5162158 5162155 +
gtggtatcaggaataatgtgggag

SEQ ID NO: 64175 - DNA, 24 bp, Artificial Sequence
  Synthetic oligonucleotide; AATAGATT chr11 5162247 5162270 5162267 +
atatgcatcaggtatgaggaagaa

SEQ ID NO: 64176 - DNA, 24 bp, Artificial Sequence
  Synthetic oligonucleotide; TTGTGATT chr11 5162296 5162319 5162316 +
tgtgaagagtgagctaagcatagt

SEQ ID NO: 64177 - DNA, 24 bp, Artificial Sequence
  Synthetic oligonucleotide; AAGGGATT chr11 5162485 5162508 5162505 +
aggaaaggagttgttgttttgtag

SEQ ID NO: 64178 - DNA, 24 bp, Artificial Sequence
  Synthetic oligonucleotide; GGGAGATT chr11 5162500 5162523 5162520 +
gttttgtagaagggattgaggttt

SEQ ID NO: 64179 - DNA, 24 bp, Artificial Sequence
  Synthetic oligonucleotide; TGCAGATT chr11 5162849 5162872 5162869 +
ggcaaaacaatttggttgataaga

SEQ ID NO: 64180 - DNA, 24 bp, Artificial Sequence
  Synthetic oligonucleotide; GAGTGATT chr11 5163023 5163046 5163043 +
ggatactggcattgagcggggtaa

SEQ ID NO: 64181 - DNA, 24 bp, Artificial Sequence
  Synthetic oligonucleotide; TGTGGATT chr11 5163098 5163121 5163118 +
gaggaagtagaggtgtcttatact

SEQ ID NO: 64182 - DNA, 24 bp, Artificial Sequence
  Synthetic oligonucleotide; TACTGATT chr11 5163416 5163439 5163436 +
gtaatgtggagtgggtagcctcca

SEQ ID NO: 64183 - DNA, 24 bp, Artificial Sequence
  Synthetic oligonucleotide; GTCCGATT chr11 5163621 5163644 5163641 +
agtggctgccaggtgagttgaaca

SEQ ID NO: 64184 - DNA, 24 bp, Artificial Sequence
  Synthetic oligonucleotide; GCCAGATT chr11 5163702 5163725 5163722 +
ctgcgggcattccttggcctggtg

SEQ ID NO: 64185 - DNA, 24 bp, Artificial Sequence
  Synthetic oligonucleotide; AGCAGATT chr11 5163974 5163997 5163994 +
tttggagttttatttaatgtcagg

SEQ ID NO: 64186 - DNA, 24 bp, Artificial Sequence
  Synthetic oligonucleotide; CTCTGATT chr11 5164119 5164142 5164139 +
atatttgatgaaagagcctaaacg

SEQ ID NO: 64187 - DNA, 24 bp, Artificial Sequence
  Synthetic oligonucleotide; AAAAGATT chr11 5164280 5164303 5164300 +
cgggtgtgaggaggggaggtgata

SEQ ID NO: 64188 - DNA, 24 bp, Artificial Sequence
  Synthetic oligonucleotide; GGAAGATT chr11 5164312 5164335 5164332 +
acagggtggaggagctgaggctga

SEQ ID NO: 64189 - DNA, 24 bp, Artificial Sequence
  Synthetic oligonucleotide; GGAAGATT chr11 5164390 5164413 5164410 +
gacgtcagatgggtctgtagaaaa

SEQ ID NO: 64190 - DNA, 24 bp, Artificial Sequence
  Synthetic oligonucleotide; GGAAGATT chr11 5164455 5164478 5164475 +
aggggacaggcgggagggaaagaa

SEQ ID NO: 64191 - DNA, 24 bp, Artificial Sequence
  Synthetic oligonucleotide; AAGGGATT chr11 5165045 5165068 5165065 +
gataagaggtcggggtgcagaaat

SEQ ID NO: 64192 - DNA, 24 bp, Artificial Sequence
  Synthetic oligonucleotide; AAGGGATT chr11 5165128 5165151 5165148 +
gataagaggttggggcacagaaat

SEQ ID NO: 64193 - DNA, 24 bp, Artificial Sequence
  Synthetic oligonucleotide; GTGGGATT chr11 5165217 5165240 5165237 +
gggtacttacccccctccagaaaa

SEQ ID NO: 64194 - DNA, 24 bp, Artificial Sequence
  Synthetic oligonucleotide; CAATGATT chr11 5165313 5165336 5165333 +
ttaataatcagagaggtgtccctg

SEQ ID NO: 64195 - DNA, 24 bp, Artificial Sequence
  Synthetic oligonucleotide; CCAAGATT chr11 5165460 5165483 5165480 +
gaagggagaaattgaagtgtggtg

SEQ ID NO: 64196 - DNA, 24 bp, Artificial Sequence
  Synthetic oligonucleotide; ACCGGATT chr11 5165532 5165555 5165552 +
gaagacagtaaaaagaggccactt

SEQ ID NO: 64197 - DNA, 24 bp, Artificial Sequence
  Synthetic oligonucleotide; AGGGGATT chr11 5165629 5165652 5165649 +
tcacggagcaaagagcaggaggac

SEQ ID NO: 64198 - DNA, 24 bp, Artificial Sequence
  Synthetic oligonucleotide; ATAAGATT chr11 5165814 5165837 5165834 +
gggagataggagtggggctgtttt

SEQ ID NO: 64199 - DNA, 24 bp, Artificial Sequence
  Synthetic oligonucleotide; GTTTGATT chr11 5166108 5166131 5166128 +
aggcctgacattcaggagcatact

SEQ ID NO: 64200 - DNA, 24 bp, Artificial Sequence
  Synthetic oligonucleotide; TGTTGATT chr11 5166383 5166406 5166403 +
ggtacattaactgtgttgttcatt

SEQ ID NO: 64201 - DNA, 24 bp, Artificial Sequence
  Synthetic oligonucleotide; ATCTGATT chr11 5166629 5166652 5166649 +
gtttttaaatttgtagtctatttt

SEQ ID NO: 64202 - DNA, 24 bp, Artificial Sequence
  Synthetic oligonucleotide; TAAGGATT chr11 5166840 5166863 5166860 +
tttacactcagtgtagttactaag

SEQ ID NO: 64203 - DNA, 24 bp, Artificial Sequence
  Synthetic oligonucleotide; ATGTGATT chr11 5166930 5166953 5166950 +
cttccttttttttccttcatggtt

SEQ ID NO: 64204 - DNA, 24 bp, Artificial Sequence
  Synthetic oligonucleotide; TATAGATT chr11 5166989 5167012 5167009 +
actttttatttttagtaaatctat

SEQ ID NO: 64205 - DNA, 24 bp, Artificial Sequence
  Synthetic oligonucleotide; GAAAGATT chr11 5167232 5167255 5167252 +
gttgctatagctattactgttttt

SEQ ID NO: 64206 - DNA, 24 bp, Artificial Sequence
  Synthetic oligonucleotide; TGTGGATT chr11 5167269 5167292 5167289 +
tttgggtttcatactggagttctg

SEQ ID NO: 64207 - DNA, 24 bp, Artificial Sequence
  Synthetic oligonucleotide; TTCAGATT chr11 5167389 5167412 5167409 +
tttgcatgttaatgtcttttttct

SEQ ID NO: 64208 - DNA, 24 bp, Artificial Sequence
  Synthetic oligonucleotide; GTGTGATT chr11 5167589 5167612 5167609 +
tttcattcgactctctcttggact

SEQ ID NO: 64209 - DNA, 24 bp, Artificial Sequence
  Synthetic oligonucleotide; ACAGGATT chr11 5167618 5167641 5167638 +
atttctattgagatgtttgttgtc

SEQ ID NO: 64210 - DNA, 24 bp, Artificial Sequence
  Synthetic oligonucleotide; TTCAGATT chr11 5168056 5168079 5168076 +
ggtttacagaattgcttggtgttc

SEQ ID NO: 64211 - DNA, 24 bp, Artificial Sequence
  Synthetic oligonucleotide; GTTGGATT chr11 5168140 5168163 5168160 +
gtgggctaaagaatcaggttttta

SEQ ID NO: 64212 - DNA, 24 bp, Artificial Sequence
  Synthetic oligonucleotide; TTGTGATT chr11 5168161 5168184 5168181 +
ttagttggattgtctggttttgag

SEQ ID NO: 64213 - DNA, 24 bp, Artificial Sequence
  Synthetic oligonucleotide; CGTGGATT chr11 5168280 5168303 5168300 +
gataatttcttcatatatttgttc

SEQ ID NO: 64214 - DNA, 24 bp, Artificial Sequence
  Synthetic oligonucleotide; GTCAGATT chr11 5168442 5168465 5168462 +
ttgactgtgtattcacgtattgta

SEQ ID NO: 64215 - DNA, 24 bp, Artificial Sequence
  Synthetic oligonucleotide; GCTGGATT chr11 5168563 5168586 5168583 +
catttaatcttcaagatcataaaa

SEQ ID NO: 64216 - DNA, 24 bp, Artificial Sequence
  Synthetic oligonucleotide; CTAAGATT chr11 5168660 5168683 5168680 +
ccacaattactaatagcaagatag

SEQ ID NO: 64217 - DNA, 24 bp, Artificial Sequence
  Synthetic oligonucleotide; GAGGGATT chr11 5169181 5169204 5169201 +
agttgggctctgcaatccctgtct

SEQ ID NO: 64218 - DNA, 24 bp, Artificial Sequence
  Synthetic oligonucleotide; GAGTGATT chr11 5169247 5169270 5169267 +
tttgtcagaagcttgtctactacc

SEQ ID NO: 64219 - DNA, 24 bp, Artificial Sequence
  Synthetic oligonucleotide; TTAAGATT chr11 5169455 5169478 5169475 +
ctctgcttcatggtgcatattcaa

SEQ ID NO: 64220 - DNA, 24 bp, Artificial Sequence
  Synthetic oligonucleotide; TTCTGATT chr11 5169870 5169893 5169890 +
tatatccatcagaggtaagcaggg

SEQ ID NO: 64221 - DNA, 24 bp, Artificial Sequence
  Synthetic oligonucleotide; TCCTGATT chr11 5169950 5169973 5169970 +
taatacaatatgtactcttttgtg

SEQ ID NO: 64222 - DNA, 24 bp, Artificial Sequence
  Synthetic oligonucleotide; CAAGGATT chr11 5170067 5170090 5170087 +
ccaaatgtcactgaattgagtatt

SEQ ID NO: 64223 - DNA, 24 bp, Artificial Sequence
  Synthetic oligonucleotide; CTTTGATT chr11 5170380 5170403 5170400 +
taagaacaacgctgttgcgaattt

SEQ ID NO: 64224 - DNA, 24 bp, Artificial Sequence
  Synthetic oligonucleotide; GACAGATT chr11 5171583 5171606 5171603 +
aacagttaaaataagcatagagat

SEQ ID NO: 64225 - DNA, 24 bp, Artificial Sequence
  Synthetic oligonucleotide; TTGGGATT chr11 5171718 5171741 5171738 +
ctaacatttaattgacgtgtaatc

SEQ ID NO: 64226 - DNA, 24 bp, Artificial Sequence
  Synthetic oligonucleotide; AGTTGATT chr11 5171733 5171756 5171753 +
cgtgtaatcttgggattatattaa

SEQ ID NO: 64227 - DNA, 24 bp, Artificial Sequence
  Synthetic oligonucleotide; CATAGATT chr11 5171971 5171994 5171991 +
ttcactctttctccacctgctatc

SEQ ID NO: 64228 - DNA, 24 bp, Artificial Sequence
  Synthetic oligonucleotide; CCCTGATT chr11 5172316 5172339 5172336 +
aataaatatttccaaataaaaatg

SEQ ID NO: 64229 - DNA, 24 bp, Artificial Sequence
  Synthetic oligonucleotide; TACCGATT chr11 5172333 5172356 5172353 +
aaaaatgccctgatttttaccagt

SEQ ID NO: 64230 - DNA, 24 bp, Artificial Sequence
  Synthetic oligonucleotide; GAATGATT chr11 5172634 5172657 5172654 +
agttgactggaggacatagagaca

SEQ ID NO: 64231 - DNA, 24 bp, Artificial Sequence
  Synthetic oligonucleotide; TAGAGATT chr11 5173118 5173141 5173138 +
gataaagacaggtaataatagtgt

SEQ ID NO: 64232 - DNA, 24 bp, Artificial Sequence
  Synthetic oligonucleotide; TCTTGATT chr11 5173125 5173148 5173145 +
acaggtaataatagtgttagagat

SEQ ID NO: 64233 - DNA, 24 bp, Artificial Sequence
  Synthetic oligonucleotide; GAGGGATT chr11 5173251 5173274 5173271 +
caagggttggtctccaagcatgat

SEQ ID NO: 64234 - DNA, 24 bp, Artificial Sequence
  Synthetic oligonucleotide; TAAGGATT chr11 5173445 5173468 5173465 +
atgctaactttgtattctttcaaa

SEQ ID NO: 64235 - DNA, 24 bp, Artificial Sequence
  Synthetic oligonucleotide; CTTTGATT chr11 5173544 5173567 5173564 +
gaagcatgggtaaatcttcatgaa

SEQ ID NO: 64236 - DNA, 24 bp, Artificial Sequence
  Synthetic oligonucleotide; AATAGATT chr11 5173556 5173579 5173576 +
aatcttcatgaactttgattttac

SEQ ID NO: 64237 - DNA, 24 bp, Artificial Sequence
  Synthetic oligonucleotide; ATTGGATT chr11 5173611 5173634 5173631 +
gagtaacaaaaaataaatacataa

SEQ ID NO: 64238 - DNA, 24 bp, Artificial Sequence
  Synthetic oligonucleotide; TAAAGATT chr11 5174102 5174125 5174122 +
ctaggtatatattaaaaatatata

SEQ ID NO: 64239 - DNA, 24 bp, Artificial Sequence
  Synthetic oligonucleotide; GACTGATT chr11 5174584 5174607 5174604 +
tatttatatgaattatctaaaata

SEQ ID NO: 64240 - DNA, 24 bp, Artificial Sequence
  Synthetic oligonucleotide; AGTAGATT chr11 5174605 5174628 5174625 +
atagactgatttagagaaacatat

SEQ ID NO: 64241 - DNA, 24 bp, Artificial Sequence
  Synthetic oligonucleotide; TTTTGATT chr11 5174867 5174890 5174887 +
aatttaaaacaagacaaattttta

SEQ ID NO: 64242 - DNA, 24 bp, Artificial Sequence
  Synthetic oligonucleotide; CTGGGATT chr11 5175159 5175182 5175179 +
ctcctgcctcagcctcccatgtag

SEQ ID NO: 64243 - DNA, 24 bp, Artificial Sequence
  Synthetic oligonucleotide; TATTGATT chr11 5175265 5175288 5175285 +
ggttcttgcagttgcataaaacat

SEQ ID NO: 64244 - DNA, 24 bp, Artificial Sequence
  Synthetic oligonucleotide; CCCAGATT chr11 5175389 5175412 5175409 +
aaagatgtaaataaagaaatacac

SEQ ID NO: 64245 - DNA, 24 bp, Artificial Sequence
  Synthetic oligonucleotide; GCTTGATT chr11 5175436 5175459 5175456 +
ttctccccccgaaatcaaaatttt

SEQ ID NO: 64246 - DNA, 24 bp, Artificial Sequence
  Synthetic oligonucleotide; GAAGGATT chr11 5175799 5175822 5175819 +
tccctttccctttcccttcctgct

SEQ ID NO: 64247 - DNA, 24 bp, Artificial Sequence
  Synthetic oligonucleotide; TAGAGATT chr11 5175948 5175971 5175968 +
tgagtgctcaactgaaagtttatt

SEQ ID NO: 64248 - DNA, 24 bp, Artificial Sequence
  Synthetic oligonucleotide; ATATGATT chr11 5176035 5176058 5176055 +
gttactgtgtagctatatatgtat

SEQ ID NO: 64249 - DNA, 24 bp, Artificial Sequence
  Synthetic oligonucleotide; ATTAGATT chr11 5176398 5176421 5176418 +
tgtagtactagcagaaacaaatta

SEQ ID NO: 64250 - DNA, 24 bp, Artificial Sequence
  Synthetic oligonucleotide; AGTAGATT chr11 5176680 5176703 5176700 +
aaagctaagcataagccaagcatg

SEQ ID NO: 64251 - DNA, 24 bp, Artificial Sequence
  Synthetic oligonucleotide; CTCAGATT chr11 5176708 5176731 5176728 +
gatttcaagtgtttaagatagtac

SEQ ID NO: 64252 - DNA, 24 bp, Artificial Sequence
  Synthetic oligonucleotide; GAGAGATT chr11 5176804 5176827 5176824 +
gcattgttctaggcttttaagaag

SEQ ID NO: 64253 - DNA, 24 bp, Artificial Sequence
  Synthetic oligonucleotide; AAGGGATT chr11 5176833 5176856 5176853 +
attgtaaaaatttgtattgatgtg

SEQ ID NO: 64254 - DNA, 24 bp, Artificial Sequence
  Synthetic oligonucleotide; CTGGGATT chr11 5176882 5176905 5176902 +
taatatcatagataattacttttg

SEQ ID NO: 64255 - DNA, 24 bp, Artificial Sequence
  Synthetic oligonucleotide; ATCAGATT chr11 5177093 5177116 5177113 +
tctccactatagggggaaatgtgt

SEQ ID NO: 64256 - DNA, 24 bp, Artificial Sequence
  Synthetic oligonucleotide; TCTGGATT chr11 5177439 5177462 5177459 +
ctagctctacgtaggaaaagtcaa

SEQ ID NO: 64257 - DNA, 24 bp, Artificial Sequence
  Synthetic oligonucleotide; TCTCGATT chr11 5177471 5177494 5177491 +
aaaccctaaaatatatttctcttt

SEQ ID NO: 64258 - DNA, 24 bp, Artificial Sequence
  Synthetic oligonucleotide; TGAGGATT chr11 5177636 5177659 5177656 +
agacaccatcattttaagtgtgtt

SEQ ID NO: 64259 - DNA, 24 bp, Artificial Sequence
  Synthetic oligonucleotide; TATGGATT chr11 5177646 5177669 5177666 +
attttaagtgtgtttgaggatttc

SEQ ID NO: 64260 - DNA, 24 bp, Artificial Sequence
  Synthetic oligonucleotide; AGCAGATT chr11 5178290 5178313 5178310 +
gtcaaatgccattgccaggagaat

SEQ ID NO: 64261 - DNA, 24 bp, Artificial Sequence
  Synthetic oligonucleotide; CTGGGATT chr11 5178574 5178597 5178594 +
tccaggtatgcaagccttccagcc

SEQ ID NO: 64262 - DNA, 24 bp, Artificial Sequence
  Synthetic oligonucleotide; GTGTGATT chr11 5178615 5178638 5178635 +
acataccacacatcctgggaatta

SEQ ID NO: 64263 - DNA, 24 bp, Artificial Sequence
  Synthetic oligonucleotide; TGAGGATT chr11 5178690 5178713 5178710 +
gccattagtgaaagactacaaagt

SEQ ID NO: 64264 - DNA, 24 bp, Artificial Sequence
  Synthetic oligonucleotide; ATCAGATT chr11 5178730 5178753 5178750 +
ctaccttaggctgaatgaggtctc

SEQ ID NO: 64265 - DNA, 24 bp, Artificial Sequence
  Synthetic oligonucleotide; ACTGGATT chr11 5179020 5179043 5179040 +
tttcagcctcttaccctaggccct

SEQ ID NO: 64266 - DNA, 24 bp, Artificial Sequence
  Synthetic oligonucleotide; AATAGATT chr11 5179212 5179235 5179232 +
atgggagggaattaagtctgacaa

SEQ ID NO: 64267 - DNA, 24 bp, Artificial Sequence
  Synthetic oligonucleotide; CATTGATT chr11 5179251 5179274 5179271 +
atatagcatgtatgccttcttcca

SEQ ID NO: 64268 - DNA, 24 bp, Artificial Sequence
  Synthetic oligonucleotide; CACTGATT chr11 5179764 5179787 5179784 +
tattttgtttctttccacttcagt

SEQ ID NO: 64269 - DNA, 24 bp, Artificial Sequence
  Synthetic oligonucleotide; GCATGATT chr11 5180284 5180307 5180304 +
acgtgtgcatgtgtctttatagca

SEQ ID NO: 64270 - DNA, 24 bp, Artificial Sequence
  Synthetic oligonucleotide; TTTTGATT chr11 5180523 5180546 5180543 +
gtgtgagatgatatctcattgtgg

SEQ ID NO: 64271 - DNA, 24 bp, Artificial Sequence
  Synthetic oligonucleotide; TGTAGATT chr11 5180682 5180705 5180702 +
tcttgtaaatttgtttgagttcat

SEQ ID NO: 64272 - DNA, 24 bp, Artificial Sequence
  Synthetic oligonucleotide; AGTAGATT chr11 5180715 5180738 5180735 +
tggatattagccctttgtcagatg

SEQ ID NO: 64273 - DNA, 24 bp, Artificial Sequence
  Synthetic oligonucleotide; TTAGGATT chr11 5181260 5181283 5181280 +
tgcctctagctttgttcttttggc

SEQ ID NO: 64274 - DNA, 24 bp, Artificial Sequence
  Synthetic oligonucleotide; TATTGATT chr11 5181410 5181433 5181430 +
tgggcagtaaggccattttcacga

SEQ ID NO: 64275 - DNA, 24 bp, Artificial Sequence
  Synthetic oligonucleotide; GTTGGATT chr11 5181527 5181550 5181547 +
agaggtccttcacatcccttgtaa

SEQ ID NO: 64276 - DNA, 24 bp, Artificial Sequence
  Synthetic oligonucleotide; TCATGATT chr11 5181581 5181604 5181601 +
aggcaattgtgaatgggagttcac

SEQ ID NO: 64277 - DNA, 24 bp, Artificial Sequence
  Synthetic oligonucleotide; TTGTGATT chr11 5181627 5181650 5181647 +
tctgttattggtgtataggaatgc

SEQ ID NO: 64278 - DNA, 24 bp, Artificial Sequence
  Synthetic oligonucleotide; CATTGATT chr11 5181641 5181664 5181661 +
ataggaatgcttgtgatttttgca

SEQ ID NO: 64279 - DNA, 24 bp, Artificial Sequence
  Synthetic oligonucleotide; AGGAGATT chr11 5181688 5181711 5181708 +
tttctgaagttgcttatcagctta

SEQ ID NO: 64280 - DNA, 24 bp, Artificial Sequence
  Synthetic oligonucleotide; GCCTGATT chr11 5181803 5181826 5181823 +
gaatgccctttatttctttctctt

SEQ ID NO: 64281 - DNA, 24 bp, Artificial Sequence
  Synthetic oligonucleotide; GCTGGATT chr11 5182091 5182114 5182111 +
ttgtgtctttggttctgtttatat

SEQ ID NO: 64282 - DNA, 24 bp, Artificial Sequence
  Synthetic oligonucleotide; TATTGATT chr11 5182104 5182127 5182124 +
tctgtttatatgctggattatgtt

SEQ ID NO: 64283 - DNA, 24 bp, Artificial Sequence
  Synthetic oligonucleotide; CCTGGATT chr11 5182187 5182210 5182207 +
ggtggataagctttttgatgtgct

SEQ ID NO: 64284 - DNA, 24 bp, Artificial Sequence
  Synthetic oligonucleotide; TGAGGATT chr11 5182214 5182237 5182234 +
ggatttggtttgccagtattttac

SEQ ID NO: 64285 - DNA, 24 bp, Artificial Sequence
  Synthetic oligonucleotide; GGAGGATT chr11 5182328 5182351 5182348 +
tgctggcctcataaaatgagttag

SEQ ID NO: 64286 - DNA, 24 bp, Artificial Sequence
  Synthetic oligonucleotide; TATTGATT chr11 5182347 5182370 5182367 +
gttagggaggattccctctttttc

SEQ ID NO: 64287 - DNA, 24 bp, Artificial Sequence
  Synthetic oligonucleotide; TGCTGATT chr11 5182497 5182520 5182517 +
taaaatactttacagacaagcaat

SEQ ID NO: 64288 - DNA, 24 bp, Artificial Sequence
  Synthetic oligonucleotide; CCCAGATT chr11 5183033 5183056 5183053 +
atatatgcacccaatacagcagca

SEQ ID NO: 64289 - DNA, 24 bp, Artificial Sequence
  Synthetic oligonucleotide; TCAGGATT chr11 5183377 5183400 5183397 +
accacagtgcaatcaaactagaac

SEQ ID NO: 64290 - DNA, 24 bp, Artificial Sequence
  Synthetic oligonucleotide; AGGAGATT chr11 5183710 5183733 5183730 +
taagtaagatcagagcagaagtga

SEQ ID NO: 64291 - DNA, 24 bp, Artificial Sequence
  Synthetic oligonucleotide; ATAAGATT chr11 5184217 5184240 5184237 +
agcaagtttaatattgagtggaaa

SEQ ID NO: 64292 - DNA, 24 bp, Artificial Sequence
  Synthetic oligonucleotide; GATAGATT chr11 5184261 5184284 5184281 +
accagggtaggtgacatatacaga

SEQ ID NO: 64293 - DNA, 24 bp, Artificial Sequence
  Synthetic oligonucleotide; TCTTGATT chr11 5184507 5184530 5184527 +
ttaagaaatgactgctcccccatc

SEQ ID NO: 64294 - DNA, 24 bp, Artificial Sequence
  Synthetic oligonucleotide; AACAGATT chr11 5185029 5185052 5185049 +
ggaatgaagataagggggaaagaa

SEQ ID NO: 64295 - DNA, 24 bp, Artificial Sequence
  Synthetic oligonucleotide; CTGAGATT chr11 5185570 5185593 5185590 +
acttcaggcttattatccatcaaa

SEQ ID NO: 64296 - DNA, 24 bp, Artificial Sequence
  Synthetic oligonucleotide; AATTGATT chr11 5185579 5185602 5185599 +
ttattatccatcaaactgagattg

SEQ ID NO: 64297 - DNA, 24 bp, Artificial Sequence
  Synthetic oligonucleotide; AGATGATT chr11 5186154 5186177 5186174 +
gggtcaaaaatcaaggaaaatgtt

SEQ ID NO: 64298 - DNA, 24 bp, Artificial Sequence
  Synthetic oligonucleotide; AAGAGATT chr11 5186321 5186344 5186341 +
ttgagaggagacaaaataaatgca

SEQ ID NO: 64299 - DNA, 24 bp, Artificial Sequence
  Synthetic oligonucleotide; GCCAGATT chr11 5186901 5186924 5186921 +
taaaaactggcttcacactgataa

SEQ ID NO: 64300 - DNA, 24 bp, Artificial Sequence
  Synthetic oligonucleotide; CTGTGATT chr11 5186958 5186981 5186978 +
tctcaagtggagccttccatatat

SEQ ID NO: 64301 - DNA, 24 bp, Artificial Sequence
  Synthetic oligonucleotide; TCTTGATT chr11 5187091 5187114 5187111 +
catcagctgaccctgactggatga

SEQ ID NO: 64302 - DNA, 24 bp, Artificial Sequence
  Synthetic oligonucleotide; TAATGATT chr11 5187581 5187604 5187601 +
ttttgagcaaatgttttcagtaaa

SEQ ID NO: 64303 - DNA, 24 bp, Artificial Sequence
  Synthetic oligonucleotide; ATATGATT chr11 5187878 5187901 5187898 +
tatgcccttaataatcatatatct

SEQ ID NO: 64304 - DNA, 24 bp, Artificial Sequence
  Synthetic oligonucleotide; TAAAGATT chr11 5187941 5187964 5187961 +
catgtaagtattatgtagaataaa

SEQ ID NO: 64305 - DNA, 24 bp, Artificial Sequence
  Synthetic oligonucleotide; AGCAGATT chr11 5187996 5188019 5188016 +
tgtcagaaattgccatcactttag

SEQ ID NO: 64306 - DNA, 24 bp, Artificial Sequence
  Synthetic oligonucleotide; TATGGATT chr11 5188035 5188058 5188055 +
taaaagactcagtttttaaatttc

SEQ ID NO: 64307 - DNA, 24 bp, Artificial Sequence
  Synthetic oligonucleotide; AAATGATT chr11 5188057 5188080 5188077 +
tctatggatttcaaggaaatggat

SEQ ID NO: 64308 - DNA, 24 bp, Artificial Sequence
  Synthetic oligonucleotide; TACTGATT chr11 5188106 5188129 5188126 +
aatagcagtaaaaatggctttggc

SEQ ID NO: 64309 - DNA, 24 bp, Artificial Sequence
  Synthetic oligonucleotide; GTTGGATT chr11 5188135 5188158 5188155 +
atttagtatctgtaaattaaggat

SEQ ID NO: 64310 - DNA, 24 bp, Artificial Sequence
  Synthetic oligonucleotide; TTGAGATT chr11 5188145 5188168 5188165 +
tgtaaattaaggatgttggattgc

SEQ ID NO: 64311 - DNA, 24 bp, Artificial Sequence
  Synthetic oligonucleotide; ATGAGATT chr11 5188584 5188607 5188604 +
ccaacacaactttcttaaaacatt

SEQ ID NO: 64312 - DNA, 24 bp, Artificial Sequence
  Synthetic oligonucleotide; TTGTGATT chr11 5188604 5188627 5188624 +
cattatgagattttatgggacatt

SEQ ID NO: 64313 - DNA, 24 bp, Artificial Sequence
  Synthetic oligonucleotide; AAAAGATT chr11 5188679 5188702 5188699 +
ttttatgtgtggcccagggaagcc

SEQ ID NO: 64314 - DNA, 24 bp, Artificial Sequence
  Synthetic oligonucleotide; CAAAGATT chr11 5188752 5188775 5188772 +
atttgcagagtcttgtagcttttt

SEQ ID NO: 64315 - DNA, 24 bp, Artificial Sequence
  Synthetic oligonucleotide; AAGTGATT chr11 5189218 5189241 5189238 +
gtgttgaagatggggcctggtggg

SEQ ID NO: 64316 - DNA, 24 bp, Artificial Sequence
  Synthetic oligonucleotide; CCATGATT chr11 5189382 5189405 5189402 +
cacatgctcctgtttttctctctg

SEQ ID NO: 64317 - DNA, 24 bp, Artificial Sequence
  Synthetic oligonucleotide; GAATGATT chr11 5190229 5190252 5190249 +
caggcctggtggcctaggagtact

SEQ ID NO: 64318 - DNA, 24 bp, Artificial Sequence
  Synthetic oligonucleotide; GTGAGATT chr11 5190243 5190266 5190263 +
taggagtactgaatgattttgtgg

SEQ ID NO: 64319 - DNA, 24 bp, Artificial Sequence
  Synthetic oligonucleotide; CCTAGATT chr11 5190452 5190475 5190472 +
aaagttgaggcttgtaagcctcca

SEQ ID NO: 64320 - DNA, 24 bp, Artificial Sequence
  Synthetic oligonucleotide; AGGAGATT chr11 5190826 5190849 5190846 +
ccctgatatgagacatggggtcaa

SEQ ID NO: 64321 - DNA, 24 bp, Artificial Sequence
  Synthetic oligonucleotide; AAGAGATT chr11 5190915 5190938 5190935 +
gagactgggtaatttataaagaaa

SEQ ID NO: 64322 - DNA, 24 bp, Artificial Sequence
  Synthetic oligonucleotide; CCATGATT chr11 5191111 5191134 5191131 +
gaacagcatgtgaaaaacctaccc

SEQ ID NO: 64323 - DNA, 24 bp, Artificial Sequence
  Synthetic oligonucleotide; CAGGGATT chr11 5191153 5191176 5191173 +
ccagtgtgttccttccatgacagg

SEQ ID NO: 64324 - DNA, 24 bp, Artificial Sequence
  Synthetic oligonucleotide; TTTTGATT chr11 5191356 5191379 5191376 +
atgtcttggaagtaactaacttgt

SEQ ID NO: 64325 - DNA, 24 bp, Artificial Sequence
  Synthetic oligonucleotide; TAATGATT chr11 5191474 5191497 5191494 +
agactttgtaggactgttgggaag

SEQ ID NO: 64326 - DNA, 24 bp, Artificial Sequence
  Synthetic oligonucleotide; ATGAGATT chr11 5191505 5191528 5191525 +
tgtattttgtgatgtgagaagaac

SEQ ID NO: 64327 - DNA, 24 bp, Artificial Sequence
  Synthetic oligonucleotide; CAGCGATT chr11 5191646 5191669 5191666 +
caatcatggtggcagagttctcat

SEQ ID NO: 64328 - DNA, 24 bp, Artificial Sequence
  Synthetic oligonucleotide; CCATGATT chr11 5191784 5191807 5191804 +
tacttgctcctgctttgtcttctg

SEQ ID NO: 64329 - DNA, 24 bp, Artificial Sequence
  Synthetic oligonucleotide; TCAAGATT chr11 5192029 5192052 5192049 +
tccttcctttgatactcaatgtga

SEQ ID NO: 64330 - DNA, 24 bp, Artificial Sequence
  Synthetic oligonucleotide; GTGTGATT chr11 5192631 5192654 5192651 +
actcatttgggtaaatacatagga

SEQ ID NO: 64331 - DNA, 24 bp, Artificial Sequence
  Synthetic oligonucleotide; ATTGGATT chr11 5192944 5192967 5192964 +
ttcagatcttttgcccactttgca

SEQ ID NO: 64332 - DNA, 24 bp, Artificial Sequence
  Synthetic oligonucleotide; TTAAGATT chr11 5193226 5193249 5193246 +
ttttcactctctcctgaactccag

SEQ ID NO: 64333 - DNA, 24 bp, Artificial Sequence
  Synthetic oligonucleotide; AATTGATT chr11 5193538 5193561 5193558 +
ctccaaataagttttctttattaa

SEQ ID NO: 64334 - DNA, 24 bp, Artificial Sequence
  Synthetic oligonucleotide; GTAAGATT chr11 5193991 5194014 5194011 +
cgcggatccaaagagtgagcagca

SEQ ID NO: 64335 - DNA, 24 bp, Artificial Sequence
  Synthetic oligonucleotide; TGCTGATT chr11 5194114 5194137 5194134 +
ccttatctgaccccacccacatcc

SEQ ID NO: 64336 - DNA, 24 bp, Artificial Sequence
  Synthetic oligonucleotide; AGCTGATT chr11 5194138 5194161 5194158 +
tgctgattggtccattttacagag

SEQ ID NO: 64337 - DNA, 24 bp, Artificial Sequence
  Synthetic oligonucleotide; TGCTGATT chr11 5194187 5194210 5194207 +
gctggttggtccgttttggcagag

SEQ ID NO: 64338 - DNA, 24 bp, Artificial Sequence
  Synthetic oligonucleotide; TGCTGATT chr11 5194228 5194251 5194248 +
acaaaccttgagctagacacagag

SEQ ID NO: 64339 - DNA, 24 bp, Artificial Sequence
  Synthetic oligonucleotide; ACTAGATT chr11 5194284 5194307 5194304 +
gacacaaaagttctccaagtcccc

SEQ ID NO: 64340 - DNA, 24 bp, Artificial Sequence
  Synthetic oligonucleotide; CACTGATT chr11 5194306 5194329 5194326 +
ccactagattagctagacacagag

SEQ ID NO: 64341 - DNA, 24 bp, Artificial Sequence
  Synthetic oligonucleotide; CACAGATT chr11 5194340 5194363 5194360 +
tgcatttacaaaccttgagttaga

SEQ ID NO: 64342 - DNA, 24 bp, Artificial Sequence
  Synthetic oligonucleotide; TGCTGATT chr11 5194347 5194370 5194367 +
acaaaccttgagttagacacagat

SEQ ID NO: 64343 - DNA, 24 bp, Artificial Sequence
  Synthetic oligonucleotide; ACTGGATT chr11 5194582 5194605 5194602 +
aacccaaatgtccaacaatgatag

SEQ ID NO: 64344 - DNA, 24 bp, Artificial Sequence
  Synthetic oligonucleotide; TGGGGATT chr11 5194998 5195021 5195018 +
aaaataattttaaaaagagtatag

SEQ ID NO: 64345 - DNA, 24 bp, Artificial Sequence
  Synthetic oligonucleotide; CATTGATT chr11 5195235 5195258 5195255 +
tgaatttcccagtgtctggatcat

SEQ ID NO: 64346 - DNA, 24 bp, Artificial Sequence
  Synthetic oligonucleotide; TATAGATT chr11 5195450 5195473 5195470 +
cattggtatccttttctgtagaca

SEQ ID NO: 64347 - DNA, 24 bp, Artificial Sequence
  Synthetic oligonucleotide; TTCAGATT chr11 5195457 5195480 5195477 +
atccttttctgtagacatatagat

SEQ ID NO: 64348 - DNA, 24 bp, Artificial Sequence
  Synthetic oligonucleotide; AGTGGATT chr11 5195574 5195597 5195594 +
gtctctgtgtacatctatagcttt

SEQ ID NO: 64349 - DNA, 24 bp, Artificial Sequence
  Synthetic oligonucleotide; CACCGATT chr11 5195797 5195820 5195817 +
attaccagcatctcaaaagctaaa

SEQ ID NO: 64350 - DNA, 24 bp, Artificial Sequence
  Synthetic oligonucleotide; GATTGATT chr11 5195801 5195824 5195821 +
ccagcatctcaaaagctaaacacc

SEQ ID NO: 64351 - DNA, 24 bp, Artificial Sequence
  Synthetic oligonucleotide; ATACGATT chr11 5196128 5196151 5196148 +
aacatctcttaagtctgtttaaca

SEQ ID NO: 64352 - DNA, 24 bp, Artificial Sequence
  Synthetic oligonucleotide; ATTAGATT chr11 5196292 5196315 5196312 +
tcctgtcacatcggcagtggcggc

SEQ ID NO: 64353 - DNA, 24 bp, Artificial Sequence
  Synthetic oligonucleotide; TGTGGATT chr11 5196476 5196499 5196496 +
gctggtgtacagtgaacatctgcc

SEQ ID NO: 64354 - DNA, 24 bp, Artificial Sequence
  Synthetic oligonucleotide; CACTGATT chr11 5196555 5196578 5196575 +
tcatgtcctctcacttctaagaat

SEQ ID NO: 64355 - DNA, 24 bp, Artificial Sequence
  Synthetic oligonucleotide; TTCTGATT chr11 5196628 5196651 5196648 +
aatagcaattgaatggactagact

SEQ ID NO: 64356 - DNA, 24 bp, Artificial Sequence
  Synthetic oligonucleotide; TACTGATT chr11 5197260 5197283 5197280 +
tcattggctttttttttttttttt

SEQ ID NO: 64357 - DNA, 24 bp, Artificial Sequence
  Synthetic oligonucleotide; TAAAGATT chr11 5197289 5197312 5197309 +
attttcctccctttggctgaattg

SEQ ID NO: 64358 - DNA, 24 bp, Artificial Sequence
  Synthetic oligonucleotide; CAATGATT chr11 5197353 5197376 5197373 +
acaattatatagctctaaaataag

SEQ ID NO: 64359 - DNA, 24 bp, Artificial Sequence
  Synthetic oligonucleotide; TACAGATT chr11 5197767 5197790 5197787 +
tctatgagacattcacatgacctc

SEQ ID NO: 64360 - DNA, 24 bp, Artificial Sequence
  Synthetic oligonucleotide; GTCAGATT chr11 5197823 5197846 5197843 +
ataaaactggggcataggaatctt

SEQ ID NO: 64361 - DNA, 24 bp, Artificial Sequence
  Synthetic oligonucleotide; CTATGATT chr11 5198201 5198224 5198221 +
atgatccgcccgcctcggcagcta

SEQ ID NO: 64362 - DNA, 24 bp, Artificial Sequence
  Synthetic oligonucleotide; GGAAGATT chr11 5198705 5198728 5198725 +
ttcttagatacctaatagaatata

SEQ ID NO: 64363 - DNA, 24 bp, Artificial Sequence
  Synthetic oligonucleotide; ACCTGATT chr11 5198751 5198774 5198771 +
cttgttatccatgcatagttttgt

SEQ ID NO: 64364 - DNA, 24 bp, Artificial Sequence
  Synthetic oligonucleotide; TAAGGATT chr11 5198978 5199001 5198998 +
agtccacatataaaatctaaaaaa

SEQ ID NO: 64365 - DNA, 24 bp, Artificial Sequence
  Synthetic oligonucleotide; TGTTGATT chr11 5199548 5199571 5199568 +
caggctgacacaatggaacttgtt

SEQ ID NO: 64366 - DNA, 24 bp, Artificial Sequence
  Synthetic oligonucleotide; CACTGATT chr11 5199643 5199666 5199663 +
ttaataattttttcttttttatgg

SEQ ID NO: 64367 - DNA, 24 bp, Artificial Sequence
  Synthetic oligonucleotide; ATGGGATT chr11 5199781 5199804 5199801 +
tgttgggtcttgacactgtagatg

SEQ ID NO: 64368 - DNA, 24 bp, Artificial Sequence
  Synthetic oligonucleotide; AGTGGATT chr11 5200261 5200284 5200281 +
ttagtcaggatggaggaataacgt

SEQ ID NO: 64369 - DNA, 24 bp, Artificial Sequence
  Synthetic oligonucleotide; CATAGATT chr11 5200544 5200567 5200564 +
tgcaattgcccaaaagcaccatgg

SEQ ID NO: 64370 - DNA, 24 bp, Artificial Sequence
  Synthetic oligonucleotide; AAGAGATT chr11 5200921 5200944 5200941 +
agccataagcaaaaacaaataagg

SEQ ID NO: 64371 - DNA, 24 bp, Artificial Sequence
  Synthetic oligonucleotide; AAATGATT chr11 5201285 5201308 5201305 +
atatttatgcatgagaccttgggt

SEQ ID NO: 64372 - DNA, 24 bp, Artificial Sequence
  Synthetic oligonucleotide; ATTAGATT chr11 5201354 5201377 5201374 +
atttgtgcctttgtgatgtagaga

SEQ ID NO: 64373 - DNA, 24 bp, Artificial Sequence
  Synthetic oligonucleotide; AGCTGATT chr11 5201424 5201447 5201444 +
attcctttatttattcagttaatg

SEQ ID NO: 64374 - DNA, 24 bp, Artificial Sequence
  Synthetic oligonucleotide; GTTTGATT chr11 5201685 5201708 5201705 +
atgttcaaaagtccatactttcat

SEQ ID NO: 64375 - DNA, 24 bp, Artificial Sequence
  Synthetic oligonucleotide; TTCAGATT chr11 5201719 5201742 5201739 +
gtaacttcgagatgttaaagtaac

SEQ ID NO: 64376 - DNA, 24 bp, Artificial Sequence
  Synthetic oligonucleotide; AGAGGATT chr11 5201949 5201972 5201969 +
gcttgaagtttcttcgtttcttgc

SEQ ID NO: 64377 - DNA, 24 bp, Artificial Sequence
  Synthetic oligonucleotide; CTCTGATT chr11 5202340 5202363 5202360 +
attatttgaaactaacatttgcac

SEQ ID NO: 64378 - DNA, 24 bp, Artificial Sequence
  Synthetic oligonucleotide; ACTTGATT chr11 5202447 5202470 5202467 +
aaataagaatgatgccaataaagt

SEQ ID NO: 64379 - DNA, 24 bp, Artificial Sequence
  Synthetic oligonucleotide; TCATGATT chr11 5202752 5202775 5202772 +
atttaatattattactagctaata

SEQ ID NO: 64380 - DNA, 24 bp, Artificial Sequence
  Synthetic oligonucleotide; AAATGATT chr11 5203131 5203154 5203151 +
ctttcaccattaacttttgagtta

SEQ ID NO: 64381 - DNA, 24 bp, Artificial Sequence
  Synthetic oligonucleotide; GGGGGATT chr11 5203148 5203171 5203168 +
tgagttaaaatgattacttcctca

SEQ ID NO: 64382 - DNA, 24 bp, Artificial Sequence
  Synthetic oligonucleotide; CCTAGATT chr11 5203175 5203198 5203195 +
ggatttttctaatactgctcccca

SEQ ID NO: 64383 - DNA, 24 bp, Artificial Sequence
  Synthetic oligonucleotide; ATTAGATT chr11 5203271 5203294 5203291 +
ccacttattatacactgaatttcc

SEQ ID NO: 64384 - DNA, 24 bp, Artificial Sequence
  Synthetic oligonucleotide; AGAAGATT chr11 5203292 5203315 5203312 +
tccattagattcattagaggctgt

SEQ ID NO: 64385 - DNA, 24 bp, Artificial Sequence
  Synthetic oligonucleotide; ACATGATT chr11 5203601 5203624 5203621 +
ttgaatacaacactccaatttcaa

SEQ ID NO: 64386 - DNA, 24 bp, Artificial Sequence
  Synthetic oligonucleotide; CTGGGATT chr11 5203649 5203672 5203669 +
tgactcagacatatcgtcaaggat

SEQ ID NO: 64387 - DNA, 24 bp, Artificial Sequence
  Synthetic oligonucleotide; AAAAGATT chr11 5203663 5203686 5203683 +
cgtcaaggatctgggattgatcac

SEQ ID NO: 64388 - DNA, 24 bp, Artificial Sequence
  Synthetic oligonucleotide; GGTGGATT chr11 5203769 5203792 5203789 +
ctagcactttgggaggccgaggca

SEQ ID NO: 64389 - DNA, 24 bp, Artificial Sequence
  Synthetic oligonucleotide; TTGGGATT chr11 5204183 5204206 5204203 +
gccaccatagagactatcagcctt

SEQ ID NO: 64390 - DNA, 24 bp, Artificial Sequence
  Synthetic oligonucleotide; GGAGGATT chr11 5204211 5204234 5204231 +
gattaccagagcaaaatacatgtt

SEQ ID NO: 64391 - DNA, 24 bp, Artificial Sequence
  Synthetic oligonucleotide; TGAAGATT chr11 5204278 5204301 5204298 +
catagttttgataaggtaaataaa

SEQ ID NO: 64392 - DNA, 24 bp, Artificial Sequence
  Synthetic oligonucleotide; AAAAGATT chr11 5204347 5204370 5204367 +
tgctccacctgtatttaaaaaaca

SEQ ID NO: 64393 - DNA, 24 bp, Artificial Sequence
  Synthetic oligonucleotide; CTGTGATT chr11 5204558 5204581 5204578 +
ggaatgttgacttggaaagcaaat

SEQ ID NO: 64394 - DNA, 24 bp, Artificial Sequence
  Synthetic oligonucleotide; CTCTGATT chr11 5204607 5204630 5204627 +
ctttcaggagtcttttctgatgcc

SEQ ID NO: 64395 - DNA, 24 bp, Artificial Sequence
  Synthetic oligonucleotide; GTGTGATT chr11 5204684 5204707 5204704 +
tctgtcttttcagaataattccct

SEQ ID NO: 64396 - DNA, 24 bp, Artificial Sequence
  Synthetic oligonucleotide; TAATGATT chr11 5205105 5205128 5205125 +
gacttgtccaaagaactgactgtt

SEQ ID NO: 64397 - DNA, 24 bp, Artificial Sequence
  Synthetic oligonucleotide; AATAGATT chr11 5205298 5205321 5205318 +
atatattatataagcataaaatgt

SEQ ID NO: 64398 - DNA, 24 bp, Artificial Sequence
  Synthetic oligonucleotide; ATAAGATT chr11 5205489 5205512 5205509 +
attacatatttcattatatatttt

SEQ ID NO: 64399 - DNA, 24 bp, Artificial Sequence
  Synthetic oligonucleotide; ATAAGATT chr11 5205627 5205650 5205647 +
catctaaccatttgagaagttttt

SEQ ID NO: 64400 - DNA, 24 bp, Artificial Sequence
  Synthetic oligonucleotide; ATTTGATT chr11 5205641 5205664 5205661 +
agaagtttttataagatttatagc

SEQ ID NO: 64401 - DNA, 24 bp, Artificial Sequence
  Synthetic oligonucleotide; GTCTGATT chr11 5206675 5206698 5206695 +
attcacattaccataattatttat

SEQ ID NO: 64402 - DNA, 24 bp, Artificial Sequence
  Synthetic oligonucleotide; GAAGGATT chr11 5206937 5206960 5206957 +
acagagtccaggatgactagcagt

SEQ ID NO: 64403 - DNA, 24 bp, Artificial Sequence
  Synthetic oligonucleotide; CCTTGATT chr11 5207109 5207132 5207129 +
gccttgtgtgaacagtaatgctag

SEQ ID NO: 64404 - DNA, 24 bp, Artificial Sequence
  Synthetic oligonucleotide; CAGGGATT chr11 5207330 5207353 5207350 +
aatacaaaagagtagacatcccca

SEQ ID NO: 64405 - DNA, 24 bp, Artificial Sequence
  Synthetic oligonucleotide; CCTAGATT chr11 5207441 5207464 5207461 +
gttgcctttgctgtggctttcgac

SEQ ID NO: 64406 - DNA, 24 bp, Artificial Sequence
  Synthetic oligonucleotide; CTTGGATT chr11 5207554 5207577 5207574 +
gtagtagatctaaaattgtaattt

SEQ ID NO: 64407 - DNA, 24 bp, Artificial Sequence
  Synthetic oligonucleotide; TGTGGATT chr11 5207579 5207602 5207599 +
ttggattcctagaatttctaaatc

SEQ ID NO: 64408 - DNA, 24 bp, Artificial Sequence
  Synthetic oligonucleotide; AGTAGATT chr11 5208153 5208176 5208173 +
ttactcactataagaaatttataa

SEQ ID NO: 64409 - DNA, 24 bp, Artificial Sequence
  Synthetic oligonucleotide; AATTGATT chr11 5208659 5208682 5208679 +
atgataataattctagttgtgaga

SEQ ID NO: 64410 - DNA, 24 bp, Artificial Sequence
  Synthetic oligonucleotide; AAATGATT chr11 5208712 5208735 5208732 +
gaagagagtggagagtaaaggcaa

SEQ ID NO: 64411 - DNA, 24 bp, Artificial Sequence
  Synthetic oligonucleotide; CCTAGATT chr11 5209240 5209263 5209260 +
tcttcaggaagttaagacagtcta

SEQ ID NO: 64412 - DNA, 24 bp, Artificial Sequence
  Synthetic oligonucleotide; TCACGATT chr11 5209596 5209619 5209616 +
ttatcctgatataattcattttta

SEQ ID NO: 64413 - DNA, 24 bp, Artificial Sequence
  Synthetic oligonucleotide; AGTTGATT chr11 5209718 5209741 5209738 +
gcattcatactagtgtatgactgt

SEQ ID NO: 64414 - DNA, 24 bp, Artificial Sequence
  Synthetic oligonucleotide; TGAAGATT chr11 5209842 5209865 5209862 +
tggctataatataaattgctgcta

SEQ ID NO: 64415 - DNA, 24 bp, Artificial Sequence
  Synthetic oligonucleotide; CCCAGATT chr11 5210016 5210039 5210036 +
ttctcttatagcagcctgcatgtg

SEQ ID NO: 64416 - DNA, 24 bp, Artificial Sequence
  Synthetic oligonucleotide; GAAGGATT chr11 5210708 5210731 5210728 +
ttcaagataggacttgagttcctc

SEQ ID NO: 64417 - DNA, 24 bp, Artificial Sequence
  Synthetic oligonucleotide; GAACGATT chr11 5210796 5210819 5210816 +
taatcacagccgaggccggaggga

SEQ ID NO: 64418 - DNA, 24 bp, Artificial Sequence
  Synthetic oligonucleotide; GGGAGATT chr11 5210952 5210975 5210972 +
gaaggatatcttgagccaaggagg

SEQ ID NO: 64419 - DNA, 24 bp, Artificial Sequence
  Synthetic oligonucleotide; CAAAGATT chr11 5210968 5210991 5210988 +
caaggagggggagattgcagtgag

SEQ ID NO: 64420 - DNA, 24 bp, Artificial Sequence
  Synthetic oligonucleotide; AGCTGATT chr11 5211311 5211334 5211331 +
aacattttgttagacttaaaaaca

SEQ ID NO: 64421 - DNA, 24 bp, Artificial Sequence
  Synthetic oligonucleotide; TACAGATT chr11 5211446 5211469 5211466 +
taaacacatgtcatgggtttgtcg

SEQ ID NO: 64422 - DNA, 24 bp, Artificial Sequence
  Synthetic oligonucleotide; GGTTGATT chr11 5211765 5211788 5211785 +
cggtataccactaatgggccttca

SEQ ID NO: 64423 - DNA, 24 bp, Artificial Sequence
  Synthetic oligonucleotide; TTGTGATT chr11 5211787 5211810 5211807 +
caggttgattctatgtctttgcta

SEQ ID NO: 64424 - DNA, 24 bp, Artificial Sequence
  Synthetic oligonucleotide; ATAGGATT chr11 5211870 5211893 5211890 +
tttcctttaggtatatactcaata

SEQ ID NO: 64425 - DNA, 24 bp, Artificial Sequence
  Synthetic oligonucleotide; GTTTGATT chr11 5212074 5212097 5212094 +
atgtgagatagtatctcattttgg

SEQ ID NO: 64426 - DNA, 24 bp, Artificial Sequence
  Synthetic oligonucleotide; TGTAGATT chr11 5212210 5212233 5212230 +
ttgtggcattgtttgttttgttct

SEQ ID NO: 64427 - DNA, 24 bp, Artificial Sequence
  Synthetic oligonucleotide; TATAGATT chr11 5212231 5212254 5212251 +
tcttgtagattcatttaagttcct

SEQ ID NO: 64428 - DNA, 24 bp, Artificial Sequence
  Synthetic oligonucleotide; TTAGGATT chr11 5213026 5213049 5213046 +
tttttcaattcccacctgtgagta

SEQ ID NO: 64429 - DNA, 24 bp, Artificial Sequence
  Synthetic oligonucleotide; TATTGATT chr11 5213180 5213203 5213200 +
taggcagtatggacattttaacaa

SEQ ID NO: 64430 - DNA, 24 bp, Artificial Sequence
  Synthetic oligonucleotide; CTCTGATT chr11 5213234 5213257 5213254 +
agtttttccatttgtttctatcag

SEQ ID NO: 64431 - DNA, 24 bp, Artificial Sequence
  Synthetic oligonucleotide; ATGGGATT chr11 5213339 5213362 5213359 +
ttattctttttgtggcaacggtaa

SEQ ID NO: 64432 - DNA, 24 bp, Artificial Sequence
  Synthetic oligonucleotide; TCCTGATT chr11 5213351 5213374 5213371 +
tggcaacggtaaatgggattgact

SEQ ID NO: 64433 - DNA, 24 bp, Artificial Sequence
  Synthetic oligonucleotide; TAGTGATT chr11 5213397 5213420 5213417 +
gctattgttgatgtatgggaatgc

SEQ ID NO: 64434 - DNA, 24 bp, Artificial Sequence
  Synthetic oligonucleotide; CATTGATT chr11 5213411 5213434 5213431 +
atgggaatgctagtgatttttgta

SEQ ID NO: 64435 - DNA, 24 bp, Artificial Sequence
  Synthetic oligonucleotide; GCCTGATT chr11 5213555 5213578 5213575 +
ggatgccctttattcccttctctt

SEQ ID NO: 64436 - DNA, 24 bp, Artificial Sequence
  Synthetic oligonucleotide; ACTTGATT chr11 5213905 5213928 5213925 +
tcttgcttctcagggataaagcct

SEQ ID NO: 64437 - DNA, 24 bp, Artificial Sequence
  Synthetic oligonucleotide; GGTGGATT chr11 5213915 5213938 5213935 +
cagggataaagcctacttgattga

SEQ ID NO: 64438 - DNA, 24 bp, Artificial Sequence
  Synthetic oligonucleotide; GCTGGATT chr11 5213939 5213962 5213959 +
ggtggattagctttgtgatgtgtt

SEQ ID NO: 64439 - DNA, 24 bp, Artificial Sequence
  Synthetic oligonucleotide; AATTGATT chr11 5214241 5214264 5214261 +
agctcatcatggatctcttcagga

SEQ ID NO: 64440 - DNA, 24 bp, Artificial Sequence
  Synthetic oligonucleotide; AATAGATT chr11 5214343 5214366 5214363 +
actctcagaccacagaggaataaa

SEQ ID NO: 64441 - DNA, 24 bp, Artificial Sequence
  Synthetic oligonucleotide; AAAAGATT chr11 5214709 5214732 5214729 +
atattaaaacacaaaataccattc

SEQ ID NO: 64442 - DNA, 24 bp, Artificial Sequence
  Synthetic oligonucleotide; TGTTGATT chr11 5215650 5215673 5215670 +
ttaatgggagactttcccctagct

SEQ ID NO: 64443 - DNA, 24 bp, Artificial Sequence
  Synthetic oligonucleotide; TTGAGATT chr11 5215708 5215731 5215728 +
tggctcctgtttagtattgctgct

SEQ ID NO: 64444 - DNA, 24 bp, Artificial Sequence
  Synthetic oligonucleotide; GCATGATT chr11 5216467 5216490 5216487 +
acgtgtgcatgtgtctttatagca

SEQ ID NO: 64445 - DNA, 24 bp, Artificial Sequence
  Synthetic oligonucleotide; TCTAGATT chr11 5216534 5216557 5216554 +
gctgggtcaaatggtatttctagt

SEQ ID NO: 64446 - DNA, 24 bp, Artificial Sequence
  Synthetic oligonucleotide; TTTTGATT chr11 5216707 5216730 5216727 +
gtgtgagatggtatctcattgtgg

SEQ ID NO: 64447 - DNA, 24 bp, Artificial Sequence
  Synthetic oligonucleotide; TTTTGATT chr11 5216761 5216784 5216781 +
atgatgagcattttttcatgtgtt

SEQ ID NO: 64448 - DNA, 24 bp, Artificial Sequence
  Synthetic oligonucleotide; TGTAGATT chr11 5216865 5216888 5216885 +
tcttgtaaatttgtttgagttcat

SEQ ID NO: 64449 - DNA, 24 bp, Artificial Sequence
  Synthetic oligonucleotide; AGTAGATT chr11 5216898 5216921 5216918 +
tggatattagccctttgtcagatg

SEQ ID NO: 64450 - DNA, 24 bp, Artificial Sequence
  Synthetic oligonucleotide; TTAGGATT chr11 5217444 5217467 5217464 +
tgcctccagctttgttcttttggc

SEQ ID NO: 64451 - DNA, 24 bp, Artificial Sequence
  Synthetic oligonucleotide; TATTGATT chr11 5217594 5217617 5217614 +
tgggcagtatgaccattttcacga

SEQ ID NO: 64452 - DNA, 24 bp, Artificial Sequence
  Synthetic oligonucleotide; GTTGGATT chr11 5217711 5217734 5217731 +
agaggtccttcacatcccttgtaa

SEQ ID NO: 64453 - DNA, 24 bp, Artificial Sequence
  Synthetic oligonucleotide; TCATGATT chr11 5217765 5217788 5217785 +
aagcaattgtgaatgggagttcac

SEQ ID NO: 64454 - DNA, 24 bp, Artificial Sequence
  Synthetic oligonucleotide; TTGTGATT chr11 5217811 5217834 5217831 +
tctgttattggtgcataggaatac

SEQ ID NO: 64455 - DNA, 24 bp, Artificial Sequence
  Synthetic oligonucleotide; CACTGATT chr11 5217825 5217848 5217845 +
ataggaatacttgtgatttttgca

SEQ ID NO: 64456 - DNA, 24 bp, Artificial Sequence
  Synthetic oligonucleotide; AGGAGATT chr11 5217872 5217895 5217892 +
ttgctgaagttgcttatcagctta

SEQ ID NO: 64457 - DNA, 24 bp, Artificial Sequence
  Synthetic oligonucleotide; GCCTGATT chr11 5217987 5218010 5218007 +
gaatgccctttatttccttctcct

SEQ ID NO: 64458 - DNA, 24 bp, Artificial Sequence
  Synthetic oligonucleotide; GCTGGATT chr11 5218275 5218298 5218295 +
ttgtgtctttggttctgtttatat

SEQ ID NO: 64459 - DNA, 24 bp, Artificial Sequence
  Synthetic oligonucleotide; TATTGATT chr11 5218288 5218311 5218308 +
tctgtttatatgctggattatgtt

SEQ ID NO: 64460 - DNA, 24 bp, Artificial Sequence
  Synthetic oligonucleotide; TGAGGATT chr11 5218373 5218396 5218393 +
tggatcagtttgccagtattttat

SEQ ID NO: 64461 - DNA, 24 bp, Artificial Sequence
  Synthetic oligonucleotide; GGAGGATT chr11 5218487 5218510 5218507 +
tgctggcctcataaaatgagttag

SEQ ID NO: 64462 - DNA, 24 bp, Artificial Sequence
  Synthetic oligonucleotide; TATTGATT chr11 5218506 5218529 5218526 +
gttagggaggattccctctttttc

SEQ ID NO: 64463 - DNA, 24 bp, Artificial Sequence
  Synthetic oligonucleotide; TCTAGATT chr11 5218723 5218746 5218743 +
gtgtcgaggaatttatccatttct

SEQ ID NO: 64464 - DNA, 24 bp, Artificial Sequence
  Synthetic oligonucleotide; ATTTGATT chr11 5218832 5218855 5218852 +
cccgtgtcattttttattgcgtct

SEQ ID NO: 64465 - DNA, 24 bp, Artificial Sequence
  Synthetic oligonucleotide; TCTGGATT chr11 5218912 5218935 5218932 +
gttgatcttttcaaaaaaacagct

SEQ ID NO: 64466 - DNA, 24 bp, Artificial Sequence
  Synthetic oligonucleotide; CATTGATT chr11 5218920 5218943 5218940 +
tttcaaaaaaacagcttctggatt

SEQ ID NO: 64467 - DNA, 24 bp, Artificial Sequence
  Synthetic oligonucleotide; CAGAGATT chr11 5219139 5219162 5219159 +
ctacacactgctttgaatgtgtct

SEQ ID NO: 64468 - DNA, 24 bp, Artificial Sequence
  Synthetic oligonucleotide; GTTTGATT chr11 5219299 5219322 5219319 +
tgagtttcttaatcctgagttcta

SEQ ID NO: 64469 - DNA, 24 bp, Artificial Sequence
  Synthetic oligonucleotide; TGTTGATT chr11 5219435 5219458 5219455 +
tggtgctgaaaagaatgtatattc

SEQ ID NO: 64470 - DNA, 24 bp, Artificial Sequence
  Synthetic oligonucleotide; CTAGGATT chr11 5219770 5219793 5219790 +
gtttaaaatctgttttatcagaga

SEQ ID NO: 64471 - DNA, 24 bp, Artificial Sequence
  Synthetic oligonucleotide; AAAGGATT chr11 5220187 5220210 5220207 +
atctctcagcatttgcttgtctgt

SEQ ID NO: 64472 - DNA, 24 bp, Artificial Sequence
  Synthetic oligonucleotide; GCTAGATT chr11 5220509 5220532 5220529 +
tgaatgtgaatttgggcttgcctt

SEQ ID NO: 64473 - DNA, 24 bp, Artificial Sequence
  Synthetic oligonucleotide; TGTAGATT chr11 5220602 5220625 5220622 +
tcactttcagctacaccaattaga

SEQ ID NO: 64474 - DNA, 24 bp, Artificial Sequence
  Synthetic oligonucleotide; ACCCGATT chr11 5221829 5221852 5221849 +
gagcgcagtattagggcgggagtg

SEQ ID NO: 64475 - DNA, 24 bp, Artificial Sequence
  Synthetic oligonucleotide; AAGCGATT chr11 5222217 5222240 5222237 +
ctgcaacctctgcctcccaggatc

SEQ ID NO: 64476 - DNA, 24 bp, Artificial Sequence
  Synthetic oligonucleotide; CTGGGATT chr11 5222249 5222272 5222269 +
ctcctgcctcagcctcccaaattg

SEQ ID NO: 64477 - DNA, 24 bp, Artificial Sequence
  Synthetic oligonucleotide; CTAAGATT chr11 5222512 5222535 5222532 +
gataattaaataacagtgttatct

SEQ ID NO: 64478 - DNA, 24 bp, Artificial Sequence
  Synthetic oligonucleotide; AATCGATT chr11 5222591 5222614 5222611 +
ttttaccttcacacctaattgtgt

SEQ ID NO: 64479 - DNA, 24 bp, Artificial Sequence
  Synthetic oligonucleotide; GTGAGATT chr11 5222727 5222750 5222747 +
tatatatcacattattatatttta

SEQ ID NO: 64480 - DNA, 24 bp, Artificial Sequence
  Synthetic oligonucleotide; TTTGGATT chr11 5222740 5222763 5222760 +
attatattttagtgagatttagtt

SEQ ID NO: 64481 - DNA, 24 bp, Artificial Sequence
  Synthetic oligonucleotide; ACATGATT chr11 5222794 5222817 5222814 +
ttacacatgagtggtattaattta

SEQ ID NO: 64482 - DNA, 24 bp, Artificial Sequence
  Synthetic oligonucleotide; TATAGATT chr11 5223049 5223072 5223069 +
atctaaaatatatatatatataat

SEQ ID NO: 64483 - DNA, 24 bp, Artificial Sequence
  Synthetic oligonucleotide; AAATGATT chr11 5223321 5223344 5223341 +
gttttaatatatgtataccttgtg

SEQ ID NO: 64484 - DNA, 24 bp, Artificial Sequence
  Synthetic oligonucleotide; AGGAGATT chr11 5223574 5223597 5223594 +
cccagctactcgggaggctgaggc

SEQ ID NO: 64485 - DNA, 24 bp, Artificial Sequence
  Synthetic oligonucleotide; TCCTGATT chr11 5223810 5223833 5223830 +
ttttataccctttgagtaatagtt

SEQ ID NO: 64486 - DNA, 24 bp, Artificial Sequence
  Synthetic oligonucleotide; GCAGGATT chr11 5223983 5224006 5224003 +
ggttcatcaattctgccataaatg

SEQ ID NO: 64487 - DNA, 24 bp, Artificial Sequence
  Synthetic oligonucleotide; TTTTGATT chr11 5224274 5224297 5224294 +
aacgtgaatattagaattttcttc

SEQ ID NO: 64488 - DNA, 24 bp, Artificial Sequence
  Synthetic oligonucleotide; GTCTGATT chr11 5224366 5224389 5224386 +
ttttgtttatggtgtaagacaagg

SEQ ID NO: 64489 - DNA, 24 bp, Artificial Sequence
  Synthetic oligonucleotide; TACTGATT chr11 5224445 5224468 5224465 +
atatacccttctatcatcacttat

SEQ ID NO: 64490 - DNA, 24 bp, Artificial Sequence
  Synthetic oligonucleotide; CCTTGATT chr11 5224458 5224481 5224478 +
tcatcacttattactgattatatg

SEQ ID NO: 64491 - DNA, 24 bp, Artificial Sequence
  Synthetic oligonucleotide; ACTAGATT chr11 5224480 5224503 5224500 +
tgccttgatttcagaatcttgcca

SEQ ID NO: 64492 - DNA, 24 bp, Artificial Sequence
  Synthetic oligonucleotide; TGCAGATT chr11 5224882 5224905 5224902 +
gtgatagttccgggagactagcac

SEQ ID NO: 64493 - DNA, 24 bp, Artificial Sequence
  Synthetic oligonucleotide; ACATGATT chr11 5225729 5225752 5225749 +
gtgggaggaagataagaggtatga

SEQ ID NO: 64494 - DNA, 24 bp, Artificial Sequence
  Synthetic oligonucleotide; GCTGGATT chr11 5225808 5225831 5225828 +
ccataaaataaaagcagaatggta

SEQ ID NO: 64495 - DNA, 24 bp, Artificial Sequence
  Synthetic oligonucleotide; AAGAGATT chr11 5225982 5226005 5226002 +
ttgtatcattattgccctgaaaga

SEQ ID NO: 64496 - DNA, 24 bp, Artificial Sequence
  Synthetic oligonucleotide; CCCTGATT chr11 5226071 5226094 5226091 +
tttaaaattacaaatgcaaaatta

SEQ ID NO: 64497 - DNA, 24 bp, Artificial Sequence
  Synthetic oligonucleotide; TAATGATT chr11 5226133 5226156 5226153 +
tacactttaacccataaatatgta

SEQ ID NO: 64498 - DNA, 24 bp, Artificial Sequence
  Synthetic oligonucleotide; GGGAGATT chr11 5226174 5226197 5226194 +
ttaaaaataaaagaaaataaagta

SEQ ID NO: 64499 - DNA, 24 bp, Artificial Sequence
  Synthetic oligonucleotide; AGTAGATT chr11 5227114 5227137 5227134 +
gctcctgccctccctgctcctggg

SEQ ID NO: 64500 - DNA, 24 bp, Artificial Sequence
  Synthetic oligonucleotide; TTTGGATT chr11 5227540 5227563 5227560 +
ggttctaagcatatcttctcctta

SEQ ID NO: 64501 - DNA, 24 bp, Artificial Sequence
  Synthetic oligonucleotide; CTCAGATT chr11 5227977 5228000 5227997 +
gaggggaaaaggtcttctacttgg

SEQ ID NO: 64502 - DNA, 24 bp, Artificial Sequence
  Synthetic oligonucleotide; CCTTGATT chr11 5228032 5228055 5228052 +
gaatactgcgttttaaaatcattt

SEQ ID NO: 64503 - DNA, 24 bp, Artificial Sequence
  Synthetic oligonucleotide; CTACGATT chr11 5228423 5228446 5228443 +
cctttcagctctaacactctgaaa

SEQ ID NO: 64504 - DNA, 24 bp, Artificial Sequence
  Synthetic oligonucleotide; CTCTGATT chr11 5228662 5228685 5228682 +
tcaggtacttgtgaaaaaatctca

SEQ ID NO: 64505 - DNA, 24 bp, Artificial Sequence
  Synthetic oligonucleotide; GTATGATT chr11 5228742 5228765 5228762 +
cctaggttaaaaaattatgcctat

SEQ ID NO: 64506 - DNA, 24 bp, Artificial Sequence
  Synthetic oligonucleotide; AAAAGATT chr11 5228850 5228873 5228870 +
tctaggcacacgtgtatccctgag

SEQ ID NO: 64507 - DNA, 24 bp, Artificial Sequence
  Synthetic oligonucleotide; TGCAGATT chr11 5228913 5228936 5228933 +
taaaatattttaaatgttaaaaca

SEQ ID NO: 64508 - DNA, 24 bp, Artificial Sequence
  Synthetic oligonucleotide; GTTAGATT chr11 5228931 5228954 5228951 +
aaaacatgcagatttgacttggct

SEQ ID NO: 64509 - DNA, 24 bp, Artificial Sequence
  Synthetic oligonucleotide; TTTGGATT chr11 5228938 5228961 5228958 +
gcagatttgacttggctgttagat

SEQ ID NO: 64510 - DNA, 24 bp, Artificial Sequence
  Synthetic oligonucleotide; TTTAGATT chr11 5228981 5229004 5229001 +
aatttaaacctgcattagcattgt

SEQ ID NO: 64511 - DNA, 24 bp, Artificial Sequence
  Synthetic oligonucleotide; TCCTGATT chr11 5229189 5229212 5229209 +
attgtcaaagcaagagctttgaaa

SEQ ID NO: 64512 - DNA, 24 bp, Artificial Sequence
  Synthetic oligonucleotide; CTCAGATT chr11 5230343 5230366 5230363 +
ttcattaatatttcctccactggg

SEQ ID NO: 64513 - DNA, 24 bp, Artificial Sequence
  Synthetic oligonucleotide; TTGAGATT chr11 5230438 5230461 5230458 +
cagaggtacagtcttcagataaat

SEQ ID NO: 64514 - DNA, 24 bp, Artificial Sequence
  Synthetic oligonucleotide; GGATGATT chr11 5230541 5230564 5230561 +
ggactgctctgaagctcaagagat

SEQ ID NO: 64515 - DNA, 24 bp, Artificial Sequence
  Synthetic oligonucleotide; TACAGATT chr11 5230884 5230907 5230904 +
attgcatatcactgggtcttgatg

SEQ ID NO: 64516 - DNA, 24 bp, Artificial Sequence
  Synthetic oligonucleotide; TTTGGATT chr11 5231217 5231240 5231237 +
gatgttctcatgaattctctggta

SEQ ID NO: 64517 - DNA, 24 bp, Artificial Sequence
  Synthetic oligonucleotide; AACAGATT chr11 5231720 5231743 5231740 +
aagcactttcaaacacaaggaaac

SEQ ID NO: 64518 - DNA, 24 bp, Artificial Sequence
  Synthetic oligonucleotide; TACAGATT chr11 5231775 5231798 5231795 +
taaaattaatcaacatgcatataa

SEQ ID NO: 64519 - DNA, 24 bp, Artificial Sequence
  Synthetic oligonucleotide; GAAAGATT chr11 5232236 5232259 5232256 +
aaaaatggtgtgggggagggtttg

SEQ ID NO: 64520 - DNA, 24 bp, Artificial Sequence
  Synthetic oligonucleotide; AACAGATT chr11 5233398 5233421 5233418 +
agcatatacaaattaattactata

SEQ ID NO: 64521 - DNA, 24 bp, Artificial Sequence
  Synthetic oligonucleotide; AATTGATT chr11 5233420 5233443 5233440 +
taaacagattaatagatacaaatt

SEQ ID NO: 64522 - DNA, 24 bp, Artificial Sequence
  Synthetic oligonucleotide; AAATGATT chr11 5233574 5233597 5233594 +
aaattccaattattccttattgta

SEQ ID NO: 64523 - DNA, 24 bp, Artificial Sequence
  Synthetic oligonucleotide; AAAGGATT chr11 5233656 5233679 5233676 +
ctcccatacccatgtggagagaca

SEQ ID NO: 64524 - DNA, 24 bp, Artificial Sequence
  Synthetic oligonucleotide; GCAAGATT chr11 5233784 5233807 5233804 +
caggatattaaataatttaaaata

SEQ ID NO: 64525 - DNA, 24 bp, Artificial Sequence
  Synthetic oligonucleotide; GTAAGATT chr11 5233918 5233941 5233938 +
gcaggtaggtaaaagaaccaaaat

SEQ ID NO: 64526 - DNA, 24 bp, Artificial Sequence
  Synthetic oligonucleotide; CTGAGATT chr11 5234603 5234626 5234623 +
attccactattcccttaacttgcc

SEQ ID NO: 64527 - DNA, 24 bp, Artificial Sequence
  Synthetic oligonucleotide; TAGAGATT chr11 5234861 5234884 5234881 +
caatataaagttcttctttgcctc

SEQ ID NO: 64528 - DNA, 24 bp, Artificial Sequence
  Synthetic oligonucleotide; AGTAGATT chr11 5235180 5235203 5235200 +
ctaaagaaagaatgcaaagtgaaa

SEQ ID NO: 64529 - DNA, 24 bp, Artificial Sequence
  Synthetic oligonucleotide; GCCAGATT chr11 5235199 5235222 5235219 +
tgaaaagtagatttaccatattca

SEQ ID NO: 64530 - DNA, 24 bp, Artificial Sequence
  Synthetic oligonucleotide; GAAGGATT chr11 5235383 5235406 5235403 +
cacacccatgagcatatccaaaag

SEQ ID NO: 64531 - DNA, 24 bp, Artificial Sequence
  Synthetic oligonucleotide; GGTTGATT chr11 5236025 5236048 5236045 +
atacaaatgcattttacagcattt

SEQ ID NO: 64532 - DNA, 24 bp, Artificial Sequence
  Synthetic oligonucleotide; CTGAGATT chr11 5236099 5236122 5236119 +
tatatagaaagatggatgatgtgc

SEQ ID NO: 64533 - DNA, 24 bp, Artificial Sequence
  Synthetic oligonucleotide; GTTTGATT chr11 5236243 5236266 5236263 +
taattcaagaaaggtggtggcatg

SEQ ID NO: 64534 - DNA, 24 bp, Artificial Sequence
  Synthetic oligonucleotide; AAAAGATT chr11 5236260 5236283 5236280 +
tggcatggtttgatttgtgtcttt

SEQ ID NO: 64535 - DNA, 24 bp, Artificial Sequence
  Synthetic oligonucleotide; AATTGATT chr11 5236726 5236749 5236746 +
atgtttccaattcatatataagaa

SEQ ID NO: 64536 - DNA, 24 bp, Artificial Sequence
  Synthetic oligonucleotide; AAATGATT chr11 5236839 5236862 5236859 +
ttcactttaattctgttctacctg

SEQ ID NO: 64537 - DNA, 24 bp, Artificial Sequence
  Synthetic oligonucleotide; TATGGATT chr11 5236883 5236906 5236903 +
agatctggttacatgtttattcta

SEQ ID NO: 64538 - DNA, 24 bp, Artificial Sequence
  Synthetic oligonucleotide; AGAGGATT chr11 5236897 5236920 5236917 +
gtttattctatatggattgcattg

SEQ ID NO: 64539 - DNA, 24 bp, Artificial Sequence
  Synthetic oligonucleotide; GGCTGATT chr11 5237086 5237109 5237106 +
actgcaggcatgcaccacacgccc

SEQ ID NO: 64540 - DNA, 24 bp, Artificial Sequence
  Synthetic oligonucleotide; TGGTGATT chr11 5237302 5237325 5237322 +
gaggacctgactgggcagtaagag

SEQ ID NO: 64541 - DNA, 24 bp, Artificial Sequence
  Synthetic oligonucleotide; TGTTGATT chr11 5237343 5237366 5237363 +
ggacaaattgaagcagaatcgaac

SEQ ID NO: 64542 - DNA, 24 bp, Artificial Sequence
  Synthetic oligonucleotide; AAATGATT chr11 5237361 5237384 5237381 +
tcgaactgttgattagaggtaggg

SEQ ID NO: 64543 - DNA, 24 bp, Artificial Sequence
  Synthetic oligonucleotide; TTGGGATT chr11 5237581 5237604 5237601 +
gaggttagaaatcagagttgggaa

SEQ ID NO: 64544 - DNA, 24 bp, Artificial Sequence
  Synthetic oligonucleotide; CGATGATT chr11 5237735 5237758 5237755 +
gtaagacatagtccccaaaatccc

SEQ ID NO: 64545 - DNA, 24 bp, Artificial Sequence
  Synthetic oligonucleotide; TATCGATT chr11 5237754 5237777 5237774 +
atccccgatgattttagaactcag

SEQ ID NO: 64546 - DNA, 24 bp, Artificial Sequence
  Synthetic oligonucleotide; TCTAGATT chr11 5237839 5237862 5237859 +
ttcagagcaggtaggagataaggt

SEQ ID NO: 64547 - DNA, 24 bp, Artificial Sequence
  Synthetic oligonucleotide; GCAAGATT chr11 5238730 5238753 5238750 +
aacactggctgagggaaagcataa

SEQ ID NO: 64548 - DNA, 24 bp, Artificial Sequence
  Synthetic oligonucleotide; TCTAGATT chr11 5238986 5239009 5239006 +
agaggttttctgatgttactaaca

SEQ ID NO: 64549 - DNA, 24 bp, Artificial Sequence
  Synthetic oligonucleotide; AGCAGATT chr11 5239480 5239503 5239500 +
atttagtggtaggaatatacaatg

SEQ ID NO: 64550 - DNA, 24 bp, Artificial Sequence
  Synthetic oligonucleotide; TCTAGATT chr11 5239734 5239757 5239754 +
agtcaaatgcagaaatccaaattc

SEQ ID NO: 64551 - DNA, 24 bp, Artificial Sequence
  Synthetic oligonucleotide; ACAAGATT chr11 5239893 5239916 5239913 +
atatcagagaatgtttacattgct

SEQ ID NO: 64552 - DNA, 24 bp, Artificial Sequence
  Synthetic oligonucleotide; GTGAGATT chr11 5240107 5240130 5240127 +
agaagggcaagggatagcacaagt

SEQ ID NO: 64553 - DNA, 24 bp, Artificial Sequence
  Synthetic oligonucleotide; GTGTGATT chr11 5240120 5240143 5240140 +
atagcacaagtgtgagattttaaa

SEQ ID NO: 64554 - DNA, 24 bp, Artificial Sequence
  Synthetic oligonucleotide; GAGTGATT chr11 5240190 5240213 5240210 +
aatgtatgctacaagacagcagtt

SEQ ID NO: 64555 - DNA, 24 bp, Artificial Sequence
  Synthetic oligonucleotide; TTGGGATT chr11 5240385 5240408 5240405 +
aggaaatactttgagaaagaggtt

SEQ ID NO: 64556 - DNA, 24 bp, Artificial Sequence
  Synthetic oligonucleotide; AAGTGATT chr11 5240501 5240524 5240521 +
aagggtcttgggtacaggagtttg

SEQ ID NO: 64557 - DNA, 24 bp, Artificial Sequence
  Synthetic oligonucleotide; CAGGGATT chr11 5240603 5240626 5240623 +
aatttccttcttttcattcacaga

SEQ ID NO: 64558 - DNA, 24 bp, Artificial Sequence
  Synthetic oligonucleotide; ACTCGATT chr11 5240684 5240707 5240704 +
caatcactgccacaatggtctctt

SEQ ID NO: 64559 - DNA, 24 bp, Artificial Sequence
  Synthetic oligonucleotide; CAGTGATT chr11 5240879 5240902 5240899 +
gtcactctcatatgcaagaaactt

SEQ ID NO: 64560 - DNA, 24 bp, Artificial Sequence
  Synthetic oligonucleotide; TATTGATT chr11 5241077 5241100 5241097 +
taaacaaaaatcagtggttttcaa

SEQ ID NO: 64561 - DNA, 24 bp, Artificial Sequence
  Synthetic oligonucleotide; AAGAGATT chr11 5241225 5241248 5241245 +
tttatagaaacagagagctgaaca

SEQ ID NO: 64562 - DNA, 24 bp, Artificial Sequence
  Synthetic oligonucleotide; CCTTGATT chr11 5241483 5241506 5241503 +
ttaagagaaagttcaaggtttggc

SEQ ID NO: 64563 - DNA, 24 bp, Artificial Sequence
  Synthetic oligonucleotide; AGACGATT chr11 5241733 5241756 5241753 +
tgtaaaaacattgtcttattctag

SEQ ID NO: 64564 - DNA, 24 bp, Artificial Sequence
  Synthetic oligonucleotide; GCAGGATT chr11 5241798 5241821 5241818 +
cacccacgagttctctcttttctt

SEQ ID NO: 64565 - DNA, 24 bp, Artificial Sequence
  Synthetic oligonucleotide; ATGAGATT chr11 5242031 5242054 5242051 +
cccaacctcccccatctaaaggag

SEQ ID NO: 64566 - DNA, 24 bp, Artificial Sequence
  Synthetic oligonucleotide; TTGTGATT chr11 5242450 5242473 5242470 +
atgccaactcactaccccaacata

SEQ ID NO: 64567 - DNA, 24 bp, Artificial Sequence
  Synthetic oligonucleotide; GTTTGATT chr11 5242819 5242842 5242839 +
tgttccctcatccaaaaacactca

SEQ ID NO: 64568 - DNA, 24 bp, Artificial Sequence
  Synthetic oligonucleotide; CTGGGATT chr11 5244410 5244433 5244430 +
cgcccacctcagcctcccaaagtg

SEQ ID NO: 64569 - DNA, 24 bp, Artificial Sequence
  Synthetic oligonucleotide; AGGAGATT chr11 5244600 5244623 5244620 +
tagtcagtgtacttatctgaacaa

SEQ ID NO: 64570 - DNA, 24 bp, Artificial Sequence
  Synthetic oligonucleotide; AGGAGATT chr11 5244722 5244745 5244742 +
gctgctctgttcaagcaagaggat

SEQ ID NO: 64571 - DNA, 24 bp, Artificial Sequence
  Synthetic oligonucleotide; CCAAGATT chr11 5245245 5245268 5245265 +
agtgacaaacagtttgaggcaaaa

SEQ ID NO: 64572 - DNA, 24 bp, Artificial Sequence
  Synthetic oligonucleotide; TATTGATT chr11 5245581 5245604 5245601 +
gacctgcagtcactttcctggaag

SEQ ID NO: 64573 - DNA, 24 bp, Artificial Sequence
  Synthetic oligonucleotide; CCATGATT chr11 5245628 5245651 5245648 +
ctgttccccatttccaattgtttt

SEQ ID NO: 64574 - DNA, 24 bp, Artificial Sequence
  Synthetic oligonucleotide; ATTAGATT chr11 5245743 5245766 5245763 +
tatgcattaattcaacaaatacat

SEQ ID NO: 64575 - DNA, 24 bp, Artificial Sequence
  Synthetic oligonucleotide; GACAGATT chr11 5245827 5245850 5245847 +
tgagaatcttacatgaactagaca

SEQ ID NO: 64576 - DNA, 24 bp, Artificial Sequence
  Synthetic oligonucleotide; AAGAGATT chr11 5245906 5245929 5245926 +
acatactaaaagaaatgaattaat

SEQ ID NO: 64577 - DNA, 24 bp, Artificial Sequence
  Synthetic oligonucleotide; AAAGGATT chr11 5246003 5246026 5246023 +
acctgacaaaagcaagcaatgggg

SEQ ID NO: 64578 - DNA, 24 bp, Artificial Sequence
  Synthetic oligonucleotide; GATGGATT chr11 5246105 5246128 5246125 +
ataccttatccaaaattaactcca

SEQ ID NO: 64579 - DNA, 24 bp, Artificial Sequence
  Synthetic oligonucleotide; CACAGATT chr11 5246193 5246216 5246213 +
tactattcatgatataaacacggg

SEQ ID NO: 64580 - DNA, 24 bp, Artificial Sequence
  Synthetic oligonucleotide; AAAAGATT chr11 5246330 5246353 5246350 +
cgaaagacaatctacagaatggga

SEQ ID NO: 64581 - DNA, 24 bp, Artificial Sequence
  Synthetic oligonucleotide; CCTGGATT chr11 5247247 5247270 5247267 +
ctgactcgtggtcagggttctctt

SEQ ID NO: 64582 - DNA, 24 bp, Artificial Sequence
  Synthetic oligonucleotide; TGGGGATT chr11 5247423 5247446 5247443 +
ccacagataaggtcagttgggagt

SEQ ID NO: 64583 - DNA, 24 bp, Artificial Sequence
  Synthetic oligonucleotide; TGCTGATT chr11 5247645 5247668 5247665 +
tgctcatgctgacttgtgagcctc

SEQ ID NO: 64584 - DNA, 24 bp, Artificial Sequence
  Synthetic oligonucleotide; ATGGGATT chr11 5247744 5247767 5247764 +
tgaccaatctgcacacttgagggc

SEQ ID NO: 64585 - DNA, 24 bp, Artificial Sequence
  Synthetic oligonucleotide; ACCGGATT chr11 5248011 5248034 5248031 +
tgtcctatagaggtctttcttccc

SEQ ID NO: 64586 - DNA, 24 bp, Artificial Sequence
  Synthetic oligonucleotide; AATAGATT chr11 5248263 5248286 5248283 +
aaatcatgtgtgatctctcagcag

SEQ ID NO: 64587 - DNA, 24 bp, Artificial Sequence
  Synthetic oligonucleotide; AATGGATT chr11 5248424 5248447 5248444 +
cctcaggggtgaattctttgccga

SEQ ID NO: 64588 - DNA, 24 bp, Artificial Sequence
  Synthetic oligonucleotide; CTGAGATT chr11 5248589 5248612 5248609 +
gcctatgttaacttccctcaaagc

SEQ ID NO: 64589 - DNA, 24 bp, Artificial Sequence
  Synthetic oligonucleotide; TCTAGATT chr11 5249147 5249170 5249167 +
ttttctcaaagtcaaaattgtcca

SEQ ID NO: 64590 - DNA, 24 bp, Artificial Sequence
  Synthetic oligonucleotide; GTGAGATT chr11 5249569 5249592 5249589 +
ccatgggtagacaaccaggagcct

SEQ ID NO: 64591 - DNA, 24 bp, Artificial Sequence
  Synthetic oligonucleotide; TTCCGATT chr11 5250081 5250104 5250101 +
attttttttatagcctttgccttg

SEQ ID NO: 64592 - DNA, 24 bp, Artificial Sequence
  Synthetic oligonucleotide; CAGGGATT chr11 5250256 5250279 5250276 +
gcatgtaccaatttttgaaaagtt

SEQ ID NO: 64593 - DNA, 24 bp, Artificial Sequence
  Synthetic oligonucleotide; CCAGGATT chr11 5250288 5250311 5250308 +
gtgaaatgtgttttaggcataggt

SEQ ID NO: 64594 - DNA, 24 bp, Artificial Sequence
  Synthetic oligonucleotide; AATAGATT chr11 5250458 5250481 5250478 +
ataaagccacagtttcagcgcagt

SEQ ID NO: 64595 - DNA, 24 bp, Artificial Sequence
  Synthetic oligonucleotide; ATTTGATT chr11 5250559 5250582 5250579 +
atgactgtttcatcttagaaaaat

SEQ ID NO: 64596 - DNA, 24 bp, Artificial Sequence
  Synthetic oligonucleotide; TGTGGATT chr11 5250708 5250731 5250728 +
ggtagaatgttctttggcaggtac

SEQ ID NO: 64597 - DNA, 24 bp, Artificial Sequence
  Synthetic oligonucleotide; GCTAGATT chr11 5251026 5251049 5251046 +
aagtgatccatgatctctaacctt

SEQ ID NO: 64598 - DNA, 24 bp, Artificial Sequence
  Synthetic oligonucleotide; GGTTGATT chr11 5251112 5251135 5251132 +
attagtttatcccctaagctatca

SEQ ID NO: 64599 - DNA, 24 bp, Artificial Sequence
  Synthetic oligonucleotide; TTATGATT chr11 5251567 5251590 5251587 +
gtgatggcatttgaagtgggtcct

SEQ ID NO: 64600 - DNA, 24 bp, Artificial Sequence
  Synthetic oligonucleotide; TGGAGATT chr11 5251844 5251867 5251864 +
ttattctgaaacacagaggacaag

SEQ ID NO: 64601 - DNA, 24 bp, Artificial Sequence
  Synthetic oligonucleotide; ACAGGATT chr11 5251979 5252002 5251999 +
agcatagactgggtgacttcaaca

SEQ ID NO: 64602 - DNA, 24 bp, Artificial Sequence
  Synthetic oligonucleotide; ACCTGATT chr11 5252152 5252175 5252172 +
atctgctctcatgagctcctctaa

SEQ ID NO: 64603 - DNA, 24 bp, Artificial Sequence
  Synthetic oligonucleotide; TGGGGATT chr11 5252202 5252225 5252222 +
ccacaaatggagccaattgggagt

SEQ ID NO: 64604 - DNA, 24 bp, Artificial Sequence
  Synthetic oligonucleotide; ATGGGATT chr11 5252528 5252551 5252548 +
tgaccagtctgtagacttaagggt

SEQ ID NO: 64605 - DNA, 24 bp, Artificial Sequence
  Synthetic oligonucleotide; ACCAGATT chr11 5252921 5252944 5252941 +
tgtcctatagaggtctttcttcca

SEQ ID NO: 64606 - DNA, 24 bp, Artificial Sequence
  Synthetic oligonucleotide; AATAGATT chr11 5253182 5253205 5253202 +
caaccatgtgtgatctcttagcag

SEQ ID NO: 64607 - DNA, 24 bp, Artificial Sequence
  Synthetic oligonucleotide; ATTTGATT chr11 5253194 5253217 5253214 +
atctcttagcagaatagatttatt

SEQ ID NO: 64608 - DNA, 24 bp, Artificial Sequence
  Synthetic oligonucleotide; AATGGATT chr11 5253342 5253365 5253362 +
cctcaggggtgaattctttgccga

SEQ ID NO: 64609 - DNA, 24 bp, Artificial Sequence
  Synthetic oligonucleotide; CTGAGATT chr11 5253507 5253530 5253527 +
gcctatgttaacttccctcaaagc

SEQ ID NO: 64610 - DNA, 24 bp, Artificial Sequence
  Synthetic oligonucleotide; TCTAGATT chr11 5254071 5254094 5254091 +
ttttctcaaagtcaaagttgtcca

SEQ ID NO: 64611 - DNA, 24 bp, Artificial Sequence
  Synthetic oligonucleotide; GTGAGATT chr11 5254493 5254516 5254513 +
ccatgggtagacaaccaggagcct

SEQ ID NO: 64612 - DNA, 24 bp, Artificial Sequence
  Synthetic oligonucleotide; TTCCGATT chr11 5255009 5255032 5255029 +
attttttttatagcctttgccttg

SEQ ID NO: 64613 - DNA, 24 bp, Artificial Sequence
  Synthetic oligonucleotide; CAGGGATT chr11 5255184 5255207 5255204 +
gcatgtaccaatttttgaaaagtt

SEQ ID NO: 64614 - DNA, 24 bp, Artificial Sequence
  Synthetic oligonucleotide; CCAGGATT chr11 5255216 5255239 5255236 +
gtgaaatgtgttttaggcataggt

SEQ ID NO: 64615 - DNA, 24 bp, Artificial Sequence
  Synthetic oligonucleotide; AATAGATT chr11 5255384 5255407 5255404 +
ataaagcaacagtttcagtgcagg

SEQ ID NO: 64616 - DNA, 24 bp, Artificial Sequence
  Synthetic oligonucleotide; TATGGATT chr11 5255639 5255662 5255659 +
ggtagaatgctctttaccagatac

SEQ ID NO: 64617 - DNA, 24 bp, Artificial Sequence
  Synthetic oligonucleotide; TTGGGATT chr11 5255901 5255924 5255921 +
gctgtttttttctttattttttct

SEQ ID NO: 64618 - DNA, 24 bp, Artificial Sequence
  Synthetic oligonucleotide; GGTAGATT chr11 5255970 5255993 5255990 +
tctctgaactcgatccatgacctt

SEQ ID NO: 64619 - DNA, 24 bp, Artificial Sequence
  Synthetic oligonucleotide; AAAAGATT chr11 5256233 5256256 5256253 +
aaaagttgaataagaaaggaaaga

SEQ ID NO: 64620 - DNA, 24 bp, Artificial Sequence
  Synthetic oligonucleotide; GAAAGATT chr11 5256312 5256335 5256332 +
ttctctcaatctaaggatgggtga

SEQ ID NO: 64621 - DNA, 24 bp, Artificial Sequence
  Synthetic oligonucleotide; TACAGATT chr11 5256336 5256359 5256356 +
gaaagatttttattggtatgctgg

SEQ ID NO: 64622 - DNA, 24 bp, Artificial Sequence
  Synthetic oligonucleotide; CTGGGATT chr11 5256660 5256683 5256680 +
ctccttcctcagcctcccaagtag

SEQ ID NO: 64623 - DNA, 24 bp, Artificial Sequence
  Synthetic oligonucleotide; ATGGGATT chr11 5256715 5256738 5256735 +
tctaatttttgtatttttgtagag

SEQ ID NO: 64624 - DNA, 24 bp, Artificial Sequence
  Synthetic oligonucleotide; CTGGGATT chr11 5256794 5256817 5256814 +
tgcctgccttggcctcccaaaatt

SEQ ID NO: 64625 - DNA, 24 bp, Artificial Sequence
  Synthetic oligonucleotide; TGTTGATT chr11 5256996 5257019 5257016 +
ttgaggcaatatcttttaagagtt

SEQ ID NO: 64626 - DNA, 24 bp, Artificial Sequence
  Synthetic oligonucleotide; CCTCGATT chr11 5257029 5257052 5257049 +
ctccttatccataactgtcttatt

SEQ ID NO: 64627 - DNA, 24 bp, Artificial Sequence
  Synthetic oligonucleotide; CATTGATT chr11 5257059 5257082 5257079 +
tttttcctatatcattgcttctga

SEQ ID NO: 64628 - DNA, 24 bp, Artificial Sequence
  Synthetic oligonucleotide; TGAAGATT chr11 5257238 5257261 5257258 +
aagtcagagaataaaactttcctc

SEQ ID NO: 64629 - DNA, 24 bp, Artificial Sequence
  Synthetic oligonucleotide; GCTGGATT chr11 5257642 5257665 5257662 +
atctctaagcaacctgtactattg

SEQ ID NO: 64630 - DNA, 24 bp, Artificial Sequence
  Synthetic oligonucleotide; CCTTGATT chr11 5257893 5257916 5257913 +
actgcccacccctcaacatcacgt

SEQ ID NO: 64631 - DNA, 24 bp, Artificial Sequence
  Synthetic oligonucleotide; AAAAGATT chr11 5257958 5257981 5257978 +
agaagaaaaagagagagagagaaa

SEQ ID NO: 64632 - DNA, 24 bp, Artificial Sequence
  Synthetic oligonucleotide; GATTGATT chr11 5257962 5257985 5257982 +
gaaaaagagagagagagaaaaaaa

SEQ ID NO: 64633 - DNA, 24 bp, Artificial Sequence
  Synthetic oligonucleotide; AGCAGATT chr11 5258152 5258175 5258172 +
agaacgcacacaccctctgaaaga

SEQ ID NO: 64634 - DNA, 24 bp, Artificial Sequence
  Synthetic oligonucleotide; AGAAGATT chr11 5258285 5258308 5258305 +
gaacctgaagatctagaccacagg

SEQ ID NO: 64635 - DNA, 24 bp, Artificial Sequence
  Synthetic oligonucleotide; AACAGATT chr11 5258635 5258658 5258655 +
agccttgctcactgactgcatgga

SEQ ID NO: 64636 - DNA, 24 bp, Artificial Sequence
  Synthetic oligonucleotide; CCCTGATT chr11 5259503 5259526 5259523 +
aatgcatccaaaccaagaagaaat

SEQ ID NO: 64637 - DNA, 24 bp, Artificial Sequence
  Synthetic oligonucleotide; CTGGGATT chr11 5259847 5259870 5259867 +
atatgaacaaagcctccaagaaat

SEQ ID NO: 64638 - DNA, 24 bp, Artificial Sequence
  Synthetic oligonucleotide; ATCAGATT chr11 5260138 5260161 5260158 +
caggtaacctatgaaagaaaacct

SEQ ID NO: 64639 - DNA, 24 bp, Artificial Sequence
  Synthetic oligonucleotide; AGCAGATT chr11 5260149 5260172 5260169 +
tgaaagaaaacctatcagattaac

SEQ ID NO: 64640 - DNA, 24 bp, Artificial Sequence
  Synthetic oligonucleotide; AATGGATT chr11 5260956 5260979 5260976 +
catcaagacagtctacaaagaaac

SEQ ID NO: 64641 - DNA, 24 bp, Artificial Sequence
  Synthetic oligonucleotide; ACATGATT chr11 5261426 5261449 5261446 +
tcaaattgtctctgtttgcagatg

SEQ ID NO: 64642 - DNA, 24 bp, Artificial Sequence
  Synthetic oligonucleotide; TATAGATT chr11 5261791 5261814 5261811 +
atggccatactgcccaaagtaatt

SEQ ID NO: 64643 - DNA, 24 bp, Artificial Sequence
  Synthetic oligonucleotide; GGTGGATT chr11 5262205 5262228 5262225 +
caccttatacaaaaattaactcaa

SEQ ID NO: 64644 - DNA, 24 bp, Artificial Sequence
  Synthetic oligonucleotide; TGGCGATT chr11 5262789 5262812 5262809 +
gttcaaccattgtggaagacagtg

SEQ ID NO: 64645 - DNA, 24 bp, Artificial Sequence
  Synthetic oligonucleotide; GCAAGATT chr11 5263680 5263703 5263700 +
ataaataaaactgatagaccatta

SEQ ID NO: 64646 - DNA, 24 bp, Artificial Sequence
  Synthetic oligonucleotide; AAAAGATT chr11 5263770 5263793 5263790 +
ctattactgataccacagaaatac

SEQ ID NO: 64647 - DNA, 24 bp, Artificial Sequence
  Synthetic oligonucleotide; GATAGATT chr11 5263966 5263989 5263986 +
caacaacaaaaaagtccaggacca

SEQ ID NO: 64648 - DNA, 24 bp, Artificial Sequence
  Synthetic oligonucleotide; ATGTGATT chr11 5264321 5264344 5264341 +
taaagagaattggaaacaaaaatc

SEQ ID NO: 64649 - DNA, 24 bp, Artificial Sequence
  Synthetic oligonucleotide; ATATGATT chr11 5264646 5264669 5264666 +
tcaaactgtcactgtttgctgatg

SEQ ID NO: 64650 - DNA, 24 bp, Artificial Sequence
  Synthetic oligonucleotide; AAAGGATT chr11 5265521 5265544 5265541 +
aacccttctacacattggcttagg

SEQ ID NO: 64651 - DNA, 24 bp, Artificial Sequence
  Synthetic oligonucleotide; AATAGATT chr11 5265719 5265742 5265739 +
tatccaggctctaaaatgaacaca

SEQ ID NO: 64652 - DNA, 24 bp, Artificial Sequence
  Synthetic oligonucleotide; TGAAGATT chr11 5266023 5266046 5266043 +
gtacaaccattatggaaaacagta

SEQ ID NO: 64653 - DNA, 24 bp, Artificial Sequence
  Synthetic oligonucleotide; AACGGATT chr11 5266203 5266226 5266223 +
aacctaagtgtctatcaacagatg

SEQ ID NO: 64654 - DNA, 24 bp, Artificial Sequence
  Synthetic oligonucleotide; AGGGGATT chr11 5266501 5266524 5266521 +
ggaaaaagtgtgagtgtgtatggg

SEQ ID NO: 64655 - DNA, 24 bp, Artificial Sequence
  Synthetic oligonucleotide; GAAGGATT chr11 5266548 5266571 5266568 +
aataggtacaaacacagttggata

SEQ ID NO: 64656 - DNA, 24 bp, Artificial Sequence
  Synthetic oligonucleotide; TGAGGATT chr11 5266633 5266656 5266653 +
tatatatttcaaaatggctagaaa

SEQ ID NO: 64657 - DNA, 24 bp, Artificial Sequence
  Synthetic oligonucleotide; AGCAGATT chr11 5267431 5267454 5267451 +
acttgaatccattttgtgcacata

SEQ ID NO: 64658 - DNA, 24 bp, Artificial Sequence
  Synthetic oligonucleotide; TAAAGATT chr11 5268127 5268150 5268147 +
taattaaccattttcccaccccga

SEQ ID NO: 64659 - DNA, 24 bp, Artificial Sequence
  Synthetic oligonucleotide; TTTTGATT chr11 5268322 5268345 5268342 +
agatggagaagataaaattgcaat

SEQ ID NO: 64660 - DNA, 24 bp, Artificial Sequence
  Synthetic oligonucleotide; GCAAGATT chr11 5269202 5269225 5269222 +
ctgggataaacacatcaagttctg

SEQ ID NO: 64661 - DNA, 24 bp, Artificial Sequence
  Synthetic oligonucleotide; CCATGATT chr11 5269326 5269349 5269346 +
tgctgttctaacatcaagctcgac

SEQ ID NO: 64662 - DNA, 24 bp, Artificial Sequence
  Synthetic oligonucleotide; ATAAGATT chr11 5269359 5269382 5269379 +
ctgagatctttgttggtctttcca

SEQ ID NO: 64663 - DNA, 24 bp, Artificial Sequence
  Synthetic oligonucleotide; TAGTGATT chr11 5269889 5269912 5269909 +
atgatgccaggcctgagagcttgc

SEQ ID NO: 64664 - DNA, 24 bp, Artificial Sequence
  Synthetic oligonucleotide; GGGTGATT chr11 5270524 5270547 5270544 +
ttaatcccaaagtacagtaccttg

SEQ ID NO: 64665 - DNA, 24 bp, Artificial Sequence
  Synthetic oligonucleotide; AAAAGATT chr11 5270551 5270574 5270571 +
tgattccctagagaggacagacag

SEQ ID NO: 64666 - DNA, 24 bp, Artificial Sequence
  Synthetic oligonucleotide; TTGGGATT chr11 5270887 5270910 5270907 +
acttggtagagctgaaactggaag

SEQ ID NO: 64667 - DNA, 24 bp, Artificial Sequence
  Synthetic oligonucleotide; TAATGATT chr11 5271046 5271069 5271066 +
atttaactatcaatgtgacagaag

SEQ ID NO: 64668 - DNA, 24 bp, Artificial Sequence
  Synthetic oligonucleotide; AAACGATT chr11 5271308 5271331 5271328 +
ctgcaaccttcgcctcctgggttc

SEQ ID NO: 64669 - DNA, 24 bp, Artificial Sequence
  Synthetic oligonucleotide; ACGGGATT chr11 5271396 5271419 5271416 +
ctaatttttttatttttagtagag

SEQ ID NO: 64670 - DNA, 24 bp, Artificial Sequence
  Synthetic oligonucleotide; TGGGGATT chr11 5271625 5271648 5271645 +
cctgtctcccaagtcaagtgcctt

SEQ ID NO: 64671 - DNA, 24 bp, Artificial Sequence
  Synthetic oligonucleotide; CCATGATT chr11 5271773 5271796 5271793 +
aagaatgtctcccttgcttttctc

SEQ ID NO: 64672 - DNA, 24 bp, Artificial Sequence
  Synthetic oligonucleotide; CTAGGATT chr11 5272120 5272143 5272140 +
tgcttctttatgaaagcattagat

SEQ ID NO: 64673 - DNA, 24 bp, Artificial Sequence
  Synthetic oligonucleotide; TACAGATT chr11 5272645 5272668 5272665 +
atttcagttacatgtaagtaaaaa

SEQ ID NO: 64674 - DNA, 24 bp, Artificial Sequence
  Synthetic oligonucleotide; CCCAGATT chr11 5272695 5272718 5272715 +
ccagccccctagtgttctgtggac

SEQ ID NO: 64675 - DNA, 24 bp, Artificial Sequence
  Synthetic oligonucleotide; CTTAGATT chr11 5273122 5273145 5273142 +
tcagagtatggacaccagtcttct

SEQ ID NO: 64676 - DNA, 24 bp, Artificial Sequence
  Synthetic oligonucleotide; AATGGATT chr11 5273476 5273499 5273496 +
tttatcatatgagataccatgaaa

SEQ ID NO: 64677 - DNA, 24 bp, Artificial Sequence
  Synthetic oligonucleotide; GAAAGATT chr11 5273556 5273579 5273576 +
gttatggccatccaggatagatca

SEQ ID NO: 64678 - DNA, 24 bp, Artificial Sequence
  Synthetic oligonucleotide; TGAAGATT chr11 5273697 5273720 5273717 +
ttagaaagaaacacccaaattcga

SEQ ID NO: 64679 - DNA, 24 bp, Artificial Sequence
  Synthetic oligonucleotide; GCAGGATT chr11 5273757 5273780 5273777 +
catttgtaatttcttaagttctat

SEQ ID NO: 64680 - DNA, 24 bp, Artificial Sequence
  Synthetic oligonucleotide; ATTAGATT chr11 5273909 5273932 5273929 +
ctattagtatgaaaaattatataa

SEQ ID NO: 64681 - DNA, 24 bp, Artificial Sequence
  Synthetic oligonucleotide; TTAGGATT chr11 5274087 5274110 5274107 +
aaccactgataggaaaagagctgc

SEQ ID NO: 64682 - DNA, 24 bp, Artificial Sequence
  Synthetic oligonucleotide; GCCAGATT chr11 5274103 5274126 5274123 +
agagctgcttaggattctaaatta

SEQ ID NO: 64683 - DNA, 24 bp, Artificial Sequence
  Synthetic oligonucleotide; AAATGATT chr11 5274175 5274198 5274195 +
ctcagaacaaaaatagatgtaagc

SEQ ID NO: 64684 - DNA, 24 bp, Artificial Sequence
  Synthetic oligonucleotide; ACTAGATT chr11 5274185 5274208 5274205 +
aaatagatgtaagcaaatgattct

SEQ ID NO: 64685 - DNA, 24 bp, Artificial Sequence
  Synthetic oligonucleotide; GTTAGATT chr11 5274197 5274220 5274217 +
gcaaatgattctactagattttgt

SEQ ID NO: 64686 - DNA, 24 bp, Artificial Sequence
  Synthetic oligonucleotide; TAGTGATT chr11 5274476 5274499 5274496 +
tcaggtattacgcttagcatccat

SEQ ID NO: 64687 - DNA, 24 bp, Artificial Sequence
  Synthetic oligonucleotide; TCATGATT chr11 5274992 5275015 5275012 +
aagtaaagatgccttcatttattt

SEQ ID NO: 64688 - DNA, 24 bp, Artificial Sequence
  Synthetic oligonucleotide; CTCTGATT chr11 5275193 5275216 5275213 +
ttatgtctagaaattttgaaaaac

SEQ ID NO: 64689 - DNA, 24 bp, Artificial Sequence
  Synthetic oligonucleotide; CTAAGATT chr11 5275206 5275229 5275226 +
ttttgaaaaacctctgattatatg

SEQ ID NO: 64690 - DNA, 24 bp, Artificial Sequence
  Synthetic oligonucleotide; CTTTGATT chr11 5275329 5275352 5275349 +
tgcctatgcatgctatcttcagta

SEQ ID NO: 64691 - DNA, 24 bp, Artificial Sequence
  Synthetic oligonucleotide; TGAGGATT chr11 5275410 5275433 5275430 +
tatttctctggagaaggttaaaac

SEQ ID NO: 64692 - DNA, 24 bp, Artificial Sequence
  Synthetic oligonucleotide; GAATGATT chr11 5275550 5275573 5275570 +
tgtgtcactaagggtgaggatgct

SEQ ID NO: 64693 - DNA, 24 bp, Artificial Sequence
  Synthetic oligonucleotide; GCATGATT chr11 5276094 5276117 5276114 +
tataggttagtgtttgagagtcct

SEQ ID NO: 64694 - DNA, 24 bp, Artificial Sequence
  Synthetic oligonucleotide; ATGTGATT chr11 5276210 5276233 5276230 +
tgtgtgtgtgttgtgtttacaaat

SEQ ID NO: 64695 - DNA, 24 bp, Artificial Sequence
  Synthetic oligonucleotide; TAGAGATT chr11 5276620 5276643 5276640 +
attgaatagaagtatgcttatcat

SEQ ID NO: 64696 - DNA, 24 bp, Artificial Sequence
  Synthetic oligonucleotide; CACTGATT chr11 5277093 5277116 5277113 +
ggcttagcacttccagctctactc

SEQ ID NO: 64697 - DNA, 24 bp, Artificial Sequence
  Synthetic oligonucleotide; ATGAGATT chr11 5277313 5277336 5277333 +
gcaaatgaaacatgttatatacca

SEQ ID NO: 64698 - DNA, 24 bp, Artificial Sequence
  Synthetic oligonucleotide; GTGTGATT chr11 5277363 5277386 5277383 +
aaaaaaactgaaatgaaggccaga

SEQ ID NO: 64699 - DNA, 24 bp, Artificial Sequence
  Synthetic oligonucleotide; CTATGATT chr11 5277484 5277507 5277504 +
gatgaggaacccatttatatgaaa

SEQ ID NO: 64700 - DNA, 24 bp, Artificial Sequence
  Synthetic oligonucleotide; ATGAGATT chr11 5277585 5277608 5277605 +
gaatatcaataaggccaatgtagg

SEQ ID NO: 64701 - DNA, 24 bp, Artificial Sequence
  Synthetic oligonucleotide; TAAGGATT chr11 5277796 5277819 5277816 +
atgaacaactattgtagagaattg

SEQ ID NO: 64702 - DNA, 24 bp, Artificial Sequence
  Synthetic oligonucleotide; GGAAGATT chr11 5277940 5277963 5277960 +
tgtagtggggcagtggtagaagca

SEQ ID NO: 64703 - DNA, 24 bp, Artificial Sequence
  Synthetic oligonucleotide; ACAGGATT chr11 5278064 5278087 5278084 +
aaaacatcctttcacgaaaaacca

SEQ ID NO: 64704 - DNA, 24 bp, Artificial Sequence
  Synthetic oligonucleotide; TAAGGATT chr11 5278165 5278188 5278185 +
tctggctgtgagtatatgtcagag

SEQ ID NO: 64705 - DNA, 24 bp, Artificial Sequence
  Synthetic oligonucleotide; AAGCGATT chr11 5278603 5278626 5278623 +
gtgcaaactccacctccccggttc

SEQ ID NO: 64706 - DNA, 24 bp, Artificial Sequence
  Synthetic oligonucleotide; GTTGGATT chr11 5278634 5278657 5278654 +
tctcctgcctcagcctcccaagta

SEQ ID NO: 64707 - DNA, 24 bp, Artificial Sequence
  Synthetic oligonucleotide; CTGTGATT chr11 5278770 5278793 5278790 +
tgcccaccttggcgtcccaaactg

SEQ ID NO: 64708 - DNA, 24 bp, Artificial Sequence
  Synthetic oligonucleotide; TAAGGATT chr11 5279144 5279167 5279164 +
atgaatagcccctttgtcaaaaat

SEQ ID NO: 64709 - DNA, 24 bp, Artificial Sequence
  Synthetic oligonucleotide; TTGTGATT chr11 5279373 5279396 5279393 +
cccactgttttttttctaattaat

SEQ ID NO: 64710 - DNA, 24 bp, Artificial Sequence
  Synthetic oligonucleotide; GGTTGATT chr11 5279467 5279490 5279487 +
tgttatctgtataaatactcttca

SEQ ID NO: 64711 - DNA, 24 bp, Artificial Sequence
  Synthetic oligonucleotide; GCCTGATT chr11 5280381 5280404 5280401 +
aatctatacacatgtattaataaa

SEQ ID NO: 64712 - DNA, 24 bp, Artificial Sequence
  Synthetic oligonucleotide; ATTTGATT chr11 5280428 5280451 5280448 +
atagaggccacctgcaagataaat

SEQ ID NO: 64713 - DNA, 24 bp, Artificial Sequence
  Synthetic oligonucleotide; CTGGGATT chr11 5281220 5281243 5281240 +
ctcctgcctcagccaccctaatag

SEQ ID NO: 64714 - DNA, 24 bp, Artificial Sequence
  Synthetic oligonucleotide; CTGGGATT chr11 5281356 5281379 5281376 +
cacccacctcagcctcccaaagtg

SEQ ID NO: 64715 - DNA, 24 bp, Artificial Sequence
  Synthetic oligonucleotide; CCCAGATT chr11 5281383 5281406 5281403 +
ggattacaggtgtgagacaccatg

SEQ ID NO: 64716 - DNA, 24 bp, Artificial Sequence
  Synthetic oligonucleotide; TGTGGATT chr11 5281445 5281468 5281465 +
gggggaaaagaatgtttctctcac

SEQ ID NO: 64717 - DNA, 24 bp, Artificial Sequence
  Synthetic oligonucleotide; TCAAGATT chr11 5281474 5281497 5281494 +
attattttagagagtggagaatgg

SEQ ID NO: 64718 - DNA, 24 bp, Artificial Sequence
  Synthetic oligonucleotide; GAGAGATT chr11 5281842 5281865 5281862 +
cactttaggcagccatgttgccat

SEQ ID NO: 64719 - DNA, 24 bp, Artificial Sequence
  Synthetic oligonucleotide; ATGAGATT chr11 5281974 5281997 5281994 +
gtattagctaatagaattatgagg

SEQ ID NO: 64720 - DNA, 24 bp, Artificial Sequence
  Synthetic oligonucleotide; AGCAGATT chr11 5282146 5282169 5282166 +
tatttcttgactgttaatgttggc

SEQ ID NO: 64721 - DNA, 24 bp, Artificial Sequence
  Synthetic oligonucleotide; AAATGATT chr11 5282505 5282528 5282525 +
atgagaaagacaatgtgaagcccc

SEQ ID NO: 64722 - DNA, 24 bp, Artificial Sequence
  Synthetic oligonucleotide; CTTTGATT chr11 5283265 5283288 5283285 +
aagcttggacaaattatttcatgt

SEQ ID NO: 64723 - DNA, 24 bp, Artificial Sequence
  Synthetic oligonucleotide; AAGTGATT chr11 5283583 5283606 5283603 +
ctgcaacctccacctcctgggttc

SEQ ID NO: 64724 - DNA, 24 bp, Artificial Sequence
  Synthetic oligonucleotide; CTGGGATT chr11 5283615 5283638 5283635 +
ctcctgcctcagcctcctgagtag

SEQ ID NO: 64725 - DNA, 24 bp, Artificial Sequence
  Synthetic oligonucleotide; GGCTGATT chr11 5283645 5283668 5283665 +
ttatagacgcgtgccaccacacct

SEQ ID NO: 64726 - DNA, 24 bp, Artificial Sequence
  Synthetic oligonucleotide; CTGGGATT chr11 5283752 5283775 5283772 +
caattgccttggcctcccaaagtg

SEQ ID NO: 64727 - DNA, 24 bp, Artificial Sequence
  Synthetic oligonucleotide; ATTTGATT chr11 5283817 5283840 5283837 +
cccggcctcatatgataaacttaa

SEQ ID NO: 64728 - DNA, 24 bp, Artificial Sequence
  Synthetic oligonucleotide; ATGAGATT chr11 5283919 5283942 5283939 +
tatctcacagaattaccatatgta

SEQ ID NO: 64729 - DNA, 24 bp, Artificial Sequence
  Synthetic oligonucleotide; GAAAGATT chr11 5283959 5283982 5283979 +
tcataaaatggcacctgacatata

SEQ ID NO: 64730 - DNA, 24 bp, Artificial Sequence
  Synthetic oligonucleotide; TGCAGATT chr11 5284087 5284110 5284107 +
atcttgtttccctctcaactcctg

SEQ ID NO: 64731 - DNA, 24 bp, Artificial Sequence
  Synthetic oligonucleotide; GTCAGATT chr11 5284145 5284168 5284165 +
ttgggcttccatgtttccagtgaa

SEQ ID NO: 64732 - DNA, 24 bp, Artificial Sequence
  Synthetic oligonucleotide; GAATGATT chr11 5284980 5285003 5285000 +
tcatggctgtctcctttatccaca

SEQ ID NO: 64733 - DNA, 24 bp, Artificial Sequence
  Synthetic oligonucleotide; AATTGATT chr11 5285207 5285230 5285227 +
cgtgaggatggaaaacaatagcaa

SEQ ID NO: 64734 - DNA, 24 bp, Artificial Sequence
  Synthetic oligonucleotide; AGTAGATT chr11 5285242 5285265 5285262 +
ctataaaaggtctcaacaaatagt

SEQ ID NO: 64735 - DNA, 24 bp, Artificial Sequence
  Synthetic oligonucleotide; TAGTGATT chr11 5285359 5285382 5285379 +
attcctcttattatattcttctta

SEQ ID NO: 64736 - DNA, 24 bp, Artificial Sequence
  Synthetic oligonucleotide; AGGAGATT chr11 5285655 5285678 5285675 +
agaaaccatttccagatagaagtg

SEQ ID NO: 64737 - DNA, 24 bp, Artificial Sequence
  Synthetic oligonucleotide; TTCTGATT chr11 5285782 5285805 5285802 +
ttccctactcttatccaatggggc

SEQ ID NO: 64738 - DNA, 24 bp, Artificial Sequence
  Synthetic oligonucleotide; CCCAGATT chr11 5285811 5285834 5285831 +
attttaagccagtcttcacaaagc

SEQ ID NO: 64739 - DNA, 24 bp, Artificial Sequence
  Synthetic oligonucleotide; ATCTGATT chr11 5285927 5285950 5285947 +
tttgtctcaacatttctgttgata

SEQ ID NO: 64740 - DNA, 24 bp, Artificial Sequence
  Synthetic oligonucleotide; TAGGGATT chr11 5286107 5286130 5286127 +
tttgctcagggtagaaatccccta

SEQ ID NO: 64741 - DNA, 24 bp, Artificial Sequence
  Synthetic oligonucleotide; CACAGATT chr11 5286157 5286180 5286177 +
aagctttctatatggtgaggagct

SEQ ID NO: 64742 - DNA, 24 bp, Artificial Sequence
  Synthetic oligonucleotide; ACTTGATT chr11 5286253 5286276 5286273 +
tctaatcctgggttacataatata

SEQ ID NO: 64743 - DNA, 24 bp, Artificial Sequence
  Synthetic oligonucleotide; ATATGATT chr11 5286881 5286904 5286901 +
cctgaaagaatccaagagtattaa

SEQ ID NO: 64744 - DNA, 24 bp, Artificial Sequence
  Synthetic oligonucleotide; GAATGATT chr11 5287009 5287032 5287029 +
aacactagttttcacctgcagcaa

SEQ ID NO: 64745 - DNA, 24 bp, Artificial Sequence
  Synthetic oligonucleotide; GGCAGATT chr11 5287188 5287211 5287208 +
ccagcactttggaaggctgaggtg

SEQ ID NO: 64746 - DNA, 24 bp, Artificial Sequence
  Synthetic oligonucleotide; CCGAGATT chr11 5287363 5287386 5287383 +
ctgggaagtgcaagttgcagtgag

SEQ ID NO: 64747 - DNA, 24 bp, Artificial Sequence
  Synthetic oligonucleotide; CTTGGATT chr11 5287971 5287994 5287991 +
cagtatgacatggaaatgatcagg

SEQ ID NO: 64748 - DNA, 24 bp, Artificial Sequence
  Synthetic oligonucleotide; GGGAGATT chr11 5289392 5289415 5289412 +
aaatgggtgactgtagggttgaga

SEQ ID NO: 64749 - DNA, 24 bp, Artificial Sequence
  Synthetic oligonucleotide; TTAAGATT chr11 5289687 5289710 5289707 +
aagaaatgagacccttgtttacct

SEQ ID NO: 64750 - DNA, 24 bp, Artificial Sequence
  Synthetic oligonucleotide; AGGAGATT chr11 5289852 5289875 5289872 +
tgggatctcagatgtagggaaaag

SEQ ID NO: 64751 - DNA, 24 bp, Artificial Sequence
  Synthetic oligonucleotide; AATTGATT chr11 5289987 5290010 5290007 +
tttgacatcagaatataacctagg

SEQ ID NO: 64752 - DNA, 24 bp, Artificial Sequence
  Synthetic oligonucleotide; TATGGATT chr11 5290193 5290216 5290213 +
tgtaagtgctcagggctgtgtgtg

SEQ ID NO: 64753 - DNA, 24 bp, Artificial Sequence
  Synthetic oligonucleotide; GGCTGATT chr11 5290303 5290326 5290323 +
cttagctgcttagcttaattgtga

SEQ ID NO: 64754 - DNA, 24 bp, Artificial Sequence
  Synthetic oligonucleotide; AAAGGATT chr11 5291713 5291736 5291733 +
tacagatattttccacaaagagta

SEQ ID NO: 64755 - DNA, 24 bp, Artificial Sequence
  Synthetic oligonucleotide; AAATGATT chr11 5291939 5291962 5291959 +
aaaggaaaggcaagtcatattaac

SEQ ID NO: 64756 - DNA, 24 bp, Artificial Sequence
  Synthetic oligonucleotide; AGAAGATT chr11 5292048 5292071 5292068 +
gttaaaggacatggccatcagtac

SEQ ID NO: 64757 - DNA, 24 bp, Artificial Sequence
  Synthetic oligonucleotide; AATAGATT chr11 5292635 5292658 5292655 +
atgtcatatgtgtcaggatgcagt

SEQ ID NO: 64758 - DNA, 24 bp, Artificial Sequence
  Synthetic oligonucleotide; GAATGATT chr11 5292654 5292677 5292674 +
gcagtaatagatttagaaaacatt

SEQ ID NO: 64759 - DNA, 24 bp, Artificial Sequence
  Synthetic oligonucleotide; TTCAGATT chr11 5292765 5292788 5292785 +
ttgatcacttttggaggtcaggaa

SEQ ID NO: 64760 - DNA, 24 bp, Artificial Sequence
  Synthetic oligonucleotide; AGTGGATT chr11 5292830 5292853 5292850 +
cattatagcagaatgtaggccttg

SEQ ID NO: 64761 - DNA, 24 bp, Artificial Sequence
  Synthetic oligonucleotide; CTGTGATT chr11 5293020 5293043 5293040 +
tgggccaggagtccaggtgccttc

SEQ ID NO: 64762 - DNA, 24 bp, Artificial Sequence
  Synthetic oligonucleotide; TATTGATT chr11 5293201 5293224 5293221 +
gctgttggaaattgttgagaagta

SEQ ID NO: 64763 - DNA, 24 bp, Artificial Sequence
  Synthetic oligonucleotide; GCAAGATT chr11 5293584 5293607 5293604 +
tgtagacccaaacagtgagcagca

SEQ ID NO: 64764 - DNA, 24 bp, Artificial Sequence
  Synthetic oligonucleotide; TGCTGATT chr11 5293707 5293730 5293727 +
tcttatctggccccacccacatcc

SEQ ID NO: 64765 - DNA, 24 bp, Artificial Sequence
  Synthetic oligonucleotide; CACTGATT chr11 5293745 5293768 5293765 +
gcccagtggtctgttttgacaggg

SEQ ID NO: 64766 - DNA, 24 bp, Artificial Sequence
  Synthetic oligonucleotide; ACCAGATT chr11 5293801 5293824 5293821 +
gacacaaaggttctccacgtcccc

SEQ ID NO: 64767 - DNA, 24 bp, Artificial Sequence
  Synthetic oligonucleotide; TGTTGATT chr11 5293873 5293896 5293893 +
ccaccagagtagctagatacagag

SEQ ID NO: 64768 - DNA, 24 bp, Artificial Sequence
  Synthetic oligonucleotide; TGCTGATT chr11 5293914 5293937 5293934 +
acaaaccctgagctagacacaggg

SEQ ID NO: 64769 - DNA, 24 bp, Artificial Sequence
  Synthetic oligonucleotide; TGTTGATT chr11 5294033 5294056 5294053 +
ccaccagagtagctagatacagag

SEQ ID NO: 64770 - DNA, 24 bp, Artificial Sequence
  Synthetic oligonucleotide; TGCTGATT chr11 5294074 5294097 5294094 +
acaaaccctgagctagacacaggg

SEQ ID NO: 64771 - DNA, 24 bp, Artificial Sequence
  Synthetic oligonucleotide; TGCCGATT chr11 5294115 5294138 5294135 +
acaaaccttgagctagatacagac

SEQ ID NO: 64772 - DNA, 24 bp, Artificial Sequence
  Synthetic oligonucleotide; TGTTGATT chr11 5294191 5294214 5294211 +
ccccaccagagtagctagatagag

SEQ ID NO: 64773 - DNA, 24 bp, Artificial Sequence
  Synthetic oligonucleotide; TGCTGATT chr11 5294232 5294255 5294252 +
acaaaccctgagctagacacaggg

SEQ ID NO: 64774 - DNA, 24 bp, Artificial Sequence
  Synthetic oligonucleotide; TAATGATT chr11 5295188 5295211 5295208 +
gtttcctcatgaattattattgta

SEQ ID NO: 64775 - DNA, 24 bp, Artificial Sequence
  Synthetic oligonucleotide; TGTAGATT chr11 5295466 5295489 5295486 +
tattacttttatactatcctagtg

SEQ ID NO: 64776 - DNA, 24 bp, Artificial Sequence
  Synthetic oligonucleotide; CAAGGATT chr11 5295553 5295576 5295573 +
aataaatagatgagatgacattgt

SEQ ID NO: 64777 - DNA, 24 bp, Artificial Sequence
  Synthetic oligonucleotide; ATGTGATT chr11 5295843 5295866 5295863 +
gtatttagaaggctttggagagga

SEQ ID NO: 64778 - DNA, 24 bp, Artificial Sequence
  Synthetic oligonucleotide; AAATGATT chr11 5296082 5296105 5296102 +
ttcctaactatttaaaatgctatg

SEQ ID NO: 64779 - DNA, 24 bp, Artificial Sequence
  Synthetic oligonucleotide; TGCAGATT chr11 5296091 5296114 5296111 +
atttaaaatgctatgaaatgattt

SEQ ID NO: 64780 - DNA, 24 bp, Artificial Sequence
  Synthetic oligonucleotide; AGCAGATT chr11 5296221 5296244 5296241 +
atctatctctttgtaacttaccac

SEQ ID NO: 64781 - DNA, 24 bp, Artificial Sequence
  Synthetic oligonucleotide; CAAGGATT chr11 5296363 5296386 5296383 +
gttttatctcttctcattttctat

SEQ ID NO: 64782 - DNA, 24 bp, Artificial Sequence
  Synthetic oligonucleotide; AATAGATT chr11 5296371 5296394 5296391 +
tcttctcattttctatcaaggatt

SEQ ID NO: 64783 - DNA, 24 bp, Artificial Sequence
  Synthetic oligonucleotide; GATAGATT chr11 5296483 5296506 5296503 +
agcaaatgcattttaacactccaa

SEQ ID NO: 64784 - DNA, 24 bp, Artificial Sequence
  Synthetic oligonucleotide; TTTAGATT chr11 5296489 5296512 5296509 +
tgcattttaacactccaagataga

SEQ ID NO: 64785 - DNA, 24 bp, Artificial Sequence
  Synthetic oligonucleotide; TACAGATT chr11 5296803 5296826 5296823 +
tacacagctgtttaaattaggaat

SEQ ID NO: 64786 - DNA, 24 bp, Artificial Sequence
  Synthetic oligonucleotide; TACAGATT chr11 5296834 5296857 5296854 +
ttcgccagataattgtatatctga

SEQ ID NO: 64787 - DNA, 24 bp, Artificial Sequence
  Synthetic oligonucleotide; TGTGGATT chr11 5297094 5297117 5297114 +
caatgcatgcagaaagaagcttaa

SEQ ID NO: 64788 - DNA, 24 bp, Artificial Sequence
  Synthetic oligonucleotide; AATTGATT chr11 5297541 5297564 5297561 +
aagacactagcaacttgaatacat

SEQ ID NO: 64789 - DNA, 24 bp, Artificial Sequence
  Synthetic oligonucleotide; AAGTGATT chr11 5297975 5297998 5297995 +
tataatataggcatgttaatatac

SEQ ID NO: 64790 - DNA, 24 bp, Artificial Sequence
  Synthetic oligonucleotide; GGAGGATT chr11 5298185 5298208 5298205 +
ccctatcattaggaggccagggtg

SEQ ID NO: 64791 - DNA, 24 bp, Artificial Sequence
  Synthetic oligonucleotide; GAAGGATT chr11 5298320 5298343 5298340 +
ctaggtactcaaaaagctgaggaa

SEQ ID NO: 64792 - DNA, 24 bp, Artificial Sequence
  Synthetic oligonucleotide; CCAGGATT chr11 5298336 5298359 5298356 +
ctgaggaagaaggattgcttgagc

SEQ ID NO: 64793 - DNA, 24 bp, Artificial Sequence
  Synthetic oligonucleotide; CACTGATT chr11 5298765 5298788 5298785 +
ggaagctgcacttgtttgaaagga

SEQ ID NO: 64794 - DNA, 24 bp, Artificial Sequence
  Synthetic oligonucleotide; AAAGGATT chr11 5298843 5298866 5298863 +
aggtggatgctgacttaataattg

SEQ ID NO: 64795 - DNA, 24 bp, Artificial Sequence
  Synthetic oligonucleotide; GAGTGATT chr11 5298939 5298962 5298959 +
aaatatacatttacttaagaaaat

SEQ ID NO: 64796 - DNA, 24 bp, Artificial Sequence
  Synthetic oligonucleotide; AATTGATT chr11 5298966 5298989 5298986 +
tgatttttaaaatttatccttttt

SEQ ID NO: 64797 - DNA, 24 bp, Artificial Sequence
  Synthetic oligonucleotide; GAAAGATT chr11 5299736 5299759 5299756 +
actgtccagatgtaaaataaatat

SEQ ID NO: 64798 - DNA, 24 bp, Artificial Sequence
  Synthetic oligonucleotide; TTGAGATT chr11 5299899 5299922 5299919 +
ttcagagaggaatgaatgcaactt

SEQ ID NO: 64799 - DNA, 24 bp, Artificial Sequence
  Synthetic oligonucleotide; AGAAGATT chr11 5300051 5300074 5300071 +
cataaagacttacaaacactttga

SEQ ID NO: 64800 - DNA, 24 bp, Artificial Sequence
  Synthetic oligonucleotide; TCGAGATT chr11 5300163 5300186 5300183 +
actatttcatgaagtgaaaaagtc

SEQ ID NO: 64801 - DNA, 24 bp, Artificial Sequence
  Synthetic oligonucleotide; TTTGGATT chr11 5300716 5300739 5300736 +
ttctgaaatcatagttactcttct

SEQ ID NO: 64802 - DNA, 24 bp, Artificial Sequence
  Synthetic oligonucleotide; TTGAGATT chr11 5300969 5300992 5300989 +
agaggcccagaaatcctagagatc

SEQ ID NO: 64803 - DNA, 24 bp, Artificial Sequence
  Synthetic oligonucleotide; ATAGGATT chr11 5301063 5301086 5301083 +
tgcttggtcttgatgctataaatg

SEQ ID NO: 64804 - DNA, 24 bp, Artificial Sequence
  Synthetic oligonucleotide; GAGAGATT chr11 5301218 5301241 5301238 +
gctaatatgggagacacaagtgtt

SEQ ID NO: 64805 - DNA, 24 bp, Artificial Sequence
  Synthetic oligonucleotide; TGAGGATT chr11 5301265 5301288 5301285 +
cagacgcaatgcccatcactgtct

SEQ ID NO: 64806 - DNA, 24 bp, Artificial Sequence
  Synthetic oligonucleotide; TGATGATT chr11 5301289 5301312 5301309 +
tgaggattagtatataagaaaaga

SEQ ID NO: 64807 - DNA, 24 bp, Artificial Sequence
  Synthetic oligonucleotide; ATGTGATT chr11 5301342 5301365 5301362 +
aaagaagtctgaataattggatat

SEQ ID NO: 64808 - DNA, 24 bp, Artificial Sequence
  Synthetic oligonucleotide; ACCTGATT chr11 5301593 5301616 5301613 +
gtcataggccaaaacaagcaagat

SEQ ID NO: 64809 - DNA, 24 bp, Artificial Sequence
  Synthetic oligonucleotide; GAAGGATT chr11 5301623 5301646 5301643 +
ttctacaatggccagtgaatgaat

SEQ ID NO: 64810 - DNA, 24 bp, Artificial Sequence
  Synthetic oligonucleotide; TCTGGATT chr11 5302054 5302077 5302074 +
tttacctcaaaacttaaatatttt

SEQ ID NO: 64811 - DNA, 24 bp, Artificial Sequence
  Synthetic oligonucleotide; TTAGGATT chr11 5302373 5302396 5302393 +
ttgaaactaatgggacagctgtat

SEQ ID NO: 64812 - DNA, 24 bp, Artificial Sequence
  Synthetic oligonucleotide; CTATGATT chr11 5302590 5302613 5302610 +
ccaggactgtgaggctgcagggag

SEQ ID NO: 64813 - DNA, 24 bp, Artificial Sequence
  Synthetic oligonucleotide; CATAGATT chr11 5302937 5302960 5302957 +
caaaagcctaatacttgttagagt

SEQ ID NO: 64814 - DNA, 24 bp, Artificial Sequence
  Synthetic oligonucleotide; TCAAGATT chr11 5303217 5303240 5303237 +
atttataattacacttttacaaag

SEQ ID NO: 64815 - DNA, 24 bp, Artificial Sequence
  Synthetic oligonucleotide; AATTGATT chr11 5303313 5303336 5303333 +
ggaaactcagtttctcccaaattc

SEQ ID NO: 64816 - DNA, 24 bp, Artificial Sequence
  Synthetic oligonucleotide; AATGGATT chr11 5303787 5303810 5303807 +
ccttccaatgttgccttataagag

SEQ ID NO: 64817 - DNA, 24 bp, Artificial Sequence
  Synthetic oligonucleotide; GCCTGATT chr11 5303888 5303911 5303908 +
accagatggaggaagccggaggag

SEQ ID NO: 64818 - DNA, 24 bp, Artificial Sequence
  Synthetic oligonucleotide; GACTGATT chr11 5304312 5304335 5304332 +
cttgcccctttctgagtgcctttg

SEQ ID NO: 64819 - DNA, 24 bp, Artificial Sequence
  Synthetic oligonucleotide; CCAAGATT chr11 5304986 5305009 5305006 +
gggagcagaggtcgtcgcagtgag

SEQ ID NO: 64820 - DNA, 24 bp, Artificial Sequence
  Synthetic oligonucleotide; TGTTGATT chr11 5305276 5305299 5305296 +
tatcaattaatataaacatagagg

SEQ ID NO: 64821 - DNA, 24 bp, Artificial Sequence
  Synthetic oligonucleotide; TGATGATT chr11 5306393 5306416 5306413 +
agccaccaccaaaccttttcgtct

SEQ ID NO: 64822 - DNA, 24 bp, Artificial Sequence
  Synthetic oligonucleotide; TATTGATT chr11 5306428 5306451 5306448 +
catcagacatttatttattctttc

SEQ ID NO: 64823 - DNA, 24 bp, Artificial Sequence
  Synthetic oligonucleotide; TCCTGATT chr11 5306814 5306837 5306834 +
tgtttatcatgtaattattcctaa

SEQ ID NO: 64824 - DNA, 24 bp, Artificial Sequence
  Synthetic oligonucleotide; ATTGGATT chr11 5306903 5306926 5306923 +
tcccattctgaaatctcttttttc

SEQ ID NO: 64825 - DNA, 24 bp, Artificial Sequence
  Synthetic oligonucleotide; TTCAGATT chr11 5307002 5307025 5307022 +
ctcaaaacatgtcaaattcagtct

SEQ ID NO: 64826 - DNA, 24 bp, Artificial Sequence
  Synthetic oligonucleotide; GTAAGATT chr11 5307132 5307155 5307152 +
ctaaatatcctctcatatattcag

SEQ ID NO: 64827 - DNA, 24 bp, Artificial Sequence
  Synthetic oligonucleotide; ACGTGATT chr11 5307148 5307171 5307168 +
atattcaggtaagattttgccaaa

SEQ ID NO: 64828 - DNA, 24 bp, Artificial Sequence
  Synthetic oligonucleotide; TGTTGATT chr11 5307204 5307227 5307224 +
ttccagaattcattttgcagaacc

SEQ ID NO: 64829 - DNA, 24 bp, Artificial Sequence
  Synthetic oligonucleotide; GAAAGATT chr11 5307300 5307323 5307320 +
tactcacagtaaaacaaaacttct

SEQ ID NO: 64830 - DNA, 24 bp, Artificial Sequence
  Synthetic oligonucleotide; ATAAGATT chr11 5307462 5307485 5307482 +
ttacaacctctacatctgtttgta

SEQ ID NO: 64831 - DNA, 24 bp, Artificial Sequence
  Synthetic oligonucleotide; GAAAGATT chr11 5307586 5307609 5307606 +
aaaaatccataacaacatcaagaa

SEQ ID NO: 64832 - DNA, 24 bp, Artificial Sequence
  Synthetic oligonucleotide; AAGTGATT chr11 5307873 5307896 5307893 +
ctgcagcctcaagcttttaggctt

SEQ ID NO: 64833 - DNA, 24 bp, Artificial Sequence
  Synthetic oligonucleotide; TGGAGATT chr11 5308369 5308392 5308389 +
aggtatgcagtaaaacttgttttc

SEQ ID NO: 64834 - DNA, 24 bp, Artificial Sequence
  Synthetic oligonucleotide; GTAAGATT chr11 5308533 5308556 5308553 +
aattgcactttgggcccctgctga

SEQ ID NO: 64835 - DNA, 24 bp, Artificial Sequence
  Synthetic oligonucleotide; GAGAGATT chr11 5308757 5308780 5308777 +
gtgtccctctcttatacctcgtca

SEQ ID NO: 64836 - DNA, 24 bp, Artificial Sequence
  Synthetic oligonucleotide; GATAGATT chr11 5308834 5308857 5308854 +
tcagtgatgctggtcatcactgaa

SEQ ID NO: 64837 - DNA, 24 bp, Artificial Sequence
  Synthetic oligonucleotide; ACCAGATT chr11 5309285 5309308 5309305 +
aaacagaggagtctttgggggata

SEQ ID NO: 64838 - DNA, 24 bp, Artificial Sequence
  Synthetic oligonucleotide; TTAAGATT chr11 5309293 5309316 5309313 +
gagtctttgggggataaccagatt

SEQ ID NO: 64839 - DNA, 24 bp, Artificial Sequence
  Synthetic oligonucleotide; AATTGATT chr11 5309393 5309416 5309413 +
cattgggtaaataatcggttttac

SEQ ID NO: 64840 - DNA, 24 bp, Artificial Sequence
  Synthetic oligonucleotide; CATAGATT chr11 5309470 5309493 5309490 +
ctacacctatttttttaagcattc

SEQ ID NO: 64841 - DNA, 24 bp, Artificial Sequence
  Synthetic oligonucleotide; CAAAGATT chr11 5309864 5309887 5309884 +
aactttactcagtgaagtccagag

SEQ ID NO: 64842 - DNA, 24 bp, Artificial Sequence
  Synthetic oligonucleotide; GAAGGATT chr11 5309954 5309977 5309974 +
ggatgccacatatttttaggtctg

SEQ ID NO: 64843 - DNA, 24 bp, Artificial Sequence
  Synthetic oligonucleotide; GTCTGATT chr11 5310429 5310452 5310449 +
ataagtcatacgcaaaagaacatt

SEQ ID NO: 64844 - DNA, 24 bp, Artificial Sequence
  Synthetic oligonucleotide; AGTAGATT chr11 5310483 5310506 5310503 +
ataggcaaattcatagagacaaaa

SEQ ID NO: 64845 - DNA, 24 bp, Artificial Sequence
  Synthetic oligonucleotide; CATGGATT chr11 5310516 5310539 5310536 +
gaagttaccagagtgtaggaagaa

SEQ ID NO: 64846 - DNA, 24 bp, Artificial Sequence
  Synthetic oligonucleotide; AACTGATT chr11 5310531 5310554 5310551 +
taggaagaacatggattggggagt

SEQ ID NO: 64847 - DNA, 24 bp, Artificial Sequence
  Synthetic oligonucleotide; TGGTGATT chr11 5310590 5310613 5310610 +
aatacaaaattttagaaatagtgg

SEQ ID NO: 64848 - DNA, 24 bp, Artificial Sequence
  Synthetic oligonucleotide; AAAAGATT chr11 5310781 5310804 5310801 +
aaattatgtctaagataaaatatt

SEQ ID NO: 64849 - DNA, 24 bp, Artificial Sequence
  Synthetic oligonucleotide; ATTTGATT chr11 5310881 5310904 5310901 +
tctcttatatcttaaagaccattt

SEQ ID NO: 64850 - DNA, 24 bp, Artificial Sequence
  Synthetic oligonucleotide; CATAGATT chr11 5310946 5310969 5310966 +
tttcacttgagagaaagaatcaag

SEQ ID NO: 64851 - DNA, 24 bp, Artificial Sequence
  Synthetic oligonucleotide; CTATGATT chr11 5310986 5311009 5311006 +
ttccatatggtcctcctcaaatat

SEQ ID NO: 64852 - DNA, 24 bp, Artificial Sequence
  Synthetic oligonucleotide; ATCAGATT chr11 5311135 5311158 5311155 +
atccatcttcctatttatgtttgt

SEQ ID NO: 64853 - DNA, 24 bp, Artificial Sequence
  Synthetic oligonucleotide; AAATGATT chr11 5311444 5311467 5311464 +
tcaggcaaaaagaaatacatactg

SEQ ID NO: 64854 - DNA, 24 bp, Artificial Sequence
  Synthetic oligonucleotide; GAATGATT chr11 5311457 5311480 5311477 +
aatacatactgaaatgatttgaat

SEQ ID NO: 64855 - DNA, 24 bp, Artificial Sequence
  Synthetic oligonucleotide; TAATGATT chr11 5311599 5311622 5311619 +
agtgtcccacaactttaaaaatta

SEQ ID NO: 64856 - DNA, 24 bp, Artificial Sequence
  Synthetic oligonucleotide; TGGTGATT chr11 5311689 5311712 5311709 +
ttccaagaacatgtcagaaattga

SEQ ID NO: 64857 - DNA, 24 bp, Artificial Sequence
  Synthetic oligonucleotide; TTATGATT chr11 5312261 5312284 5312281 +
tccattcagtgtcttctttctgct

SEQ ID NO: 64858 - DNA, 24 bp, Artificial Sequence
  Synthetic oligonucleotide; TTTGGATT chr11 5312290 5312313 5312310 +
attaatcacagcacttgttttaaa

SEQ ID NO: 64859 - DNA, 24 bp, Artificial Sequence
  Synthetic oligonucleotide; GAATGATT chr11 5312424 5312447 5312444 +
gtgcccttaaaaaattaaccaaag

SEQ ID NO: 64860 - DNA, 24 bp, Artificial Sequence
  Synthetic oligonucleotide; GAATGATT chr11 5312470 5312493 5312490 +
tttccacgaaaataggcacatgag

SEQ ID NO: 64861 - DNA, 24 bp, Artificial Sequence
  Synthetic oligonucleotide; GTGAGATT chr11 5312801 5312824 5312821 +
aaatatatgatcaaataaatccta

SEQ ID NO: 64862 - DNA, 24 bp, Artificial Sequence
  Synthetic oligonucleotide; TTGTGATT chr11 5312838 5312861 5312858 +
gttgctgcaacaaattgagatcac

SEQ ID NO: 64863 - DNA, 24 bp, Artificial Sequence
  Synthetic oligonucleotide; ATCAGATT chr11 5312887 5312910 5312907 +
aattgaatatacaaaaaggaaaat

SEQ ID NO: 64864 - DNA, 24 bp, Artificial Sequence
  Synthetic oligonucleotide; AAAGGATT chr11 5313790 5313813 5313810 +
aatactatacagccataaaaagga

SEQ ID NO: 64865 - DNA, 24 bp, Artificial Sequence
  Synthetic oligonucleotide; TTGAGATT chr11 5314219 5314242 5314239 +
aatctaccctgaaatagagtagtt

SEQ ID NO: 64866 - DNA, 24 bp, Artificial Sequence
  Synthetic oligonucleotide; CCCTGATT chr11 5314407 5314430 5314427 +
acaggttatgaataaccatatttt

SEQ ID NO: 64867 - DNA, 24 bp, Artificial Sequence
  Synthetic oligonucleotide; AAGTGATT chr11 5315100 5315123 5315120 +
aaagcaaccagaatagctgggtat

SEQ ID NO: 64868 - DNA, 24 bp, Artificial Sequence
  Synthetic oligonucleotide; CCAAGATT chr11 5315267 5315290 5315287 +
aaatagccacagttctatcttcac

SEQ ID NO: 64869 - DNA, 24 bp, Artificial Sequence
  Synthetic oligonucleotide; ACCTGATT chr11 5315346 5315369 5315366 +
gtcataggccattgacaggagaat

SEQ ID NO: 64870 - DNA, 24 bp, Artificial Sequence
  Synthetic oligonucleotide; TTGTGATT chr11 5315419 5315442 5315439 +
aagcaggccccatggataacctct

SEQ ID NO: 64871 - DNA, 24 bp, Artificial Sequence
  Synthetic oligonucleotide; ACTTGATT chr11 5316090 5316113 5316110 +
aattgcatatttggatacatttaa

SEQ ID NO: 64872 - DNA, 24 bp, Artificial Sequence
  Synthetic oligonucleotide; AATAGATT chr11 5317235 5317258 5317255 +
catgcagtggtgagcatactatcc

SEQ ID NO: 64873 - DNA, 24 bp, Artificial Sequence
  Synthetic oligonucleotide; TTAGGATT chr11 5317394 5317417 5317414 +
ttttgtgttcttgcgttaatttgc

SEQ ID NO: 64874 - DNA, 24 bp, Artificial Sequence
  Synthetic oligonucleotide; ACATGATT chr11 5317436 5317459 5317456 +
gctccacccatgttgctgaaaagg

SEQ ID NO: 64875 - DNA, 24 bp, Artificial Sequence
  Synthetic oligonucleotide; GCGGGATT chr11 5317630 5317653 5317650 +
tttcctatggatatatacccagta

SEQ ID NO: 64876 - DNA, 24 bp, Artificial Sequence
  Synthetic oligonucleotide; TTTTGATT chr11 5317830 5317853 5317850 +
ggtatgagatagtatctcttgtgg

SEQ ID NO: 64877 - DNA, 24 bp, Artificial Sequence
  Synthetic oligonucleotide; CGTGGATT chr11 5317921 5317944 5317941 +
gtcttctcttgagaagagtctgtt

SEQ ID NO: 64878 - DNA, 24 bp, Artificial Sequence
  Synthetic oligonucleotide; TATAGATT chr11 5317986 5318009 5318006 +
gcttgctgatatgttcgaattcct

SEQ ID NO: 64879 - DNA, 24 bp, Artificial Sequence
  Synthetic oligonucleotide; TGTAGATT chr11 5318047 5318070 5318067 +
gtttgtgaatagtttctcctatcc

SEQ ID NO: 64880 - DNA, 24 bp, Artificial Sequence
  Synthetic oligonucleotide; GTAAGATT chr11 5318644 5318667 5318664 +
gccaaaaatgcactgccagtgcag

SEQ ID NO: 64881 - DNA, 24 bp, Artificial Sequence
  Synthetic oligonucleotide; AGTTGATT chr11 5318686 5318709 5318706 +
catttaagttttgaattcattttc

SEQ ID NO: 64882 - DNA, 24 bp, Artificial Sequence
  Synthetic oligonucleotide; CTGGGATT chr11 5319101 5319124 5319121 +
ctcctgcctcagccttccgagtag

SEQ ID NO: 64883 - DNA, 24 bp, Artificial Sequence
  Synthetic oligonucleotide; TTAAGATT chr11 5319317 5319340 5319337 +
tgcttccaattttgttctttctgc

SEQ ID NO: 64884 - DNA, 24 bp, Artificial Sequence
  Synthetic oligonucleotide; TATTGATT chr11 5319466 5319489 5319486 +
gagcagtatggccatttaaattca

SEQ ID NO: 64885 - DNA, 24 bp, Artificial Sequence
  Synthetic oligonucleotide; TTCTGATT chr11 5319522 5319545 5319542 +
cttttatttatttatttgtgttgt

SEQ ID NO: 64886 - DNA, 24 bp, Artificial Sequence
  Synthetic oligonucleotide; CAAGGATT chr11 5319780 5319803 5319800 +
ttctcctcgaaaactgcaacaaga

SEQ ID NO: 64887 - DNA, 24 bp, Artificial Sequence
  Synthetic oligonucleotide; TACAGATT chr11 5319935 5319958 5319955 +
tatgactctatacttagaaaatcc

SEQ ID NO: 64888 - DNA, 24 bp, Artificial Sequence
  Synthetic oligonucleotide; GCAAGATT chr11 5320421 5320444 5320441 +
tgtaaaatgtacattggtaatggg

SEQ ID NO: 64889 - DNA, 24 bp, Artificial Sequence
  Synthetic oligonucleotide; GAGAGATT chr11 5320814 5320837 5320834 +
agcattagaaaggcttgaatagaa

SEQ ID NO: 64890 - DNA, 24 bp, Artificial Sequence
  Synthetic oligonucleotide; GAGTGATT chr11 5320842 5320865 5320862 +
gattctatgacttagaatagaact

SEQ ID NO: 64891 - DNA, 24 bp, Artificial Sequence
  Synthetic oligonucleotide; AGTAGATT chr11 5320856 5320879 5320876 +
gaatagaactgagtgattgaaggt

SEQ ID NO: 64892 - DNA, 24 bp, Artificial Sequence
  Synthetic oligonucleotide; TATTGATT chr11 5320988 5321011 5321008 +
tttattcactaatcaacagttatt

SEQ ID NO: 64893 - DNA, 24 bp, Artificial Sequence
  Synthetic oligonucleotide; AGTGGATT chr11 5321442 5321465 5321462 +
aaagtctcaatgaaataaaatgct

SEQ ID NO: 64894 - DNA, 24 bp, Artificial Sequence
  Synthetic oligonucleotide; TTGTGATT chr11 5321892 5321915 5321912 +
atggggatataatatcgcagtaac

SEQ ID NO: 64895 - DNA, 24 bp, Artificial Sequence
  Synthetic oligonucleotide; ATGAGATT chr11 5322022 5322045 5322042 +
aaatcaagatgggaattatccgaa

SEQ ID NO: 64896 - DNA, 24 bp, Artificial Sequence
  Synthetic oligonucleotide; TTAGGATT chr11 5322113 5322136 5322133 +
aagtctttggtagataactgactt

SEQ ID NO: 64897 - DNA, 24 bp, Artificial Sequence
  Synthetic oligonucleotide; CTAAGATT chr11 5322622 5322645 5322642 +
agaagcttgtctaggtttttcctt

SEQ ID NO: 64898 - DNA, 24 bp, Artificial Sequence
  Synthetic oligonucleotide; TAGAGATT chr11 5323040 5323063 5323060 +
gcacactgaggcaaaagtttttca

SEQ ID NO: 64899 - DNA, 24 bp, Artificial Sequence
  Synthetic oligonucleotide; GTCTGATT chr11 5323313 5323336 5323333 +
ttctggcttcatttttatgtctgt

SEQ ID NO: 64900 - DNA, 24 bp, Artificial Sequence
  Synthetic oligonucleotide; GGAAGATT chr11 5323655 5323678 5323675 +
agaagaggatgatcagacagtcta

SEQ ID NO: 64901 - DNA, 24 bp, Artificial Sequence
  Synthetic oligonucleotide; TCATGATT chr11 5323724 5323747 5323744 +
aagttatgtcagcacaagccagtc

SEQ ID NO: 64902 - DNA, 24 bp, Artificial Sequence
  Synthetic oligonucleotide; ATGAGATT chr11 5323764 5323787 5323784 +
gaggcagaaagcacgtgtgataac

SEQ ID NO: 64903 - DNA, 24 bp, Artificial Sequence
  Synthetic oligonucleotide; AAAGGATT chr11 5323891 5323914 5323911 +
ttggtgagaatggaagcatatctc

SEQ ID NO: 64904 - DNA, 24 bp, Artificial Sequence
  Synthetic oligonucleotide; ACCTGATT chr11 5323941 5323964 5323961 +
atcatatgccattgccaggaggga

SEQ ID NO: 64905 - DNA, 24 bp, Artificial Sequence
  Synthetic oligonucleotide; CTGTGATT chr11 5324011 5324034 5324031 +
aagcagcccacactgctaatctcc

SEQ ID NO: 64906 - DNA, 24 bp, Artificial Sequence
  Synthetic oligonucleotide; ATCAGATT chr11 5324293 5324316 5324313 +
cacatagtgtatccaccggtaaag

SEQ ID NO: 64907 - DNA, 24 bp, Artificial Sequence
  Synthetic oligonucleotide; AGATGATT chr11 5324344 5324367 5324364 +
ggagcctccaatcttcctgcttgg

SEQ ID NO: 64908 - DNA, 24 bp, Artificial Sequence
  Synthetic oligonucleotide; GTTCGATT chr11 5324453 5324476 5324473 +
attagaaaaaatactgagttaatg

SEQ ID NO: 64909 - DNA, 24 bp, Artificial Sequence
  Synthetic oligonucleotide; CTGTGATT chr11 5324613 5324636 5324633 +
taatctggcttagttgtcttcttg

SEQ ID NO: 64910 - DNA, 24 bp, Artificial Sequence
  Synthetic oligonucleotide; AAATGATT chr11 5324634 5324657 5324654 +
ttgctgtgattactgaccatttgg

SEQ ID NO: 64911 - DNA, 24 bp, Artificial Sequence
  Synthetic oligonucleotide; TCACGATT chr11 5324658 5324681 5324678 +
aaatgattgttgtaattttacatt

SEQ ID NO: 64912 - DNA, 24 bp, Artificial Sequence
  Synthetic oligonucleotide; CTCAGATT chr11 5324872 5324895 5324892 +
cagcgggcttgttaggcatgcagc

SEQ ID NO: 64913 - DNA, 24 bp, Artificial Sequence
  Synthetic oligonucleotide; AGGTGATT chr11 5324927 5324950 5324947 +
caaattcgcttttttcaggtcctc

SEQ ID NO: 64914 - DNA, 24 bp, Artificial Sequence
  Synthetic oligonucleotide; AGTTGATT chr11 5325025 5325048 5325045 +
agaaaccttttaatgcttccatcc

SEQ ID NO: 64915 - DNA, 24 bp, Artificial Sequence
  Synthetic oligonucleotide; TCAGGATT chr11 5325527 5325550 5325547 +
tacctctgtatcagctcctgtgag

SEQ ID NO: 64916 - DNA, 24 bp, Artificial Sequence
  Synthetic oligonucleotide; CTGAGATT chr11 5325544 5325567 5325564 +
ctgtgagtcaggattactaactta

SEQ ID NO: 64917 - DNA, 24 bp, Artificial Sequence
  Synthetic oligonucleotide; CACAGATT chr11 5325671 5325694 5325691 +
cgaaagatccttcatgcttaaaaa

SEQ ID NO: 64918 - DNA, 24 bp, Artificial Sequence
  Synthetic oligonucleotide; GGCAGATT chr11 5325724 5325747 5325744 +
aatgaggtataggaggaagagaat

SEQ ID NO: 64919 - DNA, 24 bp, Artificial Sequence
  Synthetic oligonucleotide; CTGGGATT chr11 5325862 5325885 5325882 +
tttttaaaaagaaagccataaaat

SEQ ID NO: 64920 - DNA, 24 bp, Artificial Sequence
  Synthetic oligonucleotide; ACTAGATT chr11 5325898 5325921 5325918 +
taaaaaaaattgtgtaaggatcaa

SEQ ID NO: 64921 - DNA, 24 bp, Artificial Sequence
  Synthetic oligonucleotide; CTGAGATT chr11 5326139 5326162 5326159 +
aagaaaatgaaaggtaaatcatgt

SEQ ID NO: 64922 - DNA, 24 bp, Artificial Sequence
  Synthetic oligonucleotide; TGGGGATT chr11 5326223 5326246 5326243 +
gatatttacccagaggcaggcgtg

SEQ ID NO: 64923 - DNA, 24 bp, Artificial Sequence
  Synthetic oligonucleotide; TAGTGATT chr11 5326476 5326499 5326496 +
ctctcaactcagaacataaatgtt

SEQ ID NO: 64924 - DNA, 24 bp, Artificial Sequence
  Synthetic oligonucleotide; TGATGATT chr11 5326515 5326538 5326535 +
gatctggggtcctgacttgatgtg

SEQ ID NO: 64925 - DNA, 24 bp, Artificial Sequence
  Synthetic oligonucleotide; ATAAGATT chr11 5326915 5326938 5326935 +
acatgatgatatatttctagatga

SEQ ID NO: 64926 - DNA, 24 bp, Artificial Sequence
  Synthetic oligonucleotide; ATATGATT chr11 5327164 5327187 5327184 +
cataaacaagtgaaagaggaaaaa

SEQ ID NO: 64927 - DNA, 24 bp, Artificial Sequence
  Synthetic oligonucleotide; CTCAGATT chr11 5327577 5327600 5327597 +
cctgacagttgggactacccaact

SEQ ID NO: 64928 - DNA, 24 bp, Artificial Sequence
  Synthetic oligonucleotide; ATATGATT chr11 5327654 5327677 5327674 +
ccaatatattatcatctgccatca

SEQ ID NO: 64929 - DNA, 24 bp, Artificial Sequence
  Synthetic oligonucleotide; ACTCGATT chr11 5327724 5327747 5327744 +
ggctgcccttttctaagcctttca

SEQ ID NO: 64930 - DNA, 24 bp, Artificial Sequence
  Synthetic oligonucleotide; AGTTGATT chr11 5327847 5327870 5327867 +
ccctttctggataaacaaaaactg

SEQ ID NO: 64931 - DNA, 24 bp, Artificial Sequence
  Synthetic oligonucleotide; CCCAGATT chr11 5328226 5328249 5328246 +
ttatacttatgccaatccaagggt

SEQ ID NO: 64932 - DNA, 24 bp, Artificial Sequence
  Synthetic oligonucleotide; TCGGGATT chr11 5328657 5328680 5328677 +
aacagggccccacaactgatgtcc

SEQ ID NO: 64933 - DNA, 24 bp, Artificial Sequence
  Synthetic oligonucleotide; TGCAGATT chr11 5328944 5328967 5328964 +
cttcaatggatctgttaatagtca

SEQ ID NO: 64934 - DNA, 24 bp, Artificial Sequence
  Synthetic oligonucleotide; AAGTGATT chr11 5329072 5329095 5329092 +
ctgcaaactccacctcccaggttc

SEQ ID NO: 64935 - DNA, 24 bp, Artificial Sequence
  Synthetic oligonucleotide; CTGGGATT chr11 5329237 5329260 5329257 +
caccctccttggcctcccaaagtg

SEQ ID NO: 64936 - DNA, 24 bp, Artificial Sequence
  Synthetic oligonucleotide; GCATGATT chr11 5330232 5330255 5330252 +
acgtgtgcatgtgtctttatagca

SEQ ID NO: 64937 - DNA, 24 bp, Artificial Sequence
  Synthetic oligonucleotide; TAATGATT chr11 5330426 5330449 5330446 +
agcacctgttgttccctgactttt

SEQ ID NO: 64938 - DNA, 24 bp, Artificial Sequence
  Synthetic oligonucleotide; TTTTGATT chr11 5330471 5330494 5330491 +
gtgtgagatggtatctctttgtgg

SEQ ID NO: 64939 - DNA, 24 bp, Artificial Sequence
  Synthetic oligonucleotide; ATGGGATT chr11 5330824 5330847 5330844 +
caggcagaaagcatgggagaggac

SEQ ID NO: 64940 - DNA, 24 bp, Artificial Sequence
  Synthetic oligonucleotide; TGATGATT chr11 5330856 5330879 5330876 +
gacagtaggggaatccagagaggg

SEQ ID NO: 64941 - DNA, 24 bp, Artificial Sequence
  Synthetic oligonucleotide; AGGGGATT chr11 5330954 5330977 5330974 +
ttggtgagaatggaggtgtatctc

SEQ ID NO: 64942 - DNA, 24 bp, Artificial Sequence
  Synthetic oligonucleotide; AGTGGATT chr11 5331027 5331050 5331047 +
ctctggactccacgatagagaggg

SEQ ID NO: 64943 - DNA, 24 bp, Artificial Sequence
  Synthetic oligonucleotide; CCACGATT chr11 5331569 5331592 5331589 +
taaaaatcatatatgagatagttc

SEQ ID NO: 64944 - DNA, 24 bp, Artificial Sequence
  Synthetic oligonucleotide; ACAAGATT chr11 5331879 5331902 5331899 +
cataattttaaaaacctttctacc

SEQ ID NO: 64945 - DNA, 24 bp, Artificial Sequence
  Synthetic oligonucleotide; AAGAGATT chr11 5332508 5332531 5332528 +
cgggaggcacaggttgcagggagc

SEQ ID NO: 64946 - DNA, 24 bp, Artificial Sequence
  Synthetic oligonucleotide; TATTGATT chr11 5333413 5333436 5333433 +
tggaagcaatgacagagtttgaca

SEQ ID NO: 64947 - DNA, 24 bp, Artificial Sequence
  Synthetic oligonucleotide; TTATGATT chr11 5333450 5333473 5333470 +
gttatttataaaattttaattact

SEQ ID NO: 64948 - DNA, 24 bp, Artificial Sequence
  Synthetic oligonucleotide; TGCTGATT chr11 5333485 5333508 5333505 +
acattgatcactaactgactggta

SEQ ID NO: 64949 - DNA, 24 bp, Artificial Sequence
  Synthetic oligonucleotide; AGAAGATT chr11 5334023 5334046 5334043 +
aactatgtggtggaagagaatcca

SEQ ID NO: 64950 - DNA, 24 bp, Artificial Sequence
  Synthetic oligonucleotide; GTATGATT chr11 5334400 5334423 5334420 +
atgctatctaactacctttgcctt

SEQ ID NO: 64951 - DNA, 24 bp, Artificial Sequence
  Synthetic oligonucleotide; ATAAGATT chr11 5334533 5334556 5334553 +
cacttaatcttttcttggtttcaa

SEQ ID NO: 64952 - DNA, 24 bp, Artificial Sequence
  Synthetic oligonucleotide; ATGAGATT chr11 5334867 5334890 5334887 +
tttatcctggaacttagcccaact

SEQ ID NO: 64953 - DNA, 24 bp, Artificial Sequence
  Synthetic oligonucleotide; TCATGATT chr11 5335013 5335036 5335033 +
tgtaagcagaatagtagtaggaaa

SEQ ID NO: 64954 - DNA, 24 bp, Artificial Sequence
  Synthetic oligonucleotide; TCTGGATT chr11 5335093 5335116 5335113 +
ctttgtactaagttaaaatttagg

SEQ ID NO: 64955 - DNA, 24 bp, Artificial Sequence
  Synthetic oligonucleotide; GATTGATT chr11 5335097 5335120 5335117 +
gtactaagttaaaatttaggtctg

SEQ ID NO: 64956 - DNA, 24 bp, Artificial Sequence
  Synthetic oligonucleotide; AACTGATT chr11 5335159 5335182 5335179 +
ggtgaggtagtaagaccctgagat

SEQ ID NO: 64957 - DNA, 24 bp, Artificial Sequence
  Synthetic oligonucleotide; CTCAGATT chr11 5335586 5335609 5335606 +
agtatcatgtcacagcagcataat

SEQ ID NO: 64958 - DNA, 24 bp, Artificial Sequence
  Synthetic oligonucleotide; TAACGATT chr11 5335905 5335928 5335925 +
tcaagtataataagcttatatcgc

SEQ ID NO: 64959 - DNA, 24 bp, Artificial Sequence
  Synthetic oligonucleotide; CTAGGATT chr11 5335929 5335952 5335949 +
taacgattcaggaaggtctctatc

SEQ ID NO: 64960 - DNA, 24 bp, Artificial Sequence
  Synthetic oligonucleotide; GTTTGATT chr11 5336001 5336024 5336021 +
ttcttttttttttttttctgtgta

SEQ ID NO: 64961 - DNA, 24 bp, Artificial Sequence
  Synthetic oligonucleotide; TCTGGATT chr11 5336026 5336049 5336046 +
tttgattctattatctgtcagcct

SEQ ID NO: 64962 - DNA, 24 bp, Artificial Sequence
  Synthetic oligonucleotide; CGAAGATT chr11 5336047 5336070 5336067 +
ccttctggattccacaattatctc

SEQ ID NO: 64963 - DNA, 24 bp, Artificial Sequence
  Synthetic oligonucleotide; GCAAGATT chr11 5336179 5336202 5336199 +
atgtttttgtgagggtgtttttag

SEQ ID NO: 64964 - DNA, 24 bp, Artificial Sequence
  Synthetic oligonucleotide; TTTAGATT chr11 5336358 5336381 5336378 +
ggaatctagacctttttttctgcc

SEQ ID NO: 64965 - DNA, 24 bp, Artificial Sequence
  Synthetic oligonucleotide; GGTTGATT chr11 5337088 5337111 5337108 +
ttgtctatcattgatggccatttg

SEQ ID NO: 64966 - DNA, 24 bp, Artificial Sequence
  Synthetic oligonucleotide; GAATGATT chr11 5337159 5337182 5337179 +
acatgtgcatgtatcttagtaata

SEQ ID NO: 64967 - DNA, 24 bp, Artificial Sequence
  Synthetic oligonucleotide; ATGGGATT chr11 5337194 5337217 5337214 +
actcctttaggtatatacccagta

SEQ ID NO: 64968 - DNA, 24 bp, Artificial Sequence
  Synthetic oligonucleotide; TTTTGATT chr11 5337396 5337419 5337416 +
gtgtcagatggtatttcattgtgg

SEQ ID NO: 64969 - DNA, 24 bp, Artificial Sequence
  Synthetic oligonucleotide; CATAGATT chr11 5337557 5337580 5337577 +
ttttgtaaatatgtctaagttcct

SEQ ID NO: 64970 - DNA, 24 bp, Artificial Sequence
  Synthetic oligonucleotide; GGTAGATT chr11 5337590 5337613 5337610 +
tggatattagacctttgtcagatg

SEQ ID NO: 64971 - DNA, 24 bp, Artificial Sequence
  Synthetic oligonucleotide; CTGAGATT chr11 5337811 5337834 5337831 +
ctcctgcctcagcctcctgagtag

SEQ ID NO: 64972 - DNA, 24 bp, Artificial Sequence
  Synthetic oligonucleotide; CTGGGATT chr11 5337947 5337970 5337967 +
cacccaccttggcctcccaaagtg

SEQ ID NO: 64973 - DNA, 24 bp, Artificial Sequence
  Synthetic oligonucleotide; ATCAGATT chr11 5338286 5338309 5338306 +
ttgtttttaccaggtttgttgaag

SEQ ID NO: 64974 - DNA, 24 bp, Artificial Sequence
  Synthetic oligonucleotide; TGTTGATT chr11 5338427 5338450 5338447 +
tataatttgaagttgggtaaatcc

SEQ ID NO: 64975 - DNA, 24 bp, Artificial Sequence
  Synthetic oligonucleotide; TAAGGATT chr11 5338611 5338634 5338631 +
tttattaataacaatgactgtgtc

SEQ ID NO: 64976 - DNA, 24 bp, Artificial Sequence
  Synthetic oligonucleotide; AACAGATT chr11 5338636 5338659 5338656 +
aaggatttaggctataaaatcaaa

SEQ ID NO: 64977 - DNA, 24 bp, Artificial Sequence
  Synthetic oligonucleotide; CTAAGATT chr11 5338923 5338946 5338943 +
catacatattttttcagtgtgtct

SEQ ID NO: 64978 - DNA, 24 bp, Artificial Sequence
  Synthetic oligonucleotide; CTAAGATT chr11 5338954 5338977 5338974 +
tcttccacgtcttcttaatcattt

SEQ ID NO: 64979 - DNA, 24 bp, Artificial Sequence
  Synthetic oligonucleotide; CTTAGATT chr11 5339128 5339151 5339148 +
tttttaatgtatattcttttacac

SEQ ID NO: 64980 - DNA, 24 bp, Artificial Sequence
  Synthetic oligonucleotide; TACAGATT chr11 5339472 5339495 5339492 +
aacttgtgtcacgagggtttgttg

SEQ ID NO: 64981 - DNA, 24 bp, Artificial Sequence
  Synthetic oligonucleotide; TGTTGATT chr11 5339777 5339800 5339797 +
gataatactaacatactgtgttta

SEQ ID NO: 64982 - DNA, 24 bp, Artificial Sequence
  Synthetic oligonucleotide; AGTGGATT chr11 5339819 5339842 5339839 +
gttttgaatagaaaaacatgtctg

SEQ ID NO: 64983 - DNA, 24 bp, Artificial Sequence
  Synthetic oligonucleotide; AGAAGATT chr11 5340112 5340135 5340132 +
tttccagttttaaatattagttag

SEQ ID NO: 64984 - DNA, 24 bp, Artificial Sequence
  Synthetic oligonucleotide; AAAAGATT chr11 5340244 5340267 5340264 +
gtttattaggctgtggaatcaaaa

SEQ ID NO: 64985 - DNA, 24 bp, Artificial Sequence
  Synthetic oligonucleotide; CAGAGATT chr11 5340295 5340318 5340315 +
ctgagtctcaggaaaacatggaat

SEQ ID NO: 64986 - DNA, 24 bp, Artificial Sequence
  Synthetic oligonucleotide; TGAAGATT chr11 5340303 5340326 5340323 +
caggaaaacatggaatcagagatt

SEQ ID NO: 64987 - DNA, 24 bp, Artificial Sequence
  Synthetic oligonucleotide; GAATGATT chr11 5340889 5340912 5340909 +
taagggacacatgtttggttttat

SEQ ID NO: 64988 - DNA, 24 bp, Artificial Sequence
  Synthetic oligonucleotide; AGCTGATT chr11 5341007 5341030 5341027 +
tgacaaggataaaaaacatgataa

SEQ ID NO: 64989 - DNA, 24 bp, Artificial Sequence
  Synthetic oligonucleotide; TAAGGATT chr11 5341070 5341093 5341090 +
tctcttaatgaaacagaatataaa

SEQ ID NO: 64990 - DNA, 24 bp, Artificial Sequence
  Synthetic oligonucleotide; TAGGGATT chr11 5341121 5341144 5341141 +
actctctatgagcaatacctgaga

SEQ ID NO: 64991 - DNA, 24 bp, Artificial Sequence
  Synthetic oligonucleotide; CTCTGATT chr11 5341482 5341505 5341502 +
tgtctcactgaagtattatttttg

SEQ ID NO: 64992 - DNA, 24 bp, Artificial Sequence
  Synthetic oligonucleotide; CCGTGATT chr11 5341881 5341904 5341901 +
ctgtgtctacgtcctctcatttat

SEQ ID NO: 64993 - DNA, 24 bp, Artificial Sequence
  Synthetic oligonucleotide; AGAAGATT chr11 5342047 5342070 5342067 +
ataagtaattaggtcactgatcaa

SEQ ID NO: 64994 - DNA, 24 bp, Artificial Sequence
  Synthetic oligonucleotide; ATTAGATT chr11 5342155 5342178 5342175 +
cagagaaattcataagagttggaa

SEQ ID NO: 64995 - DNA, 24 bp, Artificial Sequence
  Synthetic oligonucleotide; TTATGATT chr11 5342222 5342245 5342242 +
gaaccaactaataattttatattt

SEQ ID NO: 64996 - DNA, 24 bp, Artificial Sequence
  Synthetic oligonucleotide; TGATGATT chr11 5342549 5342572 5342569 +
ttttacattctgtgagagtgactg

SEQ ID NO: 64997 - DNA, 24 bp, Artificial Sequence
  Synthetic oligonucleotide; ATAGGATT chr11 5342638 5342661 5342658 +
tgcttggtcttgacactatatgtt

SEQ ID NO: 64998 - DNA, 24 bp, Artificial Sequence
  Synthetic oligonucleotide; GCCTGATT chr11 5343023 5343046 5343043 +
gacaatacagaaaaaaatagaggg

SEQ ID NO: 64999 - DNA, 24 bp, Artificial Sequence
  Synthetic oligonucleotide; TGAAGATT chr11 5343340 5343363 5343360 +
gccagaaagaagtacatgggctca

SEQ ID NO: 65000 - DNA, 24 bp, Artificial Sequence
  Synthetic oligonucleotide; AAGTGATT chr11 5343631 5343654 5343651 +
taaagataataatgacatcaatat

SEQ ID NO: 65001 - DNA, 24 bp, Artificial Sequence
  Synthetic oligonucleotide; TGCAGATT chr11 5343821 5343844 5343841 +
cttctaaactgttacccttaacta

SEQ ID NO: 65002 - DNA, 24 bp, Artificial Sequence
  Synthetic oligonucleotide; AGGGGATT chr11 5343859 5343882 5343879 +
aattcgtattctatggggcattca

SEQ ID NO: 65003 - DNA, 24 bp, Artificial Sequence
  Synthetic oligonucleotide; GTCAGATT chr11 5344057 5344080 5344077 +
cactaccactgtagctaaggagca

SEQ ID NO: 65004 - DNA, 24 bp, Artificial Sequence
  Synthetic oligonucleotide; TCCAGATT chr11 5344084 5344107 5344104 +
agattgagaaagagacacttggcc

SEQ ID NO: 65005 - DNA, 24 bp, Artificial Sequence
  Synthetic oligonucleotide; TCACGATT chr11 5344120 5344143 5344140 +
ggactagtgatggggaacagacat

SEQ ID NO: 65006 - DNA, 24 bp, Artificial Sequence
  Synthetic oligonucleotide; AAATGATT chr11 5344222 5344245 5344242 +
taagttagactttggggctggaat

SEQ ID NO: 65007 - DNA, 24 bp, Artificial Sequence
  Synthetic oligonucleotide; AAGAGATT chr11 5344523 5344546 5344543 +
gtggtgctgtcttttactgaagag

SEQ ID NO: 65008 - DNA, 24 bp, Artificial Sequence
  Synthetic oligonucleotide; TGTAGATT chr11 5344840 5344863 5344860 +
ttaacataaaacagtactacttga

SEQ ID NO: 65009 - DNA, 24 bp, Artificial Sequence
  Synthetic oligonucleotide; TTCTGATT chr11 5345193 5345216 5345213 +
aatggaaaatagtgtggtgatata

SEQ ID NO: 65010 - DNA, 24 bp, Artificial Sequence
  Synthetic oligonucleotide; CCAAGATT chr11 5345399 5345422 5345419 +
gacagatgcatttttgaagtagtg

SEQ ID NO: 65011 - DNA, 24 bp, Artificial Sequence
  Synthetic oligonucleotide; CCTAGATT chr11 5345456 5345479 5345476 +
agggaaaaatcaaatgaggtttcc

SEQ ID NO: 65012 - DNA, 24 bp, Artificial Sequence
  Synthetic oligonucleotide; CAATGATT chr11 5346157 5346180 5346177 +
gggaaagctaaccaaactgtaagg

SEQ ID NO: 65013 - DNA, 24 bp, Artificial Sequence
  Synthetic oligonucleotide; AGAAGATT chr11 5346420 5346443 5346440 +
tcataaagactgaggatagaagca

SEQ ID NO: 65014 - DNA, 24 bp, Artificial Sequence
  Synthetic oligonucleotide; TGCAGATT chr11 5347871 5347894 5347891 +
atgttcctaccagccaggctcatg

SEQ ID NO: 65015 - DNA, 24 bp, Artificial Sequence
  Synthetic oligonucleotide; AGCTGATT chr11 5348048 5348071 5348068 +
gcaaaaaaaaaacagagagatcga

SEQ ID NO: 65016 - DNA, 24 bp, Artificial Sequence
  Synthetic oligonucleotide; GATAGATT chr11 5348191 5348214 5348211 +
ctcttcaaatataaaaaagtgaag

SEQ ID NO: 65017 - DNA, 24 bp, Artificial Sequence
  Synthetic oligonucleotide; GACTGATT chr11 5348294 5348317 5348314 +
ggttgtagtaatttctctccacct

SEQ ID NO: 65018 - DNA, 24 bp, Artificial Sequence
  Synthetic oligonucleotide; TACAGATT chr11 5348557 5348580 5348577 +
ttatgtgtgcctctggatcagggg

SEQ ID NO: 65019 - DNA, 24 bp, Artificial Sequence
  Synthetic oligonucleotide; AGCTGATT chr11 5348669 5348692 5348689 +
ctgctttcttctagccgccctggc

SEQ ID NO: 65020 - DNA, 24 bp, Artificial Sequence
  Synthetic oligonucleotide; TTTAGATT chr11 5349125 5349148 5349145 +
tggctgcagggatgaggcaaaggt

SEQ ID NO: 65021 - DNA, 24 bp, Artificial Sequence
  Synthetic oligonucleotide; TAAGGATT chr11 5349245 5349268 5349265 +
aacagacaagacaaacagctattt

SEQ ID NO: 65022 - DNA, 24 bp, Artificial Sequence
  Synthetic oligonucleotide; ACTAGATT chr11 5349435 5349458 5349455 +
tttagtagtaatataacacaatta

SEQ ID NO: 65023 - DNA, 24 bp, Artificial Sequence
  Synthetic oligonucleotide; GTTTGATT chr11 5349575 5349598 5349595 +
gtgaggtgatagatatattaatta

SEQ ID NO: 65024 - DNA, 24 bp, Artificial Sequence
  Synthetic oligonucleotide; GGCAGATT chr11 5349711 5349734 5349731 +
tattgtctgaacctctcactggca

SEQ ID NO: 65025 - DNA, 24 bp, Artificial Sequence
  Synthetic oligonucleotide; TGCTGATT chr11 5349893 5349916 5349913 +
cacccagacatatcacattttatc

SEQ ID NO: 65026 - DNA, 24 bp, Artificial Sequence
  Synthetic oligonucleotide; TCAAGATT chr11 5350211 5350234 5350231 +
ctttacaggttatgtaaccaaatc

SEQ ID NO: 65027 - DNA, 24 bp, Artificial Sequence
  Synthetic oligonucleotide; ATCAGATT chr11 5350549 5350572 5350569 +
gccttctcacttttgtcaaatccc

SEQ ID NO: 65028 - DNA, 24 bp, Artificial Sequence
  Synthetic oligonucleotide; TAGTGATT chr11 5351152 5351175 5351172 +
ggccattacagcactattcaaata

SEQ ID NO: 65029 - DNA, 24 bp, Artificial Sequence
  Synthetic oligonucleotide; ATATGATT chr11 5351192 5351215 5351212 +
cattttgtttttattttctgggtt

SEQ ID NO: 65030 - DNA, 24 bp, Artificial Sequence
  Synthetic oligonucleotide; AACTGATT chr11 5351428 5351451 5351448 +
attctcaaggagcaacttttatac

SEQ ID NO: 65031 - DNA, 24 bp, Artificial Sequence
  Synthetic oligonucleotide; GGGAGATT chr11 5351746 5351769 5351766 +
taggtgttctgtggttagatcaca

SEQ ID NO: 65032 - DNA, 24 bp, Artificial Sequence
  Synthetic oligonucleotide; TGAAGATT chr11 5351902 5351925 5351922 +
ctatcctgaccaacacccaggtaa

SEQ ID NO: 65033 - DNA, 24 bp, Artificial Sequence
  Synthetic oligonucleotide; TTTTGATT chr11 5352133 5352156 5352153 +
ttctcatcatctttttctcctaca

SEQ ID NO: 65034 - DNA, 24 bp, Artificial Sequence
  Synthetic oligonucleotide; AGCAGATT chr11 5352367 5352390 5352387 +
catttatctatagcattaaaacta

SEQ ID NO: 65035 - DNA, 24 bp, Artificial Sequence
  Synthetic oligonucleotide; TGCTGATT chr11 5352600 5352623 5352620 +
cattattttaccctgcctgtctat

SEQ ID NO: 65036 - DNA, 24 bp, Artificial Sequence
  Synthetic oligonucleotide; GTTTGATT chr11 5352689 5352712 5352709 +
ttctcaggtaatttaactcacatt

SEQ ID NO: 65037 - DNA, 24 bp, Artificial Sequence
  Synthetic oligonucleotide; CTATGATT chr11 5352915 5352938 5352935 +
caattatatatataattcttgggt

SEQ ID NO: 65038 - DNA, 24 bp, Artificial Sequence
  Synthetic oligonucleotide; TTTTGATT chr11 5353529 5353552 5353549 +
atggccttttctggctccaaatac

SEQ ID NO: 65039 - DNA, 24 bp, Artificial Sequence
  Synthetic oligonucleotide; TGGGGATT chr11 5353798 5353821 5353818 +
cacctactcttcatcacagaaagg

SEQ ID NO: 65040 - DNA, 24 bp, Artificial Sequence
  Synthetic oligonucleotide; TTAGGATT chr11 5353808 5353831 5353828 +
tcatcacagaaaggtggggatttt

SEQ ID NO: 65041 - DNA, 24 bp, Artificial Sequence
  Synthetic oligonucleotide; ATCTGATT chr11 5353897 5353920 5353917 +
tttccaggctagtaaatgatcttt

SEQ ID NO: 65042 - DNA, 24 bp, Artificial Sequence
  Synthetic oligonucleotide; AAAAGATT chr11 5353910 5353933 5353930 +
aaatgatctttatctgattagacc

SEQ ID NO: 65043 - DNA, 24 bp, Artificial Sequence
  Synthetic oligonucleotide; GCTGGATT chr11 5354918 5354941 5354938 +
tgagtcactgtgtgaagtctgtgc

SEQ ID NO: 65044 - DNA, 24 bp, Artificial Sequence
  Synthetic oligonucleotide; ATTGGATT chr11 5355255 5355278 5355275 +
ttaccattattatagtcaagacga

SEQ ID NO: 65045 - DNA, 24 bp, Artificial Sequence
  Synthetic oligonucleotide; CACTGATT chr11 5355410 5355433 5355430 +
cttcaacattcaaagagcaacacc

SEQ ID NO: 65046 - DNA, 24 bp, Artificial Sequence
  Synthetic oligonucleotide; CTCTGATT chr11 5355813 5355836 5355833 +
ttaaaggatcaatgtaatgccctg

SEQ ID NO: 65047 - DNA, 24 bp, Artificial Sequence
  Synthetic oligonucleotide; AGCTGATT chr11 5356319 5356342 5356339 +
catgatgaatgcacaagactcagt

SEQ ID NO: 65048 - DNA, 24 bp, Artificial Sequence
  Synthetic oligonucleotide; ATCTGATT chr11 5356470 5356493 5356490 +
actatgtgaaaagaccaaatctat

SEQ ID NO: 65049 - DNA, 24 bp, Artificial Sequence
  Synthetic oligonucleotide; GTCAGATT chr11 5356649 5356672 5356669 +
agagcaactacaaggcacataatt

SEQ ID NO: 65050 - DNA, 24 bp, Artificial Sequence
  Synthetic oligonucleotide; GAGAGATT chr11 5356903 5356926 5356923 +
atactttacagacaagcaaatgct

SEQ ID NO: 65051 - DNA, 24 bp, Artificial Sequence
  Synthetic oligonucleotide; TCAGGATT chr11 5357798 5357821 5357818 +
accacagtgcaatcaaactagaac

SEQ ID NO: 65052 - DNA, 24 bp, Artificial Sequence
  Synthetic oligonucleotide; ACATGATT chr11 5358870 5358893 5358890 +
taaacagaaccaaagacaaaaacc

SEQ ID NO: 65053 - DNA, 24 bp, Artificial Sequence
  Synthetic oligonucleotide; ACACGATT chr11 5359196 5359219 5359216 +
tcaaattgtccctgtttgcagatg

SEQ ID NO: 65054 - DNA, 24 bp, Artificial Sequence
  Synthetic oligonucleotide; TATAGATT chr11 5359555 5359578 5359575 +
atggccatacagcccaaggtaatt

SEQ ID NO: 65055 - DNA, 24 bp, Artificial Sequence
  Synthetic oligonucleotide; AAAGGATT chr11 5359869 5359892 5359889 +
acctgacaaaaaaaacaaatgggg

SEQ ID NO: 65056 - DNA, 24 bp, Artificial Sequence
  Synthetic oligonucleotide; GATGGATT chr11 5359973 5359996 5359993 +
caccttatacaaaaattaattcaa

SEQ ID NO: 65057 - DNA, 24 bp, Artificial Sequence
  Synthetic oligonucleotide; TGGCGATT chr11 5360556 5360579 5360576 +
gttcaaccattgtggaagtcagtg

SEQ ID NO: 65058 - DNA, 24 bp, Artificial Sequence
  Synthetic oligonucleotide; AAAGGATT chr11 5360627 5360650 5360647 +
catcccattactgggtacatactc

SEQ ID NO: 65059 - DNA, 24 bp, Artificial Sequence
  Synthetic oligonucleotide; ACTGGATT chr11 5360737 5360760 5360757 +
aacccaaatgtccaacaatgatag

SEQ ID NO: 65060 - DNA, 24 bp, Artificial Sequence
  Synthetic oligonucleotide; CAGAGATT chr11 5361550 5361573 5361570 +
atgagcagtagacggttggcttat

SEQ ID NO: 65061 - DNA, 24 bp, Artificial Sequence
  Synthetic oligonucleotide; TTTGGATT chr11 5361803 5361826 5361823 +
ctctggtgtagttccagactctgg

SEQ ID NO: 65062 - DNA, 24 bp, Artificial Sequence
  Synthetic oligonucleotide; AATAGATT chr11 5361972 5361995 5361992 +
actaacagaaagaaaaacttacca

SEQ ID NO: 65063 - DNA, 24 bp, Artificial Sequence
  Synthetic oligonucleotide; GTCAGATT chr11 5361983 5362006 5362003 +
gaaaaacttaccaaatagattagt

SEQ ID NO: 65064 - DNA, 24 bp, Artificial Sequence
  Synthetic oligonucleotide; TGCAGATT chr11 5362148 5362171 5362168 +
cattccatgctgagctatcagcac

SEQ ID NO: 65065 - DNA, 24 bp, Artificial Sequence
  Synthetic oligonucleotide; TGATGATT chr11 5362429 5362452 5362449 +
ttgttgagccttataatgagaatg

SEQ ID NO: 65066 - DNA, 24 bp, Artificial Sequence
  Synthetic oligonucleotide; ATCTGATT chr11 5362649 5362672 5362669 +
cggtcaacccagctgtcttccccc

SEQ ID NO: 65067 - DNA, 24 bp, Artificial Sequence
  Synthetic oligonucleotide; CAGGGATT chr11 5362975 5362998 5362995 +
aaaaaagaaataatagaagttagg

SEQ ID NO: 65068 - DNA, 24 bp, Artificial Sequence
  Synthetic oligonucleotide; GAATGATT chr11 5363139 5363162 5363159 +
tcaaaactcaaagttttacgaaca

SEQ ID NO: 65069 - DNA, 24 bp, Artificial Sequence
  Synthetic oligonucleotide; GGTAGATT chr11 5363580 5363603 5363600 +
gaatgcagaaagaagatatattga

SEQ ID NO: 65070 - DNA, 24 bp, Artificial Sequence
  Synthetic oligonucleotide; CTAAGATT chr11 5363604 5363627 5363624 +
ggtagatttttctcatagatacta

SEQ ID NO: 65071 - DNA, 24 bp, Artificial Sequence
  Synthetic oligonucleotide; TGAGGATT chr11 5363739 5363762 5363759 +
gaaagcgggaaagtagcattttca

SEQ ID NO: 65072 - DNA, 24 bp, Artificial Sequence
  Synthetic oligonucleotide; GATAGATT chr11 5363991 5364014 5364011 +
aacagggcttcacaacagtgtagt

SEQ ID NO: 65073 - DNA, 24 bp, Artificial Sequence
  Synthetic oligonucleotide; GGTCGATT chr11 5364065 5364088 5364085 +
tctcattctccatggttgcaataa

SEQ ID NO: 65074 - DNA, 24 bp, Artificial Sequence
  Synthetic oligonucleotide; TATAGATT chr11 5364072 5364095 5364092 +
ctccatggttgcaataaggtcgat

SEQ ID NO: 65075 - DNA, 24 bp, Artificial Sequence
  Synthetic oligonucleotide; CTCTGATT chr11 5364639 5364662 5364659 +
atcctcatgtgcatctctgaatat

SEQ ID NO: 65076 - DNA, 24 bp, Artificial Sequence
  Synthetic oligonucleotide; AAATGATT chr11 5364861 5364884 5364881 +
atttccatttaatatagttttatt

SEQ ID NO: 65077 - DNA, 24 bp, Artificial Sequence
  Synthetic oligonucleotide; AGGGGATT chr11 5364963 5364986 5364983 +
aaaatgaagtaacagaaggctaca

SEQ ID NO: 65078 - DNA, 24 bp, Artificial Sequence
  Synthetic oligonucleotide; CCCTGATT chr11 5365657 5365680 5365677 +
tgttgaggccctaatgagaaacat

SEQ ID NO: 65079 - DNA, 24 bp, Artificial Sequence
  Synthetic oligonucleotide; TTGAGATT chr11 5366735 5366758 5366755 +
aaggaaggaaatcagggtattcac

SEQ ID NO: 65080 - DNA, 24 bp, Artificial Sequence
  Synthetic oligonucleotide; ATCTGATT chr11 5366862 5366885 5366882 +
tgggaaggtttaggcaggggtgct

SEQ ID NO: 65081 - DNA, 24 bp, Artificial Sequence
  Synthetic oligonucleotide; AGGAGATT chr11 5367174 5367197 5367194 +
gaactggaataaaatcattttgaa

SEQ ID NO: 65082 - DNA, 24 bp, Artificial Sequence
  Synthetic oligonucleotide; CTTGGATT chr11 5367239 5367262 5367259 +
caatccagaccctaagagagggtt

SEQ ID NO: 65083 - DNA, 24 bp, Artificial Sequence
  Synthetic oligonucleotide; GGTGGATT chr11 5367411 5367434 5367431 +
ttattgatgatatgctaaacaagg

SEQ ID NO: 65084 - DNA, 24 bp, Artificial Sequence
  Synthetic oligonucleotide; TTCAGATT chr11 5368094 5368117 5368114 +
ctttctttgttttttcctctgcca

SEQ ID NO: 65085 - DNA, 24 bp, Artificial Sequence
  Synthetic oligonucleotide; TAATGATT chr11 5368364 5368387 5368384 +
agtacccacatggttgaattattt

SEQ ID NO: 65086 - DNA, 24 bp, Artificial Sequence
  Synthetic oligonucleotide; TGTGGATT chr11 5368846 5368869 5368866 +
atgttggaatttacaccattctta

SEQ ID NO: 65087 - DNA, 24 bp, Artificial Sequence
  Synthetic oligonucleotide; ATCTGATT chr11 5368926 5368949 5368946 +
tttctttccggatcatgcttacag

SEQ ID NO: 65088 - DNA, 24 bp, Artificial Sequence
  Synthetic oligonucleotide; TACTGATT chr11 5369186 5369209 5369206 +
attcacacatataacctgagtccc

SEQ ID NO: 65089 - DNA, 24 bp, Artificial Sequence
  Synthetic oligonucleotide; TCAGGATT chr11 5369911 5369934 5369931 +
tagaaagaaagggaagacattttc

SEQ ID NO: 65090 - DNA, 24 bp, Artificial Sequence
  Synthetic oligonucleotide; CCAGGATT chr11 5370285 5370308 5370305 +
gatagtatcttttatgctgactgt

SEQ ID NO: 65091 - DNA, 24 bp, Artificial Sequence
  Synthetic oligonucleotide; ACATGATT chr11 5370981 5371004 5371001 +
tcatacttcaggaaaaagacttac

SEQ ID NO: 65092 - DNA, 24 bp, Artificial Sequence
  Synthetic oligonucleotide; TAGTGATT chr11 5371044 5371067 5371064 +
agcagataatttgagtgataaaaa

SEQ ID NO: 65093 - DNA, 24 bp, Artificial Sequence
  Synthetic oligonucleotide; AGATGATT chr11 5371661 5371684 5371681 +
tataggatatatgtgtacatagtg

SEQ ID NO: 65094 - DNA, 24 bp, Artificial Sequence
  Synthetic oligonucleotide; TTGAGATT chr11 5371940 5371963 5371960 +
tatgcatttgaccttatttttctt

SEQ ID NO: 65095 - DNA, 24 bp, Artificial Sequence
  Synthetic oligonucleotide; CTTAGATT chr11 5372156 5372179 5372176 +
ctgttcatctatatatagatacca

SEQ ID NO: 65096 - DNA, 24 bp, Artificial Sequence
  Synthetic oligonucleotide; TGCGGATT chr11 5372231 5372254 5372251 +
gagagtgcagatagctctagaaaa

SEQ ID NO: 65097 - DNA, 24 bp, Artificial Sequence
  Synthetic oligonucleotide; TTTTGATT chr11 5372462 5372485 5372482 +
aacaggtgtgagtgatacttgtgg

SEQ ID NO: 65098 - DNA, 24 bp, Artificial Sequence
  Synthetic oligonucleotide; TGATGATT chr11 5372480 5372503 5372500 +
ttgtggttttgatttgcattttcc

SEQ ID NO: 65099 - DNA, 24 bp, Artificial Sequence
  Synthetic oligonucleotide; AGTTGATT chr11 5372604 5372627 5372624 +
ttactattatattttttcatattt

SEQ ID NO: 65100 - DNA, 24 bp, Artificial Sequence
  Synthetic oligonucleotide; TGATGATT chr11 5372690 5372713 5372710 +
tattttctcccaaactgttccttt

SEQ ID NO: 65101 - DNA, 24 bp, Artificial Sequence
  Synthetic oligonucleotide; TTCTGATT chr11 5372882 5372905 5372902 +
aaaccaacttgatggcagcacacg

SEQ ID NO: 65102 - DNA, 24 bp, Artificial Sequence
  Synthetic oligonucleotide; AATAGATT chr11 5373141 5373164 5373161 +
accttaagccataagtcaactcaa

SEQ ID NO: 65103 - DNA, 24 bp, Artificial Sequence
  Synthetic oligonucleotide; TCTTGATT chr11 5373246 5373269 5373266 +
gtctcggcaattttttagatattg

SEQ ID NO: 65104 - DNA, 24 bp, Artificial Sequence
  Synthetic oligonucleotide; GATCGATT chr11 5373284 5373307 5373304 +
aaattttcactggaagtctatatt

SEQ ID NO: 65105 - DNA, 24 bp, Artificial Sequence
  Synthetic oligonucleotide; GGGTGATT chr11 5373387 5373410 5373407 +
cccagcgtgaacaacacagaagac

SEQ ID NO: 65106 - DNA, 24 bp, Artificial Sequence
  Synthetic oligonucleotide; AGGAGATT chr11 5373643 5373666 5373663 +
gacaggcttaggaaatggcgcacc

SEQ ID NO: 65107 - DNA, 24 bp, Artificial Sequence
  Synthetic oligonucleotide; CCCTGATT chr11 5373694 5373717 5373714 +
gagggtcctacgcccacggagtct

SEQ ID NO: 65108 - DNA, 24 bp, Artificial Sequence
  Synthetic oligonucleotide; GTCTGATT chr11 5374827 5374850 5374847 +
actatgtgaaaagatcaaatctag

SEQ ID NO: 65109 - DNA, 24 bp, Artificial Sequence
  Synthetic oligonucleotide; TTCAGATT chr11 5374935 5374958 5374955 +
ccaatctagcaaggcaggccaaca

SEQ ID NO: 65110 - DNA, 24 bp, Artificial Sequence
  Synthetic oligonucleotide; GTCAGATT chr11 5375006 5375029 5375026 +
agagcaactccaagacacataatt

SEQ ID NO: 65111 - DNA, 24 bp, Artificial Sequence
  Synthetic oligonucleotide; GAGAGATT chr11 5375260 5375283 5375280 +
atactttacagacaagcaaatgct

SEQ ID NO: 65112 - DNA, 24 bp, Artificial Sequence
  Synthetic oligonucleotide; CCCAGATT chr11 5375772 5375795 5375792 +
atatatgcacccaatacaggagca

SEQ ID NO: 65113 - DNA, 24 bp, Artificial Sequence
  Synthetic oligonucleotide; TCAGGATT chr11 5376119 5376142 5376139 +
accacagtgcaatcaaactagaac

SEQ ID NO: 65114 - DNA, 24 bp, Artificial Sequence
  Synthetic oligonucleotide; GATGGATT chr11 5376826 5376849 5376846 +
ccaaccaaaaagagtccaggacca

SEQ ID NO: 65115 - DNA, 24 bp, Artificial Sequence
  Synthetic oligonucleotide; ACATGATT chr11 5377187 5377210 5377207 +
taaacagaaccaaagacaaaaacc

SEQ ID NO: 65116 - DNA, 24 bp, Artificial Sequence
  Synthetic oligonucleotide; ACATGATT chr11 5377514 5377537 5377534 +
tcaaattgtccctgtttgcagacg

SEQ ID NO: 65117 - DNA, 24 bp, Artificial Sequence
  Synthetic oligonucleotide; TATAGATT chr11 5377873 5377896 5377893 +
atggccataatgcccaaggtaatt

SEQ ID NO: 65118 - DNA, 24 bp, Artificial Sequence
  Synthetic oligonucleotide; CAATGATT chr11 5377904 5377927 5377924 +
tcaatgccatccccatcaagctac

SEQ ID NO: 65119 - DNA, 24 bp, Artificial Sequence
  Synthetic oligonucleotide; AAAGGATT chr11 5378186 5378209 5378206 +
acctgagaaaaacaagaaatgggg

SEQ ID NO: 65120 - DNA, 24 bp, Artificial Sequence
  Synthetic oligonucleotide; GATGGATT chr11 5378290 5378313 5378310 +
caccttatacaaaaattaattcaa

SEQ ID NO: 65121 - DNA, 24 bp, Artificial Sequence
  Synthetic oligonucleotide; TGGCGATT chr11 5378877 5378900 5378897 +
gttcaaccattgtggaagtcagtg

SEQ ID NO: 65122 - DNA, 24 bp, Artificial Sequence
  Synthetic oligonucleotide; ACTGGATT chr11 5379058 5379081 5379078 +
aacccaaatgtccaacaatgatag

SEQ ID NO: 65123 - DNA, 24 bp, Artificial Sequence
  Synthetic oligonucleotide; TTAAGATT chr11 5379558 5379581 5379578 +
atgtgtctttttctatgtctgctt

SEQ ID NO: 65124 - DNA, 24 bp, Artificial Sequence
  Synthetic oligonucleotide; AATAGATT chr11 5379663 5379686 5379683 +
caaggttagctaaagatatgaatt

SEQ ID NO: 65125 - DNA, 24 bp, Artificial Sequence
  Synthetic oligonucleotide; TAAGGATT chr11 5380530 5380553 5380550 +
tggagacattgagaaccctgtgag

SEQ ID NO: 65126 - DNA, 24 bp, Artificial Sequence
  Synthetic oligonucleotide; TGGGGATT chr11 5380564 5380587 5380584 +
atttaggtctgtttctggtcagag

SEQ ID NO: 65127 - DNA, 24 bp, Artificial Sequence
  Synthetic oligonucleotide; ATATGATT chr11 5380585 5380608 5380605 +
gagtggggatttaaggcttggtca

SEQ ID NO: 65128 - DNA, 24 bp, Artificial Sequence
  Synthetic oligonucleotide; CATAGATT chr11 5380611 5380634 5380631 +
atgattaagactaaaggccacaca

SEQ ID NO: 65129 - DNA, 24 bp, Artificial Sequence
  Synthetic oligonucleotide; GTGAGATT chr11 5380622 5380645 5380642 +
taaaggccacacacatagatttgt

SEQ ID NO: 65130 - DNA, 24 bp, Artificial Sequence
  Synthetic oligonucleotide; TGGGGATT chr11 5380954 5380977 5380974 +
aaaccacagcatgtgtacagacct

SEQ ID NO: 65131 - DNA, 24 bp, Artificial Sequence
  Synthetic oligonucleotide; AATGGATT chr11 5381242 5381265 5381262 +
acagtgacacttttcacttttagt

SEQ ID NO: 65132 - DNA, 24 bp, Artificial Sequence
  Synthetic oligonucleotide; TTTAGATT chr11 5381248 5381271 5381268 +
acacttttcacttttagtaatgga

SEQ ID NO: 65133 - DNA, 24 bp, Artificial Sequence
  Synthetic oligonucleotide; GCATGATT chr11 5381371 5381394 5381391 +
ccacattcacttcacctaatattc

SEQ ID NO: 65134 - DNA, 24 bp, Artificial Sequence
  Synthetic oligonucleotide; ATATGATT chr11 5382035 5382058 5382055 +
attgttaacaatgtactctggaaa

SEQ ID NO: 65135 - DNA, 24 bp, Artificial Sequence
  Synthetic oligonucleotide; GGTTGATT chr11 5382297 5382320 5382317 +
acctttctataaagccctatctgt

SEQ ID NO: 65136 - DNA, 24 bp, Artificial Sequence
  Synthetic oligonucleotide; GCAGGATT chr11 5382567 5382590 5382587 +
gctaaaatcatgttcttaataaat

SEQ ID NO: 65137 - DNA, 24 bp, Artificial Sequence
  Synthetic oligonucleotide; GTAGGATT chr11 5383235 5383258 5383255 +
cactgacctggacatttgtttggg

SEQ ID NO: 65138 - DNA, 24 bp, Artificial Sequence
  Synthetic oligonucleotide; GCAAGATT chr11 5383249 5383272 5383269 +
tttgtttggggtaggattgaatat

SEQ ID NO: 65139 - DNA, 24 bp, Artificial Sequence
  Synthetic oligonucleotide; TGGTGATT chr11 5383379 5383402 5383399 +
aggagtgagagaatcttgaagtag

SEQ ID NO: 65140 - DNA, 24 bp, Artificial Sequence
  Synthetic oligonucleotide; ATAGGATT chr11 5383696 5383719 5383716 +
ggagataaagaaagtttcctgccc

SEQ ID NO: 65141 - DNA, 24 bp, Artificial Sequence
  Synthetic oligonucleotide; AATGGATT chr11 5384079 5384102 5384099 +
caaatgtttgaatgtccttagcca

SEQ ID NO: 65142 - DNA, 24 bp, Artificial Sequence
  Synthetic oligonucleotide; ATGGGATT chr11 5384112 5384135 5384132 +
cccacattccctgcactaagccta

SEQ ID NO: 65143 - DNA, 24 bp, Artificial Sequence
  Synthetic oligonucleotide; ACCGGATT chr11 5384238 5384261 5384258 +
aatcatagctcactgtaaactcaa

SEQ ID NO: 65144 - DNA, 24 bp, Artificial Sequence
  Synthetic oligonucleotide; CCAGGATT chr11 5384279 5384302 5384299 +
ctcccaccttattcttccaagttg

SEQ ID NO: 65145 - DNA, 24 bp, Artificial Sequence
  Synthetic oligonucleotide; CTTAGATT chr11 5384321 5384344 5384341 +
accaccatatacagcagtctgggc

SEQ ID NO: 65146 - DNA, 24 bp, Artificial Sequence
  Synthetic oligonucleotide; GAGAGATT chr11 5386055 5386078 5386075 +
cctaatgctacagaaggaagtcag

SEQ ID NO: 65147 - DNA, 24 bp, Artificial Sequence
  Synthetic oligonucleotide; TCCTGATT chr11 5386344 5386367 5386364 +
agagagacaaaggttcatatctta

SEQ ID NO: 65148 - DNA, 24 bp, Artificial Sequence
  Synthetic oligonucleotide; GGATGATT chr11 5386373 5386396 5386393 +
attttcgctcactaccaggccttg

SEQ ID NO: 65149 - DNA, 24 bp, Artificial Sequence
  Synthetic oligonucleotide; TCATGATT chr11 5386447 5386470 5386467 +
atgtttcatagttacatgaaatat

SEQ ID NO: 65150 - DNA, 24 bp, Artificial Sequence
  Synthetic oligonucleotide; CAGTGATT chr11 5386579 5386602 5386599 +
gctactgaagtactgaaaacagtg

SEQ ID NO: 65151 - DNA, 24 bp, Artificial Sequence
  Synthetic oligonucleotide; AATAGATT chr11 5386739 5386762 5386759 +
acattggctacagagatgaagatg

SEQ ID NO: 65152 - DNA, 24 bp, Artificial Sequence
  Synthetic oligonucleotide; GATAGATT chr11 5386752 5386775 5386772 +
agatgaagatgaatagattacagg

SEQ ID NO: 65153 - DNA, 24 bp, Artificial Sequence
  Synthetic oligonucleotide; TAGAGATT chr11 5387014 5387037 5387034 +
gatatgtaacggagttatctggac

SEQ ID NO: 65154 - DNA, 24 bp, Artificial Sequence
  Synthetic oligonucleotide; GTATGATT chr11 5387277 5387300 5387297 +
gcacaaaaaaatcaataaaagcag

SEQ ID NO: 65155 - DNA, 24 bp, Artificial Sequence
  Synthetic oligonucleotide; AGTGGATT chr11 5387581 5387604 5387601 +
acgtagcatttagctgctacttca

SEQ ID NO: 65156 - DNA, 24 bp, Artificial Sequence
  Synthetic oligonucleotide; CTCTGATT chr11 5387740 5387763 5387760 +
ccctaagatagccacacacttgcc

SEQ ID NO: 65157 - DNA, 24 bp, Artificial Sequence
  Synthetic oligonucleotide; TTTTGATT chr11 5387746 5387769 5387766 +
gatagccacacacttgccctctga

SEQ ID NO: 65158 - DNA, 24 bp, Artificial Sequence
  Synthetic oligonucleotide; ATAAGATT chr11 5388110 5388133 5388130 +
ttgaatattgaaataattattgaa

SEQ ID NO: 65159 - DNA, 24 bp, Artificial Sequence
  Synthetic oligonucleotide; AAAGGATT chr11 5388161 5388184 5388181 +
taataatttattcaaataatattt

SEQ ID NO: 65160 - DNA, 24 bp, Artificial Sequence
  Synthetic oligonucleotide; CAAAGATT chr11 5388443 5388466 5388463 +
ttatattagtagaagttaactaga

SEQ ID NO: 65161 - DNA, 24 bp, Artificial Sequence
  Synthetic oligonucleotide; TGGTGATT chr11 5388848 5388871 5388868 +
tcagtaaacagaaaccctaggact

SEQ ID NO: 65162 - DNA, 24 bp, Artificial Sequence
  Synthetic oligonucleotide; GGTTGATT chr11 5388856 5388879 5388876 +
cagaaaccctaggacttggtgatt

SEQ ID NO: 65163 - DNA, 24 bp, Artificial Sequence
  Synthetic oligonucleotide; GTGAGATT chr11 5389228 5389251 5389248 +
tatcaaagaaagttcaataaagta

SEQ ID NO: 65164 - DNA, 24 bp, Artificial Sequence
  Synthetic oligonucleotide; CCTGGATT chr11 5389462 5389485 5389482 +
cccatattctatctcaccagcttt

SEQ ID NO: 65165 - DNA, 24 bp, Artificial Sequence
  Synthetic oligonucleotide; ACTGGATT chr11 5389484 5389507 5389504 +
ttcctggattggaaggcatcaaac

SEQ ID NO: 65166 - DNA, 24 bp, Artificial Sequence
  Synthetic oligonucleotide; TAAAGATT chr11 5390444 5390467 5390464 +
agtattgagtatatagcatgctct

SEQ ID NO: 65167 - DNA, 24 bp, Artificial Sequence
  Synthetic oligonucleotide; CTTAGATT chr11 5390528 5390551 5390548 +
ctttaaaaaactgaacttctcttg

SEQ ID NO: 65168 - DNA, 24 bp, Artificial Sequence
  Synthetic oligonucleotide; CTCTGATT chr11 5390994 5391017 5391014 +
gatcctatccttgactcctctcat

SEQ ID NO: 65169 - DNA, 24 bp, Artificial Sequence
  Synthetic oligonucleotide; GGAGGATT chr11 5391774 5391797 5391794 +
ccagcactttgggagaccaaggtg

SEQ ID NO: 65170 - DNA, 24 bp, Artificial Sequence
  Synthetic oligonucleotide; AGAAGATT chr11 5391817 5391840 5391837 +
ggagtttgagaccaacttcaggca

SEQ ID NO: 65171 - DNA, 24 bp, Artificial Sequence
  Synthetic oligonucleotide; CCCCGATT chr11 5392028 5392051 5392048 +
tactgcctgggtgaccaagtgaga

SEQ ID NO: 65172 - DNA, 24 bp, Artificial Sequence
  Synthetic oligonucleotide; TTAGGATT chr11 5392393 5392416 5392413 +
ttggtagaatggggtacaaaaaat

SEQ ID NO: 65173 - DNA, 24 bp, Artificial Sequence
  Synthetic oligonucleotide; TTTGGATT chr11 5392399 5392422 5392419 +
gaatggggtacaaaaaatttagga

SEQ ID NO: 65174 - DNA, 24 bp, Artificial Sequence
  Synthetic oligonucleotide; TTTAGATT chr11 5392405 5392428 5392425 +
ggtacaaaaaatttaggatttgga

SEQ ID NO: 65175 - DNA, 24 bp, Artificial Sequence
  Synthetic oligonucleotide; TATAGATT chr11 5393459 5393482 5393479 +
tgttatatataatcttattttcta

SEQ ID NO: 65176 - DNA, 24 bp, Artificial Sequence
  Synthetic oligonucleotide; ATACGATT chr11 5393558 5393581 5393578 +
tttacaatgactataaaaagttat

SEQ ID NO: 65177 - DNA, 24 bp, Artificial Sequence
  Synthetic oligonucleotide; ATCTGATT chr11 5393834 5393857 5393854 +
gaactgaaattcaatatcaagcgc

SEQ ID NO: 65178 - DNA, 24 bp, Artificial Sequence
  Synthetic oligonucleotide; ACTTGATT chr11 5394058 5394081 5394078 +
attgtattaaatactttttaatag

SEQ ID NO: 65179 - DNA, 24 bp, Artificial Sequence
  Synthetic oligonucleotide; TATAGATT chr11 5394074 5394097 5394094 +
tttaatagacttgattttaagagt

SEQ ID NO: 65180 - DNA, 24 bp, Artificial Sequence
  Synthetic oligonucleotide; ACTAGATT chr11 5394230 5394253 5394250 +
caataaccttatgagatggatact

SEQ ID NO: 65181 - DNA, 24 bp, Artificial Sequence
  Synthetic oligonucleotide; CACTGATT chr11 5394346 5394369 5394366 +
gtgcttgtagttttaactatgctc

SEQ ID NO: 65182 - DNA, 24 bp, Artificial Sequence
  Synthetic oligonucleotide; AGAGGATT chr11 5394953 5394976 5394973 +
gggaaaagaaaagaaagacaaaaa

SEQ ID NO: 65183 - DNA, 24 bp, Artificial Sequence
  Synthetic oligonucleotide; GGGAGATT chr11 5395161 5395184 5395181 +
attcatcaagtctgcgtccatcta

SEQ ID NO: 65184 - DNA, 24 bp, Artificial Sequence
  Synthetic oligonucleotide; GAAAGATT chr11 5395714 5395737 5395734 +
acatagtaaaaaagctaaggttta

SEQ ID NO: 65185 - DNA, 24 bp, Artificial Sequence
  Synthetic oligonucleotide; GAAGGATT chr11 5395746 5395769 5395766 +
cagtaactttgccaaagccatatg

SEQ ID NO: 65186 - DNA, 24 bp, Artificial Sequence
  Synthetic oligonucleotide; GTCAGATT chr11 5395815 5395838 5395835 +
ccaaataccttacgcttcattgtt

SEQ ID NO: 65187 - DNA, 24 bp, Artificial Sequence
  Synthetic oligonucleotide; CTAAGATT chr11 5396003 5396026 5396023 +
gtctcaatttttcagatgaagaaa

SEQ ID NO: 65188 - DNA, 24 bp, Artificial Sequence
  Synthetic oligonucleotide; TTATGATT chr11 5396054 5396077 5396074 +
tcatagagtgaagagctattgaag

SEQ ID NO: 65189 - DNA, 24 bp, Artificial Sequence
  Synthetic oligonucleotide; ACGTGATT chr11 5396273 5396296 5396293 +
tcaaattgtccctgtttgcagatg

SEQ ID NO: 65190 - DNA, 24 bp, Artificial Sequence
  Synthetic oligonucleotide; TATAGATT chr11 5396615 5396638 5396635 +
atggccatactgcccaaggtaatt

SEQ ID NO: 65191 - DNA, 24 bp, Artificial Sequence
  Synthetic oligonucleotide; ACCTGATT chr11 5396764 5396787 5396784 +
gaacaaagctggaggcatcacact

SEQ ID NO: 65192 - DNA, 24 bp, Artificial Sequence
  Synthetic oligonucleotide; AAAGGATT chr11 5396929 5396952 5396949 +
acctgagaaaaacaagaaatgggg

SEQ ID NO: 65193 - DNA, 24 bp, Artificial Sequence
  Synthetic oligonucleotide; GATGGATT chr11 5397033 5397056 5397053 +
caccttatacaaaaattaactcaa

SEQ ID NO: 65194 - DNA, 24 bp, Artificial Sequence
  Synthetic oligonucleotide; TGGTGATT chr11 5397616 5397639 5397636 +
gttcaaacattgtggaagtcagtg

SEQ ID NO: 65195 - DNA, 24 bp, Artificial Sequence
  Synthetic oligonucleotide; AAAGGATT chr11 5397687 5397710 5397707 +
catcccattactgggtatacaccc

SEQ ID NO: 65196 - DNA, 24 bp, Artificial Sequence
  Synthetic oligonucleotide; ACTGGATT chr11 5397797 5397820 5397817 +
aacccaaatgtccaacaatgatag

SEQ ID NO: 65197 - DNA, 24 bp, Artificial Sequence
  Synthetic oligonucleotide; GGGAGATT chr11 5398635 5398658 5398655 +
tatatgtcgggggagggaccaggt

SEQ ID NO: 65198 - DNA, 24 bp, Artificial Sequence
  Synthetic oligonucleotide; CTGTGATT chr11 5399299 5399322 5399319 +
aataaaaagttggaaataagctga

SEQ ID NO: 65199 - DNA, 24 bp, Artificial Sequence
  Synthetic oligonucleotide; ATAAGATT chr11 5399484 5399507 5399504 +
aaagtacgtaaagttataccgaac

SEQ ID NO: 65200 - DNA, 24 bp, Artificial Sequence
  Synthetic oligonucleotide; TTCTGATT chr11 5399552 5399575 5399572 +
tcactgtcccacattctacttttt

SEQ ID NO: 65201 - DNA, 24 bp, Artificial Sequence
  Synthetic oligonucleotide; GAATGATT chr11 5399655 5399678 5399675 +
gtcaaacaaatcctaaactcagga

SEQ ID NO: 65202 - DNA, 24 bp, Artificial Sequence
  Synthetic oligonucleotide; TCAAGATT chr11 5399845 5399868 5399865 +
agagactctagtttcaagtatcag

SEQ ID NO: 65203 - DNA, 24 bp, Artificial Sequence
  Synthetic oligonucleotide; CAAGGATT chr11 5399914 5399937 5399934 +
gcaagatacagggtgcagtgggat

SEQ ID NO: 65204 - DNA, 24 bp, Artificial Sequence
  Synthetic oligonucleotide; TTAGGATT chr11 5399671 5399694 5399674 -
taaaacacaatcattctcctgagt

SEQ ID NO: 65205 - DNA, 24 bp, Artificial Sequence
  Synthetic oligonucleotide; ATGTGATT chr11 5399084 5399107 5399087 -
ttttccatctgccaccaatttagg

SEQ ID NO: 65206 - DNA, 24 bp, Artificial Sequence
  Synthetic oligonucleotide; TGGGGATT chr11 5398951 5398974 5398954 -
aatgctgcttcagaaggcagggct

SEQ ID NO: 65207 - DNA, 24 bp, Artificial Sequence
  Synthetic oligonucleotide; TAGGGATT chr11 5398637 5398660 5398640 -
ccacctggtccctcccccgacata

SEQ ID NO: 65208 - DNA, 24 bp, Artificial Sequence
  Synthetic oligonucleotide; TGGGGATT chr11 5398628 5398651 5398631 -
ccctcccccgacatatagggatta

SEQ ID NO: 65209 - DNA, 24 bp, Artificial Sequence
  Synthetic oligonucleotide; GCATGATT chr11 5397730 5397753 5397733 -
acgtgtgcatgtgtctttatagca

SEQ ID NO: 65210 - DNA, 24 bp, Artificial Sequence
  Synthetic oligonucleotide; TAATGATT chr11 5397536 5397559 5397539 -
agcacctgttgtttcctgactttt

SEQ ID NO: 65211 - DNA, 24 bp, Artificial Sequence
  Synthetic oligonucleotide; TTTTGATT chr11 5397491 5397514 5397494 -
gtgtgagatggtatctcattgtgg

SEQ ID NO: 65212 - DNA, 24 bp, Artificial Sequence
  Synthetic oligonucleotide; TGTAGATT chr11 5397336 5397359 5397339 -
tcttgtaaatttgtttgagttcat

SEQ ID NO: 65213 - DNA, 24 bp, Artificial Sequence
  Synthetic oligonucleotide; AGTAGATT chr11 5397303 5397326 5397306 -
tggatattagccctttgtcagatg

SEQ ID NO: 65214 - DNA, 24 bp, Artificial Sequence
  Synthetic oligonucleotide; TTAGGATT chr11 5396757 5396780 5396760 -
tgcctccagctttgttcttttggc

SEQ ID NO: 65215 - DNA, 24 bp, Artificial Sequence
  Synthetic oligonucleotide; GTTGGATT chr11 5396495 5396518 5396498 -
agaggtccttcacatcccttgtaa

SEQ ID NO: 65216 - DNA, 24 bp, Artificial Sequence
  Synthetic oligonucleotide; TTGTGATT chr11 5396407 5396430 5396410 -
tctgttattggtgtataagaatgc

SEQ ID NO: 65217 - DNA, 24 bp, Artificial Sequence
  Synthetic oligonucleotide; CATTGATT chr11 5396393 5396416 5396396 -
ataagaatgcttgtgatttttgca

SEQ ID NO: 65218 - DNA, 24 bp, Artificial Sequence
  Synthetic oligonucleotide; AGGGGATT chr11 5396346 5396369 5396349 -
ttgctgaagttgcttatcagctta

SEQ ID NO: 65219 - DNA, 24 bp, Artificial Sequence
  Synthetic oligonucleotide; GCCCGATT chr11 5396231 5396254 5396234 -
gaatgccttttatttccttctcct

SEQ ID NO: 65220 - DNA, 24 bp, Artificial Sequence
  Synthetic oligonucleotide; CTATGATT chr11 5396060 5396083 5396063 -
tcataacttcaatagctcttcact

SEQ ID NO: 65221 - DNA, 24 bp, Artificial Sequence
  Synthetic oligonucleotide; ATCTGATT chr11 5396043 5396066 5396046 -
cttcactctatgattgtgcaaagt

SEQ ID NO: 65222 - DNA, 24 bp, Artificial Sequence
  Synthetic oligonucleotide; CATAGATT chr11 5395989 5396012 5395992 -
aaattgagacaattctacctactc

SEQ ID NO: 65223 - DNA, 24 bp, Artificial Sequence
  Synthetic oligonucleotide; AAAAGATT chr11 5395862 5395885 5395865 -
agcaatgttgcagtgagctctaag

SEQ ID NO: 65224 - DNA, 24 bp, Artificial Sequence
  Synthetic oligonucleotide; GAAAGATT chr11 5395713 5395736 5395716 -
aaaccttagcttttttactatgtt

SEQ ID NO: 65225 - DNA, 24 bp, Artificial Sequence
  Synthetic oligonucleotide; AAATGATT chr11 5395676 5395699 5395679 -
atgggccctgcctcttttcgagag

SEQ ID NO: 65226 - DNA, 24 bp, Artificial Sequence
  Synthetic oligonucleotide; CTGAGATT chr11 5395602 5395625 5395605 -
aagcttcatcaattggagcaattg

SEQ ID NO: 65227 - DNA, 24 bp, Artificial Sequence
  Synthetic oligonucleotide; AACAGATT chr11 5395473 5395496 5395476 -
atatgatagaacagcagccctaac

SEQ ID NO: 65228 - DNA, 24 bp, Artificial Sequence
  Synthetic oligonucleotide; GAGGGATT chr11 5395155 5395178 5395158 -
gacgcagacttgatgaatgtcaaa

SEQ ID NO: 65229 - DNA, 24 bp, Artificial Sequence
  Synthetic oligonucleotide; TAAAGATT chr11 5394513 5394536 5394516 -
ggatattaaataacgggatagttg

SEQ ID NO: 65230 - DNA, 24 bp, Artificial Sequence
  Synthetic oligonucleotide; AGATGATT chr11 5394465 5394488 5394468 -
taggcttgtgctgaggaatgggcc

SEQ ID NO: 65231 - DNA, 24 bp, Artificial Sequence
  Synthetic oligonucleotide; GGCTGATT chr11 5394417 5394440 5394420 -
attagcaggaatatgtacagcttt

SEQ ID NO: 65232 - DNA, 24 bp, Artificial Sequence
  Synthetic oligonucleotide; TAATGATT chr11 5393824 5393847 5393827 -
ttgaatttcagttctgacttacat

SEQ ID NO: 65233 - DNA, 24 bp, Artificial Sequence
  Synthetic oligonucleotide; TTTAGATT chr11 5393550 5393573 5393553 -
ttatagtcattgtaaaatgctctt

SEQ ID NO: 65234 - DNA, 24 bp, Artificial Sequence
  Synthetic oligonucleotide; ATAAGATT chr11 5393477 5393500 5393480 -
aagatagagaaatctatatagaaa

SEQ ID NO: 65235 - DNA, 24 bp, Artificial Sequence
  Synthetic oligonucleotide; TAGTGATT chr11 5393419 5393442 5393422 -
tacaaatatttatagccttttaca

SEQ ID NO: 65236 - DNA, 24 bp, Artificial Sequence
  Synthetic oligonucleotide; CTTTGATT chr11 5393313 5393336 5393316 -
ataatagtgtatcaaatgaatatg

SEQ ID NO: 65237 - DNA, 24 bp, Artificial Sequence
  Synthetic oligonucleotide; GATGGATT chr11 5393181 5393204 5393184 -
tatttattgatcactgacctagga

SEQ ID NO: 65238 - DNA, 24 bp, Artificial Sequence
  Synthetic oligonucleotide; GACAGATT chr11 5393095 5393118 5393098 -
atttttaatttatcatttatttag

SEQ ID NO: 65239 - DNA, 24 bp, Artificial Sequence
  Synthetic oligonucleotide; CTGGGATT chr11 5392665 5392688 5392668 -
cacccgcctcggcctcccagagtg

SEQ ID NO: 65240 - DNA, 24 bp, Artificial Sequence
  Synthetic oligonucleotide; TATTGATT chr11 5392628 5392651 5392631 -
cgtgagccaccgcgcccagccaga

SEQ ID NO: 65241 - DNA, 24 bp, Artificial Sequence
  Synthetic oligonucleotide; GTGTGATT chr11 5392028 5392051 5392031 -
tctcacttggtcacccaggcagta

SEQ ID NO: 65242 - DNA, 24 bp, Artificial Sequence
  Synthetic oligonucleotide; CTGGGATT chr11 5391778 5391801 5391781 -
ctcccaccttggtctcccaaagtg

SEQ ID NO: 65243 - DNA, 24 bp, Artificial Sequence
  Synthetic oligonucleotide; TCTTGATT chr11 5391439 5391462 5391442 -
agacatgcctaattcctccaggga

SEQ ID NO: 65244 - DNA, 24 bp, Artificial Sequence
  Synthetic oligonucleotide; CAAGGATT chr11 5391243 5391266 5391246 -
gcaatttcaaagctgagacccctg

SEQ ID NO: 65245 - DNA, 24 bp, Artificial Sequence
  Synthetic oligonucleotide; ATGGGATT chr11 5391173 5391196 5391176 -
gtaaagtttatttcctcctgagca

SEQ ID NO: 65246 - DNA, 24 bp, Artificial Sequence
  Synthetic oligonucleotide; ATATGATT chr11 5390309 5390332 5390312 -
ggatctccttggtcttaatgctgt

SEQ ID NO: 65247 - DNA, 24 bp, Artificial Sequence
  Synthetic oligonucleotide; TACAGATT chr11 5390028 5390051 5390031 -
gtgaaaactaccaccatcagtcca

SEQ ID NO: 65248 - DNA, 24 bp, Artificial Sequence
  Synthetic oligonucleotide; TCTGGATT chr11 5389736 5389759 5389739 -
aggaaaaagagtggatgcagaaca

SEQ ID NO: 65249 - DNA, 24 bp, Artificial Sequence
  Synthetic oligonucleotide; CGGGGATT chr11 5389395 5389418 5389398 -
agcgaatattggactgacattcct

SEQ ID NO: 65250 - DNA, 24 bp, Artificial Sequence
  Synthetic oligonucleotide; CCATGATT chr11 5389069 5389092 5389072 -
atttcttcttaatgtcatccacta

SEQ ID NO: 65251 - DNA, 24 bp, Artificial Sequence
  Synthetic oligonucleotide; TTTTGATT chr11 5388999 5389022 5389002 -
aattccagaacttgtctttctctc

SEQ ID NO: 65252 - DNA, 24 bp, Artificial Sequence
  Synthetic oligonucleotide; TAGGGATT chr11 5388227 5388250 5388230 -
cttttttaattttaatattagctc

SEQ ID NO: 65253 - DNA, 24 bp, Artificial Sequence
  Synthetic oligonucleotide; AATTGATT chr11 5388089 5388112 5388092 -
caattatttcaataattattcatt

SEQ ID NO: 65254 - DNA, 24 bp, Artificial Sequence
  Synthetic oligonucleotide; TATTGATT chr11 5387294 5387317 5387297 -
gagagtcttaatcatacctgcttt

SEQ ID NO: 65255 - DNA, 24 bp, Artificial Sequence
  Synthetic oligonucleotide; TTCTGATT chr11 5387198 5387221 5387201 -
taatgccaagatctgctggttctc

SEQ ID NO: 65256 - DNA, 24 bp, Artificial Sequence
  Synthetic oligonucleotide; ACCTGATT chr11 5386920 5386943 5386923 -
tgagcccagcatccatcttttcac

SEQ ID NO: 65257 - DNA, 24 bp, Artificial Sequence
  Synthetic oligonucleotide; CCGAGATT chr11 5386642 5386665 5386645 -
ttggtccatcctctactgcagcca

SEQ ID NO: 65258 - DNA, 24 bp, Artificial Sequence
  Synthetic oligonucleotide; ACATGATT chr11 5386511 5386534 5386514 -
gatagtccaatttattgaggccat

SEQ ID NO: 65259 - DNA, 24 bp, Artificial Sequence
  Synthetic oligonucleotide; TATAGATT chr11 5385885 5385908 5385888 -
ataagtttaaataacatataagtg

SEQ ID NO: 65260 - DNA, 24 bp, Artificial Sequence
  Synthetic oligonucleotide; TATAGATT chr11 5385814 5385837 5385817 -
acattatatattctttatatactt

SEQ ID NO: 65261 - DNA, 24 bp, Artificial Sequence
  Synthetic oligonucleotide; AGTTGATT chr11 5385584 5385607 5385587 -
accaacctaataattcatttttta

SEQ ID NO: 65262 - DNA, 24 bp, Artificial Sequence
  Synthetic oligonucleotide; TCCTGATT chr11 5385453 5385476 5385456 -
aataaataaagtactcacctctta

SEQ ID NO: 65263 - DNA, 24 bp, Artificial Sequence
  Synthetic oligonucleotide; CTGGGATT chr11 5385331 5385354 5385334 -
gtctatacagagacaatgacaggg

SEQ ID NO: 65264 - DNA, 24 bp, Artificial Sequence
  Synthetic oligonucleotide; AGGGGATT chr11 5385281 5385304 5385284 -
acttcctcttgggaagaaagcttt

SEQ ID NO: 65265 - DNA, 24 bp, Artificial Sequence
  Synthetic oligonucleotide; AGTAGATT chr11 5385139 5385162 5385142 -
acataattaaaatattcaaggcag

SEQ ID NO: 65266 - DNA, 24 bp, Artificial Sequence
  Synthetic oligonucleotide; AAGAGATT chr11 5385101 5385124 5385104 -
agatcacaggagaaaattcctgaa

SEQ ID NO: 65267 - DNA, 24 bp, Artificial Sequence
  Synthetic oligonucleotide; ACCAGATT chr11 5384927 5384950 5384930 -
ctgcacctaaacacaaggacttga

SEQ ID NO: 65268 - DNA, 24 bp, Artificial Sequence
  Synthetic oligonucleotide; GGAGGATT chr11 5384840 5384863 5384843 -
catgcctgtttttagtaggataga

SEQ ID NO: 65269 - DNA, 24 bp, Artificial Sequence
  Synthetic oligonucleotide; TTTGGATT chr11 5384782 5384805 5384785 -
tactggggaagttacaaggtgttg

SEQ ID NO: 65270 - DNA, 24 bp, Artificial Sequence
  Synthetic oligonucleotide; AGCAGATT chr11 5384768 5384791 5384771 -
caaggtgttgtttggattaaaata

SEQ ID NO: 65271 - DNA, 24 bp, Artificial Sequence
  Synthetic oligonucleotide; AAGAGATT chr11 5384404 5384427 5384407 -
gtgcatagactctgagaatatcag

SEQ ID NO: 65272 - DNA, 24 bp, Artificial Sequence
  Synthetic oligonucleotide; GGAGGATT chr11 5384283 5384306 5384286 -
ctggcaacttggaagaataaggtg

SEQ ID NO: 65273 - DNA, 24 bp, Artificial Sequence
  Synthetic oligonucleotide; CTATGATT chr11 5384246 5384269 5384249 -
aatccggtttgagtttacagtgag

SEQ ID NO: 65274 - DNA, 24 bp, Artificial Sequence
  Synthetic oligonucleotide; GAAGGATT chr11 5383804 5383827 5383807 -
aggcacaaggctgtggctgtcaca

SEQ ID NO: 65275 - DNA, 24 bp, Artificial Sequence
  Synthetic oligonucleotide; AGAGGATT chr11 5383474 5383497 5383477 -
agagaggtcggatgtagtatatga

SEQ ID NO: 65276 - DNA, 24 bp, Artificial Sequence
  Synthetic oligonucleotide; TCAAGATT chr11 5383398 5383421 5383401 -
tgaagcaccacaatcaccactact

SEQ ID NO: 65277 - DNA, 24 bp, Artificial Sequence
  Synthetic oligonucleotide; GGTTGATT chr11 5382921 5382944 5382924 -
tattacatcctttaaatagggcat

SEQ ID NO: 65278 - DNA, 24 bp, Artificial Sequence
  Synthetic oligonucleotide; ACATGATT chr11 5382580 5382603 5382583 -
cagaaaatcctgcatttattaaga

SEQ ID NO: 65279 - DNA, 24 bp, Artificial Sequence
  Synthetic oligonucleotide; ATAAGATT chr11 5382224 5382247 5382227 -
agttgtttatgtgttttgagaact

SEQ ID NO: 65280 - DNA, 24 bp, Artificial Sequence
  Synthetic oligonucleotide; GAAGGATT chr11 5382029 5382052 5382032 -
gagtacattgttaacaatatgcag

SEQ ID NO: 65281 - DNA, 24 bp, Artificial Sequence
  Synthetic oligonucleotide; AATAGATT chr11 5381806 5381829 5381809 -
taattgaaggaccagtttccaagc

SEQ ID NO: 65282 - DNA, 24 bp, Artificial Sequence
  Synthetic oligonucleotide; TTTTGATT chr11 5381767 5381790 5381770 -
aaaccaaatgaaagaactcagcat

SEQ ID NO: 65283 - DNA, 24 bp, Artificial Sequence
  Synthetic oligonucleotide; TTTAGATT chr11 5381739 5381762 5381742 -
gattctttattgctctaaatgacc

SEQ ID NO: 65284 - DNA, 24 bp, Artificial Sequence
  Synthetic oligonucleotide; GACAGATT chr11 5381603 5381626 5381606 -
actctgatcaagaacttgaagata

SEQ ID NO: 65285 - DNA, 24 bp, Artificial Sequence
  Synthetic oligonucleotide; GTTAGATT chr11 5381549 5381572 5381552 -
atgaagctcacattgagtaaagat

SEQ ID NO: 65286 - DNA, 24 bp, Artificial Sequence
  Synthetic oligonucleotide; AGGAGATT chr11 5381009 5381032 5381012 -
ccactgagccaggcttggtgaagt

SEQ ID NO: 65287 - DNA, 24 bp, Artificial Sequence
  Synthetic oligonucleotide; TTCAGATT chr11 5380674 5380697 5380677 -
agagagataggttttcttagcttt

SEQ ID NO: 65288 - DNA, 24 bp, Artificial Sequence
  Synthetic oligonucleotide; TTAGGATT chr11 5380374 5380397 5380377 -
tcagactggagagacccacagaag

SEQ ID NO: 65289 - DNA, 24 bp, Artificial Sequence
  Synthetic oligonucleotide; AACCGATT chr11 5380151 5380174 5380154 -
ctctcttcagtcattatgaaaggg

SEQ ID NO: 65290 - DNA, 24 bp, Artificial Sequence
  Synthetic oligonucleotide; TTTTGATT chr11 5380044 5380067 5380047 -
taaagttttagtgtattttgcata

SEQ ID NO: 65291 - DNA, 24 bp, Artificial Sequence
  Synthetic oligonucleotide; TCATGATT chr11 5379975 5379998 5379978 -
tttttttttaaagttttgtttggt

SEQ ID NO: 65292 - DNA, 24 bp, Artificial Sequence
  Synthetic oligonucleotide; AATGGATT chr11 5379753 5379776 5379756 -
ttagaattctaaaaggaaacaaaa

SEQ ID NO: 65293 - DNA, 24 bp, Artificial Sequence
  Synthetic oligonucleotide; TTAAGATT chr11 5379453 5379476 5379456 -
tttatttattattattattatact

SEQ ID NO: 65294 - DNA, 24 bp, Artificial Sequence
  Synthetic oligonucleotide; TGATGATT chr11 5379189 5379212 5379192 -
gtccttgcgatagtttactgagaa

SEQ ID NO: 65295 - DNA, 24 bp, Artificial Sequence
  Synthetic oligonucleotide; GCATGATT chr11 5378991 5379014 5378994 -
acgtgtgcatgtgtctttatagca

SEQ ID NO: 65296 - DNA, 24 bp, Artificial Sequence
  Synthetic oligonucleotide; TAATGATT chr11 5378797 5378820 5378800 -
agcacctgttgtttcctgactttt

SEQ ID NO: 65297 - DNA, 24 bp, Artificial Sequence
  Synthetic oligonucleotide; TTTTGATT chr11 5378752 5378775 5378755 -
gtatgagatggtatctcattgtgg

SEQ ID NO: 65298 - DNA, 24 bp, Artificial Sequence
  Synthetic oligonucleotide; TATAGATT chr11 5378593 5378616 5378596 -
tcttgtaaatttgtttgagttcat

SEQ ID NO: 65299 - DNA, 24 bp, Artificial Sequence
  Synthetic oligonucleotide; TTAGGATT chr11 5378014 5378037 5378017 -
tgcctccagctttgttcttttggc

SEQ ID NO: 65300 - DNA, 24 bp, Artificial Sequence
  Synthetic oligonucleotide; TATTGATT chr11 5377865 5377888 5377868 -
tgggcattatggccattttgatga

SEQ ID NO: 65301 - DNA, 24 bp, Artificial Sequence
  Synthetic oligonucleotide; GTTGGATT chr11 5377748 5377771 5377751 -
agaggtccttcacatcccttgtaa

SEQ ID NO: 65302 - DNA, 24 bp, Artificial Sequence
  Synthetic oligonucleotide; TCATGATT chr11 5377694 5377717 5377697 -
aagcaattgtgaatgggagttccc

SEQ ID NO: 65303 - DNA, 24 bp, Artificial Sequence
  Synthetic oligonucleotide; TTGTGATT chr11 5377648 5377671 5377651 -
tctgttattggtgtataagaatgc

SEQ ID NO: 65304 - DNA, 24 bp, Artificial Sequence
  Synthetic oligonucleotide; AGGAGATT chr11 5377587 5377610 5377590 -
ttgctgaagttgcttatcagctta

SEQ ID NO: 65305 - DNA, 24 bp, Artificial Sequence
  Synthetic oligonucleotide; GCTGGATT chr11 5377184 5377207 5377187 -
ttttgtctttggttctgtttatat

SEQ ID NO: 65306 - DNA, 24 bp, Artificial Sequence
  Synthetic oligonucleotide; TATTGATT chr11 5377171 5377194 5377174 -
tctgtttatatgctggattacatt

SEQ ID NO: 65307 - DNA, 24 bp, Artificial Sequence
  Synthetic oligonucleotide; GCTGGATT chr11 5377088 5377111 5377091 -
cgtggataagctttttgatgtgct

SEQ ID NO: 65308 - DNA, 24 bp, Artificial Sequence
  Synthetic oligonucleotide; TGAGGATT chr11 5377061 5377084 5377064 -
ggattcggtttgccagtattttat

SEQ ID NO: 65309 - DNA, 24 bp, Artificial Sequence
  Synthetic oligonucleotide; GGAGGATT chr11 5376947 5376970 5376950 -
tgctggcctcataaaatgagttag

SEQ ID NO: 65310 - DNA, 24 bp, Artificial Sequence
  Synthetic oligonucleotide; TGTTGATT chr11 5376928 5376951 5376931 -
gttagggaggattccttctttttc

SEQ ID NO: 65311 - DNA, 24 bp, Artificial Sequence
  Synthetic oligonucleotide; TATTGATT chr11 5376821 5376844 5376824 -
ctggactctttttggttggtaagc

SEQ ID NO: 65312 - DNA, 24 bp, Artificial Sequence
  Synthetic oligonucleotide; CAGAGATT chr11 5376778 5376801 5376781 -
ttcagatcctgttattggtctatt

SEQ ID NO: 65313 - DNA, 24 bp, Artificial Sequence
  Synthetic oligonucleotide; TCTAGATT chr11 5376711 5376734 5376714 -
gtgtccaggaatttatccatttct

SEQ ID NO: 65314 - DNA, 24 bp, Artificial Sequence
  Synthetic oligonucleotide; ATTTGATT chr11 5376599 5376622 5376602 -
ctttatcatttttttattgtgtct

SEQ ID NO: 65315 - DNA, 24 bp, Artificial Sequence
  Synthetic oligonucleotide; CCCAGATT chr11 5376523 5376546 5376526 -
gttgatcctttcaaaaaaccagct

SEQ ID NO: 65316 - DNA, 24 bp, Artificial Sequence
  Synthetic oligonucleotide; CTCTGATT chr11 5376467 5376490 5376470 -
gtgtctctgtttccttcagttctg

SEQ ID NO: 65317 - DNA, 24 bp, Artificial Sequence
  Synthetic oligonucleotide; CACTGATT chr11 5376316 5376339 5376319 -
tagtgctataaatttccccctaca

SEQ ID NO: 65318 - DNA, 24 bp, Artificial Sequence
  Synthetic oligonucleotide; CAGAGATT chr11 5376297 5376320 5376300 -
ctacacactgattcgaatgtgtcc

SEQ ID NO: 65319 - DNA, 24 bp, Artificial Sequence
  Synthetic oligonucleotide; GTTTGATT chr11 5376137 5376160 5376140 -
tgagtttcttaatcctgagttcta

SEQ ID NO: 65320 - DNA, 24 bp, Artificial Sequence
  Synthetic oligonucleotide; TGTTGATT chr11 5376000 5376023 5376003 -
ggtgctgaaaaaaaatgtatattc

SEQ ID NO: 65321 - DNA, 24 bp, Artificial Sequence
  Synthetic oligonucleotide; CTAGGATT chr11 5375665 5375688 5375668 -
gtttaaagcctgttttatcagaga

SEQ ID NO: 65322 - DNA, 24 bp, Artificial Sequence
  Synthetic oligonucleotide; GCCTGATT chr11 5375383 5375406 5375386 -
agtcttgatggtcttcacattttg

SEQ ID NO: 65323 - DNA, 24 bp, Artificial Sequence
  Synthetic oligonucleotide; GCTAGATT chr11 5374945 5374968 5374948 -
tgaatctgaatgttggcctgcctt

SEQ ID NO: 65324 - DNA, 24 bp, Artificial Sequence
  Synthetic oligonucleotide; GTTCGATT chr11 5374891 5374914 5374894 -
tcctgcagagtgttttccaacttg

SEQ ID NO: 65325 - DNA, 24 bp, Artificial Sequence
  Synthetic oligonucleotide; CCTAGATT chr11 5374852 5374875 5374855 -
tcactttcaggtacaccaatcaga

SEQ ID NO: 65326 - DNA, 24 bp, Artificial Sequence
  Synthetic oligonucleotide; CGCAGATT chr11 5374185 5374208 5374188 -
tatcagcagcggtgtctgcagaac

SEQ ID NO: 65327 - DNA, 24 bp, Artificial Sequence
  Synthetic oligonucleotide; TTGTGATT chr11 5373204 5373227 5373207 -
tctatacatgttcttccaggagtt

SEQ ID NO: 65328 - DNA, 24 bp, Artificial Sequence
  Synthetic oligonucleotide; TCAAGATT chr11 5372875 5372898 5372878 -
tgccatcaagttggtttttctttc

SEQ ID NO: 65329 - DNA, 24 bp, Artificial Sequence
  Synthetic oligonucleotide; GCTTGATT chr11 5371706 5371729 5371709 -
ttgtattgatggataggttaattt

SEQ ID NO: 65330 - DNA, 24 bp, Artificial Sequence
  Synthetic oligonucleotide; TGAAGATT chr11 5370436 5370459 5370439 -
gagacataccaacaaatgatcctc

SEQ ID NO: 65331 - DNA, 24 bp, Artificial Sequence
  Synthetic oligonucleotide; TTAGGATT chr11 5370238 5370261 5370241 -
cattaaacattcaaaccttcaact

SEQ ID NO: 65332 - DNA, 24 bp, Artificial Sequence
  Synthetic oligonucleotide; TGATGATT chr11 5370187 5370210 5370190 -
tgttaatgataataataaatacat

SEQ ID NO: 65333 - DNA, 24 bp, Artificial Sequence
  Synthetic oligonucleotide; TACAGATT chr11 5369999 5370022 5370002 -
agggaggtttgaagatcttgttga

SEQ ID NO: 65334 - DNA, 24 bp, Artificial Sequence
  Synthetic oligonucleotide; TTTGGATT chr11 5369860 5369883 5369863 -
cacttttaacaactgttgacttat

SEQ ID NO: 65335 - DNA, 24 bp, Artificial Sequence
  Synthetic oligonucleotide; CACTGATT chr11 5369811 5369834 5369814 -
taacacaaaaatgcagacaagcag

SEQ ID NO: 65336 - DNA, 24 bp, Artificial Sequence
  Synthetic oligonucleotide; GGCAGATT chr11 5369678 5369701 5369681 -
tagaaaagttgcagagaaatgtat

SEQ ID NO: 65337 - DNA, 24 bp, Artificial Sequence
  Synthetic oligonucleotide; ATCAGATT chr11 5369485 5369508 5369488 -
atacttttttaaatgtctcaaatt

SEQ ID NO: 65338 - DNA, 24 bp, Artificial Sequence
  Synthetic oligonucleotide; CTTAGATT chr11 5369127 5369150 5369130 -
cttcatcctttctgtatgtctaac

SEQ ID NO: 65339 - DNA, 24 bp, Artificial Sequence
  Synthetic oligonucleotide; CACAGATT chr11 5369077 5369100 5369080 -
ctctaggtggcccaaccaccctat

SEQ ID NO: 65340 - DNA, 24 bp, Artificial Sequence
  Synthetic oligonucleotide; TTACGATT chr11 5368593 5368616 5368596 -
gaatatcttgtgtaacttcaagta

SEQ ID NO: 65341 - DNA, 24 bp, Artificial Sequence
  Synthetic oligonucleotide; TGATGATT chr11 5368484 5368507 5368487 -
gtctcattttcacaaaattttcaa

SEQ ID NO: 65342 - DNA, 24 bp, Artificial Sequence
  Synthetic oligonucleotide; CAATGATT chr11 5368463 5368486 5368466 -
caatgatgattatagtaataatag

SEQ ID NO: 65343 - DNA, 24 bp, Artificial Sequence
  Synthetic oligonucleotide; GTGGGATT chr11 5368278 5368301 5368281 -
gggtacgcagccaataagtggaag

SEQ ID NO: 65344 - DNA, 24 bp, Artificial Sequence
  Synthetic oligonucleotide; ACAGGATT chr11 5368178 5368201 5368181 -
ttcaagaagcctacagaacactta

SEQ ID NO: 65345 - DNA, 24 bp, Artificial Sequence
  Synthetic oligonucleotide; GTCTGATT chr11 5367966 5367989 5367969 -
ggtagaagtgaaactttgaagaat

SEQ ID NO: 65346 - DNA, 24 bp, Artificial Sequence
  Synthetic oligonucleotide; TCAAGATT chr11 5367914 5367937 5367917 -
ggataggaaaatgcatagccttgg

SEQ ID NO: 65347 - DNA, 24 bp, Artificial Sequence
  Synthetic oligonucleotide; CCAAGATT chr11 5367573 5367596 5367576 -
agaagctggctgaaacccaccaaa

SEQ ID NO: 65348 - DNA, 24 bp, Artificial Sequence
  Synthetic oligonucleotide; TATGGATT chr11 5367305 5367328 5367308 -
aattaacttgctttcacttttctg

SEQ ID NO: 65349 - DNA, 24 bp, Artificial Sequence
  Synthetic oligonucleotide; TCTGGATT chr11 5367248 5367271 5367251 -
aaatccaagaaccctctcttaggg

SEQ ID NO: 65350 - DNA, 24 bp, Artificial Sequence
  Synthetic oligonucleotide; AAATGATT chr11 5367194 5367217 5367197 -
tttaacttcaaaaatctcctttca

SEQ ID NO: 65351 - DNA, 24 bp, Artificial Sequence
  Synthetic oligonucleotide; TTGGGATT chr11 5366836 5366859 5366839 -
cctgcattgcacagagacccgtgc

SEQ ID NO: 65352 - DNA, 24 bp, Artificial Sequence
  Synthetic oligonucleotide; CCCTGATT chr11 5366752 5366775 5366755 -
aagactttgaatctcaagtgaata

SEQ ID NO: 65353 - DNA, 24 bp, Artificial Sequence
  Synthetic oligonucleotide; AAGCGATT chr11 5366528 5366551 5366531 -
ctgcaacctccgcctcccaggttc

SEQ ID NO: 65354 - DNA, 24 bp, Artificial Sequence
  Synthetic oligonucleotide; CTGGGATT chr11 5366359 5366382 5366362 -
ctcctgcctcagccacccaaagtg

SEQ ID NO: 65355 - DNA, 24 bp, Artificial Sequence
  Synthetic oligonucleotide; TTCAGATT chr11 5366279 5366302 5366282 -
gaggaaccttcccttgagctcctt

SEQ ID NO: 65356 - DNA, 24 bp, Artificial Sequence
  Synthetic oligonucleotide; TACTGATT chr11 5366223 5366246 5366226 -
tctcctttgtcttctatactttcc

SEQ ID NO: 65357 - DNA, 24 bp, Artificial Sequence
  Synthetic oligonucleotide; TGCTGATT chr11 5366054 5366077 5366057 -
tcttccattaacagcccccaaaca

SEQ ID NO: 65358 - DNA, 24 bp, Artificial Sequence
  Synthetic oligonucleotide; CCTGGATT chr11 5365778 5365801 5365781 -
acaatgtgggtaatggaggtgatg

SEQ ID NO: 65359 - DNA, 24 bp, Artificial Sequence
  Synthetic oligonucleotide; GTCAGATT chr11 5365632 5365655 5365635 -
atttggaggtgtgttaagacagta

SEQ ID NO: 65360 - DNA, 24 bp, Artificial Sequence
  Synthetic oligonucleotide; CAGCGATT chr11 5365436 5365459 5365439 -
ttttcatctaaatgcatctctcca

SEQ ID NO: 65361 - DNA, 24 bp, Artificial Sequence
  Synthetic oligonucleotide; GCATGATT chr11 5365092 5365115 5365095 -
cacttgaattcaaggttattacaa

SEQ ID NO: 65362 - DNA, 24 bp, Artificial Sequence
  Synthetic oligonucleotide; CCAAGATT chr11 5365046 5365069 5365049 -
ttttattgagtgtcccttatttgc

SEQ ID NO: 65363 - DNA, 24 bp, Artificial Sequence
  Synthetic oligonucleotide; CAATGATT chr11 5364917 5364940 5364920 -
cttgtgtatccaccatagaagcta

SEQ ID NO: 65364 - DNA, 24 bp, Artificial Sequence
  Synthetic oligonucleotide; TCAAGATT chr11 5364305 5364328 5364308 -
ccaaattccaatggttttgtgaag

SEQ ID NO: 65365 - DNA, 24 bp, Artificial Sequence
  Synthetic oligonucleotide; ATAAGATT chr11 5363655 5363678 5363658 -
agagttgttctttttctgtgtcac

SEQ ID NO: 65366 - DNA, 24 bp, Artificial Sequence
  Synthetic oligonucleotide; TTATGATT chr11 5363498 5363521 5363501 -
gagctgagtggtggtgatgtgtgt

SEQ ID NO: 65367 - DNA, 24 bp, Artificial Sequence
  Synthetic oligonucleotide; TGGTGATT chr11 5363409 5363432 5363412 -
taagggcttaaaggaacaattaat

SEQ ID NO: 65368 - DNA, 24 bp, Artificial Sequence
  Synthetic oligonucleotide; AAATGATT chr11 5363189 5363212 5363192 -
cacttgagatcctgtattgatgaa

SEQ ID NO: 65369 - DNA, 24 bp, Artificial Sequence
  Synthetic oligonucleotide; CAGGGATT chr11 5362891 5362914 5362894 -
gaaagaaaacttaatttacaaaag

SEQ ID NO: 65370 - DNA, 24 bp, Artificial Sequence
  Synthetic oligonucleotide; TTCTGATT chr11 5362493 5362516 5362496 -
aattatatctaacaatgttatcta

SEQ ID NO: 65371 - DNA, 24 bp, Artificial Sequence
  Synthetic oligonucleotide; ACCTGATT chr11 5362470 5362493 5362473 -
attctgattcatagtatccagtag

SEQ ID NO: 65372 - DNA, 24 bp, Artificial Sequence
  Synthetic oligonucleotide; AGTTGATT chr11 5362353 5362376 5362356 -
cactaaattcctgaccatcttcgt

SEQ ID NO: 65373 - DNA, 24 bp, Artificial Sequence
  Synthetic oligonucleotide; TAAGGATT chr11 5362113 5362136 5362116 -
caagctctctctgactttggttta

SEQ ID NO: 65374 - DNA, 24 bp, Artificial Sequence
  Synthetic oligonucleotide; CGTGGATT chr11 5361786 5361809 5361789 -
accagagatatcattctgtattcc

SEQ ID NO: 65375 - DNA, 24 bp, Artificial Sequence
  Synthetic oligonucleotide; ACTTGATT chr11 5361774 5361797 5361777 -
attctgtattcccgtggattttca

SEQ ID NO: 65376 - DNA, 24 bp, Artificial Sequence
  Synthetic oligonucleotide; CTAGGATT chr11 5361723 5361746 5361726 -
ctgctagggaatgaaaaaggagat

SEQ ID NO: 65377 - DNA, 24 bp, Artificial Sequence
  Synthetic oligonucleotide; AAGAGATT chr11 5361692 5361715 5361695 -
tttccctcttctaggaatttgcaa

SEQ ID NO: 65378 - DNA, 24 bp, Artificial Sequence
  Synthetic oligonucleotide; TAAAGATT chr11 5361667 5361690 5361670 -
agagattattcagaagccaagttc

SEQ ID NO: 65379 - DNA, 24 bp, Artificial Sequence
  Synthetic oligonucleotide; GATAGATT chr11 5361641 5361664 5361644 -
aagattttagggagtctttgggat

SEQ ID NO: 65380 - DNA, 24 bp, Artificial Sequence
  Synthetic oligonucleotide; GAGGGATT chr11 5361315 5361338 5361318 -
cctccttctttattctcccagcct

SEQ ID NO: 65381 - DNA, 24 bp, Artificial Sequence
  Synthetic oligonucleotide; ATAAGATT chr11 5361235 5361258 5361238 -
agggaattagccacatctccagaa

SEQ ID NO: 65382 - DNA, 24 bp, Artificial Sequence
  Synthetic oligonucleotide; AGCAGATT chr11 5361170 5361193 5361173 -
atgtagggaggatggcctttttgc

SEQ ID NO: 65383 - DNA, 24 bp, Artificial Sequence
  Synthetic oligonucleotide; GCATGATT chr11 5360670 5360693 5360673 -
acatgtgcatgtgtctttatagca

SEQ ID NO: 65384 - DNA, 24 bp, Artificial Sequence
  Synthetic oligonucleotide; TTTTGATT chr11 5360431 5360454 5360434 -
gtgtgagatggtatctcactgtgg

SEQ ID NO: 65385 - DNA, 24 bp, Artificial Sequence
  Synthetic oligonucleotide; CATAGATT chr11 5360276 5360299 5360279 -
tcttgtaaatttgtttgagttcat

SEQ ID NO: 65386 - DNA, 24 bp, Artificial Sequence
  Synthetic oligonucleotide; AGTAGATT chr11 5360243 5360266 5360246 -
tggatattagccctttgtcggatg

SEQ ID NO: 65387 - DNA, 24 bp, Artificial Sequence
  Synthetic oligonucleotide; TTAGGATT chr11 5359697 5359720 5359700 -
tgcctccagctttgttcttttggc

SEQ ID NO: 65388 - DNA, 24 bp, Artificial Sequence
  Synthetic oligonucleotide; TATTGATT chr11 5359547 5359570 5359550 -
tgggctgtatggccattttcatga

SEQ ID NO: 65389 - DNA, 24 bp, Artificial Sequence
  Synthetic oligonucleotide; GTTGGATT chr11 5359430 5359453 5359433 -
agaggtccttcacctctcttgtaa

SEQ ID NO: 65390 - DNA, 24 bp, Artificial Sequence
  Synthetic oligonucleotide; TCATGATT chr11 5359376 5359399 5359379 -
aagcaattgtgaatgggagttccc

SEQ ID NO: 65391 - DNA, 24 bp, Artificial Sequence
  Synthetic oligonucleotide; TTGTGATT chr11 5359330 5359353 5359333 -
tctgttattggtgtataagaatgc

SEQ ID NO: 65392 - DNA, 24 bp, Artificial Sequence
  Synthetic oligonucleotide; CATTGATT chr11 5359316 5359339 5359319 -
ataagaatgcttgtgatttttgca

SEQ ID NO: 65393 - DNA, 24 bp, Artificial Sequence
  Synthetic oligonucleotide; GCTGGATT chr11 5358867 5358890 5358870 -
ttttgtctttggttctgtttatat

SEQ ID NO: 65394 - DNA, 24 bp, Artificial Sequence
  Synthetic oligonucleotide; TATTGATT chr11 5358854 5358877 5358857 -
tctgtttatatgctggattacatt

SEQ ID NO: 65395 - DNA, 24 bp, Artificial Sequence
  Synthetic oligonucleotide; GCTGGATT chr11 5358771 5358794 5358774 -
ggtggataagcttttggatgtgct

SEQ ID NO: 65396 - DNA, 24 bp, Artificial Sequence
  Synthetic oligonucleotide; GGAGGATT chr11 5358630 5358653 5358633 -
tgctggcctcataaaatgagttag

SEQ ID NO: 65397 - DNA, 24 bp, Artificial Sequence
  Synthetic oligonucleotide; TATTGATT chr11 5358611 5358634 5358614 -
gttagggaggattccctcttttac

SEQ ID NO: 65398 - DNA, 24 bp, Artificial Sequence
  Synthetic oligonucleotide; CAGAGATT chr11 5358461 5358484 5358464 -
ttcagatcctgttattggtctatt

SEQ ID NO: 65399 - DNA, 24 bp, Artificial Sequence
  Synthetic oligonucleotide; TCTAGATT chr11 5358394 5358417 5358397 -
gtgtcaaggaatttatccatttct

SEQ ID NO: 65400 - DNA, 24 bp, Artificial Sequence
  Synthetic oligonucleotide; ATTTGATT chr11 5358283 5358306 5358286 -
cctttatcattttttattgcatct

SEQ ID NO: 65401 - DNA, 24 bp, Artificial Sequence
  Synthetic oligonucleotide; TCTGGATT chr11 5358203 5358226 5358206 -
gttgatctttttgaaaaaccagct

SEQ ID NO: 65402 - DNA, 24 bp, Artificial Sequence
  Synthetic oligonucleotide; CATTGATT chr11 5358195 5358218 5358198 -
ttttgaaaaaccagcttctggatt

SEQ ID NO: 65403 - DNA, 24 bp, Artificial Sequence
  Synthetic oligonucleotide; CTCTGATT chr11 5358146 5358169 5358149 -
gtgtctctatttccttcagttctg

SEQ ID NO: 65404 - DNA, 24 bp, Artificial Sequence
  Synthetic oligonucleotide; CAGAGATT chr11 5357976 5357999 5357979 -
ctacacactgctttgaatgtgtcc

SEQ ID NO: 65405 - DNA, 24 bp, Artificial Sequence
  Synthetic oligonucleotide; GTTTGATT chr11 5357816 5357839 5357819 -
tgagtttcttaatcctgagttcta

SEQ ID NO: 65406 - DNA, 24 bp, Artificial Sequence
  Synthetic oligonucleotide; TGTTGATT chr11 5357680 5357703 5357683 -
tggtgctgaaaagaatgtatattc

SEQ ID NO: 65407 - DNA, 24 bp, Artificial Sequence
  Synthetic oligonucleotide; TGAGGATT chr11 5357330 5357353 5357333 -
gtttaaagcctgttttatcagaga

SEQ ID NO: 65408 - DNA, 24 bp, Artificial Sequence
  Synthetic oligonucleotide; GCTAGATT chr11 5356588 5356611 5356591 -
tgaatttgaatgttgacctgcctt

SEQ ID NO: 65409 - DNA, 24 bp, Artificial Sequence
  Synthetic oligonucleotide; TATAGATT chr11 5356495 5356518 5356498 -
tcactttcaggtacaccaatcaga

SEQ ID NO: 65410 - DNA, 24 bp, Artificial Sequence
  Synthetic oligonucleotide; CTCTGATT chr11 5356066 5356089 5356069 -
cattcctttggaggaggagaggca

SEQ ID NO: 65411 - DNA, 24 bp, Artificial Sequence
  Synthetic oligonucleotide; AGCAGATT chr11 5355907 5355930 5355910 -
cttctaacaggaccctcagcttgc

SEQ ID NO: 65412 - DNA, 24 bp, Artificial Sequence
  Synthetic oligonucleotide; AGATGATT chr11 5355688 5355711 5355691 -
caccactgaaaacataacttttac

SEQ ID NO: 65413 - DNA, 24 bp, Artificial Sequence
  Synthetic oligonucleotide; ATGTGATT chr11 5355089 5355112 5355092 -
gtaagcttcctgctgcacttggtg

SEQ ID NO: 65414 - DNA, 24 bp, Artificial Sequence
  Synthetic oligonucleotide; CTTTGATT chr11 5354894 5354917 5354897 -
gcttcgtcaaggtctcttgaatgc

SEQ ID NO: 65415 - DNA, 24 bp, Artificial Sequence
  Synthetic oligonucleotide; GAAAGATT chr11 5354290 5354313 5354293 -
cactggacctagagggtgagtcaa

SEQ ID NO: 65416 - DNA, 24 bp, Artificial Sequence
  Synthetic oligonucleotide; ACAGGATT chr11 5354223 5354246 5354226 -
cccaaaagcccaagggaagaaaga

SEQ ID NO: 65417 - DNA, 24 bp, Artificial Sequence
  Synthetic oligonucleotide; GAGGGATT chr11 5352588 5352611 5352591 -
ggtaaaataatgttctaagtagca

SEQ ID NO: 65418 - DNA, 24 bp, Artificial Sequence
  Synthetic oligonucleotide; GACTGATT chr11 5352580 5352603 5352583 -
aatgttctaagtagcagagggatt

SEQ ID NO: 65419 - DNA, 24 bp, Artificial Sequence
  Synthetic oligonucleotide; CAGGGATT chr11 5352558 5352581 5352561 -
ttgactgatttccactgaaatgct

SEQ ID NO: 65420 - DNA, 24 bp, Artificial Sequence
  Synthetic oligonucleotide; GATTGATT chr11 5352554 5352577 5352557 -
ctgatttccactgaaatgctcagg

SEQ ID NO: 65421 - DNA, 24 bp, Artificial Sequence
  Synthetic oligonucleotide; GTAAGATT chr11 5351294 5351317 5351297 -
gatattatttagggtttactctat

SEQ ID NO: 65422 - DNA, 24 bp, Artificial Sequence
  Synthetic oligonucleotide; TAAAGATT chr11 5351012 5351035 5351015 -
taagcactattggaaaagcagata

SEQ ID NO: 65423 - DNA, 24 bp, Artificial Sequence
  Synthetic oligonucleotide; CAGAGATT chr11 5350942 5350965 5350945 -
caaatacaataaaatagtaaattt

SEQ ID NO: 65424 - DNA, 24 bp, Artificial Sequence
  Synthetic oligonucleotide; TGTGGATT chr11 5350722 5350745 5350725 -
taaattgaagaataaacagtaaaa

SEQ ID NO: 65425 - DNA, 24 bp, Artificial Sequence
  Synthetic oligonucleotide; ATGGGATT chr11 5350575 5350598 5350578 -
ttttttttaaaactatggaatctg

SEQ ID NO: 65426 - DNA, 24 bp, Artificial Sequence
  Synthetic oligonucleotide; CTAAGATT chr11 5350530 5350553 5350533 -
aaggctctgtgactcattagaatt

SEQ ID NO: 65427 - DNA, 24 bp, Artificial Sequence
  Synthetic oligonucleotide; GCACGATT chr11 5350375 5350398 5350378 -
aagagcatattgatgtaaatttat

SEQ ID NO: 65428 - DNA, 24 bp, Artificial Sequence
  Synthetic oligonucleotide; CCAAGATT chr11 5350332 5350355 5350335 -
tttctgtccatgaaaagaatgcat

SEQ ID NO: 65429 - DNA, 24 bp, Artificial Sequence
  Synthetic oligonucleotide; TTGAGATT chr11 5350239 5350262 5350242 -
tgatcttgggaaagtaatttaatc

SEQ ID NO: 65430 - DNA, 24 bp, Artificial Sequence
  Synthetic oligonucleotide; TAGTGATT chr11 5350206 5350229 5350209 -
ggttacataacctgtaaagactac

SEQ ID NO: 65431 - DNA, 24 bp, Artificial Sequence
  Synthetic oligonucleotide; TCAGGATT chr11 5350064 5350087 5350067 -
ttctctttctctagtgagtacatg

SEQ ID NO: 65432 - DNA, 24 bp, Artificial Sequence
  Synthetic oligonucleotide; AAATGATT chr11 5350037 5350060 5350040 -
ggattattcacccagaggtgtgtc

SEQ ID NO: 65433 - DNA, 24 bp, Artificial Sequence
  Synthetic oligonucleotide; AAAAGATT chr11 5349878 5349901 5349881 -
gtctgggtgggaaagggaaaggag

SEQ ID NO: 65434 - DNA, 24 bp, Artificial Sequence
  Synthetic oligonucleotide; GCAGGATT chr11 5349701 5349724 5349704 -
aggttcagacaatactcagcttat

SEQ ID NO: 65435 - DNA, 24 bp, Artificial Sequence
  Synthetic oligonucleotide; AAATGATT chr11 5349620 5349643 5349623 -
gttttattataggtattcattgtt

SEQ ID NO: 65436 - DNA, 24 bp, Artificial Sequence
  Synthetic oligonucleotide; ACTTGATT chr11 5349220 5349243 5349223 -
tcatattgaaaactgagtgctttc

SEQ ID NO: 65437 - DNA, 24 bp, Artificial Sequence
  Synthetic oligonucleotide; ACTTGATT chr11 5348835 5348858 5348838 -
tgtgatggttaatattgagtgcaa

SEQ ID NO: 65438 - DNA, 24 bp, Artificial Sequence
  Synthetic oligonucleotide; ATTGGATT chr11 5348830 5348853 5348833 -
tggttaatattgagtgcaaacttg

SEQ ID NO: 65439 - DNA, 24 bp, Artificial Sequence
  Synthetic oligonucleotide; AGGAGATT chr11 5348774 5348797 5348777 -
ggtgtgctgtaagggtgttgccaa

SEQ ID NO: 65440 - DNA, 24 bp, Artificial Sequence
  Synthetic oligonucleotide; TGATGATT chr11 5348469 5348492 5348472 -
ttttctagaaagtatttgaacctc

SEQ ID NO: 65441 - DNA, 24 bp, Artificial Sequence
  Synthetic oligonucleotide; AGTTGATT chr11 5348430 5348453 5348433 -
tatacctcctcaagaatttggaag

SEQ ID NO: 65442 - DNA, 24 bp, Artificial Sequence
  Synthetic oligonucleotide; GAGAGATT chr11 5348338 5348361 5348341 -
ctctcagggttagaatggaagcca

SEQ ID NO: 65443 - DNA, 24 bp, Artificial Sequence
  Synthetic oligonucleotide; AGGAGATT chr11 5348021 5348044 5348024 -
ggttcctgcaatgagatcttacag

SEQ ID NO: 65444 - DNA, 24 bp, Artificial Sequence
  Synthetic oligonucleotide; GAAAGATT chr11 5347929 5347952 5347932 -
tgtatctcacatctttagccgtat

SEQ ID NO: 65445 - DNA, 24 bp, Artificial Sequence
  Synthetic oligonucleotide; TCCTGATT chr11 5347841 5347864 5347844 -
tagaagctcctccccagagaccat

SEQ ID NO: 65446 - DNA, 24 bp, Artificial Sequence
  Synthetic oligonucleotide; GAAAGATT chr11 5347231 5347254 5347234 -
aggctttctcttgagataaactgg

SEQ ID NO: 65447 - DNA, 24 bp, Artificial Sequence
  Synthetic oligonucleotide; GTCTGATT chr11 5347144 5347167 5347147 -
ctgctggggctatgaagacaggct

SEQ ID NO: 65448 - DNA, 24 bp, Artificial Sequence
  Synthetic oligonucleotide; GCTTGATT chr11 5347110 5347133 5347113 -
ccacacataaaggtcctaccagtg

SEQ ID NO: 65449 - DNA, 24 bp, Artificial Sequence
  Synthetic oligonucleotide; GAAAGATT chr11 5347078 5347101 5347081 -
cagccagtaacttatttgaaaaaa

SEQ ID NO: 65450 - DNA, 24 bp, Artificial Sequence
  Synthetic oligonucleotide; CACAGATT chr11 5346700 5346723 5346703 -
atagtccacagctttggatgtgtg

SEQ ID NO: 65451 - DNA, 24 bp, Artificial Sequence
  Synthetic oligonucleotide; ATATGATT chr11 5346608 5346631 5346611 -
gaccttctgtactcagtgatgtga

SEQ ID NO: 65452 - DNA, 24 bp, Artificial Sequence
  Synthetic oligonucleotide; ATCTGATT chr11 5346480 5346503 5346483 -
tatggctgtaaatgttagaagttt

SEQ ID NO: 65453 - DNA, 24 bp, Artificial Sequence
  Synthetic oligonucleotide; GAGTGATT chr11 5346301 5346324 5346304 -
caagaattttcacaaaacaaagta

SEQ ID NO: 65454 - DNA, 24 bp, Artificial Sequence
  Synthetic oligonucleotide; TAGTGATT chr11 5346155 5346178 5346158 -
ttacagtttggttagctttccctg

SEQ ID NO: 65455 - DNA, 24 bp, Artificial Sequence
  Synthetic oligonucleotide; GAAAGATT chr11 5346087 5346110 5346090 -
tttttcacaaagttgagatacagt

SEQ ID NO: 65456 - DNA, 24 bp, Artificial Sequence
  Synthetic oligonucleotide; AGGAGATT chr11 5346072 5346095 5346075 -
agatacagtgaaagattaggttaa

SEQ ID NO: 65457 - DNA, 24 bp, Artificial Sequence
  Synthetic oligonucleotide; GCTGGATT chr11 5345989 5346012 5345992 -
agaacacagaaggggaggagctaa

SEQ ID NO: 65458 - DNA, 24 bp, Artificial Sequence
  Synthetic oligonucleotide; AAATGATT chr11 5345874 5345897 5345877 -
ctaggacagaatatggatgctgaa

SEQ ID NO: 65459 - DNA, 24 bp, Artificial Sequence
  Synthetic oligonucleotide; TCTTGATT chr11 5345577 5345600 5345580 -
aattcagctatatttactaatgac

SEQ ID NO: 65460 - DNA, 24 bp, Artificial Sequence
  Synthetic oligonucleotide; ATTTGATT chr11 5345471 5345494 5345474 -
aaacagaaatctaggggaaacctc

SEQ ID NO: 65461 - DNA, 24 bp, Artificial Sequence
  Synthetic oligonucleotide; TATGGATT chr11 5345321 5345344 5345324 -
agtcaaggtcaccatgactcttca

SEQ ID NO: 65462 - DNA, 24 bp, Artificial Sequence
  Synthetic oligonucleotide; TTGTGATT chr11 5345195 5345218 5345198 -
aatatatcaccacactattttcca

SEQ ID NO: 65463 - DNA, 24 bp, Artificial Sequence
  Synthetic oligonucleotide; ACTTGATT chr11 5345096 5345119 5345099 -
tggtggtctgtaaggccctatgac

SEQ ID NO: 65464 - DNA, 24 bp, Artificial Sequence
  Synthetic oligonucleotide; TGCTGATT chr11 5345026 5345049 5345029 -
tgttttcttatcaaatgccagtca

SEQ ID NO: 65465 - DNA, 24 bp, Artificial Sequence
  Synthetic oligonucleotide; ATAAGATT chr11 5344781 5344804 5344784 -
atttttcaacttaatttatggttt

SEQ ID NO: 65466 - DNA, 24 bp, Artificial Sequence
  Synthetic oligonucleotide; AACAGATT chr11 5344484 5344507 5344487 -
tagctctcactcagtattggggag

SEQ ID NO: 65467 - DNA, 24 bp, Artificial Sequence
  Synthetic oligonucleotide; GTCAGATT chr11 5344393 5344416 5344396 -
aatggagaacttgaaatgagagag

SEQ ID NO: 65468 - DNA, 24 bp, Artificial Sequence
  Synthetic oligonucleotide; GAAGGATT chr11 5344182 5344205 5344185 -
ttgtcacaagtagtgagtagtact

SEQ ID NO: 65469 - DNA, 24 bp, Artificial Sequence
  Synthetic oligonucleotide; TGTGGATT chr11 5343972 5343995 5343975 -
ggtaagtctttacatgcaggaaaa

SEQ ID NO: 65470 - DNA, 24 bp, Artificial Sequence
  Synthetic oligonucleotide; ATTTGATT chr11 5343753 5343776 5343756 -
atataaacagttgaaactccaaga

SEQ ID NO: 65471 - DNA, 24 bp, Artificial Sequence
  Synthetic oligonucleotide; ACTGGATT chr11 5343458 5343481 5343461 -
ttccaggcttggaggaagctcatc

SEQ ID NO: 65472 - DNA, 24 bp, Artificial Sequence
  Synthetic oligonucleotide; GGGAGATT chr11 5343263 5343286 5343266 -
tgggagtcctctggctggatcaca

SEQ ID NO: 65473 - DNA, 24 bp, Artificial Sequence
  Synthetic oligonucleotide; TGAAGATT chr11 5343107 5343130 5343110 -
ctgtacttactaatactcgagtag

SEQ ID NO: 65474 - DNA, 24 bp, Artificial Sequence
  Synthetic oligonucleotide; AGGGGATT chr11 5343081 5343104 5343084 -
aagattgggctgggagttctgatg

SEQ ID NO: 65475 - DNA, 24 bp, Artificial Sequence
  Synthetic oligonucleotide; GCTGGATT chr11 5342908 5342931 5342911 -
tgtgcttgtagtctttatatttgt

SEQ ID NO: 65476 - DNA, 24 bp, Artificial Sequence
  Synthetic oligonucleotide; ATCTGATT chr11 5342900 5342923 5342903 -
tagtctttatatttgtgctggatt

SEQ ID NO: 65477 - DNA, 24 bp, Artificial Sequence
  Synthetic oligonucleotide; CAGTGATT chr11 5342771 5342794 5342774 -
gctgtgtcctggttttttatgtca

SEQ ID NO: 65478 - DNA, 24 bp, Artificial Sequence
  Synthetic oligonucleotide; ATTGGATT chr11 5342766 5342789 5342769 -
gtcctggttttttatgtcacagtg

SEQ ID NO: 65479 - DNA, 24 bp, Artificial Sequence
  Synthetic oligonucleotide; CTCTGATT chr11 5342756 5342779 5342759 -
tttatgtcacagtgattggattgt

SEQ ID NO: 65480 - DNA, 24 bp, Artificial Sequence
  Synthetic oligonucleotide; AGCAGATT chr11 5342642 5342665 5342645 -
ctataacatatagtgtcaagacca

SEQ ID NO: 65481 - DNA, 24 bp, Artificial Sequence
  Synthetic oligonucleotide; GAATGATT chr11 5341687 5341710 5341690 -
aataggtttctgcatttttttgaa

SEQ ID NO: 65482 - DNA, 24 bp, Artificial Sequence
  Synthetic oligonucleotide; TTCTGATT chr11 5341663 5341686 5341666 -
gaatgattgctttctgtacataca

SEQ ID NO: 65483 - DNA, 24 bp, Artificial Sequence
  Synthetic oligonucleotide; ATTTGATT chr11 5341607 5341630 5341610 -
aaagaatacaacaatgtcattctc

SEQ ID NO: 65484 - DNA, 24 bp, Artificial Sequence
  Synthetic oligonucleotide; TCATGATT chr11 5340747 5340770 5340750 -
gcataacatttttaattggtatag

SEQ ID NO: 65485 - DNA, 24 bp, Artificial Sequence
  Synthetic oligonucleotide; CTCTGATT chr11 5340324 5340347 5340327 -
aataaataaaaagaatcttcaaat

SEQ ID NO: 65486 - DNA, 24 bp, Artificial Sequence
  Synthetic oligonucleotide; TTTTGATT chr11 5340268 5340291 5340271 -
caaggaggacagtttgaatctttt

SEQ ID NO: 65487 - DNA, 24 bp, Artificial Sequence
  Synthetic oligonucleotide; GAATGATT chr11 5340029 5340052 5340032 -
tggcaggaaagttgaccatttggt

SEQ ID NO: 65488 - DNA, 24 bp, Artificial Sequence
  Synthetic oligonucleotide; AAATGATT chr11 5338978 5339001 5338981 -
ttctgtagactaagccaatcttag

SEQ ID NO: 65489 - DNA, 24 bp, Artificial Sequence
  Synthetic oligonucleotide; TGCAGATT chr11 5338805 5338828 5338808 -
attgctgggttccttcaccagaga

SEQ ID NO: 65490 - DNA, 24 bp, Artificial Sequence
  Synthetic oligonucleotide; ACTAGATT chr11 5338757 5338780 5338760 -
aaggtgatatatttaaagatactt

SEQ ID NO: 65491 - DNA, 24 bp, Artificial Sequence
  Synthetic oligonucleotide; GGATGATT chr11 5338724 5338747 5338727 -
tatgagtattaaattgggcagcaa

SEQ ID NO: 65492 - DNA, 24 bp, Artificial Sequence
  Synthetic oligonucleotide; AAATGATT chr11 5338714 5338737 5338717 -
aaattgggcagcaaggatgattag

SEQ ID NO: 65493 - DNA, 24 bp, Artificial Sequence
  Synthetic oligonucleotide; TTTTGATT chr11 5338661 5338684 5338664 -
tccaattaaagaatgtaaatctgt

SEQ ID NO: 65494 - DNA, 24 bp, Artificial Sequence
  Synthetic oligonucleotide; CCTAGATT chr11 5338566 5338589 5338569 -
atgggaaatttaggagtttatgtc

SEQ ID NO: 65495 - DNA, 24 bp, Artificial Sequence
  Synthetic oligonucleotide; CAGTGATT chr11 5338528 5338551 5338531 -
acatgccaccaaactgacagatga

SEQ ID NO: 65496 - DNA, 24 bp, Artificial Sequence
  Synthetic oligonucleotide; ACAGGATT chr11 5338454 5338477 5338457 -
tggttctccagaaaaatagaatca

SEQ ID NO: 65497 - DNA, 24 bp, Artificial Sequence
  Synthetic oligonucleotide; AAGGGATT chr11 5338277 5338300 5338280 -
acctggtaaaaacaagtaatgggg

SEQ ID NO: 65498 - DNA, 24 bp, Artificial Sequence
  Synthetic oligonucleotide; CAAAGATT chr11 5338085 5338108 5338088 -
taccattccggacatagacacagg

SEQ ID NO: 65499 - DNA, 24 bp, Artificial Sequence
  Synthetic oligonucleotide; CAAAGATT chr11 5337262 5337285 5337265 -
gtggaagacagtgtggcaattcct

SEQ ID NO: 65500 - DNA, 24 bp, Artificial Sequence
  Synthetic oligonucleotide; ATGTGATT chr11 5336576 5336599 5336579 -
caacctaatataaggaaatagcag

SEQ ID NO: 65501 - DNA, 24 bp, Artificial Sequence
  Synthetic oligonucleotide; GGAGGATT chr11 5336463 5336486 5336466 -
ccaagtctgaaggcctgggaaaca

SEQ ID NO: 65502 - DNA, 24 bp, Artificial Sequence
  Synthetic oligonucleotide; TCTAGATT chr11 5336368 5336391 5336371 -
tcaatctaaaggcagaaaaaaagg

SEQ ID NO: 65503 - DNA, 24 bp, Artificial Sequence
  Synthetic oligonucleotide; CTCTGATT chr11 5336327 5336350 5336330 -
aggccatcaataaggaataattct

SEQ ID NO: 65504 - DNA, 24 bp, Artificial Sequence
  Synthetic oligonucleotide; AACTGATT chr11 5336281 5336304 5336284 -
actttttgttctattcaggttttc

SEQ ID NO: 65505 - DNA, 24 bp, Artificial Sequence
  Synthetic oligonucleotide; TACCGATT chr11 5336227 5336250 5336230 -
aaggaccatctgctctacttggtc

SEQ ID NO: 65506 - DNA, 24 bp, Artificial Sequence
  Synthetic oligonucleotide; ATGTGATT chr11 5335715 5335738 5335718 -
agatattctaataaatattgtgtt

SEQ ID NO: 65507 - DNA, 24 bp, Artificial Sequence
  Synthetic oligonucleotide; CTGAGATT chr11 5335615 5335638 5335618 -
caggagatggaggtccttcccaat

SEQ ID NO: 65508 - DNA, 24 bp, Artificial Sequence
  Synthetic oligonucleotide; ATGAGATT chr11 5335362 5335385 5335365 -
cctccaccaacagtgtcacttcac

SEQ ID NO: 65509 - DNA, 24 bp, Artificial Sequence
  Synthetic oligonucleotide; AGAAGATT chr11 5335262 5335285 5335265 -
ggaatagagtcatatttatggggc

SEQ ID NO: 65510 - DNA, 24 bp, Artificial Sequence
  Synthetic oligonucleotide; TCATGATT chr11 5335043 5335066 5335046 -
ccatttccagagactgacttttaa

SEQ ID NO: 65511 - DNA, 24 bp, Artificial Sequence
  Synthetic oligonucleotide; TTAGGATT chr11 5334866 5334889 5334869 -
gttgggctaagttccaggataaat

SEQ ID NO: 65512 - DNA, 24 bp, Artificial Sequence
  Synthetic oligonucleotide; AGATGATT chr11 5334803 5334826 5334806 -
tccttatttctctgacagactatg

SEQ ID NO: 65513 - DNA, 24 bp, Artificial Sequence
  Synthetic oligonucleotide; CAGGGATT chr11 5334766 5334789 5334769 -
caagtacaaattgtcagacaaagc

SEQ ID NO: 65514 - DNA, 24 bp, Artificial Sequence
  Synthetic oligonucleotide; ACTTGATT chr11 5334693 5334716 5334696 -
ggacacttaaataaaattttttaa

SEQ ID NO: 65515 - DNA, 24 bp, Artificial Sequence
  Synthetic oligonucleotide; CTCTGATT chr11 5334663 5334686 5334666 -
tttatattgctccagaagcagtaa

SEQ ID NO: 65516 - DNA, 24 bp, Artificial Sequence
  Synthetic oligonucleotide; AAAAGATT chr11 5334546 5334569 5334549 -
caaacaatcttatttgaaaccaag

SEQ ID NO: 65517 - DNA, 24 bp, Artificial Sequence
  Synthetic oligonucleotide; GAGGGATT chr11 5334532 5334555 5334535 -
tgaaaccaagaaaagattaagtgt

SEQ ID NO: 65518 - DNA, 24 bp, Artificial Sequence
  Synthetic oligonucleotide; CTTGGATT chr11 5334049 5334072 5334052 -
gagaggaaaataaagactaatctt

SEQ ID NO: 65519 - DNA, 24 bp, Artificial Sequence
  Synthetic oligonucleotide; TACAGATT chr11 5333979 5334002 5333982 -
gaaaagaggcaagatatctgtatc

SEQ ID NO: 65520 - DNA, 24 bp, Artificial Sequence
  Synthetic oligonucleotide; TTCAGATT chr11 5332642 5332665 5332645 -
gggaagaattcgcttccacgttca

SEQ ID NO: 65521 - DNA, 24 bp, Artificial Sequence
  Synthetic oligonucleotide; CTGGGATT chr11 5332335 5332358 5332338 -
cgcccgccttggcctcccaaagtg

SEQ ID NO: 65522 - DNA, 24 bp, Artificial Sequence
  Synthetic oligonucleotide; ACTCGATT chr11 5331632 5331655 5331635 -
tcagaattttctgtaagtgtaaac

SEQ ID NO: 65523 - DNA, 24 bp, Artificial Sequence
  Synthetic oligonucleotide; ATATGATT chr11 5331581 5331604 5331584 -
aaaaaatcgtgggaactatctcat

SEQ ID NO: 65524 - DNA, 24 bp, Artificial Sequence
  Synthetic oligonucleotide; TGCTGATT chr11 5331569 5331592 5331572 -
gaactatctcatatatgattttta

SEQ ID NO: 65525 - DNA, 24 bp, Artificial Sequence
  Synthetic oligonucleotide; GAGAGATT chr11 5331307 5331330 5331310 -
ctcctcactggctttccaggtctg

SEQ ID NO: 65526 - DNA, 24 bp, Artificial Sequence
  Synthetic oligonucleotide; AGGGGATT chr11 5330917 5330940 5330920 -
aagatagatctgggggttcaaatg

SEQ ID NO: 65527 - DNA, 24 bp, Artificial Sequence
  Synthetic oligonucleotide; TCTGGATT chr11 5330875 5330898 5330878 -
attgtgcccataatcatcaccctc

SEQ ID NO: 65528 - DNA, 24 bp, Artificial Sequence
  Synthetic oligonucleotide; ACTTGATT chr11 5330606 5330629 5330609 -
agctgtgttctggtttttaatgtc

SEQ ID NO: 65529 - DNA, 24 bp, Artificial Sequence
  Synthetic oligonucleotide; TGGCGATT chr11 5330346 5330369 5330349 -
gttcaaccattgtggaagtcagtg

SEQ ID NO: 65530 - DNA, 24 bp, Artificial Sequence
  Synthetic oligonucleotide; AACGGATT chr11 5330275 5330298 5330278 -
catcccattactgggtatataccc

SEQ ID NO: 65531 - DNA, 24 bp, Artificial Sequence
  Synthetic oligonucleotide; TTTGGATT chr11 5329759 5329782 5329762 -
ataataataataaaaatacattat

SEQ ID NO: 65532 - DNA, 24 bp, Artificial Sequence
  Synthetic oligonucleotide; CACAGATT chr11 5329731 5329754 5329734 -
gattaacaaaaaccaacaggctac

SEQ ID NO: 65533 - DNA, 24 bp, Artificial Sequence
  Synthetic oligonucleotide; TCTTGATT chr11 5329669 5329692 5329672 -
gttattctggctctgctagaattc

SEQ ID NO: 65534 - DNA, 24 bp, Artificial Sequence
  Synthetic oligonucleotide; CTGAGATT chr11 5329068 5329091 5329071 -
ctgggaggtggagtttgcagtgag

SEQ ID NO: 65535 - DNA, 24 bp, Artificial Sequence
  Synthetic oligonucleotide; AGGTGATT chr11 5328584 5328607 5328587 -
tgctagaaagatgaaactcagggg

SEQ ID NO: 65536 - DNA, 24 bp, Artificial Sequence
  Synthetic oligonucleotide; GAATGATT chr11 5328434 5328457 5328437 -
gtgagtgccaggaacttgaatatg

SEQ ID NO: 65537 - DNA, 24 bp, Artificial Sequence
  Synthetic oligonucleotide; CACAGATT chr11 5328322 5328345 5328325 -
cagctgaggtgggatatcctacag

SEQ ID NO: 65538 - DNA, 24 bp, Artificial Sequence
  Synthetic oligonucleotide; GATAGATT chr11 5328276 5328299 5328279 -
ttgaaagagtatttaaggaactgt

SEQ ID NO: 65539 - DNA, 24 bp, Artificial Sequence
  Synthetic oligonucleotide; CTTGGATT chr11 5328247 5328270 5328250 -
atttaggttttctaatctgggacc

SEQ ID NO: 65540 - DNA, 24 bp, Artificial Sequence
  Synthetic oligonucleotide; TGTAGATT chr11 5327927 5327950 5327930 -
tttactggtgcttttgtcatttta

SEQ ID NO: 65541 - DNA, 24 bp, Artificial Sequence
  Synthetic oligonucleotide; AGAGGATT chr11 5327807 5327830 5327810 -
tttttattgataactttcctgttc

SEQ ID NO: 65542 - DNA, 24 bp, Artificial Sequence
  Synthetic oligonucleotide; ATTGGATT chr11 5327702 5327725 5327705 -
ccaaattaagatctaagaaagcaa

SEQ ID NO: 65543 - DNA, 24 bp, Artificial Sequence
  Synthetic oligonucleotide; TGAAGATT chr11 5327540 5327563 5327543 -
ggccaaatggaggactcacttttt

SEQ ID NO: 65544 - DNA, 24 bp, Artificial Sequence
  Synthetic oligonucleotide; AATAGATT chr11 5327154 5327177 5327157 -
ttcacttgtttatgtagactgtat

SEQ ID NO: 65545 - DNA, 24 bp, Artificial Sequence
  Synthetic oligonucleotide; CTATGATT chr11 5326859 5326882 5326862 -
gctagaatgaagcagggcttagat

SEQ ID NO: 65546 - DNA, 24 bp, Artificial Sequence
  Synthetic oligonucleotide; ACATGATT chr11 5326163 5326186 5326166 -
ttctttttattcccaaaatctcag

SEQ ID NO: 65547 - DNA, 24 bp, Artificial Sequence
  Synthetic oligonucleotide; CCCAGATT chr11 5325891 5325914 5325894 -
ttacacaattttttttaaaggaat

SEQ ID NO: 65548 - DNA, 24 bp, Artificial Sequence
  Synthetic oligonucleotide; ATGTGATT chr11 5325617 5325640 5325620 -
aattcagtcttctatatgaattca

SEQ ID NO: 65549 - DNA, 24 bp, Artificial Sequence
  Synthetic oligonucleotide; TAGGGATT chr11 5325603 5325626 5325606 -
tatgaattcaatgtgatttaattt

SEQ ID NO: 65550 - DNA, 24 bp, Artificial Sequence
  Synthetic oligonucleotide; TGGTGATT chr11 5325586 5325609 5325589 -
ttaattttagggattccctagtgt

SEQ ID NO: 65551 - DNA, 24 bp, Artificial Sequence
  Synthetic oligonucleotide; TTGTGATT chr11 5325492 5325515 5325495 -
tttccttatacaatatgaaatgct

SEQ ID NO: 65552 - DNA, 24 bp, Artificial Sequence
  Synthetic oligonucleotide; TTCTGATT chr11 5325482 5325505 5325485 -
caatatgaaatgctttgtgatttc

SEQ ID NO: 65553 - DNA, 24 bp, Artificial Sequence
  Synthetic oligonucleotide; TTCTGATT chr11 5325476 5325499 5325479 -
gaaatgctttgtgatttcttctga

SEQ ID NO: 65554 - DNA, 24 bp, Artificial Sequence
  Synthetic oligonucleotide; CCAGGATT chr11 5325410 5325433 5325413 -
ctgctaggtgctaaagacttgcct

SEQ ID NO: 65555 - DNA, 24 bp, Artificial Sequence
  Synthetic oligonucleotide; GATGGATT chr11 5325016 5325039 5325019 -
cattaaaaggtttctatctcgaaa

SEQ ID NO: 65556 - DNA, 24 bp, Artificial Sequence
  Synthetic oligonucleotide; ATTTGATT chr11 5324932 5324955 5324935 -
cacctgaggacctgaaaaaagcga

SEQ ID NO: 65557 - DNA, 24 bp, Artificial Sequence
  Synthetic oligonucleotide; GCCAGATT chr11 5324622 5324645 5324625 -
taatcacagcaagaagacaactaa

SEQ ID NO: 65558 - DNA, 24 bp, Artificial Sequence
  Synthetic oligonucleotide; GGAAGATT chr11 5324361 5324384 5324364 -
acaccagttaatcatctccaagca

SEQ ID NO: 65559 - DNA, 24 bp, Artificial Sequence
  Synthetic oligonucleotide; GGGAGATT chr11 5324036 5324059 5324039 -
tgggcatcctatgggtgaatcaca

SEQ ID NO: 65560 - DNA, 24 bp, Artificial Sequence
  Synthetic oligonucleotide; ATATGATT chr11 5323948 5323971 5323951 -
atcaggttccctcctggcaatggc

SEQ ID NO: 65561 - DNA, 24 bp, Artificial Sequence
  Synthetic oligonucleotide; TACAGATT chr11 5323521 5323544 5323524 -
acagtgatgggtttgacattcatt

SEQ ID NO: 65562 - DNA, 24 bp, Artificial Sequence
  Synthetic oligonucleotide; CCATGATT chr11 5322817 5322840 5322820 -
cctgagttagggtactctctaggg

SEQ ID NO: 65563 - DNA, 24 bp, Artificial Sequence
  Synthetic oligonucleotide; TCTGGATT chr11 5322718 5322741 5322721 -
tttcaatacattccttgcaggatg

SEQ ID NO: 65564 - DNA, 24 bp, Artificial Sequence
  Synthetic oligonucleotide; AGATGATT chr11 5322569 5322592 5322572 -
tttttaagagtatgtttgctcttc

SEQ ID NO: 65565 - DNA, 24 bp, Artificial Sequence
  Synthetic oligonucleotide; TGGTGATT chr11 5322410 5322433 5322413 -
atgttcagagggaaaaattagaaa

SEQ ID NO: 65566 - DNA, 24 bp, Artificial Sequence
  Synthetic oligonucleotide; AATGGATT chr11 5322329 5322352 5322332 -
aggaagaccaacaatgttgagaga

SEQ ID NO: 65567 - DNA, 24 bp, Artificial Sequence
  Synthetic oligonucleotide; GACTGATT chr11 5322248 5322271 5322251 -
actgtgtactaaaagcttctttta

SEQ ID NO: 65568 - DNA, 24 bp, Artificial Sequence
  Synthetic oligonucleotide; ACAGGATT chr11 5322230 5322253 5322233 -
cttttagactgatttaattgtgaa

SEQ ID NO: 65569 - DNA, 24 bp, Artificial Sequence
  Synthetic oligonucleotide; TCTTGATT chr11 5322031 5322054 5322034 -
aaatctcatttcggataattccca

SEQ ID NO: 65570 - DNA, 24 bp, Artificial Sequence
  Synthetic oligonucleotide; AATTGATT chr11 5321498 5321521 5321501 -
gttgtttaaagaaaatatttttca

SEQ ID NO: 65571 - DNA, 24 bp, Artificial Sequence
  Synthetic oligonucleotide; ACCTGATT chr11 5321224 5321247 5321227 -
tcagccttcccactttaccacatg

SEQ ID NO: 65572 - DNA, 24 bp, Artificial Sequence
  Synthetic oligonucleotide; AACTGATT chr11 5321084 5321107 5321087 -
cctttgtgcaaagcacttcattga

SEQ ID NO: 65573 - DNA, 24 bp, Artificial Sequence
  Synthetic oligonucleotide; TGTTGATT chr11 5321006 5321029 5321009 -
tacaatgaccaatcaataaataac

SEQ ID NO: 65574 - DNA, 24 bp, Artificial Sequence
  Synthetic oligonucleotide; ACTTGATT chr11 5320677 5320700 5320680 -
ccatagtaactttaaacaataact

SEQ ID NO: 65575 - DNA, 24 bp, Artificial Sequence
  Synthetic oligonucleotide; ACATGATT chr11 5320607 5320630 5320610 -
cttatggtaatgtcaaaatgtttt

SEQ ID NO: 65576 - DNA, 24 bp, Artificial Sequence
  Synthetic oligonucleotide; TACAGATT chr11 5320565 5320588 5320568 -
attgtgatcagaacctgctactac

SEQ ID NO: 65577 - DNA, 24 bp, Artificial Sequence
  Synthetic oligonucleotide; CAATGATT chr11 5320368 5320391 5320371 -
gtgtttgttcttttcacctgtacg

SEQ ID NO: 65578 - DNA, 24 bp, Artificial Sequence
  Synthetic oligonucleotide; ATGGGATT chr11 5320101 5320124 5320104 -
tcattttctttgtggctgttctta

SEQ ID NO: 65579 - DNA, 24 bp, Artificial Sequence
  Synthetic oligonucleotide; TCTCGATT chr11 5320089 5320112 5320092 -
tggctgttcttaatgggattgtgt

SEQ ID NO: 65580 - DNA, 24 bp, Artificial Sequence
  Synthetic oligonucleotide; TACTGATT chr11 5320043 5320066 5320046 -
ggccttattggtgtatggaaatgc

SEQ ID NO: 65581 - DNA, 24 bp, Artificial Sequence
  Synthetic oligonucleotide; ATGTGATT chr11 5320030 5320053 5320033 -
tatggaaatgctactgatttttgt

SEQ ID NO: 65582 - DNA, 24 bp, Artificial Sequence
  Synthetic oligonucleotide; GTAGGATT chr11 5319962 5319985 5319965 -
tctagcagccttttggaagaatct

SEQ ID NO: 65583 - DNA, 24 bp, Artificial Sequence
  Synthetic oligonucleotide; GCCTGATT chr11 5319871 5319894 5319874 -
tgatgccatttctttctttctctc

SEQ ID NO: 65584 - DNA, 24 bp, Artificial Sequence
  Synthetic oligonucleotide; CATGGATT chr11 5319511 5319534 5319514 -
aaataaataaaagctttccaggct

SEQ ID NO: 65585 - DNA, 24 bp, Artificial Sequence
  Synthetic oligonucleotide; AATGGATT chr11 5318521 5318544 5318524 -
aacccaaatgtccaacaatgatag

SEQ ID NO: 65586 - DNA, 24 bp, Artificial Sequence
  Synthetic oligonucleotide; AACAGATT chr11 5317799 5317822 5317802 -
atagctatttttaaaaagccaaaa

SEQ ID NO: 65587 - DNA, 24 bp, Artificial Sequence
  Synthetic oligonucleotide; CAGTGATT chr11 5317115 5317138 5317118 -
atcctgaacctggtatgaaatggg

SEQ ID NO: 65588 - DNA, 24 bp, Artificial Sequence
  Synthetic oligonucleotide; AACTGATT chr11 5317016 5317039 5317019 -
tccattgaggttcctgtggatcag

SEQ ID NO: 65589 - DNA, 24 bp, Artificial Sequence
  Synthetic oligonucleotide; AAGTGATT chr11 5316646 5316669 5316649 -
atttggaaagaggaaactctgggg

SEQ ID NO: 65590 - DNA, 24 bp, Artificial Sequence
  Synthetic oligonucleotide; GAATGATT chr11 5316493 5316516 5316496 -
gtgagtgccaggaacaggaataag

SEQ ID NO: 65591 - DNA, 24 bp, Artificial Sequence
  Synthetic oligonucleotide; GGAAGATT chr11 5316446 5316469 5316449 -
gttagatgcagcgaagagaagata

SEQ ID NO: 65592 - DNA, 24 bp, Artificial Sequence
  Synthetic oligonucleotide; CATGGATT chr11 5316323 5316346 5316326 -
gcttgaagtttcaaatgtggtgct

SEQ ID NO: 65593 - DNA, 24 bp, Artificial Sequence
  Synthetic oligonucleotide; TCATGATT chr11 5316147 5316170 5316150 -
ttctaacaaaacactatgtctata

SEQ ID NO: 65594 - DNA, 24 bp, Artificial Sequence
  Synthetic oligonucleotide; TTTAGATT chr11 5315954 5315977 5315957 -
tgatgcattttttaaaatgtgttt

SEQ ID NO: 65595 - DNA, 24 bp, Artificial Sequence
  Synthetic oligonucleotide; TTAGGATT chr11 5315799 5315822 5315802 -
ataaattattgctaaatatgaata

SEQ ID NO: 65596 - DNA, 24 bp, Artificial Sequence
  Synthetic oligonucleotide; CAGGGATT chr11 5315742 5315765 5315745 -
agaaggtagtaaaaactgataagg

SEQ ID NO: 65597 - DNA, 24 bp, Artificial Sequence
  Synthetic oligonucleotide; CTTTGATT chr11 5315104 5315127 5315107 -
acttatacccagctattctggttg

SEQ ID NO: 65598 - DNA, 24 bp, Artificial Sequence
  Synthetic oligonucleotide; TCATGATT chr11 5314746 5314769 5314749 -
ccttttttcagaattttgtgatct

SEQ ID NO: 65599 - DNA, 24 bp, Artificial Sequence
  Synthetic oligonucleotide; GGTAGATT chr11 5314227 5314250 5314230 -
aatctcaaaactactctatttcag

SEQ ID NO: 65600 - DNA, 24 bp, Artificial Sequence
  Synthetic oligonucleotide; AATAGATT chr11 5314195 5314218 5314198 -
ttccttttttttttttttttttaa

SEQ ID NO: 65601 - DNA, 24 bp, Artificial Sequence
  Synthetic oligonucleotide; GGTTGATT chr11 5313734 5313757 5313737 -
cactctatcattgatggacatttg

SEQ ID NO: 65602 - DNA, 24 bp, Artificial Sequence
  Synthetic oligonucleotide; AATAGATT chr11 5313667 5313690 5313670 -
acataagcatgcctgtatttttat

SEQ ID NO: 65603 - DNA, 24 bp, Artificial Sequence
  Synthetic oligonucleotide; GATTGATT chr11 5313663 5313686 5313666 -
aagcatgcctgtatttttataata

SEQ ID NO: 65604 - DNA, 24 bp, Artificial Sequence
  Synthetic oligonucleotide; ATGAGATT chr11 5313628 5313651 5313631 -
attcctttgggtatatacccagta

SEQ ID NO: 65605 - DNA, 24 bp, Artificial Sequence
  Synthetic oligonucleotide; TTTTGATT chr11 5313419 5313442 5313422 -
gtgtgagatggtatcccattgtgg

SEQ ID NO: 65606 - DNA, 24 bp, Artificial Sequence
  Synthetic oligonucleotide; CTAGGATT chr11 5312826 5312849 5312829 -
tgttgcagcaacttggaaatctca

SEQ ID NO: 65607 - DNA, 24 bp, Artificial Sequence
  Synthetic oligonucleotide; AATTGATT chr11 5312780 5312803 5312783 -
ttttgctaattttcatccttttat

SEQ ID NO: 65608 - DNA, 24 bp, Artificial Sequence
  Synthetic oligonucleotide; CTGTGATT chr11 5312301 5312324 5312304 -
agaaatccaaatttaaaacaagtg

SEQ ID NO: 65609 - DNA, 24 bp, Artificial Sequence
  Synthetic oligonucleotide; GTAAGATT chr11 5312215 5312238 5312218 -
ttgaggttatggcttgaaataagg

SEQ ID NO: 65610 - DNA, 24 bp, Artificial Sequence
  Synthetic oligonucleotide; AATGGATT chr11 5312173 5312196 5312176 -
gtgtcccttcagctgagacctgaa

SEQ ID NO: 65611 - DNA, 24 bp, Artificial Sequence
  Synthetic oligonucleotide; CACTGATT chr11 5311662 5311685 5311665 -
aggcagtgccaaaagaaaggcagt

SEQ ID NO: 65612 - DNA, 24 bp, Artificial Sequence
  Synthetic oligonucleotide; ATGTGATT chr11 5311576 5311599 5311579 -
tgagaatgagtcaaaataataaac

SEQ ID NO: 65613 - DNA, 24 bp, Artificial Sequence
  Synthetic oligonucleotide; GATGGATT chr11 5311142 5311165 5311145 -
atctgatacaaacataaataggaa

SEQ ID NO: 65614 - DNA, 24 bp, Artificial Sequence
  Synthetic oligonucleotide; CCTAGATT chr11 5311050 5311073 5311053 -
ttcatgagtgcttatgttagttac

SEQ ID NO: 65615 - DNA, 24 bp, Artificial Sequence
  Synthetic oligonucleotide; GCTTGATT chr11 5310971 5310994 5310974 -
catatggaactgaaaataatctat

SEQ ID NO: 65616 - DNA, 24 bp, Artificial Sequence
  Synthetic oligonucleotide; TATTGATT chr11 5310571 5310594 5310574 -
gtattacaccaaataaaaactcta

SEQ ID NO: 65617 - DNA, 24 bp, Artificial Sequence
  Synthetic oligonucleotide; CCCAGATT chr11 5310244 5310267 5310247 -
tattgatgtcttcccttcaatatg

SEQ ID NO: 65618 - DNA, 24 bp, Artificial Sequence
  Synthetic oligonucleotide; AAATGATT chr11 5310056 5310079 5310059 -
cctgggttcagttttcagttaaag

SEQ ID NO: 65619 - DNA, 24 bp, Artificial Sequence
  Synthetic oligonucleotide; TAGAGATT chr11 5310027 5310050 5310030 -
atttaacaaattttttcactcaac

SEQ ID NO: 65620 - DNA, 24 bp, Artificial Sequence
  Synthetic oligonucleotide; TGGTGATT chr11 5309915 5309938 5309918 -
attttcacggagaaagataagaac

SEQ ID NO: 65621 - DNA, 24 bp, Artificial Sequence
  Synthetic oligonucleotide; CTGGGATT chr11 5309589 5309612 5309592 -
cacccgcctcggcctcccaaagtg

SEQ ID NO: 65622 - DNA, 24 bp, Artificial Sequence
  Synthetic oligonucleotide; AACCGATT chr11 5309413 5309436 5309416 -
tttttcatactgaatcaattgtaa

SEQ ID NO: 65623 - DNA, 24 bp, Artificial Sequence
  Synthetic oligonucleotide; TCTTGATT chr11 5309212 5309235 5309215 -
aaatttcaaccccgatcatttcca

SEQ ID NO: 65624 - DNA, 24 bp, Artificial Sequence
  Synthetic oligonucleotide; GGAAGATT chr11 5308875 5308898 5308878 -
ctgcaatttacgtccaagaagaaa

SEQ ID NO: 65625 - DNA, 24 bp, Artificial Sequence
  Synthetic oligonucleotide; TGTGGATT chr11 5308816 5308839 5308819 -
cactgaacggttatctgggcctgt

SEQ ID NO: 65626 - DNA, 24 bp, Artificial Sequence
  Synthetic oligonucleotide; AAGAGATT chr11 5308718 5308741 5308721 -
cagggctgtttccatgatggagga

SEQ ID NO: 65627 - DNA, 24 bp, Artificial Sequence
  Synthetic oligonucleotide; TGTAGATT chr11 5308703 5308726 5308706 -
gatggaggaaagagattggaggaa

SEQ ID NO: 65628 - DNA, 24 bp, Artificial Sequence
  Synthetic oligonucleotide; ATTAGATT chr11 5308434 5308457 5308437 -
agttgtttcatcttctacaacctc

SEQ ID NO: 65629 - DNA, 24 bp, Artificial Sequence
  Synthetic oligonucleotide; CAGTGATT chr11 5308290 5308313 5308293 -
cttgcatagatgtgagatggtaca

SEQ ID NO: 65630 - DNA, 24 bp, Artificial Sequence
  Synthetic oligonucleotide; TATGGATT chr11 5307597 5307620 5307600 -
aaaaatctttcttcttgatgttgt

SEQ ID NO: 65631 - DNA, 24 bp, Artificial Sequence
  Synthetic oligonucleotide; CCATGATT chr11 5307579 5307602 5307582 -
tgttgttatggatttttctctgaa

SEQ ID NO: 65632 - DNA, 24 bp, Artificial Sequence
  Synthetic oligonucleotide; AAGAGATT chr11 5306922 5306945 5306925 -
actcagcacataatccaatgaaaa

SEQ ID NO: 65633 - DNA, 24 bp, Artificial Sequence
  Synthetic oligonucleotide; TCTGGATT chr11 5306889 5306912 5306892 -
cagaatgggactaatatgacaaca

SEQ ID NO: 65634 - DNA, 24 bp, Artificial Sequence
  Synthetic oligonucleotide; TCAGGATT chr11 5306844 5306867 5306847 -
aggtggagcatcataggaaataaa

SEQ ID NO: 65635 - DNA, 24 bp, Artificial Sequence
  Synthetic oligonucleotide; CAAGGATT chr11 5306393 5306416 5306396 -
agacgaaaaggtttggtggtggct

SEQ ID NO: 65636 - DNA, 24 bp, Artificial Sequence
  Synthetic oligonucleotide; CAAGGATT chr11 5305935 5305958 5305938 -
aactgtggctcaggtaagaaaagc

SEQ ID NO: 65637 - DNA, 24 bp, Artificial Sequence
  Synthetic oligonucleotide; AACAGATT chr11 5305683 5305706 5305686 -
cttttcttttctctctctctcttt

SEQ ID NO: 65638 - DNA, 24 bp, Artificial Sequence
  Synthetic oligonucleotide; AGGGGATT chr11 5305605 5305628 5305608 -
ctgcgacctcctccaccagggttc

SEQ ID NO: 65639 - DNA, 24 bp, Artificial Sequence
  Synthetic oligonucleotide; CTGGGATT chr11 5305573 5305596 5305576 -
ctcatgcctcagcctccagagtag

SEQ ID NO: 65640 - DNA, 24 bp, Artificial Sequence
  Synthetic oligonucleotide; CTGGGATT chr11 5305438 5305461 5305441 -
caccctcctcggcctcccaaagtg

SEQ ID NO: 65641 - DNA, 24 bp, Artificial Sequence
  Synthetic oligonucleotide; CTGGGATT chr11 5304943 5304966 5304946 -
ctcctgcctcagcctcccgagtag

SEQ ID NO: 65642 - DNA, 24 bp, Artificial Sequence
  Synthetic oligonucleotide; CTAGGATT chr11 5304814 5304837 5304817 -
gatccacctcagccttccaaagtg

SEQ ID NO: 65643 - DNA, 24 bp, Artificial Sequence
  Synthetic oligonucleotide; CTGAGATT chr11 5304725 5304748 5304728 -
agatataaaaaagtcacttaaaag

SEQ ID NO: 65644 - DNA, 24 bp, Artificial Sequence
  Synthetic oligonucleotide; AGTGGATT chr11 5304593 5304616 5304596 -
tggggcaatatgtggagatgaaaa

SEQ ID NO: 65645 - DNA, 24 bp, Artificial Sequence
  Synthetic oligonucleotide; CACTGATT chr11 5304578 5304601 5304581 -
agatgaaaaagtggattcagggga

SEQ ID NO: 65646 - DNA, 24 bp, Artificial Sequence
  Synthetic oligonucleotide; TGCAGATT chr11 5304558 5304581 5304561 -
gggacactgattgtacagggcact

SEQ ID NO: 65647 - DNA, 24 bp, Artificial Sequence
  Synthetic oligonucleotide; CAAAGATT chr11 5303449 5303472 5303452 -
ggtttttataaaataaaaaaggtg

SEQ ID NO: 65648 - DNA, 24 bp, Artificial Sequence
  Synthetic oligonucleotide; TACAGATT chr11 5303141 5303164 5303144 -
gtgaatttttctcaatacgagtct

SEQ ID NO: 65649 - DNA, 24 bp, Artificial Sequence
  Synthetic oligonucleotide; TAATGATT chr11 5303131 5303154 5303134 -
ctcaatacgagtcttacagattca

SEQ ID NO: 65650 - DNA, 24 bp, Artificial Sequence
  Synthetic oligonucleotide; GTAAGATT chr11 5303114 5303137 5303117 -
agattcataatgattagagggtct

SEQ ID NO: 65651 - DNA, 24 bp, Artificial Sequence
  Synthetic oligonucleotide; TTCAGATT chr11 5302737 5302760 5302740 -
taactttacccacttgttcaggtg

SEQ ID NO: 65652 - DNA, 24 bp, Artificial Sequence
  Synthetic oligonucleotide; CCATGATT chr11 5302160 5302183 5302163 -
agtgaattggaattattattctga

SEQ ID NO: 65653 - DNA, 24 bp, Artificial Sequence
  Synthetic oligonucleotide; AGAAGATT chr11 5302031 5302054 5302034 -
aaaatggcctgatgatgtgctaca

SEQ ID NO: 65654 - DNA, 24 bp, Artificial Sequence
  Synthetic oligonucleotide; GGGAGATT chr11 5301685 5301708 5301688 -
tgggtgtcctgctgctagaccaga

SEQ ID NO: 65655 - DNA, 24 bp, Artificial Sequence
  Synthetic oligonucleotide; AGCAGATT chr11 5301067 5301090 5301070 -
ctatcatttatagcatcaagacca

SEQ ID NO: 65656 - DNA, 24 bp, Artificial Sequence
  Synthetic oligonucleotide; CTAGGATT chr11 5300988 5301011 5300991 -
ccttatttcagaatctcaagatct

SEQ ID NO: 65657 - DNA, 24 bp, Artificial Sequence
  Synthetic oligonucleotide; GTTAGATT chr11 5300916 5300939 5300919 -
tatccacacttttttttcctcaga

SEQ ID NO: 65658 - DNA, 24 bp, Artificial Sequence
  Synthetic oligonucleotide; CTATGATT chr11 5300730 5300753 5300733 -
tataacaatccaaaagaagagtaa

SEQ ID NO: 65659 - DNA, 24 bp, Artificial Sequence
  Synthetic oligonucleotide; GCTTGATT chr11 5300549 5300572 5300552 -
actagttactctgaaaaggatctt

SEQ ID NO: 65660 - DNA, 24 bp, Artificial Sequence
  Synthetic oligonucleotide; TTCTGATT chr11 5299842 5299865 5299845 -
tgagcttgcttctaatattttctt

SEQ ID NO: 65661 - DNA, 24 bp, Artificial Sequence
  Synthetic oligonucleotide; CAGAGATT chr11 5299717 5299740 5299720 -
acagtgagcactctgaaaatattc

SEQ ID NO: 65662 - DNA, 24 bp, Artificial Sequence
  Synthetic oligonucleotide; GAAGGATT chr11 5299600 5299623 5299603 -
aaaaactaataaatgactactcct

SEQ ID NO: 65663 - DNA, 24 bp, Artificial Sequence
  Synthetic oligonucleotide; AGGGGATT chr11 5299258 5299281 5299261 -
aaaatggcaaatgtatttgtcagt

SEQ ID NO: 65664 - DNA, 24 bp, Artificial Sequence
  Synthetic oligonucleotide; TCTTGATT chr11 5299238 5299261 5299241 -
cagtaggggattgcgatgctgttt

SEQ ID NO: 65665 - DNA, 24 bp, Artificial Sequence
  Synthetic oligonucleotide; TACTGATT chr11 5297865 5297888 5297868 -
gcttcttattcattcctcttgctg

SEQ ID NO: 65666 - DNA, 24 bp, Artificial Sequence
  Synthetic oligonucleotide; AACTGATT chr11 5297520 5297543 5297523 -
cttaagaggttcacatttttatct

SEQ ID NO: 65667 - DNA, 24 bp, Artificial Sequence
  Synthetic oligonucleotide; AGCTGATT chr11 5297388 5297411 5297391 -
caaaaccacacaatgtagaaccta

SEQ ID NO: 65668 - DNA, 24 bp, Artificial Sequence
  Synthetic oligonucleotide; GAGGGATT chr11 5297343 5297366 5297346 -
acaatatgtggtataaatgagaca

SEQ ID NO: 65669 - DNA, 24 bp, Artificial Sequence
  Synthetic oligonucleotide; TGAAGATT chr11 5297245 5297268 5297248 -
acgggactttacatttctgtctgt

SEQ ID NO: 65670 - DNA, 24 bp, Artificial Sequence
  Synthetic oligonucleotide; ACTTGATT chr11 5296963 5296986 5296966 -
taatgtgtctgaatatctctattt

SEQ ID NO: 65671 - DNA, 24 bp, Artificial Sequence
  Synthetic oligonucleotide; AAGAGATT chr11 5296579 5296602 5296582 -
ctcctcatcatgttacaataacgg

SEQ ID NO: 65672 - DNA, 24 bp, Artificial Sequence
  Synthetic oligonucleotide; GATAGATT chr11 5296228 5296251 5296231 -
atctgctgtggtaagttacaaaga

SEQ ID NO: 65673 - DNA, 24 bp, Artificial Sequence
  Synthetic oligonucleotide; TTTTGATT chr11 5295893 5295916 5295896 -
gcttctttcagaaatagcctctat

SEQ ID NO: 65674 - DNA, 24 bp, Artificial Sequence
  Synthetic oligonucleotide; TCTGGATT chr11 5295723 5295746 5295726 -
atagttcccacagccccacttagc

SEQ ID NO: 65675 - DNA, 24 bp, Artificial Sequence
  Synthetic oligonucleotide; CATGGATT chr11 5295671 5295694 5295674 -
ttgcaactacatggacgtaaaatg

SEQ ID NO: 65676 - DNA, 24 bp, Artificial Sequence
  Synthetic oligonucleotide; CAATGATT chr11 5295436 5295459 5295439 -
atagtagtaatagtaataacaata

SEQ ID NO: 65677 - DNA, 24 bp, Artificial Sequence
  Synthetic oligonucleotide; CTTAGATT chr11 5295131 5295154 5295134 -
aagacataatttggggtgagaaag

SEQ ID NO: 65678 - DNA, 24 bp, Artificial Sequence
  Synthetic oligonucleotide; CTTTGATT chr11 5295033 5295056 5295036 -
aataaaacatatggttcagtatgc

SEQ ID NO: 65679 - DNA, 24 bp, Artificial Sequence
  Synthetic oligonucleotide; TAGTGATT chr11 5294968 5294991 5294971 -
agggtgtgggataatgctaattac

SEQ ID NO: 65680 - DNA, 24 bp, Artificial Sequence
  Synthetic oligonucleotide; AAGGGATT chr11 5294324 5294347 5294327 -
tgcgaagaacccttatgtctagat

SEQ ID NO: 65681 - DNA, 24 bp, Artificial Sequence
  Synthetic oligonucleotide; CAGGGATT chr11 5294166 5294189 5294169 -
cttggagaacctttatgtctagct

SEQ ID NO: 65682 - DNA, 24 bp, Artificial Sequence
  Synthetic oligonucleotide; CAGGGATT chr11 5294006 5294029 5294009 -
cgtggagaacctttatgtctagct

SEQ ID NO: 65683 - DNA, 24 bp, Artificial Sequence
  Synthetic oligonucleotide; CATGGATT chr11 5293796 5293819 5293799 -
cgtggagaacctttgtgtctagct

SEQ ID NO: 65684 - DNA, 24 bp, Artificial Sequence
  Synthetic oligonucleotide; AAAAGATT chr11 5293076 5293099 5293079 -
cccttcctctatgtggcagaaagt

SEQ ID NO: 65685 - DNA, 24 bp, Artificial Sequence
  Synthetic oligonucleotide; CCTCGATT chr11 5292718 5292741 5292721 -
aattttctcattttcataggtttt

SEQ ID NO: 65686 - DNA, 24 bp, Artificial Sequence
  Synthetic oligonucleotide; TCATGATT chr11 5292701 5292724 5292704 -
aggttttcctcgattgatcattat

SEQ ID NO: 65687 - DNA, 24 bp, Artificial Sequence
  Synthetic oligonucleotide; TCCAGATT chr11 5292624 5292647 5292627 -
acacatatgacattttaactatgt

SEQ ID NO: 65688 - DNA, 24 bp, Artificial Sequence
  Synthetic oligonucleotide; GGTGGATT chr11 5292558 5292581 5292561 -
ccacaaaaaataagtatgtgaagt

SEQ ID NO: 65689 - DNA, 24 bp, Artificial Sequence
  Synthetic oligonucleotide; ACTGGATT chr11 5291847 5291870 5291850 -
tgcttcacgtagtctgtgcttatg

SEQ ID NO: 65690 - DNA, 24 bp, Artificial Sequence
  Synthetic oligonucleotide; CTCTGATT chr11 5291648 5291671 5291651 -
tagtaagcatgaggatgcctcctt

SEQ ID NO: 65691 - DNA, 24 bp, Artificial Sequence
  Synthetic oligonucleotide; GAGTGATT chr11 5291608 5291631 5291611 -
agtctgttggtcacagaataacct

SEQ ID NO: 65692 - DNA, 24 bp, Artificial Sequence
  Synthetic oligonucleotide; AGTGGATT chr11 5291518 5291541 5291521 -
agtcaaaatgtttctctttttatt

SEQ ID NO: 65693 - DNA, 24 bp, Artificial Sequence
  Synthetic oligonucleotide; TTTTGATT chr11 5291369 5291392 5291372 -
agcaaggaagttgttaaggagccc

SEQ ID NO: 65694 - DNA, 24 bp, Artificial Sequence
  Synthetic oligonucleotide; CTTTGATT chr11 5291118 5291141 5291121 -
agagtccagaaatggcaacattac

SEQ ID NO: 65695 - DNA, 24 bp, Artificial Sequence
  Synthetic oligonucleotide; AAAGGATT chr11 5290965 5290988 5290968 -
ctcatttctcagaagtatattttg

SEQ ID NO: 65696 - DNA, 24 bp, Artificial Sequence
  Synthetic oligonucleotide; TAAGGATT chr11 5290712 5290735 5290715 -
aaatacctgcttcatagttattaa

SEQ ID NO: 65697 - DNA, 24 bp, Artificial Sequence
  Synthetic oligonucleotide; ATAAGATT chr11 5290688 5290711 5290691 -
taaggattaagtgagataatgccc

SEQ ID NO: 65698 - DNA, 24 bp, Artificial Sequence
  Synthetic oligonucleotide; AAAGGATT chr11 5290638 5290661 5290641 -
atacatacacacacacacacattg

SEQ ID NO: 65699 - DNA, 24 bp, Artificial Sequence
  Synthetic oligonucleotide; GCCTGATT chr11 5289464 5289487 5289467 -
acagttgaaaagacctaagcttgt

SEQ ID NO: 65700 - DNA, 24 bp, Artificial Sequence
  Synthetic oligonucleotide; GTTAGATT chr11 5288915 5288938 5288918 -
attatctcattgctgttcataatt

SEQ ID NO: 65701 - DNA, 24 bp, Artificial Sequence
  Synthetic oligonucleotide; ACAAGATT chr11 5288644 5288667 5288647 -
agccattgaaacaggaataacaga

SEQ ID NO: 65702 - DNA, 24 bp, Artificial Sequence
  Synthetic oligonucleotide; AAATGATT chr11 5287911 5287934 5287914 -
tttttataagtaggagtctggagt

SEQ ID NO: 65703 - DNA, 24 bp, Artificial Sequence
  Synthetic oligonucleotide; GTCAGATT chr11 5287736 5287759 5287739 -
caccttcacccaggcccactgagt

SEQ ID NO: 65704 - DNA, 24 bp, Artificial Sequence
  Synthetic oligonucleotide; CAGAGATT chr11 5287567 5287590 5287570 -
ataaaagtcttgggcagtatagag

SEQ ID NO: 65705 - DNA, 24 bp, Artificial Sequence
  Synthetic oligonucleotide; GAGTGATT chr11 5287529 5287552 5287532 -
acagatgctggagccagaccacct

SEQ ID NO: 65706 - DNA, 24 bp, Artificial Sequence
  Synthetic oligonucleotide; CTGGGATT chr11 5287192 5287215 5287195 -
tgcccacctcagccttccaaagtg

SEQ ID NO: 65707 - DNA, 24 bp, Artificial Sequence
  Synthetic oligonucleotide; GCATGATT chr11 5287180 5287203 5287183 -
ccttccaaagtgctgggattataa

SEQ ID NO: 65708 - DNA, 24 bp, Artificial Sequence
  Synthetic oligonucleotide; ATAAGATT chr11 5287152 5287175 5287155 -
gattacaggagttttaacaggctc

SEQ ID NO: 65709 - DNA, 24 bp, Artificial Sequence
  Synthetic oligonucleotide; CTTGGATT chr11 5286897 5286920 5286900 -
gcataattaatcatatttaatact

SEQ ID NO: 65710 - DNA, 24 bp, Artificial Sequence
  Synthetic oligonucleotide; TTGAGATT chr11 5286772 5286795 5286775 -
ataaactactagcaaatagtagaa

SEQ ID NO: 65711 - DNA, 24 bp, Artificial Sequence
  Synthetic oligonucleotide; TTTTGATT chr11 5286445 5286468 5286448 -
caccatgtggagaaggggtggtgg

SEQ ID NO: 65712 - DNA, 24 bp, Artificial Sequence
  Synthetic oligonucleotide; CCAGGATT chr11 5286264 5286287 5286267 -
gggaatcaagttatattatgtaac

SEQ ID NO: 65713 - DNA, 24 bp, Artificial Sequence
  Synthetic oligonucleotide; AGAAGATT chr11 5286256 5286279 5286259 -
agttatattatgtaacccaggatt

SEQ ID NO: 65714 - DNA, 24 bp, Artificial Sequence
  Synthetic oligonucleotide; AGGGGATT chr11 5286130 5286153 5286133 -
acccatcattgaataaatccctat

SEQ ID NO: 65715 - DNA, 24 bp, Artificial Sequence
  Synthetic oligonucleotide; TCTTGATT chr11 5286100 5286123 5286103 -
tttctaccctgagcaaaaggctgg

SEQ ID NO: 65716 - DNA, 24 bp, Artificial Sequence
  Synthetic oligonucleotide; ATCAGATT chr11 5285958 5285981 5285961 -
ctctcataattcttggttgcatga

SEQ ID NO: 65717 - DNA, 24 bp, Artificial Sequence
  Synthetic oligonucleotide; CTTAGATT chr11 5285584 5285607 5285587 -
cctcctagcatccagagactagtg

SEQ ID NO: 65718 - DNA, 24 bp, Artificial Sequence
  Synthetic oligonucleotide; GAAGGATT chr11 5285294 5285317 5285297 -
atgggatgagtaagagaggagagg

SEQ ID NO: 65719 - DNA, 24 bp, Artificial Sequence
  Synthetic oligonucleotide; CTTGGATT chr11 5284937 5284960 5284940 -
tttgggagcaggagtctctaagga

SEQ ID NO: 65720 - DNA, 24 bp, Artificial Sequence
  Synthetic oligonucleotide; TAAAGATT chr11 5284242 5284265 5284245 -
ttttaatgaaagcttagctttcat

SEQ ID NO: 65721 - DNA, 24 bp, Artificial Sequence
  Synthetic oligonucleotide; TGTAGATT chr11 5284045 5284068 5284048 -
cacatgagagacacgaggaaatag

SEQ ID NO: 65722 - DNA, 24 bp, Artificial Sequence
  Synthetic oligonucleotide; ATGGGATT chr11 5283802 5283825 5283805 -
gaggccgggcacggtggctcatat

SEQ ID NO: 65723 - DNA, 24 bp, Artificial Sequence
  Synthetic oligonucleotide; CTAAGATT chr11 5283579 5283602 5283582 -
ccaggaggtggaggttgcagtgag

SEQ ID NO: 65724 - DNA, 24 bp, Artificial Sequence
  Synthetic oligonucleotide; AGTAGATT chr11 5283464 5283487 5283467 -
gttttactcacaccaatactcaga

SEQ ID NO: 65725 - DNA, 24 bp, Artificial Sequence
  Synthetic oligonucleotide; TGTCGATT chr11 5283105 5283128 5283108 -
cccttgcttcttacttttacttct

SEQ ID NO: 65726 - DNA, 24 bp, Artificial Sequence
  Synthetic oligonucleotide; AAGAGATT chr11 5282980 5283003 5282983 -
aaatttagaaacaacttcagaata

SEQ ID NO: 65727 - DNA, 24 bp, Artificial Sequence
  Synthetic oligonucleotide; CAGAGATT chr11 5282959 5282982 5282962 -
ataaagagattttctcttgggtta

SEQ ID NO: 65728 - DNA, 24 bp, Artificial Sequence
  Synthetic oligonucleotide; TGCAGATT chr11 5282633 5282656 5282636 -
ggtacacaagaaatgagaagaaac

SEQ ID NO: 65729 - DNA, 24 bp, Artificial Sequence
  Synthetic oligonucleotide; TGTTGATT chr11 5281844 5281867 5281847 -
tcatggcaacatggctgcctaaag

SEQ ID NO: 65730 - DNA, 24 bp, Artificial Sequence
  Synthetic oligonucleotide; TTATGATT chr11 5281076 5281099 5281079 -
ataagatacatgttttattcttat

SEQ ID NO: 65731 - DNA, 24 bp, Artificial Sequence
  Synthetic oligonucleotide; GAATGATT chr11 5281015 5281038 5281018 -
gcaggtgcttcaaaaccatttgct

SEQ ID NO: 65732 - DNA, 24 bp, Artificial Sequence
  Synthetic oligonucleotide; CTCTGATT chr11 5280957 5280980 5280960 -
ctctatcccttccagcatcctcat

SEQ ID NO: 65733 - DNA, 24 bp, Artificial Sequence
  Synthetic oligonucleotide; GAATGATT chr11 5280478 5280501 5280481 -
tatttgttgttatcaattgccata

SEQ ID NO: 65734 - DNA, 24 bp, Artificial Sequence
  Synthetic oligonucleotide; TATAGATT chr11 5280389 5280412 5280392 -
aatcaggctttattaatacatgtg

SEQ ID NO: 65735 - DNA, 24 bp, Artificial Sequence
  Synthetic oligonucleotide; AGAAGATT chr11 5279617 5279640 5279620 -
cttggtttcgctaagagcacagag

SEQ ID NO: 65736 - DNA, 24 bp, Artificial Sequence
  Synthetic oligonucleotide; GTGTGATT chr11 5278919 5278942 5278922 -
aaggaaggcaggtgtggctctgca

SEQ ID NO: 65737 - DNA, 24 bp, Artificial Sequence
  Synthetic oligonucleotide; GTCTGATT chr11 5278481 5278504 5278484 -
aattccctgaccgaacagaattct

SEQ ID NO: 65738 - DNA, 24 bp, Artificial Sequence
  Synthetic oligonucleotide; ATGGGATT chr11 5277055 5277078 5277058 -
tagccctccgcaggcagagccttg

SEQ ID NO: 65739 - DNA, 24 bp, Artificial Sequence
  Synthetic oligonucleotide; CTGAGATT chr11 5277011 5277034 5277014 -
aattggactcatttgttttgtagg

SEQ ID NO: 65740 - DNA, 24 bp, Artificial Sequence
  Synthetic oligonucleotide; GTAAGATT chr11 5276609 5276632 5276612 -
acttctattcaatgagaatattct

SEQ ID NO: 65741 - DNA, 24 bp, Artificial Sequence
  Synthetic oligonucleotide; TGTTGATT chr11 5275878 5275901 5275881 -
aaaaataatgggtttgcccatctc

SEQ ID NO: 65742 - DNA, 24 bp, Artificial Sequence
  Synthetic oligonucleotide; ATAAGATT chr11 5275197 5275220 5275200 -
agaggtttttcaaaatttctagac

SEQ ID NO: 65743 - DNA, 24 bp, Artificial Sequence
  Synthetic oligonucleotide; GGCTGATT chr11 5274851 5274874 5274854 -
catgtaggaaagtgtggcataact

SEQ ID NO: 65744 - DNA, 24 bp, Artificial Sequence
  Synthetic oligonucleotide; GAGAGATT chr11 5274704 5274727 5274707 -
gtctgtgctccaagttgccagaga

SEQ ID NO: 65745 - DNA, 24 bp, Artificial Sequence
  Synthetic oligonucleotide; TATAGATT chr11 5274173 5274196 5274176 -
ttacatctatttttgttctgagaa

SEQ ID NO: 65746 - DNA, 24 bp, Artificial Sequence
  Synthetic oligonucleotide; GAAAGATT chr11 5273850 5273873 5273853 -
taaacatatgtcataaattagcca

SEQ ID NO: 65747 - DNA, 24 bp, Artificial Sequence
  Synthetic oligonucleotide; CATAGATT chr11 5273665 5273688 5273668 -
tatacttaaatgtcttaagacata

SEQ ID NO: 65748 - DNA, 24 bp, Artificial Sequence
  Synthetic oligonucleotide; TACTGATT chr11 5273613 5273636 5273616 -
atatagacaataaatgaatattct

SEQ ID NO: 65749 - DNA, 24 bp, Artificial Sequence
  Synthetic oligonucleotide; TCAGGATT chr11 5273376 5273399 5273379 -
cccgcagcctacctgacttctgag

SEQ ID NO: 65750 - DNA, 24 bp, Artificial Sequence
  Synthetic oligonucleotide; ATGGGATT chr11 5273110 5273133 5273113 -
tccatactctgaatgggaagaatg

SEQ ID NO: 65751 - DNA, 24 bp, Artificial Sequence
  Synthetic oligonucleotide; GCATGATT chr11 5272461 5272484 5272464 -
tattgcccaggctggagtgcagtg

SEQ ID NO: 65752 - DNA, 24 bp, Artificial Sequence
  Synthetic oligonucleotide; TGGGGATT chr11 5272388 5272411 5272391 -
tcctgccttggcctcctgagtagc

SEQ ID NO: 65753 - DNA, 24 bp, Artificial Sequence
  Synthetic oligonucleotide; CTGGGATT chr11 5272253 5272276 5272256 -
tgcccgccttggcctcctgaagtg

SEQ ID NO: 65754 - DNA, 24 bp, Artificial Sequence
  Synthetic oligonucleotide; ATGAGATT chr11 5271158 5271181 5271161 -
agaaggaggaactgggctggggca

SEQ ID NO: 65755 - DNA, 24 bp, Artificial Sequence
  Synthetic oligonucleotide; CCTTGATT chr11 5271028 5271051 5271031 -
ttaaataatttctgtgaatttatt

SEQ ID NO: 65756 - DNA, 24 bp, Artificial Sequence
  Synthetic oligonucleotide; GGCAGATT chr11 5270985 5271008 5270988 -
ggataatgacaatggtattataag

SEQ ID NO: 65757 - DNA, 24 bp, Artificial Sequence
  Synthetic oligonucleotide; GCCTGATT chr11 5270808 5270831 5270811 -
aggaataatataccctgactccta

SEQ ID NO: 65758 - DNA, 24 bp, Artificial Sequence
  Synthetic oligonucleotide; TATCGATT chr11 5270796 5270819 5270799 -
ccctgactcctagcctgattaata

SEQ ID NO: 65759 - DNA, 24 bp, Artificial Sequence
  Synthetic oligonucleotide; TTAGGATT chr11 5270744 5270767 5270747 -
gacaaattctggctttaaataatt

SEQ ID NO: 65760 - DNA, 24 bp, Artificial Sequence
  Synthetic oligonucleotide; AGAGGATT chr11 5270610 5270633 5270613 -
gtggtcatagagaaatgaaaagag

SEQ ID NO: 65761 - DNA, 24 bp, Artificial Sequence
  Synthetic oligonucleotide; TTGGGATT chr11 5270534 5270557 5270537 -
ggaatcaccccaaggtactgtact

SEQ ID NO: 65762 - DNA, 24 bp, Artificial Sequence
  Synthetic oligonucleotide; GTGAGATT chr11 5270388 5270411 5270391 -
actccttaagagagctagaactgg

SEQ ID NO: 65763 - DNA, 24 bp, Artificial Sequence
  Synthetic oligonucleotide; TTGAGATT chr11 5270275 5270298 5270278 -
ttggctgaaactttttttcctatt

SEQ ID NO: 65764 - DNA, 24 bp, Artificial Sequence
  Synthetic oligonucleotide; AGTTGATT chr11 5269747 5269770 5269750 -
tgaagggtgaatattaccctagca

SEQ ID NO: 65765 - DNA, 24 bp, Artificial Sequence
  Synthetic oligonucleotide; TCAAGATT chr11 5269729 5269752 5269732 -
ctagcaagttgattgggaaagtcc

SEQ ID NO: 65766 - DNA, 24 bp, Artificial Sequence
  Synthetic oligonucleotide; CAGAGATT chr11 5269652 5269675 5269655 -
ctcctcgttgtttacccctggacc

SEQ ID NO: 65767 - DNA, 24 bp, Artificial Sequence
  Synthetic oligonucleotide; ATGTGATT chr11 5269435 5269458 5269438 -
tcaaggtgagttcaggtgctggtg

SEQ ID NO: 65768 - DNA, 24 bp, Artificial Sequence
  Synthetic oligonucleotide; ACATGATT chr11 5269299 5269322 5269302 -
ttctagtgagcataaccaaaactt

SEQ ID NO: 65769 - DNA, 24 bp, Artificial Sequence
  Synthetic oligonucleotide; AAGAGATT chr11 5269076 5269099 5269079 -
gggtcatgataattgaggtttaga

SEQ ID NO: 65770 - DNA, 24 bp, Artificial Sequence
  Synthetic oligonucleotide; AAAAGATT chr11 5269054 5269077 5269057 -
gaaagagatttttgcaaaaaaaat

SEQ ID NO: 65771 - DNA, 24 bp, Artificial Sequence
  Synthetic oligonucleotide; TGGGGATT chr11 5268957 5268980 5268960 -
gtgaaggcttgtttccgaatttgt

SEQ ID NO: 65772 - DNA, 24 bp, Artificial Sequence
  Synthetic oligonucleotide; TGGTGATT chr11 5268582 5268605 5268585 -
cctaacagctcctgggtaacgtga

SEQ ID NO: 65773 - DNA, 24 bp, Artificial Sequence
  Synthetic oligonucleotide; CCAGGATT chr11 5268193 5268216 5268196 -
taatgtggatgttatgggagaatt

SEQ ID NO: 65774 - DNA, 24 bp, Artificial Sequence
  Synthetic oligonucleotide; AGCAGATT chr11 5268057 5268080 5268060 -
ggagctgttagtggtacctgagaa

SEQ ID NO: 65775 - DNA, 24 bp, Artificial Sequence
  Synthetic oligonucleotide; AATTGATT chr11 5267908 5267931 5267911 -
gctagcttgtcacatgttttatga

SEQ ID NO: 65776 - DNA, 24 bp, Artificial Sequence
  Synthetic oligonucleotide; GAAGGATT chr11 5267855 5267878 5267858 -
tcaacaatagcctgctctttccat

SEQ ID NO: 65777 - DNA, 24 bp, Artificial Sequence
  Synthetic oligonucleotide; ATAAGATT chr11 5267483 5267506 5267486 -
ttaggatgttaagtgactcaggaa

SEQ ID NO: 65778 - DNA, 24 bp, Artificial Sequence
  Synthetic oligonucleotide; AATGGATT chr11 5267444 5267467 5267447 -
aaagtaatctgcttatgtgcacaa

SEQ ID NO: 65779 - DNA, 24 bp, Artificial Sequence
  Synthetic oligonucleotide; TGATGATT chr11 5267408 5267431 5267411 -
tttgcagataaaataaaatatgga

SEQ ID NO: 65780 - DNA, 24 bp, Artificial Sequence
  Synthetic oligonucleotide; AACAGATT chr11 5267174 5267197 5267177 -
atgtgtgaagggtagagggatatt

SEQ ID NO: 65781 - DNA, 24 bp, Artificial Sequence
  Synthetic oligonucleotide; GCTAGATT chr11 5267151 5267174 5267154 -
taacagatttactttttaggaagt

SEQ ID NO: 65782 - DNA, 24 bp, Artificial Sequence
  Synthetic oligonucleotide; CAGGGATT chr11 5266866 5266889 5266869 -
caatatgcccataaacagagtaaa

SEQ ID NO: 65783 - DNA, 24 bp, Artificial Sequence
  Synthetic oligonucleotide; TGATGATT chr11 5266740 5266763 5266743 -
tgatacttacatgcctagaacatg

SEQ ID NO: 65784 - DNA, 24 bp, Artificial Sequence
  Synthetic oligonucleotide; ACAAGATT chr11 5266291 5266314 5266294 -
gttccatccatgttgctacaaatg

SEQ ID NO: 65785 - DNA, 24 bp, Artificial Sequence
  Synthetic oligonucleotide; TACTGATT chr11 5266137 5266160 5266140 -
tgagtgtaatgtgtccattggata

SEQ ID NO: 65786 - DNA, 24 bp, Artificial Sequence
  Synthetic oligonucleotide; GTGAGATT chr11 5266102 5266125 5266105 -
tttcttttggataaataaccacta

SEQ ID NO: 65787 - DNA, 24 bp, Artificial Sequence
  Synthetic oligonucleotide; GCTGGATT chr11 5266094 5266117 5266097 -
ggataaataaccactagtgagatt

SEQ ID NO: 65788 - DNA, 24 bp, Artificial Sequence
  Synthetic oligonucleotide; TTTTGATT chr11 5265893 5265916 5265896 -
gagtaagtagatatctcattgtag

SEQ ID NO: 65789 - DNA, 24 bp, Artificial Sequence
  Synthetic oligonucleotide; TTGGGATT chr11 5265777 5265800 5265780 -
ttcatgtccttagcctacttttta

SEQ ID NO: 65790 - DNA, 24 bp, Artificial Sequence
  Synthetic oligonucleotide; TATAGATT chr11 5265701 5265724 5265704 -
tggatattattcttttgtcagatg

SEQ ID NO: 65791 - DNA, 24 bp, Artificial Sequence
  Synthetic oligonucleotide; TGAAGATT chr11 5265692 5265715 5265695 -
ttcttttgtcagatgtatagattg

SEQ ID NO: 65792 - DNA, 24 bp, Artificial Sequence
  Synthetic oligonucleotide; CTTAGATT chr11 5265482 5265505 5265485 -
tctagaattgttacagtttcaggg

SEQ ID NO: 65793 - DNA, 24 bp, Artificial Sequence
  Synthetic oligonucleotide; AGTTGATT chr11 5265454 5265477 5265457 -
gatttaagtccttgatccatcttg

SEQ ID NO: 65794 - DNA, 24 bp, Artificial Sequence
  Synthetic oligonucleotide; TTCAGATT chr11 5265177 5265200 5265180 -
tttgaaatgaggtaatgtaatgcc

SEQ ID NO: 65795 - DNA, 24 bp, Artificial Sequence
  Synthetic oligonucleotide; TTAGGATT chr11 5265112 5265135 5265115 -
ctcttttttggttccataagaatt

SEQ ID NO: 65796 - DNA, 24 bp, Artificial Sequence
  Synthetic oligonucleotide; TATTGATT chr11 5265010 5265033 5265013 -
ctggcattatggccattttcacaa

SEQ ID NO: 65797 - DNA, 24 bp, Artificial Sequence
  Synthetic oligonucleotide; ATATGATT chr11 5264956 5264979 5264959 -
tgtgtttccatttgtttgtgtctt

SEQ ID NO: 65798 - DNA, 24 bp, Artificial Sequence
  Synthetic oligonucleotide; TCTTGATT chr11 5264825 5264848 5264828 -
cagctattgtaaaaggggttgagt

SEQ ID NO: 65799 - DNA, 24 bp, Artificial Sequence
  Synthetic oligonucleotide; GTCTGATT chr11 5264604 5264627 5264607 -
ggatgtgctttacttgtttctctt

SEQ ID NO: 65800 - DNA, 24 bp, Artificial Sequence
  Synthetic oligonucleotide; AACCGATT chr11 5264427 5264450 5264430 -
ttacattgaggtatgtcctttgta

SEQ ID NO: 65801 - DNA, 24 bp, Artificial Sequence
  Synthetic oligonucleotide; ACATGATT chr11 5264349 5264372 5264352 -
gtttctgtggctattgagataatc

SEQ ID NO: 65802 - DNA, 24 bp, Artificial Sequence
  Synthetic oligonucleotide; GAATGATT chr11 5264098 5264121 5264101 -
tattaaggtgatactggcttcata

SEQ ID NO: 65803 - DNA, 24 bp, Artificial Sequence
  Synthetic oligonucleotide; GGAGGATT chr11 5264087 5264110 5264090 -
tactggcttcatagaatgatttag

SEQ ID NO: 65804 - DNA, 24 bp, Artificial Sequence
  Synthetic oligonucleotide; ATAGGATT chr11 5264048 5264071 5264051 -
tctctatcttgtagaatactgtca

SEQ ID NO: 65805 - DNA, 24 bp, Artificial Sequence
  Synthetic oligonucleotide; GAATGATT chr11 5262903 5262926 5262906 -
acgtgtgcacgtgtctttatagta

SEQ ID NO: 65806 - DNA, 24 bp, Artificial Sequence
  Synthetic oligonucleotide; ATGGGATT chr11 5262868 5262891 5262871 -
aattctttgggtatatacccagta

SEQ ID NO: 65807 - DNA, 24 bp, Artificial Sequence
  Synthetic oligonucleotide; TTTTGATT chr11 5262664 5262687 5262667 -
gcatgagatggtatctcattgtgg

SEQ ID NO: 65808 - DNA, 24 bp, Artificial Sequence
  Synthetic oligonucleotide; TGTAGATT chr11 5262505 5262528 5262508 -
tcttgtaaatttgttgaagttctt

SEQ ID NO: 65809 - DNA, 24 bp, Artificial Sequence
  Synthetic oligonucleotide; GATAGATT chr11 5262472 5262495 5262475 -
tggatgttagccctttgtcagatg

SEQ ID NO: 65810 - DNA, 24 bp, Artificial Sequence
  Synthetic oligonucleotide; CTAGGATT chr11 5262277 5262300 5262280 -
gaatggtattgcctaggttatctt

SEQ ID NO: 65811 - DNA, 24 bp, Artificial Sequence
  Synthetic oligonucleotide; TTAGGATT chr11 5261933 5261956 5261936 -
tgcctccagctttgttctttttgt

SEQ ID NO: 65812 - DNA, 24 bp, Artificial Sequence
  Synthetic oligonucleotide; TTTTGATT chr11 5261904 5261927 5261907 -
attgtcttggctatatgggctctt

SEQ ID NO: 65813 - DNA, 24 bp, Artificial Sequence
  Synthetic oligonucleotide; TATTGATT chr11 5261783 5261806 5261786 -
tgggcagtatggccattttaaaga

SEQ ID NO: 65814 - DNA, 24 bp, Artificial Sequence
  Synthetic oligonucleotide; CCATGATT chr11 5261603 5261626 5261606 -
cagcaattgtgaatgggagttcac

SEQ ID NO: 65815 - DNA, 24 bp, Artificial Sequence
  Synthetic oligonucleotide; TTGTGATT chr11 5261557 5261580 5261560 -
tctattattggtgtataggaacgc

SEQ ID NO: 65816 - DNA, 24 bp, Artificial Sequence
  Synthetic oligonucleotide; CACTGATT chr11 5261543 5261566 5261546 -
ataggaacgcttgtgatttctgca

SEQ ID NO: 65817 - DNA, 24 bp, Artificial Sequence
  Synthetic oligonucleotide; TTAAGATT chr11 5261499 5261522 5261502 -
actttgctgaagctgtttatcagc

SEQ ID NO: 65818 - DNA, 24 bp, Artificial Sequence
  Synthetic oligonucleotide; GCCTGATT chr11 5261384 5261407 5261387 -
gaatatgctttatttctttctctt

SEQ ID NO: 65819 - DNA, 24 bp, Artificial Sequence
  Synthetic oligonucleotide; AAATGATT chr11 5261298 5261321 5261301 -
ttgtcttgtgccggttttcaaagc

SEQ ID NO: 65820 - DNA, 24 bp, Artificial Sequence
  Synthetic oligonucleotide; TCTTGATT chr11 5261278 5261301 5261281 -
aagcaaatgatttttaaatttcca

SEQ ID NO: 65821 - DNA, 24 bp, Artificial Sequence
  Synthetic oligonucleotide; AGTTGATT chr11 5261191 5261214 5261194 -
catggttttgaaggttccttttgt

SEQ ID NO: 65822 - DNA, 24 bp, Artificial Sequence
  Synthetic oligonucleotide; ATGGGATT chr11 5260448 5260471 5260451 -
ctgtatttttgttgtatatgtcct

SEQ ID NO: 65823 - DNA, 24 bp, Artificial Sequence
  Synthetic oligonucleotide; TCAAGATT chr11 5260395 5260418 5260398 -
tttgatgtgcttccagggtttatt

SEQ ID NO: 65824 - DNA, 24 bp, Artificial Sequence
  Synthetic oligonucleotide; TTAAGATT chr11 5260118 5260141 5260121 -
cctggtagtttcacctcacagctc

SEQ ID NO: 65825 - DNA, 24 bp, Artificial Sequence
  Synthetic oligonucleotide; CCTTGATT chr11 5259972 5259995 5259975 -
ctctagcaaggtgggggaagtttt

SEQ ID NO: 65826 - DNA, 24 bp, Artificial Sequence
  Synthetic oligonucleotide; TTTAGATT chr11 5259938 5259961 5259941 -
ttccctggataagttttccaaact

SEQ ID NO: 65827 - DNA, 24 bp, Artificial Sequence
  Synthetic oligonucleotide; TGCTGATT chr11 5259912 5259935 5259915 -
tagatttctcttctttctcaggaa

SEQ ID NO: 65828 - DNA, 24 bp, Artificial Sequence
  Synthetic oligonucleotide; GTTTGATT chr11 5259896 5259919 5259899 -
ctcaggaatgctgattattcttag

SEQ ID NO: 65829 - DNA, 24 bp, Artificial Sequence
  Synthetic oligonucleotide; CCCAGATT chr11 5259876 5259899 5259879 -
ttaggtttgattgtttaacataat

SEQ ID NO: 65830 - DNA, 24 bp, Artificial Sequence
  Synthetic oligonucleotide; GTTGGATT chr11 5259821 5259844 5259824 -
tcttattcttttttctttgtcttt

SEQ ID NO: 65831 - DNA, 24 bp, Artificial Sequence
  Synthetic oligonucleotide; CTTGGATT chr11 5259769 5259792 5259772 -
tcttcaagctctgaatttcttctg

SEQ ID NO: 65832 - DNA, 24 bp, Artificial Sequence
  Synthetic oligonucleotide; TGAAGATT chr11 5259656 5259679 5259659 -
ttttatttatgctatctctttaac

SEQ ID NO: 65833 - DNA, 24 bp, Artificial Sequence
  Synthetic oligonucleotide; CCTTGATT chr11 5259580 5259603 5259583 -
ggacttcaccttcctcggatgcct

SEQ ID NO: 65834 - DNA, 24 bp, Artificial Sequence
  Synthetic oligonucleotide; CAGGGATT chr11 5259532 5259555 5259535 -
ttctgaattatttttcaggtaaat

SEQ ID NO: 65835 - DNA, 24 bp, Artificial Sequence
  Synthetic oligonucleotide; GTATGATT chr11 5259491 5259514 5259494 -
tttggatgcattgctggtgagcta

SEQ ID NO: 65836 - DNA, 24 bp, Artificial Sequence
  Synthetic oligonucleotide; TAGTGATT chr11 5259292 5259315 5259295 -
tggggcttcctgagagccgaactg

SEQ ID NO: 65837 - DNA, 24 bp, Artificial Sequence
  Synthetic oligonucleotide; AATGGATT chr11 5258829 5258852 5258832 -
ggatgggggtgtagtttccaggtc

SEQ ID NO: 65838 - DNA, 24 bp, Artificial Sequence
  Synthetic oligonucleotide; TGGAGATT chr11 5258504 5258527 5258507 -
gcccagcccctagatctggccagg

SEQ ID NO: 65839 - DNA, 24 bp, Artificial Sequence
  Synthetic oligonucleotide; TCTTGATT chr11 5258144 5258167 5258147 -
agggtgtgtgcgttctctcagctt

SEQ ID NO: 65840 - DNA, 24 bp, Artificial Sequence
  Synthetic oligonucleotide; TCTAGATT chr11 5257862 5257885 5257865 -
ctctttaccccttagggagctata

SEQ ID NO: 65841 - DNA, 24 bp, Artificial Sequence
  Synthetic oligonucleotide; ACAAGATT chr11 5257776 5257799 5257779 -
cacacacacacacacatctgcatg

SEQ ID NO: 65842 - DNA, 24 bp, Artificial Sequence
  Synthetic oligonucleotide; TAGAGATT chr11 5257649 5257672 5257652 -
atccagccaatagtacaggttgct

SEQ ID NO: 65843 - DNA, 24 bp, Artificial Sequence
  Synthetic oligonucleotide; GGCAGATT chr11 5257401 5257424 5257404 -
ctttatttggcaatgccttcccat

SEQ ID NO: 65844 - DNA, 24 bp, Artificial Sequence
  Synthetic oligonucleotide; CCTAGATT chr11 5257280 5257303 5257283 -
attattaattttatgtatgttcta

SEQ ID NO: 65845 - DNA, 24 bp, Artificial Sequence
  Synthetic oligonucleotide; TTAGGATT chr11 5257100 5257123 5257103 -
tgtgtaaagaaacagttttatcag

SEQ ID NO: 65846 - DNA, 24 bp, Artificial Sequence
  Synthetic oligonucleotide; TTAAGATT chr11 5256872 5256895 5256875 -
attccttagtctgaggaggagcaa

SEQ ID NO: 65847 - DNA, 24 bp, Artificial Sequence
  Synthetic oligonucleotide; GAGAGATT chr11 5256559 5256582 5256562 -
agactctgtctcaaaaaaaaaaaa

SEQ ID NO: 65848 - DNA, 24 bp, Artificial Sequence
  Synthetic oligonucleotide; AAAAGATT chr11 5256550 5256573 5256553 -
ctcaaaaaaaaaaaagagagattc

SEQ ID NO: 65849 - DNA, 24 bp, Artificial Sequence
  Synthetic oligonucleotide; CTTAGATT chr11 5256327 5256350 5256330 -
caataaaaatctttctcacccatc

SEQ ID NO: 65850 - DNA, 24 bp, Artificial Sequence
  Synthetic oligonucleotide; ACAGGATT chr11 5256123 5256146 5256126 -
actttgagcagatataagccttac

SEQ ID NO: 65851 - DNA, 24 bp, Artificial Sequence
  Synthetic oligonucleotide; AAAGGATT chr11 5256105 5256128 5256108 -
ccttacacaggattatgaagtctg

SEQ ID NO: 65852 - DNA, 24 bp, Artificial Sequence
  Synthetic oligonucleotide; GCCAGATT chr11 5256030 5256053 5256033 -
gaaggtagagctctcctccaataa

SEQ ID NO: 65853 - DNA, 24 bp, Artificial Sequence
  Synthetic oligonucleotide; ATAAGATT chr11 5255722 5255745 5255725 -
caaatacatgtcttatgtcttaga

SEQ ID NO: 65854 - DNA, 24 bp, Artificial Sequence
  Synthetic oligonucleotide; GCGTGATT chr11 5255494 5255517 5255497 -
aatacttttgctgagatgaaacag

SEQ ID NO: 65855 - DNA, 24 bp, Artificial Sequence
  Synthetic oligonucleotide; TAAGGATT chr11 5255451 5255474 5255454 -
ggtacggataagtagatattgaag

SEQ ID NO: 65856 - DNA, 24 bp, Artificial Sequence
  Synthetic oligonucleotide; ATAGGATT chr11 5255386 5255409 5255389 -
ttcctgcactgaaactgttgcttt

SEQ ID NO: 65857 - DNA, 24 bp, Artificial Sequence
  Synthetic oligonucleotide; TCAGGATT chr11 5254567 5254590 5254570 -
cctggcaaaagtccaggtcgcttc

SEQ ID NO: 65858 - DNA, 24 bp, Artificial Sequence
  Synthetic oligonucleotide; ATTAGATT chr11 5254038 5254061 5254041 -
aaatgaggaaaatgacttttcttt

SEQ ID NO: 65859 - DNA, 24 bp, Artificial Sequence
  Synthetic oligonucleotide; AGTAGATT chr11 5253743 5253766 5253746 -
gaacaattgaaacatttgggctgg

SEQ ID NO: 65860 - DNA, 24 bp, Artificial Sequence
  Synthetic oligonucleotide; ACAAGATT chr11 5253610 5253633 5253613 -
agggttcatggtggcaagaagata

SEQ ID NO: 65861 - DNA, 24 bp, Artificial Sequence
  Synthetic oligonucleotide; GCTTGATT chr11 5253509 5253532 5253512 -
aggctttgagggaagttaacatag

SEQ ID NO: 65862 - DNA, 24 bp, Artificial Sequence
  Synthetic oligonucleotide; CCTGGATT chr11 5252852 5252875 5252855 -
agtgaagggggctgaacccccttc

SEQ ID NO: 65863 - DNA, 24 bp, Artificial Sequence
  Synthetic oligonucleotide; GGCAGATT chr11 5252354 5252377 5252357 -
aatttgtataacattaattgagaa

SEQ ID NO: 65864 - DNA, 24 bp, Artificial Sequence
  Synthetic oligonucleotide; GAGAGATT chr11 5252118 5252141 5252121 -
gaattattttcctcatcagaagca

SEQ ID NO: 65865 - DNA, 24 bp, Artificial Sequence
  Synthetic oligonucleotide; AGTGGATT chr11 5251911 5251934 5251914 -
agaaaaaaataagcttcggtgttc

SEQ ID NO: 65866 - DNA, 24 bp, Artificial Sequence
  Synthetic oligonucleotide; TGCCGATT chr11 5251438 5251461 5251441 -
agagtagacgcaagggctactggt

SEQ ID NO: 65867 - DNA, 24 bp, Artificial Sequence
  Synthetic oligonucleotide; GGTAGATT chr11 5251395 5251418 5251398 -
ttttcaatagtatgctaaacaagg

SEQ ID NO: 65868 - DNA, 24 bp, Artificial Sequence
  Synthetic oligonucleotide; GTAAGATT chr11 5250791 5250814 5250794 -
tacacgcacatcttatgtcttaga

SEQ ID NO: 65869 - DNA, 24 bp, Artificial Sequence
  Synthetic oligonucleotide; TCATGATT chr11 5250563 5250586 5250566 -
aaatatttttctaagatgaaacag

SEQ ID NO: 65870 - DNA, 24 bp, Artificial Sequence
  Synthetic oligonucleotide; CTAAGATT chr11 5250340 5250363 5250343 -
gaaaccactgctaactgaaagaga

SEQ ID NO: 65871 - DNA, 24 bp, Artificial Sequence
  Synthetic oligonucleotide; TCAGGATT chr11 5249643 5249666 5249646 -
cctggcaaaagtccaggtcgcttc

SEQ ID NO: 65872 - DNA, 24 bp, Artificial Sequence
  Synthetic oligonucleotide; ATTAGATT chr11 5249114 5249137 5249117 -
aaatgaggaaaatgacttttcttt

SEQ ID NO: 65873 - DNA, 24 bp, Artificial Sequence
  Synthetic oligonucleotide; AGTAGATT chr11 5248823 5248846 5248826 -
gaacaattgaaacatttgggctgg

SEQ ID NO: 65874 - DNA, 24 bp, Artificial Sequence
  Synthetic oligonucleotide; GCAAGATT chr11 5248692 5248715 5248695 -
agggttcatggtggcaagaagata

SEQ ID NO: 65875 - DNA, 24 bp, Artificial Sequence
  Synthetic oligonucleotide; GCTTGATT chr11 5248591 5248614 5248594 -
aggctttgagggaagttaacatag

SEQ ID NO: 65876 - DNA, 24 bp, Artificial Sequence
  Synthetic oligonucleotide; CCATGATT chr11 5248350 5248373 5248353 -
tccagataccactgagctcactgc

SEQ ID NO: 65877 - DNA, 24 bp, Artificial Sequence
  Synthetic oligonucleotide; ACATGATT chr11 5248272 5248295 5248275 -
aaatctattctgctgagagatcac

SEQ ID NO: 65878 - DNA, 24 bp, Artificial Sequence
  Synthetic oligonucleotide; GCTGGATT chr11 5247951 5247974 5247954 -
aaaaggttcagtgaagacctgggg

SEQ ID NO: 65879 - DNA, 24 bp, Artificial Sequence
  Synthetic oligonucleotide; GATTGATT chr11 5247947 5247970 5247950 -
ggttcagtgaagacctgggggctg

SEQ ID NO: 65880 - DNA, 24 bp, Artificial Sequence
  Synthetic oligonucleotide; TGCAGATT chr11 5247757 5247780 5247760 -
aaattaatcccatgccctcaagtg

SEQ ID NO: 65881 - DNA, 24 bp, Artificial Sequence
  Synthetic oligonucleotide; CTTTGATT chr11 5246997 5247020 5247000 -
ataagcctgcgcccttctctctaa

SEQ ID NO: 65882 - DNA, 24 bp, Artificial Sequence
  Synthetic oligonucleotide; TTTGGATT chr11 5246606 5246629 5246609 -
ttcttgatgatatgttaaacaagt

SEQ ID NO: 65883 - DNA, 24 bp, Artificial Sequence
  Synthetic oligonucleotide; AATAGATT chr11 5246374 5246397 5246377 -
tggatattaggcctttgtcagaag

SEQ ID NO: 65884 - DNA, 24 bp, Artificial Sequence
  Synthetic oligonucleotide; TGTAGATT chr11 5246346 5246369 5246349 -
gattggaaaatctttttcccattc

SEQ ID NO: 65885 - DNA, 24 bp, Artificial Sequence
  Synthetic oligonucleotide; ATTAGATT chr11 5246286 5246309 5246289 -
gctgagcaggagctctttagttta

SEQ ID NO: 65886 - DNA, 24 bp, Artificial Sequence
  Synthetic oligonucleotide; CCTTGATT chr11 5246190 5246213 5246193 -
gtgtttatatcatgaatagtattg

SEQ ID NO: 65887 - DNA, 24 bp, Artificial Sequence
  Synthetic oligonucleotide; GTAAGATT chr11 5245839 5245862 5245842 -
agagaatctgtctgtctagttcat

SEQ ID NO: 65888 - DNA, 24 bp, Artificial Sequence
  Synthetic oligonucleotide; GGGTGATT chr11 5245093 5245116 5245096 -
agagtctccttgaaatacacatgg

SEQ ID NO: 65889 - DNA, 24 bp, Artificial Sequence
  Synthetic oligonucleotide; TAAGGATT chr11 5245066 5245089 5245069 -
tgatttcctaaactttatttcttg

SEQ ID NO: 65890 - DNA, 24 bp, Artificial Sequence
  Synthetic oligonucleotide; GCCTGATT chr11 5244850 5244873 5244853 -
atattgtcagtgaagaatgtcttt

SEQ ID NO: 65891 - DNA, 24 bp, Artificial Sequence
  Synthetic oligonucleotide; GTAGGATT chr11 5244672 5244695 5244675 -
gttctggcataattttgtagatat

SEQ ID NO: 65892 - DNA, 24 bp, Artificial Sequence
  Synthetic oligonucleotide; CAATGATT chr11 5244647 5244670 5244650 -
taggatttgacatggactattgtt

SEQ ID NO: 65893 - DNA, 24 bp, Artificial Sequence
  Synthetic oligonucleotide; AATGGATT chr11 5244597 5244620 5244600 -
ttcagataagtacactgactacta

SEQ ID NO: 65894 - DNA, 24 bp, Artificial Sequence
  Synthetic oligonucleotide; CCTGGATT chr11 5243800 5243823 5243803 -
agcaaagttcccctgagaaggcca

SEQ ID NO: 65895 - DNA, 24 bp, Artificial Sequence
  Synthetic oligonucleotide; AATAGATT chr11 5243713 5243736 5243716 -
tggagtcacaacccacccttgacc

SEQ ID NO: 65896 - DNA, 24 bp, Artificial Sequence
  Synthetic oligonucleotide; AATAGATT chr11 5243675 5243698 5243678 -
actgagggaggcaaagggctggtc

SEQ ID NO: 65897 - DNA, 24 bp, Artificial Sequence
  Synthetic oligonucleotide; GTGAGATT chr11 5243466 5243489 5243469 -
aaggttaaggtgagaaggctggag

SEQ ID NO: 65898 - DNA, 24 bp, Artificial Sequence
  Synthetic oligonucleotide; GAGGGATT chr11 5243397 5243420 5243400 -
gaaaggcagaaagtgtttctgaaa

SEQ ID NO: 65899 - DNA, 24 bp, Artificial Sequence
  Synthetic oligonucleotide; CTGTGATT chr11 5243352 5243375 5243355 -
acatagtctgactttgcacctgct

SEQ ID NO: 65900 - DNA, 24 bp, Artificial Sequence
  Synthetic oligonucleotide; GTGGGATT chr11 5242982 5243005 5242985 -
gctatgggatatgatatttcagca

SEQ ID NO: 65901 - DNA, 24 bp, Artificial Sequence
  Synthetic oligonucleotide; AGAGGATT chr11 5242685 5242708 5242688 -
caaagtagtgggaagctgttaaaa

SEQ ID NO: 65902 - DNA, 24 bp, Artificial Sequence
  Synthetic oligonucleotide; ACAGGATT chr11 5242635 5242658 5242638 -
atggtatacttttgtacgcatggt

SEQ ID NO: 65903 - DNA, 24 bp, Artificial Sequence
  Synthetic oligonucleotide; TATTGATT chr11 5242232 5242255 5242235 -
ctccccagctcttaggcaacgtga

SEQ ID NO: 65904 - DNA, 24 bp, Artificial Sequence
  Synthetic oligonucleotide; CGAGGATT chr11 5242204 5242227 5242207 -
gattgttttggcaacccacttcag

SEQ ID NO: 65905 - DNA, 24 bp, Artificial Sequence
  Synthetic oligonucleotide; TGCTGATT chr11 5242011 5242034 5242014 -
tggggagaagagcagtatcctgcc

SEQ ID NO: 65906 - DNA, 24 bp, Artificial Sequence
  Synthetic oligonucleotide; CCCTGATT chr11 5241920 5241943 5241923 -
ctctttttctgtctttatatttta

SEQ ID NO: 65907 - DNA, 24 bp, Artificial Sequence
  Synthetic oligonucleotide; GGTGGATT chr11 5241802 5241825 5241805 -
ctgcaagaaaagagagaactcgtg

SEQ ID NO: 65908 - DNA, 24 bp, Artificial Sequence
  Synthetic oligonucleotide; AGAGGATT chr11 5241696 5241719 5241699 -
atggaggtactctttggaggtgta

SEQ ID NO: 65909 - DNA, 24 bp, Artificial Sequence
  Synthetic oligonucleotide; GATAGATT chr11 5241354 5241377 5241357 -
ataattccattaagctgtgcatat

SEQ ID NO: 65910 - DNA, 24 bp, Artificial Sequence
  Synthetic oligonucleotide; AAAGGATT chr11 5241327 5241350 5241330 -
agatttatcatatgtattttcctt

SEQ ID NO: 65911 - DNA, 24 bp, Artificial Sequence
  Synthetic oligonucleotide; TAGTGATT chr11 5241197 5241220 5241200 -
tacaagttttattgtttttagtgg

SEQ ID NO: 65912 - DNA, 24 bp, Artificial Sequence
  Synthetic oligonucleotide; CACTGATT chr11 5241093 5241116 5241096 -
ttattagcaatcaatattgaaaac

SEQ ID NO: 65913 - DNA, 24 bp, Artificial Sequence
  Synthetic oligonucleotide; AGCAGATT chr11 5241066 5241089 5241069 -
tgatttttgtttatgtgagcaaac

SEQ ID NO: 65914 - DNA, 24 bp, Artificial Sequence
  Synthetic oligonucleotide; CTGAGATT chr11 5241052 5241075 5241055 -
gtgagcaaacagcagattaaaagg

SEQ ID NO: 65915 - DNA, 24 bp, Artificial Sequence
  Synthetic oligonucleotide; AATTGATT chr11 5240856 5240879 5240859 -
cataataaatagggaaacgtagaa

SEQ ID NO: 65916 - DNA, 24 bp, Artificial Sequence
  Synthetic oligonucleotide; AACTGATT chr11 5240827 5240850 5240830 -
attcacatgtatatatatatatag

SEQ ID NO: 65917 - DNA, 24 bp, Artificial Sequence
  Synthetic oligonucleotide; CAGTGATT chr11 5240693 5240716 5240696 -
aaatcgagtaagagaccattgtgg

SEQ ID NO: 65918 - DNA, 24 bp, Artificial Sequence
  Synthetic oligonucleotide; TTTGGATT chr11 5239755 5239778 5239758 -
aattaccccagtcaatctagagaa

SEQ ID NO: 65919 - DNA, 24 bp, Artificial Sequence
  Synthetic oligonucleotide; AAAAGATT chr11 5239412 5239435 5239415 -
ttccctagtatttggagatgaaaa

SEQ ID NO: 65920 - DNA, 24 bp, Artificial Sequence
  Synthetic oligonucleotide; GTTTGATT chr11 5239242 5239265 5239245 -
gttccttcctctgcctctgctata

SEQ ID NO: 65921 - DNA, 24 bp, Artificial Sequence
  Synthetic oligonucleotide; ACTGGATT chr11 5238904 5238927 5238907 -
accagagcccataaccagaggtcc

SEQ ID NO: 65922 - DNA, 24 bp, Artificial Sequence
  Synthetic oligonucleotide; CAGTGATT chr11 5238557 5238580 5238560 -
cagtaaatgaataattacagtgtg

SEQ ID NO: 65923 - DNA, 24 bp, Artificial Sequence
  Synthetic oligonucleotide; CAATGATT chr11 5238545 5238568 5238548 -
aattacagtgtgcagtgattattg

SEQ ID NO: 65924 - DNA, 24 bp, Artificial Sequence
  Synthetic oligonucleotide; CTGAGATT chr11 5238488 5238511 5238491 -
acacagaattcaaacagcagtgaa

SEQ ID NO: 65925 - DNA, 24 bp, Artificial Sequence
  Synthetic oligonucleotide; AAGCGATT chr11 5238228 5238251 5238231 -
ctgcaacatctgcctcccaggttc

SEQ ID NO: 65926 - DNA, 24 bp, Artificial Sequence
  Synthetic oligonucleotide; CGGGGATT chr11 5237761 5237784 5237764 -
atcgatactgagttctaaaatcat

SEQ ID NO: 65927 - DNA, 24 bp, Artificial Sequence
  Synthetic oligonucleotide; TTGAGATT chr11 5237724 5237747 5237727 -
gactatgtcttacttcatacttcc

SEQ ID NO: 65928 - DNA, 24 bp, Artificial Sequence
  Synthetic oligonucleotide; CTTGGATT chr11 5237657 5237680 5237660 -
atttaactttgtattcatcacact

SEQ ID NO: 65929 - DNA, 24 bp, Artificial Sequence
  Synthetic oligonucleotide; CTCTGATT chr11 5237598 5237621 5237601 -
agcctgtataatcccaattcccaa

SEQ ID NO: 65930 - DNA, 24 bp, Artificial Sequence
  Synthetic oligonucleotide; CACAGATT chr11 5237403 5237426 5237406 -
agctacttgcccattcaccaaggt

SEQ ID NO: 65931 - DNA, 24 bp, Artificial Sequence
  Synthetic oligonucleotide; GTTCGATT chr11 5237367 5237390 5237370 -
tcatttccctacctctaatcaaca

SEQ ID NO: 65932 - DNA, 24 bp, Artificial Sequence
  Synthetic oligonucleotide; CCTAGATT chr11 5237021 5237044 5237024 -
ccaggaggcagaggttgcggtgag

SEQ ID NO: 65933 - DNA, 24 bp, Artificial Sequence
  Synthetic oligonucleotide; CTAAGATT chr11 5236703 5236726 5236706 -
taattcctccctcacaaacacatt

SEQ ID NO: 65934 - DNA, 24 bp, Artificial Sequence
  Synthetic oligonucleotide; TAGTGATT chr11 5236644 5236667 5236647 -
tctgtcatttttaacaggtagtgg

SEQ ID NO: 65935 - DNA, 24 bp, Artificial Sequence
  Synthetic oligonucleotide; TTCTGATT chr11 5236483 5236506 5236486 -
aatacaatgtatccaagactgtat

SEQ ID NO: 65936 - DNA, 24 bp, Artificial Sequence
  Synthetic oligonucleotide; AGTTGATT chr11 5236007 5236030 5236010 -
ttgtatcgctacgtgttaagcagt

SEQ ID NO: 65937 - DNA, 24 bp, Artificial Sequence
  Synthetic oligonucleotide; TTATGATT chr11 5235903 5235926 5235906 -
taagtggctaccggtttgaggttt

SEQ ID NO: 65938 - DNA, 24 bp, Artificial Sequence
  Synthetic oligonucleotide; ATTTGATT chr11 5235139 5235162 5235142 -
acattcaaaatatttgtatataat

SEQ ID NO: 65939 - DNA, 24 bp, Artificial Sequence
  Synthetic oligonucleotide; AATAGATT chr11 5234939 5234962 5234942 -
aagcaagcaagtttaaactgcagc

SEQ ID NO: 65940 - DNA, 24 bp, Artificial Sequence
  Synthetic oligonucleotide; CTCAGATT chr11 5234219 5234242 5234222 -
tgtcccttgggctgttttcctacc

SEQ ID NO: 65941 - DNA, 24 bp, Artificial Sequence
  Synthetic oligonucleotide; ATTTGATT chr11 5233534 5233557 5233537 -
aatggaatggaaaggaaagtgaat

SEQ ID NO: 65942 - DNA, 24 bp, Artificial Sequence
  Synthetic oligonucleotide; CACTGATT chr11 5233460 5233483 5233463 -
ttgctaggagacagcccatcatca

SEQ ID NO: 65943 - DNA, 24 bp, Artificial Sequence
  Synthetic oligonucleotide; CTAAGATT chr11 5233198 5233221 5233201 -
gaataacctggggatcagttttgt

SEQ ID NO: 65944 - DNA, 24 bp, Artificial Sequence
  Synthetic oligonucleotide; CCTAGATT chr11 5232921 5232944 5232924 -
ataaccataagaagaccctatttc

SEQ ID NO: 65945 - DNA, 24 bp, Artificial Sequence
  Synthetic oligonucleotide; TCCTGATT chr11 5232836 5232859 5232839 -
taataaagaatgttcagctcaact

SEQ ID NO: 65946 - DNA, 24 bp, Artificial Sequence
  Synthetic oligonucleotide; CTACGATT chr11 5232573 5232596 5232576 -
taagacatagcctcaagggtaatg

SEQ ID NO: 65947 - DNA, 24 bp, Artificial Sequence
  Synthetic oligonucleotide; TAATGATT chr11 5232520 5232543 5232523 -
aaataatgtgctcaattaaaggca

SEQ ID NO: 65948 - DNA, 24 bp, Artificial Sequence
  Synthetic oligonucleotide; TCAAGATT chr11 5232345 5232368 5232348 -
tcctcttatcttcccatatttcag

SEQ ID NO: 65949 - DNA, 24 bp, Artificial Sequence
  Synthetic oligonucleotide; GAATGATT chr11 5232045 5232068 5232048 -
gaatgagtaaatgagtaaatgaag

SEQ ID NO: 65950 - DNA, 24 bp, Artificial Sequence
  Synthetic oligonucleotide; GAAGGATT chr11 5231848 5231871 5231851 -
ccatttttgccataggtaaaatta

SEQ ID NO: 65951 - DNA, 24 bp, Artificial Sequence
  Synthetic oligonucleotide; TGTTGATT chr11 5231790 5231813 5231793 -
ttttaaaaatctgtattatatgca

SEQ ID NO: 65952 - DNA, 24 bp, Artificial Sequence
  Synthetic oligonucleotide; GAGAGATT chr11 5231402 5231425 5231405 -
tgtgtggtattcgaaagacagtaa

SEQ ID NO: 65953 - DNA, 24 bp, Artificial Sequence
  Synthetic oligonucleotide; TCAAGATT chr11 5230807 5230830 5230810 -
aagtataggaatggaattaattcc

SEQ ID NO: 65954 - DNA, 24 bp, Artificial Sequence
  Synthetic oligonucleotide; CCAAGATT chr11 5230496 5230519 5230499 -
ttgtaaagggtgttcagactgaag

SEQ ID NO: 65955 - DNA, 24 bp, Artificial Sequence
  Synthetic oligonucleotide; GAGAGATT chr11 5230101 5230124 5230104 -
gagagctgctgagttgtgtttact

SEQ ID NO: 65956 - DNA, 24 bp, Artificial Sequence
  Synthetic oligonucleotide; AGTAGATT chr11 5230031 5230054 5230034 -
tgtgcttgacctaggaacatatac

SEQ ID NO: 65957 - DNA, 24 bp, Artificial Sequence
  Synthetic oligonucleotide; TCATGATT chr11 5229908 5229931 5229911 -
aaaccacactcccatagatgagtg

SEQ ID NO: 65958 - DNA, 24 bp, Artificial Sequence
  Synthetic oligonucleotide; GAAAGATT chr11 5229823 5229846 5229826 -
ctgatataaaacattaggacttaa

SEQ ID NO: 65959 - DNA, 24 bp, Artificial Sequence
  Synthetic oligonucleotide; TGCTGATT chr11 5229591 5229614 5229594 -
gaatagtttttcaggaactttgaa

SEQ ID NO: 65960 - DNA, 24 bp, Artificial Sequence
  Synthetic oligonucleotide; TTTAGATT chr11 5229585 5229608 5229588 -
tttttcaggaactttgaatgctga

SEQ ID NO: 65961 - DNA, 24 bp, Artificial Sequence
  Synthetic oligonucleotide; TCAGGATT chr11 5229219 5229242 5229222 -
taagaaggtgacaatttctgccaa

SEQ ID NO: 65962 - DNA, 24 bp, Artificial Sequence
  Synthetic oligonucleotide; CCAGGATT chr11 5228900 5228923 5228903 -
aaaatattttaaagacgtcttttc

SEQ ID NO: 65963 - DNA, 24 bp, Artificial Sequence
  Synthetic oligonucleotide; GTGAGATT chr11 5228687 5228710 5228690 -
tctgcgtgtgtgagaataatcaga

SEQ ID NO: 65964 - DNA, 24 bp, Artificial Sequence
  Synthetic oligonucleotide; GCAGGATT chr11 5228349 5228372 5228352 -
accgacatgggtttccaggtaggg

SEQ ID NO: 65965 - DNA, 24 bp, Artificial Sequence
  Synthetic oligonucleotide; AAATGATT chr11 5228056 5228079 5228059 -
gagaaataggaacttgaatcaagg

SEQ ID NO: 65966 - DNA, 24 bp, Artificial Sequence
  Synthetic oligonucleotide; TGCAGATT chr11 5227927 5227950 5227930 -
gctttttgttcccccagacactct

SEQ ID NO: 65967 - DNA, 24 bp, Artificial Sequence
  Synthetic oligonucleotide; CACTGATT chr11 5227869 5227892 5227872 -
cccagttaacctcctatttgacac

SEQ ID NO: 65968 - DNA, 24 bp, Artificial Sequence
  Synthetic oligonucleotide; CATTGATT chr11 5227731 5227754 5227734 -
aataagtaactaatgcacagagca

SEQ ID NO: 65969 - DNA, 24 bp, Artificial Sequence
  Synthetic oligonucleotide; CTGTGATT chr11 5227356 5227379 5227359 -
acgatcttcaatatgcttaccaag

SEQ ID NO: 65970 - DNA, 24 bp, Artificial Sequence
  Synthetic oligonucleotide; GAATGATT chr11 5226468 5226491 5226471 -
tacagtttagaatgggaaacagac

SEQ ID NO: 65971 - DNA, 24 bp, Artificial Sequence
  Synthetic oligonucleotide; GCTGGATT chr11 5225798 5225821 5225801 -
cttttattttatggttgggataag

SEQ ID NO: 65972 - DNA, 24 bp, Artificial Sequence
  Synthetic oligonucleotide; TCTGGATT chr11 5225505 5225528 5225508 -
ggatattatgaagggccttgagca

SEQ ID NO: 65973 - DNA, 24 bp, Artificial Sequence
  Synthetic oligonucleotide; AAAGGATT chr11 5225260 5225283 5225263 -
catatgccttattcatccctcaga

SEQ ID NO: 65974 - DNA, 24 bp, Artificial Sequence
  Synthetic oligonucleotide; GCTTGATT chr11 5225243 5225266 5225246 -
cctcagaaaaggattcaagtagag

SEQ ID NO: 65975 - DNA, 24 bp, Artificial Sequence
  Synthetic oligonucleotide; TTAAGATT chr11 5224725 5224748 5224728 -
aagtcccattcttcctcaggatgt

SEQ ID NO: 65976 - DNA, 24 bp, Artificial Sequence
  Synthetic oligonucleotide; GCTAGATT chr11 5224577 5224600 5224580 -
tattcaatacctaggtaggtagat

SEQ ID NO: 65977 - DNA, 24 bp, Artificial Sequence
  Synthetic oligonucleotide; GCAAGATT chr11 5224502 5224525 5224505 -
ccagtcaaattctgaatctagttg

SEQ ID NO: 65978 - DNA, 24 bp, Artificial Sequence
  Synthetic oligonucleotide; AGATGATT chr11 5224076 5224099 5224079 -
atatccaaaatatataagaaacac

SEQ ID NO: 65979 - DNA, 24 bp, Artificial Sequence
  Synthetic oligonucleotide; AGTAGATT chr11 5223713 5223736 5223716 -
agtatatttaaaatttgcaaagag

SEQ ID NO: 65980 - DNA, 24 bp, Artificial Sequence
  Synthetic oligonucleotide; CTGGGATT chr11 5223579 5223602 5223582 -
ctcctgcctcagcctcccgagtag

SEQ ID NO: 65981 - DNA, 24 bp, Artificial Sequence
  Synthetic oligonucleotide; CTGGGATT chr11 5223469 5223492 5223472 -
cgcctgcctcggccacccaaaggg

SEQ ID NO: 65982 - DNA, 24 bp, Artificial Sequence
  Synthetic oligonucleotide; GCTTGATT chr11 5223366 5223389 5223369 -
gtgagataatgggtatgttaatta

SEQ ID NO: 65983 - DNA, 24 bp, Artificial Sequence
  Synthetic oligonucleotide; TGATGATT chr11 5223195 5223218 5223198 -
actaaaaaataaaaaaatgcatct

SEQ ID NO: 65984 - DNA, 24 bp, Artificial Sequence
  Synthetic oligonucleotide; TCTTGATT chr11 5223177 5223200 5223180 -
gcatcttgatgattagaattgcat

SEQ ID NO: 65985 - DNA, 24 bp, Artificial Sequence
  Synthetic oligonucleotide; CCTAGATT chr11 5223030 5223053 5223033 -
tagatattttgtatagttttactc

SEQ ID NO: 65986 - DNA, 24 bp, Artificial Sequence
  Synthetic oligonucleotide; TTCTGATT chr11 5222916 5222939 5222919 -
tctctctaagtttattctattttt

SEQ ID NO: 65987 - DNA, 24 bp, Artificial Sequence
  Synthetic oligonucleotide; AATCGATT chr11 5222623 5222646 5222626 -
gaaatgcttaactgcatataccac

SEQ ID NO: 65988 - DNA, 24 bp, Artificial Sequence
  Synthetic oligonucleotide; CCAAGATT chr11 5222213 5222236 5222216 -
ctgggaggcagaggttgcagtgag

SEQ ID NO: 65989 - DNA, 24 bp, Artificial Sequence
  Synthetic oligonucleotide; GGGTGATT chr11 5222057 5222080 5222060 -
cccatcgtgagtgacgcagaagac

SEQ ID NO: 65990 - DNA, 24 bp, Artificial Sequence
  Synthetic oligonucleotide; AGGAGATT chr11 5221801 5221824 5221804 -
aacaagcttaacaaatggcacacc

SEQ ID NO: 65991 - DNA, 24 bp, Artificial Sequence
  Synthetic oligonucleotide; GTCAGATT chr11 5220448 5220471 5220451 -
aaagcaactccaagacacataact

SEQ ID NO: 65992 - DNA, 24 bp, Artificial Sequence
  Synthetic oligonucleotide; GAGAGATT chr11 5220194 5220217 5220197 -
atcctttacagacaagcaaatgct

SEQ ID NO: 65993 - DNA, 24 bp, Artificial Sequence
  Synthetic oligonucleotide; AACAGATT chr11 5219784 5219807 5219787 -
ggttgcaatcctagtctctgataa

SEQ ID NO: 65994 - DNA, 24 bp, Artificial Sequence
  Synthetic oligonucleotide; CCCAGATT chr11 5219663 5219686 5219666 -
atatatgcacccaatacaggagca

SEQ ID NO: 65995 - DNA, 24 bp, Artificial Sequence
  Synthetic oligonucleotide; TCAGGATT chr11 5219317 5219340 5219320 -
accacagtgcaatcaaactagaac

SEQ ID NO: 65996 - DNA, 24 bp, Artificial Sequence
  Synthetic oligonucleotide; GTAGGATT chr11 5218608 5218631 5218611 -
tcaaccaaaaaaagtccgggacca

SEQ ID NO: 65997 - DNA, 24 bp, Artificial Sequence
  Synthetic oligonucleotide; ATATGATT chr11 5218272 5218295 5218275 -
taaacagaaccaaagacacaaacc

SEQ ID NO: 65998 - DNA, 24 bp, Artificial Sequence
  Synthetic oligonucleotide; ACATGATT chr11 5217945 5217968 5217948 -
tgaaattgtccctgtttgcagatg

SEQ ID NO: 65999 - DNA, 24 bp, Artificial Sequence
  Synthetic oligonucleotide; TATAGATT chr11 5217586 5217609 5217589 -
atggtcatactgcccaaggtaatt

SEQ ID NO: 66000 - DNA, 24 bp, Artificial Sequence
  Synthetic oligonucleotide; AAAGGATT chr11 5217272 5217295 5217275 -
acctgagagaaacaagcaatgggg

SEQ ID NO: 66001 - DNA, 24 bp, Artificial Sequence
  Synthetic oligonucleotide; GATGGATT chr11 5217168 5217191 5217171 -
caccttatacaaaaattaattcaa

SEQ ID NO: 66002 - DNA, 24 bp, Artificial Sequence
  Synthetic oligonucleotide; AAAGGATT chr11 5216510 5216533 5216513 -
catcccattactgggtacataccc

SEQ ID NO: 66003 - DNA, 24 bp, Artificial Sequence
  Synthetic oligonucleotide; ACTGGATT chr11 5216400 5216423 5216403 -
aacccaaatgtccaacaacgatag

SEQ ID NO: 66004 - DNA, 24 bp, Artificial Sequence
  Synthetic oligonucleotide; ACTAGATT chr11 5215901 5215924 5215904 -
tctcagtcagttaacattccttca

SEQ ID NO: 66005 - DNA, 24 bp, Artificial Sequence
  Synthetic oligonucleotide; AAATGATT chr11 5215610 5215633 5215613 -
ctgggaggtcaagtcagaggtgaa

SEQ ID NO: 66006 - DNA, 24 bp, Artificial Sequence
  Synthetic oligonucleotide; CCAGGATT chr11 5215475 5215498 5215478 -
ctgaagtgataggatcacttgagc

SEQ ID NO: 66007 - DNA, 24 bp, Artificial Sequence
  Synthetic oligonucleotide; AGTGGATT chr11 5215267 5215290 5215270 -
gcagtgcctcggggctgtttctcc

SEQ ID NO: 66008 - DNA, 24 bp, Artificial Sequence
  Synthetic oligonucleotide; CTTGGATT chr11 5215187 5215210 5215190 -
aggtctcacctgtcttattcagag

SEQ ID NO: 66009 - DNA, 24 bp, Artificial Sequence
  Synthetic oligonucleotide; TTGGGATT chr11 5215157 5215180 5215160 -
ttttggactagctttttctatttc

SEQ ID NO: 66010 - DNA, 24 bp, Artificial Sequence
  Synthetic oligonucleotide; TTTAGATT chr11 5214940 5214963 5214943 -
cagtccaggaagttatccatttct

SEQ ID NO: 66011 - DNA, 24 bp, Artificial Sequence
  Synthetic oligonucleotide; TGATGATT chr11 5214894 5214917 5214897 -
catagagatgttcatagtagtttt

SEQ ID NO: 66012 - DNA, 24 bp, Artificial Sequence
  Synthetic oligonucleotide; GCTAGATT chr11 5214670 5214693 5214673 -
gatcttgtttatttcttgtcttct

SEQ ID NO: 66013 - DNA, 24 bp, Artificial Sequence
  Synthetic oligonucleotide; CAGAGATT chr11 5214529 5214552 5214532 -
cttaacactgtctaagctgtgtcc

SEQ ID NO: 66014 - DNA, 24 bp, Artificial Sequence
  Synthetic oligonucleotide; GAGTGATT chr11 5214347 5214370 5214350 -
tatttttattcctctgtggtctga

SEQ ID NO: 66015 - DNA, 24 bp, Artificial Sequence
  Synthetic oligonucleotide; ATATGATT chr11 5214338 5214361 5214341 -
tcctctgtggtctgagagtgattg

SEQ ID NO: 66016 - DNA, 24 bp, Artificial Sequence
  Synthetic oligonucleotide; TGAGGATT chr11 5214314 5214337 5214317 -
atatgattttttttttgcatttgc

SEQ ID NO: 66017 - DNA, 24 bp, Artificial Sequence
  Synthetic oligonucleotide; AAATGATT chr11 5214237 5214260 5214240 -
gaagagatccatgatgagctctga

SEQ ID NO: 66018 - DNA, 24 bp, Artificial Sequence
  Synthetic oligonucleotide; ATATGATT chr11 5214189 5214212 5214192 -
atcaaacaaaaaaagccctggaca

SEQ ID NO: 66019 - DNA, 24 bp, Artificial Sequence
  Synthetic oligonucleotide; GAGGGATT chr11 5214105 5214128 5214108 -
aagctactccaaaaaattgagggg

SEQ ID NO: 66020 - DNA, 24 bp, Artificial Sequence
  Synthetic oligonucleotide; GCAAGATT chr11 5213911 5213934 5213914 -
tcaagtaggctttatccctgagaa

SEQ ID NO: 66021 - DNA, 24 bp, Artificial Sequence
  Synthetic oligonucleotide; ATGTGATT chr11 5213879 5213902 5213882 -
ggttcagcatatacaaattgataa

SEQ ID NO: 66022 - DNA, 24 bp, Artificial Sequence
  Synthetic oligonucleotide; AAAAGATT chr11 5213815 5213838 5213818 -
catgatcatttcaatatgtgcaaa

SEQ ID NO: 66023 - DNA, 24 bp, Artificial Sequence
  Synthetic oligonucleotide; ATGAGATT chr11 5213294 5213317 5213297 -
ccaagcagttgaaagatctctaca

SEQ ID NO: 66024 - DNA, 24 bp, Artificial Sequence
  Synthetic oligonucleotide; AGAAGATT chr11 5212578 5212601 5212581 -
tgggataactgactaaccgtatgt

SEQ ID NO: 66025 - DNA, 24 bp, Artificial Sequence
  Synthetic oligonucleotide; GATGGATT chr11 5212527 5212550 5212530 -
tatcatatacacaaataaactcaa

SEQ ID NO: 66026 - DNA, 24 bp, Artificial Sequence
  Synthetic oligonucleotide; CAAAGATT chr11 5212440 5212463 5212443 -
taccattccggacataagcagggg

SEQ ID NO: 66027 - DNA, 24 bp, Artificial Sequence
  Synthetic oligonucleotide; TAATGATT chr11 5211285 5211308 5211288 -
tttatgcgcattatgaaagtaatt

SEQ ID NO: 66028 - DNA, 24 bp, Artificial Sequence
  Synthetic oligonucleotide; ATTTGATT chr11 5211260 5211283 5211263 -
aatgattctctgtccttctttgta

SEQ ID NO: 66029 - DNA, 24 bp, Artificial Sequence
  Synthetic oligonucleotide; CTGTGATT chr11 5210805 5210828 5210808 -
aaatcgttctccctccggcctcgg

SEQ ID NO: 66030 - DNA, 24 bp, Artificial Sequence
  Synthetic oligonucleotide; ACGAGATT chr11 5210688 5210711 5210691 -
tgaaaactaattcaaaaggtacta

SEQ ID NO: 66031 - DNA, 24 bp, Artificial Sequence
  Synthetic oligonucleotide; GGCAGATT chr11 5210497 5210520 5210500 -
aacagagggcattaggtcagactt

SEQ ID NO: 66032 - DNA, 24 bp, Artificial Sequence
  Synthetic oligonucleotide; GCAGGATT chr11 5210439 5210462 5210442 -
ccatccacttgctcattctggatg

SEQ ID NO: 66033 - DNA, 24 bp, Artificial Sequence
  Synthetic oligonucleotide; GTTGGATT chr11 5210325 5210348 5210328 -
gtacatttagtggggtgtgggact

SEQ ID NO: 66034 - DNA, 24 bp, Artificial Sequence
  Synthetic oligonucleotide; CTAAGATT chr11 5209041 5209064 5209044 -
ctactcagctagtaagtagctgag

SEQ ID NO: 66035 - DNA, 24 bp, Artificial Sequence
  Synthetic oligonucleotide; CTCAGATT chr11 5208771 5208794 5208774 -
cttccaaacttgatgaatggttca

SEQ ID NO: 66036 - DNA, 24 bp, Artificial Sequence
  Synthetic oligonucleotide; CCAAGATT chr11 5208531 5208554 5208534 -
ttatatacctaagaaatgacaaaa

SEQ ID NO: 66037 - DNA, 24 bp, Artificial Sequence
  Synthetic oligonucleotide; ATATGATT chr11 5208002 5208025 5208005 -
ccacagtcagcttctcaaagacaa

SEQ ID NO: 66038 - DNA, 24 bp, Artificial Sequence
  Synthetic oligonucleotide; GAAGGATT chr11 5207848 5207871 5207851 -
gaaaaaaaacgatacaaagggtat

SEQ ID NO: 66039 - DNA, 24 bp, Artificial Sequence
  Synthetic oligonucleotide; TTCTGATT chr11 5207761 5207784 5207764 -
gccccattctaggacaatggttcc

SEQ ID NO: 66040 - DNA, 24 bp, Artificial Sequence
  Synthetic oligonucleotide; ACCTGATT chr11 5207715 5207738 5207718 -
gtctgagagacatgcctggctcac

SEQ ID NO: 66041 - DNA, 24 bp, Artificial Sequence
  Synthetic oligonucleotide; CACAGATT chr11 5207607 5207630 5207610 -
cacctctagagaattctaaaaatc

SEQ ID NO: 66042 - DNA, 24 bp, Artificial Sequence
  Synthetic oligonucleotide; CACTGATT chr11 5207379 5207402 5207382 -
agaaagcaaagtggtcatgttagt

SEQ ID NO: 66043 - DNA, 24 bp, Artificial Sequence
  Synthetic oligonucleotide; AGGAGATT chr11 5206991 5207014 5206994 -
ggacttgggtctctccggttgtat

SEQ ID NO: 66044 - DNA, 24 bp, Artificial Sequence
  Synthetic oligonucleotide; TGGTGATT chr11 5206515 5206538 5206518 -
agaaagtgagagatgttctggaga

SEQ ID NO: 66045 - DNA, 24 bp, Artificial Sequence
  Synthetic oligonucleotide; ACTCGATT chr11 5206431 5206454 5206434 -
gagtctagcagcctaggtatgggt

SEQ ID NO: 66046 - DNA, 24 bp, Artificial Sequence
  Synthetic oligonucleotide; AGTTGATT chr11 5206259 5206282 5206262 -
tatttaaggatgaattttttaaaa

SEQ ID NO: 66047 - DNA, 24 bp, Artificial Sequence
  Synthetic oligonucleotide; AGGTGATT chr11 5206034 5206057 5206037 -
gttctcaccacaaaaaaagttgga

SEQ ID NO: 66048 - DNA, 24 bp, Artificial Sequence
  Synthetic oligonucleotide; AGATGATT chr11 5205694 5205717 5205697 -
aaaacaaatacactatcttgcatg

SEQ ID NO: 66049 - DNA, 24 bp, Artificial Sequence
  Synthetic oligonucleotide; AATAGATT chr11 5205167 5205190 5205170 -
taagcctacttcaggtttgtggta

SEQ ID NO: 66050 - DNA, 24 bp, Artificial Sequence
  Synthetic oligonucleotide; AAGAGATT chr11 5204669 5204692 5204672 -
aaagacagaaaaaaaaaaaaaacc

SEQ ID NO: 66051 - DNA, 24 bp, Artificial Sequence
  Synthetic oligonucleotide; CACAGATT chr11 5204587 5204610 5204590 -
aaagaatgacctggttattataat

SEQ ID NO: 66052 - DNA, 24 bp, Artificial Sequence
  Synthetic oligonucleotide; AGTAGATT chr11 5204110 5204133 5204113 -
ctagtctgaagaagcctgaatgaa

SEQ ID NO: 66053 - DNA, 24 bp, Artificial Sequence
  Synthetic oligonucleotide; AATAGATT chr11 5204044 5204067 5204047 -
tcagtctgaagaaacctgcatgaa

SEQ ID NO: 66054 - DNA, 24 bp, Artificial Sequence
  Synthetic oligonucleotide; CTGGGATT chr11 5203910 5203933 5203913 -
ctcctgcctcagtctcccaagtaa

SEQ ID NO: 66055 - DNA, 24 bp, Artificial Sequence
  Synthetic oligonucleotide; CTAGGATT chr11 5203773 5203796 5203776 -
cacctgcctcggcctcccaaagtg

SEQ ID NO: 66056 - DNA, 24 bp, Artificial Sequence
  Synthetic oligonucleotide; AGATGATT chr11 5203498 5203521 5203501 -
ggtcagaaaagactaagtgtacac

SEQ ID NO: 66057 - DNA, 24 bp, Artificial Sequence
  Synthetic oligonucleotide; CTGTGATT chr11 5203441 5203464 5203444 -
cacattcatattatctttatatct

SEQ ID NO: 66058 - DNA, 24 bp, Artificial Sequence
  Synthetic oligonucleotide; GTGTGATT chr11 5202862 5202885 5202865 -
aaagagttttttcaacaaaggttt

SEQ ID NO: 66059 - DNA, 24 bp, Artificial Sequence
  Synthetic oligonucleotide; GAAAGATT chr11 5202629 5202652 5202632 -
ctggtagaaatggtagaaattgat

SEQ ID NO: 66060 - DNA, 24 bp, Artificial Sequence
  Synthetic oligonucleotide; AATAGATT chr11 5202497 5202520 5202500 -
aatattaggagaaaagggacagaa

SEQ ID NO: 66061 - DNA, 24 bp, Artificial Sequence
  Synthetic oligonucleotide; TTAAGATT chr11 5202448 5202471 5202451 -
tactttattggcatcattcttatt

SEQ ID NO: 66062 - DNA, 24 bp, Artificial Sequence
  Synthetic oligonucleotide; AAGTGATT chr11 5202144 5202167 5202147 -
atttgtcttaagaaacttcttgaa

SEQ ID NO: 66063 - DNA, 24 bp, Artificial Sequence
  Synthetic oligonucleotide; ATTCGATT chr11 5202028 5202051 5202031 -
gaaaaattttacgaaagaagagaa

SEQ ID NO: 66064 - DNA, 24 bp, Artificial Sequence
  Synthetic oligonucleotide; TGATGATT chr11 5201652 5201675 5201655 -
ttattagagctttaaaaaaactta

SEQ ID NO: 66065 - DNA, 24 bp, Artificial Sequence
  Synthetic oligonucleotide; AATTGATT chr11 5201598 5201621 5201601 -
ggcaaacaatgtaaagaagaagcc

SEQ ID NO: 66066 - DNA, 24 bp, Artificial Sequence
  Synthetic oligonucleotide; CAAAGATT chr11 5201109 5201132 5201112 -
aatagacttatgatatttaaagcc

SEQ ID NO: 66067 - DNA, 24 bp, Artificial Sequence
  Synthetic oligonucleotide; GAATGATT chr11 5200685 5200708 5200688 -
actctcacatgtttctcagttcca

SEQ ID NO: 66068 - DNA, 24 bp, Artificial Sequence
  Synthetic oligonucleotide; ACTGGATT chr11 5200632 5200655 5200635 -
agcacgaattcttcctttcttctc

SEQ ID NO: 66069 - DNA, 24 bp, Artificial Sequence
  Synthetic oligonucleotide; CTTGGATT chr11 5200396 5200419 5200399 -
gtgggggatcattcgagagatcag

SEQ ID NO: 66070 - DNA, 24 bp, Artificial Sequence
  Synthetic oligonucleotide; ATCCGATT chr11 5200101 5200124 5200104 -
cttctccgcttagcctgttcagac

SEQ ID NO: 66071 - DNA, 24 bp, Artificial Sequence
  Synthetic oligonucleotide; TCCTGATT chr11 5200019 5200042 5200022 -
ctatactcatccttttctcctaca

SEQ ID NO: 66072 - DNA, 24 bp, Artificial Sequence
  Synthetic oligonucleotide; AACAGATT chr11 5199785 5199808 5199788 -
ccatcatctacagtgtcaagaccc

SEQ ID NO: 66073 - DNA, 24 bp, Artificial Sequence
  Synthetic oligonucleotide; TGTAGATT chr11 5199640 5199663 5199643 -
taaaaaagaaaaaattattaaaat

SEQ ID NO: 66074 - DNA, 24 bp, Artificial Sequence
  Synthetic oligonucleotide; GCTGGATT chr11 5199442 5199465 5199445 -
gcatttcctttgctgtaaaacaaa

SEQ ID NO: 66075 - DNA, 24 bp, Artificial Sequence
  Synthetic oligonucleotide; TTTGGATT chr11 5199047 5199070 5199050 -
aaagaggacacaaagaaatatgac

SEQ ID NO: 66076 - DNA, 24 bp, Artificial Sequence
  Synthetic oligonucleotide; TTTAGATT chr11 5198999 5199022 5199002 -
taatttaaattagaatccttattt

SEQ ID NO: 66077 - DNA, 24 bp, Artificial Sequence
  Synthetic oligonucleotide; AGCAGATT chr11 5198959 5198982 5198962 -
ggactccactgctacaaggctgga

SEQ ID NO: 66078 - DNA, 24 bp, Artificial Sequence
  Synthetic oligonucleotide; ACCAGATT chr11 5198612 5198635 5198615 -
tatttttagatatcaactaaaaca

SEQ ID NO: 66079 - DNA, 24 bp, Artificial Sequence
  Synthetic oligonucleotide; ACAAGATT chr11 5197849 5197872 5197852 -
gccgactggaatgtggccaatctg

SEQ ID NO: 66080 - DNA, 24 bp, Artificial Sequence
  Synthetic oligonucleotide; CATAGATT chr11 5197773 5197796 5197776 -
tctgtagaggtcatgtgaatgtct

SEQ ID NO: 66081 - DNA, 24 bp, Artificial Sequence
  Synthetic oligonucleotide; TTCAGATT chr11 5197481 5197504 5197484 -
acttcatactatgagtgtttgtgc

SEQ ID NO: 66082 - DNA, 24 bp, Artificial Sequence
  Synthetic oligonucleotide; ATAAGATT chr11 5197344 5197367 5197347 -
gagctatataattgtactatgatg

SEQ ID NO: 66083 - DNA, 24 bp, Artificial Sequence
  Synthetic oligonucleotide; ATATGATT chr11 5197249 5197272 5197252 -
aaaaagccaatgaaagtaaacttt

SEQ ID NO: 66084 - DNA, 24 bp, Artificial Sequence
  Synthetic oligonucleotide; TTTAGATT chr11 5197198 5197221 5197201 -
gaaacaggtttagaacattagtag

SEQ ID NO: 66085 - DNA, 24 bp, Artificial Sequence
  Synthetic oligonucleotide; ATCAGATT chr11 5196889 5196912 5196892 -
ctgcagagccagtgagaagcagtt

SEQ ID NO: 66086 - DNA, 24 bp, Artificial Sequence
  Synthetic oligonucleotide; GTAAGATT chr11 5196673 5196696 5196676 -
attgccgagaacaaggtgacaaaa

SEQ ID NO: 66087 - DNA, 24 bp, Artificial Sequence
  Synthetic oligonucleotide; CAGTGATT chr11 5196584 5196607 5196587 -
aagctaaggtccagtgggagaaat

SEQ ID NO: 66088 - DNA, 24 bp, Artificial Sequence
  Synthetic oligonucleotide; ACATGATT chr11 5196561 5196584 5196564 -
tcagtgattcttagaagtgagagg

SEQ ID NO: 66089 - DNA, 24 bp, Artificial Sequence
  Synthetic oligonucleotide; TCAGGATT chr11 5196554 5196577 5196557 -
ttcttagaagtgagaggacatgat

SEQ ID NO: 66090 - DNA, 24 bp, Artificial Sequence
  Synthetic oligonucleotide; ATTAGATT chr11 5196376 5196399 5196379 -
ctgttccacctcagagcattaggc

SEQ ID NO: 66091 - DNA, 24 bp, Artificial Sequence
  Synthetic oligonucleotide; ATATGATT chr11 5195518 5195541 5195521 -
aaattgataagtatatacatttaa

SEQ ID NO: 66092 - DNA, 24 bp, Artificial Sequence
  Synthetic oligonucleotide; AAATGATT chr11 5195292 5195315 5195295 -
actcatttctctttagttctggca

SEQ ID NO: 66093 - DNA, 24 bp, Artificial Sequence
  Synthetic oligonucleotide; GAGAGATT chr11 5195195 5195218 5195198 -
gactaaggtgtaatatatgaaaca

SEQ ID NO: 66094 - DNA, 24 bp, Artificial Sequence
  Synthetic oligonucleotide; ACTGGATT chr11 5195106 5195129 5195109 -
atattggcatttgagtattcgctt

SEQ ID NO: 66095 - DNA, 24 bp, Artificial Sequence
  Synthetic oligonucleotide; TGATGATT chr11 5194714 5194737 5194717 -
gtccttgcgatagtttactgagaa

SEQ ID NO: 66096 - DNA, 24 bp, Artificial Sequence
  Synthetic oligonucleotide; AAAGGATT chr11 5194279 5194302 5194282 -
cttggagaacttttgtgtctagct

SEQ ID NO: 66097 - DNA, 24 bp, Artificial Sequence
  Synthetic oligonucleotide; CAAAGATT chr11 5193624 5193647 5193627 -
caattccggacacagaaggatgga

SEQ ID NO: 66098 - DNA, 24 bp, Artificial Sequence
  Synthetic oligonucleotide; AGTAGATT chr11 5193345 5193368 5193348 -
aagtagccaataagggggacagga

SEQ ID NO: 66099 - DNA, 24 bp, Artificial Sequence
  Synthetic oligonucleotide; TATAGATT chr11 5192921 5192944 5192924 -
acagacactttaccaaagaagata

SEQ ID NO: 66100 - DNA, 24 bp, Artificial Sequence
  Synthetic oligonucleotide; TTCTGATT chr11 5192326 5192349 5192329 -
cctatagtctttcatatccttctg

SEQ ID NO: 66101 - DNA, 24 bp, Artificial Sequence
  Synthetic oligonucleotide; AATAGATT chr11 5192217 5192240 5192220 -
tcagacagctattgcatagaatga

SEQ ID NO: 66102 - DNA, 24 bp, Artificial Sequence
  Synthetic oligonucleotide; TTATGATT chr11 5192188 5192211 5192191 -
attaatatttaataacaggtaatg

SEQ ID NO: 66103 - DNA, 24 bp, Artificial Sequence
  Synthetic oligonucleotide; AAAAGATT chr11 5192158 5192181 5192161 -
tttattaaaaataagatgataaat

SEQ ID NO: 66104 - DNA, 24 bp, Artificial Sequence
  Synthetic oligonucleotide; AAATGATT chr11 5192077 5192100 5192080 -
tttggacatgagtaaagaggagta

SEQ ID NO: 66105 - DNA, 24 bp, Artificial Sequence
  Synthetic oligonucleotide; CCATGATT chr11 5191655 5191678 5191658 -
aaatcgctgatgagaactctgcca

SEQ ID NO: 66106 - DNA, 24 bp, Artificial Sequence
  Synthetic oligonucleotide; TGGTGATT chr11 5191614 5191637 5191617 -
cccacaaggccccacctccaacgc

SEQ ID NO: 66107 - DNA, 24 bp, Artificial Sequence
  Synthetic oligonucleotide; CCATGATT chr11 5190994 5191017 5190997 -
actttgctcctccttcaccttcca

SEQ ID NO: 66108 - DNA, 24 bp, Artificial Sequence
  Synthetic oligonucleotide; AAGAGATT chr11 5190739 5190762 5190742 -
agtttagcccctgctgctgctctt

SEQ ID NO: 66109 - DNA, 24 bp, Artificial Sequence
  Synthetic oligonucleotide; CCCAGATT chr11 5190436 5190459 5190439 -
tcaactttttgacctttgcacact

SEQ ID NO: 66110 - DNA, 24 bp, Artificial Sequence
  Synthetic oligonucleotide; TTCTGATT chr11 5190019 5190042 5190022 -
ctctgcttcccttttaaatataag

SEQ ID NO: 66111 - DNA, 24 bp, Artificial Sequence
  Synthetic oligonucleotide; CACAGATT chr11 5189884 5189907 5189887 -
ataatattatcaacttcgaatttc

SEQ ID NO: 66112 - DNA, 24 bp, Artificial Sequence
  Synthetic oligonucleotide; CAGAGATT chr11 5189503 5189526 5189506 -
tgagactgggtaaatggtgaagaa

SEQ ID NO: 66113 - DNA, 24 bp, Artificial Sequence
  Synthetic oligonucleotide; TGGGGATT chr11 5189218 5189241 5189221 -
cccaccaggccccatcttcaacac

SEQ ID NO: 66114 - DNA, 24 bp, Artificial Sequence
  Synthetic oligonucleotide; ATGAGATT chr11 5189200 5189223 5189203 -
caacactggggattacagctgaac

SEQ ID NO: 66115 - DNA, 24 bp, Artificial Sequence
  Synthetic oligonucleotide; TTGTGATT chr11 5189148 5189171 5189151 -
aaccatatcaggcatgcattactc

SEQ ID NO: 66116 - DNA, 24 bp, Artificial Sequence
  Synthetic oligonucleotide; TATTGATT chr11 5188753 5188776 5188756 -
gaaaaagctacaagactctgcaaa

SEQ ID NO: 66117 - DNA, 24 bp, Artificial Sequence
  Synthetic oligonucleotide; CTTGGATT chr11 5188346 5188369 5188349 -
gaaaggatcatctggaattctttt

SEQ ID NO: 66118 - DNA, 24 bp, Artificial Sequence
  Synthetic oligonucleotide; ATATGATT chr11 5187898 5187921 5187901 -
ggtatattagataatcatatagat

SEQ ID NO: 66119 - DNA, 24 bp, Artificial Sequence
  Synthetic oligonucleotide; CCGAGATT chr11 5187878 5187901 5187881 -
agatatatgattattaagggcata

SEQ ID NO: 66120 - DNA, 24 bp, Artificial Sequence
  Synthetic oligonucleotide; CCCAGATT chr11 5187557 5187580 5187560 -
aaaaattcttcaagttttagagtc

SEQ ID NO: 66121 - DNA, 24 bp, Artificial Sequence
  Synthetic oligonucleotide; CTTGGATT chr11 5187512 5187535 5187515 -
ataagttatcagcagagtatacct

SEQ ID NO: 66122 - DNA, 24 bp, Artificial Sequence
  Synthetic oligonucleotide; CTTTGATT chr11 5187397 5187420 5187400 -
ctccatctctttttctataatatc

SEQ ID NO: 66123 - DNA, 24 bp, Artificial Sequence
  Synthetic oligonucleotide; GACTGATT chr11 5187159 5187182 5187162 -
cagtgagaactaagatgcctagat

SEQ ID NO: 66124 - DNA, 24 bp, Artificial Sequence
  Synthetic oligonucleotide; TAGGGATT chr11 5187016 5187039 5187019 -
actactataggtgaaaaaagcttc

SEQ ID NO: 66125 - DNA, 24 bp, Artificial Sequence
  Synthetic oligonucleotide; TTCAGATT chr11 5186786 5186809 5186789 -
gtagctaatataatttcttggccc

SEQ ID NO: 66126 - DNA, 24 bp, Artificial Sequence
  Synthetic oligonucleotide; TCCAGATT chr11 5186365 5186388 5186368 -
tgctttaaaagaagtataaatagt

SEQ ID NO: 66127 - DNA, 24 bp, Artificial Sequence
  Synthetic oligonucleotide; TCAGGATT chr11 5186307 5186330 5186310 -
ctcctctcaacctgctaaatatct

SEQ ID NO: 66128 - DNA, 24 bp, Artificial Sequence
  Synthetic oligonucleotide; CCTTGATT chr11 5186170 5186193 5186173 -
gataacttaatcatctaacatttt

SEQ ID NO: 66129 - DNA, 24 bp, Artificial Sequence
  Synthetic oligonucleotide; AGTTGATT chr11 5186126 5186149 5186129 -
aatactagacttggctttagctgg

SEQ ID NO: 66130 - DNA, 24 bp, Artificial Sequence
  Synthetic oligonucleotide; TGCAGATT chr11 5186011 5186034 5186014 -
aaataatgctcattttctttgata

SEQ ID NO: 66131 - DNA, 24 bp, Artificial Sequence
  Synthetic oligonucleotide; CAAAGATT chr11 5185992 5186015 5185995 -
tgatatgcagatttgaatgttgta

SEQ ID NO: 66132 - DNA, 24 bp, Artificial Sequence
  Synthetic oligonucleotide; CACAGATT chr11 5185858 5185881 5185861 -
ttactcatcaggtaatagtctagg

SEQ ID NO: 66133 - DNA, 24 bp, Artificial Sequence
  Synthetic oligonucleotide; TGAAGATT chr11 5185694 5185717 5185697 -
taaaagtaaatgacagatacaggg

SEQ ID NO: 66134 - DNA, 24 bp, Artificial Sequence
  Synthetic oligonucleotide; ATAAGATT chr11 5185331 5185354 5185334 -
cgtgtccagggtcatagagtcaga

SEQ ID NO: 66135 - DNA, 24 bp, Artificial Sequence
  Synthetic oligonucleotide; TCATGATT chr11 5185238 5185261 5185241 -
actatctttgctccgtggatacat

SEQ ID NO: 66136 - DNA, 24 bp, Artificial Sequence
  Synthetic oligonucleotide; CTTAGATT chr11 5185014 5185037 5185017 -
cttcattcctgtatttttttttca

SEQ ID NO: 66137 - DNA, 24 bp, Artificial Sequence
  Synthetic oligonucleotide; AAGAGATT chr11 5184039 5184062 5184042 -
ttcagagcctattatttgtctatt

SEQ ID NO: 66138 - DNA, 24 bp, Artificial Sequence
  Synthetic oligonucleotide; ACTAGATT chr11 5183972 5183995 5183975 -
gtgtcgaggaatttatccatttct

SEQ ID NO: 66139 - DNA, 24 bp, Artificial Sequence
  Synthetic oligonucleotide; GTGGGATT chr11 5183906 5183929 5183909 -
tctctgatggtagtttgtatgtct

SEQ ID NO: 66140 - DNA, 24 bp, Artificial Sequence
  Synthetic oligonucleotide; CCTGGATT chr11 5183781 5183804 5183784 -
gttgatcttttcaaaaaaccagct

SEQ ID NO: 66141 - DNA, 24 bp, Artificial Sequence
  Synthetic oligonucleotide; CATTGATT chr11 5183773 5183796 5183776 -
tttcaaaaaaccagctcctggatt

SEQ ID NO: 66142 - DNA, 24 bp, Artificial Sequence
  Synthetic oligonucleotide; CAGAGATT chr11 5183555 5183578 5183558 -
ctacacactgctttaaatgtgtcc

SEQ ID NO: 66143 - DNA, 24 bp, Artificial Sequence
  Synthetic oligonucleotide; GTTTGATT chr11 5183395 5183418 5183398 -
tgagtttcttaatcctgagttcta

SEQ ID NO: 66144 - DNA, 24 bp, Artificial Sequence
  Synthetic oligonucleotide; TATTGATT chr11 5183261 5183284 5183264 -
tggtgctgagaagaatgtatattc

SEQ ID NO: 66145 - DNA, 24 bp, Artificial Sequence
  Synthetic oligonucleotide; CTAAGATT chr11 5182926 5182949 5182929 -
gtttaaagtctgttttatcagaga

SEQ ID NO: 66146 - DNA, 24 bp, Artificial Sequence
  Synthetic oligonucleotide; ATGAGATT chr11 5182833 5182856 5182836 -
ttgagcctatgtgtgtctctccac

SEQ ID NO: 66147 - DNA, 24 bp, Artificial Sequence
  Synthetic oligonucleotide; GATGGATT chr11 5182449 5182472 5182452 -
ccaaccaaaaaaagtccaggacca

SEQ ID NO: 66148 - DNA, 24 bp, Artificial Sequence
  Synthetic oligonucleotide; ACATGATT chr11 5182088 5182111 5182091 -
taaacagaaccaaagacacaaacc

SEQ ID NO: 66149 - DNA, 24 bp, Artificial Sequence
  Synthetic oligonucleotide; ACGTGATT chr11 5181761 5181784 5181764 -
tgaaattgtccctgtttgcagatg

SEQ ID NO: 66150 - DNA, 24 bp, Artificial Sequence
  Synthetic oligonucleotide; TATAGATT chr11 5181402 5181425 5181405 -
atggccttactgcccaaggtaatt

SEQ ID NO: 66151 - DNA, 24 bp, Artificial Sequence
  Synthetic oligonucleotide; AAAGGATT chr11 5181089 5181112 5181092 -
acctgacaaaaacaagcaatgggg

SEQ ID NO: 66152 - DNA, 24 bp, Artificial Sequence
  Synthetic oligonucleotide; GATGGATT chr11 5180985 5181008 5180988 -
caccttatacaaaaattatttcaa

SEQ ID NO: 66153 - DNA, 24 bp, Artificial Sequence
  Synthetic oligonucleotide; ACTGGATT chr11 5180217 5180240 5180220 -
aacccaaatgtccaacaatgatag

SEQ ID NO: 66154 - DNA, 24 bp, Artificial Sequence
  Synthetic oligonucleotide; AAGCGATT chr11 5179642 5179665 5179645 -
ctgaaacttctgcctcccaggttc

SEQ ID NO: 66155 - DNA, 24 bp, Artificial Sequence
  Synthetic oligonucleotide; CTGGGATT chr11 5179610 5179633 5179613 -
ctcctgcctcagcctcttgagtag

SEQ ID NO: 66156 - DNA, 24 bp, Artificial Sequence
  Synthetic oligonucleotide; CTGGGATT chr11 5179477 5179500 5179480 -
tacccgcctcagcctctcaaagtg

SEQ ID NO: 66157 - DNA, 24 bp, Artificial Sequence
  Synthetic oligonucleotide; TATAGATT chr11 5179439 5179462 5179442 -
gtgagccaccgtgccaggctggca

SEQ ID NO: 66158 - DNA, 24 bp, Artificial Sequence
  Synthetic oligonucleotide; AATAGATT chr11 5179362 5179385 5179365 -
atgttttatcctatatttttgaga

SEQ ID NO: 66159 - DNA, 24 bp, Artificial Sequence
  Synthetic oligonucleotide; TTCAGATT chr11 5179077 5179100 5179080 -
tggatggtagtaaagatcaaagct

SEQ ID NO: 66160 - DNA, 24 bp, Artificial Sequence
  Synthetic oligonucleotide; TGAAGATT chr11 5178940 5178963 5178943 -
aaagggcttttcaataggttattg

SEQ ID NO: 66161 - DNA, 24 bp, Artificial Sequence
  Synthetic oligonucleotide; GGAAGATT chr11 5178232 5178255 5178235 -
ccattttaacctcatcagccgtca

SEQ ID NO: 66162 - DNA, 24 bp, Artificial Sequence
  Synthetic oligonucleotide; GCCAGATT chr11 5178110 5178133 5178113 -
cctcattcctactgtgagcacatt

SEQ ID NO: 66163 - DNA, 24 bp, Artificial Sequence
  Synthetic oligonucleotide; GAGTGATT chr11 5177755 5177778 5177758 -
tgaagaccaaacaaattaaagatc

SEQ ID NO: 66164 - DNA, 24 bp, Artificial Sequence
  Synthetic oligonucleotide; TTAAGATT chr11 5177718 5177741 5177721 -
tttctctcctatcagtgtatgctg

SEQ ID NO: 66165 - DNA, 24 bp, Artificial Sequence
  Synthetic oligonucleotide; TCCAGATT chr11 5177469 5177492 5177472 -
agagaaatatattttagggtttaa

SEQ ID NO: 66166 - DNA, 24 bp, Artificial Sequence
  Synthetic oligonucleotide; ATGAGATT chr11 5177148 5177171 5177151 -
ataaccaatattaaattaacaaat

SEQ ID NO: 66167 - DNA, 24 bp, Artificial Sequence
  Synthetic oligonucleotide; TGGAGATT chr11 5177099 5177122 5177102 -
tctgatacacatttccccctatag

SEQ ID NO: 66168 - DNA, 24 bp, Artificial Sequence
  Synthetic oligonucleotide; AAATGATT chr11 5177032 5177055 5177035 -
aacagaaacatcactgaagaagta

SEQ ID NO: 66169 - DNA, 24 bp, Artificial Sequence
  Synthetic oligonucleotide; AGAAGATT chr11 5176963 5176986 5176966 -
aataaacattttttaaaaagctag

SEQ ID NO: 66170 - DNA, 24 bp, Artificial Sequence
  Synthetic oligonucleotide; CTGTGATT chr11 5176678 5176701 5176681 -
tgcttggcttatgcttagcttttt

SEQ ID NO: 66171 - DNA, 24 bp, Artificial Sequence
  Synthetic oligonucleotide; CTTAGATT chr11 5176642 5176665 5176645 -
tagaaatttatacatgtattaaca

SEQ ID NO: 66172 - DNA, 24 bp, Artificial Sequence
  Synthetic oligonucleotide; GATAGATT chr11 5176216 5176239 5176219 -
aatatgatggaaaatgagggaata

SEQ ID NO: 66173 - DNA, 24 bp, Artificial Sequence
  Synthetic oligonucleotide; AGAGGATT chr11 5176195 5176218 5176198 -
atagatagattgcagtatgatgac

SEQ ID NO: 66174 - DNA, 24 bp, Artificial Sequence
  Synthetic oligonucleotide; GGAAGATT chr11 5176174 5176197 5176177 -
gacagaggatttgactgaaaggta

SEQ ID NO: 66175 - DNA, 24 bp, Artificial Sequence
  Synthetic oligonucleotide; ACTTGATT chr11 5176160 5176183 5176163 -
ctgaaaggtaggaagattttgtat

SEQ ID NO: 66176 - DNA, 24 bp, Artificial Sequence
  Synthetic oligonucleotide; AAATGATT chr11 5175996 5176019 5175999 -
tgacagttaaaatggtagaagtaa

SEQ ID NO: 66177 - DNA, 24 bp, Artificial Sequence
  Synthetic oligonucleotide; CTCAGATT chr11 5175952 5175975 5175955 -
tctaaataaactttcagttgagca

SEQ ID NO: 66178 - DNA, 24 bp, Artificial Sequence
  Synthetic oligonucleotide; AAAGGATT chr11 5175941 5175964 5175944 -
tttcagttgagcactcagattctg

SEQ ID NO: 66179 - DNA, 24 bp, Artificial Sequence
  Synthetic oligonucleotide; AAGTGATT chr11 5175569 5175592 5175572 -
aaaaaacaaaaggtacagggtgct

SEQ ID NO: 66180 - DNA, 24 bp, Artificial Sequence
  Synthetic oligonucleotide; TTTTGATT chr11 5175456 5175479 5175459 -
ttagttaatatcaatcaagcaaaa

SEQ ID NO: 66181 - DNA, 24 bp, Artificial Sequence
  Synthetic oligonucleotide; GAATGATT chr11 5175160 5175183 5175163 -
gctacatgggaggctgaggcagga

SEQ ID NO: 66182 - DNA, 24 bp, Artificial Sequence
  Synthetic oligonucleotide; AATAGATT chr11 5174588 5174611 5174591 -
agtctattttagataattcatata

SEQ ID NO: 66183 - DNA, 24 bp, Artificial Sequence
  Synthetic oligonucleotide; CATAGATT chr11 5174469 5174492 5174472 -
agtctttgcttaatgttgtccatt

SEQ ID NO: 66184 - DNA, 24 bp, Artificial Sequence
  Synthetic oligonucleotide; TGAGGATT chr11 5173996 5174019 5173999 -
cttaacatttttagcagcaatata

SEQ ID NO: 66185 - DNA, 24 bp, Artificial Sequence
  Synthetic oligonucleotide; TGAAGATT chr11 5173564 5173587 5173567 -
aatctattgtaaaatcaaagttca

SEQ ID NO: 66186 - DNA, 24 bp, Artificial Sequence
  Synthetic oligonucleotide; TCATGATT chr11 5173120 5173143 5173123 -
taacactattattacctgtcttta

SEQ ID NO: 66187 - DNA, 24 bp, Artificial Sequence
  Synthetic oligonucleotide; AAATGATT chr11 5172930 5172953 5172933 -
aacctgactacataaaagttttgt

SEQ ID NO: 66188 - DNA, 24 bp, Artificial Sequence
  Synthetic oligonucleotide; CATGGATT chr11 5172564 5172587 5172567 -
aagtaaacagtaacaaatagtatg

SEQ ID NO: 66189 - DNA, 24 bp, Artificial Sequence
  Synthetic oligonucleotide; AGCTGATT chr11 5172454 5172477 5172457 -
tgctggcttgcaccagcttaggaa

SEQ ID NO: 66190 - DNA, 24 bp, Artificial Sequence
  Synthetic oligonucleotide; CACTGATT chr11 5172309 5172332 5172312 -
atttggaaatatttattactatcc

SEQ ID NO: 66191 - DNA, 24 bp, Artificial Sequence
  Synthetic oligonucleotide; CCAAGATT chr11 5171746 5171769 5171749 -
atataaatcaactttaatataatc

SEQ ID NO: 66192 - DNA, 24 bp, Artificial Sequence
  Synthetic oligonucleotide; TTGAGATT chr11 5171559 5171582 5171562 -
tttcactgccatagatgacccaac

SEQ ID NO: 66193 - DNA, 24 bp, Artificial Sequence
  Synthetic oligonucleotide; TGCTGATT chr11 5170641 5170664 5170644 -
tattgttcattgtggtttcttatg

SEQ ID NO: 66194 - DNA, 24 bp, Artificial Sequence
  Synthetic oligonucleotide; CTAAGATT chr11 5169761 5169784 5169764 -
tgtcaatttgtcaaaacggtacag

SEQ ID NO: 66195 - DNA, 24 bp, Artificial Sequence
  Synthetic oligonucleotide; AGATGATT chr11 5169671 5169694 5169674 -
aaaggaaaatagtaataataatac

SEQ ID NO: 66196 - DNA, 24 bp, Artificial Sequence
  Synthetic oligonucleotide; ATTAGATT chr11 5169666 5169689 5169669 -
aaaatagtaataataatacagatg

SEQ ID NO: 66197 - DNA, 24 bp, Artificial Sequence
  Synthetic oligonucleotide; AAAAGATT chr11 5169528 5169551 5169531 -
gtgtagtttacaatttctgtaata

SEQ ID NO: 66198 - DNA, 24 bp, Artificial Sequence
  Synthetic oligonucleotide; CAGGGATT chr11 5169202 5169225 5169205 -
aagaattctagaaaatccctcaga

SEQ ID NO: 66199 - DNA, 24 bp, Artificial Sequence
  Synthetic oligonucleotide; GAGTGATT chr11 5169111 5169134 5169114 -
tatcctattaaaccacacagtctt

SEQ ID NO: 66200 - DNA, 24 bp, Artificial Sequence
  Synthetic oligonucleotide; ATGGGATT chr11 5168926 5168949 5168929 -
atgtagtgaagtcataaaaacaac

SEQ ID NO: 66201 - DNA, 24 bp, Artificial Sequence
  Synthetic oligonucleotide; TGAAGATT chr11 5168576 5168599 5168579 -
aataaaatccagcttttatgatct

SEQ ID NO: 66202 - DNA, 24 bp, Artificial Sequence
  Synthetic oligonucleotide; AAGTGATT chr11 5168339 5168362 5168342 -
tcacgagctatagtgtaccatact

SEQ ID NO: 66203 - DNA, 24 bp, Artificial Sequence
  Synthetic oligonucleotide; TATAGATT chr11 5168329 5168352 5168332 -
tagtgtaccatactaagtgattta

SEQ ID NO: 66204 - DNA, 24 bp, Artificial Sequence
  Synthetic oligonucleotide; ACCTGATT chr11 5168159 5168182 5168162 -
caaaaccagacaatccaactaaaa

SEQ ID NO: 66205 - DNA, 24 bp, Artificial Sequence
  Synthetic oligonucleotide; TTCAGATT chr11 5168111 5168134 5168114 -
tatcagtggtcccataacttaaaa

SEQ ID NO: 66206 - DNA, 24 bp, Artificial Sequence
  Synthetic oligonucleotide; TTGAGATT chr11 5168046 5168069 5168049 -
caattctgtaaaccattttctcct

SEQ ID NO: 66207 - DNA, 24 bp, Artificial Sequence
  Synthetic oligonucleotide; TACTGATT chr11 5167914 5167937 5167917 -
cccacattagtttaactgcttagg

SEQ ID NO: 66208 - DNA, 24 bp, Artificial Sequence
  Synthetic oligonucleotide; CTAAGATT chr11 5167867 5167890 5167870 -
aaccaacacttttagaactatcat

SEQ ID NO: 66209 - DNA, 24 bp, Artificial Sequence
  Synthetic oligonucleotide; AATAGATT chr11 5167014 5167037 5167017 -
ggtaaccacagcacaaaaatctat

SEQ ID NO: 66210 - DNA, 24 bp, Artificial Sequence
  Synthetic oligonucleotide; CTCAGATT chr11 5165691 5165714 5165694 -
cgcgcatgaaatttggtgccgtga

SEQ ID NO: 66211 - DNA, 24 bp, Artificial Sequence
  Synthetic oligonucleotide; CTCTGATT chr11 5165326 5165349 5165329 -
tgtttaatcattgcagggacacct

SEQ ID NO: 66212 - DNA, 24 bp, Artificial Sequence
  Synthetic oligonucleotide; CCAGGATT chr11 5163701 5163724 5163704 -
accaggccaaggaatgcccgcagc

SEQ ID NO: 66213 - DNA, 24 bp, Artificial Sequence
  Synthetic oligonucleotide; AAAGGATT chr11 5163004 5163027 5163007 -
tatcccatcccacagcatgctttg

SEQ ID NO: 66214 - DNA, 24 bp, Artificial Sequence
  Synthetic oligonucleotide; TGCTGATT chr11 5162550 5162573 5162553 -
tcataaaaacacacgtgctctccc

SEQ ID NO: 66215 - DNA, 24 bp, Artificial Sequence
  Synthetic oligonucleotide; GTCCGATT chr11 5162540 5162563 5162543 -
acacgtgctctccctgctgattgt

SEQ ID NO: 66216 - DNA, 24 bp, Artificial Sequence
  Synthetic oligonucleotide; CCATGATT chr11 5162126 5162149 5162129 -
tattcctgataccacacctgaccc

SEQ ID NO: 66217 - DNA, 24 bp, Artificial Sequence
  Synthetic oligonucleotide; ACTTGATT chr11 5162036 5162059 5162039 -
tttcctgttcctcaccctgatcac

SEQ ID NO: 66218 - DNA, 24 bp, Artificial Sequence
  Synthetic oligonucleotide; CAGGGATT chr11 5161858 5161881 5161861 -
tccatctgctattctgctactcct

SEQ ID NO: 66219 - DNA, 24 bp, Artificial Sequence
  Synthetic oligonucleotide; CGAGGATT chr11 5161816 5161839 5161819 -
cctcccttccctacacatcaagct

SEQ ID NO: 66220 - DNA, 24 bp, Artificial Sequence
  Synthetic oligonucleotide; ATTAGATT chr11 5161786 5161809 5161789 -
tttgcccccacccaggactggcaa

SEQ ID NO: 66221 - DNA, 24 bp, Artificial Sequence
  Synthetic oligonucleotide; TATAGATT chr11 5161353 5161376 5161356 -
gggtacagcccatttgagctcctg

SEQ ID NO: 66222 - DNA, 24 bp, Artificial Sequence
  Synthetic oligonucleotide; ACAAGATT chr11 5159723 5159746 5159726 -
acctcaatagaacaataatgaata

SEQ ID NO: 66223 - DNA, 24 bp, Artificial Sequence
  Synthetic oligonucleotide; AAACGATT chr11 5159200 5159223 5159203 -
taaaaacttcactaaatactatta

SEQ ID NO: 66224 - DNA, 24 bp, Artificial Sequence
  Synthetic oligonucleotide; TACAGATT chr11 5158894 5158917 5158897 -
atgacaatactacccaaagcaatg

SEQ ID NO: 66225 - DNA, 24 bp, Artificial Sequence
  Synthetic oligonucleotide; CCAAGATT chr11 5158350 5158373 5158353 -
ctgggaggcagaagttgcagtgat

SEQ ID NO: 66226 - DNA, 24 bp, Artificial Sequence
  Synthetic oligonucleotide; GATGGATT chr11 5158172 5158195 5158175 -
cactatatacaaaaatcaaatcaa

SEQ ID NO: 66227 - DNA, 24 bp, Artificial Sequence
  Synthetic oligonucleotide; CATTGATT chr11 5158092 5158115 5158095 -
agtggggaaaccctccagggcatt

SEQ ID NO: 66228 - DNA, 24 bp, Artificial Sequence
  Synthetic oligonucleotide; TTGGGATT chr11 5158025 5158048 5158028 -
aataaccaaaacaaaaatagacaa

SEQ ID NO: 66229 - DNA, 24 bp, Artificial Sequence
  Synthetic oligonucleotide; TGGAGATT chr11 5157607 5157630 5157610 -
gtacagcaattatgaaggacagta

SEQ ID NO: 66230 - DNA, 24 bp, Artificial Sequence
  Synthetic oligonucleotide; CCAAGATT chr11 5157466 5157489 5157469 -
ttattatagcactattcacaaacg

SEQ ID NO: 66231 - DNA, 24 bp, Artificial Sequence
  Synthetic oligonucleotide; AGTAGATT chr11 5157212 5157235 5157215 -
aacgtggatcttatgaagacagag

SEQ ID NO: 66232 - DNA, 24 bp, Artificial Sequence
  Synthetic oligonucleotide; ATTAGATT chr11 5155899 5155922 5155902 -
tagtgacaaaagaataacctgaat

SEQ ID NO: 66233 - DNA, 24 bp, Artificial Sequence
  Synthetic oligonucleotide; TACAGATT chr11 5155196 5155219 5155199 -
tgtgtggtaaaaagtagttatgaa

SEQ ID NO: 66234 - DNA, 24 bp, Artificial Sequence
  Synthetic oligonucleotide; AGGAGATT chr11 5154973 5154996 5154976 -
gtgggaaaagagaaaaagagagaa

SEQ ID NO: 66235 - DNA, 24 bp, Artificial Sequence
  Synthetic oligonucleotide; TCACGATT chr11 5154350 5154373 5154353 -
tcaataataattgaggagtaagtc

SEQ ID NO: 66236 - DNA, 24 bp, Artificial Sequence
  Synthetic oligonucleotide; TTGTGATT chr11 5154183 5154206 5154186 -
ctttggtcttgaataagtcagaca

SEQ ID NO: 66237 - DNA, 24 bp, Artificial Sequence
  Synthetic oligonucleotide; AAAGGATT chr11 5154169 5154192 5154172 -
aagtcagacattgtgattgccatt

SEQ ID NO: 66238 - DNA, 24 bp, Artificial Sequence
  Synthetic oligonucleotide; TTGTGATT chr11 5154151 5154174 5154154 -
gccattaaaggattcttattctaa

SEQ ID NO: 66239 - DNA, 24 bp, Artificial Sequence
  Synthetic oligonucleotide; TGCTGATT chr11 5153966 5153989 5153969 -
gcctccctgtcatgaaatgtcctc

SEQ ID NO: 66240 - DNA, 24 bp, Artificial Sequence
  Synthetic oligonucleotide; AGCTGATT chr11 5153750 5153773 5153753 -
attggtgacatgaagcatacggtt

SEQ ID NO: 66241 - DNA, 24 bp, Artificial Sequence
  Synthetic oligonucleotide; TACTGATT chr11 5153634 5153657 5153637 -
ttctctaatgtatagcttaaaatg

SEQ ID NO: 66242 - DNA, 24 bp, Artificial Sequence
  Synthetic oligonucleotide; AAATGATT chr11 5153244 5153267 5153247 -
aggaaactggactctattctggct

SEQ ID NO: 66243 - DNA, 24 bp, Artificial Sequence
  Synthetic oligonucleotide; CTCAGATT chr11 5153005 5153028 5153008 -
ataaaaagcaaccaggagctttgg

SEQ ID NO: 66244 - DNA, 24 bp, Artificial Sequence
  Synthetic oligonucleotide; TAAAGATT chr11 5152986 5153009 5152989 -
tttggctcagatttgtcaaaagta

SEQ ID NO: 66245 - DNA, 24 bp, Artificial Sequence
  Synthetic oligonucleotide; AGGTGATT chr11 5152645 5152668 5152648 -
ggccagtagtccaatcccctgtcc

SEQ ID NO: 66246 - DNA, 24 bp, Artificial Sequence
  Synthetic oligonucleotide; TTTGGATT chr11 5152620 5152643 5152623 -
ggtgattttgctggttctaatgta

SEQ ID NO: 66247 - DNA, 24 bp, Artificial Sequence
  Synthetic oligonucleotide; GGATGATT chr11 5152503 5152526 5152506 -
tcctttcaaaactgtgaataagat

SEQ ID NO: 66248 - DNA, 24 bp, Artificial Sequence
  Synthetic oligonucleotide; GCTGGATT chr11 5152291 5152314 5152294 -
tcccaggcctagaatctgtgcagt

SEQ ID NO: 66249 - DNA, 24 bp, Artificial Sequence
  Synthetic oligonucleotide; TTGGGATT chr11 5152285 5152308 5152288 -
gcctagaatctgtgcagtgctgga

SEQ ID NO: 66250 - DNA, 24 bp, Artificial Sequence
  Synthetic oligonucleotide; CTATGATT chr11 5152252 5152275 5152255 -
cattctgtgccatttatctcattg

SEQ ID NO: 66251 - DNA, 24 bp, Artificial Sequence
  Synthetic oligonucleotide; TTTTGATT chr11 5152086 5152109 5152089 -
ctggtttaatgtgcctgaaatcta

SEQ ID NO: 66252 - DNA, 24 bp, Artificial Sequence
  Synthetic oligonucleotide; GCAGGATT chr11 5151743 5151766 5151746 -
ggtttgtttgtggccttcactgta

SEQ ID NO: 66253 - DNA, 24 bp, Artificial Sequence
  Synthetic oligonucleotide; CACAGATT chr11 5151472 5151495 5151475 -
cacttgtctatggtgcaaagacca

SEQ ID NO: 66254 - DNA, 24 bp, Artificial Sequence
  Synthetic oligonucleotide; GTGGGATT chr11 5151281 5151304 5151284 -
gatcatcatggctcatatcaatca

SEQ ID NO: 66255 - DNA, 24 bp, Artificial Sequence
  Synthetic oligonucleotide; GGAGGATT chr11 5151150 5151173 5151153 -
tattcttctaagaatatttctcca

SEQ ID NO: 66256 - DNA, 24 bp, Artificial Sequence
  Synthetic oligonucleotide; CTCTGATT chr11 5150527 5150550 5150530 -
tttgttttttggttaggtagttac

SEQ ID NO: 66257 - DNA, 24 bp, Artificial Sequence
  Synthetic oligonucleotide; AGGAGATT chr11 5150457 5150480 5150460 -
cacatcatgccaggtagatagtag

SEQ ID NO: 66258 - DNA, 24 bp, Artificial Sequence
  Synthetic oligonucleotide; CTTTGATT chr11 5150014 5150037 5150017 -
ttcacatatgggcagatgtccata

SEQ ID NO: 66259 - DNA, 24 bp, Artificial Sequence
  Synthetic oligonucleotide; CAAGAAT chr11 5150491 5150514 5150511 +
cttggctactcatccatcattcct

SEQ ID NO: 66260 - DNA, 24 bp, Artificial Sequence
  Synthetic oligonucleotide; CCAGAAT chr11 5150673 5150696 5150693 +
tctcttcctttcagtctctctttt

SEQ ID NO: 66261 - DNA, 24 bp, Artificial Sequence
  Synthetic oligonucleotide; TGAGAAT chr11 5150698 5150721 5150718 +
cagaattacataggtacaaactca

SEQ ID NO: 66262 - DNA, 24 bp, Artificial Sequence
  Synthetic oligonucleotide; CAAGAAA chr11 5151015 5151038 5151035 +
ttttttttttaaggcagggatgat

SEQ ID NO: 66263 - DNA, 24 bp, Artificial Sequence
  Synthetic oligonucleotide; GGAGAAA chr11 5151127 5151150 5151147 +
aaggcataatttataaatcctcct

SEQ ID NO: 66264 - DNA, 24 bp, Artificial Sequence
  Synthetic oligonucleotide; GAAGAAT chr11 5151142 5151165 5151162 +
aatcctcctggagaaatattctta

SEQ ID NO: 66265 - DNA, 24 bp, Artificial Sequence
  Synthetic oligonucleotide; AAAGAAT chr11 5151165 5151188 5151185 +
agaagaataactcaaccaggggct

SEQ ID NO: 66266 - DNA, 24 bp, Artificial Sequence
  Synthetic oligonucleotide; AGAGAAA chr11 5151175 5151198 5151195 +
ctcaaccaggggctaaagaataaa

SEQ ID NO: 66267 - DNA, 24 bp, Artificial Sequence
  Synthetic oligonucleotide; GTAGAAT chr11 5151238 5151261 5151258 +
acacttctcactttcattagtcac

SEQ ID NO: 66268 - DNA, 24 bp, Artificial Sequence
  Synthetic oligonucleotide; AAAGAAA chr11 5151370 5151393 5151390 +
tgttttgatatggttactactgca

SEQ ID NO: 66269 - DNA, 24 bp, Artificial Sequence
  Synthetic oligonucleotide; TGAGAAA chr11 5151475 5151498 5151495 +
tctttgcaccatagacaagtggat

SEQ ID NO: 66270 - DNA, 24 bp, Artificial Sequence
  Synthetic oligonucleotide; CTAGAAA chr11 5151504 5151527 5151524 +
aatggagggaccagcaagtaaatg

SEQ ID NO: 66271 - DNA, 24 bp, Artificial Sequence
  Synthetic oligonucleotide; AGAGAAT chr11 5151511 5151534 5151531 +
ggaccagcaagtaaatgctagaaa

SEQ ID NO: 66272 - DNA, 24 bp, Artificial Sequence
  Synthetic oligonucleotide; CAAGAAT chr11 5151874 5151897 5151894 +
ttatcagtactaggcatggggcta

SEQ ID NO: 66273 - DNA, 24 bp, Artificial Sequence
  Synthetic oligonucleotide; CCAGAAT chr11 5152082 5152105 5152102 +
aaaatagatttcaggcacattaaa

SEQ ID NO: 66274 - DNA, 24 bp, Artificial Sequence
  Synthetic oligonucleotide; TAAGAAA chr11 5152151 5152174 5152171 +
aatgtctgtggctcctagcatgcc

SEQ ID NO: 66275 - DNA, 24 bp, Artificial Sequence
  Synthetic oligonucleotide; ACAGAAT chr11 5152244 5152267 5152264 +
aatcatagcaatgagataaatggc

SEQ ID NO: 66276 - DNA, 24 bp, Artificial Sequence
  Synthetic oligonucleotide; AGAGAAT chr11 5152859 5152882 5152879 +
ttggtgtaaaagattcccaatgaa

SEQ ID NO: 66277 - DNA, 24 bp, Artificial Sequence
  Synthetic oligonucleotide; GTAGAAA chr11 5152870 5152893 5152890 +
gattcccaatgaaagagaatagag

SEQ ID NO: 66278 - DNA, 24 bp, Artificial Sequence
  Synthetic oligonucleotide; TCAGAAT chr11 5152916 5152939 5152936 +
aacataatatatttctttttatat

SEQ ID NO: 66279 - DNA, 24 bp, Artificial Sequence
  Synthetic oligonucleotide; AGAGAAT chr11 5152930 5152953 5152950 +
ctttttatattcagaataatgtaa

SEQ ID NO: 66280 - DNA, 24 bp, Artificial Sequence
  Synthetic oligonucleotide; TTAGAAA chr11 5152940 5152963 5152960 +
tcagaataatgtaaagagaatgct

SEQ ID NO: 66281 - DNA, 24 bp, Artificial Sequence
  Synthetic oligonucleotide; CCAGAAT chr11 5153222 5153245 5153242 +
ataatgggcaaatgaatcatttag

SEQ ID NO: 66282 - DNA, 24 bp, Artificial Sequence
  Synthetic oligonucleotide; TAAGAAA chr11 5153353 5153376 5153373 +
tatataattttgtgagctctgaca

SEQ ID NO: 66283 - DNA, 24 bp, Artificial Sequence
  Synthetic oligonucleotide; AAAGAAA chr11 5153479 5153502 5153499 +
ttgaggaaagcactatgaataacc

SEQ ID NO: 66284 - DNA, 24 bp, Artificial Sequence
  Synthetic oligonucleotide; AGAGAAA chr11 5153628 5153651 5153648 +
tcagtacattttaagctatacatt

SEQ ID NO: 66285 - DNA, 24 bp, Artificial Sequence
  Synthetic oligonucleotide; AAAGAAA chr11 5153782 5153805 5153802 +
aattcaggaagtagctgttctttg

SEQ ID NO: 66286 - DNA, 24 bp, Artificial Sequence
  Synthetic oligonucleotide; AAAGAAA chr11 5153818 5153841 5153838 +
gctttttttttttttttttttttg

SEQ ID NO: 66287 - DNA, 24 bp, Artificial Sequence
  Synthetic oligonucleotide; GAAGAAA chr11 5153843 5153866 5153863 +
aagaaaaggaaggtaagtaacaag

SEQ ID NO: 66288 - DNA, 24 bp, Artificial Sequence
  Synthetic oligonucleotide; AGAGAAA chr11 5153849 5153872 5153869 +
aggaaggtaagtaacaaggaagaa

SEQ ID NO: 66289 - DNA, 24 bp, Artificial Sequence
  Synthetic oligonucleotide; TTAGAAT chr11 5154127 5154150 5154147 +
tttcttctccaaagataatcacaa

SEQ ID NO: 66290 - DNA, 24 bp, Artificial Sequence
  Synthetic oligonucleotide; TAAGAAT chr11 5154133 5154156 5154153 +
ctccaaagataatcacaattagaa

SEQ ID NO: 66291 - DNA, 24 bp, Artificial Sequence
  Synthetic oligonucleotide; GAAGAAT chr11 5154378 5154401 5154398 +
tggttttgctcttaccagatacct

SEQ ID NO: 66292 - DNA, 24 bp, Artificial Sequence
  Synthetic oligonucleotide; GGAGAAA chr11 5154749 5154772 5154769 +
ggatgaatttattgagctcaaatt

SEQ ID NO: 66293 - DNA, 24 bp, Artificial Sequence
  Synthetic oligonucleotide; GCAGAAA chr11 5154936 5154959 5154956 +
atccccgtaattatttctacactt

SEQ ID NO: 66294 - DNA, 24 bp, Artificial Sequence
  Synthetic oligonucleotide; GCAGAAT chr11 5154982 5155005 5155002 +
tttctcttttcccacaggctaaat

SEQ ID NO: 66295 - DNA, 24 bp, Artificial Sequence
  Synthetic oligonucleotide; TCAGAAA chr11 5155152 5155175 5155172 +
gaggcaaggtttttctctttttat

SEQ ID NO: 66296 - DNA, 24 bp, Artificial Sequence
  Synthetic oligonucleotide; AAAGAAA chr11 5155157 5155180 5155177 +
aaggtttttctctttttattcaga

SEQ ID NO: 66297 - DNA, 24 bp, Artificial Sequence
  Synthetic oligonucleotide; GGAGAAT chr11 5155709 5155732 5155729 +
aaatttaggaagcatactaatggt

SEQ ID NO: 66298 - DNA, 24 bp, Artificial Sequence
  Synthetic oligonucleotide; CCAGAAT chr11 5155783 5155806 5155803 +
ggcaaggaaccccatgtgctcttt

SEQ ID NO: 66299 - DNA, 24 bp, Artificial Sequence
  Synthetic oligonucleotide; TAAGAAA chr11 5155897 5155920 5155917 +
atattcaggttattcttttgtcac

SEQ ID NO: 66300 - DNA, 24 bp, Artificial Sequence
  Synthetic oligonucleotide; TGAGAAA chr11 5157805 5157828 5157825 +
ctgggccatttgtatggcttcttt

SEQ ID NO: 66301 - DNA, 24 bp, Artificial Sequence
  Synthetic oligonucleotide; ACAGAAA chr11 5158847 5158870 5158867 +
tctgtgaatgccattggtattttg

SEQ ID NO: 66302 - DNA, 24 bp, Artificial Sequence
  Synthetic oligonucleotide; ATAGAAT chr11 5159535 5159558 5159555 +
gtatattagagtaatgcttgcctc

SEQ ID NO: 66303 - DNA, 24 bp, Artificial Sequence
  Synthetic oligonucleotide; CAAGAAA chr11 5159939 5159962 5159959 +
ttttgttgattttgtttacctttc

SEQ ID NO: 66304 - DNA, 24 bp, Artificial Sequence
  Synthetic oligonucleotide; TAAGAAA chr11 5160704 5160727 5160724 +
gacattcctgtcttcttatattaa

SEQ ID NO: 66305 - DNA, 24 bp, Artificial Sequence
  Synthetic oligonucleotide; GAAGAAA chr11 5160895 5160918 5160915 +
aggggtgatattgtggggttgtta

SEQ ID NO: 66306 - DNA, 24 bp, Artificial Sequence
  Synthetic oligonucleotide; GTAGAAT chr11 5160912 5160935 5160932 +
gttgttagaagaaacatttgtcat

SEQ ID NO: 66307 - DNA, 24 bp, Artificial Sequence
  Synthetic oligonucleotide; GGAGAAA chr11 5160979 5161002 5160999 +
gaaaaaccaaatggaataagagaa

SEQ ID NO: 66308 - DNA, 24 bp, Artificial Sequence
  Synthetic oligonucleotide; TGAGAAT chr11 5161203 5161226 5161223 +
aagagcagggcatgtatgagtagt

SEQ ID NO: 66309 - DNA, 24 bp, Artificial Sequence
  Synthetic oligonucleotide; TGAGAAA chr11 5161382 5161405 5161402 +
cattctgaggacaggtctgacttc

SEQ ID NO: 66310 - DNA, 24 bp, Artificial Sequence
  Synthetic oligonucleotide; AAAGAAA chr11 5161386 5161409 5161406 +
ctgaggacaggtctgacttctgag

SEQ ID NO: 66311 - DNA, 24 bp, Artificial Sequence
  Synthetic oligonucleotide; GAAGAAA chr11 5161636 5161659 5161656 +
tgaggaattatgtctgacagaagg

SEQ ID NO: 66312 - DNA, 24 bp, Artificial Sequence
  Synthetic oligonucleotide; GCAGAAT chr11 5161841 5161864 5161861 +
ggcctgaataatccctgaggagta

SEQ ID NO: 66313 - DNA, 24 bp, Artificial Sequence
  Synthetic oligonucleotide; TCAGAAA chr11 5162214 5162237 5162234 +
gagtacagctgaaggagccgggga

SEQ ID NO: 66314 - DNA, 24 bp, Artificial Sequence
  Synthetic oligonucleotide; GAAGAAA chr11 5162241 5162264 5162261 +
gaaagtatatgcatcaggtatgag

SEQ ID NO: 66315 - DNA, 24 bp, Artificial Sequence
  Synthetic oligonucleotide; TGAGAAA chr11 5162265 5162288 5162285 +
gaagaaaatagattttagaagtta

SEQ ID NO: 66316 - DNA, 24 bp, Artificial Sequence
  Synthetic oligonucleotide; ACAGAAA chr11 5162392 5162415 5162412 +
aaacagtaaggtcaagttatttgg

SEQ ID NO: 66317 - DNA, 24 bp, Artificial Sequence
  Synthetic oligonucleotide; TAAGAAT chr11 5162428 5162451 5162448 +
cagggtgcagtcctggatcttgtg

SEQ ID NO: 66318 - DNA, 24 bp, Artificial Sequence
  Synthetic oligonucleotide; TGAGAAT chr11 5162547 5162570 5162567 +
gcagggagagcacgtgtgttttta

SEQ ID NO: 66319 - DNA, 24 bp, Artificial Sequence
  Synthetic oligonucleotide; AAAGAAA chr11 5162728 5162751 5162748 +
gaatgaagggtgcaaaggaatagt

SEQ ID NO: 66320 - DNA, 24 bp, Artificial Sequence
  Synthetic oligonucleotide; ACAGAAT chr11 5162753 5162776 5162773 +
aagaaagcatgtttgagatccaga

SEQ ID NO: 66321 - DNA, 24 bp, Artificial Sequence
  Synthetic oligonucleotide; TGAGAAT chr11 5163452 5163475 5163472 +
agggtacagacttaccctccactg

SEQ ID NO: 66322 - DNA, 24 bp, Artificial Sequence
  Synthetic oligonucleotide; CCAGAAT chr11 5163937 5163960 5163957 +
gagtcctgttgtggggtttgaggt

SEQ ID NO: 66323 - DNA, 24 bp, Artificial Sequence
  Synthetic oligonucleotide; TGAGAAT chr11 5164000 5164023 5164020 +
cagattgggtaataaaatgtatat

SEQ ID NO: 66324 - DNA, 24 bp, Artificial Sequence
  Synthetic oligonucleotide; AAAGAAA chr11 5164142 5164165 5164162 +
gctctgattcgggagaggtcggat

SEQ ID NO: 66325 - DNA, 24 bp, Artificial Sequence
  Synthetic oligonucleotide; GTAGAAA chr11 5164382 5164405 5164402 +
ggaggggagacgtcagatgggtct

SEQ ID NO: 66326 - DNA, 24 bp, Artificial Sequence
  Synthetic oligonucleotide; TTAGAAA chr11 5164396 5164419 5164416 +
agatgggtctgtagaaaaggaaga

SEQ ID NO: 66327 - DNA, 24 bp, Artificial Sequence
  Synthetic oligonucleotide; AAAGAAT chr11 5164509 5164532 5164529 +
agactagggagggaccaatgtgta

SEQ ID NO: 66328 - DNA, 24 bp, Artificial Sequence
  Synthetic oligonucleotide; GAAGAAT chr11 5164577 5164600 5164597 +
tacgacaaaaattatttagatctt

SEQ ID NO: 66329 - DNA, 24 bp, Artificial Sequence
  Synthetic oligonucleotide; GAAGAAA chr11 5164659 5164682 5164679 +
gtattggagtcaagcggccttgca

SEQ ID NO: 66330 - DNA, 24 bp, Artificial Sequence
  Synthetic oligonucleotide; AGAGAAA chr11 5164788 5164811 5164808 +
gcccctagtgaaggaggcaagccc

SEQ ID NO: 66331 - DNA, 24 bp, Artificial Sequence
  Synthetic oligonucleotide; AAAGAAA chr11 5164793 5164816 5164813 +
tagtgaaggaggcaagcccagaga

SEQ ID NO: 66332 - DNA, 24 bp, Artificial Sequence
  Synthetic oligonucleotide; CCAGAAA chr11 5164842 5164865 5164862 +
aaggggttcgggggttcttactca

SEQ ID NO: 66333 - DNA, 24 bp, Artificial Sequence
  Synthetic oligonucleotide; ACAGAAA chr11 5164911 5164934 5164931 +
ggtgcagagataagaggtcagggc

SEQ ID NO: 66334 - DNA, 24 bp, Artificial Sequence
  Synthetic oligonucleotide; ACAGAAA chr11 5164953 5164976 5164973 +
ggtgcagagataagaggttggggc

SEQ ID NO: 66335 - DNA, 24 bp, Artificial Sequence
  Synthetic oligonucleotide; GCAGAAA chr11 5164995 5165018 5165015 +
ggtgcagagataagaggttggggt

SEQ ID NO: 66336 - DNA, 24 bp, Artificial Sequence
  Synthetic oligonucleotide; GCAGAAA chr11 5165037 5165060 5165057 +
ggtgcagagataagaggtcggggt

SEQ ID NO: 66337 - DNA, 24 bp, Artificial Sequence
  Synthetic oligonucleotide; ACAGAAA chr11 5165120 5165143 5165140 +
ggtgctgagataagaggttggggc

SEQ ID NO: 66338 - DNA, 24 bp, Artificial Sequence
  Synthetic oligonucleotide; CCAGAAA chr11 5165149 5165172 5165169 +
aataagggattggggttcttgccc

SEQ ID NO: 66339 - DNA, 24 bp, Artificial Sequence
  Synthetic oligonucleotide; CCAGAAA chr11 5165209 5165232 5165229 +
aggggttggggtacttacccccct

SEQ ID NO: 66340 - DNA, 24 bp, Artificial Sequence
  Synthetic oligonucleotide; GGAGAAA chr11 5165440 5165463 5165460 +
gaaaggaattgaaattaagagaag

SEQ ID NO: 66341 - DNA, 24 bp, Artificial Sequence
  Synthetic oligonucleotide; GGAGAAA chr11 5165472 5165495 5165492 +
tgaagtgtggtgccaagattgaaa

SEQ ID NO: 66342 - DNA, 24 bp, Artificial Sequence
  Synthetic oligonucleotide; GCAGAAA chr11 5166016 5166039 5166036 +
tgtggtggaatgtcatcagttaag

SEQ ID NO: 66343 - DNA, 24 bp, Artificial Sequence
  Synthetic oligonucleotide; TCAGAAA chr11 5166181 5166204 5166201 +
atttctagttttattccactgtgg

SEQ ID NO: 66344 - DNA, 24 bp, Artificial Sequence
  Synthetic oligonucleotide; AAAGAAA chr11 5166287 5166310 5166307 +
ggaaaatgttgtacatgctgcttt

SEQ ID NO: 66345 - DNA, 24 bp, Artificial Sequence
  Synthetic oligonucleotide; CAAGAAA chr11 5167024 5167047 5167044 +
gtgctgtggttaccatggggctta

SEQ ID NO: 66346 - DNA, 24 bp, Artificial Sequence
  Synthetic oligonucleotide; TTAGAAT chr11 5167736 5167759 5167756 +
actctactatatctaggactacac

SEQ ID NO: 66347 - DNA, 24 bp, Artificial Sequence
  Synthetic oligonucleotide; TAAGAAA chr11 5167815 5167838 5167835 +
aaaagtatttatttattgtaagca

SEQ ID NO: 66348 - DNA, 24 bp, Artificial Sequence
  Synthetic oligonucleotide; AGAGAAT chr11 5167878 5167901 5167898 +
aaaagtgttggttgaggaagtaga

SEQ ID NO: 66349 - DNA, 24 bp, Artificial Sequence
  Synthetic oligonucleotide; TGAGAAA chr11 5167939 5167962 5167959 +
aggccccttttataaagatcctct

SEQ ID NO: 66350 - DNA, 24 bp, Artificial Sequence
  Synthetic oligonucleotide; GGAGAAA chr11 5168023 5168046 5168043 +
aattttgtcctcatgaatctcaaa

SEQ ID NO: 66351 - DNA, 24 bp, Artificial Sequence
  Synthetic oligonucleotide; ACAGAAT chr11 5168037 5168060 5168057 +
gaatctcaaaggagaaaatggttt

SEQ ID NO: 66352 - DNA, 24 bp, Artificial Sequence
  Synthetic oligonucleotide; AAAGAAT chr11 5168123 5168146 5168143 +
ggaccactgataatatggtgggct

SEQ ID NO: 66353 - DNA, 24 bp, Artificial Sequence
  Synthetic oligonucleotide; AGAGAAA chr11 5168340 5168363 5168360 +
gtatggtacactatagctcgtgac

SEQ ID NO: 66354 - DNA, 24 bp, Artificial Sequence
  Synthetic oligonucleotide; TAAGAAT chr11 5168798 5168821 5168818 +
ctcttagttttttcatgtatacca

SEQ ID NO: 66355 - DNA, 24 bp, Artificial Sequence
  Synthetic oligonucleotide; TGAGAAT chr11 5168878 5168901 5168898 +
ggcttctaaattactctgaaattt

SEQ ID NO: 66356 - DNA, 24 bp, Artificial Sequence
  Synthetic oligonucleotide; ACAGAAA chr11 5168992 5169015 5169012 +
gtccataaattaatttcgaggaaa

SEQ ID NO: 66357 - DNA, 24 bp, Artificial Sequence
  Synthetic oligonucleotide; GAAGAAA chr11 5169144 5169167 5169164 +
gttcatggaaattcaaaattatct

SEQ ID NO: 66358 - DNA, 24 bp, Artificial Sequence
  Synthetic oligonucleotide; CTAGAAT chr11 5169191 5169214 5169211 +
tgcaatccctgtctgagggatttt

SEQ ID NO: 66359 - DNA, 24 bp, Artificial Sequence
  Synthetic oligonucleotide; TAAGAAT chr11 5169492 5169515 5169512 +
ttagcacactgagtataatttttt

SEQ ID NO: 66360 - DNA, 24 bp, Artificial Sequence
  Synthetic oligonucleotide; ACAGAAA chr11 5169508 5169531 5169528 +
aatttttttaagaatctttttatt

SEQ ID NO: 66361 - DNA, 24 bp, Artificial Sequence
  Synthetic oligonucleotide; ACAGAAT chr11 5169535 5169558 5169555 +
gaaattgtaaactacacaaagtaa

SEQ ID NO: 66362 - DNA, 24 bp, Artificial Sequence
  Synthetic oligonucleotide; CTAGAAA chr11 5169716 5169739 5169736 +
agttttgatgtaaaattgatgtac

SEQ ID NO: 66363 - DNA, 24 bp, Artificial Sequence
  Synthetic oligonucleotide; CCAGAAA chr11 5169807 5169830 5169827 +
acacaacaaaatatttccatctcc

SEQ ID NO: 66364 - DNA, 24 bp, Artificial Sequence
  Synthetic oligonucleotide; CCAGAAA chr11 5169997 5170020 5170017 +
tatgtatcactaattttaatataa

SEQ ID NO: 66365 - DNA, 24 bp, Artificial Sequence
  Synthetic oligonucleotide; GAAGAAT chr11 5170605 5170628 5170625 +
cagaagctatttccagtactgtat

SEQ ID NO: 66366 - DNA, 24 bp, Artificial Sequence
  Synthetic oligonucleotide; TAAGAAA chr11 5170619 5170642 5170639 +
agtactgtatgaagaatcagcaca

SEQ ID NO: 66367 - DNA, 24 bp, Artificial Sequence
  Synthetic oligonucleotide; ACAGAAA chr11 5170765 5170788 5170785 +
agagtgtgtgagggtattgtggcc

SEQ ID NO: 66368 - DNA, 24 bp, Artificial Sequence
  Synthetic oligonucleotide; GGAGAAA chr11 5170785 5170808 5170805 +
ggccacagaaaggcagacgcctca

SEQ ID NO: 66369 - DNA, 24 bp, Artificial Sequence
  Synthetic oligonucleotide; CCAGAAA chr11 5170844 5170867 5170864 +
cgcaaggcaatggcggcacccgtc

SEQ ID NO: 66370 - DNA, 24 bp, Artificial Sequence
  Synthetic oligonucleotide; TCAGAAT chr11 5170863 5170886 5170883 +
ccgtcccagaaatgcaggcaattg

SEQ ID NO: 66371 - DNA, 24 bp, Artificial Sequence
  Synthetic oligonucleotide; ATAGAAA chr11 5170961 5170984 5170981 +
gactccataagagtgaaagagtgc

SEQ ID NO: 66372 - DNA, 24 bp, Artificial Sequence
  Synthetic oligonucleotide; CCAGAAA chr11 5171082 5171105 5171102 +
caagttcaacaaaggccggcatgg

SEQ ID NO: 66373 - DNA, 24 bp, Artificial Sequence
  Synthetic oligonucleotide; GAAGAAT chr11 5171133 5171156 5171153 +
aggaagagtcaattcggatgatgt

SEQ ID NO: 66374 - DNA, 24 bp, Artificial Sequence
  Synthetic oligonucleotide; TCAGAAA chr11 5171394 5171417 5171414 +
aacagtcatatctaagacatttcc

SEQ ID NO: 66375 - DNA, 24 bp, Artificial Sequence
  Synthetic oligonucleotide; AGAGAAA chr11 5171457 5171480 5171477 +
cacaggtaagccacagtgagtgga

SEQ ID NO: 66376 - DNA, 24 bp, Artificial Sequence
  Synthetic oligonucleotide; GCAGAAA chr11 5171477 5171500 5171497 +
tggaagagaaacctaatgggtcat

SEQ ID NO: 66377 - DNA, 24 bp, Artificial Sequence
  Synthetic oligonucleotide; ATAGAAA chr11 5171522 5171545 5171542 +
gcctatatgccagataaggcatta

SEQ ID NO: 66378 - DNA, 24 bp, Artificial Sequence
  Synthetic oligonucleotide; GAAGAAA chr11 5171609 5171632 5171629 +
cagattcacatggaaattatgact

SEQ ID NO: 66379 - DNA, 24 bp, Artificial Sequence
  Synthetic oligonucleotide; ATAGAAT chr11 5171856 5171879 5171876 +
tggaatatagtaaatattaaatgt

SEQ ID NO: 66380 - DNA, 24 bp, Artificial Sequence
  Synthetic oligonucleotide; CTAGAAT chr11 5171906 5171929 5171926 +
attagaacacaaggatagtttctc

SEQ ID NO: 66381 - DNA, 24 bp, Artificial Sequence
  Synthetic oligonucleotide; TTAGAAA chr11 5171977 5172000 5171997 +
ctttctccacctgctatccataga

SEQ ID NO: 66382 - DNA, 24 bp, Artificial Sequence
  Synthetic oligonucleotide; CCAGAAA chr11 5172183 5172206 5172203 +
agccttaggtattaacgttggagg

SEQ ID NO: 66383 - DNA, 24 bp, Artificial Sequence
  Synthetic oligonucleotide; TCAGAAA chr11 5172208 5172231 5172228 +
cagaaatggaattcaggatggggc

SEQ ID NO: 66384 - DNA, 24 bp, Artificial Sequence
  Synthetic oligonucleotide; TAAGAAT chr11 5172215 5172238 5172235 +
ggaattcaggatggggctcagaaa

SEQ ID NO: 66385 - DNA, 24 bp, Artificial Sequence
  Synthetic oligonucleotide; ACAGAAT chr11 5172631 5172654 5172651 +
cttagttgactggaggacatagag

SEQ ID NO: 66386 - DNA, 24 bp, Artificial Sequence
  Synthetic oligonucleotide; CAAGAAT chr11 5172667 5172690 5172687 +
agtatccctcaagaagcaattaac

SEQ ID NO: 66387 - DNA, 24 bp, Artificial Sequence
  Synthetic oligonucleotide; CCAGAAA chr11 5172682 5172705 5172702 +
gcaattaaccaagaataattattc

SEQ ID NO: 66388 - DNA, 24 bp, Artificial Sequence
  Synthetic oligonucleotide; AGAGAAA chr11 5172704 5172727 5172724 +
tcccagaaacttcgggtgtattag

SEQ ID NO: 66389 - DNA, 24 bp, Artificial Sequence
  Synthetic oligonucleotide; TTAGAAT chr11 5173165 5173188 5173185 +
aatttgtttgggggacttgggtaa

SEQ ID NO: 66390 - DNA, 24 bp, Artificial Sequence
  Synthetic oligonucleotide; TAAGAAA chr11 5173650 5173673 5173670 +
aaaagttcatgcaacaaacgactt

SEQ ID NO: 66391 - DNA, 24 bp, Artificial Sequence
  Synthetic oligonucleotide; CCAGAAT chr11 5173722 5173745 5173742 +
ttatgtatttcataagtttaatat

SEQ ID NO: 66392 - DNA, 24 bp, Artificial Sequence
  Synthetic oligonucleotide; CTAGAAA chr11 5173811 5173834 5173831 +
gcaaatgatgggaatgagtaattt

SEQ ID NO: 66393 - DNA, 24 bp, Artificial Sequence
  Synthetic oligonucleotide; CTAGAAT chr11 5173889 5173912 5173909 +
caataagacactacttcaaactta

SEQ ID NO: 66394 - DNA, 24 bp, Artificial Sequence
  Synthetic oligonucleotide; AGAGAAA chr11 5173908 5173931 5173928 +
acttactagaatgtctatacttta

SEQ ID NO: 66395 - DNA, 24 bp, Artificial Sequence
  Synthetic oligonucleotide; TAAGAAA chr11 5173952 5173975 5173972 +
aagtaacaagtgttgacaaagata

SEQ ID NO: 66396 - DNA, 24 bp, Artificial Sequence
  Synthetic oligonucleotide; GTAGAAA chr11 5174009 5174032 5174029 +
aaaatgttaagtggtgcaacttct

SEQ ID NO: 66397 - DNA, 24 bp, Artificial Sequence
  Synthetic oligonucleotide; CCAGAAT chr11 5174176 5174199 5174196 +
acaatagccaaaaggtggaaacaa

SEQ ID NO: 66398 - DNA, 24 bp, Artificial Sequence
  Synthetic oligonucleotide; AAAGAAT chr11 5174252 5174275 5174272 +
aatggaatattatgtagcaataaa

SEQ ID NO: 66399 - DNA, 24 bp, Artificial Sequence
  Synthetic oligonucleotide; TGAGAAA chr11 5174380 5174403 5174400 +
actgttttagccaacactgttaga

SEQ ID NO: 66400 - DNA, 24 bp, Artificial Sequence
  Synthetic oligonucleotide; CAAGAAT chr11 5174433 5174456 5174453 +
cacttggcttaaagtttcagtttc

SEQ ID NO: 66401 - DNA, 24 bp, Artificial Sequence
  Synthetic oligonucleotide; AGAGAAA chr11 5174593 5174616 5174613 +
gaattatctaaaatagactgattt

SEQ ID NO: 66402 - DNA, 24 bp, Artificial Sequence
  Synthetic oligonucleotide; AAAGAAA chr11 5174838 5174861 5174858 +
taaactttatcacaataaaaatgg

SEQ ID NO: 66403 - DNA, 24 bp, Artificial Sequence
  Synthetic oligonucleotide; AGAGAAT chr11 5174909 5174932 5174929 +
tgaatttattatgagttgtttctg

SEQ ID NO: 66404 - DNA, 24 bp, Artificial Sequence
  Synthetic oligonucleotide; CCAGAAT chr11 5175118 5175141 5175138 +
ctcggctcactgcaacctccgcct

SEQ ID NO: 66405 - DNA, 24 bp, Artificial Sequence
  Synthetic oligonucleotide; AAAGAAA chr11 5175342 5175365 5175362 +
acttaaatgatcatatcatataca

SEQ ID NO: 66406 - DNA, 24 bp, Artificial Sequence
  Synthetic oligonucleotide; AAAGAAA chr11 5175377 5175400 5175397 +
aaaaataaaggcaaagatgtaaat

SEQ ID NO: 66407 - DNA, 24 bp, Artificial Sequence
  Synthetic oligonucleotide; TCAGAAT chr11 5175916 5175939 5175936 +
gcaacagccatttcctaaatcctt

SEQ ID NO: 66408 - DNA, 24 bp, Artificial Sequence
  Synthetic oligonucleotide; GGAGAAA chr11 5176227 5176250 5176247 +
tttccatcatattattacttttat

SEQ ID NO: 66409 - DNA, 24 bp, Artificial Sequence
  Synthetic oligonucleotide; TTAGAAT chr11 5176259 5176282 5176279 +
gcaacgctgagtgtaaatttcaca

SEQ ID NO: 66410 - DNA, 24 bp, Artificial Sequence
  Synthetic oligonucleotide; GTAGAAA chr11 5176285 5176308 5176305 +
agaatgtccaaaacattgtgtaga

SEQ ID NO: 66411 - DNA, 24 bp, Artificial Sequence
  Synthetic oligonucleotide; TGAGAAA chr11 5176322 5176345 5176342 +
ctatatgaagtttaacagatgtac

SEQ ID NO: 66412 - DNA, 24 bp, Artificial Sequence
  Synthetic oligonucleotide; GCAGAAA chr11 5176384 5176407 5176404 +
acttaaatatttagtgtagtacta

SEQ ID NO: 66413 - DNA, 24 bp, Artificial Sequence
  Synthetic oligonucleotide; TTAGAAT chr11 5176408 5176431 5176428 +
gcagaaacaaattaattagatttt

SEQ ID NO: 66414 - DNA, 24 bp, Artificial Sequence
  Synthetic oligonucleotide; ACAGAAA chr11 5176650 5176673 5176670 +
catgtataaatttctataaaaatc

SEQ ID NO: 66415 - DNA, 24 bp, Artificial Sequence
  Synthetic oligonucleotide; ATAGAAA chr11 5176988 5177011 5177008 +
taaaaatttatttatcacccaggt

SEQ ID NO: 66416 - DNA, 24 bp, Artificial Sequence
  Synthetic oligonucleotide; TTAGAAA chr11 5177238 5177261 5177258 +
gagactttgtgagatgtcagtgag

SEQ ID NO: 66417 - DNA, 24 bp, Artificial Sequence
  Synthetic oligonucleotide; GCAGAAT chr11 5177360 5177383 5177380 +
acagcgggagtgttgtacatttca

SEQ ID NO: 66418 - DNA, 24 bp, Artificial Sequence
  Synthetic oligonucleotide; GGAGAAT chr11 5177532 5177555 5177552 +
tgaaaatagtatttctgaaaaaat

SEQ ID NO: 66419 - DNA, 24 bp, Artificial Sequence
  Synthetic oligonucleotide; AGAGAAA chr11 5177711 5177734 5177731 +
atcttaacagcatacactgatagg

SEQ ID NO: 66420 - DNA, 24 bp, Artificial Sequence
  Synthetic oligonucleotide; CAAGAAA chr11 5177857 5177880 5177877 +
tggttttacctccaaagcgatggg

SEQ ID NO: 66421 - DNA, 24 bp, Artificial Sequence
  Synthetic oligonucleotide; AAAGAAT chr11 5177867 5177890 5177887 +
tccaaagcgatgggcaagaaatga

SEQ ID NO: 66422 - DNA, 24 bp, Artificial Sequence
  Synthetic oligonucleotide; GGAGAAT chr11 5178283 5178306 5178303 +
catagcggtcaaatgccattgcca

SEQ ID NO: 66423 - DNA, 24 bp, Artificial Sequence
  Synthetic oligonucleotide; AAAGAAA chr11 5178531 5178554 5178551 +
cctgcaacagccacaatgtacata

SEQ ID NO: 66424 - DNA, 24 bp, Artificial Sequence
  Synthetic oligonucleotide; AAAGAAA chr11 5178626 5178649 5178646 +
atcctgggaattagtgtgattgcg

SEQ ID NO: 66425 - DNA, 24 bp, Artificial Sequence
  Synthetic oligonucleotide; TTAGAAA chr11 5178697 5178720 5178717 +
gtgaaagactacaaagttgaggat

SEQ ID NO: 66426 - DNA, 24 bp, Artificial Sequence
  Synthetic oligonucleotide; ACAGAAA chr11 5179182 5179205 5179202 +
ttatgaaatttagttgtgctgctt

SEQ ID NO: 66427 - DNA, 24 bp, Artificial Sequence
  Synthetic oligonucleotide; GGAGAAT chr11 5179606 5179629 5179626 +
ccagctactcaagaggctgaggca

SEQ ID NO: 66428 - DNA, 24 bp, Artificial Sequence
  Synthetic oligonucleotide; AAAGAAT chr11 5179729 5179752 5179749 +
aaaagtatatgcctcataggtggt

SEQ ID NO: 66429 - DNA, 24 bp, Artificial Sequence
  Synthetic oligonucleotide; TGAGAAT chr11 5180035 5180058 5180055 +
cattgttcaactcccacctatgag

SEQ ID NO: 66430 - DNA, 24 bp, Artificial Sequence
  Synthetic oligonucleotide; TCAGAAT chr11 5180079 5180102 5180099 +
tttttcgtccttgcgatactttgc

SEQ ID NO: 66431 - DNA, 24 bp, Artificial Sequence
  Synthetic oligonucleotide; GAAGAAA chr11 5181333 5181356 5181353 +
taaagtagttttttccaattctgt

SEQ ID NO: 66432 - DNA, 24 bp, Artificial Sequence
  Synthetic oligonucleotide; GTAGAAT chr11 5182401 5182424 5182421 +
taccagctcctccttgtacctctg

SEQ ID NO: 66433 - DNA, 24 bp, Artificial Sequence
  Synthetic oligonucleotide; GGAGAAA chr11 5182466 5182489 5182486 +
tggttggtaagcttcataagtgaa

SEQ ID NO: 66434 - DNA, 24 bp, Artificial Sequence
  Synthetic oligonucleotide; AAAGAAA chr11 5182559 5182582 5182579 +
tcctgaaggaagcagtaaacatgg

SEQ ID NO: 66435 - DNA, 24 bp, Artificial Sequence
  Synthetic oligonucleotide; GGAGAAA chr11 5182622 5182645 5182642 +
aattgtaaagaccatcaaggctag

SEQ ID NO: 66436 - DNA, 24 bp, Artificial Sequence
  Synthetic oligonucleotide; ACAGAAA chr11 5183143 5183166 5183163 +
gtcaacattagacagatcaacgag

SEQ ID NO: 66437 - DNA, 24 bp, Artificial Sequence
  Synthetic oligonucleotide; ATAGAAT chr11 5183234 5183257 5183254 +
tacagaactctccatcccaaatca

SEQ ID NO: 66438 - DNA, 24 bp, Artificial Sequence
  Synthetic oligonucleotide; ACAGAAA chr11 5183325 5183348 5183345 +
gcactcctcagcaaacgtaaaaga

SEQ ID NO: 66439 - DNA, 24 bp, Artificial Sequence
  Synthetic oligonucleotide; TAAGAAA chr11 5183384 5183407 5183404 +
tgcaatcaaactagaactcaggat

SEQ ID NO: 66440 - DNA, 24 bp, Artificial Sequence
  Synthetic oligonucleotide; GCAGAAA chr11 5183469 5183492 5183489 +
tactgggtacataacaaaatgaag

SEQ ID NO: 66441 - DNA, 24 bp, Artificial Sequence
  Synthetic oligonucleotide; CGAGAAT chr11 5183498 5183521 5183518 +
aataaagatgttctttgaaaccaa

SEQ ID NO: 66442 - DNA, 24 bp, Artificial Sequence
  Synthetic oligonucleotide; ACAGAAT chr11 5183519 5183542 5183539 +
caacgagaataaagatacaacaaa

SEQ ID NO: 66443 - DNA, 24 bp, Artificial Sequence
  Synthetic oligonucleotide; AAAGAAA chr11 5183584 5183607 5183604 +
aatttatagcactaaatgcccaca

SEQ ID NO: 66444 - DNA, 24 bp, Artificial Sequence
  Synthetic oligonucleotide; CAAGAAA chr11 5183679 5183702 5183699 +
acactttcaaaagctagcggaagg

SEQ ID NO: 66445 - DNA, 24 bp, Artificial Sequence
  Synthetic oligonucleotide; GAAGAAA chr11 5183813 5183836 5183833 +
tagactgctagcaagactaataaa

SEQ ID NO: 66446 - DNA, 24 bp, Artificial Sequence
  Synthetic oligonucleotide; TAAGAAA chr11 5183845 5183868 5183865 +
gagagaagactcaaatagatgcaa

SEQ ID NO: 66447 - DNA, 24 bp, Artificial Sequence
  Synthetic oligonucleotide; AGAGAAT chr11 5183901 5183924 5183921 +
cccacagacatacaaactaccatc

SEQ ID NO: 66448 - DNA, 24 bp, Artificial Sequence
  Synthetic oligonucleotide; CTAGAAA chr11 5183934 5183957 5183954 +
tataaacacctctacgcaaataaa

SEQ ID NO: 66449 - DNA, 24 bp, Artificial Sequence
  Synthetic oligonucleotide; GTAGAAA chr11 5183946 5183969 5183966 +
tacgcaaataaactagaaaatcta

SEQ ID NO: 66450 - DNA, 24 bp, Artificial Sequence
  Synthetic oligonucleotide; GGAGAAA chr11 5183997 5184020 5184017 +
tacaccctcccaagactaaaccag

SEQ ID NO: 66451 - DNA, 24 bp, Artificial Sequence
  Synthetic oligonucleotide; CTAGAAA chr11 5184307 5184330 5184327 +
ctagctagctagctagctagctag

SEQ ID NO: 66452 - DNA, 24 bp, Artificial Sequence
  Synthetic oligonucleotide; TAAGAAA chr11 5184484 5184507 5184504 +
gttttttgaggtggcacaggggct

SEQ ID NO: 66453 - DNA, 24 bp, Artificial Sequence
  Synthetic oligonucleotide; TTAGAAT chr11 5184650 5184673 5184670 +
gggtcccattttttgagttacagt

SEQ ID NO: 66454 - DNA, 24 bp, Artificial Sequence
  Synthetic oligonucleotide; TTAGAAT chr11 5184813 5184836 5184833 +
ctatttaatatatatctcacattg

SEQ ID NO: 66455 - DNA, 24 bp, Artificial Sequence
  Synthetic oligonucleotide; AGAGAAA chr11 5184845 5184868 5184865 +
ttttaagtaaactgttgatgtttc

SEQ ID NO: 66456 - DNA, 24 bp, Artificial Sequence
  Synthetic oligonucleotide; AAAGAAT chr11 5184854 5184877 5184874 +
aactgttgatgtttcagagaaagg

SEQ ID NO: 66457 - DNA, 24 bp, Artificial Sequence
  Synthetic oligonucleotide; GAAGAAT chr11 5184978 5185001 5184998 +
catcaggacattagggatgggaga

SEQ ID NO: 66458 - DNA, 24 bp, Artificial Sequence
  Synthetic oligonucleotide; AAAGAAA chr11 5185023 5185046 5185043 +
aatacaggaatgaagataaggggg

SEQ ID NO: 66459 - DNA, 24 bp, Artificial Sequence
  Synthetic oligonucleotide; ATAGAAA chr11 5185246 5185269 5185266 +
acggagcaaagatagtgtggtgta

SEQ ID NO: 66460 - DNA, 24 bp, Artificial Sequence
  Synthetic oligonucleotide; CTAGAAT chr11 5185941 5185964 5185961 +
tattactgagccttgttttaacta

SEQ ID NO: 66461 - DNA, 24 bp, Artificial Sequence
  Synthetic oligonucleotide; AAAGAAA chr11 5185991 5186014 5186011 +
gtacaacattcaaatctgcatatc

SEQ ID NO: 66462 - DNA, 24 bp, Artificial Sequence
  Synthetic oligonucleotide; AGAGAAA chr11 5186023 5186046 5186043 +
tgagcattatttaaacatattcta

SEQ ID NO: 66463 - DNA, 24 bp, Artificial Sequence
  Synthetic oligonucleotide; GAAGAAT chr11 5186171 5186194 5186191 +
aaatgttagatgattaagttatcg

SEQ ID NO: 66464 - DNA, 24 bp, Artificial Sequence
  Synthetic oligonucleotide; CTAGAAT chr11 5186271 5186294 5186291 +
actcagtttacttacttgcatttt

SEQ ID NO: 66465 - DNA, 24 bp, Artificial Sequence
  Synthetic oligonucleotide; GGAGAAA chr11 5186460 5186483 5186480 +
ctgcttctggtacatagtccacag

SEQ ID NO: 66466 - DNA, 24 bp, Artificial Sequence
  Synthetic oligonucleotide; TCAGAAT chr11 5186750 5186773 5186770 +
tttcttggtcacatggtaaatggg

SEQ ID NO: 66467 - DNA, 24 bp, Artificial Sequence
  Synthetic oligonucleotide; CAAGAAA chr11 5186766 5186789 5186786 +
taaatgggtcagaatctgaagggc

SEQ ID NO: 66468 - DNA, 24 bp, Artificial Sequence
  Synthetic oligonucleotide; ATAGAAA chr11 5186846 5186869 5186866 +
aggaatacagatgaagataaaaag

SEQ ID NO: 66469 - DNA, 24 bp, Artificial Sequence
  Synthetic oligonucleotide; AAAGAAT chr11 5186980 5187003 5187000 +
atctgtgattttctgatatttttc

SEQ ID NO: 66470 - DNA, 24 bp, Artificial Sequence
  Synthetic oligonucleotide; TAAGAAT chr11 5187214 5187237 5187234 +
gtgagtgctatatggtgggagata

SEQ ID NO: 66471 - DNA, 24 bp, Artificial Sequence
  Synthetic oligonucleotide; AAAGAAA chr11 5187312 5187335 5187332 +
cttcaccttgcttttttagacatt

SEQ ID NO: 66472 - DNA, 24 bp, Artificial Sequence
  Synthetic oligonucleotide; AAAGAAA chr11 5187351 5187374 5187371 +
cttatcttcccacctatccttgga

SEQ ID NO: 66473 - DNA, 24 bp, Artificial Sequence
  Synthetic oligonucleotide; ATAGAAA chr11 5187379 5187402 5187399 +
aaattaaaggaatcaaaggatatt

SEQ ID NO: 66474 - DNA, 24 bp, Artificial Sequence
  Synthetic oligonucleotide; GGAGAAA chr11 5187393 5187416 5187413 +
aaaggatattatagaaaaagagat

SEQ ID NO: 66475 - DNA, 24 bp, Artificial Sequence
  Synthetic oligonucleotide; GGAGAAT chr11 5187406 5187429 5187426 +
gaaaaagagatggagaaaggacaa

SEQ ID NO: 66476 - DNA, 24 bp, Artificial Sequence
  Synthetic oligonucleotide; ACAGAAA chr11 5187423 5187446 5187443 +
aggacaaggagaatttaggggaca

SEQ ID NO: 66477 - DNA, 24 bp, Artificial Sequence
  Synthetic oligonucleotide; AAAGAAT chr11 5187471 5187494 5187491 +
ctacctgatagtgacaggaagaac

SEQ ID NO: 66478 - DNA, 24 bp, Artificial Sequence
  Synthetic oligonucleotide; ATAGAAT chr11 5187476 5187499 5187496 +
tgatagtgacaggaagaacaaaga

SEQ ID NO: 66479 - DNA, 24 bp, Artificial Sequence
  Synthetic oligonucleotide; GAAGAAT chr11 5187546 5187569 5187566 +
ttaaatctggggactctaaaactt

SEQ ID NO: 66480 - DNA, 24 bp, Artificial Sequence
  Synthetic oligonucleotide; TTAGAAA chr11 5187775 5187798 5187795 +
tctacagtctttgagccacatgct

SEQ ID NO: 66481 - DNA, 24 bp, Artificial Sequence
  Synthetic oligonucleotide; GTAGAAT chr11 5187931 5187954 5187951 +
ttgcagggaacatgtaagtattat

SEQ ID NO: 66482 - DNA, 24 bp, Artificial Sequence
  Synthetic oligonucleotide; TCAGAAA chr11 5187974 5187997 5187994 +
taaaaattctcacataagttcatg

SEQ ID NO: 66483 - DNA, 24 bp, Artificial Sequence
  Synthetic oligonucleotide; CAAGAAA chr11 5188318 5188341 5188338 +
tatgggacttgagtggaggaaatc

SEQ ID NO: 66484 - DNA, 24 bp, Artificial Sequence
  Synthetic oligonucleotide; AAAGAAT chr11 5188323 5188346 5188343 +
gacttgagtggaggaaatccaaga

SEQ ID NO: 66485 - DNA, 24 bp, Artificial Sequence
  Synthetic oligonucleotide; CCAGAAA chr11 5188443 5188466 5188463 +
tgctagtaaagctgggagttggtg

SEQ ID NO: 66486 - DNA, 24 bp, Artificial Sequence
  Synthetic oligonucleotide; ACAGAAA chr11 5188455 5188478 5188475 +
tgggagttggtgccagaaaagaga

SEQ ID NO: 66487 - DNA, 24 bp, Artificial Sequence
  Synthetic oligonucleotide; GAAGAAT chr11 5188776 5188799 5188796 +
caaagatttttcccctgccacatt

SEQ ID NO: 66488 - DNA, 24 bp, Artificial Sequence
  Synthetic oligonucleotide; GAAGAAT chr11 5188853 5188876 5188873 +
actttagagatgatctttatctgg

SEQ ID NO: 66489 - DNA, 24 bp, Artificial Sequence
  Synthetic oligonucleotide; AAAGAAA chr11 5189041 5189064 5189061 +
gaagccaatacgactgcttgtatt

SEQ ID NO: 66490 - DNA, 24 bp, Artificial Sequence
  Synthetic oligonucleotide; TGAGAAT chr11 5189523 5189546 5189543 +
ctcaggtatttccttatagcaaga

SEQ ID NO: 66491 - DNA, 24 bp, Artificial Sequence
  Synthetic oligonucleotide; ACAGAAA chr11 5189538 5189561 5189558 +
atagcaagatgagaatggaccagt

SEQ ID NO: 66492 - DNA, 24 bp, Artificial Sequence
  Synthetic oligonucleotide; GGAGAAT chr11 5189667 5189690 5189687 +
ctcagaagaagacagggagatgag

SEQ ID NO: 66493 - DNA, 24 bp, Artificial Sequence
  Synthetic oligonucleotide; AGAGAAT chr11 5189848 5189871 5189868 +
ttgactgcactgtgcctctacctt

SEQ ID NO: 66494 - DNA, 24 bp, Artificial Sequence
  Synthetic oligonucleotide; AAAGAAA chr11 5189972 5189995 5189992 +
caacctatgctcatatgtgtgagc

SEQ ID NO: 66495 - DNA, 24 bp, Artificial Sequence
  Synthetic oligonucleotide; GTAGAAA chr11 5190055 5190078 5190075 +
gaaaattatctgctcggccatgtg

SEQ ID NO: 66496 - DNA, 24 bp, Artificial Sequence
  Synthetic oligonucleotide; GTAGAAA chr11 5190100 5190123 5190120 +
tcaaaggagcaattcaagcaggct

SEQ ID NO: 66497 - DNA, 24 bp, Artificial Sequence
  Synthetic oligonucleotide; GGAGAAT chr11 5190153 5190176 5190173 +
gagttctaatagccaaaataaagg

SEQ ID NO: 66498 - DNA, 24 bp, Artificial Sequence
  Synthetic oligonucleotide; GTAGAAA chr11 5190471 5190494 5190491 +
ctccacctagatttcagaggatgt

SEQ ID NO: 66499 - DNA, 24 bp, Artificial Sequence
  Synthetic oligonucleotide; TGAGAAA chr11 5190615 5190638 5190635 +
ctggggcactgcctagcagagcta

SEQ ID NO: 66500 - DNA, 24 bp, Artificial Sequence
  Synthetic oligonucleotide; CCAGAAT chr11 5190643 5190666 5190663 +
aaaagggccaccgtcctccagacc

SEQ ID NO: 66501 - DNA, 24 bp, Artificial Sequence
  Synthetic oligonucleotide; CTAGAAA chr11 5190681 5190704 5190701 +
ccactgacagtttgcaccgtgcac

SEQ ID NO: 66502 - DNA, 24 bp, Artificial Sequence
  Synthetic oligonucleotide; GAAGAAA chr11 5190879 5190902 5190899 +
tatttgtccgttttaaactgctat

SEQ ID NO: 66503 - DNA, 24 bp, Artificial Sequence
  Synthetic oligonucleotide; AAAGAAA chr11 5190908 5190931 5190928 +
aatacccgagactgggtaatttat

SEQ ID NO: 66504 - DNA, 24 bp, Artificial Sequence
  Synthetic oligonucleotide; GAAGAAA chr11 5191179 5191202 5191199 +
gggattatgggacctactattcaa

SEQ ID NO: 66505 - DNA, 24 bp, Artificial Sequence
  Synthetic oligonucleotide; AAAGAAT chr11 5192226 5192249 5192246 +
gcaatagctgtctgaaactaagtc

SEQ ID NO: 66506 - DNA, 24 bp, Artificial Sequence
  Synthetic oligonucleotide; AGAGAAT chr11 5192376 5192399 5192396 +
aaataggttaatggagtaatatgt

SEQ ID NO: 66507 - DNA, 24 bp, Artificial Sequence
  Synthetic oligonucleotide; AAAGAAA chr11 5192396 5192419 5192416 +
atgtagagaatgatgactataatt

SEQ ID NO: 66508 - DNA, 24 bp, Artificial Sequence
  Synthetic oligonucleotide; TAAGAAA chr11 5192667 5192690 5192687 +
ggtcacatgaaaagactagttttg

SEQ ID NO: 66509 - DNA, 24 bp, Artificial Sequence
  Synthetic oligonucleotide; GTAGAAT chr11 5192966 5192989 5192986 +
caattggattgtttgttttttatt

SEQ ID NO: 66510 - DNA, 24 bp, Artificial Sequence
  Synthetic oligonucleotide; TCAGAAA chr11 5193151 5193174 5193171 +
atttcaactgctgtgttcttttgt

SEQ ID NO: 66511 - DNA, 24 bp, Artificial Sequence
  Synthetic oligonucleotide; TAAGAAT chr11 5193450 5193473 5193470 +
atctaaaatgagtggttatttaat

SEQ ID NO: 66512 - DNA, 24 bp, Artificial Sequence
  Synthetic oligonucleotide; AAAGAAT chr11 5193648 5193671 5193668 +
gtgggttcttggtctcgctgactt

SEQ ID NO: 66513 - DNA, 24 bp, Artificial Sequence
  Synthetic oligonucleotide; GAAGAAT chr11 5194005 5194028 5194025 +
gtgagcagcagtaagatttattgt

SEQ ID NO: 66514 - DNA, 24 bp, Artificial Sequence
  Synthetic oligonucleotide; AAAGAAT chr11 5194420 5194443 5194440 +
gttccatatttcatggtgaggaac

SEQ ID NO: 66515 - DNA, 24 bp, Artificial Sequence
  Synthetic oligonucleotide; TAAGAAA chr11 5194589 5194612 5194609 +
atgtccaacaatgatagactggat

SEQ ID NO: 66516 - DNA, 24 bp, Artificial Sequence
  Synthetic oligonucleotide; TCAGAAA chr11 5195056 5195079 5195076 +
ctggccagttactttgaaggctga

SEQ ID NO: 66517 - DNA, 24 bp, Artificial Sequence
  Synthetic oligonucleotide; AGAGAAA chr11 5195280 5195303 5195300 +
cactaatcattttgccagaactaa

SEQ ID NO: 66518 - DNA, 24 bp, Artificial Sequence
  Synthetic oligonucleotide; CCAGAAA chr11 5195392 5195415 5195412 +
tttataagtaatttctgtgttttt

SEQ ID NO: 66519 - DNA, 24 bp, Artificial Sequence
  Synthetic oligonucleotide; AGAGAAA chr11 5195582 5195605 5195602 +
gtacatctatagctttagtggatt

SEQ ID NO: 66520 - DNA, 24 bp, Artificial Sequence
  Synthetic oligonucleotide; GCAGAAA chr11 5195592 5195615 5195612 +
agctttagtggattagagaaagta

SEQ ID NO: 66521 - DNA, 24 bp, Artificial Sequence
  Synthetic oligonucleotide; ACAGAAA chr11 5195682 5195705 5195702 +
taaatttatattttattattcagt

SEQ ID NO: 66522 - DNA, 24 bp, Artificial Sequence
  Synthetic oligonucleotide; CAAGAAA chr11 5195760 5195783 5195780 +
aaagcttttaacaaacactcagac

SEQ ID NO: 66523 - DNA, 24 bp, Artificial Sequence
  Synthetic oligonucleotide; GCAGAAA chr11 5195879 5195902 5195899 +
ttacatggtgccaagactgcaggg

SEQ ID NO: 66524 - DNA, 24 bp, Artificial Sequence
  Synthetic oligonucleotide; TGAGAAT chr11 5196340 5196363 5196360 +
agggatctaggttgcggcttctta

SEQ ID NO: 66525 - DNA, 24 bp, Artificial Sequence
  Synthetic oligonucleotide; TAAGAAT chr11 5196548 5196571 5196568 +
tcctgaatcatgtcctctcacttc

SEQ ID NO: 66526 - DNA, 24 bp, Artificial Sequence
  Synthetic oligonucleotide; GAAGAAT chr11 5197634 5197657 5197654 +
gtggaaaacatattgtcagttgtt

SEQ ID NO: 66527 - DNA, 24 bp, Artificial Sequence
  Synthetic oligonucleotide; TGAGAAA chr11 5197736 5197759 5197756 +
ttagaaggaagcttctttggccat

SEQ ID NO: 66528 - DNA, 24 bp, Artificial Sequence
  Synthetic oligonucleotide; CCAGAAA chr11 5198430 5198453 5198450 +
ttctaaccagatactttactctgt

SEQ ID NO: 66529 - DNA, 24 bp, Artificial Sequence
  Synthetic oligonucleotide; TTAGAAA chr11 5198465 5198488 5198485 +
ttcctcactttgaggcttaagcta

SEQ ID NO: 66530 - DNA, 24 bp, Artificial Sequence
  Synthetic oligonucleotide; ATAGAAT chr11 5198695 5198718 5198715 +
aacacttaccttcttagataccta

SEQ ID NO: 66531 - DNA, 24 bp, Artificial Sequence
  Synthetic oligonucleotide; TTAGAAA chr11 5198801 5198824 5198821 +
ctttggaaagctgcactagcttac

SEQ ID NO: 66532 - DNA, 24 bp, Artificial Sequence
  Synthetic oligonucleotide; TCAGAAT chr11 5198847 5198870 5198867 +
tcttttatcttttttcttttaaac

SEQ ID NO: 66533 - DNA, 24 bp, Artificial Sequence
  Synthetic oligonucleotide; TTAGAAA chr11 5199254 5199277 5199274 +
attttatagaacatcgccatcagt

SEQ ID NO: 66534 - DNA, 24 bp, Artificial Sequence
  Synthetic oligonucleotide; AGAGAAT chr11 5199354 5199377 5199374 +
ttgaaggttaattaagtaaacctc

SEQ ID NO: 66535 - DNA, 24 bp, Artificial Sequence
  Synthetic oligonucleotide; AAAGAAA chr11 5199362 5199385 5199382 +
taattaagtaaacctcagagaatg

SEQ ID NO: 66536 - DNA, 24 bp, Artificial Sequence
  Synthetic oligonucleotide; AGAGAAA chr11 5199724 5199747 5199744 +
ctcaatatctctcaatatcttttc

SEQ ID NO: 66537 - DNA, 24 bp, Artificial Sequence
  Synthetic oligonucleotide; TAAGAAT chr11 5199983 5200006 5200003 +
gagaggcaactgccaggactgact

SEQ ID NO: 66538 - DNA, 24 bp, Artificial Sequence
  Synthetic oligonucleotide; GGAGAAA chr11 5199999 5200022 5200019 +
gactgacttaagaatcaggatgta

SEQ ID NO: 66539 - DNA, 24 bp, Artificial Sequence
  Synthetic oligonucleotide; GCAGAAA chr11 5200113 5200136 5200133 +
taagcggagaagatcctggtgcag

SEQ ID NO: 66540 - DNA, 24 bp, Artificial Sequence
  Synthetic oligonucleotide; TGAGAAA chr11 5200123 5200146 5200143 +
agatcctggtgcaggcagaaagag

SEQ ID NO: 66541 - DNA, 24 bp, Artificial Sequence
  Synthetic oligonucleotide; AAAGAAA chr11 5200185 5200208 5200205 +
cagacagatgatggggggtgtaat

SEQ ID NO: 66542 - DNA, 24 bp, Artificial Sequence
  Synthetic oligonucleotide; CCAGAAA chr11 5200594 5200617 5200614 +
agccaggggtattgctgctccatg

SEQ ID NO: 66543 - DNA, 24 bp, Artificial Sequence
  Synthetic oligonucleotide; GAAGAAA chr11 5200610 5200633 5200630 +
gctccatgccagaaaatccagtga

SEQ ID NO: 66544 - DNA, 24 bp, Artificial Sequence
  Synthetic oligonucleotide; GAAGAAT chr11 5200618 5200641 5200638 +
ccagaaaatccagtgagaagaaag

SEQ ID NO: 66545 - DNA, 24 bp, Artificial Sequence
  Synthetic oligonucleotide; TGAGAAA chr11 5200667 5200690 5200687 +
ttactgaagtaatcattctggaac

SEQ ID NO: 66546 - DNA, 24 bp, Artificial Sequence
  Synthetic oligonucleotide; TGAGAAA chr11 5200780 5200803 5200800 +
acttactgacttaaaaaaaacagc

SEQ ID NO: 66547 - DNA, 24 bp, Artificial Sequence
  Synthetic oligonucleotide; TGAGAAA chr11 5200821 5200844 5200841 +
ttgagacatagtatccattgcctt

SEQ ID NO: 66548 - DNA, 24 bp, Artificial Sequence
  Synthetic oligonucleotide; AGAGAAT chr11 5201349 5201372 5201369 +
aactcatttgtgcctttgtgatgt

SEQ ID NO: 66549 - DNA, 24 bp, Artificial Sequence
  Synthetic oligonucleotide; GCAGAAT chr11 5201562 5201585 5201582 +
tataatttcaaaagcctcatggta

SEQ ID NO: 66550 - DNA, 24 bp, Artificial Sequence
  Synthetic oligonucleotide; TGAGAAT chr11 5201616 5201639 5201636 +
tttgcctgctttaagttccagacc

SEQ ID NO: 66551 - DNA, 24 bp, Artificial Sequence
  Synthetic oligonucleotide; ATAGAAT chr11 5201918 5201941 5201938 +
actatttttaatacttttttctcc

SEQ ID NO: 66552 - DNA, 24 bp, Artificial Sequence
  Synthetic oligonucleotide; TAAGAAT chr11 5202426 5202449 5202446 +
tcatctgagtgtttaatcttaaaa

SEQ ID NO: 66553 - DNA, 24 bp, Artificial Sequence
  Synthetic oligonucleotide; CCAGAAA chr11 5202625 5202648 5202645 +
tttcatcaatttctaccatttcta

SEQ ID NO: 66554 - DNA, 24 bp, Artificial Sequence
  Synthetic oligonucleotide; CAAGAAT chr11 5203323 5203346 5203343 +
taggaaccatatctgttttttgct

SEQ ID NO: 66555 - DNA, 24 bp, Artificial Sequence
  Synthetic oligonucleotide; ATAGAAT chr11 5203349 5203372 5203369 +
agaatatgaaaaataagggttagc

SEQ ID NO: 66556 - DNA, 24 bp, Artificial Sequence
  Synthetic oligonucleotide; GGAGAAT chr11 5203906 5203929 5203926 +
ccagttacttgggagactgaggca

SEQ ID NO: 66557 - DNA, 24 bp, Artificial Sequence
  Synthetic oligonucleotide; GAAGAAA chr11 5204115 5204138 5204135 +
tcaggcttcttcagactagataca

SEQ ID NO: 66558 - DNA, 24 bp, Artificial Sequence
  Synthetic oligonucleotide; AAAGAAA chr11 5204287 5204310 5204307 +
gataaggtaaataaatgaagattt

SEQ ID NO: 66559 - DNA, 24 bp, Artificial Sequence
  Synthetic oligonucleotide; GGAGAAA chr11 5204492 5204515 5204512 +
acaaatagcagtgaatttgagtct

SEQ ID NO: 66560 - DNA, 24 bp, Artificial Sequence
  Synthetic oligonucleotide; GCAGAAA chr11 5204632 5204655 5204652 +
tctgattaaaactgacctacatat

SEQ ID NO: 66561 - DNA, 24 bp, Artificial Sequence
  Synthetic oligonucleotide; TCAGAAT chr11 5204669 5204692 5204689 +
ggttttttttttttttctgtcttt

SEQ ID NO: 66562 - DNA, 24 bp, Artificial Sequence
  Synthetic oligonucleotide; AGAGAAA chr11 5204745 5204768 5204765 +
caatagtcattgttccaaagacat

SEQ ID NO: 66563 - DNA, 24 bp, Artificial Sequence
  Synthetic oligonucleotide; AGAGAAT chr11 5205131 5205154 5205151 +
atgattctgaatatgctagttcag

SEQ ID NO: 66564 - DNA, 24 bp, Artificial Sequence
  Synthetic oligonucleotide; TCAGAAA chr11 5205720 5205743 5205740 +
tggctttaatatgttcccttttct

SEQ ID NO: 66565 - DNA, 24 bp, Artificial Sequence
  Synthetic oligonucleotide; TAAGAAA chr11 5205757 5205780 5205777 +
gacagcttaaaataaaattaacta

SEQ ID NO: 66566 - DNA, 24 bp, Artificial Sequence
  Synthetic oligonucleotide; GAAGAAA chr11 5205784 5205807 5205804 +
gaaactggtaaacactgaatgaaa

SEQ ID NO: 66567 - DNA, 24 bp, Artificial Sequence
  Synthetic oligonucleotide; GCAGAAA chr11 5205796 5205819 5205816 +
cactgaatgaaagaagaaaaccaa

SEQ ID NO: 66568 - DNA, 24 bp, Artificial Sequence
  Synthetic oligonucleotide; CTAGAAT chr11 5206337 5206360 5206357 +
attttaagttgtcctctgaaaatt

SEQ ID NO: 66569 - DNA, 24 bp, Artificial Sequence
  Synthetic oligonucleotide; TAAGAAA chr11 5206394 5206417 5206414 +
ataaaggaaattgtaaaggctttc

SEQ ID NO: 66570 - DNA, 24 bp, Artificial Sequence
  Synthetic oligonucleotide; TAAGAAT chr11 5206533 5206556 5206553 +
ctttctcatcaccacacagtggaa

SEQ ID NO: 66571 - DNA, 24 bp, Artificial Sequence
  Synthetic oligonucleotide; TCAGAAA chr11 5206589 5206612 5206609 +
tgccatatcaaattagtaaagcct

SEQ ID NO: 66572 - DNA, 24 bp, Artificial Sequence
  Synthetic oligonucleotide; CAAGAAA chr11 5206750 5206773 5206770 +
aatttccagttctatctttctgtt

SEQ ID NO: 66573 - DNA, 24 bp, Artificial Sequence
  Synthetic oligonucleotide; AAAGAAT chr11 5206755 5206778 5206775 +
ccagttctatctttctgttcaaga

SEQ ID NO: 66574 - DNA, 24 bp, Artificial Sequence
  Synthetic oligonucleotide; ATAGAAA chr11 5207246 5207269 5207266 +
ttaggaggggagtttttttttttt

SEQ ID NO: 66575 - DNA, 24 bp, Artificial Sequence
  Synthetic oligonucleotide; CTAGAAT chr11 5207563 5207586 5207583 +
ctaaaattgtaatttcttggattc

SEQ ID NO: 66576 - DNA, 24 bp, Artificial Sequence
  Synthetic oligonucleotide; TTAGAAT chr11 5207588 5207611 5207608 +
tagaatttctaaatctgtggattt

SEQ ID NO: 66577 - DNA, 24 bp, Artificial Sequence
  Synthetic oligonucleotide; CTAGAAT chr11 5207749 5207772 5207769 +
aactaatcagaaggaaccattgtc

SEQ ID NO: 66578 - DNA, 24 bp, Artificial Sequence
  Synthetic oligonucleotide; CCAGAAA chr11 5207774 5207797 5207794 +
tagaatggggcaagtgtacaatac

SEQ ID NO: 66579 - DNA, 24 bp, Artificial Sequence
  Synthetic oligonucleotide; GGAGAAA chr11 5207929 5207952 5207949 +
aggttctgtggtaaacgtcagcgt

SEQ ID NO: 66580 - DNA, 24 bp, Artificial Sequence
  Synthetic oligonucleotide; GAAGAAA chr11 5208010 5208033 5208030 +
gagaagctgactgtggctataggt

SEQ ID NO: 66581 - DNA, 24 bp, Artificial Sequence
  Synthetic oligonucleotide; TAAGAAA chr11 5208139 5208162 5208159 +
gaatttatgttaatttactcacta

SEQ ID NO: 66582 - DNA, 24 bp, Artificial Sequence
  Synthetic oligonucleotide; CAAGAAA chr11 5208383 5208406 5208403 +
tttgaaatttgagtagagtaggac

SEQ ID NO: 66583 - DNA, 24 bp, Artificial Sequence
  Synthetic oligonucleotide; AAAGAAT chr11 5208463 5208486 5208483 +
acgcagtaattagctccttagctg

SEQ ID NO: 66584 - DNA, 24 bp, Artificial Sequence
  Synthetic oligonucleotide; TGAGAAA chr11 5208654 5208677 5208674 +
tatttatgataataattctagttg

SEQ ID NO: 66585 - DNA, 24 bp, Artificial Sequence
  Synthetic oligonucleotide; AAAGAAT chr11 5209005 5209028 5209025 +
aagacactgctgactttggaattg

SEQ ID NO: 66586 - DNA, 24 bp, Artificial Sequence
  Synthetic oligonucleotide; TAAGAAT chr11 5209304 5209327 5209324 +
aaagcctaattgactaaagccatt

SEQ ID NO: 66587 - DNA, 24 bp, Artificial Sequence
  Synthetic oligonucleotide; AAAGAAA chr11 5209346 5209369 5209366 +
gttagtatgcacttcttgaaatgc

SEQ ID NO: 66588 - DNA, 24 bp, Artificial Sequence
  Synthetic oligonucleotide; GAAGAAA chr11 5210111 5210134 5210131 +
ttattattattctcatttgtagtt

SEQ ID NO: 66589 - DNA, 24 bp, Artificial Sequence
  Synthetic oligonucleotide; CCAGAAA chr11 5210156 5210179 5210176 +
gtttaaattgctcctggctacatc

SEQ ID NO: 66590 - DNA, 24 bp, Artificial Sequence
  Synthetic oligonucleotide; ACAGAAT chr11 5210263 5210286 5210283 +
ggaagcaagctggcctcaactgga

SEQ ID NO: 66591 - DNA, 24 bp, Artificial Sequence
  Synthetic oligonucleotide; AGAGAAA chr11 5210271 5210294 5210291 +
gctggcctcaactggaacagaatg

SEQ ID NO: 66592 - DNA, 24 bp, Artificial Sequence
  Synthetic oligonucleotide; CCAGAAT chr11 5210418 5210441 5210438 +
aaatataaagcctaatcctgccat

SEQ ID NO: 66593 - DNA, 24 bp, Artificial Sequence
  Synthetic oligonucleotide; GCAGAAT chr11 5210461 5210484 5210481 +
ggggaaaagggaagggaaaaagga

SEQ ID NO: 66594 - DNA, 24 bp, Artificial Sequence
  Synthetic oligonucleotide; TTAGAAA chr11 5210714 5210737 5210734 +
ataggacttgagttcctcgaagga

SEQ ID NO: 66595 - DNA, 24 bp, Artificial Sequence
  Synthetic oligonucleotide; GGAGAAA chr11 5210839 5210862 5210859 +
gttggagaccagcttgggcaacat

SEQ ID NO: 66596 - DNA, 24 bp, Artificial Sequence
  Synthetic oligonucleotide; CTAGAAA chr11 5211038 5211061 5211058 +
ctgtcaaaaaaaaaaaaaagagag

SEQ ID NO: 66597 - DNA, 24 bp, Artificial Sequence
  Synthetic oligonucleotide; AAAGAAA chr11 5211042 5211065 5211062 +
caaaaaaaaaaaaaagagagctag

SEQ ID NO: 66598 - DNA, 24 bp, Artificial Sequence
  Synthetic oligonucleotide; AAAGAAA chr11 5211046 5211069 5211066 +
aaaaaaaaaaagagagctagaaag

SEQ ID NO: 66599 - DNA, 24 bp, Artificial Sequence
  Synthetic oligonucleotide; AGAGAAT chr11 5211249 5211272 5211269 +
taaaatcaaattacaaagaaggac

SEQ ID NO: 66600 - DNA, 24 bp, Artificial Sequence
  Synthetic oligonucleotide; GAAGAAT chr11 5211365 5211388 5211385 +
ctaataggtggaaagaggagcaag

SEQ ID NO: 66601 - DNA, 24 bp, Artificial Sequence
  Synthetic oligonucleotide; ATAGAAT chr11 5211832 5211855 5211852 +
cacaggtgtgcatgtgtctttgtg

SEQ ID NO: 66602 - DNA, 24 bp, Artificial Sequence
  Synthetic oligonucleotide; GCAGAAA chr11 5212330 5212353 5212350 +
tcagttgatagtttcttttgctgt

SEQ ID NO: 66603 - DNA, 24 bp, Artificial Sequence
  Synthetic oligonucleotide; GAAGAAT chr11 5213103 5213126 5213123 +
taaagtgtatttttctagttctgt

SEQ ID NO: 66604 - DNA, 24 bp, Artificial Sequence
  Synthetic oligonucleotide; ACAGAAA chr11 5213491 5213514 5213511 +
ccttgactatggtgttttctagat

SEQ ID NO: 66605 - DNA, 24 bp, Artificial Sequence
  Synthetic oligonucleotide; GAAGAAT chr11 5213640 5213663 5213660 +
tccttgtcttgtgccagttttcaa

SEQ ID NO: 66606 - DNA, 24 bp, Artificial Sequence
  Synthetic oligonucleotide; ATAGAAT chr11 5214141 5214164 5214161 +
ttccaactcttctttgtgcatctg

SEQ ID NO: 66607 - DNA, 24 bp, Artificial Sequence
  Synthetic oligonucleotide; AGAGAAA chr11 5214529 5214552 5214549 +
ggacacagcttagacagtgttaag

SEQ ID NO: 66608 - DNA, 24 bp, Artificial Sequence
  Synthetic oligonucleotide; CAAGAAA chr11 5214652 5214675 5214672 +
accaaccctaaatctagcagaaga

SEQ ID NO: 66609 - DNA, 24 bp, Artificial Sequence
  Synthetic oligonucleotide; TTAGAAA chr11 5214813 5214836 5214833 +
gagagaagatccaaataagcacag

SEQ ID NO: 66610 - DNA, 24 bp, Artificial Sequence
  Synthetic oligonucleotide; ACAGAAA chr11 5214848 5214871 5214868 +
aaagggaatattatcactcacccc

SEQ ID NO: 66611 - DNA, 24 bp, Artificial Sequence
  Synthetic oligonucleotide; CTAGAAA chr11 5214902 5214925 5214922 +
tatgaacatctctatgtacataaa

SEQ ID NO: 66612 - DNA, 24 bp, Artificial Sequence
  Synthetic oligonucleotide; AAAGAAA chr11 5214914 5214937 5214934 +
tatgtacataaactagaaaatcta

SEQ ID NO: 66613 - DNA, 24 bp, Artificial Sequence
  Synthetic oligonucleotide; CCAGAAT chr11 5215042 5215065 5215062 +
tctctcaactctatgtccccctcc

SEQ ID NO: 66614 - DNA, 24 bp, Artificial Sequence
  Synthetic oligonucleotide; AGAGAAT chr11 5215121 5215144 5215141 +
tgttatatctgaatatatggctct

SEQ ID NO: 66615 - DNA, 24 bp, Artificial Sequence
  Synthetic oligonucleotide; CAAGAAA chr11 5215130 5215153 5215150 +
tgaatatatggctctagagaatcc

SEQ ID NO: 66616 - DNA, 24 bp, Artificial Sequence
  Synthetic oligonucleotide; ATAGAAA chr11 5215136 5215159 5215156 +
tatggctctagagaatcccaagaa

SEQ ID NO: 66617 - DNA, 24 bp, Artificial Sequence
  Synthetic oligonucleotide; CAAGAAT chr11 5215231 5215254 5215251 +
aaagttgagaagatgtgaagaacc

SEQ ID NO: 66618 - DNA, 24 bp, Artificial Sequence
  Synthetic oligonucleotide; GGAGAAA chr11 5215243 5215266 5215263 +
atgtgaagaacccaagaatccact

SEQ ID NO: 66619 - DNA, 24 bp, Artificial Sequence
  Synthetic oligonucleotide; GGAGAAT chr11 5215287 5215310 5215307 +
ctgcaaggggttcagacctgtgtt

SEQ ID NO: 66620 - DNA, 24 bp, Artificial Sequence
  Synthetic oligonucleotide; CCAGAAA chr11 5215658 5215681 5215678 +
agactttcccctagcttgttgatt

SEQ ID NO: 66621 - DNA, 24 bp, Artificial Sequence
  Synthetic oligonucleotide; TCAGAAA chr11 5215808 5215831 5215828 +
ataaacaaataagaaggaagactc

SEQ ID NO: 66622 - DNA, 24 bp, Artificial Sequence
  Synthetic oligonucleotide; TGAGAAA chr11 5215896 5215919 5215916 +
ctagttgaaggaatgttaactgac

SEQ ID NO: 66623 - DNA, 24 bp, Artificial Sequence
  Synthetic oligonucleotide; AGAGAAA chr11 5215927 5215950 5215947 +
acactaaatttctgtctatttcaa

SEQ ID NO: 66624 - DNA, 24 bp, Artificial Sequence
  Synthetic oligonucleotide; TGAGAAT chr11 5216262 5216285 5216282 +
tttattctccttgtgatagtttgc

SEQ ID NO: 66625 - DNA, 24 bp, Artificial Sequence
  Synthetic oligonucleotide; GAAGAAA chr11 5217517 5217540 5217537 +
taaagtagttttttccagttctgt

SEQ ID NO: 66626 - DNA, 24 bp, Artificial Sequence
  Synthetic oligonucleotide; GTAGAAT chr11 5218560 5218583 5218580 +
taccagctcctccttgtacctctg

SEQ ID NO: 66627 - DNA, 24 bp, Artificial Sequence
  Synthetic oligonucleotide; AAAGAAT chr11 5219420 5219443 5219440 +
ggaataggtgtggtgtggtgctga

SEQ ID NO: 66628 - DNA, 24 bp, Artificial Sequence
  Synthetic oligonucleotide; GCAGAAA chr11 5222020 5222043 5222040 +
gaacctggtacctcagttggaaat

SEQ ID NO: 66629 - DNA, 24 bp, Artificial Sequence
  Synthetic oligonucleotide; CTAGAAT chr11 5222416 5222439 5222436 +
caggtgtgagccaccgctcccagc
